United States Patent 7,655,785 (BIOINFORMATICALLY DETECTABLE GROUP OF NOVEL REGULATORY OLIGONUCLEOTIDES AND USES THEREOF) - sequence listing, part 38

SEQ ID NO: 1564211 - RNA, 15 nt, Homo sapiens
auucuagauuaccau

SEQ ID NO: 1564212 - RNA, 16 nt, Homo sapiens
auucuaugucaaugau

SEQ ID NO: 1564213 - RNA, 15 nt, Homo sapiens
auucucaucacucaa

SEQ ID NO: 1564214 - RNA, 13 nt, Homo sapiens
auucucauucuca

SEQ ID NO: 1564215 - RNA, 17 nt, Homo sapiens
auucucccuuucacuaa

SEQ ID NO: 1564216 - RNA, 22 nt, Homo sapiens
auucuccuccuauugccuccau

SEQ ID NO: 1564217 - RNA, 15 nt, Homo sapiens
auucuccugccucag

SEQ ID NO: 1564218 - RNA, 20 nt, Homo sapiens
auucuccugccucagccucc

SEQ ID NO: 1564219 - RNA, 20 nt, Homo sapiens
auucucuaaccgaauauuca

SEQ ID NO: 1564220 - RNA, 21 nt, Homo sapiens
auucucuagucaguuggcuaa

SEQ ID NO: 1564221 - RNA, 19 nt, Homo sapiens
auucucucaucuaacugau

SEQ ID NO: 1564222 - RNA, 13 nt, Homo sapiens
auucucugaguca

SEQ ID NO: 1564223 - RNA, 18 nt, Homo sapiens
auucugaaauacuuuuga

SEQ ID NO: 1564224 - RNA, 16 nt, Homo sapiens
auucugaauuugcaaa

SEQ ID NO: 1564225 - RNA, 16 nt, Homo sapiens
auucugauauguaucc

SEQ ID NO: 1564226 - RNA, 19 nt, Homo sapiens
auucugauauguauccauc

SEQ ID NO: 1564227 - RNA, 16 nt, Homo sapiens
auucugcaccacaccu

SEQ ID NO: 1564228 - RNA, 12 nt, Homo sapiens
auucugccaaag

SEQ ID NO: 1564229 - RNA, 17 nt, Homo sapiens
auucuguugcuuuacag

SEQ ID NO: 1564230 - RNA, 15 nt, Homo sapiens
auucuguuuccuuaa

SEQ ID NO: 1564231 - RNA, 21 nt, Homo sapiens
auucuuaacuuauuaccucag

SEQ ID NO: 1564232 - RNA, 19 nt, Homo sapiens
auucuuaugauuacuauca

SEQ ID NO: 1564233 - RNA, 22 nt, Homo sapiens
auucuuauuaguuccccaaaua

SEQ ID NO: 1564234 - RNA, 13 nt, Homo sapiens
auucuuccugcuu

SEQ ID NO: 1564235 - RNA, 13 nt, Homo sapiens
auucuugacuuau

SEQ ID NO: 1564236 - RNA, 14 nt, Homo sapiens
auucuugacuuaua

SEQ ID NO: 1564237 - RNA, 20 nt, Homo sapiens
auucuuggcuaaaggaucag

SEQ ID NO: 1564238 - RNA, 23 nt, Homo sapiens
auucuuggcuaaaggaucagcug

SEQ ID NO: 1564239 - RNA, 16 nt, Homo sapiens
caugaucaagauauau

SEQ ID NO: 1564240 - RNA, 15 nt, Homo sapiens
caugaucauagcuca

SEQ ID NO: 1564241 - RNA, 17 nt, Homo sapiens
caugaucaucacaauca

SEQ ID NO: 1564242 - RNA, 18 nt, Homo sapiens
caugauccuugcugauaa

SEQ ID NO: 1564243 - RNA, 19 nt, Homo sapiens
caugaugcuagccagcaaa

SEQ ID NO: 1564244 - RNA, 18 nt, Homo sapiens
caugauguauuguugcuu

SEQ ID NO: 1564245 - RNA, 19 nt, Homo sapiens
caugauuucccacugcacu

SEQ ID NO: 1564246 - RNA, 20 nt, Homo sapiens
caugauuucccuuguagaaa

SEQ ID NO: 1564247 - RNA, 16 nt, Homo sapiens
caugauuuccuugaau

SEQ ID NO: 1564248 - RNA, 12 nt, Homo sapiens
caugcacaguca

SEQ ID NO: 1564249 - RNA, 16 nt, Homo sapiens
caugcauaaaugcgau

SEQ ID NO: 1564250 - RNA, 18 nt, Homo sapiens
caugcaugacacuuccaa

SEQ ID NO: 1564251 - RNA, 21 nt, Homo sapiens
caugcaugucugccuaugcac

SEQ ID NO: 1564252 - RNA, 21 nt, Homo sapiens
caugccaacacuuaaucauuu

SEQ ID NO: 1564253 - RNA, 15 nt, Homo sapiens
caugccagugccuua

SEQ ID NO: 1564254 - RNA, 13 nt, Homo sapiens
caugccucuguag

SEQ ID NO: 1564255 - RNA, 20 nt, Homo sapiens
caugccugaggucuaccccu

SEQ ID NO: 1564256 - RNA, 15 nt, Homo sapiens
caugccuggagacau

SEQ ID NO: 1564257 - RNA, 16 nt, Homo sapiens
caugcguccuggucaa

SEQ ID NO: 1564258 - RNA, 21 nt, Homo sapiens
caugcucaggagccaccagca

SEQ ID NO: 1564259 - RNA, 13 nt, Homo sapiens
caugcuccucacc

SEQ ID NO: 1564260 - RNA, 15 nt, Homo sapiens
caugcucuugaccuu

SEQ ID NO: 1564261 - RNA, 15 nt, Homo sapiens
caugcuuauaacauu

SEQ ID NO: 1564262 - RNA, 17 nt, Homo sapiens
caugcuugacauaccua

SEQ ID NO: 1564263 - RNA, 23 nt, Homo sapiens
caugcuugcauaagagcuuaaga

SEQ ID NO: 1564264 - RNA, 22 nt, Homo sapiens
caugcuugcauuauauuuguaa

SEQ ID NO: 1564265 - RNA, 21 nt, Homo sapiens
cauggaacagcauuacccucc

SEQ ID NO: 1564266 - RNA, 16 nt, Homo sapiens
cauggaaucgaagugu

SEQ ID NO: 1564267 - RNA, 20 nt, Homo sapiens
cauggagacguggugggacu

SEQ ID NO: 1564268 - RNA, 15 nt, Homo sapiens
cauggagcugucauc

SEQ ID NO: 1564269 - RNA, 21 nt, Homo sapiens
cauggaggaacaguauuacag

SEQ ID NO: 1564270 - RNA, 19 nt, Homo sapiens
cauggaggccaagaacuug

SEQ ID NO: 1564271 - RNA, 19 nt, Homo sapiens
cauggauauguuauacuga

SEQ ID NO: 1564272 - RNA, 23 nt, Homo sapiens
cauggauauguuauacugaacca

SEQ ID NO: 1564273 - RNA, 21 nt, Homo sapiens
cauggauuacuucucuauaaa

SEQ ID NO: 1564274 - RNA, 14 nt, Homo sapiens
cauggcacauguau

SEQ ID NO: 1564275 - RNA, 19 nt, Homo sapiens
cauggcacucuauguucua

SEQ ID NO: 1564276 - RNA, 21 nt, Homo sapiens
cauggcccccaauaaaggcag

SEQ ID NO: 1564277 - RNA, 15 nt, Homo sapiens
caugggaaugcauuu

SEQ ID NO: 1564278 - RNA, 23 nt, Homo sapiens
caugggagggggcuugaagccaa

SEQ ID NO: 1564279 - RNA, 21 nt, Homo sapiens
cauggggaaaaaaaucaucua

SEQ ID NO: 1564280 - RNA, 19 nt, Homo sapiens
cauggguggcacucagucu

SEQ ID NO: 1564281 - RNA, 18 nt, Homo sapiens
cauggucccaaaauguca

SEQ ID NO: 1564282 - RNA, 17 nt, Homo sapiens
cauggucccaggcuucc

SEQ ID NO: 1564283 - RNA, 14 nt, Homo sapiens
cauguaaauugcaa

SEQ ID NO: 1564284 - RNA, 13 nt, Homo sapiens
cauguaaccacug

SEQ ID NO: 1564285 - RNA, 18 nt, Homo sapiens
cauguacccuaaaacuua

SEQ ID NO: 1564286 - RNA, 23 nt, Homo sapiens
cauguacugggaaggcaauuuca

SEQ ID NO: 1564287 - RNA, 13 nt, Homo sapiens
cauguagcauaua

SEQ ID NO: 1564288 - RNA, 14 nt, Homo sapiens
cauguagcauauaa

SEQ ID NO: 1564289 - RNA, 13 nt, Homo sapiens
cauguauacauau

SEQ ID NO: 1564290 - RNA, 15 nt, Homo sapiens
cauguaucucaguac

SEQ ID NO: 1564291 - RNA, 16 nt, Homo sapiens
cauguaugcaugcaca

SEQ ID NO: 1564292 - RNA, 16 nt, Homo sapiens
cauguauuuguuauau

SEQ ID NO: 1564293 - RNA, 12 nt, Homo sapiens
caugucaggcca

SEQ ID NO: 1564294 - RNA, 22 nt, Homo sapiens
cauguccauacacuuuguugca

SEQ ID NO: 1564295 - RNA, 16 nt, Homo sapiens
caugucuauucagcuu

SEQ ID NO: 1564296 - RNA, 19 nt, Homo sapiens
caugucugccuaugcacug

SEQ ID NO: 1564297 - RNA, 21 nt, Homo sapiens
caugucugccuaugcacugaa

SEQ ID NO: 1564298 - RNA, 15 nt, Homo sapiens
caugugauugugauu

SEQ ID NO: 1564299 - RNA, 22 nt, Homo sapiens
cauguguaaagacugagcagaa

SEQ ID NO: 1564300 - RNA, 23 nt, Homo sapiens
cauguguaggagucugggcacaa

SEQ ID NO: 1564301 - RNA, 15 nt, Homo sapiens
caugugugcuaauau

SEQ ID NO: 1564302 - RNA, 14 nt, Homo sapiens
cauguguguacaug

SEQ ID NO: 1564303 - RNA, 17 nt, Homo sapiens
cauguuggccucuucag

SEQ ID NO: 1564304 - RNA, 15 nt, Homo sapiens
cauguuucacagugg

SEQ ID NO: 1564305 - RNA, 14 nt, Homo sapiens
cauguuugacgugg

SEQ ID NO: 1564306 - RNA, 14 nt, Homo sapiens
cauuaaagagccag

SEQ ID NO: 1564307 - RNA, 18 nt, Homo sapiens
cauuaacccaucucugaa

SEQ ID NO: 1564308 - RNA, 16 nt, Homo sapiens
cauuaauaauuugcuc

SEQ ID NO: 1564309 - RNA, 14 nt, Homo sapiens
cauuaaucaguuca

SEQ ID NO: 1564310 - RNA, 17 nt, Homo sapiens
cauuacaaaaaaacacg

SEQ ID NO: 1564311 - RNA, 12 nt, Homo sapiens
cauuaccacuca

SEQ ID NO: 1564312 - RNA, 23 nt, Homo sapiens
cauuaccuguucuugccuaauaa

SEQ ID NO: 1564313 - RNA, 23 nt, Homo sapiens
cauuacgcucggaacacauucuc

SEQ ID NO: 1564314 - RNA, 22 nt, Homo sapiens
cauuacugccaucuuuaucaug

SEQ ID NO: 1564315 - RNA, 17 nt, Homo sapiens
cauuacuuuuucauaua

SEQ ID NO: 1564316 - RNA, 18 nt, Homo sapiens
cauuaucgagcagcauuu

SEQ ID NO: 1564317 - RNA, 22 nt, Homo sapiens
cauuaucucaaaacugcacugu

SEQ ID NO: 1564318 - RNA, 15 nt, Homo sapiens
cauuaucucacuuag

SEQ ID NO: 1564319 - RNA, 23 nt, Homo sapiens
cauuaucuuugcuguuauugaca

SEQ ID NO: 1564320 - RNA, 18 nt, Homo sapiens
cauucaaucauuaauuca

SEQ ID NO: 1564321 - RNA, 22 nt, Homo sapiens
cauucacagcaagucacuggcc

SEQ ID NO: 1564322 - RNA, 18 nt, Homo sapiens
cauucaccuuagugcaac

SEQ ID NO: 1564323 - RNA, 17 nt, Homo sapiens
cauucacuacaggugaa

SEQ ID NO: 1564324 - RNA, 18 nt, Homo sapiens
cauucaggcagcacugac

SEQ ID NO: 1564325 - RNA, 16 nt, Homo sapiens
cauucaggugaccucc

SEQ ID NO: 1564326 - RNA, 20 nt, Homo sapiens
cauucaggugaccuccugca

SEQ ID NO: 1564327 - RNA, 9 nt, Homo sapiens
cauucaguc

SEQ ID NO: 1564328 - RNA, 22 nt, Homo sapiens
cauucaguggcccacauuuucc

SEQ ID NO: 1564329 - RNA, 14 nt, Homo sapiens
cauucaguguaaau

SEQ ID NO: 1564330 - RNA, 19 nt, Homo sapiens
cauuccauugccuagcucu

SEQ ID NO: 1564331 - RNA, 11 nt, Homo sapiens
cauucccugag

SEQ ID NO: 1564332 - RNA, 21 nt, Homo sapiens
cauucccugagucaccaggaa

SEQ ID NO: 1564333 - RNA, 22 nt, Homo sapiens
cauuccucagcuucuucacagg

SEQ ID NO: 1564334 - RNA, 20 nt, Homo sapiens
cauuccuuuucguuuagaau

SEQ ID NO: 1564335 - RNA, 17 nt, Homo sapiens
cauucgggccauuuccg

SEQ ID NO: 1564336 - RNA, 21 nt, Homo sapiens
cauucuauuccauguuugcac

SEQ ID NO: 1564337 - RNA, 15 nt, Homo sapiens
cauucuauuuuagaa

SEQ ID NO: 1564338 - RNA, 12 nt, Homo sapiens
cauucuccugcc

SEQ ID NO: 1564339 - RNA, 19 nt, Homo sapiens
cauucucgugagucauuua

SEQ ID NO: 1564340 - RNA, 13 nt, Homo sapiens
cauucucugaguc

SEQ ID NO: 1564341 - RNA, 23 nt, Homo sapiens
cauucugcacucagaaaauggca

SEQ ID NO: 1564342 - RNA, 13 nt, Homo sapiens
cauucugccaaag

SEQ ID NO: 1564343 - RNA, 17 nt, Homo sapiens
cauucuguuagauacua

SEQ ID NO: 1564344 - RNA, 15 nt, Homo sapiens
cauucuugcuugugu

SEQ ID NO: 1564345 - RNA, 19 nt, Homo sapiens
cauucuugcuugugugucu

SEQ ID NO: 1564346 - RNA, 20 nt, Homo sapiens
cauucuuucccaacaccucu

SEQ ID NO: 1564347 - RNA, 16 nt, Homo sapiens
cauucuuuugccacau

SEQ ID NO: 1564348 - RNA, 19 nt, Homo sapiens
cauucuuuuucuguugaaa

SEQ ID NO: 1564349 - RNA, 18 nt, Homo sapiens
cauugaaauuuacuguga

SEQ ID NO: 1564350 - RNA, 23 nt, Homo sapiens
cauugaccgcgacuaauuucaaa

SEQ ID NO: 1564351 - RNA, 14 nt, Homo sapiens
cauugagaucuucc

SEQ ID NO: 1564352 - RNA, 17 nt, Homo sapiens
cauugauccagucauuu

SEQ ID NO: 1564353 - RNA, 20 nt, Homo sapiens
cauugccaauuagacaaaca

SEQ ID NO: 1564354 - RNA, 16 nt, Homo sapiens
cauugccagugucuuu

SEQ ID NO: 1564355 - RNA, 16 nt, Homo sapiens
cauugccgcuguauaa

SEQ ID NO: 1564356 - RNA, 18 nt, Homo sapiens
cauugccuucuggagcug

SEQ ID NO: 1564357 - RNA, 16 nt, Homo sapiens
ccccaggccuguccac

SEQ ID NO: 1564358 - RNA, 20 nt, Homo sapiens
ccccagggcccacuagcauc

SEQ ID NO: 1564359 - RNA, 15 nt, Homo sapiens
ccccaggucugggaa

SEQ ID NO: 1564360 - RNA, 23 nt, Homo sapiens
ccccaucugcgggggcagugcuc

SEQ ID NO: 1564361 - RNA, 22 nt, Homo sapiens
ccccauucucugccuguacuga

SEQ ID NO: 1564362 - RNA, 23 nt, Homo sapiens
cccccagccuggacaccucucau

SEQ ID NO: 1564363 - RNA, 21 nt, Homo sapiens
cccccaguuccucccaggaag

SEQ ID NO: 1564364 - RNA, 19 nt, Homo sapiens
cccccaucuuuacaaagaa

SEQ ID NO: 1564365 - RNA, 21 nt, Homo sapiens
cccccauuguggucacaggaa

SEQ ID NO: 1564366 - RNA, 11 nt, Homo sapiens
cccccuagugg

SEQ ID NO: 1564367 - RNA, 23 nt, Homo sapiens
cccccuccucugaaacagcugcc

SEQ ID NO: 1564368 - RNA, 15 nt, Homo sapiens
cccccugccagugcc

SEQ ID NO: 1564369 - RNA, 13 nt, Homo sapiens
ccccgcaaagaca

SEQ ID NO: 1564370 - RNA, 22 nt, Homo sapiens
ccccgcgcucgcccagcaggag

SEQ ID NO: 1564371 - RNA, 12 nt, Homo sapiens
ccccggcccacc

SEQ ID NO: 1564372 - RNA, 17 nt, Homo sapiens
ccccgggagacucaaag

SEQ ID NO: 1564373 - RNA, 14 nt, Homo sapiens
ccccguaccaccau

SEQ ID NO: 1564374 - RNA, 18 nt, Homo sapiens
ccccguggagcuggccaa

SEQ ID NO: 1564375 - RNA, 16 nt, Homo sapiens
ccccguggugccugca

SEQ ID NO: 1564376 - RNA, 15 nt, Homo sapiens
ccccuaguaagugcc

SEQ ID NO: 1564377 - RNA, 19 nt, Homo sapiens
ccccucaaacucauugcag

SEQ ID NO: 1564378 - RNA, 18 nt, Homo sapiens
ccccucacucuguuuccu

SEQ ID NO: 1564379 - RNA, 15 nt, Homo sapiens
ccccucagauuccac

SEQ ID NO: 1564380 - RNA, 16 nt, Homo sapiens
ccccucagauuccacc

SEQ ID NO: 1564381 - RNA, 21 nt, Homo sapiens
ccccucagauuccaccuagag

SEQ ID NO: 1564382 - RNA, 17 nt, Homo sapiens
ccccuccacuggggaau

SEQ ID NO: 1564383 - RNA, 16 nt, Homo sapiens
ccccucguuagccuuc

SEQ ID NO: 1564384 - RNA, 13 nt, Homo sapiens
ccccucucaccaa

SEQ ID NO: 1564385 - RNA, 14 nt, Homo sapiens
ccccucucaccaaa

SEQ ID NO: 1564386 - RNA, 22 nt, Homo sapiens
ccccugaaguauuuuuuaaucc

SEQ ID NO: 1564387 - RNA, 16 nt, Homo sapiens
ccccugagccacagaa

SEQ ID NO: 1564388 - RNA, 19 nt, Homo sapiens
ccccugcaauguggugaca

SEQ ID NO: 1564389 - RNA, 13 nt, Homo sapiens
ccccugucuggaa

SEQ ID NO: 1564390 - RNA, 14 nt, Homo sapiens
ccccuuccuggcac

SEQ ID NO: 1564391 - RNA, 18 nt, Homo sapiens
cccgagcuguuaccauuc

SEQ ID NO: 1564392 - RNA, 17 nt, Homo sapiens
cccgccaugcucaggag

SEQ ID NO: 1564393 - RNA, 23 nt, Homo sapiens
cccgcuauuaucagaucaugccc

SEQ ID NO: 1564394 - RNA, 17 nt, Homo sapiens
cccggcgccgggcacca

SEQ ID NO: 1564395 - RNA, 17 nt, Homo sapiens
cccgggagacucaaagg

SEQ ID NO: 1564396 - RNA, 19 nt, Homo sapiens
cccuaaaacuuaaaguaua

SEQ ID NO: 1564397 - RNA, 23 nt, Homo sapiens
cccuaaagaaugcaaccuaguca

SEQ ID NO: 1564398 - RNA, 17 nt, Homo sapiens
cccuaaaucuugacuac

SEQ ID NO: 1564399 - RNA, 21 nt, Homo sapiens
cccuaaugccuaucugaccaa

SEQ ID NO: 1564400 - RNA, 17 nt, Homo sapiens
cccuaccucuaguaaau

SEQ ID NO: 1564401 - RNA, 16 nt, Homo sapiens
cccuagaaauauaucc

SEQ ID NO: 1564402 - RNA, 20 nt, Homo sapiens
cccuagaugcacguggggcc

SEQ ID NO: 1564403 - RNA, 22 nt, Homo sapiens
cccuaggaaggugaaucugccc

SEQ ID NO: 1564404 - RNA, 21 nt, Homo sapiens
cccuauguuuauuuuuguaca

SEQ ID NO: 1564405 - RNA, 15 nt, Homo sapiens
cccuauuauuugccc

SEQ ID NO: 1564406 - RNA, 19 nt, Homo sapiens
cccuauuucuaugucauuu

SEQ ID NO: 1564407 - RNA, 15 nt, Homo sapiens
cccucagauuccacc

SEQ ID NO: 1564408 - RNA, 17 nt, Homo sapiens
cccucagauuccaccua

SEQ ID NO: 1564409 - RNA, 20 nt, Homo sapiens
cccucagauuccaccuagag

SEQ ID NO: 1564410 - RNA, 18 nt, Homo sapiens
cccucaucuuucuuccaa

SEQ ID NO: 1564411 - RNA, 11 nt, Homo sapiens
cccucaugcaa

SEQ ID NO: 1564412 - RNA, 12 nt, Homo sapiens
cccuccaaagag

SEQ ID NO: 1564413 - RNA, 17 nt, Homo sapiens
cccuccccagacucuca

SEQ ID NO: 1564414 - RNA, 13 nt, Homo sapiens
cccuccuccagua

SEQ ID NO: 1564415 - RNA, 16 nt, Homo sapiens
cccuccugcugccuaa

SEQ ID NO: 1564416 - RNA, 19 nt, Homo sapiens
cccucgggccccauccuca

SEQ ID NO: 1564417 - RNA, 16 nt, Homo sapiens
cccucggguccauaga

SEQ ID NO: 1564418 - RNA, 21 nt, Homo sapiens
cccucgucaucaggugcauag

SEQ ID NO: 1564419 - RNA, 16 nt, Homo sapiens
cccucuaucaugguga

SEQ ID NO: 1564420 - RNA, 16 nt, Homo sapiens
cccucucucaguguca

SEQ ID NO: 1564421 - RNA, 19 nt, Homo sapiens
cccucuguagccacuagua

SEQ ID NO: 1564422 - RNA, 17 nt, Homo sapiens
cccugaaaacccagaga

SEQ ID NO: 1564423 - RNA, 17 nt, Homo sapiens
cccugacuggccaaacc

SEQ ID NO: 1564424 - RNA, 20 nt, Homo sapiens
cccugaguugggcagccagg

SEQ ID NO: 1564425 - RNA, 17 nt, Homo sapiens
cccugcaauguggugac

SEQ ID NO: 1564426 - RNA, 18 nt, Homo sapiens
cccugcacacacaugcau

SEQ ID NO: 1564427 - RNA, 11 nt, Homo sapiens
cccugccauca

SEQ ID NO: 1564428 - RNA, 21 nt, Homo sapiens
cccugccucacuccuccguga

SEQ ID NO: 1564429 - RNA, 23 nt, Homo sapiens
cccugccuguuaaggaaacuuua

SEQ ID NO: 1564430 - RNA, 17 nt, Homo sapiens
cccugcuuugcaucuuu

SEQ ID NO: 1564431 - RNA, 14 nt, Homo sapiens
cccuggaaaggggg

SEQ ID NO: 1564432 - RNA, 16 nt, Homo sapiens
cccuggagagugcaca

SEQ ID NO: 1564433 - RNA, 13 nt, Homo sapiens
cccuggagggcaa

SEQ ID NO: 1564434 - RNA, 13 nt, Homo sapiens
cccuggcaggcag

SEQ ID NO: 1564435 - RNA, 17 nt, Homo sapiens
cccuggcuaacagucua

SEQ ID NO: 1564436 - RNA, 14 nt, Homo sapiens
cccugggcuggcac

SEQ ID NO: 1564437 - RNA, 20 nt, Homo sapiens
cccuggggagucugggcaca

SEQ ID NO: 1564438 - RNA, 22 nt, Homo sapiens
cccuggggcacuuucauccuca

SEQ ID NO: 1564439 - RNA, 17 nt, Homo sapiens
cccuggggcaggggugc

SEQ ID NO: 1564440 - RNA, 18 nt, Homo sapiens
cccugugucugcuguaga

SEQ ID NO: 1564441 - RNA, 19 nt, Homo sapiens
cccuguucauucugcauuc

SEQ ID NO: 1564442 - RNA, 17 nt, Homo sapiens
cccuuaacugcauccag

SEQ ID NO: 1564443 - RNA, 20 nt, Homo sapiens
cccuuaaguucagcaacugu

SEQ ID NO: 1564444 - RNA, 17 nt, Homo sapiens
cccuuagccucccugaa

SEQ ID NO: 1564445 - RNA, 12 nt, Homo sapiens
cccuucacccca

SEQ ID NO: 1564446 - RNA, 16 nt, Homo sapiens
cccuucagguguuacu

SEQ ID NO: 1564447 - RNA, 14 nt, Homo sapiens
cccuuccagugccc

SEQ ID NO: 1564448 - RNA, 17 nt, Homo sapiens
cccuuccaugugccuuu

SEQ ID NO: 1564449 - RNA, 11 nt, Homo sapiens
cccuuccccag

SEQ ID NO: 1564450 - RNA, 20 nt, Homo sapiens
cccuucuauacccacccaga

SEQ ID NO: 1564451 - RNA, 14 nt, Homo sapiens
cccuugccacccca

SEQ ID NO: 1564452 - RNA, 17 nt, Homo sapiens
cccuuggucuguacaaa

SEQ ID NO: 1564453 - RNA, 21 nt, Homo sapiens
cccuugugucaagacauuucu

SEQ ID NO: 1564454 - RNA, 19 nt, Homo sapiens
cccuuguuuauaaauagca

SEQ ID NO: 1564455 - RNA, 22 nt, Homo sapiens
cccuuuauuacaagaaggaaca

SEQ ID NO: 1564456 - RNA, 21 nt, Homo sapiens
cccuuuccuccucaggcacac

SEQ ID NO: 1564457 - RNA, 22 nt, Homo sapiens
cccuuuuaguuugaucagacag

SEQ ID NO: 1564458 - RNA, 17 nt, Homo sapiens
cccuuuugcauugccaa

SEQ ID NO: 1564459 - RNA, 15 nt, Homo sapiens
ccgaaacuaagccag

SEQ ID NO: 1564460 - RNA, 12 nt, Homo sapiens
ccgaauauugag

SEQ ID NO: 1564461 - RNA, 22 nt, Homo sapiens
ccgaauuugguacacauguguu

SEQ ID NO: 1564462 - RNA, 20 nt, Homo sapiens
ccgacaggagcacugcaugu

SEQ ID NO: 1564463 - RNA, 14 nt, Homo sapiens
ccgaccacuuccag

SEQ ID NO: 1564464 - RNA, 19 nt, Homo sapiens
ccgacuuuccauugauuca

SEQ ID NO: 1564465 - RNA, 19 nt, Homo sapiens
ccgagcgggugcaagcacu

SEQ ID NO: 1564466 - RNA, 19 nt, Homo sapiens
ccgaggcagacgucuguca

SEQ ID NO: 1564467 - RNA, 18 nt, Homo sapiens
ccgaggcuacagcuccac

SEQ ID NO: 1564468 - RNA, 16 nt, Homo sapiens
ccgaugaacaaguuua

SEQ ID NO: 1564469 - RNA, 23 nt, Homo sapiens
ccgcagaagcccugauguguccu

SEQ ID NO: 1564470 - RNA, 20 nt, Homo sapiens
ccgccaccaugcccggcuaa

SEQ ID NO: 1564471 - RNA, 19 nt, Homo sapiens
ccgccacugggccugucac

SEQ ID NO: 1564472 - RNA, 14 nt, Homo sapiens
ccgccgcaccagcc

SEQ ID NO: 1564473 - RNA, 22 nt, Homo sapiens
ccgcucuggauccugcacucua

SEQ ID NO: 1564474 - RNA, 15 nt, Homo sapiens
ccggaggacugagcc

SEQ ID NO: 1564475 - RNA, 17 nt, Homo sapiens
cgcccccaccagcucaa

SEQ ID NO: 1564476 - RNA, 14 nt, Homo sapiens
cgccccucccugaa

SEQ ID NO: 1564477 - RNA, 20 nt, Homo sapiens
cgcccugugcccgacugacu

SEQ ID NO: 1564478 - RNA, 22 nt, Homo sapiens
cgccucccuaguuagcauccag

SEQ ID NO: 1564479 - RNA, 21 nt, Homo sapiens
cgccugcccgucucucuccca

SEQ ID NO: 1564480 - RNA, 16 nt, Homo sapiens
cgccugguggugggcc

SEQ ID NO: 1564481 - RNA, 13 nt, Homo sapiens
cgcgguccugacu

SEQ ID NO: 1564482 - RNA, 20 nt, Homo sapiens
cgcguuguguauauuacacc

SEQ ID NO: 1564483 - RNA, 19 nt, Homo sapiens
cgcuacccaccuccaggga

SEQ ID NO: 1564484 - RNA, 14 nt, Homo sapiens
cgcuccacagagau

SEQ ID NO: 1564485 - RNA, 18 nt, Homo sapiens
cgcucccagguuccccca

SEQ ID NO: 1564486 - RNA, 22 nt, Homo sapiens
cgcugagcgaggagaugcuccu

SEQ ID NO: 1564487 - RNA, 18 nt, Homo sapiens
cgcuguauuuacagacac

SEQ ID NO: 1564488 - RNA, 23 nt, Homo sapiens
cgcuucuccaagucugcugauga

SEQ ID NO: 1564489 - RNA, 20 nt, Homo sapiens
cgcuugaccauguugcacug

SEQ ID NO: 1564490 - RNA, 22 nt, Homo sapiens
cgcuugcaccacuuccguccca

SEQ ID NO: 1564491 - RNA, 20 nt, Homo sapiens
cgcuugcucgcuugcuggaa

SEQ ID NO: 1564492 - RNA, 18 nt, Homo sapiens
cgcuugcuggaacacagg

SEQ ID NO: 1564493 - RNA, 13 nt, Homo sapiens
cggaauguaacuu

SEQ ID NO: 1564494 - RNA, 21 nt, Homo sapiens
cggacaagacccccagcacuu

SEQ ID NO: 1564495 - RNA, 19 nt, Homo sapiens
cggacagcccuuccuccca

SEQ ID NO: 1564496 - RNA, 22 nt, Homo sapiens
cggagaagagcuguucacagcc

SEQ ID NO: 1564497 - RNA, 11 nt, Homo sapiens
cggaggucucu

SEQ ID NO: 1564498 - RNA, 12 nt, Homo sapiens
cggauggugcau

SEQ ID NO: 1564499 - RNA, 15 nt, Homo sapiens
cggcagcauggagcu

SEQ ID NO: 1564500 - RNA, 21 nt, Homo sapiens
cggcagggugucccaggagcc

SEQ ID NO: 1564501 - RNA, 18 nt, Homo sapiens
cggccuccugucccucau

SEQ ID NO: 1564502 - RNA, 23 nt, Homo sapiens
cggcgcaugccugcaaucccagc

SEQ ID NO: 1564503 - RNA, 14 nt, Homo sapiens
cggcucacugcaac

SEQ ID NO: 1564504 - RNA, 21 nt, Homo sapiens
cggcuccuccuuaugacucca

SEQ ID NO: 1564505 - RNA, 21 nt, Homo sapiens
cggcugagucaugaucucccu

SEQ ID NO: 1564506 - RNA, 14 nt, Homo sapiens
cggcuugauuuccg

SEQ ID NO: 1564507 - RNA, 14 nt, Homo sapiens
cgggaacuggaguc

SEQ ID NO: 1564508 - RNA, 19 nt, Homo sapiens
cgggacaguaaacacucca

SEQ ID NO: 1564509 - RNA, 18 nt, Homo sapiens
cgggaccaauacuacuga

SEQ ID NO: 1564510 - RNA, 15 nt, Homo sapiens
cgggaugggggaaaa

SEQ ID NO: 1564511 - RNA, 17 nt, Homo sapiens
cgggcaccaggggccaa

SEQ ID NO: 1564512 - RNA, 15 nt, Homo sapiens
cgggcagucugcucu

SEQ ID NO: 1564513 - RNA, 21 nt, Homo sapiens
cgggcgcggccagccccggcc

SEQ ID NO: 1564514 - RNA, 14 nt, Homo sapiens
cggggacccuguga

SEQ ID NO: 1564515 - RNA, 15 nt, Homo sapiens
cggggccagcacuuc

SEQ ID NO: 1564516 - RNA, 21 nt, Homo sapiens
cggggguacagcccuugcacu

SEQ ID NO: 1564517 - RNA, 21 nt, Homo sapiens
cggguccccaaaccuguuccc

SEQ ID NO: 1564518 - RNA, 18 nt, Homo sapiens
cgguuaagaaagcacuua

SEQ ID NO: 1564519 - RNA, 14 nt, Homo sapiens
cgguuaccucugca

SEQ ID NO: 1564520 - RNA, 13 nt, Homo sapiens
cguaaagauuugg

SEQ ID NO: 1564521 - RNA, 23 nt, Homo sapiens
cguaaagugccuuauaggaauuu

SEQ ID NO: 1564522 - RNA, 14 nt, Homo sapiens
cguauguuuguacu

SEQ ID NO: 1564523 - RNA, 20 nt, Homo sapiens
cguauuaucuguugccuuau

SEQ ID NO: 1564524 - RNA, 13 nt, Homo sapiens
cgucaagacauuu

SEQ ID NO: 1564525 - RNA, 21 nt, Homo sapiens
cgucaagagcaugcacaugcu

SEQ ID NO: 1564526 - RNA, 16 nt, Homo sapiens
cgucacuacugcuacc

SEQ ID NO: 1564527 - RNA, 14 nt, Homo sapiens
cgucagcugggaca

SEQ ID NO: 1564528 - RNA, 22 nt, Homo sapiens
cgucuguugugcgaaugacuga

SEQ ID NO: 1564529 - RNA, 22 nt, Homo sapiens
cgugacggagcccacacugcca

SEQ ID NO: 1564530 - RNA, 14 nt, Homo sapiens
cgugagcaugcaca

SEQ ID NO: 1564531 - RNA, 21 nt, Homo sapiens
cgugagcaugcacacugagaa

SEQ ID NO: 1564532 - RNA, 19 nt, Homo sapiens
cgugauuuugcuguagaag

SEQ ID NO: 1564533 - RNA, 20 nt, Homo sapiens
cgugcauuuuuggaucauuu

SEQ ID NO: 1564534 - RNA, 20 nt, Homo sapiens
cgugccaaaaaucuuuucau

SEQ ID NO: 1564535 - RNA, 20 nt, Homo sapiens
cgugccagcucuaguuuuca

SEQ ID NO: 1564536 - RNA, 14 nt, Homo sapiens
cgugccaugaucug

SEQ ID NO: 1564537 - RNA, 19 nt, Homo sapiens
cgugcuacugcacuccagc

SEQ ID NO: 1564538 - RNA, 21 nt, Homo sapiens
cguggcaaaaugaacacaucu

SEQ ID NO: 1564539 - RNA, 13 nt, Homo sapiens
cgugggcucccug

SEQ ID NO: 1564540 - RNA, 16 nt, Homo sapiens
cgugggucauuacaaa

SEQ ID NO: 1564541 - RNA, 23 nt, Homo sapiens
cgugggugugugugggcacgugu

SEQ ID NO: 1564542 - RNA, 19 nt, Homo sapiens
cguguauuccauaugucua

SEQ ID NO: 1564543 - RNA, 20 nt, Homo sapiens
cguguccucucccugccaag

SEQ ID NO: 1564544 - RNA, 13 nt, Homo sapiens
cguguguuuauuu

SEQ ID NO: 1564545 - RNA, 13 nt, Homo sapiens
cguguugucauug

SEQ ID NO: 1564546 - RNA, 20 nt, Homo sapiens
cguucaccuccaagcauuuc

SEQ ID NO: 1564547 - RNA, 20 nt, Homo sapiens
cguuccccgcuccacagaga

SEQ ID NO: 1564548 - RNA, 15 nt, Homo sapiens
cguucucccaaagau

SEQ ID NO: 1564549 - RNA, 16 nt, Homo sapiens
cguucugcaagcauca

SEQ ID NO: 1564550 - RNA, 17 nt, Homo sapiens
cguugcccccagacuuc

SEQ ID NO: 1564551 - RNA, 17 nt, Homo sapiens
cguugggagccuagcuc

SEQ ID NO: 1564552 - RNA, 22 nt, Homo sapiens
cguuggucuugaacuccugacc

SEQ ID NO: 1564553 - RNA, 22 nt, Homo sapiens
cguuuccccaauaaagccuuuu

SEQ ID NO: 1564554 - RNA, 13 nt, Homo sapiens
cguuuuauuccag

SEQ ID NO: 1564555 - RNA, 12 nt, Homo sapiens
cuaaaaaagcau

SEQ ID NO: 1564556 - RNA, 18 nt, Homo sapiens
cuaaaaaugagcuugauu

SEQ ID NO: 1564557 - RNA, 17 nt, Homo sapiens
cuaaaacaaucuaaaac

SEQ ID NO: 1564558 - RNA, 12 nt, Homo sapiens
cuaaaacauucc

SEQ ID NO: 1564559 - RNA, 15 nt, Homo sapiens
cuaaaaccugagcua

SEQ ID NO: 1564560 - RNA, 16 nt, Homo sapiens
cuaaaacuuaaaguau

SEQ ID NO: 1564561 - RNA, 14 nt, Homo sapiens
cuaaaagacaugca

SEQ ID NO: 1564562 - RNA, 15 nt, Homo sapiens
cuaaaagacaugcau

SEQ ID NO: 1564563 - RNA, 12 nt, Homo sapiens
cuaaaagcuuuc

SEQ ID NO: 1564564 - RNA, 18 nt, Homo sapiens
cuaaaagugggcuugauu

SEQ ID NO: 1564565 - RNA, 15 nt, Homo sapiens
cuaaaauagcaauaa

SEQ ID NO: 1564566 - RNA, 19 nt, Homo sapiens
cuaaaaugcuucacuguac

SEQ ID NO: 1564567 - RNA, 16 nt, Homo sapiens
cuaaacaaggcauuca

SEQ ID NO: 1564568 - RNA, 17 nt, Homo sapiens
cuaaacacaacaauaac

SEQ ID NO: 1564569 - RNA, 16 nt, Homo sapiens
cuaaaccaacugaagg

SEQ ID NO: 1564570 - RNA, 16 nt, Homo sapiens
cuaaacccaauccaaa

SEQ ID NO: 1564571 - RNA, 19 nt, Homo sapiens
cuaaacgcaaugucauuuu

SEQ ID NO: 1564572 - RNA, 20 nt, Homo sapiens
cuaaacuccaggggggacaa

SEQ ID NO: 1564573 - RNA, 11 nt, Homo sapiens
cuaaacuguau

SEQ ID NO: 1564574 - RNA, 15 nt, Homo sapiens
cuaaagagcccuugc

SEQ ID NO: 1564575 - RNA, 23 nt, Homo sapiens
cuaaagaguuauucaaaugaagg

SEQ ID NO: 1564576 - RNA, 16 nt, Homo sapiens
cuaaaggacucuccag

SEQ ID NO: 1564577 - RNA, 16 nt, Homo sapiens
cuaaaggagcaucuau

SEQ ID NO: 1564578 - RNA, 20 nt, Homo sapiens
cuaaaguagggaaguuuuau

SEQ ID NO: 1564579 - RNA, 17 nt, Homo sapiens
cuaaaguuuugcaacaa

SEQ ID NO: 1564580 - RNA, 16 nt, Homo sapiens
cuaaauaccucaauca

SEQ ID NO: 1564581 - RNA, 13 nt, Homo sapiens
cuaaauaugagcc

SEQ ID NO: 1564582 - RNA, 18 nt, Homo sapiens
cuaaauaugugacugaca

SEQ ID NO: 1564583 - RNA, 23 nt, Homo sapiens
cuaaauaugugacugacaauaaa

SEQ ID NO: 1564584 - RNA, 15 nt, Homo sapiens
cuaaaucaaucugca

SEQ ID NO: 1564585 - RNA, 15 nt, Homo sapiens
cuaaaucuucagcau

SEQ ID NO: 1564586 - RNA, 17 nt, Homo sapiens
cuaaaucuucagcauag

SEQ ID NO: 1564587 - RNA, 18 nt, Homo sapiens
cuaaaugagauacacuga

SEQ ID NO: 1564588 - RNA, 12 nt, Homo sapiens
cuaaaugcaaua

SEQ ID NO: 1564589 - RNA, 22 nt, Homo sapiens
cuaaaugcagacaacaccuucc

SEQ ID NO: 1564590 - RNA, 18 nt, Homo sapiens
cuaaaugccccauauuaa

SEQ ID NO: 1564591 - RNA, 16 nt, Homo sapiens
cuaaauuacaaaugca

SEQ ID NO: 1564592 - RNA, 18 nt, Homo sapiens
cuaaauuacagugcaguu

SEQ ID NO: 1564593 - RNA, 20 nt, Homo sapiens
cuccucuuuaaaacaaaaca

SEQ ID NO: 1564594 - RNA, 14 nt, Homo sapiens
cuccugaagccaca

SEQ ID NO: 1564595 - RNA, 20 nt, Homo sapiens
cuccugaccucaggugaucc

SEQ ID NO: 1564596 - RNA, 23 nt, Homo sapiens
cuccugaggcuuuggauuugaca

SEQ ID NO: 1564597 - RNA, 20 nt, Homo sapiens
cuccugauauaacacuuucc

SEQ ID NO: 1564598 - RNA, 14 nt, Homo sapiens
cuccugcaucucau

SEQ ID NO: 1564599 - RNA, 18 nt, Homo sapiens
cuccugcaucucaugagu

SEQ ID NO: 1564600 - RNA, 15 nt, Homo sapiens
cuccugcccaggaga

SEQ ID NO: 1564601 - RNA, 13 nt, Homo sapiens
cuccuggacuaca

SEQ ID NO: 1564602 - RNA, 13 nt, Homo sapiens
cuccugggacaac

SEQ ID NO: 1564603 - RNA, 20 nt, Homo sapiens
cuccuguauuuaacaaaaag

SEQ ID NO: 1564604 - RNA, 14 nt, Homo sapiens
cuccugucaccuag

SEQ ID NO: 1564605 - RNA, 18 nt, Homo sapiens
cuccugucccucauccau

SEQ ID NO: 1564606 - RNA, 13 nt, Homo sapiens
cuccugugcucac

SEQ ID NO: 1564607 - RNA, 15 nt, Homo sapiens
cuccugugucacuga

SEQ ID NO: 1564608 - RNA, 23 nt, Homo sapiens
cuccuuaauuuaauugcuuugaa

SEQ ID NO: 1564609 - RNA, 21 nt, Homo sapiens
cuccuuccuacccuccugcac

SEQ ID NO: 1564610 - RNA, 21 nt, Homo sapiens
cuccuugcccagacuacaggg

SEQ ID NO: 1564611 - RNA, 16 nt, Homo sapiens
cuccuuggccacagac

SEQ ID NO: 1564612 - RNA, 17 nt, Homo sapiens
cuccuuguguugcacug

SEQ ID NO: 1564613 - RNA, 21 nt, Homo sapiens
cuccuuuaccuuucagugcag

SEQ ID NO: 1564614 - RNA, 18 nt, Homo sapiens
cuccuuugaaaccugcuc

SEQ ID NO: 1564615 - RNA, 15 nt, Homo sapiens
cucgaaacacagaaa

SEQ ID NO: 1564616 - RNA, 15 nt, Homo sapiens
cucgagaugggugcu

SEQ ID NO: 1564617 - RNA, 22 nt, Homo sapiens
cucgcaaacguuucuugaacaa

SEQ ID NO: 1564618 - RNA, 15 nt, Homo sapiens
cucgccaagcaggac

SEQ ID NO: 1564619 - RNA, 21 nt, Homo sapiens
cucgccaagcaggacagugcu

SEQ ID NO: 1564620 - RNA, 12 nt, Homo sapiens
cucggaugacac

SEQ ID NO: 1564621 - RNA, 18 nt, Homo sapiens
cucgggcuugagugagaa

SEQ ID NO: 1564622 - RNA, 11 nt, Homo sapiens
cucgugcagua

SEQ ID NO: 1564623 - RNA, 19 nt, Homo sapiens
cucgugguaggacuguaga

SEQ ID NO: 1564624 - RNA, 20 nt, Homo sapiens
cucgugguuagcaagauaca

SEQ ID NO: 1564625 - RNA, 13 nt, Homo sapiens
cucguuagccuuc

SEQ ID NO: 1564626 - RNA, 18 nt, Homo sapiens
cucuaagcacauuccaaa

SEQ ID NO: 1564627 - RNA, 23 nt, Homo sapiens
cucuaagcacauuccaaacuuua

SEQ ID NO: 1564628 - RNA, 14 nt, Homo sapiens
cucuaauaugauua

SEQ ID NO: 1564629 - RNA, 16 nt, Homo sapiens
cucuacugaaugucau

SEQ ID NO: 1564630 - RNA, 15 nt, Homo sapiens
cucuagaagaccaaa

SEQ ID NO: 1564631 - RNA, 14 nt, Homo sapiens
cucuagaaugagca

SEQ ID NO: 1564632 - RNA, 21 nt, Homo sapiens
cucuagguacgaugacagugu

SEQ ID NO: 1564633 - RNA, 19 nt, Homo sapiens
cucuauaaaaaauauguau

SEQ ID NO: 1564634 - RNA, 13 nt, Homo sapiens
cucuauaaagggu

SEQ ID NO: 1564635 - RNA, 17 nt, Homo sapiens
cucuauaagauuccaaa

SEQ ID NO: 1564636 - RNA, 21 nt, Homo sapiens
cucuauaagauuccaaaaagc

SEQ ID NO: 1564637 - RNA, 15 nt, Homo sapiens
cucuaucaugcaaaa

SEQ ID NO: 1564638 - RNA, 13 nt, Homo sapiens
cucuauuguaucc

SEQ ID NO: 1564639 - RNA, 14 nt, Homo sapiens
cucucaaacuucac

SEQ ID NO: 1564640 - RNA, 22 nt, Homo sapiens
cucucaacauuaccaaaaucau

SEQ ID NO: 1564641 - RNA, 18 nt, Homo sapiens
cucucaagcagguuuuua

SEQ ID NO: 1564642 - RNA, 16 nt, Homo sapiens
cucucaagcuagccag

SEQ ID NO: 1564643 - RNA, 17 nt, Homo sapiens
cucucaagcuagccaga

SEQ ID NO: 1564644 - RNA, 12 nt, Homo sapiens
cucucaccucau

SEQ ID NO: 1564645 - RNA, 21 nt, Homo sapiens
cucucagaggccugcugccag

SEQ ID NO: 1564646 - RNA, 15 nt, Homo sapiens
cucucaggcccagug

SEQ ID NO: 1564647 - RNA, 15 nt, Homo sapiens
cucucaguucucgau

SEQ ID NO: 1564648 - RNA, 15 nt, Homo sapiens
cucucaucaacugaa

SEQ ID NO: 1564649 - RNA, 20 nt, Homo sapiens
cucucaugguacuuccucug

SEQ ID NO: 1564650 - RNA, 16 nt, Homo sapiens
cucuccacaaggggau

SEQ ID NO: 1564651 - RNA, 14 nt, Homo sapiens
cucuccacacaggu

SEQ ID NO: 1564652 - RNA, 13 nt, Homo sapiens
cucuccauauccc

SEQ ID NO: 1564653 - RNA, 18 nt, Homo sapiens
cucucccagucuacccag

SEQ ID NO: 1564654 - RNA, 21 nt, Homo sapiens
cucucccagucuacccagaga

SEQ ID NO: 1564655 - RNA, 14 nt, Homo sapiens
cucucccugccaag

SEQ ID NO: 1564656 - RNA, 15 nt, Homo sapiens
cucucccugccaagu

SEQ ID NO: 1564657 - RNA, 15 nt, Homo sapiens
cucucccugcugcuc

SEQ ID NO: 1564658 - RNA, 23 nt, Homo sapiens
cucuccugccugcccugccucag

SEQ ID NO: 1564659 - RNA, 16 nt, Homo sapiens
cucuccuggugcucca

SEQ ID NO: 1564660 - RNA, 18 nt, Homo sapiens
cucuccuuuuugcuuccu

SEQ ID NO: 1564661 - RNA, 16 nt, Homo sapiens
cucucgacaguaucca

SEQ ID NO: 1564662 - RNA, 22 nt, Homo sapiens
cucucuaacguccacuagcuua

SEQ ID NO: 1564663 - RNA, 20 nt, Homo sapiens
cucucuaguugaacccuggg

SEQ ID NO: 1564664 - RNA, 22 nt, Homo sapiens
cucucucaugccuccugaggcu

SEQ ID NO: 1564665 - RNA, 14 nt, Homo sapiens
cucucucccaugga

SEQ ID NO: 1564666 - RNA, 17 nt, Homo sapiens
cucucuccccaaaguga

SEQ ID NO: 1564667 - RNA, 22 nt, Homo sapiens
cucucugucuuuuuucucucuu

SEQ ID NO: 1564668 - RNA, 21 nt, Homo sapiens
cucucuucaauaaaccacaag

SEQ ID NO: 1564669 - RNA, 15 nt, Homo sapiens
cucucuucugcucca

SEQ ID NO: 1564670 - RNA, 14 nt, Homo sapiens
cucucuuuaacccu

SEQ ID NO: 1564671 - RNA, 13 nt, Homo sapiens
cucugaagccaca

SEQ ID NO: 1564672 - RNA, 16 nt, Homo sapiens
cucugaccuuccagag

SEQ ID NO: 1564673 - RNA, 15 nt, Homo sapiens
cucugagccacagau

SEQ ID NO: 1564674 - RNA, 22 nt, Homo sapiens
cucugagucagugguuauuuga

SEQ ID NO: 1564675 - RNA, 13 nt, Homo sapiens
cucugaucccucu

SEQ ID NO: 1564676 - RNA, 16 nt, Homo sapiens
cucugauuuacauuca

SEQ ID NO: 1564677 - RNA, 12 nt, Homo sapiens
cucugcaaaagg

SEQ ID NO: 1564678 - RNA, 18 nt, Homo sapiens
cucugcaagaagaaauca

SEQ ID NO: 1564679 - RNA, 21 nt, Homo sapiens
cucugcacccagugaacacau

SEQ ID NO: 1564680 - RNA, 20 nt, Homo sapiens
cucugcagacuucccagcua

SEQ ID NO: 1564681 - RNA, 22 nt, Homo sapiens
cucugcaguaaaacacauuugg

SEQ ID NO: 1564682 - RNA, 18 nt, Homo sapiens
cucugcauggaacagcau

SEQ ID NO: 1564683 - RNA, 22 nt, Homo sapiens
cucugccgcugccaugcuuuga

SEQ ID NO: 1564684 - RNA, 16 nt, Homo sapiens
cucugccuacagccag

SEQ ID NO: 1564685 - RNA, 24 nt, Homo sapiens
cucugccuuaaacacacauugcag

SEQ ID NO: 1564686 - RNA, 17 nt, Homo sapiens
cucuggacaagucaucu

SEQ ID NO: 1564687 - RNA, 18 nt, Homo sapiens
cucuggacagccagugac

SEQ ID NO: 1564688 - RNA, 15 nt, Homo sapiens
cucuggcuggaauag

SEQ ID NO: 1564689 - RNA, 13 nt, Homo sapiens
cucugguggcaca

SEQ ID NO: 1564690 - RNA, 20 nt, Homo sapiens
cucuguaaaacacaccaauc

SEQ ID NO: 1564691 - RNA, 15 nt, Homo sapiens
cucuguaaacuucca

SEQ ID NO: 1564692 - RNA, 18 nt, Homo sapiens
cucuguacagcugcucuu

SEQ ID NO: 1564693 - RNA, 20 nt, Homo sapiens
cucuguccacgauucacuca

SEQ ID NO: 1564694 - RNA, 14 nt, Homo sapiens
cucugugaccaaug

SEQ ID NO: 1564695 - RNA, 17 nt, Homo sapiens
cucuguuugugggacug

SEQ ID NO: 1564696 - RNA, 18 nt, Homo sapiens
cucuuaaaagaugccuua

SEQ ID NO: 1564697 - RNA, 14 nt, Homo sapiens
cucuuaaaucauuu

SEQ ID NO: 1564698 - RNA, 21 nt, Homo sapiens
cucuuaauagcuauacauuaa

SEQ ID NO: 1564699 - RNA, 21 nt, Homo sapiens
cucuuaaugguccaaaggaca

SEQ ID NO: 1564700 - RNA, 19 nt, Homo sapiens
cucuuacaucaguagcauu

SEQ ID NO: 1564701 - RNA, 13 nt, Homo sapiens
cucuuacaucucc

SEQ ID NO: 1564702 - RNA, 15 nt, Homo sapiens
cucuuagauucuuaa

SEQ ID NO: 1564703 - RNA, 18 nt, Homo sapiens
cucuuagggacagucaaa

SEQ ID NO: 1564704 - RNA, 19 nt, Homo sapiens
cucuuaugggauuacaugu

SEQ ID NO: 1564705 - RNA, 18 nt, Homo sapiens
cucuuaugugugccuuug

SEQ ID NO: 1564706 - RNA, 14 nt, Homo sapiens
cucuucaacaugac

SEQ ID NO: 1564707 - RNA, 14 nt, Homo sapiens
cucuucacagucac

SEQ ID NO: 1564708 - RNA, 21 nt, Homo sapiens
cucuugggaacugaacucacu

SEQ ID NO: 1564709 - RNA, 17 nt, Homo sapiens
cucuuguggugcauuga

SEQ ID NO: 1564710 - RNA, 12 nt, Homo sapiens
cucuuuacauuu

SEQ ID NO: 1564711 - RNA, 14 nt, Homo sapiens
cucuuuaguguucu

SEQ ID NO: 1564712 - RNA, 20 nt, Homo sapiens
gagauugcaccacugcacuc

SEQ ID NO: 1564713 - RNA, 21 nt, Homo sapiens
gagauugcgccauugcacucc

SEQ ID NO: 1564714 - RNA, 21 nt, Homo sapiens
gagauugugccccugcacucc

SEQ ID NO: 1564715 - RNA, 18 nt, Homo sapiens
gagcaaaaucaacaugac

SEQ ID NO: 1564716 - RNA, 13 nt, Homo sapiens
gagcaaacagaaa

SEQ ID NO: 1564717 - RNA, 23 nt, Homo sapiens
gagcaacagcgauggcagugaga

SEQ ID NO: 1564718 - RNA, 18 nt, Homo sapiens
gagcaacucccucucagc

SEQ ID NO: 1564719 - RNA, 15 nt, Homo sapiens
gagcaaguccucacu

SEQ ID NO: 1564720 - RNA, 18 nt, Homo sapiens
gagcaaguccucacucuu

SEQ ID NO: 1564721 - RNA, 16 nt, Homo sapiens
gagcacauagagcuuu

SEQ ID NO: 1564722 - RNA, 17 nt, Homo sapiens
gagcacaucucucugcc

SEQ ID NO: 1564723 - RNA, 16 nt, Homo sapiens
gagcacccuacaggga

SEQ ID NO: 1564724 - RNA, 14 nt, Homo sapiens
gagcacccugccca

SEQ ID NO: 1564725 - RNA, 21 nt, Homo sapiens
gagcacguggagauagugcca

SEQ ID NO: 1564726 - RNA, 23 nt, Homo sapiens
gagcacguggagauagugccagg

SEQ ID NO: 1564727 - RNA, 14 nt, Homo sapiens
gagcacugcauguc

SEQ ID NO: 1564728 - RNA, 16 nt, Homo sapiens
gagcacuuuaaaaaca

SEQ ID NO: 1564729 - RNA, 17 nt, Homo sapiens
gagcagaggucucccaa

SEQ ID NO: 1564730 - RNA, 16 nt, Homo sapiens
gagcaguaaacuuucu

SEQ ID NO: 1564731 - RNA, 13 nt, Homo sapiens
gagcaguccaugc

SEQ ID NO: 1564732 - RNA, 15 nt, Homo sapiens
gagcauacaucuuaa

SEQ ID NO: 1564733 - RNA, 14 nt, Homo sapiens
gagcaugcacaugc

SEQ ID NO: 1564734 - RNA, 21 nt, Homo sapiens
gagcaugcucaguuggugcug

SEQ ID NO: 1564735 - RNA, 17 nt, Homo sapiens
gagcauuucucaucagu

SEQ ID NO: 1564736 - RNA, 21 nt, Homo sapiens
gagccacaagcugcacuguga

SEQ ID NO: 1564737 - RNA, 17 nt, Homo sapiens
gagccacagcagcauuu

SEQ ID NO: 1564738 - RNA, 18 nt, Homo sapiens
gagccaccagcaaagcgc

SEQ ID NO: 1564739 - RNA, 15 nt, Homo sapiens
gagccaccaguucuc

SEQ ID NO: 1564740 - RNA, 15 nt, Homo sapiens
gagccaccgugccug

SEQ ID NO: 1564741 - RNA, 21 nt, Homo sapiens
gagccagcugcagaagggugg

SEQ ID NO: 1564742 - RNA, 18 nt, Homo sapiens
gagccaggcacacacugu

SEQ ID NO: 1564743 - RNA, 21 nt, Homo sapiens
gagccauauguacauaaucua

SEQ ID NO: 1564744 - RNA, 18 nt, Homo sapiens
gagccaugacaagaacaa

SEQ ID NO: 1564745 - RNA, 23 nt, Homo sapiens
gagccauuugucccaagugccaa

SEQ ID NO: 1564746 - RNA, 16 nt, Homo sapiens
gagccccccuagcaau

SEQ ID NO: 1564747 - RNA, 21 nt, Homo sapiens
gagccccuuugccugucaagu

SEQ ID NO: 1564748 - RNA, 17 nt, Homo sapiens
gagcccugcucuucucu

SEQ ID NO: 1564749 - RNA, 19 nt, Homo sapiens
gagccgagaucaugccauu

SEQ ID NO: 1564750 - RNA, 22 nt, Homo sapiens
gagccuacagaagggcagugac

SEQ ID NO: 1564751 - RNA, 23 nt, Homo sapiens
gagccucacuggggcagacaaua

SEQ ID NO: 1564752 - RNA, 12 nt, Homo sapiens
gagccucaggag

SEQ ID NO: 1564753 - RNA, 16 nt, Homo sapiens
gagccuccugugccug

SEQ ID NO: 1564754 - RNA, 15 nt, Homo sapiens
gagccugggcgacca

SEQ ID NO: 1564755 - RNA, 18 nt, Homo sapiens
gagccuuagaggucuuua

SEQ ID NO: 1564756 - RNA, 21 nt, Homo sapiens
gagccuuauuuaccuagugca

SEQ ID NO: 1564757 - RNA, 20 nt, Homo sapiens
gagccuucucagaagcacag

SEQ ID NO: 1564758 - RNA, 22 nt, Homo sapiens
gagccuuggggaguccacaggc

SEQ ID NO: 1564759 - RNA, 23 nt, Homo sapiens
gagccuuuuaccccugcacaguu

SEQ ID NO: 1564760 - RNA, 13 nt, Homo sapiens
gagcgacagugag

SEQ ID NO: 1564761 - RNA, 13 nt, Homo sapiens
gagcgcuccugcc

SEQ ID NO: 1564762 - RNA, 17 nt, Homo sapiens
gagcuaauuuacuggac

SEQ ID NO: 1564763 - RNA, 13 nt, Homo sapiens
gagcuagaaccug

SEQ ID NO: 1564764 - RNA, 16 nt, Homo sapiens
gagcuagaaccuggag

SEQ ID NO: 1564765 - RNA, 19 nt, Homo sapiens
gagcuagaugugucuuacc

SEQ ID NO: 1564766 - RNA, 11 nt, Homo sapiens
gagcucaccag

SEQ ID NO: 1564767 - RNA, 19 nt, Homo sapiens
gagcucgcauuugucaaug

SEQ ID NO: 1564768 - RNA, 20 nt, Homo sapiens
gagcugacccagaguggagu

SEQ ID NO: 1564769 - RNA, 18 nt, Homo sapiens
gagcugggagacaaagga

SEQ ID NO: 1564770 - RNA, 22 nt, Homo sapiens
gagcugggccgguuaguguaug

SEQ ID NO: 1564771 - RNA, 16 nt, Homo sapiens
gagcugucugaacuca

SEQ ID NO: 1564772 - RNA, 14 nt, Homo sapiens
gagcuguguucaca

SEQ ID NO: 1564773 - RNA, 16 nt, Homo sapiens
gagcuguuaccauuca

SEQ ID NO: 1564774 - RNA, 19 nt, Homo sapiens
gagcuugacaccuggugcu

SEQ ID NO: 1564775 - RNA, 19 nt, Homo sapiens
gagcuugcaugcuugcaua

SEQ ID NO: 1564776 - RNA, 14 nt, Homo sapiens
gaggaaacuuugau

SEQ ID NO: 1564777 - RNA, 15 nt, Homo sapiens
gaggaaauucuuucc

SEQ ID NO: 1564778 - RNA, 19 nt, Homo sapiens
gaggaaggaacagcaaugg

SEQ ID NO: 1564779 - RNA, 12 nt, Homo sapiens
gaggacacagau

SEQ ID NO: 1564780 - RNA, 17 nt, Homo sapiens
gaggacugagacuggca

SEQ ID NO: 1564781 - RNA, 15 nt, Homo sapiens
gaggagaaacuggaa

SEQ ID NO: 1564782 - RNA, 14 nt, Homo sapiens
gaggaggggaccaa

SEQ ID NO: 1564783 - RNA, 17 nt, Homo sapiens
gaggaguaccgccagca

SEQ ID NO: 1564784 - RNA, 15 nt, Homo sapiens
gaggcagagccagug

SEQ ID NO: 1564785 - RNA, 20 nt, Homo sapiens
gaggcaggagaaucacuuga

SEQ ID NO: 1564786 - RNA, 19 nt, Homo sapiens
gaggcaggaggaucacuuu

SEQ ID NO: 1564787 - RNA, 16 nt, Homo sapiens
gaggcaggcggaucau

SEQ ID NO: 1564788 - RNA, 17 nt, Homo sapiens
gaggcaggcggaucaug

SEQ ID NO: 1564789 - RNA, 14 nt, Homo sapiens
gaggccagacccac

SEQ ID NO: 1564790 - RNA, 19 nt, Homo sapiens
gaggccaguaccuuuccau

SEQ ID NO: 1564791 - RNA, 20 nt, Homo sapiens
gaggcccaaccuccuauaua

SEQ ID NO: 1564792 - RNA, 21 nt, Homo sapiens
gaggccccaccugaagggugg

SEQ ID NO: 1564793 - RNA, 17 nt, Homo sapiens
gaggccccugccuccaa

SEQ ID NO: 1564794 - RNA, 15 nt, Homo sapiens
gaggcgcacagugug

SEQ ID NO: 1564795 - RNA, 23 nt, Homo sapiens
gaggcuaucuaauuuuacacucu

SEQ ID NO: 1564796 - RNA, 22 nt, Homo sapiens
gaggcuccaagccucaaagugc

SEQ ID NO: 1564797 - RNA, 19 nt, Homo sapiens
gaggcucccaaucagcuuu

SEQ ID NO: 1564798 - RNA, 18 nt, Homo sapiens
gaggcuccggauguuucu

SEQ ID NO: 1564799 - RNA, 13 nt, Homo sapiens
gaggcugccacac

SEQ ID NO: 1564800 - RNA, 18 nt, Homo sapiens
gaggcugccccucucacc

SEQ ID NO: 1564801 - RNA, 21 nt, Homo sapiens
gaggcuucuccgccagccucc

SEQ ID NO: 1564802 - RNA, 18 nt, Homo sapiens
gagggaccagacacaggu

SEQ ID NO: 1564803 - RNA, 21 nt, Homo sapiens
gagggagcgacacuugaaugu

SEQ ID NO: 1564804 - RNA, 18 nt, Homo sapiens
gagggaggaacaccugau

SEQ ID NO: 1564805 - RNA, 17 nt, Homo sapiens
gagggccacaugggagg

SEQ ID NO: 1564806 - RNA, 11 nt, Homo sapiens
gagggcccaac

SEQ ID NO: 1564807 - RNA, 20 nt, Homo sapiens
gagggcuagaaccuagaagg

SEQ ID NO: 1564808 - RNA, 20 nt, Homo sapiens
gagggcuggcuggccucacc

SEQ ID NO: 1564809 - RNA, 22 nt, Homo sapiens
gagggcuuccucuagaagccaa

SEQ ID NO: 1564810 - RNA, 19 nt, Homo sapiens
gaggggagugugugcagcg

SEQ ID NO: 1564811 - RNA, 17 nt, Homo sapiens
gagggggaguagccaag

SEQ ID NO: 1564812 - RNA, 17 nt, Homo sapiens
gagggugcccagcuuau

SEQ ID NO: 1564813 - RNA, 17 nt, Homo sapiens
gagguaaauaaguaaaa

SEQ ID NO: 1564814 - RNA, 17 nt, Homo sapiens
gaggucaucacuuugac

SEQ ID NO: 1564815 - RNA, 10 nt, Homo sapiens
gagguccagg

SEQ ID NO: 1564816 - RNA, 16 nt, Homo sapiens
gaggugccacccagua

SEQ ID NO: 1564817 - RNA, 15 nt, Homo sapiens
gaggugcgcagugga

SEQ ID NO: 1564818 - RNA, 22 nt, Homo sapiens
gaggugcgcgacgggcacagug

SEQ ID NO: 1564819 - RNA, 18 nt, Homo sapiens
gagguggauucaugucca

SEQ ID NO: 1564820 - RNA, 20 nt, Homo sapiens
gagguggauuuggagaccga

SEQ ID NO: 1564821 - RNA, 15 nt, Homo sapiens
gaggugggaggugga

SEQ ID NO: 1564822 - RNA, 20 nt, Homo sapiens
gaggugggauccucccucau

SEQ ID NO: 1564823 - RNA, 21 nt, Homo sapiens
gagguggguggaucaccugag

SEQ ID NO: 1564824 - RNA, 15 nt, Homo sapiens
gaggugucgggacau

SEQ ID NO: 1564825 - RNA, 15 nt, Homo sapiens
gaguaaaccuugaag

SEQ ID NO: 1564826 - RNA, 12 nt, Homo sapiens
gaguaacacaua

SEQ ID NO: 1564827 - RNA, 23 nt, Homo sapiens
gaguaagcccucaggagccucug

SEQ ID NO: 1564828 - RNA, 16 nt, Homo sapiens
gaguaaggcacaccca

SEQ ID NO: 1564829 - RNA, 18 nt, Homo sapiens
gaguaaggcacacccaaa

SEQ ID NO: 1564830 - RNA, 18 nt, Homo sapiens
gcagugagugccaugcuu

SEQ ID NO: 1564831 - RNA, 13 nt, Homo sapiens
gcagugaugucac

SEQ ID NO: 1564832 - RNA, 15 nt, Homo sapiens
gcagugcuaaagccu

SEQ ID NO: 1564833 - RNA, 15 nt, Homo sapiens
gcagugcucacccac

SEQ ID NO: 1564834 - RNA, 16 nt, Homo sapiens
gcaguggcgugaucuc

SEQ ID NO: 1564835 - RNA, 20 nt, Homo sapiens
gcaguggcucaugcccauaa

SEQ ID NO: 1564836 - RNA, 20 nt, Homo sapiens
gcaguguggaggccacuguu

SEQ ID NO: 1564837 - RNA, 14 nt, Homo sapiens
gcaguuggacucuc

SEQ ID NO: 1564838 - RNA, 17 nt, Homo sapiens
gcaguuggacucucagg

SEQ ID NO: 1564839 - RNA, 20 nt, Homo sapiens
gcauaagagcuuaagaacca

SEQ ID NO: 1564840 - RNA, 20 nt, Homo sapiens
gcauaaggaguuagaaccac

SEQ ID NO: 1564841 - RNA, 21 nt, Homo sapiens
gcauaauguuucuggauuuca

SEQ ID NO: 1564842 - RNA, 19 nt, Homo sapiens
gcauacugccuuguuuaau

SEQ ID NO: 1564843 - RNA, 14 nt, Homo sapiens
gcauagauugauca

SEQ ID NO: 1564844 - RNA, 20 nt, Homo sapiens
gcauaggccuuagcaguaac

SEQ ID NO: 1564845 - RNA, 13 nt, Homo sapiens
gcauauaaaugua

SEQ ID NO: 1564846 - RNA, 13 nt, Homo sapiens
gcauaugaguaag

SEQ ID NO: 1564847 - RNA, 16 nt, Homo sapiens
gcauaugcacagucaa

SEQ ID NO: 1564848 - RNA, 18 nt, Homo sapiens
gcauaugguccuagacaa

SEQ ID NO: 1564849 - RNA, 21 nt, Homo sapiens
gcauauguuuuccacauaaau

SEQ ID NO: 1564850 - RNA, 23 nt, Homo sapiens
gcauauucccugcacacacaugc

SEQ ID NO: 1564851 - RNA, 19 nt, Homo sapiens
gcaucaauacaaccagccc

SEQ ID NO: 1564852 - RNA, 21 nt, Homo sapiens
gcaucaauuuuucuuauuuca

SEQ ID NO: 1564853 - RNA, 23 nt, Homo sapiens
gcaucacggauggugcaugggcu

SEQ ID NO: 1564854 - RNA, 16 nt, Homo sapiens
gcaucacuagugacaa

SEQ ID NO: 1564855 - RNA, 14 nt, Homo sapiens
gcaucaucuguucg

SEQ ID NO: 1564856 - RNA, 17 nt, Homo sapiens
gcaucauuaauaccuaa

SEQ ID NO: 1564857 - RNA, 12 nt, Homo sapiens
gcauccacugau

SEQ ID NO: 1564858 - RNA, 21 nt, Homo sapiens
gcauccagagucccugccugg

SEQ ID NO: 1564859 - RNA, 20 nt, Homo sapiens
gcauccagcagcagcacuua

SEQ ID NO: 1564860 - RNA, 19 nt, Homo sapiens
gcauccuguguaaauggaa

SEQ ID NO: 1564861 - RNA, 18 nt, Homo sapiens
gcauccuuuucaaaaccu

SEQ ID NO: 1564862 - RNA, 19 nt, Homo sapiens
gcauccuuuucaaaaccua

SEQ ID NO: 1564863 - RNA, 14 nt, Homo sapiens
gcaucuacuuagau

SEQ ID NO: 1564864 - RNA, 21 nt, Homo sapiens
gcaucuacuuggcaaggucau

SEQ ID NO: 1564865 - RNA, 12 nt, Homo sapiens
gcaucuaucugg

SEQ ID NO: 1564866 - RNA, 21 nt, Homo sapiens
gcaucuauuuccucugugcaa

SEQ ID NO: 1564867 - RNA, 23 nt, Homo sapiens
gcaucuauuuccucugugcaaag

SEQ ID NO: 1564868 - RNA, 17 nt, Homo sapiens
gcaucucccaguucaua

SEQ ID NO: 1564869 - RNA, 20 nt, Homo sapiens
gcaucucugucacacccggg

SEQ ID NO: 1564870 - RNA, 20 nt, Homo sapiens
gcaucuucugguuuaaacuu

SEQ ID NO: 1564871 - RNA, 20 nt, Homo sapiens
gcaugaaggcagccacagac

SEQ ID NO: 1564872 - RNA, 13 nt, Homo sapiens
gcaugccauugaa

SEQ ID NO: 1564873 - RNA, 16 nt, Homo sapiens
gcaugccuguagucuc

SEQ ID NO: 1564874 - RNA, 21 nt, Homo sapiens
gcaugcucaguuggugcugcu

SEQ ID NO: 1564875 - RNA, 14 nt, Homo sapiens
gcauggaacagcau

SEQ ID NO: 1564876 - RNA, 13 nt, Homo sapiens
gcauggagcuaua

SEQ ID NO: 1564877 - RNA, 16 nt, Homo sapiens
gcaugucugccaaaau

SEQ ID NO: 1564878 - RNA, 20 nt, Homo sapiens
gcaugucugccuaugcacug

SEQ ID NO: 1564879 - RNA, 21 nt, Homo sapiens
gcaugucugccuaugcacuga

SEQ ID NO: 1564880 - RNA, 13 nt, Homo sapiens
gcaugugaucucc

SEQ ID NO: 1564881 - RNA, 22 nt, Homo sapiens
gcauguggugauuggccacaca

SEQ ID NO: 1564882 - RNA, 18 nt, Homo sapiens
gcauguuuauucuguucc

SEQ ID NO: 1564883 - RNA, 16 nt, Homo sapiens
gcauguuucacagugg

SEQ ID NO: 1564884 - RNA, 15 nt, Homo sapiens
gcauuauggucuaau

SEQ ID NO: 1564885 - RNA, 22 nt, Homo sapiens
gcauucaaaaagacagcagaca

SEQ ID NO: 1564886 - RNA, 14 nt, Homo sapiens
gcauuccagccuug

SEQ ID NO: 1564887 - RNA, 14 nt, Homo sapiens
gcauuccaugacca

SEQ ID NO: 1564888 - RNA, 14 nt, Homo sapiens
gcauucuaguuuca

SEQ ID NO: 1564889 - RNA, 22 nt, Homo sapiens
gcauucuccuccuauugccucc

SEQ ID NO: 1564890 - RNA, 23 nt, Homo sapiens
gcauucuccuccuauugccucca

SEQ ID NO: 1564891 - RNA, 16 nt, Homo sapiens
gcauuggugacucacu

SEQ ID NO: 1564892 - RNA, 21 nt, Homo sapiens
gcauuugucuauucuccagcu

SEQ ID NO: 1564893 - RNA, 20 nt, Homo sapiens
gcauuuugccuaccuggguc

SEQ ID NO: 1564894 - RNA, 19 nt, Homo sapiens
gcauuuugguuuuuccuca

SEQ ID NO: 1564895 - RNA, 13 nt, Homo sapiens
gccaaaacauacc

SEQ ID NO: 1564896 - RNA, 20 nt, Homo sapiens
gccaaaagucccucccugcc

SEQ ID NO: 1564897 - RNA, 13 nt, Homo sapiens
gccaaaccaggac

SEQ ID NO: 1564898 - RNA, 17 nt, Homo sapiens
gccaaaggaaguuuuaa

SEQ ID NO: 1564899 - RNA, 14 nt, Homo sapiens
gccaacauggugaa

SEQ ID NO: 1564900 - RNA, 15 nt, Homo sapiens
gccaaccagacaccu

SEQ ID NO: 1564901 - RNA, 17 nt, Homo sapiens
gccaagaacuugcaaua

SEQ ID NO: 1564902 - RNA, 12 nt, Homo sapiens
gccaagacuccu

SEQ ID NO: 1564903 - RNA, 18 nt, Homo sapiens
gccaagagugaagggaag

SEQ ID NO: 1564904 - RNA, 20 nt, Homo sapiens
gccaagagugcacuacugua

SEQ ID NO: 1564905 - RNA, 18 nt, Homo sapiens
gccaaguaagaaagugaa

SEQ ID NO: 1564906 - RNA, 20 nt, Homo sapiens
gccaauacagacaaagcaua

SEQ ID NO: 1564907 - RNA, 17 nt, Homo sapiens
gccacaaauaacaucuc

SEQ ID NO: 1564908 - RNA, 14 nt, Homo sapiens
gccacacacugagu

SEQ ID NO: 1564909 - RNA, 16 nt, Homo sapiens
gccacacggaagcaag

SEQ ID NO: 1564910 - RNA, 18 nt, Homo sapiens
gccacagggaagcucaca

SEQ ID NO: 1564911 - RNA, 17 nt, Homo sapiens
gccacaguagaacuguc

SEQ ID NO: 1564912 - RNA, 21 nt, Homo sapiens
gccaccaaaggagacauauca

SEQ ID NO: 1564913 - RNA, 22 nt, Homo sapiens
gccaccaagcugcucuccuuca

SEQ ID NO: 1564914 - RNA, 13 nt, Homo sapiens
gccaccaguucuc

SEQ ID NO: 1564915 - RNA, 16 nt, Homo sapiens
gccaccucaccaagga

SEQ ID NO: 1564916 - RNA, 19 nt, Homo sapiens
gccaccuggcaaaggaccc

SEQ ID NO: 1564917 - RNA, 21 nt, Homo sapiens
gccacugcgcccggcccaaga

SEQ ID NO: 1564918 - RNA, 21 nt, Homo sapiens
gccacugggccugucacugau

SEQ ID NO: 1564919 - RNA, 17 nt, Homo sapiens
gccacugucacaggcau

SEQ ID NO: 1564920 - RNA, 18 nt, Homo sapiens
gccagacuggcacaguuu

SEQ ID NO: 1564921 - RNA, 12 nt, Homo sapiens
gccagacuuccc

SEQ ID NO: 1564922 - RNA, 18 nt, Homo sapiens
gccagaggguagggcaca

SEQ ID NO: 1564923 - RNA, 13 nt, Homo sapiens
gccagccucagaa

SEQ ID NO: 1564924 - RNA, 14 nt, Homo sapiens
gccagccucagaag

SEQ ID NO: 1564925 - RNA, 18 nt, Homo sapiens
gccagccucagaaggccc

SEQ ID NO: 1564926 - RNA, 23 nt, Homo sapiens
gccagccucagaaggccccagag

SEQ ID NO: 1564927 - RNA, 13 nt, Homo sapiens
gccagcucaggaa

SEQ ID NO: 1564928 - RNA, 14 nt, Homo sapiens
gccaggaagccaga

SEQ ID NO: 1564929 - RNA, 17 nt, Homo sapiens
gccaggaggccugcuag

SEQ ID NO: 1564930 - RNA, 22 nt, Homo sapiens
gccaggaggcugccacacggaa

SEQ ID NO: 1564931 - RNA, 21 nt, Homo sapiens
gccaggcuggucucaaacucc

SEQ ID NO: 1564932 - RNA, 22 nt, Homo sapiens
gccaggggugcuccugugcuca

SEQ ID NO: 1564933 - RNA, 23 nt, Homo sapiens
gccaggggugcuccugugcucac

SEQ ID NO: 1564934 - RNA, 13 nt, Homo sapiens
gccagguggcacc

SEQ ID NO: 1564935 - RNA, 14 nt, Homo sapiens
gccagugcacuccg

SEQ ID NO: 1564936 - RNA, 18 nt, Homo sapiens
gccagugucuuucuuugg

SEQ ID NO: 1564937 - RNA, 16 nt, Homo sapiens
gccauaagaaagcacu

SEQ ID NO: 1564938 - RNA, 13 nt, Homo sapiens
gccauaauguugc

SEQ ID NO: 1564939 - RNA, 18 nt, Homo sapiens
gccauaauuacuauguca

SEQ ID NO: 1564940 - RNA, 18 nt, Homo sapiens
gccaucaaaaugcuuuuu

SEQ ID NO: 1564941 - RNA, 14 nt, Homo sapiens
gccaucaagcacuu

SEQ ID NO: 1564942 - RNA, 14 nt, Homo sapiens
gccaucaaggagua

SEQ ID NO: 1564943 - RNA, 21 nt, Homo sapiens
gccaucacucuuguacugccu

SEQ ID NO: 1564944 - RNA, 14 nt, Homo sapiens
gccaucccuguguc

SEQ ID NO: 1564945 - RNA, 23 nt, Homo sapiens
gccaucccuuuuuuuacauuuca

SEQ ID NO: 1564946 - RNA, 14 nt, Homo sapiens
gccaucguccuggg

SEQ ID NO: 1564947 - RNA, 13 nt, Homo sapiens
gccaugccaggaa

SEQ ID NO: 1564948 - RNA, 20 nt, Homo sapiens
gcuugucuuaaaauaaugaa

SEQ ID NO: 1564949 - RNA, 19 nt, Homo sapiens
gcuugucuucguccaucug

SEQ ID NO: 1564950 - RNA, 14 nt, Homo sapiens
gcuuguuccaaugc

SEQ ID NO: 1564951 - RNA, 20 nt, Homo sapiens
gcuuguuuacagcacuacuc

SEQ ID NO: 1564952 - RNA, 23 nt, Homo sapiens
gcuuguuuacagcacuacucugu

SEQ ID NO: 1564953 - RNA, 15 nt, Homo sapiens
gcuuuaaaagucauu

SEQ ID NO: 1564954 - RNA, 23 nt, Homo sapiens
gcuuuaaauuaaacucuacuuca

SEQ ID NO: 1564955 - RNA, 19 nt, Homo sapiens
gcuuuacuuucuguguuga

SEQ ID NO: 1564956 - RNA, 18 nt, Homo sapiens
gcuuuagaaacagugcaa

SEQ ID NO: 1564957 - RNA, 20 nt, Homo sapiens
gcuuuauuccagaaugcugu

SEQ ID NO: 1564958 - RNA, 22 nt, Homo sapiens
gcuuucaagugagacccaaagg

SEQ ID NO: 1564959 - RNA, 17 nt, Homo sapiens
gcuuucauaaaucaugu

SEQ ID NO: 1564960 - RNA, 14 nt, Homo sapiens
gcuuuccucaaaaa

SEQ ID NO: 1564961 - RNA, 14 nt, Homo sapiens
gcuuuccuucaucu

SEQ ID NO: 1564962 - RNA, 23 nt, Homo sapiens
gcuuucuaugcuguuuguaguga

SEQ ID NO: 1564963 - RNA, 17 nt, Homo sapiens
gcuuugaaaaaucucau

SEQ ID NO: 1564964 - RNA, 12 nt, Homo sapiens
gcuuugcagcug

SEQ ID NO: 1564965 - RNA, 16 nt, Homo sapiens
gcuuugguuaauacau

SEQ ID NO: 1564966 - RNA, 21 nt, Homo sapiens
gcuuugguucucugauuugua

SEQ ID NO: 1564967 - RNA, 13 nt, Homo sapiens
gcuuuguacuugu

SEQ ID NO: 1564968 - RNA, 23 nt, Homo sapiens
gcuuuguauucaaaaauuaucua

SEQ ID NO: 1564969 - RNA, 18 nt, Homo sapiens
gcuuuguuuacucucuuc

SEQ ID NO: 1564970 - RNA, 17 nt, Homo sapiens
gcuuuucagugauacuc

SEQ ID NO: 1564971 - RNA, 14 nt, Homo sapiens
gcuuuucuggaauu

SEQ ID NO: 1564972 - RNA, 13 nt, Homo sapiens
gcuuuucuguauu

SEQ ID NO: 1564973 - RNA, 16 nt, Homo sapiens
gcuuuugcuugcaaug

SEQ ID NO: 1564974 - RNA, 15 nt, Homo sapiens
ggaaaacaagcauuc

SEQ ID NO: 1564975 - RNA, 14 nt, Homo sapiens
ggaaaacagcuauu

SEQ ID NO: 1564976 - RNA, 21 nt, Homo sapiens
ggaaaagcauuuuucaauaua

SEQ ID NO: 1564977 - RNA, 12 nt, Homo sapiens
ggaaaauggagc

SEQ ID NO: 1564978 - RNA, 16 nt, Homo sapiens
ggaaagagacugucau

SEQ ID NO: 1564979 - RNA, 20 nt, Homo sapiens
ggaaagagagcaccacguga

SEQ ID NO: 1564980 - RNA, 23 nt, Homo sapiens
ggaaagaggcucuggacagcaga

SEQ ID NO: 1564981 - RNA, 13 nt, Homo sapiens
ggaaagaugugaa

SEQ ID NO: 1564982 - RNA, 23 nt, Homo sapiens
ggaaaggccccaaucuugcccac

SEQ ID NO: 1564983 - RNA, 20 nt, Homo sapiens
ggaaauagaaagaagccaua

SEQ ID NO: 1564984 - RNA, 13 nt, Homo sapiens
ggaaaucucuauu

SEQ ID NO: 1564985 - RNA, 18 nt, Homo sapiens
ggaaaugguggugcuuua

SEQ ID NO: 1564986 - RNA, 19 nt, Homo sapiens
ggaaauuccuaacuuugcc

SEQ ID NO: 1564987 - RNA, 17 nt, Homo sapiens
ggaaauugagguccaug

SEQ ID NO: 1564988 - RNA, 18 nt, Homo sapiens
ggaaauugcaguaacaaa

SEQ ID NO: 1564989 - RNA, 24 nt, Homo sapiens
ggaacacaggcccagaugacaucc

SEQ ID NO: 1564990 - RNA, 18 nt, Homo sapiens
ggaacagauuucaaaaaa

SEQ ID NO: 1564991 - RNA, 20 nt, Homo sapiens
ggaaccauguauaugagcuu

SEQ ID NO: 1564992 - RNA, 16 nt, Homo sapiens
ggaaccuguccaguuu

SEQ ID NO: 1564993 - RNA, 23 nt, Homo sapiens
ggaacuagaaagaaggacccaga

SEQ ID NO: 1564994 - RNA, 23 nt, Homo sapiens
ggaacugcguuaugaagagcuaa

SEQ ID NO: 1564995 - RNA, 13 nt, Homo sapiens
ggaacuggcaaaa

SEQ ID NO: 1564996 - RNA, 18 nt, Homo sapiens
ggaagaaauggcuaugaa

SEQ ID NO: 1564997 - RNA, 17 nt, Homo sapiens
ggaagaauccaguauua

SEQ ID NO: 1564998 - RNA, 12 nt, Homo sapiens
ggaagacugcuc

SEQ ID NO: 1564999 - RNA, 17 nt, Homo sapiens
ggaagaggcuacagggc

SEQ ID NO: 1565000 - RNA, 17 nt, Homo sapiens
ggaagauuugcccauuu

SEQ ID NO: 1565001 - RNA, 20 nt, Homo sapiens
ggaagccaccucaccaagga

SEQ ID NO: 1565002 - RNA, 11 nt, Homo sapiens
ggaagccagag

SEQ ID NO: 1565003 - RNA, 13 nt, Homo sapiens
ggaagggucccuu

SEQ ID NO: 1565004 - RNA, 14 nt, Homo sapiens
ggaagggucccuuu

SEQ ID NO: 1565005 - RNA, 23 nt, Homo sapiens
ggaagucaucucauuccacuguu

SEQ ID NO: 1565006 - RNA, 16 nt, Homo sapiens
ggaauaauauucaaua

SEQ ID NO: 1565007 - RNA, 13 nt, Homo sapiens
ggaauacuggcca

SEQ ID NO: 1565008 - RNA, 19 nt, Homo sapiens
ggaauacuggccaugccug

SEQ ID NO: 1565009 - RNA, 19 nt, Homo sapiens
ggaauaucaucugucauua

SEQ ID NO: 1565010 - RNA, 22 nt, Homo sapiens
ggaaugacuuggguuuaacaag

SEQ ID NO: 1565011 - RNA, 21 nt, Homo sapiens
ggaaugcucccagcugugcug

SEQ ID NO: 1565012 - RNA, 20 nt, Homo sapiens
ggaauuacgugcucuguggg

SEQ ID NO: 1565013 - RNA, 15 nt, Homo sapiens
ggaauugauuugcau

SEQ ID NO: 1565014 - RNA, 20 nt, Homo sapiens
ggaauuuccucuauugaugu

SEQ ID NO: 1565015 - RNA, 18 nt, Homo sapiens
ggaauuucuuaacuucuu

SEQ ID NO: 1565016 - RNA, 23 nt, Homo sapiens
ggacaaagaauuccaaagcaaaa

SEQ ID NO: 1565017 - RNA, 21 nt, Homo sapiens
ggacaaccaccaggugucaaa

SEQ ID NO: 1565018 - RNA, 16 nt, Homo sapiens
ggacaaccucauuuua

SEQ ID NO: 1565019 - RNA, 23 nt, Homo sapiens
ggacaagacaggcagagaucuau

SEQ ID NO: 1565020 - RNA, 22 nt, Homo sapiens
ggacaaggagugugaccacuga

SEQ ID NO: 1565021 - RNA, 15 nt, Homo sapiens
ggacaccaagccuug

SEQ ID NO: 1565022 - RNA, 12 nt, Homo sapiens
ggacaccucuca

SEQ ID NO: 1565023 - RNA, 19 nt, Homo sapiens
ggacacuguccaugaagca

SEQ ID NO: 1565024 - RNA, 16 nt, Homo sapiens
ggacagccaccaagaa

SEQ ID NO: 1565025 - RNA, 13 nt, Homo sapiens
ggacagcccuucc

SEQ ID NO: 1565026 - RNA, 15 nt, Homo sapiens
ggacagcccuuccuc

SEQ ID NO: 1565027 - RNA, 24 nt, Homo sapiens
ggacagcuccuggaccaggcccau

SEQ ID NO: 1565028 - RNA, 15 nt, Homo sapiens
ggacaggcaggccag

SEQ ID NO: 1565029 - RNA, 16 nt, Homo sapiens
ggacaguaaacacucc

SEQ ID NO: 1565030 - RNA, 20 nt, Homo sapiens
ggacauuucucaagggccau

SEQ ID NO: 1565031 - RNA, 14 nt, Homo sapiens
ggaccaccaaugga

SEQ ID NO: 1565032 - RNA, 21 nt, Homo sapiens
ggaccaccguucagucauuuu

SEQ ID NO: 1565033 - RNA, 22 nt, Homo sapiens
ggaccacuccagguggaacaaa

SEQ ID NO: 1565034 - RNA, 16 nt, Homo sapiens
ggaccagcccauuggc

SEQ ID NO: 1565035 - RNA, 12 nt, Homo sapiens
ggaccagggaug

SEQ ID NO: 1565036 - RNA, 15 nt, Homo sapiens
ggaccaucacugaga

SEQ ID NO: 1565037 - RNA, 18 nt, Homo sapiens
ggaccauuuuuacaucca

SEQ ID NO: 1565038 - RNA, 23 nt, Homo sapiens
ggaccccgggagacucaaaggga

SEQ ID NO: 1565039 - RNA, 14 nt, Homo sapiens
ggaccggggacccu

SEQ ID NO: 1565040 - RNA, 15 nt, Homo sapiens
ggaccugacuguggg

SEQ ID NO: 1565041 - RNA, 23 nt, Homo sapiens
ggaccuggcgugcucagacccaa

SEQ ID NO: 1565042 - RNA, 15 nt, Homo sapiens
ggacgaugagacuuu

SEQ ID NO: 1565043 - RNA, 23 nt, Homo sapiens
ggacgccugcaggagagagcagc

SEQ ID NO: 1565044 - RNA, 17 nt, Homo sapiens
ggacuaaaugaucucug

SEQ ID NO: 1565045 - RNA, 21 nt, Homo sapiens
ggacuacacaauacaguauua

SEQ ID NO: 1565046 - RNA, 22 nt, Homo sapiens
ggacuacaggcucaugccauca

SEQ ID NO: 1565047 - RNA, 16 nt, Homo sapiens
ggacuaugaaaagcua

SEQ ID NO: 1565048 - RNA, 20 nt, Homo sapiens
ggacucgccuguaaucucac

SEQ ID NO: 1565049 - RNA, 13 nt, Homo sapiens
ggacucuuccacc

SEQ ID NO: 1565050 - RNA, 17 nt, Homo sapiens
ggacugaaugugccuaa

SEQ ID NO: 1565051 - RNA, 14 nt, Homo sapiens
ggacugacauuucu

SEQ ID NO: 1565052 - RNA, 13 nt, Homo sapiens
ggacugugccugg

SEQ ID NO: 1565053 - RNA, 16 nt, Homo sapiens
ggacuucugcagcuau

SEQ ID NO: 1565054 - RNA, 11 nt, Homo sapiens
ggacuugccuc

SEQ ID NO: 1565055 - RNA, 18 nt, Homo sapiens
ggagaagagcuguucaca

SEQ ID NO: 1565056 - RNA, 16 nt, Homo sapiens
ggagaaucacuugaac

SEQ ID NO: 1565057 - RNA, 13 nt, Homo sapiens
ggagacauaucac

SEQ ID NO: 1565058 - RNA, 21 nt, Homo sapiens
ggagacucaccucugccucaa

SEQ ID NO: 1565059 - RNA, 15 nt, Homo sapiens
ggagaggucucagug

SEQ ID NO: 1565060 - RNA, 14 nt, Homo sapiens
ggagaguacuuugg

SEQ ID NO: 1565061 - RNA, 14 nt, Homo sapiens
ggagauacagugga

SEQ ID NO: 1565062 - RNA, 23 nt, Homo sapiens
ggagaugccacuucucacucacc

SEQ ID NO: 1565063 - RNA, 23 nt, Homo sapiens
ggagcacugcguuuuccuagcug

SEQ ID NO: 1565064 - RNA, 21 nt, Homo sapiens
ggagcaggaccuacuaggaga

SEQ ID NO: 1565065 - RNA, 12 nt, Homo sapiens
ggagcccaguga

SEQ ID NO: 1565066 - RNA, 16 nt, Homo sapiens
guaggaugaaucauau

SEQ ID NO: 1565067 - RNA, 21 nt, Homo sapiens
guaggcuuuguauucaaaaau

SEQ ID NO: 1565068 - RNA, 16 nt, Homo sapiens
guagguggaucaccug

SEQ ID NO: 1565069 - RNA, 24 nt, Homo sapiens
guaguaauuuauugucugucuaca

SEQ ID NO: 1565070 - RNA, 18 nt, Homo sapiens
guagugauggaguuccuu

SEQ ID NO: 1565071 - RNA, 22 nt, Homo sapiens
guaguguccccagccuaccucu

SEQ ID NO: 1565072 - RNA, 16 nt, Homo sapiens
guaguuauucugccuu

SEQ ID NO: 1565073 - RNA, 13 nt, Homo sapiens
guaguucucagga

SEQ ID NO: 1565074 - RNA, 22 nt, Homo sapiens
guaguugcaaagagacauuuca

SEQ ID NO: 1565075 - RNA, 16 nt, Homo sapiens
guaguuggcagaaaua

SEQ ID NO: 1565076 - RNA, 19 nt, Homo sapiens
guauaaaaauuaucaaaaa

SEQ ID NO: 1565077 - RNA, 14 nt, Homo sapiens
guauaagcaucugc

SEQ ID NO: 1565078 - RNA, 15 nt, Homo sapiens
guauaauagagauaa

SEQ ID NO: 1565079 - RNA, 15 nt, Homo sapiens
guauacaaugcacuu

SEQ ID NO: 1565080 - RNA, 11 nt, Homo sapiens
guauacuauag

SEQ ID NO: 1565081 - RNA, 20 nt, Homo sapiens
guauaggccaggcacagugg

SEQ ID NO: 1565082 - RNA, 14 nt, Homo sapiens
guauaguggaucca

SEQ ID NO: 1565083 - RNA, 15 nt, Homo sapiens
guauaugcaugcuga

SEQ ID NO: 1565084 - RNA, 22 nt, Homo sapiens
guauauggacacuacacugggg

SEQ ID NO: 1565085 - RNA, 14 nt, Homo sapiens
guauauuacaccaa

SEQ ID NO: 1565086 - RNA, 14 nt, Homo sapiens
guaucacacuguau

SEQ ID NO: 1565087 - RNA, 12 nt, Homo sapiens
guaucacagugu

SEQ ID NO: 1565088 - RNA, 22 nt, Homo sapiens
guaucacugguccaccuccuga

SEQ ID NO: 1565089 - RNA, 12 nt, Homo sapiens
guaucauucaac

SEQ ID NO: 1565090 - RNA, 23 nt, Homo sapiens
guauccaugcaccuaccuuagaa

SEQ ID NO: 1565091 - RNA, 23 nt, Homo sapiens
guaucccugaggaaaaguccaca

SEQ ID NO: 1565092 - RNA, 18 nt, Homo sapiens
guaucuauuuguacaauu

SEQ ID NO: 1565093 - RNA, 17 nt, Homo sapiens
guaucucaguaccccau

SEQ ID NO: 1565094 - RNA, 20 nt, Homo sapiens
guaucuuuuuuaaacuguaa

SEQ ID NO: 1565095 - RNA, 15 nt, Homo sapiens
guaugcaugggaugu

SEQ ID NO: 1565096 - RNA, 21 nt, Homo sapiens
guaugcauucuuuauagugaa

SEQ ID NO: 1565097 - RNA, 17 nt, Homo sapiens
guaugcauugauuuaau

SEQ ID NO: 1565098 - RNA, 19 nt, Homo sapiens
guaugcauuuuauacaugu

SEQ ID NO: 1565099 - RNA, 21 nt, Homo sapiens
guaugcugauuuacuacuuau

SEQ ID NO: 1565100 - RNA, 18 nt, Homo sapiens
guaugcuggccagcaccc

SEQ ID NO: 1565101 - RNA, 14 nt, Homo sapiens
guauggauuuccag

SEQ ID NO: 1565102 - RNA, 14 nt, Homo sapiens
guaugguacaucua

SEQ ID NO: 1565103 - RNA, 19 nt, Homo sapiens
guauguaaaagaaaaucca

SEQ ID NO: 1565104 - RNA, 14 nt, Homo sapiens
guauuaaaagcuaa

SEQ ID NO: 1565105 - RNA, 16 nt, Homo sapiens
guauuaacuauuggua

SEQ ID NO: 1565106 - RNA, 13 nt, Homo sapiens
guauuacuuccuc

SEQ ID NO: 1565107 - RNA, 18 nt, Homo sapiens
guauuagauaucaauguu

SEQ ID NO: 1565108 - RNA, 19 nt, Homo sapiens
guauucuauuugguuagaa

SEQ ID NO: 1565109 - RNA, 17 nt, Homo sapiens
guauucuuaaaaugcaa

SEQ ID NO: 1565110 - RNA, 19 nt, Homo sapiens
guauugauuuuaaauggau

SEQ ID NO: 1565111 - RNA, 16 nt, Homo sapiens
guauugugcacuguau

SEQ ID NO: 1565112 - RNA, 17 nt, Homo sapiens
guauuuaaggagaacca

SEQ ID NO: 1565113 - RNA, 21 nt, Homo sapiens
guauuuaauuguaaacuguac

SEQ ID NO: 1565114 - RNA, 17 nt, Homo sapiens
guauuuugguacuguga

SEQ ID NO: 1565115 - RNA, 18 nt, Homo sapiens
guauuuugguacugugau

SEQ ID NO: 1565116 - RNA, 14 nt, Homo sapiens
gucaaaaggugccu

SEQ ID NO: 1565117 - RNA, 22 nt, Homo sapiens
gucaaaauaaagauucucacau

SEQ ID NO: 1565118 - RNA, 18 nt, Homo sapiens
gucaaauaaacacugugu

SEQ ID NO: 1565119 - RNA, 16 nt, Homo sapiens
gucaacauuuccaaaa

SEQ ID NO: 1565120 - RNA, 19 nt, Homo sapiens
gucaaccugccugacauuu

SEQ ID NO: 1565121 - RNA, 22 nt, Homo sapiens
gucaacuggagugcucucucag

SEQ ID NO: 1565122 - RNA, 20 nt, Homo sapiens
gucaagaucagccugggcaa

SEQ ID NO: 1565123 - RNA, 20 nt, Homo sapiens
gucaagcuguugaagucuca

SEQ ID NO: 1565124 - RNA, 22 nt, Homo sapiens
gucaagcuguugaagucucagg

SEQ ID NO: 1565125 - RNA, 18 nt, Homo sapiens
gucaagugggaucuguca

SEQ ID NO: 1565126 - RNA, 15 nt, Homo sapiens
gucaauagcaugcaa

SEQ ID NO: 1565127 - RNA, 21 nt, Homo sapiens
gucaauaguauuaacuauuag

SEQ ID NO: 1565128 - RNA, 18 nt, Homo sapiens
gucaauccccucauucag

SEQ ID NO: 1565129 - RNA, 18 nt, Homo sapiens
gucaaugcaggacaacuc

SEQ ID NO: 1565130 - RNA, 22 nt, Homo sapiens
gucaauuaaaaugcccauuugu

SEQ ID NO: 1565131 - RNA, 14 nt, Homo sapiens
gucacagccaugaa

SEQ ID NO: 1565132 - RNA, 19 nt, Homo sapiens
gucacagccuccucugucu

SEQ ID NO: 1565133 - RNA, 13 nt, Homo sapiens
gucacagcuuugu

SEQ ID NO: 1565134 - RNA, 13 nt, Homo sapiens
gucacaugaccca

SEQ ID NO: 1565135 - RNA, 18 nt, Homo sapiens
gucaccagcuaucuguca

SEQ ID NO: 1565136 - RNA, 19 nt, Homo sapiens
gucacccaacucaaggaca

SEQ ID NO: 1565137 - RNA, 20 nt, Homo sapiens
gucacccaacucaaggacag

SEQ ID NO: 1565138 - RNA, 22 nt, Homo sapiens
gucacccaggcuggagugcggu

SEQ ID NO: 1565139 - RNA, 10 nt, Homo sapiens
gucacuggaa

SEQ ID NO: 1565140 - RNA, 19 nt, Homo sapiens
gucacuggcccaaccagaa

SEQ ID NO: 1565141 - RNA, 12 nt, Homo sapiens
gucacugucuca

SEQ ID NO: 1565142 - RNA, 17 nt, Homo sapiens
gucagaacccugccaug

SEQ ID NO: 1565143 - RNA, 13 nt, Homo sapiens
gucagaacuagaa

SEQ ID NO: 1565144 - RNA, 23 nt, Homo sapiens
gucagaagaguugugcacgcaga

SEQ ID NO: 1565145 - RNA, 22 nt, Homo sapiens
gucagauguacauagagaucua

SEQ ID NO: 1565146 - RNA, 12 nt, Homo sapiens
gucagaugucac

SEQ ID NO: 1565147 - RNA, 12 nt, Homo sapiens
gucagcauguac

SEQ ID NO: 1565148 - RNA, 18 nt, Homo sapiens
gucagcauguacuccccu

SEQ ID NO: 1565149 - RNA, 13 nt, Homo sapiens
gucagccacuguu

SEQ ID NO: 1565150 - RNA, 15 nt, Homo sapiens
gucagcuucucccaa

SEQ ID NO: 1565151 - RNA, 18 nt, Homo sapiens
gucaggaguuccagacca

SEQ ID NO: 1565152 - RNA, 13 nt, Homo sapiens
gucaggccaucaa

SEQ ID NO: 1565153 - RNA, 17 nt, Homo sapiens
gucagggaccugcugcu

SEQ ID NO: 1565154 - RNA, 16 nt, Homo sapiens
gucaguggccaggugc

SEQ ID NO: 1565155 - RNA, 18 nt, Homo sapiens
gucaguuuuaggguugcc

SEQ ID NO: 1565156 - RNA, 18 nt, Homo sapiens
gucauaaacacugcauaa

SEQ ID NO: 1565157 - RNA, 12 nt, Homo sapiens
gucaucacccag

SEQ ID NO: 1565158 - RNA, 19 nt, Homo sapiens
gucaucacuccucugucau

SEQ ID NO: 1565159 - RNA, 20 nt, Homo sapiens
gucaucacuccucugucaua

SEQ ID NO: 1565160 - RNA, 13 nt, Homo sapiens
gucaucagauuau

SEQ ID NO: 1565161 - RNA, 19 nt, Homo sapiens
gucaucaucacccuuucau

SEQ ID NO: 1565162 - RNA, 21 nt, Homo sapiens
gucauccauauuugcuaagaa

SEQ ID NO: 1565163 - RNA, 15 nt, Homo sapiens
gucaucuagaauuca

SEQ ID NO: 1565164 - RNA, 14 nt, Homo sapiens
gucauggaggccaa

SEQ ID NO: 1565165 - RNA, 19 nt, Homo sapiens
gucauggaggccaagaacu

SEQ ID NO: 1565166 - RNA, 13 nt, Homo sapiens
gucauggaugucc

SEQ ID NO: 1565167 - RNA, 13 nt, Homo sapiens
gucauuaacccau

SEQ ID NO: 1565168 - RNA, 21 nt, Homo sapiens
gucauuauuuuuguuagcaaa

SEQ ID NO: 1565169 - RNA, 17 nt, Homo sapiens
gucauugcaccuaucuc

SEQ ID NO: 1565170 - RNA, 14 nt, Homo sapiens
gucauuucauucca

SEQ ID NO: 1565171 - RNA, 14 nt, Homo sapiens
gucauuugugcaag

SEQ ID NO: 1565172 - RNA, 12 nt, Homo sapiens
guccaaaggaca

SEQ ID NO: 1565173 - RNA, 18 nt, Homo sapiens
guccacagacaucuuuca

SEQ ID NO: 1565174 - RNA, 13 nt, Homo sapiens
guccaccaugcuc

SEQ ID NO: 1565175 - RNA, 19 nt, Homo sapiens
guccacuccuccuacugua

SEQ ID NO: 1565176 - RNA, 17 nt, Homo sapiens
guccaggaauggugcuu

SEQ ID NO: 1565177 - RNA, 16 nt, Homo sapiens
guccaggcacugagau

SEQ ID NO: 1565178 - RNA, 23 nt, Homo sapiens
guccaucuucuuuauacaaugac

SEQ ID NO: 1565179 - RNA, 18 nt, Homo sapiens
guccaugaagcacugagc

SEQ ID NO: 1565180 - RNA, 14 nt, Homo sapiens
gucccaaccccagu

SEQ ID NO: 1565181 - RNA, 19 nt, Homo sapiens
gucccagccccuccucccu

SEQ ID NO: 1565182 - RNA, 22 nt, Homo sapiens
gucccagccccuccucccucag

SEQ ID NO: 1565183 - RNA, 15 nt, Homo sapiens
gucccaggcuuccca

SEQ ID NO: 1565184 - RNA, 17 nt, Homo sapiens
guccccacgaacuggcc

SEQ ID NO: 1565185 - RNA, 17 nt, Homo sapiens
ucaaaacugcacuguca

SEQ ID NO: 1565186 - RNA, 16 nt, Homo sapiens
ucaaaagauccuucau

SEQ ID NO: 1565187 - RNA, 12 nt, Homo sapiens
ucaaaaggugcc

SEQ ID NO: 1565188 - RNA, 23 nt, Homo sapiens
ucaaaauaaaaaguaaugacuua

SEQ ID NO: 1565189 - RNA, 15 nt, Homo sapiens
ucaaaauacaucaaa

SEQ ID NO: 1565190 - RNA, 18 nt, Homo sapiens
ucaaaaucugcacaguca

SEQ ID NO: 1565191 - RNA, 13 nt, Homo sapiens
ucaaaaucuguga

SEQ ID NO: 1565192 - RNA, 15 nt, Homo sapiens
ucaaaaucuuuccaa

SEQ ID NO: 1565193 - RNA, 13 nt, Homo sapiens
ucaaaaugcuuca

SEQ ID NO: 1565194 - RNA, 20 nt, Homo sapiens
ucaaacaagaaacauuucag

SEQ ID NO: 1565195 - RNA, 17 nt, Homo sapiens
ucaaacauuauucucaa

SEQ ID NO: 1565196 - RNA, 17 nt, Homo sapiens
ucaaacccagucucaga

SEQ ID NO: 1565197 - RNA, 13 nt, Homo sapiens
ucaaacucuggug

SEQ ID NO: 1565198 - RNA, 12 nt, Homo sapiens
ucaaacuguaaa

SEQ ID NO: 1565199 - RNA, 13 nt, Homo sapiens
ucaaacuguaaaa

SEQ ID NO: 1565200 - RNA, 14 nt, Homo sapiens
ucaaacuguaaaaa

SEQ ID NO: 1565201 - RNA, 22 nt, Homo sapiens
ucaaacuguaaaaauaacauaa

SEQ ID NO: 1565202 - RNA, 14 nt, Homo sapiens
ucaaagaaguacuu

SEQ ID NO: 1565203 - RNA, 23 nt, Homo sapiens
ucaaagaaguacuuuauugcaac

SEQ ID NO: 1565204 - RNA, 17 nt, Homo sapiens
ucaaagaggaaccagga

SEQ ID NO: 1565205 - RNA, 20 nt, Homo sapiens
ucaaagaugccccauuccuu

SEQ ID NO: 1565206 - RNA, 10 nt, Homo sapiens
ucaaagccag

SEQ ID NO: 1565207 - RNA, 20 nt, Homo sapiens
ucaaaggaaaauaguaaugu

SEQ ID NO: 1565208 - RNA, 15 nt, Homo sapiens
ucaaaggaagacuug

SEQ ID NO: 1565209 - RNA, 13 nt, Homo sapiens
ucaaaguguaaca

SEQ ID NO: 1565210 - RNA, 21 nt, Homo sapiens
ucaaaguguuuuucaagccug

SEQ ID NO: 1565211 - RNA, 13 nt, Homo sapiens
ucaaauacaugca

SEQ ID NO: 1565212 - RNA, 20 nt, Homo sapiens
ucaaauagaaccacuaugaa

SEQ ID NO: 1565213 - RNA, 22 nt, Homo sapiens
ucaaauaggcuauuaaaaaagu

SEQ ID NO: 1565214 - RNA, 18 nt, Homo sapiens
ucaaaucuguaauuacca

SEQ ID NO: 1565215 - RNA, 16 nt, Homo sapiens
ucaaaugaaacaggga

SEQ ID NO: 1565216 - RNA, 20 nt, Homo sapiens
ucaaauuaagauucucugcc

SEQ ID NO: 1565217 - RNA, 19 nt, Homo sapiens
ucaaauucaaauaaaaauc

SEQ ID NO: 1565218 - RNA, 19 nt, Homo sapiens
ucaaauucuucugaacuca

SEQ ID NO: 1565219 - RNA, 22 nt, Homo sapiens
ucaaauuguccuauugugacuc

SEQ ID NO: 1565220 - RNA, 21 nt, Homo sapiens
ucaacaaaauggucauccaaa

SEQ ID NO: 1565221 - RNA, 15 nt, Homo sapiens
ucaacaauuuaucca

SEQ ID NO: 1565222 - RNA, 18 nt, Homo sapiens
ucaacacagguagcacag

SEQ ID NO: 1565223 - RNA, 16 nt, Homo sapiens
ucaacacccaacuguc

SEQ ID NO: 1565224 - RNA, 19 nt, Homo sapiens
ucaacaccuuaauaugcug

SEQ ID NO: 1565225 - RNA, 14 nt, Homo sapiens
ucaacauuaccaaa

SEQ ID NO: 1565226 - RNA, 23 nt, Homo sapiens
ucaacauuccagggaugagccaa

SEQ ID NO: 1565227 - RNA, 18 nt, Homo sapiens
ucaaccugggcaaagccu

SEQ ID NO: 1565228 - RNA, 14 nt, Homo sapiens
ucaacuacucagcu

SEQ ID NO: 1565229 - RNA, 21 nt, Homo sapiens
ucaacuccgugcuuaaccaaa

SEQ ID NO: 1565230 - RNA, 15 nt, Homo sapiens
ucaacuccucccaua

SEQ ID NO: 1565231 - RNA, 19 nt, Homo sapiens
ucaacugaaaaaaacauau

SEQ ID NO: 1565232 - RNA, 11 nt, Homo sapiens
ucaacugccua

SEQ ID NO: 1565233 - RNA, 18 nt, Homo sapiens
ucaacuggcuacugaguc

SEQ ID NO: 1565234 - RNA, 22 nt, Homo sapiens
ucaacuguuucagaaaacauaa

SEQ ID NO: 1565235 - RNA, 17 nt, Homo sapiens
ucaacuuuccucaaauc

SEQ ID NO: 1565236 - RNA, 21 nt, Homo sapiens
ucaacuuucuguuggauucca

SEQ ID NO: 1565237 - RNA, 19 nt, Homo sapiens
ucaacuuuuuauugccuuc

SEQ ID NO: 1565238 - RNA, 17 nt, Homo sapiens
ucaagaaaagaauuaca

SEQ ID NO: 1565239 - RNA, 15 nt, Homo sapiens
ucaagaagacacuuc

SEQ ID NO: 1565240 - RNA, 21 nt, Homo sapiens
ucaagaaucuagaagaugugu

SEQ ID NO: 1565241 - RNA, 22 nt, Homo sapiens
ucaagagaucuuucuuuccaaa

SEQ ID NO: 1565242 - RNA, 18 nt, Homo sapiens
ucaagaguaguuauauaa

SEQ ID NO: 1565243 - RNA, 21 nt, Homo sapiens
ucaagauaauccuagagucuu

SEQ ID NO: 1565244 - RNA, 19 nt, Homo sapiens
ucaagauauauguguauac

SEQ ID NO: 1565245 - RNA, 15 nt, Homo sapiens
ucaagcacacuggaa

SEQ ID NO: 1565246 - RNA, 21 nt, Homo sapiens
ucaagccuccccaguucuacu

SEQ ID NO: 1565247 - RNA, 15 nt, Homo sapiens
ucaagcuagccagag

SEQ ID NO: 1565248 - RNA, 15 nt, Homo sapiens
ucaagcuccccucac

SEQ ID NO: 1565249 - RNA, 23 nt, Homo sapiens
ucaagcuggugcuacuguuugau

SEQ ID NO: 1565250 - RNA, 18 nt, Homo sapiens
ucaaggaggcccacugug

SEQ ID NO: 1565251 - RNA, 20 nt, Homo sapiens
ucaaggaggcccacuguguc

SEQ ID NO: 1565252 - RNA, 22 nt, Homo sapiens
ucaaggauagaaguauaccuga

SEQ ID NO: 1565253 - RNA, 15 nt, Homo sapiens
ucaagggcacuguga

SEQ ID NO: 1565254 - RNA, 15 nt, Homo sapiens
ucaaggguauuuuaa

SEQ ID NO: 1565255 - RNA, 16 nt, Homo sapiens
ucaagguuuaaccuua

SEQ ID NO: 1565256 - RNA, 16 nt, Homo sapiens
ucaaguaauugugaaa

SEQ ID NO: 1565257 - RNA, 13 nt, Homo sapiens
ucaaguaccaaaa

SEQ ID NO: 1565258 - RNA, 15 nt, Homo sapiens
ucaaguccaucugac

SEQ ID NO: 1565259 - RNA, 16 nt, Homo sapiens
ucaaguccgacaacac

SEQ ID NO: 1565260 - RNA, 19 nt, Homo sapiens
ucaagugggaucugucaca

SEQ ID NO: 1565261 - RNA, 14 nt, Homo sapiens
ucaaguguauuuga

SEQ ID NO: 1565262 - RNA, 18 nt, Homo sapiens
ucaauaaaaccacuguac

SEQ ID NO: 1565263 - RNA, 14 nt, Homo sapiens
ucaauaaacauuga

SEQ ID NO: 1565264 - RNA, 15 nt, Homo sapiens
ucaauacaaccagcc

SEQ ID NO: 1565265 - RNA, 19 nt, Homo sapiens
ucaauacaaccagcccaac

SEQ ID NO: 1565266 - RNA, 12 nt, Homo sapiens
ucaauagcuguc

SEQ ID NO: 1565267 - RNA, 13 nt, Homo sapiens
ucaauaguauuaa

SEQ ID NO: 1565268 - RNA, 19 nt, Homo sapiens
ucaauaguguccuaugcaa

SEQ ID NO: 1565269 - RNA, 18 nt, Homo sapiens
ucaauaugcaagcagcuu

SEQ ID NO: 1565270 - RNA, 18 nt, Homo sapiens
ucaaucauaauaccugcu

SEQ ID NO: 1565271 - RNA, 17 nt, Homo sapiens
ucaauccuaucacaguc

SEQ ID NO: 1565272 - RNA, 17 nt, Homo sapiens
ucaaucuccuaaccuug

SEQ ID NO: 1565273 - RNA, 21 nt, Homo sapiens
ucaaucugcaguuuaacaaaa

SEQ ID NO: 1565274 - RNA, 22 nt, Homo sapiens
ucaaucugcaguuuaacaaaau

SEQ ID NO: 1565275 - RNA, 17 nt, Homo sapiens
ucaaucuggauucauau

SEQ ID NO: 1565276 - RNA, 20 nt, Homo sapiens
ucaaucuggcuucugcauua

SEQ ID NO: 1565277 - RNA, 23 nt, Homo sapiens
ucaaucuguccguucacaugugu

SEQ ID NO: 1565278 - RNA, 20 nt, Homo sapiens
ucaaugaauuuuauaaucug

SEQ ID NO: 1565279 - RNA, 17 nt, Homo sapiens
ucaauguccuacugaga

SEQ ID NO: 1565280 - RNA, 20 nt, Homo sapiens
ucaauguuuguucauuacuu

SEQ ID NO: 1565281 - RNA, 15 nt, Homo sapiens
ucaauuauuugcaua

SEQ ID NO: 1565282 - RNA, 12 nt, Homo sapiens
ucaauuuacuua

SEQ ID NO: 1565283 - RNA, 20 nt, Homo sapiens
ucacaaaaaaaguaauugua

SEQ ID NO: 1565284 - RNA, 20 nt, Homo sapiens
ucacaaaggcugacauucac

SEQ ID NO: 1565285 - RNA, 17 nt, Homo sapiens
ucacaaauaaacauaau

SEQ ID NO: 1565286 - RNA, 15 nt, Homo sapiens
ucacaauacaguaag

SEQ ID NO: 1565287 - RNA, 19 nt, Homo sapiens
ucacaauacaguaaguaaa

SEQ ID NO: 1565288 - RNA, 21 nt, Homo sapiens
ucacaaucaucaucauucuca

SEQ ID NO: 1565289 - RNA, 15 nt, Homo sapiens
ucacacacacaaaaa

SEQ ID NO: 1565290 - RNA, 11 nt, Homo sapiens
ucacacacuga

SEQ ID NO: 1565291 - RNA, 11 nt, Homo sapiens
ucacacagugu

SEQ ID NO: 1565292 - RNA, 21 nt, Homo sapiens
ucacacuguauauaaacauau

SEQ ID NO: 1565293 - RNA, 20 nt, Homo sapiens
ucacacuuuguaauuugcaa

SEQ ID NO: 1565294 - RNA, 21 nt, Homo sapiens
ucacacuuuguaauuugcaaa

SEQ ID NO: 1565295 - RNA, 21 nt, Homo sapiens
ucacagaaugacugacaaaga

SEQ ID NO: 1565296 - RNA, 17 nt, Homo sapiens
ucacagacuucuggccu

SEQ ID NO: 1565297 - RNA, 16 nt, Homo sapiens
ucacagagugagacuc

SEQ ID NO: 1565298 - RNA, 23 nt, Homo sapiens
ucacagcugacuccaagcugcau

SEQ ID NO: 1565299 - RNA, 22 nt, Homo sapiens
ucacaguaaagaguacacucag

SEQ ID NO: 1565300 - RNA, 17 nt, Homo sapiens
ucacagucaauggaucc

SEQ ID NO: 1565301 - RNA, 21 nt, Homo sapiens
ucacaguguuuuuauugcucg

SEQ ID NO: 1565302 - RNA, 20 nt, Homo sapiens
ucacauacaaaucauccauc

SEQ ID NO: 1565303 - RNA, 13 nt, Homo sapiens
uccuaaucauaca

SEQ ID NO: 1565304 - RNA, 16 nt, Homo sapiens
uccuacacuugagaug

SEQ ID NO: 1565305 - RNA, 19 nt, Homo sapiens
uccuacagcacuacugggu

SEQ ID NO: 1565306 - RNA, 17 nt, Homo sapiens
uccuacccacaccucug

SEQ ID NO: 1565307 - RNA, 23 nt, Homo sapiens
uccuaccuugugcuuagcuuuca

SEQ ID NO: 1565308 - RNA, 16 nt, Homo sapiens
uccuacuuauugccau

SEQ ID NO: 1565309 - RNA, 20 nt, Homo sapiens
uccuacuuauugccaugugg

SEQ ID NO: 1565310 - RNA, 19 nt, Homo sapiens
uccuagcucucccagugaa

SEQ ID NO: 1565311 - RNA, 17 nt, Homo sapiens
uccuagcugugugaaua

SEQ ID NO: 1565312 - RNA, 14 nt, Homo sapiens
uccuagugaaagag

SEQ ID NO: 1565313 - RNA, 13 nt, Homo sapiens
uccuauaagcuua

SEQ ID NO: 1565314 - RNA, 15 nt, Homo sapiens
uccuauaagcuuaaa

SEQ ID NO: 1565315 - RNA, 18 nt, Homo sapiens
uccuaucaccuauuucca

SEQ ID NO: 1565316 - RNA, 24 nt, Homo sapiens
uccuaucaccucgagaaguaauua

SEQ ID NO: 1565317 - RNA, 12 nt, Homo sapiens
uccuaucugugu

SEQ ID NO: 1565318 - RNA, 12 nt, Homo sapiens
uccuaugcugca

SEQ ID NO: 1565319 - RNA, 17 nt, Homo sapiens
uccuaugcugcaauaca

SEQ ID NO: 1565320 - RNA, 14 nt, Homo sapiens
uccuauuuaucaua

SEQ ID NO: 1565321 - RNA, 15 nt, Homo sapiens
uccucaaaacuggag

SEQ ID NO: 1565322 - RNA, 16 nt, Homo sapiens
uccucaaauacaugca

SEQ ID NO: 1565323 - RNA, 14 nt, Homo sapiens
uccucaaaucaaaa

SEQ ID NO: 1565324 - RNA, 14 nt, Homo sapiens
uccucacaaugagg

SEQ ID NO: 1565325 - RNA, 17 nt, Homo sapiens
uccucagaaaaaacagg

SEQ ID NO: 1565326 - RNA, 17 nt, Homo sapiens
uccucagaucauuauca

SEQ ID NO: 1565327 - RNA, 22 nt, Homo sapiens
uccucaggaaauuagauaaaua

SEQ ID NO: 1565328 - RNA, 21 nt, Homo sapiens
uccucaggguggggggugaca

SEQ ID NO: 1565329 - RNA, 17 nt, Homo sapiens
uccucauccccacaauc

SEQ ID NO: 1565330 - RNA, 14 nt, Homo sapiens
uccucaucugcaaa

SEQ ID NO: 1565331 - RNA, 13 nt, Homo sapiens
uccuccacuggaa

SEQ ID NO: 1565332 - RNA, 17 nt, Homo sapiens
uccuccagagacacuga

SEQ ID NO: 1565333 - RNA, 14 nt, Homo sapiens
uccucccacaaccc

SEQ ID NO: 1565334 - RNA, 17 nt, Homo sapiens
uccucccaggaagccca

SEQ ID NO: 1565335 - RNA, 13 nt, Homo sapiens
uccucccauuucc

SEQ ID NO: 1565336 - RNA, 20 nt, Homo sapiens
uccucccauuucccauuaaa

SEQ ID NO: 1565337 - RNA, 11 nt, Homo sapiens
uccuccccaaa

SEQ ID NO: 1565338 - RNA, 14 nt, Homo sapiens
uccucccccaguuc

SEQ ID NO: 1565339 - RNA, 11 nt, Homo sapiens
uccucccucag

SEQ ID NO: 1565340 - RNA, 13 nt, Homo sapiens
uccuccucauccu

SEQ ID NO: 1565341 - RNA, 17 nt, Homo sapiens
uccuccugcagacaccu

SEQ ID NO: 1565342 - RNA, 20 nt, Homo sapiens
uccuccugcagacaccugga

SEQ ID NO: 1565343 - RNA, 16 nt, Homo sapiens
uccuccugggcuccag

SEQ ID NO: 1565344 - RNA, 21 nt, Homo sapiens
uccuccuuaacccugccaguu

SEQ ID NO: 1565345 - RNA, 23 nt, Homo sapiens
uccuccuuaugacuccauucaaa

SEQ ID NO: 1565346 - RNA, 14 nt, Homo sapiens
uccuccuugcccag

SEQ ID NO: 1565347 - RNA, 11 nt, Homo sapiens
uccucuauucc

SEQ ID NO: 1565348 - RNA, 13 nt, Homo sapiens
uccucuauugaug

SEQ ID NO: 1565349 - RNA, 13 nt, Homo sapiens
uccucucaucccc

SEQ ID NO: 1565350 - RNA, 22 nt, Homo sapiens
uccucucccuugugagucuuca

SEQ ID NO: 1565351 - RNA, 14 nt, Homo sapiens
uccucucugcacac

SEQ ID NO: 1565352 - RNA, 15 nt, Homo sapiens
uccucucuuaggggg

SEQ ID NO: 1565353 - RNA, 19 nt, Homo sapiens
uccucugaaacagcugccu

SEQ ID NO: 1565354 - RNA, 13 nt, Homo sapiens
uccucugacucag

SEQ ID NO: 1565355 - RNA, 15 nt, Homo sapiens
uccucugccaccucc

SEQ ID NO: 1565356 - RNA, 21 nt, Homo sapiens
uccucugccacucccugcugu

SEQ ID NO: 1565357 - RNA, 21 nt, Homo sapiens
uccucuggcuuucccaggaga

SEQ ID NO: 1565358 - RNA, 17 nt, Homo sapiens
uccucugugcaaaggga

SEQ ID NO: 1565359 - RNA, 16 nt, Homo sapiens
uccucuuggugucaua

SEQ ID NO: 1565360 - RNA, 14 nt, Homo sapiens
uccucuugugauuu

SEQ ID NO: 1565361 - RNA, 16 nt, Homo sapiens
uccugaaguuguacuu

SEQ ID NO: 1565362 - RNA, 16 nt, Homo sapiens
uccugaaucugugcaa

SEQ ID NO: 1565363 - RNA, 19 nt, Homo sapiens
uccugagccccucaauccu

SEQ ID NO: 1565364 - RNA, 12 nt, Homo sapiens
uccugcacucua

SEQ ID NO: 1565365 - RNA, 14 nt, Homo sapiens
uccugcauguuaau

SEQ ID NO: 1565366 - RNA, 18 nt, Homo sapiens
uccugccauucuucuggu

SEQ ID NO: 1565367 - RNA, 14 nt, Homo sapiens
uccugcccaaaaug

SEQ ID NO: 1565368 - RNA, 21 nt, Homo sapiens
uccugcccaaacagcuguauu

SEQ ID NO: 1565369 - RNA, 14 nt, Homo sapiens
uccugcucucuauc

SEQ ID NO: 1565370 - RNA, 15 nt, Homo sapiens
uccugcugaaacugc

SEQ ID NO: 1565371 - RNA, 14 nt, Homo sapiens
uccugcugauccag

SEQ ID NO: 1565372 - RNA, 20 nt, Homo sapiens
uccugcugccucccuuucau

SEQ ID NO: 1565373 - RNA, 17 nt, Homo sapiens
uccugcugccucucuuu

SEQ ID NO: 1565374 - RNA, 21 nt, Homo sapiens
uccuggaaggacacagugaug

SEQ ID NO: 1565375 - RNA, 11 nt, Homo sapiens
uccuggaccaa

SEQ ID NO: 1565376 - RNA, 19 nt, Homo sapiens
uccuggaggcacugggaag

SEQ ID NO: 1565377 - RNA, 18 nt, Homo sapiens
uccuggcagggcgccaag

SEQ ID NO: 1565378 - RNA, 17 nt, Homo sapiens
uccuggccucauacaga

SEQ ID NO: 1565379 - RNA, 19 nt, Homo sapiens
uccuggcuaacauggugaa

SEQ ID NO: 1565380 - RNA, 18 nt, Homo sapiens
uccugggacacuccgucu

SEQ ID NO: 1565381 - RNA, 14 nt, Homo sapiens
uccugggaggacag

SEQ ID NO: 1565382 - RNA, 13 nt, Homo sapiens
uccugggcccucu

SEQ ID NO: 1565383 - RNA, 16 nt, Homo sapiens
uccuggguacugaaag

SEQ ID NO: 1565384 - RNA, 17 nt, Homo sapiens
uccugguggauacugua

SEQ ID NO: 1565385 - RNA, 12 nt, Homo sapiens
uccugucuuccc

SEQ ID NO: 1565386 - RNA, 13 nt, Homo sapiens
uccuguguaaaug

SEQ ID NO: 1565387 - RNA, 19 nt, Homo sapiens
uccuguguaacaucugcca

SEQ ID NO: 1565388 - RNA, 21 nt, Homo sapiens
uccuguguaccucacugucca

SEQ ID NO: 1565389 - RNA, 22 nt, Homo sapiens
uccuguguaccucacuguccaa

SEQ ID NO: 1565390 - RNA, 13 nt, Homo sapiens
uccuguguggaag

SEQ ID NO: 1565391 - RNA, 19 nt, Homo sapiens
uccuguguggaagaaggaa

SEQ ID NO: 1565392 - RNA, 17 nt, Homo sapiens
uccuguucacaccagag

SEQ ID NO: 1565393 - RNA, 20 nt, Homo sapiens
uccuguucgguuccagacac

SEQ ID NO: 1565394 - RNA, 19 nt, Homo sapiens
uccuguuuaaaaaaccaca

SEQ ID NO: 1565395 - RNA, 18 nt, Homo sapiens
uccuguuuuuagugcuga

SEQ ID NO: 1565396 - RNA, 18 nt, Homo sapiens
uccuuaacgcuagagauu

SEQ ID NO: 1565397 - RNA, 12 nt, Homo sapiens
uccuuaaguauu

SEQ ID NO: 1565398 - RNA, 21 nt, Homo sapiens
uccuuacuguuuacaguuuag

SEQ ID NO: 1565399 - RNA, 22 nt, Homo sapiens
uccuuagccuuugucccagaau

SEQ ID NO: 1565400 - RNA, 15 nt, Homo sapiens
uccuuaggaaaaaca

SEQ ID NO: 1565401 - RNA, 14 nt, Homo sapiens
uccuuaucuuuauu

SEQ ID NO: 1565402 - RNA, 13 nt, Homo sapiens
uccuuauguuaag

SEQ ID NO: 1565403 - RNA, 14 nt, Homo sapiens
uccuuauuguucag

SEQ ID NO: 1565404 - RNA, 21 nt, Homo sapiens
uccuuauuuugugugcuuucc

SEQ ID NO: 1565405 - RNA, 17 nt, Homo sapiens
uccuucacacaguucaa

SEQ ID NO: 1565406 - RNA, 20 nt, Homo sapiens
uccuucacucugacaguauu

SEQ ID NO: 1565407 - RNA, 23 nt, Homo sapiens
uccuucaucaugaguucugcuga

SEQ ID NO: 1565408 - RNA, 22 nt, Homo sapiens
uccuucccucucaugacuugca

SEQ ID NO: 1565409 - RNA, 14 nt, Homo sapiens
uccuucccugaugg

SEQ ID NO: 1565410 - RNA, 14 nt, Homo sapiens
uccuucgucuuugc

SEQ ID NO: 1565411 - RNA, 18 nt, Homo sapiens
uccuucuauucuagccug

SEQ ID NO: 1565412 - RNA, 17 nt, Homo sapiens
uccuucuugacauuuau

SEQ ID NO: 1565413 - RNA, 11 nt, Homo sapiens
uccuugaacaa

SEQ ID NO: 1565414 - RNA, 14 nt, Homo sapiens
uccuugcaccugca

SEQ ID NO: 1565415 - RNA, 19 nt, Homo sapiens
uccuugccugaacuccaga

SEQ ID NO: 1565416 - RNA, 22 nt, Homo sapiens
uccuuggaccguaucacugguc

SEQ ID NO: 1565417 - RNA, 15 nt, Homo sapiens
uccuuggccacagac

SEQ ID NO: 1565418 - RNA, 19 nt, Homo sapiens
uccuugugaagaugauaua

SEQ ID NO: 1565419 - RNA, 15 nt, Homo sapiens
uccuuuaacauaggu

SEQ ID NO: 1565420 - RNA, 14 nt, Homo sapiens
uccuuuaccagaug

SEQ ID NO: 1565421 - RNA, 20 nt, Homo sapiens
uccuuuaccuuucagugcag

SEQ ID NO: 1565422 - RNA, 15 nt, Homo sapiens
uccuuucacucugca

SEQ ID NO: 1565423 - RNA, 19 nt, Homo sapiens
ugaacuauuagagcugccu

SEQ ID NO: 1565424 - RNA, 16 nt, Homo sapiens
ugaacucaccauagag

SEQ ID NO: 1565425 - RNA, 22 nt, Homo sapiens
ugaacucaccauagagacccau

SEQ ID NO: 1565426 - RNA, 16 nt, Homo sapiens
ugaacucacccuggga

SEQ ID NO: 1565427 - RNA, 14 nt, Homo sapiens
ugaacugacaauga

SEQ ID NO: 1565428 - RNA, 23 nt, Homo sapiens
ugaacugcuuuuaaaagugcaca

SEQ ID NO: 1565429 - RNA, 11 nt, Homo sapiens
ugaacuggaag

SEQ ID NO: 1565430 - RNA, 20 nt, Homo sapiens
ugaacugguagaaaaacauc

SEQ ID NO: 1565431 - RNA, 14 nt, Homo sapiens
ugaagaaacuuccc

SEQ ID NO: 1565432 - RNA, 12 nt, Homo sapiens
ugaagaaaggga

SEQ ID NO: 1565433 - RNA, 13 nt, Homo sapiens
ugaagaauguaga

SEQ ID NO: 1565434 - RNA, 22 nt, Homo sapiens
ugaagacaugggugaacuuacu

SEQ ID NO: 1565435 - RNA, 15 nt, Homo sapiens
ugaagacuagaaaau

SEQ ID NO: 1565436 - RNA, 15 nt, Homo sapiens
ugaagagcucuuggc

SEQ ID NO: 1565437 - RNA, 21 nt, Homo sapiens
ugaagaugaaauauauauugu

SEQ ID NO: 1565438 - RNA, 23 nt, Homo sapiens
ugaagaugcagcucacuacccua

SEQ ID NO: 1565439 - RNA, 17 nt, Homo sapiens
ugaagcaaagugcccau

SEQ ID NO: 1565440 - RNA, 17 nt, Homo sapiens
ugaagcacaacucccuu

SEQ ID NO: 1565441 - RNA, 17 nt, Homo sapiens
ugaagcagcacugugag

SEQ ID NO: 1565442 - RNA, 22 nt, Homo sapiens
ugaagccugacucagcuaaugu

SEQ ID NO: 1565443 - RNA, 22 nt, Homo sapiens
ugaagcuuugugaaaacuacug

SEQ ID NO: 1565444 - RNA, 16 nt, Homo sapiens
ugaaggagaaggugcc

SEQ ID NO: 1565445 - RNA, 18 nt, Homo sapiens
ugaaguaaaagagggacc

SEQ ID NO: 1565446 - RNA, 16 nt, Homo sapiens
ugaaguauuacaugau

SEQ ID NO: 1565447 - RNA, 23 nt, Homo sapiens
ugaagucaccccuuucuguccca

SEQ ID NO: 1565448 - RNA, 16 nt, Homo sapiens
ugaaguccuccagaca

SEQ ID NO: 1565449 - RNA, 17 nt, Homo sapiens
ugaaguccuccagacaa

SEQ ID NO: 1565450 - RNA, 18 nt, Homo sapiens
ugaaguuuaauugacuua

SEQ ID NO: 1565451 - RNA, 23 nt, Homo sapiens
ugaauaaaaauagaaaccugaau

SEQ ID NO: 1565452 - RNA, 22 nt, Homo sapiens
ugaauaaaccaucaucuugcca

SEQ ID NO: 1565453 - RNA, 23 nt, Homo sapiens
ugaauaaaugauuaaaaaaucag

SEQ ID NO: 1565454 - RNA, 19 nt, Homo sapiens
ugaauaaauuuucaaaucc

SEQ ID NO: 1565455 - RNA, 14 nt, Homo sapiens
ugaauaacauuuaa

SEQ ID NO: 1565456 - RNA, 22 nt, Homo sapiens
ugaauaaugaaugaaccaucuu

SEQ ID NO: 1565457 - RNA, 13 nt, Homo sapiens
ugaauacacagua

SEQ ID NO: 1565458 - RNA, 18 nt, Homo sapiens
ugaauacaguuacuuaau

SEQ ID NO: 1565459 - RNA, 23 nt, Homo sapiens
ugaauaguuuauuucugugaaag

SEQ ID NO: 1565460 - RNA, 16 nt, Homo sapiens
ugaauauagaugcugg

SEQ ID NO: 1565461 - RNA, 17 nt, Homo sapiens
ugaauaucaugcaaaua

SEQ ID NO: 1565462 - RNA, 20 nt, Homo sapiens
ugaauauggugucuauuaua

SEQ ID NO: 1565463 - RNA, 14 nt, Homo sapiens
ugaaucaagcaaua

SEQ ID NO: 1565464 - RNA, 13 nt, Homo sapiens
ugaaucaaucugg

SEQ ID NO: 1565465 - RNA, 20 nt, Homo sapiens
ugaaucauauucauaugcag

SEQ ID NO: 1565466 - RNA, 21 nt, Homo sapiens
ugaaucugggacugugccugg

SEQ ID NO: 1565467 - RNA, 20 nt, Homo sapiens
ugaaugaacacucuuuugcu

SEQ ID NO: 1565468 - RNA, 16 nt, Homo sapiens
ugaaugauccugucuc

SEQ ID NO: 1565469 - RNA, 14 nt, Homo sapiens
ugaaugaugccuuu

SEQ ID NO: 1565470 - RNA, 15 nt, Homo sapiens
ugaaugcaaaccaua

SEQ ID NO: 1565471 - RNA, 19 nt, Homo sapiens
ugaaugccuaugguggauc

SEQ ID NO: 1565472 - RNA, 15 nt, Homo sapiens
ugaaugccucccuca

SEQ ID NO: 1565473 - RNA, 19 nt, Homo sapiens
ugaaugcuauguucuggga

SEQ ID NO: 1565474 - RNA, 16 nt, Homo sapiens
ugaauggacaggagaa

SEQ ID NO: 1565475 - RNA, 19 nt, Homo sapiens
ugaauggccuucauaucau

SEQ ID NO: 1565476 - RNA, 19 nt, Homo sapiens
ugaaugugccuaauggaga

SEQ ID NO: 1565477 - RNA, 21 nt, Homo sapiens
ugaauguuuuauggaauugaa

SEQ ID NO: 1565478 - RNA, 14 nt, Homo sapiens
ugaauuauuguuau

SEQ ID NO: 1565479 - RNA, 13 nt, Homo sapiens
ugaauucaagaaa

SEQ ID NO: 1565480 - RNA, 15 nt, Homo sapiens
ugaauucuaacauua

SEQ ID NO: 1565481 - RNA, 14 nt, Homo sapiens
ugaauuggcuaugc

SEQ ID NO: 1565482 - RNA, 16 nt, Homo sapiens
ugaauuucaguccuua

SEQ ID NO: 1565483 - RNA, 23 nt, Homo sapiens
ugaauuugaauacugcauuuaca

SEQ ID NO: 1565484 - RNA, 17 nt, Homo sapiens
ugaauuuucaaguaauu

SEQ ID NO: 1565485 - RNA, 16 nt, Homo sapiens
ugacaaaaugacuggc

SEQ ID NO: 1565486 - RNA, 15 nt, Homo sapiens
ugacaaaauuacuua

SEQ ID NO: 1565487 - RNA, 12 nt, Homo sapiens
ugacaacaucgc

SEQ ID NO: 1565488 - RNA, 19 nt, Homo sapiens
ugacaacauuucuauagcc

SEQ ID NO: 1565489 - RNA, 12 nt, Homo sapiens
ugacaaccauua

SEQ ID NO: 1565490 - RNA, 16 nt, Homo sapiens
ugacaaucaucuccaa

SEQ ID NO: 1565491 - RNA, 17 nt, Homo sapiens
ugacaauuuauggaagc

SEQ ID NO: 1565492 - RNA, 18 nt, Homo sapiens
ugacaccacuuagauuua

SEQ ID NO: 1565493 - RNA, 14 nt, Homo sapiens
ugacacccaugcca

SEQ ID NO: 1565494 - RNA, 19 nt, Homo sapiens
ugacacccaugccagagag

SEQ ID NO: 1565495 - RNA, 20 nt, Homo sapiens
ugacaccgugggucauuaca

SEQ ID NO: 1565496 - RNA, 21 nt, Homo sapiens
ugacaccgugggucauuacaa

SEQ ID NO: 1565497 - RNA, 19 nt, Homo sapiens
ugacacucuauaagauucc

SEQ ID NO: 1565498 - RNA, 15 nt, Homo sapiens
ugacacugcucuaac

SEQ ID NO: 1565499 - RNA, 21 nt, Homo sapiens
ugacacuguuaauaguacuau

SEQ ID NO: 1565500 - RNA, 17 nt, Homo sapiens
ugacacuuauagauuga

SEQ ID NO: 1565501 - RNA, 13 nt, Homo sapiens
ugacagacaaaga

SEQ ID NO: 1565502 - RNA, 17 nt, Homo sapiens
ugacagagaugugcaug

SEQ ID NO: 1565503 - RNA, 17 nt, Homo sapiens
ugacagagcgagacucc

SEQ ID NO: 1565504 - RNA, 15 nt, Homo sapiens
ugacagcacuacaaa

SEQ ID NO: 1565505 - RNA, 19 nt, Homo sapiens
ugacaggccugaagauauu

SEQ ID NO: 1565506 - RNA, 22 nt, Homo sapiens
ugacaguaauauuggcauagaa

SEQ ID NO: 1565507 - RNA, 19 nt, Homo sapiens
ugacagucacugcauuugc

SEQ ID NO: 1565508 - RNA, 22 nt, Homo sapiens
ugacagugaagcagcacuguga

SEQ ID NO: 1565509 - RNA, 22 nt, Homo sapiens
ugacaguuaauaaaccuuugca

SEQ ID NO: 1565510 - RNA, 16 nt, Homo sapiens
ugacauaacagugcag

SEQ ID NO: 1565511 - RNA, 15 nt, Homo sapiens
ugacauaccuaccag

SEQ ID NO: 1565512 - RNA, 17 nt, Homo sapiens
ugacauaggcaauaaua

SEQ ID NO: 1565513 - RNA, 13 nt, Homo sapiens
ugacauauuuaau

SEQ ID NO: 1565514 - RNA, 21 nt, Homo sapiens
ugacaugugcuggacacuguc

SEQ ID NO: 1565515 - RNA, 15 nt, Homo sapiens
ugacauuauaugcac

SEQ ID NO: 1565516 - RNA, 17 nt, Homo sapiens
ugacauucuuagcugua

SEQ ID NO: 1565517 - RNA, 19 nt, Homo sapiens
ugacauucuuagcuguaac

SEQ ID NO: 1565518 - RNA, 19 nt, Homo sapiens
ugacauugauuugcucuua

SEQ ID NO: 1565519 - RNA, 20 nt, Homo sapiens
ugacauuuaucaccucugau

SEQ ID NO: 1565520 - RNA, 23 nt, Homo sapiens
ugacauuucacuaaaagucucca

SEQ ID NO: 1565521 - RNA, 21 nt, Homo sapiens
ugaccacugaagcaccacagg

SEQ ID NO: 1565522 - RNA, 13 nt, Homo sapiens
ugacccacaagaa

SEQ ID NO: 1565523 - RNA, 15 nt, Homo sapiens
ugacccuccuguugc

SEQ ID NO: 1565524 - RNA, 23 nt, Homo sapiens
ugaccuaaauuauuuacugcaaa

SEQ ID NO: 1565525 - RNA, 14 nt, Homo sapiens
ugaccucacuuuag

SEQ ID NO: 1565526 - RNA, 16 nt, Homo sapiens
ugaccuccugcaggga

SEQ ID NO: 1565527 - RNA, 15 nt, Homo sapiens
ugaccucgugaucca

SEQ ID NO: 1565528 - RNA, 15 nt, Homo sapiens
ugaccuuuguccuua

SEQ ID NO: 1565529 - RNA, 12 nt, Homo sapiens
ugacggugucca

SEQ ID NO: 1565530 - RNA, 16 nt, Homo sapiens
ugacgugccuaccucu

SEQ ID NO: 1565531 - RNA, 22 nt, Homo sapiens
ugacuauggagucuugugaaag

SEQ ID NO: 1565532 - RNA, 15 nt, Homo sapiens
ugacuccauucaaau

SEQ ID NO: 1565533 - RNA, 21 nt, Homo sapiens
ugacuccuccaaggaaaggga

SEQ ID NO: 1565534 - RNA, 19 nt, Homo sapiens
ugacucuagcaaggcucau

SEQ ID NO: 1565535 - RNA, 18 nt, Homo sapiens
ugacugauguucaugaua

SEQ ID NO: 1565536 - RNA, 17 nt, Homo sapiens
ugacuucuuuuuggcau

SEQ ID NO: 1565537 - RNA, 17 nt, Homo sapiens
ugacuuucuaaguagga

SEQ ID NO: 1565538 - RNA, 15 nt, Homo sapiens
ugacuuugacuuccc

SEQ ID NO: 1565539 - RNA, 17 nt, Homo sapiens
ugacuuuuuaguacuaa

SEQ ID NO: 1565540 - RNA, 19 nt, Homo sapiens
ugagaaaacagggaauaca

SEQ ID NO: 1565541 - RNA, 19 nt, Homo sapiens
uuauuagagugucuuucca

SEQ ID NO: 1565542 - RNA, 19 nt, Homo sapiens
uuauucacuugugugugua

SEQ ID NO: 1565543 - RNA, 22 nt, Homo sapiens
uuauucagaaaagaugugcaga

SEQ ID NO: 1565544 - RNA, 12 nt, Homo sapiens
uuauucugccuu

SEQ ID NO: 1565545 - RNA, 23 nt, Homo sapiens
uuauugaaaggggacaccuguac

SEQ ID NO: 1565546 - RNA, 14 nt, Homo sapiens
uuauugaaugugau

SEQ ID NO: 1565547 - RNA, 14 nt, Homo sapiens
uuauugacacugaa

SEQ ID NO: 1565548 - RNA, 16 nt, Homo sapiens
uuauugauguuuucau

SEQ ID NO: 1565549 - RNA, 20 nt, Homo sapiens
uuauugucuauuuuauaucu

SEQ ID NO: 1565550 - RNA, 23 nt, Homo sapiens
uuauuuaccugaaauaaaauuca

SEQ ID NO: 1565551 - RNA, 17 nt, Homo sapiens
uuauuuaucaaguguau

SEQ ID NO: 1565552 - RNA, 16 nt, Homo sapiens
uuauuuauuuauucau

SEQ ID NO: 1565553 - RNA, 17 nt, Homo sapiens
uuauuuccccagccaca

SEQ ID NO: 1565554 - RNA, 22 nt, Homo sapiens
uuauuuccccagccacaggcca

SEQ ID NO: 1565555 - RNA, 17 nt, Homo sapiens
uuauuucugucacagua

SEQ ID NO: 1565556 - RNA, 22 nt, Homo sapiens
uuauuuguguuuaaaugcugcu

SEQ ID NO: 1565557 - RNA, 15 nt, Homo sapiens
uucaaaagugauuau

SEQ ID NO: 1565558 - RNA, 18 nt, Homo sapiens
uucaaaauauacauucaa

SEQ ID NO: 1565559 - RNA, 13 nt, Homo sapiens
uucaaaccuaaaa

SEQ ID NO: 1565560 - RNA, 15 nt, Homo sapiens
uucaaaccuaaaaau

SEQ ID NO: 1565561 - RNA, 14 nt, Homo sapiens
uucaaacuguaaaa

SEQ ID NO: 1565562 - RNA, 12 nt, Homo sapiens
uucaaacuuaaa

SEQ ID NO: 1565563 - RNA, 16 nt, Homo sapiens
uucaaagaugauaauu

SEQ ID NO: 1565564 - RNA, 19 nt, Homo sapiens
uucaaagcaauugaaaugc

SEQ ID NO: 1565565 - RNA, 15 nt, Homo sapiens
uucaaauguucucca

SEQ ID NO: 1565566 - RNA, 12 nt, Homo sapiens
uucaacaugaca

SEQ ID NO: 1565567 - RNA, 13 nt, Homo sapiens
uucaacccagugg

SEQ ID NO: 1565568 - RNA, 19 nt, Homo sapiens
uucaaccuaguccgcugaa

SEQ ID NO: 1565569 - RNA, 20 nt, Homo sapiens
uucaaccugguggcaccaga

SEQ ID NO: 1565570 - RNA, 22 nt, Homo sapiens
uucaacgacugccgugacauca

SEQ ID NO: 1565571 - RNA, 19 nt, Homo sapiens
uucaacgaugugacugcca

SEQ ID NO: 1565572 - RNA, 21 nt, Homo sapiens
uucaacugaaaaaaacauauc

SEQ ID NO: 1565573 - RNA, 16 nt, Homo sapiens
uucaacuggcuacuga

SEQ ID NO: 1565574 - RNA, 14 nt, Homo sapiens
uucaagacuuccuc

SEQ ID NO: 1565575 - RNA, 14 nt, Homo sapiens
uucaagcagcaucu

SEQ ID NO: 1565576 - RNA, 16 nt, Homo sapiens
uucaaggcccacuucu

SEQ ID NO: 1565577 - RNA, 19 nt, Homo sapiens
uucaaguuuuaaaguucau

SEQ ID NO: 1565578 - RNA, 19 nt, Homo sapiens
uucaauaugcaagcagcuu

SEQ ID NO: 1565579 - RNA, 16 nt, Homo sapiens
uucaaucuggauucau

SEQ ID NO: 1565580 - RNA, 18 nt, Homo sapiens
uucaaucuguaaacugug

SEQ ID NO: 1565581 - RNA, 12 nt, Homo sapiens
uucaaugaaaua

SEQ ID NO: 1565582 - RNA, 15 nt, Homo sapiens
uucaaugaauacugg

SEQ ID NO: 1565583 - RNA, 10 nt, Homo sapiens
uucaaugagg

SEQ ID NO: 1565584 - RNA, 14 nt, Homo sapiens
uucaauuauacuaa

SEQ ID NO: 1565585 - RNA, 15 nt, Homo sapiens
uucacaaacugugaa

SEQ ID NO: 1565586 - RNA, 22 nt, Homo sapiens
uucacaaauagccauugaacaa

SEQ ID NO: 1565587 - RNA, 15 nt, Homo sapiens
uucacagucacugau

SEQ ID NO: 1565588 - RNA, 13 nt, Homo sapiens
uucacagugcaag

SEQ ID NO: 1565589 - RNA, 19 nt, Homo sapiens
uucacaugaugcacuucaa

SEQ ID NO: 1565590 - RNA, 16 nt, Homo sapiens
uucaccaagugcaaua

SEQ ID NO: 1565591 - RNA, 19 nt, Homo sapiens
uucacccaaaacaaaguaa

SEQ ID NO: 1565592 - RNA, 19 nt, Homo sapiens
uucaccuccaagcauuuca

SEQ ID NO: 1565593 - RNA, 13 nt, Homo sapiens
uucaccuguauau

SEQ ID NO: 1565594 - RNA, 17 nt, Homo sapiens
uucacgaacaugggcau

SEQ ID NO: 1565595 - RNA, 18 nt, Homo sapiens
uucacgauuaacugugaa

SEQ ID NO: 1565596 - RNA, 23 nt, Homo sapiens
uucacgccauucuccugccucag

SEQ ID NO: 1565597 - RNA, 19 nt, Homo sapiens
uucacgggcaaucaugagc

SEQ ID NO: 1565598 - RNA, 12 nt, Homo sapiens
uucacuacaggu

SEQ ID NO: 1565599 - RNA, 15 nt, Homo sapiens
uucacuauaauguga

SEQ ID NO: 1565600 - RNA, 18 nt, Homo sapiens
uucacucugacaguauua

SEQ ID NO: 1565601 - RNA, 13 nt, Homo sapiens
uucacucugucau

SEQ ID NO: 1565602 - RNA, 21 nt, Homo sapiens
uucacugaguuuuguuucacu

SEQ ID NO: 1565603 - RNA, 21 nt, Homo sapiens
uucagaaaucaaacugcuuau

SEQ ID NO: 1565604 - RNA, 20 nt, Homo sapiens
uucagaacagaggcauuuaa

SEQ ID NO: 1565605 - RNA, 23 nt, Homo sapiens
uucagaauauucauauuggaaaa

SEQ ID NO: 1565606 - RNA, 12 nt, Homo sapiens
uucagaauggaa

SEQ ID NO: 1565607 - RNA, 14 nt, Homo sapiens
uucagacaaaaugg

SEQ ID NO: 1565608 - RNA, 18 nt, Homo sapiens
uucagacaaauuacugau

SEQ ID NO: 1565609 - RNA, 15 nt, Homo sapiens
uucagagaacccacu

SEQ ID NO: 1565610 - RNA, 23 nt, Homo sapiens
uucagaggguaaguaaacagauu

SEQ ID NO: 1565611 - RNA, 12 nt, Homo sapiens
uucagaguauau

SEQ ID NO: 1565612 - RNA, 18 nt, Homo sapiens
uucagaguccuugcaaaa

SEQ ID NO: 1565613 - RNA, 17 nt, Homo sapiens
uucagagugacuacaca

SEQ ID NO: 1565614 - RNA, 16 nt, Homo sapiens
uucagaguggacuugu

SEQ ID NO: 1565615 - RNA, 23 nt, Homo sapiens
uucagauauaaaagacugaccaa

SEQ ID NO: 1565616 - RNA, 20 nt, Homo sapiens
uucagaugcuguuaguaccu

SEQ ID NO: 1565617 - RNA, 14 nt, Homo sapiens
uucagauuacauga

SEQ ID NO: 1565618 - RNA, 14 nt, Homo sapiens
uucagccccuccuc

SEQ ID NO: 1565619 - RNA, 15 nt, Homo sapiens
uucagcuccuuccac

SEQ ID NO: 1565620 - RNA, 15 nt, Homo sapiens
uucagcucugaucug

SEQ ID NO: 1565621 - RNA, 13 nt, Homo sapiens
uucaggacucugc

SEQ ID NO: 1565622 - RNA, 19 nt, Homo sapiens
uucaggagggaaccagcuu

SEQ ID NO: 1565623 - RNA, 15 nt, Homo sapiens
uucaggccagugugg

SEQ ID NO: 1565624 - RNA, 19 nt, Homo sapiens
uucaggccugcuagucacu

SEQ ID NO: 1565625 - RNA, 20 nt, Homo sapiens
uucaggccugcuagucacug

SEQ ID NO: 1565626 - RNA, 19 nt, Homo sapiens
uucaggguuuuaaacacua

SEQ ID NO: 1565627 - RNA, 18 nt, Homo sapiens
uucagguaauacaaacua

SEQ ID NO: 1565628 - RNA, 15 nt, Homo sapiens
uucaguaagucucau

SEQ ID NO: 1565629 - RNA, 23 nt, Homo sapiens
uucagucaaagauacacaaucug

SEQ ID NO: 1565630 - RNA, 15 nt, Homo sapiens
uucagugauacucac

SEQ ID NO: 1565631 - RNA, 23 nt, Homo sapiens
uucagugcaguuucuuuucacau

SEQ ID NO: 1565632 - RNA, 12 nt, Homo sapiens
uucaguguaaau

SEQ ID NO: 1565633 - RNA, 16 nt, Homo sapiens
uucaguucuacgugaa

SEQ ID NO: 1565634 - RNA, 15 nt, Homo sapiens
uucaguuuucaggag

SEQ ID NO: 1565635 - RNA, 14 nt, Homo sapiens
uucaguuuugcuua

SEQ ID NO: 1565636 - RNA, 15 nt, Homo sapiens
uucaguuuugcuuau

SEQ ID NO: 1565637 - RNA, 21 nt, Homo sapiens
uucauaacagugccauugucu

SEQ ID NO: 1565638 - RNA, 16 nt, Homo sapiens
uucauaaguauuucaa

SEQ ID NO: 1565639 - RNA, 13 nt, Homo sapiens
uucauacaacaga

SEQ ID NO: 1565640 - RNA, 12 nt, Homo sapiens
uucauacaacau

SEQ ID NO: 1565641 - RNA, 13 nt, Homo sapiens
uucauacaauggc

SEQ ID NO: 1565642 - RNA, 16 nt, Homo sapiens
uucauagcaaugucuc

SEQ ID NO: 1565643 - RNA, 18 nt, Homo sapiens
uucauccugacucugccc

SEQ ID NO: 1565644 - RNA, 12 nt, Homo sapiens
uucaucuaauaa

SEQ ID NO: 1565645 - RNA, 13 nt, Homo sapiens
uucaucugggaca

SEQ ID NO: 1565646 - RNA, 14 nt, Homo sapiens
uucaugcagccuaa

SEQ ID NO: 1565647 - RNA, 14 nt, Homo sapiens
uucaugcuugacau

SEQ ID NO: 1565648 - RNA, 23 nt, Homo sapiens
uucauggauucaggugcuggaga

SEQ ID NO: 1565649 - RNA, 16 nt, Homo sapiens
uucauggcuaccucag

SEQ ID NO: 1565650 - RNA, 19 nt, Homo sapiens
uucauguaauagcaaugca

SEQ ID NO: 1565651 - RNA, 14 nt, Homo sapiens
uucaugucaucaaa

SEQ ID NO: 1565652 - RNA, 21 nt, Homo sapiens
uucauuaucucaaaacugcac

SEQ ID NO: 1565653 - RNA, 14 nt, Homo sapiens
uucauucaugaaua

SEQ ID NO: 1565654 - RNA, 19 nt, Homo sapiens
uucauucauuucauuguga

SEQ ID NO: 1565655 - RNA, 23 nt, Homo sapiens
uucauuccuaaagaaaaauaucu

SEQ ID NO: 1565656 - RNA, 22 nt, Homo sapiens
uucauucucccuuucacuaaaa

SEQ ID NO: 1565657 - RNA, 16 nt, Homo sapiens
uucauuugcuguucau

SEQ ID NO: 1565658 - RNA, 12 nt, Homo sapiens
uucauuuguaug

SEQ ID NO: 1565659 - RNA, 22 nt, Homo sapiens
uucauuugugcaccaauuauca

SEQ ID NO: 1565660 - RNA, 14 nt, Homo sapiens
uuucaaagcuaaaa

SEQ ID NO: 1565661 - RNA, 20 nt, Homo sapiens
uuucaaccuauacaaccuaa

SEQ ID NO: 1565662 - RNA, 15 nt, Homo sapiens
uuucaagacuagaau

SEQ ID NO: 1565663 - RNA, 12 nt, Homo sapiens
uuucaagucucu

SEQ ID NO: 1565664 - RNA, 15 nt, Homo sapiens
uuucaauuacaaagc

SEQ ID NO: 1565665 - RNA, 15 nt, Homo sapiens
uuucaauugucacuu

SEQ ID NO: 1565666 - RNA, 20 nt, Homo sapiens
uuucacaacuuaccuuguua

SEQ ID NO: 1565667 - RNA, 22 nt, Homo sapiens
uuucacacuggauccaucuuga

SEQ ID NO: 1565668 - RNA, 20 nt, Homo sapiens
uuucacgccugaggcaauua

SEQ ID NO: 1565669 - RNA, 22 nt, Homo sapiens
uuucacucucaaacuucacuaa

SEQ ID NO: 1565670 - RNA, 22 nt, Homo sapiens
uuucacuuaaacuuugucacuu

SEQ ID NO: 1565671 - RNA, 21 nt, Homo sapiens
uuucacuuucugucuagguua

SEQ ID NO: 1565672 - RNA, 14 nt, Homo sapiens
uuucagaauuuugc

SEQ ID NO: 1565673 - RNA, 23 nt, Homo sapiens
uuucagagugacuacacacagua

SEQ ID NO: 1565674 - RNA, 19 nt, Homo sapiens
uuucagaugauucuauguc

SEQ ID NO: 1565675 - RNA, 20 nt, Homo sapiens
uuucagcagcaaaaccaaac

SEQ ID NO: 1565676 - RNA, 21 nt, Homo sapiens
uuucaggaaaauguauugauu

SEQ ID NO: 1565677 - RNA, 13 nt, Homo sapiens
uuucaggccaaau

SEQ ID NO: 1565678 - RNA, 19 nt, Homo sapiens
uuucaggcuacuguucuug

SEQ ID NO: 1565679 - RNA, 14 nt, Homo sapiens
uuucaggguuuuaa

SEQ ID NO: 1565680 - RNA, 14 nt, Homo sapiens
uuucauacaacaga

SEQ ID NO: 1565681 - RNA, 13 nt, Homo sapiens
uuucauacacuua

SEQ ID NO: 1565682 - RNA, 17 nt, Homo sapiens
uuucauaccacuugaau

SEQ ID NO: 1565683 - RNA, 19 nt, Homo sapiens
uuucauaccuaucaucuua

SEQ ID NO: 1565684 - RNA, 14 nt, Homo sapiens
uuucauaguguuca

SEQ ID NO: 1565685 - RNA, 16 nt, Homo sapiens
uuucauauuauuuuag

SEQ ID NO: 1565686 - RNA, 15 nt, Homo sapiens
uuucaucacacuggg

SEQ ID NO: 1565687 - RNA, 21 nt, Homo sapiens
uuucaugauaaugaacagaac

SEQ ID NO: 1565688 - RNA, 15 nt, Homo sapiens
uuucaugcuccauuu

SEQ ID NO: 1565689 - RNA, 11 nt, Homo sapiens
uuucauguauu

SEQ ID NO: 1565690 - RNA, 20 nt, Homo sapiens
uuucauuaaauaaauuugac

SEQ ID NO: 1565691 - RNA, 22 nt, Homo sapiens
uuucauuaguauuccucauucu

SEQ ID NO: 1565692 - RNA, 12 nt, Homo sapiens
uuucauucacuu

SEQ ID NO: 1565693 - RNA, 17 nt, Homo sapiens
uuuccaaaacuguccag

SEQ ID NO: 1565694 - RNA, 12 nt, Homo sapiens
uuuccaaccagg

SEQ ID NO: 1565695 - RNA, 23 nt, Homo sapiens
uuuccaaugccacagacaacuca

SEQ ID NO: 1565696 - RNA, 22 nt, Homo sapiens
uuuccacaagauucccagagac

SEQ ID NO: 1565697 - RNA, 20 nt, Homo sapiens
uuuccacugugcuauuacaa

SEQ ID NO: 1565698 - RNA, 22 nt, Homo sapiens
uuuccagacuuugaaacuauua

SEQ ID NO: 1565699 - RNA, 22 nt, Homo sapiens
uuuccaguggaucauaagacaa

SEQ ID NO: 1565700 - RNA, 14 nt, Homo sapiens
uuuccauccuccaa

SEQ ID NO: 1565701 - RNA, 22 nt, Homo sapiens
uuucccacgaggaaucuguggg

SEQ ID NO: 1565702 - RNA, 20 nt, Homo sapiens
uuucccauaagacaaugaca

SEQ ID NO: 1565703 - RNA, 18 nt, Homo sapiens
uuucccauuaaagagcca

SEQ ID NO: 1565704 - RNA, 23 nt, Homo sapiens
uuuccccaccccagcucaugccc

SEQ ID NO: 1565705 - RNA, 15 nt, Homo sapiens
uuuccgaaaucagaa

SEQ ID NO: 1565706 - RNA, 16 nt, Homo sapiens
uuuccuaacugugauu

SEQ ID NO: 1565707 - RNA, 17 nt, Homo sapiens
uuuccuagcuguguuau

SEQ ID NO: 1565708 - RNA, 13 nt, Homo sapiens
uuuccuaugcaaa

SEQ ID NO: 1565709 - RNA, 12 nt, Homo sapiens
uuuccucaaaac

SEQ ID NO: 1565710 - RNA, 15 nt, Homo sapiens
uuuccuccucaggca

SEQ ID NO: 1565711 - RNA, 12 nt, Homo sapiens
uuuccuccugag

SEQ ID NO: 1565712 - RNA, 12 nt, Homo sapiens
uuuccucuagga

SEQ ID NO: 1565713 - RNA, 14 nt, Homo sapiens
uuuccucuauugau

SEQ ID NO: 1565714 - RNA, 12 nt, Homo sapiens
uuuccucugcau

SEQ ID NO: 1565715 - RNA, 14 nt, Homo sapiens
uuuccucugugcaa

SEQ ID NO: 1565716 - RNA, 19 nt, Homo sapiens
uuuccucugugcaaaggga

SEQ ID NO: 1565717 - RNA, 20 nt, Homo sapiens
uuuccuggucagcauguacu

SEQ ID NO: 1565718 - RNA, 12 nt, Homo sapiens
uuuccuguguau

SEQ ID NO: 1565719 - RNA, 20 nt, Homo sapiens
uuuccuguuugaaauaucau

SEQ ID NO: 1565720 - RNA, 12 nt, Homo sapiens
uuuccuuccaga

SEQ ID NO: 1565721 - RNA, 14 nt, Homo sapiens
uuuccuugucccag

SEQ ID NO: 1565722 - RNA, 17 nt, Homo sapiens
uuuccuuuaugugaauu

SEQ ID NO: 1565723 - RNA, 22 nt, Homo sapiens
uuuccuuuuuccugugacaaaa

SEQ ID NO: 1565724 - RNA, 18 nt, Homo sapiens
uuuccuuuuugacacuga

SEQ ID NO: 1565725 - RNA, 19 nt, Homo sapiens
uuuccuuuuugacacugaa

SEQ ID NO: 1565726 - RNA, 19 nt, Homo sapiens
uuucguuuagaaucagaau

SEQ ID NO: 1565727 - RNA, 16 nt, Homo sapiens
uuucuaaaaucuaaaa

SEQ ID NO: 1565728 - RNA, 20 nt, Homo sapiens
uuucuaagcaguuaugguga

SEQ ID NO: 1565729 - RNA, 17 nt, Homo sapiens
uuucuagaugucucuga

SEQ ID NO: 1565730 - RNA, 13 nt, Homo sapiens
uuucuagcaaaca

SEQ ID NO: 1565731 - RNA, 15 nt, Homo sapiens
uuucuauagccaaaa

SEQ ID NO: 1565732 - RNA, 14 nt, Homo sapiens
uuucuauaucaaaa

SEQ ID NO: 1565733 - RNA, 14 nt, Homo sapiens
uuucuaugugacaa

SEQ ID NO: 1565734 - RNA, 21 nt, Homo sapiens
uuucuauuauggaaaacugug

SEQ ID NO: 1565735 - RNA, 23 nt, Homo sapiens
uuucucagauguugaaacuuuga

SEQ ID NO: 1565736 - RNA, 13 nt, Homo sapiens
uuucuccagugcu

SEQ ID NO: 1565737 - RNA, 17 nt, Homo sapiens
uuucuccuuuaauugua

SEQ ID NO: 1565738 - RNA, 15 nt, Homo sapiens
uuucucgggugcauu

SEQ ID NO: 1565739 - RNA, 17 nt, Homo sapiens
uuucugaaugucuguga

SEQ ID NO: 1565740 - RNA, 17 nt, Homo sapiens
uuucugacucugagcua

SEQ ID NO: 1565741 - RNA, 14 nt, Homo sapiens
uuucugagaaagac

SEQ ID NO: 1565742 - RNA, 22 nt, Homo sapiens
uuucugagaaagacuauucaaa

SEQ ID NO: 1565743 - RNA, 16 nt, Homo sapiens
uuucugagugccuucu

SEQ ID NO: 1565744 - RNA, 14 nt, Homo sapiens
uuucugccaaaaua

SEQ ID NO: 1565745 - RNA, 13 nt, Homo sapiens
uuucuggugccau

SEQ ID NO: 1565746 - RNA, 14 nt, Homo sapiens
uuucuggugccauu

SEQ ID NO: 1565747 - RNA, 16 nt, Homo sapiens
uuucuguauauacuca

SEQ ID NO: 1565748 - RNA, 22 nt, Homo sapiens
uuucugugggaggagaagggga

SEQ ID NO: 1565749 - RNA, 13 nt, Homo sapiens
uuucuugcugcag

SEQ ID NO: 1565750 - RNA, 15 nt, Homo sapiens
uuucuugcugcagug

SEQ ID NO: 1565751 - RNA, 16 nt, Homo sapiens
uuucuuguugcugcau

SEQ ID NO: 1565752 - RNA, 18 nt, Homo sapiens
uuucuuuagcaugcuaca

SEQ ID NO: 1565753 - RNA, 14 nt, Homo sapiens
uuucuuuaucauug

SEQ ID NO: 1565754 - RNA, 16 nt, Homo sapiens
uuucuuuguaucauuc

SEQ ID NO: 1565755 - RNA, 14 nt, Homo sapiens
uuugaaaaguaaaa

SEQ ID NO: 1565756 - RNA, 23 nt, Homo sapiens
uuugaaaaugggcucaaccagaa

SEQ ID NO: 1565757 - RNA, 18 nt, Homo sapiens
uuugaagaacaugugaga

SEQ ID NO: 1565758 - RNA, 17 nt, Homo sapiens
uuugaagcagucuugcu

SEQ ID NO: 1565759 - RNA, 20 nt, Homo sapiens
uuugaaggcaaaauugcaaa

SEQ ID NO: 1565760 - RNA, 15 nt, Homo sapiens
uuugaauucuugaua

SEQ ID NO: 1565761 - RNA, 18 nt, Homo sapiens
uuugacauuaauuaugaa

SEQ ID NO: 1565762 - RNA, 18 nt, Homo sapiens
uuugacccuugcugugaa

SEQ ID NO: 1565763 - RNA, 15 nt, Homo sapiens
uuugacuacuagagc

SEQ ID NO: 1565764 - RNA, 16 nt, Homo sapiens
uuugacuccaggaaca

SEQ ID NO: 1565765 - RNA, 22 nt, Homo sapiens
uuugacugaauguuuuauggaa

SEQ ID NO: 1565766 - RNA, 22 nt, Homo sapiens
uuugagacaacaguacauauaa

SEQ ID NO: 1565767 - RNA, 16 nt, Homo sapiens
uuugagacagucucac

SEQ ID NO: 1565768 - RNA, 20 nt, Homo sapiens
uuugagccaugucacacaaa

SEQ ID NO: 1565769 - RNA, 18 nt, Homo sapiens
uuugagcccccauuccac

SEQ ID NO: 1565770 - RNA, 16 nt, Homo sapiens
uuugaggaaagcaaga

SEQ ID NO: 1565771 - RNA, 18 nt, Homo sapiens
uuugagguaucacugcag

SEQ ID NO: 1565772 - RNA, 13 nt, Homo sapiens
uuugauacuaaaa

SEQ ID NO: 1565773 - RNA, 13 nt, Homo sapiens
uuugaucagacag

SEQ ID NO: 1565774 - RNA, 16 nt, Homo sapiens
uuugauuuugauuuua

SEQ ID NO: 1565775 - RNA, 17 nt, Homo sapiens
uuugcaauaaugcagua

SEQ ID NO: 1565776 - RNA, 13 nt, Homo sapiens
uuugcagcaauua

SEQ ID NO: 1565777 - RNA, 19 nt, Homo sapiens
uuugcaguaugaacuauug

SEQ ID NO: 1565778 - RNA, 20 nt, Homo sapiens
uuugcauugaugaauuuugu

SEQ ID NO: 1565779 - RNA, 16 nt, Homo sapiens
auuuccaguugcccau

SEQ ID NO: 1565780 - RNA, 13 nt, Homo sapiens
auuuccaguuuuu

SEQ ID NO: 1565781 - RNA, 18 nt, Homo sapiens
caugucugccaaaaugca

SEQ ID NO: 1565782 - RNA, 17 nt, Homo sapiens
caugucugccuaugcac

SEQ ID NO: 1565783 - RNA, 23 nt, Homo sapiens
caugucugccuaugcacugaaga

SEQ ID NO: 1565784 - RNA, 15 nt, Homo sapiens
caugucuugucauac

SEQ ID NO: 1565785 - RNA, 16 nt, Homo sapiens
caugugauguggugcg

SEQ ID NO: 1565786 - RNA, 13 nt, Homo sapiens
cagcaaaagacca

SEQ ID NO: 1565787 - RNA, 23 nt, Homo sapiens
cagcaaacaaauaaaaugaaaua

SEQ ID NO: 1565788 - RNA, 14 nt, Homo sapiens
cagcaaagucugca

SEQ ID NO: 1565789 - RNA, 14 nt, Homo sapiens
cagcaaagugguuc

SEQ ID NO: 1565790 - RNA, 16 nt, Homo sapiens
cagcaaggauggagcu

SEQ ID NO: 1565791 - RNA, 21 nt, Homo sapiens
cagcaauggugucaguaucca

SEQ ID NO: 1565792 - RNA, 20 nt, Homo sapiens
cagcaauucuccugccucag

SEQ ID NO: 1565793 - RNA, 20 nt, Homo sapiens
cagcaauuuaaauguuauga

SEQ ID NO: 1565794 - RNA, 21 nt, Homo sapiens
cagcacacgaguuccagaccc

SEQ ID NO: 1565795 - RNA, 16 nt, Homo sapiens
cagcacagucacccau

SEQ ID NO: 1565796 - RNA, 15 nt, Homo sapiens
cagcacauaugggaa

SEQ ID NO: 1565797 - RNA, 20 nt, Homo sapiens
cagcaccccccauuuuuuca

SEQ ID NO: 1565798 - RNA, 11 nt, Homo sapiens
cagcacccucc

SEQ ID NO: 1565799 - RNA, 15 nt, Homo sapiens
cagcaccuacagugu

SEQ ID NO: 1565800 - RNA, 23 nt, Homo sapiens
cagcacguguggccuguucuucu

SEQ ID NO: 1565801 - RNA, 19 nt, Homo sapiens
cagcacucccuuuuuuaua

SEQ ID NO: 1565802 - RNA, 11 nt, Homo sapiens
cagcacugagg

SEQ ID NO: 1565803 - RNA, 20 nt, Homo sapiens
cagcacuggugaacugagcu

SEQ ID NO: 1565804 - RNA, 12 nt, Homo sapiens
cagcagaacucc

SEQ ID NO: 1565805 - RNA, 22 nt, Homo sapiens
cagcagauguaguuucagacuu

SEQ ID NO: 1565806 - RNA, 13 nt, Homo sapiens
cagcagauuucca

SEQ ID NO: 1565807 - RNA, 20 nt, Homo sapiens
cagcagcauuuuuauuucag

SEQ ID NO: 1565808 - RNA, 21 nt, Homo sapiens
cagcaggaaggaacaaagaca

SEQ ID NO: 1565809 - RNA, 19 nt, Homo sapiens
cagcaggcugccagugccu

SEQ ID NO: 1565810 - RNA, 13 nt, Homo sapiens
cagcauacgucag

SEQ ID NO: 1565811 - RNA, 24 nt, Homo sapiens
cagcauagggucacuuugccauua

SEQ ID NO: 1565812 - RNA, 15 nt, Homo sapiens
cagcauggagcuaua

SEQ ID NO: 1565813 - RNA, 17 nt, Homo sapiens
cagcauggucuuaugca

SEQ ID NO: 1565814 - RNA, 18 nt, Homo sapiens
cagcauguacggauuuuc

SEQ ID NO: 1565815 - RNA, 16 nt, Homo sapiens
cagcauuccaugacca

SEQ ID NO: 1565816 - RNA, 12 nt, Homo sapiens
cagcauuugacc

SEQ ID NO: 1565817 - RNA, 13 nt, Homo sapiens
cagcauuugauaa

SEQ ID NO: 1565818 - RNA, 22 nt, Homo sapiens
cagcauuuuuauaaacuaccaa

SEQ ID NO: 1565819 - RNA, 16 nt, Homo sapiens
cagccaaaugcaggga

SEQ ID NO: 1565820 - RNA, 14 nt, Homo sapiens
cagccaagugcaga

SEQ ID NO: 1565821 - RNA, 23 nt, Homo sapiens
cagccaccaagaaguggcugcca

SEQ ID NO: 1565822 - RNA, 18 nt, Homo sapiens
cagccaccccaaagcccu

SEQ ID NO: 1565823 - RNA, 14 nt, Homo sapiens
cagccacugucaca

SEQ ID NO: 1565824 - RNA, 18 nt, Homo sapiens
cagccagagacagaggau

SEQ ID NO: 1565825 - RNA, 21 nt, Homo sapiens
cagccagaggguagggcacaa

SEQ ID NO: 1565826 - RNA, 13 nt, Homo sapiens
cagccagauccuc

SEQ ID NO: 1565827 - RNA, 18 nt, Homo sapiens
cagccagcccauggcccc

SEQ ID NO: 1565828 - RNA, 17 nt, Homo sapiens
cagccaggcccugagau

SEQ ID NO: 1565829 - RNA, 21 nt, Homo sapiens
cagccaguuuuacugugauuc

SEQ ID NO: 1565830 - RNA, 14 nt, Homo sapiens
cagccauacaaaua

SEQ ID NO: 1565831 - RNA, 22 nt, Homo sapiens
cagcccacccuccugucuuccc

SEQ ID NO: 1565832 - RNA, 21 nt, Homo sapiens
cagcccagccccuccaaaggu

SEQ ID NO: 1565833 - RNA, 11 nt, Homo sapiens
cagcccauucu

SEQ ID NO: 1565834 - RNA, 18 nt, Homo sapiens
cagccccaacuccagggg

SEQ ID NO: 1565835 - RNA, 17 nt, Homo sapiens
cagccccgccugucaca

SEQ ID NO: 1565836 - RNA, 18 nt, Homo sapiens
cagccccggcaagccaca

SEQ ID NO: 1565837 - RNA, 18 nt, Homo sapiens
cagccccuccucccucag

SEQ ID NO: 1565838 - RNA, 20 nt, Homo sapiens
cagcccucucucucacuccc

SEQ ID NO: 1565839 - RNA, 18 nt, Homo sapiens
cagcccuggaaacauaca

SEQ ID NO: 1565840 - RNA, 19 nt, Homo sapiens
cagcccuggaugguggcca

SEQ ID NO: 1565841 - RNA, 14 nt, Homo sapiens
cagccgaggccaca

SEQ ID NO: 1565842 - RNA, 15 nt, Homo sapiens
cagccguccauagca

SEQ ID NO: 1565843 - RNA, 17 nt, Homo sapiens
cagccuccccgugccaa

SEQ ID NO: 1565844 - RNA, 19 nt, Homo sapiens
cagccuccccgugccaaaa

SEQ ID NO: 1565845 - RNA, 13 nt, Homo sapiens
cagccucuacagc

SEQ ID NO: 1565846 - RNA, 14 nt, Homo sapiens
cagccucugccagc

SEQ ID NO: 1565847 - RNA, 16 nt, Homo sapiens
cagccuggaugccauc

SEQ ID NO: 1565848 - RNA, 17 nt, Homo sapiens
cagccuggaugccaucc

SEQ ID NO: 1565849 - RNA, 19 nt, Homo sapiens
cagccugggcaacagagca

SEQ ID NO: 1565850 - RNA, 15 nt, Homo sapiens
cagcgauggcaguga

SEQ ID NO: 1565851 - RNA, 18 nt, Homo sapiens
cagcgauggcagugagaa

SEQ ID NO: 1565852 - RNA, 16 nt, Homo sapiens
cagcgcgguccugacu

SEQ ID NO: 1565853 - RNA, 20 nt, Homo sapiens
cagcgcucgauggaccucag

SEQ ID NO: 1565854 - RNA, 15 nt, Homo sapiens
cagcgcuguauuuac

SEQ ID NO: 1565855 - RNA, 14 nt, Homo sapiens
cagcggcugcccuc

SEQ ID NO: 1565856 - RNA, 23 nt, Homo sapiens
cagcggcugcccucuggggccac

SEQ ID NO: 1565857 - RNA, 15 nt, Homo sapiens
cagcuauauuugauu

SEQ ID NO: 1565858 - RNA, 22 nt, Homo sapiens
cagcucauuucaguuucuauca

SEQ ID NO: 1565859 - RNA, 21 nt, Homo sapiens
cagcuccuggccauauaucaa

SEQ ID NO: 1565860 - RNA, 18 nt, Homo sapiens
cagcugagguucauuaca

SEQ ID NO: 1565861 - RNA, 13 nt, Homo sapiens
cagcugauccaga

SEQ ID NO: 1565862 - RNA, 15 nt, Homo sapiens
cagcugauuccagaa

SEQ ID NO: 1565863 - RNA, 18 nt, Homo sapiens
cagcugcccuugcagggu

SEQ ID NO: 1565864 - RNA, 16 nt, Homo sapiens
cagcugcgcuugcuuu

SEQ ID NO: 1565865 - RNA, 20 nt, Homo sapiens
cagcuggaggaauacauuuu

SEQ ID NO: 1565866 - RNA, 17 nt, Homo sapiens
cagcuggugucaguccc

SEQ ID NO: 1565867 - RNA, 20 nt, Homo sapiens
cagcuguaaucccagcacuu

SEQ ID NO: 1565868 - RNA, 14 nt, Homo sapiens
cagcugugcacuuu

SEQ ID NO: 1565869 - RNA, 12 nt, Homo sapiens
cagcugugcugu

SEQ ID NO: 1565870 - RNA, 20 nt, Homo sapiens
cagcuguggcagaguuacag

SEQ ID NO: 1565871 - RNA, 17 nt, Homo sapiens
cagcuuauauucaucca

SEQ ID NO: 1565872 - RNA, 17 nt, Homo sapiens
cagcuucuucacaggca

SEQ ID NO: 1565873 - RNA, 21 nt, Homo sapiens
cagcuuuuuauucccugccca

SEQ ID NO: 1565874 - RNA, 21 nt, Homo sapiens
caggaaacuccacaucugccu

SEQ ID NO: 1565875 - RNA, 18 nt, Homo sapiens
caggaaacuccugugacc

SEQ ID NO: 1565876 - RNA, 22 nt, Homo sapiens
caggaaagagagcaccacguga

SEQ ID NO: 1565877 - RNA, 15 nt, Homo sapiens
caggaaaggccccaa

SEQ ID NO: 1565878 - RNA, 23 nt, Homo sapiens
caggaaaggccccaaucuugccc

SEQ ID NO: 1565879 - RNA, 19 nt, Homo sapiens
caggaaccucgaguacugu

SEQ ID NO: 1565880 - RNA, 15 nt, Homo sapiens
caggaagccagagcc

SEQ ID NO: 1565881 - RNA, 20 nt, Homo sapiens
caggaagggagaacuugaaa

SEQ ID NO: 1565882 - RNA, 17 nt, Homo sapiens
caggaauacuuggaccu

SEQ ID NO: 1565883 - RNA, 19 nt, Homo sapiens
caggaauccccaacaugca

SEQ ID NO: 1565884 - RNA, 17 nt, Homo sapiens
caggacagaaccacuga

SEQ ID NO: 1565885 - RNA, 17 nt, Homo sapiens
caggacagcuccuggac

SEQ ID NO: 1565886 - RNA, 15 nt, Homo sapiens
caggacagguggugc

SEQ ID NO: 1565887 - RNA, 19 nt, Homo sapiens
caggacagguggugcaaau

SEQ ID NO: 1565888 - RNA, 12 nt, Homo sapiens
caggacagugcu

SEQ ID NO: 1565889 - RNA, 15 nt, Homo sapiens
caggaccuacuagga

SEQ ID NO: 1565890 - RNA, 17 nt, Homo sapiens
caggacggcaguacuca

SEQ ID NO: 1565891 - RNA, 22 nt, Homo sapiens
caggacuguuuuauaaacugcu

SEQ ID NO: 1565892 - RNA, 14 nt, Homo sapiens
caggagaagaacaa

SEQ ID NO: 1565893 - RNA, 15 nt, Homo sapiens
caggagaaucacuug

SEQ ID NO: 1565894 - RNA, 21 nt, Homo sapiens
caggagaauuucuacugagcg

SEQ ID NO: 1565895 - RNA, 17 nt, Homo sapiens
caggagaugauucuguu

SEQ ID NO: 1565896 - RNA, 13 nt, Homo sapiens
caggagauuacaa

SEQ ID NO: 1565897 - RNA, 22 nt, Homo sapiens
caggaggaaaaggcuugguguc

SEQ ID NO: 1565898 - RNA, 22 nt, Homo sapiens
caggaggcagacaaugacccca

SEQ ID NO: 1565899 - RNA, 16 nt, Homo sapiens
caggaggucaagauca

SEQ ID NO: 1565900 - RNA, 20 nt, Homo sapiens
caggagucugccacuuguca

SEQ ID NO: 1565901 - RNA, 19 nt, Homo sapiens
caguggcuucaucugucaa

SEQ ID NO: 1565902 - RNA, 15 nt, Homo sapiens
caguggcuucuccag

SEQ ID NO: 1565903 - RNA, 13 nt, Homo sapiens
caguggugccauc

SEQ ID NO: 1565904 - RNA, 16 nt, Homo sapiens
caguguaauccagggg

SEQ ID NO: 1565905 - RNA, 13 nt, Homo sapiens
caguguacagucu

SEQ ID NO: 1565906 - RNA, 16 nt, Homo sapiens
caaaaaaccaauuuac

SEQ ID NO: 1565907 - RNA, 16 nt, Homo sapiens
caaaaaaucaucucac

SEQ ID NO: 1565908 - RNA, 23 nt, Homo sapiens
caaaaaauguaauuaacuguaaa

SEQ ID NO: 1565909 - RNA, 14 nt, Homo sapiens
caaaaacaauguaa

SEQ ID NO: 1565910 - RNA, 18 nt, Homo sapiens
caaaaagccacaaugaac

SEQ ID NO: 1565911 - RNA, 14 nt, Homo sapiens
caaaaagcucugaa

SEQ ID NO: 1565912 - RNA, 12 nt, Homo sapiens
caaaaaggcaaa

SEQ ID NO: 1565913 - RNA, 14 nt, Homo sapiens
caaaaaggcaaaua

SEQ ID NO: 1565914 - RNA, 20 nt, Homo sapiens
caaaaaugaaauccagugag

SEQ ID NO: 1565915 - RNA, 15 nt, Homo sapiens
caaaaaugauuuagu

SEQ ID NO: 1565916 - RNA, 12 nt, Homo sapiens
caaaacaauuaa

SEQ ID NO: 1565917 - RNA, 15 nt, Homo sapiens
caaaacagagaaagc

SEQ ID NO: 1565918 - RNA, 19 nt, Homo sapiens
caaaacagauuacuagaaa

SEQ ID NO: 1565919 - RNA, 23 nt, Homo sapiens
caaaacguugaauugaugaugca

SEQ ID NO: 1565920 - RNA, 14 nt, Homo sapiens
caaaacuacaaauc

SEQ ID NO: 1565921 - RNA, 14 nt, Homo sapiens
caaaacuccgucuc

SEQ ID NO: 1565922 - RNA, 13 nt, Homo sapiens
caaaacuguccag

SEQ ID NO: 1565923 - RNA, 15 nt, Homo sapiens
caaaacuuauuggaa

SEQ ID NO: 1565924 - RNA, 18 nt, Homo sapiens
caaaagcaauuguauuac

SEQ ID NO: 1565925 - RNA, 15 nt, Homo sapiens
caaaagcacauauau

SEQ ID NO: 1565926 - RNA, 19 nt, Homo sapiens
caaaagcagauacuugagg

SEQ ID NO: 1565927 - RNA, 19 nt, Homo sapiens
caaaagccuuaccuugaaa

SEQ ID NO: 1565928 - RNA, 15 nt, Homo sapiens
caaaagcuauuuaaa

SEQ ID NO: 1565929 - RNA, 14 nt, Homo sapiens
caaaaggaaaaagc

SEQ ID NO: 1565930 - RNA, 15 nt, Homo sapiens
caaaaggaaaaagcu

SEQ ID NO: 1565931 - RNA, 19 nt, Homo sapiens
caaaaguagacugauuaca

SEQ ID NO: 1565932 - RNA, 20 nt, Homo sapiens
caaaaguggggcuaaaugaa

SEQ ID NO: 1565933 - RNA, 21 nt, Homo sapiens
caaaaguggggcuaaaugaag

SEQ ID NO: 1565934 - RNA, 22 nt, Homo sapiens
caaaaguggggcuaaaugaagu

SEQ ID NO: 1565935 - RNA, 22 nt, Homo sapiens
caaaauaaagaucacacaucaa

SEQ ID NO: 1565936 - RNA, 17 nt, Homo sapiens
caaaauaaagaucacag

SEQ ID NO: 1565937 - RNA, 23 nt, Homo sapiens
caaaauacaauuuuuuugguaaa

SEQ ID NO: 1565938 - RNA, 15 nt, Homo sapiens
caaaauauacauuca

SEQ ID NO: 1565939 - RNA, 16 nt, Homo sapiens
caaaauauguuuaaaa

SEQ ID NO: 1565940 - RNA, 16 nt, Homo sapiens
caaaaucaaaacagag

SEQ ID NO: 1565941 - RNA, 15 nt, Homo sapiens
caaaaucaacaugac

SEQ ID NO: 1565942 - RNA, 14 nt, Homo sapiens
caaaauccaaggca

SEQ ID NO: 1565943 - RNA, 17 nt, Homo sapiens
caaaaucugcacaguca

SEQ ID NO: 1565944 - RNA, 20 nt, Homo sapiens
caaaaugaacacaucuugag

SEQ ID NO: 1565945 - RNA, 14 nt, Homo sapiens
caaaauguacuuaa

SEQ ID NO: 1565946 - RNA, 17 nt, Homo sapiens
caaaauuaaauacauaa

SEQ ID NO: 1565947 - RNA, 19 nt, Homo sapiens
caaaauugcaaaucuugaa

SEQ ID NO: 1565948 - RNA, 16 nt, Homo sapiens
caaaauuguuuaccau

SEQ ID NO: 1565949 - RNA, 16 nt, Homo sapiens
caaaauuugcugccaa

SEQ ID NO: 1565950 - RNA, 15 nt, Homo sapiens
caaacaauaaaggga

SEQ ID NO: 1565951 - RNA, 14 nt, Homo sapiens
caaacaaugcagau

SEQ ID NO: 1565952 - RNA, 13 nt, Homo sapiens
caaacacaauucu

SEQ ID NO: 1565953 - RNA, 13 nt, Homo sapiens
caaacagcaagaa

SEQ ID NO: 1565954 - RNA, 20 nt, Homo sapiens
caaacauggagaaaucuacu

SEQ ID NO: 1565955 - RNA, 17 nt, Homo sapiens
caaacgcccuuuccucc

SEQ ID NO: 1565956 - RNA, 11 nt, Homo sapiens
caaacucccua

SEQ ID NO: 1565957 - RNA, 22 nt, Homo sapiens
caaacuccuauuucaaugaguu

SEQ ID NO: 1565958 - RNA, 15 nt, Homo sapiens
caaacugaggaauuu

SEQ ID NO: 1565959 - RNA, 21 nt, Homo sapiens
caaacugcuuuuuccaacuca

SEQ ID NO: 1565960 - RNA, 23 nt, Homo sapiens
caaacugcuuuuuccaacucaga

SEQ ID NO: 1565961 - RNA, 19 nt, Homo sapiens
caaacuguaaaaaaugugu

SEQ ID NO: 1565962 - RNA, 20 nt, Homo sapiens
caaacuguagaaaugaugau

SEQ ID NO: 1565963 - RNA, 18 nt, Homo sapiens
caaacuuuagcaacaguu

SEQ ID NO: 1565964 - RNA, 22 nt, Homo sapiens
caaacuuuauuuuucuaugugu

SEQ ID NO: 1565965 - RNA, 15 nt, Homo sapiens
caaagaaaggagaua

SEQ ID NO: 1565966 - RNA, 17 nt, Homo sapiens
caaagaaaggagauaca

SEQ ID NO: 1565967 - RNA, 20 nt, Homo sapiens
caaagaaauuccccaagcac

SEQ ID NO: 1565968 - RNA, 15 nt, Homo sapiens
caaagaaguacuuua

SEQ ID NO: 1565969 - RNA, 14 nt, Homo sapiens
caaagaaugggcuu

SEQ ID NO: 1565970 - RNA, 18 nt, Homo sapiens
caaagaaugggcuugaaa

SEQ ID NO: 1565971 - RNA, 19 nt, Homo sapiens
caaagacaugcuuuccauu

SEQ ID NO: 1565972 - RNA, 14 nt, Homo sapiens
caaagacauuauuu

SEQ ID NO: 1565973 - RNA, 18 nt, Homo sapiens
caaagacauuauuucuca

SEQ ID NO: 1565974 - RNA, 13 nt, Homo sapiens
caaagaggcugcc

SEQ ID NO: 1565975 - RNA, 22 nt, Homo sapiens
caaagauacacaaucugaaaca

SEQ ID NO: 1565976 - RNA, 15 nt, Homo sapiens
caaagauguuuacau

SEQ ID NO: 1565977 - RNA, 15 nt, Homo sapiens
caaagcaagcauuca

SEQ ID NO: 1565978 - RNA, 23 nt, Homo sapiens
caaagcaaggaaacuauguaaca

SEQ ID NO: 1565979 - RNA, 14 nt, Homo sapiens
caaagccuuuccag

SEQ ID NO: 1565980 - RNA, 22 nt, Homo sapiens
caaagcuuucauguaaacugug

SEQ ID NO: 1565981 - RNA, 15 nt, Homo sapiens
caaaggacccaaucc

SEQ ID NO: 1565982 - RNA, 18 nt, Homo sapiens
caaagggccaucguucau

SEQ ID NO: 1565983 - RNA, 17 nt, Homo sapiens
caaagguuuauuccaga

SEQ ID NO: 1565984 - RNA, 20 nt, Homo sapiens
caaaguccuuuuuuuccauc

SEQ ID NO: 1565985 - RNA, 18 nt, Homo sapiens
caaagucucauagcuuug

SEQ ID NO: 1565986 - RNA, 13 nt, Homo sapiens
caaagucugcauc

SEQ ID NO: 1565987 - RNA, 14 nt, Homo sapiens
caaagugaaggaca

SEQ ID NO: 1565988 - RNA, 19 nt, Homo sapiens
caaagugcugggauuacag

SEQ ID NO: 1565989 - RNA, 11 nt, Homo sapiens
caaagugcuuu

SEQ ID NO: 1565990 - RNA, 18 nt, Homo sapiens
caaaguuaaggcuugaua

SEQ ID NO: 1565991 - RNA, 20 nt, Homo sapiens
caaaguuuaaauguauuuua

SEQ ID NO: 1565992 - RNA, 23 nt, Homo sapiens
caaauaaaacaaaaccaacucag

SEQ ID NO: 1565993 - RNA, 15 nt, Homo sapiens
caaauaaacacugug

SEQ ID NO: 1565994 - RNA, 12 nt, Homo sapiens
caaauaaacuca

SEQ ID NO: 1565995 - RNA, 16 nt, Homo sapiens
caaauaaauuaugcaa

SEQ ID NO: 1565996 - RNA, 22 nt, Homo sapiens
caaauaacuacagggugcccau

SEQ ID NO: 1565997 - RNA, 20 nt, Homo sapiens
caaauaauauuuuagauuac

SEQ ID NO: 1565998 - RNA, 14 nt, Homo sapiens
caaauacaugcaca

SEQ ID NO: 1565999 - RNA, 21 nt, Homo sapiens
caaauacuuagagcagugaag

SEQ ID NO: 1566000 - RNA, 18 nt, Homo sapiens
caaauacuuagcaaaaag

SEQ ID NO: 1566001 - RNA, 22 nt, Homo sapiens
caaauagaaccacuaugaagcu

SEQ ID NO: 1566002 - RNA, 21 nt, Homo sapiens
caaauaugcaaagcacugacu

SEQ ID NO: 1566003 - RNA, 18 nt, Homo sapiens
caaauauuagcaaagaag

SEQ ID NO: 1566004 - RNA, 19 nt, Homo sapiens
caaaucauuauguuuccua

SEQ ID NO: 1566005 - RNA, 19 nt, Homo sapiens
caaaucuaccacuguauga

SEQ ID NO: 1566006 - RNA, 13 nt, Homo sapiens
caaaucucucaua

SEQ ID NO: 1566007 - RNA, 15 nt, Homo sapiens
caaaugaaaacccca

SEQ ID NO: 1566008 - RNA, 15 nt, Homo sapiens
caaaugacgucuuca

SEQ ID NO: 1566009 - RNA, 22 nt, Homo sapiens
caaaugauuucauauugaucuu

SEQ ID NO: 1566010 - RNA, 16 nt, Homo sapiens
caaaugccugacucag

SEQ ID NO: 1566011 - RNA, 14 nt, Homo sapiens
caaaugucaucagg

SEQ ID NO: 1566012 - RNA, 14 nt, Homo sapiens
caaauguccuccag

SEQ ID NO: 1566013 - RNA, 17 nt, Homo sapiens
caaauguucaucaauga

SEQ ID NO: 1566014 - RNA, 14 nt, Homo sapiens
caaauuaguacaga

SEQ ID NO: 1566015 - RNA, 14 nt, Homo sapiens
caaauuaucuucac

SEQ ID NO: 1566016 - RNA, 17 nt, Homo sapiens
caaauuuagaaagcuua

SEQ ID NO: 1566017 - RNA, 19 nt, Homo sapiens
caaauuuagaaagcuuaag

SEQ ID NO: 1566018 - RNA, 16 nt, Homo sapiens
caaauuuucuggugcu

SEQ ID NO: 1566019 - RNA, 21 nt, Homo sapiens
caacaagauuuccuugugcaa

SEQ ID NO: 1566020 - RNA, 22 nt, Homo sapiens
caacaaugacuuaaccauauaa

SEQ ID NO: 1566021 - RNA, 15 nt, Homo sapiens
caacaauugguaaaa

SEQ ID NO: 1566022 - RNA, 17 nt, Homo sapiens
cuugauucugcaguaaa

SEQ ID NO: 1566023 - RNA, 22 nt, Homo sapiens
cuugauuuugcccccugaggga

SEQ ID NO: 1566024 - RNA, 13 nt, Homo sapiens
cuugauuuuugcc

SEQ ID NO: 1566025 - RNA, 16 nt, Homo sapiens
cuugcaauaccaaugu

SEQ ID NO: 1566026 - RNA, 23 nt, Homo sapiens
cuugcaauccaggcuguucucag

SEQ ID NO: 1566027 - RNA, 21 nt, Homo sapiens
cuugcagcggcuccugcaaaa

SEQ ID NO: 1566028 - RNA, 12 nt, Homo sapiens
cuugcagcuuua

SEQ ID NO: 1566029 - RNA, 14 nt, Homo sapiens
cuugcaucugcaca

SEQ ID NO: 1566030 - RNA, 20 nt, Homo sapiens
cuugcaugcuugcauaagag

SEQ ID NO: 1566031 - RNA, 20 nt, Homo sapiens
cuugcauuugugguaaucua

SEQ ID NO: 1566032 - RNA, 16 nt, Homo sapiens
cuugccucuuucucca

SEQ ID NO: 1566033 - RNA, 14 nt, Homo sapiens
cuugcucaaaacac

SEQ ID NO: 1566034 - RNA, 14 nt, Homo sapiens
cuugcucugucacc

SEQ ID NO: 1566035 - RNA, 23 nt, Homo sapiens
cuugcugcccgcgggagacagcu

SEQ ID NO: 1566036 - RNA, 18 nt, Homo sapiens
cuugcugguagaagcuga

SEQ ID NO: 1566037 - RNA, 16 nt, Homo sapiens
cuugcuuuccugcauc

SEQ ID NO: 1566038 - RNA, 23 nt, Homo sapiens
cuugcuuuccugggccuuugcaa

SEQ ID NO: 1566039 - RNA, 22 nt, Homo sapiens
cuuggaaaaaauaaaaacauca

SEQ ID NO: 1566040 - RNA, 23 nt, Homo sapiens
cuuggaaauagaaagaagccaua

SEQ ID NO: 1566041 - RNA, 14 nt, Homo sapiens
cuuggaaaugacca

SEQ ID NO: 1566042 - RNA, 21 nt, Homo sapiens
cuuggaauuggaauuacugua

SEQ ID NO: 1566043 - RNA, 16 nt, Homo sapiens
cuuggaccaugccaga

SEQ ID NO: 1566044 - RNA, 12 nt, Homo sapiens
cuuggaccucag

SEQ ID NO: 1566045 - RNA, 14 nt, Homo sapiens
cuuggacuacacaa

SEQ ID NO: 1566046 - RNA, 14 nt, Homo sapiens
cuuggagacuccug

SEQ ID NO: 1566047 - RNA, 18 nt, Homo sapiens
cuuggcacccccaugcug

SEQ ID NO: 1566048 - RNA, 19 nt, Homo sapiens
cuuggcagcccgggucauc

SEQ ID NO: 1566049 - RNA, 21 nt, Homo sapiens
cuuggcaguugcagugcugcu

SEQ ID NO: 1566050 - RNA, 21 nt, Homo sapiens
cuuggcauacaaaauauuuaa

SEQ ID NO: 1566051 - RNA, 17 nt, Homo sapiens
cuuggccucccaaucuu

SEQ ID NO: 1566052 - RNA, 21 nt, Homo sapiens
cuuggcucacugcaaccucua

SEQ ID NO: 1566053 - RNA, 17 nt, Homo sapiens
cuuggggaaauggggcu

SEQ ID NO: 1566054 - RNA, 18 nt, Homo sapiens
cuuggucgccuagacugg

SEQ ID NO: 1566055 - RNA, 21 nt, Homo sapiens
cuuggugcgagggaagcaauu

SEQ ID NO: 1566056 - RNA, 22 nt, Homo sapiens
cuuggugcgagggaagcaauug

SEQ ID NO: 1566057 - RNA, 15 nt, Homo sapiens
cuugguguaauuuga

SEQ ID NO: 1566058 - RNA, 20 nt, Homo sapiens
cuugguugucuggcaaggac

SEQ ID NO: 1566059 - RNA, 19 nt, Homo sapiens
cuuguaaagacacaucuua

SEQ ID NO: 1566060 - RNA, 21 nt, Homo sapiens
cuuguaauaccugauugauca

SEQ ID NO: 1566061 - RNA, 18 nt, Homo sapiens
cuuguaucaaauucaaua

SEQ ID NO: 1566062 - RNA, 17 nt, Homo sapiens
cuuguauuuccaaaccu

SEQ ID NO: 1566063 - RNA, 17 nt, Homo sapiens
cuugucaaagaaggugc

SEQ ID NO: 1566064 - RNA, 22 nt, Homo sapiens
cuuguccacccaccuaugugcc

SEQ ID NO: 1566065 - RNA, 14 nt, Homo sapiens
cuuguccccgcagc

SEQ ID NO: 1566066 - RNA, 22 nt, Homo sapiens
cuugugguuagcaagacugcaa

SEQ ID NO: 1566067 - RNA, 19 nt, Homo sapiens
cuugugucaagacauuucu

SEQ ID NO: 1566068 - RNA, 17 nt, Homo sapiens
cuuguguuauauagcca

SEQ ID NO: 1566069 - RNA, 18 nt, Homo sapiens
cuuguuuuacccuauaca

SEQ ID NO: 1566070 - RNA, 22 nt, Homo sapiens
cuuguuuuacccuauacaucca

SEQ ID NO: 1566071 - RNA, 22 nt, Homo sapiens
cuuuaaaaauacauagcauuaa

SEQ ID NO: 1566072 - RNA, 15 nt, Homo sapiens
cuuuaaaagucauua

SEQ ID NO: 1566073 - RNA, 15 nt, Homo sapiens
cuuuaagaacuaaaa

SEQ ID NO: 1566074 - RNA, 14 nt, Homo sapiens
cuuuaaguauacaa

SEQ ID NO: 1566075 - RNA, 12 nt, Homo sapiens
cuuuaagugugc

SEQ ID NO: 1566076 - RNA, 13 nt, Homo sapiens
cuuuaagugugcu

SEQ ID NO: 1566077 - RNA, 22 nt, Homo sapiens
cuuuaaucacuuaacauuccua

SEQ ID NO: 1566078 - RNA, 13 nt, Homo sapiens
cuuuaauucugua

SEQ ID NO: 1566079 - RNA, 18 nt, Homo sapiens
cuuuacaaaaguauuauc

SEQ ID NO: 1566080 - RNA, 22 nt, Homo sapiens
cuuuagaaggacucaguauuau

SEQ ID NO: 1566081 - RNA, 13 nt, Homo sapiens
cuuuagaaugaga

SEQ ID NO: 1566082 - RNA, 22 nt, Homo sapiens
cuuuaguuuuugugaaguuuaa

SEQ ID NO: 1566083 - RNA, 15 nt, Homo sapiens
cuuuaucuuugugua

SEQ ID NO: 1566084 - RNA, 15 nt, Homo sapiens
cuuuaugugcaaaau

SEQ ID NO: 1566085 - RNA, 22 nt, Homo sapiens
cuuuauguggguuaucauggaa

SEQ ID NO: 1566086 - RNA, 14 nt, Homo sapiens
cuuuauugcagaau

SEQ ID NO: 1566087 - RNA, 23 nt, Homo sapiens
cuuuauuuacacuccucuaucau

SEQ ID NO: 1566088 - RNA, 12 nt, Homo sapiens
cuuuauuuuaga

SEQ ID NO: 1566089 - RNA, 13 nt, Homo sapiens
cuuucaagacaga

SEQ ID NO: 1566090 - RNA, 21 nt, Homo sapiens
cuuucaagugagacccaaagg

SEQ ID NO: 1566091 - RNA, 15 nt, Homo sapiens
cuuucaccagaauuu

SEQ ID NO: 1566092 - RNA, 10 nt, Homo sapiens
cuuucaggaa

SEQ ID NO: 1566093 - RNA, 21 nt, Homo sapiens
cuuucagggguggcccaauga

SEQ ID NO: 1566094 - RNA, 16 nt, Homo sapiens
cuuuccaaccggcuuu

SEQ ID NO: 1566095 - RNA, 15 nt, Homo sapiens
cuuuccaagucauuu

SEQ ID NO: 1566096 - RNA, 20 nt, Homo sapiens
cuuuccagccuauagcagaa

SEQ ID NO: 1566097 - RNA, 14 nt, Homo sapiens
cuuucccaguccca

SEQ ID NO: 1566098 - RNA, 22 nt, Homo sapiens
cuuucccagucccauuccucag

SEQ ID NO: 1566099 - RNA, 18 nt, Homo sapiens
cuuucccucauccaugcu

SEQ ID NO: 1566100 - RNA, 23 nt, Homo sapiens
cuuuccuuuaaaaauacauagca

SEQ ID NO: 1566101 - RNA, 18 nt, Homo sapiens
cuuucuaaaggaaaucaa

SEQ ID NO: 1566102 - RNA, 15 nt, Homo sapiens
cuuucuaccaucuca

SEQ ID NO: 1566103 - RNA, 20 nt, Homo sapiens
cuuucuguccuaaucauaca

SEQ ID NO: 1566104 - RNA, 16 nt, Homo sapiens
cuuucuuaucuggaaa

SEQ ID NO: 1566105 - RNA, 21 nt, Homo sapiens
cuuucuucaccaagugcaaua

SEQ ID NO: 1566106 - RNA, 14 nt, Homo sapiens
cuuucuucuagugc

SEQ ID NO: 1566107 - RNA, 14 nt, Homo sapiens
cuuucuuguugcug

SEQ ID NO: 1566108 - RNA, 15 nt, Homo sapiens
cuuucuuguugcugc

SEQ ID NO: 1566109 - RNA, 17 nt, Homo sapiens
cuuucuuguugcugcau

SEQ ID NO: 1566110 - RNA, 21 nt, Homo sapiens
cuuucuuguugcugcaucucc

SEQ ID NO: 1566111 - RNA, 20 nt, Homo sapiens
cuuucuuuccaaaacauuuc

SEQ ID NO: 1566112 - RNA, 21 nt, Homo sapiens
cuuugagaggcugagguggua

SEQ ID NO: 1566113 - RNA, 18 nt, Homo sapiens
cuuugaucuguuugucaa

SEQ ID NO: 1566114 - RNA, 13 nt, Homo sapiens
cuuugauucuccu

SEQ ID NO: 1566115 - RNA, 17 nt, Homo sapiens
cuuugcaccaaagacau

SEQ ID NO: 1566116 - RNA, 18 nt, Homo sapiens
cuuugccaauccccgugc

SEQ ID NO: 1566117 - RNA, 14 nt, Homo sapiens
cuuugccacaaagc

SEQ ID NO: 1566118 - RNA, 21 nt, Homo sapiens
cuuugccagaggcugauguca

SEQ ID NO: 1566119 - RNA, 17 nt, Homo sapiens
cuuugcuaguaccaaaa

SEQ ID NO: 1566120 - RNA, 17 nt, Homo sapiens
cuuugcucccugcaaga

SEQ ID NO: 1566121 - RNA, 18 nt, Homo sapiens
cuuugcucccugcaagaa

SEQ ID NO: 1566122 - RNA, 17 nt, Homo sapiens
cucuaccccugcuccca

SEQ ID NO: 1566123 - RNA, 11 nt, Homo sapiens
cucuaccuaau

SEQ ID NO: 1566124 - RNA, 17 nt, Homo sapiens
cucuaccugcacacugu

SEQ ID NO: 1566125 - RNA, 21 nt, Homo sapiens
cucuacuaaaaauacaaaaau

SEQ ID NO: 1566126 - RNA, 20 nt, Homo sapiens
cucuacucuggagguuuguu

SEQ ID NO: 1566127 - RNA, 14 nt, Homo sapiens
cucuacugccucaa

SEQ ID NO: 1566128 - RNA, 21 nt, Homo sapiens
cucuagaaugagcaagacugg

SEQ ID NO: 1566129 - RNA, 23 nt, Homo sapiens
cucuagaggcaucaccugggacc

SEQ ID NO: 1566130 - RNA, 22 nt, Homo sapiens
cucuagauggcaacauuggaca

SEQ ID NO: 1566131 - RNA, 20 nt, Homo sapiens
cucuagcauucuaguuucau

SEQ ID NO: 1566132 - RNA, 14 nt, Homo sapiens
cucuaggcuguucu

SEQ ID NO: 1566133 - RNA, 23 nt, Homo sapiens
cucuaggcuucagguugcauugg

SEQ ID NO: 1566134 - RNA, 20 nt, Homo sapiens
cucuaguugaacccugggaa

SEQ ID NO: 1566135 - RNA, 19 nt, Homo sapiens
cucuaguugaguuucuggc

SEQ ID NO: 1566136 - RNA, 21 nt, Homo sapiens
ccuuuuccuuauuugccuucu

SEQ ID NO: 1566137 - RNA, 13 nt, Homo sapiens
ccuuuucuguucu

SEQ ID NO: 1566138 - RNA, 13 nt, Homo sapiens
ccuuuugccaucc

SEQ ID NO: 1566139 - RNA, 13 nt, Homo sapiens
ccuuuuguuaaaa

SEQ ID NO: 1566140 - RNA, 19 nt, Homo sapiens
ccuuuuuacuauacagcau

SEQ ID NO: 1566141 - RNA, 19 nt, Homo sapiens
ccuuuuuccugcgucccag

SEQ ID NO: 1566142 - RNA, 17 nt, Homo sapiens
ccuuuuuguuuguacug

SEQ ID NO: 1566143 - RNA, 12 nt, Homo sapiens
ccuuuuuuccca

SEQ ID NO: 1566144 - RNA, 23 nt, Homo sapiens
ccuuuuuugaucaggcacagugg

SEQ ID NO: 1566145 - RNA, 21 nt, Homo sapiens
ccuuuuuuguuuuuucaaaau

SEQ ID NO: 1566146 - RNA, 17 nt, Homo sapiens
ccuuuuuuuaaguagua

SEQ ID NO: 1566147 - RNA, 18 nt, Homo sapiens
ccuuuuuuuacauuucau

SEQ ID NO: 1566148 - RNA, 16 nt, Homo sapiens
cgaacaauucauauau

SEQ ID NO: 1566149 - RNA, 17 nt, Homo sapiens
cgaaccuacaguuuuaa

SEQ ID NO: 1566150 - RNA, 17 nt, Homo sapiens
cgaaucuacuaauucca

SEQ ID NO: 1566151 - RNA, 17 nt, Homo sapiens
cgacauagcgagacucc

SEQ ID NO: 1566152 - RNA, 22 nt, Homo sapiens
cgaccuaauugucuuuguucug

SEQ ID NO: 1566153 - RNA, 22 nt, Homo sapiens
cgaccuccccacccgcucccac

SEQ ID NO: 1566154 - RNA, 22 nt, Homo sapiens
cgacuaauuucaaaaugcuuuu

SEQ ID NO: 1566155 - RNA, 21 nt, Homo sapiens
cgacuuuuaacuauguaauaa

SEQ ID NO: 1566156 - RNA, 15 nt, Homo sapiens
cgagacaacagcaca

SEQ ID NO: 1566157 - RNA, 18 nt, Homo sapiens
cgagacaacagcacacag

SEQ ID NO: 1566158 - RNA, 23 nt, Homo sapiens
cgagacgccuuugugagcuguga

SEQ ID NO: 1566159 - RNA, 22 nt, Homo sapiens
cgagacuccaccucuaccaaaa

SEQ ID NO: 1566160 - RNA, 12 nt, Homo sapiens
cgagacuccauc

SEQ ID NO: 1566161 - RNA, 21 nt, Homo sapiens
cgagauugcgccauugcacuc

SEQ ID NO: 1566162 - RNA, 18 nt, Homo sapiens
cgagcacauagagcuuuu

SEQ ID NO: 1566163 - RNA, 17 nt, Homo sapiens
cgagcaggcuacuguca

SEQ ID NO: 1566164 - RNA, 16 nt, Homo sapiens
cgaggacccaggaaag

SEQ ID NO: 1566165 - RNA, 18 nt, Homo sapiens
cgaggcuugggcucccac

SEQ ID NO: 1566166 - RNA, 14 nt, Homo sapiens
cgaguaacuccccu

SEQ ID NO: 1566167 - RNA, 13 nt, Homo sapiens
cgaguaccagcug

SEQ ID NO: 1566168 - RNA, 22 nt, Homo sapiens
cgagucaauccccucauucagg

SEQ ID NO: 1566169 - RNA, 14 nt, Homo sapiens
cgaguguuugccag

SEQ ID NO: 1566170 - RNA, 20 nt, Homo sapiens
cgauaucuucagaaaaccua

SEQ ID NO: 1566171 - RNA, 21 nt, Homo sapiens
cgaucaaguuguugacuguga

SEQ ID NO: 1566172 - RNA, 16 nt, Homo sapiens
cgaucaggaccugcuu

SEQ ID NO: 1566173 - RNA, 13 nt, Homo sapiens
cgaugacaguguu

SEQ ID NO: 1566174 - RNA, 15 nt, Homo sapiens
cgaugugacugccau

SEQ ID NO: 1566175 - RNA, 23 nt, Homo sapiens
cgcacacacccauguaaccacug

SEQ ID NO: 1566176 - RNA, 15 nt, Homo sapiens
cgcaccagacacuca

SEQ ID NO: 1566177 - RNA, 19 nt, Homo sapiens
cgcaugagaacauuaacaa

SEQ ID NO: 1566178 - RNA, 16 nt, Homo sapiens
cgcaugauggagcuga

SEQ ID NO: 1566179 - RNA, 14 nt, Homo sapiens
cgcauguaugcaug

SEQ ID NO: 1566180 - RNA, 15 nt, Homo sapiens
cgcauuggugacuca

SEQ ID NO: 1566181 - RNA, 19 nt, Homo sapiens
cgccaacauggcacaugua

SEQ ID NO: 1566182 - RNA, 19 nt, Homo sapiens
cgccaaucccgccaugcuc

SEQ ID NO: 1566183 - RNA, 15 nt, Homo sapiens
cgccaggaagccaga

SEQ ID NO: 1566184 - RNA, 12 nt, Homo sapiens
cgccaggccagc

SEQ ID NO: 1566185 - RNA, 19 nt, Homo sapiens
cgcccacccgccuugugag

SEQ ID NO: 1566186 - RNA, 21 nt, Homo sapiens
cgcccagacaccaugugcaau

SEQ ID NO: 1566187 - RNA, 20 nt, Homo sapiens
cgcccaggcuggagugcagu

SEQ ID NO: 1566188 - RNA, 14 nt, Homo sapiens
cgcccccaccagcu

SEQ ID NO: 1566189 - RNA, 18 nt, Homo sapiens
cgcccucuaucaugguga

SEQ ID NO: 1566190 - RNA, 19 nt, Homo sapiens
cgcccugggcugucuguca

SEQ ID NO: 1566191 - RNA, 21 nt, Homo sapiens
cgccuguaaucccagcacuuu

SEQ ID NO: 1566192 - RNA, 22 nt, Homo sapiens
cgccuguaaucccagcacuuug

SEQ ID NO: 1566193 - RNA, 21 nt, Homo sapiens
cgccuucuuagaguuuuauuc

SEQ ID NO: 1566194 - RNA, 19 nt, Homo sapiens
cgccuuugugagcugugag

SEQ ID NO: 1566195 - RNA, 22 nt, Homo sapiens
cgcgagcugcugauacagaaga

SEQ ID NO: 1566196 - RNA, 12 nt, Homo sapiens
cgcgcucgccca

SEQ ID NO: 1566197 - RNA, 15 nt, Homo sapiens
cgcuccacagagaua

SEQ ID NO: 1566198 - RNA, 15 nt, Homo sapiens
cgcugcagaccccag

SEQ ID NO: 1566199 - RNA, 15 nt, Homo sapiens
cgcugcauacagggg

SEQ ID NO: 1566200 - RNA, 16 nt, Homo sapiens
cgcuggcuggugggcc

SEQ ID NO: 1566201 - RNA, 20 nt, Homo sapiens
cgcuggguauuggaaaugga

SEQ ID NO: 1566202 - RNA, 16 nt, Homo sapiens
cgcuuaguuaucagcu

SEQ ID NO: 1566203 - RNA, 17 nt, Homo sapiens
cgcuuaucaacuaauga

SEQ ID NO: 1566204 - RNA, 10 nt, Homo sapiens
cgcuugcucg

SEQ ID NO: 1566205 - RNA, 17 nt, Homo sapiens
cggaagggguuccucaa

SEQ ID NO: 1566206 - RNA, 12 nt, Homo sapiens
cggaaugcauug

SEQ ID NO: 1566207 - RNA, 21 nt, Homo sapiens
cggaaugucauagucuugaaa

SEQ ID NO: 1566208 - RNA, 22 nt, Homo sapiens
cggacaagacccccagcacuug

SEQ ID NO: 1566209 - RNA, 21 nt, Homo sapiens
cggaccccuuguuacucagga

SEQ ID NO: 1566210 - RNA, 21 nt, Homo sapiens
cggacucacuauggccagaaa

SEQ ID NO: 1566211 - RNA, 17 nt, Homo sapiens
cggacugucaguucucu

SEQ ID NO: 1566212 - RNA, 20 nt, Homo sapiens
cggagaagagcuguucacag

SEQ ID NO: 1566213 - RNA, 17 nt, Homo sapiens
cggaggucucuguaaaa

SEQ ID NO: 1566214 - RNA, 16 nt, Homo sapiens
cggagguugcagugag

SEQ ID NO: 1566215 - RNA, 21 nt, Homo sapiens
cggauggaccaaccugcucug

SEQ ID NO: 1566216 - RNA, 19 nt, Homo sapiens
cggcaggugcucuguggau

SEQ ID NO: 1566217 - RNA, 14 nt, Homo sapiens
cggcagucaugcug

SEQ ID NO: 1566218 - RNA, 16 nt, Homo sapiens
cggccccaucucucau

SEQ ID NO: 1566219 - RNA, 16 nt, Homo sapiens
cggcgaagugcuaaaa

SEQ ID NO: 1566220 - RNA, 18 nt, Homo sapiens
cggcuccuggugcuaaca

SEQ ID NO: 1566221 - RNA, 15 nt, Homo sapiens
cgggacacagaauua

SEQ ID NO: 1566222 - RNA, 15 nt, Homo sapiens
cgggacaccuaggcu

SEQ ID NO: 1566223 - RNA, 18 nt, Homo sapiens
cgggagccugacccucau

SEQ ID NO: 1566224 - RNA, 20 nt, Homo sapiens
cgggagcucuguauggucag

SEQ ID NO: 1566225 - RNA, 21 nt, Homo sapiens
cgggcaccaacuccauguuug

SEQ ID NO: 1566226 - RNA, 14 nt, Homo sapiens
cgguagugccugaa

SEQ ID NO: 1566227 - RNA, 15 nt, Homo sapiens
cggugcuccaucucc

SEQ ID NO: 1566228 - RNA, 15 nt, Homo sapiens
cgguggcucaugccu

SEQ ID NO: 1566229 - RNA, 14 nt, Homo sapiens
cgguguuuugccau

SEQ ID NO: 1566230 - RNA, 15 nt, Homo sapiens
cgguuaccucugcau

SEQ ID NO: 1566231 - RNA, 23 nt, Homo sapiens
cguaacagauuuuguuggcauag

SEQ ID NO: 1566232 - RNA, 16 nt, Homo sapiens
cguacaucugcaauau

SEQ ID NO: 1566233 - RNA, 20 nt, Homo sapiens
cguaccaccaugcacuguaa

SEQ ID NO: 1566234 - RNA, 14 nt, Homo sapiens
cguaucacaguguu

SEQ ID NO: 1566235 - RNA, 13 nt, Homo sapiens
cguaucucuagaa

SEQ ID NO: 1566236 - RNA, 17 nt, Homo sapiens
cguauguuuguacuugg

SEQ ID NO: 1566237 - RNA, 15 nt, Homo sapiens
cgucccagccugcac

SEQ ID NO: 1566238 - RNA, 12 nt, Homo sapiens
cgucccuaagca

SEQ ID NO: 1566239 - RNA, 12 nt, Homo sapiens
cguccuggucaa

SEQ ID NO: 1566240 - RNA, 22 nt, Homo sapiens
cgucgaaagaaagaauauguaa

SEQ ID NO: 1566241 - RNA, 20 nt, Homo sapiens
cgucucuacuaaaaauacaa

SEQ ID NO: 1566242 - RNA, 20 nt, Homo sapiens
cgugagggggggguggguga

SEQ ID NO: 1566243 - RNA, 13 nt, Homo sapiens
cgugauggucuga

SEQ ID NO: 1566244 - RNA, 14 nt, Homo sapiens
cguugugcacaugu

SEQ ID NO: 1566245 - RNA, 19 nt, Homo sapiens
cguuuaaucccagcacuuu

SEQ ID NO: 1566246 - RNA, 23 nt, Homo sapiens
cguuuucauuguucacuucuaaa

SEQ ID NO: 1566247 - RNA, 14 nt, Homo sapiens
cguuuuccaaagag

SEQ ID NO: 1566248 - RNA, 23 nt, Homo sapiens
cuaaaaaugaaccugcaagccuu

SEQ ID NO: 1566249 - RNA, 17 nt, Homo sapiens
cuaaaaaugguuaucau

SEQ ID NO: 1566250 - RNA, 19 nt, Homo sapiens
cuaaaagcauguauaguua

SEQ ID NO: 1566251 - RNA, 16 nt, Homo sapiens
cuaaaaguucauaaca

SEQ ID NO: 1566252 - RNA, 19 nt, Homo sapiens
cuaaaauuauguuacugua

SEQ ID NO: 1566253 - RNA, 20 nt, Homo sapiens
cuaaaauuauguuacuguau

SEQ ID NO: 1566254 - RNA, 22 nt, Homo sapiens
cuaaaauuguaucaaaugugac

SEQ ID NO: 1566255 - RNA, 16 nt, Homo sapiens
cuaaacggauuccaaa

SEQ ID NO: 1566256 - RNA, 17 nt, Homo sapiens
cuaaacuuuccaaaacc

SEQ ID NO: 1566257 - RNA, 18 nt, Homo sapiens
cuaaagaagauaaacaca

SEQ ID NO: 1566258 - RNA, 12 nt, Homo sapiens
cuaaagacauga

SEQ ID NO: 1566259 - RNA, 21 nt, Homo sapiens
cuaaagaguuauucaaaugaa

SEQ ID NO: 1566260 - RNA, 20 nt, Homo sapiens
cuaaagcaguguuugcucca

SEQ ID NO: 1566261 - RNA, 13 nt, Homo sapiens
cuaaagcuuuauc

SEQ ID NO: 1566262 - RNA, 14 nt, Homo sapiens
cuaaaggacuauua

SEQ ID NO: 1566263 - RNA, 18 nt, Homo sapiens
cuaaagggagaaaugcca

SEQ ID NO: 1566264 - RNA, 21 nt, Homo sapiens
cuaaaguacagccuggaccac

SEQ ID NO: 1566265 - RNA, 21 nt, Homo sapiens
cuaaagugauccuaaauauga

SEQ ID NO: 1566266 - RNA, 19 nt, Homo sapiens
cuaaagugcugcacucaaa

SEQ ID NO: 1566267 - RNA, 12 nt, Homo sapiens
cuaaaguuuuag

SEQ ID NO: 1566268 - RNA, 21 nt, Homo sapiens
cuaaaguuuugcaacaauaaa

SEQ ID NO: 1566269 - RNA, 16 nt, Homo sapiens
cuaaauaugagcccag

SEQ ID NO: 1566270 - RNA, 16 nt, Homo sapiens
cuaaaugagauacacu

SEQ ID NO: 1566271 - RNA, 23 nt, Homo sapiens
cuaaaugcagacaacaccuuccu

SEQ ID NO: 1566272 - RNA, 22 nt, Homo sapiens
cuaaauuuaagcuuaagccaua

SEQ ID NO: 1566273 - RNA, 20 nt, Homo sapiens
cuaacaacaaaguuccacuu

SEQ ID NO: 1566274 - RNA, 22 nt, Homo sapiens
cuaacacuuuaguuauauucac

SEQ ID NO: 1566275 - RNA, 18 nt, Homo sapiens
cuaacagucuagugcaaa

SEQ ID NO: 1566276 - RNA, 21 nt, Homo sapiens
cuaacauuauauugcaaugaa

SEQ ID NO: 1566277 - RNA, 20 nt, Homo sapiens
cuaaccugcacguugugcac

SEQ ID NO: 1566278 - RNA, 22 nt, Homo sapiens
cuaaccugcacguugugcacau

SEQ ID NO: 1566279 - RNA, 17 nt, Homo sapiens
cuaacgcugaacugaca

SEQ ID NO: 1566280 - RNA, 18 nt, Homo sapiens
cuaacguccacuagcuua

SEQ ID NO: 1566281 - RNA, 17 nt, Homo sapiens
cuaacuagcauuguaaa

SEQ ID NO: 1566282 - RNA, 13 nt, Homo sapiens
cuaacugcuguua

SEQ ID NO: 1566283 - RNA, 20 nt, Homo sapiens
cuaacuggcaggggagacag

SEQ ID NO: 1566284 - RNA, 22 nt, Homo sapiens
cuaacugggaggacauucugcu

SEQ ID NO: 1566285 - RNA, 21 nt, Homo sapiens
cuaacuugaaaagaaaaccac

SEQ ID NO: 1566286 - RNA, 20 nt, Homo sapiens
cuaacuuuuccaagcaaaau

SEQ ID NO: 1566287 - RNA, 17 nt, Homo sapiens
cuaagaaaaaaagcaca

SEQ ID NO: 1566288 - RNA, 22 nt, Homo sapiens
cuaagaaaaaggaaaaccauuc

SEQ ID NO: 1566289 - RNA, 15 nt, Homo sapiens
cuaagaaacacucau

SEQ ID NO: 1566290 - RNA, 14 nt, Homo sapiens
cuaagaagggaaaa

SEQ ID NO: 1566291 - RNA, 21 nt, Homo sapiens
cuaagaagugaaaaucuacac

SEQ ID NO: 1566292 - RNA, 19 nt, Homo sapiens
cuaagagaaggggugcaga

SEQ ID NO: 1566293 - RNA, 19 nt, Homo sapiens
cuaagagacaguucucugu

SEQ ID NO: 1566294 - RNA, 17 nt, Homo sapiens
cuaagcaaguauauuua

SEQ ID NO: 1566295 - RNA, 17 nt, Homo sapiens
cuaagcacagaaacuca

SEQ ID NO: 1566296 - RNA, 21 nt, Homo sapiens
cuaagcaguuauggugaugac

SEQ ID NO: 1566297 - RNA, 18 nt, Homo sapiens
cuaagccuuugccgugag

SEQ ID NO: 1566298 - RNA, 15 nt, Homo sapiens
cuaagcugcucuaaa

SEQ ID NO: 1566299 - RNA, 13 nt, Homo sapiens
cuaagcuguaacc

SEQ ID NO: 1566300 - RNA, 21 nt, Homo sapiens
cuaaggagcugauacuuugac

SEQ ID NO: 1566301 - RNA, 13 nt, Homo sapiens
cuaaggcagcuaa

SEQ ID NO: 1566302 - RNA, 16 nt, Homo sapiens
cuaagggguacuccuc

SEQ ID NO: 1566303 - RNA, 17 nt, Homo sapiens
cuaagguucagccugaa

SEQ ID NO: 1566304 - RNA, 24 nt, Homo sapiens
cuaagguucuugcuuucucucuca

SEQ ID NO: 1566305 - RNA, 23 nt, Homo sapiens
cuaaguaauuuagaagauauuau

SEQ ID NO: 1566306 - RNA, 20 nt, Homo sapiens
cuaagucauuccuccagugc

SEQ ID NO: 1566307 - RNA, 13 nt, Homo sapiens
cuaagugcuuauu

SEQ ID NO: 1566308 - RNA, 20 nt, Homo sapiens
cuaagugggagaaggacuau

SEQ ID NO: 1566309 - RNA, 17 nt, Homo sapiens
cuaaguguuuucaaaua

SEQ ID NO: 1566310 - RNA, 16 nt, Homo sapiens
cuaauaccugucaaca

SEQ ID NO: 1566311 - RNA, 17 nt, Homo sapiens
cuaauagaacuuguuaa

SEQ ID NO: 1566312 - RNA, 16 nt, Homo sapiens
cuaauaucaaaugcag

SEQ ID NO: 1566313 - RNA, 14 nt, Homo sapiens
cuaauaucuuuaaa

SEQ ID NO: 1566314 - RNA, 20 nt, Homo sapiens
cuaaucaccauguaagcacu

SEQ ID NO: 1566315 - RNA, 18 nt, Homo sapiens
cuaaugaaagugaugaca

SEQ ID NO: 1566316 - RNA, 15 nt, Homo sapiens
cuaaugaaguauuac

SEQ ID NO: 1566317 - RNA, 20 nt, Homo sapiens
cuaaugagagugcacugcuc

SEQ ID NO: 1566318 - RNA, 14 nt, Homo sapiens
cuaaugcacucugg

SEQ ID NO: 1566319 - RNA, 23 nt, Homo sapiens
cuaaugcacucugggucuggcca

SEQ ID NO: 1566320 - RNA, 18 nt, Homo sapiens
cuaaugccuaucugacca

SEQ ID NO: 1566321 - RNA, 22 nt, Homo sapiens
cuaauuuacuggacaaagaauu

SEQ ID NO: 1566322 - RNA, 20 nt, Homo sapiens
cuacaaacguuugacaaaca

SEQ ID NO: 1566323 - RNA, 17 nt, Homo sapiens
cuacaaacuucaaagag

SEQ ID NO: 1566324 - RNA, 13 nt, Homo sapiens
cuacaauucauug

SEQ ID NO: 1566325 - RNA, 18 nt, Homo sapiens
cuacacaauacaguauua

SEQ ID NO: 1566326 - RNA, 14 nt, Homo sapiens
cuacacacaguacg

SEQ ID NO: 1566327 - RNA, 16 nt, Homo sapiens
cuacagaaaaaggaaa

SEQ ID NO: 1566328 - RNA, 14 nt, Homo sapiens
cuacagaugaguca

SEQ ID NO: 1566329 - RNA, 20 nt, Homo sapiens
cuacaggagaugcugucacu

SEQ ID NO: 1566330 - RNA, 17 nt, Homo sapiens
cuacaggcucaugccau

SEQ ID NO: 1566331 - RNA, 17 nt, Homo sapiens
cuacagggcuuaggacu

SEQ ID NO: 1566332 - RNA, 12 nt, Homo sapiens
cuacaguuauua

SEQ ID NO: 1566333 - RNA, 19 nt, Homo sapiens
cuacaguuuuuaacucuac

SEQ ID NO: 1566334 - RNA, 17 nt, Homo sapiens
cuacauaugaucugucu

SEQ ID NO: 1566335 - RNA, 17 nt, Homo sapiens
cuacauccaauguauga

SEQ ID NO: 1566336 - RNA, 12 nt, Homo sapiens
cuacaucugccu

SEQ ID NO: 1566337 - RNA, 22 nt, Homo sapiens
cuacaucuuuuuuucuaugaaa

SEQ ID NO: 1566338 - RNA, 14 nt, Homo sapiens
cuacaugcugaaaa

SEQ ID NO: 1566339 - RNA, 22 nt, Homo sapiens
cuacaugucuagagaacacugu

SEQ ID NO: 1566340 - RNA, 14 nt, Homo sapiens
cuacauuaucucac

SEQ ID NO: 1566341 - RNA, 18 nt, Homo sapiens
cuacauuucuacuaugau

SEQ ID NO: 1566342 - RNA, 17 nt, Homo sapiens
cuacauuucugcagauc

SEQ ID NO: 1566343 - RNA, 18 nt, Homo sapiens
cuacauuuuaaaaacuga

SEQ ID NO: 1566344 - RNA, 14 nt, Homo sapiens
cuaccaaaacaguu

SEQ ID NO: 1566345 - RNA, 17 nt, Homo sapiens
cuaccaguuggccauga

SEQ ID NO: 1566346 - RNA, 20 nt, Homo sapiens
cuaccaucucacggugggga

SEQ ID NO: 1566347 - RNA, 20 nt, Homo sapiens
cuacccccugugccuuguca

SEQ ID NO: 1566348 - RNA, 14 nt, Homo sapiens
cuacccuaaccaag

SEQ ID NO: 1566349 - RNA, 19 nt, Homo sapiens
cuacccuuccagugcccua

SEQ ID NO: 1566350 - RNA, 21 nt, Homo sapiens
cucaaaaucugugaccuguca

SEQ ID NO: 1566351 - RNA, 11 nt, Homo sapiens
cucaaaaucuu

SEQ ID NO: 1566352 - RNA, 19 nt, Homo sapiens
cucaaaaucuuuccaaaua

SEQ ID NO: 1566353 - RNA, 16 nt, Homo sapiens
cucaaacuugagaaaa

SEQ ID NO: 1566354 - RNA, 20 nt, Homo sapiens
cucaaauacaugcacaguca

SEQ ID NO: 1566355 - RNA, 17 nt, Homo sapiens
cucaacacccaacuguc

SEQ ID NO: 1566356 - RNA, 22 nt, Homo sapiens
cucaacacccugggcagcuaca

SEQ ID NO: 1566357 - RNA, 22 nt, Homo sapiens
cucaacaggacuuaacaucaac

SEQ ID NO: 1566358 - RNA, 17 nt, Homo sapiens
cucaacauuaccaaaau

SEQ ID NO: 1566359 - RNA, 13 nt, Homo sapiens
cucaacauugugu

SEQ ID NO: 1566360 - RNA, 23 nt, Homo sapiens
cucaacauuguguucccauuuca

SEQ ID NO: 1566361 - RNA, 15 nt, Homo sapiens
cucaagaaucuagaa

SEQ ID NO: 1566362 - RNA, 12 nt, Homo sapiens
cucaagggccau

SEQ ID NO: 1566363 - RNA, 23 nt, Homo sapiens
ccugggcugucugucaccagcua

SEQ ID NO: 1566364 - RNA, 21 nt, Homo sapiens
ccuggggcacuuucauccuca

SEQ ID NO: 1566365 - RNA, 20 nt, Homo sapiens
ccuggggcaggucacuuuac

SEQ ID NO: 1566366 - RNA, 14 nt, Homo sapiens
ccugggggagaccu

SEQ ID NO: 1566367 - RNA, 16 nt, Homo sapiens
ccugggggugccagga

SEQ ID NO: 1566368 - RNA, 15 nt, Homo sapiens
ccugguauauccaaa

SEQ ID NO: 1566369 - RNA, 16 nt, Homo sapiens
ccugguaugggagcca

SEQ ID NO: 1566370 - RNA, 12 nt, Homo sapiens
ccugguccuucc

SEQ ID NO: 1566371 - RNA, 17 nt, Homo sapiens
ccuggugagacugucca

SEQ ID NO: 1566372 - RNA, 20 nt, Homo sapiens
ccugguggcaagagggaaug

SEQ ID NO: 1566373 - RNA, 17 nt, Homo sapiens
ccugguggcaccagaug

SEQ ID NO: 1566374 - RNA, 19 nt, Homo sapiens
ccuguaaucccaacacuuu

SEQ ID NO: 1566375 - RNA, 20 nt, Homo sapiens
ccuguaaucccaacacuuug

SEQ ID NO: 1566376 - RNA, 19 nt, Homo sapiens
ccuguaaucccagcacuuu

SEQ ID NO: 1566377 - RNA, 17 nt, Homo sapiens
ccuguaaucucacuaca

SEQ ID NO: 1566378 - RNA, 19 nt, Homo sapiens
ccuguaaucucagcacuuu

SEQ ID NO: 1566379 - RNA, 19 nt, Homo sapiens
ccuguacucccagcacuuu

SEQ ID NO: 1566380 - RNA, 15 nt, Homo sapiens
ccuguagucccagcu

SEQ ID NO: 1566381 - RNA, 16 nt, Homo sapiens
ccuguauacucuugaa

SEQ ID NO: 1566382 - RNA, 23 nt, Homo sapiens
ccuguaucuugggggacagggcu

SEQ ID NO: 1566383 - RNA, 17 nt, Homo sapiens
ccuguauuuaagcaaau

SEQ ID NO: 1566384 - RNA, 19 nt, Homo sapiens
ccuguccuggcaucaguag

SEQ ID NO: 1566385 - RNA, 20 nt, Homo sapiens
ccugucuugaguagacuugg

SEQ ID NO: 1566386 - RNA, 14 nt, Homo sapiens
ccugugcauuuucu

SEQ ID NO: 1566387 - RNA, 19 nt, Homo sapiens
ccugugcccuagaugcacg

SEQ ID NO: 1566388 - RNA, 15 nt, Homo sapiens
ccuguggaugcugcu

SEQ ID NO: 1566389 - RNA, 13 nt, Homo sapiens
ccuguggggccug

SEQ ID NO: 1566390 - RNA, 18 nt, Homo sapiens
ccugugucugcuguagaa

SEQ ID NO: 1566391 - RNA, 14 nt, Homo sapiens
ccuguguucugggc

SEQ ID NO: 1566392 - RNA, 17 nt, Homo sapiens
ccuguucccaagcaaag

SEQ ID NO: 1566393 - RNA, 19 nt, Homo sapiens
ccuguuccccaaggacucu

SEQ ID NO: 1566394 - RNA, 15 nt, Homo sapiens
ccuguugcacccagc

SEQ ID NO: 1566395 - RNA, 16 nt, Homo sapiens
ccuguugcacccagcc

SEQ ID NO: 1566396 - RNA, 17 nt, Homo sapiens
ccuguuugucuacauau

SEQ ID NO: 1566397 - RNA, 19 nt, Homo sapiens
ccuuaaauguuuugccagc

SEQ ID NO: 1566398 - RNA, 12 nt, Homo sapiens
ccuuaaccuuaa

SEQ ID NO: 1566399 - RNA, 23 nt, Homo sapiens
ccuuaacuuuaaaugacauuugu

SEQ ID NO: 1566400 - RNA, 12 nt, Homo sapiens
ccuuaagcacaa

SEQ ID NO: 1566401 - RNA, 15 nt, Homo sapiens
ccuuaagugcugcag

SEQ ID NO: 1566402 - RNA, 16 nt, Homo sapiens
ccuuaaucuauuuuca

SEQ ID NO: 1566403 - RNA, 16 nt, Homo sapiens
ccuuaaugacaacacu

SEQ ID NO: 1566404 - RNA, 14 nt, Homo sapiens
ccuuaccgcucugu

SEQ ID NO: 1566405 - RNA, 13 nt, Homo sapiens
ccuuacuccucuu

SEQ ID NO: 1566406 - RNA, 14 nt, Homo sapiens
ccuuagacacuuug

SEQ ID NO: 1566407 - RNA, 17 nt, Homo sapiens
ccuuagagcuuggacag

SEQ ID NO: 1566408 - RNA, 22 nt, Homo sapiens
ccuuagauguucuaagucuuuc

SEQ ID NO: 1566409 - RNA, 23 nt, Homo sapiens
ccuuaggcuuuguaugacaguga

SEQ ID NO: 1566410 - RNA, 20 nt, Homo sapiens
ccuuauuagagugucuuucc

SEQ ID NO: 1566411 - RNA, 14 nt, Homo sapiens
ccuuauuugucugu

SEQ ID NO: 1566412 - RNA, 20 nt, Homo sapiens
ccuucaaaauaaaaaguaau

SEQ ID NO: 1566413 - RNA, 14 nt, Homo sapiens
ccuucaaaccuaaa

SEQ ID NO: 1566414 - RNA, 14 nt, Homo sapiens
ccuucaagugccaa

SEQ ID NO: 1566415 - RNA, 16 nt, Homo sapiens
ccuucaagugccaaac

SEQ ID NO: 1566416 - RNA, 15 nt, Homo sapiens
ccuucacaaauguca

SEQ ID NO: 1566417 - RNA, 22 nt, Homo sapiens
ccuucaccccaguggccacuca

SEQ ID NO: 1566418 - RNA, 20 nt, Homo sapiens
ccuucacucugacaguauua

SEQ ID NO: 1566419 - RNA, 22 nt, Homo sapiens
ccuucacuuccaucacaagaaa

SEQ ID NO: 1566420 - RNA, 22 nt, Homo sapiens
ccuucagaacagaggcauuuaa

SEQ ID NO: 1566421 - RNA, 16 nt, Homo sapiens
ccuucagaaugcuccu

SEQ ID NO: 1566422 - RNA, 12 nt, Homo sapiens
ccuucagccuua

SEQ ID NO: 1566423 - RNA, 16 nt, Homo sapiens
ccuucaucugggacaa

SEQ ID NO: 1566424 - RNA, 18 nt, Homo sapiens
ccuucaucugggacaaaa

SEQ ID NO: 1566425 - RNA, 13 nt, Homo sapiens
ccuuccaaagacu

SEQ ID NO: 1566426 - RNA, 19 nt, Homo sapiens
ccuuccacggauccaugua

SEQ ID NO: 1566427 - RNA, 19 nt, Homo sapiens
ccuuccagggcucuuccag

SEQ ID NO: 1566428 - RNA, 18 nt, Homo sapiens
ccuuccccagacccagag

SEQ ID NO: 1566429 - RNA, 16 nt, Homo sapiens
ccuuccucucaggcuc

SEQ ID NO: 1566430 - RNA, 18 nt, Homo sapiens
ccuuccugccugaugugg

SEQ ID NO: 1566431 - RNA, 21 nt, Homo sapiens
ccuucuauguauuagugucaa

SEQ ID NO: 1566432 - RNA, 17 nt, Homo sapiens
ccuucuggcaagccugu

SEQ ID NO: 1566433 - RNA, 20 nt, Homo sapiens
ccuucugguucuaacugcug

SEQ ID NO: 1566434 - RNA, 14 nt, Homo sapiens
ccuugaaugccaua

SEQ ID NO: 1566435 - RNA, 19 nt, Homo sapiens
ccuugacgucguuuuacaa

SEQ ID NO: 1566436 - RNA, 17 nt, Homo sapiens
ccuugacuuugcuccuc

SEQ ID NO: 1566437 - RNA, 19 nt, Homo sapiens
ccuugaguuucauauauaa

SEQ ID NO: 1566438 - RNA, 22 nt, Homo sapiens
ccuugcaagcuaauucuuugac

SEQ ID NO: 1566439 - RNA, 20 nt, Homo sapiens
ccuugcccagacuacagggc

SEQ ID NO: 1566440 - RNA, 20 nt, Homo sapiens
ccuugcccuccugggcccug

SEQ ID NO: 1566441 - RNA, 19 nt, Homo sapiens
ccuugcucucuucaauaaa

SEQ ID NO: 1566442 - RNA, 15 nt, Homo sapiens
ccuuggaaaacaaaa

SEQ ID NO: 1566443 - RNA, 23 nt, Homo sapiens
ccuuggaauuggaauuacuguaa

SEQ ID NO: 1566444 - RNA, 13 nt, Homo sapiens
ccuuggaccucag

SEQ ID NO: 1566445 - RNA, 19 nt, Homo sapiens
ccuuggaggaaaugugcuc

SEQ ID NO: 1566446 - RNA, 19 nt, Homo sapiens
ccuuggagggacaugacua

SEQ ID NO: 1566447 - RNA, 19 nt, Homo sapiens
ccuugggagguuuuauucu

SEQ ID NO: 1566448 - RNA, 17 nt, Homo sapiens
ccuugguaucauuuucu

SEQ ID NO: 1566449 - RNA, 15 nt, Homo sapiens
ccuuggugugcugua

SEQ ID NO: 1566450 - RNA, 23 nt, Homo sapiens
ccuuggugugcuguauccaucca

SEQ ID NO: 1566451 - RNA, 14 nt, Homo sapiens
ccuuguaguucuca

SEQ ID NO: 1566452 - RNA, 23 nt, Homo sapiens
ccuuguaucuauuuguggugaau

SEQ ID NO: 1566453 - RNA, 13 nt, Homo sapiens
ccuuguccaccca

SEQ ID NO: 1566454 - RNA, 24 nt, Homo sapiens
ccuuguccacccaccuaugugcca

SEQ ID NO: 1566455 - RNA, 12 nt, Homo sapiens
ccuugugaucca

SEQ ID NO: 1566456 - RNA, 17 nt, Homo sapiens
ccuuuaaaucugugaug

SEQ ID NO: 1566457 - RNA, 23 nt, Homo sapiens
ccuuuaaaucugugaugauccuc

SEQ ID NO: 1566458 - RNA, 16 nt, Homo sapiens
ccuuuagaaccuuaaa

SEQ ID NO: 1566459 - RNA, 24 nt, Homo sapiens
ccuuuagaggguaccgucuucucc

SEQ ID NO: 1566460 - RNA, 16 nt, Homo sapiens
ccuuuagcacguuuaa

SEQ ID NO: 1566461 - RNA, 16 nt, Homo sapiens
ccuuuaggguucugcc

SEQ ID NO: 1566462 - RNA, 15 nt, Homo sapiens
ccuuuauauuugcuc

SEQ ID NO: 1566463 - RNA, 17 nt, Homo sapiens
ccuuuaucauccuuaaa

SEQ ID NO: 1566464 - RNA, 13 nt, Homo sapiens
ccuuuaugugaau

SEQ ID NO: 1566465 - RNA, 15 nt, Homo sapiens
ccuuucacacuggau

SEQ ID NO: 1566466 - RNA, 15 nt, Homo sapiens
ccuuucacucugcau

SEQ ID NO: 1566467 - RNA, 20 nt, Homo sapiens
ccuuucagaugucuucugcc

SEQ ID NO: 1566468 - RNA, 17 nt, Homo sapiens
ccuuucagugcaguuuc

SEQ ID NO: 1566469 - RNA, 17 nt, Homo sapiens
ccuuucaucacacuggg

SEQ ID NO: 1566470 - RNA, 13 nt, Homo sapiens
ccuuuccauuuau

SEQ ID NO: 1566471 - RNA, 21 nt, Homo sapiens
uaacacccuuuagaaccuuaa

SEQ ID NO: 1566472 - RNA, 17 nt, Homo sapiens
uaacacuuuuugugaau

SEQ ID NO: 1566473 - RNA, 16 nt, Homo sapiens
uaacagaaauuguaua

SEQ ID NO: 1566474 - RNA, 20 nt, Homo sapiens
uaacagggagaaguagcuag

SEQ ID NO: 1566475 - RNA, 13 nt, Homo sapiens
uaacauagguuuu

SEQ ID NO: 1566476 - RNA, 16 nt, Homo sapiens
uaacaugaacucuuga

SEQ ID NO: 1566477 - RNA, 16 nt, Homo sapiens
uaacaugcaauaacaa

SEQ ID NO: 1566478 - RNA, 12 nt, Homo sapiens
uaacauguguau

SEQ ID NO: 1566479 - RNA, 17 nt, Homo sapiens
uaacauguuaucaaauc

SEQ ID NO: 1566480 - RNA, 23 nt, Homo sapiens
uaacauuaaugccugcuuuuugg

SEQ ID NO: 1566481 - RNA, 21 nt, Homo sapiens
uaacauuauauaacaaaaaag

SEQ ID NO: 1566482 - RNA, 17 nt, Homo sapiens
uaacauuaucuaguuca

SEQ ID NO: 1566483 - RNA, 15 nt, Homo sapiens
uaacauuuaaauucc

SEQ ID NO: 1566484 - RNA, 16 nt, Homo sapiens
uaacauuuaaauucca

SEQ ID NO: 1566485 - RNA, 20 nt, Homo sapiens
uaacauuuaaauuccacaga

SEQ ID NO: 1566486 - RNA, 23 nt, Homo sapiens
uaacauuucaccccacucuguac

SEQ ID NO: 1566487 - RNA, 22 nt, Homo sapiens
uaaccaaagcccaaagugguau

SEQ ID NO: 1566488 - RNA, 17 nt, Homo sapiens
uaaccacuuaaggaccu

SEQ ID NO: 1566489 - RNA, 11 nt, Homo sapiens
uaacgcugaac

SEQ ID NO: 1566490 - RNA, 17 nt, Homo sapiens
uaacguccacuagcuua

SEQ ID NO: 1566491 - RNA, 22 nt, Homo sapiens
uaacuaggcucagagaugugca

SEQ ID NO: 1566492 - RNA, 15 nt, Homo sapiens
uaacuauacuugaua

SEQ ID NO: 1566493 - RNA, 15 nt, Homo sapiens
uaacuauccuuccag

SEQ ID NO: 1566494 - RNA, 18 nt, Homo sapiens
uaacuaugagccaggcau

SEQ ID NO: 1566495 - RNA, 16 nt, Homo sapiens
uaacuauuuuuccuca

SEQ ID NO: 1566496 - RNA, 13 nt, Homo sapiens
uaacucauagauu

SEQ ID NO: 1566497 - RNA, 12 nt, Homo sapiens
uaacucuacugu

SEQ ID NO: 1566498 - RNA, 14 nt, Homo sapiens
uaacucuagaauuu

SEQ ID NO: 1566499 - RNA, 16 nt, Homo sapiens
uaacucuagaauuugg

SEQ ID NO: 1566500 - RNA, 17 nt, Homo sapiens
uaacugaaccauuccaa

SEQ ID NO: 1566501 - RNA, 20 nt, Homo sapiens
uaacugacaagccaucuuga

SEQ ID NO: 1566502 - RNA, 18 nt, Homo sapiens
uaacugaggacuguuugc

SEQ ID NO: 1566503 - RNA, 21 nt, Homo sapiens
uaacuguauuuuugaagacua

SEQ ID NO: 1566504 - RNA, 19 nt, Homo sapiens
uaacugugaaauaccacaa

SEQ ID NO: 1566505 - RNA, 17 nt, Homo sapiens
uaacuuggucagagcca

SEQ ID NO: 1566506 - RNA, 18 nt, Homo sapiens
uaacuuggucagagccac

SEQ ID NO: 1566507 - RNA, 19 nt, Homo sapiens
uaacuuuaccaugcucaau

SEQ ID NO: 1566508 - RNA, 14 nt, Homo sapiens
uaacuuucauacca

SEQ ID NO: 1566509 - RNA, 20 nt, Homo sapiens
uaacuuucauaccacuugaa

SEQ ID NO: 1566510 - RNA, 15 nt, Homo sapiens
uaagaaauaaggcua

SEQ ID NO: 1566511 - RNA, 18 nt, Homo sapiens
uaagaaauaaugccucca

SEQ ID NO: 1566512 - RNA, 19 nt, Homo sapiens
uaagaacuguacauuguga

SEQ ID NO: 1566513 - RNA, 20 nt, Homo sapiens
uaagaagaaugcuuaaucag

SEQ ID NO: 1566514 - RNA, 16 nt, Homo sapiens
uaagaagagauuucuc

SEQ ID NO: 1566515 - RNA, 20 nt, Homo sapiens
uaagaaucuuagauaacuuc

SEQ ID NO: 1566516 - RNA, 16 nt, Homo sapiens
uaagaauguacaguug

SEQ ID NO: 1566517 - RNA, 23 nt, Homo sapiens
uaagaauguacaguugagcucag

SEQ ID NO: 1566518 - RNA, 22 nt, Homo sapiens
uaagacacacuccccacuucac

SEQ ID NO: 1566519 - RNA, 18 nt, Homo sapiens
uaagacaugauuuccuug

SEQ ID NO: 1566520 - RNA, 18 nt, Homo sapiens
uaagacauuuuucauuca

SEQ ID NO: 1566521 - RNA, 24 nt, Homo sapiens
uaagacugcugguugacaucagac

SEQ ID NO: 1566522 - RNA, 15 nt, Homo sapiens
uaagagaacaaugug

SEQ ID NO: 1566523 - RNA, 23 nt, Homo sapiens
uaagagacagagccuuguucuau

SEQ ID NO: 1566524 - RNA, 14 nt, Homo sapiens
uaagagaugggacu

SEQ ID NO: 1566525 - RNA, 17 nt, Homo sapiens
uaagagccauuuagggg

SEQ ID NO: 1566526 - RNA, 17 nt, Homo sapiens
uaagaguaaaauuccuc

SEQ ID NO: 1566527 - RNA, 15 nt, Homo sapiens
uaagauaauguugcu

SEQ ID NO: 1566528 - RNA, 17 nt, Homo sapiens
uaagauauauacaugga

SEQ ID NO: 1566529 - RNA, 19 nt, Homo sapiens
uaagaucauuuaauaucuu

SEQ ID NO: 1566530 - RNA, 14 nt, Homo sapiens
uaagauccacaaau

SEQ ID NO: 1566531 - RNA, 19 nt, Homo sapiens
uaagauccacaaaugaagg

SEQ ID NO: 1566532 - RNA, 12 nt, Homo sapiens
uaagaugaaaca

SEQ ID NO: 1566533 - RNA, 13 nt, Homo sapiens
uaagauucuugac

SEQ ID NO: 1566534 - RNA, 19 nt, Homo sapiens
uaagauugcgccugagaua

SEQ ID NO: 1566535 - RNA, 20 nt, Homo sapiens
uaagauugcgccugagauac

SEQ ID NO: 1566536 - RNA, 13 nt, Homo sapiens
uaagauuuaccca

SEQ ID NO: 1566537 - RNA, 14 nt, Homo sapiens
uaagauuucucuaa

SEQ ID NO: 1566538 - RNA, 17 nt, Homo sapiens
uaagauuucucuaauau

SEQ ID NO: 1566539 - RNA, 18 nt, Homo sapiens
uaagcaacuugcuucuaa

SEQ ID NO: 1566540 - RNA, 13 nt, Homo sapiens
uaagcauaacuua

SEQ ID NO: 1566541 - RNA, 21 nt, Homo sapiens
uaagcaucugccaucugcuuu

SEQ ID NO: 1566542 - RNA, 20 nt, Homo sapiens
uaagcauuaccacucaggca

SEQ ID NO: 1566543 - RNA, 18 nt, Homo sapiens
uaagcauuuagugcucag

SEQ ID NO: 1566544 - RNA, 13 nt, Homo sapiens
uaagccacuuccc

SEQ ID NO: 1566545 - RNA, 15 nt, Homo sapiens
uaagcuaugaaaaau

SEQ ID NO: 1566546 - RNA, 19 nt, Homo sapiens
uaagcuaugaaaaauacaa

SEQ ID NO: 1566547 - RNA, 12 nt, Homo sapiens
uaagcugugauu

SEQ ID NO: 1566548 - RNA, 20 nt, Homo sapiens
uaagcuuucaauaguggcau

SEQ ID NO: 1566549 - RNA, 14 nt, Homo sapiens
uaaggaaagcaaua

SEQ ID NO: 1566550 - RNA, 16 nt, Homo sapiens
uaaggacuucugcagc

SEQ ID NO: 1566551 - RNA, 13 nt, Homo sapiens
uaaggagccuuuc

SEQ ID NO: 1566552 - RNA, 16 nt, Homo sapiens
uaaggagccuuuccag

SEQ ID NO: 1566553 - RNA, 14 nt, Homo sapiens
uaaggauuuuucaa

SEQ ID NO: 1566554 - RNA, 21 nt, Homo sapiens
uaaggcuuguuccaaugccac

SEQ ID NO: 1566555 - RNA, 17 nt, Homo sapiens
uaaggcuuuuucuuccc

SEQ ID NO: 1566556 - RNA, 18 nt, Homo sapiens
uaagggaauccugagaaa

SEQ ID NO: 1566557 - RNA, 13 nt, Homo sapiens
uaaguaaaaccac

SEQ ID NO: 1566558 - RNA, 18 nt, Homo sapiens
uacacacaguggauggac

SEQ ID NO: 1566559 - RNA, 20 nt, Homo sapiens
uacacaggaggcugaggcag

SEQ ID NO: 1566560 - RNA, 14 nt, Homo sapiens
uacacauucuugcu

SEQ ID NO: 1566561 - RNA, 15 nt, Homo sapiens
uacacauuucacugu

SEQ ID NO: 1566562 - RNA, 23 nt, Homo sapiens
uacaccaaugaaaacauguacua

SEQ ID NO: 1566563 - RNA, 16 nt, Homo sapiens
uacacccugcccucau

SEQ ID NO: 1566564 - RNA, 24 nt, Homo sapiens
uacacgcauguaugcaugcacaaa

SEQ ID NO: 1566565 - RNA, 18 nt, Homo sapiens
uacacuaggaaacguguu

SEQ ID NO: 1566566 - RNA, 21 nt, Homo sapiens
uacacuuuugagacuuuuugg

SEQ ID NO: 1566567 - RNA, 16 nt, Homo sapiens
uacagaaaucaauggu

SEQ ID NO: 1566568 - RNA, 17 nt, Homo sapiens
uacagaaaucaauggua

SEQ ID NO: 1566569 - RNA, 19 nt, Homo sapiens
uacagaaucaaaugcaauu

SEQ ID NO: 1566570 - RNA, 18 nt, Homo sapiens
uacagacucugauucuac

SEQ ID NO: 1566571 - RNA, 23 nt, Homo sapiens
uacagauggagcaaauguccuaa

SEQ ID NO: 1566572 - RNA, 15 nt, Homo sapiens
uacagccuggaccac

SEQ ID NO: 1566573 - RNA, 22 nt, Homo sapiens
uacagcuucacuagaguucuuu

SEQ ID NO: 1566574 - RNA, 23 nt, Homo sapiens
uacaggaagcaccccaugccaaa

SEQ ID NO: 1566575 - RNA, 12 nt, Homo sapiens
uacaggacauca

SEQ ID NO: 1566576 - RNA, 17 nt, Homo sapiens
uacaggaggcagacaau

SEQ ID NO: 1566577 - RNA, 18 nt, Homo sapiens
uacaggcucaugccauca

SEQ ID NO: 1566578 - RNA, 16 nt, Homo sapiens
uacagucuuguauuaa

SEQ ID NO: 1566579 - RNA, 21 nt, Homo sapiens
uacaguuauuaaucuggacau

SEQ ID NO: 1566580 - RNA, 20 nt, Homo sapiens
uacauaacuccugucccuuu

SEQ ID NO: 1566581 - RNA, 16 nt, Homo sapiens
uacauaaggaugacuu

SEQ ID NO: 1566582 - RNA, 19 nt, Homo sapiens
uacauaaguuccuauaccu

SEQ ID NO: 1566583 - RNA, 14 nt, Homo sapiens
uacauacaaauucu

SEQ ID NO: 1566584 - RNA, 20 nt, Homo sapiens
uacauacuuuaucaaugugu

SEQ ID NO: 1566585 - RNA, 13 nt, Homo sapiens
uacauagucuuug

SEQ ID NO: 1566586 - RNA, 14 nt, Homo sapiens
uacauauuaucuca

SEQ ID NO: 1566587 - RNA, 23 nt, Homo sapiens
uacauauuguggaauugacucaa

SEQ ID NO: 1566588 - RNA, 16 nt, Homo sapiens
uacaucauuauuguag

SEQ ID NO: 1566589 - RNA, 15 nt, Homo sapiens
uacaucauuccacac

SEQ ID NO: 1566590 - RNA, 14 nt, Homo sapiens
guaacaucuguuau

SEQ ID NO: 1566591 - RNA, 16 nt, Homo sapiens
guaaccacaacuuuca

SEQ ID NO: 1566592 - RNA, 16 nt, Homo sapiens
guaacuccaccaaccc

SEQ ID NO: 1566593 - RNA, 20 nt, Homo sapiens
guaagaauaaagccacugua

SEQ ID NO: 1566594 - RNA, 21 nt, Homo sapiens
guaagacccuuauugcugucc

SEQ ID NO: 1566595 - RNA, 23 nt, Homo sapiens
guaagauuuuguuugcaucugaa

SEQ ID NO: 1566596 - RNA, 14 nt, Homo sapiens
guaagcagccuuug

SEQ ID NO: 1566597 - RNA, 15 nt, Homo sapiens
guaagcauaacuuau

SEQ ID NO: 1566598 - RNA, 19 nt, Homo sapiens
guaagcauuugaguuugca

SEQ ID NO: 1566599 - RNA, 14 nt, Homo sapiens
guaaggagccuuuc

SEQ ID NO: 1566600 - RNA, 17 nt, Homo sapiens
guaaggagccuuuccag

SEQ ID NO: 1566601 - RNA, 15 nt, Homo sapiens
guaagugccuuccau

SEQ ID NO: 1566602 - RNA, 17 nt, Homo sapiens
guaauaagcaaucaagg

SEQ ID NO: 1566603 - RNA, 23 nt, Homo sapiens
guaauaauuggagaagauuuaug

SEQ ID NO: 1566604 - RNA, 21 nt, Homo sapiens
guaauagcuguaaacuuccaa

SEQ ID NO: 1566605 - RNA, 18 nt, Homo sapiens
guaauauuuuacuuugag

SEQ ID NO: 1566606 - RNA, 13 nt, Homo sapiens
guaaucacuguug

SEQ ID NO: 1566607 - RNA, 19 nt, Homo sapiens
guaaucauuuuaaauucca

SEQ ID NO: 1566608 - RNA, 14 nt, Homo sapiens
guaaucuacaccaa

SEQ ID NO: 1566609 - RNA, 17 nt, Homo sapiens
guaaucuacaccaauga

SEQ ID NO: 1566610 - RNA, 17 nt, Homo sapiens
guaaugcugcacagaaa

SEQ ID NO: 1566611 - RNA, 16 nt, Homo sapiens
guaauguucauuuccc

SEQ ID NO: 1566612 - RNA, 22 nt, Homo sapiens
guaauguuccugaaaauugcaa

SEQ ID NO: 1566613 - RNA, 20 nt, Homo sapiens
guaauguuuuauacuguuua

SEQ ID NO: 1566614 - RNA, 18 nt, Homo sapiens
guaauuguaaacuaguac

SEQ ID NO: 1566615 - RNA, 15 nt, Homo sapiens
guaauuguaauucca

SEQ ID NO: 1566616 - RNA, 20 nt, Homo sapiens
guaauuuuaguagagacagg

SEQ ID NO: 1566617 - RNA, 22 nt, Homo sapiens
guacaacuuuuuaaauagggaa

SEQ ID NO: 1566618 - RNA, 16 nt, Homo sapiens
guacaauacaauguac

SEQ ID NO: 1566619 - RNA, 13 nt, Homo sapiens
guacagacacucc

SEQ ID NO: 1566620 - RNA, 11 nt, Homo sapiens
guacagagaug

SEQ ID NO: 1566621 - RNA, 21 nt, Homo sapiens
guacaucaaguccaucugaca

SEQ ID NO: 1566622 - RNA, 11 nt, Homo sapiens
guacaugagaa

SEQ ID NO: 1566623 - RNA, 17 nt, Homo sapiens
guacauugggagucugu

SEQ ID NO: 1566624 - RNA, 20 nt, Homo sapiens
guacauuuuucaacuuugaa

SEQ ID NO: 1566625 - RNA, 18 nt, Homo sapiens
guaccaccaugcacugua

SEQ ID NO: 1566626 - RNA, 11 nt, Homo sapiens
guaccaguuaa

SEQ ID NO: 1566627 - RNA, 12 nt, Homo sapiens
guaccauagaaa

SEQ ID NO: 1566628 - RNA, 16 nt, Homo sapiens
guaccgcaaugugacu

SEQ ID NO: 1566629 - RNA, 15 nt, Homo sapiens
guaccugacuuccac

SEQ ID NO: 1566630 - RNA, 13 nt, Homo sapiens
guaccugugcacg

SEQ ID NO: 1566631 - RNA, 22 nt, Homo sapiens
guaccuuuguguccuuguucau

SEQ ID NO: 1566632 - RNA, 15 nt, Homo sapiens
guacgaugacagugu

SEQ ID NO: 1566633 - RNA, 15 nt, Homo sapiens
guacuauucauucac

SEQ ID NO: 1566634 - RNA, 14 nt, Homo sapiens
guacuuauguugca

SEQ ID NO: 1566635 - RNA, 13 nt, Homo sapiens
guacuuuaccuaa

SEQ ID NO: 1566636 - RNA, 16 nt, Homo sapiens
guacuuuagcuggaau

SEQ ID NO: 1566637 - RNA, 18 nt, Homo sapiens
guacuuuuuuuaaacugu

SEQ ID NO: 1566638 - RNA, 15 nt, Homo sapiens
guagaaaaauuauua

SEQ ID NO: 1566639 - RNA, 21 nt, Homo sapiens
guagaaucucuucaugcuuga

SEQ ID NO: 1566640 - RNA, 18 nt, Homo sapiens
guagacugauuacacuga

SEQ ID NO: 1566641 - RNA, 13 nt, Homo sapiens
guagaguccuugg

SEQ ID NO: 1566642 - RNA, 14 nt, Homo sapiens
guagauauuugaaa

SEQ ID NO: 1566643 - RNA, 22 nt, Homo sapiens
guagcaaugugccuugauugau

SEQ ID NO: 1566644 - RNA, 16 nt, Homo sapiens
guagcacuuacguaaa

SEQ ID NO: 1566645 - RNA, 21 nt, Homo sapiens
guagccugggcucacugugcu

SEQ ID NO: 1566646 - RNA, 16 nt, Homo sapiens
guagcucucccuaggc

SEQ ID NO: 1566647 - RNA, 19 nt, Homo sapiens
guagcugggauuacaggca

SEQ ID NO: 1566648 - RNA, 21 nt, Homo sapiens
guagucagacugacacuacua

SEQ ID NO: 1566649 - RNA, 16 nt, Homo sapiens
guaguuagccaucuaa

SEQ ID NO: 1566650 - RNA, 22 nt, Homo sapiens
guaguuucuugaggccaaacac

SEQ ID NO: 1566651 - RNA, 13 nt, Homo sapiens
guaguuuguuuua

SEQ ID NO: 1566652 - RNA, 13 nt, Homo sapiens
guauaaaacauua

SEQ ID NO: 1566653 - RNA, 15 nt, Homo sapiens
guauaaucccaccca

SEQ ID NO: 1566654 - RNA, 18 nt, Homo sapiens
guauacguauaaauauca

SEQ ID NO: 1566655 - RNA, 14 nt, Homo sapiens
guauacuauaguac

SEQ ID NO: 1566656 - RNA, 16 nt, Homo sapiens
guauacuauaguacca

SEQ ID NO: 1566657 - RNA, 16 nt, Homo sapiens
guauagcugcuuccag

SEQ ID NO: 1566658 - RNA, 13 nt, Homo sapiens
guauaguguucac

SEQ ID NO: 1566659 - RNA, 23 nt, Homo sapiens
guauaguguucacaaacugugaa

SEQ ID NO: 1566660 - RNA, 16 nt, Homo sapiens
guauauaaacauauca

SEQ ID NO: 1566661 - RNA, 19 nt, Homo sapiens
guauauuaagaagcaauaa

SEQ ID NO: 1566662 - RNA, 15 nt, Homo sapiens
guaucaaaugugaca

SEQ ID NO: 1566663 - RNA, 15 nt, Homo sapiens
guaucacaguguuuu

SEQ ID NO: 1566664 - RNA, 16 nt, Homo sapiens
guaucaccgggggcau

SEQ ID NO: 1566665 - RNA, 11 nt, Homo sapiens
guauccaaaaa

SEQ ID NO: 1566666 - RNA, 21 nt, Homo sapiens
guauccccagccccaaagaca

SEQ ID NO: 1566667 - RNA, 23 nt, Homo sapiens
guaucccccgccuuuaguucucc

SEQ ID NO: 1566668 - RNA, 15 nt, Homo sapiens
guaucccuuauccaa

SEQ ID NO: 1566669 - RNA, 23 nt, Homo sapiens
guauccugcgaccuugcaaccuc

SEQ ID NO: 1566670 - RNA, 12 nt, Homo sapiens
guaucucuuaca

SEQ ID NO: 1566671 - RNA, 21 nt, Homo sapiens
guaucuucuuuagugguggua

SEQ ID NO: 1566672 - RNA, 15 nt, Homo sapiens
guaugcaugcacaaa

SEQ ID NO: 1566673 - RNA, 18 nt, Homo sapiens
guaugcauucacauuuag

SEQ ID NO: 1566674 - RNA, 12 nt, Homo sapiens
guaugccaagug

SEQ ID NO: 1566675 - RNA, 13 nt, Homo sapiens
guaugcuggccag

SEQ ID NO: 1566676 - RNA, 21 nt, Homo sapiens
guauggggaggcaaguguggg

SEQ ID NO: 1566677 - RNA, 22 nt, Homo sapiens
guauguaaaucuucauggugau

SEQ ID NO: 1566678 - RNA, 18 nt, Homo sapiens
guauguacaauacaaugu

SEQ ID NO: 1566679 - RNA, 20 nt, Homo sapiens
guauguauuauuuacauuua

SEQ ID NO: 1566680 - RNA, 14 nt, Homo sapiens
guaugucuaccugg

SEQ ID NO: 1566681 - RNA, 22 nt, Homo sapiens
guauguuuuaauugcauuuaaa

SEQ ID NO: 1566682 - RNA, 16 nt, Homo sapiens
ucaacauaaagagcaa

SEQ ID NO: 1566683 - RNA, 19 nt, Homo sapiens
ucaacauaaagagcaauaa

SEQ ID NO: 1566684 - RNA, 16 nt, Homo sapiens
ucaacaugacuggugg

SEQ ID NO: 1566685 - RNA, 15 nt, Homo sapiens
ucaacauuaccaaaa

SEQ ID NO: 1566686 - RNA, 13 nt, Homo sapiens
ucaaccuccgccu

SEQ ID NO: 1566687 - RNA, 23 nt, Homo sapiens
ucaacgcuuaaaggugucuuccu

SEQ ID NO: 1566688 - RNA, 21 nt, Homo sapiens
ucaacggcuccaucaccagcc

SEQ ID NO: 1566689 - RNA, 19 nt, Homo sapiens
ucaacucccuucucggggu

SEQ ID NO: 1566690 - RNA, 24 nt, Homo sapiens
ucaacuccgugcuuaaccaaagaa

SEQ ID NO: 1566691 - RNA, 23 nt, Homo sapiens
ucaacucuccaauguucuauuaa

SEQ ID NO: 1566692 - RNA, 12 nt, Homo sapiens
ucaacucugaaa

SEQ ID NO: 1566693 - RNA, 12 nt, Homo sapiens
ucaacucugauc

SEQ ID NO: 1566694 - RNA, 14 nt, Homo sapiens
ucaacuugcaauuu

SEQ ID NO: 1566695 - RNA, 17 nt, Homo sapiens
ucaacuugcaauuugca

SEQ ID NO: 1566696 - RNA, 19 nt, Homo sapiens
ucaacuuggugacacucua

SEQ ID NO: 1566697 - RNA, 20 nt, Homo sapiens
ucaacuuugaauaaagaaua

SEQ ID NO: 1566698 - RNA, 20 nt, Homo sapiens
ucaacuuuggugaacaguuu

SEQ ID NO: 1566699 - RNA, 13 nt, Homo sapiens
ucaagaagaggaa

SEQ ID NO: 1566700 - RNA, 15 nt, Homo sapiens
ucaagaauaaucacg

SEQ ID NO: 1566701 - RNA, 13 nt, Homo sapiens
ucaagaaugccag

SEQ ID NO: 1566702 - RNA, 13 nt, Homo sapiens
ucaagacauuucu

SEQ ID NO: 1566703 - RNA, 17 nt, Homo sapiens
ucaagacauuugcugaa

SEQ ID NO: 1566704 - RNA, 20 nt, Homo sapiens
ucaagacuaucuacaaaaau

SEQ ID NO: 1566705 - RNA, 18 nt, Homo sapiens
ucaagagcaucuggaaca

SEQ ID NO: 1566706 - RNA, 19 nt, Homo sapiens
ucaagaugaugaugaucuu

SEQ ID NO: 1566707 - RNA, 19 nt, Homo sapiens
ucaagcaauucuccugccu

SEQ ID NO: 1566708 - RNA, 15 nt, Homo sapiens
ucaagcaggacccua

SEQ ID NO: 1566709 - RNA, 15 nt, Homo sapiens
ucaagccauuccaaa

SEQ ID NO: 1566710 - RNA, 12 nt, Homo sapiens
ucaaggcccacu

SEQ ID NO: 1566711 - RNA, 16 nt, Homo sapiens
ucaaggggacuaaagu

SEQ ID NO: 1566712 - RNA, 18 nt, Homo sapiens
ucaagguuuaaccuuaaa

SEQ ID NO: 1566713 - RNA, 15 nt, Homo sapiens
ucaaguaauacaaac

SEQ ID NO: 1566714 - RNA, 11 nt, Homo sapiens
ucaaguaauau

SEQ ID NO: 1566715 - RNA, 16 nt, Homo sapiens
ucaagucucucacccu

SEQ ID NO: 1566716 - RNA, 15 nt, Homo sapiens
ucaagucugcacaga

SEQ ID NO: 1566717 - RNA, 13 nt, Homo sapiens
ucaagugccaaac

SEQ ID NO: 1566718 - RNA, 16 nt, Homo sapiens
ucaagugccuuuuugu

SEQ ID NO: 1566719 - RNA, 15 nt, Homo sapiens
ucaaguugugcuugu

SEQ ID NO: 1566720 - RNA, 16 nt, Homo sapiens
ucaaguugugcuuguu

SEQ ID NO: 1566721 - RNA, 20 nt, Homo sapiens
ucaaguuguugacugugauu

SEQ ID NO: 1566722 - RNA, 14 nt, Homo sapiens
ucaauaaacaguca

SEQ ID NO: 1566723 - RNA, 16 nt, Homo sapiens
ucaauaaaucuuucaa

SEQ ID NO: 1566724 - RNA, 13 nt, Homo sapiens
ucaauacaauccu

SEQ ID NO: 1566725 - RNA, 22 nt, Homo sapiens
ucaauacauagugcugcugugu

SEQ ID NO: 1566726 - RNA, 21 nt, Homo sapiens
ucaauacuuaaaaauagucuu

SEQ ID NO: 1566727 - RNA, 13 nt, Homo sapiens
ucaauagcuugaa

SEQ ID NO: 1566728 - RNA, 16 nt, Homo sapiens
ucaauaguauuaacua

SEQ ID NO: 1566729 - RNA, 21 nt, Homo sapiens
ucaaucauaauaccugcugug

SEQ ID NO: 1566730 - RNA, 13 nt, Homo sapiens
ucaauccuaucac

SEQ ID NO: 1566731 - RNA, 15 nt, Homo sapiens
ucaaucuucaaugaa

SEQ ID NO: 1566732 - RNA, 14 nt, Homo sapiens
ucaaucuucuacuu

SEQ ID NO: 1566733 - RNA, 14 nt, Homo sapiens
ucaaucuuugccua

SEQ ID NO: 1566734 - RNA, 22 nt, Homo sapiens
ucaaugcaggacaacucuguaa

SEQ ID NO: 1566735 - RNA, 16 nt, Homo sapiens
ucaaugcuagcacaau

SEQ ID NO: 1566736 - RNA, 23 nt, Homo sapiens
ucaauguuuacuuuuuugguacu

SEQ ID NO: 1566737 - RNA, 18 nt, Homo sapiens
ucaauguuucacuacucu

SEQ ID NO: 1566738 - RNA, 15 nt, Homo sapiens
ucaauguuuguccug

SEQ ID NO: 1566739 - RNA, 14 nt, Homo sapiens
ucaauuucucugag

SEQ ID NO: 1566740 - RNA, 17 nt, Homo sapiens
ucacaaaaaaaguaauu

SEQ ID NO: 1566741 - RNA, 18 nt, Homo sapiens
ucacaaaaaaauguucau

SEQ ID NO: 1566742 - RNA, 17 nt, Homo sapiens
ucacaaacugaaugacu

SEQ ID NO: 1566743 - RNA, 19 nt, Homo sapiens
ucacaaacuuuuauacucu

SEQ ID NO: 1566744 - RNA, 23 nt, Homo sapiens
ucacaaaguagaggaauccaugu

SEQ ID NO: 1566745 - RNA, 19 nt, Homo sapiens
ucacaaaucuuaacuugaa

SEQ ID NO: 1566746 - RNA, 19 nt, Homo sapiens
ucacaaaugucauugucua

SEQ ID NO: 1566747 - RNA, 23 nt, Homo sapiens
ucacaacagauuauuaccuuaca

SEQ ID NO: 1566748 - RNA, 15 nt, Homo sapiens
ucacaacagugaaaa

SEQ ID NO: 1566749 - RNA, 12 nt, Homo sapiens
ucacaacauucu

SEQ ID NO: 1566750 - RNA, 24 nt, Homo sapiens
ucacaaugucccuucagcaccuga

SEQ ID NO: 1566751 - RNA, 23 nt, Homo sapiens
ucacaauguucuggcacuauuau

SEQ ID NO: 1566752 - RNA, 18 nt, Homo sapiens
ucacacaguucaacauaa

SEQ ID NO: 1566753 - RNA, 19 nt, Homo sapiens
ucacacguuuaaucccagc

SEQ ID NO: 1566754 - RNA, 22 nt, Homo sapiens
ucacacuguauauaaacauauc

SEQ ID NO: 1566755 - RNA, 23 nt, Homo sapiens
ucacagacggauacuggggagua

SEQ ID NO: 1566756 - RNA, 19 nt, Homo sapiens
ucacagagugagacuccau

SEQ ID NO: 1566757 - RNA, 22 nt, Homo sapiens
ucacagcaaggauggagcugaa

SEQ ID NO: 1566758 - RNA, 23 nt, Homo sapiens
ucacagcuguaaucccagcacuu

SEQ ID NO: 1566759 - RNA, 19 nt, Homo sapiens
ucacaggcauauucccugc

SEQ ID NO: 1566760 - RNA, 23 nt, Homo sapiens
ucacaggugggaucggcacucag

SEQ ID NO: 1566761 - RNA, 22 nt, Homo sapiens
ucacaguaucaguauuuucaca

SEQ ID NO: 1566762 - RNA, 16 nt, Homo sapiens
ucacagugaacacuca

SEQ ID NO: 1566763 - RNA, 12 nt, Homo sapiens
ucacagugcaag

SEQ ID NO: 1566764 - RNA, 13 nt, Homo sapiens
ucacauacaaauc

SEQ ID NO: 1566765 - RNA, 17 nt, Homo sapiens
ucacaucuaaagcuuua

SEQ ID NO: 1566766 - RNA, 12 nt, Homo sapiens
ucacaucuccag

SEQ ID NO: 1566767 - RNA, 12 nt, Homo sapiens
ucacauguccua

SEQ ID NO: 1566768 - RNA, 12 nt, Homo sapiens
ucuaagcugugu

SEQ ID NO: 1566769 - RNA, 16 nt, Homo sapiens
ucuaaguaaaaccaca

SEQ ID NO: 1566770 - RNA, 15 nt, Homo sapiens
ucuaauagucaauga

SEQ ID NO: 1566771 - RNA, 22 nt, Homo sapiens
ucuaaucaagaaaagaauuaca

SEQ ID NO: 1566772 - RNA, 23 nt, Homo sapiens
ucuaaugugcuucuaguaggcac

SEQ ID NO: 1566773 - RNA, 17 nt, Homo sapiens
ucuacacugagguuuga

SEQ ID NO: 1566774 - RNA, 14 nt, Homo sapiens
ucuacauaugaucu

SEQ ID NO: 1566775 - RNA, 18 nt, Homo sapiens
ucuacauuucacauuauu

SEQ ID NO: 1566776 - RNA, 11 nt, Homo sapiens
ucuaccaagaa

SEQ ID NO: 1566777 - RNA, 20 nt, Homo sapiens
ucuaccaugguucugccucc

SEQ ID NO: 1566778 - RNA, 10 nt, Homo sapiens
ucuaccccag

SEQ ID NO: 1566779 - RNA, 20 nt, Homo sapiens
ucuaccucuuggcugccuug

SEQ ID NO: 1566780 - RNA, 14 nt, Homo sapiens
ucuaccugcaagau

SEQ ID NO: 1566781 - RNA, 15 nt, Homo sapiens
ucuacuaacaaucag

SEQ ID NO: 1566782 - RNA, 12 nt, Homo sapiens
ucuacuaauucc

SEQ ID NO: 1566783 - RNA, 19 nt, Homo sapiens
ucuacugaaugucauugaa

SEQ ID NO: 1566784 - RNA, 17 nt, Homo sapiens
ucuacugaucaacagac

SEQ ID NO: 1566785 - RNA, 14 nt, Homo sapiens
ucuacuugucauau

SEQ ID NO: 1566786 - RNA, 15 nt, Homo sapiens
ucuagaaaaccagcu

SEQ ID NO: 1566787 - RNA, 17 nt, Homo sapiens
ucuagaaugagcaagac

SEQ ID NO: 1566788 - RNA, 20 nt, Homo sapiens
ucuagacuagcaaucucuuc

SEQ ID NO: 1566789 - RNA, 23 nt, Homo sapiens
ucuagauacaauaaauugcuaau

SEQ ID NO: 1566790 - RNA, 14 nt, Homo sapiens
ucuagaucucagcc

SEQ ID NO: 1566791 - RNA, 11 nt, Homo sapiens
ucuagccuuuu

SEQ ID NO: 1566792 - RNA, 18 nt, Homo sapiens
ucuagugucugacuuuug

SEQ ID NO: 1566793 - RNA, 20 nt, Homo sapiens
ucuaguugaggaguuuccua

SEQ ID NO: 1566794 - RNA, 14 nt, Homo sapiens
ucuauaacuccuug

SEQ ID NO: 1566795 - RNA, 15 nt, Homo sapiens
ucuauaagauuccaa

SEQ ID NO: 1566796 - RNA, 19 nt, Homo sapiens
ucuauacucagguaccucu

SEQ ID NO: 1566797 - RNA, 16 nt, Homo sapiens
ucuaucagcaucugac

SEQ ID NO: 1566798 - RNA, 15 nt, Homo sapiens
ucuaucaucugcuaa

SEQ ID NO: 1566799 - RNA, 15 nt, Homo sapiens
ucuaucuaaugacau

SEQ ID NO: 1566800 - RNA, 14 nt, Homo sapiens
uauaaauguaaaaa

SEQ ID NO: 1566801 - RNA, 13 nt, Homo sapiens
uauaaaugugauu

SEQ ID NO: 1566802 - RNA, 15 nt, Homo sapiens
uauaaauguugcuau

SEQ ID NO: 1566803 - RNA, 19 nt, Homo sapiens
uauaaauuguacauuuugu

SEQ ID NO: 1566804 - RNA, 19 nt, Homo sapiens
uauaacacuuuccagccua

SEQ ID NO: 1566805 - RNA, 12 nt, Homo sapiens
uauaacaguguu

SEQ ID NO: 1566806 - RNA, 12 nt, Homo sapiens
uauaacucugca

SEQ ID NO: 1566807 - RNA, 12 nt, Homo sapiens
uauaacuguaaa

SEQ ID NO: 1566808 - RNA, 17 nt, Homo sapiens
uauaagaauuacuaaau

SEQ ID NO: 1566809 - RNA, 12 nt, Homo sapiens
uauaagugcuca

SEQ ID NO: 1566810 - RNA, 17 nt, Homo sapiens
uauaauaaaaagcuuca

SEQ ID NO: 1566811 - RNA, 14 nt, Homo sapiens
uauaauauacuaaa

SEQ ID NO: 1566812 - RNA, 13 nt, Homo sapiens
uauaaucagagau

SEQ ID NO: 1566813 - RNA, 13 nt, Homo sapiens
uauaaucauauca

SEQ ID NO: 1566814 - RNA, 22 nt, Homo sapiens
uauaaucaucaaguaauacaaa

SEQ ID NO: 1566815 - RNA, 22 nt, Homo sapiens
uauaauccuaccagaaggaaag

SEQ ID NO: 1566816 - RNA, 12 nt, Homo sapiens
uauaauguauuu

SEQ ID NO: 1566817 - RNA, 16 nt, Homo sapiens
uauaaugugcccaaag

SEQ ID NO: 1566818 - RNA, 17 nt, Homo sapiens
uauaauuuauguaugca

SEQ ID NO: 1566819 - RNA, 14 nt, Homo sapiens
uauacaguacacag

SEQ ID NO: 1566820 - RNA, 15 nt, Homo sapiens
uauacauacauguau

SEQ ID NO: 1566821 - RNA, 11 nt, Homo sapiens
uauaccaaaaa

SEQ ID NO: 1566822 - RNA, 17 nt, Homo sapiens
uauaccagccuacugua

SEQ ID NO: 1566823 - RNA, 22 nt, Homo sapiens
uauacugaaggaaaaacacaag

SEQ ID NO: 1566824 - RNA, 14 nt, Homo sapiens
uauacuguuuacug

SEQ ID NO: 1566825 - RNA, 17 nt, Homo sapiens
uauacuugaacaaaagg

SEQ ID NO: 1566826 - RNA, 17 nt, Homo sapiens
uauacuuuaguagacau

SEQ ID NO: 1566827 - RNA, 13 nt, Homo sapiens
uauacuuugcaau

SEQ ID NO: 1566828 - RNA, 17 nt, Homo sapiens
uauacuuuuucaugaaa

SEQ ID NO: 1566829 - RNA, 14 nt, Homo sapiens
uauagaacuucaug

SEQ ID NO: 1566830 - RNA, 21 nt, Homo sapiens
uauagcagaagcacauuuuca

SEQ ID NO: 1566831 - RNA, 18 nt, Homo sapiens
uauagcuuugccaugugg

SEQ ID NO: 1566832 - RNA, 22 nt, Homo sapiens
gucacagacgugaaagccagaa

SEQ ID NO: 1566833 - RNA, 16 nt, Homo sapiens
gucaccacgacuggcc

SEQ ID NO: 1566834 - RNA, 22 nt, Homo sapiens
gucacgaacuugaaaguuuucu

SEQ ID NO: 1566835 - RNA, 16 nt, Homo sapiens
gucacucacauugaga

SEQ ID NO: 1566836 - RNA, 16 nt, Homo sapiens
gucacugacaguuaau

SEQ ID NO: 1566837 - RNA, 20 nt, Homo sapiens
gucacuggaaagagugccag

SEQ ID NO: 1566838 - RNA, 16 nt, Homo sapiens
gucacuggaaauugag

SEQ ID NO: 1566839 - RNA, 13 nt, Homo sapiens
gucacuugccaca

SEQ ID NO: 1566840 - RNA, 18 nt, Homo sapiens
gucagaaauauucuuauu

SEQ ID NO: 1566841 - RNA, 15 nt, Homo sapiens
gucagagccacucua

SEQ ID NO: 1566842 - RNA, 15 nt, Homo sapiens
gucaggcugcagagg

SEQ ID NO: 1566843 - RNA, 17 nt, Homo sapiens
gucaguacgagcugcuc

SEQ ID NO: 1566844 - RNA, 22 nt, Homo sapiens
gucauagcaagcuuuugcucaa

SEQ ID NO: 1566845 - RNA, 15 nt, Homo sapiens
gucaucaaugcaaua

SEQ ID NO: 1566846 - RNA, 22 nt, Homo sapiens
gucauccaaacucaaacuugag

SEQ ID NO: 1566847 - RNA, 15 nt, Homo sapiens
gucauccauauuugc

SEQ ID NO: 1566848 - RNA, 12 nt, Homo sapiens
gucaugcccuua

SEQ ID NO: 1566849 - RNA, 20 nt, Homo sapiens
gucauggaggccaagaacuu

SEQ ID NO: 1566850 - RNA, 23 nt, Homo sapiens
gucauggccugagaugcagguga

SEQ ID NO: 1566851 - RNA, 19 nt, Homo sapiens
gucauggcuaauuuaacac

SEQ ID NO: 1566852 - RNA, 18 nt, Homo sapiens
gucauuagacgguaccaa

SEQ ID NO: 1566853 - RNA, 15 nt, Homo sapiens
gucauuauauucuaa

SEQ ID NO: 1566854 - RNA, 23 nt, Homo sapiens
gucauuauuuuuguuagcaaaga

SEQ ID NO: 1566855 - RNA, 17 nt, Homo sapiens
gucauuuccuaugcaaa

SEQ ID NO: 1566856 - RNA, 18 nt, Homo sapiens
guccaccaugcucucuca

SEQ ID NO: 1566857 - RNA, 18 nt, Homo sapiens
guccacccaccuaugugc

SEQ ID NO: 1566858 - RNA, 24 nt, Homo sapiens
guccacgagcuguuuacuagggau

SEQ ID NO: 1566859 - RNA, 17 nt, Homo sapiens
guccacgauucacucau

SEQ ID NO: 1566860 - RNA, 21 nt, Homo sapiens
guccacuguucuguucucaua

SEQ ID NO: 1566861 - RNA, 23 nt, Homo sapiens
guccagacgcacugaucuuugca

SEQ ID NO: 1566862 - RNA, 22 nt, Homo sapiens
guccaggccucucucugcucca

SEQ ID NO: 1566863 - RNA, 22 nt, Homo sapiens
guccauacacuuuguugcaaga

SEQ ID NO: 1566864 - RNA, 21 nt, Homo sapiens
guccauaucacacacauugcu

SEQ ID NO: 1566865 - RNA, 14 nt, Homo sapiens
guccauaugcaucu

SEQ ID NO: 1566866 - RNA, 14 nt, Homo sapiens
guccaucagccucc

SEQ ID NO: 1566867 - RNA, 16 nt, Homo sapiens
gucccaaaugucauca

SEQ ID NO: 1566868 - RNA, 16 nt, Homo sapiens
gucccaaccccagugg

SEQ ID NO: 1566869 - RNA, 17 nt, Homo sapiens
gucccaccccuaccucu

SEQ ID NO: 1566870 - RNA, 18 nt, Homo sapiens
gucccaccccuaccucua

SEQ ID NO: 1566871 - RNA, 20 nt, Homo sapiens
gucccaccccuaccucuagu

SEQ ID NO: 1566872 - RNA, 18 nt, Homo sapiens
gucccacuacaucuggga

SEQ ID NO: 1566873 - RNA, 23 nt, Homo sapiens
gucccagaaugccuccugcaggg

SEQ ID NO: 1566874 - RNA, 23 nt, Homo sapiens
guccccucauucuacuaauguga

SEQ ID NO: 1566875 - RNA, 18 nt, Homo sapiens
guccccucuuccuacccu

SEQ ID NO: 1566876 - RNA, 15 nt, Homo sapiens
gucccucccugccug

SEQ ID NO: 1566877 - RNA, 22 nt, Homo sapiens
gucccugaaaccuaguacugcc

SEQ ID NO: 1566878 - RNA, 18 nt, Homo sapiens
gucccugucaccaagcuc

SEQ ID NO: 1566879 - RNA, 22 nt, Homo sapiens
gucccuguccuucccuguucuc

SEQ ID NO: 1566880 - RNA, 23 nt, Homo sapiens
gucccuguuuauuccaaaugcca

SEQ ID NO: 1566881 - RNA, 22 nt, Homo sapiens
guccgugaauggucucugucaa

SEQ ID NO: 1566882 - RNA, 13 nt, Homo sapiens
guccuaaggccca

SEQ ID NO: 1566883 - RNA, 17 nt, Homo sapiens
guccuagaugccaaagg

SEQ ID NO: 1566884 - RNA, 19 nt, Homo sapiens
guccuagaugccaaagggg

SEQ ID NO: 1566885 - RNA, 14 nt, Homo sapiens
guccuaggacuuaa

SEQ ID NO: 1566886 - RNA, 16 nt, Homo sapiens
guccuaggacuuaaaa

SEQ ID NO: 1566887 - RNA, 16 nt, Homo sapiens
guccuauuauauucau

SEQ ID NO: 1566888 - RNA, 22 nt, Homo sapiens
guccucucucuuggggcgccca

SEQ ID NO: 1566889 - RNA, 23 nt, Homo sapiens
guccuguauaagaauuacuaaau

SEQ ID NO: 1566890 - RNA, 18 nt, Homo sapiens
guccugugaggacagcug

SEQ ID NO: 1566891 - RNA, 19 nt, Homo sapiens
guccuuaggugugaggucc

SEQ ID NO: 1566892 - RNA, 13 nt, Homo sapiens
guccuuccugugc

SEQ ID NO: 1566893 - RNA, 15 nt, Homo sapiens
guccuuuccaggggc

SEQ ID NO: 1566894 - RNA, 14 nt, Homo sapiens
guccuuuucuccca

SEQ ID NO: 1566895 - RNA, 14 nt, Homo sapiens
guccuuuugacacu

SEQ ID NO: 1566896 - RNA, 16 nt, Homo sapiens
gucgaacaauucauau

SEQ ID NO: 1566897 - RNA, 23 nt, Homo sapiens
gucgagacuucacgggcaaucau

SEQ ID NO: 1566898 - RNA, 18 nt, Homo sapiens
gucgagauugcacugcug

SEQ ID NO: 1566899 - RNA, 19 nt, Homo sapiens
gucuaacgcugaacugaca

SEQ ID NO: 1566900 - RNA, 19 nt, Homo sapiens
gucuaagguucagccugaa

SEQ ID NO: 1566901 - RNA, 21 nt, Homo sapiens
gucuacauacuuucauccuga

SEQ ID NO: 1566902 - RNA, 22 nt, Homo sapiens
gucuauaacuccuuguuucaga

SEQ ID NO: 1566903 - RNA, 17 nt, Homo sapiens
gucuaucuaaugacaug

SEQ ID NO: 1566904 - RNA, 18 nt, Homo sapiens
gucuauuuaagugcaauu

SEQ ID NO: 1566905 - RNA, 21 nt, Homo sapiens
gucuauuuccaagaaccuaua

SEQ ID NO: 1566906 - RNA, 18 nt, Homo sapiens
gucuauuuuauaucuguu

SEQ ID NO: 1566907 - RNA, 21 nt, Homo sapiens
gucucaaacucccgaccucag

SEQ ID NO: 1566908 - RNA, 22 nt, Homo sapiens
gucucaacuacucagcucuccu

SEQ ID NO: 1566909 - RNA, 22 nt, Homo sapiens
gucucacugugggaaggccagc

SEQ ID NO: 1566910 - RNA, 23 nt, Homo sapiens
gucucagaaacugcgaggccagu

SEQ ID NO: 1566911 - RNA, 12 nt, Homo sapiens
gucucaggacag

SEQ ID NO: 1566912 - RNA, 23 nt, Homo sapiens
gucucaggcuugcgcuggaccug

SEQ ID NO: 1566913 - RNA, 17 nt, Homo sapiens
gucucaguggcuucauc

SEQ ID NO: 1566914 - RNA, 12 nt, Homo sapiens
gucuccaaaaca

SEQ ID NO: 1566915 - RNA, 12 nt, Homo sapiens
gucuccaagacc

SEQ ID NO: 1566916 - RNA, 16 nt, Homo sapiens
gucuccaaguagucca

SEQ ID NO: 1566917 - RNA, 13 nt, Homo sapiens
gucucugugagac

SEQ ID NO: 1566918 - RNA, 12 nt, Homo sapiens
gucucuucaucu

SEQ ID NO: 1566919 - RNA, 18 nt, Homo sapiens
gucugcauuucauauuau

SEQ ID NO: 1566920 - RNA, 18 nt, Homo sapiens
gucugccaaaaugcaaca

SEQ ID NO: 1566921 - RNA, 18 nt, Homo sapiens
gucugcuuagaguuuacu

SEQ ID NO: 1566922 - RNA, 13 nt, Homo sapiens
ggagcugcaaauu

SEQ ID NO: 1566923 - RNA, 18 nt, Homo sapiens
ggagcugcugagugacag

SEQ ID NO: 1566924 - RNA, 22 nt, Homo sapiens
ggaggaaaaggccccugcaaug

SEQ ID NO: 1566925 - RNA, 20 nt, Homo sapiens
ggaggaaccacaauguuucu

SEQ ID NO: 1566926 - RNA, 19 nt, Homo sapiens
ggaggacaggcaggccaga

SEQ ID NO: 1566927 - RNA, 21 nt, Homo sapiens
ggaggcacaacgcaccagaca

SEQ ID NO: 1566928 - RNA, 20 nt, Homo sapiens
ggaggcggagguugcaguga

SEQ ID NO: 1566929 - RNA, 11 nt, Homo sapiens
ggaggcuuccu

SEQ ID NO: 1566930 - RNA, 22 nt, Homo sapiens
ggagggcgugacucacccaagc

SEQ ID NO: 1566931 - RNA, 19 nt, Homo sapiens
ggaggggucccugcaaaac

SEQ ID NO: 1566932 - RNA, 20 nt, Homo sapiens
ggagggugguucaacaaaga

SEQ ID NO: 1566933 - RNA, 14 nt, Homo sapiens
ggaggucucuguaa

SEQ ID NO: 1566934 - RNA, 22 nt, Homo sapiens
ggaggugaaaucccugccucag

SEQ ID NO: 1566935 - RNA, 14 nt, Homo sapiens
ggagguucucccag

SEQ ID NO: 1566936 - RNA, 20 nt, Homo sapiens
ggaguacggcugguguguca

SEQ ID NO: 1566937 - RNA, 14 nt, Homo sapiens
ggaguccagccccu

SEQ ID NO: 1566938 - RNA, 19 nt, Homo sapiens
ggagugcucucucagcacu

SEQ ID NO: 1566939 - RNA, 20 nt, Homo sapiens
ggaguguccucuucccucuc

SEQ ID NO: 1566940 - RNA, 16 nt, Homo sapiens
ggaguuuuacugccug

SEQ ID NO: 1566941 - RNA, 16 nt, Homo sapiens
ggauaaagaugagaug

SEQ ID NO: 1566942 - RNA, 21 nt, Homo sapiens
ggauaacuggcacccagagaa

SEQ ID NO: 1566943 - RNA, 21 nt, Homo sapiens
ggauaaguuucuauucuguca

SEQ ID NO: 1566944 - RNA, 20 nt, Homo sapiens
ggauaaugcuguugccucau

SEQ ID NO: 1566945 - RNA, 21 nt, Homo sapiens
ggauacauaaugggccacuga

SEQ ID NO: 1566946 - RNA, 23 nt, Homo sapiens
gcuuuuucacagucacugaugua

SEQ ID NO: 1566947 - RNA, 19 nt, Homo sapiens
gcuuuuucuccccuccucu

SEQ ID NO: 1566948 - RNA, 21 nt, Homo sapiens
gcuuuuugggaccaucacuga

SEQ ID NO: 1566949 - RNA, 15 nt, Homo sapiens
gcuuuuuguucagaa

SEQ ID NO: 1566950 - RNA, 21 nt, Homo sapiens
ggaaaaaaauaguaaagccaa

SEQ ID NO: 1566951 - RNA, 21 nt, Homo sapiens
ggaaagagcagucagagucca

SEQ ID NO: 1566952 - RNA, 16 nt, Homo sapiens
ggaaagauuugugaac

SEQ ID NO: 1566953 - RNA, 15 nt, Homo sapiens
ggaaagcaugcauug

SEQ ID NO: 1566954 - RNA, 16 nt, Homo sapiens
ggaaagccaguuacau

SEQ ID NO: 1566955 - RNA, 16 nt, Homo sapiens
ggaaaggagaguacuu

SEQ ID NO: 1566956 - RNA, 14 nt, Homo sapiens
ggaaaggggugcuu

SEQ ID NO: 1566957 - RNA, 12 nt, Homo sapiens
ggaaagugaaac

SEQ ID NO: 1566958 - RNA, 17 nt, Homo sapiens
ggaaaguguacacuauu

SEQ ID NO: 1566959 - RNA, 15 nt, Homo sapiens
ggaaauguagcacuu

SEQ ID NO: 1566960 - RNA, 12 nt, Homo sapiens
ggaaauguauau

SEQ ID NO: 1566961 - RNA, 15 nt, Homo sapiens
ggaaauuaagacuuu

SEQ ID NO: 1566962 - RNA, 17 nt, Homo sapiens
ggaaauuguuuaugugu

SEQ ID NO: 1566963 - RNA, 14 nt, Homo sapiens
ggaacaaaucucuc

SEQ ID NO: 1566964 - RNA, 19 nt, Homo sapiens
ggaacacaggcccagauga

SEQ ID NO: 1566965 - RNA, 23 nt, Homo sapiens
ggaacagcacuggggagucuuug

SEQ ID NO: 1566966 - RNA, 16 nt, Homo sapiens
ggaacaucacauuccu

SEQ ID NO: 1566967 - RNA, 12 nt, Homo sapiens
ggaacuacgggg

SEQ ID NO: 1566968 - RNA, 21 nt, Homo sapiens
ggaacucuagaagaccaaaug

SEQ ID NO: 1566969 - RNA, 16 nt, Homo sapiens
ggaacucuuaagcaau

SEQ ID NO: 1566970 - RNA, 17 nt, Homo sapiens
gcugaaaacauaaccca

SEQ ID NO: 1566971 - RNA, 16 nt, Homo sapiens
gcugaacugacaauga

SEQ ID NO: 1566972 - RNA, 17 nt, Homo sapiens
gcugaacugacaaugaa

SEQ ID NO: 1566973 - RNA, 18 nt, Homo sapiens
gcugaacugacaaugaag

SEQ ID NO: 1566974 - RNA, 18 nt, Homo sapiens
gcugaagaguaaaggaaa

SEQ ID NO: 1566975 - RNA, 19 nt, Homo sapiens
gcugaagcaaagugcccau

SEQ ID NO: 1566976 - RNA, 20 nt, Homo sapiens
gcugaauuucccucucucau

SEQ ID NO: 1566977 - RNA, 19 nt, Homo sapiens
gcugacacgcucaguugaa

SEQ ID NO: 1566978 - RNA, 19 nt, Homo sapiens
gcugacccagaguggaguc

SEQ ID NO: 1566979 - RNA, 18 nt, Homo sapiens
gcugacuagaagggccag

SEQ ID NO: 1566980 - RNA, 17 nt, Homo sapiens
gcugagaggaagcaaga

SEQ ID NO: 1566981 - RNA, 16 nt, Homo sapiens
gcugagauccuggacu

SEQ ID NO: 1566982 - RNA, 21 nt, Homo sapiens
gcugagauuacucugaaaaug

SEQ ID NO: 1566983 - RNA, 16 nt, Homo sapiens
gcugagcaaucugacc

SEQ ID NO: 1566984 - RNA, 14 nt, Homo sapiens
gcugagcaugugga

SEQ ID NO: 1566985 - RNA, 21 nt, Homo sapiens
gcugaggcugaggcacuggcg

SEQ ID NO: 1566986 - RNA, 16 nt, Homo sapiens
gcugcacauggccuga

SEQ ID NO: 1566987 - RNA, 13 nt, Homo sapiens
gcugcaccugguc

SEQ ID NO: 1566988 - RNA, 15 nt, Homo sapiens
gcugcagguggcaga

SEQ ID NO: 1566989 - RNA, 17 nt, Homo sapiens
gcugcagucacaucaca

SEQ ID NO: 1566990 - RNA, 14 nt, Homo sapiens
gcugcaucgcuguu

SEQ ID NO: 1566991 - RNA, 21 nt, Homo sapiens
gcugccaccucuccauccugc

SEQ ID NO: 1566992 - RNA, 15 nt, Homo sapiens
gcugccagugccugg

SEQ ID NO: 1566993 - RNA, 13 nt, Homo sapiens
gcugccucucuuu

SEQ ID NO: 1566994 - RNA, 17 nt, Homo sapiens
gagaugguuucuagaga

SEQ ID NO: 1566995 - RNA, 21 nt, Homo sapiens
gagauguucgcucgugcagua

SEQ ID NO: 1566996 - RNA, 19 nt, Homo sapiens
gagauucauuuucuagaua

SEQ ID NO: 1566997 - RNA, 22 nt, Homo sapiens
gagauugcaccacugcacucca

SEQ ID NO: 1566998 - RNA, 22 nt, Homo sapiens
gagauugcacuauugcacucca

SEQ ID NO: 1566999 - RNA, 14 nt, Homo sapiens
gagauugcacugcu

SEQ ID NO: 1567000 - RNA, 20 nt, Homo sapiens
gagauugcgccauugcacuc

SEQ ID NO: 1567001 - RNA, 14 nt, Homo sapiens
gagcaagacccugu

SEQ ID NO: 1567002 - RNA, 21 nt, Homo sapiens
gagcacccugcccaccaagaa

SEQ ID NO: 1567003 - RNA, 18 nt, Homo sapiens
gagcacuccuggugcagg

SEQ ID NO: 1567004 - RNA, 20 nt, Homo sapiens
gagcacugcguuuuccuagc

SEQ ID NO: 1567005 - RNA, 20 nt, Homo sapiens
gagcagaaaguaagcauuuc

SEQ ID NO: 1567006 - RNA, 17 nt, Homo sapiens
gagcagagccuacagaa

SEQ ID NO: 1567007 - RNA, 20 nt, Homo sapiens
gagcagagcuuccacaagac

SEQ ID NO: 1567008 - RNA, 18 nt, Homo sapiens
gagcagccucuggacagc

SEQ ID NO: 1567009 - RNA, 20 nt, Homo sapiens
gagcaggcuacugucagcuc

SEQ ID NO: 1567010 - RNA, 19 nt, Homo sapiens
gagcagggagaccaugccu

SEQ ID NO: 1567011 - RNA, 15 nt, Homo sapiens
gagcagucagggugg

SEQ ID NO: 1567012 - RNA, 18 nt, Homo sapiens
gagcaguugcccucaggc

SEQ ID NO: 1567013 - RNA, 21 nt, Homo sapiens
gagcauguggugauuggccac

SEQ ID NO: 1567014 - RNA, 18 nt, Homo sapiens
gagccaccgcgcccggcc

SEQ ID NO: 1567015 - RNA, 19 nt, Homo sapiens
gagccagacuguccaggga

SEQ ID NO: 1567016 - RNA, 23 nt, Homo sapiens
gagccagcaggucaaaaaggcca

SEQ ID NO: 1567017 - RNA, 19 nt, Homo sapiens
gagccaggcacacacugug

SEQ ID NO: 1567018 - RNA, 12 nt, Homo sapiens
gagccaguuuau

SEQ ID NO: 1567019 - RNA, 17 nt, Homo sapiens
gagccaguuuauuuucu

SEQ ID NO: 1567020 - RNA, 13 nt, Homo sapiens
gagccauaugaau

SEQ ID NO: 1567021 - RNA, 21 nt, Homo sapiens
gagcccaggaguucaagacca

SEQ ID NO: 1567022 - RNA, 12 nt, Homo sapiens
gagcccagugaa

SEQ ID NO: 1567023 - RNA, 16 nt, Homo sapiens
gagccgcgucccggca

SEQ ID NO: 1567024 - RNA, 17 nt, Homo sapiens
gagccgggucugccucu

SEQ ID NO: 1567025 - RNA, 13 nt, Homo sapiens
gagccgguggugc

SEQ ID NO: 1567026 - RNA, 23 nt, Homo sapiens
gagccucccccucagaugaucuc

SEQ ID NO: 1567027 - RNA, 14 nt, Homo sapiens
gagccugacccuca

SEQ ID NO: 1567028 - RNA, 16 nt, Homo sapiens
gagccugcugcauggg

SEQ ID NO: 1567029 - RNA, 18 nt, Homo sapiens
gagccuucaagugccaaa

SEQ ID NO: 1567030 - RNA, 19 nt, Homo sapiens
gagccuucaagugccaaac

SEQ ID NO: 1567031 - RNA, 14 nt, Homo sapiens
gagcgagacccugu

SEQ ID NO: 1567032 - RNA, 11 nt, Homo sapiens
gagcuagaagc

SEQ ID NO: 1567033 - RNA, 21 nt, Homo sapiens
gagcucaggucccaggccagc

SEQ ID NO: 1567034 - RNA, 22 nt, Homo sapiens
gagcuccucccuccagcugcga

SEQ ID NO: 1567035 - RNA, 17 nt, Homo sapiens
gagcuccuuagccuuug

SEQ ID NO: 1567036 - RNA, 23 nt, Homo sapiens
gagcucucaagucaaggaagcug

SEQ ID NO: 1567037 - RNA, 20 nt, Homo sapiens
gagcucuggcuuugcaaggg

SEQ ID NO: 1567038 - RNA, 16 nt, Homo sapiens
gagcugauacuuugac

SEQ ID NO: 1567039 - RNA, 12 nt, Homo sapiens
gagcugcagcug

SEQ ID NO: 1567040 - RNA, 22 nt, Homo sapiens
gagcugccaagagugaagggaa

SEQ ID NO: 1567041 - RNA, 22 nt, Homo sapiens
gagcugcucccuuuccugcacc

SEQ ID NO: 1567042 - RNA, 22 nt, Homo sapiens
gagcuggggaugucucucauga

SEQ ID NO: 1567043 - RNA, 11 nt, Homo sapiens
gagcugugagu

SEQ ID NO: 1567044 - RNA, 13 nt, Homo sapiens
gagcuuagcauau

SEQ ID NO: 1567045 - RNA, 21 nt, Homo sapiens
gagcuucccugacucauucug

SEQ ID NO: 1567046 - RNA, 23 nt, Homo sapiens
gagcuuugcauguuccacuaacc

SEQ ID NO: 1567047 - RNA, 15 nt, Homo sapiens
gagcuuuucuggaau

SEQ ID NO: 1567048 - RNA, 18 nt, Homo sapiens
gagcuuuugaugccaggu

SEQ ID NO: 1567049 - RNA, 20 nt, Homo sapiens
gagcuuuuuaauagcacuaa

SEQ ID NO: 1567050 - RNA, 15 nt, Homo sapiens
gaggaaaaguccaca

SEQ ID NO: 1567051 - RNA, 14 nt, Homo sapiens
gaggaaaccuagca

SEQ ID NO: 1567052 - RNA, 13 nt, Homo sapiens
gaggaaacuuuga

SEQ ID NO: 1567053 - RNA, 13 nt, Homo sapiens
gaggaaagauuca

SEQ ID NO: 1567054 - RNA, 12 nt, Homo sapiens
gaggaaagggag

SEQ ID NO: 1567055 - RNA, 21 nt, Homo sapiens
gaggaacaaagacaaccacug

SEQ ID NO: 1567056 - RNA, 23 nt, Homo sapiens
gaggaagaagauguccgugagaa

SEQ ID NO: 1567057 - RNA, 19 nt, Homo sapiens
gaggaagcuguugguguuc

SEQ ID NO: 1567058 - RNA, 23 nt, Homo sapiens
gaggaaguagcugucagauguca

SEQ ID NO: 1567059 - RNA, 16 nt, Homo sapiens
gaggaaucagcucaau

SEQ ID NO: 1567060 - RNA, 22 nt, Homo sapiens
gaggacccagacccagugggga

SEQ ID NO: 1567061 - RNA, 21 nt, Homo sapiens
gaggacuacuuuccagaauuu

SEQ ID NO: 1567062 - RNA, 14 nt, Homo sapiens
gaggagaaacugag

SEQ ID NO: 1567063 - RNA, 16 nt, Homo sapiens
gaggagaaacuggaac

SEQ ID NO: 1567064 - RNA, 23 nt, Homo sapiens
gaggagcaguguggggggacaga

SEQ ID NO: 1567065 - RNA, 22 nt, Homo sapiens
gaggaguagcaugaacgccaag

SEQ ID NO: 1567066 - RNA, 22 nt, Homo sapiens
gaggaucagcacugccagugga

SEQ ID NO: 1567067 - RNA, 12 nt, Homo sapiens
gaggauugccuu

SEQ ID NO: 1567068 - RNA, 21 nt, Homo sapiens
gaggcaggagaauggugugaa

SEQ ID NO: 1567069 - RNA, 17 nt, Homo sapiens
gaggcccaggcugggaa

SEQ ID NO: 1567070 - RNA, 11 nt, Homo sapiens
gaggcccucaa

SEQ ID NO: 1567071 - RNA, 16 nt, Homo sapiens
gaggccucucauucca

SEQ ID NO: 1567072 - RNA, 16 nt, Homo sapiens
gaggcgcacaguguga

SEQ ID NO: 1567073 - RNA, 19 nt, Homo sapiens
gaggcuacagggccaaacg

SEQ ID NO: 1567074 - RNA, 13 nt, Homo sapiens
gaggcuacaguga

SEQ ID NO: 1567075 - RNA, 15 nt, Homo sapiens
gaggcucuguccuaa

SEQ ID NO: 1567076 - RNA, 22 nt, Homo sapiens
gaggcugaggcagaaggauuac

SEQ ID NO: 1567077 - RNA, 20 nt, Homo sapiens
gaggcugccccucucaccaa

SEQ ID NO: 1567078 - RNA, 18 nt, Homo sapiens
gaggcugccucccaacag

SEQ ID NO: 1567079 - RNA, 18 nt, Homo sapiens
gaggcuggagauccuuuc

SEQ ID NO: 1567080 - RNA, 15 nt, Homo sapiens
gaggcuggugacagg

SEQ ID NO: 1567081 - RNA, 22 nt, Homo sapiens
gaggcuucuccuguuuuauaua

SEQ ID NO: 1567082 - RNA, 15 nt, Homo sapiens
gaggcuuuacagugu

SEQ ID NO: 1567083 - RNA, 23 nt, Homo sapiens
gaggcuuucuccaggaggauuag

SEQ ID NO: 1567084 - RNA, 18 nt, Homo sapiens
gagggaauccauugaacu

SEQ ID NO: 1567085 - RNA, 12 nt, Homo sapiens
gagggagugcug

SEQ ID NO: 1567086 - RNA, 13 nt, Homo sapiens
gagggagugcugu

SEQ ID NO: 1567087 - RNA, 19 nt, Homo sapiens
gagggauaaaaacaauacu

SEQ ID NO: 1567088 - RNA, 14 nt, Homo sapiens
gagggcaagcccug

SEQ ID NO: 1567089 - RNA, 21 nt, Homo sapiens
gagggcaaugaugugugcaag

SEQ ID NO: 1567090 - RNA, 16 nt, Homo sapiens
gagggccccugcgugg

SEQ ID NO: 1567091 - RNA, 22 nt, Homo sapiens
gagggcccuccgaccacuucca

SEQ ID NO: 1567092 - RNA, 21 nt, Homo sapiens
gagggcucaccucuugccuuc

SEQ ID NO: 1567093 - RNA, 18 nt, Homo sapiens
gagggggcuugaagccaa

SEQ ID NO: 1567094 - RNA, 19 nt, Homo sapiens
gagggggcuugaagccaaa

SEQ ID NO: 1567095 - RNA, 19 nt, Homo sapiens
gaggguaaauaaaccacug

SEQ ID NO: 1567096 - RNA, 22 nt, Homo sapiens
gaggguggcuuugcuguuguug

SEQ ID NO: 1567097 - RNA, 12 nt, Homo sapiens
gaggucacugga

SEQ ID NO: 1567098 - RNA, 18 nt, Homo sapiens
gaggucagcauuugaucu

SEQ ID NO: 1567099 - RNA, 15 nt, Homo sapiens
gaggucucccaaacg

SEQ ID NO: 1567100 - RNA, 22 nt, Homo sapiens
gaggugcuguccccacugcccc

SEQ ID NO: 1567101 - RNA, 15 nt, Homo sapiens
gaggugggauccucc

SEQ ID NO: 1567102 - RNA, 20 nt, Homo sapiens
gagguuacagaggcugacuu

SEQ ID NO: 1567103 - RNA, 14 nt, Homo sapiens
gagguugaagccaa

SEQ ID NO: 1567104 - RNA, 15 nt, Homo sapiens
gagguugaagccaag

SEQ ID NO: 1567105 - RNA, 17 nt, Homo sapiens
gagguuugccagcauuu

SEQ ID NO: 1567106 - RNA, 17 nt, Homo sapiens
gaguaacaggugccuuc

SEQ ID NO: 1567107 - RNA, 12 nt, Homo sapiens
gaguaagcacgu

SEQ ID NO: 1567108 - RNA, 14 nt, Homo sapiens
gaguaauaagcaug

SEQ ID NO: 1567109 - RNA, 18 nt, Homo sapiens
gaguaauacaucaaagag

SEQ ID NO: 1567110 - RNA, 21 nt, Homo sapiens
gaguacacucagccacuguca

SEQ ID NO: 1567111 - RNA, 18 nt, Homo sapiens
gaguaguauuaaaagcua

SEQ ID NO: 1567112 - RNA, 17 nt, Homo sapiens
gaugugagccaccgugc

SEQ ID NO: 1567113 - RNA, 20 nt, Homo sapiens
gauguguauacguaggaauu

SEQ ID NO: 1567114 - RNA, 16 nt, Homo sapiens
gauguguccucaggga

SEQ ID NO: 1567115 - RNA, 15 nt, Homo sapiens
gaugugucuuaccag

SEQ ID NO: 1567116 - RNA, 16 nt, Homo sapiens
gaugugucuuaccaga

SEQ ID NO: 1567117 - RNA, 13 nt, Homo sapiens
gauguguggacac

SEQ ID NO: 1567118 - RNA, 23 nt, Homo sapiens
gauguuaugcuccugcugaucca

SEQ ID NO: 1567119 - RNA, 19 nt, Homo sapiens
gauguucgcucgugcagua

SEQ ID NO: 1567120 - RNA, 14 nt, Homo sapiens
gauuaagaaugcca

SEQ ID NO: 1567121 - RNA, 22 nt, Homo sapiens
gauuaagauauucagaaguaua

SEQ ID NO: 1567122 - RNA, 17 nt, Homo sapiens
gauuaagggacauuucu

SEQ ID NO: 1567123 - RNA, 21 nt, Homo sapiens
gauuacaaaucagaagucauc

SEQ ID NO: 1567124 - RNA, 16 nt, Homo sapiens
gauuacucuccauauc

SEQ ID NO: 1567125 - RNA, 23 nt, Homo sapiens
gauuacucuccauaucccuuccu

SEQ ID NO: 1567126 - RNA, 19 nt, Homo sapiens
gauuaggucguuuuccaaa

SEQ ID NO: 1567127 - RNA, 14 nt, Homo sapiens
gauuaucuacagaa

SEQ ID NO: 1567128 - RNA, 23 nt, Homo sapiens
gauuauuaaaacugaacuugaag

SEQ ID NO: 1567129 - RNA, 22 nt, Homo sapiens
gauuauuagccagguaauguga

SEQ ID NO: 1567130 - RNA, 16 nt, Homo sapiens
gauucaaauugcugcu

SEQ ID NO: 1567131 - RNA, 17 nt, Homo sapiens
cuuuguuacuuccuuau

SEQ ID NO: 1567132 - RNA, 14 nt, Homo sapiens
cuuuguuaggauuu

SEQ ID NO: 1567133 - RNA, 17 nt, Homo sapiens
cuuuguuggagucaaaa

SEQ ID NO: 1567134 - RNA, 17 nt, Homo sapiens
cuuuguuuaaaugccaa

SEQ ID NO: 1567135 - RNA, 20 nt, Homo sapiens
cuuuuaauccaauccacuaa

SEQ ID NO: 1567136 - RNA, 18 nt, Homo sapiens
cuuuuacaacugccucga

SEQ ID NO: 1567137 - RNA, 17 nt, Homo sapiens
cuuuuagaaaaggccaa

SEQ ID NO: 1567138 - RNA, 21 nt, Homo sapiens
cuuuuaucucacaaauaagua

SEQ ID NO: 1567139 - RNA, 19 nt, Homo sapiens
cuuuuauggaugauuaaau

SEQ ID NO: 1567140 - RNA, 21 nt, Homo sapiens
cuuuuauguaguaauugacau

SEQ ID NO: 1567141 - RNA, 18 nt, Homo sapiens
cuuuuauugacacagaaa

SEQ ID NO: 1567142 - RNA, 13 nt, Homo sapiens
cuuuucaaaaccu

SEQ ID NO: 1567143 - RNA, 18 nt, Homo sapiens
cuuuucaaucuucuacuu

SEQ ID NO: 1567144 - RNA, 19 nt, Homo sapiens
cuuuucaauguuagccaca

SEQ ID NO: 1567145 - RNA, 18 nt, Homo sapiens
cuuuucagaagcaagcca

SEQ ID NO: 1567146 - RNA, 15 nt, Homo sapiens
cuuuucagugauacu

SEQ ID NO: 1567147 - RNA, 16 nt, Homo sapiens
cuuuucagugauacuc

SEQ ID NO: 1567148 - RNA, 15 nt, Homo sapiens
cuuuucaguguuccc

SEQ ID NO: 1567149 - RNA, 15 nt, Homo sapiens
cuuuuccucaccagu

SEQ ID NO: 1567150 - RNA, 23 nt, Homo sapiens
cuuuucggccccauguaucucag

SEQ ID NO: 1567151 - RNA, 21 nt, Homo sapiens
cuuuucuaauuaauagccaaa

SEQ ID NO: 1567152 - RNA, 23 nt, Homo sapiens
cuuuucuacacacucagccacaa

SEQ ID NO: 1567153 - RNA, 21 nt, Homo sapiens
cuuuucucacaaaaaggcaaa

SEQ ID NO: 1567154 - RNA, 19 nt, Homo sapiens
cuuuucuguacuuccugag

SEQ ID NO: 1567155 - RNA, 20 nt, Homo sapiens
cuuuucuuuguaucauucau

SEQ ID NO: 1567156 - RNA, 13 nt, Homo sapiens
cuuuugacuccag

SEQ ID NO: 1567157 - RNA, 23 nt, Homo sapiens
cuuuugaugccaggugcaaucua

SEQ ID NO: 1567158 - RNA, 18 nt, Homo sapiens
cuuuugcagaaaucacaa

SEQ ID NO: 1567159 - RNA, 20 nt, Homo sapiens
cuuuugccacaucccuauag

SEQ ID NO: 1567160 - RNA, 16 nt, Homo sapiens
cuuuugccauuagcca

SEQ ID NO: 1567161 - RNA, 13 nt, Homo sapiens
cuuuugcuugcaa

SEQ ID NO: 1567162 - RNA, 20 nt, Homo sapiens
cuuuugguagagaaggagca

SEQ ID NO: 1567163 - RNA, 15 nt, Homo sapiens
cuuuuguaauaucaa

SEQ ID NO: 1567164 - RNA, 13 nt, Homo sapiens
cuuuuguacugaa

SEQ ID NO: 1567165 - RNA, 17 nt, Homo sapiens
cuuuuguccacuuguaa

SEQ ID NO: 1567166 - RNA, 13 nt, Homo sapiens
cuuuugucccaga

SEQ ID NO: 1567167 - RNA, 14 nt, Homo sapiens
cuuuugucccagaa

SEQ ID NO: 1567168 - RNA, 21 nt, Homo sapiens
cuuuuguuaaaagaugguaaa

SEQ ID NO: 1567169 - RNA, 23 nt, Homo sapiens
cuuuuguuguacuuuauaucuug

SEQ ID NO: 1567170 - RNA, 16 nt, Homo sapiens
cuuuuucaaugaauuu

SEQ ID NO: 1567171 - RNA, 18 nt, Homo sapiens
cuuuuucauauuucuacc

SEQ ID NO: 1567172 - RNA, 23 nt, Homo sapiens
cuuuuucuccccuccucuauucc

SEQ ID NO: 1567173 - RNA, 17 nt, Homo sapiens
cuuuuugggcuuucaua

SEQ ID NO: 1567174 - RNA, 20 nt, Homo sapiens
cuuuuuuagaaaugcaaaau

SEQ ID NO: 1567175 - RNA, 16 nt, Homo sapiens
cuuuuuucaauaugca

SEQ ID NO: 1567176 - RNA, 16 nt, Homo sapiens
cuuuuuuucuaugaaa

SEQ ID NO: 1567177 - RNA, 17 nt, Homo sapiens
gaaaaaaaaaacacuug

SEQ ID NO: 1567178 - RNA, 14 nt, Homo sapiens
gaaaaaaagcacaa

SEQ ID NO: 1567179 - RNA, 15 nt, Homo sapiens
gaaaaaaaucaucua

SEQ ID NO: 1567180 - RNA, 16 nt, Homo sapiens
gaaaaauaaacauucu

SEQ ID NO: 1567181 - RNA, 17 nt, Homo sapiens
gaaaaauaccaacucag

SEQ ID NO: 1567182 - RNA, 18 nt, Homo sapiens
gaaaacaaauauuucacu

SEQ ID NO: 1567183 - RNA, 17 nt, Homo sapiens
gaaaacaaucaaauauu

SEQ ID NO: 1567184 - RNA, 14 nt, Homo sapiens
gaaaacacugugca

SEQ ID NO: 1567185 - RNA, 15 nt, Homo sapiens
gaaaacacugugcac

SEQ ID NO: 1567186 - RNA, 21 nt, Homo sapiens
gaaaacauaacccacucuguc

SEQ ID NO: 1567187 - RNA, 17 nt, Homo sapiens
gaaaaccacaacuaaaa

SEQ ID NO: 1567188 - RNA, 12 nt, Homo sapiens
gaaaaccagcuu

SEQ ID NO: 1567189 - RNA, 18 nt, Homo sapiens
gaaaacuacugauacuuu

SEQ ID NO: 1567190 - RNA, 20 nt, Homo sapiens
gaaaacuacugauacuuuca

SEQ ID NO: 1567191 - RNA, 20 nt, Homo sapiens
gaaaacuuaaggaagcaaau

SEQ ID NO: 1567192 - RNA, 15 nt, Homo sapiens
gaaaagaaaugcacu

SEQ ID NO: 1567193 - RNA, 15 nt, Homo sapiens
gaaaagaagugaagu

SEQ ID NO: 1567194 - RNA, 15 nt, Homo sapiens
gaaaagagcuuugua

SEQ ID NO: 1567195 - RNA, 21 nt, Homo sapiens
gaaaagcaauacuguuuccau

SEQ ID NO: 1567196 - RNA, 15 nt, Homo sapiens
gaaaagguugccuga

SEQ ID NO: 1567197 - RNA, 17 nt, Homo sapiens
gaaaaguacuaauagaa

SEQ ID NO: 1567198 - RNA, 14 nt, Homo sapiens
gaaaaguagacaau

SEQ ID NO: 1567199 - RNA, 17 nt, Homo sapiens
gaaaagugaaucuugcu

SEQ ID NO: 1567200 - RNA, 21 nt, Homo sapiens
gaaaaguuuaaagacacuuag

SEQ ID NO: 1567201 - RNA, 14 nt, Homo sapiens
gaaaauaaacugac

SEQ ID NO: 1567202 - RNA, 15 nt, Homo sapiens
gaaaauaguauuuca

SEQ ID NO: 1567203 - RNA, 17 nt, Homo sapiens
gaaaauaucagcuuuuc

SEQ ID NO: 1567204 - RNA, 16 nt, Homo sapiens
gaaaaucacaucucca

SEQ ID NO: 1567205 - RNA, 19 nt, Homo sapiens
gaaaaucauuugaggucag

SEQ ID NO: 1567206 - RNA, 20 nt, Homo sapiens
gaaaauccacuaugacaucu

SEQ ID NO: 1567207 - RNA, 22 nt, Homo sapiens
gaaaaucuaccaagaacagagu

SEQ ID NO: 1567208 - RNA, 16 nt, Homo sapiens
gaaaaucuccaucuca

SEQ ID NO: 1567209 - RNA, 17 nt, Homo sapiens
gaaaaugagagcagaaa

SEQ ID NO: 1567210 - RNA, 17 nt, Homo sapiens
gaaaauguccaggaaag

SEQ ID NO: 1567211 - RNA, 17 nt, Homo sapiens
gaaaaugugaacaugga

SEQ ID NO: 1567212 - RNA, 20 nt, Homo sapiens
gaaaauuagacugugauuca

SEQ ID NO: 1567213 - RNA, 13 nt, Homo sapiens
gaaaauuauuuug

SEQ ID NO: 1567214 - RNA, 21 nt, Homo sapiens
gaaaauuccuagaaauugaac

SEQ ID NO: 1567215 - RNA, 12 nt, Homo sapiens
gaaaauugcaau

SEQ ID NO: 1567216 - RNA, 16 nt, Homo sapiens
gaaaauugcaauacau

SEQ ID NO: 1567217 - RNA, 20 nt, Homo sapiens
gaaaauuguauaaauuacuu

SEQ ID NO: 1567218 - RNA, 21 nt, Homo sapiens
gaaaauuguauaaauuacuuu

SEQ ID NO: 1567219 - RNA, 21 nt, Homo sapiens
gaaacaaaaucaaaacagaga

SEQ ID NO: 1567220 - RNA, 14 nt, Homo sapiens
gaaacaaaugaaau

SEQ ID NO: 1567221 - RNA, 15 nt, Homo sapiens
gaaacaaaugaaaua

SEQ ID NO: 1567222 - RNA, 17 nt, Homo sapiens
gaaacacagaaaccuuu

SEQ ID NO: 1567223 - RNA, 18 nt, Homo sapiens
gaaacaccgagucucugu

SEQ ID NO: 1567224 - RNA, 13 nt, Homo sapiens
gaaacagugugca

SEQ ID NO: 1567225 - RNA, 19 nt, Homo sapiens
gaaacaguugguaacuuuu

SEQ ID NO: 1567226 - RNA, 20 nt, Homo sapiens
gaaacauggaggaacaguau

SEQ ID NO: 1567227 - RNA, 12 nt, Homo sapiens
gaaacauuucag

SEQ ID NO: 1567228 - RNA, 15 nt, Homo sapiens
gaaacccccaucucu

SEQ ID NO: 1567229 - RNA, 20 nt, Homo sapiens
gaaaccccccagagcucuuu

SEQ ID NO: 1567230 - RNA, 19 nt, Homo sapiens
gaaaccccgucucuacuaa

SEQ ID NO: 1567231 - RNA, 12 nt, Homo sapiens
gaccugcugcuc

SEQ ID NO: 1567232 - RNA, 22 nt, Homo sapiens
gaccuggagcgccacacacugc

SEQ ID NO: 1567233 - RNA, 19 nt, Homo sapiens
gaccuguaccgcagccgcc

SEQ ID NO: 1567234 - RNA, 18 nt, Homo sapiens
gaccuguauuuaagcaaa

SEQ ID NO: 1567235 - RNA, 13 nt, Homo sapiens
gaccuuacuccuc

SEQ ID NO: 1567236 - RNA, 17 nt, Homo sapiens
gaccuuauggucaccca

SEQ ID NO: 1567237 - RNA, 23 nt, Homo sapiens
gaccuuauuaaagguaugcauuu

SEQ ID NO: 1567238 - RNA, 23 nt, Homo sapiens
gaccuuuauccagcuagugccaa

SEQ ID NO: 1567239 - RNA, 14 nt, Homo sapiens
gacgaaccuugaaa

SEQ ID NO: 1567240 - RNA, 12 nt, Homo sapiens
gacgacaguacu

SEQ ID NO: 1567241 - RNA, 20 nt, Homo sapiens
gacgcaccgccugaaggcac

SEQ ID NO: 1567242 - RNA, 21 nt, Homo sapiens
gacgccacucauuucaucuca

SEQ ID NO: 1567243 - RNA, 16 nt, Homo sapiens
gacgcccccaccagcu

SEQ ID NO: 1567244 - RNA, 19 nt, Homo sapiens
gacggagcccuggcauguc

SEQ ID NO: 1567245 - RNA, 22 nt, Homo sapiens
gacggcgugccuggacacugua

SEQ ID NO: 1567246 - RNA, 19 nt, Homo sapiens
gacguccucccugauccca

SEQ ID NO: 1567247 - RNA, 20 nt, Homo sapiens
gacguccucccugaucccac

SEQ ID NO: 1567248 - RNA, 15 nt, Homo sapiens
uucucagaaccauuu

SEQ ID NO: 1567249 - RNA, 18 nt, Homo sapiens
uucucagaaccauuucac

SEQ ID NO: 1567250 - RNA, 13 nt, Homo sapiens
uucucaucacuca

SEQ ID NO: 1567251 - RNA, 21 nt, Homo sapiens
uucucaucaguaguucacaua

SEQ ID NO: 1567252 - RNA, 13 nt, Homo sapiens
uucucaucugcaa

SEQ ID NO: 1567253 - RNA, 13 nt, Homo sapiens
uucucaugaucca

SEQ ID NO: 1567254 - RNA, 20 nt, Homo sapiens
uucucauuucuguagccuga

SEQ ID NO: 1567255 - RNA, 19 nt, Homo sapiens
uucuccagggaauucuuac

SEQ ID NO: 1567256 - RNA, 20 nt, Homo sapiens
uucuccauacgcacugguau

SEQ ID NO: 1567257 - RNA, 23 nt, Homo sapiens
uucucccacaugaggccaucuca

SEQ ID NO: 1567258 - RNA, 14 nt, Homo sapiens
uucuccugugaaug

SEQ ID NO: 1567259 - RNA, 19 nt, Homo sapiens
uucucggggugggacagac

SEQ ID NO: 1567260 - RNA, 16 nt, Homo sapiens
uucucgugacaccacc

SEQ ID NO: 1567261 - RNA, 22 nt, Homo sapiens
uucucuacugucuggauuaauu

SEQ ID NO: 1567262 - RNA, 21 nt, Homo sapiens
uucucuagaagcuccagugau

SEQ ID NO: 1567263 - RNA, 16 nt, Homo sapiens
uucucuauacucaggu

SEQ ID NO: 1567264 - RNA, 22 nt, Homo sapiens
uucucucccuuccucucuccuu

SEQ ID NO: 1567265 - RNA, 17 nt, Homo sapiens
uucucugaggacacaga

SEQ ID NO: 1567266 - RNA, 14 nt, Homo sapiens
uucucugcagucaa

SEQ ID NO: 1567267 - RNA, 22 nt, Homo sapiens
uucucugccuuuuuacuauaca

SEQ ID NO: 1567268 - RNA, 23 nt, Homo sapiens
uucucuguuguuugguucaggga

SEQ ID NO: 1567269 - RNA, 17 nt, Homo sapiens
uucucuugacagucuga

SEQ ID NO: 1567270 - RNA, 23 nt, Homo sapiens
uucugaaaaccuaccagccagag

SEQ ID NO: 1567271 - RNA, 17 nt, Homo sapiens
uucugagaaagacuauu

SEQ ID NO: 1567272 - RNA, 20 nt, Homo sapiens
uucugauaaaagauggccau

SEQ ID NO: 1567273 - RNA, 18 nt, Homo sapiens
uucugaucauguaugcau

SEQ ID NO: 1567274 - RNA, 14 nt, Homo sapiens
uucugauuucugcc

SEQ ID NO: 1567275 - RNA, 20 nt, Homo sapiens
uucugcaauccaaugcacug

SEQ ID NO: 1567276 - RNA, 22 nt, Homo sapiens
uucugcagauaaacaguaguga

SEQ ID NO: 1567277 - RNA, 21 nt, Homo sapiens
uucugcuaaauaucaccuagc

SEQ ID NO: 1567278 - RNA, 17 nt, Homo sapiens
uucuggaagucaucuca

SEQ ID NO: 1567279 - RNA, 22 nt, Homo sapiens
uucuggaaucuuugagaccaag

SEQ ID NO: 1567280 - RNA, 16 nt, Homo sapiens
uucuggacagacagau

SEQ ID NO: 1567281 - RNA, 20 nt, Homo sapiens
uucuggauuucauacuguaa

SEQ ID NO: 1567282 - RNA, 17 nt, Homo sapiens
uucugggcuucaucugg

SEQ ID NO: 1567283 - RNA, 14 nt, Homo sapiens
uucuggugccauuu

SEQ ID NO: 1567284 - RNA, 11 nt, Homo sapiens
uucuggugcua

SEQ ID NO: 1567285 - RNA, 20 nt, Homo sapiens
uucuguaauauuuacaaugu

SEQ ID NO: 1567286 - RNA, 13 nt, Homo sapiens
uucuguaccaguu

SEQ ID NO: 1567287 - RNA, 18 nt, Homo sapiens
uucuguccccucuuccua

SEQ ID NO: 1567288 - RNA, 21 nt, Homo sapiens
uucuguccuguaacuguuaca

SEQ ID NO: 1567289 - RNA, 20 nt, Homo sapiens
uucuguguugaagcacuguu

SEQ ID NO: 1567290 - RNA, 17 nt, Homo sapiens
uucuguuuuguuaauau

SEQ ID NO: 1567291 - RNA, 21 nt, Homo sapiens
uucuuaaaagaaaucuugcuu

SEQ ID NO: 1567292 - RNA, 23 nt, Homo sapiens
uucuuaaugaaccuuagaaagac

SEQ ID NO: 1567293 - RNA, 13 nt, Homo sapiens
uucuuagcuguca

SEQ ID NO: 1567294 - RNA, 17 nt, Homo sapiens
uucuuagucacaaaaua

SEQ ID NO: 1567295 - RNA, 17 nt, Homo sapiens
uucuuauuaaucauaca

SEQ ID NO: 1567296 - RNA, 20 nt, Homo sapiens
uucuucuaagaagacauuuu

SEQ ID NO: 1567297 - RNA, 12 nt, Homo sapiens
uucuucuauggg

SEQ ID NO: 1567298 - RNA, 23 nt, Homo sapiens
uugccucccgggcucaagcgauu

SEQ ID NO: 1567299 - RNA, 13 nt, Homo sapiens
uugccugcaaaaa

SEQ ID NO: 1567300 - RNA, 13 nt, Homo sapiens
uugccuucauccc

SEQ ID NO: 1567301 - RNA, 20 nt, Homo sapiens
uugccuuuugcaaccaggaa

SEQ ID NO: 1567302 - RNA, 14 nt, Homo sapiens
uugcguucaaagag

SEQ ID NO: 1567303 - RNA, 13 nt, Homo sapiens
uugcuaccaguau

SEQ ID NO: 1567304 - RNA, 23 nt, Homo sapiens
uugcuaccucagugcuccuggaa

SEQ ID NO: 1567305 - RNA, 12 nt, Homo sapiens
uugcuauauucc

SEQ ID NO: 1567306 - RNA, 13 nt, Homo sapiens
uugcucuccuaga

SEQ ID NO: 1567307 - RNA, 19 nt, Homo sapiens
uugcucucgacaguaucca

SEQ ID NO: 1567308 - RNA, 13 nt, Homo sapiens
uugcugcaucucc

SEQ ID NO: 1567309 - RNA, 23 nt, Homo sapiens
uugcuggggcucgugcccugcau

SEQ ID NO: 1567310 - RNA, 14 nt, Homo sapiens
uugcuuauugcuua

SEQ ID NO: 1567311 - RNA, 14 nt, Homo sapiens
uugcuucaauuuca

SEQ ID NO: 1567312 - RNA, 14 nt, Homo sapiens
uugcuugagcccag

SEQ ID NO: 1567313 - RNA, 13 nt, Homo sapiens
uugcuugcaaugu

SEQ ID NO: 1567314 - RNA, 21 nt, Homo sapiens
uugcuuuugaaggaauacaau

SEQ ID NO: 1567315 - RNA, 20 nt, Homo sapiens
uugcuuuugacuccaggaac

SEQ ID NO: 1567316 - RNA, 20 nt, Homo sapiens
uuggacagaaaaugcaauga

SEQ ID NO: 1567317 - RNA, 19 nt, Homo sapiens
uuggacagucugagcugua

SEQ ID NO: 1567318 - RNA, 22 nt, Homo sapiens
uuggagaaccagggcucuucuc

SEQ ID NO: 1567319 - RNA, 14 nt, Homo sapiens
uuggaggaaugaca

SEQ ID NO: 1567320 - RNA, 18 nt, Homo sapiens
uuggaugauugugugacu

SEQ ID NO: 1567321 - RNA, 18 nt, Homo sapiens
uuggaugguguuacauau

SEQ ID NO: 1567322 - RNA, 13 nt, Homo sapiens
uuggaugucugua

SEQ ID NO: 1567323 - RNA, 14 nt, Homo sapiens
uuggaugucuguag

SEQ ID NO: 1567324 - RNA, 12 nt, Homo sapiens
uuggcaaugcau

SEQ ID NO: 1567325 - RNA, 15 nt, Homo sapiens
uuggcacuaugguuu

SEQ ID NO: 1567326 - RNA, 17 nt, Homo sapiens
uuggcaguggacucaga

SEQ ID NO: 1567327 - RNA, 22 nt, Homo sapiens
uuggcauagaaaaaaguagcaa

SEQ ID NO: 1567328 - RNA, 13 nt, Homo sapiens
uuggcaugccauu

SEQ ID NO: 1567329 - RNA, 15 nt, Homo sapiens
uuggccacacacuga

SEQ ID NO: 1567330 - RNA, 19 nt, Homo sapiens
uuggccaccaggugccuuu

SEQ ID NO: 1567331 - RNA, 14 nt, Homo sapiens
uuggccucccaaag

SEQ ID NO: 1567332 - RNA, 17 nt, Homo sapiens
uuggcucacacugagaa

SEQ ID NO: 1567333 - RNA, 18 nt, Homo sapiens
uuggcuuguuuggagcau

SEQ ID NO: 1567334 - RNA, 15 nt, Homo sapiens
uugggaauucuugcu

SEQ ID NO: 1567335 - RNA, 16 nt, Homo sapiens
uugggauggcuuguag

SEQ ID NO: 1567336 - RNA, 13 nt, Homo sapiens
uugggauuuuucu

SEQ ID NO: 1567337 - RNA, 13 nt, Homo sapiens
uugggcacagucc

SEQ ID NO: 1567338 - RNA, 22 nt, Homo sapiens
uugggcacugcacccuguuuaa

SEQ ID NO: 1567339 - RNA, 14 nt, Homo sapiens
uuggguggggcucc

SEQ ID NO: 1567340 - RNA, 15 nt, Homo sapiens
uuggguguagauuuc

SEQ ID NO: 1567341 - RNA, 20 nt, Homo sapiens
uugguauacuuuugcuucag

SEQ ID NO: 1567342 - RNA, 15 nt, Homo sapiens
uugguccuccugucc

SEQ ID NO: 1567343 - RNA, 23 nt, Homo sapiens
uuggugaaucgguuguucuuucc

SEQ ID NO: 1567344 - RNA, 11 nt, Homo sapiens
uuggugccuuu

SEQ ID NO: 1567345 - RNA, 13 nt, Homo sapiens
uuggugcuagaaa

SEQ ID NO: 1567346 - RNA, 17 nt, Homo sapiens
uugguggcaaaauugcc

SEQ ID NO: 1567347 - RNA, 18 nt, Homo sapiens
uugguguuugacuguaau

SEQ ID NO: 1567348 - RNA, 16 nt, Homo sapiens
uugguuuugacuucag

SEQ ID NO: 1567349 - RNA, 20 nt, Homo sapiens
uugguuuuuuuuugagacag

SEQ ID NO: 1567350 - RNA, 18 nt, Homo sapiens
uuguaaaauaauucugag

SEQ ID NO: 1567351 - RNA, 18 nt, Homo sapiens
uuguaaaauggugugacc

SEQ ID NO: 1567352 - RNA, 15 nt, Homo sapiens
uuguaaaggauauca

SEQ ID NO: 1567353 - RNA, 15 nt, Homo sapiens
uuguaaauaugcaaa

SEQ ID NO: 1567354 - RNA, 23 nt, Homo sapiens
uuguaaauuauauuugugcuaua

SEQ ID NO: 1567355 - RNA, 21 nt, Homo sapiens
uuguaacgacuucuccaucuc

SEQ ID NO: 1567356 - RNA, 17 nt, Homo sapiens
uuguaacuaggcucaga

SEQ ID NO: 1567357 - RNA, 22 nt, Homo sapiens
uuguaauacuuucuaugugaca

SEQ ID NO: 1567358 - RNA, 19 nt, Homo sapiens
uuguaauauuuuccauaaa

SEQ ID NO: 1567359 - RNA, 16 nt, Homo sapiens
uuguaaugucaccacc

SEQ ID NO: 1567360 - RNA, 14 nt, Homo sapiens
uuguacaaguauua

SEQ ID NO: 1567361 - RNA, 16 nt, Homo sapiens
uuguaccgcaauguga

SEQ ID NO: 1567362 - RNA, 17 nt, Homo sapiens
uuguaccugacuuccac

SEQ ID NO: 1567363 - RNA, 19 nt, Homo sapiens
uuguaggacaacuuugaau

SEQ ID NO: 1567364 - RNA, 20 nt, Homo sapiens
uuguauaggggcaacuguau

SEQ ID NO: 1567365 - RNA, 17 nt, Homo sapiens
uuguauauauguguaua

SEQ ID NO: 1567366 - RNA, 18 nt, Homo sapiens
uuguauccacacaaauuc

SEQ ID NO: 1567367 - RNA, 17 nt, Homo sapiens
uuguauuaucaacagca

SEQ ID NO: 1567368 - RNA, 19 nt, Homo sapiens
uuguauuuuauuguuucuu

SEQ ID NO: 1567369 - RNA, 16 nt, Homo sapiens
uuccacaaacacauua

SEQ ID NO: 1567370 - RNA, 22 nt, Homo sapiens
uuccacauaggaaaaugccaug

SEQ ID NO: 1567371 - RNA, 19 nt, Homo sapiens
uuccaccaggccgugccuu

SEQ ID NO: 1567372 - RNA, 19 nt, Homo sapiens
uuccaccuggaaacugcuc

SEQ ID NO: 1567373 - RNA, 13 nt, Homo sapiens
uuccacucaaaau

SEQ ID NO: 1567374 - RNA, 10 nt, Homo sapiens
uuccacugag

SEQ ID NO: 1567375 - RNA, 15 nt, Homo sapiens
uuccacugucucauc

SEQ ID NO: 1567376 - RNA, 14 nt, Homo sapiens
uuccagaaaccaaa

SEQ ID NO: 1567377 - RNA, 14 nt, Homo sapiens
uuccaggcugguuc

SEQ ID NO: 1567378 - RNA, 14 nt, Homo sapiens
uuccagguguuacu

SEQ ID NO: 1567379 - RNA, 16 nt, Homo sapiens
uuccaguccuaacuuu

SEQ ID NO: 1567380 - RNA, 21 nt, Homo sapiens
uuccauaagcuuggugacaaa

SEQ ID NO: 1567381 - RNA, 22 nt, Homo sapiens
uuccauaagcuuggugacaaaa

SEQ ID NO: 1567382 - RNA, 16 nt, Homo sapiens
uuccaugaguuaucau

SEQ ID NO: 1567383 - RNA, 13 nt, Homo sapiens
uuccaugugccuu

SEQ ID NO: 1567384 - RNA, 16 nt, Homo sapiens
uuccauugccuagcuc

SEQ ID NO: 1567385 - RNA, 21 nt, Homo sapiens
uuccauuuauucuuugaucuu

SEQ ID NO: 1567386 - RNA, 17 nt, Homo sapiens
uucccacaggacauuuc

SEQ ID NO: 1567387 - RNA, 13 nt, Homo sapiens
uucccacgaggaa

SEQ ID NO: 1567388 - RNA, 21 nt, Homo sapiens
uucccacgucuaacuggaaac

SEQ ID NO: 1567389 - RNA, 17 nt, Homo sapiens
uucccacugcacuccag

SEQ ID NO: 1567390 - RNA, 14 nt, Homo sapiens
uucccagcucuccc

SEQ ID NO: 1567391 - RNA, 15 nt, Homo sapiens
uucccagggaccuug

SEQ ID NO: 1567392 - RNA, 20 nt, Homo sapiens
uucccauacccagucuagga

SEQ ID NO: 1567393 - RNA, 19 nt, Homo sapiens
uuccccaauuacaggguga

SEQ ID NO: 1567394 - RNA, 15 nt, Homo sapiens
uuccccagacccaga

SEQ ID NO: 1567395 - RNA, 14 nt, Homo sapiens
uucccccacaguuu

SEQ ID NO: 1567396 - RNA, 13 nt, Homo sapiens
uuccccugcugac

SEQ ID NO: 1567397 - RNA, 19 nt, Homo sapiens
uuccccugucugucccagg

SEQ ID NO: 1567398 - RNA, 20 nt, Homo sapiens
uuccccuuagaaacacugca

SEQ ID NO: 1567399 - RNA, 23 nt, Homo sapiens
uucccuaaagaagauaaacacaa

SEQ ID NO: 1567400 - RNA, 12 nt, Homo sapiens
uucccuagcuuu

SEQ ID NO: 1567401 - RNA, 20 nt, Homo sapiens
uucccuaucuucucccccac

SEQ ID NO: 1567402 - RNA, 20 nt, Homo sapiens
uucccuauggguucugugac

SEQ ID NO: 1567403 - RNA, 20 nt, Homo sapiens
uucccugggcugccaccagc

SEQ ID NO: 1567404 - RNA, 20 nt, Homo sapiens
uucccuggggaaaacuugca

SEQ ID NO: 1567405 - RNA, 14 nt, Homo sapiens
uucccuguucuccc

SEQ ID NO: 1567406 - RNA, 23 nt, Homo sapiens
uucccuucuuucaggaauacuug

SEQ ID NO: 1567407 - RNA, 20 nt, Homo sapiens
uuccgacaggagcacugcau

SEQ ID NO: 1567408 - RNA, 13 nt, Homo sapiens
uuccgagugcaga

SEQ ID NO: 1567409 - RNA, 14 nt, Homo sapiens
uuccgagugcagaa

SEQ ID NO: 1567410 - RNA, 23 nt, Homo sapiens
uuccggggcauuugggcacugua

SEQ ID NO: 1567411 - RNA, 16 nt, Homo sapiens
uuccgguguuguacua

SEQ ID NO: 1567412 - RNA, 21 nt, Homo sapiens
uuccgucaccacgacuggcca

SEQ ID NO: 1567413 - RNA, 21 nt, Homo sapiens
uuccuaaaagagaauggaaaa

SEQ ID NO: 1567414 - RNA, 20 nt, Homo sapiens
uuccuacagcacuacugggu

SEQ ID NO: 1567415 - RNA, 15 nt, Homo sapiens
uuccuaccauacaau

SEQ ID NO: 1567416 - RNA, 22 nt, Homo sapiens
uuccuagcaccgcuuauccccu

SEQ ID NO: 1567417 - RNA, 20 nt, Homo sapiens
uuccuaguagaacucacaga

SEQ ID NO: 1567418 - RNA, 12 nt, Homo sapiens
uuccuaugcaaa

SEQ ID NO: 1567419 - RNA, 18 nt, Homo sapiens
uuccuaugcugcaauaca

SEQ ID NO: 1567420 - RNA, 21 nt, Homo sapiens
uuccucaaauacaugcacagu

SEQ ID NO: 1567421 - RNA, 15 nt, Homo sapiens
uuccucaacaagcaa

SEQ ID NO: 1567422 - RNA, 13 nt, Homo sapiens
cuuuagcaugcua

SEQ ID NO: 1567423 - RNA, 16 nt, Homo sapiens
cuuuagccauacacau

SEQ ID NO: 1567424 - RNA, 16 nt, Homo sapiens
cuuuagguauuacaca

SEQ ID NO: 1567425 - RNA, 18 nt, Homo sapiens
cuuuagugcuuugugaua

SEQ ID NO: 1567426 - RNA, 22 nt, Homo sapiens
cuuuaguggugguauguaaugg

SEQ ID NO: 1567427 - RNA, 14 nt, Homo sapiens
cuuuaucauugcua

SEQ ID NO: 1567428 - RNA, 14 nt, Homo sapiens
cuuuaugugcaaaa

SEQ ID NO: 1567429 - RNA, 18 nt, Homo sapiens
cuuuauguggaacaucua

SEQ ID NO: 1567430 - RNA, 14 nt, Homo sapiens
cuuuauuauuccua

SEQ ID NO: 1567431 - RNA, 17 nt, Homo sapiens
cuuuauuggcugagaua

SEQ ID NO: 1567432 - RNA, 16 nt, Homo sapiens
cuuuauuuccacugug

SEQ ID NO: 1567433 - RNA, 16 nt, Homo sapiens
cuuuauuucugaucua

SEQ ID NO: 1567434 - RNA, 16 nt, Homo sapiens
cuuucaaccuauacaa

SEQ ID NO: 1567435 - RNA, 15 nt, Homo sapiens
cuuucaacuugcaau

SEQ ID NO: 1567436 - RNA, 15 nt, Homo sapiens
cuuucacacuggauc

SEQ ID NO: 1567437 - RNA, 15 nt, Homo sapiens
cuuucacccucauga

SEQ ID NO: 1567438 - RNA, 15 nt, Homo sapiens
cuuucagagccagcc

SEQ ID NO: 1567439 - RNA, 12 nt, Homo sapiens
cuuucagauuau

SEQ ID NO: 1567440 - RNA, 19 nt, Homo sapiens
cuuucaguaaaaauaaaua

SEQ ID NO: 1567441 - RNA, 18 nt, Homo sapiens
cuuucauccucaagcuca

SEQ ID NO: 1567442 - RNA, 19 nt, Homo sapiens
cuuucaucuuaaacuaaua

SEQ ID NO: 1567443 - RNA, 21 nt, Homo sapiens
cuuucauuccuucagauuugg

SEQ ID NO: 1567444 - RNA, 18 nt, Homo sapiens
cuuucauugccagugucu

SEQ ID NO: 1567445 - RNA, 20 nt, Homo sapiens
cuuuccaaaaccuaaagagg

SEQ ID NO: 1567446 - RNA, 14 nt, Homo sapiens
cuuuccaaccggcu

SEQ ID NO: 1567447 - RNA, 18 nt, Homo sapiens
cuuuccaaugccacagac

SEQ ID NO: 1567448 - RNA, 21 nt, Homo sapiens
cuuuccagccuauagcagaag

SEQ ID NO: 1567449 - RNA, 18 nt, Homo sapiens
cuuucccaaccccaggaa

SEQ ID NO: 1567450 - RNA, 14 nt, Homo sapiens
cuuucccucaucca

SEQ ID NO: 1567451 - RNA, 21 nt, Homo sapiens
cuuucccuuuagcacguuuaa

SEQ ID NO: 1567452 - RNA, 20 nt, Homo sapiens
cuuuccuagcuccacucuaa

SEQ ID NO: 1567453 - RNA, 16 nt, Homo sapiens
cuuuccucuaauccag

SEQ ID NO: 1567454 - RNA, 16 nt, Homo sapiens
cuuuccugcagcaguc

SEQ ID NO: 1567455 - RNA, 21 nt, Homo sapiens
cuuuccuucaucucccacgaa

SEQ ID NO: 1567456 - RNA, 19 nt, Homo sapiens
cuuucguaauagcucagau

SEQ ID NO: 1567457 - RNA, 16 nt, Homo sapiens
cuuucucuaauguugu

SEQ ID NO: 1567458 - RNA, 15 nt, Homo sapiens
cuuucucucuuucca

SEQ ID NO: 1567459 - RNA, 14 nt, Homo sapiens
cuuucucugugaaa

SEQ ID NO: 1567460 - RNA, 14 nt, Homo sapiens
cuuucugaauuauu

SEQ ID NO: 1567461 - RNA, 21 nt, Homo sapiens
cuuucuguguugaagcacugu

SEQ ID NO: 1567462 - RNA, 20 nt, Homo sapiens
cuuucuguugaaaagcacac

SEQ ID NO: 1567463 - RNA, 21 nt, Homo sapiens
cuuucuguugaaaagcacaca

SEQ ID NO: 1567464 - RNA, 23 nt, Homo sapiens
cuuucuucaccaagugcaauaga

SEQ ID NO: 1567465 - RNA, 20 nt, Homo sapiens
cuuucuugaaagacagucca

SEQ ID NO: 1567466 - RNA, 17 nt, Homo sapiens
cuuucuuggagugccaa

SEQ ID NO: 1567467 - RNA, 14 nt, Homo sapiens
cuuucuuuggugcc

SEQ ID NO: 1567468 - RNA, 21 nt, Homo sapiens
cuuugaaaagagaauauuuac

SEQ ID NO: 1567469 - RNA, 13 nt, Homo sapiens
cuuugaccagcac

SEQ ID NO: 1567470 - RNA, 23 nt, Homo sapiens
cuuugagaaggauaggccuucau

SEQ ID NO: 1567471 - RNA, 21 nt, Homo sapiens
cuuugagcugcugacugccaa

SEQ ID NO: 1567472 - RNA, 19 nt, Homo sapiens
cuuugcauguaagcucuuu

SEQ ID NO: 1567473 - RNA, 19 nt, Homo sapiens
cuuugccgugagcaugcac

SEQ ID NO: 1567474 - RNA, 14 nt, Homo sapiens
cuuugccugucaag

SEQ ID NO: 1567475 - RNA, 18 nt, Homo sapiens
cuuugcuaaagacaugaa

SEQ ID NO: 1567476 - RNA, 12 nt, Homo sapiens
cuuugcuacuuu

SEQ ID NO: 1567477 - RNA, 18 nt, Homo sapiens
cuuugcuaguaccaaaag

SEQ ID NO: 1567478 - RNA, 14 nt, Homo sapiens
cuuugcucccugca

SEQ ID NO: 1567479 - RNA, 15 nt, Homo sapiens
cuuugcucccugcaa

SEQ ID NO: 1567480 - RNA, 19 nt, Homo sapiens
cuuuggaaucuaaccacuu

SEQ ID NO: 1567481 - RNA, 21 nt, Homo sapiens
cuuuggaauguugaauugcau

SEQ ID NO: 1567482 - RNA, 20 nt, Homo sapiens
cuuuggcacucucugccauu

SEQ ID NO: 1567483 - RNA, 15 nt, Homo sapiens
cuuuggcgaccuccu

SEQ ID NO: 1567484 - RNA, 12 nt, Homo sapiens
cuuugguuaaua

SEQ ID NO: 1567485 - RNA, 19 nt, Homo sapiens
cuuugguucucugauuugu

SEQ ID NO: 1567486 - RNA, 15 nt, Homo sapiens
cuuuguaauaccaga

SEQ ID NO: 1567487 - RNA, 17 nt, Homo sapiens
cuuuguaauauuuucca

SEQ ID NO: 1567488 - RNA, 14 nt, Homo sapiens
cuuuguacugcuuu

SEQ ID NO: 1567489 - RNA, 18 nt, Homo sapiens
cuuuguauuguauauuac

SEQ ID NO: 1567490 - RNA, 15 nt, Homo sapiens
cuuugucucugagaa

SEQ ID NO: 1567491 - RNA, 13 nt, Homo sapiens
cuuugugcugcgc

SEQ ID NO: 1567492 - RNA, 16 nt, Homo sapiens
cuuuguggcacugggg

SEQ ID NO: 1567493 - RNA, 14 nt, Homo sapiens
cuuuguuuacauga

SEQ ID NO: 1567494 - RNA, 18 nt, Homo sapiens
cuuuuaaaaaaaaauacu

SEQ ID NO: 1567495 - RNA, 17 nt, Homo sapiens
cuuuuaagugccuugga

SEQ ID NO: 1567496 - RNA, 22 nt, Homo sapiens
cuuuuagggaauaauauucaau

SEQ ID NO: 1567497 - RNA, 15 nt, Homo sapiens
cuuuuauacaauaau

SEQ ID NO: 1567498 - RNA, 14 nt, Homo sapiens
cuuuuauagaggcu

SEQ ID NO: 1567499 - RNA, 21 nt, Homo sapiens
cuuuuauaguggaaaaacaca

SEQ ID NO: 1567500 - RNA, 19 nt, Homo sapiens
cuuuuauuaaugcacuuuc

SEQ ID NO: 1567501 - RNA, 15 nt, Homo sapiens
cuuuuauuacugggg

SEQ ID NO: 1567502 - RNA, 14 nt, Homo sapiens
cuuuucaaugugug

SEQ ID NO: 1567503 - RNA, 16 nt, Homo sapiens
cuuuuccacuccauug

SEQ ID NO: 1567504 - RNA, 17 nt, Homo sapiens
cuuuucccauugccaug

SEQ ID NO: 1567505 - RNA, 14 nt, Homo sapiens
cuuuucccauuuca

SEQ ID NO: 1567506 - RNA, 17 nt, Homo sapiens
cuuuuccccagucccag

SEQ ID NO: 1567507 - RNA, 20 nt, Homo sapiens
cuuuuccuggcagcugcugu

SEQ ID NO: 1567508 - RNA, 22 nt, Homo sapiens
cuuuucggccccauguaucuca

SEQ ID NO: 1567509 - RNA, 14 nt, Homo sapiens
cuuuucguuuagaa

SEQ ID NO: 1567510 - RNA, 23 nt, Homo sapiens
cuuuucguuuagaaucagaauaa

SEQ ID NO: 1567511 - RNA, 18 nt, Homo sapiens
cuuuucuaaaaucuaaaa

SEQ ID NO: 1567512 - RNA, 22 nt, Homo sapiens
cuuuucucugagacauuccacc

SEQ ID NO: 1567513 - RNA, 17 nt, Homo sapiens
cuuuucucuuuaaucuc

SEQ ID NO: 1567514 - RNA, 14 nt, Homo sapiens
cuuuucugccaaaa

SEQ ID NO: 1567515 - RNA, 18 nt, Homo sapiens
cuuuugaagagcaaaggg

SEQ ID NO: 1567516 - RNA, 21 nt, Homo sapiens
cuuuugauagagguaacuuaa

SEQ ID NO: 1567517 - RNA, 23 nt, Homo sapiens
cuuuugaugaaauaaaauaucaa

SEQ ID NO: 1567518 - RNA, 21 nt, Homo sapiens
cuuuugcaggaaaaggcuaag

SEQ ID NO: 1567519 - RNA, 19 nt, Homo sapiens
cuuuugcucuucauaauaa

SEQ ID NO: 1567520 - RNA, 18 nt, Homo sapiens
cuuuugcuugauccagaa

SEQ ID NO: 1567521 - RNA, 22 nt, Homo sapiens
cuuuugggauguuaccuucaca

SEQ ID NO: 1567522 - RNA, 12 nt, Homo sapiens
cuuuuguacuga

SEQ ID NO: 1567523 - RNA, 17 nt, Homo sapiens
cuuuuguuuaccagaga

SEQ ID NO: 1567524 - RNA, 16 nt, Homo sapiens
cuuuuuacaauuaaaa

SEQ ID NO: 1567525 - RNA, 21 nt, Homo sapiens
cuuuuuauuaggcucagugac

SEQ ID NO: 1567526 - RNA, 16 nt, Homo sapiens
cuuuuuauugccuucu

SEQ ID NO: 1567527 - RNA, 12 nt, Homo sapiens
cuuuuucauaua

SEQ ID NO: 1567528 - RNA, 13 nt, Homo sapiens
cuuuuuccuguga

SEQ ID NO: 1567529 - RNA, 15 nt, Homo sapiens
cuuuuugacacugaa

SEQ ID NO: 1567530 - RNA, 19 nt, Homo sapiens
cuuuuuuccugggccagaa

SEQ ID NO: 1567531 - RNA, 12 nt, Homo sapiens
cuuuuuucugcc

SEQ ID NO: 1567532 - RNA, 15 nt, Homo sapiens
cuuuuuuuccaauuu

SEQ ID NO: 1567533 - RNA, 21 nt, Homo sapiens
gaaaaaaaaaagaaaugcaaa

SEQ ID NO: 1567534 - RNA, 19 nt, Homo sapiens
gaaaaaaaauuuguuuuca

SEQ ID NO: 1567535 - RNA, 12 nt, Homo sapiens
gaaaaaaacugg

SEQ ID NO: 1567536 - RNA, 21 nt, Homo sapiens
gaaaaaaauacaaaaagcaaa

SEQ ID NO: 1567537 - RNA, 16 nt, Homo sapiens
gaaaaaaauugcucug

SEQ ID NO: 1567538 - RNA, 15 nt, Homo sapiens
gaaaaacaaacaaaa

SEQ ID NO: 1567539 - RNA, 12 nt, Homo sapiens
gaaaaagaacau

SEQ ID NO: 1567540 - RNA, 19 nt, Homo sapiens
gaaaaaguuaaacauugaa

SEQ ID NO: 1567541 - RNA, 17 nt, Homo sapiens
gaaaaauauagccuuua

SEQ ID NO: 1567542 - RNA, 18 nt, Homo sapiens
gaaaaauauuuauucauu

SEQ ID NO: 1567543 - RNA, 14 nt, Homo sapiens
gaaaaaugccauca

SEQ ID NO: 1567544 - RNA, 12 nt, Homo sapiens
gaaaaauuauua

SEQ ID NO: 1567545 - RNA, 15 nt, Homo sapiens
gaaaaauugccuuca

SEQ ID NO: 1567546 - RNA, 14 nt, Homo sapiens
gaaaacaaauaaaa

SEQ ID NO: 1567547 - RNA, 15 nt, Homo sapiens
gaaaacagaaaccau

SEQ ID NO: 1567548 - RNA, 22 nt, Homo sapiens
gaaaaccauucuaaaacacaac

SEQ ID NO: 1567549 - RNA, 17 nt, Homo sapiens
gaaaaccucuccugacc

SEQ ID NO: 1567550 - RNA, 23 nt, Homo sapiens
gaaaagaaagaaguuauuuucca

SEQ ID NO: 1567551 - RNA, 17 nt, Homo sapiens
gaaaagagaaugaugcu

SEQ ID NO: 1567552 - RNA, 16 nt, Homo sapiens
gaaaaggguguugcua

SEQ ID NO: 1567553 - RNA, 23 nt, Homo sapiens
gaaaaguccacaagaacaauuca

SEQ ID NO: 1567554 - RNA, 11 nt, Homo sapiens
gaaaaguuauu

SEQ ID NO: 1567555 - RNA, 20 nt, Homo sapiens
gaaaaguuuccccauuauuu

SEQ ID NO: 1567556 - RNA, 18 nt, Homo sapiens
gaaaauacacuuauuuca

SEQ ID NO: 1567557 - RNA, 18 nt, Homo sapiens
gaaaauauacuugacucu

SEQ ID NO: 1567558 - RNA, 19 nt, Homo sapiens
gaaaauauacuugacucua

SEQ ID NO: 1567559 - RNA, 18 nt, Homo sapiens
gaaaaucacuugccaaaa

SEQ ID NO: 1567560 - RNA, 20 nt, Homo sapiens
gaaaaucuacacuccaguga

SEQ ID NO: 1567561 - RNA, 14 nt, Homo sapiens
gaaaaugccaugaa

SEQ ID NO: 1567562 - RNA, 16 nt, Homo sapiens
gaaaauggaguuauca

SEQ ID NO: 1567563 - RNA, 20 nt, Homo sapiens
gaaaauguuacggcaucaca

SEQ ID NO: 1567564 - RNA, 14 nt, Homo sapiens
gaaaauuauuugca

SEQ ID NO: 1567565 - RNA, 16 nt, Homo sapiens
gaaaauugaaugcaaa

SEQ ID NO: 1567566 - RNA, 14 nt, Homo sapiens
gaaacaacauuuau

SEQ ID NO: 1567567 - RNA, 13 nt, Homo sapiens
gaaacaacucuuu

SEQ ID NO: 1567568 - RNA, 18 nt, Homo sapiens
gaaacacccacucacuuu

SEQ ID NO: 1567569 - RNA, 18 nt, Homo sapiens
gaaaccacacagacuugg

SEQ ID NO: 1567570 - RNA, 13 nt, Homo sapiens
gcacggacucucc

SEQ ID NO: 1567571 - RNA, 22 nt, Homo sapiens
gcacggugggccuugcugggga

SEQ ID NO: 1567572 - RNA, 15 nt, Homo sapiens
gcacguugugcacau

SEQ ID NO: 1567573 - RNA, 16 nt, Homo sapiens
gcacuagaauauuuaa

SEQ ID NO: 1567574 - RNA, 18 nt, Homo sapiens
gcacuagagaaugcacag

SEQ ID NO: 1567575 - RNA, 21 nt, Homo sapiens
gcacuccagccugagugacag

SEQ ID NO: 1567576 - RNA, 14 nt, Homo sapiens
gcacuccuggugca

SEQ ID NO: 1567577 - RNA, 13 nt, Homo sapiens
gcacucuauguuc

SEQ ID NO: 1567578 - RNA, 18 nt, Homo sapiens
gcacucugggucuggcca

SEQ ID NO: 1567579 - RNA, 16 nt, Homo sapiens
gcacugaagagcucuu

SEQ ID NO: 1567580 - RNA, 14 nt, Homo sapiens
gcacugagcagaag

SEQ ID NO: 1567581 - RNA, 19 nt, Homo sapiens
gcacugaggaagaacgggg

SEQ ID NO: 1567582 - RNA, 13 nt, Homo sapiens
gcacugugucauc

SEQ ID NO: 1567583 - RNA, 9 nt, Homo sapiens
gcacuguuu

SEQ ID NO: 1567584 - RNA, 17 nt, Homo sapiens
gcacuucaaccuagucc

SEQ ID NO: 1567585 - RNA, 14 nt, Homo sapiens
gcacuuucuucucu

SEQ ID NO: 1567586 - RNA, 20 nt, Homo sapiens
gcacuuugagaggcugaggu

SEQ ID NO: 1567587 - RNA, 17 nt, Homo sapiens
gcagaaaggguuccaaa

SEQ ID NO: 1567588 - RNA, 20 nt, Homo sapiens
gcagaaauuuaaacucugaa

SEQ ID NO: 1567589 - RNA, 21 nt, Homo sapiens
gcagaagaauugaacccagga

SEQ ID NO: 1567590 - RNA, 22 nt, Homo sapiens
gcagaagagaaaggacucagug

SEQ ID NO: 1567591 - RNA, 16 nt, Homo sapiens
gcagaagcccugaugu

SEQ ID NO: 1567592 - RNA, 18 nt, Homo sapiens
gcagaauucaaaagugau

SEQ ID NO: 1567593 - RNA, 17 nt, Homo sapiens
gcagacaacaccuuccu

SEQ ID NO: 1567594 - RNA, 22 nt, Homo sapiens
gcagacaauaaacccucagagc

SEQ ID NO: 1567595 - RNA, 16 nt, Homo sapiens
gcagacaaugacccca

SEQ ID NO: 1567596 - RNA, 19 nt, Homo sapiens
gcagacaccauucauucca

SEQ ID NO: 1567597 - RNA, 13 nt, Homo sapiens
gcagaccacugau

SEQ ID NO: 1567598 - RNA, 18 nt, Homo sapiens
gcagaccccucuaccucc

SEQ ID NO: 1567599 - RNA, 16 nt, Homo sapiens
gcagacucgggaccaa

SEQ ID NO: 1567600 - RNA, 14 nt, Homo sapiens
gcagagaaccaaag

SEQ ID NO: 1567601 - RNA, 21 nt, Homo sapiens
gcagagaagcuguaggacugu

SEQ ID NO: 1567602 - RNA, 14 nt, Homo sapiens
gcagagccagugug

SEQ ID NO: 1567603 - RNA, 13 nt, Homo sapiens
gcagagcuuccac

SEQ ID NO: 1567604 - RNA, 19 nt, Homo sapiens
gcagagcuuccacaagaca

SEQ ID NO: 1567605 - RNA, 15 nt, Homo sapiens
gcagaggaagcccag

SEQ ID NO: 1567606 - RNA, 12 nt, Homo sapiens
gcagauacuuga

SEQ ID NO: 1567607 - RNA, 19 nt, Homo sapiens
gcagauccuuugucuacag

SEQ ID NO: 1567608 - RNA, 21 nt, Homo sapiens
gcagaucucaucucaugacag

SEQ ID NO: 1567609 - RNA, 13 nt, Homo sapiens
gcagcaaaaccuu

SEQ ID NO: 1567610 - RNA, 23 nt, Homo sapiens
gcagcaaacaaauaaaaugaaau

SEQ ID NO: 1567611 - RNA, 22 nt, Homo sapiens
gcagcaaguucauacaacaugc

SEQ ID NO: 1567612 - RNA, 13 nt, Homo sapiens
gcagcacugugag

SEQ ID NO: 1567613 - RNA, 14 nt, Homo sapiens
gcagcaggcagcuu

SEQ ID NO: 1567614 - RNA, 17 nt, Homo sapiens
gcagcagggggagcucc

SEQ ID NO: 1567615 - RNA, 17 nt, Homo sapiens
gcagcauuccaugacca

SEQ ID NO: 1567616 - RNA, 15 nt, Homo sapiens
gcagcauuugauaau

SEQ ID NO: 1567617 - RNA, 17 nt, Homo sapiens
gcagccaggagugcccc

SEQ ID NO: 1567618 - RNA, 18 nt, Homo sapiens
gcagcccaacagcacuuu

SEQ ID NO: 1567619 - RNA, 23 nt, Homo sapiens
gcagcccaugcccaccugcccau

SEQ ID NO: 1567620 - RNA, 16 nt, Homo sapiens
gcagccggagaucuga

SEQ ID NO: 1567621 - RNA, 23 nt, Homo sapiens
gcagccuaaugagagugcacugc

SEQ ID NO: 1567622 - RNA, 20 nt, Homo sapiens
gcagcuaaaggaagugaauc

SEQ ID NO: 1567623 - RNA, 21 nt, Homo sapiens
gcagcucuggcucugccucag

SEQ ID NO: 1567624 - RNA, 13 nt, Homo sapiens
gcagcugauccag

SEQ ID NO: 1567625 - RNA, 19 nt, Homo sapiens
gcagcuuacuuaguaggcu

SEQ ID NO: 1567626 - RNA, 14 nt, Homo sapiens
gcagcuuauucaca

SEQ ID NO: 1567627 - RNA, 18 nt, Homo sapiens
gcagcuuauucacaagac

SEQ ID NO: 1567628 - RNA, 17 nt, Homo sapiens
gcagcuugaaacugaga

SEQ ID NO: 1567629 - RNA, 12 nt, Homo sapiens
gcaggagaauca

SEQ ID NO: 1567630 - RNA, 18 nt, Homo sapiens
gcaggagagucacuugaa

SEQ ID NO: 1567631 - RNA, 16 nt, Homo sapiens
gcaggcccacucccca

SEQ ID NO: 1567632 - RNA, 15 nt, Homo sapiens
gcaggcuacugucag

SEQ ID NO: 1567633 - RNA, 15 nt, Homo sapiens
gcaggcuagaaccug

SEQ ID NO: 1567634 - RNA, 21 nt, Homo sapiens
gcaggcugggacggaccagca

SEQ ID NO: 1567635 - RNA, 18 nt, Homo sapiens
gcagggaguuagcacuga

SEQ ID NO: 1567636 - RNA, 20 nt, Homo sapiens
gcagggccuugcccagagau

SEQ ID NO: 1567637 - RNA, 18 nt, Homo sapiens
gcagggcuggucuugggg

SEQ ID NO: 1567638 - RNA, 15 nt, Homo sapiens
gcagguauggaaggg

SEQ ID NO: 1567639 - RNA, 22 nt, Homo sapiens
gcagguuuguuuucagcacuga

SEQ ID NO: 1567640 - RNA, 13 nt, Homo sapiens
gcagucauaucaa

SEQ ID NO: 1567641 - RNA, 17 nt, Homo sapiens
gcaguccauuuccuaau

SEQ ID NO: 1567642 - RNA, 23 nt, Homo sapiens
gcagucuccucuuuaaaacaaaa

SEQ ID NO: 1567643 - RNA, 23 nt, Homo sapiens
gcaguggcucaugcccauaaucc

SEQ ID NO: 1567644 - RNA, 14 nt, Homo sapiens
gcaguggugccauc

SEQ ID NO: 1567645 - RNA, 16 nt, Homo sapiens
gcagugugaauagccu

SEQ ID NO: 1567646 - RNA, 19 nt, Homo sapiens
gcaguucagcuccuuccac

SEQ ID NO: 1567647 - RNA, 23 nt, Homo sapiens
gcaguucagcuccuuccaccaca

SEQ ID NO: 1567648 - RNA, 20 nt, Homo sapiens
gcaguuucauguauguauau

SEQ ID NO: 1567649 - RNA, 18 nt, Homo sapiens
gcaguuucugcuauugug

SEQ ID NO: 1567650 - RNA, 18 nt, Homo sapiens
gcaguuugggaggcugag

SEQ ID NO: 1567651 - RNA, 21 nt, Homo sapiens
gcaguuuugcuaucugggcug

SEQ ID NO: 1567652 - RNA, 14 nt, Homo sapiens
gcauaaaaccuaaa

SEQ ID NO: 1567653 - RNA, 24 nt, Homo sapiens
gcauaaaauggaauaacauaucaa

SEQ ID NO: 1567654 - RNA, 14 nt, Homo sapiens
gcauaaccuuuaca

SEQ ID NO: 1567655 - RNA, 14 nt, Homo sapiens
gcauaauagucaau

SEQ ID NO: 1567656 - RNA, 16 nt, Homo sapiens
gcauaccaaguugaua

SEQ ID NO: 1567657 - RNA, 20 nt, Homo sapiens
gcauacgguaugauauugca

SEQ ID NO: 1567658 - RNA, 15 nt, Homo sapiens
gcauacugagaauau

SEQ ID NO: 1567659 - RNA, 16 nt, Homo sapiens
gcauacuuucccucau

SEQ ID NO: 1567660 - RNA, 20 nt, Homo sapiens
gcauacuuucccucauccau

SEQ ID NO: 1567661 - RNA, 14 nt, Homo sapiens
gaagaacucaccag

SEQ ID NO: 1567662 - RNA, 16 nt, Homo sapiens
gaagacaucaggaaac

SEQ ID NO: 1567663 - RNA, 11 nt, Homo sapiens
gaagacauuuu

SEQ ID NO: 1567664 - RNA, 19 nt, Homo sapiens
gaagacccacgugcuaggg

SEQ ID NO: 1567665 - RNA, 18 nt, Homo sapiens
gaagacuugaagcacaga

SEQ ID NO: 1567666 - RNA, 13 nt, Homo sapiens
gaagagaaaagac

SEQ ID NO: 1567667 - RNA, 16 nt, Homo sapiens
gaagagaaaggacuca

SEQ ID NO: 1567668 - RNA, 13 nt, Homo sapiens
gaagagaagacau

SEQ ID NO: 1567669 - RNA, 15 nt, Homo sapiens
gaagagcaagggaca

SEQ ID NO: 1567670 - RNA, 23 nt, Homo sapiens
gaagauacagagaugcaaugaua

SEQ ID NO: 1567671 - RNA, 22 nt, Homo sapiens
gaagauguccgugagaacauca

SEQ ID NO: 1567672 - RNA, 17 nt, Homo sapiens
gaagauuuaugaugcac

SEQ ID NO: 1567673 - RNA, 17 nt, Homo sapiens
gaagcaaagugcccaug

SEQ ID NO: 1567674 - RNA, 16 nt, Homo sapiens
gaagcaagcagaugaa

SEQ ID NO: 1567675 - RNA, 13 nt, Homo sapiens
gaagcaagccaga

SEQ ID NO: 1567676 - RNA, 16 nt, Homo sapiens
gaagcacagagggcua

SEQ ID NO: 1567677 - RNA, 14 nt, Homo sapiens
gaagcacauuuuca

SEQ ID NO: 1567678 - RNA, 15 nt, Homo sapiens
gaagcagcacuguga

SEQ ID NO: 1567679 - RNA, 17 nt, Homo sapiens
gaagcagucuugcucug

SEQ ID NO: 1567680 - RNA, 18 nt, Homo sapiens
gaagcaucauuuccccaa

SEQ ID NO: 1567681 - RNA, 21 nt, Homo sapiens
gaagccacagagucucucccu

SEQ ID NO: 1567682 - RNA, 17 nt, Homo sapiens
gaagccagcuuuccuca

SEQ ID NO: 1567683 - RNA, 20 nt, Homo sapiens
gaagccaggugagaaaacca

SEQ ID NO: 1567684 - RNA, 15 nt, Homo sapiens
gaagccagucagggc

SEQ ID NO: 1567685 - RNA, 18 nt, Homo sapiens
gaagcccaggagccucac

SEQ ID NO: 1567686 - RNA, 14 nt, Homo sapiens
gaagccccgucucu

SEQ ID NO: 1567687 - RNA, 16 nt, Homo sapiens
gaagccucuggcuaga

SEQ ID NO: 1567688 - RNA, 21 nt, Homo sapiens
gaagccuuuaucuaugggaga

SEQ ID NO: 1567689 - RNA, 17 nt, Homo sapiens
gaagcguuguccucagc

SEQ ID NO: 1567690 - RNA, 16 nt, Homo sapiens
gaagcucuucuuccca

SEQ ID NO: 1567691 - RNA, 16 nt, Homo sapiens
gaagcuggccugagag

SEQ ID NO: 1567692 - RNA, 10 nt, Homo sapiens
gaagcuuuag

SEQ ID NO: 1567693 - RNA, 16 nt, Homo sapiens
gaaggaaaaugugaac

SEQ ID NO: 1567694 - RNA, 15 nt, Homo sapiens
gaaggaauuauuccc

SEQ ID NO: 1567695 - RNA, 15 nt, Homo sapiens
gaaggacacagugau

SEQ ID NO: 1567696 - RNA, 21 nt, Homo sapiens
gaaggacuaugaaaagcuaga

SEQ ID NO: 1567697 - RNA, 14 nt, Homo sapiens
gaaggagagcaaga

SEQ ID NO: 1567698 - RNA, 14 nt, Homo sapiens
gaaggaggggaccu

SEQ ID NO: 1567699 - RNA, 15 nt, Homo sapiens
gaaggauuacucucc

SEQ ID NO: 1567700 - RNA, 21 nt, Homo sapiens
gaaggcaacgcaccaucccuc

SEQ ID NO: 1567701 - RNA, 21 nt, Homo sapiens
gaaggcaauuuuaguguauua

SEQ ID NO: 1567702 - RNA, 14 nt, Homo sapiens
gaaggcagagccau

SEQ ID NO: 1567703 - RNA, 16 nt, Homo sapiens
gaaggcauugcuuccu

SEQ ID NO: 1567704 - RNA, 15 nt, Homo sapiens
gaaggccccagagag

SEQ ID NO: 1567705 - RNA, 18 nt, Homo sapiens
gaaggcuaaaaagcaaca

SEQ ID NO: 1567706 - RNA, 22 nt, Homo sapiens
gaagggcugggccaccagggau

SEQ ID NO: 1567707 - RNA, 22 nt, Homo sapiens
gaaggguggggauaucagggca

SEQ ID NO: 1567708 - RNA, 20 nt, Homo sapiens
gaagguauuagcaaagcaaa

SEQ ID NO: 1567709 - RNA, 23 nt, Homo sapiens
gaaggugcugauccuaagaauuu

SEQ ID NO: 1567710 - RNA, 13 nt, Homo sapiens
gaagguugcaccu

SEQ ID NO: 1567711 - RNA, 16 nt, Homo sapiens
gaagguuuucauuugc

SEQ ID NO: 1567712 - RNA, 14 nt, Homo sapiens
gaaguaagccucau

SEQ ID NO: 1567713 - RNA, 20 nt, Homo sapiens
gaaguaauucuucugccuca

SEQ ID NO: 1567714 - RNA, 15 nt, Homo sapiens
gaaguaggcauauau

SEQ ID NO: 1567715 - RNA, 17 nt, Homo sapiens
gaaguaggcauauauca

SEQ ID NO: 1567716 - RNA, 20 nt, Homo sapiens
gaagucaccccuuucugucc

SEQ ID NO: 1567717 - RNA, 22 nt, Homo sapiens
gaagucaccccuuucuguccca

SEQ ID NO: 1567718 - RNA, 21 nt, Homo sapiens
gaagucauccagucuauucac

SEQ ID NO: 1567719 - RNA, 23 nt, Homo sapiens
gaagucccucuccuggugcucca

SEQ ID NO: 1567720 - RNA, 16 nt, Homo sapiens
gaaguccuccagacaa

SEQ ID NO: 1567721 - RNA, 10 nt, Homo sapiens
gaagugcaau

SEQ ID NO: 1567722 - RNA, 11 nt, Homo sapiens
gaagugcuaaa

SEQ ID NO: 1567723 - RNA, 19 nt, Homo sapiens
gaagugcuuuguaucagga

SEQ ID NO: 1567724 - RNA, 22 nt, Homo sapiens
gaaguggagagggugucaucua

SEQ ID NO: 1567725 - RNA, 15 nt, Homo sapiens
gaaguggcugccaaa

SEQ ID NO: 1567726 - RNA, 23 nt, Homo sapiens
gaagugugaggcggcccugacca

SEQ ID NO: 1567727 - RNA, 22 nt, Homo sapiens
gaagugugucacccuuaggcca

SEQ ID NO: 1567728 - RNA, 21 nt, Homo sapiens
gaaguguugagccaugcuaca

SEQ ID NO: 1567729 - RNA, 20 nt, Homo sapiens
gaaguucuuggauuacuuua

SEQ ID NO: 1567730 - RNA, 18 nt, Homo sapiens
gaaguugcugcugugaau

SEQ ID NO: 1567731 - RNA, 21 nt, Homo sapiens
gaaguuguugcuauacauguu

SEQ ID NO: 1567732 - RNA, 11 nt, Homo sapiens
gaaguuucauc

SEQ ID NO: 1567733 - RNA, 20 nt, Homo sapiens
gaaguuucuggugccauuuc

SEQ ID NO: 1567734 - RNA, 18 nt, Homo sapiens
gaaguuugcuuuguacug

SEQ ID NO: 1567735 - RNA, 16 nt, Homo sapiens
gaaguuuuaugccaug

SEQ ID NO: 1567736 - RNA, 19 nt, Homo sapiens
gaauaaaaauagaaaccug

SEQ ID NO: 1567737 - RNA, 21 nt, Homo sapiens
gaauaaaccaucaucuugcca

SEQ ID NO: 1567738 - RNA, 22 nt, Homo sapiens
gaauaaauaagcaaaaugccaa

SEQ ID NO: 1567739 - RNA, 18 nt, Homo sapiens
gaauaaaucaaauauucc

SEQ ID NO: 1567740 - RNA, 14 nt, Homo sapiens
gaauaaauuuggga

SEQ ID NO: 1567741 - RNA, 15 nt, Homo sapiens
gaauaaccaucugaa

SEQ ID NO: 1567742 - RNA, 12 nt, Homo sapiens
gaauaaugcugu

SEQ ID NO: 1567743 - RNA, 18 nt, Homo sapiens
gcccaggcuagagugcaa

SEQ ID NO: 1567744 - RNA, 19 nt, Homo sapiens
gcccaggcuagagugcaau

SEQ ID NO: 1567745 - RNA, 20 nt, Homo sapiens
gcccaggcuagagugcaaug

SEQ ID NO: 1567746 - RNA, 19 nt, Homo sapiens
gcccaggcuggagugcagu

SEQ ID NO: 1567747 - RNA, 20 nt, Homo sapiens
gcccaggcuggagugcagug

SEQ ID NO: 1567748 - RNA, 23 nt, Homo sapiens
gcccagggcugcgucugcaaagg

SEQ ID NO: 1567749 - RNA, 22 nt, Homo sapiens
gcccauaaucccagcacuuugg

SEQ ID NO: 1567750 - RNA, 20 nt, Homo sapiens
gcccaucugaacacaaccag

SEQ ID NO: 1567751 - RNA, 19 nt, Homo sapiens
gcccaugaugagaagcaga

SEQ ID NO: 1567752 - RNA, 17 nt, Homo sapiens
gcccauucuucugggug

SEQ ID NO: 1567753 - RNA, 22 nt, Homo sapiens
gcccauugucuuauuggcacau

SEQ ID NO: 1567754 - RNA, 15 nt, Homo sapiens
gcccauuuacacuuu

SEQ ID NO: 1567755 - RNA, 16 nt, Homo sapiens
gccccaacuccagggg

SEQ ID NO: 1567756 - RNA, 14 nt, Homo sapiens
gccccaaucuugcc

SEQ ID NO: 1567757 - RNA, 17 nt, Homo sapiens
gccccaaucuugcccac

SEQ ID NO: 1567758 - RNA, 23 nt, Homo sapiens
gccccagagcuguuuauggccuc

SEQ ID NO: 1567759 - RNA, 15 nt, Homo sapiens
gccccagccuaggaa

SEQ ID NO: 1567760 - RNA, 21 nt, Homo sapiens
gccccaggcucguggacugag

SEQ ID NO: 1567761 - RNA, 22 nt, Homo sapiens
gccccagucagccucucuccca

SEQ ID NO: 1567762 - RNA, 15 nt, Homo sapiens
gccccauuccuugcg

SEQ ID NO: 1567763 - RNA, 23 nt, Homo sapiens
gcccccaugugccucuccuggga

SEQ ID NO: 1567764 - RNA, 15 nt, Homo sapiens
gcccccgccccagag

SEQ ID NO: 1567765 - RNA, 20 nt, Homo sapiens
gcccccgccugccaccggag

SEQ ID NO: 1567766 - RNA, 13 nt, Homo sapiens
gccccgacuccag

SEQ ID NO: 1567767 - RNA, 14 nt, Homo sapiens
gccccgccacagcc

SEQ ID NO: 1567768 - RNA, 17 nt, Homo sapiens
gccccggccuccucgga

SEQ ID NO: 1567769 - RNA, 17 nt, Homo sapiens
gccccggucccccagag

SEQ ID NO: 1567770 - RNA, 20 nt, Homo sapiens
gccccgugggcugugccaag

SEQ ID NO: 1567771 - RNA, 20 nt, Homo sapiens
gccccuaggaaggugaaucu

SEQ ID NO: 1567772 - RNA, 13 nt, Homo sapiens
gccccucacccac

SEQ ID NO: 1567773 - RNA, 21 nt, Homo sapiens
gccccugcagauucugagcaa

SEQ ID NO: 1567774 - RNA, 16 nt, Homo sapiens
gccccugcccccagag

SEQ ID NO: 1567775 - RNA, 22 nt, Homo sapiens
gccccugggguggccaccagua

SEQ ID NO: 1567776 - RNA, 23 nt, Homo sapiens
gccccugucccaccccuaccucu

SEQ ID NO: 1567777 - RNA, 17 nt, Homo sapiens
gccccuucauggaagaa

SEQ ID NO: 1567778 - RNA, 15 nt, Homo sapiens
gccccuuccauggua

SEQ ID NO: 1567779 - RNA, 16 nt, Homo sapiens
gccccuuugccuguca

SEQ ID NO: 1567780 - RNA, 19 nt, Homo sapiens
gcccguaaucccagcuacu

SEQ ID NO: 1567781 - RNA, 21 nt, Homo sapiens
gcccgugcccccgccugccac

SEQ ID NO: 1567782 - RNA, 16 nt, Homo sapiens
gcccuaagggacuuaa

SEQ ID NO: 1567783 - RNA, 15 nt, Homo sapiens
gcccuacauugugcu

SEQ ID NO: 1567784 - RNA, 17 nt, Homo sapiens
gcccuagaugcacgugg

SEQ ID NO: 1567785 - RNA, 17 nt, Homo sapiens
gcccuaggggagcaccg

SEQ ID NO: 1567786 - RNA, 12 nt, Homo sapiens
gcccucaaucca

SEQ ID NO: 1567787 - RNA, 11 nt, Homo sapiens
gcccucaggag

SEQ ID NO: 1567788 - RNA, 23 nt, Homo sapiens
gcccuccuccuccuuaacccugc

SEQ ID NO: 1567789 - RNA, 14 nt, Homo sapiens
gcccucucacuuga

SEQ ID NO: 1567790 - RNA, 17 nt, Homo sapiens
gcccucucugaaccuca

SEQ ID NO: 1567791 - RNA, 13 nt, Homo sapiens
gcccugaaggcac

SEQ ID NO: 1567792 - RNA, 20 nt, Homo sapiens
gcccugaaggcaccugucaa

SEQ ID NO: 1567793 - RNA, 14 nt, Homo sapiens
gcccugaccaugca

SEQ ID NO: 1567794 - RNA, 17 nt, Homo sapiens
gcccugccugguggcaa

SEQ ID NO: 1567795 - RNA, 14 nt, Homo sapiens
gcccuggccaggac

SEQ ID NO: 1567796 - RNA, 16 nt, Homo sapiens
gcccuggcccaggugc

SEQ ID NO: 1567797 - RNA, 17 nt, Homo sapiens
gcccugguguguuucca

SEQ ID NO: 1567798 - RNA, 17 nt, Homo sapiens
gcccuucacuuccauca

SEQ ID NO: 1567799 - RNA, 18 nt, Homo sapiens
gcccuuccaugugccuuu

SEQ ID NO: 1567800 - RNA, 20 nt, Homo sapiens
gcccuucccagggcacccag

SEQ ID NO: 1567801 - RNA, 20 nt, Homo sapiens
gcccuuucauggucugcuga

SEQ ID NO: 1567802 - RNA, 15 nt, Homo sapiens
gccgccaugagcaac

SEQ ID NO: 1567803 - RNA, 15 nt, Homo sapiens
gccgcugccaugcuu

SEQ ID NO: 1567804 - RNA, 18 nt, Homo sapiens
gccuaaaacacuugccaa

SEQ ID NO: 1567805 - RNA, 21 nt, Homo sapiens
gccuaaaguacagccuggacc

SEQ ID NO: 1567806 - RNA, 16 nt, Homo sapiens
gccuaacuaacuggca

SEQ ID NO: 1567807 - RNA, 14 nt, Homo sapiens
gccuacuccaaaau

SEQ ID NO: 1567808 - RNA, 14 nt, Homo sapiens
gccuagcgaucucu

SEQ ID NO: 1567809 - RNA, 22 nt, Homo sapiens
gccuaggaaagccaguuacaua

SEQ ID NO: 1567810 - RNA, 20 nt, Homo sapiens
gccuauaaucccagcuacug

SEQ ID NO: 1567811 - RNA, 20 nt, Homo sapiens
gccucaaaaaucagggccac

SEQ ID NO: 1567812 - RNA, 20 nt, Homo sapiens
gccucaccguccucacccau

SEQ ID NO: 1567813 - RNA, 17 nt, Homo sapiens
gccucagaugauuuccc

SEQ ID NO: 1567814 - RNA, 16 nt, Homo sapiens
gccucaucucagaccc

SEQ ID NO: 1567815 - RNA, 21 nt, Homo sapiens
gccuccacuccuuccaucucu

SEQ ID NO: 1567816 - RNA, 21 nt, Homo sapiens
gccuccaucucauguaucauc

SEQ ID NO: 1567817 - RNA, 22 nt, Homo sapiens
gccuccccauuucccaucugca

SEQ ID NO: 1567818 - RNA, 20 nt, Homo sapiens
gccucccccucagaugaucu

SEQ ID NO: 1567819 - RNA, 18 nt, Homo sapiens
gccuccccgugccaaaaa

SEQ ID NO: 1567820 - RNA, 19 nt, Homo sapiens
gccuccccgugccaaaaau

SEQ ID NO: 1567821 - RNA, 21 nt, Homo sapiens
gccucccggguucaagcaauu

SEQ ID NO: 1567822 - RNA, 20 nt, Homo sapiens
gccucccuugacuuugcucc

SEQ ID NO: 1567823 - RNA, 16 nt, Homo sapiens
gccuccugucccucau

SEQ ID NO: 1567824 - RNA, 17 nt, Homo sapiens
gccucucuuucacacaa

SEQ ID NO: 1567825 - RNA, 18 nt, Homo sapiens
gccucugcuggcucagga

SEQ ID NO: 1567826 - RNA, 14 nt, Homo sapiens
gccucuguggcacu

SEQ ID NO: 1567827 - RNA, 20 nt, Homo sapiens
gccucuuaccggaaauacuu

SEQ ID NO: 1567828 - RNA, 19 nt, Homo sapiens
gccucuucuuugugccuuu

SEQ ID NO: 1567829 - RNA, 17 nt, Homo sapiens
gccugaaauuucaccau

SEQ ID NO: 1567830 - RNA, 23 nt, Homo sapiens
gccugaaguggaaugacugaaag

SEQ ID NO: 1567831 - RNA, 22 nt, Homo sapiens
gccugacucagcuaaugucaca

SEQ ID NO: 1567832 - RNA, 17 nt, Homo sapiens
gccugacucagugacca

SEQ ID NO: 1567833 - RNA, 20 nt, Homo sapiens
gccugagcaacucuugauua

SEQ ID NO: 1567834 - RNA, 15 nt, Homo sapiens
gccugagggcaguac

SEQ ID NO: 1567835 - RNA, 16 nt, Homo sapiens
gccugauagaagugca

SEQ ID NO: 1567836 - RNA, 18 nt, Homo sapiens
gcucggauucaacuaccu

SEQ ID NO: 1567837 - RNA, 22 nt, Homo sapiens
gcucuaaaguccagacuaugga

SEQ ID NO: 1567838 - RNA, 16 nt, Homo sapiens
gcucuagaaaguauag

SEQ ID NO: 1567839 - RNA, 16 nt, Homo sapiens
gcucucaagucaagga

SEQ ID NO: 1567840 - RNA, 17 nt, Homo sapiens
gcucugagccagauuac

SEQ ID NO: 1567841 - RNA, 19 nt, Homo sapiens
gcucugcccccucccccau

SEQ ID NO: 1567842 - RNA, 20 nt, Homo sapiens
gcucugccccgcagacgguc

SEQ ID NO: 1567843 - RNA, 20 nt, Homo sapiens
gcucuggauccugcacucua

SEQ ID NO: 1567844 - RNA, 22 nt, Homo sapiens
gcucuguaaaacacaccaauca

SEQ ID NO: 1567845 - RNA, 20 nt, Homo sapiens
gcucugugcagucacuggag

SEQ ID NO: 1567846 - RNA, 21 nt, Homo sapiens
gcucuuauagaagcuucagca

SEQ ID NO: 1567847 - RNA, 13 nt, Homo sapiens
gcucuuauuauau

SEQ ID NO: 1567848 - RNA, 20 nt, Homo sapiens
gcucuucaaaauaaaacauc

SEQ ID NO: 1567849 - RNA, 15 nt, Homo sapiens
gcucuucucauuuca

SEQ ID NO: 1567850 - RNA, 15 nt, Homo sapiens
gcucuuuacauuucu

SEQ ID NO: 1567851 - RNA, 15 nt, Homo sapiens
gcucuuuaccaagga

SEQ ID NO: 1567852 - RNA, 22 nt, Homo sapiens
gcugaaauuuuagaaauauuca

SEQ ID NO: 1567853 - RNA, 20 nt, Homo sapiens
gcugaaccacagaaaucaca

SEQ ID NO: 1567854 - RNA, 16 nt, Homo sapiens
gcugaauuccuuuaca

SEQ ID NO: 1567855 - RNA, 23 nt, Homo sapiens
gcugacaugaagcuguuguguga

SEQ ID NO: 1567856 - RNA, 14 nt, Homo sapiens
gcugacauucacug

SEQ ID NO: 1567857 - RNA, 17 nt, Homo sapiens
gcugacauucacugagu

SEQ ID NO: 1567858 - RNA, 14 nt, Homo sapiens
gcugagacccacag

SEQ ID NO: 1567859 - RNA, 14 nt, Homo sapiens
gcugagaucgugcu

SEQ ID NO: 1567860 - RNA, 18 nt, Homo sapiens
gcugagauuacucugaaa

SEQ ID NO: 1567861 - RNA, 18 nt, Homo sapiens
gcugauaaauauaaccau

SEQ ID NO: 1567862 - RNA, 17 nt, Homo sapiens
gcugauuccagaacaaa

SEQ ID NO: 1567863 - RNA, 17 nt, Homo sapiens
gcugcaaagccuuucca

SEQ ID NO: 1567864 - RNA, 15 nt, Homo sapiens
gcugcaaggagcaac

SEQ ID NO: 1567865 - RNA, 17 nt, Homo sapiens
gcugcaauaaagauuga

SEQ ID NO: 1567866 - RNA, 16 nt, Homo sapiens
gcugcaccuggucaua

SEQ ID NO: 1567867 - RNA, 18 nt, Homo sapiens
gcugcagggccacuggaa

SEQ ID NO: 1567868 - RNA, 15 nt, Homo sapiens
gcugcauacagggga

SEQ ID NO: 1567869 - RNA, 10 nt, Homo sapiens
gcugcaucuc

SEQ ID NO: 1567870 - RNA, 14 nt, Homo sapiens
gcugccaccagccc

SEQ ID NO: 1567871 - RNA, 18 nt, Homo sapiens
gcugccagcucuguauca

SEQ ID NO: 1567872 - RNA, 12 nt, Homo sapiens
gcugccaugcuu

SEQ ID NO: 1567873 - RNA, 14 nt, Homo sapiens
gcugccuaguggga

SEQ ID NO: 1567874 - RNA, 19 nt, Homo sapiens
gcugcuccccaacaccugc

SEQ ID NO: 1567875 - RNA, 14 nt, Homo sapiens
gcugcuuccagugu

SEQ ID NO: 1567876 - RNA, 23 nt, Homo sapiens
gcugcuuucuuguugcugcaucu

SEQ ID NO: 1567877 - RNA, 19 nt, Homo sapiens
gcuggaggacuagaaccug

SEQ ID NO: 1567878 - RNA, 20 nt, Homo sapiens
gcuggagugcaguggcgcga

SEQ ID NO: 1567879 - RNA, 13 nt, Homo sapiens
gcuggaucaggaa

SEQ ID NO: 1567880 - RNA, 19 nt, Homo sapiens
gcuggcagggcgugaggaa

SEQ ID NO: 1567881 - RNA, 14 nt, Homo sapiens
gcuggcaguacugu

SEQ ID NO: 1567882 - RNA, 21 nt, Homo sapiens
gcuggccagcauuuucauuca

SEQ ID NO: 1567883 - RNA, 18 nt, Homo sapiens
gcuggccuccuaugccuc

SEQ ID NO: 1567884 - RNA, 16 nt, Homo sapiens
gcuggcuccuagggga

SEQ ID NO: 1567885 - RNA, 23 nt, Homo sapiens
gcugggacccuuaggauggggcu

SEQ ID NO: 1567886 - RNA, 18 nt, Homo sapiens
gcugggauuacaggcgcc

SEQ ID NO: 1567887 - RNA, 19 nt, Homo sapiens
gcugggccauguccaaaga

SEQ ID NO: 1567888 - RNA, 14 nt, Homo sapiens
gcuggggugucaau

SEQ ID NO: 1567889 - RNA, 15 nt, Homo sapiens
gcuggggugucaaua

SEQ ID NO: 1567890 - RNA, 19 nt, Homo sapiens
gcuggguauuggaaaugga

SEQ ID NO: 1567891 - RNA, 21 nt, Homo sapiens
gcuggucagagagaccucauc

SEQ ID NO: 1567892 - RNA, 22 nt, Homo sapiens
gcuggucccggggccagcacuu

SEQ ID NO: 1567893 - RNA, 18 nt, Homo sapiens
gcuggucucaaacuccug

SEQ ID NO: 1567894 - RNA, 20 nt, Homo sapiens
gcuggucucaaacuccugac

SEQ ID NO: 1567895 - RNA, 22 nt, Homo sapiens
gcuguacucuucugacugcccc

SEQ ID NO: 1567896 - RNA, 14 nt, Homo sapiens
gcuguagaagaugg

SEQ ID NO: 1567897 - RNA, 16 nt, Homo sapiens
gcuguagaccaccuaa

SEQ ID NO: 1567898 - RNA, 16 nt, Homo sapiens
gcuguccccacugccc

SEQ ID NO: 1567899 - RNA, 17 nt, Homo sapiens
gcuguccccacugcccc

SEQ ID NO: 1567900 - RNA, 15 nt, Homo sapiens
gcugucuacuggaca

SEQ ID NO: 1567901 - RNA, 16 nt, Homo sapiens
gcuguggacacugaga

SEQ ID NO: 1567902 - RNA, 19 nt, Homo sapiens
gcuguggccuaaccugccg

SEQ ID NO: 1567903 - RNA, 22 nt, Homo sapiens
gcugugggcaagccuaagggau

SEQ ID NO: 1567904 - RNA, 12 nt, Homo sapiens
gcuguuaaccaa

SEQ ID NO: 1567905 - RNA, 18 nt, Homo sapiens
gcuguuaccaaaucucag

SEQ ID NO: 1567906 - RNA, 13 nt, Homo sapiens
gcuguuauacugu

SEQ ID NO: 1567907 - RNA, 15 nt, Homo sapiens
gcuguuugacaccuc

SEQ ID NO: 1567908 - RNA, 14 nt, Homo sapiens
gcuguuuuauaugu

SEQ ID NO: 1567909 - RNA, 17 nt, Homo sapiens
gcuuaaaacacuucuaa

SEQ ID NO: 1567910 - RNA, 16 nt, Homo sapiens
gcuuaaaaucugugaa

SEQ ID NO: 1567911 - RNA, 21 nt, Homo sapiens
gcuuaaacuugacccaggugg

SEQ ID NO: 1567912 - RNA, 18 nt, Homo sapiens
gcuuaaauaggaaaguuu

SEQ ID NO: 1567913 - RNA, 19 nt, Homo sapiens
gcuuaauaaacaugucaca

SEQ ID NO: 1567914 - RNA, 13 nt, Homo sapiens
gcuuacugagcug

SEQ ID NO: 1567915 - RNA, 14 nt, Homo sapiens
gcuuagaacaaagg

SEQ ID NO: 1567916 - RNA, 13 nt, Homo sapiens
gcuuagauuucau

SEQ ID NO: 1567917 - RNA, 15 nt, Homo sapiens
gcuuagcauaucuga

SEQ ID NO: 1567918 - RNA, 23 nt, Homo sapiens
gcuuaguucuucuccugccuaau

SEQ ID NO: 1567919 - RNA, 18 nt, Homo sapiens
gcuuauaucuggccucug

SEQ ID NO: 1567920 - RNA, 12 nt, Homo sapiens
gcuuauauucau

SEQ ID NO: 1567921 - RNA, 21 nt, Homo sapiens
gcuuauucacaagacccaaaa

SEQ ID NO: 1567922 - RNA, 16 nt, Homo sapiens
gcuucacaaaaugcac

SEQ ID NO: 1567923 - RNA, 21 nt, Homo sapiens
gcuucacuagaguucuuugaa

SEQ ID NO: 1567924 - RNA, 14 nt, Homo sapiens
gcuucaguugcaua

SEQ ID NO: 1567925 - RNA, 15 nt, Homo sapiens
gcuucaguugcauau

SEQ ID NO: 1567926 - RNA, 18 nt, Homo sapiens
gcuucauacagaaggcaa

SEQ ID NO: 1567927 - RNA, 20 nt, Homo sapiens
gcuucauauaccagcaauau

SEQ ID NO: 1567928 - RNA, 14 nt, Homo sapiens
gguuuuccucagcu

SEQ ID NO: 1567929 - RNA, 20 nt, Homo sapiens
gguuuuugaggaaacaaaga

SEQ ID NO: 1567930 - RNA, 19 nt, Homo sapiens
gguuuuuuucuucuguauu

SEQ ID NO: 1567931 - RNA, 15 nt, Homo sapiens
guaaaacaaucuguu

SEQ ID NO: 1567932 - RNA, 21 nt, Homo sapiens
guaaaacaaucuguuuuggcu

SEQ ID NO: 1567933 - RNA, 23 nt, Homo sapiens
guaaaacagucaucuagaauuca

SEQ ID NO: 1567934 - RNA, 19 nt, Homo sapiens
guaaaacgcaccaaucagc

SEQ ID NO: 1567935 - RNA, 14 nt, Homo sapiens
guaaaagcaaaaaa

SEQ ID NO: 1567936 - RNA, 11 nt, Homo sapiens
guaaaauaugu

SEQ ID NO: 1567937 - RNA, 17 nt, Homo sapiens
guaaaauggaggccauu

SEQ ID NO: 1567938 - RNA, 14 nt, Homo sapiens
guaaaauuaaugua

SEQ ID NO: 1567939 - RNA, 14 nt, Homo sapiens
guaaaauuauuuca

SEQ ID NO: 1567940 - RNA, 20 nt, Homo sapiens
guaaacauauuggaauguac

SEQ ID NO: 1567941 - RNA, 15 nt, Homo sapiens
guaaaccaaacccua

SEQ ID NO: 1567942 - RNA, 19 nt, Homo sapiens
guaaacggcccaggccagg

SEQ ID NO: 1567943 - RNA, 13 nt, Homo sapiens
guaaacugugcac

SEQ ID NO: 1567944 - RNA, 12 nt, Homo sapiens
guaaacuuccaa

SEQ ID NO: 1567945 - RNA, 14 nt, Homo sapiens
guaaagcagaggau

SEQ ID NO: 1567946 - RNA, 12 nt, Homo sapiens
guaaaggcagua

SEQ ID NO: 1567947 - RNA, 13 nt, Homo sapiens
guaaagguuucaa

SEQ ID NO: 1567948 - RNA, 19 nt, Homo sapiens
guaaauaaaacaucacuau

SEQ ID NO: 1567949 - RNA, 22 nt, Homo sapiens
guaaauaaaugugaaacaucuu

SEQ ID NO: 1567950 - RNA, 21 nt, Homo sapiens
guaaauacacauagcauguaa

SEQ ID NO: 1567951 - RNA, 13 nt, Homo sapiens
guaaauacuguga

SEQ ID NO: 1567952 - RNA, 16 nt, Homo sapiens
guaaauagaugacaaa

SEQ ID NO: 1567953 - RNA, 21 nt, Homo sapiens
guaaaucauguugaucaugua

SEQ ID NO: 1567954 - RNA, 21 nt, Homo sapiens
guaaauguuaucuuauacugu

SEQ ID NO: 1567955 - RNA, 15 nt, Homo sapiens
guaaauuuuuaggca

SEQ ID NO: 1567956 - RNA, 17 nt, Homo sapiens
guaaauuuuuaggcaaa

SEQ ID NO: 1567957 - RNA, 12 nt, Homo sapiens
guaacacuacag

SEQ ID NO: 1567958 - RNA, 18 nt, Homo sapiens
guaacagcauuaacuguc

SEQ ID NO: 1567959 - RNA, 18 nt, Homo sapiens
guaacaucuguuaucaaa

SEQ ID NO: 1567960 - RNA, 10 nt, Homo sapiens
guaaccacug

SEQ ID NO: 1567961 - RNA, 19 nt, Homo sapiens
guaacuccccucagggaua

SEQ ID NO: 1567962 - RNA, 23 nt, Homo sapiens
guaacuguuuagaugaaugucag

SEQ ID NO: 1567963 - RNA, 12 nt, Homo sapiens
guaagaaaguga

SEQ ID NO: 1567964 - RNA, 18 nt, Homo sapiens
guaagaacuguacauugu

SEQ ID NO: 1567965 - RNA, 16 nt, Homo sapiens
guaagaagaaagcaaa

SEQ ID NO: 1567966 - RNA, 14 nt, Homo sapiens
guaagaaggcaaua

SEQ ID NO: 1567967 - RNA, 17 nt, Homo sapiens
guaagaaggcaauauua

SEQ ID NO: 1567968 - RNA, 14 nt, Homo sapiens
guaagguguguacu

SEQ ID NO: 1567969 - RNA, 22 nt, Homo sapiens
guaagguguguacucagggcau

SEQ ID NO: 1567970 - RNA, 21 nt, Homo sapiens
guaauaaaucuaggaugugau

SEQ ID NO: 1567971 - RNA, 18 nt, Homo sapiens
guaauaaaugugacucag

SEQ ID NO: 1567972 - RNA, 17 nt, Homo sapiens
guaauacaaacuauaua

SEQ ID NO: 1567973 - RNA, 16 nt, Homo sapiens
guaauaccugauugau

SEQ ID NO: 1567974 - RNA, 18 nt, Homo sapiens
guaauaccugauugauca

SEQ ID NO: 1567975 - RNA, 23 nt, Homo sapiens
guaauaguucuauccuuuugccu

SEQ ID NO: 1567976 - RNA, 13 nt, Homo sapiens
guaaucauuuuaa

SEQ ID NO: 1567977 - RNA, 16 nt, Homo sapiens
guaaucccaacacuuu

SEQ ID NO: 1567978 - RNA, 16 nt, Homo sapiens
guaaucccagcacuuu

SEQ ID NO: 1567979 - RNA, 18 nt, Homo sapiens
guaaucccagcuacucag

SEQ ID NO: 1567980 - RNA, 14 nt, Homo sapiens
guaaugaaacaaag

SEQ ID NO: 1567981 - RNA, 22 nt, Homo sapiens
guaaugaaacaaagaguucaag

SEQ ID NO: 1567982 - RNA, 23 nt, Homo sapiens
guaaugaguuuaaaaaucaacuu

SEQ ID NO: 1567983 - RNA, 15 nt, Homo sapiens
guaaugucaccaccu

SEQ ID NO: 1567984 - RNA, 18 nt, Homo sapiens
guaauucuagccuuuuaa

SEQ ID NO: 1567985 - RNA, 18 nt, Homo sapiens
guaauuuaaaauugugau

SEQ ID NO: 1567986 - RNA, 22 nt, Homo sapiens
guacaaaaauaaauuuauauga

SEQ ID NO: 1567987 - RNA, 14 nt, Homo sapiens
guacaagcaguuaa

SEQ ID NO: 1567988 - RNA, 24 nt, Homo sapiens
guacaauaaaaacauugccuuuga

SEQ ID NO: 1567989 - RNA, 22 nt, Homo sapiens
guacaauaaaaguaaaccacaa

SEQ ID NO: 1567990 - RNA, 12 nt, Homo sapiens
guacacaacaau

SEQ ID NO: 1567991 - RNA, 17 nt, Homo sapiens
guacacaauaagcaaaa

SEQ ID NO: 1567992 - RNA, 15 nt, Homo sapiens
guacacuguuuccau

SEQ ID NO: 1567993 - RNA, 19 nt, Homo sapiens
guacaggaaugaaccuucu

SEQ ID NO: 1567994 - RNA, 20 nt, Homo sapiens
guacaguauguuuuacaugu

SEQ ID NO: 1567995 - RNA, 23 nt, Homo sapiens
guacaguucugggguacauguua

SEQ ID NO: 1567996 - RNA, 22 nt, Homo sapiens
guacauaauucuugcuaugaaa

SEQ ID NO: 1567997 - RNA, 15 nt, Homo sapiens
guacaucugcaauau

SEQ ID NO: 1567998 - RNA, 17 nt, Homo sapiens
guacauuuaucacugaa

SEQ ID NO: 1567999 - RNA, 16 nt, Homo sapiens
guacauuugagccaug

SEQ ID NO: 1568000 - RNA, 20 nt, Homo sapiens
guacauuuuuauacagugau

SEQ ID NO: 1568001 - RNA, 21 nt, Homo sapiens
guacauuuuuuaacuuucuag

SEQ ID NO: 1568002 - RNA, 16 nt, Homo sapiens
guaccaccaugcacug

SEQ ID NO: 1568003 - RNA, 19 nt, Homo sapiens
guaccaccaugcacuguaa

SEQ ID NO: 1568004 - RNA, 17 nt, Homo sapiens
guacccagcaaaugggc

SEQ ID NO: 1568005 - RNA, 15 nt, Homo sapiens
guaccccauggagcu

SEQ ID NO: 1568006 - RNA, 21 nt, Homo sapiens
gucauacaagucauggucaca

SEQ ID NO: 1568007 - RNA, 14 nt, Homo sapiens
gucaucacuuugac

SEQ ID NO: 1568008 - RNA, 17 nt, Homo sapiens
gucaucaggugcauagc

SEQ ID NO: 1568009 - RNA, 16 nt, Homo sapiens
gucaucuguaccucug

SEQ ID NO: 1568010 - RNA, 16 nt, Homo sapiens
gucaucuucaauuuau

SEQ ID NO: 1568011 - RNA, 18 nt, Homo sapiens
gucauggaggccaagaac

SEQ ID NO: 1568012 - RNA, 22 nt, Homo sapiens
gucauggucacaguaaagagua

SEQ ID NO: 1568013 - RNA, 20 nt, Homo sapiens
gucauuaacccaucucugaa

SEQ ID NO: 1568014 - RNA, 23 nt, Homo sapiens
gucauuaauggcauaugguccua

SEQ ID NO: 1568015 - RNA, 16 nt, Homo sapiens
gucauuauuuuuguua

SEQ ID NO: 1568016 - RNA, 16 nt, Homo sapiens
gucauuguaaucacug

SEQ ID NO: 1568017 - RNA, 21 nt, Homo sapiens
gucauuucauuccauugccua

SEQ ID NO: 1568018 - RNA, 16 nt, Homo sapiens
gucauuuccaccagca

SEQ ID NO: 1568019 - RNA, 13 nt, Homo sapiens
guccaaggucucc

SEQ ID NO: 1568020 - RNA, 15 nt, Homo sapiens
guccacaacaauaug

SEQ ID NO: 1568021 - RNA, 17 nt, Homo sapiens
guccacaagaacaauuc

SEQ ID NO: 1568022 - RNA, 13 nt, Homo sapiens
guccacacccagc

SEQ ID NO: 1568023 - RNA, 16 nt, Homo sapiens
guccacgcccaccagc

SEQ ID NO: 1568024 - RNA, 14 nt, Homo sapiens
guccacugucaggg

SEQ ID NO: 1568025 - RNA, 15 nt, Homo sapiens
guccacuguggcacu

SEQ ID NO: 1568026 - RNA, 19 nt, Homo sapiens
guccacuguucuguucuca

SEQ ID NO: 1568027 - RNA, 21 nt, Homo sapiens
guccacuuuucuuuacauuuu

SEQ ID NO: 1568028 - RNA, 22 nt, Homo sapiens
guccagaagggcuacuuuccac

SEQ ID NO: 1568029 - RNA, 20 nt, Homo sapiens
guccagcaaauaaagcaguc

SEQ ID NO: 1568030 - RNA, 18 nt, Homo sapiens
guccagcuugcucuucag

SEQ ID NO: 1568031 - RNA, 17 nt, Homo sapiens
guccauccgacugcccc

SEQ ID NO: 1568032 - RNA, 15 nt, Homo sapiens
guccaugaagcacug

SEQ ID NO: 1568033 - RNA, 15 nt, Homo sapiens
guccaugccuuccau

SEQ ID NO: 1568034 - RNA, 17 nt, Homo sapiens
guccauguguucuuauu

SEQ ID NO: 1568035 - RNA, 11 nt, Homo sapiens
guccauucucu

SEQ ID NO: 1568036 - RNA, 19 nt, Homo sapiens
gucccaccccuaccucuag

SEQ ID NO: 1568037 - RNA, 21 nt, Homo sapiens
gucccaccccuaccucuagua

SEQ ID NO: 1568038 - RNA, 21 nt, Homo sapiens
gucccagaaauaaacugagaa

SEQ ID NO: 1568039 - RNA, 15 nt, Homo sapiens
gucccagacaauucc

SEQ ID NO: 1568040 - RNA, 16 nt, Homo sapiens
gucccaggagcaggac

SEQ ID NO: 1568041 - RNA, 21 nt, Homo sapiens
gucccaggccgacccaaggga

SEQ ID NO: 1568042 - RNA, 20 nt, Homo sapiens
gucccauuuuucucuugcca

SEQ ID NO: 1568043 - RNA, 21 nt, Homo sapiens
guccccccucaagaguacaga

SEQ ID NO: 1568044 - RNA, 18 nt, Homo sapiens
guccccguaccaccaugc

SEQ ID NO: 1568045 - RNA, 19 nt, Homo sapiens
guccccuucucucaucucu

SEQ ID NO: 1568046 - RNA, 18 nt, Homo sapiens
gucccggggccagcacuu

SEQ ID NO: 1568047 - RNA, 18 nt, Homo sapiens
gucccuccaccccacaga

SEQ ID NO: 1568048 - RNA, 12 nt, Homo sapiens
gucccugcaaaa

SEQ ID NO: 1568049 - RNA, 22 nt, Homo sapiens
gucccuguuuucccacgaggaa

SEQ ID NO: 1568050 - RNA, 13 nt, Homo sapiens
guugggcuuccau

SEQ ID NO: 1568051 - RNA, 14 nt, Homo sapiens
guuggugaccaguu

SEQ ID NO: 1568052 - RNA, 20 nt, Homo sapiens
guuggugugaaaauacacuu

SEQ ID NO: 1568053 - RNA, 15 nt, Homo sapiens
guuguacaagcucag

SEQ ID NO: 1568054 - RNA, 19 nt, Homo sapiens
guuguccugcccuguggaa

SEQ ID NO: 1568055 - RNA, 13 nt, Homo sapiens
guugugagacuuc

SEQ ID NO: 1568056 - RNA, 19 nt, Homo sapiens
guuguuaauaaaaguacau

SEQ ID NO: 1568057 - RNA, 21 nt, Homo sapiens
guuguuaauaaaaguacaugu

SEQ ID NO: 1568058 - RNA, 19 nt, Homo sapiens
guuguucuaguaacaauac

SEQ ID NO: 1568059 - RNA, 16 nt, Homo sapiens
guuuaaaaccugggau

SEQ ID NO: 1568060 - RNA, 14 nt, Homo sapiens
guuuaaaauuacuu

SEQ ID NO: 1568061 - RNA, 14 nt, Homo sapiens
guuuaaacagucaa

SEQ ID NO: 1568062 - RNA, 13 nt, Homo sapiens
guuuaaagucuca

SEQ ID NO: 1568063 - RNA, 22 nt, Homo sapiens
guuuaaagucucaguuucuugc

SEQ ID NO: 1568064 - RNA, 15 nt, Homo sapiens
guuuaaaugccaaaa

SEQ ID NO: 1568065 - RNA, 17 nt, Homo sapiens
guuuaaucccagcacuu

SEQ ID NO: 1568066 - RNA, 18 nt, Homo sapiens
guuuaaucccagcacuuu

SEQ ID NO: 1568067 - RNA, 14 nt, Homo sapiens
guuuaccaucugaa

SEQ ID NO: 1568068 - RNA, 23 nt, Homo sapiens
guuuaguuuaacuuccacuguua

SEQ ID NO: 1568069 - RNA, 22 nt, Homo sapiens
guuuauuccaaaugccauccag

SEQ ID NO: 1568070 - RNA, 21 nt, Homo sapiens
guuuauuuccuagacuguuau

SEQ ID NO: 1568071 - RNA, 22 nt, Homo sapiens
guuuauuuucauucugccaaag

SEQ ID NO: 1568072 - RNA, 20 nt, Homo sapiens
guuucaaaauagacaaguuu

SEQ ID NO: 1568073 - RNA, 20 nt, Homo sapiens
guuucagccguauaguggau

SEQ ID NO: 1568074 - RNA, 17 nt, Homo sapiens
guuucuaggcaccucag

SEQ ID NO: 1568075 - RNA, 18 nt, Homo sapiens
guuucuauggauucacuu

SEQ ID NO: 1568076 - RNA, 16 nt, Homo sapiens
guuucucaagcgcuau

SEQ ID NO: 1568077 - RNA, 13 nt, Homo sapiens
guuucuccuggua

SEQ ID NO: 1568078 - RNA, 15 nt, Homo sapiens
guuucucugcuguca

SEQ ID NO: 1568079 - RNA, 18 nt, Homo sapiens
guuucugaggaucagcac

SEQ ID NO: 1568080 - RNA, 16 nt, Homo sapiens
guuucuggaagacugc

SEQ ID NO: 1568081 - RNA, 14 nt, Homo sapiens
guuucuguccugua

SEQ ID NO: 1568082 - RNA, 21 nt, Homo sapiens
guuugaaaauauuuuguugcc

SEQ ID NO: 1568083 - RNA, 22 nt, Homo sapiens
guuugaaauucugaauuugcaa

SEQ ID NO: 1568084 - RNA, 10 nt, Homo sapiens
guuugacaac

SEQ ID NO: 1568085 - RNA, 16 nt, Homo sapiens
guuugauauaccaaau

SEQ ID NO: 1568086 - RNA, 19 nt, Homo sapiens
guuugcacuuggcaaaaag

SEQ ID NO: 1568087 - RNA, 18 nt, Homo sapiens
guuugcagaaaagcaccu

SEQ ID NO: 1568088 - RNA, 15 nt, Homo sapiens
guuugcuucuugcca

SEQ ID NO: 1568089 - RNA, 16 nt, Homo sapiens
guuugcuucuugccau

SEQ ID NO: 1568090 - RNA, 21 nt, Homo sapiens
guuuggcuagguaucauucaa

SEQ ID NO: 1568091 - RNA, 14 nt, Homo sapiens
guuuggggagacag

SEQ ID NO: 1568092 - RNA, 15 nt, Homo sapiens
guuuguaaaugccuc

SEQ ID NO: 1568093 - RNA, 18 nt, Homo sapiens
guuugugguaaccagccc

SEQ ID NO: 1568094 - RNA, 17 nt, Homo sapiens
guuuguuauaucaggga

SEQ ID NO: 1568095 - RNA, 21 nt, Homo sapiens
guuuguuuauaucacugucua

SEQ ID NO: 1568096 - RNA, 20 nt, Homo sapiens
guuuuaagaaacuagcagau

SEQ ID NO: 1568097 - RNA, 13 nt, Homo sapiens
guuuuacuuuuaa

SEQ ID NO: 1568098 - RNA, 12 nt, Homo sapiens
guuuuagaacca

SEQ ID NO: 1568099 - RNA, 18 nt, Homo sapiens
guuuuauggagaccucuc

SEQ ID NO: 1568100 - RNA, 24 nt, Homo sapiens
guuuucacauaugacaauguugca

SEQ ID NO: 1568101 - RNA, 20 nt, Homo sapiens
guuuucaucauuucagccaa

SEQ ID NO: 1568102 - RNA, 12 nt, Homo sapiens
gugaacucaucc

SEQ ID NO: 1568103 - RNA, 14 nt, Homo sapiens
gugaacuccaccuc

SEQ ID NO: 1568104 - RNA, 15 nt, Homo sapiens
gugaacucuggugcu

SEQ ID NO: 1568105 - RNA, 13 nt, Homo sapiens
gugaacugagcug

SEQ ID NO: 1568106 - RNA, 20 nt, Homo sapiens
gugaagaauuuagaucuuau

SEQ ID NO: 1568107 - RNA, 18 nt, Homo sapiens
gugaagcagcacugugag

SEQ ID NO: 1568108 - RNA, 14 nt, Homo sapiens
gugaagccucugag

SEQ ID NO: 1568109 - RNA, 23 nt, Homo sapiens
gugaagucucuggguggaagugu

SEQ ID NO: 1568110 - RNA, 16 nt, Homo sapiens
gugaauaaaccaucau

SEQ ID NO: 1568111 - RNA, 16 nt, Homo sapiens
gugaaugaacacucuu

SEQ ID NO: 1568112 - RNA, 12 nt, Homo sapiens
gugaaugcuucu

SEQ ID NO: 1568113 - RNA, 17 nt, Homo sapiens
gugaauuaaaguacuuu

SEQ ID NO: 1568114 - RNA, 18 nt, Homo sapiens
gugaauuauugacacuga

SEQ ID NO: 1568115 - RNA, 19 nt, Homo sapiens
gugaauuauugacacugaa

SEQ ID NO: 1568116 - RNA, 23 nt, Homo sapiens
gugaauuuguuugugacaacuaa

SEQ ID NO: 1568117 - RNA, 14 nt, Homo sapiens
gugaauuuuugcaa

SEQ ID NO: 1568118 - RNA, 11 nt, Homo sapiens
gugacagucau

SEQ ID NO: 1568119 - RNA, 14 nt, Homo sapiens
gugacaucauucag

SEQ ID NO: 1568120 - RNA, 17 nt, Homo sapiens
gugacauuuccaugcau

SEQ ID NO: 1568121 - RNA, 17 nt, Homo sapiens
gugaccaguggggcccu

SEQ ID NO: 1568122 - RNA, 18 nt, Homo sapiens
gugacgugguagucacuu

SEQ ID NO: 1568123 - RNA, 19 nt, Homo sapiens
gugacucagcaucacccac

SEQ ID NO: 1568124 - RNA, 17 nt, Homo sapiens
gugacuccugaaaccuc

SEQ ID NO: 1568125 - RNA, 16 nt, Homo sapiens
gugacucuaccugcaa

SEQ ID NO: 1568126 - RNA, 12 nt, Homo sapiens
gugacuuucuaa

SEQ ID NO: 1568127 - RNA, 16 nt, Homo sapiens
gugagaccauguuuca

SEQ ID NO: 1568128 - RNA, 12 nt, Homo sapiens
gugagacccagc

SEQ ID NO: 1568129 - RNA, 22 nt, Homo sapiens
gugagccaagagugcacuacug

SEQ ID NO: 1568130 - RNA, 13 nt, Homo sapiens
gugagcugugagu

SEQ ID NO: 1568131 - RNA, 19 nt, Homo sapiens
gugaggcggcccugaccaa

SEQ ID NO: 1568132 - RNA, 15 nt, Homo sapiens
gugagggugcugacu

SEQ ID NO: 1568133 - RNA, 22 nt, Homo sapiens
gugaguauaaaauaaagcaaau

SEQ ID NO: 1568134 - RNA, 13 nt, Homo sapiens
gugagucuucacu

SEQ ID NO: 1568135 - RNA, 20 nt, Homo sapiens
gugagugccuccuguggucu

SEQ ID NO: 1568136 - RNA, 22 nt, Homo sapiens
gugaguuuuacucuuaaaucau

SEQ ID NO: 1568137 - RNA, 23 nt, Homo sapiens
gugauaaguugaggaaagaaaua

SEQ ID NO: 1568138 - RNA, 17 nt, Homo sapiens
gugauccacccaccucg

SEQ ID NO: 1568139 - RNA, 18 nt, Homo sapiens
gugaucuugagaaccuuu

SEQ ID NO: 1568140 - RNA, 14 nt, Homo sapiens
gugaugucauuuga

SEQ ID NO: 1568141 - RNA, 21 nt, Homo sapiens
gugauuggccacacacugagu

SEQ ID NO: 1568142 - RNA, 18 nt, Homo sapiens
gugauuuggaccauggca

SEQ ID NO: 1568143 - RNA, 13 nt, Homo sapiens
gugcaaagggaac

SEQ ID NO: 1568144 - RNA, 18 nt, Homo sapiens
gugcacaauaaagggggu

SEQ ID NO: 1568145 - RNA, 16 nt, Homo sapiens
gugcacaucugugucu

SEQ ID NO: 1568146 - RNA, 12 nt, Homo sapiens
gugcacauguac

SEQ ID NO: 1568147 - RNA, 17 nt, Homo sapiens
gugcaccuguaauccca

SEQ ID NO: 1568148 - RNA, 20 nt, Homo sapiens
gugcacuccccguguucaua

SEQ ID NO: 1568149 - RNA, 19 nt, Homo sapiens
ugaucucccucuaagcaca

SEQ ID NO: 1568150 - RNA, 19 nt, Homo sapiens
ugaucucggcucacugcaa

SEQ ID NO: 1568151 - RNA, 17 nt, Homo sapiens
ugaucugucuguggcaa

SEQ ID NO: 1568152 - RNA, 22 nt, Homo sapiens
ugaucuguuuuacaggaaacaa

SEQ ID NO: 1568153 - RNA, 22 nt, Homo sapiens
ugaucuucagggaacugcauag

SEQ ID NO: 1568154 - RNA, 21 nt, Homo sapiens
ugaucuuuguuuaaaugccaa

SEQ ID NO: 1568155 - RNA, 17 nt, Homo sapiens
ugaugaacuuauaauga

SEQ ID NO: 1568156 - RNA, 12 nt, Homo sapiens
ugaugaagucac

SEQ ID NO: 1568157 - RNA, 23 nt, Homo sapiens
ugaugagucgguccucuuuccag

SEQ ID NO: 1568158 - RNA, 15 nt, Homo sapiens
ugaugcaggcacuua

SEQ ID NO: 1568159 - RNA, 14 nt, Homo sapiens
ugaugcugugcuau

SEQ ID NO: 1568160 - RNA, 14 nt, Homo sapiens
ugauggcugaagaa

SEQ ID NO: 1568161 - RNA, 16 nt, Homo sapiens
ugauggucggugguug

SEQ ID NO: 1568162 - RNA, 21 nt, Homo sapiens
ugauggucucaagcuaugauc

SEQ ID NO: 1568163 - RNA, 16 nt, Homo sapiens
ugaugucuccacuuuc

SEQ ID NO: 1568164 - RNA, 14 nt, Homo sapiens
ugauguggaugaaa

SEQ ID NO: 1568165 - RNA, 20 nt, Homo sapiens
ugauguuuguggccucagaa

SEQ ID NO: 1568166 - RNA, 21 nt, Homo sapiens
ugauguuuugguguauuguca

SEQ ID NO: 1568167 - RNA, 22 nt, Homo sapiens
ugauguuuuuucuguaauguaa

SEQ ID NO: 1568168 - RNA, 16 nt, Homo sapiens
ugauuaaagugcucac

SEQ ID NO: 1568169 - RNA, 15 nt, Homo sapiens
ugauuaccugccaau

SEQ ID NO: 1568170 - RNA, 22 nt, Homo sapiens
ugauuagagggaugagacagac

SEQ ID NO: 1568171 - RNA, 23 nt, Homo sapiens
ugauuauccauauugagucaaau

SEQ ID NO: 1568172 - RNA, 13 nt, Homo sapiens
ugauucaagccau

SEQ ID NO: 1568173 - RNA, 20 nt, Homo sapiens
ugauucaagccauuccaaag

SEQ ID NO: 1568174 - RNA, 22 nt, Homo sapiens
ugauucaggggucugaugacac

SEQ ID NO: 1568175 - RNA, 13 nt, Homo sapiens
ugauucuaugucu

SEQ ID NO: 1568176 - RNA, 13 nt, Homo sapiens
ugauuguagcuau

SEQ ID NO: 1568177 - RNA, 20 nt, Homo sapiens
ugauuguauaaaugcaauaa

SEQ ID NO: 1568178 - RNA, 15 nt, Homo sapiens
ugauuguauuuaccu

SEQ ID NO: 1568179 - RNA, 17 nt, Homo sapiens
ugauuguggaauggaga

SEQ ID NO: 1568180 - RNA, 15 nt, Homo sapiens
ugauuuaguacuugu

SEQ ID NO: 1568181 - RNA, 16 nt, Homo sapiens
ugauuuagugaucaaa

SEQ ID NO: 1568182 - RNA, 17 nt, Homo sapiens
ugauuucauauugaucu

SEQ ID NO: 1568183 - RNA, 14 nt, Homo sapiens
ugauuucugcccuu

SEQ ID NO: 1568184 - RNA, 18 nt, Homo sapiens
ugauuuuaaauggauguc

SEQ ID NO: 1568185 - RNA, 19 nt, Homo sapiens
ugcaaaaaugaaauccagu

SEQ ID NO: 1568186 - RNA, 20 nt, Homo sapiens
ugcaaaaaugacccaagaga

SEQ ID NO: 1568187 - RNA, 13 nt, Homo sapiens
ugcaaaacuuuag

SEQ ID NO: 1568188 - RNA, 20 nt, Homo sapiens
ugcaaaaguaaauguugaca

SEQ ID NO: 1568189 - RNA, 18 nt, Homo sapiens
ugcaaaauauuugacuau

SEQ ID NO: 1568190 - RNA, 21 nt, Homo sapiens
ugcaaaaucuccaauccacac

SEQ ID NO: 1568191 - RNA, 19 nt, Homo sapiens
ugcaaaaugggaacaauga

SEQ ID NO: 1568192 - RNA, 15 nt, Homo sapiens
ugcaaacuuguuaga

SEQ ID NO: 1568193 - RNA, 16 nt, Homo sapiens
ugcaaagaacggugau

SEQ ID NO: 1568194 - RNA, 14 nt, Homo sapiens
ugcaaaguaaggag

SEQ ID NO: 1568195 - RNA, 15 nt, Homo sapiens
ugcaaaguacuguaa

SEQ ID NO: 1568196 - RNA, 14 nt, Homo sapiens
ugcaaauacuguau

SEQ ID NO: 1568197 - RNA, 17 nt, Homo sapiens
ugcaaauugugaaauag

SEQ ID NO: 1568198 - RNA, 20 nt, Homo sapiens
ugcaacaauaaaguacuuua

SEQ ID NO: 1568199 - RNA, 20 nt, Homo sapiens
ugcaaccacugcaauaucuu

SEQ ID NO: 1568200 - RNA, 14 nt, Homo sapiens
ugcaaccucugccu

SEQ ID NO: 1568201 - RNA, 14 nt, Homo sapiens
ugcaacuucugccu

SEQ ID NO: 1568202 - RNA, 20 nt, Homo sapiens
ugcaagaaggauaccaaaua

SEQ ID NO: 1568203 - RNA, 19 nt, Homo sapiens
ugcaagacagcacaggcaa

SEQ ID NO: 1568204 - RNA, 12 nt, Homo sapiens
ugcaagcacucg

SEQ ID NO: 1568205 - RNA, 22 nt, Homo sapiens
ugcaagccccucuuucuguccc

SEQ ID NO: 1568206 - RNA, 21 nt, Homo sapiens
ugcaaggauuacacauuucac

SEQ ID NO: 1568207 - RNA, 16 nt, Homo sapiens
ugcaaguguaucuccu

SEQ ID NO: 1568208 - RNA, 19 nt, Homo sapiens
ugcaauaacaagcaugcau

SEQ ID NO: 1568209 - RNA, 14 nt, Homo sapiens
ugcaauacauuuca

SEQ ID NO: 1568210 - RNA, 15 nt, Homo sapiens
ugcaauaccaauguu

SEQ ID NO: 1568211 - RNA, 18 nt, Homo sapiens
ugcaauaccaauguucua

SEQ ID NO: 1568212 - RNA, 19 nt, Homo sapiens
ugcaauaccaauguucuaa

SEQ ID NO: 1568213 - RNA, 16 nt, Homo sapiens
ugcaauaugaauucaa

SEQ ID NO: 1568214 - RNA, 13 nt, Homo sapiens
ugcaauguuuuag

SEQ ID NO: 1568215 - RNA, 13 nt, Homo sapiens
ugcaauuccaaga

SEQ ID NO: 1568216 - RNA, 11 nt, Homo sapiens
ugcacaaacaa

SEQ ID NO: 1568217 - RNA, 15 nt, Homo sapiens
ugcacacacaugcau

SEQ ID NO: 1568218 - RNA, 21 nt, Homo sapiens
ugcacaccagagacaagcaga

SEQ ID NO: 1568219 - RNA, 20 nt, Homo sapiens
ugcacagauaaguaggccau

SEQ ID NO: 1568220 - RNA, 17 nt, Homo sapiens
ugcacagcaggcugcca

SEQ ID NO: 1568221 - RNA, 13 nt, Homo sapiens
ugcacagucauac

SEQ ID NO: 1568222 - RNA, 21 nt, Homo sapiens
ugcacaucuguaaaucuacac

SEQ ID NO: 1568223 - RNA, 14 nt, Homo sapiens
ugcacaugccucug

SEQ ID NO: 1568224 - RNA, 17 nt, Homo sapiens
ugcacauguacccuaaa

SEQ ID NO: 1568225 - RNA, 23 nt, Homo sapiens
ugcacauuaaggagaaaucuaua

SEQ ID NO: 1568226 - RNA, 17 nt, Homo sapiens
ugcaccacaccuggcau

SEQ ID NO: 1568227 - RNA, 20 nt, Homo sapiens
ugcaccacuuccgucccauc

SEQ ID NO: 1568228 - RNA, 17 nt, Homo sapiens
ugcaccaggggugcaca

SEQ ID NO: 1568229 - RNA, 15 nt, Homo sapiens
ugcacguugugcaca

SEQ ID NO: 1568230 - RNA, 20 nt, Homo sapiens
ugcacguugugcacauguac

SEQ ID NO: 1568231 - RNA, 13 nt, Homo sapiens
ugcacuacuccuc

SEQ ID NO: 1568232 - RNA, 23 nt, Homo sapiens
ugcacuacuccucugcagugccu

SEQ ID NO: 1568233 - RNA, 15 nt, Homo sapiens
ugcacucacuccuga

SEQ ID NO: 1568234 - RNA, 22 nt, Homo sapiens
ugcacuccagccugagugacag

SEQ ID NO: 1568235 - RNA, 17 nt, Homo sapiens
ugcacuccuacugaguu

SEQ ID NO: 1568236 - RNA, 22 nt, Homo sapiens
ugcacuuauaagaaagaucaaa

SEQ ID NO: 1568237 - RNA, 15 nt, Homo sapiens
ugcacuucaaauuca

SEQ ID NO: 1568238 - RNA, 20 nt, Homo sapiens
ugcacuucaaauucaaauaa

SEQ ID NO: 1568239 - RNA, 15 nt, Homo sapiens
ugcacuuguggcaac

SEQ ID NO: 1568240 - RNA, 20 nt, Homo sapiens
ugcacuuguggcaacagaua

SEQ ID NO: 1568241 - RNA, 12 nt, Homo sapiens
ugcagacuuccc

SEQ ID NO: 1568242 - RNA, 13 nt, Homo sapiens
ugcagcacgccaa

SEQ ID NO: 1568243 - RNA, 13 nt, Homo sapiens
ugcagcagucgcc

SEQ ID NO: 1568244 - RNA, 22 nt, Homo sapiens
ugcagccacuggcuuggaacac

SEQ ID NO: 1568245 - RNA, 13 nt, Homo sapiens
ugcagcuacugga

SEQ ID NO: 1568246 - RNA, 15 nt, Homo sapiens
ugcagcucaacuuuc

SEQ ID NO: 1568247 - RNA, 15 nt, Homo sapiens
ugcagcucugaccca

SEQ ID NO: 1568248 - RNA, 18 nt, Homo sapiens
ugcaggagcuaguucuca

SEQ ID NO: 1568249 - RNA, 20 nt, Homo sapiens
ugcaggagcuaguucucagc

SEQ ID NO: 1568250 - RNA, 21 nt, Homo sapiens
ugcaggagcuaguucucagcu

SEQ ID NO: 1568251 - RNA, 22 nt, Homo sapiens
ugcaggaucugucugugcacau

SEQ ID NO: 1568252 - RNA, 15 nt, Homo sapiens
ugcagggccacugga

SEQ ID NO: 1568253 - RNA, 16 nt, Homo sapiens
ugcagggccacuggaa

SEQ ID NO: 1568254 - RNA, 12 nt, Homo sapiens
ugcagggguccc

SEQ ID NO: 1568255 - RNA, 13 nt, Homo sapiens
ugcaggggucccc

SEQ ID NO: 1568256 - RNA, 19 nt, Homo sapiens
ugcagggguccccccucaa

SEQ ID NO: 1568257 - RNA, 13 nt, Homo sapiens
ugcaguaguauuu

SEQ ID NO: 1568258 - RNA, 20 nt, Homo sapiens
ugcaguaucucuuacaucag

SEQ ID NO: 1568259 - RNA, 19 nt, Homo sapiens
ugcaguaugaacuauugcc

SEQ ID NO: 1568260 - RNA, 16 nt, Homo sapiens
ugcaguaugguacauu

SEQ ID NO: 1568261 - RNA, 22 nt, Homo sapiens
ugcagucacaucacaauauuca

SEQ ID NO: 1568262 - RNA, 12 nt, Homo sapiens
ugcagucacugg

SEQ ID NO: 1568263 - RNA, 18 nt, Homo sapiens
ugcaguggugugaucucg

SEQ ID NO: 1568264 - RNA, 14 nt, Homo sapiens
ugcaguuccaucag

SEQ ID NO: 1568265 - RNA, 19 nt, Homo sapiens
ugcaguuucaaguaccaaa

SEQ ID NO: 1568266 - RNA, 22 nt, Homo sapiens
ugcaguuugaaauucugaauuu

SEQ ID NO: 1568267 - RNA, 20 nt, Homo sapiens
ugcuaaggcagcugauccag

SEQ ID NO: 1568268 - RNA, 13 nt, Homo sapiens
ugcuaauguugcu

SEQ ID NO: 1568269 - RNA, 14 nt, Homo sapiens
ugcuacaauucauu

SEQ ID NO: 1568270 - RNA, 20 nt, Homo sapiens
ugcuacaguuauuaaucugg

SEQ ID NO: 1568271 - RNA, 19 nt, Homo sapiens
ugcuacaguuuuuccuaaa

SEQ ID NO: 1568272 - RNA, 16 nt, Homo sapiens
ugcuacauauaugcaa

SEQ ID NO: 1568273 - RNA, 18 nt, Homo sapiens
ugcuacccuggcuggcag

SEQ ID NO: 1568274 - RNA, 23 nt, Homo sapiens
ugcuaccucagugcuccuggaaa

SEQ ID NO: 1568275 - RNA, 20 nt, Homo sapiens
ugcuacuauaaucaaaugau

SEQ ID NO: 1568276 - RNA, 16 nt, Homo sapiens
ugcuagucacuggaaa

SEQ ID NO: 1568277 - RNA, 18 nt, Homo sapiens
ugcuauauaaauauguca

SEQ ID NO: 1568278 - RNA, 16 nt, Homo sapiens
ugcuaucccacuguau

SEQ ID NO: 1568279 - RNA, 16 nt, Homo sapiens
ugcuauccccaucucc

SEQ ID NO: 1568280 - RNA, 14 nt, Homo sapiens
ugcuaugugccuua

SEQ ID NO: 1568281 - RNA, 15 nt, Homo sapiens
ugcuauuacuaguac

SEQ ID NO: 1568282 - RNA, 20 nt, Homo sapiens
ugcucaaaaucuuuccaaau

SEQ ID NO: 1568283 - RNA, 18 nt, Homo sapiens
ugcucaaauuacuaauga

SEQ ID NO: 1568284 - RNA, 18 nt, Homo sapiens
ugcucaaucccugaggac

SEQ ID NO: 1568285 - RNA, 13 nt, Homo sapiens
ugcucaccaagga

SEQ ID NO: 1568286 - RNA, 12 nt, Homo sapiens
ugcucaccagcc

SEQ ID NO: 1568287 - RNA, 20 nt, Homo sapiens
ugcucaccaugcuuccagcu

SEQ ID NO: 1568288 - RNA, 21 nt, Homo sapiens
ugcucaccucuucuuuaccag

SEQ ID NO: 1568289 - RNA, 24 nt, Homo sapiens
ugcucagucccuacugaguacucu

SEQ ID NO: 1568290 - RNA, 13 nt, Homo sapiens
ugcucagugcuug

SEQ ID NO: 1568291 - RNA, 18 nt, Homo sapiens
ugcucauacuacauugag

SEQ ID NO: 1568292 - RNA, 17 nt, Homo sapiens
ugcucauguauauuuag

SEQ ID NO: 1568293 - RNA, 19 nt, Homo sapiens
ugcuccaaccaguccucag

SEQ ID NO: 1568294 - RNA, 12 nt, Homo sapiens
ugcuccaccagc

SEQ ID NO: 1568295 - RNA, 13 nt, Homo sapiens
ugcuccaccagca

SEQ ID NO: 1568296 - RNA, 12 nt, Homo sapiens
ugcuccaucucc

SEQ ID NO: 1568297 - RNA, 17 nt, Homo sapiens
ugcucccaacccauuca

SEQ ID NO: 1568298 - RNA, 18 nt, Homo sapiens
ugcucccaguccugccug

SEQ ID NO: 1568299 - RNA, 14 nt, Homo sapiens
ugcuccccugugaa

SEQ ID NO: 1568300 - RNA, 21 nt, Homo sapiens
ugcuccgaggacccaggaaag

SEQ ID NO: 1568301 - RNA, 15 nt, Homo sapiens
ugcuccugcaucuca

SEQ ID NO: 1568302 - RNA, 13 nt, Homo sapiens
ugcucgcugagaa

SEQ ID NO: 1568303 - RNA, 16 nt, Homo sapiens
ugcucggacacaguuu

SEQ ID NO: 1568304 - RNA, 16 nt, Homo sapiens
ugcucuauauguaaua

SEQ ID NO: 1568305 - RNA, 18 nt, Homo sapiens
ugcucuccuucacucuga

SEQ ID NO: 1568306 - RNA, 13 nt, Homo sapiens
ugcucucuucaau

SEQ ID NO: 1568307 - RNA, 15 nt, Homo sapiens
ugcucugcaaaagga

SEQ ID NO: 1568308 - RNA, 20 nt, Homo sapiens
ugcugagaccccccaccacc

SEQ ID NO: 1568309 - RNA, 12 nt, Homo sapiens
ugcugauccaga

SEQ ID NO: 1568310 - RNA, 17 nt, Homo sapiens
ugcugcaaauacuguau

SEQ ID NO: 1568311 - RNA, 20 nt, Homo sapiens
ugcugcagguggcagaguga

SEQ ID NO: 1568312 - RNA, 15 nt, Homo sapiens
ugcugcagucaucua

SEQ ID NO: 1568313 - RNA, 15 nt, Homo sapiens
ugcugccagcucuca

SEQ ID NO: 1568314 - RNA, 20 nt, Homo sapiens
ugcugcccagcagccccuga

SEQ ID NO: 1568315 - RNA, 14 nt, Homo sapiens
ugcugcuccugaua

SEQ ID NO: 1568316 - RNA, 18 nt, Homo sapiens
ugcugcuuucuuguugcu

SEQ ID NO: 1568317 - RNA, 16 nt, Homo sapiens
ugcuggcucaggagga

SEQ ID NO: 1568318 - RNA, 18 nt, Homo sapiens
ugcugggcugggcccucu

SEQ ID NO: 1568319 - RNA, 18 nt, Homo sapiens
ugcuggguccauaucaca

SEQ ID NO: 1568320 - RNA, 21 nt, Homo sapiens
ugcugguguugagaccaagua

SEQ ID NO: 1568321 - RNA, 21 nt, Homo sapiens
ugcuguagaagauggcacuua

SEQ ID NO: 1568322 - RNA, 20 nt, Homo sapiens
ugcuguagacauuugcuaug

SEQ ID NO: 1568323 - RNA, 21 nt, Homo sapiens
ugcuguagacauuugcuauga

SEQ ID NO: 1568324 - RNA, 15 nt, Homo sapiens
ugcuguauccaucca

SEQ ID NO: 1568325 - RNA, 18 nt, Homo sapiens
ugcuguauccauccaugg

SEQ ID NO: 1568326 - RNA, 17 nt, Homo sapiens
ugcuguccaugcuucuc

SEQ ID NO: 1568327 - RNA, 13 nt, Homo sapiens
ugcugucugagua

SEQ ID NO: 1568328 - RNA, 14 nt, Homo sapiens
ugcugugacuuccu

SEQ ID NO: 1568329 - RNA, 14 nt, Homo sapiens
ugcugugauuccac

SEQ ID NO: 1568330 - RNA, 16 nt, Homo sapiens
ugcuguggguuuccaa

SEQ ID NO: 1568331 - RNA, 22 nt, Homo sapiens
ugcuguguggacuucaucucaa

SEQ ID NO: 1568332 - RNA, 21 nt, Homo sapiens
ugcuucaauuucaaacuuuug

SEQ ID NO: 1568333 - RNA, 13 nt, Homo sapiens
ugcuucagaccau

SEQ ID NO: 1568334 - RNA, 14 nt, Homo sapiens
ugcuuccuccucag

SEQ ID NO: 1568335 - RNA, 20 nt, Homo sapiens
ugcuucucaucccaaccucu

SEQ ID NO: 1568336 - RNA, 16 nt, Homo sapiens
ugcuucuccccagaau

SEQ ID NO: 1568337 - RNA, 22 nt, Homo sapiens
ugcuucuggcuaccuguuugaa

SEQ ID NO: 1568338 - RNA, 24 nt, Homo sapiens
ugcuucuguuaacugaagccugcu

SEQ ID NO: 1568339 - RNA, 15 nt, Homo sapiens
ugcuucuugccauca

SEQ ID NO: 1568340 - RNA, 18 nt, Homo sapiens
ugcuugcccgcucccaca

SEQ ID NO: 1568341 - RNA, 14 nt, Homo sapiens
ugcuuggauuuuga

SEQ ID NO: 1568342 - RNA, 17 nt, Homo sapiens
ugcuuuaauaaaucacu

SEQ ID NO: 1568343 - RNA, 16 nt, Homo sapiens
ugcuuuagccauacac

SEQ ID NO: 1568344 - RNA, 16 nt, Homo sapiens
ugcuuuagucauauau

SEQ ID NO: 1568345 - RNA, 13 nt, Homo sapiens
ugcuuucaucuaa

SEQ ID NO: 1568346 - RNA, 16 nt, Homo sapiens
ugcuuuccagacuuug

SEQ ID NO: 1568347 - RNA, 18 nt, Homo sapiens
ugcuuuccaucuccagga

SEQ ID NO: 1568348 - RNA, 17 nt, Homo sapiens
ugcuuucuauuguacag

SEQ ID NO: 1568349 - RNA, 17 nt, Homo sapiens
ugcuuuuaaaagugcac

SEQ ID NO: 1568350 - RNA, 15 nt, Homo sapiens
ugcuuuuaacucuag

SEQ ID NO: 1568351 - RNA, 15 nt, Homo sapiens
ugcuuuuaucacuua

SEQ ID NO: 1568352 - RNA, 18 nt, Homo sapiens
ugcuuuuccucugccuuc

SEQ ID NO: 1568353 - RNA, 16 nt, Homo sapiens
ugcuuuugcuucuaga

SEQ ID NO: 1568354 - RNA, 23 nt, Homo sapiens
uggaaaagugauguauuuucaua

SEQ ID NO: 1568355 - RNA, 22 nt, Homo sapiens
uggaaacauggaggaacaguau

SEQ ID NO: 1568356 - RNA, 22 nt, Homo sapiens
uggaaaccaaggaaagugaaac

SEQ ID NO: 1568357 - RNA, 22 nt, Homo sapiens
uggaaagucaugcaaucccauu

SEQ ID NO: 1568358 - RNA, 17 nt, Homo sapiens
uggaaaguuuucuccac

SEQ ID NO: 1568359 - RNA, 21 nt, Homo sapiens
uggaaauaaagucagauggaa

SEQ ID NO: 1568360 - RNA, 22 nt, Homo sapiens
uggaaauagaaagaagccauau

SEQ ID NO: 1568361 - RNA, 17 nt, Homo sapiens
uggaaaugaccaggcca

SEQ ID NO: 1568362 - RNA, 20 nt, Homo sapiens
uggaaaugguuucacuugcu

SEQ ID NO: 1568363 - RNA, 15 nt, Homo sapiens
uggaaauguauuuua

SEQ ID NO: 1568364 - RNA, 16 nt, Homo sapiens
uggaaauugaggucca

SEQ ID NO: 1568365 - RNA, 19 nt, Homo sapiens
uggaaauugcaguaacaaa

SEQ ID NO: 1568366 - RNA, 15 nt, Homo sapiens
uggaacagauuucaa

SEQ ID NO: 1568367 - RNA, 14 nt, Homo sapiens
uggaaccccagcuu

SEQ ID NO: 1568368 - RNA, 16 nt, Homo sapiens
uggaacccccaucucu

SEQ ID NO: 1568369 - RNA, 16 nt, Homo sapiens
uggaaccugcaaaaaa

SEQ ID NO: 1568370 - RNA, 15 nt, Homo sapiens
uggaacuguccuucc

SEQ ID NO: 1568371 - RNA, 18 nt, Homo sapiens
uccuagauuacaucugcc

SEQ ID NO: 1568372 - RNA, 21 nt, Homo sapiens
uccuagauuacaucugccuua

SEQ ID NO: 1568373 - RNA, 20 nt, Homo sapiens
uccuaguaauaaagugaaau

SEQ ID NO: 1568374 - RNA, 13 nt, Homo sapiens
uccuauaccuuac

SEQ ID NO: 1568375 - RNA, 15 nt, Homo sapiens
uccuaugcugcaaua

SEQ ID NO: 1568376 - RNA, 20 nt, Homo sapiens
uccuauggguugucaccaag

SEQ ID NO: 1568377 - RNA, 13 nt, Homo sapiens
uccuauuccuuca

SEQ ID NO: 1568378 - RNA, 19 nt, Homo sapiens
uccuauuccuucacacagu

SEQ ID NO: 1568379 - RNA, 16 nt, Homo sapiens
uccuauuuucgaugaa

SEQ ID NO: 1568380 - RNA, 14 nt, Homo sapiens
uccucaaagggaga

SEQ ID NO: 1568381 - RNA, 12 nt, Homo sapiens
uccucacaauga

SEQ ID NO: 1568382 - RNA, 15 nt, Homo sapiens
uccucaccaagcuca

SEQ ID NO: 1568383 - RNA, 16 nt, Homo sapiens
uccucacuguauccag

SEQ ID NO: 1568384 - RNA, 15 nt, Homo sapiens
uccucacuucuagau

SEQ ID NO: 1568385 - RNA, 21 nt, Homo sapiens
uccucaggugauuuguaugcu

SEQ ID NO: 1568386 - RNA, 19 nt, Homo sapiens
uccucauccccacaaucug

SEQ ID NO: 1568387 - RNA, 21 nt, Homo sapiens
uccuccagcccagacccagug

SEQ ID NO: 1568388 - RNA, 22 nt, Homo sapiens
uccuccagcccagacccagugg

SEQ ID NO: 1568389 - RNA, 18 nt, Homo sapiens
uccuccagugcauacugu

SEQ ID NO: 1568390 - RNA, 19 nt, Homo sapiens
uccuccaucaauucuguau

SEQ ID NO: 1568391 - RNA, 14 nt, Homo sapiens
uccuccaugggaga

SEQ ID NO: 1568392 - RNA, 13 nt, Homo sapiens
uccucccagugag

SEQ ID NO: 1568393 - RNA, 15 nt, Homo sapiens
uccucccauuuccca

SEQ ID NO: 1568394 - RNA, 19 nt, Homo sapiens
uccucccauuucccauuaa

SEQ ID NO: 1568395 - RNA, 16 nt, Homo sapiens
uccucccccaguuccu

SEQ ID NO: 1568396 - RNA, 14 nt, Homo sapiens
uccucccucagacc

SEQ ID NO: 1568397 - RNA, 15 nt, Homo sapiens
uccuccuacuguauu

SEQ ID NO: 1568398 - RNA, 22 nt, Homo sapiens
uccuccuuuaccuuucagugca

SEQ ID NO: 1568399 - RNA, 19 nt, Homo sapiens
uccucucaagcuagccaga

SEQ ID NO: 1568400 - RNA, 15 nt, Homo sapiens
uccucugaaacagcu

SEQ ID NO: 1568401 - RNA, 10 nt, Homo sapiens
uccucugcau

SEQ ID NO: 1568402 - RNA, 20 nt, Homo sapiens
uccucugcccgggagcucag

SEQ ID NO: 1568403 - RNA, 16 nt, Homo sapiens
uccucugggcccuguc

SEQ ID NO: 1568404 - RNA, 16 nt, Homo sapiens
uccucuuucaaccuca

SEQ ID NO: 1568405 - RNA, 19 nt, Homo sapiens
uccugaaaaggguguugcu

SEQ ID NO: 1568406 - RNA, 16 nt, Homo sapiens
uccugaaaauugcaau

SEQ ID NO: 1568407 - RNA, 13 nt, Homo sapiens
uccugaacuucac

SEQ ID NO: 1568408 - RNA, 22 nt, Homo sapiens
uccugaggaagagggacuguuc

SEQ ID NO: 1568409 - RNA, 19 nt, Homo sapiens
uccugaggggcaucugccc

SEQ ID NO: 1568410 - RNA, 20 nt, Homo sapiens
uccugcccucacaucuucca

SEQ ID NO: 1568411 - RNA, 18 nt, Homo sapiens
uccugcguagaagauaug

SEQ ID NO: 1568412 - RNA, 22 nt, Homo sapiens
uccugcguagaagauauggaag

SEQ ID NO: 1568413 - RNA, 19 nt, Homo sapiens
uccugcucuuuugugauga

SEQ ID NO: 1568414 - RNA, 22 nt, Homo sapiens
uccugcugcccuuaggccacau

SEQ ID NO: 1568415 - RNA, 21 nt, Homo sapiens
uccuggaaacuuagcuuuuga

SEQ ID NO: 1568416 - RNA, 15 nt, Homo sapiens
uccuggauucacuca

SEQ ID NO: 1568417 - RNA, 23 nt, Homo sapiens
uccuggcaucaguagcaucugua

SEQ ID NO: 1568418 - RNA, 15 nt, Homo sapiens
uccuggccuggccau

SEQ ID NO: 1568419 - RNA, 17 nt, Homo sapiens
uccugggacaaccagac

SEQ ID NO: 1568420 - RNA, 13 nt, Homo sapiens
uccugggacccuu

SEQ ID NO: 1568421 - RNA, 15 nt, Homo sapiens
uccugggagcacugc

SEQ ID NO: 1568422 - RNA, 22 nt, Homo sapiens
uccugggcucaagcaauccucc

SEQ ID NO: 1568423 - RNA, 14 nt, Homo sapiens
uccugggugcauca

SEQ ID NO: 1568424 - RNA, 16 nt, Homo sapiens
uccugguuuuugccua

SEQ ID NO: 1568425 - RNA, 23 nt, Homo sapiens
uccuguaagaagcggcauagcac

SEQ ID NO: 1568426 - RNA, 16 nt, Homo sapiens
uccuguaggcuaaaag

SEQ ID NO: 1568427 - RNA, 17 nt, Homo sapiens
uccuguauuuaacaaaa

SEQ ID NO: 1568428 - RNA, 20 nt, Homo sapiens
uccuguauuuaacaaaaagu

SEQ ID NO: 1568429 - RNA, 13 nt, Homo sapiens
uccugucccucau

SEQ ID NO: 1568430 - RNA, 19 nt, Homo sapiens
uccugucccucauccauag

SEQ ID NO: 1568431 - RNA, 17 nt, Homo sapiens
uccugugaccacaacau

SEQ ID NO: 1568432 - RNA, 20 nt, Homo sapiens
uccuguggccugcucaucac

SEQ ID NO: 1568433 - RNA, 15 nt, Homo sapiens
uccugugucacugaa

SEQ ID NO: 1568434 - RNA, 19 nt, Homo sapiens
uccuguucacaccagagaa

SEQ ID NO: 1568435 - RNA, 23 nt, Homo sapiens
uccuguucacaccagagaaccag

SEQ ID NO: 1568436 - RNA, 16 nt, Homo sapiens
uccuguucagcauucu

SEQ ID NO: 1568437 - RNA, 15 nt, Homo sapiens
uccuguuugucuaca

SEQ ID NO: 1568438 - RNA, 21 nt, Homo sapiens
uccuguuuuucacauuuuccu

SEQ ID NO: 1568439 - RNA, 22 nt, Homo sapiens
uccuuaggaaaaacaugagcau

SEQ ID NO: 1568440 - RNA, 14 nt, Homo sapiens
uccuuaggccucug

SEQ ID NO: 1568441 - RNA, 20 nt, Homo sapiens
uccuuaugacuccauucaaa

SEQ ID NO: 1568442 - RNA, 14 nt, Homo sapiens
uccuuauuugccuu

SEQ ID NO: 1568443 - RNA, 19 nt, Homo sapiens
uccuucaacuggcuacuga

SEQ ID NO: 1568444 - RNA, 20 nt, Homo sapiens
uccuucaacuggcuacugag

SEQ ID NO: 1568445 - RNA, 16 nt, Homo sapiens
uccuucacacaguuca

SEQ ID NO: 1568446 - RNA, 22 nt, Homo sapiens
uccuucccacccccaguccugu

SEQ ID NO: 1568447 - RNA, 22 nt, Homo sapiens
uccuucccucaaagaggccuua

SEQ ID NO: 1568448 - RNA, 16 nt, Homo sapiens
uccuugaccugcauug

SEQ ID NO: 1568449 - RNA, 19 nt, Homo sapiens
uccuugacgucguuuuaca

SEQ ID NO: 1568450 - RNA, 20 nt, Homo sapiens
uccuuggcuucuuuacuuag

SEQ ID NO: 1568451 - RNA, 15 nt, Homo sapiens
uccuuguauucugag

SEQ ID NO: 1568452 - RNA, 20 nt, Homo sapiens
uccuugucaacaaagugcuu

SEQ ID NO: 1568453 - RNA, 22 nt, Homo sapiens
uccuugugcaaaauauuugacu

SEQ ID NO: 1568454 - RNA, 23 nt, Homo sapiens
uccuugugcaaaauauuugacua

SEQ ID NO: 1568455 - RNA, 17 nt, Homo sapiens
uccuuuccccucccuca

SEQ ID NO: 1568456 - RNA, 19 nt, Homo sapiens
uccuuuccuccucugacuu

SEQ ID NO: 1568457 - RNA, 13 nt, Homo sapiens
uccuuugugcuua

SEQ ID NO: 1568458 - RNA, 17 nt, Homo sapiens
uccuuuuugacacugaa

SEQ ID NO: 1568459 - RNA, 17 nt, Homo sapiens
ucgaagggauuguguau

SEQ ID NO: 1568460 - RNA, 19 nt, Homo sapiens
ucgaauucucacaaggaaa

SEQ ID NO: 1568461 - RNA, 18 nt, Homo sapiens
ucgagaccauccuggcua

SEQ ID NO: 1568462 - RNA, 16 nt, Homo sapiens
ucgauuuaugccucag

SEQ ID NO: 1568463 - RNA, 21 nt, Homo sapiens
ucgcaaacguuucuugaacaa

SEQ ID NO: 1568464 - RNA, 14 nt, Homo sapiens
ucgcauuugucaau

SEQ ID NO: 1568465 - RNA, 17 nt, Homo sapiens
ucgcccagacaccaugu

SEQ ID NO: 1568466 - RNA, 14 nt, Homo sapiens
ucggaacacauucu

SEQ ID NO: 1568467 - RNA, 19 nt, Homo sapiens
ucggaagggguuccucaaa

SEQ ID NO: 1568468 - RNA, 12 nt, Homo sapiens
ucggaaugucau

SEQ ID NO: 1568469 - RNA, 16 nt, Homo sapiens
ucggagagcagcagca

SEQ ID NO: 1568470 - RNA, 22 nt, Homo sapiens
ucggaucucacaggcugagaac

SEQ ID NO: 1568471 - RNA, 19 nt, Homo sapiens
ucggauuugccauagccuu

SEQ ID NO: 1568472 - RNA, 23 nt, Homo sapiens
ucggcaccuuccccugaggaccu

SEQ ID NO: 1568473 - RNA, 20 nt, Homo sapiens
ucggcuuccuacagccagca

SEQ ID NO: 1568474 - RNA, 18 nt, Homo sapiens
ucgggaguucgagaccag

SEQ ID NO: 1568475 - RNA, 22 nt, Homo sapiens
ucggggaacuccuggaaauauc

SEQ ID NO: 1568476 - RNA, 16 nt, Homo sapiens
ucgguggcucaugccu

SEQ ID NO: 1568477 - RNA, 13 nt, Homo sapiens
ucguaacuuuaug

SEQ ID NO: 1568478 - RNA, 17 nt, Homo sapiens
ucguaacuuuauggagu

SEQ ID NO: 1568479 - RNA, 20 nt, Homo sapiens
ucguacaugaauaauaauac

SEQ ID NO: 1568480 - RNA, 15 nt, Homo sapiens
ucgugagucauuuaa

SEQ ID NO: 1568481 - RNA, 21 nt, Homo sapiens
ucgugauccacccaccuuggc

SEQ ID NO: 1568482 - RNA, 15 nt, Homo sapiens
ucuaaaaacauuugu

SEQ ID NO: 1568483 - RNA, 13 nt, Homo sapiens
ucuaaaacauucc

SEQ ID NO: 1568484 - RNA, 13 nt, Homo sapiens
ucuaaaagcuuuc

SEQ ID NO: 1568485 - RNA, 20 nt, Homo sapiens
ucuaaaaggugugaagguga

SEQ ID NO: 1568486 - RNA, 15 nt, Homo sapiens
ucuaaaaugcaaaga

SEQ ID NO: 1568487 - RNA, 20 nt, Homo sapiens
ucuaaagcuaguaaacuucc

SEQ ID NO: 1568488 - RNA, 13 nt, Homo sapiens
ucuaaagcugccc

SEQ ID NO: 1568489 - RNA, 15 nt, Homo sapiens
uccaucaugucugua

SEQ ID NO: 1568490 - RNA, 14 nt, Homo sapiens
uccaucccuacccc

SEQ ID NO: 1568491 - RNA, 17 nt, Homo sapiens
uccaucguccauccucu

SEQ ID NO: 1568492 - RNA, 14 nt, Homo sapiens
uccaucuccaggag

SEQ ID NO: 1568493 - RNA, 16 nt, Homo sapiens
uccaucuucaauaaag

SEQ ID NO: 1568494 - RNA, 18 nt, Homo sapiens
uccaugaaaaugaaccau

SEQ ID NO: 1568495 - RNA, 15 nt, Homo sapiens
uccaugaagcacuga

SEQ ID NO: 1568496 - RNA, 16 nt, Homo sapiens
uccaugaagcacugag

SEQ ID NO: 1568497 - RNA, 23 nt, Homo sapiens
uccaugcaacuggaguuccuuau

SEQ ID NO: 1568498 - RNA, 14 nt, Homo sapiens
uccaugccuuccau

SEQ ID NO: 1568499 - RNA, 14 nt, Homo sapiens
uccaugcuccucac

SEQ ID NO: 1568500 - RNA, 18 nt, Homo sapiens
uccauguaaauugcaaau

SEQ ID NO: 1568501 - RNA, 18 nt, Homo sapiens
uccauuccccacuucucu

SEQ ID NO: 1568502 - RNA, 18 nt, Homo sapiens
uccauucuccucucucua

SEQ ID NO: 1568503 - RNA, 13 nt, Homo sapiens
uccauucucugag

SEQ ID NO: 1568504 - RNA, 17 nt, Homo sapiens
uccauugguguugacau

SEQ ID NO: 1568505 - RNA, 21 nt, Homo sapiens
uccauuuuuaaccacuugccu

SEQ ID NO: 1568506 - RNA, 23 nt, Homo sapiens
uccauuuuuuucuuuacuuaucu

SEQ ID NO: 1568507 - RNA, 15 nt, Homo sapiens
ucccaaaccagacac

SEQ ID NO: 1568508 - RNA, 12 nt, Homo sapiens
ucccaaagugaa

SEQ ID NO: 1568509 - RNA, 20 nt, Homo sapiens
ucccaaagugcugggauuaa

SEQ ID NO: 1568510 - RNA, 20 nt, Homo sapiens
ucccaaagugcugggauuac

SEQ ID NO: 1568511 - RNA, 22 nt, Homo sapiens
ucccaacccauucacuacaggu

SEQ ID NO: 1568512 - RNA, 20 nt, Homo sapiens
ucccaagcacccagagcuuu

SEQ ID NO: 1568513 - RNA, 12 nt, Homo sapiens
ucccaagcugcc

SEQ ID NO: 1568514 - RNA, 16 nt, Homo sapiens
ucccaagguccucuca

SEQ ID NO: 1568515 - RNA, 20 nt, Homo sapiens
ucccaaguagcugggauuac

SEQ ID NO: 1568516 - RNA, 14 nt, Homo sapiens
ucccaauagcacuu

SEQ ID NO: 1568517 - RNA, 19 nt, Homo sapiens
ucccacagagugcuggacu

SEQ ID NO: 1568518 - RNA, 13 nt, Homo sapiens
ucccacaggacau

SEQ ID NO: 1568519 - RNA, 14 nt, Homo sapiens
ucccaccccuaccu

SEQ ID NO: 1568520 - RNA, 15 nt, Homo sapiens
ucccaccgaacacua

SEQ ID NO: 1568521 - RNA, 14 nt, Homo sapiens
ucccaccucagccu

SEQ ID NO: 1568522 - RNA, 17 nt, Homo sapiens
ucccacguucuguuaau

SEQ ID NO: 1568523 - RNA, 16 nt, Homo sapiens
ucccagauagcugcau

SEQ ID NO: 1568524 - RNA, 17 nt, Homo sapiens
ucccagcccacaucuca

SEQ ID NO: 1568525 - RNA, 20 nt, Homo sapiens
ucccagccccuccucccuca

SEQ ID NO: 1568526 - RNA, 19 nt, Homo sapiens
ucccagcuauuccuacucu

SEQ ID NO: 1568527 - RNA, 21 nt, Homo sapiens
ucccaggccgacccaagggag

SEQ ID NO: 1568528 - RNA, 13 nt, Homo sapiens
ucccaguacaaca

SEQ ID NO: 1568529 - RNA, 18 nt, Homo sapiens
ucccaguacaacaacaug

SEQ ID NO: 1568530 - RNA, 22 nt, Homo sapiens
ucccaucuaaaacucauacaau

SEQ ID NO: 1568531 - RNA, 13 nt, Homo sapiens
ucccaucugguca

SEQ ID NO: 1568532 - RNA, 12 nt, Homo sapiens
ucccauguauuu

SEQ ID NO: 1568533 - RNA, 22 nt, Homo sapiens
ucccauuaaaaaugagauuucu

SEQ ID NO: 1568534 - RNA, 17 nt, Homo sapiens
ucccauuaaagagccag

SEQ ID NO: 1568535 - RNA, 16 nt, Homo sapiens
ucccauucuauguguc

SEQ ID NO: 1568536 - RNA, 18 nt, Homo sapiens
ucccauuucuugcuagcu

SEQ ID NO: 1568537 - RNA, 15 nt, Homo sapiens
uccccaaaccauaaa

SEQ ID NO: 1568538 - RNA, 16 nt, Homo sapiens
uccccaaauagccucu

SEQ ID NO: 1568539 - RNA, 17 nt, Homo sapiens
uccccaagacacauccu

SEQ ID NO: 1568540 - RNA, 19 nt, Homo sapiens
uccccaaggacucuuccac

SEQ ID NO: 1568541 - RNA, 17 nt, Homo sapiens
uccccacccagucucau

SEQ ID NO: 1568542 - RNA, 17 nt, Homo sapiens
uccccacgaacuggccu

SEQ ID NO: 1568543 - RNA, 14 nt, Homo sapiens
uccccacgcccguc

SEQ ID NO: 1568544 - RNA, 20 nt, Homo sapiens
uccccacuucucucucccca

SEQ ID NO: 1568545 - RNA, 18 nt, Homo sapiens
uccccagaaacagugugc

SEQ ID NO: 1568546 - RNA, 23 nt, Homo sapiens
uccccauccccacccagucucau

SEQ ID NO: 1568547 - RNA, 20 nt, Homo sapiens
uccccauuggaacuagucau

SEQ ID NO: 1568548 - RNA, 18 nt, Homo sapiens
ucccccaccuauccccau

SEQ ID NO: 1568549 - RNA, 19 nt, Homo sapiens
ucccccgcaaagacaucaa

SEQ ID NO: 1568550 - RNA, 15 nt, Homo sapiens
ucccccugcaacuuc

SEQ ID NO: 1568551 - RNA, 13 nt, Homo sapiens
uccccgugccaaa

SEQ ID NO: 1568552 - RNA, 13 nt, Homo sapiens
uccccuccucuau

SEQ ID NO: 1568553 - RNA, 16 nt, Homo sapiens
uccccucucaccucau

SEQ ID NO: 1568554 - RNA, 18 nt, Homo sapiens
uccccucucagcauuucc

SEQ ID NO: 1568555 - RNA, 17 nt, Homo sapiens
uccccugaauaccccaa

SEQ ID NO: 1568556 - RNA, 21 nt, Homo sapiens
uccccuggggagucugggcac

SEQ ID NO: 1568557 - RNA, 21 nt, Homo sapiens
uccccuguagcagucacugac

SEQ ID NO: 1568558 - RNA, 15 nt, Homo sapiens
uccccuuccacugag

SEQ ID NO: 1568559 - RNA, 18 nt, Homo sapiens
uccccuuccuggcacauu

SEQ ID NO: 1568560 - RNA, 20 nt, Homo sapiens
uccccuucucucaucucuua

SEQ ID NO: 1568561 - RNA, 20 nt, Homo sapiens
uccccuugucugcacuguuc

SEQ ID NO: 1568562 - RNA, 15 nt, Homo sapiens
uccccuuucacaggu

SEQ ID NO: 1568563 - RNA, 12 nt, Homo sapiens
ucccgaccucag

SEQ ID NO: 1568564 - RNA, 22 nt, Homo sapiens
ucccgccacucgccuucuuaga

SEQ ID NO: 1568565 - RNA, 17 nt, Homo sapiens
ucccggggccagcacuu

SEQ ID NO: 1568566 - RNA, 23 nt, Homo sapiens
ucccguguuguaccugacuucca

SEQ ID NO: 1568567 - RNA, 20 nt, Homo sapiens
ucccuacccuaaccaaguuc

SEQ ID NO: 1568568 - RNA, 12 nt, Homo sapiens
ucccuaccucag

SEQ ID NO: 1568569 - RNA, 16 nt, Homo sapiens
ucccucagacccagga

SEQ ID NO: 1568570 - RNA, 14 nt, Homo sapiens
ucccucccuaucua

SEQ ID NO: 1568571 - RNA, 16 nt, Homo sapiens
ucccucuuucuuccca

SEQ ID NO: 1568572 - RNA, 23 nt, Homo sapiens
ucccugacucuuagccccagacu

SEQ ID NO: 1568573 - RNA, 19 nt, Homo sapiens
ucccugacuuuucugugga

SEQ ID NO: 1568574 - RNA, 16 nt, Homo sapiens
ucccugcacaccagag

SEQ ID NO: 1568575 - RNA, 12 nt, Homo sapiens
ucccugccucac

SEQ ID NO: 1568576 - RNA, 17 nt, Homo sapiens
ucccuggacuucuggga

SEQ ID NO: 1568577 - RNA, 21 nt, Homo sapiens
ucccuggcucccaugaccaua

SEQ ID NO: 1568578 - RNA, 20 nt, Homo sapiens
ucccugggccuuagguuuga

SEQ ID NO: 1568579 - RNA, 19 nt, Homo sapiens
ucccugggggaagcccugg

SEQ ID NO: 1568580 - RNA, 20 nt, Homo sapiens
ucccugggggagaccuauga

SEQ ID NO: 1568581 - RNA, 16 nt, Homo sapiens
ucccugucuccagggc

SEQ ID NO: 1568582 - RNA, 22 nt, Homo sapiens
ucccuuaggaauauacauaguc

SEQ ID NO: 1568583 - RNA, 17 nt, Homo sapiens
ucccuugaaauuuagau

SEQ ID NO: 1568584 - RNA, 18 nt, Homo sapiens
ucccuugugagucuucac

SEQ ID NO: 1568585 - RNA, 13 nt, Homo sapiens
ucccuuuccugag

SEQ ID NO: 1568586 - RNA, 19 nt, Homo sapiens
ucccuuuuuuuacauuuca

SEQ ID NO: 1568587 - RNA, 21 nt, Homo sapiens
uccgacaacaccguguccaaa

SEQ ID NO: 1568588 - RNA, 13 nt, Homo sapiens
uccgaguguuugc

SEQ ID NO: 1568589 - RNA, 15 nt, Homo sapiens
uccgccgcaccagcc

SEQ ID NO: 1568590 - RNA, 13 nt, Homo sapiens
uccgccuaccuca

SEQ ID NO: 1568591 - RNA, 12 nt, Homo sapiens
uccgcugaagau

SEQ ID NO: 1568592 - RNA, 23 nt, Homo sapiens
uccggcgggugacagcuccggga

SEQ ID NO: 1568593 - RNA, 16 nt, Homo sapiens
uccgggaaaacagcua

SEQ ID NO: 1568594 - RNA, 23 nt, Homo sapiens
uccgggaggacaaccagaccaac

SEQ ID NO: 1568595 - RNA, 18 nt, Homo sapiens
uccgugcuuaaccaaaga

SEQ ID NO: 1568596 - RNA, 16 nt, Homo sapiens
uccgugggacccucag

SEQ ID NO: 1568597 - RNA, 20 nt, Homo sapiens
uccguggucagagugccacu

SEQ ID NO: 1568598 - RNA, 12 nt, Homo sapiens
uccguguguuua

SEQ ID NO: 1568599 - RNA, 16 nt, Homo sapiens
uccuaaaacaauccug

SEQ ID NO: 1568600 - RNA, 14 nt, Homo sapiens
uccuaauacuguca

SEQ ID NO: 1568601 - RNA, 22 nt, Homo sapiens
uccuacagcccuuuguacuuca

SEQ ID NO: 1568602 - RNA, 20 nt, Homo sapiens
uccuaccaucagcucugccu

SEQ ID NO: 1568603 - RNA, 17 nt, Homo sapiens
uccuaccccuuugcacu

SEQ ID NO: 1568604 - RNA, 20 nt, Homo sapiens
uccuacccuccugcacuguu

SEQ ID NO: 1568605 - RNA, 14 nt, Homo sapiens
uccuacccuuccag

SEQ ID NO: 1568606 - RNA, 18 nt, Homo sapiens
uccuacuguaugugggaa

SEQ ID NO: 1568607 - RNA, 22 nt, Homo sapiens
uccuagaugccaaagggguucc

SEQ ID NO: 1568608 - RNA, 17 nt, Homo sapiens
ucaugcucugcaaaagg

SEQ ID NO: 1568609 - RNA, 22 nt, Homo sapiens
ucaugcuggaaccugcaaaaaa

SEQ ID NO: 1568610 - RNA, 22 nt, Homo sapiens
ucaugcuuaauaaacaugucac

SEQ ID NO: 1568611 - RNA, 14 nt, Homo sapiens
ucaugcuugacaua

SEQ ID NO: 1568612 - RNA, 17 nt, Homo sapiens
ucaugcuuuugcuugca

SEQ ID NO: 1568613 - RNA, 18 nt, Homo sapiens
ucaugcuuuugcuugcaa

SEQ ID NO: 1568614 - RNA, 21 nt, Homo sapiens
ucauggaagaaaaggauuuug

SEQ ID NO: 1568615 - RNA, 22 nt, Homo sapiens
ucauggccugagaugcagguga

SEQ ID NO: 1568616 - RNA, 22 nt, Homo sapiens
ucauggugaaaagcuccaucaa

SEQ ID NO: 1568617 - RNA, 17 nt, Homo sapiens
ucaugugacucuuucca

SEQ ID NO: 1568618 - RNA, 19 nt, Homo sapiens
ucaugugcugccugcaagc

SEQ ID NO: 1568619 - RNA, 19 nt, Homo sapiens
ucauguuuacagaggacag

SEQ ID NO: 1568620 - RNA, 13 nt, Homo sapiens
ucauuaacccauc

SEQ ID NO: 1568621 - RNA, 11 nt, Homo sapiens
ucauuaccuca

SEQ ID NO: 1568622 - RNA, 21 nt, Homo sapiens
ucauuagggcuuuugauuuau

SEQ ID NO: 1568623 - RNA, 13 nt, Homo sapiens
ucauuaguauucc

SEQ ID NO: 1568624 - RNA, 19 nt, Homo sapiens
ucauuaucuuugcuguuau

SEQ ID NO: 1568625 - RNA, 14 nt, Homo sapiens
ucauucaacacauu

SEQ ID NO: 1568626 - RNA, 18 nt, Homo sapiens
ucauucaacucuccaaug

SEQ ID NO: 1568627 - RNA, 13 nt, Homo sapiens
ucauucauggcua

SEQ ID NO: 1568628 - RNA, 13 nt, Homo sapiens
ucauucauuucau

SEQ ID NO: 1568629 - RNA, 17 nt, Homo sapiens
ucauucauuucauugug

SEQ ID NO: 1568630 - RNA, 15 nt, Homo sapiens
ucauuccauugccua

SEQ ID NO: 1568631 - RNA, 15 nt, Homo sapiens
ucauucucagaauuc

SEQ ID NO: 1568632 - RNA, 14 nt, Homo sapiens
ucauucugccaaag

SEQ ID NO: 1568633 - RNA, 14 nt, Homo sapiens
ucauugaugcugcu

SEQ ID NO: 1568634 - RNA, 22 nt, Homo sapiens
ucauugcaccuaucucagccau

SEQ ID NO: 1568635 - RNA, 11 nt, Homo sapiens
ucauugccucu

SEQ ID NO: 1568636 - RNA, 15 nt, Homo sapiens
ucauuggaagccauc

SEQ ID NO: 1568637 - RNA, 18 nt, Homo sapiens
ucauuguaaucacuguug

SEQ ID NO: 1568638 - RNA, 12 nt, Homo sapiens
ucauuguucacu

SEQ ID NO: 1568639 - RNA, 17 nt, Homo sapiens
ucauuguucacuucuaa

SEQ ID NO: 1568640 - RNA, 21 nt, Homo sapiens
ucauuguuuauuguauacugc

SEQ ID NO: 1568641 - RNA, 19 nt, Homo sapiens
ucauuguuuggaccugcau

SEQ ID NO: 1568642 - RNA, 19 nt, Homo sapiens
ucauuuaaaacaggcaaag

SEQ ID NO: 1568643 - RNA, 13 nt, Homo sapiens
ucauuuaaacuuc

SEQ ID NO: 1568644 - RNA, 13 nt, Homo sapiens
ucauuucagccaa

SEQ ID NO: 1568645 - RNA, 13 nt, Homo sapiens
ucauuucaucuca

SEQ ID NO: 1568646 - RNA, 15 nt, Homo sapiens
ucauuugaaugcuua

SEQ ID NO: 1568647 - RNA, 19 nt, Homo sapiens
ucauuuuacacaaagggaa

SEQ ID NO: 1568648 - RNA, 22 nt, Homo sapiens
ucauuuuuacagaguuugugaa

SEQ ID NO: 1568649 - RNA, 21 nt, Homo sapiens
uccaaaaauagcccugcaaaa

SEQ ID NO: 1568650 - RNA, 19 nt, Homo sapiens
uccaaaaauagucaaaaau

SEQ ID NO: 1568651 - RNA, 18 nt, Homo sapiens
uccaaaacuguccagggc

SEQ ID NO: 1568652 - RNA, 19 nt, Homo sapiens
uccaaacucaaacuugaga

SEQ ID NO: 1568653 - RNA, 15 nt, Homo sapiens
uccaaagaggcugcc

SEQ ID NO: 1568654 - RNA, 19 nt, Homo sapiens
uccaacaacgacacauuca

SEQ ID NO: 1568655 - RNA, 22 nt, Homo sapiens
uccaaccugagaaauggccaaa

SEQ ID NO: 1568656 - RNA, 22 nt, Homo sapiens
uccaacucagauugagcccuac

SEQ ID NO: 1568657 - RNA, 16 nt, Homo sapiens
uccaacuuccuguggc

SEQ ID NO: 1568658 - RNA, 23 nt, Homo sapiens
uccaagccucucuggcacuuuga

SEQ ID NO: 1568659 - RNA, 21 nt, Homo sapiens
uccaagccuuauuuugaguaa

SEQ ID NO: 1568660 - RNA, 20 nt, Homo sapiens
uccaagcgcgguuacuaugg

SEQ ID NO: 1568661 - RNA, 23 nt, Homo sapiens
uccaaggaccucucucaaugcca

SEQ ID NO: 1568662 - RNA, 18 nt, Homo sapiens
uccaaggcacacuguuaa

SEQ ID NO: 1568663 - RNA, 17 nt, Homo sapiens
uccaaguugcuaauaca

SEQ ID NO: 1568664 - RNA, 17 nt, Homo sapiens
uccaauauuuugccuuu

SEQ ID NO: 1568665 - RNA, 22 nt, Homo sapiens
uccaaugauacccaacaguuua

SEQ ID NO: 1568666 - RNA, 20 nt, Homo sapiens
uccaaugccacauacuugca

SEQ ID NO: 1568667 - RNA, 17 nt, Homo sapiens
uccaauuacuccaccau

SEQ ID NO: 1568668 - RNA, 17 nt, Homo sapiens
uccaauuuuaauuuagu

SEQ ID NO: 1568669 - RNA, 17 nt, Homo sapiens
uccacaaaaucugucca

SEQ ID NO: 1568670 - RNA, 14 nt, Homo sapiens
uccacaaacacauu

SEQ ID NO: 1568671 - RNA, 12 nt, Homo sapiens
uccacaagacau

SEQ ID NO: 1568672 - RNA, 14 nt, Homo sapiens
uccacacgcauuaa

SEQ ID NO: 1568673 - RNA, 18 nt, Homo sapiens
uccacaggcuccccaucu

SEQ ID NO: 1568674 - RNA, 18 nt, Homo sapiens
uccacauauagagcucca

SEQ ID NO: 1568675 - RNA, 21 nt, Homo sapiens
uccacauugcaauguucaaug

SEQ ID NO: 1568676 - RNA, 17 nt, Homo sapiens
uccaccaaaugugcuuu

SEQ ID NO: 1568677 - RNA, 15 nt, Homo sapiens
uccaccaucaccucu

SEQ ID NO: 1568678 - RNA, 15 nt, Homo sapiens
uccaccaugagcuca

SEQ ID NO: 1568679 - RNA, 21 nt, Homo sapiens
uccacccuuggccugucucau

SEQ ID NO: 1568680 - RNA, 20 nt, Homo sapiens
uccaccuagagcuagaugug

SEQ ID NO: 1568681 - RNA, 12 nt, Homo sapiens
uccaccuucuac

SEQ ID NO: 1568682 - RNA, 21 nt, Homo sapiens
uccaccuuggaccucagugac

SEQ ID NO: 1568683 - RNA, 23 nt, Homo sapiens
uccacggagccacuccucugacu

SEQ ID NO: 1568684 - RNA, 15 nt, Homo sapiens
uccacguacuuaauu

SEQ ID NO: 1568685 - RNA, 17 nt, Homo sapiens
uccacuccuccuacugu

SEQ ID NO: 1568686 - RNA, 18 nt, Homo sapiens
uccacuccuccuacugua

SEQ ID NO: 1568687 - RNA, 12 nt, Homo sapiens
uccacucugcca

SEQ ID NO: 1568688 - RNA, 15 nt, Homo sapiens
uccacucugccauuc

SEQ ID NO: 1568689 - RNA, 21 nt, Homo sapiens
uccacuggcuuuugccuguaa

SEQ ID NO: 1568690 - RNA, 23 nt, Homo sapiens
uccacugggacccccaacauucu

SEQ ID NO: 1568691 - RNA, 20 nt, Homo sapiens
uccacuuuucuuuacauuuu

SEQ ID NO: 1568692 - RNA, 14 nt, Homo sapiens
uccagaaaccaaac

SEQ ID NO: 1568693 - RNA, 21 nt, Homo sapiens
uccagaaccaacugcauuggu

SEQ ID NO: 1568694 - RNA, 21 nt, Homo sapiens
uccagacaaugccagcauaaa

SEQ ID NO: 1568695 - RNA, 13 nt, Homo sapiens
uccagacuuugaa

SEQ ID NO: 1568696 - RNA, 16 nt, Homo sapiens
uccagagacacugagc

SEQ ID NO: 1568697 - RNA, 19 nt, Homo sapiens
uccagagggcacucagaag

SEQ ID NO: 1568698 - RNA, 13 nt, Homo sapiens
uccagcaaacuca

SEQ ID NO: 1568699 - RNA, 16 nt, Homo sapiens
uccagcagcagcacuu

SEQ ID NO: 1568700 - RNA, 20 nt, Homo sapiens
uccagccugagcgacaguga

SEQ ID NO: 1568701 - RNA, 20 nt, Homo sapiens
uccagccugggcaacagagc

SEQ ID NO: 1568702 - RNA, 13 nt, Homo sapiens
uccagccuucuac

SEQ ID NO: 1568703 - RNA, 17 nt, Homo sapiens
uccagcuccccccaaga

SEQ ID NO: 1568704 - RNA, 15 nt, Homo sapiens
uccagcugauccaga

SEQ ID NO: 1568705 - RNA, 18 nt, Homo sapiens
uccagcugauccagaugu

SEQ ID NO: 1568706 - RNA, 17 nt, Homo sapiens
uccaggaauuaaaucau

SEQ ID NO: 1568707 - RNA, 16 nt, Homo sapiens
uccaggagaaggccaa

SEQ ID NO: 1568708 - RNA, 14 nt, Homo sapiens
uccaggagccucau

SEQ ID NO: 1568709 - RNA, 20 nt, Homo sapiens
uccaggagccucauccagcc

SEQ ID NO: 1568710 - RNA, 16 nt, Homo sapiens
uccaggaucuuugacu

SEQ ID NO: 1568711 - RNA, 14 nt, Homo sapiens
uccaggauguggaa

SEQ ID NO: 1568712 - RNA, 15 nt, Homo sapiens
uccaggcuguucuca

SEQ ID NO: 1568713 - RNA, 16 nt, Homo sapiens
uccagggagaaggcau

SEQ ID NO: 1568714 - RNA, 21 nt, Homo sapiens
uccagggcuauagggugugau

SEQ ID NO: 1568715 - RNA, 22 nt, Homo sapiens
uccaggggccaauuuuggauga

SEQ ID NO: 1568716 - RNA, 17 nt, Homo sapiens
uccagguggaacaaaca

SEQ ID NO: 1568717 - RNA, 17 nt, Homo sapiens
uccagguguuacuguaa

SEQ ID NO: 1568718 - RNA, 21 nt, Homo sapiens
uccaguccaaagccggcuuga

SEQ ID NO: 1568719 - RNA, 12 nt, Homo sapiens
uccagugcaguc

SEQ ID NO: 1568720 - RNA, 16 nt, Homo sapiens
uccagugcauacugua

SEQ ID NO: 1568721 - RNA, 21 nt, Homo sapiens
uccaguugcccauaagcacau

SEQ ID NO: 1568722 - RNA, 23 nt, Homo sapiens
uccaguuuuauaaaaaguggaga

SEQ ID NO: 1568723 - RNA, 18 nt, Homo sapiens
uccauagacacaguauug

SEQ ID NO: 1568724 - RNA, 24 nt, Homo sapiens
uccauauauuuagccccauuacac

SEQ ID NO: 1568725 - RNA, 15 nt, Homo sapiens
uccauaugcaucuac

SEQ ID NO: 1568726 - RNA, 13 nt, Homo sapiens
uccaucaccagcc

SEQ ID NO: 1568727 - RNA, 15 nt, Homo sapiens
ucagauacacaagga

SEQ ID NO: 1568728 - RNA, 18 nt, Homo sapiens
ucagauccuguuacuugc

SEQ ID NO: 1568729 - RNA, 14 nt, Homo sapiens
ucagaucugucuga

SEQ ID NO: 1568730 - RNA, 23 nt, Homo sapiens
ucagaugcuugcggcaaaaggaa

SEQ ID NO: 1568731 - RNA, 12 nt, Homo sapiens
ucagauuccacc

SEQ ID NO: 1568732 - RNA, 14 nt, Homo sapiens
ucagauuccaccua

SEQ ID NO: 1568733 - RNA, 12 nt, Homo sapiens
ucagauuugccu

SEQ ID NO: 1568734 - RNA, 15 nt, Homo sapiens
ucagcaacuguuuaa

SEQ ID NO: 1568735 - RNA, 21 nt, Homo sapiens
ucagcaacuguuuaaccuguu

SEQ ID NO: 1568736 - RNA, 19 nt, Homo sapiens
ucagcaagacauaaagccu

SEQ ID NO: 1568737 - RNA, 17 nt, Homo sapiens
ucagcaccugacccugu

SEQ ID NO: 1568738 - RNA, 12 nt, Homo sapiens
ucagcacucugu

SEQ ID NO: 1568739 - RNA, 16 nt, Homo sapiens
ucagcacucuguaaaa

SEQ ID NO: 1568740 - RNA, 17 nt, Homo sapiens
ucagcagcaaaaccaaa

SEQ ID NO: 1568741 - RNA, 21 nt, Homo sapiens
ucagcagcaaaaccaaacugg

SEQ ID NO: 1568742 - RNA, 15 nt, Homo sapiens
ucagcagcccuccuc

SEQ ID NO: 1568743 - RNA, 23 nt, Homo sapiens
ucagcauagugacuaaacuacau

SEQ ID NO: 1568744 - RNA, 14 nt, Homo sapiens
ucagccaagugcag

SEQ ID NO: 1568745 - RNA, 20 nt, Homo sapiens
ucagccacugucacaggcau

SEQ ID NO: 1568746 - RNA, 22 nt, Homo sapiens
ucagccacuugccugugcuaca

SEQ ID NO: 1568747 - RNA, 23 nt, Homo sapiens
ucagccagcccauggcccccaau

SEQ ID NO: 1568748 - RNA, 19 nt, Homo sapiens
ucagccauaagaaagcacu

SEQ ID NO: 1568749 - RNA, 18 nt, Homo sapiens
ucagccccuucauggaag

SEQ ID NO: 1568750 - RNA, 16 nt, Homo sapiens
ucagcccucaguuccu

SEQ ID NO: 1568751 - RNA, 17 nt, Homo sapiens
ucagcccucaguuccuu

SEQ ID NO: 1568752 - RNA, 20 nt, Homo sapiens
ucagccucugccagcgccaa

SEQ ID NO: 1568753 - RNA, 18 nt, Homo sapiens
ucagccugggcaacaugg

SEQ ID NO: 1568754 - RNA, 12 nt, Homo sapiens
ucagcuccuucc

SEQ ID NO: 1568755 - RNA, 17 nt, Homo sapiens
ucagcucuccugcugca

SEQ ID NO: 1568756 - RNA, 19 nt, Homo sapiens
ucagcuucucccaagccca

SEQ ID NO: 1568757 - RNA, 22 nt, Homo sapiens
ucagcuugcuuagauguuccaa

SEQ ID NO: 1568758 - RNA, 16 nt, Homo sapiens
ucaggagccaccagca

SEQ ID NO: 1568759 - RNA, 20 nt, Homo sapiens
ucaggagguggagucccugg

SEQ ID NO: 1568760 - RNA, 16 nt, Homo sapiens
ucaggagucugccacu

SEQ ID NO: 1568761 - RNA, 21 nt, Homo sapiens
ucaggagucugccacuuguca

SEQ ID NO: 1568762 - RNA, 15 nt, Homo sapiens
ucaggcacacagcua

SEQ ID NO: 1568763 - RNA, 22 nt, Homo sapiens
ucaggcgcaguggcucaugccu

SEQ ID NO: 1568764 - RNA, 24 nt, Homo sapiens
ucaggcuacuguucuugacaauca

SEQ ID NO: 1568765 - RNA, 19 nt, Homo sapiens
ucagggaccugcugcucag

SEQ ID NO: 1568766 - RNA, 14 nt, Homo sapiens
ucagggagugcaga

SEQ ID NO: 1568767 - RNA, 15 nt, Homo sapiens
ucagggcacauguga

SEQ ID NO: 1568768 - RNA, 21 nt, Homo sapiens
ucagggccaccauugucucaa

SEQ ID NO: 1568769 - RNA, 14 nt, Homo sapiens
ucaggggacucagc

SEQ ID NO: 1568770 - RNA, 21 nt, Homo sapiens
ucagggggucuggaaagaagg

SEQ ID NO: 1568771 - RNA, 12 nt, Homo sapiens
ucagggucuaag

SEQ ID NO: 1568772 - RNA, 16 nt, Homo sapiens
ucagguaacacuacag

SEQ ID NO: 1568773 - RNA, 13 nt, Homo sapiens
ucagguaauacaa

SEQ ID NO: 1568774 - RNA, 21 nt, Homo sapiens
ucaggugauccgccuaccuca

SEQ ID NO: 1568775 - RNA, 11 nt, Homo sapiens
ucaggugguua

SEQ ID NO: 1568776 - RNA, 22 nt, Homo sapiens
ucaguaaaaauaaauaaaacag

SEQ ID NO: 1568777 - RNA, 16 nt, Homo sapiens
ucaguaaacaaaucag

SEQ ID NO: 1568778 - RNA, 23 nt, Homo sapiens
ucaguacugguguagugugucag

SEQ ID NO: 1568779 - RNA, 22 nt, Homo sapiens
ucaguagcaucuguaacagcau

SEQ ID NO: 1568780 - RNA, 23 nt, Homo sapiens
ucaguagucacaaacugaucuaa

SEQ ID NO: 1568781 - RNA, 18 nt, Homo sapiens
ucaguaguucacauacaa

SEQ ID NO: 1568782 - RNA, 17 nt, Homo sapiens
ucaguaugucacucugg

SEQ ID NO: 1568783 - RNA, 19 nt, Homo sapiens
ucaguauuuuccagccuua

SEQ ID NO: 1568784 - RNA, 20 nt, Homo sapiens
ucagucaacaacuuacacuu

SEQ ID NO: 1568785 - RNA, 21 nt, Homo sapiens
ucagucaacaacuuacacuua

SEQ ID NO: 1568786 - RNA, 13 nt, Homo sapiens
ucagucaagcugu

SEQ ID NO: 1568787 - RNA, 17 nt, Homo sapiens
ucagucauuagacuccu

SEQ ID NO: 1568788 - RNA, 18 nt, Homo sapiens
ucaguccaugaagaugua

SEQ ID NO: 1568789 - RNA, 15 nt, Homo sapiens
ucaguccucuuuccu

SEQ ID NO: 1568790 - RNA, 23 nt, Homo sapiens
ucagucuaaggucucaugcuguu

SEQ ID NO: 1568791 - RNA, 19 nt, Homo sapiens
ucagucucugagcagugaa

SEQ ID NO: 1568792 - RNA, 23 nt, Homo sapiens
ucagugaguaauuuuggauuuug

SEQ ID NO: 1568793 - RNA, 20 nt, Homo sapiens
ucagugccgaccugcgccaa

SEQ ID NO: 1568794 - RNA, 21 nt, Homo sapiens
ucagugcucccucacauguca

SEQ ID NO: 1568795 - RNA, 16 nt, Homo sapiens
ucagugcuccuggaaa

SEQ ID NO: 1568796 - RNA, 15 nt, Homo sapiens
ucaguggccaggugc

SEQ ID NO: 1568797 - RNA, 22 nt, Homo sapiens
ucaguguagaaccuaauucaau

SEQ ID NO: 1568798 - RNA, 13 nt, Homo sapiens
ucagugucacugg

SEQ ID NO: 1568799 - RNA, 15 nt, Homo sapiens
ucaguguuaaaugug

SEQ ID NO: 1568800 - RNA, 20 nt, Homo sapiens
ucaguucccuuggccucaga

SEQ ID NO: 1568801 - RNA, 13 nt, Homo sapiens
ucaguuggugcug

SEQ ID NO: 1568802 - RNA, 23 nt, Homo sapiens
ucaguuguuauuuauugaaauga

SEQ ID NO: 1568803 - RNA, 15 nt, Homo sapiens
ucaguuuuucacuuc

SEQ ID NO: 1568804 - RNA, 17 nt, Homo sapiens
ucauaacuauacuugau

SEQ ID NO: 1568805 - RNA, 15 nt, Homo sapiens
ucauaagacaaugga

SEQ ID NO: 1568806 - RNA, 14 nt, Homo sapiens
ucauaaguagcauu

SEQ ID NO: 1568807 - RNA, 18 nt, Homo sapiens
ucauaaguuaugccucug

SEQ ID NO: 1568808 - RNA, 20 nt, Homo sapiens
ucauaauucagcacuuaacu

SEQ ID NO: 1568809 - RNA, 20 nt, Homo sapiens
ucauaauuccuacagcacua

SEQ ID NO: 1568810 - RNA, 14 nt, Homo sapiens
ucauaauucuaauc

SEQ ID NO: 1568811 - RNA, 20 nt, Homo sapiens
ucauaauucuaaucuaacaa

SEQ ID NO: 1568812 - RNA, 13 nt, Homo sapiens
ucauacacuuauu

SEQ ID NO: 1568813 - RNA, 22 nt, Homo sapiens
ucauaccacuugaauuuauuga

SEQ ID NO: 1568814 - RNA, 14 nt, Homo sapiens
ucauacuacauuga

SEQ ID NO: 1568815 - RNA, 22 nt, Homo sapiens
ucauagaagaaaauccauucau

SEQ ID NO: 1568816 - RNA, 17 nt, Homo sapiens
ucauagacaauuccucc

SEQ ID NO: 1568817 - RNA, 14 nt, Homo sapiens
ucauaguaacuucu

SEQ ID NO: 1568818 - RNA, 15 nt, Homo sapiens
ucauagugcugaaaa

SEQ ID NO: 1568819 - RNA, 13 nt, Homo sapiens
ucauauaccagca

SEQ ID NO: 1568820 - RNA, 16 nt, Homo sapiens
ucauaucaaaggguaa

SEQ ID NO: 1568821 - RNA, 12 nt, Homo sapiens
ucauaugcagaa

SEQ ID NO: 1568822 - RNA, 18 nt, Homo sapiens
ucauauggcccaguguca

SEQ ID NO: 1568823 - RNA, 19 nt, Homo sapiens
ucauaugucaccuuugcua

SEQ ID NO: 1568824 - RNA, 23 nt, Homo sapiens
ucauauuauuuuaguguguaaaa

SEQ ID NO: 1568825 - RNA, 15 nt, Homo sapiens
ucauauucauaugca

SEQ ID NO: 1568826 - RNA, 18 nt, Homo sapiens
ucaucaaaaucugcacag

SEQ ID NO: 1568827 - RNA, 21 nt, Homo sapiens
ucaucaaauuauuaaucugaa

SEQ ID NO: 1568828 - RNA, 19 nt, Homo sapiens
ucaucaacacgagaauaca

SEQ ID NO: 1568829 - RNA, 14 nt, Homo sapiens
ucaucaagcuccac

SEQ ID NO: 1568830 - RNA, 14 nt, Homo sapiens
ucaucaaguaauac

SEQ ID NO: 1568831 - RNA, 15 nt, Homo sapiens
ucaucaaugaaugaa

SEQ ID NO: 1568832 - RNA, 12 nt, Homo sapiens
ucaucagagccu

SEQ ID NO: 1568833 - RNA, 21 nt, Homo sapiens
ucaucagagccuuuccucaaa

SEQ ID NO: 1568834 - RNA, 14 nt, Homo sapiens
ucaucaggugcaua

SEQ ID NO: 1568835 - RNA, 18 nt, Homo sapiens
ucaucauucucugucuca

SEQ ID NO: 1568836 - RNA, 17 nt, Homo sapiens
ucauccccacaaucugg

SEQ ID NO: 1568837 - RNA, 11 nt, Homo sapiens
ucauccuccau

SEQ ID NO: 1568838 - RNA, 15 nt, Homo sapiens
ucaucuagcgcaauu

SEQ ID NO: 1568839 - RNA, 20 nt, Homo sapiens
ucaucugucauuauauucua

SEQ ID NO: 1568840 - RNA, 15 nt, Homo sapiens
ucaucuucacugcaa

SEQ ID NO: 1568841 - RNA, 14 nt, Homo sapiens
ucaucuuugccaag

SEQ ID NO: 1568842 - RNA, 13 nt, Homo sapiens
ucaugauccuugc

SEQ ID NO: 1568843 - RNA, 20 nt, Homo sapiens
ucaugauguauuguugcuuu

SEQ ID NO: 1568844 - RNA, 17 nt, Homo sapiens
ucaugccagugccuuau

SEQ ID NO: 1568845 - RNA, 17 nt, Homo sapiens
ucaugccuguaaucuca

SEQ ID NO: 1568846 - RNA, 15 nt, Homo sapiens
ucaaucauuaauuca

SEQ ID NO: 1568847 - RNA, 18 nt, Homo sapiens
ucaauccuccauuugcug

SEQ ID NO: 1568848 - RNA, 21 nt, Homo sapiens
ucaaucuuuggaggcuuuuaa

SEQ ID NO: 1568849 - RNA, 15 nt, Homo sapiens
ucaaugcuagcacaa

SEQ ID NO: 1568850 - RNA, 14 nt, Homo sapiens
ucaauggauccaca

SEQ ID NO: 1568851 - RNA, 17 nt, Homo sapiens
ucaaugguagcauuuag

SEQ ID NO: 1568852 - RNA, 20 nt, Homo sapiens
ucaauguuuguccuguauaa

SEQ ID NO: 1568853 - RNA, 13 nt, Homo sapiens
ucaauuacaaagc

SEQ ID NO: 1568854 - RNA, 19 nt, Homo sapiens
ucaauuauacuaaaccuca

SEQ ID NO: 1568855 - RNA, 19 nt, Homo sapiens
ucaauuucuaauguuuacu

SEQ ID NO: 1568856 - RNA, 14 nt, Homo sapiens
ucacaaacugugaa

SEQ ID NO: 1568857 - RNA, 22 nt, Homo sapiens
ucacaaauaaguaauaucuuuc

SEQ ID NO: 1568858 - RNA, 23 nt, Homo sapiens
ucacaaauaaguaauaucuuuca

SEQ ID NO: 1568859 - RNA, 13 nt, Homo sapiens
ucacaacagugaa

SEQ ID NO: 1568860 - RNA, 22 nt, Homo sapiens
ucacaaucaucaucauucucau

SEQ ID NO: 1568861 - RNA, 15 nt, Homo sapiens
ucacaaugagauuga

SEQ ID NO: 1568862 - RNA, 19 nt, Homo sapiens
ucacaaugaguuugggcau

SEQ ID NO: 1568863 - RNA, 14 nt, Homo sapiens
ucacacaagggaag

SEQ ID NO: 1568864 - RNA, 19 nt, Homo sapiens
ucacaccauucuccugccu

SEQ ID NO: 1568865 - RNA, 19 nt, Homo sapiens
ucacacucaaggacaggag

SEQ ID NO: 1568866 - RNA, 11 nt, Homo sapiens
ucacagaggaa

SEQ ID NO: 1568867 - RNA, 19 nt, Homo sapiens
ucacagaugaagacaucag

SEQ ID NO: 1568868 - RNA, 14 nt, Homo sapiens
ucacagucuacuga

SEQ ID NO: 1568869 - RNA, 15 nt, Homo sapiens
ucacaguuccucgcc

SEQ ID NO: 1568870 - RNA, 18 nt, Homo sapiens
ucacauacaaaucaucca

SEQ ID NO: 1568871 - RNA, 21 nt, Homo sapiens
ucacaucccauugggacucca

SEQ ID NO: 1568872 - RNA, 22 nt, Homo sapiens
ucacaucuuccaccagcaccuu

SEQ ID NO: 1568873 - RNA, 17 nt, Homo sapiens
ucacauuccaagccuca

SEQ ID NO: 1568874 - RNA, 18 nt, Homo sapiens
ucacauuccucugcccuu

SEQ ID NO: 1568875 - RNA, 18 nt, Homo sapiens
ucacauuuuccuuuucaa

SEQ ID NO: 1568876 - RNA, 19 nt, Homo sapiens
ucacauuuuuuuaugcucu

SEQ ID NO: 1568877 - RNA, 20 nt, Homo sapiens
ucaccaagcuaggugcuauu

SEQ ID NO: 1568878 - RNA, 16 nt, Homo sapiens
ucaccacuaccagcca

SEQ ID NO: 1568879 - RNA, 23 nt, Homo sapiens
ucaccagcccgggcuggcccaag

SEQ ID NO: 1568880 - RNA, 18 nt, Homo sapiens
ucaccagcuaucugucau

SEQ ID NO: 1568881 - RNA, 20 nt, Homo sapiens
ucaccaggcuggagugcagu

SEQ ID NO: 1568882 - RNA, 14 nt, Homo sapiens
ucaccaugaaagaa

SEQ ID NO: 1568883 - RNA, 16 nt, Homo sapiens
ucaccaugaaagaaga

SEQ ID NO: 1568884 - RNA, 19 nt, Homo sapiens
ucaccauuucuuggcauug

SEQ ID NO: 1568885 - RNA, 20 nt, Homo sapiens
ucaccauuuggcaaugccau

SEQ ID NO: 1568886 - RNA, 15 nt, Homo sapiens
ucacccaagccacaa

SEQ ID NO: 1568887 - RNA, 14 nt, Homo sapiens
ucacccacaccaua

SEQ ID NO: 1568888 - RNA, 22 nt, Homo sapiens
ucacccaccccugcacaguuga

SEQ ID NO: 1568889 - RNA, 18 nt, Homo sapiens
ucacccaggcaaucuugc

SEQ ID NO: 1568890 - RNA, 13 nt, Homo sapiens
ucacccauggaac

SEQ ID NO: 1568891 - RNA, 16 nt, Homo sapiens
ucaccccccacacuca

SEQ ID NO: 1568892 - RNA, 14 nt, Homo sapiens
ucacccuuugccua

SEQ ID NO: 1568893 - RNA, 16 nt, Homo sapiens
ucaccuacauuaucuc

SEQ ID NO: 1568894 - RNA, 18 nt, Homo sapiens
ucaccuacauuaucucac

SEQ ID NO: 1568895 - RNA, 17 nt, Homo sapiens
ucaccuagaacgugcau

SEQ ID NO: 1568896 - RNA, 17 nt, Homo sapiens
ucaccucacaaaccuga

SEQ ID NO: 1568897 - RNA, 18 nt, Homo sapiens
ucaccuccaagcauuuca

SEQ ID NO: 1568898 - RNA, 19 nt, Homo sapiens
ucaccuccaagcauuucau

SEQ ID NO: 1568899 - RNA, 16 nt, Homo sapiens
ucaccucuugccuucu

SEQ ID NO: 1568900 - RNA, 13 nt, Homo sapiens
ucaccuguaaaac

SEQ ID NO: 1568901 - RNA, 23 nt, Homo sapiens
ucacuaaauaaacacgauuuuau

SEQ ID NO: 1568902 - RNA, 21 nt, Homo sapiens
ucacuaagcuguggcuggaau

SEQ ID NO: 1568903 - RNA, 16 nt, Homo sapiens
ucacuacugcauuuau

SEQ ID NO: 1568904 - RNA, 17 nt, Homo sapiens
ucacuauauaagucaca

SEQ ID NO: 1568905 - RNA, 22 nt, Homo sapiens
ucacucaauuucucugaggaca

SEQ ID NO: 1568906 - RNA, 13 nt, Homo sapiens
ucacucacauuga

SEQ ID NO: 1568907 - RNA, 18 nt, Homo sapiens
ucacucacauugagagua

SEQ ID NO: 1568908 - RNA, 15 nt, Homo sapiens
ucacucauccauccc

SEQ ID NO: 1568909 - RNA, 21 nt, Homo sapiens
ucacucaugcaaacugcuuua

SEQ ID NO: 1568910 - RNA, 20 nt, Homo sapiens
ucacucauuaaugaaucaca

SEQ ID NO: 1568911 - RNA, 21 nt, Homo sapiens
ucacucauuaaugaaucacau

SEQ ID NO: 1568912 - RNA, 20 nt, Homo sapiens
ucacucauuccuucacucau

SEQ ID NO: 1568913 - RNA, 16 nt, Homo sapiens
ucacuccucugucaua

SEQ ID NO: 1568914 - RNA, 13 nt, Homo sapiens
ucacucuguuaau

SEQ ID NO: 1568915 - RNA, 17 nt, Homo sapiens
ucacucuuuauagugca

SEQ ID NO: 1568916 - RNA, 19 nt, Homo sapiens
ucacucuuuauagugcaca

SEQ ID NO: 1568917 - RNA, 22 nt, Homo sapiens
ucacugaguuuuguuucacuuu

SEQ ID NO: 1568918 - RNA, 16 nt, Homo sapiens
ucacugcaaccuccac

SEQ ID NO: 1568919 - RNA, 18 nt, Homo sapiens
ucacugccccucucucag

SEQ ID NO: 1568920 - RNA, 20 nt, Homo sapiens
ucacugcuccaggccugcau

SEQ ID NO: 1568921 - RNA, 22 nt, Homo sapiens
ucacugcugcaaauacuguaua

SEQ ID NO: 1568922 - RNA, 15 nt, Homo sapiens
ucacuggaaagggga

SEQ ID NO: 1568923 - RNA, 16 nt, Homo sapiens
ucacuggaaauugagg

SEQ ID NO: 1568924 - RNA, 17 nt, Homo sapiens
ucacuggggcagacaau

SEQ ID NO: 1568925 - RNA, 18 nt, Homo sapiens
ucacuggggcagacaaua

SEQ ID NO: 1568926 - RNA, 19 nt, Homo sapiens
ucacuguauauaaacauau

SEQ ID NO: 1568927 - RNA, 17 nt, Homo sapiens
ucacuuaaacucagcua

SEQ ID NO: 1568928 - RNA, 20 nt, Homo sapiens
ucacuuaaaggcacaaauag

SEQ ID NO: 1568929 - RNA, 14 nt, Homo sapiens
ucacuuaagccugg

SEQ ID NO: 1568930 - RNA, 14 nt, Homo sapiens
ucacuuaauuugaa

SEQ ID NO: 1568931 - RNA, 16 nt, Homo sapiens
ucacuucaauguguca

SEQ ID NO: 1568932 - RNA, 15 nt, Homo sapiens
ucacuucauaaucca

SEQ ID NO: 1568933 - RNA, 16 nt, Homo sapiens
ucacuuguaaggggaa

SEQ ID NO: 1568934 - RNA, 21 nt, Homo sapiens
ucacuuucauuuuugauagcu

SEQ ID NO: 1568935 - RNA, 18 nt, Homo sapiens
ucagaaaauggcacuugg

SEQ ID NO: 1568936 - RNA, 19 nt, Homo sapiens
ucagaaaauuaaacuacag

SEQ ID NO: 1568937 - RNA, 14 nt, Homo sapiens
ucagaaagauuuga

SEQ ID NO: 1568938 - RNA, 15 nt, Homo sapiens
ucagaaagauuugau

SEQ ID NO: 1568939 - RNA, 14 nt, Homo sapiens
ucagaacacuccaa

SEQ ID NO: 1568940 - RNA, 14 nt, Homo sapiens
ucagaaccauuuca

SEQ ID NO: 1568941 - RNA, 17 nt, Homo sapiens
ucagaacccugccaugg

SEQ ID NO: 1568942 - RNA, 19 nt, Homo sapiens
ucagaaccucuuccccaga

SEQ ID NO: 1568943 - RNA, 18 nt, Homo sapiens
ucagaacuagaauuugau

SEQ ID NO: 1568944 - RNA, 22 nt, Homo sapiens
ucagaagagguugggcuuccau

SEQ ID NO: 1568945 - RNA, 16 nt, Homo sapiens
ucagaagcaagccaga

SEQ ID NO: 1568946 - RNA, 20 nt, Homo sapiens
ucagaaggccccagagagac

SEQ ID NO: 1568947 - RNA, 19 nt, Homo sapiens
ucagaaguuaguuuguaua

SEQ ID NO: 1568948 - RNA, 13 nt, Homo sapiens
ucagaauagccac

SEQ ID NO: 1568949 - RNA, 19 nt, Homo sapiens
ucagaaucccuuaacaguu

SEQ ID NO: 1568950 - RNA, 21 nt, Homo sapiens
ucagaauuaagcagaacacug

SEQ ID NO: 1568951 - RNA, 22 nt, Homo sapiens
ucagaauuuaguguauccauaa

SEQ ID NO: 1568952 - RNA, 22 nt, Homo sapiens
ucagacaaaauggauacauaaa

SEQ ID NO: 1568953 - RNA, 13 nt, Homo sapiens
ucagacccaggag

SEQ ID NO: 1568954 - RNA, 20 nt, Homo sapiens
ucagacccuaccccaccacg

SEQ ID NO: 1568955 - RNA, 16 nt, Homo sapiens
ucagacgugugaccuc

SEQ ID NO: 1568956 - RNA, 14 nt, Homo sapiens
ucagagaugugcac

SEQ ID NO: 1568957 - RNA, 17 nt, Homo sapiens
ucagagcacucauuccu

SEQ ID NO: 1568958 - RNA, 13 nt, Homo sapiens
ucagagcacuccc

SEQ ID NO: 1568959 - RNA, 14 nt, Homo sapiens
ucagaggagcugca

SEQ ID NO: 1568960 - RNA, 17 nt, Homo sapiens
ucagaggucucugcuag

SEQ ID NO: 1568961 - RNA, 14 nt, Homo sapiens
ucagaguccuugca

SEQ ID NO: 1568962 - RNA, 16 nt, Homo sapiens
ucagaguccuugcaaa

SEQ ID NO: 1568963 - RNA, 20 nt, Homo sapiens
ucagagucucugauacacag

SEQ ID NO: 1568964 - RNA, 21 nt, Homo sapiens
ucagaguugcugcaaaccuga

SEQ ID NO: 1568965 - RNA, 21 nt, Homo sapiens
uauuucagccaaaacauacca

SEQ ID NO: 1568966 - RNA, 17 nt, Homo sapiens
uauuucauuccaguuug

SEQ ID NO: 1568967 - RNA, 15 nt, Homo sapiens
uauuuccauagucaa

SEQ ID NO: 1568968 - RNA, 17 nt, Homo sapiens
uauuuccccagccacag

SEQ ID NO: 1568969 - RNA, 22 nt, Homo sapiens
uauuuccucugugcaaagggaa

SEQ ID NO: 1568970 - RNA, 20 nt, Homo sapiens
uauuuccuuuaugugaauuu

SEQ ID NO: 1568971 - RNA, 18 nt, Homo sapiens
uauuucuccuuugcaaua

SEQ ID NO: 1568972 - RNA, 13 nt, Homo sapiens
uauuucuugaaga

SEQ ID NO: 1568973 - RNA, 21 nt, Homo sapiens
uauuucuuucuuggagugcca

SEQ ID NO: 1568974 - RNA, 19 nt, Homo sapiens
uauuuggaaauaaagucag

SEQ ID NO: 1568975 - RNA, 20 nt, Homo sapiens
uauuugggcacaacacauca

SEQ ID NO: 1568976 - RNA, 22 nt, Homo sapiens
uauuugggggaacuggacacaa

SEQ ID NO: 1568977 - RNA, 21 nt, Homo sapiens
uauuuguaauuaaaagcaaau

SEQ ID NO: 1568978 - RNA, 20 nt, Homo sapiens
uauuuguacaccaauauuca

SEQ ID NO: 1568979 - RNA, 18 nt, Homo sapiens
uauuuuaaaaaacacuga

SEQ ID NO: 1568980 - RNA, 17 nt, Homo sapiens
uauuuuaagacgugaau

SEQ ID NO: 1568981 - RNA, 14 nt, Homo sapiens
uauuuuaagaucca

SEQ ID NO: 1568982 - RNA, 17 nt, Homo sapiens
uauuuuauuuagacaag

SEQ ID NO: 1568983 - RNA, 21 nt, Homo sapiens
uauuuugauauaauuguacug

SEQ ID NO: 1568984 - RNA, 23 nt, Homo sapiens
uauuuuguaugaaauauauguga

SEQ ID NO: 1568985 - RNA, 16 nt, Homo sapiens
uauuuuuguacguuau

SEQ ID NO: 1568986 - RNA, 17 nt, Homo sapiens
uauuuuuuaauaaacug

SEQ ID NO: 1568987 - RNA, 19 nt, Homo sapiens
ucaaaaaggccaacacaac

SEQ ID NO: 1568988 - RNA, 15 nt, Homo sapiens
ucaaaaauacucuug

SEQ ID NO: 1568989 - RNA, 23 nt, Homo sapiens
ucaaaaauuaucuauagcuaagu

SEQ ID NO: 1568990 - RNA, 12 nt, Homo sapiens
ucaaaacagaga

SEQ ID NO: 1568991 - RNA, 10 nt, Homo sapiens
ucaaaaccug

SEQ ID NO: 1568992 - RNA, 18 nt, Homo sapiens
ucaaaacuaaccaucuga

SEQ ID NO: 1568993 - RNA, 12 nt, Homo sapiens
ucaaaagcaaac

SEQ ID NO: 1568994 - RNA, 15 nt, Homo sapiens
ucaaaagcaccagca

SEQ ID NO: 1568995 - RNA, 22 nt, Homo sapiens
ucaaaauaccaugccauuuaaa

SEQ ID NO: 1568996 - RNA, 14 nt, Homo sapiens
ucaaaauacuucuu

SEQ ID NO: 1568997 - RNA, 17 nt, Homo sapiens
ucaaaauauacauucaa

SEQ ID NO: 1568998 - RNA, 18 nt, Homo sapiens
ucaaaauauacauucaaa

SEQ ID NO: 1568999 - RNA, 14 nt, Homo sapiens
ucaaaaugcuuuuu

SEQ ID NO: 1569000 - RNA, 22 nt, Homo sapiens
ucaaaauuguuuaccauagaaa

SEQ ID NO: 1569001 - RNA, 17 nt, Homo sapiens
ucaaaauuuaaagccau

SEQ ID NO: 1569002 - RNA, 16 nt, Homo sapiens
ucaaaauuuaacaguu

SEQ ID NO: 1569003 - RNA, 13 nt, Homo sapiens
ucaaaauuugcug

SEQ ID NO: 1569004 - RNA, 23 nt, Homo sapiens
ucaaacaaaaauauuuugaucau

SEQ ID NO: 1569005 - RNA, 15 nt, Homo sapiens
ucaaacccagucuca

SEQ ID NO: 1569006 - RNA, 16 nt, Homo sapiens
ucaaacgacagaggag

SEQ ID NO: 1569007 - RNA, 22 nt, Homo sapiens
ucaaacucccgaccucagguga

SEQ ID NO: 1569008 - RNA, 17 nt, Homo sapiens
ucaaacugaaacaaaau

SEQ ID NO: 1569009 - RNA, 22 nt, Homo sapiens
ucaaagaaaguguauugguuua

SEQ ID NO: 1569010 - RNA, 19 nt, Homo sapiens
ucaaagaaucuuuaaggga

SEQ ID NO: 1569011 - RNA, 18 nt, Homo sapiens
ucaaagagaaaacaucuc

SEQ ID NO: 1569012 - RNA, 15 nt, Homo sapiens
ucaaagaggugaaca

SEQ ID NO: 1569013 - RNA, 15 nt, Homo sapiens
ucaaaguguuuuuca

SEQ ID NO: 1569014 - RNA, 17 nt, Homo sapiens
ucaaauacaugcacagu

SEQ ID NO: 1569015 - RNA, 19 nt, Homo sapiens
ucaaauacaugcacaguca

SEQ ID NO: 1569016 - RNA, 13 nt, Homo sapiens
ucaaauacugugu

SEQ ID NO: 1569017 - RNA, 18 nt, Homo sapiens
ucaaauaguugcauagca

SEQ ID NO: 1569018 - RNA, 16 nt, Homo sapiens
ucaaauaucuaagcaa

SEQ ID NO: 1569019 - RNA, 14 nt, Homo sapiens
ucaaauauuugcug

SEQ ID NO: 1569020 - RNA, 15 nt, Homo sapiens
ucaaauccaaaaugg

SEQ ID NO: 1569021 - RNA, 17 nt, Homo sapiens
ucaaauccauagauuuc

SEQ ID NO: 1569022 - RNA, 19 nt, Homo sapiens
ucaaauccuuauuguucag

SEQ ID NO: 1569023 - RNA, 14 nt, Homo sapiens
ucaaaugcauuuug

SEQ ID NO: 1569024 - RNA, 17 nt, Homo sapiens
ucaaaugucgaugcuac

SEQ ID NO: 1569025 - RNA, 18 nt, Homo sapiens
ucaaaugugacauuauau

SEQ ID NO: 1569026 - RNA, 18 nt, Homo sapiens
ucaaauguucuccaguca

SEQ ID NO: 1569027 - RNA, 15 nt, Homo sapiens
ucaaauuaucuucac

SEQ ID NO: 1569028 - RNA, 21 nt, Homo sapiens
ucaaauucagcucugaucuga

SEQ ID NO: 1569029 - RNA, 14 nt, Homo sapiens
ucaaauucuucaca

SEQ ID NO: 1569030 - RNA, 14 nt, Homo sapiens
ucaaauugcugcuu

SEQ ID NO: 1569031 - RNA, 15 nt, Homo sapiens
ucaaauugcugcuug

SEQ ID NO: 1569032 - RNA, 23 nt, Homo sapiens
ucaaauuuauuuccaauguuuca

SEQ ID NO: 1569033 - RNA, 23 nt, Homo sapiens
ucaacaagauuuccuugugcaaa

SEQ ID NO: 1569034 - RNA, 19 nt, Homo sapiens
ucaacaauuuauccauuca

SEQ ID NO: 1569035 - RNA, 16 nt, Homo sapiens
ucaacauuaccaaaau

SEQ ID NO: 1569036 - RNA, 15 nt, Homo sapiens
ucaacauuccaggga

SEQ ID NO: 1569037 - RNA, 12 nt, Homo sapiens
ucaacauugcau

SEQ ID NO: 1569038 - RNA, 14 nt, Homo sapiens
ucaacauuuccaaa

SEQ ID NO: 1569039 - RNA, 20 nt, Homo sapiens
ucaaccugggacuuccuaaa

SEQ ID NO: 1569040 - RNA, 22 nt, Homo sapiens
ucaaccugguggcaccagaugc

SEQ ID NO: 1569041 - RNA, 16 nt, Homo sapiens
ucaacuccgugcuuaa

SEQ ID NO: 1569042 - RNA, 17 nt, Homo sapiens
ucaacugaaugagguca

SEQ ID NO: 1569043 - RNA, 16 nt, Homo sapiens
ucaacugccucucuuu

SEQ ID NO: 1569044 - RNA, 19 nt, Homo sapiens
ucaacuggcuacugaguca

SEQ ID NO: 1569045 - RNA, 18 nt, Homo sapiens
ucaacuugcaauuugcaa

SEQ ID NO: 1569046 - RNA, 22 nt, Homo sapiens
ucaacuuggugacacucuauaa

SEQ ID NO: 1569047 - RNA, 18 nt, Homo sapiens
ucaacuuuuuauugccuu

SEQ ID NO: 1569048 - RNA, 21 nt, Homo sapiens
ucaagaauuuuuugacuugaa

SEQ ID NO: 1569049 - RNA, 19 nt, Homo sapiens
ucaagacaagccuggccua

SEQ ID NO: 1569050 - RNA, 23 nt, Homo sapiens
ucaagacagaugagcaggagcuu

SEQ ID NO: 1569051 - RNA, 20 nt, Homo sapiens
ucaagaccagccugggcaac

SEQ ID NO: 1569052 - RNA, 22 nt, Homo sapiens
ucaagacgucacccuccauucu

SEQ ID NO: 1569053 - RNA, 18 nt, Homo sapiens
ucaagacuuccucaugaa

SEQ ID NO: 1569054 - RNA, 23 nt, Homo sapiens
ucaagagaucuuucuuuccaaaa

SEQ ID NO: 1569055 - RNA, 16 nt, Homo sapiens
ucaagagcaugcacau

SEQ ID NO: 1569056 - RNA, 13 nt, Homo sapiens
ucaagagccagca

SEQ ID NO: 1569057 - RNA, 19 nt, Homo sapiens
ucaagauuuuuuuugucag

SEQ ID NO: 1569058 - RNA, 13 nt, Homo sapiens
ucaagcacuaaaa

SEQ ID NO: 1569059 - RNA, 13 nt, Homo sapiens
ucaagccauucca

SEQ ID NO: 1569060 - RNA, 15 nt, Homo sapiens
ucaagccccauuucc

SEQ ID NO: 1569061 - RNA, 18 nt, Homo sapiens
ucaagccugugcaaaaaa

SEQ ID NO: 1569062 - RNA, 13 nt, Homo sapiens
ucaagcucagggc

SEQ ID NO: 1569063 - RNA, 16 nt, Homo sapiens
ucaagcuggugcuacu

SEQ ID NO: 1569064 - RNA, 20 nt, Homo sapiens
ucaaggacagccaccaagaa

SEQ ID NO: 1569065 - RNA, 17 nt, Homo sapiens
ucaaggacaggagccug

SEQ ID NO: 1569066 - RNA, 18 nt, Homo sapiens
ucaagggcacugugauac

SEQ ID NO: 1569067 - RNA, 17 nt, Homo sapiens
ucaaguaauacaaacua

SEQ ID NO: 1569068 - RNA, 18 nt, Homo sapiens
ucaaguaauaggcauuuu

SEQ ID NO: 1569069 - RNA, 16 nt, Homo sapiens
ucaagucuacugccac

SEQ ID NO: 1569070 - RNA, 13 nt, Homo sapiens
ucaagucucucac

SEQ ID NO: 1569071 - RNA, 21 nt, Homo sapiens
ucaagugccuagacuguuacu

SEQ ID NO: 1569072 - RNA, 22 nt, Homo sapiens
ucaagugcgugacuguaugugu

SEQ ID NO: 1569073 - RNA, 19 nt, Homo sapiens
ucaaguuguugacugugau

SEQ ID NO: 1569074 - RNA, 20 nt, Homo sapiens
ucaaguuuuucauacuguac

SEQ ID NO: 1569075 - RNA, 16 nt, Homo sapiens
ucaauaaaccacaagc

SEQ ID NO: 1569076 - RNA, 17 nt, Homo sapiens
ucaauaaaccacaagca

SEQ ID NO: 1569077 - RNA, 17 nt, Homo sapiens
ucaauacacaguacuuc

SEQ ID NO: 1569078 - RNA, 19 nt, Homo sapiens
ucaauagcaccccuacuca

SEQ ID NO: 1569079 - RNA, 12 nt, Homo sapiens
ucaauaguauua

SEQ ID NO: 1569080 - RNA, 22 nt, Homo sapiens
ucaauauaagaagcaaucuuug

SEQ ID NO: 1569081 - RNA, 21 nt, Homo sapiens
ucaauauuuuuauaucaugca

SEQ ID NO: 1569082 - RNA, 16 nt, Homo sapiens
ucaaucaaguuuacau

SEQ ID NO: 1569083 - RNA, 15 nt, Homo sapiens
uaugcucauugaacu

SEQ ID NO: 1569084 - RNA, 12 nt, Homo sapiens
uaugcuggccag

SEQ ID NO: 1569085 - RNA, 13 nt, Homo sapiens
uauggaauaucau

SEQ ID NO: 1569086 - RNA, 19 nt, Homo sapiens
uauggaauugauuugcauu

SEQ ID NO: 1569087 - RNA, 19 nt, Homo sapiens
uauggaauuuugcaaagau

SEQ ID NO: 1569088 - RNA, 16 nt, Homo sapiens
uauggagaauugcuga

SEQ ID NO: 1569089 - RNA, 14 nt, Homo sapiens
uauggcauuugcag

SEQ ID NO: 1569090 - RNA, 16 nt, Homo sapiens
uauggcuagacaggaa

SEQ ID NO: 1569091 - RNA, 16 nt, Homo sapiens
uauggcuauucuugaa

SEQ ID NO: 1569092 - RNA, 17 nt, Homo sapiens
uaugguuagcugucaca

SEQ ID NO: 1569093 - RNA, 17 nt, Homo sapiens
uaugguucucucgcaag

SEQ ID NO: 1569094 - RNA, 14 nt, Homo sapiens
uauguagugcauuu

SEQ ID NO: 1569095 - RNA, 19 nt, Homo sapiens
uauguaugcugauuuacua

SEQ ID NO: 1569096 - RNA, 14 nt, Homo sapiens
uaugucucaugaug

SEQ ID NO: 1569097 - RNA, 15 nt, Homo sapiens
uaugugacuugcaau

SEQ ID NO: 1569098 - RNA, 23 nt, Homo sapiens
uaugugagagaaagugugagcaa

SEQ ID NO: 1569099 - RNA, 12 nt, Homo sapiens
uaugugcacauc

SEQ ID NO: 1569100 - RNA, 23 nt, Homo sapiens
uauguggaagugugggucugugu

SEQ ID NO: 1569101 - RNA, 16 nt, Homo sapiens
uaugugggggucugug

SEQ ID NO: 1569102 - RNA, 17 nt, Homo sapiens
uaugugugguacuuugc

SEQ ID NO: 1569103 - RNA, 17 nt, Homo sapiens
uauguuuccuaacugug

SEQ ID NO: 1569104 - RNA, 17 nt, Homo sapiens
uauguuuucuuucucac

SEQ ID NO: 1569105 - RNA, 20 nt, Homo sapiens
uauguuuucuuucucaccca

SEQ ID NO: 1569106 - RNA, 15 nt, Homo sapiens
uauuaagauucuuga

SEQ ID NO: 1569107 - RNA, 20 nt, Homo sapiens
uauuaaggccuuuuccacac

SEQ ID NO: 1569108 - RNA, 15 nt, Homo sapiens
uauuaccuaaugaaa

SEQ ID NO: 1569109 - RNA, 19 nt, Homo sapiens
uauuaccuggucauuucaa

SEQ ID NO: 1569110 - RNA, 21 nt, Homo sapiens
uauuagagcugccugugccuu

SEQ ID NO: 1569111 - RNA, 14 nt, Homo sapiens
uauuauaaacuaua

SEQ ID NO: 1569112 - RNA, 14 nt, Homo sapiens
uauuauaaagccaa

SEQ ID NO: 1569113 - RNA, 18 nt, Homo sapiens
uauuauagcaacuuuaag

SEQ ID NO: 1569114 - RNA, 16 nt, Homo sapiens
uauuauauauuuacag

SEQ ID NO: 1569115 - RNA, 17 nt, Homo sapiens
uauuauguaaauuuugc

SEQ ID NO: 1569116 - RNA, 20 nt, Homo sapiens
uauucaauacacaguacuuc

SEQ ID NO: 1569117 - RNA, 18 nt, Homo sapiens
uauucacugguuuuacac

SEQ ID NO: 1569118 - RNA, 18 nt, Homo sapiens
uauucacuugugugugua

SEQ ID NO: 1569119 - RNA, 15 nt, Homo sapiens
uauucaggcacugag

SEQ ID NO: 1569120 - RNA, 14 nt, Homo sapiens
uauucauuccucac

SEQ ID NO: 1569121 - RNA, 14 nt, Homo sapiens
uauuccaccuuaaa

SEQ ID NO: 1569122 - RNA, 21 nt, Homo sapiens
uauucccaaaaauuacuuugg

SEQ ID NO: 1569123 - RNA, 21 nt, Homo sapiens
uauucuaagaaauaucuguga

SEQ ID NO: 1569124 - RNA, 23 nt, Homo sapiens
uauucuaguuuugucaaacugua

SEQ ID NO: 1569125 - RNA, 17 nt, Homo sapiens
uauucucacuccaccac

SEQ ID NO: 1569126 - RNA, 19 nt, Homo sapiens
uauucucacuccaccaccc

SEQ ID NO: 1569127 - RNA, 14 nt, Homo sapiens
uauucugacaugua

SEQ ID NO: 1569128 - RNA, 19 nt, Homo sapiens
uauucugccuuccaguuug

SEQ ID NO: 1569129 - RNA, 18 nt, Homo sapiens
uauucuucacuuaaacuc

SEQ ID NO: 1569130 - RNA, 19 nt, Homo sapiens
uauugaaguuguuuaucaa

SEQ ID NO: 1569131 - RNA, 18 nt, Homo sapiens
uauugaaugaugugauac

SEQ ID NO: 1569132 - RNA, 19 nt, Homo sapiens
uauugacacugaacuuaau

SEQ ID NO: 1569133 - RNA, 17 nt, Homo sapiens
uauugacucaaaccaua

SEQ ID NO: 1569134 - RNA, 14 nt, Homo sapiens
uauugcucugagaa

SEQ ID NO: 1569135 - RNA, 12 nt, Homo sapiens
uauugcuucuag

SEQ ID NO: 1569136 - RNA, 17 nt, Homo sapiens
uauuggauuuucacaga

SEQ ID NO: 1569137 - RNA, 17 nt, Homo sapiens
uauuggcauagaaaaaa

SEQ ID NO: 1569138 - RNA, 23 nt, Homo sapiens
uauuggcccuaaauagcagaaag

SEQ ID NO: 1569139 - RNA, 15 nt, Homo sapiens
uauugguuugcacaa

SEQ ID NO: 1569140 - RNA, 18 nt, Homo sapiens
uauuguacagaagcucuu

SEQ ID NO: 1569141 - RNA, 23 nt, Homo sapiens
uauuguccaccaugcucucucac

SEQ ID NO: 1569142 - RNA, 20 nt, Homo sapiens
uauuguggaauugacucaaa

SEQ ID NO: 1569143 - RNA, 21 nt, Homo sapiens
uauuguugcuuuuuuuccaau

SEQ ID NO: 1569144 - RNA, 18 nt, Homo sapiens
uauuuaaaaaauuaugga

SEQ ID NO: 1569145 - RNA, 22 nt, Homo sapiens
uauuuaaaaaauuauggaauau

SEQ ID NO: 1569146 - RNA, 23 nt, Homo sapiens
uauuuaaaggaaaaucacaucuc

SEQ ID NO: 1569147 - RNA, 13 nt, Homo sapiens
uauuuaaauucca

SEQ ID NO: 1569148 - RNA, 18 nt, Homo sapiens
uauuuaacaaaaagugcu

SEQ ID NO: 1569149 - RNA, 14 nt, Homo sapiens
uauuuaagcaaaua

SEQ ID NO: 1569150 - RNA, 12 nt, Homo sapiens
uauuuacauuua

SEQ ID NO: 1569151 - RNA, 21 nt, Homo sapiens
uauuuagccccauuacacuag

SEQ ID NO: 1569152 - RNA, 21 nt, Homo sapiens
uauuuauagucgaacaauuca

SEQ ID NO: 1569153 - RNA, 18 nt, Homo sapiens
uauuuauuuuuaccugcu

SEQ ID NO: 1569154 - RNA, 18 nt, Homo sapiens
uauuucaagucucucacc

SEQ ID NO: 1569155 - RNA, 13 nt, Homo sapiens
uauuucaauguaa

SEQ ID NO: 1569156 - RNA, 19 nt, Homo sapiens
uauuucaauucuaaaauac

SEQ ID NO: 1569157 - RNA, 20 nt, Homo sapiens
uauuucagccaaaacauacc

SEQ ID NO: 1569158 - RNA, 15 nt, Homo sapiens
uggaauuuugcaaag

SEQ ID NO: 1569159 - RNA, 24 nt, Homo sapiens
uggacacuguccaugaagcacuga

SEQ ID NO: 1569160 - RNA, 21 nt, Homo sapiens
uggacagaaaaugcaaugaca

SEQ ID NO: 1569161 - RNA, 21 nt, Homo sapiens
uggaccaccguucagucauuu

SEQ ID NO: 1569162 - RNA, 19 nt, Homo sapiens
uggaccagcccauuggccg

SEQ ID NO: 1569163 - RNA, 15 nt, Homo sapiens
uggaccaugccagau

SEQ ID NO: 1569164 - RNA, 18 nt, Homo sapiens
uggacccaaaaaaucauc

SEQ ID NO: 1569165 - RNA, 12 nt, Homo sapiens
uggacuacacaa

SEQ ID NO: 1569166 - RNA, 14 nt, Homo sapiens
uggacuacacaaua

SEQ ID NO: 1569167 - RNA, 14 nt, Homo sapiens
uggacucucaggga

SEQ ID NO: 1569168 - RNA, 15 nt, Homo sapiens
uggacucucagggau

SEQ ID NO: 1569169 - RNA, 13 nt, Homo sapiens
uggacucuuccac

SEQ ID NO: 1569170 - RNA, 18 nt, Homo sapiens
uggacugugcuggugcau

SEQ ID NO: 1569171 - RNA, 15 nt, Homo sapiens
uggacuuauucauuc

SEQ ID NO: 1569172 - RNA, 18 nt, Homo sapiens
uggacuucagucuugccu

SEQ ID NO: 1569173 - RNA, 17 nt, Homo sapiens
uggagaaaaaaauugcu

SEQ ID NO: 1569174 - RNA, 15 nt, Homo sapiens
uggagaaaguauuua

SEQ ID NO: 1569175 - RNA, 22 nt, Homo sapiens
uggagaaccagggcucuucuca

SEQ ID NO: 1569176 - RNA, 22 nt, Homo sapiens
uggagaacccaggggacagcug

SEQ ID NO: 1569177 - RNA, 15 nt, Homo sapiens
uggagagaagcugau

SEQ ID NO: 1569178 - RNA, 19 nt, Homo sapiens
uggagagucagaucuuucu

SEQ ID NO: 1569179 - RNA, 20 nt, Homo sapiens
uggagagucagaucuuucuc

SEQ ID NO: 1569180 - RNA, 14 nt, Homo sapiens
uggagagugcacau

SEQ ID NO: 1569181 - RNA, 13 nt, Homo sapiens
uggagaugaagcc

SEQ ID NO: 1569182 - RNA, 21 nt, Homo sapiens
uggagauucaguuuucauuug

SEQ ID NO: 1569183 - RNA, 13 nt, Homo sapiens
uggagcacgugga

SEQ ID NO: 1569184 - RNA, 15 nt, Homo sapiens
uggagcaucaagcca

SEQ ID NO: 1569185 - RNA, 16 nt, Homo sapiens
uggagcccagcgucag

SEQ ID NO: 1569186 - RNA, 22 nt, Homo sapiens
uggagccuuaguugagauuuca

SEQ ID NO: 1569187 - RNA, 16 nt, Homo sapiens
uggagcucagguccca

SEQ ID NO: 1569188 - RNA, 15 nt, Homo sapiens
uggagcugaaaacau

SEQ ID NO: 1569189 - RNA, 24 nt, Homo sapiens
uggagcugagcagguguucuucau

SEQ ID NO: 1569190 - RNA, 13 nt, Homo sapiens
uggagcugucauc

SEQ ID NO: 1569191 - RNA, 14 nt, Homo sapiens
uggaggaacaguau

SEQ ID NO: 1569192 - RNA, 22 nt, Homo sapiens
uggaggcacaacgcaccagaca

SEQ ID NO: 1569193 - RNA, 11 nt, Homo sapiens
uggaggcuucc

SEQ ID NO: 1569194 - RNA, 15 nt, Homo sapiens
uggagggaaggacag

SEQ ID NO: 1569195 - RNA, 19 nt, Homo sapiens
uggagggaaugcucagaaa

SEQ ID NO: 1569196 - RNA, 16 nt, Homo sapiens
uggagggacaugacua

SEQ ID NO: 1569197 - RNA, 20 nt, Homo sapiens
uggagggggcuggggucaca

SEQ ID NO: 1569198 - RNA, 23 nt, Homo sapiens
uggagggguggcccagagccaua

SEQ ID NO: 1569199 - RNA, 12 nt, Homo sapiens
uggaggguccca

SEQ ID NO: 1569200 - RNA, 17 nt, Homo sapiens
uggaggucagcauuuga

SEQ ID NO: 1569201 - RNA, 22 nt, Homo sapiens
uggagguggaaaagcaacauuc

SEQ ID NO: 1569202 - RNA, 21 nt, Homo sapiens
uggagguuuguuuagaagaag

SEQ ID NO: 1569203 - RNA, 14 nt, Homo sapiens
uggagucacuguag

SEQ ID NO: 1569204 - RNA, 16 nt, Homo sapiens
uggagucguguuguca

SEQ ID NO: 1569205 - RNA, 23 nt, Homo sapiens
uggagucuugugccaaaccuacu

SEQ ID NO: 1569206 - RNA, 19 nt, Homo sapiens
uggagugccaaguuugcaa

SEQ ID NO: 1569207 - RNA, 17 nt, Homo sapiens
uggaguuaucaguuauc

SEQ ID NO: 1569208 - RNA, 24 nt, Homo sapiens
uggaguuucauguacaagaugaag

SEQ ID NO: 1569209 - RNA, 14 nt, Homo sapiens
uggauaacuuuaca

SEQ ID NO: 1569210 - RNA, 15 nt, Homo sapiens
uggauaacuuuacag

SEQ ID NO: 1569211 - RNA, 17 nt, Homo sapiens
uggauagcuaauaauga

SEQ ID NO: 1569212 - RNA, 14 nt, Homo sapiens
uggauauucauucu

SEQ ID NO: 1569213 - RNA, 22 nt, Homo sapiens
uggauauucuccucggacugug

SEQ ID NO: 1569214 - RNA, 19 nt, Homo sapiens
uggauccacaaggccugag

SEQ ID NO: 1569215 - RNA, 13 nt, Homo sapiens
uggauccagcacu

SEQ ID NO: 1569216 - RNA, 23 nt, Homo sapiens
uggauccugggucaaaaaaaaga

SEQ ID NO: 1569217 - RNA, 21 nt, Homo sapiens
uggaucuauuuacauagucau

SEQ ID NO: 1569218 - RNA, 12 nt, Homo sapiens
uggaucugugag

SEQ ID NO: 1569219 - RNA, 21 nt, Homo sapiens
uggaugacccuccccuaguca

SEQ ID NO: 1569220 - RNA, 14 nt, Homo sapiens
uggaugacuugaga

SEQ ID NO: 1569221 - RNA, 17 nt, Homo sapiens
uggaugcagcacgccaa

SEQ ID NO: 1569222 - RNA, 12 nt, Homo sapiens
uggaugcaugaa

SEQ ID NO: 1569223 - RNA, 20 nt, Homo sapiens
uggaugccgauuucuguaaa

SEQ ID NO: 1569224 - RNA, 21 nt, Homo sapiens
uggauguugcuuuugcaccua

SEQ ID NO: 1569225 - RNA, 20 nt, Homo sapiens
uggauucaggugcuggagaa

SEQ ID NO: 1569226 - RNA, 17 nt, Homo sapiens
uggauucauucucauaa

SEQ ID NO: 1569227 - RNA, 22 nt, Homo sapiens
uggauuccuagauuacaucugc

SEQ ID NO: 1569228 - RNA, 13 nt, Homo sapiens
uggauugauaucg

SEQ ID NO: 1569229 - RNA, 22 nt, Homo sapiens
uggauuuaaaagccugcucaau

SEQ ID NO: 1569230 - RNA, 15 nt, Homo sapiens
uggauuuauagcuau

SEQ ID NO: 1569231 - RNA, 19 nt, Homo sapiens
uggauuuugaaauuuacug

SEQ ID NO: 1569232 - RNA, 18 nt, Homo sapiens
uggauuuugcauguaaua

SEQ ID NO: 1569233 - RNA, 18 nt, Homo sapiens
uggauuuuucuuuaacug

SEQ ID NO: 1569234 - RNA, 22 nt, Homo sapiens
uggcaaaaaggagccuuuugcu

SEQ ID NO: 1569235 - RNA, 18 nt, Homo sapiens
uggcaaacugaagcugca

SEQ ID NO: 1569236 - RNA, 20 nt, Homo sapiens
uggcaacaaaaaguaaugaa

SEQ ID NO: 1569237 - RNA, 17 nt, Homo sapiens
uggcacuuauaaccaaa

SEQ ID NO: 1569238 - RNA, 20 nt, Homo sapiens
uggcacuuuugaugaaauaa

SEQ ID NO: 1569239 - RNA, 13 nt, Homo sapiens
uggcagagccaug

SEQ ID NO: 1569240 - RNA, 19 nt, Homo sapiens
uggcagaucuacaugucua

SEQ ID NO: 1569241 - RNA, 23 nt, Homo sapiens
uggcauagaaaaaaguagcaaau

SEQ ID NO: 1569242 - RNA, 16 nt, Homo sapiens
uggcauagccccggcc

SEQ ID NO: 1569243 - RNA, 15 nt, Homo sapiens
uggcauaugguccua

SEQ ID NO: 1569244 - RNA, 19 nt, Homo sapiens
uggcauaugguccuagaca

SEQ ID NO: 1569245 - RNA, 13 nt, Homo sapiens
uggcauccucaca

SEQ ID NO: 1569246 - RNA, 17 nt, Homo sapiens
uggcauggugcagggag

SEQ ID NO: 1569247 - RNA, 23 nt, Homo sapiens
uggcauuugggugaacuguggac

SEQ ID NO: 1569248 - RNA, 21 nt, Homo sapiens
uggccaauucaguuucacuuu

SEQ ID NO: 1569249 - RNA, 21 nt, Homo sapiens
uggccacacacugaguugcac

SEQ ID NO: 1569250 - RNA, 14 nt, Homo sapiens
uggccacacugggg

SEQ ID NO: 1569251 - RNA, 20 nt, Homo sapiens
uggccacaguaauuggucau

SEQ ID NO: 1569252 - RNA, 18 nt, Homo sapiens
uggccagaaauaaaggga

SEQ ID NO: 1569253 - RNA, 16 nt, Homo sapiens
uggccagccagaucaa

SEQ ID NO: 1569254 - RNA, 18 nt, Homo sapiens
uggccaggcuggucucaa

SEQ ID NO: 1569255 - RNA, 19 nt, Homo sapiens
uggccaggcuggucucaaa

SEQ ID NO: 1569256 - RNA, 13 nt, Homo sapiens
uggccaguucauu

SEQ ID NO: 1569257 - RNA, 16 nt, Homo sapiens
uggcccauaaugugaa

SEQ ID NO: 1569258 - RNA, 21 nt, Homo sapiens
ucuagaaagcucuaaagacca

SEQ ID NO: 1569259 - RNA, 17 nt, Homo sapiens
ucuagaagcuccaguga

SEQ ID NO: 1569260 - RNA, 19 nt, Homo sapiens
ucuagaaucauacuuaaca

SEQ ID NO: 1569261 - RNA, 14 nt, Homo sapiens
ucuagacuagcaau

SEQ ID NO: 1569262 - RNA, 17 nt, Homo sapiens
ucuagagacacauugga

SEQ ID NO: 1569263 - RNA, 13 nt, Homo sapiens
ucuagagcaaagc

SEQ ID NO: 1569264 - RNA, 22 nt, Homo sapiens
ucuagaggcaucaccugggacc

SEQ ID NO: 1569265 - RNA, 17 nt, Homo sapiens
ucuagcacacucuucuc

SEQ ID NO: 1569266 - RNA, 18 nt, Homo sapiens
ucuaggagucaacuggcu

SEQ ID NO: 1569267 - RNA, 22 nt, Homo sapiens
ucuaguccacuuuucuuuacau

SEQ ID NO: 1569268 - RNA, 17 nt, Homo sapiens
ucuaguucauugaauca

SEQ ID NO: 1569269 - RNA, 16 nt, Homo sapiens
ucuaguugcaguauug

SEQ ID NO: 1569270 - RNA, 15 nt, Homo sapiens
ucuaguuuugucaaa

SEQ ID NO: 1569271 - RNA, 14 nt, Homo sapiens
ucuauaaacagaca

SEQ ID NO: 1569272 - RNA, 20 nt, Homo sapiens
ucuauacaaauuuucagaag

SEQ ID NO: 1569273 - RNA, 13 nt, Homo sapiens
ucuauaccugccu

SEQ ID NO: 1569274 - RNA, 23 nt, Homo sapiens
ucuauagguuuuuaaauggaauu

SEQ ID NO: 1569275 - RNA, 13 nt, Homo sapiens
ucuauaucaaaaa

SEQ ID NO: 1569276 - RNA, 17 nt, Homo sapiens
ucuaucauuuuugagca

SEQ ID NO: 1569277 - RNA, 18 nt, Homo sapiens
ucuaugacgcaaagauca

SEQ ID NO: 1569278 - RNA, 13 nt, Homo sapiens
ucuauggauucac

SEQ ID NO: 1569279 - RNA, 19 nt, Homo sapiens
ucuauggguuggacaaccu

SEQ ID NO: 1569280 - RNA, 16 nt, Homo sapiens
ucuaugucucaugaug

SEQ ID NO: 1569281 - RNA, 11 nt, Homo sapiens
ucuauguuaau

SEQ ID NO: 1569282 - RNA, 12 nt, Homo sapiens
ucuauguucccc

SEQ ID NO: 1569283 - RNA, 12 nt, Homo sapiens
ucuauuaaucaa

SEQ ID NO: 1569284 - RNA, 14 nt, Homo sapiens
ucuauuaaucaccu

SEQ ID NO: 1569285 - RNA, 12 nt, Homo sapiens
ucuauucuagcc

SEQ ID NO: 1569286 - RNA, 13 nt, Homo sapiens
ucuauuugugcuu

SEQ ID NO: 1569287 - RNA, 16 nt, Homo sapiens
ucucaaaacaauauua

SEQ ID NO: 1569288 - RNA, 21 nt, Homo sapiens
ucucaaaacugcacugucaag

SEQ ID NO: 1569289 - RNA, 16 nt, Homo sapiens
ucucaaacuacuggca

SEQ ID NO: 1569290 - RNA, 12 nt, Homo sapiens
ucucaaacuuca

SEQ ID NO: 1569291 - RNA, 16 nt, Homo sapiens
ucucaaacuucacuaa

SEQ ID NO: 1569292 - RNA, 22 nt, Homo sapiens
ucucaaagcauaaaauggaaua

SEQ ID NO: 1569293 - RNA, 20 nt, Homo sapiens
ucucaagcgcuauccacaga

SEQ ID NO: 1569294 - RNA, 23 nt, Homo sapiens
ucucacuuaauuuucccaaugau

SEQ ID NO: 1569295 - RNA, 12 nt, Homo sapiens
ucucagacacua

SEQ ID NO: 1569296 - RNA, 13 nt, Homo sapiens
ucucagaccccac

SEQ ID NO: 1569297 - RNA, 13 nt, Homo sapiens
ucucagaguccac

SEQ ID NO: 1569298 - RNA, 20 nt, Homo sapiens
ucucagaguccacuguggca

SEQ ID NO: 1569299 - RNA, 18 nt, Homo sapiens
ucucagagugacagucau

SEQ ID NO: 1569300 - RNA, 17 nt, Homo sapiens
ucucagcugcuggauga

SEQ ID NO: 1569301 - RNA, 18 nt, Homo sapiens
ucucaggacagaaccacu

SEQ ID NO: 1569302 - RNA, 19 nt, Homo sapiens
ucucaggaccaaagcuuuc

SEQ ID NO: 1569303 - RNA, 17 nt, Homo sapiens
ucucaggagucucuggu

SEQ ID NO: 1569304 - RNA, 16 nt, Homo sapiens
ucucauagcuuuggag

SEQ ID NO: 1569305 - RNA, 15 nt, Homo sapiens
ucucaucccaaccuc

SEQ ID NO: 1569306 - RNA, 16 nt, Homo sapiens
ucucaucuuucuugau

SEQ ID NO: 1569307 - RNA, 18 nt, Homo sapiens
ucucaugagcuguguuca

SEQ ID NO: 1569308 - RNA, 23 nt, Homo sapiens
ucucaugauccaacuaaugccuu

SEQ ID NO: 1569309 - RNA, 15 nt, Homo sapiens
ucucaugugugcuca

SEQ ID NO: 1569310 - RNA, 17 nt, Homo sapiens
ucucauuacuuauacug

SEQ ID NO: 1569311 - RNA, 23 nt, Homo sapiens
ucucauugucuguguagaguguu

SEQ ID NO: 1569312 - RNA, 23 nt, Homo sapiens
ucucauuuuccugggugcaucaa

SEQ ID NO: 1569313 - RNA, 23 nt, Homo sapiens
ucuccaaccccccagcacugagg

SEQ ID NO: 1569314 - RNA, 15 nt, Homo sapiens
ucuccacacaggugu

SEQ ID NO: 1569315 - RNA, 13 nt, Homo sapiens
ucuccaccugcac

SEQ ID NO: 1569316 - RNA, 19 nt, Homo sapiens
ucuccacugggaccugacu

SEQ ID NO: 1569317 - RNA, 22 nt, Homo sapiens
ucuccagcaauaauguuuucua

SEQ ID NO: 1569318 - RNA, 21 nt, Homo sapiens
ucuccaggcauuuagcccuca

SEQ ID NO: 1569319 - RNA, 16 nt, Homo sapiens
ucuccccuccucugaa

SEQ ID NO: 1569320 - RNA, 21 nt, Homo sapiens
ucucccugccaagucucagaa

SEQ ID NO: 1569321 - RNA, 14 nt, Homo sapiens
ucucccugcugcuc

SEQ ID NO: 1569322 - RNA, 20 nt, Homo sapiens
ucuccucacucugucccugu

SEQ ID NO: 1569323 - RNA, 14 nt, Homo sapiens
ucuccuccauuccc

SEQ ID NO: 1569324 - RNA, 12 nt, Homo sapiens
ucuccugacccc

SEQ ID NO: 1569325 - RNA, 13 nt, Homo sapiens
ucuccugcugcag

SEQ ID NO: 1569326 - RNA, 18 nt, Homo sapiens
ucuccuguaagccaaaga

SEQ ID NO: 1569327 - RNA, 20 nt, Homo sapiens
ucuccuuugcucucuggcca

SEQ ID NO: 1569328 - RNA, 15 nt, Homo sapiens
ucucgacaguaucca

SEQ ID NO: 1569329 - RNA, 17 nt, Homo sapiens
ucucggcucacugcaag

SEQ ID NO: 1569330 - RNA, 14 nt, Homo sapiens
ucucgguuugccaa

SEQ ID NO: 1569331 - RNA, 14 nt, Homo sapiens
ucucuaucccugaa

SEQ ID NO: 1569332 - RNA, 15 nt, Homo sapiens
ucucucaugccuccu

SEQ ID NO: 1569333 - RNA, 21 nt, Homo sapiens
ucucuccacgguagcacuuga

SEQ ID NO: 1569334 - RNA, 16 nt, Homo sapiens
ucucucccagguccca

SEQ ID NO: 1569335 - RNA, 15 nt, Homo sapiens
ucucucccagucuac

SEQ ID NO: 1569336 - RNA, 22 nt, Homo sapiens
ucucucccagucuacccagaga

SEQ ID NO: 1569337 - RNA, 16 nt, Homo sapiens
ucucuccccauauaua

SEQ ID NO: 1569338 - RNA, 20 nt, Homo sapiens
ucucucuuagcauccugccu

SEQ ID NO: 1569339 - RNA, 22 nt, Homo sapiens
ucucucuuagcauccugccuua

SEQ ID NO: 1569340 - RNA, 15 nt, Homo sapiens
ucucucuugcaggaa

SEQ ID NO: 1569341 - RNA, 22 nt, Homo sapiens
ucucugaauuuucagagacuuu

SEQ ID NO: 1569342 - RNA, 15 nt, Homo sapiens
ucucugagcagugaa

SEQ ID NO: 1569343 - RNA, 19 nt, Homo sapiens
ucucugagcagugaaugau

SEQ ID NO: 1569344 - RNA, 14 nt, Homo sapiens
ucucugauacacag

SEQ ID NO: 1569345 - RNA, 17 nt, Homo sapiens
ucucugcagacuuccca

SEQ ID NO: 1569346 - RNA, 13 nt, Homo sapiens
ucucugccuguac

SEQ ID NO: 1569347 - RNA, 22 nt, Homo sapiens
ucucugccuguacugaagcuga

SEQ ID NO: 1569348 - RNA, 16 nt, Homo sapiens
ucucuuagcaacucag

SEQ ID NO: 1569349 - RNA, 18 nt, Homo sapiens
ucucuuccacauguuacu

SEQ ID NO: 1569350 - RNA, 16 nt, Homo sapiens
ucucuuccuucagaag

SEQ ID NO: 1569351 - RNA, 13 nt, Homo sapiens
ucucuucugccuu

SEQ ID NO: 1569352 - RNA, 14 nt, Homo sapiens
aaaaaaagaaucac

SEQ ID NO: 1569353 - RNA, 14 nt, Homo sapiens
aaaaaagcauauau

SEQ ID NO: 1569354 - RNA, 13 nt, Homo sapiens
aaaaaauacauua

SEQ ID NO: 1569355 - RNA, 11 nt, Homo sapiens
aaaaaauuacu

SEQ ID NO: 1569356 - RNA, 15 nt, Homo sapiens
aaaaacaggucuuca

SEQ ID NO: 1569357 - RNA, 19 nt, Homo sapiens
aaaaacaugagcaucccca

SEQ ID NO: 1569358 - RNA, 13 nt, Homo sapiens
aaaaacugaugaa

SEQ ID NO: 1569359 - RNA, 20 nt, Homo sapiens
aaaaagauggcuuaugucau

SEQ ID NO: 1569360 - RNA, 21 nt, Homo sapiens
aaaaagauucucaucacucaa

SEQ ID NO: 1569361 - RNA, 11 nt, Homo sapiens
aaaaaggccaa

SEQ ID NO: 1569362 - RNA, 12 nt, Homo sapiens
aaaaagguuuaa

SEQ ID NO: 1569363 - RNA, 21 nt, Homo sapiens
aaaaauaaaacuuuucaugua

SEQ ID NO: 1569364 - RNA, 21 nt, Homo sapiens
aaaaauaaacggaaguuacau

SEQ ID NO: 1569365 - RNA, 14 nt, Homo sapiens
aaaaauaauugcca

SEQ ID NO: 1569366 - RNA, 15 nt, Homo sapiens
aaaaauagacacucc

SEQ ID NO: 1569367 - RNA, 19 nt, Homo sapiens
aaaaauauuguuucugcau

SEQ ID NO: 1569368 - RNA, 15 nt, Homo sapiens
aaaaaucagggccac

SEQ ID NO: 1569369 - RNA, 13 nt, Homo sapiens
aaaaaugagcucg

SEQ ID NO: 1569370 - RNA, 16 nt, Homo sapiens
aaaaaugcacaccuca

SEQ ID NO: 1569371 - RNA, 12 nt, Homo sapiens
aaaaaugcugcu

SEQ ID NO: 1569372 - RNA, 13 nt, Homo sapiens
aaaaaugcugcuc

SEQ ID NO: 1569373 - RNA, 21 nt, Homo sapiens
aaaaaugguuuaaauggucaa

SEQ ID NO: 1569374 - RNA, 15 nt, Homo sapiens
aaaaaugucaucuca

SEQ ID NO: 1569375 - RNA, 14 nt, Homo sapiens
aaaaauuauggaau

SEQ ID NO: 1569376 - RNA, 16 nt, Homo sapiens
aaaaauucccuaaaga

SEQ ID NO: 1569377 - RNA, 18 nt, Homo sapiens
aaaaauugcucuguguau

SEQ ID NO: 1569378 - RNA, 15 nt, Homo sapiens
aaaaauuuauuauuu

SEQ ID NO: 1569379 - RNA, 16 nt, Homo sapiens
aaaacaaaacaaaaca

SEQ ID NO: 1569380 - RNA, 22 nt, Homo sapiens
aaaacaacagcucgauccaaau

SEQ ID NO: 1569381 - RNA, 13 nt, Homo sapiens
aaaacacacauac

SEQ ID NO: 1569382 - RNA, 23 nt, Homo sapiens
aaaacacauggggaaaaaaauca

SEQ ID NO: 1569383 - RNA, 18 nt, Homo sapiens
aaaacagccucacagaag

SEQ ID NO: 1569384 - RNA, 23 nt, Homo sapiens
aaaacagcucuguugaaucacag

SEQ ID NO: 1569385 - RNA, 18 nt, Homo sapiens
aaaacagggaauacauug

SEQ ID NO: 1569386 - RNA, 15 nt, Homo sapiens
aaaacaggucuucau

SEQ ID NO: 1569387 - RNA, 11 nt, Homo sapiens
aaaacagucau

SEQ ID NO: 1569388 - RNA, 20 nt, Homo sapiens
aaaggcaacauaauucuucc

SEQ ID NO: 1569389 - RNA, 17 nt, Homo sapiens
aaaggccaauauaccua

SEQ ID NO: 1569390 - RNA, 17 nt, Homo sapiens
aaaggcuaaacauaugg

SEQ ID NO: 1569391 - RNA, 21 nt, Homo sapiens
aaaggcugacauucacugagu

SEQ ID NO: 1569392 - RNA, 22 nt, Homo sapiens
aaaggcugacauucacugagug

SEQ ID NO: 1569393 - RNA, 13 nt, Homo sapiens
aaaggcugagaag

SEQ ID NO: 1569394 - RNA, 16 nt, Homo sapiens
aaagggaaacauagua

SEQ ID NO: 1569395 - RNA, 18 nt, Homo sapiens
aaagggaaugggucugca

SEQ ID NO: 1569396 - RNA, 16 nt, Homo sapiens
aaagggagaagaggga

SEQ ID NO: 1569397 - RNA, 21 nt, Homo sapiens
aaagggaucaucaugcagcuc

SEQ ID NO: 1569398 - RNA, 22 nt, Homo sapiens
aaagggaucaucaugcagcuca

SEQ ID NO: 1569399 - RNA, 16 nt, Homo sapiens
aaagguagauuuuaca

SEQ ID NO: 1569400 - RNA, 12 nt, Homo sapiens
aaagguccugua

SEQ ID NO: 1569401 - RNA, 14 nt, Homo sapiens
aaagguuggccuua

SEQ ID NO: 1569402 - RNA, 23 nt, Homo sapiens
aaagguuggccuuaguagucaaa

SEQ ID NO: 1569403 - RNA, 14 nt, Homo sapiens
aaagguuuuccuua

SEQ ID NO: 1569404 - RNA, 13 nt, Homo sapiens
aaaguaaugacuu

SEQ ID NO: 1569405 - RNA, 13 nt, Homo sapiens
aaaguaaugccac

SEQ ID NO: 1569406 - RNA, 20 nt, Homo sapiens
aaaguaauuguaaacuagua

SEQ ID NO: 1569407 - RNA, 13 nt, Homo sapiens
aaaguacuuuaau

SEQ ID NO: 1569408 - RNA, 14 nt, Homo sapiens
aaaguaguauugca

SEQ ID NO: 1569409 - RNA, 13 nt, Homo sapiens
aaaguaguuauuu

SEQ ID NO: 1569410 - RNA, 21 nt, Homo sapiens
aaaguauagauggccaaagga

SEQ ID NO: 1569411 - RNA, 20 nt, Homo sapiens
aaaguaucuugcacugauaa

SEQ ID NO: 1569412 - RNA, 11 nt, Homo sapiens
aaaguauucca

SEQ ID NO: 1569413 - RNA, 12 nt, Homo sapiens
aaaguauuguaa

SEQ ID NO: 1569414 - RNA, 16 nt, Homo sapiens
aaaguccacaagaaca

SEQ ID NO: 1569415 - RNA, 16 nt, Homo sapiens
aaagucguuuuccaaa

SEQ ID NO: 1569416 - RNA, 16 nt, Homo sapiens
aaaguggacaaggagu

SEQ ID NO: 1569417 - RNA, 17 nt, Homo sapiens
aaaacauaccauuucua

SEQ ID NO: 1569418 - RNA, 11 nt, Homo sapiens
aaaacauuccc

SEQ ID NO: 1569419 - RNA, 19 nt, Homo sapiens
aaaaccauguaauggauuu

SEQ ID NO: 1569420 - RNA, 17 nt, Homo sapiens
aaaaccuaccagccaga

SEQ ID NO: 1569421 - RNA, 17 nt, Homo sapiens
aaaaccuuuacaguuag

SEQ ID NO: 1569422 - RNA, 14 nt, Homo sapiens
aaaacuaaccaucu

SEQ ID NO: 1569423 - RNA, 14 nt, Homo sapiens
aaaacuaccacaug

SEQ ID NO: 1569424 - RNA, 13 nt, Homo sapiens
aaaacuagcauua

SEQ ID NO: 1569425 - RNA, 21 nt, Homo sapiens
aaaacuauguguucaaugaaa

SEQ ID NO: 1569426 - RNA, 18 nt, Homo sapiens
aaaagaaagaaccacuca

SEQ ID NO: 1569427 - RNA, 15 nt, Homo sapiens
aaaagaacaugcagu

SEQ ID NO: 1569428 - RNA, 15 nt, Homo sapiens
aaaagaaugacuaua

SEQ ID NO: 1569429 - RNA, 23 nt, Homo sapiens
aaaagacauguuggaaauguagu

SEQ ID NO: 1569430 - RNA, 15 nt, Homo sapiens
aaaagacuccaaaga

SEQ ID NO: 1569431 - RNA, 13 nt, Homo sapiens
aaaagacugacca

SEQ ID NO: 1569432 - RNA, 19 nt, Homo sapiens
aaaagaggccagcucugca

SEQ ID NO: 1569433 - RNA, 19 nt, Homo sapiens
aaaagaugguaaaccagau

SEQ ID NO: 1569434 - RNA, 14 nt, Homo sapiens
aaaagcaaguucgu

SEQ ID NO: 1569435 - RNA, 16 nt, Homo sapiens
aaaagcaauacuguuu

SEQ ID NO: 1569436 - RNA, 18 nt, Homo sapiens
aaaagcacaaaguucuca

SEQ ID NO: 1569437 - RNA, 16 nt, Homo sapiens
aaaagcacaaguacuu

SEQ ID NO: 1569438 - RNA, 16 nt, Homo sapiens
aaaagcaugcauauca

SEQ ID NO: 1569439 - RNA, 13 nt, Homo sapiens
aaaagcauguaua

SEQ ID NO: 1569440 - RNA, 23 nt, Homo sapiens
aaaagcgcucccccgucgugcuu

SEQ ID NO: 1569441 - RNA, 22 nt, Homo sapiens
aaaaggacuauggccacauuca

SEQ ID NO: 1569442 - RNA, 20 nt, Homo sapiens
aaaaggguacagaugugcug

SEQ ID NO: 1569443 - RNA, 19 nt, Homo sapiens
aaaaggguguugcuaagcu

SEQ ID NO: 1569444 - RNA, 21 nt, Homo sapiens
aaaaggucugaggacugagcc

SEQ ID NO: 1569445 - RNA, 19 nt, Homo sapiens
aaaagguuuucuucauuca

SEQ ID NO: 1569446 - RNA, 15 nt, Homo sapiens
aaaaguacauaauga

SEQ ID NO: 1569447 - RNA, 20 nt, Homo sapiens
aaucaagguaagcucaggau

SEQ ID NO: 1569448 - RNA, 21 nt, Homo sapiens
aaucaauaaagaccacuuuac

SEQ ID NO: 1569449 - RNA, 12 nt, Homo sapiens
aaucaaucugca

SEQ ID NO: 1569450 - RNA, 20 nt, Homo sapiens
aaucaaucuggcuucugcau

SEQ ID NO: 1569451 - RNA, 18 nt, Homo sapiens
aaucacaauuuuccugug

SEQ ID NO: 1569452 - RNA, 13 nt, Homo sapiens
aaucacaucucca

SEQ ID NO: 1569453 - RNA, 14 nt, Homo sapiens
aaucacaucuccag

SEQ ID NO: 1569454 - RNA, 19 nt, Homo sapiens
aaucaccaaggcugauuaa

SEQ ID NO: 1569455 - RNA, 17 nt, Homo sapiens
aaucacuuaagccugga

SEQ ID NO: 1569456 - RNA, 17 nt, Homo sapiens
aaucagauuagccugua

SEQ ID NO: 1569457 - RNA, 13 nt, Homo sapiens
aaucagcacucug

SEQ ID NO: 1569458 - RNA, 23 nt, Homo sapiens
aaucaggcgagacgccuuuguga

SEQ ID NO: 1569459 - RNA, 12 nt, Homo sapiens
aaucagggccac

SEQ ID NO: 1569460 - RNA, 15 nt, Homo sapiens
aaucauacuuaacau

SEQ ID NO: 1569461 - RNA, 15 nt, Homo sapiens
aaucauauaccagag

SEQ ID NO: 1569462 - RNA, 19 nt, Homo sapiens
aaucauauucauaugcaga

SEQ ID NO: 1569463 - RNA, 17 nt, Homo sapiens
aaucaugcucauguaua

SEQ ID NO: 1569464 - RNA, 13 nt, Homo sapiens
aaucauuaucuca

SEQ ID NO: 1569465 - RNA, 15 nt, Homo sapiens
aaucauuauguuucc

SEQ ID NO: 1569466 - RNA, 17 nt, Homo sapiens
aaucauucuacugaaca

SEQ ID NO: 1569467 - RNA, 20 nt, Homo sapiens
aaucauuucugcaucagcug

SEQ ID NO: 1569468 - RNA, 15 nt, Homo sapiens
aaucauuuuaaauuc

SEQ ID NO: 1569469 - RNA, 15 nt, Homo sapiens
aaugugugcuuuauu

SEQ ID NO: 1569470 - RNA, 20 nt, Homo sapiens
aauguguuauuugucacaaa

SEQ ID NO: 1569471 - RNA, 20 nt, Homo sapiens
aauguuaauugggcagguga

SEQ ID NO: 1569472 - RNA, 21 nt, Homo sapiens
aauguuaauugggcaggugaa

SEQ ID NO: 1569473 - RNA, 19 nt, Homo sapiens
aauguuauccaacuauuaa

SEQ ID NO: 1569474 - RNA, 18 nt, Homo sapiens
aauguuaugacuauguaa

SEQ ID NO: 1569475 - RNA, 20 nt, Homo sapiens
aauguucuaaaguuuugcaa

SEQ ID NO: 1569476 - RNA, 14 nt, Homo sapiens
aauguugcauuaau

SEQ ID NO: 1569477 - RNA, 23 nt, Homo sapiens
aauguugcauuuaugaugcaguu

SEQ ID NO: 1569478 - RNA, 21 nt, Homo sapiens
aauguuggcauuuaguagaaa

SEQ ID NO: 1569479 - RNA, 13 nt, Homo sapiens
aauguuucacuac

SEQ ID NO: 1569480 - RNA, 17 nt, Homo sapiens
aauguuuguccuguaua

SEQ ID NO: 1569481 - RNA, 15 nt, Homo sapiens
aauguuuguucauua

SEQ ID NO: 1569482 - RNA, 22 nt, Homo sapiens
aauguuuuaaaguuuaaugccu

SEQ ID NO: 1569483 - RNA, 16 nt, Homo sapiens
aauguuuucauuuuac

SEQ ID NO: 1569484 - RNA, 22 nt, Homo sapiens
aauguuuucuagucacuuccuc

SEQ ID NO: 1569485 - RNA, 17 nt, Homo sapiens
aauuaaaaaagcauacu

SEQ ID NO: 1569486 - RNA, 15 nt, Homo sapiens
aauuaaaaacuuuaa

SEQ ID NO: 1569487 - RNA, 14 nt, Homo sapiens
aauuaaaauacuau

SEQ ID NO: 1569488 - RNA, 16 nt, Homo sapiens
aauuaaaauuuauucu

SEQ ID NO: 1569489 - RNA, 23 nt, Homo sapiens
aauuaaacuguuaacuuauucaa

SEQ ID NO: 1569490 - RNA, 16 nt, Homo sapiens
aauuaaacuuccaaag

SEQ ID NO: 1569491 - RNA, 14 nt, Homo sapiens
aauuaaagccuuaa

SEQ ID NO: 1569492 - RNA, 21 nt, Homo sapiens
aauuaaagccuuaagcacaau

SEQ ID NO: 1569493 - RNA, 19 nt, Homo sapiens
aauuaaauauacuaccaag

SEQ ID NO: 1569494 - RNA, 13 nt, Homo sapiens
aauuaaauuggaa

SEQ ID NO: 1569495 - RNA, 15 nt, Homo sapiens
aauuaaccuuacuaa

SEQ ID NO: 1569496 - RNA, 14 nt, Homo sapiens
aauuaagacuuuau

SEQ ID NO: 1569497 - RNA, 20 nt, Homo sapiens
aauuaaugagacacacuuaa

SEQ ID NO: 1569498 - RNA, 21 nt, Homo sapiens
aauuacagacucaguagccau

SEQ ID NO: 1569499 - RNA, 13 nt, Homo sapiens
aauuacagacucu

SEQ ID NO: 1569500 - RNA, 16 nt, Homo sapiens
aauuacauacuauucu

SEQ ID NO: 1569501 - RNA, 23 nt, Homo sapiens
aauuacauguuuuuucauuugua

SEQ ID NO: 1569502 - RNA, 14 nt, Homo sapiens
aauuaccuguggau

SEQ ID NO: 1569503 - RNA, 22 nt, Homo sapiens
aauuacguucuuacaagcuuaa

SEQ ID NO: 1569504 - RNA, 17 nt, Homo sapiens
aauuacuaaauuacaaa

SEQ ID NO: 1569505 - RNA, 20 nt, Homo sapiens
aauuacuccaccaucaccuc

SEQ ID NO: 1569506 - RNA, 12 nt, Homo sapiens
aauuacuggaau

SEQ ID NO: 1569507 - RNA, 13 nt, Homo sapiens
aauuacuuuguga

SEQ ID NO: 1569508 - RNA, 22 nt, Homo sapiens
aauuacuuugugaauagaacuc

SEQ ID NO: 1569509 - RNA, 23 nt, Homo sapiens
aauuacuuugugaauagaacucu

SEQ ID NO: 1569510 - RNA, 14 nt, Homo sapiens
aauuagacuaagug

SEQ ID NO: 1569511 - RNA, 16 nt, Homo sapiens
aauuaggcagugcuaa

SEQ ID NO: 1569512 - RNA, 15 nt, Homo sapiens
aauuaggcuguaacu

SEQ ID NO: 1569513 - RNA, 15 nt, Homo sapiens
aauuaguaagccaug

SEQ ID NO: 1569514 - RNA, 20 nt, Homo sapiens
aauuagucuuuuguaauauc

SEQ ID NO: 1569515 - RNA, 13 nt, Homo sapiens
aauuauaugauau

SEQ ID NO: 1569516 - RNA, 16 nt, Homo sapiens
aauuaucaaaaagcua

SEQ ID NO: 1569517 - RNA, 17 nt, Homo sapiens
aauuauuaucuucuuaa

SEQ ID NO: 1569518 - RNA, 20 nt, Homo sapiens
aauuauugacacugaacuua

SEQ ID NO: 1569519 - RNA, 18 nt, Homo sapiens
aauuauugcuguauguaa

SEQ ID NO: 1569520 - RNA, 19 nt, Homo sapiens
aauuauuguagacaugccc

SEQ ID NO: 1569521 - RNA, 13 nt, Homo sapiens
aauucaaauccau

SEQ ID NO: 1569522 - RNA, 11 nt, Homo sapiens
aauucaagaaa

SEQ ID NO: 1569523 - RNA, 20 nt, Homo sapiens
aauucacagugcucuuuucu

SEQ ID NO: 1569524 - RNA, 20 nt, Homo sapiens
aauucacaugaugcacuuca

SEQ ID NO: 1569525 - RNA, 14 nt, Homo sapiens
aauucagaguccuu

SEQ ID NO: 1569526 - RNA, 16 nt, Homo sapiens
aauucagcaaaguggu

SEQ ID NO: 1569527 - RNA, 15 nt, Homo sapiens
aauucauucauuuca

SEQ ID NO: 1569528 - RNA, 16 nt, Homo sapiens
aauucauuugcuugca

SEQ ID NO: 1569529 - RNA, 22 nt, Homo sapiens
aauuccacaccuuuuauugaca

SEQ ID NO: 1569530 - RNA, 14 nt, Homo sapiens
aauucccuggaaaa

SEQ ID NO: 1569531 - RNA, 19 nt, Homo sapiens
aauucgugauuuucaagca

SEQ ID NO: 1569532 - RNA, 22 nt, Homo sapiens
aauucuaaaaaugguuaucauu

SEQ ID NO: 1569533 - RNA, 18 nt, Homo sapiens
aauucuaccuccuugugu

SEQ ID NO: 1569534 - RNA, 22 nt, Homo sapiens
aauucuaccuccuuguguugca

SEQ ID NO: 1569535 - RNA, 14 nt, Homo sapiens
aauucuacuggaaa

SEQ ID NO: 1569536 - RNA, 19 nt, Homo sapiens
aauucuaguauuuuaucug

SEQ ID NO: 1569537 - RNA, 21 nt, Homo sapiens
aauucucauaaguagcauuca

SEQ ID NO: 1569538 - RNA, 13 nt, Homo sapiens
aauucucuuucac

SEQ ID NO: 1569539 - RNA, 16 nt, Homo sapiens
aauucugugacauaca

SEQ ID NO: 1569540 - RNA, 21 nt, Homo sapiens
aauucuguuuuuaaugcuauu

SEQ ID NO: 1569541 - RNA, 17 nt, Homo sapiens
aauucuuagucacaaaa

SEQ ID NO: 1569542 - RNA, 14 nt, Homo sapiens
aauugaauaguuua

SEQ ID NO: 1569543 - RNA, 18 nt, Homo sapiens
aauugaauaguuuauuuc

SEQ ID NO: 1569544 - RNA, 17 nt, Homo sapiens
aauugacaaugauuuau

SEQ ID NO: 1569545 - RNA, 13 nt, Homo sapiens
aauugacacuuaa

SEQ ID NO: 1569546 - RNA, 20 nt, Homo sapiens
aauugacuuauacucuugag

SEQ ID NO: 1569547 - RNA, 13 nt, Homo sapiens
aauugaugaugca

SEQ ID NO: 1569548 - RNA, 13 nt, Homo sapiens
aauugauuugcau

SEQ ID NO: 1569549 - RNA, 18 nt, Homo sapiens
aauugcaaauaaaccacu

SEQ ID NO: 1569550 - RNA, 17 nt, Homo sapiens
aauugcaauacauuuca

SEQ ID NO: 1569551 - RNA, 18 nt, Homo sapiens
aauugcaauacauuucaa

SEQ ID NO: 1569552 - RNA, 23 nt, Homo sapiens
aauugcacacagaugugaaauga

SEQ ID NO: 1569553 - RNA, 22 nt, Homo sapiens
aauugcagguauuggggaacag

SEQ ID NO: 1569554 - RNA, 12 nt, Homo sapiens
aauugcauuuaa

SEQ ID NO: 1569555 - RNA, 15 nt, Homo sapiens
aauugcgcucagggg

SEQ ID NO: 1569556 - RNA, 18 nt, Homo sapiens
aauugcuaagaagggaaa

SEQ ID NO: 1569557 - RNA, 16 nt, Homo sapiens
aauugcuccugcaugc

SEQ ID NO: 1569558 - RNA, 21 nt, Homo sapiens
aauugcuuugccaaaauacca

SEQ ID NO: 1569559 - RNA, 17 nt, Homo sapiens
aauuggagaagauuuau

SEQ ID NO: 1569560 - RNA, 15 nt, Homo sapiens
aauugggcaggugaa

SEQ ID NO: 1569561 - RNA, 23 nt, Homo sapiens
aauuguaacgacuucuccaucuc

SEQ ID NO: 1569562 - RNA, 16 nt, Homo sapiens
aauuguauuacuuccu

SEQ ID NO: 1569563 - RNA, 19 nt, Homo sapiens
aauugucuaaaaugucagu

SEQ ID NO: 1569564 - RNA, 13 nt, Homo sapiens
aauugucugccau

SEQ ID NO: 1569565 - RNA, 22 nt, Homo sapiens
aauugugguuuauugaauguga

SEQ ID NO: 1569566 - RNA, 16 nt, Homo sapiens
aauuuaaacucugaag

SEQ ID NO: 1569567 - RNA, 14 nt, Homo sapiens
aauaaaaaucacuu

SEQ ID NO: 1569568 - RNA, 18 nt, Homo sapiens
aauaaaaauguucuuaca

SEQ ID NO: 1569569 - RNA, 14 nt, Homo sapiens
aauaaaaccuguua

SEQ ID NO: 1569570 - RNA, 12 nt, Homo sapiens
aauaaacaguca

SEQ ID NO: 1569571 - RNA, 13 nt, Homo sapiens
aauaaacagucac

SEQ ID NO: 1569572 - RNA, 14 nt, Homo sapiens
aauaaacagucacu

SEQ ID NO: 1569573 - RNA, 15 nt, Homo sapiens
aauaaacauucucaa

SEQ ID NO: 1569574 - RNA, 11 nt, Homo sapiens
aauaaaccaca

SEQ ID NO: 1569575 - RNA, 19 nt, Homo sapiens
aauaaaccacaagcaucuc

SEQ ID NO: 1569576 - RNA, 20 nt, Homo sapiens
aauaaaccaucaucuugcca

SEQ ID NO: 1569577 - RNA, 12 nt, Homo sapiens
aauaaacccuca

SEQ ID NO: 1569578 - RNA, 12 nt, Homo sapiens
aauaaacugugc

SEQ ID NO: 1569579 - RNA, 15 nt, Homo sapiens
aauaaagcuuacaua

SEQ ID NO: 1569580 - RNA, 14 nt, Homo sapiens
aauaaaggcagcug

SEQ ID NO: 1569581 - RNA, 19 nt, Homo sapiens
aauaaaguacuuuaccuaa

SEQ ID NO: 1569582 - RNA, 16 nt, Homo sapiens
aauaaagucauuauua

SEQ ID NO: 1569583 - RNA, 17 nt, Homo sapiens
aauaaagugaacuuugu

SEQ ID NO: 1569584 - RNA, 15 nt, Homo sapiens
aauaaaguguuuuca

SEQ ID NO: 1569585 - RNA, 12 nt, Homo sapiens
aauaaaucuucc

SEQ ID NO: 1569586 - RNA, 13 nt, Homo sapiens
aauaaaucuuccu

SEQ ID NO: 1569587 - RNA, 22 nt, Homo sapiens
aauaaaugagagggaaucgacu

SEQ ID NO: 1569588 - RNA, 23 nt, Homo sapiens
aauaaaugagagggaaucgacug

SEQ ID NO: 1569589 - RNA, 12 nt, Homo sapiens
aauaaaugauua

SEQ ID NO: 1569590 - RNA, 13 nt, Homo sapiens
aagcuucaaaaag

SEQ ID NO: 1569591 - RNA, 12 nt, Homo sapiens
aagcuucaggga

SEQ ID NO: 1569592 - RNA, 20 nt, Homo sapiens
aagcuuuaucugucuugacu

SEQ ID NO: 1569593 - RNA, 21 nt, Homo sapiens
aagcuuuuuauuccuccugcu

SEQ ID NO: 1569594 - RNA, 12 nt, Homo sapiens
aaggaaaaagcu

SEQ ID NO: 1569595 - RNA, 20 nt, Homo sapiens
aaggaaaagacugaaucuac

SEQ ID NO: 1569596 - RNA, 16 nt, Homo sapiens
aaggaacucuacuuca

SEQ ID NO: 1569597 - RNA, 15 nt, Homo sapiens
aaggaaucauuguuc

SEQ ID NO: 1569598 - RNA, 13 nt, Homo sapiens
aaggaaugauaua

SEQ ID NO: 1569599 - RNA, 13 nt, Homo sapiens
aaggaauggugcg

SEQ ID NO: 1569600 - RNA, 17 nt, Homo sapiens
aaggacagccaccaaga

SEQ ID NO: 1569601 - RNA, 18 nt, Homo sapiens
aaggacagccaccaagaa

SEQ ID NO: 1569602 - RNA, 21 nt, Homo sapiens
aaggacauuuaaaauucaauu

SEQ ID NO: 1569603 - RNA, 20 nt, Homo sapiens
aaggaccucucucaaugcca

SEQ ID NO: 1569604 - RNA, 15 nt, Homo sapiens
aaggaccuuggaaga

SEQ ID NO: 1569605 - RNA, 16 nt, Homo sapiens
aaggacuaugaaaagc

SEQ ID NO: 1569606 - RNA, 20 nt, Homo sapiens
aaggacuccucagaaaaaac

SEQ ID NO: 1569607 - RNA, 17 nt, Homo sapiens
aaggacucuuccaccuc

SEQ ID NO: 1569608 - RNA, 16 nt, Homo sapiens
aaggagagacauggaa

SEQ ID NO: 1569609 - RNA, 18 nt, Homo sapiens
aaggagaggcaacaucca

SEQ ID NO: 1569610 - RNA, 16 nt, Homo sapiens
aaggagccccauuccu

SEQ ID NO: 1569611 - RNA, 18 nt, Homo sapiens
aaggaguauaccaugaga

SEQ ID NO: 1569612 - RNA, 14 nt, Homo sapiens
aaggauagaagcug

SEQ ID NO: 1569613 - RNA, 21 nt, Homo sapiens
aaggaugcggcaggugcucug

SEQ ID NO: 1569614 - RNA, 15 nt, Homo sapiens
uauguguucaaugaa

SEQ ID NO: 1569615 - RNA, 12 nt, Homo sapiens
uauguuugcaaa

SEQ ID NO: 1569616 - RNA, 13 nt, Homo sapiens
uauguuugcugau

SEQ ID NO: 1569617 - RNA, 13 nt, Homo sapiens
uauuaaacaaagu

SEQ ID NO: 1569618 - RNA, 16 nt, Homo sapiens
uauuaaaccuuuccau

SEQ ID NO: 1569619 - RNA, 18 nt, Homo sapiens
uauuaaaccuuuccauuu

SEQ ID NO: 1569620 - RNA, 18 nt, Homo sapiens
uauuaacuauuaguguua

SEQ ID NO: 1569621 - RNA, 13 nt, Homo sapiens
uauuaacucugca

SEQ ID NO: 1569622 - RNA, 15 nt, Homo sapiens
uauuaaucauacaaa

SEQ ID NO: 1569623 - RNA, 17 nt, Homo sapiens
uauuaaucauagauuau

SEQ ID NO: 1569624 - RNA, 22 nt, Homo sapiens
uauuaaucuuggauagcuaaua

SEQ ID NO: 1569625 - RNA, 14 nt, Homo sapiens
uauuacuaguacua

SEQ ID NO: 1569626 - RNA, 18 nt, Homo sapiens
uauuacugaaaaugauuc

SEQ ID NO: 1569627 - RNA, 16 nt, Homo sapiens
uauuacugaugugugc

SEQ ID NO: 1569628 - RNA, 20 nt, Homo sapiens
uauuacugggacugugcuca

SEQ ID NO: 1569629 - RNA, 18 nt, Homo sapiens
uauuagcagggauucucu

SEQ ID NO: 1569630 - RNA, 19 nt, Homo sapiens
uauuauaaugugcccaaag

SEQ ID NO: 1569631 - RNA, 19 nt, Homo sapiens
uauuaucugucagcugcaa

SEQ ID NO: 1569632 - RNA, 16 nt, Homo sapiens
uauuaucuguugccuu

SEQ ID NO: 1569633 - RNA, 14 nt, Homo sapiens
uauucaaaaaauca

SEQ ID NO: 1569634 - RNA, 13 nt, Homo sapiens
uauucaacuaaua

SEQ ID NO: 1569635 - RNA, 19 nt, Homo sapiens
uauucacuuguguguguac

SEQ ID NO: 1569636 - RNA, 22 nt, Homo sapiens
uauucagaaaagaugugcagau

SEQ ID NO: 1569637 - RNA, 15 nt, Homo sapiens
uauucagacaaaaug

SEQ ID NO: 1569638 - RNA, 19 nt, Homo sapiens
uauucagacaaaauggaua

SEQ ID NO: 1569639 - RNA, 22 nt, Homo sapiens
uauucaugcugaggugauucag

SEQ ID NO: 1569640 - RNA, 16 nt, Homo sapiens
uauucauuauuuguca

SEQ ID NO: 1569641 - RNA, 16 nt, Homo sapiens
uauucauuccucacaa

SEQ ID NO: 1569642 - RNA, 23 nt, Homo sapiens
uauuccccccacuuaagacugug

SEQ ID NO: 1569643 - RNA, 18 nt, Homo sapiens
uauuccuucacacaguuc

SEQ ID NO: 1569644 - RNA, 18 nt, Homo sapiens
uauucucuuccucaucca

SEQ ID NO: 1569645 - RNA, 19 nt, Homo sapiens
uauucuguuugcguacuug

SEQ ID NO: 1569646 - RNA, 20 nt, Homo sapiens
uauucuguuugcguacuugu

SEQ ID NO: 1569647 - RNA, 21 nt, Homo sapiens
uauucuguuugcguacuugua

SEQ ID NO: 1569648 - RNA, 19 nt, Homo sapiens
uauucuuaaaaugcaauau

SEQ ID NO: 1569649 - RNA, 14 nt, Homo sapiens
uauucuucaugaaa

SEQ ID NO: 1569650 - RNA, 14 nt, Homo sapiens
uauugaaauucuau

SEQ ID NO: 1569651 - RNA, 15 nt, Homo sapiens
uauugcaguuuauca

SEQ ID NO: 1569652 - RNA, 14 nt, Homo sapiens
uauugcuacuauaa

SEQ ID NO: 1569653 - RNA, 15 nt, Homo sapiens
uauugcuacuauaau

SEQ ID NO: 1569654 - RNA, 14 nt, Homo sapiens
uauuggcagcucua

SEQ ID NO: 1569655 - RNA, 13 nt, Homo sapiens
uauuggggaacag

SEQ ID NO: 1569656 - RNA, 22 nt, Homo sapiens
uauugguccagcuugcucuuca

SEQ ID NO: 1569657 - RNA, 22 nt, Homo sapiens
uauugguuuuaaaaaagcauua

SEQ ID NO: 1569658 - RNA, 23 nt, Homo sapiens
uauugguuuuaaaaaagcauuau

SEQ ID NO: 1569659 - RNA, 16 nt, Homo sapiens
uauuguggucauuucc

SEQ ID NO: 1569660 - RNA, 22 nt, Homo sapiens
uauuguuaggaaaugucaucaa

SEQ ID NO: 1569661 - RNA, 15 nt, Homo sapiens
uauuuaacaaaaagu

SEQ ID NO: 1569662 - RNA, 20 nt, Homo sapiens
uauuuaacuaugaacugaag

SEQ ID NO: 1569663 - RNA, 15 nt, Homo sapiens
uauuuaacuggugca

SEQ ID NO: 1569664 - RNA, 13 nt, Homo sapiens
uauuuaagugcaa

SEQ ID NO: 1569665 - RNA, 22 nt, Homo sapiens
uauuuacagauaacuucuuuag

SEQ ID NO: 1569666 - RNA, 18 nt, Homo sapiens
uauuuaccuucuaccucu

SEQ ID NO: 1569667 - RNA, 15 nt, Homo sapiens
uauuuagcaguauug

SEQ ID NO: 1569668 - RNA, 22 nt, Homo sapiens
uauuuaguuuuuaacaaucuaa

SEQ ID NO: 1569669 - RNA, 16 nt, Homo sapiens
uauuuauacuuugcaa

SEQ ID NO: 1569670 - RNA, 12 nt, Homo sapiens
uauuuauagucg

SEQ ID NO: 1569671 - RNA, 15 nt, Homo sapiens
uauuuaugugugagg

SEQ ID NO: 1569672 - RNA, 20 nt, Homo sapiens
uauuucagcugcuuugacaa

SEQ ID NO: 1569673 - RNA, 14 nt, Homo sapiens
uauuuccaccuccu

SEQ ID NO: 1569674 - RNA, 23 nt, Homo sapiens
uauuuccuuaaauguuuugccag

SEQ ID NO: 1569675 - RNA, 20 nt, Homo sapiens
uauuucuaugaaaaugggau

SEQ ID NO: 1569676 - RNA, 17 nt, Homo sapiens
uauuucuuaagaauuca

SEQ ID NO: 1569677 - RNA, 22 nt, Homo sapiens
uauuucuucuacugcuaucuac

SEQ ID NO: 1569678 - RNA, 20 nt, Homo sapiens
uauuugagacuguccugugc

SEQ ID NO: 1569679 - RNA, 19 nt, Homo sapiens
uauuugagagaaucuacua

SEQ ID NO: 1569680 - RNA, 14 nt, Homo sapiens
uauuugcauaacaa

SEQ ID NO: 1569681 - RNA, 19 nt, Homo sapiens
uauuugccuccagugcagu

SEQ ID NO: 1569682 - RNA, 14 nt, Homo sapiens
uauuugcuauucaa

SEQ ID NO: 1569683 - RNA, 15 nt, Homo sapiens
uauuugcuauucaaa

SEQ ID NO: 1569684 - RNA, 21 nt, Homo sapiens
uauuugggagggaaaagggaa

SEQ ID NO: 1569685 - RNA, 20 nt, Homo sapiens
uauuuuaaacuacugauuga

SEQ ID NO: 1569686 - RNA, 19 nt, Homo sapiens
uauuuuacuuuucugccaa

SEQ ID NO: 1569687 - RNA, 17 nt, Homo sapiens
uauuuucauucugccaa

SEQ ID NO: 1569688 - RNA, 15 nt, Homo sapiens
uauuuucuauuuucc

SEQ ID NO: 1569689 - RNA, 13 nt, Homo sapiens
uauuuucuguuga

SEQ ID NO: 1569690 - RNA, 14 nt, Homo sapiens
uauuuucuuuauca

SEQ ID NO: 1569691 - RNA, 20 nt, Homo sapiens
uauuuugagcccccauucca

SEQ ID NO: 1569692 - RNA, 17 nt, Homo sapiens
uauuuuguaaugcugca

SEQ ID NO: 1569693 - RNA, 22 nt, Homo sapiens
uauuuuguugccuucaucuuca

SEQ ID NO: 1569694 - RNA, 16 nt, Homo sapiens
uauuuuuauccaugac

SEQ ID NO: 1569695 - RNA, 15 nt, Homo sapiens
uauuuuucuuuccaa

SEQ ID NO: 1569696 - RNA, 20 nt, Homo sapiens
ucaaaaacaaccugaaagag

SEQ ID NO: 1569697 - RNA, 13 nt, Homo sapiens
ucaaaaaggccaa

SEQ ID NO: 1569698 - RNA, 20 nt, Homo sapiens
ucaaaacgcacaagccagac

SEQ ID NO: 1569699 - RNA, 20 nt, Homo sapiens
ucaaaacuucagacauagaa

SEQ ID NO: 1569700 - RNA, 15 nt, Homo sapiens
ucaaaagacuuuuau

SEQ ID NO: 1569701 - RNA, 14 nt, Homo sapiens
ucacauucuuggcu

SEQ ID NO: 1569702 - RNA, 17 nt, Homo sapiens
ucacauuggagucacug

SEQ ID NO: 1569703 - RNA, 17 nt, Homo sapiens
ucaccaaacacaagaaa

SEQ ID NO: 1569704 - RNA, 20 nt, Homo sapiens
ucaccaacugaaguggcuaa

SEQ ID NO: 1569705 - RNA, 19 nt, Homo sapiens
ucaccaagcucacaguucc

SEQ ID NO: 1569706 - RNA, 16 nt, Homo sapiens
ucaccacaaaggaccc

SEQ ID NO: 1569707 - RNA, 15 nt, Homo sapiens
ucaccagcugcaaag

SEQ ID NO: 1569708 - RNA, 16 nt, Homo sapiens
ucaccagcugcaaagu

SEQ ID NO: 1569709 - RNA, 13 nt, Homo sapiens
ucaccaugaucac

SEQ ID NO: 1569710 - RNA, 23 nt, Homo sapiens
ucaccaugaugugaagaguuuca

SEQ ID NO: 1569711 - RNA, 19 nt, Homo sapiens
ucaccauuuggcaaugcca

SEQ ID NO: 1569712 - RNA, 16 nt, Homo sapiens
ucacccaacucaagga

SEQ ID NO: 1569713 - RNA, 19 nt, Homo sapiens
ucacccaccucuugugcaa

SEQ ID NO: 1569714 - RNA, 13 nt, Homo sapiens
ucacccaggcaau

SEQ ID NO: 1569715 - RNA, 19 nt, Homo sapiens
ucacccaucaaaagcacca

SEQ ID NO: 1569716 - RNA, 17 nt, Homo sapiens
ucaccccaguggccacu

SEQ ID NO: 1569717 - RNA, 17 nt, Homo sapiens
ucacccccuccuucaua

SEQ ID NO: 1569718 - RNA, 18 nt, Homo sapiens
ucacccuaccaacuuuac

SEQ ID NO: 1569719 - RNA, 16 nt, Homo sapiens
ucacccuguauguuag

SEQ ID NO: 1569720 - RNA, 17 nt, Homo sapiens
ucaccgagcgggugcaa

SEQ ID NO: 1569721 - RNA, 12 nt, Homo sapiens
ucaccgggggca

SEQ ID NO: 1569722 - RNA, 17 nt, Homo sapiens
ucaccguccucacccau

SEQ ID NO: 1569723 - RNA, 17 nt, Homo sapiens
ucaccuacauuaucuca

SEQ ID NO: 1569724 - RNA, 19 nt, Homo sapiens
ucaccuagaacgugcaucc

SEQ ID NO: 1569725 - RNA, 13 nt, Homo sapiens
ucaccuagacaac

SEQ ID NO: 1569726 - RNA, 18 nt, Homo sapiens
ucaccuagggaagcacuu

SEQ ID NO: 1569727 - RNA, 16 nt, Homo sapiens
ucaccucaaccuccgc

SEQ ID NO: 1569728 - RNA, 18 nt, Homo sapiens
ucaccuccucugugauuu

SEQ ID NO: 1569729 - RNA, 15 nt, Homo sapiens
ucaccucugccucaa

SEQ ID NO: 1569730 - RNA, 14 nt, Homo sapiens
ucaccucuugccuu

SEQ ID NO: 1569731 - RNA, 19 nt, Homo sapiens
ucaccugggaccuuacucc

SEQ ID NO: 1569732 - RNA, 20 nt, Homo sapiens
ucacgaacuugaaaguuuuc

SEQ ID NO: 1569733 - RNA, 12 nt, Homo sapiens
ucacgagcccau

SEQ ID NO: 1569734 - RNA, 22 nt, Homo sapiens
uacauccguaggacaaguuuua

SEQ ID NO: 1569735 - RNA, 19 nt, Homo sapiens
uacauccuaagguucuugc

SEQ ID NO: 1569736 - RNA, 16 nt, Homo sapiens
uacauccugaguguga

SEQ ID NO: 1569737 - RNA, 21 nt, Homo sapiens
uacaucuaccuaaaggacuau

SEQ ID NO: 1569738 - RNA, 20 nt, Homo sapiens
uacaucuccuugaucauguc

SEQ ID NO: 1569739 - RNA, 15 nt, Homo sapiens
uacaucugcaauaug

SEQ ID NO: 1569740 - RNA, 21 nt, Homo sapiens
uacaucugcaauaugaauuca

SEQ ID NO: 1569741 - RNA, 21 nt, Homo sapiens
uacaucugggacugacuuucc

SEQ ID NO: 1569742 - RNA, 21 nt, Homo sapiens
uacaugagaaggaacuuccag

SEQ ID NO: 1569743 - RNA, 15 nt, Homo sapiens
uacaugauaagacau

SEQ ID NO: 1569744 - RNA, 15 nt, Homo sapiens
uacaugcaacagaag

SEQ ID NO: 1569745 - RNA, 18 nt, Homo sapiens
uacaugcagcccaugccc

SEQ ID NO: 1569746 - RNA, 11 nt, Homo sapiens
uacaugugauu

SEQ ID NO: 1569747 - RNA, 11 nt, Homo sapiens
uacauguuaag

SEQ ID NO: 1569748 - RNA, 21 nt, Homo sapiens
uacauguuuauaaaucuuaug

SEQ ID NO: 1569749 - RNA, 13 nt, Homo sapiens
uacauuacagauu

SEQ ID NO: 1569750 - RNA, 16 nt, Homo sapiens
uacauuaucucacuua

SEQ ID NO: 1569751 - RNA, 23 nt, Homo sapiens
uacauuauguguuucuccucaga

SEQ ID NO: 1569752 - RNA, 17 nt, Homo sapiens
uacauuauguugcuuaa

SEQ ID NO: 1569753 - RNA, 16 nt, Homo sapiens
uacauugaguagacac

SEQ ID NO: 1569754 - RNA, 13 nt, Homo sapiens
uacauuguauucu

SEQ ID NO: 1569755 - RNA, 13 nt, Homo sapiens
uacauugucuuga

SEQ ID NO: 1569756 - RNA, 17 nt, Homo sapiens
uacauuuaauaaaacug

SEQ ID NO: 1569757 - RNA, 19 nt, Homo sapiens
uacauuuaauaauaucaaa

SEQ ID NO: 1569758 - RNA, 14 nt, Homo sapiens
uacauuuauaaucu

SEQ ID NO: 1569759 - RNA, 14 nt, Homo sapiens
uacauuucugcaga

SEQ ID NO: 1569760 - RNA, 16 nt, Homo sapiens
uaccaaaaucauuucu

SEQ ID NO: 1569761 - RNA, 15 nt, Homo sapiens
uaccaaauaccaugu

SEQ ID NO: 1569762 - RNA, 19 nt, Homo sapiens
uaccaaaugaaaugccaaa

SEQ ID NO: 1569763 - RNA, 23 nt, Homo sapiens
uaccaacagcuuuucccaggaga

SEQ ID NO: 1569764 - RNA, 15 nt, Homo sapiens
uaccaagaacagagu

SEQ ID NO: 1569765 - RNA, 20 nt, Homo sapiens
uaccaagaacagagucucag

SEQ ID NO: 1569766 - RNA, 13 nt, Homo sapiens
uaccaauguucua

SEQ ID NO: 1569767 - RNA, 17 nt, Homo sapiens
uaccacaagacauuucu

SEQ ID NO: 1569768 - RNA, 16 nt, Homo sapiens
uaccacaguggaugua

SEQ ID NO: 1569769 - RNA, 23 nt, Homo sapiens
uaccaccaagggaucugccauug

SEQ ID NO: 1569770 - RNA, 20 nt, Homo sapiens
uaccacucuuuaccuuuauu

SEQ ID NO: 1569771 - RNA, 22 nt, Homo sapiens
uaccagagccuucaagugccaa

SEQ ID NO: 1569772 - RNA, 15 nt, Homo sapiens
uaccagcaucuccca

SEQ ID NO: 1569773 - RNA, 20 nt, Homo sapiens
uaccauagaaagaugacaaa

SEQ ID NO: 1569774 - RNA, 14 nt, Homo sapiens
uaccaugugugcua

SEQ ID NO: 1569775 - RNA, 21 nt, Homo sapiens
uaccauuugcuacuguacaua

SEQ ID NO: 1569776 - RNA, 19 nt, Homo sapiens
uacccacucuggagcauuu

SEQ ID NO: 1569777 - RNA, 23 nt, Homo sapiens
uaccccaccacgauguggcccug

SEQ ID NO: 1569778 - RNA, 20 nt, Homo sapiens
uaccccagacuagauguagu

SEQ ID NO: 1569779 - RNA, 22 nt, Homo sapiens
uaccccaguuccuagcacugcc

SEQ ID NO: 1569780 - RNA, 18 nt, Homo sapiens
uaccccggcugcuuggca

SEQ ID NO: 1569781 - RNA, 19 nt, Homo sapiens
uaccccugcucccauuccu

SEQ ID NO: 1569782 - RNA, 16 nt, Homo sapiens
uaccccuuugcacuug

SEQ ID NO: 1569783 - RNA, 15 nt, Homo sapiens
uacccucccaccaga

SEQ ID NO: 1569784 - RNA, 14 nt, Homo sapiens
uaccuaaacuguau

SEQ ID NO: 1569785 - RNA, 17 nt, Homo sapiens
uaccuaaacuguaucau

SEQ ID NO: 1569786 - RNA, 13 nt, Homo sapiens
uaccuacaucaga

SEQ ID NO: 1569787 - RNA, 15 nt, Homo sapiens
uaccuacaucaguca

SEQ ID NO: 1569788 - RNA, 22 nt, Homo sapiens
uaccuagugcaaaaacuguaaa

SEQ ID NO: 1569789 - RNA, 23 nt, Homo sapiens
uaccuccuaauuccacacccuca

SEQ ID NO: 1569790 - RNA, 20 nt, Homo sapiens
uaccuccuuguguugcacug

SEQ ID NO: 1569791 - RNA, 13 nt, Homo sapiens
uaccucugagaag

SEQ ID NO: 1569792 - RNA, 20 nt, Homo sapiens
uaccucugagaagacacaag

SEQ ID NO: 1569793 - RNA, 16 nt, Homo sapiens
uaccucuuucaggguu

SEQ ID NO: 1569794 - RNA, 13 nt, Homo sapiens
uaccugacuucca

SEQ ID NO: 1569795 - RNA, 19 nt, Homo sapiens
uaccugccacucacacagc

SEQ ID NO: 1569796 - RNA, 20 nt, Homo sapiens
uaccugcuguggaugcuuca

SEQ ID NO: 1569797 - RNA, 19 nt, Homo sapiens
uaccuggcccugugccuug

SEQ ID NO: 1569798 - RNA, 16 nt, Homo sapiens
uaccuucaaacuuuag

SEQ ID NO: 1569799 - RNA, 16 nt, Homo sapiens
uaccuucuauguauua

SEQ ID NO: 1569800 - RNA, 19 nt, Homo sapiens
uaccuugcuuuugcuucua

SEQ ID NO: 1569801 - RNA, 24 nt, Homo sapiens
uaccuuggaauuggaauuacugua

SEQ ID NO: 1569802 - RNA, 23 nt, Homo sapiens
uaccuuuaucuuucaccuuucua

SEQ ID NO: 1569803 - RNA, 15 nt, Homo sapiens
uaccuuucagugcag

SEQ ID NO: 1569804 - RNA, 14 nt, Homo sapiens
uaccuuuccccaaa

SEQ ID NO: 1569805 - RNA, 16 nt, Homo sapiens
uaccuuugaacuuuca

SEQ ID NO: 1569806 - RNA, 18 nt, Homo sapiens
uaccuuuucucacaaaaa

SEQ ID NO: 1569807 - RNA, 19 nt, Homo sapiens
uaccuuuuuauuugcaugu

SEQ ID NO: 1569808 - RNA, 15 nt, Homo sapiens
uacgaugacaguguu

SEQ ID NO: 1569809 - RNA, 17 nt, Homo sapiens
uacgcucagcucaucca

SEQ ID NO: 1569810 - RNA, 16 nt, Homo sapiens
uacgucauuugugcaa

SEQ ID NO: 1569811 - RNA, 14 nt, Homo sapiens
uacguucuuuucaa

SEQ ID NO: 1569812 - RNA, 17 nt, Homo sapiens
uacguuuuucuggugcu

SEQ ID NO: 1569813 - RNA, 17 nt, Homo sapiens
uacuacagcuucaguga

SEQ ID NO: 1569814 - RNA, 15 nt, Homo sapiens
uacuacauuccaaag

SEQ ID NO: 1569815 - RNA, 12 nt, Homo sapiens
uacuaccccagc

SEQ ID NO: 1569816 - RNA, 14 nt, Homo sapiens
uacuagcugagaaa

SEQ ID NO: 1569817 - RNA, 17 nt, Homo sapiens
uacuagucaccagagac

SEQ ID NO: 1569818 - RNA, 16 nt, Homo sapiens
uacuaguuuucaauca

SEQ ID NO: 1569819 - RNA, 13 nt, Homo sapiens
uacuauaaaagcu

SEQ ID NO: 1569820 - RNA, 22 nt, Homo sapiens
uacuauacagcauaccacgcca

SEQ ID NO: 1569821 - RNA, 17 nt, Homo sapiens
uaugccaauaaaguuug

SEQ ID NO: 1569822 - RNA, 21 nt, Homo sapiens
uaugccauggaggcacuaaca

SEQ ID NO: 1569823 - RNA, 15 nt, Homo sapiens
uaugcuaagugaaau

SEQ ID NO: 1569824 - RNA, 18 nt, Homo sapiens
uaugcucauugaacuuua

SEQ ID NO: 1569825 - RNA, 19 nt, Homo sapiens
uaugcucauugaacuuuaa

SEQ ID NO: 1569826 - RNA, 20 nt, Homo sapiens
uaugcucauugaacuuuaag

SEQ ID NO: 1569827 - RNA, 14 nt, Homo sapiens
uaugcuccugcuga

SEQ ID NO: 1569828 - RNA, 19 nt, Homo sapiens
uaugcugauuuacuacuua

SEQ ID NO: 1569829 - RNA, 17 nt, Homo sapiens
uaugcugcaacaaaaug

SEQ ID NO: 1569830 - RNA, 23 nt, Homo sapiens
uaugcugucuuaauucuuuucac

SEQ ID NO: 1569831 - RNA, 18 nt, Homo sapiens
uauggaaccuucccucca

SEQ ID NO: 1569832 - RNA, 19 nt, Homo sapiens
uauggagaaacaaaauccu

SEQ ID NO: 1569833 - RNA, 14 nt, Homo sapiens
uauggauucacuuc

SEQ ID NO: 1569834 - RNA, 14 nt, Homo sapiens
uauggccacauuca

SEQ ID NO: 1569835 - RNA, 15 nt, Homo sapiens
uauggccacauucaa

SEQ ID NO: 1569836 - RNA, 21 nt, Homo sapiens
uauggcuauaggugcuacaaa

SEQ ID NO: 1569837 - RNA, 21 nt, Homo sapiens
uauggcuuucaaagcuaaaau

SEQ ID NO: 1569838 - RNA, 22 nt, Homo sapiens
uaugggggauggugagcuguga

SEQ ID NO: 1569839 - RNA, 20 nt, Homo sapiens
uauggguuggacaaccucau

SEQ ID NO: 1569840 - RNA, 14 nt, Homo sapiens
uaugguaaucuuua

SEQ ID NO: 1569841 - RNA, 19 nt, Homo sapiens
uaugguagaaaaauuucac

SEQ ID NO: 1569842 - RNA, 15 nt, Homo sapiens
uaugguucucaggcc

SEQ ID NO: 1569843 - RNA, 22 nt, Homo sapiens
uauguaauggaacuuagccauu

SEQ ID NO: 1569844 - RNA, 14 nt, Homo sapiens
uauguacaugagaa

SEQ ID NO: 1569845 - RNA, 14 nt, Homo sapiens
uauguauguaaaaa

SEQ ID NO: 1569846 - RNA, 13 nt, Homo sapiens
uaugucauagaaa

SEQ ID NO: 1569847 - RNA, 21 nt, Homo sapiens
uauguccacuguucuguucuc

SEQ ID NO: 1569848 - RNA, 20 nt, Homo sapiens
uaugugacauuuuacauuaa

SEQ ID NO: 1569849 - RNA, 14 nt, Homo sapiens
uaugugacugacaa

SEQ ID NO: 1569850 - RNA, 18 nt, Homo sapiens
uaugugagaaaucagaau

SEQ ID NO: 1569851 - RNA, 18 nt, Homo sapiens
uaugugcauuauucauaa

SEQ ID NO: 1569852 - RNA, 11 nt, Homo sapiens
uaauaccaaag

SEQ ID NO: 1569853 - RNA, 15 nt, Homo sapiens
uaauaccagaacucu

SEQ ID NO: 1569854 - RNA, 17 nt, Homo sapiens
uaauaccagaacucuaa

SEQ ID NO: 1569855 - RNA, 17 nt, Homo sapiens
uaauacuauauugcugu

SEQ ID NO: 1569856 - RNA, 14 nt, Homo sapiens
uaauacugucuuac

SEQ ID NO: 1569857 - RNA, 23 nt, Homo sapiens
uaauagcugccuucaaggacugu

SEQ ID NO: 1569858 - RNA, 17 nt, Homo sapiens
uaauaguacuauuacua

SEQ ID NO: 1569859 - RNA, 14 nt, Homo sapiens
uaauaguacuauug

SEQ ID NO: 1569860 - RNA, 13 nt, Homo sapiens
uaauauaccccaa

SEQ ID NO: 1569861 - RNA, 23 nt, Homo sapiens
uaauauguuuaguuuuacauuuu

SEQ ID NO: 1569862 - RNA, 22 nt, Homo sapiens
uaauauugauaagcuauugucu

SEQ ID NO: 1569863 - RNA, 19 nt, Homo sapiens
uaauauuuuuccacuuaaa

SEQ ID NO: 1569864 - RNA, 14 nt, Homo sapiens
uaaucaaaugauuu

SEQ ID NO: 1569865 - RNA, 18 nt, Homo sapiens
uaaucacaaacugaauga

SEQ ID NO: 1569866 - RNA, 12 nt, Homo sapiens
uaaucauacaaa

SEQ ID NO: 1569867 - RNA, 17 nt, Homo sapiens
uaaucauacaccagaag

SEQ ID NO: 1569868 - RNA, 17 nt, Homo sapiens
uaaucaucaaguaauac

SEQ ID NO: 1569869 - RNA, 14 nt, Homo sapiens
uaaucaugcucaug

SEQ ID NO: 1569870 - RNA, 18 nt, Homo sapiens
uaauccagcaaagugauu

SEQ ID NO: 1569871 - RNA, 17 nt, Homo sapiens
uaaucccaacacuuuga

SEQ ID NO: 1569872 - RNA, 15 nt, Homo sapiens
uaaucccagcacuuu

SEQ ID NO: 1569873 - RNA, 15 nt, Homo sapiens
uaauccuucuggcaa

SEQ ID NO: 1569874 - RNA, 21 nt, Homo sapiens
uaaucuauaacaaaugcuuua

SEQ ID NO: 1569875 - RNA, 13 nt, Homo sapiens
uaaucucaaagga

SEQ ID NO: 1569876 - RNA, 11 nt, Homo sapiens
uaaucucagga

SEQ ID NO: 1569877 - RNA, 17 nt, Homo sapiens
uaaucugaaaauagcaa

SEQ ID NO: 1569878 - RNA, 15 nt, Homo sapiens
uaaucugaacugacc

SEQ ID NO: 1569879 - RNA, 16 nt, Homo sapiens
uaaucugagaguuuuc

SEQ ID NO: 1569880 - RNA, 14 nt, Homo sapiens
uaaugaaacaaaga

SEQ ID NO: 1569881 - RNA, 14 nt, Homo sapiens
uaaugaagugcaau

SEQ ID NO: 1569882 - RNA, 17 nt, Homo sapiens
uaaugaccauguuauau

SEQ ID NO: 1569883 - RNA, 13 nt, Homo sapiens
uaaugacuuuuaa

SEQ ID NO: 1569884 - RNA, 16 nt, Homo sapiens
uaaugagaauuccuua

SEQ ID NO: 1569885 - RNA, 13 nt, Homo sapiens
uaaugauacugau

SEQ ID NO: 1569886 - RNA, 14 nt, Homo sapiens
uaaugaucacauuc

SEQ ID NO: 1569887 - RNA, 14 nt, Homo sapiens
uaaugaugaucuuc

SEQ ID NO: 1569888 - RNA, 19 nt, Homo sapiens
uaaugauucugauauguau

SEQ ID NO: 1569889 - RNA, 20 nt, Homo sapiens
uaaugcuuuucuaauuaaua

SEQ ID NO: 1569890 - RNA, 16 nt, Homo sapiens
uaauggaacuuagcca

SEQ ID NO: 1569891 - RNA, 12 nt, Homo sapiens
uaauggguauau

SEQ ID NO: 1569892 - RNA, 21 nt, Homo sapiens
uaaugguaaaauaaaaugccu

SEQ ID NO: 1569893 - RNA, 21 nt, Homo sapiens
uaauggugaaaacgucuuccu

SEQ ID NO: 1569894 - RNA, 17 nt, Homo sapiens
uaauguaauaaagugaa

SEQ ID NO: 1569895 - RNA, 17 nt, Homo sapiens
uaauguauaccagccua

SEQ ID NO: 1569896 - RNA, 15 nt, Homo sapiens
uaauguuauucauuu

SEQ ID NO: 1569897 - RNA, 22 nt, Homo sapiens
uaauguugauuuuaauccugua

SEQ ID NO: 1569898 - RNA, 12 nt, Homo sapiens
uaauguugcuuu

SEQ ID NO: 1569899 - RNA, 18 nt, Homo sapiens
uaauuaccaaccuguuac

SEQ ID NO: 1569900 - RNA, 17 nt, Homo sapiens
uaauuaccaguuuucca

SEQ ID NO: 1569901 - RNA, 14 nt, Homo sapiens
uaauuacuucacua

SEQ ID NO: 1569902 - RNA, 16 nt, Homo sapiens
uaauuaguaacaugug

SEQ ID NO: 1569903 - RNA, 18 nt, Homo sapiens
uaauucaagaaaugacag

SEQ ID NO: 1569904 - RNA, 14 nt, Homo sapiens
uaauucagcacuua

SEQ ID NO: 1569905 - RNA, 13 nt, Homo sapiens
uaauugcaugaaa

SEQ ID NO: 1569906 - RNA, 13 nt, Homo sapiens
uaauugcauuuaa

SEQ ID NO: 1569907 - RNA, 14 nt, Homo sapiens
uaauugcuuugaag

SEQ ID NO: 1569908 - RNA, 13 nt, Homo sapiens
uaauugcuuugcc

SEQ ID NO: 1569909 - RNA, 16 nt, Homo sapiens
uaauugcuuugccaaa

SEQ ID NO: 1569910 - RNA, 17 nt, Homo sapiens
uaauugcuuugccaaaa

SEQ ID NO: 1569911 - RNA, 17 nt, Homo sapiens
uaauuguaaacuaguac

SEQ ID NO: 1569912 - RNA, 16 nt, Homo sapiens
uaauuuacagcuuuca

SEQ ID NO: 1569913 - RNA, 24 nt, Homo sapiens
uaauuuaguaaauaaacaagucaa

SEQ ID NO: 1569914 - RNA, 15 nt, Homo sapiens
uaauuuaugugcuau

SEQ ID NO: 1569915 - RNA, 13 nt, Homo sapiens
uaauuuauuucca

SEQ ID NO: 1569916 - RNA, 17 nt, Homo sapiens
uaauuuccuuuuugaca

SEQ ID NO: 1569917 - RNA, 22 nt, Homo sapiens
uaauuuccuuuuugacacugaa

SEQ ID NO: 1569918 - RNA, 14 nt, Homo sapiens
uaauuuuacauguu

SEQ ID NO: 1569919 - RNA, 21 nt, Homo sapiens
uaauuuugauauaaucuuuca

SEQ ID NO: 1569920 - RNA, 15 nt, Homo sapiens
uaauuuuggauuuug

SEQ ID NO: 1569921 - RNA, 17 nt, Homo sapiens
uaauuuuugugagguau

SEQ ID NO: 1569922 - RNA, 18 nt, Homo sapiens
uaauuuuuuaaacuguag

SEQ ID NO: 1569923 - RNA, 17 nt, Homo sapiens
uaauuuuuuacuuucag

SEQ ID NO: 1569924 - RNA, 14 nt, Homo sapiens
uacaaaaacacagc

SEQ ID NO: 1569925 - RNA, 15 nt, Homo sapiens
uacaaaaacacagca

SEQ ID NO: 1569926 - RNA, 17 nt, Homo sapiens
uacaaaaacacagcaag

SEQ ID NO: 1569927 - RNA, 14 nt, Homo sapiens
uacaaaaggcauuu

SEQ ID NO: 1569928 - RNA, 23 nt, Homo sapiens
uacaaaccauuuuguuauugacu

SEQ ID NO: 1569929 - RNA, 18 nt, Homo sapiens
uacaaacguuugacaaac

SEQ ID NO: 1569930 - RNA, 20 nt, Homo sapiens
uacaaagggccaucguucau

SEQ ID NO: 1569931 - RNA, 14 nt, Homo sapiens
uacaaauacuaaaa

SEQ ID NO: 1569932 - RNA, 20 nt, Homo sapiens
uacaacgccgagugcacugc

SEQ ID NO: 1569933 - RNA, 22 nt, Homo sapiens
uacaacgccgagugcacugcau

SEQ ID NO: 1569934 - RNA, 17 nt, Homo sapiens
uacaacuucaagugcau

SEQ ID NO: 1569935 - RNA, 17 nt, Homo sapiens
uacaacuuguauuucca

SEQ ID NO: 1569936 - RNA, 14 nt, Homo sapiens
uacaaguauuacaa

SEQ ID NO: 1569937 - RNA, 21 nt, Homo sapiens
uacaaucuuggagcugcuugg

SEQ ID NO: 1569938 - RNA, 15 nt, Homo sapiens
uacacaauacaguau

SEQ ID NO: 1569939 - RNA, 17 nt, Homo sapiens
uacacacacaccuagcc

SEQ ID NO: 1569940 - RNA, 13 nt, Homo sapiens
gucuggcaccaug

SEQ ID NO: 1569941 - RNA, 16 nt, Homo sapiens
gucugggagucacaca

SEQ ID NO: 1569942 - RNA, 18 nt, Homo sapiens
gucugggagucacacagu

SEQ ID NO: 1569943 - RNA, 15 nt, Homo sapiens
gucugggcacuggau

SEQ ID NO: 1569944 - RNA, 22 nt, Homo sapiens
gucugguaauaaaugugacuca

SEQ ID NO: 1569945 - RNA, 22 nt, Homo sapiens
gucuggugggaggacggugcaa

SEQ ID NO: 1569946 - RNA, 17 nt, Homo sapiens
gucuguaaaaaauggag

SEQ ID NO: 1569947 - RNA, 23 nt, Homo sapiens
gucugucccaggccgacccaagg

SEQ ID NO: 1569948 - RNA, 14 nt, Homo sapiens
gucugugacauuuc

SEQ ID NO: 1569949 - RNA, 13 nt, Homo sapiens
gucugugcacaug

SEQ ID NO: 1569950 - RNA, 20 nt, Homo sapiens
gucuguguagaguguuauac

SEQ ID NO: 1569951 - RNA, 18 nt, Homo sapiens
gucugugugggacuguac

SEQ ID NO: 1569952 - RNA, 19 nt, Homo sapiens
gucuguguguuuaugugug

SEQ ID NO: 1569953 - RNA, 15 nt, Homo sapiens
gucuguucacugcau

SEQ ID NO: 1569954 - RNA, 13 nt, Homo sapiens
gucuguuugcauu

SEQ ID NO: 1569955 - RNA, 21 nt, Homo sapiens
gucuuacguuuuucuggugcu

SEQ ID NO: 1569956 - RNA, 16 nt, Homo sapiens
gucuuacuguugcaua

SEQ ID NO: 1569957 - RNA, 20 nt, Homo sapiens
gucuuaugaaacaauuugag

SEQ ID NO: 1569958 - RNA, 23 nt, Homo sapiens
gucuuccacaaaaaauacuuuau

SEQ ID NO: 1569959 - RNA, 14 nt, Homo sapiens
gucuucccuaccuc

SEQ ID NO: 1569960 - RNA, 15 nt, Homo sapiens
gucuucccugcuuca

SEQ ID NO: 1569961 - RNA, 14 nt, Homo sapiens
gugaaaaaggaaua

SEQ ID NO: 1569962 - RNA, 23 nt, Homo sapiens
gugaaaaggguacagaugugcug

SEQ ID NO: 1569963 - RNA, 13 nt, Homo sapiens
gugaaaaugugac

SEQ ID NO: 1569964 - RNA, 15 nt, Homo sapiens
gugaaacagagugau

SEQ ID NO: 1569965 - RNA, 21 nt, Homo sapiens
gugaaaugcuuuuauauucua

SEQ ID NO: 1569966 - RNA, 19 nt, Homo sapiens
gugaaauggccacuacuuu

SEQ ID NO: 1569967 - RNA, 17 nt, Homo sapiens
guauuaaaccuuuccau

SEQ ID NO: 1569968 - RNA, 16 nt, Homo sapiens
guauuaacaugcaaua

SEQ ID NO: 1569969 - RNA, 15 nt, Homo sapiens
guauuaauaccaaag

SEQ ID NO: 1569970 - RNA, 16 nt, Homo sapiens
guauuaugcuggaauu

SEQ ID NO: 1569971 - RNA, 18 nt, Homo sapiens
guauuaugucucuucuga

SEQ ID NO: 1569972 - RNA, 22 nt, Homo sapiens
guauuauuuuacaaucaacaaa

SEQ ID NO: 1569973 - RNA, 22 nt, Homo sapiens
guauucccaaaaauuacuuugg

SEQ ID NO: 1569974 - RNA, 17 nt, Homo sapiens
guauuccucaugucauc

SEQ ID NO: 1569975 - RNA, 20 nt, Homo sapiens
guauugcuguccuugaaugc

SEQ ID NO: 1569976 - RNA, 14 nt, Homo sapiens
guauugucuauuau

SEQ ID NO: 1569977 - RNA, 15 nt, Homo sapiens
guauuguugaaaaag

SEQ ID NO: 1569978 - RNA, 14 nt, Homo sapiens
guauuuaaacuuuc

SEQ ID NO: 1569979 - RNA, 20 nt, Homo sapiens
guauuuaacuacaucugccu

SEQ ID NO: 1569980 - RNA, 20 nt, Homo sapiens
guauuugaaauaagaauuca

SEQ ID NO: 1569981 - RNA, 21 nt, Homo sapiens
guauuuggaaauaaagucaga

SEQ ID NO: 1569982 - RNA, 16 nt, Homo sapiens
guauuuuuaaaggcau

SEQ ID NO: 1569983 - RNA, 17 nt, Homo sapiens
guauuuuucagaaauca

SEQ ID NO: 1569984 - RNA, 17 nt, Homo sapiens
gucaaaaagaaccacuu

SEQ ID NO: 1569985 - RNA, 18 nt, Homo sapiens
gucaaaaccaagucacuu

SEQ ID NO: 1569986 - RNA, 16 nt, Homo sapiens
gucaaaacuacugaca

SEQ ID NO: 1569987 - RNA, 13 nt, Homo sapiens
gucaaagaagcuu

SEQ ID NO: 1569988 - RNA, 23 nt, Homo sapiens
gucaacauagugagacacugucu

SEQ ID NO: 1569989 - RNA, 22 nt, Homo sapiens
gucaaccccaaguuaguucaau

SEQ ID NO: 1569990 - RNA, 19 nt, Homo sapiens
gucaagccugugcaaaaaa

SEQ ID NO: 1569991 - RNA, 17 nt, Homo sapiens
gucaauguccuacugag

SEQ ID NO: 1569992 - RNA, 14 nt, Homo sapiens
gucacaaaaauuca

SEQ ID NO: 1569993 - RNA, 22 nt, Homo sapiens
gucacacaaacugaugaugaca

SEQ ID NO: 1569994 - RNA, 12 nt, Homo sapiens
ggauauauuuga

SEQ ID NO: 1569995 - RNA, 16 nt, Homo sapiens
ggauauccuuucacuc

SEQ ID NO: 1569996 - RNA, 20 nt, Homo sapiens
ggauauccuuucacucugca

SEQ ID NO: 1569997 - RNA, 20 nt, Homo sapiens
ggauauuaggccaguugaag

SEQ ID NO: 1569998 - RNA, 21 nt, Homo sapiens
ggauauucuccucggacugug

SEQ ID NO: 1569999 - RNA, 17 nt, Homo sapiens
ggauauuuuuuacuuua

SEQ ID NO: 1570000 - RNA, 16 nt, Homo sapiens
ggaucaugguacauuu

SEQ ID NO: 1570001 - RNA, 15 nt, Homo sapiens
ggauccacacugaga

SEQ ID NO: 1570002 - RNA, 17 nt, Homo sapiens
ggauccuccacagagag

SEQ ID NO: 1570003 - RNA, 13 nt, Homo sapiens
ggauccucuccuu

SEQ ID NO: 1570004 - RNA, 15 nt, Homo sapiens
ggauccugggucaaa

SEQ ID NO: 1570005 - RNA, 17 nt, Homo sapiens
ggaugaacaauguauac

SEQ ID NO: 1570006 - RNA, 17 nt, Homo sapiens
ggaugagccaaaccagc

SEQ ID NO: 1570007 - RNA, 17 nt, Homo sapiens
ggaugagcgugcacucc

SEQ ID NO: 1570008 - RNA, 20 nt, Homo sapiens
ggaugauuauuuucuguucu

SEQ ID NO: 1570009 - RNA, 18 nt, Homo sapiens
ggaugauuuuaauauuaa

SEQ ID NO: 1570010 - RNA, 23 nt, Homo sapiens
ggaugcccccuguggaugcugcu

SEQ ID NO: 1570011 - RNA, 15 nt, Homo sapiens
ggaugcgugugaacg

SEQ ID NO: 1570012 - RNA, 22 nt, Homo sapiens
ggauggggcuucacugcuguga

SEQ ID NO: 1570013 - RNA, 18 nt, Homo sapiens
ggaugguuuuaucuuccc

SEQ ID NO: 1570014 - RNA, 22 nt, Homo sapiens
ggaugucccaccucucugagcu

SEQ ID NO: 1570015 - RNA, 23 nt, Homo sapiens
ggauguggcuuaugagauacuuu

SEQ ID NO: 1570016 - RNA, 18 nt, Homo sapiens
ggauguugcuuuugcacc

SEQ ID NO: 1570017 - RNA, 13 nt, Homo sapiens
ggauuaaaccuuu

SEQ ID NO: 1570018 - RNA, 21 nt, Homo sapiens
ggauuaagaaaccuugcucuc

SEQ ID NO: 1570019 - RNA, 22 nt, Homo sapiens
ggauuauuuuaaauacaaaagg

SEQ ID NO: 1570020 - RNA, 19 nt, Homo sapiens
ggauuccaaaccaggacac

SEQ ID NO: 1570021 - RNA, 21 nt, Homo sapiens
ggauuccucaccaagcucaac

SEQ ID NO: 1570022 - RNA, 19 nt, Homo sapiens
ggauucuguacaugcauug

SEQ ID NO: 1570023 - RNA, 16 nt, Homo sapiens
ggauugaaauaaauga

SEQ ID NO: 1570024 - RNA, 19 nt, Homo sapiens
ggauugacuuugcugucaa

SEQ ID NO: 1570025 - RNA, 18 nt, Homo sapiens
ggcaaaugccugacucag

SEQ ID NO: 1570026 - RNA, 19 nt, Homo sapiens
ggcaacaggggcacaagcc

SEQ ID NO: 1570027 - RNA, 19 nt, Homo sapiens
ggcaacauucauugccaag

SEQ ID NO: 1570028 - RNA, 19 nt, Homo sapiens
ggcaacguagccugggcuc

SEQ ID NO: 1570029 - RNA, 19 nt, Homo sapiens
ggcaagguugggcuggugc

SEQ ID NO: 1570030 - RNA, 20 nt, Homo sapiens
ggcaagugugggggguccuu

SEQ ID NO: 1570031 - RNA, 15 nt, Homo sapiens
ggcaaucuugccuuc

SEQ ID NO: 1570032 - RNA, 17 nt, Homo sapiens
ggcaauuuugcacugaa

SEQ ID NO: 1570033 - RNA, 21 nt, Homo sapiens
ggcacagccuggcuguggccu

SEQ ID NO: 1570034 - RNA, 17 nt, Homo sapiens
ggcacagcuaaccacuu

SEQ ID NO: 1570035 - RNA, 13 nt, Homo sapiens
ggcacucaggggg

SEQ ID NO: 1570036 - RNA, 17 nt, Homo sapiens
ggcacuggaugcaugaa

SEQ ID NO: 1570037 - RNA, 16 nt, Homo sapiens
ggcacugggaagccua

SEQ ID NO: 1570038 - RNA, 20 nt, Homo sapiens
ggcacugugauacaguuuug

SEQ ID NO: 1570039 - RNA, 22 nt, Homo sapiens
ggcagaagaauugaacccagga

SEQ ID NO: 1570040 - RNA, 12 nt, Homo sapiens
ggcagagccaug

SEQ ID NO: 1570041 - RNA, 22 nt, Homo sapiens
ggcagagccccuuaaagcugcu

SEQ ID NO: 1570042 - RNA, 16 nt, Homo sapiens
ggcagccacccaagcc

SEQ ID NO: 1570043 - RNA, 20 nt, Homo sapiens
ggcagccucuccgacucugc

SEQ ID NO: 1570044 - RNA, 13 nt, Homo sapiens
ggcaggacagcuc

SEQ ID NO: 1570045 - RNA, 13 nt, Homo sapiens
ggcaggagaagaa

SEQ ID NO: 1570046 - RNA, 15 nt, Homo sapiens
ggcaggcugggccau

SEQ ID NO: 1570047 - RNA, 15 nt, Homo sapiens
ggcagggccaggccu

SEQ ID NO: 1570048 - RNA, 19 nt, Homo sapiens
ggcagucuccccuuccugg

SEQ ID NO: 1570049 - RNA, 16 nt, Homo sapiens
ggcagucugcucugcu

SEQ ID NO: 1570050 - RNA, 15 nt, Homo sapiens
ggcauagcacccgug

SEQ ID NO: 1570051 - RNA, 17 nt, Homo sapiens
ggcauagcucuggggug

SEQ ID NO: 1570052 - RNA, 16 nt, Homo sapiens
ggcaucacagacccca

SEQ ID NO: 1570053 - RNA, 20 nt, Homo sapiens
ggcaucucuuccccagagag

SEQ ID NO: 1570054 - RNA, 20 nt, Homo sapiens
ggcaugguaguauacaaaaa

SEQ ID NO: 1570055 - RNA, 23 nt, Homo sapiens
ggcaugguggugugugccuauag

SEQ ID NO: 1570056 - RNA, 22 nt, Homo sapiens
ggcauuucauuaugcuuugaac

SEQ ID NO: 1570057 - RNA, 11 nt, Homo sapiens
ggcauuugcag

SEQ ID NO: 1570058 - RNA, 13 nt, Homo sapiens
ggcauuugcuaag

SEQ ID NO: 1570059 - RNA, 18 nt, Homo sapiens
ggcauuugggcacuguag

SEQ ID NO: 1570060 - RNA, 21 nt, Homo sapiens
ggccaaagagucuccaguuua

SEQ ID NO: 1570061 - RNA, 17 nt, Homo sapiens
ggccaacggcaacagca

SEQ ID NO: 1570062 - RNA, 19 nt, Homo sapiens
ggccaagccuaucaaagga

SEQ ID NO: 1570063 - RNA, 14 nt, Homo sapiens
ggccaagguccugc

SEQ ID NO: 1570064 - RNA, 16 nt, Homo sapiens
ggccaauuacuugaag

SEQ ID NO: 1570065 - RNA, 15 nt, Homo sapiens
ggccacacacugagu

SEQ ID NO: 1570066 - RNA, 22 nt, Homo sapiens
ggccacacacugaguugcacau

SEQ ID NO: 1570067 - RNA, 18 nt, Homo sapiens
ggccacagugcaauuuua

SEQ ID NO: 1570068 - RNA, 17 nt, Homo sapiens
ggccacauagaugcuga

SEQ ID NO: 1570069 - RNA, 21 nt, Homo sapiens
ggccacauagaugcugaugga

SEQ ID NO: 1570070 - RNA, 22 nt, Homo sapiens
ggccacccccuauccucugagu

SEQ ID NO: 1570071 - RNA, 12 nt, Homo sapiens
ggccagcacuuc

SEQ ID NO: 1570072 - RNA, 14 nt, Homo sapiens
ggccagcccagcca

SEQ ID NO: 1570073 - RNA, 20 nt, Homo sapiens
ggccaggggugcuccugugc

SEQ ID NO: 1570074 - RNA, 17 nt, Homo sapiens
ggccaguaccuuuccau

SEQ ID NO: 1570075 - RNA, 23 nt, Homo sapiens
ggccagucaggcugcagaggcac

SEQ ID NO: 1570076 - RNA, 14 nt, Homo sapiens
ggccauguccaaag

SEQ ID NO: 1570077 - RNA, 15 nt, Homo sapiens
ggccauguccaaaga

SEQ ID NO: 1570078 - RNA, 16 nt, Homo sapiens
ggccauucuuucccaa

SEQ ID NO: 1570079 - RNA, 22 nt, Homo sapiens
ggccauuuccaagaggcuguag

SEQ ID NO: 1570080 - RNA, 18 nt, Homo sapiens
ggcccaaagaaagagcua

SEQ ID NO: 1570081 - RNA, 14 nt, Homo sapiens
ggcccaacacuggc

SEQ ID NO: 1570082 - RNA, 23 nt, Homo sapiens
ggcccaaccgcgggggcugugag

SEQ ID NO: 1570083 - RNA, 20 nt, Homo sapiens
ggcccacuagcauccacuga

SEQ ID NO: 1570084 - RNA, 17 nt, Homo sapiens
ggcccagaugacauccc

SEQ ID NO: 1570085 - RNA, 18 nt, Homo sapiens
ggcccaggucagccacug

SEQ ID NO: 1570086 - RNA, 22 nt, Homo sapiens
ggccccucccgccccuucccac

SEQ ID NO: 1570087 - RNA, 19 nt, Homo sapiens
ggccccugcgugggggcca

SEQ ID NO: 1570088 - RNA, 18 nt, Homo sapiens
ggcccuccccacaaugcc

SEQ ID NO: 1570089 - RNA, 19 nt, Homo sapiens
ggcccugggccucaguuca

SEQ ID NO: 1570090 - RNA, 21 nt, Homo sapiens
ggcccuguccuggcaucagua

SEQ ID NO: 1570091 - RNA, 15 nt, Homo sapiens
ggcccugugccuugg

SEQ ID NO: 1570092 - RNA, 16 nt, Homo sapiens
ggcccuucacuuccau

SEQ ID NO: 1570093 - RNA, 14 nt, Homo sapiens
ggccgccugagacc

SEQ ID NO: 1570094 - RNA, 14 nt, Homo sapiens
ggccgucauuucau

SEQ ID NO: 1570095 - RNA, 17 nt, Homo sapiens
ggccguccuugucucug

SEQ ID NO: 1570096 - RNA, 16 nt, Homo sapiens
ggccgugagggguccc

SEQ ID NO: 1570097 - RNA, 13 nt, Homo sapiens
ggccuaccccagu

SEQ ID NO: 1570098 - RNA, 15 nt, Homo sapiens
ggccuagcgaucucu

SEQ ID NO: 1570099 - RNA, 10 nt, Homo sapiens
ggccucagaa

SEQ ID NO: 1570100 - RNA, 14 nt, Homo sapiens
ggccucaucucaga

SEQ ID NO: 1570101 - RNA, 22 nt, Homo sapiens
ggccuccgccugggucaugggc

SEQ ID NO: 1570102 - RNA, 16 nt, Homo sapiens
ggccucugagaagcuc

SEQ ID NO: 1570103 - RNA, 19 nt, Homo sapiens
ggccucugagaagcucuga

SEQ ID NO: 1570104 - RNA, 19 nt, Homo sapiens
ggccucuucucaacuuuuu

SEQ ID NO: 1570105 - RNA, 15 nt, Homo sapiens
ggccuggccagucaa

SEQ ID NO: 1570106 - RNA, 18 nt, Homo sapiens
ggccuucaggacucuaga

SEQ ID NO: 1570107 - RNA, 19 nt, Homo sapiens
ggcgagcucuggcuuugca

SEQ ID NO: 1570108 - RNA, 21 nt, Homo sapiens
ggcgcaguggcucaugccugu

SEQ ID NO: 1570109 - RNA, 17 nt, Homo sapiens
ggcgccaucgccaagua

SEQ ID NO: 1570110 - RNA, 22 nt, Homo sapiens
ggcgccccuccgagggcccaac

SEQ ID NO: 1570111 - RNA, 19 nt, Homo sapiens
ggcggcagauccugcccug

SEQ ID NO: 1570112 - RNA, 16 nt, Homo sapiens
ggaacuguguauuuau

SEQ ID NO: 1570113 - RNA, 19 nt, Homo sapiens
ggaacuuuuauuacugggg

SEQ ID NO: 1570114 - RNA, 14 nt, Homo sapiens
ggaagaaacuuucu

SEQ ID NO: 1570115 - RNA, 17 nt, Homo sapiens
ggaagaaagaaugcaag

SEQ ID NO: 1570116 - RNA, 13 nt, Homo sapiens
ggaagacuugaag

SEQ ID NO: 1570117 - RNA, 17 nt, Homo sapiens
ggaagagggugauugcu

SEQ ID NO: 1570118 - RNA, 17 nt, Homo sapiens
ggaagaguagaugagcc

SEQ ID NO: 1570119 - RNA, 17 nt, Homo sapiens
ggaagagugauguuuca

SEQ ID NO: 1570120 - RNA, 19 nt, Homo sapiens
ggaagaucagcacccuaag

SEQ ID NO: 1570121 - RNA, 14 nt, Homo sapiens
ggaagauggcauaa

SEQ ID NO: 1570122 - RNA, 18 nt, Homo sapiens
ggaagcggcccuaaggga

SEQ ID NO: 1570123 - RNA, 17 nt, Homo sapiens
ggaagcucuucuuccca

SEQ ID NO: 1570124 - RNA, 21 nt, Homo sapiens
ggaaggaacagcaaugguguc

SEQ ID NO: 1570125 - RNA, 21 nt, Homo sapiens
ggaaggaacauggagcuguca

SEQ ID NO: 1570126 - RNA, 15 nt, Homo sapiens
ggaaggacagucccu

SEQ ID NO: 1570127 - RNA, 18 nt, Homo sapiens
ggaaggcaacgcaccauc

SEQ ID NO: 1570128 - RNA, 18 nt, Homo sapiens
ggaaggcugugauaacca

SEQ ID NO: 1570129 - RNA, 13 nt, Homo sapiens
ggaagggacacca

SEQ ID NO: 1570130 - RNA, 19 nt, Homo sapiens
ggaagggccuacagcccau

SEQ ID NO: 1570131 - RNA, 21 nt, Homo sapiens
ggaagggucccuuuugcauug

SEQ ID NO: 1570132 - RNA, 14 nt, Homo sapiens
ggaagguucucugu

SEQ ID NO: 1570133 - RNA, 13 nt, Homo sapiens
ggaagucaucuca

SEQ ID NO: 1570134 - RNA, 23 nt, Homo sapiens
ggaauaauuagcuuguuacaauu

SEQ ID NO: 1570135 - RNA, 13 nt, Homo sapiens
ggaauacauugua

SEQ ID NO: 1570136 - RNA, 17 nt, Homo sapiens
ggaauauaaaacaguca

SEQ ID NO: 1570137 - RNA, 17 nt, Homo sapiens
ggaauauacgugcuugg

SEQ ID NO: 1570138 - RNA, 14 nt, Homo sapiens
ggaaucacuuuuaa

SEQ ID NO: 1570139 - RNA, 19 nt, Homo sapiens
ggaaucaugucaggccauc

SEQ ID NO: 1570140 - RNA, 21 nt, Homo sapiens
ggaauccauguaaauugcaaa

SEQ ID NO: 1570141 - RNA, 18 nt, Homo sapiens
ggaaugacuuacuuuccu

SEQ ID NO: 1570142 - RNA, 14 nt, Homo sapiens
ggaaugcaccuccc

SEQ ID NO: 1570143 - RNA, 12 nt, Homo sapiens
ggaaugccuugg

SEQ ID NO: 1570144 - RNA, 19 nt, Homo sapiens
ggaaugcuuuccaucucca

SEQ ID NO: 1570145 - RNA, 17 nt, Homo sapiens
ggaauguaugugcacau

SEQ ID NO: 1570146 - RNA, 22 nt, Homo sapiens
ggaaugucagcaggaccccauc

SEQ ID NO: 1570147 - RNA, 11 nt, Homo sapiens
ggaaugucaua

SEQ ID NO: 1570148 - RNA, 18 nt, Homo sapiens
ggaaugucgcagacuccu

SEQ ID NO: 1570149 - RNA, 16 nt, Homo sapiens
ggaauuauucccauga

SEQ ID NO: 1570150 - RNA, 13 nt, Homo sapiens
ggaauugcucaga

SEQ ID NO: 1570151 - RNA, 21 nt, Homo sapiens
ggacaaauguuguccuguuaa

SEQ ID NO: 1570152 - RNA, 22 nt, Homo sapiens
ggacaaccaugcaaauugugaa

SEQ ID NO: 1570153 - RNA, 14 nt, Homo sapiens
ggacaagaccccca

SEQ ID NO: 1570154 - RNA, 21 nt, Homo sapiens
ggacaagacccccagcacuug

SEQ ID NO: 1570155 - RNA, 15 nt, Homo sapiens
ggacaauaugugcca

SEQ ID NO: 1570156 - RNA, 13 nt, Homo sapiens
ggacacagaccca

SEQ ID NO: 1570157 - RNA, 15 nt, Homo sapiens
ggacacuacacuggg

SEQ ID NO: 1570158 - RNA, 16 nt, Homo sapiens
ggacacuguccaugaa

SEQ ID NO: 1570159 - RNA, 23 nt, Homo sapiens
ggacacuuaauacuaccuugaaa

SEQ ID NO: 1570160 - RNA, 19 nt, Homo sapiens
ggacagaaaaauugaacua

SEQ ID NO: 1570161 - RNA, 17 nt, Homo sapiens
ggacagaaaaugcaaug

SEQ ID NO: 1570162 - RNA, 13 nt, Homo sapiens
ggacagcauauaa

SEQ ID NO: 1570163 - RNA, 13 nt, Homo sapiens
ggacagccaccaa

SEQ ID NO: 1570164 - RNA, 15 nt, Homo sapiens
ggacagccaccaaga

SEQ ID NO: 1570165 - RNA, 23 nt, Homo sapiens
ggacagcccuuccucccauuucc

SEQ ID NO: 1570166 - RNA, 18 nt, Homo sapiens
ggacaggauaagagggau

SEQ ID NO: 1570167 - RNA, 16 nt, Homo sapiens
ggacaugcccugugug

SEQ ID NO: 1570168 - RNA, 17 nt, Homo sapiens
ggacauuuaaaauucaa

SEQ ID NO: 1570169 - RNA, 22 nt, Homo sapiens
ggacauuucucaagggccaugu

SEQ ID NO: 1570170 - RNA, 20 nt, Homo sapiens
ggaccagccucuccacucau

SEQ ID NO: 1570171 - RNA, 23 nt, Homo sapiens
ggacccacaaaagaaggcucaca

SEQ ID NO: 1570172 - RNA, 22 nt, Homo sapiens
ggaccccucgccccagccucau

SEQ ID NO: 1570173 - RNA, 19 nt, Homo sapiens
ggacccugcccagagcuga

SEQ ID NO: 1570174 - RNA, 18 nt, Homo sapiens
ggaccuggcgugcucaga

SEQ ID NO: 1570175 - RNA, 18 nt, Homo sapiens
ggacgccacucauuucau

SEQ ID NO: 1570176 - RNA, 20 nt, Homo sapiens
ggacgcccccaccagcucaa

SEQ ID NO: 1570177 - RNA, 21 nt, Homo sapiens
ggacgcccccaccagcucaaa

SEQ ID NO: 1570178 - RNA, 15 nt, Homo sapiens
ggacggcaggcucac

SEQ ID NO: 1570179 - RNA, 17 nt, Homo sapiens
ggacgguuuugcuuuau

SEQ ID NO: 1570180 - RNA, 23 nt, Homo sapiens
ggacuaucaacaccacuaggaau

SEQ ID NO: 1570181 - RNA, 19 nt, Homo sapiens
ggacuauggccacauucaa

SEQ ID NO: 1570182 - RNA, 20 nt, Homo sapiens
ggacuaugguggccaagggc

SEQ ID NO: 1570183 - RNA, 18 nt, Homo sapiens
ggacuauuacauccacau

SEQ ID NO: 1570184 - RNA, 14 nt, Homo sapiens
ggacucucuaagga

SEQ ID NO: 1570185 - RNA, 21 nt, Homo sapiens
ggacugagggggccuggaugc

SEQ ID NO: 1570186 - RNA, 16 nt, Homo sapiens
ggacuuauucauuccu

SEQ ID NO: 1570187 - RNA, 22 nt, Homo sapiens
ggacuugguuuguuauaucagg

SEQ ID NO: 1570188 - RNA, 13 nt, Homo sapiens
ggagaaacuggaa

SEQ ID NO: 1570189 - RNA, 17 nt, Homo sapiens
ggagaaacuucugcuca

SEQ ID NO: 1570190 - RNA, 17 nt, Homo sapiens
ggagaaguagcuaguag

SEQ ID NO: 1570191 - RNA, 15 nt, Homo sapiens
ggagaaucacuugaa

SEQ ID NO: 1570192 - RNA, 23 nt, Homo sapiens
ggagacaaccagaucaggagagc

SEQ ID NO: 1570193 - RNA, 16 nt, Homo sapiens
ggagacaaggugcuaa

SEQ ID NO: 1570194 - RNA, 18 nt, Homo sapiens
ggagacauauuucaguga

SEQ ID NO: 1570195 - RNA, 15 nt, Homo sapiens
ggagagacaggcagc

SEQ ID NO: 1570196 - RNA, 22 nt, Homo sapiens
ggagaggcggccucgugccaug

SEQ ID NO: 1570197 - RNA, 14 nt, Homo sapiens
ggagaucugaggug

SEQ ID NO: 1570198 - RNA, 21 nt, Homo sapiens
ggagaugcuucucuccuugcc

SEQ ID NO: 1570199 - RNA, 16 nt, Homo sapiens
ggagcacggacuguca

SEQ ID NO: 1570200 - RNA, 18 nt, Homo sapiens
ggagcaggaccuacuagg

SEQ ID NO: 1570201 - RNA, 23 nt, Homo sapiens
ggagcaguaaacuuucucugcaa

SEQ ID NO: 1570202 - RNA, 15 nt, Homo sapiens
ggagcaguccaugca

SEQ ID NO: 1570203 - RNA, 16 nt, Homo sapiens
ggagcaucaagccacu

SEQ ID NO: 1570204 - RNA, 13 nt, Homo sapiens
ggagccaccagca

SEQ ID NO: 1570205 - RNA, 15 nt, Homo sapiens
ggagccucacugggg

SEQ ID NO: 1570206 - RNA, 23 nt, Homo sapiens
gcugccuucccuagcuuuagacc

SEQ ID NO: 1570207 - RNA, 15 nt, Homo sapiens
gcugcgucugcaaag

SEQ ID NO: 1570208 - RNA, 18 nt, Homo sapiens
gcugcucuaagaagggaa

SEQ ID NO: 1570209 - RNA, 19 nt, Homo sapiens
gcugcugcccauguuucaa

SEQ ID NO: 1570210 - RNA, 12 nt, Homo sapiens
gcugcuuuccag

SEQ ID NO: 1570211 - RNA, 20 nt, Homo sapiens
gcugcuuucuuguugcugca

SEQ ID NO: 1570212 - RNA, 17 nt, Homo sapiens
gcuggagggguggccca

SEQ ID NO: 1570213 - RNA, 13 nt, Homo sapiens
gcuggagugcagu

SEQ ID NO: 1570214 - RNA, 18 nt, Homo sapiens
gcuggagugcaguggugu

SEQ ID NO: 1570215 - RNA, 20 nt, Homo sapiens
gcuggagugcagugguguga

SEQ ID NO: 1570216 - RNA, 15 nt, Homo sapiens
gcuggcaucaagagg

SEQ ID NO: 1570217 - RNA, 15 nt, Homo sapiens
gcuggccagugcugc

SEQ ID NO: 1570218 - RNA, 22 nt, Homo sapiens
gcuggccucacccaccccugca

SEQ ID NO: 1570219 - RNA, 21 nt, Homo sapiens
gcuggccuccuaugccucauc

SEQ ID NO: 1570220 - RNA, 20 nt, Homo sapiens
gcuggcuggaaaaaggugaa

SEQ ID NO: 1570221 - RNA, 19 nt, Homo sapiens
gcugggagaaauacuugaa

SEQ ID NO: 1570222 - RNA, 12 nt, Homo sapiens
gcugggagacaa

SEQ ID NO: 1570223 - RNA, 13 nt, Homo sapiens
gcugggauuacag

SEQ ID NO: 1570224 - RNA, 16 nt, Homo sapiens
gcugggccauguccaa

SEQ ID NO: 1570225 - RNA, 22 nt, Homo sapiens
gcuggggacacacauucugccu

SEQ ID NO: 1570226 - RNA, 23 nt, Homo sapiens
gcuggucccggggccagcacuuc

SEQ ID NO: 1570227 - RNA, 22 nt, Homo sapiens
gcugguuugcaagaaugaaaug

SEQ ID NO: 1570228 - RNA, 14 nt, Homo sapiens
gcuguaacuacuuu

SEQ ID NO: 1570229 - RNA, 18 nt, Homo sapiens
gcuguaaucccagcacuu

SEQ ID NO: 1570230 - RNA, 16 nt, Homo sapiens
gcuguauaaagcaugu

SEQ ID NO: 1570231 - RNA, 22 nt, Homo sapiens
gcugucaacuucccaucuggcu

SEQ ID NO: 1570232 - RNA, 21 nt, Homo sapiens
gcugucaagggcagaaugaau

SEQ ID NO: 1570233 - RNA, 13 nt, Homo sapiens
gcugucacuuuuu

SEQ ID NO: 1570234 - RNA, 17 nt, Homo sapiens
gcugucagaugucacau

SEQ ID NO: 1570235 - RNA, 20 nt, Homo sapiens
gcugucaguaugacauuuca

SEQ ID NO: 1570236 - RNA, 22 nt, Homo sapiens
gcugugauuguacuguacauaa

SEQ ID NO: 1570237 - RNA, 20 nt, Homo sapiens
gcugugccuacgacuaucug

SEQ ID NO: 1570238 - RNA, 13 nt, Homo sapiens
gcugugcuguauu

SEQ ID NO: 1570239 - RNA, 17 nt, Homo sapiens
gcuguggacacugagaa

SEQ ID NO: 1570240 - RNA, 24 nt, Homo sapiens
gcuguggaguucaaaugucgaugc

SEQ ID NO: 1570241 - RNA, 14 nt, Homo sapiens
gcuguggaugcuuc

SEQ ID NO: 1570242 - RNA, 22 nt, Homo sapiens
gcuguguccgccgcaccagcca

SEQ ID NO: 1570243 - RNA, 19 nt, Homo sapiens
gcuguguucacagaccuca

SEQ ID NO: 1570244 - RNA, 18 nt, Homo sapiens
gcuguguuuccaucucaa

SEQ ID NO: 1570245 - RNA, 15 nt, Homo sapiens
gcuguuaccauucac

SEQ ID NO: 1570246 - RNA, 13 nt, Homo sapiens
gcuguuccagugg

SEQ ID NO: 1570247 - RNA, 15 nt, Homo sapiens
gcuguuccuguucag

SEQ ID NO: 1570248 - RNA, 20 nt, Homo sapiens
gcuguuguugggacauggca

SEQ ID NO: 1570249 - RNA, 20 nt, Homo sapiens
gcuguuugcuuguaguugaa

SEQ ID NO: 1570250 - RNA, 15 nt, Homo sapiens
gcuguuuguagugaa

SEQ ID NO: 1570251 - RNA, 18 nt, Homo sapiens
gcuuaaaaaauacuuuau

SEQ ID NO: 1570252 - RNA, 21 nt, Homo sapiens
gcuuaaacccuuuagugcuuu

SEQ ID NO: 1570253 - RNA, 21 nt, Homo sapiens
gcuuaauuauugauguuuuca

SEQ ID NO: 1570254 - RNA, 18 nt, Homo sapiens
gcuuaccuacauacgugu

SEQ ID NO: 1570255 - RNA, 14 nt, Homo sapiens
gcuuagauuucaua

SEQ ID NO: 1570256 - RNA, 14 nt, Homo sapiens
gcuuagcuugaggg

SEQ ID NO: 1570257 - RNA, 22 nt, Homo sapiens
gcuuaguccaauuccuugcaca

SEQ ID NO: 1570258 - RNA, 16 nt, Homo sapiens
gcuuaguuaucagcuu

SEQ ID NO: 1570259 - RNA, 19 nt, Homo sapiens
gcuuauagaggaacuugaa

SEQ ID NO: 1570260 - RNA, 13 nt, Homo sapiens
gcuucacaguacc

SEQ ID NO: 1570261 - RNA, 23 nt, Homo sapiens
gcuucaggaaccucgaguacugu

SEQ ID NO: 1570262 - RNA, 14 nt, Homo sapiens
gcuucauacagaag

SEQ ID NO: 1570263 - RNA, 13 nt, Homo sapiens
gcuucaucugugg

SEQ ID NO: 1570264 - RNA, 18 nt, Homo sapiens
gcuuccacaaaauuagaa

SEQ ID NO: 1570265 - RNA, 21 nt, Homo sapiens
gcuuccauuuuccuacaggca

SEQ ID NO: 1570266 - RNA, 23 nt, Homo sapiens
gcuuccucccuggugugaacucu

SEQ ID NO: 1570267 - RNA, 18 nt, Homo sapiens
gcuuccucuagaagccaa

SEQ ID NO: 1570268 - RNA, 15 nt, Homo sapiens
gcuucggacaaaaua

SEQ ID NO: 1570269 - RNA, 22 nt, Homo sapiens
gcuucuccagggaauucuuaca

SEQ ID NO: 1570270 - RNA, 14 nt, Homo sapiens
gcuugaagccaaag

SEQ ID NO: 1570271 - RNA, 13 nt, Homo sapiens
gcuugaccaaaga

SEQ ID NO: 1570272 - RNA, 22 nt, Homo sapiens
gcuugaccauguugcacuguuu

SEQ ID NO: 1570273 - RNA, 20 nt, Homo sapiens
gcuugauuguuuuggucuca

SEQ ID NO: 1570274 - RNA, 14 nt, Homo sapiens
gcuugcacagccaa

SEQ ID NO: 1570275 - RNA, 15 nt, Homo sapiens
gcuugcaugcuugca

SEQ ID NO: 1570276 - RNA, 16 nt, Homo sapiens
gcuuggaguucucuau

SEQ ID NO: 1570277 - RNA, 18 nt, Homo sapiens
gcuugggaggaaaccuga

SEQ ID NO: 1570278 - RNA, 14 nt, Homo sapiens
gcuuggggaccuga

SEQ ID NO: 1570279 - RNA, 16 nt, Homo sapiens
gcuuggggaccugaac

SEQ ID NO: 1570280 - RNA, 12 nt, Homo sapiens
gcuugugaucuc

SEQ ID NO: 1570281 - RNA, 16 nt, Homo sapiens
gcuuguuguuugcgca

SEQ ID NO: 1570282 - RNA, 16 nt, Homo sapiens
gcuuguuuacagcacu

SEQ ID NO: 1570283 - RNA, 21 nt, Homo sapiens
gcuuguuuacagcacuacucu

SEQ ID NO: 1570284 - RNA, 19 nt, Homo sapiens
gcuuuacaguuacaguuga

SEQ ID NO: 1570285 - RNA, 15 nt, Homo sapiens
gcuuuacugcaugaa

SEQ ID NO: 1570286 - RNA, 15 nt, Homo sapiens
gcuuuagccauacac

SEQ ID NO: 1570287 - RNA, 19 nt, Homo sapiens
gcuuuaggcagagccauaa

SEQ ID NO: 1570288 - RNA, 20 nt, Homo sapiens
gcuuucauguaaacugugca

SEQ ID NO: 1570289 - RNA, 21 nt, Homo sapiens
gcuuucauguaaacugugcac

SEQ ID NO: 1570290 - RNA, 20 nt, Homo sapiens
gcuuucuaccacacacagcc

SEQ ID NO: 1570291 - RNA, 13 nt, Homo sapiens
gcuuucucucuca

SEQ ID NO: 1570292 - RNA, 15 nt, Homo sapiens
gcuuucuuguugcug

SEQ ID NO: 1570293 - RNA, 15 nt, Homo sapiens
gcuuugcauguucca

SEQ ID NO: 1570294 - RNA, 16 nt, Homo sapiens
gcuuuggauuugacau

SEQ ID NO: 1570295 - RNA, 23 nt, Homo sapiens
gcuuugugaaaacuacugauguu

SEQ ID NO: 1570296 - RNA, 12 nt, Homo sapiens
gcuuuguggcac

SEQ ID NO: 1570297 - RNA, 20 nt, Homo sapiens
gcuuuugaaaaacaacugca

SEQ ID NO: 1570298 - RNA, 13 nt, Homo sapiens
gcuuuugccauua

SEQ ID NO: 1570299 - RNA, 17 nt, Homo sapiens
gcuuuugcuugcaaugu

SEQ ID NO: 1570300 - RNA, 20 nt, Homo sapiens
gcuuuuucacagucacugau

SEQ ID NO: 1570301 - RNA, 22 nt, Homo sapiens
gcgcuggguauuggaaauggau

SEQ ID NO: 1570302 - RNA, 16 nt, Homo sapiens
gcggcagcauggagcu

SEQ ID NO: 1570303 - RNA, 12 nt, Homo sapiens
gcggccacugcg

SEQ ID NO: 1570304 - RNA, 21 nt, Homo sapiens
gcggccucgugccaugaucug

SEQ ID NO: 1570305 - RNA, 16 nt, Homo sapiens
gcggguaaagugcaau

SEQ ID NO: 1570306 - RNA, 15 nt, Homo sapiens
gcgggugauggccag

SEQ ID NO: 1570307 - RNA, 12 nt, Homo sapiens
gcggucuugggc

SEQ ID NO: 1570308 - RNA, 15 nt, Homo sapiens
gcgucaucuguguaa

SEQ ID NO: 1570309 - RNA, 19 nt, Homo sapiens
gcgugauccaccacaccug

SEQ ID NO: 1570310 - RNA, 17 nt, Homo sapiens
gcgugcacuccccgugu

SEQ ID NO: 1570311 - RNA, 17 nt, Homo sapiens
gcgugcccagcucuuca

SEQ ID NO: 1570312 - RNA, 19 nt, Homo sapiens
gcguuacugcuugaccaaa

SEQ ID NO: 1570313 - RNA, 16 nt, Homo sapiens
gcuaaacugaugacuu

SEQ ID NO: 1570314 - RNA, 21 nt, Homo sapiens
gcuaaagagcuuugugauaua

SEQ ID NO: 1570315 - RNA, 11 nt, Homo sapiens
gcuaaccacuu

SEQ ID NO: 1570316 - RNA, 23 nt, Homo sapiens
gcuaaccugcacguugugcacau

SEQ ID NO: 1570317 - RNA, 23 nt, Homo sapiens
gcuaaggaugguuuuaucuuccc

SEQ ID NO: 1570318 - RNA, 13 nt, Homo sapiens
gcuaaguacacaa

SEQ ID NO: 1570319 - RNA, 20 nt, Homo sapiens
gcuaagugaaauaagccaga

SEQ ID NO: 1570320 - RNA, 20 nt, Homo sapiens
gcuaaucagucauuucuuca

SEQ ID NO: 1570321 - RNA, 12 nt, Homo sapiens
gcuaauguuucc

SEQ ID NO: 1570322 - RNA, 18 nt, Homo sapiens
gcuaauucagugucacau

SEQ ID NO: 1570323 - RNA, 16 nt, Homo sapiens
gcuacaaaaacacagc

SEQ ID NO: 1570324 - RNA, 23 nt, Homo sapiens
gcuacaguuauuaaucuggacau

SEQ ID NO: 1570325 - RNA, 14 nt, Homo sapiens
gcuaccaguauuua

SEQ ID NO: 1570326 - RNA, 18 nt, Homo sapiens
gcuacccuuuuccuuugu

SEQ ID NO: 1570327 - RNA, 21 nt, Homo sapiens
gcuaccuguugguuagauuca

SEQ ID NO: 1570328 - RNA, 23 nt, Homo sapiens
gcuacuggaaugguguuuuguca

SEQ ID NO: 1570329 - RNA, 22 nt, Homo sapiens
gcuacuuuuguuccacauucuc

SEQ ID NO: 1570330 - RNA, 11 nt, Homo sapiens
gcuagaaccua

SEQ ID NO: 1570331 - RNA, 21 nt, Homo sapiens
gcuagacgucucacucaaaga

SEQ ID NO: 1570332 - RNA, 21 nt, Homo sapiens
gcuagacuaccggacacucgu

SEQ ID NO: 1570333 - RNA, 18 nt, Homo sapiens
gcuagagaaggaccagaa

SEQ ID NO: 1570334 - RNA, 14 nt, Homo sapiens
gcuagaguccucac

SEQ ID NO: 1570335 - RNA, 19 nt, Homo sapiens
gcuagaugugucuuaccag

SEQ ID NO: 1570336 - RNA, 19 nt, Homo sapiens
gcuaggacuuaaccuugaa

SEQ ID NO: 1570337 - RNA, 22 nt, Homo sapiens
gcuaggacuuaaccuugaaaug

SEQ ID NO: 1570338 - RNA, 22 nt, Homo sapiens
gcuaggcaugguggacucgccu

SEQ ID NO: 1570339 - RNA, 14 nt, Homo sapiens
gcuagucacuggaa

SEQ ID NO: 1570340 - RNA, 13 nt, Homo sapiens
gcuagugccaaau

SEQ ID NO: 1570341 - RNA, 14 nt, Homo sapiens
gcuauaacuaagca

SEQ ID NO: 1570342 - RNA, 23 nt, Homo sapiens
gcuauaagugcucaauagcuuga

SEQ ID NO: 1570343 - RNA, 20 nt, Homo sapiens
gcuaugaucagaagacuuua

SEQ ID NO: 1570344 - RNA, 18 nt, Homo sapiens
gcuaugguucucucgcaa

SEQ ID NO: 1570345 - RNA, 20 nt, Homo sapiens
gcuauuacuaguacuauuac

SEQ ID NO: 1570346 - RNA, 15 nt, Homo sapiens
gcucaaaaucuguga

SEQ ID NO: 1570347 - RNA, 20 nt, Homo sapiens
gcucaaaguacuacagcaaa

SEQ ID NO: 1570348 - RNA, 14 nt, Homo sapiens
gcucaaccuuccaa

SEQ ID NO: 1570349 - RNA, 21 nt, Homo sapiens
gcucacccucucuuggugcau

SEQ ID NO: 1570350 - RNA, 11 nt, Homo sapiens
gcucacugggc

SEQ ID NO: 1570351 - RNA, 19 nt, Homo sapiens
gcucagaaggaauggugcg

SEQ ID NO: 1570352 - RNA, 15 nt, Homo sapiens
gcucagcauuuccac

SEQ ID NO: 1570353 - RNA, 17 nt, Homo sapiens
gcucaguaacugugcau

SEQ ID NO: 1570354 - RNA, 15 nt, Homo sapiens
gcucaguuggugcug

SEQ ID NO: 1570355 - RNA, 18 nt, Homo sapiens
gcucaguuggugcugcuu

SEQ ID NO: 1570356 - RNA, 20 nt, Homo sapiens
gcucaguuggugcugcuuuc

SEQ ID NO: 1570357 - RNA, 13 nt, Homo sapiens
gcucaucauucuc

SEQ ID NO: 1570358 - RNA, 22 nt, Homo sapiens
gcucaucccuggacuucuggga

SEQ ID NO: 1570359 - RNA, 15 nt, Homo sapiens
gcucaucugcaaaag

SEQ ID NO: 1570360 - RNA, 18 nt, Homo sapiens
gcucaugcccauaauccc

SEQ ID NO: 1570361 - RNA, 19 nt, Homo sapiens
gcucaugccuguaaucuca

SEQ ID NO: 1570362 - RNA, 18 nt, Homo sapiens
gcucauuucaguuucuau

SEQ ID NO: 1570363 - RNA, 20 nt, Homo sapiens
gcuccaccagcagcauggca

SEQ ID NO: 1570364 - RNA, 17 nt, Homo sapiens
gcuccagcgauggugcu

SEQ ID NO: 1570365 - RNA, 16 nt, Homo sapiens
gcucccaaaacauuuu

SEQ ID NO: 1570366 - RNA, 14 nt, Homo sapiens
gcucccaagcugcc

SEQ ID NO: 1570367 - RNA, 17 nt, Homo sapiens
gcucccugccuccugcc

SEQ ID NO: 1570368 - RNA, 17 nt, Homo sapiens
gcuccgaggacccagga

SEQ ID NO: 1570369 - RNA, 15 nt, Homo sapiens
gcuccgggaucagca

SEQ ID NO: 1570370 - RNA, 23 nt, Homo sapiens
gcuccgucagcuucucccaagcc

SEQ ID NO: 1570371 - RNA, 14 nt, Homo sapiens
gcuccuaucugugu

SEQ ID NO: 1570372 - RNA, 15 nt, Homo sapiens
gcuccugaggggcau

SEQ ID NO: 1570373 - RNA, 12 nt, Homo sapiens
gcuccugcaaaa

SEQ ID NO: 1570374 - RNA, 21 nt, Homo sapiens
gcuccuggggagcuccuggga

SEQ ID NO: 1570375 - RNA, 14 nt, Homo sapiens
gcuccugugcucac

SEQ ID NO: 1570376 - RNA, 19 nt, Homo sapiens
gcuccuguucacaccagag

SEQ ID NO: 1570377 - RNA, 22 nt, Homo sapiens
gcuccuuggcacccccaugcug

SEQ ID NO: 1570378 - RNA, 17 nt, Homo sapiens
gcucgcccacaaacuga

SEQ ID NO: 1570379 - RNA, 22 nt, Homo sapiens
gcucggagcggcgucccuucca

SEQ ID NO: 1570380 - RNA, 12 nt, Homo sapiens
gcucgugcagua

SEQ ID NO: 1570381 - RNA, 22 nt, Homo sapiens
gcucuaacaaugacauuuauau

SEQ ID NO: 1570382 - RNA, 20 nt, Homo sapiens
gcucuaauucacagugcucu

SEQ ID NO: 1570383 - RNA, 22 nt, Homo sapiens
gcucuaggcuguucuguagcuu

SEQ ID NO: 1570384 - RNA, 16 nt, Homo sapiens
gcucucaacaggacuu

SEQ ID NO: 1570385 - RNA, 20 nt, Homo sapiens
gcucucaagucaaggaagcu

SEQ ID NO: 1570386 - RNA, 19 nt, Homo sapiens
gcucuccuucacucugaca

SEQ ID NO: 1570387 - RNA, 14 nt, Homo sapiens
gcucucucuagaau

SEQ ID NO: 1570388 - RNA, 22 nt, Homo sapiens
gcucucuucuccccacugugcc

SEQ ID NO: 1570389 - RNA, 17 nt, Homo sapiens
gcucugaauaguuaaaa

SEQ ID NO: 1570390 - RNA, 15 nt, Homo sapiens
gcucugcuaugagug

SEQ ID NO: 1570391 - RNA, 10 nt, Homo sapiens
gcucugggaa

SEQ ID NO: 1570392 - RNA, 11 nt, Homo sapiens
gcucuucacau

SEQ ID NO: 1570393 - RNA, 17 nt, Homo sapiens
gcucuuguucuacugag

SEQ ID NO: 1570394 - RNA, 15 nt, Homo sapiens
gcucuuuugugauga

SEQ ID NO: 1570395 - RNA, 13 nt, Homo sapiens
gcugaaaacauaa

SEQ ID NO: 1570396 - RNA, 16 nt, Homo sapiens
cugaccgugggcgggg

SEQ ID NO: 1570397 - RNA, 17 nt, Homo sapiens
cugaccuuccagagccc

SEQ ID NO: 1570398 - RNA, 15 nt, Homo sapiens
cugacgacaguacug

SEQ ID NO: 1570399 - RNA, 19 nt, Homo sapiens
cugacuaaagguuaccugu

SEQ ID NO: 1570400 - RNA, 20 nt, Homo sapiens
cugacuaggugucaccauac

SEQ ID NO: 1570401 - RNA, 16 nt, Homo sapiens
cugacuaugugccgag

SEQ ID NO: 1570402 - RNA, 18 nt, Homo sapiens
cugacucagcuaauguca

SEQ ID NO: 1570403 - RNA, 18 nt, Homo sapiens
cugacuccaagcugcaug

SEQ ID NO: 1570404 - RNA, 20 nt, Homo sapiens
cugacuggauucauucucau

SEQ ID NO: 1570405 - RNA, 20 nt, Homo sapiens
cugacuuaacguucuauaaa

SEQ ID NO: 1570406 - RNA, 18 nt, Homo sapiens
cugacuuccaagauccuu

SEQ ID NO: 1570407 - RNA, 21 nt, Homo sapiens
cugacuuggaucccaaagcaa

SEQ ID NO: 1570408 - RNA, 17 nt, Homo sapiens
cugagaaaagccucucc

SEQ ID NO: 1570409 - RNA, 18 nt, Homo sapiens
cugagaaagacuauucaa

SEQ ID NO: 1570410 - RNA, 15 nt, Homo sapiens
cugagaaaguacaaa

SEQ ID NO: 1570411 - RNA, 17 nt, Homo sapiens
cugagaaggaacaggga

SEQ ID NO: 1570412 - RNA, 17 nt, Homo sapiens
cugagaccaaaguagau

SEQ ID NO: 1570413 - RNA, 14 nt, Homo sapiens
cugagagaggccau

SEQ ID NO: 1570414 - RNA, 14 nt, Homo sapiens
cugagagucauuca

SEQ ID NO: 1570415 - RNA, 16 nt, Homo sapiens
cugagaucagugccuc

SEQ ID NO: 1570416 - RNA, 12 nt, Homo sapiens
cugagauucaau

SEQ ID NO: 1570417 - RNA, 16 nt, Homo sapiens
cugagauuuugcuuga

SEQ ID NO: 1570418 - RNA, 21 nt, Homo sapiens
cugagcacauuugacuccacu

SEQ ID NO: 1570419 - RNA, 16 nt, Homo sapiens
cugagcagaacugaaa

SEQ ID NO: 1570420 - RNA, 22 nt, Homo sapiens
cugagcagaagcuggaggcaca

SEQ ID NO: 1570421 - RNA, 16 nt, Homo sapiens
cugagcagcauccacc

SEQ ID NO: 1570422 - RNA, 13 nt, Homo sapiens
cugagccagcugc

SEQ ID NO: 1570423 - RNA, 18 nt, Homo sapiens
cugagccauuugcugcau

SEQ ID NO: 1570424 - RNA, 20 nt, Homo sapiens
cugagccauuugcugcauuu

SEQ ID NO: 1570425 - RNA, 18 nt, Homo sapiens
cugagcccauaggucuca

SEQ ID NO: 1570426 - RNA, 21 nt, Homo sapiens
cugagcccugguguguuucca

SEQ ID NO: 1570427 - RNA, 18 nt, Homo sapiens
cugagcgggagucaggga

SEQ ID NO: 1570428 - RNA, 13 nt, Homo sapiens
cugagcuauuuca

SEQ ID NO: 1570429 - RNA, 20 nt, Homo sapiens
cugagcugccuguaacuuga

SEQ ID NO: 1570430 - RNA, 21 nt, Homo sapiens
cugaggaagugggcgugagug

SEQ ID NO: 1570431 - RNA, 19 nt, Homo sapiens
cugaggccccugccuccaa

SEQ ID NO: 1570432 - RNA, 18 nt, Homo sapiens
cugaggggauaccauaaa

SEQ ID NO: 1570433 - RNA, 15 nt, Homo sapiens
cugaggucaggaguu

SEQ ID NO: 1570434 - RNA, 17 nt, Homo sapiens
cugagguuuugaaagaa

SEQ ID NO: 1570435 - RNA, 14 nt, Homo sapiens
cugaguaguggcca

SEQ ID NO: 1570436 - RNA, 20 nt, Homo sapiens
cugaguaguggccacugggg

SEQ ID NO: 1570437 - RNA, 15 nt, Homo sapiens
cugaguccuuuccag

SEQ ID NO: 1570438 - RNA, 16 nt, Homo sapiens
cugagugaaauacugu

SEQ ID NO: 1570439 - RNA, 23 nt, Homo sapiens
cugagugacugcagcuugccaaa

SEQ ID NO: 1570440 - RNA, 14 nt, Homo sapiens
cugaguugcacaua

SEQ ID NO: 1570441 - RNA, 19 nt, Homo sapiens
cugaguuuggaugucugua

SEQ ID NO: 1570442 - RNA, 22 nt, Homo sapiens
cugauaagagaaucaacauuuc

SEQ ID NO: 1570443 - RNA, 18 nt, Homo sapiens
cugauacuuugacagugu

SEQ ID NO: 1570444 - RNA, 17 nt, Homo sapiens
cugauccagaugcccag

SEQ ID NO: 1570445 - RNA, 23 nt, Homo sapiens
cugauccagauguuaugcuccug

SEQ ID NO: 1570446 - RNA, 15 nt, Homo sapiens
cugauccuugcacgc

SEQ ID NO: 1570447 - RNA, 21 nt, Homo sapiens
cugaugacacaggcugacuca

SEQ ID NO: 1570448 - RNA, 17 nt, Homo sapiens
cugaugagaaucaugca

SEQ ID NO: 1570449 - RNA, 15 nt, Homo sapiens
cugaugagcacaucu

SEQ ID NO: 1570450 - RNA, 14 nt, Homo sapiens
cugaugauuucacu

SEQ ID NO: 1570451 - RNA, 16 nt, Homo sapiens
cugaugcagccgucca

SEQ ID NO: 1570452 - RNA, 14 nt, Homo sapiens
cugaugcugggacc

SEQ ID NO: 1570453 - RNA, 18 nt, Homo sapiens
cugaugcuguuaaccaaa

SEQ ID NO: 1570454 - RNA, 20 nt, Homo sapiens
cugaugcuguuaaccaaagg

SEQ ID NO: 1570455 - RNA, 19 nt, Homo sapiens
cugauggccuuuggaccca

SEQ ID NO: 1570456 - RNA, 15 nt, Homo sapiens
cugauggcugaagaa

SEQ ID NO: 1570457 - RNA, 15 nt, Homo sapiens
cugaugggcaaaaaa

SEQ ID NO: 1570458 - RNA, 17 nt, Homo sapiens
cugaugguggcucuggu

SEQ ID NO: 1570459 - RNA, 14 nt, Homo sapiens
cugauguaaaacgg

SEQ ID NO: 1570460 - RNA, 14 nt, Homo sapiens
cugauguguucucu

SEQ ID NO: 1570461 - RNA, 19 nt, Homo sapiens
cugauguucuuuccaugaa

SEQ ID NO: 1570462 - RNA, 16 nt, Homo sapiens
cugauuaccugccaau

SEQ ID NO: 1570463 - RNA, 13 nt, Homo sapiens
cugauucaguggg

SEQ ID NO: 1570464 - RNA, 19 nt, Homo sapiens
cugauuccagaacaaauca

SEQ ID NO: 1570465 - RNA, 20 nt, Homo sapiens
cugauucuuaugauuacuau

SEQ ID NO: 1570466 - RNA, 14 nt, Homo sapiens
cugauugacugugc

SEQ ID NO: 1570467 - RNA, 14 nt, Homo sapiens
cugauuuaacacuu

SEQ ID NO: 1570468 - RNA, 14 nt, Homo sapiens
cugauuuacauuca

SEQ ID NO: 1570469 - RNA, 23 nt, Homo sapiens
cugauuuauguuuugaucaaauu

SEQ ID NO: 1570470 - RNA, 23 nt, Homo sapiens
cugauuugggcugaauguaugua

SEQ ID NO: 1570471 - RNA, 23 nt, Homo sapiens
cugcaaaaaugaaauccagugag

SEQ ID NO: 1570472 - RNA, 19 nt, Homo sapiens
cugcaacaggcuugugcaa

SEQ ID NO: 1570473 - RNA, 15 nt, Homo sapiens
cugcaagauggacac

SEQ ID NO: 1570474 - RNA, 15 nt, Homo sapiens
cugcaagauuucaca

SEQ ID NO: 1570475 - RNA, 12 nt, Homo sapiens
cugcaagcauuu

SEQ ID NO: 1570476 - RNA, 14 nt, Homo sapiens
cugcaauacauuaa

SEQ ID NO: 1570477 - RNA, 22 nt, Homo sapiens
cugcaaucccagcuacuuggaa

SEQ ID NO: 1570478 - RNA, 20 nt, Homo sapiens
cugcacaaaagcagauacuu

SEQ ID NO: 1570479 - RNA, 14 nt, Homo sapiens
cugcacaaacaaua

SEQ ID NO: 1570480 - RNA, 15 nt, Homo sapiens
cugcacaaacaauau

SEQ ID NO: 1570481 - RNA, 19 nt, Homo sapiens
cugcacaacugacuuccaa

SEQ ID NO: 1570482 - RNA, 17 nt, Homo sapiens
cugcaccacaccuggca

SEQ ID NO: 1570483 - RNA, 19 nt, Homo sapiens
cugcaccaggggugcacaa

SEQ ID NO: 1570484 - RNA, 17 nt, Homo sapiens
cugcacccuguuuaaca

SEQ ID NO: 1570485 - RNA, 15 nt, Homo sapiens
cugcacgaccccuga

SEQ ID NO: 1570486 - RNA, 15 nt, Homo sapiens
cugcacguugugcac

SEQ ID NO: 1570487 - RNA, 20 nt, Homo sapiens
cugcacuccagccuggggga

SEQ ID NO: 1570488 - RNA, 13 nt, Homo sapiens
cugcagaccaucc

SEQ ID NO: 1570489 - RNA, 18 nt, Homo sapiens
cugcagaccucaagccau

SEQ ID NO: 1570490 - RNA, 22 nt, Homo sapiens
cugcagcagucgcccaagcaga

SEQ ID NO: 1570491 - RNA, 16 nt, Homo sapiens
cugcagcucugaccca

SEQ ID NO: 1570492 - RNA, 19 nt, Homo sapiens
cugcagcuggaaugugcca

SEQ ID NO: 1570493 - RNA, 12 nt, Homo sapiens
cugcagcugucu

SEQ ID NO: 1570494 - RNA, 19 nt, Homo sapiens
cugcaggguuacacaaaaa

SEQ ID NO: 1570495 - RNA, 15 nt, Homo sapiens
cugcaguuccaucag

SEQ ID NO: 1570496 - RNA, 15 nt, Homo sapiens
cugcauccagagauu

SEQ ID NO: 1570497 - RNA, 17 nt, Homo sapiens
cugcaucuauaauguca

SEQ ID NO: 1570498 - RNA, 14 nt, Homo sapiens
cugcauggcaaguu

SEQ ID NO: 1570499 - RNA, 17 nt, Homo sapiens
gacgugauuuugcugua

SEQ ID NO: 1570500 - RNA, 21 nt, Homo sapiens
gacgugccuaccucuuagaca

SEQ ID NO: 1570501 - RNA, 19 nt, Homo sapiens
gacuacauccugaguguga

SEQ ID NO: 1570502 - RNA, 20 nt, Homo sapiens
gacuacaugugaacugggac

SEQ ID NO: 1570503 - RNA, 21 nt, Homo sapiens
gacuacuagagcuccauuucu

SEQ ID NO: 1570504 - RNA, 14 nt, Homo sapiens
gacuagaaccugga

SEQ ID NO: 1570505 - RNA, 17 nt, Homo sapiens
gacuauggccacauuca

SEQ ID NO: 1570506 - RNA, 22 nt, Homo sapiens
gacucaauguggaaaaaauauu

SEQ ID NO: 1570507 - RNA, 18 nt, Homo sapiens
gacucagaugaggacaga

SEQ ID NO: 1570508 - RNA, 21 nt, Homo sapiens
gacucauuuuaaaaaauggaa

SEQ ID NO: 1570509 - RNA, 12 nt, Homo sapiens
gacuccaagcug

SEQ ID NO: 1570510 - RNA, 14 nt, Homo sapiens
gacucucagcagcu

SEQ ID NO: 1570511 - RNA, 16 nt, Homo sapiens
gacucuccagccaccc

SEQ ID NO: 1570512 - RNA, 15 nt, Homo sapiens
gacucugauucuaca

SEQ ID NO: 1570513 - RNA, 14 nt, Homo sapiens
gacugauguguaua

SEQ ID NO: 1570514 - RNA, 11 nt, Homo sapiens
gacugauuacc

SEQ ID NO: 1570515 - RNA, 21 nt, Homo sapiens
gacugcaacaggcuugugcaa

SEQ ID NO: 1570516 - RNA, 13 nt, Homo sapiens
gacugcuaccucu

SEQ ID NO: 1570517 - RNA, 18 nt, Homo sapiens
gacugcuaccucugagaa

SEQ ID NO: 1570518 - RNA, 21 nt, Homo sapiens
gacugcugcagucacaucaca

SEQ ID NO: 1570519 - RNA, 18 nt, Homo sapiens
gacuggacccccuggaag

SEQ ID NO: 1570520 - RNA, 19 nt, Homo sapiens
gacuggaugguccaguguc

SEQ ID NO: 1570521 - RNA, 22 nt, Homo sapiens
gacuggcccuguccuggcauca

SEQ ID NO: 1570522 - RNA, 16 nt, Homo sapiens
gacuggcuuuuauuaa

SEQ ID NO: 1570523 - RNA, 21 nt, Homo sapiens
gacugggugagacccaaagcg

SEQ ID NO: 1570524 - RNA, 14 nt, Homo sapiens
gacugucaguucuc

SEQ ID NO: 1570525 - RNA, 21 nt, Homo sapiens
gacuuagcgucaagacauuug

SEQ ID NO: 1570526 - RNA, 12 nt, Homo sapiens
gacuuaucaaca

SEQ ID NO: 1570527 - RNA, 16 nt, Homo sapiens
gacuuauucauuccuc

SEQ ID NO: 1570528 - RNA, 13 nt, Homo sapiens
gacuucacacugc

SEQ ID NO: 1570529 - RNA, 13 nt, Homo sapiens
gacuucacuguau

SEQ ID NO: 1570530 - RNA, 20 nt, Homo sapiens
gacuucugucuucacaacag

SEQ ID NO: 1570531 - RNA, 14 nt, Homo sapiens
gacuugaacaaaga

SEQ ID NO: 1570532 - RNA, 20 nt, Homo sapiens
gacuugagaugaaaaaggag

SEQ ID NO: 1570533 - RNA, 13 nt, Homo sapiens
gacuugcaaucca

SEQ ID NO: 1570534 - RNA, 18 nt, Homo sapiens
gacuugcucccucuccaa

SEQ ID NO: 1570535 - RNA, 15 nt, Homo sapiens
gacuuggagacuccu

SEQ ID NO: 1570536 - RNA, 20 nt, Homo sapiens
gacuuggaguaaaacuguau

SEQ ID NO: 1570537 - RNA, 20 nt, Homo sapiens
gacuugucccgggacaccua

SEQ ID NO: 1570538 - RNA, 20 nt, Homo sapiens
gacuuguuuuaaacuugccu

SEQ ID NO: 1570539 - RNA, 16 nt, Homo sapiens
gacuuuacaaaccuuu

SEQ ID NO: 1570540 - RNA, 19 nt, Homo sapiens
gacuuucuucuagugcuuu

SEQ ID NO: 1570541 - RNA, 21 nt, Homo sapiens
gacuuuuuaguacuaagcuua

SEQ ID NO: 1570542 - RNA, 14 nt, Homo sapiens
gagaaaaagggagg

SEQ ID NO: 1570543 - RNA, 23 nt, Homo sapiens
gagaaaccauucuuuccccucag

SEQ ID NO: 1570544 - RNA, 14 nt, Homo sapiens
gagaaagaaaggga

SEQ ID NO: 1570545 - RNA, 12 nt, Homo sapiens
gagaaaugccag

SEQ ID NO: 1570546 - RNA, 20 nt, Homo sapiens
gagaaaugcuuagaaauuca

SEQ ID NO: 1570547 - RNA, 13 nt, Homo sapiens
gagaaauggccaa

SEQ ID NO: 1570548 - RNA, 19 nt, Homo sapiens
gagaacaccagagaccuca

SEQ ID NO: 1570549 - RNA, 12 nt, Homo sapiens
gagaacacugug

SEQ ID NO: 1570550 - RNA, 16 nt, Homo sapiens
gagaacacugugcucu

SEQ ID NO: 1570551 - RNA, 23 nt, Homo sapiens
gagaacuccaucagaaaaccaaa

SEQ ID NO: 1570552 - RNA, 19 nt, Homo sapiens
gagaagaaguggcugccac

SEQ ID NO: 1570553 - RNA, 14 nt, Homo sapiens
gagaagcaaugggu

SEQ ID NO: 1570554 - RNA, 17 nt, Homo sapiens
gagaagccaaacagcaa

SEQ ID NO: 1570555 - RNA, 20 nt, Homo sapiens
gagaagcucugaagaacucu

SEQ ID NO: 1570556 - RNA, 18 nt, Homo sapiens
gagaaggaaaagacugaa

SEQ ID NO: 1570557 - RNA, 14 nt, Homo sapiens
gagaaggcugugag

SEQ ID NO: 1570558 - RNA, 22 nt, Homo sapiens
gagaagguauuagcaaagcaaa

SEQ ID NO: 1570559 - RNA, 17 nt, Homo sapiens
gagaagucuaacgcuga

SEQ ID NO: 1570560 - RNA, 16 nt, Homo sapiens
gagaaguugcugcuug

SEQ ID NO: 1570561 - RNA, 16 nt, Homo sapiens
gagaauaggggagcca

SEQ ID NO: 1570562 - RNA, 21 nt, Homo sapiens
gagaaucccaaauuugauuga

SEQ ID NO: 1570563 - RNA, 15 nt, Homo sapiens
gagaaugaauucuga

SEQ ID NO: 1570564 - RNA, 11 nt, Homo sapiens
gagaauggagg

SEQ ID NO: 1570565 - RNA, 16 nt, Homo sapiens
gagaauguaagaacua

SEQ ID NO: 1570566 - RNA, 16 nt, Homo sapiens
gagacacauugccuuc

SEQ ID NO: 1570567 - RNA, 12 nt, Homo sapiens
gagacacugagc

SEQ ID NO: 1570568 - RNA, 22 nt, Homo sapiens
gagacagaaagcagaacaguga

SEQ ID NO: 1570569 - RNA, 19 nt, Homo sapiens
gagacagagccuuguucua

SEQ ID NO: 1570570 - RNA, 15 nt, Homo sapiens
gagacaggagccuag

SEQ ID NO: 1570571 - RNA, 15 nt, Homo sapiens
gagaccacacauuuu

SEQ ID NO: 1570572 - RNA, 23 nt, Homo sapiens
gagacccccacaccucaguuccc

SEQ ID NO: 1570573 - RNA, 18 nt, Homo sapiens
gagacgguguuuugccau

SEQ ID NO: 1570574 - RNA, 14 nt, Homo sapiens
gagacuccaucuca

SEQ ID NO: 1570575 - RNA, 14 nt, Homo sapiens
gagacuccgucuca

SEQ ID NO: 1570576 - RNA, 16 nt, Homo sapiens
gagacucugucucagu

SEQ ID NO: 1570577 - RNA, 20 nt, Homo sapiens
gagacugggagccacuucuc

SEQ ID NO: 1570578 - RNA, 22 nt, Homo sapiens
gagacugggagccacuucuccc

SEQ ID NO: 1570579 - RNA, 19 nt, Homo sapiens
gagacuguacauaauugca

SEQ ID NO: 1570580 - RNA, 15 nt, Homo sapiens
gagagaccucauccu

SEQ ID NO: 1570581 - RNA, 15 nt, Homo sapiens
gagagcagaggucuc

SEQ ID NO: 1570582 - RNA, 13 nt, Homo sapiens
gagagcagcagca

SEQ ID NO: 1570583 - RNA, 14 nt, Homo sapiens
gagagcccauuccc

SEQ ID NO: 1570584 - RNA, 14 nt, Homo sapiens
gagagcgaaggggg

SEQ ID NO: 1570585 - RNA, 15 nt, Homo sapiens
gagaggaacgggcag

SEQ ID NO: 1570586 - RNA, 13 nt, Homo sapiens
gagaggcaggcau

SEQ ID NO: 1570587 - RNA, 14 nt, Homo sapiens
gagaguaagcacgu

SEQ ID NO: 1570588 - RNA, 14 nt, Homo sapiens
gagaguccaucagc

SEQ ID NO: 1570589 - RNA, 12 nt, Homo sapiens
gagagugcacau

SEQ ID NO: 1570590 - RNA, 20 nt, Homo sapiens
gagaguucuuuauauucaaa

SEQ ID NO: 1570591 - RNA, 16 nt, Homo sapiens
gagauaggaaacugaa

SEQ ID NO: 1570592 - RNA, 18 nt, Homo sapiens
gagauaguuuucauuuua

SEQ ID NO: 1570593 - RNA, 18 nt, Homo sapiens
gagauauggacucucuaa

SEQ ID NO: 1570594 - RNA, 12 nt, Homo sapiens
gagaucaugcca

SEQ ID NO: 1570595 - RNA, 19 nt, Homo sapiens
gagaucuauaaacagacag

SEQ ID NO: 1570596 - RNA, 16 nt, Homo sapiens
gagaucugcacaguca

SEQ ID NO: 1570597 - RNA, 20 nt, Homo sapiens
gagaugcaggugaugccauu

SEQ ID NO: 1570598 - RNA, 18 nt, Homo sapiens
gagaugccacuucucacu

SEQ ID NO: 1570599 - RNA, 22 nt, Homo sapiens
gagaugccacuucucacucacc

SEQ ID NO: 1570600 - RNA, 22 nt, Homo sapiens
gaguaguuguuggucuguagca

SEQ ID NO: 1570601 - RNA, 20 nt, Homo sapiens
gagucaauagcuugucuucg

SEQ ID NO: 1570602 - RNA, 15 nt, Homo sapiens
gagucacugccaagu

SEQ ID NO: 1570603 - RNA, 21 nt, Homo sapiens
gagucaggaguuuuacugccu

SEQ ID NO: 1570604 - RNA, 20 nt, Homo sapiens
gagucauucaggugaccucc

SEQ ID NO: 1570605 - RNA, 14 nt, Homo sapiens
gaguccucacuccc

SEQ ID NO: 1570606 - RNA, 20 nt, Homo sapiens
gagucucacuuugacaccca

SEQ ID NO: 1570607 - RNA, 21 nt, Homo sapiens
gagucucacuuugacacccag

SEQ ID NO: 1570608 - RNA, 15 nt, Homo sapiens
gagucucaggacaga

SEQ ID NO: 1570609 - RNA, 17 nt, Homo sapiens
gagucucauuugggcua

SEQ ID NO: 1570610 - RNA, 20 nt, Homo sapiens
gagugacuacacacaguacg

SEQ ID NO: 1570611 - RNA, 19 nt, Homo sapiens
gagugagacccugucucaa

SEQ ID NO: 1570612 - RNA, 13 nt, Homo sapiens
gagugcacuacug

SEQ ID NO: 1570613 - RNA, 20 nt, Homo sapiens
gagugcaguggcaugaucau

SEQ ID NO: 1570614 - RNA, 13 nt, Homo sapiens
gagugccaugcuu

SEQ ID NO: 1570615 - RNA, 19 nt, Homo sapiens
gagugcucucucagcacug

SEQ ID NO: 1570616 - RNA, 15 nt, Homo sapiens
gaguggggggacaga

SEQ ID NO: 1570617 - RNA, 23 nt, Homo sapiens
gagugguuuccaauguguucaau

SEQ ID NO: 1570618 - RNA, 18 nt, Homo sapiens
gaguguccuggcugugaa

SEQ ID NO: 1570619 - RNA, 23 nt, Homo sapiens
gagugucuuuccacggagccacu

SEQ ID NO: 1570620 - RNA, 23 nt, Homo sapiens
gagugugggggaggcgcacagug

SEQ ID NO: 1570621 - RNA, 22 nt, Homo sapiens
gaguguguguuuguguguuuca

SEQ ID NO: 1570622 - RNA, 22 nt, Homo sapiens
gaguguuuaccuggugcucuca

SEQ ID NO: 1570623 - RNA, 21 nt, Homo sapiens
gaguuaguggauuacugccau

SEQ ID NO: 1570624 - RNA, 14 nt, Homo sapiens
gaguucaaguccga

SEQ ID NO: 1570625 - RNA, 21 nt, Homo sapiens
gaguucccucaguacuauucc

SEQ ID NO: 1570626 - RNA, 21 nt, Homo sapiens
gaguuccuuaucccucucuuc

SEQ ID NO: 1570627 - RNA, 14 nt, Homo sapiens
gaguucugaagcug

SEQ ID NO: 1570628 - RNA, 17 nt, Homo sapiens
gaguugagcagccuuuc

SEQ ID NO: 1570629 - RNA, 19 nt, Homo sapiens
gaguuguuuaaacagucaa

SEQ ID NO: 1570630 - RNA, 23 nt, Homo sapiens
gaguuuauuggaggaucaaagaa

SEQ ID NO: 1570631 - RNA, 19 nt, Homo sapiens
gaguuucuauggauucacu

SEQ ID NO: 1570632 - RNA, 14 nt, Homo sapiens
gaguuucugcaguu

SEQ ID NO: 1570633 - RNA, 18 nt, Homo sapiens
gaguuuggaugucuguag

SEQ ID NO: 1570634 - RNA, 21 nt, Homo sapiens
gaguuuugcuuuugacuccag

SEQ ID NO: 1570635 - RNA, 20 nt, Homo sapiens
gauaaaaagaggaauauucu

SEQ ID NO: 1570636 - RNA, 13 nt, Homo sapiens
gauaaaaucuucc

SEQ ID NO: 1570637 - RNA, 23 nt, Homo sapiens
gauaaaauuacaggauaucacau

SEQ ID NO: 1570638 - RNA, 16 nt, Homo sapiens
gauaaaugauagacaa

SEQ ID NO: 1570639 - RNA, 22 nt, Homo sapiens
gauaaauuuuaaaauugguaua

SEQ ID NO: 1570640 - RNA, 11 nt, Homo sapiens
gauaacaaaca

SEQ ID NO: 1570641 - RNA, 14 nt, Homo sapiens
gauaacaaccugga

SEQ ID NO: 1570642 - RNA, 14 nt, Homo sapiens
gauaacugauuucu

SEQ ID NO: 1570643 - RNA, 19 nt, Homo sapiens
gauaagaaaugaucuuuac

SEQ ID NO: 1570644 - RNA, 19 nt, Homo sapiens
gauaagagauguugacucu

SEQ ID NO: 1570645 - RNA, 21 nt, Homo sapiens
gauaaguugaggaaagaaaua

SEQ ID NO: 1570646 - RNA, 24 nt, Homo sapiens
gauaauauccagccucccacaaga

SEQ ID NO: 1570647 - RNA, 20 nt, Homo sapiens
gauaauaugaaaaucuccau

SEQ ID NO: 1570648 - RNA, 12 nt, Homo sapiens
gauacacagaua

SEQ ID NO: 1570649 - RNA, 15 nt, Homo sapiens
gauacacagauauau

SEQ ID NO: 1570650 - RNA, 15 nt, Homo sapiens
gauacagaacucuuu

SEQ ID NO: 1570651 - RNA, 15 nt, Homo sapiens
gauacugaugcauug

SEQ ID NO: 1570652 - RNA, 16 nt, Homo sapiens
gauacugcuuuucacc

SEQ ID NO: 1570653 - RNA, 15 nt, Homo sapiens
gauacuguaauacuu

SEQ ID NO: 1570654 - RNA, 20 nt, Homo sapiens
gauacuuuaguacaauuuca

SEQ ID NO: 1570655 - RNA, 14 nt, Homo sapiens
gauagcuacagugu

SEQ ID NO: 1570656 - RNA, 18 nt, Homo sapiens
gauagcuuggagggaugg

SEQ ID NO: 1570657 - RNA, 16 nt, Homo sapiens
gauaguucuauaagaa

SEQ ID NO: 1570658 - RNA, 13 nt, Homo sapiens
gauauaaucuuuc

SEQ ID NO: 1570659 - RNA, 22 nt, Homo sapiens
gauauaccuaauguuaaaugac

SEQ ID NO: 1570660 - RNA, 18 nt, Homo sapiens
gauauauacacacagugg

SEQ ID NO: 1570661 - RNA, 22 nt, Homo sapiens
gauauaucuuuaauaaguaauc

SEQ ID NO: 1570662 - RNA, 18 nt, Homo sapiens
gauaucgugaaauccuca

SEQ ID NO: 1570663 - RNA, 13 nt, Homo sapiens
gauaucuucagaa

SEQ ID NO: 1570664 - RNA, 15 nt, Homo sapiens
gauaucuuugcugcu

SEQ ID NO: 1570665 - RNA, 15 nt, Homo sapiens
gauaugaaggauuac

SEQ ID NO: 1570666 - RNA, 16 nt, Homo sapiens
gauauucagaaguaua

SEQ ID NO: 1570667 - RNA, 19 nt, Homo sapiens
gauauucuaagaaauaucu

SEQ ID NO: 1570668 - RNA, 14 nt, Homo sapiens
gauauugaauguga

SEQ ID NO: 1570669 - RNA, 17 nt, Homo sapiens
gauauugauuacuauca

SEQ ID NO: 1570670 - RNA, 20 nt, Homo sapiens
gaucaaaguguaaacaccau

SEQ ID NO: 1570671 - RNA, 14 nt, Homo sapiens
gaucaauuucuccc

SEQ ID NO: 1570672 - RNA, 15 nt, Homo sapiens
gaucacacaguguua

SEQ ID NO: 1570673 - RNA, 20 nt, Homo sapiens
gaucacgccauuguacucca

SEQ ID NO: 1570674 - RNA, 22 nt, Homo sapiens
gaucacgccauuguacuccagc

SEQ ID NO: 1570675 - RNA, 14 nt, Homo sapiens
gaucaggaauucua

SEQ ID NO: 1570676 - RNA, 18 nt, Homo sapiens
gaucauuuggagcucuug

SEQ ID NO: 1570677 - RNA, 19 nt, Homo sapiens
gauccucaugguucccaag

SEQ ID NO: 1570678 - RNA, 16 nt, Homo sapiens
gauccucccaccucag

SEQ ID NO: 1570679 - RNA, 16 nt, Homo sapiens
gauccucccucauggc

SEQ ID NO: 1570680 - RNA, 22 nt, Homo sapiens
gauccugcacucuaacacucga

SEQ ID NO: 1570681 - RNA, 13 nt, Homo sapiens
gauccugcugcuu

SEQ ID NO: 1570682 - RNA, 20 nt, Homo sapiens
gaucgugcuacugcacucca

SEQ ID NO: 1570683 - RNA, 13 nt, Homo sapiens
gaucuaccagcau

SEQ ID NO: 1570684 - RNA, 22 nt, Homo sapiens
gaucucagcucaccucaaccuc

SEQ ID NO: 1570685 - RNA, 12 nt, Homo sapiens
gaucuccugacc

SEQ ID NO: 1570686 - RNA, 20 nt, Homo sapiens
gaucucguuuacuccauguu

SEQ ID NO: 1570687 - RNA, 17 nt, Homo sapiens
gaucuguuuuacaggaa

SEQ ID NO: 1570688 - RNA, 21 nt, Homo sapiens
gaucuuaauauaaauucacuu

SEQ ID NO: 1570689 - RNA, 17 nt, Homo sapiens
gaucuuccguggucaga

SEQ ID NO: 1570690 - RNA, 16 nt, Homo sapiens
gaucuugagaaccuuu

SEQ ID NO: 1570691 - RNA, 22 nt, Homo sapiens
gaucuuucucaaucuugaacuc

SEQ ID NO: 1570692 - RNA, 18 nt, Homo sapiens
gaugaaacaucauuucaa

SEQ ID NO: 1570693 - RNA, 15 nt, Homo sapiens
gaugaacgugccuga

SEQ ID NO: 1570694 - RNA, 23 nt, Homo sapiens
gaugaagcugagcuuuugaugcc

SEQ ID NO: 1570695 - RNA, 21 nt, Homo sapiens
gaugacgauucuuaacaauaa

SEQ ID NO: 1570696 - RNA, 16 nt, Homo sapiens
gaugagaaucaugcac

SEQ ID NO: 1570697 - RNA, 12 nt, Homo sapiens
gaugaucuucag

SEQ ID NO: 1570698 - RNA, 22 nt, Homo sapiens
gaugaucuuuaaaauacacacu

SEQ ID NO: 1570699 - RNA, 19 nt, Homo sapiens
gaugcaacaaauguggcca

SEQ ID NO: 1570700 - RNA, 21 nt, Homo sapiens
gaugcaucacacucaaggaca

SEQ ID NO: 1570701 - RNA, 13 nt, Homo sapiens
gaugcauuucaaa

SEQ ID NO: 1570702 - RNA, 17 nt, Homo sapiens
gaugcggccucagagag

SEQ ID NO: 1570703 - RNA, 16 nt, Homo sapiens
gaugcugccauuuaac

SEQ ID NO: 1570704 - RNA, 19 nt, Homo sapiens
gaugcuggguccauaucac

SEQ ID NO: 1570705 - RNA, 17 nt, Homo sapiens
gauggaacaucagugga

SEQ ID NO: 1570706 - RNA, 19 nt, Homo sapiens
gauggcuggaaggggucca

SEQ ID NO: 1570707 - RNA, 17 nt, Homo sapiens
gaugggaccagggaugg

SEQ ID NO: 1570708 - RNA, 20 nt, Homo sapiens
gaugggagaaucacuugaac

SEQ ID NO: 1570709 - RNA, 21 nt, Homo sapiens
gaugggcaaacccuggugcuu

SEQ ID NO: 1570710 - RNA, 14 nt, Homo sapiens
gauggggcucccag

SEQ ID NO: 1570711 - RNA, 21 nt, Homo sapiens
gaugguaucuggguaagaaga

SEQ ID NO: 1570712 - RNA, 17 nt, Homo sapiens
gauggucucgaucucuu

SEQ ID NO: 1570713 - RNA, 23 nt, Homo sapiens
gauggugcaugccuguagucuca

SEQ ID NO: 1570714 - RNA, 18 nt, Homo sapiens
gaugguugaauacaguua

SEQ ID NO: 1570715 - RNA, 19 nt, Homo sapiens
gauguacauuacagauuaa

SEQ ID NO: 1570716 - RNA, 20 nt, Homo sapiens
gauguaccagcaucucccag

SEQ ID NO: 1570717 - RNA, 23 nt, Homo sapiens
cuccacucaugugacucuuucca

SEQ ID NO: 1570718 - RNA, 19 nt, Homo sapiens
cuccagaccccaugccuua

SEQ ID NO: 1570719 - RNA, 12 nt, Homo sapiens
cuccagccagag

SEQ ID NO: 1570720 - RNA, 16 nt, Homo sapiens
cuccagcugauccaga

SEQ ID NO: 1570721 - RNA, 22 nt, Homo sapiens
cuccagcuucccgaguaccagu

SEQ ID NO: 1570722 - RNA, 15 nt, Homo sapiens
cuccaggagccucau

SEQ ID NO: 1570723 - RNA, 18 nt, Homo sapiens
cuccaggcccaaggcucc

SEQ ID NO: 1570724 - RNA, 18 nt, Homo sapiens
cuccagggaauucuuaca

SEQ ID NO: 1570725 - RNA, 23 nt, Homo sapiens
cuccagggaugauucaagccauu

SEQ ID NO: 1570726 - RNA, 21 nt, Homo sapiens
cuccaguuagaaugcaccaug

SEQ ID NO: 1570727 - RNA, 23 nt, Homo sapiens
cuccaguuagaaugcaccaugga

SEQ ID NO: 1570728 - RNA, 22 nt, Homo sapiens
cuccaguuuacccuucagguug

SEQ ID NO: 1570729 - RNA, 17 nt, Homo sapiens
cuccauagcgacacccu

SEQ ID NO: 1570730 - RNA, 17 nt, Homo sapiens
cuccauaucuccauggc

SEQ ID NO: 1570731 - RNA, 23 nt, Homo sapiens
cuccauccuccugugucacugaa

SEQ ID NO: 1570732 - RNA, 17 nt, Homo sapiens
cuccaucguccauccuc

SEQ ID NO: 1570733 - RNA, 14 nt, Homo sapiens
cuccaucucaugua

SEQ ID NO: 1570734 - RNA, 10 nt, Homo sapiens
cuccaucucc

SEQ ID NO: 1570735 - RNA, 18 nt, Homo sapiens
cuccaucucuucugcaag

SEQ ID NO: 1570736 - RNA, 14 nt, Homo sapiens
cuccauuuccacuu

SEQ ID NO: 1570737 - RNA, 16 nt, Homo sapiens
cucccaaaacagauua

SEQ ID NO: 1570738 - RNA, 16 nt, Homo sapiens
cucccaacccauucac

SEQ ID NO: 1570739 - RNA, 23 nt, Homo sapiens
cucccaagguccucucaguucuc

SEQ ID NO: 1570740 - RNA, 18 nt, Homo sapiens
cucccaccccacccccuu

SEQ ID NO: 1570741 - RNA, 18 nt, Homo sapiens
cucccacuucacugcgaa

SEQ ID NO: 1570742 - RNA, 17 nt, Homo sapiens
cucccagauaaugugaa

SEQ ID NO: 1570743 - RNA, 16 nt, Homo sapiens
cucccagcuccuuuca

SEQ ID NO: 1570744 - RNA, 20 nt, Homo sapiens
cucccagguucccccagcaa

SEQ ID NO: 1570745 - RNA, 15 nt, Homo sapiens
cucccagucauuuaa

SEQ ID NO: 1570746 - RNA, 22 nt, Homo sapiens
cucccaguccaaauguccucca

SEQ ID NO: 1570747 - RNA, 21 nt, Homo sapiens
cucccauaauugcuuugccaa

SEQ ID NO: 1570748 - RNA, 22 nt, Homo sapiens
cucccauaauugcuuugccaaa

SEQ ID NO: 1570749 - RNA, 12 nt, Homo sapiens
cucccaugaagc

SEQ ID NO: 1570750 - RNA, 11 nt, Homo sapiens
cuccccaacuc

SEQ ID NO: 1570751 - RNA, 19 nt, Homo sapiens
cuccccacacagacuccac

SEQ ID NO: 1570752 - RNA, 21 nt, Homo sapiens
cuccccacaccucccuacucc

SEQ ID NO: 1570753 - RNA, 15 nt, Homo sapiens
cuccccccagacccc

SEQ ID NO: 1570754 - RNA, 18 nt, Homo sapiens
cucccccguggugccugc

SEQ ID NO: 1570755 - RNA, 12 nt, Homo sapiens
cuccccuaucca

SEQ ID NO: 1570756 - RNA, 17 nt, Homo sapiens
cuccccucagauuccac

SEQ ID NO: 1570757 - RNA, 20 nt, Homo sapiens
cuccccuguucauucugcau

SEQ ID NO: 1570758 - RNA, 15 nt, Homo sapiens
cucccggaccccuug

SEQ ID NO: 1570759 - RNA, 19 nt, Homo sapiens
cucccuaguagcugggauu

SEQ ID NO: 1570760 - RNA, 19 nt, Homo sapiens
cucccuaguuagcauccag

SEQ ID NO: 1570761 - RNA, 15 nt, Homo sapiens
cucccucagacccag

SEQ ID NO: 1570762 - RNA, 22 nt, Homo sapiens
cucccucagacccagcggucca

SEQ ID NO: 1570763 - RNA, 22 nt, Homo sapiens
cucccucagacccaggggucca

SEQ ID NO: 1570764 - RNA, 22 nt, Homo sapiens
cucccucucucuucugcuccac

SEQ ID NO: 1570765 - RNA, 16 nt, Homo sapiens
cucccucuuucuuccc

SEQ ID NO: 1570766 - RNA, 19 nt, Homo sapiens
cucccugacccugcuccua

SEQ ID NO: 1570767 - RNA, 15 nt, Homo sapiens
cucccuucucaucuc

SEQ ID NO: 1570768 - RNA, 13 nt, Homo sapiens
cuccgacucugca

SEQ ID NO: 1570769 - RNA, 14 nt, Homo sapiens
cuccgaggccagua

SEQ ID NO: 1570770 - RNA, 14 nt, Homo sapiens
cuccggaggacuga

SEQ ID NO: 1570771 - RNA, 18 nt, Homo sapiens
cuccuacacaaguguuuc

SEQ ID NO: 1570772 - RNA, 19 nt, Homo sapiens
cuccucaaacccagucuca

SEQ ID NO: 1570773 - RNA, 19 nt, Homo sapiens
cuccucaccucaugcccac

SEQ ID NO: 1570774 - RNA, 20 nt, Homo sapiens
cuccucacuguauccagguu

SEQ ID NO: 1570775 - RNA, 19 nt, Homo sapiens
cuccucagagcgccaggaa

SEQ ID NO: 1570776 - RNA, 20 nt, Homo sapiens
cuccucaggcccagcugcuc

SEQ ID NO: 1570777 - RNA, 15 nt, Homo sapiens
cuccucaucuccaag

SEQ ID NO: 1570778 - RNA, 12 nt, Homo sapiens
cuccuccaggga

SEQ ID NO: 1570779 - RNA, 13 nt, Homo sapiens
cuccuccagggaa

SEQ ID NO: 1570780 - RNA, 19 nt, Homo sapiens
cuccucccucagacccagg

SEQ ID NO: 1570781 - RNA, 22 nt, Homo sapiens
cuccucgagaucccaacacugc

SEQ ID NO: 1570782 - RNA, 12 nt, Homo sapiens
cuccucuauucc

SEQ ID NO: 1570783 - RNA, 17 nt, Homo sapiens
cuccucugaaacagcug

SEQ ID NO: 1570784 - RNA, 21 nt, Homo sapiens
cuccucuguuaaaaaaaauga

SEQ ID NO: 1570785 - RNA, 15 nt, Homo sapiens
cuccugaagccacag

SEQ ID NO: 1570786 - RNA, 12 nt, Homo sapiens
cuccugaccucg

SEQ ID NO: 1570787 - RNA, 13 nt, Homo sapiens
cuccugcagggau

SEQ ID NO: 1570788 - RNA, 14 nt, Homo sapiens
cuccugcugaucca

SEQ ID NO: 1570789 - RNA, 22 nt, Homo sapiens
cuccuggacuccggaggacuga

SEQ ID NO: 1570790 - RNA, 14 nt, Homo sapiens
cuccuggccucaua

SEQ ID NO: 1570791 - RNA, 19 nt, Homo sapiens
cuccuggccucauacagaa

SEQ ID NO: 1570792 - RNA, 15 nt, Homo sapiens
cuccuggccuggcca

SEQ ID NO: 1570793 - RNA, 18 nt, Homo sapiens
cuccuggcuguccuacca

SEQ ID NO: 1570794 - RNA, 19 nt, Homo sapiens
cuccugggcucaagcaauc

SEQ ID NO: 1570795 - RNA, 20 nt, Homo sapiens
cuccuggguucaagugauuc

SEQ ID NO: 1570796 - RNA, 14 nt, Homo sapiens
cuccuggucuguga

SEQ ID NO: 1570797 - RNA, 13 nt, Homo sapiens
cuccuggugcuaa

SEQ ID NO: 1570798 - RNA, 15 nt, Homo sapiens
cuccugucuccagca

SEQ ID NO: 1570799 - RNA, 16 nt, Homo sapiens
cuccuguuuugcacag

SEQ ID NO: 1570800 - RNA, 23 nt, Homo sapiens
cuccuuauagacacuugcuccca

SEQ ID NO: 1570801 - RNA, 14 nt, Homo sapiens
cuccuuccaccaca

SEQ ID NO: 1570802 - RNA, 13 nt, Homo sapiens
cuccuuccagacc

SEQ ID NO: 1570803 - RNA, 18 nt, Homo sapiens
cuccuuucuccugugaau

SEQ ID NO: 1570804 - RNA, 13 nt, Homo sapiens
cuccuuuguacag

SEQ ID NO: 1570805 - RNA, 14 nt, Homo sapiens
cucgaaacacagaa

SEQ ID NO: 1570806 - RNA, 13 nt, Homo sapiens
cucgagaucccaa

SEQ ID NO: 1570807 - RNA, 21 nt, Homo sapiens
cucgaggccugcaaaccuucc

SEQ ID NO: 1570808 - RNA, 20 nt, Homo sapiens
cucgauagccugagguggga

SEQ ID NO: 1570809 - RNA, 21 nt, Homo sapiens
cucgcccagacaccaugugca

SEQ ID NO: 1570810 - RNA, 16 nt, Homo sapiens
cucgccccagccucau

SEQ ID NO: 1570811 - RNA, 17 nt, Homo sapiens
cucgccggaucugaggg

SEQ ID NO: 1570812 - RNA, 14 nt, Homo sapiens
cucggagacgggac

SEQ ID NO: 1570813 - RNA, 20 nt, Homo sapiens
cucggggggguuuucaucua

SEQ ID NO: 1570814 - RNA, 21 nt, Homo sapiens
cucgggugcauuugagagaag

SEQ ID NO: 1570815 - RNA, 11 nt, Homo sapiens
cucguccuccc

SEQ ID NO: 1570816 - RNA, 13 nt, Homo sapiens
cucuaaagaccau

SEQ ID NO: 1570817 - RNA, 15 nt, Homo sapiens
cucuaaauagcacuu

SEQ ID NO: 1570818 - RNA, 16 nt, Homo sapiens
cucuaagcacauucca

SEQ ID NO: 1570819 - RNA, 14 nt, Homo sapiens
cucuaaguuuagaa

SEQ ID NO: 1570820 - RNA, 18 nt, Homo sapiens
cucuaauucacagugcuc

SEQ ID NO: 1570821 - RNA, 19 nt, Homo sapiens
cucuaauucggauuugcca

SEQ ID NO: 1570822 - RNA, 15 nt, Homo sapiens
cucaagucugcacag

SEQ ID NO: 1570823 - RNA, 17 nt, Homo sapiens
cucaagugaauuugaau

SEQ ID NO: 1570824 - RNA, 15 nt, Homo sapiens
cucaauaaacaguca

SEQ ID NO: 1570825 - RNA, 13 nt, Homo sapiens
cucaauagcuuga

SEQ ID NO: 1570826 - RNA, 16 nt, Homo sapiens
cucaauuaccaauaug

SEQ ID NO: 1570827 - RNA, 17 nt, Homo sapiens
cucaauucaaauccaua

SEQ ID NO: 1570828 - RNA, 21 nt, Homo sapiens
cucaauuucucugaggacaca

SEQ ID NO: 1570829 - RNA, 23 nt, Homo sapiens
cucacaaaaaggcaaauauugaa

SEQ ID NO: 1570830 - RNA, 23 nt, Homo sapiens
cucacacuuuuggaaccaugccu

SEQ ID NO: 1570831 - RNA, 22 nt, Homo sapiens
cucacagcaaggauggagcuga

SEQ ID NO: 1570832 - RNA, 21 nt, Homo sapiens
cucacagccguccaacuuaaa

SEQ ID NO: 1570833 - RNA, 14 nt, Homo sapiens
cucacauugagagu

SEQ ID NO: 1570834 - RNA, 15 nt, Homo sapiens
cucacauugagagua

SEQ ID NO: 1570835 - RNA, 13 nt, Homo sapiens
cucaccaagcuca

SEQ ID NO: 1570836 - RNA, 18 nt, Homo sapiens
cucaccaggguuuaguuu

SEQ ID NO: 1570837 - RNA, 12 nt, Homo sapiens
cucaccauagag

SEQ ID NO: 1570838 - RNA, 17 nt, Homo sapiens
cucaccaugaugugaag

SEQ ID NO: 1570839 - RNA, 20 nt, Homo sapiens
cucacccagucuucuacaca

SEQ ID NO: 1570840 - RNA, 16 nt, Homo sapiens
cucacccccaccacca

SEQ ID NO: 1570841 - RNA, 11 nt, Homo sapiens
cucaccucucu

SEQ ID NO: 1570842 - RNA, 17 nt, Homo sapiens
cucaccugguugaccca

SEQ ID NO: 1570843 - RNA, 23 nt, Homo sapiens
cucaccugucuaggucuccucag

SEQ ID NO: 1570844 - RNA, 15 nt, Homo sapiens
cucaccuugagccca

SEQ ID NO: 1570845 - RNA, 22 nt, Homo sapiens
cucaccuuuuuaaauccuaaaa

SEQ ID NO: 1570846 - RNA, 13 nt, Homo sapiens
cucacgccuguaa

SEQ ID NO: 1570847 - RNA, 14 nt, Homo sapiens
cucacucacucuga

SEQ ID NO: 1570848 - RNA, 15 nt, Homo sapiens
cucacucccagucca

SEQ ID NO: 1570849 - RNA, 15 nt, Homo sapiens
cucacucuguuuccu

SEQ ID NO: 1570850 - RNA, 12 nt, Homo sapiens
cucacucuucaa

SEQ ID NO: 1570851 - RNA, 23 nt, Homo sapiens
cucacucuucaaggaggcccacu

SEQ ID NO: 1570852 - RNA, 16 nt, Homo sapiens
cucacugcagugcuga

SEQ ID NO: 1570853 - RNA, 21 nt, Homo sapiens
cucacugcugcaaauacugua

SEQ ID NO: 1570854 - RNA, 21 nt, Homo sapiens
cucacuggggcagacaauaaa

SEQ ID NO: 1570855 - RNA, 17 nt, Homo sapiens
cucacuguccaauauga

SEQ ID NO: 1570856 - RNA, 15 nt, Homo sapiens
cucacuucaaugugu

SEQ ID NO: 1570857 - RNA, 23 nt, Homo sapiens
cucacuuuacuuucaaguaauau

SEQ ID NO: 1570858 - RNA, 19 nt, Homo sapiens
cucacuuucccuuguguca

SEQ ID NO: 1570859 - RNA, 17 nt, Homo sapiens
cucacuuuuauugauaa

SEQ ID NO: 1570860 - RNA, 19 nt, Homo sapiens
cucagaaaagaggccagcu

SEQ ID NO: 1570861 - RNA, 22 nt, Homo sapiens
cucagaaacugcgaggccaguu

SEQ ID NO: 1570862 - RNA, 22 nt, Homo sapiens
cucagaaauguaguuugcacuu

SEQ ID NO: 1570863 - RNA, 18 nt, Homo sapiens
cucagaaggaauggugcg

SEQ ID NO: 1570864 - RNA, 19 nt, Homo sapiens
cucagaaggccccagagag

SEQ ID NO: 1570865 - RNA, 14 nt, Homo sapiens
cucagaauccacaa

SEQ ID NO: 1570866 - RNA, 17 nt, Homo sapiens
cucagaccaaucaucaa

SEQ ID NO: 1570867 - RNA, 13 nt, Homo sapiens
cucagacccaggg

SEQ ID NO: 1570868 - RNA, 14 nt, Homo sapiens
cucagaggccugcu

SEQ ID NO: 1570869 - RNA, 15 nt, Homo sapiens
cucagaucauuauca

SEQ ID NO: 1570870 - RNA, 17 nt, Homo sapiens
cucagauucuucacugg

SEQ ID NO: 1570871 - RNA, 11 nt, Homo sapiens
cucagcacugu

SEQ ID NO: 1570872 - RNA, 23 nt, Homo sapiens
cucagcauagggucacuuugcca

SEQ ID NO: 1570873 - RNA, 23 nt, Homo sapiens
cucagccacugucacaggcauau

SEQ ID NO: 1570874 - RNA, 15 nt, Homo sapiens
cucagccacuugccu

SEQ ID NO: 1570875 - RNA, 21 nt, Homo sapiens
cucagccacuugccugugcua

SEQ ID NO: 1570876 - RNA, 17 nt, Homo sapiens
cucagccuccugaguag

SEQ ID NO: 1570877 - RNA, 23 nt, Homo sapiens
cucagccugcuuuccugcagcag

SEQ ID NO: 1570878 - RNA, 21 nt, Homo sapiens
cucagccuggagguagggggc

SEQ ID NO: 1570879 - RNA, 18 nt, Homo sapiens
cucagccuguuccaugaa

SEQ ID NO: 1570880 - RNA, 15 nt, Homo sapiens
cucagcuaaugucac

SEQ ID NO: 1570881 - RNA, 15 nt, Homo sapiens
cucagcucucuggga

SEQ ID NO: 1570882 - RNA, 20 nt, Homo sapiens
cucagcuucccaaguagcug

SEQ ID NO: 1570883 - RNA, 23 nt, Homo sapiens
cucagcuucuucacaggcacucc

SEQ ID NO: 1570884 - RNA, 14 nt, Homo sapiens
cucaggacagaaca

SEQ ID NO: 1570885 - RNA, 16 nt, Homo sapiens
cucaggacagaaccac

SEQ ID NO: 1570886 - RNA, 14 nt, Homo sapiens
cucaggcacacagc

SEQ ID NO: 1570887 - RNA, 19 nt, Homo sapiens
cucaggccaagggaccagg

SEQ ID NO: 1570888 - RNA, 16 nt, Homo sapiens
cucaggcgggacagug

SEQ ID NO: 1570889 - RNA, 18 nt, Homo sapiens
cucaggcgggacagugcu

SEQ ID NO: 1570890 - RNA, 15 nt, Homo sapiens
cucaggcucuugacu

SEQ ID NO: 1570891 - RNA, 16 nt, Homo sapiens
cucagggccucaggca

SEQ ID NO: 1570892 - RNA, 16 nt, Homo sapiens
cucaggggucauucau

SEQ ID NO: 1570893 - RNA, 22 nt, Homo sapiens
cucagguggaggcaacagggcc

SEQ ID NO: 1570894 - RNA, 22 nt, Homo sapiens
cucagguuuguuuugugaauuu

SEQ ID NO: 1570895 - RNA, 21 nt, Homo sapiens
cucagugaccagugccuguga

SEQ ID NO: 1570896 - RNA, 15 nt, Homo sapiens
cucagugacucagaa

SEQ ID NO: 1570897 - RNA, 15 nt, Homo sapiens
cucaguggaucuuca

SEQ ID NO: 1570898 - RNA, 23 nt, Homo sapiens
cucaguuauuacauguaauuuga

SEQ ID NO: 1570899 - RNA, 18 nt, Homo sapiens
cucaguuggugcugcuuu

SEQ ID NO: 1570900 - RNA, 21 nt, Homo sapiens
cucaguuggugcugcuuucuu

SEQ ID NO: 1570901 - RNA, 22 nt, Homo sapiens
cucaguuguuugcuucuugcca

SEQ ID NO: 1570902 - RNA, 21 nt, Homo sapiens
cucaguuuccucaucugcaaa

SEQ ID NO: 1570903 - RNA, 16 nt, Homo sapiens
cucaguuucuaggcac

SEQ ID NO: 1570904 - RNA, 20 nt, Homo sapiens
cucaguuuuuaucaggcuuu

SEQ ID NO: 1570905 - RNA, 13 nt, Homo sapiens
cucauaagcauau

SEQ ID NO: 1570906 - RNA, 13 nt, Homo sapiens
cucauacagaaag

SEQ ID NO: 1570907 - RNA, 13 nt, Homo sapiens
cucauauugugau

SEQ ID NO: 1570908 - RNA, 21 nt, Homo sapiens
cucaucaacugaaugagguca

SEQ ID NO: 1570909 - RNA, 13 nt, Homo sapiens
cucaucacauaaa

SEQ ID NO: 1570910 - RNA, 13 nt, Homo sapiens
cucaucacuagga

SEQ ID NO: 1570911 - RNA, 23 nt, Homo sapiens
cucaucaggccauugucccugaa

SEQ ID NO: 1570912 - RNA, 17 nt, Homo sapiens
cucaucccgagcaccuc

SEQ ID NO: 1570913 - RNA, 16 nt, Homo sapiens
cucaucucuuagcucc

SEQ ID NO: 1570914 - RNA, 12 nt, Homo sapiens
cucaugccauca

SEQ ID NO: 1570915 - RNA, 20 nt, Homo sapiens
cucaugcccauaaucccagc

SEQ ID NO: 1570916 - RNA, 18 nt, Homo sapiens
cucaugccuguaauccca

SEQ ID NO: 1570917 - RNA, 20 nt, Homo sapiens
cucaugccuguaaucccagc

SEQ ID NO: 1570918 - RNA, 17 nt, Homo sapiens
cucaugccuguaaucuc

SEQ ID NO: 1570919 - RNA, 15 nt, Homo sapiens
cucaugccuugagau

SEQ ID NO: 1570920 - RNA, 21 nt, Homo sapiens
cucauggcuguguccacugca

SEQ ID NO: 1570921 - RNA, 15 nt, Homo sapiens
cucaugggugggaca

SEQ ID NO: 1570922 - RNA, 17 nt, Homo sapiens
cucaugguccuuggagg

SEQ ID NO: 1570923 - RNA, 15 nt, Homo sapiens
cucauuccagaggaa

SEQ ID NO: 1570924 - RNA, 17 nt, Homo sapiens
cucauugagaauucaaa

SEQ ID NO: 1570925 - RNA, 22 nt, Homo sapiens
cucauuucaaauuugugcagug

SEQ ID NO: 1570926 - RNA, 16 nt, Homo sapiens
cucauuugaaugcuua

SEQ ID NO: 1570927 - RNA, 14 nt, Homo sapiens
cuacugaacccugc

SEQ ID NO: 1570928 - RNA, 13 nt, Homo sapiens
cuacugauacuuu

SEQ ID NO: 1570929 - RNA, 12 nt, Homo sapiens
cuacugaucaac

SEQ ID NO: 1570930 - RNA, 23 nt, Homo sapiens
cuacugggugucauuucauucca

SEQ ID NO: 1570931 - RNA, 16 nt, Homo sapiens
cuacuguucuugacaa

SEQ ID NO: 1570932 - RNA, 13 nt, Homo sapiens
cuacuucaagaaa

SEQ ID NO: 1570933 - RNA, 15 nt, Homo sapiens
cuacuugucauauca

SEQ ID NO: 1570934 - RNA, 14 nt, Homo sapiens
cuacuuuacuguug

SEQ ID NO: 1570935 - RNA, 20 nt, Homo sapiens
cuacuuuacuguugguggca

SEQ ID NO: 1570936 - RNA, 15 nt, Homo sapiens
cuacuuucaucuuaa

SEQ ID NO: 1570937 - RNA, 16 nt, Homo sapiens
cuagaaacauguaauc

SEQ ID NO: 1570938 - RNA, 18 nt, Homo sapiens
cuagaaagagaaacaguu

SEQ ID NO: 1570939 - RNA, 19 nt, Homo sapiens
cuagaaccuggagggcuag

SEQ ID NO: 1570940 - RNA, 19 nt, Homo sapiens
cuagaagaaccaaauaccu

SEQ ID NO: 1570941 - RNA, 13 nt, Homo sapiens
cuagaagggcuag

SEQ ID NO: 1570942 - RNA, 20 nt, Homo sapiens
cuagaaggggcuaugcauau

SEQ ID NO: 1570943 - RNA, 18 nt, Homo sapiens
cuagaaucuggagagcua

SEQ ID NO: 1570944 - RNA, 22 nt, Homo sapiens
cuagaaugcaaguauccugcga

SEQ ID NO: 1570945 - RNA, 22 nt, Homo sapiens
cuagacuaagaagauuuaguuu

SEQ ID NO: 1570946 - RNA, 12 nt, Homo sapiens
cuagacuauaaa

SEQ ID NO: 1570947 - RNA, 15 nt, Homo sapiens
cuagagaacacugug

SEQ ID NO: 1570948 - RNA, 23 nt, Homo sapiens
cuagagauauggcagcgaaagga

SEQ ID NO: 1570949 - RNA, 21 nt, Homo sapiens
cuagagcuagaugugucuuac

SEQ ID NO: 1570950 - RNA, 16 nt, Homo sapiens
cuagagcuccauuucu

SEQ ID NO: 1570951 - RNA, 17 nt, Homo sapiens
cuagaguucauggauau

SEQ ID NO: 1570952 - RNA, 20 nt, Homo sapiens
cuagaucucagccauucuaa

SEQ ID NO: 1570953 - RNA, 14 nt, Homo sapiens
cuagauggacccca

SEQ ID NO: 1570954 - RNA, 17 nt, Homo sapiens
cuagauuuaacucaguu

SEQ ID NO: 1570955 - RNA, 13 nt, Homo sapiens
cuagcacacucuu

SEQ ID NO: 1570956 - RNA, 23 nt, Homo sapiens
cuagcacccuggagagugcacau

SEQ ID NO: 1570957 - RNA, 18 nt, Homo sapiens
cuagcauucuaguuucau

SEQ ID NO: 1570958 - RNA, 23 nt, Homo sapiens
cuagcauuguaaaauuauuucau

SEQ ID NO: 1570959 - RNA, 18 nt, Homo sapiens
cuaggaagagcaggacuc

SEQ ID NO: 1570960 - RNA, 19 nt, Homo sapiens
cuaggagaacugcuguguu

SEQ ID NO: 1570961 - RNA, 23 nt, Homo sapiens
cuaggagaacugcuguguucuca

SEQ ID NO: 1570962 - RNA, 22 nt, Homo sapiens
cuaggauaacuggcacccagag

SEQ ID NO: 1570963 - RNA, 22 nt, Homo sapiens
cuaggaugggaacaaggaagga

SEQ ID NO: 1570964 - RNA, 16 nt, Homo sapiens
cuaggaugguucugug

SEQ ID NO: 1570965 - RNA, 15 nt, Homo sapiens
cuaggaugugaugau

SEQ ID NO: 1570966 - RNA, 21 nt, Homo sapiens
cuaggccacuccuccaaagga

SEQ ID NO: 1570967 - RNA, 19 nt, Homo sapiens
cuaggccauuagcccuuca

SEQ ID NO: 1570968 - RNA, 22 nt, Homo sapiens
cuaggcuaggguggggagagac

SEQ ID NO: 1570969 - RNA, 16 nt, Homo sapiens
cuagggucuugggggu

SEQ ID NO: 1570970 - RNA, 13 nt, Homo sapiens
cuagguaucauuc

SEQ ID NO: 1570971 - RNA, 15 nt, Homo sapiens
cuaguaagugccuuc

SEQ ID NO: 1570972 - RNA, 12 nt, Homo sapiens
cuaguacuauua

SEQ ID NO: 1570973 - RNA, 24 nt, Homo sapiens
cuaguacuauuacuaguacuagua

SEQ ID NO: 1570974 - RNA, 19 nt, Homo sapiens
cuaguacugccccccauga

SEQ ID NO: 1570975 - RNA, 21 nt, Homo sapiens
cuaguagaacucacagaaaua

SEQ ID NO: 1570976 - RNA, 22 nt, Homo sapiens
cuaguauuuauggguggauuua

SEQ ID NO: 1570977 - RNA, 19 nt, Homo sapiens
cuagucacaaagacuccuu

SEQ ID NO: 1570978 - RNA, 12 nt, Homo sapiens
cuagugccuuua

SEQ ID NO: 1570979 - RNA, 17 nt, Homo sapiens
cuaguucugccaggaga

SEQ ID NO: 1570980 - RNA, 16 nt, Homo sapiens
cuauaaaaaauaugua

SEQ ID NO: 1570981 - RNA, 19 nt, Homo sapiens
cuauaaaagcuuucugcca

SEQ ID NO: 1570982 - RNA, 21 nt, Homo sapiens
cuauaacuuuugguaucuacu

SEQ ID NO: 1570983 - RNA, 19 nt, Homo sapiens
cuauaauggguccccaaaa

SEQ ID NO: 1570984 - RNA, 12 nt, Homo sapiens
cuauacaaccua

SEQ ID NO: 1570985 - RNA, 16 nt, Homo sapiens
cuauacuugaacaaaa

SEQ ID NO: 1570986 - RNA, 21 nt, Homo sapiens
cuauagcagaagcacauuuuc

SEQ ID NO: 1570987 - RNA, 17 nt, Homo sapiens
cuauagguccagaaguc

SEQ ID NO: 1570988 - RNA, 16 nt, Homo sapiens
cuauauaaauauguca

SEQ ID NO: 1570989 - RNA, 22 nt, Homo sapiens
cuauauauccaagaagcaugca

SEQ ID NO: 1570990 - RNA, 22 nt, Homo sapiens
cuauaucaaaaaaccuuuacag

SEQ ID NO: 1570991 - RNA, 21 nt, Homo sapiens
cuauauuccuuuuucuaugaa

SEQ ID NO: 1570992 - RNA, 20 nt, Homo sapiens
cuaucaacaccacuaggaau

SEQ ID NO: 1570993 - RNA, 19 nt, Homo sapiens
cuaucauaauucagcacuu

SEQ ID NO: 1570994 - RNA, 18 nt, Homo sapiens
cuaucauauauacuguau

SEQ ID NO: 1570995 - RNA, 22 nt, Homo sapiens
cuauccugauccccaacugaag

SEQ ID NO: 1570996 - RNA, 13 nt, Homo sapiens
cuaucugaccaaa

SEQ ID NO: 1570997 - RNA, 16 nt, Homo sapiens
cuaugaaaaugagccc

SEQ ID NO: 1570998 - RNA, 19 nt, Homo sapiens
cuaugaauuaacccaaaga

SEQ ID NO: 1570999 - RNA, 19 nt, Homo sapiens
cuaugacuucgacagcauc

SEQ ID NO: 1571000 - RNA, 18 nt, Homo sapiens
cuaugaggaaacugaguc

SEQ ID NO: 1571001 - RNA, 19 nt, Homo sapiens
cuaugauauuuucugugcc

SEQ ID NO: 1571002 - RNA, 22 nt, Homo sapiens
cuaugauauuuucugugccuga

SEQ ID NO: 1571003 - RNA, 15 nt, Homo sapiens
cuaugaugugaaaca

SEQ ID NO: 1571004 - RNA, 13 nt, Homo sapiens
cuaugcacugaag

SEQ ID NO: 1571005 - RNA, 22 nt, Homo sapiens
cuaugcaggcagcacagcagac

SEQ ID NO: 1571006 - RNA, 16 nt, Homo sapiens
cuauuaacaacccaua

SEQ ID NO: 1571007 - RNA, 14 nt, Homo sapiens
cuauuaacucugca

SEQ ID NO: 1571008 - RNA, 16 nt, Homo sapiens
cuauuaauacucugca

SEQ ID NO: 1571009 - RNA, 15 nt, Homo sapiens
cuauuagauuuuaga

SEQ ID NO: 1571010 - RNA, 13 nt, Homo sapiens
cuauuauauucau

SEQ ID NO: 1571011 - RNA, 16 nt, Homo sapiens
cuauucauggcuaccu

SEQ ID NO: 1571012 - RNA, 18 nt, Homo sapiens
cuauucauggcuaccuca

SEQ ID NO: 1571013 - RNA, 19 nt, Homo sapiens
cuauucauggcuaccucag

SEQ ID NO: 1571014 - RNA, 20 nt, Homo sapiens
cuauucccucucucucccag

SEQ ID NO: 1571015 - RNA, 14 nt, Homo sapiens
cuauugcuaguacu

SEQ ID NO: 1571016 - RNA, 18 nt, Homo sapiens
cuauugcuaguacuagua

SEQ ID NO: 1571017 - RNA, 12 nt, Homo sapiens
cuauuggucucc

SEQ ID NO: 1571018 - RNA, 15 nt, Homo sapiens
cuauugucuguaaua

SEQ ID NO: 1571019 - RNA, 15 nt, Homo sapiens
cuauuguuacauuau

SEQ ID NO: 1571020 - RNA, 21 nt, Homo sapiens
cuauuguuacauuauguggaa

SEQ ID NO: 1571021 - RNA, 21 nt, Homo sapiens
cuauuuaaaggaaaaucacau

SEQ ID NO: 1571022 - RNA, 19 nt, Homo sapiens
cuauuuauauguacaugag

SEQ ID NO: 1571023 - RNA, 18 nt, Homo sapiens
cuauuucagcugcuuuga

SEQ ID NO: 1571024 - RNA, 18 nt, Homo sapiens
cuauuuccucugugcaaa

SEQ ID NO: 1571025 - RNA, 18 nt, Homo sapiens
cuauuucuucuacugcua

SEQ ID NO: 1571026 - RNA, 15 nt, Homo sapiens
cuauuugaacaagug

SEQ ID NO: 1571027 - RNA, 18 nt, Homo sapiens
cuauuugcuuuaaugaga

SEQ ID NO: 1571028 - RNA, 19 nt, Homo sapiens
cuauuuuaagacgugaaug

SEQ ID NO: 1571029 - RNA, 19 nt, Homo sapiens
cuauuuuacuuuucugcca

SEQ ID NO: 1571030 - RNA, 18 nt, Homo sapiens
cucaaaacuucagacaua

SEQ ID NO: 1571031 - RNA, 22 nt, Homo sapiens
cucaaaauaccaugccauuuaa

SEQ ID NO: 1571032 - RNA, 20 nt, Homo sapiens
ccuuucccagguaauuuaaa

SEQ ID NO: 1571033 - RNA, 23 nt, Homo sapiens
ccuuucccuuuagcacguuuaaa

SEQ ID NO: 1571034 - RNA, 13 nt, Homo sapiens
ccuuuccuuccag

SEQ ID NO: 1571035 - RNA, 17 nt, Homo sapiens
ccuuugauguggaugaa

SEQ ID NO: 1571036 - RNA, 22 nt, Homo sapiens
ccuuuggacuugucccgggaca

SEQ ID NO: 1571037 - RNA, 21 nt, Homo sapiens
ccuuuguaaccacaacuuuca

SEQ ID NO: 1571038 - RNA, 16 nt, Homo sapiens
ccuuugugcacauuua

SEQ ID NO: 1571039 - RNA, 17 nt, Homo sapiens
ccuuuuauaauacuuuu

SEQ ID NO: 1571040 - RNA, 21 nt, Homo sapiens
ccuuuucaaaaccuaaaaaca

SEQ ID NO: 1571041 - RNA, 17 nt, Homo sapiens
ccuuuuccuauccuuau

SEQ ID NO: 1571042 - RNA, 16 nt, Homo sapiens
auugacuucauuuuau

SEQ ID NO: 1571043 - RNA, 19 nt, Homo sapiens
auugagaaagaaacuaaua

SEQ ID NO: 1571044 - RNA, 15 nt, Homo sapiens
auugagaagccaugu

SEQ ID NO: 1571045 - RNA, 14 nt, Homo sapiens
auugagaccugagu

SEQ ID NO: 1571046 - RNA, 15 nt, Homo sapiens
auugagcucucucau

SEQ ID NO: 1571047 - RNA, 24 nt, Homo sapiens
auugaggcuaaccuccaacacagu

SEQ ID NO: 1571048 - RNA, 16 nt, Homo sapiens
auugaguuuaacaaua

SEQ ID NO: 1571049 - RNA, 16 nt, Homo sapiens
auugaguuuucagugg

SEQ ID NO: 1571050 - RNA, 20 nt, Homo sapiens
auugauauugaaugauguga

SEQ ID NO: 1571051 - RNA, 16 nt, Homo sapiens
auugaucaccaugaaa

SEQ ID NO: 1571052 - RNA, 19 nt, Homo sapiens
auugauccagucauuuuau

SEQ ID NO: 1571053 - RNA, 20 nt, Homo sapiens
auugaucuguuuuacaggaa

SEQ ID NO: 1571054 - RNA, 16 nt, Homo sapiens
auugauuucugacucu

SEQ ID NO: 1571055 - RNA, 13 nt, Homo sapiens
auugcacucauca

SEQ ID NO: 1571056 - RNA, 12 nt, Homo sapiens
auugcacugcug

SEQ ID NO: 1571057 - RNA, 23 nt, Homo sapiens
auugcauuuaaaaauauauagcu

SEQ ID NO: 1571058 - RNA, 12 nt, Homo sapiens
auugccaagugc

SEQ ID NO: 1571059 - RNA, 24 nt, Homo sapiens
auugccaagugccauaaccaugag

SEQ ID NO: 1571060 - RNA, 20 nt, Homo sapiens
auugccaccaggagaaccac

SEQ ID NO: 1571061 - RNA, 16 nt, Homo sapiens
auugccuccauucucc

SEQ ID NO: 1571062 - RNA, 20 nt, Homo sapiens
auugcgccauugcacuccag

SEQ ID NO: 1571063 - RNA, 18 nt, Homo sapiens
auugcuaaaagcauguau

SEQ ID NO: 1571064 - RNA, 21 nt, Homo sapiens
auugcuaagacuaacucaaga

SEQ ID NO: 1571065 - RNA, 13 nt, Homo sapiens
auugcuacuauaa

SEQ ID NO: 1571066 - RNA, 19 nt, Homo sapiens
auugcuagguuuugcuaca

SEQ ID NO: 1571067 - RNA, 21 nt, Homo sapiens
auugcuguccuggaggggcug

SEQ ID NO: 1571068 - RNA, 13 nt, Homo sapiens
auugcuuugccaa

SEQ ID NO: 1571069 - RNA, 13 nt, Homo sapiens
auuggaaauggau

SEQ ID NO: 1571070 - RNA, 16 nt, Homo sapiens
auuggaauuacuguaa

SEQ ID NO: 1571071 - RNA, 23 nt, Homo sapiens
auuggagucacugccaagucaua

SEQ ID NO: 1571072 - RNA, 22 nt, Homo sapiens
auuggcaucucuccccauauau

SEQ ID NO: 1571073 - RNA, 17 nt, Homo sapiens
auuggccacacacugag

SEQ ID NO: 1571074 - RNA, 15 nt, Homo sapiens
auuggcccaacaaga

SEQ ID NO: 1571075 - RNA, 13 nt, Homo sapiens
auuggcucagccc

SEQ ID NO: 1571076 - RNA, 17 nt, Homo sapiens
auuggcuugaauuccau

SEQ ID NO: 1571077 - RNA, 18 nt, Homo sapiens
auuggcuugauaaacaua

SEQ ID NO: 1571078 - RNA, 22 nt, Homo sapiens
auugggcacagccuagggucuu

SEQ ID NO: 1571079 - RNA, 22 nt, Homo sapiens
auugguccagcuugcucuucag

SEQ ID NO: 1571080 - RNA, 16 nt, Homo sapiens
auugguggcaucacag

SEQ ID NO: 1571081 - RNA, 16 nt, Homo sapiens
auugguugcauccagg

SEQ ID NO: 1571082 - RNA, 11 nt, Homo sapiens
auuguaaaaug

SEQ ID NO: 1571083 - RNA, 16 nt, Homo sapiens
auuguaaaaugcaccc

SEQ ID NO: 1571084 - RNA, 14 nt, Homo sapiens
auugucaccaugau

SEQ ID NO: 1571085 - RNA, 22 nt, Homo sapiens
auuguccaccaugcucucucac

SEQ ID NO: 1571086 - RNA, 17 nt, Homo sapiens
auugucgguuaccucug

SEQ ID NO: 1571087 - RNA, 20 nt, Homo sapiens
auugucgguuaccucugcau

SEQ ID NO: 1571088 - RNA, 17 nt, Homo sapiens
auugucugccauuacac

SEQ ID NO: 1571089 - RNA, 12 nt, Homo sapiens
auugugaauauu

SEQ ID NO: 1571090 - RNA, 15 nt, Homo sapiens
auugugcaguacuuu

SEQ ID NO: 1571091 - RNA, 17 nt, Homo sapiens
auugugcuuucaccaga

SEQ ID NO: 1571092 - RNA, 23 nt, Homo sapiens
auugugguuuauugaaugugauu

SEQ ID NO: 1571093 - RNA, 12 nt, Homo sapiens
auuguguuuauu

SEQ ID NO: 1571094 - RNA, 17 nt, Homo sapiens
auuguuaauucuuccua

SEQ ID NO: 1571095 - RNA, 13 nt, Homo sapiens
auuguuagcacua

SEQ ID NO: 1571096 - RNA, 20 nt, Homo sapiens
auuguuaggaaaugucauca

SEQ ID NO: 1571097 - RNA, 20 nt, Homo sapiens
auuguuaggagaugucauca

SEQ ID NO: 1571098 - RNA, 24 nt, Homo sapiens
auuguuaggagaugucaucaagcu

SEQ ID NO: 1571099 - RNA, 20 nt, Homo sapiens
auuguucacuucuaaaccaa

SEQ ID NO: 1571100 - RNA, 17 nt, Homo sapiens
auuguugucaggccaua

SEQ ID NO: 1571101 - RNA, 22 nt, Homo sapiens
auuguuuauguguuaugaacau

SEQ ID NO: 1571102 - RNA, 19 nt, Homo sapiens
auuguuuggaccugcauau

SEQ ID NO: 1571103 - RNA, 13 nt, Homo sapiens
auuguuuuuggau

SEQ ID NO: 1571104 - RNA, 20 nt, Homo sapiens
auuuaaaaaaacgagcaauu

SEQ ID NO: 1571105 - RNA, 15 nt, Homo sapiens
auuuaaaauucaauu

SEQ ID NO: 1571106 - RNA, 21 nt, Homo sapiens
auuuaaagacaaagacauuau

SEQ ID NO: 1571107 - RNA, 13 nt, Homo sapiens
auuuaaagcauca

SEQ ID NO: 1571108 - RNA, 23 nt, Homo sapiens
auuuaaauguguacaauguacac

SEQ ID NO: 1571109 - RNA, 13 nt, Homo sapiens
auuuaaauuccac

SEQ ID NO: 1571110 - RNA, 14 nt, Homo sapiens
auuuaaauuccaca

SEQ ID NO: 1571111 - RNA, 17 nt, Homo sapiens
auuuaaauuccacagau

SEQ ID NO: 1571112 - RNA, 20 nt, Homo sapiens
auuuaaauuuuuuuccuuac

SEQ ID NO: 1571113 - RNA, 15 nt, Homo sapiens
auuuaacauuaucua

SEQ ID NO: 1571114 - RNA, 22 nt, Homo sapiens
auuuaacucuuugaaacuguau

SEQ ID NO: 1571115 - RNA, 12 nt, Homo sapiens
auuuaagugaau

SEQ ID NO: 1571116 - RNA, 16 nt, Homo sapiens
auuuaauugcuuugaa

SEQ ID NO: 1571117 - RNA, 21 nt, Homo sapiens
auuuacagcucuguaaccucc

SEQ ID NO: 1571118 - RNA, 19 nt, Homo sapiens
auuuacaugugauugugau

SEQ ID NO: 1571119 - RNA, 15 nt, Homo sapiens
auuuacauguuuaua

SEQ ID NO: 1571120 - RNA, 12 nt, Homo sapiens
auuuacauuaau

SEQ ID NO: 1571121 - RNA, 22 nt, Homo sapiens
auuuacuaaaucaaucugcagu

SEQ ID NO: 1571122 - RNA, 22 nt, Homo sapiens
auuuacugcucuagaaaguaua

SEQ ID NO: 1571123 - RNA, 19 nt, Homo sapiens
auuuagaagccaacuauga

SEQ ID NO: 1571124 - RNA, 23 nt, Homo sapiens
auuuagaagccaacuaugauuau

SEQ ID NO: 1571125 - RNA, 15 nt, Homo sapiens
auuuagcaaacuguu

SEQ ID NO: 1571126 - RNA, 18 nt, Homo sapiens
auuuagccagcguuuauu

SEQ ID NO: 1571127 - RNA, 22 nt, Homo sapiens
auuuaggaaaugggcagugaag

SEQ ID NO: 1571128 - RNA, 17 nt, Homo sapiens
auuuaggguacuauuca

SEQ ID NO: 1571129 - RNA, 12 nt, Homo sapiens
auuuaguugaua

SEQ ID NO: 1571130 - RNA, 14 nt, Homo sapiens
auuuauaagcauuu

SEQ ID NO: 1571131 - RNA, 17 nt, Homo sapiens
auuuauauaagucuguu

SEQ ID NO: 1571132 - RNA, 23 nt, Homo sapiens
auuuauauguaaacaagcaauaa

SEQ ID NO: 1571133 - RNA, 17 nt, Homo sapiens
auuuaucuuuaccaaaa

SEQ ID NO: 1571134 - RNA, 15 nt, Homo sapiens
auuuaugaugcacuu

SEQ ID NO: 1571135 - RNA, 16 nt, Homo sapiens
auuuaugaugcacuua

SEQ ID NO: 1571136 - RNA, 15 nt, Homo sapiens
auuuauuuacacucu

SEQ ID NO: 1571137 - RNA, 14 nt, Homo sapiens
auuuauuucuagca

SEQ ID NO: 1571138 - RNA, 20 nt, Homo sapiens
auuuauuugguucccuuccu

SEQ ID NO: 1571139 - RNA, 18 nt, Homo sapiens
auuucaaaccauugcucu

SEQ ID NO: 1571140 - RNA, 17 nt, Homo sapiens
auuucaacuacagugau

SEQ ID NO: 1571141 - RNA, 14 nt, Homo sapiens
auuucaauuccugu

SEQ ID NO: 1571142 - RNA, 17 nt, Homo sapiens
auuucacauuucuacuc

SEQ ID NO: 1571143 - RNA, 22 nt, Homo sapiens
auuucacuaaaagucuccaaaa

SEQ ID NO: 1571144 - RNA, 18 nt, Homo sapiens
auuucacucucaaacuuc

SEQ ID NO: 1571145 - RNA, 19 nt, Homo sapiens
auuucacucucaaacuuca

SEQ ID NO: 1571146 - RNA, 14 nt, Homo sapiens
auuucacugugaug

SEQ ID NO: 1571147 - RNA, 22 nt, Homo sapiens
auuucagggucuuggcugccug

SEQ ID NO: 1571148 - RNA, 23 nt, Homo sapiens
auuucaguuucuaucaaccuuca

SEQ ID NO: 1571149 - RNA, 22 nt, Homo sapiens
auuucauacaacagaaaccaga

SEQ ID NO: 1571150 - RNA, 21 nt, Homo sapiens
auuucauacccaugucagauu

SEQ ID NO: 1571151 - RNA, 13 nt, Homo sapiens
auuucauacugua

SEQ ID NO: 1571152 - RNA, 23 nt, Homo sapiens
auuucauauuauuuuagugugua

SEQ ID NO: 1571153 - RNA, 14 nt, Homo sapiens
auuucaugugaauc

SEQ ID NO: 1571154 - RNA, 19 nt, Homo sapiens
auuucaugugaaucccuuu

SEQ ID NO: 1571155 - RNA, 18 nt, Homo sapiens
auuucauuucaaggcagu

SEQ ID NO: 1571156 - RNA, 13 nt, Homo sapiens
auuuccacaaaau

SEQ ID NO: 1571157 - RNA, 21 nt, Homo sapiens
auuuccacaaaaucuguccaa

SEQ ID NO: 1571158 - RNA, 21 nt, Homo sapiens
auuuuuuuuuuuaagcucaaa

SEQ ID NO: 1571159 - RNA, 23 nt, Homo sapiens
auuuuuuuuuuuuaaauuaugca

SEQ ID NO: 1571160 - RNA, 23 nt, Homo sapiens
caaaaaaaaaaaaaaauuacaaa

SEQ ID NO: 1571161 - RNA, 14 nt, Homo sapiens
caguguacagucuu

SEQ ID NO: 1571162 - RNA, 17 nt, Homo sapiens
caguuacaguugauguu

SEQ ID NO: 1571163 - RNA, 15 nt, Homo sapiens
caguuaucacacuuu

SEQ ID NO: 1571164 - RNA, 23 nt, Homo sapiens
caguuauuaaucuggacauucga

SEQ ID NO: 1571165 - RNA, 20 nt, Homo sapiens
caguucaacauaaagagcaa

SEQ ID NO: 1571166 - RNA, 15 nt, Homo sapiens
caguucacaugccac

SEQ ID NO: 1571167 - RNA, 14 nt, Homo sapiens
caguucauuguggg

SEQ ID NO: 1571168 - RNA, 16 nt, Homo sapiens
caguuccuagcacugc

SEQ ID NO: 1571169 - RNA, 15 nt, Homo sapiens
caguuccucccagga

SEQ ID NO: 1571170 - RNA, 19 nt, Homo sapiens
caguuccucccccaguucc

SEQ ID NO: 1571171 - RNA, 15 nt, Homo sapiens
caguucuacugaccu

SEQ ID NO: 1571172 - RNA, 22 nt, Homo sapiens
caguugauuccuugaguuucau

SEQ ID NO: 1571173 - RNA, 16 nt, Homo sapiens
caguugcccucaggcc

SEQ ID NO: 1571174 - RNA, 23 nt, Homo sapiens
caguugguuuggauuuuuggacc

SEQ ID NO: 1571175 - RNA, 13 nt, Homo sapiens
caguuucuaucaa

SEQ ID NO: 1571176 - RNA, 21 nt, Homo sapiens
caguuugaagcccaaucugca

SEQ ID NO: 1571177 - RNA, 15 nt, Homo sapiens
cauaaagacuaagua

SEQ ID NO: 1571178 - RNA, 18 nt, Homo sapiens
cauaaagugaauguuuac

SEQ ID NO: 1571179 - RNA, 16 nt, Homo sapiens
cauaaauugguauaau

SEQ ID NO: 1571180 - RNA, 18 nt, Homo sapiens
cauaaauuuuaauucaag

SEQ ID NO: 1571181 - RNA, 14 nt, Homo sapiens
cauaagaaagcacu

SEQ ID NO: 1571182 - RNA, 20 nt, Homo sapiens
cauaagagcuuaagaaccau

SEQ ID NO: 1571183 - RNA, 15 nt, Homo sapiens
cauaagccacuuccc

SEQ ID NO: 1571184 - RNA, 16 nt, Homo sapiens
cauaaguauuaugucu

SEQ ID NO: 1571185 - RNA, 18 nt, Homo sapiens
cauaaguuccuauaccuu

SEQ ID NO: 1571186 - RNA, 20 nt, Homo sapiens
cauaauagcuacagugcaua

SEQ ID NO: 1571187 - RNA, 18 nt, Homo sapiens
cauaaucccagcacuuug

SEQ ID NO: 1571188 - RNA, 17 nt, Homo sapiens
cauaauuacucuacuuc

SEQ ID NO: 1571189 - RNA, 24 nt, Homo sapiens
cauaauuaugaaaacucaugauca

SEQ ID NO: 1571190 - RNA, 14 nt, Homo sapiens
cauaauucagcacu

SEQ ID NO: 1571191 - RNA, 15 nt, Homo sapiens
cauaauucagcacuu

SEQ ID NO: 1571192 - RNA, 19 nt, Homo sapiens
cauaauucuugcuaugaaa

SEQ ID NO: 1571193 - RNA, 17 nt, Homo sapiens
cauaauugcuuugccaa

SEQ ID NO: 1571194 - RNA, 23 nt, Homo sapiens
cauaauuuaaaaaucuccauuaa

SEQ ID NO: 1571195 - RNA, 17 nt, Homo sapiens
cauaauuuaaaagcaca

SEQ ID NO: 1571196 - RNA, 16 nt, Homo sapiens
cauacaacagaaacca

SEQ ID NO: 1571197 - RNA, 19 nt, Homo sapiens
cauacaauguauguacaau

SEQ ID NO: 1571198 - RNA, 17 nt, Homo sapiens
cauacacacacacaaaa

SEQ ID NO: 1571199 - RNA, 17 nt, Homo sapiens
cauacaccagaagacaa

SEQ ID NO: 1571200 - RNA, 15 nt, Homo sapiens
cauacagaaggcaac

SEQ ID NO: 1571201 - RNA, 15 nt, Homo sapiens
cauacauauuaucuc

SEQ ID NO: 1571202 - RNA, 18 nt, Homo sapiens
cauacauauugcuguauu

SEQ ID NO: 1571203 - RNA, 21 nt, Homo sapiens
cauaccaagacccccgucucu

SEQ ID NO: 1571204 - RNA, 14 nt, Homo sapiens
cauacgucagcauu

SEQ ID NO: 1571205 - RNA, 15 nt, Homo sapiens
cauacuuaacauuuc

SEQ ID NO: 1571206 - RNA, 15 nt, Homo sapiens
cauacuuaucucucu

SEQ ID NO: 1571207 - RNA, 21 nt, Homo sapiens
cauacuuaucucucugugcug

SEQ ID NO: 1571208 - RNA, 14 nt, Homo sapiens
cauagaacauugau

SEQ ID NO: 1571209 - RNA, 17 nt, Homo sapiens
cauagaagaaaauccau

SEQ ID NO: 1571210 - RNA, 22 nt, Homo sapiens
cauagaaggaaguguguuugcc

SEQ ID NO: 1571211 - RNA, 14 nt, Homo sapiens
cauagaauacacau

SEQ ID NO: 1571212 - RNA, 16 nt, Homo sapiens
cauagacaauuccucc

SEQ ID NO: 1571213 - RNA, 15 nt, Homo sapiens
cauagauauaucuuu

SEQ ID NO: 1571214 - RNA, 13 nt, Homo sapiens
cauagcacccgug

SEQ ID NO: 1571215 - RNA, 20 nt, Homo sapiens
cauagcccucagacauuuau

SEQ ID NO: 1571216 - RNA, 17 nt, Homo sapiens
cauaggaaaaugccaug

SEQ ID NO: 1571217 - RNA, 23 nt, Homo sapiens
cauagucuuuggagaaaugcuua

SEQ ID NO: 1571218 - RNA, 14 nt, Homo sapiens
cauauaaccaaaau

SEQ ID NO: 1571219 - RNA, 22 nt, Homo sapiens
cauauauaaauuauuacuuuaa

SEQ ID NO: 1571220 - RNA, 13 nt, Homo sapiens
cauauaugaauuu

SEQ ID NO: 1571221 - RNA, 14 nt, Homo sapiens
cauauaugcaauau

SEQ ID NO: 1571222 - RNA, 19 nt, Homo sapiens
cauauauuuuuaccaucug

SEQ ID NO: 1571223 - RNA, 13 nt, Homo sapiens
cauaucacucaau

SEQ ID NO: 1571224 - RNA, 12 nt, Homo sapiens
cauauccaaaau

SEQ ID NO: 1571225 - RNA, 16 nt, Homo sapiens
cauaucccuuccucuc

SEQ ID NO: 1571226 - RNA, 16 nt, Homo sapiens
cauaugaaaggugcca

SEQ ID NO: 1571227 - RNA, 18 nt, Homo sapiens
cauaugagaauauaccuu

SEQ ID NO: 1571228 - RNA, 20 nt, Homo sapiens
cauaugaucugucuguggca

SEQ ID NO: 1571229 - RNA, 19 nt, Homo sapiens
cauauggauugccaaguca

SEQ ID NO: 1571230 - RNA, 13 nt, Homo sapiens
cauauguagcuaa

SEQ ID NO: 1571231 - RNA, 11 nt, Homo sapiens
cauaugucacg

SEQ ID NO: 1571232 - RNA, 17 nt, Homo sapiens
cauaugucagggcacau

SEQ ID NO: 1571233 - RNA, 19 nt, Homo sapiens
cauauguuuuccacauaaa

SEQ ID NO: 1571234 - RNA, 15 nt, Homo sapiens
cauauuagugcagcc

SEQ ID NO: 1571235 - RNA, 22 nt, Homo sapiens
cauauuauuuuaguguguaaaa

SEQ ID NO: 1571236 - RNA, 23 nt, Homo sapiens
cauauucccugcacacacaugca

SEQ ID NO: 1571237 - RNA, 22 nt, Homo sapiens
cauauugucaccucagcacugu

SEQ ID NO: 1571238 - RNA, 17 nt, Homo sapiens
cauauugugauucugcc

SEQ ID NO: 1571239 - RNA, 16 nt, Homo sapiens
cauauuuauuuuuacc

SEQ ID NO: 1571240 - RNA, 21 nt, Homo sapiens
cauauuuauuuuuauguucuu

SEQ ID NO: 1571241 - RNA, 21 nt, Homo sapiens
caucaaaaucugcacagucac

SEQ ID NO: 1571242 - RNA, 17 nt, Homo sapiens
caucaacauuccaggga

SEQ ID NO: 1571243 - RNA, 15 nt, Homo sapiens
caucaagacuaucua

SEQ ID NO: 1571244 - RNA, 12 nt, Homo sapiens
caucacauaaag

SEQ ID NO: 1571245 - RNA, 12 nt, Homo sapiens
caucacuuugac

SEQ ID NO: 1571246 - RNA, 14 nt, Homo sapiens
caucagaaaacagg

SEQ ID NO: 1571247 - RNA, 21 nt, Homo sapiens
caucagacccaacccaugaag

SEQ ID NO: 1571248 - RNA, 12 nt, Homo sapiens
caucagcaaaca

SEQ ID NO: 1571249 - RNA, 13 nt, Homo sapiens
caucagcacucug

SEQ ID NO: 1571250 - RNA, 21 nt, Homo sapiens
caucagccuucaagaaucaga

SEQ ID NO: 1571251 - RNA, 15 nt, Homo sapiens
caucaggaaacagga

SEQ ID NO: 1571252 - RNA, 23 nt, Homo sapiens
caucagguuuuguuuuuuuucag

SEQ ID NO: 1571253 - RNA, 18 nt, Homo sapiens
caucaguagcaucuguaa

SEQ ID NO: 1571254 - RNA, 15 nt, Homo sapiens
caucagucaacaacu

SEQ ID NO: 1571255 - RNA, 16 nt, Homo sapiens
caucagucaacaacuu

SEQ ID NO: 1571256 - RNA, 17 nt, Homo sapiens
caucagugcucccucac

SEQ ID NO: 1571257 - RNA, 18 nt, Homo sapiens
caucauagcaagaccuca

SEQ ID NO: 1571258 - RNA, 14 nt, Homo sapiens
caucaucacuguaa

SEQ ID NO: 1571259 - RNA, 20 nt, Homo sapiens
caucaucuguucgauugaaa

SEQ ID NO: 1571260 - RNA, 22 nt, Homo sapiens
caucaugcggugggugcugcca

SEQ ID NO: 1571261 - RNA, 12 nt, Homo sapiens
caucauguugaa

SEQ ID NO: 1571262 - RNA, 23 nt, Homo sapiens
caucauuaauaccuaaacuguau

SEQ ID NO: 1571263 - RNA, 15 nt, Homo sapiens
caucauuacugccau

SEQ ID NO: 1571264 - RNA, 17 nt, Homo sapiens
cauccaauggacugcau

SEQ ID NO: 1571265 - RNA, 17 nt, Homo sapiens
cauccauagcaccucca

SEQ ID NO: 1571266 - RNA, 16 nt, Homo sapiens
cauccaucaucaugug

SEQ ID NO: 1571267 - RNA, 15 nt, Homo sapiens
cauccauccaaaggc

SEQ ID NO: 1571268 - RNA, 11 nt, Homo sapiens
cauccaugaaa

SEQ ID NO: 1571269 - RNA, 19 nt, Homo sapiens
caucccagcccacaucuca

SEQ ID NO: 1571270 - RNA, 18 nt, Homo sapiens
cauccccaccacugauau

SEQ ID NO: 1571271 - RNA, 15 nt, Homo sapiens
cauccccagggccau

SEQ ID NO: 1571272 - RNA, 18 nt, Homo sapiens
caucccguaucacagugu

SEQ ID NO: 1571273 - RNA, 20 nt, Homo sapiens
cauccgucccacaucagggc

SEQ ID NO: 1571274 - RNA, 18 nt, Homo sapiens
cauccuaccccuuugcac

SEQ ID NO: 1571275 - RNA, 20 nt, Homo sapiens
ccuggacuccggaggacuga

SEQ ID NO: 1571276 - RNA, 23 nt, Homo sapiens
ccuggacuguuucaagguccaug

SEQ ID NO: 1571277 - RNA, 23 nt, Homo sapiens
ccuggagaugcagcuacuggaau

SEQ ID NO: 1571278 - RNA, 21 nt, Homo sapiens
ccuggaggacagagggagaca

SEQ ID NO: 1571279 - RNA, 22 nt, Homo sapiens
ccuggaggacagagggagacag

SEQ ID NO: 1571280 - RNA, 17 nt, Homo sapiens
ccuggaucuaccagcau

SEQ ID NO: 1571281 - RNA, 21 nt, Homo sapiens
ccuggcaaaugccugacucag

SEQ ID NO: 1571282 - RNA, 17 nt, Homo sapiens
ccuggcagcacaggaaa

SEQ ID NO: 1571283 - RNA, 21 nt, Homo sapiens
ccuggcccagggcaucuggga

SEQ ID NO: 1571284 - RNA, 22 nt, Homo sapiens
ccugggacaguuuaucaugaag

SEQ ID NO: 1571285 - RNA, 14 nt, Homo sapiens
cagaacuaacuuug

SEQ ID NO: 1571286 - RNA, 21 nt, Homo sapiens
cagaacuuaaucuggacacac

SEQ ID NO: 1571287 - RNA, 16 nt, Homo sapiens
cagaacuuucuuucac

SEQ ID NO: 1571288 - RNA, 17 nt, Homo sapiens
cagaagaaaauucuccu

SEQ ID NO: 1571289 - RNA, 21 nt, Homo sapiens
cagaagagauggauauugaaa

SEQ ID NO: 1571290 - RNA, 15 nt, Homo sapiens
cagaagcaagccaga

SEQ ID NO: 1571291 - RNA, 19 nt, Homo sapiens
cagaagcagcagaccuccu

SEQ ID NO: 1571292 - RNA, 12 nt, Homo sapiens
cagaagcccuga

SEQ ID NO: 1571293 - RNA, 16 nt, Homo sapiens
cagaagccuuugauau

SEQ ID NO: 1571294 - RNA, 18 nt, Homo sapiens
cagaagggcuacuuucca

SEQ ID NO: 1571295 - RNA, 21 nt, Homo sapiens
cagaagggcuacuuuccacau

SEQ ID NO: 1571296 - RNA, 12 nt, Homo sapiens
cagaagugugac

SEQ ID NO: 1571297 - RNA, 13 nt, Homo sapiens
cagaagugugacu

SEQ ID NO: 1571298 - RNA, 16 nt, Homo sapiens
cagaaguuaguuugua

SEQ ID NO: 1571299 - RNA, 19 nt, Homo sapiens
cagaaguugugcuaaacca

SEQ ID NO: 1571300 - RNA, 22 nt, Homo sapiens
cagaauacgggucccucuaacc

SEQ ID NO: 1571301 - RNA, 21 nt, Homo sapiens
cagaauaguuuacacacugug

SEQ ID NO: 1571302 - RNA, 20 nt, Homo sapiens
cagaauauuaaauauuauaa

SEQ ID NO: 1571303 - RNA, 14 nt, Homo sapiens
cagaauccacaacu

SEQ ID NO: 1571304 - RNA, 15 nt, Homo sapiens
cagaaucccuuaaca

SEQ ID NO: 1571305 - RNA, 13 nt, Homo sapiens
cagaauccugaug

SEQ ID NO: 1571306 - RNA, 16 nt, Homo sapiens
cagaaucugaauguaa

SEQ ID NO: 1571307 - RNA, 22 nt, Homo sapiens
cagaaugaaucuaugcuggaua

SEQ ID NO: 1571308 - RNA, 22 nt, Homo sapiens
cagaaugcggccucugagacau

SEQ ID NO: 1571309 - RNA, 15 nt, Homo sapiens
cagaauguaaagguu

SEQ ID NO: 1571310 - RNA, 13 nt, Homo sapiens
cagaauucuucag

SEQ ID NO: 1571311 - RNA, 18 nt, Homo sapiens
cagaauuuaagcaagaaa

SEQ ID NO: 1571312 - RNA, 17 nt, Homo sapiens
cagaauuugcucgcuac

SEQ ID NO: 1571313 - RNA, 15 nt, Homo sapiens
cagacaaauuacuga

SEQ ID NO: 1571314 - RNA, 20 nt, Homo sapiens
cagacaagcgccgcugugag

SEQ ID NO: 1571315 - RNA, 14 nt, Homo sapiens
cagacaauaaaccc

SEQ ID NO: 1571316 - RNA, 17 nt, Homo sapiens
cagacaauaaacccuca

SEQ ID NO: 1571317 - RNA, 18 nt, Homo sapiens
cagacaauaaacccucag

SEQ ID NO: 1571318 - RNA, 15 nt, Homo sapiens
cagacacaacccaau

SEQ ID NO: 1571319 - RNA, 15 nt, Homo sapiens
cagacacacccagug

SEQ ID NO: 1571320 - RNA, 17 nt, Homo sapiens
cagacacaggucccuga

SEQ ID NO: 1571321 - RNA, 18 nt, Homo sapiens
cagacacaggucccugag

SEQ ID NO: 1571322 - RNA, 14 nt, Homo sapiens
cagacacaggugua

SEQ ID NO: 1571323 - RNA, 13 nt, Homo sapiens
cagacaccagccu

SEQ ID NO: 1571324 - RNA, 23 nt, Homo sapiens
cagacaccauucauuccaugucc

SEQ ID NO: 1571325 - RNA, 19 nt, Homo sapiens
cagacaccuaaccccaggg

SEQ ID NO: 1571326 - RNA, 20 nt, Homo sapiens
cagacaccuccuucuuccua

SEQ ID NO: 1571327 - RNA, 21 nt, Homo sapiens
cagacaccuccuucuuccuag

SEQ ID NO: 1571328 - RNA, 16 nt, Homo sapiens
cagacaccuggacuga

SEQ ID NO: 1571329 - RNA, 19 nt, Homo sapiens
cagacaccuggacugagcc

SEQ ID NO: 1571330 - RNA, 20 nt, Homo sapiens
cagacacuggcauggauaua

SEQ ID NO: 1571331 - RNA, 22 nt, Homo sapiens
cagaccaaggcgaguuucccca

SEQ ID NO: 1571332 - RNA, 14 nt, Homo sapiens
cagaccacuugcca

SEQ ID NO: 1571333 - RNA, 12 nt, Homo sapiens
cagacccagugg

SEQ ID NO: 1571334 - RNA, 18 nt, Homo sapiens
cagaccugcauugaacag

SEQ ID NO: 1571335 - RNA, 15 nt, Homo sapiens
cagacgauuguucuu

SEQ ID NO: 1571336 - RNA, 21 nt, Homo sapiens
cagacggaugcccauuccugc

SEQ ID NO: 1571337 - RNA, 13 nt, Homo sapiens
cagacgugugacc

SEQ ID NO: 1571338 - RNA, 15 nt, Homo sapiens
cagacucaguagcca

SEQ ID NO: 1571339 - RNA, 14 nt, Homo sapiens
cagacucgggacca

SEQ ID NO: 1571340 - RNA, 15 nt, Homo sapiens
cagacucgggaccaa

SEQ ID NO: 1571341 - RNA, 16 nt, Homo sapiens
cagacugucaagaaga

SEQ ID NO: 1571342 - RNA, 15 nt, Homo sapiens
cagacuguccaggga

SEQ ID NO: 1571343 - RNA, 17 nt, Homo sapiens
cagacuucacacugcaa

SEQ ID NO: 1571344 - RNA, 16 nt, Homo sapiens
cagacuucccacggcu

SEQ ID NO: 1571345 - RNA, 19 nt, Homo sapiens
cagacuuucuuuuucuaca

SEQ ID NO: 1571346 - RNA, 17 nt, Homo sapiens
cagagaaaaaugcuccc

SEQ ID NO: 1571347 - RNA, 21 nt, Homo sapiens
cagagaagguaaggugugaac

SEQ ID NO: 1571348 - RNA, 15 nt, Homo sapiens
cagagacacugagcc

SEQ ID NO: 1571349 - RNA, 19 nt, Homo sapiens
cagagaccacaccacuaac

SEQ ID NO: 1571350 - RNA, 15 nt, Homo sapiens
cagagagaaagaaga

SEQ ID NO: 1571351 - RNA, 19 nt, Homo sapiens
cagagagaccucauccugc

SEQ ID NO: 1571352 - RNA, 19 nt, Homo sapiens
cagagaggcacucagugag

SEQ ID NO: 1571353 - RNA, 16 nt, Homo sapiens
cagagauaaaccaaua

SEQ ID NO: 1571354 - RNA, 14 nt, Homo sapiens
cagagauacacaga

SEQ ID NO: 1571355 - RNA, 18 nt, Homo sapiens
cagagaucucccuucuca

SEQ ID NO: 1571356 - RNA, 20 nt, Homo sapiens
cagagaugcaaugauaguua

SEQ ID NO: 1571357 - RNA, 22 nt, Homo sapiens
cagagaugugcacccaugggcu

SEQ ID NO: 1571358 - RNA, 17 nt, Homo sapiens
cagagcacccccugcuc

SEQ ID NO: 1571359 - RNA, 12 nt, Homo sapiens
cagagcacuccc

SEQ ID NO: 1571360 - RNA, 14 nt, Homo sapiens
cagagccucuggcc

SEQ ID NO: 1571361 - RNA, 15 nt, Homo sapiens
cagagccuuguucua

SEQ ID NO: 1571362 - RNA, 20 nt, Homo sapiens
cagagcggguaaagugcaau

SEQ ID NO: 1571363 - RNA, 13 nt, Homo sapiens
cagaggacaguau

SEQ ID NO: 1571364 - RNA, 21 nt, Homo sapiens
cagaggagccaccaguucuca

SEQ ID NO: 1571365 - RNA, 14 nt, Homo sapiens
cagaggagugcagc

SEQ ID NO: 1571366 - RNA, 20 nt, Homo sapiens
cagaggaugcaacaaaugug

SEQ ID NO: 1571367 - RNA, 22 nt, Homo sapiens
cagaggauuucuuuagugucau

SEQ ID NO: 1571368 - RNA, 14 nt, Homo sapiens
cagaggcugauguc

SEQ ID NO: 1571369 - RNA, 22 nt, Homo sapiens
cagagggagaauccaaggguug

SEQ ID NO: 1571370 - RNA, 19 nt, Homo sapiens
cagagggggaguagccaag

SEQ ID NO: 1571371 - RNA, 15 nt, Homo sapiens
cagaggguacuuuaa

SEQ ID NO: 1571372 - RNA, 15 nt, Homo sapiens
cagaggucucccaaa

SEQ ID NO: 1571373 - RNA, 20 nt, Homo sapiens
cagagguugcagugagccga

SEQ ID NO: 1571374 - RNA, 19 nt, Homo sapiens
cagagguugcagugagcug

SEQ ID NO: 1571375 - RNA, 14 nt, Homo sapiens
cagaguacgugaaa

SEQ ID NO: 1571376 - RNA, 19 nt, Homo sapiens
cagagucaggcuguugcgc

SEQ ID NO: 1571377 - RNA, 13 nt, Homo sapiens
cagaguccacugu

SEQ ID NO: 1571378 - RNA, 17 nt, Homo sapiens
cagaguccagugcucug

SEQ ID NO: 1571379 - RNA, 14 nt, Homo sapiens
cagagucucaggac

SEQ ID NO: 1571380 - RNA, 22 nt, Homo sapiens
cagagugagacccagcccucau

SEQ ID NO: 1571381 - RNA, 15 nt, Homo sapiens
cagaguguucccuga

SEQ ID NO: 1571382 - RNA, 13 nt, Homo sapiens
cagaguuguucug

SEQ ID NO: 1571383 - RNA, 13 nt, Homo sapiens
cagauaccucacc

SEQ ID NO: 1571384 - RNA, 23 nt, Homo sapiens
cagauaucauuuaggaguauuau

SEQ ID NO: 1571385 - RNA, 22 nt, Homo sapiens
cagaucgauccuggauucacuc

SEQ ID NO: 1571386 - RNA, 21 nt, Homo sapiens
cagaucuuucuccuugaauau

SEQ ID NO: 1571387 - RNA, 19 nt, Homo sapiens
cagaugaagacaucaggaa

SEQ ID NO: 1571388 - RNA, 16 nt, Homo sapiens
cagaugaauaaacuga

SEQ ID NO: 1571389 - RNA, 13 nt, Homo sapiens
cagaugcaguuug

SEQ ID NO: 1571390 - RNA, 19 nt, Homo sapiens
cagaugccccagagcuguu

SEQ ID NO: 1571391 - RNA, 18 nt, Homo sapiens
cagaugcuacgcuccagc

SEQ ID NO: 1571392 - RNA, 19 nt, Homo sapiens
cagaugcuuuccugcacau

SEQ ID NO: 1571393 - RNA, 15 nt, Homo sapiens
cagauggugucauuu

SEQ ID NO: 1571394 - RNA, 16 nt, Homo sapiens
cagauggugucauuua

SEQ ID NO: 1571395 - RNA, 19 nt, Homo sapiens
cagaugugugcaauguggc

SEQ ID NO: 1571396 - RNA, 14 nt, Homo sapiens
cagauuaaacccuu

SEQ ID NO: 1571397 - RNA, 16 nt, Homo sapiens
cagauuaucuacuuag

SEQ ID NO: 1571398 - RNA, 19 nt, Homo sapiens
cagauuaugaguuacuguu

SEQ ID NO: 1571399 - RNA, 22 nt, Homo sapiens
cagauucagacuuggacuauga

SEQ ID NO: 1571400 - RNA, 12 nt, Homo sapiens
caggaguucaag

SEQ ID NO: 1571401 - RNA, 21 nt, Homo sapiens
caggaguuuuaaguccagcuu

SEQ ID NO: 1571402 - RNA, 12 nt, Homo sapiens
caggaugcuaau

SEQ ID NO: 1571403 - RNA, 23 nt, Homo sapiens
caggauuauucccaccugccaca

SEQ ID NO: 1571404 - RNA, 16 nt, Homo sapiens
auuaucaacagcauuu

SEQ ID NO: 1571405 - RNA, 17 nt, Homo sapiens
auuaucucuuugaucua

SEQ ID NO: 1571406 - RNA, 14 nt, Homo sapiens
auuaugcacguguc

SEQ ID NO: 1571407 - RNA, 21 nt, Homo sapiens
auuauggaauuacucuacugu

SEQ ID NO: 1571408 - RNA, 20 nt, Homo sapiens
auuaugucucuucugagcua

SEQ ID NO: 1571409 - RNA, 19 nt, Homo sapiens
auuaugugacauuuuacau

SEQ ID NO: 1571410 - RNA, 18 nt, Homo sapiens
auuauguggcccucugga

SEQ ID NO: 1571411 - RNA, 13 nt, Homo sapiens
auuauucaucucu

SEQ ID NO: 1571412 - RNA, 18 nt, Homo sapiens
auuauuccaaaccaaauu

SEQ ID NO: 1571413 - RNA, 16 nt, Homo sapiens
auuauuccccuaggcu

SEQ ID NO: 1571414 - RNA, 14 nt, Homo sapiens
auuauugacacuga

SEQ ID NO: 1571415 - RNA, 19 nt, Homo sapiens
auuauugacacugaacuua

SEQ ID NO: 1571416 - RNA, 17 nt, Homo sapiens
auuauuguagacaugcc

SEQ ID NO: 1571417 - RNA, 14 nt, Homo sapiens
auuauugugacuuc

SEQ ID NO: 1571418 - RNA, 16 nt, Homo sapiens
auuauugugacuucac

SEQ ID NO: 1571419 - RNA, 17 nt, Homo sapiens
auuauugugacuucacu

SEQ ID NO: 1571420 - RNA, 20 nt, Homo sapiens
auuauuuauaaugcuuggaa

SEQ ID NO: 1571421 - RNA, 23 nt, Homo sapiens
auuauuugggagggaaaagggaa

SEQ ID NO: 1571422 - RNA, 17 nt, Homo sapiens
auuauuuuacaaucaac

SEQ ID NO: 1571423 - RNA, 19 nt, Homo sapiens
auucaaaaauuaucuauag

SEQ ID NO: 1571424 - RNA, 21 nt, Homo sapiens
auucaaagcauggacauuuag

SEQ ID NO: 1571425 - RNA, 22 nt, Homo sapiens
auucaacaagagcacuacauuc

SEQ ID NO: 1571426 - RNA, 23 nt, Homo sapiens
auucaacagggaagaaacuuucu

SEQ ID NO: 1571427 - RNA, 17 nt, Homo sapiens
auucaaccaaccaagga

SEQ ID NO: 1571428 - RNA, 12 nt, Homo sapiens
auucaacuaccu

SEQ ID NO: 1571429 - RNA, 14 nt, Homo sapiens
auucaagaaacuag

SEQ ID NO: 1571430 - RNA, 15 nt, Homo sapiens
auucaagaaugccag

SEQ ID NO: 1571431 - RNA, 15 nt, Homo sapiens
auucaauaaaaaccu

SEQ ID NO: 1571432 - RNA, 17 nt, Homo sapiens
auucacaaaauuuccac

SEQ ID NO: 1571433 - RNA, 15 nt, Homo sapiens
auucacaaauagcca

SEQ ID NO: 1571434 - RNA, 17 nt, Homo sapiens
auucacaagacccaaaa

SEQ ID NO: 1571435 - RNA, 18 nt, Homo sapiens
auucacagcaagucacug

SEQ ID NO: 1571436 - RNA, 14 nt, Homo sapiens
auucacaguaauau

SEQ ID NO: 1571437 - RNA, 21 nt, Homo sapiens
auucacaguaauaugguuccc

SEQ ID NO: 1571438 - RNA, 17 nt, Homo sapiens
auucacaugaugcacuu

SEQ ID NO: 1571439 - RNA, 14 nt, Homo sapiens
auucaccuguaaaa

SEQ ID NO: 1571440 - RNA, 13 nt, Homo sapiens
auucacuacaggu

SEQ ID NO: 1571441 - RNA, 20 nt, Homo sapiens
auucagaaauucuccaggau

SEQ ID NO: 1571442 - RNA, 19 nt, Homo sapiens
auucagacaaaauggauac

SEQ ID NO: 1571443 - RNA, 15 nt, Homo sapiens
auucagaggucacuu

SEQ ID NO: 1571444 - RNA, 12 nt, Homo sapiens
auucagcacuua

SEQ ID NO: 1571445 - RNA, 13 nt, Homo sapiens
auucagcacuuaa

SEQ ID NO: 1571446 - RNA, 22 nt, Homo sapiens
auucagcaguuucugacaauua

SEQ ID NO: 1571447 - RNA, 16 nt, Homo sapiens
auucagccagcuuaaa

SEQ ID NO: 1571448 - RNA, 18 nt, Homo sapiens
auucaggcagcacugaca

SEQ ID NO: 1571449 - RNA, 23 nt, Homo sapiens
auucagguaauacaaacuauaua

SEQ ID NO: 1571450 - RNA, 18 nt, Homo sapiens
auucauaggaagguguuu

SEQ ID NO: 1571451 - RNA, 17 nt, Homo sapiens
auucauagucuuuggag

SEQ ID NO: 1571452 - RNA, 16 nt, Homo sapiens
auucauuguguuaccu

SEQ ID NO: 1571453 - RNA, 23 nt, Homo sapiens
auucauuucauugugaucagcua

SEQ ID NO: 1571454 - RNA, 17 nt, Homo sapiens
auucauuucuagacuca

SEQ ID NO: 1571455 - RNA, 17 nt, Homo sapiens
auucauuuggugacugu

SEQ ID NO: 1571456 - RNA, 17 nt, Homo sapiens
auuccaaaaagcacaua

SEQ ID NO: 1571457 - RNA, 14 nt, Homo sapiens
auuccaaaguucaa

SEQ ID NO: 1571458 - RNA, 23 nt, Homo sapiens
auuccacacccucacugcuguag

SEQ ID NO: 1571459 - RNA, 15 nt, Homo sapiens
auuccaccaaaugug

SEQ ID NO: 1571460 - RNA, 15 nt, Homo sapiens
auuccacuuugucca

SEQ ID NO: 1571461 - RNA, 23 nt, Homo sapiens
auuccagaacaaaucauuauguu

SEQ ID NO: 1571462 - RNA, 17 nt, Homo sapiens
auuccagaaugcuguac

SEQ ID NO: 1571463 - RNA, 13 nt, Homo sapiens
auuccagccaggg

SEQ ID NO: 1571464 - RNA, 15 nt, Homo sapiens
auuccaggagauugg

SEQ ID NO: 1571465 - RNA, 13 nt, Homo sapiens
auuccauccacua

SEQ ID NO: 1571466 - RNA, 22 nt, Homo sapiens
auucccuaaagacuaacuugaa

SEQ ID NO: 1571467 - RNA, 24 nt, Homo sapiens
auucccugcacacacaugcauacu

SEQ ID NO: 1571468 - RNA, 21 nt, Homo sapiens
auucccugcccaaacccuuaa

SEQ ID NO: 1571469 - RNA, 22 nt, Homo sapiens
auuccuaugcugcaauacauua

SEQ ID NO: 1571470 - RNA, 16 nt, Homo sapiens
auuccucauucugcau

SEQ ID NO: 1571471 - RNA, 22 nt, Homo sapiens
auuccugguggauacuguagaa

SEQ ID NO: 1571472 - RNA, 18 nt, Homo sapiens
auuccuguuugucuacau

SEQ ID NO: 1571473 - RNA, 19 nt, Homo sapiens
auuccuuagacucuuuucc

SEQ ID NO: 1571474 - RNA, 21 nt, Homo sapiens
auuccuucacauaguuugaua

SEQ ID NO: 1571475 - RNA, 15 nt, Homo sapiens
auuccuugguaauau

SEQ ID NO: 1571476 - RNA, 22 nt, Homo sapiens
auuccuuuauuuugcugcuuga

SEQ ID NO: 1571477 - RNA, 21 nt, Homo sapiens
auuccuuuucguuuagaauca

SEQ ID NO: 1571478 - RNA, 18 nt, Homo sapiens
auucggugugcugccaac

SEQ ID NO: 1571479 - RNA, 22 nt, Homo sapiens
auucuaaauaaauuucccaguu

SEQ ID NO: 1571480 - RNA, 15 nt, Homo sapiens
auucuaaucuaacaa

SEQ ID NO: 1571481 - RNA, 19 nt, Homo sapiens
auucuagcugagaagcaau

SEQ ID NO: 1571482 - RNA, 16 nt, Homo sapiens
auucuaguuuugucaa

SEQ ID NO: 1571483 - RNA, 22 nt, Homo sapiens
auucuauugggauauccuuuca

SEQ ID NO: 1571484 - RNA, 17 nt, Homo sapiens
auucuauuuauauguac

SEQ ID NO: 1571485 - RNA, 14 nt, Homo sapiens
auucucaucacuca

SEQ ID NO: 1571486 - RNA, 23 nt, Homo sapiens
auucuccucaguggcuucuccag

SEQ ID NO: 1571487 - RNA, 20 nt, Homo sapiens
auucucucauagaacauuga

SEQ ID NO: 1571488 - RNA, 21 nt, Homo sapiens
auucucucaucuaacugauga

SEQ ID NO: 1571489 - RNA, 23 nt, Homo sapiens
auucucucuuauuguucuuucau

SEQ ID NO: 1571490 - RNA, 18 nt, Homo sapiens
auucucugagcugugcag

SEQ ID NO: 1571491 - RNA, 17 nt, Homo sapiens
auucucugucucaucca

SEQ ID NO: 1571492 - RNA, 12 nt, Homo sapiens
auucucuuucac

SEQ ID NO: 1571493 - RNA, 22 nt, Homo sapiens
auucugaaucagaaucucgcag

SEQ ID NO: 1571494 - RNA, 15 nt, Homo sapiens
auucuggaagcaaau

SEQ ID NO: 1571495 - RNA, 17 nt, Homo sapiens
auucuggcaggaccuca

SEQ ID NO: 1571496 - RNA, 14 nt, Homo sapiens
auucuguauuaaau

SEQ ID NO: 1571497 - RNA, 15 nt, Homo sapiens
auucuguuaucucag

SEQ ID NO: 1571498 - RNA, 15 nt, Homo sapiens
auucuguucugcaac

SEQ ID NO: 1571499 - RNA, 19 nt, Homo sapiens
auucuguuugcguacuugu

SEQ ID NO: 1571500 - RNA, 16 nt, Homo sapiens
auucuuaaaaugcaau

SEQ ID NO: 1571501 - RNA, 17 nt, Homo sapiens
auucuuaaaaugcaaua

SEQ ID NO: 1571502 - RNA, 20 nt, Homo sapiens
auucuuccaucaucacugua

SEQ ID NO: 1571503 - RNA, 21 nt, Homo sapiens
auucuugauuuauuugcuucu

SEQ ID NO: 1571504 - RNA, 16 nt, Homo sapiens
auucuuggaccaugcc

SEQ ID NO: 1571505 - RNA, 19 nt, Homo sapiens
auucuuuuugaaaugucaa

SEQ ID NO: 1571506 - RNA, 16 nt, Homo sapiens
auugaaaugauuucac

SEQ ID NO: 1571507 - RNA, 18 nt, Homo sapiens
auugaaauuuacugugag

SEQ ID NO: 1571508 - RNA, 22 nt, Homo sapiens
auugaacaaaaauguuuccacu

SEQ ID NO: 1571509 - RNA, 12 nt, Homo sapiens
auugaacuacag

SEQ ID NO: 1571510 - RNA, 18 nt, Homo sapiens
auugaacuuuuguacuga

SEQ ID NO: 1571511 - RNA, 21 nt, Homo sapiens
auugaacuuuuguacugaauu

SEQ ID NO: 1571512 - RNA, 12 nt, Homo sapiens
auugaagcaacu

SEQ ID NO: 1571513 - RNA, 12 nt, Homo sapiens
auugaagcagau

SEQ ID NO: 1571514 - RNA, 13 nt, Homo sapiens
auugaagcuuugu

SEQ ID NO: 1571515 - RNA, 15 nt, Homo sapiens
auugaauaguuuauu

SEQ ID NO: 1571516 - RNA, 18 nt, Homo sapiens
auugaauaguuuauuucu

SEQ ID NO: 1571517 - RNA, 22 nt, Homo sapiens
auugaaugaugugauacaaauu

SEQ ID NO: 1571518 - RNA, 14 nt, Homo sapiens
auugaaugugauuu

SEQ ID NO: 1571519 - RNA, 12 nt, Homo sapiens
auugaccaaaua

SEQ ID NO: 1571520 - RNA, 22 nt, Homo sapiens
aucuucaauuuauuacugaaaa

SEQ ID NO: 1571521 - RNA, 19 nt, Homo sapiens
augccagccacugugauag

SEQ ID NO: 1571522 - RNA, 20 nt, Homo sapiens
aauuucucccagucauuuaa

SEQ ID NO: 1571523 - RNA, 16 nt, Homo sapiens
aauuucugccauuuca

SEQ ID NO: 1571524 - RNA, 17 nt, Homo sapiens
aauuucuuaugugacau

SEQ ID NO: 1571525 - RNA, 16 nt, Homo sapiens
aauuugaauacugcau

SEQ ID NO: 1571526 - RNA, 17 nt, Homo sapiens
aauuugcaaaguacugu

SEQ ID NO: 1571527 - RNA, 13 nt, Homo sapiens
aauuugguuaaua

SEQ ID NO: 1571528 - RNA, 19 nt, Homo sapiens
aauuuuaaugaagugcaau

SEQ ID NO: 1571529 - RNA, 20 nt, Homo sapiens
aauuuuaaugaagugcaaua

SEQ ID NO: 1571530 - RNA, 17 nt, Homo sapiens
aauuuuacaguagaaua

SEQ ID NO: 1571531 - RNA, 15 nt, Homo sapiens
aauuuuacugugaaa

SEQ ID NO: 1571532 - RNA, 15 nt, Homo sapiens
aauuuuauuacauau

SEQ ID NO: 1571533 - RNA, 22 nt, Homo sapiens
aauuuucaaaacaauccuuuaa

SEQ ID NO: 1571534 - RNA, 15 nt, Homo sapiens
aauuuugcaccagcg

SEQ ID NO: 1571535 - RNA, 17 nt, Homo sapiens
aauuuugcacugaagag

SEQ ID NO: 1571536 - RNA, 15 nt, Homo sapiens
aauuuuugcaauaau

SEQ ID NO: 1571537 - RNA, 17 nt, Homo sapiens
aauuuuuuuuccuugcc

SEQ ID NO: 1571538 - RNA, 15 nt, Homo sapiens
acaaaaaauacuuua

SEQ ID NO: 1571539 - RNA, 19 nt, Homo sapiens
acaaaaaaugcagaacuua

SEQ ID NO: 1571540 - RNA, 13 nt, Homo sapiens
acaaaagaaggcu

SEQ ID NO: 1571541 - RNA, 22 nt, Homo sapiens
acaaaaggguguauaguguuca

SEQ ID NO: 1571542 - RNA, 12 nt, Homo sapiens
acaaaagucugu

SEQ ID NO: 1571543 - RNA, 15 nt, Homo sapiens
acaaaagucugucuu

SEQ ID NO: 1571544 - RNA, 16 nt, Homo sapiens
acaaaauauauuuugu

SEQ ID NO: 1571545 - RNA, 16 nt, Homo sapiens
acaaaaucagauugau

SEQ ID NO: 1571546 - RNA, 16 nt, Homo sapiens
acaaaaucagguaacu

SEQ ID NO: 1571547 - RNA, 12 nt, Homo sapiens
acaaaaugcacu

SEQ ID NO: 1571548 - RNA, 15 nt, Homo sapiens
acaaaauggauacau

SEQ ID NO: 1571549 - RNA, 19 nt, Homo sapiens
acaaaauguagaauauuca

SEQ ID NO: 1571550 - RNA, 12 nt, Homo sapiens
acaaacaugugu

SEQ ID NO: 1571551 - RNA, 17 nt, Homo sapiens
acaaaccauuaccugua

SEQ ID NO: 1571552 - RNA, 18 nt, Homo sapiens
acaaacgggcucgggucu

SEQ ID NO: 1571553 - RNA, 14 nt, Homo sapiens
acaaacuucaaaga

SEQ ID NO: 1571554 - RNA, 18 nt, Homo sapiens
acaaacuucaaagaggaa

SEQ ID NO: 1571555 - RNA, 17 nt, Homo sapiens
acaaagacaugcuuucc

SEQ ID NO: 1571556 - RNA, 14 nt, Homo sapiens
acaaagauugagaa

SEQ ID NO: 1571557 - RNA, 13 nt, Homo sapiens
acaaagcugcuaa

SEQ ID NO: 1571558 - RNA, 22 nt, Homo sapiens
acaaagcugggauuucagucua

SEQ ID NO: 1571559 - RNA, 16 nt, Homo sapiens
acaaaggaaauaucaa

SEQ ID NO: 1571560 - RNA, 19 nt, Homo sapiens
acaaaguagaggaauccau

SEQ ID NO: 1571561 - RNA, 17 nt, Homo sapiens
acaaauaacaucucacc

SEQ ID NO: 1571562 - RNA, 17 nt, Homo sapiens
acaaauaagauuaauaa

SEQ ID NO: 1571563 - RNA, 14 nt, Homo sapiens
acaaaugacuguau

SEQ ID NO: 1571564 - RNA, 18 nt, Homo sapiens
acaaauuaagauguucag

SEQ ID NO: 1571565 - RNA, 18 nt, Homo sapiens
acaaauuguauggugaua

SEQ ID NO: 1571566 - RNA, 13 nt, Homo sapiens
acaacaaagagaa

SEQ ID NO: 1571567 - RNA, 24 nt, Homo sapiens
acaacaccuuccuccugcagacac

SEQ ID NO: 1571568 - RNA, 11 nt, Homo sapiens
acaacacuuaa

SEQ ID NO: 1571569 - RNA, 17 nt, Homo sapiens
acaacagucaaguugau

SEQ ID NO: 1571570 - RNA, 10 nt, Homo sapiens
acaacauguu

SEQ ID NO: 1571571 - RNA, 13 nt, Homo sapiens
acaaccacuggga

SEQ ID NO: 1571572 - RNA, 17 nt, Homo sapiens
acaaccgguaaccaaag

SEQ ID NO: 1571573 - RNA, 19 nt, Homo sapiens
acaaccucauuuuaacuca

SEQ ID NO: 1571574 - RNA, 14 nt, Homo sapiens
acaacugacuucca

SEQ ID NO: 1571575 - RNA, 19 nt, Homo sapiens
acaacuuguauuuccaaac

SEQ ID NO: 1571576 - RNA, 21 nt, Homo sapiens
acaacuuucacuauaauguga

SEQ ID NO: 1571577 - RNA, 14 nt, Homo sapiens
acaagaaagcuauu

SEQ ID NO: 1571578 - RNA, 19 nt, Homo sapiens
acaagacccaaaaggcaga

SEQ ID NO: 1571579 - RNA, 15 nt, Homo sapiens
acaagaccucagugc

SEQ ID NO: 1571580 - RNA, 11 nt, Homo sapiens
acaagauuccc

SEQ ID NO: 1571581 - RNA, 15 nt, Homo sapiens
acaagcaauuacaau

SEQ ID NO: 1571582 - RNA, 13 nt, Homo sapiens
acaagccaaagag

SEQ ID NO: 1571583 - RNA, 14 nt, Homo sapiens
acaagccugagaac

SEQ ID NO: 1571584 - RNA, 15 nt, Homo sapiens
acaagcuuacaaaga

SEQ ID NO: 1571585 - RNA, 15 nt, Homo sapiens
acaagggcacaagcu

SEQ ID NO: 1571586 - RNA, 20 nt, Homo sapiens
acaaggguccguggaccagg

SEQ ID NO: 1571587 - RNA, 21 nt, Homo sapiens
acaaguaccacucuuggucag

SEQ ID NO: 1571588 - RNA, 21 nt, Homo sapiens
acaaguauuauuuuacaauca

SEQ ID NO: 1571589 - RNA, 17 nt, Homo sapiens
acaagugcagcugugac

SEQ ID NO: 1571590 - RNA, 20 nt, Homo sapiens
acaagugguuaaaacauagc

SEQ ID NO: 1571591 - RNA, 16 nt, Homo sapiens
acaagugucugugcau

SEQ ID NO: 1571592 - RNA, 13 nt, Homo sapiens
acaauaaaaccaa

SEQ ID NO: 1571593 - RNA, 13 nt, Homo sapiens
acaauaaaagcuu

SEQ ID NO: 1571594 - RNA, 18 nt, Homo sapiens
acaauaaagauacaugau

SEQ ID NO: 1571595 - RNA, 13 nt, Homo sapiens
acaauacaucaac

SEQ ID NO: 1571596 - RNA, 13 nt, Homo sapiens
acaauacaucuaa

SEQ ID NO: 1571597 - RNA, 14 nt, Homo sapiens
acaauaguucugug

SEQ ID NO: 1571598 - RNA, 18 nt, Homo sapiens
acaauaugacacuuguaa

SEQ ID NO: 1571599 - RNA, 19 nt, Homo sapiens
acaaucaucaucauucuca

SEQ ID NO: 1571600 - RNA, 20 nt, Homo sapiens
acaaucuggcuuagugccac

SEQ ID NO: 1571601 - RNA, 21 nt, Homo sapiens
acaaucuguuuuggcuuuaug

SEQ ID NO: 1571602 - RNA, 19 nt, Homo sapiens
acaaugacauuuauaucac

SEQ ID NO: 1571603 - RNA, 19 nt, Homo sapiens
acaaugaccacauccugaa

SEQ ID NO: 1571604 - RNA, 9 nt, Homo sapiens
acaaugcca

SEQ ID NO: 1571605 - RNA, 15 nt, Homo sapiens
acaauguauaagcua

SEQ ID NO: 1571606 - RNA, 11 nt, Homo sapiens
acaauguaucu

SEQ ID NO: 1571607 - RNA, 19 nt, Homo sapiens
acaauguuucuucauuucu

SEQ ID NO: 1571608 - RNA, 19 nt, Homo sapiens
acaauuauauaaaucauuu

SEQ ID NO: 1571609 - RNA, 23 nt, Homo sapiens
acaauuccuccagagacacugag

SEQ ID NO: 1571610 - RNA, 16 nt, Homo sapiens
acaauuucagcuucau

SEQ ID NO: 1571611 - RNA, 18 nt, Homo sapiens
acaauuuuaaaguucuua

SEQ ID NO: 1571612 - RNA, 14 nt, Homo sapiens
acaauuuuccugug

SEQ ID NO: 1571613 - RNA, 14 nt, Homo sapiens
acacaaaaacagaa

SEQ ID NO: 1571614 - RNA, 17 nt, Homo sapiens
acacaaaggaaguccaa

SEQ ID NO: 1571615 - RNA, 23 nt, Homo sapiens
acacaaaggaaguccaaccugag

SEQ ID NO: 1571616 - RNA, 15 nt, Homo sapiens
acacaagaggggaug

SEQ ID NO: 1571617 - RNA, 18 nt, Homo sapiens
acacaaucugaaacagcu

SEQ ID NO: 1571618 - RNA, 23 nt, Homo sapiens
acacaauuucauuuccagcauuu

SEQ ID NO: 1571619 - RNA, 16 nt, Homo sapiens
acacacaaaaacagaa

SEQ ID NO: 1571620 - RNA, 15 nt, Homo sapiens
acacacaacaccuua

SEQ ID NO: 1571621 - RNA, 16 nt, Homo sapiens
acacacaccuagccag

SEQ ID NO: 1571622 - RNA, 23 nt, Homo sapiens
ucucugauuccccaaaucugcau

SEQ ID NO: 1571623 - RNA, 20 nt, Homo sapiens
ucucugcaauuuuacuguga

SEQ ID NO: 1571624 - RNA, 23 nt, Homo sapiens
ucucugcaauuuuacugugaaaa

SEQ ID NO: 1571625 - RNA, 12 nt, Homo sapiens
ucucugcucugc

SEQ ID NO: 1571626 - RNA, 12 nt, Homo sapiens
ucucugcuugcu

SEQ ID NO: 1571627 - RNA, 18 nt, Homo sapiens
ucucugcuugcuuggccc

SEQ ID NO: 1571628 - RNA, 15 nt, Homo sapiens
ucucuggaguauucu

SEQ ID NO: 1571629 - RNA, 15 nt, Homo sapiens
ucucuguauugucua

SEQ ID NO: 1571630 - RNA, 20 nt, Homo sapiens
ucucugucaugugcagauga

SEQ ID NO: 1571631 - RNA, 11 nt, Homo sapiens
ucucugugcau

SEQ ID NO: 1571632 - RNA, 14 nt, Homo sapiens
ucucuguugucgua

SEQ ID NO: 1571633 - RNA, 14 nt, Homo sapiens
ucucuucaaauaau

SEQ ID NO: 1571634 - RNA, 17 nt, Homo sapiens
ucucuucaauaaaccac

SEQ ID NO: 1571635 - RNA, 18 nt, Homo sapiens
ucucuucaauaaaccaca

SEQ ID NO: 1571636 - RNA, 19 nt, Homo sapiens
ucucuucaauaaaccacaa

SEQ ID NO: 1571637 - RNA, 23 nt, Homo sapiens
ucucuucauuauucucugcuaua

SEQ ID NO: 1571638 - RNA, 14 nt, Homo sapiens
ucucuucuuuaaag

SEQ ID NO: 1571639 - RNA, 21 nt, Homo sapiens
ucucuuggacccaccuguggg

SEQ ID NO: 1571640 - RNA, 14 nt, Homo sapiens
ucucuuuaaucucc

SEQ ID NO: 1571641 - RNA, 15 nt, Homo sapiens
ucucuuucacacaau

SEQ ID NO: 1571642 - RNA, 20 nt, Homo sapiens
ucucuuuggaggaagcccau

SEQ ID NO: 1571643 - RNA, 16 nt, Homo sapiens
ucucuuugguguuaca

SEQ ID NO: 1571644 - RNA, 16 nt, Homo sapiens
ucucuuuguacugcuu

SEQ ID NO: 1571645 - RNA, 21 nt, Homo sapiens
ucugaaaauagcaacccagaa

SEQ ID NO: 1571646 - RNA, 15 nt, Homo sapiens
ucugaaaggagacau

SEQ ID NO: 1571647 - RNA, 15 nt, Homo sapiens
ucugaaauggaauau

SEQ ID NO: 1571648 - RNA, 14 nt, Homo sapiens
ucugaaccaugugg

SEQ ID NO: 1571649 - RNA, 13 nt, Homo sapiens
ucugaacuuccaa

SEQ ID NO: 1571650 - RNA, 16 nt, Homo sapiens
ucugaagagcuagucu

SEQ ID NO: 1571651 - RNA, 22 nt, Homo sapiens
ucugaagcucgcauccagacag

SEQ ID NO: 1571652 - RNA, 21 nt, Homo sapiens
ucugaaggagccccauuccug

SEQ ID NO: 1571653 - RNA, 21 nt, Homo sapiens
ucugaauuugcaaaguacugu

SEQ ID NO: 1571654 - RNA, 23 nt, Homo sapiens
ucugacagaaagcagauaccuca

SEQ ID NO: 1571655 - RNA, 17 nt, Homo sapiens
aaaaugcuucacuguac

SEQ ID NO: 1571656 - RNA, 18 nt, Homo sapiens
aaaauggaauaacauauc

SEQ ID NO: 1571657 - RNA, 22 nt, Homo sapiens
aaaauggagcucaguaacauaa

SEQ ID NO: 1571658 - RNA, 14 nt, Homo sapiens
aaaaugggaacaau

SEQ ID NO: 1571659 - RNA, 22 nt, Homo sapiens
aaaaugggagacagccucuuac

SEQ ID NO: 1571660 - RNA, 22 nt, Homo sapiens
aaaauguacccgagcacauaga

SEQ ID NO: 1571661 - RNA, 21 nt, Homo sapiens
aaaauguaugccacaucucag

SEQ ID NO: 1571662 - RNA, 23 nt, Homo sapiens
aaaauuaaacuacagaauauuaa

SEQ ID NO: 1571663 - RNA, 15 nt, Homo sapiens
aaaauuaaauacaua

SEQ ID NO: 1571664 - RNA, 16 nt, Homo sapiens
aaaauuaauguaauaa

SEQ ID NO: 1571665 - RNA, 23 nt, Homo sapiens
aaaauuaauuaggaauuacuuua

SEQ ID NO: 1571666 - RNA, 16 nt, Homo sapiens
aaaauuagacugugau

SEQ ID NO: 1571667 - RNA, 21 nt, Homo sapiens
aaaauuagccgggcauggugg

SEQ ID NO: 1571668 - RNA, 18 nt, Homo sapiens
aaaauuauguuccuagaa

SEQ ID NO: 1571669 - RNA, 23 nt, Homo sapiens
aaaauuauuuaaaccgcuaaaag

SEQ ID NO: 1571670 - RNA, 18 nt, Homo sapiens
aaaauuauuugcauaaca

SEQ ID NO: 1571671 - RNA, 21 nt, Homo sapiens
aaaauucagaguccuugcaaa

SEQ ID NO: 1571672 - RNA, 18 nt, Homo sapiens
aaaauuuauaagccaaag

SEQ ID NO: 1571673 - RNA, 17 nt, Homo sapiens
aaaauuucauagcugua

SEQ ID NO: 1571674 - RNA, 14 nt, Homo sapiens
aaaauuugcugcca

SEQ ID NO: 1571675 - RNA, 16 nt, Homo sapiens
aaaauuuuacauuuga

SEQ ID NO: 1571676 - RNA, 17 nt, Homo sapiens
aaaauuuuuaaauauuc

SEQ ID NO: 1571677 - RNA, 20 nt, Homo sapiens
aaacaaaaauauuuugauca

SEQ ID NO: 1571678 - RNA, 21 nt, Homo sapiens
aaacaaaacccucagcacugu

SEQ ID NO: 1571679 - RNA, 17 nt, Homo sapiens
aaacaaaaggguguaua

SEQ ID NO: 1571680 - RNA, 14 nt, Homo sapiens
aaacaaaugaaaua

SEQ ID NO: 1571681 - RNA, 12 nt, Homo sapiens
aaacaacucuuu

SEQ ID NO: 1571682 - RNA, 23 nt, Homo sapiens
aaacaacuuucuccuacucuucc

SEQ ID NO: 1571683 - RNA, 14 nt, Homo sapiens
aaacaaguauuugu

SEQ ID NO: 1571684 - RNA, 14 nt, Homo sapiens
aaacaagucaaaga

SEQ ID NO: 1571685 - RNA, 22 nt, Homo sapiens
aaacaaucuguuuuggcuuuau

SEQ ID NO: 1571686 - RNA, 18 nt, Homo sapiens
aaacaaugaaaacucuuu

SEQ ID NO: 1571687 - RNA, 15 nt, Homo sapiens
aaacaaugcagaucu

SEQ ID NO: 1571688 - RNA, 19 nt, Homo sapiens
aaacacaaaauccauucca

SEQ ID NO: 1571689 - RNA, 13 nt, Homo sapiens
aaacaccauucau

SEQ ID NO: 1571690 - RNA, 15 nt, Homo sapiens
aaacacuauuuccaa

SEQ ID NO: 1571691 - RNA, 20 nt, Homo sapiens
aaacacuuccagucuggaga

SEQ ID NO: 1571692 - RNA, 22 nt, Homo sapiens
aaacacuuugccuccuguguac

SEQ ID NO: 1571693 - RNA, 21 nt, Homo sapiens
aaacagauuacuagaaauauu

SEQ ID NO: 1571694 - RNA, 14 nt, Homo sapiens
aaacaguagugaua

SEQ ID NO: 1571695 - RNA, 11 nt, Homo sapiens
aaacagucaaa

SEQ ID NO: 1571696 - RNA, 14 nt, Homo sapiens
aaacauaucuugag

SEQ ID NO: 1571697 - RNA, 17 nt, Homo sapiens
aaacaucacaccugccc

SEQ ID NO: 1571698 - RNA, 21 nt, Homo sapiens
aaacaucacaccugcccuaaa

SEQ ID NO: 1571699 - RNA, 13 nt, Homo sapiens
aaacaucauuuca

SEQ ID NO: 1571700 - RNA, 18 nt, Homo sapiens
aaacaucuccccucucac

SEQ ID NO: 1571701 - RNA, 19 nt, Homo sapiens
aaacaucuccccucucacc

SEQ ID NO: 1571702 - RNA, 14 nt, Homo sapiens
aaacaucuuuucac

SEQ ID NO: 1571703 - RNA, 21 nt, Homo sapiens
aaacaugagcauccccagcca

SEQ ID NO: 1571704 - RNA, 19 nt, Homo sapiens
aaacauggaggaacaguau

SEQ ID NO: 1571705 - RNA, 14 nt, Homo sapiens
aaacauguacuaca

SEQ ID NO: 1571706 - RNA, 23 nt, Homo sapiens
aaacauguauuuauguaaugaag

SEQ ID NO: 1571707 - RNA, 15 nt, Homo sapiens
aaacauuacuuauuu

SEQ ID NO: 1571708 - RNA, 21 nt, Homo sapiens
aaacauugaaguaaugaauuu

SEQ ID NO: 1571709 - RNA, 14 nt, Homo sapiens
aaacauuucuggac

SEQ ID NO: 1571710 - RNA, 18 nt, Homo sapiens
aaaccaaagagggcuucc

SEQ ID NO: 1571711 - RNA, 19 nt, Homo sapiens
aaaccaagauuaugugacu

SEQ ID NO: 1571712 - RNA, 14 nt, Homo sapiens
aaaccaaggcuaga

SEQ ID NO: 1571713 - RNA, 23 nt, Homo sapiens
aaaccacgccucuugaccaggcu

SEQ ID NO: 1571714 - RNA, 15 nt, Homo sapiens
aaaccagaaaagcaa

SEQ ID NO: 1571715 - RNA, 14 nt, Homo sapiens
aaaccagugugaac

SEQ ID NO: 1571716 - RNA, 21 nt, Homo sapiens
aaaccauaaaacccuauacaa

SEQ ID NO: 1571717 - RNA, 20 nt, Homo sapiens
aaaccauucuagguguuuca

SEQ ID NO: 1571718 - RNA, 14 nt, Homo sapiens
aaaccauucuuucc

SEQ ID NO: 1571719 - RNA, 22 nt, Homo sapiens
aaaccauucuuuccccucagga

SEQ ID NO: 1571720 - RNA, 14 nt, Homo sapiens
aaaccccacuuccc

SEQ ID NO: 1571721 - RNA, 14 nt, Homo sapiens
aaacccccaucucu

SEQ ID NO: 1571722 - RNA, 21 nt, Homo sapiens
aaaccccccagagcucuuuac

SEQ ID NO: 1571723 - RNA, 13 nt, Homo sapiens
aaaccccgucucu

SEQ ID NO: 1571724 - RNA, 17 nt, Homo sapiens
aaacccgcccucagggg

SEQ ID NO: 1571725 - RNA, 23 nt, Homo sapiens
aaacccuuuagugcuuugugaua

SEQ ID NO: 1571726 - RNA, 16 nt, Homo sapiens
aaaccguaaagugccu

SEQ ID NO: 1571727 - RNA, 19 nt, Homo sapiens
aaaccuucaguuaugauuu

SEQ ID NO: 1571728 - RNA, 18 nt, Homo sapiens
aaaccuugaaagacauuu

SEQ ID NO: 1571729 - RNA, 12 nt, Homo sapiens
aaaccuuuccau

SEQ ID NO: 1571730 - RNA, 23 nt, Homo sapiens
aaacgcaccaaucagcacucugu

SEQ ID NO: 1571731 - RNA, 17 nt, Homo sapiens
aaacggaggccagagag

SEQ ID NO: 1571732 - RNA, 12 nt, Homo sapiens
aaacuaaacaga

SEQ ID NO: 1571733 - RNA, 17 nt, Homo sapiens
aaacuaaacucuuacca

SEQ ID NO: 1571734 - RNA, 15 nt, Homo sapiens
aaacuaccaauccca

SEQ ID NO: 1571735 - RNA, 12 nt, Homo sapiens
aaacuagcuuug

SEQ ID NO: 1571736 - RNA, 16 nt, Homo sapiens
aaacuaguaagaaaca

SEQ ID NO: 1571737 - RNA, 21 nt, Homo sapiens
aaacuauaacauuauauaaca

SEQ ID NO: 1571738 - RNA, 17 nt, Homo sapiens
aaacuauguaacaugua

SEQ ID NO: 1571739 - RNA, 17 nt, Homo sapiens
aaacuauuuauaucaca

SEQ ID NO: 1571740 - RNA, 22 nt, Homo sapiens
aaacucacuauauaagucacau

SEQ ID NO: 1571741 - RNA, 14 nt, Homo sapiens
aaacucagauuuaa

SEQ ID NO: 1571742 - RNA, 22 nt, Homo sapiens
aaacucagccugggacaguuua

SEQ ID NO: 1571743 - RNA, 13 nt, Homo sapiens
aaacuccgucuca

SEQ ID NO: 1571744 - RNA, 23 nt, Homo sapiens
aaacucuguccacgauucacuca

SEQ ID NO: 1571745 - RNA, 17 nt, Homo sapiens
aaacugaaugacuugac

SEQ ID NO: 1571746 - RNA, 18 nt, Homo sapiens
aaacugacuaaacuuaca

SEQ ID NO: 1571747 - RNA, 20 nt, Homo sapiens
aaacugagcgaaauccaaga

SEQ ID NO: 1571748 - RNA, 23 nt, Homo sapiens
aaacugagucacucacauugaga

SEQ ID NO: 1571749 - RNA, 18 nt, Homo sapiens
aaacugcccacucugcaa

SEQ ID NO: 1571750 - RNA, 22 nt, Homo sapiens
aaacugcccuggcuccagugaa

SEQ ID NO: 1571751 - RNA, 16 nt, Homo sapiens
aaacugcgaggccagu

SEQ ID NO: 1571752 - RNA, 18 nt, Homo sapiens
aaacugcuuuauuuuccc

SEQ ID NO: 1571753 - RNA, 14 nt, Homo sapiens
aaacugucuugccc

SEQ ID NO: 1571754 - RNA, 12 nt, Homo sapiens
aaacugugcacc

SEQ ID NO: 1571755 - RNA, 15 nt, Homo sapiens
aaacuguuacugaaa

SEQ ID NO: 1571756 - RNA, 16 nt, Homo sapiens
aaacuguuuugacaaa

SEQ ID NO: 1571757 - RNA, 17 nt, Homo sapiens
aaacuguuuugacaaau

SEQ ID NO: 1571758 - RNA, 15 nt, Homo sapiens
aaacuuaacauucau

SEQ ID NO: 1571759 - RNA, 22 nt, Homo sapiens
aaacuucaccuacauuaucuca

SEQ ID NO: 1571760 - RNA, 21 nt, Homo sapiens
aaacuucaguuucacagaaaa

SEQ ID NO: 1571761 - RNA, 22 nt, Homo sapiens
aaacuuccaauuucuagccaua

SEQ ID NO: 1571762 - RNA, 13 nt, Homo sapiens
aaacuugaucaca

SEQ ID NO: 1571763 - RNA, 22 nt, Homo sapiens
aaacuuguaaagacacaucuua

SEQ ID NO: 1571764 - RNA, 21 nt, Homo sapiens
aaacuugugaaugcuucucac

SEQ ID NO: 1571765 - RNA, 22 nt, Homo sapiens
aaacuuguguucaaucugugaa

SEQ ID NO: 1571766 - RNA, 20 nt, Homo sapiens
aaacuuuaugcuaagugaaa

SEQ ID NO: 1571767 - RNA, 21 nt, Homo sapiens
aaacuuugauaggauguggau

SEQ ID NO: 1571768 - RNA, 18 nt, Homo sapiens
aaacuuuggguacuuaua

SEQ ID NO: 1571769 - RNA, 16 nt, Homo sapiens
aaacuuugugauuuaa

SEQ ID NO: 1571770 - RNA, 23 nt, Homo sapiens
aaacuuuuuuucuguaccaguua

SEQ ID NO: 1571771 - RNA, 23 nt, Homo sapiens
aaagaaaaauaucuuggccuaaa

SEQ ID NO: 1571772 - RNA, 23 nt, Homo sapiens
aaccgaggcccucaauccaccuu

SEQ ID NO: 1571773 - RNA, 19 nt, Homo sapiens
aaccggcauauuauuccau

SEQ ID NO: 1571774 - RNA, 14 nt, Homo sapiens
aaccggcuuugugg

SEQ ID NO: 1571775 - RNA, 21 nt, Homo sapiens
aaccgguggauccucaaacaa

SEQ ID NO: 1571776 - RNA, 23 nt, Homo sapiens
aaccguguaacacgugaaggcaa

SEQ ID NO: 1571777 - RNA, 13 nt, Homo sapiens
aaccuacaguuuu

SEQ ID NO: 1571778 - RNA, 23 nt, Homo sapiens
aaccuacaguuuuaacuguggau

SEQ ID NO: 1571779 - RNA, 22 nt, Homo sapiens
aaccuagucagguuagcugaac

SEQ ID NO: 1571780 - RNA, 19 nt, Homo sapiens
aaccuaguccgcugaagau

SEQ ID NO: 1571781 - RNA, 23 nt, Homo sapiens
aaccuaugauauuuucugugccu

SEQ ID NO: 1571782 - RNA, 21 nt, Homo sapiens
aaccucaacugccuacuccaa

SEQ ID NO: 1571783 - RNA, 22 nt, Homo sapiens
aaccucagggcucccagggguc

SEQ ID NO: 1571784 - RNA, 23 nt, Homo sapiens
aaccucagggcucccaggggucu

SEQ ID NO: 1571785 - RNA, 23 nt, Homo sapiens
aaccucauuuuaguugccuaagc

SEQ ID NO: 1571786 - RNA, 15 nt, Homo sapiens
aaccuccaacacagu

SEQ ID NO: 1571787 - RNA, 14 nt, Homo sapiens
aaccuccauucuau

SEQ ID NO: 1571788 - RNA, 20 nt, Homo sapiens
aaccuccgccucccagguuc

SEQ ID NO: 1571789 - RNA, 16 nt, Homo sapiens
aaccucgaguacugug

SEQ ID NO: 1571790 - RNA, 22 nt, Homo sapiens
aaccucugccgcccuccacacc

SEQ ID NO: 1571791 - RNA, 19 nt, Homo sapiens
aaccugacuuccucugcca

SEQ ID NO: 1571792 - RNA, 18 nt, Homo sapiens
aaccugagaucuguguuu

SEQ ID NO: 1571793 - RNA, 21 nt, Homo sapiens
aaccuggcagguuagaaccua

SEQ ID NO: 1571794 - RNA, 19 nt, Homo sapiens
aaccugguggcaccagaug

SEQ ID NO: 1571795 - RNA, 12 nt, Homo sapiens
aaccugucucac

SEQ ID NO: 1571796 - RNA, 22 nt, Homo sapiens
aaccuuaaagaaccaucagcau

SEQ ID NO: 1571797 - RNA, 13 nt, Homo sapiens
aaccuuccaccca

SEQ ID NO: 1571798 - RNA, 20 nt, Homo sapiens
aaccuuccacccagugcuga

SEQ ID NO: 1571799 - RNA, 14 nt, Homo sapiens
aaccuuucccucac

SEQ ID NO: 1571800 - RNA, 17 nt, Homo sapiens
aaccuuuggaagucaug

SEQ ID NO: 1571801 - RNA, 15 nt, Homo sapiens
aaccuuuuccucacc

SEQ ID NO: 1571802 - RNA, 16 nt, Homo sapiens
aacgaugugacugcca

SEQ ID NO: 1571803 - RNA, 16 nt, Homo sapiens
aacgcaaugucauuuu

SEQ ID NO: 1571804 - RNA, 14 nt, Homo sapiens
aacgcaccagacac

SEQ ID NO: 1571805 - RNA, 15 nt, Homo sapiens
aacgccgagugcacu

SEQ ID NO: 1571806 - RNA, 16 nt, Homo sapiens
aacgccgagugcacug

SEQ ID NO: 1571807 - RNA, 20 nt, Homo sapiens
aacgcuuaaaggugucuucc

SEQ ID NO: 1571808 - RNA, 20 nt, Homo sapiens
aacggguagcagcagaugua

SEQ ID NO: 1571809 - RNA, 18 nt, Homo sapiens
aacggugccaucccugaa

SEQ ID NO: 1571810 - RNA, 17 nt, Homo sapiens
aacgugccugacuuuga

SEQ ID NO: 1571811 - RNA, 21 nt, Homo sapiens
aacuaaagugcugcacucaaa

SEQ ID NO: 1571812 - RNA, 21 nt, Homo sapiens
aacuacucagcucuccugcug

SEQ ID NO: 1571813 - RNA, 14 nt, Homo sapiens
aacuagaaccugga

SEQ ID NO: 1571814 - RNA, 15 nt, Homo sapiens
aacuaggcucagaga

SEQ ID NO: 1571815 - RNA, 23 nt, Homo sapiens
aacuaggcucagagaugugcacc

SEQ ID NO: 1571816 - RNA, 17 nt, Homo sapiens
aacuaguaaacauaugu

SEQ ID NO: 1571817 - RNA, 12 nt, Homo sapiens
aacuagugaaau

SEQ ID NO: 1571818 - RNA, 14 nt, Homo sapiens
aacuauaagauaca

SEQ ID NO: 1571819 - RNA, 14 nt, Homo sapiens
aacuauaagcaaga

SEQ ID NO: 1571820 - RNA, 19 nt, Homo sapiens
aacuauacuugaacaaaag

SEQ ID NO: 1571821 - RNA, 20 nt, Homo sapiens
aacuauugcauuuauaugua

SEQ ID NO: 1571822 - RNA, 18 nt, Homo sapiens
aacuauuuauaucacaca

SEQ ID NO: 1571823 - RNA, 13 nt, Homo sapiens
aacucacuuuccc

SEQ ID NO: 1571824 - RNA, 17 nt, Homo sapiens
aacucagaucugucuga

SEQ ID NO: 1571825 - RNA, 17 nt, Homo sapiens
aacucauuugaaugcuu

SEQ ID NO: 1571826 - RNA, 21 nt, Homo sapiens
aacuccaucagaaaaccaaag

SEQ ID NO: 1571827 - RNA, 21 nt, Homo sapiens
aacucccgaccucaggugauc

SEQ ID NO: 1571828 - RNA, 20 nt, Homo sapiens
aacuccgugcuuaaccaaag

SEQ ID NO: 1571829 - RNA, 14 nt, Homo sapiens
aacuccugaccuca

SEQ ID NO: 1571830 - RNA, 23 nt, Homo sapiens
aacuccuuguuucagaugauucu

SEQ ID NO: 1571831 - RNA, 17 nt, Homo sapiens
aacuccuuucagccaca

SEQ ID NO: 1571832 - RNA, 21 nt, Homo sapiens
aacucuagaugguaugccucu

SEQ ID NO: 1571833 - RNA, 20 nt, Homo sapiens
aacucuccccuugucugcac

SEQ ID NO: 1571834 - RNA, 20 nt, Homo sapiens
aacucuccuggccuggccau

SEQ ID NO: 1571835 - RNA, 14 nt, Homo sapiens
aacucucuagcuua

SEQ ID NO: 1571836 - RNA, 22 nt, Homo sapiens
aacucucuucucuuucucucuc

SEQ ID NO: 1571837 - RNA, 21 nt, Homo sapiens
aacucuguccacgauucacuc

SEQ ID NO: 1571838 - RNA, 13 nt, Homo sapiens
aacucuuaagcaa

SEQ ID NO: 1571839 - RNA, 17 nt, Homo sapiens
aacucuucuuugcugca

SEQ ID NO: 1571840 - RNA, 13 nt, Homo sapiens
aacugaaacuggg

SEQ ID NO: 1571841 - RNA, 14 nt, Homo sapiens
aacugaaaggugau

SEQ ID NO: 1571842 - RNA, 13 nt, Homo sapiens
aacugaacuguaa

SEQ ID NO: 1571843 - RNA, 22 nt, Homo sapiens
aacugaaggcuaaaaagcaaca

SEQ ID NO: 1571844 - RNA, 14 nt, Homo sapiens
aacugaagguguug

SEQ ID NO: 1571845 - RNA, 20 nt, Homo sapiens
aacugaaugacuugacuuca

SEQ ID NO: 1571846 - RNA, 17 nt, Homo sapiens
aacugaaugagaaccaa

SEQ ID NO: 1571847 - RNA, 15 nt, Homo sapiens
aacugacaagccauc

SEQ ID NO: 1571848 - RNA, 13 nt, Homo sapiens
aacugacaaugaa

SEQ ID NO: 1571849 - RNA, 21 nt, Homo sapiens
aacugaugaguaaacugaggc

SEQ ID NO: 1571850 - RNA, 20 nt, Homo sapiens
aacugcaucccacguucugu

SEQ ID NO: 1571851 - RNA, 18 nt, Homo sapiens
aacugcaucuggcagcug

SEQ ID NO: 1571852 - RNA, 10 nt, Homo sapiens
aacugcauuu

SEQ ID NO: 1571853 - RNA, 12 nt, Homo sapiens
aacugccagcaa

SEQ ID NO: 1571854 - RNA, 19 nt, Homo sapiens
aacugccuuccccagggug

SEQ ID NO: 1571855 - RNA, 18 nt, Homo sapiens
aacugcgaggacaucaaa

SEQ ID NO: 1571856 - RNA, 16 nt, Homo sapiens
aacugcuguguucuca

SEQ ID NO: 1571857 - RNA, 17 nt, Homo sapiens
aacuggaagaaagcaac

SEQ ID NO: 1571858 - RNA, 18 nt, Homo sapiens
aacuggauaaaaucuucc

SEQ ID NO: 1571859 - RNA, 20 nt, Homo sapiens
aacugggaccugcaggccaa

SEQ ID NO: 1571860 - RNA, 17 nt, Homo sapiens
aacugucuuccucaaaa

SEQ ID NO: 1571861 - RNA, 15 nt, Homo sapiens
aacugugaaauacca

SEQ ID NO: 1571862 - RNA, 21 nt, Homo sapiens
aacugugccaauacagacaaa

SEQ ID NO: 1571863 - RNA, 14 nt, Homo sapiens
aacuguguuuacuc

SEQ ID NO: 1571864 - RNA, 12 nt, Homo sapiens
aacuguguuuca

SEQ ID NO: 1571865 - RNA, 21 nt, Homo sapiens
aacuguuaguauuaacuauua

SEQ ID NO: 1571866 - RNA, 17 nt, Homo sapiens
aacuguuucaagcccuc

SEQ ID NO: 1571867 - RNA, 15 nt, Homo sapiens
aacuuaaaguauaau

SEQ ID NO: 1571868 - RNA, 16 nt, Homo sapiens
aacuuaaggaagcaaa

SEQ ID NO: 1571869 - RNA, 22 nt, Homo sapiens
aacuuaccaggcaccaaaagaa

SEQ ID NO: 1571870 - RNA, 21 nt, Homo sapiens
aacuuaccuuguuaagacaaa

SEQ ID NO: 1571871 - RNA, 16 nt, Homo sapiens
aacuuacuuaguguua

SEQ ID NO: 1571872 - RNA, 11 nt, Homo sapiens
aacuuagccau

SEQ ID NO: 1571873 - RNA, 17 nt, Homo sapiens
aacuuauaacccacuuu

SEQ ID NO: 1571874 - RNA, 17 nt, Homo sapiens
aacuuauggaaagccca

SEQ ID NO: 1571875 - RNA, 18 nt, Homo sapiens
aacuuauggaaagcccau

SEQ ID NO: 1571876 - RNA, 22 nt, Homo sapiens
aacuucaccuacauuaucucac

SEQ ID NO: 1571877 - RNA, 23 nt, Homo sapiens
aacuuccuuaaaaaagaauacaa

SEQ ID NO: 1571878 - RNA, 22 nt, Homo sapiens
aacuucugccucccaugcuuac

SEQ ID NO: 1571879 - RNA, 14 nt, Homo sapiens
aacuucugccucua

SEQ ID NO: 1571880 - RNA, 18 nt, Homo sapiens
aacuucuugcuucuuucu

SEQ ID NO: 1571881 - RNA, 18 nt, Homo sapiens
aacuugcaauaccaaugu

SEQ ID NO: 1571882 - RNA, 16 nt, Homo sapiens
aacuugguucugaaua

SEQ ID NO: 1571883 - RNA, 20 nt, Homo sapiens
aacuuguggccucaagcaau

SEQ ID NO: 1571884 - RNA, 19 nt, Homo sapiens
aacuuguuugcugugaaca

SEQ ID NO: 1571885 - RNA, 17 nt, Homo sapiens
aacuuuaaaaaagcaaa

SEQ ID NO: 1571886 - RNA, 20 nt, Homo sapiens
aacuuuagacuucccacugu

SEQ ID NO: 1571887 - RNA, 22 nt, Homo sapiens
aacuuucauuuuuuuccaggcu

SEQ ID NO: 1571888 - RNA, 15 nt, Homo sapiens
aacuuuccaaaaccu

SEQ ID NO: 1571889 - RNA, 20 nt, Homo sapiens
aauacagucuuccauuugca

SEQ ID NO: 1571890 - RNA, 23 nt, Homo sapiens
aauacauaguguauuuugcacaa

SEQ ID NO: 1571891 - RNA, 15 nt, Homo sapiens
aauacauuuauaauc

SEQ ID NO: 1571892 - RNA, 17 nt, Homo sapiens
aauacauuucaauuaua

SEQ ID NO: 1571893 - RNA, 22 nt, Homo sapiens
aauacauuucaauuauacuaaa

SEQ ID NO: 1571894 - RNA, 18 nt, Homo sapiens
aauaccuuggucucaccu

SEQ ID NO: 1571895 - RNA, 20 nt, Homo sapiens
aauaccuuuucucacaaaaa

SEQ ID NO: 1571896 - RNA, 13 nt, Homo sapiens
aauacguacuuua

SEQ ID NO: 1571897 - RNA, 20 nt, Homo sapiens
aauacguacuuuagcuggaa

SEQ ID NO: 1571898 - RNA, 12 nt, Homo sapiens
aauacucugcag

SEQ ID NO: 1571899 - RNA, 11 nt, Homo sapiens
aauacugaugu

SEQ ID NO: 1571900 - RNA, 19 nt, Homo sapiens
aauacugcauuuacagugu

SEQ ID NO: 1571901 - RNA, 13 nt, Homo sapiens
aauacuguuucca

SEQ ID NO: 1571902 - RNA, 21 nt, Homo sapiens
aauacuuaccgagucagacuu

SEQ ID NO: 1571903 - RNA, 12 nt, Homo sapiens
aauagaaaaagu

SEQ ID NO: 1571904 - RNA, 16 nt, Homo sapiens
aauagaaacauuugua

SEQ ID NO: 1571905 - RNA, 13 nt, Homo sapiens
aauagaacacagu

SEQ ID NO: 1571906 - RNA, 16 nt, Homo sapiens
aauagaaccacuauga

SEQ ID NO: 1571907 - RNA, 19 nt, Homo sapiens
aauagacuuaauacaugca

SEQ ID NO: 1571908 - RNA, 12 nt, Homo sapiens
aauagcaauaac

SEQ ID NO: 1571909 - RNA, 14 nt, Homo sapiens
aauagcacauaugg

SEQ ID NO: 1571910 - RNA, 14 nt, Homo sapiens
aauaggaccagagc

SEQ ID NO: 1571911 - RNA, 20 nt, Homo sapiens
aauaguaccuucaauacuua

SEQ ID NO: 1571912 - RNA, 14 nt, Homo sapiens
aauaguacuauuaa

SEQ ID NO: 1571913 - RNA, 15 nt, Homo sapiens
aauagugaaaugcca

SEQ ID NO: 1571914 - RNA, 13 nt, Homo sapiens
aauaguggcauaa

SEQ ID NO: 1571915 - RNA, 18 nt, Homo sapiens
aauaguggcauaccaaau

SEQ ID NO: 1571916 - RNA, 16 nt, Homo sapiens
aauagugucauccuca

SEQ ID NO: 1571917 - RNA, 16 nt, Homo sapiens
aauauaaaacagucau

SEQ ID NO: 1571918 - RNA, 19 nt, Homo sapiens
aauauaaaagaucuugcag

SEQ ID NO: 1571919 - RNA, 16 nt, Homo sapiens
aauauaaacuauaauu

SEQ ID NO: 1571920 - RNA, 15 nt, Homo sapiens
aauauaaauguugcu

SEQ ID NO: 1571921 - RNA, 15 nt, Homo sapiens
aauauaaauucacuu

SEQ ID NO: 1571922 - RNA, 20 nt, Homo sapiens
aauauaagaaaaguaaugaa

SEQ ID NO: 1571923 - RNA, 21 nt, Homo sapiens
aauauauaguggguacaucaa

SEQ ID NO: 1571924 - RNA, 13 nt, Homo sapiens
aauauauccugug

SEQ ID NO: 1571925 - RNA, 18 nt, Homo sapiens
aauauauggcauuugcag

SEQ ID NO: 1571926 - RNA, 22 nt, Homo sapiens
aauauccagccucccacaagaa

SEQ ID NO: 1571927 - RNA, 21 nt, Homo sapiens
aauauccagugagcucuuuag

SEQ ID NO: 1571928 - RNA, 12 nt, Homo sapiens
aauaucuuggcc

SEQ ID NO: 1571929 - RNA, 22 nt, Homo sapiens
aauaugaaaaucuccaucucaa

SEQ ID NO: 1571930 - RNA, 16 nt, Homo sapiens
aauaugacacuuguaa

SEQ ID NO: 1571931 - RNA, 19 nt, Homo sapiens
aauaugagcuucaauauaa

SEQ ID NO: 1571932 - RNA, 19 nt, Homo sapiens
aauaugauaauaaaggcau

SEQ ID NO: 1571933 - RNA, 19 nt, Homo sapiens
aauaugauuauacaaaaga

SEQ ID NO: 1571934 - RNA, 19 nt, Homo sapiens
aauaugccuuuuugaagca

SEQ ID NO: 1571935 - RNA, 15 nt, Homo sapiens
aauauuaauuccagg

SEQ ID NO: 1571936 - RNA, 22 nt, Homo sapiens
aauauucauauuggaaaaauca

SEQ ID NO: 1571937 - RNA, 18 nt, Homo sapiens
aauauuccuaugcugcaa

SEQ ID NO: 1571938 - RNA, 19 nt, Homo sapiens
aauauuccuuuauuuugcu

SEQ ID NO: 1571939 - RNA, 22 nt, Homo sapiens
aauauuccuuuauuuugcugcu

SEQ ID NO: 1571940 - RNA, 15 nt, Homo sapiens
aauauucugaaucac

SEQ ID NO: 1571941 - RNA, 17 nt, Homo sapiens
aauauugugacucuggg

SEQ ID NO: 1571942 - RNA, 18 nt, Homo sapiens
aauauuuaaaaaugucuu

SEQ ID NO: 1571943 - RNA, 19 nt, Homo sapiens
aauauuucuucaaauaucu

SEQ ID NO: 1571944 - RNA, 17 nt, Homo sapiens
aauauuuuagauuacag

SEQ ID NO: 1571945 - RNA, 14 nt, Homo sapiens
aauauuuuccauaa

SEQ ID NO: 1571946 - RNA, 19 nt, Homo sapiens
aauauuuuguaaugcugca

SEQ ID NO: 1571947 - RNA, 23 nt, Homo sapiens
aauauuuuuauaucaugcaaaau

SEQ ID NO: 1571948 - RNA, 19 nt, Homo sapiens
aauauuuuuggucauugua

SEQ ID NO: 1571949 - RNA, 13 nt, Homo sapiens
aaucaaaacagag

SEQ ID NO: 1571950 - RNA, 13 nt, Homo sapiens
aaucaaaugauuu

SEQ ID NO: 1571951 - RNA, 14 nt, Homo sapiens
aaucaaaugcaauu

SEQ ID NO: 1571952 - RNA, 18 nt, Homo sapiens
aaucaacaaaauggucau

SEQ ID NO: 1571953 - RNA, 23 nt, Homo sapiens
aaucaagcuuuugcuugauccag

SEQ ID NO: 1571954 - RNA, 13 nt, Homo sapiens
aaucaaggaugcu

SEQ ID NO: 1571955 - RNA, 22 nt, Homo sapiens
aaucaaguauuugggaagugaa

SEQ ID NO: 1571956 - RNA, 15 nt, Homo sapiens
aaucaauacaauccu

SEQ ID NO: 1571957 - RNA, 13 nt, Homo sapiens
aaucaaucugcag

SEQ ID NO: 1571958 - RNA, 13 nt, Homo sapiens
aaucacaguauca

SEQ ID NO: 1571959 - RNA, 19 nt, Homo sapiens
aaucacuugccaaaaucca

SEQ ID NO: 1571960 - RNA, 20 nt, Homo sapiens
aaucagacuucacacugcaa

SEQ ID NO: 1571961 - RNA, 21 nt, Homo sapiens
aaucagauugauaacuaugaa

SEQ ID NO: 1571962 - RNA, 12 nt, Homo sapiens
aaucagccauaa

SEQ ID NO: 1571963 - RNA, 19 nt, Homo sapiens
aaucagccauaagaaagca

SEQ ID NO: 1571964 - RNA, 23 nt, Homo sapiens
aaucagccauaagaaagcacuau

SEQ ID NO: 1571965 - RNA, 21 nt, Homo sapiens
aaucaguaugcaaagcaaucu

SEQ ID NO: 1571966 - RNA, 13 nt, Homo sapiens
aaucaucaaguaa

SEQ ID NO: 1571967 - RNA, 18 nt, Homo sapiens
aaucaucaaguaauacaa

SEQ ID NO: 1571968 - RNA, 12 nt, Homo sapiens
aaucaucucacc

SEQ ID NO: 1571969 - RNA, 16 nt, Homo sapiens
aaucaugcucauguau

SEQ ID NO: 1571970 - RNA, 15 nt, Homo sapiens
aaucaugucaggcca

SEQ ID NO: 1571971 - RNA, 16 nt, Homo sapiens
aaucauucauuucgac

SEQ ID NO: 1571972 - RNA, 18 nt, Homo sapiens
aaucauuuagaugcacuu

SEQ ID NO: 1571973 - RNA, 23 nt, Homo sapiens
aaucauuuauuuacaugugauug

SEQ ID NO: 1571974 - RNA, 19 nt, Homo sapiens
aaucauuucuagauuauaa

SEQ ID NO: 1571975 - RNA, 15 nt, Homo sapiens
aaucauuucuauuaa

SEQ ID NO: 1571976 - RNA, 18 nt, Homo sapiens
aaucauuuucauuccuaa

SEQ ID NO: 1571977 - RNA, 20 nt, Homo sapiens
aauccaaauggcgucuggaa

SEQ ID NO: 1571978 - RNA, 19 nt, Homo sapiens
aauccaaggaaacaugcag

SEQ ID NO: 1571979 - RNA, 20 nt, Homo sapiens
aauccacuaugacaucuaag

SEQ ID NO: 1571980 - RNA, 17 nt, Homo sapiens
aauccaggcuguucuca

SEQ ID NO: 1571981 - RNA, 24 nt, Homo sapiens
aauccaguauuauccacaauuauu

SEQ ID NO: 1571982 - RNA, 19 nt, Homo sapiens
aauccagugagcacuagaa

SEQ ID NO: 1571983 - RNA, 15 nt, Homo sapiens
aauccauagauuucg

SEQ ID NO: 1571984 - RNA, 12 nt, Homo sapiens
aauccaugaacc

SEQ ID NO: 1571985 - RNA, 20 nt, Homo sapiens
aauccaugaaccaagaccau

SEQ ID NO: 1571986 - RNA, 11 nt, Homo sapiens
aauccaugcuu

SEQ ID NO: 1571987 - RNA, 22 nt, Homo sapiens
aauccauguaaauugcaaauaa

SEQ ID NO: 1571988 - RNA, 16 nt, Homo sapiens
aauccauuaucgagca

SEQ ID NO: 1571989 - RNA, 17 nt, Homo sapiens
aaucccaacacuuugag

SEQ ID NO: 1571990 - RNA, 15 nt, Homo sapiens
aaucccacaucccag

SEQ ID NO: 1571991 - RNA, 14 nt, Homo sapiens
aaucccagcacuuu

SEQ ID NO: 1571992 - RNA, 18 nt, Homo sapiens
aauccccaacaugcacug

SEQ ID NO: 1571993 - RNA, 16 nt, Homo sapiens
aauccuaaaaaacacu

SEQ ID NO: 1571994 - RNA, 16 nt, Homo sapiens
aauccuccauuugcug

SEQ ID NO: 1571995 - RNA, 16 nt, Homo sapiens
aauccugaugguauca

SEQ ID NO: 1571996 - RNA, 21 nt, Homo sapiens
aauccuggaccaagcacaaaa

SEQ ID NO: 1571997 - RNA, 14 nt, Homo sapiens
aauccuguacaauu

SEQ ID NO: 1571998 - RNA, 16 nt, Homo sapiens
aauccuugcauuuugg

SEQ ID NO: 1571999 - RNA, 13 nt, Homo sapiens
aauccuugcuauu

SEQ ID NO: 1572000 - RNA, 16 nt, Homo sapiens
aaucuaaaauguuuua

SEQ ID NO: 1572001 - RNA, 17 nt, Homo sapiens
aaucuaaaauuucauaa

SEQ ID NO: 1572002 - RNA, 15 nt, Homo sapiens
aaucuaaaucuucag

SEQ ID NO: 1572003 - RNA, 12 nt, Homo sapiens
aaucuacacucc

SEQ ID NO: 1572004 - RNA, 15 nt, Homo sapiens
aaucuaccacuguau

SEQ ID NO: 1572005 - RNA, 14 nt, Homo sapiens
aaucuagaauuuag

SEQ ID NO: 1572006 - RNA, 19 nt, Homo sapiens
aaucuagacauucuuuuaa

SEQ ID NO: 1572007 - RNA, 13 nt, Homo sapiens
aaucucacuacac

SEQ ID NO: 1572008 - RNA, 15 nt, Homo sapiens
acagaaacaaaauca

SEQ ID NO: 1572009 - RNA, 20 nt, Homo sapiens
acagaaagagacuccgucuc

SEQ ID NO: 1572010 - RNA, 19 nt, Homo sapiens
acagaaagcuccuuccaga

SEQ ID NO: 1572011 - RNA, 15 nt, Homo sapiens
acagaaagugacaag

SEQ ID NO: 1572012 - RNA, 12 nt, Homo sapiens
acagaaccacug

SEQ ID NO: 1572013 - RNA, 13 nt, Homo sapiens
acagaaccacuga

SEQ ID NO: 1572014 - RNA, 12 nt, Homo sapiens
acagaagcaaau

SEQ ID NO: 1572015 - RNA, 22 nt, Homo sapiens
acagaagcuuaaaaucugugaa

SEQ ID NO: 1572016 - RNA, 14 nt, Homo sapiens
acagaagggcagug

SEQ ID NO: 1572017 - RNA, 23 nt, Homo sapiens
acagaaugcggccucugagacau

SEQ ID NO: 1572018 - RNA, 14 nt, Homo sapiens
acagacaaagcaua

SEQ ID NO: 1572019 - RNA, 20 nt, Homo sapiens
acagacaggaauuuagaaaa

SEQ ID NO: 1572020 - RNA, 21 nt, Homo sapiens
acagacauggacaaggagcug

SEQ ID NO: 1572021 - RNA, 19 nt, Homo sapiens
acagaccacaugagacuaa

SEQ ID NO: 1572022 - RNA, 16 nt, Homo sapiens
acagaccucaguuuua

SEQ ID NO: 1572023 - RNA, 17 nt, Homo sapiens
acagaccuuaguugaaa

SEQ ID NO: 1572024 - RNA, 22 nt, Homo sapiens
acagacuacauuuucacaacuc

SEQ ID NO: 1572025 - RNA, 13 nt, Homo sapiens
acagacucucaca

SEQ ID NO: 1572026 - RNA, 23 nt, Homo sapiens
acagacucugauucuacagugau

SEQ ID NO: 1572027 - RNA, 19 nt, Homo sapiens
acagagaaagcagaaaauc

SEQ ID NO: 1572028 - RNA, 15 nt, Homo sapiens
acagagaugugcaug

SEQ ID NO: 1572029 - RNA, 18 nt, Homo sapiens
acagagcaggggcuccag

SEQ ID NO: 1572030 - RNA, 22 nt, Homo sapiens
acagagccagcggcuccaacuc

SEQ ID NO: 1572031 - RNA, 16 nt, Homo sapiens
acagagcuucccugac

SEQ ID NO: 1572032 - RNA, 22 nt, Homo sapiens
acagaggagaugccacuucuca

SEQ ID NO: 1572033 - RNA, 20 nt, Homo sapiens
acagaggagcuuuucuggaa

SEQ ID NO: 1572034 - RNA, 22 nt, Homo sapiens
acagaggcauagaauacacauu

SEQ ID NO: 1572035 - RNA, 14 nt, Homo sapiens
acagaguacgugaa

SEQ ID NO: 1572036 - RNA, 23 nt, Homo sapiens
acagaguacgugaaaugcucaag

SEQ ID NO: 1572037 - RNA, 15 nt, Homo sapiens
acagagucucacuuu

SEQ ID NO: 1572038 - RNA, 17 nt, Homo sapiens
acagaguuucaccaugu

SEQ ID NO: 1572039 - RNA, 13 nt, Homo sapiens
acagaugccccag

SEQ ID NO: 1572040 - RNA, 22 nt, Homo sapiens
acagaugugaaaugaauguaau

SEQ ID NO: 1572041 - RNA, 23 nt, Homo sapiens
acagauguuuguuuucaaaauac

SEQ ID NO: 1572042 - RNA, 21 nt, Homo sapiens
acagauuccuggcagagccau

SEQ ID NO: 1572043 - RNA, 13 nt, Homo sapiens
acagcaaaggaac

SEQ ID NO: 1572044 - RNA, 13 nt, Homo sapiens
acagcaacaauga

SEQ ID NO: 1572045 - RNA, 13 nt, Homo sapiens
acagcaacaucca

SEQ ID NO: 1572046 - RNA, 11 nt, Homo sapiens
acagcacacag

SEQ ID NO: 1572047 - RNA, 16 nt, Homo sapiens
acagcacuggggaguc

SEQ ID NO: 1572048 - RNA, 20 nt, Homo sapiens
acagcagcagcaaacaaaua

SEQ ID NO: 1572049 - RNA, 20 nt, Homo sapiens
acagcagcauuuuuauuuca

SEQ ID NO: 1572050 - RNA, 13 nt, Homo sapiens
acagccaccaaga

SEQ ID NO: 1572051 - RNA, 14 nt, Homo sapiens
acagccaccaagaa

SEQ ID NO: 1572052 - RNA, 15 nt, Homo sapiens
acagccaccaagaag

SEQ ID NO: 1572053 - RNA, 13 nt, Homo sapiens
acagccccggggc

SEQ ID NO: 1572054 - RNA, 18 nt, Homo sapiens
acagccccuggagccuca

SEQ ID NO: 1572055 - RNA, 17 nt, Homo sapiens
acagcccucucucucac

SEQ ID NO: 1572056 - RNA, 16 nt, Homo sapiens
acagcccuuccuccca

SEQ ID NO: 1572057 - RNA, 19 nt, Homo sapiens
acagcccuuccucccauuu

SEQ ID NO: 1572058 - RNA, 22 nt, Homo sapiens
acagcccuuccucccauuuccc

SEQ ID NO: 1572059 - RNA, 23 nt, Homo sapiens
acagcccuuccucccauuuccca

SEQ ID NO: 1572060 - RNA, 17 nt, Homo sapiens
acagccucuuacuugcc

SEQ ID NO: 1572061 - RNA, 18 nt, Homo sapiens
acagcgcaugcuggugca

SEQ ID NO: 1572062 - RNA, 16 nt, Homo sapiens
acagcgcuguauuuac

SEQ ID NO: 1572063 - RNA, 20 nt, Homo sapiens
acagcuaaccacuucgcaca

SEQ ID NO: 1572064 - RNA, 17 nt, Homo sapiens
acagcuacucuccccac

SEQ ID NO: 1572065 - RNA, 20 nt, Homo sapiens
acagcuacuugggaggcuga

SEQ ID NO: 1572066 - RNA, 21 nt, Homo sapiens
acagcuauauuugauuaugua

SEQ ID NO: 1572067 - RNA, 13 nt, Homo sapiens
acagcuccuggcc

SEQ ID NO: 1572068 - RNA, 20 nt, Homo sapiens
acagcugaaaagagcuuugu

SEQ ID NO: 1572069 - RNA, 22 nt, Homo sapiens
acagcuguaaucccagcacuuu

SEQ ID NO: 1572070 - RNA, 14 nt, Homo sapiens
acagcuguauuuau

SEQ ID NO: 1572071 - RNA, 14 nt, Homo sapiens
acagcugucauaua

SEQ ID NO: 1572072 - RNA, 20 nt, Homo sapiens
acagcuucacuagaguucuu

SEQ ID NO: 1572073 - RNA, 15 nt, Homo sapiens
acagcuuuccucaaa

SEQ ID NO: 1572074 - RNA, 16 nt, Homo sapiens
acaggaaaggccccaa

SEQ ID NO: 1572075 - RNA, 23 nt, Homo sapiens
acaggaaaggccccaaucuugcc

SEQ ID NO: 1572076 - RNA, 18 nt, Homo sapiens
acaggcacacaggucuca

SEQ ID NO: 1572077 - RNA, 14 nt, Homo sapiens
acaggcaccugcca

SEQ ID NO: 1572078 - RNA, 17 nt, Homo sapiens
acaggcacgugccacca

SEQ ID NO: 1572079 - RNA, 20 nt, Homo sapiens
acaggcgccugccaucaugc

SEQ ID NO: 1572080 - RNA, 17 nt, Homo sapiens
acagggaauacauugua

SEQ ID NO: 1572081 - RNA, 23 nt, Homo sapiens
acagggagaaguagcuaguagca

SEQ ID NO: 1572082 - RNA, 14 nt, Homo sapiens
acagggauuaucau

SEQ ID NO: 1572083 - RNA, 23 nt, Homo sapiens
acaggggugcugcagguggcaga

SEQ ID NO: 1572084 - RNA, 21 nt, Homo sapiens
acaggguccaggaauggugcu

SEQ ID NO: 1572085 - RNA, 19 nt, Homo sapiens
acagggucuugcucugucc

SEQ ID NO: 1572086 - RNA, 21 nt, Homo sapiens
acagggugacucacagccgca

SEQ ID NO: 1572087 - RNA, 14 nt, Homo sapiens
acagguagugggcu

SEQ ID NO: 1572088 - RNA, 13 nt, Homo sapiens
acaggucuaagag

SEQ ID NO: 1572089 - RNA, 20 nt, Homo sapiens
acaggugugaaccacugugc

SEQ ID NO: 1572090 - RNA, 18 nt, Homo sapiens
acagguugggaugggaua

SEQ ID NO: 1572091 - RNA, 22 nt, Homo sapiens
acaguaauaaauuaaaccaaca

SEQ ID NO: 1572092 - RNA, 19 nt, Homo sapiens
acaguaaugaaauguuuac

SEQ ID NO: 1572093 - RNA, 12 nt, Homo sapiens
acaguaauguca

SEQ ID NO: 1572094 - RNA, 17 nt, Homo sapiens
acaguacagaaggcaaa

SEQ ID NO: 1572095 - RNA, 12 nt, Homo sapiens
acaguaccugau

SEQ ID NO: 1572096 - RNA, 22 nt, Homo sapiens
acaguacugauacauaauuuaa

SEQ ID NO: 1572097 - RNA, 15 nt, Homo sapiens
acaguagaacugucu

SEQ ID NO: 1572098 - RNA, 14 nt, Homo sapiens
acaguauccacaau

SEQ ID NO: 1572099 - RNA, 18 nt, Homo sapiens
acaguauuaacaucaaag

SEQ ID NO: 1572100 - RNA, 18 nt, Homo sapiens
acaguauuacaguguccu

SEQ ID NO: 1572101 - RNA, 20 nt, Homo sapiens
acagucaaaauguuugauau

SEQ ID NO: 1572102 - RNA, 11 nt, Homo sapiens
acagucacuga

SEQ ID NO: 1572103 - RNA, 18 nt, Homo sapiens
acagucacuggcccaacc

SEQ ID NO: 1572104 - RNA, 22 nt, Homo sapiens
acagucauaaauacugucaaac

SEQ ID NO: 1572105 - RNA, 14 nt, Homo sapiens
acagucucacuuug

SEQ ID NO: 1572106 - RNA, 13 nt, Homo sapiens
acagucucaggaa

SEQ ID NO: 1572107 - RNA, 22 nt, Homo sapiens
acagucuuguauuaaguuguua

SEQ ID NO: 1572108 - RNA, 15 nt, Homo sapiens
acagugagacuguac

SEQ ID NO: 1572109 - RNA, 12 nt, Homo sapiens
acagugaugcug

SEQ ID NO: 1572110 - RNA, 18 nt, Homo sapiens
acagugggcagcaccuuu

SEQ ID NO: 1572111 - RNA, 18 nt, Homo sapiens
acaguguagaguaacaca

SEQ ID NO: 1572112 - RNA, 15 nt, Homo sapiens
acaguguuucuggcu

SEQ ID NO: 1572113 - RNA, 15 nt, Homo sapiens
acaguuacaguugau

SEQ ID NO: 1572114 - RNA, 14 nt, Homo sapiens
acaguucugugguu

SEQ ID NO: 1572115 - RNA, 19 nt, Homo sapiens
acaguuggaccuuacuuug

SEQ ID NO: 1572116 - RNA, 20 nt, Homo sapiens
acaguuuaggaguacugaua

SEQ ID NO: 1572117 - RNA, 17 nt, Homo sapiens
acauaaaaguuggcuca

SEQ ID NO: 1572118 - RNA, 15 nt, Homo sapiens
acauaauauagcuua

SEQ ID NO: 1572119 - RNA, 18 nt, Homo sapiens
acauaaugaaaauccaug

SEQ ID NO: 1572120 - RNA, 15 nt, Homo sapiens
acauaauugcaugaa

SEQ ID NO: 1572121 - RNA, 15 nt, Homo sapiens
acauacaggauuuga

SEQ ID NO: 1572122 - RNA, 18 nt, Homo sapiens
acauacauauuaucucau

SEQ ID NO: 1572123 - RNA, 23 nt, Homo sapiens
acauaccuggcccugugccuugg

SEQ ID NO: 1572124 - RNA, 18 nt, Homo sapiens
acauacuauucuuacuaa

SEQ ID NO: 1572125 - RNA, 19 nt, Homo sapiens
acauacuccuuccaucaaa

SEQ ID NO: 1572126 - RNA, 14 nt, Homo sapiens
agcuccugggaccc

SEQ ID NO: 1572127 - RNA, 15 nt, Homo sapiens
agcuccuuaaggcuc

SEQ ID NO: 1572128 - RNA, 14 nt, Homo sapiens
agcucucccaguga

SEQ ID NO: 1572129 - RNA, 15 nt, Homo sapiens
agcucucccagugaa

SEQ ID NO: 1572130 - RNA, 12 nt, Homo sapiens
agcucucuggga

SEQ ID NO: 1572131 - RNA, 22 nt, Homo sapiens
agcucuggggugggcaguuuuu

SEQ ID NO: 1572132 - RNA, 18 nt, Homo sapiens
agcucuguauggucagga

SEQ ID NO: 1572133 - RNA, 22 nt, Homo sapiens
agcugaaagauugauuaaugaa

SEQ ID NO: 1572134 - RNA, 23 nt, Homo sapiens
agcugaaauuuuagaaauauuca

SEQ ID NO: 1572135 - RNA, 13 nt, Homo sapiens
agcugacuguucu

SEQ ID NO: 1572136 - RNA, 22 nt, Homo sapiens
agcugagaaauuguaggcaugu

SEQ ID NO: 1572137 - RNA, 15 nt, Homo sapiens
agcugagaagcaaug

SEQ ID NO: 1572138 - RNA, 17 nt, Homo sapiens
agcugagaagcaauggg

SEQ ID NO: 1572139 - RNA, 23 nt, Homo sapiens
agcugagauugcaccacugcacu

SEQ ID NO: 1572140 - RNA, 14 nt, Homo sapiens
agcugauacuuuga

SEQ ID NO: 1572141 - RNA, 14 nt, Homo sapiens
agcugauccagaug

SEQ ID NO: 1572142 - RNA, 21 nt, Homo sapiens
agcugcaaauugccugcaaaa

SEQ ID NO: 1572143 - RNA, 14 nt, Homo sapiens
agcugcaaguguau

SEQ ID NO: 1572144 - RNA, 15 nt, Homo sapiens
agcugccucugcucc

SEQ ID NO: 1572145 - RNA, 23 nt, Homo sapiens
agcugcuccgaggacccaggaaa

SEQ ID NO: 1572146 - RNA, 21 nt, Homo sapiens
agcugcugaaacaacaaauag

SEQ ID NO: 1572147 - RNA, 15 nt, Homo sapiens
agcugcugacugcca

SEQ ID NO: 1572148 - RNA, 12 nt, Homo sapiens
agcugcuuugac

SEQ ID NO: 1572149 - RNA, 18 nt, Homo sapiens
agcuggaaaaaguguccu

SEQ ID NO: 1572150 - RNA, 15 nt, Homo sapiens
agcuggaaaaccucc

SEQ ID NO: 1572151 - RNA, 18 nt, Homo sapiens
agcuggagcccagcguca

SEQ ID NO: 1572152 - RNA, 13 nt, Homo sapiens
agcuggccugaga

SEQ ID NO: 1572153 - RNA, 19 nt, Homo sapiens
agcuggccuucugcuucug

SEQ ID NO: 1572154 - RNA, 20 nt, Homo sapiens
agcuggcuuuucccauuuca

SEQ ID NO: 1572155 - RNA, 14 nt, Homo sapiens
agcugggagcacug

SEQ ID NO: 1572156 - RNA, 15 nt, Homo sapiens
agcuguaaacauauu

SEQ ID NO: 1572157 - RNA, 14 nt, Homo sapiens
agcuguaaccgaua

SEQ ID NO: 1572158 - RNA, 19 nt, Homo sapiens
agcuguaaucccagcacuu

SEQ ID NO: 1572159 - RNA, 23 nt, Homo sapiens
agcuguagaccaccuaauaucaa

SEQ ID NO: 1572160 - RNA, 22 nt, Homo sapiens
agcuguauaaacagaacuccac

SEQ ID NO: 1572161 - RNA, 16 nt, Homo sapiens
agcugucccacaucac

SEQ ID NO: 1572162 - RNA, 23 nt, Homo sapiens
agcugugccgggaggcagccaca

SEQ ID NO: 1572163 - RNA, 17 nt, Homo sapiens
agcuguugugugagguu

SEQ ID NO: 1572164 - RNA, 14 nt, Homo sapiens
agcuuaagaaccau

SEQ ID NO: 1572165 - RNA, 21 nt, Homo sapiens
agcuuaaguccagcucauuuc

SEQ ID NO: 1572166 - RNA, 15 nt, Homo sapiens
agcuuaauagcugua

SEQ ID NO: 1572167 - RNA, 17 nt, Homo sapiens
agcuuaaugauucugau

SEQ ID NO: 1572168 - RNA, 18 nt, Homo sapiens
agcuuagacuaaggccau

SEQ ID NO: 1572169 - RNA, 16 nt, Homo sapiens
agcuuauuaaaacuca

SEQ ID NO: 1572170 - RNA, 21 nt, Homo sapiens
agcuucaggagggaaccagcu

SEQ ID NO: 1572171 - RNA, 23 nt, Homo sapiens
agcuucagugauugggggaggaa

SEQ ID NO: 1572172 - RNA, 18 nt, Homo sapiens
agcuucucuucuuucuga

SEQ ID NO: 1572173 - RNA, 19 nt, Homo sapiens
agcuucugcuuuucugccc

SEQ ID NO: 1572174 - RNA, 17 nt, Homo sapiens
agcuucuucacaggcac

SEQ ID NO: 1572175 - RNA, 21 nt, Homo sapiens
agcuugagggugacuauggag

SEQ ID NO: 1572176 - RNA, 22 nt, Homo sapiens
agcuugcacagccaacgagaca

SEQ ID NO: 1572177 - RNA, 17 nt, Homo sapiens
agcuugcucuucagugg

SEQ ID NO: 1572178 - RNA, 22 nt, Homo sapiens
agcuuuaauguuacauaguaaa

SEQ ID NO: 1572179 - RNA, 22 nt, Homo sapiens
agcuuucccugccucucaucaa

SEQ ID NO: 1572180 - RNA, 21 nt, Homo sapiens
agcuuuccuuucuccaugugu

SEQ ID NO: 1572181 - RNA, 12 nt, Homo sapiens
agcuuucugcca

SEQ ID NO: 1572182 - RNA, 15 nt, Homo sapiens
agcuuuggaccuaau

SEQ ID NO: 1572183 - RNA, 19 nt, Homo sapiens
agcuuuggaccuaauccaa

SEQ ID NO: 1572184 - RNA, 19 nt, Homo sapiens
agcuuuuauggaugauuaa

SEQ ID NO: 1572185 - RNA, 19 nt, Homo sapiens
agcuuuuauugucacagau

SEQ ID NO: 1572186 - RNA, 17 nt, Homo sapiens
aggaaaaacaaacucua

SEQ ID NO: 1572187 - RNA, 20 nt, Homo sapiens
aggaaaaguccacaagaaca

SEQ ID NO: 1572188 - RNA, 22 nt, Homo sapiens
aggaaacaaagauuugugguaa

SEQ ID NO: 1572189 - RNA, 22 nt, Homo sapiens
aggaaaggauuuuaccaaagca

SEQ ID NO: 1572190 - RNA, 19 nt, Homo sapiens
aggaaauggcuuugugauu

SEQ ID NO: 1572191 - RNA, 23 nt, Homo sapiens
aggaacaaagacaaccacuggga

SEQ ID NO: 1572192 - RNA, 14 nt, Homo sapiens
aggaacaaagacag

SEQ ID NO: 1572193 - RNA, 13 nt, Homo sapiens
aggaacagcacug

SEQ ID NO: 1572194 - RNA, 19 nt, Homo sapiens
aggaacaguauuacagugu

SEQ ID NO: 1572195 - RNA, 15 nt, Homo sapiens
aggaaccacaauguu

SEQ ID NO: 1572196 - RNA, 20 nt, Homo sapiens
aggaacgugccaccaugacu

SEQ ID NO: 1572197 - RNA, 22 nt, Homo sapiens
aggaagaacggggcucuucuca

SEQ ID NO: 1572198 - RNA, 20 nt, Homo sapiens
aggaagacuugaagcacaga

SEQ ID NO: 1572199 - RNA, 11 nt, Homo sapiens
aggaagcccag

SEQ ID NO: 1572200 - RNA, 20 nt, Homo sapiens
aggaagggugaagccuuauu

SEQ ID NO: 1572201 - RNA, 14 nt, Homo sapiens
aggaagguguuuca

SEQ ID NO: 1572202 - RNA, 22 nt, Homo sapiens
aggaagucauccagucuauuca

SEQ ID NO: 1572203 - RNA, 14 nt, Homo sapiens
aggaaguggcucag

SEQ ID NO: 1572204 - RNA, 19 nt, Homo sapiens
aggaauacaauauauagcu

SEQ ID NO: 1572205 - RNA, 16 nt, Homo sapiens
aggaauauacauaguc

SEQ ID NO: 1572206 - RNA, 18 nt, Homo sapiens
aggaauccccaacaugca

SEQ ID NO: 1572207 - RNA, 22 nt, Homo sapiens
aggaaucuguuucucugcuguc

SEQ ID NO: 1572208 - RNA, 14 nt, Homo sapiens
aggaauuacgugcu

SEQ ID NO: 1572209 - RNA, 18 nt, Homo sapiens
aggaauuauagaccucua

SEQ ID NO: 1572210 - RNA, 15 nt, Homo sapiens
aggaauuguuuuuau

SEQ ID NO: 1572211 - RNA, 19 nt, Homo sapiens
aggaauuucaccuguaaac

SEQ ID NO: 1572212 - RNA, 18 nt, Homo sapiens
aggacaagaggagcauga

SEQ ID NO: 1572213 - RNA, 13 nt, Homo sapiens
aggacaaguuuua

SEQ ID NO: 1572214 - RNA, 23 nt, Homo sapiens
aggacacagauaggauggggugu

SEQ ID NO: 1572215 - RNA, 21 nt, Homo sapiens
aggacacccucccuccagggu

SEQ ID NO: 1572216 - RNA, 16 nt, Homo sapiens
aggacagccaccaaga

SEQ ID NO: 1572217 - RNA, 14 nt, Homo sapiens
aggaccaacaucca

SEQ ID NO: 1572218 - RNA, 15 nt, Homo sapiens
aggaccccucgccuu

SEQ ID NO: 1572219 - RNA, 23 nt, Homo sapiens
aggacucaguauuauuucaagac

SEQ ID NO: 1572220 - RNA, 13 nt, Homo sapiens
aggacucuuccac

SEQ ID NO: 1572221 - RNA, 19 nt, Homo sapiens
aggacuggugccuggcaca

SEQ ID NO: 1572222 - RNA, 17 nt, Homo sapiens
aggagaaaaagcuuaau

SEQ ID NO: 1572223 - RNA, 14 nt, Homo sapiens
aggagaaggggaag

SEQ ID NO: 1572224 - RNA, 13 nt, Homo sapiens
aggagaaggugcc

SEQ ID NO: 1572225 - RNA, 11 nt, Homo sapiens
aggagaaucuc

SEQ ID NO: 1572226 - RNA, 20 nt, Homo sapiens
aggagacaggucaguaguca

SEQ ID NO: 1572227 - RNA, 15 nt, Homo sapiens
aggagacucaccucu

SEQ ID NO: 1572228 - RNA, 22 nt, Homo sapiens
aggagacucaccucugccucaa

SEQ ID NO: 1572229 - RNA, 15 nt, Homo sapiens
aggagacuuucaugc

SEQ ID NO: 1572230 - RNA, 19 nt, Homo sapiens
aggagaugccacuucucac

SEQ ID NO: 1572231 - RNA, 20 nt, Homo sapiens
aggagcaacagcgauggcag

SEQ ID NO: 1572232 - RNA, 22 nt, Homo sapiens
aggagccaggccuugggcuccu

SEQ ID NO: 1572233 - RNA, 14 nt, Homo sapiens
aggagcccuucuau

SEQ ID NO: 1572234 - RNA, 15 nt, Homo sapiens
aggagccucacuggg

SEQ ID NO: 1572235 - RNA, 20 nt, Homo sapiens
aggagccucauccagccuca

SEQ ID NO: 1572236 - RNA, 12 nt, Homo sapiens
aggagcuccuuc

SEQ ID NO: 1572237 - RNA, 18 nt, Homo sapiens
aggagcugauacuuugac

SEQ ID NO: 1572238 - RNA, 16 nt, Homo sapiens
aggagcuggaaccaug

SEQ ID NO: 1572239 - RNA, 12 nt, Homo sapiens
aggaggacaaaa

SEQ ID NO: 1572240 - RNA, 17 nt, Homo sapiens
aggaggcccacuguguc

SEQ ID NO: 1572241 - RNA, 21 nt, Homo sapiens
aggaggccuccaucucaugua

SEQ ID NO: 1572242 - RNA, 18 nt, Homo sapiens
aggagggaggugcuucua

SEQ ID NO: 1572243 - RNA, 23 nt, Homo sapiens
aggagggaugcguguuccagcca

SEQ ID NO: 1572244 - RNA, 14 nt, Homo sapiens
aguggagacagacu

SEQ ID NO: 1572245 - RNA, 16 nt, Homo sapiens
aguggauuacugccau

SEQ ID NO: 1572246 - RNA, 13 nt, Homo sapiens
aguggccacucag

SEQ ID NO: 1572247 - RNA, 18 nt, Homo sapiens
aguggcucaugcccauaa

SEQ ID NO: 1572248 - RNA, 14 nt, Homo sapiens
aguggcucaugccu

SEQ ID NO: 1572249 - RNA, 17 nt, Homo sapiens
aguggcuucaucuguca

SEQ ID NO: 1572250 - RNA, 15 nt, Homo sapiens
agugggacuguggug

SEQ ID NO: 1572251 - RNA, 20 nt, Homo sapiens
agugggaucugucacaccag

SEQ ID NO: 1572252 - RNA, 23 nt, Homo sapiens
aguggggcccuucucugcaguca

SEQ ID NO: 1572253 - RNA, 12 nt, Homo sapiens
aguggggugcug

SEQ ID NO: 1572254 - RNA, 12 nt, Homo sapiens
agugggugguga

SEQ ID NO: 1572255 - RNA, 21 nt, Homo sapiens
aguggguuugccccaucacuu

SEQ ID NO: 1572256 - RNA, 12 nt, Homo sapiens
aguggugguaug

SEQ ID NO: 1572257 - RNA, 18 nt, Homo sapiens
agugguuaaaacauagcu

SEQ ID NO: 1572258 - RNA, 15 nt, Homo sapiens
aguguaaacaccaua

SEQ ID NO: 1572259 - RNA, 13 nt, Homo sapiens
aguguaugauuac

SEQ ID NO: 1572260 - RNA, 23 nt, Homo sapiens
aguguauuuauuuuacagcucau

SEQ ID NO: 1572261 - RNA, 13 nt, Homo sapiens
agugucaacucuu

SEQ ID NO: 1572262 - RNA, 20 nt, Homo sapiens
agugucauccucacagugaa

SEQ ID NO: 1572263 - RNA, 21 nt, Homo sapiens
agugucauuuugaucugcuuu

SEQ ID NO: 1572264 - RNA, 20 nt, Homo sapiens
aguguccccuuauacagugg

SEQ ID NO: 1572265 - RNA, 17 nt, Homo sapiens
aguguccuaagugcuaa

SEQ ID NO: 1572266 - RNA, 16 nt, Homo sapiens
aguguccuaugcaaua

SEQ ID NO: 1572267 - RNA, 14 nt, Homo sapiens
agugugaccacuga

SEQ ID NO: 1572268 - RNA, 13 nt, Homo sapiens
agugugcugggca

SEQ ID NO: 1572269 - RNA, 20 nt, Homo sapiens
aguguggaggagaggggugg

SEQ ID NO: 1572270 - RNA, 20 nt, Homo sapiens
aguguggggauuuucacuga

SEQ ID NO: 1572271 - RNA, 11 nt, Homo sapiens
aguguguaaaa

SEQ ID NO: 1572272 - RNA, 13 nt, Homo sapiens
aguguguaaaauu

SEQ ID NO: 1572273 - RNA, 15 nt, Homo sapiens
aguguguacuucuuc

SEQ ID NO: 1572274 - RNA, 21 nt, Homo sapiens
aguguguguuuguguguuuca

SEQ ID NO: 1572275 - RNA, 18 nt, Homo sapiens
aguguucacaacagugaa

SEQ ID NO: 1572276 - RNA, 16 nt, Homo sapiens
aguguuccccuuccac

SEQ ID NO: 1572277 - RNA, 15 nt, Homo sapiens
aguguucccgugccu

SEQ ID NO: 1572278 - RNA, 13 nt, Homo sapiens
aguguucugggug

SEQ ID NO: 1572279 - RNA, 17 nt, Homo sapiens
aguguuuuuauugcucg

SEQ ID NO: 1572280 - RNA, 12 nt, Homo sapiens
aguuaacuauug

SEQ ID NO: 1572281 - RNA, 23 nt, Homo sapiens
aguuaacugugaaauaccacaag

SEQ ID NO: 1572282 - RNA, 13 nt, Homo sapiens
aguuaagugugga

SEQ ID NO: 1572283 - RNA, 15 nt, Homo sapiens
aguuacugugguaug

SEQ ID NO: 1572284 - RNA, 13 nt, Homo sapiens
aguuagauucacu

SEQ ID NO: 1572285 - RNA, 17 nt, Homo sapiens
aguuauaggauuuucac

SEQ ID NO: 1572286 - RNA, 20 nt, Homo sapiens
aguuaugccucugacagucc

SEQ ID NO: 1572287 - RNA, 19 nt, Homo sapiens
aguuaugcugucauggucc

SEQ ID NO: 1572288 - RNA, 19 nt, Homo sapiens
aguuauggcuauaggugcu

SEQ ID NO: 1572289 - RNA, 20 nt, Homo sapiens
aguuauuacauguaauuuga

SEQ ID NO: 1572290 - RNA, 21 nt, Homo sapiens
aguucacauacaaaucaucca

SEQ ID NO: 1572291 - RNA, 14 nt, Homo sapiens
aguucagcuccuuc

SEQ ID NO: 1572292 - RNA, 17 nt, Homo sapiens
aguucagcuccuuccac

SEQ ID NO: 1572293 - RNA, 19 nt, Homo sapiens
aguucaugcagcuguggca

SEQ ID NO: 1572294 - RNA, 15 nt, Homo sapiens
aguucauggauaugu

SEQ ID NO: 1572295 - RNA, 19 nt, Homo sapiens
aguuccagaaaaccucucc

SEQ ID NO: 1572296 - RNA, 17 nt, Homo sapiens
aguuccccugucugucc

SEQ ID NO: 1572297 - RNA, 17 nt, Homo sapiens
aguuccgccucccgggu

SEQ ID NO: 1572298 - RNA, 17 nt, Homo sapiens
aguuccucccccaguuc

SEQ ID NO: 1572299 - RNA, 23 nt, Homo sapiens
aguuccuuaucccucucuucccc

SEQ ID NO: 1572300 - RNA, 19 nt, Homo sapiens
aguucuacauuauucuuca

SEQ ID NO: 1572301 - RNA, 15 nt, Homo sapiens
aguucugcaaaauac

SEQ ID NO: 1572302 - RNA, 14 nt, Homo sapiens
aguugaagacagcu

SEQ ID NO: 1572303 - RNA, 10 nt, Homo sapiens
aguugagauu

SEQ ID NO: 1572304 - RNA, 13 nt, Homo sapiens
aguugcaguauug

SEQ ID NO: 1572305 - RNA, 17 nt, Homo sapiens
aguugccuaagcauugc

SEQ ID NO: 1572306 - RNA, 23 nt, Homo sapiens
aguugcuaacuuaaaaaacugca

SEQ ID NO: 1572307 - RNA, 18 nt, Homo sapiens
aguugcuguugugugauc

SEQ ID NO: 1572308 - RNA, 17 nt, Homo sapiens
aguuggacucucaggga

SEQ ID NO: 1572309 - RNA, 14 nt, Homo sapiens
aguuggcacuguaa

SEQ ID NO: 1572310 - RNA, 19 nt, Homo sapiens
aguuggggguguggcucug

SEQ ID NO: 1572311 - RNA, 21 nt, Homo sapiens
aguuggggguguggcucugcc

SEQ ID NO: 1572312 - RNA, 20 nt, Homo sapiens
aguuguguuccugacacuca

SEQ ID NO: 1572313 - RNA, 15 nt, Homo sapiens
aguuguuaauaaaag

SEQ ID NO: 1572314 - RNA, 20 nt, Homo sapiens
aguuguucuaguaacaauac

SEQ ID NO: 1572315 - RNA, 22 nt, Homo sapiens
aguuguuuuaauaacuuaucua

SEQ ID NO: 1572316 - RNA, 16 nt, Homo sapiens
aguuuauuacaaugua

SEQ ID NO: 1572317 - RNA, 16 nt, Homo sapiens
aguuuccucaucugca

SEQ ID NO: 1572318 - RNA, 22 nt, Homo sapiens
aguuucugaggaucagcacugc

SEQ ID NO: 1572319 - RNA, 19 nt, Homo sapiens
aguuucuggauuagcuuuu

SEQ ID NO: 1572320 - RNA, 17 nt, Homo sapiens
aguuucuugaggccaaa

SEQ ID NO: 1572321 - RNA, 20 nt, Homo sapiens
aguuugaagcacaacucccu

SEQ ID NO: 1572322 - RNA, 14 nt, Homo sapiens
aguuugaagcccaa

SEQ ID NO: 1572323 - RNA, 13 nt, Homo sapiens
aguuugcuugaua

SEQ ID NO: 1572324 - RNA, 21 nt, Homo sapiens
aguuuggaauuauuguagaca

SEQ ID NO: 1572325 - RNA, 16 nt, Homo sapiens
aguuuggagucacugu

SEQ ID NO: 1572326 - RNA, 15 nt, Homo sapiens
aguuugggaggcuga

SEQ ID NO: 1572327 - RNA, 16 nt, Homo sapiens
aguuuuaaacccaaaa

SEQ ID NO: 1572328 - RNA, 15 nt, Homo sapiens
aguuuuaaguccagc

SEQ ID NO: 1572329 - RNA, 20 nt, Homo sapiens
aguuuuaauaagaacagauc

SEQ ID NO: 1572330 - RNA, 21 nt, Homo sapiens
aguuuuaauaagaacagauca

SEQ ID NO: 1572331 - RNA, 17 nt, Homo sapiens
aguuuucuaaacucaau

SEQ ID NO: 1572332 - RNA, 21 nt, Homo sapiens
aguuuucuuuccuccuuuccu

SEQ ID NO: 1572333 - RNA, 15 nt, Homo sapiens
aguuuugcacuuuua

SEQ ID NO: 1572334 - RNA, 20 nt, Homo sapiens
aguuuugcuuuaguacaaua

SEQ ID NO: 1572335 - RNA, 10 nt, Homo sapiens
aguuuuuacu

SEQ ID NO: 1572336 - RNA, 13 nt, Homo sapiens
aguuuuuauacau

SEQ ID NO: 1572337 - RNA, 19 nt, Homo sapiens
auaaaaaaauuuuaauucc

SEQ ID NO: 1572338 - RNA, 17 nt, Homo sapiens
auaaaaaccauggaacu

SEQ ID NO: 1572339 - RNA, 19 nt, Homo sapiens
auaaaaagauaaucucagu

SEQ ID NO: 1572340 - RNA, 19 nt, Homo sapiens
auaaaauauuauugaacua

SEQ ID NO: 1572341 - RNA, 17 nt, Homo sapiens
auaaaaucagugugcuu

SEQ ID NO: 1572342 - RNA, 21 nt, Homo sapiens
auaaaauggaauaacauauca

SEQ ID NO: 1572343 - RNA, 21 nt, Homo sapiens
auaaacagaacuccacugcaa

SEQ ID NO: 1572344 - RNA, 18 nt, Homo sapiens
auaaacaguagugauagu

SEQ ID NO: 1572345 - RNA, 16 nt, Homo sapiens
auaaacagucacugga

SEQ ID NO: 1572346 - RNA, 18 nt, Homo sapiens
auaaacaugcuugcauua

SEQ ID NO: 1572347 - RNA, 11 nt, Homo sapiens
auaaaccacaa

SEQ ID NO: 1572348 - RNA, 18 nt, Homo sapiens
auaaaccacaagcaucuc

SEQ ID NO: 1572349 - RNA, 19 nt, Homo sapiens
auaaaccauggccaauuca

SEQ ID NO: 1572350 - RNA, 19 nt, Homo sapiens
auaaaccgaaaguguuaca

SEQ ID NO: 1572351 - RNA, 17 nt, Homo sapiens
auaaaccugaccuccuu

SEQ ID NO: 1572352 - RNA, 17 nt, Homo sapiens
auaaacguccuacugua

SEQ ID NO: 1572353 - RNA, 12 nt, Homo sapiens
auaaacuaccaa

SEQ ID NO: 1572354 - RNA, 16 nt, Homo sapiens
auaaacucauuuaacu

SEQ ID NO: 1572355 - RNA, 12 nt, Homo sapiens
auaaagacuuuu

SEQ ID NO: 1572356 - RNA, 16 nt, Homo sapiens
auaaagagacugagcc

SEQ ID NO: 1572357 - RNA, 17 nt, Homo sapiens
auaaagauugaguuugc

SEQ ID NO: 1572358 - RNA, 13 nt, Homo sapiens
auaaagcugugcu

SEQ ID NO: 1572359 - RNA, 14 nt, Homo sapiens
auaaaggaugugau

SEQ ID NO: 1572360 - RNA, 18 nt, Homo sapiens
auaaauaaauaagggaaa

SEQ ID NO: 1572361 - RNA, 16 nt, Homo sapiens
auaaauauauauucua

SEQ ID NO: 1572362 - RNA, 19 nt, Homo sapiens
auaaauauaucuaccccag

SEQ ID NO: 1572363 - RNA, 13 nt, Homo sapiens
aucccaacuuccu

SEQ ID NO: 1572364 - RNA, 18 nt, Homo sapiens
aucccacaucccaguuuc

SEQ ID NO: 1572365 - RNA, 12 nt, Homo sapiens
aucccagcacuu

SEQ ID NO: 1572366 - RNA, 14 nt, Homo sapiens
aucccagcacuuug

SEQ ID NO: 1572367 - RNA, 22 nt, Homo sapiens
auccccaacugcgacugugacc

SEQ ID NO: 1572368 - RNA, 14 nt, Homo sapiens
auccccacaaucug

SEQ ID NO: 1572369 - RNA, 14 nt, Homo sapiens
auccccacccaguc

SEQ ID NO: 1572370 - RNA, 20 nt, Homo sapiens
auccccagccacaacugcca

SEQ ID NO: 1572371 - RNA, 12 nt, Homo sapiens
auccccaucucc

SEQ ID NO: 1572372 - RNA, 21 nt, Homo sapiens
aucccccgccuuuaguucucc

SEQ ID NO: 1572373 - RNA, 17 nt, Homo sapiens
auccccuggcuccagag

SEQ ID NO: 1572374 - RNA, 17 nt, Homo sapiens
aucccguaucacagugu

SEQ ID NO: 1572375 - RNA, 16 nt, Homo sapiens
aucccuauagaccacu

SEQ ID NO: 1572376 - RNA, 18 nt, Homo sapiens
aucccuauagaccacugg

SEQ ID NO: 1572377 - RNA, 24 nt, Homo sapiens
aucccucuaauuucucauuuaugc

SEQ ID NO: 1572378 - RNA, 15 nt, Homo sapiens
aucccugaaauccag

SEQ ID NO: 1572379 - RNA, 16 nt, Homo sapiens
aucccugccuguuaag

SEQ ID NO: 1572380 - RNA, 21 nt, Homo sapiens
aucccuggguucaacucugcu

SEQ ID NO: 1572381 - RNA, 18 nt, Homo sapiens
aucccuuaacaguuguau

SEQ ID NO: 1572382 - RNA, 20 nt, Homo sapiens
aucccuuuuucaaugaauuu

SEQ ID NO: 1572383 - RNA, 13 nt, Homo sapiens
auccuaccuugcu

SEQ ID NO: 1572384 - RNA, 14 nt, Homo sapiens
auccuauaagcuua

SEQ ID NO: 1572385 - RNA, 20 nt, Homo sapiens
auccuaucacagucuacuga

SEQ ID NO: 1572386 - RNA, 21 nt, Homo sapiens
auccuaucacagucuacugac

SEQ ID NO: 1572387 - RNA, 18 nt, Homo sapiens
auccucaaacgacagagg

SEQ ID NO: 1572388 - RNA, 20 nt, Homo sapiens
auccucugcuaccaucucau

SEQ ID NO: 1572389 - RNA, 13 nt, Homo sapiens
auccugaccagcu

SEQ ID NO: 1572390 - RNA, 19 nt, Homo sapiens
auccugcaauuccacuuau

SEQ ID NO: 1572391 - RNA, 18 nt, Homo sapiens
auccugcagggcuucucc

SEQ ID NO: 1572392 - RNA, 19 nt, Homo sapiens
auccugcucuuuugugaug

SEQ ID NO: 1572393 - RNA, 14 nt, Homo sapiens
auccuggaaggaca

SEQ ID NO: 1572394 - RNA, 23 nt, Homo sapiens
auccuggaaggacacagugauga

SEQ ID NO: 1572395 - RNA, 18 nt, Homo sapiens
auccuggcaacucaaggc

SEQ ID NO: 1572396 - RNA, 17 nt, Homo sapiens
auccugucucuaaaaag

SEQ ID NO: 1572397 - RNA, 17 nt, Homo sapiens
auccuuaaaacaauucu

SEQ ID NO: 1572398 - RNA, 22 nt, Homo sapiens
auccuugccaauagugucaucc

SEQ ID NO: 1572399 - RNA, 20 nt, Homo sapiens
aucgauccuggauucacuca

SEQ ID NO: 1572400 - RNA, 18 nt, Homo sapiens
aucguuaagcacaagaca

SEQ ID NO: 1572401 - RNA, 14 nt, Homo sapiens
aucguuuugcccga

SEQ ID NO: 1572402 - RNA, 13 nt, Homo sapiens
aucuaaccacuua

SEQ ID NO: 1572403 - RNA, 23 nt, Homo sapiens
aucuaaugacaugccuauaugag

SEQ ID NO: 1572404 - RNA, 20 nt, Homo sapiens
aucuacaaaaauuuauuaua

SEQ ID NO: 1572405 - RNA, 13 nt, Homo sapiens
aucuacacauguu

SEQ ID NO: 1572406 - RNA, 23 nt, Homo sapiens
aucuacaccaaugaaaacaugua

SEQ ID NO: 1572407 - RNA, 12 nt, Homo sapiens
aucuacacucca

SEQ ID NO: 1572408 - RNA, 17 nt, Homo sapiens
aucuacacuccagugag

SEQ ID NO: 1572409 - RNA, 17 nt, Homo sapiens
aucuacaugucuagaga

SEQ ID NO: 1572410 - RNA, 13 nt, Homo sapiens
aucuaccaagaac

SEQ ID NO: 1572411 - RNA, 13 nt, Homo sapiens
aucuaccugcuug

SEQ ID NO: 1572412 - RNA, 14 nt, Homo sapiens
aucuacuaauucca

SEQ ID NO: 1572413 - RNA, 23 nt, Homo sapiens
aucuacuggaaauguagcacuua

SEQ ID NO: 1572414 - RNA, 17 nt, Homo sapiens
aucuagaauucacugag

SEQ ID NO: 1572415 - RNA, 19 nt, Homo sapiens
aucuauaauuuaccuaaga

SEQ ID NO: 1572416 - RNA, 22 nt, Homo sapiens
aucuauagcuaaguacacaaua

SEQ ID NO: 1572417 - RNA, 16 nt, Homo sapiens
aucuaucuacaaagaa

SEQ ID NO: 1572418 - RNA, 12 nt, Homo sapiens
aucuaugggaga

SEQ ID NO: 1572419 - RNA, 14 nt, Homo sapiens
aucucaaaacugca

SEQ ID NO: 1572420 - RNA, 22 nt, Homo sapiens
aucucaaacuacuggcaauuug

SEQ ID NO: 1572421 - RNA, 17 nt, Homo sapiens
aucucaaagaaggcauu

SEQ ID NO: 1572422 - RNA, 21 nt, Homo sapiens
aucucaccuucagucaagaaa

SEQ ID NO: 1572423 - RNA, 15 nt, Homo sapiens
aucucagaugcaguu

SEQ ID NO: 1572424 - RNA, 19 nt, Homo sapiens
aucucagcauuuuuauucc

SEQ ID NO: 1572425 - RNA, 17 nt, Homo sapiens
aucucagcucaccucaa

SEQ ID NO: 1572426 - RNA, 15 nt, Homo sapiens
aucucaguaccccau

SEQ ID NO: 1572427 - RNA, 18 nt, Homo sapiens
aucucauuuuacacaaag

SEQ ID NO: 1572428 - RNA, 23 nt, Homo sapiens
aucuccaauggaaagcuuuucag

SEQ ID NO: 1572429 - RNA, 17 nt, Homo sapiens
aucuccaggcuuucaau

SEQ ID NO: 1572430 - RNA, 18 nt, Homo sapiens
aucucccagugacaacau

SEQ ID NO: 1572431 - RNA, 15 nt, Homo sapiens
aucucccucuaagca

SEQ ID NO: 1572432 - RNA, 22 nt, Homo sapiens
aucucuaacauaugauacugau

SEQ ID NO: 1572433 - RNA, 13 nt, Homo sapiens
aucucuacugcuu

SEQ ID NO: 1572434 - RNA, 21 nt, Homo sapiens
aucucuccagccccugacccc

SEQ ID NO: 1572435 - RNA, 18 nt, Homo sapiens
aucucuccccauauauaa

SEQ ID NO: 1572436 - RNA, 19 nt, Homo sapiens
aucucuuaugggauuacau

SEQ ID NO: 1572437 - RNA, 19 nt, Homo sapiens
aucucuucaugcuugacau

SEQ ID NO: 1572438 - RNA, 15 nt, Homo sapiens
aucucuuccccagag

SEQ ID NO: 1572439 - RNA, 21 nt, Homo sapiens
aucucuuccuccgaggccagu

SEQ ID NO: 1572440 - RNA, 17 nt, Homo sapiens
aucucuucuuauacaga

SEQ ID NO: 1572441 - RNA, 18 nt, Homo sapiens
aucugaagaaacuuccca

SEQ ID NO: 1572442 - RNA, 12 nt, Homo sapiens
aucugaccaaac

SEQ ID NO: 1572443 - RNA, 12 nt, Homo sapiens
aucugagugaaa

SEQ ID NO: 1572444 - RNA, 15 nt, Homo sapiens
aucugauuaauccau

SEQ ID NO: 1572445 - RNA, 20 nt, Homo sapiens
aucugauuguugucaggcca

SEQ ID NO: 1572446 - RNA, 13 nt, Homo sapiens
aucugcacaguca

SEQ ID NO: 1572447 - RNA, 17 nt, Homo sapiens
aucugcaggacagaggg

SEQ ID NO: 1572448 - RNA, 15 nt, Homo sapiens
aucugcaguuuaaca

SEQ ID NO: 1572449 - RNA, 19 nt, Homo sapiens
aucugcauaaauuuuacag

SEQ ID NO: 1572450 - RNA, 23 nt, Homo sapiens
aucugcauaaauuuuacaguaga

SEQ ID NO: 1572451 - RNA, 18 nt, Homo sapiens
aucugcauuuaccacugu

SEQ ID NO: 1572452 - RNA, 17 nt, Homo sapiens
aucugccuuaaaaccaa

SEQ ID NO: 1572453 - RNA, 19 nt, Homo sapiens
aucugcuguuaacugcaac

SEQ ID NO: 1572454 - RNA, 20 nt, Homo sapiens
aucuggaacaacuuguagca

SEQ ID NO: 1572455 - RNA, 21 nt, Homo sapiens
aucugggagacccugaacuca

SEQ ID NO: 1572456 - RNA, 14 nt, Homo sapiens
aucuguaaagauaa

SEQ ID NO: 1572457 - RNA, 13 nt, Homo sapiens
aucuguaccucug

SEQ ID NO: 1572458 - RNA, 18 nt, Homo sapiens
aucuguauaauacuuugu

SEQ ID NO: 1572459 - RNA, 15 nt, Homo sapiens
aucugucaucucucu

SEQ ID NO: 1572460 - RNA, 20 nt, Homo sapiens
aucuguccguucacaugugu

SEQ ID NO: 1572461 - RNA, 16 nt, Homo sapiens
aucugucucuucuaca

SEQ ID NO: 1572462 - RNA, 15 nt, Homo sapiens
aucugucugugcaca

SEQ ID NO: 1572463 - RNA, 17 nt, Homo sapiens
aucugucugugcacaug

SEQ ID NO: 1572464 - RNA, 19 nt, Homo sapiens
aucugucuuuuauuuaaca

SEQ ID NO: 1572465 - RNA, 23 nt, Homo sapiens
aucugugaggggcucucucauga

SEQ ID NO: 1572466 - RNA, 17 nt, Homo sapiens
aucugugccccaugccu

SEQ ID NO: 1572467 - RNA, 21 nt, Homo sapiens
aucugugggucugggagucac

SEQ ID NO: 1572468 - RNA, 20 nt, Homo sapiens
aucuguuuugaaggcaaaau

SEQ ID NO: 1572469 - RNA, 21 nt, Homo sapiens
aucuuaagcaguaaucuguca

SEQ ID NO: 1572470 - RNA, 17 nt, Homo sapiens
aucuuacaaaauacaca

SEQ ID NO: 1572471 - RNA, 19 nt, Homo sapiens
aucuuaguucuguauauaa

SEQ ID NO: 1572472 - RNA, 15 nt, Homo sapiens
aucuucacugcaauu

SEQ ID NO: 1572473 - RNA, 15 nt, Homo sapiens
aucuucacugccaag

SEQ ID NO: 1572474 - RNA, 13 nt, Homo sapiens
aucuuccauuccu

SEQ ID NO: 1572475 - RNA, 16 nt, Homo sapiens
aucuuccuguuuaaaa

SEQ ID NO: 1572476 - RNA, 16 nt, Homo sapiens
aucuucguacaugaau

SEQ ID NO: 1572477 - RNA, 22 nt, Homo sapiens
aucuucuaaacccaauccaaau

SEQ ID NO: 1572478 - RNA, 14 nt, Homo sapiens
aucuucucccccac

SEQ ID NO: 1572479 - RNA, 22 nt, Homo sapiens
aucuugaaauuaagaaggcaaa

SEQ ID NO: 1572480 - RNA, 19 nt, Homo sapiens
aucuugcuaccaguauuua

SEQ ID NO: 1572481 - RNA, 16 nt, Homo sapiens
auucuuguaucaaauu

SEQ ID NO: 1572482 - RNA, 21 nt, Homo sapiens
auucuuguaucaaauucaaua

SEQ ID NO: 1572483 - RNA, 16 nt, Homo sapiens
auucuuguauuauaau

SEQ ID NO: 1572484 - RNA, 22 nt, Homo sapiens
auucuuguuggagacaugggau

SEQ ID NO: 1572485 - RNA, 20 nt, Homo sapiens
auucuuucccaauucacauc

SEQ ID NO: 1572486 - RNA, 13 nt, Homo sapiens
auucuuuccccag

SEQ ID NO: 1572487 - RNA, 15 nt, Homo sapiens
auucuuuccccagag

SEQ ID NO: 1572488 - RNA, 15 nt, Homo sapiens
auucuuugaccuguu

SEQ ID NO: 1572489 - RNA, 15 nt, Homo sapiens
auucuuuugccacau

SEQ ID NO: 1572490 - RNA, 13 nt, Homo sapiens
auugaaaagcaca

SEQ ID NO: 1572491 - RNA, 22 nt, Homo sapiens
auugaaaauuuuuaaauauuca

SEQ ID NO: 1572492 - RNA, 17 nt, Homo sapiens
auugaaacacagaguug

SEQ ID NO: 1572493 - RNA, 13 nt, Homo sapiens
auugaaaugcauu

SEQ ID NO: 1572494 - RNA, 17 nt, Homo sapiens
auugaaguccuccagac

SEQ ID NO: 1572495 - RNA, 19 nt, Homo sapiens
auugaaguccuccagacaa

SEQ ID NO: 1572496 - RNA, 15 nt, Homo sapiens
auugaaugugaaaca

SEQ ID NO: 1572497 - RNA, 15 nt, Homo sapiens
auugaauuucacugu

SEQ ID NO: 1572498 - RNA, 24 nt, Homo sapiens
auugacaugugccagggcaaugau

SEQ ID NO: 1572499 - RNA, 20 nt, Homo sapiens
auugagaaaaauauauacua

SEQ ID NO: 1572500 - RNA, 21 nt, Homo sapiens
auugagaagccauguacucaa

SEQ ID NO: 1572501 - RNA, 13 nt, Homo sapiens
auugagaccugag

SEQ ID NO: 1572502 - RNA, 12 nt, Homo sapiens
auugagguucuc

SEQ ID NO: 1572503 - RNA, 14 nt, Homo sapiens
auugagugagcacc

SEQ ID NO: 1572504 - RNA, 18 nt, Homo sapiens
auugauauugaaugaugu

SEQ ID NO: 1572505 - RNA, 15 nt, Homo sapiens
auugauuaaugaacu

SEQ ID NO: 1572506 - RNA, 18 nt, Homo sapiens
auugcaaauaaaccacuu

SEQ ID NO: 1572507 - RNA, 13 nt, Homo sapiens
auugcaaauugag

SEQ ID NO: 1572508 - RNA, 16 nt, Homo sapiens
auugcacaccuuggaa

SEQ ID NO: 1572509 - RNA, 16 nt, Homo sapiens
auugcagaauucaaaa

SEQ ID NO: 1572510 - RNA, 21 nt, Homo sapiens
auugcagguggaacucaguca

SEQ ID NO: 1572511 - RNA, 13 nt, Homo sapiens
auugcaugcaauu

SEQ ID NO: 1572512 - RNA, 12 nt, Homo sapiens
auugccaaaaag

SEQ ID NO: 1572513 - RNA, 19 nt, Homo sapiens
auugccacaaguccagcug

SEQ ID NO: 1572514 - RNA, 12 nt, Homo sapiens
auugccaucacu

SEQ ID NO: 1572515 - RNA, 20 nt, Homo sapiens
auugcccaaauaauauuuua

SEQ ID NO: 1572516 - RNA, 22 nt, Homo sapiens
auugcccccucucacuuuagca

SEQ ID NO: 1572517 - RNA, 22 nt, Homo sapiens
auugccccuggcuuugccucuu

SEQ ID NO: 1572518 - RNA, 19 nt, Homo sapiens
auugccuuauuugucugua

SEQ ID NO: 1572519 - RNA, 14 nt, Homo sapiens
auugcgcucagggg

SEQ ID NO: 1572520 - RNA, 19 nt, Homo sapiens
auugcgcucaggggcucca

SEQ ID NO: 1572521 - RNA, 14 nt, Homo sapiens
auugcuacuauaau

SEQ ID NO: 1572522 - RNA, 22 nt, Homo sapiens
auugcuauuacuaguacuauua

SEQ ID NO: 1572523 - RNA, 22 nt, Homo sapiens
auugcugccccaucagugcucc

SEQ ID NO: 1572524 - RNA, 14 nt, Homo sapiens
auugcuugagcuca

SEQ ID NO: 1572525 - RNA, 20 nt, Homo sapiens
auuggaagaagcacugaugg

SEQ ID NO: 1572526 - RNA, 15 nt, Homo sapiens
auuggauuuccuaau

SEQ ID NO: 1572527 - RNA, 18 nt, Homo sapiens
auuggccacacacugagu

SEQ ID NO: 1572528 - RNA, 19 nt, Homo sapiens
auuggccacacacugaguu

SEQ ID NO: 1572529 - RNA, 22 nt, Homo sapiens
auuggcuaaaagacaugcauuu

SEQ ID NO: 1572530 - RNA, 20 nt, Homo sapiens
auugguauacuuuugcuuca

SEQ ID NO: 1572531 - RNA, 15 nt, Homo sapiens
auugguuuuccauga

SEQ ID NO: 1572532 - RNA, 15 nt, Homo sapiens
auuguaaaaugcacc

SEQ ID NO: 1572533 - RNA, 14 nt, Homo sapiens
auuguaaacuagua

SEQ ID NO: 1572534 - RNA, 17 nt, Homo sapiens
auuguaauguucauuuc

SEQ ID NO: 1572535 - RNA, 16 nt, Homo sapiens
auuguacacgcugaug

SEQ ID NO: 1572536 - RNA, 12 nt, Homo sapiens
auuguacugugu

SEQ ID NO: 1572537 - RNA, 19 nt, Homo sapiens
auuguauauuguaauuuaa

SEQ ID NO: 1572538 - RNA, 14 nt, Homo sapiens
auuguauccaaagg

SEQ ID NO: 1572539 - RNA, 17 nt, Homo sapiens
auuguauuaauaccaaa

SEQ ID NO: 1572540 - RNA, 19 nt, Homo sapiens
auuguauuaauaccaaagu

SEQ ID NO: 1572541 - RNA, 16 nt, Homo sapiens
auugucugccauuaca

SEQ ID NO: 1572542 - RNA, 18 nt, Homo sapiens
auugucugccauuacacc

SEQ ID NO: 1572543 - RNA, 14 nt, Homo sapiens
auugucugucuaca

SEQ ID NO: 1572544 - RNA, 16 nt, Homo sapiens
auugugacuucacugu

SEQ ID NO: 1572545 - RNA, 17 nt, Homo sapiens
auugugacuucacugua

SEQ ID NO: 1572546 - RNA, 18 nt, Homo sapiens
auugugacuucacuguau

SEQ ID NO: 1572547 - RNA, 22 nt, Homo sapiens
auuguguuaggacagcauauaa

SEQ ID NO: 1572548 - RNA, 19 nt, Homo sapiens
auuguguugugcagcauua

SEQ ID NO: 1572549 - RNA, 19 nt, Homo sapiens
auuguuaggaaaugucauc

SEQ ID NO: 1572550 - RNA, 21 nt, Homo sapiens
auuguucacuucuaaaccaaa

SEQ ID NO: 1572551 - RNA, 22 nt, Homo sapiens
auuguucacuucuaaaccaaaa

SEQ ID NO: 1572552 - RNA, 22 nt, Homo sapiens
auuguucagcaugcaauacaua

SEQ ID NO: 1572553 - RNA, 20 nt, Homo sapiens
auuguugaaagguaauuuga

SEQ ID NO: 1572554 - RNA, 12 nt, Homo sapiens
auuguuuggacc

SEQ ID NO: 1572555 - RNA, 20 nt, Homo sapiens
auuguuuuuguugucuuuau

SEQ ID NO: 1572556 - RNA, 13 nt, Homo sapiens
auuuaaacuucua

SEQ ID NO: 1572557 - RNA, 19 nt, Homo sapiens
auuuaaagaaagaaugcau

SEQ ID NO: 1572558 - RNA, 19 nt, Homo sapiens
auuuaaagaccugacagcu

SEQ ID NO: 1572559 - RNA, 12 nt, Homo sapiens
auuuaaagacua

SEQ ID NO: 1572560 - RNA, 23 nt, Homo sapiens
auuuaaauuacaauuuuaucugu

SEQ ID NO: 1572561 - RNA, 15 nt, Homo sapiens
auuuaaauuccacag

SEQ ID NO: 1572562 - RNA, 16 nt, Homo sapiens
auuuaaauuccacaga

SEQ ID NO: 1572563 - RNA, 20 nt, Homo sapiens
auuuaacaaaaagugcuuca

SEQ ID NO: 1572564 - RNA, 21 nt, Homo sapiens
auuuaaccccuugguacugaa

SEQ ID NO: 1572565 - RNA, 18 nt, Homo sapiens
auuuaaccuguuauuucu

SEQ ID NO: 1572566 - RNA, 15 nt, Homo sapiens
auuuaacuacccuua

SEQ ID NO: 1572567 - RNA, 19 nt, Homo sapiens
auuuaacuaugaacugaag

SEQ ID NO: 1572568 - RNA, 22 nt, Homo sapiens
auuuaacugauuaaaaauaccu

SEQ ID NO: 1572569 - RNA, 13 nt, Homo sapiens
auuuaagugcaau

SEQ ID NO: 1572570 - RNA, 21 nt, Homo sapiens
auuuaauaaaugugccuucau

SEQ ID NO: 1572571 - RNA, 21 nt, Homo sapiens
auuuaauuuuuuaaacuguag

SEQ ID NO: 1572572 - RNA, 19 nt, Homo sapiens
auuuaauuuuuuacuuuca

SEQ ID NO: 1572573 - RNA, 15 nt, Homo sapiens
auuuacaaggaguua

SEQ ID NO: 1572574 - RNA, 15 nt, Homo sapiens
auuuacagaaaucaa

SEQ ID NO: 1572575 - RNA, 15 nt, Homo sapiens
auuuacagcucugua

SEQ ID NO: 1572576 - RNA, 11 nt, Homo sapiens
auuuacauuca

SEQ ID NO: 1572577 - RNA, 18 nt, Homo sapiens
auuuagcccgagaucugg

SEQ ID NO: 1572578 - RNA, 21 nt, Homo sapiens
auuuaggaaaugggcagugaa

SEQ ID NO: 1572579 - RNA, 13 nt, Homo sapiens
auuuaguuucaua

SEQ ID NO: 1572580 - RNA, 21 nt, Homo sapiens
auuuauacuuugcaauccaaa

SEQ ID NO: 1572581 - RNA, 22 nt, Homo sapiens
auuuauacuuugcaauccaaau

SEQ ID NO: 1572582 - RNA, 22 nt, Homo sapiens
auuuauaguguugcuuuccuug

SEQ ID NO: 1572583 - RNA, 17 nt, Homo sapiens
auuuaugaugcaguuuc

SEQ ID NO: 1572584 - RNA, 13 nt, Homo sapiens
auuuaugugaugg

SEQ ID NO: 1572585 - RNA, 22 nt, Homo sapiens
auuuauguggauuuugcaugua

SEQ ID NO: 1572586 - RNA, 17 nt, Homo sapiens
auuuauugaaaugauuu

SEQ ID NO: 1572587 - RNA, 18 nt, Homo sapiens
auuuauuuacaugugauu

SEQ ID NO: 1572588 - RNA, 15 nt, Homo sapiens
auuuauuuuguauga

SEQ ID NO: 1572589 - RNA, 13 nt, Homo sapiens
auuucacagugug

SEQ ID NO: 1572590 - RNA, 14 nt, Homo sapiens
auuucacaucagcu

SEQ ID NO: 1572591 - RNA, 21 nt, Homo sapiens
auuucacccagacagccuguu

SEQ ID NO: 1572592 - RNA, 21 nt, Homo sapiens
auuucagccaaaacauaccau

SEQ ID NO: 1572593 - RNA, 21 nt, Homo sapiens
auuucauaccuaucaucuuaa

SEQ ID NO: 1572594 - RNA, 14 nt, Homo sapiens
auuucauacuguaa

SEQ ID NO: 1572595 - RNA, 14 nt, Homo sapiens
auuucauagcugua

SEQ ID NO: 1572596 - RNA, 22 nt, Homo sapiens
auuucauccuugaauccuaugu

SEQ ID NO: 1572597 - RNA, 12 nt, Homo sapiens
auuucaucugcu

SEQ ID NO: 1572598 - RNA, 13 nt, Homo sapiens
auuucaugugaau

SEQ ID NO: 1572599 - RNA, 13 nt, Homo sapiens
cauagaggcuucu

SEQ ID NO: 1572600 - RNA, 16 nt, Homo sapiens
cauagauucaccugua

SEQ ID NO: 1572601 - RNA, 21 nt, Homo sapiens
cauagauuucgaagccacaga

SEQ ID NO: 1572602 - RNA, 22 nt, Homo sapiens
cauagauuucgaagccacagag

SEQ ID NO: 1572603 - RNA, 14 nt, Homo sapiens
cauagcgagacucc

SEQ ID NO: 1572604 - RNA, 16 nt, Homo sapiens
cauagcgagacuccac

SEQ ID NO: 1572605 - RNA, 23 nt, Homo sapiens
cauagcuuucuucccguaaaaac

SEQ ID NO: 1572606 - RNA, 20 nt, Homo sapiens
cauaggaaaaugccaugaaa

SEQ ID NO: 1572607 - RNA, 13 nt, Homo sapiens
cauaggugcaguu

SEQ ID NO: 1572608 - RNA, 20 nt, Homo sapiens
cauagguuaaaaaaaaaagu

SEQ ID NO: 1572609 - RNA, 12 nt, Homo sapiens
cauauaccagca

SEQ ID NO: 1572610 - RNA, 16 nt, Homo sapiens
cauauaccagcaauau

SEQ ID NO: 1572611 - RNA, 16 nt, Homo sapiens
cauauaucuauuacac

SEQ ID NO: 1572612 - RNA, 15 nt, Homo sapiens
cauauaugaccagaa

SEQ ID NO: 1572613 - RNA, 14 nt, Homo sapiens
cauauauuuagccc

SEQ ID NO: 1572614 - RNA, 23 nt, Homo sapiens
cauauauuugaaguggagccaua

SEQ ID NO: 1572615 - RNA, 18 nt, Homo sapiens
cauaucaguugagcuuca

SEQ ID NO: 1572616 - RNA, 19 nt, Homo sapiens
cauauccaggcaccaggac

SEQ ID NO: 1572617 - RNA, 21 nt, Homo sapiens
cauaucccuuccucucaggcu

SEQ ID NO: 1572618 - RNA, 21 nt, Homo sapiens
cauaugacaauguugcauuua

SEQ ID NO: 1572619 - RNA, 19 nt, Homo sapiens
cauaugagaauauaccuua

SEQ ID NO: 1572620 - RNA, 21 nt, Homo sapiens
cauauguagccuucacacaga

SEQ ID NO: 1572621 - RNA, 19 nt, Homo sapiens
cauaugucacgaacuugaa

SEQ ID NO: 1572622 - RNA, 13 nt, Homo sapiens
cauauuauuccau

SEQ ID NO: 1572623 - RNA, 14 nt, Homo sapiens
cauauucauaugca

SEQ ID NO: 1572624 - RNA, 19 nt, Homo sapiens
cauauucaugaaaugugga

SEQ ID NO: 1572625 - RNA, 23 nt, Homo sapiens
cauauugagaaccuaaugcacuc

SEQ ID NO: 1572626 - RNA, 20 nt, Homo sapiens
cauauuuauuuuuaccugcu

SEQ ID NO: 1572627 - RNA, 23 nt, Homo sapiens
cauauuuugguuuguguauccau

SEQ ID NO: 1572628 - RNA, 17 nt, Homo sapiens
caucaaaagcaccagca

SEQ ID NO: 1572629 - RNA, 17 nt, Homo sapiens
caucaaauuauuaaucu

SEQ ID NO: 1572630 - RNA, 13 nt, Homo sapiens
caucaagcacuuc

SEQ ID NO: 1572631 - RNA, 16 nt, Homo sapiens
caucaagcacuuccca

SEQ ID NO: 1572632 - RNA, 14 nt, Homo sapiens
caucaauacaacca

SEQ ID NO: 1572633 - RNA, 22 nt, Homo sapiens
caucaauaguguccuaugcaau

SEQ ID NO: 1572634 - RNA, 22 nt, Homo sapiens
caucaaucuuguuacugcugau

SEQ ID NO: 1572635 - RNA, 13 nt, Homo sapiens
caucaaugcaguu

SEQ ID NO: 1572636 - RNA, 14 nt, Homo sapiens
caucaaugcaguuc

SEQ ID NO: 1572637 - RNA, 16 nt, Homo sapiens
caucacaagaaaguca

SEQ ID NO: 1572638 - RNA, 17 nt, Homo sapiens
caucacacucaaggaca

SEQ ID NO: 1572639 - RNA, 12 nt, Homo sapiens
caucacacuggg

SEQ ID NO: 1572640 - RNA, 23 nt, Homo sapiens
caucacuccucugucauaugcag

SEQ ID NO: 1572641 - RNA, 16 nt, Homo sapiens
caucagagccuuuccu

SEQ ID NO: 1572642 - RNA, 20 nt, Homo sapiens
caucagcuugcccuguuaaa

SEQ ID NO: 1572643 - RNA, 18 nt, Homo sapiens
caucaggaaacaggaaga

SEQ ID NO: 1572644 - RNA, 13 nt, Homo sapiens
caucaggacucug

SEQ ID NO: 1572645 - RNA, 16 nt, Homo sapiens
caucaguagcaucugu

SEQ ID NO: 1572646 - RNA, 22 nt, Homo sapiens
caucagucaucaggugugcuca

SEQ ID NO: 1572647 - RNA, 15 nt, Homo sapiens
caucaguuacagaga

SEQ ID NO: 1572648 - RNA, 20 nt, Homo sapiens
caucauauuuuguugugcac

SEQ ID NO: 1572649 - RNA, 18 nt, Homo sapiens
caucauccuccauugcuc

SEQ ID NO: 1572650 - RNA, 15 nt, Homo sapiens
caucauuacuuauga

SEQ ID NO: 1572651 - RNA, 14 nt, Homo sapiens
caucauuucaaucg

SEQ ID NO: 1572652 - RNA, 19 nt, Homo sapiens
cauccaacauuaaaagcca

SEQ ID NO: 1572653 - RNA, 18 nt, Homo sapiens
cauccaaccacuguacac

SEQ ID NO: 1572654 - RNA, 18 nt, Homo sapiens
cauccaaggcuguuacca

SEQ ID NO: 1572655 - RNA, 23 nt, Homo sapiens
cauccaaggcuguuaccauuuua

SEQ ID NO: 1572656 - RNA, 14 nt, Homo sapiens
cauccacacaugaa

SEQ ID NO: 1572657 - RNA, 22 nt, Homo sapiens
cauccacaggguuuugacacuu

SEQ ID NO: 1572658 - RNA, 15 nt, Homo sapiens
cauccagagaugacu

SEQ ID NO: 1572659 - RNA, 18 nt, Homo sapiens
cauccagaugugugcaau

SEQ ID NO: 1572660 - RNA, 15 nt, Homo sapiens
cauccauagacacag

SEQ ID NO: 1572661 - RNA, 20 nt, Homo sapiens
cauccauagacacaguauug

SEQ ID NO: 1572662 - RNA, 23 nt, Homo sapiens
cauccaugcugugcuguguuauu

SEQ ID NO: 1572663 - RNA, 16 nt, Homo sapiens
cauccccaacuccaug

SEQ ID NO: 1572664 - RNA, 22 nt, Homo sapiens
cauccccaacugcgacugugac

SEQ ID NO: 1572665 - RNA, 21 nt, Homo sapiens
caucccccaaggaugaaauca

SEQ ID NO: 1572666 - RNA, 18 nt, Homo sapiens
caucccuuguuuauaaau

SEQ ID NO: 1572667 - RNA, 18 nt, Homo sapiens
caucccuuuuucugcuaa

SEQ ID NO: 1572668 - RNA, 16 nt, Homo sapiens
caucccuuuuuuuaca

SEQ ID NO: 1572669 - RNA, 14 nt, Homo sapiens
cauccucacaguga

SEQ ID NO: 1572670 - RNA, 21 nt, Homo sapiens
cauccucccauugcccaguga

SEQ ID NO: 1572671 - RNA, 14 nt, Homo sapiens
cauccugaccagcu

SEQ ID NO: 1572672 - RNA, 18 nt, Homo sapiens
cauccugguuuccacugu

SEQ ID NO: 1572673 - RNA, 23 nt, Homo sapiens
cauccuuaaaacaauucugugac

SEQ ID NO: 1572674 - RNA, 14 nt, Homo sapiens
cauccuuguaauac

SEQ ID NO: 1572675 - RNA, 11 nt, Homo sapiens
cauccuuucag

SEQ ID NO: 1572676 - RNA, 15 nt, Homo sapiens
caucgcucuaggaua

SEQ ID NO: 1572677 - RNA, 12 nt, Homo sapiens
caucgggagcac

SEQ ID NO: 1572678 - RNA, 15 nt, Homo sapiens
caucguccugggacu

SEQ ID NO: 1572679 - RNA, 13 nt, Homo sapiens
caucguucaucca

SEQ ID NO: 1572680 - RNA, 19 nt, Homo sapiens
caucuaaaacucauacaau

SEQ ID NO: 1572681 - RNA, 16 nt, Homo sapiens
caucuaagcuauacug

SEQ ID NO: 1572682 - RNA, 14 nt, Homo sapiens
caucuaauaaauca

SEQ ID NO: 1572683 - RNA, 19 nt, Homo sapiens
caucuacuuagauuuaaca

SEQ ID NO: 1572684 - RNA, 17 nt, Homo sapiens
caucuagaauucacuga

SEQ ID NO: 1572685 - RNA, 21 nt, Homo sapiens
caucuauuuccucugugcaaa

SEQ ID NO: 1572686 - RNA, 22 nt, Homo sapiens
caucuauuuuauuuuauugaau

SEQ ID NO: 1572687 - RNA, 22 nt, Homo sapiens
caucucaaaaauaaugcauaaa

SEQ ID NO: 1572688 - RNA, 17 nt, Homo sapiens
caucucaaagaaggcau

SEQ ID NO: 1572689 - RNA, 21 nt, Homo sapiens
caucucaccuucagucaagaa

SEQ ID NO: 1572690 - RNA, 19 nt, Homo sapiens
caucucauuaaaaggcccu

SEQ ID NO: 1572691 - RNA, 19 nt, Homo sapiens
caucuccccucucaccuca

SEQ ID NO: 1572692 - RNA, 11 nt, Homo sapiens
caucucuacua

SEQ ID NO: 1572693 - RNA, 18 nt, Homo sapiens
caucugaacacaaccaga

SEQ ID NO: 1572694 - RNA, 20 nt, Homo sapiens
caucugaagagcuagucuau

SEQ ID NO: 1572695 - RNA, 12 nt, Homo sapiens
caucugcaaaag

SEQ ID NO: 1572696 - RNA, 18 nt, Homo sapiens
caucugcuaauauaaaug

SEQ ID NO: 1572697 - RNA, 14 nt, Homo sapiens
caucuguaccucug

SEQ ID NO: 1572698 - RNA, 16 nt, Homo sapiens
caucuucacugcaauu

SEQ ID NO: 1572699 - RNA, 22 nt, Homo sapiens
caucuugugaaauggccaggau

SEQ ID NO: 1572700 - RNA, 22 nt, Homo sapiens
caucuuuacaaaacuacaugag

SEQ ID NO: 1572701 - RNA, 18 nt, Homo sapiens
caucuuuucuagagacac

SEQ ID NO: 1572702 - RNA, 17 nt, Homo sapiens
caugaaaauggaguuau

SEQ ID NO: 1572703 - RNA, 21 nt, Homo sapiens
caugaacucuugaagucacac

SEQ ID NO: 1572704 - RNA, 17 nt, Homo sapiens
caugaaggcagagccau

SEQ ID NO: 1572705 - RNA, 15 nt, Homo sapiens
caugacaaaauuacu

SEQ ID NO: 1572706 - RNA, 19 nt, Homo sapiens
caugacaagaacaaagcca

SEQ ID NO: 1572707 - RNA, 17 nt, Homo sapiens
caugacacuuccaaaga

SEQ ID NO: 1572708 - RNA, 18 nt, Homo sapiens
caugaccagaaacaggga

SEQ ID NO: 1572709 - RNA, 21 nt, Homo sapiens
caugacucuuuauugucugua

SEQ ID NO: 1572710 - RNA, 15 nt, Homo sapiens
caugacugucugugc

SEQ ID NO: 1572711 - RNA, 14 nt, Homo sapiens
caugagcaucccca

SEQ ID NO: 1572712 - RNA, 18 nt, Homo sapiens
caugaggccaccaguaaa

SEQ ID NO: 1572713 - RNA, 17 nt, Homo sapiens
caugagucagauacaca

SEQ ID NO: 1572714 - RNA, 18 nt, Homo sapiens
caugaguucaaauacuuu

SEQ ID NO: 1572715 - RNA, 22 nt, Homo sapiens
caugauaaaauuuuacauuuga

SEQ ID NO: 1572716 - RNA, 16 nt, Homo sapiens
caugauaaaugauaga

SEQ ID NO: 1572717 - RNA, 16 nt, Homo sapiens
ccagcaucuggaagau

SEQ ID NO: 1572718 - RNA, 12 nt, Homo sapiens
ccagcauuccag

SEQ ID NO: 1572719 - RNA, 23 nt, Homo sapiens
ccagcauuuuuauaaacuaccaa

SEQ ID NO: 1572720 - RNA, 19 nt, Homo sapiens
ccagccacauugagacuuu

SEQ ID NO: 1572721 - RNA, 13 nt, Homo sapiens
ccagccacuguca

SEQ ID NO: 1572722 - RNA, 19 nt, Homo sapiens
ccagccagauggacuccag

SEQ ID NO: 1572723 - RNA, 15 nt, Homo sapiens
ccagcccagagccac

SEQ ID NO: 1572724 - RNA, 16 nt, Homo sapiens
ccagccguauuuuaca

SEQ ID NO: 1572725 - RNA, 20 nt, Homo sapiens
ccagccguauuuuacaugaa

SEQ ID NO: 1572726 - RNA, 14 nt, Homo sapiens
ccagccucccacaa

SEQ ID NO: 1572727 - RNA, 20 nt, Homo sapiens
ccagccucugccgcugccau

SEQ ID NO: 1572728 - RNA, 20 nt, Homo sapiens
ccagccuggacgacauagcg

SEQ ID NO: 1572729 - RNA, 22 nt, Homo sapiens
ccagccuggccaacauggugaa

SEQ ID NO: 1572730 - RNA, 15 nt, Homo sapiens
ccagccuuggcgaca

SEQ ID NO: 1572731 - RNA, 17 nt, Homo sapiens
ccagcuagugccaaaua

SEQ ID NO: 1572732 - RNA, 21 nt, Homo sapiens
ccagcucacgccugguggugg

SEQ ID NO: 1572733 - RNA, 24 nt, Homo sapiens
ccagcuccccucuuuuguaaguau

SEQ ID NO: 1572734 - RNA, 16 nt, Homo sapiens
ccagcucuaguuuuca

SEQ ID NO: 1572735 - RNA, 15 nt, Homo sapiens
ccagcugugcacuuu

SEQ ID NO: 1572736 - RNA, 18 nt, Homo sapiens
ccagcuuaugagcucaaa

SEQ ID NO: 1572737 - RNA, 21 nt, Homo sapiens
ccagcuugcgaauaacagucc

SEQ ID NO: 1572738 - RNA, 22 nt, Homo sapiens
ccagcuugcgaauaacaguccc

SEQ ID NO: 1572739 - RNA, 20 nt, Homo sapiens
ccaggaaagguuuuccuuau

SEQ ID NO: 1572740 - RNA, 21 nt, Homo sapiens
ccaggaaggaaaaugugaaca

SEQ ID NO: 1572741 - RNA, 12 nt, Homo sapiens
ccaggaccaguc

SEQ ID NO: 1572742 - RNA, 19 nt, Homo sapiens
ccaggagacuuuuucagaa

SEQ ID NO: 1572743 - RNA, 16 nt, Homo sapiens
ccaggagccucaucca

SEQ ID NO: 1572744 - RNA, 13 nt, Homo sapiens
ccaggaguccagg

SEQ ID NO: 1572745 - RNA, 14 nt, Homo sapiens
ccaggauacuggca

SEQ ID NO: 1572746 - RNA, 16 nt, Homo sapiens
ccaggaucugcuccaa

SEQ ID NO: 1572747 - RNA, 18 nt, Homo sapiens
ccaggauuuuaauuucag

SEQ ID NO: 1572748 - RNA, 14 nt, Homo sapiens
ccaggcaggggugg

SEQ ID NO: 1572749 - RNA, 22 nt, Homo sapiens
ccaggcccggggcuggcggcua

SEQ ID NO: 1572750 - RNA, 16 nt, Homo sapiens
ccaggcccuccagugg

SEQ ID NO: 1572751 - RNA, 14 nt, Homo sapiens
ccaggcgcugcaua

SEQ ID NO: 1572752 - RNA, 17 nt, Homo sapiens
ccaggcuagagugcaau

SEQ ID NO: 1572753 - RNA, 17 nt, Homo sapiens
ccaggcuggagugcagu

SEQ ID NO: 1572754 - RNA, 13 nt, Homo sapiens
ccaggcugucuag

SEQ ID NO: 1572755 - RNA, 14 nt, Homo sapiens
ccaggcuguucuca

SEQ ID NO: 1572756 - RNA, 18 nt, Homo sapiens
ccaggcuuacugagcugu

SEQ ID NO: 1572757 - RNA, 17 nt, Homo sapiens
ccaggcuuucaauguuu

SEQ ID NO: 1572758 - RNA, 23 nt, Homo sapiens
ccagggcccacuagcauccacug

SEQ ID NO: 1572759 - RNA, 22 nt, Homo sapiens
ccaggggaaccugccaugccag

SEQ ID NO: 1572760 - RNA, 18 nt, Homo sapiens
ccagguagcucggcacca

SEQ ID NO: 1572761 - RNA, 16 nt, Homo sapiens
ccaggucuacagugau

SEQ ID NO: 1572762 - RNA, 16 nt, Homo sapiens
ccagguucaugaauau

SEQ ID NO: 1572763 - RNA, 19 nt, Homo sapiens
ccaguacuugucauaugua

SEQ ID NO: 1572764 - RNA, 14 nt, Homo sapiens
ccaguaggacaaac

SEQ ID NO: 1572765 - RNA, 12 nt, Homo sapiens
ccagucagggcc

SEQ ID NO: 1572766 - RNA, 23 nt, Homo sapiens
ccagucauuuuauuuuguaauau

SEQ ID NO: 1572767 - RNA, 21 nt, Homo sapiens
ccagucccagacaauuccauu

SEQ ID NO: 1572768 - RNA, 21 nt, Homo sapiens
ccaguccccgaggagcugggc

SEQ ID NO: 1572769 - RNA, 14 nt, Homo sapiens
ccagucucagacac

SEQ ID NO: 1572770 - RNA, 16 nt, Homo sapiens
ccagucucugccagac

SEQ ID NO: 1572771 - RNA, 23 nt, Homo sapiens
ccagucuggaaaacagaaaccau

SEQ ID NO: 1572772 - RNA, 14 nt, Homo sapiens
ccagugagcucuuu

SEQ ID NO: 1572773 - RNA, 18 nt, Homo sapiens
ccagugcagggcuggucu

SEQ ID NO: 1572774 - RNA, 11 nt, Homo sapiens
ccagugcaguc

SEQ ID NO: 1572775 - RNA, 13 nt, Homo sapiens
ccagugcugccac

SEQ ID NO: 1572776 - RNA, 22 nt, Homo sapiens
ccaguggggcccuucucugcag

SEQ ID NO: 1572777 - RNA, 18 nt, Homo sapiens
ccagugucauuuugaucu

SEQ ID NO: 1572778 - RNA, 22 nt, Homo sapiens
ccaguguuccugaagcugcugu

SEQ ID NO: 1572779 - RNA, 22 nt, Homo sapiens
ccaguuaaguaauaguuugaua

SEQ ID NO: 1572780 - RNA, 12 nt, Homo sapiens
ccaguuacauaa

SEQ ID NO: 1572781 - RNA, 23 nt, Homo sapiens
ccaguuaucuugaguugcagcuc

SEQ ID NO: 1572782 - RNA, 13 nt, Homo sapiens
ccaguucaguguu

SEQ ID NO: 1572783 - RNA, 21 nt, Homo sapiens
ccaguuccucccccaguuccu

SEQ ID NO: 1572784 - RNA, 22 nt, Homo sapiens
ccaguuuuucacauuaucuuug

SEQ ID NO: 1572785 - RNA, 15 nt, Homo sapiens
ccauaagaaagcacu

SEQ ID NO: 1572786 - RNA, 16 nt, Homo sapiens
ccauaagaaagcacua

SEQ ID NO: 1572787 - RNA, 22 nt, Homo sapiens
ccauacuagaguucauggauau

SEQ ID NO: 1572788 - RNA, 22 nt, Homo sapiens
ccauacuguuugcccauuuuca

SEQ ID NO: 1572789 - RNA, 23 nt, Homo sapiens
ccauagagacccaugucagcaaa

SEQ ID NO: 1572790 - RNA, 23 nt, Homo sapiens
ccauaggaggugggggaacugga

SEQ ID NO: 1572791 - RNA, 14 nt, Homo sapiens
ccauaggugcaguu

SEQ ID NO: 1572792 - RNA, 18 nt, Homo sapiens
ccauauuuauacagcaga

SEQ ID NO: 1572793 - RNA, 22 nt, Homo sapiens
ccauauuuauuuuuauguucuu

SEQ ID NO: 1572794 - RNA, 12 nt, Homo sapiens
ccauauuuucac

SEQ ID NO: 1572795 - RNA, 23 nt, Homo sapiens
ccauauuuuuuaugauggagcaa

SEQ ID NO: 1572796 - RNA, 19 nt, Homo sapiens
ccaucacccucagcaguuc

SEQ ID NO: 1572797 - RNA, 13 nt, Homo sapiens
ccaucaccucucu

SEQ ID NO: 1572798 - RNA, 15 nt, Homo sapiens
ccaucagaaaaccaa

SEQ ID NO: 1572799 - RNA, 16 nt, Homo sapiens
ccaucagcacucugua

SEQ ID NO: 1572800 - RNA, 23 nt, Homo sapiens
ccaucagugcucccucacauguc

SEQ ID NO: 1572801 - RNA, 13 nt, Homo sapiens
ccaucagugcucu

SEQ ID NO: 1572802 - RNA, 19 nt, Homo sapiens
ccaucagugcucuguaaaa

SEQ ID NO: 1572803 - RNA, 14 nt, Homo sapiens
ccaucaugucugua

SEQ ID NO: 1572804 - RNA, 14 nt, Homo sapiens
ccaucccuucucug

SEQ ID NO: 1572805 - RNA, 12 nt, Homo sapiens
ccaucucaaaaa

SEQ ID NO: 1572806 - RNA, 13 nt, Homo sapiens
ccaucucuuuacc

SEQ ID NO: 1572807 - RNA, 16 nt, Homo sapiens
ccaucucuuuaccucc

SEQ ID NO: 1572808 - RNA, 18 nt, Homo sapiens
ccaucugcuugguuggcu

SEQ ID NO: 1572809 - RNA, 22 nt, Homo sapiens
ccaucuugaucuuugagcccau

SEQ ID NO: 1572810 - RNA, 11 nt, Homo sapiens
ccaucuuuaca

SEQ ID NO: 1572811 - RNA, 19 nt, Homo sapiens
ccaugaagcacugagcaga

SEQ ID NO: 1572812 - RNA, 22 nt, Homo sapiens
ccaugacaagaacaaagccacu

SEQ ID NO: 1572813 - RNA, 22 nt, Homo sapiens
ccaugagaugagaugaccacca

SEQ ID NO: 1572814 - RNA, 21 nt, Homo sapiens
ccaugagcucacccgugucua

SEQ ID NO: 1572815 - RNA, 19 nt, Homo sapiens
ccaugaggaaggaacagca

SEQ ID NO: 1572816 - RNA, 15 nt, Homo sapiens
ccaugcuaacaaaga

SEQ ID NO: 1572817 - RNA, 17 nt, Homo sapiens
ccaugcucaccaaggaa

SEQ ID NO: 1572818 - RNA, 13 nt, Homo sapiens
ccaugcucucuca

SEQ ID NO: 1572819 - RNA, 20 nt, Homo sapiens
ccaugcuucacucaugcaaa

SEQ ID NO: 1572820 - RNA, 19 nt, Homo sapiens
ccaugcuugccugaagcuu

SEQ ID NO: 1572821 - RNA, 19 nt, Homo sapiens
ccauggcaccuucagacuu

SEQ ID NO: 1572822 - RNA, 16 nt, Homo sapiens
ccauggcccccaauaa

SEQ ID NO: 1572823 - RNA, 18 nt, Homo sapiens
ccauggcccccaauaaag

SEQ ID NO: 1572824 - RNA, 23 nt, Homo sapiens
ccauggcccccaauaaaggcagc

SEQ ID NO: 1572825 - RNA, 17 nt, Homo sapiens
ccauguaaauugcaaau

SEQ ID NO: 1572826 - RNA, 18 nt, Homo sapiens
ccauguaaauugcaaaua

SEQ ID NO: 1572827 - RNA, 14 nt, Homo sapiens
ccauguaaccacug

SEQ ID NO: 1572828 - RNA, 21 nt, Homo sapiens
ccauguccaaagaggcugccc

SEQ ID NO: 1572829 - RNA, 22 nt, Homo sapiens
ccaugucuccuggacucagggu

SEQ ID NO: 1572830 - RNA, 22 nt, Homo sapiens
ccaugugaccgaacacugcagc

SEQ ID NO: 1572831 - RNA, 16 nt, Homo sapiens
ccauguguggcccacc

SEQ ID NO: 1572832 - RNA, 17 nt, Homo sapiens
ccauguuaauauuugaa

SEQ ID NO: 1572833 - RNA, 14 nt, Homo sapiens
ccauguugcacugu

SEQ ID NO: 1572834 - RNA, 16 nt, Homo sapiens
ccauuaaaaacuacca

SEQ ID NO: 1572835 - RNA, 22 nt, Homo sapiens
ccuccugugucacugaauauca

SEQ ID NO: 1572836 - RNA, 15 nt, Homo sapiens
ccucgcuggacucuc

SEQ ID NO: 1572837 - RNA, 14 nt, Homo sapiens
ccucuaagcacauu

SEQ ID NO: 1572838 - RNA, 12 nt, Homo sapiens
ccucuaccaaaa

SEQ ID NO: 1572839 - RNA, 14 nt, Homo sapiens
ccucuagaagccaa

SEQ ID NO: 1572840 - RNA, 21 nt, Homo sapiens
ccucucaaauucagcucugau

SEQ ID NO: 1572841 - RNA, 20 nt, Homo sapiens
ccucucaacauuaccaaaau

SEQ ID NO: 1572842 - RNA, 12 nt, Homo sapiens
ccucucaccaaa

SEQ ID NO: 1572843 - RNA, 20 nt, Homo sapiens
ccucucagagugacagucau

SEQ ID NO: 1572844 - RNA, 16 nt, Homo sapiens
ccucucagcauuuccu

SEQ ID NO: 1572845 - RNA, 22 nt, Homo sapiens
ccucuccacucaugugacucuu

SEQ ID NO: 1572846 - RNA, 21 nt, Homo sapiens
ccucucccccuccuccaggga

SEQ ID NO: 1572847 - RNA, 16 nt, Homo sapiens
ccucucccuaggagaa

SEQ ID NO: 1572848 - RNA, 20 nt, Homo sapiens
ccucucggugcuccaucucc

SEQ ID NO: 1572849 - RNA, 14 nt, Homo sapiens
ccucucucauuccc

SEQ ID NO: 1572850 - RNA, 23 nt, Homo sapiens
ccucucugcagacuucccagcua

SEQ ID NO: 1572851 - RNA, 23 nt, Homo sapiens
ccucucuuucacacaaugcccaa

SEQ ID NO: 1572852 - RNA, 21 nt, Homo sapiens
ccucugaaacagcugccuuag

SEQ ID NO: 1572853 - RNA, 14 nt, Homo sapiens
ccucugagacauga

SEQ ID NO: 1572854 - RNA, 11 nt, Homo sapiens
ccucugcauuu

SEQ ID NO: 1572855 - RNA, 14 nt, Homo sapiens
ccucugcauuuaca

SEQ ID NO: 1572856 - RNA, 22 nt, Homo sapiens
ccucugccgcugccaugcuuug

SEQ ID NO: 1572857 - RNA, 20 nt, Homo sapiens
ccucugccucccggguucaa

SEQ ID NO: 1572858 - RNA, 16 nt, Homo sapiens
ccucugcuacuagcca

SEQ ID NO: 1572859 - RNA, 16 nt, Homo sapiens
ccucuggacaagucau

SEQ ID NO: 1572860 - RNA, 18 nt, Homo sapiens
ccucuggggccuucggga

SEQ ID NO: 1572861 - RNA, 23 nt, Homo sapiens
ccucuggguuguuaauacuguau

SEQ ID NO: 1572862 - RNA, 18 nt, Homo sapiens
ccucuguccaggcacuga

SEQ ID NO: 1572863 - RNA, 16 nt, Homo sapiens
ccucugugcaaaggga

SEQ ID NO: 1572864 - RNA, 14 nt, Homo sapiens
ccucuuccccagaa

SEQ ID NO: 1572865 - RNA, 21 nt, Homo sapiens
ccucuucuacccucaucauca

SEQ ID NO: 1572866 - RNA, 18 nt, Homo sapiens
ccucuucuuugugccuuu

SEQ ID NO: 1572867 - RNA, 19 nt, Homo sapiens
ccucuucuuugugccuuug

SEQ ID NO: 1572868 - RNA, 17 nt, Homo sapiens
ccucuuggcugccuugu

SEQ ID NO: 1572869 - RNA, 21 nt, Homo sapiens
ccucuuucuccagcagcugau

SEQ ID NO: 1572870 - RNA, 20 nt, Homo sapiens
ccucuuugugucccuugguc

SEQ ID NO: 1572871 - RNA, 18 nt, Homo sapiens
ccugaaaaggguguugcu

SEQ ID NO: 1572872 - RNA, 17 nt, Homo sapiens
ccugaaaauugcaauac

SEQ ID NO: 1572873 - RNA, 13 nt, Homo sapiens
ccugaaaggcaac

SEQ ID NO: 1572874 - RNA, 19 nt, Homo sapiens
ccugaacuccagagguguc

SEQ ID NO: 1572875 - RNA, 13 nt, Homo sapiens
ccugaacuugccu

SEQ ID NO: 1572876 - RNA, 23 nt, Homo sapiens
ccugaaggcaccugucaacugga

SEQ ID NO: 1572877 - RNA, 23 nt, Homo sapiens
ccugaaggguggaugugcuggag

SEQ ID NO: 1572878 - RNA, 22 nt, Homo sapiens
ccugaagguguuuuucauucac

SEQ ID NO: 1572879 - RNA, 12 nt, Homo sapiens
ccugaaguauuu

SEQ ID NO: 1572880 - RNA, 23 nt, Homo sapiens
ccugaauauuuguuauguagaua

SEQ ID NO: 1572881 - RNA, 19 nt, Homo sapiens
ccugaauuaucuauuucau

SEQ ID NO: 1572882 - RNA, 23 nt, Homo sapiens
ccugacacucaauaaacagucac

SEQ ID NO: 1572883 - RNA, 16 nt, Homo sapiens
ccugaccuugugaucc

SEQ ID NO: 1572884 - RNA, 15 nt, Homo sapiens
ccugacuuccucugc

SEQ ID NO: 1572885 - RNA, 15 nt, Homo sapiens
ccugacuucuggaau

SEQ ID NO: 1572886 - RNA, 16 nt, Homo sapiens
ccugagagauuuaaca

SEQ ID NO: 1572887 - RNA, 22 nt, Homo sapiens
ccugagauacaaggcccagaag

SEQ ID NO: 1572888 - RNA, 21 nt, Homo sapiens
ccugagauucagaugucauuu

SEQ ID NO: 1572889 - RNA, 19 nt, Homo sapiens
ccugagcacuccuggugca

SEQ ID NO: 1572890 - RNA, 19 nt, Homo sapiens
ccugagccccucaauccua

SEQ ID NO: 1572891 - RNA, 13 nt, Homo sapiens
ccugagcuaaaua

SEQ ID NO: 1572892 - RNA, 20 nt, Homo sapiens
ccugauaacaaccuggagac

SEQ ID NO: 1572893 - RNA, 16 nt, Homo sapiens
ccugauauaacacuuu

SEQ ID NO: 1572894 - RNA, 19 nt, Homo sapiens
ccugauauaacacuuucca

SEQ ID NO: 1572895 - RNA, 21 nt, Homo sapiens
ccugaugcuggggacacagca

SEQ ID NO: 1572896 - RNA, 23 nt, Homo sapiens
ccugaugugggaacagcucuucu

SEQ ID NO: 1572897 - RNA, 19 nt, Homo sapiens
ccugcagaccucaagccau

SEQ ID NO: 1572898 - RNA, 11 nt, Homo sapiens
ccugcauguac

SEQ ID NO: 1572899 - RNA, 13 nt, Homo sapiens
ccugcccacagaa

SEQ ID NO: 1572900 - RNA, 16 nt, Homo sapiens
ccugcccaccaagaag

SEQ ID NO: 1572901 - RNA, 20 nt, Homo sapiens
ccugccccaccccauccagc

SEQ ID NO: 1572902 - RNA, 14 nt, Homo sapiens
ccugcccugccuca

SEQ ID NO: 1572903 - RNA, 13 nt, Homo sapiens
ccugccucaggcc

SEQ ID NO: 1572904 - RNA, 16 nt, Homo sapiens
ccugcgagacgcacac

SEQ ID NO: 1572905 - RNA, 23 nt, Homo sapiens
ccugcgcccaccccgcucugcau

SEQ ID NO: 1572906 - RNA, 23 nt, Homo sapiens
ccugcuccuagcacccuggagag

SEQ ID NO: 1572907 - RNA, 16 nt, Homo sapiens
ccugcugcagcaugaa

SEQ ID NO: 1572908 - RNA, 18 nt, Homo sapiens
ccugcugccugcugagau

SEQ ID NO: 1572909 - RNA, 12 nt, Homo sapiens
ccugcugugauu

SEQ ID NO: 1572910 - RNA, 12 nt, Homo sapiens
ccugcugugcug

SEQ ID NO: 1572911 - RNA, 23 nt, Homo sapiens
ccugcuucuuuccagaaaccaaa

SEQ ID NO: 1572912 - RNA, 13 nt, Homo sapiens
ccuggaaauggac

SEQ ID NO: 1572913 - RNA, 15 nt, Homo sapiens
ccuggaagguggaag

SEQ ID NO: 1572914 - RNA, 15 nt, Homo sapiens
ccuggacaccucuca

SEQ ID NO: 1572915 - RNA, 14 nt, Homo sapiens
ccuggacacuguac

SEQ ID NO: 1572916 - RNA, 16 nt, Homo sapiens
ccuggaccaggucuca

SEQ ID NO: 1572917 - RNA, 17 nt, Homo sapiens
ccuggagacaaggugcu

SEQ ID NO: 1572918 - RNA, 16 nt, Homo sapiens
ccuggauccagcacug

SEQ ID NO: 1572919 - RNA, 21 nt, Homo sapiens
ccuggcaaagaacucauuuga

SEQ ID NO: 1572920 - RNA, 22 nt, Homo sapiens
ccuggcaaagaacucauuugaa

SEQ ID NO: 1572921 - RNA, 23 nt, Homo sapiens
ccuggcaucaguagcaucuguaa

SEQ ID NO: 1572922 - RNA, 16 nt, Homo sapiens
ccuggccaaucaggcg

SEQ ID NO: 1572923 - RNA, 14 nt, Homo sapiens
ccuggccauuucca

SEQ ID NO: 1572924 - RNA, 18 nt, Homo sapiens
ccuggcccauaaugugaa

SEQ ID NO: 1572925 - RNA, 16 nt, Homo sapiens
ccuggccucaucucag

SEQ ID NO: 1572926 - RNA, 19 nt, Homo sapiens
ccuggcuaagaucaugucu

SEQ ID NO: 1572927 - RNA, 18 nt, Homo sapiens
ccuggcuggcaggcaccg

SEQ ID NO: 1572928 - RNA, 19 nt, Homo sapiens
ccugggacaaccagacucu

SEQ ID NO: 1572929 - RNA, 23 nt, Homo sapiens
ccugggagagaaguuugaagcac

SEQ ID NO: 1572930 - RNA, 18 nt, Homo sapiens
ccugggccccaccaccua

SEQ ID NO: 1572931 - RNA, 23 nt, Homo sapiens
ccugggcuuggccugcugugauu

SEQ ID NO: 1572932 - RNA, 22 nt, Homo sapiens
ccuggggagcccaguccacuga

SEQ ID NO: 1572933 - RNA, 15 nt, Homo sapiens
ccuggggguggcagg

SEQ ID NO: 1572934 - RNA, 20 nt, Homo sapiens
ccuggggguggcaggcacac

SEQ ID NO: 1572935 - RNA, 17 nt, Homo sapiens
ccugggucaugggccug

SEQ ID NO: 1572936 - RNA, 18 nt, Homo sapiens
ccugggugacagagugag

SEQ ID NO: 1572937 - RNA, 18 nt, Homo sapiens
ccuggguggaaauccugc

SEQ ID NO: 1572938 - RNA, 19 nt, Homo sapiens
ccuggugagacuguccaua

SEQ ID NO: 1572939 - RNA, 18 nt, Homo sapiens
ccuggugcuuuccuucau

SEQ ID NO: 1572940 - RNA, 14 nt, Homo sapiens
ccugguguguuucc

SEQ ID NO: 1572941 - RNA, 15 nt, Homo sapiens
ccuguaaaacuuuau

SEQ ID NO: 1572942 - RNA, 17 nt, Homo sapiens
ccuguaauccuugcauu

SEQ ID NO: 1572943 - RNA, 20 nt, Homo sapiens
ccuguaaucucagcacuuug

SEQ ID NO: 1572944 - RNA, 15 nt, Homo sapiens
ccuguaccucagugg

SEQ ID NO: 1572945 - RNA, 17 nt, Homo sapiens
ccuguagcagucacuga

SEQ ID NO: 1572946 - RNA, 20 nt, Homo sapiens
ccugucccaccccuaccucu

SEQ ID NO: 1572947 - RNA, 17 nt, Homo sapiens
ccugugcccagcaugcc

SEQ ID NO: 1572948 - RNA, 18 nt, Homo sapiens
ccugugcugugagugugu

SEQ ID NO: 1572949 - RNA, 15 nt, Homo sapiens
ccuguggugaagugu

SEQ ID NO: 1572950 - RNA, 12 nt, Homo sapiens
ccugugugaccc

SEQ ID NO: 1572951 - RNA, 19 nt, Homo sapiens
ccuguguggucuccaugcu

SEQ ID NO: 1572952 - RNA, 19 nt, Homo sapiens
ccuguguguauagcugugu

SEQ ID NO: 1572953 - RNA, 16 nt, Homo sapiens
cuaguccgcugaagau

SEQ ID NO: 1572954 - RNA, 13 nt, Homo sapiens
cuaguucugccag

SEQ ID NO: 1572955 - RNA, 20 nt, Homo sapiens
cuaguucugccaggagacag

SEQ ID NO: 1572956 - RNA, 17 nt, Homo sapiens
cuaguuuuuauacaugu

SEQ ID NO: 1572957 - RNA, 15 nt, Homo sapiens
cuauaaaagcuuucu

SEQ ID NO: 1572958 - RNA, 13 nt, Homo sapiens
cuauaaccucagc

SEQ ID NO: 1572959 - RNA, 18 nt, Homo sapiens
cuauaagauuccaaaaag

SEQ ID NO: 1572960 - RNA, 17 nt, Homo sapiens
cuauaaggaagauuugg

SEQ ID NO: 1572961 - RNA, 18 nt, Homo sapiens
cuauacaaaaugauuuug

SEQ ID NO: 1572962 - RNA, 15 nt, Homo sapiens
cuauacagcauacca

SEQ ID NO: 1572963 - RNA, 16 nt, Homo sapiens
cuauaccuuacugaca

SEQ ID NO: 1572964 - RNA, 9 nt, Homo sapiens
cuauacuug

SEQ ID NO: 1572965 - RNA, 14 nt, Homo sapiens
cuauacuugaacaa

SEQ ID NO: 1572966 - RNA, 19 nt, Homo sapiens
cuauacuugguuugcuacc

SEQ ID NO: 1572967 - RNA, 22 nt, Homo sapiens
cuauagcaacucauugguggua

SEQ ID NO: 1572968 - RNA, 18 nt, Homo sapiens
cuauagcacugagcucac

SEQ ID NO: 1572969 - RNA, 17 nt, Homo sapiens
cuauaggaacauaugaa

SEQ ID NO: 1572970 - RNA, 20 nt, Homo sapiens
cuauagggugugaugaaguc

SEQ ID NO: 1572971 - RNA, 23 nt, Homo sapiens
cuauaggugcuacaaaaacacag

SEQ ID NO: 1572972 - RNA, 14 nt, Homo sapiens
cuauaguauuugau

SEQ ID NO: 1572973 - RNA, 23 nt, Homo sapiens
cuauauauaaucaucaaguaaua

SEQ ID NO: 1572974 - RNA, 21 nt, Homo sapiens
cuauaucauaacuauacuuga

SEQ ID NO: 1572975 - RNA, 22 nt, Homo sapiens
cuauauuccuuuuucuaugaaa

SEQ ID NO: 1572976 - RNA, 20 nt, Homo sapiens
cuaucauaauucagcacuua

SEQ ID NO: 1572977 - RNA, 17 nt, Homo sapiens
cuaucauauauacugua

SEQ ID NO: 1572978 - RNA, 18 nt, Homo sapiens
cuaucauuggccuccaaa

SEQ ID NO: 1572979 - RNA, 18 nt, Homo sapiens
cuauccuggcaacucaag

SEQ ID NO: 1572980 - RNA, 21 nt, Homo sapiens
cuaucuacuacaaacuucaaa

SEQ ID NO: 1572981 - RNA, 23 nt, Homo sapiens
cuaucuacuacaaacuucaaaga

SEQ ID NO: 1572982 - RNA, 14 nt, Homo sapiens
cuaucuagcauuua

SEQ ID NO: 1572983 - RNA, 21 nt, Homo sapiens
cuaucucaugccagugccuua

SEQ ID NO: 1572984 - RNA, 20 nt, Homo sapiens
cuaucucuacugaaugucau

SEQ ID NO: 1572985 - RNA, 16 nt, Homo sapiens
cuaucugguauuaaau

SEQ ID NO: 1572986 - RNA, 17 nt, Homo sapiens
cuaugaauaugaucccu

SEQ ID NO: 1572987 - RNA, 13 nt, Homo sapiens
cuaugacaucuaa

SEQ ID NO: 1572988 - RNA, 16 nt, Homo sapiens
cuaugagcacauagga

SEQ ID NO: 1572989 - RNA, 20 nt, Homo sapiens
cuaugaucagaagacuuuaa

SEQ ID NO: 1572990 - RNA, 21 nt, Homo sapiens
cuaugauuguccguaggccca

SEQ ID NO: 1572991 - RNA, 16 nt, Homo sapiens
cuauggauucacuucu

SEQ ID NO: 1572992 - RNA, 23 nt, Homo sapiens
cuauggguugucaauaguauuaa

SEQ ID NO: 1572993 - RNA, 14 nt, Homo sapiens
cuauguaacaugua

SEQ ID NO: 1572994 - RNA, 21 nt, Homo sapiens
cuauguaauaauguacagagg

SEQ ID NO: 1572995 - RNA, 16 nt, Homo sapiens
cuauguauguguaaaa

SEQ ID NO: 1572996 - RNA, 14 nt, Homo sapiens
cuaugucuuucacc

SEQ ID NO: 1572997 - RNA, 22 nt, Homo sapiens
cuauguucuaagaagugaaaau

SEQ ID NO: 1572998 - RNA, 13 nt, Homo sapiens
cuauuacuaguac

SEQ ID NO: 1572999 - RNA, 15 nt, Homo sapiens
cuauuacuaguacua

SEQ ID NO: 1573000 - RNA, 12 nt, Homo sapiens
cuauuacuauua

SEQ ID NO: 1573001 - RNA, 16 nt, Homo sapiens
cuauuacuauuacuau

SEQ ID NO: 1573002 - RNA, 17 nt, Homo sapiens
cuauuauaagugcuuca

SEQ ID NO: 1573003 - RNA, 20 nt, Homo sapiens
cuauuauagcaacuuuaaga

SEQ ID NO: 1573004 - RNA, 12 nt, Homo sapiens
cuauuaucucaa

SEQ ID NO: 1573005 - RNA, 21 nt, Homo sapiens
cuauuauuuagaaaugaacaa

SEQ ID NO: 1573006 - RNA, 21 nt, Homo sapiens
cuauucgaaugaaaagacaag

SEQ ID NO: 1573007 - RNA, 21 nt, Homo sapiens
cuauugugaauauuuggaauu

SEQ ID NO: 1573008 - RNA, 13 nt, Homo sapiens
cuauuuaaagcau

SEQ ID NO: 1573009 - RNA, 22 nt, Homo sapiens
cuauuuauuuauuuauucauua

SEQ ID NO: 1573010 - RNA, 11 nt, Homo sapiens
cuauuuccauu

SEQ ID NO: 1573011 - RNA, 17 nt, Homo sapiens
cuauuucuccaaagccu

SEQ ID NO: 1573012 - RNA, 19 nt, Homo sapiens
cuauuucuucuacugcuau

SEQ ID NO: 1573013 - RNA, 15 nt, Homo sapiens
cuauuucuugaagaa

SEQ ID NO: 1573014 - RNA, 15 nt, Homo sapiens
cuauuuguacaauuu

SEQ ID NO: 1573015 - RNA, 18 nt, Homo sapiens
cuauuuuaaagacaaugu

SEQ ID NO: 1573016 - RNA, 16 nt, Homo sapiens
cuauuuuaaugaauga

SEQ ID NO: 1573017 - RNA, 21 nt, Homo sapiens
cuauuuuacuuuucugccaaa

SEQ ID NO: 1573018 - RNA, 23 nt, Homo sapiens
cuauuuuaggguucuaaaugcaa

SEQ ID NO: 1573019 - RNA, 20 nt, Homo sapiens
cuauuuugaugcagcauuug

SEQ ID NO: 1573020 - RNA, 17 nt, Homo sapiens
cucaaaaauaaugcaua

SEQ ID NO: 1573021 - RNA, 14 nt, Homo sapiens
cucaaaacuuucaa

SEQ ID NO: 1573022 - RNA, 18 nt, Homo sapiens
cucaaaauaccaugccau

SEQ ID NO: 1573023 - RNA, 19 nt, Homo sapiens
cucaaaaucugugaccugu

SEQ ID NO: 1573024 - RNA, 20 nt, Homo sapiens
cucaaacuccugaccucagg

SEQ ID NO: 1573025 - RNA, 13 nt, Homo sapiens
cucaaacuugaga

SEQ ID NO: 1573026 - RNA, 14 nt, Homo sapiens
cucaaagaaagugu

SEQ ID NO: 1573027 - RNA, 15 nt, Homo sapiens
cucaaagaucugaau

SEQ ID NO: 1573028 - RNA, 22 nt, Homo sapiens
cucaaagcauaaaauggaauaa

SEQ ID NO: 1573029 - RNA, 13 nt, Homo sapiens
cucaaagccucaa

SEQ ID NO: 1573030 - RNA, 14 nt, Homo sapiens
cucaaauacaugca

SEQ ID NO: 1573031 - RNA, 17 nt, Homo sapiens
cucaaaugcugggggua

SEQ ID NO: 1573032 - RNA, 12 nt, Homo sapiens
cucaacaagcaa

SEQ ID NO: 1573033 - RNA, 20 nt, Homo sapiens
cucaacaagcaagaucugcu

SEQ ID NO: 1573034 - RNA, 15 nt, Homo sapiens
cucaacagagagcaa

SEQ ID NO: 1573035 - RNA, 19 nt, Homo sapiens
cucaacugccuacuccaaa

SEQ ID NO: 1573036 - RNA, 21 nt, Homo sapiens
cucaacugccuacuccaaaau

SEQ ID NO: 1573037 - RNA, 14 nt, Homo sapiens
cucaagaguacaga

SEQ ID NO: 1573038 - RNA, 14 nt, Homo sapiens
cucaagauauggaa

SEQ ID NO: 1573039 - RNA, 14 nt, Homo sapiens
cucaaggacagcca

SEQ ID NO: 1573040 - RNA, 17 nt, Homo sapiens
cucaaggacagccacca

SEQ ID NO: 1573041 - RNA, 15 nt, Homo sapiens
cucaaguaccaccaa

SEQ ID NO: 1573042 - RNA, 21 nt, Homo sapiens
cucaagucugcacagagcaag

SEQ ID NO: 1573043 - RNA, 18 nt, Homo sapiens
cucaaguuuuuauaguua

SEQ ID NO: 1573044 - RNA, 16 nt, Homo sapiens
cucaauaaacagucac

SEQ ID NO: 1573045 - RNA, 14 nt, Homo sapiens
cucaauccuaucac

SEQ ID NO: 1573046 - RNA, 20 nt, Homo sapiens
cucaauucaaauccauagau

SEQ ID NO: 1573047 - RNA, 20 nt, Homo sapiens
cucaauugaaagugggcaaa

SEQ ID NO: 1573048 - RNA, 22 nt, Homo sapiens
cucacaaaguagaggaauccau

SEQ ID NO: 1573049 - RNA, 18 nt, Homo sapiens
cucacagaagaauaugac

SEQ ID NO: 1573050 - RNA, 18 nt, Homo sapiens
cucacagauuuaaagcau

SEQ ID NO: 1573051 - RNA, 23 nt, Homo sapiens
cucacagcugacuccaagcugca

SEQ ID NO: 1573052 - RNA, 14 nt, Homo sapiens
cucaccagucccau

SEQ ID NO: 1573053 - RNA, 17 nt, Homo sapiens
cucaccccccacacuca

SEQ ID NO: 1573054 - RNA, 19 nt, Homo sapiens
cucaccuagccugaugaga

SEQ ID NO: 1573055 - RNA, 15 nt, Homo sapiens
cucacguuugcuuaa

SEQ ID NO: 1573056 - RNA, 16 nt, Homo sapiens
cucacucacucugauu

SEQ ID NO: 1573057 - RNA, 15 nt, Homo sapiens
cucacucuucaagga

SEQ ID NO: 1573058 - RNA, 17 nt, Homo sapiens
cucacuuaauuuuccca

SEQ ID NO: 1573059 - RNA, 16 nt, Homo sapiens
cucacuuaguccuuua

SEQ ID NO: 1573060 - RNA, 16 nt, Homo sapiens
cucacuugguaaauga

SEQ ID NO: 1573061 - RNA, 14 nt, Homo sapiens
cucagaaaucuguu

SEQ ID NO: 1573062 - RNA, 20 nt, Homo sapiens
cucagaauugaucauuuucc

SEQ ID NO: 1573063 - RNA, 15 nt, Homo sapiens
cucagaggguguccu

SEQ ID NO: 1573064 - RNA, 18 nt, Homo sapiens
cucagaucaguguaccau

SEQ ID NO: 1573065 - RNA, 23 nt, Homo sapiens
cucagaucauuaucagccugugc

SEQ ID NO: 1573066 - RNA, 16 nt, Homo sapiens
cucagauuccaccuag

SEQ ID NO: 1573067 - RNA, 23 nt, Homo sapiens
cucagcacauucgggaccaauau

SEQ ID NO: 1573068 - RNA, 14 nt, Homo sapiens
cucagcauuuccac

SEQ ID NO: 1573069 - RNA, 11 nt, Homo sapiens
cucagccagcc

SEQ ID NO: 1573070 - RNA, 22 nt, Homo sapiens
cucagccuuccuccucauccuc

SEQ ID NO: 1573071 - RNA, 21 nt, Homo sapiens
gaauggagggaaugcucagaa

SEQ ID NO: 1573072 - RNA, 20 nt, Homo sapiens
gaauggguguuguaugggga

SEQ ID NO: 1573073 - RNA, 16 nt, Homo sapiens
gaauggucucugucaa

SEQ ID NO: 1573074 - RNA, 11 nt, Homo sapiens
gaauggugcuu

SEQ ID NO: 1573075 - RNA, 15 nt, Homo sapiens
gaauguaugugcaca

SEQ ID NO: 1573076 - RNA, 19 nt, Homo sapiens
gaaugucauagucuugaaa

SEQ ID NO: 1573077 - RNA, 12 nt, Homo sapiens
gaaugucucagc

SEQ ID NO: 1573078 - RNA, 11 nt, Homo sapiens
gaaugugauuu

SEQ ID NO: 1573079 - RNA, 19 nt, Homo sapiens
gaauguguuauuugucaca

SEQ ID NO: 1573080 - RNA, 20 nt, Homo sapiens
gaauguguuauuugucacaa

SEQ ID NO: 1573081 - RNA, 16 nt, Homo sapiens
gaauguugcaauguga

SEQ ID NO: 1573082 - RNA, 17 nt, Homo sapiens
gaauuaaaaaagcauac

SEQ ID NO: 1573083 - RNA, 19 nt, Homo sapiens
gaauuaaaucaucccuuaa

SEQ ID NO: 1573084 - RNA, 15 nt, Homo sapiens
gaauuaacacaugau

SEQ ID NO: 1573085 - RNA, 15 nt, Homo sapiens
gaauuaacccaaaga

SEQ ID NO: 1573086 - RNA, 21 nt, Homo sapiens
gaauuaagaauugguugccau

SEQ ID NO: 1573087 - RNA, 22 nt, Homo sapiens
gaauuacuaaauuacaaaugca

SEQ ID NO: 1573088 - RNA, 17 nt, Homo sapiens
gaauucaccaguguucc

SEQ ID NO: 1573089 - RNA, 13 nt, Homo sapiens
gaauucacugagu

SEQ ID NO: 1573090 - RNA, 21 nt, Homo sapiens
gaauucagucaaagauacaca

SEQ ID NO: 1573091 - RNA, 15 nt, Homo sapiens
gaauuccaaagcaaa

SEQ ID NO: 1573092 - RNA, 20 nt, Homo sapiens
gaauuccacuccuuccagaa

SEQ ID NO: 1573093 - RNA, 19 nt, Homo sapiens
gaauucugaauguacacuu

SEQ ID NO: 1573094 - RNA, 17 nt, Homo sapiens
gaauugaugaugcaguu

SEQ ID NO: 1573095 - RNA, 19 nt, Homo sapiens
gaauuggcauaauuugucu

SEQ ID NO: 1573096 - RNA, 18 nt, Homo sapiens
gaauuggccgcugucacu

SEQ ID NO: 1573097 - RNA, 19 nt, Homo sapiens
gaauuggcuaaaagacaug

SEQ ID NO: 1573098 - RNA, 12 nt, Homo sapiens
gaauuguuacau

SEQ ID NO: 1573099 - RNA, 20 nt, Homo sapiens
gaauuguuuuuugcucuuuu

SEQ ID NO: 1573100 - RNA, 21 nt, Homo sapiens
gaauuuaaaaaaacgagcaau

SEQ ID NO: 1573101 - RNA, 18 nt, Homo sapiens
gaauuuagaaaaagucaa

SEQ ID NO: 1573102 - RNA, 15 nt, Homo sapiens
gaauuuccucuauug

SEQ ID NO: 1573103 - RNA, 19 nt, Homo sapiens
gaauuuguuugugacaacu

SEQ ID NO: 1573104 - RNA, 17 nt, Homo sapiens
gaauuuguuuuagccau

SEQ ID NO: 1573105 - RNA, 16 nt, Homo sapiens
gaauuuuuaaacaagu

SEQ ID NO: 1573106 - RNA, 22 nt, Homo sapiens
gaauuuuuuuguaauaagcaau

SEQ ID NO: 1573107 - RNA, 22 nt, Homo sapiens
gaauuuuuuuuuuuaagcucaa

SEQ ID NO: 1573108 - RNA, 17 nt, Homo sapiens
gacaaagaaacccaagu

SEQ ID NO: 1573109 - RNA, 23 nt, Homo sapiens
gacaaagagauugagguucucua

SEQ ID NO: 1573110 - RNA, 20 nt, Homo sapiens
gacaaaucuaaaaugcaaag

SEQ ID NO: 1573111 - RNA, 23 nt, Homo sapiens
gacaacaaaugggucccucaguc

SEQ ID NO: 1573112 - RNA, 14 nt, Homo sapiens
gacaacuguuuaau

SEQ ID NO: 1573113 - RNA, 14 nt, Homo sapiens
gacaagaacaaagc

SEQ ID NO: 1573114 - RNA, 11 nt, Homo sapiens
gacaagccauc

SEQ ID NO: 1573115 - RNA, 13 nt, Homo sapiens
gacaaggugcuaa

SEQ ID NO: 1573116 - RNA, 23 nt, Homo sapiens
gacaauaguauuucuccuuugca

SEQ ID NO: 1573117 - RNA, 19 nt, Homo sapiens
gacaauuccuccagagaca

SEQ ID NO: 1573118 - RNA, 18 nt, Homo sapiens
gacacacauucugccuug

SEQ ID NO: 1573119 - RNA, 18 nt, Homo sapiens
gacacauagaaaacaauc

SEQ ID NO: 1573120 - RNA, 19 nt, Homo sapiens
gacacauagaaaacaauca

SEQ ID NO: 1573121 - RNA, 20 nt, Homo sapiens
gacacaugaagguaaauaaa

SEQ ID NO: 1573122 - RNA, 19 nt, Homo sapiens
gacacauuggaaugccuug

SEQ ID NO: 1573123 - RNA, 13 nt, Homo sapiens
gacaccuccuucu

SEQ ID NO: 1573124 - RNA, 17 nt, Homo sapiens
gacaccuguacauucuu

SEQ ID NO: 1573125 - RNA, 21 nt, Homo sapiens
gacacugaaaguuuuguaaaa

SEQ ID NO: 1573126 - RNA, 22 nt, Homo sapiens
gacagaaaaauugaacuacagc

SEQ ID NO: 1573127 - RNA, 13 nt, Homo sapiens
gacagaacuggug

SEQ ID NO: 1573128 - RNA, 15 nt, Homo sapiens
gacagacggaaauga

SEQ ID NO: 1573129 - RNA, 20 nt, Homo sapiens
gacagagugagaccauguuu

SEQ ID NO: 1573130 - RNA, 19 nt, Homo sapiens
gacagauuuaaccucugcc

SEQ ID NO: 1573131 - RNA, 15 nt, Homo sapiens
gacagccccugcaac

SEQ ID NO: 1573132 - RNA, 14 nt, Homo sapiens
gacagcccuuccuc

SEQ ID NO: 1573133 - RNA, 14 nt, Homo sapiens
gacagcuugggagg

SEQ ID NO: 1573134 - RNA, 18 nt, Homo sapiens
gacagcuuuccucaaaaa

SEQ ID NO: 1573135 - RNA, 15 nt, Homo sapiens
gacaggagcacugca

SEQ ID NO: 1573136 - RNA, 18 nt, Homo sapiens
gacaggcuccucugggga

SEQ ID NO: 1573137 - RNA, 23 nt, Homo sapiens
gacaggcuggguccugccagcug

SEQ ID NO: 1573138 - RNA, 20 nt, Homo sapiens
gacagggacaugcccugugu

SEQ ID NO: 1573139 - RNA, 21 nt, Homo sapiens
gacagggacaugcccugugug

SEQ ID NO: 1573140 - RNA, 20 nt, Homo sapiens
gacaguccaaaccacuccac

SEQ ID NO: 1573141 - RNA, 14 nt, Homo sapiens
gacaguccacaggg

SEQ ID NO: 1573142 - RNA, 19 nt, Homo sapiens
gacagugaagcagcacugu

SEQ ID NO: 1573143 - RNA, 18 nt, Homo sapiens
gacagugaggcaggagaa

SEQ ID NO: 1573144 - RNA, 17 nt, Homo sapiens
gacauacauauuaucuc

SEQ ID NO: 1573145 - RNA, 19 nt, Homo sapiens
gacauacauauuaucucau

SEQ ID NO: 1573146 - RNA, 17 nt, Homo sapiens
gacauagcgagacucca

SEQ ID NO: 1573147 - RNA, 21 nt, Homo sapiens
gacaucaaagugguaaauacu

SEQ ID NO: 1573148 - RNA, 18 nt, Homo sapiens
gacauccagcgugacgga

SEQ ID NO: 1573149 - RNA, 19 nt, Homo sapiens
gacaugaagacaccaucuc

SEQ ID NO: 1573150 - RNA, 20 nt, Homo sapiens
gacaugugcuggacacuguc

SEQ ID NO: 1573151 - RNA, 16 nt, Homo sapiens
gacauuacuuguuuua

SEQ ID NO: 1573152 - RNA, 13 nt, Homo sapiens
gacauuccaccau

SEQ ID NO: 1573153 - RNA, 13 nt, Homo sapiens
gacauuguuacaa

SEQ ID NO: 1573154 - RNA, 23 nt, Homo sapiens
gacauuucgaagucaucauuccu

SEQ ID NO: 1573155 - RNA, 19 nt, Homo sapiens
gacauuucucaagggccau

SEQ ID NO: 1573156 - RNA, 23 nt, Homo sapiens
gacauuucucaagggccaugugg

SEQ ID NO: 1573157 - RNA, 20 nt, Homo sapiens
gacauuuuggaagcugagau

SEQ ID NO: 1573158 - RNA, 21 nt, Homo sapiens
gacauuuuguuuuuacuguau

SEQ ID NO: 1573159 - RNA, 13 nt, Homo sapiens
gaccaaaucucag

SEQ ID NO: 1573160 - RNA, 20 nt, Homo sapiens
gaccaaaugcuuuuccucaa

SEQ ID NO: 1573161 - RNA, 14 nt, Homo sapiens
gaccaagcacaaaa

SEQ ID NO: 1573162 - RNA, 20 nt, Homo sapiens
gaccaaucaucaacuaccau

SEQ ID NO: 1573163 - RNA, 19 nt, Homo sapiens
gaccacauaagaaggcaau

SEQ ID NO: 1573164 - RNA, 15 nt, Homo sapiens
gaccacuuccagggg

SEQ ID NO: 1573165 - RNA, 23 nt, Homo sapiens
gaccagccuggucaacauaguga

SEQ ID NO: 1573166 - RNA, 18 nt, Homo sapiens
gaccaggccaagacucaa

SEQ ID NO: 1573167 - RNA, 12 nt, Homo sapiens
gaccaggucuca

SEQ ID NO: 1573168 - RNA, 19 nt, Homo sapiens
gaccauuuuuacauccaug

SEQ ID NO: 1573169 - RNA, 20 nt, Homo sapiens
gacccaaaaaaucaucucac

SEQ ID NO: 1573170 - RNA, 15 nt, Homo sapiens
gacccacacuuccau

SEQ ID NO: 1573171 - RNA, 20 nt, Homo sapiens
gacccacacuuccaugagaa

SEQ ID NO: 1573172 - RNA, 16 nt, Homo sapiens
gacccacgaaacugcc

SEQ ID NO: 1573173 - RNA, 21 nt, Homo sapiens
gacccaguggucagcaggugu

SEQ ID NO: 1573174 - RNA, 17 nt, Homo sapiens
gaccccagccauccagg

SEQ ID NO: 1573175 - RNA, 11 nt, Homo sapiens
gaccccagugu

SEQ ID NO: 1573176 - RNA, 14 nt, Homo sapiens
gaccccaugucucc

SEQ ID NO: 1573177 - RNA, 15 nt, Homo sapiens
gacccccagcacuug

SEQ ID NO: 1573178 - RNA, 23 nt, Homo sapiens
gacccccagcacuuggggguuca

SEQ ID NO: 1573179 - RNA, 15 nt, Homo sapiens
gaccccuuguuacuc

SEQ ID NO: 1573180 - RNA, 20 nt, Homo sapiens
gaccccuuguuacucaggaa

SEQ ID NO: 1573181 - RNA, 15 nt, Homo sapiens
gacccugcaagacca

SEQ ID NO: 1573182 - RNA, 17 nt, Homo sapiens
gacccugccacagccag

SEQ ID NO: 1573183 - RNA, 17 nt, Homo sapiens
gacccuggggcaggggu

SEQ ID NO: 1573184 - RNA, 16 nt, Homo sapiens
gacccuguccggccca

SEQ ID NO: 1573185 - RNA, 16 nt, Homo sapiens
gacccugucucaaaaa

SEQ ID NO: 1573186 - RNA, 14 nt, Homo sapiens
gaccgaacacugca

SEQ ID NO: 1573187 - RNA, 20 nt, Homo sapiens
gaccgugaccguuugcuaua

SEQ ID NO: 1573188 - RNA, 20 nt, Homo sapiens
gaccguuugcuauauuccuu

SEQ ID NO: 1573189 - RNA, 22 nt, Homo sapiens
gaugggcaaacccuggugcuuu

SEQ ID NO: 1573190 - RNA, 15 nt, Homo sapiens
gaugguaaaccagau

SEQ ID NO: 1573191 - RNA, 16 nt, Homo sapiens
gauggucucgaucucu

SEQ ID NO: 1573192 - RNA, 15 nt, Homo sapiens
gauggugcaugccug

SEQ ID NO: 1573193 - RNA, 17 nt, Homo sapiens
gaugguuuaauagguaa

SEQ ID NO: 1573194 - RNA, 22 nt, Homo sapiens
gauguaaaaaugaaaagccaaa

SEQ ID NO: 1573195 - RNA, 23 nt, Homo sapiens
gauguaaaaaugaaaagccaaau

SEQ ID NO: 1573196 - RNA, 18 nt, Homo sapiens
gauguaauaaucauuuua

SEQ ID NO: 1573197 - RNA, 12 nt, Homo sapiens
gaugucacucac

SEQ ID NO: 1573198 - RNA, 16 nt, Homo sapiens
gaugucuauguagcug

SEQ ID NO: 1573199 - RNA, 17 nt, Homo sapiens
gaugucuccacuuucac

SEQ ID NO: 1573200 - RNA, 17 nt, Homo sapiens
gaugucugggugaccuc

SEQ ID NO: 1573201 - RNA, 18 nt, Homo sapiens
gaugugaaaauauacuug

SEQ ID NO: 1573202 - RNA, 14 nt, Homo sapiens
gaugugacugccau

SEQ ID NO: 1573203 - RNA, 14 nt, Homo sapiens
gaugugagccaccg

SEQ ID NO: 1573204 - RNA, 20 nt, Homo sapiens
gauguggccaggggugcucc

SEQ ID NO: 1573205 - RNA, 18 nt, Homo sapiens
gauguggccugcauguac

SEQ ID NO: 1573206 - RNA, 14 nt, Homo sapiens
gaugugucuuacca

SEQ ID NO: 1573207 - RNA, 18 nt, Homo sapiens
gauguugcuuuugcaccu

SEQ ID NO: 1573208 - RNA, 19 nt, Homo sapiens
gauguuucuggaauugaua

SEQ ID NO: 1573209 - RNA, 15 nt, Homo sapiens
gauuaaaaauaccuu

SEQ ID NO: 1573210 - RNA, 16 nt, Homo sapiens
gauuacaggcaccugc

SEQ ID NO: 1573211 - RNA, 17 nt, Homo sapiens
gauuacaucugccuuaa

SEQ ID NO: 1573212 - RNA, 12 nt, Homo sapiens
gauuacauguua

SEQ ID NO: 1573213 - RNA, 12 nt, Homo sapiens
gauuacccugag

SEQ ID NO: 1573214 - RNA, 21 nt, Homo sapiens
gauuacugccauucacuucau

SEQ ID NO: 1573215 - RNA, 13 nt, Homo sapiens
gauuauaaaguuu

SEQ ID NO: 1573216 - RNA, 19 nt, Homo sapiens
gauuaugugacuugcaaua

SEQ ID NO: 1573217 - RNA, 21 nt, Homo sapiens
gauucaagacucaauguggaa

SEQ ID NO: 1573218 - RNA, 14 nt, Homo sapiens
gauucaagagccag

SEQ ID NO: 1573219 - RNA, 15 nt, Homo sapiens
gauucaggggucuga

SEQ ID NO: 1573220 - RNA, 21 nt, Homo sapiens
gauuccuagauuacaucugcc

SEQ ID NO: 1573221 - RNA, 13 nt, Homo sapiens
gauucucacauau

SEQ ID NO: 1573222 - RNA, 23 nt, Homo sapiens
gauucuuauuaguuccccaaaua

SEQ ID NO: 1573223 - RNA, 17 nt, Homo sapiens
gauugaaauuuugcacc

SEQ ID NO: 1573224 - RNA, 15 nt, Homo sapiens
gauugaggacuacuu

SEQ ID NO: 1573225 - RNA, 16 nt, Homo sapiens
gauugcauuguaugaa

SEQ ID NO: 1573226 - RNA, 22 nt, Homo sapiens
gauugccccuggcuuugccucu

SEQ ID NO: 1573227 - RNA, 23 nt, Homo sapiens
gauugccucugaagccuauguau

SEQ ID NO: 1573228 - RNA, 17 nt, Homo sapiens
gauugcgccugagauac

SEQ ID NO: 1573229 - RNA, 13 nt, Homo sapiens
gauugguugccuc

SEQ ID NO: 1573230 - RNA, 18 nt, Homo sapiens
gauugucuuacuguugca

SEQ ID NO: 1573231 - RNA, 20 nt, Homo sapiens
gauugugccccugcacucca

SEQ ID NO: 1573232 - RNA, 17 nt, Homo sapiens
gauuguugucaggccau

SEQ ID NO: 1573233 - RNA, 18 nt, Homo sapiens
gauuuaaagcaucaucug

SEQ ID NO: 1573234 - RNA, 15 nt, Homo sapiens
gauuuaauguugauu

SEQ ID NO: 1573235 - RNA, 16 nt, Homo sapiens
gauuuaugaugcacuu

SEQ ID NO: 1573236 - RNA, 21 nt, Homo sapiens
gauuuauuuuaauuguugaua

SEQ ID NO: 1573237 - RNA, 21 nt, Homo sapiens
gauuucccacugcacuccagc

SEQ ID NO: 1573238 - RNA, 19 nt, Homo sapiens
gauuuccuugugcaaaaua

SEQ ID NO: 1573239 - RNA, 18 nt, Homo sapiens
gauuucuauggcuuucaa

SEQ ID NO: 1573240 - RNA, 19 nt, Homo sapiens
gauuugaagaacaugugag

SEQ ID NO: 1573241 - RNA, 16 nt, Homo sapiens
gauuugcauaaaguga

SEQ ID NO: 1573242 - RNA, 22 nt, Homo sapiens
gauuugcuuccauuuuccuaca

SEQ ID NO: 1573243 - RNA, 18 nt, Homo sapiens
gauuuggccacacugggg

SEQ ID NO: 1573244 - RNA, 16 nt, Homo sapiens
gauuugggugaacaaa

SEQ ID NO: 1573245 - RNA, 18 nt, Homo sapiens
gauuuugaaucaagcaau

SEQ ID NO: 1573246 - RNA, 24 nt, Homo sapiens
gauuuuguuggugaguagucucau

SEQ ID NO: 1573247 - RNA, 17 nt, Homo sapiens
gauuuuuuccucugcau

SEQ ID NO: 1573248 - RNA, 18 nt, Homo sapiens
gauuuuuuccucugcauu

SEQ ID NO: 1573249 - RNA, 20 nt, Homo sapiens
gcaaaaaagaaaaauaauca

SEQ ID NO: 1573250 - RNA, 14 nt, Homo sapiens
gcaaaaaauacuuu

SEQ ID NO: 1573251 - RNA, 17 nt, Homo sapiens
gcaaaaucaacaugacu

SEQ ID NO: 1573252 - RNA, 19 nt, Homo sapiens
gcaaaauuaaauacauaaa

SEQ ID NO: 1573253 - RNA, 18 nt, Homo sapiens
gcaaacaaauaaaaugaa

SEQ ID NO: 1573254 - RNA, 20 nt, Homo sapiens
gcaaacaaauaaaaugaaau

SEQ ID NO: 1573255 - RNA, 17 nt, Homo sapiens
gcaaacguuucuugaac

SEQ ID NO: 1573256 - RNA, 14 nt, Homo sapiens
gcaaacuuacaggu

SEQ ID NO: 1573257 - RNA, 18 nt, Homo sapiens
gcaaagccuuuccagaaa

SEQ ID NO: 1573258 - RNA, 23 nt, Homo sapiens
gcaaagcgauuccuaccauacaa

SEQ ID NO: 1573259 - RNA, 12 nt, Homo sapiens
gcaaaggaacua

SEQ ID NO: 1573260 - RNA, 22 nt, Homo sapiens
gcaaauaaaauaaaugaaaucu

SEQ ID NO: 1573261 - RNA, 16 nt, Homo sapiens
gcaaauaaaccacuuu

SEQ ID NO: 1573262 - RNA, 19 nt, Homo sapiens
gcaaauaaauuaugcaauu

SEQ ID NO: 1573263 - RNA, 18 nt, Homo sapiens
gcaaaucacaacauucug

SEQ ID NO: 1573264 - RNA, 20 nt, Homo sapiens
gcaacaauaaaguacuuuac

SEQ ID NO: 1573265 - RNA, 20 nt, Homo sapiens
gcaacaugccagccacugug

SEQ ID NO: 1573266 - RNA, 21 nt, Homo sapiens
gcaacaugccagccacuguga

SEQ ID NO: 1573267 - RNA, 20 nt, Homo sapiens
gcaaccaacugccccagggg

SEQ ID NO: 1573268 - RNA, 17 nt, Homo sapiens
gcaacuggaguuccuua

SEQ ID NO: 1573269 - RNA, 15 nt, Homo sapiens
gcaacuguaugaaaa

SEQ ID NO: 1573270 - RNA, 15 nt, Homo sapiens
gcaagaagcuguuac

SEQ ID NO: 1573271 - RNA, 17 nt, Homo sapiens
gcaagagggaaugucag

SEQ ID NO: 1573272 - RNA, 13 nt, Homo sapiens
gcaagaugagcug

SEQ ID NO: 1573273 - RNA, 10 nt, Homo sapiens
gcaagcaaaa

SEQ ID NO: 1573274 - RNA, 11 nt, Homo sapiens
gcaagccagac

SEQ ID NO: 1573275 - RNA, 20 nt, Homo sapiens
gcaagcuaaccuuauccugc

SEQ ID NO: 1573276 - RNA, 13 nt, Homo sapiens
gcaaggugacauu

SEQ ID NO: 1573277 - RNA, 11 nt, Homo sapiens
gcaaggugcau

SEQ ID NO: 1573278 - RNA, 17 nt, Homo sapiens
gcaaguacgcaagaaau

SEQ ID NO: 1573279 - RNA, 15 nt, Homo sapiens
gcaagugaaagcaag

SEQ ID NO: 1573280 - RNA, 17 nt, Homo sapiens
gcaagugaacucauccc

SEQ ID NO: 1573281 - RNA, 15 nt, Homo sapiens
gcaaguguaucuccu

SEQ ID NO: 1573282 - RNA, 17 nt, Homo sapiens
gcaaguuaacuuggaaa

SEQ ID NO: 1573283 - RNA, 20 nt, Homo sapiens
gcaaguugcucugaccuccu

SEQ ID NO: 1573284 - RNA, 18 nt, Homo sapiens
gcaaguuuuaaacccaaa

SEQ ID NO: 1573285 - RNA, 18 nt, Homo sapiens
gcaauaaaaaucauagua

SEQ ID NO: 1573286 - RNA, 17 nt, Homo sapiens
gcaauaaacauaugugu

SEQ ID NO: 1573287 - RNA, 19 nt, Homo sapiens
gcaauaagauugcgccuga

SEQ ID NO: 1573288 - RNA, 17 nt, Homo sapiens
gcaauaauaagugaugu

SEQ ID NO: 1573289 - RNA, 14 nt, Homo sapiens
gcaauaaugcagua

SEQ ID NO: 1573290 - RNA, 13 nt, Homo sapiens
gcaauacauuuca

SEQ ID NO: 1573291 - RNA, 20 nt, Homo sapiens
gcaauacugagugugccuca

SEQ ID NO: 1573292 - RNA, 22 nt, Homo sapiens
gcaaucacaaaggcugacauuc

SEQ ID NO: 1573293 - RNA, 15 nt, Homo sapiens
gcaaucguucugcug

SEQ ID NO: 1573294 - RNA, 23 nt, Homo sapiens
gcaaucuaaucugaacugaccuu

SEQ ID NO: 1573295 - RNA, 16 nt, Homo sapiens
gcaaugagacuacaac

SEQ ID NO: 1573296 - RNA, 21 nt, Homo sapiens
gcaauggaagcccucaaagaa

SEQ ID NO: 1573297 - RNA, 19 nt, Homo sapiens
gcaauuacaauacaucuaa

SEQ ID NO: 1573298 - RNA, 21 nt, Homo sapiens
gcaauugaauuaaauuaggaa

SEQ ID NO: 1573299 - RNA, 13 nt, Homo sapiens
gcaauuguggaag

SEQ ID NO: 1573300 - RNA, 23 nt, Homo sapiens
gcaauuuuaguguauuaaucaua

SEQ ID NO: 1573301 - RNA, 15 nt, Homo sapiens
gcacaaaacuacuuu

SEQ ID NO: 1573302 - RNA, 22 nt, Homo sapiens
gcacaaaaugggacugcugaag

SEQ ID NO: 1573303 - RNA, 21 nt, Homo sapiens
gcacaacgcaccagacacuca

SEQ ID NO: 1573304 - RNA, 13 nt, Homo sapiens
gcacacacaugca

SEQ ID NO: 1573305 - RNA, 20 nt, Homo sapiens
gcacacauuauuuggcuuaa

SEQ ID NO: 1573306 - RNA, 22 nt, Homo sapiens
gcacaccccuggggcugagucu

SEQ ID NO: 1573307 - RNA, 18 nt, Homo sapiens
gccugaaaugacauuuca

SEQ ID NO: 1573308 - RNA, 23 nt, Homo sapiens
gccugaacagcccucucucucac

SEQ ID NO: 1573309 - RNA, 18 nt, Homo sapiens
gccugaagaagcacuucu

SEQ ID NO: 1573310 - RNA, 21 nt, Homo sapiens
gccugaagaagcacuucugcu

SEQ ID NO: 1573311 - RNA, 21 nt, Homo sapiens
gccugaauuggcuaugcagua

SEQ ID NO: 1573312 - RNA, 22 nt, Homo sapiens
gccugagcuggccuccuaugcc

SEQ ID NO: 1573313 - RNA, 14 nt, Homo sapiens
gccugaggcuguaa

SEQ ID NO: 1573314 - RNA, 11 nt, Homo sapiens
gccugcacugg

SEQ ID NO: 1573315 - RNA, 16 nt, Homo sapiens
gccugccuggcaggcu

SEQ ID NO: 1573316 - RNA, 18 nt, Homo sapiens
gccugcuggccgacccac

SEQ ID NO: 1573317 - RNA, 17 nt, Homo sapiens
gccuggaccagccucuc

SEQ ID NO: 1573318 - RNA, 16 nt, Homo sapiens
gccuggagacauauca

SEQ ID NO: 1573319 - RNA, 18 nt, Homo sapiens
gccuggagcuaauggcga

SEQ ID NO: 1573320 - RNA, 14 nt, Homo sapiens
gccuggccaccagc

SEQ ID NO: 1573321 - RNA, 16 nt, Homo sapiens
gccuggccaccagcca

SEQ ID NO: 1573322 - RNA, 20 nt, Homo sapiens
gccuggccaggagcucuuca

SEQ ID NO: 1573323 - RNA, 20 nt, Homo sapiens
gccuggccuccaaaauauua

SEQ ID NO: 1573324 - RNA, 22 nt, Homo sapiens
gccuggcuguggccuaaccugc

SEQ ID NO: 1573325 - RNA, 23 nt, Homo sapiens
gccugggcaacgagugaaacucc

SEQ ID NO: 1573326 - RNA, 16 nt, Homo sapiens
gccugggggauguacc

SEQ ID NO: 1573327 - RNA, 14 nt, Homo sapiens
gccugggucauggg

SEQ ID NO: 1573328 - RNA, 21 nt, Homo sapiens
gccugguggcaagagggaaug

SEQ ID NO: 1573329 - RNA, 11 nt, Homo sapiens
gccuggugggc

SEQ ID NO: 1573330 - RNA, 13 nt, Homo sapiens
gccuguaauccca

SEQ ID NO: 1573331 - RNA, 14 nt, Homo sapiens
gccuguaaucccag

SEQ ID NO: 1573332 - RNA, 19 nt, Homo sapiens
gccuguaaucccagcacuu

SEQ ID NO: 1573333 - RNA, 20 nt, Homo sapiens
gccuguaaucccagcacuuu

SEQ ID NO: 1573334 - RNA, 20 nt, Homo sapiens
gccuguaaucucagcacuuu

SEQ ID NO: 1573335 - RNA, 23 nt, Homo sapiens
gccugucgcaugagaacauuaac

SEQ ID NO: 1573336 - RNA, 14 nt, Homo sapiens
gccugucuucagag

SEQ ID NO: 1573337 - RNA, 12 nt, Homo sapiens
gccugugccuuu

SEQ ID NO: 1573338 - RNA, 12 nt, Homo sapiens
gccuuacuguac

SEQ ID NO: 1573339 - RNA, 23 nt, Homo sapiens
gccuuauuucucauugccucuuc

SEQ ID NO: 1573340 - RNA, 22 nt, Homo sapiens
gccuuggaggaaaugugcucaa

SEQ ID NO: 1573341 - RNA, 18 nt, Homo sapiens
gccuuguaagacccuuau

SEQ ID NO: 1573342 - RNA, 22 nt, Homo sapiens
gccuuguuugaguuuuuccucc

SEQ ID NO: 1573343 - RNA, 18 nt, Homo sapiens
gccuuuaaaucugugaug

SEQ ID NO: 1573344 - RNA, 17 nt, Homo sapiens
gccuuuauuuccacugu

SEQ ID NO: 1573345 - RNA, 15 nt, Homo sapiens
gccuuuguuucccau

SEQ ID NO: 1573346 - RNA, 20 nt, Homo sapiens
gccuuuuccacacgcauuaa

SEQ ID NO: 1573347 - RNA, 17 nt, Homo sapiens
gcgaaaaaaucagugaa

SEQ ID NO: 1573348 - RNA, 20 nt, Homo sapiens
gcgaucucagcucaccucaa

SEQ ID NO: 1573349 - RNA, 15 nt, Homo sapiens
gcgauggcagugaga

SEQ ID NO: 1573350 - RNA, 13 nt, Homo sapiens
gcgcaccaucucu

SEQ ID NO: 1573351 - RNA, 22 nt, Homo sapiens
gcgcaguguggaggccacuguu

SEQ ID NO: 1573352 - RNA, 22 nt, Homo sapiens
gcgcaguuggucuuuaaccacu

SEQ ID NO: 1573353 - RNA, 19 nt, Homo sapiens
gcgccaagucuggcaccau

SEQ ID NO: 1573354 - RNA, 15 nt, Homo sapiens
gcgccacccgggcaa

SEQ ID NO: 1573355 - RNA, 20 nt, Homo sapiens
gcgccacccgggcaaggguc

SEQ ID NO: 1573356 - RNA, 21 nt, Homo sapiens
gcgcccuuaacugcauccagc

SEQ ID NO: 1573357 - RNA, 13 nt, Homo sapiens
gcgccugagauac

SEQ ID NO: 1573358 - RNA, 21 nt, Homo sapiens
gcgccugccaucaugccugac

SEQ ID NO: 1573359 - RNA, 15 nt, Homo sapiens
gcgccuucgugccug

SEQ ID NO: 1573360 - RNA, 15 nt, Homo sapiens
gcgcuauccacagaa

SEQ ID NO: 1573361 - RNA, 15 nt, Homo sapiens
gcgcucccuugccuu

SEQ ID NO: 1573362 - RNA, 22 nt, Homo sapiens
gcggaccccucgucaucaggug

SEQ ID NO: 1573363 - RNA, 13 nt, Homo sapiens
gcggagguugcag

SEQ ID NO: 1573364 - RNA, 22 nt, Homo sapiens
gcgggcucagagcuuugucacu

SEQ ID NO: 1573365 - RNA, 14 nt, Homo sapiens
gcggggugcagaag

SEQ ID NO: 1573366 - RNA, 22 nt, Homo sapiens
gcgguggcucacgccuguaauc

SEQ ID NO: 1573367 - RNA, 12 nt, Homo sapiens
gcguuacugcuu

SEQ ID NO: 1573368 - RNA, 24 nt, Homo sapiens
gcguucugcaagcaucaguucuac

SEQ ID NO: 1573369 - RNA, 22 nt, Homo sapiens
gcguuuuuuaaauguauacuau

SEQ ID NO: 1573370 - RNA, 14 nt, Homo sapiens
gcuaaaaaagcaua

SEQ ID NO: 1573371 - RNA, 19 nt, Homo sapiens
gcuaaacgcaaugucauuu

SEQ ID NO: 1573372 - RNA, 14 nt, Homo sapiens
gcuaaagcaguguu

SEQ ID NO: 1573373 - RNA, 12 nt, Homo sapiens
gcuaaagugauc

SEQ ID NO: 1573374 - RNA, 14 nt, Homo sapiens
gcuaaggcagcuga

SEQ ID NO: 1573375 - RNA, 23 nt, Homo sapiens
gcuaauucuacucacagugcuuu

SEQ ID NO: 1573376 - RNA, 21 nt, Homo sapiens
gcuaauuuacuggacaaagaa

SEQ ID NO: 1573377 - RNA, 14 nt, Homo sapiens
gcuacaaucuugga

SEQ ID NO: 1573378 - RNA, 12 nt, Homo sapiens
gcuacagggcca

SEQ ID NO: 1573379 - RNA, 13 nt, Homo sapiens
gcuacagggccaa

SEQ ID NO: 1573380 - RNA, 16 nt, Homo sapiens
gcuacauauaugcaau

SEQ ID NO: 1573381 - RNA, 13 nt, Homo sapiens
gcuaccaucucau

SEQ ID NO: 1573382 - RNA, 17 nt, Homo sapiens
gcuacuauaaucaaaug

SEQ ID NO: 1573383 - RNA, 18 nt, Homo sapiens
gcuacuauagguccagaa

SEQ ID NO: 1573384 - RNA, 17 nt, Homo sapiens
gcuacucgauagccuga

SEQ ID NO: 1573385 - RNA, 22 nt, Homo sapiens
gcuagaaagcauccauuaauua

SEQ ID NO: 1573386 - RNA, 13 nt, Homo sapiens
gcuagaaccugga

SEQ ID NO: 1573387 - RNA, 22 nt, Homo sapiens
gcuaggcgcuggggagacugau

SEQ ID NO: 1573388 - RNA, 20 nt, Homo sapiens
gcuaggguggcccuugcagu

SEQ ID NO: 1573389 - RNA, 13 nt, Homo sapiens
gcuauaggugcua

SEQ ID NO: 1573390 - RNA, 21 nt, Homo sapiens
gcuaugaacagaaacuacauu

SEQ ID NO: 1573391 - RNA, 20 nt, Homo sapiens
gcuauggggauagaugugug

SEQ ID NO: 1573392 - RNA, 14 nt, Homo sapiens
gcuauguaaggguc

SEQ ID NO: 1573393 - RNA, 21 nt, Homo sapiens
gcuauuaagaauuuaagacuu

SEQ ID NO: 1573394 - RNA, 18 nt, Homo sapiens
gcuauuacuaguacuauu

SEQ ID NO: 1573395 - RNA, 15 nt, Homo sapiens
gcuauuguagagcca

SEQ ID NO: 1573396 - RNA, 16 nt, Homo sapiens
gcuauuuaacauuuua

SEQ ID NO: 1573397 - RNA, 22 nt, Homo sapiens
gcuauuucaucuauuuuuggca

SEQ ID NO: 1573398 - RNA, 20 nt, Homo sapiens
gcuauuucuucuacugcuau

SEQ ID NO: 1573399 - RNA, 17 nt, Homo sapiens
gcuauuuuagaaagcua

SEQ ID NO: 1573400 - RNA, 18 nt, Homo sapiens
gcuauuuuagaaagcuaa

SEQ ID NO: 1573401 - RNA, 14 nt, Homo sapiens
gcucaaaaccucca

SEQ ID NO: 1573402 - RNA, 17 nt, Homo sapiens
gcucaagaggccacuua

SEQ ID NO: 1573403 - RNA, 23 nt, Homo sapiens
gcucaauagcuugaagcccaaga

SEQ ID NO: 1573404 - RNA, 11 nt, Homo sapiens
gcucacagauu

SEQ ID NO: 1573405 - RNA, 12 nt, Homo sapiens
gcucacagauuu

SEQ ID NO: 1573406 - RNA, 15 nt, Homo sapiens
gcucacccaguccug

SEQ ID NO: 1573407 - RNA, 22 nt, Homo sapiens
gcucaccucuucuuuaccagaa

SEQ ID NO: 1573408 - RNA, 20 nt, Homo sapiens
gcucacuaggccgauccugc

SEQ ID NO: 1573409 - RNA, 17 nt, Homo sapiens
gcucacuugcucaaaac

SEQ ID NO: 1573410 - RNA, 20 nt, Homo sapiens
gcucagacugggcacugggg

SEQ ID NO: 1573411 - RNA, 18 nt, Homo sapiens
gcucagagcuuugucacu

SEQ ID NO: 1573412 - RNA, 15 nt, Homo sapiens
gcucagcuucuucuu

SEQ ID NO: 1573413 - RNA, 16 nt, Homo sapiens
gcucaggcgucgcugg

SEQ ID NO: 1573414 - RNA, 13 nt, Homo sapiens
gcucaggugcaag

SEQ ID NO: 1573415 - RNA, 16 nt, Homo sapiens
gcucagucuguucacu

SEQ ID NO: 1573416 - RNA, 15 nt, Homo sapiens
gcucaucauucucug

SEQ ID NO: 1573417 - RNA, 12 nt, Homo sapiens
gcucaugccauc

SEQ ID NO: 1573418 - RNA, 17 nt, Homo sapiens
gcuccaagcaguuugaa

SEQ ID NO: 1573419 - RNA, 13 nt, Homo sapiens
gcuccacauugca

SEQ ID NO: 1573420 - RNA, 22 nt, Homo sapiens
gcuccagcugauccagauguua

SEQ ID NO: 1573421 - RNA, 18 nt, Homo sapiens
gcucccagggucccugcc

SEQ ID NO: 1573422 - RNA, 15 nt, Homo sapiens
gcucccaguccugcc

SEQ ID NO: 1573423 - RNA, 12 nt, Homo sapiens
gcucccaugacc

SEQ ID NO: 1573424 - RNA, 17 nt, Homo sapiens
gcucccaugcucauacc

SEQ ID NO: 1573425 - RNA, 22 nt, Homo sapiens
ggcaguggacucagaaagccaa

SEQ ID NO: 1573426 - RNA, 22 nt, Homo sapiens
ggcaguuuaaaaaauaacuuca

SEQ ID NO: 1573427 - RNA, 16 nt, Homo sapiens
ggcauaauagucaauu

SEQ ID NO: 1573428 - RNA, 13 nt, Homo sapiens
ggcauaugcacag

SEQ ID NO: 1573429 - RNA, 18 nt, Homo sapiens
ggcaucaguagcaucugu

SEQ ID NO: 1573430 - RNA, 22 nt, Homo sapiens
ggcaucaguagcaucuguaaca

SEQ ID NO: 1573431 - RNA, 21 nt, Homo sapiens
ggcaucuuuucuagagacaca

SEQ ID NO: 1573432 - RNA, 12 nt, Homo sapiens
ggcauguaugca

SEQ ID NO: 1573433 - RNA, 11 nt, Homo sapiens
ggcauugcuga

SEQ ID NO: 1573434 - RNA, 15 nt, Homo sapiens
ggccaagccuaucaa

SEQ ID NO: 1573435 - RNA, 15 nt, Homo sapiens
ggccaagggcagggu

SEQ ID NO: 1573436 - RNA, 17 nt, Homo sapiens
ggccaaggucagggagc

SEQ ID NO: 1573437 - RNA, 13 nt, Homo sapiens
ggccacacacuga

SEQ ID NO: 1573438 - RNA, 15 nt, Homo sapiens
ggccacucaggccag

SEQ ID NO: 1573439 - RNA, 16 nt, Homo sapiens
ggccacuggauccugc

SEQ ID NO: 1573440 - RNA, 11 nt, Homo sapiens
ggccagcacca

SEQ ID NO: 1573441 - RNA, 16 nt, Homo sapiens
ggccagcgcgaugaac

SEQ ID NO: 1573442 - RNA, 15 nt, Homo sapiens
ggccaggccucugcu

SEQ ID NO: 1573443 - RNA, 18 nt, Homo sapiens
ggccagucaggcugcaga

SEQ ID NO: 1573444 - RNA, 20 nt, Homo sapiens
ggccaguggaagaaacaccc

SEQ ID NO: 1573445 - RNA, 14 nt, Homo sapiens
ggccauacugccuu

SEQ ID NO: 1573446 - RNA, 18 nt, Homo sapiens
ggccauugugaaccaaug

SEQ ID NO: 1573447 - RNA, 13 nt, Homo sapiens
ggccauuuccgug

SEQ ID NO: 1573448 - RNA, 18 nt, Homo sapiens
ggccauuuuggugcuuau

SEQ ID NO: 1573449 - RNA, 15 nt, Homo sapiens
ggcccauggcauuuu

SEQ ID NO: 1573450 - RNA, 15 nt, Homo sapiens
ggccccaaucuugcc

SEQ ID NO: 1573451 - RNA, 14 nt, Homo sapiens
ggccccucacccac

SEQ ID NO: 1573452 - RNA, 18 nt, Homo sapiens
ggccccucacccaccaug

SEQ ID NO: 1573453 - RNA, 14 nt, Homo sapiens
ggccccuccaucca

SEQ ID NO: 1573454 - RNA, 22 nt, Homo sapiens
ggcccugggcugggugcuggga

SEQ ID NO: 1573455 - RNA, 15 nt, Homo sapiens
ggccgacccaaggga

SEQ ID NO: 1573456 - RNA, 21 nt, Homo sapiens
ggccgcagaggauccaucaca

SEQ ID NO: 1573457 - RNA, 19 nt, Homo sapiens
ggccggugccagcugcccu

SEQ ID NO: 1573458 - RNA, 23 nt, Homo sapiens
ggccuacaugguugaaaccccau

SEQ ID NO: 1573459 - RNA, 18 nt, Homo sapiens
ggccucucccugccugug

SEQ ID NO: 1573460 - RNA, 15 nt, Homo sapiens
ggccugaccaaacag

SEQ ID NO: 1573461 - RNA, 14 nt, Homo sapiens
ggccugacucucag

SEQ ID NO: 1573462 - RNA, 19 nt, Homo sapiens
ggccugagaugcaggugau

SEQ ID NO: 1573463 - RNA, 15 nt, Homo sapiens
ggccugagauuucau

SEQ ID NO: 1573464 - RNA, 18 nt, Homo sapiens
ggccuggcccugcuuucu

SEQ ID NO: 1573465 - RNA, 17 nt, Homo sapiens
ggccuggggaggcccua

SEQ ID NO: 1573466 - RNA, 17 nt, Homo sapiens
ggccuucugaacuccau

SEQ ID NO: 1573467 - RNA, 15 nt, Homo sapiens
ggccuuuuuccugcg

SEQ ID NO: 1573468 - RNA, 23 nt, Homo sapiens
ggcgagccauuugucccaagugc

SEQ ID NO: 1573469 - RNA, 14 nt, Homo sapiens
ggcggaucaccuga

SEQ ID NO: 1573470 - RNA, 17 nt, Homo sapiens
ggcggcccugaccaaug

SEQ ID NO: 1573471 - RNA, 20 nt, Homo sapiens
ggcggcuccuggugcuaaca

SEQ ID NO: 1573472 - RNA, 20 nt, Homo sapiens
ggcggguggaucacgagguc

SEQ ID NO: 1573473 - RNA, 19 nt, Homo sapiens
ggcgguacacuacgcacug

SEQ ID NO: 1573474 - RNA, 21 nt, Homo sapiens
ggcuaaaagacaugcauuuuu

SEQ ID NO: 1573475 - RNA, 21 nt, Homo sapiens
ggcuaaagcucgaugugguca

SEQ ID NO: 1573476 - RNA, 22 nt, Homo sapiens
ggcuaacagucuagugcaaaag

SEQ ID NO: 1573477 - RNA, 19 nt, Homo sapiens
ggcuaagcaaaaugugaua

SEQ ID NO: 1573478 - RNA, 16 nt, Homo sapiens
ggcuaagcaucuucaa

SEQ ID NO: 1573479 - RNA, 19 nt, Homo sapiens
ggcuacuauagguccagaa

SEQ ID NO: 1573480 - RNA, 15 nt, Homo sapiens
ggcuacucuggaaug

SEQ ID NO: 1573481 - RNA, 17 nt, Homo sapiens
ggcuagaaccuggagag

SEQ ID NO: 1573482 - RNA, 15 nt, Homo sapiens
ggcuagagugcaaug

SEQ ID NO: 1573483 - RNA, 20 nt, Homo sapiens
ggcuaugaaaaugagcccug

SEQ ID NO: 1573484 - RNA, 20 nt, Homo sapiens
ggcucaauugaaagugggca

SEQ ID NO: 1573485 - RNA, 23 nt, Homo sapiens
ggcucacagauuuaaagcaucau

SEQ ID NO: 1573486 - RNA, 17 nt, Homo sapiens
ggcucagaagaauuuaa

SEQ ID NO: 1573487 - RNA, 14 nt, Homo sapiens
ggcucagugccacc

SEQ ID NO: 1573488 - RNA, 17 nt, Homo sapiens
ggcuccaggagccucau

SEQ ID NO: 1573489 - RNA, 21 nt, Homo sapiens
ggcucuaauucacagugcucu

SEQ ID NO: 1573490 - RNA, 22 nt, Homo sapiens
ggcucugcccuggaaagggggu

SEQ ID NO: 1573491 - RNA, 20 nt, Homo sapiens
ggcucuuaugugugccuuug

SEQ ID NO: 1573492 - RNA, 16 nt, Homo sapiens
ggcucuugacuacuug

SEQ ID NO: 1573493 - RNA, 15 nt, Homo sapiens
ggcugaacucucccc

SEQ ID NO: 1573494 - RNA, 19 nt, Homo sapiens
ggcugacacccaggcccga

SEQ ID NO: 1573495 - RNA, 16 nt, Homo sapiens
ggcugaccgugucucu

SEQ ID NO: 1573496 - RNA, 14 nt, Homo sapiens
ggcugagcaugugg

SEQ ID NO: 1573497 - RNA, 20 nt, Homo sapiens
ggcugaggccucucauucca

SEQ ID NO: 1573498 - RNA, 17 nt, Homo sapiens
ggcugccccucucacca

SEQ ID NO: 1573499 - RNA, 20 nt, Homo sapiens
ggcuggagugcaguggcgca

SEQ ID NO: 1573500 - RNA, 11 nt, Homo sapiens
ggcugggagac

SEQ ID NO: 1573501 - RNA, 13 nt, Homo sapiens
ggcugggccaugu

SEQ ID NO: 1573502 - RNA, 22 nt, Homo sapiens
ggcuggggccaccuuugugcag

SEQ ID NO: 1573503 - RNA, 22 nt, Homo sapiens
ggcugggguugccagaggcccu

SEQ ID NO: 1573504 - RNA, 14 nt, Homo sapiens
ggcuggucuugggg

SEQ ID NO: 1573505 - RNA, 13 nt, Homo sapiens
ggcugguuugcaa

SEQ ID NO: 1573506 - RNA, 10 nt, Homo sapiens
ggcugugagc

SEQ ID NO: 1573507 - RNA, 18 nt, Homo sapiens
ggcugugggcaagccuaa

SEQ ID NO: 1573508 - RNA, 17 nt, Homo sapiens
ggcuguguuaugaaaau

SEQ ID NO: 1573509 - RNA, 14 nt, Homo sapiens
ggcuuagugccacc

SEQ ID NO: 1573510 - RNA, 19 nt, Homo sapiens
ggcuucacugcugugacuu

SEQ ID NO: 1573511 - RNA, 15 nt, Homo sapiens
ggcuucaucugucaa

SEQ ID NO: 1573512 - RNA, 17 nt, Homo sapiens
ggcuugaagccaaagaa

SEQ ID NO: 1573513 - RNA, 14 nt, Homo sapiens
ggcuugcagugcgc

SEQ ID NO: 1573514 - RNA, 20 nt, Homo sapiens
ggcuugugggcacugugcca

SEQ ID NO: 1573515 - RNA, 15 nt, Homo sapiens
ggcuuucagagccag

SEQ ID NO: 1573516 - RNA, 14 nt, Homo sapiens
ggcuuucaugauuu

SEQ ID NO: 1573517 - RNA, 15 nt, Homo sapiens
ggcuuugggguccua

SEQ ID NO: 1573518 - RNA, 19 nt, Homo sapiens
ggcuuuguaugacagugaa

SEQ ID NO: 1573519 - RNA, 13 nt, Homo sapiens
gggaaacugggaa

SEQ ID NO: 1573520 - RNA, 20 nt, Homo sapiens
gggaaccauguauaugagcu

SEQ ID NO: 1573521 - RNA, 16 nt, Homo sapiens
gggaacggacugguau

SEQ ID NO: 1573522 - RNA, 18 nt, Homo sapiens
gggaagagacagcccagg

SEQ ID NO: 1573523 - RNA, 19 nt, Homo sapiens
gggaagcggcccuaaggga

SEQ ID NO: 1573524 - RNA, 14 nt, Homo sapiens
gggaauccugagaa

SEQ ID NO: 1573525 - RNA, 22 nt, Homo sapiens
gggacgcccccaccagcucaaa

SEQ ID NO: 1573526 - RNA, 23 nt, Homo sapiens
gggacuccggcugugcugggaga

SEQ ID NO: 1573527 - RNA, 16 nt, Homo sapiens
gggacuccuccuuuau

SEQ ID NO: 1573528 - RNA, 12 nt, Homo sapiens
gggagaaggcau

SEQ ID NO: 1573529 - RNA, 16 nt, Homo sapiens
gggagaaugucaguau

SEQ ID NO: 1573530 - RNA, 19 nt, Homo sapiens
gggagacugggcugaggga

SEQ ID NO: 1573531 - RNA, 21 nt, Homo sapiens
gggagauuuuuuugagucaaa

SEQ ID NO: 1573532 - RNA, 22 nt, Homo sapiens
gggagcacugcguuuuccuagc

SEQ ID NO: 1573533 - RNA, 18 nt, Homo sapiens
gggagccugacccucauc

SEQ ID NO: 1573534 - RNA, 23 nt, Homo sapiens
gggaggaaaaggccccugcaaug

SEQ ID NO: 1573535 - RNA, 23 nt, Homo sapiens
gggaggcaagugugggggguccu

SEQ ID NO: 1573536 - RNA, 15 nt, Homo sapiens
gggaggcagggcagc

SEQ ID NO: 1573537 - RNA, 13 nt, Homo sapiens
gggaggcuggaga

SEQ ID NO: 1573538 - RNA, 17 nt, Homo sapiens
gggauagaggggcugca

SEQ ID NO: 1573539 - RNA, 15 nt, Homo sapiens
gggaucaguugcccc

SEQ ID NO: 1573540 - RNA, 23 nt, Homo sapiens
gggauggggcggcgguagcagcu

SEQ ID NO: 1573541 - RNA, 22 nt, Homo sapiens
gggauuaaggcgugagccacug

SEQ ID NO: 1573542 - RNA, 23 nt, Homo sapiens
gggauucacaaggugaagaacug

SEQ ID NO: 1573543 - RNA, 19 nt, Homo sapiens
gguucaagcacacuggaau

SEQ ID NO: 1573544 - RNA, 14 nt, Homo sapiens
gguucaccagcccu

SEQ ID NO: 1573545 - RNA, 16 nt, Homo sapiens
gguucagaaauagcuc

SEQ ID NO: 1573546 - RNA, 15 nt, Homo sapiens
gguucgagacuccau

SEQ ID NO: 1573547 - RNA, 15 nt, Homo sapiens
gguucuuagcccuug

SEQ ID NO: 1573548 - RNA, 22 nt, Homo sapiens
gguucuuugaccagcacauuaa

SEQ ID NO: 1573549 - RNA, 19 nt, Homo sapiens
gguugcagugagcugagau

SEQ ID NO: 1573550 - RNA, 15 nt, Homo sapiens
gguugggcagccaga

SEQ ID NO: 1573551 - RNA, 15 nt, Homo sapiens
gguuguuucuguucc

SEQ ID NO: 1573552 - RNA, 23 nt, Homo sapiens
gguuuccgaaggguuuugcuaca

SEQ ID NO: 1573553 - RNA, 14 nt, Homo sapiens
gguuugaagcugac

SEQ ID NO: 1573554 - RNA, 21 nt, Homo sapiens
gguuugccaaaauucauuucu

SEQ ID NO: 1573555 - RNA, 16 nt, Homo sapiens
guaaaaauaacauaau

SEQ ID NO: 1573556 - RNA, 18 nt, Homo sapiens
guaaaaaugcugcucuca

SEQ ID NO: 1573557 - RNA, 13 nt, Homo sapiens
guaaaacaaagag

SEQ ID NO: 1573558 - RNA, 14 nt, Homo sapiens
guaaaacaaucugu

SEQ ID NO: 1573559 - RNA, 19 nt, Homo sapiens
guaaaacacaccaaucagc

SEQ ID NO: 1573560 - RNA, 12 nt, Homo sapiens
guaaaacagggc

SEQ ID NO: 1573561 - RNA, 17 nt, Homo sapiens
guaaaacauuuguuucc

SEQ ID NO: 1573562 - RNA, 20 nt, Homo sapiens
guaaaaugcacccaucagca

SEQ ID NO: 1573563 - RNA, 19 nt, Homo sapiens
guaaaaugcacccaucagu

SEQ ID NO: 1573564 - RNA, 19 nt, Homo sapiens
guaaaauguuuucauuuua

SEQ ID NO: 1573565 - RNA, 15 nt, Homo sapiens
guaaaauuaauguaa

SEQ ID NO: 1573566 - RNA, 12 nt, Homo sapiens
guaaacagauuu

SEQ ID NO: 1573567 - RNA, 22 nt, Homo sapiens
guaaaccuugaagggcuuuauu

SEQ ID NO: 1573568 - RNA, 14 nt, Homo sapiens
guaaacuagcuuug

SEQ ID NO: 1573569 - RNA, 20 nt, Homo sapiens
guaaacugaggcccaaagca

SEQ ID NO: 1573570 - RNA, 21 nt, Homo sapiens
guaaagaaauauauaugauau

SEQ ID NO: 1573571 - RNA, 15 nt, Homo sapiens
guaaaggccuuuaau

SEQ ID NO: 1573572 - RNA, 21 nt, Homo sapiens
guaaauagggaaaauaaucuc

SEQ ID NO: 1573573 - RNA, 14 nt, Homo sapiens
guaaauauaaacua

SEQ ID NO: 1573574 - RNA, 13 nt, Homo sapiens
guaaauaugcaaa

SEQ ID NO: 1573575 - RNA, 13 nt, Homo sapiens
guaaauauugcua

SEQ ID NO: 1573576 - RNA, 18 nt, Homo sapiens
guaaaucaggacaggugg

SEQ ID NO: 1573577 - RNA, 11 nt, Homo sapiens
guaaaugccuc

SEQ ID NO: 1573578 - RNA, 18 nt, Homo sapiens
guaaauguggauuuugua

SEQ ID NO: 1573579 - RNA, 23 nt, Homo sapiens
guaaauugcaaauaaaccacuuu

SEQ ID NO: 1573580 - RNA, 19 nt, Homo sapiens
guaaauuuaaguccaccuc

SEQ ID NO: 1573581 - RNA, 18 nt, Homo sapiens
guaacaauacaugagaaa

SEQ ID NO: 1573582 - RNA, 22 nt, Homo sapiens
guaacagauuuuguuggcauag

SEQ ID NO: 1573583 - RNA, 13 nt, Homo sapiens
guaaccaaggaga

SEQ ID NO: 1573584 - RNA, 14 nt, Homo sapiens
guaacuagugaaau

SEQ ID NO: 1573585 - RNA, 23 nt, Homo sapiens
guaacuugcuuaaauuucuuaug

SEQ ID NO: 1573586 - RNA, 18 nt, Homo sapiens
guaacuuucauaccacuu

SEQ ID NO: 1573587 - RNA, 20 nt, Homo sapiens
guaagauguccuccuugaua

SEQ ID NO: 1573588 - RNA, 13 nt, Homo sapiens
guaauaaagugaa

SEQ ID NO: 1573589 - RNA, 16 nt, Homo sapiens
guaauaaagugaacuu

SEQ ID NO: 1573590 - RNA, 13 nt, Homo sapiens
guaauaagcaauc

SEQ ID NO: 1573591 - RNA, 17 nt, Homo sapiens
guaauagauguuugaua

SEQ ID NO: 1573592 - RNA, 13 nt, Homo sapiens
guaauagcuguaa

SEQ ID NO: 1573593 - RNA, 18 nt, Homo sapiens
guaauauaaugaugcugu

SEQ ID NO: 1573594 - RNA, 21 nt, Homo sapiens
guaauauacaagcaagcaaaa

SEQ ID NO: 1573595 - RNA, 15 nt, Homo sapiens
guaaucauuaucuca

SEQ ID NO: 1573596 - RNA, 15 nt, Homo sapiens
guaaucccagcacuu

SEQ ID NO: 1573597 - RNA, 15 nt, Homo sapiens
guaaucuaaguauau

SEQ ID NO: 1573598 - RNA, 17 nt, Homo sapiens
guaaucuacaaaggaaa

SEQ ID NO: 1573599 - RNA, 12 nt, Homo sapiens
guaaucuacacc

SEQ ID NO: 1573600 - RNA, 16 nt, Homo sapiens
guaaucucagcacuuu

SEQ ID NO: 1573601 - RNA, 19 nt, Homo sapiens
guaaucuguauaauacuuu

SEQ ID NO: 1573602 - RNA, 14 nt, Homo sapiens
guaauggugaaaac

SEQ ID NO: 1573603 - RNA, 21 nt, Homo sapiens
guaauuauguuuucaacacuu

SEQ ID NO: 1573604 - RNA, 22 nt, Homo sapiens
guaauuguaaacuaguacuauu

SEQ ID NO: 1573605 - RNA, 16 nt, Homo sapiens
guaauuguacaagcag

SEQ ID NO: 1573606 - RNA, 15 nt, Homo sapiens
guaauuuuaucuaaa

SEQ ID NO: 1573607 - RNA, 19 nt, Homo sapiens
guaauuuuuuuuccuugcc

SEQ ID NO: 1573608 - RNA, 12 nt, Homo sapiens
guacaacccuga

SEQ ID NO: 1573609 - RNA, 21 nt, Homo sapiens
guacaaggcccccacugccug

SEQ ID NO: 1573610 - RNA, 14 nt, Homo sapiens
guacaauacaaugu

SEQ ID NO: 1573611 - RNA, 19 nt, Homo sapiens
guacacacugguacuuaga

SEQ ID NO: 1573612 - RNA, 19 nt, Homo sapiens
guacacucagccacuguca

SEQ ID NO: 1573613 - RNA, 21 nt, Homo sapiens
guacacucagccacugucaca

SEQ ID NO: 1573614 - RNA, 18 nt, Homo sapiens
guacagaaagcugccugg

SEQ ID NO: 1573615 - RNA, 21 nt, Homo sapiens
guacagaaauauccaugacaa

SEQ ID NO: 1573616 - RNA, 12 nt, Homo sapiens
guacagacacuc

SEQ ID NO: 1573617 - RNA, 14 nt, Homo sapiens
guacagacauauuu

SEQ ID NO: 1573618 - RNA, 22 nt, Homo sapiens
guacagcagaagccccaagcaa

SEQ ID NO: 1573619 - RNA, 16 nt, Homo sapiens
guacaggaaugaaccu

SEQ ID NO: 1573620 - RNA, 21 nt, Homo sapiens
guacaguucugggguacaugu

SEQ ID NO: 1573621 - RNA, 23 nt, Homo sapiens
guacaugauaaaugauagacaau

SEQ ID NO: 1573622 - RNA, 21 nt, Homo sapiens
guacaugugcuugccaugugu

SEQ ID NO: 1573623 - RNA, 17 nt, Homo sapiens
guacauguuaaacuuac

SEQ ID NO: 1573624 - RNA, 18 nt, Homo sapiens
guacauucuagcugagaa

SEQ ID NO: 1573625 - RNA, 21 nt, Homo sapiens
guacauuugagccaugucaca

SEQ ID NO: 1573626 - RNA, 14 nt, Homo sapiens
guaccaauucagug

SEQ ID NO: 1573627 - RNA, 22 nt, Homo sapiens
guaccaauucagugucuguucc

SEQ ID NO: 1573628 - RNA, 21 nt, Homo sapiens
guacccacucuggagcauuuc

SEQ ID NO: 1573629 - RNA, 21 nt, Homo sapiens
guaccuucaaacuagggccaa

SEQ ID NO: 1573630 - RNA, 20 nt, Homo sapiens
guacuaacuagcauuguaaa

SEQ ID NO: 1573631 - RNA, 14 nt, Homo sapiens
guacuaguacuauu

SEQ ID NO: 1573632 - RNA, 16 nt, Homo sapiens
guacuaugacacuguu

SEQ ID NO: 1573633 - RNA, 19 nt, Homo sapiens
guacuaugacacuguuaau

SEQ ID NO: 1573634 - RNA, 16 nt, Homo sapiens
guacuauuacuaguac

SEQ ID NO: 1573635 - RNA, 15 nt, Homo sapiens
guacuauuacuauua

SEQ ID NO: 1573636 - RNA, 19 nt, Homo sapiens
guacuguuuuccaguucau

SEQ ID NO: 1573637 - RNA, 20 nt, Homo sapiens
guacuuauguugcacaauga

SEQ ID NO: 1573638 - RNA, 23 nt, Homo sapiens
guacuuauguugcacaaugagaa

SEQ ID NO: 1573639 - RNA, 23 nt, Homo sapiens
guacuuccucccagcauugcuac

SEQ ID NO: 1573640 - RNA, 19 nt, Homo sapiens
guacuuuuuuuaaacugug

SEQ ID NO: 1573641 - RNA, 22 nt, Homo sapiens
guagaaaauuuguuauuuugca

SEQ ID NO: 1573642 - RNA, 18 nt, Homo sapiens
guagaaagacaucugccu

SEQ ID NO: 1573643 - RNA, 17 nt, Homo sapiens
guagaagccacuauuac

SEQ ID NO: 1573644 - RNA, 20 nt, Homo sapiens
guagaagguaacucuuugca

SEQ ID NO: 1573645 - RNA, 18 nt, Homo sapiens
guagaauauucagacaaa

SEQ ID NO: 1573646 - RNA, 15 nt, Homo sapiens
guagaauugcauuga

SEQ ID NO: 1573647 - RNA, 16 nt, Homo sapiens
guagacauuugcuaug

SEQ ID NO: 1573648 - RNA, 14 nt, Homo sapiens
guagacugugccag

SEQ ID NO: 1573649 - RNA, 21 nt, Homo sapiens
guagagacgguguuuugccau

SEQ ID NO: 1573650 - RNA, 18 nt, Homo sapiens
guagagcucuacugccuc

SEQ ID NO: 1573651 - RNA, 16 nt, Homo sapiens
guagagggcccuggug

SEQ ID NO: 1573652 - RNA, 12 nt, Homo sapiens
guagauauuuga

SEQ ID NO: 1573653 - RNA, 13 nt, Homo sapiens
guagcaauggcca

SEQ ID NO: 1573654 - RNA, 22 nt, Homo sapiens
guagcauuuuucuaaaaccuua

SEQ ID NO: 1573655 - RNA, 15 nt, Homo sapiens
guagccugaauugcu

SEQ ID NO: 1573656 - RNA, 23 nt, Homo sapiens
guagccugggcucacugugcugg

SEQ ID NO: 1573657 - RNA, 10 nt, Homo sapiens
guagcucucc

SEQ ID NO: 1573658 - RNA, 16 nt, Homo sapiens
guagcugggauuacag

SEQ ID NO: 1573659 - RNA, 18 nt, Homo sapiens
guagcugggauuacaggc

SEQ ID NO: 1573660 - RNA, 22 nt, Homo sapiens
guagcugugucauguauauacc

SEQ ID NO: 1573661 - RNA, 16 nt, Homo sapiens
uauaagaaagaucaaa

SEQ ID NO: 1573662 - RNA, 15 nt, Homo sapiens
uauaagguaauguag

SEQ ID NO: 1573663 - RNA, 19 nt, Homo sapiens
uauaagucugggcacugga

SEQ ID NO: 1573664 - RNA, 21 nt, Homo sapiens
uauaagugagagaaaugaagu

SEQ ID NO: 1573665 - RNA, 16 nt, Homo sapiens
uauaaguuucuuuaga

SEQ ID NO: 1573666 - RNA, 22 nt, Homo sapiens
uauaauaaaauuucuugcugca

SEQ ID NO: 1573667 - RNA, 19 nt, Homo sapiens
uauaauaaauacucaguga

SEQ ID NO: 1573668 - RNA, 21 nt, Homo sapiens
uauaaucaucaaguaauacaa

SEQ ID NO: 1573669 - RNA, 20 nt, Homo sapiens
uauaaucccagcauuuuggg

SEQ ID NO: 1573670 - RNA, 16 nt, Homo sapiens
uauaauuaauugucau

SEQ ID NO: 1573671 - RNA, 20 nt, Homo sapiens
uauaauuucaaaccacacau

SEQ ID NO: 1573672 - RNA, 22 nt, Homo sapiens
uauaauuucaaaccacacauua

SEQ ID NO: 1573673 - RNA, 11 nt, Homo sapiens
uauaauuuuga

SEQ ID NO: 1573674 - RNA, 15 nt, Homo sapiens
uauacaaaacuuuau

SEQ ID NO: 1573675 - RNA, 19 nt, Homo sapiens
uauacaaguuguucuagua

SEQ ID NO: 1573676 - RNA, 23 nt, Homo sapiens
uauacaccuuagucuuuccuuag

SEQ ID NO: 1573677 - RNA, 15 nt, Homo sapiens
uauaccagaggaaag

SEQ ID NO: 1573678 - RNA, 19 nt, Homo sapiens
uauaccaugugugcuaaua

SEQ ID NO: 1573679 - RNA, 14 nt, Homo sapiens
uauaccuagcacuu

SEQ ID NO: 1573680 - RNA, 23 nt, Homo sapiens
uauaccuggcaauucacaaauag

SEQ ID NO: 1573681 - RNA, 20 nt, Homo sapiens
uauacuucucuauuaucuca

SEQ ID NO: 1573682 - RNA, 21 nt, Homo sapiens
uauacuuuaguagacauuuau

SEQ ID NO: 1573683 - RNA, 19 nt, Homo sapiens
uauagaauuuccuguaaua

SEQ ID NO: 1573684 - RNA, 16 nt, Homo sapiens
uauagcuuugccaugu

SEQ ID NO: 1573685 - RNA, 14 nt, Homo sapiens
uauauaaacugugc

SEQ ID NO: 1573686 - RNA, 13 nt, Homo sapiens
uauauaacuauuu

SEQ ID NO: 1573687 - RNA, 14 nt, Homo sapiens
uauauaaucaauca

SEQ ID NO: 1573688 - RNA, 15 nt, Homo sapiens
uauauacauggaauc

SEQ ID NO: 1573689 - RNA, 18 nt, Homo sapiens
uauauagaauuuccugua

SEQ ID NO: 1573690 - RNA, 17 nt, Homo sapiens
uauauaggugugugaga

SEQ ID NO: 1573691 - RNA, 13 nt, Homo sapiens
uauaucacugucu

SEQ ID NO: 1573692 - RNA, 14 nt, Homo sapiens
uauaucuaccccag

SEQ ID NO: 1573693 - RNA, 16 nt, Homo sapiens
uauaucugcuguccag

SEQ ID NO: 1573694 - RNA, 14 nt, Homo sapiens
uauauguacaugag

SEQ ID NO: 1573695 - RNA, 19 nt, Homo sapiens
uauauguauaucacauucc

SEQ ID NO: 1573696 - RNA, 18 nt, Homo sapiens
uauauguguauacauaca

SEQ ID NO: 1573697 - RNA, 11 nt, Homo sapiens
uauauucuuga

SEQ ID NO: 1573698 - RNA, 12 nt, Homo sapiens
uauauugcagua

SEQ ID NO: 1573699 - RNA, 16 nt, Homo sapiens
uauauuguguugcaaa

SEQ ID NO: 1573700 - RNA, 19 nt, Homo sapiens
uauauuugaaauaguauac

SEQ ID NO: 1573701 - RNA, 22 nt, Homo sapiens
uauauuugugugaaaaugugac

SEQ ID NO: 1573702 - RNA, 23 nt, Homo sapiens
uauauuuuaucuugguaguacau

SEQ ID NO: 1573703 - RNA, 15 nt, Homo sapiens
uauauuuuugugcac

SEQ ID NO: 1573704 - RNA, 14 nt, Homo sapiens
uaucaacagcauuu

SEQ ID NO: 1573705 - RNA, 16 nt, Homo sapiens
uaucaaguguauuuga

SEQ ID NO: 1573706 - RNA, 15 nt, Homo sapiens
uaucaauaaaauucu

SEQ ID NO: 1573707 - RNA, 16 nt, Homo sapiens
uaucaauggauuuauc

SEQ ID NO: 1573708 - RNA, 20 nt, Homo sapiens
uaucaauguuuguccuguau

SEQ ID NO: 1573709 - RNA, 14 nt, Homo sapiens
uaucaccgggggca

SEQ ID NO: 1573710 - RNA, 21 nt, Homo sapiens
uaucagacucuguaauugaau

SEQ ID NO: 1573711 - RNA, 23 nt, Homo sapiens
uaucagcagacacuccaguuugc

SEQ ID NO: 1573712 - RNA, 21 nt, Homo sapiens
uaucaguugagcuucauauac

SEQ ID NO: 1573713 - RNA, 17 nt, Homo sapiens
uaucauaacuauacuug

SEQ ID NO: 1573714 - RNA, 18 nt, Homo sapiens
uaucauaauucagcacuu

SEQ ID NO: 1573715 - RNA, 16 nt, Homo sapiens
uaucauccccauuuaa

SEQ ID NO: 1573716 - RNA, 19 nt, Homo sapiens
uaucaucugcuaaguaauu

SEQ ID NO: 1573717 - RNA, 23 nt, Homo sapiens
uaucaucugucauuauauucuaa

SEQ ID NO: 1573718 - RNA, 15 nt, Homo sapiens
uaucaugaagcacau

SEQ ID NO: 1573719 - RNA, 19 nt, Homo sapiens
uaucaugaagcacaucaau

SEQ ID NO: 1573720 - RNA, 22 nt, Homo sapiens
uaucaugauccucccuaucaag

SEQ ID NO: 1573721 - RNA, 16 nt, Homo sapiens
uaucauggcauauaac

SEQ ID NO: 1573722 - RNA, 20 nt, Homo sapiens
uaucauggugaaaagcucca

SEQ ID NO: 1573723 - RNA, 22 nt, Homo sapiens
uaucauuaaacaaauaaaauac

SEQ ID NO: 1573724 - RNA, 21 nt, Homo sapiens
uaucauuaucuuugcuguuau

SEQ ID NO: 1573725 - RNA, 22 nt, Homo sapiens
uaucauuaucuuugcuguuauu

SEQ ID NO: 1573726 - RNA, 14 nt, Homo sapiens
uaucauucacccaa

SEQ ID NO: 1573727 - RNA, 21 nt, Homo sapiens
uaucauuuuugagcaacuccc

SEQ ID NO: 1573728 - RNA, 17 nt, Homo sapiens
uauccaauugcucuuuc

SEQ ID NO: 1573729 - RNA, 14 nt, Homo sapiens
uauccagccuccca

SEQ ID NO: 1573730 - RNA, 13 nt, Homo sapiens
uauccauccaugg

SEQ ID NO: 1573731 - RNA, 22 nt, Homo sapiens
uaucccccgccuuuaguucucc

SEQ ID NO: 1573732 - RNA, 19 nt, Homo sapiens
uauccugggagcacugcgu

SEQ ID NO: 1573733 - RNA, 11 nt, Homo sapiens
uauccuuccag

SEQ ID NO: 1573734 - RNA, 22 nt, Homo sapiens
uaucgggagaggggauucacaa

SEQ ID NO: 1573735 - RNA, 19 nt, Homo sapiens
uaucguuaagcacaagaca

SEQ ID NO: 1573736 - RNA, 21 nt, Homo sapiens
uaucuaacccucccauggcac

SEQ ID NO: 1573737 - RNA, 15 nt, Homo sapiens
uaucuaguucauuga

SEQ ID NO: 1573738 - RNA, 19 nt, Homo sapiens
uaucuauuaucucaauuua

SEQ ID NO: 1573739 - RNA, 20 nt, Homo sapiens
uaucucacaaauaaguaaua

SEQ ID NO: 1573740 - RNA, 19 nt, Homo sapiens
uaucucuaaaaacauagaa

SEQ ID NO: 1573741 - RNA, 13 nt, Homo sapiens
uaucugcauuuac

SEQ ID NO: 1573742 - RNA, 14 nt, Homo sapiens
uaucugcggcuuua

SEQ ID NO: 1573743 - RNA, 14 nt, Homo sapiens
uaucugucaucucu

SEQ ID NO: 1573744 - RNA, 16 nt, Homo sapiens
uaucuugcagcuguaa

SEQ ID NO: 1573745 - RNA, 23 nt, Homo sapiens
uaucuugcagcuguaaacauauu

SEQ ID NO: 1573746 - RNA, 14 nt, Homo sapiens
uaucuugugcuucu

SEQ ID NO: 1573747 - RNA, 14 nt, Homo sapiens
uaucuuuaccuccu

SEQ ID NO: 1573748 - RNA, 13 nt, Homo sapiens
uaucuuugauucu

SEQ ID NO: 1573749 - RNA, 16 nt, Homo sapiens
uaucuuugcuguuauu

SEQ ID NO: 1573750 - RNA, 20 nt, Homo sapiens
uaugaaaaccguaaagugcc

SEQ ID NO: 1573751 - RNA, 23 nt, Homo sapiens
uaugaaaaccguaaagugccuua

SEQ ID NO: 1573752 - RNA, 14 nt, Homo sapiens
uaugaaaagaauuu

SEQ ID NO: 1573753 - RNA, 20 nt, Homo sapiens
uaugaaaauauagacauucu

SEQ ID NO: 1573754 - RNA, 23 nt, Homo sapiens
uaugaaaauauagacauucucac

SEQ ID NO: 1573755 - RNA, 20 nt, Homo sapiens
uaugaaaccacugcuggcag

SEQ ID NO: 1573756 - RNA, 16 nt, Homo sapiens
uaugacuccauucaaa

SEQ ID NO: 1573757 - RNA, 18 nt, Homo sapiens
uaugagccaggcaucaua

SEQ ID NO: 1573758 - RNA, 22 nt, Homo sapiens
uaugagcuggggaugucucuca

SEQ ID NO: 1573759 - RNA, 18 nt, Homo sapiens
uaugaguaauacaucaaa

SEQ ID NO: 1573760 - RNA, 16 nt, Homo sapiens
uaugauauauugcugu

SEQ ID NO: 1573761 - RNA, 15 nt, Homo sapiens
uaugauauugcagcu

SEQ ID NO: 1573762 - RNA, 23 nt, Homo sapiens
uaugaugagaggccagcacauua

SEQ ID NO: 1573763 - RNA, 12 nt, Homo sapiens
uaugaugcaguu

SEQ ID NO: 1573764 - RNA, 13 nt, Homo sapiens
uaugauuauacaa

SEQ ID NO: 1573765 - RNA, 14 nt, Homo sapiens
uaugauuauacaaa

SEQ ID NO: 1573766 - RNA, 17 nt, Homo sapiens
uaugauuccaccuacau

SEQ ID NO: 1573767 - RNA, 18 nt, Homo sapiens
uaugcaaaccucaucuuu

SEQ ID NO: 1573768 - RNA, 14 nt, Homo sapiens
uaugcaaauggaga

SEQ ID NO: 1573769 - RNA, 15 nt, Homo sapiens
uaugcauuauaucaa

SEQ ID NO: 1573770 - RNA, 21 nt, Homo sapiens
uaugccauugggguaguugug

SEQ ID NO: 1573771 - RNA, 20 nt, Homo sapiens
uaugccuuuaaaucugugau

SEQ ID NO: 1573772 - RNA, 22 nt, Homo sapiens
uaugcgcuuaaauuaagauuau

SEQ ID NO: 1573773 - RNA, 21 nt, Homo sapiens
uaugcugcaacaaaauguaga

SEQ ID NO: 1573774 - RNA, 16 nt, Homo sapiens
uaugcugcuccugaua

SEQ ID NO: 1573775 - RNA, 16 nt, Homo sapiens
uaugcuuacugauaua

SEQ ID NO: 1573776 - RNA, 22 nt, Homo sapiens
uaugcuuuccuucuuugggaua

SEQ ID NO: 1573777 - RNA, 21 nt, Homo sapiens
uauggaauaucaucugucauu

SEQ ID NO: 1573778 - RNA, 19 nt, Homo sapiens
uauggcuaauaccugucaa

SEQ ID NO: 1573779 - RNA, 12 nt, Homo sapiens
ucagcugccuca

SEQ ID NO: 1573780 - RNA, 18 nt, Homo sapiens
ucagcuuuuguucuagac

SEQ ID NO: 1573781 - RNA, 23 nt, Homo sapiens
ucagcuuuuguuguuuauauaca

SEQ ID NO: 1573782 - RNA, 18 nt, Homo sapiens
ucaggaaaacuacugaua

SEQ ID NO: 1573783 - RNA, 11 nt, Homo sapiens
ucaggaaaaug

SEQ ID NO: 1573784 - RNA, 22 nt, Homo sapiens
ucaggaaaucaaauaugcaaag

SEQ ID NO: 1573785 - RNA, 17 nt, Homo sapiens
ucaggagaucgagacca

SEQ ID NO: 1573786 - RNA, 20 nt, Homo sapiens
ucaggagcuugggcagugcc

SEQ ID NO: 1573787 - RNA, 16 nt, Homo sapiens
ucaggccagugcaccc

SEQ ID NO: 1573788 - RNA, 22 nt, Homo sapiens
ucaggccauggguucaccagcc

SEQ ID NO: 1573789 - RNA, 18 nt, Homo sapiens
ucaggccauugucccuga

SEQ ID NO: 1573790 - RNA, 19 nt, Homo sapiens
ucaggcccaggaguccagg

SEQ ID NO: 1573791 - RNA, 20 nt, Homo sapiens
ucaggcccaggaguccaggc

SEQ ID NO: 1573792 - RNA, 20 nt, Homo sapiens
ucaggccugcuagucacugg

SEQ ID NO: 1573793 - RNA, 16 nt, Homo sapiens
ucaggcuacaagguag

SEQ ID NO: 1573794 - RNA, 22 nt, Homo sapiens
ucaggcuaucauauauacugua

SEQ ID NO: 1573795 - RNA, 17 nt, Homo sapiens
ucagggaaaaggaguag

SEQ ID NO: 1573796 - RNA, 18 nt, Homo sapiens
ucagggaagcugccaaag

SEQ ID NO: 1573797 - RNA, 13 nt, Homo sapiens
ucaggggccucuc

SEQ ID NO: 1573798 - RNA, 16 nt, Homo sapiens
ucaggguaccuggggc

SEQ ID NO: 1573799 - RNA, 19 nt, Homo sapiens
ucagggucuaagcaccuug

SEQ ID NO: 1573800 - RNA, 17 nt, Homo sapiens
ucagguaauacaaacua

SEQ ID NO: 1573801 - RNA, 17 nt, Homo sapiens
ucaggucccaggccagc

SEQ ID NO: 1573802 - RNA, 13 nt, Homo sapiens
ucaggugccaacc

SEQ ID NO: 1573803 - RNA, 18 nt, Homo sapiens
ucaggugugacucuagca

SEQ ID NO: 1573804 - RNA, 13 nt, Homo sapiens
ucaggugugcuca

SEQ ID NO: 1573805 - RNA, 23 nt, Homo sapiens
ucagguuuuugaggaaacaaaga

SEQ ID NO: 1573806 - RNA, 19 nt, Homo sapiens
ucaguacgagcugcucuaa

SEQ ID NO: 1573807 - RNA, 17 nt, Homo sapiens
ucaguauccacacauaa

SEQ ID NO: 1573808 - RNA, 15 nt, Homo sapiens
ucaguauucugacau

SEQ ID NO: 1573809 - RNA, 17 nt, Homo sapiens
ucaguauuuaauaucug

SEQ ID NO: 1573810 - RNA, 14 nt, Homo sapiens
ucagucaacaacuu

SEQ ID NO: 1573811 - RNA, 19 nt, Homo sapiens
ucagucaauagccauauca

SEQ ID NO: 1573812 - RNA, 13 nt, Homo sapiens
ucagucucugagc

SEQ ID NO: 1573813 - RNA, 18 nt, Homo sapiens
ucagucuuuaaucugaga

SEQ ID NO: 1573814 - RNA, 18 nt, Homo sapiens
ucagugaauaaaccauca

SEQ ID NO: 1573815 - RNA, 16 nt, Homo sapiens
ucagugagaccuggau

SEQ ID NO: 1573816 - RNA, 20 nt, Homo sapiens
ucagugcaguuucuuuucac

SEQ ID NO: 1573817 - RNA, 16 nt, Homo sapiens
ucagugcucuguaaaa

SEQ ID NO: 1573818 - RNA, 17 nt, Homo sapiens
ucaguguaccauuugcc

SEQ ID NO: 1573819 - RNA, 16 nt, Homo sapiens
ucagugugaugaauca

SEQ ID NO: 1573820 - RNA, 15 nt, Homo sapiens
ucaguguuugggaaa

SEQ ID NO: 1573821 - RNA, 16 nt, Homo sapiens
ucaguuaacuauugca

SEQ ID NO: 1573822 - RNA, 18 nt, Homo sapiens
ucaguuacucagcccugg

SEQ ID NO: 1573823 - RNA, 20 nt, Homo sapiens
ucaguuaucuguuuguuacu

SEQ ID NO: 1573824 - RNA, 15 nt, Homo sapiens
ucaguuggugcugcu

SEQ ID NO: 1573825 - RNA, 17 nt, Homo sapiens
ucauaaguggggagaga

SEQ ID NO: 1573826 - RNA, 15 nt, Homo sapiens
ucauaaucacaaccc

SEQ ID NO: 1573827 - RNA, 15 nt, Homo sapiens
ucauaauuuugcaaa

SEQ ID NO: 1573828 - RNA, 14 nt, Homo sapiens
ucauacauguuaca

SEQ ID NO: 1573829 - RNA, 20 nt, Homo sapiens
ucauaccuacaucagacaaa

SEQ ID NO: 1573830 - RNA, 18 nt, Homo sapiens
ucauacuaaacuucaccu

SEQ ID NO: 1573831 - RNA, 11 nt, Homo sapiens
ucauacuguac

SEQ ID NO: 1573832 - RNA, 15 nt, Homo sapiens
ucauacuguacacau

SEQ ID NO: 1573833 - RNA, 17 nt, Homo sapiens
ucauagaaugaaaguau

SEQ ID NO: 1573834 - RNA, 15 nt, Homo sapiens
ucauaguuuugcacu

SEQ ID NO: 1573835 - RNA, 20 nt, Homo sapiens
ucauauauuuuuaccaucug

SEQ ID NO: 1573836 - RNA, 23 nt, Homo sapiens
ucauauauuuuuaccaucugcug

SEQ ID NO: 1573837 - RNA, 19 nt, Homo sapiens
ucauaugaaaggugccaug

SEQ ID NO: 1573838 - RNA, 20 nt, Homo sapiens
ucauaugaaaggugccaugg

SEQ ID NO: 1573839 - RNA, 20 nt, Homo sapiens
ucauaugucagggcacaugu

SEQ ID NO: 1573840 - RNA, 19 nt, Homo sapiens
ucauauuauuuuagugugu

SEQ ID NO: 1573841 - RNA, 20 nt, Homo sapiens
ucauauuuauacuuugcaau

SEQ ID NO: 1573842 - RNA, 14 nt, Homo sapiens
ucaucaaacuccac

SEQ ID NO: 1573843 - RNA, 12 nt, Homo sapiens
ucaucacuguaa

SEQ ID NO: 1573844 - RNA, 17 nt, Homo sapiens
ucaucagauaugcuuac

SEQ ID NO: 1573845 - RNA, 19 nt, Homo sapiens
ucaucaggugugcucaggg

SEQ ID NO: 1573846 - RNA, 17 nt, Homo sapiens
ucaucauuucagccaaa

SEQ ID NO: 1573847 - RNA, 17 nt, Homo sapiens
ucauccagccucagaga

SEQ ID NO: 1573848 - RNA, 18 nt, Homo sapiens
ucauccauagacacagua

SEQ ID NO: 1573849 - RNA, 20 nt, Homo sapiens
ucaucccguaucacaguguu

SEQ ID NO: 1573850 - RNA, 14 nt, Homo sapiens
ucauccucccugac

SEQ ID NO: 1573851 - RNA, 23 nt, Homo sapiens
ucauccuuaaaacaauucuguga

SEQ ID NO: 1573852 - RNA, 15 nt, Homo sapiens
ucaucuaacugauga

SEQ ID NO: 1573853 - RNA, 16 nt, Homo sapiens
ucaucuauaacaugca

SEQ ID NO: 1573854 - RNA, 21 nt, Homo sapiens
ucaucuauuuuuggcagucug

SEQ ID NO: 1573855 - RNA, 21 nt, Homo sapiens
ucaucugaaggggcaaauucu

SEQ ID NO: 1573856 - RNA, 22 nt, Homo sapiens
ucaucugcacaacugacuucca

SEQ ID NO: 1573857 - RNA, 19 nt, Homo sapiens
ucaucugggacaaaacugg

SEQ ID NO: 1573858 - RNA, 14 nt, Homo sapiens
ucaucuucacugca

SEQ ID NO: 1573859 - RNA, 12 nt, Homo sapiens
ucaucuugccac

SEQ ID NO: 1573860 - RNA, 15 nt, Homo sapiens
ucaucuugcuaccag

SEQ ID NO: 1573861 - RNA, 19 nt, Homo sapiens
ucaucuuugccaccaccug

SEQ ID NO: 1573862 - RNA, 17 nt, Homo sapiens
ucaugauccaacuaaug

SEQ ID NO: 1573863 - RNA, 22 nt, Homo sapiens
ucaugaugcuagccagcaaaga

SEQ ID NO: 1573864 - RNA, 14 nt, Homo sapiens
ucaugcagcucaac

SEQ ID NO: 1573865 - RNA, 22 nt, Homo sapiens
ucaugcccccuuucagaugucu

SEQ ID NO: 1573866 - RNA, 20 nt, Homo sapiens
ucaugcccuuaaguucagca

SEQ ID NO: 1573867 - RNA, 21 nt, Homo sapiens
ucaugccuugagaucuguggu

SEQ ID NO: 1573868 - RNA, 20 nt, Homo sapiens
ucaugcuaauauaaguuucu

SEQ ID NO: 1573869 - RNA, 23 nt, Homo sapiens
ucaugcuguugcugcuacugucu

SEQ ID NO: 1573870 - RNA, 17 nt, Homo sapiens
ucaugcuugacauaccu

SEQ ID NO: 1573871 - RNA, 18 nt, Homo sapiens
ucaugcuugacauaccua

SEQ ID NO: 1573872 - RNA, 20 nt, Homo sapiens
ucaugcuuuugcuugcaaug

SEQ ID NO: 1573873 - RNA, 22 nt, Homo sapiens
ucauggaggccaagaacuugca

SEQ ID NO: 1573874 - RNA, 18 nt, Homo sapiens
ucauggauaaauugcaca

SEQ ID NO: 1573875 - RNA, 15 nt, Homo sapiens
ucaugguacauuuau

SEQ ID NO: 1573876 - RNA, 19 nt, Homo sapiens
ucaugguacauuuaucacu

SEQ ID NO: 1573877 - RNA, 16 nt, Homo sapiens
ucaugguacuacccca

SEQ ID NO: 1573878 - RNA, 18 nt, Homo sapiens
ucaugguggguucagggg

SEQ ID NO: 1573879 - RNA, 14 nt, Homo sapiens
ucauguauauaccu

SEQ ID NO: 1573880 - RNA, 17 nt, Homo sapiens
ucaugucaggccaucaa

SEQ ID NO: 1573881 - RNA, 11 nt, Homo sapiens
ucaugucauca

SEQ ID NO: 1573882 - RNA, 18 nt, Homo sapiens
ucaugugacucuuuccaa

SEQ ID NO: 1573883 - RNA, 19 nt, Homo sapiens
ucaugugcagucagcuuuu

SEQ ID NO: 1573884 - RNA, 16 nt, Homo sapiens
ucauguguucccuuug

SEQ ID NO: 1573885 - RNA, 18 nt, Homo sapiens
ucauguugaucauguacu

SEQ ID NO: 1573886 - RNA, 16 nt, Homo sapiens
ucauuaacccaucucu

SEQ ID NO: 1573887 - RNA, 17 nt, Homo sapiens
ucauuaauaauuugcuc

SEQ ID NO: 1573888 - RNA, 14 nt, Homo sapiens
ucauuaauucacau

SEQ ID NO: 1573889 - RNA, 23 nt, Homo sapiens
ucauuaccacgccuugaccuucc

SEQ ID NO: 1573890 - RNA, 11 nt, Homo sapiens
ucauuaucuca

SEQ ID NO: 1573891 - RNA, 13 nt, Homo sapiens
ucauuauguuucc

SEQ ID NO: 1573892 - RNA, 23 nt, Homo sapiens
ucauucaacucuccaauguucua

SEQ ID NO: 1573893 - RNA, 24 nt, Homo sapiens
ucauucagauuuguucuagauaau

SEQ ID NO: 1573894 - RNA, 21 nt, Homo sapiens
ucauucagcgcaugcaccuuc

SEQ ID NO: 1573895 - RNA, 23 nt, Homo sapiens
ucauucaguauuuauugagcauc

SEQ ID NO: 1573896 - RNA, 13 nt, Homo sapiens
ucauucaucauag

SEQ ID NO: 1573897 - RNA, 13 nt, Homo sapiens
uccaucuguugac

SEQ ID NO: 1573898 - RNA, 15 nt, Homo sapiens
uccaucuguugacaa

SEQ ID NO: 1573899 - RNA, 13 nt, Homo sapiens
uccaugugccuuu

SEQ ID NO: 1573900 - RNA, 22 nt, Homo sapiens
uccaugugccuuucuuugccuc

SEQ ID NO: 1573901 - RNA, 16 nt, Homo sapiens
uccaugugugugccaa

SEQ ID NO: 1573902 - RNA, 15 nt, Homo sapiens
uccauguuugcaccu

SEQ ID NO: 1573903 - RNA, 15 nt, Homo sapiens
uccauugauucaggg

SEQ ID NO: 1573904 - RNA, 16 nt, Homo sapiens
uccauugccuagcucu

SEQ ID NO: 1573905 - RNA, 16 nt, Homo sapiens
uccauuugcaaauaua

SEQ ID NO: 1573906 - RNA, 16 nt, Homo sapiens
uccauuuucuaugcuu

SEQ ID NO: 1573907 - RNA, 20 nt, Homo sapiens
uccauuuuuuucuuuacuua

SEQ ID NO: 1573908 - RNA, 13 nt, Homo sapiens
ucccaaaugaaaa

SEQ ID NO: 1573909 - RNA, 20 nt, Homo sapiens
ucccaaaugaaaaccccagu

SEQ ID NO: 1573910 - RNA, 21 nt, Homo sapiens
ucccaaauuucauaccuauca

SEQ ID NO: 1573911 - RNA, 16 nt, Homo sapiens
ucccaaauuugauuga

SEQ ID NO: 1573912 - RNA, 21 nt, Homo sapiens
ucccaacccauucacuacagg

SEQ ID NO: 1573913 - RNA, 15 nt, Homo sapiens
ucccaaccccaggaa

SEQ ID NO: 1573914 - RNA, 12 nt, Homo sapiens
ucccaagugcca

SEQ ID NO: 1573915 - RNA, 13 nt, Homo sapiens
ucccaauguuuga

SEQ ID NO: 1573916 - RNA, 13 nt, Homo sapiens
ucccacaucaggg

SEQ ID NO: 1573917 - RNA, 23 nt, Homo sapiens
ucccaccucucugagcucugcau

SEQ ID NO: 1573918 - RNA, 15 nt, Homo sapiens
ucccacgacuguugu

SEQ ID NO: 1573919 - RNA, 16 nt, Homo sapiens
ucccacgacuguugua

SEQ ID NO: 1573920 - RNA, 13 nt, Homo sapiens
ucccacuuggcau

SEQ ID NO: 1573921 - RNA, 13 nt, Homo sapiens
ucccacuuucauc

SEQ ID NO: 1573922 - RNA, 13 nt, Homo sapiens
ucccagacacugg

SEQ ID NO: 1573923 - RNA, 18 nt, Homo sapiens
ucccagagauguugagaa

SEQ ID NO: 1573924 - RNA, 21 nt, Homo sapiens
ucccagaggagccaccaguuc

SEQ ID NO: 1573925 - RNA, 17 nt, Homo sapiens
ucccagauggcuggaag

SEQ ID NO: 1573926 - RNA, 14 nt, Homo sapiens
ucccagauguaaag

SEQ ID NO: 1573927 - RNA, 15 nt, Homo sapiens
ucccagcccacaucu

SEQ ID NO: 1573928 - RNA, 23 nt, Homo sapiens
ucccaggccagcaagcucuucac

SEQ ID NO: 1573929 - RNA, 19 nt, Homo sapiens
ucccauaauugcuuugcca

SEQ ID NO: 1573930 - RNA, 14 nt, Homo sapiens
ucccaugaacuaua

SEQ ID NO: 1573931 - RNA, 21 nt, Homo sapiens
ucccaugagggagaugccaug

SEQ ID NO: 1573932 - RNA, 19 nt, Homo sapiens
ucccaugcucauaccucuu

SEQ ID NO: 1573933 - RNA, 19 nt, Homo sapiens
ucccauuaaagagccaguu

SEQ ID NO: 1573934 - RNA, 12 nt, Homo sapiens
ucccauugccau

SEQ ID NO: 1573935 - RNA, 15 nt, Homo sapiens
ucccauuucuugcua

SEQ ID NO: 1573936 - RNA, 23 nt, Homo sapiens
ucccauuuugauggugucuguga

SEQ ID NO: 1573937 - RNA, 22 nt, Homo sapiens
ucccauuuuugcuuagcucaau

SEQ ID NO: 1573938 - RNA, 15 nt, Homo sapiens
uccccaacaugcacu

SEQ ID NO: 1573939 - RNA, 14 nt, Homo sapiens
uccccaacugcucc

SEQ ID NO: 1573940 - RNA, 14 nt, Homo sapiens
uccccaaggacucu

SEQ ID NO: 1573941 - RNA, 14 nt, Homo sapiens
uccccaaggccaca

SEQ ID NO: 1573942 - RNA, 22 nt, Homo sapiens
uccccacaaacccccaccagca

SEQ ID NO: 1573943 - RNA, 13 nt, Homo sapiens
uccccacaaucug

SEQ ID NO: 1573944 - RNA, 20 nt, Homo sapiens
uccccacaccucccuacucc

SEQ ID NO: 1573945 - RNA, 16 nt, Homo sapiens
uccccacccagucuca

SEQ ID NO: 1573946 - RNA, 16 nt, Homo sapiens
uccccagaugugacua

SEQ ID NO: 1573947 - RNA, 13 nt, Homo sapiens
uccccagccuacc

SEQ ID NO: 1573948 - RNA, 15 nt, Homo sapiens
uccccagccuaccuc

SEQ ID NO: 1573949 - RNA, 23 nt, Homo sapiens
uccccagccuccccgugccaaaa

SEQ ID NO: 1573950 - RNA, 15 nt, Homo sapiens
uccccaguacagggg

SEQ ID NO: 1573951 - RNA, 16 nt, Homo sapiens
uccccagucccagaca

SEQ ID NO: 1573952 - RNA, 17 nt, Homo sapiens
uccccauggaacaaaug

SEQ ID NO: 1573953 - RNA, 19 nt, Homo sapiens
uccccccgagucuccggga

SEQ ID NO: 1573954 - RNA, 17 nt, Homo sapiens
ucccccgccuccaguca

SEQ ID NO: 1573955 - RNA, 17 nt, Homo sapiens
ucccccuaaaccaacug

SEQ ID NO: 1573956 - RNA, 14 nt, Homo sapiens
ucccccucuuucac

SEQ ID NO: 1573957 - RNA, 17 nt, Homo sapiens
ucccccugcuugucuuc

SEQ ID NO: 1573958 - RNA, 14 nt, Homo sapiens
uccccgugccaaaa

SEQ ID NO: 1573959 - RNA, 21 nt, Homo sapiens
uccccgugccaaaaaucuuuu

SEQ ID NO: 1573960 - RNA, 15 nt, Homo sapiens
uccccguuucuugca

SEQ ID NO: 1573961 - RNA, 19 nt, Homo sapiens
uccccucaaacucauugca

SEQ ID NO: 1573962 - RNA, 14 nt, Homo sapiens
uccccucacucugu

SEQ ID NO: 1573963 - RNA, 15 nt, Homo sapiens
uccccucagauucca

SEQ ID NO: 1573964 - RNA, 13 nt, Homo sapiens
uccccucccucag

SEQ ID NO: 1573965 - RNA, 16 nt, Homo sapiens
uccccuccucuauucc

SEQ ID NO: 1573966 - RNA, 16 nt, Homo sapiens
uccccuggcacuggca

SEQ ID NO: 1573967 - RNA, 20 nt, Homo sapiens
uccccuggggagucugggca

SEQ ID NO: 1573968 - RNA, 22 nt, Homo sapiens
uccccuggggagucugggcaca

SEQ ID NO: 1573969 - RNA, 21 nt, Homo sapiens
uccccuucccccaucccuacc

SEQ ID NO: 1573970 - RNA, 15 nt, Homo sapiens
uccccuucucucauc

SEQ ID NO: 1573971 - RNA, 15 nt, Homo sapiens
uccccuugucugcac

SEQ ID NO: 1573972 - RNA, 23 nt, Homo sapiens
uccccuuuguggauucuuuuugg

SEQ ID NO: 1573973 - RNA, 20 nt, Homo sapiens
ucccgaguugcugggauuac

SEQ ID NO: 1573974 - RNA, 20 nt, Homo sapiens
ucccgggacaccuaggcuag

SEQ ID NO: 1573975 - RNA, 16 nt, Homo sapiens
ucccguaucacagugu

SEQ ID NO: 1573976 - RNA, 17 nt, Homo sapiens
ucccuauagaccacugg

SEQ ID NO: 1573977 - RNA, 15 nt, Homo sapiens
ucccucaaaugacag

SEQ ID NO: 1573978 - RNA, 15 nt, Homo sapiens
ucccucagacccagc

SEQ ID NO: 1573979 - RNA, 22 nt, Homo sapiens
ucccucagacccagggguccag

SEQ ID NO: 1573980 - RNA, 11 nt, Homo sapiens
ucccucaggcc

SEQ ID NO: 1573981 - RNA, 13 nt, Homo sapiens
ucccuccaccuca

SEQ ID NO: 1573982 - RNA, 12 nt, Homo sapiens
ucccuccagggu

SEQ ID NO: 1573983 - RNA, 14 nt, Homo sapiens
ucccucucaugacu

SEQ ID NO: 1573984 - RNA, 19 nt, Homo sapiens
ucccucucaugacuugcag

SEQ ID NO: 1573985 - RNA, 21 nt, Homo sapiens
ucccucucaugacuugcaggg

SEQ ID NO: 1573986 - RNA, 19 nt, Homo sapiens
ucccugaaaacccagagag

SEQ ID NO: 1573987 - RNA, 18 nt, Homo sapiens
ucccugaagagaagggca

SEQ ID NO: 1573988 - RNA, 21 nt, Homo sapiens
ucccugaaucccccuugccac

SEQ ID NO: 1573989 - RNA, 19 nt, Homo sapiens
ucccugauaacaaccugga

SEQ ID NO: 1573990 - RNA, 15 nt, Homo sapiens
ucccugcagaccuca

SEQ ID NO: 1573991 - RNA, 15 nt, Homo sapiens
ucccugccucaggcc

SEQ ID NO: 1573992 - RNA, 24 nt, Homo sapiens
ucccugccucucaucaacugaaug

SEQ ID NO: 1573993 - RNA, 17 nt, Homo sapiens
ucccugccuguggcauu

SEQ ID NO: 1573994 - RNA, 12 nt, Homo sapiens
ucccugcucagu

SEQ ID NO: 1573995 - RNA, 15 nt, Homo sapiens
ucccugcuuugcauc

SEQ ID NO: 1573996 - RNA, 22 nt, Homo sapiens
ucccugggaguguucccgugcc

SEQ ID NO: 1573997 - RNA, 19 nt, Homo sapiens
ucccuggggaaaacuugca

SEQ ID NO: 1573998 - RNA, 24 nt, Homo sapiens
ucccuggggaaaacuugcagcuaa

SEQ ID NO: 1573999 - RNA, 18 nt, Homo sapiens
ucccuggggcacuuucau

SEQ ID NO: 1574000 - RNA, 16 nt, Homo sapiens
ucccuuggccucagaa

SEQ ID NO: 1574001 - RNA, 19 nt, Homo sapiens
ucccuugugagucuucacu

SEQ ID NO: 1574002 - RNA, 23 nt, Homo sapiens
ucccuuuuaguuugaucagacag

SEQ ID NO: 1574003 - RNA, 15 nt, Homo sapiens
ucccuuuucuguucu

SEQ ID NO: 1574004 - RNA, 19 nt, Homo sapiens
ucccuuuuucaaugaauuu

SEQ ID NO: 1574005 - RNA, 22 nt, Homo sapiens
uccgacaacaccguguccaaaa

SEQ ID NO: 1574006 - RNA, 18 nt, Homo sapiens
uccgauuccccuguagca

SEQ ID NO: 1574007 - RNA, 20 nt, Homo sapiens
uccgcggaccggggacccuu

SEQ ID NO: 1574008 - RNA, 14 nt, Homo sapiens
uccgggaacuggag

SEQ ID NO: 1574009 - RNA, 13 nt, Homo sapiens
uccgucucaaaaa

SEQ ID NO: 1574010 - RNA, 15 nt, Homo sapiens
uccuaaaaaacacug

SEQ ID NO: 1574011 - RNA, 23 nt, Homo sapiens
uccuaaagaaaaauaucuuggcc

SEQ ID NO: 1574012 - RNA, 14 nt, Homo sapiens
uccuaaauaucuca

SEQ ID NO: 1574013 - RNA, 15 nt, Homo sapiens
uccuaacugugauuu

SEQ ID NO: 1574014 - RNA, 16 nt, Homo sapiens
uccuaagguucuugcu

SEQ ID NO: 1574015 - RNA, 13 nt, Homo sapiens
uccuaauacuguc

SEQ ID NO: 1574016 - RNA, 18 nt, Homo sapiens
ucugcucccaugcucaua

SEQ ID NO: 1574017 - RNA, 13 nt, Homo sapiens
ucugcucccucug

SEQ ID NO: 1574018 - RNA, 22 nt, Homo sapiens
ucugcugagaggcaccagucca

SEQ ID NO: 1574019 - RNA, 18 nt, Homo sapiens
ucugcuguuccaguggua

SEQ ID NO: 1574020 - RNA, 20 nt, Homo sapiens
ucugcuuuucccauugccau

SEQ ID NO: 1574021 - RNA, 18 nt, Homo sapiens
ucugcuuuuuauuuuaca

SEQ ID NO: 1574022 - RNA, 16 nt, Homo sapiens
ucuggaaagaggcucu

SEQ ID NO: 1574023 - RNA, 21 nt, Homo sapiens
ucuggaagucaucucauucca

SEQ ID NO: 1574024 - RNA, 15 nt, Homo sapiens
ucuggacacacuguu

SEQ ID NO: 1574025 - RNA, 21 nt, Homo sapiens
ucuggaccauauaccaucucc

SEQ ID NO: 1574026 - RNA, 16 nt, Homo sapiens
ucuggaguauucuaua

SEQ ID NO: 1574027 - RNA, 19 nt, Homo sapiens
ucuggcaagccugucuuca

SEQ ID NO: 1574028 - RNA, 19 nt, Homo sapiens
ucuggcaaugggacucuga

SEQ ID NO: 1574029 - RNA, 21 nt, Homo sapiens
ucuggccagggcuuccucaaa

SEQ ID NO: 1574030 - RNA, 22 nt, Homo sapiens
ucuggcucaaguucgucucuga

SEQ ID NO: 1574031 - RNA, 18 nt, Homo sapiens
ucuggcucuaauucacag

SEQ ID NO: 1574032 - RNA, 16 nt, Homo sapiens
ucuggcucugccucag

SEQ ID NO: 1574033 - RNA, 17 nt, Homo sapiens
ucuggcuuagugccacc

SEQ ID NO: 1574034 - RNA, 15 nt, Homo sapiens
ucugggagucacaca

SEQ ID NO: 1574035 - RNA, 17 nt, Homo sapiens
ucugggccacucaggcc

SEQ ID NO: 1574036 - RNA, 21 nt, Homo sapiens
ucugggcuagguagaaaaagg

SEQ ID NO: 1574037 - RNA, 14 nt, Homo sapiens
ucuggggugcagcu

SEQ ID NO: 1574038 - RNA, 14 nt, Homo sapiens
ucuggguaucuuug

SEQ ID NO: 1574039 - RNA, 12 nt, Homo sapiens
ucugguaacugc

SEQ ID NO: 1574040 - RNA, 22 nt, Homo sapiens
ucugguaauaaaugugacucag

SEQ ID NO: 1574041 - RNA, 13 nt, Homo sapiens
ucuguaaaacaca

SEQ ID NO: 1574042 - RNA, 22 nt, Homo sapiens
ucuguaaaagcagacccaccuc

SEQ ID NO: 1574043 - RNA, 13 nt, Homo sapiens
ucuguaauugaau

SEQ ID NO: 1574044 - RNA, 14 nt, Homo sapiens
ucuguauauacuca

SEQ ID NO: 1574045 - RNA, 20 nt, Homo sapiens
ucuguauugucuauuauuua

SEQ ID NO: 1574046 - RNA, 14 nt, Homo sapiens
ucugucacaccagc

SEQ ID NO: 1574047 - RNA, 18 nt, Homo sapiens
ucugucaccaacugaagu

SEQ ID NO: 1574048 - RNA, 15 nt, Homo sapiens
ucugucauuauauuc

SEQ ID NO: 1574049 - RNA, 15 nt, Homo sapiens
ucugucuguggcaaa

SEQ ID NO: 1574050 - RNA, 15 nt, Homo sapiens
ucugugaaauaucau

SEQ ID NO: 1574051 - RNA, 14 nt, Homo sapiens
ucugugaagaaaga

SEQ ID NO: 1574052 - RNA, 23 nt, Homo sapiens
ucugugacauacauauuaucuca

SEQ ID NO: 1574053 - RNA, 17 nt, Homo sapiens
ucugugaccugucagaa

SEQ ID NO: 1574054 - RNA, 21 nt, Homo sapiens
ucugugaggggcucucucaug

SEQ ID NO: 1574055 - RNA, 14 nt, Homo sapiens
ucugugaugauccu

SEQ ID NO: 1574056 - RNA, 14 nt, Homo sapiens
ucugugcacaugcc

SEQ ID NO: 1574057 - RNA, 18 nt, Homo sapiens
ucugugcagucacuggag

SEQ ID NO: 1574058 - RNA, 14 nt, Homo sapiens
ucugugcuguggaa

SEQ ID NO: 1574059 - RNA, 19 nt, Homo sapiens
ucugugggcuccauguaga

SEQ ID NO: 1574060 - RNA, 22 nt, Homo sapiens
ucugugggucaguccucuuucc

SEQ ID NO: 1574061 - RNA, 14 nt, Homo sapiens
ucuguguaucucag

SEQ ID NO: 1574062 - RNA, 21 nt, Homo sapiens
ucuguguugacccuuugucca

SEQ ID NO: 1574063 - RNA, 15 nt, Homo sapiens
ucuguuaaaugaacu

SEQ ID NO: 1574064 - RNA, 18 nt, Homo sapiens
ucuguuaaaugaacuuga

SEQ ID NO: 1574065 - RNA, 16 nt, Homo sapiens
ucuguuauauagugga

SEQ ID NO: 1574066 - RNA, 18 nt, Homo sapiens
ucuguugaaaagcacaca

SEQ ID NO: 1574067 - RNA, 18 nt, Homo sapiens
ucuguugaaucacaguau

SEQ ID NO: 1574068 - RNA, 23 nt, Homo sapiens
ucuguugcaagccccucuuucug

SEQ ID NO: 1574069 - RNA, 18 nt, Homo sapiens
ucuguuggauuccaugcu

SEQ ID NO: 1574070 - RNA, 20 nt, Homo sapiens
ucuguuucuucaaugguucu

SEQ ID NO: 1574071 - RNA, 19 nt, Homo sapiens
ucuguuugaucacugugaa

SEQ ID NO: 1574072 - RNA, 16 nt, Homo sapiens
ucuguuuggaucuaua

SEQ ID NO: 1574073 - RNA, 17 nt, Homo sapiens
ucuguuuugaaggcaaa

SEQ ID NO: 1574074 - RNA, 19 nt, Homo sapiens
ucuuaaaacuauaacauua

SEQ ID NO: 1574075 - RNA, 15 nt, Homo sapiens
ucuuaaaaugcaaua

SEQ ID NO: 1574076 - RNA, 19 nt, Homo sapiens
ucuuaaauauuuaguugau

SEQ ID NO: 1574077 - RNA, 15 nt, Homo sapiens
ucuuaaaugagaaag

SEQ ID NO: 1574078 - RNA, 15 nt, Homo sapiens
ucuuaaccucaggga

SEQ ID NO: 1574079 - RNA, 23 nt, Homo sapiens
ucuuaauauaaauucacuuucau

SEQ ID NO: 1574080 - RNA, 24 nt, Homo sapiens
ucuuaauauaaauucacuuucauu

SEQ ID NO: 1574081 - RNA, 20 nt, Homo sapiens
ucuuacaaaauacacauucu

SEQ ID NO: 1574082 - RNA, 22 nt, Homo sapiens
ucuuacaagaggauuguaaaau

SEQ ID NO: 1574083 - RNA, 22 nt, Homo sapiens
ucuuacacaaggggcaaaugaa

SEQ ID NO: 1574084 - RNA, 12 nt, Homo sapiens
ucuuacuguugc

SEQ ID NO: 1574085 - RNA, 17 nt, Homo sapiens
ucuuacuguugcauaac

SEQ ID NO: 1574086 - RNA, 13 nt, Homo sapiens
ucuuagaauuugu

SEQ ID NO: 1574087 - RNA, 14 nt, Homo sapiens
ucuuagcugucacc

SEQ ID NO: 1574088 - RNA, 15 nt, Homo sapiens
ucuuaguguaugauu

SEQ ID NO: 1574089 - RNA, 14 nt, Homo sapiens
ucuuaguugcugua

SEQ ID NO: 1574090 - RNA, 23 nt, Homo sapiens
ucuuauaguguuuggacagcuga

SEQ ID NO: 1574091 - RNA, 16 nt, Homo sapiens
ucuuaucccagugauc

SEQ ID NO: 1574092 - RNA, 21 nt, Homo sapiens
ucuuaugcacaggaacuaaag

SEQ ID NO: 1574093 - RNA, 18 nt, Homo sapiens
ucuuauucucacuccacc

SEQ ID NO: 1574094 - RNA, 13 nt, Homo sapiens
ucuucaacaugac

SEQ ID NO: 1574095 - RNA, 16 nt, Homo sapiens
ucuucaaugguucucu

SEQ ID NO: 1574096 - RNA, 13 nt, Homo sapiens
ucuucacaacaga

SEQ ID NO: 1574097 - RNA, 18 nt, Homo sapiens
ucuucacaacagauuauu

SEQ ID NO: 1574098 - RNA, 13 nt, Homo sapiens
ucuucacuaaaau

SEQ ID NO: 1574099 - RNA, 22 nt, Homo sapiens
ucuucacuggugagacaaugaa

SEQ ID NO: 1574100 - RNA, 12 nt, Homo sapiens
ucuucagcauuu

SEQ ID NO: 1574101 - RNA, 16 nt, Homo sapiens
ucuucaguuuuucacu

SEQ ID NO: 1574102 - RNA, 20 nt, Homo sapiens
ucuucaugaguagugggcua

SEQ ID NO: 1574103 - RNA, 15 nt, Homo sapiens
ucuucaugucaucaa

SEQ ID NO: 1574104 - RNA, 14 nt, Homo sapiens
ucuucauuaccuca

SEQ ID NO: 1574105 - RNA, 15 nt, Homo sapiens
ucuucauuaccucag

SEQ ID NO: 1574106 - RNA, 22 nt, Homo sapiens
ucuucauuuuuuaaugugcucu

SEQ ID NO: 1574107 - RNA, 18 nt, Homo sapiens
ucuuccaaacaggcucag

SEQ ID NO: 1574108 - RNA, 14 nt, Homo sapiens
ucuucccauguccc

SEQ ID NO: 1574109 - RNA, 17 nt, Homo sapiens
ucuucccguaaaaacua

SEQ ID NO: 1574110 - RNA, 11 nt, Homo sapiens
ucuucccuacc

SEQ ID NO: 1574111 - RNA, 18 nt, Homo sapiens
ucuucccuaccucaggca

SEQ ID NO: 1574112 - RNA, 15 nt, Homo sapiens
ucuucccucucugca

SEQ ID NO: 1574113 - RNA, 22 nt, Homo sapiens
ucuucccucucugcagacuucc

SEQ ID NO: 1574114 - RNA, 23 nt, Homo sapiens
ucuuccuaacagggcacauauuc

SEQ ID NO: 1574115 - RNA, 19 nt, Homo sapiens
ucuuccucuagacuuggag

SEQ ID NO: 1574116 - RNA, 19 nt, Homo sapiens
ucuuccuuuuugguuuuua

SEQ ID NO: 1574117 - RNA, 20 nt, Homo sapiens
ucuucuaaaauagcaauaac

SEQ ID NO: 1574118 - RNA, 19 nt, Homo sapiens
ucuucuacccucaucauca

SEQ ID NO: 1574119 - RNA, 22 nt, Homo sapiens
ucuucuagugcuuuucagugau

SEQ ID NO: 1574120 - RNA, 21 nt, Homo sapiens
ucuucuccugccuaauuuuga

SEQ ID NO: 1574121 - RNA, 15 nt, Homo sapiens
ucuucucugcacuua

SEQ ID NO: 1574122 - RNA, 16 nt, Homo sapiens
ucuucuggauuagaau

SEQ ID NO: 1574123 - RNA, 16 nt, Homo sapiens
ucuucugguguugacu

SEQ ID NO: 1574124 - RNA, 14 nt, Homo sapiens
ucuucuuugcugca

SEQ ID NO: 1574125 - RNA, 20 nt, Homo sapiens
ucuugaaauuaagaaggcaa

SEQ ID NO: 1574126 - RNA, 19 nt, Homo sapiens
ucuugaaguauauauauca

SEQ ID NO: 1574127 - RNA, 14 nt, Homo sapiens
ucuugaauacucug

SEQ ID NO: 1574128 - RNA, 19 nt, Homo sapiens
ucuugacuacagucaggaa

SEQ ID NO: 1574129 - RNA, 20 nt, Homo sapiens
ucuugagggacaaugccaau

SEQ ID NO: 1574130 - RNA, 18 nt, Homo sapiens
ucuugaucggaaagcucu

SEQ ID NO: 1574131 - RNA, 17 nt, Homo sapiens
ucuugaucuuugagccc

SEQ ID NO: 1574132 - RNA, 14 nt, Homo sapiens
ucuugcacauggau

SEQ ID NO: 1574133 - RNA, 13 nt, Homo sapiens
ucuugccaucacu

SEQ ID NO: 1574134 - RNA, 20 nt, Homo sapiens
uguuuugcccuauauaccuc

SEQ ID NO: 1574135 - RNA, 12 nt, Homo sapiens
uguuuuuugcca

SEQ ID NO: 1574136 - RNA, 19 nt, Homo sapiens
uuaaaaaaaaauacugaug

SEQ ID NO: 1574137 - RNA, 17 nt, Homo sapiens
uuaaaaaaauaagaaga

SEQ ID NO: 1574138 - RNA, 18 nt, Homo sapiens
uuaaaaaaauaugccuuu

SEQ ID NO: 1574139 - RNA, 14 nt, Homo sapiens
uuaaaaaagcaaau

SEQ ID NO: 1574140 - RNA, 16 nt, Homo sapiens
uuaaaaauagacacuc

SEQ ID NO: 1574141 - RNA, 18 nt, Homo sapiens
uuaaaacaauucugugac

SEQ ID NO: 1574142 - RNA, 19 nt, Homo sapiens
uuaaaacaauucugugaca

SEQ ID NO: 1574143 - RNA, 11 nt, Homo sapiens
uuaaaacacuu

SEQ ID NO: 1574144 - RNA, 18 nt, Homo sapiens
uuaaaaccagaaagguga

SEQ ID NO: 1574145 - RNA, 21 nt, Homo sapiens
uuaaaacugaacuugaagcua

SEQ ID NO: 1574146 - RNA, 18 nt, Homo sapiens
uuaaaagaacucauucau

SEQ ID NO: 1574147 - RNA, 16 nt, Homo sapiens
uuaaaagcacacuccc

SEQ ID NO: 1574148 - RNA, 18 nt, Homo sapiens
uuaaaagccccagucuca

SEQ ID NO: 1574149 - RNA, 15 nt, Homo sapiens
uuaaaaguugcaaag

SEQ ID NO: 1574150 - RNA, 15 nt, Homo sapiens
uuaaaauaacuaagc

SEQ ID NO: 1574151 - RNA, 16 nt, Homo sapiens
uuaaaauaaugaacac

SEQ ID NO: 1574152 - RNA, 19 nt, Homo sapiens
uuaaaauagcaaaagaaga

SEQ ID NO: 1574153 - RNA, 17 nt, Homo sapiens
uuaaaauauucuacaga

SEQ ID NO: 1574154 - RNA, 18 nt, Homo sapiens
uuaaaaucugucacguag

SEQ ID NO: 1574155 - RNA, 14 nt, Homo sapiens
uuaaaaucugugaa

SEQ ID NO: 1574156 - RNA, 11 nt, Homo sapiens
uuaaaauggaa

SEQ ID NO: 1574157 - RNA, 17 nt, Homo sapiens
uuaaacaaauaauuuag

SEQ ID NO: 1574158 - RNA, 23 nt, Homo sapiens
uuaaacacacauugcagcuucaa

SEQ ID NO: 1574159 - RNA, 11 nt, Homo sapiens
uuaaacacauu

SEQ ID NO: 1574160 - RNA, 23 nt, Homo sapiens
uuaaacacuaaucacaaacugaa

SEQ ID NO: 1574161 - RNA, 23 nt, Homo sapiens
uuaaacucugaagccacaaagac

SEQ ID NO: 1574162 - RNA, 19 nt, Homo sapiens
uuaaacucuggacacucua

SEQ ID NO: 1574163 - RNA, 12 nt, Homo sapiens
uuaaacuuucaa

SEQ ID NO: 1574164 - RNA, 16 nt, Homo sapiens
uuaaagaaagaagugu

SEQ ID NO: 1574165 - RNA, 16 nt, Homo sapiens
uuaaagaaagaaugca

SEQ ID NO: 1574166 - RNA, 15 nt, Homo sapiens
uuaaagaauaugacu

SEQ ID NO: 1574167 - RNA, 12 nt, Homo sapiens
uuaaagacacuu

SEQ ID NO: 1574168 - RNA, 21 nt, Homo sapiens
uuaaagcaaacuaugauuuau

SEQ ID NO: 1574169 - RNA, 19 nt, Homo sapiens
uuaaagcauauuggugcua

SEQ ID NO: 1574170 - RNA, 16 nt, Homo sapiens
uuaaagcaucaucugu

SEQ ID NO: 1574171 - RNA, 19 nt, Homo sapiens
uuaaaggaaaaucacaucu

SEQ ID NO: 1574172 - RNA, 16 nt, Homo sapiens
uuaaagguaugcauuu

SEQ ID NO: 1574173 - RNA, 20 nt, Homo sapiens
uuaaagguguaaaauaacau

SEQ ID NO: 1574174 - RNA, 17 nt, Homo sapiens
uuaaauaauacauuuau

SEQ ID NO: 1574175 - RNA, 12 nt, Homo sapiens
uuaaaucaauaa

SEQ ID NO: 1574176 - RNA, 23 nt, Homo sapiens
uuaaaucaauaaagaccacuuua

SEQ ID NO: 1574177 - RNA, 22 nt, Homo sapiens
uuaaaucauuuuaacuucuaua

SEQ ID NO: 1574178 - RNA, 14 nt, Homo sapiens
uuaaaugacaauuu

SEQ ID NO: 1574179 - RNA, 22 nt, Homo sapiens
uuaaauggaauuuucuaauaua

SEQ ID NO: 1574180 - RNA, 15 nt, Homo sapiens
uuaaauuccacagau

SEQ ID NO: 1574181 - RNA, 17 nt, Homo sapiens
uuaaauuccacagauua

SEQ ID NO: 1574182 - RNA, 21 nt, Homo sapiens
uuaacacccuuuagaaccuua

SEQ ID NO: 1574183 - RNA, 23 nt, Homo sapiens
uuaaccucugcuuuuaucucaga

SEQ ID NO: 1574184 - RNA, 13 nt, Homo sapiens
uuaaccuuuccag

SEQ ID NO: 1574185 - RNA, 20 nt, Homo sapiens
uuaacgaaaauaguauuuca

SEQ ID NO: 1574186 - RNA, 13 nt, Homo sapiens
uuaacgacaauuu

SEQ ID NO: 1574187 - RNA, 14 nt, Homo sapiens
uuaacggugcuaaa

SEQ ID NO: 1574188 - RNA, 19 nt, Homo sapiens
uuaacuccuccugagcucu

SEQ ID NO: 1574189 - RNA, 22 nt, Homo sapiens
uuaacugaagccugcuccuucu

SEQ ID NO: 1574190 - RNA, 16 nt, Homo sapiens
uuaacuggcaugucau

SEQ ID NO: 1574191 - RNA, 15 nt, Homo sapiens
uuaacuggugcacuu

SEQ ID NO: 1574192 - RNA, 20 nt, Homo sapiens
uuaacugugaaauaccacaa

SEQ ID NO: 1574193 - RNA, 18 nt, Homo sapiens
uuaacuuuuguaccaaau

SEQ ID NO: 1574194 - RNA, 18 nt, Homo sapiens
uuaagaaaaaaagcaaaa

SEQ ID NO: 1574195 - RNA, 18 nt, Homo sapiens
uuaagaaauucacuuccc

SEQ ID NO: 1574196 - RNA, 15 nt, Homo sapiens
uuaagaaugaaacua

SEQ ID NO: 1574197 - RNA, 18 nt, Homo sapiens
uuaagaauuuuuuccuaa

SEQ ID NO: 1574198 - RNA, 19 nt, Homo sapiens
uuaagauccacaaaugaag

SEQ ID NO: 1574199 - RNA, 20 nt, Homo sapiens
uuaagauucuugacuuauau

SEQ ID NO: 1574200 - RNA, 21 nt, Homo sapiens
uuaagcaaauacuuagcaaaa

SEQ ID NO: 1574201 - RNA, 15 nt, Homo sapiens
uuaagccaucaggga

SEQ ID NO: 1574202 - RNA, 19 nt, Homo sapiens
uuaaggucuccaaaccaga

SEQ ID NO: 1574203 - RNA, 22 nt, Homo sapiens
uuaaguauguuauuuucuguug

SEQ ID NO: 1574204 - RNA, 12 nt, Homo sapiens
uuaaguguaaau

SEQ ID NO: 1574205 - RNA, 22 nt, Homo sapiens
uuaaguuacacauuuuucagau

SEQ ID NO: 1574206 - RNA, 17 nt, Homo sapiens
uuaauaaaacucacuca

SEQ ID NO: 1574207 - RNA, 14 nt, Homo sapiens
uuaauaaaaguaca

SEQ ID NO: 1574208 - RNA, 12 nt, Homo sapiens
uuaauaaacaug

SEQ ID NO: 1574209 - RNA, 16 nt, Homo sapiens
uuaauaaaccuuugca

SEQ ID NO: 1574210 - RNA, 21 nt, Homo sapiens
uuaauacauaguguauuuugc

SEQ ID NO: 1574211 - RNA, 18 nt, Homo sapiens
uuaauaccacagcuauuu

SEQ ID NO: 1574212 - RNA, 20 nt, Homo sapiens
uuaauacugacucagugucu

SEQ ID NO: 1574213 - RNA, 22 nt, Homo sapiens
uuaauagcaacagagcacuuga

SEQ ID NO: 1574214 - RNA, 13 nt, Homo sapiens
uuaauagcacuaa

SEQ ID NO: 1574215 - RNA, 19 nt, Homo sapiens
uuaauagccaaagauuuca

SEQ ID NO: 1574216 - RNA, 21 nt, Homo sapiens
uuaauaggugcagucuuugag

SEQ ID NO: 1574217 - RNA, 15 nt, Homo sapiens
uuaauaugagcuuca

SEQ ID NO: 1574218 - RNA, 20 nt, Homo sapiens
uuaauauuuuccuaguagau

SEQ ID NO: 1574219 - RNA, 18 nt, Homo sapiens
uuaaucugagaggccaca

SEQ ID NO: 1574220 - RNA, 21 nt, Homo sapiens
uuaaucuuaguguaugauuac

SEQ ID NO: 1574221 - RNA, 15 nt, Homo sapiens
uuaaugaagugcaau

SEQ ID NO: 1574222 - RNA, 16 nt, Homo sapiens
uuaaugaagugcaaua

SEQ ID NO: 1574223 - RNA, 17 nt, Homo sapiens
uuaauguagaaccucaa

SEQ ID NO: 1574224 - RNA, 17 nt, Homo sapiens
uuaauuacaacugcuau

SEQ ID NO: 1574225 - RNA, 13 nt, Homo sapiens
uuaauuacauaca

SEQ ID NO: 1574226 - RNA, 14 nt, Homo sapiens
uuaauuacauacau

SEQ ID NO: 1574227 - RNA, 14 nt, Homo sapiens
uuaauugcauuuaa

SEQ ID NO: 1574228 - RNA, 15 nt, Homo sapiens
uuaauuuaauugcuu

SEQ ID NO: 1574229 - RNA, 15 nt, Homo sapiens
uuaauuucauguaua

SEQ ID NO: 1574230 - RNA, 16 nt, Homo sapiens
uuaauuuucaaaacaa

SEQ ID NO: 1574231 - RNA, 22 nt, Homo sapiens
uuacaaaaucagguaacuaacu

SEQ ID NO: 1574232 - RNA, 20 nt, Homo sapiens
uuacaaaccauuaccuguac

SEQ ID NO: 1574233 - RNA, 13 nt, Homo sapiens
uuacaaauauugu

SEQ ID NO: 1574234 - RNA, 19 nt, Homo sapiens
uuacaacuuguauuuccaa

SEQ ID NO: 1574235 - RNA, 16 nt, Homo sapiens
uuacaagugguuaaaa

SEQ ID NO: 1574236 - RNA, 22 nt, Homo sapiens
uuacacagagaaauacaaaaua

SEQ ID NO: 1574237 - RNA, 12 nt, Homo sapiens
uuacacauagca

SEQ ID NO: 1574238 - RNA, 20 nt, Homo sapiens
uuacacauuucacugugaug

SEQ ID NO: 1574239 - RNA, 17 nt, Homo sapiens
uuacacugugucauucu

SEQ ID NO: 1574240 - RNA, 17 nt, Homo sapiens
uuacaggcgugauccac

SEQ ID NO: 1574241 - RNA, 16 nt, Homo sapiens
uuacagggugacucac

SEQ ID NO: 1574242 - RNA, 22 nt, Homo sapiens
uuacaggugugaaccacugugc

SEQ ID NO: 1574243 - RNA, 14 nt, Homo sapiens
uuacagugauccac

SEQ ID NO: 1574244 - RNA, 22 nt, Homo sapiens
uuacaguguagaguaacacaua

SEQ ID NO: 1574245 - RNA, 21 nt, Homo sapiens
uuacaguuagaaacaccagcc

SEQ ID NO: 1574246 - RNA, 14 nt, Homo sapiens
uuacauacuauucu

SEQ ID NO: 1574247 - RNA, 17 nt, Homo sapiens
uuacauacuauucuuac

SEQ ID NO: 1574248 - RNA, 23 nt, Homo sapiens
uuacauagaugauaaaagagaag

SEQ ID NO: 1574249 - RNA, 23 nt, Homo sapiens
uuacauaguuuucuuccuuugaa

SEQ ID NO: 1574250 - RNA, 22 nt, Homo sapiens
uuacaucaugcuggaaccugca

SEQ ID NO: 1574251 - RNA, 15 nt, Homo sapiens
uuacauccucugaua

SEQ ID NO: 1574252 - RNA, 15 nt, Homo sapiens
uuccaaaacauuucu

SEQ ID NO: 1574253 - RNA, 19 nt, Homo sapiens
uuccaaaacuguccagggc

SEQ ID NO: 1574254 - RNA, 19 nt, Homo sapiens
uuccaaagacucccuccau

SEQ ID NO: 1574255 - RNA, 19 nt, Homo sapiens
uuccaaagcagccugugaa

SEQ ID NO: 1574256 - RNA, 20 nt, Homo sapiens
uuccaaauuuagaaagcuua

SEQ ID NO: 1574257 - RNA, 20 nt, Homo sapiens
uuccaaccccccaguauaaa

SEQ ID NO: 1574258 - RNA, 16 nt, Homo sapiens
uuccaaccuuuggaag

SEQ ID NO: 1574259 - RNA, 23 nt, Homo sapiens
uuccaacucgaaucugugugaaa

SEQ ID NO: 1574260 - RNA, 20 nt, Homo sapiens
uuccaauuuuguugcaucau

SEQ ID NO: 1574261 - RNA, 11 nt, Homo sapiens
uuccacaaaau

SEQ ID NO: 1574262 - RNA, 15 nt, Homo sapiens
uuccacaaaccugga

SEQ ID NO: 1574263 - RNA, 21 nt, Homo sapiens
uuccacaaagaaaauuccuau

SEQ ID NO: 1574264 - RNA, 15 nt, Homo sapiens
uuccacagauuauca

SEQ ID NO: 1574265 - RNA, 24 nt, Homo sapiens
uuccacgugggccucacauuccag

SEQ ID NO: 1574266 - RNA, 18 nt, Homo sapiens
uuccacuccuuccagaac

SEQ ID NO: 1574267 - RNA, 11 nt, Homo sapiens
uuccacugaaa

SEQ ID NO: 1574268 - RNA, 20 nt, Homo sapiens
uuccacugucuuucaaugac

SEQ ID NO: 1574269 - RNA, 14 nt, Homo sapiens
uuccagacuuugaa

SEQ ID NO: 1574270 - RNA, 22 nt, Homo sapiens
uuccagacuuugaaacuauuaa

SEQ ID NO: 1574271 - RNA, 14 nt, Homo sapiens
uuccagagcugaga

SEQ ID NO: 1574272 - RNA, 18 nt, Homo sapiens
uuccagcacuuuguauga

SEQ ID NO: 1574273 - RNA, 22 nt, Homo sapiens
uuccagccuucuacugcucucc

SEQ ID NO: 1574274 - RNA, 14 nt, Homo sapiens
uuccagggauuuaa

SEQ ID NO: 1574275 - RNA, 23 nt, Homo sapiens
uuccagguagcucggcaccaacu

SEQ ID NO: 1574276 - RNA, 20 nt, Homo sapiens
uuccagguggacaaagucaa

SEQ ID NO: 1574277 - RNA, 18 nt, Homo sapiens
uuccagguguuacuguaa

SEQ ID NO: 1574278 - RNA, 13 nt, Homo sapiens
uuccauacuguuu

SEQ ID NO: 1574279 - RNA, 19 nt, Homo sapiens
uuccauaggaaggcuguga

SEQ ID NO: 1574280 - RNA, 20 nt, Homo sapiens
uuccauaguguuaacuguca

SEQ ID NO: 1574281 - RNA, 22 nt, Homo sapiens
uuccaucacaagaaagucauua

SEQ ID NO: 1574282 - RNA, 22 nt, Homo sapiens
uuccaucuccaggagacuuuca

SEQ ID NO: 1574283 - RNA, 23 nt, Homo sapiens
uuccaugcaacuggaguuccuua

SEQ ID NO: 1574284 - RNA, 13 nt, Homo sapiens
uuccauguccaua

SEQ ID NO: 1574285 - RNA, 22 nt, Homo sapiens
uuccauguucugggugauggaa

SEQ ID NO: 1574286 - RNA, 15 nt, Homo sapiens
uuccauuagaacaaa

SEQ ID NO: 1574287 - RNA, 16 nt, Homo sapiens
uuccauuugcaaggga

SEQ ID NO: 1574288 - RNA, 18 nt, Homo sapiens
uucccaaauuucauaccu

SEQ ID NO: 1574289 - RNA, 18 nt, Homo sapiens
uucccaagcgucaucugu

SEQ ID NO: 1574290 - RNA, 15 nt, Homo sapiens
uucccacugcacucc

SEQ ID NO: 1574291 - RNA, 23 nt, Homo sapiens
uucccaggagauggguccagggg

SEQ ID NO: 1574292 - RNA, 21 nt, Homo sapiens
uucccaggccagcaagcucuu

SEQ ID NO: 1574293 - RNA, 23 nt, Homo sapiens
uucccaguuaaagauuauuguga

SEQ ID NO: 1574294 - RNA, 17 nt, Homo sapiens
uucccauuaaagagcca

SEQ ID NO: 1574295 - RNA, 16 nt, Homo sapiens
uucccauuuuugcuua

SEQ ID NO: 1574296 - RNA, 20 nt, Homo sapiens
uuccccaaggacucuuccac

SEQ ID NO: 1574297 - RNA, 22 nt, Homo sapiens
uuccccaccccagcucaugccc

SEQ ID NO: 1574298 - RNA, 16 nt, Homo sapiens
uuccccaucuucuaaa

SEQ ID NO: 1574299 - RNA, 18 nt, Homo sapiens
uucccccaauguuuaaaa

SEQ ID NO: 1574300 - RNA, 16 nt, Homo sapiens
uucccucccuaucuaa

SEQ ID NO: 1574301 - RNA, 20 nt, Homo sapiens
uucccugaaaacccagagag

SEQ ID NO: 1574302 - RNA, 23 nt, Homo sapiens
uucccuuugucuuucaaacucca

SEQ ID NO: 1574303 - RNA, 16 nt, Homo sapiens
uuccgguuguugauau

SEQ ID NO: 1574304 - RNA, 15 nt, Homo sapiens
uuccguggucagagu

SEQ ID NO: 1574305 - RNA, 20 nt, Homo sapiens
uuccuaaaaguucauaacag

SEQ ID NO: 1574306 - RNA, 14 nt, Homo sapiens
uuccuaacugugau

SEQ ID NO: 1574307 - RNA, 12 nt, Homo sapiens
uuccuagcugug

SEQ ID NO: 1574308 - RNA, 15 nt, Homo sapiens
uuccuaggccacguc

SEQ ID NO: 1574309 - RNA, 22 nt, Homo sapiens
uuccuaugcugcaauacauuaa

SEQ ID NO: 1574310 - RNA, 17 nt, Homo sapiens
uuccucaaaacuucaga

SEQ ID NO: 1574311 - RNA, 17 nt, Homo sapiens
uuccucaaauacaugca

SEQ ID NO: 1574312 - RNA, 20 nt, Homo sapiens
uuccucccaggaagcccagg

SEQ ID NO: 1574313 - RNA, 21 nt, Homo sapiens
uuccucccaggaagcccagga

SEQ ID NO: 1574314 - RNA, 16 nt, Homo sapiens
uuccucccauuuccca

SEQ ID NO: 1574315 - RNA, 17 nt, Homo sapiens
uuccucccccaguuccu

SEQ ID NO: 1574316 - RNA, 19 nt, Homo sapiens
uuccucccccaguuccucc

SEQ ID NO: 1574317 - RNA, 19 nt, Homo sapiens
uuccuccuaaaacaauccu

SEQ ID NO: 1574318 - RNA, 12 nt, Homo sapiens
uuccucugccac

SEQ ID NO: 1574319 - RNA, 22 nt, Homo sapiens
uuccucuugugauuucuuuaaa

SEQ ID NO: 1574320 - RNA, 18 nt, Homo sapiens
uuccugcaucucugugaa

SEQ ID NO: 1574321 - RNA, 20 nt, Homo sapiens
uuccuggaggucagcauuug

SEQ ID NO: 1574322 - RNA, 20 nt, Homo sapiens
uuccugggugcaucaaacaa

SEQ ID NO: 1574323 - RNA, 14 nt, Homo sapiens
uuccuguaauauau

SEQ ID NO: 1574324 - RNA, 14 nt, Homo sapiens
uuccugugacaaaa

SEQ ID NO: 1574325 - RNA, 11 nt, Homo sapiens
uuccugugauu

SEQ ID NO: 1574326 - RNA, 15 nt, Homo sapiens
uuccuguucuauuaa

SEQ ID NO: 1574327 - RNA, 21 nt, Homo sapiens
uuccuucaugaucaucacaau

SEQ ID NO: 1574328 - RNA, 13 nt, Homo sapiens
uuccuucucccau

SEQ ID NO: 1574329 - RNA, 21 nt, Homo sapiens
uuccuugaauguggcuugaga

SEQ ID NO: 1574330 - RNA, 19 nt, Homo sapiens
uuccuuggcaguggacuca

SEQ ID NO: 1574331 - RNA, 22 nt, Homo sapiens
uuccuuguccccgcagcugcuu

SEQ ID NO: 1574332 - RNA, 24 nt, Homo sapiens
uuccuuucccuuuagcacguuuaa

SEQ ID NO: 1574333 - RNA, 19 nt, Homo sapiens
uuccuuuuucuaugaaaua

SEQ ID NO: 1574334 - RNA, 18 nt, Homo sapiens
uuccuuuuucuucacuua

SEQ ID NO: 1574335 - RNA, 17 nt, Homo sapiens
uuccuuuuugacacuga

SEQ ID NO: 1574336 - RNA, 19 nt, Homo sapiens
uucgcuuaguaacuaguga

SEQ ID NO: 1574337 - RNA, 17 nt, Homo sapiens
uucggauuuggggugga

SEQ ID NO: 1574338 - RNA, 14 nt, Homo sapiens
uucggugugcugcc

SEQ ID NO: 1574339 - RNA, 21 nt, Homo sapiens
uucguucugauaugugaauuu

SEQ ID NO: 1574340 - RNA, 21 nt, Homo sapiens
uucuaaaggaaaucaaaugaa

SEQ ID NO: 1574341 - RNA, 21 nt, Homo sapiens
uucuacaauguagaaaaugag

SEQ ID NO: 1574342 - RNA, 23 nt, Homo sapiens
uucuacacagagcaggacugcac

SEQ ID NO: 1574343 - RNA, 19 nt, Homo sapiens
uucuacauacuauggaauu

SEQ ID NO: 1574344 - RNA, 15 nt, Homo sapiens
uucuacuaugaucag

SEQ ID NO: 1574345 - RNA, 12 nt, Homo sapiens
uucuacuggaaa

SEQ ID NO: 1574346 - RNA, 23 nt, Homo sapiens
uucuacuucuggaagucaucuca

SEQ ID NO: 1574347 - RNA, 22 nt, Homo sapiens
uucuagagcuuagcauaucuga

SEQ ID NO: 1574348 - RNA, 14 nt, Homo sapiens
uucuagccuuuuaa

SEQ ID NO: 1574349 - RNA, 21 nt, Homo sapiens
uucuagugcuuuucagugaua

SEQ ID NO: 1574350 - RNA, 22 nt, Homo sapiens
uucuauaaaugaaugugcugaa

SEQ ID NO: 1574351 - RNA, 17 nt, Homo sapiens
uucuauaggaacauaug

SEQ ID NO: 1574352 - RNA, 15 nt, Homo sapiens
uucuauuauggaaaa

SEQ ID NO: 1574353 - RNA, 18 nt, Homo sapiens
uucuauucuagccugcau

SEQ ID NO: 1574354 - RNA, 13 nt, Homo sapiens
uucuauugggaua

SEQ ID NO: 1574355 - RNA, 14 nt, Homo sapiens
uucuauugggauau

SEQ ID NO: 1574356 - RNA, 18 nt, Homo sapiens
uucuauugggauauccuu

SEQ ID NO: 1574357 - RNA, 21 nt, Homo sapiens
uucuauuuauauguacaugag

SEQ ID NO: 1574358 - RNA, 19 nt, Homo sapiens
uucucaacauacuguaauc

SEQ ID NO: 1574359 - RNA, 12 nt, Homo sapiens
uucucaacuggg

SEQ ID NO: 1574360 - RNA, 19 nt, Homo sapiens
uucucacaaaaaggcaaau

SEQ ID NO: 1574361 - RNA, 16 nt, Homo sapiens
uucucacccaggcaau

SEQ ID NO: 1574362 - RNA, 16 nt, Homo sapiens
uucucacuccaccacc

SEQ ID NO: 1574363 - RNA, 12 nt, Homo sapiens
uucucagaaaag

SEQ ID NO: 1574364 - RNA, 22 nt, Homo sapiens
uucucagauguugaaacuuuga

SEQ ID NO: 1574365 - RNA, 20 nt, Homo sapiens
uucucaucacucaaccuuau

SEQ ID NO: 1574366 - RNA, 16 nt, Homo sapiens
uucucaucccaaccuc

SEQ ID NO: 1574367 - RNA, 21 nt, Homo sapiens
uucucaucuucuuauuuucca

SEQ ID NO: 1574368 - RNA, 13 nt, Homo sapiens
uucuccugccuca

SEQ ID NO: 1574369 - RNA, 16 nt, Homo sapiens
uuguguauccaugcac

SEQ ID NO: 1574370 - RNA, 16 nt, Homo sapiens
uugugucagauuacca

SEQ ID NO: 1574371 - RNA, 18 nt, Homo sapiens
uuguuacauuauguggaa

SEQ ID NO: 1574372 - RNA, 14 nt, Homo sapiens
uuguuacucaggaa

SEQ ID NO: 1574373 - RNA, 21 nt, Homo sapiens
uuguuacucaggaaccucacc

SEQ ID NO: 1574374 - RNA, 19 nt, Homo sapiens
uuguucgccgcguggaaug

SEQ ID NO: 1574375 - RNA, 23 nt, Homo sapiens
uuguucgccgcguggaaugugag

SEQ ID NO: 1574376 - RNA, 12 nt, Homo sapiens
uuguucugagau

SEQ ID NO: 1574377 - RNA, 13 nt, Homo sapiens
uuguugacuguga

SEQ ID NO: 1574378 - RNA, 19 nt, Homo sapiens
uuguugcaagaugugaauu

SEQ ID NO: 1574379 - RNA, 18 nt, Homo sapiens
uuguugccuucaucuuca

SEQ ID NO: 1574380 - RNA, 14 nt, Homo sapiens
uuguugcugucaag

SEQ ID NO: 1574381 - RNA, 14 nt, Homo sapiens
uuguugucuuuaug

SEQ ID NO: 1574382 - RNA, 18 nt, Homo sapiens
uuguuuaaacaaucuuuc

SEQ ID NO: 1574383 - RNA, 22 nt, Homo sapiens
uuguuuaauuuuuauuucuucc

SEQ ID NO: 1574384 - RNA, 23 nt, Homo sapiens
uuguuuaccauagaaagaugaca

SEQ ID NO: 1574385 - RNA, 14 nt, Homo sapiens
uuguuuauauugca

SEQ ID NO: 1574386 - RNA, 13 nt, Homo sapiens
uuguuuaugcugc

SEQ ID NO: 1574387 - RNA, 21 nt, Homo sapiens
uuguuucccaucagacuguca

SEQ ID NO: 1574388 - RNA, 19 nt, Homo sapiens
uuguuuguaaaugccucuu

SEQ ID NO: 1574389 - RNA, 22 nt, Homo sapiens
uuguuuucagcacugauggaaa

SEQ ID NO: 1574390 - RNA, 12 nt, Homo sapiens
uuguuuugugaa

SEQ ID NO: 1574391 - RNA, 22 nt, Homo sapiens
uuguuuuugcaugaaauuguau

SEQ ID NO: 1574392 - RNA, 20 nt, Homo sapiens
uuguuuuuuagcagugcuga

SEQ ID NO: 1574393 - RNA, 14 nt, Homo sapiens
uuguuuuuugccau

SEQ ID NO: 1574394 - RNA, 23 nt, Homo sapiens
uuuaaaaaaccacauggcacaga

SEQ ID NO: 1574395 - RNA, 18 nt, Homo sapiens
uuuaaaaaauuauggaau

SEQ ID NO: 1574396 - RNA, 19 nt, Homo sapiens
uuuaaaaaugucuugcugu

SEQ ID NO: 1574397 - RNA, 16 nt, Homo sapiens
uuuaaaacaggcaaag

SEQ ID NO: 1574398 - RNA, 13 nt, Homo sapiens
uuuaaaagucauu

SEQ ID NO: 1574399 - RNA, 14 nt, Homo sapiens
uuuaaaauagcaaa

SEQ ID NO: 1574400 - RNA, 21 nt, Homo sapiens
uuuaaaaucauuucugcauca

SEQ ID NO: 1574401 - RNA, 22 nt, Homo sapiens
uuuaaaaugcucaauuucagca

SEQ ID NO: 1574402 - RNA, 15 nt, Homo sapiens
uuuaaaauucaauua

SEQ ID NO: 1574403 - RNA, 18 nt, Homo sapiens
uuuaaacuuguuugcugu

SEQ ID NO: 1574404 - RNA, 17 nt, Homo sapiens
uuuaaagaaagaaugca

SEQ ID NO: 1574405 - RNA, 19 nt, Homo sapiens
uuuaaagauaagucuacau

SEQ ID NO: 1574406 - RNA, 23 nt, Homo sapiens
uuuaaagccagucuuguucacau

SEQ ID NO: 1574407 - RNA, 21 nt, Homo sapiens
uuuaaagcuuauuaaaacuca

SEQ ID NO: 1574408 - RNA, 20 nt, Homo sapiens
uuuaaaggaaaaucacaucu

SEQ ID NO: 1574409 - RNA, 14 nt, Homo sapiens
uuuaaaguaugcau

SEQ ID NO: 1574410 - RNA, 18 nt, Homo sapiens
uuuaaaguggguuauucu

SEQ ID NO: 1574411 - RNA, 23 nt, Homo sapiens
uuuaaauacagucuuccauuugc

SEQ ID NO: 1574412 - RNA, 13 nt, Homo sapiens
uuuaaaugauuua

SEQ ID NO: 1574413 - RNA, 19 nt, Homo sapiens
uuuaaauuccacagauuau

SEQ ID NO: 1574414 - RNA, 14 nt, Homo sapiens
uuuaaccuaugaua

SEQ ID NO: 1574415 - RNA, 13 nt, Homo sapiens
uuuaaccuguaua

SEQ ID NO: 1574416 - RNA, 19 nt, Homo sapiens
uuuaacucuuugaaacugu

SEQ ID NO: 1574417 - RNA, 20 nt, Homo sapiens
uuuaacuuuaaggauuugaa

SEQ ID NO: 1574418 - RNA, 22 nt, Homo sapiens
uuuaagaggcuuuggcccaaug

SEQ ID NO: 1574419 - RNA, 17 nt, Homo sapiens
uuuaagauguacauuua

SEQ ID NO: 1574420 - RNA, 22 nt, Homo sapiens
uuuaagcaaauacuuagcaaaa

SEQ ID NO: 1574421 - RNA, 11 nt, Homo sapiens
uuuaaguccac

SEQ ID NO: 1574422 - RNA, 13 nt, Homo sapiens
uuuaagugaagga

SEQ ID NO: 1574423 - RNA, 21 nt, Homo sapiens
uuuaaguggcauuucuaugca

SEQ ID NO: 1574424 - RNA, 17 nt, Homo sapiens
uuuaaguugucaaagaa

SEQ ID NO: 1574425 - RNA, 19 nt, Homo sapiens
uuuaauaaaacugcgagga

SEQ ID NO: 1574426 - RNA, 16 nt, Homo sapiens
uuuaauaaauauucau

SEQ ID NO: 1574427 - RNA, 21 nt, Homo sapiens
uuuaauagggaauauaucucu

SEQ ID NO: 1574428 - RNA, 22 nt, Homo sapiens
uuuaaucauuauuugagacugu

SEQ ID NO: 1574429 - RNA, 23 nt, Homo sapiens
uuuaauggcaauaggacauugug

SEQ ID NO: 1574430 - RNA, 23 nt, Homo sapiens
uuuaauguuuucagcccaucucc

SEQ ID NO: 1574431 - RNA, 19 nt, Homo sapiens
uuuaauuaaaaacuuuaaa

SEQ ID NO: 1574432 - RNA, 14 nt, Homo sapiens
uuuaauuaugccuu

SEQ ID NO: 1574433 - RNA, 15 nt, Homo sapiens
uuuaauuaugccuuu

SEQ ID NO: 1574434 - RNA, 20 nt, Homo sapiens
uuuaauuuuuuaaacuguag

SEQ ID NO: 1574435 - RNA, 20 nt, Homo sapiens
uuuacaaaacuacaugagaa

SEQ ID NO: 1574436 - RNA, 13 nt, Homo sapiens
uuuacacacauga

SEQ ID NO: 1574437 - RNA, 23 nt, Homo sapiens
uuuacagaaucaaaugcaauuuu

SEQ ID NO: 1574438 - RNA, 13 nt, Homo sapiens
uuuacagacacac

SEQ ID NO: 1574439 - RNA, 14 nt, Homo sapiens
uuuacaugaguuca

SEQ ID NO: 1574440 - RNA, 13 nt, Homo sapiens
uuuacaugugauu

SEQ ID NO: 1574441 - RNA, 11 nt, Homo sapiens
uuuacauuuca

SEQ ID NO: 1574442 - RNA, 16 nt, Homo sapiens
uuuacauuucauacaa

SEQ ID NO: 1574443 - RNA, 20 nt, Homo sapiens
uuuacccuauacauccacag

SEQ ID NO: 1574444 - RNA, 18 nt, Homo sapiens
uuuaccuucaaacuuuag

SEQ ID NO: 1574445 - RNA, 15 nt, Homo sapiens
uuuaccuuugcccua

SEQ ID NO: 1574446 - RNA, 19 nt, Homo sapiens
uuuacguggcaaaaugaac

SEQ ID NO: 1574447 - RNA, 22 nt, Homo sapiens
uuuacucagaggagcugcaaau

SEQ ID NO: 1574448 - RNA, 17 nt, Homo sapiens
uuuacuuuuaaacugug

SEQ ID NO: 1574449 - RNA, 16 nt, Homo sapiens
uuuacuuuucugccaa

SEQ ID NO: 1574450 - RNA, 15 nt, Homo sapiens
uuuagaaaaagucaa

SEQ ID NO: 1574451 - RNA, 20 nt, Homo sapiens
uuuagaacagagggaccaaa

SEQ ID NO: 1574452 - RNA, 18 nt, Homo sapiens
uuuagacccugcauuuau

SEQ ID NO: 1574453 - RNA, 20 nt, Homo sapiens
uuuagaugguuacacuguua

SEQ ID NO: 1574454 - RNA, 18 nt, Homo sapiens
uuuagccuaggaguaaga

SEQ ID NO: 1574455 - RNA, 16 nt, Homo sapiens
uuuagcuauuacugga

SEQ ID NO: 1574456 - RNA, 19 nt, Homo sapiens
uuuaggaaaugggcaguga

SEQ ID NO: 1574457 - RNA, 15 nt, Homo sapiens
uuuaggauccaugca

SEQ ID NO: 1574458 - RNA, 15 nt, Homo sapiens
uuuaguaaauaaaca

SEQ ID NO: 1574459 - RNA, 23 nt, Homo sapiens
uuuaguacuuguucccucuguug

SEQ ID NO: 1574460 - RNA, 17 nt, Homo sapiens
uuuagugcuuugugaua

SEQ ID NO: 1574461 - RNA, 13 nt, Homo sapiens
uuuaguuauauuc

SEQ ID NO: 1574462 - RNA, 11 nt, Homo sapiens
uuuaguucucc

SEQ ID NO: 1574463 - RNA, 19 nt, Homo sapiens
uuuaguuugaucagacagc

SEQ ID NO: 1574464 - RNA, 17 nt, Homo sapiens
uuuauaggcauaccucc

SEQ ID NO: 1574465 - RNA, 20 nt, Homo sapiens
uuuauagucgaacaauucau

SEQ ID NO: 1574466 - RNA, 17 nt, Homo sapiens
uuuauauguacaugaga

SEQ ID NO: 1574467 - RNA, 19 nt, Homo sapiens
uuuaucaggcuuucucugg

SEQ ID NO: 1574468 - RNA, 17 nt, Homo sapiens
uuuaucaugaagcacau

SEQ ID NO: 1574469 - RNA, 20 nt, Homo sapiens
uuuaucuaaauuacagugca

SEQ ID NO: 1574470 - RNA, 22 nt, Homo sapiens
uuuaucucacaaauaaguaaua

SEQ ID NO: 1574471 - RNA, 12 nt, Homo sapiens
uuuaugguucuc

SEQ ID NO: 1574472 - RNA, 16 nt, Homo sapiens
uuuauguaugcauuga

SEQ ID NO: 1574473 - RNA, 22 nt, Homo sapiens
uuuauguguuaugaacauccaa

SEQ ID NO: 1574474 - RNA, 15 nt, Homo sapiens
uuuauuauacaccuu

SEQ ID NO: 1574475 - RNA, 18 nt, Homo sapiens
uuuauucaagaaugccag

SEQ ID NO: 1574476 - RNA, 14 nt, Homo sapiens
uuuauuccuuugaa

SEQ ID NO: 1574477 - RNA, 17 nt, Homo sapiens
uuuauuguuuucaacuc

SEQ ID NO: 1574478 - RNA, 15 nt, Homo sapiens
uuuauuuacacuccu

SEQ ID NO: 1574479 - RNA, 18 nt, Homo sapiens
uuuauuuacacucuugau

SEQ ID NO: 1574480 - RNA, 20 nt, Homo sapiens
uuuauuuaguuuuuaacaau

SEQ ID NO: 1574481 - RNA, 15 nt, Homo sapiens
uuuauuucaauguaa

SEQ ID NO: 1574482 - RNA, 13 nt, Homo sapiens
uuuauuucucggg

SEQ ID NO: 1574483 - RNA, 16 nt, Homo sapiens
uuuauuucugaucuau

SEQ ID NO: 1574484 - RNA, 16 nt, Homo sapiens
uuucaaaacaauccuu

SEQ ID NO: 1574485 - RNA, 16 nt, Homo sapiens
uuucaaaaugcuucaa

SEQ ID NO: 1574486 - RNA, 21 nt, Homo sapiens
uuucaaaccagcuucaugugg

SEQ ID NO: 1574487 - RNA, 14 nt, Homo sapiens
aaaaaacugaugaa

SEQ ID NO: 1574488 - RNA, 13 nt, Homo sapiens
aaaaaacugggau

SEQ ID NO: 1574489 - RNA, 23 nt, Homo sapiens
aaaaaagcaaauuucaugcacug

SEQ ID NO: 1574490 - RNA, 21 nt, Homo sapiens
aaaaacaggcagguacaggua

SEQ ID NO: 1574491 - RNA, 18 nt, Homo sapiens
aaaaacuaaugugucuca

SEQ ID NO: 1574492 - RNA, 16 nt, Homo sapiens
aaaaagaacaauauaa

SEQ ID NO: 1574493 - RNA, 17 nt, Homo sapiens
aaaaagaagcaaccuca

SEQ ID NO: 1574494 - RNA, 20 nt, Homo sapiens
aaaaagagaucgagucacaa

SEQ ID NO: 1574495 - RNA, 13 nt, Homo sapiens
aaaaagcauacuu

SEQ ID NO: 1574496 - RNA, 16 nt, Homo sapiens
aaaaagccacaaugaa

SEQ ID NO: 1574497 - RNA, 15 nt, Homo sapiens
aaaaaggaauacauu

SEQ ID NO: 1574498 - RNA, 23 nt, Homo sapiens
aaaaaggagccuuuugcucucug

SEQ ID NO: 1574499 - RNA, 14 nt, Homo sapiens
aaaaagguccugua

SEQ ID NO: 1574500 - RNA, 21 nt, Homo sapiens
aaaaagucaccaaauagugug

SEQ ID NO: 1574501 - RNA, 15 nt, Homo sapiens
aaaaauaaauuugca

SEQ ID NO: 1574502 - RNA, 15 nt, Homo sapiens
aaaaauacaacacug

SEQ ID NO: 1574503 - RNA, 11 nt, Homo sapiens
aaaaauacuuu

SEQ ID NO: 1574504 - RNA, 20 nt, Homo sapiens
aaaaauauuuauucauuauu

SEQ ID NO: 1574505 - RNA, 17 nt, Homo sapiens
aaaaaucauaguacucu

SEQ ID NO: 1574506 - RNA, 17 nt, Homo sapiens
aaaaaugaaauccagug

SEQ ID NO: 1574507 - RNA, 21 nt, Homo sapiens
aaaaaugagcauacaucuuaa

SEQ ID NO: 1574508 - RNA, 22 nt, Homo sapiens
aaaaaugcacaccucaugaguc

SEQ ID NO: 1574509 - RNA, 20 nt, Homo sapiens
aaaaauguauaugcacuuau

SEQ ID NO: 1574510 - RNA, 21 nt, Homo sapiens
aaaaauguaugccacaucuca

SEQ ID NO: 1574511 - RNA, 12 nt, Homo sapiens
aaaaauguucuu

SEQ ID NO: 1574512 - RNA, 17 nt, Homo sapiens
aaaaauuaaacuaaaga

SEQ ID NO: 1574513 - RNA, 23 nt, Homo sapiens
aaaaauucuagauuaccaugaag

SEQ ID NO: 1574514 - RNA, 21 nt, Homo sapiens
aaaaauuuugugacauuccuu

SEQ ID NO: 1574515 - RNA, 14 nt, Homo sapiens
aaaacaauacauca

SEQ ID NO: 1574516 - RNA, 15 nt, Homo sapiens
aaaacacaccaauca

SEQ ID NO: 1574517 - RNA, 18 nt, Homo sapiens
aaaacacugcccucuugu

SEQ ID NO: 1574518 - RNA, 13 nt, Homo sapiens
aaaacacugugca

SEQ ID NO: 1574519 - RNA, 14 nt, Homo sapiens
aaaacacugugcac

SEQ ID NO: 1574520 - RNA, 11 nt, Homo sapiens
aaaacauaucu

SEQ ID NO: 1574521 - RNA, 10 nt, Homo sapiens
aaaacauuuu

SEQ ID NO: 1574522 - RNA, 18 nt, Homo sapiens
aaaaccacauagaacuga

SEQ ID NO: 1574523 - RNA, 18 nt, Homo sapiens
aaaaccagaacaguauga

SEQ ID NO: 1574524 - RNA, 22 nt, Homo sapiens
aaaaccagaacaguaugaauuu

SEQ ID NO: 1574525 - RNA, 13 nt, Homo sapiens
aaaacccagagag

SEQ ID NO: 1574526 - RNA, 15 nt, Homo sapiens
aaaacuaaccaucug

SEQ ID NO: 1574527 - RNA, 14 nt, Homo sapiens
aaaacucacuguga

SEQ ID NO: 1574528 - RNA, 15 nt, Homo sapiens
aaaacucacugugau

SEQ ID NO: 1574529 - RNA, 19 nt, Homo sapiens
aaaacucagccugggacag

SEQ ID NO: 1574530 - RNA, 14 nt, Homo sapiens
aaaacuccgucuca

SEQ ID NO: 1574531 - RNA, 14 nt, Homo sapiens
aaaacuuaacuauc

SEQ ID NO: 1574532 - RNA, 19 nt, Homo sapiens
aaaacuugaucacaugcuu

SEQ ID NO: 1574533 - RNA, 15 nt, Homo sapiens
aaaagaaaugcacua

SEQ ID NO: 1574534 - RNA, 16 nt, Homo sapiens
aaaagaacaugcaguu

SEQ ID NO: 1574535 - RNA, 16 nt, Homo sapiens
aaaagaagcaaccuca

SEQ ID NO: 1574536 - RNA, 13 nt, Homo sapiens
aaaagaccuauga

SEQ ID NO: 1574537 - RNA, 14 nt, Homo sapiens
aaaagacugaccaa

SEQ ID NO: 1574538 - RNA, 16 nt, Homo sapiens
aaaagauacugaugca

SEQ ID NO: 1574539 - RNA, 14 nt, Homo sapiens
aaaagcaauacugu

SEQ ID NO: 1574540 - RNA, 23 nt, Homo sapiens
aaaagcauuauccuuuuaucuca

SEQ ID NO: 1574541 - RNA, 15 nt, Homo sapiens
aaaagccacaaugaa

SEQ ID NO: 1574542 - RNA, 17 nt, Homo sapiens
aaaagcccgcuugcucg

SEQ ID NO: 1574543 - RNA, 20 nt, Homo sapiens
aaaagcgacccauucagaga

SEQ ID NO: 1574544 - RNA, 23 nt, Homo sapiens
aaaagcgcguuguguauauuaca

SEQ ID NO: 1574545 - RNA, 18 nt, Homo sapiens
aaaagcuucagggaacaa

SEQ ID NO: 1574546 - RNA, 10 nt, Homo sapiens
aaaagcuuuc

SEQ ID NO: 1574547 - RNA, 20 nt, Homo sapiens
aaaaggacucucaggaccaa

SEQ ID NO: 1574548 - RNA, 18 nt, Homo sapiens
aaaaggccaauauaccua

SEQ ID NO: 1574549 - RNA, 16 nt, Homo sapiens
aaaagggaacugaaca

SEQ ID NO: 1574550 - RNA, 22 nt, Homo sapiens
aaaaguaaugaagaaaauugag

SEQ ID NO: 1574551 - RNA, 14 nt, Homo sapiens
aaaaguaaugacuu

SEQ ID NO: 1574552 - RNA, 17 nt, Homo sapiens
aaaaguccacaagaaca

SEQ ID NO: 1574553 - RNA, 13 nt, Homo sapiens
aaaagugaaucuu

SEQ ID NO: 1574554 - RNA, 22 nt, Homo sapiens
aaaaguucaaccucuuacaaua

SEQ ID NO: 1574555 - RNA, 21 nt, Homo sapiens
aaaaguucccucucacuuuca

SEQ ID NO: 1574556 - RNA, 21 nt, Homo sapiens
aaaaguugaaccauuauacuu

SEQ ID NO: 1574557 - RNA, 15 nt, Homo sapiens
aaaauaaagugucau

SEQ ID NO: 1574558 - RNA, 22 nt, Homo sapiens
aaaauaaauauaucuaccccag

SEQ ID NO: 1574559 - RNA, 13 nt, Homo sapiens
aaaauaaauuaca

SEQ ID NO: 1574560 - RNA, 14 nt, Homo sapiens
aaaauaaauuugca

SEQ ID NO: 1574561 - RNA, 13 nt, Homo sapiens
aaaauaacauaau

SEQ ID NO: 1574562 - RNA, 21 nt, Homo sapiens
aaaauaaccaugaauacacuu

SEQ ID NO: 1574563 - RNA, 12 nt, Homo sapiens
aaaauaaucuau

SEQ ID NO: 1574564 - RNA, 17 nt, Homo sapiens
aaaauacauagcauuaa

SEQ ID NO: 1574565 - RNA, 13 nt, Homo sapiens
aaaauaccuucua

SEQ ID NO: 1574566 - RNA, 20 nt, Homo sapiens
aaaauagcuaaauaccucaa

SEQ ID NO: 1574567 - RNA, 16 nt, Homo sapiens
aaaauaguaaagccaa

SEQ ID NO: 1574568 - RNA, 19 nt, Homo sapiens
aaaauaguacacacauaua

SEQ ID NO: 1574569 - RNA, 22 nt, Homo sapiens
aaaauaguguaagaacuguaca

SEQ ID NO: 1574570 - RNA, 18 nt, Homo sapiens
aaaauaguuaagacauga

SEQ ID NO: 1574571 - RNA, 14 nt, Homo sapiens
aaaauaguuuagau

SEQ ID NO: 1574572 - RNA, 20 nt, Homo sapiens
aaaauauauaauauacuaaa

SEQ ID NO: 1574573 - RNA, 14 nt, Homo sapiens
aaaauauauauuaa

SEQ ID NO: 1574574 - RNA, 22 nt, Homo sapiens
aaaauauuaagacaauagcacu

SEQ ID NO: 1574575 - RNA, 17 nt, Homo sapiens
aaaaucauucuacugaa

SEQ ID NO: 1574576 - RNA, 13 nt, Homo sapiens
aaaaucauuugag

SEQ ID NO: 1574577 - RNA, 20 nt, Homo sapiens
aaaauccaaggcaauuccug

SEQ ID NO: 1574578 - RNA, 14 nt, Homo sapiens
aaaaucuaccaaga

SEQ ID NO: 1574579 - RNA, 15 nt, Homo sapiens
aaaaucuaccaagaa

SEQ ID NO: 1574580 - RNA, 17 nt, Homo sapiens
aaaaucuauaacauaaa

SEQ ID NO: 1574581 - RNA, 13 nt, Homo sapiens
aaaaucuccaucu

SEQ ID NO: 1574582 - RNA, 15 nt, Homo sapiens
aaaaucuccaucuca

SEQ ID NO: 1574583 - RNA, 21 nt, Homo sapiens
aaaaucucccagugacaacau

SEQ ID NO: 1574584 - RNA, 21 nt, Homo sapiens
aaaaucucuacugcuuuggau

SEQ ID NO: 1574585 - RNA, 18 nt, Homo sapiens
aaaaugaaacaacaaaac

SEQ ID NO: 1574586 - RNA, 20 nt, Homo sapiens
aaaaugaagcugacaauuua

SEQ ID NO: 1574587 - RNA, 23 nt, Homo sapiens
aaaaugaaugaggucugggcuag

SEQ ID NO: 1574588 - RNA, 23 nt, Homo sapiens
aaaaugacaaaugacgucuucac

SEQ ID NO: 1574589 - RNA, 11 nt, Homo sapiens
aaaaugcaaua

SEQ ID NO: 1574590 - RNA, 20 nt, Homo sapiens
aaaaugcaauguaagcauac

SEQ ID NO: 1574591 - RNA, 17 nt, Homo sapiens
aaaaugcacccaucagc

SEQ ID NO: 1574592 - RNA, 13 nt, Homo sapiens
aaaaugccaugaa

SEQ ID NO: 1574593 - RNA, 18 nt, Homo sapiens
aaaaugcuugggaccaga

SEQ ID NO: 1574594 - RNA, 13 nt, Homo sapiens
aaaaugcuuuaaa

SEQ ID NO: 1574595 - RNA, 19 nt, Homo sapiens
aaaauggcacuugggggac

SEQ ID NO: 1574596 - RNA, 18 nt, Homo sapiens
aaaauggcuugucuuugc

SEQ ID NO: 1574597 - RNA, 11 nt, Homo sapiens
aaaaugggaug

SEQ ID NO: 1574598 - RNA, 14 nt, Homo sapiens
aaaauggucaucca

SEQ ID NO: 1574599 - RNA, 22 nt, Homo sapiens
aaaauggucauccaaacucaaa

SEQ ID NO: 1574600 - RNA, 14 nt, Homo sapiens
aaaauguaugucug

SEQ ID NO: 1574601 - RNA, 22 nt, Homo sapiens
aaaaugucacuauaucuuccca

SEQ ID NO: 1574602 - RNA, 21 nt, Homo sapiens
aaaaugucaguguuugggaaa

SEQ ID NO: 1574603 - RNA, 19 nt, Homo sapiens
aaaaugugaacauggaaac

SEQ ID NO: 1574604 - RNA, 19 nt, Homo sapiens
aaaaugugcuauacugcau

SEQ ID NO: 1574605 - RNA, 20 nt, Homo sapiens
aagucugcauuucauauuau

SEQ ID NO: 1574606 - RNA, 14 nt, Homo sapiens
aagucugucuugcc

SEQ ID NO: 1574607 - RNA, 14 nt, Homo sapiens
aagugaacuuuguu

SEQ ID NO: 1574608 - RNA, 23 nt, Homo sapiens
aagugaauguuuaccaugaagau

SEQ ID NO: 1574609 - RNA, 22 nt, Homo sapiens
aagugacaagggcacaagcuca

SEQ ID NO: 1574610 - RNA, 14 nt, Homo sapiens
aagugagacccaaa

SEQ ID NO: 1574611 - RNA, 17 nt, Homo sapiens
aagugagacccaaagga

SEQ ID NO: 1574612 - RNA, 13 nt, Homo sapiens
aagugcacuuuaa

SEQ ID NO: 1574613 - RNA, 16 nt, Homo sapiens
aagugccauaaccaug

SEQ ID NO: 1574614 - RNA, 14 nt, Homo sapiens
aagugcucacguua

SEQ ID NO: 1574615 - RNA, 16 nt, Homo sapiens
aagugcugcacucaaa

SEQ ID NO: 1574616 - RNA, 23 nt, Homo sapiens
aagugcugggauuacagguguga

SEQ ID NO: 1574617 - RNA, 19 nt, Homo sapiens
aagugcuucacagguuuua

SEQ ID NO: 1574618 - RNA, 22 nt, Homo sapiens
aagugggaucugucacaccagc

SEQ ID NO: 1574619 - RNA, 13 nt, Homo sapiens
aagugguacuuga

SEQ ID NO: 1574620 - RNA, 12 nt, Homo sapiens
aagugucuuugu

SEQ ID NO: 1574621 - RNA, 23 nt, Homo sapiens
aagugugugccaccaugccucac

SEQ ID NO: 1574622 - RNA, 20 nt, Homo sapiens
aaguguucugauuccuucaa

SEQ ID NO: 1574623 - RNA, 21 nt, Homo sapiens
aaguuacagccauaugcagga

SEQ ID NO: 1574624 - RNA, 14 nt, Homo sapiens
aaguuacauuguua

SEQ ID NO: 1574625 - RNA, 17 nt, Homo sapiens
aaguuagaaaacauaau

SEQ ID NO: 1574626 - RNA, 20 nt, Homo sapiens
aaguucaugcagcuguggca

SEQ ID NO: 1574627 - RNA, 21 nt, Homo sapiens
aaguucuuaaaaaauuuauac

SEQ ID NO: 1574628 - RNA, 19 nt, Homo sapiens
aaguucuuucaaccuauac

SEQ ID NO: 1574629 - RNA, 12 nt, Homo sapiens
aaguugacuuau

SEQ ID NO: 1574630 - RNA, 15 nt, Homo sapiens
aaguugugacaguca

SEQ ID NO: 1574631 - RNA, 23 nt, Homo sapiens
aaguuucccuucucccaguccaa

SEQ ID NO: 1574632 - RNA, 17 nt, Homo sapiens
aaacugaaagcuuuaau

SEQ ID NO: 1574633 - RNA, 23 nt, Homo sapiens
aaacugcuuaugaaaaguacuaa

SEQ ID NO: 1574634 - RNA, 16 nt, Homo sapiens
aaacuggagaugcauc

SEQ ID NO: 1574635 - RNA, 21 nt, Homo sapiens
aaacugggucuucagcuuuau

SEQ ID NO: 1574636 - RNA, 12 nt, Homo sapiens
aaacuucaccua

SEQ ID NO: 1574637 - RNA, 23 nt, Homo sapiens
aaacuucaccuacauuaucucac

SEQ ID NO: 1574638 - RNA, 22 nt, Homo sapiens
aaacuucaugguuugcauuuaa

SEQ ID NO: 1574639 - RNA, 18 nt, Homo sapiens
aaacuuggauacuuggau

SEQ ID NO: 1574640 - RNA, 19 nt, Homo sapiens
aaacuugugagguguuugc

SEQ ID NO: 1574641 - RNA, 23 nt, Homo sapiens
aaacuuuaggcccugccccagau

SEQ ID NO: 1574642 - RNA, 18 nt, Homo sapiens
aaacuuuaugcuaaguga

SEQ ID NO: 1574643 - RNA, 18 nt, Homo sapiens
aaacuuucuguaguaaaa

SEQ ID NO: 1574644 - RNA, 19 nt, Homo sapiens
aaacuuuggguacuuauac

SEQ ID NO: 1574645 - RNA, 16 nt, Homo sapiens
aaagaaaagaaaaaga

SEQ ID NO: 1574646 - RNA, 19 nt, Homo sapiens
aaagaaaauaaauuacaau

SEQ ID NO: 1574647 - RNA, 15 nt, Homo sapiens
aaagaaagaauaugu

SEQ ID NO: 1574648 - RNA, 16 nt, Homo sapiens
aaagaaauaauacaaa

SEQ ID NO: 1574649 - RNA, 21 nt, Homo sapiens
aaagaacgcgacuuccacaaa

SEQ ID NO: 1574650 - RNA, 18 nt, Homo sapiens
aaagaacugaaagcacua

SEQ ID NO: 1574651 - RNA, 23 nt, Homo sapiens
aaagaagagaugagaaaugauga

SEQ ID NO: 1574652 - RNA, 17 nt, Homo sapiens
aaagaagcuuccacaaa

SEQ ID NO: 1574653 - RNA, 20 nt, Homo sapiens
aaagaaguacuuuauugcaa

SEQ ID NO: 1574654 - RNA, 14 nt, Homo sapiens
aaagaagucuugga

SEQ ID NO: 1574655 - RNA, 13 nt, Homo sapiens
aaagaauguuacu

SEQ ID NO: 1574656 - RNA, 15 nt, Homo sapiens
aaagaauguuuggca

SEQ ID NO: 1574657 - RNA, 12 nt, Homo sapiens
aaagaauuacag

SEQ ID NO: 1574658 - RNA, 16 nt, Homo sapiens
aaagacagaagcuuaa

SEQ ID NO: 1574659 - RNA, 16 nt, Homo sapiens
aaagacagucaaagga

SEQ ID NO: 1574660 - RNA, 23 nt, Homo sapiens
aaagacauuuauauggguuuauu

SEQ ID NO: 1574661 - RNA, 14 nt, Homo sapiens
aaagaccuaugagc

SEQ ID NO: 1574662 - RNA, 23 nt, Homo sapiens
aaagacugaaucuaccugcccua

SEQ ID NO: 1574663 - RNA, 16 nt, Homo sapiens
aagagucugucucaaa

SEQ ID NO: 1574664 - RNA, 17 nt, Homo sapiens
aagauacagaacucuuu

SEQ ID NO: 1574665 - RNA, 15 nt, Homo sapiens
aagauagcagggcau

SEQ ID NO: 1574666 - RNA, 20 nt, Homo sapiens
aagauaguuacaaaauacaa

SEQ ID NO: 1574667 - RNA, 15 nt, Homo sapiens
aagaucaggcacaga

SEQ ID NO: 1574668 - RNA, 13 nt, Homo sapiens
aagaucuugcaga

SEQ ID NO: 1574669 - RNA, 16 nt, Homo sapiens
aagaugcgcauucuaa

SEQ ID NO: 1574670 - RNA, 20 nt, Homo sapiens
aagauggcacuuauaaccaa

SEQ ID NO: 1574671 - RNA, 21 nt, Homo sapiens
aagauggcauaaccugucuca

SEQ ID NO: 1574672 - RNA, 22 nt, Homo sapiens
aagaugggagguggaagcagag

SEQ ID NO: 1574673 - RNA, 15 nt, Homo sapiens
aagauuaauguagga

SEQ ID NO: 1574674 - RNA, 16 nt, Homo sapiens
aagauuaauguaggau

SEQ ID NO: 1574675 - RNA, 22 nt, Homo sapiens
aagauuacccugagcugcagcu

SEQ ID NO: 1574676 - RNA, 20 nt, Homo sapiens
aagauuauuuacugacauau

SEQ ID NO: 1574677 - RNA, 18 nt, Homo sapiens
aagauuccaaaaagcaca

SEQ ID NO: 1574678 - RNA, 19 nt, Homo sapiens
aagauuccaaaaagcacau

SEQ ID NO: 1574679 - RNA, 14 nt, Homo sapiens
aagauucuguguca

SEQ ID NO: 1574680 - RNA, 20 nt, Homo sapiens
aagauucuuaaaaauugaau

SEQ ID NO: 1574681 - RNA, 18 nt, Homo sapiens
aagauucuugacuuauau

SEQ ID NO: 1574682 - RNA, 16 nt, Homo sapiens
aagauugagaagccau

SEQ ID NO: 1574683 - RNA, 17 nt, Homo sapiens
aagauugagaagccaug

SEQ ID NO: 1574684 - RNA, 20 nt, Homo sapiens
aagauuguccuuuucuccca

SEQ ID NO: 1574685 - RNA, 15 nt, Homo sapiens
aagauuuaugaugca

SEQ ID NO: 1574686 - RNA, 13 nt, Homo sapiens
aagauuugcccau

SEQ ID NO: 1574687 - RNA, 20 nt, Homo sapiens
aagauuuuaaaggaccucau

SEQ ID NO: 1574688 - RNA, 19 nt, Homo sapiens
aagauuuuguuugcaucug

SEQ ID NO: 1574689 - RNA, 14 nt, Homo sapiens
aagcaaaagcaagg

SEQ ID NO: 1574690 - RNA, 16 nt, Homo sapiens
aagcaaaaugugauau

SEQ ID NO: 1574691 - RNA, 14 nt, Homo sapiens
aagcaaagugccca

SEQ ID NO: 1574692 - RNA, 22 nt, Homo sapiens
aagcaaaugcuacauauaugca

SEQ ID NO: 1574693 - RNA, 18 nt, Homo sapiens
aagcaacagacucucaca

SEQ ID NO: 1574694 - RNA, 14 nt, Homo sapiens
aagcaacaggccau

SEQ ID NO: 1574695 - RNA, 18 nt, Homo sapiens
aagcaacccaaauguuca

SEQ ID NO: 1574696 - RNA, 15 nt, Homo sapiens
aagcaacuugcuucu

SEQ ID NO: 1574697 - RNA, 16 nt, Homo sapiens
aagcaagggacugagu

SEQ ID NO: 1574698 - RNA, 19 nt, Homo sapiens
aagcaaguguucacaacag

SEQ ID NO: 1574699 - RNA, 16 nt, Homo sapiens
aagcaaguuaaguguc

SEQ ID NO: 1574700 - RNA, 16 nt, Homo sapiens
aagcacaacucccuua

SEQ ID NO: 1574701 - RNA, 17 nt, Homo sapiens
aagcacaaguacuuuug

SEQ ID NO: 1574702 - RNA, 13 nt, Homo sapiens
aagcacagaauau

SEQ ID NO: 1574703 - RNA, 15 nt, Homo sapiens
aagcacauguauuga

SEQ ID NO: 1574704 - RNA, 21 nt, Homo sapiens
aagcacauucgggccauuucc

SEQ ID NO: 1574705 - RNA, 21 nt, Homo sapiens
aagcagaaaaucuaccaagaa

SEQ ID NO: 1574706 - RNA, 16 nt, Homo sapiens
aagcagaacagugauu

SEQ ID NO: 1574707 - RNA, 22 nt, Homo sapiens
aagcagagcggguaaagugcaa

SEQ ID NO: 1574708 - RNA, 23 nt, Homo sapiens
aagcagaggcuaauucaguguca

SEQ ID NO: 1574709 - RNA, 14 nt, Homo sapiens
aagcagaugaacua

SEQ ID NO: 1574710 - RNA, 13 nt, Homo sapiens
aagcagaugagga

SEQ ID NO: 1574711 - RNA, 12 nt, Homo sapiens
aagcagcacugu

SEQ ID NO: 1574712 - RNA, 19 nt, Homo sapiens
aagcagcuuuuuauucccu

SEQ ID NO: 1574713 - RNA, 16 nt, Homo sapiens
aagcagucaguuugca

SEQ ID NO: 1574714 - RNA, 17 nt, Homo sapiens
aagcaguuugaagccca

SEQ ID NO: 1574715 - RNA, 16 nt, Homo sapiens
aagcauagcuacaauu

SEQ ID NO: 1574716 - RNA, 17 nt, Homo sapiens
aagcauauauaacuauu

SEQ ID NO: 1574717 - RNA, 23 nt, Homo sapiens
aagcauccauuaauuaaugagac

SEQ ID NO: 1574718 - RNA, 19 nt, Homo sapiens
aagcauggugucaguuuug

SEQ ID NO: 1574719 - RNA, 16 nt, Homo sapiens
aagcauguagacugug

SEQ ID NO: 1574720 - RNA, 23 nt, Homo sapiens
aagcauuauccuuuuaucucaca

SEQ ID NO: 1574721 - RNA, 20 nt, Homo sapiens
aagcauuuuauaaaugauau

SEQ ID NO: 1574722 - RNA, 14 nt, Homo sapiens
aagcauuuuuccau

SEQ ID NO: 1574723 - RNA, 11 nt, Homo sapiens
aagccaaagaa

SEQ ID NO: 1574724 - RNA, 16 nt, Homo sapiens
aagccaaagaaaugaa

SEQ ID NO: 1574725 - RNA, 19 nt, Homo sapiens
aagccaaagagccucccac

SEQ ID NO: 1574726 - RNA, 17 nt, Homo sapiens
aagccaucauccuccau

SEQ ID NO: 1574727 - RNA, 14 nt, Homo sapiens
aagccaugaguucc

SEQ ID NO: 1574728 - RNA, 12 nt, Homo sapiens
aagccauuccaa

SEQ ID NO: 1574729 - RNA, 21 nt, Homo sapiens
aagcccaaguucaugcagcug

SEQ ID NO: 1574730 - RNA, 18 nt, Homo sapiens
aagcccaaucugcaagga

SEQ ID NO: 1574731 - RNA, 21 nt, Homo sapiens
aagcccaauuuugacccuggu

SEQ ID NO: 1574732 - RNA, 21 nt, Homo sapiens
aagcccaggagccucacuggg

SEQ ID NO: 1574733 - RNA, 14 nt, Homo sapiens
aagcccaguucauc

SEQ ID NO: 1574734 - RNA, 19 nt, Homo sapiens
aagcccauuuguguacaca

SEQ ID NO: 1574735 - RNA, 23 nt, Homo sapiens
aagcccugauguguccucaggga

SEQ ID NO: 1574736 - RNA, 20 nt, Homo sapiens
aagccuaagggauccugccu

SEQ ID NO: 1574737 - RNA, 14 nt, Homo sapiens
aagccucaugucca

SEQ ID NO: 1574738 - RNA, 20 nt, Homo sapiens
aagccuccccaguucuacug

SEQ ID NO: 1574739 - RNA, 16 nt, Homo sapiens
aagccugaaguggaau

SEQ ID NO: 1574740 - RNA, 13 nt, Homo sapiens
aagccugacuuca

SEQ ID NO: 1574741 - RNA, 20 nt, Homo sapiens
aagccuguguauaaaaaaga

SEQ ID NO: 1574742 - RNA, 16 nt, Homo sapiens
aagccuuccaguuuug

SEQ ID NO: 1574743 - RNA, 19 nt, Homo sapiens
aagccuucuaaaugaguca

SEQ ID NO: 1574744 - RNA, 22 nt, Homo sapiens
aagcgacccauucagagacugu

SEQ ID NO: 1574745 - RNA, 15 nt, Homo sapiens
aagcguuugcacaga

SEQ ID NO: 1574746 - RNA, 19 nt, Homo sapiens
aagcuaaugugcagggaua

SEQ ID NO: 1574747 - RNA, 13 nt, Homo sapiens
aagcuaggauggu

SEQ ID NO: 1574748 - RNA, 21 nt, Homo sapiens
aagcuaggguggcccuugcag

SEQ ID NO: 1574749 - RNA, 15 nt, Homo sapiens
aagcucagacuugcc

SEQ ID NO: 1574750 - RNA, 20 nt, Homo sapiens
aagcucagggcccaucccuu

SEQ ID NO: 1574751 - RNA, 13 nt, Homo sapiens
aagcucauuucau

SEQ ID NO: 1574752 - RNA, 21 nt, Homo sapiens
aagcucccagcuccuuucaug

SEQ ID NO: 1574753 - RNA, 20 nt, Homo sapiens
agcagagcuuccacaagaca

SEQ ID NO: 1574754 - RNA, 13 nt, Homo sapiens
agcagcacuguga

SEQ ID NO: 1574755 - RNA, 20 nt, Homo sapiens
agcagcccuggaugguggcc

SEQ ID NO: 1574756 - RNA, 18 nt, Homo sapiens
agcagccgccagcuggga

SEQ ID NO: 1574757 - RNA, 14 nt, Homo sapiens
agcaggacagacac

SEQ ID NO: 1574758 - RNA, 19 nt, Homo sapiens
agcaggacccaguggucag

SEQ ID NO: 1574759 - RNA, 22 nt, Homo sapiens
agcaggcagcuucuacuccugc

SEQ ID NO: 1574760 - RNA, 21 nt, Homo sapiens
agcaggccaaggucugagcca

SEQ ID NO: 1574761 - RNA, 14 nt, Homo sapiens
agcagggacuugaa

SEQ ID NO: 1574762 - RNA, 20 nt, Homo sapiens
agcagggaguuagcacugaa

SEQ ID NO: 1574763 - RNA, 19 nt, Homo sapiens
agcaggggcuccagcaccu

SEQ ID NO: 1574764 - RNA, 21 nt, Homo sapiens
agcaggugucuuuaacuguca

SEQ ID NO: 1574765 - RNA, 17 nt, Homo sapiens
agcagucagaguccagu

SEQ ID NO: 1574766 - RNA, 20 nt, Homo sapiens
agcagucagaguccagugcu

SEQ ID NO: 1574767 - RNA, 15 nt, Homo sapiens
agcagucgccugccu

SEQ ID NO: 1574768 - RNA, 21 nt, Homo sapiens
agcagugaaauaugauaauaa

SEQ ID NO: 1574769 - RNA, 15 nt, Homo sapiens
agcagugaaguauaa

SEQ ID NO: 1574770 - RNA, 20 nt, Homo sapiens
agcaguguguacuucuucau

SEQ ID NO: 1574771 - RNA, 20 nt, Homo sapiens
agcaguuaguuccuucauga

SEQ ID NO: 1574772 - RNA, 20 nt, Homo sapiens
agcaguucagcuccuuccac

SEQ ID NO: 1574773 - RNA, 18 nt, Homo sapiens
agcauaccaacacgagca

SEQ ID NO: 1574774 - RNA, 23 nt, Homo sapiens
agcauagggucacuuugccauua

SEQ ID NO: 1574775 - RNA, 13 nt, Homo sapiens
agcaucaagccac

SEQ ID NO: 1574776 - RNA, 14 nt, Homo sapiens
agcaucaagccacu

SEQ ID NO: 1574777 - RNA, 13 nt, Homo sapiens
agcaucaauacaa

SEQ ID NO: 1574778 - RNA, 19 nt, Homo sapiens
agcaucagauuuuaccuaa

SEQ ID NO: 1574779 - RNA, 12 nt, Homo sapiens
agcaucaucugu

SEQ ID NO: 1574780 - RNA, 15 nt, Homo sapiens
agcaucaucuguucg

SEQ ID NO: 1574781 - RNA, 13 nt, Homo sapiens
agcauccacugau

SEQ ID NO: 1574782 - RNA, 23 nt, Homo sapiens
agcauccccagccacaacugcca

SEQ ID NO: 1574783 - RNA, 19 nt, Homo sapiens
agcaucgggguggcccacu

SEQ ID NO: 1574784 - RNA, 16 nt, Homo sapiens
agcaucugacagguga

SEQ ID NO: 1574785 - RNA, 17 nt, Homo sapiens
agcaucugacaggugaa

SEQ ID NO: 1574786 - RNA, 16 nt, Homo sapiens
agcaucuggcucuaau

SEQ ID NO: 1574787 - RNA, 17 nt, Homo sapiens
agcaugcuauggcauuu

SEQ ID NO: 1574788 - RNA, 15 nt, Homo sapiens
agcauggacauuuag

SEQ ID NO: 1574789 - RNA, 16 nt, Homo sapiens
agcauggucuuaugca

SEQ ID NO: 1574790 - RNA, 18 nt, Homo sapiens
agcauuacauuauuaaac

SEQ ID NO: 1574791 - RNA, 22 nt, Homo sapiens
agcauuauuuuuuguugaauag

SEQ ID NO: 1574792 - RNA, 23 nt, Homo sapiens
agcauuuagauaaucuugugcaa

SEQ ID NO: 1574793 - RNA, 17 nt, Homo sapiens
agcauuugaugauagca

SEQ ID NO: 1574794 - RNA, 13 nt, Homo sapiens
agccaaagagccu

SEQ ID NO: 1574795 - RNA, 15 nt, Homo sapiens
agccaaaugcaggga

SEQ ID NO: 1574796 - RNA, 17 nt, Homo sapiens
agccaagagugcacuac

SEQ ID NO: 1574797 - RNA, 21 nt, Homo sapiens
agccaagaucgccccacugca

SEQ ID NO: 1574798 - RNA, 19 nt, Homo sapiens
agccaagggaaaggggugc

SEQ ID NO: 1574799 - RNA, 13 nt, Homo sapiens
agccaagugcccu

SEQ ID NO: 1574800 - RNA, 15 nt, Homo sapiens
agccaagugcccucu

SEQ ID NO: 1574801 - RNA, 15 nt, Homo sapiens
agccacaaagaccca

SEQ ID NO: 1574802 - RNA, 14 nt, Homo sapiens
agccacaacugcca

SEQ ID NO: 1574803 - RNA, 19 nt, Homo sapiens
agccacaccuuuuccagga

SEQ ID NO: 1574804 - RNA, 16 nt, Homo sapiens
agccaccaguucucau

SEQ ID NO: 1574805 - RNA, 18 nt, Homo sapiens
agccaccaugcuugccug

SEQ ID NO: 1574806 - RNA, 18 nt, Homo sapiens
agccacccaagccugcug

SEQ ID NO: 1574807 - RNA, 13 nt, Homo sapiens
agccaccgugccc

SEQ ID NO: 1574808 - RNA, 14 nt, Homo sapiens
agccaccucaccaa

SEQ ID NO: 1574809 - RNA, 15 nt, Homo sapiens
agccacgucaaugca

SEQ ID NO: 1574810 - RNA, 17 nt, Homo sapiens
agccacuggcuuggaac

SEQ ID NO: 1574811 - RNA, 18 nt, Homo sapiens
agccagaggguagggcac

SEQ ID NO: 1574812 - RNA, 17 nt, Homo sapiens
agccagaggucuggccc

SEQ ID NO: 1574813 - RNA, 15 nt, Homo sapiens
agccagcugugcacu

SEQ ID NO: 1574814 - RNA, 23 nt, Homo sapiens
agccaggccugggggcagccucu

SEQ ID NO: 1574815 - RNA, 15 nt, Homo sapiens
agccagguaauguga

SEQ ID NO: 1574816 - RNA, 21 nt, Homo sapiens
agccaggugagaaaaccaugg

SEQ ID NO: 1574817 - RNA, 22 nt, Homo sapiens
agccaguuaauuuuaagaauuu

SEQ ID NO: 1574818 - RNA, 20 nt, Homo sapiens
agccauaagaaagcacuauu

SEQ ID NO: 1574819 - RNA, 22 nt, Homo sapiens
agccauacuuaucucucugugc

SEQ ID NO: 1574820 - RNA, 11 nt, Homo sapiens
agccauaugca

SEQ ID NO: 1574821 - RNA, 12 nt, Homo sapiens
agccauaugcag

SEQ ID NO: 1574822 - RNA, 16 nt, Homo sapiens
agccaucaagcacuuc

SEQ ID NO: 1574823 - RNA, 23 nt, Homo sapiens
agccaucccuuuuuuuacauuuc

SEQ ID NO: 1574824 - RNA, 15 nt, Homo sapiens
agccaucuaaugcuu

SEQ ID NO: 1574825 - RNA, 21 nt, Homo sapiens
agccaugccuaucaguaaaaa

SEQ ID NO: 1574826 - RNA, 17 nt, Homo sapiens
agccauuaaaugaauau

SEQ ID NO: 1574827 - RNA, 20 nt, Homo sapiens
agccauuuuucaaagcaauu

SEQ ID NO: 1574828 - RNA, 14 nt, Homo sapiens
agcccaaguucaug

SEQ ID NO: 1574829 - RNA, 15 nt, Homo sapiens
agcccaggagccuca

SEQ ID NO: 1574830 - RNA, 17 nt, Homo sapiens
agcccaggccacagcca

SEQ ID NO: 1574831 - RNA, 14 nt, Homo sapiens
agcccagugcugcc

SEQ ID NO: 1574832 - RNA, 16 nt, Homo sapiens
agcccauggcacucua

SEQ ID NO: 1574833 - RNA, 15 nt, Homo sapiens
agcccauucucaugu

SEQ ID NO: 1574834 - RNA, 17 nt, Homo sapiens
agccccagacucuucau

SEQ ID NO: 1574835 - RNA, 17 nt, Homo sapiens
agccccaggccagcugc

SEQ ID NO: 1574836 - RNA, 15 nt, Homo sapiens
agcccccacugcacc

SEQ ID NO: 1574837 - RNA, 14 nt, Homo sapiens
agccccgccuguca

SEQ ID NO: 1574838 - RNA, 12 nt, Homo sapiens
agccccgucucu

SEQ ID NO: 1574839 - RNA, 18 nt, Homo sapiens
agccccuccucccucaga

SEQ ID NO: 1574840 - RNA, 19 nt, Homo sapiens
agccccuccucccucagac

SEQ ID NO: 1574841 - RNA, 23 nt, Homo sapiens
agccccugcagauucugagcaaa

SEQ ID NO: 1574842 - RNA, 17 nt, Homo sapiens
agccccugggguggcca

SEQ ID NO: 1574843 - RNA, 13 nt, Homo sapiens
agcccgaggucau

SEQ ID NO: 1574844 - RNA, 15 nt, Homo sapiens
agcccucacauuaga

SEQ ID NO: 1574845 - RNA, 13 nt, Homo sapiens
agcccucaucccg

SEQ ID NO: 1574846 - RNA, 15 nt, Homo sapiens
agcccugaggugaaa

SEQ ID NO: 1574847 - RNA, 18 nt, Homo sapiens
agcccugauguguccuca

SEQ ID NO: 1574848 - RNA, 12 nt, Homo sapiens
agcccugcauuu

SEQ ID NO: 1574849 - RNA, 17 nt, Homo sapiens
agcccugcucccugccu

SEQ ID NO: 1574850 - RNA, 16 nt, Homo sapiens
agcccuggaaacauac

SEQ ID NO: 1574851 - RNA, 21 nt, Homo sapiens
agcccuggcucccaccuguuu

SEQ ID NO: 1574852 - RNA, 15 nt, Homo sapiens
agcccuggucucagc

SEQ ID NO: 1574853 - RNA, 14 nt, Homo sapiens
agcccugucugcua

SEQ ID NO: 1574854 - RNA, 20 nt, Homo sapiens
agcccuucaccaucuaccug

SEQ ID NO: 1574855 - RNA, 23 nt, Homo sapiens
agcccuugcacuccuacugaguu

SEQ ID NO: 1574856 - RNA, 19 nt, Homo sapiens
agccgaagggcaauaucua

SEQ ID NO: 1574857 - RNA, 19 nt, Homo sapiens
agccgagaucaugccauug

SEQ ID NO: 1574858 - RNA, 23 nt, Homo sapiens
agccgagauugcgccauugcacu

SEQ ID NO: 1574859 - RNA, 17 nt, Homo sapiens
agccgauaucagaauuu

SEQ ID NO: 1574860 - RNA, 15 nt, Homo sapiens
agccgccauugccac

SEQ ID NO: 1574861 - RNA, 17 nt, Homo sapiens
agccgcgggccaggagg

SEQ ID NO: 1574862 - RNA, 20 nt, Homo sapiens
agccggagaucugaggugcu

SEQ ID NO: 1574863 - RNA, 17 nt, Homo sapiens
agccgggagccugaccc

SEQ ID NO: 1574864 - RNA, 21 nt, Homo sapiens
agccgggcguguuggugugca

SEQ ID NO: 1574865 - RNA, 16 nt, Homo sapiens
agccuaagaaacacuc

SEQ ID NO: 1574866 - RNA, 22 nt, Homo sapiens
agccuaaugagagugcacugcu

SEQ ID NO: 1574867 - RNA, 23 nt, Homo sapiens
agccuaaugagagugcacugcuc

SEQ ID NO: 1574868 - RNA, 18 nt, Homo sapiens
agccuacagaagggcagu

SEQ ID NO: 1574869 - RNA, 21 nt, Homo sapiens
agccuacagaagggcagugac

SEQ ID NO: 1574870 - RNA, 16 nt, Homo sapiens
agccuauuuuuuuaga

SEQ ID NO: 1574871 - RNA, 21 nt, Homo sapiens
agccucacuggggcagacaau

SEQ ID NO: 1574872 - RNA, 21 nt, Homo sapiens
acuuuagcaacaguuaucaca

SEQ ID NO: 1574873 - RNA, 18 nt, Homo sapiens
acuuuaguagacauuuau

SEQ ID NO: 1574874 - RNA, 15 nt, Homo sapiens
acuuuauaucuguaa

SEQ ID NO: 1574875 - RNA, 22 nt, Homo sapiens
acuuuauguaguuuuuauaugu

SEQ ID NO: 1574876 - RNA, 16 nt, Homo sapiens
acuuucaagacagaug

SEQ ID NO: 1574877 - RNA, 16 nt, Homo sapiens
acuuucaauugucacu

SEQ ID NO: 1574878 - RNA, 14 nt, Homo sapiens
acuuucauaccacu

SEQ ID NO: 1574879 - RNA, 21 nt, Homo sapiens
acuuucauccugguuuccacu

SEQ ID NO: 1574880 - RNA, 17 nt, Homo sapiens
acuuucauuccuucaga

SEQ ID NO: 1574881 - RNA, 23 nt, Homo sapiens
acuuuccgagccuccaguccaaa

SEQ ID NO: 1574882 - RNA, 17 nt, Homo sapiens
acuuucucaguuuucau

SEQ ID NO: 1574883 - RNA, 14 nt, Homo sapiens
acuuucucugcaaa

SEQ ID NO: 1574884 - RNA, 17 nt, Homo sapiens
acuuucugucuagguua

SEQ ID NO: 1574885 - RNA, 20 nt, Homo sapiens
acuuucugucuagguuaaag

SEQ ID NO: 1574886 - RNA, 21 nt, Homo sapiens
acuuucuguguugaagcacug

SEQ ID NO: 1574887 - RNA, 18 nt, Homo sapiens
acuuucuucaaagccaca

SEQ ID NO: 1574888 - RNA, 22 nt, Homo sapiens
acuuucuucuagugcuuuucag

SEQ ID NO: 1574889 - RNA, 19 nt, Homo sapiens
acuuucuucucuuucccaa

SEQ ID NO: 1574890 - RNA, 13 nt, Homo sapiens
acuuugaccuaaa

SEQ ID NO: 1574891 - RNA, 18 nt, Homo sapiens
acuuugauaggaugugga

SEQ ID NO: 1574892 - RNA, 13 nt, Homo sapiens
acuuugugcauuc

SEQ ID NO: 1574893 - RNA, 22 nt, Homo sapiens
acuuuguuaaaugguuauccaa

SEQ ID NO: 1574894 - RNA, 18 nt, Homo sapiens
acuuuuaaaaugaagcuu

SEQ ID NO: 1574895 - RNA, 15 nt, Homo sapiens
acuuuucccauucag

SEQ ID NO: 1574896 - RNA, 17 nt, Homo sapiens
acuuuuggaaccaugcc

SEQ ID NO: 1574897 - RNA, 19 nt, Homo sapiens
agauuccuggcagagccau

SEQ ID NO: 1574898 - RNA, 16 nt, Homo sapiens
agauucuugacuuaua

SEQ ID NO: 1574899 - RNA, 19 nt, Homo sapiens
agauuggcucacacugaga

SEQ ID NO: 1574900 - RNA, 20 nt, Homo sapiens
agauuggcucacacugagaa

SEQ ID NO: 1574901 - RNA, 17 nt, Homo sapiens
agauugugguggugcua

SEQ ID NO: 1574902 - RNA, 14 nt, Homo sapiens
agauuuaacauaua

SEQ ID NO: 1574903 - RNA, 21 nt, Homo sapiens
agauuuaagugaauacauuaa

SEQ ID NO: 1574904 - RNA, 20 nt, Homo sapiens
agauuucuccucuuccugcc

SEQ ID NO: 1574905 - RNA, 17 nt, Homo sapiens
agauuugaugggccaca

SEQ ID NO: 1574906 - RNA, 13 nt, Homo sapiens
agauuugccuuau

SEQ ID NO: 1574907 - RNA, 18 nt, Homo sapiens
agauuuggcuugacaaag

SEQ ID NO: 1574908 - RNA, 17 nt, Homo sapiens
agauuugggugaacaaa

SEQ ID NO: 1574909 - RNA, 23 nt, Homo sapiens
agauuugugcaaacauggagaaa

SEQ ID NO: 1574910 - RNA, 22 nt, Homo sapiens
agauuuuaacuaauaaugcugg

SEQ ID NO: 1574911 - RNA, 15 nt, Homo sapiens
agauuuucuuuugcc

SEQ ID NO: 1574912 - RNA, 13 nt, Homo sapiens
agauuuuuagucu

SEQ ID NO: 1574913 - RNA, 23 nt, Homo sapiens
agauuuuuguuuuccacugugcu

SEQ ID NO: 1574914 - RNA, 18 nt, Homo sapiens
agauuuuuuagaucuucc

SEQ ID NO: 1574915 - RNA, 21 nt, Homo sapiens
agauuuuuuuuguaacuucaa

SEQ ID NO: 1574916 - RNA, 17 nt, Homo sapiens
agcaaaacuccgucuca

SEQ ID NO: 1574917 - RNA, 16 nt, Homo sapiens
agcaaaagaccaaauc

SEQ ID NO: 1574918 - RNA, 17 nt, Homo sapiens
agcaaaaguaaucacuu

SEQ ID NO: 1574919 - RNA, 20 nt, Homo sapiens
agcaaaauuaaauacauaaa

SEQ ID NO: 1574920 - RNA, 22 nt, Homo sapiens
agcaaacaaauaaaaugaaaua

SEQ ID NO: 1574921 - RNA, 16 nt, Homo sapiens
agcaaagggccaggca

SEQ ID NO: 1574922 - RNA, 21 nt, Homo sapiens
agcaaagugcccaugguggcg

SEQ ID NO: 1574923 - RNA, 19 nt, Homo sapiens
agcaaaguuaaggcuugau

SEQ ID NO: 1574924 - RNA, 18 nt, Homo sapiens
agcaaauaaagcagucau

SEQ ID NO: 1574925 - RNA, 19 nt, Homo sapiens
agcaaauaggcaaaagaca

SEQ ID NO: 1574926 - RNA, 15 nt, Homo sapiens
agcaaaucacgacca

SEQ ID NO: 1574927 - RNA, 16 nt, Homo sapiens
agcaaauuuucagcau

SEQ ID NO: 1574928 - RNA, 19 nt, Homo sapiens
agcaacaaaaucauggcuu

SEQ ID NO: 1574929 - RNA, 12 nt, Homo sapiens
agcaacaaugac

SEQ ID NO: 1574930 - RNA, 16 nt, Homo sapiens
agcaacagagcacuug

SEQ ID NO: 1574931 - RNA, 23 nt, Homo sapiens
agcaacagcgauggcagugagaa

SEQ ID NO: 1574932 - RNA, 15 nt, Homo sapiens
agcaacaggccauug

SEQ ID NO: 1574933 - RNA, 18 nt, Homo sapiens
agcaacaggccauuguga

SEQ ID NO: 1574934 - RNA, 15 nt, Homo sapiens
agcaacaguuaucac

SEQ ID NO: 1574935 - RNA, 20 nt, Homo sapiens
agcaacccuuccugcugcug

SEQ ID NO: 1574936 - RNA, 20 nt, Homo sapiens
agcaaccuauauaaaccugg

SEQ ID NO: 1574937 - RNA, 15 nt, Homo sapiens
agcaaccuuucccuu

SEQ ID NO: 1574938 - RNA, 22 nt, Homo sapiens
agcaacucagguuuuggcauua

SEQ ID NO: 1574939 - RNA, 16 nt, Homo sapiens
agcaacuguuuaaccu

SEQ ID NO: 1574940 - RNA, 20 nt, Homo sapiens
agcaacuguuuaaccuguuu

SEQ ID NO: 1574941 - RNA, 13 nt, Homo sapiens
agcaagacccugu

SEQ ID NO: 1574942 - RNA, 15 nt, Homo sapiens
agcaagccagaccua

SEQ ID NO: 1574943 - RNA, 18 nt, Homo sapiens
agcaagcucuucacugaa

SEQ ID NO: 1574944 - RNA, 18 nt, Homo sapiens
agcaagcugcccagcccu

SEQ ID NO: 1574945 - RNA, 13 nt, Homo sapiens
agcaaggcauaau

SEQ ID NO: 1574946 - RNA, 19 nt, Homo sapiens
agcaaggguuggaggcaau

SEQ ID NO: 1574947 - RNA, 20 nt, Homo sapiens
agcaaggguuggaggcaaug

SEQ ID NO: 1574948 - RNA, 20 nt, Homo sapiens
agcaaguauauuuauuucua

SEQ ID NO: 1574949 - RNA, 19 nt, Homo sapiens
agcaaguccucacucuuca

SEQ ID NO: 1574950 - RNA, 15 nt, Homo sapiens
agcaaguuagaacua

SEQ ID NO: 1574951 - RNA, 14 nt, Homo sapiens
agcaauacagggag

SEQ ID NO: 1574952 - RNA, 14 nt, Homo sapiens
agcaaucauuuuau

SEQ ID NO: 1574953 - RNA, 18 nt, Homo sapiens
agcaauugaaaugcauug

SEQ ID NO: 1574954 - RNA, 20 nt, Homo sapiens
agcaauuguauuacuuccuc

SEQ ID NO: 1574955 - RNA, 19 nt, Homo sapiens
agcacaaccuuuuccucac

SEQ ID NO: 1574956 - RNA, 22 nt, Homo sapiens
agcacaaccuuuuccucaccag

SEQ ID NO: 1574957 - RNA, 22 nt, Homo sapiens
agcacaagcaggugaacuggga

SEQ ID NO: 1574958 - RNA, 22 nt, Homo sapiens
agcacaauuaauuaaaagugaa

SEQ ID NO: 1574959 - RNA, 21 nt, Homo sapiens
agcacaccuacagagcaccug

SEQ ID NO: 1574960 - RNA, 14 nt, Homo sapiens
agcacaccuaucuu

SEQ ID NO: 1574961 - RNA, 13 nt, Homo sapiens
agcacacucuucu

SEQ ID NO: 1574962 - RNA, 19 nt, Homo sapiens
agcacagauuuugaaucug

SEQ ID NO: 1574963 - RNA, 18 nt, Homo sapiens
agcacagugccugacaca

SEQ ID NO: 1574964 - RNA, 22 nt, Homo sapiens
agcacauaugggaacuaugagg

SEQ ID NO: 1574965 - RNA, 17 nt, Homo sapiens
agcaccacacccagugg

SEQ ID NO: 1574966 - RNA, 19 nt, Homo sapiens
agcaccacacccaguggga

SEQ ID NO: 1574967 - RNA, 16 nt, Homo sapiens
agcaccaccauuuaau

SEQ ID NO: 1574968 - RNA, 15 nt, Homo sapiens
agcaccacccuaguc

SEQ ID NO: 1574969 - RNA, 14 nt, Homo sapiens
agcaccccuugccg

SEQ ID NO: 1574970 - RNA, 20 nt, Homo sapiens
agcacccugcccaccaagaa

SEQ ID NO: 1574971 - RNA, 16 nt, Homo sapiens
agcaccgcuuaucccc

SEQ ID NO: 1574972 - RNA, 19 nt, Homo sapiens
agcaccuacaguguacagu

SEQ ID NO: 1574973 - RNA, 18 nt, Homo sapiens
agcacgauuuugcacaaa

SEQ ID NO: 1574974 - RNA, 21 nt, Homo sapiens
agcacggacugucaguucucu

SEQ ID NO: 1574975 - RNA, 17 nt, Homo sapiens
agcacguguggccuguu

SEQ ID NO: 1574976 - RNA, 14 nt, Homo sapiens
agcacguugcccaa

SEQ ID NO: 1574977 - RNA, 13 nt, Homo sapiens
agcacuaaccaau

SEQ ID NO: 1574978 - RNA, 22 nt, Homo sapiens
agcacuacugggugucauuuca

SEQ ID NO: 1574979 - RNA, 20 nt, Homo sapiens
agcacuagaauauuuaaaac

SEQ ID NO: 1574980 - RNA, 15 nt, Homo sapiens
agcacuauuaauacu

SEQ ID NO: 1574981 - RNA, 19 nt, Homo sapiens
agcacuccgcaucaccuca

SEQ ID NO: 1574982 - RNA, 13 nt, Homo sapiens
agcacugacaaua

SEQ ID NO: 1574983 - RNA, 15 nt, Homo sapiens
agcacugccagugga

SEQ ID NO: 1574984 - RNA, 19 nt, Homo sapiens
agcacugggaaccuagcua

SEQ ID NO: 1574985 - RNA, 19 nt, Homo sapiens
agcacugggugaccagcug

SEQ ID NO: 1574986 - RNA, 19 nt, Homo sapiens
agcacuggugaacugagcu

SEQ ID NO: 1574987 - RNA, 20 nt, Homo sapiens
agcacuuagcaggcaccgcc

SEQ ID NO: 1574988 - RNA, 13 nt, Homo sapiens
agcacuugcucaa

SEQ ID NO: 1574989 - RNA, 17 nt, Homo sapiens
agcacuuucauugccag

SEQ ID NO: 1574990 - RNA, 15 nt, Homo sapiens
agcagacaccauuca

SEQ ID NO: 1574991 - RNA, 22 nt, Homo sapiens
agcagagcggguaaagugcaau

SEQ ID NO: 1574992 - RNA, 19 nt, Homo sapiens
acugcucguggacugugcu

SEQ ID NO: 1574993 - RNA, 19 nt, Homo sapiens
acugcugcaaauacuguau

SEQ ID NO: 1574994 - RNA, 13 nt, Homo sapiens
acugcugcugcug

SEQ ID NO: 1574995 - RNA, 16 nt, Homo sapiens
acugcugggcuuggca

SEQ ID NO: 1574996 - RNA, 17 nt, Homo sapiens
acugcugggcuuggcag

SEQ ID NO: 1574997 - RNA, 13 nt, Homo sapiens
acugcuguagaca

SEQ ID NO: 1574998 - RNA, 19 nt, Homo sapiens
acuggaaauguagcacuua

SEQ ID NO: 1574999 - RNA, 22 nt, Homo sapiens
acuggaaccccagcuucccucc

SEQ ID NO: 1575000 - RNA, 23 nt, Homo sapiens
acuggaauauaauuucaaaccac

SEQ ID NO: 1575001 - RNA, 22 nt, Homo sapiens
acuggacaaagaauuccaaagc

SEQ ID NO: 1575002 - RNA, 22 nt, Homo sapiens
acuggagaggcuagaaccaaga

SEQ ID NO: 1575003 - RNA, 15 nt, Homo sapiens
acuggauagaaccac

SEQ ID NO: 1575004 - RNA, 12 nt, Homo sapiens
acuggauccugc

SEQ ID NO: 1575005 - RNA, 12 nt, Homo sapiens
acuggccugcac

SEQ ID NO: 1575006 - RNA, 17 nt, Homo sapiens
acuggcugucaguauga

SEQ ID NO: 1575007 - RNA, 21 nt, Homo sapiens
acugggaaacuggguuucuca

SEQ ID NO: 1575008 - RNA, 23 nt, Homo sapiens
acugggacccccaacauucugcc

SEQ ID NO: 1575009 - RNA, 21 nt, Homo sapiens
acugggagagcugguggugca

SEQ ID NO: 1575010 - RNA, 18 nt, Homo sapiens
acugggaggcagggcucu

SEQ ID NO: 1575011 - RNA, 18 nt, Homo sapiens
acugggcccgagccugaa

SEQ ID NO: 1575012 - RNA, 14 nt, Homo sapiens
acugggcucaagag

SEQ ID NO: 1575013 - RNA, 23 nt, Homo sapiens
acuggggaggaauccuggaccaa

SEQ ID NO: 1575014 - RNA, 22 nt, Homo sapiens
acugguauguguggaugaugcu

SEQ ID NO: 1575015 - RNA, 17 nt, Homo sapiens
acuggugcacuuuguaa

SEQ ID NO: 1575016 - RNA, 15 nt, Homo sapiens
acugguucaccugaa

SEQ ID NO: 1575017 - RNA, 18 nt, Homo sapiens
acuguaaaaauaacauaa

SEQ ID NO: 1575018 - RNA, 14 nt, Homo sapiens
acaaccacugggau

SEQ ID NO: 1575019 - RNA, 12 nt, Homo sapiens
acaacuaccuga

SEQ ID NO: 1575020 - RNA, 17 nt, Homo sapiens
acaacugccagcucucu

SEQ ID NO: 1575021 - RNA, 23 nt, Homo sapiens
acaacuuucuccuacucuuccuu

SEQ ID NO: 1575022 - RNA, 14 nt, Homo sapiens
acaagaacaauuca

SEQ ID NO: 1575023 - RNA, 14 nt, Homo sapiens
acaagaaccaagga

SEQ ID NO: 1575024 - RNA, 11 nt, Homo sapiens
acaagaagcug

SEQ ID NO: 1575025 - RNA, 20 nt, Homo sapiens
acaagacauuucgaagucau

SEQ ID NO: 1575026 - RNA, 22 nt, Homo sapiens
acaagacauuucgaagucauca

SEQ ID NO: 1575027 - RNA, 21 nt, Homo sapiens
acaagagaucuacacauguug

SEQ ID NO: 1575028 - RNA, 15 nt, Homo sapiens
acaagccaagaaaga

SEQ ID NO: 1575029 - RNA, 23 nt, Homo sapiens
acaagccuccuguaccucagugg

SEQ ID NO: 1575030 - RNA, 18 nt, Homo sapiens
acaagcgccgcugugagg

SEQ ID NO: 1575031 - RNA, 22 nt, Homo sapiens
acaagcucugcgccaaucacag

SEQ ID NO: 1575032 - RNA, 16 nt, Homo sapiens
acaagcugcacuguga

SEQ ID NO: 1575033 - RNA, 20 nt, Homo sapiens
acaaggaggaguuccaccau

SEQ ID NO: 1575034 - RNA, 17 nt, Homo sapiens
acaauaaaaacauugcc

SEQ ID NO: 1575035 - RNA, 17 nt, Homo sapiens
acaauaaaaccaaacau

SEQ ID NO: 1575036 - RNA, 13 nt, Homo sapiens
acaauaaauuauu

SEQ ID NO: 1575037 - RNA, 13 nt, Homo sapiens
acaauaguauaca

SEQ ID NO: 1575038 - RNA, 13 nt, Homo sapiens
acaauaguauuuc

SEQ ID NO: 1575039 - RNA, 16 nt, Homo sapiens
acaauaguucuguggg

SEQ ID NO: 1575040 - RNA, 14 nt, Homo sapiens
acaaucagcuccuu

SEQ ID NO: 1575041 - RNA, 14 nt, Homo sapiens
acaauguacaauua

SEQ ID NO: 1575042 - RNA, 13 nt, Homo sapiens
acaaugucccuuc

SEQ ID NO: 1575043 - RNA, 22 nt, Homo sapiens
acaauguugcauuuaugaugca

SEQ ID NO: 1575044 - RNA, 22 nt, Homo sapiens
aauauagagacuguguucaugu

SEQ ID NO: 1575045 - RNA, 15 nt, Homo sapiens
aauauauagcuggca

SEQ ID NO: 1575046 - RNA, 20 nt, Homo sapiens
aauauauauggucauauaca

SEQ ID NO: 1575047 - RNA, 23 nt, Homo sapiens
aauauauguuuuaauaccacaaa

SEQ ID NO: 1575048 - RNA, 14 nt, Homo sapiens
aauaucaguauucu

SEQ ID NO: 1575049 - RNA, 15 nt, Homo sapiens
aauaucaguuacuca

SEQ ID NO: 1575050 - RNA, 12 nt, Homo sapiens
aauaucaugcaa

SEQ ID NO: 1575051 - RNA, 14 nt, Homo sapiens
aauauccaccacuu

SEQ ID NO: 1575052 - RNA, 15 nt, Homo sapiens
aauauccauccugaa

SEQ ID NO: 1575053 - RNA, 23 nt, Homo sapiens
aauaucguuagggugaagcauua

SEQ ID NO: 1575054 - RNA, 22 nt, Homo sapiens
aauaucuaagcaagugaacuca

SEQ ID NO: 1575055 - RNA, 20 nt, Homo sapiens
aauaucucaauuaccaauau

SEQ ID NO: 1575056 - RNA, 21 nt, Homo sapiens
aauaugaguaauacaucaaag

SEQ ID NO: 1575057 - RNA, 22 nt, Homo sapiens
aauaugaguaauacaucaaaga

SEQ ID NO: 1575058 - RNA, 23 nt, Homo sapiens
aauaugaucagguaacuuucgac

SEQ ID NO: 1575059 - RNA, 16 nt, Homo sapiens
aauaugcaagcagcuu

SEQ ID NO: 1575060 - RNA, 12 nt, Homo sapiens
aauaugugaaug

SEQ ID NO: 1575061 - RNA, 22 nt, Homo sapiens
aauauguucaccaggagauuac

SEQ ID NO: 1575062 - RNA, 13 nt, Homo sapiens
aauauuaaacacu

SEQ ID NO: 1575063 - RNA, 14 nt, Homo sapiens
aauauuauuagucu

SEQ ID NO: 1575064 - RNA, 18 nt, Homo sapiens
aauauucagccagcuuaa

SEQ ID NO: 1575065 - RNA, 23 nt, Homo sapiens
aauauuguccauuguccaauccu

SEQ ID NO: 1575066 - RNA, 22 nt, Homo sapiens
aauauuguguugugcagcauua

SEQ ID NO: 1575067 - RNA, 17 nt, Homo sapiens
aauauuuagcaguauug

SEQ ID NO: 1575068 - RNA, 15 nt, Homo sapiens
aauauuuauaagcua

SEQ ID NO: 1575069 - RNA, 22 nt, Homo sapiens
aauauuuuaaacuacugauuga

SEQ ID NO: 1575070 - RNA, 20 nt, Homo sapiens
aaggaguuagaaccacagca

SEQ ID NO: 1575071 - RNA, 17 nt, Homo sapiens
aaggauaccaaauacca

SEQ ID NO: 1575072 - RNA, 18 nt, Homo sapiens
aaggauaccaaauaccau

SEQ ID NO: 1575073 - RNA, 19 nt, Homo sapiens
aaggaucccaugagcuccu

SEQ ID NO: 1575074 - RNA, 18 nt, Homo sapiens
aaggauguaguaucucau

SEQ ID NO: 1575075 - RNA, 16 nt, Homo sapiens
aaggauuuuaccaaag

SEQ ID NO: 1575076 - RNA, 15 nt, Homo sapiens
aaggauuuuggaaac

SEQ ID NO: 1575077 - RNA, 16 nt, Homo sapiens
aaggcagccaccagcg

SEQ ID NO: 1575078 - RNA, 16 nt, Homo sapiens
aaggcagcugccucug

SEQ ID NO: 1575079 - RNA, 20 nt, Homo sapiens
aaggcaggaggaucacuuga

SEQ ID NO: 1575080 - RNA, 16 nt, Homo sapiens
aaggcagucauaucaa

SEQ ID NO: 1575081 - RNA, 14 nt, Homo sapiens
aaggcauaugcaca

SEQ ID NO: 1575082 - RNA, 19 nt, Homo sapiens
aaggcaucuacacaauuua

SEQ ID NO: 1575083 - RNA, 15 nt, Homo sapiens
aaggccacaggcagu

SEQ ID NO: 1575084 - RNA, 18 nt, Homo sapiens
aaggccaggcaugguggu

SEQ ID NO: 1575085 - RNA, 16 nt, Homo sapiens
aaggcccacuguaaua

SEQ ID NO: 1575086 - RNA, 15 nt, Homo sapiens
aaggccgucauuuca

SEQ ID NO: 1575087 - RNA, 16 nt, Homo sapiens
aaggccgucauuucau

SEQ ID NO: 1575088 - RNA, 20 nt, Homo sapiens
aaggccucuucucaacuuuu

SEQ ID NO: 1575089 - RNA, 21 nt, Homo sapiens
aaggccugacuucugcuggca

SEQ ID NO: 1575090 - RNA, 17 nt, Homo sapiens
aaggcguccauguuuau

SEQ ID NO: 1575091 - RNA, 14 nt, Homo sapiens
aaggcucauuuaaa

SEQ ID NO: 1575092 - RNA, 22 nt, Homo sapiens
aaggcucccggaauuccgucac

SEQ ID NO: 1575093 - RNA, 18 nt, Homo sapiens
aaggcugacauucacuga

SEQ ID NO: 1575094 - RNA, 20 nt, Homo sapiens
aaggcugacauucacugagu

SEQ ID NO: 1575095 - RNA, 22 nt, Homo sapiens
aaggcugaggcaggaggaucac

SEQ ID NO: 1575096 - RNA, 13 nt, Homo sapiens
aaggcugugagcc

SEQ ID NO: 1575097 - RNA, 20 nt, Homo sapiens
aagggaauucggugugcacc

SEQ ID NO: 1575098 - RNA, 15 nt, Homo sapiens
aagggaauugcucag

SEQ ID NO: 1575099 - RNA, 18 nt, Homo sapiens
aagggaauugcucagaga

SEQ ID NO: 1575100 - RNA, 15 nt, Homo sapiens
aagggacacauauca

SEQ ID NO: 1575101 - RNA, 21 nt, Homo sapiens
aagggaucagaagauaucuuu

SEQ ID NO: 1575102 - RNA, 14 nt, Homo sapiens
aagggauggcaaga

SEQ ID NO: 1575103 - RNA, 13 nt, Homo sapiens
aagggcacucuga

SEQ ID NO: 1575104 - RNA, 16 nt, Homo sapiens
aagggccgacuaagag

SEQ ID NO: 1575105 - RNA, 20 nt, Homo sapiens
aagggggugaccucuugccu

SEQ ID NO: 1575106 - RNA, 18 nt, Homo sapiens
aaggguacagaugugcug

SEQ ID NO: 1575107 - RNA, 23 nt, Homo sapiens
aagggucccuuuugcauugccaa

SEQ ID NO: 1575108 - RNA, 23 nt, Homo sapiens
aaggguguugcuaagcuguaacc

SEQ ID NO: 1575109 - RNA, 14 nt, Homo sapiens
aaggguugcuugcu

SEQ ID NO: 1575110 - RNA, 16 nt, Homo sapiens
aaggguuucucuauua

SEQ ID NO: 1575111 - RNA, 16 nt, Homo sapiens
aagguaagaucauuua

SEQ ID NO: 1575112 - RNA, 18 nt, Homo sapiens
aagguaugugucagccau

SEQ ID NO: 1575113 - RNA, 18 nt, Homo sapiens
aagguauuagcaaagcaa

SEQ ID NO: 1575114 - RNA, 19 nt, Homo sapiens
aagguauuagcaaagcaaa

SEQ ID NO: 1575115 - RNA, 19 nt, Homo sapiens
aagguauuuuaaucaccaa

SEQ ID NO: 1575116 - RNA, 20 nt, Homo sapiens
aaggucacuacugcauuuau

SEQ ID NO: 1575117 - RNA, 21 nt, Homo sapiens
aaggucagggagcaagaggug

SEQ ID NO: 1575118 - RNA, 16 nt, Homo sapiens
aaggugcauugauaca

SEQ ID NO: 1575119 - RNA, 20 nt, Homo sapiens
aaggugggcggaucaccuga

SEQ ID NO: 1575120 - RNA, 11 nt, Homo sapiens
aagguucucug

SEQ ID NO: 1575121 - RNA, 16 nt, Homo sapiens
aagguugagggcaaug

SEQ ID NO: 1575122 - RNA, 13 nt, Homo sapiens
aagguugcacagc

SEQ ID NO: 1575123 - RNA, 15 nt, Homo sapiens
aagguuuucaaggug

SEQ ID NO: 1575124 - RNA, 14 nt, Homo sapiens
aaguaaaacaguca

SEQ ID NO: 1575125 - RNA, 15 nt, Homo sapiens
aaguaaaacagucau

SEQ ID NO: 1575126 - RNA, 21 nt, Homo sapiens
aaguaaaauugaagcaacuac

SEQ ID NO: 1575127 - RNA, 15 nt, Homo sapiens
aaguaaaccacaaaa

SEQ ID NO: 1575128 - RNA, 15 nt, Homo sapiens
aaguaaauguugaca

SEQ ID NO: 1575129 - RNA, 14 nt, Homo sapiens
aaguaauaucuuuc

SEQ ID NO: 1575130 - RNA, 16 nt, Homo sapiens
aaguaaucaguaugca

SEQ ID NO: 1575131 - RNA, 13 nt, Homo sapiens
aaguaaugauuaa

SEQ ID NO: 1575132 - RNA, 15 nt, Homo sapiens
aaguacagccuggac

SEQ ID NO: 1575133 - RNA, 21 nt, Homo sapiens
aaguagcuaguagcaaugugc

SEQ ID NO: 1575134 - RNA, 21 nt, Homo sapiens
aaguaggaacucuuaagcaau

SEQ ID NO: 1575135 - RNA, 19 nt, Homo sapiens
aaguauaaucagcacuuug

SEQ ID NO: 1575136 - RNA, 22 nt, Homo sapiens
aaguauaaucagcacuuugcca

SEQ ID NO: 1575137 - RNA, 20 nt, Homo sapiens
aaguauauaaugcuugcacc

SEQ ID NO: 1575138 - RNA, 16 nt, Homo sapiens
aaguaucacacuguau

SEQ ID NO: 1575139 - RNA, 17 nt, Homo sapiens
aaguaucacacuguaua

SEQ ID NO: 1575140 - RNA, 15 nt, Homo sapiens
aaguaucccaucuaa

SEQ ID NO: 1575141 - RNA, 12 nt, Homo sapiens
aaguauccuuca

SEQ ID NO: 1575142 - RNA, 19 nt, Homo sapiens
aaguauccuucagccugaa

SEQ ID NO: 1575143 - RNA, 15 nt, Homo sapiens
aaguauuauuuuaca

SEQ ID NO: 1575144 - RNA, 15 nt, Homo sapiens
aaguauuggcauuca

SEQ ID NO: 1575145 - RNA, 16 nt, Homo sapiens
aaguauuggcauucaa

SEQ ID NO: 1575146 - RNA, 14 nt, Homo sapiens
aagucaacaguaaa

SEQ ID NO: 1575147 - RNA, 18 nt, Homo sapiens
aagucaauguacuuguuu

SEQ ID NO: 1575148 - RNA, 23 nt, Homo sapiens
aagucacaccagggcaacucuug

SEQ ID NO: 1575149 - RNA, 15 nt, Homo sapiens
aagucacuggccagu

SEQ ID NO: 1575150 - RNA, 16 nt, Homo sapiens
aagucauaccaaugaa

SEQ ID NO: 1575151 - RNA, 14 nt, Homo sapiens
aagucaugccugag

SEQ ID NO: 1575152 - RNA, 18 nt, Homo sapiens
aagucauuuuuuacuuga

SEQ ID NO: 1575153 - RNA, 14 nt, Homo sapiens
aaguccacagacau

SEQ ID NO: 1575154 - RNA, 24 nt, Homo sapiens
aaguccagccacuugacuggcaca

SEQ ID NO: 1575155 - RNA, 22 nt, Homo sapiens
aaguccagcugggaagcccuuu

SEQ ID NO: 1575156 - RNA, 16 nt, Homo sapiens
aaguccaucugacaaa

SEQ ID NO: 1575157 - RNA, 14 nt, Homo sapiens
aagucuacaacaua

SEQ ID NO: 1575158 - RNA, 15 nt, Homo sapiens
aagucucauagcuuu

SEQ ID NO: 1575159 - RNA, 13 nt, Homo sapiens
aagucucucaccc

SEQ ID NO: 1575160 - RNA, 22 nt, Homo sapiens
aagucugauguucuuuccauga

SEQ ID NO: 1575161 - RNA, 18 nt, Homo sapiens
gcauguggugauuggcca

SEQ ID NO: 1575162 - RNA, 20 nt, Homo sapiens
gcauguggugauuggccaca

SEQ ID NO: 1575163 - RNA, 19 nt, Homo sapiens
gcauucauuuuuauagcaa

SEQ ID NO: 1575164 - RNA, 17 nt, Homo sapiens
gcauuccuuuuucuuca

SEQ ID NO: 1575165 - RNA, 13 nt, Homo sapiens
gcauucucuaguc

SEQ ID NO: 1575166 - RNA, 17 nt, Homo sapiens
gcauugcugacugugua

SEQ ID NO: 1575167 - RNA, 18 nt, Homo sapiens
gcauugguuuuccaugac

SEQ ID NO: 1575168 - RNA, 20 nt, Homo sapiens
gcauuuagacccugcauuua

SEQ ID NO: 1575169 - RNA, 15 nt, Homo sapiens
gcauuuaugaugcag

SEQ ID NO: 1575170 - RNA, 15 nt, Homo sapiens
gcauuuccagccuau

SEQ ID NO: 1575171 - RNA, 20 nt, Homo sapiens
gcauuuccuaccuugugcuu

SEQ ID NO: 1575172 - RNA, 19 nt, Homo sapiens
gcauuuucuucucugcacu

SEQ ID NO: 1575173 - RNA, 14 nt, Homo sapiens
gccaaaaauagcua

SEQ ID NO: 1575174 - RNA, 17 nt, Homo sapiens
gccaaaacaagccaaag

SEQ ID NO: 1575175 - RNA, 12 nt, Homo sapiens
gccaaaaggaaa

SEQ ID NO: 1575176 - RNA, 14 nt, Homo sapiens
gccaaaccaagcaa

SEQ ID NO: 1575177 - RNA, 21 nt, Homo sapiens
gccaaagaaaugaacauucca

SEQ ID NO: 1575178 - RNA, 16 nt, Homo sapiens
gccaaaggacacggcu

SEQ ID NO: 1575179 - RNA, 12 nt, Homo sapiens
gccaacacuuaa

SEQ ID NO: 1575180 - RNA, 14 nt, Homo sapiens
gccaacgagacaca

SEQ ID NO: 1575181 - RNA, 15 nt, Homo sapiens
gccaacucaacuuuc

SEQ ID NO: 1575182 - RNA, 12 nt, Homo sapiens
gccaagaacuug

SEQ ID NO: 1575183 - RNA, 14 nt, Homo sapiens
gccaagaagcagug

SEQ ID NO: 1575184 - RNA, 17 nt, Homo sapiens
gccaagaauacuugaag

SEQ ID NO: 1575185 - RNA, 16 nt, Homo sapiens
gccaagauuguccuuu

SEQ ID NO: 1575186 - RNA, 17 nt, Homo sapiens
gccaagcuaaucugccu

SEQ ID NO: 1575187 - RNA, 15 nt, Homo sapiens
gccaaggagugaaaa

SEQ ID NO: 1575188 - RNA, 14 nt, Homo sapiens
gccaaggcucucuc

SEQ ID NO: 1575189 - RNA, 20 nt, Homo sapiens
gccaagggaaaggggugcuu

SEQ ID NO: 1575190 - RNA, 12 nt, Homo sapiens
gccaagugcaga

SEQ ID NO: 1575191 - RNA, 13 nt, Homo sapiens
gccaagugccaua

SEQ ID NO: 1575192 - RNA, 24 nt, Homo sapiens
gccaagugcccucucugaaccuca

SEQ ID NO: 1575193 - RNA, 19 nt, Homo sapiens
gccaauaggugccuaguaa

SEQ ID NO: 1575194 - RNA, 15 nt, Homo sapiens
gccaauuacuugaag

SEQ ID NO: 1575195 - RNA, 12 nt, Homo sapiens
gccaauuucacc

SEQ ID NO: 1575196 - RNA, 16 nt, Homo sapiens
gccaauuucaccccau

SEQ ID NO: 1575197 - RNA, 19 nt, Homo sapiens
gccacacaaacguuuacuu

SEQ ID NO: 1575198 - RNA, 15 nt, Homo sapiens
gccacacacugaguu

SEQ ID NO: 1575199 - RNA, 20 nt, Homo sapiens
gccacacacugaguugcaca

SEQ ID NO: 1575200 - RNA, 20 nt, Homo sapiens
gccacaggccugagauuuca

SEQ ID NO: 1575201 - RNA, 13 nt, Homo sapiens
gccacaguucaca

SEQ ID NO: 1575202 - RNA, 18 nt, Homo sapiens
gccacaguucacaugcca

SEQ ID NO: 1575203 - RNA, 15 nt, Homo sapiens
gccacauauugagau

SEQ ID NO: 1575204 - RNA, 23 nt, Homo sapiens
gccacaucccuauagaccacugg

SEQ ID NO: 1575205 - RNA, 18 nt, Homo sapiens
gccacauuuggaauacuu

SEQ ID NO: 1575206 - RNA, 23 nt, Homo sapiens
gccaccagcgaaugcuaggucuc

SEQ ID NO: 1575207 - RNA, 23 nt, Homo sapiens
gccaccccuccccaguacagggg

SEQ ID NO: 1575208 - RNA, 17 nt, Homo sapiens
gccacccuuugguuauu

SEQ ID NO: 1575209 - RNA, 20 nt, Homo sapiens
gccaccggaggucacuccac

SEQ ID NO: 1575210 - RNA, 22 nt, Homo sapiens
gccaccgugcccggccaaguaa

SEQ ID NO: 1575211 - RNA, 17 nt, Homo sapiens
gccaccuuugugcagcu

SEQ ID NO: 1575212 - RNA, 19 nt, Homo sapiens
gccacucaggggucauuca

SEQ ID NO: 1575213 - RNA, 23 nt, Homo sapiens
gccacugagaagugcacuuuaag

SEQ ID NO: 1575214 - RNA, 23 nt, Homo sapiens
gccacuggaaggaacauggagcu

SEQ ID NO: 1575215 - RNA, 15 nt, Homo sapiens
gccacuggaccucag

SEQ ID NO: 1575216 - RNA, 19 nt, Homo sapiens
gccagacccacaaggccag

SEQ ID NO: 1575217 - RNA, 18 nt, Homo sapiens
gccagacuucccacggcu

SEQ ID NO: 1575218 - RNA, 16 nt, Homo sapiens
gccagagcaaacagaa

SEQ ID NO: 1575219 - RNA, 13 nt, Homo sapiens
gccagagccucug

SEQ ID NO: 1575220 - RNA, 16 nt, Homo sapiens
gccagagccucuggcc

SEQ ID NO: 1575221 - RNA, 17 nt, Homo sapiens
gccagauggacuccagc

SEQ ID NO: 1575222 - RNA, 22 nt, Homo sapiens
gccagauggccccuccacuggg

SEQ ID NO: 1575223 - RNA, 19 nt, Homo sapiens
gccagcagggcaucuugga

SEQ ID NO: 1575224 - RNA, 22 nt, Homo sapiens
gccagcaggucaaaaaggccaa

SEQ ID NO: 1575225 - RNA, 15 nt, Homo sapiens
gccagcgcgaugaac

SEQ ID NO: 1575226 - RNA, 12 nt, Homo sapiens
gccagcucagga

SEQ ID NO: 1575227 - RNA, 14 nt, Homo sapiens
gccagcucucagga

SEQ ID NO: 1575228 - RNA, 22 nt, Homo sapiens
gccagcugaagaguaaaggaaa

SEQ ID NO: 1575229 - RNA, 16 nt, Homo sapiens
gccagcugugcacuuu

SEQ ID NO: 1575230 - RNA, 18 nt, Homo sapiens
gccaggaggaacaaagag

SEQ ID NO: 1575231 - RNA, 21 nt, Homo sapiens
gccaggaggggaaacaucaca

SEQ ID NO: 1575232 - RNA, 16 nt, Homo sapiens
gccaggcacacacugu

SEQ ID NO: 1575233 - RNA, 21 nt, Homo sapiens
gccaggccucuuggcagucac

SEQ ID NO: 1575234 - RNA, 21 nt, Homo sapiens
gccaggcuaucuggccugaga

SEQ ID NO: 1575235 - RNA, 17 nt, Homo sapiens
gccaggcucugugcuga

SEQ ID NO: 1575236 - RNA, 11 nt, Homo sapiens
gccaggugccg

SEQ ID NO: 1575237 - RNA, 19 nt, Homo sapiens
gccaguccugccuggccag

SEQ ID NO: 1575238 - RNA, 21 nt, Homo sapiens
gccaguggcuggaucugugag

SEQ ID NO: 1575239 - RNA, 15 nt, Homo sapiens
gccaguuaauuuuaa

SEQ ID NO: 1575240 - RNA, 18 nt, Homo sapiens
gccauaagaaagcacuau

SEQ ID NO: 1575241 - RNA, 20 nt, Homo sapiens
gccauaauuacuaugucauu

SEQ ID NO: 1575242 - RNA, 17 nt, Homo sapiens
gccauauaugcuguauu

SEQ ID NO: 1575243 - RNA, 22 nt, Homo sapiens
gccauaugaaugucaguaguuu

SEQ ID NO: 1575244 - RNA, 14 nt, Homo sapiens
gccauauuaccccu

SEQ ID NO: 1575245 - RNA, 15 nt, Homo sapiens
gccaucaagcacuuc

SEQ ID NO: 1575246 - RNA, 21 nt, Homo sapiens
gccaucaaggaguauauggac

SEQ ID NO: 1575247 - RNA, 19 nt, Homo sapiens
gccaucauccuccauugcu

SEQ ID NO: 1575248 - RNA, 12 nt, Homo sapiens
gccaucaugccu

SEQ ID NO: 1575249 - RNA, 16 nt, Homo sapiens
gccaucaugccugacu

SEQ ID NO: 1575250 - RNA, 15 nt, Homo sapiens
gccaucgccaaguaa

SEQ ID NO: 1575251 - RNA, 15 nt, Homo sapiens
gccaucguucaucca

SEQ ID NO: 1575252 - RNA, 16 nt, Homo sapiens
gccaucucuuccucau

SEQ ID NO: 1575253 - RNA, 22 nt, Homo sapiens
gccugaucagcgccgcaccagc

SEQ ID NO: 1575254 - RNA, 18 nt, Homo sapiens
gccugaugcucccucccc

SEQ ID NO: 1575255 - RNA, 21 nt, Homo sapiens
gccugcaaaaaugaaauccag

SEQ ID NO: 1575256 - RNA, 17 nt, Homo sapiens
gccugcuacgaacgcuc

SEQ ID NO: 1575257 - RNA, 16 nt, Homo sapiens
gccugcuucuuuccag

SEQ ID NO: 1575258 - RNA, 19 nt, Homo sapiens
gccuggacacuguaccgac

SEQ ID NO: 1575259 - RNA, 17 nt, Homo sapiens
gccuggccagcacccca

SEQ ID NO: 1575260 - RNA, 22 nt, Homo sapiens
gccuggcccuccccacaaugcc

SEQ ID NO: 1575261 - RNA, 15 nt, Homo sapiens
gccugggagcccaga

SEQ ID NO: 1575262 - RNA, 16 nt, Homo sapiens
gccuggggauucugag

SEQ ID NO: 1575263 - RNA, 18 nt, Homo sapiens
gccugggggcagccucuc

SEQ ID NO: 1575264 - RNA, 14 nt, Homo sapiens
gccugggugucaag

SEQ ID NO: 1575265 - RNA, 23 nt, Homo sapiens
gccuguaaucccaacacuuugag

SEQ ID NO: 1575266 - RNA, 20 nt, Homo sapiens
gccuguaaucccagaacuuu

SEQ ID NO: 1575267 - RNA, 19 nt, Homo sapiens
gccuguaaucucacuacac

SEQ ID NO: 1575268 - RNA, 22 nt, Homo sapiens
gccuguaaucucagcacuuugg

SEQ ID NO: 1575269 - RNA, 20 nt, Homo sapiens
gccuguacucccagcacuuu

SEQ ID NO: 1575270 - RNA, 18 nt, Homo sapiens
gccuguacugaagcugaa

SEQ ID NO: 1575271 - RNA, 20 nt, Homo sapiens
gccuguagucucagcuaguu

SEQ ID NO: 1575272 - RNA, 18 nt, Homo sapiens
gccuguccaacaugguga

SEQ ID NO: 1575273 - RNA, 19 nt, Homo sapiens
gccuguccaacauggugaa

SEQ ID NO: 1575274 - RNA, 23 nt, Homo sapiens
gccuguggguuugguccuugaac

SEQ ID NO: 1575275 - RNA, 20 nt, Homo sapiens
gccuguuauaacucugcacu

SEQ ID NO: 1575276 - RNA, 14 nt, Homo sapiens
gccuguuccaugaa

SEQ ID NO: 1575277 - RNA, 23 nt, Homo sapiens
cgccuggaggagacgcuggacuu

SEQ ID NO: 1575278 - RNA, 13 nt, Homo sapiens
cgccuuaaacucu

SEQ ID NO: 1575279 - RNA, 20 nt, Homo sapiens
cgccuuugugagcugugagu

SEQ ID NO: 1575280 - RNA, 12 nt, Homo sapiens
cgcgacuuccac

SEQ ID NO: 1575281 - RNA, 14 nt, Homo sapiens
cgcgcccggccuca

SEQ ID NO: 1575282 - RNA, 20 nt, Homo sapiens
cgcuaugugacuugcgcuua

SEQ ID NO: 1575283 - RNA, 20 nt, Homo sapiens
cgcucuaggauaacuggcac

SEQ ID NO: 1575284 - RNA, 19 nt, Homo sapiens
cgcugaagcgccuccccca

SEQ ID NO: 1575285 - RNA, 14 nt, Homo sapiens
cgcugcauacaggg

SEQ ID NO: 1575286 - RNA, 17 nt, Homo sapiens
cgcugccacccgcccac

SEQ ID NO: 1575287 - RNA, 14 nt, Homo sapiens
cgcuggaccugguu

SEQ ID NO: 1575288 - RNA, 16 nt, Homo sapiens
cgcuguauaaagcaug

SEQ ID NO: 1575289 - RNA, 16 nt, Homo sapiens
cgcuuaaccuuuccag

SEQ ID NO: 1575290 - RNA, 13 nt, Homo sapiens
cggaacacauucu

SEQ ID NO: 1575291 - RNA, 22 nt, Homo sapiens
cggacccuucuggguccaggga

SEQ ID NO: 1575292 - RNA, 23 nt, Homo sapiens
cggacugugugcagguugcagag

SEQ ID NO: 1575293 - RNA, 23 nt, Homo sapiens
cggaggaggcuggugacaggcca

SEQ ID NO: 1575294 - RNA, 14 nt, Homo sapiens
cggaggccagagag

SEQ ID NO: 1575295 - RNA, 22 nt, Homo sapiens
cggagggccccugcgugggggc

SEQ ID NO: 1575296 - RNA, 21 nt, Homo sapiens
cggaugcccauuccugccugg

SEQ ID NO: 1575297 - RNA, 21 nt, Homo sapiens
cggauguuucuggaauugaua

SEQ ID NO: 1575298 - RNA, 17 nt, Homo sapiens
cggcccagaaguuuccc

SEQ ID NO: 1575299 - RNA, 18 nt, Homo sapiens
cggccccucccccugaga

SEQ ID NO: 1575300 - RNA, 13 nt, Homo sapiens
cggcccugaccaa

SEQ ID NO: 1575301 - RNA, 14 nt, Homo sapiens
cggcuacucuggaa

SEQ ID NO: 1575302 - RNA, 17 nt, Homo sapiens
cggcuccaucaccagcc

SEQ ID NO: 1575303 - RNA, 14 nt, Homo sapiens
cggcuccugcaaaa

SEQ ID NO: 1575304 - RNA, 15 nt, Homo sapiens
cggcuccugcaaaag

SEQ ID NO: 1575305 - RNA, 20 nt, Homo sapiens
cggcucuaguaccuuuucag

SEQ ID NO: 1575306 - RNA, 19 nt, Homo sapiens
cggcuuccuacagccagca

SEQ ID NO: 1575307 - RNA, 23 nt, Homo sapiens
cgggacauccucugcuaccaucu

SEQ ID NO: 1575308 - RNA, 17 nt, Homo sapiens
cgggagacucaaaggga

SEQ ID NO: 1575309 - RNA, 13 nt, Homo sapiens
cgggcaccuguag

SEQ ID NO: 1575310 - RNA, 22 nt, Homo sapiens
cgggcaggggucagagcacucc

SEQ ID NO: 1575311 - RNA, 16 nt, Homo sapiens
cgggccccauccucau

SEQ ID NO: 1575312 - RNA, 18 nt, Homo sapiens
cggggccagcacuuccau

SEQ ID NO: 1575313 - RNA, 15 nt, Homo sapiens
cggggcucuucucau

SEQ ID NO: 1575314 - RNA, 17 nt, Homo sapiens
cgggguggcccacugag

SEQ ID NO: 1575315 - RNA, 21 nt, Homo sapiens
cgggguuucaccauguuggcc

SEQ ID NO: 1575316 - RNA, 21 nt, Homo sapiens
cggguaauucuauugggauau

SEQ ID NO: 1575317 - RNA, 16 nt, Homo sapiens
cggucccugucccucu

SEQ ID NO: 1575318 - RNA, 17 nt, Homo sapiens
cgguuaccucugcaugg

SEQ ID NO: 1575319 - RNA, 15 nt, Homo sapiens
cgguucuuugaccag

SEQ ID NO: 1575320 - RNA, 12 nt, Homo sapiens
cgguuuuagcuu

SEQ ID NO: 1575321 - RNA, 19 nt, Homo sapiens
cgguuuuccucagcucuag

SEQ ID NO: 1575322 - RNA, 11 nt, Homo sapiens
cguaaacuaug

SEQ ID NO: 1575323 - RNA, 23 nt, Homo sapiens
cguaagugguaugcaugggaugu

SEQ ID NO: 1575324 - RNA, 14 nt, Homo sapiens
cguacuuguaauau

SEQ ID NO: 1575325 - RNA, 18 nt, Homo sapiens
cguaguauuaugauugca

SEQ ID NO: 1575326 - RNA, 16 nt, Homo sapiens
cguauuuuacaugaag

SEQ ID NO: 1575327 - RNA, 15 nt, Homo sapiens
cgucagcugggacac

SEQ ID NO: 1575328 - RNA, 11 nt, Homo sapiens
cgucauuucau

SEQ ID NO: 1575329 - RNA, 13 nt, Homo sapiens
cguccuuccucuc

SEQ ID NO: 1575330 - RNA, 13 nt, Homo sapiens
cgucuaacuggaa

SEQ ID NO: 1575331 - RNA, 13 nt, Homo sapiens
cgucucaaucucc

SEQ ID NO: 1575332 - RNA, 14 nt, Homo sapiens
cgugagcaccacca

SEQ ID NO: 1575333 - RNA, 16 nt, Homo sapiens
cgugauuuugcuguag

SEQ ID NO: 1575334 - RNA, 15 nt, Homo sapiens
cgugccaaaaaucuu

SEQ ID NO: 1575335 - RNA, 13 nt, Homo sapiens
cgugccuguaguc

SEQ ID NO: 1575336 - RNA, 17 nt, Homo sapiens
cgugggccucacauucc

SEQ ID NO: 1575337 - RNA, 15 nt, Homo sapiens
cgugguagucacuug

SEQ ID NO: 1575338 - RNA, 19 nt, Homo sapiens
cgugguaugaaaugucuga

SEQ ID NO: 1575339 - RNA, 18 nt, Homo sapiens
cguggugaccuuucacga

SEQ ID NO: 1575340 - RNA, 23 nt, Homo sapiens
cgugguggccagcagcagcuaca

SEQ ID NO: 1575341 - RNA, 20 nt, Homo sapiens
cgugguuacucacaccugua

SEQ ID NO: 1575342 - RNA, 13 nt, Homo sapiens
cgugugaccucca

SEQ ID NO: 1575343 - RNA, 19 nt, Homo sapiens
cguguguagauaguaugca

SEQ ID NO: 1575344 - RNA, 17 nt, Homo sapiens
cgugugugccaccucau

SEQ ID NO: 1575345 - RNA, 18 nt, Homo sapiens
cguguguguuauuucccc

SEQ ID NO: 1575346 - RNA, 11 nt, Homo sapiens
cguguuugcuu

SEQ ID NO: 1575347 - RNA, 18 nt, Homo sapiens
cguuaccauuuacauguu

SEQ ID NO: 1575348 - RNA, 18 nt, Homo sapiens
cguucccagaccauggga

SEQ ID NO: 1575349 - RNA, 21 nt, Homo sapiens
cguugaauugaugaugcaguu

SEQ ID NO: 1575350 - RNA, 21 nt, Homo sapiens
cguuucauuuuuacaccaauu

SEQ ID NO: 1575351 - RNA, 21 nt, Homo sapiens
cguuugaauauauuuuaucuu

SEQ ID NO: 1575352 - RNA, 18 nt, Homo sapiens
cguuugcuuaaacccuuu

SEQ ID NO: 1575353 - RNA, 12 nt, Homo sapiens
cuaaaacuuaac

SEQ ID NO: 1575354 - RNA, 14 nt, Homo sapiens
cuaaaacuuaacau

SEQ ID NO: 1575355 - RNA, 17 nt, Homo sapiens
cuaaaacuuaacauuca

SEQ ID NO: 1575356 - RNA, 16 nt, Homo sapiens
cuaaaauacaaaccca

SEQ ID NO: 1575357 - RNA, 19 nt, Homo sapiens
cuaaaauguaucuaagaau

SEQ ID NO: 1575358 - RNA, 11 nt, Homo sapiens
cuaaaccaagu

SEQ ID NO: 1575359 - RNA, 16 nt, Homo sapiens
cuaaacccuguuccug

SEQ ID NO: 1575360 - RNA, 20 nt, Homo sapiens
cuaaagaguuuucuaugaau

SEQ ID NO: 1575361 - RNA, 15 nt, Homo sapiens
cuaaagauguuuuaa

SEQ ID NO: 1575362 - RNA, 16 nt, Homo sapiens
cuaaagcuucuauaaa

SEQ ID NO: 1575363 - RNA, 15 nt, Homo sapiens
cuaaaggacuauuau

SEQ ID NO: 1575364 - RNA, 20 nt, Homo sapiens
cuaaaggauccagagagcag

SEQ ID NO: 1575365 - RNA, 19 nt, Homo sapiens
cuaaagggagaaaugccag

SEQ ID NO: 1575366 - RNA, 21 nt, Homo sapiens
cuaaagguggugaggcaauaa

SEQ ID NO: 1575367 - RNA, 14 nt, Homo sapiens
cuaaagguuaccug

SEQ ID NO: 1575368 - RNA, 13 nt, Homo sapiens
cuaaauagcacuu

SEQ ID NO: 1575369 - RNA, 12 nt, Homo sapiens
cuaaauaucuca

SEQ ID NO: 1575370 - RNA, 21 nt, Homo sapiens
cuaaauauugcuucaauuuca

SEQ ID NO: 1575371 - RNA, 11 nt, Homo sapiens
cuaaaugaagu

SEQ ID NO: 1575372 - RNA, 19 nt, Homo sapiens
cuaaaugagucacugagca

SEQ ID NO: 1575373 - RNA, 23 nt, Homo sapiens
cuaaaugcuguucuuacacauaa

SEQ ID NO: 1575374 - RNA, 23 nt, Homo sapiens
cuaaaugucuuuuucacaaucau

SEQ ID NO: 1575375 - RNA, 17 nt, Homo sapiens
cuaaauuauaucuguga

SEQ ID NO: 1575376 - RNA, 22 nt, Homo sapiens
cuaacaaugacauuuauaucac

SEQ ID NO: 1575377 - RNA, 22 nt, Homo sapiens
cuaacaauggaagauuugccca

SEQ ID NO: 1575378 - RNA, 23 nt, Homo sapiens
cuaacaauggaagauuugcccau

SEQ ID NO: 1575379 - RNA, 17 nt, Homo sapiens
cuaacaggucuagaaaa

SEQ ID NO: 1575380 - RNA, 19 nt, Homo sapiens
cuaacaucuugaauacucu

SEQ ID NO: 1575381 - RNA, 22 nt, Homo sapiens
cuaacccaagacaugacauucu

SEQ ID NO: 1575382 - RNA, 21 nt, Homo sapiens
cuaaccgaauauucauggaug

SEQ ID NO: 1575383 - RNA, 22 nt, Homo sapiens
cuaaccuucacgauuaacugug

SEQ ID NO: 1575384 - RNA, 16 nt, Homo sapiens
cuaacguccacuagcu

SEQ ID NO: 1575385 - RNA, 16 nt, Homo sapiens
cuaacguuuaauugcc

SEQ ID NO: 1575386 - RNA, 15 nt, Homo sapiens
cuaacuagcauugua

SEQ ID NO: 1575387 - RNA, 15 nt, Homo sapiens
cuaacuugaaaagaa

SEQ ID NO: 1575388 - RNA, 17 nt, Homo sapiens
cuaagaagagauuucuc

SEQ ID NO: 1575389 - RNA, 13 nt, Homo sapiens
cuaagaagggaac

SEQ ID NO: 1575390 - RNA, 18 nt, Homo sapiens
gaauaaugcuguuuuaua

SEQ ID NO: 1575391 - RNA, 21 nt, Homo sapiens
gaauaauuagcuuguuacaau

SEQ ID NO: 1575392 - RNA, 19 nt, Homo sapiens
gaauacacauuuuuugcca

SEQ ID NO: 1575393 - RNA, 17 nt, Homo sapiens
gaauacauggaaauauu

SEQ ID NO: 1575394 - RNA, 20 nt, Homo sapiens
gaauacauuaacggugcuaa

SEQ ID NO: 1575395 - RNA, 14 nt, Homo sapiens
gaauaccaccuaau

SEQ ID NO: 1575396 - RNA, 20 nt, Homo sapiens
gaauacucugcccucuagag

SEQ ID NO: 1575397 - RNA, 21 nt, Homo sapiens
gaauacugcauuuacagugua

SEQ ID NO: 1575398 - RNA, 17 nt, Homo sapiens
gaauacuggccaugccu

SEQ ID NO: 1575399 - RNA, 24 nt, Homo sapiens
gaauacuggccaugccuggagaca

SEQ ID NO: 1575400 - RNA, 15 nt, Homo sapiens
gaauacuugaacucu

SEQ ID NO: 1575401 - RNA, 12 nt, Homo sapiens
gaauagaacucu

SEQ ID NO: 1575402 - RNA, 17 nt, Homo sapiens
gaauagccuggccacca

SEQ ID NO: 1575403 - RNA, 22 nt, Homo sapiens
gaauaguucaggagacuuuaca

SEQ ID NO: 1575404 - RNA, 14 nt, Homo sapiens
gaauauacauaguc

SEQ ID NO: 1575405 - RNA, 15 nt, Homo sapiens
gaauauagacagugc

SEQ ID NO: 1575406 - RNA, 17 nt, Homo sapiens
gaauaucaucugucauu

SEQ ID NO: 1575407 - RNA, 17 nt, Homo sapiens
gaaucaacauuucucaa

SEQ ID NO: 1575408 - RNA, 17 nt, Homo sapiens
gaaucaagagcugcccu

SEQ ID NO: 1575409 - RNA, 17 nt, Homo sapiens
gaaucacugcuccaggc

SEQ ID NO: 1575410 - RNA, 15 nt, Homo sapiens
gaaucagaccugguu

SEQ ID NO: 1575411 - RNA, 20 nt, Homo sapiens
gaaucaugucaggccaucaa

SEQ ID NO: 1575412 - RNA, 21 nt, Homo sapiens
gaaucccccuugccaccccac

SEQ ID NO: 1575413 - RNA, 20 nt, Homo sapiens
gaauccuggaccaagcacaa

SEQ ID NO: 1575414 - RNA, 20 nt, Homo sapiens
gaauccuuggugugguuucu

SEQ ID NO: 1575415 - RNA, 22 nt, Homo sapiens
gaaucggcuggggacugcuacc

SEQ ID NO: 1575416 - RNA, 19 nt, Homo sapiens
gaaucuagagcaaagccau

SEQ ID NO: 1575417 - RNA, 20 nt, Homo sapiens
gaaucucuuuuugcuuucga

SEQ ID NO: 1575418 - RNA, 20 nt, Homo sapiens
gaaucugaauguaauuugug

SEQ ID NO: 1575419 - RNA, 20 nt, Homo sapiens
gaaucugcugagaggcacca

SEQ ID NO: 1575420 - RNA, 19 nt, Homo sapiens
gaaucuuauuuuuccuguc

SEQ ID NO: 1575421 - RNA, 22 nt, Homo sapiens
gaaucuuauuuuuccuguccug

SEQ ID NO: 1575422 - RNA, 16 nt, Homo sapiens
gaaugaagguaauauu

SEQ ID NO: 1575423 - RNA, 20 nt, Homo sapiens
gaaugaauuuaucuuuacca

SEQ ID NO: 1575424 - RNA, 15 nt, Homo sapiens
gaaugagacuuacuu

SEQ ID NO: 1575425 - RNA, 18 nt, Homo sapiens
gaaugcauugucaauauu

SEQ ID NO: 1575426 - RNA, 14 nt, Homo sapiens
uaagagauaauugu

SEQ ID NO: 1575427 - RNA, 19 nt, Homo sapiens
uaagagcauagaacucaaa

SEQ ID NO: 1575428 - RNA, 18 nt, Homo sapiens
uaagauauauacauggaa

SEQ ID NO: 1575429 - RNA, 20 nt, Homo sapiens
uaagauauucagaaguauau

SEQ ID NO: 1575430 - RNA, 17 nt, Homo sapiens
uaagauauuuaguaaua

SEQ ID NO: 1575431 - RNA, 18 nt, Homo sapiens
uaagauauuuaguaauau

SEQ ID NO: 1575432 - RNA, 13 nt, Homo sapiens
uaagauccacaaa

SEQ ID NO: 1575433 - RNA, 20 nt, Homo sapiens
uaagauccuaaacucucuag

SEQ ID NO: 1575434 - RNA, 19 nt, Homo sapiens
uaagaucucgguuugccaa

SEQ ID NO: 1575435 - RNA, 18 nt, Homo sapiens
uaagauuuuuuguaggca

SEQ ID NO: 1575436 - RNA, 16 nt, Homo sapiens
uaagcaaaaugccaaa

SEQ ID NO: 1575437 - RNA, 19 nt, Homo sapiens
uaagcaaauugcuuuuuuc

SEQ ID NO: 1575438 - RNA, 17 nt, Homo sapiens
uaagcaacuugcuucua

SEQ ID NO: 1575439 - RNA, 17 nt, Homo sapiens
uaagcaagugaacucau

SEQ ID NO: 1575440 - RNA, 16 nt, Homo sapiens
uaagcagaccacugau

SEQ ID NO: 1575441 - RNA, 13 nt, Homo sapiens
uaagcagccagac

SEQ ID NO: 1575442 - RNA, 24 nt, Homo sapiens
uaagcagccagacccacaaggcca

SEQ ID NO: 1575443 - RNA, 14 nt, Homo sapiens
uaagcaucugccau

SEQ ID NO: 1575444 - RNA, 19 nt, Homo sapiens
uaagccaaagaaaugaaca

SEQ ID NO: 1575445 - RNA, 20 nt, Homo sapiens
uaagccaaagguucagaaaa

SEQ ID NO: 1575446 - RNA, 15 nt, Homo sapiens
uaagcuaaagccuga

SEQ ID NO: 1575447 - RNA, 16 nt, Homo sapiens
uaagcuacugccaucc

SEQ ID NO: 1575448 - RNA, 12 nt, Homo sapiens
uaagcuuuuugg

SEQ ID NO: 1575449 - RNA, 16 nt, Homo sapiens
uaaggaaguaucagca

SEQ ID NO: 1575450 - RNA, 13 nt, Homo sapiens
uaaggcaggagaa

SEQ ID NO: 1575451 - RNA, 16 nt, Homo sapiens
uaaggcuuuuucuucc

SEQ ID NO: 1575452 - RNA, 14 nt, Homo sapiens
uaagggguacuccu

SEQ ID NO: 1575453 - RNA, 15 nt, Homo sapiens
uaagguaauguaggg

SEQ ID NO: 1575454 - RNA, 21 nt, Homo sapiens
uaagguacaucauuauuguag

SEQ ID NO: 1575455 - RNA, 19 nt, Homo sapiens
uaaguacacaauaagcaaa

SEQ ID NO: 1575456 - RNA, 16 nt, Homo sapiens
uaagucaccuguauaa

SEQ ID NO: 1575457 - RNA, 21 nt, Homo sapiens
uaagucauuccuccagugcau

SEQ ID NO: 1575458 - RNA, 13 nt, Homo sapiens
uaagucuaucugg

SEQ ID NO: 1575459 - RNA, 19 nt, Homo sapiens
uaagugagagaaaugaagu

SEQ ID NO: 1575460 - RNA, 15 nt, Homo sapiens
uaaguguucauuuua

SEQ ID NO: 1575461 - RNA, 18 nt, Homo sapiens
uaaguuaauguauauaaa

SEQ ID NO: 1575462 - RNA, 16 nt, Homo sapiens
uaaguucuuaugagga

SEQ ID NO: 1575463 - RNA, 21 nt, Homo sapiens
uaauaaaaccggucacugaug

SEQ ID NO: 1575464 - RNA, 21 nt, Homo sapiens
uaauaaaucuaggaugugaug

SEQ ID NO: 1575465 - RNA, 24 nt, Homo sapiens
uaauaaaucucuucuuugcugcag

SEQ ID NO: 1575466 - RNA, 16 nt, Homo sapiens
uaauaagaauuuggag

SEQ ID NO: 1575467 - RNA, 15 nt, Homo sapiens
uaauaaguaaucuaa

SEQ ID NO: 1575468 - RNA, 17 nt, Homo sapiens
uaauaauaguacuauua

SEQ ID NO: 1575469 - RNA, 23 nt, Homo sapiens
uaauaaugauggucaacaauaag

SEQ ID NO: 1575470 - RNA, 16 nt, Homo sapiens
uaauaaugcuggaugg

SEQ ID NO: 1575471 - RNA, 22 nt, Homo sapiens
uaauaauuggagaagauuuaug

SEQ ID NO: 1575472 - RNA, 17 nt, Homo sapiens
uaauaauuugcucacuu

SEQ ID NO: 1575473 - RNA, 15 nt, Homo sapiens
uaauacaaacuaauu

SEQ ID NO: 1575474 - RNA, 14 nt, Homo sapiens
uaauacaaacuaua

SEQ ID NO: 1575475 - RNA, 22 nt, Homo sapiens
uaauacacagugagacacagua

SEQ ID NO: 1575476 - RNA, 15 nt, Homo sapiens
uaauacaucaaagag

SEQ ID NO: 1575477 - RNA, 18 nt, Homo sapiens
uaauacguagcucucuua

SEQ ID NO: 1575478 - RNA, 15 nt, Homo sapiens
uaauacuuuuccaca

SEQ ID NO: 1575479 - RNA, 18 nt, Homo sapiens
uaauagagauaaguccau

SEQ ID NO: 1575480 - RNA, 23 nt, Homo sapiens
uaauagccuggguuaaguauuau

SEQ ID NO: 1575481 - RNA, 17 nt, Homo sapiens
uaauagcuacagugcau

SEQ ID NO: 1575482 - RNA, 15 nt, Homo sapiens
uaauaguacuauuac

SEQ ID NO: 1575483 - RNA, 19 nt, Homo sapiens
uaauagucaauuucuacuu

SEQ ID NO: 1575484 - RNA, 15 nt, Homo sapiens
guuagugauggagcu

SEQ ID NO: 1575485 - RNA, 16 nt, Homo sapiens
guuauaaaaggcuuua

SEQ ID NO: 1575486 - RNA, 21 nt, Homo sapiens
guuauaacucugcacuacucc

SEQ ID NO: 1575487 - RNA, 19 nt, Homo sapiens
guuauacuuauuuguauau

SEQ ID NO: 1575488 - RNA, 21 nt, Homo sapiens
guuaucccuauuuugcugaug

SEQ ID NO: 1575489 - RNA, 15 nt, Homo sapiens
guuauuuauaguguu

SEQ ID NO: 1575490 - RNA, 21 nt, Homo sapiens
guuauuucagcccccaucacc

SEQ ID NO: 1575491 - RNA, 22 nt, Homo sapiens
guuauuugaaaauuugauuuug

SEQ ID NO: 1575492 - RNA, 16 nt, Homo sapiens
guucaaauucuucuga

SEQ ID NO: 1575493 - RNA, 12 nt, Homo sapiens
guucaagaccag

SEQ ID NO: 1575494 - RNA, 15 nt, Homo sapiens
guucacaaacuguga

SEQ ID NO: 1575495 - RNA, 16 nt, Homo sapiens
guucacaaacugugaa

SEQ ID NO: 1575496 - RNA, 15 nt, Homo sapiens
guucacaacagugaa

SEQ ID NO: 1575497 - RNA, 22 nt, Homo sapiens
guucacaccagagaaccaggcu

SEQ ID NO: 1575498 - RNA, 15 nt, Homo sapiens
guucacauccauuac

SEQ ID NO: 1575499 - RNA, 19 nt, Homo sapiens
guucacuucuaaaccaaaa

SEQ ID NO: 1575500 - RNA, 20 nt, Homo sapiens
guucacuucuaaaccaaaaa

SEQ ID NO: 1575501 - RNA, 17 nt, Homo sapiens
guucauauuaugaugcc

SEQ ID NO: 1575502 - RNA, 17 nt, Homo sapiens
guucauugaagcuuugu

SEQ ID NO: 1575503 - RNA, 16 nt, Homo sapiens
guuccaccaugagcuc

SEQ ID NO: 1575504 - RNA, 15 nt, Homo sapiens
guuccagacauucuc

SEQ ID NO: 1575505 - RNA, 15 nt, Homo sapiens
guuccaggaaucuca

SEQ ID NO: 1575506 - RNA, 16 nt, Homo sapiens
guuccaggauguggaa

SEQ ID NO: 1575507 - RNA, 23 nt, Homo sapiens
guucccgugacgaggcucaaaaa

SEQ ID NO: 1575508 - RNA, 22 nt, Homo sapiens
guucccuuggccucagaauuca

SEQ ID NO: 1575509 - RNA, 15 nt, Homo sapiens
guuccucccaggaag

SEQ ID NO: 1575510 - RNA, 20 nt, Homo sapiens
guuccucccaggaagcccag

SEQ ID NO: 1575511 - RNA, 14 nt, Homo sapiens
guucgagacuccau

SEQ ID NO: 1575512 - RNA, 20 nt, Homo sapiens
guucgcauggucacacacug

SEQ ID NO: 1575513 - RNA, 21 nt, Homo sapiens
guucgccgcguggaaugugag

SEQ ID NO: 1575514 - RNA, 17 nt, Homo sapiens
guucuaacugcuguuaa

SEQ ID NO: 1575515 - RNA, 17 nt, Homo sapiens
guucuaaggcugugcca

SEQ ID NO: 1575516 - RNA, 16 nt, Homo sapiens
guucucagaaccauuu

SEQ ID NO: 1575517 - RNA, 16 nt, Homo sapiens
guucuccucuaucuua

SEQ ID NO: 1575518 - RNA, 21 nt, Homo sapiens
guucucuucuuuaaagggaug

SEQ ID NO: 1575519 - RNA, 18 nt, Homo sapiens
guucucuuugguguuaca

SEQ ID NO: 1575520 - RNA, 20 nt, Homo sapiens
guucugcacccuacccaguu

SEQ ID NO: 1575521 - RNA, 17 nt, Homo sapiens
guucugguuacuguucu

SEQ ID NO: 1575522 - RNA, 12 nt, Homo sapiens
guucuguucuca

SEQ ID NO: 1575523 - RNA, 20 nt, Homo sapiens
guucuucuuggucucagugu

SEQ ID NO: 1575524 - RNA, 12 nt, Homo sapiens
guucuuguucuu

SEQ ID NO: 1575525 - RNA, 18 nt, Homo sapiens
guucuuuaaaggcaucua

SEQ ID NO: 1575526 - RNA, 14 nt, Homo sapiens
guucuuuccaugaa

SEQ ID NO: 1575527 - RNA, 12 nt, Homo sapiens
guucuuuccucc

SEQ ID NO: 1575528 - RNA, 23 nt, Homo sapiens
guugaaaacuuaaggaagcaaau

SEQ ID NO: 1575529 - RNA, 14 nt, Homo sapiens
guugaaaagcacac

SEQ ID NO: 1575530 - RNA, 16 nt, Homo sapiens
guugaaaccaccguga

SEQ ID NO: 1575531 - RNA, 17 nt, Homo sapiens
guugaauguugcaaugu

SEQ ID NO: 1575532 - RNA, 19 nt, Homo sapiens
guugacuuauaguacauga

SEQ ID NO: 1575533 - RNA, 19 nt, Homo sapiens
guugagaaucacugcucca

SEQ ID NO: 1575534 - RNA, 17 nt, Homo sapiens
guugagauuucagcauu

SEQ ID NO: 1575535 - RNA, 11 nt, Homo sapiens
guugagcaauu

SEQ ID NO: 1575536 - RNA, 18 nt, Homo sapiens
guugagggcaauggacaa

SEQ ID NO: 1575537 - RNA, 23 nt, Homo sapiens
guugauuucagcaccuacagugu

SEQ ID NO: 1575538 - RNA, 16 nt, Homo sapiens
guugcaagaugugaau

SEQ ID NO: 1575539 - RNA, 13 nt, Homo sapiens
guugcacuuugua

SEQ ID NO: 1575540 - RNA, 20 nt, Homo sapiens
guugcauuuaugaugcaguu

SEQ ID NO: 1575541 - RNA, 21 nt, Homo sapiens
guugcauuuaugaugcaguuu

SEQ ID NO: 1575542 - RNA, 22 nt, Homo sapiens
guugccucccccgccuccaguc

SEQ ID NO: 1575543 - RNA, 13 nt, Homo sapiens
guugcucuucuac

SEQ ID NO: 1575544 - RNA, 14 nt, Homo sapiens
guugcugcaucucc

SEQ ID NO: 1575545 - RNA, 15 nt, Homo sapiens
guugcuguaugucuc

SEQ ID NO: 1575546 - RNA, 15 nt, Homo sapiens
guugcuuucuuaucc

SEQ ID NO: 1575547 - RNA, 16 nt, Homo sapiens
guugcuuuuacuucuc

SEQ ID NO: 1575548 - RNA, 10 nt, Homo sapiens
guuggaagag

SEQ ID NO: 1575549 - RNA, 23 nt, Homo sapiens
guuggacuucagucuugccuagg

SEQ ID NO: 1575550 - RNA, 14 nt, Homo sapiens
guuggcacuguaag

SEQ ID NO: 1575551 - RNA, 14 nt, Homo sapiens
uaaaauaguuuaga

SEQ ID NO: 1575552 - RNA, 22 nt, Homo sapiens
uaaaauauccagugagcucuuu

SEQ ID NO: 1575553 - RNA, 21 nt, Homo sapiens
uaaaaucccucuaauuucuca

SEQ ID NO: 1575554 - RNA, 17 nt, Homo sapiens
uaaaaucuaaaauuuca

SEQ ID NO: 1575555 - RNA, 15 nt, Homo sapiens
uaaaauggaauaaca

SEQ ID NO: 1575556 - RNA, 11 nt, Homo sapiens
uaaaauggagg

SEQ ID NO: 1575557 - RNA, 15 nt, Homo sapiens
uaaaauggaugccuu

SEQ ID NO: 1575558 - RNA, 17 nt, Homo sapiens
uaaaauggaugccuuga

SEQ ID NO: 1575559 - RNA, 22 nt, Homo sapiens
uaaaaugguaugccaacuuaag

SEQ ID NO: 1575560 - RNA, 23 nt, Homo sapiens
uaaaauguauuauguccugugag

SEQ ID NO: 1575561 - RNA, 23 nt, Homo sapiens
uaaaauuaauguaauaaagugaa

SEQ ID NO: 1575562 - RNA, 17 nt, Homo sapiens
uaaaauuauacugugug

SEQ ID NO: 1575563 - RNA, 14 nt, Homo sapiens
uaaaauugugaugu

SEQ ID NO: 1575564 - RNA, 13 nt, Homo sapiens
uaaaauugugcau

SEQ ID NO: 1575565 - RNA, 23 nt, Homo sapiens
uaaacacuaaucacaaacugaau

SEQ ID NO: 1575566 - RNA, 16 nt, Homo sapiens
uaaacacuuaucuucu

SEQ ID NO: 1575567 - RNA, 15 nt, Homo sapiens
uaaacaguagugaua

SEQ ID NO: 1575568 - RNA, 11 nt, Homo sapiens
uaaacagugcc

SEQ ID NO: 1575569 - RNA, 23 nt, Homo sapiens
uaaacaucuccccucucaccuca

SEQ ID NO: 1575570 - RNA, 12 nt, Homo sapiens
uaaacaugucac

SEQ ID NO: 1575571 - RNA, 12 nt, Homo sapiens
uaaaccaaaaau

SEQ ID NO: 1575572 - RNA, 17 nt, Homo sapiens
uaaaccaucaucuugcc

SEQ ID NO: 1575573 - RNA, 18 nt, Homo sapiens
uaaacccuuuagugcuuu

SEQ ID NO: 1575574 - RNA, 20 nt, Homo sapiens
uaaaccuagaguuuuaucaa

SEQ ID NO: 1575575 - RNA, 17 nt, Homo sapiens
uaaaccuugucuaugaa

SEQ ID NO: 1575576 - RNA, 13 nt, Homo sapiens
uaaaccuuuccau

SEQ ID NO: 1575577 - RNA, 19 nt, Homo sapiens
uaaacuauuuugagcauua

SEQ ID NO: 1575578 - RNA, 13 nt, Homo sapiens
uaaacucuacuuc

SEQ ID NO: 1575579 - RNA, 12 nt, Homo sapiens
uaaacucucuag

SEQ ID NO: 1575580 - RNA, 16 nt, Homo sapiens
uaaacugaaaauggac

SEQ ID NO: 1575581 - RNA, 12 nt, Homo sapiens
uaaacugauuaa

SEQ ID NO: 1575582 - RNA, 13 nt, Homo sapiens
uaaacugugcacc

SEQ ID NO: 1575583 - RNA, 11 nt, Homo sapiens
uaaacugugua

SEQ ID NO: 1575584 - RNA, 15 nt, Homo sapiens
uaaacuguugggaaa

SEQ ID NO: 1575585 - RNA, 18 nt, Homo sapiens
uaaacuuauuuacaaaua

SEQ ID NO: 1575586 - RNA, 18 nt, Homo sapiens
uaaacuuuccaaaaccuu

SEQ ID NO: 1575587 - RNA, 19 nt, Homo sapiens
uaaagaaagaaugcauucc

SEQ ID NO: 1575588 - RNA, 20 nt, Homo sapiens
uaaagaaauauauaugauau

SEQ ID NO: 1575589 - RNA, 19 nt, Homo sapiens
uaaagaaauuuuaguaguu

SEQ ID NO: 1575590 - RNA, 19 nt, Homo sapiens
uaaagaagaaacuuguaaa

SEQ ID NO: 1575591 - RNA, 16 nt, Homo sapiens
uaaagaagauaaacac

SEQ ID NO: 1575592 - RNA, 12 nt, Homo sapiens
uaaagaauacac

SEQ ID NO: 1575593 - RNA, 12 nt, Homo sapiens
uaaagaauacuu

SEQ ID NO: 1575594 - RNA, 21 nt, Homo sapiens
uaaagaauacuugaacuuguc

SEQ ID NO: 1575595 - RNA, 14 nt, Homo sapiens
uaaagaaugccauu

SEQ ID NO: 1575596 - RNA, 16 nt, Homo sapiens
uaaagacaaauuuugc

SEQ ID NO: 1575597 - RNA, 13 nt, Homo sapiens
uaaagacaaccau

SEQ ID NO: 1575598 - RNA, 14 nt, Homo sapiens
uaaagacuaggaua

SEQ ID NO: 1575599 - RNA, 18 nt, Homo sapiens
uaaagagaaacuuugugc

SEQ ID NO: 1575600 - RNA, 17 nt, Homo sapiens
uaaagagccaguuuauu

SEQ ID NO: 1575601 - RNA, 16 nt, Homo sapiens
uaaagaucacacauca

SEQ ID NO: 1575602 - RNA, 18 nt, Homo sapiens
uaaagaugguccaaaaau

SEQ ID NO: 1575603 - RNA, 23 nt, Homo sapiens
uaaagaugguccaaaaauaguca

SEQ ID NO: 1575604 - RNA, 18 nt, Homo sapiens
uaaagauuuauuuagcua

SEQ ID NO: 1575605 - RNA, 15 nt, Homo sapiens
uaaagauuucuagua

SEQ ID NO: 1575606 - RNA, 13 nt, Homo sapiens
uaaagcauuucag

SEQ ID NO: 1575607 - RNA, 19 nt, Homo sapiens
guauauuuauuucuagcaa

SEQ ID NO: 1575608 - RNA, 17 nt, Homo sapiens
guauauuugguacugua

SEQ ID NO: 1575609 - RNA, 15 nt, Homo sapiens
guaucaggacccaga

SEQ ID NO: 1575610 - RNA, 19 nt, Homo sapiens
guaucaucuuugccaagua

SEQ ID NO: 1575611 - RNA, 20 nt, Homo sapiens
guaucuauuagcagccauau

SEQ ID NO: 1575612 - RNA, 22 nt, Homo sapiens
guaucuucguaacuucauauua

SEQ ID NO: 1575613 - RNA, 21 nt, Homo sapiens
guaucuuucauccuugacuaa

SEQ ID NO: 1575614 - RNA, 21 nt, Homo sapiens
guaucuuuuuuaaacuguaaa

SEQ ID NO: 1575615 - RNA, 18 nt, Homo sapiens
guaugaaagagcaaguga

SEQ ID NO: 1575616 - RNA, 15 nt, Homo sapiens
guaugcaaaccucau

SEQ ID NO: 1575617 - RNA, 21 nt, Homo sapiens
guaugcaaaccucaucuuucu

SEQ ID NO: 1575618 - RNA, 21 nt, Homo sapiens
guaugccuuuaaaucugugau

SEQ ID NO: 1575619 - RNA, 17 nt, Homo sapiens
guauggcuaauaccugu

SEQ ID NO: 1575620 - RNA, 19 nt, Homo sapiens
guauguauuuaaggagaac

SEQ ID NO: 1575621 - RNA, 14 nt, Homo sapiens
guaugucacucugg

SEQ ID NO: 1575622 - RNA, 20 nt, Homo sapiens
guaugucagugucacuggau

SEQ ID NO: 1575623 - RNA, 14 nt, Homo sapiens
guaugucuguuacc

SEQ ID NO: 1575624 - RNA, 18 nt, Homo sapiens
guauguguaaaacaaucu

SEQ ID NO: 1575625 - RNA, 18 nt, Homo sapiens
guaugugugugugugaac

SEQ ID NO: 1575626 - RNA, 16 nt, Homo sapiens
guauguuuguacuugg

SEQ ID NO: 1575627 - RNA, 13 nt, Homo sapiens
guauuaacuauua

SEQ ID NO: 1575628 - RNA, 14 nt, Homo sapiens
guauuaacuauuag

SEQ ID NO: 1575629 - RNA, 15 nt, Homo sapiens
guauuaaguuguuaa

SEQ ID NO: 1575630 - RNA, 17 nt, Homo sapiens
guauuauauaauucaag

SEQ ID NO: 1575631 - RNA, 22 nt, Homo sapiens
guauuauccacaauuauuggca

SEQ ID NO: 1575632 - RNA, 17 nt, Homo sapiens
guauuauuuuacaauca

SEQ ID NO: 1575633 - RNA, 23 nt, Homo sapiens
guauuauuuuuuaauaaacugca

SEQ ID NO: 1575634 - RNA, 22 nt, Homo sapiens
guauucaggcacugagaaugau

SEQ ID NO: 1575635 - RNA, 21 nt, Homo sapiens
guauucuguuugcguacuugu

SEQ ID NO: 1575636 - RNA, 14 nt, Homo sapiens
guauugacaacagu

SEQ ID NO: 1575637 - RNA, 16 nt, Homo sapiens
guauuggaaauggaug

SEQ ID NO: 1575638 - RNA, 21 nt, Homo sapiens
guauugucgguuaccucugca

SEQ ID NO: 1575639 - RNA, 21 nt, Homo sapiens
guauuguuaggaaaugucauc

SEQ ID NO: 1575640 - RNA, 23 nt, Homo sapiens
guauuguuaggagaugucaucaa

SEQ ID NO: 1575641 - RNA, 15 nt, Homo sapiens
guauuuaacaaaaag

SEQ ID NO: 1575642 - RNA, 15 nt, Homo sapiens
guauuuacagacaca

SEQ ID NO: 1575643 - RNA, 15 nt, Homo sapiens
guauuuacagggugg

SEQ ID NO: 1575644 - RNA, 17 nt, Homo sapiens
guauuucaagucucuca

SEQ ID NO: 1575645 - RNA, 20 nt, Homo sapiens
guauuucugauguguucucu

SEQ ID NO: 1575646 - RNA, 23 nt, Homo sapiens
guauuuucuuacacugugucauu

SEQ ID NO: 1575647 - RNA, 21 nt, Homo sapiens
gucaaaaaugauuuaguacuu

SEQ ID NO: 1575648 - RNA, 16 nt, Homo sapiens
gucaaaaggacauuua

SEQ ID NO: 1575649 - RNA, 22 nt, Homo sapiens
gucaaaauuguuuaccauagaa

SEQ ID NO: 1575650 - RNA, 21 nt, Homo sapiens
gucaaagaaggugcugauccu

SEQ ID NO: 1575651 - RNA, 16 nt, Homo sapiens
gucaaauaaacacugu

SEQ ID NO: 1575652 - RNA, 16 nt, Homo sapiens
gucaacaaagugcuuu

SEQ ID NO: 1575653 - RNA, 15 nt, Homo sapiens
gucaacaacuuacac

SEQ ID NO: 1575654 - RNA, 12 nt, Homo sapiens
gucaacauuucu

SEQ ID NO: 1575655 - RNA, 20 nt, Homo sapiens
gucaagaagaggaaagggag

SEQ ID NO: 1575656 - RNA, 21 nt, Homo sapiens
gucaaugauuguguagccaug

SEQ ID NO: 1575657 - RNA, 23 nt, Homo sapiens
gucaauguccuacugagacagca

SEQ ID NO: 1575658 - RNA, 19 nt, Homo sapiens
gucacaauacaguaaguaa

SEQ ID NO: 1575659 - RNA, 12 nt, Homo sapiens
gucacacacuga

SEQ ID NO: 1575660 - RNA, 14 nt, Homo sapiens
gucacagaugaaga

SEQ ID NO: 1575661 - RNA, 14 nt, Homo sapiens
gucaccaugaucac

SEQ ID NO: 1575662 - RNA, 18 nt, Homo sapiens
gucacguuuggugcuucu

SEQ ID NO: 1575663 - RNA, 17 nt, Homo sapiens
gucacucacauugagag

SEQ ID NO: 1575664 - RNA, 16 nt, Homo sapiens
gucacucaccuagaca

SEQ ID NO: 1575665 - RNA, 15 nt, Homo sapiens
gucacuucucacaau

SEQ ID NO: 1575666 - RNA, 17 nt, Homo sapiens
gucacuuuuuggccaug

SEQ ID NO: 1575667 - RNA, 22 nt, Homo sapiens
gucagaaugugaaaaaggaaua

SEQ ID NO: 1575668 - RNA, 22 nt, Homo sapiens
gucagacucuuggcuacaguga

SEQ ID NO: 1575669 - RNA, 18 nt, Homo sapiens
gucagacuuccaaauccu

SEQ ID NO: 1575670 - RNA, 21 nt, Homo sapiens
gucagaguccagugcucugcc

SEQ ID NO: 1575671 - RNA, 18 nt, Homo sapiens
gucagauuaucuacuuag

SEQ ID NO: 1575672 - RNA, 20 nt, Homo sapiens
gucagauuaucuacuuagau

SEQ ID NO: 1575673 - RNA, 16 nt, Homo sapiens
gucagccaagugcaga

SEQ ID NO: 1575674 - RNA, 19 nt, Homo sapiens
gucagccugacucuucccu

SEQ ID NO: 1575675 - RNA, 21 nt, Homo sapiens
gucagcuucucccaagcccac

SEQ ID NO: 1575676 - RNA, 22 nt, Homo sapiens
gucaggccuggccucaucucag

SEQ ID NO: 1575677 - RNA, 16 nt, Homo sapiens
gucaggcuggucucaa

SEQ ID NO: 1575678 - RNA, 15 nt, Homo sapiens
gucaguauguggaag

SEQ ID NO: 1575679 - RNA, 11 nt, Homo sapiens
gucaguauuuu

SEQ ID NO: 1575680 - RNA, 15 nt, Homo sapiens
gucagucccuacuua

SEQ ID NO: 1575681 - RNA, 21 nt, Homo sapiens
guaccucucaacauuaccaaa

SEQ ID NO: 1575682 - RNA, 18 nt, Homo sapiens
guaccugcccccaaucca

SEQ ID NO: 1575683 - RNA, 16 nt, Homo sapiens
guaccugguugguccu

SEQ ID NO: 1575684 - RNA, 14 nt, Homo sapiens
guacuauuacuauu

SEQ ID NO: 1575685 - RNA, 23 nt, Homo sapiens
guacucaaguaccaccaagggau

SEQ ID NO: 1575686 - RNA, 22 nt, Homo sapiens
guacucagcauggucuuaugca

SEQ ID NO: 1575687 - RNA, 13 nt, Homo sapiens
guacuccucagac

SEQ ID NO: 1575688 - RNA, 16 nt, Homo sapiens
guacuuauguugcaca

SEQ ID NO: 1575689 - RNA, 15 nt, Homo sapiens
guacuucucacccag

SEQ ID NO: 1575690 - RNA, 19 nt, Homo sapiens
guagaacucacagaaauaa

SEQ ID NO: 1575691 - RNA, 13 nt, Homo sapiens
guagaacuuggau

SEQ ID NO: 1575692 - RNA, 17 nt, Homo sapiens
guagaagguaacucuuu

SEQ ID NO: 1575693 - RNA, 16 nt, Homo sapiens
guagaauaaaugaaga

SEQ ID NO: 1575694 - RNA, 16 nt, Homo sapiens
guagaauauucagaca

SEQ ID NO: 1575695 - RNA, 19 nt, Homo sapiens
guagaggcugggggcucca

SEQ ID NO: 1575696 - RNA, 22 nt, Homo sapiens
guagaguaacgagaagugcuuu

SEQ ID NO: 1575697 - RNA, 15 nt, Homo sapiens
guagauauuaauuaa

SEQ ID NO: 1575698 - RNA, 15 nt, Homo sapiens
guagauuacugaaaa

SEQ ID NO: 1575699 - RNA, 16 nt, Homo sapiens
guagcaaacuuuucac

SEQ ID NO: 1575700 - RNA, 13 nt, Homo sapiens
guagcagcuauau

SEQ ID NO: 1575701 - RNA, 20 nt, Homo sapiens
guagccaucaagcacuuccc

SEQ ID NO: 1575702 - RNA, 19 nt, Homo sapiens
guagccugggcucacugug

SEQ ID NO: 1575703 - RNA, 16 nt, Homo sapiens
guagcucggcaccaac

SEQ ID NO: 1575704 - RNA, 16 nt, Homo sapiens
guagcuggcacuacag

SEQ ID NO: 1575705 - RNA, 12 nt, Homo sapiens
guagcugggauu

SEQ ID NO: 1575706 - RNA, 14 nt, Homo sapiens
guaggaucaccuga

SEQ ID NO: 1575707 - RNA, 15 nt, Homo sapiens
guaggcauauaucac

SEQ ID NO: 1575708 - RNA, 23 nt, Homo sapiens
guaggcuaaaaggcuuccaggcu

SEQ ID NO: 1575709 - RNA, 17 nt, Homo sapiens
guaggucauugcaccua

SEQ ID NO: 1575710 - RNA, 16 nt, Homo sapiens
guaguaaacuuggaac

SEQ ID NO: 1575711 - RNA, 18 nt, Homo sapiens
guaguccaccuucauuua

SEQ ID NO: 1575712 - RNA, 13 nt, Homo sapiens
guaguccaucacc

SEQ ID NO: 1575713 - RNA, 17 nt, Homo sapiens
guaguguccccagccua

SEQ ID NO: 1575714 - RNA, 18 nt, Homo sapiens
guaguucucaggaccugu

SEQ ID NO: 1575715 - RNA, 22 nt, Homo sapiens
guaguuuguuuuagaaccagcc

SEQ ID NO: 1575716 - RNA, 17 nt, Homo sapiens
guauaaauguacaucag

SEQ ID NO: 1575717 - RNA, 19 nt, Homo sapiens
guauaaccugucuauacua

SEQ ID NO: 1575718 - RNA, 15 nt, Homo sapiens
guauaaucuuuucau

SEQ ID NO: 1575719 - RNA, 21 nt, Homo sapiens
guauacuuuuagcuuguaguu

SEQ ID NO: 1575720 - RNA, 21 nt, Homo sapiens
guauaggggcaacuguaugaa

SEQ ID NO: 1575721 - RNA, 23 nt, Homo sapiens
guauaguagaaagacaucugccu

SEQ ID NO: 1575722 - RNA, 21 nt, Homo sapiens
cuucgaaaaucuagaggaaaa

SEQ ID NO: 1575723 - RNA, 19 nt, Homo sapiens
cuucgcacacacccaugua

SEQ ID NO: 1575724 - RNA, 18 nt, Homo sapiens
cuucuacccucaucauca

SEQ ID NO: 1575725 - RNA, 23 nt, Homo sapiens
cuucuaccucuuggcugccuugu

SEQ ID NO: 1575726 - RNA, 12 nt, Homo sapiens
cuucuacugcua

SEQ ID NO: 1575727 - RNA, 17 nt, Homo sapiens
cuucuacuuguaaaaug

SEQ ID NO: 1575728 - RNA, 16 nt, Homo sapiens
cuucuagaacaccugc

SEQ ID NO: 1575729 - RNA, 19 nt, Homo sapiens
cuucuagagcuuagcauau

SEQ ID NO: 1575730 - RNA, 22 nt, Homo sapiens
cuucuaggauagcuaacuguaa

SEQ ID NO: 1575731 - RNA, 16 nt, Homo sapiens
cuucuaguucugccag

SEQ ID NO: 1575732 - RNA, 15 nt, Homo sapiens
cuucuauggggucua

SEQ ID NO: 1575733 - RNA, 20 nt, Homo sapiens
cuucuauuuauuuauuauua

SEQ ID NO: 1575734 - RNA, 11 nt, Homo sapiens
cuucucaggaa

SEQ ID NO: 1575735 - RNA, 16 nt, Homo sapiens
cuucucaucuugugaa

SEQ ID NO: 1575736 - RNA, 15 nt, Homo sapiens
cuucucaugauccaa

SEQ ID NO: 1575737 - RNA, 12 nt, Homo sapiens
cuucucauuucu

SEQ ID NO: 1575738 - RNA, 15 nt, Homo sapiens
cuucuccaucuccug

SEQ ID NO: 1575739 - RNA, 17 nt, Homo sapiens
cuucuccuuacugcauc

SEQ ID NO: 1575740 - RNA, 19 nt, Homo sapiens
cuucucgugacaccaccaa

SEQ ID NO: 1575741 - RNA, 22 nt, Homo sapiens
cuucucuauugggcacagccua

SEQ ID NO: 1575742 - RNA, 19 nt, Homo sapiens
cuucucuccagcugacuaa

SEQ ID NO: 1575743 - RNA, 20 nt, Homo sapiens
cuucucugcaguaaaacaca

SEQ ID NO: 1575744 - RNA, 18 nt, Homo sapiens
cuucugaauaaagcaauu

SEQ ID NO: 1575745 - RNA, 15 nt, Homo sapiens
cuucugccuucucag

SEQ ID NO: 1575746 - RNA, 14 nt, Homo sapiens
cuucuggcucccaa

SEQ ID NO: 1575747 - RNA, 20 nt, Homo sapiens
cuucuguuugaucacuguga

SEQ ID NO: 1575748 - RNA, 20 nt, Homo sapiens
cuggagugcaguggcgugau

SEQ ID NO: 1575749 - RNA, 20 nt, Homo sapiens
cuggagugcgguggcgcaau

SEQ ID NO: 1575750 - RNA, 21 nt, Homo sapiens
cuggaucuaccagcauaaaua

SEQ ID NO: 1575751 - RNA, 20 nt, Homo sapiens
cuggaucucuuaagacagca

SEQ ID NO: 1575752 - RNA, 22 nt, Homo sapiens
cuggaucuuauacccaacacac

SEQ ID NO: 1575753 - RNA, 17 nt, Homo sapiens
cuggauggcccauagac

SEQ ID NO: 1575754 - RNA, 14 nt, Homo sapiens
cuggauguauguaa

SEQ ID NO: 1575755 - RNA, 20 nt, Homo sapiens
cuggaugucaaacaguaaua

SEQ ID NO: 1575756 - RNA, 19 nt, Homo sapiens
cuggaugucugggugaccu

SEQ ID NO: 1575757 - RNA, 15 nt, Homo sapiens
cuggauucacucacu

SEQ ID NO: 1575758 - RNA, 16 nt, Homo sapiens
cuggauugaaagugaa

SEQ ID NO: 1575759 - RNA, 19 nt, Homo sapiens
cuggcaaaugccugacuca

SEQ ID NO: 1575760 - RNA, 22 nt, Homo sapiens
cuggcaacaaaaaguaaugaag

SEQ ID NO: 1575761 - RNA, 14 nt, Homo sapiens
cuggcaacaucuuu

SEQ ID NO: 1575762 - RNA, 15 nt, Homo sapiens
cuggcaacucaaggc

SEQ ID NO: 1575763 - RNA, 19 nt, Homo sapiens
cuggcaagccugucuucag

SEQ ID NO: 1575764 - RNA, 19 nt, Homo sapiens
cuggcaaugggacucugag

SEQ ID NO: 1575765 - RNA, 15 nt, Homo sapiens
cuggcacaguuuucu

SEQ ID NO: 1575766 - RNA, 15 nt, Homo sapiens
cuggcacuacaggca

SEQ ID NO: 1575767 - RNA, 19 nt, Homo sapiens
cuggcacuuagcccaagag

SEQ ID NO: 1575768 - RNA, 20 nt, Homo sapiens
cuggcagagagguaaagggu

SEQ ID NO: 1575769 - RNA, 12 nt, Homo sapiens
cuggcaggcacc

SEQ ID NO: 1575770 - RNA, 21 nt, Homo sapiens
cuggcaucguguauuccauau

SEQ ID NO: 1575771 - RNA, 20 nt, Homo sapiens
cuggccaagcaggcugguuu

SEQ ID NO: 1575772 - RNA, 13 nt, Homo sapiens
cuggccaccagcc

SEQ ID NO: 1575773 - RNA, 19 nt, Homo sapiens
cuggccagggcuuccucaa

SEQ ID NO: 1575774 - RNA, 24 nt, Homo sapiens
cuggccaugccuggagacauauca

SEQ ID NO: 1575775 - RNA, 16 nt, Homo sapiens
cuggcccaaccagaac

SEQ ID NO: 1575776 - RNA, 23 nt, Homo sapiens
cuggcccuguccuggcaucagua

SEQ ID NO: 1575777 - RNA, 12 nt, Homo sapiens
cuggcccugugc

SEQ ID NO: 1575778 - RNA, 17 nt, Homo sapiens
cuggccugaacugagga

SEQ ID NO: 1575779 - RNA, 14 nt, Homo sapiens
cuggcgccucugca

SEQ ID NO: 1575780 - RNA, 16 nt, Homo sapiens
cuggcuacugagucau

SEQ ID NO: 1575781 - RNA, 22 nt, Homo sapiens
cuggcuagaguccucacuccca

SEQ ID NO: 1575782 - RNA, 20 nt, Homo sapiens
cuggcucugcccccuccccc

SEQ ID NO: 1575783 - RNA, 18 nt, Homo sapiens
cuggcugagguuccucug

SEQ ID NO: 1575784 - RNA, 20 nt, Homo sapiens
cuggcuuagugccacccacc

SEQ ID NO: 1575785 - RNA, 14 nt, Homo sapiens
cuggcuuggaacac

SEQ ID NO: 1575786 - RNA, 21 nt, Homo sapiens
cugggaaaauacaagaaccaa

SEQ ID NO: 1575787 - RNA, 19 nt, Homo sapiens
cugggaaaauccacuauga

SEQ ID NO: 1575788 - RNA, 23 nt, Homo sapiens
cugggacaguuuaucaugaagcc

SEQ ID NO: 1575789 - RNA, 16 nt, Homo sapiens
cugggacugugccugg

SEQ ID NO: 1575790 - RNA, 21 nt, Homo sapiens
cugggagaguggaccugugcu

SEQ ID NO: 1575791 - RNA, 16 nt, Homo sapiens
cugggagucacacagu

SEQ ID NO: 1575792 - RNA, 17 nt, Homo sapiens
cugggaucagcuggugu

SEQ ID NO: 1575793 - RNA, 18 nt, Homo sapiens
cugggauggugacuccug

SEQ ID NO: 1575794 - RNA, 22 nt, Homo sapiens
cugggauuaaggcgugagccac

SEQ ID NO: 1575795 - RNA, 21 nt, Homo sapiens
cugggauuacaggugugagcc

SEQ ID NO: 1575796 - RNA, 23 nt, Homo sapiens
cugggcagaccccucuaccuccu

SEQ ID NO: 1575797 - RNA, 21 nt, Homo sapiens
cugggcauuuggugagaguca

SEQ ID NO: 1575798 - RNA, 10 nt, Homo sapiens
cugggccaug

SEQ ID NO: 1575799 - RNA, 18 nt, Homo sapiens
cugggccauguccaaaga

SEQ ID NO: 1575800 - RNA, 22 nt, Homo sapiens
cugggccccaccaccuaggcca

SEQ ID NO: 1575801 - RNA, 17 nt, Homo sapiens
cugggcuauugcugcug

SEQ ID NO: 1575802 - RNA, 12 nt, Homo sapiens
cugggcucucca

SEQ ID NO: 1575803 - RNA, 19 nt, Homo sapiens
cuggggaaacaacauuuau

SEQ ID NO: 1575804 - RNA, 19 nt, Homo sapiens
cuggggaauauacgugcuu

SEQ ID NO: 1575805 - RNA, 17 nt, Homo sapiens
cuggggaccuggcacug

SEQ ID NO: 1575806 - RNA, 19 nt, Homo sapiens
cuggggaggcccuagggga

SEQ ID NO: 1575807 - RNA, 20 nt, Homo sapiens
cuggggagugguuaggcagc

SEQ ID NO: 1575808 - RNA, 17 nt, Homo sapiens
cuggggcagaaacacuc

SEQ ID NO: 1575809 - RNA, 23 nt, Homo sapiens
cuggggcagacaauaaacccuca

SEQ ID NO: 1575810 - RNA, 19 nt, Homo sapiens
cuggggcaggucacuuuac

SEQ ID NO: 1575811 - RNA, 15 nt, Homo sapiens
cuggggccacccagc

SEQ ID NO: 1575812 - RNA, 18 nt, Homo sapiens
cuggggccccaucuugau

SEQ ID NO: 1575813 - RNA, 19 nt, Homo sapiens
cuggggucacccaaccuga

SEQ ID NO: 1575814 - RNA, 16 nt, Homo sapiens
cugggguccauucucu

SEQ ID NO: 1575815 - RNA, 16 nt, Homo sapiens
cugggguugccagagg

SEQ ID NO: 1575816 - RNA, 20 nt, Homo sapiens
cuggguggcuuaugagagag

SEQ ID NO: 1575817 - RNA, 18 nt, Homo sapiens
cuggguuucuagagguca

SEQ ID NO: 1575818 - RNA, 22 nt, Homo sapiens
cugguaaaagcaccauugugaa

SEQ ID NO: 1575819 - RNA, 16 nt, Homo sapiens
cugguaacugcagaaa

SEQ ID NO: 1575820 - RNA, 16 nt, Homo sapiens
cugguauuguucucac

SEQ ID NO: 1575821 - RNA, 15 nt, Homo sapiens
cuggucuguggguca

SEQ ID NO: 1575822 - RNA, 16 nt, Homo sapiens
cuggugcaaauucaga

SEQ ID NO: 1575823 - RNA, 18 nt, Homo sapiens
cuggugcagucauuauga

SEQ ID NO: 1575824 - RNA, 22 nt, Homo sapiens
cugguggcacaggaguguccuc

SEQ ID NO: 1575825 - RNA, 20 nt, Homo sapiens
cugguggcaccagaugcaac

SEQ ID NO: 1575826 - RNA, 18 nt, Homo sapiens
cuggugguggcucgggag

SEQ ID NO: 1575827 - RNA, 15 nt, Homo sapiens
cuggugugaccugag

SEQ ID NO: 1575828 - RNA, 17 nt, Homo sapiens
cugguguugacuggacu

SEQ ID NO: 1575829 - RNA, 20 nt, Homo sapiens
cugguucucaucuuucuuga

SEQ ID NO: 1575830 - RNA, 14 nt, Homo sapiens
cugguucuugcaaa

SEQ ID NO: 1575831 - RNA, 23 nt, Homo sapiens
cugguugaacucugguggcacag

SEQ ID NO: 1575832 - RNA, 18 nt, Homo sapiens
cugguugugggcacuggc

SEQ ID NO: 1575833 - RNA, 16 nt, Homo sapiens
cugguuuuacagagcu

SEQ ID NO: 1575834 - RNA, 15 nt, Homo sapiens
cugguuuucugccaa

SEQ ID NO: 1575835 - RNA, 16 nt, Homo sapiens
cugguuuucugccaau

SEQ ID NO: 1575836 - RNA, 13 nt, Homo sapiens
cuguaaaaugcac

SEQ ID NO: 1575837 - RNA, 14 nt, Homo sapiens
cuguaaaaugcacc

SEQ ID NO: 1575838 - RNA, 23 nt, Homo sapiens
cuguaaaauggaggccauugugu

SEQ ID NO: 1575839 - RNA, 15 nt, Homo sapiens
cuguaaacuguguau

SEQ ID NO: 1575840 - RNA, 14 nt, Homo sapiens
cuguaaacuuccaa

SEQ ID NO: 1575841 - RNA, 15 nt, Homo sapiens
cuguaaacuuggaau

SEQ ID NO: 1575842 - RNA, 19 nt, Homo sapiens
cuguaaauauuuuucacau

SEQ ID NO: 1575843 - RNA, 19 nt, Homo sapiens
cuguaagauaauguugcuu

SEQ ID NO: 1575844 - RNA, 20 nt, Homo sapiens
cuguaauauuuacaauguau

SEQ ID NO: 1575845 - RNA, 22 nt, Homo sapiens
cuuaauagcuauacauuaaucc

SEQ ID NO: 1575846 - RNA, 22 nt, Homo sapiens
cuuaauauaaauucacuuucau

SEQ ID NO: 1575847 - RNA, 19 nt, Homo sapiens
cuuaauauuucuucaaaua

SEQ ID NO: 1575848 - RNA, 19 nt, Homo sapiens
cuuaauccaauauuuugcc

SEQ ID NO: 1575849 - RNA, 13 nt, Homo sapiens
cuuaaucuaaucu

SEQ ID NO: 1575850 - RNA, 23 nt, Homo sapiens
cuuaaucuucagaggugcuaaau

SEQ ID NO: 1575851 - RNA, 13 nt, Homo sapiens
cuuaaucuugaua

SEQ ID NO: 1575852 - RNA, 19 nt, Homo sapiens
cuuaauguugaaugcugcu

SEQ ID NO: 1575853 - RNA, 22 nt, Homo sapiens
cuuaauguuucuuagagccaag

SEQ ID NO: 1575854 - RNA, 18 nt, Homo sapiens
cuuaauuuauuucuuaac

SEQ ID NO: 1575855 - RNA, 17 nt, Homo sapiens
cuuaauuuucccaauga

SEQ ID NO: 1575856 - RNA, 16 nt, Homo sapiens
cuuacaucauguguug

SEQ ID NO: 1575857 - RNA, 21 nt, Homo sapiens
cuuaccagaucuaauauugac

SEQ ID NO: 1575858 - RNA, 17 nt, Homo sapiens
cuuaccaggcaccaaaa

SEQ ID NO: 1575859 - RNA, 18 nt, Homo sapiens
cuuacuguagccucagau

SEQ ID NO: 1575860 - RNA, 20 nt, Homo sapiens
cuuacugucuucuucauguc

SEQ ID NO: 1575861 - RNA, 21 nt, Homo sapiens
cuuacugucuucuucauguca

SEQ ID NO: 1575862 - RNA, 14 nt, Homo sapiens
cuuacuguugcaua

SEQ ID NO: 1575863 - RNA, 23 nt, Homo sapiens
cuuacuuuggugaccccauacau

SEQ ID NO: 1575864 - RNA, 22 nt, Homo sapiens
cuuagaauuuguuucaucuauu

SEQ ID NO: 1575865 - RNA, 23 nt, Homo sapiens
cuuagagccaggcacacacugug

SEQ ID NO: 1575866 - RNA, 19 nt, Homo sapiens
cuuagauguuccaguaauc

SEQ ID NO: 1575867 - RNA, 18 nt, Homo sapiens
cuuagauuuaacauauac

SEQ ID NO: 1575868 - RNA, 20 nt, Homo sapiens
ccuguguuucauuacuugaa

SEQ ID NO: 1575869 - RNA, 23 nt, Homo sapiens
ccuguuaccuacuuugacuuuuu

SEQ ID NO: 1575870 - RNA, 20 nt, Homo sapiens
ccuguuccccaaggacucuu

SEQ ID NO: 1575871 - RNA, 17 nt, Homo sapiens
ccuguugguuagauuca

SEQ ID NO: 1575872 - RNA, 16 nt, Homo sapiens
ccuuaaaaaugcacac

SEQ ID NO: 1575873 - RNA, 13 nt, Homo sapiens
ccuuaaggcucuu

SEQ ID NO: 1575874 - RNA, 17 nt, Homo sapiens
ccuuaauccuauuuuca

SEQ ID NO: 1575875 - RNA, 21 nt, Homo sapiens
ccuuacaacgccgagugcacu

SEQ ID NO: 1575876 - RNA, 14 nt, Homo sapiens
ccuuacucaccucu

SEQ ID NO: 1575877 - RNA, 16 nt, Homo sapiens
ccuuacucaccucucu

SEQ ID NO: 1575878 - RNA, 19 nt, Homo sapiens
ccuuagaaaacaaguauug

SEQ ID NO: 1575879 - RNA, 18 nt, Homo sapiens
ccuuagcccugucugcua

SEQ ID NO: 1575880 - RNA, 15 nt, Homo sapiens
ccuuaggaaaaacau

SEQ ID NO: 1575881 - RNA, 14 nt, Homo sapiens
ccuuaggugugagg

SEQ ID NO: 1575882 - RNA, 16 nt, Homo sapiens
ccuuagguucuuucug

SEQ ID NO: 1575883 - RNA, 12 nt, Homo sapiens
ccuuaugacucc

SEQ ID NO: 1575884 - RNA, 20 nt, Homo sapiens
ccuuauuuaccuagugcaaa

SEQ ID NO: 1575885 - RNA, 23 nt, Homo sapiens
ccuuauuuugugugcuuucccag

SEQ ID NO: 1575886 - RNA, 15 nt, Homo sapiens
ccuucaauacuuaaa

SEQ ID NO: 1575887 - RNA, 21 nt, Homo sapiens
ccuucacgauuaacugugaaa

SEQ ID NO: 1575888 - RNA, 17 nt, Homo sapiens
ccuucaugaucaucaca

SEQ ID NO: 1575889 - RNA, 22 nt, Homo sapiens
ccuucaugaucaucacaaucau

SEQ ID NO: 1575890 - RNA, 20 nt, Homo sapiens
ccuucauuaacaaaauguau

SEQ ID NO: 1575891 - RNA, 20 nt, Homo sapiens
ccuucauuaaugaugaucuu

SEQ ID NO: 1575892 - RNA, 21 nt, Homo sapiens
ccuucauuuaacucuuugaaa

SEQ ID NO: 1575893 - RNA, 12 nt, Homo sapiens
ccuuccacugag

SEQ ID NO: 1575894 - RNA, 18 nt, Homo sapiens
ccuuccaggugauucugu

SEQ ID NO: 1575895 - RNA, 17 nt, Homo sapiens
ccuuccauuuucauucu

SEQ ID NO: 1575896 - RNA, 15 nt, Homo sapiens
ccuuccccucucuca

SEQ ID NO: 1575897 - RNA, 18 nt, Homo sapiens
ccuucccucucaugacuu

SEQ ID NO: 1575898 - RNA, 16 nt, Homo sapiens
ccuuccucccauuucc

SEQ ID NO: 1575899 - RNA, 18 nt, Homo sapiens
ccuuccucccauuuccca

SEQ ID NO: 1575900 - RNA, 22 nt, Homo sapiens
ccuuccucucucucuuccucuu

SEQ ID NO: 1575901 - RNA, 21 nt, Homo sapiens
ccuuccucugauuuacauuca

SEQ ID NO: 1575902 - RNA, 15 nt, Homo sapiens
ccuuccugagcuuua

SEQ ID NO: 1575903 - RNA, 15 nt, Homo sapiens
ccuucuaggucacuu

SEQ ID NO: 1575904 - RNA, 14 nt, Homo sapiens
ccuucucaccagcu

SEQ ID NO: 1575905 - RNA, 19 nt, Homo sapiens
ccuucuccauccacauggg

SEQ ID NO: 1575906 - RNA, 14 nt, Homo sapiens
ccuucucucaucuc

SEQ ID NO: 1575907 - RNA, 20 nt, Homo sapiens
ccuucucugcagucaagccc

SEQ ID NO: 1575908 - RNA, 20 nt, Homo sapiens
ccuucucugcuccaccacau

SEQ ID NO: 1575909 - RNA, 21 nt, Homo sapiens
ccuucugguucuaacugcugu

SEQ ID NO: 1575910 - RNA, 20 nt, Homo sapiens
ccuucugguuugaaggcgcu

SEQ ID NO: 1575911 - RNA, 17 nt, Homo sapiens
ccuucuuugucuugccc

SEQ ID NO: 1575912 - RNA, 17 nt, Homo sapiens
ccuugagaagcugccau

SEQ ID NO: 1575913 - RNA, 17 nt, Homo sapiens
ccuugaguuucauauau

SEQ ID NO: 1575914 - RNA, 14 nt, Homo sapiens
ccuugcaaccucac

SEQ ID NO: 1575915 - RNA, 13 nt, Homo sapiens
ccuugcaccugca

SEQ ID NO: 1575916 - RNA, 20 nt, Homo sapiens
ccuugcacuccuacugaguu

SEQ ID NO: 1575917 - RNA, 23 nt, Homo sapiens
ccuugcagcggcuccugcaaaag

SEQ ID NO: 1575918 - RNA, 13 nt, Homo sapiens
ccuugcccagaga

SEQ ID NO: 1575919 - RNA, 23 nt, Homo sapiens
ccuugcccagcuuucaaaggaca

SEQ ID NO: 1575920 - RNA, 16 nt, Homo sapiens
ccuuggccucugcuaa

SEQ ID NO: 1575921 - RNA, 16 nt, Homo sapiens
ccuugggcugcuccuc

SEQ ID NO: 1575922 - RNA, 14 nt, Homo sapiens
ccuuguauucugag

SEQ ID NO: 1575923 - RNA, 15 nt, Homo sapiens
ccuugucugcacugu

SEQ ID NO: 1575924 - RNA, 13 nt, Homo sapiens
ccuugugaaggaa

SEQ ID NO: 1575925 - RNA, 21 nt, Homo sapiens
ccuuguucuauugcacaggcu

SEQ ID NO: 1575926 - RNA, 23 nt, Homo sapiens
ccuuuaaaauaauaauaguacua

SEQ ID NO: 1575927 - RNA, 15 nt, Homo sapiens
ccuuuaagaaccuua

SEQ ID NO: 1575928 - RNA, 17 nt, Homo sapiens
ccuuuagugcuuuguga

SEQ ID NO: 1575929 - RNA, 23 nt, Homo sapiens
ccuuucacccucaugaaaacaca

SEQ ID NO: 1575930 - RNA, 17 nt, Homo sapiens
ccuuucacuaaaacaca

SEQ ID NO: 1575931 - RNA, 17 nt, Homo sapiens
ccuuuccccucccucag

SEQ ID NO: 1575932 - RNA, 15 nt, Homo sapiens
ccuuuccuacaguug

SEQ ID NO: 1575933 - RNA, 19 nt, Homo sapiens
ccuuuccuuccaucccuac

SEQ ID NO: 1575934 - RNA, 18 nt, Homo sapiens
ccuuucuaaccuucacga

SEQ ID NO: 1575935 - RNA, 18 nt, Homo sapiens
ccuuucuucagacacuga

SEQ ID NO: 1575936 - RNA, 14 nt, Homo sapiens
ccuuucuuugccuc

SEQ ID NO: 1575937 - RNA, 21 nt, Homo sapiens
ccuuugaaaccugcucuguag

SEQ ID NO: 1575938 - RNA, 15 nt, Homo sapiens
ccuuugacucugggg

SEQ ID NO: 1575939 - RNA, 22 nt, Homo sapiens
ccuuugagcugcugacugccaa

SEQ ID NO: 1575940 - RNA, 15 nt, Homo sapiens
ccuuugauguggaug

SEQ ID NO: 1575941 - RNA, 20 nt, Homo sapiens
ccuuuggacuugucccggga

SEQ ID NO: 1575942 - RNA, 24 nt, Homo sapiens
ccuuugggcccagggacaccagcc

SEQ ID NO: 1575943 - RNA, 14 nt, Homo sapiens
ccuuugucccagaa

SEQ ID NO: 1575944 - RNA, 17 nt, Homo sapiens
ccuuuguuggagucaaa

SEQ ID NO: 1575945 - RNA, 14 nt, Homo sapiens
ccuuuuacauauuu

SEQ ID NO: 1575946 - RNA, 22 nt, Homo sapiens
ccuuuuagggaauaauauucaa

SEQ ID NO: 1575947 - RNA, 14 nt, Homo sapiens
ccuuuucaaaaccu

SEQ ID NO: 1575948 - RNA, 22 nt, Homo sapiens
ccuuuucucacaaaaaggcaaa

SEQ ID NO: 1575949 - RNA, 19 nt, Homo sapiens
ccuuuugaaugaugccuuu

SEQ ID NO: 1575950 - RNA, 13 nt, Homo sapiens
ccuuuuucaauga

SEQ ID NO: 1575951 - RNA, 22 nt, Homo sapiens
ccuuuuucuucacuuacaagaa

SEQ ID NO: 1575952 - RNA, 17 nt, Homo sapiens
ccuuuuuucaauaugca

SEQ ID NO: 1575953 - RNA, 17 nt, Homo sapiens
cgaagggggucaaagga

SEQ ID NO: 1575954 - RNA, 21 nt, Homo sapiens
cgaauauuuucaguaauguua

SEQ ID NO: 1575955 - RNA, 15 nt, Homo sapiens
cgacaggagcacugc

SEQ ID NO: 1575956 - RNA, 19 nt, Homo sapiens
cgacccuugagaagcugcc

SEQ ID NO: 1575957 - RNA, 14 nt, Homo sapiens
cgacugaaacugga

SEQ ID NO: 1575958 - RNA, 21 nt, Homo sapiens
cgagaucaugccauugcauuc

SEQ ID NO: 1575959 - RNA, 20 nt, Homo sapiens
cgagcuguuaccauucacaa

SEQ ID NO: 1575960 - RNA, 23 nt, Homo sapiens
cgaggaaaggauuuuaccaaagc

SEQ ID NO: 1575961 - RNA, 13 nt, Homo sapiens
cgaguagggcuau

SEQ ID NO: 1575962 - RNA, 15 nt, Homo sapiens
cgagugcacugcauu

SEQ ID NO: 1575963 - RNA, 21 nt, Homo sapiens
cgauauaauuuuauuacauau

SEQ ID NO: 1575964 - RNA, 22 nt, Homo sapiens
cgaucaaguuguugacugugau

SEQ ID NO: 1575965 - RNA, 13 nt, Homo sapiens
cgaucucagcuca

SEQ ID NO: 1575966 - RNA, 15 nt, Homo sapiens
cgaucucuccuggcc

SEQ ID NO: 1575967 - RNA, 22 nt, Homo sapiens
cgauugaaauuuugcaccagcg

SEQ ID NO: 1575968 - RNA, 19 nt, Homo sapiens
cgauugcaggagucccugc

SEQ ID NO: 1575969 - RNA, 15 nt, Homo sapiens
cgcaaagacaucaaa

SEQ ID NO: 1575970 - RNA, 11 nt, Homo sapiens
cgcacagugug

SEQ ID NO: 1575971 - RNA, 13 nt, Homo sapiens
cgcacagugugag

SEQ ID NO: 1575972 - RNA, 19 nt, Homo sapiens
cgcagagguguaggggugg

SEQ ID NO: 1575973 - RNA, 17 nt, Homo sapiens
cgcaggagccauugcuc

SEQ ID NO: 1575974 - RNA, 12 nt, Homo sapiens
cgcagucucuua

SEQ ID NO: 1575975 - RNA, 20 nt, Homo sapiens
cgccaacauggcacauguau

SEQ ID NO: 1575976 - RNA, 16 nt, Homo sapiens
cgccaagcaggacagu

SEQ ID NO: 1575977 - RNA, 11 nt, Homo sapiens
cgccagacucg

SEQ ID NO: 1575978 - RNA, 14 nt, Homo sapiens
cgccagacuuccca

SEQ ID NO: 1575979 - RNA, 13 nt, Homo sapiens
cgccagcugggag

SEQ ID NO: 1575980 - RNA, 18 nt, Homo sapiens
cgccauucuccugccuca

SEQ ID NO: 1575981 - RNA, 20 nt, Homo sapiens
cgcccaaacuggagugcagu

SEQ ID NO: 1575982 - RNA, 19 nt, Homo sapiens
cgcccggccucagugccuu

SEQ ID NO: 1575983 - RNA, 18 nt, Homo sapiens
ccucuuuccuugucccag

SEQ ID NO: 1575984 - RNA, 20 nt, Homo sapiens
ccucuuuuuccuccuggaca

SEQ ID NO: 1575985 - RNA, 20 nt, Homo sapiens
ccugaaaauaacagaauucu

SEQ ID NO: 1575986 - RNA, 22 nt, Homo sapiens
ccugaaacccgcccucaggggc

SEQ ID NO: 1575987 - RNA, 12 nt, Homo sapiens
ccugaaauccag

SEQ ID NO: 1575988 - RNA, 15 nt, Homo sapiens
ccugaaaugacauuu

SEQ ID NO: 1575989 - RNA, 18 nt, Homo sapiens
ccugaaaugacauuucac

SEQ ID NO: 1575990 - RNA, 17 nt, Homo sapiens
ccugaaauuuuaaugaa

SEQ ID NO: 1575991 - RNA, 21 nt, Homo sapiens
ccugaacagcccucucucuca

SEQ ID NO: 1575992 - RNA, 13 nt, Homo sapiens
ccugaacucagaa

SEQ ID NO: 1575993 - RNA, 12 nt, Homo sapiens
ccugaacuucac

SEQ ID NO: 1575994 - RNA, 21 nt, Homo sapiens
ccugaagauggagccucagga

SEQ ID NO: 1575995 - RNA, 12 nt, Homo sapiens
ccugaaggcaca

SEQ ID NO: 1575996 - RNA, 19 nt, Homo sapiens
ccugaaguggaaugacuga

SEQ ID NO: 1575997 - RNA, 18 nt, Homo sapiens
ccugaaguugcugcugug

SEQ ID NO: 1575998 - RNA, 23 nt, Homo sapiens
ccugaaucugcugagaggcacca

SEQ ID NO: 1575999 - RNA, 14 nt, Homo sapiens
ccugaaucugugca

SEQ ID NO: 1576000 - RNA, 17 nt, Homo sapiens
ccugacacuccuuucag

SEQ ID NO: 1576001 - RNA, 12 nt, Homo sapiens
ccugaccccagu

SEQ ID NO: 1576002 - RNA, 22 nt, Homo sapiens
ccugacccucaucuuucuucca

SEQ ID NO: 1576003 - RNA, 15 nt, Homo sapiens
ccugacccugcuccu

SEQ ID NO: 1576004 - RNA, 23 nt, Homo sapiens
ccugaccuccuuuaugguuaaua

SEQ ID NO: 1576005 - RNA, 12 nt, Homo sapiens
ccugacuuccac

SEQ ID NO: 1576006 - RNA, 22 nt, Homo sapiens
ccugacuuuuauuuugccaaaa

SEQ ID NO: 1576007 - RNA, 18 nt, Homo sapiens
ccugagaagaaguggcug

SEQ ID NO: 1576008 - RNA, 14 nt, Homo sapiens
ccugagcacacugc

SEQ ID NO: 1576009 - RNA, 16 nt, Homo sapiens
ccugagccacagaaag

SEQ ID NO: 1576010 - RNA, 22 nt, Homo sapiens
ccugagccccuuauucccgcuc

SEQ ID NO: 1576011 - RNA, 18 nt, Homo sapiens
ccugaggaaaaguccaca

SEQ ID NO: 1576012 - RNA, 15 nt, Homo sapiens
ccugaggaagaugac

SEQ ID NO: 1576013 - RNA, 11 nt, Homo sapiens
ccugaggucag

SEQ ID NO: 1576014 - RNA, 13 nt, Homo sapiens
ccugaggugggag

SEQ ID NO: 1576015 - RNA, 15 nt, Homo sapiens
ccugagguuugccag

SEQ ID NO: 1576016 - RNA, 22 nt, Homo sapiens
ccugagguuugccagcauuuag

SEQ ID NO: 1576017 - RNA, 14 nt, Homo sapiens
ccugaguuucucuc

SEQ ID NO: 1576018 - RNA, 16 nt, Homo sapiens
ccugauagaagugcau

SEQ ID NO: 1576019 - RNA, 19 nt, Homo sapiens
ccugauagaagugcauucu

SEQ ID NO: 1576020 - RNA, 13 nt, Homo sapiens
ccugaugagauuu

SEQ ID NO: 1576021 - RNA, 21 nt, Homo sapiens
ccugauggccuuuggacccag

SEQ ID NO: 1576022 - RNA, 21 nt, Homo sapiens
ccugauugaucacacaguguu

SEQ ID NO: 1576023 - RNA, 20 nt, Homo sapiens
ccugcaagacagcacaggca

SEQ ID NO: 1576024 - RNA, 16 nt, Homo sapiens
ccugcaaucccagcua

SEQ ID NO: 1576025 - RNA, 15 nt, Homo sapiens
ccugcacacacaugc

SEQ ID NO: 1576026 - RNA, 17 nt, Homo sapiens
ccugcacacacaugcau

SEQ ID NO: 1576027 - RNA, 22 nt, Homo sapiens
ccugcacagaucgauaccuuuc

SEQ ID NO: 1576028 - RNA, 17 nt, Homo sapiens
ccugcacguugugcaca

SEQ ID NO: 1576029 - RNA, 21 nt, Homo sapiens
ccugcacguugugcacaugua

SEQ ID NO: 1576030 - RNA, 16 nt, Homo sapiens
ccugcaucaucuugaa

SEQ ID NO: 1576031 - RNA, 13 nt, Homo sapiens
ccugcauuaacug

SEQ ID NO: 1576032 - RNA, 21 nt, Homo sapiens
ccugcauuguaaauagguucu

SEQ ID NO: 1576033 - RNA, 23 nt, Homo sapiens
ccugccaaaugaauaagacaaca

SEQ ID NO: 1576034 - RNA, 15 nt, Homo sapiens
ccugccacaguucac

SEQ ID NO: 1576035 - RNA, 15 nt, Homo sapiens
ccugccaggcacaca

SEQ ID NO: 1576036 - RNA, 14 nt, Homo sapiens
ccugcccaaugaga

SEQ ID NO: 1576037 - RNA, 15 nt, Homo sapiens
ccugcccaccaagaa

SEQ ID NO: 1576038 - RNA, 14 nt, Homo sapiens
ccugcccagacuga

SEQ ID NO: 1576039 - RNA, 19 nt, Homo sapiens
ccugcccccgcucccgcuc

SEQ ID NO: 1576040 - RNA, 14 nt, Homo sapiens
ccugccucacuccu

SEQ ID NO: 1576041 - RNA, 13 nt, Homo sapiens
ccugcggaugcau

SEQ ID NO: 1576042 - RNA, 21 nt, Homo sapiens
ccugcguagaagauauggaag

SEQ ID NO: 1576043 - RNA, 18 nt, Homo sapiens
ccugcgugggggccaguc

SEQ ID NO: 1576044 - RNA, 21 nt, Homo sapiens
ccugcuggggaagaacagccc

SEQ ID NO: 1576045 - RNA, 22 nt, Homo sapiens
ccugcuuuccuaucuagcauuu

SEQ ID NO: 1576046 - RNA, 17 nt, Homo sapiens
ccugcuuuccugcagca

SEQ ID NO: 1576047 - RNA, 22 nt, Homo sapiens
ccuggaaaagggaaaugugacu

SEQ ID NO: 1576048 - RNA, 22 nt, Homo sapiens
ccuggaaauaucaguuacucag

SEQ ID NO: 1576049 - RNA, 18 nt, Homo sapiens
ccuggaaucuacaagcca

SEQ ID NO: 1576050 - RNA, 15 nt, Homo sapiens
ccuggacuacaggag

SEQ ID NO: 1576051 - RNA, 12 nt, Homo sapiens
ccuggacugagc

SEQ ID NO: 1576052 - RNA, 15 nt, Homo sapiens
ccuggacuucuggga

SEQ ID NO: 1576053 - RNA, 18 nt, Homo sapiens
ccuggagacaaggugcua

SEQ ID NO: 1576054 - RNA, 22 nt, Homo sapiens
ccuggagaugcagcuacuggaa

SEQ ID NO: 1576055 - RNA, 24 nt, Homo sapiens
ccuggagcgccacacacugcacau

SEQ ID NO: 1576056 - RNA, 16 nt, Homo sapiens
ccuggaucuaccagca

SEQ ID NO: 1576057 - RNA, 22 nt, Homo sapiens
ccuggcauggugcagggagaca

SEQ ID NO: 1576058 - RNA, 16 nt, Homo sapiens
ccuggccaacauguca

SEQ ID NO: 1576059 - RNA, 14 nt, Homo sapiens
ccuggccaggagcu

SEQ ID NO: 1576060 - RNA, 17 nt, Homo sapiens
ccuggccaggagcucuu

SEQ ID NO: 1576061 - RNA, 18 nt, Homo sapiens
ccuggcccccaaccucag

SEQ ID NO: 1576062 - RNA, 15 nt, Homo sapiens
ccuggccucaucuca

SEQ ID NO: 1576063 - RNA, 16 nt, Homo sapiens
ccuggcuccagucuca

SEQ ID NO: 1576064 - RNA, 16 nt, Homo sapiens
ccuggcuggcaggcac

SEQ ID NO: 1576065 - RNA, 14 nt, Homo sapiens
ccuggcuuugccuc

SEQ ID NO: 1576066 - RNA, 15 nt, Homo sapiens
ccugggacaaccaga

SEQ ID NO: 1576067 - RNA, 14 nt, Homo sapiens
ccugggcaaagccu

SEQ ID NO: 1576068 - RNA, 15 nt, Homo sapiens
ccugggcuggcacag

SEQ ID NO: 1576069 - RNA, 17 nt, Homo sapiens
ccugggcugucugucac

SEQ ID NO: 1576070 - RNA, 22 nt, Homo sapiens
ccugggguucgaaaucagugag

SEQ ID NO: 1576071 - RNA, 18 nt, Homo sapiens
ccugggucacagagugag

SEQ ID NO: 1576072 - RNA, 16 nt, Homo sapiens
ccugggugcaucaaac

SEQ ID NO: 1576073 - RNA, 21 nt, Homo sapiens
ccuggguuccgguuguugaua

SEQ ID NO: 1576074 - RNA, 18 nt, Homo sapiens
ccuggucaacauagugag

SEQ ID NO: 1576075 - RNA, 15 nt, Homo sapiens
ccuggucauuucaaa

SEQ ID NO: 1576076 - RNA, 12 nt, Homo sapiens
ccugguucucau

SEQ ID NO: 1576077 - RNA, 19 nt, Homo sapiens
ccuguaaucccagaacuuu

SEQ ID NO: 1576078 - RNA, 15 nt, Homo sapiens
ccuguaaucccagcu

SEQ ID NO: 1576079 - RNA, 18 nt, Homo sapiens
ccuguaaucucagcacuu

SEQ ID NO: 1576080 - RNA, 12 nt, Homo sapiens
ccuguacauucu

SEQ ID NO: 1576081 - RNA, 16 nt, Homo sapiens
ccuguaccugugcacg

SEQ ID NO: 1576082 - RNA, 15 nt, Homo sapiens
ccugucaacauuugg

SEQ ID NO: 1576083 - RNA, 19 nt, Homo sapiens
ccugucagugaggacucuu

SEQ ID NO: 1576084 - RNA, 13 nt, Homo sapiens
ccugucaguguca

SEQ ID NO: 1576085 - RNA, 17 nt, Homo sapiens
ccugucccaaccccagu

SEQ ID NO: 1576086 - RNA, 22 nt, Homo sapiens
ccugucccaccccuaccucuag

SEQ ID NO: 1576087 - RNA, 16 nt, Homo sapiens
ccugucccauucuaga

SEQ ID NO: 1576088 - RNA, 15 nt, Homo sapiens
ccugucccuugccuc

SEQ ID NO: 1576089 - RNA, 22 nt, Homo sapiens
ccugucuaggucuccucagggu

SEQ ID NO: 1576090 - RNA, 19 nt, Homo sapiens
ccugucuaggugccccuga

SEQ ID NO: 1576091 - RNA, 14 nt, Homo sapiens
ccugucuccagggc

SEQ ID NO: 1576092 - RNA, 14 nt, Homo sapiens
ccugucugucccag

SEQ ID NO: 1576093 - RNA, 12 nt, Homo sapiens
ccugugacaugg

SEQ ID NO: 1576094 - RNA, 13 nt, Homo sapiens
ccugugcaaaaaa

SEQ ID NO: 1576095 - RNA, 17 nt, Homo sapiens
ccugugcuacaauucau

SEQ ID NO: 1576096 - RNA, 20 nt, Homo sapiens
ccuguggccugcucaucacc

SEQ ID NO: 1576097 - RNA, 14 nt, Homo sapiens
ccugugggaguaga

SEQ ID NO: 1576098 - RNA, 21 nt, Homo sapiens
ccuguggggccuggggagccc

SEQ ID NO: 1576099 - RNA, 22 nt, Homo sapiens
ccuguggguguucuuuccugcc

SEQ ID NO: 1576100 - RNA, 14 nt, Homo sapiens
ccuagauaugaaua

SEQ ID NO: 1576101 - RNA, 23 nt, Homo sapiens
ccuagauaugaauauauggcauu

SEQ ID NO: 1576102 - RNA, 17 nt, Homo sapiens
ccuagaugccaaagggg

SEQ ID NO: 1576103 - RNA, 22 nt, Homo sapiens
ccuagcacugccccacaugcau

SEQ ID NO: 1576104 - RNA, 20 nt, Homo sapiens
ccuagcagaggaaaguguaa

SEQ ID NO: 1576105 - RNA, 17 nt, Homo sapiens
ccuagccugcauaucau

SEQ ID NO: 1576106 - RNA, 18 nt, Homo sapiens
ccuagcucucccagugaa

SEQ ID NO: 1576107 - RNA, 21 nt, Homo sapiens
ccuagcuggcucugugagggu

SEQ ID NO: 1576108 - RNA, 20 nt, Homo sapiens
ccuaggauacccagaugcca

SEQ ID NO: 1576109 - RNA, 15 nt, Homo sapiens
ccuaggcuagggugg

SEQ ID NO: 1576110 - RNA, 17 nt, Homo sapiens
ccuaggucaugccuccu

SEQ ID NO: 1576111 - RNA, 17 nt, Homo sapiens
ccuaguccgcugaagau

SEQ ID NO: 1576112 - RNA, 12 nt, Homo sapiens
ccuagucuccac

SEQ ID NO: 1576113 - RNA, 12 nt, Homo sapiens
ccuauaagcuua

SEQ ID NO: 1576114 - RNA, 18 nt, Homo sapiens
ccuauaaggagaguucaa

SEQ ID NO: 1576115 - RNA, 15 nt, Homo sapiens
ccuauacauccacag

SEQ ID NO: 1576116 - RNA, 19 nt, Homo sapiens
ccuauagcagaagcacauu

SEQ ID NO: 1576117 - RNA, 14 nt, Homo sapiens
ccuaucaagcacua

SEQ ID NO: 1576118 - RNA, 12 nt, Homo sapiens
ccuaucuggaag

SEQ ID NO: 1576119 - RNA, 13 nt, Homo sapiens
ccuaucuuccuuc

SEQ ID NO: 1576120 - RNA, 14 nt, Homo sapiens
ccuaugcugcaaua

SEQ ID NO: 1576121 - RNA, 12 nt, Homo sapiens
ccuaugggccag

SEQ ID NO: 1576122 - RNA, 23 nt, Homo sapiens
ccuauggguugucaauaguauua

SEQ ID NO: 1576123 - RNA, 17 nt, Homo sapiens
ccuauugccuccauucu

SEQ ID NO: 1576124 - RNA, 19 nt, Homo sapiens
ccuauugccuccauucucc

SEQ ID NO: 1576125 - RNA, 20 nt, Homo sapiens
ccuauuuccauucaacaaga

SEQ ID NO: 1576126 - RNA, 13 nt, Homo sapiens
ccuauuuccccac

SEQ ID NO: 1576127 - RNA, 19 nt, Homo sapiens
ccucaaaaaucagggccac

SEQ ID NO: 1576128 - RNA, 21 nt, Homo sapiens
ccucaaaacuguaaaaaucau

SEQ ID NO: 1576129 - RNA, 13 nt, Homo sapiens
ccucaaacaacac

SEQ ID NO: 1576130 - RNA, 23 nt, Homo sapiens
ccucaaagaagucggaaugucau

SEQ ID NO: 1576131 - RNA, 14 nt, Homo sapiens
ccucaacaagaaga

SEQ ID NO: 1576132 - RNA, 16 nt, Homo sapiens
ccucaacccaagggga

SEQ ID NO: 1576133 - RNA, 17 nt, Homo sapiens
ccucaagccccauuucc

SEQ ID NO: 1576134 - RNA, 20 nt, Homo sapiens
ccucaagccccauuuccuca

SEQ ID NO: 1576135 - RNA, 21 nt, Homo sapiens
ccucaagccccauuuccucac

SEQ ID NO: 1576136 - RNA, 22 nt, Homo sapiens
ccucacaaaccugaauggucug

SEQ ID NO: 1576137 - RNA, 23 nt, Homo sapiens
ccucacauuuggaugauugucau

SEQ ID NO: 1576138 - RNA, 20 nt, Homo sapiens
ccucacuggggcagacaaua

SEQ ID NO: 1576139 - RNA, 19 nt, Homo sapiens
ccucagaaggccccagaga

SEQ ID NO: 1576140 - RNA, 20 nt, Homo sapiens
ccucagaaggccccagagag

SEQ ID NO: 1576141 - RNA, 19 nt, Homo sapiens
ccucagaagugcaucugga

SEQ ID NO: 1576142 - RNA, 23 nt, Homo sapiens
ccucagacccagggguccaggcc

SEQ ID NO: 1576143 - RNA, 23 nt, Homo sapiens
ccucagacucagagguccaggcc

SEQ ID NO: 1576144 - RNA, 15 nt, Homo sapiens
ccucagaggccacuu

SEQ ID NO: 1576145 - RNA, 12 nt, Homo sapiens
ccucagcacugu

SEQ ID NO: 1576146 - RNA, 18 nt, Homo sapiens
ccucagccuaagaaacac

SEQ ID NO: 1576147 - RNA, 20 nt, Homo sapiens
ccucagcguccugggcucaa

SEQ ID NO: 1576148 - RNA, 18 nt, Homo sapiens
ccucagcucucugggacc

SEQ ID NO: 1576149 - RNA, 17 nt, Homo sapiens
ccucaggcccagcugcu

SEQ ID NO: 1576150 - RNA, 11 nt, Homo sapiens
ccucagggugg

SEQ ID NO: 1576151 - RNA, 21 nt, Homo sapiens
ccucaggguggggggugacag

SEQ ID NO: 1576152 - RNA, 22 nt, Homo sapiens
ccucagucuggcaaugggacuc

SEQ ID NO: 1576153 - RNA, 13 nt, Homo sapiens
ccucagugccuuc

SEQ ID NO: 1576154 - RNA, 12 nt, Homo sapiens
ccucaguuuccu

SEQ ID NO: 1576155 - RNA, 14 nt, Homo sapiens
ccucauccauagca

SEQ ID NO: 1576156 - RNA, 19 nt, Homo sapiens
ccucauccaugcugugcug

SEQ ID NO: 1576157 - RNA, 19 nt, Homo sapiens
ccucaugaaaacacacaua

SEQ ID NO: 1576158 - RNA, 18 nt, Homo sapiens
ccucauggcucuggcaca

SEQ ID NO: 1576159 - RNA, 22 nt, Homo sapiens
ccucauuucaccugcgcugugg

SEQ ID NO: 1576160 - RNA, 12 nt, Homo sapiens
ccuccaccucaa

SEQ ID NO: 1576161 - RNA, 17 nt, Homo sapiens
ccuccagagacacugag

SEQ ID NO: 1576162 - RNA, 22 nt, Homo sapiens
ccuccagggcccgaggugaucc

SEQ ID NO: 1576163 - RNA, 14 nt, Homo sapiens
ccuccagugcaguc

SEQ ID NO: 1576164 - RNA, 19 nt, Homo sapiens
ccuccagugcaguccauuu

SEQ ID NO: 1576165 - RNA, 14 nt, Homo sapiens
ccucccauuuccca

SEQ ID NO: 1576166 - RNA, 14 nt, Homo sapiens
ccuccccacccucc

SEQ ID NO: 1576167 - RNA, 17 nt, Homo sapiens
ccuccccagauaucauu

SEQ ID NO: 1576168 - RNA, 15 nt, Homo sapiens
ccucccggguucaca

SEQ ID NO: 1576169 - RNA, 13 nt, Homo sapiens
ccucccucaggcc

SEQ ID NO: 1576170 - RNA, 17 nt, Homo sapiens
ccucccugccugcuccu

SEQ ID NO: 1576171 - RNA, 22 nt, Homo sapiens
ccuccgccugggucaugggccu

SEQ ID NO: 1576172 - RNA, 13 nt, Homo sapiens
ccuccuacuguau

SEQ ID NO: 1576173 - RNA, 20 nt, Homo sapiens
ccuccucaggcacacagcua

SEQ ID NO: 1576174 - RNA, 17 nt, Homo sapiens
ccuccuccccuagggaa

SEQ ID NO: 1576175 - RNA, 13 nt, Homo sapiens
ccuccucccucaa

SEQ ID NO: 1576176 - RNA, 22 nt, Homo sapiens
ccuccucuucccuuagccucuc

SEQ ID NO: 1576177 - RNA, 16 nt, Homo sapiens
ccuccuuggugccucu

SEQ ID NO: 1576178 - RNA, 15 nt, Homo sapiens
ccuccuuuuggccug

SEQ ID NO: 1576179 - RNA, 13 nt, Homo sapiens
ccucgagauccca

SEQ ID NO: 1576180 - RNA, 20 nt, Homo sapiens
ccucgagaucccaacacugc

SEQ ID NO: 1576181 - RNA, 14 nt, Homo sapiens
ccucgcggucuugg

SEQ ID NO: 1576182 - RNA, 14 nt, Homo sapiens
ccucgcugccagcu

SEQ ID NO: 1576183 - RNA, 20 nt, Homo sapiens
ccucggagagcagcagcacc

SEQ ID NO: 1576184 - RNA, 19 nt, Homo sapiens
ccucgggccccauccucau

SEQ ID NO: 1576185 - RNA, 18 nt, Homo sapiens
ccucuaagcacauuccaa

SEQ ID NO: 1576186 - RNA, 15 nt, Homo sapiens
ccucuagaagccaag

SEQ ID NO: 1576187 - RNA, 15 nt, Homo sapiens
ccucuaggaggagcu

SEQ ID NO: 1576188 - RNA, 20 nt, Homo sapiens
ccucuaguaaauuuaagucc

SEQ ID NO: 1576189 - RNA, 22 nt, Homo sapiens
ccucuaguaaauuuaaguccac

SEQ ID NO: 1576190 - RNA, 20 nt, Homo sapiens
ccucuaguagcugaaaugca

SEQ ID NO: 1576191 - RNA, 18 nt, Homo sapiens
ccucucaggcucuugacu

SEQ ID NO: 1576192 - RNA, 16 nt, Homo sapiens
ccucucaugacuugca

SEQ ID NO: 1576193 - RNA, 13 nt, Homo sapiens
ccucuccacucau

SEQ ID NO: 1576194 - RNA, 19 nt, Homo sapiens
ccucuccaggcauuuagcc

SEQ ID NO: 1576195 - RNA, 18 nt, Homo sapiens
ccucuccuggugcuccaa

SEQ ID NO: 1576196 - RNA, 16 nt, Homo sapiens
ccucucucagugucaa

SEQ ID NO: 1576197 - RNA, 21 nt, Homo sapiens
ccucucucucccaggucccag

SEQ ID NO: 1576198 - RNA, 19 nt, Homo sapiens
ccucucucuucugcuccac

SEQ ID NO: 1576199 - RNA, 21 nt, Homo sapiens
ccucucugagcucugcauuug

SEQ ID NO: 1576200 - RNA, 12 nt, Homo sapiens
ccucucuggaaa

SEQ ID NO: 1576201 - RNA, 21 nt, Homo sapiens
ccucucuggcacuuugaguua

SEQ ID NO: 1576202 - RNA, 12 nt, Homo sapiens
ccucucuuucac

SEQ ID NO: 1576203 - RNA, 17 nt, Homo sapiens
ccucugaauuuaauucu

SEQ ID NO: 1576204 - RNA, 20 nt, Homo sapiens
ccucugagcuuugcauguuc

SEQ ID NO: 1576205 - RNA, 20 nt, Homo sapiens
ccucugccagcgccaaaaca

SEQ ID NO: 1576206 - RNA, 18 nt, Homo sapiens
ccucugcuaccaucucau

SEQ ID NO: 1576207 - RNA, 21 nt, Homo sapiens
ccucugcuaccaucucauuaa

SEQ ID NO: 1576208 - RNA, 12 nt, Homo sapiens
ccucugcuggag

SEQ ID NO: 1576209 - RNA, 19 nt, Homo sapiens
ccucugcuggagaaagcca

SEQ ID NO: 1576210 - RNA, 15 nt, Homo sapiens
ccucuggacagccag

SEQ ID NO: 1576211 - RNA, 19 nt, Homo sapiens
ccucuggacagccagugac

SEQ ID NO: 1576212 - RNA, 21 nt, Homo sapiens
ccucuggcuggcuaacuggaa

SEQ ID NO: 1576213 - RNA, 20 nt, Homo sapiens
ccucugucauaugcagaauu

SEQ ID NO: 1576214 - RNA, 22 nt, Homo sapiens
ccucugugaacugugugugaau

SEQ ID NO: 1576215 - RNA, 11 nt, Homo sapiens
ccucuguggac

SEQ ID NO: 1576216 - RNA, 15 nt, Homo sapiens
ccucuguguaucuca

SEQ ID NO: 1576217 - RNA, 22 nt, Homo sapiens
cauccaggcuggccagugcugc

SEQ ID NO: 1576218 - RNA, 18 nt, Homo sapiens
caucccuuuccugaguca

SEQ ID NO: 1576219 - RNA, 19 nt, Homo sapiens
caucccuuuuucugcuaau

SEQ ID NO: 1576220 - RNA, 15 nt, Homo sapiens
cauccuaacaaugug

SEQ ID NO: 1576221 - RNA, 15 nt, Homo sapiens
caggcgggacagugc

SEQ ID NO: 1576222 - RNA, 17 nt, Homo sapiens
caggcuagagugcaaug

SEQ ID NO: 1576223 - RNA, 21 nt, Homo sapiens
caggcuaucauauauacugua

SEQ ID NO: 1576224 - RNA, 19 nt, Homo sapiens
caggcuccccaucuucucc

SEQ ID NO: 1576225 - RNA, 20 nt, Homo sapiens
cagcaggcacguuaacucga

SEQ ID NO: 1576226 - RNA, 19 nt, Homo sapiens
cagcaggcucaggcacaua

SEQ ID NO: 1576227 - RNA, 20 nt, Homo sapiens
cagcaggcugccagugccug

SEQ ID NO: 1576228 - RNA, 20 nt, Homo sapiens
cagcaggugucuuuaacugu

SEQ ID NO: 1576229 - RNA, 22 nt, Homo sapiens
cacaacucccuuaaggucucca

SEQ ID NO: 1576230 - RNA, 23 nt, Homo sapiens
cacaagaaguucuuguucuucag

SEQ ID NO: 1576231 - RNA, 13 nt, Homo sapiens
cacaagccagacc

SEQ ID NO: 1576232 - RNA, 23 nt, Homo sapiens
cacaagccuccuguaccucagug

SEQ ID NO: 1576233 - RNA, 15 nt, Homo sapiens
cacaaggugauuuca

SEQ ID NO: 1576234 - RNA, 14 nt, Homo sapiens
cacaagugucccug

SEQ ID NO: 1576235 - RNA, 18 nt, Homo sapiens
caaggucuccagagggug

SEQ ID NO: 1576236 - RNA, 21 nt, Homo sapiens
caagguggccuuugugcugcg

SEQ ID NO: 1576237 - RNA, 16 nt, Homo sapiens
caagguugcacagcaa

SEQ ID NO: 1576238 - RNA, 12 nt, Homo sapiens
caaguaauacaa

SEQ ID NO: 1576239 - RNA, 12 nt, Homo sapiens
caaguacuucau

SEQ ID NO: 1576240 - RNA, 19 nt, Homo sapiens
caaguagcugggauuacag

SEQ ID NO: 1576241 - RNA, 21 nt, Homo sapiens
caaguauguuuguacaguaug

SEQ ID NO: 1576242 - RNA, 14 nt, Homo sapiens
auucaagaaugcca

SEQ ID NO: 1576243 - RNA, 18 nt, Homo sapiens
auucacaaaauuuccaca

SEQ ID NO: 1576244 - RNA, 20 nt, Homo sapiens
auucacaauaaaagcuuaaa

SEQ ID NO: 1576245 - RNA, 12 nt, Homo sapiens
auucacauuuag

SEQ ID NO: 1576246 - RNA, 22 nt, Homo sapiens
auucaccuagagucuagaacac

SEQ ID NO: 1576247 - RNA, 23 nt, Homo sapiens
auucacugguuuuacacagagaa

SEQ ID NO: 1576248 - RNA, 16 nt, Homo sapiens
auucacuucauaaucc

SEQ ID NO: 1576249 - RNA, 19 nt, Homo sapiens
auucagaacugagggcucu

SEQ ID NO: 1576250 - RNA, 15 nt, Homo sapiens
auucagccagcuuaa

SEQ ID NO: 1576251 - RNA, 16 nt, Homo sapiens
auucaggcacugagaa

SEQ ID NO: 1576252 - RNA, 18 nt, Homo sapiens
auucagggagaauguugu

SEQ ID NO: 1576253 - RNA, 13 nt, Homo sapiens
auguguauuucau

SEQ ID NO: 1576254 - RNA, 18 nt, Homo sapiens
auguguccccucacucug

SEQ ID NO: 1576255 - RNA, 22 nt, Homo sapiens
auguguccccucacucugucag

SEQ ID NO: 1576256 - RNA, 15 nt, Homo sapiens
auguguccucaggga

SEQ ID NO: 1576257 - RNA, 13 nt, Homo sapiens
augugucuuacca

SEQ ID NO: 1576258 - RNA, 17 nt, Homo sapiens
augugucuuaccagauc

SEQ ID NO: 1576259 - RNA, 16 nt, Homo sapiens
auguguguguguugug

SEQ ID NO: 1576260 - RNA, 16 nt, Homo sapiens
auguguuagcacugau

SEQ ID NO: 1576261 - RNA, 19 nt, Homo sapiens
auguguucucugaucugcc

SEQ ID NO: 1576262 - RNA, 20 nt, Homo sapiens
auguguucucugaucugccc

SEQ ID NO: 1576263 - RNA, 16 nt, Homo sapiens
auguguugaaaaccaa

SEQ ID NO: 1576264 - RNA, 18 nt, Homo sapiens
auguguugccaaaaccaa

SEQ ID NO: 1576265 - RNA, 19 nt, Homo sapiens
auguguuuuucuccagugc

SEQ ID NO: 1576266 - RNA, 21 nt, Homo sapiens
uugaucaggcacaguggcuca

SEQ ID NO: 1576267 - RNA, 17 nt, Homo sapiens
uugaucuuugagcccau

SEQ ID NO: 1576268 - RNA, 18 nt, Homo sapiens
uugauguuuguggccuca

SEQ ID NO: 1576269 - RNA, 13 nt, Homo sapiens
uugauuugcucuu

SEQ ID NO: 1576270 - RNA, 18 nt, Homo sapiens
uugauuuuuacugaggaa

SEQ ID NO: 1576271 - RNA, 20 nt, Homo sapiens
uugcaaagaaaaguuucacc

SEQ ID NO: 1576272 - RNA, 14 nt, Homo sapiens
uugcaaaguacugu

SEQ ID NO: 1576273 - RNA, 16 nt, Homo sapiens
uugcaaauaaaccacu

SEQ ID NO: 1576274 - RNA, 21 nt, Homo sapiens
uugcaaauauugguuaguauu

SEQ ID NO: 1576275 - RNA, 21 nt, Homo sapiens
uugcaaccacugcaauaucuu

SEQ ID NO: 1576276 - RNA, 22 nt, Homo sapiens
uugcaaccucgcuggacucuca

SEQ ID NO: 1576277 - RNA, 13 nt, Homo sapiens
uugcaaggcauuu

SEQ ID NO: 1576278 - RNA, 22 nt, Homo sapiens
uugcacaaacuugugagcauca

SEQ ID NO: 1576279 - RNA, 12 nt, Homo sapiens
uugcacauuaau

SEQ ID NO: 1576280 - RNA, 12 nt, Homo sapiens
uugcaccaaaga

SEQ ID NO: 1576281 - RNA, 11 nt, Homo sapiens
uugcaccagcg

SEQ ID NO: 1576282 - RNA, 14 nt, Homo sapiens
uugcacucaucaua

SEQ ID NO: 1576283 - RNA, 24 nt, Homo sapiens
uugcacuuuuuuguuugaauguua

SEQ ID NO: 1576284 - RNA, 16 nt, Homo sapiens
uugcagauaacaaaca

SEQ ID NO: 1576285 - RNA, 19 nt, Homo sapiens
uugcagcuguaaacauauu

SEQ ID NO: 1576286 - RNA, 17 nt, Homo sapiens
uugcaucugaaagagaa

SEQ ID NO: 1576287 - RNA, 21 nt, Homo sapiens
uugcaucugcacauaggcagu

SEQ ID NO: 1576288 - RNA, 12 nt, Homo sapiens
uugcaugaaauu

SEQ ID NO: 1576289 - RNA, 18 nt, Homo sapiens
uugccaaaauaccagagc

SEQ ID NO: 1576290 - RNA, 22 nt, Homo sapiens
uugccaauagugucauccucac

SEQ ID NO: 1576291 - RNA, 16 nt, Homo sapiens
uugccacuacccccuc

SEQ ID NO: 1576292 - RNA, 16 nt, Homo sapiens
uugccauacagcuuca

SEQ ID NO: 1576293 - RNA, 17 nt, Homo sapiens
uugcccagacuacaggg

SEQ ID NO: 1576294 - RNA, 23 nt, Homo sapiens
uugccccuaggaaggugaaucug

SEQ ID NO: 1576295 - RNA, 12 nt, Homo sapiens
uugccgcuguau

SEQ ID NO: 1576296 - RNA, 18 nt, Homo sapiens
uugccuaacuaacuggca

SEQ ID NO: 1576297 - RNA, 21 nt, Homo sapiens
uugccucugaagccuauguau

SEQ ID NO: 1576298 - RNA, 22 nt, Homo sapiens
uugccuucaucuucacugcaau

SEQ ID NO: 1576299 - RNA, 16 nt, Homo sapiens
uugccuucuaggucac

SEQ ID NO: 1576300 - RNA, 17 nt, Homo sapiens
uugcuaaaaaagcauau

SEQ ID NO: 1576301 - RNA, 14 nt, Homo sapiens
uugcuaaagacaug

SEQ ID NO: 1576302 - RNA, 18 nt, Homo sapiens
uugcuaagaaugucuauu

SEQ ID NO: 1576303 - RNA, 15 nt, Homo sapiens
uugcuaguaccaaaa

SEQ ID NO: 1576304 - RNA, 15 nt, Homo sapiens
uugcuaguacuagua

SEQ ID NO: 1576305 - RNA, 23 nt, Homo sapiens
uugcucgcccagacaccaugugc

SEQ ID NO: 1576306 - RNA, 14 nt, Homo sapiens
uugcugaacucagc

SEQ ID NO: 1576307 - RNA, 16 nt, Homo sapiens
uugcugaauguugcau

SEQ ID NO: 1576308 - RNA, 23 nt, Homo sapiens
uugcugacaaccauuaaagucag

SEQ ID NO: 1576309 - RNA, 22 nt, Homo sapiens
uugcugauaaauauaaccauca

SEQ ID NO: 1576310 - RNA, 21 nt, Homo sapiens
uugcugcaucuccccucagau

SEQ ID NO: 1576311 - RNA, 14 nt, Homo sapiens
uugcugcugugaau

SEQ ID NO: 1576312 - RNA, 18 nt, Homo sapiens
uugcugcuugugaucuca

SEQ ID NO: 1576313 - RNA, 14 nt, Homo sapiens
uugcugcuuuccag

SEQ ID NO: 1576314 - RNA, 18 nt, Homo sapiens
uugcuggggcuuguccua

SEQ ID NO: 1576315 - RNA, 11 nt, Homo sapiens
uugcuguagaa

SEQ ID NO: 1576316 - RNA, 23 nt, Homo sapiens
uugcuguggacuauuauuacaua

SEQ ID NO: 1576317 - RNA, 20 nt, Homo sapiens
uugcugugucuccucucaga

SEQ ID NO: 1576318 - RNA, 13 nt, Homo sapiens
uugcuuaaacccu

SEQ ID NO: 1576319 - RNA, 20 nt, Homo sapiens
uugcuuccugauuaccaguc

SEQ ID NO: 1576320 - RNA, 21 nt, Homo sapiens
uugcuucuagagcuuagcaua

SEQ ID NO: 1576321 - RNA, 13 nt, Homo sapiens
uugcuucuugcca

SEQ ID NO: 1576322 - RNA, 15 nt, Homo sapiens
uugcuucuugccauc

SEQ ID NO: 1576323 - RNA, 21 nt, Homo sapiens
uugcuuuccugcaucucugug

SEQ ID NO: 1576324 - RNA, 15 nt, Homo sapiens
uuggaaaccacuaaa

SEQ ID NO: 1576325 - RNA, 16 nt, Homo sapiens
uuggaaacucaaggaa

SEQ ID NO: 1576326 - RNA, 17 nt, Homo sapiens
uuggaaagagucuccag

SEQ ID NO: 1576327 - RNA, 21 nt, Homo sapiens
uuggaacuauacccgggacca

SEQ ID NO: 1576328 - RNA, 14 nt, Homo sapiens
uuggaagauggcau

SEQ ID NO: 1576329 - RNA, 12 nt, Homo sapiens
uuggaaugcuuu

SEQ ID NO: 1576330 - RNA, 23 nt, Homo sapiens
uuggacuaugauuaucuacagaa

SEQ ID NO: 1576331 - RNA, 13 nt, Homo sapiens
uuggacugucuau

SEQ ID NO: 1576332 - RNA, 15 nt, Homo sapiens
uuggagaaaguauuu

SEQ ID NO: 1576333 - RNA, 21 nt, Homo sapiens
uuggagaccgaagacugggau

SEQ ID NO: 1576334 - RNA, 21 nt, Homo sapiens
uuggagagucagaucuuucuc

SEQ ID NO: 1576335 - RNA, 15 nt, Homo sapiens
uuggagcuguuccau

SEQ ID NO: 1576336 - RNA, 18 nt, Homo sapiens
uuggaggaaaugugcuca

SEQ ID NO: 1576337 - RNA, 13 nt, Homo sapiens
uuggaggcuccaa

SEQ ID NO: 1576338 - RNA, 14 nt, Homo sapiens
uuggagucacugua

SEQ ID NO: 1576339 - RNA, 23 nt, Homo sapiens
uuggagucccaggggcagccaca

SEQ ID NO: 1576340 - RNA, 18 nt, Homo sapiens
uuggauaaguuucuauuc

SEQ ID NO: 1576341 - RNA, 14 nt, Homo sapiens
uuggaugguucuca

SEQ ID NO: 1576342 - RNA, 14 nt, Homo sapiens
uuggauugauaucg

SEQ ID NO: 1576343 - RNA, 12 nt, Homo sapiens
uuggauuugaca

SEQ ID NO: 1576344 - RNA, 16 nt, Homo sapiens
uuggcagccucugaaa

SEQ ID NO: 1576345 - RNA, 16 nt, Homo sapiens
uuggcagcucuacucu

SEQ ID NO: 1576346 - RNA, 16 nt, Homo sapiens
uuggcaguggacucag

SEQ ID NO: 1576347 - RNA, 15 nt, Homo sapiens
uuggcaucuacuuag

SEQ ID NO: 1576348 - RNA, 17 nt, Homo sapiens
uuggcauuaucucuuuc

SEQ ID NO: 1576349 - RNA, 15 nt, Homo sapiens
uuggcauugcaauga

SEQ ID NO: 1576350 - RNA, 12 nt, Homo sapiens
uuggccacagac

SEQ ID NO: 1576351 - RNA, 21 nt, Homo sapiens
uuggcuaaaagacaugcauuu

SEQ ID NO: 1576352 - RNA, 15 nt, Homo sapiens
uuggcucuacccuga

SEQ ID NO: 1576353 - RNA, 21 nt, Homo sapiens
uugggaacggacugguaugua

SEQ ID NO: 1576354 - RNA, 20 nt, Homo sapiens
uugggaauucuugcuguuaa

SEQ ID NO: 1576355 - RNA, 18 nt, Homo sapiens
uugggaggauacagagga

SEQ ID NO: 1576356 - RNA, 19 nt, Homo sapiens
uugggagggauggggaaaa

SEQ ID NO: 1576357 - RNA, 23 nt, Homo sapiens
uugggagggugguucaacaaaga

SEQ ID NO: 1576358 - RNA, 23 nt, Homo sapiens
uugggauugucuuacuguugcau

SEQ ID NO: 1576359 - RNA, 15 nt, Homo sapiens
uugggcccuuugagu

SEQ ID NO: 1576360 - RNA, 17 nt, Homo sapiens
uugggcuccacauugca

SEQ ID NO: 1576361 - RNA, 20 nt, Homo sapiens
uuggggaccugaacuguccu

SEQ ID NO: 1576362 - RNA, 20 nt, Homo sapiens
uuggggcuaauuuaacaaga

SEQ ID NO: 1576363 - RNA, 13 nt, Homo sapiens
uuggggucucuuu

SEQ ID NO: 1576364 - RNA, 18 nt, Homo sapiens
uugguaaaaaugcugcuc

SEQ ID NO: 1576365 - RNA, 20 nt, Homo sapiens
uugguaaaacucacugugau

SEQ ID NO: 1576366 - RNA, 22 nt, Homo sapiens
uugguaagauugcacuguucug

SEQ ID NO: 1576367 - RNA, 15 nt, Homo sapiens
uugguacacaugugu

SEQ ID NO: 1576368 - RNA, 15 nt, Homo sapiens
uuggugauucugaau

SEQ ID NO: 1576369 - RNA, 22 nt, Homo sapiens
uugguucccguguuguaccuga

SEQ ID NO: 1576370 - RNA, 17 nt, Homo sapiens
uugguuggauaagcuau

SEQ ID NO: 1576371 - RNA, 22 nt, Homo sapiens
uugguuguuugguuagugacug

SEQ ID NO: 1576372 - RNA, 18 nt, Homo sapiens
uugguuuaaagaaagugu

SEQ ID NO: 1576373 - RNA, 21 nt, Homo sapiens
uugguuuuguuuucuucacua

SEQ ID NO: 1576374 - RNA, 14 nt, Homo sapiens
uuguaaaauggugu

SEQ ID NO: 1576375 - RNA, 17 nt, Homo sapiens
uuguaaaauuauuucau

SEQ ID NO: 1576376 - RNA, 16 nt, Homo sapiens
uuguaaacuaguacua

SEQ ID NO: 1576377 - RNA, 19 nt, Homo sapiens
uuguaaacuaguacuauua

SEQ ID NO: 1576378 - RNA, 20 nt, Homo sapiens
uuguaaauacacauagcaug

SEQ ID NO: 1576379 - RNA, 16 nt, Homo sapiens
uuguaacuucaaauau

SEQ ID NO: 1576380 - RNA, 12 nt, Homo sapiens
uuguaaggggaa

SEQ ID NO: 1576381 - RNA, 14 nt, Homo sapiens
uuguaauccuguac

SEQ ID NO: 1576382 - RNA, 17 nt, Homo sapiens
uuguaaugcugcacaga

SEQ ID NO: 1576383 - RNA, 15 nt, Homo sapiens
uuguaauggugaaaa

SEQ ID NO: 1576384 - RNA, 21 nt, Homo sapiens
uuguacaugauaagacauuuu

SEQ ID NO: 1576385 - RNA, 14 nt, Homo sapiens
uguaugacagugaa

SEQ ID NO: 1576386 - RNA, 22 nt, Homo sapiens
uguauguuuuaauugcauuuaa

SEQ ID NO: 1576387 - RNA, 19 nt, Homo sapiens
uguauguuuuucuguauaa

SEQ ID NO: 1576388 - RNA, 16 nt, Homo sapiens
uguauuaauaccaaag

SEQ ID NO: 1576389 - RNA, 14 nt, Homo sapiens
uguauuagauauca

SEQ ID NO: 1576390 - RNA, 21 nt, Homo sapiens
uguauucucugagcugugcag

SEQ ID NO: 1576391 - RNA, 17 nt, Homo sapiens
uguauucucuuccucau

SEQ ID NO: 1576392 - RNA, 20 nt, Homo sapiens
uguauugaaguccuccagac

SEQ ID NO: 1576393 - RNA, 13 nt, Homo sapiens
uguauugauucaa

SEQ ID NO: 1576394 - RNA, 21 nt, Homo sapiens
uguauuucugauguguucucu

SEQ ID NO: 1576395 - RNA, 22 nt, Homo sapiens
uguauuuuccuaaugugaucau

SEQ ID NO: 1576396 - RNA, 17 nt, Homo sapiens
ugucaaaacuacugaca

SEQ ID NO: 1576397 - RNA, 17 nt, Homo sapiens
ugucaaauaaacacugu

SEQ ID NO: 1576398 - RNA, 21 nt, Homo sapiens
ugucaagaugaugaugaucuu

SEQ ID NO: 1576399 - RNA, 16 nt, Homo sapiens
ugucaauaaaaccacu

SEQ ID NO: 1576400 - RNA, 15 nt, Homo sapiens
ugucaauaguauuaa

SEQ ID NO: 1576401 - RNA, 21 nt, Homo sapiens
ugucacaaauaaacauaauaa

SEQ ID NO: 1576402 - RNA, 14 nt, Homo sapiens
ugucacagcuuugu

SEQ ID NO: 1576403 - RNA, 22 nt, Homo sapiens
ugucacagucucuacuguuauu

SEQ ID NO: 1576404 - RNA, 17 nt, Homo sapiens
ugucagauuaccaguua

SEQ ID NO: 1576405 - RNA, 15 nt, Homo sapiens
ugucagccaugacca

SEQ ID NO: 1576406 - RNA, 12 nt, Homo sapiens
ugucagccugac

SEQ ID NO: 1576407 - RNA, 15 nt, Homo sapiens
ugucagccuugcuac

SEQ ID NO: 1576408 - RNA, 16 nt, Homo sapiens
ugucaggcuacaaggu

SEQ ID NO: 1576409 - RNA, 14 nt, Homo sapiens
uggccccaugucuc

SEQ ID NO: 1576410 - RNA, 20 nt, Homo sapiens
uggccgggucccugagcucc

SEQ ID NO: 1576411 - RNA, 13 nt, Homo sapiens
uggccuccaaaau

SEQ ID NO: 1576412 - RNA, 15 nt, Homo sapiens
uggccucugugccau

SEQ ID NO: 1576413 - RNA, 21 nt, Homo sapiens
uggccugcugugauuccacua

SEQ ID NO: 1576414 - RNA, 14 nt, Homo sapiens
uggccuggccauuu

SEQ ID NO: 1576415 - RNA, 22 nt, Homo sapiens
uggccugggggaggucagaaca

SEQ ID NO: 1576416 - RNA, 15 nt, Homo sapiens
uggccuucauaucau

SEQ ID NO: 1576417 - RNA, 14 nt, Homo sapiens
uggccuuguaagac

SEQ ID NO: 1576418 - RNA, 14 nt, Homo sapiens
uggcgccucugcaa

SEQ ID NO: 1576419 - RNA, 18 nt, Homo sapiens
uggcgcuuggaucugggg

SEQ ID NO: 1576420 - RNA, 16 nt, Homo sapiens
uggcgggcaccuguag

SEQ ID NO: 1576421 - RNA, 19 nt, Homo sapiens
uggcgugcucagacccaac

SEQ ID NO: 1576422 - RNA, 23 nt, Homo sapiens
uggcguuacugcuugaccaaaga

SEQ ID NO: 1576423 - RNA, 21 nt, Homo sapiens
uggcuaaagagcuuugugaua

SEQ ID NO: 1576424 - RNA, 19 nt, Homo sapiens
uggcuaccucagaaagauu

SEQ ID NO: 1576425 - RNA, 18 nt, Homo sapiens
uggcuauaacagugucuu

SEQ ID NO: 1576426 - RNA, 22 nt, Homo sapiens
uggcucaagucugcacagagca

SEQ ID NO: 1576427 - RNA, 16 nt, Homo sapiens
uggcucacacugagaa

SEQ ID NO: 1576428 - RNA, 14 nt, Homo sapiens
uggcucagugccac

SEQ ID NO: 1576429 - RNA, 16 nt, Homo sapiens
uggaacuuagccauuu

SEQ ID NO: 1576430 - RNA, 17 nt, Homo sapiens
uggaagaggaacagcac

SEQ ID NO: 1576431 - RNA, 23 nt, Homo sapiens
uggaagaggaacagcacugggga

SEQ ID NO: 1576432 - RNA, 15 nt, Homo sapiens
uggaagauggcauaa

SEQ ID NO: 1576433 - RNA, 21 nt, Homo sapiens
uggaagccagggcuugucaca

SEQ ID NO: 1576434 - RNA, 18 nt, Homo sapiens
uggaagcuguguccuugc

SEQ ID NO: 1576435 - RNA, 16 nt, Homo sapiens
uggaaggacacaguga

SEQ ID NO: 1576436 - RNA, 15 nt, Homo sapiens
uggaaguugcaguga

SEQ ID NO: 1576437 - RNA, 22 nt, Homo sapiens
uggaauauaaggaaagcaauaa

SEQ ID NO: 1576438 - RNA, 21 nt, Homo sapiens
uggaauauuguccauugucca

SEQ ID NO: 1576439 - RNA, 22 nt, Homo sapiens
uggaaugaaaaauaaacauucu

SEQ ID NO: 1576440 - RNA, 13 nt, Homo sapiens
uggaaugacugaa

SEQ ID NO: 1576441 - RNA, 15 nt, Homo sapiens
uggaaugacugaaag

SEQ ID NO: 1576442 - RNA, 17 nt, Homo sapiens
uggaauguacaugucaa

SEQ ID NO: 1576443 - RNA, 14 nt, Homo sapiens
uggaaugugccaca

SEQ ID NO: 1576444 - RNA, 14 nt, Homo sapiens
uggaauguuggaua

SEQ ID NO: 1576445 - RNA, 14 nt, Homo sapiens
uggaauucuacugg

SEQ ID NO: 1576446 - RNA, 15 nt, Homo sapiens
uggaauugacucaaa

SEQ ID NO: 1576447 - RNA, 19 nt, Homo sapiens
guccgccgcaccagccacc

SEQ ID NO: 1576448 - RNA, 16 nt, Homo sapiens
guccuaaauaucucaa

SEQ ID NO: 1576449 - RNA, 15 nt, Homo sapiens
guccuagacaaacca

SEQ ID NO: 1576450 - RNA, 12 nt, Homo sapiens
guccucacccau

SEQ ID NO: 1576451 - RNA, 23 nt, Homo sapiens
guccucacccaucaaaagcacca

SEQ ID NO: 1576452 - RNA, 20 nt, Homo sapiens
guccucaccugguugaccca

SEQ ID NO: 1576453 - RNA, 15 nt, Homo sapiens
guccucacucuucaa

SEQ ID NO: 1576454 - RNA, 12 nt, Homo sapiens
guccuccagaca

SEQ ID NO: 1576455 - RNA, 17 nt, Homo sapiens
guccucucccugccaag

SEQ ID NO: 1576456 - RNA, 15 nt, Homo sapiens
guccucucugugucc

SEQ ID NO: 1576457 - RNA, 21 nt, Homo sapiens
guccugagcaccacacccagu

SEQ ID NO: 1576458 - RNA, 16 nt, Homo sapiens
guccugcugaaacugc

SEQ ID NO: 1576459 - RNA, 21 nt, Homo sapiens
guccugcugccucucuuucac

SEQ ID NO: 1576460 - RNA, 12 nt, Homo sapiens
guccuggucaag

SEQ ID NO: 1576461 - RNA, 14 nt, Homo sapiens
guccugugauguca

SEQ ID NO: 1576462 - RNA, 16 nt, Homo sapiens
guccuuccacugugca

SEQ ID NO: 1576463 - RNA, 22 nt, Homo sapiens
guccuuccugugcccugcaaau

SEQ ID NO: 1576464 - RNA, 22 nt, Homo sapiens
guccuuuuuccaauguuuuauu

SEQ ID NO: 1576465 - RNA, 12 nt, Homo sapiens
gucgcagacucc

SEQ ID NO: 1576466 - RNA, 14 nt, Homo sapiens
gucgggacaugguu

SEQ ID NO: 1576467 - RNA, 17 nt, Homo sapiens
gucuaaguguccgagac

SEQ ID NO: 1576468 - RNA, 17 nt, Homo sapiens
gucuaucagcaucugac

SEQ ID NO: 1576469 - RNA, 14 nt, Homo sapiens
gucuaugaauauga

SEQ ID NO: 1576470 - RNA, 19 nt, Homo sapiens
gucucaaacuccugaccuc

SEQ ID NO: 1576471 - RNA, 12 nt, Homo sapiens
gucucaccagcc

SEQ ID NO: 1576472 - RNA, 15 nt, Homo sapiens
gucucaguccaugaa

SEQ ID NO: 1576473 - RNA, 20 nt, Homo sapiens
gucucaguggcuucaucugu

SEQ ID NO: 1576474 - RNA, 23 nt, Homo sapiens
gucucauaaugcauguggcacuu

SEQ ID NO: 1576475 - RNA, 13 nt, Homo sapiens
gucuccacacugc

SEQ ID NO: 1576476 - RNA, 17 nt, Homo sapiens
gucuccaugcucaccaa

SEQ ID NO: 1576477 - RNA, 19 nt, Homo sapiens
gucucgccaagcaggacag

SEQ ID NO: 1576478 - RNA, 21 nt, Homo sapiens
gucucuuagaauuuguuucau

SEQ ID NO: 1576479 - RNA, 14 nt, Homo sapiens
gucugaacaauaua

SEQ ID NO: 1576480 - RNA, 20 nt, Homo sapiens
gucugaacaauauauacuua

SEQ ID NO: 1576481 - RNA, 16 nt, Homo sapiens
gucugaguaguggcca

SEQ ID NO: 1576482 - RNA, 15 nt, Homo sapiens
gucugauaaacugac

SEQ ID NO: 1576483 - RNA, 12 nt, Homo sapiens
gucugaugacac

SEQ ID NO: 1576484 - RNA, 21 nt, Homo sapiens
gucugauguucuuuccaugaa

SEQ ID NO: 1576485 - RNA, 14 nt, Homo sapiens
gucugcaucuggcg

SEQ ID NO: 1576486 - RNA, 20 nt, Homo sapiens
gucugccacuugucaaagaa

SEQ ID NO: 1576487 - RNA, 13 nt, Homo sapiens
gucugccauuaca

SEQ ID NO: 1576488 - RNA, 13 nt, Homo sapiens
gucugccuaugca

SEQ ID NO: 1576489 - RNA, 22 nt, Homo sapiens
gucugccugguucccuccccaa

SEQ ID NO: 1576490 - RNA, 17 nt, Homo sapiens
gucugcuguuccagugg

SEQ ID NO: 1576491 - RNA, 23 nt, Homo sapiens
gucuggaaaacagaaaccauucu

SEQ ID NO: 1576492 - RNA, 16 nt, Homo sapiens
gucugggccacucagg

SEQ ID NO: 1576493 - RNA, 14 nt, Homo sapiens
gucugucaccagcu

SEQ ID NO: 1576494 - RNA, 21 nt, Homo sapiens
gucugucaugaacauguuccu

SEQ ID NO: 1576495 - RNA, 14 nt, Homo sapiens
gucugucucuauau

SEQ ID NO: 1576496 - RNA, 12 nt, Homo sapiens
gucuguuugcaa

SEQ ID NO: 1576497 - RNA, 21 nt, Homo sapiens
gucuuaaacuaaaugugcaau

SEQ ID NO: 1576498 - RNA, 17 nt, Homo sapiens
gucuuaaagcauuucag

SEQ ID NO: 1576499 - RNA, 21 nt, Homo sapiens
gucuucaguuuccgaaucucu

SEQ ID NO: 1576500 - RNA, 23 nt, Homo sapiens
gucuucauuuuuuaaugugcucu

SEQ ID NO: 1576501 - RNA, 19 nt, Homo sapiens
gucuucguagguugugaug

SEQ ID NO: 1576502 - RNA, 13 nt, Homo sapiens
gucuucuaaacuu

SEQ ID NO: 1576503 - RNA, 12 nt, Homo sapiens
gucuucucaggc

SEQ ID NO: 1576504 - RNA, 17 nt, Homo sapiens
gucuucuucaugucauc

SEQ ID NO: 1576505 - RNA, 15 nt, Homo sapiens
gucuuuacagaauca

SEQ ID NO: 1576506 - RNA, 13 nt, Homo sapiens
gucuuucaaugac

SEQ ID NO: 1576507 - RNA, 14 nt, Homo sapiens
gucuuucauugcua

SEQ ID NO: 1576508 - RNA, 21 nt, Homo sapiens
gucuuuguaaugucaccaccu

SEQ ID NO: 1576509 - RNA, 16 nt, Homo sapiens
gucuuuguucugugau

SEQ ID NO: 1576510 - RNA, 17 nt, Homo sapiens
gucuuuuguaauaucaa

SEQ ID NO: 1576511 - RNA, 18 nt, Homo sapiens
gucuuuuuucucucuuag

SEQ ID NO: 1576512 - RNA, 22 nt, Homo sapiens
gugaaaaaccuauuacuacuaa

SEQ ID NO: 1576513 - RNA, 18 nt, Homo sapiens
gugaaaaaggaaugauau

SEQ ID NO: 1576514 - RNA, 21 nt, Homo sapiens
gugaaaaaguuaaacauugaa

SEQ ID NO: 1576515 - RNA, 16 nt, Homo sapiens
gugaaacagagugauu

SEQ ID NO: 1576516 - RNA, 16 nt, Homo sapiens
gugaaaucccugccuc

SEQ ID NO: 1576517 - RNA, 14 nt, Homo sapiens
gugaacacaucagc

SEQ ID NO: 1576518 - RNA, 15 nt, Homo sapiens
gugaacacaucagcu

SEQ ID NO: 1576519 - RNA, 20 nt, Homo sapiens
gugaaccaacccccaucucc

SEQ ID NO: 1576520 - RNA, 14 nt, Homo sapiens
uaucuauuaucuca

SEQ ID NO: 1576521 - RNA, 16 nt, Homo sapiens
uaucucaaacuacugg

SEQ ID NO: 1576522 - RNA, 13 nt, Homo sapiens
uaucucagcauuu

SEQ ID NO: 1576523 - RNA, 20 nt, Homo sapiens
uaucuggggaaaucaaaaca

SEQ ID NO: 1576524 - RNA, 16 nt, Homo sapiens
uaucugguuucucuag

SEQ ID NO: 1576525 - RNA, 16 nt, Homo sapiens
uaucugucaucucucu

SEQ ID NO: 1576526 - RNA, 13 nt, Homo sapiens
uaucugugcuuug

SEQ ID NO: 1576527 - RNA, 21 nt, Homo sapiens
uaucuguugccuuauuucuca

SEQ ID NO: 1576528 - RNA, 20 nt, Homo sapiens
uaucuguuuguuacugcauc

SEQ ID NO: 1576529 - RNA, 13 nt, Homo sapiens
uaucuguuuugcu

SEQ ID NO: 1576530 - RNA, 18 nt, Homo sapiens
uaucuuacuuuccucuga

SEQ ID NO: 1576531 - RNA, 22 nt, Homo sapiens
uaucuucccuuuauuacaagaa

SEQ ID NO: 1576532 - RNA, 17 nt, Homo sapiens
uaucuucuuuugaacaa

SEQ ID NO: 1576533 - RNA, 17 nt, Homo sapiens
uaucuuggacaaaucac

SEQ ID NO: 1576534 - RNA, 21 nt, Homo sapiens
uaucuuuguauauauguguau

SEQ ID NO: 1576535 - RNA, 20 nt, Homo sapiens
uaucuuuugaauucuugaua

SEQ ID NO: 1576536 - RNA, 16 nt, Homo sapiens
uaugaaaacuagcauu

SEQ ID NO: 1576537 - RNA, 18 nt, Homo sapiens
uaugaaaaucuccaucuc

SEQ ID NO: 1576538 - RNA, 21 nt, Homo sapiens
uaugaaaauuauacugagaac

SEQ ID NO: 1576539 - RNA, 23 nt, Homo sapiens
uaugaacugaaggcagcauguau

SEQ ID NO: 1576540 - RNA, 12 nt, Homo sapiens
uaugaaguacag

SEQ ID NO: 1576541 - RNA, 23 nt, Homo sapiens
uaugaauggguggaaagguguga

SEQ ID NO: 1576542 - RNA, 19 nt, Homo sapiens
uaugaauuaacccaaagaa

SEQ ID NO: 1576543 - RNA, 16 nt, Homo sapiens
uaugaauuaagcugua

SEQ ID NO: 1576544 - RNA, 16 nt, Homo sapiens
uaugaccagaagccuu

SEQ ID NO: 1576545 - RNA, 17 nt, Homo sapiens
uaugagaauauaccuua

SEQ ID NO: 1576546 - RNA, 22 nt, Homo sapiens
uaugagccaggcaucauacuaa

SEQ ID NO: 1576547 - RNA, 18 nt, Homo sapiens
uaugagcuaaaacaucca

SEQ ID NO: 1576548 - RNA, 23 nt, Homo sapiens
uaugagcuggggaugucucucau

SEQ ID NO: 1576549 - RNA, 15 nt, Homo sapiens
uaugaggaccuuuau

SEQ ID NO: 1576550 - RNA, 16 nt, Homo sapiens
uaugagggcagauuca

SEQ ID NO: 1576551 - RNA, 14 nt, Homo sapiens
uaugauacugaugc

SEQ ID NO: 1576552 - RNA, 18 nt, Homo sapiens
uaugauauaacaugugua

SEQ ID NO: 1576553 - RNA, 16 nt, Homo sapiens
uaugauugcauuguau

SEQ ID NO: 1576554 - RNA, 21 nt, Homo sapiens
uaugcaaaccucaucuuucuc

SEQ ID NO: 1576555 - RNA, 18 nt, Homo sapiens
uaugcaaaucagcuuuau

SEQ ID NO: 1576556 - RNA, 14 nt, Homo sapiens
uaugcaagcagcuu

SEQ ID NO: 1576557 - RNA, 22 nt, Homo sapiens
uaugcaauaaaauuauuugcag

SEQ ID NO: 1576558 - RNA, 12 nt, Homo sapiens
uaugcacaacuu

SEQ ID NO: 1576559 - RNA, 22 nt, Homo sapiens
uaugcacugaagagcucuuggc

SEQ ID NO: 1576560 - RNA, 14 nt, Homo sapiens
uaugcaguccuuua

SEQ ID NO: 1576561 - RNA, 16 nt, Homo sapiens
uaugcauguagcauau

SEQ ID NO: 1576562 - RNA, 17 nt, Homo sapiens
uaugccuuuuuugauca

SEQ ID NO: 1576563 - RNA, 17 nt, Homo sapiens
uaugcgcaauguggcau

SEQ ID NO: 1576564 - RNA, 15 nt, Homo sapiens
ugcauaaaugcauaa

SEQ ID NO: 1576565 - RNA, 14 nt, Homo sapiens
ugcauaaccuuuac

SEQ ID NO: 1576566 - RNA, 22 nt, Homo sapiens
ugcauaauguuucuggauuuca

SEQ ID NO: 1576567 - RNA, 23 nt, Homo sapiens
ugcauaccaaguugauacuugaa

SEQ ID NO: 1576568 - RNA, 20 nt, Homo sapiens
ugcauacuuucccucaucca

SEQ ID NO: 1576569 - RNA, 21 nt, Homo sapiens
ugcauacuuucccucauccau

SEQ ID NO: 1576570 - RNA, 18 nt, Homo sapiens
ugcauauguaaagcacau

SEQ ID NO: 1576571 - RNA, 14 nt, Homo sapiens
ugcaucauguugaa

SEQ ID NO: 1576572 - RNA, 21 nt, Homo sapiens
ugcaucccagcccacaucuca

SEQ ID NO: 1576573 - RNA, 23 nt, Homo sapiens
ugcaugaauuccacuccuuccag

SEQ ID NO: 1576574 - RNA, 14 nt, Homo sapiens
ugcaugcagaggag

SEQ ID NO: 1576575 - RNA, 14 nt, Homo sapiens
ugcauguacuguau

SEQ ID NO: 1576576 - RNA, 17 nt, Homo sapiens
ugcauuaugcacguguc

SEQ ID NO: 1576577 - RNA, 18 nt, Homo sapiens
ugcauuaugcacgugucu

SEQ ID NO: 1576578 - RNA, 12 nt, Homo sapiens
ugcauuccagaa

SEQ ID NO: 1576579 - RNA, 22 nt, Homo sapiens
ugcauuccuuuuucuucacuua

SEQ ID NO: 1576580 - RNA, 16 nt, Homo sapiens
ugcauucucuagucag

SEQ ID NO: 1576581 - RNA, 15 nt, Homo sapiens
ugcauucuucucugu

SEQ ID NO: 1576582 - RNA, 12 nt, Homo sapiens
ugcauugaacag

SEQ ID NO: 1576583 - RNA, 15 nt, Homo sapiens
ugcauugagcucucu

SEQ ID NO: 1576584 - RNA, 20 nt, Homo sapiens
ugcauuuaaaacagacacug

SEQ ID NO: 1576585 - RNA, 16 nt, Homo sapiens
ugcauuuaugaugcag

SEQ ID NO: 1576586 - RNA, 18 nt, Homo sapiens
ugcauuuaugaugcaguu

SEQ ID NO: 1576587 - RNA, 21 nt, Homo sapiens
ugcauuugugguaaucuacac

SEQ ID NO: 1576588 - RNA, 16 nt, Homo sapiens
ugcauuuuuagaccau

SEQ ID NO: 1576589 - RNA, 10 nt, Homo sapiens
ugccaaaaau

SEQ ID NO: 1576590 - RNA, 16 nt, Homo sapiens
ugccaaaauaaaccug

SEQ ID NO: 1576591 - RNA, 13 nt, Homo sapiens
ugccaaaccuacu

SEQ ID NO: 1576592 - RNA, 19 nt, Homo sapiens
ugccaaaugcguaugccac

SEQ ID NO: 1576593 - RNA, 18 nt, Homo sapiens
ugccaagggguuaaugaa

SEQ ID NO: 1576594 - RNA, 15 nt, Homo sapiens
ugccaauagugucau

SEQ ID NO: 1576595 - RNA, 17 nt, Homo sapiens
ugccaauagugucaucc

SEQ ID NO: 1576596 - RNA, 20 nt, Homo sapiens
ugccacaaauaacaucucac

SEQ ID NO: 1576597 - RNA, 21 nt, Homo sapiens
ugccacaaauuguauggugau

SEQ ID NO: 1576598 - RNA, 21 nt, Homo sapiens
ugccacacggaagcaagcaga

SEQ ID NO: 1576599 - RNA, 22 nt, Homo sapiens
ugccacauggugucucccaaca

SEQ ID NO: 1576600 - RNA, 16 nt, Homo sapiens
ugccaccaacuuacaa

SEQ ID NO: 1576601 - RNA, 18 nt, Homo sapiens
ugccacuuaauguauguu

SEQ ID NO: 1576602 - RNA, 14 nt, Homo sapiens
ugccagaagcuacu

SEQ ID NO: 1576603 - RNA, 19 nt, Homo sapiens
ugccagaagcuacugcgau

SEQ ID NO: 1576604 - RNA, 21 nt, Homo sapiens
ugccagcauuuagacccugca

SEQ ID NO: 1576605 - RNA, 14 nt, Homo sapiens
ugccagcauuuccc

SEQ ID NO: 1576606 - RNA, 22 nt, Homo sapiens
ugccagcucucugauuccccaa

SEQ ID NO: 1576607 - RNA, 18 nt, Homo sapiens
ugccaggaggaacaaaga

SEQ ID NO: 1576608 - RNA, 14 nt, Homo sapiens
ugccaggcacuuug

SEQ ID NO: 1576609 - RNA, 14 nt, Homo sapiens
ugccagggccuguc

SEQ ID NO: 1576610 - RNA, 19 nt, Homo sapiens
ugccagggccugucucuga

SEQ ID NO: 1576611 - RNA, 21 nt, Homo sapiens
ugccaggugcaaucuacugga

SEQ ID NO: 1576612 - RNA, 15 nt, Homo sapiens
ugccagugcacuccg

SEQ ID NO: 1576613 - RNA, 21 nt, Homo sapiens
ugccagugccuuauuacccag

SEQ ID NO: 1576614 - RNA, 13 nt, Homo sapiens
ugccaucaugccu

SEQ ID NO: 1576615 - RNA, 12 nt, Homo sapiens
ugccaugaaaau

SEQ ID NO: 1576616 - RNA, 12 nt, Homo sapiens
ugccaugaucug

SEQ ID NO: 1576617 - RNA, 14 nt, Homo sapiens
ugccauuacaccag

SEQ ID NO: 1576618 - RNA, 22 nt, Homo sapiens
ugccauuaugcaaauggagaua

SEQ ID NO: 1576619 - RNA, 20 nt, Homo sapiens
ugccauucuucuggugcuac

SEQ ID NO: 1576620 - RNA, 20 nt, Homo sapiens
ugcccaaacagcuguauuua

SEQ ID NO: 1576621 - RNA, 15 nt, Homo sapiens
ugcccaaaucuuuag

SEQ ID NO: 1576622 - RNA, 19 nt, Homo sapiens
ugcccaaggccuaccccag

SEQ ID NO: 1576623 - RNA, 18 nt, Homo sapiens
ugcccaaugagacucuag

SEQ ID NO: 1576624 - RNA, 18 nt, Homo sapiens
ugcccacucgggucugca

SEQ ID NO: 1576625 - RNA, 20 nt, Homo sapiens
ugcccacucuccauccuccc

SEQ ID NO: 1576626 - RNA, 17 nt, Homo sapiens
ugcccagacuacagggc

SEQ ID NO: 1576627 - RNA, 17 nt, Homo sapiens
ugcccagcacagugccu

SEQ ID NO: 1576628 - RNA, 13 nt, Homo sapiens
ugcccagccugcu

SEQ ID NO: 1576629 - RNA, 21 nt, Homo sapiens
ugcccaggcuagagugcaaug

SEQ ID NO: 1576630 - RNA, 17 nt, Homo sapiens
ugcccauccugacugaa

SEQ ID NO: 1576631 - RNA, 20 nt, Homo sapiens
ugcccauccugccauccuca

SEQ ID NO: 1576632 - RNA, 16 nt, Homo sapiens
ugcccauuuacacuuu

SEQ ID NO: 1576633 - RNA, 15 nt, Homo sapiens
ugccccagagcuguu

SEQ ID NO: 1576634 - RNA, 21 nt, Homo sapiens
ugcccccucccccaugggcug

SEQ ID NO: 1576635 - RNA, 20 nt, Homo sapiens
ugccccgugggcugugccaa

SEQ ID NO: 1576636 - RNA, 20 nt, Homo sapiens
ugccccucccccacuuucaa

SEQ ID NO: 1576637 - RNA, 15 nt, Homo sapiens
ugccccucucucagu

SEQ ID NO: 1576638 - RNA, 17 nt, Homo sapiens
ugccccugcacuccagc

SEQ ID NO: 1576639 - RNA, 19 nt, Homo sapiens
ugccccuugggagacucca

SEQ ID NO: 1576640 - RNA, 18 nt, Homo sapiens
ugcccggccuguguacaa

SEQ ID NO: 1576641 - RNA, 18 nt, Homo sapiens
ugcccucucugaaccuca

SEQ ID NO: 1576642 - RNA, 13 nt, Homo sapiens
ugcccugccucag

SEQ ID NO: 1576643 - RNA, 16 nt, Homo sapiens
ugcccuggaaaggggg

SEQ ID NO: 1576644 - RNA, 16 nt, Homo sapiens
ugcccugguccaggga

SEQ ID NO: 1576645 - RNA, 19 nt, Homo sapiens
ugccgaauuugguacacau

SEQ ID NO: 1576646 - RNA, 16 nt, Homo sapiens
ugccgugagcaugcac

SEQ ID NO: 1576647 - RNA, 20 nt, Homo sapiens
ugccguucugcacccuaccc

SEQ ID NO: 1576648 - RNA, 14 nt, Homo sapiens
ugccuacuccaaaa

SEQ ID NO: 1576649 - RNA, 15 nt, Homo sapiens
ugccuaucugaccaa

SEQ ID NO: 1576650 - RNA, 16 nt, Homo sapiens
ugccucacuuccuaca

SEQ ID NO: 1576651 - RNA, 16 nt, Homo sapiens
ugccucaguaggcauc

SEQ ID NO: 1576652 - RNA, 18 nt, Homo sapiens
ugccucccaagguccucu

SEQ ID NO: 1576653 - RNA, 15 nt, Homo sapiens
ugccuccuguggucu

SEQ ID NO: 1576654 - RNA, 18 nt, Homo sapiens
ugccucuaaauagcacuu

SEQ ID NO: 1576655 - RNA, 18 nt, Homo sapiens
ugccucucccugcugcuc

SEQ ID NO: 1576656 - RNA, 16 nt, Homo sapiens
ugccucugcucccucu

SEQ ID NO: 1576657 - RNA, 16 nt, Homo sapiens
ugccugcccugccuca

SEQ ID NO: 1576658 - RNA, 20 nt, Homo sapiens
ugccuggccaggcagaucug

SEQ ID NO: 1576659 - RNA, 11 nt, Homo sapiens
ugccugggaag

SEQ ID NO: 1576660 - RNA, 14 nt, Homo sapiens
ugccuguaaucaca

SEQ ID NO: 1576661 - RNA, 21 nt, Homo sapiens
ugccuguacuaaggagcauga

SEQ ID NO: 1576662 - RNA, 11 nt, Homo sapiens
ugccugugacu

SEQ ID NO: 1576663 - RNA, 20 nt, Homo sapiens
ugccuguuauaacucugcac

SEQ ID NO: 1576664 - RNA, 21 nt, Homo sapiens
ugccuuaaacacacauugcag

SEQ ID NO: 1576665 - RNA, 13 nt, Homo sapiens
ugccuuacuguac

SEQ ID NO: 1576666 - RNA, 22 nt, Homo sapiens
ugccuuccccagggugucucua

SEQ ID NO: 1576667 - RNA, 18 nt, Homo sapiens
ugccuucucaugauccaa

SEQ ID NO: 1576668 - RNA, 22 nt, Homo sapiens
ugccuucucuguucccuugcag

SEQ ID NO: 1576669 - RNA, 15 nt, Homo sapiens
ugccuuguuguauuc

SEQ ID NO: 1576670 - RNA, 18 nt, Homo sapiens
ugccuuucaaauuuagaa

SEQ ID NO: 1576671 - RNA, 21 nt, Homo sapiens
uguggaacauaaaaaggacau

SEQ ID NO: 1576672 - RNA, 21 nt, Homo sapiens
uguggaagcauguagacugug

SEQ ID NO: 1576673 - RNA, 22 nt, Homo sapiens
uguggacuuauucauuccucac

SEQ ID NO: 1576674 - RNA, 17 nt, Homo sapiens
uguggacuucaucucaa

SEQ ID NO: 1576675 - RNA, 20 nt, Homo sapiens
uguggcaucagauaaugcca

SEQ ID NO: 1576676 - RNA, 13 nt, Homo sapiens
uguggccccaaga

SEQ ID NO: 1576677 - RNA, 21 nt, Homo sapiens
ugugggcggcuccuggugcua

SEQ ID NO: 1576678 - RNA, 21 nt, Homo sapiens
uguggggagggauuuggggcu

SEQ ID NO: 1576679 - RNA, 21 nt, Homo sapiens
ugugggucccgcacucugccc

SEQ ID NO: 1576680 - RNA, 14 nt, Homo sapiens
ugugguacuuugca

SEQ ID NO: 1576681 - RNA, 15 nt, Homo sapiens
uguguaaauuucuca

SEQ ID NO: 1576682 - RNA, 13 nt, Homo sapiens
uguguagauuuga

SEQ ID NO: 1576683 - RNA, 21 nt, Homo sapiens
uguguauuuacgcuuugauuc

SEQ ID NO: 1576684 - RNA, 15 nt, Homo sapiens
uguguccucagggag

SEQ ID NO: 1576685 - RNA, 15 nt, Homo sapiens
ugugucgcuuauguc

SEQ ID NO: 1576686 - RNA, 15 nt, Homo sapiens
ugugugaaaauguga

SEQ ID NO: 1576687 - RNA, 18 nt, Homo sapiens
ugugugaauaccccaaga

SEQ ID NO: 1576688 - RNA, 14 nt, Homo sapiens
ugugugacuuucag

SEQ ID NO: 1576689 - RNA, 23 nt, Homo sapiens
ugugugacuuucaggcuacuguu

SEQ ID NO: 1576690 - RNA, 22 nt, Homo sapiens
ugugugagauuuuauuuugaca

SEQ ID NO: 1576691 - RNA, 15 nt, Homo sapiens
ugugugggcacgugu

SEQ ID NO: 1576692 - RNA, 17 nt, Homo sapiens
uguguggggugggcaca

SEQ ID NO: 1576693 - RNA, 17 nt, Homo sapiens
ugugugguauucaacua

SEQ ID NO: 1576694 - RNA, 22 nt, Homo sapiens
uguguguauucuuaaaaugcaa

SEQ ID NO: 1576695 - RNA, 13 nt, Homo sapiens
ugugugugugaac

SEQ ID NO: 1576696 - RNA, 22 nt, Homo sapiens
aaaguuuaacaaaugacuguau

SEQ ID NO: 1576697 - RNA, 16 nt, Homo sapiens
aaauaaaaaucucuuu

SEQ ID NO: 1576698 - RNA, 14 nt, Homo sapiens
aaauaaacacugug

SEQ ID NO: 1576699 - RNA, 17 nt, Homo sapiens
aaauaaagauauuguuc

SEQ ID NO: 1576700 - RNA, 16 nt, Homo sapiens
aaauaaaucaguucau

SEQ ID NO: 1576701 - RNA, 16 nt, Homo sapiens
aaauaaauuugcacug

SEQ ID NO: 1576702 - RNA, 13 nt, Homo sapiens
aaauaacaucuca

SEQ ID NO: 1576703 - RNA, 14 nt, Homo sapiens
aaauaagcauuuag

SEQ ID NO: 1576704 - RNA, 17 nt, Homo sapiens
aaauaaucuauauuaaa

SEQ ID NO: 1576705 - RNA, 21 nt, Homo sapiens
aaauaaugcauccagcaguac

SEQ ID NO: 1576706 - RNA, 20 nt, Homo sapiens
aaauaauuauauaacuguau

SEQ ID NO: 1576707 - RNA, 15 nt, Homo sapiens
aaauaauuauuuucc

SEQ ID NO: 1576708 - RNA, 15 nt, Homo sapiens
aaauacaacacugag

SEQ ID NO: 1576709 - RNA, 16 nt, Homo sapiens
aaauacacuuccugcu

SEQ ID NO: 1576710 - RNA, 20 nt, Homo sapiens
aaauacacuuccugcuuaaa

SEQ ID NO: 1576711 - RNA, 21 nt, Homo sapiens
aaauacagucuuccauuugca

SEQ ID NO: 1576712 - RNA, 14 nt, Homo sapiens
aaauacaugcacag

SEQ ID NO: 1576713 - RNA, 18 nt, Homo sapiens
aaauacaugcacagucau

SEQ ID NO: 1576714 - RNA, 18 nt, Homo sapiens
aaauaccagagccuucaa

SEQ ID NO: 1576715 - RNA, 15 nt, Homo sapiens
aaauacccuccacuc

SEQ ID NO: 1576716 - RNA, 20 nt, Homo sapiens
aaauacuaugcaguaucucu

SEQ ID NO: 1576717 - RNA, 16 nt, Homo sapiens
aaauacucagcaacug

SEQ ID NO: 1576718 - RNA, 19 nt, Homo sapiens
aaauacuucuuuuucauua

SEQ ID NO: 1576719 - RNA, 15 nt, Homo sapiens
aaauagaaaccugaa

SEQ ID NO: 1576720 - RNA, 17 nt, Homo sapiens
aaauagaaccacuauga

SEQ ID NO: 1576721 - RNA, 13 nt, Homo sapiens
aaauagauuucag

SEQ ID NO: 1576722 - RNA, 14 nt, Homo sapiens
aaauaguaauguga

SEQ ID NO: 1576723 - RNA, 21 nt, Homo sapiens
aaauaguauacauugucuuga

SEQ ID NO: 1576724 - RNA, 17 nt, Homo sapiens
aaauagucuuccacaaa

SEQ ID NO: 1576725 - RNA, 15 nt, Homo sapiens
aaauauauacuaaac

SEQ ID NO: 1576726 - RNA, 15 nt, Homo sapiens
aaauauauauaaaga

SEQ ID NO: 1576727 - RNA, 23 nt, Homo sapiens
aaauauauauuauauauuuacaa

SEQ ID NO: 1576728 - RNA, 22 nt, Homo sapiens
aaauauauccuguguaccucac

SEQ ID NO: 1576729 - RNA, 19 nt, Homo sapiens
aaauaucaguauucugaca

SEQ ID NO: 1576730 - RNA, 11 nt, Homo sapiens
aaauaucucaa

SEQ ID NO: 1576731 - RNA, 16 nt, Homo sapiens
aaauauguauuuacca

SEQ ID NO: 1576732 - RNA, 15 nt, Homo sapiens
aaauaugugacugac

SEQ ID NO: 1576733 - RNA, 17 nt, Homo sapiens
aaauauuagugcaguua

SEQ ID NO: 1576734 - RNA, 15 nt, Homo sapiens
aaauauugcuucaau

SEQ ID NO: 1576735 - RNA, 13 nt, Homo sapiens
aaauauugugacu

SEQ ID NO: 1576736 - RNA, 23 nt, Homo sapiens
aaauauuguguugugcagcauua

SEQ ID NO: 1576737 - RNA, 13 nt, Homo sapiens
aaaucaacaugac

SEQ ID NO: 1576738 - RNA, 20 nt, Homo sapiens
aaaucaagugguauuuucca

SEQ ID NO: 1576739 - RNA, 13 nt, Homo sapiens
aaaucacaucucc

SEQ ID NO: 1576740 - RNA, 16 nt, Homo sapiens
aaaucagccauaagaa

SEQ ID NO: 1576741 - RNA, 14 nt, Homo sapiens
aaaucaugauuucc

SEQ ID NO: 1576742 - RNA, 20 nt, Homo sapiens
aaaucauuugaggucagaag

SEQ ID NO: 1576743 - RNA, 20 nt, Homo sapiens
aaauccauuccagguagcuc

SEQ ID NO: 1576744 - RNA, 16 nt, Homo sapiens
aaauccucaggugauu

SEQ ID NO: 1576745 - RNA, 17 nt, Homo sapiens
aaauccugaacuuucuc

SEQ ID NO: 1576746 - RNA, 23 nt, Homo sapiens
aaauccuggaaggacacagugau

SEQ ID NO: 1576747 - RNA, 15 nt, Homo sapiens
aaaucuccaucucaa

SEQ ID NO: 1576748 - RNA, 23 nt, Homo sapiens
aaaucucuacugcuuuggauccu

SEQ ID NO: 1576749 - RNA, 19 nt, Homo sapiens
aaaucucuucaaauucuuc

SEQ ID NO: 1576750 - RNA, 18 nt, Homo sapiens
aaaucugauggccuuaau

SEQ ID NO: 1576751 - RNA, 18 nt, Homo sapiens
aaaucuguguaacuguaa

SEQ ID NO: 1576752 - RNA, 14 nt, Homo sapiens
aaaucuuucucuca

SEQ ID NO: 1576753 - RNA, 17 nt, Homo sapiens
aaaucuuuuaaaucuuu

SEQ ID NO: 1576754 - RNA, 13 nt, Homo sapiens
aaaugaaaagaga

SEQ ID NO: 1576755 - RNA, 21 nt, Homo sapiens
aaaugaaagggaaacugggaa

SEQ ID NO: 1576756 - RNA, 16 nt, Homo sapiens
aaaugaaauccaguga

SEQ ID NO: 1576757 - RNA, 16 nt, Homo sapiens
aaaugaagggauauaa

SEQ ID NO: 1576758 - RNA, 21 nt, Homo sapiens
aaaugaaugaggucugggcua

SEQ ID NO: 1576759 - RNA, 22 nt, Homo sapiens
aaaugacaaccugaauuaucua

SEQ ID NO: 1576760 - RNA, 13 nt, Homo sapiens
aaaugacagaucu

SEQ ID NO: 1576761 - RNA, 16 nt, Homo sapiens
aaaugacaguaauauu

SEQ ID NO: 1576762 - RNA, 19 nt, Homo sapiens
aaaugacauuucacuaaaa

SEQ ID NO: 1576763 - RNA, 15 nt, Homo sapiens
aaaugacgucuucac

SEQ ID NO: 1576764 - RNA, 18 nt, Homo sapiens
aaaugagaaagcauuucu

SEQ ID NO: 1576765 - RNA, 22 nt, Homo sapiens
aaaugcaauguaagcauacuuu

SEQ ID NO: 1576766 - RNA, 20 nt, Homo sapiens
aaaugcacccaucagcacuc

SEQ ID NO: 1576767 - RNA, 18 nt, Homo sapiens
aaaugcauccauuccuca

SEQ ID NO: 1576768 - RNA, 18 nt, Homo sapiens
aaaugccaaaggaaguuu

SEQ ID NO: 1576769 - RNA, 16 nt, Homo sapiens
aaaugccucagcuaug

SEQ ID NO: 1576770 - RNA, 16 nt, Homo sapiens
aaaugcugguuuuuca

SEQ ID NO: 1576771 - RNA, 18 nt, Homo sapiens
aaaugcuguuaguaaauu

SEQ ID NO: 1576772 - RNA, 15 nt, Homo sapiens
aaaugcuuuuccuca

SEQ ID NO: 1576773 - RNA, 15 nt, Homo sapiens
aaauggccaaauaua

SEQ ID NO: 1576774 - RNA, 16 nt, Homo sapiens
aaauggccaaugagau

SEQ ID NO: 1576775 - RNA, 15 nt, Homo sapiens
aaauggguuuauuca

SEQ ID NO: 1576776 - RNA, 15 nt, Homo sapiens
aaaugguuucacuug

SEQ ID NO: 1576777 - RNA, 18 nt, Homo sapiens
aaauguaauaaguaucac

SEQ ID NO: 1576778 - RNA, 16 nt, Homo sapiens
aaauguacagacauau

SEQ ID NO: 1576779 - RNA, 14 nt, Homo sapiens
aaaugucacuauau

SEQ ID NO: 1576780 - RNA, 14 nt, Homo sapiens
aaaugucaucaggu

SEQ ID NO: 1576781 - RNA, 22 nt, Homo sapiens
aaaugucuugcuguugacauau

SEQ ID NO: 1576782 - RNA, 16 nt, Homo sapiens
aaaugugaacauggaa

SEQ ID NO: 1576783 - RNA, 18 nt, Homo sapiens
aaaugugacucagcauca

SEQ ID NO: 1576784 - RNA, 14 nt, Homo sapiens
aaaugugccuucau

SEQ ID NO: 1576785 - RNA, 17 nt, Homo sapiens
aaaugugcuauacugca

SEQ ID NO: 1576786 - RNA, 11 nt, Homo sapiens
aaaugugcuca

SEQ ID NO: 1576787 - RNA, 23 nt, Homo sapiens
aaaugugcucaaauuacuaauga

SEQ ID NO: 1576788 - RNA, 16 nt, Homo sapiens
aaauguguaagaacaa

SEQ ID NO: 1576789 - RNA, 21 nt, Homo sapiens
aaaugugucauuggaagccau

SEQ ID NO: 1576790 - RNA, 22 nt, Homo sapiens
aaaugugucauuggaagccauc

SEQ ID NO: 1576791 - RNA, 19 nt, Homo sapiens
aaauguguuagcacugaua

SEQ ID NO: 1576792 - RNA, 16 nt, Homo sapiens
aaauguucaagucaug

SEQ ID NO: 1576793 - RNA, 11 nt, Homo sapiens
aaauguuggca

SEQ ID NO: 1576794 - RNA, 17 nt, Homo sapiens
aaauguuuacuguauca

SEQ ID NO: 1576795 - RNA, 14 nt, Homo sapiens
aaauguuugagcac

SEQ ID NO: 1576796 - RNA, 12 nt, Homo sapiens
aaauuaagaagg

SEQ ID NO: 1576797 - RNA, 14 nt, Homo sapiens
aaauuaccugugga

SEQ ID NO: 1576798 - RNA, 21 nt, Homo sapiens
aaauuauaucugugaauugca

SEQ ID NO: 1576799 - RNA, 18 nt, Homo sapiens
aaauuauuagaacauuca

SEQ ID NO: 1576800 - RNA, 21 nt, Homo sapiens
aaauucacaugaugcacuuca

SEQ ID NO: 1576801 - RNA, 14 nt, Homo sapiens
aaauucacuucccc

SEQ ID NO: 1576802 - RNA, 14 nt, Homo sapiens
aaauucacuuucau

SEQ ID NO: 1576803 - RNA, 14 nt, Homo sapiens
aaauucagaacaag

SEQ ID NO: 1576804 - RNA, 15 nt, Homo sapiens
aaauucagcauuuga

SEQ ID NO: 1576805 - RNA, 17 nt, Homo sapiens
aaauucagcauuugacc

SEQ ID NO: 1576806 - RNA, 21 nt, Homo sapiens
aaauucauuaguuguuaguga

SEQ ID NO: 1576807 - RNA, 13 nt, Homo sapiens
aaauuccacagau

SEQ ID NO: 1576808 - RNA, 22 nt, Homo sapiens
aaauuccccaagcaccuucccc

SEQ ID NO: 1576809 - RNA, 23 nt, Homo sapiens
aaauucuacucuaaagcuucuau

SEQ ID NO: 1576810 - RNA, 15 nt, Homo sapiens
aaauucuacuuuaau

SEQ ID NO: 1576811 - RNA, 20 nt, Homo sapiens
aaauucuauaggaacauaug

SEQ ID NO: 1576812 - RNA, 21 nt, Homo sapiens
aaauucuauaggaacauauga

SEQ ID NO: 1576813 - RNA, 17 nt, Homo sapiens
aaauucugaauuugcaa

SEQ ID NO: 1576814 - RNA, 15 nt, Homo sapiens
aaauucuucacaugu

SEQ ID NO: 1576815 - RNA, 20 nt, Homo sapiens
accacagcagacaccauuca

SEQ ID NO: 1576816 - RNA, 15 nt, Homo sapiens
accacauccugaaaa

SEQ ID NO: 1576817 - RNA, 20 nt, Homo sapiens
accacauccugaaaagggug

SEQ ID NO: 1576818 - RNA, 13 nt, Homo sapiens
accacauggacca

SEQ ID NO: 1576819 - RNA, 22 nt, Homo sapiens
accaccaugcacuguaaauauc

SEQ ID NO: 1576820 - RNA, 15 nt, Homo sapiens
accaccuaauaucaa

SEQ ID NO: 1576821 - RNA, 13 nt, Homo sapiens
accacgacuggcc

SEQ ID NO: 1576822 - RNA, 18 nt, Homo sapiens
accacgacuggccagggc

SEQ ID NO: 1576823 - RNA, 22 nt, Homo sapiens
accacuaggccugaaaugacau

SEQ ID NO: 1576824 - RNA, 17 nt, Homo sapiens
accacugauaaaaccau

SEQ ID NO: 1576825 - RNA, 21 nt, Homo sapiens
accacuugaauuuauugauau

SEQ ID NO: 1576826 - RNA, 17 nt, Homo sapiens
accagaaaagcaauacu

SEQ ID NO: 1576827 - RNA, 19 nt, Homo sapiens
accagaaagcuucauccac

SEQ ID NO: 1576828 - RNA, 14 nt, Homo sapiens
accagaacccagug

SEQ ID NO: 1576829 - RNA, 13 nt, Homo sapiens
accagacacucac

SEQ ID NO: 1576830 - RNA, 21 nt, Homo sapiens
accagacuugaauacaacauu

SEQ ID NO: 1576831 - RNA, 17 nt, Homo sapiens
accagaucugucuccaa

SEQ ID NO: 1576832 - RNA, 21 nt, Homo sapiens
accagaucugucuccaagacc

SEQ ID NO: 1576833 - RNA, 14 nt, Homo sapiens
accagcccaaccau

SEQ ID NO: 1576834 - RNA, 20 nt, Homo sapiens
accagcccgggcuggcccaa

SEQ ID NO: 1576835 - RNA, 20 nt, Homo sapiens
accagcccugaccccagugu

SEQ ID NO: 1576836 - RNA, 15 nt, Homo sapiens
accagcccugcacga

SEQ ID NO: 1576837 - RNA, 13 nt, Homo sapiens
accagcuacccug

SEQ ID NO: 1576838 - RNA, 21 nt, Homo sapiens
accagcuaucugucaucucuc

SEQ ID NO: 1576839 - RNA, 19 nt, Homo sapiens
accagcucugaacuuccaa

SEQ ID NO: 1576840 - RNA, 17 nt, Homo sapiens
accagcuucauguggcu

SEQ ID NO: 1576841 - RNA, 21 nt, Homo sapiens
accagcuucugauaaacacaa

SEQ ID NO: 1576842 - RNA, 16 nt, Homo sapiens
accagcuugcgaauaa

SEQ ID NO: 1576843 - RNA, 13 nt, Homo sapiens
accagggaugcug

SEQ ID NO: 1576844 - RNA, 13 nt, Homo sapiens
accaguaugacag

SEQ ID NO: 1576845 - RNA, 19 nt, Homo sapiens
accagugaauuuuugcaau

SEQ ID NO: 1576846 - RNA, 15 nt, Homo sapiens
accagugauaaguca

SEQ ID NO: 1576847 - RNA, 23 nt, Homo sapiens
accagugccucucccugcugcuc

SEQ ID NO: 1576848 - RNA, 19 nt, Homo sapiens
accaguguuccugaagcug

SEQ ID NO: 1576849 - RNA, 10 nt, Homo sapiens
accaguuuuc

SEQ ID NO: 1576850 - RNA, 17 nt, Homo sapiens
accaguuuucuuuauga

SEQ ID NO: 1576851 - RNA, 14 nt, Homo sapiens
accauaagcagcca

SEQ ID NO: 1576852 - RNA, 17 nt, Homo sapiens
accauaagcuacugcca

SEQ ID NO: 1576853 - RNA, 19 nt, Homo sapiens
accauagaaagaugacaaa

SEQ ID NO: 1576854 - RNA, 20 nt, Homo sapiens
accauagggacccauucuac

SEQ ID NO: 1576855 - RNA, 20 nt, Homo sapiens
accauauaccaucuccagcu

SEQ ID NO: 1576856 - RNA, 13 nt, Homo sapiens
accaucaguauau

SEQ ID NO: 1576857 - RNA, 22 nt, Homo sapiens
accauccagaggaauaaaaagg

SEQ ID NO: 1576858 - RNA, 18 nt, Homo sapiens
accaucgaaaagaacaug

SEQ ID NO: 1576859 - RNA, 14 nt, Homo sapiens
accaucucugugau

SEQ ID NO: 1576860 - RNA, 20 nt, Homo sapiens
accaucugaagaaacuuccc

SEQ ID NO: 1576861 - RNA, 21 nt, Homo sapiens
accaucuucguacaugaauaa

SEQ ID NO: 1576862 - RNA, 12 nt, Homo sapiens
accaugaaguca

SEQ ID NO: 1576863 - RNA, 22 nt, Homo sapiens
accaugaauacacuuacaguua

SEQ ID NO: 1576864 - RNA, 13 nt, Homo sapiens
accaugcacugua

SEQ ID NO: 1576865 - RNA, 15 nt, Homo sapiens
accaugccaggcuaa

SEQ ID NO: 1576866 - RNA, 15 nt, Homo sapiens
accauggugaacucc

SEQ ID NO: 1576867 - RNA, 23 nt, Homo sapiens
accauguacauaauucuugcuau

SEQ ID NO: 1576868 - RNA, 15 nt, Homo sapiens
accaugugguuugcu

SEQ ID NO: 1576869 - RNA, 23 nt, Homo sapiens
accauguuggccaggauggucuc

SEQ ID NO: 1576870 - RNA, 14 nt, Homo sapiens
acccaaaguguucu

SEQ ID NO: 1576871 - RNA, 14 nt, Homo sapiens
acccaacucaagga

SEQ ID NO: 1576872 - RNA, 15 nt, Homo sapiens
acccaacucaaggac

SEQ ID NO: 1576873 - RNA, 18 nt, Homo sapiens
acccaagugcugcacaaa

SEQ ID NO: 1576874 - RNA, 19 nt, Homo sapiens
acccacaacgaaugaauga

SEQ ID NO: 1576875 - RNA, 13 nt, Homo sapiens
acccacaaggcca

SEQ ID NO: 1576876 - RNA, 21 nt, Homo sapiens
acccaccauggaccagcccau

SEQ ID NO: 1576877 - RNA, 22 nt, Homo sapiens
acccaccauggaccagcccauu

SEQ ID NO: 1576878 - RNA, 16 nt, Homo sapiens
acccaccccugcacag

SEQ ID NO: 1576879 - RNA, 19 nt, Homo sapiens
acccaccugcuagugugaa

SEQ ID NO: 1576880 - RNA, 23 nt, Homo sapiens
acccaccuggcuucauacagaag

SEQ ID NO: 1576881 - RNA, 18 nt, Homo sapiens
acccacucccugucaaug

SEQ ID NO: 1576882 - RNA, 19 nt, Homo sapiens
acccagaaugagacaucca

SEQ ID NO: 1576883 - RNA, 16 nt, Homo sapiens
acccagcaaaugggca

SEQ ID NO: 1576884 - RNA, 15 nt, Homo sapiens
acccagccucugaga

SEQ ID NO: 1576885 - RNA, 13 nt, Homo sapiens
acccaggagucca

SEQ ID NO: 1576886 - RNA, 15 nt, Homo sapiens
acccaggaguccagc

SEQ ID NO: 1576887 - RNA, 17 nt, Homo sapiens
acccaggcaaucuugcc

SEQ ID NO: 1576888 - RNA, 21 nt, Homo sapiens
acccagggccugacuugagcc

SEQ ID NO: 1576889 - RNA, 12 nt, Homo sapiens
acccagucucau

SEQ ID NO: 1576890 - RNA, 21 nt, Homo sapiens
acccaguggucagcagguguc

SEQ ID NO: 1576891 - RNA, 20 nt, Homo sapiens
acccauaaguuuaacuguau

SEQ ID NO: 1576892 - RNA, 19 nt, Homo sapiens
acccaucaaaagcaccagc

SEQ ID NO: 1576893 - RNA, 24 nt, Homo sapiens
acccaugaaggcuggaaggcagca

SEQ ID NO: 1576894 - RNA, 22 nt, Homo sapiens
acccaugggcucugacagaaag

SEQ ID NO: 1576895 - RNA, 21 nt, Homo sapiens
accccaaauuguguauauauc

SEQ ID NO: 1576896 - RNA, 16 nt, Homo sapiens
accccagcucaugccc

SEQ ID NO: 1576897 - RNA, 23 nt, Homo sapiens
accccaggacgccacucauuuca

SEQ ID NO: 1576898 - RNA, 18 nt, Homo sapiens
accccaguggauucucau

SEQ ID NO: 1576899 - RNA, 11 nt, Homo sapiens
accccauacau

SEQ ID NO: 1576900 - RNA, 13 nt, Homo sapiens
accccauuccugu

SEQ ID NO: 1576901 - RNA, 14 nt, Homo sapiens
acccccagcacuug

SEQ ID NO: 1576902 - RNA, 21 nt, Homo sapiens
acccccaucucuacuaaaaau

SEQ ID NO: 1576903 - RNA, 20 nt, Homo sapiens
acccccccuccugcugccua

SEQ ID NO: 1576904 - RNA, 14 nt, Homo sapiens
acccccucccauuu

SEQ ID NO: 1576905 - RNA, 21 nt, Homo sapiens
accccggcugcuuggcaguug

SEQ ID NO: 1576906 - RNA, 20 nt, Homo sapiens
accccggggacccugugaca

SEQ ID NO: 1576907 - RNA, 20 nt, Homo sapiens
accccgucucuacuaaaaau

SEQ ID NO: 1576908 - RNA, 15 nt, Homo sapiens
accccuaaugcugca

SEQ ID NO: 1576909 - RNA, 11 nt, Homo sapiens
accccuaccuc

SEQ ID NO: 1576910 - RNA, 13 nt, Homo sapiens
accccuaccucua

SEQ ID NO: 1576911 - RNA, 14 nt, Homo sapiens
accccuaccucuag

SEQ ID NO: 1576912 - RNA, 15 nt, Homo sapiens
accccuacucacaua

SEQ ID NO: 1576913 - RNA, 23 nt, Homo sapiens
accccuccggacauccagcguga

SEQ ID NO: 1576914 - RNA, 22 nt, Homo sapiens
accccuccugccccucucucuc

SEQ ID NO: 1576915 - RNA, 18 nt, Homo sapiens
accccucgccccagccuc

SEQ ID NO: 1576916 - RNA, 23 nt, Homo sapiens
accccugcccccagccccggggu

SEQ ID NO: 1576917 - RNA, 13 nt, Homo sapiens
accccugcucagu

SEQ ID NO: 1576918 - RNA, 15 nt, Homo sapiens
accccugguucucau

SEQ ID NO: 1576919 - RNA, 14 nt, Homo sapiens
accccugucccaac

SEQ ID NO: 1576920 - RNA, 15 nt, Homo sapiens
accccuuagccuccc

SEQ ID NO: 1576921 - RNA, 20 nt, Homo sapiens
accccuugccggugaaggau

SEQ ID NO: 1576922 - RNA, 18 nt, Homo sapiens
acccgacugaaacuggaa

SEQ ID NO: 1576923 - RNA, 13 nt, Homo sapiens
acccgauuccacc

SEQ ID NO: 1576924 - RNA, 17 nt, Homo sapiens
acccgggggagcccagu

SEQ ID NO: 1576925 - RNA, 14 nt, Homo sapiens
acccguuugcuaca

SEQ ID NO: 1576926 - RNA, 16 nt, Homo sapiens
acccucagcacuguua

SEQ ID NO: 1576927 - RNA, 11 nt, Homo sapiens
acccucagcag

SEQ ID NO: 1576928 - RNA, 21 nt, Homo sapiens
acccucaucgggcgcuacugu

SEQ ID NO: 1576929 - RNA, 14 nt, Homo sapiens
acccucaucuuucu

SEQ ID NO: 1576930 - RNA, 18 nt, Homo sapiens
acccucaucuuucuucca

SEQ ID NO: 1576931 - RNA, 13 nt, Homo sapiens
acccucauuccuu

SEQ ID NO: 1576932 - RNA, 15 nt, Homo sapiens
acccuccccuaguca

SEQ ID NO: 1576933 - RNA, 21 nt, Homo sapiens
acuuaaauaauaaacagugga

SEQ ID NO: 1576934 - RNA, 17 nt, Homo sapiens
acuuaacaucaacagga

SEQ ID NO: 1576935 - RNA, 13 nt, Homo sapiens
acuuaaccuugaa

SEQ ID NO: 1576936 - RNA, 13 nt, Homo sapiens
acuuaacuaguua

SEQ ID NO: 1576937 - RNA, 21 nt, Homo sapiens
acuuaagcaucuggcucuaau

SEQ ID NO: 1576938 - RNA, 18 nt, Homo sapiens
acuuaaggggcugggaug

SEQ ID NO: 1576939 - RNA, 23 nt, Homo sapiens
acuuaaguccagaagccuccugu

SEQ ID NO: 1576940 - RNA, 14 nt, Homo sapiens
acuuacuguagccu

SEQ ID NO: 1576941 - RNA, 17 nt, Homo sapiens
acuuacuguagccucag

SEQ ID NO: 1576942 - RNA, 23 nt, Homo sapiens
acuuacugucuucuucaugucau

SEQ ID NO: 1576943 - RNA, 15 nt, Homo sapiens
acuuagcagaaccac

SEQ ID NO: 1576944 - RNA, 17 nt, Homo sapiens
acuuagcgucaagacau

SEQ ID NO: 1576945 - RNA, 22 nt, Homo sapiens
acuuagguaaaauaaaagacua

SEQ ID NO: 1576946 - RNA, 15 nt, Homo sapiens
acuuauaguacauga

SEQ ID NO: 1576947 - RNA, 14 nt, Homo sapiens
acuuaucaguuugc

SEQ ID NO: 1576948 - RNA, 15 nt, Homo sapiens
acuuaucucucaaaa

SEQ ID NO: 1576949 - RNA, 15 nt, Homo sapiens
acuuaugaccccuua

SEQ ID NO: 1576950 - RNA, 17 nt, Homo sapiens
acuuauuaccucaggug

SEQ ID NO: 1576951 - RNA, 13 nt, Homo sapiens
acuuauucauucc

SEQ ID NO: 1576952 - RNA, 22 nt, Homo sapiens
acuuauuggaacucugcuugau

SEQ ID NO: 1576953 - RNA, 16 nt, Homo sapiens
acuuauuucagccaaa

SEQ ID NO: 1576954 - RNA, 16 nt, Homo sapiens
acuucaaaauauugag

SEQ ID NO: 1576955 - RNA, 11 nt, Homo sapiens
acuucaaagag

SEQ ID NO: 1576956 - RNA, 14 nt, Homo sapiens
acuucaaaguuaau

SEQ ID NO: 1576957 - RNA, 19 nt, Homo sapiens
acuucaagaucugaauuug

SEQ ID NO: 1576958 - RNA, 16 nt, Homo sapiens
acuucacccccaacuu

SEQ ID NO: 1576959 - RNA, 23 nt, Homo sapiens
acuucacccgaguuccucugggu

SEQ ID NO: 1576960 - RNA, 17 nt, Homo sapiens
acuucagcuuuguguau

SEQ ID NO: 1576961 - RNA, 14 nt, Homo sapiens
acuucauaauccag

SEQ ID NO: 1576962 - RNA, 13 nt, Homo sapiens
acuucauauuaau

SEQ ID NO: 1576963 - RNA, 17 nt, Homo sapiens
acuucauauuaauauaa

SEQ ID NO: 1576964 - RNA, 14 nt, Homo sapiens
acuucauggaucag

SEQ ID NO: 1576965 - RNA, 22 nt, Homo sapiens
acuuccaugagaagaagcagau

SEQ ID NO: 1576966 - RNA, 13 nt, Homo sapiens
acuuccucaugaa

SEQ ID NO: 1576967 - RNA, 15 nt, Homo sapiens
acuuccugugccuuu

SEQ ID NO: 1576968 - RNA, 16 nt, Homo sapiens
acuucgcacacaccca

SEQ ID NO: 1576969 - RNA, 18 nt, Homo sapiens
acuucuacauccaaugua

SEQ ID NO: 1576970 - RNA, 17 nt, Homo sapiens
acuucuaccuacauauu

SEQ ID NO: 1576971 - RNA, 18 nt, Homo sapiens
acuucucacucaccacua

SEQ ID NO: 1576972 - RNA, 23 nt, Homo sapiens
acuucucauuuuuuaaaaaagcu

SEQ ID NO: 1576973 - RNA, 18 nt, Homo sapiens
acuucucuauuaucucaa

SEQ ID NO: 1576974 - RNA, 16 nt, Homo sapiens
acuucugccucuaagc

SEQ ID NO: 1576975 - RNA, 16 nt, Homo sapiens
acuucugcuggcauca

SEQ ID NO: 1576976 - RNA, 20 nt, Homo sapiens
acuucugcuguacagauauc

SEQ ID NO: 1576977 - RNA, 23 nt, Homo sapiens
acuucuuauggaauugauuugca

SEQ ID NO: 1576978 - RNA, 23 nt, Homo sapiens
acuucuucuguaauauuuacaau

SEQ ID NO: 1576979 - RNA, 23 nt, Homo sapiens
acuucuucuucuuuuuguuaaca

SEQ ID NO: 1576980 - RNA, 22 nt, Homo sapiens
acuucuuuuuggcauuaucucu

SEQ ID NO: 1576981 - RNA, 22 nt, Homo sapiens
acuugaaacagauucaggccag

SEQ ID NO: 1576982 - RNA, 14 nt, Homo sapiens
acuugaacaaaagg

SEQ ID NO: 1576983 - RNA, 22 nt, Homo sapiens
acuugacugggugagacccaaa

SEQ ID NO: 1576984 - RNA, 21 nt, Homo sapiens
acuugagaaccagucuccuca

SEQ ID NO: 1576985 - RNA, 19 nt, Homo sapiens
acuugccaggcucccuuuc

SEQ ID NO: 1576986 - RNA, 14 nt, Homo sapiens
acuugccucugcac

SEQ ID NO: 1576987 - RNA, 16 nt, Homo sapiens
acuugccucugcacac

SEQ ID NO: 1576988 - RNA, 21 nt, Homo sapiens
acuuggacccaaaaaaucauc

SEQ ID NO: 1576989 - RNA, 18 nt, Homo sapiens
acuuggaccucagccaac

SEQ ID NO: 1576990 - RNA, 23 nt, Homo sapiens
acuugguguuugguuccuguuca

SEQ ID NO: 1576991 - RNA, 19 nt, Homo sapiens
acuuguauuauuaaugcca

SEQ ID NO: 1576992 - RNA, 14 nt, Homo sapiens
acuugucccgggac

SEQ ID NO: 1576993 - RNA, 17 nt, Homo sapiens
acuugugcuuacaauau

SEQ ID NO: 1576994 - RNA, 19 nt, Homo sapiens
acuuguggccucaagcaau

SEQ ID NO: 1576995 - RNA, 20 nt, Homo sapiens
acuuguguucaaucugugaa

SEQ ID NO: 1576996 - RNA, 13 nt, Homo sapiens
acuuguucccucu

SEQ ID NO: 1576997 - RNA, 18 nt, Homo sapiens
acuuuaaagauaagucua

SEQ ID NO: 1576998 - RNA, 14 nt, Homo sapiens
acuuuaaguauaca

SEQ ID NO: 1576999 - RNA, 23 nt, Homo sapiens
acuuuaccaaaugaaaugccaaa

SEQ ID NO: 1577000 - RNA, 13 nt, Homo sapiens
acuuuaccaugcu

SEQ ID NO: 1577001 - RNA, 14 nt, Homo sapiens
acuuuaguacaauu

SEQ ID NO: 1577002 - RNA, 15 nt, Homo sapiens
acuuuaucaaugugu

SEQ ID NO: 1577003 - RNA, 23 nt, Homo sapiens
acuuuaugagcagcaagauugcu

SEQ ID NO: 1577004 - RNA, 22 nt, Homo sapiens
acuuuauuucugaucuauacaa

SEQ ID NO: 1577005 - RNA, 16 nt, Homo sapiens
acuuucaaaagcaaac

SEQ ID NO: 1577006 - RNA, 15 nt, Homo sapiens
acuuucauagcacug

SEQ ID NO: 1577007 - RNA, 19 nt, Homo sapiens
acuuucauugccagugucu

SEQ ID NO: 1577008 - RNA, 14 nt, Homo sapiens
acuuuccaaaaccu

SEQ ID NO: 1577009 - RNA, 19 nt, Homo sapiens
acuuucccuugugucaaga

SEQ ID NO: 1577010 - RNA, 21 nt, Homo sapiens
acuuucgaccgacuuucccca

SEQ ID NO: 1577011 - RNA, 22 nt, Homo sapiens
acuuucuaaguaggaugaauca

SEQ ID NO: 1577012 - RNA, 16 nt, Homo sapiens
acuuucucugcaaaga

SEQ ID NO: 1577013 - RNA, 17 nt, Homo sapiens
acuuugaaacuaucuca

SEQ ID NO: 1577014 - RNA, 14 nt, Homo sapiens
acuuugacaguguu

SEQ ID NO: 1577015 - RNA, 23 nt, Homo sapiens
acuuugccauuaugcaaauggag

SEQ ID NO: 1577016 - RNA, 14 nt, Homo sapiens
acuuuggaaucuaa

SEQ ID NO: 1577017 - RNA, 16 nt, Homo sapiens
acuuuggcaauuuccu

SEQ ID NO: 1577018 - RNA, 16 nt, Homo sapiens
acuuuggguacuuaua

SEQ ID NO: 1577019 - RNA, 20 nt, Homo sapiens
acuuugucacuucugcugua

SEQ ID NO: 1577020 - RNA, 23 nt, Homo sapiens
acuuuguuuucaagaugguguua

SEQ ID NO: 1577021 - RNA, 20 nt, Homo sapiens
acuuuuaaaaugaagcuuug

SEQ ID NO: 1577022 - RNA, 15 nt, Homo sapiens
acuuuuaccacuugc

SEQ ID NO: 1577023 - RNA, 16 nt, Homo sapiens
agaaaaaaagcacaaa

SEQ ID NO: 1577024 - RNA, 15 nt, Homo sapiens
agaaaaaacaggccc

SEQ ID NO: 1577025 - RNA, 15 nt, Homo sapiens
agaaaaauauuauaa

SEQ ID NO: 1577026 - RNA, 13 nt, Homo sapiens
agaaaacaaucaa

SEQ ID NO: 1577027 - RNA, 15 nt, Homo sapiens
agaaaacauaaucuu

SEQ ID NO: 1577028 - RNA, 22 nt, Homo sapiens
agaaaaccacaacuaaaacugg

SEQ ID NO: 1577029 - RNA, 22 nt, Homo sapiens
agaaaaccucuccugaccccug

SEQ ID NO: 1577030 - RNA, 21 nt, Homo sapiens
agaaaacucccaauacaaaga

SEQ ID NO: 1577031 - RNA, 18 nt, Homo sapiens
agaaaagcaugcauauca

SEQ ID NO: 1577032 - RNA, 19 nt, Homo sapiens
agaaaagcccaaguucaug

SEQ ID NO: 1577033 - RNA, 21 nt, Homo sapiens
agaaaaguuauuagugguuua

SEQ ID NO: 1577034 - RNA, 19 nt, Homo sapiens
agaaaaucaaauauauaac

SEQ ID NO: 1577035 - RNA, 21 nt, Homo sapiens
agaaaauccauucauucaauc

SEQ ID NO: 1577036 - RNA, 16 nt, Homo sapiens
agaaaaucuaccaaga

SEQ ID NO: 1577037 - RNA, 16 nt, Homo sapiens
agaaaauuagacugug

SEQ ID NO: 1577038 - RNA, 21 nt, Homo sapiens
agaaaauuagugaccauuauu

SEQ ID NO: 1577039 - RNA, 21 nt, Homo sapiens
agaaaauuccuagaaauugaa

SEQ ID NO: 1577040 - RNA, 21 nt, Homo sapiens
agaaacaaaaucaaaacagag

SEQ ID NO: 1577041 - RNA, 17 nt, Homo sapiens
agaaacaaagauguuau

SEQ ID NO: 1577042 - RNA, 22 nt, Homo sapiens
agaaacaccagccgaggccaca

SEQ ID NO: 1577043 - RNA, 11 nt, Homo sapiens
agaaaccaaac

SEQ ID NO: 1577044 - RNA, 12 nt, Homo sapiens
agaaacccaagu

SEQ ID NO: 1577045 - RNA, 14 nt, Homo sapiens
agaaaccugacuca

SEQ ID NO: 1577046 - RNA, 14 nt, Homo sapiens
agaaacgucuucua

SEQ ID NO: 1577047 - RNA, 13 nt, Homo sapiens
agaaacuucccaa

SEQ ID NO: 1577048 - RNA, 14 nt, Homo sapiens
agaaacuuugugcu

SEQ ID NO: 1577049 - RNA, 16 nt, Homo sapiens
agaaacuuugugcuac

SEQ ID NO: 1577050 - RNA, 14 nt, Homo sapiens
agaaagaaagggaa

SEQ ID NO: 1577051 - RNA, 17 nt, Homo sapiens
agauugcaccacugcac

SEQ ID NO: 1577052 - RNA, 19 nt, Homo sapiens
agauuggcaugccauugaa

SEQ ID NO: 1577053 - RNA, 17 nt, Homo sapiens
agauugggauacuguaa

SEQ ID NO: 1577054 - RNA, 19 nt, Homo sapiens
agauuguccuuuucuccca

SEQ ID NO: 1577055 - RNA, 17 nt, Homo sapiens
agauuuaaagcaucauc

SEQ ID NO: 1577056 - RNA, 16 nt, Homo sapiens
agauuuacuaaaucaa

SEQ ID NO: 1577057 - RNA, 17 nt, Homo sapiens
agauuuaggagcagaaa

SEQ ID NO: 1577058 - RNA, 23 nt, Homo sapiens
agauuugcccauuuacacuuuug

SEQ ID NO: 1577059 - RNA, 17 nt, Homo sapiens
agauuuggcuugacaaa

SEQ ID NO: 1577060 - RNA, 17 nt, Homo sapiens
agauuuucaugcaaaag

SEQ ID NO: 1577061 - RNA, 15 nt, Homo sapiens
agauuuuguuugcau

SEQ ID NO: 1577062 - RNA, 18 nt, Homo sapiens
agauuuuucuauccaaau

SEQ ID NO: 1577063 - RNA, 16 nt, Homo sapiens
agcaaaaggcugagaa

SEQ ID NO: 1577064 - RNA, 14 nt, Homo sapiens
agcaaaauaaugca

SEQ ID NO: 1577065 - RNA, 13 nt, Homo sapiens
agcaaaaugugau

SEQ ID NO: 1577066 - RNA, 16 nt, Homo sapiens
agcaaagauuaaaugu

SEQ ID NO: 1577067 - RNA, 19 nt, Homo sapiens
agcaaagauuaaauguguc

SEQ ID NO: 1577068 - RNA, 21 nt, Homo sapiens
agcaaagcaaaaggcugagaa

SEQ ID NO: 1577069 - RNA, 15 nt, Homo sapiens
agcaaauaagucauc

SEQ ID NO: 1577070 - RNA, 19 nt, Homo sapiens
agcaaauuagaaacaccau

SEQ ID NO: 1577071 - RNA, 23 nt, Homo sapiens
agcaacaggccauugugaaccaa

SEQ ID NO: 1577072 - RNA, 19 nt, Homo sapiens
agcaacauucauagucuuu

SEQ ID NO: 1577073 - RNA, 20 nt, Homo sapiens
agcaacauucauagucuuug

SEQ ID NO: 1577074 - RNA, 20 nt, Homo sapiens
agcaacauuuguuuuagucu

SEQ ID NO: 1577075 - RNA, 19 nt, Homo sapiens
agcaacccagaauguaaaa

SEQ ID NO: 1577076 - RNA, 14 nt, Homo sapiens
agcaacucagagaa

SEQ ID NO: 1577077 - RNA, 13 nt, Homo sapiens
agcaacuuuccuu

SEQ ID NO: 1577078 - RNA, 16 nt, Homo sapiens
agcaagaccucaucuc

SEQ ID NO: 1577079 - RNA, 23 nt, Homo sapiens
agcaagacugaagauggcuuuuc

SEQ ID NO: 1577080 - RNA, 22 nt, Homo sapiens
agcaagcuuugguuuaugguuu

SEQ ID NO: 1577081 - RNA, 21 nt, Homo sapiens
agcaaggaguuuaaaugagac

SEQ ID NO: 1577082 - RNA, 15 nt, Homo sapiens
agcaaggauggagcu

SEQ ID NO: 1577083 - RNA, 21 nt, Homo sapiens
agcaagggggacauugcccaa

SEQ ID NO: 1577084 - RNA, 22 nt, Homo sapiens
agcaaguguucacaacagugaa

SEQ ID NO: 1577085 - RNA, 13 nt, Homo sapiens
agcaauacaggga

SEQ ID NO: 1577086 - RNA, 15 nt, Homo sapiens
agcaauagguuugua

SEQ ID NO: 1577087 - RNA, 19 nt, Homo sapiens
agcaaucaagguuauaauu

SEQ ID NO: 1577088 - RNA, 20 nt, Homo sapiens
agcaaucauuuuaugcuguu

SEQ ID NO: 1577089 - RNA, 15 nt, Homo sapiens
agcaauccuccugcc

SEQ ID NO: 1577090 - RNA, 14 nt, Homo sapiens
agcaauggccagag

SEQ ID NO: 1577091 - RNA, 20 nt, Homo sapiens
agcaaugguaauugugaaua

SEQ ID NO: 1577092 - RNA, 17 nt, Homo sapiens
agcaauucuccugccuc

SEQ ID NO: 1577093 - RNA, 21 nt, Homo sapiens
agcaauuugaagagaaucuuu

SEQ ID NO: 1577094 - RNA, 21 nt, Homo sapiens
agcacagaggacuuauucaac

SEQ ID NO: 1577095 - RNA, 15 nt, Homo sapiens
agcacauauuugcau

SEQ ID NO: 1577096 - RNA, 16 nt, Homo sapiens
agcacaucaauuacaa

SEQ ID NO: 1577097 - RNA, 12 nt, Homo sapiens
agcacaucucuc

SEQ ID NO: 1577098 - RNA, 17 nt, Homo sapiens
agcacaucucucugccc

SEQ ID NO: 1577099 - RNA, 23 nt, Homo sapiens
agcacauuccaaacuuuagcaac

SEQ ID NO: 1577100 - RNA, 21 nt, Homo sapiens
agcaccaucucuuuaccuccu

SEQ ID NO: 1577101 - RNA, 22 nt, Homo sapiens
agcacggacucuuacugcuaac

SEQ ID NO: 1577102 - RNA, 19 nt, Homo sapiens
agcacggucccccaggagg

SEQ ID NO: 1577103 - RNA, 19 nt, Homo sapiens
agcacuaagguggacagca

SEQ ID NO: 1577104 - RNA, 22 nt, Homo sapiens
agcacucccuaauuuaugugcu

SEQ ID NO: 1577105 - RNA, 10 nt, Homo sapiens
agcacugagg

SEQ ID NO: 1577106 - RNA, 17 nt, Homo sapiens
agcacuggggagucuuu

SEQ ID NO: 1577107 - RNA, 15 nt, Homo sapiens
agcacugggugacca

SEQ ID NO: 1577108 - RNA, 14 nt, Homo sapiens
agcacuuccauggg

SEQ ID NO: 1577109 - RNA, 20 nt, Homo sapiens
agcacuugagaaccagucuc

SEQ ID NO: 1577110 - RNA, 14 nt, Homo sapiens
agcagaacagugau

SEQ ID NO: 1577111 - RNA, 15 nt, Homo sapiens
agcagaacagugauu

SEQ ID NO: 1577112 - RNA, 19 nt, Homo sapiens
agcagaagcacauuuucag

SEQ ID NO: 1577113 - RNA, 19 nt, Homo sapiens
agcagaagcuggaggcaca

SEQ ID NO: 1577114 - RNA, 20 nt, Homo sapiens
agcagaauucauucauacuu

SEQ ID NO: 1577115 - RNA, 17 nt, Homo sapiens
agcagacaaaaugaaag

SEQ ID NO: 1577116 - RNA, 20 nt, Homo sapiens
agcagacaccauucauucca

SEQ ID NO: 1577117 - RNA, 14 nt, Homo sapiens
agcagagaacugcc

SEQ ID NO: 1577118 - RNA, 18 nt, Homo sapiens
agcagagcagcucugcua

SEQ ID NO: 1577119 - RNA, 15 nt, Homo sapiens
agcagaggucuccca

SEQ ID NO: 1577120 - RNA, 15 nt, Homo sapiens
agcagauaacuuuuu

SEQ ID NO: 1577121 - RNA, 14 nt, Homo sapiens
agcagauacuugag

SEQ ID NO: 1577122 - RNA, 18 nt, Homo sapiens
agcagcacgauuuugcac

SEQ ID NO: 1577123 - RNA, 14 nt, Homo sapiens
agcagcacugugag

SEQ ID NO: 1577124 - RNA, 22 nt, Homo sapiens
agcagcagcacuuagaccugcc

SEQ ID NO: 1577125 - RNA, 12 nt, Homo sapiens
agcagcauccac

SEQ ID NO: 1577126 - RNA, 18 nt, Homo sapiens
agcaggaaaaaaggaaua

SEQ ID NO: 1577127 - RNA, 13 nt, Homo sapiens
agcaggcauuugc

SEQ ID NO: 1577128 - RNA, 20 nt, Homo sapiens
agcaggcugacuaugugccg

SEQ ID NO: 1577129 - RNA, 21 nt, Homo sapiens
agcaggggacuacaugugaac

SEQ ID NO: 1577130 - RNA, 18 nt, Homo sapiens
agcaggggcagaugccac

SEQ ID NO: 1577131 - RNA, 16 nt, Homo sapiens
agcaggggcuccagca

SEQ ID NO: 1577132 - RNA, 14 nt, Homo sapiens
agcaggguaaugua

SEQ ID NO: 1577133 - RNA, 19 nt, Homo sapiens
agcaggucaaaaaggccaa

SEQ ID NO: 1577134 - RNA, 15 nt, Homo sapiens
agcagguguacacau

SEQ ID NO: 1577135 - RNA, 12 nt, Homo sapiens
agcagucagggu

SEQ ID NO: 1577136 - RNA, 13 nt, Homo sapiens
agcagucuugcuc

SEQ ID NO: 1577137 - RNA, 14 nt, Homo sapiens
agcaguguuuuaga

SEQ ID NO: 1577138 - RNA, 14 nt, Homo sapiens
agcaguucugcaaa

SEQ ID NO: 1577139 - RNA, 22 nt, Homo sapiens
agcaucucccaguucauaauca

SEQ ID NO: 1577140 - RNA, 14 nt, Homo sapiens
agcaugaaagugga

SEQ ID NO: 1577141 - RNA, 22 nt, Homo sapiens
agcaugauaggauuuggggcag

SEQ ID NO: 1577142 - RNA, 22 nt, Homo sapiens
agcaugcacacugagaaugcua

SEQ ID NO: 1577143 - RNA, 22 nt, Homo sapiens
agcaugccaaggcucuguggga

SEQ ID NO: 1577144 - RNA, 11 nt, Homo sapiens
agcauggagcu

SEQ ID NO: 1577145 - RNA, 21 nt, Homo sapiens
agcauguggucuuauaguguu

SEQ ID NO: 1577146 - RNA, 16 nt, Homo sapiens
agcauuaacugucuua

SEQ ID NO: 1577147 - RNA, 14 nt, Homo sapiens
agcauugagcauaa

SEQ ID NO: 1577148 - RNA, 23 nt, Homo sapiens
agcauuugguagaaggacugaac

SEQ ID NO: 1577149 - RNA, 20 nt, Homo sapiens
agccaagagugcacuacugu

SEQ ID NO: 1577150 - RNA, 22 nt, Homo sapiens
agccaauaaaccgaaaguguua

SEQ ID NO: 1577151 - RNA, 14 nt, Homo sapiens
agccacaaagcccc

SEQ ID NO: 1577152 - RNA, 17 nt, Homo sapiens
agccacaccuuuuccag

SEQ ID NO: 1577153 - RNA, 21 nt, Homo sapiens
agccacagaugggcaaacccu

SEQ ID NO: 1577154 - RNA, 11 nt, Homo sapiens
agccacaggcc

SEQ ID NO: 1577155 - RNA, 21 nt, Homo sapiens
agccacaggccugagauuuca

SEQ ID NO: 1577156 - RNA, 12 nt, Homo sapiens
agccacaugccc

SEQ ID NO: 1577157 - RNA, 18 nt, Homo sapiens
agccacauugagacuuuc

SEQ ID NO: 1577158 - RNA, 23 nt, Homo sapiens
agccaccacaucccuucauauca

SEQ ID NO: 1577159 - RNA, 19 nt, Homo sapiens
agccacugucacaggcaua

SEQ ID NO: 1577160 - RNA, 14 nt, Homo sapiens
agccagacuggcac

SEQ ID NO: 1577161 - RNA, 19 nt, Homo sapiens
agccagacuguccagggaa

SEQ ID NO: 1577162 - RNA, 16 nt, Homo sapiens
agccagagacagagga

SEQ ID NO: 1577163 - RNA, 19 nt, Homo sapiens
agccagaggguagggcaca

SEQ ID NO: 1577164 - RNA, 16 nt, Homo sapiens
agccagccaagcuuua

SEQ ID NO: 1577165 - RNA, 20 nt, Homo sapiens
agccagcuuacuagcacuuu

SEQ ID NO: 1577166 - RNA, 22 nt, Homo sapiens
agccagcuuacuagcacuuuga

SEQ ID NO: 1577167 - RNA, 12 nt, Homo sapiens
agccaggagcag

SEQ ID NO: 1577168 - RNA, 19 nt, Homo sapiens
agccaggcacacacugugc

SEQ ID NO: 1577169 - RNA, 15 nt, Homo sapiens
aggagagacauggaa

SEQ ID NO: 1577170 - RNA, 12 nt, Homo sapiens
aggagaugucau

SEQ ID NO: 1577171 - RNA, 14 nt, Homo sapiens
aggagauuacaauu

SEQ ID NO: 1577172 - RNA, 15 nt, Homo sapiens
aggagcaacagcgau

SEQ ID NO: 1577173 - RNA, 18 nt, Homo sapiens
aggagcagaccagcacuu

SEQ ID NO: 1577174 - RNA, 21 nt, Homo sapiens
aggagccauugcucuccuaga

SEQ ID NO: 1577175 - RNA, 14 nt, Homo sapiens
aggagccucacugg

SEQ ID NO: 1577176 - RNA, 16 nt, Homo sapiens
aggagccucacugggg

SEQ ID NO: 1577177 - RNA, 14 nt, Homo sapiens
aggagccuuuccag

SEQ ID NO: 1577178 - RNA, 23 nt, Homo sapiens
aggagcugauacuuugacagugu

SEQ ID NO: 1577179 - RNA, 14 nt, Homo sapiens
aggagcugcaaauu

SEQ ID NO: 1577180 - RNA, 18 nt, Homo sapiens
aggagcuuuggaccuaau

SEQ ID NO: 1577181 - RNA, 16 nt, Homo sapiens
aggaggauaagcuuuu

SEQ ID NO: 1577182 - RNA, 14 nt, Homo sapiens
aggaggaucacuug

SEQ ID NO: 1577183 - RNA, 15 nt, Homo sapiens
aggaggaucacuuga

SEQ ID NO: 1577184 - RNA, 14 nt, Homo sapiens
aggaggcugccaca

SEQ ID NO: 1577185 - RNA, 15 nt, Homo sapiens
aggagggagugcugu

SEQ ID NO: 1577186 - RNA, 15 nt, Homo sapiens
aggagggcaggcauc

SEQ ID NO: 1577187 - RNA, 23 nt, Homo sapiens
aggagggcgugacucacccaagc

SEQ ID NO: 1577188 - RNA, 20 nt, Homo sapiens
aggagggucuccacacugcu

SEQ ID NO: 1577189 - RNA, 16 nt, Homo sapiens
aggaguauauggacac

SEQ ID NO: 1577190 - RNA, 12 nt, Homo sapiens
aggaguccaggc

SEQ ID NO: 1577191 - RNA, 15 nt, Homo sapiens
aggagucccugccau

SEQ ID NO: 1577192 - RNA, 13 nt, Homo sapiens
aggaguucaagac

SEQ ID NO: 1577193 - RNA, 15 nt, Homo sapiens
aggaguuccaccaug

SEQ ID NO: 1577194 - RNA, 18 nt, Homo sapiens
aggaguuuauuacaaugu

SEQ ID NO: 1577195 - RNA, 22 nt, Homo sapiens
aggauacauaaugggccacuga

SEQ ID NO: 1577196 - RNA, 17 nt, Homo sapiens
aggauacccagaugcca

SEQ ID NO: 1577197 - RNA, 15 nt, Homo sapiens
aggauauaaugugug

SEQ ID NO: 1577198 - RNA, 18 nt, Homo sapiens
aggaucaaagaacugaaa

SEQ ID NO: 1577199 - RNA, 17 nt, Homo sapiens
aggaucaguuaacuauu

SEQ ID NO: 1577200 - RNA, 14 nt, Homo sapiens
aggaucugcuccaa

SEQ ID NO: 1577201 - RNA, 14 nt, Homo sapiens
aggauguaagccug

SEQ ID NO: 1577202 - RNA, 15 nt, Homo sapiens
aggauguaagccugg

SEQ ID NO: 1577203 - RNA, 12 nt, Homo sapiens
aggaugugauga

SEQ ID NO: 1577204 - RNA, 17 nt, Homo sapiens
aggauuacacauuucac

SEQ ID NO: 1577205 - RNA, 22 nt, Homo sapiens
aggauuacacauuucacuguga

SEQ ID NO: 1577206 - RNA, 14 nt, Homo sapiens
aggauucagcuauu

SEQ ID NO: 1577207 - RNA, 23 nt, Homo sapiens
aggauuugccauuguccaggaaa

SEQ ID NO: 1577208 - RNA, 21 nt, Homo sapiens
aggauuuggggcagagggaca

SEQ ID NO: 1577209 - RNA, 16 nt, Homo sapiens
aggauuuuaccaaagc

SEQ ID NO: 1577210 - RNA, 21 nt, Homo sapiens
aggcaaaaccgugcucuuuau

SEQ ID NO: 1577211 - RNA, 14 nt, Homo sapiens
aggcaaaauugcaa

SEQ ID NO: 1577212 - RNA, 19 nt, Homo sapiens
aggcaaaguuuacagaugu

SEQ ID NO: 1577213 - RNA, 22 nt, Homo sapiens
aggcaagcguguucucagcaca

SEQ ID NO: 1577214 - RNA, 14 nt, Homo sapiens
aggcacacacugug

SEQ ID NO: 1577215 - RNA, 16 nt, Homo sapiens
aggcacauacaccucg

SEQ ID NO: 1577216 - RNA, 21 nt, Homo sapiens
aggcacccucagggagccucc

SEQ ID NO: 1577217 - RNA, 20 nt, Homo sapiens
aggcagacgucugucagggg

SEQ ID NO: 1577218 - RNA, 16 nt, Homo sapiens
aggcagagacaucuuu

SEQ ID NO: 1577219 - RNA, 14 nt, Homo sapiens
aggcagagccagug

SEQ ID NO: 1577220 - RNA, 17 nt, Homo sapiens
aggcagagccagugugc

SEQ ID NO: 1577221 - RNA, 12 nt, Homo sapiens
aggcagaucugu

SEQ ID NO: 1577222 - RNA, 14 nt, Homo sapiens
aggcagcauuccau

SEQ ID NO: 1577223 - RNA, 14 nt, Homo sapiens
aggcagccagccgu

SEQ ID NO: 1577224 - RNA, 18 nt, Homo sapiens
aggcagcuucuacuccug

SEQ ID NO: 1577225 - RNA, 24 nt, Homo sapiens
aggcagcuucuacuccugccucau

SEQ ID NO: 1577226 - RNA, 16 nt, Homo sapiens
aggcaggacuucucac

SEQ ID NO: 1577227 - RNA, 19 nt, Homo sapiens
aggcaggagaaucacuuga

SEQ ID NO: 1577228 - RNA, 15 nt, Homo sapiens
aggcaggagguacaa

SEQ ID NO: 1577229 - RNA, 22 nt, Homo sapiens
aggcaggcugggacggaccagc

SEQ ID NO: 1577230 - RNA, 21 nt, Homo sapiens
aggcagggccuugcccagaga

SEQ ID NO: 1577231 - RNA, 16 nt, Homo sapiens
aggcaggggaauguau

SEQ ID NO: 1577232 - RNA, 15 nt, Homo sapiens
aggcaggugcaggga

SEQ ID NO: 1577233 - RNA, 15 nt, Homo sapiens
aggcaguaaugccuu

SEQ ID NO: 1577234 - RNA, 15 nt, Homo sapiens
aggcagucauaucaa

SEQ ID NO: 1577235 - RNA, 18 nt, Homo sapiens
aggcagugcugagaggga

SEQ ID NO: 1577236 - RNA, 18 nt, Homo sapiens
aggcauacacacagcagu

SEQ ID NO: 1577237 - RNA, 21 nt, Homo sapiens
aggcaucaguaugucacucug

SEQ ID NO: 1577238 - RNA, 20 nt, Homo sapiens
aggcaucauacuaaacuuca

SEQ ID NO: 1577239 - RNA, 20 nt, Homo sapiens
aggcauguuugauacacauu

SEQ ID NO: 1577240 - RNA, 21 nt, Homo sapiens
aggccaacuuuuuuuccuugu

SEQ ID NO: 1577241 - RNA, 22 nt, Homo sapiens
aggccaauguaucccugaggaa

SEQ ID NO: 1577242 - RNA, 18 nt, Homo sapiens
aggccaccaagcugcucu

SEQ ID NO: 1577243 - RNA, 14 nt, Homo sapiens
aggccacguccagg

SEQ ID NO: 1577244 - RNA, 15 nt, Homo sapiens
aggccagcaccaucu

SEQ ID NO: 1577245 - RNA, 17 nt, Homo sapiens
aggccagcaccaucucu

SEQ ID NO: 1577246 - RNA, 20 nt, Homo sapiens
aggccaggcacaguggcuca

SEQ ID NO: 1577247 - RNA, 15 nt, Homo sapiens
aggccauugucccug

SEQ ID NO: 1577248 - RNA, 22 nt, Homo sapiens
aggccccaaucuugcccacugg

SEQ ID NO: 1577249 - RNA, 12 nt, Homo sapiens
aggcccucgcug

SEQ ID NO: 1577250 - RNA, 13 nt, Homo sapiens
aggccgccagacu

SEQ ID NO: 1577251 - RNA, 22 nt, Homo sapiens
aggccguugguugucugaagag

SEQ ID NO: 1577252 - RNA, 23 nt, Homo sapiens
aggccuagacucugucuaccugg

SEQ ID NO: 1577253 - RNA, 23 nt, Homo sapiens
aggccuauaacuuuugguaucua

SEQ ID NO: 1577254 - RNA, 19 nt, Homo sapiens
aggccucucggugcuccau

SEQ ID NO: 1577255 - RNA, 22 nt, Homo sapiens
aggccucucggugcuccaucuc

SEQ ID NO: 1577256 - RNA, 19 nt, Homo sapiens
aggccucugcuggcucagg

SEQ ID NO: 1577257 - RNA, 20 nt, Homo sapiens
aggccugaaaugacauuuca

SEQ ID NO: 1577258 - RNA, 12 nt, Homo sapiens
aggccugagauu

SEQ ID NO: 1577259 - RNA, 16 nt, Homo sapiens
aggccugagauuucau

SEQ ID NO: 1577260 - RNA, 23 nt, Homo sapiens
aggccugagauuucaucugcucu

SEQ ID NO: 1577261 - RNA, 18 nt, Homo sapiens
aggccugaggagcagugu

SEQ ID NO: 1577262 - RNA, 18 nt, Homo sapiens
aggccugcuagucacugg

SEQ ID NO: 1577263 - RNA, 16 nt, Homo sapiens
aggccugguguguuca

SEQ ID NO: 1577264 - RNA, 17 nt, Homo sapiens
aggccuucaggacucua

SEQ ID NO: 1577265 - RNA, 14 nt, Homo sapiens
aggccuuggguguu

SEQ ID NO: 1577266 - RNA, 17 nt, Homo sapiens
aggccuuggguguucca

SEQ ID NO: 1577267 - RNA, 15 nt, Homo sapiens
aggcgcacaguguga

SEQ ID NO: 1577268 - RNA, 16 nt, Homo sapiens
aggcgcacagugugag

SEQ ID NO: 1577269 - RNA, 18 nt, Homo sapiens
aggcggcagauccugccc

SEQ ID NO: 1577270 - RNA, 15 nt, Homo sapiens
aggcgggaaaaucau

SEQ ID NO: 1577271 - RNA, 19 nt, Homo sapiens
aggcgggaaaaucauuuga

SEQ ID NO: 1577272 - RNA, 15 nt, Homo sapiens
aggcuaaaaagcaac

SEQ ID NO: 1577273 - RNA, 18 nt, Homo sapiens
aggcuaaaugagauacac

SEQ ID NO: 1577274 - RNA, 17 nt, Homo sapiens
aggcuagaaccaccugc

SEQ ID NO: 1577275 - RNA, 22 nt, Homo sapiens
aggcuccagagggcacucugcu

SEQ ID NO: 1577276 - RNA, 16 nt, Homo sapiens
aggcuccccaucuucu

SEQ ID NO: 1577277 - RNA, 18 nt, Homo sapiens
aggcuccccaucuucucc

SEQ ID NO: 1577278 - RNA, 17 nt, Homo sapiens
aggcucguugacuggcu

SEQ ID NO: 1577279 - RNA, 16 nt, Homo sapiens
aggcucugaaauggaa

SEQ ID NO: 1577280 - RNA, 20 nt, Homo sapiens
aggcucuuaugugugccuuu

SEQ ID NO: 1577281 - RNA, 14 nt, Homo sapiens
aggcugacauucac

SEQ ID NO: 1577282 - RNA, 18 nt, Homo sapiens
aggcugagaacucguuca

SEQ ID NO: 1577283 - RNA, 14 nt, Homo sapiens
aggcugagaaggaa

SEQ ID NO: 1577284 - RNA, 17 nt, Homo sapiens
aggcugagccugcucau

SEQ ID NO: 1577285 - RNA, 18 nt, Homo sapiens
aggcugccccucucacca

SEQ ID NO: 1577286 - RNA, 17 nt, Homo sapiens
aggcugcuagauguagg

SEQ ID NO: 1577287 - RNA, 16 nt, Homo sapiens
aggcuggaaaugguuu

SEQ ID NO: 1577288 - RNA, 13 nt, Homo sapiens
agugaaucuguau

SEQ ID NO: 1577289 - RNA, 23 nt, Homo sapiens
agugacaagggcacaagcucagg

SEQ ID NO: 1577290 - RNA, 20 nt, Homo sapiens
agugacagagcgagacucca

SEQ ID NO: 1577291 - RNA, 12 nt, Homo sapiens
agugacagucau

SEQ ID NO: 1577292 - RNA, 16 nt, Homo sapiens
agugacaugugcugga

SEQ ID NO: 1577293 - RNA, 21 nt, Homo sapiens
agugacaugugcuggacacug

SEQ ID NO: 1577294 - RNA, 22 nt, Homo sapiens
agugaccauuauucacaggugg

SEQ ID NO: 1577295 - RNA, 15 nt, Homo sapiens
agugacccacccuag

SEQ ID NO: 1577296 - RNA, 19 nt, Homo sapiens
agugagaaggcaaccaaag

SEQ ID NO: 1577297 - RNA, 15 nt, Homo sapiens
agugagacacaguaa

SEQ ID NO: 1577298 - RNA, 15 nt, Homo sapiens
agugagacuguacau

SEQ ID NO: 1577299 - RNA, 16 nt, Homo sapiens
agugagccgagaucau

SEQ ID NO: 1577300 - RNA, 16 nt, Homo sapiens
agugagcugagaucac

SEQ ID NO: 1577301 - RNA, 16 nt, Homo sapiens
agugagugccaugcuu

SEQ ID NO: 1577302 - RNA, 17 nt, Homo sapiens
agugauacucacguuug

SEQ ID NO: 1577303 - RNA, 13 nt, Homo sapiens
agugcacaugccc

SEQ ID NO: 1577304 - RNA, 19 nt, Homo sapiens
agugcagccuucuccauau

SEQ ID NO: 1577305 - RNA, 20 nt, Homo sapiens
agugcaguggugugaucuca

SEQ ID NO: 1577306 - RNA, 18 nt, Homo sapiens
agugcaucagauguaaca

SEQ ID NO: 1577307 - RNA, 21 nt, Homo sapiens
agugccacccaccuuugccac

SEQ ID NO: 1577308 - RNA, 21 nt, Homo sapiens
agugccauaaccaugagcacu

SEQ ID NO: 1577309 - RNA, 13 nt, Homo sapiens
agugcccuaggcc

SEQ ID NO: 1577310 - RNA, 13 nt, Homo sapiens
agugcccucucug

SEQ ID NO: 1577311 - RNA, 14 nt, Homo sapiens
agugccuuaccucc

SEQ ID NO: 1577312 - RNA, 15 nt, Homo sapiens
agugcuauuguagag

SEQ ID NO: 1577313 - RNA, 14 nt, Homo sapiens
agugcucaauagcu

SEQ ID NO: 1577314 - RNA, 18 nt, Homo sapiens
agugcugcccaugagcaa

SEQ ID NO: 1577315 - RNA, 21 nt, Homo sapiens
agugcuguccaugcuucucau

SEQ ID NO: 1577316 - RNA, 15 nt, Homo sapiens
agugcuuaaaaauac

SEQ ID NO: 1577317 - RNA, 14 nt, Homo sapiens
agugcuuugugaua

SEQ ID NO: 1577318 - RNA, 16 nt, Homo sapiens
agugcuuugugauagu

SEQ ID NO: 1577319 - RNA, 11 nt, Homo sapiens
aguggacaaau

SEQ ID NO: 1577320 - RNA, 19 nt, Homo sapiens
aguggacgugucagguggu

SEQ ID NO: 1577321 - RNA, 19 nt, Homo sapiens
aguggacucagaaagccaa

SEQ ID NO: 1577322 - RNA, 17 nt, Homo sapiens
aguggagaccuuucuag

SEQ ID NO: 1577323 - RNA, 15 nt, Homo sapiens
aguggagagugacau

SEQ ID NO: 1577324 - RNA, 14 nt, Homo sapiens
aguggagaugaagc

SEQ ID NO: 1577325 - RNA, 22 nt, Homo sapiens
aguggaucuucagaacugcccu

SEQ ID NO: 1577326 - RNA, 13 nt, Homo sapiens
aguggccaggugc

SEQ ID NO: 1577327 - RNA, 17 nt, Homo sapiens
aguggcccauggcauuu

SEQ ID NO: 1577328 - RNA, 19 nt, Homo sapiens
aguggcccauggcauuuua

SEQ ID NO: 1577329 - RNA, 15 nt, Homo sapiens
aguggcgcaugccug

SEQ ID NO: 1577330 - RNA, 14 nt, Homo sapiens
aguggcgugaucuc

SEQ ID NO: 1577331 - RNA, 22 nt, Homo sapiens
aguggcguuguugcauguuuga

SEQ ID NO: 1577332 - RNA, 16 nt, Homo sapiens
agugggccuccaagga

SEQ ID NO: 1577333 - RNA, 23 nt, Homo sapiens
aguggggagagagcccuucccag

SEQ ID NO: 1577334 - RNA, 17 nt, Homo sapiens
agugguaaauacuguga

SEQ ID NO: 1577335 - RNA, 16 nt, Homo sapiens
aguggucagcaggugu

SEQ ID NO: 1577336 - RNA, 22 nt, Homo sapiens
agugguucaagcacacuggaau

SEQ ID NO: 1577337 - RNA, 22 nt, Homo sapiens
agugguuguccccguaccacca

SEQ ID NO: 1577338 - RNA, 17 nt, Homo sapiens
aguguaacagauaucag

SEQ ID NO: 1577339 - RNA, 14 nt, Homo sapiens
aguguauuaaucuc

SEQ ID NO: 1577340 - RNA, 18 nt, Homo sapiens
agugucaaauaaacacug

SEQ ID NO: 1577341 - RNA, 20 nt, Homo sapiens
agugucaaauaaacacugug

SEQ ID NO: 1577342 - RNA, 22 nt, Homo sapiens
agugucaaauaaacacugugua

SEQ ID NO: 1577343 - RNA, 20 nt, Homo sapiens
agugucaccuugguuugcaa

SEQ ID NO: 1577344 - RNA, 14 nt, Homo sapiens
aguguccuaugcaa

SEQ ID NO: 1577345 - RNA, 18 nt, Homo sapiens
agugucuccccguguccu

SEQ ID NO: 1577346 - RNA, 16 nt, Homo sapiens
agugugcucggacaca

SEQ ID NO: 1577347 - RNA, 16 nt, Homo sapiens
agugugggggguccuu

SEQ ID NO: 1577348 - RNA, 21 nt, Homo sapiens
agugugugauaaaucagucaa

SEQ ID NO: 1577349 - RNA, 16 nt, Homo sapiens
aguguuaaaacaugaa

SEQ ID NO: 1577350 - RNA, 20 nt, Homo sapiens
aguguuccccuuccacugag

SEQ ID NO: 1577351 - RNA, 23 nt, Homo sapiens
aguguuccccuuccacugagggc

SEQ ID NO: 1577352 - RNA, 13 nt, Homo sapiens
aguguucccugac

SEQ ID NO: 1577353 - RNA, 19 nt, Homo sapiens
aguguucugauuccuucaa

SEQ ID NO: 1577354 - RNA, 13 nt, Homo sapiens
aguguuuaccugg

SEQ ID NO: 1577355 - RNA, 17 nt, Homo sapiens
aguguuuaugugcuauu

SEQ ID NO: 1577356 - RNA, 22 nt, Homo sapiens
aguguuuuuccuguguauuaaa

SEQ ID NO: 1577357 - RNA, 21 nt, Homo sapiens
aguuaaaaauuaaauauuuau

SEQ ID NO: 1577358 - RNA, 19 nt, Homo sapiens
aguuaaacauugaaguaau

SEQ ID NO: 1577359 - RNA, 16 nt, Homo sapiens
aguuaagucuaucugg

SEQ ID NO: 1577360 - RNA, 18 nt, Homo sapiens
aguuacaguucugugguu

SEQ ID NO: 1577361 - RNA, 23 nt, Homo sapiens
aguuaccuuauaguuacugugua

SEQ ID NO: 1577362 - RNA, 15 nt, Homo sapiens
aguuacuguccuguu

SEQ ID NO: 1577363 - RNA, 17 nt, Homo sapiens
aguuagaacuagccaaa

SEQ ID NO: 1577364 - RNA, 17 nt, Homo sapiens
aguuagaggagaaaaag

SEQ ID NO: 1577365 - RNA, 13 nt, Homo sapiens
aguuagcacugaa

SEQ ID NO: 1577366 - RNA, 21 nt, Homo sapiens
aguuauaggaacaauucucuu

SEQ ID NO: 1577367 - RNA, 14 nt, Homo sapiens
aguuaucagggaac

SEQ ID NO: 1577368 - RNA, 16 nt, Homo sapiens
aguuauuaaucuggac

SEQ ID NO: 1577369 - RNA, 14 nt, Homo sapiens
aguucaauugugaa

SEQ ID NO: 1577370 - RNA, 17 nt, Homo sapiens
aguucaauugugaaaau

SEQ ID NO: 1577371 - RNA, 16 nt, Homo sapiens
aguucaguguugcaug

SEQ ID NO: 1577372 - RNA, 17 nt, Homo sapiens
aguucaucaccauuucc

SEQ ID NO: 1577373 - RNA, 23 nt, Homo sapiens
aguuccaguugaaguuaguggaa

SEQ ID NO: 1577374 - RNA, 15 nt, Homo sapiens
aguuccccaaauaca

SEQ ID NO: 1577375 - RNA, 18 nt, Homo sapiens
aguuccccugucuguccc

SEQ ID NO: 1577376 - RNA, 22 nt, Homo sapiens
aguuccgccucccggguucaca

SEQ ID NO: 1577377 - RNA, 15 nt, Homo sapiens
aguuccuagcacugc

SEQ ID NO: 1577378 - RNA, 22 nt, Homo sapiens
aguuccuauaccuuacugacac

SEQ ID NO: 1577379 - RNA, 15 nt, Homo sapiens
aguuccucccaggaa

SEQ ID NO: 1577380 - RNA, 18 nt, Homo sapiens
aguuccuuacuguuuaca

SEQ ID NO: 1577381 - RNA, 22 nt, Homo sapiens
aguuccuuccaggugauucugu

SEQ ID NO: 1577382 - RNA, 21 nt, Homo sapiens
aguucucauggguggcacuca

SEQ ID NO: 1577383 - RNA, 13 nt, Homo sapiens
aguucuuccugua

SEQ ID NO: 1577384 - RNA, 12 nt, Homo sapiens
aguugaacaugg

SEQ ID NO: 1577385 - RNA, 23 nt, Homo sapiens
aguugaggagacauuacaaugug

SEQ ID NO: 1577386 - RNA, 20 nt, Homo sapiens
aguugcugaauguugcauua

SEQ ID NO: 1577387 - RNA, 11 nt, Homo sapiens
aguugcuguau

SEQ ID NO: 1577388 - RNA, 13 nt, Homo sapiens
aguugcuguaugu

SEQ ID NO: 1577389 - RNA, 22 nt, Homo sapiens
aguugcuuauaauaaaauaauu

SEQ ID NO: 1577390 - RNA, 22 nt, Homo sapiens
aguuggcucugagauacuaaua

SEQ ID NO: 1577391 - RNA, 15 nt, Homo sapiens
aguuggugcugcuuu

SEQ ID NO: 1577392 - RNA, 13 nt, Homo sapiens
aguuguacaugau

SEQ ID NO: 1577393 - RNA, 21 nt, Homo sapiens
aguuguacaugauaagacauu

SEQ ID NO: 1577394 - RNA, 23 nt, Homo sapiens
aguuguaccgcaaugugacuuaa

SEQ ID NO: 1577395 - RNA, 16 nt, Homo sapiens
aguugugacagucacu

SEQ ID NO: 1577396 - RNA, 18 nt, Homo sapiens
aguugugacagucacugc

SEQ ID NO: 1577397 - RNA, 15 nt, Homo sapiens
aguuguuggucugua

SEQ ID NO: 1577398 - RNA, 15 nt, Homo sapiens
aguuguuugcuucuu

SEQ ID NO: 1577399 - RNA, 15 nt, Homo sapiens
aguuuaaagacacuu

SEQ ID NO: 1577400 - RNA, 14 nt, Homo sapiens
aguuuaaaugagac

SEQ ID NO: 1577401 - RNA, 23 nt, Homo sapiens
aguuuaaggguggaaaaaugccc

SEQ ID NO: 1577402 - RNA, 18 nt, Homo sapiens
aguuuaaugccuagcaga

SEQ ID NO: 1577403 - RNA, 16 nt, Homo sapiens
aguuuaguauagcuuc

SEQ ID NO: 1577404 - RNA, 15 nt, Homo sapiens
aguuuauaagacugg

SEQ ID NO: 1577405 - RNA, 15 nt, Homo sapiens
aguuuauacuucucu

SEQ ID NO: 1577406 - RNA, 18 nt, Homo sapiens
caagaugaaugcagauua

SEQ ID NO: 1577407 - RNA, 21 nt, Homo sapiens
caagaugugaauuauugacac

SEQ ID NO: 1577408 - RNA, 18 nt, Homo sapiens
caagaugugggcagugau

SEQ ID NO: 1577409 - RNA, 19 nt, Homo sapiens
caagauuaugugacuugca

SEQ ID NO: 1577410 - RNA, 22 nt, Homo sapiens
caagauuaugugacuugcaaua

SEQ ID NO: 1577411 - RNA, 16 nt, Homo sapiens
caagauuucacaucag

SEQ ID NO: 1577412 - RNA, 19 nt, Homo sapiens
caagauuuuuucauuucaa

SEQ ID NO: 1577413 - RNA, 14 nt, Homo sapiens
caagcacaaaaacu

SEQ ID NO: 1577414 - RNA, 19 nt, Homo sapiens
caagcaggcugguuugcaa

SEQ ID NO: 1577415 - RNA, 20 nt, Homo sapiens
caagcagugaaauaugauaa

SEQ ID NO: 1577416 - RNA, 22 nt, Homo sapiens
caagcauguaacuuauauuaau

SEQ ID NO: 1577417 - RNA, 21 nt, Homo sapiens
caagcauuucaugaaaaagcu

SEQ ID NO: 1577418 - RNA, 16 nt, Homo sapiens
caagccugucuucaga

SEQ ID NO: 1577419 - RNA, 17 nt, Homo sapiens
caagccugucuucagag

SEQ ID NO: 1577420 - RNA, 17 nt, Homo sapiens
caagccugugcaaaaaa

SEQ ID NO: 1577421 - RNA, 13 nt, Homo sapiens
caagcuaaccuua

SEQ ID NO: 1577422 - RNA, 14 nt, Homo sapiens
caagcuaggugcua

SEQ ID NO: 1577423 - RNA, 12 nt, Homo sapiens
caagcucagggc

SEQ ID NO: 1577424 - RNA, 21 nt, Homo sapiens
caagcugaguuuggaugucug

SEQ ID NO: 1577425 - RNA, 13 nt, Homo sapiens
caagcuuccauag

SEQ ID NO: 1577426 - RNA, 20 nt, Homo sapiens
caagcuuuggguuggagcug

SEQ ID NO: 1577427 - RNA, 20 nt, Homo sapiens
caaggaaaaacaggucuuca

SEQ ID NO: 1577428 - RNA, 12 nt, Homo sapiens
caaggaaaaaga

SEQ ID NO: 1577429 - RNA, 14 nt, Homo sapiens
caaggaaacaugca

SEQ ID NO: 1577430 - RNA, 14 nt, Homo sapiens
caaggacauuucuc

SEQ ID NO: 1577431 - RNA, 15 nt, Homo sapiens
caaggacucuuccac

SEQ ID NO: 1577432 - RNA, 20 nt, Homo sapiens
caaggaggaguuccaccaug

SEQ ID NO: 1577433 - RNA, 23 nt, Homo sapiens
caaggaggaguuccaccaugagc

SEQ ID NO: 1577434 - RNA, 23 nt, Homo sapiens
caaggaggccuggggaggcccua

SEQ ID NO: 1577435 - RNA, 21 nt, Homo sapiens
caaggaggguguaauggagca

SEQ ID NO: 1577436 - RNA, 16 nt, Homo sapiens
caaggcccacuucuuc

SEQ ID NO: 1577437 - RNA, 18 nt, Homo sapiens
caaggcccccacugccug

SEQ ID NO: 1577438 - RNA, 15 nt, Homo sapiens
caagggacugaguga

SEQ ID NO: 1577439 - RNA, 15 nt, Homo sapiens
caagggaucugccau

SEQ ID NO: 1577440 - RNA, 14 nt, Homo sapiens
caagggcagggucu

SEQ ID NO: 1577441 - RNA, 18 nt, Homo sapiens
caaggguuggaggcaaug

SEQ ID NO: 1577442 - RNA, 14 nt, Homo sapiens
caaggucauagaca

SEQ ID NO: 1577443 - RNA, 16 nt, Homo sapiens
caaggugcugauguca

SEQ ID NO: 1577444 - RNA, 13 nt, Homo sapiens
caagguugcacag

SEQ ID NO: 1577445 - RNA, 19 nt, Homo sapiens
caagguugggcuggugcuc

SEQ ID NO: 1577446 - RNA, 16 nt, Homo sapiens
caaguaauacaaacua

SEQ ID NO: 1577447 - RNA, 22 nt, Homo sapiens
caaguauauuuauuucuagcaa

SEQ ID NO: 1577448 - RNA, 16 nt, Homo sapiens
caaguaugaaguauaa

SEQ ID NO: 1577449 - RNA, 22 nt, Homo sapiens
caaguauuauuuuacaaucaac

SEQ ID NO: 1577450 - RNA, 15 nt, Homo sapiens
caagucauggucaca

SEQ ID NO: 1577451 - RNA, 18 nt, Homo sapiens
caaguccaagcauaccaa

SEQ ID NO: 1577452 - RNA, 22 nt, Homo sapiens
caagugaucaaaauuaacguca

SEQ ID NO: 1577453 - RNA, 23 nt, Homo sapiens
caagugggauuugcauaaaguga

SEQ ID NO: 1577454 - RNA, 23 nt, Homo sapiens
caagugguuaaaacauagcuuuc

SEQ ID NO: 1577455 - RNA, 15 nt, Homo sapiens
caaguguaucuccuu

SEQ ID NO: 1577456 - RNA, 21 nt, Homo sapiens
caagugucugugcaugucccc

SEQ ID NO: 1577457 - RNA, 21 nt, Homo sapiens
caaguucaugcagcuguggca

SEQ ID NO: 1577458 - RNA, 21 nt, Homo sapiens
caaguucgucuguugugcgaa

SEQ ID NO: 1577459 - RNA, 20 nt, Homo sapiens
caaguucuuagggcacauga

SEQ ID NO: 1577460 - RNA, 18 nt, Homo sapiens
caaguugaaaaauagcau

SEQ ID NO: 1577461 - RNA, 19 nt, Homo sapiens
caaguuuuuauaguuauua

SEQ ID NO: 1577462 - RNA, 18 nt, Homo sapiens
caaguuuuucauacugua

SEQ ID NO: 1577463 - RNA, 17 nt, Homo sapiens
caauaaaccacaagcau

SEQ ID NO: 1577464 - RNA, 19 nt, Homo sapiens
caauaaagaccacuuuaca

SEQ ID NO: 1577465 - RNA, 16 nt, Homo sapiens
caauaaaguacuuuac

SEQ ID NO: 1577466 - RNA, 18 nt, Homo sapiens
caauaaaguuauucagaa

SEQ ID NO: 1577467 - RNA, 17 nt, Homo sapiens
caauaaauauuugcuaa

SEQ ID NO: 1577468 - RNA, 15 nt, Homo sapiens
caauaaaucuuucaa

SEQ ID NO: 1577469 - RNA, 12 nt, Homo sapiens
caauaaauucau

SEQ ID NO: 1577470 - RNA, 23 nt, Homo sapiens
caauaagauugcgccugagauac

SEQ ID NO: 1577471 - RNA, 15 nt, Homo sapiens
caauaagcaaaaaca

SEQ ID NO: 1577472 - RNA, 23 nt, Homo sapiens
caauaauauuucaagugccuaga

SEQ ID NO: 1577473 - RNA, 12 nt, Homo sapiens
caauaaugcagu

SEQ ID NO: 1577474 - RNA, 14 nt, Homo sapiens
caauacauaccacg

SEQ ID NO: 1577475 - RNA, 12 nt, Homo sapiens
caauaccaaugu

SEQ ID NO: 1577476 - RNA, 20 nt, Homo sapiens
caauacuguuuccauuuuaa

SEQ ID NO: 1577477 - RNA, 22 nt, Homo sapiens
caauagacauugcaaacucuca

SEQ ID NO: 1577478 - RNA, 21 nt, Homo sapiens
caauagguuuguaaaaugcac

SEQ ID NO: 1577479 - RNA, 20 nt, Homo sapiens
caauaguguccuaugcaaua

SEQ ID NO: 1577480 - RNA, 12 nt, Homo sapiens
caauaugaagua

SEQ ID NO: 1577481 - RNA, 16 nt, Homo sapiens
caauaugugccaauca

SEQ ID NO: 1577482 - RNA, 14 nt, Homo sapiens
caauauucaguggu

SEQ ID NO: 1577483 - RNA, 18 nt, Homo sapiens
caauauuuaagagauuaa

SEQ ID NO: 1577484 - RNA, 13 nt, Homo sapiens
caauauuuugccu

SEQ ID NO: 1577485 - RNA, 19 nt, Homo sapiens
caaucaaauauuugcugaa

SEQ ID NO: 1577486 - RNA, 22 nt, Homo sapiens
caaucacaaaggcugacauuca

SEQ ID NO: 1577487 - RNA, 21 nt, Homo sapiens
caaucaucaacuaccauucua

SEQ ID NO: 1577488 - RNA, 16 nt, Homo sapiens
caauccaaugcacuga

SEQ ID NO: 1577489 - RNA, 14 nt, Homo sapiens
caaucccauuugca

SEQ ID NO: 1577490 - RNA, 17 nt, Homo sapiens
caauccuccauuugcug

SEQ ID NO: 1577491 - RNA, 17 nt, Homo sapiens
caaucgagacugcaaug

SEQ ID NO: 1577492 - RNA, 17 nt, Homo sapiens
caaucggguccagagac

SEQ ID NO: 1577493 - RNA, 23 nt, Homo sapiens
caaucuauuuaaaaaacuguaua

SEQ ID NO: 1577494 - RNA, 12 nt, Homo sapiens
caaucucuuaau

SEQ ID NO: 1577495 - RNA, 15 nt, Homo sapiens
caaucugaaacagcu

SEQ ID NO: 1577496 - RNA, 18 nt, Homo sapiens
caaucugaaacagcuuca

SEQ ID NO: 1577497 - RNA, 12 nt, Homo sapiens
caaucuguaaac

SEQ ID NO: 1577498 - RNA, 16 nt, Homo sapiens
caaucuucuacuuuaa

SEQ ID NO: 1577499 - RNA, 13 nt, Homo sapiens
caaucuugcccua

SEQ ID NO: 1577500 - RNA, 15 nt, Homo sapiens
caaucuuucaugucu

SEQ ID NO: 1577501 - RNA, 14 nt, Homo sapiens
caaucuuugacaau

SEQ ID NO: 1577502 - RNA, 22 nt, Homo sapiens
caaugaaaacauguacuacagc

SEQ ID NO: 1577503 - RNA, 16 nt, Homo sapiens
caaugacugagcagca

SEQ ID NO: 1577504 - RNA, 19 nt, Homo sapiens
caaugacuuaaccauauaa

SEQ ID NO: 1577505 - RNA, 18 nt, Homo sapiens
caaugaugugugcaagua

SEQ ID NO: 1577506 - RNA, 19 nt, Homo sapiens
caaugccacagacaacuca

SEQ ID NO: 1577507 - RNA, 19 nt, Homo sapiens
caaugccuuguuguauucc

SEQ ID NO: 1577508 - RNA, 17 nt, Homo sapiens
caauggaagauuugccc

SEQ ID NO: 1577509 - RNA, 13 nt, Homo sapiens
caauguaucuuua

SEQ ID NO: 1577510 - RNA, 14 nt, Homo sapiens
caauguuagccaca

SEQ ID NO: 1577511 - RNA, 16 nt, Homo sapiens
caauguucaaugccac

SEQ ID NO: 1577512 - RNA, 19 nt, Homo sapiens
caauguuuguccuguauaa

SEQ ID NO: 1577513 - RNA, 21 nt, Homo sapiens
caauuaacauacaucauucca

SEQ ID NO: 1577514 - RNA, 13 nt, Homo sapiens
caauuaaucauuu

SEQ ID NO: 1577515 - RNA, 23 nt, Homo sapiens
caauuaauuccuguuugucuaca

SEQ ID NO: 1577516 - RNA, 13 nt, Homo sapiens
caauuaccaauau

SEQ ID NO: 1577517 - RNA, 13 nt, Homo sapiens
caauuauauaaau

SEQ ID NO: 1577518 - RNA, 20 nt, Homo sapiens
caauuauauaaaucauuuca

SEQ ID NO: 1577519 - RNA, 15 nt, Homo sapiens
caauuauuggcaaag

SEQ ID NO: 1577520 - RNA, 22 nt, Homo sapiens
caauucaagaaacuaguaagaa

SEQ ID NO: 1577521 - RNA, 23 nt, Homo sapiens
caauuccuccagagacacugagc

SEQ ID NO: 1577522 - RNA, 14 nt, Homo sapiens
caauuccugugauu

SEQ ID NO: 1577523 - RNA, 23 nt, Homo sapiens
caauucugcccgcuccauggaaa

SEQ ID NO: 1577524 - RNA, 15 nt, Homo sapiens
cagauaaguuugcag

SEQ ID NO: 1577525 - RNA, 13 nt, Homo sapiens
cagauaaugugaa

SEQ ID NO: 1577526 - RNA, 14 nt, Homo sapiens
cagauagcugcauu

SEQ ID NO: 1577527 - RNA, 23 nt, Homo sapiens
cagauaucuuggacaaaucacau

SEQ ID NO: 1577528 - RNA, 12 nt, Homo sapiens
cagaucaugccc

SEQ ID NO: 1577529 - RNA, 19 nt, Homo sapiens
cagauccgugcgugaagua

SEQ ID NO: 1577530 - RNA, 14 nt, Homo sapiens
cagaugaucucucc

SEQ ID NO: 1577531 - RNA, 12 nt, Homo sapiens
cagaugaugcuu

SEQ ID NO: 1577532 - RNA, 19 nt, Homo sapiens
cagaugauucuaugucuca

SEQ ID NO: 1577533 - RNA, 21 nt, Homo sapiens
cagaugcccagaggcuccauc

SEQ ID NO: 1577534 - RNA, 21 nt, Homo sapiens
cagaugcuacgcuccagcuga

SEQ ID NO: 1577535 - RNA, 17 nt, Homo sapiens
cagaugcugguggagga

SEQ ID NO: 1577536 - RNA, 21 nt, Homo sapiens
cagauggacuccagccugccu

SEQ ID NO: 1577537 - RNA, 13 nt, Homo sapiens
cagauggcugugg

SEQ ID NO: 1577538 - RNA, 16 nt, Homo sapiens
cagauguaacagaaca

SEQ ID NO: 1577539 - RNA, 23 nt, Homo sapiens
cagauguaauguuuucuuugcaa

SEQ ID NO: 1577540 - RNA, 19 nt, Homo sapiens
cagauguuucaucaaugca

SEQ ID NO: 1577541 - RNA, 17 nt, Homo sapiens
cagauguuuguuuucaa

SEQ ID NO: 1577542 - RNA, 23 nt, Homo sapiens
cagauguuuguuuucaaaauacu

SEQ ID NO: 1577543 - RNA, 21 nt, Homo sapiens
cagauguuuuucuucauuaac

SEQ ID NO: 1577544 - RNA, 18 nt, Homo sapiens
cagauuacuagaaauauu

SEQ ID NO: 1577545 - RNA, 19 nt, Homo sapiens
cagauuccaccuagagcua

SEQ ID NO: 1577546 - RNA, 16 nt, Homo sapiens
cagauuguccuggaac

SEQ ID NO: 1577547 - RNA, 17 nt, Homo sapiens
cagauuuucaugcaaaa

SEQ ID NO: 1577548 - RNA, 13 nt, Homo sapiens
cagauuuugauaa

SEQ ID NO: 1577549 - RNA, 22 nt, Homo sapiens
cagcaaaaaucucccagugaca

SEQ ID NO: 1577550 - RNA, 21 nt, Homo sapiens
cagcaaaauuaaauacauaaa

SEQ ID NO: 1577551 - RNA, 16 nt, Homo sapiens
cagcaaagcagcagug

SEQ ID NO: 1577552 - RNA, 14 nt, Homo sapiens
cagcaaaucacgac

SEQ ID NO: 1577553 - RNA, 12 nt, Homo sapiens
cagcaagcuuug

SEQ ID NO: 1577554 - RNA, 23 nt, Homo sapiens
cagcaaguacgcaagaaauugga

SEQ ID NO: 1577555 - RNA, 15 nt, Homo sapiens
cagcaauauuuugua

SEQ ID NO: 1577556 - RNA, 22 nt, Homo sapiens
cagcaauucuccugccucagcc

SEQ ID NO: 1577557 - RNA, 16 nt, Homo sapiens
cagcaccaaccacagc

SEQ ID NO: 1577558 - RNA, 12 nt, Homo sapiens
cagcacugccag

SEQ ID NO: 1577559 - RNA, 13 nt, Homo sapiens
cagcacuggugaa

SEQ ID NO: 1577560 - RNA, 17 nt, Homo sapiens
cagcacuggugaacuga

SEQ ID NO: 1577561 - RNA, 12 nt, Homo sapiens
cagcacugugag

SEQ ID NO: 1577562 - RNA, 14 nt, Homo sapiens
cagcacuugucuca

SEQ ID NO: 1577563 - RNA, 21 nt, Homo sapiens
cagcagaagccuccaagcaca

SEQ ID NO: 1577564 - RNA, 17 nt, Homo sapiens
cagcagacaccauucau

SEQ ID NO: 1577565 - RNA, 16 nt, Homo sapiens
cagcagagaagcugua

SEQ ID NO: 1577566 - RNA, 16 nt, Homo sapiens
cagcagaggacagucu

SEQ ID NO: 1577567 - RNA, 15 nt, Homo sapiens
cagcagcaaacaaau

SEQ ID NO: 1577568 - RNA, 23 nt, Homo sapiens
cagcagcacagucacccauggaa

SEQ ID NO: 1577569 - RNA, 14 nt, Homo sapiens
cagcaggcauuugc

SEQ ID NO: 1577570 - RNA, 17 nt, Homo sapiens
cagcauaccacgccaca

SEQ ID NO: 1577571 - RNA, 23 nt, Homo sapiens
cagcauauguguaaagauuuaua

SEQ ID NO: 1577572 - RNA, 18 nt, Homo sapiens
cagcauuccaugaccaga

SEQ ID NO: 1577573 - RNA, 17 nt, Homo sapiens
cagcauuuccacaccaa

SEQ ID NO: 1577574 - RNA, 11 nt, Homo sapiens
cagcauuuccc

SEQ ID NO: 1577575 - RNA, 19 nt, Homo sapiens
cagcauuuccuaccuugug

SEQ ID NO: 1577576 - RNA, 21 nt, Homo sapiens
cagcauuugaugauagcagac

SEQ ID NO: 1577577 - RNA, 18 nt, Homo sapiens
cagcauuuucauucauuu

SEQ ID NO: 1577578 - RNA, 17 nt, Homo sapiens
cagcauuuuuauuccca

SEQ ID NO: 1577579 - RNA, 17 nt, Homo sapiens
cagccaaaaaggacuuu

SEQ ID NO: 1577580 - RNA, 23 nt, Homo sapiens
cagccacauugagacuuucuucu

SEQ ID NO: 1577581 - RNA, 12 nt, Homo sapiens
cagccaccagcg

SEQ ID NO: 1577582 - RNA, 17 nt, Homo sapiens
cagccacgucagcuuuu

SEQ ID NO: 1577583 - RNA, 19 nt, Homo sapiens
cagccacuugccugugcua

SEQ ID NO: 1577584 - RNA, 19 nt, Homo sapiens
cagccagcgccucccucca

SEQ ID NO: 1577585 - RNA, 13 nt, Homo sapiens
cagccaggagugc

SEQ ID NO: 1577586 - RNA, 18 nt, Homo sapiens
cagccauaagaaagcacu

SEQ ID NO: 1577587 - RNA, 19 nt, Homo sapiens
cagccauaagaaagcacua

SEQ ID NO: 1577588 - RNA, 12 nt, Homo sapiens
cagccauaugca

SEQ ID NO: 1577589 - RNA, 17 nt, Homo sapiens
cagccaucguccuggga

SEQ ID NO: 1577590 - RNA, 23 nt, Homo sapiens
cagccaugugccuuaguguccuu

SEQ ID NO: 1577591 - RNA, 15 nt, Homo sapiens
cagcccaacagcacu

SEQ ID NO: 1577592 - RNA, 16 nt, Homo sapiens
cagcccaacagcacuu

SEQ ID NO: 1577593 - RNA, 17 nt, Homo sapiens
cagcccagacccagugg

SEQ ID NO: 1577594 - RNA, 13 nt, Homo sapiens
cagcccagagcca

SEQ ID NO: 1577595 - RNA, 14 nt, Homo sapiens
cagcccaggccaca

SEQ ID NO: 1577596 - RNA, 15 nt, Homo sapiens
cagccccugcagauu

SEQ ID NO: 1577597 - RNA, 18 nt, Homo sapiens
cagcccuagagccugccu

SEQ ID NO: 1577598 - RNA, 14 nt, Homo sapiens
cagcccugaaggca

SEQ ID NO: 1577599 - RNA, 15 nt, Homo sapiens
cagcccugaaggcac

SEQ ID NO: 1577600 - RNA, 20 nt, Homo sapiens
cagcccugaccccaguguac

SEQ ID NO: 1577601 - RNA, 20 nt, Homo sapiens
cagcccuggcaaaugccuga

SEQ ID NO: 1577602 - RNA, 14 nt, Homo sapiens
cagcccuuccuccc

SEQ ID NO: 1577603 - RNA, 19 nt, Homo sapiens
cagccgaggccacagaauc

SEQ ID NO: 1577604 - RNA, 14 nt, Homo sapiens
cagccgauguggua

SEQ ID NO: 1577605 - RNA, 16 nt, Homo sapiens
cagccuacaaagagau

SEQ ID NO: 1577606 - RNA, 19 nt, Homo sapiens
cagccuaggcccuggggag

SEQ ID NO: 1577607 - RNA, 13 nt, Homo sapiens
cagccuccagggc

SEQ ID NO: 1577608 - RNA, 19 nt, Homo sapiens
cagccucugccgcugccau

SEQ ID NO: 1577609 - RNA, 12 nt, Homo sapiens
cagccucuggac

SEQ ID NO: 1577610 - RNA, 17 nt, Homo sapiens
cagccuggacaccucuc

SEQ ID NO: 1577611 - RNA, 19 nt, Homo sapiens
cagccuggacgacauagcg

SEQ ID NO: 1577612 - RNA, 21 nt, Homo sapiens
cagccugggcaacauggugaa

SEQ ID NO: 1577613 - RNA, 20 nt, Homo sapiens
cagccugggcaacgagugaa

SEQ ID NO: 1577614 - RNA, 17 nt, Homo sapiens
cagccuguuugggaugu

SEQ ID NO: 1577615 - RNA, 23 nt, Homo sapiens
cagcgauaagcuuucaauagugg

SEQ ID NO: 1577616 - RNA, 15 nt, Homo sapiens
cagcgauggugcugc

SEQ ID NO: 1577617 - RNA, 17 nt, Homo sapiens
cagcgcagaaugaaggg

SEQ ID NO: 1577618 - RNA, 17 nt, Homo sapiens
cagcggcuccaacuccu

SEQ ID NO: 1577619 - RNA, 21 nt, Homo sapiens
cagcggucagauagcaucaga

SEQ ID NO: 1577620 - RNA, 21 nt, Homo sapiens
cagcgugugugccaccucauu

SEQ ID NO: 1577621 - RNA, 22 nt, Homo sapiens
cagcguuuuuaccuaggcacca

SEQ ID NO: 1577622 - RNA, 16 nt, Homo sapiens
cagcuaaccacuucgc

SEQ ID NO: 1577623 - RNA, 16 nt, Homo sapiens
cagcuacaagugcagc

SEQ ID NO: 1577624 - RNA, 20 nt, Homo sapiens
cagcuauguagcaaagggaa

SEQ ID NO: 1577625 - RNA, 21 nt, Homo sapiens
cagcuauuuagaagcaucauc

SEQ ID NO: 1577626 - RNA, 13 nt, Homo sapiens
cagcucaccucaa

SEQ ID NO: 1577627 - RNA, 12 nt, Homo sapiens
cagcucaggaua

SEQ ID NO: 1577628 - RNA, 14 nt, Homo sapiens
cagcuccuuucaug

SEQ ID NO: 1577629 - RNA, 19 nt, Homo sapiens
cagcucgggcccucuguga

SEQ ID NO: 1577630 - RNA, 17 nt, Homo sapiens
cagcucuccugcugcag

SEQ ID NO: 1577631 - RNA, 19 nt, Homo sapiens
cagcucugagccagauuac

SEQ ID NO: 1577632 - RNA, 15 nt, Homo sapiens
cagcucugaucugag

SEQ ID NO: 1577633 - RNA, 16 nt, Homo sapiens
cagcucuucaacauga

SEQ ID NO: 1577634 - RNA, 17 nt, Homo sapiens
cagcugagccugagcca

SEQ ID NO: 1577635 - RNA, 23 nt, Homo sapiens
cagcugauccaggcaaucguucu

SEQ ID NO: 1577636 - RNA, 17 nt, Homo sapiens
cagcugauugacugugc

SEQ ID NO: 1577637 - RNA, 19 nt, Homo sapiens
cagcugccucugcucccuc

SEQ ID NO: 1577638 - RNA, 14 nt, Homo sapiens
cagcugcuuugaca

SEQ ID NO: 1577639 - RNA, 17 nt, Homo sapiens
cagcugggaagcccuuu

SEQ ID NO: 1577640 - RNA, 21 nt, Homo sapiens
cagcugguugcuccauuugag

SEQ ID NO: 1577641 - RNA, 21 nt, Homo sapiens
cagcugucaagggcagaauga

SEQ ID NO: 1577642 - RNA, 16 nt, Homo sapiens
cauuauuugagacugu

SEQ ID NO: 1577643 - RNA, 22 nt, Homo sapiens
cauuauuuggcuuaaaccagaa

SEQ ID NO: 1577644 - RNA, 22 nt, Homo sapiens
cauuauuuuuguuagcaaagau

SEQ ID NO: 1577645 - RNA, 15 nt, Homo sapiens
cauucacagugcaag

SEQ ID NO: 1577646 - RNA, 15 nt, Homo sapiens
cauucauucaaucau

SEQ ID NO: 1577647 - RNA, 17 nt, Homo sapiens
cauuccaacuucaauuu

SEQ ID NO: 1577648 - RNA, 19 nt, Homo sapiens
cauuccaguagccaguauc

SEQ ID NO: 1577649 - RNA, 13 nt, Homo sapiens
cauuccaugucca

SEQ ID NO: 1577650 - RNA, 21 nt, Homo sapiens
cauucccguggaacguuuuuc

SEQ ID NO: 1577651 - RNA, 22 nt, Homo sapiens
cauuccuccagugcauacugua

SEQ ID NO: 1577652 - RNA, 21 nt, Homo sapiens
cauuccugugcggacagcccu

SEQ ID NO: 1577653 - RNA, 15 nt, Homo sapiens
cauuccuucacauag

SEQ ID NO: 1577654 - RNA, 19 nt, Homo sapiens
cauuccuucacucauccag

SEQ ID NO: 1577655 - RNA, 21 nt, Homo sapiens
cauucuaauccuugcuauuaa

SEQ ID NO: 1577656 - RNA, 20 nt, Homo sapiens
cauucuagcugagaagcaau

SEQ ID NO: 1577657 - RNA, 13 nt, Homo sapiens
cauucucacauaa

SEQ ID NO: 1577658 - RNA, 16 nt, Homo sapiens
cauucucuagacaaaa

SEQ ID NO: 1577659 - RNA, 12 nt, Homo sapiens
cauucucugucu

SEQ ID NO: 1577660 - RNA, 21 nt, Homo sapiens
cauucugcauccuggcuugaa

SEQ ID NO: 1577661 - RNA, 11 nt, Homo sapiens
cauucugccaa

SEQ ID NO: 1577662 - RNA, 12 nt, Homo sapiens
cauucugccaaa

SEQ ID NO: 1577663 - RNA, 17 nt, Homo sapiens
cauucuuguuggcuuuu

SEQ ID NO: 1577664 - RNA, 21 nt, Homo sapiens
cauucuuucccaacaccucuu

SEQ ID NO: 1577665 - RNA, 12 nt, Homo sapiens
cauucuuuugca

SEQ ID NO: 1577666 - RNA, 22 nt, Homo sapiens
cauugaaacuaagagcucucaa

SEQ ID NO: 1577667 - RNA, 18 nt, Homo sapiens
cauugaaauguaauuuca

SEQ ID NO: 1577668 - RNA, 14 nt, Homo sapiens
cauugaacuuuaag

SEQ ID NO: 1577669 - RNA, 22 nt, Homo sapiens
cauugaagacccugucucaaaa

SEQ ID NO: 1577670 - RNA, 23 nt, Homo sapiens
cauugaugagcaagacauacuua

SEQ ID NO: 1577671 - RNA, 17 nt, Homo sapiens
cauugauuuaauguaau

SEQ ID NO: 1577672 - RNA, 11 nt, Homo sapiens
cauugccaagu

SEQ ID NO: 1577673 - RNA, 21 nt, Homo sapiens
cauugcuaaacugaugacuua

SEQ ID NO: 1577674 - RNA, 22 nt, Homo sapiens
cauugcuaccucagugcuccug

SEQ ID NO: 1577675 - RNA, 19 nt, Homo sapiens
cauugcuuccucccuggug

SEQ ID NO: 1577676 - RNA, 17 nt, Homo sapiens
cauuggaacuagucauu

SEQ ID NO: 1577677 - RNA, 16 nt, Homo sapiens
cauuggugacucacuu

SEQ ID NO: 1577678 - RNA, 15 nt, Homo sapiens
cauuguaauguucau

SEQ ID NO: 1577679 - RNA, 22 nt, Homo sapiens
cauuguaauguucauuucccac

SEQ ID NO: 1577680 - RNA, 15 nt, Homo sapiens
cauugucuacuccua

SEQ ID NO: 1577681 - RNA, 15 nt, Homo sapiens
cauugucugucugca

SEQ ID NO: 1577682 - RNA, 17 nt, Homo sapiens
cauugugcugcaccugg

SEQ ID NO: 1577683 - RNA, 17 nt, Homo sapiens
cauuguggcuccuaucu

SEQ ID NO: 1577684 - RNA, 18 nt, Homo sapiens
cauuguuuauuguauacu

SEQ ID NO: 1577685 - RNA, 19 nt, Homo sapiens
cauuuaaagaaagaaugca

SEQ ID NO: 1577686 - RNA, 17 nt, Homo sapiens
cauuuaaauguguacaa

SEQ ID NO: 1577687 - RNA, 15 nt, Homo sapiens
cauuuaaauuccaca

SEQ ID NO: 1577688 - RNA, 20 nt, Homo sapiens
cauuuaaauuccacagauua

SEQ ID NO: 1577689 - RNA, 21 nt, Homo sapiens
cauuuaaauuccacagauuau

SEQ ID NO: 1577690 - RNA, 15 nt, Homo sapiens
cauuuaagaacugag

SEQ ID NO: 1577691 - RNA, 18 nt, Homo sapiens
cauuuaagacacauugac

SEQ ID NO: 1577692 - RNA, 13 nt, Homo sapiens
cauuuacagugua

SEQ ID NO: 1577693 - RNA, 20 nt, Homo sapiens
cauuuagcgaacaaccacag

SEQ ID NO: 1577694 - RNA, 16 nt, Homo sapiens
cauuuaggaguauuau

SEQ ID NO: 1577695 - RNA, 13 nt, Homo sapiens
cauuuauagcaua

SEQ ID NO: 1577696 - RNA, 22 nt, Homo sapiens
cauuuauuuccucagcuguaca

SEQ ID NO: 1577697 - RNA, 17 nt, Homo sapiens
cauuucaauuccuguga

SEQ ID NO: 1577698 - RNA, 21 nt, Homo sapiens
cauuucauauuauuuuagugu

SEQ ID NO: 1577699 - RNA, 21 nt, Homo sapiens
cauuucaugcucugcaaaagg

SEQ ID NO: 1577700 - RNA, 12 nt, Homo sapiens
cauuuccaaaag

SEQ ID NO: 1577701 - RNA, 12 nt, Homo sapiens
cauuuccaugca

SEQ ID NO: 1577702 - RNA, 17 nt, Homo sapiens
cauuuccaugcauaaau

SEQ ID NO: 1577703 - RNA, 15 nt, Homo sapiens
cauuuccuaugcaaa

SEQ ID NO: 1577704 - RNA, 23 nt, Homo sapiens
cauuucuagacucaaaaccugga

SEQ ID NO: 1577705 - RNA, 16 nt, Homo sapiens
cauuucuauagccaaa

SEQ ID NO: 1577706 - RNA, 20 nt, Homo sapiens
cauuucuggacaguaccuga

SEQ ID NO: 1577707 - RNA, 14 nt, Homo sapiens
cauuugauggccac

SEQ ID NO: 1577708 - RNA, 20 nt, Homo sapiens
cauuugauggccaccagcuu

SEQ ID NO: 1577709 - RNA, 22 nt, Homo sapiens
cauuugcaaaggcgacaauaaa

SEQ ID NO: 1577710 - RNA, 12 nt, Homo sapiens
cauuugcaauua

SEQ ID NO: 1577711 - RNA, 19 nt, Homo sapiens
cauuugcuggagcucugcc

SEQ ID NO: 1577712 - RNA, 18 nt, Homo sapiens
cauuugcuguucaucuug

SEQ ID NO: 1577713 - RNA, 17 nt, Homo sapiens
cauuugcuugcaaucua

SEQ ID NO: 1577714 - RNA, 15 nt, Homo sapiens
cauuuggugacugug

SEQ ID NO: 1577715 - RNA, 16 nt, Homo sapiens
cauuuggugacugugu

SEQ ID NO: 1577716 - RNA, 12 nt, Homo sapiens
cauuuguagcuu

SEQ ID NO: 1577717 - RNA, 14 nt, Homo sapiens
cauuuguagcuuug

SEQ ID NO: 1577718 - RNA, 17 nt, Homo sapiens
cauuugugaagcuuacu

SEQ ID NO: 1577719 - RNA, 15 nt, Homo sapiens
cauuuguguacacag

SEQ ID NO: 1577720 - RNA, 20 nt, Homo sapiens
cauuuguguuuugaaagccc

SEQ ID NO: 1577721 - RNA, 21 nt, Homo sapiens
cauuuguuucccccacaguuu

SEQ ID NO: 1577722 - RNA, 18 nt, Homo sapiens
cauuuguuuuagucugaa

SEQ ID NO: 1577723 - RNA, 23 nt, Homo sapiens
cauuuuaacuggcaugucauuug

SEQ ID NO: 1577724 - RNA, 21 nt, Homo sapiens
cauuuuaugagaguuuggaau

SEQ ID NO: 1577725 - RNA, 17 nt, Homo sapiens
cauuuuauuaagcuuuu

SEQ ID NO: 1577726 - RNA, 15 nt, Homo sapiens
cauuuucauucuguu

SEQ ID NO: 1577727 - RNA, 15 nt, Homo sapiens
cauuuucauugauga

SEQ ID NO: 1577728 - RNA, 21 nt, Homo sapiens
cauuuuccuuaggaaaaacau

SEQ ID NO: 1577729 - RNA, 15 nt, Homo sapiens
cauuuucuaugcuug

SEQ ID NO: 1577730 - RNA, 18 nt, Homo sapiens
cauuuucucccuuaggaa

SEQ ID NO: 1577731 - RNA, 22 nt, Homo sapiens
cauuuugauggugucugugaca

SEQ ID NO: 1577732 - RNA, 19 nt, Homo sapiens
cauuuugccuaccuggguc

SEQ ID NO: 1577733 - RNA, 19 nt, Homo sapiens
cauuuuuauacagugauaa

SEQ ID NO: 1577734 - RNA, 19 nt, Homo sapiens
cauuuuucaacuuugaaua

SEQ ID NO: 1577735 - RNA, 17 nt, Homo sapiens
cauuuuugagcaacucc

SEQ ID NO: 1577736 - RNA, 20 nt, Homo sapiens
cauuuuuuuuuuaucagagu

SEQ ID NO: 1577737 - RNA, 23 nt, Homo sapiens
ccaaaaaaaaauacaugcuaaga

SEQ ID NO: 1577738 - RNA, 13 nt, Homo sapiens
ccaaaaacauuug

SEQ ID NO: 1577739 - RNA, 13 nt, Homo sapiens
ccaaaacauuucu

SEQ ID NO: 1577740 - RNA, 15 nt, Homo sapiens
ccaaaaucucuuaaa

SEQ ID NO: 1577741 - RNA, 16 nt, Homo sapiens
ccaaaauguacuuaaa

SEQ ID NO: 1577742 - RNA, 18 nt, Homo sapiens
ccaaacagcuguauuuau

SEQ ID NO: 1577743 - RNA, 14 nt, Homo sapiens
ccaaagacaucagu

SEQ ID NO: 1577744 - RNA, 22 nt, Homo sapiens
ccaaagaguagaauugcauuga

SEQ ID NO: 1577745 - RNA, 22 nt, Homo sapiens
ccaaagcaucaauacaaccagc

SEQ ID NO: 1577746 - RNA, 18 nt, Homo sapiens
ccaaagugcaggacauca

SEQ ID NO: 1577747 - RNA, 18 nt, Homo sapiens
ccaaauaccauguacaua

SEQ ID NO: 1577748 - RNA, 12 nt, Homo sapiens
ccaaauaccuca

SEQ ID NO: 1577749 - RNA, 13 nt, Homo sapiens
ccaaauauaacca

SEQ ID NO: 1577750 - RNA, 11 nt, Homo sapiens
ccaaaucucag

SEQ ID NO: 1577751 - RNA, 16 nt, Homo sapiens
ccaaaucucaguggcu

SEQ ID NO: 1577752 - RNA, 20 nt, Homo sapiens
ccaaaugccauccagaugug

SEQ ID NO: 1577753 - RNA, 17 nt, Homo sapiens
ccaaauggcacuuuuga

SEQ ID NO: 1577754 - RNA, 17 nt, Homo sapiens
ccaaauguccuuucuca

SEQ ID NO: 1577755 - RNA, 15 nt, Homo sapiens
ccaaauugcuucuag

SEQ ID NO: 1577756 - RNA, 20 nt, Homo sapiens
ccaaauuuagaaagcuuaag

SEQ ID NO: 1577757 - RNA, 19 nt, Homo sapiens
ccaaauuucauaccuauca

SEQ ID NO: 1577758 - RNA, 13 nt, Homo sapiens
ccaacacuuugag

SEQ ID NO: 1577759 - RNA, 11 nt, Homo sapiens
ccaacauggca

SEQ ID NO: 1577760 - RNA, 12 nt, Homo sapiens
cuccuacuguau

SEQ ID NO: 1577761 - RNA, 18 nt, Homo sapiens
cuccuauggucacagacu

SEQ ID NO: 1577762 - RNA, 17 nt, Homo sapiens
cuccuauuccuucacac

SEQ ID NO: 1577763 - RNA, 23 nt, Homo sapiens
cuccuauuccuucacacaguuca

SEQ ID NO: 1577764 - RNA, 18 nt, Homo sapiens
cuccucaaacccagucuc

SEQ ID NO: 1577765 - RNA, 19 nt, Homo sapiens
cuccucaggcacacagcua

SEQ ID NO: 1577766 - RNA, 19 nt, Homo sapiens
cuccucauagugcugaaaa

SEQ ID NO: 1577767 - RNA, 15 nt, Homo sapiens
cuccuccauucccua

SEQ ID NO: 1577768 - RNA, 14 nt, Homo sapiens
cuccuccccuuuca

SEQ ID NO: 1577769 - RNA, 12 nt, Homo sapiens
cuccucccucag

SEQ ID NO: 1577770 - RNA, 22 nt, Homo sapiens
cuccuccuacccuuccagugcc

SEQ ID NO: 1577771 - RNA, 15 nt, Homo sapiens
cuccucgagauccca

SEQ ID NO: 1577772 - RNA, 17 nt, Homo sapiens
cuccucgagaucccaac

SEQ ID NO: 1577773 - RNA, 13 nt, Homo sapiens
cuccucuaucuua

SEQ ID NO: 1577774 - RNA, 13 nt, Homo sapiens
cuccucugaauuu

SEQ ID NO: 1577775 - RNA, 12 nt, Homo sapiens
cuccucugcacu

SEQ ID NO: 1577776 - RNA, 11 nt, Homo sapiens
cuccugccauu

SEQ ID NO: 1577777 - RNA, 14 nt, Homo sapiens
cuccugccuacuca

SEQ ID NO: 1577778 - RNA, 15 nt, Homo sapiens
cuccugcugauccag

SEQ ID NO: 1577779 - RNA, 17 nt, Homo sapiens
cuccugcugccuaauaa

SEQ ID NO: 1577780 - RNA, 15 nt, Homo sapiens
cuccuggggagcucc

SEQ ID NO: 1577781 - RNA, 13 nt, Homo sapiens
cuccuggugcagg

SEQ ID NO: 1577782 - RNA, 14 nt, Homo sapiens
cuccuguaccucag

SEQ ID NO: 1577783 - RNA, 16 nt, Homo sapiens
cuccugugaauggagg

SEQ ID NO: 1577784 - RNA, 20 nt, Homo sapiens
cuccuguucacaccagagaa

SEQ ID NO: 1577785 - RNA, 13 nt, Homo sapiens
cuccuucauuuca

SEQ ID NO: 1577786 - RNA, 20 nt, Homo sapiens
cuccuugaauaucuuucgau

SEQ ID NO: 1577787 - RNA, 22 nt, Homo sapiens
cuccuuggcuucuuuacuuagu

SEQ ID NO: 1577788 - RNA, 17 nt, Homo sapiens
cuccuuguccacccacc

SEQ ID NO: 1577789 - RNA, 23 nt, Homo sapiens
cuccuugugagaguggcuuucua

SEQ ID NO: 1577790 - RNA, 22 nt, Homo sapiens
cuccuuuauuucagcauggagg

SEQ ID NO: 1577791 - RNA, 15 nt, Homo sapiens
cuccuuucaugcucc

SEQ ID NO: 1577792 - RNA, 19 nt, Homo sapiens
cuccuuucuccugugaaug

SEQ ID NO: 1577793 - RNA, 15 nt, Homo sapiens
cucgacaaaggccac

SEQ ID NO: 1577794 - RNA, 14 nt, Homo sapiens
cucgcucugucacc

SEQ ID NO: 1577795 - RNA, 21 nt, Homo sapiens
cucggagaagagcuguucaca

SEQ ID NO: 1577796 - RNA, 13 nt, Homo sapiens
cucggaggcugcc

SEQ ID NO: 1577797 - RNA, 16 nt, Homo sapiens
cucgugccaugaucug

SEQ ID NO: 1577798 - RNA, 23 nt, Homo sapiens
cucguuuuaagaaacuagcagau

SEQ ID NO: 1577799 - RNA, 13 nt, Homo sapiens
cucuaaaguccag

SEQ ID NO: 1577800 - RNA, 23 nt, Homo sapiens
cucuaaauaaacagauacauuca

SEQ ID NO: 1577801 - RNA, 18 nt, Homo sapiens
cucuaacaaugacauuua

SEQ ID NO: 1577802 - RNA, 13 nt, Homo sapiens
cucuaacccagug

SEQ ID NO: 1577803 - RNA, 17 nt, Homo sapiens
cucuaacuccugccauu

SEQ ID NO: 1577804 - RNA, 19 nt, Homo sapiens
cucuaagcacauuccaaac

SEQ ID NO: 1577805 - RNA, 20 nt, Homo sapiens
cucuaagcacauuccaaacu

SEQ ID NO: 1577806 - RNA, 16 nt, Homo sapiens
cucuaauccagcaaag

SEQ ID NO: 1577807 - RNA, 12 nt, Homo sapiens
cucuacaugcau

SEQ ID NO: 1577808 - RNA, 17 nt, Homo sapiens
cucuacuaaaaacacaa

SEQ ID NO: 1577809 - RNA, 20 nt, Homo sapiens
cucuacuaaaaauacaaaaa

SEQ ID NO: 1577810 - RNA, 21 nt, Homo sapiens
cucuacuaaaaauaccaaaaa

SEQ ID NO: 1577811 - RNA, 14 nt, Homo sapiens
cucuagaagccaag

SEQ ID NO: 1577812 - RNA, 20 nt, Homo sapiens
cucuaguaaauuuaagucca

SEQ ID NO: 1577813 - RNA, 16 nt, Homo sapiens
cucuaguuauauugaa

SEQ ID NO: 1577814 - RNA, 18 nt, Homo sapiens
cucuaucccugaaaucca

SEQ ID NO: 1577815 - RNA, 19 nt, Homo sapiens
cucuaucccugaaauccag

SEQ ID NO: 1577816 - RNA, 14 nt, Homo sapiens
cucuaugucugccu

SEQ ID NO: 1577817 - RNA, 13 nt, Homo sapiens
cucuauuaucuca

SEQ ID NO: 1577818 - RNA, 19 nt, Homo sapiens
cucuauugauguacagucu

SEQ ID NO: 1577819 - RNA, 15 nt, Homo sapiens
cucuauuuaaauucu

SEQ ID NO: 1577820 - RNA, 15 nt, Homo sapiens
cucuauuugagaaua

SEQ ID NO: 1577821 - RNA, 16 nt, Homo sapiens
cucuauuuuuacauuu

SEQ ID NO: 1577822 - RNA, 20 nt, Homo sapiens
cucucaaaagagaaaaacaa

SEQ ID NO: 1577823 - RNA, 15 nt, Homo sapiens
cucucaaauccaaaa

SEQ ID NO: 1577824 - RNA, 18 nt, Homo sapiens
cucucaagggcaggauua

SEQ ID NO: 1577825 - RNA, 17 nt, Homo sapiens
cucucacuauaccagua

SEQ ID NO: 1577826 - RNA, 23 nt, Homo sapiens
cucucacuuaauuuucccaauga

SEQ ID NO: 1577827 - RNA, 21 nt, Homo sapiens
cucuccacaaggggauuuugc

SEQ ID NO: 1577828 - RNA, 16 nt, Homo sapiens
cucuccagcugacuaa

SEQ ID NO: 1577829 - RNA, 22 nt, Homo sapiens
cucuccccauccccacccaguc

SEQ ID NO: 1577830 - RNA, 12 nt, Homo sapiens
cucuccugcaaa

SEQ ID NO: 1577831 - RNA, 21 nt, Homo sapiens
cucuccuuauagacacuugcu

SEQ ID NO: 1577832 - RNA, 15 nt, Homo sapiens
cucucgacaguaucc

SEQ ID NO: 1577833 - RNA, 22 nt, Homo sapiens
cucucuagcuuaaguguaaaug

SEQ ID NO: 1577834 - RNA, 21 nt, Homo sapiens
cucucuaucccugaaauccag

SEQ ID NO: 1577835 - RNA, 12 nt, Homo sapiens
cucucuccuuau

SEQ ID NO: 1577836 - RNA, 14 nt, Homo sapiens
cucucugaaccuca

SEQ ID NO: 1577837 - RNA, 20 nt, Homo sapiens
cucucugaugucccagugcu

SEQ ID NO: 1577838 - RNA, 20 nt, Homo sapiens
cucucuucaauaaaccacaa

SEQ ID NO: 1577839 - RNA, 14 nt, Homo sapiens
cucucuucucucca

SEQ ID NO: 1577840 - RNA, 23 nt, Homo sapiens
cucucuugcaggaaggacuauga

SEQ ID NO: 1577841 - RNA, 15 nt, Homo sapiens
cucugaaaccagugu

SEQ ID NO: 1577842 - RNA, 17 nt, Homo sapiens
cucugaaaccaguguua

SEQ ID NO: 1577843 - RNA, 13 nt, Homo sapiens
cucugaacuucca

SEQ ID NO: 1577844 - RNA, 12 nt, Homo sapiens
cucugacagucc

SEQ ID NO: 1577845 - RNA, 15 nt, Homo sapiens
cucugaucugaggcu

SEQ ID NO: 1577846 - RNA, 18 nt, Homo sapiens
cucugauucuacagugau

SEQ ID NO: 1577847 - RNA, 18 nt, Homo sapiens
cucugcagucaagcccug

SEQ ID NO: 1577848 - RNA, 12 nt, Homo sapiens
cucugcauagac

SEQ ID NO: 1577849 - RNA, 11 nt, Homo sapiens
cucugcucccu

SEQ ID NO: 1577850 - RNA, 15 nt, Homo sapiens
cucuggccacuauua

SEQ ID NO: 1577851 - RNA, 22 nt, Homo sapiens
cucuggggacugggaacccaug

SEQ ID NO: 1577852 - RNA, 21 nt, Homo sapiens
cucuggugcuccugcaucuca

SEQ ID NO: 1577853 - RNA, 13 nt, Homo sapiens
cucuguacagcug

SEQ ID NO: 1577854 - RNA, 19 nt, Homo sapiens
cucuguacagcugcucuua

SEQ ID NO: 1577855 - RNA, 15 nt, Homo sapiens
cucuguacuuuucau

SEQ ID NO: 1577856 - RNA, 23 nt, Homo sapiens
cucuguagcuagcaauagguuug

SEQ ID NO: 1577857 - RNA, 23 nt, Homo sapiens
cucuguccuggaggcacugggaa

SEQ ID NO: 1577858 - RNA, 18 nt, Homo sapiens
cucugucucaguccauga

SEQ ID NO: 1577859 - RNA, 13 nt, Homo sapiens
cucugugacuccc

SEQ ID NO: 1577860 - RNA, 23 nt, Homo sapiens
cucugugagggugcugacuggcu

SEQ ID NO: 1577861 - RNA, 14 nt, Homo sapiens
cucuguguaucuca

SEQ ID NO: 1577862 - RNA, 21 nt, Homo sapiens
cucuguuaauguggacuggaa

SEQ ID NO: 1577863 - RNA, 21 nt, Homo sapiens
cucuguugaaucacaguauca

SEQ ID NO: 1577864 - RNA, 20 nt, Homo sapiens
cucuuacaucuccuugauca

SEQ ID NO: 1577865 - RNA, 18 nt, Homo sapiens
cucuuagccccagacucu

SEQ ID NO: 1577866 - RNA, 17 nt, Homo sapiens
cucuuaugugugccuuu

SEQ ID NO: 1577867 - RNA, 18 nt, Homo sapiens
cucuucaauaaaccacaa

SEQ ID NO: 1577868 - RNA, 20 nt, Homo sapiens
cucuucaauaaaccacaagc

SEQ ID NO: 1577869 - RNA, 12 nt, Homo sapiens
cucuucacagau

SEQ ID NO: 1577870 - RNA, 17 nt, Homo sapiens
cucuucaugcuugacau

SEQ ID NO: 1577871 - RNA, 22 nt, Homo sapiens
cucuuccgacucuuucugagug

SEQ ID NO: 1577872 - RNA, 17 nt, Homo sapiens
cucuucuaaaauagcaa

SEQ ID NO: 1577873 - RNA, 17 nt, Homo sapiens
cucuucuacccucauca

SEQ ID NO: 1577874 - RNA, 20 nt, Homo sapiens
cucuucucuugagcaguuag

SEQ ID NO: 1577875 - RNA, 16 nt, Homo sapiens
cucuucugccuucuca

SEQ ID NO: 1577876 - RNA, 17 nt, Homo sapiens
cucuugaauuccucuca

SEQ ID NO: 1577877 - RNA, 19 nt, Homo sapiens
cucuugaauuccucucaaa

SEQ ID NO: 1577878 - RNA, 12 nt, Homo sapiens
cucuugacuacu

SEQ ID NO: 1577879 - RNA, 16 nt, Homo sapiens
cugucucgaugcaaug

SEQ ID NO: 1577880 - RNA, 13 nt, Homo sapiens
cugucucuaaaaa

SEQ ID NO: 1577881 - RNA, 16 nt, Homo sapiens
cugucugucaccagcu

SEQ ID NO: 1577882 - RNA, 17 nt, Homo sapiens
cugucugucaccagcua

SEQ ID NO: 1577883 - RNA, 11 nt, Homo sapiens
cugucuguccc

SEQ ID NO: 1577884 - RNA, 14 nt, Homo sapiens
cugucugugcacau

SEQ ID NO: 1577885 - RNA, 15 nt, Homo sapiens
cugucugugcaccga

SEQ ID NO: 1577886 - RNA, 13 nt, Homo sapiens
cugucuuccucaa

SEQ ID NO: 1577887 - RNA, 17 nt, Homo sapiens
cugucuugugucuccua

SEQ ID NO: 1577888 - RNA, 14 nt, Homo sapiens
cugucuuuaauucu

SEQ ID NO: 1577889 - RNA, 17 nt, Homo sapiens
cugucuuuuauuuaaca

SEQ ID NO: 1577890 - RNA, 16 nt, Homo sapiens
cugugaaauaccacaa

SEQ ID NO: 1577891 - RNA, 20 nt, Homo sapiens
cugugaaauucacaguaaua

SEQ ID NO: 1577892 - RNA, 16 nt, Homo sapiens
cugugaacccacugaa

SEQ ID NO: 1577893 - RNA, 21 nt, Homo sapiens
cugugacauacauauuaucuc

SEQ ID NO: 1577894 - RNA, 13 nt, Homo sapiens
cugugacauuucc

SEQ ID NO: 1577895 - RNA, 16 nt, Homo sapiens
cugugacccaucugua

SEQ ID NO: 1577896 - RNA, 21 nt, Homo sapiens
cugugacucccccucuuucac

SEQ ID NO: 1577897 - RNA, 16 nt, Homo sapiens
cugugagcauggggcc

SEQ ID NO: 1577898 - RNA, 21 nt, Homo sapiens
cugugauggggucaucaaauu

SEQ ID NO: 1577899 - RNA, 18 nt, Homo sapiens
cugugauuuaucuuucaa

SEQ ID NO: 1577900 - RNA, 21 nt, Homo sapiens
cugugauuucuuucuuugcac

SEQ ID NO: 1577901 - RNA, 16 nt, Homo sapiens
cugugcacccagaaga

SEQ ID NO: 1577902 - RNA, 21 nt, Homo sapiens
cugugcagguucccacuuaaa

SEQ ID NO: 1577903 - RNA, 19 nt, Homo sapiens
cugugcccuagaugcacgu

SEQ ID NO: 1577904 - RNA, 18 nt, Homo sapiens
cugugccuccccccagac

SEQ ID NO: 1577905 - RNA, 15 nt, Homo sapiens
cugugcuaugaauuu

SEQ ID NO: 1577906 - RNA, 16 nt, Homo sapiens
cugugcuguccuuuaa

SEQ ID NO: 1577907 - RNA, 15 nt, Homo sapiens
cuguggaugcugcug

SEQ ID NO: 1577908 - RNA, 13 nt, Homo sapiens
cuguggaugcuuc

SEQ ID NO: 1577909 - RNA, 14 nt, Homo sapiens
cuguggcagaguua

SEQ ID NO: 1577910 - RNA, 16 nt, Homo sapiens
cuguggcaucuuugcc

SEQ ID NO: 1577911 - RNA, 14 nt, Homo sapiens
cuguggccccaaga

SEQ ID NO: 1577912 - RNA, 15 nt, Homo sapiens
cugugggcagcaccc

SEQ ID NO: 1577913 - RNA, 22 nt, Homo sapiens
cugugggcauggucaaaggcuc

SEQ ID NO: 1577914 - RNA, 21 nt, Homo sapiens
cuguggguuugguccuugaac

SEQ ID NO: 1577915 - RNA, 20 nt, Homo sapiens
cugugguuccucugcucacc

SEQ ID NO: 1577916 - RNA, 19 nt, Homo sapiens
cuguguccuugcaccugca

SEQ ID NO: 1577917 - RNA, 18 nt, Homo sapiens
cugugucuggcguucuca

SEQ ID NO: 1577918 - RNA, 20 nt, Homo sapiens
cugugugucgcuuaugucua

SEQ ID NO: 1577919 - RNA, 15 nt, Homo sapiens
cugugugugugaaug

SEQ ID NO: 1577920 - RNA, 10 nt, Homo sapiens
cuguguuuca

SEQ ID NO: 1577921 - RNA, 11 nt, Homo sapiens
cuguguuucaa

SEQ ID NO: 1577922 - RNA, 14 nt, Homo sapiens
cuguuaaccaaagg

SEQ ID NO: 1577923 - RNA, 22 nt, Homo sapiens
cuguuaaccaaagggcagaaua

SEQ ID NO: 1577924 - RNA, 20 nt, Homo sapiens
cuguuaauguggacuggaac

SEQ ID NO: 1577925 - RNA, 14 nt, Homo sapiens
cuguuacaguaaug

SEQ ID NO: 1577926 - RNA, 13 nt, Homo sapiens
cuguuaccauuca

SEQ ID NO: 1577927 - RNA, 20 nt, Homo sapiens
cuguuaccauucacaauaaa

SEQ ID NO: 1577928 - RNA, 13 nt, Homo sapiens
cuguuacccaggc

SEQ ID NO: 1577929 - RNA, 19 nt, Homo sapiens
cuguuacugaaauugguau

SEQ ID NO: 1577930 - RNA, 12 nt, Homo sapiens
cuguuaguauua

SEQ ID NO: 1577931 - RNA, 15 nt, Homo sapiens
cuguucaaaccucug

SEQ ID NO: 1577932 - RNA, 21 nt, Homo sapiens
cuguuccccucugcuacuagc

SEQ ID NO: 1577933 - RNA, 18 nt, Homo sapiens
cuguuccucaacaagcaa

SEQ ID NO: 1577934 - RNA, 21 nt, Homo sapiens
cuguucuaccaagaacugaag

SEQ ID NO: 1577935 - RNA, 20 nt, Homo sapiens
cuguucucuugggaacugaa

SEQ ID NO: 1577936 - RNA, 20 nt, Homo sapiens
cuguucugaaaggagacauu

SEQ ID NO: 1577937 - RNA, 15 nt, Homo sapiens
cuguugaaaagcaca

SEQ ID NO: 1577938 - RNA, 13 nt, Homo sapiens
cuguugaugugga

SEQ ID NO: 1577939 - RNA, 21 nt, Homo sapiens
cuguugcauuuuuaaccaaca

SEQ ID NO: 1577940 - RNA, 18 nt, Homo sapiens
cuguugccgagcccagcu

SEQ ID NO: 1577941 - RNA, 22 nt, Homo sapiens
cuguugcuuuaauaugagcuuc

SEQ ID NO: 1577942 - RNA, 23 nt, Homo sapiens
cuguuggcguggggccuuuguca

SEQ ID NO: 1577943 - RNA, 19 nt, Homo sapiens
cuguuuagaugaaugucag

SEQ ID NO: 1577944 - RNA, 17 nt, Homo sapiens
cuguuuaguuuuacacu

SEQ ID NO: 1577945 - RNA, 15 nt, Homo sapiens
cuguuucaagcccuc

SEQ ID NO: 1577946 - RNA, 15 nt, Homo sapiens
cuguuucacauugca

SEQ ID NO: 1577947 - RNA, 21 nt, Homo sapiens
cuguuucagugugagucagaa

SEQ ID NO: 1577948 - RNA, 16 nt, Homo sapiens
cuguuuccuagcugug

SEQ ID NO: 1577949 - RNA, 13 nt, Homo sapiens
cuguuuccugaca

SEQ ID NO: 1577950 - RNA, 21 nt, Homo sapiens
cuguuugagaaccauuuacuu

SEQ ID NO: 1577951 - RNA, 12 nt, Homo sapiens
cuguuugcuugu

SEQ ID NO: 1577952 - RNA, 21 nt, Homo sapiens
cuguuugcuuguaguugaaua

SEQ ID NO: 1577953 - RNA, 14 nt, Homo sapiens
cuguuuguuuacaa

SEQ ID NO: 1577954 - RNA, 22 nt, Homo sapiens
cuguuuucucuuuguacugcuu

SEQ ID NO: 1577955 - RNA, 14 nt, Homo sapiens
cuguuuuguuguuu

SEQ ID NO: 1577956 - RNA, 23 nt, Homo sapiens
cuuaaaaaaauagaaauuauucu

SEQ ID NO: 1577957 - RNA, 16 nt, Homo sapiens
cuuaaaaaagaauaca

SEQ ID NO: 1577958 - RNA, 20 nt, Homo sapiens
cuuaaaaauuaaauuggaaa

SEQ ID NO: 1577959 - RNA, 19 nt, Homo sapiens
cuuaaaacaauucugugac

SEQ ID NO: 1577960 - RNA, 13 nt, Homo sapiens
cuuaaaacacuuc

SEQ ID NO: 1577961 - RNA, 18 nt, Homo sapiens
cuuaaaagaacauguaua

SEQ ID NO: 1577962 - RNA, 21 nt, Homo sapiens
cuuaaaauaugugaaguuuuc

SEQ ID NO: 1577963 - RNA, 14 nt, Homo sapiens
cuuaaaaugcaaua

SEQ ID NO: 1577964 - RNA, 11 nt, Homo sapiens
cuuaaacacau

SEQ ID NO: 1577965 - RNA, 21 nt, Homo sapiens
cuuaaaccuggaacaucucac

SEQ ID NO: 1577966 - RNA, 22 nt, Homo sapiens
cuuaaacucagcuacugcaaau

SEQ ID NO: 1577967 - RNA, 20 nt, Homo sapiens
cuuaaacucuggacacucua

SEQ ID NO: 1577968 - RNA, 11 nt, Homo sapiens
cuuaaaggcac

SEQ ID NO: 1577969 - RNA, 20 nt, Homo sapiens
cuuaaaggccgucauuucau

SEQ ID NO: 1577970 - RNA, 20 nt, Homo sapiens
cuuaaaguugacauuuaacu

SEQ ID NO: 1577971 - RNA, 15 nt, Homo sapiens
cuuaaaucuuuucaa

SEQ ID NO: 1577972 - RNA, 12 nt, Homo sapiens
cuuaaccaaaga

SEQ ID NO: 1577973 - RNA, 22 nt, Homo sapiens
cuuaacccccuagaaagacaga

SEQ ID NO: 1577974 - RNA, 12 nt, Homo sapiens
cuuaacuaugag

SEQ ID NO: 1577975 - RNA, 12 nt, Homo sapiens
cuuaagaacugu

SEQ ID NO: 1577976 - RNA, 22 nt, Homo sapiens
cuuaagcagcaacagccuacaa

SEQ ID NO: 1577977 - RNA, 14 nt, Homo sapiens
cuuaaggucuccaa

SEQ ID NO: 1577978 - RNA, 22 nt, Homo sapiens
cuuaaguauuauauaaacugug

SEQ ID NO: 1577979 - RNA, 19 nt, Homo sapiens
cuuaauaacuguguacugu

SEQ ID NO: 1577980 - RNA, 17 nt, Homo sapiens
cuuaauaaucaaccugg

SEQ ID NO: 1577981 - RNA, 14 nt, Homo sapiens
cuuaauacuaagga

SEQ ID NO: 1577982 - RNA, 16 nt, Homo sapiens
cuuaauacuaccuuga

SEQ ID NO: 1577983 - RNA, 21 nt, Homo sapiens
cuuaauauaaauucacuuuca

SEQ ID NO: 1577984 - RNA, 17 nt, Homo sapiens
cuuaaugaaccuuagaa

SEQ ID NO: 1577985 - RNA, 23 nt, Homo sapiens
cuuaaugguaggucaaguaauaa

SEQ ID NO: 1577986 - RNA, 21 nt, Homo sapiens
cuuacaacgccgagugcacug

SEQ ID NO: 1577987 - RNA, 16 nt, Homo sapiens
cuuacaguuaggauuu

SEQ ID NO: 1577988 - RNA, 11 nt, Homo sapiens
cuuacauaguu

SEQ ID NO: 1577989 - RNA, 13 nt, Homo sapiens
cuuaccauauguu

SEQ ID NO: 1577990 - RNA, 14 nt, Homo sapiens
cuuaccgcucuguu

SEQ ID NO: 1577991 - RNA, 22 nt, Homo sapiens
cuuacguauguuuguacuuggu

SEQ ID NO: 1577992 - RNA, 18 nt, Homo sapiens
cuuacuagaccuguaacu

SEQ ID NO: 1577993 - RNA, 11 nt, Homo sapiens
cuuacugagcu

SEQ ID NO: 1577994 - RNA, 15 nt, Homo sapiens
cuuacuguacauaca

SEQ ID NO: 1577995 - RNA, 14 nt, Homo sapiens
cuuagaaagucuga

SEQ ID NO: 1577996 - RNA, 18 nt, Homo sapiens
cuuagaaauucagcauuu

SEQ ID NO: 1577997 - RNA, 18 nt, Homo sapiens
cuuagaauugaccaaaua

SEQ ID NO: 1577998 - RNA, 23 nt, Homo sapiens
gaaacugcccuggcuccagugaa

SEQ ID NO: 1577999 - RNA, 17 nt, Homo sapiens
gaaacugcgaggccagu

SEQ ID NO: 1578000 - RNA, 17 nt, Homo sapiens
gaaagaaggacccagaa

SEQ ID NO: 1578001 - RNA, 14 nt, Homo sapiens
gaaagaaugcauuc

SEQ ID NO: 1578002 - RNA, 23 nt, Homo sapiens
gaaagaaugcauuccagaacaaa

SEQ ID NO: 1578003 - RNA, 14 nt, Homo sapiens
gaaagaauguuacu

SEQ ID NO: 1578004 - RNA, 23 nt, Homo sapiens
gaaagaccaggccaaugucaggg

SEQ ID NO: 1578005 - RNA, 18 nt, Homo sapiens
gaaagacuauucaaacag

SEQ ID NO: 1578006 - RNA, 18 nt, Homo sapiens
gaaagagcaagugacuuu

SEQ ID NO: 1578007 - RNA, 14 nt, Homo sapiens
gaaagaugacaaaa

SEQ ID NO: 1578008 - RNA, 15 nt, Homo sapiens
gaaagauuugugaac

SEQ ID NO: 1578009 - RNA, 19 nt, Homo sapiens
gaaagcaaaagcaagggac

SEQ ID NO: 1578010 - RNA, 15 nt, Homo sapiens
gaaagcaacaaagau

SEQ ID NO: 1578011 - RNA, 22 nt, Homo sapiens
gaaagcacuauuaauacucugc

SEQ ID NO: 1578012 - RNA, 16 nt, Homo sapiens
gaaagcagaaaaucua

SEQ ID NO: 1578013 - RNA, 18 nt, Homo sapiens
gaaagcagggacuugaac

SEQ ID NO: 1578014 - RNA, 21 nt, Homo sapiens
gaaagcaggggcagaugccac

SEQ ID NO: 1578015 - RNA, 22 nt, Homo sapiens
gaaagcaucugagcuaacuuau

SEQ ID NO: 1578016 - RNA, 22 nt, Homo sapiens
gaaagcauuucuuuucucuuua

SEQ ID NO: 1578017 - RNA, 18 nt, Homo sapiens
gaaagcuccuuccagacc

SEQ ID NO: 1578018 - RNA, 18 nt, Homo sapiens
gaaagcugacauugccaa

SEQ ID NO: 1578019 - RNA, 23 nt, Homo sapiens
gaaagcuugcccuggugccucac

SEQ ID NO: 1578020 - RNA, 15 nt, Homo sapiens
gaaaggacuguggac

SEQ ID NO: 1578021 - RNA, 14 nt, Homo sapiens
gaaaggcucauuua

SEQ ID NO: 1578022 - RNA, 23 nt, Homo sapiens
gaaaggggccccaccggggucua

SEQ ID NO: 1578023 - RNA, 13 nt, Homo sapiens
gaaaggggugcuu

SEQ ID NO: 1578024 - RNA, 20 nt, Homo sapiens
gaaaggguuuguaauacuuu

SEQ ID NO: 1578025 - RNA, 17 nt, Homo sapiens
gaaaguaagcauuucca

SEQ ID NO: 1578026 - RNA, 12 nt, Homo sapiens
gaaaguacccag

SEQ ID NO: 1578027 - RNA, 18 nt, Homo sapiens
gaaaguauagauggccaa

SEQ ID NO: 1578028 - RNA, 17 nt, Homo sapiens
gaaaguauuggcauuca

SEQ ID NO: 1578029 - RNA, 16 nt, Homo sapiens
gaaaguauuuacuuuu

SEQ ID NO: 1578030 - RNA, 19 nt, Homo sapiens
gaaaguuaauccacuguga

SEQ ID NO: 1578031 - RNA, 16 nt, Homo sapiens
gaaauaaaaaagucuc

SEQ ID NO: 1578032 - RNA, 13 nt, Homo sapiens
gaaauaaacugag

SEQ ID NO: 1578033 - RNA, 19 nt, Homo sapiens
gaaauaaaggaugugauug

SEQ ID NO: 1578034 - RNA, 14 nt, Homo sapiens
gaaauaaaugacaa

SEQ ID NO: 1578035 - RNA, 15 nt, Homo sapiens
gaaauaucaaagugu

SEQ ID NO: 1578036 - RNA, 17 nt, Homo sapiens
gaaauauuaagagcuau

SEQ ID NO: 1578037 - RNA, 21 nt, Homo sapiens
gaaauauugacucaaaccaua

SEQ ID NO: 1578038 - RNA, 16 nt, Homo sapiens
gaaaucuuaaaccuua

SEQ ID NO: 1578039 - RNA, 14 nt, Homo sapiens
gaaaucuugcuuca

SEQ ID NO: 1578040 - RNA, 14 nt, Homo sapiens
gaaaugaaagggaa

SEQ ID NO: 1578041 - RNA, 23 nt, Homo sapiens
gaaaugaaagggaaacugggaaa

SEQ ID NO: 1578042 - RNA, 14 nt, Homo sapiens
gaaaugauuucaca

SEQ ID NO: 1578043 - RNA, 14 nt, Homo sapiens
gaaaugcauugcuc

SEQ ID NO: 1578044 - RNA, 19 nt, Homo sapiens
gaaaugcuguuaguaaauu

SEQ ID NO: 1578045 - RNA, 15 nt, Homo sapiens
gaaauggaacagauu

SEQ ID NO: 1578046 - RNA, 21 nt, Homo sapiens
gaaauggaugcaaaguacaau

SEQ ID NO: 1578047 - RNA, 16 nt, Homo sapiens
gaaauggccacuacuu

SEQ ID NO: 1578048 - RNA, 22 nt, Homo sapiens
gaaaugucuccacccgugucca

SEQ ID NO: 1578049 - RNA, 11 nt, Homo sapiens
gaaauuaacac

SEQ ID NO: 1578050 - RNA, 15 nt, Homo sapiens
gaaauuagauuugug

SEQ ID NO: 1578051 - RNA, 17 nt, Homo sapiens
gaaauuaugugacauuu

SEQ ID NO: 1578052 - RNA, 14 nt, Homo sapiens
gaaauucuuuccca

SEQ ID NO: 1578053 - RNA, 15 nt, Homo sapiens
gaaauugaccauaca

SEQ ID NO: 1578054 - RNA, 22 nt, Homo sapiens
gaaauuuaaacuauaagcaaga

SEQ ID NO: 1578055 - RNA, 20 nt, Homo sapiens
gaaauuuacugugagacugu

SEQ ID NO: 1578056 - RNA, 13 nt, Homo sapiens
gaaauuuggcaaa

SEQ ID NO: 1578057 - RNA, 14 nt, Homo sapiens
gaaauuuugcacca

SEQ ID NO: 1578058 - RNA, 17 nt, Homo sapiens
gaaauuuuguaagaagg

SEQ ID NO: 1578059 - RNA, 21 nt, Homo sapiens
gaaauuuuguaagaaggcaau

SEQ ID NO: 1578060 - RNA, 13 nt, Homo sapiens
gaacaaacagggc

SEQ ID NO: 1578061 - RNA, 20 nt, Homo sapiens
gaacaacuuguagcagcuau

SEQ ID NO: 1578062 - RNA, 18 nt, Homo sapiens
gaacaagcaauuacaaua

SEQ ID NO: 1578063 - RNA, 18 nt, Homo sapiens
gaacaauauaauuuucac

SEQ ID NO: 1578064 - RNA, 14 nt, Homo sapiens
gaacaauucaagaa

SEQ ID NO: 1578065 - RNA, 13 nt, Homo sapiens
gaacacaaccaga

SEQ ID NO: 1578066 - RNA, 11 nt, Homo sapiens
gaacacuaacc

SEQ ID NO: 1578067 - RNA, 23 nt, Homo sapiens
gaacacucuuagcuauguugaca

SEQ ID NO: 1578068 - RNA, 18 nt, Homo sapiens
gaacacucuuuugcuuua

SEQ ID NO: 1578069 - RNA, 19 nt, Homo sapiens
gaacagaauugcuccugca

SEQ ID NO: 1578070 - RNA, 13 nt, Homo sapiens
gaacagagucuca

SEQ ID NO: 1578071 - RNA, 15 nt, Homo sapiens
gaacagaucaggaau

SEQ ID NO: 1578072 - RNA, 14 nt, Homo sapiens
gaacaguaugaauu

SEQ ID NO: 1578073 - RNA, 18 nt, Homo sapiens
gaacaguauuacaguguc

SEQ ID NO: 1578074 - RNA, 19 nt, Homo sapiens
gaacaguuuuacaauagac

SEQ ID NO: 1578075 - RNA, 17 nt, Homo sapiens
gaacauaaaaaggacau

SEQ ID NO: 1578076 - RNA, 22 nt, Homo sapiens
gaacauuaacaaaagcaauugu

SEQ ID NO: 1578077 - RNA, 19 nt, Homo sapiens
gaacauucacuuuuguuaa

SEQ ID NO: 1578078 - RNA, 17 nt, Homo sapiens
gaaccaagaagggcuag

SEQ ID NO: 1578079 - RNA, 18 nt, Homo sapiens
gaaccacagcagacacca

SEQ ID NO: 1578080 - RNA, 12 nt, Homo sapiens
gaaccagcccca

SEQ ID NO: 1578081 - RNA, 12 nt, Homo sapiens
gaaccaggccag

SEQ ID NO: 1578082 - RNA, 20 nt, Homo sapiens
gaaccaucuucguacaugaa

SEQ ID NO: 1578083 - RNA, 18 nt, Homo sapiens
gaaccauggugaacucca

SEQ ID NO: 1578084 - RNA, 21 nt, Homo sapiens
gaaccauguggauaacuuuac

SEQ ID NO: 1578085 - RNA, 13 nt, Homo sapiens
gaaccauuuacuu

SEQ ID NO: 1578086 - RNA, 16 nt, Homo sapiens
gaaccauuucacccag

SEQ ID NO: 1578087 - RNA, 18 nt, Homo sapiens
gaacccaguguuuccaca

SEQ ID NO: 1578088 - RNA, 21 nt, Homo sapiens
gaaccccagcuucccuccagc

SEQ ID NO: 1578089 - RNA, 23 nt, Homo sapiens
gaacccuagaaauauauccugug

SEQ ID NO: 1578090 - RNA, 19 nt, Homo sapiens
gaaccucaguuuccucauc

SEQ ID NO: 1578091 - RNA, 22 nt, Homo sapiens
gaaccucucguaguccaucacc

SEQ ID NO: 1578092 - RNA, 14 nt, Homo sapiens
gaaccuguccaguu

SEQ ID NO: 1578093 - RNA, 20 nt, Homo sapiens
gaacgcuuguaauuggaaua

SEQ ID NO: 1578094 - RNA, 12 nt, Homo sapiens
gaacuaggcucu

SEQ ID NO: 1578095 - RNA, 19 nt, Homo sapiens
gaacuauacccgggaccaa

SEQ ID NO: 1578096 - RNA, 13 nt, Homo sapiens
gaacucacagaaa

SEQ ID NO: 1578097 - RNA, 14 nt, Homo sapiens
gaacucauuugaau

SEQ ID NO: 1578098 - RNA, 20 nt, Homo sapiens
gaacucauuugaaugcuuaa

SEQ ID NO: 1578099 - RNA, 16 nt, Homo sapiens
gaacuccauacagccu

SEQ ID NO: 1578100 - RNA, 19 nt, Homo sapiens
gaacucggccccuccucaa

SEQ ID NO: 1578101 - RNA, 18 nt, Homo sapiens
gaacucuacuucagucaa

SEQ ID NO: 1578102 - RNA, 23 nt, Homo sapiens
gaacucuccccuugucugcacug

SEQ ID NO: 1578103 - RNA, 19 nt, Homo sapiens
gaacucugguggcacagga

SEQ ID NO: 1578104 - RNA, 18 nt, Homo sapiens
gaacugaaggcauaugca

SEQ ID NO: 1578105 - RNA, 17 nt, Homo sapiens
gaacugacaaugaaggg

SEQ ID NO: 1578106 - RNA, 17 nt, Homo sapiens
gaacugcagcaaucaca

SEQ ID NO: 1578107 - RNA, 22 nt, Homo sapiens
gaacugggagcagcucugugac

SEQ ID NO: 1578108 - RNA, 11 nt, Homo sapiens
gaacuguuaca

SEQ ID NO: 1578109 - RNA, 13 nt, Homo sapiens
gaacuuacuguag

SEQ ID NO: 1578110 - RNA, 11 nt, Homo sapiens
gaacuugcaau

SEQ ID NO: 1578111 - RNA, 16 nt, Homo sapiens
gaacuugcaauaccaa

SEQ ID NO: 1578112 - RNA, 18 nt, Homo sapiens
gaacuuuaagaagcagug

SEQ ID NO: 1578113 - RNA, 21 nt, Homo sapiens
gaacuuuaagaagcaguguuu

SEQ ID NO: 1578114 - RNA, 17 nt, Homo sapiens
gaagaaaaaggacaaau

SEQ ID NO: 1578115 - RNA, 22 nt, Homo sapiens
gaagaaaacaguacagaaggca

SEQ ID NO: 1578116 - RNA, 19 nt, Homo sapiens
gaguguuuuaaaacauuca

SEQ ID NO: 1578117 - RNA, 15 nt, Homo sapiens
gaguuaacugugaaa

SEQ ID NO: 1578118 - RNA, 14 nt, Homo sapiens
gaguuacaguucug

SEQ ID NO: 1578119 - RNA, 21 nt, Homo sapiens
gaguuaggaccaccaauggau

SEQ ID NO: 1578120 - RNA, 14 nt, Homo sapiens
gaguucaagaccag

SEQ ID NO: 1578121 - RNA, 21 nt, Homo sapiens
gaguucauggauauguuauac

SEQ ID NO: 1578122 - RNA, 12 nt, Homo sapiens
gaguuccagacc

SEQ ID NO: 1578123 - RNA, 19 nt, Homo sapiens
gaguucugacuaaagguua

SEQ ID NO: 1578124 - RNA, 16 nt, Homo sapiens
gaguucuuuauauuca

SEQ ID NO: 1578125 - RNA, 20 nt, Homo sapiens
gaguugaagacagcuuccca

SEQ ID NO: 1578126 - RNA, 11 nt, Homo sapiens
gaguugcacau

SEQ ID NO: 1578127 - RNA, 20 nt, Homo sapiens
gaguuguuuaaacagucaaa

SEQ ID NO: 1578128 - RNA, 19 nt, Homo sapiens
gaguuucacaaauccuuca

SEQ ID NO: 1578129 - RNA, 17 nt, Homo sapiens
gaguuuggaugucugua

SEQ ID NO: 1578130 - RNA, 11 nt, Homo sapiens
gauaaaacacc

SEQ ID NO: 1578131 - RNA, 16 nt, Homo sapiens
gauaaagaugcaagga

SEQ ID NO: 1578132 - RNA, 17 nt, Homo sapiens
gauaaaugauagacaau

SEQ ID NO: 1578133 - RNA, 17 nt, Homo sapiens
gauaacuggcacccaga

SEQ ID NO: 1578134 - RNA, 20 nt, Homo sapiens
gauaacuuggggaggcaaga

SEQ ID NO: 1578135 - RNA, 22 nt, Homo sapiens
gauaaggacgggaccauuuuua

SEQ ID NO: 1578136 - RNA, 20 nt, Homo sapiens
gauaauagagggcuggaauu

SEQ ID NO: 1578137 - RNA, 19 nt, Homo sapiens
gauaauauugucugucucu

SEQ ID NO: 1578138 - RNA, 21 nt, Homo sapiens
gauaaucuuucuaaaaauuca

SEQ ID NO: 1578139 - RNA, 19 nt, Homo sapiens
gauaaugcuguugccucau

SEQ ID NO: 1578140 - RNA, 13 nt, Homo sapiens
gauaauuggugca

SEQ ID NO: 1578141 - RNA, 23 nt, Homo sapiens
gauacaguuuugaguaaaaagac

SEQ ID NO: 1578142 - RNA, 12 nt, Homo sapiens
gauacauuuaau

SEQ ID NO: 1578143 - RNA, 12 nt, Homo sapiens
gauacugauuau

SEQ ID NO: 1578144 - RNA, 20 nt, Homo sapiens
gauacuugaauaaccaucug

SEQ ID NO: 1578145 - RNA, 17 nt, Homo sapiens
gauacuuuagccaucau

SEQ ID NO: 1578146 - RNA, 14 nt, Homo sapiens
gauagaaggcuaug

SEQ ID NO: 1578147 - RNA, 14 nt, Homo sapiens
gauagauaaugccu

SEQ ID NO: 1578148 - RNA, 13 nt, Homo sapiens
gauagaugucuau

SEQ ID NO: 1578149 - RNA, 22 nt, Homo sapiens
gauagcaagguuuggugcaaag

SEQ ID NO: 1578150 - RNA, 14 nt, Homo sapiens
gauagcugcauuac

SEQ ID NO: 1578151 - RNA, 11 nt, Homo sapiens
gauagcugucc

SEQ ID NO: 1578152 - RNA, 14 nt, Homo sapiens
gauaggaaugugaa

SEQ ID NO: 1578153 - RNA, 18 nt, Homo sapiens
gauauaaaaauaauguca

SEQ ID NO: 1578154 - RNA, 22 nt, Homo sapiens
gauauaauuuuauuacauauga

SEQ ID NO: 1578155 - RNA, 19 nt, Homo sapiens
gauauacauuuauuuacac

SEQ ID NO: 1578156 - RNA, 12 nt, Homo sapiens
gauauaccuaau

SEQ ID NO: 1578157 - RNA, 17 nt, Homo sapiens
gauaucuuugcugcuuu

SEQ ID NO: 1578158 - RNA, 14 nt, Homo sapiens
gauaugcacuugaa

SEQ ID NO: 1578159 - RNA, 19 nt, Homo sapiens
gauaugcacuugaaaugau

SEQ ID NO: 1578160 - RNA, 19 nt, Homo sapiens
gauauggacucucuaagga

SEQ ID NO: 1578161 - RNA, 13 nt, Homo sapiens
gauauucauucuu

SEQ ID NO: 1578162 - RNA, 20 nt, Homo sapiens
gauauucuguugcuuuacag

SEQ ID NO: 1578163 - RNA, 14 nt, Homo sapiens
gauauugcuacuau

SEQ ID NO: 1578164 - RNA, 17 nt, Homo sapiens
gauauuuuuuacuuuag

SEQ ID NO: 1578165 - RNA, 17 nt, Homo sapiens
gaucaaauugugcagua

SEQ ID NO: 1578166 - RNA, 20 nt, Homo sapiens
gaucaacaucuuuucuugcc

SEQ ID NO: 1578167 - RNA, 21 nt, Homo sapiens
gaucaaguuguugacugugau

SEQ ID NO: 1578168 - RNA, 18 nt, Homo sapiens
gaucacuacaaguauuau

SEQ ID NO: 1578169 - RNA, 18 nt, Homo sapiens
gaucagagcgcacaggga

SEQ ID NO: 1578170 - RNA, 14 nt, Homo sapiens
gaucauggaccugg

SEQ ID NO: 1578171 - RNA, 18 nt, Homo sapiens
gaucauuaucagccugug

SEQ ID NO: 1578172 - RNA, 23 nt, Homo sapiens
gaucauuaucagccugugccacg

SEQ ID NO: 1578173 - RNA, 13 nt, Homo sapiens
gaucauugugaag

SEQ ID NO: 1578174 - RNA, 21 nt, Homo sapiens
gaucauuuuuaacugauucuu

SEQ ID NO: 1578175 - RNA, 14 nt, Homo sapiens
gauccacacugaga

SEQ ID NO: 1578176 - RNA, 21 nt, Homo sapiens
gauccagauguuaugcuccug

SEQ ID NO: 1578177 - RNA, 15 nt, Homo sapiens
gauccagccaugccu

SEQ ID NO: 1578178 - RNA, 16 nt, Homo sapiens
gaucccaacacugcca

SEQ ID NO: 1578179 - RNA, 23 nt, Homo sapiens
gauccucauauggcccaguguca

SEQ ID NO: 1578180 - RNA, 15 nt, Homo sapiens
gauccuccacagaga

SEQ ID NO: 1578181 - RNA, 15 nt, Homo sapiens
gauccucccaccuca

SEQ ID NO: 1578182 - RNA, 23 nt, Homo sapiens
gauccucucuggggcuguguuuu

SEQ ID NO: 1578183 - RNA, 21 nt, Homo sapiens
gauccugcaccccagcauucc

SEQ ID NO: 1578184 - RNA, 13 nt, Homo sapiens
gauccugcacucu

SEQ ID NO: 1578185 - RNA, 16 nt, Homo sapiens
gauccugcccuggcca

SEQ ID NO: 1578186 - RNA, 22 nt, Homo sapiens
gaucgcaccacugcacuccagc

SEQ ID NO: 1578187 - RNA, 18 nt, Homo sapiens
gaucggcggccacugcgc

SEQ ID NO: 1578188 - RNA, 13 nt, Homo sapiens
gaucuauuuacau

SEQ ID NO: 1578189 - RNA, 19 nt, Homo sapiens
gaucucccugccgccucaa

SEQ ID NO: 1578190 - RNA, 18 nt, Homo sapiens
gaucucggcucacugcaa

SEQ ID NO: 1578191 - RNA, 21 nt, Homo sapiens
gaucugucugugcacaugccu

SEQ ID NO: 1578192 - RNA, 22 nt, Homo sapiens
gaucugucugugcacaugccuc

SEQ ID NO: 1578193 - RNA, 19 nt, Homo sapiens
gaucuguuuugaaggcaaa

SEQ ID NO: 1578194 - RNA, 23 nt, Homo sapiens
gaucuuccguggucagagugcca

SEQ ID NO: 1578195 - RNA, 17 nt, Homo sapiens
gaucuuucuuuccaaaa

SEQ ID NO: 1578196 - RNA, 18 nt, Homo sapiens
gaucuuugagcccauucu

SEQ ID NO: 1578197 - RNA, 18 nt, Homo sapiens
gaugaaaguacauuggga

SEQ ID NO: 1578198 - RNA, 16 nt, Homo sapiens
gaugaacaucuuuuaa

SEQ ID NO: 1578199 - RNA, 13 nt, Homo sapiens
gaugacaaccucc

SEQ ID NO: 1578200 - RNA, 17 nt, Homo sapiens
gaugagacagacauuca

SEQ ID NO: 1578201 - RNA, 20 nt, Homo sapiens
gaugagaugguuucuagaga

SEQ ID NO: 1578202 - RNA, 18 nt, Homo sapiens
gaugagcaagacauacuu

SEQ ID NO: 1578203 - RNA, 17 nt, Homo sapiens
gaugaguuaacugugaa

SEQ ID NO: 1578204 - RNA, 12 nt, Homo sapiens
gaugaugaaggg

SEQ ID NO: 1578205 - RNA, 13 nt, Homo sapiens
gaugaugcaguuu

SEQ ID NO: 1578206 - RNA, 22 nt, Homo sapiens
gaugauuuccuaguagaacuca

SEQ ID NO: 1578207 - RNA, 17 nt, Homo sapiens
gaugcacguggggccca

SEQ ID NO: 1578208 - RNA, 17 nt, Homo sapiens
gaugcacuucaaauuca

SEQ ID NO: 1578209 - RNA, 12 nt, Homo sapiens
gaugcagcauuu

SEQ ID NO: 1578210 - RNA, 17 nt, Homo sapiens
gaugcagcuacuggaau

SEQ ID NO: 1578211 - RNA, 22 nt, Homo sapiens
gaugcaguuucaaguaccaaaa

SEQ ID NO: 1578212 - RNA, 23 nt, Homo sapiens
gaugcccccuguggaugcugcug

SEQ ID NO: 1578213 - RNA, 22 nt, Homo sapiens
gaugccuguuaauuuauaaugu

SEQ ID NO: 1578214 - RNA, 17 nt, Homo sapiens
gaugcugaugcuguuaa

SEQ ID NO: 1578215 - RNA, 12 nt, Homo sapiens
gaugcugccaaa

SEQ ID NO: 1578216 - RNA, 17 nt, Homo sapiens
gaugcuggggacacagc

SEQ ID NO: 1578217 - RNA, 13 nt, Homo sapiens
gaugcugucugaa

SEQ ID NO: 1578218 - RNA, 15 nt, Homo sapiens
gauggaaaauaccag

SEQ ID NO: 1578219 - RNA, 16 nt, Homo sapiens
gauggagaaacaagac

SEQ ID NO: 1578220 - RNA, 18 nt, Homo sapiens
gauggcaucuccauguag

SEQ ID NO: 1578221 - RNA, 20 nt, Homo sapiens
gauggccccuccacugggga

SEQ ID NO: 1578222 - RNA, 21 nt, Homo sapiens
gaugggcagcccaacagcacu

SEQ ID NO: 1578223 - RNA, 22 nt, Homo sapiens
gauggggucucgcucugucacc

SEQ ID NO: 1578224 - RNA, 14 nt, Homo sapiens
gauggguccagggg

SEQ ID NO: 1578225 - RNA, 14 nt, Homo sapiens
gauggugugccuuc

SEQ ID NO: 1578226 - RNA, 22 nt, Homo sapiens
gaugguucuucuccaguuagaa

SEQ ID NO: 1578227 - RNA, 11 nt, Homo sapiens
gauguacaauu

SEQ ID NO: 1578228 - RNA, 18 nt, Homo sapiens
gauguaggguaaggugcc

SEQ ID NO: 1578229 - RNA, 15 nt, Homo sapiens
gauguaguaucucau

SEQ ID NO: 1578230 - RNA, 15 nt, Homo sapiens
gauguauuguugcuu

SEQ ID NO: 1578231 - RNA, 23 nt, Homo sapiens
gauguauuuuugauguauauauc

SEQ ID NO: 1578232 - RNA, 22 nt, Homo sapiens
gaugugaauuauugacacugaa

SEQ ID NO: 1578233 - RNA, 13 nt, Homo sapiens
gaugugauacaaa

SEQ ID NO: 1578234 - RNA, 15 nt, Homo sapiens
guauuggaaauggau

SEQ ID NO: 1578235 - RNA, 20 nt, Homo sapiens
guauuguugcuuuuuuucca

SEQ ID NO: 1578236 - RNA, 21 nt, Homo sapiens
guauuuauuuuacagcucauu

SEQ ID NO: 1578237 - RNA, 17 nt, Homo sapiens
guauuucuccuuugcaa

SEQ ID NO: 1578238 - RNA, 18 nt, Homo sapiens
guauuucuuaagaauuca

SEQ ID NO: 1578239 - RNA, 16 nt, Homo sapiens
guauuugaaauaagaa

SEQ ID NO: 1578240 - RNA, 17 nt, Homo sapiens
guauuuuuauccaugac

SEQ ID NO: 1578241 - RNA, 18 nt, Homo sapiens
guauuuuuucacuuguac

SEQ ID NO: 1578242 - RNA, 14 nt, Homo sapiens
gucaaaacuacuga

SEQ ID NO: 1578243 - RNA, 19 nt, Homo sapiens
gucaaaauuugcugccaaa

SEQ ID NO: 1578244 - RNA, 13 nt, Homo sapiens
gucaaacaguaau

SEQ ID NO: 1578245 - RNA, 11 nt, Homo sapiens
gucaaacugua

SEQ ID NO: 1578246 - RNA, 13 nt, Homo sapiens
gucaaacuguaga

SEQ ID NO: 1578247 - RNA, 22 nt, Homo sapiens
gucaaagaagcuuccacaaaau

SEQ ID NO: 1578248 - RNA, 20 nt, Homo sapiens
gucaaagauacacaaucuga

SEQ ID NO: 1578249 - RNA, 23 nt, Homo sapiens
gucaacgcaacgucuaacuggac

SEQ ID NO: 1578250 - RNA, 13 nt, Homo sapiens
gucaagcugcuga

SEQ ID NO: 1578251 - RNA, 15 nt, Homo sapiens
gucaagcuggugcua

SEQ ID NO: 1578252 - RNA, 19 nt, Homo sapiens
gucaauaaaaccacuguac

SEQ ID NO: 1578253 - RNA, 16 nt, Homo sapiens
gucacaacaauuaaau

SEQ ID NO: 1578254 - RNA, 21 nt, Homo sapiens
gucacacauuucuauuuugca

SEQ ID NO: 1578255 - RNA, 19 nt, Homo sapiens
gucacagagugagacucca

SEQ ID NO: 1578256 - RNA, 13 nt, Homo sapiens
gucacagaugaag

SEQ ID NO: 1578257 - RNA, 21 nt, Homo sapiens
gucacaugcuuuagccauaca

SEQ ID NO: 1578258 - RNA, 12 nt, Homo sapiens
gucaccagagac

SEQ ID NO: 1578259 - RNA, 13 nt, Homo sapiens
gucacccaaccug

SEQ ID NO: 1578260 - RNA, 21 nt, Homo sapiens
gucaccgggaugaaccuaucc

SEQ ID NO: 1578261 - RNA, 18 nt, Homo sapiens
gucaccggucagugccuu

SEQ ID NO: 1578262 - RNA, 19 nt, Homo sapiens
gucacguuaccauuuacau

SEQ ID NO: 1578263 - RNA, 14 nt, Homo sapiens
gucacuagucucac

SEQ ID NO: 1578264 - RNA, 15 nt, Homo sapiens
gucacuagucucacc

SEQ ID NO: 1578265 - RNA, 18 nt, Homo sapiens
gucacuggcccaaccaga

SEQ ID NO: 1578266 - RNA, 22 nt, Homo sapiens
gucagaacccugccauggaacu

SEQ ID NO: 1578267 - RNA, 23 nt, Homo sapiens
gucagacuuuguguucauuucau

SEQ ID NO: 1578268 - RNA, 15 nt, Homo sapiens
gucagagagaccuca

SEQ ID NO: 1578269 - RNA, 14 nt, Homo sapiens
gucagagcacuccc

SEQ ID NO: 1578270 - RNA, 14 nt, Homo sapiens
gucagaugucacau

SEQ ID NO: 1578271 - RNA, 14 nt, Homo sapiens
gucagccaagugca

SEQ ID NO: 1578272 - RNA, 14 nt, Homo sapiens
gucagccacuguuu

SEQ ID NO: 1578273 - RNA, 23 nt, Homo sapiens
gucaggcgcaguggcucaugccu

SEQ ID NO: 1578274 - RNA, 16 nt, Homo sapiens
gucagguaguugcaau

SEQ ID NO: 1578275 - RNA, 23 nt, Homo sapiens
gucaucaauaguguccuaugcaa

SEQ ID NO: 1578276 - RNA, 16 nt, Homo sapiens
gucaucacccagccuc

SEQ ID NO: 1578277 - RNA, 23 nt, Homo sapiens
gucauccagucuauucacagaag

SEQ ID NO: 1578278 - RNA, 20 nt, Homo sapiens
gucaucuuucuuuucuuuga

SEQ ID NO: 1578279 - RNA, 13 nt, Homo sapiens
gucaugcccuuaa

SEQ ID NO: 1578280 - RNA, 16 nt, Homo sapiens
gucauggccugagaug

SEQ ID NO: 1578281 - RNA, 21 nt, Homo sapiens
gucauuaaaacagaagcaaau

SEQ ID NO: 1578282 - RNA, 14 nt, Homo sapiens
gucauuauguuaau

SEQ ID NO: 1578283 - RNA, 21 nt, Homo sapiens
gucauuuuuauaaaacuuuga

SEQ ID NO: 1578284 - RNA, 22 nt, Homo sapiens
gucauuuuuauaaaacuuugaa

SEQ ID NO: 1578285 - RNA, 18 nt, Homo sapiens
guccaaaaauagucaaaa

SEQ ID NO: 1578286 - RNA, 15 nt, Homo sapiens
guccaagacaggggc

SEQ ID NO: 1578287 - RNA, 23 nt, Homo sapiens
guccacaacaauaugaaguacag

SEQ ID NO: 1578288 - RNA, 18 nt, Homo sapiens
guccacaagaacaauuca

SEQ ID NO: 1578289 - RNA, 20 nt, Homo sapiens
guccacuccuccuacuguau

SEQ ID NO: 1578290 - RNA, 18 nt, Homo sapiens
guccacuguucuguucuc

SEQ ID NO: 1578291 - RNA, 18 nt, Homo sapiens
guccagagggacagucag

SEQ ID NO: 1578292 - RNA, 22 nt, Homo sapiens
guccagccacuugacuggcaca

SEQ ID NO: 1578293 - RNA, 18 nt, Homo sapiens
guccagccccuccucccu

SEQ ID NO: 1578294 - RNA, 21 nt, Homo sapiens
guccagccccuccucccucag

SEQ ID NO: 1578295 - RNA, 23 nt, Homo sapiens
guccagccgccauugccaccagg

SEQ ID NO: 1578296 - RNA, 19 nt, Homo sapiens
guccaggagcuaaucugac

SEQ ID NO: 1578297 - RNA, 19 nt, Homo sapiens
guccaggccucucucugcu

SEQ ID NO: 1578298 - RNA, 23 nt, Homo sapiens
guccaggggucugucugcuuugg

SEQ ID NO: 1578299 - RNA, 12 nt, Homo sapiens
guccauaugcau

SEQ ID NO: 1578300 - RNA, 19 nt, Homo sapiens
guccaugaagcacugagca

SEQ ID NO: 1578301 - RNA, 17 nt, Homo sapiens
guccauuguccaauccu

SEQ ID NO: 1578302 - RNA, 17 nt, Homo sapiens
gucccaaugguccugac

SEQ ID NO: 1578303 - RNA, 16 nt, Homo sapiens
gucccaccccuaccuc

SEQ ID NO: 1578304 - RNA, 22 nt, Homo sapiens
gucccaccccuaccucuaguaa

SEQ ID NO: 1578305 - RNA, 16 nt, Homo sapiens
gucccacccucccuag

SEQ ID NO: 1578306 - RNA, 13 nt, Homo sapiens
gucccacugugca

SEQ ID NO: 1578307 - RNA, 21 nt, Homo sapiens
gucccaugaccuugggguaca

SEQ ID NO: 1578308 - RNA, 14 nt, Homo sapiens
gucccauuccucag

SEQ ID NO: 1578309 - RNA, 15 nt, Homo sapiens
gucccccccaggugc

SEQ ID NO: 1578310 - RNA, 19 nt, Homo sapiens
gucccccugcuugucuuca

SEQ ID NO: 1578311 - RNA, 18 nt, Homo sapiens
guccccucacucugucag

SEQ ID NO: 1578312 - RNA, 18 nt, Homo sapiens
guccccuccccucucagc

SEQ ID NO: 1578313 - RNA, 20 nt, Homo sapiens
gucccggggccagcacuucc

SEQ ID NO: 1578314 - RNA, 12 nt, Homo sapiens
gucccuaccugc

SEQ ID NO: 1578315 - RNA, 13 nt, Homo sapiens
gucccucccugcc

SEQ ID NO: 1578316 - RNA, 18 nt, Homo sapiens
gucccuggaaccuucuag

SEQ ID NO: 1578317 - RNA, 21 nt, Homo sapiens
gucccuucagcaccugacccu

SEQ ID NO: 1578318 - RNA, 19 nt, Homo sapiens
gucccuuggucuguacaaa

SEQ ID NO: 1578319 - RNA, 20 nt, Homo sapiens
gucccuuggucuguacaaau

SEQ ID NO: 1578320 - RNA, 22 nt, Homo sapiens
guccgacaacaccguguccaaa

SEQ ID NO: 1578321 - RNA, 22 nt, Homo sapiens
guccuaccacucuaaucaagaa

SEQ ID NO: 1578322 - RNA, 19 nt, Homo sapiens
guccuagaggcuccagcuc

SEQ ID NO: 1578323 - RNA, 17 nt, Homo sapiens
guccucacucccagucc

SEQ ID NO: 1578324 - RNA, 19 nt, Homo sapiens
guccucuggggccuucggg

SEQ ID NO: 1578325 - RNA, 13 nt, Homo sapiens
guccugccggugg

SEQ ID NO: 1578326 - RNA, 12 nt, Homo sapiens
guccuugaacaa

SEQ ID NO: 1578327 - RNA, 21 nt, Homo sapiens
guccuugugaguccaucuaac

SEQ ID NO: 1578328 - RNA, 16 nt, Homo sapiens
guccuuuuugucaugc

SEQ ID NO: 1578329 - RNA, 16 nt, Homo sapiens
gucgagauugcacugc

SEQ ID NO: 1578330 - RNA, 18 nt, Homo sapiens
gucggaucuacagaacaa

SEQ ID NO: 1578331 - RNA, 17 nt, Homo sapiens
gucguuuuccaaagagc

SEQ ID NO: 1578332 - RNA, 16 nt, Homo sapiens
gucuaaaaacauuugu

SEQ ID NO: 1578333 - RNA, 12 nt, Homo sapiens
gucuaacgcuga

SEQ ID NO: 1578334 - RNA, 17 nt, Homo sapiens
gucuacauacuuucauc

SEQ ID NO: 1578335 - RNA, 17 nt, Homo sapiens
gucuagacacaauuuca

SEQ ID NO: 1578336 - RNA, 15 nt, Homo sapiens
gucuaggagcuccuu

SEQ ID NO: 1578337 - RNA, 23 nt, Homo sapiens
gucuauaucauaacuauacuuga

SEQ ID NO: 1578338 - RNA, 14 nt, Homo sapiens
gucuaucaaaggua

SEQ ID NO: 1578339 - RNA, 15 nt, Homo sapiens
gucucagucauugcu

SEQ ID NO: 1578340 - RNA, 16 nt, Homo sapiens
gucucaguccaugaag

SEQ ID NO: 1578341 - RNA, 22 nt, Homo sapiens
gucucauuucucauaauuuugc

SEQ ID NO: 1578342 - RNA, 15 nt, Homo sapiens
gucucauuugggcua

SEQ ID NO: 1578343 - RNA, 17 nt, Homo sapiens
gucuccaaaacauuucu

SEQ ID NO: 1578344 - RNA, 16 nt, Homo sapiens
gucuccaccugagacc

SEQ ID NO: 1578345 - RNA, 20 nt, Homo sapiens
gucuccaugcucaccaagga

SEQ ID NO: 1578346 - RNA, 20 nt, Homo sapiens
gucuccucucagagugacag

SEQ ID NO: 1578347 - RNA, 18 nt, Homo sapiens
gucuccuggacucagggu

SEQ ID NO: 1578348 - RNA, 22 nt, Homo sapiens
gucucucuaguugaacccuggg

SEQ ID NO: 1578349 - RNA, 13 nt, Homo sapiens
gucucucuuggac

SEQ ID NO: 1578350 - RNA, 21 nt, Homo sapiens
gucucugccugcggcccagaa

SEQ ID NO: 1578351 - RNA, 14 nt, Homo sapiens
gucucugcugcuaa

SEQ ID NO: 1578352 - RNA, 19 nt, Homo sapiens
uaaaagagacaaacuguaa

SEQ ID NO: 1578353 - RNA, 17 nt, Homo sapiens
uaaaagcacaaguacuu

SEQ ID NO: 1578354 - RNA, 20 nt, Homo sapiens
uaaaagcacaaguacuuuug

SEQ ID NO: 1578355 - RNA, 13 nt, Homo sapiens
uaaaagcuaucuu

SEQ ID NO: 1578356 - RNA, 23 nt, Homo sapiens
uaaaaguacauguuaaacuuacu

SEQ ID NO: 1578357 - RNA, 16 nt, Homo sapiens
uaaaagucuccaaaac

SEQ ID NO: 1578358 - RNA, 17 nt, Homo sapiens
uaaaagucuccaaaaca

SEQ ID NO: 1578359 - RNA, 15 nt, Homo sapiens
uaaaagugcacauua

SEQ ID NO: 1578360 - RNA, 14 nt, Homo sapiens
uaaaaguugcaaag

SEQ ID NO: 1578361 - RNA, 16 nt, Homo sapiens
uaaaauaaaagacuau

SEQ ID NO: 1578362 - RNA, 18 nt, Homo sapiens
uaaaauaacuaagcaagu

SEQ ID NO: 1578363 - RNA, 20 nt, Homo sapiens
uaaaauaaguggauuuugua

SEQ ID NO: 1578364 - RNA, 14 nt, Homo sapiens
uaaaauaaguucuu

SEQ ID NO: 1578365 - RNA, 16 nt, Homo sapiens
uaaaauaaugaacacu

SEQ ID NO: 1578366 - RNA, 22 nt, Homo sapiens
uaaaauaauuauauaacuguau

SEQ ID NO: 1578367 - RNA, 22 nt, Homo sapiens
uaaaauagaaacauuuguaugg

SEQ ID NO: 1578368 - RNA, 22 nt, Homo sapiens
uaaaauauuuuguaaugcugca

SEQ ID NO: 1578369 - RNA, 16 nt, Homo sapiens
uaaaaugcacccauca

SEQ ID NO: 1578370 - RNA, 22 nt, Homo sapiens
uaaaaugcuccuagaagucuua

SEQ ID NO: 1578371 - RNA, 12 nt, Homo sapiens
uaaaaugcuuuu

SEQ ID NO: 1578372 - RNA, 12 nt, Homo sapiens
uaaaauggaaua

SEQ ID NO: 1578373 - RNA, 23 nt, Homo sapiens
uaaaaugugauuuuucuucaggu

SEQ ID NO: 1578374 - RNA, 12 nt, Homo sapiens
uaaaauucauuu

SEQ ID NO: 1578375 - RNA, 20 nt, Homo sapiens
uaaaauuccucuuacuguaa

SEQ ID NO: 1578376 - RNA, 19 nt, Homo sapiens
uaaaauugaagcaacuaca

SEQ ID NO: 1578377 - RNA, 14 nt, Homo sapiens
uaaaauugguauau

SEQ ID NO: 1578378 - RNA, 14 nt, Homo sapiens
uaaaauugugcaua

SEQ ID NO: 1578379 - RNA, 16 nt, Homo sapiens
uaaaauuuauuucacu

SEQ ID NO: 1578380 - RNA, 20 nt, Homo sapiens
uaaacaagucaaagacuugu

SEQ ID NO: 1578381 - RNA, 12 nt, Homo sapiens
uaaacacugugu

SEQ ID NO: 1578382 - RNA, 18 nt, Homo sapiens
uaaacagacaggaauuua

SEQ ID NO: 1578383 - RNA, 21 nt, Homo sapiens
uaaacagauuugauugugagg

SEQ ID NO: 1578384 - RNA, 19 nt, Homo sapiens
uaaacagguguuugccuua

SEQ ID NO: 1578385 - RNA, 21 nt, Homo sapiens
uaaacaguagugauaguugua

SEQ ID NO: 1578386 - RNA, 19 nt, Homo sapiens
uaaacaucuccccucucac

SEQ ID NO: 1578387 - RNA, 14 nt, Homo sapiens
uaaacaugcuugca

SEQ ID NO: 1578388 - RNA, 17 nt, Homo sapiens
uaaacauugaaguaaug

SEQ ID NO: 1578389 - RNA, 19 nt, Homo sapiens
uaaacauuuugacacaaaa

SEQ ID NO: 1578390 - RNA, 18 nt, Homo sapiens
uaaaccaaaaauuaugug

SEQ ID NO: 1578391 - RNA, 22 nt, Homo sapiens
uaaaccaaaaauuauguguugc

SEQ ID NO: 1578392 - RNA, 13 nt, Homo sapiens
uaaaccaguguga

SEQ ID NO: 1578393 - RNA, 13 nt, Homo sapiens
uaaacccucagag

SEQ ID NO: 1578394 - RNA, 19 nt, Homo sapiens
uaaaccuagaguuuuauca

SEQ ID NO: 1578395 - RNA, 21 nt, Homo sapiens
uaaaccuugaagggcuuuauu

SEQ ID NO: 1578396 - RNA, 21 nt, Homo sapiens
uaaacggcccaggccaggugc

SEQ ID NO: 1578397 - RNA, 14 nt, Homo sapiens
uaaacuacauuaua

SEQ ID NO: 1578398 - RNA, 23 nt, Homo sapiens
uaaacuacuauuuuucuuuccaa

SEQ ID NO: 1578399 - RNA, 19 nt, Homo sapiens
uaaacucagcuacugcaaa

SEQ ID NO: 1578400 - RNA, 12 nt, Homo sapiens
uaaacucucuuc

SEQ ID NO: 1578401 - RNA, 18 nt, Homo sapiens
uaaacugaaucuauggcu

SEQ ID NO: 1578402 - RNA, 21 nt, Homo sapiens
uaaacuuccaauuucuagcca

SEQ ID NO: 1578403 - RNA, 23 nt, Homo sapiens
uaaacuuguguauugagucuuaa

SEQ ID NO: 1578404 - RNA, 17 nt, Homo sapiens
uaaacuuucucugcaaa

SEQ ID NO: 1578405 - RNA, 20 nt, Homo sapiens
uaaagaaaaguuuaccaucu

SEQ ID NO: 1578406 - RNA, 14 nt, Homo sapiens
uaaagaauacuuga

SEQ ID NO: 1578407 - RNA, 21 nt, Homo sapiens
uaaagaaugcaaccuagucag

SEQ ID NO: 1578408 - RNA, 19 nt, Homo sapiens
uaaagacaaagacauuauu

SEQ ID NO: 1578409 - RNA, 13 nt, Homo sapiens
uaaagagcaaucc

SEQ ID NO: 1578410 - RNA, 12 nt, Homo sapiens
uaaagagccagu

SEQ ID NO: 1578411 - RNA, 17 nt, Homo sapiens
uaaagauguuuauuuca

SEQ ID NO: 1578412 - RNA, 17 nt, Homo sapiens
uaaagauuauugugacu

SEQ ID NO: 1578413 - RNA, 12 nt, Homo sapiens
uaaagauuuaua

SEQ ID NO: 1578414 - RNA, 16 nt, Homo sapiens
uaaagauuugcuucca

SEQ ID NO: 1578415 - RNA, 22 nt, Homo sapiens
uaaagauuuuuuaauaauuuag

SEQ ID NO: 1578416 - RNA, 15 nt, Homo sapiens
uaaagcauauuggug

SEQ ID NO: 1578417 - RNA, 18 nt, Homo sapiens
uaaagcauauuggugcua

SEQ ID NO: 1578418 - RNA, 13 nt, Homo sapiens
uaaagcaucaucu

SEQ ID NO: 1578419 - RNA, 14 nt, Homo sapiens
uaaagcaucaucug

SEQ ID NO: 1578420 - RNA, 12 nt, Homo sapiens
uaaaggcagcug

SEQ ID NO: 1578421 - RNA, 18 nt, Homo sapiens
uaaaggcagcugccucug

SEQ ID NO: 1578422 - RNA, 20 nt, Homo sapiens
uaaaggcagcugccucugcu

SEQ ID NO: 1578423 - RNA, 21 nt, Homo sapiens
uaaaggcagcugccucugcuc

SEQ ID NO: 1578424 - RNA, 16 nt, Homo sapiens
uaaaggcaguguuaca

SEQ ID NO: 1578425 - RNA, 15 nt, Homo sapiens
uaaaggcaguuuucu

SEQ ID NO: 1578426 - RNA, 21 nt, Homo sapiens
uaaagggcuucauuuuagucc

SEQ ID NO: 1578427 - RNA, 13 nt, Homo sapiens
uaaaggggguucu

SEQ ID NO: 1578428 - RNA, 17 nt, Homo sapiens
uaaagggucuuaugaaa

SEQ ID NO: 1578429 - RNA, 22 nt, Homo sapiens
uaaaguaaauuauuaagcagac

SEQ ID NO: 1578430 - RNA, 16 nt, Homo sapiens
uaaaguaugcauuauu

SEQ ID NO: 1578431 - RNA, 14 nt, Homo sapiens
uaaaguauguccuu

SEQ ID NO: 1578432 - RNA, 12 nt, Homo sapiens
uaaaguauucca

SEQ ID NO: 1578433 - RNA, 15 nt, Homo sapiens
uaaagucacacggcu

SEQ ID NO: 1578434 - RNA, 19 nt, Homo sapiens
uaaagucacaucccuguaa

SEQ ID NO: 1578435 - RNA, 14 nt, Homo sapiens
uaaagugguuuugu

SEQ ID NO: 1578436 - RNA, 20 nt, Homo sapiens
uaaagugucauccaagccau

SEQ ID NO: 1578437 - RNA, 20 nt, Homo sapiens
uaaaguuuguuauagucuau

SEQ ID NO: 1578438 - RNA, 21 nt, Homo sapiens
uaaaguuuuaggguacaguuu

SEQ ID NO: 1578439 - RNA, 16 nt, Homo sapiens
uaaaguuuugcaacaa

SEQ ID NO: 1578440 - RNA, 16 nt, Homo sapiens
uaaauaaaagcacaag

SEQ ID NO: 1578441 - RNA, 21 nt, Homo sapiens
uaaauaaaauucauuucuaca

SEQ ID NO: 1578442 - RNA, 21 nt, Homo sapiens
uaaauaaccggggauucugua

SEQ ID NO: 1578443 - RNA, 19 nt, Homo sapiens
uaaauaauuuaacuacccu

SEQ ID NO: 1578444 - RNA, 13 nt, Homo sapiens
uaaauacaaaagg

SEQ ID NO: 1578445 - RNA, 17 nt, Homo sapiens
uaaauacucagugauga

SEQ ID NO: 1578446 - RNA, 13 nt, Homo sapiens
uaaauacugucaa

SEQ ID NO: 1578447 - RNA, 16 nt, Homo sapiens
uaaauagagcaaccua

SEQ ID NO: 1578448 - RNA, 14 nt, Homo sapiens
uaaauagaugacaa

SEQ ID NO: 1578449 - RNA, 20 nt, Homo sapiens
uaaauagggaaaauaaucuc

SEQ ID NO: 1578450 - RNA, 21 nt, Homo sapiens
uaaauagggaaaauaaucuca

SEQ ID NO: 1578451 - RNA, 18 nt, Homo sapiens
uaaauaguuuaugauucc

SEQ ID NO: 1578452 - RNA, 13 nt, Homo sapiens
uaaauauaaacua

SEQ ID NO: 1578453 - RNA, 15 nt, Homo sapiens
uaaauauaucuaccc

SEQ ID NO: 1578454 - RNA, 23 nt, Homo sapiens
uaaaucauguugaucauguacuu

SEQ ID NO: 1578455 - RNA, 20 nt, Homo sapiens
uaaauccuugggagucauua

SEQ ID NO: 1578456 - RNA, 20 nt, Homo sapiens
uaaaucuaggaugugaugau

SEQ ID NO: 1578457 - RNA, 22 nt, Homo sapiens
uaaaugauuaaaaaaucagaga

SEQ ID NO: 1578458 - RNA, 17 nt, Homo sapiens
uaaaugauuauauucac

SEQ ID NO: 1578459 - RNA, 18 nt, Homo sapiens
uaaaugauuauauucaca

SEQ ID NO: 1578460 - RNA, 16 nt, Homo sapiens
uaaaugauuucauuca

SEQ ID NO: 1578461 - RNA, 14 nt, Homo sapiens
uaaauguauacuau

SEQ ID NO: 1578462 - RNA, 17 nt, Homo sapiens
uaaauguauacuauagu

SEQ ID NO: 1578463 - RNA, 14 nt, Homo sapiens
uaaaugugacucag

SEQ ID NO: 1578464 - RNA, 13 nt, Homo sapiens
uaaaugugagcaa

SEQ ID NO: 1578465 - RNA, 18 nt, Homo sapiens
uaaauguguuagcacuga

SEQ ID NO: 1578466 - RNA, 19 nt, Homo sapiens
uaaauguguuagcacugau

SEQ ID NO: 1578467 - RNA, 19 nt, Homo sapiens
uaaauguuaugacuaugua

SEQ ID NO: 1578468 - RNA, 19 nt, Homo sapiens
uaaauguuuguuuauauca

SEQ ID NO: 1578469 - RNA, 18 nt, Homo sapiens
uaaauuauaucugugaau

SEQ ID NO: 1578470 - RNA, 20 nt, Homo sapiens
uacuguugguuaaaugacaa

SEQ ID NO: 1578471 - RNA, 12 nt, Homo sapiens
uacuguuuccau

SEQ ID NO: 1578472 - RNA, 19 nt, Homo sapiens
uacuuaaaaauagucuucc

SEQ ID NO: 1578473 - RNA, 14 nt, Homo sapiens
uacuuaacauuuca

SEQ ID NO: 1578474 - RNA, 22 nt, Homo sapiens
uacuuaaguugucgaacaguag

SEQ ID NO: 1578475 - RNA, 14 nt, Homo sapiens
uacuuaaugcauau

SEQ ID NO: 1578476 - RNA, 15 nt, Homo sapiens
uacuuagaaugccau

SEQ ID NO: 1578477 - RNA, 17 nt, Homo sapiens
uacuuagagcagugaag

SEQ ID NO: 1578478 - RNA, 14 nt, Homo sapiens
uacuuagcaaaaag

SEQ ID NO: 1578479 - RNA, 19 nt, Homo sapiens
uacuuaggaaauacucagc

SEQ ID NO: 1578480 - RNA, 23 nt, Homo sapiens
uacuucucacuaauuuguaggaa

SEQ ID NO: 1578481 - RNA, 20 nt, Homo sapiens
uacuucucuuguuagguaau

SEQ ID NO: 1578482 - RNA, 16 nt, Homo sapiens
uacuucuugaauauaa

SEQ ID NO: 1578483 - RNA, 22 nt, Homo sapiens
uacuugaaacagucacuaucau

SEQ ID NO: 1578484 - RNA, 14 nt, Homo sapiens
uacuugccaagaaa

SEQ ID NO: 1578485 - RNA, 22 nt, Homo sapiens
uacuuuacaaaccauuaccugu

SEQ ID NO: 1578486 - RNA, 21 nt, Homo sapiens
uacuuugaagucauaccaaug

SEQ ID NO: 1578487 - RNA, 15 nt, Homo sapiens
uacuuuguuaggauu

SEQ ID NO: 1578488 - RNA, 16 nt, Homo sapiens
uacuuuucugccaaaa

SEQ ID NO: 1578489 - RNA, 13 nt, Homo sapiens
uacuuuugcuuca

SEQ ID NO: 1578490 - RNA, 20 nt, Homo sapiens
uagaaaagcaaagggugcua

SEQ ID NO: 1578491 - RNA, 14 nt, Homo sapiens
uagaaaaugaggaa

SEQ ID NO: 1578492 - RNA, 19 nt, Homo sapiens
uagaaaauuagacugugau

SEQ ID NO: 1578493 - RNA, 20 nt, Homo sapiens
uagaaagaaggacccagaac

SEQ ID NO: 1578494 - RNA, 22 nt, Homo sapiens
uagaaagacuacauguuacuaa

SEQ ID NO: 1578495 - RNA, 13 nt, Homo sapiens
uagaaagaugaca

SEQ ID NO: 1578496 - RNA, 20 nt, Homo sapiens
uagaaagugaggcucagauu

SEQ ID NO: 1578497 - RNA, 12 nt, Homo sapiens
uagaaaugaaca

SEQ ID NO: 1578498 - RNA, 14 nt, Homo sapiens
uagaaccacagcag

SEQ ID NO: 1578499 - RNA, 22 nt, Homo sapiens
uagaaccucucguaguccauca

SEQ ID NO: 1578500 - RNA, 17 nt, Homo sapiens
uagaacugucugugaac

SEQ ID NO: 1578501 - RNA, 19 nt, Homo sapiens
uagaacuucauggaucaga

SEQ ID NO: 1578502 - RNA, 13 nt, Homo sapiens
uagaagacaauuu

SEQ ID NO: 1578503 - RNA, 16 nt, Homo sapiens
uagaagagucuauugu

SEQ ID NO: 1578504 - RNA, 22 nt, Homo sapiens
uagaagccacuauuacugggac

SEQ ID NO: 1578505 - RNA, 15 nt, Homo sapiens
uagaauaaauuccca

SEQ ID NO: 1578506 - RNA, 11 nt, Homo sapiens
uagaauaccac

SEQ ID NO: 1578507 - RNA, 12 nt, Homo sapiens
uagaaucuggag

SEQ ID NO: 1578508 - RNA, 18 nt, Homo sapiens
uagaaugagacuuacuuc

SEQ ID NO: 1578509 - RNA, 20 nt, Homo sapiens
uagaauguugaaaaguaauu

SEQ ID NO: 1578510 - RNA, 16 nt, Homo sapiens
uagaauuaacacauga

SEQ ID NO: 1578511 - RNA, 20 nt, Homo sapiens
uagaauucacugaguuuugu

SEQ ID NO: 1578512 - RNA, 16 nt, Homo sapiens
uagaauugaccaaaua

SEQ ID NO: 1578513 - RNA, 12 nt, Homo sapiens
uagaauugcauu

SEQ ID NO: 1578514 - RNA, 15 nt, Homo sapiens
uagacaaacagcauc

SEQ ID NO: 1578515 - RNA, 20 nt, Homo sapiens
uagacaaaccaucuccuccu

SEQ ID NO: 1578516 - RNA, 16 nt, Homo sapiens
uagacagaguugcuua

SEQ ID NO: 1578517 - RNA, 14 nt, Homo sapiens
uagacagugcccuu

SEQ ID NO: 1578518 - RNA, 21 nt, Homo sapiens
uagacgucucacucaaagaca

SEQ ID NO: 1578519 - RNA, 13 nt, Homo sapiens
uagacugugccag

SEQ ID NO: 1578520 - RNA, 18 nt, Homo sapiens
uagagaaggcugugagcc

SEQ ID NO: 1578521 - RNA, 14 nt, Homo sapiens
uagagaugagccca

SEQ ID NO: 1578522 - RNA, 19 nt, Homo sapiens
uagagaugguuucuacugg

SEQ ID NO: 1578523 - RNA, 18 nt, Homo sapiens
uagagauuaccuccugag

SEQ ID NO: 1578524 - RNA, 16 nt, Homo sapiens
uagagcuagauguguc

SEQ ID NO: 1578525 - RNA, 19 nt, Homo sapiens
uagagcuagaugugucuua

SEQ ID NO: 1578526 - RNA, 20 nt, Homo sapiens
uagagcuagaugugucuuac

SEQ ID NO: 1578527 - RNA, 22 nt, Homo sapiens
uagagcuagaugugucuuacca

SEQ ID NO: 1578528 - RNA, 14 nt, Homo sapiens
uagagcugcucagc

SEQ ID NO: 1578529 - RNA, 23 nt, Homo sapiens
uagaggaauccauguaaauugca

SEQ ID NO: 1578530 - RNA, 18 nt, Homo sapiens
uagaggcugggggcucca

SEQ ID NO: 1578531 - RNA, 20 nt, Homo sapiens
uagaggggucucaugucucc

SEQ ID NO: 1578532 - RNA, 13 nt, Homo sapiens
uagaguaacacau

SEQ ID NO: 1578533 - RNA, 16 nt, Homo sapiens
uagaguaacacauaac

SEQ ID NO: 1578534 - RNA, 20 nt, Homo sapiens
uagagucggccaccacagau

SEQ ID NO: 1578535 - RNA, 20 nt, Homo sapiens
uagagucuagaacacaauuu

SEQ ID NO: 1578536 - RNA, 17 nt, Homo sapiens
uagaguuucuguuugau

SEQ ID NO: 1578537 - RNA, 20 nt, Homo sapiens
uagaguuuuaucaacuuugg

SEQ ID NO: 1578538 - RNA, 20 nt, Homo sapiens
uagauaaagauuucuaguag

SEQ ID NO: 1578539 - RNA, 22 nt, Homo sapiens
uagauaauuuauuauacaccuu

SEQ ID NO: 1578540 - RNA, 22 nt, Homo sapiens
uagauacucucuucuucucaua

SEQ ID NO: 1578541 - RNA, 13 nt, Homo sapiens
uagaucuuauauu

SEQ ID NO: 1578542 - RNA, 19 nt, Homo sapiens
uagaugcacguggggccca

SEQ ID NO: 1578543 - RNA, 15 nt, Homo sapiens
uagaugguuacacug

SEQ ID NO: 1578544 - RNA, 13 nt, Homo sapiens
uagaugugucuua

SEQ ID NO: 1578545 - RNA, 14 nt, Homo sapiens
uagaugugucuuac

SEQ ID NO: 1578546 - RNA, 16 nt, Homo sapiens
uagaugugucuuacca

SEQ ID NO: 1578547 - RNA, 15 nt, Homo sapiens
uagauuaauacucua

SEQ ID NO: 1578548 - RNA, 17 nt, Homo sapiens
uagauuuccacacgcca

SEQ ID NO: 1578549 - RNA, 17 nt, Homo sapiens
uagauuucgaagccaca

SEQ ID NO: 1578550 - RNA, 21 nt, Homo sapiens
uagauuuuuucagacuuguca

SEQ ID NO: 1578551 - RNA, 20 nt, Homo sapiens
uagcaaaauacaugacauuu

SEQ ID NO: 1578552 - RNA, 16 nt, Homo sapiens
uagcaaauguuuacug

SEQ ID NO: 1578553 - RNA, 19 nt, Homo sapiens
uagcaaggcauaauguaau

SEQ ID NO: 1578554 - RNA, 14 nt, Homo sapiens
uagcaaugugccuu

SEQ ID NO: 1578555 - RNA, 20 nt, Homo sapiens
uagcacuggccugcacggug

SEQ ID NO: 1578556 - RNA, 20 nt, Homo sapiens
uagcagaguuaaaucucaaa

SEQ ID NO: 1578557 - RNA, 21 nt, Homo sapiens
uagcagcagauguaguuucag

SEQ ID NO: 1578558 - RNA, 21 nt, Homo sapiens
uagcagcaggcucaggcacau

SEQ ID NO: 1578559 - RNA, 22 nt, Homo sapiens
uagcagcaggcucaggcacaua

SEQ ID NO: 1578560 - RNA, 20 nt, Homo sapiens
uagcaguucugcaaauagaa

SEQ ID NO: 1578561 - RNA, 14 nt, Homo sapiens
uagcauccacugau

SEQ ID NO: 1578562 - RNA, 14 nt, Homo sapiens
uagcauguuccucc

SEQ ID NO: 1578563 - RNA, 17 nt, Homo sapiens
uagccaacucucccaaa

SEQ ID NO: 1578564 - RNA, 21 nt, Homo sapiens
uagccacagcugcuguucuca

SEQ ID NO: 1578565 - RNA, 18 nt, Homo sapiens
uagccagcugugcacuuu

SEQ ID NO: 1578566 - RNA, 19 nt, Homo sapiens
uagccagcugugcacuuuc

SEQ ID NO: 1578567 - RNA, 17 nt, Homo sapiens
uagccaggcuaucuggc

SEQ ID NO: 1578568 - RNA, 19 nt, Homo sapiens
uagccauaucagggguaca

SEQ ID NO: 1578569 - RNA, 18 nt, Homo sapiens
uagcccauaaggggucaa

SEQ ID NO: 1578570 - RNA, 17 nt, Homo sapiens
uagccucaguacuggug

SEQ ID NO: 1578571 - RNA, 15 nt, Homo sapiens
uagccuuugucccag

SEQ ID NO: 1578572 - RNA, 15 nt, Homo sapiens
uagcgccucuuuuau

SEQ ID NO: 1578573 - RNA, 20 nt, Homo sapiens
uagcgcugccgcaccccaga

SEQ ID NO: 1578574 - RNA, 18 nt, Homo sapiens
uagcuaguagcaaugugc

SEQ ID NO: 1578575 - RNA, 18 nt, Homo sapiens
uagcucacugcagccuca

SEQ ID NO: 1578576 - RNA, 14 nt, Homo sapiens
uagcugacuugcac

SEQ ID NO: 1578577 - RNA, 15 nt, Homo sapiens
uagcugagaagcaau

SEQ ID NO: 1578578 - RNA, 14 nt, Homo sapiens
uagcugcaucuaua

SEQ ID NO: 1578579 - RNA, 16 nt, Homo sapiens
uagcugggacuacagg

SEQ ID NO: 1578580 - RNA, 18 nt, Homo sapiens
uagcugggauuacaggcg

SEQ ID NO: 1578581 - RNA, 23 nt, Homo sapiens
uagcugguucacacugaccaaga

SEQ ID NO: 1578582 - RNA, 11 nt, Homo sapiens
uagcuguucua

SEQ ID NO: 1578583 - RNA, 21 nt, Homo sapiens
uagcuguuucaaaugugcauu

SEQ ID NO: 1578584 - RNA, 15 nt, Homo sapiens
uagcuuaaguguaaa

SEQ ID NO: 1578585 - RNA, 21 nt, Homo sapiens
uagcuuagcuaugucagccaa

SEQ ID NO: 1578586 - RNA, 22 nt, Homo sapiens
uagcuucugcuuuucugcccug

SEQ ID NO: 1578587 - RNA, 19 nt, Homo sapiens
uagcuuuagaaacagugca

SEQ ID NO: 1578588 - RNA, 19 nt, Homo sapiens
ucaaauuuagaaacuaauu

SEQ ID NO: 1578589 - RNA, 21 nt, Homo sapiens
ucaaauuuuggcgaaucucaa

SEQ ID NO: 1578590 - RNA, 14 nt, Homo sapiens
ucaacaagauuucc

SEQ ID NO: 1578591 - RNA, 16 nt, Homo sapiens
ucaacaccacuaggaa

SEQ ID NO: 1578592 - RNA, 20 nt, Homo sapiens
ucaacagaaacuaaaugaac

SEQ ID NO: 1578593 - RNA, 22 nt, Homo sapiens
ucaacagagggaguuuaauaca

SEQ ID NO: 1578594 - RNA, 22 nt, Homo sapiens
ucaacagcauuuucaagcaguu

SEQ ID NO: 1578595 - RNA, 21 nt, Homo sapiens
ucaacaugacauccagagaug

SEQ ID NO: 1578596 - RNA, 13 nt, Homo sapiens
ucaacauuucuca

SEQ ID NO: 1578597 - RNA, 17 nt, Homo sapiens
ucaacauuucucaauaa

SEQ ID NO: 1578598 - RNA, 15 nt, Homo sapiens
ucaaccaauguagaa

SEQ ID NO: 1578599 - RNA, 21 nt, Homo sapiens
ucaaccugguggcaccagaug

SEQ ID NO: 1578600 - RNA, 16 nt, Homo sapiens
ucaacgaugugacugc

SEQ ID NO: 1578601 - RNA, 18 nt, Homo sapiens
ucaacgaugugacugcca

SEQ ID NO: 1578602 - RNA, 23 nt, Homo sapiens
ucaacuguuucagaaaacauaau

SEQ ID NO: 1578603 - RNA, 21 nt, Homo sapiens
ucaacuuaccaggcaccaaaa

SEQ ID NO: 1578604 - RNA, 19 nt, Homo sapiens
ucaagaagaggaaagggag

SEQ ID NO: 1578605 - RNA, 22 nt, Homo sapiens
ucaagaaucuagaagaugugua

SEQ ID NO: 1578606 - RNA, 21 nt, Homo sapiens
ucaagacgucacccuccauuc

SEQ ID NO: 1578607 - RNA, 14 nt, Homo sapiens
ucaagauauggaag

SEQ ID NO: 1578608 - RNA, 14 nt, Homo sapiens
ucaagcacacugga

SEQ ID NO: 1578609 - RNA, 23 nt, Homo sapiens
ucaagccuccccaguucuacuga

SEQ ID NO: 1578610 - RNA, 19 nt, Homo sapiens
ucaagcuguugaagucuca

SEQ ID NO: 1578611 - RNA, 16 nt, Homo sapiens
ucaaggaaaaguucuu

SEQ ID NO: 1578612 - RNA, 21 nt, Homo sapiens
ucaaggacagccaccaagaag

SEQ ID NO: 1578613 - RNA, 14 nt, Homo sapiens
ucaaggguuuucca

SEQ ID NO: 1578614 - RNA, 14 nt, Homo sapiens
ucaaguaccaaaac

SEQ ID NO: 1578615 - RNA, 16 nt, Homo sapiens
ucaaguaccaccaagg

SEQ ID NO: 1578616 - RNA, 21 nt, Homo sapiens
ucaaguauuuuugacauuuac

SEQ ID NO: 1578617 - RNA, 13 nt, Homo sapiens
ucaagucaaggaa

SEQ ID NO: 1578618 - RNA, 18 nt, Homo sapiens
ucaagucuaaaccaagau

SEQ ID NO: 1578619 - RNA, 20 nt, Homo sapiens
ucaaguugugcuuguuuaca

SEQ ID NO: 1578620 - RNA, 22 nt, Homo sapiens
ucaaguuuuuuauacugcacuu

SEQ ID NO: 1578621 - RNA, 13 nt, Homo sapiens
ucaauaaaccaca

SEQ ID NO: 1578622 - RNA, 18 nt, Homo sapiens
ucaauaaaccacaagcau

SEQ ID NO: 1578623 - RNA, 18 nt, Homo sapiens
ucaauaauauauuuucug

SEQ ID NO: 1578624 - RNA, 16 nt, Homo sapiens
ucaauacacaguacuu

SEQ ID NO: 1578625 - RNA, 13 nt, Homo sapiens
ucaauaguggcau

SEQ ID NO: 1578626 - RNA, 18 nt, Homo sapiens
ucaauaguggcauaccaa

SEQ ID NO: 1578627 - RNA, 20 nt, Homo sapiens
ucaauaguguccuaugcaau

SEQ ID NO: 1578628 - RNA, 21 nt, Homo sapiens
ucaauaguguccuaugcaaua

SEQ ID NO: 1578629 - RNA, 12 nt, Homo sapiens
ucaauccagcua

SEQ ID NO: 1578630 - RNA, 16 nt, Homo sapiens
ucaaucugcaguuuaa

SEQ ID NO: 1578631 - RNA, 16 nt, Homo sapiens
ucaaugguagcauuua

SEQ ID NO: 1578632 - RNA, 16 nt, Homo sapiens
ucaauguccuacugag

SEQ ID NO: 1578633 - RNA, 22 nt, Homo sapiens
ucaaugugucuuucuaagaaau

SEQ ID NO: 1578634 - RNA, 20 nt, Homo sapiens
ucaauuauacuaaaccucac

SEQ ID NO: 1578635 - RNA, 15 nt, Homo sapiens
ucaauuccugugauu

SEQ ID NO: 1578636 - RNA, 21 nt, Homo sapiens
ucaauuuaaaaaaaaaccuga

SEQ ID NO: 1578637 - RNA, 18 nt, Homo sapiens
ucaauuuauuacugaaaa

SEQ ID NO: 1578638 - RNA, 14 nt, Homo sapiens
ucaauuucuacuuc

SEQ ID NO: 1578639 - RNA, 17 nt, Homo sapiens
ucaauuucucugaggac

SEQ ID NO: 1578640 - RNA, 19 nt, Homo sapiens
ucaauuucucugaggacac

SEQ ID NO: 1578641 - RNA, 14 nt, Homo sapiens
ucacaaaaugcacu

SEQ ID NO: 1578642 - RNA, 10 nt, Homo sapiens
ucacaaagug

SEQ ID NO: 1578643 - RNA, 16 nt, Homo sapiens
ucacaaauccuucaaa

SEQ ID NO: 1578644 - RNA, 23 nt, Homo sapiens
ucacaaaucuuaacuugaaggag

SEQ ID NO: 1578645 - RNA, 14 nt, Homo sapiens
ucacaacagucacc

SEQ ID NO: 1578646 - RNA, 18 nt, Homo sapiens
ucacaacagucaccucac

SEQ ID NO: 1578647 - RNA, 17 nt, Homo sapiens
ucacaacucuucuuucc

SEQ ID NO: 1578648 - RNA, 17 nt, Homo sapiens
ucacacagauagaccuu

SEQ ID NO: 1578649 - RNA, 20 nt, Homo sapiens
ucacacaguucaacauaaag

SEQ ID NO: 1578650 - RNA, 21 nt, Homo sapiens
ucacacauccugucaguguca

SEQ ID NO: 1578651 - RNA, 11 nt, Homo sapiens
ucacaccagcc

SEQ ID NO: 1578652 - RNA, 20 nt, Homo sapiens
ucacacggcuugugggcacu

SEQ ID NO: 1578653 - RNA, 11 nt, Homo sapiens
ucacacuguau

SEQ ID NO: 1578654 - RNA, 19 nt, Homo sapiens
ucacagaauuuaagcaaga

SEQ ID NO: 1578655 - RNA, 12 nt, Homo sapiens
ucacagaggcau

SEQ ID NO: 1578656 - RNA, 23 nt, Homo sapiens
ucacagagugagacuccaucuca

SEQ ID NO: 1578657 - RNA, 20 nt, Homo sapiens
ucacagcaagucacuggcca

SEQ ID NO: 1578658 - RNA, 21 nt, Homo sapiens
ucacagccacaccuggacuga

SEQ ID NO: 1578659 - RNA, 23 nt, Homo sapiens
ucacaggaaguagaggaggccac

SEQ ID NO: 1578660 - RNA, 20 nt, Homo sapiens
ucacaggcauauucccugca

SEQ ID NO: 1578661 - RNA, 18 nt, Homo sapiens
ucacaguaaagaguacac

SEQ ID NO: 1578662 - RNA, 12 nt, Homo sapiens
ucacaguugugu

SEQ ID NO: 1578663 - RNA, 22 nt, Homo sapiens
ucacauccuaccccuuugcacu

SEQ ID NO: 1578664 - RNA, 17 nt, Homo sapiens
ucacaucuuaaauucau

SEQ ID NO: 1578665 - RNA, 15 nt, Homo sapiens
ucacaugccacaaau

SEQ ID NO: 1578666 - RNA, 20 nt, Homo sapiens
ucacaugcuuuagccauaca

SEQ ID NO: 1578667 - RNA, 15 nt, Homo sapiens
ucacauguccauuau

SEQ ID NO: 1578668 - RNA, 23 nt, Homo sapiens
ucacauuccaagccucaugucca

SEQ ID NO: 1578669 - RNA, 15 nt, Homo sapiens
ucacauucuuuccaa

SEQ ID NO: 1578670 - RNA, 19 nt, Homo sapiens
ucacauugcacucaucaua

SEQ ID NO: 1578671 - RNA, 19 nt, Homo sapiens
ucaccaagcuaggugcuau

SEQ ID NO: 1578672 - RNA, 21 nt, Homo sapiens
ucaccaagcuaggugcuauuu

SEQ ID NO: 1578673 - RNA, 13 nt, Homo sapiens
ucaccaaggcuga

SEQ ID NO: 1578674 - RNA, 14 nt, Homo sapiens
ucaccaagugcaau

SEQ ID NO: 1578675 - RNA, 16 nt, Homo sapiens
ucaccagagacuuuag

SEQ ID NO: 1578676 - RNA, 14 nt, Homo sapiens
ucaccagcccugaa

SEQ ID NO: 1578677 - RNA, 13 nt, Homo sapiens
ucaccauguugcc

SEQ ID NO: 1578678 - RNA, 12 nt, Homo sapiens
ucaccauguugg

SEQ ID NO: 1578679 - RNA, 22 nt, Homo sapiens
ucaccauugcugucaaguuccu

SEQ ID NO: 1578680 - RNA, 22 nt, Homo sapiens
ucaccauuucuuggcauuggaa

SEQ ID NO: 1578681 - RNA, 23 nt, Homo sapiens
ucaccauuuggcaaugccaucau

SEQ ID NO: 1578682 - RNA, 13 nt, Homo sapiens
ucacccaaaacaa

SEQ ID NO: 1578683 - RNA, 13 nt, Homo sapiens
ucacccaaccuga

SEQ ID NO: 1578684 - RNA, 14 nt, Homo sapiens
ucacccaacucaag

SEQ ID NO: 1578685 - RNA, 16 nt, Homo sapiens
ucacccaucaaaagca

SEQ ID NO: 1578686 - RNA, 17 nt, Homo sapiens
ucaccccccacacucac

SEQ ID NO: 1578687 - RNA, 22 nt, Homo sapiens
ucacccccucgggucuccucac

SEQ ID NO: 1578688 - RNA, 18 nt, Homo sapiens
ucaccccugguucucauc

SEQ ID NO: 1578689 - RNA, 14 nt, Homo sapiens
ucacccucaugaaa

SEQ ID NO: 1578690 - RNA, 12 nt, Homo sapiens
ucacccugcuac

SEQ ID NO: 1578691 - RNA, 18 nt, Homo sapiens
ucacccuuccgacaggag

SEQ ID NO: 1578692 - RNA, 18 nt, Homo sapiens
ucaccggucagugccuuu

SEQ ID NO: 1578693 - RNA, 15 nt, Homo sapiens
ucaccuccucuguga

SEQ ID NO: 1578694 - RNA, 14 nt, Homo sapiens
ucaccucugucagc

SEQ ID NO: 1578695 - RNA, 12 nt, Homo sapiens
ucaccugagguc

SEQ ID NO: 1578696 - RNA, 21 nt, Homo sapiens
ucaccuggacuuaagcaucug

SEQ ID NO: 1578697 - RNA, 18 nt, Homo sapiens
ucaccuguaaaacuuuau

SEQ ID NO: 1578698 - RNA, 16 nt, Homo sapiens
ucaccuguaaaccuga

SEQ ID NO: 1578699 - RNA, 14 nt, Homo sapiens
ucacgaacuugaaa

SEQ ID NO: 1578700 - RNA, 15 nt, Homo sapiens
ucacgcagugcuuuc

SEQ ID NO: 1578701 - RNA, 21 nt, Homo sapiens
ucacgccauuguacuccagcc

SEQ ID NO: 1578702 - RNA, 20 nt, Homo sapiens
ucacuaaaacacacaggugc

SEQ ID NO: 1578703 - RNA, 13 nt, Homo sapiens
ucacuaaaaucag

SEQ ID NO: 1578704 - RNA, 19 nt, Homo sapiens
ucacuaaugaucacauucu

SEQ ID NO: 1578705 - RNA, 12 nt, Homo sapiens
ucacuacaggug

SEQ ID NO: 1578706 - RNA, 16 nt, Homo sapiens
ugcccccgagcugcuc

SEQ ID NO: 1578707 - RNA, 20 nt, Homo sapiens
ugcccccgcggguucuagac

SEQ ID NO: 1578708 - RNA, 13 nt, Homo sapiens
ugccccuucuuau

SEQ ID NO: 1578709 - RNA, 15 nt, Homo sapiens
ugcccggccaaguaa

SEQ ID NO: 1578710 - RNA, 19 nt, Homo sapiens
ugcccuaggauacccagau

SEQ ID NO: 1578711 - RNA, 24 nt, Homo sapiens
ugcccuccaaauguccuuucucag

SEQ ID NO: 1578712 - RNA, 15 nt, Homo sapiens
ugcccucuagagccu

SEQ ID NO: 1578713 - RNA, 19 nt, Homo sapiens
ugcccuguaccugugcacg

SEQ ID NO: 1578714 - RNA, 13 nt, Homo sapiens
ugcccuuaggcca

SEQ ID NO: 1578715 - RNA, 16 nt, Homo sapiens
ugccgacacugagcug

SEQ ID NO: 1578716 - RNA, 19 nt, Homo sapiens
ugccgcuggaggccaccaa

SEQ ID NO: 1578717 - RNA, 17 nt, Homo sapiens
ugccggcucuaguaccu

SEQ ID NO: 1578718 - RNA, 12 nt, Homo sapiens
ugccuaccuggg

SEQ ID NO: 1578719 - RNA, 20 nt, Homo sapiens
ugccuauagucccacuacuu

SEQ ID NO: 1578720 - RNA, 21 nt, Homo sapiens
ugccucaacccaaggggauuu

SEQ ID NO: 1578721 - RNA, 16 nt, Homo sapiens
ugccucagaagugcau

SEQ ID NO: 1578722 - RNA, 22 nt, Homo sapiens
ugccucagccaggcccugagau

SEQ ID NO: 1578723 - RNA, 18 nt, Homo sapiens
ugccucagccucccgagu

SEQ ID NO: 1578724 - RNA, 23 nt, Homo sapiens
ugccuccaaguucaaaacuuauu

SEQ ID NO: 1578725 - RNA, 16 nt, Homo sapiens
ugccuccagugcaguc

SEQ ID NO: 1578726 - RNA, 21 nt, Homo sapiens
ugccuccagugcaguccauuu

SEQ ID NO: 1578727 - RNA, 16 nt, Homo sapiens
ugccucccacuucacu

SEQ ID NO: 1578728 - RNA, 19 nt, Homo sapiens
ugccucccagguuccagca

SEQ ID NO: 1578729 - RNA, 22 nt, Homo sapiens
ugccucccccgccuccagucau

SEQ ID NO: 1578730 - RNA, 20 nt, Homo sapiens
ugccucgaggggcccaggga

SEQ ID NO: 1578731 - RNA, 23 nt, Homo sapiens
ugccucucuuuuugggcuuucau

SEQ ID NO: 1578732 - RNA, 19 nt, Homo sapiens
ugccucuucuacuuguaaa

SEQ ID NO: 1578733 - RNA, 20 nt, Homo sapiens
ugccucuucuuugugccuuu

SEQ ID NO: 1578734 - RNA, 17 nt, Homo sapiens
ugccugacucagugacc

SEQ ID NO: 1578735 - RNA, 15 nt, Homo sapiens
ugccugagaacacca

SEQ ID NO: 1578736 - RNA, 19 nt, Homo sapiens
ugccugcaaaaaugaaauc

SEQ ID NO: 1578737 - RNA, 14 nt, Homo sapiens
ugccuggacacugu

SEQ ID NO: 1578738 - RNA, 15 nt, Homo sapiens
ugccuggacacugua

SEQ ID NO: 1578739 - RNA, 22 nt, Homo sapiens
ugccuggagucuuguguucacc

SEQ ID NO: 1578740 - RNA, 14 nt, Homo sapiens
ugccuggccuuuau

SEQ ID NO: 1578741 - RNA, 22 nt, Homo sapiens
ugccugggagaguggaccugug

SEQ ID NO: 1578742 - RNA, 18 nt, Homo sapiens
ugccuguaaucccaacac

SEQ ID NO: 1578743 - RNA, 20 nt, Homo sapiens
ugccuguaaucucagcacuu

SEQ ID NO: 1578744 - RNA, 16 nt, Homo sapiens
ugccuguuaauuuaua

SEQ ID NO: 1578745 - RNA, 18 nt, Homo sapiens
ugccuucuaggucacuuc

SEQ ID NO: 1578746 - RNA, 17 nt, Homo sapiens
ugccuucucaccagcug

SEQ ID NO: 1578747 - RNA, 14 nt, Homo sapiens
ugccuucucaggaa

SEQ ID NO: 1578748 - RNA, 14 nt, Homo sapiens
ugccuucuggccuu

SEQ ID NO: 1578749 - RNA, 23 nt, Homo sapiens
ugccuuggaggaaaugugcucaa

SEQ ID NO: 1578750 - RNA, 18 nt, Homo sapiens
ugccuuuaaaucugugau

SEQ ID NO: 1578751 - RNA, 19 nt, Homo sapiens
ugccuuuauuuccacugug

SEQ ID NO: 1578752 - RNA, 16 nt, Homo sapiens
ugcgaauaacaguccc

SEQ ID NO: 1578753 - RNA, 15 nt, Homo sapiens
ugcgagggaagcaau

SEQ ID NO: 1578754 - RNA, 14 nt, Homo sapiens
ugcggaaugcauug

SEQ ID NO: 1578755 - RNA, 19 nt, Homo sapiens
ugcggacagcccuuccucc

SEQ ID NO: 1578756 - RNA, 20 nt, Homo sapiens
ugcggacagcccuuccuccc

SEQ ID NO: 1578757 - RNA, 22 nt, Homo sapiens
ugcggcaaaaggaaagcugugu

SEQ ID NO: 1578758 - RNA, 17 nt, Homo sapiens
ugcggccucugagacau

SEQ ID NO: 1578759 - RNA, 17 nt, Homo sapiens
ugcgggggugaugugaa

SEQ ID NO: 1578760 - RNA, 22 nt, Homo sapiens
ugcgugaaguaggcauauauca

SEQ ID NO: 1578761 - RNA, 15 nt, Homo sapiens
ugcuaaaaaagcaua

SEQ ID NO: 1578762 - RNA, 17 nt, Homo sapiens
ugcuaaaagcauguaua

SEQ ID NO: 1578763 - RNA, 13 nt, Homo sapiens
ugcuaaggcagcu

SEQ ID NO: 1578764 - RNA, 16 nt, Homo sapiens
ugcuaaggcagcugau

SEQ ID NO: 1578765 - RNA, 17 nt, Homo sapiens
ugcuaaguaauuuagaa

SEQ ID NO: 1578766 - RNA, 13 nt, Homo sapiens
ugcuaagugaaau

SEQ ID NO: 1578767 - RNA, 18 nt, Homo sapiens
ugcuaagugcuuauuaca

SEQ ID NO: 1578768 - RNA, 21 nt, Homo sapiens
ugcuaauggaauuacugccuu

SEQ ID NO: 1578769 - RNA, 17 nt, Homo sapiens
ugcuacaaaaacacagc

SEQ ID NO: 1578770 - RNA, 17 nt, Homo sapiens
ugcuacacauacaggau

SEQ ID NO: 1578771 - RNA, 23 nt, Homo sapiens
ugcuacaugacgacaaagcugcu

SEQ ID NO: 1578772 - RNA, 23 nt, Homo sapiens
ugcuaggaggugugggugccuuc

SEQ ID NO: 1578773 - RNA, 14 nt, Homo sapiens
ugcuaggucucgga

SEQ ID NO: 1578774 - RNA, 23 nt, Homo sapiens
ugcuagugggcccucucucuggg

SEQ ID NO: 1578775 - RNA, 21 nt, Homo sapiens
ugcuauccccaucucccugcc

SEQ ID NO: 1578776 - RNA, 13 nt, Homo sapiens
ugcuauguucugg

SEQ ID NO: 1578777 - RNA, 19 nt, Homo sapiens
ugcuauuguagagccagag

SEQ ID NO: 1578778 - RNA, 15 nt, Homo sapiens
ugcuauuugucaucu

SEQ ID NO: 1578779 - RNA, 15 nt, Homo sapiens
ugcucaaaaucuuuc

SEQ ID NO: 1578780 - RNA, 16 nt, Homo sapiens
ugcucaaaaucuuucc

SEQ ID NO: 1578781 - RNA, 17 nt, Homo sapiens
ugcucaaaaucuuucca

SEQ ID NO: 1578782 - RNA, 22 nt, Homo sapiens
ugcucaaccccccucccagaca

SEQ ID NO: 1578783 - RNA, 17 nt, Homo sapiens
ugcucacguuaccuuga

SEQ ID NO: 1578784 - RNA, 18 nt, Homo sapiens
ugcucaggagccaccagc

SEQ ID NO: 1578785 - RNA, 19 nt, Homo sapiens
ugcucagucccuacugagu

SEQ ID NO: 1578786 - RNA, 17 nt, Homo sapiens
ugcucaguuggugcugc

SEQ ID NO: 1578787 - RNA, 18 nt, Homo sapiens
ugcucaguuggugcugcu

SEQ ID NO: 1578788 - RNA, 20 nt, Homo sapiens
ugcucaguuggugcugcuuu

SEQ ID NO: 1578789 - RNA, 18 nt, Homo sapiens
ugcucauguauauuuagu

SEQ ID NO: 1578790 - RNA, 15 nt, Homo sapiens
ugcucccaugcucau

SEQ ID NO: 1578791 - RNA, 18 nt, Homo sapiens
ugcucccccugguggugg

SEQ ID NO: 1578792 - RNA, 13 nt, Homo sapiens
ugcuccugcugau

SEQ ID NO: 1578793 - RNA, 14 nt, Homo sapiens
ugcuccugugcuca

SEQ ID NO: 1578794 - RNA, 19 nt, Homo sapiens
ugcuccuugggcccuuuga

SEQ ID NO: 1578795 - RNA, 18 nt, Homo sapiens
ugcucuccuccaccucaa

SEQ ID NO: 1578796 - RNA, 22 nt, Homo sapiens
ugcucucuucuccccacugugc

SEQ ID NO: 1578797 - RNA, 17 nt, Homo sapiens
ugcucugaccuuccaga

SEQ ID NO: 1578798 - RNA, 13 nt, Homo sapiens
ugcucugccucag

SEQ ID NO: 1578799 - RNA, 21 nt, Homo sapiens
ugcucuggucugugggucagu

SEQ ID NO: 1578800 - RNA, 21 nt, Homo sapiens
ugcucugguuguuucuguucc

SEQ ID NO: 1578801 - RNA, 13 nt, Homo sapiens
ugcucuguaaaac

SEQ ID NO: 1578802 - RNA, 19 nt, Homo sapiens
ugcucuuacuacagcuuca

SEQ ID NO: 1578803 - RNA, 23 nt, Homo sapiens
ugcucuuuauuuuaaaaaacacu

SEQ ID NO: 1578804 - RNA, 15 nt, Homo sapiens
ugcucuuuugugaug

SEQ ID NO: 1578805 - RNA, 17 nt, Homo sapiens
ugcucuuuugugaugaa

SEQ ID NO: 1578806 - RNA, 22 nt, Homo sapiens
ugcugacugggucagccuuccg

SEQ ID NO: 1578807 - RNA, 14 nt, Homo sapiens
ugcugauccagaug

SEQ ID NO: 1578808 - RNA, 19 nt, Homo sapiens
ugcugcaaagccuuuccag

SEQ ID NO: 1578809 - RNA, 17 nt, Homo sapiens
ugcugccaugacagagg

SEQ ID NO: 1578810 - RNA, 10 nt, Homo sapiens
ugcugccuaa

SEQ ID NO: 1578811 - RNA, 22 nt, Homo sapiens
ugcugccucccuuucauacaau

SEQ ID NO: 1578812 - RNA, 17 nt, Homo sapiens
ugcugcuugaugaugag

SEQ ID NO: 1578813 - RNA, 13 nt, Homo sapiens
ugcuggacucugg

SEQ ID NO: 1578814 - RNA, 19 nt, Homo sapiens
ugcuggauggccugaggaa

SEQ ID NO: 1578815 - RNA, 13 nt, Homo sapiens
ugcuggcucagga

SEQ ID NO: 1578816 - RNA, 22 nt, Homo sapiens
ugcuggcucugcuguccuugcc

SEQ ID NO: 1578817 - RNA, 15 nt, Homo sapiens
ugcugggcuuggcag

SEQ ID NO: 1578818 - RNA, 20 nt, Homo sapiens
ugcuggucagagagaccuca

SEQ ID NO: 1578819 - RNA, 18 nt, Homo sapiens
ugcuguagacauuugcua

SEQ ID NO: 1578820 - RNA, 20 nt, Homo sapiens
ugcuguauaugcaaugucca

SEQ ID NO: 1578821 - RNA, 14 nt, Homo sapiens
ugcugugaacaauu

SEQ ID NO: 1578822 - RNA, 19 nt, Homo sapiens
ugcugugucuccucucaga

SEQ ID NO: 1578823 - RNA, 14 nt, Homo sapiens
ugcuguuaaccaaa

SEQ ID NO: 1578824 - RNA, 23 nt, Homo sapiens
uguaaucgaguaaggcacaccca

SEQ ID NO: 1578825 - RNA, 21 nt, Homo sapiens
uguaaugauacugauuaugaa

SEQ ID NO: 1578826 - RNA, 20 nt, Homo sapiens
uguaauggagcaucaagcca

SEQ ID NO: 1578827 - RNA, 22 nt, Homo sapiens
uguaaugguaucuuaaagugug

SEQ ID NO: 1578828 - RNA, 22 nt, Homo sapiens
uguaauuaauaacuuucucugu

SEQ ID NO: 1578829 - RNA, 16 nt, Homo sapiens
uguaauuugcaaagaa

SEQ ID NO: 1578830 - RNA, 21 nt, Homo sapiens
uguacaaauaauagcaaugua

SEQ ID NO: 1578831 - RNA, 15 nt, Homo sapiens
uguacacaugccaac

SEQ ID NO: 1578832 - RNA, 16 nt, Homo sapiens
uguacaccaauauuca

SEQ ID NO: 1578833 - RNA, 16 nt, Homo sapiens
uguacaccacaugcua

SEQ ID NO: 1578834 - RNA, 20 nt, Homo sapiens
uguacagcaagauguuucuu

SEQ ID NO: 1578835 - RNA, 16 nt, Homo sapiens
uguacauuuaauaaua

SEQ ID NO: 1578836 - RNA, 20 nt, Homo sapiens
uguacauuuaauaauaucaa

SEQ ID NO: 1578837 - RNA, 16 nt, Homo sapiens
uguaccaucauaagau

SEQ ID NO: 1578838 - RNA, 15 nt, Homo sapiens
uguacccgagcacau

SEQ ID NO: 1578839 - RNA, 21 nt, Homo sapiens
uguacuacagcuauauuugau

SEQ ID NO: 1578840 - RNA, 15 nt, Homo sapiens
uguacucaaguacca

SEQ ID NO: 1578841 - RNA, 15 nt, Homo sapiens
uguacuugccuuauu

SEQ ID NO: 1578842 - RNA, 15 nt, Homo sapiens
uguagaauaaaugaa

SEQ ID NO: 1578843 - RNA, 21 nt, Homo sapiens
uguagacucuaagauacacug

SEQ ID NO: 1578844 - RNA, 18 nt, Homo sapiens
uguagauaguaugcacua

SEQ ID NO: 1578845 - RNA, 21 nt, Homo sapiens
uguagauucagguaauacaaa

SEQ ID NO: 1578846 - RNA, 22 nt, Homo sapiens
uguagcagcuauauauuucccc

SEQ ID NO: 1578847 - RNA, 15 nt, Homo sapiens
uguagcagucacuga

SEQ ID NO: 1578848 - RNA, 15 nt, Homo sapiens
uguagcuaaccugca

SEQ ID NO: 1578849 - RNA, 16 nt, Homo sapiens
uguaggcacaagacca

SEQ ID NO: 1578850 - RNA, 21 nt, Homo sapiens
uguagggcacccaaaacucaa

SEQ ID NO: 1578851 - RNA, 18 nt, Homo sapiens
uguaguguauuaaucucu

SEQ ID NO: 1578852 - RNA, 14 nt, Homo sapiens
uguaguucucagga

SEQ ID NO: 1578853 - RNA, 23 nt, Homo sapiens
uguauaaaaaagaaaacuugugu

SEQ ID NO: 1578854 - RNA, 20 nt, Homo sapiens
uguauaauuggaguagauau

SEQ ID NO: 1578855 - RNA, 16 nt, Homo sapiens
uguauauaaacauauc

SEQ ID NO: 1578856 - RNA, 22 nt, Homo sapiens
uguauauauuauuauaaucuua

SEQ ID NO: 1578857 - RNA, 20 nt, Homo sapiens
uguauauuugagaaaacagg

SEQ ID NO: 1578858 - RNA, 16 nt, Homo sapiens
uguaucaguguccuuu

SEQ ID NO: 1578859 - RNA, 14 nt, Homo sapiens
uguauccauccaug

SEQ ID NO: 1578860 - RNA, 15 nt, Homo sapiens
uguaucgggcaaaaa

SEQ ID NO: 1578861 - RNA, 15 nt, Homo sapiens
uguaucuacaguaau

SEQ ID NO: 1578862 - RNA, 11 nt, Homo sapiens
uguaucuucac

SEQ ID NO: 1578863 - RNA, 22 nt, Homo sapiens
uguaucuuucuuucucuaaugu

SEQ ID NO: 1578864 - RNA, 22 nt, Homo sapiens
uguaucuuuuuuaaacuguaaa

SEQ ID NO: 1578865 - RNA, 16 nt, Homo sapiens
uguaugccacaucuca

SEQ ID NO: 1578866 - RNA, 14 nt, Homo sapiens
uguauggauauaau

SEQ ID NO: 1578867 - RNA, 15 nt, Homo sapiens
uguauguuugcugau

SEQ ID NO: 1578868 - RNA, 15 nt, Homo sapiens
uguauucaccaccaa

SEQ ID NO: 1578869 - RNA, 16 nt, Homo sapiens
uguauucggcaccuuc

SEQ ID NO: 1578870 - RNA, 15 nt, Homo sapiens
uguauucgugcauuu

SEQ ID NO: 1578871 - RNA, 13 nt, Homo sapiens
ugucaaagcuuug

SEQ ID NO: 1578872 - RNA, 16 nt, Homo sapiens
ugucaacuucaguuga

SEQ ID NO: 1578873 - RNA, 23 nt, Homo sapiens
ugucaagcugcugaaacuguaau

SEQ ID NO: 1578874 - RNA, 19 nt, Homo sapiens
ugucaauaaaaccacugua

SEQ ID NO: 1578875 - RNA, 20 nt, Homo sapiens
ugucaauaaaaccacuguac

SEQ ID NO: 1578876 - RNA, 21 nt, Homo sapiens
ugucaauaguauuaacuauua

SEQ ID NO: 1578877 - RNA, 22 nt, Homo sapiens
ugucaauguccuacugagacag

SEQ ID NO: 1578878 - RNA, 13 nt, Homo sapiens
ugucacagucucu

SEQ ID NO: 1578879 - RNA, 14 nt, Homo sapiens
ugucaccaacugaa

SEQ ID NO: 1578880 - RNA, 22 nt, Homo sapiens
ugucaccagcuaucugucaucu

SEQ ID NO: 1578881 - RNA, 19 nt, Homo sapiens
ugucagauagucuauguau

SEQ ID NO: 1578882 - RNA, 15 nt, Homo sapiens
ugucaguaaaacucu

SEQ ID NO: 1578883 - RNA, 16 nt, Homo sapiens
ugucagugaggacucu

SEQ ID NO: 1578884 - RNA, 17 nt, Homo sapiens
ugucagugucacuggau

SEQ ID NO: 1578885 - RNA, 21 nt, Homo sapiens
ugucaguuuuguacauagcaa

SEQ ID NO: 1578886 - RNA, 21 nt, Homo sapiens
ugucaucugcuccuguucaca

SEQ ID NO: 1578887 - RNA, 23 nt, Homo sapiens
uguccacguacuuaauuuacuua

SEQ ID NO: 1578888 - RNA, 20 nt, Homo sapiens
uguccacuguucuguucuca

SEQ ID NO: 1578889 - RNA, 15 nt, Homo sapiens
uguccauaugcaucu

SEQ ID NO: 1578890 - RNA, 16 nt, Homo sapiens
uguccaugaagcacug

SEQ ID NO: 1578891 - RNA, 17 nt, Homo sapiens
ugucccaccccuaccuc

SEQ ID NO: 1578892 - RNA, 19 nt, Homo sapiens
ugucccaccccuaccucua

SEQ ID NO: 1578893 - RNA, 18 nt, Homo sapiens
ugucccagaaugccuccu

SEQ ID NO: 1578894 - RNA, 20 nt, Homo sapiens
uguccccuucucucaucucu

SEQ ID NO: 1578895 - RNA, 19 nt, Homo sapiens
uguccuaaggcccauuuga

SEQ ID NO: 1578896 - RNA, 18 nt, Homo sapiens
uguccucucccugccaag

SEQ ID NO: 1578897 - RNA, 16 nt, Homo sapiens
uguccucucugugucc

SEQ ID NO: 1578898 - RNA, 21 nt, Homo sapiens
uguccucuucuggcuacugca

SEQ ID NO: 1578899 - RNA, 17 nt, Homo sapiens
uguccugagcaccacac

SEQ ID NO: 1578900 - RNA, 22 nt, Homo sapiens
uguccugagcaccacacccagu

SEQ ID NO: 1578901 - RNA, 22 nt, Homo sapiens
uguccugggccugccccugugu

SEQ ID NO: 1578902 - RNA, 18 nt, Homo sapiens
ugucgaugacuucaucaa

SEQ ID NO: 1578903 - RNA, 14 nt, Homo sapiens
ugucgcuaugugac

SEQ ID NO: 1578904 - RNA, 16 nt, Homo sapiens
ugucgggaauuuuccc

SEQ ID NO: 1578905 - RNA, 20 nt, Homo sapiens
ugucuaggcaggcaagagaa

SEQ ID NO: 1578906 - RNA, 16 nt, Homo sapiens
ugucuauuauuuagaa

SEQ ID NO: 1578907 - RNA, 20 nt, Homo sapiens
ugucuauuuaagugcaauua

SEQ ID NO: 1578908 - RNA, 16 nt, Homo sapiens
ugucucaguccaugaa

SEQ ID NO: 1578909 - RNA, 15 nt, Homo sapiens
ugucucuauauugcu

SEQ ID NO: 1578910 - RNA, 12 nt, Homo sapiens
ugucucugccug

SEQ ID NO: 1578911 - RNA, 17 nt, Homo sapiens
ugucugauuuuggccau

SEQ ID NO: 1578912 - RNA, 12 nt, Homo sapiens
ugucugccaaaa

SEQ ID NO: 1578913 - RNA, 18 nt, Homo sapiens
ugucugccuucacaaaug

SEQ ID NO: 1578914 - RNA, 22 nt, Homo sapiens
ugucugggugaccucacuuuag

SEQ ID NO: 1578915 - RNA, 12 nt, Homo sapiens
ugucuuaccaga

SEQ ID NO: 1578916 - RNA, 15 nt, Homo sapiens
ugucuuucaaugaca

SEQ ID NO: 1578917 - RNA, 20 nt, Homo sapiens
ugugaaaagagcaaucagaa

SEQ ID NO: 1578918 - RNA, 18 nt, Homo sapiens
ugugaaaagcuacccuga

SEQ ID NO: 1578919 - RNA, 13 nt, Homo sapiens
ugugaaaaugaau

SEQ ID NO: 1578920 - RNA, 20 nt, Homo sapiens
ugugaaacauuuuuucuucu

SEQ ID NO: 1578921 - RNA, 17 nt, Homo sapiens
ugugaaaugcuuuuaua

SEQ ID NO: 1578922 - RNA, 21 nt, Homo sapiens
ugugaaaugcuuuuauauucu

SEQ ID NO: 1578923 - RNA, 15 nt, Homo sapiens
ugugaacacaucagc

SEQ ID NO: 1578924 - RNA, 23 nt, Homo sapiens
ugugaacuggaagaaagcaacaa

SEQ ID NO: 1578925 - RNA, 15 nt, Homo sapiens
ugugaaguaugcacu

SEQ ID NO: 1578926 - RNA, 16 nt, Homo sapiens
ugugaaguggaaaugu

SEQ ID NO: 1578927 - RNA, 19 nt, Homo sapiens
ugugaauuaggcuguaacu

SEQ ID NO: 1578928 - RNA, 20 nt, Homo sapiens
ugugaauuauugacacugaa

SEQ ID NO: 1578929 - RNA, 20 nt, Homo sapiens
ugugacaaaacaucuuuuca

SEQ ID NO: 1578930 - RNA, 19 nt, Homo sapiens
ugugacauugauuugcucu

SEQ ID NO: 1578931 - RNA, 18 nt, Homo sapiens
ugugacauuuuacauuaa

SEQ ID NO: 1578932 - RNA, 17 nt, Homo sapiens
ugugaccugucagaaua

SEQ ID NO: 1578933 - RNA, 15 nt, Homo sapiens
ugugacucuuuccaa

SEQ ID NO: 1578934 - RNA, 12 nt, Homo sapiens
ugugacugccau

SEQ ID NO: 1578935 - RNA, 21 nt, Homo sapiens
ugugacuuaaugccacuaaau

SEQ ID NO: 1578936 - RNA, 15 nt, Homo sapiens
ugugacuugcaauaa

SEQ ID NO: 1578937 - RNA, 15 nt, Homo sapiens
ugugagagaaagugu

SEQ ID NO: 1578938 - RNA, 16 nt, Homo sapiens
ugugagcucugguuau

SEQ ID NO: 1578939 - RNA, 19 nt, Homo sapiens
ugugagguucgcuuaucaa

SEQ ID NO: 1578940 - RNA, 22 nt, Homo sapiens
ugugauauguaccuaacgaagu

SEQ ID NO: 1578941 - RNA, 16 nt, Homo sapiens
uuauauuacacuacac

SEQ ID NO: 1578942 - RNA, 19 nt, Homo sapiens
uuaucaacuucgcuagaaa

SEQ ID NO: 1578943 - RNA, 14 nt, Homo sapiens
uuaucagcaaaaaa

SEQ ID NO: 1578944 - RNA, 21 nt, Homo sapiens
uuaucccccgcaaagacauca

SEQ ID NO: 1578945 - RNA, 21 nt, Homo sapiens
uuauccuguuugaagaaaaag

SEQ ID NO: 1578946 - RNA, 16 nt, Homo sapiens
uuaucucucaaaacaa

SEQ ID NO: 1578947 - RNA, 14 nt, Homo sapiens
uuaucuugcugcac

SEQ ID NO: 1578948 - RNA, 15 nt, Homo sapiens
uuaucuuuauaugaa

SEQ ID NO: 1578949 - RNA, 14 nt, Homo sapiens
uuaugaaaaagaag

SEQ ID NO: 1578950 - RNA, 15 nt, Homo sapiens
uuaugaaaaagaaga

SEQ ID NO: 1578951 - RNA, 17 nt, Homo sapiens
uuaugaaaacuagcauu

SEQ ID NO: 1578952 - RNA, 15 nt, Homo sapiens
uuaugagaaacugca

SEQ ID NO: 1578953 - RNA, 11 nt, Homo sapiens
uuaugagacag

SEQ ID NO: 1578954 - RNA, 23 nt, Homo sapiens
uuaugagaggcaaugauuguuaa

SEQ ID NO: 1578955 - RNA, 18 nt, Homo sapiens
uuaugauggagcaacuga

SEQ ID NO: 1578956 - RNA, 14 nt, Homo sapiens
uuaugcaaauggag

SEQ ID NO: 1578957 - RNA, 12 nt, Homo sapiens
uuaugcugucau

SEQ ID NO: 1578958 - RNA, 13 nt, Homo sapiens
uuauggcaaagau

SEQ ID NO: 1578959 - RNA, 17 nt, Homo sapiens
uuaugguuaauacuauu

SEQ ID NO: 1578960 - RNA, 18 nt, Homo sapiens
uuaugucaucaguaaagu

SEQ ID NO: 1578961 - RNA, 21 nt, Homo sapiens
uuauguguaguugucucucuu

SEQ ID NO: 1578962 - RNA, 18 nt, Homo sapiens
uuauguguugaugacuca

SEQ ID NO: 1578963 - RNA, 19 nt, Homo sapiens
uuauguguugccaaaacca

SEQ ID NO: 1578964 - RNA, 14 nt, Homo sapiens
uuauguuacuguau

SEQ ID NO: 1578965 - RNA, 18 nt, Homo sapiens
uuauguuuucuuucucac

SEQ ID NO: 1578966 - RNA, 13 nt, Homo sapiens
uuauuaaagaaau

SEQ ID NO: 1578967 - RNA, 18 nt, Homo sapiens
uuauuaagcuuuuuggaa

SEQ ID NO: 1578968 - RNA, 11 nt, Homo sapiens
uuauuacugaa

SEQ ID NO: 1578969 - RNA, 13 nt, Homo sapiens
uuauuaucuauua

SEQ ID NO: 1578970 - RNA, 15 nt, Homo sapiens
uuauuaucuucuuaa

SEQ ID NO: 1578971 - RNA, 17 nt, Homo sapiens
uuauuccugguuuaauu

SEQ ID NO: 1578972 - RNA, 14 nt, Homo sapiens
uuauucugccuucc

SEQ ID NO: 1578973 - RNA, 16 nt, Homo sapiens
uuauucugccuuccag

SEQ ID NO: 1578974 - RNA, 17 nt, Homo sapiens
uuauucuguuauauagu

SEQ ID NO: 1578975 - RNA, 13 nt, Homo sapiens
uuauugacacuga

SEQ ID NO: 1578976 - RNA, 15 nt, Homo sapiens
uuauuggcugagaua

SEQ ID NO: 1578977 - RNA, 20 nt, Homo sapiens
uuauugugacuucacuguau

SEQ ID NO: 1578978 - RNA, 20 nt, Homo sapiens
uuauuuacaugugauuguga

SEQ ID NO: 1578979 - RNA, 20 nt, Homo sapiens
uuauuuacugacauauaucu

SEQ ID NO: 1578980 - RNA, 18 nt, Homo sapiens
uuauuuauuuugugguaa

SEQ ID NO: 1578981 - RNA, 13 nt, Homo sapiens
uuauuucuagcaa

SEQ ID NO: 1578982 - RNA, 13 nt, Homo sapiens
uuauuucugugaa

SEQ ID NO: 1578983 - RNA, 22 nt, Homo sapiens
uuauuugggagggaaaagggaa

SEQ ID NO: 1578984 - RNA, 16 nt, Homo sapiens
uuauuugugggguaca

SEQ ID NO: 1578985 - RNA, 14 nt, Homo sapiens
uuauuuuucuuguc

SEQ ID NO: 1578986 - RNA, 19 nt, Homo sapiens
uuauuuuuguuagcaaaga

SEQ ID NO: 1578987 - RNA, 16 nt, Homo sapiens
uuauuuuuuucuuaaa

SEQ ID NO: 1578988 - RNA, 14 nt, Homo sapiens
uucaaaaauuucac

SEQ ID NO: 1578989 - RNA, 12 nt, Homo sapiens
uucaaaauaugu

SEQ ID NO: 1578990 - RNA, 19 nt, Homo sapiens
uucaaacagucucaggaaa

SEQ ID NO: 1578991 - RNA, 15 nt, Homo sapiens
uucaaaccagcuuca

SEQ ID NO: 1578992 - RNA, 22 nt, Homo sapiens
uucaaaucacauggaacuuuag

SEQ ID NO: 1578993 - RNA, 15 nt, Homo sapiens
uucaaauccauagau

SEQ ID NO: 1578994 - RNA, 23 nt, Homo sapiens
uucaaauccuuauuguucagagu

SEQ ID NO: 1578995 - RNA, 15 nt, Homo sapiens
uucaaaucuguaauu

SEQ ID NO: 1578996 - RNA, 12 nt, Homo sapiens
uucaaaugaaac

SEQ ID NO: 1578997 - RNA, 15 nt, Homo sapiens
uucaacagagacuga

SEQ ID NO: 1578998 - RNA, 16 nt, Homo sapiens
uucaacagggaagaaa

SEQ ID NO: 1578999 - RNA, 15 nt, Homo sapiens
uucaacgaugugacu

SEQ ID NO: 1579000 - RNA, 11 nt, Homo sapiens
uucaagaccag

SEQ ID NO: 1579001 - RNA, 13 nt, Homo sapiens
uucaagcaauucu

SEQ ID NO: 1579002 - RNA, 15 nt, Homo sapiens
uucaagccucuaaac

SEQ ID NO: 1579003 - RNA, 22 nt, Homo sapiens
uucaaggacuguuucaguguga

SEQ ID NO: 1579004 - RNA, 12 nt, Homo sapiens
uucaagugccua

SEQ ID NO: 1579005 - RNA, 12 nt, Homo sapiens
uucaaguguaaa

SEQ ID NO: 1579006 - RNA, 15 nt, Homo sapiens
uucaauaaacauuga

SEQ ID NO: 1579007 - RNA, 18 nt, Homo sapiens
uucaauaaaccacaagca

SEQ ID NO: 1579008 - RNA, 19 nt, Homo sapiens
uucaauaaaucuuucaaaa

SEQ ID NO: 1579009 - RNA, 16 nt, Homo sapiens
uucaaucauaauaccu

SEQ ID NO: 1579010 - RNA, 17 nt, Homo sapiens
uucaaucauuuauucau

SEQ ID NO: 1579011 - RNA, 18 nt, Homo sapiens
uucaaugaaauaaaagca

SEQ ID NO: 1579012 - RNA, 16 nt, Homo sapiens
uucacaaauccuucaa

SEQ ID NO: 1579013 - RNA, 23 nt, Homo sapiens
uucacaagccuccuguaccucag

SEQ ID NO: 1579014 - RNA, 16 nt, Homo sapiens
uucacacugaccaaga

SEQ ID NO: 1579015 - RNA, 19 nt, Homo sapiens
uucacagccagacuggcac

SEQ ID NO: 1579016 - RNA, 18 nt, Homo sapiens
uucacauaguuugauaaa

SEQ ID NO: 1579017 - RNA, 16 nt, Homo sapiens
uucacaucagcuuuag

SEQ ID NO: 1579018 - RNA, 16 nt, Homo sapiens
uucacaucuaaccuca

SEQ ID NO: 1579019 - RNA, 16 nt, Homo sapiens
uucacauuuguauuaa

SEQ ID NO: 1579020 - RNA, 22 nt, Homo sapiens
uucaccaaaucuugguugaugc

SEQ ID NO: 1579021 - RNA, 16 nt, Homo sapiens
uucaccuacauuaucu

SEQ ID NO: 1579022 - RNA, 18 nt, Homo sapiens
uucaccuacauuaucuca

SEQ ID NO: 1579023 - RNA, 14 nt, Homo sapiens
uucaccugaaucau

SEQ ID NO: 1579024 - RNA, 11 nt, Homo sapiens
uucaccuguaa

SEQ ID NO: 1579025 - RNA, 20 nt, Homo sapiens
uucaccuguaaaacuuuauu

SEQ ID NO: 1579026 - RNA, 13 nt, Homo sapiens
uucaccuguaaac

SEQ ID NO: 1579027 - RNA, 10 nt, Homo sapiens
uucacugagu

SEQ ID NO: 1579028 - RNA, 16 nt, Homo sapiens
uucacugcgaagaccc

SEQ ID NO: 1579029 - RNA, 18 nt, Homo sapiens
uucagaagaaaaagaagc

SEQ ID NO: 1579030 - RNA, 13 nt, Homo sapiens
uucagagcacuca

SEQ ID NO: 1579031 - RNA, 15 nt, Homo sapiens
uucagaggugcuaaa

SEQ ID NO: 1579032 - RNA, 11 nt, Homo sapiens
uucagccaaaa

SEQ ID NO: 1579033 - RNA, 12 nt, Homo sapiens
uucagccuuaau

SEQ ID NO: 1579034 - RNA, 17 nt, Homo sapiens
uucagccuuaauggaag

SEQ ID NO: 1579035 - RNA, 21 nt, Homo sapiens
uucagcugacuccaguauaau

SEQ ID NO: 1579036 - RNA, 14 nt, Homo sapiens
uucagcugcuuuga

SEQ ID NO: 1579037 - RNA, 18 nt, Homo sapiens
uucagcugcuuugacaaa

SEQ ID NO: 1579038 - RNA, 19 nt, Homo sapiens
uucaggaaaauguauugau

SEQ ID NO: 1579039 - RNA, 17 nt, Homo sapiens
uucaggaauacuuggac

SEQ ID NO: 1579040 - RNA, 23 nt, Homo sapiens
uucaggccauggguucaccagcc

SEQ ID NO: 1579041 - RNA, 19 nt, Homo sapiens
uucaggugugacucuagca

SEQ ID NO: 1579042 - RNA, 21 nt, Homo sapiens
uucaguauuuauugagcaucu

SEQ ID NO: 1579043 - RNA, 13 nt, Homo sapiens
uucagucuugccu

SEQ ID NO: 1579044 - RNA, 21 nt, Homo sapiens
uucagugucgggaauuuuccc

SEQ ID NO: 1579045 - RNA, 16 nt, Homo sapiens
uucaguucauucccag

SEQ ID NO: 1579046 - RNA, 14 nt, Homo sapiens
uucaguuucacaga

SEQ ID NO: 1579047 - RNA, 22 nt, Homo sapiens
uucaguuucuaucaaccuucaa

SEQ ID NO: 1579048 - RNA, 20 nt, Homo sapiens
uucauaaaaaauaauggugu

SEQ ID NO: 1579049 - RNA, 23 nt, Homo sapiens
uucauaaaaaauaauggugucca

SEQ ID NO: 1579050 - RNA, 18 nt, Homo sapiens
uucauauuuauacuuugc

SEQ ID NO: 1579051 - RNA, 14 nt, Homo sapiens
uucaucaaacauug

SEQ ID NO: 1579052 - RNA, 22 nt, Homo sapiens
uucauccaguuuguucuccggg

SEQ ID NO: 1579053 - RNA, 15 nt, Homo sapiens
uucaugaucaucaca

SEQ ID NO: 1579054 - RNA, 22 nt, Homo sapiens
uucauggugauugucauguaag

SEQ ID NO: 1579055 - RNA, 15 nt, Homo sapiens
uucauguaauaaaca

SEQ ID NO: 1579056 - RNA, 19 nt, Homo sapiens
uucauguaauaaacagguu

SEQ ID NO: 1579057 - RNA, 22 nt, Homo sapiens
uucaugugaaucccuuuaggau

SEQ ID NO: 1579058 - RNA, 18 nt, Homo sapiens
uucaugugcugccugcaa

SEQ ID NO: 1579059 - RNA, 17 nt, Homo sapiens
uucauuauugguuuuaa

SEQ ID NO: 1579060 - RNA, 15 nt, Homo sapiens
uucauucacuuuaau

SEQ ID NO: 1579061 - RNA, 18 nt, Homo sapiens
uuugaaugcuuaauucaa

SEQ ID NO: 1579062 - RNA, 19 nt, Homo sapiens
uuugaaugcuuaauucaau

SEQ ID NO: 1579063 - RNA, 16 nt, Homo sapiens
uuugaauugccuugcu

SEQ ID NO: 1579064 - RNA, 13 nt, Homo sapiens
uuugaccagcaca

SEQ ID NO: 1579065 - RNA, 11 nt, Homo sapiens
uuugaccaguu

SEQ ID NO: 1579066 - RNA, 14 nt, Homo sapiens
uuugacugucagca

SEQ ID NO: 1579067 - RNA, 22 nt, Homo sapiens
uuugagauggagucuugcucug

SEQ ID NO: 1579068 - RNA, 15 nt, Homo sapiens
uuugagcaggucuca

SEQ ID NO: 1579069 - RNA, 21 nt, Homo sapiens
uuugagcccauucuucugggu

SEQ ID NO: 1579070 - RNA, 21 nt, Homo sapiens
uuugagcuccaucaaggguau

SEQ ID NO: 1579071 - RNA, 14 nt, Homo sapiens
uuugauagaaccau

SEQ ID NO: 1579072 - RNA, 18 nt, Homo sapiens
uuugauauaauuguacug

SEQ ID NO: 1579073 - RNA, 23 nt, Homo sapiens
uuugaugaaauaaaauaucaaua

SEQ ID NO: 1579074 - RNA, 16 nt, Homo sapiens
uuugauucagcaaaaa

SEQ ID NO: 1579075 - RNA, 14 nt, Homo sapiens
uuugauugauuuga

SEQ ID NO: 1579076 - RNA, 15 nt, Homo sapiens
uuugcaaaguacugu

SEQ ID NO: 1579077 - RNA, 13 nt, Homo sapiens
uuugcagagccuu

SEQ ID NO: 1579078 - RNA, 22 nt, Homo sapiens
uuugcaggaucugucugugcac

SEQ ID NO: 1579079 - RNA, 21 nt, Homo sapiens
uuugcaggguccucuucuggg

SEQ ID NO: 1579080 - RNA, 19 nt, Homo sapiens
uuugcauuaaauucacaaa

SEQ ID NO: 1579081 - RNA, 14 nt, Homo sapiens
uuugcauugccaag

SEQ ID NO: 1579082 - RNA, 17 nt, Homo sapiens
uuugccauuaugcaaau

SEQ ID NO: 1579083 - RNA, 18 nt, Homo sapiens
uuugccuccagugcaguc

SEQ ID NO: 1579084 - RNA, 17 nt, Homo sapiens
uuugcuaaagacaugaa

SEQ ID NO: 1579085 - RNA, 14 nt, Homo sapiens
uuugcuacauucua

SEQ ID NO: 1579086 - RNA, 15 nt, Homo sapiens
uuugcucuuacuaca

SEQ ID NO: 1579087 - RNA, 18 nt, Homo sapiens
uuugcuggaguucaggga

SEQ ID NO: 1579088 - RNA, 16 nt, Homo sapiens
uuugcuugcaauguag

SEQ ID NO: 1579089 - RNA, 16 nt, Homo sapiens
uuugcuuuaguacaau

SEQ ID NO: 1579090 - RNA, 16 nt, Homo sapiens
uuuggaaccaugccuu

SEQ ID NO: 1579091 - RNA, 15 nt, Homo sapiens
uuuggaauauuaaaa

SEQ ID NO: 1579092 - RNA, 20 nt, Homo sapiens
uuuggacugucuauaucaua

SEQ ID NO: 1579093 - RNA, 19 nt, Homo sapiens
uuuggagaaaugcuuagaa

SEQ ID NO: 1579094 - RNA, 17 nt, Homo sapiens
uuuggaugucuguagca

SEQ ID NO: 1579095 - RNA, 14 nt, Homo sapiens
uuuggauugucaaa

SEQ ID NO: 1579096 - RNA, 19 nt, Homo sapiens
uuuggcaaaacucaggcag

SEQ ID NO: 1579097 - RNA, 21 nt, Homo sapiens
uuuggcacuugccauuccaaa

SEQ ID NO: 1579098 - RNA, 17 nt, Homo sapiens
uuuggcaucuacuuaga

SEQ ID NO: 1579099 - RNA, 23 nt, Homo sapiens
uuuggcgaccuccuuucaucaca

SEQ ID NO: 1579100 - RNA, 18 nt, Homo sapiens
uuuggcuagguaucauuc

SEQ ID NO: 1579101 - RNA, 18 nt, Homo sapiens
uuuggcuauaagugcuca

SEQ ID NO: 1579102 - RNA, 19 nt, Homo sapiens
uuugggaccaucacugaga

SEQ ID NO: 1579103 - RNA, 15 nt, Homo sapiens
uuugggcaccuuaaa

SEQ ID NO: 1579104 - RNA, 15 nt, Homo sapiens
uuugggcaucagaaa

SEQ ID NO: 1579105 - RNA, 21 nt, Homo sapiens
uuugggcccagggacaccagc

SEQ ID NO: 1579106 - RNA, 11 nt, Homo sapiens
uuugggguccc

SEQ ID NO: 1579107 - RNA, 16 nt, Homo sapiens
uuuguaaaggauauca

SEQ ID NO: 1579108 - RNA, 17 nt, Homo sapiens
uuuguaauacuuuacaa

SEQ ID NO: 1579109 - RNA, 15 nt, Homo sapiens
uuuguacauaucaaa

SEQ ID NO: 1579110 - RNA, 21 nt, Homo sapiens
uuuguagguaauguuccugaa

SEQ ID NO: 1579111 - RNA, 18 nt, Homo sapiens
uuugucacaaauaaacau

SEQ ID NO: 1579112 - RNA, 12 nt, Homo sapiens
uuugucacuucu

SEQ ID NO: 1579113 - RNA, 13 nt, Homo sapiens
uuugucacuucug

SEQ ID NO: 1579114 - RNA, 23 nt, Homo sapiens
uuugugacccugagaaggcaaaa

SEQ ID NO: 1579115 - RNA, 16 nt, Homo sapiens
uuuguggucacagcca

SEQ ID NO: 1579116 - RNA, 14 nt, Homo sapiens
uuuguuagcaaaga

SEQ ID NO: 1579117 - RNA, 21 nt, Homo sapiens
uuuguuauauauaauaaauac

SEQ ID NO: 1579118 - RNA, 14 nt, Homo sapiens
uuuguuauugcaaa

SEQ ID NO: 1579119 - RNA, 13 nt, Homo sapiens
uuuguuccaugag

SEQ ID NO: 1579120 - RNA, 17 nt, Homo sapiens
uuuguucucccaaaaca

SEQ ID NO: 1579121 - RNA, 21 nt, Homo sapiens
uuuguucuccggguguggccu

SEQ ID NO: 1579122 - RNA, 13 nt, Homo sapiens
uuuguuucaauga

SEQ ID NO: 1579123 - RNA, 21 nt, Homo sapiens
uuuguuuucccuggcuaacag

SEQ ID NO: 1579124 - RNA, 14 nt, Homo sapiens
uuuuaaaacauuca

SEQ ID NO: 1579125 - RNA, 21 nt, Homo sapiens
uuuuaaagcauauuggugcua

SEQ ID NO: 1579126 - RNA, 19 nt, Homo sapiens
uuuuaaauaaaagcacaag

SEQ ID NO: 1579127 - RNA, 18 nt, Homo sapiens
uuuuaaaugaaaguauug

SEQ ID NO: 1579128 - RNA, 14 nt, Homo sapiens
uuuuaacaugucaa

SEQ ID NO: 1579129 - RNA, 13 nt, Homo sapiens
uuuuaacucuaga

SEQ ID NO: 1579130 - RNA, 15 nt, Homo sapiens
uuuuaagcugcaaau

SEQ ID NO: 1579131 - RNA, 15 nt, Homo sapiens
uuuuaauagcacuaa

SEQ ID NO: 1579132 - RNA, 18 nt, Homo sapiens
uuuuaauuaugggaauaa

SEQ ID NO: 1579133 - RNA, 19 nt, Homo sapiens
uuuuaauuuauuucaucca

SEQ ID NO: 1579134 - RNA, 22 nt, Homo sapiens
uuuuacagagaggauacauuua

SEQ ID NO: 1579135 - RNA, 21 nt, Homo sapiens
uuuuacauuucauacaacaga

SEQ ID NO: 1579136 - RNA, 21 nt, Homo sapiens
uuuuaccaaagcaucaauaca

SEQ ID NO: 1579137 - RNA, 22 nt, Homo sapiens
uuuuaccaaagcaucaauacaa

SEQ ID NO: 1579138 - RNA, 17 nt, Homo sapiens
uuuuacgcuuugcagac

SEQ ID NO: 1579139 - RNA, 18 nt, Homo sapiens
uuuuacuucucuauacaa

SEQ ID NO: 1579140 - RNA, 14 nt, Homo sapiens
uuuuacuugaauca

SEQ ID NO: 1579141 - RNA, 15 nt, Homo sapiens
uuuuacuuugguuua

SEQ ID NO: 1579142 - RNA, 20 nt, Homo sapiens
uuuuagaaaccccucuguag

SEQ ID NO: 1579143 - RNA, 13 nt, Homo sapiens
uuuuagcuguaga

SEQ ID NO: 1579144 - RNA, 12 nt, Homo sapiens
uuuuagcuguga

SEQ ID NO: 1579145 - RNA, 22 nt, Homo sapiens
uuuuaggaaaagugaaucuugc

SEQ ID NO: 1579146 - RNA, 13 nt, Homo sapiens
uuuuauacugcac

SEQ ID NO: 1579147 - RNA, 22 nt, Homo sapiens
uuuuaugaugguuuuaucaaaa

SEQ ID NO: 1579148 - RNA, 20 nt, Homo sapiens
uuuuauggaggcuuugcaua

SEQ ID NO: 1579149 - RNA, 23 nt, Homo sapiens
uuuuauggaggcuuugcauagau

SEQ ID NO: 1579150 - RNA, 13 nt, Homo sapiens
uuuuauguucuug

SEQ ID NO: 1579151 - RNA, 17 nt, Homo sapiens
uuuucaaagcaguauag

SEQ ID NO: 1579152 - RNA, 22 nt, Homo sapiens
uuuucaauaaugugaaugcuau

SEQ ID NO: 1579153 - RNA, 23 nt, Homo sapiens
uuuucagacaaauuacugauaaa

SEQ ID NO: 1579154 - RNA, 15 nt, Homo sapiens
uuuucauuauugguu

SEQ ID NO: 1579155 - RNA, 11 nt, Homo sapiens
uuuuccaaaug

SEQ ID NO: 1579156 - RNA, 22 nt, Homo sapiens
uuuuccacaagauucccagaga

SEQ ID NO: 1579157 - RNA, 17 nt, Homo sapiens
uuuuccaugaccuuaag

SEQ ID NO: 1579158 - RNA, 14 nt, Homo sapiens
uuuuccauuuggca

SEQ ID NO: 1579159 - RNA, 23 nt, Homo sapiens
uuuuccauuuuuauuucaaaaua

SEQ ID NO: 1579160 - RNA, 14 nt, Homo sapiens
uuuucccccuauca

SEQ ID NO: 1579161 - RNA, 15 nt, Homo sapiens
uuuuccuguucuuaa

SEQ ID NO: 1579162 - RNA, 21 nt, Homo sapiens
uuuucuaccuauaacacucua

SEQ ID NO: 1579163 - RNA, 16 nt, Homo sapiens
uuuucuauuauggaaa

SEQ ID NO: 1579164 - RNA, 14 nt, Homo sapiens
uuuucucaauugua

SEQ ID NO: 1579165 - RNA, 14 nt, Homo sapiens
uuuucucacaaaaa

SEQ ID NO: 1579166 - RNA, 14 nt, Homo sapiens
uuuucucaugauga

SEQ ID NO: 1579167 - RNA, 18 nt, Homo sapiens
uuuucucuuguaccauag

SEQ ID NO: 1579168 - RNA, 13 nt, Homo sapiens
uuuucugccaaaa

SEQ ID NO: 1579169 - RNA, 11 nt, Homo sapiens
uuuucugcuaa

SEQ ID NO: 1579170 - RNA, 13 nt, Homo sapiens
uuuucuggugcua

SEQ ID NO: 1579171 - RNA, 15 nt, Homo sapiens
uuuucuugauuugag

SEQ ID NO: 1579172 - RNA, 19 nt, Homo sapiens
uuuucuugccuugguuguc

SEQ ID NO: 1579173 - RNA, 17 nt, Homo sapiens
uuuucuuugagucuguu

SEQ ID NO: 1579174 - RNA, 12 nt, Homo sapiens
uuuugaaggcaa

SEQ ID NO: 1579175 - RNA, 14 nt, Homo sapiens
uuuugauaauggcu

SEQ ID NO: 1579176 - RNA, 15 nt, Homo sapiens
uuuugauaauggcuu

SEQ ID NO: 1579177 - RNA, 20 nt, Homo sapiens
uuuugcuuccccgugcauga

SEQ ID NO: 1579178 - RNA, 18 nt, Homo sapiens
uuuugcuuuugacuccag

SEQ ID NO: 1579179 - RNA, 20 nt, Homo sapiens
uuuuggaggugcuugaucua

SEQ ID NO: 1579180 - RNA, 14 nt, Homo sapiens
aaaaacaauaaaga

SEQ ID NO: 1579181 - RNA, 21 nt, Homo sapiens
aaaaacaauaaagauacauga

SEQ ID NO: 1579182 - RNA, 14 nt, Homo sapiens
aaaaacacaugggg

SEQ ID NO: 1579183 - RNA, 16 nt, Homo sapiens
aaaaacacguggagau

SEQ ID NO: 1579184 - RNA, 17 nt, Homo sapiens
aaaaaccccaaacuguu

SEQ ID NO: 1579185 - RNA, 15 nt, Homo sapiens
aaaaaccugauggaa

SEQ ID NO: 1579186 - RNA, 20 nt, Homo sapiens
aaaaaccuuuacaguuagca

SEQ ID NO: 1579187 - RNA, 11 nt, Homo sapiens
aaaaacugacu

SEQ ID NO: 1579188 - RNA, 13 nt, Homo sapiens
aaaaagaaaugca

SEQ ID NO: 1579189 - RNA, 12 nt, Homo sapiens
aaaaagacauuu

SEQ ID NO: 1579190 - RNA, 22 nt, Homo sapiens
aaaaagcaggaaaaaaggaaua

SEQ ID NO: 1579191 - RNA, 18 nt, Homo sapiens
aaaaagcaucuaucucau

SEQ ID NO: 1579192 - RNA, 19 nt, Homo sapiens
aaaaagcuaaugugcaggg

SEQ ID NO: 1579193 - RNA, 12 nt, Homo sapiens
aaaaagcuucca

SEQ ID NO: 1579194 - RNA, 20 nt, Homo sapiens
aaaaagucuacauacuuuca

SEQ ID NO: 1579195 - RNA, 16 nt, Homo sapiens
aaaaaguuaaacauug

SEQ ID NO: 1579196 - RNA, 19 nt, Homo sapiens
aaaaaguugaaccauuaua

SEQ ID NO: 1579197 - RNA, 14 nt, Homo sapiens
aaaaauaacuucau

SEQ ID NO: 1579198 - RNA, 20 nt, Homo sapiens
aaaaauauuguuucugcauu

SEQ ID NO: 1579199 - RNA, 16 nt, Homo sapiens
aaaaaucaaguuuaau

SEQ ID NO: 1579200 - RNA, 17 nt, Homo sapiens
aaaaaucaggagauucc

SEQ ID NO: 1579201 - RNA, 15 nt, Homo sapiens
aaaaaucagugaaua

SEQ ID NO: 1579202 - RNA, 16 nt, Homo sapiens
aaaaaucucccaguga

SEQ ID NO: 1579203 - RNA, 17 nt, Homo sapiens
aaaaaucuuuucauuaa

SEQ ID NO: 1579204 - RNA, 22 nt, Homo sapiens
aaaaaugcccauuuuugcuaau

SEQ ID NO: 1579205 - RNA, 23 nt, Homo sapiens
aaaaauggauacuggugcaguca

SEQ ID NO: 1579206 - RNA, 18 nt, Homo sapiens
aaaaauguucuuacacaa

SEQ ID NO: 1579207 - RNA, 23 nt, Homo sapiens
aaaaauuauuagaacauucacuu

SEQ ID NO: 1579208 - RNA, 21 nt, Homo sapiens
aaaaauuguaucucauuacuu

SEQ ID NO: 1579209 - RNA, 19 nt, Homo sapiens
aaaaauuuugugacauucc

SEQ ID NO: 1579210 - RNA, 11 nt, Homo sapiens
aaaacaauccu

SEQ ID NO: 1579211 - RNA, 13 nt, Homo sapiens
aaaacaauccuga

SEQ ID NO: 1579212 - RNA, 17 nt, Homo sapiens
aaaacaauucugugaca

SEQ ID NO: 1579213 - RNA, 11 nt, Homo sapiens
aaaacacugug

SEQ ID NO: 1579214 - RNA, 18 nt, Homo sapiens
aaaacagagaaagcagaa

SEQ ID NO: 1579215 - RNA, 17 nt, Homo sapiens
aaaacagcucuguugaa

SEQ ID NO: 1579216 - RNA, 21 nt, Homo sapiens
aaaacagucaucuagaauuca

SEQ ID NO: 1579217 - RNA, 11 nt, Homo sapiens
aaaacauucac

SEQ ID NO: 1579218 - RNA, 21 nt, Homo sapiens
aaaacauuguccccaaugaau

SEQ ID NO: 1579219 - RNA, 11 nt, Homo sapiens
aaaacauuucu

SEQ ID NO: 1579220 - RNA, 12 nt, Homo sapiens
aaaaccaaagag

SEQ ID NO: 1579221 - RNA, 13 nt, Homo sapiens
aaaaccacuguac

SEQ ID NO: 1579222 - RNA, 18 nt, Homo sapiens
aaaaccaguagcuuccca

SEQ ID NO: 1579223 - RNA, 18 nt, Homo sapiens
aaaaccauggucucucug

SEQ ID NO: 1579224 - RNA, 17 nt, Homo sapiens
aaaacccucagcacugu

SEQ ID NO: 1579225 - RNA, 15 nt, Homo sapiens
aaaaccuuuacaguu

SEQ ID NO: 1579226 - RNA, 19 nt, Homo sapiens
aaaacgcacaagccagacc

SEQ ID NO: 1579227 - RNA, 15 nt, Homo sapiens
aaaacgcaccaauca

SEQ ID NO: 1579228 - RNA, 17 nt, Homo sapiens
aaaacgcaccaaucagc

SEQ ID NO: 1579229 - RNA, 16 nt, Homo sapiens
aaaacuaaugugucuc

SEQ ID NO: 1579230 - RNA, 11 nt, Homo sapiens
aaaacuacuga

SEQ ID NO: 1579231 - RNA, 19 nt, Homo sapiens
aaaacuacugauacuuuca

SEQ ID NO: 1579232 - RNA, 16 nt, Homo sapiens
aaaacuagcauuacau

SEQ ID NO: 1579233 - RNA, 19 nt, Homo sapiens
aaaacucaguaagaauuau

SEQ ID NO: 1579234 - RNA, 17 nt, Homo sapiens
aaaacuguguugccaca

SEQ ID NO: 1579235 - RNA, 18 nt, Homo sapiens
aaaacuuaaggaagcaaa

SEQ ID NO: 1579236 - RNA, 11 nt, Homo sapiens
aaaacuuguaa

SEQ ID NO: 1579237 - RNA, 21 nt, Homo sapiens
aaaacuuuaggcccugcccca

SEQ ID NO: 1579238 - RNA, 19 nt, Homo sapiens
aaaacuuuaugcuaaguga

SEQ ID NO: 1579239 - RNA, 12 nt, Homo sapiens
aaaagaacaugc

SEQ ID NO: 1579240 - RNA, 20 nt, Homo sapiens
aaaagaaggcucacagauuu

SEQ ID NO: 1579241 - RNA, 20 nt, Homo sapiens
aaaagaauuacagacucuga

SEQ ID NO: 1579242 - RNA, 12 nt, Homo sapiens
aaaagacugaau

SEQ ID NO: 1579243 - RNA, 20 nt, Homo sapiens
aaaagacugaaucuaccugc

SEQ ID NO: 1579244 - RNA, 18 nt, Homo sapiens
aaaagagacaaacuguaa

SEQ ID NO: 1579245 - RNA, 15 nt, Homo sapiens
aaaagaugugcagau

SEQ ID NO: 1579246 - RNA, 21 nt, Homo sapiens
aaaagcaacaggccauuguga

SEQ ID NO: 1579247 - RNA, 18 nt, Homo sapiens
aaaagcaagggaccuuca

SEQ ID NO: 1579248 - RNA, 19 nt, Homo sapiens
aaaagcaagggaccuucau

SEQ ID NO: 1579249 - RNA, 21 nt, Homo sapiens
aaaagcaauucugacugucca

SEQ ID NO: 1579250 - RNA, 13 nt, Homo sapiens
aaaagcacacucc

SEQ ID NO: 1579251 - RNA, 20 nt, Homo sapiens
aaaagcacauguauugacaa

SEQ ID NO: 1579252 - RNA, 18 nt, Homo sapiens
aaaagcaccacuguucug

SEQ ID NO: 1579253 - RNA, 18 nt, Homo sapiens
aaaagccuuccaguuuug

SEQ ID NO: 1579254 - RNA, 14 nt, Homo sapiens
aaaagcugccugga

SEQ ID NO: 1579255 - RNA, 14 nt, Homo sapiens
aaaagcuucaggga

SEQ ID NO: 1579256 - RNA, 21 nt, Homo sapiens
aaaagcuuucugccaccccua

SEQ ID NO: 1579257 - RNA, 17 nt, Homo sapiens
aaaaggagccugugaga

SEQ ID NO: 1579258 - RNA, 13 nt, Homo sapiens
aaaaggcugagaa

SEQ ID NO: 1579259 - RNA, 15 nt, Homo sapiens
aaaaguaaaccacaa

SEQ ID NO: 1579260 - RNA, 19 nt, Homo sapiens
aaaaguacuaauagaacuu

SEQ ID NO: 1579261 - RNA, 18 nt, Homo sapiens
aaaaguagucauggauaa

SEQ ID NO: 1579262 - RNA, 19 nt, Homo sapiens
aaaagucuacaacauagca

SEQ ID NO: 1579263 - RNA, 23 nt, Homo sapiens
aaaagugaaucuugcuguuuuca

SEQ ID NO: 1579264 - RNA, 12 nt, Homo sapiens
aaaagugcacau

SEQ ID NO: 1579265 - RNA, 16 nt, Homo sapiens
aaaaguuauugugaua

SEQ ID NO: 1579266 - RNA, 22 nt, Homo sapiens
aaaaguucauaacagugccauu

SEQ ID NO: 1579267 - RNA, 22 nt, Homo sapiens
aaaaguugaaccauuauacuuu

SEQ ID NO: 1579268 - RNA, 16 nt, Homo sapiens
aaaauaaaaacuauuc

SEQ ID NO: 1579269 - RNA, 14 nt, Homo sapiens
aaaauaaaagacua

SEQ ID NO: 1579270 - RNA, 18 nt, Homo sapiens
aaaauaaaauacuuugag

SEQ ID NO: 1579271 - RNA, 22 nt, Homo sapiens
aaaauaaagacuagagcaaaau

SEQ ID NO: 1579272 - RNA, 14 nt, Homo sapiens
aaaauaaauuacaa

SEQ ID NO: 1579273 - RNA, 13 nt, Homo sapiens
aaaauaacuucau

SEQ ID NO: 1579274 - RNA, 15 nt, Homo sapiens
aaaauaagcauuuag

SEQ ID NO: 1579275 - RNA, 12 nt, Homo sapiens
aaaauaaucaug

SEQ ID NO: 1579276 - RNA, 13 nt, Homo sapiens
aaaauacaugaca

SEQ ID NO: 1579277 - RNA, 18 nt, Homo sapiens
aaaauacaugacauuuau

SEQ ID NO: 1579278 - RNA, 14 nt, Homo sapiens
aaaauaccaugcca

SEQ ID NO: 1579279 - RNA, 22 nt, Homo sapiens
aaaauacuuuugcuuucaggga

SEQ ID NO: 1579280 - RNA, 13 nt, Homo sapiens
aaaauaguaaugu

SEQ ID NO: 1579281 - RNA, 15 nt, Homo sapiens
aaaauauacauucaa

SEQ ID NO: 1579282 - RNA, 15 nt, Homo sapiens
aaaauaucuacauua

SEQ ID NO: 1579283 - RNA, 16 nt, Homo sapiens
aaaauaucugcucaaa

SEQ ID NO: 1579284 - RNA, 14 nt, Homo sapiens
aaaaucaacaugac

SEQ ID NO: 1579285 - RNA, 22 nt, Homo sapiens
aaaaucaauacaauccuuugaa

SEQ ID NO: 1579286 - RNA, 17 nt, Homo sapiens
aaaaucagggccaccau

SEQ ID NO: 1579287 - RNA, 20 nt, Homo sapiens
aaaaucauucuacugaacag

SEQ ID NO: 1579288 - RNA, 22 nt, Homo sapiens
aaaaucuaccaagaacagaguc

SEQ ID NO: 1579289 - RNA, 13 nt, Homo sapiens
aaaaucugcacag

SEQ ID NO: 1579290 - RNA, 16 nt, Homo sapiens
aaaaucuguguaacug

SEQ ID NO: 1579291 - RNA, 20 nt, Homo sapiens
aaaaucuguuauagcuuuaa

SEQ ID NO: 1579292 - RNA, 20 nt, Homo sapiens
aaaaucuuccaaauccaaaa

SEQ ID NO: 1579293 - RNA, 16 nt, Homo sapiens
aaaaugaaaagccaaa

SEQ ID NO: 1579294 - RNA, 11 nt, Homo sapiens
aaaaugaagga

SEQ ID NO: 1579295 - RNA, 16 nt, Homo sapiens
aaaaugacaccaucuu

SEQ ID NO: 1579296 - RNA, 13 nt, Homo sapiens
aaaaugacuggcu

SEQ ID NO: 1579297 - RNA, 12 nt, Homo sapiens
aaaaugauacug

SEQ ID NO: 1579298 - RNA, 16 nt, Homo sapiens
aaaaugcaccaaucag

SEQ ID NO: 1579299 - RNA, 23 nt, Homo sapiens
ugcacuuguggcaacagauaagu

SEQ ID NO: 1579300 - RNA, 20 nt, Homo sapiens
ugcacuuuccaaugccacag

SEQ ID NO: 1579301 - RNA, 17 nt, Homo sapiens
ugcagaaccagcacuaa

SEQ ID NO: 1579302 - RNA, 20 nt, Homo sapiens
ugcagagaaagaaagggaaa

SEQ ID NO: 1579303 - RNA, 14 nt, Homo sapiens
ugcagaguguuuac

SEQ ID NO: 1579304 - RNA, 15 nt, Homo sapiens
ugcagauaaacagua

SEQ ID NO: 1579305 - RNA, 22 nt, Homo sapiens
ugcagauaaacaguagugauag

SEQ ID NO: 1579306 - RNA, 15 nt, Homo sapiens
ugcagauaacaaaca

SEQ ID NO: 1579307 - RNA, 13 nt, Homo sapiens
ugcagccacuggc

SEQ ID NO: 1579308 - RNA, 17 nt, Homo sapiens
ugcagcccccucgggga

SEQ ID NO: 1579309 - RNA, 20 nt, Homo sapiens
ugcagcucuucaacaugaca

SEQ ID NO: 1579310 - RNA, 13 nt, Homo sapiens
ugcagcuggaaug

SEQ ID NO: 1579311 - RNA, 18 nt, Homo sapiens
ugcagcuggaaugugcca

SEQ ID NO: 1579312 - RNA, 17 nt, Homo sapiens
ugcagcuguaaacauau

SEQ ID NO: 1579313 - RNA, 13 nt, Homo sapiens
ugcagcugucuga

SEQ ID NO: 1579314 - RNA, 15 nt, Homo sapiens
ugcagcuuauauuca

SEQ ID NO: 1579315 - RNA, 19 nt, Homo sapiens
ugcagcuuauauucaucca

SEQ ID NO: 1579316 - RNA, 21 nt, Homo sapiens
ugcaggagucccugccaucau

SEQ ID NO: 1579317 - RNA, 17 nt, Homo sapiens
ugcagggauauugccuu

SEQ ID NO: 1579318 - RNA, 18 nt, Homo sapiens
ugcagggauauugccuua

SEQ ID NO: 1579319 - RNA, 22 nt, Homo sapiens
ugcaggucuccaccugcacauu

SEQ ID NO: 1579320 - RNA, 15 nt, Homo sapiens
ugcaggugaugccau

SEQ ID NO: 1579321 - RNA, 22 nt, Homo sapiens
ugcagguguccugagcaccaca

SEQ ID NO: 1579322 - RNA, 23 nt, Homo sapiens
ugcagguucauggauuacuucuc

SEQ ID NO: 1579323 - RNA, 19 nt, Homo sapiens
ugcaguagagagcaaagau

SEQ ID NO: 1579324 - RNA, 15 nt, Homo sapiens
ugcagucaucuacuu

SEQ ID NO: 1579325 - RNA, 22 nt, Homo sapiens
ugcagucauuaugagaggcaau

SEQ ID NO: 1579326 - RNA, 17 nt, Homo sapiens
ugcaguggcgugaucuc

SEQ ID NO: 1579327 - RNA, 18 nt, Homo sapiens
ugcaguuggacucucagg

SEQ ID NO: 1579328 - RNA, 21 nt, Homo sapiens
ugcaguuucuuguguagauuu

SEQ ID NO: 1579329 - RNA, 22 nt, Homo sapiens
ugcauaaaugcgauccacagaa

SEQ ID NO: 1579330 - RNA, 23 nt, Homo sapiens
ugcauaaugcuuuggaaaaaugg

SEQ ID NO: 1579331 - RNA, 21 nt, Homo sapiens
ugcauauguuuuccacauaaa

SEQ ID NO: 1579332 - RNA, 16 nt, Homo sapiens
ugcaucauguugaaua

SEQ ID NO: 1579333 - RNA, 18 nt, Homo sapiens
ugcauccagcaguacaau

SEQ ID NO: 1579334 - RNA, 15 nt, Homo sapiens
ugcaucugcacauag

SEQ ID NO: 1579335 - RNA, 13 nt, Homo sapiens
ugcaugauuuacu

SEQ ID NO: 1579336 - RNA, 20 nt, Homo sapiens
ugcaugccuguagucucagc

SEQ ID NO: 1579337 - RNA, 19 nt, Homo sapiens
ugcaugucugccuaugcac

SEQ ID NO: 1579338 - RNA, 22 nt, Homo sapiens
ugcaugucugccuaugcacuga

SEQ ID NO: 1579339 - RNA, 15 nt, Homo sapiens
ugcauguggcacuua

SEQ ID NO: 1579340 - RNA, 16 nt, Homo sapiens
ugcauuaccugggaau

SEQ ID NO: 1579341 - RNA, 16 nt, Homo sapiens
ugcauuauaucaaauc

SEQ ID NO: 1579342 - RNA, 14 nt, Homo sapiens
ugcauuccagaaca

SEQ ID NO: 1579343 - RNA, 19 nt, Homo sapiens
ugcauuguuguaaaguauu

SEQ ID NO: 1579344 - RNA, 19 nt, Homo sapiens
ugcauuuauaugcgcuuaa

SEQ ID NO: 1579345 - RNA, 22 nt, Homo sapiens
ugcauuucauauuauuuuagug

SEQ ID NO: 1579346 - RNA, 21 nt, Homo sapiens
ugcauuugugcguaugcagug

SEQ ID NO: 1579347 - RNA, 20 nt, Homo sapiens
ugcauuugugguaaucuaca

SEQ ID NO: 1579348 - RNA, 22 nt, Homo sapiens
ugccaaaauaccagagccuuca

SEQ ID NO: 1579349 - RNA, 12 nt, Homo sapiens
ugccaaaaucaa

SEQ ID NO: 1579350 - RNA, 21 nt, Homo sapiens
ugccaaaaucaauacaauccu

SEQ ID NO: 1579351 - RNA, 20 nt, Homo sapiens
ugccaaaauccaaggcaauu

SEQ ID NO: 1579352 - RNA, 16 nt, Homo sapiens
ugccaaaccaagcaaa

SEQ ID NO: 1579353 - RNA, 22 nt, Homo sapiens
ugccaaaugaauaagacaacaa

SEQ ID NO: 1579354 - RNA, 14 nt, Homo sapiens
ugccaagugccaua

SEQ ID NO: 1579355 - RNA, 20 nt, Homo sapiens
ugccaauagugucauccuca

SEQ ID NO: 1579356 - RNA, 19 nt, Homo sapiens
ugccacaaauaacaucuca

SEQ ID NO: 1579357 - RNA, 23 nt, Homo sapiens
ugccacagccuccccugccaggg

SEQ ID NO: 1579358 - RNA, 23 nt, Homo sapiens
ugccacccaccuuugccacaaag

SEQ ID NO: 1579359 - RNA, 17 nt, Homo sapiens
ugccaccccuaaacucc

SEQ ID NO: 1579360 - RNA, 19 nt, Homo sapiens
ugccacucccugcugugug

SEQ ID NO: 1579361 - RNA, 22 nt, Homo sapiens
ugccagaggcugaugucaagca

SEQ ID NO: 1579362 - RNA, 15 nt, Homo sapiens
ugccagccacuguca

SEQ ID NO: 1579363 - RNA, 22 nt, Homo sapiens
ugccagcuggaucgcugcacau

SEQ ID NO: 1579364 - RNA, 16 nt, Homo sapiens
ugccaggaagggccau

SEQ ID NO: 1579365 - RNA, 17 nt, Homo sapiens
ugccaggaggaacaaag

SEQ ID NO: 1579366 - RNA, 21 nt, Homo sapiens
ugccagguggcucagugccac

SEQ ID NO: 1579367 - RNA, 20 nt, Homo sapiens
ugccagucucuucugauuaa

SEQ ID NO: 1579368 - RNA, 21 nt, Homo sapiens
ugccauaucuucaggccaugg

SEQ ID NO: 1579369 - RNA, 13 nt, Homo sapiens
ugccaucuuuauc

SEQ ID NO: 1579370 - RNA, 13 nt, Homo sapiens
ugccaugcuuuuu

SEQ ID NO: 1579371 - RNA, 22 nt, Homo sapiens
ugccauggaacuguuuccuuca

SEQ ID NO: 1579372 - RNA, 16 nt, Homo sapiens
ugccauugcauuccag

SEQ ID NO: 1579373 - RNA, 13 nt, Homo sapiens
ugccauuguccag

SEQ ID NO: 1579374 - RNA, 17 nt, Homo sapiens
ugcccaacccuauccca

SEQ ID NO: 1579375 - RNA, 21 nt, Homo sapiens
ugcccaaggccuaccccaguu

SEQ ID NO: 1579376 - RNA, 17 nt, Homo sapiens
ugcccaagguugcacag

SEQ ID NO: 1579377 - RNA, 18 nt, Homo sapiens
ugcccaagguugcacagc

SEQ ID NO: 1579378 - RNA, 19 nt, Homo sapiens
ugcccagacugaugagcac

SEQ ID NO: 1579379 - RNA, 23 nt, Homo sapiens
ugcccagaggcuccaucguccau

SEQ ID NO: 1579380 - RNA, 20 nt, Homo sapiens
ugcccaggcuagagugcaau

SEQ ID NO: 1579381 - RNA, 20 nt, Homo sapiens
ugcccaggcuggagugcagu

SEQ ID NO: 1579382 - RNA, 22 nt, Homo sapiens
ugcccaggguuggcaugacugu

SEQ ID NO: 1579383 - RNA, 18 nt, Homo sapiens
ugcccauccugacugaaa

SEQ ID NO: 1579384 - RNA, 15 nt, Homo sapiens
ugcccauugucuuau

SEQ ID NO: 1579385 - RNA, 19 nt, Homo sapiens
ugcccauuugugaagcuua

SEQ ID NO: 1579386 - RNA, 16 nt, Homo sapiens
ugccccacaugcaugu

SEQ ID NO: 1579387 - RNA, 23 nt, Homo sapiens
ugccccacccaacuccacagggc

SEQ ID NO: 1579388 - RNA, 20 nt, Homo sapiens
ugccccagggaguccagggu

SEQ ID NO: 1579389 - RNA, 18 nt, Homo sapiens
ugcccccagccccggggu

SEQ ID NO: 1579390 - RNA, 14 nt, Homo sapiens
ugccccccaugagg

SEQ ID NO: 1579391 - RNA, 14 nt, Homo sapiens
ugcccccuccccca

SEQ ID NO: 1579392 - RNA, 21 nt, Homo sapiens
ugcccccuguggaugcugcug

SEQ ID NO: 1579393 - RNA, 13 nt, Homo sapiens
ugcccccuuucag

SEQ ID NO: 1579394 - RNA, 20 nt, Homo sapiens
ugccccucugccuugcccuc

SEQ ID NO: 1579395 - RNA, 12 nt, Homo sapiens
ugccccugccuu

SEQ ID NO: 1579396 - RNA, 19 nt, Homo sapiens
ugccccuggaccugggaac

SEQ ID NO: 1579397 - RNA, 23 nt, Homo sapiens
ugccccuugggagacuccaggga

SEQ ID NO: 1579398 - RNA, 15 nt, Homo sapiens
ugcccgggagcucag

SEQ ID NO: 1579399 - RNA, 16 nt, Homo sapiens
ugcccguaaucccagc

SEQ ID NO: 1579400 - RNA, 13 nt, Homo sapiens
ugcccuaaacccu

SEQ ID NO: 1579401 - RNA, 20 nt, Homo sapiens
ugcccuacccccucccauuu

SEQ ID NO: 1579402 - RNA, 14 nt, Homo sapiens
ugcccuauauaccu

SEQ ID NO: 1579403 - RNA, 15 nt, Homo sapiens
ugcccuauauaccuc

SEQ ID NO: 1579404 - RNA, 22 nt, Homo sapiens
ugcccuccagagauuugcucaa

SEQ ID NO: 1579405 - RNA, 13 nt, Homo sapiens
ugcccucucugaa

SEQ ID NO: 1579406 - RNA, 18 nt, Homo sapiens
ugcccuggagaugucaca

SEQ ID NO: 1579407 - RNA, 20 nt, Homo sapiens
ugcccuugggguaagccaga

SEQ ID NO: 1579408 - RNA, 14 nt, Homo sapiens
ugccgauaucuuca

SEQ ID NO: 1579409 - RNA, 12 nt, Homo sapiens
ugccgcugccau

SEQ ID NO: 1579410 - RNA, 17 nt, Homo sapiens
ugccgguuaucucgaaa

SEQ ID NO: 1579411 - RNA, 21 nt, Homo sapiens
ugccuacuaucaaacuagcug

SEQ ID NO: 1579412 - RNA, 20 nt, Homo sapiens
ugccuagacuguuacuuugg

SEQ ID NO: 1579413 - RNA, 17 nt, Homo sapiens
ugccuaucugaccaaac

SEQ ID NO: 1579414 - RNA, 21 nt, Homo sapiens
ugccucagacguugccugaga

SEQ ID NO: 1579415 - RNA, 14 nt, Homo sapiens
ugccucagccuccc

SEQ ID NO: 1579416 - RNA, 19 nt, Homo sapiens
ugcuuagucccucaugcaa

SEQ ID NO: 1579417 - RNA, 17 nt, Homo sapiens
ugcuucaucugugggau

SEQ ID NO: 1579418 - RNA, 13 nt, Homo sapiens
ugcuuccagugua

SEQ ID NO: 1579419 - RNA, 15 nt, Homo sapiens
ugcuuccauuaaaag

SEQ ID NO: 1579420 - RNA, 18 nt, Homo sapiens
ugcuuccugucugaguaa

SEQ ID NO: 1579421 - RNA, 14 nt, Homo sapiens
ugcuuccuguguaa

SEQ ID NO: 1579422 - RNA, 15 nt, Homo sapiens
ugcuucuaauauuag

SEQ ID NO: 1579423 - RNA, 18 nt, Homo sapiens
ugcuucuacaugaugcua

SEQ ID NO: 1579424 - RNA, 15 nt, Homo sapiens
ugcuucuacuuucau

SEQ ID NO: 1579425 - RNA, 15 nt, Homo sapiens
ugcuugaacuaggcu

SEQ ID NO: 1579426 - RNA, 18 nt, Homo sapiens
ugcuugcaauguagucaa

SEQ ID NO: 1579427 - RNA, 16 nt, Homo sapiens
ugcuugcccgcuccca

SEQ ID NO: 1579428 - RNA, 19 nt, Homo sapiens
ugcuuuaaaaugucugugu

SEQ ID NO: 1579429 - RNA, 18 nt, Homo sapiens
ugcuuuagccauacacau

SEQ ID NO: 1579430 - RNA, 15 nt, Homo sapiens
ugcuuucaauuacaa

SEQ ID NO: 1579431 - RNA, 18 nt, Homo sapiens
ugcuuuccagacuuugaa

SEQ ID NO: 1579432 - RNA, 17 nt, Homo sapiens
ugcuuuccuucaucucc

SEQ ID NO: 1579433 - RNA, 19 nt, Homo sapiens
ugcuuucuuaucccaguga

SEQ ID NO: 1579434 - RNA, 13 nt, Homo sapiens
ugcuuugccaaaa

SEQ ID NO: 1579435 - RNA, 17 nt, Homo sapiens
ugcuuugggaacugugu

SEQ ID NO: 1579436 - RNA, 15 nt, Homo sapiens
uggaaaacuguguug

SEQ ID NO: 1579437 - RNA, 23 nt, Homo sapiens
uggaaaauaagacaauaguauuu

SEQ ID NO: 1579438 - RNA, 15 nt, Homo sapiens
uggaaaauaccagug

SEQ ID NO: 1579439 - RNA, 18 nt, Homo sapiens
uggaaaaugcaaaagcac

SEQ ID NO: 1579440 - RNA, 19 nt, Homo sapiens
uggaaaaugccaugaauua

SEQ ID NO: 1579441 - RNA, 17 nt, Homo sapiens
uggaaacaguuggcacu

SEQ ID NO: 1579442 - RNA, 23 nt, Homo sapiens
uggaaacuaguggcaauauccaa

SEQ ID NO: 1579443 - RNA, 17 nt, Homo sapiens
uggaaauaaacugugca

SEQ ID NO: 1579444 - RNA, 14 nt, Homo sapiens
uggaaauaaaguca

SEQ ID NO: 1579445 - RNA, 21 nt, Homo sapiens
uggaaauagaaagaagccaua

SEQ ID NO: 1579446 - RNA, 19 nt, Homo sapiens
uggaaaucaguagaaagcu

SEQ ID NO: 1579447 - RNA, 15 nt, Homo sapiens
uggaacaacuuguag

SEQ ID NO: 1579448 - RNA, 13 nt, Homo sapiens
uggaacuagucau

SEQ ID NO: 1579449 - RNA, 22 nt, Homo sapiens
uggaacuagucauuaacccauc

SEQ ID NO: 1579450 - RNA, 17 nt, Homo sapiens
uggaacuccuggccuuu

SEQ ID NO: 1579451 - RNA, 22 nt, Homo sapiens
uggaacuguccuucccucaaag

SEQ ID NO: 1579452 - RNA, 21 nt, Homo sapiens
uggaacuuuuauuacuggggu

SEQ ID NO: 1579453 - RNA, 20 nt, Homo sapiens
uggaagaaggaaacaccgag

SEQ ID NO: 1579454 - RNA, 12 nt, Homo sapiens
uggaagaaggga

SEQ ID NO: 1579455 - RNA, 15 nt, Homo sapiens
uggaagauagcugug

SEQ ID NO: 1579456 - RNA, 12 nt, Homo sapiens
uggaagauggca

SEQ ID NO: 1579457 - RNA, 14 nt, Homo sapiens
uggaagauuugccc

SEQ ID NO: 1579458 - RNA, 13 nt, Homo sapiens
uggaagcaacagg

SEQ ID NO: 1579459 - RNA, 21 nt, Homo sapiens
uggaagccaccucaccaagga

SEQ ID NO: 1579460 - RNA, 21 nt, Homo sapiens
uggaagcugagauuacucuga

SEQ ID NO: 1579461 - RNA, 15 nt, Homo sapiens
uggaagggguccagc

SEQ ID NO: 1579462 - RNA, 15 nt, Homo sapiens
uggaagucaucucau

SEQ ID NO: 1579463 - RNA, 21 nt, Homo sapiens
uggaaguguauuuauuuuaca

SEQ ID NO: 1579464 - RNA, 18 nt, Homo sapiens
uggaagugugggucugug

SEQ ID NO: 1579465 - RNA, 20 nt, Homo sapiens
uggaaguuucuggugccauu

SEQ ID NO: 1579466 - RNA, 13 nt, Homo sapiens
uggaauaguggca

SEQ ID NO: 1579467 - RNA, 14 nt, Homo sapiens
uggaauaguggcau

SEQ ID NO: 1579468 - RNA, 21 nt, Homo sapiens
uggaauauaaggaaagcaaua

SEQ ID NO: 1579469 - RNA, 17 nt, Homo sapiens
uggaauauuugcuuuau

SEQ ID NO: 1579470 - RNA, 17 nt, Homo sapiens
uggaaucuacaagccaa

SEQ ID NO: 1579471 - RNA, 15 nt, Homo sapiens
uggaauggagauuca

SEQ ID NO: 1579472 - RNA, 15 nt, Homo sapiens
uggaauuacugccuu

SEQ ID NO: 1579473 - RNA, 18 nt, Homo sapiens
uggaauuauucuauguca

SEQ ID NO: 1579474 - RNA, 22 nt, Homo sapiens
uggaauuggagucguguuguca

SEQ ID NO: 1579475 - RNA, 14 nt, Homo sapiens
uggaauuuugcaaa

SEQ ID NO: 1579476 - RNA, 12 nt, Homo sapiens
uggacaaaucac

SEQ ID NO: 1579477 - RNA, 20 nt, Homo sapiens
uggacaaggagugugaccac

SEQ ID NO: 1579478 - RNA, 18 nt, Homo sapiens
uggacagaaaaugcaaug

SEQ ID NO: 1579479 - RNA, 23 nt, Homo sapiens
uggacaguuggaccuuacuuugg

SEQ ID NO: 1579480 - RNA, 23 nt, Homo sapiens
uggacauuuuuguagaccacuuu

SEQ ID NO: 1579481 - RNA, 21 nt, Homo sapiens
uggaccaggaggauugccuuu

SEQ ID NO: 1579482 - RNA, 21 nt, Homo sapiens
uggacccacccaccacagccc

SEQ ID NO: 1579483 - RNA, 21 nt, Homo sapiens
uggacuacacaauacaguauu

SEQ ID NO: 1579484 - RNA, 20 nt, Homo sapiens
uggacuccggaggacugagc

SEQ ID NO: 1579485 - RNA, 21 nt, Homo sapiens
uggacucucuguggucccuuc

SEQ ID NO: 1579486 - RNA, 15 nt, Homo sapiens
uggacuucaucucaa

SEQ ID NO: 1579487 - RNA, 19 nt, Homo sapiens
uggagaaaaaaauugcucu

SEQ ID NO: 1579488 - RNA, 22 nt, Homo sapiens
uggagaaaauggguuuauucac

SEQ ID NO: 1579489 - RNA, 23 nt, Homo sapiens
uggagaagccacaggccugagau

SEQ ID NO: 1579490 - RNA, 22 nt, Homo sapiens
uggagaauggaaaauacauuuu

SEQ ID NO: 1579491 - RNA, 22 nt, Homo sapiens
uggagacagacugauguguaua

SEQ ID NO: 1579492 - RNA, 16 nt, Homo sapiens
uggagaggacagagca

SEQ ID NO: 1579493 - RNA, 19 nt, Homo sapiens
uggagagggugucaucuag

SEQ ID NO: 1579494 - RNA, 19 nt, Homo sapiens
uggagauccuuucucucaa

SEQ ID NO: 1579495 - RNA, 20 nt, Homo sapiens
uggagaugcagcuacuggaa

SEQ ID NO: 1579496 - RNA, 16 nt, Homo sapiens
uggagcacaaaauuca

SEQ ID NO: 1579497 - RNA, 11 nt, Homo sapiens
uggagcacgug

SEQ ID NO: 1579498 - RNA, 17 nt, Homo sapiens
uggagcauuucucauca

SEQ ID NO: 1579499 - RNA, 21 nt, Homo sapiens
uggagccugcauuaugcacgu

SEQ ID NO: 1579500 - RNA, 19 nt, Homo sapiens
uggaggacuagaaccugga

SEQ ID NO: 1579501 - RNA, 23 nt, Homo sapiens
uggaggcacaacgcaccagacac

SEQ ID NO: 1579502 - RNA, 16 nt, Homo sapiens
uggaggcagagaccuc

SEQ ID NO: 1579503 - RNA, 21 nt, Homo sapiens
uggaggccaagaacuugcaau

SEQ ID NO: 1579504 - RNA, 22 nt, Homo sapiens
uggaggccaagaacuugcaaua

SEQ ID NO: 1579505 - RNA, 16 nt, Homo sapiens
uggaggcugccccauu

SEQ ID NO: 1579506 - RNA, 16 nt, Homo sapiens
uggagggaaugcucag

SEQ ID NO: 1579507 - RNA, 20 nt, Homo sapiens
uggaggugggcaaagggaag

SEQ ID NO: 1579508 - RNA, 16 nt, Homo sapiens
uggagguugaagccaa

SEQ ID NO: 1579509 - RNA, 13 nt, Homo sapiens
uggagucugucaa

SEQ ID NO: 1579510 - RNA, 18 nt, Homo sapiens
uggagugcaguggcauga

SEQ ID NO: 1579511 - RNA, 23 nt, Homo sapiens
uggaguucccucaguacuauucc

SEQ ID NO: 1579512 - RNA, 18 nt, Homo sapiens
uggauagaaccaccauag

SEQ ID NO: 1579513 - RNA, 15 nt, Homo sapiens
uggaucgcugcacau

SEQ ID NO: 1579514 - RNA, 22 nt, Homo sapiens
uggaucuaccagcauaaauauc

SEQ ID NO: 1579515 - RNA, 21 nt, Homo sapiens
uggaucuuauacccaacacac

SEQ ID NO: 1579516 - RNA, 24 nt, Homo sapiens
uggaugcagcacgccaacauggca

SEQ ID NO: 1579517 - RNA, 12 nt, Homo sapiens
uggaugccaucc

SEQ ID NO: 1579518 - RNA, 15 nt, Homo sapiens
uggaugcgugugaac

SEQ ID NO: 1579519 - RNA, 16 nt, Homo sapiens
uggaugcgugugaacg

SEQ ID NO: 1579520 - RNA, 18 nt, Homo sapiens
uggaugucgaugacuuca

SEQ ID NO: 1579521 - RNA, 15 nt, Homo sapiens
uggaugucuguagca

SEQ ID NO: 1579522 - RNA, 19 nt, Homo sapiens
uggauguguucucuaggcc

SEQ ID NO: 1579523 - RNA, 13 nt, Homo sapiens
uggauuagcuuuu

SEQ ID NO: 1579524 - RNA, 15 nt, Homo sapiens
uggauucacucacuc

SEQ ID NO: 1579525 - RNA, 21 nt, Homo sapiens
uggauuccuagauuacaucug

SEQ ID NO: 1579526 - RNA, 20 nt, Homo sapiens
uggauucuuuaaacgcucua

SEQ ID NO: 1579527 - RNA, 21 nt, Homo sapiens
uggauuggguaugucuaccug

SEQ ID NO: 1579528 - RNA, 15 nt, Homo sapiens
uggauugucaaagag

SEQ ID NO: 1579529 - RNA, 18 nt, Homo sapiens
uggauuuauagcuaugaa

SEQ ID NO: 1579530 - RNA, 23 nt, Homo sapiens
uggauuugaucacuacaaguauu

SEQ ID NO: 1579531 - RNA, 14 nt, Homo sapiens
uggcaaaaccagua

SEQ ID NO: 1579532 - RNA, 23 nt, Homo sapiens
uggcaaagauuuuuggcacuuug

SEQ ID NO: 1579533 - RNA, 15 nt, Homo sapiens
ugggucaugacaaga

SEQ ID NO: 1579534 - RNA, 20 nt, Homo sapiens
ugggucucugggcugucagc

SEQ ID NO: 1579535 - RNA, 22 nt, Homo sapiens
uggguggaaauccugcccugga

SEQ ID NO: 1579536 - RNA, 21 nt, Homo sapiens
uggguggggcugcuccuccag

SEQ ID NO: 1579537 - RNA, 14 nt, Homo sapiens
uggguuaaguauua

SEQ ID NO: 1579538 - RNA, 22 nt, Homo sapiens
uggguuuggcaaaacucaggca

SEQ ID NO: 1579539 - RNA, 18 nt, Homo sapiens
ugguaaaacucacuguga

SEQ ID NO: 1579540 - RNA, 20 nt, Homo sapiens
ugguaaaacucacugugauc

SEQ ID NO: 1579541 - RNA, 17 nt, Homo sapiens
ugguaaccagcccugca

SEQ ID NO: 1579542 - RNA, 19 nt, Homo sapiens
ugguaacugcuuucuguuc

SEQ ID NO: 1579543 - RNA, 23 nt, Homo sapiens
ugguaagguguguacucagggca

SEQ ID NO: 1579544 - RNA, 14 nt, Homo sapiens
ugguacaaggaaua

SEQ ID NO: 1579545 - RNA, 17 nt, Homo sapiens
ugguacccgcccuuccg

SEQ ID NO: 1579546 - RNA, 18 nt, Homo sapiens
ugguacuaccccagccau

SEQ ID NO: 1579547 - RNA, 12 nt, Homo sapiens
ugguacugugau

SEQ ID NO: 1579548 - RNA, 18 nt, Homo sapiens
ugguagaggggagacauu

SEQ ID NO: 1579549 - RNA, 22 nt, Homo sapiens
ugguaggaucaccugaggucag

SEQ ID NO: 1579550 - RNA, 21 nt, Homo sapiens
ugguaguuuuacaguguuucu

SEQ ID NO: 1579551 - RNA, 14 nt, Homo sapiens
uggucagagugcca

SEQ ID NO: 1579552 - RNA, 15 nt, Homo sapiens
uggucagagugccac

SEQ ID NO: 1579553 - RNA, 23 nt, Homo sapiens
uggucauccgggaggacaaccag

SEQ ID NO: 1579554 - RNA, 18 nt, Homo sapiens
uggucauuuccuaugcaa

SEQ ID NO: 1579555 - RNA, 17 nt, Homo sapiens
uggucccaggcuuccca

SEQ ID NO: 1579556 - RNA, 14 nt, Homo sapiens
ugguccuugaacaa

SEQ ID NO: 1579557 - RNA, 20 nt, Homo sapiens
uggucuaagguucagccuga

SEQ ID NO: 1579558 - RNA, 23 nt, Homo sapiens
uggucucaaacucccgaccucag

SEQ ID NO: 1579559 - RNA, 15 nt, Homo sapiens
uggugaaaagcucca

SEQ ID NO: 1579560 - RNA, 19 nt, Homo sapiens
uggugaaacccccaucucu

SEQ ID NO: 1579561 - RNA, 14 nt, Homo sapiens
uggugaacuccacc

SEQ ID NO: 1579562 - RNA, 16 nt, Homo sapiens
uggugaauauaaauga

SEQ ID NO: 1579563 - RNA, 16 nt, Homo sapiens
uggugaccccauacau

SEQ ID NO: 1579564 - RNA, 16 nt, Homo sapiens
uggugaccuuucacga

SEQ ID NO: 1579565 - RNA, 14 nt, Homo sapiens
uggugaggcaauaa

SEQ ID NO: 1579566 - RNA, 22 nt, Homo sapiens
uggugcaggucuccaccugcac

SEQ ID NO: 1579567 - RNA, 21 nt, Homo sapiens
uggugcaugccuguagucuca

SEQ ID NO: 1579568 - RNA, 18 nt, Homo sapiens
uggugccugcacacagag

SEQ ID NO: 1579569 - RNA, 13 nt, Homo sapiens
uggugcucauuua

SEQ ID NO: 1579570 - RNA, 14 nt, Homo sapiens
uggugcucauuuaa

SEQ ID NO: 1579571 - RNA, 20 nt, Homo sapiens
uggugcuuuauaauguauac

SEQ ID NO: 1579572 - RNA, 23 nt, Homo sapiens
ugguggacucgccuguaaucuca

SEQ ID NO: 1579573 - RNA, 15 nt, Homo sapiens
ugguggagcagagug

SEQ ID NO: 1579574 - RNA, 15 nt, Homo sapiens
ugguggagggccaca

SEQ ID NO: 1579575 - RNA, 20 nt, Homo sapiens
ugguggcaacauucauugcc

SEQ ID NO: 1579576 - RNA, 24 nt, Homo sapiens
ugguggcacaggaguguccucuuc

SEQ ID NO: 1579577 - RNA, 17 nt, Homo sapiens
ugguggcauuguuuaca

SEQ ID NO: 1579578 - RNA, 15 nt, Homo sapiens
ugguggccagcagca

SEQ ID NO: 1579579 - RNA, 14 nt, Homo sapiens
uggugucaguaucc

SEQ ID NO: 1579580 - RNA, 21 nt, Homo sapiens
uggugucccgguaccuuccau

SEQ ID NO: 1579581 - RNA, 16 nt, Homo sapiens
uggugucugugacauu

SEQ ID NO: 1579582 - RNA, 13 nt, Homo sapiens
uggugugaccuga

SEQ ID NO: 1579583 - RNA, 13 nt, Homo sapiens
ugguguguucaag

SEQ ID NO: 1579584 - RNA, 15 nt, Homo sapiens
ugguuaaaacauagc

SEQ ID NO: 1579585 - RNA, 13 nt, Homo sapiens
ugguuaacagagc

SEQ ID NO: 1579586 - RNA, 15 nt, Homo sapiens
ugguuauauguauau

SEQ ID NO: 1579587 - RNA, 19 nt, Homo sapiens
ugguucaggaaaacuacug

SEQ ID NO: 1579588 - RNA, 23 nt, Homo sapiens
ugguucauauuuauacuuugcaa

SEQ ID NO: 1579589 - RNA, 15 nt, Homo sapiens
ugguucucaucuuuc

SEQ ID NO: 1579590 - RNA, 12 nt, Homo sapiens
ugguucuuucag

SEQ ID NO: 1579591 - RNA, 20 nt, Homo sapiens
ugguugaaaccccaucucua

SEQ ID NO: 1579592 - RNA, 14 nt, Homo sapiens
ugguuuaaagucac

SEQ ID NO: 1579593 - RNA, 14 nt, Homo sapiens
ugguuucauuugaa

SEQ ID NO: 1579594 - RNA, 17 nt, Homo sapiens
ugguuugugaauccauc

SEQ ID NO: 1579595 - RNA, 17 nt, Homo sapiens
ugguuuuaaaaaagcau

SEQ ID NO: 1579596 - RNA, 16 nt, Homo sapiens
ugguuuuaaaagagaa

SEQ ID NO: 1579597 - RNA, 17 nt, Homo sapiens
ugguuuuccaugaccuu

SEQ ID NO: 1579598 - RNA, 19 nt, Homo sapiens
ugguuuuuuuuugagacag

SEQ ID NO: 1579599 - RNA, 13 nt, Homo sapiens
uguaaaaaaugga

SEQ ID NO: 1579600 - RNA, 20 nt, Homo sapiens
uguaaaaauccuuuugaaug

SEQ ID NO: 1579601 - RNA, 14 nt, Homo sapiens
uguaaaacaaagag

SEQ ID NO: 1579602 - RNA, 20 nt, Homo sapiens
uguaaaacacaccaaucagc

SEQ ID NO: 1579603 - RNA, 13 nt, Homo sapiens
uguaaaaugcacc

SEQ ID NO: 1579604 - RNA, 13 nt, Homo sapiens
uguaaacuaguac

SEQ ID NO: 1579605 - RNA, 15 nt, Homo sapiens
uguaaacugugcacc

SEQ ID NO: 1579606 - RNA, 20 nt, Homo sapiens
uguaaacuuuuugugcugaa

SEQ ID NO: 1579607 - RNA, 17 nt, Homo sapiens
uguaaagaagggauauu

SEQ ID NO: 1579608 - RNA, 15 nt, Homo sapiens
uguaaaggccuuuaa

SEQ ID NO: 1579609 - RNA, 20 nt, Homo sapiens
uguaaaguaaaagcuauaaa

SEQ ID NO: 1579610 - RNA, 13 nt, Homo sapiens
uguaaaguucaau

SEQ ID NO: 1579611 - RNA, 18 nt, Homo sapiens
uguaaaguugguuggaua

SEQ ID NO: 1579612 - RNA, 19 nt, Homo sapiens
uguaaaguugguuggauaa

SEQ ID NO: 1579613 - RNA, 22 nt, Homo sapiens
uguaaauagagcaaccuauaua

SEQ ID NO: 1579614 - RNA, 14 nt, Homo sapiens
uguaaauaugcaaa

SEQ ID NO: 1579615 - RNA, 13 nt, Homo sapiens
uguaaaugcauau

SEQ ID NO: 1579616 - RNA, 19 nt, Homo sapiens
uguaaauguguuagcacug

SEQ ID NO: 1579617 - RNA, 16 nt, Homo sapiens
uguaaauuuaugugau

SEQ ID NO: 1579618 - RNA, 13 nt, Homo sapiens
uguaacagcauua

SEQ ID NO: 1579619 - RNA, 17 nt, Homo sapiens
uguaaccagaauuauac

SEQ ID NO: 1579620 - RNA, 16 nt, Homo sapiens
uguaaccgauaugcac

SEQ ID NO: 1579621 - RNA, 19 nt, Homo sapiens
uguaacuguaaaacauuga

SEQ ID NO: 1579622 - RNA, 17 nt, Homo sapiens
uguaacuuaacuauuaa

SEQ ID NO: 1579623 - RNA, 15 nt, Homo sapiens
uguaagaaaauguua

SEQ ID NO: 1579624 - RNA, 13 nt, Homo sapiens
uguaagaacugua

SEQ ID NO: 1579625 - RNA, 16 nt, Homo sapiens
uguaagcauacuuugu

SEQ ID NO: 1579626 - RNA, 13 nt, Homo sapiens
uguaauaaaguga

SEQ ID NO: 1579627 - RNA, 14 nt, Homo sapiens
uguaauaaagugaa

SEQ ID NO: 1579628 - RNA, 15 nt, Homo sapiens
uguaauaaguaucac

SEQ ID NO: 1579629 - RNA, 21 nt, Homo sapiens
uguaauaaguaucacacugua

SEQ ID NO: 1579630 - RNA, 16 nt, Homo sapiens
uguaauacauauagca

SEQ ID NO: 1579631 - RNA, 12 nt, Homo sapiens
uguaauaccaga

SEQ ID NO: 1579632 - RNA, 19 nt, Homo sapiens
uguaauauuuacaauguau

SEQ ID NO: 1579633 - RNA, 17 nt, Homo sapiens
uguaaucccagcacuuu

SEQ ID NO: 1579634 - RNA, 18 nt, Homo sapiens
uguaauccuaaauuuacc

SEQ ID NO: 1579635 - RNA, 12 nt, Homo sapiens
uguaaucucagc

SEQ ID NO: 1579636 - RNA, 13 nt, Homo sapiens
uguaaugauacug

SEQ ID NO: 1579637 - RNA, 15 nt, Homo sapiens
uguaauggaaaccaa

SEQ ID NO: 1579638 - RNA, 16 nt, Homo sapiens
uguaauguucauuucc

SEQ ID NO: 1579639 - RNA, 21 nt, Homo sapiens
uguaauuuauuaacuaaucaa

SEQ ID NO: 1579640 - RNA, 21 nt, Homo sapiens
uguaauuucgccuuaaacucu

SEQ ID NO: 1579641 - RNA, 20 nt, Homo sapiens
uguacacacuuuauuuacuu

SEQ ID NO: 1579642 - RNA, 23 nt, Homo sapiens
uguacagaggucagcacacauua

SEQ ID NO: 1579643 - RNA, 16 nt, Homo sapiens
uguacagcaguucaca

SEQ ID NO: 1579644 - RNA, 14 nt, Homo sapiens
uguacagucuugua

SEQ ID NO: 1579645 - RNA, 23 nt, Homo sapiens
uguacaucuauuuuggauuguau

SEQ ID NO: 1579646 - RNA, 17 nt, Homo sapiens
uguacaugugcuugcca

SEQ ID NO: 1579647 - RNA, 14 nt, Homo sapiens
uguacauucuucca

SEQ ID NO: 1579648 - RNA, 16 nt, Homo sapiens
uguacccgagcacaua

SEQ ID NO: 1579649 - RNA, 22 nt, Homo sapiens
uguacccuaaaacuuaaaguau

SEQ ID NO: 1579650 - RNA, 15 nt, Homo sapiens
uguaccucacugucc

SEQ ID NO: 1579651 - RNA, 22 nt, Homo sapiens
uguaccucacuguccaauauga

SEQ ID NO: 1579652 - RNA, 19 nt, Homo sapiens
ugugaggagguagauuugg

SEQ ID NO: 1579653 - RNA, 18 nt, Homo sapiens
ugugagucuucacuaaaa

SEQ ID NO: 1579654 - RNA, 16 nt, Homo sapiens
ugugauguuuguccug

SEQ ID NO: 1579655 - RNA, 19 nt, Homo sapiens
ugugauucaaucuguaaac

SEQ ID NO: 1579656 - RNA, 19 nt, Homo sapiens
ugugauuuggaccauggca

SEQ ID NO: 1579657 - RNA, 13 nt, Homo sapiens
ugugcacauguac

SEQ ID NO: 1579658 - RNA, 16 nt, Homo sapiens
ugugcaccaauuauca

SEQ ID NO: 1579659 - RNA, 21 nt, Homo sapiens
ugugcaccaauuaucaucuuu

SEQ ID NO: 1579660 - RNA, 13 nt, Homo sapiens
ugugcauaaugcu

SEQ ID NO: 1579661 - RNA, 23 nt, Homo sapiens
ugugcauaaugcuuuggaaaaau

SEQ ID NO: 1579662 - RNA, 22 nt, Homo sapiens
ugugcauacuuucccucaucca

SEQ ID NO: 1579663 - RNA, 20 nt, Homo sapiens
ugugcaugaaagagaaagac

SEQ ID NO: 1579664 - RNA, 14 nt, Homo sapiens
ugugccaauacaga

SEQ ID NO: 1579665 - RNA, 17 nt, Homo sapiens
ugugccaauacagacaa

SEQ ID NO: 1579666 - RNA, 13 nt, Homo sapiens
ugugccaccucau

SEQ ID NO: 1579667 - RNA, 14 nt, Homo sapiens
ugugccaucagcuc

SEQ ID NO: 1579668 - RNA, 20 nt, Homo sapiens
ugugccauggaugauucuuu

SEQ ID NO: 1579669 - RNA, 18 nt, Homo sapiens
ugugcucagagaccccuc

SEQ ID NO: 1579670 - RNA, 19 nt, Homo sapiens
ugugcugcaccuggucaua

SEQ ID NO: 1579671 - RNA, 22 nt, Homo sapiens
ugugcuuuuugggaccaucacu

SEQ ID NO: 1579672 - RNA, 19 nt, Homo sapiens
uguggaauugacucaaaaa

SEQ ID NO: 1579673 - RNA, 20 nt, Homo sapiens
uguggaauugacucaaaaau

SEQ ID NO: 1579674 - RNA, 16 nt, Homo sapiens
uguggagcacguggag

SEQ ID NO: 1579675 - RNA, 21 nt, Homo sapiens
uguggaucaaccaucgcuuua

SEQ ID NO: 1579676 - RNA, 14 nt, Homo sapiens
uguggaugcugcug

SEQ ID NO: 1579677 - RNA, 19 nt, Homo sapiens
uguggcagaucuacauguc

SEQ ID NO: 1579678 - RNA, 13 nt, Homo sapiens
uguggcagugguu

SEQ ID NO: 1579679 - RNA, 15 nt, Homo sapiens
ugugggcacgugugg

SEQ ID NO: 1579680 - RNA, 23 nt, Homo sapiens
uguggggccucaggcuccgggca

SEQ ID NO: 1579681 - RNA, 18 nt, Homo sapiens
uguggggugggcacauug

SEQ ID NO: 1579682 - RNA, 22 nt, Homo sapiens
ugugguaaccagcccugcacga

SEQ ID NO: 1579683 - RNA, 17 nt, Homo sapiens
ugugguaaucuacacca

SEQ ID NO: 1579684 - RNA, 16 nt, Homo sapiens
uguggucacagcugua

SEQ ID NO: 1579685 - RNA, 17 nt, Homo sapiens
uguggugauuggccaca

SEQ ID NO: 1579686 - RNA, 14 nt, Homo sapiens
ugugguuccucugc

SEQ ID NO: 1579687 - RNA, 23 nt, Homo sapiens
ugugguuugggcuccacauugca

SEQ ID NO: 1579688 - RNA, 22 nt, Homo sapiens
uguguaaauacuucaauaaagc

SEQ ID NO: 1579689 - RNA, 22 nt, Homo sapiens
uguguaacuguaaaacauugaa

SEQ ID NO: 1579690 - RNA, 15 nt, Homo sapiens
uguguacucagggca

SEQ ID NO: 1579691 - RNA, 16 nt, Homo sapiens
uguguacugcaguugg

SEQ ID NO: 1579692 - RNA, 23 nt, Homo sapiens
uguguauccaugcaccuaccuua

SEQ ID NO: 1579693 - RNA, 9 nt, Homo sapiens
uguguaugu

SEQ ID NO: 1579694 - RNA, 16 nt, Homo sapiens
uguguauuagauauca

SEQ ID NO: 1579695 - RNA, 13 nt, Homo sapiens
ugugucauguaua

SEQ ID NO: 1579696 - RNA, 23 nt, Homo sapiens
uguguccacugcaauugguggua

SEQ ID NO: 1579697 - RNA, 18 nt, Homo sapiens
ugugucccccucugucca

SEQ ID NO: 1579698 - RNA, 17 nt, Homo sapiens
ugugugaacacgugugu

SEQ ID NO: 1579699 - RNA, 23 nt, Homo sapiens
ugugugacuuugggcaagccaag

SEQ ID NO: 1579700 - RNA, 20 nt, Homo sapiens
ugugugaggcucuguccuaa

SEQ ID NO: 1579701 - RNA, 19 nt, Homo sapiens
ugugugcucacaauguucu

SEQ ID NO: 1579702 - RNA, 14 nt, Homo sapiens
ugugugcuuuccca

SEQ ID NO: 1579703 - RNA, 17 nt, Homo sapiens
ugugugggcacgugugg

SEQ ID NO: 1579704 - RNA, 19 nt, Homo sapiens
uguguggucaacauuucuc

SEQ ID NO: 1579705 - RNA, 15 nt, Homo sapiens
ugugugugaaccacu

SEQ ID NO: 1579706 - RNA, 12 nt, Homo sapiens
uguguguggcag

SEQ ID NO: 1579707 - RNA, 14 nt, Homo sapiens
ugugugugugugaa

SEQ ID NO: 1579708 - RNA, 16 nt, Homo sapiens
ugugugugugugcaca

SEQ ID NO: 1579709 - RNA, 15 nt, Homo sapiens
uguguuagcacugau

SEQ ID NO: 1579710 - RNA, 14 nt, Homo sapiens
uguguucugucacc

SEQ ID NO: 1579711 - RNA, 21 nt, Homo sapiens
uguguuuauauggaagaaagu

SEQ ID NO: 1579712 - RNA, 18 nt, Homo sapiens
uguguuuugaaagcccaa

SEQ ID NO: 1579713 - RNA, 18 nt, Homo sapiens
uguuaaaaaaaaugauaa

SEQ ID NO: 1579714 - RNA, 23 nt, Homo sapiens
uguuaacaccuaccucacagggu

SEQ ID NO: 1579715 - RNA, 23 nt, Homo sapiens
uguuaaccucugcuuuuaucuca

SEQ ID NO: 1579716 - RNA, 19 nt, Homo sapiens
uguuaauuuuuugguacaa

SEQ ID NO: 1579717 - RNA, 22 nt, Homo sapiens
uguuacauuauuccaaugauac

SEQ ID NO: 1579718 - RNA, 20 nt, Homo sapiens
uguuaccugaaaacacugug

SEQ ID NO: 1579719 - RNA, 14 nt, Homo sapiens
uguuaccuguagau

SEQ ID NO: 1579720 - RNA, 14 nt, Homo sapiens
uguuaccuucacau

SEQ ID NO: 1579721 - RNA, 21 nt, Homo sapiens
uguuacuauaccuaccauuua

SEQ ID NO: 1579722 - RNA, 22 nt, Homo sapiens
uguuacucucuuccacauguua

SEQ ID NO: 1579723 - RNA, 19 nt, Homo sapiens
uguuagaugcuuaguguga

SEQ ID NO: 1579724 - RNA, 16 nt, Homo sapiens
uguuauagaacuucau

SEQ ID NO: 1579725 - RNA, 14 nt, Homo sapiens
uguuauaucaggga

SEQ ID NO: 1579726 - RNA, 15 nt, Homo sapiens
uguuauaucagggaa

SEQ ID NO: 1579727 - RNA, 17 nt, Homo sapiens
uguuauauucagugugu

SEQ ID NO: 1579728 - RNA, 15 nt, Homo sapiens
uguuaugaacaucca

SEQ ID NO: 1579729 - RNA, 18 nt, Homo sapiens
uguuaugcuccugcugau

SEQ ID NO: 1579730 - RNA, 18 nt, Homo sapiens
uguuauugguaccucuca

SEQ ID NO: 1579731 - RNA, 19 nt, Homo sapiens
uguucacaacagugaaaag

SEQ ID NO: 1579732 - RNA, 17 nt, Homo sapiens
uguuccaggauguggaa

SEQ ID NO: 1579733 - RNA, 22 nt, Homo sapiens
uguuccaugaaggcagagccau

SEQ ID NO: 1579734 - RNA, 17 nt, Homo sapiens
uguucccgugccuggga

SEQ ID NO: 1579735 - RNA, 16 nt, Homo sapiens
uguuccugacuuuaua

SEQ ID NO: 1579736 - RNA, 15 nt, Homo sapiens
uguucuuaacacuuc

SEQ ID NO: 1579737 - RNA, 15 nt, Homo sapiens
uguucuugaauuaua

SEQ ID NO: 1579738 - RNA, 20 nt, Homo sapiens
uguucuuuaagaguuuaaaa

SEQ ID NO: 1579739 - RNA, 15 nt, Homo sapiens
uguugaaacuuugaa

SEQ ID NO: 1579740 - RNA, 16 nt, Homo sapiens
uguugaagcacuguug

SEQ ID NO: 1579741 - RNA, 18 nt, Homo sapiens
uguugaaggaacuugucu

SEQ ID NO: 1579742 - RNA, 14 nt, Homo sapiens
uguugacugugauu

SEQ ID NO: 1579743 - RNA, 12 nt, Homo sapiens
uguugcacugaa

SEQ ID NO: 1579744 - RNA, 16 nt, Homo sapiens
uguugccaaaaccaaa

SEQ ID NO: 1579745 - RNA, 17 nt, Homo sapiens
uguugccuucaucuuca

SEQ ID NO: 1579746 - RNA, 21 nt, Homo sapiens
uguugcguucaaagaggugaa

SEQ ID NO: 1579747 - RNA, 13 nt, Homo sapiens
uguugggucagug

SEQ ID NO: 1579748 - RNA, 17 nt, Homo sapiens
uguuguacauacagagg

SEQ ID NO: 1579749 - RNA, 17 nt, Homo sapiens
uguugugcagcauuaaa

SEQ ID NO: 1579750 - RNA, 17 nt, Homo sapiens
uguuuacaugaguucaa

SEQ ID NO: 1579751 - RNA, 23 nt, Homo sapiens
uguuuaccauagaaagaugacaa

SEQ ID NO: 1579752 - RNA, 12 nt, Homo sapiens
uguuuacucauu

SEQ ID NO: 1579753 - RNA, 17 nt, Homo sapiens
uguuuagaaagaauauu

SEQ ID NO: 1579754 - RNA, 14 nt, Homo sapiens
uguuuauagcaaaa

SEQ ID NO: 1579755 - RNA, 21 nt, Homo sapiens
uguuucaaaauagacaaguuu

SEQ ID NO: 1579756 - RNA, 13 nt, Homo sapiens
uguuucagagcau

SEQ ID NO: 1579757 - RNA, 14 nt, Homo sapiens
uguuuccacacuua

SEQ ID NO: 1579758 - RNA, 17 nt, Homo sapiens
uguuucccccacaguuu

SEQ ID NO: 1579759 - RNA, 12 nt, Homo sapiens
uguuuccugaca

SEQ ID NO: 1579760 - RNA, 16 nt, Homo sapiens
uguuugcccauuuuca

SEQ ID NO: 1579761 - RNA, 16 nt, Homo sapiens
uguuuggaaaagacag

SEQ ID NO: 1579762 - RNA, 23 nt, Homo sapiens
uguuuguuuauaucacugucuag

SEQ ID NO: 1579763 - RNA, 23 nt, Homo sapiens
uguuuuaaagaauaugacuuuuu

SEQ ID NO: 1579764 - RNA, 19 nt, Homo sapiens
uguuuucaagaugguguua

SEQ ID NO: 1579765 - RNA, 22 nt, Homo sapiens
uguuuucaauguuucacuacuc

SEQ ID NO: 1579766 - RNA, 16 nt, Homo sapiens
uguuuucauuuuacug

SEQ ID NO: 1579767 - RNA, 16 nt, Homo sapiens
uguuuuccacugugcu

SEQ ID NO: 1579768 - RNA, 23 nt, Homo sapiens
uguuuucuguagacucuaagaua

SEQ ID NO: 1579769 - RNA, 15 nt, Homo sapiens
uguuuucuuugcaaa

SEQ ID NO: 1579770 - RNA, 15 nt, Homo sapiens
acgguguuuugccau

SEQ ID NO: 1579771 - RNA, 14 nt, Homo sapiens
acguaaacuaugac

SEQ ID NO: 1579772 - RNA, 22 nt, Homo sapiens
acguagccugggcucacugugc

SEQ ID NO: 1579773 - RNA, 19 nt, Homo sapiens
acgucacguuggucuugaa

SEQ ID NO: 1579774 - RNA, 18 nt, Homo sapiens
acgucagcugggacaccc

SEQ ID NO: 1579775 - RNA, 14 nt, Homo sapiens
acgucuaacuggaa

SEQ ID NO: 1579776 - RNA, 18 nt, Homo sapiens
acgugauuuugcuguaga

SEQ ID NO: 1579777 - RNA, 16 nt, Homo sapiens
acgugccagcucuagu

SEQ ID NO: 1579778 - RNA, 14 nt, Homo sapiens
acgugguaauaauu

SEQ ID NO: 1579779 - RNA, 16 nt, Homo sapiens
acgugguagucacuug

SEQ ID NO: 1579780 - RNA, 20 nt, Homo sapiens
acgugguaugaaaugucuga

SEQ ID NO: 1579781 - RNA, 23 nt, Homo sapiens
acgugugugugugugcacaucua

SEQ ID NO: 1579782 - RNA, 13 nt, Homo sapiens
acguuaugaugac

SEQ ID NO: 1579783 - RNA, 11 nt, Homo sapiens
acguugcccaa

SEQ ID NO: 1579784 - RNA, 17 nt, Homo sapiens
acuaaaacacacaggug

SEQ ID NO: 1579785 - RNA, 15 nt, Homo sapiens
acuaaacuacauuau

SEQ ID NO: 1579786 - RNA, 17 nt, Homo sapiens
acuaaauaugugacuga

SEQ ID NO: 1579787 - RNA, 16 nt, Homo sapiens
acuaaaucaaucugca

SEQ ID NO: 1579788 - RNA, 23 nt, Homo sapiens
acuaaaucaaucugcaguuuaac

SEQ ID NO: 1579789 - RNA, 17 nt, Homo sapiens
acuaacacuuuaguuau

SEQ ID NO: 1579790 - RNA, 16 nt, Homo sapiens
acuaacaggccaaaga

SEQ ID NO: 1579791 - RNA, 19 nt, Homo sapiens
acuaaccaaacaaugcaga

SEQ ID NO: 1579792 - RNA, 22 nt, Homo sapiens
acuaaccaucugaagaaacuuc

SEQ ID NO: 1579793 - RNA, 19 nt, Homo sapiens
acuaagaaaaaaagcacaa

SEQ ID NO: 1579794 - RNA, 20 nt, Homo sapiens
acuaagagaaggggugcaga

SEQ ID NO: 1579795 - RNA, 19 nt, Homo sapiens
acuaaggcagcuaagacau

SEQ ID NO: 1579796 - RNA, 22 nt, Homo sapiens
acuaaucaagaaaaacaucuuu

SEQ ID NO: 1579797 - RNA, 21 nt, Homo sapiens
acuaaugaaguauuacaugau

SEQ ID NO: 1579798 - RNA, 21 nt, Homo sapiens
acuacacacuguguacugcag

SEQ ID NO: 1579799 - RNA, 21 nt, Homo sapiens
acuacaccuggcugagguucc

SEQ ID NO: 1579800 - RNA, 14 nt, Homo sapiens
acuacagaauauua

SEQ ID NO: 1579801 - RNA, 19 nt, Homo sapiens
acuacaggagaugcuguca

SEQ ID NO: 1579802 - RNA, 22 nt, Homo sapiens
acuacaggagaugcugucacuu

SEQ ID NO: 1579803 - RNA, 17 nt, Homo sapiens
acuacaggcucaugcca

SEQ ID NO: 1579804 - RNA, 13 nt, Homo sapiens
acuacaucugccu

SEQ ID NO: 1579805 - RNA, 17 nt, Homo sapiens
acuacauugaguagaca

SEQ ID NO: 1579806 - RNA, 24 nt, Homo sapiens
acuacauuuuaaaaacugacuuaa

SEQ ID NO: 1579807 - RNA, 14 nt, Homo sapiens
acuacuaaggccuu

SEQ ID NO: 1579808 - RNA, 19 nt, Homo sapiens
acuacucagcucuccugcu

SEQ ID NO: 1579809 - RNA, 22 nt, Homo sapiens
acuacuccucugcagugccuug

SEQ ID NO: 1579810 - RNA, 19 nt, Homo sapiens
acuacuccugaggaugcua

SEQ ID NO: 1579811 - RNA, 15 nt, Homo sapiens
acuacucugugccag

SEQ ID NO: 1579812 - RNA, 14 nt, Homo sapiens
acuacugcauuuau

SEQ ID NO: 1579813 - RNA, 20 nt, Homo sapiens
acuagaaagaaggacccaga

SEQ ID NO: 1579814 - RNA, 15 nt, Homo sapiens
acuagccagcacaaa

SEQ ID NO: 1579815 - RNA, 15 nt, Homo sapiens
acuagggaucccuca

SEQ ID NO: 1579816 - RNA, 16 nt, Homo sapiens
acuaguuuucaaucau

SEQ ID NO: 1579817 - RNA, 16 nt, Homo sapiens
acuauaaaagcuuucu

SEQ ID NO: 1579818 - RNA, 15 nt, Homo sapiens
acuaucuuugcugca

SEQ ID NO: 1579819 - RNA, 19 nt, Homo sapiens
acuaugaagcuaccucaaa

SEQ ID NO: 1579820 - RNA, 13 nt, Homo sapiens
acuaugacaucua

SEQ ID NO: 1579821 - RNA, 14 nt, Homo sapiens
acuaugauuauuaa

SEQ ID NO: 1579822 - RNA, 21 nt, Homo sapiens
acuauggagcugagcaggugu

SEQ ID NO: 1579823 - RNA, 15 nt, Homo sapiens
acuauggagucuugu

SEQ ID NO: 1579824 - RNA, 17 nt, Homo sapiens
acuauggagucuuguga

SEQ ID NO: 1579825 - RNA, 18 nt, Homo sapiens
acuauggauguguucucu

SEQ ID NO: 1579826 - RNA, 18 nt, Homo sapiens
acuaugggcagcccagug

SEQ ID NO: 1579827 - RNA, 13 nt, Homo sapiens
acuauuaguauua

SEQ ID NO: 1579828 - RNA, 21 nt, Homo sapiens
acuauuuaaaggaaaaucaca

SEQ ID NO: 1579829 - RNA, 22 nt, Homo sapiens
acuauuuauaucacacaauaua

SEQ ID NO: 1579830 - RNA, 15 nt, Homo sapiens
acuauuuauuuacau

SEQ ID NO: 1579831 - RNA, 19 nt, Homo sapiens
acuauuuauuuacauauuu

SEQ ID NO: 1579832 - RNA, 22 nt, Homo sapiens
acucaaaccacauggaccacga

SEQ ID NO: 1579833 - RNA, 12 nt, Homo sapiens
acucaacuuuca

SEQ ID NO: 1579834 - RNA, 22 nt, Homo sapiens
acucaaggacagccaccaagaa

SEQ ID NO: 1579835 - RNA, 20 nt, Homo sapiens
acucaaguaccaccaaggga

SEQ ID NO: 1579836 - RNA, 22 nt, Homo sapiens
acucacaccuguaaucccagca

SEQ ID NO: 1579837 - RNA, 16 nt, Homo sapiens
acucacagcaaggaug

SEQ ID NO: 1579838 - RNA, 19 nt, Homo sapiens
acucacccugggagccagu

SEQ ID NO: 1579839 - RNA, 17 nt, Homo sapiens
acucaccucugccucaa

SEQ ID NO: 1579840 - RNA, 17 nt, Homo sapiens
acucacucauuccuuca

SEQ ID NO: 1579841 - RNA, 12 nt, Homo sapiens
acucacugugau

SEQ ID NO: 1579842 - RNA, 19 nt, Homo sapiens
acucacuucaaugugucau

SEQ ID NO: 1579843 - RNA, 14 nt, Homo sapiens
acucagaaagccaa

SEQ ID NO: 1579844 - RNA, 15 nt, Homo sapiens
acucagaaagccaac

SEQ ID NO: 1579845 - RNA, 23 nt, Homo sapiens
acucagaaagccaacauguggcu

SEQ ID NO: 1579846 - RNA, 20 nt, Homo sapiens
acucagaaauguaguuugca

SEQ ID NO: 1579847 - RNA, 21 nt, Homo sapiens
acucagaacuucugccucuaa

SEQ ID NO: 1579848 - RNA, 14 nt, Homo sapiens
acucagagguccag

SEQ ID NO: 1579849 - RNA, 13 nt, Homo sapiens
acucagcacauuc

SEQ ID NO: 1579850 - RNA, 21 nt, Homo sapiens
acucagcacauucgggaccaa

SEQ ID NO: 1579851 - RNA, 14 nt, Homo sapiens
acucagcagcagag

SEQ ID NO: 1579852 - RNA, 16 nt, Homo sapiens
acucagggagcauuua

SEQ ID NO: 1579853 - RNA, 15 nt, Homo sapiens
acucaguagccauau

SEQ ID NO: 1579854 - RNA, 12 nt, Homo sapiens
acucaguauuau

SEQ ID NO: 1579855 - RNA, 17 nt, Homo sapiens
acucauccauccccugg

SEQ ID NO: 1579856 - RNA, 12 nt, Homo sapiens
acucauccugau

SEQ ID NO: 1579857 - RNA, 17 nt, Homo sapiens
acucauuugaaugcuua

SEQ ID NO: 1579858 - RNA, 23 nt, Homo sapiens
acucauuugaaugcuuaauucaa

SEQ ID NO: 1579859 - RNA, 16 nt, Homo sapiens
acuccaaaauguuggu

SEQ ID NO: 1579860 - RNA, 17 nt, Homo sapiens
acuccacuccacacucu

SEQ ID NO: 1579861 - RNA, 23 nt, Homo sapiens
acuccagccugagcgacagugag

SEQ ID NO: 1579862 - RNA, 19 nt, Homo sapiens
acuccaggggggacaauau

SEQ ID NO: 1579863 - RNA, 22 nt, Homo sapiens
acuccaucuugguaguucugug

SEQ ID NO: 1579864 - RNA, 19 nt, Homo sapiens
acuccaugcuccuugagag

SEQ ID NO: 1579865 - RNA, 18 nt, Homo sapiens
acuccauguuaaucacau

SEQ ID NO: 1579866 - RNA, 20 nt, Homo sapiens
acuccauucaaaucuacggu

SEQ ID NO: 1579867 - RNA, 15 nt, Homo sapiens
acucccacuuggcau

SEQ ID NO: 1579868 - RNA, 14 nt, Homo sapiens
acucccagcacuuu

SEQ ID NO: 1579869 - RNA, 23 nt, Homo sapiens
acucccaugagggagaugccaug

SEQ ID NO: 1579870 - RNA, 14 nt, Homo sapiens
acuccccguguuca

SEQ ID NO: 1579871 - RNA, 20 nt, Homo sapiens
acuccggccugggugacaga

SEQ ID NO: 1579872 - RNA, 14 nt, Homo sapiens
acuccuacugaguu

SEQ ID NO: 1579873 - RNA, 20 nt, Homo sapiens
acuccuauaaggagaguuca

SEQ ID NO: 1579874 - RNA, 19 nt, Homo sapiens
acuccuauggucacagacu

SEQ ID NO: 1579875 - RNA, 21 nt, Homo sapiens
acuccucauccccacaaucug

SEQ ID NO: 1579876 - RNA, 18 nt, Homo sapiens
acuccugggacacuccgu

SEQ ID NO: 1579877 - RNA, 13 nt, Homo sapiens
acuccuuccauca

SEQ ID NO: 1579878 - RNA, 14 nt, Homo sapiens
acuccuuccaucuc

SEQ ID NO: 1579879 - RNA, 15 nt, Homo sapiens
acucgagaacuuuca

SEQ ID NO: 1579880 - RNA, 18 nt, Homo sapiens
acucggccccuccucaau

SEQ ID NO: 1579881 - RNA, 22 nt, Homo sapiens
acucgggaccaauacuacugac

SEQ ID NO: 1579882 - RNA, 19 nt, Homo sapiens
acucuaaggcuaagcaucu

SEQ ID NO: 1579883 - RNA, 20 nt, Homo sapiens
acucuaccugcaagauuuca

SEQ ID NO: 1579884 - RNA, 15 nt, Homo sapiens
acucuacuucaagaa

SEQ ID NO: 1579885 - RNA, 21 nt, Homo sapiens
acucuacuucccaguaacccu

SEQ ID NO: 1579886 - RNA, 15 nt, Homo sapiens
acucuagaaaaaagg

SEQ ID NO: 1579887 - RNA, 16 nt, Homo sapiens
acucuaggguccagug

SEQ ID NO: 1579888 - RNA, 20 nt, Homo sapiens
acucuaggguccaguggaug

SEQ ID NO: 1579889 - RNA, 20 nt, Homo sapiens
acucuaucauuggccuccaa

SEQ ID NO: 1579890 - RNA, 13 nt, Homo sapiens
acucucaaaucca

SEQ ID NO: 1579891 - RNA, 15 nt, Homo sapiens
acucucaaauccaaa

SEQ ID NO: 1579892 - RNA, 16 nt, Homo sapiens
acucucaaauccaaaa

SEQ ID NO: 1579893 - RNA, 20 nt, Homo sapiens
acucuccaauguucuauuaa

SEQ ID NO: 1579894 - RNA, 18 nt, Homo sapiens
acucuccccuucuucccc

SEQ ID NO: 1579895 - RNA, 14 nt, Homo sapiens
acucuccccuuguc

SEQ ID NO: 1579896 - RNA, 12 nt, Homo sapiens
acucucugccau

SEQ ID NO: 1579897 - RNA, 21 nt, Homo sapiens
acucucuguggucccuuccaa

SEQ ID NO: 1579898 - RNA, 16 nt, Homo sapiens
acucugcauccagaga

SEQ ID NO: 1579899 - RNA, 12 nt, Homo sapiens
acucugccauuc

SEQ ID NO: 1579900 - RNA, 22 nt, Homo sapiens
acucugcuugauuuuugccucu

SEQ ID NO: 1579901 - RNA, 19 nt, Homo sapiens
acucuggccuccaaaaugg

SEQ ID NO: 1579902 - RNA, 18 nt, Homo sapiens
acucugggaaugacaaca

SEQ ID NO: 1579903 - RNA, 19 nt, Homo sapiens
acucuggggugcagcuuca

SEQ ID NO: 1579904 - RNA, 15 nt, Homo sapiens
acucuguaacucacc

SEQ ID NO: 1579905 - RNA, 14 nt, Homo sapiens
acucuguacagcug

SEQ ID NO: 1579906 - RNA, 23 nt, Homo sapiens
acucuguccuggaggcacuggga

SEQ ID NO: 1579907 - RNA, 19 nt, Homo sapiens
acucuuagccccagacucu

SEQ ID NO: 1579908 - RNA, 22 nt, Homo sapiens
acucuucaaggaggcccacugu

SEQ ID NO: 1579909 - RNA, 14 nt, Homo sapiens
acucuuccaccucc

SEQ ID NO: 1579910 - RNA, 17 nt, Homo sapiens
acucuuccaccucccaa

SEQ ID NO: 1579911 - RNA, 10 nt, Homo sapiens
acucuucccu

SEQ ID NO: 1579912 - RNA, 23 nt, Homo sapiens
acucuucccuuccccucucucau

SEQ ID NO: 1579913 - RNA, 16 nt, Homo sapiens
acucuucuuugcugca

SEQ ID NO: 1579914 - RNA, 19 nt, Homo sapiens
acucuuugcuaguaccaaa

SEQ ID NO: 1579915 - RNA, 14 nt, Homo sapiens
acugaaaaugugcu

SEQ ID NO: 1579916 - RNA, 17 nt, Homo sapiens
acugaaagguagacuuu

SEQ ID NO: 1579917 - RNA, 14 nt, Homo sapiens
acugaacauuccag

SEQ ID NO: 1579918 - RNA, 17 nt, Homo sapiens
acugaacgauccuucaa

SEQ ID NO: 1579919 - RNA, 15 nt, Homo sapiens
acugaacucacuuuc

SEQ ID NO: 1579920 - RNA, 20 nt, Homo sapiens
acugaacuuaauaacugugu

SEQ ID NO: 1579921 - RNA, 18 nt, Homo sapiens
acugaagagcucuuggcc

SEQ ID NO: 1579922 - RNA, 14 nt, Homo sapiens
acugaaguggcuaa

SEQ ID NO: 1579923 - RNA, 16 nt, Homo sapiens
acugaaucuaccugcc

SEQ ID NO: 1579924 - RNA, 15 nt, Homo sapiens
acugaaugacuugac

SEQ ID NO: 1579925 - RNA, 20 nt, Homo sapiens
acugaauggacuuugcacac

SEQ ID NO: 1579926 - RNA, 19 nt, Homo sapiens
acugaauuggcuuccagau

SEQ ID NO: 1579927 - RNA, 20 nt, Homo sapiens
acugaauuuugggacuucua

SEQ ID NO: 1579928 - RNA, 20 nt, Homo sapiens
acugaauuuuuugucuguua

SEQ ID NO: 1579929 - RNA, 23 nt, Homo sapiens
acugacacauugcugauaugcaa

SEQ ID NO: 1579930 - RNA, 14 nt, Homo sapiens
acugacucuguuau

SEQ ID NO: 1579931 - RNA, 20 nt, Homo sapiens
acugacuuuccgagccucca

SEQ ID NO: 1579932 - RNA, 16 nt, Homo sapiens
acugagaaugauagua

SEQ ID NO: 1579933 - RNA, 15 nt, Homo sapiens
acugagauggaguga

SEQ ID NO: 1579934 - RNA, 19 nt, Homo sapiens
acugagaugugaacacauc

SEQ ID NO: 1579935 - RNA, 15 nt, Homo sapiens
acugagcagaacuga

SEQ ID NO: 1579936 - RNA, 17 nt, Homo sapiens
acugagcagaacugaaa

SEQ ID NO: 1579937 - RNA, 12 nt, Homo sapiens
acugagcuguga

SEQ ID NO: 1579938 - RNA, 21 nt, Homo sapiens
acugaggacuguuugcaauug

SEQ ID NO: 1579939 - RNA, 17 nt, Homo sapiens
acugagggacucugaag

SEQ ID NO: 1579940 - RNA, 16 nt, Homo sapiens
acugaguuaucaggug

SEQ ID NO: 1579941 - RNA, 12 nt, Homo sapiens
acugaguugcac

SEQ ID NO: 1579942 - RNA, 14 nt, Homo sapiens
acugaguugcacau

SEQ ID NO: 1579943 - RNA, 17 nt, Homo sapiens
acugauaaaaaugauau

SEQ ID NO: 1579944 - RNA, 20 nt, Homo sapiens
acugauccaguauaagacua

SEQ ID NO: 1579945 - RNA, 18 nt, Homo sapiens
acugaugaugacagguca

SEQ ID NO: 1579946 - RNA, 12 nt, Homo sapiens
acugaugguuca

SEQ ID NO: 1579947 - RNA, 14 nt, Homo sapiens
acugauguacaauu

SEQ ID NO: 1579948 - RNA, 16 nt, Homo sapiens
acugauguacaauuaa

SEQ ID NO: 1579949 - RNA, 14 nt, Homo sapiens
acugaugugugcaa

SEQ ID NO: 1579950 - RNA, 15 nt, Homo sapiens
acugauuacacugag

SEQ ID NO: 1579951 - RNA, 22 nt, Homo sapiens
acugauuaccuccuguguggaa

SEQ ID NO: 1579952 - RNA, 16 nt, Homo sapiens
acugcaccaagucuca

SEQ ID NO: 1579953 - RNA, 19 nt, Homo sapiens
acugcagaccuguccuccu

SEQ ID NO: 1579954 - RNA, 22 nt, Homo sapiens
acugcauaaccuuuacacuccu

SEQ ID NO: 1579955 - RNA, 16 nt, Homo sapiens
acugcaugaaugaaac

SEQ ID NO: 1579956 - RNA, 14 nt, Homo sapiens
acugcaugucagag

SEQ ID NO: 1579957 - RNA, 16 nt, Homo sapiens
acugcauuuacagugu

SEQ ID NO: 1579958 - RNA, 22 nt, Homo sapiens
acugccagcccacccccuuuga

SEQ ID NO: 1579959 - RNA, 16 nt, Homo sapiens
acugccaggcugccuc

SEQ ID NO: 1579960 - RNA, 21 nt, Homo sapiens
acugccccacggagacagagg

SEQ ID NO: 1579961 - RNA, 17 nt, Homo sapiens
acugccgugacaucauu

SEQ ID NO: 1579962 - RNA, 13 nt, Homo sapiens
acugccuuugcag

SEQ ID NO: 1579963 - RNA, 17 nt, Homo sapiens
acugcgaggacaucaaa

SEQ ID NO: 1579964 - RNA, 21 nt, Homo sapiens
acugcucagcuucuucuuuca

SEQ ID NO: 1579965 - RNA, 20 nt, Homo sapiens
acugcucuccuccaccucaa

SEQ ID NO: 1579966 - RNA, 16 nt, Homo sapiens
acugcugauucuugua

SEQ ID NO: 1579967 - RNA, 18 nt, Homo sapiens
acugcugcucucccaagg

SEQ ID NO: 1579968 - RNA, 20 nt, Homo sapiens
acugcuguagacauuugcua

SEQ ID NO: 1579969 - RNA, 16 nt, Homo sapiens
acugcuugaccaaaga

SEQ ID NO: 1579970 - RNA, 19 nt, Homo sapiens
acugcuuuuaaaagugcac

SEQ ID NO: 1579971 - RNA, 22 nt, Homo sapiens
acuggaaaaaaauacaaaaagc

SEQ ID NO: 1579972 - RNA, 21 nt, Homo sapiens
acuggaaauguauauuuugua

SEQ ID NO: 1579973 - RNA, 12 nt, Homo sapiens
acuggaccucag

SEQ ID NO: 1579974 - RNA, 17 nt, Homo sapiens
acuggagcucaucugca

SEQ ID NO: 1579975 - RNA, 19 nt, Homo sapiens
acuggagguugaagccaag

SEQ ID NO: 1579976 - RNA, 13 nt, Homo sapiens
acuggagugcucu

SEQ ID NO: 1579977 - RNA, 22 nt, Homo sapiens
acuggccagggccacgcuccag

SEQ ID NO: 1579978 - RNA, 20 nt, Homo sapiens
acugggccccacauggcuua

SEQ ID NO: 1579979 - RNA, 19 nt, Homo sapiens
acugggcccgagccugaac

SEQ ID NO: 1579980 - RNA, 18 nt, Homo sapiens
acugggcugggccucgug

SEQ ID NO: 1579981 - RNA, 15 nt, Homo sapiens
acuggggcagacaau

SEQ ID NO: 1579982 - RNA, 12 nt, Homo sapiens
acugggugacca

SEQ ID NO: 1579983 - RNA, 16 nt, Homo sapiens
acugggugucauuuca

SEQ ID NO: 1579984 - RNA, 19 nt, Homo sapiens
acugguauuuuaucuuuga

SEQ ID NO: 1579985 - RNA, 23 nt, Homo sapiens
acuggucucuuuccaaagcauuu

SEQ ID NO: 1579986 - RNA, 16 nt, Homo sapiens
acugguucaggcucaa

SEQ ID NO: 1579987 - RNA, 19 nt, Homo sapiens
acuguaaaaauaacauaau

SEQ ID NO: 1579988 - RNA, 20 nt, Homo sapiens
acuguaaugagucagugaag

SEQ ID NO: 1579989 - RNA, 12 nt, Homo sapiens
acuguacauaaa

SEQ ID NO: 1579990 - RNA, 14 nt, Homo sapiens
acuguacauuguga

SEQ ID NO: 1579991 - RNA, 17 nt, Homo sapiens
acuguacauugugagcu

SEQ ID NO: 1579992 - RNA, 15 nt, Homo sapiens
acuguauaaacaaaa

SEQ ID NO: 1579993 - RNA, 16 nt, Homo sapiens
acuguauaacauuaag

SEQ ID NO: 1579994 - RNA, 18 nt, Homo sapiens
acuguaugugggaauuua

SEQ ID NO: 1579995 - RNA, 19 nt, Homo sapiens
acuguauuuuugaagacua

SEQ ID NO: 1579996 - RNA, 17 nt, Homo sapiens
acugucauccucaaaga

SEQ ID NO: 1579997 - RNA, 20 nt, Homo sapiens
acugucauucccauuccuuu

SEQ ID NO: 1579998 - RNA, 12 nt, Homo sapiens
acuguccagggc

SEQ ID NO: 1579999 - RNA, 12 nt, Homo sapiens
acuguccaugaa

SEQ ID NO: 1580000 - RNA, 15 nt, Homo sapiens
acuguccaugaagca

SEQ ID NO: 1580001 - RNA, 19 nt, Homo sapiens
acuguccaugaagcacuga

SEQ ID NO: 1580002 - RNA, 21 nt, Homo sapiens
acugucugugaacagagagac

SEQ ID NO: 1580003 - RNA, 14 nt, Homo sapiens
acugucuuccucaa

SEQ ID NO: 1580004 - RNA, 15 nt, Homo sapiens
acugucuuccucaaa

SEQ ID NO: 1580005 - RNA, 11 nt, Homo sapiens
acugucuuuca

SEQ ID NO: 1580006 - RNA, 21 nt, Homo sapiens
acugugaccuagagacuucac

SEQ ID NO: 1580007 - RNA, 14 nt, Homo sapiens
acugugagacugua

SEQ ID NO: 1580008 - RNA, 19 nt, Homo sapiens
acugugauuagaucacauc

SEQ ID NO: 1580009 - RNA, 21 nt, Homo sapiens
acugugcagguucccacuuaa

SEQ ID NO: 1580010 - RNA, 24 nt, Homo sapiens
acuguggaaaugccaaaccaagca

SEQ ID NO: 1580011 - RNA, 16 nt, Homo sapiens
acuguguauuccaaga

SEQ ID NO: 1580012 - RNA, 19 nt, Homo sapiens
acuguuaauaguacuauua

SEQ ID NO: 1580013 - RNA, 16 nt, Homo sapiens
acuguuauuaugcauu

SEQ ID NO: 1580014 - RNA, 18 nt, Homo sapiens
acuguucugauuauguaa

SEQ ID NO: 1580015 - RNA, 23 nt, Homo sapiens
acuguugagaggguuacuuacau

SEQ ID NO: 1580016 - RNA, 17 nt, Homo sapiens
acuguugcauaacuauu

SEQ ID NO: 1580017 - RNA, 18 nt, Homo sapiens
acuguugcgccgcaguuu

SEQ ID NO: 1580018 - RNA, 19 nt, Homo sapiens
acuguuggcaaggugacau

SEQ ID NO: 1580019 - RNA, 20 nt, Homo sapiens
acuguugguuaaaugacaau

SEQ ID NO: 1580020 - RNA, 20 nt, Homo sapiens
acuguuuagaugaaugucag

SEQ ID NO: 1580021 - RNA, 20 nt, Homo sapiens
acuguuuauuaaaguacaac

SEQ ID NO: 1580022 - RNA, 23 nt, Homo sapiens
acuguuucaaaaauaaauuugca

SEQ ID NO: 1580023 - RNA, 20 nt, Homo sapiens
acuguuucagaaaacauaau

SEQ ID NO: 1580024 - RNA, 15 nt, Homo sapiens
acuguuuugacaaau

SEQ ID NO: 1580025 - RNA, 15 nt, Homo sapiens
acuuaaaaaacugca

SEQ ID NO: 1580026 - RNA, 13 nt, Homo sapiens
acuuaacuaugag

SEQ ID NO: 1580027 - RNA, 18 nt, Homo sapiens
acuuaacuauuaaggccu

SEQ ID NO: 1580028 - RNA, 15 nt, Homo sapiens
acuuaagacugugua

SEQ ID NO: 1580029 - RNA, 13 nt, Homo sapiens
acuuaauuugaaa

SEQ ID NO: 1580030 - RNA, 13 nt, Homo sapiens
acuuacacuguau

SEQ ID NO: 1580031 - RNA, 17 nt, Homo sapiens
acuuagauuuggcaucu

SEQ ID NO: 1580032 - RNA, 18 nt, Homo sapiens
acuuagcgucaagacauu

SEQ ID NO: 1580033 - RNA, 19 nt, Homo sapiens
acuuaguaaguaauaucaa

SEQ ID NO: 1580034 - RNA, 22 nt, Homo sapiens
acuuaguaaguaauaucaaagc

SEQ ID NO: 1580035 - RNA, 12 nt, Homo sapiens
acuuaguucaag

SEQ ID NO: 1580036 - RNA, 22 nt, Homo sapiens
acuuauagaauucagucaaaga

SEQ ID NO: 1580037 - RNA, 20 nt, Homo sapiens
acuuaucucuaaaccaucua

SEQ ID NO: 1580038 - RNA, 15 nt, Homo sapiens
acuuaugaugaugaa

SEQ ID NO: 1580039 - RNA, 19 nt, Homo sapiens
acuuauuggauauucauuc

SEQ ID NO: 1580040 - RNA, 23 nt, Homo sapiens
acuuauuguauuccucaugucau

SEQ ID NO: 1580041 - RNA, 17 nt, Homo sapiens
acuuauuucagccaaaa

SEQ ID NO: 1580042 - RNA, 15 nt, Homo sapiens
acuucaaaagcaaca

SEQ ID NO: 1580043 - RNA, 20 nt, Homo sapiens
acuucaaagaggaaccagga

SEQ ID NO: 1580044 - RNA, 14 nt, Homo sapiens
acuucaaccuaguc

SEQ ID NO: 1580045 - RNA, 14 nt, Homo sapiens
acuucaacugccca

SEQ ID NO: 1580046 - RNA, 14 nt, Homo sapiens
acuucaauuuacuu

SEQ ID NO: 1580047 - RNA, 20 nt, Homo sapiens
acuucacuaaugaucacauu

SEQ ID NO: 1580048 - RNA, 23 nt, Homo sapiens
acuucagauugaacuuacuguag

SEQ ID NO: 1580049 - RNA, 20 nt, Homo sapiens
acuucauuuugggggguauu

SEQ ID NO: 1580050 - RNA, 16 nt, Homo sapiens
acuucccacggcuccu

SEQ ID NO: 1580051 - RNA, 16 nt, Homo sapiens
acuuccuggacaagau

SEQ ID NO: 1580052 - RNA, 21 nt, Homo sapiens
acuuccuuggacucauuuuaa

SEQ ID NO: 1580053 - RNA, 19 nt, Homo sapiens
acuucuaaguaaaaccaca

SEQ ID NO: 1580054 - RNA, 22 nt, Homo sapiens
acuucuaaguaaaaccacagca

SEQ ID NO: 1580055 - RNA, 21 nt, Homo sapiens
acuucuacauccaauguauga

SEQ ID NO: 1580056 - RNA, 17 nt, Homo sapiens
acuucucaccagcaguc

SEQ ID NO: 1580057 - RNA, 17 nt, Homo sapiens
acuucucuauuaucuca

SEQ ID NO: 1580058 - RNA, 19 nt, Homo sapiens
acuucuggaagucaucuca

SEQ ID NO: 1580059 - RNA, 15 nt, Homo sapiens
acuucugucuucaca

SEQ ID NO: 1580060 - RNA, 21 nt, Homo sapiens
acuucugucuucacaacagau

SEQ ID NO: 1580061 - RNA, 17 nt, Homo sapiens
acuugaaacagauucag

SEQ ID NO: 1580062 - RNA, 21 nt, Homo sapiens
acuugaaagaaauggugaaug

SEQ ID NO: 1580063 - RNA, 20 nt, Homo sapiens
acuugcaauaaaguuauuca

SEQ ID NO: 1580064 - RNA, 23 nt, Homo sapiens
acuugcaauccaggcuguucuca

SEQ ID NO: 1580065 - RNA, 20 nt, Homo sapiens
acuugcauaccaaguugaua

SEQ ID NO: 1580066 - RNA, 12 nt, Homo sapiens
acuugccaagaa

SEQ ID NO: 1580067 - RNA, 11 nt, Homo sapiens
acuugccauaa

SEQ ID NO: 1580068 - RNA, 19 nt, Homo sapiens
acuugcccugaccaugcau

SEQ ID NO: 1580069 - RNA, 15 nt, Homo sapiens
acuugcccugagcac

SEQ ID NO: 1580070 - RNA, 16 nt, Homo sapiens
acuugcccugagcacu

SEQ ID NO: 1580071 - RNA, 18 nt, Homo sapiens
acuugcccugagcacucc

SEQ ID NO: 1580072 - RNA, 22 nt, Homo sapiens
acuugccugugcuacaauucau

SEQ ID NO: 1580073 - RNA, 21 nt, Homo sapiens
acuugccuguucagagcacuc

SEQ ID NO: 1580074 - RNA, 19 nt, Homo sapiens
acuuggauaucaacccucu

SEQ ID NO: 1580075 - RNA, 23 nt, Homo sapiens
acuuggauaucaacccucucuac

SEQ ID NO: 1580076 - RNA, 13 nt, Homo sapiens
acuuggcaaaaag

SEQ ID NO: 1580077 - RNA, 15 nt, Homo sapiens
acuuggcaaggucau

SEQ ID NO: 1580078 - RNA, 21 nt, Homo sapiens
acuuggucagagccacucuau

SEQ ID NO: 1580079 - RNA, 17 nt, Homo sapiens
acuugguguuugguucc

SEQ ID NO: 1580080 - RNA, 21 nt, Homo sapiens
acuugucaagccugugcaaaa

SEQ ID NO: 1580081 - RNA, 23 nt, Homo sapiens
acuugucccgggacaccuaggcu

SEQ ID NO: 1580082 - RNA, 15 nt, Homo sapiens
acuugugcuuacaau

SEQ ID NO: 1580083 - RNA, 16 nt, Homo sapiens
acuuguggggcuaagg

SEQ ID NO: 1580084 - RNA, 21 nt, Homo sapiens
acuuguuagaucaaccuccaa

SEQ ID NO: 1580085 - RNA, 14 nt, Homo sapiens
acuuguucauuugg

SEQ ID NO: 1580086 - RNA, 16 nt, Homo sapiens
acuuguuccagcucuu

SEQ ID NO: 1580087 - RNA, 19 nt, Homo sapiens
acuuuaaagauaagucuac

SEQ ID NO: 1580088 - RNA, 15 nt, Homo sapiens
acuuuaaauggaaua

SEQ ID NO: 1580089 - RNA, 22 nt, Homo sapiens
acuuuaccaaaugaaaugccaa

SEQ ID NO: 1580090 - RNA, 16 nt, Homo sapiens
acuuuaccaugcucaa

SEQ ID NO: 1580091 - RNA, 19 nt, Homo sapiens
acuuuacuuguguuauaua

SEQ ID NO: 1580092 - RNA, 17 nt, Homo sapiens
acuuuagcaacaguuau

SEQ ID NO: 1580093 - RNA, 14 nt, Homo sapiens
acuuuagcuggaau

SEQ ID NO: 1580094 - RNA, 17 nt, Homo sapiens
acuuuaguaauagcuug

SEQ ID NO: 1580095 - RNA, 21 nt, Homo sapiens
acuuuauauggcccugcacag

SEQ ID NO: 1580096 - RNA, 17 nt, Homo sapiens
acuuuauuucugaucua

SEQ ID NO: 1580097 - RNA, 23 nt, Homo sapiens
acuuucauccucaagcucagggc

SEQ ID NO: 1580098 - RNA, 19 nt, Homo sapiens
acuuucauccugguuucca

SEQ ID NO: 1580099 - RNA, 13 nt, Homo sapiens
acuuucaucuuaa

SEQ ID NO: 1580100 - RNA, 15 nt, Homo sapiens
acuuuccaaacacca

SEQ ID NO: 1580101 - RNA, 20 nt, Homo sapiens
acuuuccccaauuacagggu

SEQ ID NO: 1580102 - RNA, 20 nt, Homo sapiens
acuuucccguuuuauuccag

SEQ ID NO: 1580103 - RNA, 15 nt, Homo sapiens
acuuucccucaucca

SEQ ID NO: 1580104 - RNA, 14 nt, Homo sapiens
acuuucuguccuaa

SEQ ID NO: 1580105 - RNA, 21 nt, Homo sapiens
acuuugaaacuaucucaugcc

SEQ ID NO: 1580106 - RNA, 15 nt, Homo sapiens
acuuugagaagcuga

SEQ ID NO: 1580107 - RNA, 14 nt, Homo sapiens
acuuugcuccucac

SEQ ID NO: 1580108 - RNA, 22 nt, Homo sapiens
acuuugcugucaaaacuacuga

SEQ ID NO: 1580109 - RNA, 23 nt, Homo sapiens
acuuugcugucaaaacuacugac

SEQ ID NO: 1580110 - RNA, 23 nt, Homo sapiens
acuuuguaauaccagaacucuaa

SEQ ID NO: 1580111 - RNA, 16 nt, Homo sapiens
acuuuguauacuuuaa

SEQ ID NO: 1580112 - RNA, 16 nt, Homo sapiens
acuuugucacuucugc

SEQ ID NO: 1580113 - RNA, 14 nt, Homo sapiens
acuuuguguauuaa

SEQ ID NO: 1580114 - RNA, 15 nt, Homo sapiens
acuuuuauaaauuaa

SEQ ID NO: 1580115 - RNA, 20 nt, Homo sapiens
acuuuuaugagaacaaugga

SEQ ID NO: 1580116 - RNA, 19 nt, Homo sapiens
acuuuuaugugagauuucc

SEQ ID NO: 1580117 - RNA, 16 nt, Homo sapiens
acuuuucccauucagc

SEQ ID NO: 1580118 - RNA, 15 nt, Homo sapiens
acuuuucugccaaaa

SEQ ID NO: 1580119 - RNA, 23 nt, Homo sapiens
acuuuugggcguaagaccaaaug

SEQ ID NO: 1580120 - RNA, 16 nt, Homo sapiens
acuuuuguaccaaaua

SEQ ID NO: 1580121 - RNA, 12 nt, Homo sapiens
acuuuuucacau

SEQ ID NO: 1580122 - RNA, 23 nt, Homo sapiens
agaaaaaaagcacaaaguucuca

SEQ ID NO: 1580123 - RNA, 13 nt, Homo sapiens
agaaaaacaaaua

SEQ ID NO: 1580124 - RNA, 13 nt, Homo sapiens
agacacaguauug

SEQ ID NO: 1580125 - RNA, 21 nt, Homo sapiens
agacacaguauugacuucuuu

SEQ ID NO: 1580126 - RNA, 15 nt, Homo sapiens
agacaccaugugcaa

SEQ ID NO: 1580127 - RNA, 20 nt, Homo sapiens
agacacuggcguuacugcuu

SEQ ID NO: 1580128 - RNA, 21 nt, Homo sapiens
agacacuuuggaaucuaacca

SEQ ID NO: 1580129 - RNA, 13 nt, Homo sapiens
agacagacauuca

SEQ ID NO: 1580130 - RNA, 16 nt, Homo sapiens
agacagcuucucugca

SEQ ID NO: 1580131 - RNA, 16 nt, Homo sapiens
agacaggacagaaugu

SEQ ID NO: 1580132 - RNA, 11 nt, Homo sapiens
agacaggugag

SEQ ID NO: 1580133 - RNA, 17 nt, Homo sapiens
agacaguccaagcccug

SEQ ID NO: 1580134 - RNA, 11 nt, Homo sapiens
agacauacucc

SEQ ID NO: 1580135 - RNA, 19 nt, Homo sapiens
agacauacuccuuccauca

SEQ ID NO: 1580136 - RNA, 16 nt, Homo sapiens
agacauaucacucaau

SEQ ID NO: 1580137 - RNA, 22 nt, Homo sapiens
agacaucagucuccaacauguu

SEQ ID NO: 1580138 - RNA, 17 nt, Homo sapiens
agacaugauuuccuuga

SEQ ID NO: 1580139 - RNA, 16 nt, Homo sapiens
agacauggaaagggag

SEQ ID NO: 1580140 - RNA, 23 nt, Homo sapiens
agacaugggugaacuuacuugca

SEQ ID NO: 1580141 - RNA, 21 nt, Homo sapiens
agacauucucgcuucccugaa

SEQ ID NO: 1580142 - RNA, 22 nt, Homo sapiens
agacauucucgcuucccugaaa

SEQ ID NO: 1580143 - RNA, 13 nt, Homo sapiens
agacauugcucua

SEQ ID NO: 1580144 - RNA, 21 nt, Homo sapiens
agacauuucucuaacuccugc

SEQ ID NO: 1580145 - RNA, 19 nt, Homo sapiens
agacauuugcuaugagcug

SEQ ID NO: 1580146 - RNA, 15 nt, Homo sapiens
agacauuugcugaac

SEQ ID NO: 1580147 - RNA, 13 nt, Homo sapiens
agaccaauuacug

SEQ ID NO: 1580148 - RNA, 12 nt, Homo sapiens
agaccagggaug

SEQ ID NO: 1580149 - RNA, 17 nt, Homo sapiens
agaccagggaugcugcc

SEQ ID NO: 1580150 - RNA, 20 nt, Homo sapiens
agaccauuuaucugggauua

SEQ ID NO: 1580151 - RNA, 21 nt, Homo sapiens
agacccacaaggccagguccu

SEQ ID NO: 1580152 - RNA, 17 nt, Homo sapiens
agacccagagguccagg

SEQ ID NO: 1580153 - RNA, 21 nt, Homo sapiens
agacccaggaguccagccccu

SEQ ID NO: 1580154 - RNA, 16 nt, Homo sapiens
agacccaugucagcaa

SEQ ID NO: 1580155 - RNA, 14 nt, Homo sapiens
agaccuaugacuuc

SEQ ID NO: 1580156 - RNA, 21 nt, Homo sapiens
agaccucuccuuccuacccuc

SEQ ID NO: 1580157 - RNA, 14 nt, Homo sapiens
agaccugacguccc

SEQ ID NO: 1580158 - RNA, 15 nt, Homo sapiens
agaccuggauucaaa

SEQ ID NO: 1580159 - RNA, 18 nt, Homo sapiens
agaccuguguuacuaaaa

SEQ ID NO: 1580160 - RNA, 22 nt, Homo sapiens
agaccuugaugcuuggccuccc

SEQ ID NO: 1580161 - RNA, 22 nt, Homo sapiens
agaccuuuuuuuuuuuuccaau

SEQ ID NO: 1580162 - RNA, 13 nt, Homo sapiens
agacuaaggccau

SEQ ID NO: 1580163 - RNA, 12 nt, Homo sapiens
agacuagccacu

SEQ ID NO: 1580164 - RNA, 17 nt, Homo sapiens
agacuagccacuccugc

SEQ ID NO: 1580165 - RNA, 17 nt, Homo sapiens
agacuauucaaacaguc

SEQ ID NO: 1580166 - RNA, 22 nt, Homo sapiens
agacuauuuuucuaugacuuag

SEQ ID NO: 1580167 - RNA, 15 nt, Homo sapiens
agacucaguagccau

SEQ ID NO: 1580168 - RNA, 13 nt, Homo sapiens
agacuccaucuca

SEQ ID NO: 1580169 - RNA, 15 nt, Homo sapiens
agacucccaugaagc

SEQ ID NO: 1580170 - RNA, 24 nt, Homo sapiens
agacucccaugagggagaugccau

SEQ ID NO: 1580171 - RNA, 17 nt, Homo sapiens
agacuccugcucucuau

SEQ ID NO: 1580172 - RNA, 19 nt, Homo sapiens
agacucuguaauugaauau

SEQ ID NO: 1580173 - RNA, 14 nt, Homo sapiens
agacucugucucag

SEQ ID NO: 1580174 - RNA, 15 nt, Homo sapiens
agacucugucucagu

SEQ ID NO: 1580175 - RNA, 22 nt, Homo sapiens
agacugaugagcacaucucucu

SEQ ID NO: 1580176 - RNA, 16 nt, Homo sapiens
agacugcaauauagag

SEQ ID NO: 1580177 - RNA, 22 nt, Homo sapiens
agacuggaauauaauuucaaac

SEQ ID NO: 1580178 - RNA, 18 nt, Homo sapiens
agacugggcgcaguggcu

SEQ ID NO: 1580179 - RNA, 21 nt, Homo sapiens
agacugugcuguccuuuaaca

SEQ ID NO: 1580180 - RNA, 13 nt, Homo sapiens
agacuuacugcuc

SEQ ID NO: 1580181 - RNA, 17 nt, Homo sapiens
agacuuccaucuaguca

SEQ ID NO: 1580182 - RNA, 16 nt, Homo sapiens
agacuucccacuguuc

SEQ ID NO: 1580183 - RNA, 12 nt, Homo sapiens
agacuuccccau

SEQ ID NO: 1580184 - RNA, 22 nt, Homo sapiens
agacuuccucaugaaucucuca

SEQ ID NO: 1580185 - RNA, 18 nt, Homo sapiens
agacuucgcuaagggcuu

SEQ ID NO: 1580186 - RNA, 23 nt, Homo sapiens
agagaaagaaagggaaacuggcu

SEQ ID NO: 1580187 - RNA, 19 nt, Homo sapiens
agagaacuaaagcuggaga

SEQ ID NO: 1580188 - RNA, 19 nt, Homo sapiens
agagaaggcugugagccaa

SEQ ID NO: 1580189 - RNA, 22 nt, Homo sapiens
agagaaggcugugagccaagga

SEQ ID NO: 1580190 - RNA, 21 nt, Homo sapiens
agagaaguuguaaaguaugua

SEQ ID NO: 1580191 - RNA, 13 nt, Homo sapiens
agagacaccugca

SEQ ID NO: 1580192 - RNA, 13 nt, Homo sapiens
agagacagaggau

SEQ ID NO: 1580193 - RNA, 12 nt, Homo sapiens
agagacccaagg

SEQ ID NO: 1580194 - RNA, 23 nt, Homo sapiens
agagacgggcccuggugguggcu

SEQ ID NO: 1580195 - RNA, 19 nt, Homo sapiens
agagacgguguuuugccau

SEQ ID NO: 1580196 - RNA, 12 nt, Homo sapiens
agagacugagcc

SEQ ID NO: 1580197 - RNA, 20 nt, Homo sapiens
agagacugggcgcaguggcu

SEQ ID NO: 1580198 - RNA, 18 nt, Homo sapiens
agagauacaguauaccug

SEQ ID NO: 1580199 - RNA, 19 nt, Homo sapiens
agagaucagcgacccugag

SEQ ID NO: 1580200 - RNA, 14 nt, Homo sapiens
agagaucuacacau

SEQ ID NO: 1580201 - RNA, 12 nt, Homo sapiens
agagaucuauaa

SEQ ID NO: 1580202 - RNA, 16 nt, Homo sapiens
agagaugggacuagga

SEQ ID NO: 1580203 - RNA, 15 nt, Homo sapiens
agagauugugguggu

SEQ ID NO: 1580204 - RNA, 19 nt, Homo sapiens
agagauugugguggugcua

SEQ ID NO: 1580205 - RNA, 21 nt, Homo sapiens
agagcaaacccacucccaaau

SEQ ID NO: 1580206 - RNA, 19 nt, Homo sapiens
agagcaagacccugucuca

SEQ ID NO: 1580207 - RNA, 20 nt, Homo sapiens
agagcaagacccugucucaa

SEQ ID NO: 1580208 - RNA, 18 nt, Homo sapiens
agagcacguccagccgcc

SEQ ID NO: 1580209 - RNA, 15 nt, Homo sapiens
agagcagagguggaa

SEQ ID NO: 1580210 - RNA, 15 nt, Homo sapiens
agagcaggggcucca

SEQ ID NO: 1580211 - RNA, 13 nt, Homo sapiens
agagcaucugccc

SEQ ID NO: 1580212 - RNA, 21 nt, Homo sapiens
agagcaucuggaacaacagau

SEQ ID NO: 1580213 - RNA, 20 nt, Homo sapiens
agagccagggcagggcgagc

SEQ ID NO: 1580214 - RNA, 19 nt, Homo sapiens
agagccccuuaaagcugcu

SEQ ID NO: 1580215 - RNA, 18 nt, Homo sapiens
agagcccuucccagggca

SEQ ID NO: 1580216 - RNA, 13 nt, Homo sapiens
agagccucugggc

SEQ ID NO: 1580217 - RNA, 19 nt, Homo sapiens
agagcgagacuccaucucu

SEQ ID NO: 1580218 - RNA, 21 nt, Homo sapiens
agagcuaauuuacuggacaaa

SEQ ID NO: 1580219 - RNA, 14 nt, Homo sapiens
agagcuagaugugu

SEQ ID NO: 1580220 - RNA, 22 nt, Homo sapiens
agagcucuuuaccaaggaugaa

SEQ ID NO: 1580221 - RNA, 23 nt, Homo sapiens
agagcuggcgcucagcagcccua

SEQ ID NO: 1580222 - RNA, 13 nt, Homo sapiens
agagcuuggacua

SEQ ID NO: 1580223 - RNA, 20 nt, Homo sapiens
agagcuuggacuacacaaua

SEQ ID NO: 1580224 - RNA, 22 nt, Homo sapiens
agaggacagagcaggggcucca

SEQ ID NO: 1580225 - RNA, 14 nt, Homo sapiens
agaggacaguauuu

SEQ ID NO: 1580226 - RNA, 13 nt, Homo sapiens
agaggagaaaaag

SEQ ID NO: 1580227 - RNA, 12 nt, Homo sapiens
agaggagcauga

SEQ ID NO: 1580228 - RNA, 17 nt, Homo sapiens
agaggagccaccaguuc

SEQ ID NO: 1580229 - RNA, 20 nt, Homo sapiens
agaggaggcaacacugaucc

SEQ ID NO: 1580230 - RNA, 16 nt, Homo sapiens
agaggaggggaaaguc

SEQ ID NO: 1580231 - RNA, 15 nt, Homo sapiens
agaggaggggaccaa

SEQ ID NO: 1580232 - RNA, 23 nt, Homo sapiens
agaggaguccuuuuugucaugcc

SEQ ID NO: 1580233 - RNA, 16 nt, Homo sapiens
agaggauccaucacag

SEQ ID NO: 1580234 - RNA, 23 nt, Homo sapiens
agaggccagcacauuaucuucau

SEQ ID NO: 1580235 - RNA, 18 nt, Homo sapiens
agaggcugccccucucac

SEQ ID NO: 1580236 - RNA, 16 nt, Homo sapiens
agaggcuuucuccagg

SEQ ID NO: 1580237 - RNA, 21 nt, Homo sapiens
agagggaccaaauugcuucua

SEQ ID NO: 1580238 - RNA, 17 nt, Homo sapiens
agagggauaaaaacaau

SEQ ID NO: 1580239 - RNA, 15 nt, Homo sapiens
agagggaugagacag

SEQ ID NO: 1580240 - RNA, 20 nt, Homo sapiens
agagggcaagccucuagugu

SEQ ID NO: 1580241 - RNA, 23 nt, Homo sapiens
agagggcacucagaaguugugcu

SEQ ID NO: 1580242 - RNA, 18 nt, Homo sapiens
agccauuuuucaaagcaa

SEQ ID NO: 1580243 - RNA, 16 nt, Homo sapiens
agcccaacagcacuuu

SEQ ID NO: 1580244 - RNA, 23 nt, Homo sapiens
agcccaaucugcaaggacauuuc

SEQ ID NO: 1580245 - RNA, 21 nt, Homo sapiens
agcccacccuccugucuuccc

SEQ ID NO: 1580246 - RNA, 19 nt, Homo sapiens
agcccaggauacuggcaca

SEQ ID NO: 1580247 - RNA, 18 nt, Homo sapiens
agcccaguccacugagca

SEQ ID NO: 1580248 - RNA, 18 nt, Homo sapiens
agccccaacauguucaga

SEQ ID NO: 1580249 - RNA, 16 nt, Homo sapiens
agccccgccugucaca

SEQ ID NO: 1580250 - RNA, 14 nt, Homo sapiens
agccccuccaaagg

SEQ ID NO: 1580251 - RNA, 17 nt, Homo sapiens
agccccuccucccucaa

SEQ ID NO: 1580252 - RNA, 20 nt, Homo sapiens
agccccuccucccucagacc

SEQ ID NO: 1580253 - RNA, 16 nt, Homo sapiens
agccccuggagccuca

SEQ ID NO: 1580254 - RNA, 22 nt, Homo sapiens
agccccugggcccaguaccuag

SEQ ID NO: 1580255 - RNA, 22 nt, Homo sapiens
agcccgaggucaucaccuccca

SEQ ID NO: 1580256 - RNA, 18 nt, Homo sapiens
agcccgggcuggcccaag

SEQ ID NO: 1580257 - RNA, 23 nt, Homo sapiens
agcccuacauugugcugcaccug

SEQ ID NO: 1580258 - RNA, 21 nt, Homo sapiens
agcccucaccccugguucuca

SEQ ID NO: 1580259 - RNA, 19 nt, Homo sapiens
agcccuccucugcacuccc

SEQ ID NO: 1580260 - RNA, 15 nt, Homo sapiens
agcccucucucucac

SEQ ID NO: 1580261 - RNA, 18 nt, Homo sapiens
agcccugaccccagugua

SEQ ID NO: 1580262 - RNA, 12 nt, Homo sapiens
agcccugcccac

SEQ ID NO: 1580263 - RNA, 13 nt, Homo sapiens
agcccugcucccu

SEQ ID NO: 1580264 - RNA, 23 nt, Homo sapiens
agcccuggcaaaugccugacuca

SEQ ID NO: 1580265 - RNA, 21 nt, Homo sapiens
agcccugggccccaccaccua

SEQ ID NO: 1580266 - RNA, 21 nt, Homo sapiens
agcccuuaauaauaaugccaa

SEQ ID NO: 1580267 - RNA, 17 nt, Homo sapiens
agcccuuccucccauuu

SEQ ID NO: 1580268 - RNA, 19 nt, Homo sapiens
agcccuuccucccauuucc

SEQ ID NO: 1580269 - RNA, 21 nt, Homo sapiens
agcccuuccucccauuuccca

SEQ ID NO: 1580270 - RNA, 14 nt, Homo sapiens
agcccuugcacucc

SEQ ID NO: 1580271 - RNA, 13 nt, Homo sapiens
agcccuugggcac

SEQ ID NO: 1580272 - RNA, 16 nt, Homo sapiens
agccgagaucaugcca

SEQ ID NO: 1580273 - RNA, 19 nt, Homo sapiens
agccgcauuggugacucac

SEQ ID NO: 1580274 - RNA, 18 nt, Homo sapiens
agccgccaguacuuguca

SEQ ID NO: 1580275 - RNA, 18 nt, Homo sapiens
agccgggcacaguggcgc

SEQ ID NO: 1580276 - RNA, 18 nt, Homo sapiens
agccgggcaugauggugc

SEQ ID NO: 1580277 - RNA, 17 nt, Homo sapiens
agccgggcaugguggca

SEQ ID NO: 1580278 - RNA, 17 nt, Homo sapiens
agccggucaucacccag

SEQ ID NO: 1580279 - RNA, 20 nt, Homo sapiens
agccguggggggaagcacau

SEQ ID NO: 1580280 - RNA, 21 nt, Homo sapiens
agccuaaccccauuccugugc

SEQ ID NO: 1580281 - RNA, 15 nt, Homo sapiens
agccuaccucuccac

SEQ ID NO: 1580282 - RNA, 15 nt, Homo sapiens
agccuagcggagccc

SEQ ID NO: 1580283 - RNA, 15 nt, Homo sapiens
agccuaucaaaggaa

SEQ ID NO: 1580284 - RNA, 23 nt, Homo sapiens
agccucaaagugcccgcagagcc

SEQ ID NO: 1580285 - RNA, 20 nt, Homo sapiens
agccucacuggggcagacaa

SEQ ID NO: 1580286 - RNA, 22 nt, Homo sapiens
agccucacuggggcagacaaua

SEQ ID NO: 1580287 - RNA, 23 nt, Homo sapiens
agccucaucaucagagccuuucc

SEQ ID NO: 1580288 - RNA, 17 nt, Homo sapiens
agccucauccagccuca

SEQ ID NO: 1580289 - RNA, 19 nt, Homo sapiens
agccucaugccaacccugg

SEQ ID NO: 1580290 - RNA, 15 nt, Homo sapiens
agccuccccgugcca

SEQ ID NO: 1580291 - RNA, 19 nt, Homo sapiens
agccuccccgugccaaaaa

SEQ ID NO: 1580292 - RNA, 20 nt, Homo sapiens
agccuccccgugccaaaaau

SEQ ID NO: 1580293 - RNA, 20 nt, Homo sapiens
agccuccucuggacuccacc

SEQ ID NO: 1580294 - RNA, 21 nt, Homo sapiens
agccuccugaaguugcugcug

SEQ ID NO: 1580295 - RNA, 13 nt, Homo sapiens
agccucuggcuag

SEQ ID NO: 1580296 - RNA, 16 nt, Homo sapiens
agccucuggcuagagg

SEQ ID NO: 1580297 - RNA, 23 nt, Homo sapiens
agccugaaacucauagacacuga

SEQ ID NO: 1580298 - RNA, 16 nt, Homo sapiens
agccugacucuucccu

SEQ ID NO: 1580299 - RNA, 21 nt, Homo sapiens
agccugcagaaguaagccuca

SEQ ID NO: 1580300 - RNA, 23 nt, Homo sapiens
agccugccucccaagguccucuc

SEQ ID NO: 1580301 - RNA, 22 nt, Homo sapiens
agccugccuggcaggcugucug

SEQ ID NO: 1580302 - RNA, 20 nt, Homo sapiens
agccugcuuugcuuuacugc

SEQ ID NO: 1580303 - RNA, 14 nt, Homo sapiens
agccuggaugccau

SEQ ID NO: 1580304 - RNA, 22 nt, Homo sapiens
agccuggccccaggccccagac

SEQ ID NO: 1580305 - RNA, 22 nt, Homo sapiens
agccugggacaguuuaucauga

SEQ ID NO: 1580306 - RNA, 18 nt, Homo sapiens
agccugggcaacauacca

SEQ ID NO: 1580307 - RNA, 17 nt, Homo sapiens
agccugggccaucucuu

SEQ ID NO: 1580308 - RNA, 14 nt, Homo sapiens
agccugggggacag

SEQ ID NO: 1580309 - RNA, 18 nt, Homo sapiens
agccuguccaacauggug

SEQ ID NO: 1580310 - RNA, 14 nt, Homo sapiens
agccugugaagucc

SEQ ID NO: 1580311 - RNA, 22 nt, Homo sapiens
agccuguggcuggcuggaaaaa

SEQ ID NO: 1580312 - RNA, 14 nt, Homo sapiens
agccuguuauauuc

SEQ ID NO: 1580313 - RNA, 23 nt, Homo sapiens
agccuguugggaucgcauugcau

SEQ ID NO: 1580314 - RNA, 18 nt, Homo sapiens
agccuuaagcacaauuaa

SEQ ID NO: 1580315 - RNA, 16 nt, Homo sapiens
agccuucagccuuaau

SEQ ID NO: 1580316 - RNA, 14 nt, Homo sapiens
agccuugcucucuu

SEQ ID NO: 1580317 - RNA, 18 nt, Homo sapiens
agccuuggcucuacccug

SEQ ID NO: 1580318 - RNA, 23 nt, Homo sapiens
agccuugggcucucuucuguccc

SEQ ID NO: 1580319 - RNA, 19 nt, Homo sapiens
agccuuuacuguuugauau

SEQ ID NO: 1580320 - RNA, 17 nt, Homo sapiens
agccuuucugcugauua

SEQ ID NO: 1580321 - RNA, 18 nt, Homo sapiens
agccuuugccgugagcau

SEQ ID NO: 1580322 - RNA, 18 nt, Homo sapiens
agcgaggaggcuccagag

SEQ ID NO: 1580323 - RNA, 13 nt, Homo sapiens
agcgcacagggag

SEQ ID NO: 1580324 - RNA, 14 nt, Homo sapiens
agcgcagacuggcg

SEQ ID NO: 1580325 - RNA, 14 nt, Homo sapiens
agcgccgcugugag

SEQ ID NO: 1580326 - RNA, 17 nt, Homo sapiens
agcgcuacccaccucca

SEQ ID NO: 1580327 - RNA, 14 nt, Homo sapiens
agcgugugccacug

SEQ ID NO: 1580328 - RNA, 20 nt, Homo sapiens
agcguuuuuuaaauguauac

SEQ ID NO: 1580329 - RNA, 14 nt, Homo sapiens
agcuaaaaaugaac

SEQ ID NO: 1580330 - RNA, 16 nt, Homo sapiens
agcuaaacgcaauguc

SEQ ID NO: 1580331 - RNA, 14 nt, Homo sapiens
agcuaaagccugaa

SEQ ID NO: 1580332 - RNA, 21 nt, Homo sapiens
agcuaacagucccuauggaaa

SEQ ID NO: 1580333 - RNA, 13 nt, Homo sapiens
agcuaaucugccu

SEQ ID NO: 1580334 - RNA, 22 nt, Homo sapiens
agcuaauggcgaucaucuuugc

SEQ ID NO: 1580335 - RNA, 12 nt, Homo sapiens
agcuaauuugca

SEQ ID NO: 1580336 - RNA, 16 nt, Homo sapiens
agcuaccucaaacuuc

SEQ ID NO: 1580337 - RNA, 22 nt, Homo sapiens
agcuacucaggaggcugagaca

SEQ ID NO: 1580338 - RNA, 21 nt, Homo sapiens
agcuacucuccccacgagggc

SEQ ID NO: 1580339 - RNA, 22 nt, Homo sapiens
agcuacugccauccuggcccag

SEQ ID NO: 1580340 - RNA, 20 nt, Homo sapiens
agcuacuugggaggcugaga

SEQ ID NO: 1580341 - RNA, 12 nt, Homo sapiens
agcuagaaccua

SEQ ID NO: 1580342 - RNA, 12 nt, Homo sapiens
agcuagccagag

SEQ ID NO: 1580343 - RNA, 20 nt, Homo sapiens
agcuaggaagagcaggacuc

SEQ ID NO: 1580344 - RNA, 21 nt, Homo sapiens
agcuaggacuuaaccuugaaa

SEQ ID NO: 1580345 - RNA, 14 nt, Homo sapiens
agcuaggaugguuc

SEQ ID NO: 1580346 - RNA, 13 nt, Homo sapiens
agcuagugccuuu

SEQ ID NO: 1580347 - RNA, 18 nt, Homo sapiens
agcuauaacuaagcaucc

SEQ ID NO: 1580348 - RNA, 16 nt, Homo sapiens
agcuaucugucaucuc

SEQ ID NO: 1580349 - RNA, 19 nt, Homo sapiens
agcuaucugucaucucucu

SEQ ID NO: 1580350 - RNA, 14 nt, Homo sapiens
agcuauuacuggau

SEQ ID NO: 1580351 - RNA, 22 nt, Homo sapiens
agcuauuucauuugcuguucau

SEQ ID NO: 1580352 - RNA, 23 nt, Homo sapiens
agcuauuugggcacaacacauca

SEQ ID NO: 1580353 - RNA, 21 nt, Homo sapiens
agcuauuuuagaaagcuaaau

SEQ ID NO: 1580354 - RNA, 20 nt, Homo sapiens
agcuauuuugugaagccaug

SEQ ID NO: 1580355 - RNA, 17 nt, Homo sapiens
agcucacuacccuauuc

SEQ ID NO: 1580356 - RNA, 16 nt, Homo sapiens
agcucagcauuuccac

SEQ ID NO: 1580357 - RNA, 22 nt, Homo sapiens
agcucaggaaccgaggcaggga

SEQ ID NO: 1580358 - RNA, 19 nt, Homo sapiens
agcuccauuucuacucuua

SEQ ID NO: 1580359 - RNA, 23 nt, Homo sapiens
caaggaaguagaaacaaaauaca

SEQ ID NO: 1580360 - RNA, 13 nt, Homo sapiens
caaggaagucaaa

SEQ ID NO: 1580361 - RNA, 23 nt, Homo sapiens
caaggacacccucccuccagggu

SEQ ID NO: 1580362 - RNA, 22 nt, Homo sapiens
caaggacauggugagucuauuu

SEQ ID NO: 1580363 - RNA, 15 nt, Homo sapiens
caaggaccucucuca

SEQ ID NO: 1580364 - RNA, 19 nt, Homo sapiens
caaggacguggaugacccu

SEQ ID NO: 1580365 - RNA, 22 nt, Homo sapiens
caaggacguggaugacccuccc

SEQ ID NO: 1580366 - RNA, 15 nt, Homo sapiens
caaggagaauaugau

SEQ ID NO: 1580367 - RNA, 22 nt, Homo sapiens
caaggaguuuauuacaauguau

SEQ ID NO: 1580368 - RNA, 13 nt, Homo sapiens
caaggauucuguu

SEQ ID NO: 1580369 - RNA, 18 nt, Homo sapiens
caaggccaagauuguccu

SEQ ID NO: 1580370 - RNA, 15 nt, Homo sapiens
caaggccagugcuaa

SEQ ID NO: 1580371 - RNA, 19 nt, Homo sapiens
caaggcccacuucuucuca

SEQ ID NO: 1580372 - RNA, 14 nt, Homo sapiens
caaggccuacccca

SEQ ID NO: 1580373 - RNA, 20 nt, Homo sapiens
caaggcugcuucuguuaacu

SEQ ID NO: 1580374 - RNA, 23 nt, Homo sapiens
caagggguggccgggcacagugg

SEQ ID NO: 1580375 - RNA, 19 nt, Homo sapiens
caaggucauagacaauucc

SEQ ID NO: 1580376 - RNA, 22 nt, Homo sapiens
caagguccucucaguucucucc

SEQ ID NO: 1580377 - RNA, 17 nt, Homo sapiens
caaggugacauuuccau

SEQ ID NO: 1580378 - RNA, 12 nt, Homo sapiens
caagguuuacau

SEQ ID NO: 1580379 - RNA, 17 nt, Homo sapiens
caaguagcugggauuac

SEQ ID NO: 1580380 - RNA, 16 nt, Homo sapiens
caaguauauaauuuac

SEQ ID NO: 1580381 - RNA, 20 nt, Homo sapiens
caaguauuacaaccauauau

SEQ ID NO: 1580382 - RNA, 21 nt, Homo sapiens
caaguauugucgguuaccucu

SEQ ID NO: 1580383 - RNA, 13 nt, Homo sapiens
caagucaaagacu

SEQ ID NO: 1580384 - RNA, 16 nt, Homo sapiens
caaguccucacucuuc

SEQ ID NO: 1580385 - RNA, 18 nt, Homo sapiens
caaguccucacucuucaa

SEQ ID NO: 1580386 - RNA, 20 nt, Homo sapiens
caagucuuuacagaaucaaa

SEQ ID NO: 1580387 - RNA, 11 nt, Homo sapiens
caagugccaua

SEQ ID NO: 1580388 - RNA, 18 nt, Homo sapiens
caagugccugcaccaggg

SEQ ID NO: 1580389 - RNA, 16 nt, Homo sapiens
caagugcgugacugua

SEQ ID NO: 1580390 - RNA, 16 nt, Homo sapiens
caagugggaucuguca

SEQ ID NO: 1580391 - RNA, 17 nt, Homo sapiens
caagugugcacuccagc

SEQ ID NO: 1580392 - RNA, 22 nt, Homo sapiens
caaguguggaggagaggggugg

SEQ ID NO: 1580393 - RNA, 22 nt, Homo sapiens
caaguuagaaaacauaaucuuc

SEQ ID NO: 1580394 - RNA, 15 nt, Homo sapiens
caaguucaaaacuua

SEQ ID NO: 1580395 - RNA, 21 nt, Homo sapiens
caaguugugacagucacugca

SEQ ID NO: 1580396 - RNA, 17 nt, Homo sapiens
caaguuuuucauacugu

SEQ ID NO: 1580397 - RNA, 18 nt, Homo sapiens
caaguuuuuuauacugca

SEQ ID NO: 1580398 - RNA, 20 nt, Homo sapiens
caauaaaaccaaacaugcuu

SEQ ID NO: 1580399 - RNA, 22 nt, Homo sapiens
caauaaaaucagugugcuugcc

SEQ ID NO: 1580400 - RNA, 18 nt, Homo sapiens
caauaaacagucacugga

SEQ ID NO: 1580401 - RNA, 14 nt, Homo sapiens
caauaaacccucag

SEQ ID NO: 1580402 - RNA, 19 nt, Homo sapiens
caauaaacccucagagccu

SEQ ID NO: 1580403 - RNA, 18 nt, Homo sapiens
caauaaagaccacuuuac

SEQ ID NO: 1580404 - RNA, 19 nt, Homo sapiens
caauaauugaaguguuccc

SEQ ID NO: 1580405 - RNA, 12 nt, Homo sapiens
caauacaauccu

SEQ ID NO: 1580406 - RNA, 13 nt, Homo sapiens
caauacaauguac

SEQ ID NO: 1580407 - RNA, 14 nt, Homo sapiens
caauaccaauguuc

SEQ ID NO: 1580408 - RNA, 12 nt, Homo sapiens
caauacuacuga

SEQ ID NO: 1580409 - RNA, 15 nt, Homo sapiens
caauacuguuuccau

SEQ ID NO: 1580410 - RNA, 15 nt, Homo sapiens
caauagcaugcaaaa

SEQ ID NO: 1580411 - RNA, 12 nt, Homo sapiens
caauagcuugaa

SEQ ID NO: 1580412 - RNA, 14 nt, Homo sapiens
caauaggagucuua

SEQ ID NO: 1580413 - RNA, 22 nt, Homo sapiens
caauaggucuuucucucaguga

SEQ ID NO: 1580414 - RNA, 19 nt, Homo sapiens
caauaguauuaacuauuag

SEQ ID NO: 1580415 - RNA, 17 nt, Homo sapiens
caauagugaaaugccac

SEQ ID NO: 1580416 - RNA, 21 nt, Homo sapiens
caauagugaaaugccacaccu

SEQ ID NO: 1580417 - RNA, 15 nt, Homo sapiens
caauagugucauccu

SEQ ID NO: 1580418 - RNA, 22 nt, Homo sapiens
caauauauacuuauagaauuca

SEQ ID NO: 1580419 - RNA, 16 nt, Homo sapiens
caauauauugaacuuu

SEQ ID NO: 1580420 - RNA, 16 nt, Homo sapiens
caauaugaaaaccgua

SEQ ID NO: 1580421 - RNA, 12 nt, Homo sapiens
caauaugcauuu

SEQ ID NO: 1580422 - RNA, 20 nt, Homo sapiens
caauaugggaggaacaaaga

SEQ ID NO: 1580423 - RNA, 13 nt, Homo sapiens
caauaugugccaa

SEQ ID NO: 1580424 - RNA, 15 nt, Homo sapiens
caauauuacuuuguc

SEQ ID NO: 1580425 - RNA, 16 nt, Homo sapiens
caauauuguacaguuu

SEQ ID NO: 1580426 - RNA, 21 nt, Homo sapiens
caauauuuuuauaucaugcaa

SEQ ID NO: 1580427 - RNA, 15 nt, Homo sapiens
caaucagcacucugu

SEQ ID NO: 1580428 - RNA, 16 nt, Homo sapiens
caaucagcacucugua

SEQ ID NO: 1580429 - RNA, 21 nt, Homo sapiens
caaucagcacucuguaaaaug

SEQ ID NO: 1580430 - RNA, 17 nt, Homo sapiens
caaucauaauaccugcu

SEQ ID NO: 1580431 - RNA, 19 nt, Homo sapiens
caaucaugagcaagugaac

SEQ ID NO: 1580432 - RNA, 22 nt, Homo sapiens
caaucauguacugggaaggcaa

SEQ ID NO: 1580433 - RNA, 16 nt, Homo sapiens
caauccagcuauguua

SEQ ID NO: 1580434 - RNA, 13 nt, Homo sapiens
caauccuaucaca

SEQ ID NO: 1580435 - RNA, 13 nt, Homo sapiens
caauccuauguuu

SEQ ID NO: 1580436 - RNA, 15 nt, Homo sapiens
caaucuuauguuucc

SEQ ID NO: 1580437 - RNA, 11 nt, Homo sapiens
caaucuugccc

SEQ ID NO: 1580438 - RNA, 20 nt, Homo sapiens
caaucuuucaugucuuguca

SEQ ID NO: 1580439 - RNA, 14 nt, Homo sapiens
caaugaacaucuca

SEQ ID NO: 1580440 - RNA, 19 nt, Homo sapiens
caaugaauuuuauaaucug

SEQ ID NO: 1580441 - RNA, 21 nt, Homo sapiens
caaugacauuuauaucacaug

SEQ ID NO: 1580442 - RNA, 13 nt, Homo sapiens
caaugaccaaaca

SEQ ID NO: 1580443 - RNA, 17 nt, Homo sapiens
caaugaccacauccuga

SEQ ID NO: 1580444 - RNA, 19 nt, Homo sapiens
caaugaccacauccugaaa

SEQ ID NO: 1580445 - RNA, 19 nt, Homo sapiens
caaugacgugccuaccucu

SEQ ID NO: 1580446 - RNA, 19 nt, Homo sapiens
caaugacugagcagcaucc

SEQ ID NO: 1580447 - RNA, 16 nt, Homo sapiens
caaugagaucauugug

SEQ ID NO: 1580448 - RNA, 17 nt, Homo sapiens
caaugagaucauuguga

SEQ ID NO: 1580449 - RNA, 18 nt, Homo sapiens
caaugagauugaauuuca

SEQ ID NO: 1580450 - RNA, 13 nt, Homo sapiens
caaugaguuauug

SEQ ID NO: 1580451 - RNA, 22 nt, Homo sapiens
caaugauuuuuaagcuaugaaa

SEQ ID NO: 1580452 - RNA, 21 nt, Homo sapiens
caaugccacauacuugcagcu

SEQ ID NO: 1580453 - RNA, 18 nt, Homo sapiens
caaugccgccguguuucc

SEQ ID NO: 1580454 - RNA, 16 nt, Homo sapiens
caaugcucaccucuuc

SEQ ID NO: 1580455 - RNA, 22 nt, Homo sapiens
caaugcucaccucuucuuuacc

SEQ ID NO: 1580456 - RNA, 18 nt, Homo sapiens
caauggaaagcuuuucag

SEQ ID NO: 1580457 - RNA, 21 nt, Homo sapiens
caaugggaagcagacaauaac

SEQ ID NO: 1580458 - RNA, 18 nt, Homo sapiens
caauguaucccugaggaa

SEQ ID NO: 1580459 - RNA, 14 nt, Homo sapiens
caauguaugaauua

SEQ ID NO: 1580460 - RNA, 14 nt, Homo sapiens
caaugucuaaaaac

SEQ ID NO: 1580461 - RNA, 14 nt, Homo sapiens
caaugugauucuuc

SEQ ID NO: 1580462 - RNA, 17 nt, Homo sapiens
caauguggcaaacugaa

SEQ ID NO: 1580463 - RNA, 16 nt, Homo sapiens
caaugugggaucucag

SEQ ID NO: 1580464 - RNA, 19 nt, Homo sapiens
caauguuaaagaugcacag

SEQ ID NO: 1580465 - RNA, 20 nt, Homo sapiens
caauguucuggcacuauuau

SEQ ID NO: 1580466 - RNA, 10 nt, Homo sapiens
caauguuuca

SEQ ID NO: 1580467 - RNA, 17 nt, Homo sapiens
caauucauaauauguuc

SEQ ID NO: 1580468 - RNA, 18 nt, Homo sapiens
caauuccugugauuuaug

SEQ ID NO: 1580469 - RNA, 18 nt, Homo sapiens
caauucuggacagacaga

SEQ ID NO: 1580470 - RNA, 12 nt, Homo sapiens
caauucugugac

SEQ ID NO: 1580471 - RNA, 20 nt, Homo sapiens
caauucugugacauacauau

SEQ ID NO: 1580472 - RNA, 18 nt, Homo sapiens
caauugacauaggcaaua

SEQ ID NO: 1580473 - RNA, 16 nt, Homo sapiens
caauugggagcugcca

SEQ ID NO: 1580474 - RNA, 17 nt, Homo sapiens
caauugucgaaaagagu

SEQ ID NO: 1580475 - RNA, 18 nt, Homo sapiens
caauugugaaaaugaaua

SEQ ID NO: 1580476 - RNA, 12 nt, Homo sapiens
caauuuauccaa

SEQ ID NO: 1580477 - RNA, 18 nt, Homo sapiens
cacccaccuaugugccaa

SEQ ID NO: 1580478 - RNA, 15 nt, Homo sapiens
cacccacuuugucca

SEQ ID NO: 1580479 - RNA, 13 nt, Homo sapiens
cacccagucucau

SEQ ID NO: 1580480 - RNA, 22 nt, Homo sapiens
cacccaucagcacucuguaaaa

SEQ ID NO: 1580481 - RNA, 15 nt, Homo sapiens
cacccaugccagaga

SEQ ID NO: 1580482 - RNA, 14 nt, Homo sapiens
cacccccagugcag

SEQ ID NO: 1580483 - RNA, 13 nt, Homo sapiens
caccccuaccucu

SEQ ID NO: 1580484 - RNA, 14 nt, Homo sapiens
cacccuacccaguu

SEQ ID NO: 1580485 - RNA, 17 nt, Homo sapiens
cacccuccaugcuccuc

SEQ ID NO: 1580486 - RNA, 20 nt, Homo sapiens
cacccuccaugcuccucacc

SEQ ID NO: 1580487 - RNA, 17 nt, Homo sapiens
cacccucccuccagggu

SEQ ID NO: 1580488 - RNA, 17 nt, Homo sapiens
cacccugccuccucccg

SEQ ID NO: 1580489 - RNA, 16 nt, Homo sapiens
cacccuggacaaagaa

SEQ ID NO: 1580490 - RNA, 22 nt, Homo sapiens
caccgagcgggugcaagcacuc

SEQ ID NO: 1580491 - RNA, 17 nt, Homo sapiens
caccguacaucugcaau

SEQ ID NO: 1580492 - RNA, 19 nt, Homo sapiens
caccuagagcuagaugugu

SEQ ID NO: 1580493 - RNA, 21 nt, Homo sapiens
caccuagagcuagaugugucu

SEQ ID NO: 1580494 - RNA, 13 nt, Homo sapiens
caccuaugugcca

SEQ ID NO: 1580495 - RNA, 14 nt, Homo sapiens
caccuauugaauua

SEQ ID NO: 1580496 - RNA, 17 nt, Homo sapiens
caccuccucugugauuu

SEQ ID NO: 1580497 - RNA, 18 nt, Homo sapiens
caccucugccucaaugug

SEQ ID NO: 1580498 - RNA, 21 nt, Homo sapiens
caccucuuacuuccugccuca

SEQ ID NO: 1580499 - RNA, 12 nt, Homo sapiens
caccugcacauu

SEQ ID NO: 1580500 - RNA, 17 nt, Homo sapiens
caccugccaaaugaaua

SEQ ID NO: 1580501 - RNA, 18 nt, Homo sapiens
caccugccaaaugaauaa

SEQ ID NO: 1580502 - RNA, 15 nt, Homo sapiens
caccugcgcugugga

SEQ ID NO: 1580503 - RNA, 23 nt, Homo sapiens
caccugcucccaguccugccuga

SEQ ID NO: 1580504 - RNA, 17 nt, Homo sapiens
caccuggcccuugcaau

SEQ ID NO: 1580505 - RNA, 23 nt, Homo sapiens
caccuggcucuguggcgagccau

SEQ ID NO: 1580506 - RNA, 11 nt, Homo sapiens
caccuguaauc

SEQ ID NO: 1580507 - RNA, 14 nt, Homo sapiens
caccuguaauccca

SEQ ID NO: 1580508 - RNA, 14 nt, Homo sapiens
caccuguacauucu

SEQ ID NO: 1580509 - RNA, 21 nt, Homo sapiens
caccuguauaauguuuuguaa

SEQ ID NO: 1580510 - RNA, 20 nt, Homo sapiens
caccuguggggccuggggag

SEQ ID NO: 1580511 - RNA, 13 nt, Homo sapiens
caccuuagugcaa

SEQ ID NO: 1580512 - RNA, 19 nt, Homo sapiens
caccuuggaccucagugac

SEQ ID NO: 1580513 - RNA, 15 nt, Homo sapiens
caccuuggauuaaaa

SEQ ID NO: 1580514 - RNA, 13 nt, Homo sapiens
caccuuggccucc

SEQ ID NO: 1580515 - RNA, 17 nt, Homo sapiens
caccuuucccaccucuc

SEQ ID NO: 1580516 - RNA, 21 nt, Homo sapiens
cacgaacucaaggguuuucca

SEQ ID NO: 1580517 - RNA, 14 nt, Homo sapiens
cacgacaguggaug

SEQ ID NO: 1580518 - RNA, 14 nt, Homo sapiens
cacgauuaacugug

SEQ ID NO: 1580519 - RNA, 16 nt, Homo sapiens
cacgauuaacugugaa

SEQ ID NO: 1580520 - RNA, 22 nt, Homo sapiens
cacggcuccuccuuaugacucc

SEQ ID NO: 1580521 - RNA, 17 nt, Homo sapiens
cacgggcaaucaugagc

SEQ ID NO: 1580522 - RNA, 19 nt, Homo sapiens
cacguaauuuuuuucacag

SEQ ID NO: 1580523 - RNA, 19 nt, Homo sapiens
cacguggagauagugccag

SEQ ID NO: 1580524 - RNA, 20 nt, Homo sapiens
cacguuuaaucccagcacuu

SEQ ID NO: 1580525 - RNA, 21 nt, Homo sapiens
cacguuuaaucccagcacuuu

SEQ ID NO: 1580526 - RNA, 21 nt, Homo sapiens
cacuaaaacccuggauugaaa

SEQ ID NO: 1580527 - RNA, 15 nt, Homo sapiens
cacuacuuuacuguu

SEQ ID NO: 1580528 - RNA, 17 nt, Homo sapiens
cacuagcauccacugau

SEQ ID NO: 1580529 - RNA, 15 nt, Homo sapiens
cacuagcccaaugaa

SEQ ID NO: 1580530 - RNA, 21 nt, Homo sapiens
cacuaguccauaagcuuuacc

SEQ ID NO: 1580531 - RNA, 20 nt, Homo sapiens
cacuauuaaguggguuugcc

SEQ ID NO: 1580532 - RNA, 23 nt, Homo sapiens
cacuauuaaguggguuugcccca

SEQ ID NO: 1580533 - RNA, 23 nt, Homo sapiens
cacuauucuuggaccaugccaga

SEQ ID NO: 1580534 - RNA, 21 nt, Homo sapiens
cacuauuuccaaaagcacaug

SEQ ID NO: 1580535 - RNA, 22 nt, Homo sapiens
cacucaaaauagggacuaucua

SEQ ID NO: 1580536 - RNA, 17 nt, Homo sapiens
cacucaaagacauuugu

SEQ ID NO: 1580537 - RNA, 13 nt, Homo sapiens
cacucagaaaaug

SEQ ID NO: 1580538 - RNA, 16 nt, Homo sapiens
cacucagccacuguca

SEQ ID NO: 1580539 - RNA, 17 nt, Homo sapiens
cacucauuucaucucau

SEQ ID NO: 1580540 - RNA, 13 nt, Homo sapiens
cacuccacacucu

SEQ ID NO: 1580541 - RNA, 22 nt, Homo sapiens
cacuccagguggaacaaacaga

SEQ ID NO: 1580542 - RNA, 12 nt, Homo sapiens
cacucccaaagc

SEQ ID NO: 1580543 - RNA, 23 nt, Homo sapiens
cacucccaccugacacaccaggc

SEQ ID NO: 1580544 - RNA, 14 nt, Homo sapiens
cacucccaguccaa

SEQ ID NO: 1580545 - RNA, 13 nt, Homo sapiens
cacuccuccguga

SEQ ID NO: 1580546 - RNA, 18 nt, Homo sapiens
cacuccuccuacuguauu

SEQ ID NO: 1580547 - RNA, 16 nt, Homo sapiens
cacucggggucccugg

SEQ ID NO: 1580548 - RNA, 16 nt, Homo sapiens
cacucuaacuguauau

SEQ ID NO: 1580549 - RNA, 15 nt, Homo sapiens
cacucuggagcauuu

SEQ ID NO: 1580550 - RNA, 16 nt, Homo sapiens
cacucuggagcauuuc

SEQ ID NO: 1580551 - RNA, 14 nt, Homo sapiens
cacucuguaaaacg

SEQ ID NO: 1580552 - RNA, 14 nt, Homo sapiens
cacucuguaaaaug

SEQ ID NO: 1580553 - RNA, 13 nt, Homo sapiens
cacucuucugucu

SEQ ID NO: 1580554 - RNA, 16 nt, Homo sapiens
cacucuugauucuaca

SEQ ID NO: 1580555 - RNA, 18 nt, Homo sapiens
cacugaagagagcauuug

SEQ ID NO: 1580556 - RNA, 15 nt, Homo sapiens
cacugaagagcucuu

SEQ ID NO: 1580557 - RNA, 17 nt, Homo sapiens
cacugaagcaccacagg

SEQ ID NO: 1580558 - RNA, 18 nt, Homo sapiens
cacugaccaagugcuggc

SEQ ID NO: 1580559 - RNA, 17 nt, Homo sapiens
cacugagggguggcacg

SEQ ID NO: 1580560 - RNA, 18 nt, Homo sapiens
cacugaggugaggcuaca

SEQ ID NO: 1580561 - RNA, 15 nt, Homo sapiens
cacugaguugcacau

SEQ ID NO: 1580562 - RNA, 16 nt, Homo sapiens
cacugaguugcacaua

SEQ ID NO: 1580563 - RNA, 13 nt, Homo sapiens
cacugcacuccag

SEQ ID NO: 1580564 - RNA, 22 nt, Homo sapiens
cacugcacuuuccaaugccaca

SEQ ID NO: 1580565 - RNA, 14 nt, Homo sapiens
cacugcagugcuga

SEQ ID NO: 1580566 - RNA, 12 nt, Homo sapiens
cacugcauuugc

SEQ ID NO: 1580567 - RNA, 14 nt, Homo sapiens
cacugcauuugccu

SEQ ID NO: 1580568 - RNA, 15 nt, Homo sapiens
cacugccauuaccca

SEQ ID NO: 1580569 - RNA, 23 nt, Homo sapiens
cacugcccucuuguggugcauug

SEQ ID NO: 1580570 - RNA, 14 nt, Homo sapiens
cacugcccugucuc

SEQ ID NO: 1580571 - RNA, 21 nt, Homo sapiens
cacugcguguggcgcaucucu

SEQ ID NO: 1580572 - RNA, 11 nt, Homo sapiens
cacugcugcau

SEQ ID NO: 1580573 - RNA, 15 nt, Homo sapiens
cacugcugcauucca

SEQ ID NO: 1580574 - RNA, 23 nt, Homo sapiens
cacuggaugucaaacaguaauaa

SEQ ID NO: 1580575 - RNA, 17 nt, Homo sapiens
cacuggcguuacugcuu

SEQ ID NO: 1580576 - RNA, 16 nt, Homo sapiens
cacuggggcagacaau

SEQ ID NO: 1580577 - RNA, 17 nt, Homo sapiens
cacugggugaccagcug

SEQ ID NO: 1580578 - RNA, 21 nt, Homo sapiens
cacugggugagagaggaauaa

SEQ ID NO: 1580579 - RNA, 22 nt, Homo sapiens
cacugggugguggccugguccc

SEQ ID NO: 1580580 - RNA, 16 nt, Homo sapiens
cacugguuuuacacag

SEQ ID NO: 1580581 - RNA, 20 nt, Homo sapiens
cacuguauauaaacauauca

SEQ ID NO: 1580582 - RNA, 15 nt, Homo sapiens
cacuguauguuauag

SEQ ID NO: 1580583 - RNA, 16 nt, Homo sapiens
cacugucacaggcaua

SEQ ID NO: 1580584 - RNA, 21 nt, Homo sapiens
cacugucuauuuaagugcaau

SEQ ID NO: 1580585 - RNA, 22 nt, Homo sapiens
cacugugagugguucaagcaca

SEQ ID NO: 1580586 - RNA, 22 nt, Homo sapiens
cacugugcccggccuguguaca

SEQ ID NO: 1580587 - RNA, 20 nt, Homo sapiens
cacugugcucuauuaccauu

SEQ ID NO: 1580588 - RNA, 16 nt, Homo sapiens
cacugugucauucugu

SEQ ID NO: 1580589 - RNA, 20 nt, Homo sapiens
cacuuaaaaauuaaauugga

SEQ ID NO: 1580590 - RNA, 15 nt, Homo sapiens
cacuuaaacuuuguc

SEQ ID NO: 1580591 - RNA, 17 nt, Homo sapiens
cacuuaagacuguguau

SEQ ID NO: 1580592 - RNA, 19 nt, Homo sapiens
cacuuaguccuuuaucauc

SEQ ID NO: 1580593 - RNA, 23 nt, Homo sapiens
cacuuauaagaaagaucaaagac

SEQ ID NO: 1580594 - RNA, 18 nt, Homo sapiens
cacuuauuucagccaaaa

SEQ ID NO: 1580595 - RNA, 16 nt, Homo sapiens
cagcugguugcuccau

SEQ ID NO: 1580596 - RNA, 22 nt, Homo sapiens
cagcugucagaacacuccaagc

SEQ ID NO: 1580597 - RNA, 13 nt, Homo sapiens
cagcuuaaaccca

SEQ ID NO: 1580598 - RNA, 15 nt, Homo sapiens
cagcuuagauuucau

SEQ ID NO: 1580599 - RNA, 13 nt, Homo sapiens
cagcuuauauuca

SEQ ID NO: 1580600 - RNA, 13 nt, Homo sapiens
cagcuuauucaca

SEQ ID NO: 1580601 - RNA, 16 nt, Homo sapiens
cagcuucaacuuuucu

SEQ ID NO: 1580602 - RNA, 23 nt, Homo sapiens
cagcuuuucccaggagaccauuu

SEQ ID NO: 1580603 - RNA, 22 nt, Homo sapiens
caggaaacaguugcauguagua

SEQ ID NO: 1580604 - RNA, 21 nt, Homo sapiens
caggaaagcuggugucugauu

SEQ ID NO: 1580605 - RNA, 14 nt, Homo sapiens
caggaaaucaaaua

SEQ ID NO: 1580606 - RNA, 22 nt, Homo sapiens
caggaaauuagauaaauaaaaa

SEQ ID NO: 1580607 - RNA, 20 nt, Homo sapiens
caggaacagcaaaugcaaaa

SEQ ID NO: 1580608 - RNA, 17 nt, Homo sapiens
caggaagcccaggagcc

SEQ ID NO: 1580609 - RNA, 19 nt, Homo sapiens
caggaaggaaaaugugaac

SEQ ID NO: 1580610 - RNA, 16 nt, Homo sapiens
caggaaggacuaugaa

SEQ ID NO: 1580611 - RNA, 19 nt, Homo sapiens
caggaagggagaacuugaa

SEQ ID NO: 1580612 - RNA, 21 nt, Homo sapiens
caggaagggcaggaaggagag

SEQ ID NO: 1580613 - RNA, 14 nt, Homo sapiens
caggacagaaccac

SEQ ID NO: 1580614 - RNA, 18 nt, Homo sapiens
caggacagaaccacugag

SEQ ID NO: 1580615 - RNA, 19 nt, Homo sapiens
caggacucugacgucucuu

SEQ ID NO: 1580616 - RNA, 14 nt, Homo sapiens
caggacuuaacaca

SEQ ID NO: 1580617 - RNA, 17 nt, Homo sapiens
caggagaaccacuacau

SEQ ID NO: 1580618 - RNA, 17 nt, Homo sapiens
caggagaaucacuugaa

SEQ ID NO: 1580619 - RNA, 15 nt, Homo sapiens
caggagagucacuug

SEQ ID NO: 1580620 - RNA, 19 nt, Homo sapiens
caggagauggguccagggg

SEQ ID NO: 1580621 - RNA, 17 nt, Homo sapiens
caggagccucacugggg

SEQ ID NO: 1580622 - RNA, 18 nt, Homo sapiens
caggagccucacuggggc

SEQ ID NO: 1580623 - RNA, 11 nt, Homo sapiens
caggagcucuu

SEQ ID NO: 1580624 - RNA, 14 nt, Homo sapiens
caggaggaagugag

SEQ ID NO: 1580625 - RNA, 16 nt, Homo sapiens
caggaguaaaacuccc

SEQ ID NO: 1580626 - RNA, 21 nt, Homo sapiens
caggaguguccuggcugugaa

SEQ ID NO: 1580627 - RNA, 17 nt, Homo sapiens
caggauaagagggauua

SEQ ID NO: 1580628 - RNA, 23 nt, Homo sapiens
caggauauggcuuaggaaugacu

SEQ ID NO: 1580629 - RNA, 19 nt, Homo sapiens
caggauggucucgaucucu

SEQ ID NO: 1580630 - RNA, 20 nt, Homo sapiens
caggauggucucgaucucuu

SEQ ID NO: 1580631 - RNA, 12 nt, Homo sapiens
caggauugaaaa

SEQ ID NO: 1580632 - RNA, 17 nt, Homo sapiens
caggcaagagaauugaa

SEQ ID NO: 1580633 - RNA, 15 nt, Homo sapiens
caggcacacacagcc

SEQ ID NO: 1580634 - RNA, 20 nt, Homo sapiens
caggcacacacagccccuau

SEQ ID NO: 1580635 - RNA, 16 nt, Homo sapiens
caggcacccucaggga

SEQ ID NO: 1580636 - RNA, 13 nt, Homo sapiens
caggcaccugcca

SEQ ID NO: 1580637 - RNA, 12 nt, Homo sapiens
caggcacgugcc

SEQ ID NO: 1580638 - RNA, 14 nt, Homo sapiens
caggcacuccugga

SEQ ID NO: 1580639 - RNA, 12 nt, Homo sapiens
caggcacugaga

SEQ ID NO: 1580640 - RNA, 20 nt, Homo sapiens
caggcagccuccgggcgugu

SEQ ID NO: 1580641 - RNA, 17 nt, Homo sapiens
caggcagggccuggcuc

SEQ ID NO: 1580642 - RNA, 15 nt, Homo sapiens
caggcagggucuguu

SEQ ID NO: 1580643 - RNA, 12 nt, Homo sapiens
caggcagucucu

SEQ ID NO: 1580644 - RNA, 18 nt, Homo sapiens
caggcauagaggcuucuc

SEQ ID NO: 1580645 - RNA, 23 nt, Homo sapiens
caggccaauguaucccugaggaa

SEQ ID NO: 1580646 - RNA, 13 nt, Homo sapiens
caggccaauguca

SEQ ID NO: 1580647 - RNA, 14 nt, Homo sapiens
caggccagcccagc

SEQ ID NO: 1580648 - RNA, 16 nt, Homo sapiens
caggccagcucaggaa

SEQ ID NO: 1580649 - RNA, 14 nt, Homo sapiens
caggccaggugccc

SEQ ID NO: 1580650 - RNA, 18 nt, Homo sapiens
caggccauauuaucaaug

SEQ ID NO: 1580651 - RNA, 20 nt, Homo sapiens
caggccaucaaggaguauau

SEQ ID NO: 1580652 - RNA, 21 nt, Homo sapiens
caggccauggguucaccagcc

SEQ ID NO: 1580653 - RNA, 17 nt, Homo sapiens
caggcccagcugcuccc

SEQ ID NO: 1580654 - RNA, 20 nt, Homo sapiens
caggcccuccagugggcuga

SEQ ID NO: 1580655 - RNA, 23 nt, Homo sapiens
caggcccucccugucuccagggc

SEQ ID NO: 1580656 - RNA, 17 nt, Homo sapiens
caggccucuuguuccuu

SEQ ID NO: 1580657 - RNA, 18 nt, Homo sapiens
caggccugcuagucacug

SEQ ID NO: 1580658 - RNA, 20 nt, Homo sapiens
caggccuggccucaucucag

SEQ ID NO: 1580659 - RNA, 19 nt, Homo sapiens
caggccuuaccgcucuguu

SEQ ID NO: 1580660 - RNA, 12 nt, Homo sapiens
caggcgaagggu

SEQ ID NO: 1580661 - RNA, 14 nt, Homo sapiens
caggcgaagggugg

SEQ ID NO: 1580662 - RNA, 21 nt, Homo sapiens
caggcgcaguggcucaugccu

SEQ ID NO: 1580663 - RNA, 13 nt, Homo sapiens
caggcgugaucca

SEQ ID NO: 1580664 - RNA, 19 nt, Homo sapiens
caggcuacuguucuugaca

SEQ ID NO: 1580665 - RNA, 20 nt, Homo sapiens
caggcucuugacuacuugga

SEQ ID NO: 1580666 - RNA, 23 nt, Homo sapiens
caggcugagaacucguucaccuc

SEQ ID NO: 1580667 - RNA, 14 nt, Homo sapiens
caggcugcaguggc

SEQ ID NO: 1580668 - RNA, 19 nt, Homo sapiens
caggcugggccauguccaa

SEQ ID NO: 1580669 - RNA, 22 nt, Homo sapiens
caggcugggccauguccaaaga

SEQ ID NO: 1580670 - RNA, 21 nt, Homo sapiens
caggcugguuugcaagaauga

SEQ ID NO: 1580671 - RNA, 13 nt, Homo sapiens
caggcuguucuca

SEQ ID NO: 1580672 - RNA, 13 nt, Homo sapiens
caggcuugugcaa

SEQ ID NO: 1580673 - RNA, 13 nt, Homo sapiens
caggcuuuguaca

SEQ ID NO: 1580674 - RNA, 19 nt, Homo sapiens
cagggaaaauuauuugcau

SEQ ID NO: 1580675 - RNA, 14 nt, Homo sapiens
cagggaacuuagua

SEQ ID NO: 1580676 - RNA, 14 nt, Homo sapiens
cagggaauggagcu

SEQ ID NO: 1580677 - RNA, 16 nt, Homo sapiens
cagggacaaccaccag

SEQ ID NO: 1580678 - RNA, 13 nt, Homo sapiens
cagggacugucuu

SEQ ID NO: 1580679 - RNA, 13 nt, Homo sapiens
cagggacuugaac

SEQ ID NO: 1580680 - RNA, 13 nt, Homo sapiens
cagggcaaaauau

SEQ ID NO: 1580681 - RNA, 14 nt, Homo sapiens
cagggccacucaac

SEQ ID NO: 1580682 - RNA, 16 nt, Homo sapiens
cagggccaggccucug

SEQ ID NO: 1580683 - RNA, 21 nt, Homo sapiens
cagggccccccaacuguggua

SEQ ID NO: 1580684 - RNA, 21 nt, Homo sapiens
cagggccugacuugagccacu

SEQ ID NO: 1580685 - RNA, 19 nt, Homo sapiens
cagggcugaggccucucau

SEQ ID NO: 1580686 - RNA, 20 nt, Homo sapiens
cagggcuuuacuccguaaca

SEQ ID NO: 1580687 - RNA, 18 nt, Homo sapiens
caggggccaaccucaggc

SEQ ID NO: 1580688 - RNA, 19 nt, Homo sapiens
caggggccaaccucaggcu

SEQ ID NO: 1580689 - RNA, 22 nt, Homo sapiens
cagggggagcucccaagcugcc

SEQ ID NO: 1580690 - RNA, 13 nt, Homo sapiens
caggguaccucaa

SEQ ID NO: 1580691 - RNA, 21 nt, Homo sapiens
caggguccaggaauggugcuu

SEQ ID NO: 1580692 - RNA, 14 nt, Homo sapiens
cagggugucccagg

SEQ ID NO: 1580693 - RNA, 21 nt, Homo sapiens
caggguuucaccauguugccc

SEQ ID NO: 1580694 - RNA, 15 nt, Homo sapiens
caggguuucucugca

SEQ ID NO: 1580695 - RNA, 12 nt, Homo sapiens
cagguaauacaa

SEQ ID NO: 1580696 - RNA, 13 nt, Homo sapiens
cagguaaugugaa

SEQ ID NO: 1580697 - RNA, 19 nt, Homo sapiens
cagguaccucuuucagggu

SEQ ID NO: 1580698 - RNA, 13 nt, Homo sapiens
caggucacuuuac

SEQ ID NO: 1580699 - RNA, 23 nt, Homo sapiens
caggucagcgcgguccugacucc

SEQ ID NO: 1580700 - RNA, 22 nt, Homo sapiens
cagguccuccccucucuuguca

SEQ ID NO: 1580701 - RNA, 21 nt, Homo sapiens
caggucuccaccugcacauug

SEQ ID NO: 1580702 - RNA, 15 nt, Homo sapiens
caggucuuuaaauca

SEQ ID NO: 1580703 - RNA, 16 nt, Homo sapiens
caggugagaaaaccau

SEQ ID NO: 1580704 - RNA, 18 nt, Homo sapiens
caggugauccgccuaccu

SEQ ID NO: 1580705 - RNA, 19 nt, Homo sapiens
caggugcaacagacuugaa

SEQ ID NO: 1580706 - RNA, 14 nt, Homo sapiens
caggugcauagcaa

SEQ ID NO: 1580707 - RNA, 16 nt, Homo sapiens
caggugcucuguggau

SEQ ID NO: 1580708 - RNA, 15 nt, Homo sapiens
cagguggaggcaaca

SEQ ID NO: 1580709 - RNA, 17 nt, Homo sapiens
cagguggcucagugcca

SEQ ID NO: 1580710 - RNA, 22 nt, Homo sapiens
caggugucuuuaacugucauug

SEQ ID NO: 1580711 - RNA, 20 nt, Homo sapiens
caggugugaaccacugugcc

SEQ ID NO: 1580712 - RNA, 21 nt, Homo sapiens
cagguguucuucauuaccuca

SEQ ID NO: 1580713 - RNA, 16 nt, Homo sapiens
cagguuccaaucagaa

SEQ ID NO: 1580714 - RNA, 18 nt, Homo sapiens
cuggccuauguggucuaa

SEQ ID NO: 1580715 - RNA, 16 nt, Homo sapiens
cuggcgacugccccug

SEQ ID NO: 1580716 - RNA, 16 nt, Homo sapiens
cuggcguucucaagaa

SEQ ID NO: 1580717 - RNA, 15 nt, Homo sapiens
cuggcucuaccuucc

SEQ ID NO: 1580718 - RNA, 15 nt, Homo sapiens
cuggcuuagugccac

SEQ ID NO: 1580719 - RNA, 13 nt, Homo sapiens
cuggcuucauaca

SEQ ID NO: 1580720 - RNA, 14 nt, Homo sapiens
cuggcuuugccucu

SEQ ID NO: 1580721 - RNA, 13 nt, Homo sapiens
cugggaaacuggg

SEQ ID NO: 1580722 - RNA, 17 nt, Homo sapiens
cugggaaggcaauuuca

SEQ ID NO: 1580723 - RNA, 13 nt, Homo sapiens
cugggaggacauu

SEQ ID NO: 1580724 - RNA, 22 nt, Homo sapiens
cugggaguguucccgugccugg

SEQ ID NO: 1580725 - RNA, 18 nt, Homo sapiens
cugggauauggcugccca

SEQ ID NO: 1580726 - RNA, 23 nt, Homo sapiens
cugggauggggcuucacugcugu

SEQ ID NO: 1580727 - RNA, 21 nt, Homo sapiens
cugggauuacaggcgugaucc

SEQ ID NO: 1580728 - RNA, 21 nt, Homo sapiens
cugggcagcaccucuggucag

SEQ ID NO: 1580729 - RNA, 13 nt, Homo sapiens
cugggccaugucc

SEQ ID NO: 1580730 - RNA, 14 nt, Homo sapiens
cugggccaugucca

SEQ ID NO: 1580731 - RNA, 15 nt, Homo sapiens
cugggccccaccacc

SEQ ID NO: 1580732 - RNA, 16 nt, Homo sapiens
cugggccccuccagga

SEQ ID NO: 1580733 - RNA, 15 nt, Homo sapiens
cugggccugaccaaa

SEQ ID NO: 1580734 - RNA, 17 nt, Homo sapiens
cugggcuaaggaaguau

SEQ ID NO: 1580735 - RNA, 15 nt, Homo sapiens
cugggcucacugugc

SEQ ID NO: 1580736 - RNA, 17 nt, Homo sapiens
cugggcucacugugcug

SEQ ID NO: 1580737 - RNA, 17 nt, Homo sapiens
cuggggaggcugaggca

SEQ ID NO: 1580738 - RNA, 16 nt, Homo sapiens
cuggggcagacaauaa

SEQ ID NO: 1580739 - RNA, 15 nt, Homo sapiens
cuggggcaggucacu

SEQ ID NO: 1580740 - RNA, 16 nt, Homo sapiens
cuggggucuccgaaga

SEQ ID NO: 1580741 - RNA, 14 nt, Homo sapiens
cugggguugccaga

SEQ ID NO: 1580742 - RNA, 15 nt, Homo sapiens
cugggugacagagug

SEQ ID NO: 1580743 - RNA, 19 nt, Homo sapiens
cugggugaccucacuuuag

SEQ ID NO: 1580744 - RNA, 21 nt, Homo sapiens
cuggguggaagugugugccaa

SEQ ID NO: 1580745 - RNA, 18 nt, Homo sapiens
cugggugucaagugccug

SEQ ID NO: 1580746 - RNA, 20 nt, Homo sapiens
cuggguucccuuuccuucca

SEQ ID NO: 1580747 - RNA, 17 nt, Homo sapiens
cugguaaaagcaccauu

SEQ ID NO: 1580748 - RNA, 20 nt, Homo sapiens
cugguaauaaaugugacuca

SEQ ID NO: 1580749 - RNA, 21 nt, Homo sapiens
cugguaauaaaugugacucag

SEQ ID NO: 1580750 - RNA, 17 nt, Homo sapiens
cugguaauagcuguaaa

SEQ ID NO: 1580751 - RNA, 20 nt, Homo sapiens
cugguagaaaaacaucugaa

SEQ ID NO: 1580752 - RNA, 15 nt, Homo sapiens
cugguauguguggau

SEQ ID NO: 1580753 - RNA, 16 nt, Homo sapiens
cugguauguguggaug

SEQ ID NO: 1580754 - RNA, 16 nt, Homo sapiens
cuggucaguacccacu

SEQ ID NO: 1580755 - RNA, 20 nt, Homo sapiens
cuggugagaucaacaacacu

SEQ ID NO: 1580756 - RNA, 16 nt, Homo sapiens
cuggugagucaccacu

SEQ ID NO: 1580757 - RNA, 13 nt, Homo sapiens
cuggugccauuuc

SEQ ID NO: 1580758 - RNA, 17 nt, Homo sapiens
cuggugcuacuccaugc

SEQ ID NO: 1580759 - RNA, 12 nt, Homo sapiens
cuggugcuccaa

SEQ ID NO: 1580760 - RNA, 16 nt, Homo sapiens
cugguggcaccagaug

SEQ ID NO: 1580761 - RNA, 13 nt, Homo sapiens
cugguucagaaau

SEQ ID NO: 1580762 - RNA, 18 nt, Homo sapiens
cugguucucucucuuagc

SEQ ID NO: 1580763 - RNA, 16 nt, Homo sapiens
cuguaaaaaauggagc

SEQ ID NO: 1580764 - RNA, 23 nt, Homo sapiens
cuguaaacuguguauuccaagac

SEQ ID NO: 1580765 - RNA, 23 nt, Homo sapiens
cuguaacagcggcaggguguccc

SEQ ID NO: 1580766 - RNA, 18 nt, Homo sapiens
cuguaagauaauguugcu

SEQ ID NO: 1580767 - RNA, 19 nt, Homo sapiens
cuguaaucccaacacuuug

SEQ ID NO: 1580768 - RNA, 17 nt, Homo sapiens
cuguaaucucagcacuu

SEQ ID NO: 1580769 - RNA, 19 nt, Homo sapiens
cuguaauguaaauaaacua

SEQ ID NO: 1580770 - RNA, 16 nt, Homo sapiens
cuguaauugaauauaa

SEQ ID NO: 1580771 - RNA, 14 nt, Homo sapiens
cuguacaauugcau

SEQ ID NO: 1580772 - RNA, 16 nt, Homo sapiens
cuguaccgacuuugau

SEQ ID NO: 1580773 - RNA, 13 nt, Homo sapiens
cuguaccuccaaa

SEQ ID NO: 1580774 - RNA, 22 nt, Homo sapiens
cuguacuauccuguaaauauau

SEQ ID NO: 1580775 - RNA, 14 nt, Homo sapiens
cuguacucuuugcu

SEQ ID NO: 1580776 - RNA, 16 nt, Homo sapiens
cuguacucuuugcuag

SEQ ID NO: 1580777 - RNA, 22 nt, Homo sapiens
cuguagaaaagggaacugaaca

SEQ ID NO: 1580778 - RNA, 23 nt, Homo sapiens
cuguagaaaugaugauguggaag

SEQ ID NO: 1580779 - RNA, 21 nt, Homo sapiens
cuguagauucagguaauacaa

SEQ ID NO: 1580780 - RNA, 12 nt, Homo sapiens
cuguagccucag

SEQ ID NO: 1580781 - RNA, 21 nt, Homo sapiens
cuguauaaucuauuuacauaa

SEQ ID NO: 1580782 - RNA, 15 nt, Homo sapiens
cuguauagcugcuuc

SEQ ID NO: 1580783 - RNA, 22 nt, Homo sapiens
cuguauguaaacuguuacugaa

SEQ ID NO: 1580784 - RNA, 18 nt, Homo sapiens
cuguauuuaacaaaaagu

SEQ ID NO: 1580785 - RNA, 24 nt, Homo sapiens
cuguauuuaacaaaaagugcuuca

SEQ ID NO: 1580786 - RNA, 19 nt, Homo sapiens
cuguauuuuacaagucaaa

SEQ ID NO: 1580787 - RNA, 20 nt, Homo sapiens
cuguauuuuacaagucaaaa

SEQ ID NO: 1580788 - RNA, 12 nt, Homo sapiens
cugucaagaaga

SEQ ID NO: 1580789 - RNA, 15 nt, Homo sapiens
cugucaagcuggugc

SEQ ID NO: 1580790 - RNA, 22 nt, Homo sapiens
cugucaauguccuacugagaca

SEQ ID NO: 1580791 - RNA, 14 nt, Homo sapiens
cugucacaccagcc

SEQ ID NO: 1580792 - RNA, 18 nt, Homo sapiens
cugucacuagucucacca

SEQ ID NO: 1580793 - RNA, 12 nt, Homo sapiens
cugucagauuaa

SEQ ID NO: 1580794 - RNA, 22 nt, Homo sapiens
cugucagcaagacugaagaugg

SEQ ID NO: 1580795 - RNA, 18 nt, Homo sapiens
cugucaggguugucuacc

SEQ ID NO: 1580796 - RNA, 15 nt, Homo sapiens
cugucauuccuaaaa

SEQ ID NO: 1580797 - RNA, 17 nt, Homo sapiens
cuguccacguacuuaau

SEQ ID NO: 1580798 - RNA, 20 nt, Homo sapiens
cugucccaccccuaccucua

SEQ ID NO: 1580799 - RNA, 23 nt, Homo sapiens
cugucccagccccggcaagccac

SEQ ID NO: 1580800 - RNA, 14 nt, Homo sapiens
cuguccccacugcc

SEQ ID NO: 1580801 - RNA, 23 nt, Homo sapiens
cuguccccucuuccuacccugcc

SEQ ID NO: 1580802 - RNA, 19 nt, Homo sapiens
cugucccucauccauagca

SEQ ID NO: 1580803 - RNA, 15 nt, Homo sapiens
cuguccuaaucauau

SEQ ID NO: 1580804 - RNA, 16 nt, Homo sapiens
cuguccugcacacccu

SEQ ID NO: 1580805 - RNA, 18 nt, Homo sapiens
cuguccuguuucugucaa

SEQ ID NO: 1580806 - RNA, 17 nt, Homo sapiens
cuguccuugaaugccau

SEQ ID NO: 1580807 - RNA, 13 nt, Homo sapiens
cugucucaaaaaa

SEQ ID NO: 1580808 - RNA, 19 nt, Homo sapiens
cugucugucaccagcuauc

SEQ ID NO: 1580809 - RNA, 15 nt, Homo sapiens
cugucugugcacaug

SEQ ID NO: 1580810 - RNA, 16 nt, Homo sapiens
cugucuugugagcuga

SEQ ID NO: 1580811 - RNA, 23 nt, Homo sapiens
cugucuuucaaugacacccugau

SEQ ID NO: 1580812 - RNA, 15 nt, Homo sapiens
cugugaaauaucauc

SEQ ID NO: 1580813 - RNA, 22 nt, Homo sapiens
cugugaauggaggcagagaccu

SEQ ID NO: 1580814 - RNA, 22 nt, Homo sapiens
cugugacaaaacaucuuuucac

SEQ ID NO: 1580815 - RNA, 12 nt, Homo sapiens
cugugacauuuc

SEQ ID NO: 1580816 - RNA, 13 nt, Homo sapiens
cugugacuuugcc

SEQ ID NO: 1580817 - RNA, 18 nt, Homo sapiens
cugugagcauggggccag

SEQ ID NO: 1580818 - RNA, 18 nt, Homo sapiens
cugugauuuuaagacaag

SEQ ID NO: 1580819 - RNA, 14 nt, Homo sapiens
cugugcaaagggaa

SEQ ID NO: 1580820 - RNA, 15 nt, Homo sapiens
cugugcaaagggaac

SEQ ID NO: 1580821 - RNA, 15 nt, Homo sapiens
cugugcagucacugg

SEQ ID NO: 1580822 - RNA, 23 nt, Homo sapiens
cugugccaauacagacaaagcau

SEQ ID NO: 1580823 - RNA, 23 nt, Homo sapiens
cugugcccagcacagugccugac

SEQ ID NO: 1580824 - RNA, 16 nt, Homo sapiens
cugugcccuccaaaga

SEQ ID NO: 1580825 - RNA, 22 nt, Homo sapiens
cugugccgggaggcagccacag

SEQ ID NO: 1580826 - RNA, 21 nt, Homo sapiens
cuguggaacuacauuacugua

SEQ ID NO: 1580827 - RNA, 14 nt, Homo sapiens
cuguggucucaggc

SEQ ID NO: 1580828 - RNA, 23 nt, Homo sapiens
cuguggugugucccccucugucc

SEQ ID NO: 1580829 - RNA, 16 nt, Homo sapiens
cuguguacauaacuga

SEQ ID NO: 1580830 - RNA, 13 nt, Homo sapiens
cuguguaucucag

SEQ ID NO: 1580831 - RNA, 17 nt, Homo sapiens
cuguguauuaacaugca

SEQ ID NO: 1580832 - RNA, 15 nt, Homo sapiens
cuucaccaagugcaa

SEQ ID NO: 1580833 - RNA, 15 nt, Homo sapiens
cuucacucaugcaaa

SEQ ID NO: 1580834 - RNA, 11 nt, Homo sapiens
cuucacugggc

SEQ ID NO: 1580835 - RNA, 23 nt, Homo sapiens
cuucacuuacaagaaaggccuga

SEQ ID NO: 1580836 - RNA, 16 nt, Homo sapiens
cuucacuuucuucaaa

SEQ ID NO: 1580837 - RNA, 14 nt, Homo sapiens
cuucagaacugccc

SEQ ID NO: 1580838 - RNA, 16 nt, Homo sapiens
cuucagcuugcuuaga

SEQ ID NO: 1580839 - RNA, 19 nt, Homo sapiens
cuucagguaacacuacaga

SEQ ID NO: 1580840 - RNA, 19 nt, Homo sapiens
cuucagucuugguaaaaca

SEQ ID NO: 1580841 - RNA, 22 nt, Homo sapiens
cuucauccauagacacaguauu

SEQ ID NO: 1580842 - RNA, 22 nt, Homo sapiens
cuucaucgaaucuacuaauucc

SEQ ID NO: 1580843 - RNA, 12 nt, Homo sapiens
cuucaugcuuuu

SEQ ID NO: 1580844 - RNA, 14 nt, Homo sapiens
cuucaugugcugcc

SEQ ID NO: 1580845 - RNA, 17 nt, Homo sapiens
cuucauuuccaccaggc

SEQ ID NO: 1580846 - RNA, 14 nt, Homo sapiens
cuuccacugagggc

SEQ ID NO: 1580847 - RNA, 14 nt, Homo sapiens
cuuccacuguuaaa

SEQ ID NO: 1580848 - RNA, 13 nt, Homo sapiens
cuuccagauccug

SEQ ID NO: 1580849 - RNA, 14 nt, Homo sapiens
cuuccagauuacaa

SEQ ID NO: 1580850 - RNA, 20 nt, Homo sapiens
cuuccagggcucuuccagau

SEQ ID NO: 1580851 - RNA, 18 nt, Homo sapiens
cuuccaggggaaccugcc

SEQ ID NO: 1580852 - RNA, 23 nt, Homo sapiens
cuuccagguguuacuguaauucc

SEQ ID NO: 1580853 - RNA, 16 nt, Homo sapiens
cuuccaguuugcuuga

SEQ ID NO: 1580854 - RNA, 18 nt, Homo sapiens
cuuccaguuugcuugaua

SEQ ID NO: 1580855 - RNA, 14 nt, Homo sapiens
cuuccaucuaguca

SEQ ID NO: 1580856 - RNA, 16 nt, Homo sapiens
cuuccaugugccuuuc

SEQ ID NO: 1580857 - RNA, 19 nt, Homo sapiens
cuucccaacguacuccuca

SEQ ID NO: 1580858 - RNA, 12 nt, Homo sapiens
cuucccacggcu

SEQ ID NO: 1580859 - RNA, 23 nt, Homo sapiens
cuucccagcacuaugcuuuccuu

SEQ ID NO: 1580860 - RNA, 21 nt, Homo sapiens
cuucccaguaacccuaaggaa

SEQ ID NO: 1580861 - RNA, 14 nt, Homo sapiens
cuuccccauggcag

SEQ ID NO: 1580862 - RNA, 21 nt, Homo sapiens
cuucccuggcuuguaacucca

SEQ ID NO: 1580863 - RNA, 21 nt, Homo sapiens
cuuccguggucagagugccac

SEQ ID NO: 1580864 - RNA, 18 nt, Homo sapiens
cuuccucaaauacaugca

SEQ ID NO: 1580865 - RNA, 12 nt, Homo sapiens
cuuccuccucag

SEQ ID NO: 1580866 - RNA, 16 nt, Homo sapiens
cuuccucuagaagcca

SEQ ID NO: 1580867 - RNA, 22 nt, Homo sapiens
cuuccucucaagcuagccagag

SEQ ID NO: 1580868 - RNA, 15 nt, Homo sapiens
cuuccucuccugucu

SEQ ID NO: 1580869 - RNA, 20 nt, Homo sapiens
cuuccugcguagaagauaug

SEQ ID NO: 1580870 - RNA, 23 nt, Homo sapiens
cuuccugcguagaagauauggaa

SEQ ID NO: 1580871 - RNA, 15 nt, Homo sapiens
cuuccugucugagua

SEQ ID NO: 1580872 - RNA, 19 nt, Homo sapiens
cuuccuguguaacaucugc

SEQ ID NO: 1580873 - RNA, 23 nt, Homo sapiens
cuuccuuauuuagccuaggagua

SEQ ID NO: 1580874 - RNA, 12 nt, Homo sapiens
cuucgcacacac

SEQ ID NO: 1580875 - RNA, 14 nt, Homo sapiens
cuucuaaaccaaaa

SEQ ID NO: 1580876 - RNA, 16 nt, Homo sapiens
cuucuacaauuguggu

SEQ ID NO: 1580877 - RNA, 18 nt, Homo sapiens
cuucuaggucacuucuca

SEQ ID NO: 1580878 - RNA, 21 nt, Homo sapiens
cuucuaggucacuucucacaa

SEQ ID NO: 1580879 - RNA, 22 nt, Homo sapiens
cuucuaggucacuucucacaau

SEQ ID NO: 1580880 - RNA, 13 nt, Homo sapiens
cuucuauuaauca

SEQ ID NO: 1580881 - RNA, 20 nt, Homo sapiens
cuucucagauuucugaggaa

SEQ ID NO: 1580882 - RNA, 15 nt, Homo sapiens
cuucucaucugcaaa

SEQ ID NO: 1580883 - RNA, 12 nt, Homo sapiens
cuucuccaggga

SEQ ID NO: 1580884 - RNA, 18 nt, Homo sapiens
cuucuccauccacauggg

SEQ ID NO: 1580885 - RNA, 17 nt, Homo sapiens
cuucucuucacagucac

SEQ ID NO: 1580886 - RNA, 16 nt, Homo sapiens
cuucucuugacagucu

SEQ ID NO: 1580887 - RNA, 15 nt, Homo sapiens
cuucucuuugacaaa

SEQ ID NO: 1580888 - RNA, 16 nt, Homo sapiens
cuucugaguugcacau

SEQ ID NO: 1580889 - RNA, 14 nt, Homo sapiens
cuucugcaacaucu

SEQ ID NO: 1580890 - RNA, 15 nt, Homo sapiens
cuucugccuguuaua

SEQ ID NO: 1580891 - RNA, 18 nt, Homo sapiens
cuucuggagaaagcucau

SEQ ID NO: 1580892 - RNA, 23 nt, Homo sapiens
cuucuggggcaggcugggccaug

SEQ ID NO: 1580893 - RNA, 19 nt, Homo sapiens
cuucuguuaacugaagccu

SEQ ID NO: 1580894 - RNA, 16 nt, Homo sapiens
cuucuuaacagacuca

SEQ ID NO: 1580895 - RNA, 16 nt, Homo sapiens
cuucuucccagcacua

SEQ ID NO: 1580896 - RNA, 20 nt, Homo sapiens
cuucuuuauacaaugaccac

SEQ ID NO: 1580897 - RNA, 14 nt, Homo sapiens
cuucuuucauucua

SEQ ID NO: 1580898 - RNA, 18 nt, Homo sapiens
cuucuuucauucuaaucc

SEQ ID NO: 1580899 - RNA, 13 nt, Homo sapiens
cuucuuugcugca

SEQ ID NO: 1580900 - RNA, 21 nt, Homo sapiens
cuucuuuugaacaaaugacau

SEQ ID NO: 1580901 - RNA, 17 nt, Homo sapiens
cuugaaaccaguauuua

SEQ ID NO: 1580902 - RNA, 16 nt, Homo sapiens
cuugaaacugagaugu

SEQ ID NO: 1580903 - RNA, 17 nt, Homo sapiens
cuugaaagcaguuaaac

SEQ ID NO: 1580904 - RNA, 22 nt, Homo sapiens
cuugaaaugaugguaaguuaau

SEQ ID NO: 1580905 - RNA, 13 nt, Homo sapiens
cuugaacaaaagg

SEQ ID NO: 1580906 - RNA, 14 nt, Homo sapiens
cuugaagggcuuua

SEQ ID NO: 1580907 - RNA, 19 nt, Homo sapiens
cuugaaguauccacagaaa

SEQ ID NO: 1580908 - RNA, 16 nt, Homo sapiens
cuugaauaaccaucug

SEQ ID NO: 1580909 - RNA, 18 nt, Homo sapiens
cuugaauaaccaucugaa

SEQ ID NO: 1580910 - RNA, 16 nt, Homo sapiens
cuugacaaucaucucc

SEQ ID NO: 1580911 - RNA, 14 nt, Homo sapiens
cuugacauaccuac

SEQ ID NO: 1580912 - RNA, 12 nt, Homo sapiens
cuugacauuuau

SEQ ID NO: 1580913 - RNA, 16 nt, Homo sapiens
cuugacauuuaucacc

SEQ ID NO: 1580914 - RNA, 18 nt, Homo sapiens
cuugagaagcugccauau

SEQ ID NO: 1580915 - RNA, 19 nt, Homo sapiens
cuugagccacagucacugg

SEQ ID NO: 1580916 - RNA, 20 nt, Homo sapiens
cuugagccacagucacugga

SEQ ID NO: 1580917 - RNA, 20 nt, Homo sapiens
cuugagccgggccccugggc

SEQ ID NO: 1580918 - RNA, 16 nt, Homo sapiens
cuugagggacaaugcc

SEQ ID NO: 1580919 - RNA, 14 nt, Homo sapiens
cuugaguucccaga

SEQ ID NO: 1580920 - RNA, 22 nt, Homo sapiens
cuugaucaacaucuuuucuugc

SEQ ID NO: 1580921 - RNA, 13 nt, Homo sapiens
cuugaucacaugc

SEQ ID NO: 1580922 - RNA, 17 nt, Homo sapiens
cuugaucucucuugucc

SEQ ID NO: 1580923 - RNA, 20 nt, Homo sapiens
cuugauguuccaccugccac

SEQ ID NO: 1580924 - RNA, 16 nt, Homo sapiens
cuugauuagaccuaau

SEQ ID NO: 1580925 - RNA, 16 nt, Homo sapiens
cuugauuuuuauaugu

SEQ ID NO: 1580926 - RNA, 21 nt, Homo sapiens
cuugcaaaacagggauuauca

SEQ ID NO: 1580927 - RNA, 21 nt, Homo sapiens
cuugcaagggaagagccuuua

SEQ ID NO: 1580928 - RNA, 13 nt, Homo sapiens
cuugcacagccaa

SEQ ID NO: 1580929 - RNA, 20 nt, Homo sapiens
cuugcagcuguaaacauauu

SEQ ID NO: 1580930 - RNA, 14 nt, Homo sapiens
cuugcagggccguu

SEQ ID NO: 1580931 - RNA, 21 nt, Homo sapiens
cuugcauuugugguaaucuac

SEQ ID NO: 1580932 - RNA, 13 nt, Homo sapiens
cuugccauaaaac

SEQ ID NO: 1580933 - RNA, 20 nt, Homo sapiens
cuugccauuuguagcuuugc

SEQ ID NO: 1580934 - RNA, 15 nt, Homo sapiens
cuugcccacuggccg

SEQ ID NO: 1580935 - RNA, 20 nt, Homo sapiens
cuugcccagagaugccucca

SEQ ID NO: 1580936 - RNA, 22 nt, Homo sapiens
cuugcccagccuggaugccauc

SEQ ID NO: 1580937 - RNA, 21 nt, Homo sapiens
cuugccugugcuacaauucau

SEQ ID NO: 1580938 - RNA, 17 nt, Homo sapiens
cuugcuaccaguauuua

SEQ ID NO: 1580939 - RNA, 17 nt, Homo sapiens
cuugcuguugacauauu

SEQ ID NO: 1580940 - RNA, 20 nt, Homo sapiens
cuugcuuuccaaguaaaggu

SEQ ID NO: 1580941 - RNA, 16 nt, Homo sapiens
cuugcuuucucucuca

SEQ ID NO: 1580942 - RNA, 21 nt, Homo sapiens
cuuggaaauagaaagaagcca

SEQ ID NO: 1580943 - RNA, 18 nt, Homo sapiens
cuuggaaaugguggugcu

SEQ ID NO: 1580944 - RNA, 15 nt, Homo sapiens
cuuggaccguaucac

SEQ ID NO: 1580945 - RNA, 13 nt, Homo sapiens
cuuggaccucagu

SEQ ID NO: 1580946 - RNA, 22 nt, Homo sapiens
cuuggagaaaauggguuuauuc

SEQ ID NO: 1580947 - RNA, 16 nt, Homo sapiens
cuuggaggaaugacaa

SEQ ID NO: 1580948 - RNA, 16 nt, Homo sapiens
cuuggagugugugaua

SEQ ID NO: 1580949 - RNA, 19 nt, Homo sapiens
cuuggaucagauccuggaa

SEQ ID NO: 1580950 - RNA, 11 nt, Homo sapiens
cuuugucacuu

SEQ ID NO: 1580951 - RNA, 13 nt, Homo sapiens
cuuugucuugccc

SEQ ID NO: 1580952 - RNA, 18 nt, Homo sapiens
cuuugugaaaacuacuga

SEQ ID NO: 1580953 - RNA, 21 nt, Homo sapiens
cuuuguguucaguuccacuau

SEQ ID NO: 1580954 - RNA, 15 nt, Homo sapiens
cuuuguuaaaaccaa

SEQ ID NO: 1580955 - RNA, 15 nt, Homo sapiens
cuuuguucugugauu

SEQ ID NO: 1580956 - RNA, 15 nt, Homo sapiens
cuuuguuuacaugag

SEQ ID NO: 1580957 - RNA, 23 nt, Homo sapiens
cuuuguuuacaugaguucaaaua

SEQ ID NO: 1580958 - RNA, 19 nt, Homo sapiens
cuuuuaaaaugcaauguaa

SEQ ID NO: 1580959 - RNA, 16 nt, Homo sapiens
cuuuuaaccaucugau

SEQ ID NO: 1580960 - RNA, 15 nt, Homo sapiens
cuuuuaaggcuaaaa

SEQ ID NO: 1580961 - RNA, 16 nt, Homo sapiens
cuuuuauaguggaaaa

SEQ ID NO: 1580962 - RNA, 14 nt, Homo sapiens
cuuuuaucucacaa

SEQ ID NO: 1580963 - RNA, 15 nt, Homo sapiens
cuuuuaucucacaaa

SEQ ID NO: 1580964 - RNA, 21 nt, Homo sapiens
cuuuuauguguugaugacuca

SEQ ID NO: 1580965 - RNA, 13 nt, Homo sapiens
cuuuucaaugugu

SEQ ID NO: 1580966 - RNA, 15 nt, Homo sapiens
cuuuucagauugugg

SEQ ID NO: 1580967 - RNA, 22 nt, Homo sapiens
cuuuucauggucucugcaccca

SEQ ID NO: 1580968 - RNA, 18 nt, Homo sapiens
cuuuucccauugccaugc

SEQ ID NO: 1580969 - RNA, 21 nt, Homo sapiens
cuuuuccccggucccuugaga

SEQ ID NO: 1580970 - RNA, 11 nt, Homo sapiens
cuuuuccucug

SEQ ID NO: 1580971 - RNA, 19 nt, Homo sapiens
cuuuucucacaaaaaggca

SEQ ID NO: 1580972 - RNA, 21 nt, Homo sapiens
cuuuucuccucacuguaucca

SEQ ID NO: 1580973 - RNA, 22 nt, Homo sapiens
cuuuucuccucacuguauccag

SEQ ID NO: 1580974 - RNA, 21 nt, Homo sapiens
cuuuucuggcaaaaaggagcc

SEQ ID NO: 1580975 - RNA, 18 nt, Homo sapiens
cuuuucuugccucugucc

SEQ ID NO: 1580976 - RNA, 17 nt, Homo sapiens
cuuuugaaaaacaacug

SEQ ID NO: 1580977 - RNA, 17 nt, Homo sapiens
cuuuugaaucaaucugg

SEQ ID NO: 1580978 - RNA, 15 nt, Homo sapiens
cuuuugaaugaugcc

SEQ ID NO: 1580979 - RNA, 21 nt, Homo sapiens
cuuuugagacuuuuuggugga

SEQ ID NO: 1580980 - RNA, 14 nt, Homo sapiens
cuuuugcauugcca

SEQ ID NO: 1580981 - RNA, 15 nt, Homo sapiens
cuuuuguaccaaaua

SEQ ID NO: 1580982 - RNA, 23 nt, Homo sapiens
cuuuugucaauugcaccaaaaga

SEQ ID NO: 1580983 - RNA, 18 nt, Homo sapiens
cuuuuguuaaugcauugu

SEQ ID NO: 1580984 - RNA, 18 nt, Homo sapiens
cuuuuuaaaaaaguuugg

SEQ ID NO: 1580985 - RNA, 17 nt, Homo sapiens
cuuuuuaaauccuaaaa

SEQ ID NO: 1580986 - RNA, 23 nt, Homo sapiens
cuuuuuaaauccuaaaaaacacu

SEQ ID NO: 1580987 - RNA, 15 nt, Homo sapiens
cuuuuucacugccua

SEQ ID NO: 1580988 - RNA, 13 nt, Homo sapiens
cuuuuuccacaag

SEQ ID NO: 1580989 - RNA, 19 nt, Homo sapiens
cuuuuuccccuugauggaa

SEQ ID NO: 1580990 - RNA, 18 nt, Homo sapiens
cuuuuuccugugacaaaa

SEQ ID NO: 1580991 - RNA, 15 nt, Homo sapiens
cuuuuuccuuacugu

SEQ ID NO: 1580992 - RNA, 16 nt, Homo sapiens
cuuuuucuacauguga

SEQ ID NO: 1580993 - RNA, 18 nt, Homo sapiens
cuuuuucuucuucccucc

SEQ ID NO: 1580994 - RNA, 20 nt, Homo sapiens
cuuuuugggaccaucacuga

SEQ ID NO: 1580995 - RNA, 20 nt, Homo sapiens
cuuuuugguuuuuacuuaac

SEQ ID NO: 1580996 - RNA, 16 nt, Homo sapiens
cuuuuuuucuguacca

SEQ ID NO: 1580997 - RNA, 17 nt, Homo sapiens
cuuuuuuucuguaccag

SEQ ID NO: 1580998 - RNA, 14 nt, Homo sapiens
cuuuuuuuguaugu

SEQ ID NO: 1580999 - RNA, 18 nt, Homo sapiens
cuuuuuuuuaaguuacac

SEQ ID NO: 1581000 - RNA, 18 nt, Homo sapiens
gaaaaaaacuucauucuc

SEQ ID NO: 1581001 - RNA, 14 nt, Homo sapiens
gaaaaaaagcaaaa

SEQ ID NO: 1581002 - RNA, 16 nt, Homo sapiens
gaaaaacagcauguac

SEQ ID NO: 1581003 - RNA, 16 nt, Homo sapiens
gaaaaacagcucuguu

SEQ ID NO: 1581004 - RNA, 14 nt, Homo sapiens
gaaaaacaucugaa

SEQ ID NO: 1581005 - RNA, 22 nt, Homo sapiens
gaaaaagaagguugagggcaau

SEQ ID NO: 1581006 - RNA, 12 nt, Homo sapiens
gaaaaaucucau

SEQ ID NO: 1581007 - RNA, 20 nt, Homo sapiens
gaaaacaauggggcugguuu

SEQ ID NO: 1581008 - RNA, 10 nt, Homo sapiens
gaaaacagaa

SEQ ID NO: 1581009 - RNA, 11 nt, Homo sapiens
gaaaacagaaa

SEQ ID NO: 1581010 - RNA, 14 nt, Homo sapiens
gaaaacauguacua

SEQ ID NO: 1581011 - RNA, 20 nt, Homo sapiens
gaaaacucccaauacaaaga

SEQ ID NO: 1581012 - RNA, 13 nt, Homo sapiens
gaaaacugugcaa

SEQ ID NO: 1581013 - RNA, 19 nt, Homo sapiens
gaaaacuuaugcugauuua

SEQ ID NO: 1581014 - RNA, 22 nt, Homo sapiens
gaaaagaacuaggacugaacua

SEQ ID NO: 1581015 - RNA, 15 nt, Homo sapiens
gaaaagagucuucca

SEQ ID NO: 1581016 - RNA, 15 nt, Homo sapiens
gaaaagcaacauuca

SEQ ID NO: 1581017 - RNA, 19 nt, Homo sapiens
gaaaagcaguggcuccauu

SEQ ID NO: 1581018 - RNA, 11 nt, Homo sapiens
gaaaagccaaa

SEQ ID NO: 1581019 - RNA, 16 nt, Homo sapiens
gaaaagccaaauaaaa

SEQ ID NO: 1581020 - RNA, 21 nt, Homo sapiens
gaaaagccaaauaaaaaucuu

SEQ ID NO: 1581021 - RNA, 22 nt, Homo sapiens
gaaaagccuccgccugcugugu

SEQ ID NO: 1581022 - RNA, 15 nt, Homo sapiens
gaaaaggccauuaaa

SEQ ID NO: 1581023 - RNA, 13 nt, Homo sapiens
gaaaaggcuuuca

SEQ ID NO: 1581024 - RNA, 21 nt, Homo sapiens
gaaaaggucugaggacugagc

SEQ ID NO: 1581025 - RNA, 16 nt, Homo sapiens
gaaaagguugccugaa

SEQ ID NO: 1581026 - RNA, 22 nt, Homo sapiens
gaaaaguagacaaucauuguuu

SEQ ID NO: 1581027 - RNA, 14 nt, Homo sapiens
gaaaauaagacaau

SEQ ID NO: 1581028 - RNA, 15 nt, Homo sapiens
gaaaauaguguaaga

SEQ ID NO: 1581029 - RNA, 14 nt, Homo sapiens
gaaaauaucuugcu

SEQ ID NO: 1581030 - RNA, 18 nt, Homo sapiens
gaaaauaucuugcuuuca

SEQ ID NO: 1581031 - RNA, 14 nt, Homo sapiens
gaaaaucauuugag

SEQ ID NO: 1581032 - RNA, 19 nt, Homo sapiens
gaaaauccccaacuaugca

SEQ ID NO: 1581033 - RNA, 21 nt, Homo sapiens
gaaaaucuaccaagaacagag

SEQ ID NO: 1581034 - RNA, 23 nt, Homo sapiens
gaaaaucuagaggaaaagaaaga

SEQ ID NO: 1581035 - RNA, 18 nt, Homo sapiens
gaaaaugaaccauucaca

SEQ ID NO: 1581036 - RNA, 23 nt, Homo sapiens
gaaaaugaaccauucacagugca

SEQ ID NO: 1581037 - RNA, 14 nt, Homo sapiens
gaaaaugagaaaau

SEQ ID NO: 1581038 - RNA, 13 nt, Homo sapiens
gaaaaugcaaaag

SEQ ID NO: 1581039 - RNA, 13 nt, Homo sapiens
gaaaaugccauga

SEQ ID NO: 1581040 - RNA, 17 nt, Homo sapiens
gaaaaugccaugaaaau

SEQ ID NO: 1581041 - RNA, 18 nt, Homo sapiens
gaaaauggagccaugaca

SEQ ID NO: 1581042 - RNA, 17 nt, Homo sapiens
gaaaauguauugauuca

SEQ ID NO: 1581043 - RNA, 15 nt, Homo sapiens
gaaaaugucuuucuc

SEQ ID NO: 1581044 - RNA, 19 nt, Homo sapiens
gaaaauuauguuccuagaa

SEQ ID NO: 1581045 - RNA, 13 nt, Homo sapiens
gaaaauugcaaua

SEQ ID NO: 1581046 - RNA, 20 nt, Homo sapiens
gaaaauuuuccacauaggaa

SEQ ID NO: 1581047 - RNA, 22 nt, Homo sapiens
gaaaauuuuuaaauauucacaa

SEQ ID NO: 1581048 - RNA, 16 nt, Homo sapiens
gaaacaaaaucaaaac

SEQ ID NO: 1581049 - RNA, 23 nt, Homo sapiens
gaaacaaauagcuguugacguuu

SEQ ID NO: 1581050 - RNA, 22 nt, Homo sapiens
gaaacaacaauuucuacuuuga

SEQ ID NO: 1581051 - RNA, 23 nt, Homo sapiens
gaaacaacaauuucuacuuugaa

SEQ ID NO: 1581052 - RNA, 15 nt, Homo sapiens
gaaacaagguuuuca

SEQ ID NO: 1581053 - RNA, 18 nt, Homo sapiens
gaaacacagcaacaauga

SEQ ID NO: 1581054 - RNA, 16 nt, Homo sapiens
gaaacagucacuauca

SEQ ID NO: 1581055 - RNA, 20 nt, Homo sapiens
gaaacauuuuuguucuuaug

SEQ ID NO: 1581056 - RNA, 20 nt, Homo sapiens
gaaaccaaggaaagugaaac

SEQ ID NO: 1581057 - RNA, 13 nt, Homo sapiens
gaaacccaaccuu

SEQ ID NO: 1581058 - RNA, 21 nt, Homo sapiens
gaaaccccuucuuuacuuccc

SEQ ID NO: 1581059 - RNA, 15 nt, Homo sapiens
gaaacuaaacucuua

SEQ ID NO: 1581060 - RNA, 22 nt, Homo sapiens
gaaacuaagagacaguucucug

SEQ ID NO: 1581061 - RNA, 14 nt, Homo sapiens
gaaacuaagccagg

SEQ ID NO: 1581062 - RNA, 18 nt, Homo sapiens
gaaacuaagccaggccug

SEQ ID NO: 1581063 - RNA, 20 nt, Homo sapiens
gaaacuaauauuuuauguga

SEQ ID NO: 1581064 - RNA, 22 nt, Homo sapiens
gaaacuacauuucuacuaugau

SEQ ID NO: 1581065 - RNA, 16 nt, Homo sapiens
gaaacuaucucaugcc

SEQ ID NO: 1581066 - RNA, 14 nt, Homo sapiens
gaaacugagucacu

SEQ ID NO: 1581067 - RNA, 18 nt, Homo sapiens
gaaacuugugaaguggaa

SEQ ID NO: 1581068 - RNA, 17 nt, Homo sapiens
guccccaguuugcagaa

SEQ ID NO: 1581069 - RNA, 23 nt, Homo sapiens
gucccccagauuccaacauuucu

SEQ ID NO: 1581070 - RNA, 14 nt, Homo sapiens
gucccccuccucag

SEQ ID NO: 1581071 - RNA, 19 nt, Homo sapiens
gucccggggccagcacuuc

SEQ ID NO: 1581072 - RNA, 15 nt, Homo sapiens
gucccgguaccuucc

SEQ ID NO: 1581073 - RNA, 13 nt, Homo sapiens
gucccuugccucu

SEQ ID NO: 1581074 - RNA, 17 nt, Homo sapiens
gucccuugguccuggaa

SEQ ID NO: 1581075 - RNA, 14 nt, Homo sapiens
guccuaaaagcaaa

SEQ ID NO: 1581076 - RNA, 20 nt, Homo sapiens
guccuaaucauacaccagaa

SEQ ID NO: 1581077 - RNA, 15 nt, Homo sapiens
guccuaggacuuaaa

SEQ ID NO: 1581078 - RNA, 13 nt, Homo sapiens
guccuaugcaaua

SEQ ID NO: 1581079 - RNA, 19 nt, Homo sapiens
guccucaggccugaacuca

SEQ ID NO: 1581080 - RNA, 14 nt, Homo sapiens
guccuccagacaac

SEQ ID NO: 1581081 - RNA, 15 nt, Homo sapiens
guccucuucugggcc

SEQ ID NO: 1581082 - RNA, 16 nt, Homo sapiens
guccugcccuguggaa

SEQ ID NO: 1581083 - RNA, 18 nt, Homo sapiens
guccuggaggcacuggga

SEQ ID NO: 1581084 - RNA, 14 nt, Homo sapiens
guccuggcugugaa

SEQ ID NO: 1581085 - RNA, 14 nt, Homo sapiens
guccuggugcugcc

SEQ ID NO: 1581086 - RNA, 16 nt, Homo sapiens
guccuguuucugucaa

SEQ ID NO: 1581087 - RNA, 23 nt, Homo sapiens
guccuucagugagccccucccca

SEQ ID NO: 1581088 - RNA, 16 nt, Homo sapiens
guccuugaaugccaua

SEQ ID NO: 1581089 - RNA, 21 nt, Homo sapiens
guccuuuugacacugcucuaa

SEQ ID NO: 1581090 - RNA, 13 nt, Homo sapiens
gucgagacuucac

SEQ ID NO: 1581091 - RNA, 20 nt, Homo sapiens
gucggccccaccagugccuc

SEQ ID NO: 1581092 - RNA, 19 nt, Homo sapiens
gucuaauagucuuugccag

SEQ ID NO: 1581093 - RNA, 12 nt, Homo sapiens
gucuacauuucu

SEQ ID NO: 1581094 - RNA, 19 nt, Homo sapiens
gucuacuggacaaucuuau

SEQ ID NO: 1581095 - RNA, 16 nt, Homo sapiens
gucuagagaacacugu

SEQ ID NO: 1581096 - RNA, 19 nt, Homo sapiens
gucuaggucuccucagggu

SEQ ID NO: 1581097 - RNA, 21 nt, Homo sapiens
gucuauuugucucuuacaucu

SEQ ID NO: 1581098 - RNA, 23 nt, Homo sapiens
gucuauuugucucuuacaucucc

SEQ ID NO: 1581099 - RNA, 19 nt, Homo sapiens
gucucaaacucccgaccuc

SEQ ID NO: 1581100 - RNA, 21 nt, Homo sapiens
gucucaaagcauaaaauggaa

SEQ ID NO: 1581101 - RNA, 22 nt, Homo sapiens
gucucaauucaaauccauagau

SEQ ID NO: 1581102 - RNA, 23 nt, Homo sapiens
gucucaccuggacuuaagcaucu

SEQ ID NO: 1581103 - RNA, 18 nt, Homo sapiens
gucucacuuuuauugaua

SEQ ID NO: 1581104 - RNA, 23 nt, Homo sapiens
gucucaggacagaaccacugagu

SEQ ID NO: 1581105 - RNA, 14 nt, Homo sapiens
gucuccaugcucac

SEQ ID NO: 1581106 - RNA, 14 nt, Homo sapiens
gucuccccaaagcu

SEQ ID NO: 1581107 - RNA, 19 nt, Homo sapiens
gucuccucuuuaaaacaaa

SEQ ID NO: 1581108 - RNA, 23 nt, Homo sapiens
gucucgugguaggacuguagaaa

SEQ ID NO: 1581109 - RNA, 22 nt, Homo sapiens
gucucuuguaauccgaaucucu

SEQ ID NO: 1581110 - RNA, 19 nt, Homo sapiens
gucugaacaauauauacuu

SEQ ID NO: 1581111 - RNA, 18 nt, Homo sapiens
gucugaauagaaucugga

SEQ ID NO: 1581112 - RNA, 21 nt, Homo sapiens
gucugaguaagcccucaggag

SEQ ID NO: 1581113 - RNA, 18 nt, Homo sapiens
gucugauuguagcuauga

SEQ ID NO: 1581114 - RNA, 14 nt, Homo sapiens
gucugcacagauuc

SEQ ID NO: 1581115 - RNA, 14 nt, Homo sapiens
gucugcagaccauc

SEQ ID NO: 1581116 - RNA, 10 nt, Homo sapiens
gucugccaag

SEQ ID NO: 1581117 - RNA, 16 nt, Homo sapiens
gucugccaagugggaa

SEQ ID NO: 1581118 - RNA, 22 nt, Homo sapiens
gucuggagaagguauuagcaaa

SEQ ID NO: 1581119 - RNA, 15 nt, Homo sapiens
gucuggcccaccagg

SEQ ID NO: 1581120 - RNA, 16 nt, Homo sapiens
gucugggauauggcug

SEQ ID NO: 1581121 - RNA, 17 nt, Homo sapiens
gucugggccacucaggg

SEQ ID NO: 1581122 - RNA, 19 nt, Homo sapiens
gucugguugggcagccaga

SEQ ID NO: 1581123 - RNA, 20 nt, Homo sapiens
gucugucaauguccuacuga

SEQ ID NO: 1581124 - RNA, 16 nt, Homo sapiens
gucugugcacaugccu

SEQ ID NO: 1581125 - RNA, 14 nt, Homo sapiens
gucuuaaagcauuu

SEQ ID NO: 1581126 - RNA, 15 nt, Homo sapiens
gucuuacuguugcau

SEQ ID NO: 1581127 - RNA, 21 nt, Homo sapiens
gucuucaccaagugaucaaaa

SEQ ID NO: 1581128 - RNA, 18 nt, Homo sapiens
gucuuccaauuaaugcuu

SEQ ID NO: 1581129 - RNA, 18 nt, Homo sapiens
gucuuccugacacuuuaa

SEQ ID NO: 1581130 - RNA, 17 nt, Homo sapiens
gucuucugccuguuaua

SEQ ID NO: 1581131 - RNA, 15 nt, Homo sapiens
gucuugcucugucac

SEQ ID NO: 1581132 - RNA, 17 nt, Homo sapiens
gucuugggggucagggg

SEQ ID NO: 1581133 - RNA, 17 nt, Homo sapiens
gucuuguugauuuccuc

SEQ ID NO: 1581134 - RNA, 14 nt, Homo sapiens
gucuuuaaccacuu

SEQ ID NO: 1581135 - RNA, 23 nt, Homo sapiens
gucuuugaacugcagcaaucaca

SEQ ID NO: 1581136 - RNA, 19 nt, Homo sapiens
gucuuugccagucauucag

SEQ ID NO: 1581137 - RNA, 17 nt, Homo sapiens
gucuuuuuucucucuua

SEQ ID NO: 1581138 - RNA, 22 nt, Homo sapiens
gugaaacccccaucucuacuaa

SEQ ID NO: 1581139 - RNA, 19 nt, Homo sapiens
gugaaaccucccauuggcc

SEQ ID NO: 1581140 - RNA, 15 nt, Homo sapiens
gugaaagaggcagcu

SEQ ID NO: 1581141 - RNA, 19 nt, Homo sapiens
gugaaagcacggacucuua

SEQ ID NO: 1581142 - RNA, 17 nt, Homo sapiens
gugaaaguuaauccacu

SEQ ID NO: 1581143 - RNA, 14 nt, Homo sapiens
gugaaauaagccag

SEQ ID NO: 1581144 - RNA, 11 nt, Homo sapiens
gugaagccaug

SEQ ID NO: 1581145 - RNA, 12 nt, Homo sapiens
gugaaguguuac

SEQ ID NO: 1581146 - RNA, 23 nt, Homo sapiens
gugaauaaaccaucaucuugcca

SEQ ID NO: 1581147 - RNA, 20 nt, Homo sapiens
gugaauaggcugaugggcaa

SEQ ID NO: 1581148 - RNA, 17 nt, Homo sapiens
gugaauguuuaccauga

SEQ ID NO: 1581149 - RNA, 14 nt, Homo sapiens
gugaauuaggcugu

SEQ ID NO: 1581150 - RNA, 16 nt, Homo sapiens
gugaauuaggcuguaa

SEQ ID NO: 1581151 - RNA, 18 nt, Homo sapiens
gugaauugaauggugcau

SEQ ID NO: 1581152 - RNA, 16 nt, Homo sapiens
gugacacucuauaaga

SEQ ID NO: 1581153 - RNA, 16 nt, Homo sapiens
gugacagcugagcacc

SEQ ID NO: 1581154 - RNA, 18 nt, Homo sapiens
gugacagcuuuccucaaa

SEQ ID NO: 1581155 - RNA, 15 nt, Homo sapiens
gugacauuccuucuc

SEQ ID NO: 1581156 - RNA, 16 nt, Homo sapiens
gugaccacugaagcac

SEQ ID NO: 1581157 - RNA, 22 nt, Homo sapiens
gugaccagaaagcuucauccac

SEQ ID NO: 1581158 - RNA, 23 nt, Homo sapiens
gugaccccggguacgagcuggcc

SEQ ID NO: 1581159 - RNA, 19 nt, Homo sapiens
gugacccugagaaggcaaa

SEQ ID NO: 1581160 - RNA, 13 nt, Homo sapiens
gugaccucuugcc

SEQ ID NO: 1581161 - RNA, 19 nt, Homo sapiens
gugacuccugaaaccucuu

SEQ ID NO: 1581162 - RNA, 14 nt, Homo sapiens
gugacucuuuccaa

SEQ ID NO: 1581163 - RNA, 15 nt, Homo sapiens
gugacuucacuguau

SEQ ID NO: 1581164 - RNA, 20 nt, Homo sapiens
gugagacccugucucaaaaa

SEQ ID NO: 1581165 - RNA, 17 nt, Homo sapiens
gugaggggcucucucau

SEQ ID NO: 1581166 - RNA, 12 nt, Homo sapiens
gugagggguccc

SEQ ID NO: 1581167 - RNA, 15 nt, Homo sapiens
gugagucaccacuuc

SEQ ID NO: 1581168 - RNA, 22 nt, Homo sapiens
gugagugccuccuguggucuca

SEQ ID NO: 1581169 - RNA, 16 nt, Homo sapiens
gugauacaaauugaua

SEQ ID NO: 1581170 - RNA, 18 nt, Homo sapiens
gugauccgccuaccucag

SEQ ID NO: 1581171 - RNA, 16 nt, Homo sapiens
gugaugauagcacugg

SEQ ID NO: 1581172 - RNA, 16 nt, Homo sapiens
gugauuacucuuugcu

SEQ ID NO: 1581173 - RNA, 23 nt, Homo sapiens
gugauuuuucugcacuaauauaa

SEQ ID NO: 1581174 - RNA, 16 nt, Homo sapiens
gugcaaaaacuguaaa

SEQ ID NO: 1581175 - RNA, 14 nt, Homo sapiens
gugcaaaaucuguu

SEQ ID NO: 1581176 - RNA, 12 nt, Homo sapiens
gugcaaagggaa

SEQ ID NO: 1581177 - RNA, 16 nt, Homo sapiens
gugcaauagcagggau

SEQ ID NO: 1581178 - RNA, 20 nt, Homo sapiens
gugcacccaugggcucugac

SEQ ID NO: 1581179 - RNA, 19 nt, Homo sapiens
gugcacuccccguguucau

SEQ ID NO: 1581180 - RNA, 22 nt, Homo sapiens
gugcacuuuaagaggugggagc

SEQ ID NO: 1581181 - RNA, 17 nt, Homo sapiens
gugcagaagaauccgag

SEQ ID NO: 1581182 - RNA, 13 nt, Homo sapiens
gugcagauaucac

SEQ ID NO: 1581183 - RNA, 22 nt, Homo sapiens
gugcaguacuuugugcauucug

SEQ ID NO: 1581184 - RNA, 19 nt, Homo sapiens
gugcaguggugccaucacc

SEQ ID NO: 1581185 - RNA, 21 nt, Homo sapiens
gugcaguugcuguuuacuuga

SEQ ID NO: 1581186 - RNA, 17 nt, Homo sapiens
uaaacaagucaaagacu

SEQ ID NO: 1581187 - RNA, 23 nt, Homo sapiens
uaaacaaugaugcccugcuccag

SEQ ID NO: 1581188 - RNA, 21 nt, Homo sapiens
uaaacaccauagggacccauu

SEQ ID NO: 1581189 - RNA, 14 nt, Homo sapiens
uaaacagaugaaua

SEQ ID NO: 1581190 - RNA, 18 nt, Homo sapiens
uaaacaggagacagguca

SEQ ID NO: 1581191 - RNA, 17 nt, Homo sapiens
uaaacaguggaauauaa

SEQ ID NO: 1581192 - RNA, 23 nt, Homo sapiens
uaaacauauuuuuauacuuuauu

SEQ ID NO: 1581193 - RNA, 22 nt, Homo sapiens
uaaacauugaagacccugucuc

SEQ ID NO: 1581194 - RNA, 21 nt, Homo sapiens
uaaaccaacucuaauauugcu

SEQ ID NO: 1581195 - RNA, 14 nt, Homo sapiens
uaaacccaagugcu

SEQ ID NO: 1581196 - RNA, 15 nt, Homo sapiens
uaaaccgaaaguguu

SEQ ID NO: 1581197 - RNA, 22 nt, Homo sapiens
uaaaccucaguuauuacaugua

SEQ ID NO: 1581198 - RNA, 17 nt, Homo sapiens
uaaaccuggaacaucuc

SEQ ID NO: 1581199 - RNA, 15 nt, Homo sapiens
uaaacuacagaauau

SEQ ID NO: 1581200 - RNA, 14 nt, Homo sapiens
uaaacuaguacuau

SEQ ID NO: 1581201 - RNA, 16 nt, Homo sapiens
uaaacuauaaccucuc

SEQ ID NO: 1581202 - RNA, 21 nt, Homo sapiens
uaaacuauaauuuauugucua

SEQ ID NO: 1581203 - RNA, 16 nt, Homo sapiens
uaaacuauuuauauca

SEQ ID NO: 1581204 - RNA, 18 nt, Homo sapiens
uaaacuauuuauaucaca

SEQ ID NO: 1581205 - RNA, 17 nt, Homo sapiens
uaaacuauuuguggcaa

SEQ ID NO: 1581206 - RNA, 16 nt, Homo sapiens
uaaacucucuagcuua

SEQ ID NO: 1581207 - RNA, 13 nt, Homo sapiens
uaaacucugcuca

SEQ ID NO: 1581208 - RNA, 23 nt, Homo sapiens
uaaacucuguccacgauucacuc

SEQ ID NO: 1581209 - RNA, 21 nt, Homo sapiens
uaaacugaaucuauggcuuua

SEQ ID NO: 1581210 - RNA, 20 nt, Homo sapiens
uaaacuguaaaguucaauug

SEQ ID NO: 1581211 - RNA, 12 nt, Homo sapiens
uaaacuguguau

SEQ ID NO: 1581212 - RNA, 15 nt, Homo sapiens
uaaacuuaaguccag

SEQ ID NO: 1581213 - RNA, 20 nt, Homo sapiens
uaaacuuggaaucaagguaa

SEQ ID NO: 1581214 - RNA, 16 nt, Homo sapiens
uaaacuuguaaagaca

SEQ ID NO: 1581215 - RNA, 14 nt, Homo sapiens
uaaacuuguuugcu

SEQ ID NO: 1581216 - RNA, 19 nt, Homo sapiens
uaaacuuuccaaaaccuuc

SEQ ID NO: 1581217 - RNA, 23 nt, Homo sapiens
uaaacuuuuuuucuguaccaguu

SEQ ID NO: 1581218 - RNA, 20 nt, Homo sapiens
uaaagaaagaaugcauucca

SEQ ID NO: 1581219 - RNA, 22 nt, Homo sapiens
uaaagaaccaucagcaucaccc

SEQ ID NO: 1581220 - RNA, 18 nt, Homo sapiens
uaaagaacgcgacuucca

SEQ ID NO: 1581221 - RNA, 21 nt, Homo sapiens
uaaagaagauaaacacaaaau

SEQ ID NO: 1581222 - RNA, 15 nt, Homo sapiens
uaaagaauacuugaa

SEQ ID NO: 1581223 - RNA, 18 nt, Homo sapiens
uaaagaauacuugaacuu

SEQ ID NO: 1581224 - RNA, 14 nt, Homo sapiens
uaaagaccacuuua

SEQ ID NO: 1581225 - RNA, 16 nt, Homo sapiens
uaaagacuacaauaaa

SEQ ID NO: 1581226 - RNA, 23 nt, Homo sapiens
uaaagagagagagagagaauucc

SEQ ID NO: 1581227 - RNA, 16 nt, Homo sapiens
uaaagagccaguuuau

SEQ ID NO: 1581228 - RNA, 21 nt, Homo sapiens
uaaagaguacacucagccacu

SEQ ID NO: 1581229 - RNA, 14 nt, Homo sapiens
uaaagauacaugau

SEQ ID NO: 1581230 - RNA, 21 nt, Homo sapiens
uaaagauauggagaauugcug

SEQ ID NO: 1581231 - RNA, 13 nt, Homo sapiens
uaaagauucucac

SEQ ID NO: 1581232 - RNA, 16 nt, Homo sapiens
uaaagauuucuaguag

SEQ ID NO: 1581233 - RNA, 19 nt, Homo sapiens
uaaagauuucuaguaggca

SEQ ID NO: 1581234 - RNA, 18 nt, Homo sapiens
uaaagcaaagugagucau

SEQ ID NO: 1581235 - RNA, 18 nt, Homo sapiens
uaaagcaauaugcauuua

SEQ ID NO: 1581236 - RNA, 13 nt, Homo sapiens
uaaagcagucaug

SEQ ID NO: 1581237 - RNA, 19 nt, Homo sapiens
uaaagcaguguuugcucca

SEQ ID NO: 1581238 - RNA, 19 nt, Homo sapiens
uaaagcauauuggugcuag

SEQ ID NO: 1581239 - RNA, 23 nt, Homo sapiens
uaaagcuacaauauucucucuua

SEQ ID NO: 1581240 - RNA, 13 nt, Homo sapiens
uaaagcucaaggu

SEQ ID NO: 1581241 - RNA, 18 nt, Homo sapiens
uaaaggagcaucuaucag

SEQ ID NO: 1581242 - RNA, 14 nt, Homo sapiens
uaaaggcagcugcc

SEQ ID NO: 1581243 - RNA, 16 nt, Homo sapiens
uaaaggcauuucaaag

SEQ ID NO: 1581244 - RNA, 16 nt, Homo sapiens
uaaagggacacuuuua

SEQ ID NO: 1581245 - RNA, 17 nt, Homo sapiens
uaaagggagaaaugcca

SEQ ID NO: 1581246 - RNA, 18 nt, Homo sapiens
uaaagggagaaaugccag

SEQ ID NO: 1581247 - RNA, 18 nt, Homo sapiens
uaaagggcauuuuacuaa

SEQ ID NO: 1581248 - RNA, 16 nt, Homo sapiens
uaaagggucuuaugaa

SEQ ID NO: 1581249 - RNA, 11 nt, Homo sapiens
uaaagguuuau

SEQ ID NO: 1581250 - RNA, 18 nt, Homo sapiens
uaaagugcugcacucaaa

SEQ ID NO: 1581251 - RNA, 18 nt, Homo sapiens
uaaaguucagauguuuca

SEQ ID NO: 1581252 - RNA, 22 nt, Homo sapiens
uaaauaaaacagcagcagcaaa

SEQ ID NO: 1581253 - RNA, 16 nt, Homo sapiens
uaaauaaaccacugug

SEQ ID NO: 1581254 - RNA, 19 nt, Homo sapiens
uaaauaagcaaaaugccaa

SEQ ID NO: 1581255 - RNA, 16 nt, Homo sapiens
uaaauagggaauauga

SEQ ID NO: 1581256 - RNA, 15 nt, Homo sapiens
uaaauauauauucua

SEQ ID NO: 1581257 - RNA, 20 nt, Homo sapiens
uaaauauauauuucuaauau

SEQ ID NO: 1581258 - RNA, 18 nt, Homo sapiens
uaaauauaucuaccccag

SEQ ID NO: 1581259 - RNA, 20 nt, Homo sapiens
uaaauauuguguugugcagc

SEQ ID NO: 1581260 - RNA, 17 nt, Homo sapiens
uaaauauuuuucaucaa

SEQ ID NO: 1581261 - RNA, 22 nt, Homo sapiens
uaaaucaaugguucaagucuuc

SEQ ID NO: 1581262 - RNA, 20 nt, Homo sapiens
uaaaucaggacagguggugc

SEQ ID NO: 1581263 - RNA, 21 nt, Homo sapiens
uaaauccauccauccaaaggc

SEQ ID NO: 1581264 - RNA, 17 nt, Homo sapiens
uaaaucccacaucccag

SEQ ID NO: 1581265 - RNA, 13 nt, Homo sapiens
uaaaucugugaug

SEQ ID NO: 1581266 - RNA, 15 nt, Homo sapiens
uaaaucuuucucuca

SEQ ID NO: 1581267 - RNA, 11 nt, Homo sapiens
uaaaugaacuu

SEQ ID NO: 1581268 - RNA, 20 nt, Homo sapiens
uaaaugagaaaggauuuccu

SEQ ID NO: 1581269 - RNA, 22 nt, Homo sapiens
uaaaugagagggaaucgacugu

SEQ ID NO: 1581270 - RNA, 12 nt, Homo sapiens
uaaaugaucucu

SEQ ID NO: 1581271 - RNA, 12 nt, Homo sapiens
uaaaugcucaua

SEQ ID NO: 1581272 - RNA, 22 nt, Homo sapiens
uaaaugcuucauuuguauguca

SEQ ID NO: 1581273 - RNA, 15 nt, Homo sapiens
uaaauguauguauuu

SEQ ID NO: 1581274 - RNA, 20 nt, Homo sapiens
uaaaugugacauugauuugc

SEQ ID NO: 1581275 - RNA, 19 nt, Homo sapiens
uaaaugugacucagcauca

SEQ ID NO: 1581276 - RNA, 20 nt, Homo sapiens
uaaauuacagcuuuuaugga

SEQ ID NO: 1581277 - RNA, 23 nt, Homo sapiens
uaaauuaggcauaucucugccau

SEQ ID NO: 1581278 - RNA, 15 nt, Homo sapiens
uaaauuaugcaauuu

SEQ ID NO: 1581279 - RNA, 14 nt, Homo sapiens
uaaauuauugcugu

SEQ ID NO: 1581280 - RNA, 17 nt, Homo sapiens
uaaauucagaacaagca

SEQ ID NO: 1581281 - RNA, 16 nt, Homo sapiens
uaaauuccacagauua

SEQ ID NO: 1581282 - RNA, 20 nt, Homo sapiens
uaaauuccacagauuaucaa

SEQ ID NO: 1581283 - RNA, 20 nt, Homo sapiens
uaaauugauagcagauauca

SEQ ID NO: 1581284 - RNA, 20 nt, Homo sapiens
uaaauugucugccauuacac

SEQ ID NO: 1581285 - RNA, 20 nt, Homo sapiens
uaaauuuaucaguaccuaag

SEQ ID NO: 1581286 - RNA, 15 nt, Homo sapiens
uaaauuucccaguua

SEQ ID NO: 1581287 - RNA, 23 nt, Homo sapiens
uaaauuuguuauuguguauuaug

SEQ ID NO: 1581288 - RNA, 21 nt, Homo sapiens
uaaauuuuagaauauuuucua

SEQ ID NO: 1581289 - RNA, 15 nt, Homo sapiens
uaaauuuuaugucau

SEQ ID NO: 1581290 - RNA, 18 nt, Homo sapiens
uaaauuuuguaugccaau

SEQ ID NO: 1581291 - RNA, 23 nt, Homo sapiens
uaaauuuuuuugcaauccuuucc

SEQ ID NO: 1581292 - RNA, 16 nt, Homo sapiens
uaacaaaagcaauugu

SEQ ID NO: 1581293 - RNA, 18 nt, Homo sapiens
uaacaaaauguaugucug

SEQ ID NO: 1581294 - RNA, 15 nt, Homo sapiens
uaacaaaugcuuuau

SEQ ID NO: 1581295 - RNA, 12 nt, Homo sapiens
uaacaaccugga

SEQ ID NO: 1581296 - RNA, 17 nt, Homo sapiens
uaacaagaccucagugc

SEQ ID NO: 1581297 - RNA, 22 nt, Homo sapiens
uaacaauuucccccuguucuua

SEQ ID NO: 1581298 - RNA, 19 nt, Homo sapiens
uaacacacccugcuucauu

SEQ ID NO: 1581299 - RNA, 19 nt, Homo sapiens
uaacagcuaauaagagaua

SEQ ID NO: 1581300 - RNA, 17 nt, Homo sapiens
uaacagucuagugcaaa

SEQ ID NO: 1581301 - RNA, 15 nt, Homo sapiens
uaacauaugauacug

SEQ ID NO: 1581302 - RNA, 14 nt, Homo sapiens
uaacaucaaagacu

SEQ ID NO: 1581303 - RNA, 11 nt, Homo sapiens
uaacaucucac

SEQ ID NO: 1581304 - RNA, 14 nt, Homo sapiens
cuguggaacauaaa

SEQ ID NO: 1581305 - RNA, 16 nt, Homo sapiens
cuguggaacauaaaaa

SEQ ID NO: 1581306 - RNA, 18 nt, Homo sapiens
cuguggaacauaaaaagg

SEQ ID NO: 1581307 - RNA, 12 nt, Homo sapiens
cuguggaugcuu

SEQ ID NO: 1581308 - RNA, 15 nt, Homo sapiens
cuguggcacuggcca

SEQ ID NO: 1581309 - RNA, 15 nt, Homo sapiens
cuguggcagaguuac

SEQ ID NO: 1581310 - RNA, 15 nt, Homo sapiens
cuguggccaaguucu

SEQ ID NO: 1581311 - RNA, 19 nt, Homo sapiens
cuguggcuuuuuguucaga

SEQ ID NO: 1581312 - RNA, 16 nt, Homo sapiens
cugugggcaagccuaa

SEQ ID NO: 1581313 - RNA, 21 nt, Homo sapiens
cugugggucugggagucacac

SEQ ID NO: 1581314 - RNA, 16 nt, Homo sapiens
cugugguucugagaag

SEQ ID NO: 1581315 - RNA, 23 nt, Homo sapiens
cuguguaacuguaaaacauugaa

SEQ ID NO: 1581316 - RNA, 15 nt, Homo sapiens
cuguguaacuuucuc

SEQ ID NO: 1581317 - RNA, 17 nt, Homo sapiens
cuguguaauauaaaaga

SEQ ID NO: 1581318 - RNA, 18 nt, Homo sapiens
cuguguaucucagcauuu

SEQ ID NO: 1581319 - RNA, 15 nt, Homo sapiens
cuguguauucuaguu

SEQ ID NO: 1581320 - RNA, 15 nt, Homo sapiens
cccagugaucaccug

SEQ ID NO: 1581321 - RNA, 18 nt, Homo sapiens
cccaguggacucuuccac

SEQ ID NO: 1581322 - RNA, 21 nt, Homo sapiens
cccaguggccggucagccaca

SEQ ID NO: 1581323 - RNA, 21 nt, Homo sapiens
cccaguucaucaccauuuccu

SEQ ID NO: 1581324 - RNA, 21 nt, Homo sapiens
cccaguuccucccccaguucc

SEQ ID NO: 1581325 - RNA, 22 nt, Homo sapiens
cccauacaauguauguacaaua

SEQ ID NO: 1581326 - RNA, 18 nt, Homo sapiens
cccaucagcacucuguaa

SEQ ID NO: 1581327 - RNA, 23 nt, Homo sapiens
cccaugaacuauaugacuggcca

SEQ ID NO: 1581328 - RNA, 19 nt, Homo sapiens
cccaugaccccaaagccaa

SEQ ID NO: 1581329 - RNA, 22 nt, Homo sapiens
cccauggcccccaauaaaggca

SEQ ID NO: 1581330 - RNA, 15 nt, Homo sapiens
cccauucuacacaga

SEQ ID NO: 1581331 - RNA, 17 nt, Homo sapiens
cccauucucugccugua

SEQ ID NO: 1581332 - RNA, 15 nt, Homo sapiens
cccauuucaaugugu

SEQ ID NO: 1581333 - RNA, 20 nt, Homo sapiens
cccauuuuugcuuagcucaa

SEQ ID NO: 1581334 - RNA, 10 nt, Homo sapiens
ccccaaagcu

SEQ ID NO: 1581335 - RNA, 16 nt, Homo sapiens
ccccaacaugcacuga

SEQ ID NO: 1581336 - RNA, 17 nt, Homo sapiens
ccccaaguuaguucaau

SEQ ID NO: 1581337 - RNA, 19 nt, Homo sapiens
ccccaauaaaccaguguga

SEQ ID NO: 1581338 - RNA, 13 nt, Homo sapiens
ccccacacucacu

SEQ ID NO: 1581339 - RNA, 14 nt, Homo sapiens
ccccacaugcaugu

SEQ ID NO: 1581340 - RNA, 12 nt, Homo sapiens
ccccacucugua

SEQ ID NO: 1581341 - RNA, 14 nt, Homo sapiens
ccccagagcuguuu

SEQ ID NO: 1581342 - RNA, 11 nt, Homo sapiens
ccccagcacuu

SEQ ID NO: 1581343 - RNA, 12 nt, Homo sapiens
ccccagcacuug

SEQ ID NO: 1581344 - RNA, 14 nt, Homo sapiens
ccccagcauuccag

SEQ ID NO: 1581345 - RNA, 15 nt, Homo sapiens
ccccaggcauugcca

SEQ ID NO: 1581346 - RNA, 18 nt, Homo sapiens
ccccagguuccauaccau

SEQ ID NO: 1581347 - RNA, 19 nt, Homo sapiens
ccccagucggcugaacucu

SEQ ID NO: 1581348 - RNA, 18 nt, Homo sapiens
ccccaguucuacugaccu

SEQ ID NO: 1581349 - RNA, 15 nt, Homo sapiens
ccccauccagccaga

SEQ ID NO: 1581350 - RNA, 13 nt, Homo sapiens
ccccaucugucca

SEQ ID NO: 1581351 - RNA, 15 nt, Homo sapiens
ccccaucuuuacaaa

SEQ ID NO: 1581352 - RNA, 15 nt, Homo sapiens
ccccaugccugucca

SEQ ID NO: 1581353 - RNA, 18 nt, Homo sapiens
ccccaugccuguccagcc

SEQ ID NO: 1581354 - RNA, 16 nt, Homo sapiens
cccccaaauuaguaca

SEQ ID NO: 1581355 - RNA, 17 nt, Homo sapiens
cccccaauaaaccagug

SEQ ID NO: 1581356 - RNA, 12 nt, Homo sapiens
cccccacagugc

SEQ ID NO: 1581357 - RNA, 14 nt, Homo sapiens
cccccagagcucuu

SEQ ID NO: 1581358 - RNA, 22 nt, Homo sapiens
cccccaguccuguccuaucacu

SEQ ID NO: 1581359 - RNA, 19 nt, Homo sapiens
cccccaugggcuguguccu

SEQ ID NO: 1581360 - RNA, 18 nt, Homo sapiens
cccccauucacuuuguca

SEQ ID NO: 1581361 - RNA, 15 nt, Homo sapiens
cccccgagcugcucc

SEQ ID NO: 1581362 - RNA, 20 nt, Homo sapiens
cccccguggugccugcacac

SEQ ID NO: 1581363 - RNA, 22 nt, Homo sapiens
cccccuggaagcugauucacua

SEQ ID NO: 1581364 - RNA, 12 nt, Homo sapiens
ccccgcucugca

SEQ ID NO: 1581365 - RNA, 23 nt, Homo sapiens
ccccguaccaccaugcacuguaa

SEQ ID NO: 1581366 - RNA, 15 nt, Homo sapiens
ccccuaccucuagua

SEQ ID NO: 1581367 - RNA, 18 nt, Homo sapiens
ccccuaccucuaguaaau

SEQ ID NO: 1581368 - RNA, 14 nt, Homo sapiens
ccccugcacaguug

SEQ ID NO: 1581369 - RNA, 17 nt, Homo sapiens
ccccugcgggcgcgggc

SEQ ID NO: 1581370 - RNA, 21 nt, Homo sapiens
ccccugcucaguaaagcacuu

SEQ ID NO: 1581371 - RNA, 22 nt, Homo sapiens
ccccugcuggcucuucugccca

SEQ ID NO: 1581372 - RNA, 18 nt, Homo sapiens
ccccuggaucuaccagca

SEQ ID NO: 1581373 - RNA, 16 nt, Homo sapiens
ccccuggcacuggcaa

SEQ ID NO: 1581374 - RNA, 23 nt, Homo sapiens
ccccuggcuccagagauggucac

SEQ ID NO: 1581375 - RNA, 16 nt, Homo sapiens
ccccugguguguagcu

SEQ ID NO: 1581376 - RNA, 20 nt, Homo sapiens
ccccuugguacugaaaauga

SEQ ID NO: 1581377 - RNA, 16 nt, Homo sapiens
ccccuuucacacugga

SEQ ID NO: 1581378 - RNA, 22 nt, Homo sapiens
cccgccuccacucuaguucuag

SEQ ID NO: 1581379 - RNA, 21 nt, Homo sapiens
cccgggagacucaaagggaga

SEQ ID NO: 1581380 - RNA, 17 nt, Homo sapiens
cccggggccagcacuuc

SEQ ID NO: 1581381 - RNA, 16 nt, Homo sapiens
cccgggggugaagggg

SEQ ID NO: 1581382 - RNA, 12 nt, Homo sapiens
cccuaaccaagu

SEQ ID NO: 1581383 - RNA, 10 nt, Homo sapiens
cccuaaggga

SEQ ID NO: 1581384 - RNA, 13 nt, Homo sapiens
cccuaaugcugca

SEQ ID NO: 1581385 - RNA, 17 nt, Homo sapiens
cccuaggauacccagau

SEQ ID NO: 1581386 - RNA, 15 nt, Homo sapiens
cccuaucccagagac

SEQ ID NO: 1581387 - RNA, 12 nt, Homo sapiens
cccucacccauc

SEQ ID NO: 1581388 - RNA, 16 nt, Homo sapiens
cccucagacccaggag

SEQ ID NO: 1581389 - RNA, 13 nt, Homo sapiens
cccucagagccuc

SEQ ID NO: 1581390 - RNA, 22 nt, Homo sapiens
cccucagccuaagaaacacuca

SEQ ID NO: 1581391 - RNA, 11 nt, Homo sapiens
cccuccaaaga

SEQ ID NO: 1581392 - RNA, 20 nt, Homo sapiens
cccuccagagauuugcucaa

SEQ ID NO: 1581393 - RNA, 21 nt, Homo sapiens
cccucccuguauaagacacuu

SEQ ID NO: 1581394 - RNA, 14 nt, Homo sapiens
cccuccgaccacuu

SEQ ID NO: 1581395 - RNA, 14 nt, Homo sapiens
cccuccucuuggaa

SEQ ID NO: 1581396 - RNA, 20 nt, Homo sapiens
cccucuaagcacauuccaaa

SEQ ID NO: 1581397 - RNA, 12 nt, Homo sapiens
cccucucacuuu

SEQ ID NO: 1581398 - RNA, 14 nt, Homo sapiens
cccucucucugggc

SEQ ID NO: 1581399 - RNA, 18 nt, Homo sapiens
cccucugcuuuuaacucu

SEQ ID NO: 1581400 - RNA, 21 nt, Homo sapiens
cccucugcuuuuaacucuaga

SEQ ID NO: 1581401 - RNA, 21 nt, Homo sapiens
cccucuguugggaugccaguu

SEQ ID NO: 1581402 - RNA, 17 nt, Homo sapiens
cccucuuucacuucaua

SEQ ID NO: 1581403 - RNA, 13 nt, Homo sapiens
cccugagagccug

SEQ ID NO: 1581404 - RNA, 11 nt, Homo sapiens
cccugcaaaac

SEQ ID NO: 1581405 - RNA, 17 nt, Homo sapiens
cccugcacacacaugca

SEQ ID NO: 1581406 - RNA, 20 nt, Homo sapiens
cccugcacacacaugcauac

SEQ ID NO: 1581407 - RNA, 16 nt, Homo sapiens
cccugcacaccagaga

SEQ ID NO: 1581408 - RNA, 17 nt, Homo sapiens
cccugcacaggcacaca

SEQ ID NO: 1581409 - RNA, 20 nt, Homo sapiens
cccugcagccggagaucuga

SEQ ID NO: 1581410 - RNA, 23 nt, Homo sapiens
cccugcagcuggaaugugccaca

SEQ ID NO: 1581411 - RNA, 15 nt, Homo sapiens
cccugcccaaugaga

SEQ ID NO: 1581412 - RNA, 15 nt, Homo sapiens
cccugcccuggucca

SEQ ID NO: 1581413 - RNA, 15 nt, Homo sapiens
cccugcucagugcuu

SEQ ID NO: 1581414 - RNA, 16 nt, Homo sapiens
cccugcucccauuccu

SEQ ID NO: 1581415 - RNA, 17 nt, Homo sapiens
cccugcugugugacuuu

SEQ ID NO: 1581416 - RNA, 13 nt, Homo sapiens
cccugcuuucuac

SEQ ID NO: 1581417 - RNA, 18 nt, Homo sapiens
cccuggagagugcacaug

SEQ ID NO: 1581418 - RNA, 16 nt, Homo sapiens
cccuggaugguggcca

SEQ ID NO: 1581419 - RNA, 14 nt, Homo sapiens
cccuggcacuggca

SEQ ID NO: 1581420 - RNA, 17 nt, Homo sapiens
cccuggcccccaucagc

SEQ ID NO: 1581421 - RNA, 15 nt, Homo sapiens
cccuggcuccaguga

SEQ ID NO: 1581422 - RNA, 17 nt, Homo sapiens
cccuggggcgugcagca

SEQ ID NO: 1581423 - RNA, 16 nt, Homo sapiens
cccuggggcugagucu

SEQ ID NO: 1581424 - RNA, 20 nt, Homo sapiens
cccugggguggccaccagua

SEQ ID NO: 1581425 - RNA, 19 nt, Homo sapiens
cccugggguuugaagcuga

SEQ ID NO: 1581426 - RNA, 15 nt, Homo sapiens
cccuggugccucuca

SEQ ID NO: 1581427 - RNA, 17 nt, Homo sapiens
cccuguaccugugcacg

SEQ ID NO: 1581428 - RNA, 20 nt, Homo sapiens
cccuguguauucaccaccaa

SEQ ID NO: 1581429 - RNA, 13 nt, Homo sapiens
cccuguuuaacau

SEQ ID NO: 1581430 - RNA, 16 nt, Homo sapiens
cccuuaaauaucuuuc

SEQ ID NO: 1581431 - RNA, 12 nt, Homo sapiens
ccucagugcauu

SEQ ID NO: 1581432 - RNA, 21 nt, Homo sapiens
ccucaguucucugccacccau

SEQ ID NO: 1581433 - RNA, 15 nt, Homo sapiens
ccucaguuuccucau

SEQ ID NO: 1581434 - RNA, 18 nt, Homo sapiens
ccucaucccgagcaccuc

SEQ ID NO: 1581435 - RNA, 16 nt, Homo sapiens
ccucaucuaugguucu

SEQ ID NO: 1581436 - RNA, 15 nt, Homo sapiens
ccucaucugcaaaau

SEQ ID NO: 1581437 - RNA, 14 nt, Homo sapiens
ccucaugucaucaa

SEQ ID NO: 1581438 - RNA, 22 nt, Homo sapiens
ccuccaaggaggggcuguaaaa

SEQ ID NO: 1581439 - RNA, 18 nt, Homo sapiens
ccuccaccagauguccac

SEQ ID NO: 1581440 - RNA, 12 nt, Homo sapiens
ccuccacucugc

SEQ ID NO: 1581441 - RNA, 12 nt, Homo sapiens
ccuccacuggaa

SEQ ID NO: 1581442 - RNA, 21 nt, Homo sapiens
ccuccagggcuggacugaggc

SEQ ID NO: 1581443 - RNA, 19 nt, Homo sapiens
ccuccauuuccacuuggug

SEQ ID NO: 1581444 - RNA, 20 nt, Homo sapiens
ccucccaaaguguugggauu

SEQ ID NO: 1581445 - RNA, 12 nt, Homo sapiens
ccucccaggaag

SEQ ID NO: 1581446 - RNA, 17 nt, Homo sapiens
ccuccccagacucucag

SEQ ID NO: 1581447 - RNA, 15 nt, Homo sapiens
ccucccccaugggcu

SEQ ID NO: 1581448 - RNA, 13 nt, Homo sapiens
ccucccgaaaaau

SEQ ID NO: 1581449 - RNA, 21 nt, Homo sapiens
ccucccgaguagcuggcacua

SEQ ID NO: 1581450 - RNA, 16 nt, Homo sapiens
ccuccgccuccaggaa

SEQ ID NO: 1581451 - RNA, 13 nt, Homo sapiens
ccuccguccagcc

SEQ ID NO: 1581452 - RNA, 11 nt, Homo sapiens
ccuccuacccu

SEQ ID NO: 1581453 - RNA, 22 nt, Homo sapiens
ccuccuauggguugucaccaag

SEQ ID NO: 1581454 - RNA, 12 nt, Homo sapiens
ccuccugugguc

SEQ ID NO: 1581455 - RNA, 21 nt, Homo sapiens
ccucggacugugugcagguug

SEQ ID NO: 1581456 - RNA, 22 nt, Homo sapiens
ccucguuggaagaggaacagca

SEQ ID NO: 1581457 - RNA, 18 nt, Homo sapiens
ccucuaauccagcaaagu

SEQ ID NO: 1581458 - RNA, 18 nt, Homo sapiens
ccucuagagccuucagcc

SEQ ID NO: 1581459 - RNA, 21 nt, Homo sapiens
ccucuaguaaauuuaagucca

SEQ ID NO: 1581460 - RNA, 22 nt, Homo sapiens
ccucucaaauucagcucugauc

SEQ ID NO: 1581461 - RNA, 13 nt, Homo sapiens
ccucucaugacuu

SEQ ID NO: 1581462 - RNA, 18 nt, Homo sapiens
ccucucccugcugcuccu

SEQ ID NO: 1581463 - RNA, 12 nt, Homo sapiens
ccucucucaaaa

SEQ ID NO: 1581464 - RNA, 17 nt, Homo sapiens
ccucucucccugccuca

SEQ ID NO: 1581465 - RNA, 12 nt, Homo sapiens
ccucucugcucu

SEQ ID NO: 1581466 - RNA, 14 nt, Homo sapiens
ccucucuuucacac

SEQ ID NO: 1581467 - RNA, 22 nt, Homo sapiens
ccucugcauggaacagcauuac

SEQ ID NO: 1581468 - RNA, 18 nt, Homo sapiens
ccucugcuaagguguauu

SEQ ID NO: 1581469 - RNA, 17 nt, Homo sapiens
ccucugcuaccaucuca

SEQ ID NO: 1581470 - RNA, 19 nt, Homo sapiens
ccucuguccccuucucuca

SEQ ID NO: 1581471 - RNA, 19 nt, Homo sapiens
ccucugugccauggaugau

SEQ ID NO: 1581472 - RNA, 18 nt, Homo sapiens
ccucuguugggaugccag

SEQ ID NO: 1581473 - RNA, 16 nt, Homo sapiens
ccucuguuuuccagaa

SEQ ID NO: 1581474 - RNA, 19 nt, Homo sapiens
ccucuuaaaugagaaagca

SEQ ID NO: 1581475 - RNA, 18 nt, Homo sapiens
ccucuuccagcaacugaa

SEQ ID NO: 1581476 - RNA, 24 nt, Homo sapiens
ccucuuccccagaaaggagacuag

SEQ ID NO: 1581477 - RNA, 15 nt, Homo sapiens
ccucuucugcucuuu

SEQ ID NO: 1581478 - RNA, 15 nt, Homo sapiens
ccucuuucuucauuc

SEQ ID NO: 1581479 - RNA, 17 nt, Homo sapiens
ccucuuucuucccauga

SEQ ID NO: 1581480 - RNA, 19 nt, Homo sapiens
ccugaaaaggguguugcua

SEQ ID NO: 1581481 - RNA, 15 nt, Homo sapiens
ccugaaaauugcaau

SEQ ID NO: 1581482 - RNA, 17 nt, Homo sapiens
ccugaaaugacauuuca

SEQ ID NO: 1581483 - RNA, 13 nt, Homo sapiens
ccugaacauauua

SEQ ID NO: 1581484 - RNA, 14 nt, Homo sapiens
ccugaacuccagag

SEQ ID NO: 1581485 - RNA, 23 nt, Homo sapiens
ccugaaggcacagcuaaccacuu

SEQ ID NO: 1581486 - RNA, 18 nt, Homo sapiens
ccugacacggacugugca

SEQ ID NO: 1581487 - RNA, 16 nt, Homo sapiens
ccugacacucaauaaa

SEQ ID NO: 1581488 - RNA, 14 nt, Homo sapiens
ccugacccccaugu

SEQ ID NO: 1581489 - RNA, 18 nt, Homo sapiens
ccugacccguuugcuaca

SEQ ID NO: 1581490 - RNA, 16 nt, Homo sapiens
ccugacccugcuccua

SEQ ID NO: 1581491 - RNA, 15 nt, Homo sapiens
ccugaccuccgcccc

SEQ ID NO: 1581492 - RNA, 15 nt, Homo sapiens
ccugacuaagccuuu

SEQ ID NO: 1581493 - RNA, 22 nt, Homo sapiens
ccugacuucuggaaucuuugag

SEQ ID NO: 1581494 - RNA, 15 nt, Homo sapiens
ccugacuugagccac

SEQ ID NO: 1581495 - RNA, 12 nt, Homo sapiens
ccugacuuugac

SEQ ID NO: 1581496 - RNA, 16 nt, Homo sapiens
ccugagaaacaaucac

SEQ ID NO: 1581497 - RNA, 16 nt, Homo sapiens
ccugagaccagggugg

SEQ ID NO: 1581498 - RNA, 14 nt, Homo sapiens
ccugagagccugug

SEQ ID NO: 1581499 - RNA, 20 nt, Homo sapiens
ccugagaucugcacagucag

SEQ ID NO: 1581500 - RNA, 22 nt, Homo sapiens
ccugagccuuggggaguccaca

SEQ ID NO: 1581501 - RNA, 17 nt, Homo sapiens
ccugagcgggagucagg

SEQ ID NO: 1581502 - RNA, 18 nt, Homo sapiens
ccugaggacugauuucag

SEQ ID NO: 1581503 - RNA, 21 nt, Homo sapiens
ccugaggugaaagggagcuau

SEQ ID NO: 1581504 - RNA, 23 nt, Homo sapiens
ccugaggugggagaaucacuuaa

SEQ ID NO: 1581505 - RNA, 21 nt, Homo sapiens
ccugauagaagugcauucucc

SEQ ID NO: 1581506 - RNA, 17 nt, Homo sapiens
ccugauauaacacuuuc

SEQ ID NO: 1581507 - RNA, 20 nt, Homo sapiens
ccugauugaucacacagugu

SEQ ID NO: 1581508 - RNA, 18 nt, Homo sapiens
ccugcaauguggugacac

SEQ ID NO: 1581509 - RNA, 20 nt, Homo sapiens
ccugcacacacaugcauacu

SEQ ID NO: 1581510 - RNA, 15 nt, Homo sapiens
ccugcacacagagug

SEQ ID NO: 1581511 - RNA, 18 nt, Homo sapiens
ccugcacguugugcacau

SEQ ID NO: 1581512 - RNA, 14 nt, Homo sapiens
ccugcagaccucaa

SEQ ID NO: 1581513 - RNA, 17 nt, Homo sapiens
ccugcagcccaccagac

SEQ ID NO: 1581514 - RNA, 13 nt, Homo sapiens
ccugcagggccaa

SEQ ID NO: 1581515 - RNA, 14 nt, Homo sapiens
ccugcauugaacag

SEQ ID NO: 1581516 - RNA, 18 nt, Homo sapiens
ccugcauuguuagcacua

SEQ ID NO: 1581517 - RNA, 10 nt, Homo sapiens
ccugccaagu

SEQ ID NO: 1581518 - RNA, 18 nt, Homo sapiens
ccugccacagccagagga

SEQ ID NO: 1581519 - RNA, 13 nt, Homo sapiens
ccugccaggcaca

SEQ ID NO: 1581520 - RNA, 17 nt, Homo sapiens
ccugcccaaacccuuaa

SEQ ID NO: 1581521 - RNA, 21 nt, Homo sapiens
ccugcccaaggccuaccccag

SEQ ID NO: 1581522 - RNA, 19 nt, Homo sapiens
ccugccccagauuuacuaa

SEQ ID NO: 1581523 - RNA, 13 nt, Homo sapiens
ccugccucagcuu

SEQ ID NO: 1581524 - RNA, 22 nt, Homo sapiens
ccugccucccaagguccucuca

SEQ ID NO: 1581525 - RNA, 16 nt, Homo sapiens
ccugccucugacccca

SEQ ID NO: 1581526 - RNA, 15 nt, Homo sapiens
ccugcggcccagaag

SEQ ID NO: 1581527 - RNA, 23 nt, Homo sapiens
ccugcgggcgcgggcagccaccc

SEQ ID NO: 1581528 - RNA, 16 nt, Homo sapiens
ccugcuagcacagagg

SEQ ID NO: 1581529 - RNA, 21 nt, Homo sapiens
ccugcucauguaccucugauu

SEQ ID NO: 1581530 - RNA, 19 nt, Homo sapiens
ccugcucucccuaaccccu

SEQ ID NO: 1581531 - RNA, 22 nt, Homo sapiens
ccugcugacuauuugaccccca

SEQ ID NO: 1581532 - RNA, 17 nt, Homo sapiens
ccugcugcaaagccuuu

SEQ ID NO: 1581533 - RNA, 14 nt, Homo sapiens
ccugcugcagggac

SEQ ID NO: 1581534 - RNA, 12 nt, Homo sapiens
ccugcugcucag

SEQ ID NO: 1581535 - RNA, 16 nt, Homo sapiens
ccugcugugcugcuca

SEQ ID NO: 1581536 - RNA, 18 nt, Homo sapiens
ccugcuguguggacuuca

SEQ ID NO: 1581537 - RNA, 22 nt, Homo sapiens
ccugcuuggucuuucauugcua

SEQ ID NO: 1581538 - RNA, 13 nt, Homo sapiens
ccugcuuugcauc

SEQ ID NO: 1581539 - RNA, 19 nt, Homo sapiens
ccuggaaucuacaagccaa

SEQ ID NO: 1581540 - RNA, 18 nt, Homo sapiens
cugggagucacacagugu

SEQ ID NO: 1581541 - RNA, 14 nt, Homo sapiens
cugggaguguuccc

SEQ ID NO: 1581542 - RNA, 15 nt, Homo sapiens
cugggcagcuacaag

SEQ ID NO: 1581543 - RNA, 23 nt, Homo sapiens
cugggcccaguaccuagcuggcu

SEQ ID NO: 1581544 - RNA, 16 nt, Homo sapiens
cugggccccaccaccu

SEQ ID NO: 1581545 - RNA, 17 nt, Homo sapiens
cugggcccgagccugaa

SEQ ID NO: 1581546 - RNA, 22 nt, Homo sapiens
cugggcccucucugcucugcgu

SEQ ID NO: 1581547 - RNA, 18 nt, Homo sapiens
cugggccgguuaguguau

SEQ ID NO: 1581548 - RNA, 24 nt, Homo sapiens
cugggcgcugucuugugucuccua

SEQ ID NO: 1581549 - RNA, 22 nt, Homo sapiens
cugggcuaaguaaauaggaauu

SEQ ID NO: 1581550 - RNA, 14 nt, Homo sapiens
cugggcucaagcaa

SEQ ID NO: 1581551 - RNA, 20 nt, Homo sapiens
cugggcucccucaaaugaca

SEQ ID NO: 1581552 - RNA, 17 nt, Homo sapiens
cugggcugccaccagcc

SEQ ID NO: 1581553 - RNA, 14 nt, Homo sapiens
cugggcuggcacag

SEQ ID NO: 1581554 - RNA, 20 nt, Homo sapiens
cugggcuggggccaccuuug

SEQ ID NO: 1581555 - RNA, 16 nt, Homo sapiens
cugggcugucugucac

SEQ ID NO: 1581556 - RNA, 20 nt, Homo sapiens
ccauaaggcacuuaucccug

SEQ ID NO: 1581557 - RNA, 19 nt, Homo sapiens
ccauaauugcuuugccaaa

SEQ ID NO: 1581558 - RNA, 23 nt, Homo sapiens
ccauacacacacacaaaaacaga

SEQ ID NO: 1581559 - RNA, 21 nt, Homo sapiens
ccauacacaugguaacauuga

SEQ ID NO: 1581560 - RNA, 14 nt, Homo sapiens
ccauagcaccucca

SEQ ID NO: 1581561 - RNA, 19 nt, Homo sapiens
ccauagggacccauucuac

SEQ ID NO: 1581562 - RNA, 21 nt, Homo sapiens
ccauagggacccauucuacac

SEQ ID NO: 1581563 - RNA, 19 nt, Homo sapiens
ccauagucagcagcagcuc

SEQ ID NO: 1581564 - RNA, 17 nt, Homo sapiens
ccauauuugauaguaua

SEQ ID NO: 1581565 - RNA, 14 nt, Homo sapiens
ccaucaagcacuuc

SEQ ID NO: 1581566 - RNA, 21 nt, Homo sapiens
ccaucaauaaagaagcauucu

SEQ ID NO: 1581567 - RNA, 12 nt, Homo sapiens
ccaucagacugu

SEQ ID NO: 1581568 - RNA, 15 nt, Homo sapiens
ccaucagacugucaa

SEQ ID NO: 1581569 - RNA, 19 nt, Homo sapiens
ccaucagcacucuguaaaa

SEQ ID NO: 1581570 - RNA, 20 nt, Homo sapiens
ccauccagaugugugcaaug

SEQ ID NO: 1581571 - RNA, 14 nt, Homo sapiens
ccauccagccagac

SEQ ID NO: 1581572 - RNA, 16 nt, Homo sapiens
ccauccccacccaguc

SEQ ID NO: 1581573 - RNA, 15 nt, Homo sapiens
ccaucccccugccuc

SEQ ID NO: 1581574 - RNA, 22 nt, Homo sapiens
ccaucguccuuccucucaagcu

SEQ ID NO: 1581575 - RNA, 14 nt, Homo sapiens
ccaucuaccugcuu

SEQ ID NO: 1581576 - RNA, 19 nt, Homo sapiens
ccaucugaagaaacuuccc

SEQ ID NO: 1581577 - RNA, 22 nt, Homo sapiens
ccaucuucuaaacccaauccaa

SEQ ID NO: 1581578 - RNA, 17 nt, Homo sapiens
ccaucuugaucuuugag

SEQ ID NO: 1581579 - RNA, 12 nt, Homo sapiens
ccaucuuuacaa

SEQ ID NO: 1581580 - RNA, 15 nt, Homo sapiens
ccaucuuugcugcca

SEQ ID NO: 1581581 - RNA, 22 nt, Homo sapiens
ccaucuuugcugccagcucuca

SEQ ID NO: 1581582 - RNA, 15 nt, Homo sapiens
ccaugaaauugaccc

SEQ ID NO: 1581583 - RNA, 17 nt, Homo sapiens
ccaugaagauaaacugu

SEQ ID NO: 1581584 - RNA, 11 nt, Homo sapiens
ccaugaaguca

SEQ ID NO: 1581585 - RNA, 12 nt, Homo sapiens
ccaugagcucac

SEQ ID NO: 1581586 - RNA, 23 nt, Homo sapiens
ccaugagcuccuuaaggcucuuu

SEQ ID NO: 1581587 - RNA, 21 nt, Homo sapiens
ccaugaugugaagaguuucac

SEQ ID NO: 1581588 - RNA, 15 nt, Homo sapiens
ccaugcacuguaaau

SEQ ID NO: 1581589 - RNA, 17 nt, Homo sapiens
ccaugcguccuggucaa

SEQ ID NO: 1581590 - RNA, 21 nt, Homo sapiens
ccaugcguguuucugacucug

SEQ ID NO: 1581591 - RNA, 17 nt, Homo sapiens
ccaugcuaagcaagcua

SEQ ID NO: 1581592 - RNA, 11 nt, Homo sapiens
ccaugcucaau

SEQ ID NO: 1581593 - RNA, 13 nt, Homo sapiens
ccaugcucaauga

SEQ ID NO: 1581594 - RNA, 16 nt, Homo sapiens
ccaugcucauaccucu

SEQ ID NO: 1581595 - RNA, 20 nt, Homo sapiens
ccaugcucuuguucuguucc

SEQ ID NO: 1581596 - RNA, 16 nt, Homo sapiens
ccaugcugugcugugu

SEQ ID NO: 1581597 - RNA, 22 nt, Homo sapiens
ccauggcccccaauaaaggcag

SEQ ID NO: 1581598 - RNA, 14 nt, Homo sapiens
ccauguaaauugca

SEQ ID NO: 1581599 - RNA, 13 nt, Homo sapiens
ccauguaaccacu

SEQ ID NO: 1581600 - RNA, 20 nt, Homo sapiens
ccauguaaccacugcacuuu

SEQ ID NO: 1581601 - RNA, 22 nt, Homo sapiens
ccauguuauuuauaguguugcu

SEQ ID NO: 1581602 - RNA, 13 nt, Homo sapiens
ccauguugaucuu

SEQ ID NO: 1581603 - RNA, 17 nt, Homo sapiens
ccauuaaaaacuaccac

SEQ ID NO: 1581604 - RNA, 13 nt, Homo sapiens
ccauuaccuguac

SEQ ID NO: 1581605 - RNA, 11 nt, Homo sapiens
ccauuagccaa

SEQ ID NO: 1581606 - RNA, 19 nt, Homo sapiens
ccauuauacuuuauaucug

SEQ ID NO: 1581607 - RNA, 16 nt, Homo sapiens
ccauucacagugcaag

SEQ ID NO: 1581608 - RNA, 20 nt, Homo sapiens
ccauuccggcccaccucccu

SEQ ID NO: 1581609 - RNA, 16 nt, Homo sapiens
ccauucuccugccuca

SEQ ID NO: 1581610 - RNA, 23 nt, Homo sapiens
ccauucuguuuggaucuauagaa

SEQ ID NO: 1581611 - RNA, 21 nt, Homo sapiens
ccauucuucagacaucaguca

SEQ ID NO: 1581612 - RNA, 16 nt, Homo sapiens
ccauugcauuccagcc

SEQ ID NO: 1581613 - RNA, 15 nt, Homo sapiens
ccauugguguugaca

SEQ ID NO: 1581614 - RNA, 13 nt, Homo sapiens
ccauugugaacca

SEQ ID NO: 1581615 - RNA, 14 nt, Homo sapiens
ccauugugaaccaa

SEQ ID NO: 1581616 - RNA, 13 nt, Homo sapiens
ccauuuaucuuuu

SEQ ID NO: 1581617 - RNA, 22 nt, Homo sapiens
ccauuucacucucaaacuucac

SEQ ID NO: 1581618 - RNA, 14 nt, Homo sapiens
ccauuucccauuaa

SEQ ID NO: 1581619 - RNA, 15 nt, Homo sapiens
ccauuucccauuaaa

SEQ ID NO: 1581620 - RNA, 17 nt, Homo sapiens
ccauuuccccucuuaaa

SEQ ID NO: 1581621 - RNA, 22 nt, Homo sapiens
ccauuuccuccuuuaccuuuca

SEQ ID NO: 1581622 - RNA, 19 nt, Homo sapiens
ccauuucugccucgcucac

SEQ ID NO: 1581623 - RNA, 20 nt, Homo sapiens
ccauuuguguacacagucag

SEQ ID NO: 1581624 - RNA, 20 nt, Homo sapiens
ccauuuuaaaaugcaucauu

SEQ ID NO: 1581625 - RNA, 14 nt, Homo sapiens
cccaaaacaaagua

SEQ ID NO: 1581626 - RNA, 19 nt, Homo sapiens
cccaaacuggagugcagug

SEQ ID NO: 1581627 - RNA, 15 nt, Homo sapiens
cccaaagcacuugcu

SEQ ID NO: 1581628 - RNA, 18 nt, Homo sapiens
cccaaauuaguacagaaa

SEQ ID NO: 1581629 - RNA, 13 nt, Homo sapiens
cccaacagcacuu

SEQ ID NO: 1581630 - RNA, 14 nt, Homo sapiens
cccaacagcacuuu

SEQ ID NO: 1581631 - RNA, 14 nt, Homo sapiens
cccaacaugcacug

SEQ ID NO: 1581632 - RNA, 16 nt, Homo sapiens
cccaacucaggacaga

SEQ ID NO: 1581633 - RNA, 22 nt, Homo sapiens
cccaacucuccuggccuggcca

SEQ ID NO: 1581634 - RNA, 16 nt, Homo sapiens
cccaagaugagcugca

SEQ ID NO: 1581635 - RNA, 21 nt, Homo sapiens
cccaagauuauucaauuuaua

SEQ ID NO: 1581636 - RNA, 22 nt, Homo sapiens
cccaaggccaagauuguccuuu

SEQ ID NO: 1581637 - RNA, 15 nt, Homo sapiens
cccaagguugcacag

SEQ ID NO: 1581638 - RNA, 17 nt, Homo sapiens
cccaaguagcugggauu

SEQ ID NO: 1581639 - RNA, 17 nt, Homo sapiens
cccaaguucaugcagcu

SEQ ID NO: 1581640 - RNA, 13 nt, Homo sapiens
cccaauacaaaga

SEQ ID NO: 1581641 - RNA, 17 nt, Homo sapiens
cccaaucugaaauucaa

SEQ ID NO: 1581642 - RNA, 22 nt, Homo sapiens
cccaauuaaaauacuaugcagu

SEQ ID NO: 1581643 - RNA, 19 nt, Homo sapiens
cccaauuacagggugacuc

SEQ ID NO: 1581644 - RNA, 15 nt, Homo sapiens
cccacaccucugcca

SEQ ID NO: 1581645 - RNA, 15 nt, Homo sapiens
cccacagaaccuuca

SEQ ID NO: 1581646 - RNA, 13 nt, Homo sapiens
cccacaugcaugu

SEQ ID NO: 1581647 - RNA, 14 nt, Homo sapiens
cccaccagugccuc

SEQ ID NO: 1581648 - RNA, 17 nt, Homo sapiens
cccaccuggugugacuu

SEQ ID NO: 1581649 - RNA, 13 nt, Homo sapiens
cccaccuuugcca

SEQ ID NO: 1581650 - RNA, 12 nt, Homo sapiens
cccacggcaccu

SEQ ID NO: 1581651 - RNA, 22 nt, Homo sapiens
cccacucugcuucuugcuggug

SEQ ID NO: 1581652 - RNA, 13 nt, Homo sapiens
cccacugcuucua

SEQ ID NO: 1581653 - RNA, 17 nt, Homo sapiens
cccagaaacagugugca

SEQ ID NO: 1581654 - RNA, 18 nt, Homo sapiens
cccagacuagauguagua

SEQ ID NO: 1581655 - RNA, 13 nt, Homo sapiens
cccagagugagcu

SEQ ID NO: 1581656 - RNA, 16 nt, Homo sapiens
cccagcaaaugggcau

SEQ ID NO: 1581657 - RNA, 15 nt, Homo sapiens
cccagcaacucuggc

SEQ ID NO: 1581658 - RNA, 14 nt, Homo sapiens
cccagcacugagga

SEQ ID NO: 1581659 - RNA, 13 nt, Homo sapiens
cccagcacuuugg

SEQ ID NO: 1581660 - RNA, 17 nt, Homo sapiens
cccagcacuuugggaga

SEQ ID NO: 1581661 - RNA, 19 nt, Homo sapiens
cccagcaucccuggagcag

SEQ ID NO: 1581662 - RNA, 18 nt, Homo sapiens
cccagccauccagggggc

SEQ ID NO: 1581663 - RNA, 21 nt, Homo sapiens
cccagcccccacagugcuguc

SEQ ID NO: 1581664 - RNA, 13 nt, Homo sapiens
cccagcccggcuc

SEQ ID NO: 1581665 - RNA, 20 nt, Homo sapiens
cccagccuccccgugccaaa

SEQ ID NO: 1581666 - RNA, 17 nt, Homo sapiens
cccagccuggaugccau

SEQ ID NO: 1581667 - RNA, 19 nt, Homo sapiens
cccagccuggaugccaucc

SEQ ID NO: 1581668 - RNA, 13 nt, Homo sapiens
gugguaugaaaug

SEQ ID NO: 1581669 - RNA, 23 nt, Homo sapiens
guggucacagcuguauagcugcu

SEQ ID NO: 1581670 - RNA, 11 nt, Homo sapiens
guggucauuuc

SEQ ID NO: 1581671 - RNA, 19 nt, Homo sapiens
guggugccugcacacagag

SEQ ID NO: 1581672 - RNA, 16 nt, Homo sapiens
gugguggcgugcauau

SEQ ID NO: 1581673 - RNA, 12 nt, Homo sapiens
gugguggugcua

SEQ ID NO: 1581674 - RNA, 18 nt, Homo sapiens
gugguuagagcugcucag

SEQ ID NO: 1581675 - RNA, 22 nt, Homo sapiens
gugguuuuauacugaaggaaaa

SEQ ID NO: 1581676 - RNA, 12 nt, Homo sapiens
guguaacuuuca

SEQ ID NO: 1581677 - RNA, 23 nt, Homo sapiens
guguaagauuuuguuugcaucug

SEQ ID NO: 1581678 - RNA, 23 nt, Homo sapiens
guguaagguuuugguuauggagu

SEQ ID NO: 1581679 - RNA, 16 nt, Homo sapiens
guguaauggaaaccaa

SEQ ID NO: 1581680 - RNA, 19 nt, Homo sapiens
guguaauggaaaccaagga

SEQ ID NO: 1581681 - RNA, 20 nt, Homo sapiens
guguaauggaaaccaaggaa

SEQ ID NO: 1581682 - RNA, 17 nt, Homo sapiens
guguacagagagauauu

SEQ ID NO: 1581683 - RNA, 16 nt, Homo sapiens
guguaccaagugcuuc

SEQ ID NO: 1581684 - RNA, 23 nt, Homo sapiens
guguauagcuguguguguguuca

SEQ ID NO: 1581685 - RNA, 19 nt, Homo sapiens
guguauaucucuuggaaaa

SEQ ID NO: 1581686 - RNA, 16 nt, Homo sapiens
guguaucaugguguuc

SEQ ID NO: 1581687 - RNA, 15 nt, Homo sapiens
guguauuagauauca

SEQ ID NO: 1581688 - RNA, 17 nt, Homo sapiens
guguauuccauaugucu

SEQ ID NO: 1581689 - RNA, 22 nt, Homo sapiens
guguauuuauuuuacagcucau

SEQ ID NO: 1581690 - RNA, 14 nt, Homo sapiens
guguauuugcuaau

SEQ ID NO: 1581691 - RNA, 21 nt, Homo sapiens
gugucaggugguuaccaggca

SEQ ID NO: 1581692 - RNA, 16 nt, Homo sapiens
gugucauaaacuuucu

SEQ ID NO: 1581693 - RNA, 16 nt, Homo sapiens
guguccagcauugcug

SEQ ID NO: 1581694 - RNA, 11 nt, Homo sapiens
guguccaugcc

SEQ ID NO: 1581695 - RNA, 17 nt, Homo sapiens
guguccaugccuuccau

SEQ ID NO: 1581696 - RNA, 12 nt, Homo sapiens
gugucugugcau

SEQ ID NO: 1581697 - RNA, 14 nt, Homo sapiens
gugucugugcccuc

SEQ ID NO: 1581698 - RNA, 20 nt, Homo sapiens
gugugaggcggcccugacca

SEQ ID NO: 1581699 - RNA, 22 nt, Homo sapiens
gugugaucuuaauauauuugaa

SEQ ID NO: 1581700 - RNA, 13 nt, Homo sapiens
gugugggcacgug

SEQ ID NO: 1581701 - RNA, 20 nt, Homo sapiens
gugugggggaggcgcacagu

SEQ ID NO: 1581702 - RNA, 14 nt, Homo sapiens
gugugggggguccu

SEQ ID NO: 1581703 - RNA, 23 nt, Homo sapiens
gugugucgcuuaugucuauaacu

SEQ ID NO: 1581704 - RNA, 13 nt, Homo sapiens
guguguguguaug

SEQ ID NO: 1581705 - RNA, 14 nt, Homo sapiens
guguuagcacugau

SEQ ID NO: 1581706 - RNA, 19 nt, Homo sapiens
guguucaagugcgugacug

SEQ ID NO: 1581707 - RNA, 18 nt, Homo sapiens
guguucacaaacugugaa

SEQ ID NO: 1581708 - RNA, 16 nt, Homo sapiens
guguucaguaaacaaa

SEQ ID NO: 1581709 - RNA, 14 nt, Homo sapiens
guguucaugaucuc

SEQ ID NO: 1581710 - RNA, 15 nt, Homo sapiens
guguucccgugccug

SEQ ID NO: 1581711 - RNA, 16 nt, Homo sapiens
guguugagggugucac

SEQ ID NO: 1581712 - RNA, 20 nt, Homo sapiens
guguugauuguauaaaugca

SEQ ID NO: 1581713 - RNA, 21 nt, Homo sapiens
guguuucuuuugacaccuuag

SEQ ID NO: 1581714 - RNA, 18 nt, Homo sapiens
guguuuuaaaacauucac

SEQ ID NO: 1581715 - RNA, 22 nt, Homo sapiens
guguuuucaucauuucagccaa

SEQ ID NO: 1581716 - RNA, 16 nt, Homo sapiens
guguuuuuaacauguc

SEQ ID NO: 1581717 - RNA, 21 nt, Homo sapiens
guguuuuucuuuuuccacaag

SEQ ID NO: 1581718 - RNA, 17 nt, Homo sapiens
guuaaacauugaaguaa

SEQ ID NO: 1581719 - RNA, 18 nt, Homo sapiens
guuaaaugguuauccaau

SEQ ID NO: 1581720 - RNA, 18 nt, Homo sapiens
guuaaauguauucuuggc

SEQ ID NO: 1581721 - RNA, 19 nt, Homo sapiens
guuaacugugaaauaccac

SEQ ID NO: 1581722 - RNA, 20 nt, Homo sapiens
guuaacuuuucuaacagaaa

SEQ ID NO: 1581723 - RNA, 16 nt, Homo sapiens
guuaagaaagcacuua

SEQ ID NO: 1581724 - RNA, 17 nt, Homo sapiens
guuaagaacaucaaaac

SEQ ID NO: 1581725 - RNA, 23 nt, Homo sapiens
guuaagucccauucaguggcaac

SEQ ID NO: 1581726 - RNA, 20 nt, Homo sapiens
guuaauaaaccuuugcaaac

SEQ ID NO: 1581727 - RNA, 13 nt, Homo sapiens
guuaauacuauau

SEQ ID NO: 1581728 - RNA, 15 nt, Homo sapiens
guuaauaguacuauu

SEQ ID NO: 1581729 - RNA, 17 nt, Homo sapiens
guuaauaguacuauuaa

SEQ ID NO: 1581730 - RNA, 17 nt, Homo sapiens
guuaauggucaaugcua

SEQ ID NO: 1581731 - RNA, 16 nt, Homo sapiens
guuacacagcccaaga

SEQ ID NO: 1581732 - RNA, 16 nt, Homo sapiens
guuacagccauaugca

SEQ ID NO: 1581733 - RNA, 15 nt, Homo sapiens
guuaccuacuuugac

SEQ ID NO: 1581734 - RNA, 16 nt, Homo sapiens
guuaccucugcaugga

SEQ ID NO: 1581735 - RNA, 17 nt, Homo sapiens
guuaccucugcauggaa

SEQ ID NO: 1581736 - RNA, 12 nt, Homo sapiens
guuacugucauu

SEQ ID NO: 1581737 - RNA, 15 nt, Homo sapiens
guuacugucauuccc

SEQ ID NO: 1581738 - RNA, 21 nt, Homo sapiens
guuacuuuugacccaugugca

SEQ ID NO: 1581739 - RNA, 16 nt, Homo sapiens
guuagauucacuuuga

SEQ ID NO: 1581740 - RNA, 18 nt, Homo sapiens
guuagcacugaacugcuu

SEQ ID NO: 1581741 - RNA, 17 nt, Homo sapiens
guuaggggccaauaaaa

SEQ ID NO: 1581742 - RNA, 22 nt, Homo sapiens
guuauaaaacuauguguucaau

SEQ ID NO: 1581743 - RNA, 20 nt, Homo sapiens
guuauaagcagcaagacaaa

SEQ ID NO: 1581744 - RNA, 14 nt, Homo sapiens
guuaugugcauuau

SEQ ID NO: 1581745 - RNA, 21 nt, Homo sapiens
guuauucauuuggugacugug

SEQ ID NO: 1581746 - RNA, 12 nt, Homo sapiens
guucaaagccag

SEQ ID NO: 1581747 - RNA, 20 nt, Homo sapiens
guucaagaaguaaucaguau

SEQ ID NO: 1581748 - RNA, 12 nt, Homo sapiens
guucaagcaauu

SEQ ID NO: 1581749 - RNA, 13 nt, Homo sapiens
guucaaggccagc

SEQ ID NO: 1581750 - RNA, 13 nt, Homo sapiens
guucacaugccac

SEQ ID NO: 1581751 - RNA, 21 nt, Homo sapiens
guucacuucuaaaccaaaaau

SEQ ID NO: 1581752 - RNA, 21 nt, Homo sapiens
guucauauuuauacuuugcaa

SEQ ID NO: 1581753 - RNA, 22 nt, Homo sapiens
guucauggauauguuauacuga

SEQ ID NO: 1581754 - RNA, 12 nt, Homo sapiens
guucauucugca

SEQ ID NO: 1581755 - RNA, 15 nt, Homo sapiens
guucauugaugcugc

SEQ ID NO: 1581756 - RNA, 14 nt, Homo sapiens
guucccaagcaaag

SEQ ID NO: 1581757 - RNA, 18 nt, Homo sapiens
guuccccgauaccaugcu

SEQ ID NO: 1581758 - RNA, 13 nt, Homo sapiens
uaaaacagucauc

SEQ ID NO: 1581759 - RNA, 16 nt, Homo sapiens
uaaaaccaaacaugcu

SEQ ID NO: 1581760 - RNA, 14 nt, Homo sapiens
uaaaaccacuguac

SEQ ID NO: 1581761 - RNA, 19 nt, Homo sapiens
uaaaaccagaaaggugauu

SEQ ID NO: 1581762 - RNA, 18 nt, Homo sapiens
uaaaacucacugugauca

SEQ ID NO: 1581763 - RNA, 18 nt, Homo sapiens
uaaaacucaucacauaaa

SEQ ID NO: 1581764 - RNA, 12 nt, Homo sapiens
uaaaacuguaua

SEQ ID NO: 1581765 - RNA, 20 nt, Homo sapiens
uaaaacugucuugugagcug

SEQ ID NO: 1581766 - RNA, 14 nt, Homo sapiens
uaaaacuguuucaa

SEQ ID NO: 1581767 - RNA, 14 nt, Homo sapiens
uaaaacuugguucu

SEQ ID NO: 1581768 - RNA, 19 nt, Homo sapiens
uaaaacuugguucugaaua

SEQ ID NO: 1581769 - RNA, 18 nt, Homo sapiens
uaaaacuuuggguacuua

SEQ ID NO: 1581770 - RNA, 12 nt, Homo sapiens
uaaaagacauua

SEQ ID NO: 1581771 - RNA, 18 nt, Homo sapiens
uaaaagagaagcaucauu

SEQ ID NO: 1581772 - RNA, 18 nt, Homo sapiens
uaaaagaggaaaagccaa

SEQ ID NO: 1581773 - RNA, 22 nt, Homo sapiens
uaaaagcaauucugacugucca

SEQ ID NO: 1581774 - RNA, 14 nt, Homo sapiens
uaaaagcacacucc

SEQ ID NO: 1581775 - RNA, 15 nt, Homo sapiens
uaaaagcacacuccc

SEQ ID NO: 1581776 - RNA, 19 nt, Homo sapiens
uaaaagcaccacuguucug

SEQ ID NO: 1581777 - RNA, 21 nt, Homo sapiens
uaaaagcaccauugugaagca

SEQ ID NO: 1581778 - RNA, 20 nt, Homo sapiens
uaaaagcuauaaagcaguau

SEQ ID NO: 1581779 - RNA, 21 nt, Homo sapiens
uaaaagguguuguaaugguga

SEQ ID NO: 1581780 - RNA, 19 nt, Homo sapiens
uaaaaguaaauucauguaa

SEQ ID NO: 1581781 - RNA, 14 nt, Homo sapiens
uaaaaguacauuaa

SEQ ID NO: 1581782 - RNA, 21 nt, Homo sapiens
uaaaagucacgugaaacagag

SEQ ID NO: 1581783 - RNA, 11 nt, Homo sapiens
uaaaagugcac

SEQ ID NO: 1581784 - RNA, 16 nt, Homo sapiens
uaaaagugcacauuaa

SEQ ID NO: 1581785 - RNA, 17 nt, Homo sapiens
uaaaagugggcuugauu

SEQ ID NO: 1581786 - RNA, 12 nt, Homo sapiens
uaaaaguuggcu

SEQ ID NO: 1581787 - RNA, 21 nt, Homo sapiens
uaaaaguuuuuuauuaugcau

SEQ ID NO: 1581788 - RNA, 13 nt, Homo sapiens
gauucaagccauu

SEQ ID NO: 1581789 - RNA, 17 nt, Homo sapiens
gauucaagccauuccaa

SEQ ID NO: 1581790 - RNA, 17 nt, Homo sapiens
gauucagaugucauuua

SEQ ID NO: 1581791 - RNA, 14 nt, Homo sapiens
gauucaguguuaaa

SEQ ID NO: 1581792 - RNA, 17 nt, Homo sapiens
gauuccaaaaagcacau

SEQ ID NO: 1581793 - RNA, 19 nt, Homo sapiens
gauuccaaaaagcacauau

SEQ ID NO: 1581794 - RNA, 21 nt, Homo sapiens
gauuccguauugguauacuuu

SEQ ID NO: 1581795 - RNA, 13 nt, Homo sapiens
gauucuauguuaa

SEQ ID NO: 1581796 - RNA, 16 nt, Homo sapiens
gauucucacauaugcc

SEQ ID NO: 1581797 - RNA, 12 nt, Homo sapiens
gauucuccuuca

SEQ ID NO: 1581798 - RNA, 14 nt, Homo sapiens
gauucugugucaga

SEQ ID NO: 1581799 - RNA, 17 nt, Homo sapiens
gauucuuucccaauuca

SEQ ID NO: 1581800 - RNA, 23 nt, Homo sapiens
gauugaaaaaaagggcacucuga

SEQ ID NO: 1581801 - RNA, 16 nt, Homo sapiens
gauugaauuucacugu

SEQ ID NO: 1581802 - RNA, 24 nt, Homo sapiens
gauugagaaauguguagcugcaaa

SEQ ID NO: 1581803 - RNA, 12 nt, Homo sapiens
gauugauuagau

SEQ ID NO: 1581804 - RNA, 18 nt, Homo sapiens
gauuggccacacacugag

SEQ ID NO: 1581805 - RNA, 19 nt, Homo sapiens
gauugguguucguuuccau

SEQ ID NO: 1581806 - RNA, 19 nt, Homo sapiens
gauugucaccaugaucacu

SEQ ID NO: 1581807 - RNA, 16 nt, Homo sapiens
gauugugguggugcua

SEQ ID NO: 1581808 - RNA, 18 nt, Homo sapiens
gauuguugucaggccaua

SEQ ID NO: 1581809 - RNA, 19 nt, Homo sapiens
gauuuaauacguacuuuag

SEQ ID NO: 1581810 - RNA, 20 nt, Homo sapiens
gauuuaauuuuuuaaacugu

SEQ ID NO: 1581811 - RNA, 22 nt, Homo sapiens
gauuuacuaaaucaaucugcag

SEQ ID NO: 1581812 - RNA, 15 nt, Homo sapiens
gauuucacaucagcu

SEQ ID NO: 1581813 - RNA, 21 nt, Homo sapiens
gauuucauaguucagaauuua

SEQ ID NO: 1581814 - RNA, 19 nt, Homo sapiens
gauuuccacacgccaagcu

SEQ ID NO: 1581815 - RNA, 11 nt, Homo sapiens
gauuucuggga

SEQ ID NO: 1581816 - RNA, 23 nt, Homo sapiens
gauuucuuucuuugcaccaaaga

SEQ ID NO: 1581817 - RNA, 20 nt, Homo sapiens
gauuugcguggaaaucucag

SEQ ID NO: 1581818 - RNA, 23 nt, Homo sapiens
gauuugcuguuaccaaaucucag

SEQ ID NO: 1581819 - RNA, 16 nt, Homo sapiens
gauuuggccacacugg

SEQ ID NO: 1581820 - RNA, 13 nt, Homo sapiens
gauuuggggcuuu

SEQ ID NO: 1581821 - RNA, 22 nt, Homo sapiens
gauuugucccuaugcauaucag

SEQ ID NO: 1581822 - RNA, 13 nt, Homo sapiens
gauuuuaccaaag

SEQ ID NO: 1581823 - RNA, 14 nt, Homo sapiens
gauuuuaccaaagc

SEQ ID NO: 1581824 - RNA, 21 nt, Homo sapiens
gauuuuauggugaugucacuc

SEQ ID NO: 1581825 - RNA, 22 nt, Homo sapiens
gauuuugaaauauaguaaacac

SEQ ID NO: 1581826 - RNA, 20 nt, Homo sapiens
gauuuugcuugagcaggauu

SEQ ID NO: 1581827 - RNA, 23 nt, Homo sapiens
gauuuuggccaucaggacucuga

SEQ ID NO: 1581828 - RNA, 15 nt, Homo sapiens
gauuuugucuaccau

SEQ ID NO: 1581829 - RNA, 20 nt, Homo sapiens
gauuuuuguuuuccacugug

SEQ ID NO: 1581830 - RNA, 15 nt, Homo sapiens
gcaaaaccaaacugg

SEQ ID NO: 1581831 - RNA, 16 nt, Homo sapiens
gcaaaagaaagaacca

SEQ ID NO: 1581832 - RNA, 16 nt, Homo sapiens
gcaaaaguaaucacuu

SEQ ID NO: 1581833 - RNA, 18 nt, Homo sapiens
gcaaaaguaaucacuuaa

SEQ ID NO: 1581834 - RNA, 18 nt, Homo sapiens
gcaaaauacaugacauuu

SEQ ID NO: 1581835 - RNA, 19 nt, Homo sapiens
gcaaaauacaugacauuua

SEQ ID NO: 1581836 - RNA, 12 nt, Homo sapiens
gcaaaauauuca

SEQ ID NO: 1581837 - RNA, 19 nt, Homo sapiens
gcaaaaucucuacugcuuu

SEQ ID NO: 1581838 - RNA, 20 nt, Homo sapiens
gcaaaaugaaaaugucaaua

SEQ ID NO: 1581839 - RNA, 18 nt, Homo sapiens
gcaaaauuaaauacauaa

SEQ ID NO: 1581840 - RNA, 12 nt, Homo sapiens
gcaaaauugcaa

SEQ ID NO: 1581841 - RNA, 20 nt, Homo sapiens
gcaaacacugugauuacucu

SEQ ID NO: 1581842 - RNA, 16 nt, Homo sapiens
gcaaacccuggugcuu

SEQ ID NO: 1581843 - RNA, 23 nt, Homo sapiens
gcaaacccuggugcuuuccuuca

SEQ ID NO: 1581844 - RNA, 15 nt, Homo sapiens
gcaaaccugcaguuu

SEQ ID NO: 1581845 - RNA, 23 nt, Homo sapiens
gcaaaccugcaguuuuuaauuug

SEQ ID NO: 1581846 - RNA, 12 nt, Homo sapiens
gcaaaccuuccu

SEQ ID NO: 1581847 - RNA, 21 nt, Homo sapiens
gcaaaccuuccugggaggaca

SEQ ID NO: 1581848 - RNA, 21 nt, Homo sapiens
gcaaacucaaguugaaggaca

SEQ ID NO: 1581849 - RNA, 19 nt, Homo sapiens
gcaaacuguuuugacaaau

SEQ ID NO: 1581850 - RNA, 22 nt, Homo sapiens
gcaaagaaaggagauacagugg

SEQ ID NO: 1581851 - RNA, 23 nt, Homo sapiens
gcaaagaacucauuugaaugcuu

SEQ ID NO: 1581852 - RNA, 14 nt, Homo sapiens
gcaaagacaucaaa

SEQ ID NO: 1581853 - RNA, 16 nt, Homo sapiens
gcaaagauuuuuggca

SEQ ID NO: 1581854 - RNA, 18 nt, Homo sapiens
gcaaagcaaaaggcugag

SEQ ID NO: 1581855 - RNA, 16 nt, Homo sapiens
gcaaaguggaauuaaa

SEQ ID NO: 1581856 - RNA, 20 nt, Homo sapiens
gcaaauaaaauaaaugaaau

SEQ ID NO: 1581857 - RNA, 15 nt, Homo sapiens
gcaaauaaaccacuu

SEQ ID NO: 1581858 - RNA, 14 nt, Homo sapiens
gcaaauagccacaa

SEQ ID NO: 1581859 - RNA, 15 nt, Homo sapiens
gcaaauauacuuuac

SEQ ID NO: 1581860 - RNA, 15 nt, Homo sapiens
gcaaaugcaaaaacu

SEQ ID NO: 1581861 - RNA, 16 nt, Homo sapiens
gcaaaugccugacuca

SEQ ID NO: 1581862 - RNA, 17 nt, Homo sapiens
gcaaauggccaaugaga

SEQ ID NO: 1581863 - RNA, 15 nt, Homo sapiens
gcaaauguacuucuc

SEQ ID NO: 1581864 - RNA, 13 nt, Homo sapiens
gcaaauugcaauc

SEQ ID NO: 1581865 - RNA, 19 nt, Homo sapiens
gcaaauuuucagcauuaag

SEQ ID NO: 1581866 - RNA, 17 nt, Homo sapiens
gcaacaauuuaugaauu

SEQ ID NO: 1581867 - RNA, 21 nt, Homo sapiens
gcaacagauaaguuugcaguu

SEQ ID NO: 1581868 - RNA, 18 nt, Homo sapiens
gcaacagcaaacaggugc

SEQ ID NO: 1581869 - RNA, 15 nt, Homo sapiens
gcaacaguuaucaca

SEQ ID NO: 1581870 - RNA, 12 nt, Homo sapiens
gcaacauccaga

SEQ ID NO: 1581871 - RNA, 18 nt, Homo sapiens
gcaacauucauagucuuu

SEQ ID NO: 1581872 - RNA, 19 nt, Homo sapiens
gcaaccaaagugcaggaca

SEQ ID NO: 1581873 - RNA, 12 nt, Homo sapiens
gcaaccaggaac

SEQ ID NO: 1581874 - RNA, 23 nt, Homo sapiens
gcaacuaggaaaaucacuugcca

SEQ ID NO: 1581875 - RNA, 23 nt, Homo sapiens
gcaacuauuuccaccuccuccca

SEQ ID NO: 1581876 - RNA, 18 nt, Homo sapiens
gcaacuguuuaaccuguu

SEQ ID NO: 1581877 - RNA, 15 nt, Homo sapiens
gcaacuugcuucuaa

SEQ ID NO: 1581878 - RNA, 14 nt, Homo sapiens
gcaagaaugaaaug

SEQ ID NO: 1581879 - RNA, 12 nt, Homo sapiens
gcaagagacugg

SEQ ID NO: 1581880 - RNA, 23 nt, Homo sapiens
gcaagaggugugcacaccaaagc

SEQ ID NO: 1581881 - RNA, 16 nt, Homo sapiens
gcaagaguggacugaa

SEQ ID NO: 1581882 - RNA, 15 nt, Homo sapiens
gcaagccaagugccc

SEQ ID NO: 1581883 - RNA, 12 nt, Homo sapiens
gcaagccagcuu

SEQ ID NO: 1581884 - RNA, 16 nt, Homo sapiens
gcaagcccugcccaca

SEQ ID NO: 1581885 - RNA, 23 nt, Homo sapiens
gcaaggaaacuauguaacaugua

SEQ ID NO: 1581886 - RNA, 12 nt, Homo sapiens
gugaaccacugu

SEQ ID NO: 1581887 - RNA, 17 nt, Homo sapiens
gugaacuuacuugcaua

SEQ ID NO: 1581888 - RNA, 11 nt, Homo sapiens
gugaacuuugu

SEQ ID NO: 1581889 - RNA, 11 nt, Homo sapiens
gugaagaccaa

SEQ ID NO: 1581890 - RNA, 13 nt, Homo sapiens
gugaagaccaaca

SEQ ID NO: 1581891 - RNA, 12 nt, Homo sapiens
gugaagccuuua

SEQ ID NO: 1581892 - RNA, 12 nt, Homo sapiens
gugaaggugauu

SEQ ID NO: 1581893 - RNA, 15 nt, Homo sapiens
gugaaguaaaagagg

SEQ ID NO: 1581894 - RNA, 20 nt, Homo sapiens
gugaauacuugaacucuguu

SEQ ID NO: 1581895 - RNA, 14 nt, Homo sapiens
gugaauagaacucu

SEQ ID NO: 1581896 - RNA, 14 nt, Homo sapiens
gugaaucagacccu

SEQ ID NO: 1581897 - RNA, 17 nt, Homo sapiens
gugaauggucucuguca

SEQ ID NO: 1581898 - RNA, 21 nt, Homo sapiens
gugaauuaggcuguaacuacu

SEQ ID NO: 1581899 - RNA, 16 nt, Homo sapiens
gugacauuuccaugca

SEQ ID NO: 1581900 - RNA, 15 nt, Homo sapiens
gugaccaaaucagug

SEQ ID NO: 1581901 - RNA, 16 nt, Homo sapiens
gugaccguuugcuaua

SEQ ID NO: 1581902 - RNA, 17 nt, Homo sapiens
gugacgugguagucacu

SEQ ID NO: 1581903 - RNA, 13 nt, Homo sapiens
gugacuugcaaua

SEQ ID NO: 1581904 - RNA, 13 nt, Homo sapiens
gugagaacaucau

SEQ ID NO: 1581905 - RNA, 18 nt, Homo sapiens
gugagacagcucugcaua

SEQ ID NO: 1581906 - RNA, 18 nt, Homo sapiens
gugagacccaaaggaaga

SEQ ID NO: 1581907 - RNA, 11 nt, Homo sapiens
gugagcacuag

SEQ ID NO: 1581908 - RNA, 15 nt, Homo sapiens
gugagcacuagaaua

SEQ ID NO: 1581909 - RNA, 19 nt, Homo sapiens
gugagcaugcacacugaga

SEQ ID NO: 1581910 - RNA, 16 nt, Homo sapiens
gugagcauggggccag

SEQ ID NO: 1581911 - RNA, 17 nt, Homo sapiens
gugagcugagauugcac

SEQ ID NO: 1581912 - RNA, 22 nt, Homo sapiens
gugaggaugucugggccacuca

SEQ ID NO: 1581913 - RNA, 18 nt, Homo sapiens
gugaggcggucggaucua

SEQ ID NO: 1581914 - RNA, 19 nt, Homo sapiens
gugaggcuccggauguuuc

SEQ ID NO: 1581915 - RNA, 20 nt, Homo sapiens
gugaggugugucacaaugag

SEQ ID NO: 1581916 - RNA, 15 nt, Homo sapiens
gugagucgagauugc

SEQ ID NO: 1581917 - RNA, 14 nt, Homo sapiens
gugaguuugagcug

SEQ ID NO: 1581918 - RNA, 23 nt, Homo sapiens
gugauauacugguucacauccua

SEQ ID NO: 1581919 - RNA, 22 nt, Homo sapiens
gugauauuguguggucugguuc

SEQ ID NO: 1581920 - RNA, 16 nt, Homo sapiens
gugauccgccuaccuc

SEQ ID NO: 1581921 - RNA, 16 nt, Homo sapiens
gugaugaacgugccug

SEQ ID NO: 1581922 - RNA, 22 nt, Homo sapiens
gugaugacuuagcgucaagaca

SEQ ID NO: 1581923 - RNA, 20 nt, Homo sapiens
gugauggaguuucucuagaa

SEQ ID NO: 1581924 - RNA, 23 nt, Homo sapiens
gugauggggaggggcauugcuga

SEQ ID NO: 1581925 - RNA, 13 nt, Homo sapiens
gugauguggugcg

SEQ ID NO: 1581926 - RNA, 21 nt, Homo sapiens
gugauguguccugauaagcug

SEQ ID NO: 1581927 - RNA, 18 nt, Homo sapiens
gugauuucuuucuuugca

SEQ ID NO: 1581928 - RNA, 16 nt, Homo sapiens
gugauuuuaagacaag

SEQ ID NO: 1581929 - RNA, 11 nt, Homo sapiens
gugcaaaggga

SEQ ID NO: 1581930 - RNA, 20 nt, Homo sapiens
gugcaagaaggauaccaaau

SEQ ID NO: 1581931 - RNA, 20 nt, Homo sapiens
gugcaagaugaaugcagauu

SEQ ID NO: 1581932 - RNA, 12 nt, Homo sapiens
gugcacaaauac

SEQ ID NO: 1581933 - RNA, 24 nt, Homo sapiens
gugcacaucuacaugccaugccua

SEQ ID NO: 1581934 - RNA, 17 nt, Homo sapiens
gugcagcugcugugccu

SEQ ID NO: 1581935 - RNA, 21 nt, Homo sapiens
gugcagcuucgaggacaggaa

SEQ ID NO: 1581936 - RNA, 18 nt, Homo sapiens
gugcagggauauugccuu

SEQ ID NO: 1581937 - RNA, 13 nt, Homo sapiens
gugcagucuuuga

SEQ ID NO: 1581938 - RNA, 19 nt, Homo sapiens
gugcaguggugugaucuca

SEQ ID NO: 1581939 - RNA, 12 nt, Homo sapiens
gugcaugcucuc

SEQ ID NO: 1581940 - RNA, 17 nt, Homo sapiens
gugcaugguaugugggu

SEQ ID NO: 1581941 - RNA, 23 nt, Homo sapiens
gugcauuuuuacuauuguuacau

SEQ ID NO: 1581942 - RNA, 19 nt, Homo sapiens
gugccaaaaaucuuuucau

SEQ ID NO: 1581943 - RNA, 21 nt, Homo sapiens
gugccaaagaagcagaccauu

SEQ ID NO: 1581944 - RNA, 17 nt, Homo sapiens
gugccacuggaccucag

SEQ ID NO: 1581945 - RNA, 18 nt, Homo sapiens
gugccagauauaacuguc

SEQ ID NO: 1581946 - RNA, 20 nt, Homo sapiens
gugcccauccugccauccuc

SEQ ID NO: 1581947 - RNA, 21 nt, Homo sapiens
gugccccagggaguccagggu

SEQ ID NO: 1581948 - RNA, 13 nt, Homo sapiens
gugccccaugccu

SEQ ID NO: 1581949 - RNA, 19 nt, Homo sapiens
gugcccuagaugcacgugg

SEQ ID NO: 1581950 - RNA, 10 nt, Homo sapiens
gugcccucca

SEQ ID NO: 1581951 - RNA, 22 nt, Homo sapiens
gugccgaggacaugcaugacac

SEQ ID NO: 1581952 - RNA, 14 nt, Homo sapiens
gugccuagacuguu

SEQ ID NO: 1581953 - RNA, 21 nt, Homo sapiens
gugccuagacuguuacuuugg

SEQ ID NO: 1581954 - RNA, 21 nt, Homo sapiens
gugccugaaauuucaccauug

SEQ ID NO: 1581955 - RNA, 22 nt, Homo sapiens
gugccuugucacgccagacuuc

SEQ ID NO: 1581956 - RNA, 13 nt, Homo sapiens
gugcuaaaccaag

SEQ ID NO: 1581957 - RNA, 18 nt, Homo sapiens
gugcuacaaaaacacagc

SEQ ID NO: 1581958 - RNA, 13 nt, Homo sapiens
gugcucaccagcc

SEQ ID NO: 1581959 - RNA, 14 nt, Homo sapiens
gugcucagccaaau

SEQ ID NO: 1581960 - RNA, 13 nt, Homo sapiens
gugcuccaucucc

SEQ ID NO: 1581961 - RNA, 13 nt, Homo sapiens
gugcuccuggaaa

SEQ ID NO: 1581962 - RNA, 20 nt, Homo sapiens
gugcucucaacaggacuuaa

SEQ ID NO: 1581963 - RNA, 18 nt, Homo sapiens
gugcucuguaccugucaa

SEQ ID NO: 1581964 - RNA, 12 nt, Homo sapiens
gugcugcaccug

SEQ ID NO: 1581965 - RNA, 11 nt, Homo sapiens
gugcugggauu

SEQ ID NO: 1581966 - RNA, 20 nt, Homo sapiens
gugcugggauuacaggugua

SEQ ID NO: 1581967 - RNA, 21 nt, Homo sapiens
gugcugggauuacagguguga

SEQ ID NO: 1581968 - RNA, 15 nt, Homo sapiens
gugcuggggcacggc

SEQ ID NO: 1581969 - RNA, 18 nt, Homo sapiens
gugcugugggcagcaccc

SEQ ID NO: 1581970 - RNA, 20 nt, Homo sapiens
gugcuuuuaaaaaaaaauac

SEQ ID NO: 1581971 - RNA, 20 nt, Homo sapiens
gugcuuuuugggaccaucac

SEQ ID NO: 1581972 - RNA, 18 nt, Homo sapiens
guggaaaacuuaugcuga

SEQ ID NO: 1581973 - RNA, 23 nt, Homo sapiens
guggaaagcgugugagugaggga

SEQ ID NO: 1581974 - RNA, 15 nt, Homo sapiens
guggaacucagucau

SEQ ID NO: 1581975 - RNA, 14 nt, Homo sapiens
guggaagaaggaaa

SEQ ID NO: 1581976 - RNA, 20 nt, Homo sapiens
guggacaaagucaacuucca

SEQ ID NO: 1581977 - RNA, 12 nt, Homo sapiens
uuuccuguucag

SEQ ID NO: 1581978 - RNA, 17 nt, Homo sapiens
uuuccuugucccaggau

SEQ ID NO: 1581979 - RNA, 19 nt, Homo sapiens
uuuccuuuaaaaauacaua

SEQ ID NO: 1581980 - RNA, 21 nt, Homo sapiens
uuucuaaaaaggcugcucaca

SEQ ID NO: 1581981 - RNA, 22 nt, Homo sapiens
uuucuaaaccuugugauucugc

SEQ ID NO: 1581982 - RNA, 16 nt, Homo sapiens
uuucuaacacuagcuu

SEQ ID NO: 1581983 - RNA, 13 nt, Homo sapiens
uuucuaagagaag

SEQ ID NO: 1581984 - RNA, 19 nt, Homo sapiens
uuucuauauuauugcccau

SEQ ID NO: 1581985 - RNA, 22 nt, Homo sapiens
uuucuaugacaauaugacacuu

SEQ ID NO: 1581986 - RNA, 12 nt, Homo sapiens
uuucucacugaa

SEQ ID NO: 1581987 - RNA, 13 nt, Homo sapiens
uuucucauuaaau

SEQ ID NO: 1581988 - RNA, 14 nt, Homo sapiens
uuucucccuauguu

SEQ ID NO: 1581989 - RNA, 21 nt, Homo sapiens
uuucucugagcagucagggug

SEQ ID NO: 1581990 - RNA, 19 nt, Homo sapiens
uuucugaacuguuacaacu

SEQ ID NO: 1581991 - RNA, 16 nt, Homo sapiens
uuucugaggaguaaaa

SEQ ID NO: 1581992 - RNA, 14 nt, Homo sapiens
uuucugagugccuu

SEQ ID NO: 1581993 - RNA, 21 nt, Homo sapiens
uuucugauaaaagauggccau

SEQ ID NO: 1581994 - RNA, 15 nt, Homo sapiens
uuucugcaauccaau

SEQ ID NO: 1581995 - RNA, 20 nt, Homo sapiens
uuucugcaauccaaugcacu

SEQ ID NO: 1581996 - RNA, 21 nt, Homo sapiens
uuucugggagacagaaaacau

SEQ ID NO: 1581997 - RNA, 19 nt, Homo sapiens
uuucugggguccauucucu

SEQ ID NO: 1581998 - RNA, 16 nt, Homo sapiens
uuucuggugcuuuaua

SEQ ID NO: 1581999 - RNA, 18 nt, Homo sapiens
uuucuuaaugaaccuuag

SEQ ID NO: 1582000 - RNA, 14 nt, Homo sapiens
uuucuucaccaaau

SEQ ID NO: 1582001 - RNA, 17 nt, Homo sapiens
uuucuucuagugcuuuu

SEQ ID NO: 1582002 - RNA, 13 nt, Homo sapiens
uuucuugcuuuca

SEQ ID NO: 1582003 - RNA, 23 nt, Homo sapiens
uuucuuguaaggcauacugccuu

SEQ ID NO: 1582004 - RNA, 17 nt, Homo sapiens
uuucuuucucacuaaau

SEQ ID NO: 1582005 - RNA, 18 nt, Homo sapiens
uuugaaagacugugcugu

SEQ ID NO: 1582006 - RNA, 20 nt, Homo sapiens
uuugaaauagucugugugaa

SEQ ID NO: 1582007 - RNA, 21 nt, Homo sapiens
uuugaagcacaacucccuuaa

SEQ ID NO: 1582008 - RNA, 14 nt, Homo sapiens
uuugacacugcucu

SEQ ID NO: 1582009 - RNA, 20 nt, Homo sapiens
uuugacacuucccaguggaa

SEQ ID NO: 1582010 - RNA, 14 nt, Homo sapiens
uuugacauuuacug

SEQ ID NO: 1582011 - RNA, 20 nt, Homo sapiens
uuugacucuggggugcagcu

SEQ ID NO: 1582012 - RNA, 13 nt, Homo sapiens
uuugagcuucuag

SEQ ID NO: 1582013 - RNA, 17 nt, Homo sapiens
uuugagguaaagauaug

SEQ ID NO: 1582014 - RNA, 14 nt, Homo sapiens
uuugaggucuacau

SEQ ID NO: 1582015 - RNA, 23 nt, Homo sapiens
uuugaguccacgcccaccagccu

SEQ ID NO: 1582016 - RNA, 18 nt, Homo sapiens
uuugauacuaagcauuga

SEQ ID NO: 1582017 - RNA, 17 nt, Homo sapiens
uuugauaggauguggau

SEQ ID NO: 1582018 - RNA, 20 nt, Homo sapiens
uuugauauaccaaauuaaaa

SEQ ID NO: 1582019 - RNA, 10 nt, Homo sapiens
uuugaucaug

SEQ ID NO: 1582020 - RNA, 18 nt, Homo sapiens
uuugaucuuuguuuaaau

SEQ ID NO: 1582021 - RNA, 15 nt, Homo sapiens
uuugauuauucagug

SEQ ID NO: 1582022 - RNA, 15 nt, Homo sapiens
uuugauucagcaaaa

SEQ ID NO: 1582023 - RNA, 13 nt, Homo sapiens
uuugcaaacguuc

SEQ ID NO: 1582024 - RNA, 20 nt, Homo sapiens
uuugcaacaauaaaguacuu

SEQ ID NO: 1582025 - RNA, 15 nt, Homo sapiens
uuugcacuuggcaaa

SEQ ID NO: 1582026 - RNA, 21 nt, Homo sapiens
uuugcagauaacaaacaagaa

SEQ ID NO: 1582027 - RNA, 16 nt, Homo sapiens
uuugcaguaugaacua

SEQ ID NO: 1582028 - RNA, 17 nt, Homo sapiens
uuugccaaaauucauuu

SEQ ID NO: 1582029 - RNA, 19 nt, Homo sapiens
uuugccugcuucuuuccag

SEQ ID NO: 1582030 - RNA, 13 nt, Homo sapiens
uuugcguacuugu

SEQ ID NO: 1582031 - RNA, 15 nt, Homo sapiens
uuugcuaucugggcu

SEQ ID NO: 1582032 - RNA, 14 nt, Homo sapiens
uuugcucucuggcc

SEQ ID NO: 1582033 - RNA, 18 nt, Homo sapiens
uuugcucuuuucaaugug

SEQ ID NO: 1582034 - RNA, 11 nt, Homo sapiens
uuugcuguaga

SEQ ID NO: 1582035 - RNA, 12 nt, Homo sapiens
uuugcuguagaa

SEQ ID NO: 1582036 - RNA, 18 nt, Homo sapiens
uuugcuguggaacuacau

SEQ ID NO: 1582037 - RNA, 23 nt, Homo sapiens
uuugcuguuguugggacauggca

SEQ ID NO: 1582038 - RNA, 17 nt, Homo sapiens
uuugcuuacuugcuaaa

SEQ ID NO: 1582039 - RNA, 14 nt, Homo sapiens
uuugcuuagcucaa

SEQ ID NO: 1582040 - RNA, 11 nt, Homo sapiens
uuugcuucccc

SEQ ID NO: 1582041 - RNA, 17 nt, Homo sapiens
uuuggaauauuguccau

SEQ ID NO: 1582042 - RNA, 23 nt, Homo sapiens
uuuggacccagggccugacuuga

SEQ ID NO: 1582043 - RNA, 20 nt, Homo sapiens
uuuggagcacaaaauucaaa

SEQ ID NO: 1582044 - RNA, 20 nt, Homo sapiens
uuuggaggcuccaagccuca

SEQ ID NO: 1582045 - RNA, 19 nt, Homo sapiens
uuuggaggugcuugaucua

SEQ ID NO: 1582046 - RNA, 18 nt, Homo sapiens
uuuggcuugcuguuuacu

SEQ ID NO: 1582047 - RNA, 18 nt, Homo sapiens
uuuggcuuuaugugcaaa

SEQ ID NO: 1582048 - RNA, 14 nt, Homo sapiens
uuugggcagugcca

SEQ ID NO: 1582049 - RNA, 14 nt, Homo sapiens
uuuaaauuccacag

SEQ ID NO: 1582050 - RNA, 16 nt, Homo sapiens
uuuaaauuccacagau

SEQ ID NO: 1582051 - RNA, 18 nt, Homo sapiens
uuuaaauugauagcagau

SEQ ID NO: 1582052 - RNA, 13 nt, Homo sapiens
uuuaacagccucu

SEQ ID NO: 1582053 - RNA, 19 nt, Homo sapiens
uuuaacauuguugauuuca

SEQ ID NO: 1582054 - RNA, 14 nt, Homo sapiens
uuuaaccaacagaa

SEQ ID NO: 1582055 - RNA, 22 nt, Homo sapiens
uuuaacuggcaugucauuugca

SEQ ID NO: 1582056 - RNA, 16 nt, Homo sapiens
uuuaacuuuaccaugc

SEQ ID NO: 1582057 - RNA, 17 nt, Homo sapiens
uuuaacuuuaccaugcu

SEQ ID NO: 1582058 - RNA, 17 nt, Homo sapiens
uuuaagccgaagggcaa

SEQ ID NO: 1582059 - RNA, 13 nt, Homo sapiens
uuuaagcuaugaa

SEQ ID NO: 1582060 - RNA, 11 nt, Homo sapiens
uuuaagcucaa

SEQ ID NO: 1582061 - RNA, 17 nt, Homo sapiens
uuuaaggauucugagau

SEQ ID NO: 1582062 - RNA, 23 nt, Homo sapiens
uuuaagggauugcuuucaucuaa

SEQ ID NO: 1582063 - RNA, 15 nt, Homo sapiens
uuuaagugacauaau

SEQ ID NO: 1582064 - RNA, 14 nt, Homo sapiens
uuuaauagcaaaga

SEQ ID NO: 1582065 - RNA, 22 nt, Homo sapiens
uuuaauagcacuaaccaaugcc

SEQ ID NO: 1582066 - RNA, 12 nt, Homo sapiens
uuuaaucuucca

SEQ ID NO: 1582067 - RNA, 16 nt, Homo sapiens
uuuaaugaagugcaau

SEQ ID NO: 1582068 - RNA, 11 nt, Homo sapiens
uuuaauuuugu

SEQ ID NO: 1582069 - RNA, 17 nt, Homo sapiens
uuuacacuccucuauca

SEQ ID NO: 1582070 - RNA, 14 nt, Homo sapiens
uuuacagaaaucaa

SEQ ID NO: 1582071 - RNA, 23 nt, Homo sapiens
uuuacagccagugggagauguua

SEQ ID NO: 1582072 - RNA, 11 nt, Homo sapiens
uuuacaguguu

SEQ ID NO: 1582073 - RNA, 20 nt, Homo sapiens
uuuacaguuagaaacaccag

SEQ ID NO: 1582074 - RNA, 12 nt, Homo sapiens
uuuacauuugau

SEQ ID NO: 1582075 - RNA, 20 nt, Homo sapiens
uuuaccucacacccaaagca

SEQ ID NO: 1582076 - RNA, 21 nt, Homo sapiens
uuuaccugaaauaaaauucau

SEQ ID NO: 1582077 - RNA, 22 nt, Homo sapiens
uuuaccuuucagugcaguuucu

SEQ ID NO: 1582078 - RNA, 18 nt, Homo sapiens
uuuacuaucacacaugaa

SEQ ID NO: 1582079 - RNA, 15 nt, Homo sapiens
uuuacuuaucucuca

SEQ ID NO: 1582080 - RNA, 15 nt, Homo sapiens
uuuacuuuucugcca

SEQ ID NO: 1582081 - RNA, 21 nt, Homo sapiens
uuuagaccuguguuacuaaaa

SEQ ID NO: 1582082 - RNA, 17 nt, Homo sapiens
uuuagagcguuugguua

SEQ ID NO: 1582083 - RNA, 15 nt, Homo sapiens
uuuagaugaauguca

SEQ ID NO: 1582084 - RNA, 13 nt, Homo sapiens
uuuagccauacac

SEQ ID NO: 1582085 - RNA, 13 nt, Homo sapiens
uuuaggaagcaag

SEQ ID NO: 1582086 - RNA, 17 nt, Homo sapiens
uuuaguaguuacuaaaa

SEQ ID NO: 1582087 - RNA, 13 nt, Homo sapiens
uuuaguguguaaa

SEQ ID NO: 1582088 - RNA, 20 nt, Homo sapiens
uuuaguuuuucccucaguga

SEQ ID NO: 1582089 - RNA, 16 nt, Homo sapiens
uuuauaaaacuuugaa

SEQ ID NO: 1582090 - RNA, 16 nt, Homo sapiens
uuuauaaaaguguuca

SEQ ID NO: 1582091 - RNA, 17 nt, Homo sapiens
uuuauaaagggacacuu

SEQ ID NO: 1582092 - RNA, 16 nt, Homo sapiens
uuuauaaaugauauca

SEQ ID NO: 1582093 - RNA, 21 nt, Homo sapiens
uuuauaauguauacauuacau

SEQ ID NO: 1582094 - RNA, 22 nt, Homo sapiens
uuuauaccagcuuaugagcuca

SEQ ID NO: 1582095 - RNA, 14 nt, Homo sapiens
uuuauacugcacuu

SEQ ID NO: 1582096 - RNA, 15 nt, Homo sapiens
uuuauacuuugcaau

SEQ ID NO: 1582097 - RNA, 18 nt, Homo sapiens
uuuauagaggcuagcuuc

SEQ ID NO: 1582098 - RNA, 19 nt, Homo sapiens
uuuauaggcauaccuccua

SEQ ID NO: 1582099 - RNA, 14 nt, Homo sapiens
uuuauaucugagca

SEQ ID NO: 1582100 - RNA, 16 nt, Homo sapiens
uuuauaucuggaauga

SEQ ID NO: 1582101 - RNA, 22 nt, Homo sapiens
uuuauauuguuuuuauauauua

SEQ ID NO: 1582102 - RNA, 19 nt, Homo sapiens
uuuaucaaguguauuugaa

SEQ ID NO: 1582103 - RNA, 19 nt, Homo sapiens
uuuaucacacuucugugag

SEQ ID NO: 1582104 - RNA, 12 nt, Homo sapiens
uuuaucuauggg

SEQ ID NO: 1582105 - RNA, 19 nt, Homo sapiens
uuuaucuauuagauaauca

SEQ ID NO: 1582106 - RNA, 18 nt, Homo sapiens
uuuaucuguuuccugaca

SEQ ID NO: 1582107 - RNA, 20 nt, Homo sapiens
uuuaugauggagcaacugaa

SEQ ID NO: 1582108 - RNA, 13 nt, Homo sapiens
uuuauggccucag

SEQ ID NO: 1582109 - RNA, 21 nt, Homo sapiens
uuuaugguccuaaaagcaaaa

SEQ ID NO: 1582110 - RNA, 19 nt, Homo sapiens
uuuaugugcaaaaucuguu

SEQ ID NO: 1582111 - RNA, 21 nt, Homo sapiens
uuuauguugguugauauaaca

SEQ ID NO: 1582112 - RNA, 21 nt, Homo sapiens
uuuauuccaaaugccauccag

SEQ ID NO: 1582113 - RNA, 21 nt, Homo sapiens
uuuauugucugucuacauuuc

SEQ ID NO: 1582114 - RNA, 15 nt, Homo sapiens
uuuauuucugaucua

SEQ ID NO: 1582115 - RNA, 16 nt, Homo sapiens
uuuauuuuucucauga

SEQ ID NO: 1582116 - RNA, 14 nt, Homo sapiens
uuucaaaaugauag

SEQ ID NO: 1582117 - RNA, 16 nt, Homo sapiens
uuucaaaccagcuuca

SEQ ID NO: 1582118 - RNA, 15 nt, Homo sapiens
uuucaaauuggcacu

SEQ ID NO: 1582119 - RNA, 15 nt, Homo sapiens
uuucaacgucuugcu

SEQ ID NO: 1582120 - RNA, 17 nt, Homo sapiens
uuucaacuugcaauuug

SEQ ID NO: 1582121 - RNA, 17 nt, Homo sapiens
uuucaaggcauuugucu

SEQ ID NO: 1582122 - RNA, 13 nt, Homo sapiens
uuucaagugccua

SEQ ID NO: 1582123 - RNA, 21 nt, Homo sapiens
ugggacagacggaaaugaaau

SEQ ID NO: 1582124 - RNA, 13 nt, Homo sapiens
ugggacagaggag

SEQ ID NO: 1582125 - RNA, 17 nt, Homo sapiens
ugggacuacaggcucau

SEQ ID NO: 1582126 - RNA, 18 nt, Homo sapiens
ugggagaaucacuugaac

SEQ ID NO: 1582127 - RNA, 15 nt, Homo sapiens
ugggagcuuauugcu

SEQ ID NO: 1582128 - RNA, 17 nt, Homo sapiens
ugggaggaacaaagaca

SEQ ID NO: 1582129 - RNA, 11 nt, Homo sapiens
ugggaggacag

SEQ ID NO: 1582130 - RNA, 16 nt, Homo sapiens
ugggaggaugaaggag

SEQ ID NO: 1582131 - RNA, 21 nt, Homo sapiens
ugggagggggcuugaagccaa

SEQ ID NO: 1582132 - RNA, 16 nt, Homo sapiens
ugggagguggaagaag

SEQ ID NO: 1582133 - RNA, 15 nt, Homo sapiens
ugggagucacacagu

SEQ ID NO: 1582134 - RNA, 18 nt, Homo sapiens
ugggauaacugauuucua

SEQ ID NO: 1582135 - RNA, 19 nt, Homo sapiens
ugggauaacugauuucuau

SEQ ID NO: 1582136 - RNA, 18 nt, Homo sapiens
ugggauagagaauguucc

SEQ ID NO: 1582137 - RNA, 22 nt, Homo sapiens
ugggauggggcuucacugcugu

SEQ ID NO: 1582138 - RNA, 13 nt, Homo sapiens
ugggauuacaggc

SEQ ID NO: 1582139 - RNA, 13 nt, Homo sapiens
ugggauuacaggu

SEQ ID NO: 1582140 - RNA, 16 nt, Homo sapiens
ugggauuugcugugua

SEQ ID NO: 1582141 - RNA, 13 nt, Homo sapiens
ugggcagagccca

SEQ ID NO: 1582142 - RNA, 18 nt, Homo sapiens
ugggcaggguacagacac

SEQ ID NO: 1582143 - RNA, 15 nt, Homo sapiens
ugggccacaacuguc

SEQ ID NO: 1582144 - RNA, 22 nt, Homo sapiens
ugggccacucaggggucauuca

SEQ ID NO: 1582145 - RNA, 16 nt, Homo sapiens
ugggcccuuugagugc

SEQ ID NO: 1582146 - RNA, 18 nt, Homo sapiens
ugggccuaggaugggacg

SEQ ID NO: 1582147 - RNA, 15 nt, Homo sapiens
ugggccucaguucaa

SEQ ID NO: 1582148 - RNA, 23 nt, Homo sapiens
ugggcuauugcugcugccccuua

SEQ ID NO: 1582149 - RNA, 16 nt, Homo sapiens
ugggcuccacauugca

SEQ ID NO: 1582150 - RNA, 16 nt, Homo sapiens
ugggcucccacauaag

SEQ ID NO: 1582151 - RNA, 23 nt, Homo sapiens
ugggcucugccuuaaacacacau

SEQ ID NO: 1582152 - RNA, 23 nt, Homo sapiens
ugggcucugugcagucacuggag

SEQ ID NO: 1582153 - RNA, 14 nt, Homo sapiens
ugggcugucuguca

SEQ ID NO: 1582154 - RNA, 16 nt, Homo sapiens
ugggcuugaaacauua

SEQ ID NO: 1582155 - RNA, 14 nt, Homo sapiens
ugggcuugauucug

SEQ ID NO: 1582156 - RNA, 12 nt, Homo sapiens
ugggcuuucaua

SEQ ID NO: 1582157 - RNA, 13 nt, Homo sapiens
uggggaagaacag

SEQ ID NO: 1582158 - RNA, 16 nt, Homo sapiens
uggggaagaagacaca

SEQ ID NO: 1582159 - RNA, 18 nt, Homo sapiens
uggggaagaagacacaga

SEQ ID NO: 1582160 - RNA, 22 nt, Homo sapiens
uggggaauacuggccaugccug

SEQ ID NO: 1582161 - RNA, 23 nt, Homo sapiens
uggggacggggggccccagucag

SEQ ID NO: 1582162 - RNA, 19 nt, Homo sapiens
uggggagggugucugggga

SEQ ID NO: 1582163 - RNA, 16 nt, Homo sapiens
uggggauuuucacuga

SEQ ID NO: 1582164 - RNA, 20 nt, Homo sapiens
uggggcagaaacacucaagu

SEQ ID NO: 1582165 - RNA, 17 nt, Homo sapiens
uggggcaggcugcuuca

SEQ ID NO: 1582166 - RNA, 24 nt, Homo sapiens
uggggcaggcugggccauguccaa

SEQ ID NO: 1582167 - RNA, 16 nt, Homo sapiens
uggggcaggucacuuu

SEQ ID NO: 1582168 - RNA, 22 nt, Homo sapiens
uggggcaggucacuuuaccucu

SEQ ID NO: 1582169 - RNA, 21 nt, Homo sapiens
uggggccaaacccaccugcua

SEQ ID NO: 1582170 - RNA, 15 nt, Homo sapiens
ugcuugcuccccaag

SEQ ID NO: 1582171 - RNA, 19 nt, Homo sapiens
ugcuugcuguaauguauau

SEQ ID NO: 1582172 - RNA, 14 nt, Homo sapiens
ugcuuguuauuaga

SEQ ID NO: 1582173 - RNA, 14 nt, Homo sapiens
ugcuuuauugaauu

SEQ ID NO: 1582174 - RNA, 22 nt, Homo sapiens
ugcuuuauuuucccuacuugca

SEQ ID NO: 1582175 - RNA, 14 nt, Homo sapiens
ugcuuucucucuca

SEQ ID NO: 1582176 - RNA, 13 nt, Homo sapiens
ugcuuucuguucc

SEQ ID NO: 1582177 - RNA, 15 nt, Homo sapiens
ugcuuucuguuccaa

SEQ ID NO: 1582178 - RNA, 15 nt, Homo sapiens
ugcuuugccaaaaua

SEQ ID NO: 1582179 - RNA, 21 nt, Homo sapiens
ugcuuuugguugggggcagau

SEQ ID NO: 1582180 - RNA, 16 nt, Homo sapiens
ugcuuuuuuucaggga

SEQ ID NO: 1582181 - RNA, 12 nt, Homo sapiens
uggaaaaaucac

SEQ ID NO: 1582182 - RNA, 20 nt, Homo sapiens
uggaaaaaugccaucaaaug

SEQ ID NO: 1582183 - RNA, 19 nt, Homo sapiens
uggaaaaccuccuuuacca

SEQ ID NO: 1582184 - RNA, 14 nt, Homo sapiens
uggaaaacuguguu

SEQ ID NO: 1582185 - RNA, 19 nt, Homo sapiens
uggaaaagcaacauucaua

SEQ ID NO: 1582186 - RNA, 13 nt, Homo sapiens
uggaaacaaaaca

SEQ ID NO: 1582187 - RNA, 23 nt, Homo sapiens
uggaaacacccacucacuuugca

SEQ ID NO: 1582188 - RNA, 21 nt, Homo sapiens
uggaaaccuuccacccagugc

SEQ ID NO: 1582189 - RNA, 14 nt, Homo sapiens
uggaaagucaugca

SEQ ID NO: 1582190 - RNA, 23 nt, Homo sapiens
uggaaauauuugucuucucaggc

SEQ ID NO: 1582191 - RNA, 19 nt, Homo sapiens
uggaaaucuuuuacauuuu

SEQ ID NO: 1582192 - RNA, 13 nt, Homo sapiens
uggaaaugaccag

SEQ ID NO: 1582193 - RNA, 18 nt, Homo sapiens
uggaaaugaccaggccaa

SEQ ID NO: 1582194 - RNA, 20 nt, Homo sapiens
uggaaaugguggugcuuuaa

SEQ ID NO: 1582195 - RNA, 20 nt, Homo sapiens
uggaacaccuuggggucccu

SEQ ID NO: 1582196 - RNA, 17 nt, Homo sapiens
uggaacuacauuacugu

SEQ ID NO: 1582197 - RNA, 20 nt, Homo sapiens
uggaacuuuauuuacacucc

SEQ ID NO: 1582198 - RNA, 16 nt, Homo sapiens
uggaagaaauggcuau

SEQ ID NO: 1582199 - RNA, 19 nt, Homo sapiens
uggaagaaauggcuaugaa

SEQ ID NO: 1582200 - RNA, 17 nt, Homo sapiens
uggaagaagcacugaug

SEQ ID NO: 1582201 - RNA, 17 nt, Homo sapiens
uggaagacuaucuuacu

SEQ ID NO: 1582202 - RNA, 16 nt, Homo sapiens
uggaagaggaacagca

SEQ ID NO: 1582203 - RNA, 16 nt, Homo sapiens
uggaagcccuccuucc

SEQ ID NO: 1582204 - RNA, 18 nt, Homo sapiens
uggaaggacacagugaug

SEQ ID NO: 1582205 - RNA, 21 nt, Homo sapiens
uggaaggcagcaggcauuugc

SEQ ID NO: 1582206 - RNA, 21 nt, Homo sapiens
uggaagugugugccaagagcu

SEQ ID NO: 1582207 - RNA, 16 nt, Homo sapiens
uggaaguuguugcuau

SEQ ID NO: 1582208 - RNA, 21 nt, Homo sapiens
uggaauaacauaucaaaugaa

SEQ ID NO: 1582209 - RNA, 19 nt, Homo sapiens
uggaauaauacauacuaau

SEQ ID NO: 1582210 - RNA, 19 nt, Homo sapiens
uggaauaguaaacuaaagu

SEQ ID NO: 1582211 - RNA, 21 nt, Homo sapiens
uggaauauaauuucaaaccac

SEQ ID NO: 1582212 - RNA, 18 nt, Homo sapiens
uggaauauuugcuuuaua

SEQ ID NO: 1582213 - RNA, 19 nt, Homo sapiens
uggaaucuuuguaccaaaa

SEQ ID NO: 1582214 - RNA, 16 nt, Homo sapiens
uggaaugaagguaaua

SEQ ID NO: 1582215 - RNA, 16 nt, Homo sapiens
uggaauuacagacuca

SEQ ID NO: 1582216 - RNA, 17 nt, Homo sapiens
uggaauuggagucgugu

SEQ ID NO: 1582217 - RNA, 20 nt, Homo sapiens
uggaauuugccugcugggau

SEQ ID NO: 1582218 - RNA, 23 nt, Homo sapiens
uggaauuuucucacgcaggagcc

SEQ ID NO: 1582219 - RNA, 17 nt, Homo sapiens
uggacaaggagugugac

SEQ ID NO: 1582220 - RNA, 15 nt, Homo sapiens
uggacacgagccaca

SEQ ID NO: 1582221 - RNA, 22 nt, Homo sapiens
uggacacggaucugcugggcuc

SEQ ID NO: 1582222 - RNA, 12 nt, Homo sapiens
uggacagccagu

SEQ ID NO: 1582223 - RNA, 15 nt, Homo sapiens
uggacagccagugac

SEQ ID NO: 1582224 - RNA, 21 nt, Homo sapiens
uggaccaauagggcugagcuc

SEQ ID NO: 1582225 - RNA, 21 nt, Homo sapiens
uggacccaccuguggggccug

SEQ ID NO: 1582226 - RNA, 21 nt, Homo sapiens
uggacgacauagcgagacucc

SEQ ID NO: 1582227 - RNA, 22 nt, Homo sapiens
uggacgagugcucucggcccaa

SEQ ID NO: 1582228 - RNA, 23 nt, Homo sapiens
uggacgagugcucucggcccaac

SEQ ID NO: 1582229 - RNA, 16 nt, Homo sapiens
uggacggacaagacag

SEQ ID NO: 1582230 - RNA, 23 nt, Homo sapiens
uggacuaaaugaucucugaaagu

SEQ ID NO: 1582231 - RNA, 20 nt, Homo sapiens
uggacuacacaauacaguau

SEQ ID NO: 1582232 - RNA, 16 nt, Homo sapiens
uggacuacauccugag

SEQ ID NO: 1582233 - RNA, 15 nt, Homo sapiens
uggacuaugauuauc

SEQ ID NO: 1582234 - RNA, 17 nt, Homo sapiens
uggacucagaaagccaa

SEQ ID NO: 1582235 - RNA, 16 nt, Homo sapiens
uggacuuaacuaguua

SEQ ID NO: 1582236 - RNA, 15 nt, Homo sapiens
uggagaaacaagaca

SEQ ID NO: 1582237 - RNA, 16 nt, Homo sapiens
uggagaaccagggcuc

SEQ ID NO: 1582238 - RNA, 20 nt, Homo sapiens
uggagacaaggugcuaacau

SEQ ID NO: 1582239 - RNA, 16 nt, Homo sapiens
uggagaccagccagag

SEQ ID NO: 1582240 - RNA, 19 nt, Homo sapiens
uggagacccugccacagcc

SEQ ID NO: 1582241 - RNA, 22 nt, Homo sapiens
uggagacccugccacagccaga

SEQ ID NO: 1582242 - RNA, 15 nt, Homo sapiens
uggagaccucuccuu

SEQ ID NO: 1582243 - RNA, 15 nt, Homo sapiens
uggagaccuuucuag

SEQ ID NO: 1582244 - RNA, 15 nt, Homo sapiens
uggagagcacaccua

SEQ ID NO: 1582245 - RNA, 22 nt, Homo sapiens
uggagagcacaccuaucuuagu

SEQ ID NO: 1582246 - RNA, 19 nt, Homo sapiens
uggagagcuagaaccugga

SEQ ID NO: 1582247 - RNA, 23 nt, Homo sapiens
uggagagucagaucuuucuccuu

SEQ ID NO: 1582248 - RNA, 17 nt, Homo sapiens
uggagagugcacaugcc

SEQ ID NO: 1582249 - RNA, 19 nt, Homo sapiens
uggagaugcagcuacugga

SEQ ID NO: 1582250 - RNA, 19 nt, Homo sapiens
uggagauuggcaugccauu

SEQ ID NO: 1582251 - RNA, 17 nt, Homo sapiens
uggagcaaacagcugua

SEQ ID NO: 1582252 - RNA, 16 nt, Homo sapiens
uggagcaaauguccua

SEQ ID NO: 1582253 - RNA, 19 nt, Homo sapiens
uggagcaggagccccgcca

SEQ ID NO: 1582254 - RNA, 19 nt, Homo sapiens
uggagcgccacacacugca

SEQ ID NO: 1582255 - RNA, 21 nt, Homo sapiens
uggagcuaauggcgaucaucu

SEQ ID NO: 1582256 - RNA, 14 nt, Homo sapiens
uggagcugggcuaa

SEQ ID NO: 1582257 - RNA, 15 nt, Homo sapiens
uggaggaaugacaau

SEQ ID NO: 1582258 - RNA, 21 nt, Homo sapiens
uggaggaccuggcgugcucag

SEQ ID NO: 1582259 - RNA, 19 nt, Homo sapiens
uggaggaggaaggcaagag

SEQ ID NO: 1582260 - RNA, 19 nt, Homo sapiens
uggaggaucaaagaacuga

SEQ ID NO: 1582261 - RNA, 15 nt, Homo sapiens
uggagggcaagcccu

SEQ ID NO: 1582262 - RNA, 19 nt, Homo sapiens
uggagggcuagaaucugga

SEQ ID NO: 1582263 - RNA, 11 nt, Homo sapiens
uggaggggugu

SEQ ID NO: 1582264 - RNA, 23 nt, Homo sapiens
uggagguggaaaagcaacauuca

SEQ ID NO: 1582265 - RNA, 15 nt, Homo sapiens
uggagucacuguagu

SEQ ID NO: 1582266 - RNA, 16 nt, Homo sapiens
uggagugcucucucag

SEQ ID NO: 1582267 - RNA, 19 nt, Homo sapiens
uggaguguuauguauuucc

SEQ ID NO: 1582268 - RNA, 15 nt, Homo sapiens
uggaguuucucuguu

SEQ ID NO: 1582269 - RNA, 15 nt, Homo sapiens
uggauaaauagauac

SEQ ID NO: 1582270 - RNA, 21 nt, Homo sapiens
uggauaaauagauaccacuga

SEQ ID NO: 1582271 - RNA, 13 nt, Homo sapiens
uggauaaauugca

SEQ ID NO: 1582272 - RNA, 22 nt, Homo sapiens
uggauauuaaaaaucuguaaau

SEQ ID NO: 1582273 - RNA, 13 nt, Homo sapiens
uggauauucauuc

SEQ ID NO: 1582274 - RNA, 18 nt, Homo sapiens
uggauauuuuuuacuuua

SEQ ID NO: 1582275 - RNA, 14 nt, Homo sapiens
uggaucaaguauua

SEQ ID NO: 1582276 - RNA, 13 nt, Homo sapiens
uggauccacuuuu

SEQ ID NO: 1582277 - RNA, 19 nt, Homo sapiens
uggauccagccaugccuga

SEQ ID NO: 1582278 - RNA, 14 nt, Homo sapiens
uggaucuaccagca

SEQ ID NO: 1582279 - RNA, 17 nt, Homo sapiens
uggaugcaucacacuca

SEQ ID NO: 1582280 - RNA, 14 nt, Homo sapiens
uggaugcauuucaa

SEQ ID NO: 1582281 - RNA, 11 nt, Homo sapiens
uggaugccuug

SEQ ID NO: 1582282 - RNA, 18 nt, Homo sapiens
uggaugccuugaauaaua

SEQ ID NO: 1582283 - RNA, 15 nt, Homo sapiens
uggauguaaugcacu

SEQ ID NO: 1582284 - RNA, 15 nt, Homo sapiens
uggauucucauugcc

SEQ ID NO: 1582285 - RNA, 17 nt, Homo sapiens
uggauugccaguuacau

SEQ ID NO: 1582286 - RNA, 13 nt, Homo sapiens
uggauugugcuuu

SEQ ID NO: 1582287 - RNA, 23 nt, Homo sapiens
uggcaaaacaaaaguacauugcu

SEQ ID NO: 1582288 - RNA, 15 nt, Homo sapiens
ugccuaccuggguca

SEQ ID NO: 1582289 - RNA, 15 nt, Homo sapiens
ugccuagacuguuac

SEQ ID NO: 1582290 - RNA, 16 nt, Homo sapiens
ugccuagacuguuacu

SEQ ID NO: 1582291 - RNA, 16 nt, Homo sapiens
ugccuaucugaccaaa

SEQ ID NO: 1582292 - RNA, 16 nt, Homo sapiens
ugccucagccuuccaa

SEQ ID NO: 1582293 - RNA, 23 nt, Homo sapiens
ugccucauuaucuugcagcugua

SEQ ID NO: 1582294 - RNA, 14 nt, Homo sapiens
ugccucauuucccu

SEQ ID NO: 1582295 - RNA, 22 nt, Homo sapiens
ugccucccaagguccucucagu

SEQ ID NO: 1582296 - RNA, 20 nt, Homo sapiens
ugccucccggguucaagcaa

SEQ ID NO: 1582297 - RNA, 23 nt, Homo sapiens
ugccucccuggcagcacaggaaa

SEQ ID NO: 1582298 - RNA, 17 nt, Homo sapiens
ugccuccugaggcuguu

SEQ ID NO: 1582299 - RNA, 18 nt, Homo sapiens
ugccucuaagcugcucua

SEQ ID NO: 1582300 - RNA, 22 nt, Homo sapiens
ugccucuccugggacaaccaga

SEQ ID NO: 1582301 - RNA, 14 nt, Homo sapiens
ugccucuucuacuu

SEQ ID NO: 1582302 - RNA, 15 nt, Homo sapiens
ugccucuucuuugug

SEQ ID NO: 1582303 - RNA, 15 nt, Homo sapiens
ugccugaaaguaaua

SEQ ID NO: 1582304 - RNA, 17 nt, Homo sapiens
ugccugcccugccucag

SEQ ID NO: 1582305 - RNA, 19 nt, Homo sapiens
ugccugguuuuauuuauau

SEQ ID NO: 1582306 - RNA, 16 nt, Homo sapiens
ugccuguaacuugaga

SEQ ID NO: 1582307 - RNA, 14 nt, Homo sapiens
ugccuguaaucuca

SEQ ID NO: 1582308 - RNA, 22 nt, Homo sapiens
ugccuguaaucucagcacuuug

SEQ ID NO: 1582309 - RNA, 16 nt, Homo sapiens
ugccugucugcuugca

SEQ ID NO: 1582310 - RNA, 21 nt, Homo sapiens
ugccuguuaaggaaacuuuau

SEQ ID NO: 1582311 - RNA, 14 nt, Homo sapiens
ugccuuauuaccca

SEQ ID NO: 1582312 - RNA, 20 nt, Homo sapiens
ugccuucaucuucacugcaa

SEQ ID NO: 1582313 - RNA, 20 nt, Homo sapiens
ugccuuccucaguauccaca

SEQ ID NO: 1582314 - RNA, 14 nt, Homo sapiens
ugccuucucaugau

SEQ ID NO: 1582315 - RNA, 18 nt, Homo sapiens
ugccuucuguggggacuc

SEQ ID NO: 1582316 - RNA, 15 nt, Homo sapiens
ugccuuuaaauauaa

SEQ ID NO: 1582317 - RNA, 16 nt, Homo sapiens
ugccuuuugcaaccag

SEQ ID NO: 1582318 - RNA, 18 nt, Homo sapiens
ugccuuuuuuaacuugag

SEQ ID NO: 1582319 - RNA, 21 nt, Homo sapiens
ugcgagacgcacacagcugag

SEQ ID NO: 1582320 - RNA, 20 nt, Homo sapiens
ugcgcagucauuggcccaac

SEQ ID NO: 1582321 - RNA, 21 nt, Homo sapiens
ugcgcccaccccgcucugcau

SEQ ID NO: 1582322 - RNA, 13 nt, Homo sapiens
ugcgcucaggggc

SEQ ID NO: 1582323 - RNA, 15 nt, Homo sapiens
ugcggagacccugag

SEQ ID NO: 1582324 - RNA, 19 nt, Homo sapiens
ugcguagaagauauggaag

SEQ ID NO: 1582325 - RNA, 13 nt, Homo sapiens
ugcgugaagacca

SEQ ID NO: 1582326 - RNA, 14 nt, Homo sapiens
ugcgugaagaccaa

SEQ ID NO: 1582327 - RNA, 11 nt, Homo sapiens
ugcgugccugc

SEQ ID NO: 1582328 - RNA, 13 nt, Homo sapiens
ugcgugggggcca

SEQ ID NO: 1582329 - RNA, 12 nt, Homo sapiens
ugcuaaagacau

SEQ ID NO: 1582330 - RNA, 16 nt, Homo sapiens
ugcuaacauagauuua

SEQ ID NO: 1582331 - RNA, 16 nt, Homo sapiens
ugcuaagacuaacuca

SEQ ID NO: 1582332 - RNA, 22 nt, Homo sapiens
ugcuaagcaagcuaaccuuauc

SEQ ID NO: 1582333 - RNA, 19 nt, Homo sapiens
ugcuaaggcagcugaucca

SEQ ID NO: 1582334 - RNA, 12 nt, Homo sapiens
ugcuaauguugc

SEQ ID NO: 1582335 - RNA, 12 nt, Homo sapiens
ugcuacauauau

SEQ ID NO: 1582336 - RNA, 18 nt, Homo sapiens
ugcuacauucuaaugcau

SEQ ID NO: 1582337 - RNA, 17 nt, Homo sapiens
ugcuaccaaaacaguua

SEQ ID NO: 1582338 - RNA, 17 nt, Homo sapiens
ugcuacccucauuucac

SEQ ID NO: 1582339 - RNA, 22 nt, Homo sapiens
ugcuacgcuccagcugauccag

SEQ ID NO: 1582340 - RNA, 18 nt, Homo sapiens
ugcuagaaaaauguucuu

SEQ ID NO: 1582341 - RNA, 20 nt, Homo sapiens
ugcuaggcgcuggggagacu

SEQ ID NO: 1582342 - RNA, 14 nt, Homo sapiens
ugcuagugugaauu

SEQ ID NO: 1582343 - RNA, 16 nt, Homo sapiens
ugcuauaguauuugau

SEQ ID NO: 1582344 - RNA, 21 nt, Homo sapiens
ugcuauuguagagccagaggu

SEQ ID NO: 1582345 - RNA, 16 nt, Homo sapiens
ugcuauuuaacauuuu

SEQ ID NO: 1582346 - RNA, 22 nt, Homo sapiens
ugcucaacaauuuauccauuca

SEQ ID NO: 1582347 - RNA, 22 nt, Homo sapiens
ugcucacgucaaaugcauacaa

SEQ ID NO: 1582348 - RNA, 20 nt, Homo sapiens
ugcucagagaaggaaaagac

SEQ ID NO: 1582349 - RNA, 13 nt, Homo sapiens
ugcucagcacaua

SEQ ID NO: 1582350 - RNA, 12 nt, Homo sapiens
ugcucaggauaa

SEQ ID NO: 1582351 - RNA, 17 nt, Homo sapiens
ugcucauauugugauuc

SEQ ID NO: 1582352 - RNA, 16 nt, Homo sapiens
ugcucauguaccucug

SEQ ID NO: 1582353 - RNA, 18 nt, Homo sapiens
ugcuccaggccugcauua

SEQ ID NO: 1582354 - RNA, 16 nt, Homo sapiens
ugcucccaguccugcc

SEQ ID NO: 1582355 - RNA, 20 nt, Homo sapiens
ugcuccgaggacccaggaaa

SEQ ID NO: 1582356 - RNA, 16 nt, Homo sapiens
ugcuccuccuacccuu

SEQ ID NO: 1582357 - RNA, 14 nt, Homo sapiens
ugcucgcugagaaa

SEQ ID NO: 1582358 - RNA, 17 nt, Homo sapiens
ugcucucaacaggacuu

SEQ ID NO: 1582359 - RNA, 23 nt, Homo sapiens
ugcucugguuguuucuguuccaa

SEQ ID NO: 1582360 - RNA, 21 nt, Homo sapiens
ugcucuguaggagcuacccuu

SEQ ID NO: 1582361 - RNA, 14 nt, Homo sapiens
ugcucuguuaccca

SEQ ID NO: 1582362 - RNA, 23 nt, Homo sapiens
ugcucuuacccauuuuuuuuacc

SEQ ID NO: 1582363 - RNA, 20 nt, Homo sapiens
ugcucuuaucuuucuugacu

SEQ ID NO: 1582364 - RNA, 21 nt, Homo sapiens
ugcugaaggagaaaaagacag

SEQ ID NO: 1582365 - RNA, 11 nt, Homo sapiens
uccucagggag

SEQ ID NO: 1582366 - RNA, 15 nt, Homo sapiens
uccucaugucaucaa

SEQ ID NO: 1582367 - RNA, 15 nt, Homo sapiens
uccuccacaaauuau

SEQ ID NO: 1582368 - RNA, 20 nt, Homo sapiens
uccuccagaagccucuggcu

SEQ ID NO: 1582369 - RNA, 12 nt, Homo sapiens
uccuccagacaa

SEQ ID NO: 1582370 - RNA, 20 nt, Homo sapiens
uccuccccccuccucugaaa

SEQ ID NO: 1582371 - RNA, 18 nt, Homo sapiens
uccuccccuguucauucu

SEQ ID NO: 1582372 - RNA, 11 nt, Homo sapiens
uccucccucaa

SEQ ID NO: 1582373 - RNA, 13 nt, Homo sapiens
uccucccucagac

SEQ ID NO: 1582374 - RNA, 20 nt, Homo sapiens
uccucccuuccuuuucccug

SEQ ID NO: 1582375 - RNA, 10 nt, Homo sapiens
uccuccucag

SEQ ID NO: 1582376 - RNA, 14 nt, Homo sapiens
uccucgagaggcac

SEQ ID NO: 1582377 - RNA, 18 nt, Homo sapiens
uccucgagaucccaacac

SEQ ID NO: 1582378 - RNA, 19 nt, Homo sapiens
uccucucgagcccagaugg

SEQ ID NO: 1582379 - RNA, 21 nt, Homo sapiens
uccucugaaacagcugccuua

SEQ ID NO: 1582380 - RNA, 15 nt, Homo sapiens
uccucugcauuuaca

SEQ ID NO: 1582381 - RNA, 16 nt, Homo sapiens
uccucuguaaacuuuu

SEQ ID NO: 1582382 - RNA, 16 nt, Homo sapiens
uccucugugaccaaug

SEQ ID NO: 1582383 - RNA, 19 nt, Homo sapiens
uccucugugaccaaugucu

SEQ ID NO: 1582384 - RNA, 12 nt, Homo sapiens
uccucugugauu

SEQ ID NO: 1582385 - RNA, 17 nt, Homo sapiens
uccugaaagcauuauuu

SEQ ID NO: 1582386 - RNA, 17 nt, Homo sapiens
uccugaaguugcugcug

SEQ ID NO: 1582387 - RNA, 19 nt, Homo sapiens
uccugaauccaaacuaauc

SEQ ID NO: 1582388 - RNA, 20 nt, Homo sapiens
uccugacugaaaguaggggg

SEQ ID NO: 1582389 - RNA, 23 nt, Homo sapiens
uccugaggcuuuggauuugacau

SEQ ID NO: 1582390 - RNA, 12 nt, Homo sapiens
uccugaguuucu

SEQ ID NO: 1582391 - RNA, 16 nt, Homo sapiens
uccugauauaacacuu

SEQ ID NO: 1582392 - RNA, 21 nt, Homo sapiens
uccugaugaggagaaaggggc

SEQ ID NO: 1582393 - RNA, 18 nt, Homo sapiens
uccugauggaacuaagga

SEQ ID NO: 1582394 - RNA, 21 nt, Homo sapiens
uccugcacagaucgauaccuu

SEQ ID NO: 1582395 - RNA, 12 nt, Homo sapiens
uccugcagacac

SEQ ID NO: 1582396 - RNA, 14 nt, Homo sapiens
uccugccacaugga

SEQ ID NO: 1582397 - RNA, 19 nt, Homo sapiens
uccugcccaaaaugugaag

SEQ ID NO: 1582398 - RNA, 18 nt, Homo sapiens
ucccauuaaagagccagu

SEQ ID NO: 1582399 - RNA, 22 nt, Homo sapiens
ucccauuaaagagccaguuuau

SEQ ID NO: 1582400 - RNA, 23 nt, Homo sapiens
ucccauuaaagagccaguuuauu

SEQ ID NO: 1582401 - RNA, 19 nt, Homo sapiens
uccccaaagcuuuaucugu

SEQ ID NO: 1582402 - RNA, 13 nt, Homo sapiens
uccccaagcaccu

SEQ ID NO: 1582403 - RNA, 17 nt, Homo sapiens
uccccaagcaccuuccc

SEQ ID NO: 1582404 - RNA, 17 nt, Homo sapiens
uccccaauaaagccuuu

SEQ ID NO: 1582405 - RNA, 15 nt, Homo sapiens
uccccacaccucccu

SEQ ID NO: 1582406 - RNA, 19 nt, Homo sapiens
uccccacccagucucaugu

SEQ ID NO: 1582407 - RNA, 12 nt, Homo sapiens
uccccacugugc

SEQ ID NO: 1582408 - RNA, 22 nt, Homo sapiens
uccccagccccuccucccucag

SEQ ID NO: 1582409 - RNA, 20 nt, Homo sapiens
uccccagggugucucuauga

SEQ ID NO: 1582410 - RNA, 13 nt, Homo sapiens
uccccagucccag

SEQ ID NO: 1582411 - RNA, 17 nt, Homo sapiens
uccccagucccagacaa

SEQ ID NO: 1582412 - RNA, 19 nt, Homo sapiens
uccccauucucugccugua

SEQ ID NO: 1582413 - RNA, 12 nt, Homo sapiens
ucccccacugau

SEQ ID NO: 1582414 - RNA, 22 nt, Homo sapiens
ucccccagaugcagggcugcag

SEQ ID NO: 1582415 - RNA, 19 nt, Homo sapiens
ucccccuuucacacuggau

SEQ ID NO: 1582416 - RNA, 18 nt, Homo sapiens
ucccccuuugugcacauu

SEQ ID NO: 1582417 - RNA, 16 nt, Homo sapiens
uccccuagucacucau

SEQ ID NO: 1582418 - RNA, 14 nt, Homo sapiens
uccccucagauucc

SEQ ID NO: 1582419 - RNA, 22 nt, Homo sapiens
uccccucagggauacgacacau

SEQ ID NO: 1582420 - RNA, 16 nt, Homo sapiens
uccccuccaaccuggg

SEQ ID NO: 1582421 - RNA, 22 nt, Homo sapiens
uccccucccuggcucccaugac

SEQ ID NO: 1582422 - RNA, 17 nt, Homo sapiens
uccccucccuguauaag

SEQ ID NO: 1582423 - RNA, 13 nt, Homo sapiens
uccccucggagaa

SEQ ID NO: 1582424 - RNA, 23 nt, Homo sapiens
uccccugcagacggaugcccauu

SEQ ID NO: 1582425 - RNA, 22 nt, Homo sapiens
uccccuggggacgccaaggagg

SEQ ID NO: 1582426 - RNA, 18 nt, Homo sapiens
uccccuuccccugcugac

SEQ ID NO: 1582427 - RNA, 14 nt, Homo sapiens
uccccuucucucau

SEQ ID NO: 1582428 - RNA, 13 nt, Homo sapiens
uccccuugucugc

SEQ ID NO: 1582429 - RNA, 13 nt, Homo sapiens
ucccgaccucagg

SEQ ID NO: 1582430 - RNA, 14 nt, Homo sapiens
ucccgccaugcuca

SEQ ID NO: 1582431 - RNA, 17 nt, Homo sapiens
uuccaauaaaacuuuau

SEQ ID NO: 1582432 - RNA, 17 nt, Homo sapiens
uuccaauuuuguugcau

SEQ ID NO: 1582433 - RNA, 12 nt, Homo sapiens
uuccacaagaca

SEQ ID NO: 1582434 - RNA, 16 nt, Homo sapiens
uuccacagauuaucaa

SEQ ID NO: 1582435 - RNA, 19 nt, Homo sapiens
uuccaccaaaugugcuuug

SEQ ID NO: 1582436 - RNA, 18 nt, Homo sapiens
uuccaccuagagcuagau

SEQ ID NO: 1582437 - RNA, 13 nt, Homo sapiens
uuccacugaaaau

SEQ ID NO: 1582438 - RNA, 16 nt, Homo sapiens
uuccacugucuuucaa

SEQ ID NO: 1582439 - RNA, 13 nt, Homo sapiens
uuccagacauucu

SEQ ID NO: 1582440 - RNA, 15 nt, Homo sapiens
uuccagacuuugaaa

SEQ ID NO: 1582441 - RNA, 14 nt, Homo sapiens
uuccagauuacaaa

SEQ ID NO: 1582442 - RNA, 21 nt, Homo sapiens
uuccagcauuuuuauaaacua

SEQ ID NO: 1582443 - RNA, 15 nt, Homo sapiens
uuccagccaggguga

SEQ ID NO: 1582444 - RNA, 23 nt, Homo sapiens
uuccaggaguucugaagcugaca

SEQ ID NO: 1582445 - RNA, 22 nt, Homo sapiens
uuccagguagcucggcaccaac

SEQ ID NO: 1582446 - RNA, 17 nt, Homo sapiens
uuccauaugucuauaac

SEQ ID NO: 1582447 - RNA, 23 nt, Homo sapiens
uuccauauuuauacagcagagaa

SEQ ID NO: 1582448 - RNA, 19 nt, Homo sapiens
uuccaugagaagaagcaga

SEQ ID NO: 1582449 - RNA, 14 nt, Homo sapiens
uuccaugugccuuu

SEQ ID NO: 1582450 - RNA, 23 nt, Homo sapiens
uuccauuuuuauuucaaaauaua

SEQ ID NO: 1582451 - RNA, 12 nt, Homo sapiens
uucccaaaaaca

SEQ ID NO: 1582452 - RNA, 17 nt, Homo sapiens
uucccaaucaucuggcu

SEQ ID NO: 1582453 - RNA, 16 nt, Homo sapiens
uucccacaggacauuu

SEQ ID NO: 1582454 - RNA, 11 nt, Homo sapiens
uucccaccacc

SEQ ID NO: 1582455 - RNA, 20 nt, Homo sapiens
uucccacgucuaacuggaaa

SEQ ID NO: 1582456 - RNA, 19 nt, Homo sapiens
uucccagagauguugagaa

SEQ ID NO: 1582457 - RNA, 22 nt, Homo sapiens
uucccagccccuccucccucag

SEQ ID NO: 1582458 - RNA, 23 nt, Homo sapiens
uucccaucacuggagcaccaggc

SEQ ID NO: 1582459 - RNA, 17 nt, Homo sapiens
uucccaucugcaccccu

SEQ ID NO: 1582460 - RNA, 16 nt, Homo sapiens
uucccauuaaagaagu

SEQ ID NO: 1582461 - RNA, 17 nt, Homo sapiens
uucccauucuacauacu

SEQ ID NO: 1582462 - RNA, 20 nt, Homo sapiens
uucccauuguggcuccuauc

SEQ ID NO: 1582463 - RNA, 22 nt, Homo sapiens
uuccccagacccagagguccag

SEQ ID NO: 1582464 - RNA, 18 nt, Homo sapiens
uuccccaucccaaggcaa

SEQ ID NO: 1582465 - RNA, 20 nt, Homo sapiens
uuccccuaguaagugccuuc

SEQ ID NO: 1582466 - RNA, 21 nt, Homo sapiens
uucccgacgacacauauacau

SEQ ID NO: 1582467 - RNA, 20 nt, Homo sapiens
uucccucagccuaagaaaca

SEQ ID NO: 1582468 - RNA, 13 nt, Homo sapiens
uucccuccccaga

SEQ ID NO: 1582469 - RNA, 13 nt, Homo sapiens
uucccucccuauc

SEQ ID NO: 1582470 - RNA, 19 nt, Homo sapiens
uucccucucaugacuugca

SEQ ID NO: 1582471 - RNA, 13 nt, Homo sapiens
uucccugagucac

SEQ ID NO: 1582472 - RNA, 20 nt, Homo sapiens
uucccugucagccugacucu

SEQ ID NO: 1582473 - RNA, 19 nt, Homo sapiens
uucccuuagccucucccac

SEQ ID NO: 1582474 - RNA, 18 nt, Homo sapiens
uucccuuguagaaaguga

SEQ ID NO: 1582475 - RNA, 19 nt, Homo sapiens
uucccuuuuguauucucuu

SEQ ID NO: 1582476 - RNA, 21 nt, Homo sapiens
uuccggccuccugucccucau

SEQ ID NO: 1582477 - RNA, 20 nt, Homo sapiens
uuccuaauaagugaagggaa

SEQ ID NO: 1582478 - RNA, 22 nt, Homo sapiens
uuccuagauuacaucugccuua

SEQ ID NO: 1582479 - RNA, 13 nt, Homo sapiens
uuccucaccaagc

SEQ ID NO: 1582480 - RNA, 18 nt, Homo sapiens
uuccucaccaagcucaac

SEQ ID NO: 1582481 - RNA, 20 nt, Homo sapiens
uuccucagggacagagacac

SEQ ID NO: 1582482 - RNA, 19 nt, Homo sapiens
uuccucaugaaucucucaa

SEQ ID NO: 1582483 - RNA, 18 nt, Homo sapiens
uuccuccagagacacuga

SEQ ID NO: 1582484 - RNA, 14 nt, Homo sapiens
uuccucccagugag

SEQ ID NO: 1582485 - RNA, 20 nt, Homo sapiens
uuccuccccagucggcugaa

SEQ ID NO: 1582486 - RNA, 16 nt, Homo sapiens
uuccuccccuguucau

SEQ ID NO: 1582487 - RNA, 20 nt, Homo sapiens
uuccuccucaggcacacagc

SEQ ID NO: 1582488 - RNA, 11 nt, Homo sapiens
uuccucugcau

SEQ ID NO: 1582489 - RNA, 14 nt, Homo sapiens
uuccucuuacugua

SEQ ID NO: 1582490 - RNA, 18 nt, Homo sapiens
uuccucuuggugucauau

SEQ ID NO: 1582491 - RNA, 18 nt, Homo sapiens
uuccugaaaauugcaaua

SEQ ID NO: 1582492 - RNA, 15 nt, Homo sapiens
uuccugaagcugcug

SEQ ID NO: 1582493 - RNA, 22 nt, Homo sapiens
uuccugagggcuaauucuggga

SEQ ID NO: 1582494 - RNA, 16 nt, Homo sapiens
uuccugauaacauuau

SEQ ID NO: 1582495 - RNA, 12 nt, Homo sapiens
uuccuucacuca

SEQ ID NO: 1582496 - RNA, 14 nt, Homo sapiens
uuccuucacucauc

SEQ ID NO: 1582497 - RNA, 19 nt, Homo sapiens
uuccuucauuuccaccagg

SEQ ID NO: 1582498 - RNA, 22 nt, Homo sapiens
uuccuucuguacuaaaguauug

SEQ ID NO: 1582499 - RNA, 20 nt, Homo sapiens
uuccuucuugacauuuauca

SEQ ID NO: 1582500 - RNA, 18 nt, Homo sapiens
uuccuuggccaugcagaa

SEQ ID NO: 1582501 - RNA, 14 nt, Homo sapiens
uuccuugucccagg

SEQ ID NO: 1582502 - RNA, 17 nt, Homo sapiens
uuccuugugguuagcaa

SEQ ID NO: 1582503 - RNA, 16 nt, Homo sapiens
uuccuuuuagggaaua

SEQ ID NO: 1582504 - RNA, 15 nt, Homo sapiens
uuccuuuuucugggu

SEQ ID NO: 1582505 - RNA, 19 nt, Homo sapiens
uuccuuuuugacacugaaa

SEQ ID NO: 1582506 - RNA, 15 nt, Homo sapiens
uucgaagccacagag

SEQ ID NO: 1582507 - RNA, 19 nt, Homo sapiens
uucgaagucaucauuccuc

SEQ ID NO: 1582508 - RNA, 18 nt, Homo sapiens
uucgaccgacuuucccca

SEQ ID NO: 1582509 - RNA, 15 nt, Homo sapiens
uucgcucgugcagua

SEQ ID NO: 1582510 - RNA, 19 nt, Homo sapiens
uucggaagggguuccucaa

SEQ ID NO: 1582511 - RNA, 17 nt, Homo sapiens
uucggacaaaauaucuc

SEQ ID NO: 1582512 - RNA, 19 nt, Homo sapiens
uucggagugaauguggcag

SEQ ID NO: 1582513 - RNA, 14 nt, Homo sapiens
uucguaagaaggaa

SEQ ID NO: 1582514 - RNA, 20 nt, Homo sapiens
uucuaaaaauaaaaguauug

SEQ ID NO: 1582515 - RNA, 15 nt, Homo sapiens
uucuaaagcuaguaa

SEQ ID NO: 1582516 - RNA, 18 nt, Homo sapiens
uucuaaauaaauuuccca

SEQ ID NO: 1582517 - RNA, 23 nt, Homo sapiens
uucuaacccaagacaugacauuc

SEQ ID NO: 1582518 - RNA, 13 nt, Homo sapiens
uucuaacccugac

SEQ ID NO: 1582519 - RNA, 20 nt, Homo sapiens
uucuaacucauauguuccca

SEQ ID NO: 1582520 - RNA, 16 nt, Homo sapiens
uucuaacugcuguuaa

SEQ ID NO: 1582521 - RNA, 19 nt, Homo sapiens
uucuaagaaauaucuguga

SEQ ID NO: 1582522 - RNA, 19 nt, Homo sapiens
uucuaaguaaaaccacagc

SEQ ID NO: 1582523 - RNA, 17 nt, Homo sapiens
uucuaagucauucauaa

SEQ ID NO: 1582524 - RNA, 19 nt, Homo sapiens
uucuaauccuuuuccuuau

SEQ ID NO: 1582525 - RNA, 17 nt, Homo sapiens
uucuaauguuuacuaua

SEQ ID NO: 1582526 - RNA, 15 nt, Homo sapiens
uucuaauuaaccuua

SEQ ID NO: 1582527 - RNA, 15 nt, Homo sapiens
uucuacaguguccua

SEQ ID NO: 1582528 - RNA, 13 nt, Homo sapiens
uucuaccugcccu

SEQ ID NO: 1582529 - RNA, 22 nt, Homo sapiens
uucuacuuuaauauaaacccau

SEQ ID NO: 1582530 - RNA, 16 nt, Homo sapiens
uucuaggcucacugca

SEQ ID NO: 1582531 - RNA, 20 nt, Homo sapiens
uucuagugcuuuucagugau

SEQ ID NO: 1582532 - RNA, 24 nt, Homo sapiens
uucuaguuuugucaaacuguagaa

SEQ ID NO: 1582533 - RNA, 15 nt, Homo sapiens
uucuauaaggccaua

SEQ ID NO: 1582534 - RNA, 19 nt, Homo sapiens
uucuauccuuuugccugca

SEQ ID NO: 1582535 - RNA, 12 nt, Homo sapiens
uucuaugagcau

SEQ ID NO: 1582536 - RNA, 12 nt, Homo sapiens
uucuauggauuc

SEQ ID NO: 1582537 - RNA, 16 nt, Homo sapiens
uucuauggauucacuu

SEQ ID NO: 1582538 - RNA, 18 nt, Homo sapiens
uucuauggauucacuucu

SEQ ID NO: 1582539 - RNA, 21 nt, Homo sapiens
uucuauggguuggacaaccuc

SEQ ID NO: 1582540 - RNA, 19 nt, Homo sapiens
uucucacaaugucccuuca

SEQ ID NO: 1582541 - RNA, 19 nt, Homo sapiens
uucucacccaggcaaucuu

SEQ ID NO: 1582542 - RNA, 23 nt, Homo sapiens
uucucacccaggcaaucuugccu

SEQ ID NO: 1582543 - RNA, 20 nt, Homo sapiens
uucucacgcuuuguuuacuc

SEQ ID NO: 1582544 - RNA, 23 nt, Homo sapiens
uucucauaauuccuacagcacua

SEQ ID NO: 1582545 - RNA, 22 nt, Homo sapiens
uucucauuaaaguuguuuccca

SEQ ID NO: 1582546 - RNA, 14 nt, Homo sapiens
uucucauuucaccc

SEQ ID NO: 1582547 - RNA, 22 nt, Homo sapiens
uucuccagggguuuacagugaa

SEQ ID NO: 1582548 - RNA, 17 nt, Homo sapiens
uucucccaagcccacgu

SEQ ID NO: 1582549 - RNA, 24 nt, Homo sapiens
uuaugucuggggcagaaacacuca

SEQ ID NO: 1582550 - RNA, 12 nt, Homo sapiens
uuaugugaagaa

SEQ ID NO: 1582551 - RNA, 13 nt, Homo sapiens
uuaugugagauac

SEQ ID NO: 1582552 - RNA, 12 nt, Homo sapiens
uuaugugcuaua

SEQ ID NO: 1582553 - RNA, 19 nt, Homo sapiens
uuaugugugaggagcugcu

SEQ ID NO: 1582554 - RNA, 20 nt, Homo sapiens
uuauguguuaugaacaucca

SEQ ID NO: 1582555 - RNA, 23 nt, Homo sapiens
uuauguuaaaucaauaaagacca

SEQ ID NO: 1582556 - RNA, 13 nt, Homo sapiens
uuauuaaaauucu

SEQ ID NO: 1582557 - RNA, 19 nt, Homo sapiens
uuauuaaaguacaaccaua

SEQ ID NO: 1582558 - RNA, 22 nt, Homo sapiens
uuauuaaauguagcuucaguca

SEQ ID NO: 1582559 - RNA, 12 nt, Homo sapiens
uuauuaaucuga

SEQ ID NO: 1582560 - RNA, 14 nt, Homo sapiens
uuauuaaugccauu

SEQ ID NO: 1582561 - RNA, 15 nt, Homo sapiens
uuauuacaauguauc

SEQ ID NO: 1582562 - RNA, 13 nt, Homo sapiens
uuauuacauguaa

SEQ ID NO: 1582563 - RNA, 18 nt, Homo sapiens
uuauuagaacauucacuu

SEQ ID NO: 1582564 - RNA, 17 nt, Homo sapiens
uuauuaggcucagugac

SEQ ID NO: 1582565 - RNA, 14 nt, Homo sapiens
uuauuauacaccuu

SEQ ID NO: 1582566 - RNA, 22 nt, Homo sapiens
uuauucauuuggugacugugua

SEQ ID NO: 1582567 - RNA, 17 nt, Homo sapiens
uuauuccuccugcucau

SEQ ID NO: 1582568 - RNA, 13 nt, Homo sapiens
uuauuccuuugaa

SEQ ID NO: 1582569 - RNA, 15 nt, Homo sapiens
uuauugaaugugauu

SEQ ID NO: 1582570 - RNA, 21 nt, Homo sapiens
uuauugauauuuaauuaugaa

SEQ ID NO: 1582571 - RNA, 20 nt, Homo sapiens
uuauugcaauaaaguauaau

SEQ ID NO: 1582572 - RNA, 13 nt, Homo sapiens
uuauugcaguuua

SEQ ID NO: 1582573 - RNA, 19 nt, Homo sapiens
uuauuggcugagauaugaa

SEQ ID NO: 1582574 - RNA, 21 nt, Homo sapiens
uuauuuaggaaguugacuuau

SEQ ID NO: 1582575 - RNA, 19 nt, Homo sapiens
uuauuucucauugccucuu

SEQ ID NO: 1582576 - RNA, 14 nt, Homo sapiens
uuauuucugaucua

SEQ ID NO: 1582577 - RNA, 19 nt, Homo sapiens
uuauuucugaucuauacaa

SEQ ID NO: 1582578 - RNA, 20 nt, Homo sapiens
uuauuucugaucuauacaaa

SEQ ID NO: 1582579 - RNA, 18 nt, Homo sapiens
uuauuugcaggucuuuaa

SEQ ID NO: 1582580 - RNA, 14 nt, Homo sapiens
uuauuuuccaggua

SEQ ID NO: 1582581 - RNA, 20 nt, Homo sapiens
uuauuuuugguuuccaaaga

SEQ ID NO: 1582582 - RNA, 19 nt, Homo sapiens
uucaaaaaacucucuccca

SEQ ID NO: 1582583 - RNA, 13 nt, Homo sapiens
uucaaaagugauu

SEQ ID NO: 1582584 - RNA, 12 nt, Homo sapiens
uucaaaauacuu

SEQ ID NO: 1582585 - RNA, 16 nt, Homo sapiens
uucaaagaaguacuuu

SEQ ID NO: 1582586 - RNA, 20 nt, Homo sapiens
uucaaagauuuuuauuuuga

SEQ ID NO: 1582587 - RNA, 14 nt, Homo sapiens
uucaaagucucaau

SEQ ID NO: 1582588 - RNA, 13 nt, Homo sapiens
uucaaagucucac

SEQ ID NO: 1582589 - RNA, 20 nt, Homo sapiens
uucaaauucuucugaacuca

SEQ ID NO: 1582590 - RNA, 20 nt, Homo sapiens
uucaaauuugugcagugucu

SEQ ID NO: 1582591 - RNA, 19 nt, Homo sapiens
uucaacauaaagagcaaua

SEQ ID NO: 1582592 - RNA, 18 nt, Homo sapiens
uucaacaugacauccaga

SEQ ID NO: 1582593 - RNA, 21 nt, Homo sapiens
uucaaccuguccuuucaggga

SEQ ID NO: 1582594 - RNA, 14 nt, Homo sapiens
uucaacgacugccg

SEQ ID NO: 1582595 - RNA, 13 nt, Homo sapiens
uucaacgauguga

SEQ ID NO: 1582596 - RNA, 14 nt, Homo sapiens
uucaacuacaguga

SEQ ID NO: 1582597 - RNA, 21 nt, Homo sapiens
uucaacuuugaauaaagaaua

SEQ ID NO: 1582598 - RNA, 11 nt, Homo sapiens
uucaagacaga

SEQ ID NO: 1582599 - RNA, 19 nt, Homo sapiens
uucaagaccagccugggca

SEQ ID NO: 1582600 - RNA, 17 nt, Homo sapiens
uucaagcacacuggaau

SEQ ID NO: 1582601 - RNA, 15 nt, Homo sapiens
uucaagccauuccaa

SEQ ID NO: 1582602 - RNA, 22 nt, Homo sapiens
uucaaggaggcccacugugucu

SEQ ID NO: 1582603 - RNA, 21 nt, Homo sapiens
uucaaggccccgagcuguuac

SEQ ID NO: 1582604 - RNA, 16 nt, Homo sapiens
uucaaguaauugugaa

SEQ ID NO: 1582605 - RNA, 13 nt, Homo sapiens
uucaagugccaaa

SEQ ID NO: 1582606 - RNA, 15 nt, Homo sapiens
uucaagugccaaaca

SEQ ID NO: 1582607 - RNA, 13 nt, Homo sapiens
uucaauaauguga

SEQ ID NO: 1582608 - RNA, 17 nt, Homo sapiens
uucaauugcaucuccca

SEQ ID NO: 1582609 - RNA, 16 nt, Homo sapiens
uucaauuuauuacuga

SEQ ID NO: 1582610 - RNA, 16 nt, Homo sapiens
uucacaagacccaaaa

SEQ ID NO: 1582611 - RNA, 19 nt, Homo sapiens
uucacagacugauuggaau

SEQ ID NO: 1582612 - RNA, 13 nt, Homo sapiens
uucacagccagac

SEQ ID NO: 1582613 - RNA, 15 nt, Homo sapiens
uucacauaugacaau

SEQ ID NO: 1582614 - RNA, 13 nt, Homo sapiens
uucacauugcacu

SEQ ID NO: 1582615 - RNA, 17 nt, Homo sapiens
uucaccaagugaucaaa

SEQ ID NO: 1582616 - RNA, 18 nt, Homo sapiens
uucacccaccaggccagc

SEQ ID NO: 1582617 - RNA, 20 nt, Homo sapiens
uucacuaaugaucacauucu

SEQ ID NO: 1582618 - RNA, 19 nt, Homo sapiens
uucacuagaguucuuugaa

SEQ ID NO: 1582619 - RNA, 15 nt, Homo sapiens
uucacuuuugacaaa

SEQ ID NO: 1582620 - RNA, 19 nt, Homo sapiens
uucagaaaagaagugaagu

SEQ ID NO: 1582621 - RNA, 23 nt, Homo sapiens
uucagacccucauuccuucccag

SEQ ID NO: 1582622 - RNA, 16 nt, Homo sapiens
uucagaguggacuaca

SEQ ID NO: 1582623 - RNA, 23 nt, Homo sapiens
uucagauaauugaauaaguaccu

SEQ ID NO: 1582624 - RNA, 15 nt, Homo sapiens
uucagauuugccuua

SEQ ID NO: 1582625 - RNA, 18 nt, Homo sapiens
uucagcaccgauggccau

SEQ ID NO: 1582626 - RNA, 21 nt, Homo sapiens
uucagcauccgcaggugcugg

SEQ ID NO: 1582627 - RNA, 19 nt, Homo sapiens
uucagcuccuuccaccaca

SEQ ID NO: 1582628 - RNA, 23 nt, Homo sapiens
uucaggaaccucgaguacugugg

SEQ ID NO: 1582629 - RNA, 17 nt, Homo sapiens
uucaggagacuuuacaa

SEQ ID NO: 1582630 - RNA, 21 nt, Homo sapiens
uucaggcuaagaagagauuuc

SEQ ID NO: 1582631 - RNA, 15 nt, Homo sapiens
uucagguaacacuac

SEQ ID NO: 1582632 - RNA, 19 nt, Homo sapiens
uucagugagccccucccca

SEQ ID NO: 1582633 - RNA, 14 nt, Homo sapiens
uucagugcaguuuc

SEQ ID NO: 1582634 - RNA, 12 nt, Homo sapiens
uucaguuacuaa

SEQ ID NO: 1582635 - RNA, 13 nt, Homo sapiens
uucauaacuuauu

SEQ ID NO: 1582636 - RNA, 15 nt, Homo sapiens
uucauacaacaugca

SEQ ID NO: 1582637 - RNA, 15 nt, Homo sapiens
uucauacagaaggca

SEQ ID NO: 1582638 - RNA, 13 nt, Homo sapiens
uucauacuaaacu

SEQ ID NO: 1582639 - RNA, 12 nt, Homo sapiens
uucauacuguaa

SEQ ID NO: 1582640 - RNA, 14 nt, Homo sapiens
uucauaguguucau

SEQ ID NO: 1582641 - RNA, 17 nt, Homo sapiens
uucauauaccagcaaua

SEQ ID NO: 1582642 - RNA, 14 nt, Homo sapiens
uucauaugcagaug

SEQ ID NO: 1582643 - RNA, 17 nt, Homo sapiens
uucauauuaugaugcca

SEQ ID NO: 1582644 - RNA, 13 nt, Homo sapiens
uucaucacacugg

SEQ ID NO: 1582645 - RNA, 13 nt, Homo sapiens
uucaucauuucag

SEQ ID NO: 1582646 - RNA, 19 nt, Homo sapiens
uucaucuaaaugaaagugg

SEQ ID NO: 1582647 - RNA, 20 nt, Homo sapiens
uucaucuuguacaaacuuug

SEQ ID NO: 1582648 - RNA, 14 nt, Homo sapiens
uucaugccagguua

SEQ ID NO: 1582649 - RNA, 18 nt, Homo sapiens
uucaugugguacuacuga

SEQ ID NO: 1582650 - RNA, 22 nt, Homo sapiens
uucaugugguacuacugaagaa

SEQ ID NO: 1582651 - RNA, 20 nt, Homo sapiens
uucauguuuuguaccaucau

SEQ ID NO: 1582652 - RNA, 17 nt, Homo sapiens
uucauuaaugaugaucu

SEQ ID NO: 1582653 - RNA, 12 nt, Homo sapiens
uucauuaccuca

SEQ ID NO: 1582654 - RNA, 18 nt, Homo sapiens
uucauucuguuaucucag

SEQ ID NO: 1582655 - RNA, 14 nt, Homo sapiens
uucauucuuugcag

SEQ ID NO: 1582656 - RNA, 19 nt, Homo sapiens
uucauucuuuuugaaaugu

SEQ ID NO: 1582657 - RNA, 16 nt, Homo sapiens
uucauugagaaacugg

SEQ ID NO: 1582658 - RNA, 16 nt, Homo sapiens
uucauugccagugucu

SEQ ID NO: 1582659 - RNA, 18 nt, Homo sapiens
uucauuguguuaccugua

SEQ ID NO: 1582660 - RNA, 13 nt, Homo sapiens
uucauuguucacu

SEQ ID NO: 1582661 - RNA, 14 nt, Homo sapiens
uucauuuauaucgc

SEQ ID NO: 1582662 - RNA, 15 nt, Homo sapiens
uucauuucauuucag

SEQ ID NO: 1582663 - RNA, 13 nt, Homo sapiens
uucauuuccagca

SEQ ID NO: 1582664 - RNA, 14 nt, Homo sapiens
uucauuuccagcau

SEQ ID NO: 1582665 - RNA, 23 nt, Homo sapiens
uucauuuuugauagcugucccau

SEQ ID NO: 1582666 - RNA, 12 nt, Homo sapiens
uuccaaacacca

SEQ ID NO: 1582667 - RNA, 11 nt, Homo sapiens
uuccaaagaca

SEQ ID NO: 1582668 - RNA, 11 nt, Homo sapiens
uuccaaagcaa

SEQ ID NO: 1582669 - RNA, 18 nt, Homo sapiens
uuaaagacguucccuuuu

SEQ ID NO: 1582670 - RNA, 15 nt, Homo sapiens
uuaaagcaucaucug

SEQ ID NO: 1582671 - RNA, 20 nt, Homo sapiens
uuaaagcaucuauaaggugc

SEQ ID NO: 1582672 - RNA, 19 nt, Homo sapiens
uuaaagcuuauccauaaaa

SEQ ID NO: 1582673 - RNA, 16 nt, Homo sapiens
uuaaaggaaaaucaca

SEQ ID NO: 1582674 - RNA, 23 nt, Homo sapiens
uuaaaggaaaaucacaucuccag

SEQ ID NO: 1582675 - RNA, 17 nt, Homo sapiens
uuaaaggaccucauuaa

SEQ ID NO: 1582676 - RNA, 19 nt, Homo sapiens
uuaaaggggguaugugaua

SEQ ID NO: 1582677 - RNA, 11 nt, Homo sapiens
uuaaaguauuu

SEQ ID NO: 1582678 - RNA, 14 nt, Homo sapiens
uuaaauacaaaagg

SEQ ID NO: 1582679 - RNA, 13 nt, Homo sapiens
uuaaauacauaaa

SEQ ID NO: 1582680 - RNA, 16 nt, Homo sapiens
uuaaauauccauuuau

SEQ ID NO: 1582681 - RNA, 15 nt, Homo sapiens
uuaaauauuucuuaa

SEQ ID NO: 1582682 - RNA, 21 nt, Homo sapiens
uuaaaucaacgaguacuucaa

SEQ ID NO: 1582683 - RNA, 13 nt, Homo sapiens
uuaaauccuaaaa

SEQ ID NO: 1582684 - RNA, 14 nt, Homo sapiens
uuaaaucuagacau

SEQ ID NO: 1582685 - RNA, 19 nt, Homo sapiens
uuaaaucugugaugauccu

SEQ ID NO: 1582686 - RNA, 20 nt, Homo sapiens
uuaaaugaaaguauuggcau

SEQ ID NO: 1582687 - RNA, 14 nt, Homo sapiens
uuaaauguauacua

SEQ ID NO: 1582688 - RNA, 20 nt, Homo sapiens
uuaaauuaaacucuacuuca

SEQ ID NO: 1582689 - RNA, 15 nt, Homo sapiens
uuaaauuaauaucuu

SEQ ID NO: 1582690 - RNA, 17 nt, Homo sapiens
uuaaauuacaauuuuau

SEQ ID NO: 1582691 - RNA, 16 nt, Homo sapiens
uuaaauuaugcaacgu

SEQ ID NO: 1582692 - RNA, 20 nt, Homo sapiens
uuaaauuccacagauuauca

SEQ ID NO: 1582693 - RNA, 16 nt, Homo sapiens
uuaaauucucuuucac

SEQ ID NO: 1582694 - RNA, 14 nt, Homo sapiens
uuaaauuuuguaug

SEQ ID NO: 1582695 - RNA, 16 nt, Homo sapiens
uuaaauuuuuuuuaca

SEQ ID NO: 1582696 - RNA, 21 nt, Homo sapiens
uuaacacgugaauauuuugcu

SEQ ID NO: 1582697 - RNA, 22 nt, Homo sapiens
uuaacacuaaccaaacaaugca

SEQ ID NO: 1582698 - RNA, 20 nt, Homo sapiens
uuaacagacucaaaccacau

SEQ ID NO: 1582699 - RNA, 15 nt, Homo sapiens
uuaacagcaacgaac

SEQ ID NO: 1582700 - RNA, 20 nt, Homo sapiens
uuaaccacauuucugaaugu

SEQ ID NO: 1582701 - RNA, 15 nt, Homo sapiens
uuaacccaaagaagc

SEQ ID NO: 1582702 - RNA, 14 nt, Homo sapiens
uuaaccucagggag

SEQ ID NO: 1582703 - RNA, 16 nt, Homo sapiens
uuaaccuuugcuaugu

SEQ ID NO: 1582704 - RNA, 16 nt, Homo sapiens
uuaacuaaaugcucau

SEQ ID NO: 1582705 - RNA, 13 nt, Homo sapiens
uuaacucugcaua

SEQ ID NO: 1582706 - RNA, 15 nt, Homo sapiens
uuaacugcauccagc

SEQ ID NO: 1582707 - RNA, 19 nt, Homo sapiens
uuaacuguauuucaguauu

SEQ ID NO: 1582708 - RNA, 21 nt, Homo sapiens
uuaacuuaaaagaacauguau

SEQ ID NO: 1582709 - RNA, 22 nt, Homo sapiens
uuaacuuuaccaugcucaauga

SEQ ID NO: 1582710 - RNA, 14 nt, Homo sapiens
uuaagaaacuagca

SEQ ID NO: 1582711 - RNA, 15 nt, Homo sapiens
uuaagaaacuguuuc

SEQ ID NO: 1582712 - RNA, 12 nt, Homo sapiens
uuaagaaauuca

SEQ ID NO: 1582713 - RNA, 11 nt, Homo sapiens
uuaagauaucu

SEQ ID NO: 1582714 - RNA, 13 nt, Homo sapiens
uuaagcaagaaug

SEQ ID NO: 1582715 - RNA, 18 nt, Homo sapiens
uuaagcauggauuuuccc

SEQ ID NO: 1582716 - RNA, 16 nt, Homo sapiens
uuaagcgugucuguau

SEQ ID NO: 1582717 - RNA, 21 nt, Homo sapiens
uuaagcuaugaaaaauacaau

SEQ ID NO: 1582718 - RNA, 19 nt, Homo sapiens
uuaagcuuuaaaugacagu

SEQ ID NO: 1582719 - RNA, 21 nt, Homo sapiens
uuaaggagaggagaaacugag

SEQ ID NO: 1582720 - RNA, 20 nt, Homo sapiens
uuaaggccaggcaugguggu

SEQ ID NO: 1582721 - RNA, 14 nt, Homo sapiens
uuaaguagggauaa

SEQ ID NO: 1582722 - RNA, 16 nt, Homo sapiens
uuaagucaccuguaua

SEQ ID NO: 1582723 - RNA, 13 nt, Homo sapiens
uuaaguccaccuc

SEQ ID NO: 1582724 - RNA, 16 nt, Homo sapiens
uuaauaagucauugaa

SEQ ID NO: 1582725 - RNA, 19 nt, Homo sapiens
uuaauacugacucaguguc

SEQ ID NO: 1582726 - RNA, 15 nt, Homo sapiens
uuaauauuucugagg

SEQ ID NO: 1582727 - RNA, 11 nt, Homo sapiens
uuaaucaccaa

SEQ ID NO: 1582728 - RNA, 16 nt, Homo sapiens
uuaauccaauccacua

SEQ ID NO: 1582729 - RNA, 14 nt, Homo sapiens
uuaauccuaccuca

SEQ ID NO: 1582730 - RNA, 16 nt, Homo sapiens
uuaaucucuaguaaaa

SEQ ID NO: 1582731 - RNA, 20 nt, Homo sapiens
uuaaucuuggauagcuaaua

SEQ ID NO: 1582732 - RNA, 18 nt, Homo sapiens
uuaaugaagaaaguggaa

SEQ ID NO: 1582733 - RNA, 15 nt, Homo sapiens
uuaaugacaacacuu

SEQ ID NO: 1582734 - RNA, 14 nt, Homo sapiens
uuaaugacucuuuc

SEQ ID NO: 1582735 - RNA, 15 nt, Homo sapiens
uuaaugagacaugaa

SEQ ID NO: 1582736 - RNA, 17 nt, Homo sapiens
uuaaugcacuuucuauc

SEQ ID NO: 1582737 - RNA, 21 nt, Homo sapiens
uuaauggcagcuagugccuuu

SEQ ID NO: 1582738 - RNA, 18 nt, Homo sapiens
uuaauguagaaccucaaa

SEQ ID NO: 1582739 - RNA, 15 nt, Homo sapiens
uuaauuaaagccuua

SEQ ID NO: 1582740 - RNA, 13 nt, Homo sapiens
uuaauuaagcaaa

SEQ ID NO: 1582741 - RNA, 20 nt, Homo sapiens
uuaauuaagucaccuguaua

SEQ ID NO: 1582742 - RNA, 16 nt, Homo sapiens
uuaauuagggugaaaa

SEQ ID NO: 1582743 - RNA, 23 nt, Homo sapiens
uuaauuaugauaauaaagagauu

SEQ ID NO: 1582744 - RNA, 12 nt, Homo sapiens
uuaauucuagua

SEQ ID NO: 1582745 - RNA, 21 nt, Homo sapiens
uuaauucuuaaaacuauaaca

SEQ ID NO: 1582746 - RNA, 20 nt, Homo sapiens
uuaauuuacuuaaguguuca

SEQ ID NO: 1582747 - RNA, 20 nt, Homo sapiens
uuaauuugguagaugacaaa

SEQ ID NO: 1582748 - RNA, 15 nt, Homo sapiens
uuaauuuugauauaa

SEQ ID NO: 1582749 - RNA, 14 nt, Homo sapiens
uuaauuuugauuca

SEQ ID NO: 1582750 - RNA, 14 nt, Homo sapiens
uuacaaaguuucaa

SEQ ID NO: 1582751 - RNA, 18 nt, Homo sapiens
uuacaaauuuugcacuuu

SEQ ID NO: 1582752 - RNA, 19 nt, Homo sapiens
uuacaagaggauuguaaaa

SEQ ID NO: 1582753 - RNA, 20 nt, Homo sapiens
uuacaaguuuuuuaggauuc

SEQ ID NO: 1582754 - RNA, 18 nt, Homo sapiens
uuacaaucgagacugcaa

SEQ ID NO: 1582755 - RNA, 21 nt, Homo sapiens
uuacacagccuaaagcuaaaa

SEQ ID NO: 1582756 - RNA, 15 nt, Homo sapiens
uuacaccucaguauu

SEQ ID NO: 1582757 - RNA, 18 nt, Homo sapiens
uuacagacucugauucua

SEQ ID NO: 1582758 - RNA, 23 nt, Homo sapiens
uuacagacuggaauaguggcaua

SEQ ID NO: 1582759 - RNA, 23 nt, Homo sapiens
uuacagagagcuugcugugacua

SEQ ID NO: 1582760 - RNA, 18 nt, Homo sapiens
uuacagagaggauacauu

SEQ ID NO: 1582761 - RNA, 20 nt, Homo sapiens
uuacagccaaguugugacag

SEQ ID NO: 1582762 - RNA, 16 nt, Homo sapiens
uuacaggaaugaagaa

SEQ ID NO: 1582763 - RNA, 14 nt, Homo sapiens
uuacaggcacgugc

SEQ ID NO: 1582764 - RNA, 23 nt, Homo sapiens
uuacaggggagaaaaaugacaaa

SEQ ID NO: 1582765 - RNA, 10 nt, Homo sapiens
uuacauacac

SEQ ID NO: 1582766 - RNA, 14 nt, Homo sapiens
uuacaucugccuua

SEQ ID NO: 1582767 - RNA, 17 nt, Homo sapiens
uuacaugaagcuguaua

SEQ ID NO: 1582768 - RNA, 14 nt, Homo sapiens
uuacaugaguucaa

SEQ ID NO: 1582769 - RNA, 16 nt, Homo sapiens
uuacauguaauuugau

SEQ ID NO: 1582770 - RNA, 14 nt, Homo sapiens
uuacauuguugagc

SEQ ID NO: 1582771 - RNA, 18 nt, Homo sapiens
uuacauuucauacaacag

SEQ ID NO: 1582772 - RNA, 21 nt, Homo sapiens
uuaccaggcaccaaaagaagu

SEQ ID NO: 1582773 - RNA, 19 nt, Homo sapiens
uuaccaguuuuccagaaca

SEQ ID NO: 1582774 - RNA, 15 nt, Homo sapiens
uuaccugagagauuu

SEQ ID NO: 1582775 - RNA, 20 nt, Homo sapiens
uuaccuugaaaugcuguuag

SEQ ID NO: 1582776 - RNA, 20 nt, Homo sapiens
uuacgcucggaacacauucu

SEQ ID NO: 1582777 - RNA, 21 nt, Homo sapiens
uuacguauguuuguacuuggu

SEQ ID NO: 1582778 - RNA, 22 nt, Homo sapiens
uuacuaaauuacaaaugcaauu

SEQ ID NO: 1582779 - RNA, 17 nt, Homo sapiens
uuacuaauuauacuacu

SEQ ID NO: 1582780 - RNA, 19 nt, Homo sapiens
uuacuauuuauuuacauau

SEQ ID NO: 1582781 - RNA, 18 nt, Homo sapiens
uuacuauuucacaacagc

SEQ ID NO: 1582782 - RNA, 17 nt, Homo sapiens
uuacucacucacucuga

SEQ ID NO: 1582783 - RNA, 21 nt, Homo sapiens
uuacucagaggagcugcaaau

SEQ ID NO: 1582784 - RNA, 22 nt, Homo sapiens
uuacugaaaaaugcaaauugca

SEQ ID NO: 1582785 - RNA, 14 nt, Homo sapiens
uuacugaugugaua

SEQ ID NO: 1582786 - RNA, 15 nt, Homo sapiens
uuacugaugugauau

SEQ ID NO: 1582787 - RNA, 16 nt, Homo sapiens
uuacugaugugugcaa

SEQ ID NO: 1582788 - RNA, 12 nt, Homo sapiens
uuacuguuuaca

SEQ ID NO: 1582789 - RNA, 21 nt, Homo sapiens
uuacuuauuuaacugauuaaa

SEQ ID NO: 1582790 - RNA, 23 nt, Homo sapiens
uuacuucucuauaaaaaauaugu

SEQ ID NO: 1582791 - RNA, 17 nt, Homo sapiens
uuacuuuuuugguacua

SEQ ID NO: 1582792 - RNA, 20 nt, Homo sapiens
uuacuuuuuugguacuauaa

SEQ ID NO: 1582793 - RNA, 22 nt, Homo sapiens
uuagaaagcugacauugccaaa

SEQ ID NO: 1582794 - RNA, 20 nt, Homo sapiens
uuagaaauauuccaguucuc

SEQ ID NO: 1582795 - RNA, 13 nt, Homo sapiens
uuagaaaugcaaa

SEQ ID NO: 1582796 - RNA, 17 nt, Homo sapiens
uuagaaauucagcauuu

SEQ ID NO: 1582797 - RNA, 15 nt, Homo sapiens
uuagaacauucacuu

SEQ ID NO: 1582798 - RNA, 21 nt, Homo sapiens
uuagaagauaaaaguacauaa

SEQ ID NO: 1582799 - RNA, 20 nt, Homo sapiens
uuagaagauauuauuugucu

SEQ ID NO: 1582800 - RNA, 15 nt, Homo sapiens
uuagaauguugaaaa

SEQ ID NO: 1582801 - RNA, 19 nt, Homo sapiens
uuagaauuuguuucaucua

SEQ ID NO: 1582802 - RNA, 21 nt, Homo sapiens
uuagacccgcccuccccuuuu

SEQ ID NO: 1582803 - RNA, 13 nt, Homo sapiens
uuagacuugcucc

SEQ ID NO: 1582804 - RNA, 16 nt, Homo sapiens
uuagagcugccugugc

SEQ ID NO: 1582805 - RNA, 15 nt, Homo sapiens
uuagaguauuccuca

SEQ ID NO: 1582806 - RNA, 17 nt, Homo sapiens
uuagagugucuuuccac

SEQ ID NO: 1582807 - RNA, 21 nt, Homo sapiens
uuagauaaucaagggcacugu

SEQ ID NO: 1582808 - RNA, 16 nt, Homo sapiens
uuagauauugcuacua

SEQ ID NO: 1582809 - RNA, 20 nt, Homo sapiens
uuagauauugcuacuauaau

SEQ ID NO: 1582810 - RNA, 23 nt, Homo sapiens
uuagaugcaaguggcugaggcca

SEQ ID NO: 1582811 - RNA, 18 nt, Homo sapiens
uuagaugggcaugguggu

SEQ ID NO: 1582812 - RNA, 15 nt, Homo sapiens
uuagauucacuuuga

SEQ ID NO: 1582813 - RNA, 14 nt, Homo sapiens
uuagauugaaucug

SEQ ID NO: 1582814 - RNA, 22 nt, Homo sapiens
uuagauugaguaagauuuaccc

SEQ ID NO: 1582815 - RNA, 22 nt, Homo sapiens
uuagauugggucguuacuaaaa

SEQ ID NO: 1582816 - RNA, 18 nt, Homo sapiens
uuagcaagacugcaagag

SEQ ID NO: 1582817 - RNA, 22 nt, Homo sapiens
uuagcagggauguuccuuacca

SEQ ID NO: 1582818 - RNA, 16 nt, Homo sapiens
uuagcaguucugcaaa

SEQ ID NO: 1582819 - RNA, 19 nt, Homo sapiens
uuagccaaucuuucuagau

SEQ ID NO: 1582820 - RNA, 20 nt, Homo sapiens
uuagccauuuuucaaagcaa

SEQ ID NO: 1582821 - RNA, 21 nt, Homo sapiens
uuagccgggcaugauggugca

SEQ ID NO: 1582822 - RNA, 12 nt, Homo sapiens
uuagcuauuacu

SEQ ID NO: 1582823 - RNA, 12 nt, Homo sapiens
uuagcugucacc

SEQ ID NO: 1582824 - RNA, 17 nt, Homo sapiens
uuagcuugucugugauc

SEQ ID NO: 1582825 - RNA, 15 nt, Homo sapiens
uuagcuuucagauua

SEQ ID NO: 1582826 - RNA, 20 nt, Homo sapiens
uuaggaaggcagcauuccau

SEQ ID NO: 1582827 - RNA, 13 nt, Homo sapiens
uuaggacugacau

SEQ ID NO: 1582828 - RNA, 12 nt, Homo sapiens
uuaggaguacug

SEQ ID NO: 1582829 - RNA, 23 nt, Homo sapiens
uuaggaguacugauagggguuca

SEQ ID NO: 1582830 - RNA, 16 nt, Homo sapiens
uuaggauuugugguaa

SEQ ID NO: 1582831 - RNA, 20 nt, Homo sapiens
uuaggccuccggaugacugc

SEQ ID NO: 1582832 - RNA, 21 nt, Homo sapiens
uuaggucagcagccucccuga

SEQ ID NO: 1582833 - RNA, 24 nt, Homo sapiens
uuaguaaauagggaaaauaaucuc

SEQ ID NO: 1582834 - RNA, 14 nt, Homo sapiens
uuaguacaauuuca

SEQ ID NO: 1582835 - RNA, 17 nt, Homo sapiens
uuaguacagaaauaucc

SEQ ID NO: 1582836 - RNA, 21 nt, Homo sapiens
uuaguagagacgggguuucac

SEQ ID NO: 1582837 - RNA, 21 nt, Homo sapiens
uuagugaucaaauugugcagu

SEQ ID NO: 1582838 - RNA, 18 nt, Homo sapiens
uuaguguggcuaaccaag

SEQ ID NO: 1582839 - RNA, 21 nt, Homo sapiens
uuaguuaaaaaaaaauucccu

SEQ ID NO: 1582840 - RNA, 23 nt, Homo sapiens
uuaguuccccaaauacaaaguua

SEQ ID NO: 1582841 - RNA, 21 nt, Homo sapiens
uuaguuucaaauuuaccucag

SEQ ID NO: 1582842 - RNA, 18 nt, Homo sapiens
uuaguuuuuaacaaucua

SEQ ID NO: 1582843 - RNA, 16 nt, Homo sapiens
uuauaaagcuguucuu

SEQ ID NO: 1582844 - RNA, 19 nt, Homo sapiens
uuauaaaugauaucaaaga

SEQ ID NO: 1582845 - RNA, 22 nt, Homo sapiens
uuauaaaugauaucaaagaaga

SEQ ID NO: 1582846 - RNA, 20 nt, Homo sapiens
uuauaaauucagaacaagca

SEQ ID NO: 1582847 - RNA, 14 nt, Homo sapiens
uuauaauacuguuu

SEQ ID NO: 1582848 - RNA, 13 nt, Homo sapiens
uuauaauuuuacu

SEQ ID NO: 1582849 - RNA, 16 nt, Homo sapiens
uuauacaaaagagcau

SEQ ID NO: 1582850 - RNA, 19 nt, Homo sapiens
uuauacauguguaaacaau

SEQ ID NO: 1582851 - RNA, 21 nt, Homo sapiens
uuauacuaaauaugugacuga

SEQ ID NO: 1582852 - RNA, 18 nt, Homo sapiens
uuauagcaacaacaauug

SEQ ID NO: 1582853 - RNA, 22 nt, Homo sapiens
uuauagcaacaacaauugguaa

SEQ ID NO: 1582854 - RNA, 21 nt, Homo sapiens
uuauaguuauuaaauguuuca

SEQ ID NO: 1582855 - RNA, 21 nt, Homo sapiens
uuauaucagcagacacuccag

SEQ ID NO: 1582856 - RNA, 16 nt, Homo sapiens
uuauaucauacaguuu

SEQ ID NO: 1582857 - RNA, 18 nt, Homo sapiens
uuauaucuguaaugauac

SEQ ID NO: 1582858 - RNA, 21 nt, Homo sapiens
uuauaucugugaauugcaggu

SEQ ID NO: 1582859 - RNA, 19 nt, Homo sapiens
uuauaugagggcagauuca

SEQ ID NO: 1582860 - RNA, 19 nt, Homo sapiens
uuaucacacuucugugaga

SEQ ID NO: 1582861 - RNA, 18 nt, Homo sapiens
uuaucaccgugggcuccc

SEQ ID NO: 1582862 - RNA, 22 nt, Homo sapiens
uuaucagacucuguaauugaau

SEQ ID NO: 1582863 - RNA, 22 nt, Homo sapiens
uuaucagcaaaaaaguccaauu

SEQ ID NO: 1582864 - RNA, 13 nt, Homo sapiens
uuaucauauccuu

SEQ ID NO: 1582865 - RNA, 23 nt, Homo sapiens
uuaucccccgcaaagacaucaaa

SEQ ID NO: 1582866 - RNA, 16 nt, Homo sapiens
uuaucucaaaacugca

SEQ ID NO: 1582867 - RNA, 19 nt, Homo sapiens
uuaucucacuuuguaaaua

SEQ ID NO: 1582868 - RNA, 13 nt, Homo sapiens
uuaucuuuaccaa

SEQ ID NO: 1582869 - RNA, 16 nt, Homo sapiens
uuaucuuugcuguuau

SEQ ID NO: 1582870 - RNA, 21 nt, Homo sapiens
uuaugaaaacuagcauuacau

SEQ ID NO: 1582871 - RNA, 17 nt, Homo sapiens
uuaugaaaaguacuaau

SEQ ID NO: 1582872 - RNA, 21 nt, Homo sapiens
uuaugaaaauuauacugagaa

SEQ ID NO: 1582873 - RNA, 18 nt, Homo sapiens
uuaugaugccacuuuucu

SEQ ID NO: 1582874 - RNA, 18 nt, Homo sapiens
uuaugauugcauuguaug

SEQ ID NO: 1582875 - RNA, 16 nt, Homo sapiens
uuaugcaaauggagau

SEQ ID NO: 1582876 - RNA, 16 nt, Homo sapiens
uuaugcuaagugaaau

SEQ ID NO: 1582877 - RNA, 13 nt, Homo sapiens
uuaugcugugaca

SEQ ID NO: 1582878 - RNA, 16 nt, Homo sapiens
uuauggaaaacugugu

SEQ ID NO: 1582879 - RNA, 19 nt, Homo sapiens
uuauggugaugucacucac

SEQ ID NO: 1582880 - RNA, 19 nt, Homo sapiens
uuaugguuaauacuauuaa

SEQ ID NO: 1582881 - RNA, 20 nt, Homo sapiens
uuauguaugaaaauuauucu

SEQ ID NO: 1582882 - RNA, 17 nt, Homo sapiens
ugacuaauagagcucca

SEQ ID NO: 1582883 - RNA, 17 nt, Homo sapiens
ugacuaauucacaaaaa

SEQ ID NO: 1582884 - RNA, 21 nt, Homo sapiens
ugacucacaccugaacugaac

SEQ ID NO: 1582885 - RNA, 15 nt, Homo sapiens
ugacucagugaccag

SEQ ID NO: 1582886 - RNA, 14 nt, Homo sapiens
ugacuccauucaaa

SEQ ID NO: 1582887 - RNA, 22 nt, Homo sapiens
ugacuccauucaaaucuacggu

SEQ ID NO: 1582888 - RNA, 17 nt, Homo sapiens
ugacucuaccugcaaga

SEQ ID NO: 1582889 - RNA, 13 nt, Homo sapiens
ugacucugagcua

SEQ ID NO: 1582890 - RNA, 18 nt, Homo sapiens
ugacugagcagcauccac

SEQ ID NO: 1582891 - RNA, 18 nt, Homo sapiens
ugacugcccggcacagau

SEQ ID NO: 1582892 - RNA, 21 nt, Homo sapiens
ugacugccucugccugucgca

SEQ ID NO: 1582893 - RNA, 22 nt, Homo sapiens
ugacuggaggaggccuguccca

SEQ ID NO: 1582894 - RNA, 19 nt, Homo sapiens
ugacuggccacacaggauc

SEQ ID NO: 1582895 - RNA, 15 nt, Homo sapiens
ugacuuaaccauaua

SEQ ID NO: 1582896 - RNA, 16 nt, Homo sapiens
ugacuuugcuccucac

SEQ ID NO: 1582897 - RNA, 22 nt, Homo sapiens
ugagaaaagaaauuaguuucaa

SEQ ID NO: 1582898 - RNA, 18 nt, Homo sapiens
ugagaaaagccucuccag

SEQ ID NO: 1582899 - RNA, 16 nt, Homo sapiens
ugagaaaauaucuugc

SEQ ID NO: 1582900 - RNA, 22 nt, Homo sapiens
ugagaaaauccccaacuaugca

SEQ ID NO: 1582901 - RNA, 17 nt, Homo sapiens
ugagaaagaaacuaaua

SEQ ID NO: 1582902 - RNA, 18 nt, Homo sapiens
ugagaaccuaaugcacuc

SEQ ID NO: 1582903 - RNA, 18 nt, Homo sapiens
ugagaagccagcuuuccu

SEQ ID NO: 1582904 - RNA, 14 nt, Homo sapiens
ugagaagccaugua

SEQ ID NO: 1582905 - RNA, 17 nt, Homo sapiens
ugagaagcccgagguca

SEQ ID NO: 1582906 - RNA, 21 nt, Homo sapiens
ugagaagccugaugacaucaa

SEQ ID NO: 1582907 - RNA, 22 nt, Homo sapiens
ugagaaggucacuacugcauuu

SEQ ID NO: 1582908 - RNA, 13 nt, Homo sapiens
ugagaagugcacu

SEQ ID NO: 1582909 - RNA, 17 nt, Homo sapiens
ugagaagugcacuuuaa

SEQ ID NO: 1582910 - RNA, 19 nt, Homo sapiens
ugagaauauagacagugcc

SEQ ID NO: 1582911 - RNA, 15 nt, Homo sapiens
ugagaaucaugcacu

SEQ ID NO: 1582912 - RNA, 21 nt, Homo sapiens
ugagaauguucaucucuccag

SEQ ID NO: 1582913 - RNA, 15 nt, Homo sapiens
ugagaauugugcuuu

SEQ ID NO: 1582914 - RNA, 13 nt, Homo sapiens
ugagacacaagau

SEQ ID NO: 1582915 - RNA, 14 nt, Homo sapiens
ugagaccucuagag

SEQ ID NO: 1582916 - RNA, 22 nt, Homo sapiens
ugagacuacaagugugugccac

SEQ ID NO: 1582917 - RNA, 14 nt, Homo sapiens
ugagacuccaucuc

SEQ ID NO: 1582918 - RNA, 23 nt, Homo sapiens
ugagacucuaggguccaguggau

SEQ ID NO: 1582919 - RNA, 22 nt, Homo sapiens
ugagacuuugaaacuaucucau

SEQ ID NO: 1582920 - RNA, 13 nt, Homo sapiens
ugagagaccugcu

SEQ ID NO: 1582921 - RNA, 14 nt, Homo sapiens
ugagaggcaaugau

SEQ ID NO: 1582922 - RNA, 23 nt, Homo sapiens
ugagagggagggcugcugccaca

SEQ ID NO: 1582923 - RNA, 14 nt, Homo sapiens
ugagagucaaagcu

SEQ ID NO: 1582924 - RNA, 19 nt, Homo sapiens
ugagaguuuucuaaaguau

SEQ ID NO: 1582925 - RNA, 17 nt, Homo sapiens
ugagaucaacaacacua

SEQ ID NO: 1582926 - RNA, 21 nt, Homo sapiens
ugagaucacgccauuguacuc

SEQ ID NO: 1582927 - RNA, 15 nt, Homo sapiens
ugagaucauugugaa

SEQ ID NO: 1582928 - RNA, 22 nt, Homo sapiens
ugagaugggagaaucacuugaa

SEQ ID NO: 1582929 - RNA, 14 nt, Homo sapiens
ugagauguguauca

SEQ ID NO: 1582930 - RNA, 20 nt, Homo sapiens
ugagauugagcgccacgaca

SEQ ID NO: 1582931 - RNA, 16 nt, Homo sapiens
ugagauugcaccacug

SEQ ID NO: 1582932 - RNA, 23 nt, Homo sapiens
ugagauugcaccacugcacucca

SEQ ID NO: 1582933 - RNA, 12 nt, Homo sapiens
ugagcaacucuu

SEQ ID NO: 1582934 - RNA, 19 nt, Homo sapiens
ugagcaacucuugauuauc

SEQ ID NO: 1582935 - RNA, 18 nt, Homo sapiens
ugagcacaucucucugcc

SEQ ID NO: 1582936 - RNA, 23 nt, Homo sapiens
ugagcacuuagcaggcaccgcca

SEQ ID NO: 1582937 - RNA, 22 nt, Homo sapiens
ugagcagaagcuggaggcacaa

SEQ ID NO: 1582938 - RNA, 22 nt, Homo sapiens
ugagcagccucuggacagccag

SEQ ID NO: 1582939 - RNA, 13 nt, Homo sapiens
ugagcagccuuuc

SEQ ID NO: 1582940 - RNA, 19 nt, Homo sapiens
ugagcaugcacacugagaa

SEQ ID NO: 1582941 - RNA, 18 nt, Homo sapiens
ugagccacagaugggcaa

SEQ ID NO: 1582942 - RNA, 15 nt, Homo sapiens
ugagccaugcuacag

SEQ ID NO: 1582943 - RNA, 19 nt, Homo sapiens
ugagccgagaucaugccau

SEQ ID NO: 1582944 - RNA, 14 nt, Homo sapiens
ugagcuaacuuaua

SEQ ID NO: 1582945 - RNA, 12 nt, Homo sapiens
ugagcucucuca

SEQ ID NO: 1582946 - RNA, 15 nt, Homo sapiens
ugagcucuucccuua

SEQ ID NO: 1582947 - RNA, 19 nt, Homo sapiens
ugagcugccuguaacuuga

SEQ ID NO: 1582948 - RNA, 16 nt, Homo sapiens
ugagcuggacauaaca

SEQ ID NO: 1582949 - RNA, 20 nt, Homo sapiens
ugagcuggggacucagggac

SEQ ID NO: 1582950 - RNA, 17 nt, Homo sapiens
ugagcuggggaugucuc

SEQ ID NO: 1582951 - RNA, 22 nt, Homo sapiens
ugagcuggggaugucucucaug

SEQ ID NO: 1582952 - RNA, 12 nt, Homo sapiens
ugagcugugagu

SEQ ID NO: 1582953 - RNA, 15 nt, Homo sapiens
ugagcuguguucaca

SEQ ID NO: 1582954 - RNA, 18 nt, Homo sapiens
ugagcuugauuaaaucaa

SEQ ID NO: 1582955 - RNA, 12 nt, Homo sapiens
ugagcuuugaaa

SEQ ID NO: 1582956 - RNA, 23 nt, Homo sapiens
ugaggaaaaguccacaagaacaa

SEQ ID NO: 1582957 - RNA, 19 nt, Homo sapiens
ugaggaaacugagucacuc

SEQ ID NO: 1582958 - RNA, 22 nt, Homo sapiens
ugaggaaacugagucacucaca

SEQ ID NO: 1582959 - RNA, 20 nt, Homo sapiens
ugaggaagaguuuauggcaa

SEQ ID NO: 1582960 - RNA, 15 nt, Homo sapiens
ugaggacugauuuca

SEQ ID NO: 1582961 - RNA, 18 nt, Homo sapiens
ugaggacuuaauuuacuu

SEQ ID NO: 1582962 - RNA, 14 nt, Homo sapiens
ugaggagacuauga

SEQ ID NO: 1582963 - RNA, 16 nt, Homo sapiens
ugaggagccucugauc

SEQ ID NO: 1582964 - RNA, 13 nt, Homo sapiens
ugaggcaggagaa

SEQ ID NO: 1582965 - RNA, 19 nt, Homo sapiens
ugaggccaucucaggagau

SEQ ID NO: 1582966 - RNA, 15 nt, Homo sapiens
ugaggcccaaaacau

SEQ ID NO: 1582967 - RNA, 16 nt, Homo sapiens
ugaggcccugcccaau

SEQ ID NO: 1582968 - RNA, 17 nt, Homo sapiens
ugaggccuagacucugu

SEQ ID NO: 1582969 - RNA, 16 nt, Homo sapiens
ugaggcggagaauugc

SEQ ID NO: 1582970 - RNA, 13 nt, Homo sapiens
ugaggcucuucac

SEQ ID NO: 1582971 - RNA, 11 nt, Homo sapiens
ugagggacaau

SEQ ID NO: 1582972 - RNA, 16 nt, Homo sapiens
ugagggacaaugccaa

SEQ ID NO: 1582973 - RNA, 19 nt, Homo sapiens
ugagggagccuggccccau

SEQ ID NO: 1582974 - RNA, 14 nt, Homo sapiens
ugaggggucucgga

SEQ ID NO: 1582975 - RNA, 19 nt, Homo sapiens
ugagggugacuauggagcu

SEQ ID NO: 1582976 - RNA, 13 nt, Homo sapiens
ugagggugcccag

SEQ ID NO: 1582977 - RNA, 19 nt, Homo sapiens
ugagggugcccagcuuaua

SEQ ID NO: 1582978 - RNA, 18 nt, Homo sapiens
ugagggugcugacuggcu

SEQ ID NO: 1582979 - RNA, 22 nt, Homo sapiens
ugagguaauucuagccuuuuaa

SEQ ID NO: 1582980 - RNA, 13 nt, Homo sapiens
ugagguaucuucu

SEQ ID NO: 1582981 - RNA, 17 nt, Homo sapiens
ugaggucaacacaggua

SEQ ID NO: 1582982 - RNA, 22 nt, Homo sapiens
ugagguccaggguugcuaggaa

SEQ ID NO: 1582983 - RNA, 16 nt, Homo sapiens
ugagguuuugaaagaa

SEQ ID NO: 1582984 - RNA, 14 nt, Homo sapiens
ugagucaugauccu

SEQ ID NO: 1582985 - RNA, 14 nt, Homo sapiens
ugagucaugaucuc

SEQ ID NO: 1582986 - RNA, 16 nt, Homo sapiens
ugaguccuaggacuua

SEQ ID NO: 1582987 - RNA, 15 nt, Homo sapiens
ugagugagggagaca

SEQ ID NO: 1582988 - RNA, 17 nt, Homo sapiens
ugagugccaugcuuuuu

SEQ ID NO: 1582989 - RNA, 19 nt, Homo sapiens
ugagugccuguaaucacag

SEQ ID NO: 1582990 - RNA, 15 nt, Homo sapiens
ugagugugacuaugu

SEQ ID NO: 1582991 - RNA, 18 nt, Homo sapiens
ugaguuuuguuucacuuu

SEQ ID NO: 1582992 - RNA, 20 nt, Homo sapiens
ugaguuuuuccucccaguga

SEQ ID NO: 1582993 - RNA, 15 nt, Homo sapiens
ugauaaaacacugcc

SEQ ID NO: 1582994 - RNA, 17 nt, Homo sapiens
ugauaaaugauagacaa

SEQ ID NO: 1582995 - RNA, 14 nt, Homo sapiens
ugauaagaaugaau

SEQ ID NO: 1582996 - RNA, 17 nt, Homo sapiens
ugauaagcugagcuccu

SEQ ID NO: 1582997 - RNA, 20 nt, Homo sapiens
ugauaauuguguaccuuaag

SEQ ID NO: 1582998 - RNA, 16 nt, Homo sapiens
ugauacugcaacuuua

SEQ ID NO: 1582999 - RNA, 17 nt, Homo sapiens
ugauacuuuagccauca

SEQ ID NO: 1583000 - RNA, 12 nt, Homo sapiens
ugauacuuugac

SEQ ID NO: 1583001 - RNA, 15 nt, Homo sapiens
uucuccccacugugc

SEQ ID NO: 1583002 - RNA, 16 nt, Homo sapiens
uucucccucgacauuu

SEQ ID NO: 1583003 - RNA, 15 nt, Homo sapiens
uucuccucacuguau

SEQ ID NO: 1583004 - RNA, 17 nt, Homo sapiens
uucuccugcaaauuuag

SEQ ID NO: 1583005 - RNA, 22 nt, Homo sapiens
uucuccugugaauggaggcaga

SEQ ID NO: 1583006 - RNA, 18 nt, Homo sapiens
uucuccuuaccgucuuga

SEQ ID NO: 1583007 - RNA, 20 nt, Homo sapiens
uucucuaacaagcuauggga

SEQ ID NO: 1583008 - RNA, 15 nt, Homo sapiens
uucucuaaugcagcu

SEQ ID NO: 1583009 - RNA, 20 nt, Homo sapiens
uucucuaauguuguaucaua

SEQ ID NO: 1583010 - RNA, 20 nt, Homo sapiens
uucucucauagaacauugau

SEQ ID NO: 1583011 - RNA, 19 nt, Homo sapiens
uucucuccccuccucugaa

SEQ ID NO: 1583012 - RNA, 18 nt, Homo sapiens
uucucugcaauuuuacug

SEQ ID NO: 1583013 - RNA, 17 nt, Homo sapiens
uucucugcuccaccaca

SEQ ID NO: 1583014 - RNA, 22 nt, Homo sapiens
uucucuucacagucacauucca

SEQ ID NO: 1583015 - RNA, 17 nt, Homo sapiens
uucucuuugguguuaca

SEQ ID NO: 1583016 - RNA, 21 nt, Homo sapiens
uucugaaagaaucauuugcau

SEQ ID NO: 1583017 - RNA, 14 nt, Homo sapiens
uucugaagaucaau

SEQ ID NO: 1583018 - RNA, 23 nt, Homo sapiens
uucugaggcccugcccaaugaga

SEQ ID NO: 1583019 - RNA, 19 nt, Homo sapiens
uucugauguguucucugau

SEQ ID NO: 1583020 - RNA, 22 nt, Homo sapiens
uucugauuugucccuaugcaua

SEQ ID NO: 1583021 - RNA, 22 nt, Homo sapiens
uucugcaacaucuuaagaucca

SEQ ID NO: 1583022 - RNA, 23 nt, Homo sapiens
uucugcaacaucuuaagauccac

SEQ ID NO: 1583023 - RNA, 17 nt, Homo sapiens
uucugcaccacaccugg

SEQ ID NO: 1583024 - RNA, 11 nt, Homo sapiens
uucugccaaaa

SEQ ID NO: 1583025 - RNA, 19 nt, Homo sapiens
uucugccuucucaugaucc

SEQ ID NO: 1583026 - RNA, 13 nt, Homo sapiens
uucugcucuggaa

SEQ ID NO: 1583027 - RNA, 20 nt, Homo sapiens
uucuggauggugugccuucc

SEQ ID NO: 1583028 - RNA, 22 nt, Homo sapiens
uucuggcuacugcacucuccac

SEQ ID NO: 1583029 - RNA, 17 nt, Homo sapiens
uucuggugcuacuccau

SEQ ID NO: 1583030 - RNA, 17 nt, Homo sapiens
uucuggugucugcucag

SEQ ID NO: 1583031 - RNA, 15 nt, Homo sapiens
uucugguuucuucca

SEQ ID NO: 1583032 - RNA, 23 nt, Homo sapiens
uucugucaagcuggugcuacugu

SEQ ID NO: 1583033 - RNA, 10 nt, Homo sapiens
uucugucacc

SEQ ID NO: 1583034 - RNA, 16 nt, Homo sapiens
uucugucccacuacau

SEQ ID NO: 1583035 - RNA, 15 nt, Homo sapiens
uucuguccuaaucau

SEQ ID NO: 1583036 - RNA, 12 nt, Homo sapiens
uucuguccugua

SEQ ID NO: 1583037 - RNA, 14 nt, Homo sapiens
uucugugucccaug

SEQ ID NO: 1583038 - RNA, 16 nt, Homo sapiens
uucuguugaaguuuac

SEQ ID NO: 1583039 - RNA, 22 nt, Homo sapiens
uucuguuuuuaaugcuauuuga

SEQ ID NO: 1583040 - RNA, 16 nt, Homo sapiens
uucuuaaccuuugcua

SEQ ID NO: 1583041 - RNA, 18 nt, Homo sapiens
uucuuacacugugucauu

SEQ ID NO: 1583042 - RNA, 13 nt, Homo sapiens
uucuuagaccucc

SEQ ID NO: 1583043 - RNA, 17 nt, Homo sapiens
uucuuauuuugcuacug

SEQ ID NO: 1583044 - RNA, 17 nt, Homo sapiens
uucuuauuuuuguacuu

SEQ ID NO: 1583045 - RNA, 19 nt, Homo sapiens
uucuucagguaacacuaca

SEQ ID NO: 1583046 - RNA, 15 nt, Homo sapiens
uucuucauccauaga

SEQ ID NO: 1583047 - RNA, 18 nt, Homo sapiens
uucuucaugaaauguguu

SEQ ID NO: 1583048 - RNA, 15 nt, Homo sapiens
uucuucauguacaga

SEQ ID NO: 1583049 - RNA, 13 nt, Homo sapiens
uucuucaugucau

SEQ ID NO: 1583050 - RNA, 17 nt, Homo sapiens
uucuuccaaacaggcuc

SEQ ID NO: 1583051 - RNA, 15 nt, Homo sapiens
uucuucuagugcuuu

SEQ ID NO: 1583052 - RNA, 13 nt, Homo sapiens
uucuugacaauca

SEQ ID NO: 1583053 - RNA, 18 nt, Homo sapiens
uucuugacaaucaucucc

SEQ ID NO: 1583054 - RNA, 15 nt, Homo sapiens
uucuugaggucuuga

SEQ ID NO: 1583055 - RNA, 14 nt, Homo sapiens
uucuuguugcugca

SEQ ID NO: 1583056 - RNA, 19 nt, Homo sapiens
uucuuguugcugcaucucc

SEQ ID NO: 1583057 - RNA, 17 nt, Homo sapiens
uucuuguuucucaugaa

SEQ ID NO: 1583058 - RNA, 17 nt, Homo sapiens
uucuuuauauugucauu

SEQ ID NO: 1583059 - RNA, 18 nt, Homo sapiens
uucuuucaaccuauacaa

SEQ ID NO: 1583060 - RNA, 16 nt, Homo sapiens
uucuuucccauguauu

SEQ ID NO: 1583061 - RNA, 12 nt, Homo sapiens
uucuuugcaaag

SEQ ID NO: 1583062 - RNA, 15 nt, Homo sapiens
uucuuuucuuuacaa

SEQ ID NO: 1583063 - RNA, 14 nt, Homo sapiens
uucuuuucuuuaua

SEQ ID NO: 1583064 - RNA, 19 nt, Homo sapiens
uucuuuugaaucaaucugg

SEQ ID NO: 1583065 - RNA, 20 nt, Homo sapiens
uucuuuuuccacaaggaaua

SEQ ID NO: 1583066 - RNA, 18 nt, Homo sapiens
uucuuuuucuacauguga

SEQ ID NO: 1583067 - RNA, 16 nt, Homo sapiens
uucuuuuucuguugaa

SEQ ID NO: 1583068 - RNA, 18 nt, Homo sapiens
uucuuuuugaaaugucaa

SEQ ID NO: 1583069 - RNA, 20 nt, Homo sapiens
uugaaaaaaaacaguggauc

SEQ ID NO: 1583070 - RNA, 21 nt, Homo sapiens
uugaaaaaaacuucauucucg

SEQ ID NO: 1583071 - RNA, 12 nt, Homo sapiens
uugaaaaacuaa

SEQ ID NO: 1583072 - RNA, 18 nt, Homo sapiens
uugaaacuaucucaugcc

SEQ ID NO: 1583073 - RNA, 12 nt, Homo sapiens
uugaaacuguau

SEQ ID NO: 1583074 - RNA, 15 nt, Homo sapiens
uugaaagaaauggug

SEQ ID NO: 1583075 - RNA, 21 nt, Homo sapiens
uugaaagaaauuuggcuauaa

SEQ ID NO: 1583076 - RNA, 18 nt, Homo sapiens
uugaaaguuaacauuaau

SEQ ID NO: 1583077 - RNA, 23 nt, Homo sapiens
uugaaauauucagaaauucucca

SEQ ID NO: 1583078 - RNA, 21 nt, Homo sapiens
uugaaaugaugguaaguuaau

SEQ ID NO: 1583079 - RNA, 20 nt, Homo sapiens
uugaaauuaagaaggcaaaa

SEQ ID NO: 1583080 - RNA, 18 nt, Homo sapiens
uugaacuacagcuugaga

SEQ ID NO: 1583081 - RNA, 18 nt, Homo sapiens
uugaacuaggcugagcaa

SEQ ID NO: 1583082 - RNA, 19 nt, Homo sapiens
uugaacuuuaagaagcagu

SEQ ID NO: 1583083 - RNA, 22 nt, Homo sapiens
uugaagauuuaugaugcacuua

SEQ ID NO: 1583084 - RNA, 14 nt, Homo sapiens
uugaagccaaagaa

SEQ ID NO: 1583085 - RNA, 14 nt, Homo sapiens
uugaagcccaagaa

SEQ ID NO: 1583086 - RNA, 19 nt, Homo sapiens
uugaaguccuccagacaac

SEQ ID NO: 1583087 - RNA, 14 nt, Homo sapiens
uugaagugagcuga

SEQ ID NO: 1583088 - RNA, 13 nt, Homo sapiens
uugaaguuuacaa

SEQ ID NO: 1583089 - RNA, 15 nt, Homo sapiens
uugaauauuacuccu

SEQ ID NO: 1583090 - RNA, 12 nt, Homo sapiens
uugaaugugauu

SEQ ID NO: 1583091 - RNA, 19 nt, Homo sapiens
uugaauugaugaugcaguu

SEQ ID NO: 1583092 - RNA, 23 nt, Homo sapiens
uugaauuguuacaucaugcugga

SEQ ID NO: 1583093 - RNA, 15 nt, Homo sapiens
uugaauuucagaaaa

SEQ ID NO: 1583094 - RNA, 12 nt, Homo sapiens
uugacaaacaca

SEQ ID NO: 1583095 - RNA, 18 nt, Homo sapiens
uugacacugaaaguuuug

SEQ ID NO: 1583096 - RNA, 22 nt, Homo sapiens
uugacacuuuucauaucauuuc

SEQ ID NO: 1583097 - RNA, 11 nt, Homo sapiens
uugaccaaaga

SEQ ID NO: 1583098 - RNA, 18 nt, Homo sapiens
uugaccauauagauuuua

SEQ ID NO: 1583099 - RNA, 22 nt, Homo sapiens
uugacuagaugauggaugccaa

SEQ ID NO: 1583100 - RNA, 22 nt, Homo sapiens
uugacuagggauucaggcugcu

SEQ ID NO: 1583101 - RNA, 12 nt, Homo sapiens
uugacugcauug

SEQ ID NO: 1583102 - RNA, 16 nt, Homo sapiens
uugagacagagggcaa

SEQ ID NO: 1583103 - RNA, 14 nt, Homo sapiens
uugagagccagugg

SEQ ID NO: 1583104 - RNA, 15 nt, Homo sapiens
uugagauggagcuuu

SEQ ID NO: 1583105 - RNA, 22 nt, Homo sapiens
uugagccacuccuuccuucagg

SEQ ID NO: 1583106 - RNA, 17 nt, Homo sapiens
uugagcuaguuacauaa

SEQ ID NO: 1583107 - RNA, 13 nt, Homo sapiens
uugaggccaaaca

SEQ ID NO: 1583108 - RNA, 15 nt, Homo sapiens
uugagggcaauggac

SEQ ID NO: 1583109 - RNA, 15 nt, Homo sapiens
uugagguaucacugc

SEQ ID NO: 1583110 - RNA, 18 nt, Homo sapiens
uugagguaucacugcagu

SEQ ID NO: 1583111 - RNA, 22 nt, Homo sapiens
uugagugugauuugaaugauuu

SEQ ID NO: 1583112 - RNA, 23 nt, Homo sapiens
uugauaagcuauugucuguaaua

SEQ ID NO: 1583113 - RNA, 17 nt, Homo sapiens
uugauagaaccauugca

SEQ ID NO: 1583114 - RNA, 13 nt, Homo sapiens
uugauagauuucu

SEQ ID NO: 1583115 - RNA, 21 nt, Homo sapiens
uugauagauuucuacacugag

SEQ ID NO: 1583116 - RNA, 16 nt, Homo sapiens
uugauaguuuggcuau

SEQ ID NO: 1583117 - RNA, 19 nt, Homo sapiens
uugauauugccacccucca

SEQ ID NO: 1583118 - RNA, 18 nt, Homo sapiens
uugauauuuaauuaugaa

SEQ ID NO: 1583119 - RNA, 13 nt, Homo sapiens
uugaucagacagc

SEQ ID NO: 1583120 - RNA, 21 nt, Homo sapiens
aguccaaggccaguccccauu

SEQ ID NO: 1583121 - RNA, 20 nt, Homo sapiens
aguccaauuccuugcacaua

SEQ ID NO: 1583122 - RNA, 20 nt, Homo sapiens
aguccacaagaacaauucaa

SEQ ID NO: 1583123 - RNA, 13 nt, Homo sapiens
aguccacaggcuc

SEQ ID NO: 1583124 - RNA, 21 nt, Homo sapiens
aguccagaccccccagccccu

SEQ ID NO: 1583125 - RNA, 18 nt, Homo sapiens
aguccaucuaacaucaua

SEQ ID NO: 1583126 - RNA, 14 nt, Homo sapiens
aguccaugcuccag

SEQ ID NO: 1583127 - RNA, 22 nt, Homo sapiens
agucccagacaauuccauucaa

SEQ ID NO: 1583128 - RNA, 18 nt, Homo sapiens
aguccuaacuuccugugc

SEQ ID NO: 1583129 - RNA, 22 nt, Homo sapiens
aguccuagaauguuucauuugc

SEQ ID NO: 1583130 - RNA, 15 nt, Homo sapiens
aguccucaguucucu

SEQ ID NO: 1583131 - RNA, 23 nt, Homo sapiens
aguccuguaguuuuauuuuaugu

SEQ ID NO: 1583132 - RNA, 19 nt, Homo sapiens
aguccuuuuugucaugccc

SEQ ID NO: 1583133 - RNA, 16 nt, Homo sapiens
agucggccccaucucu

SEQ ID NO: 1583134 - RNA, 19 nt, Homo sapiens
agucggccccaucucucau

SEQ ID NO: 1583135 - RNA, 17 nt, Homo sapiens
agucuauguauguguaa

SEQ ID NO: 1583136 - RNA, 23 nt, Homo sapiens
agucucacugugggaaggccagc

SEQ ID NO: 1583137 - RNA, 21 nt, Homo sapiens
agucucacuuuuauugauaaa

SEQ ID NO: 1583138 - RNA, 23 nt, Homo sapiens
agucucaggacagaaccacugag

SEQ ID NO: 1583139 - RNA, 14 nt, Homo sapiens
agucucagucugau

SEQ ID NO: 1583140 - RNA, 16 nt, Homo sapiens
agucucauagcuuugg

SEQ ID NO: 1583141 - RNA, 16 nt, Homo sapiens
agucuccucacucugu

SEQ ID NO: 1583142 - RNA, 19 nt, Homo sapiens
agucucucucuuccucaca

SEQ ID NO: 1583143 - RNA, 14 nt, Homo sapiens
agucugaaacuggc

SEQ ID NO: 1583144 - RNA, 16 nt, Homo sapiens
agucugauuguagcua

SEQ ID NO: 1583145 - RNA, 13 nt, Homo sapiens
agucugcucugcu

SEQ ID NO: 1583146 - RNA, 22 nt, Homo sapiens
agucuggcaaugggacucugag

SEQ ID NO: 1583147 - RNA, 19 nt, Homo sapiens
agucugugugggacuguac

SEQ ID NO: 1583148 - RNA, 21 nt, Homo sapiens
agucuuaagggucacuggccu

SEQ ID NO: 1583149 - RNA, 21 nt, Homo sapiens
agucuuagcuccuguguuaca

SEQ ID NO: 1583150 - RNA, 19 nt, Homo sapiens
agucuuccugacacuuuaa

SEQ ID NO: 1583151 - RNA, 16 nt, Homo sapiens
agucuuguauuaaguu

SEQ ID NO: 1583152 - RNA, 14 nt, Homo sapiens
agucuugugccaaa

SEQ ID NO: 1583153 - RNA, 22 nt, Homo sapiens
agucuugugccaaaccuacuag

SEQ ID NO: 1583154 - RNA, 17 nt, Homo sapiens
agucuuuagcuauuacu

SEQ ID NO: 1583155 - RNA, 12 nt, Homo sapiens
agugaaccaaaa

SEQ ID NO: 1583156 - RNA, 13 nt, Homo sapiens
agugaaucuugcu

SEQ ID NO: 1583157 - RNA, 19 nt, Homo sapiens
agugacaagggcacaagcu

SEQ ID NO: 1583158 - RNA, 21 nt, Homo sapiens
agugacaagggcacaagcuca

SEQ ID NO: 1583159 - RNA, 22 nt, Homo sapiens
agugacauaauuguccaguuau

SEQ ID NO: 1583160 - RNA, 23 nt, Homo sapiens
agugacgggugcccguaauccca

SEQ ID NO: 1583161 - RNA, 18 nt, Homo sapiens
agugagacuccaucucaa

SEQ ID NO: 1583162 - RNA, 12 nt, Homo sapiens
agugagcacuag

SEQ ID NO: 1583163 - RNA, 12 nt, Homo sapiens
agugagccagca

SEQ ID NO: 1583164 - RNA, 20 nt, Homo sapiens
agugagccgagaucaugcca

SEQ ID NO: 1583165 - RNA, 18 nt, Homo sapiens
agugaggcaggagaagaa

SEQ ID NO: 1583166 - RNA, 15 nt, Homo sapiens
agugaucaccugcca

SEQ ID NO: 1583167 - RNA, 12 nt, Homo sapiens
agugauggagcu

SEQ ID NO: 1583168 - RNA, 12 nt, Homo sapiens
agugauguaauc

SEQ ID NO: 1583169 - RNA, 17 nt, Homo sapiens
agugauucccaacuccu

SEQ ID NO: 1583170 - RNA, 15 nt, Homo sapiens
agugauucucuugcc

SEQ ID NO: 1583171 - RNA, 14 nt, Homo sapiens
agugcaauggguaa

SEQ ID NO: 1583172 - RNA, 14 nt, Homo sapiens
agugcacuacugua

SEQ ID NO: 1583173 - RNA, 12 nt, Homo sapiens
agugcagccacu

SEQ ID NO: 1583174 - RNA, 18 nt, Homo sapiens
agugcagcugcugugccu

SEQ ID NO: 1583175 - RNA, 17 nt, Homo sapiens
agugcaggugcaguuuc

SEQ ID NO: 1583176 - RNA, 19 nt, Homo sapiens
agugcaguggcgugaucuc

SEQ ID NO: 1583177 - RNA, 20 nt, Homo sapiens
agugcaguggcgugaucucg

SEQ ID NO: 1583178 - RNA, 20 nt, Homo sapiens
agugcaguggugugaucucg

SEQ ID NO: 1583179 - RNA, 10 nt, Homo sapiens
agugcaguuu

SEQ ID NO: 1583180 - RNA, 20 nt, Homo sapiens
agugcaugggacccacgaaa

SEQ ID NO: 1583181 - RNA, 12 nt, Homo sapiens
agugcauucucc

SEQ ID NO: 1583182 - RNA, 16 nt, Homo sapiens
agugcauuugugcuag

SEQ ID NO: 1583183 - RNA, 16 nt, Homo sapiens
agugccagguggcuca

SEQ ID NO: 1583184 - RNA, 22 nt, Homo sapiens
agugccauugucuuuauaugaa

SEQ ID NO: 1583185 - RNA, 16 nt, Homo sapiens
agugcccucucugaac

SEQ ID NO: 1583186 - RNA, 20 nt, Homo sapiens
agugcccucucugaaccuca

SEQ ID NO: 1583187 - RNA, 19 nt, Homo sapiens
agugccuccuguggucuca

SEQ ID NO: 1583188 - RNA, 21 nt, Homo sapiens
agugccucuguuuuccagaag

SEQ ID NO: 1583189 - RNA, 16 nt, Homo sapiens
agugccuggguggaug

SEQ ID NO: 1583190 - RNA, 14 nt, Homo sapiens
agugcuggucagag

SEQ ID NO: 1583191 - RNA, 23 nt, Homo sapiens
agugcuugcagaucaucugggga

SEQ ID NO: 1583192 - RNA, 17 nt, Homo sapiens
agugcuuuucagugaua

SEQ ID NO: 1583193 - RNA, 21 nt, Homo sapiens
agugcuuuucagugauacuca

SEQ ID NO: 1583194 - RNA, 18 nt, Homo sapiens
aguggaaauuaagacuuu

SEQ ID NO: 1583195 - RNA, 14 nt, Homo sapiens
aguggacuccugaa

SEQ ID NO: 1583196 - RNA, 16 nt, Homo sapiens
aguggaguuggugaau

SEQ ID NO: 1583197 - RNA, 18 nt, Homo sapiens
aguggcauaccaaauggc

SEQ ID NO: 1583198 - RNA, 23 nt, Homo sapiens
aguggcgcaugccuguaauccca

SEQ ID NO: 1583199 - RNA, 23 nt, Homo sapiens
aguggcggggggguuuugccuaa

SEQ ID NO: 1583200 - RNA, 15 nt, Homo sapiens
aguggcgugaucucg

SEQ ID NO: 1583201 - RNA, 20 nt, Homo sapiens
aguggcgugaucucggcuca

SEQ ID NO: 1583202 - RNA, 19 nt, Homo sapiens
aguggcucagaccccucag

SEQ ID NO: 1583203 - RNA, 16 nt, Homo sapiens
aguggcugcucuggga

SEQ ID NO: 1583204 - RNA, 14 nt, Homo sapiens
aguggcuucaucug

SEQ ID NO: 1583205 - RNA, 20 nt, Homo sapiens
agugggcuucggagugaaug

SEQ ID NO: 1583206 - RNA, 15 nt, Homo sapiens
agugggguagguugg

SEQ ID NO: 1583207 - RNA, 16 nt, Homo sapiens
aguggugguauguaau

SEQ ID NO: 1583208 - RNA, 18 nt, Homo sapiens
agugguguaggugggggu

SEQ ID NO: 1583209 - RNA, 20 nt, Homo sapiens
aguggugugaucucggcuca

SEQ ID NO: 1583210 - RNA, 18 nt, Homo sapiens
agugguuaacagagcuaa

SEQ ID NO: 1583211 - RNA, 22 nt, Homo sapiens
agugguuagagcugcucagccu

SEQ ID NO: 1583212 - RNA, 13 nt, Homo sapiens
agugguucaagca

SEQ ID NO: 1583213 - RNA, 19 nt, Homo sapiens
agugguucaagcacacugg

SEQ ID NO: 1583214 - RNA, 15 nt, Homo sapiens
aguguaccauuugcc

SEQ ID NO: 1583215 - RNA, 17 nt, Homo sapiens
aguguagcuaccuacau

SEQ ID NO: 1583216 - RNA, 20 nt, Homo sapiens
aguguagcuaccuacaugcu

SEQ ID NO: 1583217 - RNA, 17 nt, Homo sapiens
aguguaugauuacuggc

SEQ ID NO: 1583218 - RNA, 17 nt, Homo sapiens
ugaaauuaagaaggcaa

SEQ ID NO: 1583219 - RNA, 17 nt, Homo sapiens
ugaaauucacaguaaua

SEQ ID NO: 1583220 - RNA, 19 nt, Homo sapiens
ugaaauucugaauuugcaa

SEQ ID NO: 1583221 - RNA, 18 nt, Homo sapiens
ugaaauuuccuaauuuau

SEQ ID NO: 1583222 - RNA, 15 nt, Homo sapiens
ugaaauuuggcaaag

SEQ ID NO: 1583223 - RNA, 15 nt, Homo sapiens
ugaacaaacaaugaa

SEQ ID NO: 1583224 - RNA, 15 nt, Homo sapiens
ugaacaaaugacauc

SEQ ID NO: 1583225 - RNA, 23 nt, Homo sapiens
ugaacaaauuuacagagacagaa

SEQ ID NO: 1583226 - RNA, 21 nt, Homo sapiens
ugaacaaauuuucuggugcua

SEQ ID NO: 1583227 - RNA, 12 nt, Homo sapiens
ugaacacaucuu

SEQ ID NO: 1583228 - RNA, 21 nt, Homo sapiens
ugaacacucuuuugcuuuauu

SEQ ID NO: 1583229 - RNA, 11 nt, Homo sapiens
ugaacauggaa

SEQ ID NO: 1583230 - RNA, 13 nt, Homo sapiens
ugaacuaauuuca

SEQ ID NO: 1583231 - RNA, 18 nt, Homo sapiens
ugaacugacaaugaaggg

SEQ ID NO: 1583232 - RNA, 16 nt, Homo sapiens
ugaacuuuuguacuga

SEQ ID NO: 1583233 - RNA, 23 nt, Homo sapiens
ugaagacaccaucuccaugugac

SEQ ID NO: 1583234 - RNA, 14 nt, Homo sapiens
ugaagagagcauuu

SEQ ID NO: 1583235 - RNA, 14 nt, Homo sapiens
ugaagaguuucaca

SEQ ID NO: 1583236 - RNA, 20 nt, Homo sapiens
ugaagauaagaaaugaucuu

SEQ ID NO: 1583237 - RNA, 17 nt, Homo sapiens
ugaagauauuacuacuu

SEQ ID NO: 1583238 - RNA, 18 nt, Homo sapiens
ugaagauauuacuacuua

SEQ ID NO: 1583239 - RNA, 15 nt, Homo sapiens
ugaagaugcucugug

SEQ ID NO: 1583240 - RNA, 19 nt, Homo sapiens
ugaagauuuaugaugcacu

SEQ ID NO: 1583241 - RNA, 16 nt, Homo sapiens
ugaagcaaaucagaaa

SEQ ID NO: 1583242 - RNA, 15 nt, Homo sapiens
ugaagcagcacugug

SEQ ID NO: 1583243 - RNA, 16 nt, Homo sapiens
ugaagcagucuugcuc

SEQ ID NO: 1583244 - RNA, 22 nt, Homo sapiens
ugaagcuucggccgcgccaccc

SEQ ID NO: 1583245 - RNA, 22 nt, Homo sapiens
ugaaggaagagaagacauuugc

SEQ ID NO: 1583246 - RNA, 14 nt, Homo sapiens
ugaaggcauaugca

SEQ ID NO: 1583247 - RNA, 22 nt, Homo sapiens
ugaaggcgcugacacuggcaga

SEQ ID NO: 1583248 - RNA, 19 nt, Homo sapiens
ugaagguagaauguuuuca

SEQ ID NO: 1583249 - RNA, 18 nt, Homo sapiens
ugaaguacaaacaugaaa

SEQ ID NO: 1583250 - RNA, 16 nt, Homo sapiens
ugaaguauauauauca

SEQ ID NO: 1583251 - RNA, 18 nt, Homo sapiens
ugaagucaccgggaugaa

SEQ ID NO: 1583252 - RNA, 16 nt, Homo sapiens
ugaaguuaugcuguca

SEQ ID NO: 1583253 - RNA, 20 nt, Homo sapiens
ugaaguucugagauacugaa

SEQ ID NO: 1583254 - RNA, 15 nt, Homo sapiens
ugaaguuuaaacucu

SEQ ID NO: 1583255 - RNA, 15 nt, Homo sapiens
ugaaguuuacaauca

SEQ ID NO: 1583256 - RNA, 20 nt, Homo sapiens
ugaauaacauuuaaauucca

SEQ ID NO: 1583257 - RNA, 22 nt, Homo sapiens
ugaauaacauuuaaauuccaca

SEQ ID NO: 1583258 - RNA, 19 nt, Homo sapiens
ugaauaagacaacaaagag

SEQ ID NO: 1583259 - RNA, 21 nt, Homo sapiens
ugaauaagcagaacauacugu

SEQ ID NO: 1583260 - RNA, 22 nt, Homo sapiens
ugaauacugcauuuacagugua

SEQ ID NO: 1583261 - RNA, 23 nt, Homo sapiens
ugaauagccuggccaccagccau

SEQ ID NO: 1583262 - RNA, 20 nt, Homo sapiens
ugaauaguuuauuucuguga

SEQ ID NO: 1583263 - RNA, 21 nt, Homo sapiens
ugaauauaaauguuuuacuca

SEQ ID NO: 1583264 - RNA, 23 nt, Homo sapiens
ugaauauaaauguuuuacucaga

SEQ ID NO: 1583265 - RNA, 14 nt, Homo sapiens
ugaauauuacuccu

SEQ ID NO: 1583266 - RNA, 15 nt, Homo sapiens
ugaauauuacuccua

SEQ ID NO: 1583267 - RNA, 19 nt, Homo sapiens
ugaaucauauucauaugca

SEQ ID NO: 1583268 - RNA, 19 nt, Homo sapiens
ugaaucugagagucauuca

SEQ ID NO: 1583269 - RNA, 13 nt, Homo sapiens
ugaaugaucuugu

SEQ ID NO: 1583270 - RNA, 19 nt, Homo sapiens
ugaaugaucuuguguaagg

SEQ ID NO: 1583271 - RNA, 14 nt, Homo sapiens
ugaaugaugugaua

SEQ ID NO: 1583272 - RNA, 21 nt, Homo sapiens
ugaauggaggcagagaccucc

SEQ ID NO: 1583273 - RNA, 11 nt, Homo sapiens
ugaaugugauu

SEQ ID NO: 1583274 - RNA, 17 nt, Homo sapiens
ugaauguugcaauguga

SEQ ID NO: 1583275 - RNA, 19 nt, Homo sapiens
ugaauguuuaccaugaaga

SEQ ID NO: 1583276 - RNA, 14 nt, Homo sapiens
ugaauuaagccauc

SEQ ID NO: 1583277 - RNA, 15 nt, Homo sapiens
ugaauuaagcccaau

SEQ ID NO: 1583278 - RNA, 14 nt, Homo sapiens
ugaauuuucagaga

SEQ ID NO: 1583279 - RNA, 22 nt, Homo sapiens
ugaauuuugggacuucuaccca

SEQ ID NO: 1583280 - RNA, 19 nt, Homo sapiens
ugaauuuuuaagcugcaaa

SEQ ID NO: 1583281 - RNA, 16 nt, Homo sapiens
ugaauuuuuaugauau

SEQ ID NO: 1583282 - RNA, 19 nt, Homo sapiens
ugacaaauaagauuaauaa

SEQ ID NO: 1583283 - RNA, 19 nt, Homo sapiens
ugacaaaugacgucuucac

SEQ ID NO: 1583284 - RNA, 16 nt, Homo sapiens
ugacaacaucgcaaua

SEQ ID NO: 1583285 - RNA, 23 nt, Homo sapiens
ugacaaccgcaacaacaaaaaca

SEQ ID NO: 1583286 - RNA, 17 nt, Homo sapiens
ugacaaccuccauucua

SEQ ID NO: 1583287 - RNA, 19 nt, Homo sapiens
ugacaaccugaauuaucua

SEQ ID NO: 1583288 - RNA, 18 nt, Homo sapiens
ugacaagaacaaagccac

SEQ ID NO: 1583289 - RNA, 16 nt, Homo sapiens
ugacaauaaaaacaau

SEQ ID NO: 1583290 - RNA, 16 nt, Homo sapiens
ugacaauguugcauuu

SEQ ID NO: 1583291 - RNA, 22 nt, Homo sapiens
ugacacccuggccugaacugag

SEQ ID NO: 1583292 - RNA, 15 nt, Homo sapiens
ugacacgucucgcca

SEQ ID NO: 1583293 - RNA, 20 nt, Homo sapiens
ugacacucccuugggcuccc

SEQ ID NO: 1583294 - RNA, 15 nt, Homo sapiens
ugacacuccuuucag

SEQ ID NO: 1583295 - RNA, 23 nt, Homo sapiens
ugacagaaagcagauaccucacc

SEQ ID NO: 1583296 - RNA, 21 nt, Homo sapiens
ugacagagaugugcauguggg

SEQ ID NO: 1583297 - RNA, 22 nt, Homo sapiens
ugacagagcgagacuccaucuc

SEQ ID NO: 1583298 - RNA, 19 nt, Homo sapiens
ugacagcucccgggucccc

SEQ ID NO: 1583299 - RNA, 16 nt, Homo sapiens
ugacaggaaagcccuc

SEQ ID NO: 1583300 - RNA, 17 nt, Homo sapiens
ugacaguaucuuuuuuc

SEQ ID NO: 1583301 - RNA, 11 nt, Homo sapiens
ugacaguauua

SEQ ID NO: 1583302 - RNA, 21 nt, Homo sapiens
ugacagucauaaauacuguca

SEQ ID NO: 1583303 - RNA, 22 nt, Homo sapiens
ugacagucauaaauacugucaa

SEQ ID NO: 1583304 - RNA, 18 nt, Homo sapiens
ugacauauaucuauuaca

SEQ ID NO: 1583305 - RNA, 19 nt, Homo sapiens
ugacaucaaacuugugagg

SEQ ID NO: 1583306 - RNA, 21 nt, Homo sapiens
ugacaucauucagcgcaugca

SEQ ID NO: 1583307 - RNA, 23 nt, Homo sapiens
ugacaugggccuuuaagaaccuu

SEQ ID NO: 1583308 - RNA, 14 nt, Homo sapiens
ugacauucacugag

SEQ ID NO: 1583309 - RNA, 14 nt, Homo sapiens
ugacauuccuucuc

SEQ ID NO: 1583310 - RNA, 17 nt, Homo sapiens
ugaccaaagagcccuca

SEQ ID NO: 1583311 - RNA, 20 nt, Homo sapiens
ugaccaagauacuuaagugc

SEQ ID NO: 1583312 - RNA, 19 nt, Homo sapiens
ugaccaauauuguacaguu

SEQ ID NO: 1583313 - RNA, 15 nt, Homo sapiens
ugaccaaugugugaa

SEQ ID NO: 1583314 - RNA, 22 nt, Homo sapiens
ugaccaaugugugaaguaugca

SEQ ID NO: 1583315 - RNA, 18 nt, Homo sapiens
ugaccacauaagaaggca

SEQ ID NO: 1583316 - RNA, 19 nt, Homo sapiens
ugaccacguuuauguuuaa

SEQ ID NO: 1583317 - RNA, 11 nt, Homo sapiens
ugaccauuuga

SEQ ID NO: 1583318 - RNA, 16 nt, Homo sapiens
ugacccacacuuccau

SEQ ID NO: 1583319 - RNA, 12 nt, Homo sapiens
ugaccccagugu

SEQ ID NO: 1583320 - RNA, 17 nt, Homo sapiens
ugaccccuaaugcugca

SEQ ID NO: 1583321 - RNA, 19 nt, Homo sapiens
ugaccccugccaccuuccg

SEQ ID NO: 1583322 - RNA, 18 nt, Homo sapiens
ugacccuugcugugaauu

SEQ ID NO: 1583323 - RNA, 15 nt, Homo sapiens
ugaccgaacacugca

SEQ ID NO: 1583324 - RNA, 22 nt, Homo sapiens
ugaccgggcucacuugcucaaa

SEQ ID NO: 1583325 - RNA, 14 nt, Homo sapiens
ugaccuaaauuauu

SEQ ID NO: 1583326 - RNA, 15 nt, Homo sapiens
ugaccuaguuuucca

SEQ ID NO: 1583327 - RNA, 23 nt, Homo sapiens
ugaccucacuuuaggcagcugua

SEQ ID NO: 1583328 - RNA, 13 nt, Homo sapiens
ugaccucuugccu

SEQ ID NO: 1583329 - RNA, 16 nt, Homo sapiens
ugaccuuccaaagacu

SEQ ID NO: 1583330 - RNA, 20 nt, Homo sapiens
ugaccuuggaggaaugacaa

SEQ ID NO: 1583331 - RNA, 18 nt, Homo sapiens
ugaccuugggguacaauu

SEQ ID NO: 1583332 - RNA, 22 nt, Homo sapiens
ugacgcaaagaucaccagccau

SEQ ID NO: 1583333 - RNA, 16 nt, Homo sapiens
ugacggguugugagac

SEQ ID NO: 1583334 - RNA, 19 nt, Homo sapiens
ugacuaaagguuaccuguu

SEQ ID NO: 1583335 - RNA, 23 nt, Homo sapiens
ugacuaaguuuuuauaccagcuu

SEQ ID NO: 1583336 - RNA, 22 nt, Homo sapiens
ucuuaugauuacuaucauggca

SEQ ID NO: 1583337 - RNA, 14 nt, Homo sapiens
ucuuauuaaucaua

SEQ ID NO: 1583338 - RNA, 18 nt, Homo sapiens
ucuuauuaaucauacaaa

SEQ ID NO: 1583339 - RNA, 22 nt, Homo sapiens
ucuuauuuucaaagcaguauag

SEQ ID NO: 1583340 - RNA, 22 nt, Homo sapiens
ucuucaaggaggcccacugugu

SEQ ID NO: 1583341 - RNA, 18 nt, Homo sapiens
ucuucacaggcacuccug

SEQ ID NO: 1583342 - RNA, 18 nt, Homo sapiens
ucuucaccaagugcaaua

SEQ ID NO: 1583343 - RNA, 12 nt, Homo sapiens
ucuucaggccau

SEQ ID NO: 1583344 - RNA, 14 nt, Homo sapiens
ucuucaugcuugac

SEQ ID NO: 1583345 - RNA, 12 nt, Homo sapiens
ucuucauuaccu

SEQ ID NO: 1583346 - RNA, 11 nt, Homo sapiens
ucuucauucag

SEQ ID NO: 1583347 - RNA, 19 nt, Homo sapiens
ucuuccacaaaaaauacuu

SEQ ID NO: 1583348 - RNA, 17 nt, Homo sapiens
ucuuccauuugcaaggg

SEQ ID NO: 1583349 - RNA, 20 nt, Homo sapiens
ucuucccagcacuaugcuuu

SEQ ID NO: 1583350 - RNA, 13 nt, Homo sapiens
ucuuccccagaga

SEQ ID NO: 1583351 - RNA, 13 nt, Homo sapiens
ucuucccuaccuc

SEQ ID NO: 1583352 - RNA, 15 nt, Homo sapiens
ucuucccuaccucag

SEQ ID NO: 1583353 - RNA, 23 nt, Homo sapiens
ucuuccguggucagagugccacu

SEQ ID NO: 1583354 - RNA, 23 nt, Homo sapiens
ucuuccuccgaggccaguaccuu

SEQ ID NO: 1583355 - RNA, 21 nt, Homo sapiens
ucuucguagguugugaugaua

SEQ ID NO: 1583356 - RNA, 14 nt, Homo sapiens
ucuucuaaacuucc

SEQ ID NO: 1583357 - RNA, 14 nt, Homo sapiens
ucuucuacuuuaag

SEQ ID NO: 1583358 - RNA, 14 nt, Homo sapiens
ucuucucguuuuca

SEQ ID NO: 1583359 - RNA, 15 nt, Homo sapiens
ucuucuggaucugcu

SEQ ID NO: 1583360 - RNA, 24 nt, Homo sapiens
ucuucuguaauauuuacaauguau

SEQ ID NO: 1583361 - RNA, 13 nt, Homo sapiens
ucuucugucccag

SEQ ID NO: 1583362 - RNA, 18 nt, Homo sapiens
ucuucuuagcugucaccu

SEQ ID NO: 1583363 - RNA, 12 nt, Homo sapiens
ucuugaaaaaga

SEQ ID NO: 1583364 - RNA, 23 nt, Homo sapiens
ucuugaagaauaaauucuaccuc

SEQ ID NO: 1583365 - RNA, 17 nt, Homo sapiens
ucuugaauuccucucaa

SEQ ID NO: 1583366 - RNA, 17 nt, Homo sapiens
ucuugacaaucaucucc

SEQ ID NO: 1583367 - RNA, 18 nt, Homo sapiens
ucuugacaaucaucucca

SEQ ID NO: 1583368 - RNA, 21 nt, Homo sapiens
ucuugaucggaaagcucuucc

SEQ ID NO: 1583369 - RNA, 15 nt, Homo sapiens
ucuugcagcuguaaa

SEQ ID NO: 1583370 - RNA, 10 nt, Homo sapiens
ucuugccuug

SEQ ID NO: 1583371 - RNA, 13 nt, Homo sapiens
ucuugcucuguca

SEQ ID NO: 1583372 - RNA, 16 nt, Homo sapiens
ucuugcuguugacaua

SEQ ID NO: 1583373 - RNA, 18 nt, Homo sapiens
ucuugcuguugacauauu

SEQ ID NO: 1583374 - RNA, 16 nt, Homo sapiens
ucuugcuucagaccau

SEQ ID NO: 1583375 - RNA, 17 nt, Homo sapiens
ucuuggaaaaggaacuc

SEQ ID NO: 1583376 - RNA, 17 nt, Homo sapiens
ucuuggaauuacaagcc

SEQ ID NO: 1583377 - RNA, 21 nt, Homo sapiens
ucuuggauuacuuuacaccuc

SEQ ID NO: 1583378 - RNA, 17 nt, Homo sapiens
ucuuggccuaaaccuca

SEQ ID NO: 1583379 - RNA, 19 nt, Homo sapiens
ucuugguucgauaccugga

SEQ ID NO: 1583380 - RNA, 15 nt, Homo sapiens
ucuuguaaaucuuuu

SEQ ID NO: 1583381 - RNA, 12 nt, Homo sapiens
ucuugugccaaa

SEQ ID NO: 1583382 - RNA, 16 nt, Homo sapiens
ucuuguguuaccugaa

SEQ ID NO: 1583383 - RNA, 18 nt, Homo sapiens
ucuuguuccugugcauug

SEQ ID NO: 1583384 - RNA, 19 nt, Homo sapiens
ucuuguucugagauucaau

SEQ ID NO: 1583385 - RNA, 14 nt, Homo sapiens
ucuuguugcucaaa

SEQ ID NO: 1583386 - RNA, 18 nt, Homo sapiens
ucuuguugcugcaucucc

SEQ ID NO: 1583387 - RNA, 17 nt, Homo sapiens
ucuuuaccuaauggucu

SEQ ID NO: 1583388 - RNA, 19 nt, Homo sapiens
ucuuuaccuaauggucucu

SEQ ID NO: 1583389 - RNA, 22 nt, Homo sapiens
ucuuuagagaauccguauugaa

SEQ ID NO: 1583390 - RNA, 18 nt, Homo sapiens
ucuuuagcuauuacugga

SEQ ID NO: 1583391 - RNA, 16 nt, Homo sapiens
ucuuuaucauugcuaa

SEQ ID NO: 1583392 - RNA, 23 nt, Homo sapiens
ucuuuauuauuccuagucuuucc

SEQ ID NO: 1583393 - RNA, 18 nt, Homo sapiens
ucuuuccaaaacauuucu

SEQ ID NO: 1583394 - RNA, 15 nt, Homo sapiens
ucuuuccaggcuucc

SEQ ID NO: 1583395 - RNA, 13 nt, Homo sapiens
ucuuucccaacac

SEQ ID NO: 1583396 - RNA, 17 nt, Homo sapiens
ucuuuccuuccuuccuc

SEQ ID NO: 1583397 - RNA, 19 nt, Homo sapiens
ucuuucuccagcagcugau

SEQ ID NO: 1583398 - RNA, 15 nt, Homo sapiens
ucuuucucucacugu

SEQ ID NO: 1583399 - RNA, 17 nt, Homo sapiens
ucuuucugagugccuuc

SEQ ID NO: 1583400 - RNA, 19 nt, Homo sapiens
ucuuucuuugcaccaaaga

SEQ ID NO: 1583401 - RNA, 18 nt, Homo sapiens
ucuuugacugucagcaag

SEQ ID NO: 1583402 - RNA, 14 nt, Homo sapiens
ucuuugcaaaguau

SEQ ID NO: 1583403 - RNA, 15 nt, Homo sapiens
ucuuugcaccaaaga

SEQ ID NO: 1583404 - RNA, 18 nt, Homo sapiens
ucuuugcagagccuuuua

SEQ ID NO: 1583405 - RNA, 18 nt, Homo sapiens
ucuuugcauguaagcucu

SEQ ID NO: 1583406 - RNA, 15 nt, Homo sapiens
ucuuugcugcaguca

SEQ ID NO: 1583407 - RNA, 13 nt, Homo sapiens
ucuuugcugccag

SEQ ID NO: 1583408 - RNA, 17 nt, Homo sapiens
ucuuuggaggcuuuuaa

SEQ ID NO: 1583409 - RNA, 23 nt, Homo sapiens
ucuuuguaauacuuucuauguga

SEQ ID NO: 1583410 - RNA, 14 nt, Homo sapiens
ucuuuguauugaca

SEQ ID NO: 1583411 - RNA, 19 nt, Homo sapiens
ucuuuguuuacaugaguuc

SEQ ID NO: 1583412 - RNA, 21 nt, Homo sapiens
ucuuuuaaaauaagcauuuag

SEQ ID NO: 1583413 - RNA, 15 nt, Homo sapiens
ucuuuuauaugcuaa

SEQ ID NO: 1583414 - RNA, 20 nt, Homo sapiens
ucuuuuuaaagcuuauccau

SEQ ID NO: 1583415 - RNA, 21 nt, Homo sapiens
ucuuuuuuaauaaacuacucu

SEQ ID NO: 1583416 - RNA, 20 nt, Homo sapiens
ucuuuuuuuuaauaaaccau

SEQ ID NO: 1583417 - RNA, 22 nt, Homo sapiens
ugaaaaaagguuguguagcugu

SEQ ID NO: 1583418 - RNA, 21 nt, Homo sapiens
ugaaaaaccuauuacuacuaa

SEQ ID NO: 1583419 - RNA, 19 nt, Homo sapiens
ugaaaacauguacuacagc

SEQ ID NO: 1583420 - RNA, 16 nt, Homo sapiens
ugaaaacucuuugcug

SEQ ID NO: 1583421 - RNA, 20 nt, Homo sapiens
ugaaaagagaaugaugcuca

SEQ ID NO: 1583422 - RNA, 19 nt, Homo sapiens
ugaaaagauacugaugcau

SEQ ID NO: 1583423 - RNA, 18 nt, Homo sapiens
ugaaaaggguguugcuaa

SEQ ID NO: 1583424 - RNA, 21 nt, Homo sapiens
ugaaaauaaagugucauccaa

SEQ ID NO: 1583425 - RNA, 20 nt, Homo sapiens
ugaaaauaaccaugaauaca

SEQ ID NO: 1583426 - RNA, 18 nt, Homo sapiens
ugaaaauauagacauucu

SEQ ID NO: 1583427 - RNA, 19 nt, Homo sapiens
ugaaaauauuuuguugccu

SEQ ID NO: 1583428 - RNA, 19 nt, Homo sapiens
ugaaaaugaaccauucaca

SEQ ID NO: 1583429 - RNA, 19 nt, Homo sapiens
ugaaaaugguccaggagaa

SEQ ID NO: 1583430 - RNA, 17 nt, Homo sapiens
ugaaaauguccaggaaa

SEQ ID NO: 1583431 - RNA, 19 nt, Homo sapiens
ugaaaauguuuuucugcca

SEQ ID NO: 1583432 - RNA, 13 nt, Homo sapiens
ugaaacagcugcc

SEQ ID NO: 1583433 - RNA, 14 nt, Homo sapiens
ugaaacaucauuuc

SEQ ID NO: 1583434 - RNA, 20 nt, Homo sapiens
ugaaaccaccgugaaccaga

SEQ ID NO: 1583435 - RNA, 21 nt, Homo sapiens
ugaaaccucccauuggccaaa

SEQ ID NO: 1583436 - RNA, 22 nt, Homo sapiens
ugaaacguaauuguacaagcag

SEQ ID NO: 1583437 - RNA, 11 nt, Homo sapiens
ugaaacuaaga

SEQ ID NO: 1583438 - RNA, 19 nt, Homo sapiens
ugaaacucauagacacuga

SEQ ID NO: 1583439 - RNA, 13 nt, Homo sapiens
ugaaagaaaccac

SEQ ID NO: 1583440 - RNA, 22 nt, Homo sapiens
ugaaagagcaagugacuuucua

SEQ ID NO: 1583441 - RNA, 16 nt, Homo sapiens
ugaaagggaucaucau

SEQ ID NO: 1583442 - RNA, 14 nt, Homo sapiens
ugaaaggguuugau

SEQ ID NO: 1583443 - RNA, 17 nt, Homo sapiens
ugaaaguggacaaggag

SEQ ID NO: 1583444 - RNA, 15 nt, Homo sapiens
ugaaaguuaacauua

SEQ ID NO: 1583445 - RNA, 14 nt, Homo sapiens
ugaaaguuaaucca

SEQ ID NO: 1583446 - RNA, 18 nt, Homo sapiens
ugaaaguuguacaugaua

SEQ ID NO: 1583447 - RNA, 23 nt, Homo sapiens
ugaaaguuuucuaaacucaauaa

SEQ ID NO: 1583448 - RNA, 14 nt, Homo sapiens
ugaaauaccacaag

SEQ ID NO: 1583449 - RNA, 18 nt, Homo sapiens
ugaaauaccacaagccug

SEQ ID NO: 1583450 - RNA, 13 nt, Homo sapiens
ugaaauaucauca

SEQ ID NO: 1583451 - RNA, 20 nt, Homo sapiens
ugaaauccagugagcacuag

SEQ ID NO: 1583452 - RNA, 20 nt, Homo sapiens
ugaaaucccugccucaggcc

SEQ ID NO: 1583453 - RNA, 23 nt, Homo sapiens
ugaaaucuuguuuguuacuguca

SEQ ID NO: 1583454 - RNA, 11 nt, Homo sapiens
ugaaaugccaa

SEQ ID NO: 1583455 - RNA, 15 nt, Homo sapiens
ucucuucuucucaua

SEQ ID NO: 1583456 - RNA, 20 nt, Homo sapiens
ucucuugaccucgugaucca

SEQ ID NO: 1583457 - RNA, 21 nt, Homo sapiens
ucucuuggaaaauaagacaau

SEQ ID NO: 1583458 - RNA, 15 nt, Homo sapiens
ucucuuuaaucuccu

SEQ ID NO: 1583459 - RNA, 15 nt, Homo sapiens
ucucuuuaccuccua

SEQ ID NO: 1583460 - RNA, 21 nt, Homo sapiens
ucugaacaauauauacuuaua

SEQ ID NO: 1583461 - RNA, 19 nt, Homo sapiens
ucugaacucaaacugagga

SEQ ID NO: 1583462 - RNA, 12 nt, Homo sapiens
ucugaacuucca

SEQ ID NO: 1583463 - RNA, 18 nt, Homo sapiens
ucugaagaaacuucccaa

SEQ ID NO: 1583464 - RNA, 21 nt, Homo sapiens
ucugaagagcuagucuaucag

SEQ ID NO: 1583465 - RNA, 15 nt, Homo sapiens
ucugaauuaauuaau

SEQ ID NO: 1583466 - RNA, 16 nt, Homo sapiens
ucugaccuuccagagc

SEQ ID NO: 1583467 - RNA, 14 nt, Homo sapiens
ucugacgucucuuu

SEQ ID NO: 1583468 - RNA, 16 nt, Homo sapiens
ucugagaaaguacaaa

SEQ ID NO: 1583469 - RNA, 15 nt, Homo sapiens
ucugagaacuccuca

SEQ ID NO: 1583470 - RNA, 17 nt, Homo sapiens
ucugagaucagugccuc

SEQ ID NO: 1583471 - RNA, 14 nt, Homo sapiens
ucugagcugugcag

SEQ ID NO: 1583472 - RNA, 15 nt, Homo sapiens
ucugaggacacagau

SEQ ID NO: 1583473 - RNA, 20 nt, Homo sapiens
ucugaggaucagcacugcca

SEQ ID NO: 1583474 - RNA, 19 nt, Homo sapiens
ucugaguaagcccucagga

SEQ ID NO: 1583475 - RNA, 20 nt, Homo sapiens
ucugaguaagcccucaggag

SEQ ID NO: 1583476 - RNA, 18 nt, Homo sapiens
ucugauaaaagauggcca

SEQ ID NO: 1583477 - RNA, 13 nt, Homo sapiens
ucugaucauguau

SEQ ID NO: 1583478 - RNA, 19 nt, Homo sapiens
ucugauguguucucugauc

SEQ ID NO: 1583479 - RNA, 20 nt, Homo sapiens
ucugauuccuucaacuggcu

SEQ ID NO: 1583480 - RNA, 20 nt, Homo sapiens
ucugauuuauguuuugauca

SEQ ID NO: 1583481 - RNA, 13 nt, Homo sapiens
ucugauuucauaa

SEQ ID NO: 1583482 - RNA, 16 nt, Homo sapiens
ucugauuucauaauuc

SEQ ID NO: 1583483 - RNA, 17 nt, Homo sapiens
ucugauuucugcccuug

SEQ ID NO: 1583484 - RNA, 14 nt, Homo sapiens
ucugcaacuccauc

SEQ ID NO: 1583485 - RNA, 13 nt, Homo sapiens
ucugcaagcauca

SEQ ID NO: 1583486 - RNA, 23 nt, Homo sapiens
ucugcaaggacauuucucaaggg

SEQ ID NO: 1583487 - RNA, 14 nt, Homo sapiens
ucugcacaccuacu

SEQ ID NO: 1583488 - RNA, 15 nt, Homo sapiens
ucugcacuguucaaa

SEQ ID NO: 1583489 - RNA, 16 nt, Homo sapiens
ucugcagucaagcccu

SEQ ID NO: 1583490 - RNA, 15 nt, Homo sapiens
ucugcauccagagau

SEQ ID NO: 1583491 - RNA, 11 nt, Homo sapiens
ucugcauuuac

SEQ ID NO: 1583492 - RNA, 16 nt, Homo sapiens
ucugcauuucauauua

SEQ ID NO: 1583493 - RNA, 18 nt, Homo sapiens
ucugcauuucauauuauu

SEQ ID NO: 1583494 - RNA, 13 nt, Homo sapiens
ucugccaaaguaa

SEQ ID NO: 1583495 - RNA, 21 nt, Homo sapiens
ucugccaagucaguucucuuu

SEQ ID NO: 1583496 - RNA, 19 nt, Homo sapiens
ucugccauuaaaacauuac

SEQ ID NO: 1583497 - RNA, 22 nt, Homo sapiens
ucugccauuccggcccaccucc

SEQ ID NO: 1583498 - RNA, 13 nt, Homo sapiens
ucugccauuucau

SEQ ID NO: 1583499 - RNA, 23 nt, Homo sapiens
ucugcccgggaaggucaccagca

SEQ ID NO: 1583500 - RNA, 14 nt, Homo sapiens
ucugcccucuagag

SEQ ID NO: 1583501 - RNA, 19 nt, Homo sapiens
ucugccgauuuuguaaaug

SEQ ID NO: 1583502 - RNA, 21 nt, Homo sapiens
ucugccgcccuccacaccucu

SEQ ID NO: 1583503 - RNA, 22 nt, Homo sapiens
ucugccgcccuccacaccucua

SEQ ID NO: 1583504 - RNA, 16 nt, Homo sapiens
ucugccuaugcacuga

SEQ ID NO: 1583505 - RNA, 18 nt, Homo sapiens
ucugccuaugcacugaag

SEQ ID NO: 1583506 - RNA, 16 nt, Homo sapiens
ucugccuggguuuugu

SEQ ID NO: 1583507 - RNA, 22 nt, Homo sapiens
ucugccuguuauaacucugcac

SEQ ID NO: 1583508 - RNA, 23 nt, Homo sapiens
ucugcgcuuggucuuucugugcu

SEQ ID NO: 1583509 - RNA, 15 nt, Homo sapiens
ucugcuaaauaucac

SEQ ID NO: 1583510 - RNA, 18 nt, Homo sapiens
ucugcucaucauucucug

SEQ ID NO: 1583511 - RNA, 15 nt, Homo sapiens
ucugcuccuguucac

SEQ ID NO: 1583512 - RNA, 16 nt, Homo sapiens
ucugcugcucugaccu

SEQ ID NO: 1583513 - RNA, 17 nt, Homo sapiens
ucugcuggagaaagcca

SEQ ID NO: 1583514 - RNA, 16 nt, Homo sapiens
ucugcugggcucugcc

SEQ ID NO: 1583515 - RNA, 17 nt, Homo sapiens
ucugcuuuucccauugc

SEQ ID NO: 1583516 - RNA, 19 nt, Homo sapiens
ucugcuuuucccauugcca

SEQ ID NO: 1583517 - RNA, 22 nt, Homo sapiens
ucuggaaagaggcucuggacag

SEQ ID NO: 1583518 - RNA, 14 nt, Homo sapiens
ucuggaacaacuug

SEQ ID NO: 1583519 - RNA, 16 nt, Homo sapiens
ucuggaagucaucuca

SEQ ID NO: 1583520 - RNA, 13 nt, Homo sapiens
ucuggaaguccaa

SEQ ID NO: 1583521 - RNA, 19 nt, Homo sapiens
ucuggaauuucaaaccauu

SEQ ID NO: 1583522 - RNA, 13 nt, Homo sapiens
ucuggacuccacc

SEQ ID NO: 1583523 - RNA, 15 nt, Homo sapiens
ucuggacuccaccuu

SEQ ID NO: 1583524 - RNA, 12 nt, Homo sapiens
ucuggcaaaaag

SEQ ID NO: 1583525 - RNA, 14 nt, Homo sapiens
ucuggcagguccuc

SEQ ID NO: 1583526 - RNA, 22 nt, Homo sapiens
ucuggccguccuugucucuggg

SEQ ID NO: 1583527 - RNA, 16 nt, Homo sapiens
ucuggcuucugcauua

SEQ ID NO: 1583528 - RNA, 14 nt, Homo sapiens
ucugggaagggaga

SEQ ID NO: 1583529 - RNA, 19 nt, Homo sapiens
ucugggauauggcugccca

SEQ ID NO: 1583530 - RNA, 22 nt, Homo sapiens
ucugggguccauucucugaguc

SEQ ID NO: 1583531 - RNA, 23 nt, Homo sapiens
ucugggguccauucucugaguca

SEQ ID NO: 1583532 - RNA, 15 nt, Homo sapiens
ucugggugaccucac

SEQ ID NO: 1583533 - RNA, 21 nt, Homo sapiens
ucugguaauaaaugugacuca

SEQ ID NO: 1583534 - RNA, 16 nt, Homo sapiens
ucugguagccugcaga

SEQ ID NO: 1583535 - RNA, 16 nt, Homo sapiens
ucuguaaaucuacaca

SEQ ID NO: 1583536 - RNA, 14 nt, Homo sapiens
ucuguaauguaggc

SEQ ID NO: 1583537 - RNA, 16 nt, Homo sapiens
ucuguacuaaaguauu

SEQ ID NO: 1583538 - RNA, 24 nt, Homo sapiens
ucuguagaagcuaauaaauaauca

SEQ ID NO: 1583539 - RNA, 14 nt, Homo sapiens
ucugucaccagcua

SEQ ID NO: 1583540 - RNA, 15 nt, Homo sapiens
ucugucauaugcaga

SEQ ID NO: 1583541 - RNA, 20 nt, Homo sapiens
ucugucauccauauuugcua

SEQ ID NO: 1583542 - RNA, 17 nt, Homo sapiens
ucuguccccuucucuca

SEQ ID NO: 1583543 - RNA, 18 nt, Homo sapiens
ucuguccguuuacuccaa

SEQ ID NO: 1583544 - RNA, 13 nt, Homo sapiens
ucugucuaccugg

SEQ ID NO: 1583545 - RNA, 14 nt, Homo sapiens
ucugucuguggcaa

SEQ ID NO: 1583546 - RNA, 19 nt, Homo sapiens
ucugugaagaaagagguua

SEQ ID NO: 1583547 - RNA, 14 nt, Homo sapiens
ucugugacauuucc

SEQ ID NO: 1583548 - RNA, 18 nt, Homo sapiens
ucugugacccaucuguag

SEQ ID NO: 1583549 - RNA, 23 nt, Homo sapiens
ucugugacuugaaguuuagucag

SEQ ID NO: 1583550 - RNA, 14 nt, Homo sapiens
ucugugccccaugc

SEQ ID NO: 1583551 - RNA, 14 nt, Homo sapiens
ucugugccugaaua

SEQ ID NO: 1583552 - RNA, 16 nt, Homo sapiens
ucuguguugaagcacu

SEQ ID NO: 1583553 - RNA, 16 nt, Homo sapiens
ucuguugggaugccag

SEQ ID NO: 1583554 - RNA, 20 nt, Homo sapiens
ucuguuuagaggaggcaaca

SEQ ID NO: 1583555 - RNA, 13 nt, Homo sapiens
ucuguuucuaguu

SEQ ID NO: 1583556 - RNA, 12 nt, Homo sapiens
ucuguuugaaac

SEQ ID NO: 1583557 - RNA, 17 nt, Homo sapiens
ucuguuugcguacuugu

SEQ ID NO: 1583558 - RNA, 22 nt, Homo sapiens
ucuguuugcuguggaacuacau

SEQ ID NO: 1583559 - RNA, 21 nt, Homo sapiens
ucuuaaaaaauuuauacuuaa

SEQ ID NO: 1583560 - RNA, 15 nt, Homo sapiens
ucuuaaaacacauga

SEQ ID NO: 1583561 - RNA, 16 nt, Homo sapiens
ucuuaaaaugcaauau

SEQ ID NO: 1583562 - RNA, 21 nt, Homo sapiens
ucuuaaacuaaaugugcaaua

SEQ ID NO: 1583563 - RNA, 22 nt, Homo sapiens
ucuuaaacuaaaugugcaauag

SEQ ID NO: 1583564 - RNA, 23 nt, Homo sapiens
ucuuaaagacaaauuuugcauau

SEQ ID NO: 1583565 - RNA, 16 nt, Homo sapiens
ucuuaaagcauuucag

SEQ ID NO: 1583566 - RNA, 23 nt, Homo sapiens
ucuuaagacgugauuuugcugua

SEQ ID NO: 1583567 - RNA, 16 nt, Homo sapiens
ucuuaauagcuauaca

SEQ ID NO: 1583568 - RNA, 17 nt, Homo sapiens
ucuuagccccagacucu

SEQ ID NO: 1583569 - RNA, 20 nt, Homo sapiens
ucuuagccccagacucuuca

SEQ ID NO: 1583570 - RNA, 23 nt, Homo sapiens
ucuuagcuugucugugaucucug

SEQ ID NO: 1583571 - RNA, 22 nt, Homo sapiens
ucuuaguguaugauuacuggcc

SEQ ID NO: 1583572 - RNA, 14 nt, Homo sapiens
ucuuagugugccaa

SEQ ID NO: 1583573 - RNA, 20 nt, Homo sapiens
ucuuaucuuugcucccugca

SEQ ID NO: 1583574 - RNA, 13 nt, Homo sapiens
uagugcuuuucag

SEQ ID NO: 1583575 - RNA, 17 nt, Homo sapiens
uaguguaacuugcuuaa

SEQ ID NO: 1583576 - RNA, 16 nt, Homo sapiens
uaguguccuaugcaau

SEQ ID NO: 1583577 - RNA, 21 nt, Homo sapiens
uaguguguaaaauuaauguaa

SEQ ID NO: 1583578 - RNA, 16 nt, Homo sapiens
uaguuaaagaaaggaa

SEQ ID NO: 1583579 - RNA, 19 nt, Homo sapiens
uaguuacaaaauacaaaag

SEQ ID NO: 1583580 - RNA, 18 nt, Homo sapiens
uaguuaccuuauaguuac

SEQ ID NO: 1583581 - RNA, 13 nt, Homo sapiens
uaguuauauugaa

SEQ ID NO: 1583582 - RNA, 22 nt, Homo sapiens
uaguucacauacaaaucaucca

SEQ ID NO: 1583583 - RNA, 12 nt, Homo sapiens
uaguugcuguau

SEQ ID NO: 1583584 - RNA, 19 nt, Homo sapiens
uaguuguaccgcaauguga

SEQ ID NO: 1583585 - RNA, 16 nt, Homo sapiens
uaguuguagacaaagu

SEQ ID NO: 1583586 - RNA, 18 nt, Homo sapiens
uaguuguuggucuguagc

SEQ ID NO: 1583587 - RNA, 20 nt, Homo sapiens
uaguuucccuugcaugguuu

SEQ ID NO: 1583588 - RNA, 22 nt, Homo sapiens
uaguuuguaugccaagugagaa

SEQ ID NO: 1583589 - RNA, 21 nt, Homo sapiens
uaguuuguuuuagaaccagcc

SEQ ID NO: 1583590 - RNA, 17 nt, Homo sapiens
uaguuuuauaggcagcu

SEQ ID NO: 1583591 - RNA, 22 nt, Homo sapiens
uaguuuuuaaaauuuauuugca

SEQ ID NO: 1583592 - RNA, 14 nt, Homo sapiens
uaguuuuucacuuu

SEQ ID NO: 1583593 - RNA, 13 nt, Homo sapiens
uauaaaacaguca

SEQ ID NO: 1583594 - RNA, 21 nt, Homo sapiens
uauaaaacagucauggccuga

SEQ ID NO: 1583595 - RNA, 12 nt, Homo sapiens
uauaaacagaca

SEQ ID NO: 1583596 - RNA, 13 nt, Homo sapiens
uauaaacauauca

SEQ ID NO: 1583597 - RNA, 15 nt, Homo sapiens
uauaaaccuuaugaa

SEQ ID NO: 1583598 - RNA, 13 nt, Homo sapiens
uauaaacuaccaa

SEQ ID NO: 1583599 - RNA, 23 nt, Homo sapiens
uauaaagauacagaacucuuuca

SEQ ID NO: 1583600 - RNA, 16 nt, Homo sapiens
uauaaaucaacaccuu

SEQ ID NO: 1583601 - RNA, 12 nt, Homo sapiens
uauaaaucuuuc

SEQ ID NO: 1583602 - RNA, 17 nt, Homo sapiens
uauaaauguaccagaga

SEQ ID NO: 1583603 - RNA, 21 nt, Homo sapiens
uauaaccagacacauacucau

SEQ ID NO: 1583604 - RNA, 16 nt, Homo sapiens
uauaaccugucuauac

SEQ ID NO: 1583605 - RNA, 22 nt, Homo sapiens
uauaacuuaggccuagccucuu

SEQ ID NO: 1583606 - RNA, 22 nt, Homo sapiens
uauaacuuuugguaucuacuuc

SEQ ID NO: 1583607 - RNA, 14 nt, Homo sapiens
uauaagaauuacua

SEQ ID NO: 1583608 - RNA, 15 nt, Homo sapiens
uauaagauuccaaaa

SEQ ID NO: 1583609 - RNA, 18 nt, Homo sapiens
uauaagauuccaaaaagc

SEQ ID NO: 1583610 - RNA, 21 nt, Homo sapiens
uauaagcaagaaggcaaaaau

SEQ ID NO: 1583611 - RNA, 16 nt, Homo sapiens
uauaagcagcaagaca

SEQ ID NO: 1583612 - RNA, 12 nt, Homo sapiens
uauaagcuuaaa

SEQ ID NO: 1583613 - RNA, 19 nt, Homo sapiens
uauaaucccacccaccuca

SEQ ID NO: 1583614 - RNA, 16 nt, Homo sapiens
uauaaucucuucuuau

SEQ ID NO: 1583615 - RNA, 20 nt, Homo sapiens
uauaaucuuucaaaccagcu

SEQ ID NO: 1583616 - RNA, 16 nt, Homo sapiens
uauaauugaguuuuca

SEQ ID NO: 1583617 - RNA, 21 nt, Homo sapiens
uauaauuuaaaaaaagcaaaa

SEQ ID NO: 1583618 - RNA, 23 nt, Homo sapiens
uauaauuucaaaccacacauuag

SEQ ID NO: 1583619 - RNA, 15 nt, Homo sapiens
uauacaaugcacuuu

SEQ ID NO: 1583620 - RNA, 13 nt, Homo sapiens
uauacacauaguu

SEQ ID NO: 1583621 - RNA, 13 nt, Homo sapiens
uauacaccuuagu

SEQ ID NO: 1583622 - RNA, 21 nt, Homo sapiens
uauacauaugagaauauaccu

SEQ ID NO: 1583623 - RNA, 16 nt, Homo sapiens
uauacauugucuugau

SEQ ID NO: 1583624 - RNA, 17 nt, Homo sapiens
uauacauuuauuuacac

SEQ ID NO: 1583625 - RNA, 17 nt, Homo sapiens
uauaccaucuccagcua

SEQ ID NO: 1583626 - RNA, 16 nt, Homo sapiens
uauaccucacuagcca

SEQ ID NO: 1583627 - RNA, 20 nt, Homo sapiens
uauacugguucacauccuac

SEQ ID NO: 1583628 - RNA, 17 nt, Homo sapiens
uauagacauucucacau

SEQ ID NO: 1583629 - RNA, 15 nt, Homo sapiens
uauagauguuuacua

SEQ ID NO: 1583630 - RNA, 22 nt, Homo sapiens
uauagcaacuuuaagaaguaau

SEQ ID NO: 1583631 - RNA, 17 nt, Homo sapiens
uauagccaauauaacua

SEQ ID NO: 1583632 - RNA, 12 nt, Homo sapiens
uauagccuuuaa

SEQ ID NO: 1583633 - RNA, 13 nt, Homo sapiens
uauagcuaaguac

SEQ ID NO: 1583634 - RNA, 17 nt, Homo sapiens
uauagcuaaguacacaa

SEQ ID NO: 1583635 - RNA, 21 nt, Homo sapiens
uauaggaaaaguuauugugau

SEQ ID NO: 1583636 - RNA, 13 nt, Homo sapiens
uauaggaauuugu

SEQ ID NO: 1583637 - RNA, 22 nt, Homo sapiens
uauaggcuucucacggcgacca

SEQ ID NO: 1583638 - RNA, 14 nt, Homo sapiens
uauaguacaugaua

SEQ ID NO: 1583639 - RNA, 21 nt, Homo sapiens
uauagugaaacauguacuuug

SEQ ID NO: 1583640 - RNA, 21 nt, Homo sapiens
uauaguguucacaaacuguga

SEQ ID NO: 1583641 - RNA, 20 nt, Homo sapiens
uauaguguuuggacagcuga

SEQ ID NO: 1583642 - RNA, 14 nt, Homo sapiens
uauauaaaccugga

SEQ ID NO: 1583643 - RNA, 12 nt, Homo sapiens
uauauaaccaau

SEQ ID NO: 1583644 - RNA, 19 nt, Homo sapiens
uauauaauuuauuuccacu

SEQ ID NO: 1583645 - RNA, 15 nt, Homo sapiens
uauauacauacugca

SEQ ID NO: 1583646 - RNA, 13 nt, Homo sapiens
uauauacauauau

SEQ ID NO: 1583647 - RNA, 21 nt, Homo sapiens
uauauauuuaauugauuucug

SEQ ID NO: 1583648 - RNA, 19 nt, Homo sapiens
uauauauuuuaaagaccaa

SEQ ID NO: 1583649 - RNA, 20 nt, Homo sapiens
uauauauuuucauccuauaa

SEQ ID NO: 1583650 - RNA, 21 nt, Homo sapiens
uauauauuuuugugcacauuu

SEQ ID NO: 1583651 - RNA, 14 nt, Homo sapiens
uauaucacuaagcu

SEQ ID NO: 1583652 - RNA, 21 nt, Homo sapiens
uauaucauaacuauacuugau

SEQ ID NO: 1583653 - RNA, 15 nt, Homo sapiens
uauauccucuggaaa

SEQ ID NO: 1583654 - RNA, 12 nt, Homo sapiens
uauaucuauuac

SEQ ID NO: 1583655 - RNA, 16 nt, Homo sapiens
uauaucugaagagcua

SEQ ID NO: 1583656 - RNA, 15 nt, Homo sapiens
uauaucuuguuuaca

SEQ ID NO: 1583657 - RNA, 12 nt, Homo sapiens
uauauguaccgu

SEQ ID NO: 1583658 - RNA, 11 nt, Homo sapiens
uauauguauuu

SEQ ID NO: 1583659 - RNA, 13 nt, Homo sapiens
uauauguguauau

SEQ ID NO: 1583660 - RNA, 16 nt, Homo sapiens
uauaugugugcccugg

SEQ ID NO: 1583661 - RNA, 18 nt, Homo sapiens
uauauuguauaggggcaa

SEQ ID NO: 1583662 - RNA, 20 nt, Homo sapiens
uauauuguguugacuuuaua

SEQ ID NO: 1583663 - RNA, 22 nt, Homo sapiens
uauauuuaaaaaauuauggaau

SEQ ID NO: 1583664 - RNA, 12 nt, Homo sapiens
uauauuucacau

SEQ ID NO: 1583665 - RNA, 19 nt, Homo sapiens
uauauuugaaguggagcca

SEQ ID NO: 1583666 - RNA, 16 nt, Homo sapiens
uauauuuuaaagacca

SEQ ID NO: 1583667 - RNA, 22 nt, Homo sapiens
uaucaaaagccugaaguggaau

SEQ ID NO: 1583668 - RNA, 15 nt, Homo sapiens
uaucaagcacuaaaa

SEQ ID NO: 1583669 - RNA, 13 nt, Homo sapiens
uaucaauggugcu

SEQ ID NO: 1583670 - RNA, 21 nt, Homo sapiens
uaucaauguuuguccuguaua

SEQ ID NO: 1583671 - RNA, 17 nt, Homo sapiens
uaucacagggucaccuc

SEQ ID NO: 1583672 - RNA, 20 nt, Homo sapiens
uaucacucaauuucucugag

SEQ ID NO: 1583673 - RNA, 21 nt, Homo sapiens
uaucacugguccaccuccuga

SEQ ID NO: 1583674 - RNA, 23 nt, Homo sapiens
uaucagcuuuuuaaaguggguua

SEQ ID NO: 1583675 - RNA, 21 nt, Homo sapiens
uaucaguugauuuuucuuauu

SEQ ID NO: 1583676 - RNA, 11 nt, Homo sapiens
uaucaucuuuu

SEQ ID NO: 1583677 - RNA, 17 nt, Homo sapiens
uaucauggugaaaagcu

SEQ ID NO: 1583678 - RNA, 13 nt, Homo sapiens
uaucauugcuaaa

SEQ ID NO: 1583679 - RNA, 18 nt, Homo sapiens
uauccaauugcucuuuca

SEQ ID NO: 1583680 - RNA, 21 nt, Homo sapiens
uauccacaauuauuggcaaag

SEQ ID NO: 1583681 - RNA, 15 nt, Homo sapiens
uaucccagugaucac

SEQ ID NO: 1583682 - RNA, 15 nt, Homo sapiens
uaucccugguuccua

SEQ ID NO: 1583683 - RNA, 23 nt, Homo sapiens
uauccuaaacuuuagacuuccca

SEQ ID NO: 1583684 - RNA, 22 nt, Homo sapiens
uauccugcgaccuugcaaccuc

SEQ ID NO: 1583685 - RNA, 23 nt, Homo sapiens
uauccugcgaccuugcaaccuca

SEQ ID NO: 1583686 - RNA, 18 nt, Homo sapiens
uaucguuaagcacaagac

SEQ ID NO: 1583687 - RNA, 13 nt, Homo sapiens
uaucuaagacuca

SEQ ID NO: 1583688 - RNA, 22 nt, Homo sapiens
uaucuaauuuuacacucuguau

SEQ ID NO: 1583689 - RNA, 12 nt, Homo sapiens
uaucuaccccag

SEQ ID NO: 1583690 - RNA, 12 nt, Homo sapiens
uaucuacuacaa

SEQ ID NO: 1583691 - RNA, 15 nt, Homo sapiens
uaucuacuucuacau

SEQ ID NO: 1583692 - RNA, 21 nt, Homo sapiens
uaucuauaguagacacacuau

SEQ ID NO: 1583693 - RNA, 16 nt, Homo sapiens
uagagacaggguuuca

SEQ ID NO: 1583694 - RNA, 20 nt, Homo sapiens
uagagacgguguuuugccau

SEQ ID NO: 1583695 - RNA, 16 nt, Homo sapiens
uagagacuucacccgg

SEQ ID NO: 1583696 - RNA, 18 nt, Homo sapiens
uagagauagcuacagugu

SEQ ID NO: 1583697 - RNA, 20 nt, Homo sapiens
uagagauagcuacaguguaa

SEQ ID NO: 1583698 - RNA, 17 nt, Homo sapiens
uagagcaaccuauauaa

SEQ ID NO: 1583699 - RNA, 21 nt, Homo sapiens
uagagccaggcacacacugug

SEQ ID NO: 1583700 - RNA, 19 nt, Homo sapiens
uagagcucuacugccucaa

SEQ ID NO: 1583701 - RNA, 18 nt, Homo sapiens
uagaggaggcaacacuga

SEQ ID NO: 1583702 - RNA, 17 nt, Homo sapiens
uagaggcuagcuucugc

SEQ ID NO: 1583703 - RNA, 15 nt, Homo sapiens
uagagggggucucag

SEQ ID NO: 1583704 - RNA, 16 nt, Homo sapiens
uagagggggucucaga

SEQ ID NO: 1583705 - RNA, 22 nt, Homo sapiens
uagaguaacacauaacauugua

SEQ ID NO: 1583706 - RNA, 21 nt, Homo sapiens
uagagucuuaaagcauuucag

SEQ ID NO: 1583707 - RNA, 20 nt, Homo sapiens
uagauaaucucuccauuccc

SEQ ID NO: 1583708 - RNA, 19 nt, Homo sapiens
uagauaaucuugugcaaaa

SEQ ID NO: 1583709 - RNA, 18 nt, Homo sapiens
uagauaccacugaaugaa

SEQ ID NO: 1583710 - RNA, 15 nt, Homo sapiens
uagauaucaauguua

SEQ ID NO: 1583711 - RNA, 19 nt, Homo sapiens
uagauauugcuacuauaau

SEQ ID NO: 1583712 - RNA, 14 nt, Homo sapiens
uagaugaaugucag

SEQ ID NO: 1583713 - RNA, 17 nt, Homo sapiens
uagaugauaaaagagaa

SEQ ID NO: 1583714 - RNA, 23 nt, Homo sapiens
uagaugauaaagagacagugaua

SEQ ID NO: 1583715 - RNA, 21 nt, Homo sapiens
uagaugccucgcucuuuucaa

SEQ ID NO: 1583716 - RNA, 17 nt, Homo sapiens
uagaugugucuuaccag

SEQ ID NO: 1583717 - RNA, 23 nt, Homo sapiens
uagauuaauuugaucuaguucua

SEQ ID NO: 1583718 - RNA, 16 nt, Homo sapiens
uagauuaccaugaaga

SEQ ID NO: 1583719 - RNA, 14 nt, Homo sapiens
uagauuacugaaaa

SEQ ID NO: 1583720 - RNA, 16 nt, Homo sapiens
uagauuacugauguga

SEQ ID NO: 1583721 - RNA, 21 nt, Homo sapiens
uagauuauuccaagccuuauu

SEQ ID NO: 1583722 - RNA, 21 nt, Homo sapiens
uagauucuuaauucaugagga

SEQ ID NO: 1583723 - RNA, 15 nt, Homo sapiens
uagauuuaagugaau

SEQ ID NO: 1583724 - RNA, 19 nt, Homo sapiens
uagauuuacagaacaaagu

SEQ ID NO: 1583725 - RNA, 17 nt, Homo sapiens
uagauuucuacacugag

SEQ ID NO: 1583726 - RNA, 15 nt, Homo sapiens
uagcaaauguuuacu

SEQ ID NO: 1583727 - RNA, 16 nt, Homo sapiens
uagcaacccagaaugu

SEQ ID NO: 1583728 - RNA, 16 nt, Homo sapiens
uagcaagcuuuugcuc

SEQ ID NO: 1583729 - RNA, 14 nt, Homo sapiens
uagcaagugugcac

SEQ ID NO: 1583730 - RNA, 20 nt, Homo sapiens
uagcaauagguuuguaaaau

SEQ ID NO: 1583731 - RNA, 15 nt, Homo sapiens
uagcaccauuaacuc

SEQ ID NO: 1583732 - RNA, 18 nt, Homo sapiens
uagcaccuccacauaccu

SEQ ID NO: 1583733 - RNA, 20 nt, Homo sapiens
uagcacugcagaaaccuuua

SEQ ID NO: 1583734 - RNA, 12 nt, Homo sapiens
uagcagcuauau

SEQ ID NO: 1583735 - RNA, 19 nt, Homo sapiens
uagcagggauguuccuuac

SEQ ID NO: 1583736 - RNA, 13 nt, Homo sapiens
uagcagucacuga

SEQ ID NO: 1583737 - RNA, 17 nt, Homo sapiens
uagcauaaaaaccacau

SEQ ID NO: 1583738 - RNA, 18 nt, Homo sapiens
uagcauacgguaugauau

SEQ ID NO: 1583739 - RNA, 13 nt, Homo sapiens
uagcauccacuga

SEQ ID NO: 1583740 - RNA, 14 nt, Homo sapiens
uagcaucccuggaa

SEQ ID NO: 1583741 - RNA, 17 nt, Homo sapiens
uagcaucuguaacagca

SEQ ID NO: 1583742 - RNA, 21 nt, Homo sapiens
uagcaucuguaacagcauuaa

SEQ ID NO: 1583743 - RNA, 14 nt, Homo sapiens
uagcaugaacgcca

SEQ ID NO: 1583744 - RNA, 20 nt, Homo sapiens
uagcauguuccuccuuuucu

SEQ ID NO: 1583745 - RNA, 17 nt, Homo sapiens
uagccauuucacucuca

SEQ ID NO: 1583746 - RNA, 14 nt, Homo sapiens
uagcccugucugcu

SEQ ID NO: 1583747 - RNA, 20 nt, Homo sapiens
uagccuuuaaaucauuuuua

SEQ ID NO: 1583748 - RNA, 19 nt, Homo sapiens
uagcuaaacggauuccaaa

SEQ ID NO: 1583749 - RNA, 15 nt, Homo sapiens
uagcucucccaguga

SEQ ID NO: 1583750 - RNA, 15 nt, Homo sapiens
uagcugauaugucag

SEQ ID NO: 1583751 - RNA, 16 nt, Homo sapiens
uagcugcaaguguauc

SEQ ID NO: 1583752 - RNA, 18 nt, Homo sapiens
uagcugguucacacugac

SEQ ID NO: 1583753 - RNA, 12 nt, Homo sapiens
uagcuguuucaa

SEQ ID NO: 1583754 - RNA, 22 nt, Homo sapiens
uagcuguuucaaaugugcauuu

SEQ ID NO: 1583755 - RNA, 14 nt, Homo sapiens
uagcuuaguucuuc

SEQ ID NO: 1583756 - RNA, 20 nt, Homo sapiens
uagcuuggagggauggagag

SEQ ID NO: 1583757 - RNA, 21 nt, Homo sapiens
uagcuuuccuggucccucacc

SEQ ID NO: 1583758 - RNA, 14 nt, Homo sapiens
uaggaaaaauccau

SEQ ID NO: 1583759 - RNA, 21 nt, Homo sapiens
uaggaaaaguuauugugauaa

SEQ ID NO: 1583760 - RNA, 14 nt, Homo sapiens
uaggaaaaugccau

SEQ ID NO: 1583761 - RNA, 17 nt, Homo sapiens
uaggaaggcagcauucc

SEQ ID NO: 1583762 - RNA, 16 nt, Homo sapiens
uaggaaggugaaucug

SEQ ID NO: 1583763 - RNA, 13 nt, Homo sapiens
uaggaaguaggaa

SEQ ID NO: 1583764 - RNA, 17 nt, Homo sapiens
uaggaagugaacccaua

SEQ ID NO: 1583765 - RNA, 22 nt, Homo sapiens
uaggaaguguuacuaucuugau

SEQ ID NO: 1583766 - RNA, 15 nt, Homo sapiens
uaggacagcauauaa

SEQ ID NO: 1583767 - RNA, 20 nt, Homo sapiens
uaggaggugugggugccuuc

SEQ ID NO: 1583768 - RNA, 17 nt, Homo sapiens
uaggauauugaauguga

SEQ ID NO: 1583769 - RNA, 19 nt, Homo sapiens
uaggauccaugcagcuuuu

SEQ ID NO: 1583770 - RNA, 15 nt, Homo sapiens
uaggauggggcuccc

SEQ ID NO: 1583771 - RNA, 22 nt, Homo sapiens
uaggcaaagauaauuuauuuca

SEQ ID NO: 1583772 - RNA, 23 nt, Homo sapiens
uaggcagagccauaauggacuaa

SEQ ID NO: 1583773 - RNA, 18 nt, Homo sapiens
uaggcagcuguccuguga

SEQ ID NO: 1583774 - RNA, 19 nt, Homo sapiens
uaggcagcuguccugugau

SEQ ID NO: 1583775 - RNA, 20 nt, Homo sapiens
uaggccagcaccaucucuuu

SEQ ID NO: 1583776 - RNA, 15 nt, Homo sapiens
uaggccugucccuug

SEQ ID NO: 1583777 - RNA, 17 nt, Homo sapiens
uaggcuauuaaaaaagu

SEQ ID NO: 1583778 - RNA, 19 nt, Homo sapiens
uaggcucagagaugugcac

SEQ ID NO: 1583779 - RNA, 18 nt, Homo sapiens
uaggcuguucuguagcuu

SEQ ID NO: 1583780 - RNA, 20 nt, Homo sapiens
uaggcuuuguaugacaguga

SEQ ID NO: 1583781 - RNA, 21 nt, Homo sapiens
uagggcaugauuaacaaagca

SEQ ID NO: 1583782 - RNA, 22 nt, Homo sapiens
uagggcaugauuaacaaagcaa

SEQ ID NO: 1583783 - RNA, 23 nt, Homo sapiens
uaggggaaggaggauaagcuuuu

SEQ ID NO: 1583784 - RNA, 16 nt, Homo sapiens
uaggguugccuguauc

SEQ ID NO: 1583785 - RNA, 17 nt, Homo sapiens
uagguaucauucaacuc

SEQ ID NO: 1583786 - RNA, 21 nt, Homo sapiens
uagguccagaaguccuuaugu

SEQ ID NO: 1583787 - RNA, 17 nt, Homo sapiens
uaggucuccucagggug

SEQ ID NO: 1583788 - RNA, 12 nt, Homo sapiens
uaggugagacag

SEQ ID NO: 1583789 - RNA, 18 nt, Homo sapiens
uagguuaaaaaaaaaagu

SEQ ID NO: 1583790 - RNA, 17 nt, Homo sapiens
uagguuacagaccucag

SEQ ID NO: 1583791 - RNA, 23 nt, Homo sapiens
uaguaauuuauugucugucuaca

SEQ ID NO: 1583792 - RNA, 18 nt, Homo sapiens
uaguacuaguacuaugac

SEQ ID NO: 1583793 - RNA, 15 nt, Homo sapiens
uaguacuucuucugu

SEQ ID NO: 1583794 - RNA, 15 nt, Homo sapiens
uaguagagacagggu

SEQ ID NO: 1583795 - RNA, 13 nt, Homo sapiens
uaguagcaaugug

SEQ ID NO: 1583796 - RNA, 16 nt, Homo sapiens
uaguauuaugauugca

SEQ ID NO: 1583797 - RNA, 12 nt, Homo sapiens
uagucccagaaa

SEQ ID NO: 1583798 - RNA, 20 nt, Homo sapiens
uagucucaugccuugagauc

SEQ ID NO: 1583799 - RNA, 22 nt, Homo sapiens
uagucugaacaauauauacuua

SEQ ID NO: 1583800 - RNA, 20 nt, Homo sapiens
uagugaaccaaaaauagaaa

SEQ ID NO: 1583801 - RNA, 17 nt, Homo sapiens
uagugaaucacguaaag

SEQ ID NO: 1583802 - RNA, 22 nt, Homo sapiens
uagugaaucacguaaagcuaga

SEQ ID NO: 1583803 - RNA, 19 nt, Homo sapiens
uagugaccauuauucacag

SEQ ID NO: 1583804 - RNA, 19 nt, Homo sapiens
uagugaugagaauuguaug

SEQ ID NO: 1583805 - RNA, 14 nt, Homo sapiens
uagugauuaccaaa

SEQ ID NO: 1583806 - RNA, 17 nt, Homo sapiens
uagugauuaccaaaaua

SEQ ID NO: 1583807 - RNA, 17 nt, Homo sapiens
uagugcaauuccaagaa

SEQ ID NO: 1583808 - RNA, 14 nt, Homo sapiens
uagugccacccacc

SEQ ID NO: 1583809 - RNA, 21 nt, Homo sapiens
uagugccacccaccuuugcca

SEQ ID NO: 1583810 - RNA, 21 nt, Homo sapiens
uagugcuucacaaaaugcacu

SEQ ID NO: 1583811 - RNA, 13 nt, Homo sapiens
uaccuccaugagc

SEQ ID NO: 1583812 - RNA, 17 nt, Homo sapiens
uaccuccuguguggaag

SEQ ID NO: 1583813 - RNA, 18 nt, Homo sapiens
uaccuccuguguggaaga

SEQ ID NO: 1583814 - RNA, 21 nt, Homo sapiens
uaccucuaguaaauuuaaguc

SEQ ID NO: 1583815 - RNA, 19 nt, Homo sapiens
uaccucuuggcugccuugu

SEQ ID NO: 1583816 - RNA, 20 nt, Homo sapiens
uaccugaaauaaaauucauu

SEQ ID NO: 1583817 - RNA, 20 nt, Homo sapiens
uaccuggauguucuuuuuac

SEQ ID NO: 1583818 - RNA, 16 nt, Homo sapiens
uaccuuguuaagacaa

SEQ ID NO: 1583819 - RNA, 17 nt, Homo sapiens
uaccuuguuaagacaaa

SEQ ID NO: 1583820 - RNA, 14 nt, Homo sapiens
uacgaaccaugccu

SEQ ID NO: 1583821 - RNA, 12 nt, Homo sapiens
uacgaagcaaua

SEQ ID NO: 1583822 - RNA, 15 nt, Homo sapiens
uacgguuaugaaggc

SEQ ID NO: 1583823 - RNA, 16 nt, Homo sapiens
uacgugaaaugcucaa

SEQ ID NO: 1583824 - RNA, 20 nt, Homo sapiens
uacgugauccucucaccuca

SEQ ID NO: 1583825 - RNA, 14 nt, Homo sapiens
uacuaaaccucaca

SEQ ID NO: 1583826 - RNA, 19 nt, Homo sapiens
uacuaaacuucaccuacau

SEQ ID NO: 1583827 - RNA, 21 nt, Homo sapiens
uacuaaauuacaaaugcaauu

SEQ ID NO: 1583828 - RNA, 18 nt, Homo sapiens
uacuaacauuuucauuga

SEQ ID NO: 1583829 - RNA, 24 nt, Homo sapiens
uacuaacauuuucauugaugagca

SEQ ID NO: 1583830 - RNA, 21 nt, Homo sapiens
uacuaauuccacaccuuuuau

SEQ ID NO: 1583831 - RNA, 14 nt, Homo sapiens
uacuagcacuuuga

SEQ ID NO: 1583832 - RNA, 17 nt, Homo sapiens
uacuaguacuaugacac

SEQ ID NO: 1583833 - RNA, 20 nt, Homo sapiens
uacuaguacuauugcuauua

SEQ ID NO: 1583834 - RNA, 14 nt, Homo sapiens
uacuaguuuucaau

SEQ ID NO: 1583835 - RNA, 17 nt, Homo sapiens
uacuauaaaagcuuucu

SEQ ID NO: 1583836 - RNA, 22 nt, Homo sapiens
uacuauaaaagcuuucugccac

SEQ ID NO: 1583837 - RNA, 16 nt, Homo sapiens
uacuauaguaccagua

SEQ ID NO: 1583838 - RNA, 21 nt, Homo sapiens
uacuauuauggaauuacucua

SEQ ID NO: 1583839 - RNA, 13 nt, Homo sapiens
uacucaaguacca

SEQ ID NO: 1583840 - RNA, 22 nt, Homo sapiens
uacucagacgugugaccuccau

SEQ ID NO: 1583841 - RNA, 15 nt, Homo sapiens
uacucauacauguua

SEQ ID NO: 1583842 - RNA, 21 nt, Homo sapiens
uacuccuagaagaaccaaaua

SEQ ID NO: 1583843 - RNA, 16 nt, Homo sapiens
uacuccucucaucccc

SEQ ID NO: 1583844 - RNA, 19 nt, Homo sapiens
uacuccugaggaugcuacu

SEQ ID NO: 1583845 - RNA, 17 nt, Homo sapiens
uacucuaccaugguucu

SEQ ID NO: 1583846 - RNA, 16 nt, Homo sapiens
uacucugcccucuaga

SEQ ID NO: 1583847 - RNA, 23 nt, Homo sapiens
uacucugcccucuagagccuuca

SEQ ID NO: 1583848 - RNA, 20 nt, Homo sapiens
uacugaagaaggugcauuga

SEQ ID NO: 1583849 - RNA, 20 nt, Homo sapiens
uacugaaucugcuaccaaaa

SEQ ID NO: 1583850 - RNA, 23 nt, Homo sapiens
uacugacacauugcugauaugca

SEQ ID NO: 1583851 - RNA, 12 nt, Homo sapiens
uacugacauaua

SEQ ID NO: 1583852 - RNA, 19 nt, Homo sapiens
uacugaggaaucagcucaa

SEQ ID NO: 1583853 - RNA, 22 nt, Homo sapiens
uacugaugugugcaaccuuuua

SEQ ID NO: 1583854 - RNA, 21 nt, Homo sapiens
uacugcaggaccuccagcuga

SEQ ID NO: 1583855 - RNA, 20 nt, Homo sapiens
uacugcaucaucuguuugua

SEQ ID NO: 1583856 - RNA, 16 nt, Homo sapiens
uacugcucuccuccac

SEQ ID NO: 1583857 - RNA, 18 nt, Homo sapiens
uacugcuugaccaaagag

SEQ ID NO: 1583858 - RNA, 16 nt, Homo sapiens
uacuggaaauguagca

SEQ ID NO: 1583859 - RNA, 22 nt, Homo sapiens
uacugggacaccauuaccaaaa

SEQ ID NO: 1583860 - RNA, 17 nt, Homo sapiens
uacugggugucauuuca

SEQ ID NO: 1583861 - RNA, 13 nt, Homo sapiens
uacuguaauuccu

SEQ ID NO: 1583862 - RNA, 14 nt, Homo sapiens
uacugugagacugu

SEQ ID NO: 1583863 - RNA, 10 nt, Homo sapiens
uacugugaug

SEQ ID NO: 1583864 - RNA, 12 nt, Homo sapiens
uacuguucuuga

SEQ ID NO: 1583865 - RNA, 15 nt, Homo sapiens
uacuuaacauuucau

SEQ ID NO: 1583866 - RNA, 19 nt, Homo sapiens
uacuuaaguguucauuuua

SEQ ID NO: 1583867 - RNA, 22 nt, Homo sapiens
uacuuagauuuggcaucuacuu

SEQ ID NO: 1583868 - RNA, 18 nt, Homo sapiens
uacuucccuuaacuuuca

SEQ ID NO: 1583869 - RNA, 19 nt, Homo sapiens
uacuucuacauccaaugua

SEQ ID NO: 1583870 - RNA, 15 nt, Homo sapiens
uacuucucgugacac

SEQ ID NO: 1583871 - RNA, 14 nt, Homo sapiens
uacuucucugcuau

SEQ ID NO: 1583872 - RNA, 17 nt, Homo sapiens
uacuugaaaccaguauu

SEQ ID NO: 1583873 - RNA, 15 nt, Homo sapiens
uacuugaacaaaagg

SEQ ID NO: 1583874 - RNA, 13 nt, Homo sapiens
uacuugaauguag

SEQ ID NO: 1583875 - RNA, 16 nt, Homo sapiens
uacuuggaacuaggcu

SEQ ID NO: 1583876 - RNA, 15 nt, Homo sapiens
uacuuguucauuugg

SEQ ID NO: 1583877 - RNA, 15 nt, Homo sapiens
uacuuuaugagcagc

SEQ ID NO: 1583878 - RNA, 22 nt, Homo sapiens
uacuuuauuucugaucuauaca

SEQ ID NO: 1583879 - RNA, 22 nt, Homo sapiens
uacuuuccacauauagagcucc

SEQ ID NO: 1583880 - RNA, 16 nt, Homo sapiens
uacuuucccucaucca

SEQ ID NO: 1583881 - RNA, 23 nt, Homo sapiens
uacuuucuguguugaagcacugu

SEQ ID NO: 1583882 - RNA, 14 nt, Homo sapiens
uacuuugacagugu

SEQ ID NO: 1583883 - RNA, 18 nt, Homo sapiens
uacuuuguaaauaggauu

SEQ ID NO: 1583884 - RNA, 12 nt, Homo sapiens
uacuuugugcau

SEQ ID NO: 1583885 - RNA, 15 nt, Homo sapiens
uacuuugugcauucu

SEQ ID NO: 1583886 - RNA, 14 nt, Homo sapiens
uacuuuuaacuaau

SEQ ID NO: 1583887 - RNA, 13 nt, Homo sapiens
uacuuuucugcca

SEQ ID NO: 1583888 - RNA, 18 nt, Homo sapiens
uacuuuucugccaaaaua

SEQ ID NO: 1583889 - RNA, 19 nt, Homo sapiens
uacuuuugacccaugugca

SEQ ID NO: 1583890 - RNA, 15 nt, Homo sapiens
uacuuuuuaguaauu

SEQ ID NO: 1583891 - RNA, 22 nt, Homo sapiens
uacuuuuucaugaaaauggagu

SEQ ID NO: 1583892 - RNA, 14 nt, Homo sapiens
uagaaaaagauucu

SEQ ID NO: 1583893 - RNA, 17 nt, Homo sapiens
uagaaaaaucucauucc

SEQ ID NO: 1583894 - RNA, 23 nt, Homo sapiens
uagaaaaugacuuauuucugcuc

SEQ ID NO: 1583895 - RNA, 14 nt, Homo sapiens
uagaaacaccagcc

SEQ ID NO: 1583896 - RNA, 16 nt, Homo sapiens
uagaaaccccucugua

SEQ ID NO: 1583897 - RNA, 15 nt, Homo sapiens
uagaaaccugaauga

SEQ ID NO: 1583898 - RNA, 19 nt, Homo sapiens
uagaaacguaaacuaugac

SEQ ID NO: 1583899 - RNA, 14 nt, Homo sapiens
uagaaagaaacuaa

SEQ ID NO: 1583900 - RNA, 15 nt, Homo sapiens
uagaaagaugacaaa

SEQ ID NO: 1583901 - RNA, 17 nt, Homo sapiens
uagaaaggacaacaguu

SEQ ID NO: 1583902 - RNA, 17 nt, Homo sapiens
uagaaagugaggcucag

SEQ ID NO: 1583903 - RNA, 22 nt, Homo sapiens
uagaaaguuggccaauuucacc

SEQ ID NO: 1583904 - RNA, 16 nt, Homo sapiens
uagaacaagaugcacu

SEQ ID NO: 1583905 - RNA, 15 nt, Homo sapiens
uagaacacaguuugu

SEQ ID NO: 1583906 - RNA, 17 nt, Homo sapiens
uagaacaccugccuucu

SEQ ID NO: 1583907 - RNA, 17 nt, Homo sapiens
uagaacauugaucuguu

SEQ ID NO: 1583908 - RNA, 19 nt, Homo sapiens
uagaaccuuaaagaaccau

SEQ ID NO: 1583909 - RNA, 19 nt, Homo sapiens
uagaacucugaaaugaaga

SEQ ID NO: 1583910 - RNA, 17 nt, Homo sapiens
uagaacuucauggauca

SEQ ID NO: 1583911 - RNA, 21 nt, Homo sapiens
uagaagaagcccauaucacau

SEQ ID NO: 1583912 - RNA, 15 nt, Homo sapiens
uagaagauauggaag

SEQ ID NO: 1583913 - RNA, 21 nt, Homo sapiens
uagaagcugaagauccccaac

SEQ ID NO: 1583914 - RNA, 19 nt, Homo sapiens
uagaaggacucaguauuau

SEQ ID NO: 1583915 - RNA, 23 nt, Homo sapiens
uagaauaaauucccaacuucucu

SEQ ID NO: 1583916 - RNA, 21 nt, Homo sapiens
uagaaugagcacccauuccaa

SEQ ID NO: 1583917 - RNA, 11 nt, Homo sapiens
uagaauggugc

SEQ ID NO: 1583918 - RNA, 18 nt, Homo sapiens
uagaauguuucauuugca

SEQ ID NO: 1583919 - RNA, 15 nt, Homo sapiens
uagacaaaaaguaua

SEQ ID NO: 1583920 - RNA, 17 nt, Homo sapiens
uagacaaaccaucuccu

SEQ ID NO: 1583921 - RNA, 14 nt, Homo sapiens
uagacaaaguacau

SEQ ID NO: 1583922 - RNA, 21 nt, Homo sapiens
uagacacaauuucauuuccag

SEQ ID NO: 1583923 - RNA, 21 nt, Homo sapiens
uagacagaguugcuuaaugaa

SEQ ID NO: 1583924 - RNA, 18 nt, Homo sapiens
uagaccaauuacugcacu

SEQ ID NO: 1583925 - RNA, 19 nt, Homo sapiens
uagaccaccuaauaucaau

SEQ ID NO: 1583926 - RNA, 15 nt, Homo sapiens
uagacugugccagag

SEQ ID NO: 1583927 - RNA, 14 nt, Homo sapiens
uagacuguuucaca

SEQ ID NO: 1583928 - RNA, 19 nt, Homo sapiens
uagacuguuucacauugca

SEQ ID NO: 1583929 - RNA, 19 nt, Homo sapiens
uagagaacacgcguauuua

SEQ ID NO: 1583930 - RNA, 15 nt, Homo sapiens
uacaguacacagaua

SEQ ID NO: 1583931 - RNA, 15 nt, Homo sapiens
uacagucugucauga

SEQ ID NO: 1583932 - RNA, 22 nt, Homo sapiens
uacagugaugcugugcuaugaa

SEQ ID NO: 1583933 - RNA, 22 nt, Homo sapiens
uacauaacugaaaaugugcuau

SEQ ID NO: 1583934 - RNA, 16 nt, Homo sapiens
uacauacacuguaugu

SEQ ID NO: 1583935 - RNA, 15 nt, Homo sapiens
uacauacagagguaa

SEQ ID NO: 1583936 - RNA, 16 nt, Homo sapiens
uacauacuaaugaagu

SEQ ID NO: 1583937 - RNA, 19 nt, Homo sapiens
uacauaugagaauauaccu

SEQ ID NO: 1583938 - RNA, 21 nt, Homo sapiens
uacauaugagaauauaccuua

SEQ ID NO: 1583939 - RNA, 16 nt, Homo sapiens
uacauauuaucucauu

SEQ ID NO: 1583940 - RNA, 16 nt, Homo sapiens
uacauauuuguauguu

SEQ ID NO: 1583941 - RNA, 13 nt, Homo sapiens
uacaucaaagagu

SEQ ID NO: 1583942 - RNA, 13 nt, Homo sapiens
uacaucaaagcuu

SEQ ID NO: 1583943 - RNA, 23 nt, Homo sapiens
uacaucagacucuagaaaaaagg

SEQ ID NO: 1583944 - RNA, 13 nt, Homo sapiens
uacaucugccuua

SEQ ID NO: 1583945 - RNA, 20 nt, Homo sapiens
uacaugagaaagaugucuau

SEQ ID NO: 1583946 - RNA, 17 nt, Homo sapiens
uacaugcauugagcucu

SEQ ID NO: 1583947 - RNA, 18 nt, Homo sapiens
uacaugguugaaacccca

SEQ ID NO: 1583948 - RNA, 17 nt, Homo sapiens
uacaugguuuaaaguca

SEQ ID NO: 1583949 - RNA, 16 nt, Homo sapiens
uacauguaauuugaug

SEQ ID NO: 1583950 - RNA, 13 nt, Homo sapiens
uacaugucaauaa

SEQ ID NO: 1583951 - RNA, 16 nt, Homo sapiens
uacaugugauugugau

SEQ ID NO: 1583952 - RNA, 24 nt, Homo sapiens
uacauuaaaauaacuaagcaagua

SEQ ID NO: 1583953 - RNA, 17 nt, Homo sapiens
uacauuaacggugcuaa

SEQ ID NO: 1583954 - RNA, 14 nt, Homo sapiens
uacauuauguugcu

SEQ ID NO: 1583955 - RNA, 14 nt, Homo sapiens
uacauuauucuuca

SEQ ID NO: 1583956 - RNA, 15 nt, Homo sapiens
uacauucaacagaga

SEQ ID NO: 1583957 - RNA, 15 nt, Homo sapiens
uacauugugcugcac

SEQ ID NO: 1583958 - RNA, 15 nt, Homo sapiens
uacauuuaucacuga

SEQ ID NO: 1583959 - RNA, 14 nt, Homo sapiens
uacauuuauuuaca

SEQ ID NO: 1583960 - RNA, 14 nt, Homo sapiens
uacauuucauacaa

SEQ ID NO: 1583961 - RNA, 20 nt, Homo sapiens
uacauuucugcagaucuucc

SEQ ID NO: 1583962 - RNA, 24 nt, Homo sapiens
uacauuugagcuucuagcauugau

SEQ ID NO: 1583963 - RNA, 15 nt, Homo sapiens
uacauuuucagugag

SEQ ID NO: 1583964 - RNA, 17 nt, Homo sapiens
uaccaaaugaaaugcca

SEQ ID NO: 1583965 - RNA, 20 nt, Homo sapiens
uaccaaaugaaaugccaaag

SEQ ID NO: 1583966 - RNA, 14 nt, Homo sapiens
uaccaaauggcacu

SEQ ID NO: 1583967 - RNA, 20 nt, Homo sapiens
uaccaagaacugaaggcaua

SEQ ID NO: 1583968 - RNA, 18 nt, Homo sapiens
uaccacacccagggcuau

SEQ ID NO: 1583969 - RNA, 18 nt, Homo sapiens
uaccacagcuauuuagaa

SEQ ID NO: 1583970 - RNA, 20 nt, Homo sapiens
uaccaccaagggaucugcca

SEQ ID NO: 1583971 - RNA, 16 nt, Homo sapiens
uaccaccaugcacugu

SEQ ID NO: 1583972 - RNA, 21 nt, Homo sapiens
uaccagagccuucaagugcca

SEQ ID NO: 1583973 - RNA, 20 nt, Homo sapiens
uaccagaggaaguuauggca

SEQ ID NO: 1583974 - RNA, 15 nt, Homo sapiens
uaccagaucuaauau

SEQ ID NO: 1583975 - RNA, 14 nt, Homo sapiens
uaccagaugcugac

SEQ ID NO: 1583976 - RNA, 22 nt, Homo sapiens
uaccaguauaagcaucugccau

SEQ ID NO: 1583977 - RNA, 21 nt, Homo sapiens
uaccaguauaauugaguuuuc

SEQ ID NO: 1583978 - RNA, 14 nt, Homo sapiens
uaccauacaauaua

SEQ ID NO: 1583979 - RNA, 16 nt, Homo sapiens
uaccaugguucugccu

SEQ ID NO: 1583980 - RNA, 17 nt, Homo sapiens
uaccauuuuucauucac

SEQ ID NO: 1583981 - RNA, 17 nt, Homo sapiens
uacccaaaggucuucaa

SEQ ID NO: 1583982 - RNA, 14 nt, Homo sapiens
uacccagaauguca

SEQ ID NO: 1583983 - RNA, 13 nt, Homo sapiens
uaccccaccacga

SEQ ID NO: 1583984 - RNA, 20 nt, Homo sapiens
uaccccaguuccuagcacug

SEQ ID NO: 1583985 - RNA, 13 nt, Homo sapiens
uacccuaaccaag

SEQ ID NO: 1583986 - RNA, 17 nt, Homo sapiens
uacccucuugaauauaa

SEQ ID NO: 1583987 - RNA, 19 nt, Homo sapiens
uacccuggcuggcaggcac

SEQ ID NO: 1583988 - RNA, 20 nt, Homo sapiens
uaccgcaucucccugcaguu

SEQ ID NO: 1583989 - RNA, 20 nt, Homo sapiens
uaccuaauguuaaaugacga

SEQ ID NO: 1583990 - RNA, 20 nt, Homo sapiens
uaccuacauacguguuccua

SEQ ID NO: 1583991 - RNA, 15 nt, Homo sapiens
uaccuagcugcaucu

SEQ ID NO: 1583992 - RNA, 15 nt, Homo sapiens
uaccuaucaucuuaa

SEQ ID NO: 1583993 - RNA, 18 nt, Homo sapiens
uaccucacacccaaagca

SEQ ID NO: 1583994 - RNA, 16 nt, Homo sapiens
aaagacuggcuuuuau

SEQ ID NO: 1583995 - RNA, 16 nt, Homo sapiens
aaagacuuuguuaaau

SEQ ID NO: 1583996 - RNA, 23 nt, Homo sapiens
aaagacuuuuaugugagauuucc

SEQ ID NO: 1583997 - RNA, 23 nt, Homo sapiens
aaagagaaacuuugugcuacaug

SEQ ID NO: 1583998 - RNA, 22 nt, Homo sapiens
aaagagaacaccuccagcuuuu

SEQ ID NO: 1583999 - RNA, 20 nt, Homo sapiens
aaagagaagcaucauuuccc

SEQ ID NO: 1584000 - RNA, 17 nt, Homo sapiens
aaagagacuccgucuca

SEQ ID NO: 1584001 - RNA, 12 nt, Homo sapiens
aaagagacugag

SEQ ID NO: 1584002 - RNA, 22 nt, Homo sapiens
aaagagagcaccacgugaugga

SEQ ID NO: 1584003 - RNA, 21 nt, Homo sapiens
aaagagcauggaugcauuuca

SEQ ID NO: 1584004 - RNA, 20 nt, Homo sapiens
aaagagccugaagaccuuca

SEQ ID NO: 1584005 - RNA, 19 nt, Homo sapiens
aaagagcuguuauacugug

SEQ ID NO: 1584006 - RNA, 15 nt, Homo sapiens
aaagaggaaccagga

SEQ ID NO: 1584007 - RNA, 15 nt, Homo sapiens
aaagaggcagcuuga

SEQ ID NO: 1584008 - RNA, 15 nt, Homo sapiens
aaagaggccagcucu

SEQ ID NO: 1584009 - RNA, 13 nt, Homo sapiens
aaagauacaugau

SEQ ID NO: 1584010 - RNA, 20 nt, Homo sapiens
aaagauaggaggaaccacaa

SEQ ID NO: 1584011 - RNA, 23 nt, Homo sapiens
aaagaucauuuauaauacuguuu

SEQ ID NO: 1584012 - RNA, 23 nt, Homo sapiens
aaagauccagccucauaccuaca

SEQ ID NO: 1584013 - RNA, 18 nt, Homo sapiens
aaagauggcuuccgugag

SEQ ID NO: 1584014 - RNA, 23 nt, Homo sapiens
aaagaugguggagauuggcaugc

SEQ ID NO: 1584015 - RNA, 13 nt, Homo sapiens
aaagauguauaua

SEQ ID NO: 1584016 - RNA, 20 nt, Homo sapiens
aaagaugugcagauaucaca

SEQ ID NO: 1584017 - RNA, 16 nt, Homo sapiens
aaagauugaguuugca

SEQ ID NO: 1584018 - RNA, 15 nt, Homo sapiens
aaagauuugugaacu

SEQ ID NO: 1584019 - RNA, 22 nt, Homo sapiens
aaagcaaggcaaaaauguaugc

SEQ ID NO: 1584020 - RNA, 23 nt, Homo sapiens
aaagcaauucugacuguccagga

SEQ ID NO: 1584021 - RNA, 19 nt, Homo sapiens
aaagcacauguauugacaa

SEQ ID NO: 1584022 - RNA, 15 nt, Homo sapiens
aaagcacugacuucu

SEQ ID NO: 1584023 - RNA, 22 nt, Homo sapiens
aaagcagaaaaucuaccaagaa

SEQ ID NO: 1584024 - RNA, 15 nt, Homo sapiens
aaagcagccugugaa

SEQ ID NO: 1584025 - RNA, 16 nt, Homo sapiens
aaagcagggacuugaa

SEQ ID NO: 1584026 - RNA, 17 nt, Homo sapiens
aaagcagggacuugaac

SEQ ID NO: 1584027 - RNA, 23 nt, Homo sapiens
aaagcagggacuugaacccauau

SEQ ID NO: 1584028 - RNA, 20 nt, Homo sapiens
aaagcaguggcuccauuggu

SEQ ID NO: 1584029 - RNA, 21 nt, Homo sapiens
aaagcauauuggugcuagaaa

SEQ ID NO: 1584030 - RNA, 21 nt, Homo sapiens
aaagcaucaauacaaccagcc

SEQ ID NO: 1584031 - RNA, 13 nt, Homo sapiens
aaagcaucaucug

SEQ ID NO: 1584032 - RNA, 21 nt, Homo sapiens
aaagcaucugagcuaacuuau

SEQ ID NO: 1584033 - RNA, 16 nt, Homo sapiens
aaagccaagaccucac

SEQ ID NO: 1584034 - RNA, 17 nt, Homo sapiens
aaagccagccaagcuuu

SEQ ID NO: 1584035 - RNA, 15 nt, Homo sapiens
aaagccuuaagcaca

SEQ ID NO: 1584036 - RNA, 19 nt, Homo sapiens
aaagcuauuccaagacuca

SEQ ID NO: 1584037 - RNA, 18 nt, Homo sapiens
aaagcucauuucaugcuc

SEQ ID NO: 1584038 - RNA, 13 nt, Homo sapiens
aaagcugcuguca

SEQ ID NO: 1584039 - RNA, 16 nt, Homo sapiens
aaagcugggauuucag

SEQ ID NO: 1584040 - RNA, 13 nt, Homo sapiens
aaagcugugggac

SEQ ID NO: 1584041 - RNA, 22 nt, Homo sapiens
aaagcugugggacgaaagcaca

SEQ ID NO: 1584042 - RNA, 21 nt, Homo sapiens
aaagcuguguguuuggaagac

SEQ ID NO: 1584043 - RNA, 23 nt, Homo sapiens
aaagcuuaauauauucccaagcu

SEQ ID NO: 1584044 - RNA, 12 nt, Homo sapiens
aaagcuucacag

SEQ ID NO: 1584045 - RNA, 22 nt, Homo sapiens
aaagcuuccgggaaaacagcua

SEQ ID NO: 1584046 - RNA, 23 nt, Homo sapiens
aaagcuuucauguaaacugugca

SEQ ID NO: 1584047 - RNA, 23 nt, Homo sapiens
aaagcuuucugccaccccuaaac

SEQ ID NO: 1584048 - RNA, 19 nt, Homo sapiens
aaaggaaaaucacaucucc

SEQ ID NO: 1584049 - RNA, 13 nt, Homo sapiens
aaaggaacaaaua

SEQ ID NO: 1584050 - RNA, 17 nt, Homo sapiens
aaaggaacuugcccuga

SEQ ID NO: 1584051 - RNA, 16 nt, Homo sapiens
aaaggaagacuugaag

SEQ ID NO: 1584052 - RNA, 14 nt, Homo sapiens
aaaggaaugauaua

SEQ ID NO: 1584053 - RNA, 14 nt, Homo sapiens
aaaggaauguguaa

SEQ ID NO: 1584054 - RNA, 16 nt, Homo sapiens
aaaggacucuccagcc

SEQ ID NO: 1584055 - RNA, 15 nt, Homo sapiens
aaaggagacauauca

SEQ ID NO: 1584056 - RNA, 17 nt, Homo sapiens
aaaggagagacucccau

SEQ ID NO: 1584057 - RNA, 16 nt, Homo sapiens
aaaggagcagagcucc

SEQ ID NO: 1584058 - RNA, 13 nt, Homo sapiens
aaaggaugaucaa

SEQ ID NO: 1584059 - RNA, 20 nt, Homo sapiens
aaaggauuuuaccaaagcau

SEQ ID NO: 1584060 - RNA, 19 nt, Homo sapiens
aaaggcagcugccucugcu

SEQ ID NO: 1584061 - RNA, 13 nt, Homo sapiens
aaaggcaguuuuc

SEQ ID NO: 1584062 - RNA, 22 nt, Homo sapiens
aaaggccauuaaagcucaaggu

SEQ ID NO: 1584063 - RNA, 22 nt, Homo sapiens
aaaggcccccuacgccaaucaa

SEQ ID NO: 1584064 - RNA, 16 nt, Homo sapiens
aaaggccccugcaaug

SEQ ID NO: 1584065 - RNA, 20 nt, Homo sapiens
aaaggcccuucaccucugga

SEQ ID NO: 1584066 - RNA, 16 nt, Homo sapiens
aaaggccgucauuuca

SEQ ID NO: 1584067 - RNA, 16 nt, Homo sapiens
aaagggaaaacaaaua

SEQ ID NO: 1584068 - RNA, 17 nt, Homo sapiens
aaagggaaacugggaaa

SEQ ID NO: 1584069 - RNA, 17 nt, Homo sapiens
aaagggagaaaugccag

SEQ ID NO: 1584070 - RNA, 17 nt, Homo sapiens
aaaggggguaugugaua

SEQ ID NO: 1584071 - RNA, 22 nt, Homo sapiens
aaagguaaaucccacaucccag

SEQ ID NO: 1584072 - RNA, 18 nt, Homo sapiens
aaaggugauugcagcuuu

SEQ ID NO: 1584073 - RNA, 19 nt, Homo sapiens
aaagguuuucuucauucau

SEQ ID NO: 1584074 - RNA, 14 nt, Homo sapiens
aaaguaaaccacaa

SEQ ID NO: 1584075 - RNA, 18 nt, Homo sapiens
aaaguaauauaaugaugc

SEQ ID NO: 1584076 - RNA, 19 nt, Homo sapiens
aaaguaauauaaugaugcu

SEQ ID NO: 1584077 - RNA, 19 nt, Homo sapiens
aaaguacacuaaguuugca

SEQ ID NO: 1584078 - RNA, 14 nt, Homo sapiens
aaaguacuaauaga

SEQ ID NO: 1584079 - RNA, 22 nt, Homo sapiens
aaaguagucauggauaacuaca

SEQ ID NO: 1584080 - RNA, 12 nt, Homo sapiens
aaauacaacucu

SEQ ID NO: 1584081 - RNA, 15 nt, Homo sapiens
aaauacaagaaccaa

SEQ ID NO: 1584082 - RNA, 11 nt, Homo sapiens
aaauacacuua

SEQ ID NO: 1584083 - RNA, 15 nt, Homo sapiens
aaauacagucuucca

SEQ ID NO: 1584084 - RNA, 19 nt, Homo sapiens
aaauacagucuuccacaaa

SEQ ID NO: 1584085 - RNA, 19 nt, Homo sapiens
aaauaccacaagccugaga

SEQ ID NO: 1584086 - RNA, 12 nt, Homo sapiens
aaauacugugaa

SEQ ID NO: 1584087 - RNA, 11 nt, Homo sapiens
aaauacuucuu

SEQ ID NO: 1584088 - RNA, 19 nt, Homo sapiens
aaauagaacaaccugcaca

SEQ ID NO: 1584089 - RNA, 21 nt, Homo sapiens
aaauaguaccuucaauacuua

SEQ ID NO: 1584090 - RNA, 18 nt, Homo sapiens
aaauauacaaaacuuuau

SEQ ID NO: 1584091 - RNA, 18 nt, Homo sapiens
aaauauacuugacucuaa

SEQ ID NO: 1584092 - RNA, 21 nt, Homo sapiens
aaauauagcaggguaauguaa

SEQ ID NO: 1584093 - RNA, 22 nt, Homo sapiens
aaauauauagugaaaaauguca

SEQ ID NO: 1584094 - RNA, 15 nt, Homo sapiens
aaauauauaugauau

SEQ ID NO: 1584095 - RNA, 18 nt, Homo sapiens
aaauauauuuuggaaaac

SEQ ID NO: 1584096 - RNA, 17 nt, Homo sapiens
aaauaucuugcuuucaa

SEQ ID NO: 1584097 - RNA, 15 nt, Homo sapiens
aaauaugagagcaau

SEQ ID NO: 1584098 - RNA, 16 nt, Homo sapiens
aaauaugugacugaca

SEQ ID NO: 1584099 - RNA, 21 nt, Homo sapiens
aaauauuaaaauuuauuucac

SEQ ID NO: 1584100 - RNA, 20 nt, Homo sapiens
aaauauugcuucaauuucaa

SEQ ID NO: 1584101 - RNA, 17 nt, Homo sapiens
aaauauuugugauuuac

SEQ ID NO: 1584102 - RNA, 18 nt, Homo sapiens
aaauauuuuaaacuacug

SEQ ID NO: 1584103 - RNA, 14 nt, Homo sapiens
aaaucaaacugcuu

SEQ ID NO: 1584104 - RNA, 19 nt, Homo sapiens
aaaucaaauaugcaaagca

SEQ ID NO: 1584105 - RNA, 13 nt, Homo sapiens
aaaucaaauauuc

SEQ ID NO: 1584106 - RNA, 21 nt, Homo sapiens
aaaucaacuuuuuauugccuu

SEQ ID NO: 1584107 - RNA, 20 nt, Homo sapiens
aaaucaauaaagaccacuuu

SEQ ID NO: 1584108 - RNA, 16 nt, Homo sapiens
aaaucaauacaauccu

SEQ ID NO: 1584109 - RNA, 19 nt, Homo sapiens
aaaucacgaccacugauag

SEQ ID NO: 1584110 - RNA, 23 nt, Homo sapiens
aaaucagcuuuauagguuuauua

SEQ ID NO: 1584111 - RNA, 13 nt, Homo sapiens
aaaucagggccac

SEQ ID NO: 1584112 - RNA, 14 nt, Homo sapiens
aaaucauuucugca

SEQ ID NO: 1584113 - RNA, 19 nt, Homo sapiens
aaauccuuuugaaugaugc

SEQ ID NO: 1584114 - RNA, 16 nt, Homo sapiens
aaaucuaaaucuucag

SEQ ID NO: 1584115 - RNA, 18 nt, Homo sapiens
aaaucuacacuccaguga

SEQ ID NO: 1584116 - RNA, 21 nt, Homo sapiens
aaaucuagaauuuagugauac

SEQ ID NO: 1584117 - RNA, 17 nt, Homo sapiens
aaaucuaggaugugaug

SEQ ID NO: 1584118 - RNA, 16 nt, Homo sapiens
aaaucuauagaacuga

SEQ ID NO: 1584119 - RNA, 17 nt, Homo sapiens
aaaucuauagaacugaa

SEQ ID NO: 1584120 - RNA, 18 nt, Homo sapiens
aaaucuauagaacugaau

SEQ ID NO: 1584121 - RNA, 16 nt, Homo sapiens
aaaucucagauucuuc

SEQ ID NO: 1584122 - RNA, 14 nt, Homo sapiens
aaaucucaguggcu

SEQ ID NO: 1584123 - RNA, 19 nt, Homo sapiens
aaaucucuacugcuuugga

SEQ ID NO: 1584124 - RNA, 23 nt, Homo sapiens
aaaucucucauauucgcuagugu

SEQ ID NO: 1584125 - RNA, 15 nt, Homo sapiens
aaaucugcacaguca

SEQ ID NO: 1584126 - RNA, 12 nt, Homo sapiens
aaaucuguaaau

SEQ ID NO: 1584127 - RNA, 18 nt, Homo sapiens
aaaucugugaccugucag

SEQ ID NO: 1584128 - RNA, 16 nt, Homo sapiens
aaaucuucagcaugau

SEQ ID NO: 1584129 - RNA, 19 nt, Homo sapiens
aaaucuugcuucagaccau

SEQ ID NO: 1584130 - RNA, 22 nt, Homo sapiens
aaaucuugguugaugccaaaaa

SEQ ID NO: 1584131 - RNA, 21 nt, Homo sapiens
aaaucuuguuuguuacuguca

SEQ ID NO: 1584132 - RNA, 20 nt, Homo sapiens
aaaugaaaaauuccacucaa

SEQ ID NO: 1584133 - RNA, 20 nt, Homo sapiens
aaaugaaaagagaaugaugc

SEQ ID NO: 1584134 - RNA, 14 nt, Homo sapiens
aaaugaaaagccaa

SEQ ID NO: 1584135 - RNA, 17 nt, Homo sapiens
aaaugaaaaugucuugu

SEQ ID NO: 1584136 - RNA, 22 nt, Homo sapiens
aaaugaaagggaaacugggaaa

SEQ ID NO: 1584137 - RNA, 19 nt, Homo sapiens
aaaugaaguuuugauuuau

SEQ ID NO: 1584138 - RNA, 16 nt, Homo sapiens
aaaugaauaaugccuu

SEQ ID NO: 1584139 - RNA, 18 nt, Homo sapiens
aaaugacuggcuccugac

SEQ ID NO: 1584140 - RNA, 12 nt, Homo sapiens
aaaugacuguau

SEQ ID NO: 1584141 - RNA, 17 nt, Homo sapiens
aaaugagagcagaaagu

SEQ ID NO: 1584142 - RNA, 20 nt, Homo sapiens
aaaugagcaccagugguacu

SEQ ID NO: 1584143 - RNA, 15 nt, Homo sapiens
aaaugauagacaauu

SEQ ID NO: 1584144 - RNA, 15 nt, Homo sapiens
aaaugauagcagaau

SEQ ID NO: 1584145 - RNA, 19 nt, Homo sapiens
aaaugcacaaacaaugcaa

SEQ ID NO: 1584146 - RNA, 14 nt, Homo sapiens
aaaugcacccauca

SEQ ID NO: 1584147 - RNA, 23 nt, Homo sapiens
aaaugcacccaucagcacucugu

SEQ ID NO: 1584148 - RNA, 14 nt, Homo sapiens
aaaugcagaacuua

SEQ ID NO: 1584149 - RNA, 14 nt, Homo sapiens
aaaugccauccaga

SEQ ID NO: 1584150 - RNA, 14 nt, Homo sapiens
aaaugccugacuca

SEQ ID NO: 1584151 - RNA, 15 nt, Homo sapiens
aaaugccugacucag

SEQ ID NO: 1584152 - RNA, 18 nt, Homo sapiens
aaaugcucaauuucagca

SEQ ID NO: 1584153 - RNA, 11 nt, Homo sapiens
aaaugcugcuc

SEQ ID NO: 1584154 - RNA, 23 nt, Homo sapiens
aaaugcugguuuuucaguuuuca

SEQ ID NO: 1584155 - RNA, 16 nt, Homo sapiens
aaaugcuuuuccucaa

SEQ ID NO: 1584156 - RNA, 22 nt, Homo sapiens
aaauggaacuaucuccaaauuu

SEQ ID NO: 1584157 - RNA, 23 nt, Homo sapiens
aaauggaguuaucaguuaucugu

SEQ ID NO: 1584158 - RNA, 17 nt, Homo sapiens
aaaugggcagugaaggc

SEQ ID NO: 1584159 - RNA, 18 nt, Homo sapiens
aaaugguaggcauuuccu

SEQ ID NO: 1584160 - RNA, 21 nt, Homo sapiens
aaauggucacguuuggugcuu

SEQ ID NO: 1584161 - RNA, 22 nt, Homo sapiens
aaaugguccaggagaaggccaa

SEQ ID NO: 1584162 - RNA, 17 nt, Homo sapiens
aaauguacaucaguuug

SEQ ID NO: 1584163 - RNA, 15 nt, Homo sapiens
aaauguauacuauag

SEQ ID NO: 1584164 - RNA, 14 nt, Homo sapiens
aaaugucaucaaac

SEQ ID NO: 1584165 - RNA, 20 nt, Homo sapiens
aaaugucgaugcuacccugg

SEQ ID NO: 1584166 - RNA, 22 nt, Homo sapiens
aaauguggaggcuaucaacaaa

SEQ ID NO: 1584167 - RNA, 19 nt, Homo sapiens
acucacuauauaagucaca

SEQ ID NO: 1584168 - RNA, 14 nt, Homo sapiens
acucacucacucug

SEQ ID NO: 1584169 - RNA, 23 nt, Homo sapiens
acucacugcugcaaauacuguau

SEQ ID NO: 1584170 - RNA, 13 nt, Homo sapiens
acucacugugauc

SEQ ID NO: 1584171 - RNA, 21 nt, Homo sapiens
acucacuuucccuugugucaa

SEQ ID NO: 1584172 - RNA, 14 nt, Homo sapiens
acucagccuuccuc

SEQ ID NO: 1584173 - RNA, 16 nt, Homo sapiens
acucaggagucugcca

SEQ ID NO: 1584174 - RNA, 14 nt, Homo sapiens
acucaggcauuuga

SEQ ID NO: 1584175 - RNA, 17 nt, Homo sapiens
acucagggagcauuuaa

SEQ ID NO: 1584176 - RNA, 14 nt, Homo sapiens
acucaggggucauu

SEQ ID NO: 1584177 - RNA, 17 nt, Homo sapiens
acucaggggucauucau

SEQ ID NO: 1584178 - RNA, 22 nt, Homo sapiens
acucagguaccucuuucagggu

SEQ ID NO: 1584179 - RNA, 17 nt, Homo sapiens
acucauauguucccaau

SEQ ID NO: 1584180 - RNA, 19 nt, Homo sapiens
acucaugauuucuucuuac

SEQ ID NO: 1584181 - RNA, 21 nt, Homo sapiens
acucaugcugguggcauuguu

SEQ ID NO: 1584182 - RNA, 22 nt, Homo sapiens
acucauuugaaugcuuaauuca

SEQ ID NO: 1584183 - RNA, 14 nt, Homo sapiens
acuccacaccuuuu

SEQ ID NO: 1584184 - RNA, 12 nt, Homo sapiens
acuccacaucaa

SEQ ID NO: 1584185 - RNA, 16 nt, Homo sapiens
acuccaccucuaccaa

SEQ ID NO: 1584186 - RNA, 18 nt, Homo sapiens
acuccaccucuaccaaaa

SEQ ID NO: 1584187 - RNA, 22 nt, Homo sapiens
acuccagccugagugacagagc

SEQ ID NO: 1584188 - RNA, 21 nt, Homo sapiens
acuccaguuugcccaccacaa

SEQ ID NO: 1584189 - RNA, 12 nt, Homo sapiens
acuccauucaaa

SEQ ID NO: 1584190 - RNA, 15 nt, Homo sapiens
acucccagcacuuug

SEQ ID NO: 1584191 - RNA, 22 nt, Homo sapiens
acucccaugagggagaugccau

SEQ ID NO: 1584192 - RNA, 19 nt, Homo sapiens
acuccccuuaaucuaaucu

SEQ ID NO: 1584193 - RNA, 17 nt, Homo sapiens
accccucccuuucuccc

SEQ ID NO: 1584194 - RNA, 15 nt, Homo sapiens
accccucuaccuccu

SEQ ID NO: 1584195 - RNA, 16 nt, Homo sapiens
accccugguucucauc

SEQ ID NO: 1584196 - RNA, 18 nt, Homo sapiens
accccuuagccucccuga

SEQ ID NO: 1584197 - RNA, 18 nt, Homo sapiens
accccuugguacugaaaa

SEQ ID NO: 1584198 - RNA, 16 nt, Homo sapiens
acccuaaaucuugacu

SEQ ID NO: 1584199 - RNA, 15 nt, Homo sapiens
acccuaagaugaagc

SEQ ID NO: 1584200 - RNA, 13 nt, Homo sapiens
acccuagucccuu

SEQ ID NO: 1584201 - RNA, 16 nt, Homo sapiens
acccucaucacuagga

SEQ ID NO: 1584202 - RNA, 19 nt, Homo sapiens
acccucaucuuucuuccaa

SEQ ID NO: 1584203 - RNA, 19 nt, Homo sapiens
acccuccagaauccugaug

SEQ ID NO: 1584204 - RNA, 21 nt, Homo sapiens
acccucccuggaguguggcug

SEQ ID NO: 1584205 - RNA, 21 nt, Homo sapiens
acccucgggccccauccucau

SEQ ID NO: 1584206 - RNA, 23 nt, Homo sapiens
acccugagccggccccaggcucg

SEQ ID NO: 1584207 - RNA, 14 nt, Homo sapiens
acccugccauggaa

SEQ ID NO: 1584208 - RNA, 18 nt, Homo sapiens
acccugggaacaauuucc

SEQ ID NO: 1584209 - RNA, 23 nt, Homo sapiens
acccuggggcaggggugcuuccu

SEQ ID NO: 1584210 - RNA, 21 nt, Homo sapiens
acccuguccggcccagugcca

SEQ ID NO: 1584211 - RNA, 14 nt, Homo sapiens
acccuuaggccagc

SEQ ID NO: 1584212 - RNA, 22 nt, Homo sapiens
acccuucucgcuuuugccauua

SEQ ID NO: 1584213 - RNA, 16 nt, Homo sapiens
accgaaaguguuacag

SEQ ID NO: 1584214 - RNA, 21 nt, Homo sapiens
accgagcgggugcaagcacuc

SEQ ID NO: 1584215 - RNA, 13 nt, Homo sapiens
accgauggccaug

SEQ ID NO: 1584216 - RNA, 13 nt, Homo sapiens
accgcaaugugac

SEQ ID NO: 1584217 - RNA, 20 nt, Homo sapiens
accgccaacugcagcucucc

SEQ ID NO: 1584218 - RNA, 18 nt, Homo sapiens
accgccacgucccagcau

SEQ ID NO: 1584219 - RNA, 16 nt, Homo sapiens
accgcuuauccccuca

SEQ ID NO: 1584220 - RNA, 21 nt, Homo sapiens
accggggaggcggagguugca

SEQ ID NO: 1584221 - RNA, 16 nt, Homo sapiens
accggggccugggcag

SEQ ID NO: 1584222 - RNA, 13 nt, Homo sapiens
accguaugaugag

SEQ ID NO: 1584223 - RNA, 21 nt, Homo sapiens
accgucuucucccuauucccu

SEQ ID NO: 1584224 - RNA, 22 nt, Homo sapiens
accgugauggagaggacagagc

SEQ ID NO: 1584225 - RNA, 13 nt, Homo sapiens
accguggggagcc

SEQ ID NO: 1584226 - RNA, 17 nt, Homo sapiens
accuaaagcaagccuga

SEQ ID NO: 1584227 - RNA, 18 nt, Homo sapiens
accuaaauaugagcccag

SEQ ID NO: 1584228 - RNA, 21 nt, Homo sapiens
accuaaauaugagcccagaaa

SEQ ID NO: 1584229 - RNA, 14 nt, Homo sapiens
accuaagcacuucu

SEQ ID NO: 1584230 - RNA, 14 nt, Homo sapiens
accuaauacagcag

SEQ ID NO: 1584231 - RNA, 11 nt, Homo sapiens
accuaauccaa

SEQ ID NO: 1584232 - RNA, 14 nt, Homo sapiens
accuacauuaucuc

SEQ ID NO: 1584233 - RNA, 16 nt, Homo sapiens
accuacuaggccauua

SEQ ID NO: 1584234 - RNA, 19 nt, Homo sapiens
accuagagcuagauguguc

SEQ ID NO: 1584235 - RNA, 16 nt, Homo sapiens
accuagcuacacugag

SEQ ID NO: 1584236 - RNA, 23 nt, Homo sapiens
accuagucagguuagcugaaccg

SEQ ID NO: 1584237 - RNA, 15 nt, Homo sapiens
accuaguguuuacuc

SEQ ID NO: 1584238 - RNA, 18 nt, Homo sapiens
accucaaacuuccaguca

SEQ ID NO: 1584239 - RNA, 22 nt, Homo sapiens
accucaacugccuacuccaaaa

SEQ ID NO: 1584240 - RNA, 18 nt, Homo sapiens
accucagaaagauuugau

SEQ ID NO: 1584241 - RNA, 12 nt, Homo sapiens
accucaucuuuc

SEQ ID NO: 1584242 - RNA, 19 nt, Homo sapiens
accucaugagucuaccuga

SEQ ID NO: 1584243 - RNA, 17 nt, Homo sapiens
accucauuuuaguugcc

SEQ ID NO: 1584244 - RNA, 17 nt, Homo sapiens
accuccaagcauuucau

SEQ ID NO: 1584245 - RNA, 20 nt, Homo sapiens
accuccaagcauuucaugaa

SEQ ID NO: 1584246 - RNA, 21 nt, Homo sapiens
accucccccuuucacacugga

SEQ ID NO: 1584247 - RNA, 18 nt, Homo sapiens
accuccugagccccucaa

SEQ ID NO: 1584248 - RNA, 22 nt, Homo sapiens
accuccuuagcccugucugcua

SEQ ID NO: 1584249 - RNA, 14 nt, Homo sapiens
accuccuuuaccag

SEQ ID NO: 1584250 - RNA, 19 nt, Homo sapiens
accucgucaagagcaugca

SEQ ID NO: 1584251 - RNA, 22 nt, Homo sapiens
accucgucaagagcaugcacau

SEQ ID NO: 1584252 - RNA, 13 nt, Homo sapiens
accucguccuccc

SEQ ID NO: 1584253 - RNA, 14 nt, Homo sapiens
accucuaccaaaaa

SEQ ID NO: 1584254 - RNA, 12 nt, Homo sapiens
accucuaguaaa

SEQ ID NO: 1584255 - RNA, 13 nt, Homo sapiens
accucuaguaaau

SEQ ID NO: 1584256 - RNA, 15 nt, Homo sapiens
accucuccacacagg

SEQ ID NO: 1584257 - RNA, 16 nt, Homo sapiens
accucuccauccugcu

SEQ ID NO: 1584258 - RNA, 20 nt, Homo sapiens
accucuccugcccugugaua

SEQ ID NO: 1584259 - RNA, 10 nt, Homo sapiens
accucugaga

SEQ ID NO: 1584260 - RNA, 12 nt, Homo sapiens
accucuguggac

SEQ ID NO: 1584261 - RNA, 19 nt, Homo sapiens
accugaaaacacugugcac

SEQ ID NO: 1584262 - RNA, 20 nt, Homo sapiens
accugaaaacacugugcaca

SEQ ID NO: 1584263 - RNA, 14 nt, Homo sapiens
accugagacucaga

SEQ ID NO: 1584264 - RNA, 17 nt, Homo sapiens
accugcaaguugcucug

SEQ ID NO: 1584265 - RNA, 15 nt, Homo sapiens
accugcacaaccugg

SEQ ID NO: 1584266 - RNA, 18 nt, Homo sapiens
accugcacguugugcaca

SEQ ID NO: 1584267 - RNA, 19 nt, Homo sapiens
accugccaggcaggggugg

SEQ ID NO: 1584268 - RNA, 13 nt, Homo sapiens
accugccaugcca

SEQ ID NO: 1584269 - RNA, 16 nt, Homo sapiens
accugccgagagucca

SEQ ID NO: 1584270 - RNA, 18 nt, Homo sapiens
accugccucugaccccag

SEQ ID NO: 1584271 - RNA, 13 nt, Homo sapiens
accugccuucuac

SEQ ID NO: 1584272 - RNA, 15 nt, Homo sapiens
accugcgcuguggac

SEQ ID NO: 1584273 - RNA, 20 nt, Homo sapiens
accugcgcuguggacacuga

SEQ ID NO: 1584274 - RNA, 22 nt, Homo sapiens
accuggagggaaugaaccugga

SEQ ID NO: 1584275 - RNA, 21 nt, Homo sapiens
accuggagggcuagaaccuag

SEQ ID NO: 1584276 - RNA, 19 nt, Homo sapiens
accuggcauggugcaggga

SEQ ID NO: 1584277 - RNA, 16 nt, Homo sapiens
accuggcccuugcaau

SEQ ID NO: 1584278 - RNA, 16 nt, Homo sapiens
accuggggagagccug

SEQ ID NO: 1584279 - RNA, 21 nt, Homo sapiens
accuggggagugguuaggcag

SEQ ID NO: 1584280 - RNA, 14 nt, Homo sapiens
accuggucucuaca

SEQ ID NO: 1584281 - RNA, 14 nt, Homo sapiens
accuguaaaacuuu

SEQ ID NO: 1584282 - RNA, 22 nt, Homo sapiens
accuguacauucuuccaucauc

SEQ ID NO: 1584283 - RNA, 13 nt, Homo sapiens
accuguaguccca

SEQ ID NO: 1584284 - RNA, 18 nt, Homo sapiens
accugucaaaaauuuuga

SEQ ID NO: 1584285 - RNA, 13 nt, Homo sapiens
accuucaauacuu

SEQ ID NO: 1584286 - RNA, 15 nt, Homo sapiens
acauuuuacauuaaa

SEQ ID NO: 1584287 - RNA, 21 nt, Homo sapiens
acauuuucuauaacauaugau

SEQ ID NO: 1584288 - RNA, 20 nt, Homo sapiens
acauuuuguuuuuacuguau

SEQ ID NO: 1584289 - RNA, 16 nt, Homo sapiens
acauuuuuguacuaac

SEQ ID NO: 1584290 - RNA, 18 nt, Homo sapiens
acauuuuuuaacuuucua

SEQ ID NO: 1584291 - RNA, 22 nt, Homo sapiens
accaaaaacauuugauuaauaa

SEQ ID NO: 1584292 - RNA, 15 nt, Homo sapiens
accaaaauccgacug

SEQ ID NO: 1584293 - RNA, 13 nt, Homo sapiens
accaaacacccag

SEQ ID NO: 1584294 - RNA, 19 nt, Homo sapiens
accaaacacccagaggucu

SEQ ID NO: 1584295 - RNA, 22 nt, Homo sapiens
accaaacugggucuucagcuuu

SEQ ID NO: 1584296 - RNA, 16 nt, Homo sapiens
accaaagagggcuucc

SEQ ID NO: 1584297 - RNA, 17 nt, Homo sapiens
accaaaggagacauauc

SEQ ID NO: 1584298 - RNA, 16 nt, Homo sapiens
accaaagucacaaauc

SEQ ID NO: 1584299 - RNA, 12 nt, Homo sapiens
accaaaucucag

SEQ ID NO: 1584300 - RNA, 18 nt, Homo sapiens
accaaaugcuuuuccuca

SEQ ID NO: 1584301 - RNA, 19 nt, Homo sapiens
accaaaugcuuuuccucaa

SEQ ID NO: 1584302 - RNA, 23 nt, Homo sapiens
accaaauggcacuuuugaugaaa

SEQ ID NO: 1584303 - RNA, 13 nt, Homo sapiens
accaaaugugcuu

SEQ ID NO: 1584304 - RNA, 17 nt, Homo sapiens
accaaauuagugaacca

SEQ ID NO: 1584305 - RNA, 13 nt, Homo sapiens
accaaccuguuac

SEQ ID NO: 1584306 - RNA, 16 nt, Homo sapiens
accaacugaaggcuaa

SEQ ID NO: 1584307 - RNA, 21 nt, Homo sapiens
accaagauuaugugacuugca

SEQ ID NO: 1584308 - RNA, 23 nt, Homo sapiens
accaagccuuggcucuacccuga

SEQ ID NO: 1584309 - RNA, 17 nt, Homo sapiens
accaaguaccaguauaa

SEQ ID NO: 1584310 - RNA, 17 nt, Homo sapiens
accaagucaaacuugga

SEQ ID NO: 1584311 - RNA, 18 nt, Homo sapiens
accaaguugauacuugaa

SEQ ID NO: 1584312 - RNA, 16 nt, Homo sapiens
accaauauuguacagu

SEQ ID NO: 1584313 - RNA, 20 nt, Homo sapiens
accaauauuguacaguuuuu

SEQ ID NO: 1584314 - RNA, 20 nt, Homo sapiens
accaaugaaaacauguacua

SEQ ID NO: 1584315 - RNA, 12 nt, Homo sapiens
accaauguagaa

SEQ ID NO: 1584316 - RNA, 13 nt, Homo sapiens
accaaugugugaa

SEQ ID NO: 1584317 - RNA, 20 nt, Homo sapiens
accacaccuggcccuugcaa

SEQ ID NO: 1584318 - RNA, 21 nt, Homo sapiens
accacaccuggcccuugcaau

SEQ ID NO: 1584319 - RNA, 18 nt, Homo sapiens
accacagauucagacuug

SEQ ID NO: 1584320 - RNA, 11 nt, Homo sapiens
accacagcaga

SEQ ID NO: 1584321 - RNA, 17 nt, Homo sapiens
accaccauuuaauuuca

SEQ ID NO: 1584322 - RNA, 14 nt, Homo sapiens
accaccuaauauca

SEQ ID NO: 1584323 - RNA, 14 nt, Homo sapiens
accaccuaauccuu

SEQ ID NO: 1584324 - RNA, 21 nt, Homo sapiens
accacucaggcauuugacuga

SEQ ID NO: 1584325 - RNA, 15 nt, Homo sapiens
accacuccacuggcc

SEQ ID NO: 1584326 - RNA, 21 nt, Homo sapiens
accacucuucuuuaagccaua

SEQ ID NO: 1584327 - RNA, 20 nt, Homo sapiens
accacugcagaagacaguau

SEQ ID NO: 1584328 - RNA, 12 nt, Homo sapiens
accacuuccagg

SEQ ID NO: 1584329 - RNA, 15 nt, Homo sapiens
accagaaagcuucau

SEQ ID NO: 1584330 - RNA, 17 nt, Homo sapiens
accagaacuggaacuac

SEQ ID NO: 1584331 - RNA, 14 nt, Homo sapiens
accagaauuucuaa

SEQ ID NO: 1584332 - RNA, 15 nt, Homo sapiens
accagagacuuuagg

SEQ ID NO: 1584333 - RNA, 14 nt, Homo sapiens
accagcaaggggcu

SEQ ID NO: 1584334 - RNA, 15 nt, Homo sapiens
accagcaaggggcug

SEQ ID NO: 1584335 - RNA, 13 nt, Homo sapiens
accagcacuucaa

SEQ ID NO: 1584336 - RNA, 13 nt, Homo sapiens
accagcagcaugg

SEQ ID NO: 1584337 - RNA, 18 nt, Homo sapiens
accagccauacuuaucuc

SEQ ID NO: 1584338 - RNA, 15 nt, Homo sapiens
accagcccugaaggc

SEQ ID NO: 1584339 - RNA, 16 nt, Homo sapiens
accagccgaggccaca

SEQ ID NO: 1584340 - RNA, 17 nt, Homo sapiens
accagccguauuuuaca

SEQ ID NO: 1584341 - RNA, 21 nt, Homo sapiens
accagccguauuuuacaugaa

SEQ ID NO: 1584342 - RNA, 17 nt, Homo sapiens
accagccucuccacuca

SEQ ID NO: 1584343 - RNA, 21 nt, Homo sapiens
accagccuguccaacauggug

SEQ ID NO: 1584344 - RNA, 21 nt, Homo sapiens
accagccuugcucucuucaau

SEQ ID NO: 1584345 - RNA, 16 nt, Homo sapiens
accaggacuagggcug

SEQ ID NO: 1584346 - RNA, 15 nt, Homo sapiens
accaggaggacaaga

SEQ ID NO: 1584347 - RNA, 16 nt, Homo sapiens
accaggccaagacuca

SEQ ID NO: 1584348 - RNA, 15 nt, Homo sapiens
accaggccaucccca

SEQ ID NO: 1584349 - RNA, 12 nt, Homo sapiens
accagggacuga

SEQ ID NO: 1584350 - RNA, 11 nt, Homo sapiens
accagggaugg

SEQ ID NO: 1584351 - RNA, 22 nt, Homo sapiens
accagggcuccaggagccucau

SEQ ID NO: 1584352 - RNA, 20 nt, Homo sapiens
accaggguugaccccagagg

SEQ ID NO: 1584353 - RNA, 16 nt, Homo sapiens
accaggucuacaguga

SEQ ID NO: 1584354 - RNA, 13 nt, Homo sapiens
accaggucucaua

SEQ ID NO: 1584355 - RNA, 15 nt, Homo sapiens
accaguauaagcauc

SEQ ID NO: 1584356 - RNA, 17 nt, Homo sapiens
accauagcacaggcuaa

SEQ ID NO: 1584357 - RNA, 17 nt, Homo sapiens
accauagugaaguguga

SEQ ID NO: 1584358 - RNA, 15 nt, Homo sapiens
accauauaccaucuc

SEQ ID NO: 1584359 - RNA, 22 nt, Homo sapiens
accauauauugagguucauugg

SEQ ID NO: 1584360 - RNA, 19 nt, Homo sapiens
accaucacugccaucacau

SEQ ID NO: 1584361 - RNA, 17 nt, Homo sapiens
accauccauucuccuca

SEQ ID NO: 1584362 - RNA, 17 nt, Homo sapiens
accaugggaaaugggaa

SEQ ID NO: 1584363 - RNA, 14 nt, Homo sapiens
accauucauuccau

SEQ ID NO: 1584364 - RNA, 16 nt, Homo sapiens
accauuccaacuucaa

SEQ ID NO: 1584365 - RNA, 20 nt, Homo sapiens
accauugcugucaaguuccu

SEQ ID NO: 1584366 - RNA, 21 nt, Homo sapiens
accauuuaaagaaagaaugca

SEQ ID NO: 1584367 - RNA, 23 nt, Homo sapiens
accauuuguguuuugaaagccca

SEQ ID NO: 1584368 - RNA, 18 nt, Homo sapiens
acccaaaaaaucaucuca

SEQ ID NO: 1584369 - RNA, 14 nt, Homo sapiens
acccacaaggccag

SEQ ID NO: 1584370 - RNA, 18 nt, Homo sapiens
acccacaccucugccaga

SEQ ID NO: 1584371 - RNA, 20 nt, Homo sapiens
acccaccauggaccagccca

SEQ ID NO: 1584372 - RNA, 16 nt, Homo sapiens
acccaccuggcuucau

SEQ ID NO: 1584373 - RNA, 15 nt, Homo sapiens
acccagaggucucau

SEQ ID NO: 1584374 - RNA, 20 nt, Homo sapiens
acccagaugccaaccagaca

SEQ ID NO: 1584375 - RNA, 12 nt, Homo sapiens
acccagccaggc

SEQ ID NO: 1584376 - RNA, 14 nt, Homo sapiens
acccaggaagggaa

SEQ ID NO: 1584377 - RNA, 15 nt, Homo sapiens
acccaggaguccaga

SEQ ID NO: 1584378 - RNA, 20 nt, Homo sapiens
acccaggcuggagugcggug

SEQ ID NO: 1584379 - RNA, 20 nt, Homo sapiens
aggguugggcccagaucugg

SEQ ID NO: 1584380 - RNA, 21 nt, Homo sapiens
aggguugggcgugcuaccugc

SEQ ID NO: 1584381 - RNA, 22 nt, Homo sapiens
aggguugggcgugcuaccugca

SEQ ID NO: 1584382 - RNA, 20 nt, Homo sapiens
aggguuucaccauguugccc

SEQ ID NO: 1584383 - RNA, 23 nt, Homo sapiens
aggguuuuaaacacuaaucacaa

SEQ ID NO: 1584384 - RNA, 22 nt, Homo sapiens
agguaaauuuuuaggcaaagau

SEQ ID NO: 1584385 - RNA, 19 nt, Homo sapiens
agguaauagggacuuagca

SEQ ID NO: 1584386 - RNA, 20 nt, Homo sapiens
agguaccagcugcgcuugcu

SEQ ID NO: 1584387 - RNA, 21 nt, Homo sapiens
agguaccagcugcgcuugcuu

SEQ ID NO: 1584388 - RNA, 21 nt, Homo sapiens
agguagcauucuuuggaguua

SEQ ID NO: 1584389 - RNA, 15 nt, Homo sapiens
agguagugggcucac

SEQ ID NO: 1584390 - RNA, 17 nt, Homo sapiens
agguaucacugcaguca

SEQ ID NO: 1584391 - RNA, 16 nt, Homo sapiens
agguaugugucagcca

SEQ ID NO: 1584392 - RNA, 22 nt, Homo sapiens
agguaugugucagccaugacca

SEQ ID NO: 1584393 - RNA, 16 nt, Homo sapiens
aggucaaaaaggccaa

SEQ ID NO: 1584394 - RNA, 17 nt, Homo sapiens
aggucacuacugcauuu

SEQ ID NO: 1584395 - RNA, 18 nt, Homo sapiens
aggucagaaguucaaggc

SEQ ID NO: 1584396 - RNA, 21 nt, Homo sapiens
aggucaggacggcuccucaga

SEQ ID NO: 1584397 - RNA, 12 nt, Homo sapiens
aggucaggagau

SEQ ID NO: 1584398 - RNA, 15 nt, Homo sapiens
aggucaggaguucaa

SEQ ID NO: 1584399 - RNA, 17 nt, Homo sapiens
aggucaggaguucaaga

SEQ ID NO: 1584400 - RNA, 14 nt, Homo sapiens
aggucauaaacacu

SEQ ID NO: 1584401 - RNA, 11 nt, Homo sapiens
aggucccugag

SEQ ID NO: 1584402 - RNA, 16 nt, Homo sapiens
agguccuggugguauu

SEQ ID NO: 1584403 - RNA, 14 nt, Homo sapiens
aggucuaccccugg

SEQ ID NO: 1584404 - RNA, 21 nt, Homo sapiens
aggucuccagagggugaaagc

SEQ ID NO: 1584405 - RNA, 23 nt, Homo sapiens
aggucugagccacagcagcauuu

SEQ ID NO: 1584406 - RNA, 22 nt, Homo sapiens
aggugaacaagguaaaacaacu

SEQ ID NO: 1584407 - RNA, 17 nt, Homo sapiens
aggugaacugggagcag

SEQ ID NO: 1584408 - RNA, 12 nt, Homo sapiens
aggugaauaauu

SEQ ID NO: 1584409 - RNA, 22 nt, Homo sapiens
aggugacuuguuuacucauuga

SEQ ID NO: 1584410 - RNA, 19 nt, Homo sapiens
aggugaguuugagcugccu

SEQ ID NO: 1584411 - RNA, 17 nt, Homo sapiens
aggugauccaccugccu

SEQ ID NO: 1584412 - RNA, 23 nt, Homo sapiens
aggugauuuguaugcucauugaa

SEQ ID NO: 1584413 - RNA, 18 nt, Homo sapiens
aggugcagggaagugcag

SEQ ID NO: 1584414 - RNA, 17 nt, Homo sapiens
aggugcccagaauuuac

SEQ ID NO: 1584415 - RNA, 16 nt, Homo sapiens
aggugccgacacugag

SEQ ID NO: 1584416 - RNA, 17 nt, Homo sapiens
aggugcuacaaaaacac

SEQ ID NO: 1584417 - RNA, 18 nt, Homo sapiens
aggugcuguccccacugc

SEQ ID NO: 1584418 - RNA, 15 nt, Homo sapiens
aggugcuuggaguuu

SEQ ID NO: 1584419 - RNA, 20 nt, Homo sapiens
agguggaaaagcaacauuca

SEQ ID NO: 1584420 - RNA, 14 nt, Homo sapiens
agguggaaguugca

SEQ ID NO: 1584421 - RNA, 17 nt, Homo sapiens
agguggauucaugucca

SEQ ID NO: 1584422 - RNA, 22 nt, Homo sapiens
agguggauuuggagaccgaaga

SEQ ID NO: 1584423 - RNA, 18 nt, Homo sapiens
agguggcagagugaaugu

SEQ ID NO: 1584424 - RNA, 20 nt, Homo sapiens
aggugguauggagcugugcc

SEQ ID NO: 1584425 - RNA, 15 nt, Homo sapiens
agguggugaggcaau

SEQ ID NO: 1584426 - RNA, 20 nt, Homo sapiens
agguggugggcaaaaacaau

SEQ ID NO: 1584427 - RNA, 16 nt, Homo sapiens
agguguauugaagucc

SEQ ID NO: 1584428 - RNA, 19 nt, Homo sapiens
aggugugaaccacugugcc

SEQ ID NO: 1584429 - RNA, 14 nt, Homo sapiens
aggugugggugccu

SEQ ID NO: 1584430 - RNA, 16 nt, Homo sapiens
agguguuacuagaagg

SEQ ID NO: 1584431 - RNA, 21 nt, Homo sapiens
agguguucuucauuaccucag

SEQ ID NO: 1584432 - RNA, 20 nt, Homo sapiens
agguuaaaaaaaaaagucac

SEQ ID NO: 1584433 - RNA, 18 nt, Homo sapiens
agguuauugcaauaaagu

SEQ ID NO: 1584434 - RNA, 15 nt, Homo sapiens
agguucagccugaaa

SEQ ID NO: 1584435 - RNA, 19 nt, Homo sapiens
agguucaugaauauggugu

SEQ ID NO: 1584436 - RNA, 13 nt, Homo sapiens
agguucauggauu

SEQ ID NO: 1584437 - RNA, 22 nt, Homo sapiens
agguucucuuccuggcaucaua

SEQ ID NO: 1584438 - RNA, 18 nt, Homo sapiens
agguugcagugagccaaa

SEQ ID NO: 1584439 - RNA, 19 nt, Homo sapiens
aguaaaauuauacugugug

SEQ ID NO: 1584440 - RNA, 12 nt, Homo sapiens
aguaaacacuug

SEQ ID NO: 1584441 - RNA, 12 nt, Homo sapiens
aguaaaccacaa

SEQ ID NO: 1584442 - RNA, 20 nt, Homo sapiens
aguaaaggcaguaaugccuu

SEQ ID NO: 1584443 - RNA, 22 nt, Homo sapiens
aguaaaguaccuuuauguuaug

SEQ ID NO: 1584444 - RNA, 23 nt, Homo sapiens
aguaaauagggaaaauaaucuca

SEQ ID NO: 1584445 - RNA, 17 nt, Homo sapiens
aguaaauuuaaguccac

SEQ ID NO: 1584446 - RNA, 22 nt, Homo sapiens
aguaagauauugugugugugaa

SEQ ID NO: 1584447 - RNA, 18 nt, Homo sapiens
aguaagcauuuccagccu

SEQ ID NO: 1584448 - RNA, 23 nt, Homo sapiens
aguaagcauuuccagccuaucua

SEQ ID NO: 1584449 - RNA, 15 nt, Homo sapiens
aguaaguauuuccau

SEQ ID NO: 1584450 - RNA, 14 nt, Homo sapiens
aguaauacaaacua

SEQ ID NO: 1584451 - RNA, 18 nt, Homo sapiens
aguaauaucaaagcauuu

SEQ ID NO: 1584452 - RNA, 21 nt, Homo sapiens
aguaauaucuuucaguuauua

SEQ ID NO: 1584453 - RNA, 21 nt, Homo sapiens
aguaaugaauuuuuaugauau

SEQ ID NO: 1584454 - RNA, 23 nt, Homo sapiens
aguaauuggucaugugaugcaag

SEQ ID NO: 1584455 - RNA, 14 nt, Homo sapiens
aguaauugugacaa

SEQ ID NO: 1584456 - RNA, 22 nt, Homo sapiens
aguaauuuuguuuaugcugcuc

SEQ ID NO: 1584457 - RNA, 22 nt, Homo sapiens
aguacaaacaugaaaaacaaac

SEQ ID NO: 1584458 - RNA, 16 nt, Homo sapiens
aguacagccuggacca

SEQ ID NO: 1584459 - RNA, 10 nt, Homo sapiens
aguacagggg

SEQ ID NO: 1584460 - RNA, 19 nt, Homo sapiens
aguacaugauaaaugauag

SEQ ID NO: 1584461 - RNA, 22 nt, Homo sapiens
aguacaugauaaaugauagaca

SEQ ID NO: 1584462 - RNA, 16 nt, Homo sapiens
aguacauuaaaacacu

SEQ ID NO: 1584463 - RNA, 20 nt, Homo sapiens
aguaccauuaaaaccagaaa

SEQ ID NO: 1584464 - RNA, 22 nt, Homo sapiens
aguaccauuaaaaccagaaagg

SEQ ID NO: 1584465 - RNA, 18 nt, Homo sapiens
aguaccuacaucagucaa

SEQ ID NO: 1584466 - RNA, 21 nt, Homo sapiens
aguaccuagcuggcucuguga

SEQ ID NO: 1584467 - RNA, 21 nt, Homo sapiens
aguacuaugacacuguuaaua

SEQ ID NO: 1584468 - RNA, 13 nt, Homo sapiens
aguacuauuaaca

SEQ ID NO: 1584469 - RNA, 20 nt, Homo sapiens
aguacuauuacuaguacuag

SEQ ID NO: 1584470 - RNA, 17 nt, Homo sapiens
aguacucauacauguua

SEQ ID NO: 1584471 - RNA, 17 nt, Homo sapiens
aguacuugaaacaguca

SEQ ID NO: 1584472 - RNA, 14 nt, Homo sapiens
aguacuuuaccuaa

SEQ ID NO: 1584473 - RNA, 20 nt, Homo sapiens
aguagagacgggguuucacc

SEQ ID NO: 1584474 - RNA, 18 nt, Homo sapiens
aguagcaaauguuuacug

SEQ ID NO: 1584475 - RNA, 17 nt, Homo sapiens
aguagcauuuuucuaaa

SEQ ID NO: 1584476 - RNA, 19 nt, Homo sapiens
aguagcucaaaaauacucu

SEQ ID NO: 1584477 - RNA, 19 nt, Homo sapiens
aguagcugcccuuccugcc

SEQ ID NO: 1584478 - RNA, 15 nt, Homo sapiens
aguaggauccaguga

SEQ ID NO: 1584479 - RNA, 21 nt, Homo sapiens
aguaggcaucaguaugucacu

SEQ ID NO: 1584480 - RNA, 20 nt, Homo sapiens
aguaguccuuggcauagaca

SEQ ID NO: 1584481 - RNA, 15 nt, Homo sapiens
aguagucuugaugac

SEQ ID NO: 1584482 - RNA, 16 nt, Homo sapiens
aguaguuguuggucug

SEQ ID NO: 1584483 - RNA, 22 nt, Homo sapiens
aguauaauuuaaaaaaagcaaa

SEQ ID NO: 1584484 - RNA, 13 nt, Homo sapiens
aguaucagcacua

SEQ ID NO: 1584485 - RNA, 13 nt, Homo sapiens
aguaugguauaug

SEQ ID NO: 1584486 - RNA, 19 nt, Homo sapiens
aguauguuuguacaguaug

SEQ ID NO: 1584487 - RNA, 13 nt, Homo sapiens
aguauuacagugu

SEQ ID NO: 1584488 - RNA, 14 nt, Homo sapiens
aguauuacaugauu

SEQ ID NO: 1584489 - RNA, 13 nt, Homo sapiens
aguauuauuaaca

SEQ ID NO: 1584490 - RNA, 23 nt, Homo sapiens
aguauuccaugguguauaugugc

SEQ ID NO: 1584491 - RNA, 19 nt, Homo sapiens
aguauuggcauucaaaaag

SEQ ID NO: 1584492 - RNA, 23 nt, Homo sapiens
aguauuuuaucuggaacaacuug

SEQ ID NO: 1584493 - RNA, 14 nt, Homo sapiens
aguauuuucccaau

SEQ ID NO: 1584494 - RNA, 17 nt, Homo sapiens
agucaaaaggugccugu

SEQ ID NO: 1584495 - RNA, 18 nt, Homo sapiens
agucaaagaugccccauu

SEQ ID NO: 1584496 - RNA, 18 nt, Homo sapiens
acuagccaaaccaggacc

SEQ ID NO: 1584497 - RNA, 13 nt, Homo sapiens
acuagcugagaaa

SEQ ID NO: 1584498 - RNA, 23 nt, Homo sapiens
acuaggccugaaaugacauuuca

SEQ ID NO: 1584499 - RNA, 11 nt, Homo sapiens
acuagugcaau

SEQ ID NO: 1584500 - RNA, 17 nt, Homo sapiens
acuaguuuuuauuccuu

SEQ ID NO: 1584501 - RNA, 23 nt, Homo sapiens
acuaguuuuuccuaucauguuaa

SEQ ID NO: 1584502 - RNA, 20 nt, Homo sapiens
acuauaaacuuaagggcaag

SEQ ID NO: 1584503 - RNA, 16 nt, Homo sapiens
acuauacccgggacca

SEQ ID NO: 1584504 - RNA, 22 nt, Homo sapiens
acuauauugcuguaugguauau

SEQ ID NO: 1584505 - RNA, 17 nt, Homo sapiens
acuaucucaugccagug

SEQ ID NO: 1584506 - RNA, 14 nt, Homo sapiens
acuaugacaucuaa

SEQ ID NO: 1584507 - RNA, 19 nt, Homo sapiens
acuaugaggagccucugau

SEQ ID NO: 1584508 - RNA, 14 nt, Homo sapiens
acuauguguucaau

SEQ ID NO: 1584509 - RNA, 14 nt, Homo sapiens
acuauuaguguuaa

SEQ ID NO: 1584510 - RNA, 14 nt, Homo sapiens
acuauuauggaauu

SEQ ID NO: 1584511 - RNA, 15 nt, Homo sapiens
acuauucaaacaguc

SEQ ID NO: 1584512 - RNA, 20 nt, Homo sapiens
acuauugcuaguacuaguac

SEQ ID NO: 1584513 - RNA, 14 nt, Homo sapiens
acuauuuccaccuc

SEQ ID NO: 1584514 - RNA, 23 nt, Homo sapiens
acucaaaacgcuacugagucaca

SEQ ID NO: 1584515 - RNA, 14 nt, Homo sapiens
acucaaacugagga

SEQ ID NO: 1584516 - RNA, 16 nt, Homo sapiens
acucaaagacauuugu

SEQ ID NO: 1584517 - RNA, 15 nt, Homo sapiens
acucaaggacagcca

SEQ ID NO: 1584518 - RNA, 21 nt, Homo sapiens
acucaaggacagccaccaaga

SEQ ID NO: 1584519 - RNA, 18 nt, Homo sapiens
acucaaggguuuuccagg

SEQ ID NO: 1584520 - RNA, 15 nt, Homo sapiens
acucaaguaccacca

SEQ ID NO: 1584521 - RNA, 17 nt, Homo sapiens
acucaaguaccaccaag

SEQ ID NO: 1584522 - RNA, 17 nt, Homo sapiens
acucaauaaacagucac

SEQ ID NO: 1584523 - RNA, 15 nt, Homo sapiens
acucaccaaacacaa

SEQ ID NO: 1584524 - RNA, 13 nt, Homo sapiens
acucaccauagag

SEQ ID NO: 1584525 - RNA, 15 nt, Homo sapiens
acucaccucucucua

SEQ ID NO: 1584526 - RNA, 17 nt, Homo sapiens
acucaccugcacuaaca

SEQ ID NO: 1584527 - RNA, 21 nt, Homo sapiens
acucacguuugcuuaaacccu

SEQ ID NO: 1584528 - RNA, 21 nt, Homo sapiens
acucagaggagcugcaaauug

SEQ ID NO: 1584529 - RNA, 18 nt, Homo sapiens
acucagaugaugccagcu

SEQ ID NO: 1584530 - RNA, 23 nt, Homo sapiens
acucagauugagcccuacauugu

SEQ ID NO: 1584531 - RNA, 17 nt, Homo sapiens
acucagccacugucaca

SEQ ID NO: 1584532 - RNA, 17 nt, Homo sapiens
acucagcuaaugucaca

SEQ ID NO: 1584533 - RNA, 16 nt, Homo sapiens
acucaguuucuaggca

SEQ ID NO: 1584534 - RNA, 23 nt, Homo sapiens
acucauagcgggggccuaaaaaa

SEQ ID NO: 1584535 - RNA, 19 nt, Homo sapiens
acucaugugacucuuucca

SEQ ID NO: 1584536 - RNA, 20 nt, Homo sapiens
acucaugugacucuuuccaa

SEQ ID NO: 1584537 - RNA, 13 nt, Homo sapiens
acucauuccagau

SEQ ID NO: 1584538 - RNA, 15 nt, Homo sapiens
acucauuucaucuca

SEQ ID NO: 1584539 - RNA, 12 nt, Homo sapiens
acuccacacucu

SEQ ID NO: 1584540 - RNA, 17 nt, Homo sapiens
acuccaccaucaccucu

SEQ ID NO: 1584541 - RNA, 16 nt, Homo sapiens
acuccacccaccuggc

SEQ ID NO: 1584542 - RNA, 19 nt, Homo sapiens
acuccaccuuggaccucag

SEQ ID NO: 1584543 - RNA, 20 nt, Homo sapiens
acuccaccuuggaccucagu

SEQ ID NO: 1584544 - RNA, 13 nt, Homo sapiens
acuccacugcaag

SEQ ID NO: 1584545 - RNA, 20 nt, Homo sapiens
acuccacuggccuccuggca

SEQ ID NO: 1584546 - RNA, 18 nt, Homo sapiens
acuccaggcccaaggcuc

SEQ ID NO: 1584547 - RNA, 15 nt, Homo sapiens
acuccagguggaaca

SEQ ID NO: 1584548 - RNA, 19 nt, Homo sapiens
acuccagguggaacaaaca

SEQ ID NO: 1584549 - RNA, 15 nt, Homo sapiens
acuccaucucaaaaa

SEQ ID NO: 1584550 - RNA, 21 nt, Homo sapiens
acucccuaauuuaugugcuau

SEQ ID NO: 1584551 - RNA, 21 nt, Homo sapiens
acucccucgucgagcuggaug

SEQ ID NO: 1584552 - RNA, 20 nt, Homo sapiens
acuccgagagcaugcuuaau

SEQ ID NO: 1584553 - RNA, 13 nt, Homo sapiens
acuccuacugagu

SEQ ID NO: 1584554 - RNA, 14 nt, Homo sapiens
acuccucccauaga

SEQ ID NO: 1584555 - RNA, 19 nt, Homo sapiens
acuccucccauagauacuc

SEQ ID NO: 1584556 - RNA, 13 nt, Homo sapiens
acuccuccuuuau

SEQ ID NO: 1584557 - RNA, 12 nt, Homo sapiens
acuccucuauca

SEQ ID NO: 1584558 - RNA, 21 nt, Homo sapiens
acuccucugucauaugcagaa

SEQ ID NO: 1584559 - RNA, 19 nt, Homo sapiens
acuccugggcucaagcaau

SEQ ID NO: 1584560 - RNA, 22 nt, Homo sapiens
acuccuuccuucaggacucugc

SEQ ID NO: 1584561 - RNA, 12 nt, Homo sapiens
acucgacccaga

SEQ ID NO: 1584562 - RNA, 18 nt, Homo sapiens
acucuaaaguugauuuaa

SEQ ID NO: 1584563 - RNA, 19 nt, Homo sapiens
acucuaauaugauuauaca

SEQ ID NO: 1584564 - RNA, 18 nt, Homo sapiens
acucuagaagaccaaaug

SEQ ID NO: 1584565 - RNA, 16 nt, Homo sapiens
acucuagaauguccau

SEQ ID NO: 1584566 - RNA, 21 nt, Homo sapiens
acucuagaugaaguuuuacau

SEQ ID NO: 1584567 - RNA, 17 nt, Homo sapiens
acucuauaagauuccaa

SEQ ID NO: 1584568 - RNA, 20 nt, Homo sapiens
acucuauaagauuccaaaaa

SEQ ID NO: 1584569 - RNA, 23 nt, Homo sapiens
acucucauuccccagguggcuga

SEQ ID NO: 1584570 - RNA, 14 nt, Homo sapiens
acucugaagccaca

SEQ ID NO: 1584571 - RNA, 14 nt, Homo sapiens
acucugacaguauu

SEQ ID NO: 1584572 - RNA, 15 nt, Homo sapiens
acucugacaguauua

SEQ ID NO: 1584573 - RNA, 15 nt, Homo sapiens
acucugagaacuccu

SEQ ID NO: 1584574 - RNA, 19 nt, Homo sapiens
acucugcagugauuagaag

SEQ ID NO: 1584575 - RNA, 22 nt, Homo sapiens
acucugcccucuagagccuuca

SEQ ID NO: 1584576 - RNA, 16 nt, Homo sapiens
acucuggccuccaaaa

SEQ ID NO: 1584577 - RNA, 18 nt, Homo sapiens
acucuggugcuccugcau

SEQ ID NO: 1584578 - RNA, 22 nt, Homo sapiens
acucuguaaaacgcaccaauca

SEQ ID NO: 1584579 - RNA, 19 nt, Homo sapiens
acucuguaaaaugcaccaa

SEQ ID NO: 1584580 - RNA, 19 nt, Homo sapiens
acucuguaauugaauauaa

SEQ ID NO: 1584581 - RNA, 21 nt, Homo sapiens
acucuguccacgauucacuca

SEQ ID NO: 1584582 - RNA, 22 nt, Homo sapiens
acucuguguuuggaauaucucu

SEQ ID NO: 1584583 - RNA, 18 nt, Homo sapiens
acucuguuuccuggucag

SEQ ID NO: 1584584 - RNA, 19 nt, Homo sapiens
acucuuagagaugauucag

SEQ ID NO: 1584585 - RNA, 16 nt, Homo sapiens
acucuuagccccagac

SEQ ID NO: 1584586 - RNA, 14 nt, Homo sapiens
acucuucuaaaaau

SEQ ID NO: 1584587 - RNA, 17 nt, Homo sapiens
acucuucugacugcccc

SEQ ID NO: 1584588 - RNA, 18 nt, Homo sapiens
acucuugaauuccucuca

SEQ ID NO: 1584589 - RNA, 17 nt, Homo sapiens
acugaaacgucuaggaa

SEQ ID NO: 1584590 - RNA, 12 nt, Homo sapiens
acugaaacugga

SEQ ID NO: 1584591 - RNA, 13 nt, Homo sapiens
acugaaacuggaa

SEQ ID NO: 1584592 - RNA, 14 nt, Homo sapiens
acugaaagcacuag

SEQ ID NO: 1584593 - RNA, 21 nt, Homo sapiens
acugaacuuaauaacugugua

SEQ ID NO: 1584594 - RNA, 13 nt, Homo sapiens
acugaacuugaag

SEQ ID NO: 1584595 - RNA, 14 nt, Homo sapiens
acugaagcucuuau

SEQ ID NO: 1584596 - RNA, 22 nt, Homo sapiens
acugaagcuucaaaaagccacu

SEQ ID NO: 1584597 - RNA, 19 nt, Homo sapiens
acugaaggagaaggugccc

SEQ ID NO: 1584598 - RNA, 16 nt, Homo sapiens
acugaaggcauaugca

SEQ ID NO: 1584599 - RNA, 14 nt, Homo sapiens
acugaagugcuugc

SEQ ID NO: 1584600 - RNA, 11 nt, Homo sapiens
acugaaucuau

SEQ ID NO: 1584601 - RNA, 16 nt, Homo sapiens
acugacaaagacaucg

SEQ ID NO: 1584602 - RNA, 13 nt, Homo sapiens
acugacagccgcc

SEQ ID NO: 1584603 - RNA, 14 nt, Homo sapiens
acugaccuuugucc

SEQ ID NO: 1584604 - RNA, 19 nt, Homo sapiens
acugacuccaaccauucaa

SEQ ID NO: 1584605 - RNA, 13 nt, Homo sapiens
acugacucuguua

SEQ ID NO: 1584606 - RNA, 19 nt, Homo sapiens
acugagaagugcacuuuaa

SEQ ID NO: 1584607 - RNA, 18 nt, Homo sapiens
acugagcagccgccagcu

SEQ ID NO: 1584608 - RNA, 17 nt, Homo sapiens
acugagccagucuuuga

SEQ ID NO: 1584609 - RNA, 18 nt, Homo sapiens
acugagccagucuuugaa

SEQ ID NO: 1584610 - RNA, 22 nt, Homo sapiens
acugagucacucacauugagag

SEQ ID NO: 1584611 - RNA, 19 nt, Homo sapiens
acugaucuuauguguuaca

SEQ ID NO: 1584612 - RNA, 20 nt, Homo sapiens
acugauggaaaauaccagug

SEQ ID NO: 1584613 - RNA, 22 nt, Homo sapiens
acugcaaccuccacaucccaug

SEQ ID NO: 1584614 - RNA, 14 nt, Homo sapiens
acugcaagagaugg

SEQ ID NO: 1584615 - RNA, 22 nt, Homo sapiens
accuggagggcuagaaccugga

SEQ ID NO: 1584616 - RNA, 23 nt, Homo sapiens
accuggagggcuggaaucuggag

SEQ ID NO: 1584617 - RNA, 20 nt, Homo sapiens
accuggauccagcacuggug

SEQ ID NO: 1584618 - RNA, 19 nt, Homo sapiens
accuggcccugugccuugg

SEQ ID NO: 1584619 - RNA, 23 nt, Homo sapiens
accuggcucuguggcgagccauu

SEQ ID NO: 1584620 - RNA, 14 nt, Homo sapiens
accuggucauuuca

SEQ ID NO: 1584621 - RNA, 15 nt, Homo sapiens
accuggugcuuuuaa

SEQ ID NO: 1584622 - RNA, 13 nt, Homo sapiens
accuguaauccca

SEQ ID NO: 1584623 - RNA, 24 nt, Homo sapiens
accuguacauucuuccaucaucac

SEQ ID NO: 1584624 - RNA, 21 nt, Homo sapiens
accuguaccuggccuggccuc

SEQ ID NO: 1584625 - RNA, 18 nt, Homo sapiens
accugucuaggucuccuc

SEQ ID NO: 1584626 - RNA, 18 nt, Homo sapiens
accugucuauacuacagu

SEQ ID NO: 1584627 - RNA, 21 nt, Homo sapiens
accugugcacguuggaacuuu

SEQ ID NO: 1584628 - RNA, 19 nt, Homo sapiens
accuguggccaaguucuua

SEQ ID NO: 1584629 - RNA, 14 nt, Homo sapiens
accuguucaagaag

SEQ ID NO: 1584630 - RNA, 20 nt, Homo sapiens
accuuaaagaaccaucagca

SEQ ID NO: 1584631 - RNA, 18 nt, Homo sapiens
accuuaaugacaacacuu

SEQ ID NO: 1584632 - RNA, 24 nt, Homo sapiens
accuuacugacacauugcugauau

SEQ ID NO: 1584633 - RNA, 22 nt, Homo sapiens
accuuauuaaagguaugcauuu

SEQ ID NO: 1584634 - RNA, 17 nt, Homo sapiens
accuucaaaacaagaca

SEQ ID NO: 1584635 - RNA, 16 nt, Homo sapiens
accuucagucaagaaa

SEQ ID NO: 1584636 - RNA, 16 nt, Homo sapiens
accuucauuuuuaaac

SEQ ID NO: 1584637 - RNA, 16 nt, Homo sapiens
accuuccgacauccca

SEQ ID NO: 1584638 - RNA, 21 nt, Homo sapiens
accuuggaauucgcuuucuaa

SEQ ID NO: 1584639 - RNA, 20 nt, Homo sapiens
accuuggaggaaugacaaua

SEQ ID NO: 1584640 - RNA, 20 nt, Homo sapiens
accuuggccucccaaagugu

SEQ ID NO: 1584641 - RNA, 13 nt, Homo sapiens
accuuguuuauua

SEQ ID NO: 1584642 - RNA, 23 nt, Homo sapiens
accuuuccaguuuauaagacugg

SEQ ID NO: 1584643 - RNA, 19 nt, Homo sapiens
accuuucuagggacaugaa

SEQ ID NO: 1584644 - RNA, 19 nt, Homo sapiens
accuuucugaggaguaaaa

SEQ ID NO: 1584645 - RNA, 14 nt, Homo sapiens
accuuuggaaguca

SEQ ID NO: 1584646 - RNA, 18 nt, Homo sapiens
accuuuggcugguagcag

SEQ ID NO: 1584647 - RNA, 14 nt, Homo sapiens
accuuugguuuuaa

SEQ ID NO: 1584648 - RNA, 12 nt, Homo sapiens
accuuugucaac

SEQ ID NO: 1584649 - RNA, 15 nt, Homo sapiens
accuuuuacauauuu

SEQ ID NO: 1584650 - RNA, 23 nt, Homo sapiens
accuuuuuuccuucuugacauuu

SEQ ID NO: 1584651 - RNA, 19 nt, Homo sapiens
accuuuuuuuuuuuuccaa

SEQ ID NO: 1584652 - RNA, 17 nt, Homo sapiens
acgaaaauaguauuuca

SEQ ID NO: 1584653 - RNA, 20 nt, Homo sapiens
acgaaauaugaagagcaaaa

SEQ ID NO: 1584654 - RNA, 14 nt, Homo sapiens
acgaggcucaaaaa

SEQ ID NO: 1584655 - RNA, 14 nt, Homo sapiens
acgauuaacuguga

SEQ ID NO: 1584656 - RNA, 19 nt, Homo sapiens
acgcaccagacacucacag

SEQ ID NO: 1584657 - RNA, 20 nt, Homo sapiens
acgcaccgccugaaggcaca

SEQ ID NO: 1584658 - RNA, 22 nt, Homo sapiens
acgcaggaggagaaaagaaaug

SEQ ID NO: 1584659 - RNA, 17 nt, Homo sapiens
acgcaguugauuccuug

SEQ ID NO: 1584660 - RNA, 21 nt, Homo sapiens
acgcauguaugcaugcacaaa

SEQ ID NO: 1584661 - RNA, 21 nt, Homo sapiens
acgcaugugguaaggugugua

SEQ ID NO: 1584662 - RNA, 20 nt, Homo sapiens
acgccaacauggcacaugua

SEQ ID NO: 1584663 - RNA, 15 nt, Homo sapiens
acgccagacuuccca

SEQ ID NO: 1584664 - RNA, 20 nt, Homo sapiens
acgcccuauuucuaugucau

SEQ ID NO: 1584665 - RNA, 15 nt, Homo sapiens
acgccuguaauccca

SEQ ID NO: 1584666 - RNA, 21 nt, Homo sapiens
acgccuuugugagcugugagu

SEQ ID NO: 1584667 - RNA, 19 nt, Homo sapiens
acgcggcuuuaagugugcu

SEQ ID NO: 1584668 - RNA, 17 nt, Homo sapiens
acgcuaaagagcccuug

SEQ ID NO: 1584669 - RNA, 16 nt, Homo sapiens
acgcuggcaacacaga

SEQ ID NO: 1584670 - RNA, 19 nt, Homo sapiens
acgcuuguaauuggaauac

SEQ ID NO: 1584671 - RNA, 17 nt, Homo sapiens
acgcuuguuugccugaa

SEQ ID NO: 1584672 - RNA, 13 nt, Homo sapiens
acggaaaucauga

SEQ ID NO: 1584673 - RNA, 23 nt, Homo sapiens
acggaguuuaguuuuauauugcu

SEQ ID NO: 1584674 - RNA, 19 nt, Homo sapiens
acggcguuucaccauguug

SEQ ID NO: 1584675 - RNA, 21 nt, Homo sapiens
acgggaccauuuuuacaucca

SEQ ID NO: 1584676 - RNA, 22 nt, Homo sapiens
acgguaccaauucagugucugu

SEQ ID NO: 1584677 - RNA, 20 nt, Homo sapiens
acgguagugccugaaauuuc

SEQ ID NO: 1584678 - RNA, 14 nt, Homo sapiens
acggugcugugagg

SEQ ID NO: 1584679 - RNA, 17 nt, Homo sapiens
acguaauuguacaagca

SEQ ID NO: 1584680 - RNA, 21 nt, Homo sapiens
acguaauuguacaagcaguua

SEQ ID NO: 1584681 - RNA, 18 nt, Homo sapiens
acguaauuuguuauauca

SEQ ID NO: 1584682 - RNA, 19 nt, Homo sapiens
acguagcuaguaagcauuu

SEQ ID NO: 1584683 - RNA, 11 nt, Homo sapiens
acgucauuugu

SEQ ID NO: 1584684 - RNA, 17 nt, Homo sapiens
acgucauuugugcaaga

SEQ ID NO: 1584685 - RNA, 21 nt, Homo sapiens
acgucugucaggggcuuggau

SEQ ID NO: 1584686 - RNA, 17 nt, Homo sapiens
acgugaaacagagugau

SEQ ID NO: 1584687 - RNA, 16 nt, Homo sapiens
acgugccaccaugacu

SEQ ID NO: 1584688 - RNA, 22 nt, Homo sapiens
acgugccaccaugacuggcuaa

SEQ ID NO: 1584689 - RNA, 19 nt, Homo sapiens
acguggagauagugccagg

SEQ ID NO: 1584690 - RNA, 22 nt, Homo sapiens
acguggcgggaaugagcugugu

SEQ ID NO: 1584691 - RNA, 14 nt, Homo sapiens
acgugucaaugugu

SEQ ID NO: 1584692 - RNA, 14 nt, Homo sapiens
acgugucagguggu

SEQ ID NO: 1584693 - RNA, 16 nt, Homo sapiens
acgugucaggugguua

SEQ ID NO: 1584694 - RNA, 14 nt, Homo sapiens
acguugaauugaug

SEQ ID NO: 1584695 - RNA, 22 nt, Homo sapiens
acguuggucuugaacuccugac

SEQ ID NO: 1584696 - RNA, 17 nt, Homo sapiens
acguugugcacauguac

SEQ ID NO: 1584697 - RNA, 13 nt, Homo sapiens
acguuuaagccaa

SEQ ID NO: 1584698 - RNA, 13 nt, Homo sapiens
acguuugacaaac

SEQ ID NO: 1584699 - RNA, 21 nt, Homo sapiens
acguuugcucauuuaagaauu

SEQ ID NO: 1584700 - RNA, 16 nt, Homo sapiens
acuaaaaaaaagauga

SEQ ID NO: 1584701 - RNA, 16 nt, Homo sapiens
acuaaaaauacaaaaa

SEQ ID NO: 1584702 - RNA, 17 nt, Homo sapiens
acuaaaaauaccaaaaa

SEQ ID NO: 1584703 - RNA, 18 nt, Homo sapiens
acuaaaacuggaaaugua

SEQ ID NO: 1584704 - RNA, 16 nt, Homo sapiens
acuaaaaguacauuaa

SEQ ID NO: 1584705 - RNA, 17 nt, Homo sapiens
acuaaaagucuccaaaa

SEQ ID NO: 1584706 - RNA, 15 nt, Homo sapiens
acuaaaauucaaaaa

SEQ ID NO: 1584707 - RNA, 22 nt, Homo sapiens
acuaaaauuguaucaaauguga

SEQ ID NO: 1584708 - RNA, 20 nt, Homo sapiens
acuaaacagaaaacucccaa

SEQ ID NO: 1584709 - RNA, 22 nt, Homo sapiens
acuaaaccaacucuaauauugc

SEQ ID NO: 1584710 - RNA, 15 nt, Homo sapiens
acuaaacugauuaaa

SEQ ID NO: 1584711 - RNA, 20 nt, Homo sapiens
acuaaagcucccagcuccuu

SEQ ID NO: 1584712 - RNA, 13 nt, Homo sapiens
acuaaaugaacau

SEQ ID NO: 1584713 - RNA, 24 nt, Homo sapiens
acuaaaugcucauacacaguuaaa

SEQ ID NO: 1584714 - RNA, 20 nt, Homo sapiens
acuaaauuacaaaugcaauu

SEQ ID NO: 1584715 - RNA, 14 nt, Homo sapiens
acuaaccaaugccu

SEQ ID NO: 1584716 - RNA, 18 nt, Homo sapiens
acuaaccuggguucccuu

SEQ ID NO: 1584717 - RNA, 19 nt, Homo sapiens
acuaagcaaauaggcaaaa

SEQ ID NO: 1584718 - RNA, 23 nt, Homo sapiens
acuaauagaauaaaggcaguuuu

SEQ ID NO: 1584719 - RNA, 16 nt, Homo sapiens
acuaaugaaguauuac

SEQ ID NO: 1584720 - RNA, 19 nt, Homo sapiens
acuaauuauacuacuuugu

SEQ ID NO: 1584721 - RNA, 20 nt, Homo sapiens
acuaauuuaguaauagccug

SEQ ID NO: 1584722 - RNA, 15 nt, Homo sapiens
acuaauuuuacaugu

SEQ ID NO: 1584723 - RNA, 15 nt, Homo sapiens
acuacaaacuucaaa

SEQ ID NO: 1584724 - RNA, 15 nt, Homo sapiens
acuacaucugggacu

SEQ ID NO: 1584725 - RNA, 22 nt, Homo sapiens
acuacaucugggacugacuuuc

SEQ ID NO: 1584726 - RNA, 18 nt, Homo sapiens
acuacaugugaacuggga

SEQ ID NO: 1584727 - RNA, 15 nt, Homo sapiens
acuacauuuucacaa

SEQ ID NO: 1584728 - RNA, 16 nt, Homo sapiens
acuacuagagcuccau

SEQ ID NO: 1584729 - RNA, 21 nt, Homo sapiens
acuacuuggaacuaggcucuu

SEQ ID NO: 1584730 - RNA, 20 nt, Homo sapiens
acuagaaaauuagacuguga

SEQ ID NO: 1584731 - RNA, 18 nt, Homo sapiens
acuagaccuguaacuuuu

SEQ ID NO: 1584732 - RNA, 23 nt, Homo sapiens
aagacgucacccuccauucugca

SEQ ID NO: 1584733 - RNA, 15 nt, Homo sapiens
aagacuaacuugaaa

SEQ ID NO: 1584734 - RNA, 22 nt, Homo sapiens
aagacucaggagucugccacuu

SEQ ID NO: 1584735 - RNA, 14 nt, Homo sapiens
aagacugagcagaa

SEQ ID NO: 1584736 - RNA, 23 nt, Homo sapiens
aagacugauuuuaauagggaaua

SEQ ID NO: 1584737 - RNA, 18 nt, Homo sapiens
aagacugguuuucugcca

SEQ ID NO: 1584738 - RNA, 17 nt, Homo sapiens
aagacuuaucaacauuu

SEQ ID NO: 1584739 - RNA, 21 nt, Homo sapiens
aagagaaaaagcagaggccaa

SEQ ID NO: 1584740 - RNA, 15 nt, Homo sapiens
aagagaaaaugcguc

SEQ ID NO: 1584741 - RNA, 14 nt, Homo sapiens
aagagaaacuucaa

SEQ ID NO: 1584742 - RNA, 14 nt, Homo sapiens
aagagaaguuguaa

SEQ ID NO: 1584743 - RNA, 21 nt, Homo sapiens
aagagaaucaacauuucucaa

SEQ ID NO: 1584744 - RNA, 20 nt, Homo sapiens
aagagaccacccauaucaug

SEQ ID NO: 1584745 - RNA, 22 nt, Homo sapiens
aagagagcgagacccugucuca

SEQ ID NO: 1584746 - RNA, 23 nt, Homo sapiens
aagagagcgagacccugucucaa

SEQ ID NO: 1584747 - RNA, 15 nt, Homo sapiens
aagagaucuacacau

SEQ ID NO: 1584748 - RNA, 18 nt, Homo sapiens
aagagaucuacacauguu

SEQ ID NO: 1584749 - RNA, 16 nt, Homo sapiens
aagagaucuuucuuuc

SEQ ID NO: 1584750 - RNA, 17 nt, Homo sapiens
aagagaucuuucuuucc

SEQ ID NO: 1584751 - RNA, 18 nt, Homo sapiens
aagagcaaagggaaauca

SEQ ID NO: 1584752 - RNA, 18 nt, Homo sapiens
aagagcauagaacucaaa

SEQ ID NO: 1584753 - RNA, 20 nt, Homo sapiens
aagagcauggaugcauuuca

SEQ ID NO: 1584754 - RNA, 22 nt, Homo sapiens
aagagcccucaagcggcccuua

SEQ ID NO: 1584755 - RNA, 23 nt, Homo sapiens
aagagcuaagauaaagacugugg

SEQ ID NO: 1584756 - RNA, 23 nt, Homo sapiens
acccaggugggucccggcucugu

SEQ ID NO: 1584757 - RNA, 14 nt, Homo sapiens
acccagguucauga

SEQ ID NO: 1584758 - RNA, 20 nt, Homo sapiens
acccagucuucuacacagau

SEQ ID NO: 1584759 - RNA, 19 nt, Homo sapiens
acccaguggacucuuccac

SEQ ID NO: 1584760 - RNA, 15 nt, Homo sapiens
acccaugccagagag

SEQ ID NO: 1584761 - RNA, 17 nt, Homo sapiens
acccauguaaccacugc

SEQ ID NO: 1584762 - RNA, 18 nt, Homo sapiens
acccauucacuacaggug

SEQ ID NO: 1584763 - RNA, 17 nt, Homo sapiens
acccauucuacacagag

SEQ ID NO: 1584764 - RNA, 16 nt, Homo sapiens
acccauuucaaugugu

SEQ ID NO: 1584765 - RNA, 13 nt, Homo sapiens
accccagcauucc

SEQ ID NO: 1584766 - RNA, 16 nt, Homo sapiens
accccagccauccagg

SEQ ID NO: 1584767 - RNA, 17 nt, Homo sapiens
accccagucgugaugug

SEQ ID NO: 1584768 - RNA, 21 nt, Homo sapiens
acccccagccuggacaccucu

SEQ ID NO: 1584769 - RNA, 16 nt, Homo sapiens
acccccaucuuuacaa

SEQ ID NO: 1584770 - RNA, 12 nt, Homo sapiens
acccccaugcug

SEQ ID NO: 1584771 - RNA, 14 nt, Homo sapiens
acccccuucagugc

SEQ ID NO: 1584772 - RNA, 14 nt, Homo sapiens
accccgggcucucu

SEQ ID NO: 1584773 - RNA, 16 nt, Homo sapiens
accccuccucccucag

SEQ ID NO: 1584774 - RNA, 19 nt, Homo sapiens
accccuccucccucagacu

SEQ ID NO: 1584775 - RNA, 17 nt, Homo sapiens
accccuguuucuggcac

SEQ ID NO: 1584776 - RNA, 22 nt, Homo sapiens
accccuuguccgcaagggguga

SEQ ID NO: 1584777 - RNA, 14 nt, Homo sapiens
accccuuguuacuc

SEQ ID NO: 1584778 - RNA, 17 nt, Homo sapiens
acccgccgccucccacg

SEQ ID NO: 1584779 - RNA, 16 nt, Homo sapiens
acccgugggugugugu

SEQ ID NO: 1584780 - RNA, 16 nt, Homo sapiens
acccuaagccaagacc

SEQ ID NO: 1584781 - RNA, 16 nt, Homo sapiens
acccuacaguauauaa

SEQ ID NO: 1584782 - RNA, 17 nt, Homo sapiens
acccuauaaaucaacac

SEQ ID NO: 1584783 - RNA, 16 nt, Homo sapiens
acccuaucugugauuc

SEQ ID NO: 1584784 - RNA, 14 nt, Homo sapiens
acccucagcacugu

SEQ ID NO: 1584785 - RNA, 15 nt, Homo sapiens
acccucagcacuguu

SEQ ID NO: 1584786 - RNA, 22 nt, Homo sapiens
acccuccagagacaacagguaa

SEQ ID NO: 1584787 - RNA, 16 nt, Homo sapiens
acccuccccuagucac

SEQ ID NO: 1584788 - RNA, 23 nt, Homo sapiens
acccugaagcuuaggacuaccag

SEQ ID NO: 1584789 - RNA, 15 nt, Homo sapiens
acccugaucuucacu

SEQ ID NO: 1584790 - RNA, 15 nt, Homo sapiens
acccugcaagaccac

SEQ ID NO: 1584791 - RNA, 18 nt, Homo sapiens
acccugcaagaccacgga

SEQ ID NO: 1584792 - RNA, 16 nt, Homo sapiens
acccugcccucaugcu

SEQ ID NO: 1584793 - RNA, 20 nt, Homo sapiens
acccugcgucgaaggaugcu

SEQ ID NO: 1584794 - RNA, 18 nt, Homo sapiens
acccugcuacacauacag

SEQ ID NO: 1584795 - RNA, 16 nt, Homo sapiens
acccugcuccuagcac

SEQ ID NO: 1584796 - RNA, 22 nt, Homo sapiens
acccuggauugaaagugaaaau

SEQ ID NO: 1584797 - RNA, 21 nt, Homo sapiens
acccugggagccaguccucca

SEQ ID NO: 1584798 - RNA, 18 nt, Homo sapiens
acccuggggcgugcagca

SEQ ID NO: 1584799 - RNA, 15 nt, Homo sapiens
acccugucucaaaaa

SEQ ID NO: 1584800 - RNA, 17 nt, Homo sapiens
acccuucagauuugccu

SEQ ID NO: 1584801 - RNA, 10 nt, Homo sapiens
acccuuccag

SEQ ID NO: 1584802 - RNA, 22 nt, Homo sapiens
acccuugugagagcccauuccc

SEQ ID NO: 1584803 - RNA, 19 nt, Homo sapiens
accgaggcagggaaggauc

SEQ ID NO: 1584804 - RNA, 22 nt, Homo sapiens
accgcacaugugccacuguuca

SEQ ID NO: 1584805 - RNA, 13 nt, Homo sapiens
accgccacugggc

SEQ ID NO: 1584806 - RNA, 17 nt, Homo sapiens
accgcccaucaggguuc

SEQ ID NO: 1584807 - RNA, 17 nt, Homo sapiens
accgccugaaggcacag

SEQ ID NO: 1584808 - RNA, 18 nt, Homo sapiens
accgcgggggcugugagc

SEQ ID NO: 1584809 - RNA, 22 nt, Homo sapiens
accgggagccucccccucagau

SEQ ID NO: 1584810 - RNA, 16 nt, Homo sapiens
accguacaucugcaau

SEQ ID NO: 1584811 - RNA, 19 nt, Homo sapiens
accguauccauaaagaccc

SEQ ID NO: 1584812 - RNA, 13 nt, Homo sapiens
accguaucucagg

SEQ ID NO: 1584813 - RNA, 17 nt, Homo sapiens
accguguaacacgugaa

SEQ ID NO: 1584814 - RNA, 21 nt, Homo sapiens
accguuuugaagcuacugugu

SEQ ID NO: 1584815 - RNA, 15 nt, Homo sapiens
accuaaauuucugcc

SEQ ID NO: 1584816 - RNA, 14 nt, Homo sapiens
accuaagucauucc

SEQ ID NO: 1584817 - RNA, 15 nt, Homo sapiens
accuacagagcaccu

SEQ ID NO: 1584818 - RNA, 14 nt, Homo sapiens
accuacaguguaca

SEQ ID NO: 1584819 - RNA, 15 nt, Homo sapiens
accuacauuaucuca

SEQ ID NO: 1584820 - RNA, 16 nt, Homo sapiens
accuacauuaucucac

SEQ ID NO: 1584821 - RNA, 21 nt, Homo sapiens
accuacuuugacuuuuugcau

SEQ ID NO: 1584822 - RNA, 23 nt, Homo sapiens
accuaguacugccccccaugagg

SEQ ID NO: 1584823 - RNA, 15 nt, Homo sapiens
accuaugccuguggu

SEQ ID NO: 1584824 - RNA, 14 nt, Homo sapiens
accucaccaaggac

SEQ ID NO: 1584825 - RNA, 16 nt, Homo sapiens
accucaccugaccuca

SEQ ID NO: 1584826 - RNA, 22 nt, Homo sapiens
accucacuuuaggcagcuguaa

SEQ ID NO: 1584827 - RNA, 20 nt, Homo sapiens
accuccaacaacgacacauu

SEQ ID NO: 1584828 - RNA, 20 nt, Homo sapiens
accuccaacacagugcaucu

SEQ ID NO: 1584829 - RNA, 20 nt, Homo sapiens
accuccaaggaccucucuca

SEQ ID NO: 1584830 - RNA, 15 nt, Homo sapiens
accuccacauaccug

SEQ ID NO: 1584831 - RNA, 19 nt, Homo sapiens
accuccacaucccauguug

SEQ ID NO: 1584832 - RNA, 14 nt, Homo sapiens
accuccacucugcc

SEQ ID NO: 1584833 - RNA, 15 nt, Homo sapiens
accuccagggagcac

SEQ ID NO: 1584834 - RNA, 21 nt, Homo sapiens
accuccccacccgcucccaca

SEQ ID NO: 1584835 - RNA, 23 nt, Homo sapiens
accuccuaauuccacacccucac

SEQ ID NO: 1584836 - RNA, 13 nt, Homo sapiens
accuccucuguga

SEQ ID NO: 1584837 - RNA, 18 nt, Homo sapiens
accuccugaguaauaagc

SEQ ID NO: 1584838 - RNA, 13 nt, Homo sapiens
accucgugaucca

SEQ ID NO: 1584839 - RNA, 24 nt, Homo sapiens
accucuaguaaauuuaaguccacc

SEQ ID NO: 1584840 - RNA, 19 nt, Homo sapiens
accucucagcugcuggaug

SEQ ID NO: 1584841 - RNA, 18 nt, Homo sapiens
accucugagaagacacaa

SEQ ID NO: 1584842 - RNA, 19 nt, Homo sapiens
accucugauggcugaagaa

SEQ ID NO: 1584843 - RNA, 20 nt, Homo sapiens
accucuucuacccucaucau

SEQ ID NO: 1584844 - RNA, 18 nt, Homo sapiens
accugaaauaaaauucau

SEQ ID NO: 1584845 - RNA, 23 nt, Homo sapiens
accugacaggugaggucuguucc

SEQ ID NO: 1584846 - RNA, 22 nt, Homo sapiens
accugacccuucucucacuucu

SEQ ID NO: 1584847 - RNA, 12 nt, Homo sapiens
accugacuucca

SEQ ID NO: 1584848 - RNA, 13 nt, Homo sapiens
accugacuuccac

SEQ ID NO: 1584849 - RNA, 14 nt, Homo sapiens
accugacuuccucu

SEQ ID NO: 1584850 - RNA, 13 nt, Homo sapiens
accugcauugaac

SEQ ID NO: 1584851 - RNA, 15 nt, Homo sapiens
accugccacaguuca

SEQ ID NO: 1584852 - RNA, 15 nt, Homo sapiens
accugccacucugcc

SEQ ID NO: 1584853 - RNA, 23 nt, Homo sapiens
accugcgcuguggacacugagaa

SEQ ID NO: 1584854 - RNA, 23 nt, Homo sapiens
accugcucuuguucuacugagaa

SEQ ID NO: 1584855 - RNA, 13 nt, Homo sapiens
accugcuuggucu

SEQ ID NO: 1584856 - RNA, 20 nt, Homo sapiens
accuggaaucuacaagccaa

SEQ ID NO: 1584857 - RNA, 22 nt, Homo sapiens
accuggagaacuagaaccugga

SEQ ID NO: 1584858 - RNA, 22 nt, Homo sapiens
accuggagagcuagaaccuaga

SEQ ID NO: 1584859 - RNA, 23 nt, Homo sapiens
aacaugacauccagagaugacua

SEQ ID NO: 1584860 - RNA, 12 nt, Homo sapiens
aacaugcaauaa

SEQ ID NO: 1584861 - RNA, 19 nt, Homo sapiens
aacaugccagccacuguga

SEQ ID NO: 1584862 - RNA, 15 nt, Homo sapiens
aacauggagcuguca

SEQ ID NO: 1584863 - RNA, 16 nt, Homo sapiens
aacauggagcugucau

SEQ ID NO: 1584864 - RNA, 21 nt, Homo sapiens
aacauggaggaacaguauuac

SEQ ID NO: 1584865 - RNA, 22 nt, Homo sapiens
aacauggugaaaccccgucucu

SEQ ID NO: 1584866 - RNA, 17 nt, Homo sapiens
aacauguucagaaaaga

SEQ ID NO: 1584867 - RNA, 18 nt, Homo sapiens
aacauuacuuauuuaacu

SEQ ID NO: 1584868 - RNA, 22 nt, Homo sapiens
aacauuaucuaguucauugaau

SEQ ID NO: 1584869 - RNA, 15 nt, Homo sapiens
aacauucauagucuu

SEQ ID NO: 1584870 - RNA, 21 nt, Homo sapiens
aacauuccagggaugagccaa

SEQ ID NO: 1584871 - RNA, 12 nt, Homo sapiens
aacauucucuca

SEQ ID NO: 1584872 - RNA, 16 nt, Homo sapiens
aacauucugggccuuu

SEQ ID NO: 1584873 - RNA, 20 nt, Homo sapiens
aacauuucaccccacucugu

SEQ ID NO: 1584874 - RNA, 20 nt, Homo sapiens
aacauuucuauagccaaaaa

SEQ ID NO: 1584875 - RNA, 15 nt, Homo sapiens
aacauuuuacaguaa

SEQ ID NO: 1584876 - RNA, 14 nt, Homo sapiens
aacauuuugacuaa

SEQ ID NO: 1584877 - RNA, 22 nt, Homo sapiens
aaccaaacccagguucaugaau

SEQ ID NO: 1584878 - RNA, 14 nt, Homo sapiens
aaccaagcaaauua

SEQ ID NO: 1584879 - RNA, 20 nt, Homo sapiens
aaccaauagugaaaugccac

SEQ ID NO: 1584880 - RNA, 11 nt, Homo sapiens
aaccacaagca

SEQ ID NO: 1584881 - RNA, 18 nt, Homo sapiens
aaccacagcagacaccau

SEQ ID NO: 1584882 - RNA, 12 nt, Homo sapiens
aaccacugcacu

SEQ ID NO: 1584883 - RNA, 14 nt, Homo sapiens
aaccacuguacaca

SEQ ID NO: 1584884 - RNA, 13 nt, Homo sapiens
aaccacuguacau

SEQ ID NO: 1584885 - RNA, 17 nt, Homo sapiens
aaccacuguguacugga

SEQ ID NO: 1584886 - RNA, 20 nt, Homo sapiens
guugccccacucaucugccg

SEQ ID NO: 1584887 - RNA, 15 nt, Homo sapiens
guugccucucuuuga

SEQ ID NO: 1584888 - RNA, 14 nt, Homo sapiens
guugcuauacaugu

SEQ ID NO: 1584889 - RNA, 15 nt, Homo sapiens
guugcugcugugaau

SEQ ID NO: 1584890 - RNA, 20 nt, Homo sapiens
guugcugcuugugaucucac

SEQ ID NO: 1584891 - RNA, 16 nt, Homo sapiens
guugcuggcaguacug

SEQ ID NO: 1584892 - RNA, 16 nt, Homo sapiens
guugcuuuuuuuccaa

SEQ ID NO: 1584893 - RNA, 15 nt, Homo sapiens
guuggauuccaugcu

SEQ ID NO: 1584894 - RNA, 23 nt, Homo sapiens
guuggcaugguaguauacaaaaa

SEQ ID NO: 1584895 - RNA, 18 nt, Homo sapiens
guuggccaggauggucuc

SEQ ID NO: 1584896 - RNA, 12 nt, Homo sapiens
guuggucuugaa

SEQ ID NO: 1584897 - RNA, 13 nt, Homo sapiens
guuggugcugcuu

SEQ ID NO: 1584898 - RNA, 19 nt, Homo sapiens
guuguaacuaggcucagag

SEQ ID NO: 1584899 - RNA, 17 nt, Homo sapiens
guugucuccacuuguau

SEQ ID NO: 1584900 - RNA, 15 nt, Homo sapiens
guuguggggccucag

SEQ ID NO: 1584901 - RNA, 23 nt, Homo sapiens
guuguucucuucuuuaaagggau

SEQ ID NO: 1584902 - RNA, 13 nt, Homo sapiens
guuguuguuguug

SEQ ID NO: 1584903 - RNA, 24 nt, Homo sapiens
guuguuuucagacucagacuccau

SEQ ID NO: 1584904 - RNA, 22 nt, Homo sapiens
guuuaaaaaggcaguuugcaaa

SEQ ID NO: 1584905 - RNA, 13 nt, Homo sapiens
guuuaaaugccaa

SEQ ID NO: 1584906 - RNA, 16 nt, Homo sapiens
guuuacagcacuacuc

SEQ ID NO: 1584907 - RNA, 12 nt, Homo sapiens
guuuaccagaga

SEQ ID NO: 1584908 - RNA, 12 nt, Homo sapiens
guuuaccaucug

SEQ ID NO: 1584909 - RNA, 23 nt, Homo sapiens
guuuauauuuucaugugguacua

SEQ ID NO: 1584910 - RNA, 19 nt, Homo sapiens
guuuaugauauuucuugcu

SEQ ID NO: 1584911 - RNA, 19 nt, Homo sapiens
guuuauuguauacugccuu

SEQ ID NO: 1584912 - RNA, 16 nt, Homo sapiens
guuucaaguaccaaaa

SEQ ID NO: 1584913 - RNA, 18 nt, Homo sapiens
guuucacagaaaauaagg

SEQ ID NO: 1584914 - RNA, 18 nt, Homo sapiens
guuucacagccuauaacc

SEQ ID NO: 1584915 - RNA, 17 nt, Homo sapiens
guuucaucaaugcaguu

SEQ ID NO: 1584916 - RNA, 14 nt, Homo sapiens
guuuccacuggcuu

SEQ ID NO: 1584917 - RNA, 19 nt, Homo sapiens
guuuccuagcugugugaau

SEQ ID NO: 1584918 - RNA, 23 nt, Homo sapiens
guuuccugacagaugccugguga

SEQ ID NO: 1584919 - RNA, 21 nt, Homo sapiens
guuucgaagaauaaaauauga

SEQ ID NO: 1584920 - RNA, 21 nt, Homo sapiens
guuucguaacacagcauugua

SEQ ID NO: 1584921 - RNA, 21 nt, Homo sapiens
guuucugucaagcuggugcua

SEQ ID NO: 1584922 - RNA, 14 nt, Homo sapiens
guuucuugcaaggg

SEQ ID NO: 1584923 - RNA, 21 nt, Homo sapiens
guuucuugcucccagaccaag

SEQ ID NO: 1584924 - RNA, 16 nt, Homo sapiens
guuucuuuuugcucgc

SEQ ID NO: 1584925 - RNA, 19 nt, Homo sapiens
guuugaaaguuguacauga

SEQ ID NO: 1584926 - RNA, 15 nt, Homo sapiens
guuugaaggggagag

SEQ ID NO: 1584927 - RNA, 10 nt, Homo sapiens
guuugacaaa

SEQ ID NO: 1584928 - RNA, 20 nt, Homo sapiens
guuugaguuuuuccucccag

SEQ ID NO: 1584929 - RNA, 18 nt, Homo sapiens
guuugauaaaaagaucaa

SEQ ID NO: 1584930 - RNA, 12 nt, Homo sapiens
guuugcacuuac

SEQ ID NO: 1584931 - RNA, 17 nt, Homo sapiens
guuugcuuugcuuugua

SEQ ID NO: 1584932 - RNA, 19 nt, Homo sapiens
guuuggcaaaacucaggca

SEQ ID NO: 1584933 - RNA, 18 nt, Homo sapiens
guuuggggagacagguga

SEQ ID NO: 1584934 - RNA, 13 nt, Homo sapiens
guuuggucauuuu

SEQ ID NO: 1584935 - RNA, 22 nt, Homo sapiens
guuuuaaaagagaagcaucauu

SEQ ID NO: 1584936 - RNA, 17 nt, Homo sapiens
guuuuaacuguggauau

SEQ ID NO: 1584937 - RNA, 21 nt, Homo sapiens
guuuuacaguguuucuggcuu

SEQ ID NO: 1584938 - RNA, 19 nt, Homo sapiens
guuuucaagaugguguuau

SEQ ID NO: 1584939 - RNA, 12 nt, Homo sapiens
guuuucauuugc

SEQ ID NO: 1584940 - RNA, 17 nt, Homo sapiens
guuuuccaguucaucga

SEQ ID NO: 1584941 - RNA, 14 nt, Homo sapiens
guuuucuucacuau

SEQ ID NO: 1584942 - RNA, 15 nt, Homo sapiens
guuuuguauucucug

SEQ ID NO: 1584943 - RNA, 19 nt, Homo sapiens
guuuugucagacuuccaaa

SEQ ID NO: 1584944 - RNA, 19 nt, Homo sapiens
guuuuguuaauauacccca

SEQ ID NO: 1584945 - RNA, 23 nt, Homo sapiens
guuuuguuuuuuuucagccacua

SEQ ID NO: 1584946 - RNA, 18 nt, Homo sapiens
guuuuuauaccagcuuaa

SEQ ID NO: 1584947 - RNA, 19 nt, Homo sapiens
guuuuuauaccagcuuaau

SEQ ID NO: 1584948 - RNA, 18 nt, Homo sapiens
guuuuugucuaugaauau

SEQ ID NO: 1584949 - RNA, 21 nt, Homo sapiens
guuuuuugaaauuaugugaca

SEQ ID NO: 1584950 - RNA, 16 nt, Homo sapiens
guuuuuugaaccucca

SEQ ID NO: 1584951 - RNA, 18 nt, Homo sapiens
uaaaaaaaaaaaaaagcu

SEQ ID NO: 1584952 - RNA, 23 nt, Homo sapiens
uaaaaaaaaauuguaucucauua

SEQ ID NO: 1584953 - RNA, 23 nt, Homo sapiens
uaaaaaaaaugauaaggcucuga

SEQ ID NO: 1584954 - RNA, 16 nt, Homo sapiens
uaaaaaacuucaugua

SEQ ID NO: 1584955 - RNA, 13 nt, Homo sapiens
uaaaaaagcauac

SEQ ID NO: 1584956 - RNA, 15 nt, Homo sapiens
uaaaaaauacuguug

SEQ ID NO: 1584957 - RNA, 21 nt, Homo sapiens
uaaaaaauauugaaaugcugu

SEQ ID NO: 1584958 - RNA, 15 nt, Homo sapiens
uaaaaaauggagcuc

SEQ ID NO: 1584959 - RNA, 12 nt, Homo sapiens
uaaaaacaaagu

SEQ ID NO: 1584960 - RNA, 22 nt, Homo sapiens
uaaaaauaaagaaaucagccau

SEQ ID NO: 1584961 - RNA, 17 nt, Homo sapiens
uaaaaauacaacacuga

SEQ ID NO: 1584962 - RNA, 16 nt, Homo sapiens
uaaaaaucuagcacac

SEQ ID NO: 1584963 - RNA, 20 nt, Homo sapiens
uaaaaaucuagcacacucuu

SEQ ID NO: 1584964 - RNA, 13 nt, Homo sapiens
uaaaaaucuccau

SEQ ID NO: 1584965 - RNA, 19 nt, Homo sapiens
uaaaaaugcugcucucagc

SEQ ID NO: 1584966 - RNA, 21 nt, Homo sapiens
uaaaaauggauagcucauuaa

SEQ ID NO: 1584967 - RNA, 22 nt, Homo sapiens
uaaaaaugucuugcuguugaca

SEQ ID NO: 1584968 - RNA, 19 nt, Homo sapiens
uaaaaauuuauaagcauuu

SEQ ID NO: 1584969 - RNA, 12 nt, Homo sapiens
uaaaacaaaaga

SEQ ID NO: 1584970 - RNA, 13 nt, Homo sapiens
uaaaacaaaagag

SEQ ID NO: 1584971 - RNA, 16 nt, Homo sapiens
uaaaacaaaauuugac

SEQ ID NO: 1584972 - RNA, 22 nt, Homo sapiens
uaaaacaaaauuugacuaauuu

SEQ ID NO: 1584973 - RNA, 18 nt, Homo sapiens
uaaaacaauacaucaaca

SEQ ID NO: 1584974 - RNA, 11 nt, Homo sapiens
uaaaacacuuc

SEQ ID NO: 1584975 - RNA, 22 nt, Homo sapiens
cuuaugcguaagugguaugcau

SEQ ID NO: 1584976 - RNA, 18 nt, Homo sapiens
cuuauggaauugauuugc

SEQ ID NO: 1584977 - RNA, 17 nt, Homo sapiens
cuuauggacuguuuuga

SEQ ID NO: 1584978 - RNA, 12 nt, Homo sapiens
cuuaugggguga

SEQ ID NO: 1584979 - RNA, 17 nt, Homo sapiens
cuuauguguuacauuau

SEQ ID NO: 1584980 - RNA, 22 nt, Homo sapiens
cuuauguugcacaaugagaaaa

SEQ ID NO: 1584981 - RNA, 13 nt, Homo sapiens
cuuauucauuccu

SEQ ID NO: 1584982 - RNA, 24 nt, Homo sapiens
cuuauugcaucccaaaccacgccu

SEQ ID NO: 1584983 - RNA, 23 nt, Homo sapiens
cuuauuuaaugccgauauacucu

SEQ ID NO: 1584984 - RNA, 14 nt, Homo sapiens
cuuauuuacagaua

SEQ ID NO: 1584985 - RNA, 18 nt, Homo sapiens
cuuauuucagccaaaaca

SEQ ID NO: 1584986 - RNA, 20 nt, Homo sapiens
cuuauuuggaauauauauca

SEQ ID NO: 1584987 - RNA, 14 nt, Homo sapiens
cuucaaaccuaaaa

SEQ ID NO: 1584988 - RNA, 12 nt, Homo sapiens
cuucaacccagu

SEQ ID NO: 1584989 - RNA, 24 nt, Homo sapiens
cuucaacugaaaaaaacauaucca

SEQ ID NO: 1584990 - RNA, 21 nt, Homo sapiens
cuucaagagcaucuggaacaa

SEQ ID NO: 1584991 - RNA, 16 nt, Homo sapiens
cugcauguacuguaua

SEQ ID NO: 1584992 - RNA, 22 nt, Homo sapiens
cugcauuacucacuugcugcga

SEQ ID NO: 1584993 - RNA, 15 nt, Homo sapiens
cugcauuacuccuuc

SEQ ID NO: 1584994 - RNA, 12 nt, Homo sapiens
cugcauuccagc

SEQ ID NO: 1584995 - RNA, 13 nt, Homo sapiens
cugcauuccagcc

SEQ ID NO: 1584996 - RNA, 16 nt, Homo sapiens
cugcauuuacagugua

SEQ ID NO: 1584997 - RNA, 11 nt, Homo sapiens
cugccaagagu

SEQ ID NO: 1584998 - RNA, 16 nt, Homo sapiens
cugccacucacacagc

SEQ ID NO: 1584999 - RNA, 12 nt, Homo sapiens
cugccagccuug

SEQ ID NO: 1585000 - RNA, 20 nt, Homo sapiens
cugccaggggauuuggggcu

SEQ ID NO: 1585001 - RNA, 23 nt, Homo sapiens
cugccaguuucuccauccagcuc

SEQ ID NO: 1585002 - RNA, 13 nt, Homo sapiens
cugcccaaugaga

SEQ ID NO: 1585003 - RNA, 16 nt, Homo sapiens
cugcccacucugcaag

SEQ ID NO: 1585004 - RNA, 22 nt, Homo sapiens
cugcccagacugaugagcacau

SEQ ID NO: 1585005 - RNA, 16 nt, Homo sapiens
cugccccugagcccau

SEQ ID NO: 1585006 - RNA, 19 nt, Homo sapiens
cugcccgcgggagacagcu

SEQ ID NO: 1585007 - RNA, 18 nt, Homo sapiens
cccuuaggaauauacaua

SEQ ID NO: 1585008 - RNA, 19 nt, Homo sapiens
cccuuccccugcugaccuu

SEQ ID NO: 1585009 - RNA, 16 nt, Homo sapiens
cccuucccucugggca

SEQ ID NO: 1585010 - RNA, 14 nt, Homo sapiens
cccuuccucccauu

SEQ ID NO: 1585011 - RNA, 22 nt, Homo sapiens
cccuuccuguuucucguuguca

SEQ ID NO: 1585012 - RNA, 20 nt, Homo sapiens
cccuuccuucuuugucuugc

SEQ ID NO: 1585013 - RNA, 17 nt, Homo sapiens
cccuucucccaguccaa

SEQ ID NO: 1585014 - RNA, 21 nt, Homo sapiens
cccuugguccuggaacauuua

SEQ ID NO: 1585015 - RNA, 21 nt, Homo sapiens
cccuuggucgccuagacugga

SEQ ID NO: 1585016 - RNA, 13 nt, Homo sapiens
cccagcuacucag

SEQ ID NO: 1585017 - RNA, 13 nt, Homo sapiens
cccaggaagccca

SEQ ID NO: 1585018 - RNA, 21 nt, Homo sapiens
cccaggccccagacagggugg

SEQ ID NO: 1585019 - RNA, 23 nt, Homo sapiens
cccaggccuaucuggaagccacc

SEQ ID NO: 1585020 - RNA, 12 nt, Homo sapiens
cccagggggaga

SEQ ID NO: 1585021 - RNA, 22 nt, Homo sapiens
cccagggucauaaguggggaga

SEQ ID NO: 1585022 - RNA, 20 nt, Homo sapiens
cccaguacaggggugcugca

SEQ ID NO: 1585023 - RNA, 19 nt, Homo sapiens
cccagugacaacaucgcaa

SEQ ID NO: 1585024 - RNA, 14 nt, Homo sapiens
cacccugggagcca

SEQ ID NO: 1585025 - RNA, 15 nt, Homo sapiens
cacccugggcagcua

SEQ ID NO: 1585026 - RNA, 12 nt, Homo sapiens
caccgagaagag

SEQ ID NO: 1585027 - RNA, 22 nt, Homo sapiens
caccuaagaucucgguuugcca

SEQ ID NO: 1585028 - RNA, 14 nt, Homo sapiens
caccuaauaucaau

SEQ ID NO: 1585029 - RNA, 23 nt, Homo sapiens
caccuaugagugagaauaugugg

SEQ ID NO: 1585030 - RNA, 12 nt, Homo sapiens
caccuauuucca

SEQ ID NO: 1585031 - RNA, 14 nt, Homo sapiens
caccucaccaaaac

SEQ ID NO: 1585032 - RNA, 21 nt, Homo sapiens
caccucaugagucuaccugag

SEQ ID NO: 1585033 - RNA, 15 nt, Homo sapiens
caccucuaaacaucu

SEQ ID NO: 1585034 - RNA, 20 nt, Homo sapiens
caccucugccucaaugugaa

SEQ ID NO: 1585035 - RNA, 23 nt, Homo sapiens
caccucuuccgacucuuucugag

SEQ ID NO: 1585036 - RNA, 17 nt, Homo sapiens
caccucuucuuuaccag

SEQ ID NO: 1585037 - RNA, 12 nt, Homo sapiens
caccugccuugg

SEQ ID NO: 1585038 - RNA, 21 nt, Homo sapiens
caccuggaugucugggugacc

SEQ ID NO: 1585039 - RNA, 12 nt, Homo sapiens
caccuuugccac

SEQ ID NO: 1585040 - RNA, 17 nt, Homo sapiens
caccuuugccacaaagc

SEQ ID NO: 1585041 - RNA, 22 nt, Homo sapiens
caccuuugcuacgcaaggaaau

SEQ ID NO: 1585042 - RNA, 17 nt, Homo sapiens
caccuuuuauugacaca

SEQ ID NO: 1585043 - RNA, 20 nt, Homo sapiens
cacgaaagaaauguaccuuc

SEQ ID NO: 1585044 - RNA, 16 nt, Homo sapiens
cacgaacccaccugcu

SEQ ID NO: 1585045 - RNA, 20 nt, Homo sapiens
cacgacugcgggagccagac

SEQ ID NO: 1585046 - RNA, 20 nt, Homo sapiens
cacgacuguuguacaagcuc

SEQ ID NO: 1585047 - RNA, 15 nt, Homo sapiens
cacgauuuugcacaa

SEQ ID NO: 1585048 - RNA, 20 nt, Homo sapiens
cacgcagugcggauccggga

SEQ ID NO: 1585049 - RNA, 18 nt, Homo sapiens
cacgccauuguacuccag

SEQ ID NO: 1585050 - RNA, 22 nt, Homo sapiens
cacgccuguaaucccagcacuu

SEQ ID NO: 1585051 - RNA, 16 nt, Homo sapiens
cacggauggugcaugg

SEQ ID NO: 1585052 - RNA, 17 nt, Homo sapiens
cacggcguuuuuuuaca

SEQ ID NO: 1585053 - RNA, 23 nt, Homo sapiens
cacggcuccuccuuaugacucca

SEQ ID NO: 1585054 - RNA, 18 nt, Homo sapiens
cacguauucuuguaucaa

SEQ ID NO: 1585055 - RNA, 15 nt, Homo sapiens
cacguauuugaaugg

SEQ ID NO: 1585056 - RNA, 19 nt, Homo sapiens
cacgugaaggcaaugcuca

SEQ ID NO: 1585057 - RNA, 22 nt, Homo sapiens
cacgugaauauuuugcuaaaaa

SEQ ID NO: 1585058 - RNA, 15 nt, Homo sapiens
cacguggggcccacu

SEQ ID NO: 1585059 - RNA, 22 nt, Homo sapiens
cacgugugugugugugcacauc

SEQ ID NO: 1585060 - RNA, 15 nt, Homo sapiens
cacguucugcucauc

SEQ ID NO: 1585061 - RNA, 17 nt, Homo sapiens
cacguugugcacaugua

SEQ ID NO: 1585062 - RNA, 18 nt, Homo sapiens
cacuaaaaggaagacagu

SEQ ID NO: 1585063 - RNA, 16 nt, Homo sapiens
cacuaacaaacucuga

SEQ ID NO: 1585064 - RNA, 12 nt, Homo sapiens
cacuaaccaaug

SEQ ID NO: 1585065 - RNA, 20 nt, Homo sapiens
cacuaauaauaguacuauua

SEQ ID NO: 1585066 - RNA, 21 nt, Homo sapiens
cacuaaucacaaacugaauga

SEQ ID NO: 1585067 - RNA, 23 nt, Homo sapiens
cacuacacaggaggcugaggcag

SEQ ID NO: 1585068 - RNA, 20 nt, Homo sapiens
cacuacaucugggacugacu

SEQ ID NO: 1585069 - RNA, 15 nt, Homo sapiens
cacuacauucauuua

SEQ ID NO: 1585070 - RNA, 16 nt, Homo sapiens
cacuagcauccacuga

SEQ ID NO: 1585071 - RNA, 17 nt, Homo sapiens
cacuaggccugaaauga

SEQ ID NO: 1585072 - RNA, 19 nt, Homo sapiens
cacuauggggggaggugua

SEQ ID NO: 1585073 - RNA, 14 nt, Homo sapiens
cacuauuacuggga

SEQ ID NO: 1585074 - RNA, 22 nt, Homo sapiens
cacucaaaacgcuacugaguca

SEQ ID NO: 1585075 - RNA, 17 nt, Homo sapiens
cacucagaaguugugcu

SEQ ID NO: 1585076 - RNA, 12 nt, Homo sapiens
cacucauuccuu

SEQ ID NO: 1585077 - RNA, 23 nt, Homo sapiens
cacuccagccugagcgacaguga

SEQ ID NO: 1585078 - RNA, 23 nt, Homo sapiens
cacucccuaauuuaugugcuaua

SEQ ID NO: 1585079 - RNA, 19 nt, Homo sapiens
cacuccggcccuccagagc

SEQ ID NO: 1585080 - RNA, 17 nt, Homo sapiens
cacuccgucugcuccaa

SEQ ID NO: 1585081 - RNA, 19 nt, Homo sapiens
cacucuauaagauuccaaa

SEQ ID NO: 1585082 - RNA, 23 nt, Homo sapiens
cacucuauaagauuccaaaaagc

SEQ ID NO: 1585083 - RNA, 18 nt, Homo sapiens
cacucucugccauucugu

SEQ ID NO: 1585084 - RNA, 13 nt, Homo sapiens
cacucugcaagaa

SEQ ID NO: 1585085 - RNA, 17 nt, Homo sapiens
cacucuggagcauuucu

SEQ ID NO: 1585086 - RNA, 15 nt, Homo sapiens
cacucuuuauagugc

SEQ ID NO: 1585087 - RNA, 20 nt, Homo sapiens
cacucuuuugcuuuauucca

SEQ ID NO: 1585088 - RNA, 16 nt, Homo sapiens
cacugaagugcuugca

SEQ ID NO: 1585089 - RNA, 13 nt, Homo sapiens
cacugacugagau

SEQ ID NO: 1585090 - RNA, 15 nt, Homo sapiens
cacugaggugaggcu

SEQ ID NO: 1585091 - RNA, 22 nt, Homo sapiens
cacugaugcuuagauguuccag

SEQ ID NO: 1585092 - RNA, 18 nt, Homo sapiens
cacugauggaaaauacca

SEQ ID NO: 1585093 - RNA, 21 nt, Homo sapiens
cacugcaaccuccacauccca

SEQ ID NO: 1585094 - RNA, 12 nt, Homo sapiens
cacugcacucca

SEQ ID NO: 1585095 - RNA, 15 nt, Homo sapiens
cacugccaccuugug

SEQ ID NO: 1585096 - RNA, 19 nt, Homo sapiens
cacugccagucucacugug

SEQ ID NO: 1585097 - RNA, 18 nt, Homo sapiens
cacugccauuacccagug

SEQ ID NO: 1585098 - RNA, 23 nt, Homo sapiens
cacugcgcccuuaacugcaucca

SEQ ID NO: 1585099 - RNA, 18 nt, Homo sapiens
cacugcugagacccacag

SEQ ID NO: 1585100 - RNA, 11 nt, Homo sapiens
cacugcuguag

SEQ ID NO: 1585101 - RNA, 22 nt, Homo sapiens
cacuggaauauaaaacagucau

SEQ ID NO: 1585102 - RNA, 19 nt, Homo sapiens
cacuggagguugaagccaa

SEQ ID NO: 1585103 - RNA, 18 nt, Homo sapiens
cacuggggcagacaauaa

SEQ ID NO: 1585104 - RNA, 23 nt, Homo sapiens
cacugugggaaggccagcugccc

SEQ ID NO: 1585105 - RNA, 16 nt, Homo sapiens
cacuguucaaaccucu

SEQ ID NO: 1585106 - RNA, 12 nt, Homo sapiens
cacuguuuccau

SEQ ID NO: 1585107 - RNA, 19 nt, Homo sapiens
cacuuaacuacuuaucucu

SEQ ID NO: 1585108 - RNA, 12 nt, Homo sapiens
cacuuaauagca

SEQ ID NO: 1585109 - RNA, 17 nt, Homo sapiens
cacuuagguaguaccaa

SEQ ID NO: 1585110 - RNA, 12 nt, Homo sapiens
cacuuaucugau

SEQ ID NO: 1585111 - RNA, 14 nt, Homo sapiens
cacuuccaugagaa

SEQ ID NO: 1585112 - RNA, 22 nt, Homo sapiens
cacuucccaggaucugcuccaa

SEQ ID NO: 1585113 - RNA, 21 nt, Homo sapiens
cacuucucucuccccaucccc

SEQ ID NO: 1585114 - RNA, 13 nt, Homo sapiens
cacuugcucaaaa

SEQ ID NO: 1585115 - RNA, 20 nt, Homo sapiens
cacuugcucaaaaucuguga

SEQ ID NO: 1585116 - RNA, 13 nt, Homo sapiens
cacuugcucuuug

SEQ ID NO: 1585117 - RNA, 17 nt, Homo sapiens
cacuuucauugccagug

SEQ ID NO: 1585118 - RNA, 12 nt, Homo sapiens
cacuuucuucaa

SEQ ID NO: 1585119 - RNA, 20 nt, Homo sapiens
cacuuucuucaaagccacau

SEQ ID NO: 1585120 - RNA, 17 nt, Homo sapiens
cacuuugagaagcugag

SEQ ID NO: 1585121 - RNA, 22 nt, Homo sapiens
cacuuuguugcaagaugugaau

SEQ ID NO: 1585122 - RNA, 16 nt, Homo sapiens
cacuuuucauaucauu

SEQ ID NO: 1585123 - RNA, 13 nt, Homo sapiens
cagaaaacauguu

SEQ ID NO: 1585124 - RNA, 17 nt, Homo sapiens
cagaaaagcaauacugu

SEQ ID NO: 1585125 - RNA, 22 nt, Homo sapiens
cagaaaagcaauacuguuucca

SEQ ID NO: 1585126 - RNA, 17 nt, Homo sapiens
cagaaaaucuaccaaga

SEQ ID NO: 1585127 - RNA, 23 nt, Homo sapiens
cagaaaauguugagaaucccaaa

SEQ ID NO: 1585128 - RNA, 20 nt, Homo sapiens
cagaaacuugugaaguggaa

SEQ ID NO: 1585129 - RNA, 19 nt, Homo sapiens
cagaaagcuccuuccagac

SEQ ID NO: 1585130 - RNA, 19 nt, Homo sapiens
cagaaaguaagcauuucca

SEQ ID NO: 1585131 - RNA, 18 nt, Homo sapiens
cagaaauaaagaucucag

SEQ ID NO: 1585132 - RNA, 22 nt, Homo sapiens
cagaaauacagucuuccacaaa

SEQ ID NO: 1585133 - RNA, 16 nt, Homo sapiens
cagaaauagcuccuca

SEQ ID NO: 1585134 - RNA, 16 nt, Homo sapiens
cagaaaucacagucaa

SEQ ID NO: 1585135 - RNA, 14 nt, Homo sapiens
cagaaauuguauau

SEQ ID NO: 1585136 - RNA, 20 nt, Homo sapiens
cagaacaaauuguuuacaua

SEQ ID NO: 1585137 - RNA, 18 nt, Homo sapiens
cagaacauacuguucuca

SEQ ID NO: 1585138 - RNA, 15 nt, Homo sapiens
cagaaccauuucacc

SEQ ID NO: 1585139 - RNA, 22 nt, Homo sapiens
cacaauaggucuuucucucagu

SEQ ID NO: 1585140 - RNA, 17 nt, Homo sapiens
cacaauauuccuaugcu

SEQ ID NO: 1585141 - RNA, 21 nt, Homo sapiens
cacaauguucuggcacuauua

SEQ ID NO: 1585142 - RNA, 16 nt, Homo sapiens
cacaauguuucuucau

SEQ ID NO: 1585143 - RNA, 19 nt, Homo sapiens
cacaauuacauacuauucu

SEQ ID NO: 1585144 - RNA, 16 nt, Homo sapiens
cacacacaaccacaaa

SEQ ID NO: 1585145 - RNA, 14 nt, Homo sapiens
cacacacacaaaaa

SEQ ID NO: 1585146 - RNA, 10 nt, Homo sapiens
cacacaguuc

SEQ ID NO: 1585147 - RNA, 14 nt, Homo sapiens
cacacauugcagcu

SEQ ID NO: 1585148 - RNA, 16 nt, Homo sapiens
cacacauugcugugaa

SEQ ID NO: 1585149 - RNA, 18 nt, Homo sapiens
cacacauugcugugaaca

SEQ ID NO: 1585150 - RNA, 23 nt, Homo sapiens
cacacauugcugugaacaggaaa

SEQ ID NO: 1585151 - RNA, 12 nt, Homo sapiens
cacaccaaagcu

SEQ ID NO: 1585152 - RNA, 18 nt, Homo sapiens
cacaccaaguaccaguau

SEQ ID NO: 1585153 - RNA, 21 nt, Homo sapiens
cacaccccuccggacauccag

SEQ ID NO: 1585154 - RNA, 18 nt, Homo sapiens
cacacccggggagaagau

SEQ ID NO: 1585155 - RNA, 14 nt, Homo sapiens
cacacccugcuuca

SEQ ID NO: 1585156 - RNA, 13 nt, Homo sapiens
cacaccugcccua

SEQ ID NO: 1585157 - RNA, 22 nt, Homo sapiens
cacaccugggcauuuggugaga

SEQ ID NO: 1585158 - RNA, 23 nt, Homo sapiens
cacaccuuuguccacugucaggg

SEQ ID NO: 1585159 - RNA, 19 nt, Homo sapiens
cacacggaagcaagcagau

SEQ ID NO: 1585160 - RNA, 14 nt, Homo sapiens
cacacguaagcaca

SEQ ID NO: 1585161 - RNA, 22 nt, Homo sapiens
cacacguuuaaucccagcacuu

SEQ ID NO: 1585162 - RNA, 16 nt, Homo sapiens
cacacuccccacuuca

SEQ ID NO: 1585163 - RNA, 17 nt, Homo sapiens
cacacugaguugcacau

SEQ ID NO: 1585164 - RNA, 14 nt, Homo sapiens
cacacuguauauaa

SEQ ID NO: 1585165 - RNA, 13 nt, Homo sapiens
cacacugugcuuu

SEQ ID NO: 1585166 - RNA, 20 nt, Homo sapiens
cacacuuuguaauuugcaaa

SEQ ID NO: 1585167 - RNA, 19 nt, Homo sapiens
cacagaauaguuuacacac

SEQ ID NO: 1585168 - RNA, 19 nt, Homo sapiens
cacagaauauguauguaua

SEQ ID NO: 1585169 - RNA, 19 nt, Homo sapiens
cacagaaugacugacaaag

SEQ ID NO: 1585170 - RNA, 15 nt, Homo sapiens
cacagacaacucaca

SEQ ID NO: 1585171 - RNA, 16 nt, Homo sapiens
cacagacugauuggaa

SEQ ID NO: 1585172 - RNA, 19 nt, Homo sapiens
cacagacuucuggccuagg

SEQ ID NO: 1585173 - RNA, 17 nt, Homo sapiens
cacagaggagugcagcc

SEQ ID NO: 1585174 - RNA, 14 nt, Homo sapiens
cacagagugcugga

SEQ ID NO: 1585175 - RNA, 15 nt, Homo sapiens
cacagaugugaaaug

SEQ ID NO: 1585176 - RNA, 19 nt, Homo sapiens
cacagaugugaaaugaaug

SEQ ID NO: 1585177 - RNA, 13 nt, Homo sapiens
cacagauuaucaa

SEQ ID NO: 1585178 - RNA, 22 nt, Homo sapiens
cacagauuccuggcagagccau

SEQ ID NO: 1585179 - RNA, 16 nt, Homo sapiens
cacagcagacaccauu

SEQ ID NO: 1585180 - RNA, 20 nt, Homo sapiens
cacagcaggcugccagugcc

SEQ ID NO: 1585181 - RNA, 11 nt, Homo sapiens
cacagccagag

SEQ ID NO: 1585182 - RNA, 13 nt, Homo sapiens
cacagcccaagag

SEQ ID NO: 1585183 - RNA, 14 nt, Homo sapiens
cacagcccaucacc

SEQ ID NO: 1585184 - RNA, 19 nt, Homo sapiens
cacagccgcgggccaggag

SEQ ID NO: 1585185 - RNA, 17 nt, Homo sapiens
cacagccuccccugcca

SEQ ID NO: 1585186 - RNA, 19 nt, Homo sapiens
cacagcguccuguccacac

SEQ ID NO: 1585187 - RNA, 23 nt, Homo sapiens
cacaggcauauucccugcacaca

SEQ ID NO: 1585188 - RNA, 19 nt, Homo sapiens
cacaggccugagauuucau

SEQ ID NO: 1585189 - RNA, 16 nt, Homo sapiens
cacagucacauuccaa

SEQ ID NO: 1585190 - RNA, 15 nt, Homo sapiens
cacagucauacaagu

SEQ ID NO: 1585191 - RNA, 18 nt, Homo sapiens
cacagugaugaauguacu

SEQ ID NO: 1585192 - RNA, 19 nt, Homo sapiens
cacaguguuuuuauugcuc

SEQ ID NO: 1585193 - RNA, 22 nt, Homo sapiens
cacaguuuuaauaagaacagau

SEQ ID NO: 1585194 - RNA, 13 nt, Homo sapiens
cacauacaaauca

SEQ ID NO: 1585195 - RNA, 23 nt, Homo sapiens
cacauaccuggcccugugccuug

SEQ ID NO: 1585196 - RNA, 15 nt, Homo sapiens
cacauagauucaccu

SEQ ID NO: 1585197 - RNA, 22 nt, Homo sapiens
cacauaguagguacccaauuca

SEQ ID NO: 1585198 - RNA, 18 nt, Homo sapiens
cacauaugggaacuauga

SEQ ID NO: 1585199 - RNA, 13 nt, Homo sapiens
cacaucacacaga

SEQ ID NO: 1585200 - RNA, 22 nt, Homo sapiens
cacaucgcucuaggauaacugg

SEQ ID NO: 1585201 - RNA, 16 nt, Homo sapiens
cacaucuaaccucauc

SEQ ID NO: 1585202 - RNA, 15 nt, Homo sapiens
cacaucuuaaauuca

SEQ ID NO: 1585203 - RNA, 14 nt, Homo sapiens
cacaucuuauuuau

SEQ ID NO: 1585204 - RNA, 17 nt, Homo sapiens
cacaugaggccaucuca

SEQ ID NO: 1585205 - RNA, 13 nt, Homo sapiens
cacaugccacaaa

SEQ ID NO: 1585206 - RNA, 13 nt, Homo sapiens
cacaugcccauga

SEQ ID NO: 1585207 - RNA, 17 nt, Homo sapiens
cacaugcccaugaugag

SEQ ID NO: 1585208 - RNA, 15 nt, Homo sapiens
cacaugcuuuagcca

SEQ ID NO: 1585209 - RNA, 19 nt, Homo sapiens
cacauguauugacaacagu

SEQ ID NO: 1585210 - RNA, 21 nt, Homo sapiens
cacauguccuauuacugaugu

SEQ ID NO: 1585211 - RNA, 23 nt, Homo sapiens
cacauguguuucugucucuccau

SEQ ID NO: 1585212 - RNA, 18 nt, Homo sapiens
cacauuacagcuaccuuc

SEQ ID NO: 1585213 - RNA, 18 nt, Homo sapiens
cacauugcugauaugcaa

SEQ ID NO: 1585214 - RNA, 16 nt, Homo sapiens
cacauuucacugugau

SEQ ID NO: 1585215 - RNA, 23 nt, Homo sapiens
caccaaagcuauuggagauuugc

SEQ ID NO: 1585216 - RNA, 17 nt, Homo sapiens
caccaagcuaggugcua

SEQ ID NO: 1585217 - RNA, 20 nt, Homo sapiens
caccaagcugcucuccuuca

SEQ ID NO: 1585218 - RNA, 15 nt, Homo sapiens
caccaaguaccagua

SEQ ID NO: 1585219 - RNA, 16 nt, Homo sapiens
caccaaucagcacucu

SEQ ID NO: 1585220 - RNA, 23 nt, Homo sapiens
caccaaucagcaggauucuaaaa

SEQ ID NO: 1585221 - RNA, 17 nt, Homo sapiens
caccaauuaucaucuuu

SEQ ID NO: 1585222 - RNA, 15 nt, Homo sapiens
caccacgacuggcca

SEQ ID NO: 1585223 - RNA, 21 nt, Homo sapiens
caccagcccugaccccagugu

SEQ ID NO: 1585224 - RNA, 20 nt, Homo sapiens
caccagccgaggccacagaa

SEQ ID NO: 1585225 - RNA, 16 nt, Homo sapiens
caccagcuaucuguca

SEQ ID NO: 1585226 - RNA, 22 nt, Homo sapiens
caccaggaauccccaacaugca

SEQ ID NO: 1585227 - RNA, 21 nt, Homo sapiens
caccaggcugggcagggacaa

SEQ ID NO: 1585228 - RNA, 16 nt, Homo sapiens
caccaggggugcacaa

SEQ ID NO: 1585229 - RNA, 15 nt, Homo sapiens
caccaggugccuuuc

SEQ ID NO: 1585230 - RNA, 18 nt, Homo sapiens
caccagugguacuaagca

SEQ ID NO: 1585231 - RNA, 17 nt, Homo sapiens
caccaguguuccugaag

SEQ ID NO: 1585232 - RNA, 19 nt, Homo sapiens
caccauacacauucuuaga

SEQ ID NO: 1585233 - RNA, 18 nt, Homo sapiens
caccaucucuuuaccucc

SEQ ID NO: 1585234 - RNA, 22 nt, Homo sapiens
caccaugcucucucaccugcuc

SEQ ID NO: 1585235 - RNA, 15 nt, Homo sapiens
caccauuaacuccuc

SEQ ID NO: 1585236 - RNA, 14 nt, Homo sapiens
caccauugugaagc

SEQ ID NO: 1585237 - RNA, 23 nt, Homo sapiens
cacccaaaagucaaaaggugccu

SEQ ID NO: 1585238 - RNA, 17 nt, Homo sapiens
cacccaaggauucuguu

SEQ ID NO: 1585239 - RNA, 16 nt, Homo sapiens
cacccacaccauaagc

SEQ ID NO: 1585240 - RNA, 14 nt, Homo sapiens
cacccagaacagug

SEQ ID NO: 1585241 - RNA, 20 nt, Homo sapiens
cacccaggcuggagugcagu

SEQ ID NO: 1585242 - RNA, 19 nt, Homo sapiens
cacccaguaccgcaucucc

SEQ ID NO: 1585243 - RNA, 20 nt, Homo sapiens
cacccagugggaagagugug

SEQ ID NO: 1585244 - RNA, 16 nt, Homo sapiens
cacccaucagcacucu

SEQ ID NO: 1585245 - RNA, 15 nt, Homo sapiens
cacccaucagugcuc

SEQ ID NO: 1585246 - RNA, 22 nt, Homo sapiens
cacccaucagugcucuguaaaa

SEQ ID NO: 1585247 - RNA, 18 nt, Homo sapiens
caccccacccucccugga

SEQ ID NO: 1585248 - RNA, 21 nt, Homo sapiens
cacccccugcuccaccagcag

SEQ ID NO: 1585249 - RNA, 20 nt, Homo sapiens
caccccuaccucuaguaaau

SEQ ID NO: 1585250 - RNA, 12 nt, Homo sapiens
caccccugaguu

SEQ ID NO: 1585251 - RNA, 16 nt, Homo sapiens
caccccugcacaguug

SEQ ID NO: 1585252 - RNA, 23 nt, Homo sapiens
cacccuccagaauccugauggua

SEQ ID NO: 1585253 - RNA, 17 nt, Homo sapiens
cacccuccugucuuccc

SEQ ID NO: 1585254 - RNA, 20 nt, Homo sapiens
acugcacuuuccaaugccac

SEQ ID NO: 1585255 - RNA, 21 nt, Homo sapiens
acugcacuuuccaaugccaca

SEQ ID NO: 1585256 - RNA, 16 nt, Homo sapiens
acugcaggaccuccag

SEQ ID NO: 1585257 - RNA, 14 nt, Homo sapiens
acugcauaaauaac

SEQ ID NO: 1585258 - RNA, 12 nt, Homo sapiens
acugcaucccag

SEQ ID NO: 1585259 - RNA, 17 nt, Homo sapiens
acugcauuuacagugua

SEQ ID NO: 1585260 - RNA, 20 nt, Homo sapiens
acugccaggauaaagcuucc

SEQ ID NO: 1585261 - RNA, 16 nt, Homo sapiens
acugccauuacccagu

SEQ ID NO: 1585262 - RNA, 21 nt, Homo sapiens
acugccccacaugcaugucug

SEQ ID NO: 1585263 - RNA, 23 nt, Homo sapiens
acugccccccugccuugcucccc

SEQ ID NO: 1585264 - RNA, 19 nt, Homo sapiens
acugccucgaaacacagaa

SEQ ID NO: 1585265 - RNA, 18 nt, Homo sapiens
acugccugucugcuugca

SEQ ID NO: 1585266 - RNA, 14 nt, Homo sapiens
acugcgacugugac

SEQ ID NO: 1585267 - RNA, 20 nt, Homo sapiens
acugcugggggugagcugua

SEQ ID NO: 1585268 - RNA, 17 nt, Homo sapiens
aacucaguuucuaggca

SEQ ID NO: 1585269 - RNA, 16 nt, Homo sapiens
aacucaucacauaaag

SEQ ID NO: 1585270 - RNA, 15 nt, Homo sapiens
aacucauuugaaugc

SEQ ID NO: 1585271 - RNA, 18 nt, Homo sapiens
aacucauuugaaugcuua

SEQ ID NO: 1585272 - RNA, 19 nt, Homo sapiens
aacucauuugaaugcuuaa

SEQ ID NO: 1585273 - RNA, 23 nt, Homo sapiens
aacucauuugaaugcuuaauuca

SEQ ID NO: 1585274 - RNA, 20 nt, Homo sapiens
aacucauuugagaucagucu

SEQ ID NO: 1585275 - RNA, 14 nt, Homo sapiens
aacuccugccauuc

SEQ ID NO: 1585276 - RNA, 18 nt, Homo sapiens
aacucuccccagugccug

SEQ ID NO: 1585277 - RNA, 23 nt, Homo sapiens
aacucuccuuugcucucuggcca

SEQ ID NO: 1585278 - RNA, 24 nt, Homo sapiens
aacucuccuuugcucucuggccac

SEQ ID NO: 1585279 - RNA, 16 nt, Homo sapiens
aacucugaagccacaa

SEQ ID NO: 1585280 - RNA, 16 nt, Homo sapiens
aacucugcacuacucc

SEQ ID NO: 1585281 - RNA, 23 nt, Homo sapiens
aacucugcuugauuuuugccucu

SEQ ID NO: 1585282 - RNA, 22 nt, Homo sapiens
aacucuggacacucuauaugua

SEQ ID NO: 1585283 - RNA, 22 nt, Homo sapiens
aacucuuuaucaagcaacauuc

SEQ ID NO: 1585284 - RNA, 18 nt, Homo sapiens
aacugaaagguagacuuu

SEQ ID NO: 1585285 - RNA, 18 nt, Homo sapiens
aacugaaggcuaaaaagc

SEQ ID NO: 1585286 - RNA, 20 nt, Homo sapiens
aacugaaggcuaaaaagcaa

SEQ ID NO: 1585287 - RNA, 13 nt, Homo sapiens
aacugacuuccaa

SEQ ID NO: 1585288 - RNA, 15 nt, Homo sapiens
aacugagucacucac

SEQ ID NO: 1585289 - RNA, 22 nt, Homo sapiens
aacugagucacucacauugaga

SEQ ID NO: 1585290 - RNA, 23 nt, Homo sapiens
aacugagucacucacauugagag

SEQ ID NO: 1585291 - RNA, 15 nt, Homo sapiens
aacugaugauuucac

SEQ ID NO: 1585292 - RNA, 20 nt, Homo sapiens
uaauuugagagaaauaugaa

SEQ ID NO: 1585293 - RNA, 15 nt, Homo sapiens
uaauuuguagacuua

SEQ ID NO: 1585294 - RNA, 14 nt, Homo sapiens
uaauuuuacacucu

SEQ ID NO: 1585295 - RNA, 17 nt, Homo sapiens
uaauuuuauuacauaug

SEQ ID NO: 1585296 - RNA, 17 nt, Homo sapiens
uaauuuuguuuaugcug

SEQ ID NO: 1585297 - RNA, 20 nt, Homo sapiens
uacaaacuuuuaagauuucu

SEQ ID NO: 1585298 - RNA, 17 nt, Homo sapiens
uacaaaggaaauaucaa

SEQ ID NO: 1585299 - RNA, 13 nt, Homo sapiens
uacaaaucaucca

SEQ ID NO: 1585300 - RNA, 17 nt, Homo sapiens
uacaaaugcaauuucau

SEQ ID NO: 1585301 - RNA, 22 nt, Homo sapiens
uacaaaugcaauuucauuuaaa

SEQ ID NO: 1585302 - RNA, 11 nt, Homo sapiens
uacaaccagcc

SEQ ID NO: 1585303 - RNA, 18 nt, Homo sapiens
uacaacugccucgaaaca

SEQ ID NO: 1585304 - RNA, 20 nt, Homo sapiens
uacaaggccccaagguuuac

SEQ ID NO: 1585305 - RNA, 12 nt, Homo sapiens
uacaagucaaaa

SEQ ID NO: 1585306 - RNA, 15 nt, Homo sapiens
uacaagucaugguca

SEQ ID NO: 1585307 - RNA, 18 nt, Homo sapiens
uacaauagacauugcaaa

SEQ ID NO: 1585308 - RNA, 19 nt, Homo sapiens
uacaaucgagacugcaaug

SEQ ID NO: 1585309 - RNA, 22 nt, Homo sapiens
uacaaugauaggaaaaauccau

SEQ ID NO: 1585310 - RNA, 13 nt, Homo sapiens
uacaauguacaau

SEQ ID NO: 1585311 - RNA, 15 nt, Homo sapiens
uacacaaguguuuca

SEQ ID NO: 1585312 - RNA, 14 nt, Homo sapiens
uacacaauaagcaa

SEQ ID NO: 1585313 - RNA, 15 nt, Homo sapiens
uacacaaugugauuu

SEQ ID NO: 1585314 - RNA, 23 nt, Homo sapiens
uacacaaugugauuuuaugguga

SEQ ID NO: 1585315 - RNA, 18 nt, Homo sapiens
uacacacacacaaaaaca

SEQ ID NO: 1585316 - RNA, 19 nt, Homo sapiens
uacacacacacgcacacaa

SEQ ID NO: 1585317 - RNA, 18 nt, Homo sapiens
uacacagagaaauacaaa

SEQ ID NO: 1585318 - RNA, 20 nt, Homo sapiens
uacacagagaaauacaaaau

SEQ ID NO: 1585319 - RNA, 15 nt, Homo sapiens
uacacagcccaagag

SEQ ID NO: 1585320 - RNA, 12 nt, Homo sapiens
uacacaguacuu

SEQ ID NO: 1585321 - RNA, 18 nt, Homo sapiens
uacacauacaggauuuga

SEQ ID NO: 1585322 - RNA, 17 nt, Homo sapiens
uacacauugcuaccuca

SEQ ID NO: 1585323 - RNA, 18 nt, Homo sapiens
uacaccucgucaagagca

SEQ ID NO: 1585324 - RNA, 22 nt, Homo sapiens
uacaccucgucaagagcaugca

SEQ ID NO: 1585325 - RNA, 16 nt, Homo sapiens
uacacucuugauucua

SEQ ID NO: 1585326 - RNA, 14 nt, Homo sapiens
uacacuuuguugca

SEQ ID NO: 1585327 - RNA, 19 nt, Homo sapiens
uacacuuuuucucuuucca

SEQ ID NO: 1585328 - RNA, 15 nt, Homo sapiens
uacagaaauauccau

SEQ ID NO: 1585329 - RNA, 14 nt, Homo sapiens
uacagaagggcagu

SEQ ID NO: 1585330 - RNA, 18 nt, Homo sapiens
uacagacaaagcauaauc

SEQ ID NO: 1585331 - RNA, 14 nt, Homo sapiens
uacagacucugauu

SEQ ID NO: 1585332 - RNA, 18 nt, Homo sapiens
uacagagaugcaaugaua

SEQ ID NO: 1585333 - RNA, 17 nt, Homo sapiens
uacagauauuugucaug

SEQ ID NO: 1585334 - RNA, 16 nt, Homo sapiens
uacagcaacaauuuau

SEQ ID NO: 1585335 - RNA, 13 nt, Homo sapiens
uacagcaggcagu

SEQ ID NO: 1585336 - RNA, 19 nt, Homo sapiens
uacagcaugacguaguauu

SEQ ID NO: 1585337 - RNA, 20 nt, Homo sapiens
uacagccagcagcacaguca

SEQ ID NO: 1585338 - RNA, 14 nt, Homo sapiens
uacagccauaugca

SEQ ID NO: 1585339 - RNA, 14 nt, Homo sapiens
uacagccuggacca

SEQ ID NO: 1585340 - RNA, 17 nt, Homo sapiens
uacaggaaauugacuua

SEQ ID NO: 1585341 - RNA, 14 nt, Homo sapiens
uacaggcacgugcc

SEQ ID NO: 1585342 - RNA, 15 nt, Homo sapiens
uacaggcucaugcca

SEQ ID NO: 1585343 - RNA, 18 nt, Homo sapiens
uacagguagugggcucac

SEQ ID NO: 1585344 - RNA, 23 nt, Homo sapiens
uacagguccguuuccuuacacau

SEQ ID NO: 1585345 - RNA, 21 nt, Homo sapiens
uacagguccugcugaaacugc

SEQ ID NO: 1585346 - RNA, 22 nt, Homo sapiens
uacaggugcgcgccaccgugcc

SEQ ID NO: 1585347 - RNA, 13 nt, Homo sapiens
agaggggaaaaug

SEQ ID NO: 1585348 - RNA, 21 nt, Homo sapiens
agaggguaaguaaacagauuu

SEQ ID NO: 1585349 - RNA, 21 nt, Homo sapiens
agagguagucucacugcuuga

SEQ ID NO: 1585350 - RNA, 24 nt, Homo sapiens
agagguccuccacgcuuguuugcc

SEQ ID NO: 1585351 - RNA, 19 nt, Homo sapiens
agagguggagguugcagug

SEQ ID NO: 1585352 - RNA, 17 nt, Homo sapiens
agagguggauccuguag

SEQ ID NO: 1585353 - RNA, 22 nt, Homo sapiens
agaguaaaccuugaagggcuuu

SEQ ID NO: 1585354 - RNA, 16 nt, Homo sapiens
agaguaacacauaaca

SEQ ID NO: 1585355 - RNA, 21 nt, Homo sapiens
agaguacgugaaaugcucaag

SEQ ID NO: 1585356 - RNA, 12 nt, Homo sapiens
agaguacuuugg

SEQ ID NO: 1585357 - RNA, 15 nt, Homo sapiens
agaguauuccucaaa

SEQ ID NO: 1585358 - RNA, 17 nt, Homo sapiens
agagucauuuucacuuu

SEQ ID NO: 1585359 - RNA, 18 nt, Homo sapiens
agagucuuaaagcauuuc

SEQ ID NO: 1585360 - RNA, 13 nt, Homo sapiens
agagugacaguca

SEQ ID NO: 1585361 - RNA, 14 nt, Homo sapiens
agagugacagucau

SEQ ID NO: 1585362 - RNA, 10 nt, Homo sapiens
agagugccac

SEQ ID NO: 1585363 - RNA, 20 nt, Homo sapiens
agagugcuggacuguuccag

SEQ ID NO: 1585364 - RNA, 19 nt, Homo sapiens
agagugguggccuauuuca

SEQ ID NO: 1585365 - RNA, 23 nt, Homo sapiens
agaguguguguuuguguguuuca

SEQ ID NO: 1585366 - RNA, 15 nt, Homo sapiens
agaguguucccugac

SEQ ID NO: 1585367 - RNA, 13 nt, Homo sapiens
agaguguuuaccu

SEQ ID NO: 1585368 - RNA, 21 nt, Homo sapiens
agaguuuggaauuauuguaga

SEQ ID NO: 1585369 - RNA, 13 nt, Homo sapiens
agauaaacaguag

SEQ ID NO: 1585370 - RNA, 20 nt, Homo sapiens
agauaacuguaaaugugaca

SEQ ID NO: 1585371 - RNA, 18 nt, Homo sapiens
agauaagucuacauuaaa

SEQ ID NO: 1585372 - RNA, 19 nt, Homo sapiens
agauaaucucuccauuccc

SEQ ID NO: 1585373 - RNA, 12 nt, Homo sapiens
agauaaugccac

SEQ ID NO: 1585374 - RNA, 21 nt, Homo sapiens
agauacagagaugcaaugaua

SEQ ID NO: 1585375 - RNA, 16 nt, Homo sapiens
agauaggaaacugaag

SEQ ID NO: 1585376 - RNA, 23 nt, Homo sapiens
agauagucuauguauguguaaaa

SEQ ID NO: 1585377 - RNA, 17 nt, Homo sapiens
agauauauguguauaca

SEQ ID NO: 1585378 - RNA, 16 nt, Homo sapiens
agauauguuaagcaug

SEQ ID NO: 1585379 - RNA, 16 nt, Homo sapiens
agaucaauuucuccca

SEQ ID NO: 1585380 - RNA, 11 nt, Homo sapiens
agaucacuuga

SEQ ID NO: 1585381 - RNA, 13 nt, Homo sapiens
agaucacuugagc

SEQ ID NO: 1585382 - RNA, 17 nt, Homo sapiens
agaucagccacaccuuu

SEQ ID NO: 1585383 - RNA, 19 nt, Homo sapiens
agaucagcgacccugagga

SEQ ID NO: 1585384 - RNA, 17 nt, Homo sapiens
agaucauccugaacuuc

SEQ ID NO: 1585385 - RNA, 23 nt, Homo sapiens
agaucaugccauugcauuccagc

SEQ ID NO: 1585386 - RNA, 19 nt, Homo sapiens
agaucauuuggagcucuug

SEQ ID NO: 1585387 - RNA, 23 nt, Homo sapiens
agauccuuuuuuacgcuuugcag

SEQ ID NO: 1585388 - RNA, 20 nt, Homo sapiens
agaucgcgccacugcacugc

SEQ ID NO: 1585389 - RNA, 18 nt, Homo sapiens
agaucgugcuacugcacu

SEQ ID NO: 1585390 - RNA, 21 nt, Homo sapiens
agaucucuuucuaaagacagg

SEQ ID NO: 1585391 - RNA, 18 nt, Homo sapiens
agaucugcucgcugagaa

SEQ ID NO: 1585392 - RNA, 14 nt, Homo sapiens
agaugaaacaucau

SEQ ID NO: 1585393 - RNA, 17 nt, Homo sapiens
agaugacgaguaacucc

SEQ ID NO: 1585394 - RNA, 18 nt, Homo sapiens
agaugagaaagcuuuuau

SEQ ID NO: 1585395 - RNA, 23 nt, Homo sapiens
agaugagccggguccggccucuc

SEQ ID NO: 1585396 - RNA, 15 nt, Homo sapiens
agaugcaaccucacu

SEQ ID NO: 1585397 - RNA, 22 nt, Homo sapiens
agaugcacagaauauguaugua

SEQ ID NO: 1585398 - RNA, 18 nt, Homo sapiens
agaugcagcuacuggaau

SEQ ID NO: 1585399 - RNA, 14 nt, Homo sapiens
agaugcaggugaug

SEQ ID NO: 1585400 - RNA, 23 nt, Homo sapiens
agaugccucuuaggacuggugcc

SEQ ID NO: 1585401 - RNA, 17 nt, Homo sapiens
agaugccuggugagcag

SEQ ID NO: 1585402 - RNA, 15 nt, Homo sapiens
agaugcucugugaaa

SEQ ID NO: 1585403 - RNA, 16 nt, Homo sapiens
agaugcugucacuuaa

SEQ ID NO: 1585404 - RNA, 21 nt, Homo sapiens
agaugcuuuccugcacauuaa

SEQ ID NO: 1585405 - RNA, 22 nt, Homo sapiens
agauggacacgagccacaagcu

SEQ ID NO: 1585406 - RNA, 23 nt, Homo sapiens
agauggggucucgcucugucacc

SEQ ID NO: 1585407 - RNA, 18 nt, Homo sapiens
agaugguuucuacuggcu

SEQ ID NO: 1585408 - RNA, 15 nt, Homo sapiens
agaugucaucaagcu

SEQ ID NO: 1585409 - RNA, 19 nt, Homo sapiens
agaugugaacacaucagcu

SEQ ID NO: 1585410 - RNA, 17 nt, Homo sapiens
agaugugggcagugaug

SEQ ID NO: 1585411 - RNA, 15 nt, Homo sapiens
agaugugucuuacca

SEQ ID NO: 1585412 - RNA, 20 nt, Homo sapiens
agauguucgcucgugcagua

SEQ ID NO: 1585413 - RNA, 12 nt, Homo sapiens
agauguuuauuu

SEQ ID NO: 1585414 - RNA, 22 nt, Homo sapiens
agauuaugugacuugcaauaaa

SEQ ID NO: 1585415 - RNA, 22 nt, Homo sapiens
agauuauuaucuauuaucucaa

SEQ ID NO: 1585416 - RNA, 19 nt, Homo sapiens
agauuauuuacugacauau

SEQ ID NO: 1585417 - RNA, 13 nt, Homo sapiens
agauucagacuug

SEQ ID NO: 1585418 - RNA, 17 nt, Homo sapiens
agauucagguaauacaa

SEQ ID NO: 1585419 - RNA, 14 nt, Homo sapiens
agauuccaaaaagc

SEQ ID NO: 1585420 - RNA, 15 nt, Homo sapiens
agauucugaacuaaa

SEQ ID NO: 1585421 - RNA, 17 nt, Homo sapiens
agauucuucacugguga

SEQ ID NO: 1585422 - RNA, 21 nt, Homo sapiens
agauucuuuuuuucugucagu

SEQ ID NO: 1585423 - RNA, 12 nt, Homo sapiens
agauugaaucug

SEQ ID NO: 1585424 - RNA, 20 nt, Homo sapiens
agauugaaucugaaccaugu

SEQ ID NO: 1585425 - RNA, 22 nt, Homo sapiens
agauugagaagccauguacuca

SEQ ID NO: 1585426 - RNA, 16 nt, Homo sapiens
agauugauaacuauga

SEQ ID NO: 1585427 - RNA, 18 nt, Homo sapiens
agauugauuaaugaacua

SEQ ID NO: 1585428 - RNA, 24 nt, Homo sapiens
agauugcaccacugcacuccaguc

SEQ ID NO: 1585429 - RNA, 12 nt, Homo sapiens
agauugcacugc

SEQ ID NO: 1585430 - RNA, 15 nt, Homo sapiens
agauuuaacauuauc

SEQ ID NO: 1585431 - RNA, 20 nt, Homo sapiens
agauuuaaccccuccacugc

SEQ ID NO: 1585432 - RNA, 19 nt, Homo sapiens
agauuuaguugaguuauuc

SEQ ID NO: 1585433 - RNA, 17 nt, Homo sapiens
agauuuaugaugcacuu

SEQ ID NO: 1585434 - RNA, 18 nt, Homo sapiens
agauuugaugggccacaa

SEQ ID NO: 1585435 - RNA, 23 nt, Homo sapiens
agauuuggaagcucuucuuccca

SEQ ID NO: 1585436 - RNA, 19 nt, Homo sapiens
agauuuuaucugggggaaa

SEQ ID NO: 1585437 - RNA, 18 nt, Homo sapiens
agauuuucuuuugccuuu

SEQ ID NO: 1585438 - RNA, 15 nt, Homo sapiens
agauuuuuuccucug

SEQ ID NO: 1585439 - RNA, 12 nt, Homo sapiens
agcaaaaccaaa

SEQ ID NO: 1585440 - RNA, 20 nt, Homo sapiens
agcaaaauacaugacauuua

SEQ ID NO: 1585441 - RNA, 18 nt, Homo sapiens
agcaaaaucaacaugacu

SEQ ID NO: 1585442 - RNA, 14 nt, Homo sapiens
agcaaaaugccaaa

SEQ ID NO: 1585443 - RNA, 12 nt, Homo sapiens
agcaaacaaaua

SEQ ID NO: 1585444 - RNA, 13 nt, Homo sapiens
agcaaagcaaaag

SEQ ID NO: 1585445 - RNA, 16 nt, Homo sapiens
agcaaagggaaugggu

SEQ ID NO: 1585446 - RNA, 15 nt, Homo sapiens
agcaaaguaguacuu

SEQ ID NO: 1585447 - RNA, 20 nt, Homo sapiens
agcaaauaagucaucugaug

SEQ ID NO: 1585448 - RNA, 18 nt, Homo sapiens
agcaaaugcuacauauau

SEQ ID NO: 1585449 - RNA, 18 nt, Homo sapiens
agcaacccaaauguucau

SEQ ID NO: 1585450 - RNA, 17 nt, Homo sapiens
agcaagaagcuguuacc

SEQ ID NO: 1585451 - RNA, 17 nt, Homo sapiens
agcaagacauacuuaau

SEQ ID NO: 1585452 - RNA, 20 nt, Homo sapiens
agcaagacauacuuaaugca

SEQ ID NO: 1585453 - RNA, 22 nt, Homo sapiens
agcaagaucugcucgcugagaa

SEQ ID NO: 1585454 - RNA, 22 nt, Homo sapiens
agcaagccaucauccuccauug

SEQ ID NO: 1585455 - RNA, 22 nt, Homo sapiens
agcaagcucuuuuauaugcuaa

SEQ ID NO: 1585456 - RNA, 15 nt, Homo sapiens
agcaaguguucacaa

SEQ ID NO: 1585457 - RNA, 18 nt, Homo sapiens
agcaaguuacagugaugc

SEQ ID NO: 1585458 - RNA, 15 nt, Homo sapiens
agcaauaaaaugcua

SEQ ID NO: 1585459 - RNA, 9 nt, Homo sapiens
agcaauacu

SEQ ID NO: 1585460 - RNA, 13 nt, Homo sapiens
agcaauguaaaaa

SEQ ID NO: 1585461 - RNA, 11 nt, Homo sapiens
agcaauuacuc

SEQ ID NO: 1585462 - RNA, 24 nt, Homo sapiens
agcaauuucccccuaaaccaacug

SEQ ID NO: 1585463 - RNA, 13 nt, Homo sapiens
agcacacuggaau

SEQ ID NO: 1585464 - RNA, 15 nt, Homo sapiens
agcacagugccugac

SEQ ID NO: 1585465 - RNA, 16 nt, Homo sapiens
caaaugaaaaauucca

SEQ ID NO: 1585466 - RNA, 14 nt, Homo sapiens
caaaugaaacuuua

SEQ ID NO: 1585467 - RNA, 15 nt, Homo sapiens
caaaugaaauguaug

SEQ ID NO: 1585468 - RNA, 13 nt, Homo sapiens
caaaugcaauuuu

SEQ ID NO: 1585469 - RNA, 21 nt, Homo sapiens
caaaugccugacucagugacc

SEQ ID NO: 1585470 - RNA, 19 nt, Homo sapiens
caaaugcuacauauaugca

SEQ ID NO: 1585471 - RNA, 19 nt, Homo sapiens
caaauggcgacaguugcuu

SEQ ID NO: 1585472 - RNA, 20 nt, Homo sapiens
caaaugguaggcauuuccua

SEQ ID NO: 1585473 - RNA, 17 nt, Homo sapiens
caaaugucauugucuac

SEQ ID NO: 1585474 - RNA, 11 nt, Homo sapiens
caaauguccua

SEQ ID NO: 1585475 - RNA, 13 nt, Homo sapiens
caaaugugacauu

SEQ ID NO: 1585476 - RNA, 19 nt, Homo sapiens
caaauguguggguuuuuaa

SEQ ID NO: 1585477 - RNA, 20 nt, Homo sapiens
caaauuagaaacaccauuca

SEQ ID NO: 1585478 - RNA, 20 nt, Homo sapiens
caaauuauauuugugugaaa

SEQ ID NO: 1585479 - RNA, 16 nt, Homo sapiens
caaauucagcucugau

SEQ ID NO: 1585480 - RNA, 17 nt, Homo sapiens
caaauucaguuucauaa

SEQ ID NO: 1585481 - RNA, 17 nt, Homo sapiens
caaauucuuuugaauug

SEQ ID NO: 1585482 - RNA, 16 nt, Homo sapiens
caaauugauagucaau

SEQ ID NO: 1585483 - RNA, 14 nt, Homo sapiens
caaauugccugcaa

SEQ ID NO: 1585484 - RNA, 22 nt, Homo sapiens
caaauuuaauuaaagccuuaag

SEQ ID NO: 1585485 - RNA, 13 nt, Homo sapiens
caaauuucaugca

SEQ ID NO: 1585486 - RNA, 11 nt, Homo sapiens
caaauuugaug

SEQ ID NO: 1585487 - RNA, 21 nt, Homo sapiens
caaauuugauugauuugaaga

SEQ ID NO: 1585488 - RNA, 20 nt, Homo sapiens
caacaaaaacaaacaaaagc

SEQ ID NO: 1585489 - RNA, 23 nt, Homo sapiens
caacaaaauggucauccaaacuc

SEQ ID NO: 1585490 - RNA, 16 nt, Homo sapiens
caacaaagauugagaa

SEQ ID NO: 1585491 - RNA, 23 nt, Homo sapiens
caacaaagauugagaagccaugu

SEQ ID NO: 1585492 - RNA, 16 nt, Homo sapiens
caacaagaacugcauc

SEQ ID NO: 1585493 - RNA, 15 nt, Homo sapiens
caacaagcaagaucu

SEQ ID NO: 1585494 - RNA, 14 nt, Homo sapiens
caacaaguugccuc

SEQ ID NO: 1585495 - RNA, 12 nt, Homo sapiens
caacaaucuucc

SEQ ID NO: 1585496 - RNA, 22 nt, Homo sapiens
caacacaugagacuuacugcuc

SEQ ID NO: 1585497 - RNA, 21 nt, Homo sapiens
caacacugucacuagucucac

SEQ ID NO: 1585498 - RNA, 15 nt, Homo sapiens
caacagaaaccagaa

SEQ ID NO: 1585499 - RNA, 16 nt, Homo sapiens
caacagagacagugaa

SEQ ID NO: 1585500 - RNA, 20 nt, Homo sapiens
caacagccugacaacauuuc

SEQ ID NO: 1585501 - RNA, 21 nt, Homo sapiens
caacagggaagaaacuuucug

SEQ ID NO: 1585502 - RNA, 14 nt, Homo sapiens
caacauccaaaaua

SEQ ID NO: 1585503 - RNA, 16 nt, Homo sapiens
caacaugcacugaugu

SEQ ID NO: 1585504 - RNA, 23 nt, Homo sapiens
caacauggagaagccccgucucu

SEQ ID NO: 1585505 - RNA, 13 nt, Homo sapiens
caacauggcacau

SEQ ID NO: 1585506 - RNA, 10 nt, Homo sapiens
caacauucau

SEQ ID NO: 1585507 - RNA, 11 nt, Homo sapiens
caacauugugu

SEQ ID NO: 1585508 - RNA, 12 nt, Homo sapiens
caaccaccaggu

SEQ ID NO: 1585509 - RNA, 18 nt, Homo sapiens
caaccccuccucccucag

SEQ ID NO: 1585510 - RNA, 14 nt, Homo sapiens
caacccuguccuca

SEQ ID NO: 1585511 - RNA, 15 nt, Homo sapiens
caaccgccugcagga

SEQ ID NO: 1585512 - RNA, 12 nt, Homo sapiens
caaccucaguga

SEQ ID NO: 1585513 - RNA, 18 nt, Homo sapiens
caaccucauuuuaacuca

SEQ ID NO: 1585514 - RNA, 16 nt, Homo sapiens
caaccugacuuccucu

SEQ ID NO: 1585515 - RNA, 16 nt, Homo sapiens
caaccuguuaccuacu

SEQ ID NO: 1585516 - RNA, 14 nt, Homo sapiens
caaccuuucccuca

SEQ ID NO: 1585517 - RNA, 15 nt, Homo sapiens
caaccuuuuaugugu

SEQ ID NO: 1585518 - RNA, 22 nt, Homo sapiens
caacgagugaaacuccgucuca

SEQ ID NO: 1585519 - RNA, 23 nt, Homo sapiens
caacgaugugacugccaucaucu

SEQ ID NO: 1585520 - RNA, 20 nt, Homo sapiens
caacuaagaaaaaaagcaca

SEQ ID NO: 1585521 - RNA, 14 nt, Homo sapiens
caacuaauacaugg

SEQ ID NO: 1585522 - RNA, 18 nt, Homo sapiens
caacuaaugccuuacucu

SEQ ID NO: 1585523 - RNA, 12 nt, Homo sapiens
caacuaccugag

SEQ ID NO: 1585524 - RNA, 12 nt, Homo sapiens
caacuccagggg

SEQ ID NO: 1585525 - RNA, 19 nt, Homo sapiens
caacuccauguuugguguu

SEQ ID NO: 1585526 - RNA, 19 nt, Homo sapiens
caacuccuuucagccacau

SEQ ID NO: 1585527 - RNA, 18 nt, Homo sapiens
caacucuuuuaagugccu

SEQ ID NO: 1585528 - RNA, 15 nt, Homo sapiens
caacugcauaaccuu

SEQ ID NO: 1585529 - RNA, 19 nt, Homo sapiens
caacugcauugguuuucca

SEQ ID NO: 1585530 - RNA, 18 nt, Homo sapiens
caacuggcuacugaguca

SEQ ID NO: 1585531 - RNA, 16 nt, Homo sapiens
caacuggggggcaauu

SEQ ID NO: 1585532 - RNA, 21 nt, Homo sapiens
caacuggggggcaauuuugca

SEQ ID NO: 1585533 - RNA, 19 nt, Homo sapiens
caacuuacugucuucuuca

SEQ ID NO: 1585534 - RNA, 13 nt, Homo sapiens
caacuugcaauuu

SEQ ID NO: 1585535 - RNA, 16 nt, Homo sapiens
caacuuguauuuccaa

SEQ ID NO: 1585536 - RNA, 17 nt, Homo sapiens
caagaaaaacaucuuug

SEQ ID NO: 1585537 - RNA, 13 nt, Homo sapiens
caagaaaauauca

SEQ ID NO: 1585538 - RNA, 15 nt, Homo sapiens
caagaaacauuucag

SEQ ID NO: 1585539 - RNA, 21 nt, Homo sapiens
caagaaaggccugaauggagg

SEQ ID NO: 1585540 - RNA, 12 nt, Homo sapiens
caagaaauggau

SEQ ID NO: 1585541 - RNA, 19 nt, Homo sapiens
caagaacagagucucagga

SEQ ID NO: 1585542 - RNA, 22 nt, Homo sapiens
caagaaccaaggaaucauguca

SEQ ID NO: 1585543 - RNA, 15 nt, Homo sapiens
caagaacuugcaaua

SEQ ID NO: 1585544 - RNA, 17 nt, Homo sapiens
caagaaggaacaauaaa

SEQ ID NO: 1585545 - RNA, 17 nt, Homo sapiens
caagaaguaaucaguau

SEQ ID NO: 1585546 - RNA, 20 nt, Homo sapiens
caagaaguucuuguucuuca

SEQ ID NO: 1585547 - RNA, 13 nt, Homo sapiens
caagaaugaaaug

SEQ ID NO: 1585548 - RNA, 13 nt, Homo sapiens
caagacaaaaagc

SEQ ID NO: 1585549 - RNA, 15 nt, Homo sapiens
caagacaaaaagcca

SEQ ID NO: 1585550 - RNA, 12 nt, Homo sapiens
caagacaggcag

SEQ ID NO: 1585551 - RNA, 12 nt, Homo sapiens
caagacauuucg

SEQ ID NO: 1585552 - RNA, 22 nt, Homo sapiens
caagacauuucucuaacuccug

SEQ ID NO: 1585553 - RNA, 17 nt, Homo sapiens
caagacccccagcacuu

SEQ ID NO: 1585554 - RNA, 18 nt, Homo sapiens
caagacccccagcacuug

SEQ ID NO: 1585555 - RNA, 22 nt, Homo sapiens
caagaccucacacacacaaaaa

SEQ ID NO: 1585556 - RNA, 12 nt, Homo sapiens
caagagaucuac

SEQ ID NO: 1585557 - RNA, 22 nt, Homo sapiens
caagaggacugagacuggcacu

SEQ ID NO: 1585558 - RNA, 16 nt, Homo sapiens
caagagggauaaaaca

SEQ ID NO: 1585559 - RNA, 20 nt, Homo sapiens
caagaggugugcacaccaaa

SEQ ID NO: 1585560 - RNA, 19 nt, Homo sapiens
caagaucagccugggcaac

SEQ ID NO: 1585561 - RNA, 12 nt, Homo sapiens
caagaugagcug

SEQ ID NO: 1585562 - RNA, 22 nt, Homo sapiens
caagauuggucucccauaugca

SEQ ID NO: 1585563 - RNA, 17 nt, Homo sapiens
caagauuuaaccugcaa

SEQ ID NO: 1585564 - RNA, 14 nt, Homo sapiens
caagcaaauggcca

SEQ ID NO: 1585565 - RNA, 17 nt, Homo sapiens
caagcaacagacucuca

SEQ ID NO: 1585566 - RNA, 13 nt, Homo sapiens
caagcaagcaaaa

SEQ ID NO: 1585567 - RNA, 15 nt, Homo sapiens
caagcacaaaaacuu

SEQ ID NO: 1585568 - RNA, 18 nt, Homo sapiens
caagcagaucucaucuca

SEQ ID NO: 1585569 - RNA, 15 nt, Homo sapiens
caagcagaugaacua

SEQ ID NO: 1585570 - RNA, 23 nt, Homo sapiens
caagcaguuaguuccuucaugau

SEQ ID NO: 1585571 - RNA, 20 nt, Homo sapiens
caagcauaccaacacgagca

SEQ ID NO: 1585572 - RNA, 12 nt, Homo sapiens
caagcauuucau

SEQ ID NO: 1585573 - RNA, 22 nt, Homo sapiens
caagccagcuuacuagcacuuu

SEQ ID NO: 1585574 - RNA, 16 nt, Homo sapiens
caagccccugccucca

SEQ ID NO: 1585575 - RNA, 16 nt, Homo sapiens
caagccugugcaaaaa

SEQ ID NO: 1585576 - RNA, 14 nt, Homo sapiens
caagccuuacucac

SEQ ID NO: 1585577 - RNA, 18 nt, Homo sapiens
caagcgucaucuguguaa

SEQ ID NO: 1585578 - RNA, 23 nt, Homo sapiens
caagcuaugaucagaagacuuua

SEQ ID NO: 1585579 - RNA, 15 nt, Homo sapiens
caagcucuucacuga

SEQ ID NO: 1585580 - RNA, 13 nt, Homo sapiens
caagcugcugaaa

SEQ ID NO: 1585581 - RNA, 16 nt, Homo sapiens
caagcugguuguccac

SEQ ID NO: 1585582 - RNA, 14 nt, Homo sapiens
caagcuuuugcuug

SEQ ID NO: 1585583 - RNA, 13 nt, Homo sapiens
caaggaaccauuu

SEQ ID NO: 1585584 - RNA, 14 nt, Homo sapiens
cacuucaaauucaa

SEQ ID NO: 1585585 - RNA, 12 nt, Homo sapiens
cacuuccagggg

SEQ ID NO: 1585586 - RNA, 17 nt, Homo sapiens
cacuucgcacacaccca

SEQ ID NO: 1585587 - RNA, 20 nt, Homo sapiens
cacuucuuugcagagccuuu

SEQ ID NO: 1585588 - RNA, 15 nt, Homo sapiens
cacuugaacccagga

SEQ ID NO: 1585589 - RNA, 12 nt, Homo sapiens
cacuugaacccg

SEQ ID NO: 1585590 - RNA, 17 nt, Homo sapiens
cacuugccugugcuaca

SEQ ID NO: 1585591 - RNA, 14 nt, Homo sapiens
cacuugcucaaaac

SEQ ID NO: 1585592 - RNA, 19 nt, Homo sapiens
cacuugggauugucuuacu

SEQ ID NO: 1585593 - RNA, 13 nt, Homo sapiens
cacuuuacuuuca

SEQ ID NO: 1585594 - RNA, 19 nt, Homo sapiens
cacuuugagaagcugaggu

SEQ ID NO: 1585595 - RNA, 15 nt, Homo sapiens
cacuuuguccauuug

SEQ ID NO: 1585596 - RNA, 16 nt, Homo sapiens
cacuuuguugcaagau

SEQ ID NO: 1585597 - RNA, 19 nt, Homo sapiens
cacuuuuuccuuacugugc

SEQ ID NO: 1585598 - RNA, 16 nt, Homo sapiens
cacuuuuuuucuauau

SEQ ID NO: 1585599 - RNA, 13 nt, Homo sapiens
cagaaaaagaagg

SEQ ID NO: 1585600 - RNA, 19 nt, Homo sapiens
cagaaaacaggguccagga

SEQ ID NO: 1585601 - RNA, 13 nt, Homo sapiens
cagaaaacauaau

SEQ ID NO: 1585602 - RNA, 17 nt, Homo sapiens
cagaaaagaugugcaga

SEQ ID NO: 1585603 - RNA, 13 nt, Homo sapiens
cagaaaauucugu

SEQ ID NO: 1585604 - RNA, 15 nt, Homo sapiens
cagaaacaaaaucaa

SEQ ID NO: 1585605 - RNA, 23 nt, Homo sapiens
cagaaacaaaaucaaaacagaga

SEQ ID NO: 1585606 - RNA, 15 nt, Homo sapiens
cagaaacuacauuuc

SEQ ID NO: 1585607 - RNA, 20 nt, Homo sapiens
cagaaagagacuccgucuca

SEQ ID NO: 1585608 - RNA, 14 nt, Homo sapiens
cagaaagauuugau

SEQ ID NO: 1585609 - RNA, 18 nt, Homo sapiens
cagaaagcagauaccuca

SEQ ID NO: 1585610 - RNA, 22 nt, Homo sapiens
cagaaagcuucauccacagccu

SEQ ID NO: 1585611 - RNA, 16 nt, Homo sapiens
cagaaaguaagcauuu

SEQ ID NO: 1585612 - RNA, 17 nt, Homo sapiens
cagaaaucaaacugcuu

SEQ ID NO: 1585613 - RNA, 12 nt, Homo sapiens
cagaaaucacaa

SEQ ID NO: 1585614 - RNA, 22 nt, Homo sapiens
cagaaaugcaaggggcugcaug

SEQ ID NO: 1585615 - RNA, 15 nt, Homo sapiens
cagaaauggacugga

SEQ ID NO: 1585616 - RNA, 17 nt, Homo sapiens
cagaacaagaagcuuau

SEQ ID NO: 1585617 - RNA, 11 nt, Homo sapiens
cagaacagagg

SEQ ID NO: 1585618 - RNA, 12 nt, Homo sapiens
cagaacagugau

SEQ ID NO: 1585619 - RNA, 22 nt, Homo sapiens
cagaacagugguggcaacauuc

SEQ ID NO: 1585620 - RNA, 20 nt, Homo sapiens
cagaacauucgaaucucugc

SEQ ID NO: 1585621 - RNA, 15 nt, Homo sapiens
cagaaccacugaguc

SEQ ID NO: 1585622 - RNA, 14 nt, Homo sapiens
cagaacgguucuuu

SEQ ID NO: 1585623 - RNA, 20 nt, Homo sapiens
cagaacguggugaccuuuca

SEQ ID NO: 1585624 - RNA, 18 nt, Homo sapiens
cagaacuaaauuuuucau

SEQ ID NO: 1585625 - RNA, 18 nt, Homo sapiens
cagaacucccauuacaac

SEQ ID NO: 1585626 - RNA, 19 nt, Homo sapiens
cagaagagaaaggacucag

SEQ ID NO: 1585627 - RNA, 18 nt, Homo sapiens
cagaagauuauuuacuga

SEQ ID NO: 1585628 - RNA, 14 nt, Homo sapiens
cagaagccuuggaa

SEQ ID NO: 1585629 - RNA, 13 nt, Homo sapiens
cagaagcuuaaaa

SEQ ID NO: 1585630 - RNA, 20 nt, Homo sapiens
cagaaggauuaccugaggca

SEQ ID NO: 1585631 - RNA, 16 nt, Homo sapiens
cagaaggcaaacccau

SEQ ID NO: 1585632 - RNA, 12 nt, Homo sapiens
cagaagggauaa

SEQ ID NO: 1585633 - RNA, 15 nt, Homo sapiens
cagaaggggguggug

SEQ ID NO: 1585634 - RNA, 23 nt, Homo sapiens
cagaaggguggggauaucagggc

SEQ ID NO: 1585635 - RNA, 15 nt, Homo sapiens
cagaaguaagccuca

SEQ ID NO: 1585636 - RNA, 17 nt, Homo sapiens
cagaagucuaguuuuau

SEQ ID NO: 1585637 - RNA, 21 nt, Homo sapiens
cagaaucaagcuuuugcuuga

SEQ ID NO: 1585638 - RNA, 21 nt, Homo sapiens
cagaaucccuuaacaguugua

SEQ ID NO: 1585639 - RNA, 18 nt, Homo sapiens
cagaauggaaauuuauaa

SEQ ID NO: 1585640 - RNA, 12 nt, Homo sapiens
cagaauggagcu

SEQ ID NO: 1585641 - RNA, 23 nt, Homo sapiens
cagaauguggguauugaguguga

SEQ ID NO: 1585642 - RNA, 13 nt, Homo sapiens
cagaauguguuau

SEQ ID NO: 1585643 - RNA, 19 nt, Homo sapiens
cagaauguguuauuuguca

SEQ ID NO: 1585644 - RNA, 16 nt, Homo sapiens
cagacaacaccuuccu

SEQ ID NO: 1585645 - RNA, 15 nt, Homo sapiens
cagacaccaugugca

SEQ ID NO: 1585646 - RNA, 16 nt, Homo sapiens
cagacaccauucauuc

SEQ ID NO: 1585647 - RNA, 22 nt, Homo sapiens
cagacaccauucauuccauguc

SEQ ID NO: 1585648 - RNA, 14 nt, Homo sapiens
cagacaccuggacu

SEQ ID NO: 1585649 - RNA, 23 nt, Homo sapiens
cagacacugaccauccacucuac

SEQ ID NO: 1585650 - RNA, 21 nt, Homo sapiens
cagacacuggcguuacugcuu

SEQ ID NO: 1585651 - RNA, 22 nt, Homo sapiens
cagacagcccuggcaaaugccu

SEQ ID NO: 1585652 - RNA, 10 nt, Homo sapiens
cagacauauu

SEQ ID NO: 1585653 - RNA, 16 nt, Homo sapiens
cagacaucaacagaua

SEQ ID NO: 1585654 - RNA, 17 nt, Homo sapiens
cagacauggacaaggag

SEQ ID NO: 1585655 - RNA, 12 nt, Homo sapiens
cagaccacugau

SEQ ID NO: 1585656 - RNA, 20 nt, Homo sapiens
cagaccacugauaaaaccau

SEQ ID NO: 1585657 - RNA, 15 nt, Homo sapiens
cagaccauccagagg

SEQ ID NO: 1585658 - RNA, 19 nt, Homo sapiens
cagaccugguucccacuga

SEQ ID NO: 1585659 - RNA, 12 nt, Homo sapiens
cagacgugugac

SEQ ID NO: 1585660 - RNA, 13 nt, Homo sapiens
cagacguugccug

SEQ ID NO: 1585661 - RNA, 17 nt, Homo sapiens
cagacguugccugagaa

SEQ ID NO: 1585662 - RNA, 21 nt, Homo sapiens
cagacuauggauguguucucu

SEQ ID NO: 1585663 - RNA, 16 nt, Homo sapiens
cagacucagacuccau

SEQ ID NO: 1585664 - RNA, 21 nt, Homo sapiens
cagacuccugcucucuaucca

SEQ ID NO: 1585665 - RNA, 13 nt, Homo sapiens
cagacucuuggcu

SEQ ID NO: 1585666 - RNA, 17 nt, Homo sapiens
cagacugaugagcacau

SEQ ID NO: 1585667 - RNA, 21 nt, Homo sapiens
cagacuugccaggcucccuuu

SEQ ID NO: 1585668 - RNA, 23 nt, Homo sapiens
cagacuuggaguaaaacuguaua

SEQ ID NO: 1585669 - RNA, 21 nt, Homo sapiens
cagacuuuguguucauuucau

SEQ ID NO: 1585670 - RNA, 22 nt, Homo sapiens
cagagaaaaggacuccucagaa

SEQ ID NO: 1585671 - RNA, 15 nt, Homo sapiens
cagagaaaaugagaa

SEQ ID NO: 1585672 - RNA, 22 nt, Homo sapiens
cagagaaccugaguucccggga

SEQ ID NO: 1585673 - RNA, 14 nt, Homo sapiens
cagagacaccugca

SEQ ID NO: 1585674 - RNA, 13 nt, Homo sapiens
cagagacacugag

SEQ ID NO: 1585675 - RNA, 16 nt, Homo sapiens
cagagacugaauagau

SEQ ID NO: 1585676 - RNA, 23 nt, Homo sapiens
cagagauaaagcuuaggucaaag

SEQ ID NO: 1585677 - RNA, 19 nt, Homo sapiens
cagagaugccuccaccgcu

SEQ ID NO: 1585678 - RNA, 13 nt, Homo sapiens
cagagaugugcau

SEQ ID NO: 1585679 - RNA, 20 nt, Homo sapiens
cagagcccaaggucagggag

SEQ ID NO: 1585680 - RNA, 15 nt, Homo sapiens
cagagcccaccuuga

SEQ ID NO: 1585681 - RNA, 21 nt, Homo sapiens
cagagccuacagaagggcagu

SEQ ID NO: 1585682 - RNA, 15 nt, Homo sapiens
cagagccucuggccc

SEQ ID NO: 1585683 - RNA, 19 nt, Homo sapiens
cagagccuucaagugccaa

SEQ ID NO: 1585684 - RNA, 20 nt, Homo sapiens
cagagcgaggaaaggauuuu

SEQ ID NO: 1585685 - RNA, 19 nt, Homo sapiens
cagagcggguaaagugcaa

SEQ ID NO: 1585686 - RNA, 16 nt, Homo sapiens
cagagcugagcccuca

SEQ ID NO: 1585687 - RNA, 13 nt, Homo sapiens
cagagcugggcua

SEQ ID NO: 1585688 - RNA, 15 nt, Homo sapiens
cagagcuucccugac

SEQ ID NO: 1585689 - RNA, 21 nt, Homo sapiens
cagaggaaagaccaugugguu

SEQ ID NO: 1585690 - RNA, 16 nt, Homo sapiens
cagaggaaauucuuuc

SEQ ID NO: 1585691 - RNA, 20 nt, Homo sapiens
cagaggagaauaaaaaaugg

SEQ ID NO: 1585692 - RNA, 19 nt, Homo sapiens
cagaggagccaccaguucu

SEQ ID NO: 1585693 - RNA, 20 nt, Homo sapiens
cagaggaggggaaaguccag

SEQ ID NO: 1585694 - RNA, 23 nt, Homo sapiens
cagaggaggggaaaguccagggc

SEQ ID NO: 1585695 - RNA, 23 nt, Homo sapiens
cagaggaugcaacaaauguggcc

SEQ ID NO: 1585696 - RNA, 14 nt, Homo sapiens
cagaggauguggcc

SEQ ID NO: 1585697 - RNA, 21 nt, Homo sapiens
cagaggccugcugccagugca

SEQ ID NO: 1585698 - RNA, 20 nt, Homo sapiens
cagaggcuaauucaguguca

SEQ ID NO: 1585699 - RNA, 19 nt, Homo sapiens
cagaggggaaagacuucca

SEQ ID NO: 1585700 - RNA, 18 nt, Homo sapiens
cagaggggacgcugagga

SEQ ID NO: 1585701 - RNA, 19 nt, Homo sapiens
cagaguccacuguggcacu

SEQ ID NO: 1585702 - RNA, 16 nt, Homo sapiens
cugcacuuugauguca

SEQ ID NO: 1585703 - RNA, 19 nt, Homo sapiens
cugcagagcugacccagag

SEQ ID NO: 1585704 - RNA, 13 nt, Homo sapiens
cugcagaucuucc

SEQ ID NO: 1585705 - RNA, 16 nt, Homo sapiens
cugcagccccccagag

SEQ ID NO: 1585706 - RNA, 18 nt, Homo sapiens
cugcagcccccucgggga

SEQ ID NO: 1585707 - RNA, 16 nt, Homo sapiens
cugcagccucauacuc

SEQ ID NO: 1585708 - RNA, 19 nt, Homo sapiens
cugcaggcagagacugaaa

SEQ ID NO: 1585709 - RNA, 22 nt, Homo sapiens
cugcagguggcagagugaaugu

SEQ ID NO: 1585710 - RNA, 18 nt, Homo sapiens
cugcagucacaucacaau

SEQ ID NO: 1585711 - RNA, 22 nt, Homo sapiens
cugcauacucauuaggauggcu

SEQ ID NO: 1585712 - RNA, 22 nt, Homo sapiens
cugcaucuccccucagauucca

SEQ ID NO: 1585713 - RNA, 19 nt, Homo sapiens
cugcauggcaucagacuag

SEQ ID NO: 1585714 - RNA, 21 nt, Homo sapiens
cugcauucaccuuagugcaac

SEQ ID NO: 1585715 - RNA, 15 nt, Homo sapiens
cugccaagacuccuc

SEQ ID NO: 1585716 - RNA, 17 nt, Homo sapiens
cugccacagacuguggu

SEQ ID NO: 1585717 - RNA, 19 nt, Homo sapiens
cugccagaagauccccuca

SEQ ID NO: 1585718 - RNA, 19 nt, Homo sapiens
cugccaggauaaagcuucc

SEQ ID NO: 1585719 - RNA, 20 nt, Homo sapiens
cugccaggcuguuucagcca

SEQ ID NO: 1585720 - RNA, 13 nt, Homo sapiens
cugccagggagcu

SEQ ID NO: 1585721 - RNA, 15 nt, Homo sapiens
cugccaucaugccug

SEQ ID NO: 1585722 - RNA, 23 nt, Homo sapiens
cugccaucauguuuacagaggac

SEQ ID NO: 1585723 - RNA, 17 nt, Homo sapiens
cugccaugacagaggcu

SEQ ID NO: 1585724 - RNA, 11 nt, Homo sapiens
cugccauuaca

SEQ ID NO: 1585725 - RNA, 22 nt, Homo sapiens
cugccauucacuucauaaucca

SEQ ID NO: 1585726 - RNA, 13 nt, Homo sapiens
cugcccagacuga

SEQ ID NO: 1585727 - RNA, 19 nt, Homo sapiens
cugcccaggccuaucugga

SEQ ID NO: 1585728 - RNA, 22 nt, Homo sapiens
cugccccacggagacagaggaa

SEQ ID NO: 1585729 - RNA, 15 nt, Homo sapiens
cugccccagauuuac

SEQ ID NO: 1585730 - RNA, 15 nt, Homo sapiens
cugccccccaugagg

SEQ ID NO: 1585731 - RNA, 17 nt, Homo sapiens
cugccccucucaccaaa

SEQ ID NO: 1585732 - RNA, 16 nt, Homo sapiens
cugccccuuaaacaca

SEQ ID NO: 1585733 - RNA, 21 nt, Homo sapiens
cugcccgggaaggucaccagc

SEQ ID NO: 1585734 - RNA, 19 nt, Homo sapiens
cugcccucacaucuuccac

SEQ ID NO: 1585735 - RNA, 12 nt, Homo sapiens
cugcccucccaa

SEQ ID NO: 1585736 - RNA, 17 nt, Homo sapiens
cugcccuccuuguccac

SEQ ID NO: 1585737 - RNA, 17 nt, Homo sapiens
cugcccucucccugugu

SEQ ID NO: 1585738 - RNA, 17 nt, Homo sapiens
cugcccuuccugccuga

SEQ ID NO: 1585739 - RNA, 14 nt, Homo sapiens
cugccgagagucca

SEQ ID NO: 1585740 - RNA, 19 nt, Homo sapiens
cugccuaauaguaacuggu

SEQ ID NO: 1585741 - RNA, 16 nt, Homo sapiens
cugccuaauuuugcca

SEQ ID NO: 1585742 - RNA, 18 nt, Homo sapiens
cugccucaggccaaggga

SEQ ID NO: 1585743 - RNA, 23 nt, Homo sapiens
cugccuccuuuccccucccucag

SEQ ID NO: 1585744 - RNA, 16 nt, Homo sapiens
cugccuuaaaaccaaa

SEQ ID NO: 1585745 - RNA, 19 nt, Homo sapiens
cugccuuuuuacuauacag

SEQ ID NO: 1585746 - RNA, 18 nt, Homo sapiens
cugcgaaugggauccuga

SEQ ID NO: 1585747 - RNA, 13 nt, Homo sapiens
cugcgaccuugca

SEQ ID NO: 1585748 - RNA, 18 nt, Homo sapiens
cugcggaccccucgucau

SEQ ID NO: 1585749 - RNA, 19 nt, Homo sapiens
cugcguagaagauauggaa

SEQ ID NO: 1585750 - RNA, 14 nt, Homo sapiens
cugcuaaauaucac

SEQ ID NO: 1585751 - RNA, 20 nt, Homo sapiens
cugcuaaggcuccuccuugc

SEQ ID NO: 1585752 - RNA, 14 nt, Homo sapiens
cugcuaccaucuca

SEQ ID NO: 1585753 - RNA, 20 nt, Homo sapiens
cugcuacugucuuacuauua

SEQ ID NO: 1585754 - RNA, 17 nt, Homo sapiens
cugcuaucccacuguau

SEQ ID NO: 1585755 - RNA, 14 nt, Homo sapiens
cugcucaagauaug

SEQ ID NO: 1585756 - RNA, 14 nt, Homo sapiens
cugcuccaccacau

SEQ ID NO: 1585757 - RNA, 19 nt, Homo sapiens
cugcuccaggccugcauua

SEQ ID NO: 1585758 - RNA, 15 nt, Homo sapiens
cugcuccccacguca

SEQ ID NO: 1585759 - RNA, 22 nt, Homo sapiens
cugcuccccacgucagcuggga

SEQ ID NO: 1585760 - RNA, 14 nt, Homo sapiens
cugcuccugauaua

SEQ ID NO: 1585761 - RNA, 16 nt, Homo sapiens
cugcugaaugccgcga

SEQ ID NO: 1585762 - RNA, 14 nt, Homo sapiens
cugcugacugccaa

SEQ ID NO: 1585763 - RNA, 20 nt, Homo sapiens
cugcugcccuuaggccacau

SEQ ID NO: 1585764 - RNA, 22 nt, Homo sapiens
cugcugccucccuuucauacaa

SEQ ID NO: 1585765 - RNA, 15 nt, Homo sapiens
cugcugcugcugcug

SEQ ID NO: 1585766 - RNA, 15 nt, Homo sapiens
cugcuggccaagaag

SEQ ID NO: 1585767 - RNA, 16 nt, Homo sapiens
cugcuguccagacagc

SEQ ID NO: 1585768 - RNA, 14 nt, Homo sapiens
cugcugugaaucug

SEQ ID NO: 1585769 - RNA, 15 nt, Homo sapiens
cugcuguguucucac

SEQ ID NO: 1585770 - RNA, 18 nt, Homo sapiens
cugcuucacgauucuuac

SEQ ID NO: 1585771 - RNA, 13 nt, Homo sapiens
cugcuucuuucca

SEQ ID NO: 1585772 - RNA, 14 nt, Homo sapiens
cugcuugaccaaag

SEQ ID NO: 1585773 - RNA, 15 nt, Homo sapiens
cugcuugaccaaaga

SEQ ID NO: 1585774 - RNA, 22 nt, Homo sapiens
cugcuugaggaaaacaagcauu

SEQ ID NO: 1585775 - RNA, 17 nt, Homo sapiens
cugcuugcaucugcaca

SEQ ID NO: 1585776 - RNA, 13 nt, Homo sapiens
cugcuugugaucu

SEQ ID NO: 1585777 - RNA, 19 nt, Homo sapiens
cugcuuucccugagccccu

SEQ ID NO: 1585778 - RNA, 17 nt, Homo sapiens
cugcuuucuuguugcug

SEQ ID NO: 1585779 - RNA, 20 nt, Homo sapiens
cugcuuuugcagaaaucaca

SEQ ID NO: 1585780 - RNA, 15 nt, Homo sapiens
cuggaaaaaggugaa

SEQ ID NO: 1585781 - RNA, 22 nt, Homo sapiens
cuggaaaguuuucuccacugga

SEQ ID NO: 1585782 - RNA, 12 nt, Homo sapiens
cuggaaauggac

SEQ ID NO: 1585783 - RNA, 18 nt, Homo sapiens
cuggaaauguagcacuua

SEQ ID NO: 1585784 - RNA, 13 nt, Homo sapiens
cuggaacauuuau

SEQ ID NO: 1585785 - RNA, 17 nt, Homo sapiens
cuggaaccugcaaaaaa

SEQ ID NO: 1585786 - RNA, 14 nt, Homo sapiens
cuggaagaaccacu

SEQ ID NO: 1585787 - RNA, 19 nt, Homo sapiens
cuggaaggacacagugaug

SEQ ID NO: 1585788 - RNA, 18 nt, Homo sapiens
cuggaagggguccagccu

SEQ ID NO: 1585789 - RNA, 19 nt, Homo sapiens
cuggaaugugccacagagg

SEQ ID NO: 1585790 - RNA, 18 nt, Homo sapiens
cuggaauucuucugcaac

SEQ ID NO: 1585791 - RNA, 14 nt, Homo sapiens
cuggacacugucca

SEQ ID NO: 1585792 - RNA, 17 nt, Homo sapiens
cuggacagcagaagccu

SEQ ID NO: 1585793 - RNA, 15 nt, Homo sapiens
cuggaccaggucuca

SEQ ID NO: 1585794 - RNA, 19 nt, Homo sapiens
cuggacuccggaggacuga

SEQ ID NO: 1585795 - RNA, 17 nt, Homo sapiens
cuggacugccggcucua

SEQ ID NO: 1585796 - RNA, 15 nt, Homo sapiens
cuggagagugcacau

SEQ ID NO: 1585797 - RNA, 19 nt, Homo sapiens
cuggagagugcacaugccc

SEQ ID NO: 1585798 - RNA, 13 nt, Homo sapiens
cuggagauaugaa

SEQ ID NO: 1585799 - RNA, 17 nt, Homo sapiens
cuggagcucaucugcaa

SEQ ID NO: 1585800 - RNA, 13 nt, Homo sapiens
cuggagcucugcc

SEQ ID NO: 1585801 - RNA, 15 nt, Homo sapiens
cuggaggaacacuug

SEQ ID NO: 1585802 - RNA, 15 nt, Homo sapiens
cuggagucugucaau

SEQ ID NO: 1585803 - RNA, 17 nt, Homo sapiens
cuggagugcaguggcau

SEQ ID NO: 1585804 - RNA, 19 nt, Homo sapiens
cuggagugcaguggcgcau

SEQ ID NO: 1585805 - RNA, 21 nt, Homo sapiens
cuggagugcaguggugugauc

SEQ ID NO: 1585806 - RNA, 19 nt, Homo sapiens
cuggauccagcacugguga

SEQ ID NO: 1585807 - RNA, 21 nt, Homo sapiens
cuggauccagccaugccugag

SEQ ID NO: 1585808 - RNA, 15 nt, Homo sapiens
cuggaucuaccagca

SEQ ID NO: 1585809 - RNA, 17 nt, Homo sapiens
cuggaugacuugagaug

SEQ ID NO: 1585810 - RNA, 15 nt, Homo sapiens
cuggaugcaugaauu

SEQ ID NO: 1585811 - RNA, 21 nt, Homo sapiens
cuggaugucugggugaccuca

SEQ ID NO: 1585812 - RNA, 20 nt, Homo sapiens
cuggcaaagaacucauuuga

SEQ ID NO: 1585813 - RNA, 23 nt, Homo sapiens
cuggcaaaugccugacucaguga

SEQ ID NO: 1585814 - RNA, 15 nt, Homo sapiens
cuggcaacacagagg

SEQ ID NO: 1585815 - RNA, 14 nt, Homo sapiens
cuggcacagaggua

SEQ ID NO: 1585816 - RNA, 14 nt, Homo sapiens
cuggcaguacuguu

SEQ ID NO: 1585817 - RNA, 21 nt, Homo sapiens
cuggccacaguaauuggucau

SEQ ID NO: 1585818 - RNA, 22 nt, Homo sapiens
cuggccacuggguauacugcug

SEQ ID NO: 1585819 - RNA, 17 nt, Homo sapiens
cuggcccuccacuccuc

SEQ ID NO: 1585820 - RNA, 20 nt, Homo sapiens
cuggcccuccccacaaugcc

SEQ ID NO: 1585821 - RNA, 17 nt, Homo sapiens
cuuggccaaggugguga

SEQ ID NO: 1585822 - RNA, 23 nt, Homo sapiens
cuuggccucccaaagugcugaga

SEQ ID NO: 1585823 - RNA, 13 nt, Homo sapiens
cuugggcucccug

SEQ ID NO: 1585824 - RNA, 17 nt, Homo sapiens
cuugggguaagccagag

SEQ ID NO: 1585825 - RNA, 16 nt, Homo sapiens
cuugguaaucaugaaa

SEQ ID NO: 1585826 - RNA, 18 nt, Homo sapiens
cuugguacugaaaaugag

SEQ ID NO: 1585827 - RNA, 14 nt, Homo sapiens
cuugguucuuucag

SEQ ID NO: 1585828 - RNA, 19 nt, Homo sapiens
cuuguauagcuuuuaucug

SEQ ID NO: 1585829 - RNA, 21 nt, Homo sapiens
cuugucaagccugugcaaaaa

SEQ ID NO: 1585830 - RNA, 15 nt, Homo sapiens
cuugucauguacuga

SEQ ID NO: 1585831 - RNA, 17 nt, Homo sapiens
cuugugaaguggaaaug

SEQ ID NO: 1585832 - RNA, 22 nt, Homo sapiens
cuugugagagcccauucccacc

SEQ ID NO: 1585833 - RNA, 23 nt, Homo sapiens
cuugugccaaaccuacuaggcca

SEQ ID NO: 1585834 - RNA, 19 nt, Homo sapiens
cuugugcuucuucacuuac

SEQ ID NO: 1585835 - RNA, 14 nt, Homo sapiens
cuuguggguccaug

SEQ ID NO: 1585836 - RNA, 18 nt, Homo sapiens
cuuguggguccaugcuaa

SEQ ID NO: 1585837 - RNA, 22 nt, Homo sapiens
cuugugucugcggggaucagag

SEQ ID NO: 1585838 - RNA, 17 nt, Homo sapiens
cuugugugaggcucugu

SEQ ID NO: 1585839 - RNA, 16 nt, Homo sapiens
cuuguguucaaucugu

SEQ ID NO: 1585840 - RNA, 17 nt, Homo sapiens
cuuguguugcacugaac

SEQ ID NO: 1585841 - RNA, 17 nt, Homo sapiens
cuuguuaacugguuaaa

SEQ ID NO: 1585842 - RNA, 18 nt, Homo sapiens
cuuguuaauuuuauucaa

SEQ ID NO: 1585843 - RNA, 19 nt, Homo sapiens
cuuguucugagauucaaua

SEQ ID NO: 1585844 - RNA, 13 nt, Homo sapiens
cuuguugcucaaa

SEQ ID NO: 1585845 - RNA, 17 nt, Homo sapiens
cuuguugcugcaucucc

SEQ ID NO: 1585846 - RNA, 13 nt, Homo sapiens
cuuguugucucca

SEQ ID NO: 1585847 - RNA, 14 nt, Homo sapiens
cuuguuuacagcac

SEQ ID NO: 1585848 - RNA, 14 nt, Homo sapiens
cuuguuuacucauu

SEQ ID NO: 1585849 - RNA, 17 nt, Homo sapiens
cuuguuuacucauugaa

SEQ ID NO: 1585850 - RNA, 17 nt, Homo sapiens
cuuguuuguuacuguca

SEQ ID NO: 1585851 - RNA, 19 nt, Homo sapiens
cuuuaaaaacuguuuuaga

SEQ ID NO: 1585852 - RNA, 20 nt, Homo sapiens
cuuuaaagcguuugcacaga

SEQ ID NO: 1585853 - RNA, 18 nt, Homo sapiens
cuuuaaauaaauccaaaa

SEQ ID NO: 1585854 - RNA, 17 nt, Homo sapiens
cuuuaaauggaauaauu

SEQ ID NO: 1585855 - RNA, 19 nt, Homo sapiens
cuuuaacugacaagccauc

SEQ ID NO: 1585856 - RNA, 22 nt, Homo sapiens
cuuuaagaagcaguguuuuaga

SEQ ID NO: 1585857 - RNA, 16 nt, Homo sapiens
cuuuaaguuauuuuac

SEQ ID NO: 1585858 - RNA, 15 nt, Homo sapiens
cuuuacaaaaguauu

SEQ ID NO: 1585859 - RNA, 21 nt, Homo sapiens
cuuuacaaaccauuaccugua

SEQ ID NO: 1585860 - RNA, 21 nt, Homo sapiens
cuuuacaaaccuuuguuucaa

SEQ ID NO: 1585861 - RNA, 13 nt, Homo sapiens
cuuuacaguuaca

SEQ ID NO: 1585862 - RNA, 21 nt, Homo sapiens
cuuuaccaaaugaaaugccaa

SEQ ID NO: 1585863 - RNA, 23 nt, Homo sapiens
cuuuaccaaaugaaaugccaaag

SEQ ID NO: 1585864 - RNA, 15 nt, Homo sapiens
cuuuacuaauggugu

SEQ ID NO: 1585865 - RNA, 13 nt, Homo sapiens
cuuuacuucccag

SEQ ID NO: 1585866 - RNA, 18 nt, Homo sapiens
cuuuagaaagcugacauu

SEQ ID NO: 1585867 - RNA, 18 nt, Homo sapiens
cuuuagcaagugugcacu

SEQ ID NO: 1585868 - RNA, 20 nt, Homo sapiens
cuuuauagguuuauuacaag

SEQ ID NO: 1585869 - RNA, 19 nt, Homo sapiens
cuuuauccccguuucuugc

SEQ ID NO: 1585870 - RNA, 20 nt, Homo sapiens
cuuuauuuaaaaagaaugga

SEQ ID NO: 1585871 - RNA, 23 nt, Homo sapiens
cuuuauuuuaaaaaacacugaua

SEQ ID NO: 1585872 - RNA, 13 nt, Homo sapiens
cuuucaaaagccu

SEQ ID NO: 1585873 - RNA, 16 nt, Homo sapiens
cuuucaaccucaguga

SEQ ID NO: 1585874 - RNA, 15 nt, Homo sapiens
cuuucaagcaaaaaa

SEQ ID NO: 1585875 - RNA, 21 nt, Homo sapiens
cuuucaauuacaaagcaguua

SEQ ID NO: 1585876 - RNA, 14 nt, Homo sapiens
cuuucacucuguca

SEQ ID NO: 1585877 - RNA, 21 nt, Homo sapiens
cuuucagauuauggaugauua

SEQ ID NO: 1585878 - RNA, 19 nt, Homo sapiens
cuuucagccacaugcccca

SEQ ID NO: 1585879 - RNA, 21 nt, Homo sapiens
cuuucauaccacuugaauuua

SEQ ID NO: 1585880 - RNA, 13 nt, Homo sapiens
cuuucaugcucca

SEQ ID NO: 1585881 - RNA, 22 nt, Homo sapiens
cuuucauucggugugaacuuuu

SEQ ID NO: 1585882 - RNA, 13 nt, Homo sapiens
cuuuccaaaaccu

SEQ ID NO: 1585883 - RNA, 20 nt, Homo sapiens
cuuuccaaaaggaacucuag

SEQ ID NO: 1585884 - RNA, 16 nt, Homo sapiens
cuuuccaaacaccacu

SEQ ID NO: 1585885 - RNA, 15 nt, Homo sapiens
cuuuccaaagcauuu

SEQ ID NO: 1585886 - RNA, 21 nt, Homo sapiens
cuuuccacauauagagcucca

SEQ ID NO: 1585887 - RNA, 15 nt, Homo sapiens
cuuuccaggggccaa

SEQ ID NO: 1585888 - RNA, 15 nt, Homo sapiens
cuuucccagucccau

SEQ ID NO: 1585889 - RNA, 13 nt, Homo sapiens
cuuucccagugag

SEQ ID NO: 1585890 - RNA, 23 nt, Homo sapiens
cuuucccauucuguuuggaucua

SEQ ID NO: 1585891 - RNA, 16 nt, Homo sapiens
cuuuccccucccucag

SEQ ID NO: 1585892 - RNA, 13 nt, Homo sapiens
cuuucccuugugu

SEQ ID NO: 1585893 - RNA, 23 nt, Homo sapiens
cuuuccuaaagucucugcugcua

SEQ ID NO: 1585894 - RNA, 17 nt, Homo sapiens
cuuuccucaaaucaaaa

SEQ ID NO: 1585895 - RNA, 16 nt, Homo sapiens
cuuuccucaucaggcc

SEQ ID NO: 1585896 - RNA, 13 nt, Homo sapiens
cuuuccuccugag

SEQ ID NO: 1585897 - RNA, 15 nt, Homo sapiens
cuuuccuucaucucc

SEQ ID NO: 1585898 - RNA, 15 nt, Homo sapiens
cuuucuaaagacagg

SEQ ID NO: 1585899 - RNA, 22 nt, Homo sapiens
cuuucuaaaggaaaucaaauga

SEQ ID NO: 1585900 - RNA, 13 nt, Homo sapiens
cuuucuaugcugu

SEQ ID NO: 1585901 - RNA, 21 nt, Homo sapiens
cuuucucaaucuugaacucau

SEQ ID NO: 1585902 - RNA, 14 nt, Homo sapiens
cuuucucucaguga

SEQ ID NO: 1585903 - RNA, 12 nt, Homo sapiens
cuuucucugcaa

SEQ ID NO: 1585904 - RNA, 19 nt, Homo sapiens
cuuucugcucuuuacauuu

SEQ ID NO: 1585905 - RNA, 19 nt, Homo sapiens
cuuucuguuuggacccaug

SEQ ID NO: 1585906 - RNA, 14 nt, Homo sapiens
cuuucuuaucccag

SEQ ID NO: 1585907 - RNA, 16 nt, Homo sapiens
cuuucuucaccaaauc

SEQ ID NO: 1585908 - RNA, 13 nt, Homo sapiens
cuuucuuccaaac

SEQ ID NO: 1585909 - RNA, 16 nt, Homo sapiens
cuuucuucuagugcuu

SEQ ID NO: 1585910 - RNA, 18 nt, Homo sapiens
cuuucuuggagugccaag

SEQ ID NO: 1585911 - RNA, 21 nt, Homo sapiens
cuuucuuggagugccaaguuu

SEQ ID NO: 1585912 - RNA, 17 nt, Homo sapiens
cuuucuuuggugccuuu

SEQ ID NO: 1585913 - RNA, 20 nt, Homo sapiens
cuuucuuuuuaaucuuccau

SEQ ID NO: 1585914 - RNA, 15 nt, Homo sapiens
cuuugaaucugggac

SEQ ID NO: 1585915 - RNA, 22 nt, Homo sapiens
cuuugacacuuuucauaucauu

SEQ ID NO: 1585916 - RNA, 13 nt, Homo sapiens
cuuugacaguguu

SEQ ID NO: 1585917 - RNA, 14 nt, Homo sapiens
cuuugacaguguuu

SEQ ID NO: 1585918 - RNA, 23 nt, Homo sapiens
cuuugaccacaucgcucuaggau

SEQ ID NO: 1585919 - RNA, 20 nt, Homo sapiens
cuuugaccuaaauuauuuac

SEQ ID NO: 1585920 - RNA, 21 nt, Homo sapiens
cuuugagucaauagcuugucu

SEQ ID NO: 1585921 - RNA, 16 nt, Homo sapiens
cuuugagugacugggu

SEQ ID NO: 1585922 - RNA, 22 nt, Homo sapiens
cuuugauagauuucuacacuga

SEQ ID NO: 1585923 - RNA, 11 nt, Homo sapiens
cuuugcacuug

SEQ ID NO: 1585924 - RNA, 19 nt, Homo sapiens
cuuugcaguuggacucuca

SEQ ID NO: 1585925 - RNA, 16 nt, Homo sapiens
cuuugccaaaauacca

SEQ ID NO: 1585926 - RNA, 19 nt, Homo sapiens
cuuugccucuucuuugugc

SEQ ID NO: 1585927 - RNA, 23 nt, Homo sapiens
cuuugccucuucuuugugccuuu

SEQ ID NO: 1585928 - RNA, 12 nt, Homo sapiens
cuuugcugccag

SEQ ID NO: 1585929 - RNA, 15 nt, Homo sapiens
cuuugcuucccauug

SEQ ID NO: 1585930 - RNA, 18 nt, Homo sapiens
cuuuggaagauggcauaa

SEQ ID NO: 1585931 - RNA, 17 nt, Homo sapiens
cuuuggaagucaugagc

SEQ ID NO: 1585932 - RNA, 22 nt, Homo sapiens
cuuuggacuugucccgggacac

SEQ ID NO: 1585933 - RNA, 20 nt, Homo sapiens
cuuuggagaaaugcuuagaa

SEQ ID NO: 1585934 - RNA, 13 nt, Homo sapiens
cuuuggcauggga

SEQ ID NO: 1585935 - RNA, 23 nt, Homo sapiens
cuuugguccuggugcugccgagg

SEQ ID NO: 1585936 - RNA, 19 nt, Homo sapiens
cuuuguauacaaguacugg

SEQ ID NO: 1585937 - RNA, 13 nt, Homo sapiens
cuuuguauacuuu

SEQ ID NO: 1585938 - RNA, 17 nt, Homo sapiens
cuuuguaugacagugaa

SEQ ID NO: 1585939 - RNA, 16 nt, Homo sapiens
gaagaaagcaacaaag

SEQ ID NO: 1585940 - RNA, 22 nt, Homo sapiens
gaagaacagaauugcuccugca

SEQ ID NO: 1585941 - RNA, 15 nt, Homo sapiens
gaagacagcuuccca

SEQ ID NO: 1585942 - RNA, 16 nt, Homo sapiens
gaagacccacgugcua

SEQ ID NO: 1585943 - RNA, 13 nt, Homo sapiens
gaagagaagggca

SEQ ID NO: 1585944 - RNA, 14 nt, Homo sapiens
gaagagggucccuc

SEQ ID NO: 1585945 - RNA, 19 nt, Homo sapiens
gaagagguugggcuuccau

SEQ ID NO: 1585946 - RNA, 13 nt, Homo sapiens
gaagagucauuuu

SEQ ID NO: 1585947 - RNA, 22 nt, Homo sapiens
gaagagugauguuucagucaag

SEQ ID NO: 1585948 - RNA, 15 nt, Homo sapiens
gaagauaaacacaaa

SEQ ID NO: 1585949 - RNA, 14 nt, Homo sapiens
gaagaucaggcaca

SEQ ID NO: 1585950 - RNA, 23 nt, Homo sapiens
gaagaugacgaguaacuccccuc

SEQ ID NO: 1585951 - RNA, 16 nt, Homo sapiens
gaagauuagaaacuac

SEQ ID NO: 1585952 - RNA, 22 nt, Homo sapiens
gaagauuauuuacugacauaua

SEQ ID NO: 1585953 - RNA, 15 nt, Homo sapiens
gaagauucuauguua

SEQ ID NO: 1585954 - RNA, 17 nt, Homo sapiens
gaagauucuauguuaau

SEQ ID NO: 1585955 - RNA, 22 nt, Homo sapiens
gaagcaaaaguaaucacuuaaa

SEQ ID NO: 1585956 - RNA, 13 nt, Homo sapiens
gaagcaaaugcua

SEQ ID NO: 1585957 - RNA, 19 nt, Homo sapiens
gaagcaacaggaaucaaga

SEQ ID NO: 1585958 - RNA, 19 nt, Homo sapiens
gaagcacagagggcuaggg

SEQ ID NO: 1585959 - RNA, 16 nt, Homo sapiens
gaagcagcagaccucc

SEQ ID NO: 1585960 - RNA, 15 nt, Homo sapiens
gaagcaggacccagu

SEQ ID NO: 1585961 - RNA, 13 nt, Homo sapiens
gaagcaguauuuu

SEQ ID NO: 1585962 - RNA, 20 nt, Homo sapiens
gaagcaugaauaacauuuaa

SEQ ID NO: 1585963 - RNA, 12 nt, Homo sapiens
gaagccaaagaa

SEQ ID NO: 1585964 - RNA, 14 nt, Homo sapiens
gaagccacaaagac

SEQ ID NO: 1585965 - RNA, 15 nt, Homo sapiens
gaagccagagcccca

SEQ ID NO: 1585966 - RNA, 18 nt, Homo sapiens
gaagccauauaugaccag

SEQ ID NO: 1585967 - RNA, 22 nt, Homo sapiens
gaagcccaggagccucacuggg

SEQ ID NO: 1585968 - RNA, 19 nt, Homo sapiens
gaagcccgaggucaucacc

SEQ ID NO: 1585969 - RNA, 13 nt, Homo sapiens
gaagccugcuccu

SEQ ID NO: 1585970 - RNA, 17 nt, Homo sapiens
gaagccugggugucaag

SEQ ID NO: 1585971 - RNA, 20 nt, Homo sapiens
gaagccuguggaugaucaau

SEQ ID NO: 1585972 - RNA, 16 nt, Homo sapiens
gaagcuauuucauuug

SEQ ID NO: 1585973 - RNA, 14 nt, Homo sapiens
gaagcucuucuucc

SEQ ID NO: 1585974 - RNA, 22 nt, Homo sapiens
gaagcugaagauccccaacugc

SEQ ID NO: 1585975 - RNA, 17 nt, Homo sapiens
gaagcuguauaauuaau

SEQ ID NO: 1585976 - RNA, 19 nt, Homo sapiens
gaagcuuaaaaucugugaa

SEQ ID NO: 1585977 - RNA, 14 nt, Homo sapiens
gaagcuucaugcca

SEQ ID NO: 1585978 - RNA, 17 nt, Homo sapiens
gaagcuucaugccaggu

SEQ ID NO: 1585979 - RNA, 20 nt, Homo sapiens
gaagcuuugguucucugauu

SEQ ID NO: 1585980 - RNA, 11 nt, Homo sapiens
gaagcuuuguc

SEQ ID NO: 1585981 - RNA, 14 nt, Homo sapiens
gaaggaacuuccag

SEQ ID NO: 1585982 - RNA, 18 nt, Homo sapiens
gaaggaaggaugccacuu

SEQ ID NO: 1585983 - RNA, 14 nt, Homo sapiens
gaaggacacaguga

SEQ ID NO: 1585984 - RNA, 19 nt, Homo sapiens
gaaggacacagugaugaau

SEQ ID NO: 1585985 - RNA, 14 nt, Homo sapiens
gaaggagaagucua

SEQ ID NO: 1585986 - RNA, 15 nt, Homo sapiens
gaaggagaugcugcu

SEQ ID NO: 1585987 - RNA, 19 nt, Homo sapiens
gaaggaggagucagggaga

SEQ ID NO: 1585988 - RNA, 13 nt, Homo sapiens
gaaggaucaucug

SEQ ID NO: 1585989 - RNA, 12 nt, Homo sapiens
gaaggaucccau

SEQ ID NO: 1585990 - RNA, 12 nt, Homo sapiens
gaaggcaaaauu

SEQ ID NO: 1585991 - RNA, 19 nt, Homo sapiens
gaaggcaagagggggugga

SEQ ID NO: 1585992 - RNA, 21 nt, Homo sapiens
gaaggcagcaggcauuugcua

SEQ ID NO: 1585993 - RNA, 10 nt, Homo sapiens
gaaggccagc

SEQ ID NO: 1585994 - RNA, 15 nt, Homo sapiens
gaagggaauugcuca

SEQ ID NO: 1585995 - RNA, 17 nt, Homo sapiens
gaagggaauugcucaga

SEQ ID NO: 1585996 - RNA, 16 nt, Homo sapiens
gaagggcagugacucg

SEQ ID NO: 1585997 - RNA, 19 nt, Homo sapiens
gaagggcuagaaccuggag

SEQ ID NO: 1585998 - RNA, 19 nt, Homo sapiens
gaaggguggaugugcugga

SEQ ID NO: 1585999 - RNA, 20 nt, Homo sapiens
gaagguucucugugcuccuc

SEQ ID NO: 1586000 - RNA, 18 nt, Homo sapiens
gaagguuuucauuugcca

SEQ ID NO: 1586001 - RNA, 19 nt, Homo sapiens
gaaguaaaacagucaucua

SEQ ID NO: 1586002 - RNA, 19 nt, Homo sapiens
gaaguaagccucaucauca

SEQ ID NO: 1586003 - RNA, 22 nt, Homo sapiens
gaaguacucauacauguuacaa

SEQ ID NO: 1586004 - RNA, 15 nt, Homo sapiens
gaaguauuacaugau

SEQ ID NO: 1586005 - RNA, 22 nt, Homo sapiens
gaaguauuuuuuuaauuucuga

SEQ ID NO: 1586006 - RNA, 20 nt, Homo sapiens
gaagucaucucauuccacug

SEQ ID NO: 1586007 - RNA, 13 nt, Homo sapiens
gaagugagcugag

SEQ ID NO: 1586008 - RNA, 18 nt, Homo sapiens
gaaguggagaggguguca

SEQ ID NO: 1586009 - RNA, 14 nt, Homo sapiens
gaaguuauuuucca

SEQ ID NO: 1586010 - RNA, 17 nt, Homo sapiens
gaaguugacuuauagua

SEQ ID NO: 1586011 - RNA, 17 nt, Homo sapiens
gaaguugcugcugugaa

SEQ ID NO: 1586012 - RNA, 16 nt, Homo sapiens
gaaguuuaauugacuu

SEQ ID NO: 1586013 - RNA, 15 nt, Homo sapiens
gaaguuuacaaucaa

SEQ ID NO: 1586014 - RNA, 19 nt, Homo sapiens
gaaguuucuggugccauuu

SEQ ID NO: 1586015 - RNA, 17 nt, Homo sapiens
gaaguuugaccaucacc

SEQ ID NO: 1586016 - RNA, 16 nt, Homo sapiens
gaaguuuuaaaggccg

SEQ ID NO: 1586017 - RNA, 18 nt, Homo sapiens
gaaguuuuaugccauguu

SEQ ID NO: 1586018 - RNA, 19 nt, Homo sapiens
gaaguuuuaugccauguua

SEQ ID NO: 1586019 - RNA, 21 nt, Homo sapiens
gaauaaaaagguuggccuuag

SEQ ID NO: 1586020 - RNA, 22 nt, Homo sapiens
gaauaaaaauagaaaccugaau

SEQ ID NO: 1586021 - RNA, 23 nt, Homo sapiens
gaauaaagccacuguaugauucu

SEQ ID NO: 1586022 - RNA, 17 nt, Homo sapiens
gaauaaaggcaguuuuc

SEQ ID NO: 1586023 - RNA, 14 nt, Homo sapiens
gaauaaauucccaa

SEQ ID NO: 1586024 - RNA, 15 nt, Homo sapiens
gaauaaauucccaac

SEQ ID NO: 1586025 - RNA, 14 nt, Homo sapiens
gaauaacauuuaaa

SEQ ID NO: 1586026 - RNA, 20 nt, Homo sapiens
gaauaacauuuaaauuccac

SEQ ID NO: 1586027 - RNA, 12 nt, Homo sapiens
gaauaaggccca

SEQ ID NO: 1586028 - RNA, 22 nt, Homo sapiens
gaauacaggaggcagacaauga

SEQ ID NO: 1586029 - RNA, 23 nt, Homo sapiens
gaauacaggaggcagacaaugac

SEQ ID NO: 1586030 - RNA, 23 nt, Homo sapiens
gaauacauuguauuaauaccaaa

SEQ ID NO: 1586031 - RNA, 19 nt, Homo sapiens
gaauaccuuggucucaccu

SEQ ID NO: 1586032 - RNA, 13 nt, Homo sapiens
gaauacuggccau

SEQ ID NO: 1586033 - RNA, 22 nt, Homo sapiens
gaauacuuggaccucagccaac

SEQ ID NO: 1586034 - RNA, 22 nt, Homo sapiens
gaauaggcugaugggcaaaaaa

SEQ ID NO: 1586035 - RNA, 18 nt, Homo sapiens
gaauauaaaacagucaug

SEQ ID NO: 1586036 - RNA, 20 nt, Homo sapiens
gaauauaauuucaaaccaca

SEQ ID NO: 1586037 - RNA, 19 nt, Homo sapiens
gaauaucaucugucauuau

SEQ ID NO: 1586038 - RNA, 15 nt, Homo sapiens
gaauaucugguuucu

SEQ ID NO: 1586039 - RNA, 20 nt, Homo sapiens
gaauaugaucccuaaugugu

SEQ ID NO: 1586040 - RNA, 14 nt, Homo sapiens
gaauauuacuccua

SEQ ID NO: 1586041 - RNA, 20 nt, Homo sapiens
gaauauuuguuuuaauacca

SEQ ID NO: 1586042 - RNA, 21 nt, Homo sapiens
gaaucacuuaagccuggaagg

SEQ ID NO: 1586043 - RNA, 13 nt, Homo sapiens
gaaucacuugaac

SEQ ID NO: 1586044 - RNA, 20 nt, Homo sapiens
gaaucagauggugucauuua

SEQ ID NO: 1586045 - RNA, 19 nt, Homo sapiens
gaaucauauucauaugcag

SEQ ID NO: 1586046 - RNA, 22 nt, Homo sapiens
gaaucauuguggugguugagau

SEQ ID NO: 1586047 - RNA, 16 nt, Homo sapiens
gaaucccaauguuuga

SEQ ID NO: 1586048 - RNA, 16 nt, Homo sapiens
gaauccccaacaugca

SEQ ID NO: 1586049 - RNA, 17 nt, Homo sapiens
gaauccuauuuaucaga

SEQ ID NO: 1586050 - RNA, 17 nt, Homo sapiens
gaaucuacuaauuccac

SEQ ID NO: 1586051 - RNA, 18 nt, Homo sapiens
gaaucucgcaguguuucu

SEQ ID NO: 1586052 - RNA, 19 nt, Homo sapiens
gaaucugugggucugggag

SEQ ID NO: 1586053 - RNA, 13 nt, Homo sapiens
gaaugacauugaa

SEQ ID NO: 1586054 - RNA, 18 nt, Homo sapiens
gaaugacugacaaagaca

SEQ ID NO: 1586055 - RNA, 17 nt, Homo sapiens
gaaugcaaaccauagca

SEQ ID NO: 1586056 - RNA, 21 nt, Homo sapiens
gaaugcuucuagaaacuucca

SEQ ID NO: 1586057 - RNA, 19 nt, Homo sapiens
guuuccuaugacuaauuca

SEQ ID NO: 1586058 - RNA, 13 nt, Homo sapiens
guuuccuggucag

SEQ ID NO: 1586059 - RNA, 23 nt, Homo sapiens
guuuccuuuguuggagucaaaaa

SEQ ID NO: 1586060 - RNA, 23 nt, Homo sapiens
guuucucuagaagcuccagugau

SEQ ID NO: 1586061 - RNA, 14 nt, Homo sapiens
guuucucuauugua

SEQ ID NO: 1586062 - RNA, 18 nt, Homo sapiens
guuucuggaagacugcuc

SEQ ID NO: 1586063 - RNA, 16 nt, Homo sapiens
guuucuggaauugaua

SEQ ID NO: 1586064 - RNA, 23 nt, Homo sapiens
guuucuggauuucauacuguaac

SEQ ID NO: 1586065 - RNA, 14 nt, Homo sapiens
guuugaccaucacc

SEQ ID NO: 1586066 - RNA, 17 nt, Homo sapiens
guuugauuauucagugu

SEQ ID NO: 1586067 - RNA, 15 nt, Homo sapiens
guuugauucagcaaa

SEQ ID NO: 1586068 - RNA, 20 nt, Homo sapiens
guuugcaguuggcuaagaga

SEQ ID NO: 1586069 - RNA, 17 nt, Homo sapiens
guuuggacccaugguca

SEQ ID NO: 1586070 - RNA, 14 nt, Homo sapiens
guuuggagucacug

SEQ ID NO: 1586071 - RNA, 16 nt, Homo sapiens
guuuggagucacugua

SEQ ID NO: 1586072 - RNA, 17 nt, Homo sapiens
guuuggagucacuguag

SEQ ID NO: 1586073 - RNA, 20 nt, Homo sapiens
guuuggcuauaagugcucaa

SEQ ID NO: 1586074 - RNA, 21 nt, Homo sapiens
guuugguaguuagccaucuaa

SEQ ID NO: 1586075 - RNA, 18 nt, Homo sapiens
guuuguaauacuuuacaa

SEQ ID NO: 1586076 - RNA, 15 nt, Homo sapiens
guuuguacgauuucu

SEQ ID NO: 1586077 - RNA, 14 nt, Homo sapiens
guuuguggccucag

SEQ ID NO: 1586078 - RNA, 20 nt, Homo sapiens
guuuguggccucagaauuga

SEQ ID NO: 1586079 - RNA, 20 nt, Homo sapiens
guuuguuuucaaaauacuuc

SEQ ID NO: 1586080 - RNA, 23 nt, Homo sapiens
guuuuaaaaugugaggcaauaag

SEQ ID NO: 1586081 - RNA, 15 nt, Homo sapiens
guuuuaaacuugccu

SEQ ID NO: 1586082 - RNA, 14 nt, Homo sapiens
guuuuaaaguucau

SEQ ID NO: 1586083 - RNA, 20 nt, Homo sapiens
guuuuacauuguugagcuau

SEQ ID NO: 1586084 - RNA, 15 nt, Homo sapiens
guuuuagaaccagcc

SEQ ID NO: 1586085 - RNA, 16 nt, Homo sapiens
guuuuagaaccagccg

SEQ ID NO: 1586086 - RNA, 17 nt, Homo sapiens
guuuuaggguacaguuu

SEQ ID NO: 1586087 - RNA, 16 nt, Homo sapiens
guuuucaacacuuuuu

SEQ ID NO: 1586088 - RNA, 13 nt, Homo sapiens
guuuucuaaagua

SEQ ID NO: 1586089 - RNA, 15 nt, Homo sapiens
guuuucuagaauuua

SEQ ID NO: 1586090 - RNA, 16 nt, Homo sapiens
guuuucuccacuggaa

SEQ ID NO: 1586091 - RNA, 23 nt, Homo sapiens
guuuucuuucucacccaggcaau

SEQ ID NO: 1586092 - RNA, 15 nt, Homo sapiens
guuuugaguaauuca

SEQ ID NO: 1586093 - RNA, 12 nt, Homo sapiens
guuuugcaacaa

SEQ ID NO: 1586094 - RNA, 21 nt, Homo sapiens
guuuugcccuauauaccucac

SEQ ID NO: 1586095 - RNA, 16 nt, Homo sapiens
guuuugcuacauucua

SEQ ID NO: 1586096 - RNA, 18 nt, Homo sapiens
guuuugugugguauucaa

SEQ ID NO: 1586097 - RNA, 16 nt, Homo sapiens
guuuuuaaaacccagu

SEQ ID NO: 1586098 - RNA, 17 nt, Homo sapiens
guuuuucccucagugaa

SEQ ID NO: 1586099 - RNA, 22 nt, Homo sapiens
guuuuuccucauugagaauuca

SEQ ID NO: 1586100 - RNA, 19 nt, Homo sapiens
guuuuucuggugcuuuaua

SEQ ID NO: 1586101 - RNA, 15 nt, Homo sapiens
guuuuucuugcaugg

SEQ ID NO: 1586102 - RNA, 19 nt, Homo sapiens
guuuuucuuguuguuauuc

SEQ ID NO: 1586103 - RNA, 15 nt, Homo sapiens
guuuuugucuaugaa

SEQ ID NO: 1586104 - RNA, 16 nt, Homo sapiens
guuuuuuaaauguaua

SEQ ID NO: 1586105 - RNA, 16 nt, Homo sapiens
guuuuuuauuaugcau

SEQ ID NO: 1586106 - RNA, 16 nt, Homo sapiens
guuuuuugccauguua

SEQ ID NO: 1586107 - RNA, 23 nt, Homo sapiens
guuuuuuuagaagacaauuuuca

SEQ ID NO: 1586108 - RNA, 12 nt, Homo sapiens
uaaaaaagcauu

SEQ ID NO: 1586109 - RNA, 15 nt, Homo sapiens
uaaaaaaucaugcca

SEQ ID NO: 1586110 - RNA, 20 nt, Homo sapiens
uaaaaaauuaaacuaaagau

SEQ ID NO: 1586111 - RNA, 15 nt, Homo sapiens
uaaaaacauugccuu

SEQ ID NO: 1586112 - RNA, 20 nt, Homo sapiens
uaaaaacuaacagcuacaaa

SEQ ID NO: 1586113 - RNA, 23 nt, Homo sapiens
uaaaaacucuauaaccucagcuu

SEQ ID NO: 1586114 - RNA, 16 nt, Homo sapiens
uaaaaagaagccacag

SEQ ID NO: 1586115 - RNA, 16 nt, Homo sapiens
uaaaaagauaaucuca

SEQ ID NO: 1586116 - RNA, 19 nt, Homo sapiens
uaaaaaggccaccuagcuu

SEQ ID NO: 1586117 - RNA, 19 nt, Homo sapiens
uaaaaauacaacacugagc

SEQ ID NO: 1586118 - RNA, 16 nt, Homo sapiens
uaaaaauacauagcau

SEQ ID NO: 1586119 - RNA, 22 nt, Homo sapiens
uaaaaauauaaauuguacauuu

SEQ ID NO: 1586120 - RNA, 16 nt, Homo sapiens
uaaaaaucaaguuauu

SEQ ID NO: 1586121 - RNA, 14 nt, Homo sapiens
uaaaaaugcugcuc

SEQ ID NO: 1586122 - RNA, 18 nt, Homo sapiens
uaaaaauggauacuggug

SEQ ID NO: 1586123 - RNA, 23 nt, Homo sapiens
uaaaaauggcaggggguggaauu

SEQ ID NO: 1586124 - RNA, 19 nt, Homo sapiens
uaaaaauuaaaugugagca

SEQ ID NO: 1586125 - RNA, 16 nt, Homo sapiens
uaaaaauugacaauga

SEQ ID NO: 1586126 - RNA, 14 nt, Homo sapiens
uaaaacacaugaua

SEQ ID NO: 1586127 - RNA, 18 nt, Homo sapiens
uaaaacacaugauaccag

SEQ ID NO: 1586128 - RNA, 13 nt, Homo sapiens
uaaaacagcagca

SEQ ID NO: 1586129 - RNA, 21 nt, Homo sapiens
uaaaacaggcaaaguuuuaca

SEQ ID NO: 1586130 - RNA, 21 nt, Homo sapiens
uaaaacauuacuuauuuaacu

SEQ ID NO: 1586131 - RNA, 12 nt, Homo sapiens
uaaaacauuccc

SEQ ID NO: 1586132 - RNA, 23 nt, Homo sapiens
uaaaacauuuguuucccccacag

SEQ ID NO: 1586133 - RNA, 12 nt, Homo sapiens
uaaaacuagcaa

SEQ ID NO: 1586134 - RNA, 16 nt, Homo sapiens
uaaaacuucaguuuca

SEQ ID NO: 1586135 - RNA, 17 nt, Homo sapiens
uaaaacuuuauggacac

SEQ ID NO: 1586136 - RNA, 17 nt, Homo sapiens
uaaaagaaaaaugcugu

SEQ ID NO: 1586137 - RNA, 15 nt, Homo sapiens
uaaaagaaugacuau

SEQ ID NO: 1586138 - RNA, 15 nt, Homo sapiens
uaaaagagggacccc

SEQ ID NO: 1586139 - RNA, 17 nt, Homo sapiens
uaaaagagggaccccug

SEQ ID NO: 1586140 - RNA, 14 nt, Homo sapiens
uaaaagaucuugca

SEQ ID NO: 1586141 - RNA, 17 nt, Homo sapiens
uaaaagaucuugcagaa

SEQ ID NO: 1586142 - RNA, 19 nt, Homo sapiens
uaaaagaugaaagagcagu

SEQ ID NO: 1586143 - RNA, 19 nt, Homo sapiens
uaaaagaugguaaaccaga

SEQ ID NO: 1586144 - RNA, 20 nt, Homo sapiens
uaaaagaugguaaaccagau

SEQ ID NO: 1586145 - RNA, 18 nt, Homo sapiens
uaaaagcaauuccaaccu

SEQ ID NO: 1586146 - RNA, 16 nt, Homo sapiens
uaaaagcuuucugcca

SEQ ID NO: 1586147 - RNA, 24 nt, Homo sapiens
uaaaagguauacuuuaguagacau

SEQ ID NO: 1586148 - RNA, 23 nt, Homo sapiens
uaaaagguguuguaauggugaaa

SEQ ID NO: 1586149 - RNA, 23 nt, Homo sapiens
uaaaaguagacaaucacagggag

SEQ ID NO: 1586150 - RNA, 21 nt, Homo sapiens
uaaaagugaaacguaauugua

SEQ ID NO: 1586151 - RNA, 22 nt, Homo sapiens
uaaaaguuuuuuauuaugcauu

SEQ ID NO: 1586152 - RNA, 23 nt, Homo sapiens
uaaaaguuuuuuauuaugcauua

SEQ ID NO: 1586153 - RNA, 14 nt, Homo sapiens
uaaaauaaaugaaa

SEQ ID NO: 1586154 - RNA, 15 nt, Homo sapiens
uaaaauacacacuca

SEQ ID NO: 1586155 - RNA, 17 nt, Homo sapiens
uaaaauacacacucaaa

SEQ ID NO: 1586156 - RNA, 14 nt, Homo sapiens
uaaaauacuaugca

SEQ ID NO: 1586157 - RNA, 22 nt, Homo sapiens
uaaaauagacuuacugcaguua

SEQ ID NO: 1586158 - RNA, 14 nt, Homo sapiens
uaaaauaucuacau

SEQ ID NO: 1586159 - RNA, 15 nt, Homo sapiens
uaaaaucauuucacu

SEQ ID NO: 1586160 - RNA, 19 nt, Homo sapiens
uaaaaucauuucugcauca

SEQ ID NO: 1586161 - RNA, 12 nt, Homo sapiens
uaaaaugcaaua

SEQ ID NO: 1586162 - RNA, 23 nt, Homo sapiens
uaaaaugcccauuugugaagcuu

SEQ ID NO: 1586163 - RNA, 16 nt, Homo sapiens
uaaaaugcuucacugu

SEQ ID NO: 1586164 - RNA, 17 nt, Homo sapiens
uaaaauggaauaacaua

SEQ ID NO: 1586165 - RNA, 18 nt, Homo sapiens
uaaaauggaugccuugaa

SEQ ID NO: 1586166 - RNA, 13 nt, Homo sapiens
uaaaauguuuuca

SEQ ID NO: 1586167 - RNA, 17 nt, Homo sapiens
uaaaauuaauguaauaa

SEQ ID NO: 1586168 - RNA, 21 nt, Homo sapiens
uaaaauuacuugguuugugaa

SEQ ID NO: 1586169 - RNA, 13 nt, Homo sapiens
uaaaauuauuuca

SEQ ID NO: 1586170 - RNA, 17 nt, Homo sapiens
uaaaauucagaugcugu

SEQ ID NO: 1586171 - RNA, 19 nt, Homo sapiens
uaaaauugaauaguuuauu

SEQ ID NO: 1586172 - RNA, 17 nt, Homo sapiens
uaaaauugcaguuucau

SEQ ID NO: 1586173 - RNA, 12 nt, Homo sapiens
uaaaauuuuaca

SEQ ID NO: 1586174 - RNA, 16 nt, Homo sapiens
uaaaauuuuacauuug

SEQ ID NO: 1586175 - RNA, 19 nt, Homo sapiens
uacaguauguuuuacaugu

SEQ ID NO: 1586176 - RNA, 18 nt, Homo sapiens
uacagucuuccauuugca

SEQ ID NO: 1586177 - RNA, 12 nt, Homo sapiens
uacagugcaguu

SEQ ID NO: 1586178 - RNA, 12 nt, Homo sapiens
uacagugguuuu

SEQ ID NO: 1586179 - RNA, 20 nt, Homo sapiens
uacaguguagaguaacacau

SEQ ID NO: 1586180 - RNA, 20 nt, Homo sapiens
uacaguuuuuauugcuuguu

SEQ ID NO: 1586181 - RNA, 22 nt, Homo sapiens
uacauaauuuaaaagcacacuc

SEQ ID NO: 1586182 - RNA, 15 nt, Homo sapiens
uacauacaaauucua

SEQ ID NO: 1586183 - RNA, 21 nt, Homo sapiens
uacauacacuguauguuauag

SEQ ID NO: 1586184 - RNA, 20 nt, Homo sapiens
uacauaggcuucuauuaccu

SEQ ID NO: 1586185 - RNA, 13 nt, Homo sapiens
uacauauaugcaa

SEQ ID NO: 1586186 - RNA, 15 nt, Homo sapiens
uacauaugagaauau

SEQ ID NO: 1586187 - RNA, 20 nt, Homo sapiens
uacaucaaguccaucugaca

SEQ ID NO: 1586188 - RNA, 23 nt, Homo sapiens
uacaucugcaauaugaauucaag

SEQ ID NO: 1586189 - RNA, 14 nt, Homo sapiens
uacaucugccuuaa

SEQ ID NO: 1586190 - RNA, 13 nt, Homo sapiens
uacaugacauuua

SEQ ID NO: 1586191 - RNA, 23 nt, Homo sapiens
uacaugaugcuaaaggcugcgaa

SEQ ID NO: 1586192 - RNA, 21 nt, Homo sapiens
uacaugcauugagcucucuca

SEQ ID NO: 1586193 - RNA, 13 nt, Homo sapiens
uacaugucuagag

SEQ ID NO: 1586194 - RNA, 19 nt, Homo sapiens
uacaugugagauaguuuuc

SEQ ID NO: 1586195 - RNA, 14 nt, Homo sapiens
uacauuaaggagca

SEQ ID NO: 1586196 - RNA, 13 nt, Homo sapiens
uacauuaucucac

SEQ ID NO: 1586197 - RNA, 16 nt, Homo sapiens
uacauucaacucugau

SEQ ID NO: 1586198 - RNA, 23 nt, Homo sapiens
uacauucuugguuguuaauuuag

SEQ ID NO: 1586199 - RNA, 22 nt, Homo sapiens
uacauuugaugcaugucuuuua

SEQ ID NO: 1586200 - RNA, 19 nt, Homo sapiens
uacauuuuuuaacuuucua

SEQ ID NO: 1586201 - RNA, 24 nt, Homo sapiens
uacauuuuuugggcagcaauuuaa

SEQ ID NO: 1586202 - RNA, 19 nt, Homo sapiens
uaccaaagcaucaauacaa

SEQ ID NO: 1586203 - RNA, 18 nt, Homo sapiens
uaccaaauagcaauacaa

SEQ ID NO: 1586204 - RNA, 12 nt, Homo sapiens
uaccaacuuuac

SEQ ID NO: 1586205 - RNA, 22 nt, Homo sapiens
uaccaaguaaauccaggcuuua

SEQ ID NO: 1586206 - RNA, 18 nt, Homo sapiens
uaccacaagccugagaac

SEQ ID NO: 1586207 - RNA, 21 nt, Homo sapiens
uaccaccaagggaucugccau

SEQ ID NO: 1586208 - RNA, 22 nt, Homo sapiens
uaccaccaagggaucugccauu

SEQ ID NO: 1586209 - RNA, 15 nt, Homo sapiens
uaccaccaugcacug

SEQ ID NO: 1586210 - RNA, 21 nt, Homo sapiens
uaccaccaugcacuguaaaua

SEQ ID NO: 1586211 - RNA, 14 nt, Homo sapiens
uaccacuuguauua

SEQ ID NO: 1586212 - RNA, 17 nt, Homo sapiens
uaccagaaggagaugcu

SEQ ID NO: 1586213 - RNA, 23 nt, Homo sapiens
uaccagagccuucaagugccaaa

SEQ ID NO: 1586214 - RNA, 15 nt, Homo sapiens
uaccagaugcuuucc

SEQ ID NO: 1586215 - RNA, 13 nt, Homo sapiens
uaccagugaauuu

SEQ ID NO: 1586216 - RNA, 21 nt, Homo sapiens
uaccagugaauuuuugcaaua

SEQ ID NO: 1586217 - RNA, 11 nt, Homo sapiens
uaccauagaaa

SEQ ID NO: 1586218 - RNA, 20 nt, Homo sapiens
uacccaggcuggagugcagu

SEQ ID NO: 1586219 - RNA, 16 nt, Homo sapiens
uacccagugggacaga

SEQ ID NO: 1586220 - RNA, 17 nt, Homo sapiens
uacccccugugccuugu

SEQ ID NO: 1586221 - RNA, 14 nt, Homo sapiens
uaccccuuacaaau

SEQ ID NO: 1586222 - RNA, 14 nt, Homo sapiens
uacccuauacaucc

SEQ ID NO: 1586223 - RNA, 23 nt, Homo sapiens
uacccuugugagagcccauuccc

SEQ ID NO: 1586224 - RNA, 13 nt, Homo sapiens
uaccggauucucu

SEQ ID NO: 1586225 - RNA, 18 nt, Homo sapiens
uaccuaauguuaaaugac

SEQ ID NO: 1586226 - RNA, 19 nt, Homo sapiens
uaccuagcuggcucuguga

SEQ ID NO: 1586227 - RNA, 11 nt, Homo sapiens
uaccucuagua

SEQ ID NO: 1586228 - RNA, 12 nt, Homo sapiens
uaccucugagaa

SEQ ID NO: 1586229 - RNA, 21 nt, Homo sapiens
uaccucugagaagacacaagg

SEQ ID NO: 1586230 - RNA, 19 nt, Homo sapiens
uaccucugaucaaguauuu

SEQ ID NO: 1586231 - RNA, 14 nt, Homo sapiens
uaccucuuggcugc

SEQ ID NO: 1586232 - RNA, 21 nt, Homo sapiens
uaccugaaaacacugugcaca

SEQ ID NO: 1586233 - RNA, 14 nt, Homo sapiens
uaccugagagauuu

SEQ ID NO: 1586234 - RNA, 15 nt, Homo sapiens
uaccugaggccagga

SEQ ID NO: 1586235 - RNA, 22 nt, Homo sapiens
uaccugagugacggcaaccugc

SEQ ID NO: 1586236 - RNA, 21 nt, Homo sapiens
uaccugcccccaauccaugaa

SEQ ID NO: 1586237 - RNA, 17 nt, Homo sapiens
uaccuggcaauucacaa

SEQ ID NO: 1586238 - RNA, 20 nt, Homo sapiens
uaccuggcccugugccuugg

SEQ ID NO: 1586239 - RNA, 14 nt, Homo sapiens
uaccugggaauuua

SEQ ID NO: 1586240 - RNA, 18 nt, Homo sapiens
uaccuggggccaaaccca

SEQ ID NO: 1586241 - RNA, 17 nt, Homo sapiens
uaccuguauacagugca

SEQ ID NO: 1586242 - RNA, 14 nt, Homo sapiens
uaccuucuaccucu

SEQ ID NO: 1586243 - RNA, 15 nt, Homo sapiens
uaccuucuaccucuu

SEQ ID NO: 1586244 - RNA, 21 nt, Homo sapiens
uaccuucuaccucuuggcugc

SEQ ID NO: 1586245 - RNA, 15 nt, Homo sapiens
uaccuucuagcuuua

SEQ ID NO: 1586246 - RNA, 14 nt, Homo sapiens
uaccuucuuucacu

SEQ ID NO: 1586247 - RNA, 21 nt, Homo sapiens
uaccuugguucccccacugau

SEQ ID NO: 1586248 - RNA, 13 nt, Homo sapiens
uaccuugugcuua

SEQ ID NO: 1586249 - RNA, 18 nt, Homo sapiens
uacgcucagcucauccau

SEQ ID NO: 1586250 - RNA, 16 nt, Homo sapiens
uacguauaaauaucag

SEQ ID NO: 1586251 - RNA, 20 nt, Homo sapiens
uacguuaggaggacaaaagg

SEQ ID NO: 1586252 - RNA, 13 nt, Homo sapiens
uacuaaaguauug

SEQ ID NO: 1586253 - RNA, 19 nt, Homo sapiens
uacuaacauuuucauugau

SEQ ID NO: 1586254 - RNA, 20 nt, Homo sapiens
uacuaauaugccuagcacaa

SEQ ID NO: 1586255 - RNA, 15 nt, Homo sapiens
uacuaauuuuacuuc

SEQ ID NO: 1586256 - RNA, 19 nt, Homo sapiens
uacuacaaacuucaaagag

SEQ ID NO: 1586257 - RNA, 13 nt, Homo sapiens
uacuaccuugaaa

SEQ ID NO: 1586258 - RNA, 13 nt, Homo sapiens
uacuagcacuuug

SEQ ID NO: 1586259 - RNA, 16 nt, Homo sapiens
uacuaucauggcauau

SEQ ID NO: 1586260 - RNA, 15 nt, Homo sapiens
uacuauuacuaguac

SEQ ID NO: 1586261 - RNA, 17 nt, Homo sapiens
uacuauuacuauuacua

SEQ ID NO: 1586262 - RNA, 12 nt, Homo sapiens
uacuauugcuag

SEQ ID NO: 1586263 - RNA, 17 nt, Homo sapiens
uacuauugcuaguacua

SEQ ID NO: 1586264 - RNA, 18 nt, Homo sapiens
uacuauuuuucuuuccaa

SEQ ID NO: 1586265 - RNA, 15 nt, Homo sapiens
uacucacaccuguaa

SEQ ID NO: 1586266 - RNA, 22 nt, Homo sapiens
uacucagcaacuguuagcuggg

SEQ ID NO: 1586267 - RNA, 15 nt, Homo sapiens
uacucgauagccuga

SEQ ID NO: 1586268 - RNA, 17 nt, Homo sapiens
uacucuaaagcuucuau

SEQ ID NO: 1586269 - RNA, 14 nt, Homo sapiens
uacucuccaaccug

SEQ ID NO: 1586270 - RNA, 15 nt, Homo sapiens
uacucuuuguagcaa

SEQ ID NO: 1586271 - RNA, 21 nt, Homo sapiens
uacugaaaaaugcaaauugca

SEQ ID NO: 1586272 - RNA, 17 nt, Homo sapiens
uacugaacccugccucu

SEQ ID NO: 1586273 - RNA, 16 nt, Homo sapiens
uacugaaugucauuga

SEQ ID NO: 1586274 - RNA, 19 nt, Homo sapiens
uacugacuuggaucccaaa

SEQ ID NO: 1586275 - RNA, 19 nt, Homo sapiens
uacugagucacacaaggga

SEQ ID NO: 1586276 - RNA, 23 nt, Homo sapiens
uacugaguuugugguaaccagcc

SEQ ID NO: 1586277 - RNA, 19 nt, Homo sapiens
uacugauccucgcaugaug

SEQ ID NO: 1586278 - RNA, 13 nt, Homo sapiens
uacugaugcauug

SEQ ID NO: 1586279 - RNA, 13 nt, Homo sapiens
uacugaugugaua

SEQ ID NO: 1586280 - RNA, 13 nt, Homo sapiens
uacugcaaaucag

SEQ ID NO: 1586281 - RNA, 13 nt, Homo sapiens
uacugcauuuaca

SEQ ID NO: 1586282 - RNA, 18 nt, Homo sapiens
uacugcauuuacagugua

SEQ ID NO: 1586283 - RNA, 12 nt, Homo sapiens
uacugcauuuau

SEQ ID NO: 1586284 - RNA, 17 nt, Homo sapiens
uacugccaucuuuauca

SEQ ID NO: 1586285 - RNA, 14 nt, Homo sapiens
uacugccuuuagaa

SEQ ID NO: 1586286 - RNA, 11 nt, Homo sapiens
uacugcuaccc

SEQ ID NO: 1586287 - RNA, 11 nt, Homo sapiens
uacugcugcug

SEQ ID NO: 1586288 - RNA, 17 nt, Homo sapiens
uacugcuugaccaaaga

SEQ ID NO: 1586289 - RNA, 16 nt, Homo sapiens
uacugcuugcuuucca

SEQ ID NO: 1586290 - RNA, 16 nt, Homo sapiens
uacuggcuguggacca

SEQ ID NO: 1586291 - RNA, 20 nt, Homo sapiens
uacugggaaggcaauuucau

SEQ ID NO: 1586292 - RNA, 21 nt, Homo sapiens
uacugggacugugcucagaga

SEQ ID NO: 1586293 - RNA, 22 nt, Homo sapiens
uacuguaaauauuuuucacaua

SEQ ID NO: 1586294 - RNA, 15 nt, Homo sapiens
ucacgcaggagccau

SEQ ID NO: 1586295 - RNA, 16 nt, Homo sapiens
ucacguaaagcuagaa

SEQ ID NO: 1586296 - RNA, 21 nt, Homo sapiens
ucacguuuggugcuucucaga

SEQ ID NO: 1586297 - RNA, 17 nt, Homo sapiens
ucacuacccuauucucu

SEQ ID NO: 1586298 - RNA, 18 nt, Homo sapiens
ucacuacucucuacucug

SEQ ID NO: 1586299 - RNA, 15 nt, Homo sapiens
ucacuacugcauuua

SEQ ID NO: 1586300 - RNA, 15 nt, Homo sapiens
ucacuaugguaugcu

SEQ ID NO: 1586301 - RNA, 15 nt, Homo sapiens
ucacuauuacuugaa

SEQ ID NO: 1586302 - RNA, 14 nt, Homo sapiens
ucacucaaccuuau

SEQ ID NO: 1586303 - RNA, 20 nt, Homo sapiens
ucacucaauuucucugagga

SEQ ID NO: 1586304 - RNA, 14 nt, Homo sapiens
ucacucauccaucc

SEQ ID NO: 1586305 - RNA, 16 nt, Homo sapiens
ucacucucaaacuuca

SEQ ID NO: 1586306 - RNA, 16 nt, Homo sapiens
ucacucugacaguauu

SEQ ID NO: 1586307 - RNA, 17 nt, Homo sapiens
ucacucugacaguauua

SEQ ID NO: 1586308 - RNA, 12 nt, Homo sapiens
ucacucugucag

SEQ ID NO: 1586309 - RNA, 18 nt, Homo sapiens
ucacugcaacuucugccu

SEQ ID NO: 1586310 - RNA, 23 nt, Homo sapiens
ucacugcugagacccacaggucu

SEQ ID NO: 1586311 - RNA, 20 nt, Homo sapiens
ucacugcugcaaauacugua

SEQ ID NO: 1586312 - RNA, 13 nt, Homo sapiens
ucacuggccucuc

SEQ ID NO: 1586313 - RNA, 13 nt, Homo sapiens
ucacugggccaau

SEQ ID NO: 1586314 - RNA, 22 nt, Homo sapiens
ucacugucuauuuaagugcaau

SEQ ID NO: 1586315 - RNA, 13 nt, Homo sapiens
ucacuuccuacaa

SEQ ID NO: 1586316 - RNA, 17 nt, Homo sapiens
ucacuucuaaaccaaaa

SEQ ID NO: 1586317 - RNA, 23 nt, Homo sapiens
ucacuugccaaaauccaaggcaa

SEQ ID NO: 1586318 - RNA, 15 nt, Homo sapiens
ucacuugcucuuuga

SEQ ID NO: 1586319 - RNA, 23 nt, Homo sapiens
ucacuuguguguguaccuguggc

SEQ ID NO: 1586320 - RNA, 19 nt, Homo sapiens
ucacuuucucaguuuucau

SEQ ID NO: 1586321 - RNA, 23 nt, Homo sapiens
ucagaaaagaugugcagauauca

SEQ ID NO: 1586322 - RNA, 23 nt, Homo sapiens
ucagaaagauuugaugggccaca

SEQ ID NO: 1586323 - RNA, 12 nt, Homo sapiens
ucagaaagccaa

SEQ ID NO: 1586324 - RNA, 18 nt, Homo sapiens
ucagaaauagcuccucaa

SEQ ID NO: 1586325 - RNA, 18 nt, Homo sapiens
ucagaaauguaguuugca

SEQ ID NO: 1586326 - RNA, 13 nt, Homo sapiens
ucagaacugcccu

SEQ ID NO: 1586327 - RNA, 18 nt, Homo sapiens
ucagaagucaucuugcua

SEQ ID NO: 1586328 - RNA, 20 nt, Homo sapiens
ucagaaguuaguuuguauau

SEQ ID NO: 1586329 - RNA, 20 nt, Homo sapiens
ucagaauaaauuauugcugu

SEQ ID NO: 1586330 - RNA, 19 nt, Homo sapiens
ucagaauauucauauugga

SEQ ID NO: 1586331 - RNA, 16 nt, Homo sapiens
ucagaauucggugugc

SEQ ID NO: 1586332 - RNA, 18 nt, Homo sapiens
ucagaauucggugugcug

SEQ ID NO: 1586333 - RNA, 21 nt, Homo sapiens
ucagacaguggaugagacaca

SEQ ID NO: 1586334 - RNA, 16 nt, Homo sapiens
ucagacccacaacgaa

SEQ ID NO: 1586335 - RNA, 20 nt, Homo sapiens
ucagacccagggguccaggc

SEQ ID NO: 1586336 - RNA, 16 nt, Homo sapiens
ucagagaacuuuccca

SEQ ID NO: 1586337 - RNA, 15 nt, Homo sapiens
ucagagcacucccua

SEQ ID NO: 1586338 - RNA, 24 nt, Homo sapiens
ucagagcacuuuaaaaacaggcca

SEQ ID NO: 1586339 - RNA, 17 nt, Homo sapiens
ucagagccuuuccucaa

SEQ ID NO: 1586340 - RNA, 23 nt, Homo sapiens
ucagagugacuacacacaguacg

SEQ ID NO: 1586341 - RNA, 22 nt, Homo sapiens
ucagaguugcugcaaaccugac

SEQ ID NO: 1586342 - RNA, 18 nt, Homo sapiens
ucagauaccgacuggggc

SEQ ID NO: 1586343 - RNA, 14 nt, Homo sapiens
ucagaugauucuau

SEQ ID NO: 1586344 - RNA, 20 nt, Homo sapiens
ucagaugauucuaugucuca

SEQ ID NO: 1586345 - RNA, 23 nt, Homo sapiens
ucagaugauucuaugucucauga

SEQ ID NO: 1586346 - RNA, 20 nt, Homo sapiens
ucagauuccuuucccuuuag

SEQ ID NO: 1586347 - RNA, 19 nt, Homo sapiens
ucagauugaauguauuuaa

SEQ ID NO: 1586348 - RNA, 22 nt, Homo sapiens
ucagauugauagggaguuuuaa

SEQ ID NO: 1586349 - RNA, 23 nt, Homo sapiens
ucagauuguggaauguuggauaa

SEQ ID NO: 1586350 - RNA, 16 nt, Homo sapiens
ucagauuuaaccuguu

SEQ ID NO: 1586351 - RNA, 20 nt, Homo sapiens
ucagauuuuaccuaauacag

SEQ ID NO: 1586352 - RNA, 21 nt, Homo sapiens
ucagcaaaaaucucccaguga

SEQ ID NO: 1586353 - RNA, 19 nt, Homo sapiens
ucagcacauucgggaccaa

SEQ ID NO: 1586354 - RNA, 16 nt, Homo sapiens
ucagcaccuacagugu

SEQ ID NO: 1586355 - RNA, 15 nt, Homo sapiens
ucagcacucuguaaa

SEQ ID NO: 1586356 - RNA, 20 nt, Homo sapiens
ucagcaguucagcuccuucc

SEQ ID NO: 1586357 - RNA, 21 nt, Homo sapiens
ucagcaugauguguuguguau

SEQ ID NO: 1586358 - RNA, 10 nt, Homo sapiens
ucagccacua

SEQ ID NO: 1586359 - RNA, 12 nt, Homo sapiens
ucagcccagaag

SEQ ID NO: 1586360 - RNA, 21 nt, Homo sapiens
ucagcccccaccacaaacaca

SEQ ID NO: 1586361 - RNA, 15 nt, Homo sapiens
ucagcccccaucacc

SEQ ID NO: 1586362 - RNA, 13 nt, Homo sapiens
ucagcccugcucc

SEQ ID NO: 1586363 - RNA, 17 nt, Homo sapiens
ucagcucucugggaccu

SEQ ID NO: 1586364 - RNA, 19 nt, Homo sapiens
ucagcugcaagguacucug

SEQ ID NO: 1586365 - RNA, 15 nt, Homo sapiens
ucagcugccuccugc

SEQ ID NO: 1586366 - RNA, 19 nt, Homo sapiens
ucagcuuuuguucuagacu

SEQ ID NO: 1586367 - RNA, 14 nt, Homo sapiens
ucaggaaaacugac

SEQ ID NO: 1586368 - RNA, 23 nt, Homo sapiens
ucaggaaagagagcaccacguga

SEQ ID NO: 1586369 - RNA, 20 nt, Homo sapiens
ucaggaaccucgaguacugu

SEQ ID NO: 1586370 - RNA, 22 nt, Homo sapiens
ucaggaaccucgaguacugugg

SEQ ID NO: 1586371 - RNA, 16 nt, Homo sapiens
ucaggaaguccagcca

SEQ ID NO: 1586372 - RNA, 18 nt, Homo sapiens
ucaggacagaacaguguu

SEQ ID NO: 1586373 - RNA, 18 nt, Homo sapiens
ucaggacagaaccacuga

SEQ ID NO: 1586374 - RNA, 14 nt, Homo sapiens
ucaggcacacagcu

SEQ ID NO: 1586375 - RNA, 17 nt, Homo sapiens
ucaggcacacagcuacu

SEQ ID NO: 1586376 - RNA, 15 nt, Homo sapiens
ucaggccaucaagga

SEQ ID NO: 1586377 - RNA, 16 nt, Homo sapiens
ucaggccccgccccau

SEQ ID NO: 1586378 - RNA, 15 nt, Homo sapiens
ucaggccugaacuca

SEQ ID NO: 1586379 - RNA, 16 nt, Homo sapiens
aacuucuuccugugaa

SEQ ID NO: 1586380 - RNA, 20 nt, Homo sapiens
aacuugaaaagaaaaccaca

SEQ ID NO: 1586381 - RNA, 15 nt, Homo sapiens
aacuugaaacagauu

SEQ ID NO: 1586382 - RNA, 16 nt, Homo sapiens
aacuugcaauuugcaa

SEQ ID NO: 1586383 - RNA, 19 nt, Homo sapiens
aacuuggucugcagaccau

SEQ ID NO: 1586384 - RNA, 17 nt, Homo sapiens
aacuuuaccaugcucaa

SEQ ID NO: 1586385 - RNA, 18 nt, Homo sapiens
aacuuugcccuccaaagu

SEQ ID NO: 1586386 - RNA, 16 nt, Homo sapiens
aacuuuggguacuuau

SEQ ID NO: 1586387 - RNA, 18 nt, Homo sapiens
aacuuuggguacuuauac

SEQ ID NO: 1586388 - RNA, 18 nt, Homo sapiens
aacuuuucuaacagaaag

SEQ ID NO: 1586389 - RNA, 20 nt, Homo sapiens
aacuuuugguaucuacuucu

SEQ ID NO: 1586390 - RNA, 15 nt, Homo sapiens
aagaaaaaaagcaca

SEQ ID NO: 1586391 - RNA, 21 nt, Homo sapiens
aagaaaaaaugacaccaucuu

SEQ ID NO: 1586392 - RNA, 18 nt, Homo sapiens
aagaaaaacaucuuuggc

SEQ ID NO: 1586393 - RNA, 23 nt, Homo sapiens
aagaaaaagaccuaugagcacau

SEQ ID NO: 1586394 - RNA, 16 nt, Homo sapiens
aagaaaaaucucauua

SEQ ID NO: 1586395 - RNA, 13 nt, Homo sapiens
aagaaaaccacaa

SEQ ID NO: 1586396 - RNA, 23 nt, Homo sapiens
aagaaaaccuuucuucaccaaau

SEQ ID NO: 1586397 - RNA, 13 nt, Homo sapiens
aagaaaaguuuac

SEQ ID NO: 1586398 - RNA, 21 nt, Homo sapiens
aagaaaauuccuauaaggaag

SEQ ID NO: 1586399 - RNA, 14 nt, Homo sapiens
aagaaacauuucag

SEQ ID NO: 1586400 - RNA, 14 nt, Homo sapiens
aagaaacuccgaag

SEQ ID NO: 1586401 - RNA, 14 nt, Homo sapiens
aagaaauaaugccu

SEQ ID NO: 1586402 - RNA, 17 nt, Homo sapiens
aagaaauaaugccucca

SEQ ID NO: 1586403 - RNA, 21 nt, Homo sapiens
aagaaauccugugugucgcuu

SEQ ID NO: 1586404 - RNA, 12 nt, Homo sapiens
aagaaauuggaa

SEQ ID NO: 1586405 - RNA, 21 nt, Homo sapiens
aagaacaugauuuuacaagua

SEQ ID NO: 1586406 - RNA, 20 nt, Homo sapiens
aagaacauuauucaucucuc

SEQ ID NO: 1586407 - RNA, 21 nt, Homo sapiens
aagaacauuauucaucucucc

SEQ ID NO: 1586408 - RNA, 22 nt, Homo sapiens
aagaacauuauucaucucuccu

SEQ ID NO: 1586409 - RNA, 16 nt, Homo sapiens
aagaacgcgacuucca

SEQ ID NO: 1586410 - RNA, 14 nt, Homo sapiens
aagaacucauuuga

SEQ ID NO: 1586411 - RNA, 20 nt, Homo sapiens
aagaacugaggaaccugaga

SEQ ID NO: 1586412 - RNA, 20 nt, Homo sapiens
aagaacuugcaauaccaaug

SEQ ID NO: 1586413 - RNA, 12 nt, Homo sapiens
aagaagccacag

SEQ ID NO: 1586414 - RNA, 17 nt, Homo sapiens
aagaagcccauaucaca

SEQ ID NO: 1586415 - RNA, 18 nt, Homo sapiens
aagaagcccauaucacau

SEQ ID NO: 1586416 - RNA, 23 nt, Homo sapiens
aagaagcugguggagcagagugu

SEQ ID NO: 1586417 - RNA, 18 nt, Homo sapiens
aagaagcuucaugccagg

SEQ ID NO: 1586418 - RNA, 15 nt, Homo sapiens
aagaagcuuuauuuc

SEQ ID NO: 1586419 - RNA, 17 nt, Homo sapiens
aagaauaaauucuaccu

SEQ ID NO: 1586420 - RNA, 21 nt, Homo sapiens
aagaauagccuagauaugaau

SEQ ID NO: 1586421 - RNA, 18 nt, Homo sapiens
aagaaucuagaagaugug

SEQ ID NO: 1586422 - RNA, 21 nt, Homo sapiens
aagaauguacaguugagcuca

SEQ ID NO: 1586423 - RNA, 21 nt, Homo sapiens
aagaauguagucagacugaca

SEQ ID NO: 1586424 - RNA, 13 nt, Homo sapiens
aagaauguauucg

SEQ ID NO: 1586425 - RNA, 23 nt, Homo sapiens
aagacaaauuagccauuucacuc

SEQ ID NO: 1586426 - RNA, 22 nt, Homo sapiens
aagacaagaaaaucagguauua

SEQ ID NO: 1586427 - RNA, 22 nt, Homo sapiens
aagacagcacaggcaacuucuc

SEQ ID NO: 1586428 - RNA, 15 nt, Homo sapiens
aagacaugacauucu

SEQ ID NO: 1586429 - RNA, 22 nt, Homo sapiens
aagaccaggccaaugucagggu

SEQ ID NO: 1586430 - RNA, 13 nt, Homo sapiens
aagacuaggauau

SEQ ID NO: 1586431 - RNA, 16 nt, Homo sapiens
aagacucugccauuaa

SEQ ID NO: 1586432 - RNA, 17 nt, Homo sapiens
aagacugaaucuaccug

SEQ ID NO: 1586433 - RNA, 20 nt, Homo sapiens
aagacugcugguugacauca

SEQ ID NO: 1586434 - RNA, 21 nt, Homo sapiens
aagacuggaagcuaauuugca

SEQ ID NO: 1586435 - RNA, 20 nt, Homo sapiens
aagacuggaauauaauuuca

SEQ ID NO: 1586436 - RNA, 13 nt, Homo sapiens
aagacugugcugu

SEQ ID NO: 1586437 - RNA, 13 nt, Homo sapiens
aagagacugagcc

SEQ ID NO: 1586438 - RNA, 16 nt, Homo sapiens
aagagauaacuguaaa

SEQ ID NO: 1586439 - RNA, 14 nt, Homo sapiens
aagagaucuacaca

SEQ ID NO: 1586440 - RNA, 19 nt, Homo sapiens
aagagaucuuucuuuccaa

SEQ ID NO: 1586441 - RNA, 23 nt, Homo sapiens
aagagaucuuucuuuccaaaaca

SEQ ID NO: 1586442 - RNA, 13 nt, Homo sapiens
aagagcaaaacuc

SEQ ID NO: 1586443 - RNA, 19 nt, Homo sapiens
aagagcaaaacuccgucuc

SEQ ID NO: 1586444 - RNA, 20 nt, Homo sapiens
aagagcaaaacuccgucuca

SEQ ID NO: 1586445 - RNA, 22 nt, Homo sapiens
aagagcaaucagaauugugcuu

SEQ ID NO: 1586446 - RNA, 17 nt, Homo sapiens
aagagcauagaacucaa

SEQ ID NO: 1586447 - RNA, 18 nt, Homo sapiens
aagagcauggaugcauuu

SEQ ID NO: 1586448 - RNA, 12 nt, Homo sapiens
aagagccaguuu

SEQ ID NO: 1586449 - RNA, 14 nt, Homo sapiens
aagagcgaguacag

SEQ ID NO: 1586450 - RNA, 15 nt, Homo sapiens
aagagcuacucccac

SEQ ID NO: 1586451 - RNA, 12 nt, Homo sapiens
aagagcuuugua

SEQ ID NO: 1586452 - RNA, 23 nt, Homo sapiens
aagagcuuugugauauacugguu

SEQ ID NO: 1586453 - RNA, 14 nt, Homo sapiens
aagaggaaagggag

SEQ ID NO: 1586454 - RNA, 21 nt, Homo sapiens
aagaggaauauucugguuuau

SEQ ID NO: 1586455 - RNA, 21 nt, Homo sapiens
aagaggauuguaaaaugcacc

SEQ ID NO: 1586456 - RNA, 16 nt, Homo sapiens
aagagggcccagccca

SEQ ID NO: 1586457 - RNA, 21 nt, Homo sapiens
aagagggcuuccucuagaagc

SEQ ID NO: 1586458 - RNA, 13 nt, Homo sapiens
aagaggugggagc

SEQ ID NO: 1586459 - RNA, 22 nt, Homo sapiens
aagaguacagaagcuuuagcaa

SEQ ID NO: 1586460 - RNA, 13 nt, Homo sapiens
aagaguaguuaua

SEQ ID NO: 1586461 - RNA, 15 nt, Homo sapiens
aagagucugucucaa

SEQ ID NO: 1586462 - RNA, 13 nt, Homo sapiens
aagagucuuccaa

SEQ ID NO: 1586463 - RNA, 15 nt, Homo sapiens
aagagugauguuuca

SEQ ID NO: 1586464 - RNA, 11 nt, Homo sapiens
aagaguuuaaa

SEQ ID NO: 1586465 - RNA, 13 nt, Homo sapiens
aagauaaacacaa

SEQ ID NO: 1586466 - RNA, 19 nt, Homo sapiens
aagauaaagacuguggaaa

SEQ ID NO: 1586467 - RNA, 22 nt, Homo sapiens
aagauaauauugucugucucua

SEQ ID NO: 1586468 - RNA, 20 nt, Homo sapiens
aagauaauccuagagucuua

SEQ ID NO: 1586469 - RNA, 12 nt, Homo sapiens
aagauacaugau

SEQ ID NO: 1586470 - RNA, 15 nt, Homo sapiens
aagauauauguguau

SEQ ID NO: 1586471 - RNA, 18 nt, Homo sapiens
aagauauauguguauaca

SEQ ID NO: 1586472 - RNA, 18 nt, Homo sapiens
aagaucauuuaauaucuu

SEQ ID NO: 1586473 - RNA, 18 nt, Homo sapiens
aagaucucgguuugccaa

SEQ ID NO: 1586474 - RNA, 15 nt, Homo sapiens
aagaucuguuuugaa

SEQ ID NO: 1586475 - RNA, 20 nt, Homo sapiens
aagaugaaacaucauuucaa

SEQ ID NO: 1586476 - RNA, 17 nt, Homo sapiens
aagaugaugaugaucuu

SEQ ID NO: 1586477 - RNA, 14 nt, Homo sapiens
aagaugauugacuc

SEQ ID NO: 1586478 - RNA, 19 nt, Homo sapiens
aagaugccuuaauccauuc

SEQ ID NO: 1586479 - RNA, 17 nt, Homo sapiens
aagaugcgcauucuaac

SEQ ID NO: 1586480 - RNA, 20 nt, Homo sapiens
aagauggauguaaugcacuu

SEQ ID NO: 1586481 - RNA, 22 nt, Homo sapiens
aagauggcuuccgugagacaca

SEQ ID NO: 1586482 - RNA, 23 nt, Homo sapiens
aagauguagaggagaaacuggaa

SEQ ID NO: 1586483 - RNA, 17 nt, Homo sapiens
aagaugucuauguagcu

SEQ ID NO: 1586484 - RNA, 21 nt, Homo sapiens
aagaugucuuaaccucaggga

SEQ ID NO: 1586485 - RNA, 22 nt, Homo sapiens
aagaugugggcagugaugucac

SEQ ID NO: 1586486 - RNA, 14 nt, Homo sapiens
aagauuaaaugugu

SEQ ID NO: 1586487 - RNA, 20 nt, Homo sapiens
aagauuaugugacuugcaau

SEQ ID NO: 1586488 - RNA, 21 nt, Homo sapiens
aagauuaugugacuugcaaua

SEQ ID NO: 1586489 - RNA, 15 nt, Homo sapiens
aagauuccaaaaagc

SEQ ID NO: 1586490 - RNA, 16 nt, Homo sapiens
aagauucuauguuaau

SEQ ID NO: 1586491 - RNA, 22 nt, Homo sapiens
aagauucucuauuggcucccuu

SEQ ID NO: 1586492 - RNA, 13 nt, Homo sapiens
aagauucuugacu

SEQ ID NO: 1586493 - RNA, 17 nt, Homo sapiens
aagauugcacuguucug

SEQ ID NO: 1586494 - RNA, 20 nt, Homo sapiens
aagauuuaguugaguuauuc

SEQ ID NO: 1586495 - RNA, 19 nt, Homo sapiens
aagauuuaugaugcacuua

SEQ ID NO: 1586496 - RNA, 22 nt, Homo sapiens
aagauuugaugggccacaacug

SEQ ID NO: 1586497 - RNA, 21 nt, Homo sapiens
aauaaucaucccuccuugccu

SEQ ID NO: 1586498 - RNA, 23 nt, Homo sapiens
aauaaucaucccuccuugccuag

SEQ ID NO: 1586499 - RNA, 20 nt, Homo sapiens
aauaaugaaugaaccaucuu

SEQ ID NO: 1586500 - RNA, 13 nt, Homo sapiens
aauaaugccaaug

SEQ ID NO: 1586501 - RNA, 19 nt, Homo sapiens
aauaauggaaaaugccaug

SEQ ID NO: 1586502 - RNA, 16 nt, Homo sapiens
aauaaugucucuguga

SEQ ID NO: 1586503 - RNA, 20 nt, Homo sapiens
aauaauuggagaagauuuau

SEQ ID NO: 1586504 - RNA, 12 nt, Homo sapiens
aauacaaaaacu

SEQ ID NO: 1586505 - RNA, 12 nt, Homo sapiens
aauacaaaaauu

SEQ ID NO: 1586506 - RNA, 12 nt, Homo sapiens
aauacaaacuau

SEQ ID NO: 1586507 - RNA, 16 nt, Homo sapiens
aauacaauguacaauu

SEQ ID NO: 1586508 - RNA, 23 nt, Homo sapiens
aauacagacaaagcauaaucaau

SEQ ID NO: 1586509 - RNA, 13 nt, Homo sapiens
aauacaguucugc

SEQ ID NO: 1586510 - RNA, 18 nt, Homo sapiens
aauacaugcacagucaua

SEQ ID NO: 1586511 - RNA, 20 nt, Homo sapiens
aauacauuucaauuauacua

SEQ ID NO: 1586512 - RNA, 13 nt, Homo sapiens
aauaccaaaaauu

SEQ ID NO: 1586513 - RNA, 15 nt, Homo sapiens
aauaccuuuucucac

SEQ ID NO: 1586514 - RNA, 19 nt, Homo sapiens
aauaccuuuucucacaaaa

SEQ ID NO: 1586515 - RNA, 20 nt, Homo sapiens
aauacuacugacguccuccc

SEQ ID NO: 1586516 - RNA, 18 nt, Homo sapiens
aauacucugcagugauua

SEQ ID NO: 1586517 - RNA, 20 nt, Homo sapiens
aauacugauguuccuaguga

SEQ ID NO: 1586518 - RNA, 22 nt, Homo sapiens
aauacugauguuccuagugaaa

SEQ ID NO: 1586519 - RNA, 17 nt, Homo sapiens
aauacuuaacacgugaa

SEQ ID NO: 1586520 - RNA, 24 nt, Homo sapiens
aauacuuuugggauguuaccuuca

SEQ ID NO: 1586521 - RNA, 14 nt, Homo sapiens
aauagaagggcaaa

SEQ ID NO: 1586522 - RNA, 16 nt, Homo sapiens
aauagauaccacugaa

SEQ ID NO: 1586523 - RNA, 12 nt, Homo sapiens
aauagauaugaa

SEQ ID NO: 1586524 - RNA, 16 nt, Homo sapiens
aauagauuacugaugu

SEQ ID NO: 1586525 - RNA, 12 nt, Homo sapiens
aauagauuucag

SEQ ID NO: 1586526 - RNA, 21 nt, Homo sapiens
aauagcacuuucauugccagu

SEQ ID NO: 1586527 - RNA, 18 nt, Homo sapiens
aauagcaguuauaacaga

SEQ ID NO: 1586528 - RNA, 17 nt, Homo sapiens
aauagccuagauaugaa

SEQ ID NO: 1586529 - RNA, 15 nt, Homo sapiens
aauagcgccucuuuu

SEQ ID NO: 1586530 - RNA, 17 nt, Homo sapiens
aauagcuaaauaccuca

SEQ ID NO: 1586531 - RNA, 17 nt, Homo sapiens
aauagcuauacauuaau

SEQ ID NO: 1586532 - RNA, 16 nt, Homo sapiens
aauaggaacagcugaa

SEQ ID NO: 1586533 - RNA, 21 nt, Homo sapiens
aauaggaaucuucacuagaag

SEQ ID NO: 1586534 - RNA, 12 nt, Homo sapiens
aauaggaccaga

SEQ ID NO: 1586535 - RNA, 19 nt, Homo sapiens
aauaggcuauuaaaaaagu

SEQ ID NO: 1586536 - RNA, 18 nt, Homo sapiens
aauaggcugaugggcaaa

SEQ ID NO: 1586537 - RNA, 13 nt, Homo sapiens
aauagguguguga

SEQ ID NO: 1586538 - RNA, 17 nt, Homo sapiens
aauaguaccuucaauac

SEQ ID NO: 1586539 - RNA, 14 nt, Homo sapiens
aauaguaggucucc

SEQ ID NO: 1586540 - RNA, 17 nt, Homo sapiens
aauaguauuaacuauua

SEQ ID NO: 1586541 - RNA, 13 nt, Homo sapiens
aauagucaauuuc

SEQ ID NO: 1586542 - RNA, 15 nt, Homo sapiens
aauagucuuugccag

SEQ ID NO: 1586543 - RNA, 19 nt, Homo sapiens
aauaguggcauaccaaaug

SEQ ID NO: 1586544 - RNA, 23 nt, Homo sapiens
aauaguuaaaaauuaaauauuua

SEQ ID NO: 1586545 - RNA, 15 nt, Homo sapiens
aauauaaaugaugau

SEQ ID NO: 1586546 - RNA, 14 nt, Homo sapiens
aauauaaauuguac

SEQ ID NO: 1586547 - RNA, 21 nt, Homo sapiens
aauauaaugaugcugucugaa

SEQ ID NO: 1586548 - RNA, 15 nt, Homo sapiens
aauauacuugaauga

SEQ ID NO: 1586549 - RNA, 16 nt, Homo sapiens
aauauagacagugccc

SEQ ID NO: 1586550 - RNA, 23 nt, Homo sapiens
aauauagaugcuggccagcauuu

SEQ ID NO: 1586551 - RNA, 14 nt, Homo sapiens
aauauagguaaaua

SEQ ID NO: 1586552 - RNA, 19 nt, Homo sapiens
aauauauauaaagaauaua

SEQ ID NO: 1586553 - RNA, 16 nt, Homo sapiens
aauauaucuaccccag

SEQ ID NO: 1586554 - RNA, 15 nt, Homo sapiens
aauauauuuuaucuu

SEQ ID NO: 1586555 - RNA, 14 nt, Homo sapiens
aauaucaaaugcag

SEQ ID NO: 1586556 - RNA, 17 nt, Homo sapiens
aauaucaagcagugaaa

SEQ ID NO: 1586557 - RNA, 15 nt, Homo sapiens
aauaucaauggugcu

SEQ ID NO: 1586558 - RNA, 12 nt, Homo sapiens
aauaucauguua

SEQ ID NO: 1586559 - RNA, 12 nt, Homo sapiens
aauauccauuua

SEQ ID NO: 1586560 - RNA, 20 nt, Homo sapiens
aauaucugugaaauaucauc

SEQ ID NO: 1586561 - RNA, 12 nt, Homo sapiens
aauaucuuucag

SEQ ID NO: 1586562 - RNA, 16 nt, Homo sapiens
aauaugaguaauacau

SEQ ID NO: 1586563 - RNA, 11 nt, Homo sapiens
aauaugauuau

SEQ ID NO: 1586564 - RNA, 11 nt, Homo sapiens
aauaugggagg

SEQ ID NO: 1586565 - RNA, 16 nt, Homo sapiens
aauaugggaggaacaa

SEQ ID NO: 1586566 - RNA, 11 nt, Homo sapiens
aauauuaacau

SEQ ID NO: 1586567 - RNA, 15 nt, Homo sapiens
aauauuagcaaagaa

SEQ ID NO: 1586568 - RNA, 17 nt, Homo sapiens
aauauucacugggccaa

SEQ ID NO: 1586569 - RNA, 13 nt, Homo sapiens
aauauucaguggu

SEQ ID NO: 1586570 - RNA, 13 nt, Homo sapiens
aauauuccuuuau

SEQ ID NO: 1586571 - RNA, 15 nt, Homo sapiens
aauauugaaaugcug

SEQ ID NO: 1586572 - RNA, 20 nt, Homo sapiens
aauauugaaguuguuuauca

SEQ ID NO: 1586573 - RNA, 15 nt, Homo sapiens
aauauugguauguaa

SEQ ID NO: 1586574 - RNA, 14 nt, Homo sapiens
aauauugugcaaac

SEQ ID NO: 1586575 - RNA, 14 nt, Homo sapiens
aauauuuaagugaa

SEQ ID NO: 1586576 - RNA, 20 nt, Homo sapiens
aauauuuaauggaaguguau

SEQ ID NO: 1586577 - RNA, 22 nt, Homo sapiens
aauauuugcuuuauacugagcu

SEQ ID NO: 1586578 - RNA, 18 nt, Homo sapiens
aauauuuucuaaaugucu

SEQ ID NO: 1586579 - RNA, 16 nt, Homo sapiens
aauauuuuguaauauu

SEQ ID NO: 1586580 - RNA, 17 nt, Homo sapiens
aauauuuuguauauuau

SEQ ID NO: 1586581 - RNA, 16 nt, Homo sapiens
aauauuuuucauacaa

SEQ ID NO: 1586582 - RNA, 18 nt, Homo sapiens
aauauuuuucaugcuauc

SEQ ID NO: 1586583 - RNA, 18 nt, Homo sapiens
aauauuuuuccacuuaaa

SEQ ID NO: 1586584 - RNA, 14 nt, Homo sapiens
aaucaaaagcuauu

SEQ ID NO: 1586585 - RNA, 18 nt, Homo sapiens
aaucaaaauaaaaauuaa

SEQ ID NO: 1586586 - RNA, 13 nt, Homo sapiens
aaucaaacugcuu

SEQ ID NO: 1586587 - RNA, 15 nt, Homo sapiens
aaucaaaugauuuca

SEQ ID NO: 1586588 - RNA, 21 nt, Homo sapiens
aaucaacaaaauggucaucca

SEQ ID NO: 1586589 - RNA, 22 nt, Homo sapiens
aaucaacaaaauggucauccaa

SEQ ID NO: 1586590 - RNA, 20 nt, Homo sapiens
aaucaagaaaaacaucuuug

SEQ ID NO: 1586591 - RNA, 12 nt, Homo sapiens
aaucaagggcaa

SEQ ID NO: 1586592 - RNA, 16 nt, Homo sapiens
aaucaauaaagaccac

SEQ ID NO: 1586593 - RNA, 23 nt, Homo sapiens
aaucaaucuggcuucugcauuac

SEQ ID NO: 1586594 - RNA, 17 nt, Homo sapiens
aaucaaugguagcauuu

SEQ ID NO: 1586595 - RNA, 17 nt, Homo sapiens
aaucacaaacugaauga

SEQ ID NO: 1586596 - RNA, 17 nt, Homo sapiens
aaucacaguuguguucc

SEQ ID NO: 1586597 - RNA, 18 nt, Homo sapiens
aaucaccauguaagcacu

SEQ ID NO: 1586598 - RNA, 23 nt, Homo sapiens
aaucacccaccauagggcaugau

SEQ ID NO: 1586599 - RNA, 14 nt, Homo sapiens
aaucaccucucugu

SEQ ID NO: 1586600 - RNA, 21 nt, Homo sapiens
aaucacuuaacauuccuaaaa

SEQ ID NO: 1586601 - RNA, 22 nt, Homo sapiens
aaucaggacagguggugcaaau

SEQ ID NO: 1586602 - RNA, 18 nt, Homo sapiens
aaucagucauuucuucau

SEQ ID NO: 1586603 - RNA, 22 nt, Homo sapiens
aaucaucuauuuugaugcagca

SEQ ID NO: 1586604 - RNA, 18 nt, Homo sapiens
aaucaugagcaagugaac

SEQ ID NO: 1586605 - RNA, 21 nt, Homo sapiens
aaucauuaauucacaugucca

SEQ ID NO: 1586606 - RNA, 14 nt, Homo sapiens
aaucauuuccuugg

SEQ ID NO: 1586607 - RNA, 20 nt, Homo sapiens
aauccacaacuuguaccaag

SEQ ID NO: 1586608 - RNA, 16 nt, Homo sapiens
aauccaccugccuugg

SEQ ID NO: 1586609 - RNA, 14 nt, Homo sapiens
aauccacugugacu

SEQ ID NO: 1586610 - RNA, 16 nt, Homo sapiens
aauccagugagcacua

SEQ ID NO: 1586611 - RNA, 20 nt, Homo sapiens
aauccauugaacuggaagaa

SEQ ID NO: 1586612 - RNA, 16 nt, Homo sapiens
aaucccagcacuuugg

SEQ ID NO: 1586613 - RNA, 16 nt, Homo sapiens
aaucccagcauuuugg

SEQ ID NO: 1586614 - RNA, 14 nt, Homo sapiens
aaucccauuugcag

SEQ ID NO: 1586615 - RNA, 17 nt, Homo sapiens
aauccccggaaaacugg

SEQ ID NO: 1586616 - RNA, 19 nt, Homo sapiens
acaaaaaggcaaauauuga

SEQ ID NO: 1586617 - RNA, 14 nt, Homo sapiens
acaaaacaauuacu

SEQ ID NO: 1586618 - RNA, 13 nt, Homo sapiens
acaaaagcaagaa

SEQ ID NO: 1586619 - RNA, 13 nt, Homo sapiens
acaaaauacacau

SEQ ID NO: 1586620 - RNA, 18 nt, Homo sapiens
acaaaaugacuggcuccu

SEQ ID NO: 1586621 - RNA, 18 nt, Homo sapiens
acaaaaugauuuugaaga

SEQ ID NO: 1586622 - RNA, 21 nt, Homo sapiens
acaaaauggucauccaaacuc

SEQ ID NO: 1586623 - RNA, 12 nt, Homo sapiens
acaaaauuacuu

SEQ ID NO: 1586624 - RNA, 15 nt, Homo sapiens
acaaacacauuauaa

SEQ ID NO: 1586625 - RNA, 11 nt, Homo sapiens
acaaacagggc

SEQ ID NO: 1586626 - RNA, 22 nt, Homo sapiens
acaaacauguauguauacauga

SEQ ID NO: 1586627 - RNA, 18 nt, Homo sapiens
acaaagaauuccaaagca

SEQ ID NO: 1586628 - RNA, 13 nt, Homo sapiens
acaaagacauuua

SEQ ID NO: 1586629 - RNA, 18 nt, Homo sapiens
acaaagauugagaagcca

SEQ ID NO: 1586630 - RNA, 19 nt, Homo sapiens
acaaagcaguuacuaauau

SEQ ID NO: 1586631 - RNA, 19 nt, Homo sapiens
acaaaggacccaaucccca

SEQ ID NO: 1586632 - RNA, 18 nt, Homo sapiens
acaaaggccacaggcagu

SEQ ID NO: 1586633 - RNA, 17 nt, Homo sapiens
acaaaggcugacauuca

SEQ ID NO: 1586634 - RNA, 18 nt, Homo sapiens
acaaaggcugacauucac

SEQ ID NO: 1586635 - RNA, 22 nt, Homo sapiens
acaaagggccaucguucaucca

SEQ ID NO: 1586636 - RNA, 16 nt, Homo sapiens
acaaauaaaacauggc

SEQ ID NO: 1586637 - RNA, 15 nt, Homo sapiens
acaaauaaaauacuu

SEQ ID NO: 1586638 - RNA, 13 nt, Homo sapiens
acaaaugacauca

SEQ ID NO: 1586639 - RNA, 14 nt, Homo sapiens
acaaaugacaucaa

SEQ ID NO: 1586640 - RNA, 15 nt, Homo sapiens
acaaaugcaauuuca

SEQ ID NO: 1586641 - RNA, 13 nt, Homo sapiens
acaaaugcaguau

SEQ ID NO: 1586642 - RNA, 16 nt, Homo sapiens
acaaaugcaguauaua

SEQ ID NO: 1586643 - RNA, 23 nt, Homo sapiens
acaaaugguuaaaaagaaacaaa

SEQ ID NO: 1586644 - RNA, 18 nt, Homo sapiens
acaaauguggccaagccu

SEQ ID NO: 1586645 - RNA, 17 nt, Homo sapiens
acaaauuagccauuuca

SEQ ID NO: 1586646 - RNA, 17 nt, Homo sapiens
acaaauuagcuaggcau

SEQ ID NO: 1586647 - RNA, 19 nt, Homo sapiens
acaaauuuacagagacaga

SEQ ID NO: 1586648 - RNA, 17 nt, Homo sapiens
acaaauuuggccuuaag

SEQ ID NO: 1586649 - RNA, 24 nt, Homo sapiens
acaaauuuggccuuaagaacugug

SEQ ID NO: 1586650 - RNA, 18 nt, Homo sapiens
acaaauuuucuggugcua

SEQ ID NO: 1586651 - RNA, 16 nt, Homo sapiens
acaaauuuugcauauu

SEQ ID NO: 1586652 - RNA, 10 nt, Homo sapiens
acaacacuga

SEQ ID NO: 1586653 - RNA, 14 nt, Homo sapiens
acaacaucgcaaua

SEQ ID NO: 1586654 - RNA, 22 nt, Homo sapiens
acaacauuuacaacucauucca

SEQ ID NO: 1586655 - RNA, 20 nt, Homo sapiens
acaaccagaccaaccgccug

SEQ ID NO: 1586656 - RNA, 21 nt, Homo sapiens
acaaccaugcaaauugugaaa

SEQ ID NO: 1586657 - RNA, 15 nt, Homo sapiens
acaacccuguccuca

SEQ ID NO: 1586658 - RNA, 23 nt, Homo sapiens
acaaccuaacuuauggacuguuu

SEQ ID NO: 1586659 - RNA, 19 nt, Homo sapiens
acaacgcaccagacacuca

SEQ ID NO: 1586660 - RNA, 18 nt, Homo sapiens
acaacgccgagugcacug

SEQ ID NO: 1586661 - RNA, 16 nt, Homo sapiens
acaacugcauaaccuu

SEQ ID NO: 1586662 - RNA, 15 nt, Homo sapiens
acaacugccagcucu

SEQ ID NO: 1586663 - RNA, 16 nt, Homo sapiens
acaacuuguauuucca

SEQ ID NO: 1586664 - RNA, 21 nt, Homo sapiens
acaacuuguauuuccaaaccu

SEQ ID NO: 1586665 - RNA, 17 nt, Homo sapiens
acaagaaaaucaaauau

SEQ ID NO: 1586666 - RNA, 16 nt, Homo sapiens
acaagaacaaagccac

SEQ ID NO: 1586667 - RNA, 18 nt, Homo sapiens
acaagacccccagcacuu

SEQ ID NO: 1586668 - RNA, 19 nt, Homo sapiens
acaagacccccagcacuug

SEQ ID NO: 1586669 - RNA, 21 nt, Homo sapiens
acaagagggcaagccucuagu

SEQ ID NO: 1586670 - RNA, 13 nt, Homo sapiens
acaagccaagaaa

SEQ ID NO: 1586671 - RNA, 11 nt, Homo sapiens
acaaggccagg

SEQ ID NO: 1586672 - RNA, 15 nt, Homo sapiens
acaagucauggucac

SEQ ID NO: 1586673 - RNA, 12 nt, Homo sapiens
acaagugcccag

SEQ ID NO: 1586674 - RNA, 20 nt, Homo sapiens
acaagugcccagccugugga

SEQ ID NO: 1586675 - RNA, 11 nt, Homo sapiens
acaagugucug

SEQ ID NO: 1586676 - RNA, 19 nt, Homo sapiens
acaaguuagaaaacauaau

SEQ ID NO: 1586677 - RNA, 12 nt, Homo sapiens
acaauaaacccu

SEQ ID NO: 1586678 - RNA, 14 nt, Homo sapiens
acaauaaacccuca

SEQ ID NO: 1586679 - RNA, 23 nt, Homo sapiens
acaauaaagauuguuuuaaagag

SEQ ID NO: 1586680 - RNA, 21 nt, Homo sapiens
acaauaauauuucaagugccu

SEQ ID NO: 1586681 - RNA, 13 nt, Homo sapiens
acaauacaguauu

SEQ ID NO: 1586682 - RNA, 22 nt, Homo sapiens
acaauagccgauaucagaauuu

SEQ ID NO: 1586683 - RNA, 23 nt, Homo sapiens
acaauaggucuuucucucaguga

SEQ ID NO: 1586684 - RNA, 16 nt, Homo sapiens
acaauauucucucuua

SEQ ID NO: 1586685 - RNA, 19 nt, Homo sapiens
acaauauuuuugaccugga

SEQ ID NO: 1586686 - RNA, 16 nt, Homo sapiens
acaaucaacaaaaugg

SEQ ID NO: 1586687 - RNA, 14 nt, Homo sapiens
acaaugacgugccu

SEQ ID NO: 1586688 - RNA, 19 nt, Homo sapiens
acaauggaagauuugccca

SEQ ID NO: 1586689 - RNA, 16 nt, Homo sapiens
acaauguauguacaau

SEQ ID NO: 1586690 - RNA, 15 nt, Homo sapiens
acaauguucuggcac

SEQ ID NO: 1586691 - RNA, 18 nt, Homo sapiens
acaauguucuggcacuau

SEQ ID NO: 1586692 - RNA, 20 nt, Homo sapiens
acaauguucuggcacuauua

SEQ ID NO: 1586693 - RNA, 18 nt, Homo sapiens
acaauuaacauacaucau

SEQ ID NO: 1586694 - RNA, 15 nt, Homo sapiens
acaauuauuggcaaa

SEQ ID NO: 1586695 - RNA, 22 nt, Homo sapiens
acaauuccuccagagacacuga

SEQ ID NO: 1586696 - RNA, 17 nt, Homo sapiens
acacaaaccacaccaca

SEQ ID NO: 1586697 - RNA, 16 nt, Homo sapiens
acacaauacaguauua

SEQ ID NO: 1586698 - RNA, 21 nt, Homo sapiens
acacaauaggucuuucucuca

SEQ ID NO: 1586699 - RNA, 16 nt, Homo sapiens
acacaaucugaaacag

SEQ ID NO: 1586700 - RNA, 22 nt, Homo sapiens
acacaaucugaaacagcuucau

SEQ ID NO: 1586701 - RNA, 10 nt, Homo sapiens
acacaaugcc

SEQ ID NO: 1586702 - RNA, 18 nt, Homo sapiens
acacaauuggaagucuaa

SEQ ID NO: 1586703 - RNA, 13 nt, Homo sapiens
acacacacaccaa

SEQ ID NO: 1586704 - RNA, 13 nt, Homo sapiens
acacacaugcaua

SEQ ID NO: 1586705 - RNA, 20 nt, Homo sapiens
acacacgcacacaaaccaca

SEQ ID NO: 1586706 - RNA, 16 nt, Homo sapiens
acacacucaaaucaag

SEQ ID NO: 1586707 - RNA, 14 nt, Homo sapiens
acacacuccgucca

SEQ ID NO: 1586708 - RNA, 18 nt, Homo sapiens
acacacugaguugcacau

SEQ ID NO: 1586709 - RNA, 18 nt, Homo sapiens
acacagacuccacccucc

SEQ ID NO: 1586710 - RNA, 17 nt, Homo sapiens
acacagcaacauccaga

SEQ ID NO: 1586711 - RNA, 22 nt, Homo sapiens
acacagcaagggugaugggaaa

SEQ ID NO: 1586712 - RNA, 21 nt, Homo sapiens
acacaggcccagaugacaucc

SEQ ID NO: 1586713 - RNA, 19 nt, Homo sapiens
acacaguaauugugacaau

SEQ ID NO: 1586714 - RNA, 22 nt, Homo sapiens
acacaguggauggacggacaag

SEQ ID NO: 1586715 - RNA, 23 nt, Homo sapiens
acacauaauuucuuaauuuucac

SEQ ID NO: 1586716 - RNA, 24 nt, Homo sapiens
acacauagaaaacaaucaaauauu

SEQ ID NO: 1586717 - RNA, 22 nt, Homo sapiens
acacauuauaaagaauacaaaa

SEQ ID NO: 1586718 - RNA, 22 nt, Homo sapiens
acacauucacgcauacuuggau

SEQ ID NO: 1586719 - RNA, 17 nt, Homo sapiens
acacauuggaaugccuu

SEQ ID NO: 1586720 - RNA, 17 nt, Homo sapiens
acaccacgguagugccu

SEQ ID NO: 1586721 - RNA, 19 nt, Homo sapiens
acaccagagacaagcagag

SEQ ID NO: 1586722 - RNA, 21 nt, Homo sapiens
acaccagccgaggccacagaa

SEQ ID NO: 1586723 - RNA, 15 nt, Homo sapiens
acacccauggccuca

SEQ ID NO: 1586724 - RNA, 23 nt, Homo sapiens
acaccucaguucccuuggccuca

SEQ ID NO: 1586725 - RNA, 24 nt, Homo sapiens
acaccucccccuuucacacuggau

SEQ ID NO: 1586726 - RNA, 15 nt, Homo sapiens
acaccucccuacucc

SEQ ID NO: 1586727 - RNA, 21 nt, Homo sapiens
acaccucccuccccacaccuc

SEQ ID NO: 1586728 - RNA, 14 nt, Homo sapiens
acaccugcccuaaa

SEQ ID NO: 1586729 - RNA, 12 nt, Homo sapiens
acacgcauuaau

SEQ ID NO: 1586730 - RNA, 20 nt, Homo sapiens
acacggaggucucuguaaaa

SEQ ID NO: 1586731 - RNA, 14 nt, Homo sapiens
acacguaagcacau

SEQ ID NO: 1586732 - RNA, 13 nt, Homo sapiens
acacgucucgcca

SEQ ID NO: 1586733 - RNA, 22 nt, Homo sapiens
acacuaaucacaaacugaauga

SEQ ID NO: 1586734 - RNA, 18 nt, Homo sapiens
uuuugggaagaauccagu

SEQ ID NO: 1586735 - RNA, 20 nt, Homo sapiens
uuuugggaccaucacugaga

SEQ ID NO: 1586736 - RNA, 15 nt, Homo sapiens
uuuuuaaauggaauu

SEQ ID NO: 1586737 - RNA, 14 nt, Homo sapiens
uuuuuaagcucaaa

SEQ ID NO: 1586738 - RNA, 21 nt, Homo sapiens
uuuuuaauggcaauaggacau

SEQ ID NO: 1586739 - RNA, 15 nt, Homo sapiens
uuuuuacauccauga

SEQ ID NO: 1586740 - RNA, 12 nt, Homo sapiens
uuuuuacuauua

SEQ ID NO: 1586741 - RNA, 22 nt, Homo sapiens
uuuuuaucauaaaugcagaaua

SEQ ID NO: 1586742 - RNA, 20 nt, Homo sapiens
uuuuuauggaggcuuugcau

SEQ ID NO: 1586743 - RNA, 19 nt, Homo sapiens
uuuuuccgguguuguacua

SEQ ID NO: 1586744 - RNA, 18 nt, Homo sapiens
uuuuuccuaagacauuuu

SEQ ID NO: 1586745 - RNA, 16 nt, Homo sapiens
uuuuuccucauugaga

SEQ ID NO: 1586746 - RNA, 15 nt, Homo sapiens
uuuuucuuuuuccac

SEQ ID NO: 1586747 - RNA, 11 nt, Homo sapiens
uuuuugcaaua

SEQ ID NO: 1586748 - RNA, 12 nt, Homo sapiens
uuuuugggacca

SEQ ID NO: 1586749 - RNA, 21 nt, Homo sapiens
uuuuuuaggaagcaagcuuaa

SEQ ID NO: 1586750 - RNA, 13 nt, Homo sapiens
uuuuuugccacuu

SEQ ID NO: 1586751 - RNA, 13 nt, Homo sapiens
uuuuuuuuaccuc

SEQ ID NO: 1586752 - RNA, 15 nt, Homo sapiens
aguuuauauuaucaa

SEQ ID NO: 1586753 - RNA, 20 nt, Homo sapiens
aguuucuauggauucacuuc

SEQ ID NO: 1586754 - RNA, 17 nt, Homo sapiens
aguuucuauucugucag

SEQ ID NO: 1586755 - RNA, 23 nt, Homo sapiens
aguuucuugaggccaaacacacu

SEQ ID NO: 1586756 - RNA, 14 nt, Homo sapiens
aguuucuuuucaca

SEQ ID NO: 1586757 - RNA, 21 nt, Homo sapiens
aguuugaaaguuguacaugau

SEQ ID NO: 1586758 - RNA, 21 nt, Homo sapiens
aguuugaagcacaacucccuu

SEQ ID NO: 1586759 - RNA, 22 nt, Homo sapiens
aguuugaggcugcaaugagcca

SEQ ID NO: 1586760 - RNA, 14 nt, Homo sapiens
aguuugagggagaa

SEQ ID NO: 1586761 - RNA, 15 nt, Homo sapiens
aguuugcacaacaag

SEQ ID NO: 1586762 - RNA, 22 nt, Homo sapiens
aguuugccaggaggaacaaaga

SEQ ID NO: 1586763 - RNA, 18 nt, Homo sapiens
aguuugcuucuacaugau

SEQ ID NO: 1586764 - RNA, 16 nt, Homo sapiens
aguuuggaugucugua

SEQ ID NO: 1586765 - RNA, 17 nt, Homo sapiens
aguuuguagguaaaaug

SEQ ID NO: 1586766 - RNA, 23 nt, Homo sapiens
aguuuuagcuguagaucaagcua

SEQ ID NO: 1586767 - RNA, 15 nt, Homo sapiens
aguuuucuaaacuca

SEQ ID NO: 1586768 - RNA, 23 nt, Homo sapiens
aguuuucucaacagagagcaaag

SEQ ID NO: 1586769 - RNA, 12 nt, Homo sapiens
aguuuugcacuu

SEQ ID NO: 1586770 - RNA, 15 nt, Homo sapiens
aguuuuggcauaaua

SEQ ID NO: 1586771 - RNA, 18 nt, Homo sapiens
aguuuugugaaggugauu

SEQ ID NO: 1586772 - RNA, 21 nt, Homo sapiens
aguuuuuaaaauuuauuugca

SEQ ID NO: 1586773 - RNA, 21 nt, Homo sapiens
aguuuuuuauuaugcauuaua

SEQ ID NO: 1586774 - RNA, 13 nt, Homo sapiens
auaaaaaggaaua

SEQ ID NO: 1586775 - RNA, 21 nt, Homo sapiens
auaaaaaucauucuacugaac

SEQ ID NO: 1586776 - RNA, 19 nt, Homo sapiens
auaaaacaaaaccaacuca

SEQ ID NO: 1586777 - RNA, 15 nt, Homo sapiens
auaaaagaucuugca

SEQ ID NO: 1586778 - RNA, 17 nt, Homo sapiens
auaaaaguaaaccacaa

SEQ ID NO: 1586779 - RNA, 13 nt, Homo sapiens
auaaaaugaauuc

SEQ ID NO: 1586780 - RNA, 19 nt, Homo sapiens
auaaaaugagggugcccag

SEQ ID NO: 1586781 - RNA, 15 nt, Homo sapiens
auaaaauuauuugca

SEQ ID NO: 1586782 - RNA, 13 nt, Homo sapiens
auaaacacugugu

SEQ ID NO: 1586783 - RNA, 13 nt, Homo sapiens
auaaacagaacuc

SEQ ID NO: 1586784 - RNA, 16 nt, Homo sapiens
auaaacagauacauuc

SEQ ID NO: 1586785 - RNA, 15 nt, Homo sapiens
auaaaccacugugcg

SEQ ID NO: 1586786 - RNA, 12 nt, Homo sapiens
auaaaccacuuu

SEQ ID NO: 1586787 - RNA, 15 nt, Homo sapiens
auaaaccacuuucua

SEQ ID NO: 1586788 - RNA, 18 nt, Homo sapiens
auaaacccucagagccuc

SEQ ID NO: 1586789 - RNA, 16 nt, Homo sapiens
auaaacccuccuuggu

SEQ ID NO: 1586790 - RNA, 19 nt, Homo sapiens
auaaaccuugucuaugaaa

SEQ ID NO: 1586791 - RNA, 18 nt, Homo sapiens
auaaacggcaguguuaaa

SEQ ID NO: 1586792 - RNA, 16 nt, Homo sapiens
auaaacuauaaacuua

SEQ ID NO: 1586793 - RNA, 20 nt, Homo sapiens
auaaacugacuaaacuuaca

SEQ ID NO: 1586794 - RNA, 15 nt, Homo sapiens
auaaacugugccaau

SEQ ID NO: 1586795 - RNA, 13 nt, Homo sapiens
auaaagagcaaua

SEQ ID NO: 1586796 - RNA, 15 nt, Homo sapiens
auaaaggcagcugcc

SEQ ID NO: 1586797 - RNA, 19 nt, Homo sapiens
auaaaggcagcugccucug

SEQ ID NO: 1586798 - RNA, 18 nt, Homo sapiens
auaaaggcaguuuucuaa

SEQ ID NO: 1586799 - RNA, 19 nt, Homo sapiens
auaaaguucagauguuuca

SEQ ID NO: 1586800 - RNA, 20 nt, Homo sapiens
auaaaguucagauguuucau

SEQ ID NO: 1586801 - RNA, 18 nt, Homo sapiens
auaaauaaaacagcagca

SEQ ID NO: 1586802 - RNA, 18 nt, Homo sapiens
auaaauacucagugauga

SEQ ID NO: 1586803 - RNA, 13 nt, Homo sapiens
auaaauacuguca

SEQ ID NO: 1586804 - RNA, 14 nt, Homo sapiens
auaaauacugucaa

SEQ ID NO: 1586805 - RNA, 21 nt, Homo sapiens
auaaauaguuuaugauuccac

SEQ ID NO: 1586806 - RNA, 15 nt, Homo sapiens
auaaauaugucagau

SEQ ID NO: 1586807 - RNA, 22 nt, Homo sapiens
auaaauauuguguugugcagca

SEQ ID NO: 1586808 - RNA, 13 nt, Homo sapiens
auaaaucagucaa

SEQ ID NO: 1586809 - RNA, 17 nt, Homo sapiens
auaaaucucuccuauaa

SEQ ID NO: 1586810 - RNA, 15 nt, Homo sapiens
auaaaugaaugugcu

SEQ ID NO: 1586811 - RNA, 16 nt, Homo sapiens
auaaauguaccagaga

SEQ ID NO: 1586812 - RNA, 12 nt, Homo sapiens
auaaauguaucu

SEQ ID NO: 1586813 - RNA, 12 nt, Homo sapiens
auaaauucccaa

SEQ ID NO: 1586814 - RNA, 15 nt, Homo sapiens
auaaauuucccaguu

SEQ ID NO: 1586815 - RNA, 13 nt, Homo sapiens
auaaauuugcacu

SEQ ID NO: 1586816 - RNA, 15 nt, Homo sapiens
auaaauuugcacugu

SEQ ID NO: 1586817 - RNA, 24 nt, Homo sapiens
auaaauuuuuuugcaauccuuucc

SEQ ID NO: 1586818 - RNA, 12 nt, Homo sapiens
auaacaucucac

SEQ ID NO: 1586819 - RNA, 19 nt, Homo sapiens
auaacauuuaaauuccaca

SEQ ID NO: 1586820 - RNA, 21 nt, Homo sapiens
auaacauuuaaauuccacaga

SEQ ID NO: 1586821 - RNA, 17 nt, Homo sapiens
auaacuccugucccuuu

SEQ ID NO: 1586822 - RNA, 18 nt, Homo sapiens
auaacucugcacuacucc

SEQ ID NO: 1586823 - RNA, 22 nt, Homo sapiens
auaacuguaaaugugacauuga

SEQ ID NO: 1586824 - RNA, 22 nt, Homo sapiens
auaacuguauuugaaauaagaa

SEQ ID NO: 1586825 - RNA, 17 nt, Homo sapiens
auaagaaagaucaaaga

SEQ ID NO: 1586826 - RNA, 15 nt, Homo sapiens
auaagaaagcacuau

SEQ ID NO: 1586827 - RNA, 17 nt, Homo sapiens
auaagaaagcacuauua

SEQ ID NO: 1586828 - RNA, 14 nt, Homo sapiens
auaagaauuacuuu

SEQ ID NO: 1586829 - RNA, 13 nt, Homo sapiens
auaagacaaugac

SEQ ID NO: 1586830 - RNA, 19 nt, Homo sapiens
auaagcaaaaacaaaaaga

SEQ ID NO: 1586831 - RNA, 19 nt, Homo sapiens
auaagcagaacauacuguu

SEQ ID NO: 1586832 - RNA, 15 nt, Homo sapiens
auaaggaaagcaaua

SEQ ID NO: 1586833 - RNA, 16 nt, Homo sapiens
auaaggaaagcaauaa

SEQ ID NO: 1586834 - RNA, 22 nt, Homo sapiens
auaagggaaauuccuaacuuug

SEQ ID NO: 1586835 - RNA, 20 nt, Homo sapiens
auaaggggaaagauaauauu

SEQ ID NO: 1586836 - RNA, 16 nt, Homo sapiens
auaauaaacaguggaa

SEQ ID NO: 1586837 - RNA, 24 nt, Homo sapiens
auaauauccagccucccacaagaa

SEQ ID NO: 1586838 - RNA, 19 nt, Homo sapiens
auaauauucagccagcuua

SEQ ID NO: 1586839 - RNA, 17 nt, Homo sapiens
auaaucaaaagcuauuu

SEQ ID NO: 1586840 - RNA, 21 nt, Homo sapiens
auaaucaaucauuucuauuaa

SEQ ID NO: 1586841 - RNA, 16 nt, Homo sapiens
auaaucacaguugugu

SEQ ID NO: 1586842 - RNA, 19 nt, Homo sapiens
auaaucaucccuccuugcc

SEQ ID NO: 1586843 - RNA, 11 nt, Homo sapiens
auaaucccagc

SEQ ID NO: 1586844 - RNA, 14 nt, Homo sapiens
auaaucucaaagga

SEQ ID NO: 1586845 - RNA, 12 nt, Homo sapiens
auaaucuuaucu

SEQ ID NO: 1586846 - RNA, 13 nt, Homo sapiens
auaaucuucugcc

SEQ ID NO: 1586847 - RNA, 12 nt, Homo sapiens
auaaucuuucaa

SEQ ID NO: 1586848 - RNA, 15 nt, Homo sapiens
auaaugcauccagca

SEQ ID NO: 1586849 - RNA, 15 nt, Homo sapiens
auaauucagcacuua

SEQ ID NO: 1586850 - RNA, 19 nt, Homo sapiens
auaauucagcacuuaacua

SEQ ID NO: 1586851 - RNA, 21 nt, Homo sapiens
auaauuuaaaauccauuuuag

SEQ ID NO: 1586852 - RNA, 22 nt, Homo sapiens
auaauuuucacaugaacccuug

SEQ ID NO: 1586853 - RNA, 10 nt, Homo sapiens
auaauuuugu

SEQ ID NO: 1586854 - RNA, 21 nt, Homo sapiens
auaauuuuguaagaggcuuca

SEQ ID NO: 1586855 - RNA, 18 nt, Homo sapiens
auaauuuuugugagguau

SEQ ID NO: 1586856 - RNA, 22 nt, Homo sapiens
auacaagucauggucacaguaa

SEQ ID NO: 1586857 - RNA, 15 nt, Homo sapiens
auacaauauauagcu

SEQ ID NO: 1586858 - RNA, 18 nt, Homo sapiens
auacaauuggacgcauuu

SEQ ID NO: 1586859 - RNA, 16 nt, Homo sapiens
auacacacacacaaaa

SEQ ID NO: 1586860 - RNA, 12 nt, Homo sapiens
auacacacucaa

SEQ ID NO: 1586861 - RNA, 22 nt, Homo sapiens
auacaccagaagacaaacaaua

SEQ ID NO: 1586862 - RNA, 18 nt, Homo sapiens
auacacccaaacacuuac

SEQ ID NO: 1586863 - RNA, 20 nt, Homo sapiens
auacagaaggcaacaggggc

SEQ ID NO: 1586864 - RNA, 14 nt, Homo sapiens
auacauauuaucuc

SEQ ID NO: 1586865 - RNA, 14 nt, Homo sapiens
auacaucauuccac

SEQ ID NO: 1586866 - RNA, 16 nt, Homo sapiens
auacaugcacagucau

SEQ ID NO: 1586867 - RNA, 17 nt, Homo sapiens
auaccaaauggcacuuu

SEQ ID NO: 1586868 - RNA, 15 nt, Homo sapiens
auaccaacucaguga

SEQ ID NO: 1586869 - RNA, 15 nt, Homo sapiens
auaccaaguugauac

SEQ ID NO: 1586870 - RNA, 20 nt, Homo sapiens
auaccaaguugauacuugaa

SEQ ID NO: 1586871 - RNA, 16 nt, Homo sapiens
auauugugauucugcc

SEQ ID NO: 1586872 - RNA, 16 nt, Homo sapiens
auauuuaaaacaucau

SEQ ID NO: 1586873 - RNA, 15 nt, Homo sapiens
auauuuaacuaugaa

SEQ ID NO: 1586874 - RNA, 21 nt, Homo sapiens
auauuuauucauuauuuguca

SEQ ID NO: 1586875 - RNA, 23 nt, Homo sapiens
auauuuauucauuauuugucaaa

SEQ ID NO: 1586876 - RNA, 12 nt, Homo sapiens
auauuucacuua

SEQ ID NO: 1586877 - RNA, 19 nt, Homo sapiens
auauuugaaauaguauaca

SEQ ID NO: 1586878 - RNA, 19 nt, Homo sapiens
auauuuuaaaaucugucac

SEQ ID NO: 1586879 - RNA, 17 nt, Homo sapiens
auauuuuaauaaaguag

SEQ ID NO: 1586880 - RNA, 16 nt, Homo sapiens
auauuuuacauacacu

SEQ ID NO: 1586881 - RNA, 22 nt, Homo sapiens
auauuuuagauuacaggauuaa

SEQ ID NO: 1586882 - RNA, 22 nt, Homo sapiens
auauuuuaucuugguaguacau

SEQ ID NO: 1586883 - RNA, 15 nt, Homo sapiens
auauuuuguuuacaa

SEQ ID NO: 1586884 - RNA, 18 nt, Homo sapiens
auauuuuuagauaguuag

SEQ ID NO: 1586885 - RNA, 17 nt, Homo sapiens
auauuuuugugcacauu

SEQ ID NO: 1586886 - RNA, 15 nt, Homo sapiens
aucaaaacagagaaa

SEQ ID NO: 1586887 - RNA, 20 nt, Homo sapiens
aucaaaacuaaccaucugaa

SEQ ID NO: 1586888 - RNA, 19 nt, Homo sapiens
aucaaacauuuucuggcca

SEQ ID NO: 1586889 - RNA, 21 nt, Homo sapiens
aucaacacgagaauacaggag

SEQ ID NO: 1586890 - RNA, 12 nt, Homo sapiens
aucaacaugacu

SEQ ID NO: 1586891 - RNA, 17 nt, Homo sapiens
aucaacauuuguuccau

SEQ ID NO: 1586892 - RNA, 16 nt, Homo sapiens
aucaacgaguacuuca

SEQ ID NO: 1586893 - RNA, 18 nt, Homo sapiens
aucaagaaaaacaucuuu

SEQ ID NO: 1586894 - RNA, 16 nt, Homo sapiens
aucaagagaaacuuca

SEQ ID NO: 1586895 - RNA, 13 nt, Homo sapiens
aucaagagcugcc

SEQ ID NO: 1586896 - RNA, 17 nt, Homo sapiens
aucaaggggacuaaagu

SEQ ID NO: 1586897 - RNA, 11 nt, Homo sapiens
aucaaguaaua

SEQ ID NO: 1586898 - RNA, 13 nt, Homo sapiens
aucaaguaauaca

SEQ ID NO: 1586899 - RNA, 17 nt, Homo sapiens
aucaaguccaucugaca

SEQ ID NO: 1586900 - RNA, 19 nt, Homo sapiens
aucaaguuguugacuguga

SEQ ID NO: 1586901 - RNA, 14 nt, Homo sapiens
aucaauacaauccu

SEQ ID NO: 1586902 - RNA, 24 nt, Homo sapiens
aucaauauuuuuauaucaugcaaa

SEQ ID NO: 1586903 - RNA, 16 nt, Homo sapiens
aucaaucugcaguuua

SEQ ID NO: 1586904 - RNA, 22 nt, Homo sapiens
aucaaucuuguuacugcugauu

SEQ ID NO: 1586905 - RNA, 17 nt, Homo sapiens
aucaauucuguauucca

SEQ ID NO: 1586906 - RNA, 17 nt, Homo sapiens
aucacauuccucugccc

SEQ ID NO: 1586907 - RNA, 15 nt, Homo sapiens
aucacauucuuucca

SEQ ID NO: 1586908 - RNA, 20 nt, Homo sapiens
aucaccaugaaagaagaaua

SEQ ID NO: 1586909 - RNA, 16 nt, Homo sapiens
aucacccaagccacaa

SEQ ID NO: 1586910 - RNA, 22 nt, Homo sapiens
aucaccucugauggcugaagaa

SEQ ID NO: 1586911 - RNA, 12 nt, Homo sapiens
aucacgaccacu

SEQ ID NO: 1586912 - RNA, 19 nt, Homo sapiens
aucacgcuuuccugaaucc

SEQ ID NO: 1586913 - RNA, 17 nt, Homo sapiens
aucacggauggugcaug

SEQ ID NO: 1586914 - RNA, 19 nt, Homo sapiens
aucacuaaauaaacacgau

SEQ ID NO: 1586915 - RNA, 15 nt, Homo sapiens
aucacuaaugcucaa

SEQ ID NO: 1586916 - RNA, 13 nt, Homo sapiens
aucacuaucaauu

SEQ ID NO: 1586917 - RNA, 22 nt, Homo sapiens
aucacuaucaauuuuaaggaaa

SEQ ID NO: 1586918 - RNA, 21 nt, Homo sapiens
aucacugucuagcuguuucaa

SEQ ID NO: 1586919 - RNA, 15 nt, Homo sapiens
aucacuuaguucuca

SEQ ID NO: 1586920 - RNA, 16 nt, Homo sapiens
aucacuuaguucucag

SEQ ID NO: 1586921 - RNA, 18 nt, Homo sapiens
aucacuuaguucucaggc

SEQ ID NO: 1586922 - RNA, 19 nt, Homo sapiens
aucagaauagccacauuug

SEQ ID NO: 1586923 - RNA, 13 nt, Homo sapiens
aucagaccugguu

SEQ ID NO: 1586924 - RNA, 13 nt, Homo sapiens
aucagagaacuuu

SEQ ID NO: 1586925 - RNA, 24 nt, Homo sapiens
aucagagagcugcccuucagcgau

SEQ ID NO: 1586926 - RNA, 12 nt, Homo sapiens
aucagaguugcu

SEQ ID NO: 1586927 - RNA, 12 nt, Homo sapiens
aucagcacucug

SEQ ID NO: 1586928 - RNA, 14 nt, Homo sapiens
aucagcacucugua

SEQ ID NO: 1586929 - RNA, 18 nt, Homo sapiens
aucagcaucucuucuucc

SEQ ID NO: 1586930 - RNA, 21 nt, Homo sapiens
aucagcugguucaguacuguc

SEQ ID NO: 1586931 - RNA, 22 nt, Homo sapiens
aucaggauccagucuggaaaac

SEQ ID NO: 1586932 - RNA, 18 nt, Homo sapiens
aucaggugaggugugcuc

SEQ ID NO: 1586933 - RNA, 21 nt, Homo sapiens
aucaggugcauagcaagugaa

SEQ ID NO: 1586934 - RNA, 18 nt, Homo sapiens
aucaguauuuaauaucug

SEQ ID NO: 1586935 - RNA, 14 nt, Homo sapiens
aucaguuaacuauu

SEQ ID NO: 1586936 - RNA, 21 nt, Homo sapiens
aucaguucuacggaucaucaa

SEQ ID NO: 1586937 - RNA, 18 nt, Homo sapiens
aucaguugguuuggauuu

SEQ ID NO: 1586938 - RNA, 16 nt, Homo sapiens
aucauaagacaaugga

SEQ ID NO: 1586939 - RNA, 14 nt, Homo sapiens
aucauauauacugu

SEQ ID NO: 1586940 - RNA, 17 nt, Homo sapiens
aucauauucauaugcag

SEQ ID NO: 1586941 - RNA, 12 nt, Homo sapiens
aucaucacugua

SEQ ID NO: 1586942 - RNA, 13 nt, Homo sapiens
aucaucauucuca

SEQ ID NO: 1586943 - RNA, 22 nt, Homo sapiens
aucaugaagcacaucaauuaca

SEQ ID NO: 1586944 - RNA, 16 nt, Homo sapiens
aucaugucaggccauc

SEQ ID NO: 1586945 - RNA, 13 nt, Homo sapiens
aucaugucuguau

SEQ ID NO: 1586946 - RNA, 20 nt, Homo sapiens
aucauguuuuaauguagaac

SEQ ID NO: 1586947 - RNA, 14 nt, Homo sapiens
aucauuacuuauga

SEQ ID NO: 1586948 - RNA, 13 nt, Homo sapiens
aucauuagggcuu

SEQ ID NO: 1586949 - RNA, 12 nt, Homo sapiens
aucauucaucuu

SEQ ID NO: 1586950 - RNA, 19 nt, Homo sapiens
aucauuguggugguugaga

SEQ ID NO: 1586951 - RNA, 17 nt, Homo sapiens
aucauuguuuauuguau

SEQ ID NO: 1586952 - RNA, 20 nt, Homo sapiens
aucauuguuuauuguauacu

SEQ ID NO: 1586953 - RNA, 20 nt, Homo sapiens
aucauuuccccaacagggca

SEQ ID NO: 1586954 - RNA, 21 nt, Homo sapiens
aucauuuguuuacauuugaug

SEQ ID NO: 1586955 - RNA, 21 nt, Homo sapiens
auccacaccguacaucugcaa

SEQ ID NO: 1586956 - RNA, 15 nt, Homo sapiens
auccacacugagaga

SEQ ID NO: 1586957 - RNA, 20 nt, Homo sapiens
auccacagaaccuuugucaa

SEQ ID NO: 1586958 - RNA, 15 nt, Homo sapiens
auccagacagucgcu

SEQ ID NO: 1586959 - RNA, 19 nt, Homo sapiens
auccagauguuaugcuccu

SEQ ID NO: 1586960 - RNA, 20 nt, Homo sapiens
auccagauguuaugcuccug

SEQ ID NO: 1586961 - RNA, 12 nt, Homo sapiens
auccagcacugg

SEQ ID NO: 1586962 - RNA, 13 nt, Homo sapiens
auccagcacuggu

SEQ ID NO: 1586963 - RNA, 14 nt, Homo sapiens
auccagcacuggug

SEQ ID NO: 1586964 - RNA, 23 nt, Homo sapiens
auccagcacuggugaacugagcu

SEQ ID NO: 1586965 - RNA, 21 nt, Homo sapiens
auccagccucagagaucuccc

SEQ ID NO: 1586966 - RNA, 22 nt, Homo sapiens
auccauagcaccuccacauacc

SEQ ID NO: 1586967 - RNA, 13 nt, Homo sapiens
auccauccaaagg

SEQ ID NO: 1586968 - RNA, 13 nt, Homo sapiens
aucccacauccca

SEQ ID NO: 1586969 - RNA, 13 nt, Homo sapiens
aucccagcacuuu

SEQ ID NO: 1586970 - RNA, 15 nt, Homo sapiens
aucccagcuacucag

SEQ ID NO: 1586971 - RNA, 16 nt, Homo sapiens
aucccagucucugcca

SEQ ID NO: 1586972 - RNA, 14 nt, Homo sapiens
auccccaacuccau

SEQ ID NO: 1586973 - RNA, 13 nt, Homo sapiens
auccccagacuca

SEQ ID NO: 1586974 - RNA, 23 nt, Homo sapiens
auccccagccccuccucccucag

SEQ ID NO: 1586975 - RNA, 22 nt, Homo sapiens
auccccauucucugccuguacu

SEQ ID NO: 1586976 - RNA, 22 nt, Homo sapiens
auccccuaagcagaccacugau

SEQ ID NO: 1586977 - RNA, 17 nt, Homo sapiens
aucccugguuccuagca

SEQ ID NO: 1586978 - RNA, 13 nt, Homo sapiens
aucccuuugacca

SEQ ID NO: 1586979 - RNA, 13 nt, Homo sapiens
auccgaaacggca

SEQ ID NO: 1586980 - RNA, 15 nt, Homo sapiens
auccguugugacucu

SEQ ID NO: 1586981 - RNA, 11 nt, Homo sapiens
auccuaaaaaa

SEQ ID NO: 1586982 - RNA, 17 nt, Homo sapiens
auccuaccagaaggaaa

SEQ ID NO: 1586983 - RNA, 21 nt, Homo sapiens
auccuacccccugugccuugu

SEQ ID NO: 1586984 - RNA, 21 nt, Homo sapiens
auccuaccccuuugcacuugu

SEQ ID NO: 1586985 - RNA, 22 nt, Homo sapiens
auccuauuuaaagaccugacag

SEQ ID NO: 1586986 - RNA, 16 nt, Homo sapiens
auccucagccgagaaa

SEQ ID NO: 1586987 - RNA, 15 nt, Homo sapiens
auccuccacagagag

SEQ ID NO: 1586988 - RNA, 20 nt, Homo sapiens
auccucccauugcccaguga

SEQ ID NO: 1586989 - RNA, 18 nt, Homo sapiens
auccucccuccaccucaa

SEQ ID NO: 1586990 - RNA, 16 nt, Homo sapiens
augaacauauucauga

SEQ ID NO: 1586991 - RNA, 15 nt, Homo sapiens
augaacuauuguuaa

SEQ ID NO: 1586992 - RNA, 18 nt, Homo sapiens
augaagaaaaucacuuag

SEQ ID NO: 1586993 - RNA, 15 nt, Homo sapiens
augaagagcuaauuu

SEQ ID NO: 1586994 - RNA, 16 nt, Homo sapiens
augaagauaaacuguu

SEQ ID NO: 1586995 - RNA, 16 nt, Homo sapiens
augaagcccuaaagaa

SEQ ID NO: 1586996 - RNA, 14 nt, Homo sapiens
augaagguaauauu

SEQ ID NO: 1586997 - RNA, 13 nt, Homo sapiens
augaagugcaaua

SEQ ID NO: 1586998 - RNA, 20 nt, Homo sapiens
augaauaugaugacaaucag

SEQ ID NO: 1586999 - RNA, 14 nt, Homo sapiens
augaaucauauuca

SEQ ID NO: 1587000 - RNA, 14 nt, Homo sapiens
augaaucugcacau

SEQ ID NO: 1587001 - RNA, 20 nt, Homo sapiens
augaaucugcacaucuguaa

SEQ ID NO: 1587002 - RNA, 17 nt, Homo sapiens
augaaugacauugaacu

SEQ ID NO: 1587003 - RNA, 15 nt, Homo sapiens
augaauuaacccaaa

SEQ ID NO: 1587004 - RNA, 18 nt, Homo sapiens
augaauucaagaaaggaa

SEQ ID NO: 1587005 - RNA, 19 nt, Homo sapiens
augacaaccuccauucuau

SEQ ID NO: 1587006 - RNA, 22 nt, Homo sapiens
augacaagaacaaagccacuga

SEQ ID NO: 1587007 - RNA, 19 nt, Homo sapiens
augacacaggcugacucau

SEQ ID NO: 1587008 - RNA, 17 nt, Homo sapiens
augacagccucuauccu

SEQ ID NO: 1587009 - RNA, 11 nt, Homo sapiens
augacagugaa

SEQ ID NO: 1587010 - RNA, 23 nt, Homo sapiens
augacagugaagcagcacuguga

SEQ ID NO: 1587011 - RNA, 22 nt, Homo sapiens
augacauuuguauucucagaca

SEQ ID NO: 1587012 - RNA, 23 nt, Homo sapiens
augaccaguuguuauuuacagcu

SEQ ID NO: 1587013 - RNA, 16 nt, Homo sapiens
augacuggcuccugac

SEQ ID NO: 1587014 - RNA, 11 nt, Homo sapiens
augacuggugg

SEQ ID NO: 1587015 - RNA, 13 nt, Homo sapiens
augacuucaucaa

SEQ ID NO: 1587016 - RNA, 24 nt, Homo sapiens
augacuugacuucaaaagcaacaa

SEQ ID NO: 1587017 - RNA, 15 nt, Homo sapiens
augagaaaugaugaa

SEQ ID NO: 1587018 - RNA, 14 nt, Homo sapiens
augagaaucaugca

SEQ ID NO: 1587019 - RNA, 17 nt, Homo sapiens
augagaauuguauguca

SEQ ID NO: 1587020 - RNA, 22 nt, Homo sapiens
augagaauuugagugcucugau

SEQ ID NO: 1587021 - RNA, 13 nt, Homo sapiens
augagcaaccugg

SEQ ID NO: 1587022 - RNA, 17 nt, Homo sapiens
augagcacuacucuacc

SEQ ID NO: 1587023 - RNA, 14 nt, Homo sapiens
augagcauccccag

SEQ ID NO: 1587024 - RNA, 19 nt, Homo sapiens
augagcccaccauuguuca

SEQ ID NO: 1587025 - RNA, 18 nt, Homo sapiens
augagcuccuuaaggcuc

SEQ ID NO: 1587026 - RNA, 20 nt, Homo sapiens
augaggagaaaggggcccca

SEQ ID NO: 1587027 - RNA, 22 nt, Homo sapiens
augaggaugucaccaacugaau

SEQ ID NO: 1587028 - RNA, 24 nt, Homo sapiens
augaggucuguuuaaaguggcaau

SEQ ID NO: 1587029 - RNA, 17 nt, Homo sapiens
augauacugauuaugaa

SEQ ID NO: 1587030 - RNA, 15 nt, Homo sapiens
augaucaaaaacugc

SEQ ID NO: 1587031 - RNA, 23 nt, Homo sapiens
augaugagucgguccucuuucca

SEQ ID NO: 1587032 - RNA, 19 nt, Homo sapiens
augaugaucuuuaaaauac

SEQ ID NO: 1587033 - RNA, 14 nt, Homo sapiens
augaugaugaucuu

SEQ ID NO: 1587034 - RNA, 13 nt, Homo sapiens
augaugcaguuuc

SEQ ID NO: 1587035 - RNA, 20 nt, Homo sapiens
augaugcccugcuccaggga

SEQ ID NO: 1587036 - RNA, 20 nt, Homo sapiens
augauggcagccauagugca

SEQ ID NO: 1587037 - RNA, 16 nt, Homo sapiens
augauguauuguugcu

SEQ ID NO: 1587038 - RNA, 18 nt, Homo sapiens
augauucaaauugcugcu

SEQ ID NO: 1587039 - RNA, 15 nt, Homo sapiens
augauugaaaccaag

SEQ ID NO: 1587040 - RNA, 16 nt, Homo sapiens
augauuuaauguugau

SEQ ID NO: 1587041 - RNA, 23 nt, Homo sapiens
augauuuaauuuuuuaaacugua

SEQ ID NO: 1587042 - RNA, 13 nt, Homo sapiens
augauuucauuca

SEQ ID NO: 1587043 - RNA, 19 nt, Homo sapiens
augauuuuuuuuucauaca

SEQ ID NO: 1587044 - RNA, 14 nt, Homo sapiens
augcaaaagcacau

SEQ ID NO: 1587045 - RNA, 14 nt, Homo sapiens
augcaaagcacuga

SEQ ID NO: 1587046 - RNA, 22 nt, Homo sapiens
augcaacgcaggaggagaaaag

SEQ ID NO: 1587047 - RNA, 18 nt, Homo sapiens
augcaagaguggacugaa

SEQ ID NO: 1587048 - RNA, 15 nt, Homo sapiens
augcaauacauacca

SEQ ID NO: 1587049 - RNA, 16 nt, Homo sapiens
augcacaaacaugugu

SEQ ID NO: 1587050 - RNA, 14 nt, Homo sapiens
augcaccaaucagc

SEQ ID NO: 1587051 - RNA, 21 nt, Homo sapiens
augcacccaucagcacucugu

SEQ ID NO: 1587052 - RNA, 18 nt, Homo sapiens
augcacuugaaaugaugg

SEQ ID NO: 1587053 - RNA, 21 nt, Homo sapiens
augcagcacgccaacauggca

SEQ ID NO: 1587054 - RNA, 17 nt, Homo sapiens
augcauacaaguuucau

SEQ ID NO: 1587055 - RNA, 17 nt, Homo sapiens
augcauaccacaagaca

SEQ ID NO: 1587056 - RNA, 20 nt, Homo sapiens
augcauacuuacagacugga

SEQ ID NO: 1587057 - RNA, 21 nt, Homo sapiens
augcaugaauuccacuccuuc

SEQ ID NO: 1587058 - RNA, 17 nt, Homo sapiens
augcauguagcauauaa

SEQ ID NO: 1587059 - RNA, 14 nt, Homo sapiens
augcaugucugccu

SEQ ID NO: 1587060 - RNA, 22 nt, Homo sapiens
augcaugucugccuaugcacug

SEQ ID NO: 1587061 - RNA, 11 nt, Homo sapiens
augccaaagga

SEQ ID NO: 1587062 - RNA, 14 nt, Homo sapiens
augccacuaugaaa

SEQ ID NO: 1587063 - RNA, 14 nt, Homo sapiens
augccagugccuua

SEQ ID NO: 1587064 - RNA, 21 nt, Homo sapiens
augccauuacagaaccaaauc

SEQ ID NO: 1587065 - RNA, 19 nt, Homo sapiens
augccccuugguccuggca

SEQ ID NO: 1587066 - RNA, 19 nt, Homo sapiens
augcccuguaccugugcac

SEQ ID NO: 1587067 - RNA, 17 nt, Homo sapiens
augccugcaaucccagc

SEQ ID NO: 1587068 - RNA, 15 nt, Homo sapiens
augccuguaauccca

SEQ ID NO: 1587069 - RNA, 15 nt, Homo sapiens
augccuguaaucuca

SEQ ID NO: 1587070 - RNA, 17 nt, Homo sapiens
augccuguaaucucagc

SEQ ID NO: 1587071 - RNA, 20 nt, Homo sapiens
augccuuacgaaccaugccu

SEQ ID NO: 1587072 - RNA, 23 nt, Homo sapiens
augccuuggaggaaaugugcuca

SEQ ID NO: 1587073 - RNA, 18 nt, Homo sapiens
augcgcguggaguucaag

SEQ ID NO: 1587074 - RNA, 12 nt, Homo sapiens
augcgugugaac

SEQ ID NO: 1587075 - RNA, 18 nt, Homo sapiens
augcucaguuggugcugc

SEQ ID NO: 1587076 - RNA, 19 nt, Homo sapiens
augcucaguuggugcugcu

SEQ ID NO: 1587077 - RNA, 21 nt, Homo sapiens
augcucaguuggugcugcuuu

SEQ ID NO: 1587078 - RNA, 16 nt, Homo sapiens
augcucauugaacuuu

SEQ ID NO: 1587079 - RNA, 17 nt, Homo sapiens
augcucccagcugugcu

SEQ ID NO: 1587080 - RNA, 18 nt, Homo sapiens
augcucucucaccugcuc

SEQ ID NO: 1587081 - RNA, 18 nt, Homo sapiens
augcugaaaaauauagcc

SEQ ID NO: 1587082 - RNA, 15 nt, Homo sapiens
augcugcacagaaau

SEQ ID NO: 1587083 - RNA, 23 nt, Homo sapiens
augcugcugagguuuugaaagaa

SEQ ID NO: 1587084 - RNA, 15 nt, Homo sapiens
augcuggcugaagag

SEQ ID NO: 1587085 - RNA, 18 nt, Homo sapiens
augcuggggacacagcau

SEQ ID NO: 1587086 - RNA, 20 nt, Homo sapiens
augcuggggacacagcauca

SEQ ID NO: 1587087 - RNA, 16 nt, Homo sapiens
augcugucaugguccu

SEQ ID NO: 1587088 - RNA, 22 nt, Homo sapiens
augcugucuuaauucuuuucac

SEQ ID NO: 1587089 - RNA, 17 nt, Homo sapiens
augcuguggguuuccaa

SEQ ID NO: 1587090 - RNA, 21 nt, Homo sapiens
augcuguuaguaccuacauca

SEQ ID NO: 1587091 - RNA, 19 nt, Homo sapiens
augcuguuuuauauguaga

SEQ ID NO: 1587092 - RNA, 14 nt, Homo sapiens
augcuucaugugcu

SEQ ID NO: 1587093 - RNA, 20 nt, Homo sapiens
augcuuccagcuaacagguc

SEQ ID NO: 1587094 - RNA, 14 nt, Homo sapiens
augcuuuccugcac

SEQ ID NO: 1587095 - RNA, 20 nt, Homo sapiens
auggaaagucaugcaauccc

SEQ ID NO: 1587096 - RNA, 16 nt, Homo sapiens
auggaacaucagugga

SEQ ID NO: 1587097 - RNA, 11 nt, Homo sapiens
auggaccucag

SEQ ID NO: 1587098 - RNA, 16 nt, Homo sapiens
auggacucucuaagga

SEQ ID NO: 1587099 - RNA, 15 nt, Homo sapiens
auggaggaacaguau

SEQ ID NO: 1587100 - RNA, 14 nt, Homo sapiens
auggauaaagauga

SEQ ID NO: 1587101 - RNA, 13 nt, Homo sapiens
auggauacauaaa

SEQ ID NO: 1587102 - RNA, 12 nt, Homo sapiens
auggaucagauc

SEQ ID NO: 1587103 - RNA, 18 nt, Homo sapiens
auggaucccuggggccaa

SEQ ID NO: 1587104 - RNA, 18 nt, Homo sapiens
auggaugcaucacacuca

SEQ ID NO: 1587105 - RNA, 20 nt, Homo sapiens
auggauugggggggccaaaa

SEQ ID NO: 1587106 - RNA, 21 nt, Homo sapiens
auggcagaagggaauugcuca

SEQ ID NO: 1587107 - RNA, 17 nt, Homo sapiens
auggcagcugguugcuc

SEQ ID NO: 1587108 - RNA, 13 nt, Homo sapiens
auucauuccucac

SEQ ID NO: 1587109 - RNA, 21 nt, Homo sapiens
auucauuguguuaccuguaga

SEQ ID NO: 1587110 - RNA, 13 nt, Homo sapiens
auuccaaacuuua

SEQ ID NO: 1587111 - RNA, 12 nt, Homo sapiens
auuccaaagcaa

SEQ ID NO: 1587112 - RNA, 15 nt, Homo sapiens
auuccaggaacacau

SEQ ID NO: 1587113 - RNA, 23 nt, Homo sapiens
auuccagguagcucggcaccaac

SEQ ID NO: 1587114 - RNA, 13 nt, Homo sapiens
auuccccuaggcu

SEQ ID NO: 1587115 - RNA, 14 nt, Homo sapiens
auucccugcacaca

SEQ ID NO: 1587116 - RNA, 17 nt, Homo sapiens
auuccuaaaaugcuuca

SEQ ID NO: 1587117 - RNA, 16 nt, Homo sapiens
auuccuaccauacaau

SEQ ID NO: 1587118 - RNA, 23 nt, Homo sapiens
auuccuagaaauugaacaaaaau

SEQ ID NO: 1587119 - RNA, 16 nt, Homo sapiens
auuccucacaaugagg

SEQ ID NO: 1587120 - RNA, 17 nt, Homo sapiens
auuccucaugucaucaa

SEQ ID NO: 1587121 - RNA, 19 nt, Homo sapiens
auuccugcccaaacagcug

SEQ ID NO: 1587122 - RNA, 22 nt, Homo sapiens
auuccugcccaaacagcuguau

SEQ ID NO: 1587123 - RNA, 15 nt, Homo sapiens
auuccugccuggucc

SEQ ID NO: 1587124 - RNA, 17 nt, Homo sapiens
auuccugugcggacagc

SEQ ID NO: 1587125 - RNA, 17 nt, Homo sapiens
auuccuguuugucuaca

SEQ ID NO: 1587126 - RNA, 14 nt, Homo sapiens
auuccuucacacag

SEQ ID NO: 1587127 - RNA, 13 nt, Homo sapiens
auuccuucacuca

SEQ ID NO: 1587128 - RNA, 18 nt, Homo sapiens
auuccuucacucauccag

SEQ ID NO: 1587129 - RNA, 21 nt, Homo sapiens
auuccuugaggacagaccuua

SEQ ID NO: 1587130 - RNA, 18 nt, Homo sapiens
auuccuuuuucuaugaaa

SEQ ID NO: 1587131 - RNA, 16 nt, Homo sapiens
auucgggccauuuccg

SEQ ID NO: 1587132 - RNA, 14 nt, Homo sapiens
auucggugugcugc

SEQ ID NO: 1587133 - RNA, 22 nt, Homo sapiens
auucuaacccagguauccaaaa

SEQ ID NO: 1587134 - RNA, 13 nt, Homo sapiens
auucuacagugau

SEQ ID NO: 1587135 - RNA, 17 nt, Homo sapiens
auucuaggaugaacaau

SEQ ID NO: 1587136 - RNA, 21 nt, Homo sapiens
auucuauuacauuuucaguga

SEQ ID NO: 1587137 - RNA, 21 nt, Homo sapiens
auucucacuccaccacccaaa

SEQ ID NO: 1587138 - RNA, 16 nt, Homo sapiens
auucucauaugacuaa

SEQ ID NO: 1587139 - RNA, 24 nt, Homo sapiens
auucucauuaaaagaauaucuggc

SEQ ID NO: 1587140 - RNA, 19 nt, Homo sapiens
auucuccuccuauugccuc

SEQ ID NO: 1587141 - RNA, 21 nt, Homo sapiens
auucuccuccuauugccucca

SEQ ID NO: 1587142 - RNA, 17 nt, Homo sapiens
auucucgcuucccugaa

SEQ ID NO: 1587143 - RNA, 19 nt, Homo sapiens
auucucugucucauccauc

SEQ ID NO: 1587144 - RNA, 12 nt, Homo sapiens
auucugaacaau

SEQ ID NO: 1587145 - RNA, 13 nt, Homo sapiens
auucugcacucag

SEQ ID NO: 1587146 - RNA, 14 nt, Homo sapiens
auucugccaaagua

SEQ ID NO: 1587147 - RNA, 13 nt, Homo sapiens
auucugcuaccaa

SEQ ID NO: 1587148 - RNA, 14 nt, Homo sapiens
auucugcuaccaau

SEQ ID NO: 1587149 - RNA, 20 nt, Homo sapiens
auucugcuacuucacuguca

SEQ ID NO: 1587150 - RNA, 17 nt, Homo sapiens
auucuguuauauagugg

SEQ ID NO: 1587151 - RNA, 17 nt, Homo sapiens
auucuucugaccaucua

SEQ ID NO: 1587152 - RNA, 22 nt, Homo sapiens
auucuugagggacaaugccaau

SEQ ID NO: 1587153 - RNA, 22 nt, Homo sapiens
auucuuguuugaauuccuccuc

SEQ ID NO: 1587154 - RNA, 21 nt, Homo sapiens
auucuuuaucccauuuuauca

SEQ ID NO: 1587155 - RNA, 16 nt, Homo sapiens
auucuuuaucuugcaa

SEQ ID NO: 1587156 - RNA, 17 nt, Homo sapiens
auucuuucccaacaccu

SEQ ID NO: 1587157 - RNA, 19 nt, Homo sapiens
auucuuucccaacaccucu

SEQ ID NO: 1587158 - RNA, 16 nt, Homo sapiens
auucuuucccagugag

SEQ ID NO: 1587159 - RNA, 16 nt, Homo sapiens
auucuuuuaaugccac

SEQ ID NO: 1587160 - RNA, 14 nt, Homo sapiens
auucuuuuguucua

SEQ ID NO: 1587161 - RNA, 20 nt, Homo sapiens
auucuuuuuuaauaaacuac

SEQ ID NO: 1587162 - RNA, 21 nt, Homo sapiens
auugaaaauuuuuaaauauuc

SEQ ID NO: 1587163 - RNA, 16 nt, Homo sapiens
auugaaaccauugugg

SEQ ID NO: 1587164 - RNA, 23 nt, Homo sapiens
auugaaauaaaugacaauguaau

SEQ ID NO: 1587165 - RNA, 16 nt, Homo sapiens
auugaaauuuugcacc

SEQ ID NO: 1587166 - RNA, 15 nt, Homo sapiens
auugaacacaaacug

SEQ ID NO: 1587167 - RNA, 14 nt, Homo sapiens
auugaagcuuugug

SEQ ID NO: 1587168 - RNA, 15 nt, Homo sapiens
auugaaguuguuuau

SEQ ID NO: 1587169 - RNA, 12 nt, Homo sapiens
auugaaugaaac

SEQ ID NO: 1587170 - RNA, 18 nt, Homo sapiens
auugaauguuaaugguca

SEQ ID NO: 1587171 - RNA, 22 nt, Homo sapiens
auugacacagaaaauguugaga

SEQ ID NO: 1587172 - RNA, 20 nt, Homo sapiens
auugacuaacaggccaaaga

SEQ ID NO: 1587173 - RNA, 21 nt, Homo sapiens
auugacucaaucuuugccuaa

SEQ ID NO: 1587174 - RNA, 15 nt, Homo sapiens
auugacuccuuucca

SEQ ID NO: 1587175 - RNA, 16 nt, Homo sapiens
auugagaccugaguga

SEQ ID NO: 1587176 - RNA, 19 nt, Homo sapiens
auugagcagaauucauuca

SEQ ID NO: 1587177 - RNA, 21 nt, Homo sapiens
auugaguuccaguugaaguua

SEQ ID NO: 1587178 - RNA, 18 nt, Homo sapiens
auugauagcagauaucac

SEQ ID NO: 1587179 - RNA, 23 nt, Homo sapiens
auugauagcagauaucacgacag

SEQ ID NO: 1587180 - RNA, 18 nt, Homo sapiens
auugauagucaauaucaa

SEQ ID NO: 1587181 - RNA, 23 nt, Homo sapiens
auugauauacacggaugacuuaa

SEQ ID NO: 1587182 - RNA, 15 nt, Homo sapiens
auugaucaccaugaa

SEQ ID NO: 1587183 - RNA, 15 nt, Homo sapiens
auugaugagcaagac

SEQ ID NO: 1587184 - RNA, 16 nt, Homo sapiens
auugauuaaugaacua

SEQ ID NO: 1587185 - RNA, 22 nt, Homo sapiens
auugauuaaugaacuauuguua

SEQ ID NO: 1587186 - RNA, 15 nt, Homo sapiens
auugauuacuaucau

SEQ ID NO: 1587187 - RNA, 18 nt, Homo sapiens
auugcaaagauguuuaca

SEQ ID NO: 1587188 - RNA, 22 nt, Homo sapiens
auugcaacucuuuuaagugccu

SEQ ID NO: 1587189 - RNA, 16 nt, Homo sapiens
auugcaccacugcacu

SEQ ID NO: 1587190 - RNA, 20 nt, Homo sapiens
auugcaccuaucucagccau

SEQ ID NO: 1587191 - RNA, 16 nt, Homo sapiens
auugcaggagucccug

SEQ ID NO: 1587192 - RNA, 17 nt, Homo sapiens
auugcaucccaaaccac

SEQ ID NO: 1587193 - RNA, 15 nt, Homo sapiens
auugccaagugccau

SEQ ID NO: 1587194 - RNA, 12 nt, Homo sapiens
auugcccaugau

SEQ ID NO: 1587195 - RNA, 21 nt, Homo sapiens
auugccccuggcuuugccucu

SEQ ID NO: 1587196 - RNA, 16 nt, Homo sapiens
auugccuagcucuuuu

SEQ ID NO: 1587197 - RNA, 12 nt, Homo sapiens
auugcuauuacu

SEQ ID NO: 1587198 - RNA, 17 nt, Homo sapiens
auugcucagagaaggaa

SEQ ID NO: 1587199 - RNA, 18 nt, Homo sapiens
auugcucuauauguaaua

SEQ ID NO: 1587200 - RNA, 16 nt, Homo sapiens
auugcugauaugcaag

SEQ ID NO: 1587201 - RNA, 22 nt, Homo sapiens
auugcugugucuccucucagag

SEQ ID NO: 1587202 - RNA, 16 nt, Homo sapiens
auugcuuccuguguaa

SEQ ID NO: 1587203 - RNA, 14 nt, Homo sapiens
auugcuugagccca

SEQ ID NO: 1587204 - RNA, 15 nt, Homo sapiens
auugcuugagcucag

SEQ ID NO: 1587205 - RNA, 12 nt, Homo sapiens
auugcuuugcca

SEQ ID NO: 1587206 - RNA, 15 nt, Homo sapiens
auugcuuugccaaaa

SEQ ID NO: 1587207 - RNA, 18 nt, Homo sapiens
auuggaauucuacuggaa

SEQ ID NO: 1587208 - RNA, 19 nt, Homo sapiens
auuggaauucuacuggaaa

SEQ ID NO: 1587209 - RNA, 17 nt, Homo sapiens
auuggagaagauuuaug

SEQ ID NO: 1587210 - RNA, 11 nt, Homo sapiens
auuggcaaagu

SEQ ID NO: 1587211 - RNA, 17 nt, Homo sapiens
auuggccuccaaacaca

SEQ ID NO: 1587212 - RNA, 20 nt, Homo sapiens
auugggacuccaugcuccuu

SEQ ID NO: 1587213 - RNA, 15 nt, Homo sapiens
auugggcaggugaaa

SEQ ID NO: 1587214 - RNA, 18 nt, Homo sapiens
auugggggggccaaaagg

SEQ ID NO: 1587215 - RNA, 18 nt, Homo sapiens
auugguguugacauacau

SEQ ID NO: 1587216 - RNA, 15 nt, Homo sapiens
auugguuuugcagaa

SEQ ID NO: 1587217 - RNA, 22 nt, Homo sapiens
auuguaaaaugcacccaucagu

SEQ ID NO: 1587218 - RNA, 13 nt, Homo sapiens
auuguaacgacuu

SEQ ID NO: 1587219 - RNA, 21 nt, Homo sapiens
auuguauuccucaugucauca

SEQ ID NO: 1587220 - RNA, 21 nt, Homo sapiens
auuguauuuaccuucuaccuc

SEQ ID NO: 1587221 - RNA, 14 nt, Homo sapiens
auugucacagauga

SEQ ID NO: 1587222 - RNA, 13 nt, Homo sapiens
auugucaccauga

SEQ ID NO: 1587223 - RNA, 16 nt, Homo sapiens
auuguccccaaugaau

SEQ ID NO: 1587224 - RNA, 12 nt, Homo sapiens
auugucccugaa

SEQ ID NO: 1587225 - RNA, 22 nt, Homo sapiens
auugucgaaaagagucuuccaa

SEQ ID NO: 1587226 - RNA, 9 nt, Homo sapiens
ccucaggcu

SEQ ID NO: 1587227 - RNA, 23 nt, Homo sapiens
ccucagggacagagacaccugca

SEQ ID NO: 1587228 - RNA, 16 nt, Homo sapiens
ccucagggagugcaga

SEQ ID NO: 1587229 - RNA, 15 nt, Homo sapiens
ccucaguaggcauca

SEQ ID NO: 1587230 - RNA, 16 nt, Homo sapiens
ccucagugagaagcca

SEQ ID NO: 1587231 - RNA, 12 nt, Homo sapiens
ccucaguucucu

SEQ ID NO: 1587232 - RNA, 20 nt, Homo sapiens
ccucaguuuccucaucugca

SEQ ID NO: 1587233 - RNA, 22 nt, Homo sapiens
ccucaguuuccucaucugcaaa

SEQ ID NO: 1587234 - RNA, 20 nt, Homo sapiens
ccucauauggcccaguguca

SEQ ID NO: 1587235 - RNA, 14 nt, Homo sapiens
ccucaucaucagag

SEQ ID NO: 1587236 - RNA, 15 nt, Homo sapiens
ccucauccagccuca

SEQ ID NO: 1587237 - RNA, 19 nt, Homo sapiens
ccucaucugcaaaauggga

SEQ ID NO: 1587238 - RNA, 22 nt, Homo sapiens
ccucauucuacuaaugugaugc

SEQ ID NO: 1587239 - RNA, 16 nt, Homo sapiens
ccuccaaaggucugau

SEQ ID NO: 1587240 - RNA, 20 nt, Homo sapiens
ccuccaaauguccuuucuca

SEQ ID NO: 1587241 - RNA, 21 nt, Homo sapiens
ccuccaacaacgacacauuca

SEQ ID NO: 1587242 - RNA, 12 nt, Homo sapiens
ccuccaagcaca

SEQ ID NO: 1587243 - RNA, 23 nt, Homo sapiens
ccuccacagagaggaggggacca

SEQ ID NO: 1587244 - RNA, 19 nt, Homo sapiens
ccuccacucuaguucuaga

SEQ ID NO: 1587245 - RNA, 18 nt, Homo sapiens
ccuccagagauuugcuca

SEQ ID NO: 1587246 - RNA, 11 nt, Homo sapiens
ccuccaucuca

SEQ ID NO: 1587247 - RNA, 14 nt, Homo sapiens
ccuccauuccccac

SEQ ID NO: 1587248 - RNA, 20 nt, Homo sapiens
ccucccaaagugcugagauu

SEQ ID NO: 1587249 - RNA, 20 nt, Homo sapiens
ccucccaaagugcugggauu

SEQ ID NO: 1587250 - RNA, 18 nt, Homo sapiens
ccucccaaggagaacaaa

SEQ ID NO: 1587251 - RNA, 19 nt, Homo sapiens
ccucccaagguccucucag

SEQ ID NO: 1587252 - RNA, 12 nt, Homo sapiens
ccucccacaauu

SEQ ID NO: 1587253 - RNA, 21 nt, Homo sapiens
ccucccauaauugcuuugcca

SEQ ID NO: 1587254 - RNA, 14 nt, Homo sapiens
ccuccccaacuccc

SEQ ID NO: 1587255 - RNA, 15 nt, Homo sapiens
ccuccccagauauca

SEQ ID NO: 1587256 - RNA, 16 nt, Homo sapiens
ccucccccaugggcug

SEQ ID NO: 1587257 - RNA, 20 nt, Homo sapiens
ccucccccuuucacacugga

SEQ ID NO: 1587258 - RNA, 18 nt, Homo sapiens
ccuccccgugccaaaaau

SEQ ID NO: 1587259 - RNA, 15 nt, Homo sapiens
ccuccccuuccuguu

SEQ ID NO: 1587260 - RNA, 14 nt, Homo sapiens
ccucccgggcucaa

SEQ ID NO: 1587261 - RNA, 14 nt, Homo sapiens
ccucccuacaggcc

SEQ ID NO: 1587262 - RNA, 18 nt, Homo sapiens
ccucccuuguggcagcaa

SEQ ID NO: 1587263 - RNA, 16 nt, Homo sapiens
ccuccgaccacuucca

SEQ ID NO: 1587264 - RNA, 21 nt, Homo sapiens
ccuccgugagcaccaccaggg

SEQ ID NO: 1587265 - RNA, 20 nt, Homo sapiens
ccuccuacccuuccagugcc

SEQ ID NO: 1587266 - RNA, 13 nt, Homo sapiens
ccuccucaccucu

SEQ ID NO: 1587267 - RNA, 13 nt, Homo sapiens
ccuccucccucag

SEQ ID NO: 1587268 - RNA, 20 nt, Homo sapiens
ccuccucugccuacagccag

SEQ ID NO: 1587269 - RNA, 15 nt, Homo sapiens
ccuccugagcucuga

SEQ ID NO: 1587270 - RNA, 24 nt, Homo sapiens
ccuccuucauaugaaaggugccau

SEQ ID NO: 1587271 - RNA, 14 nt, Homo sapiens
ccuccuugugccuu

SEQ ID NO: 1587272 - RNA, 13 nt, Homo sapiens
ccucggacugugu

SEQ ID NO: 1587273 - RNA, 21 nt, Homo sapiens
ccucgucaagagcaugcacau

SEQ ID NO: 1587274 - RNA, 17 nt, Homo sapiens
ccucuaaauagcacuuu

SEQ ID NO: 1587275 - RNA, 19 nt, Homo sapiens
ccucuaacagcacagggaa

SEQ ID NO: 1587276 - RNA, 16 nt, Homo sapiens
ccucucaacauuacca

SEQ ID NO: 1587277 - RNA, 14 nt, Homo sapiens
ccucucacuuucag

SEQ ID NO: 1587278 - RNA, 20 nt, Homo sapiens
ccucucagcugcuggaugac

SEQ ID NO: 1587279 - RNA, 12 nt, Homo sapiens
ccucucauucca

SEQ ID NO: 1587280 - RNA, 15 nt, Homo sapiens
ccucuccaggcauuu

SEQ ID NO: 1587281 - RNA, 15 nt, Homo sapiens
ccucucccugccaag

SEQ ID NO: 1587282 - RNA, 16 nt, Homo sapiens
ccucucggugcuccau

SEQ ID NO: 1587283 - RNA, 22 nt, Homo sapiens
ccucucucuaucccugaaaucc

SEQ ID NO: 1587284 - RNA, 14 nt, Homo sapiens
ccucucucugcucc

SEQ ID NO: 1587285 - RNA, 13 nt, Homo sapiens
ccucucuuucaca

SEQ ID NO: 1587286 - RNA, 15 nt, Homo sapiens
ccucucuuucucugg

SEQ ID NO: 1587287 - RNA, 12 nt, Homo sapiens
ccucucuuugac

SEQ ID NO: 1587288 - RNA, 14 nt, Homo sapiens
ccucugaaacagcu

SEQ ID NO: 1587289 - RNA, 12 nt, Homo sapiens
ccucugacucag

SEQ ID NO: 1587290 - RNA, 12 nt, Homo sapiens
ccucugccucaa

SEQ ID NO: 1587291 - RNA, 13 nt, Homo sapiens
ccucugcuucuca

SEQ ID NO: 1587292 - RNA, 21 nt, Homo sapiens
ccucuggacaagucaucugca

SEQ ID NO: 1587293 - RNA, 23 nt, Homo sapiens
ccucuggauccagccaugccuga

SEQ ID NO: 1587294 - RNA, 17 nt, Homo sapiens
ccucugugccauggaug

SEQ ID NO: 1587295 - RNA, 19 nt, Homo sapiens
ccucuuuccuuccuuccuc

SEQ ID NO: 1587296 - RNA, 17 nt, Homo sapiens
ccucuuuuuagggcuaa

SEQ ID NO: 1587297 - RNA, 19 nt, Homo sapiens
ccugaaacccaguaauucu

SEQ ID NO: 1587298 - RNA, 21 nt, Homo sapiens
ccugaaauccaggaagucccu

SEQ ID NO: 1587299 - RNA, 13 nt, Homo sapiens
ccugaacugcuuu

SEQ ID NO: 1587300 - RNA, 19 nt, Homo sapiens
ccugaacuuucucccucau

SEQ ID NO: 1587301 - RNA, 20 nt, Homo sapiens
ccugaaggaaaauaaacuga

SEQ ID NO: 1587302 - RNA, 17 nt, Homo sapiens
ccugaaggcaccuguca

SEQ ID NO: 1587303 - RNA, 23 nt, Homo sapiens
ccugaaguucuuggauuacuuua

SEQ ID NO: 1587304 - RNA, 17 nt, Homo sapiens
ccugacacggacugugc

SEQ ID NO: 1587305 - RNA, 13 nt, Homo sapiens
ccugaccagucag

SEQ ID NO: 1587306 - RNA, 15 nt, Homo sapiens
ccugaccaugcauuu

SEQ ID NO: 1587307 - RNA, 18 nt, Homo sapiens
ccugacuccuccaaggaa

SEQ ID NO: 1587308 - RNA, 14 nt, Homo sapiens
ccugacuggccaaa

SEQ ID NO: 1587309 - RNA, 13 nt, Homo sapiens
ccugacuuccucu

SEQ ID NO: 1587310 - RNA, 14 nt, Homo sapiens
ccugagaaggcaaa

SEQ ID NO: 1587311 - RNA, 13 nt, Homo sapiens
ccugagaccucua

SEQ ID NO: 1587312 - RNA, 23 nt, Homo sapiens
ccugagagauuuaacauuaucua

SEQ ID NO: 1587313 - RNA, 19 nt, Homo sapiens
ccugagauucagaugucau

SEQ ID NO: 1587314 - RNA, 16 nt, Homo sapiens
ccugagauuucaucug

SEQ ID NO: 1587315 - RNA, 17 nt, Homo sapiens
ccugagauuucaucugc

SEQ ID NO: 1587316 - RNA, 17 nt, Homo sapiens
ccugagccccucaaucc

SEQ ID NO: 1587317 - RNA, 14 nt, Homo sapiens
ccugagcuuuaugg

SEQ ID NO: 1587318 - RNA, 21 nt, Homo sapiens
ccugaggacacccaggccacc

SEQ ID NO: 1587319 - RNA, 20 nt, Homo sapiens
ccugagguuugccagcauuu

SEQ ID NO: 1587320 - RNA, 22 nt, Homo sapiens
ccugaguaauaagcaugguguc

SEQ ID NO: 1587321 - RNA, 21 nt, Homo sapiens
ccugaucagagccgugguccu

SEQ ID NO: 1587322 - RNA, 21 nt, Homo sapiens
ccugaucuuugggcaucagaa

SEQ ID NO: 1587323 - RNA, 14 nt, Homo sapiens
ccugauguguccuc

SEQ ID NO: 1587324 - RNA, 10 nt, Homo sapiens
ccugcaaaac

SEQ ID NO: 1587325 - RNA, 17 nt, Homo sapiens
ccugcaaaaggacucuc

SEQ ID NO: 1587326 - RNA, 15 nt, Homo sapiens
ccugcaaaccuuccu

SEQ ID NO: 1587327 - RNA, 13 nt, Homo sapiens
ccugcaauuccac

SEQ ID NO: 1587328 - RNA, 18 nt, Homo sapiens
ccugcacaaccuggauuu

SEQ ID NO: 1587329 - RNA, 12 nt, Homo sapiens
ccugcacaccag

SEQ ID NO: 1587330 - RNA, 13 nt, Homo sapiens
ccugcaccuccca

SEQ ID NO: 1587331 - RNA, 13 nt, Homo sapiens
ccugcagaccuca

SEQ ID NO: 1587332 - RNA, 18 nt, Homo sapiens
ccugcagaccucaagcca

SEQ ID NO: 1587333 - RNA, 17 nt, Homo sapiens
ccugcaggcaggaacaa

SEQ ID NO: 1587334 - RNA, 23 nt, Homo sapiens
ccugcagggccaauggccuggug

SEQ ID NO: 1587335 - RNA, 19 nt, Homo sapiens
ccugcaguuugacuucuuu

SEQ ID NO: 1587336 - RNA, 14 nt, Homo sapiens
ccugccacagccag

SEQ ID NO: 1587337 - RNA, 17 nt, Homo sapiens
ccugccagccacuguca

SEQ ID NO: 1587338 - RNA, 10 nt, Homo sapiens
ccugccauuc

SEQ ID NO: 1587339 - RNA, 23 nt, Homo sapiens
ccugcccaggguuggcaugacug

SEQ ID NO: 1587340 - RNA, 15 nt, Homo sapiens
ccugcccaugugucc

SEQ ID NO: 1587341 - RNA, 21 nt, Homo sapiens
ccugccccagauuuacuaaau

SEQ ID NO: 1587342 - RNA, 17 nt, Homo sapiens
ccugcccuguccaaaag

SEQ ID NO: 1587343 - RNA, 23 nt, Homo sapiens
ccugccucccacuucacugcgaa

SEQ ID NO: 1587344 - RNA, 21 nt, Homo sapiens
ccugcgcagucauuggcccaa

SEQ ID NO: 1587345 - RNA, 15 nt, Homo sapiens
cguucaucaccugcu

SEQ ID NO: 1587346 - RNA, 18 nt, Homo sapiens
cguugagaaucacugcuc

SEQ ID NO: 1587347 - RNA, 20 nt, Homo sapiens
cguugcccaagguugcacag

SEQ ID NO: 1587348 - RNA, 12 nt, Homo sapiens
cguugucccuga

SEQ ID NO: 1587349 - RNA, 22 nt, Homo sapiens
cguuguuuugguuguacuuugg

SEQ ID NO: 1587350 - RNA, 19 nt, Homo sapiens
cguuucucuauuguaucca

SEQ ID NO: 1587351 - RNA, 12 nt, Homo sapiens
cguuugcuauau

SEQ ID NO: 1587352 - RNA, 16 nt, Homo sapiens
cguuuuucuggugcuu

SEQ ID NO: 1587353 - RNA, 16 nt, Homo sapiens
cuaaaaagaagccaca

SEQ ID NO: 1587354 - RNA, 17 nt, Homo sapiens
cuaaaaagaagccacag

SEQ ID NO: 1587355 - RNA, 18 nt, Homo sapiens
cuaaaaaugaaaauucua

SEQ ID NO: 1587356 - RNA, 18 nt, Homo sapiens
cuaaaacuuaacauucau

SEQ ID NO: 1587357 - RNA, 18 nt, Homo sapiens
cuaaaagcuuucaugucc

SEQ ID NO: 1587358 - RNA, 19 nt, Homo sapiens
cuaaaauagcaauaacuga

SEQ ID NO: 1587359 - RNA, 19 nt, Homo sapiens
cuaaaaucuaaaauuucau

SEQ ID NO: 1587360 - RNA, 14 nt, Homo sapiens
cuaaaauguucuaa

SEQ ID NO: 1587361 - RNA, 20 nt, Homo sapiens
cuaaaccaagauuaugugac

SEQ ID NO: 1587362 - RNA, 22 nt, Homo sapiens
cuaaacuaguuuuuccuaucau

SEQ ID NO: 1587363 - RNA, 17 nt, Homo sapiens
cuaaacucucuagcuua

SEQ ID NO: 1587364 - RNA, 20 nt, Homo sapiens
cuaaacuucaccuacauuau

SEQ ID NO: 1587365 - RNA, 18 nt, Homo sapiens
cuaaacuuuccaaaaccu

SEQ ID NO: 1587366 - RNA, 21 nt, Homo sapiens
cuaaagaaaaauaucuuggcc

SEQ ID NO: 1587367 - RNA, 14 nt, Homo sapiens
cuaaagacaugaag

SEQ ID NO: 1587368 - RNA, 18 nt, Homo sapiens
cuaaagacuaacuugaaa

SEQ ID NO: 1587369 - RNA, 22 nt, Homo sapiens
cuaaagaguuauucaaaugaag

SEQ ID NO: 1587370 - RNA, 13 nt, Homo sapiens
cuaaagcaagccu

SEQ ID NO: 1587371 - RNA, 15 nt, Homo sapiens
cuaaagcaauaugca

SEQ ID NO: 1587372 - RNA, 18 nt, Homo sapiens
cuaaaggacucuccagcc

SEQ ID NO: 1587373 - RNA, 16 nt, Homo sapiens
cuaaagguguuuugua

SEQ ID NO: 1587374 - RNA, 18 nt, Homo sapiens
cuaaagguuaccuguugu

SEQ ID NO: 1587375 - RNA, 19 nt, Homo sapiens
cuaaaguaugguacaucua

SEQ ID NO: 1587376 - RNA, 16 nt, Homo sapiens
cuaaaguauguuuuca

SEQ ID NO: 1587377 - RNA, 19 nt, Homo sapiens
cuaaaguccagacuaugga

SEQ ID NO: 1587378 - RNA, 11 nt, Homo sapiens
cuaaaguuaua

SEQ ID NO: 1587379 - RNA, 20 nt, Homo sapiens
cuaaauaaauuucccaguua

SEQ ID NO: 1587380 - RNA, 16 nt, Homo sapiens
cuaaauaugugacuga

SEQ ID NO: 1587381 - RNA, 17 nt, Homo sapiens
cuaaaucuccaguacuu

SEQ ID NO: 1587382 - RNA, 20 nt, Homo sapiens
cuaaaugcagacaacaccuu

SEQ ID NO: 1587383 - RNA, 20 nt, Homo sapiens
cuaaauuacagugcaguuua

SEQ ID NO: 1587384 - RNA, 23 nt, Homo sapiens
cuaaauuauuuacugcaaaaaga

SEQ ID NO: 1587385 - RNA, 15 nt, Homo sapiens
cuaacaggccaaaga

SEQ ID NO: 1587386 - RNA, 16 nt, Homo sapiens
cuaacaguaguugcaa

SEQ ID NO: 1587387 - RNA, 14 nt, Homo sapiens
cuaacauagauuua

SEQ ID NO: 1587388 - RNA, 12 nt, Homo sapiens
cuaaccaagaga

SEQ ID NO: 1587389 - RNA, 14 nt, Homo sapiens
cuaaccccauuccu

SEQ ID NO: 1587390 - RNA, 22 nt, Homo sapiens
cuaaccugccgagaguccauca

SEQ ID NO: 1587391 - RNA, 22 nt, Homo sapiens
cuaacuugaaaagaaaaccaca

SEQ ID NO: 1587392 - RNA, 23 nt, Homo sapiens
cuaagaauguacaguugagcuca

SEQ ID NO: 1587393 - RNA, 19 nt, Homo sapiens
cuaagaaugucuauuucca

SEQ ID NO: 1587394 - RNA, 16 nt, Homo sapiens
cuaagagaacaaugug

SEQ ID NO: 1587395 - RNA, 15 nt, Homo sapiens
cuaagcacauuccaa

SEQ ID NO: 1587396 - RNA, 13 nt, Homo sapiens
cuaaggaaccuuc

SEQ ID NO: 1587397 - RNA, 17 nt, Homo sapiens
cuaaggcagcugaucca

SEQ ID NO: 1587398 - RNA, 21 nt, Homo sapiens
cuaaggccuuuuauguaauuu

SEQ ID NO: 1587399 - RNA, 22 nt, Homo sapiens
cuaaggcuguccacguacuuaa

SEQ ID NO: 1587400 - RNA, 14 nt, Homo sapiens
cuaagugccuccaa

SEQ ID NO: 1587401 - RNA, 17 nt, Homo sapiens
cuaauaaauaaucaucc

SEQ ID NO: 1587402 - RNA, 22 nt, Homo sapiens
cuaauagaauaaaggcaguuuu

SEQ ID NO: 1587403 - RNA, 16 nt, Homo sapiens
cuaauagucuuugcca

SEQ ID NO: 1587404 - RNA, 17 nt, Homo sapiens
cuaauagucuuugccag

SEQ ID NO: 1587405 - RNA, 12 nt, Homo sapiens
cuaauauauuaa

SEQ ID NO: 1587406 - RNA, 13 nt, Homo sapiens
cuaauaugauuau

SEQ ID NO: 1587407 - RNA, 22 nt, Homo sapiens
cuaauccuugcuauuaagaauu

SEQ ID NO: 1587408 - RNA, 17 nt, Homo sapiens
cuaaucuaacaauggaa

SEQ ID NO: 1587409 - RNA, 18 nt, Homo sapiens
cuaaugagagugcacugc

SEQ ID NO: 1587410 - RNA, 23 nt, Homo sapiens
cuaaugucacaacauggugcuac

SEQ ID NO: 1587411 - RNA, 11 nt, Homo sapiens
cuaaugugcag

SEQ ID NO: 1587412 - RNA, 21 nt, Homo sapiens
cuaaugugcuucuaguaggca

SEQ ID NO: 1587413 - RNA, 18 nt, Homo sapiens
cuaauguugcuggaucag

SEQ ID NO: 1587414 - RNA, 13 nt, Homo sapiens
cuaauguuuacua

SEQ ID NO: 1587415 - RNA, 16 nt, Homo sapiens
cuaauguuuacuauau

SEQ ID NO: 1587416 - RNA, 18 nt, Homo sapiens
cuaauuauacuacuuugu

SEQ ID NO: 1587417 - RNA, 17 nt, Homo sapiens
cuaauucacagugcucu

SEQ ID NO: 1587418 - RNA, 17 nt, Homo sapiens
cuaauuccacacccuca

SEQ ID NO: 1587419 - RNA, 23 nt, Homo sapiens
cuaauucggauuugccauagccu

SEQ ID NO: 1587420 - RNA, 23 nt, Homo sapiens
cuaauugucuuuguucugugauu

SEQ ID NO: 1587421 - RNA, 22 nt, Homo sapiens
cuaauuuuuaagaaauuuugcc

SEQ ID NO: 1587422 - RNA, 17 nt, Homo sapiens
cuaauuuuuuguuguuu

SEQ ID NO: 1587423 - RNA, 20 nt, Homo sapiens
cuacaaaaaaugcagaacuu

SEQ ID NO: 1587424 - RNA, 13 nt, Homo sapiens
cuacaaaaacaca

SEQ ID NO: 1587425 - RNA, 18 nt, Homo sapiens
cuacaaacguuugacaaa

SEQ ID NO: 1587426 - RNA, 23 nt, Homo sapiens
cuacaaaggaaauaucaaagugu

SEQ ID NO: 1587427 - RNA, 19 nt, Homo sapiens
cuacaagugcagcugugac

SEQ ID NO: 1587428 - RNA, 20 nt, Homo sapiens
cuacaauuuguuuuugcauu

SEQ ID NO: 1587429 - RNA, 14 nt, Homo sapiens
cuacacaauuuaau

SEQ ID NO: 1587430 - RNA, 11 nt, Homo sapiens
cuacacauguu

SEQ ID NO: 1587431 - RNA, 21 nt, Homo sapiens
cuacaccaaugaaaacaugua

SEQ ID NO: 1587432 - RNA, 16 nt, Homo sapiens
cuacacugggugcuga

SEQ ID NO: 1587433 - RNA, 14 nt, Homo sapiens
cuacagaaugcggc

SEQ ID NO: 1587434 - RNA, 16 nt, Homo sapiens
cuacagagagaaaaau

SEQ ID NO: 1587435 - RNA, 14 nt, Homo sapiens
cuacagauagaaaa

SEQ ID NO: 1587436 - RNA, 12 nt, Homo sapiens
cuacagggccaa

SEQ ID NO: 1587437 - RNA, 16 nt, Homo sapiens
cuacaguaaugaaaug

SEQ ID NO: 1587438 - RNA, 13 nt, Homo sapiens
cuacaguauauaa

SEQ ID NO: 1587439 - RNA, 10 nt, Homo sapiens
cuacauauau

SEQ ID NO: 1587440 - RNA, 15 nt, Homo sapiens
cuacauucuaaugca

SEQ ID NO: 1587441 - RNA, 19 nt, Homo sapiens
cuaccaagaacugaaggca

SEQ ID NO: 1587442 - RNA, 13 nt, Homo sapiens
cuaccagcauaaa

SEQ ID NO: 1587443 - RNA, 9 nt, Homo sapiens
cuaccccag

SEQ ID NO: 1587444 - RNA, 13 nt, Homo sapiens
cuaccuacauauu

SEQ ID NO: 1587445 - RNA, 14 nt, Homo sapiens
cuaccugagcauuc

SEQ ID NO: 1587446 - RNA, 18 nt, Homo sapiens
cuaccuggcagauacuca

SEQ ID NO: 1587447 - RNA, 13 nt, Homo sapiens
cuacuaaggggcu

SEQ ID NO: 1587448 - RNA, 23 nt, Homo sapiens
cuacucaggaggcugaggcagaa

SEQ ID NO: 1587449 - RNA, 12 nt, Homo sapiens
cuacuccaaaau

SEQ ID NO: 1587450 - RNA, 21 nt, Homo sapiens
cuacuccccuuaaucuaaucu

SEQ ID NO: 1587451 - RNA, 15 nt, Homo sapiens
cuacuccucugcagu

SEQ ID NO: 1587452 - RNA, 23 nt, Homo sapiens
cuacucucagguuuuugaggaaa

SEQ ID NO: 1587453 - RNA, 14 nt, Homo sapiens
cuacucugugccag

SEQ ID NO: 1587454 - RNA, 21 nt, Homo sapiens
cuacugaacaguccaucuucu

SEQ ID NO: 1587455 - RNA, 14 nt, Homo sapiens
cuacugaaugucau

SEQ ID NO: 1587456 - RNA, 19 nt, Homo sapiens
cuacugagggcaguucuga

SEQ ID NO: 1587457 - RNA, 17 nt, Homo sapiens
cuacugcucaagauaug

SEQ ID NO: 1587458 - RNA, 22 nt, Homo sapiens
cuacuggaaugguguuuuguca

SEQ ID NO: 1587459 - RNA, 20 nt, Homo sapiens
cuacuggggaggcugaggca

SEQ ID NO: 1587460 - RNA, 17 nt, Homo sapiens
cuacuggggaucagagu

SEQ ID NO: 1587461 - RNA, 15 nt, Homo sapiens
cuacuguacuauuua

SEQ ID NO: 1587462 - RNA, 16 nt, Homo sapiens
cuacuucuacauccaa

SEQ ID NO: 1587463 - RNA, 16 nt, Homo sapiens
cuacuugucauaucac

SEQ ID NO: 1587464 - RNA, 18 nt, Homo sapiens
gcauaaucaauauaaucu

SEQ ID NO: 1587465 - RNA, 14 nt, Homo sapiens
gcauacaaaauauu

SEQ ID NO: 1587466 - RNA, 21 nt, Homo sapiens
gcauaccaaguugauacuuga

SEQ ID NO: 1587467 - RNA, 22 nt, Homo sapiens
gcauagaaggaaguguguuugc

SEQ ID NO: 1587468 - RNA, 21 nt, Homo sapiens
gcauauguguaaagauuuaua

SEQ ID NO: 1587469 - RNA, 17 nt, Homo sapiens
gcauauuuguuacuuua

SEQ ID NO: 1587470 - RNA, 19 nt, Homo sapiens
gcaucagaccugcauugaa

SEQ ID NO: 1587471 - RNA, 23 nt, Homo sapiens
gcaucagcugcugaaacaacaaa

SEQ ID NO: 1587472 - RNA, 17 nt, Homo sapiens
gcaucaguagcaucugu

SEQ ID NO: 1587473 - RNA, 11 nt, Homo sapiens
gcaucauucac

SEQ ID NO: 1587474 - RNA, 20 nt, Homo sapiens
gcauccuuuaggguucugcc

SEQ ID NO: 1587475 - RNA, 20 nt, Homo sapiens
gcaucuauuuccucugugca

SEQ ID NO: 1587476 - RNA, 16 nt, Homo sapiens
gcaucucccugcaguu

SEQ ID NO: 1587477 - RNA, 16 nt, Homo sapiens
gcaucugacaggugaa

SEQ ID NO: 1587478 - RNA, 22 nt, Homo sapiens
gcaucuuuguugcuuauuacau

SEQ ID NO: 1587479 - RNA, 20 nt, Homo sapiens
gcaugaaagagaaagacuga

SEQ ID NO: 1587480 - RNA, 13 nt, Homo sapiens
gcaugagugcuga

SEQ ID NO: 1587481 - RNA, 18 nt, Homo sapiens
gcaugcaaaaaaugcuuu

SEQ ID NO: 1587482 - RNA, 20 nt, Homo sapiens
gcaugccauugaaacuaaga

SEQ ID NO: 1587483 - RNA, 14 nt, Homo sapiens
gcauggacauuuag

SEQ ID NO: 1587484 - RNA, 21 nt, Homo sapiens
gcauggugcagggagacaucu

SEQ ID NO: 1587485 - RNA, 23 nt, Homo sapiens
gcaugguggaacccccaucucua

SEQ ID NO: 1587486 - RNA, 13 nt, Homo sapiens
gcauguagacugu

SEQ ID NO: 1587487 - RNA, 12 nt, Homo sapiens
gcaugucauuug

SEQ ID NO: 1587488 - RNA, 13 nt, Homo sapiens
gcauuaaauucac

SEQ ID NO: 1587489 - RNA, 16 nt, Homo sapiens
gcauuaucagccuguu

SEQ ID NO: 1587490 - RNA, 14 nt, Homo sapiens
gcauugcagucaua

SEQ ID NO: 1587491 - RNA, 10 nt, Homo sapiens
gcauugcugg

SEQ ID NO: 1587492 - RNA, 20 nt, Homo sapiens
gcauugggguuccucuguac

SEQ ID NO: 1587493 - RNA, 21 nt, Homo sapiens
gcauuggugacucacuucaau

SEQ ID NO: 1587494 - RNA, 22 nt, Homo sapiens
gcauugguggcaucacagaccc

SEQ ID NO: 1587495 - RNA, 12 nt, Homo sapiens
gcauugucaaua

SEQ ID NO: 1587496 - RNA, 17 nt, Homo sapiens
gcauuuaugaugcaguu

SEQ ID NO: 1587497 - RNA, 18 nt, Homo sapiens
gcauuuaugaugcaguuu

SEQ ID NO: 1587498 - RNA, 18 nt, Homo sapiens
gcauuugaugauagcaga

SEQ ID NO: 1587499 - RNA, 22 nt, Homo sapiens
gcauuugccugcuucuuuccag

SEQ ID NO: 1587500 - RNA, 20 nt, Homo sapiens
gcauuuggagauauaccuaa

SEQ ID NO: 1587501 - RNA, 17 nt, Homo sapiens
gcauuuggcaacccaag

SEQ ID NO: 1587502 - RNA, 19 nt, Homo sapiens
gcauuuggugagagucaaa

SEQ ID NO: 1587503 - RNA, 21 nt, Homo sapiens
gcauuugucaaugacaguuuc

SEQ ID NO: 1587504 - RNA, 20 nt, Homo sapiens
gcauuuuaaguaaaagucua

SEQ ID NO: 1587505 - RNA, 21 nt, Homo sapiens
gcauuuuauaggcauaccucc

SEQ ID NO: 1587506 - RNA, 17 nt, Homo sapiens
gcauuuucaagcaguua

SEQ ID NO: 1587507 - RNA, 12 nt, Homo sapiens
gcauuuuccucc

SEQ ID NO: 1587508 - RNA, 19 nt, Homo sapiens
gcauuuuuaaccaacagaa

SEQ ID NO: 1587509 - RNA, 13 nt, Homo sapiens
gccaaaaccaaac

SEQ ID NO: 1587510 - RNA, 20 nt, Homo sapiens
gccaaaaucaauacaauccu

SEQ ID NO: 1587511 - RNA, 15 nt, Homo sapiens
gccaaacacacugua

SEQ ID NO: 1587512 - RNA, 23 nt, Homo sapiens
gccaaacagcaagaagcuguuac

SEQ ID NO: 1587513 - RNA, 23 nt, Homo sapiens
gccaacuuuuuuuccuugugguu

SEQ ID NO: 1587514 - RNA, 19 nt, Homo sapiens
gccaagaaacgucuucuaa

SEQ ID NO: 1587515 - RNA, 13 nt, Homo sapiens
gccaagacuccuc

SEQ ID NO: 1587516 - RNA, 17 nt, Homo sapiens
gccaagagugcacuacu

SEQ ID NO: 1587517 - RNA, 21 nt, Homo sapiens
gccaagauuuuccucuuguga

SEQ ID NO: 1587518 - RNA, 19 nt, Homo sapiens
gccaagggccgacuaagag

SEQ ID NO: 1587519 - RNA, 14 nt, Homo sapiens
gccaagguccugcu

SEQ ID NO: 1587520 - RNA, 23 nt, Homo sapiens
gccaaguaagagugguggccuau

SEQ ID NO: 1587521 - RNA, 16 nt, Homo sapiens
gccaaguggggugcug

SEQ ID NO: 1587522 - RNA, 20 nt, Homo sapiens
gccaaguugugacagucacu

SEQ ID NO: 1587523 - RNA, 19 nt, Homo sapiens
gccaaucccgccaugcuca

SEQ ID NO: 1587524 - RNA, 18 nt, Homo sapiens
gccacaaauaacaucuca

SEQ ID NO: 1587525 - RNA, 21 nt, Homo sapiens
gccacaaccuuuuacauauuu

SEQ ID NO: 1587526 - RNA, 18 nt, Homo sapiens
gccacacccagcggcccc

SEQ ID NO: 1587527 - RNA, 15 nt, Homo sapiens
gccacacguuguaua

SEQ ID NO: 1587528 - RNA, 20 nt, Homo sapiens
gccacagacaacauggaaau

SEQ ID NO: 1587529 - RNA, 15 nt, Homo sapiens
gccacagacaacuca

SEQ ID NO: 1587530 - RNA, 22 nt, Homo sapiens
gccacagcugcuguucucagga

SEQ ID NO: 1587531 - RNA, 14 nt, Homo sapiens
gccacagugcaauu

SEQ ID NO: 1587532 - RNA, 11 nt, Homo sapiens
gccacauggga

SEQ ID NO: 1587533 - RNA, 19 nt, Homo sapiens
gccacauuuucuuaaucca

SEQ ID NO: 1587534 - RNA, 19 nt, Homo sapiens
gccacugacugagauggag

SEQ ID NO: 1587535 - RNA, 22 nt, Homo sapiens
gccacugccccccgaggcugcu

SEQ ID NO: 1587536 - RNA, 18 nt, Homo sapiens
gccacugcgcccggccca

SEQ ID NO: 1587537 - RNA, 16 nt, Homo sapiens
gccacuugucaaagaa

SEQ ID NO: 1587538 - RNA, 17 nt, Homo sapiens
gccagacaucaacagau

SEQ ID NO: 1587539 - RNA, 23 nt, Homo sapiens
gccagaccagcaggcuggccuau

SEQ ID NO: 1587540 - RNA, 18 nt, Homo sapiens
gccagagcaaacagaaaa

SEQ ID NO: 1587541 - RNA, 20 nt, Homo sapiens
gccagcagcagcuacaacau

SEQ ID NO: 1587542 - RNA, 20 nt, Homo sapiens
gccagcagggcaucuuggaa

SEQ ID NO: 1587543 - RNA, 21 nt, Homo sapiens
gccagcauuucccuuccuucc

SEQ ID NO: 1587544 - RNA, 22 nt, Homo sapiens
gccagcugcccuugcagggugg

SEQ ID NO: 1587545 - RNA, 14 nt, Homo sapiens
gccagcugcggcca

SEQ ID NO: 1587546 - RNA, 23 nt, Homo sapiens
gccagcuuaaacccauacaaugu

SEQ ID NO: 1587547 - RNA, 13 nt, Homo sapiens
gccaggcacuuug

SEQ ID NO: 1587548 - RNA, 14 nt, Homo sapiens
gccaggcacuuuga

SEQ ID NO: 1587549 - RNA, 21 nt, Homo sapiens
gccaggccucugcuggcucag

SEQ ID NO: 1587550 - RNA, 20 nt, Homo sapiens
gccaggcugccaaggccaga

SEQ ID NO: 1587551 - RNA, 14 nt, Homo sapiens
gccagggaugggca

SEQ ID NO: 1587552 - RNA, 18 nt, Homo sapiens
gccagggcaaugaugaau

SEQ ID NO: 1587553 - RNA, 17 nt, Homo sapiens
gccagguccugugcuau

SEQ ID NO: 1587554 - RNA, 23 nt, Homo sapiens
gccaggugcaaucuacuggaaau

SEQ ID NO: 1587555 - RNA, 11 nt, Homo sapiens
gccaggugccc

SEQ ID NO: 1587556 - RNA, 16 nt, Homo sapiens
gccagucagcagucau

SEQ ID NO: 1587557 - RNA, 14 nt, Homo sapiens
gccagugucuuucu

SEQ ID NO: 1587558 - RNA, 15 nt, Homo sapiens
gccaguuacauaaaa

SEQ ID NO: 1587559 - RNA, 15 nt, Homo sapiens
gccaguuauggcuau

SEQ ID NO: 1587560 - RNA, 17 nt, Homo sapiens
gccaguuucuccaucca

SEQ ID NO: 1587561 - RNA, 13 nt, Homo sapiens
gccauacugccuu

SEQ ID NO: 1587562 - RNA, 15 nt, Homo sapiens
gccauaggugcaguu

SEQ ID NO: 1587563 - RNA, 18 nt, Homo sapiens
gccauaucuucaggccau

SEQ ID NO: 1587564 - RNA, 17 nt, Homo sapiens
gccaucaugccugacua

SEQ ID NO: 1587565 - RNA, 19 nt, Homo sapiens
gccauccagaugugugcaa

SEQ ID NO: 1587566 - RNA, 23 nt, Homo sapiens
gccaucuuuaucaugaagcacau

SEQ ID NO: 1587567 - RNA, 17 nt, Homo sapiens
gccaugacaagaacaaa

SEQ ID NO: 1587568 - RNA, 23 nt, Homo sapiens
gccaugacaagaacaaagccacu

SEQ ID NO: 1587569 - RNA, 15 nt, Homo sapiens
gccaugcugggccac

SEQ ID NO: 1587570 - RNA, 14 nt, Homo sapiens
gccauguccaaaga

SEQ ID NO: 1587571 - RNA, 15 nt, Homo sapiens
gccauguccaaagag

SEQ ID NO: 1587572 - RNA, 21 nt, Homo sapiens
gccauucacuucauaauccag

SEQ ID NO: 1587573 - RNA, 22 nt, Homo sapiens
gccauuuaaguaucuugugcuu

SEQ ID NO: 1587574 - RNA, 16 nt, Homo sapiens
gccauuucacucucaa

SEQ ID NO: 1587575 - RNA, 17 nt, Homo sapiens
gcccaaagaaagagcua

SEQ ID NO: 1587576 - RNA, 14 nt, Homo sapiens
gcccaacacuggcc

SEQ ID NO: 1587577 - RNA, 20 nt, Homo sapiens
gcccaaccuccuauauauag

SEQ ID NO: 1587578 - RNA, 18 nt, Homo sapiens
gcccaagaggacugagac

SEQ ID NO: 1587579 - RNA, 15 nt, Homo sapiens
gcccaagaggucuga

SEQ ID NO: 1587580 - RNA, 21 nt, Homo sapiens
gcccagacaccaugugcaaua

SEQ ID NO: 1587581 - RNA, 21 nt, Homo sapiens
gcucuguccuaaauaucucaa

SEQ ID NO: 1587582 - RNA, 18 nt, Homo sapiens
gcucuguggcgagccauu

SEQ ID NO: 1587583 - RNA, 18 nt, Homo sapiens
gcucugugggaggaugaa

SEQ ID NO: 1587584 - RNA, 18 nt, Homo sapiens
gcucuuaugugugccuuu

SEQ ID NO: 1587585 - RNA, 13 nt, Homo sapiens
gcucuucacugaa

SEQ ID NO: 1587586 - RNA, 16 nt, Homo sapiens
gcucuucucauuucac

SEQ ID NO: 1587587 - RNA, 14 nt, Homo sapiens
gcucuucugcccaa

SEQ ID NO: 1587588 - RNA, 20 nt, Homo sapiens
gcucuuuagaaggacucagu

SEQ ID NO: 1587589 - RNA, 20 nt, Homo sapiens
gcugaaaaauauagccuuua

SEQ ID NO: 1587590 - RNA, 17 nt, Homo sapiens
gcugaaaagagcuuugu

SEQ ID NO: 1587591 - RNA, 13 nt, Homo sapiens
gcugacuuuggga

SEQ ID NO: 1587592 - RNA, 15 nt, Homo sapiens
gcugagauuacucug

SEQ ID NO: 1587593 - RNA, 21 nt, Homo sapiens
gcugagauugcaccacugcac

SEQ ID NO: 1587594 - RNA, 20 nt, Homo sapiens
gcugagcaaucugacccuau

SEQ ID NO: 1587595 - RNA, 15 nt, Homo sapiens
gcugagcauguggag

SEQ ID NO: 1587596 - RNA, 22 nt, Homo sapiens
gcugaggccucucauuccagag

SEQ ID NO: 1587597 - RNA, 20 nt, Homo sapiens
gcugaggccugggagucucu

SEQ ID NO: 1587598 - RNA, 18 nt, Homo sapiens
gcugagguuccucugccu

SEQ ID NO: 1587599 - RNA, 18 nt, Homo sapiens
gcugagugacugcagcuu

SEQ ID NO: 1587600 - RNA, 20 nt, Homo sapiens
gcugauuauuuaugaccuga

SEQ ID NO: 1587601 - RNA, 22 nt, Homo sapiens
gcugcaaaauuaaaucuagaca

SEQ ID NO: 1587602 - RNA, 21 nt, Homo sapiens
gcugcagggacagcccugaca

SEQ ID NO: 1587603 - RNA, 14 nt, Homo sapiens
gcugcagucaucua

SEQ ID NO: 1587604 - RNA, 21 nt, Homo sapiens
gcugcaucuccccucagauuc

SEQ ID NO: 1587605 - RNA, 12 nt, Homo sapiens
gcugcaugaccu

SEQ ID NO: 1587606 - RNA, 14 nt, Homo sapiens
gcugccaaaugcgu

SEQ ID NO: 1587607 - RNA, 12 nt, Homo sapiens
gcugccuaauaa

SEQ ID NO: 1587608 - RNA, 15 nt, Homo sapiens
gcugccucacuuccu

SEQ ID NO: 1587609 - RNA, 19 nt, Homo sapiens
gcugccucccuuucauaca

SEQ ID NO: 1587610 - RNA, 16 nt, Homo sapiens
gcugccucuaccugac

SEQ ID NO: 1587611 - RNA, 20 nt, Homo sapiens
gcugccugguauauccaaaa

SEQ ID NO: 1587612 - RNA, 19 nt, Homo sapiens
gcugccuuuggacuugucc

SEQ ID NO: 1587613 - RNA, 12 nt, Homo sapiens
gcugcuacugcu

SEQ ID NO: 1587614 - RNA, 22 nt, Homo sapiens
gcugcugccccuuaaacacagg

SEQ ID NO: 1587615 - RNA, 19 nt, Homo sapiens
gcugcuuccugucugagua

SEQ ID NO: 1587616 - RNA, 22 nt, Homo sapiens
gcugcuucuuauuaaucauaca

SEQ ID NO: 1587617 - RNA, 16 nt, Homo sapiens
gcugcuugugaucuca

SEQ ID NO: 1587618 - RNA, 21 nt, Homo sapiens
gcugcuuguggcggauuccuc

SEQ ID NO: 1587619 - RNA, 17 nt, Homo sapiens
gcuggaaaaaggugaau

SEQ ID NO: 1587620 - RNA, 23 nt, Homo sapiens
gcuggaaaaccuccuuuaccaga

SEQ ID NO: 1587621 - RNA, 15 nt, Homo sapiens
gcuggaaggggucca

SEQ ID NO: 1587622 - RNA, 16 nt, Homo sapiens
gcuggaaugugccaca

SEQ ID NO: 1587623 - RNA, 17 nt, Homo sapiens
gcuggagcccagcguca

SEQ ID NO: 1587624 - RNA, 21 nt, Homo sapiens
gcuggagguugagcucuucuu

SEQ ID NO: 1587625 - RNA, 20 nt, Homo sapiens
gcuggagugcaguggcauga

SEQ ID NO: 1587626 - RNA, 20 nt, Homo sapiens
gcuggagugcaguggugcca

SEQ ID NO: 1587627 - RNA, 17 nt, Homo sapiens
gcugggagcacuggugu

SEQ ID NO: 1587628 - RNA, 13 nt, Homo sapiens
gcugggccauguc

SEQ ID NO: 1587629 - RNA, 18 nt, Homo sapiens
gcugggccauguccaaag

SEQ ID NO: 1587630 - RNA, 14 nt, Homo sapiens
gcuggggaugucuc

SEQ ID NO: 1587631 - RNA, 19 nt, Homo sapiens
gcuggucuggaguugcuga

SEQ ID NO: 1587632 - RNA, 13 nt, Homo sapiens
gcuggucuugggg

SEQ ID NO: 1587633 - RNA, 20 nt, Homo sapiens
gcuggugugucauacugugc

SEQ ID NO: 1587634 - RNA, 19 nt, Homo sapiens
gcuguagacauuugcuaug

SEQ ID NO: 1587635 - RNA, 14 nt, Homo sapiens
gcuguagaugacaa

SEQ ID NO: 1587636 - RNA, 17 nt, Homo sapiens
gcuguauccauccaugg

SEQ ID NO: 1587637 - RNA, 16 nt, Homo sapiens
gcuguauguaaacugu

SEQ ID NO: 1587638 - RNA, 15 nt, Homo sapiens
gcuguauuuugauau

SEQ ID NO: 1587639 - RNA, 19 nt, Homo sapiens
gcugucaaaacuacugaca

SEQ ID NO: 1587640 - RNA, 15 nt, Homo sapiens
gcugucuuggucacu

SEQ ID NO: 1587641 - RNA, 14 nt, Homo sapiens
gcuguggacuauua

SEQ ID NO: 1587642 - RNA, 10 nt, Homo sapiens
gcuguuauac

SEQ ID NO: 1587643 - RNA, 23 nt, Homo sapiens
gcuguucacagccagacuggcac

SEQ ID NO: 1587644 - RNA, 22 nt, Homo sapiens
gcuguugcgcucccaccucagc

SEQ ID NO: 1587645 - RNA, 17 nt, Homo sapiens
gcuuaaaaucugugaag

SEQ ID NO: 1587646 - RNA, 19 nt, Homo sapiens
gcuuaaacccauacaaugu

SEQ ID NO: 1587647 - RNA, 15 nt, Homo sapiens
gcuuaaagcuugauu

SEQ ID NO: 1587648 - RNA, 22 nt, Homo sapiens
gcuuaaauuucuuaugugacau

SEQ ID NO: 1587649 - RNA, 23 nt, Homo sapiens
gcuuaacacaguggguggugagu

SEQ ID NO: 1587650 - RNA, 21 nt, Homo sapiens
gcuuaaccuuuccaguuuaua

SEQ ID NO: 1587651 - RNA, 18 nt, Homo sapiens
gcuuaauaaacaugucac

SEQ ID NO: 1587652 - RNA, 15 nt, Homo sapiens
gcuuaccugaucuca

SEQ ID NO: 1587653 - RNA, 14 nt, Homo sapiens
gcuuagaaauucag

SEQ ID NO: 1587654 - RNA, 20 nt, Homo sapiens
gcuuagaaauucagcauuug

SEQ ID NO: 1587655 - RNA, 15 nt, Homo sapiens
gcuuaguaacuagug

SEQ ID NO: 1587656 - RNA, 18 nt, Homo sapiens
gcuuauaagaaugguguu

SEQ ID NO: 1587657 - RNA, 23 nt, Homo sapiens
gcuucacagguuuuauguguucu

SEQ ID NO: 1587658 - RNA, 16 nt, Homo sapiens
gcuucauauaccagca

SEQ ID NO: 1587659 - RNA, 21 nt, Homo sapiens
gcuucaucugugggaugcuga

SEQ ID NO: 1587660 - RNA, 15 nt, Homo sapiens
gcuuccaugauucua

SEQ ID NO: 1587661 - RNA, 12 nt, Homo sapiens
gcuuccucaguu

SEQ ID NO: 1587662 - RNA, 23 nt, Homo sapiens
gcuuccuccccucggaaggugcg

SEQ ID NO: 1587663 - RNA, 19 nt, Homo sapiens
gcuuccucuagaagccaag

SEQ ID NO: 1587664 - RNA, 21 nt, Homo sapiens
gcuucucagauuucugaggaa

SEQ ID NO: 1587665 - RNA, 20 nt, Homo sapiens
gcuucugggccacucaggcc

SEQ ID NO: 1587666 - RNA, 17 nt, Homo sapiens
gcuucugucuccagcuu

SEQ ID NO: 1587667 - RNA, 15 nt, Homo sapiens
gcuucuucacaggca

SEQ ID NO: 1587668 - RNA, 15 nt, Homo sapiens
gcuugacauaccuac

SEQ ID NO: 1587669 - RNA, 14 nt, Homo sapiens
gcuugauacaggaa

SEQ ID NO: 1587670 - RNA, 16 nt, Homo sapiens
gcuugcaauguaguca

SEQ ID NO: 1587671 - RNA, 16 nt, Homo sapiens
gcuugcaccacuuccg

SEQ ID NO: 1587672 - RNA, 16 nt, Homo sapiens
gcuugcaucugcacau

SEQ ID NO: 1587673 - RNA, 11 nt, Homo sapiens
gcuugccaaau

SEQ ID NO: 1587674 - RNA, 18 nt, Homo sapiens
gcuuggauuucgugugcc

SEQ ID NO: 1587675 - RNA, 19 nt, Homo sapiens
gcuuggcccuuuccuucca

SEQ ID NO: 1587676 - RNA, 23 nt, Homo sapiens
gcuugucacagucucuacuguua

SEQ ID NO: 1587677 - RNA, 21 nt, Homo sapiens
gcuuguugucuccacuuguau

SEQ ID NO: 1587678 - RNA, 15 nt, Homo sapiens
gcuuguuugccugaa

SEQ ID NO: 1587679 - RNA, 19 nt, Homo sapiens
gcuuuaaaaugucugugua

SEQ ID NO: 1587680 - RNA, 17 nt, Homo sapiens
gcuuuagaaacagugca

SEQ ID NO: 1587681 - RNA, 21 nt, Homo sapiens
gcuuuauccccguuucuugca

SEQ ID NO: 1587682 - RNA, 21 nt, Homo sapiens
gcuuuccuggucccucacccc

SEQ ID NO: 1587683 - RNA, 15 nt, Homo sapiens
gcuuugaaaaaguuu

SEQ ID NO: 1587684 - RNA, 22 nt, Homo sapiens
gcuuugguaaaacaguuucauc

SEQ ID NO: 1587685 - RNA, 17 nt, Homo sapiens
gcuuuguaugacaguga

SEQ ID NO: 1587686 - RNA, 12 nt, Homo sapiens
gcuuugugauuc

SEQ ID NO: 1587687 - RNA, 18 nt, Homo sapiens
gcuuuucagugauacuca

SEQ ID NO: 1587688 - RNA, 22 nt, Homo sapiens
gcuuuuuauuaggcucagugac

SEQ ID NO: 1587689 - RNA, 23 nt, Homo sapiens
gcuuuuugggaccaucacugaga

SEQ ID NO: 1587690 - RNA, 21 nt, Homo sapiens
ggaaaaaauaaaaacaucagu

SEQ ID NO: 1587691 - RNA, 22 nt, Homo sapiens
ggaaaaauaaucaaaagcuauu

SEQ ID NO: 1587692 - RNA, 20 nt, Homo sapiens
ggaaaacaaauauuucacuu

SEQ ID NO: 1587693 - RNA, 21 nt, Homo sapiens
ggaaaacgggcagucugcucu

SEQ ID NO: 1587694 - RNA, 23 nt, Homo sapiens
ggaaaacuacaaacguuugacaa

SEQ ID NO: 1587695 - RNA, 12 nt, Homo sapiens
ggaaaacuacug

SEQ ID NO: 1587696 - RNA, 18 nt, Homo sapiens
ggaaaaucacuugccaaa

SEQ ID NO: 1587697 - RNA, 18 nt, Homo sapiens
ggaaaauccacuaugaca

SEQ ID NO: 1587698 - RNA, 13 nt, Homo sapiens
ggcgugggcgcuu

SEQ ID NO: 1587699 - RNA, 12 nt, Homo sapiens
ggcuaaucucag

SEQ ID NO: 1587700 - RNA, 17 nt, Homo sapiens
ggcuaauucagugucac

SEQ ID NO: 1587701 - RNA, 13 nt, Homo sapiens
ggcuacugaguca

SEQ ID NO: 1587702 - RNA, 24 nt, Homo sapiens
ggcuacuuuccacauauagagcuc

SEQ ID NO: 1587703 - RNA, 17 nt, Homo sapiens
ggcuagaaucuggagag

SEQ ID NO: 1587704 - RNA, 19 nt, Homo sapiens
ggcuaugcgggggugccua

SEQ ID NO: 1587705 - RNA, 16 nt, Homo sapiens
ggcucaagucugcaca

SEQ ID NO: 1587706 - RNA, 18 nt, Homo sapiens
ggcuccaagccucaaagu

SEQ ID NO: 1587707 - RNA, 14 nt, Homo sapiens
ggcuccagcaccuu

SEQ ID NO: 1587708 - RNA, 19 nt, Homo sapiens
ggcuccagcucuggcacag

SEQ ID NO: 1587709 - RNA, 13 nt, Homo sapiens
ggcucccaugacc

SEQ ID NO: 1587710 - RNA, 14 nt, Homo sapiens
ggcucccaugacca

SEQ ID NO: 1587711 - RNA, 23 nt, Homo sapiens
ggcucccccuccagccagagaca

SEQ ID NO: 1587712 - RNA, 21 nt, Homo sapiens
ggcuccgggcaccaggggcca

SEQ ID NO: 1587713 - RNA, 19 nt, Homo sapiens
ggcucuaauucacagugcu

SEQ ID NO: 1587714 - RNA, 21 nt, Homo sapiens
ggcucucgcugcccuguggac

SEQ ID NO: 1587715 - RNA, 13 nt, Homo sapiens
ggcucuguccuaa

SEQ ID NO: 1587716 - RNA, 19 nt, Homo sapiens
ggcucuuaugugugccuuu

SEQ ID NO: 1587717 - RNA, 11 nt, Homo sapiens
ggcugccuugu

SEQ ID NO: 1587718 - RNA, 11 nt, Homo sapiens
ggcugcucccc

SEQ ID NO: 1587719 - RNA, 18 nt, Homo sapiens
ggcuggaagaaccacugu

SEQ ID NO: 1587720 - RNA, 16 nt, Homo sapiens
ggcuggaaggggucca

SEQ ID NO: 1587721 - RNA, 22 nt, Homo sapiens
ggcuggagauccuuucucucaa

SEQ ID NO: 1587722 - RNA, 20 nt, Homo sapiens
ggcuggagugcaguggcaug

SEQ ID NO: 1587723 - RNA, 16 nt, Homo sapiens
ggcuggcauccucaca

SEQ ID NO: 1587724 - RNA, 19 nt, Homo sapiens
ggcugggagacagagucag

SEQ ID NO: 1587725 - RNA, 20 nt, Homo sapiens
ggcuggggccaccuuugugc

SEQ ID NO: 1587726 - RNA, 18 nt, Homo sapiens
ggcuguggccuaaccugc

SEQ ID NO: 1587727 - RNA, 16 nt, Homo sapiens
ggcuguguuuccaucu

SEQ ID NO: 1587728 - RNA, 17 nt, Homo sapiens
ggcuguuccagacucag

SEQ ID NO: 1587729 - RNA, 11 nt, Homo sapiens
ggcuguucuca

SEQ ID NO: 1587730 - RNA, 15 nt, Homo sapiens
ggcuguugcauuuuu

SEQ ID NO: 1587731 - RNA, 22 nt, Homo sapiens
ggcuguuuucccucugcugcuu

SEQ ID NO: 1587732 - RNA, 15 nt, Homo sapiens
ggcuuaacacaucuc

SEQ ID NO: 1587733 - RNA, 13 nt, Homo sapiens
ggcuuacugagcu

SEQ ID NO: 1587734 - RNA, 18 nt, Homo sapiens
ggcuucacagccacaccu

SEQ ID NO: 1587735 - RNA, 19 nt, Homo sapiens
ggcuucacagccacaccug

SEQ ID NO: 1587736 - RNA, 15 nt, Homo sapiens
ggcuucuauuaccua

SEQ ID NO: 1587737 - RNA, 11 nt, Homo sapiens
ggcuucucacg

SEQ ID NO: 1587738 - RNA, 14 nt, Homo sapiens
ggcuugaagccaaa

SEQ ID NO: 1587739 - RNA, 16 nt, Homo sapiens
ggcuugaaggccagca

SEQ ID NO: 1587740 - RNA, 15 nt, Homo sapiens
ggcuuuugauuuaua

SEQ ID NO: 1587741 - RNA, 13 nt, Homo sapiens
gggaaaaggagua

SEQ ID NO: 1587742 - RNA, 12 nt, Homo sapiens
gggaaacaauga

SEQ ID NO: 1587743 - RNA, 23 nt, Homo sapiens
gggaaacagguugggaugggaua

SEQ ID NO: 1587744 - RNA, 17 nt, Homo sapiens
gggaacaaggaaggaaa

SEQ ID NO: 1587745 - RNA, 22 nt, Homo sapiens
gggaagagugacucuccagggg

SEQ ID NO: 1587746 - RNA, 22 nt, Homo sapiens
gggaaggucagcccagccccuc

SEQ ID NO: 1587747 - RNA, 14 nt, Homo sapiens
gggaaguaacagac

SEQ ID NO: 1587748 - RNA, 16 nt, Homo sapiens
gggaaugcaccucccc

SEQ ID NO: 1587749 - RNA, 15 nt, Homo sapiens
gggaauucccucccc

SEQ ID NO: 1587750 - RNA, 21 nt, Homo sapiens
gggacauuaguaacugcacac

SEQ ID NO: 1587751 - RNA, 21 nt, Homo sapiens
gggacccuuccccgugcccua

SEQ ID NO: 1587752 - RNA, 18 nt, Homo sapiens
gggacgcccccaccagcu

SEQ ID NO: 1587753 - RNA, 18 nt, Homo sapiens
gggacguugcugagccag

SEQ ID NO: 1587754 - RNA, 22 nt, Homo sapiens
gggacguugcugagccagcugc

SEQ ID NO: 1587755 - RNA, 15 nt, Homo sapiens
gggacuaggaccuga

SEQ ID NO: 1587756 - RNA, 11 nt, Homo sapiens
gggacucuccu

SEQ ID NO: 1587757 - RNA, 16 nt, Homo sapiens
gggacuugaacaaaga

SEQ ID NO: 1587758 - RNA, 18 nt, Homo sapiens
gggagacucagccuuccu

SEQ ID NO: 1587759 - RNA, 16 nt, Homo sapiens
gggagagacaggcagc

SEQ ID NO: 1587760 - RNA, 19 nt, Homo sapiens
gggagaguaaaccuugaag

SEQ ID NO: 1587761 - RNA, 22 nt, Homo sapiens
gggagaugcuucucuccuugcc

SEQ ID NO: 1587762 - RNA, 17 nt, Homo sapiens
gggagccgcagagccug

SEQ ID NO: 1587763 - RNA, 18 nt, Homo sapiens
gggagcgacacuugaaug

SEQ ID NO: 1587764 - RNA, 13 nt, Homo sapiens
gggagcugccaag

SEQ ID NO: 1587765 - RNA, 14 nt, Homo sapiens
gggaggaacaaaga

SEQ ID NO: 1587766 - RNA, 19 nt, Homo sapiens
gggaggaagcuacccaagg

SEQ ID NO: 1587767 - RNA, 20 nt, Homo sapiens
gggaggcggagguugcagug

SEQ ID NO: 1587768 - RNA, 12 nt, Homo sapiens
gggagucugggc

SEQ ID NO: 1587769 - RNA, 14 nt, Homo sapiens
gggaguguguaauu

SEQ ID NO: 1587770 - RNA, 16 nt, Homo sapiens
gggauauggguccucu

SEQ ID NO: 1587771 - RNA, 14 nt, Homo sapiens
gggaucugccauug

SEQ ID NO: 1587772 - RNA, 19 nt, Homo sapiens
gggaucugucacaccagcc

SEQ ID NO: 1587773 - RNA, 20 nt, Homo sapiens
gggaugcugggcugggcccu

SEQ ID NO: 1587774 - RNA, 15 nt, Homo sapiens
gggauucaggcugcu

SEQ ID NO: 1587775 - RNA, 22 nt, Homo sapiens
gggauugucuuacuguugcaua

SEQ ID NO: 1587776 - RNA, 11 nt, Homo sapiens
gggcaccuuuu

SEQ ID NO: 1587777 - RNA, 20 nt, Homo sapiens
gggcacugcacccuguuuaa

SEQ ID NO: 1587778 - RNA, 15 nt, Homo sapiens
gggcacuuucauccu

SEQ ID NO: 1587779 - RNA, 20 nt, Homo sapiens
gggcagcccagugcugccac

SEQ ID NO: 1587780 - RNA, 16 nt, Homo sapiens
gggcaggcugggccau

SEQ ID NO: 1587781 - RNA, 22 nt, Homo sapiens
gggcaggggugcuuccuccuca

SEQ ID NO: 1587782 - RNA, 15 nt, Homo sapiens
gggccaaaaggaaaa

SEQ ID NO: 1587783 - RNA, 21 nt, Homo sapiens
gggccaaauucccaaccugcu

SEQ ID NO: 1587784 - RNA, 14 nt, Homo sapiens
gggccacccagcca

SEQ ID NO: 1587785 - RNA, 22 nt, Homo sapiens
gggccacucaggggucauucau

SEQ ID NO: 1587786 - RNA, 14 nt, Homo sapiens
gggccacuggggac

SEQ ID NO: 1587787 - RNA, 12 nt, Homo sapiens
gggccagcacuu

SEQ ID NO: 1587788 - RNA, 17 nt, Homo sapiens
gggccauguccaaagag

SEQ ID NO: 1587789 - RNA, 16 nt, Homo sapiens
gggcccaacacuggcc

SEQ ID NO: 1587790 - RNA, 21 nt, Homo sapiens
gggcccaggucagccacuguu

SEQ ID NO: 1587791 - RNA, 15 nt, Homo sapiens
gggccccaccaccua

SEQ ID NO: 1587792 - RNA, 15 nt, Homo sapiens
gggccccaucuugau

SEQ ID NO: 1587793 - RNA, 22 nt, Homo sapiens
gggccccgccagggcuggggac

SEQ ID NO: 1587794 - RNA, 22 nt, Homo sapiens
gggcccucuuucccugcgagac

SEQ ID NO: 1587795 - RNA, 16 nt, Homo sapiens
gggcccugggccucag

SEQ ID NO: 1587796 - RNA, 22 nt, Homo sapiens
gggccugcacccuuccacagcu

SEQ ID NO: 1587797 - RNA, 15 nt, Homo sapiens
gggccugucacugau

SEQ ID NO: 1587798 - RNA, 17 nt, Homo sapiens
gggcguucucccaaaga

SEQ ID NO: 1587799 - RNA, 12 nt, Homo sapiens
gggcuagggagg

SEQ ID NO: 1587800 - RNA, 16 nt, Homo sapiens
gggcucagaguggggu

SEQ ID NO: 1587801 - RNA, 15 nt, Homo sapiens
gggcuccauguagaa

SEQ ID NO: 1587802 - RNA, 14 nt, Homo sapiens
gggcucccaggcca

SEQ ID NO: 1587803 - RNA, 16 nt, Homo sapiens
gggcucccaggggucu

SEQ ID NO: 1587804 - RNA, 23 nt, Homo sapiens
gggcuggaggcccaggcugggaa

SEQ ID NO: 1587805 - RNA, 22 nt, Homo sapiens
gggcuuccucaaauacaugcac

SEQ ID NO: 1587806 - RNA, 15 nt, Homo sapiens
gggcuugaagccaaa

SEQ ID NO: 1587807 - RNA, 18 nt, Homo sapiens
gggcuuggaccagaucua

SEQ ID NO: 1587808 - RNA, 15 nt, Homo sapiens
gggcuuucauagugu

SEQ ID NO: 1587809 - RNA, 20 nt, Homo sapiens
ggggacaggauuuggccaca

SEQ ID NO: 1587810 - RNA, 12 nt, Homo sapiens
ggggacagguga

SEQ ID NO: 1587811 - RNA, 17 nt, Homo sapiens
ggggacucagggaccgg

SEQ ID NO: 1587812 - RNA, 16 nt, Homo sapiens
ggggagagacaggcag

SEQ ID NO: 1587813 - RNA, 12 nt, Homo sapiens
ggggagguguau

SEQ ID NO: 1587814 - RNA, 18 nt, Homo sapiens
ggggauucuguguuuuca

SEQ ID NO: 1587815 - RNA, 21 nt, Homo sapiens
ggggcccugccugguggcaag

SEQ ID NO: 1587816 - RNA, 13 nt, Homo sapiens
ggggcucucucau

SEQ ID NO: 1587817 - RNA, 13 nt, Homo sapiens
uccccucaaccca

SEQ ID NO: 1587818 - RNA, 16 nt, Homo sapiens
uccccucagauuccac

SEQ ID NO: 1587819 - RNA, 19 nt, Homo sapiens
uccccucccuggcucccau

SEQ ID NO: 1587820 - RNA, 12 nt, Homo sapiens
uccccucuagga

SEQ ID NO: 1587821 - RNA, 15 nt, Homo sapiens
uccccucucaccuca

SEQ ID NO: 1587822 - RNA, 16 nt, Homo sapiens
uccccucucagcauuu

SEQ ID NO: 1587823 - RNA, 18 nt, Homo sapiens
uccccuucucucaucucu

SEQ ID NO: 1587824 - RNA, 14 nt, Homo sapiens
ucccgaguaccagu

SEQ ID NO: 1587825 - RNA, 16 nt, Homo sapiens
ucccgcucacucccuc

SEQ ID NO: 1587826 - RNA, 21 nt, Homo sapiens
ucccuaccccauuugugguca

SEQ ID NO: 1587827 - RNA, 17 nt, Homo sapiens
ucccuaguuagcaucca

SEQ ID NO: 1587828 - RNA, 22 nt, Homo sapiens
ucccuauuuuucucuccugucc

SEQ ID NO: 1587829 - RNA, 22 nt, Homo sapiens
ucccucaaaugcgcgugugcac

SEQ ID NO: 1587830 - RNA, 14 nt, Homo sapiens
ucccucagcucucu

SEQ ID NO: 1587831 - RNA, 17 nt, Homo sapiens
ucccucagcucucuggg

SEQ ID NO: 1587832 - RNA, 19 nt, Homo sapiens
ucccucaggccgaaggagg

SEQ ID NO: 1587833 - RNA, 11 nt, Homo sapiens
ucccucaguga

SEQ ID NO: 1587834 - RNA, 13 nt, Homo sapiens
ucccucagugaag

SEQ ID NO: 1587835 - RNA, 14 nt, Homo sapiens
ucccucauccauag

SEQ ID NO: 1587836 - RNA, 23 nt, Homo sapiens
ucccucccagaggagccaccagu

SEQ ID NO: 1587837 - RNA, 14 nt, Homo sapiens
ucccuccggccaua

SEQ ID NO: 1587838 - RNA, 20 nt, Homo sapiens
ucccucuaagcacauuccaa

SEQ ID NO: 1587839 - RNA, 21 nt, Homo sapiens
ucccucuaagcacauuccaaa

SEQ ID NO: 1587840 - RNA, 23 nt, Homo sapiens
ucccucucagaggccugcugcca

SEQ ID NO: 1587841 - RNA, 16 nt, Homo sapiens
ucccucucucccugcc

SEQ ID NO: 1587842 - RNA, 17 nt, Homo sapiens
ucccugaaaccuaguac

SEQ ID NO: 1587843 - RNA, 14 nt, Homo sapiens
ucccugacuccucc

SEQ ID NO: 1587844 - RNA, 20 nt, Homo sapiens
ucccugauaacaaccuggag

SEQ ID NO: 1587845 - RNA, 11 nt, Homo sapiens
ucccugcaaaa

SEQ ID NO: 1587846 - RNA, 16 nt, Homo sapiens
ucccugcacacacaug

SEQ ID NO: 1587847 - RNA, 14 nt, Homo sapiens
ucccugcagaccuc

SEQ ID NO: 1587848 - RNA, 15 nt, Homo sapiens
ucccugcugugccau

SEQ ID NO: 1587849 - RNA, 14 nt, Homo sapiens
ucccugcuguguga

SEQ ID NO: 1587850 - RNA, 18 nt, Homo sapiens
ucccuggaaaccuuccac

SEQ ID NO: 1587851 - RNA, 16 nt, Homo sapiens
ucccugucauuugaac

SEQ ID NO: 1587852 - RNA, 21 nt, Homo sapiens
ucccuguccuccucggaucac

SEQ ID NO: 1587853 - RNA, 21 nt, Homo sapiens
ucccuuauucuaaagcugccc

SEQ ID NO: 1587854 - RNA, 17 nt, Homo sapiens
ucccuucucccagucca

SEQ ID NO: 1587855 - RNA, 17 nt, Homo sapiens
ucccuucucguguuugc

SEQ ID NO: 1587856 - RNA, 18 nt, Homo sapiens
ucccuucuuucaggaaua

SEQ ID NO: 1587857 - RNA, 12 nt, Homo sapiens
ucccuugaccau

SEQ ID NO: 1587858 - RNA, 15 nt, Homo sapiens
ucccuugcagggguc

SEQ ID NO: 1587859 - RNA, 19 nt, Homo sapiens
ucccuuguagaaagugagg

SEQ ID NO: 1587860 - RNA, 15 nt, Homo sapiens
ucccuuucacuaaaa

SEQ ID NO: 1587861 - RNA, 13 nt, Homo sapiens
ucccuuucauaca

SEQ ID NO: 1587862 - RNA, 15 nt, Homo sapiens
ucccuuucauacaau

SEQ ID NO: 1587863 - RNA, 13 nt, Homo sapiens
uccgaggccagua

SEQ ID NO: 1587864 - RNA, 14 nt, Homo sapiens
uccgagggcccaac

SEQ ID NO: 1587865 - RNA, 23 nt, Homo sapiens
uccgcagaagcccugaugugucc

SEQ ID NO: 1587866 - RNA, 17 nt, Homo sapiens
uccggccccgucucucu

SEQ ID NO: 1587867 - RNA, 20 nt, Homo sapiens
uccggccuccugucccucau

SEQ ID NO: 1587868 - RNA, 20 nt, Homo sapiens
uccgugguuugaacacgaaa

SEQ ID NO: 1587869 - RNA, 20 nt, Homo sapiens
uccuaaacucucuagcuuaa

SEQ ID NO: 1587870 - RNA, 21 nt, Homo sapiens
uccuaaacucucuagcuuaag

SEQ ID NO: 1587871 - RNA, 15 nt, Homo sapiens
uccuaaacuuuccaa

SEQ ID NO: 1587872 - RNA, 13 nt, Homo sapiens
uccuaaagagaca

SEQ ID NO: 1587873 - RNA, 15 nt, Homo sapiens
uccuaaauaucucaa

SEQ ID NO: 1587874 - RNA, 11 nt, Homo sapiens
uccuaagacau

SEQ ID NO: 1587875 - RNA, 14 nt, Homo sapiens
uccuaccacucuaa

SEQ ID NO: 1587876 - RNA, 15 nt, Homo sapiens
uccuaccagaaggaa

SEQ ID NO: 1587877 - RNA, 16 nt, Homo sapiens
uccuacccacaccucu

SEQ ID NO: 1587878 - RNA, 19 nt, Homo sapiens
uccuagaugccaaaggggu

SEQ ID NO: 1587879 - RNA, 20 nt, Homo sapiens
uccuagauuacaucugccuu

SEQ ID NO: 1587880 - RNA, 22 nt, Homo sapiens
uccuagccaggcuaucuggccu

SEQ ID NO: 1587881 - RNA, 19 nt, Homo sapiens
uccuagcuguguuauuccu

SEQ ID NO: 1587882 - RNA, 22 nt, Homo sapiens
uccuaguguuucuuuguggucu

SEQ ID NO: 1587883 - RNA, 18 nt, Homo sapiens
uccuauuuuucaauggga

SEQ ID NO: 1587884 - RNA, 19 nt, Homo sapiens
uccucaaauacaugcacag

SEQ ID NO: 1587885 - RNA, 22 nt, Homo sapiens
uccucaaauuuuuugacuuuuu

SEQ ID NO: 1587886 - RNA, 19 nt, Homo sapiens
uccucacccaucaaaagca

SEQ ID NO: 1587887 - RNA, 13 nt, Homo sapiens
uccucacucuuca

SEQ ID NO: 1587888 - RNA, 15 nt, Homo sapiens
uccucagccaaggaa

SEQ ID NO: 1587889 - RNA, 22 nt, Homo sapiens
uccucaggcacacagcuacucu

SEQ ID NO: 1587890 - RNA, 24 nt, Homo sapiens
uccucagggacagagacaccugca

SEQ ID NO: 1587891 - RNA, 21 nt, Homo sapiens
uccucauauggcccaguguca

SEQ ID NO: 1587892 - RNA, 16 nt, Homo sapiens
uccucaugucaucaaa

SEQ ID NO: 1587893 - RNA, 12 nt, Homo sapiens
uccucauguugc

SEQ ID NO: 1587894 - RNA, 18 nt, Homo sapiens
uccuccagaauggagcug

SEQ ID NO: 1587895 - RNA, 14 nt, Homo sapiens
uccucccagugaga

SEQ ID NO: 1587896 - RNA, 17 nt, Homo sapiens
uccucccccaguuccuc

SEQ ID NO: 1587897 - RNA, 21 nt, Homo sapiens
uccuccccuguaggguuugga

SEQ ID NO: 1587898 - RNA, 15 nt, Homo sapiens
uccuccccuguucau

SEQ ID NO: 1587899 - RNA, 14 nt, Homo sapiens
uccuccuacuguau

SEQ ID NO: 1587900 - RNA, 22 nt, Homo sapiens
uccuccucugacuuggggaccu

SEQ ID NO: 1587901 - RNA, 14 nt, Homo sapiens
uccuccugccucag

SEQ ID NO: 1587902 - RNA, 19 nt, Homo sapiens
uccucuauuuaagauauau

SEQ ID NO: 1587903 - RNA, 22 nt, Homo sapiens
uccucucccccuccuccaggga

SEQ ID NO: 1587904 - RNA, 19 nt, Homo sapiens
uccucuccuccagcccaga

SEQ ID NO: 1587905 - RNA, 11 nt, Homo sapiens
uccucucugcu

SEQ ID NO: 1587906 - RNA, 15 nt, Homo sapiens
uccucucuuccacag

SEQ ID NO: 1587907 - RNA, 17 nt, Homo sapiens
uccucugcauuuacaca

SEQ ID NO: 1587908 - RNA, 14 nt, Homo sapiens
uccugaacuuucuc

SEQ ID NO: 1587909 - RNA, 22 nt, Homo sapiens
uccugaaggaaaauaaacugac

SEQ ID NO: 1587910 - RNA, 23 nt, Homo sapiens
uccugaagguguuuuucauucac

SEQ ID NO: 1587911 - RNA, 15 nt, Homo sapiens
uccugacacucaaua

SEQ ID NO: 1587912 - RNA, 15 nt, Homo sapiens
uccugacacuuuaau

SEQ ID NO: 1587913 - RNA, 13 nt, Homo sapiens
uccugaccucagg

SEQ ID NO: 1587914 - RNA, 20 nt, Homo sapiens
uccugaccuugugauccacc

SEQ ID NO: 1587915 - RNA, 18 nt, Homo sapiens
uccugacuaagccuuuga

SEQ ID NO: 1587916 - RNA, 13 nt, Homo sapiens
uccugacugaaag

SEQ ID NO: 1587917 - RNA, 14 nt, Homo sapiens
uccugccuggccag

SEQ ID NO: 1587918 - RNA, 18 nt, Homo sapiens
uccugcugauccagaugc

SEQ ID NO: 1587919 - RNA, 14 nt, Homo sapiens
uccuggaacuugcu

SEQ ID NO: 1587920 - RNA, 19 nt, Homo sapiens
uccuggaggugacacuuga

SEQ ID NO: 1587921 - RNA, 22 nt, Homo sapiens
uccuggcaucaguagcaucugu

SEQ ID NO: 1587922 - RNA, 21 nt, Homo sapiens
uccuggcccuccacuccucau

SEQ ID NO: 1587923 - RNA, 15 nt, Homo sapiens
uccuggccucauaca

SEQ ID NO: 1587924 - RNA, 22 nt, Homo sapiens
uccuggcuguccuaccaucagc

SEQ ID NO: 1587925 - RNA, 22 nt, Homo sapiens
uccuggguacugaaagccuuag

SEQ ID NO: 1587926 - RNA, 18 nt, Homo sapiens
uccuggugccaauuucaa

SEQ ID NO: 1587927 - RNA, 20 nt, Homo sapiens
uccugguggauacuguagaa

SEQ ID NO: 1587928 - RNA, 19 nt, Homo sapiens
uccuguacaauugcaucac

SEQ ID NO: 1587929 - RNA, 16 nt, Homo sapiens
uccugucccucaucca

SEQ ID NO: 1587930 - RNA, 17 nt, Homo sapiens
uccuguccuaucacucu

SEQ ID NO: 1587931 - RNA, 13 nt, Homo sapiens
uccugugaaggaa

SEQ ID NO: 1587932 - RNA, 13 nt, Homo sapiens
uccugugaccaca

SEQ ID NO: 1587933 - RNA, 18 nt, Homo sapiens
uccugugauuuaugccaa

SEQ ID NO: 1587934 - RNA, 18 nt, Homo sapiens
uccugugcggacagcccu

SEQ ID NO: 1587935 - RNA, 23 nt, Homo sapiens
uccuguggguguucuuuccugcc

SEQ ID NO: 1587936 - RNA, 20 nt, Homo sapiens
ucugccuuaaaaccaaagag

SEQ ID NO: 1587937 - RNA, 15 nt, Homo sapiens
ucugccuucucagga

SEQ ID NO: 1587938 - RNA, 19 nt, Homo sapiens
ucugcggagcacacuggcu

SEQ ID NO: 1587939 - RNA, 14 nt, Homo sapiens
ucugcuaaauauca

SEQ ID NO: 1587940 - RNA, 19 nt, Homo sapiens
ucugcucaaaacuuucaaa

SEQ ID NO: 1587941 - RNA, 22 nt, Homo sapiens
ucugcuccccugugaacccacu

SEQ ID NO: 1587942 - RNA, 20 nt, Homo sapiens
ucugcugaaggcagucauau

SEQ ID NO: 1587943 - RNA, 13 nt, Homo sapiens
ucugcuuugcucu

SEQ ID NO: 1587944 - RNA, 18 nt, Homo sapiens
ucugcuuuuuuucaggga

SEQ ID NO: 1587945 - RNA, 14 nt, Homo sapiens
ucuggaagucaucu

SEQ ID NO: 1587946 - RNA, 19 nt, Homo sapiens
ucuggaauugauauugaau

SEQ ID NO: 1587947 - RNA, 18 nt, Homo sapiens
ucuggaguugcugaaugu

SEQ ID NO: 1587948 - RNA, 18 nt, Homo sapiens
ucuggauccagccaugcc

SEQ ID NO: 1587949 - RNA, 17 nt, Homo sapiens
ucuggauggugugccuu

SEQ ID NO: 1587950 - RNA, 18 nt, Homo sapiens
ucuggauggugugccuuc

SEQ ID NO: 1587951 - RNA, 20 nt, Homo sapiens
ucuggauuucauacuguaac

SEQ ID NO: 1587952 - RNA, 23 nt, Homo sapiens
ucuggcaaugggacucugagaac

SEQ ID NO: 1587953 - RNA, 16 nt, Homo sapiens
ucuggcuuagugccac

SEQ ID NO: 1587954 - RNA, 20 nt, Homo sapiens
ucugggaagcugagggcaaa

SEQ ID NO: 1587955 - RNA, 19 nt, Homo sapiens
ucugguacugcaggaccuc

SEQ ID NO: 1587956 - RNA, 13 nt, Homo sapiens
ucuggugccauuu

SEQ ID NO: 1587957 - RNA, 16 nt, Homo sapiens
ucugguuuauuuccua

SEQ ID NO: 1587958 - RNA, 15 nt, Homo sapiens
ucuguaaacuuccaa

SEQ ID NO: 1587959 - RNA, 17 nt, Homo sapiens
ucuguaaugauacugau

SEQ ID NO: 1587960 - RNA, 18 nt, Homo sapiens
ucugucacaccagccaua

SEQ ID NO: 1587961 - RNA, 13 nt, Homo sapiens
ucugucaccaacu

SEQ ID NO: 1587962 - RNA, 23 nt, Homo sapiens
ucugucaccaacugaaguggcua

SEQ ID NO: 1587963 - RNA, 14 nt, Homo sapiens
ucugucagcugcaa

SEQ ID NO: 1587964 - RNA, 16 nt, Homo sapiens
ucugucauaugcagaa

SEQ ID NO: 1587965 - RNA, 19 nt, Homo sapiens
ucuguccuaaauaucucaa

SEQ ID NO: 1587966 - RNA, 18 nt, Homo sapiens
ucuguccuaaucauauac

SEQ ID NO: 1587967 - RNA, 10 nt, Homo sapiens
ucugugaaag

SEQ ID NO: 1587968 - RNA, 15 nt, Homo sapiens
ucugugacauacaua

SEQ ID NO: 1587969 - RNA, 21 nt, Homo sapiens
ucugugagacccccacaccuc

SEQ ID NO: 1587970 - RNA, 14 nt, Homo sapiens
ucugugcauguccc

SEQ ID NO: 1587971 - RNA, 16 nt, Homo sapiens
ucugugccccaugccu

SEQ ID NO: 1587972 - RNA, 16 nt, Homo sapiens
ucuguggagguggaaa

SEQ ID NO: 1587973 - RNA, 20 nt, Homo sapiens
ucugugguuugggcuccaca

SEQ ID NO: 1587974 - RNA, 23 nt, Homo sapiens
ucuguguguguguaugugggggu

SEQ ID NO: 1587975 - RNA, 16 nt, Homo sapiens
ucuguuccagucacau

SEQ ID NO: 1587976 - RNA, 20 nt, Homo sapiens
ucuguugaaucacaguauca

SEQ ID NO: 1587977 - RNA, 20 nt, Homo sapiens
ucuguuggauaauuagcagu

SEQ ID NO: 1587978 - RNA, 21 nt, Homo sapiens
ucuguugucguaaagauuugg

SEQ ID NO: 1587979 - RNA, 19 nt, Homo sapiens
ucuguuugcguacuuguaa

SEQ ID NO: 1587980 - RNA, 19 nt, Homo sapiens
ucuguuugggggaauuugu

SEQ ID NO: 1587981 - RNA, 15 nt, Homo sapiens
ucuuaaacaauuugu

SEQ ID NO: 1587982 - RNA, 23 nt, Homo sapiens
ucuuaaagcauuucaggccagug

SEQ ID NO: 1587983 - RNA, 19 nt, Homo sapiens
ucuuaaccuuugcuaugua

SEQ ID NO: 1587984 - RNA, 20 nt, Homo sapiens
ucuuaaccuuugcuauguaa

SEQ ID NO: 1587985 - RNA, 16 nt, Homo sapiens
ucuuaaguagggacuu

SEQ ID NO: 1587986 - RNA, 22 nt, Homo sapiens
ucuuaauacuaaggaaccaaca

SEQ ID NO: 1587987 - RNA, 13 nt, Homo sapiens
ucuuaaucuugau

SEQ ID NO: 1587988 - RNA, 20 nt, Homo sapiens
ucuuaaugaaccuuagaaag

SEQ ID NO: 1587989 - RNA, 16 nt, Homo sapiens
ucuuagaaguggacca

SEQ ID NO: 1587990 - RNA, 13 nt, Homo sapiens
ucuuagcuauguu

SEQ ID NO: 1587991 - RNA, 14 nt, Homo sapiens
ucuuauacagauaa

SEQ ID NO: 1587992 - RNA, 18 nt, Homo sapiens
ucuuaucccagugaucac

SEQ ID NO: 1587993 - RNA, 17 nt, Homo sapiens
ucuuaugauuacuauca

SEQ ID NO: 1587994 - RNA, 18 nt, Homo sapiens
ucuuauuaguuccccaaa

SEQ ID NO: 1587995 - RNA, 20 nt, Homo sapiens
ucuuauuucauuucuuugag

SEQ ID NO: 1587996 - RNA, 16 nt, Homo sapiens
ucuuauuuugcuacug

SEQ ID NO: 1587997 - RNA, 15 nt, Homo sapiens
ucuucaacaugacau

SEQ ID NO: 1587998 - RNA, 16 nt, Homo sapiens
ucuucaauaaaccaca

SEQ ID NO: 1587999 - RNA, 18 nt, Homo sapiens
ucuucaauaaaccacaag

SEQ ID NO: 1588000 - RNA, 20 nt, Homo sapiens
ucuucaauuuauuacugaaa

SEQ ID NO: 1588001 - RNA, 21 nt, Homo sapiens
ucuucacagauuuuuaucuua

SEQ ID NO: 1588002 - RNA, 12 nt, Homo sapiens
ucuucacaggca

SEQ ID NO: 1588003 - RNA, 13 nt, Homo sapiens
ucuucagcauuua

SEQ ID NO: 1588004 - RNA, 16 nt, Homo sapiens
ucuucaggccucccuc

SEQ ID NO: 1588005 - RNA, 21 nt, Homo sapiens
ucuucagggaacugcauagau

SEQ ID NO: 1588006 - RNA, 12 nt, Homo sapiens
ucuucagugaau

SEQ ID NO: 1588007 - RNA, 14 nt, Homo sapiens
ucuucccuaccuca

SEQ ID NO: 1588008 - RNA, 23 nt, Homo sapiens
ucuucccugggcugccaccagcc

SEQ ID NO: 1588009 - RNA, 14 nt, Homo sapiens
ucuuccugacacuu

SEQ ID NO: 1588010 - RNA, 23 nt, Homo sapiens
ucuuccuguugugacugccagga

SEQ ID NO: 1588011 - RNA, 19 nt, Homo sapiens
ucuuccuuccuaauaggca

SEQ ID NO: 1588012 - RNA, 19 nt, Homo sapiens
ucuuccuugaccugcauug

SEQ ID NO: 1588013 - RNA, 19 nt, Homo sapiens
ucuuccuuuuauauaaaua

SEQ ID NO: 1588014 - RNA, 14 nt, Homo sapiens
ucuuccuuuuauca

SEQ ID NO: 1588015 - RNA, 15 nt, Homo sapiens
ucuucuaaacuuccc

SEQ ID NO: 1588016 - RNA, 13 nt, Homo sapiens
ucuucuagugcuu

SEQ ID NO: 1588017 - RNA, 19 nt, Homo sapiens
ucuucuauuaaucaagaga

SEQ ID NO: 1588018 - RNA, 20 nt, Homo sapiens
ucuucugaacucaaacugag

SEQ ID NO: 1588019 - RNA, 18 nt, Homo sapiens
ucuucugauuugucccua

SEQ ID NO: 1588020 - RNA, 21 nt, Homo sapiens
ucuucugcaagccucaugcca

SEQ ID NO: 1588021 - RNA, 13 nt, Homo sapiens
ucuugacuccacu

SEQ ID NO: 1588022 - RNA, 14 nt, Homo sapiens
ucuugacuccacua

SEQ ID NO: 1588023 - RNA, 22 nt, Homo sapiens
ucuugacuuuguaucuucacug

SEQ ID NO: 1588024 - RNA, 14 nt, Homo sapiens
ucuugauaaauaua

SEQ ID NO: 1588025 - RNA, 20 nt, Homo sapiens
ucuugaucuuugagcccauu

SEQ ID NO: 1588026 - RNA, 17 nt, Homo sapiens
ucuugaugcaugcacug

SEQ ID NO: 1588027 - RNA, 13 nt, Homo sapiens
ucuugcuaugaaa

SEQ ID NO: 1588028 - RNA, 19 nt, Homo sapiens
ucuugggcccgguccacag

SEQ ID NO: 1588029 - RNA, 18 nt, Homo sapiens
ucuugguaaaacauuacu

SEQ ID NO: 1588030 - RNA, 20 nt, Homo sapiens
ucuugguguuugacuguaau

SEQ ID NO: 1588031 - RNA, 21 nt, Homo sapiens
ucuuguauaaugaacauguua

SEQ ID NO: 1588032 - RNA, 13 nt, Homo sapiens
ucuugucuuuauu

SEQ ID NO: 1588033 - RNA, 23 nt, Homo sapiens
ucuugugaaggggucaccccagc

SEQ ID NO: 1588034 - RNA, 18 nt, Homo sapiens
ucuuguguaagguuuugg

SEQ ID NO: 1588035 - RNA, 15 nt, Homo sapiens
ucuuguuacugcuga

SEQ ID NO: 1588036 - RNA, 15 nt, Homo sapiens
ucuuguucuacugag

SEQ ID NO: 1588037 - RNA, 13 nt, Homo sapiens
ucuuguugcugca

SEQ ID NO: 1588038 - RNA, 17 nt, Homo sapiens
ucuuguugcugcaucuc

SEQ ID NO: 1588039 - RNA, 18 nt, Homo sapiens
ucuuguuuacaauaaaga

SEQ ID NO: 1588040 - RNA, 14 nt, Homo sapiens
ucuuuaaaggcauc

SEQ ID NO: 1588041 - RNA, 20 nt, Homo sapiens
ucuuuaaaggcaucuacaca

SEQ ID NO: 1588042 - RNA, 22 nt, Homo sapiens
ucuuuaaccacuuuucaauguc

SEQ ID NO: 1588043 - RNA, 12 nt, Homo sapiens
ucuuuaaucucc

SEQ ID NO: 1588044 - RNA, 20 nt, Homo sapiens
ucuuuacaaaacuacaugag

SEQ ID NO: 1588045 - RNA, 23 nt, Homo sapiens
ucuuuaccaaaaaccauguugcg

SEQ ID NO: 1588046 - RNA, 13 nt, Homo sapiens
ucuuuaccagaac

SEQ ID NO: 1588047 - RNA, 12 nt, Homo sapiens
ucuuuaccuccu

SEQ ID NO: 1588048 - RNA, 19 nt, Homo sapiens
ucuuuagaaggacucagua

SEQ ID NO: 1588049 - RNA, 22 nt, Homo sapiens
ucuuuaucaugaagcacaucaa

SEQ ID NO: 1588050 - RNA, 15 nt, Homo sapiens
ucuuucauccuugac

SEQ ID NO: 1588051 - RNA, 17 nt, Homo sapiens
ucuuucccaauucacau

SEQ ID NO: 1588052 - RNA, 16 nt, Homo sapiens
ucuuucucaaucuuga

SEQ ID NO: 1588053 - RNA, 22 nt, Homo sapiens
ucuuucucuccccuccucugaa

SEQ ID NO: 1588054 - RNA, 19 nt, Homo sapiens
acauguuaacaccuaccuc

SEQ ID NO: 1588055 - RNA, 15 nt, Homo sapiens
acauguuaucaaauc

SEQ ID NO: 1588056 - RNA, 18 nt, Homo sapiens
acauguuuuuucauuugu

SEQ ID NO: 1588057 - RNA, 20 nt, Homo sapiens
acauuaaaauaacuaagcaa

SEQ ID NO: 1588058 - RNA, 19 nt, Homo sapiens
acauuaaacaaugaucaca

SEQ ID NO: 1588059 - RNA, 14 nt, Homo sapiens
acauuaacggugcu

SEQ ID NO: 1588060 - RNA, 18 nt, Homo sapiens
acauuaaugagaauuccu

SEQ ID NO: 1588061 - RNA, 18 nt, Homo sapiens
acauuauucuucacuuaa

SEQ ID NO: 1588062 - RNA, 12 nt, Homo sapiens
acauuccaaacu

SEQ ID NO: 1588063 - RNA, 20 nt, Homo sapiens
acauucccuugauggucuca

SEQ ID NO: 1588064 - RNA, 22 nt, Homo sapiens
acauucuagcugagaagcaaug

SEQ ID NO: 1588065 - RNA, 22 nt, Homo sapiens
acauucuuccaucaucacugua

SEQ ID NO: 1588066 - RNA, 11 nt, Homo sapiens
acauugcccaa

SEQ ID NO: 1588067 - RNA, 12 nt, Homo sapiens
acauugcccaag

SEQ ID NO: 1588068 - RNA, 13 nt, Homo sapiens
acauugcuagacg

SEQ ID NO: 1588069 - RNA, 18 nt, Homo sapiens
acauuguuuuuguauauu

SEQ ID NO: 1588070 - RNA, 16 nt, Homo sapiens
acauuuaaaccuuuua

SEQ ID NO: 1588071 - RNA, 14 nt, Homo sapiens
acauuuaaauucca

SEQ ID NO: 1588072 - RNA, 17 nt, Homo sapiens
acauuuaauaaaacugc

SEQ ID NO: 1588073 - RNA, 15 nt, Homo sapiens
acauuuacuguggau

SEQ ID NO: 1588074 - RNA, 18 nt, Homo sapiens
acauuuagccaaucuuuc

SEQ ID NO: 1588075 - RNA, 18 nt, Homo sapiens
acauuucaccccacucug

SEQ ID NO: 1588076 - RNA, 16 nt, Homo sapiens
acauuuccacaccaga

SEQ ID NO: 1588077 - RNA, 13 nt, Homo sapiens
acauuuccaugca

SEQ ID NO: 1588078 - RNA, 18 nt, Homo sapiens
acauuucuauagccaaaa

SEQ ID NO: 1588079 - RNA, 14 nt, Homo sapiens
acauuucucacuga

SEQ ID NO: 1588080 - RNA, 12 nt, Homo sapiens
acauuuguucca

SEQ ID NO: 1588081 - RNA, 21 nt, Homo sapiens
acccaggggacagcuggugca

SEQ ID NO: 1588082 - RNA, 17 nt, Homo sapiens
acccagguucaugaaua

SEQ ID NO: 1588083 - RNA, 13 nt, Homo sapiens
acccagucucaga

SEQ ID NO: 1588084 - RNA, 18 nt, Homo sapiens
acccagugcugaauuucc

SEQ ID NO: 1588085 - RNA, 14 nt, Homo sapiens
acccaucagcacuc

SEQ ID NO: 1588086 - RNA, 12 nt, Homo sapiens
acccaugccaga

SEQ ID NO: 1588087 - RNA, 17 nt, Homo sapiens
acccauucagagacugu

SEQ ID NO: 1588088 - RNA, 18 nt, Homo sapiens
acccauucuacacagagc

SEQ ID NO: 1588089 - RNA, 14 nt, Homo sapiens
accccaacucuccc

SEQ ID NO: 1588090 - RNA, 24 nt, Homo sapiens
accccaauggcuacucugcucaca

SEQ ID NO: 1588091 - RNA, 18 nt, Homo sapiens
accccagcaugagugcug

SEQ ID NO: 1588092 - RNA, 22 nt, Homo sapiens
accccagccccaacuccagggg

SEQ ID NO: 1588093 - RNA, 22 nt, Homo sapiens
accccaguaccgacuaagcaaa

SEQ ID NO: 1588094 - RNA, 17 nt, Homo sapiens
accccaguggauucuca

SEQ ID NO: 1588095 - RNA, 17 nt, Homo sapiens
accccaguuccuagcac

SEQ ID NO: 1588096 - RNA, 20 nt, Homo sapiens
accccaguuccuagcacugc

SEQ ID NO: 1588097 - RNA, 14 nt, Homo sapiens
accccaugccaaag

SEQ ID NO: 1588098 - RNA, 20 nt, Homo sapiens
acccccaaauuuaauuaaag

SEQ ID NO: 1588099 - RNA, 14 nt, Homo sapiens
acccccagugcagg

SEQ ID NO: 1588100 - RNA, 13 nt, Homo sapiens
acccccaucuuua

SEQ ID NO: 1588101 - RNA, 21 nt, Homo sapiens
acccccaucuuuacaaagaaa

SEQ ID NO: 1588102 - RNA, 18 nt, Homo sapiens
accccccagcacugagga

SEQ ID NO: 1588103 - RNA, 13 nt, Homo sapiens
acccccugcccug

SEQ ID NO: 1588104 - RNA, 21 nt, Homo sapiens
acccccuucaaaccuaaaaau

SEQ ID NO: 1588105 - RNA, 13 nt, Homo sapiens
acccccuuccuuc

SEQ ID NO: 1588106 - RNA, 17 nt, Homo sapiens
accccuaccucuaguaa

SEQ ID NO: 1588107 - RNA, 14 nt, Homo sapiens
aggaaagcccuccc

SEQ ID NO: 1588108 - RNA, 22 nt, Homo sapiens
aggaaaggccccaaucuugccc

SEQ ID NO: 1588109 - RNA, 23 nt, Homo sapiens
aggaaauaguaccuucaauacuu

SEQ ID NO: 1588110 - RNA, 14 nt, Homo sapiens
aggaaauccgguca

SEQ ID NO: 1588111 - RNA, 15 nt, Homo sapiens
aggaacaaacagggc

SEQ ID NO: 1588112 - RNA, 20 nt, Homo sapiens
aggaacaaagacaaccacug

SEQ ID NO: 1588113 - RNA, 15 nt, Homo sapiens
aggaacaaagacagg

SEQ ID NO: 1588114 - RNA, 15 nt, Homo sapiens
aggaacagcacuggg

SEQ ID NO: 1588115 - RNA, 20 nt, Homo sapiens
aggaaccucgaguacugugg

SEQ ID NO: 1588116 - RNA, 18 nt, Homo sapiens
aggaacuugucucuucau

SEQ ID NO: 1588117 - RNA, 15 nt, Homo sapiens
aggaagaaaugucag

SEQ ID NO: 1588118 - RNA, 17 nt, Homo sapiens
aggaagaaaugucagau

SEQ ID NO: 1588119 - RNA, 16 nt, Homo sapiens
aggaagagcaggacuc

SEQ ID NO: 1588120 - RNA, 18 nt, Homo sapiens
aggaagccaggugagaaa

SEQ ID NO: 1588121 - RNA, 15 nt, Homo sapiens
aggaagggagaacuu

SEQ ID NO: 1588122 - RNA, 21 nt, Homo sapiens
aggaagggccauuuuggugcu

SEQ ID NO: 1588123 - RNA, 21 nt, Homo sapiens
aggaagguaugugucagccau

SEQ ID NO: 1588124 - RNA, 15 nt, Homo sapiens
aggaaguggcucaga

SEQ ID NO: 1588125 - RNA, 19 nt, Homo sapiens
aggaaguggcugucccugu

SEQ ID NO: 1588126 - RNA, 22 nt, Homo sapiens
aggaaguugacuuauaguacau

SEQ ID NO: 1588127 - RNA, 18 nt, Homo sapiens
aggaauauaagaaaagua

SEQ ID NO: 1588128 - RNA, 17 nt, Homo sapiens
aggaauccccaacaugc

SEQ ID NO: 1588129 - RNA, 23 nt, Homo sapiens
aggaauccuggaccaagcacaaa

SEQ ID NO: 1588130 - RNA, 14 nt, Homo sapiens
aggaaugacaauaa

SEQ ID NO: 1588131 - RNA, 13 nt, Homo sapiens
aggaauggugcuu

SEQ ID NO: 1588132 - RNA, 14 nt, Homo sapiens
aggaauuacuuuau

SEQ ID NO: 1588133 - RNA, 12 nt, Homo sapiens
aggacacaguga

SEQ ID NO: 1588134 - RNA, 17 nt, Homo sapiens
aggacaucaaaguggua

SEQ ID NO: 1588135 - RNA, 16 nt, Homo sapiens
aggaccaacauccagu

SEQ ID NO: 1588136 - RNA, 17 nt, Homo sapiens
aggacccuaagaugaag

SEQ ID NO: 1588137 - RNA, 23 nt, Homo sapiens
aggacuaccagccauacaaauag

SEQ ID NO: 1588138 - RNA, 14 nt, Homo sapiens
aggacuccucagaa

SEQ ID NO: 1588139 - RNA, 12 nt, Homo sapiens
aggacugaacaa

SEQ ID NO: 1588140 - RNA, 14 nt, Homo sapiens
aggacuguaaucuu

SEQ ID NO: 1588141 - RNA, 13 nt, Homo sapiens
aggacuguagaaa

SEQ ID NO: 1588142 - RNA, 23 nt, Homo sapiens
aggacuuagggugucguuuucac

SEQ ID NO: 1588143 - RNA, 19 nt, Homo sapiens
aggacuuagugcaucagau

SEQ ID NO: 1588144 - RNA, 17 nt, Homo sapiens
aggagaacaaauauuca

SEQ ID NO: 1588145 - RNA, 17 nt, Homo sapiens
aggagaagaagguuucu

SEQ ID NO: 1588146 - RNA, 16 nt, Homo sapiens
aggagacuuucaugca

SEQ ID NO: 1588147 - RNA, 19 nt, Homo sapiens
aggagacuuucaugcagcc

SEQ ID NO: 1588148 - RNA, 13 nt, Homo sapiens
aggagagagcagc

SEQ ID NO: 1588149 - RNA, 12 nt, Homo sapiens
aggagagcaaga

SEQ ID NO: 1588150 - RNA, 18 nt, Homo sapiens
aggagaugucaucaagcu

SEQ ID NO: 1588151 - RNA, 15 nt, Homo sapiens
aggagauuccuuucc

SEQ ID NO: 1588152 - RNA, 13 nt, Homo sapiens
aggagcagcccug

SEQ ID NO: 1588153 - RNA, 19 nt, Homo sapiens
aggagccaccaguucucau

SEQ ID NO: 1588154 - RNA, 17 nt, Homo sapiens
aggagccucacuggggc

SEQ ID NO: 1588155 - RNA, 21 nt, Homo sapiens
aggagccucauccagccucag

SEQ ID NO: 1588156 - RNA, 13 nt, Homo sapiens
aggagcuacccuu

SEQ ID NO: 1588157 - RNA, 21 nt, Homo sapiens
aggagcugcuggcuugcagug

SEQ ID NO: 1588158 - RNA, 14 nt, Homo sapiens
aggaggaucacuuu

SEQ ID NO: 1588159 - RNA, 15 nt, Homo sapiens
aggaggcagcucagg

SEQ ID NO: 1588160 - RNA, 19 nt, Homo sapiens
aggagggaugcguguucca

SEQ ID NO: 1588161 - RNA, 23 nt, Homo sapiens
aggagguccuuaggccucugaga

SEQ ID NO: 1588162 - RNA, 22 nt, Homo sapiens
aggagguuauaccaggauuuau

SEQ ID NO: 1588163 - RNA, 18 nt, Homo sapiens
aggaguauaccaugagau

SEQ ID NO: 1588164 - RNA, 13 nt, Homo sapiens
aggaguccaggcc

SEQ ID NO: 1588165 - RNA, 20 nt, Homo sapiens
aggagugcgugccugcuacg

SEQ ID NO: 1588166 - RNA, 21 nt, Homo sapiens
aggaguguccucuucccucuc

SEQ ID NO: 1588167 - RNA, 17 nt, Homo sapiens
aggagugugaccacuga

SEQ ID NO: 1588168 - RNA, 17 nt, Homo sapiens
aggaguuagaaccacag

SEQ ID NO: 1588169 - RNA, 22 nt, Homo sapiens
aggauaacuggcacccagagaa

SEQ ID NO: 1588170 - RNA, 23 nt, Homo sapiens
aggauagaagcugcagugguauu

SEQ ID NO: 1588171 - RNA, 12 nt, Homo sapiens
aggaucacuuga

SEQ ID NO: 1588172 - RNA, 20 nt, Homo sapiens
aggaucugucugugcacaug

SEQ ID NO: 1588173 - RNA, 16 nt, Homo sapiens
aggaucuuugacugaa

SEQ ID NO: 1588174 - RNA, 17 nt, Homo sapiens
aggauggaugcaucaca

SEQ ID NO: 1588175 - RNA, 19 nt, Homo sapiens
aggauggaugcaucacacu

SEQ ID NO: 1588176 - RNA, 22 nt, Homo sapiens
aggauggggcucccagcuccuu

SEQ ID NO: 1588177 - RNA, 13 nt, Homo sapiens
aggauguacaguu

SEQ ID NO: 1588178 - RNA, 19 nt, Homo sapiens
aggaugucaccaacugaau

SEQ ID NO: 1588179 - RNA, 22 nt, Homo sapiens
aggauugaaaauguccaggaaa

SEQ ID NO: 1588180 - RNA, 14 nt, Homo sapiens
aggauuuuaccaaa

SEQ ID NO: 1588181 - RNA, 18 nt, Homo sapiens
aggauuuucacacauuca

SEQ ID NO: 1588182 - RNA, 21 nt, Homo sapiens
aggauuuucacauucuuggcu

SEQ ID NO: 1588183 - RNA, 17 nt, Homo sapiens
aggcaaaguuuacagau

SEQ ID NO: 1588184 - RNA, 20 nt, Homo sapiens
aggcaacaggggcacaagcc

SEQ ID NO: 1588185 - RNA, 14 nt, Homo sapiens
aggcaacauccaaa

SEQ ID NO: 1588186 - RNA, 21 nt, Homo sapiens
aggcaagguugggcuggugcu

SEQ ID NO: 1588187 - RNA, 23 nt, Homo sapiens
aggcaauaauaagugaugugcug

SEQ ID NO: 1588188 - RNA, 18 nt, Homo sapiens
aggcaauccuaccuugcu

SEQ ID NO: 1588189 - RNA, 19 nt, Homo sapiens
aggcaaugugggaucucag

SEQ ID NO: 1588190 - RNA, 16 nt, Homo sapiens
aggcacacacugugcu

SEQ ID NO: 1588191 - RNA, 18 nt, Homo sapiens
aggcacacagcuacucuc

SEQ ID NO: 1588192 - RNA, 18 nt, Homo sapiens
aggcacagcuaaccacuu

SEQ ID NO: 1588193 - RNA, 16 nt, Homo sapiens
aggcacaguggcucac

SEQ ID NO: 1588194 - RNA, 14 nt, Homo sapiens
aggcaccagaagaa

SEQ ID NO: 1588195 - RNA, 19 nt, Homo sapiens
aggcacccgccaccaugcc

SEQ ID NO: 1588196 - RNA, 19 nt, Homo sapiens
aggcaccugccaccaugcc

SEQ ID NO: 1588197 - RNA, 13 nt, Homo sapiens
aggcacgugccac

SEQ ID NO: 1588198 - RNA, 15 nt, Homo sapiens
aggcagcagugugag

SEQ ID NO: 1588199 - RNA, 14 nt, Homo sapiens
aggcagcugaucca

SEQ ID NO: 1588200 - RNA, 19 nt, Homo sapiens
aggcagcugccucugcucc

SEQ ID NO: 1588201 - RNA, 21 nt, Homo sapiens
aggcaggaacaaacagggcug

SEQ ID NO: 1588202 - RNA, 14 nt, Homo sapiens
aggccaagaacuug

SEQ ID NO: 1588203 - RNA, 15 nt, Homo sapiens
aggccagacauggug

SEQ ID NO: 1588204 - RNA, 16 nt, Homo sapiens
aggccaggcacagugg

SEQ ID NO: 1588205 - RNA, 21 nt, Homo sapiens
aacaguucugagcuguaauuu

SEQ ID NO: 1588206 - RNA, 23 nt, Homo sapiens
aacaguugccacaucacacagac

SEQ ID NO: 1588207 - RNA, 14 nt, Homo sapiens
aacaguuguauguu

SEQ ID NO: 1588208 - RNA, 17 nt, Homo sapiens
aacauaccccuuacaaa

SEQ ID NO: 1588209 - RNA, 20 nt, Homo sapiens
aacauagauuuaagugaaua

SEQ ID NO: 1588210 - RNA, 16 nt, Homo sapiens
aacaucacucuugucu

SEQ ID NO: 1588211 - RNA, 18 nt, Homo sapiens
aacaucauuacuuaugau

SEQ ID NO: 1588212 - RNA, 21 nt, Homo sapiens
aacaucuccccucucaccuca

SEQ ID NO: 1588213 - RNA, 19 nt, Homo sapiens
aacaucuuaagauccacaa

SEQ ID NO: 1588214 - RNA, 23 nt, Homo sapiens
aacaucuuuucuugccucugucc

SEQ ID NO: 1588215 - RNA, 18 nt, Homo sapiens
aacaugacauccagagau

SEQ ID NO: 1588216 - RNA, 11 nt, Homo sapiens
aacaugcaaua

SEQ ID NO: 1588217 - RNA, 20 nt, Homo sapiens
aacaugccagccacugugau

SEQ ID NO: 1588218 - RNA, 18 nt, Homo sapiens
aacaugcuuauaacauua

SEQ ID NO: 1588219 - RNA, 17 nt, Homo sapiens
aacaugcuugcauuaua

SEQ ID NO: 1588220 - RNA, 16 nt, Homo sapiens
aacauggcacauguau

SEQ ID NO: 1588221 - RNA, 20 nt, Homo sapiens
aacauguaagcauaacuuau

SEQ ID NO: 1588222 - RNA, 14 nt, Homo sapiens
aacauguacuacag

SEQ ID NO: 1588223 - RNA, 18 nt, Homo sapiens
aacauuaacaaaagcaau

SEQ ID NO: 1588224 - RNA, 17 nt, Homo sapiens
aacauuaucuaguucau

SEQ ID NO: 1588225 - RNA, 17 nt, Homo sapiens
aacauuauucaucucuc

SEQ ID NO: 1588226 - RNA, 22 nt, Homo sapiens
aacauuauucaucucuccuccc

SEQ ID NO: 1588227 - RNA, 13 nt, Homo sapiens
aacauuauucuca

SEQ ID NO: 1588228 - RNA, 12 nt, Homo sapiens
aacauucaggaa

SEQ ID NO: 1588229 - RNA, 23 nt, Homo sapiens
aacauucucucauagaacauuga

SEQ ID NO: 1588230 - RNA, 13 nt, Homo sapiens
aacauuguacugu

SEQ ID NO: 1588231 - RNA, 16 nt, Homo sapiens
aacauuguugauuuca

SEQ ID NO: 1588232 - RNA, 22 nt, Homo sapiens
aacauuguuuuuguugucuuua

SEQ ID NO: 1588233 - RNA, 14 nt, Homo sapiens
aacauuuacaacuc

SEQ ID NO: 1588234 - RNA, 15 nt, Homo sapiens
aacauuucauuguac

SEQ ID NO: 1588235 - RNA, 16 nt, Homo sapiens
aacauuucucacugaa

SEQ ID NO: 1588236 - RNA, 19 nt, Homo sapiens
ccaaagaaauguaagggaa

SEQ ID NO: 1588237 - RNA, 19 nt, Homo sapiens
ccaaagagggcuuccucua

SEQ ID NO: 1588238 - RNA, 23 nt, Homo sapiens
ccaaagcuuuaucugucuugacu

SEQ ID NO: 1588239 - RNA, 19 nt, Homo sapiens
ccaaaggagaagaguguaa

SEQ ID NO: 1588240 - RNA, 17 nt, Homo sapiens
ccaaaggagacauauca

SEQ ID NO: 1588241 - RNA, 20 nt, Homo sapiens
ccaaaguccuuuuuuuccau

SEQ ID NO: 1588242 - RNA, 15 nt, Homo sapiens
ccaaagugcugggau

SEQ ID NO: 1588243 - RNA, 18 nt, Homo sapiens
ccaaauaaaauguucccu

SEQ ID NO: 1588244 - RNA, 14 nt, Homo sapiens
ccaaaucaccacaa

SEQ ID NO: 1588245 - RNA, 13 nt, Homo sapiens
ccaaaucucagua

SEQ ID NO: 1588246 - RNA, 14 nt, Homo sapiens
ccaaaugcagggag

SEQ ID NO: 1588247 - RNA, 16 nt, Homo sapiens
ccaaaugucaucaggu

SEQ ID NO: 1588248 - RNA, 17 nt, Homo sapiens
ccaaauuagugaaccaa

SEQ ID NO: 1588249 - RNA, 15 nt, Homo sapiens
ccaaauuuaauuaaa

SEQ ID NO: 1588250 - RNA, 20 nt, Homo sapiens
ccaaauuuaauuaaagccuu

SEQ ID NO: 1588251 - RNA, 21 nt, Homo sapiens
ccaaauuuaauuaaagccuua

SEQ ID NO: 1588252 - RNA, 13 nt, Homo sapiens
ccaacagcacuuu

SEQ ID NO: 1588253 - RNA, 11 nt, Homo sapiens
ccaacauccag

SEQ ID NO: 1588254 - RNA, 17 nt, Homo sapiens
ccaacauggcacaugua

SEQ ID NO: 1588255 - RNA, 16 nt, Homo sapiens
ccaacauuucucacug

SEQ ID NO: 1588256 - RNA, 21 nt, Homo sapiens
ccaaccaguccucaguucucu

SEQ ID NO: 1588257 - RNA, 15 nt, Homo sapiens
ccaacccccaucucc

SEQ ID NO: 1588258 - RNA, 15 nt, Homo sapiens
ccaaccucacccucc

SEQ ID NO: 1588259 - RNA, 15 nt, Homo sapiens
ccaaccuggacuugu

SEQ ID NO: 1588260 - RNA, 19 nt, Homo sapiens
ccaacgagacacauugccu

SEQ ID NO: 1588261 - RNA, 14 nt, Homo sapiens
ccaacguacuccuc

SEQ ID NO: 1588262 - RNA, 21 nt, Homo sapiens
ccaacuaaugccuuacucuuc

SEQ ID NO: 1588263 - RNA, 11 nt, Homo sapiens
ccaacuauuaa

SEQ ID NO: 1588264 - RNA, 12 nt, Homo sapiens
ccaacucaagga

SEQ ID NO: 1588265 - RNA, 13 nt, Homo sapiens
ccaacuccaggaa

SEQ ID NO: 1588266 - RNA, 20 nt, Homo sapiens
ccaacuccaggaaagagcag

SEQ ID NO: 1588267 - RNA, 13 nt, Homo sapiens
ccaacuccagggg

SEQ ID NO: 1588268 - RNA, 20 nt, Homo sapiens
ccaacuccgcccagccucuc

SEQ ID NO: 1588269 - RNA, 20 nt, Homo sapiens
ccaacugcagcucuccauca

SEQ ID NO: 1588270 - RNA, 13 nt, Homo sapiens
ccaacugcuccag

SEQ ID NO: 1588271 - RNA, 19 nt, Homo sapiens
ccaacuucucuugcuuucu

SEQ ID NO: 1588272 - RNA, 14 nt, Homo sapiens
ccaagaacagaguc

SEQ ID NO: 1588273 - RNA, 19 nt, Homo sapiens
ccaagaaguggcugccaaa

SEQ ID NO: 1588274 - RNA, 15 nt, Homo sapiens
ccaagcaggacagug

SEQ ID NO: 1588275 - RNA, 12 nt, Homo sapiens
ccaagcauuuca

SEQ ID NO: 1588276 - RNA, 16 nt, Homo sapiens
ccaagccaaguuuucu

SEQ ID NO: 1588277 - RNA, 11 nt, Homo sapiens
ccaagcucaac

SEQ ID NO: 1588278 - RNA, 17 nt, Homo sapiens
ccaaggaaucaugucag

SEQ ID NO: 1588279 - RNA, 20 nt, Homo sapiens
ccaaggauagaagcugcagu

SEQ ID NO: 1588280 - RNA, 14 nt, Homo sapiens
ccaaggcaagcaug

SEQ ID NO: 1588281 - RNA, 19 nt, Homo sapiens
ccaaggccacagggagcuc

SEQ ID NO: 1588282 - RNA, 17 nt, Homo sapiens
ccaagggaucugccauu

SEQ ID NO: 1588283 - RNA, 17 nt, Homo sapiens
ccaagguauacaucuuc

SEQ ID NO: 1588284 - RNA, 11 nt, Homo sapiens
ccaagguccug

SEQ ID NO: 1588285 - RNA, 12 nt, Homo sapiens
ccaaggugguga

SEQ ID NO: 1588286 - RNA, 20 nt, Homo sapiens
ccaagguggugaaaucccau

SEQ ID NO: 1588287 - RNA, 22 nt, Homo sapiens
ccaaguaaacaggguaccucaa

SEQ ID NO: 1588288 - RNA, 19 nt, Homo sapiens
ccaaguagcugggauuaca

SEQ ID NO: 1588289 - RNA, 15 nt, Homo sapiens
ccaagucaguucucu

SEQ ID NO: 1588290 - RNA, 16 nt, Homo sapiens
ccaagucucagaagag

SEQ ID NO: 1588291 - RNA, 11 nt, Homo sapiens
ccaagugcaau

SEQ ID NO: 1588292 - RNA, 12 nt, Homo sapiens
ccaagugcaaua

SEQ ID NO: 1588293 - RNA, 20 nt, Homo sapiens
ccaaguuccuuggccaugca

SEQ ID NO: 1588294 - RNA, 23 nt, Homo sapiens
ccaaguucuuagggcacaugaaa

SEQ ID NO: 1588295 - RNA, 21 nt, Homo sapiens
ccaaguucuuaguugcuguau

SEQ ID NO: 1588296 - RNA, 13 nt, Homo sapiens
ccaauagcacuuu

SEQ ID NO: 1588297 - RNA, 18 nt, Homo sapiens
ccaauagugucauccuca

SEQ ID NO: 1588298 - RNA, 14 nt, Homo sapiens
ccaaucagcacucu

SEQ ID NO: 1588299 - RNA, 16 nt, Homo sapiens
ccaaucagcacucugu

SEQ ID NO: 1588300 - RNA, 17 nt, Homo sapiens
ccaauccacacauauug

SEQ ID NO: 1588301 - RNA, 21 nt, Homo sapiens
ccaaugacacccaugccagag

SEQ ID NO: 1588302 - RNA, 18 nt, Homo sapiens
ccaaugagacucuagggu

SEQ ID NO: 1588303 - RNA, 20 nt, Homo sapiens
ccaaugagaucauugugaag

SEQ ID NO: 1588304 - RNA, 20 nt, Homo sapiens
ccaaugagggaauccauuga

SEQ ID NO: 1588305 - RNA, 15 nt, Homo sapiens
ccaaugaucuugcaa

SEQ ID NO: 1588306 - RNA, 14 nt, Homo sapiens
ccaaugccaccuag

SEQ ID NO: 1588307 - RNA, 23 nt, Homo sapiens
ccaauguucuauuaaucaccucu

SEQ ID NO: 1588308 - RNA, 19 nt, Homo sapiens
ccaauuacagggugacuca

SEQ ID NO: 1588309 - RNA, 16 nt, Homo sapiens
ccaauucagugucugu

SEQ ID NO: 1588310 - RNA, 16 nt, Homo sapiens
ccaauuccuugcacau

SEQ ID NO: 1588311 - RNA, 17 nt, Homo sapiens
ccaauugccucuugcag

SEQ ID NO: 1588312 - RNA, 13 nt, Homo sapiens
ccaauuuauaugu

SEQ ID NO: 1588313 - RNA, 22 nt, Homo sapiens
ccaauuugguaaaaaugcugcu

SEQ ID NO: 1588314 - RNA, 15 nt, Homo sapiens
ccaauuuuguugcau

SEQ ID NO: 1588315 - RNA, 14 nt, Homo sapiens
ccacaaaaguuccc

SEQ ID NO: 1588316 - RNA, 16 nt, Homo sapiens
ccacaaacacauuaua

SEQ ID NO: 1588317 - RNA, 20 nt, Homo sapiens
ccacaagcugcacugugaac

SEQ ID NO: 1588318 - RNA, 22 nt, Homo sapiens
ccacaaucuggcuuagugccac

SEQ ID NO: 1588319 - RNA, 22 nt, Homo sapiens
ccacaauuacauacuauucuua

SEQ ID NO: 1588320 - RNA, 22 nt, Homo sapiens
ccacaauuauuggcaaaguuua

SEQ ID NO: 1588321 - RNA, 12 nt, Homo sapiens
ccacacacugag

SEQ ID NO: 1588322 - RNA, 20 nt, Homo sapiens
ccacacacugaguugcacau

SEQ ID NO: 1588323 - RNA, 18 nt, Homo sapiens
ccacacauuaguacuuau

SEQ ID NO: 1588324 - RNA, 14 nt, Homo sapiens
ccacaccaagcagc

SEQ ID NO: 1588325 - RNA, 23 nt, Homo sapiens
ccacaccuggcauggugcaggga

SEQ ID NO: 1588326 - RNA, 12 nt, Homo sapiens
ccacacuccacu

SEQ ID NO: 1588327 - RNA, 11 nt, Homo sapiens
ccacacugaga

SEQ ID NO: 1588328 - RNA, 20 nt, Homo sapiens
ccacacugagagaguggaga

SEQ ID NO: 1588329 - RNA, 18 nt, Homo sapiens
ccacacuuaaauucucua

SEQ ID NO: 1588330 - RNA, 22 nt, Homo sapiens
ccacagaaagcuccuuccagac

SEQ ID NO: 1588331 - RNA, 20 nt, Homo sapiens
ccacagcagacaccauucau

SEQ ID NO: 1588332 - RNA, 14 nt, Homo sapiens
ccacagcagcauuu

SEQ ID NO: 1588333 - RNA, 22 nt, Homo sapiens
ccacagcgcucgauggaccuca

SEQ ID NO: 1588334 - RNA, 18 nt, Homo sapiens
ccacagcugcuguucuca

SEQ ID NO: 1588335 - RNA, 14 nt, Homo sapiens
ccacaggacauuuc

SEQ ID NO: 1588336 - RNA, 22 nt, Homo sapiens
ccacaggcaguccaggccucuc

SEQ ID NO: 1588337 - RNA, 19 nt, Homo sapiens
ccacaggccugagauuuca

SEQ ID NO: 1588338 - RNA, 22 nt, Homo sapiens
ccacaggcuccccaucuucucc

SEQ ID NO: 1588339 - RNA, 22 nt, Homo sapiens
ccacagggagcuccgucagcuu

SEQ ID NO: 1588340 - RNA, 16 nt, Homo sapiens
ccacaguaauugguca

SEQ ID NO: 1588341 - RNA, 14 nt, Homo sapiens
ccacagucacugga

SEQ ID NO: 1588342 - RNA, 14 nt, Homo sapiens
ccacauaaauuuua

SEQ ID NO: 1588343 - RNA, 17 nt, Homo sapiens
ccacauaagaaggcaau

SEQ ID NO: 1588344 - RNA, 20 nt, Homo sapiens
ccacauaagaaggcaauuuu

SEQ ID NO: 1588345 - RNA, 15 nt, Homo sapiens
ccacauaagcacucc

SEQ ID NO: 1588346 - RNA, 14 nt, Homo sapiens
ccacauaccuggcc

SEQ ID NO: 1588347 - RNA, 22 nt, Homo sapiens
ccacauauuuuagacacuuccc

SEQ ID NO: 1588348 - RNA, 21 nt, Homo sapiens
ccacauccuccacguucugcu

SEQ ID NO: 1588349 - RNA, 23 nt, Homo sapiens
ccacauccuccacguucugcuca

SEQ ID NO: 1588350 - RNA, 12 nt, Homo sapiens
ccacauguuuca

SEQ ID NO: 1588351 - RNA, 23 nt, Homo sapiens
ccaccaaaggagacauaucacug

SEQ ID NO: 1588352 - RNA, 18 nt, Homo sapiens
ccaccaacauucuuggca

SEQ ID NO: 1588353 - RNA, 17 nt, Homo sapiens
ccaccaagaagcacugg

SEQ ID NO: 1588354 - RNA, 16 nt, Homo sapiens
ccaccaccccaguuuc

SEQ ID NO: 1588355 - RNA, 22 nt, Homo sapiens
cauguuggucaggcuggucuca

SEQ ID NO: 1588356 - RNA, 22 nt, Homo sapiens
cauuaaaaggcccuucaccucu

SEQ ID NO: 1588357 - RNA, 23 nt, Homo sapiens
cauuaaaauuuuuuaacauauug

SEQ ID NO: 1588358 - RNA, 14 nt, Homo sapiens
cauuaaacaaauaa

SEQ ID NO: 1588359 - RNA, 21 nt, Homo sapiens
cauuaaacucuaaagauuagg

SEQ ID NO: 1588360 - RNA, 13 nt, Homo sapiens
cauuaaagagcca

SEQ ID NO: 1588361 - RNA, 18 nt, Homo sapiens
cauuaaauucacaaacuu

SEQ ID NO: 1588362 - RNA, 17 nt, Homo sapiens
cauuaacaaaagcaauu

SEQ ID NO: 1588363 - RNA, 20 nt, Homo sapiens
cauuaacugcacaaacaaua

SEQ ID NO: 1588364 - RNA, 20 nt, Homo sapiens
cauuaauaccuaaacuguau

SEQ ID NO: 1588365 - RNA, 15 nt, Homo sapiens
cauuaaucagauuag

SEQ ID NO: 1588366 - RNA, 22 nt, Homo sapiens
cauuaccgucauuggccuguga

SEQ ID NO: 1588367 - RNA, 20 nt, Homo sapiens
cauuaccuguucuugccuaa

SEQ ID NO: 1588368 - RNA, 22 nt, Homo sapiens
cauuacuuaugaugaugaaggg

SEQ ID NO: 1588369 - RNA, 19 nt, Homo sapiens
cauuagucaauaacuaaac

SEQ ID NO: 1588370 - RNA, 18 nt, Homo sapiens
cauuauaacugaaggaga

SEQ ID NO: 1588371 - RNA, 20 nt, Homo sapiens
cauuauaugcacuagcaaua

SEQ ID NO: 1588372 - RNA, 15 nt, Homo sapiens
cauuauauugcaaug

SEQ ID NO: 1588373 - RNA, 20 nt, Homo sapiens
cauuauccuuuuaucucaca

SEQ ID NO: 1588374 - RNA, 19 nt, Homo sapiens
cauuaucgagcagcauuuu

SEQ ID NO: 1588375 - RNA, 15 nt, Homo sapiens
cauuaugcaaaugga

SEQ ID NO: 1588376 - RNA, 17 nt, Homo sapiens
cauucaacucuccaaug

SEQ ID NO: 1588377 - RNA, 16 nt, Homo sapiens
cauucacucuuccugc

SEQ ID NO: 1588378 - RNA, 23 nt, Homo sapiens
cauucagaagaaaaagaagcaac

SEQ ID NO: 1588379 - RNA, 23 nt, Homo sapiens
cauuccaaaguucaacuugguga

SEQ ID NO: 1588380 - RNA, 14 nt, Homo sapiens
cauuccagcucugc

SEQ ID NO: 1588381 - RNA, 17 nt, Homo sapiens
cauuccuaaaacacccu

SEQ ID NO: 1588382 - RNA, 14 nt, Homo sapiens
cauuccuucccacc

SEQ ID NO: 1588383 - RNA, 20 nt, Homo sapiens
cauucuccagggguuuacag

SEQ ID NO: 1588384 - RNA, 22 nt, Homo sapiens
cauucuccucucucuaucccug

SEQ ID NO: 1588385 - RNA, 15 nt, Homo sapiens
cauucucgcuucccu

SEQ ID NO: 1588386 - RNA, 14 nt, Homo sapiens
cauucugccaaagu

SEQ ID NO: 1588387 - RNA, 15 nt, Homo sapiens
cauucugccaaagua

SEQ ID NO: 1588388 - RNA, 22 nt, Homo sapiens
cauucuuccaucaucacuguaa

SEQ ID NO: 1588389 - RNA, 20 nt, Homo sapiens
cauucuuuuugaaaugucaa

SEQ ID NO: 1588390 - RNA, 18 nt, Homo sapiens
cauugaaguaaugaauuu

SEQ ID NO: 1588391 - RNA, 22 nt, Homo sapiens
cauugaguaaaguuuuaaaaag

SEQ ID NO: 1588392 - RNA, 12 nt, Homo sapiens
cauugauguuaa

SEQ ID NO: 1588393 - RNA, 18 nt, Homo sapiens
cauugauuugcucuuacu

SEQ ID NO: 1588394 - RNA, 19 nt, Homo sapiens
cauugauuugcucuuacua

SEQ ID NO: 1588395 - RNA, 18 nt, Homo sapiens
cauugccaauuagacaaa

SEQ ID NO: 1588396 - RNA, 13 nt, Homo sapiens
cauugccuagcuc

SEQ ID NO: 1588397 - RNA, 20 nt, Homo sapiens
cauuggaauucuacuggaaa

SEQ ID NO: 1588398 - RNA, 15 nt, Homo sapiens
cauuggugaaguaaa

SEQ ID NO: 1588399 - RNA, 21 nt, Homo sapiens
cauugguggcaucacagaccc

SEQ ID NO: 1588400 - RNA, 14 nt, Homo sapiens
cauuguauucuguu

SEQ ID NO: 1588401 - RNA, 12 nt, Homo sapiens
cauugucccuga

SEQ ID NO: 1588402 - RNA, 22 nt, Homo sapiens
cauugucguauaggcauguaaa

SEQ ID NO: 1588403 - RNA, 17 nt, Homo sapiens
cauugugaucagcuagc

SEQ ID NO: 1588404 - RNA, 17 nt, Homo sapiens
cauuuaaaacaggcaaa

SEQ ID NO: 1588405 - RNA, 16 nt, Homo sapiens
cauuuaaaauucaauu

SEQ ID NO: 1588406 - RNA, 21 nt, Homo sapiens
cauuuaaagaaagaaugcauu

SEQ ID NO: 1588407 - RNA, 16 nt, Homo sapiens
cauuuaaauuccacag

SEQ ID NO: 1588408 - RNA, 13 nt, Homo sapiens
cauuuaaccccuu

SEQ ID NO: 1588409 - RNA, 21 nt, Homo sapiens
cauuuaacucuuugaaacugu

SEQ ID NO: 1588410 - RNA, 23 nt, Homo sapiens
cauuuaacucuuugaaacuguau

SEQ ID NO: 1588411 - RNA, 15 nt, Homo sapiens
cauuuaauagacuua

SEQ ID NO: 1588412 - RNA, 17 nt, Homo sapiens
cauuuaauaucuuugau

SEQ ID NO: 1588413 - RNA, 12 nt, Homo sapiens
cauuuacagugu

SEQ ID NO: 1588414 - RNA, 22 nt, Homo sapiens
cauuuacuuagcagaaccacau

SEQ ID NO: 1588415 - RNA, 22 nt, Homo sapiens
cauuuaguuugauuauucagug

SEQ ID NO: 1588416 - RNA, 14 nt, Homo sapiens
cauuuauaaaggga

SEQ ID NO: 1588417 - RNA, 18 nt, Homo sapiens
cauuuaugaugcaguuuc

SEQ ID NO: 1588418 - RNA, 17 nt, Homo sapiens
cauuuauuuacauguga

SEQ ID NO: 1588419 - RNA, 19 nt, Homo sapiens
cauuuauuuacaugugauu

SEQ ID NO: 1588420 - RNA, 15 nt, Homo sapiens
cauuucacucucaaa

SEQ ID NO: 1588421 - RNA, 18 nt, Homo sapiens
cauuucauacaacagaaa

SEQ ID NO: 1588422 - RNA, 12 nt, Homo sapiens
cauuucauauua

SEQ ID NO: 1588423 - RNA, 12 nt, Homo sapiens
cauuucaugucc

SEQ ID NO: 1588424 - RNA, 13 nt, Homo sapiens
cauuucauuccau

SEQ ID NO: 1588425 - RNA, 12 nt, Homo sapiens
cauuuccagagc

SEQ ID NO: 1588426 - RNA, 15 nt, Homo sapiens
cauuuccaugcauaa

SEQ ID NO: 1588427 - RNA, 16 nt, Homo sapiens
cauuucccaucugcac

SEQ ID NO: 1588428 - RNA, 22 nt, Homo sapiens
cauuucccauuaaagagccagu

SEQ ID NO: 1588429 - RNA, 23 nt, Homo sapiens
cauuucccauuaaagagccaguu

SEQ ID NO: 1588430 - RNA, 16 nt, Homo sapiens
cauuuccuaugcaaau

SEQ ID NO: 1588431 - RNA, 21 nt, Homo sapiens
cauuucuagacucaaaaccug

SEQ ID NO: 1588432 - RNA, 17 nt, Homo sapiens
cauuucucaagggccau

SEQ ID NO: 1588433 - RNA, 22 nt, Homo sapiens
cauuucucaucaguaguucaca

SEQ ID NO: 1588434 - RNA, 23 nt, Homo sapiens
cauuucucaucaguaguucacau

SEQ ID NO: 1588435 - RNA, 20 nt, Homo sapiens
cauuucuuuuaaaauaagca

SEQ ID NO: 1588436 - RNA, 16 nt, Homo sapiens
cauuugaaugcuuaau

SEQ ID NO: 1588437 - RNA, 16 nt, Homo sapiens
cauuugagccauguca

SEQ ID NO: 1588438 - RNA, 19 nt, Homo sapiens
cauuugcaggaucugucug

SEQ ID NO: 1588439 - RNA, 20 nt, Homo sapiens
cauuugcugaacucagcaca

SEQ ID NO: 1588440 - RNA, 19 nt, Homo sapiens
cauuuggagauauaccuaa

SEQ ID NO: 1588441 - RNA, 15 nt, Homo sapiens
cauuugggcaccuua

SEQ ID NO: 1588442 - RNA, 16 nt, Homo sapiens
cauuugggcaccuuaa

SEQ ID NO: 1588443 - RNA, 16 nt, Homo sapiens
cauuugggcacuguag

SEQ ID NO: 1588444 - RNA, 21 nt, Homo sapiens
cauuugguagaaggacugaac

SEQ ID NO: 1588445 - RNA, 21 nt, Homo sapiens
cauuuguaugucaaagcuuug

SEQ ID NO: 1588446 - RNA, 17 nt, Homo sapiens
cauuugucuuuguaaua

SEQ ID NO: 1588447 - RNA, 22 nt, Homo sapiens
cauuuguggucacagccaugaa

SEQ ID NO: 1588448 - RNA, 14 nt, Homo sapiens
cauuuguuccauga

SEQ ID NO: 1588449 - RNA, 15 nt, Homo sapiens
cauuuguuuaaaaag

SEQ ID NO: 1588450 - RNA, 14 nt, Homo sapiens
cauuuuacacaaag

SEQ ID NO: 1588451 - RNA, 19 nt, Homo sapiens
cauuuuauuuuguaauauu

SEQ ID NO: 1588452 - RNA, 14 nt, Homo sapiens
cauuuucaauuugg

SEQ ID NO: 1588453 - RNA, 12 nt, Homo sapiens
cauuuucauuca

SEQ ID NO: 1588454 - RNA, 15 nt, Homo sapiens
cauuuugacacaaaa

SEQ ID NO: 1588455 - RNA, 21 nt, Homo sapiens
cauuuuggugugcaacccugu

SEQ ID NO: 1588456 - RNA, 19 nt, Homo sapiens
cauuuuucaaagcaauuga

SEQ ID NO: 1588457 - RNA, 18 nt, Homo sapiens
cauuuuucucuugccauu

SEQ ID NO: 1588458 - RNA, 14 nt, Homo sapiens
cauuuuuuacuuga

SEQ ID NO: 1588459 - RNA, 17 nt, Homo sapiens
ccaaaaagaccagacua

SEQ ID NO: 1588460 - RNA, 16 nt, Homo sapiens
ccaaaaagggcuucaa

SEQ ID NO: 1588461 - RNA, 17 nt, Homo sapiens
ccaaaaagggcuucaag

SEQ ID NO: 1588462 - RNA, 18 nt, Homo sapiens
ccaaaaauuauguguugc

SEQ ID NO: 1588463 - RNA, 13 nt, Homo sapiens
ccaaaacaaucua

SEQ ID NO: 1588464 - RNA, 14 nt, Homo sapiens
ccaaaacaguuaau

SEQ ID NO: 1588465 - RNA, 15 nt, Homo sapiens
ccaaaaccauguaau

SEQ ID NO: 1588466 - RNA, 13 nt, Homo sapiens
ccaaaauuugaug

SEQ ID NO: 1588467 - RNA, 17 nt, Homo sapiens
ccaaaccaaauuuuaau

SEQ ID NO: 1588468 - RNA, 14 nt, Homo sapiens
ccaaaccaagcaaa

SEQ ID NO: 1588469 - RNA, 18 nt, Homo sapiens
ccaaacccuuaacugaca

SEQ ID NO: 1588470 - RNA, 17 nt, Homo sapiens
ccaaacucaaacuugag

SEQ ID NO: 1588471 - RNA, 14 nt, Homo sapiens
ccaaacugacucaa

SEQ ID NO: 1588472 - RNA, 19 nt, Homo sapiens
ccaaacugauccaguauaa

SEQ ID NO: 1588473 - RNA, 23 nt, Homo sapiens
ccaaacugggucuucagcuuuau

SEQ ID NO: 1588474 - RNA, 19 nt, Homo sapiens
auuucuaucuugaauuuca

SEQ ID NO: 1588475 - RNA, 16 nt, Homo sapiens
auuucuccaaagccuu

SEQ ID NO: 1588476 - RNA, 19 nt, Homo sapiens
auuucuccucccuuccuuu

SEQ ID NO: 1588477 - RNA, 14 nt, Homo sapiens
auuucucuacuugu

SEQ ID NO: 1588478 - RNA, 16 nt, Homo sapiens
auuucucuacuuguca

SEQ ID NO: 1588479 - RNA, 17 nt, Homo sapiens
auuucugacucuaucau

SEQ ID NO: 1588480 - RNA, 18 nt, Homo sapiens
auuucugaucuauacaaa

SEQ ID NO: 1588481 - RNA, 20 nt, Homo sapiens
auuucuuaaaacacaugaua

SEQ ID NO: 1588482 - RNA, 14 nt, Homo sapiens
auuucuucaaauaa

SEQ ID NO: 1588483 - RNA, 19 nt, Homo sapiens
caaaauauaauuuacauua

SEQ ID NO: 1588484 - RNA, 21 nt, Homo sapiens
caaaauauauuuuguuuacaa

SEQ ID NO: 1588485 - RNA, 20 nt, Homo sapiens
caaaauauuuaagugaagga

SEQ ID NO: 1588486 - RNA, 16 nt, Homo sapiens
caaaaucaacaugacu

SEQ ID NO: 1588487 - RNA, 19 nt, Homo sapiens
caaaaucaacaugacuggu

SEQ ID NO: 1588488 - RNA, 20 nt, Homo sapiens
caaaaucaugugacaauaau

SEQ ID NO: 1588489 - RNA, 19 nt, Homo sapiens
caaaaugcacuucuauuua

SEQ ID NO: 1588490 - RNA, 17 nt, Homo sapiens
caaaauggauacauaaa

SEQ ID NO: 1588491 - RNA, 19 nt, Homo sapiens
caaaauggauacauaaaga

SEQ ID NO: 1588492 - RNA, 18 nt, Homo sapiens
caaaaugggcccuugccu

SEQ ID NO: 1588493 - RNA, 19 nt, Homo sapiens
caaaauguucaguuuauau

SEQ ID NO: 1588494 - RNA, 13 nt, Homo sapiens
caaaauuaaauac

SEQ ID NO: 1588495 - RNA, 18 nt, Homo sapiens
caaaauuaaauacauaaa

SEQ ID NO: 1588496 - RNA, 18 nt, Homo sapiens
caaaauucuuaaguaugu

SEQ ID NO: 1588497 - RNA, 19 nt, Homo sapiens
caaaauuguuuaccauaga

SEQ ID NO: 1588498 - RNA, 11 nt, Homo sapiens
caaacaaaagc

SEQ ID NO: 1588499 - RNA, 12 nt, Homo sapiens
caaacaaugaaa

SEQ ID NO: 1588500 - RNA, 13 nt, Homo sapiens
caaacacacugua

SEQ ID NO: 1588501 - RNA, 16 nt, Homo sapiens
caaacagucucaggaa

SEQ ID NO: 1588502 - RNA, 21 nt, Homo sapiens
caaacauguaagcauaacuua

SEQ ID NO: 1588503 - RNA, 19 nt, Homo sapiens
caaaccagcuucauguggc

SEQ ID NO: 1588504 - RNA, 20 nt, Homo sapiens
caaacccuggugcuuuccuu

SEQ ID NO: 1588505 - RNA, 14 nt, Homo sapiens
caaaccucaucuuu

SEQ ID NO: 1588506 - RNA, 21 nt, Homo sapiens
caaaccuccugucagugagga

SEQ ID NO: 1588507 - RNA, 12 nt, Homo sapiens
caaaccucugcc

SEQ ID NO: 1588508 - RNA, 16 nt, Homo sapiens
caaaccugaguaucag

SEQ ID NO: 1588509 - RNA, 13 nt, Homo sapiens
caaaccugcaguu

SEQ ID NO: 1588510 - RNA, 19 nt, Homo sapiens
caaacguaauuuguuauau

SEQ ID NO: 1588511 - RNA, 17 nt, Homo sapiens
caaacucaaacuugaga

SEQ ID NO: 1588512 - RNA, 23 nt, Homo sapiens
caaacucccuagucuccaccuga

SEQ ID NO: 1588513 - RNA, 22 nt, Homo sapiens
caaacugaaugacuugacuuca

SEQ ID NO: 1588514 - RNA, 12 nt, Homo sapiens
caaacuguaaaa

SEQ ID NO: 1588515 - RNA, 15 nt, Homo sapiens
caaacuucaaagagg

SEQ ID NO: 1588516 - RNA, 20 nt, Homo sapiens
caaacuuuugaaagauguau

SEQ ID NO: 1588517 - RNA, 14 nt, Homo sapiens
caaagaaaguguau

SEQ ID NO: 1588518 - RNA, 16 nt, Homo sapiens
caaagaacucauuuga

SEQ ID NO: 1588519 - RNA, 17 nt, Homo sapiens
caaagaacucauuugaa

SEQ ID NO: 1588520 - RNA, 22 nt, Homo sapiens
caaagaacucauuugaaugcuu

SEQ ID NO: 1588521 - RNA, 12 nt, Homo sapiens
caaagacaucaa

SEQ ID NO: 1588522 - RNA, 21 nt, Homo sapiens
caaagacccagagcaaaccca

SEQ ID NO: 1588523 - RNA, 20 nt, Homo sapiens
caaagacgcaaggugugcuc

SEQ ID NO: 1588524 - RNA, 17 nt, Homo sapiens
caaagaggcugccccuc

SEQ ID NO: 1588525 - RNA, 18 nt, Homo sapiens
caaagaucaccagccaug

SEQ ID NO: 1588526 - RNA, 13 nt, Homo sapiens
caaagaugcccca

SEQ ID NO: 1588527 - RNA, 21 nt, Homo sapiens
caaagcacuagagaaugcaca

SEQ ID NO: 1588528 - RNA, 21 nt, Homo sapiens
caaagcacuugcuuacauccu

SEQ ID NO: 1588529 - RNA, 18 nt, Homo sapiens
caaagcauggacauuuag

SEQ ID NO: 1588530 - RNA, 18 nt, Homo sapiens
caaagccacugacugaga

SEQ ID NO: 1588531 - RNA, 16 nt, Homo sapiens
caaagccccccagcuc

SEQ ID NO: 1588532 - RNA, 15 nt, Homo sapiens
caaagccuuuccaga

SEQ ID NO: 1588533 - RNA, 18 nt, Homo sapiens
caaagcuaggaugguucu

SEQ ID NO: 1588534 - RNA, 20 nt, Homo sapiens
caaaguagaggaauccaugu

SEQ ID NO: 1588535 - RNA, 22 nt, Homo sapiens
caaagucccccuccucagccag

SEQ ID NO: 1588536 - RNA, 18 nt, Homo sapiens
caaaguccuuuuuuucca

SEQ ID NO: 1588537 - RNA, 16 nt, Homo sapiens
caaagucucaaugaaa

SEQ ID NO: 1588538 - RNA, 14 nt, Homo sapiens
caaauaaaaauccu

SEQ ID NO: 1588539 - RNA, 18 nt, Homo sapiens
caaauaaaacaaaaccaa

SEQ ID NO: 1588540 - RNA, 17 nt, Homo sapiens
caaauaaaauaaaugaa

SEQ ID NO: 1588541 - RNA, 16 nt, Homo sapiens
caaauaaacacugugu

SEQ ID NO: 1588542 - RNA, 16 nt, Homo sapiens
caaauaaagauaaccc

SEQ ID NO: 1588543 - RNA, 17 nt, Homo sapiens
caaauaaagcagucaug

SEQ ID NO: 1588544 - RNA, 20 nt, Homo sapiens
caaauaaaugauuauauuca

SEQ ID NO: 1588545 - RNA, 22 nt, Homo sapiens
caaauaaaugauuauauucaca

SEQ ID NO: 1588546 - RNA, 15 nt, Homo sapiens
caaauacaugcacag

SEQ ID NO: 1588547 - RNA, 18 nt, Homo sapiens
caaauacaugcacaguca

SEQ ID NO: 1588548 - RNA, 20 nt, Homo sapiens
caaauacaugcacagucaua

SEQ ID NO: 1588549 - RNA, 14 nt, Homo sapiens
caaauacuuagcaa

SEQ ID NO: 1588550 - RNA, 19 nt, Homo sapiens
caaauaggauguacuguug

SEQ ID NO: 1588551 - RNA, 14 nt, Homo sapiens
caaauauacuuuac

SEQ ID NO: 1588552 - RNA, 15 nt, Homo sapiens
caaauaugcaaagca

SEQ ID NO: 1588553 - RNA, 15 nt, Homo sapiens
caaauauuucacuua

SEQ ID NO: 1588554 - RNA, 18 nt, Homo sapiens
caaaucacauauuuuaaa

SEQ ID NO: 1588555 - RNA, 17 nt, Homo sapiens
caaaucacgaccacuga

SEQ ID NO: 1588556 - RNA, 21 nt, Homo sapiens
caaaucaguuggcaggcacca

SEQ ID NO: 1588557 - RNA, 12 nt, Homo sapiens
caaauccaagga

SEQ ID NO: 1588558 - RNA, 19 nt, Homo sapiens
caaauccaaggaaacaugc

SEQ ID NO: 1588559 - RNA, 16 nt, Homo sapiens
caaaucuaccacugua

SEQ ID NO: 1588560 - RNA, 20 nt, Homo sapiens
caaaucuacgguuaugaagg

SEQ ID NO: 1588561 - RNA, 21 nt, Homo sapiens
caaaucuacgguuaugaaggc

SEQ ID NO: 1588562 - RNA, 12 nt, Homo sapiens
caaaucucaguu

SEQ ID NO: 1588563 - RNA, 21 nt, Homo sapiens
caaaucuggguaucuuuccag

SEQ ID NO: 1588564 - RNA, 16 nt, Homo sapiens
caaaucuuaacuugaa

SEQ ID NO: 1588565 - RNA, 16 nt, Homo sapiens
caaaucuugaaauuaa

SEQ ID NO: 1588566 - RNA, 21 nt, Homo sapiens
caaaucuugguugaugccaaa

SEQ ID NO: 1588567 - RNA, 15 nt, Homo sapiens
caaaugaaauaaaua

SEQ ID NO: 1588568 - RNA, 16 nt, Homo sapiens
caaaugaaaugccaaa

SEQ ID NO: 1588569 - RNA, 19 nt, Homo sapiens
caaaugaaaugccaaagga

SEQ ID NO: 1588570 - RNA, 23 nt, Homo sapiens
caaaugaauggaggaacuuucca

SEQ ID NO: 1588571 - RNA, 12 nt, Homo sapiens
caaaugauuuca

SEQ ID NO: 1588572 - RNA, 14 nt, Homo sapiens
caaaugccauccag

SEQ ID NO: 1588573 - RNA, 14 nt, Homo sapiens
caaauggcauauga

SEQ ID NO: 1588574 - RNA, 15 nt, Homo sapiens
caaaugggucccuca

SEQ ID NO: 1588575 - RNA, 16 nt, Homo sapiens
caaaugggucccucag

SEQ ID NO: 1588576 - RNA, 13 nt, Homo sapiens
caaauguauuuca

SEQ ID NO: 1588577 - RNA, 16 nt, Homo sapiens
caaauguuuacuguau

SEQ ID NO: 1588578 - RNA, 15 nt, Homo sapiens
caaauuagugaacca

SEQ ID NO: 1588579 - RNA, 18 nt, Homo sapiens
caaauuagugaaccaaaa

SEQ ID NO: 1588580 - RNA, 18 nt, Homo sapiens
caaauuauaaaaaccaug

SEQ ID NO: 1588581 - RNA, 13 nt, Homo sapiens
caaauucauggca

SEQ ID NO: 1588582 - RNA, 18 nt, Homo sapiens
caaauucuucugaacuca

SEQ ID NO: 1588583 - RNA, 15 nt, Homo sapiens
caaauugaggacuua

SEQ ID NO: 1588584 - RNA, 15 nt, Homo sapiens
caaauugauagucaa

SEQ ID NO: 1588585 - RNA, 13 nt, Homo sapiens
caaauugcugcuu

SEQ ID NO: 1588586 - RNA, 13 nt, Homo sapiens
caaauuguguaua

SEQ ID NO: 1588587 - RNA, 17 nt, Homo sapiens
caaauuguguauauauc

SEQ ID NO: 1588588 - RNA, 14 nt, Homo sapiens
caaauuguuuacau

SEQ ID NO: 1588589 - RNA, 18 nt, Homo sapiens
caaauuuggccuuaagaa

SEQ ID NO: 1588590 - RNA, 20 nt, Homo sapiens
caaauuuguaauaaaacuau

SEQ ID NO: 1588591 - RNA, 21 nt, Homo sapiens
caacaaagauugagaagccau

SEQ ID NO: 1588592 - RNA, 19 nt, Homo sapiens
caacaaaguuccacuucca

SEQ ID NO: 1588593 - RNA, 20 nt, Homo sapiens
gaugccaaccagacaccucc

SEQ ID NO: 1588594 - RNA, 23 nt, Homo sapiens
gaugcuacgcuccagcugaucca

SEQ ID NO: 1588595 - RNA, 14 nt, Homo sapiens
gaugcugugcuaug

SEQ ID NO: 1588596 - RNA, 17 nt, Homo sapiens
gaugcuguuaaccaaag

SEQ ID NO: 1588597 - RNA, 9 nt, Homo sapiens
gauggagcu

SEQ ID NO: 1588598 - RNA, 14 nt, Homo sapiens
gauggcagugagaa

SEQ ID NO: 1588599 - RNA, 18 nt, Homo sapiens
gauggcccauagaccuga

SEQ ID NO: 1588600 - RNA, 15 nt, Homo sapiens
gauggcuuaagccug

SEQ ID NO: 1588601 - RNA, 14 nt, Homo sapiens
gaugggagaguaaa

SEQ ID NO: 1588602 - RNA, 16 nt, Homo sapiens
gaugggcgucacuacu

SEQ ID NO: 1588603 - RNA, 21 nt, Homo sapiens
gaugguguccugaggccucca

SEQ ID NO: 1588604 - RNA, 23 nt, Homo sapiens
gaugguucucagaaccauuucac

SEQ ID NO: 1588605 - RNA, 19 nt, Homo sapiens
gaugguuuuaucuucccuu

SEQ ID NO: 1588606 - RNA, 21 nt, Homo sapiens
gauguaaaaaugaaaagccaa

SEQ ID NO: 1588607 - RNA, 13 nt, Homo sapiens
gauguacaauuaa

SEQ ID NO: 1588608 - RNA, 20 nt, Homo sapiens
gauguagauuacugaaaaau

SEQ ID NO: 1588609 - RNA, 19 nt, Homo sapiens
gauguaggguaaggugccu

SEQ ID NO: 1588610 - RNA, 12 nt, Homo sapiens
gaugucauuuga

SEQ ID NO: 1588611 - RNA, 16 nt, Homo sapiens
gaugugaaaugaaugu

SEQ ID NO: 1588612 - RNA, 14 nt, Homo sapiens
gaugugaacacauc

SEQ ID NO: 1588613 - RNA, 19 nt, Homo sapiens
gaugugaauuauugacacu

SEQ ID NO: 1588614 - RNA, 17 nt, Homo sapiens
gaugugcagauaucaca

SEQ ID NO: 1588615 - RNA, 21 nt, Homo sapiens
gauguuucaucaaugcaguuc

SEQ ID NO: 1588616 - RNA, 21 nt, Homo sapiens
gauuaacuuucaaaagcaaac

SEQ ID NO: 1588617 - RNA, 14 nt, Homo sapiens
gauuaauauuauua

SEQ ID NO: 1588618 - RNA, 15 nt, Homo sapiens
gauuacacauuucac

SEQ ID NO: 1588619 - RNA, 14 nt, Homo sapiens
gauuaccugccaau

SEQ ID NO: 1588620 - RNA, 19 nt, Homo sapiens
gauuaccugccaauugcua

SEQ ID NO: 1588621 - RNA, 21 nt, Homo sapiens
gauuaguauucaggcacugag

SEQ ID NO: 1588622 - RNA, 14 nt, Homo sapiens
gauuauaaacugac

SEQ ID NO: 1588623 - RNA, 18 nt, Homo sapiens
gauuauacaaaagagcau

SEQ ID NO: 1588624 - RNA, 13 nt, Homo sapiens
gauuauucagugu

SEQ ID NO: 1588625 - RNA, 15 nt, Homo sapiens
gauucaaauugcugc

SEQ ID NO: 1588626 - RNA, 19 nt, Homo sapiens
caacagcaguguucugggu

SEQ ID NO: 1588627 - RNA, 16 nt, Homo sapiens
caacaggccauuguga

SEQ ID NO: 1588628 - RNA, 23 nt, Homo sapiens
caacaggccauugugaaccaaug

SEQ ID NO: 1588629 - RNA, 15 nt, Homo sapiens
caacagucaccucac

SEQ ID NO: 1588630 - RNA, 15 nt, Homo sapiens
caacaguucugagcu

SEQ ID NO: 1588631 - RNA, 15 nt, Homo sapiens
caacauaaguuaaua

SEQ ID NO: 1588632 - RNA, 15 nt, Homo sapiens
caacauaccaagacc

SEQ ID NO: 1588633 - RNA, 15 nt, Homo sapiens
caacaugcacugaug

SEQ ID NO: 1588634 - RNA, 21 nt, Homo sapiens
caacaugcauguucuccucua

SEQ ID NO: 1588635 - RNA, 18 nt, Homo sapiens
caacaugccagccacugu

SEQ ID NO: 1588636 - RNA, 19 nt, Homo sapiens
caacaugccagccacugug

SEQ ID NO: 1588637 - RNA, 11 nt, Homo sapiens
caacaugguga

SEQ ID NO: 1588638 - RNA, 23 nt, Homo sapiens
caacauggugaaaccccgucucu

SEQ ID NO: 1588639 - RNA, 15 nt, Homo sapiens
caacauguuauuugu

SEQ ID NO: 1588640 - RNA, 22 nt, Homo sapiens
caacauuuacaacucauuccag

SEQ ID NO: 1588641 - RNA, 16 nt, Homo sapiens
caacauuucucacuga

SEQ ID NO: 1588642 - RNA, 19 nt, Homo sapiens
caacauuucucacugaaag

SEQ ID NO: 1588643 - RNA, 16 nt, Homo sapiens
caaccaacugccccag

SEQ ID NO: 1588644 - RNA, 12 nt, Homo sapiens
caaccagacucu

SEQ ID NO: 1588645 - RNA, 19 nt, Homo sapiens
caacccaaauguucaucaa

SEQ ID NO: 1588646 - RNA, 20 nt, Homo sapiens
caacccaaggaaccauuugc

SEQ ID NO: 1588647 - RNA, 12 nt, Homo sapiens
caaccccagugg

SEQ ID NO: 1588648 - RNA, 18 nt, Homo sapiens
caacccuuccugcugcug

SEQ ID NO: 1588649 - RNA, 22 nt, Homo sapiens
caacccuuccugcugcugcuac

SEQ ID NO: 1588650 - RNA, 17 nt, Homo sapiens
caaccgcacaugugcca

SEQ ID NO: 1588651 - RNA, 23 nt, Homo sapiens
caaccgguaaccaaagucacaaa

SEQ ID NO: 1588652 - RNA, 17 nt, Homo sapiens
caaccuaaccccuuucc

SEQ ID NO: 1588653 - RNA, 20 nt, Homo sapiens
caaccucgcuggacucucag

SEQ ID NO: 1588654 - RNA, 17 nt, Homo sapiens
caaccucuuuuuccucc

SEQ ID NO: 1588655 - RNA, 20 nt, Homo sapiens
caaccugacuuccucugcca

SEQ ID NO: 1588656 - RNA, 17 nt, Homo sapiens
caaccugcacaaccugg

SEQ ID NO: 1588657 - RNA, 18 nt, Homo sapiens
caaccugggacuuccuaa

SEQ ID NO: 1588658 - RNA, 19 nt, Homo sapiens
caaccugguaugggagcca

SEQ ID NO: 1588659 - RNA, 23 nt, Homo sapiens
caaccuuaaaggccgucauuuca

SEQ ID NO: 1588660 - RNA, 20 nt, Homo sapiens
caacgcaccagacacucaca

SEQ ID NO: 1588661 - RNA, 21 nt, Homo sapiens
caacgcuuaaaggugucuucc

SEQ ID NO: 1588662 - RNA, 20 nt, Homo sapiens
caacuaauacaugguuuaaa

SEQ ID NO: 1588663 - RNA, 14 nt, Homo sapiens
caacuaaugccuua

SEQ ID NO: 1588664 - RNA, 13 nt, Homo sapiens
caacuacuaauag

SEQ ID NO: 1588665 - RNA, 12 nt, Homo sapiens
caacuagccauc

SEQ ID NO: 1588666 - RNA, 20 nt, Homo sapiens
caacucagguuuuggcauua

SEQ ID NO: 1588667 - RNA, 20 nt, Homo sapiens
caacucuaccccugcuccca

SEQ ID NO: 1588668 - RNA, 18 nt, Homo sapiens
caacucuccaauguucua

SEQ ID NO: 1588669 - RNA, 14 nt, Homo sapiens
caacucugcuccca

SEQ ID NO: 1588670 - RNA, 12 nt, Homo sapiens
caacucuugauu

SEQ ID NO: 1588671 - RNA, 22 nt, Homo sapiens
caacugaaaaaaacauauccaa

SEQ ID NO: 1588672 - RNA, 18 nt, Homo sapiens
caacugaaggcuaaaaag

SEQ ID NO: 1588673 - RNA, 22 nt, Homo sapiens
caacugacuuccaagauccuuu

SEQ ID NO: 1588674 - RNA, 19 nt, Homo sapiens
caacugggucugacaugaa

SEQ ID NO: 1588675 - RNA, 21 nt, Homo sapiens
caacuuacugucuucuucaug

SEQ ID NO: 1588676 - RNA, 12 nt, Homo sapiens
caacuugauguu

SEQ ID NO: 1588677 - RNA, 16 nt, Homo sapiens
caacuugcaauuugca

SEQ ID NO: 1588678 - RNA, 21 nt, Homo sapiens
caacuugugauagguaccuga

SEQ ID NO: 1588679 - RNA, 20 nt, Homo sapiens
caacuuuccucaaaucaaaa

SEQ ID NO: 1588680 - RNA, 14 nt, Homo sapiens
caagaaaaccacaa

SEQ ID NO: 1588681 - RNA, 15 nt, Homo sapiens
caagaaacuguccaa

SEQ ID NO: 1588682 - RNA, 15 nt, Homo sapiens
caagaaaucagccau

SEQ ID NO: 1588683 - RNA, 14 nt, Homo sapiens
caagaaccaaggaa

SEQ ID NO: 1588684 - RNA, 20 nt, Homo sapiens
caagaagaaaucaugauaua

SEQ ID NO: 1588685 - RNA, 20 nt, Homo sapiens
caagaagaaugggagcugca

SEQ ID NO: 1588686 - RNA, 21 nt, Homo sapiens
caagaaucuagaagaugugua

SEQ ID NO: 1588687 - RNA, 12 nt, Homo sapiens
caagaaugccag

SEQ ID NO: 1588688 - RNA, 23 nt, Homo sapiens
caagacacagaauaguuuacaca

SEQ ID NO: 1588689 - RNA, 19 nt, Homo sapiens
caagaccucaucucuacua

SEQ ID NO: 1588690 - RNA, 20 nt, Homo sapiens
caagagaugggaaugaggug

SEQ ID NO: 1588691 - RNA, 21 nt, Homo sapiens
caagagcaaaacuccgucuca

SEQ ID NO: 1588692 - RNA, 23 nt, Homo sapiens
caagagcugcccuccuuguccac

SEQ ID NO: 1588693 - RNA, 16 nt, Homo sapiens
caagaggacugagacu

SEQ ID NO: 1588694 - RNA, 17 nt, Homo sapiens
caagaggggaugaguug

SEQ ID NO: 1588695 - RNA, 21 nt, Homo sapiens
caagaggggguggaggggugu

SEQ ID NO: 1588696 - RNA, 21 nt, Homo sapiens
caagaggugugcacaccaaag

SEQ ID NO: 1588697 - RNA, 21 nt, Homo sapiens
caagauaauccuagagucuua

SEQ ID NO: 1588698 - RNA, 20 nt, Homo sapiens
caagaucgccccacugcacu

SEQ ID NO: 1588699 - RNA, 14 nt, Homo sapiens
caagaucugaauuu

SEQ ID NO: 1588700 - RNA, 16 nt, Homo sapiens
caagaugaaugcagau

SEQ ID NO: 1588701 - RNA, 20 nt, Homo sapiens
caagauggacacgagccaca

SEQ ID NO: 1588702 - RNA, 21 nt, Homo sapiens
caagauuguccuuuucuccca

SEQ ID NO: 1588703 - RNA, 16 nt, Homo sapiens
caagcaagaucugcuc

SEQ ID NO: 1588704 - RNA, 22 nt, Homo sapiens
caagcacaaaaacuuaacaaaa

SEQ ID NO: 1588705 - RNA, 15 nt, Homo sapiens
caagcacacuggaau

SEQ ID NO: 1588706 - RNA, 14 nt, Homo sapiens
caagcacucggggu

SEQ ID NO: 1588707 - RNA, 21 nt, Homo sapiens
caagcauucagaagaaaaaga

SEQ ID NO: 1588708 - RNA, 15 nt, Homo sapiens
caagcauuuuuccau

SEQ ID NO: 1588709 - RNA, 22 nt, Homo sapiens
caagccaagugcccucucugaa

SEQ ID NO: 1588710 - RNA, 13 nt, Homo sapiens
caagccauuccaa

SEQ ID NO: 1588711 - RNA, 17 nt, Homo sapiens
caagccccauuuccuca

SEQ ID NO: 1588712 - RNA, 16 nt, Homo sapiens
caagcgauucuccugc

SEQ ID NO: 1588713 - RNA, 15 nt, Homo sapiens
caagcgccgcuguga

SEQ ID NO: 1588714 - RNA, 16 nt, Homo sapiens
caagcgggccgucucc

SEQ ID NO: 1588715 - RNA, 15 nt, Homo sapiens
caagcguguucucag

SEQ ID NO: 1588716 - RNA, 15 nt, Homo sapiens
caagcuaaucugccu

SEQ ID NO: 1588717 - RNA, 23 nt, Homo sapiens
caagcugcucuccuucacucuga

SEQ ID NO: 1588718 - RNA, 18 nt, Homo sapiens
caagcuuaaagcuugauu

SEQ ID NO: 1588719 - RNA, 21 nt, Homo sapiens
caagcuuuugcuugauccaga

SEQ ID NO: 1588720 - RNA, 23 nt, Homo sapiens
caaggaaaaguucuuucaaccua

SEQ ID NO: 1588721 - RNA, 16 nt, Homo sapiens
caaggaaguagaaaca

SEQ ID NO: 1588722 - RNA, 15 nt, Homo sapiens
caaggaauaaaugag

SEQ ID NO: 1588723 - RNA, 13 nt, Homo sapiens
caaggacucuucc

SEQ ID NO: 1588724 - RNA, 15 nt, Homo sapiens
caaggagaggcaaag

SEQ ID NO: 1588725 - RNA, 22 nt, Homo sapiens
caaggagcaacagcgauggcag

SEQ ID NO: 1588726 - RNA, 15 nt, Homo sapiens
caaggaggaguucca

SEQ ID NO: 1588727 - RNA, 16 nt, Homo sapiens
caaggaggaguuccac

SEQ ID NO: 1588728 - RNA, 23 nt, Homo sapiens
caaggauagaagcugcaguggua

SEQ ID NO: 1588729 - RNA, 15 nt, Homo sapiens
caaggauggagcuga

SEQ ID NO: 1588730 - RNA, 20 nt, Homo sapiens
caaggauuacacauuucacu

SEQ ID NO: 1588731 - RNA, 18 nt, Homo sapiens
caaggauuuuguaagaag

SEQ ID NO: 1588732 - RNA, 16 nt, Homo sapiens
caaggauuuuuagccc

SEQ ID NO: 1588733 - RNA, 13 nt, Homo sapiens
caagggacaguga

SEQ ID NO: 1588734 - RNA, 17 nt, Homo sapiens
caaggguuggaggcaau

SEQ ID NO: 1588735 - RNA, 18 nt, Homo sapiens
caaggucauagacaauuc

SEQ ID NO: 1588736 - RNA, 19 nt, Homo sapiens
gagcauccccagccacaac

SEQ ID NO: 1588737 - RNA, 18 nt, Homo sapiens
gagcaucugccccaggua

SEQ ID NO: 1588738 - RNA, 23 nt, Homo sapiens
gagcaugcucaguuggugcugcu

SEQ ID NO: 1588739 - RNA, 18 nt, Homo sapiens
gagcauggaugcauuuca

SEQ ID NO: 1588740 - RNA, 21 nt, Homo sapiens
gagccaagagugcacuacugu

SEQ ID NO: 1588741 - RNA, 23 nt, Homo sapiens
gagccaaggagggagggucuucc

SEQ ID NO: 1588742 - RNA, 20 nt, Homo sapiens
gagccaccgugcccggccaa

SEQ ID NO: 1588743 - RNA, 23 nt, Homo sapiens
gagccccccuagcaauacaggga

SEQ ID NO: 1588744 - RNA, 16 nt, Homo sapiens
gagcccuggcucccac

SEQ ID NO: 1588745 - RNA, 17 nt, Homo sapiens
gagccgagaucaugcca

SEQ ID NO: 1588746 - RNA, 20 nt, Homo sapiens
gagccgagaucaugccauug

SEQ ID NO: 1588747 - RNA, 16 nt, Homo sapiens
gagccgggagccugac

SEQ ID NO: 1588748 - RNA, 17 nt, Homo sapiens
gagccuagcuccugcca

SEQ ID NO: 1588749 - RNA, 13 nt, Homo sapiens
gagccuccagucc

SEQ ID NO: 1588750 - RNA, 22 nt, Homo sapiens
gagccucccaaggagaacaaau

SEQ ID NO: 1588751 - RNA, 21 nt, Homo sapiens
gagccugaagaccuucagucu

SEQ ID NO: 1588752 - RNA, 22 nt, Homo sapiens
gagccuuuccucaaaacuggag

SEQ ID NO: 1588753 - RNA, 13 nt, Homo sapiens
gagcgcacaggga

SEQ ID NO: 1588754 - RNA, 18 nt, Homo sapiens
gagcuagaaccuggagag

SEQ ID NO: 1588755 - RNA, 18 nt, Homo sapiens
gagcuagaugugucuuac

SEQ ID NO: 1588756 - RNA, 20 nt, Homo sapiens
gagcucccccguggugccug

SEQ ID NO: 1588757 - RNA, 16 nt, Homo sapiens
gagcuccugggacccu

SEQ ID NO: 1588758 - RNA, 21 nt, Homo sapiens
gagcugauacuuugacagugu

SEQ ID NO: 1588759 - RNA, 20 nt, Homo sapiens
gagcugcagcugagccugag

SEQ ID NO: 1588760 - RNA, 20 nt, Homo sapiens
gagcugcccuccuuguccac

SEQ ID NO: 1588761 - RNA, 20 nt, Homo sapiens
gagcugccucuucucuugac

SEQ ID NO: 1588762 - RNA, 11 nt, Homo sapiens
gagcugugcag

SEQ ID NO: 1588763 - RNA, 21 nt, Homo sapiens
gagcuuaaagauaguuacaaa

SEQ ID NO: 1588764 - RNA, 13 nt, Homo sapiens
gagcuugauuaaa

SEQ ID NO: 1588765 - RNA, 21 nt, Homo sapiens
gagcuuggacagucugagcug

SEQ ID NO: 1588766 - RNA, 17 nt, Homo sapiens
gagcuuugucacuugcc

SEQ ID NO: 1588767 - RNA, 13 nt, Homo sapiens
gaggaacaguauu

SEQ ID NO: 1588768 - RNA, 17 nt, Homo sapiens
gaggaagacaggcaaau

SEQ ID NO: 1588769 - RNA, 12 nt, Homo sapiens
gaggaagggaca

SEQ ID NO: 1588770 - RNA, 15 nt, Homo sapiens
gaggaauuggccgcu

SEQ ID NO: 1588771 - RNA, 21 nt, Homo sapiens
gaggaauuuacuuucuucacc

SEQ ID NO: 1588772 - RNA, 16 nt, Homo sapiens
gaggacaaaaggaaug

SEQ ID NO: 1588773 - RNA, 21 nt, Homo sapiens
gaggacagagcaggggcucca

SEQ ID NO: 1588774 - RNA, 21 nt, Homo sapiens
gaggacagcugaggccaagga

SEQ ID NO: 1588775 - RNA, 15 nt, Homo sapiens
gaggacuacuuucca

SEQ ID NO: 1588776 - RNA, 15 nt, Homo sapiens
gaggagaaaugcaau

SEQ ID NO: 1588777 - RNA, 23 nt, Homo sapiens
gaggagcaagguuuaaauuuguu

SEQ ID NO: 1588778 - RNA, 19 nt, Homo sapiens
gaggagcagaccagcacuu

SEQ ID NO: 1588779 - RNA, 16 nt, Homo sapiens
gaggagccugcaacau

SEQ ID NO: 1588780 - RNA, 21 nt, Homo sapiens
gaggagcuggccugcggugga

SEQ ID NO: 1588781 - RNA, 18 nt, Homo sapiens
gaggagggcgugacucac

SEQ ID NO: 1588782 - RNA, 15 nt, Homo sapiens
gaggaguaaaauuca

SEQ ID NO: 1588783 - RNA, 12 nt, Homo sapiens
gaggagugcagc

SEQ ID NO: 1588784 - RNA, 14 nt, Homo sapiens
gaggaucagcacug

SEQ ID NO: 1588785 - RNA, 24 nt, Homo sapiens
gaggaucuauuacugaccguauga

SEQ ID NO: 1588786 - RNA, 22 nt, Homo sapiens
gaggauggacuaaaugaucucu

SEQ ID NO: 1588787 - RNA, 19 nt, Homo sapiens
gaggcacaacgcaccagac

SEQ ID NO: 1588788 - RNA, 20 nt, Homo sapiens
gaggcacucagugagccucc

SEQ ID NO: 1588789 - RNA, 23 nt, Homo sapiens
gaggcacugggaagccuagagaa

SEQ ID NO: 1588790 - RNA, 20 nt, Homo sapiens
gaggcagguggaucgcuuga

SEQ ID NO: 1588791 - RNA, 15 nt, Homo sapiens
gaggccaaacacacu

SEQ ID NO: 1588792 - RNA, 18 nt, Homo sapiens
gaggcccugcccaaugag

SEQ ID NO: 1588793 - RNA, 19 nt, Homo sapiens
gaggccuccacuccuucca

SEQ ID NO: 1588794 - RNA, 23 nt, Homo sapiens
gaggccugggagucucuugacuc

SEQ ID NO: 1588795 - RNA, 19 nt, Homo sapiens
gaggcggagaauugcuuga

SEQ ID NO: 1588796 - RNA, 20 nt, Homo sapiens
gaggcgggaaaaucauuuga

SEQ ID NO: 1588797 - RNA, 22 nt, Homo sapiens
gaggcucaaaaacuugaucaca

SEQ ID NO: 1588798 - RNA, 14 nt, Homo sapiens
gaggcucagauuaa

SEQ ID NO: 1588799 - RNA, 18 nt, Homo sapiens
gaggcuggugacaggcca

SEQ ID NO: 1588800 - RNA, 20 nt, Homo sapiens
gagggaccagacacaggucc

SEQ ID NO: 1588801 - RNA, 15 nt, Homo sapiens
gagggagaugccaug

SEQ ID NO: 1588802 - RNA, 17 nt, Homo sapiens
gagggaggucacuggaa

SEQ ID NO: 1588803 - RNA, 20 nt, Homo sapiens
gagggauggggaaaacuaca

SEQ ID NO: 1588804 - RNA, 23 nt, Homo sapiens
gagggcaagcccugcccacagaa

SEQ ID NO: 1588805 - RNA, 16 nt, Homo sapiens
gagggcagucgauaga

SEQ ID NO: 1588806 - RNA, 19 nt, Homo sapiens
gagggccgugagggguccc

SEQ ID NO: 1588807 - RNA, 18 nt, Homo sapiens
gagggcuagaaccuggag

SEQ ID NO: 1588808 - RNA, 23 nt, Homo sapiens
gagggcuuccucuagaagccaag

SEQ ID NO: 1588809 - RNA, 14 nt, Homo sapiens
gaggggacgcugag

SEQ ID NO: 1588810 - RNA, 19 nt, Homo sapiens
gaggguaugucagugucac

SEQ ID NO: 1588811 - RNA, 17 nt, Homo sapiens
gagguacugagagugaa

SEQ ID NO: 1588812 - RNA, 13 nt, Homo sapiens
gaggucacuggaa

SEQ ID NO: 1588813 - RNA, 17 nt, Homo sapiens
gaggucagcacacauua

SEQ ID NO: 1588814 - RNA, 22 nt, Homo sapiens
gagguggaaguggagcccagug

SEQ ID NO: 1588815 - RNA, 19 nt, Homo sapiens
gagguggagguugcaguga

SEQ ID NO: 1588816 - RNA, 20 nt, Homo sapiens
gaggugugcacaccaaagcu

SEQ ID NO: 1588817 - RNA, 14 nt, Homo sapiens
gagguuaaggcaua

SEQ ID NO: 1588818 - RNA, 14 nt, Homo sapiens
gagguuaggaguag

SEQ ID NO: 1588819 - RNA, 18 nt, Homo sapiens
gagguugagaaaaccuga

SEQ ID NO: 1588820 - RNA, 16 nt, Homo sapiens
gagguugggcuuccau

SEQ ID NO: 1588821 - RNA, 15 nt, Homo sapiens
gaguaaaauucaguu

SEQ ID NO: 1588822 - RNA, 16 nt, Homo sapiens
gaguaacagggcagaa

SEQ ID NO: 1588823 - RNA, 22 nt, Homo sapiens
gaguaauaagcauggugucagu

SEQ ID NO: 1588824 - RNA, 19 nt, Homo sapiens
gaguacacucagccacugu

SEQ ID NO: 1588825 - RNA, 14 nt, Homo sapiens
gaguagaauugcau

SEQ ID NO: 1588826 - RNA, 17 nt, Homo sapiens
gaguagaauugcauuga

SEQ ID NO: 1588827 - RNA, 23 nt, Homo sapiens
gaguagguaccauuugugucucu

SEQ ID NO: 1588828 - RNA, 15 nt, Homo sapiens
gaguauaccaugaga

SEQ ID NO: 1588829 - RNA, 16 nt, Homo sapiens
gagucacaauaaagau

SEQ ID NO: 1588830 - RNA, 14 nt, Homo sapiens
gagucacacagugu

SEQ ID NO: 1588831 - RNA, 22 nt, Homo sapiens
gagucagaucuuucuccuugaa

SEQ ID NO: 1588832 - RNA, 23 nt, Homo sapiens
gaguccacuguggcacuggccac

SEQ ID NO: 1588833 - RNA, 15 nt, Homo sapiens
gaguccuaggacuua

SEQ ID NO: 1588834 - RNA, 17 nt, Homo sapiens
gagucggccaccacaga

SEQ ID NO: 1588835 - RNA, 19 nt, Homo sapiens
gagucucugauacacagua

SEQ ID NO: 1588836 - RNA, 14 nt, Homo sapiens
gagucucuguauaa

SEQ ID NO: 1588837 - RNA, 13 nt, Homo sapiens
gagucuucacuaa

SEQ ID NO: 1588838 - RNA, 14 nt, Homo sapiens
gagucuuguguuca

SEQ ID NO: 1588839 - RNA, 17 nt, Homo sapiens
gagugacggcaaccugc

SEQ ID NO: 1588840 - RNA, 14 nt, Homo sapiens
gagugacucuccag

SEQ ID NO: 1588841 - RNA, 19 nt, Homo sapiens
gagugcaguggcgugaucu

SEQ ID NO: 1588842 - RNA, 20 nt, Homo sapiens
gagugcaguggcgugaucuc

SEQ ID NO: 1588843 - RNA, 21 nt, Homo sapiens
gagugccagucagcagucaug

SEQ ID NO: 1588844 - RNA, 14 nt, Homo sapiens
gagugccuacucuu

SEQ ID NO: 1588845 - RNA, 11 nt, Homo sapiens
gagugcugaua

SEQ ID NO: 1588846 - RNA, 16 nt, Homo sapiens
gaguggcccaccgugg

SEQ ID NO: 1588847 - RNA, 19 nt, Homo sapiens
gaguggggccuuugccagc

SEQ ID NO: 1588848 - RNA, 20 nt, Homo sapiens
gagugggguagguugggaga

SEQ ID NO: 1588849 - RNA, 16 nt, Homo sapiens
gagugguuuccaaugu

SEQ ID NO: 1588850 - RNA, 13 nt, Homo sapiens
gagugugaugaac

SEQ ID NO: 1588851 - RNA, 21 nt, Homo sapiens
gaguguguuugugugcaugaa

SEQ ID NO: 1588852 - RNA, 21 nt, Homo sapiens
gaguguuccccuuccacugag

SEQ ID NO: 1588853 - RNA, 18 nt, Homo sapiens
gaguguuuaaaguucaac

SEQ ID NO: 1588854 - RNA, 19 nt, Homo sapiens
gcuuugguuaauacaucuu

SEQ ID NO: 1588855 - RNA, 15 nt, Homo sapiens
gcuuuguggcacugg

SEQ ID NO: 1588856 - RNA, 11 nt, Homo sapiens
gcuuuugccau

SEQ ID NO: 1588857 - RNA, 14 nt, Homo sapiens
gcuuuuucagugau

SEQ ID NO: 1588858 - RNA, 18 nt, Homo sapiens
gcuuuuuguucagaauua

SEQ ID NO: 1588859 - RNA, 14 nt, Homo sapiens
ggaaaaaccuugug

SEQ ID NO: 1588860 - RNA, 13 nt, Homo sapiens
ggaaaacuacuga

SEQ ID NO: 1588861 - RNA, 22 nt, Homo sapiens
ggaaaacuguguugccacagua

SEQ ID NO: 1588862 - RNA, 18 nt, Homo sapiens
ggaaaagggaaaugugac

SEQ ID NO: 1588863 - RNA, 24 nt, Homo sapiens
ggaaaauaaacugacacuuauuaa

SEQ ID NO: 1588864 - RNA, 15 nt, Homo sapiens
ggaaaauaaucucaa

SEQ ID NO: 1588865 - RNA, 22 nt, Homo sapiens
ggaaaauaggaagugaacccau

SEQ ID NO: 1588866 - RNA, 16 nt, Homo sapiens
ggaaaauauccauccu

SEQ ID NO: 1588867 - RNA, 18 nt, Homo sapiens
ggaaaaucacaucuccag

SEQ ID NO: 1588868 - RNA, 22 nt, Homo sapiens
ggaaaaucauuugaggucagaa

SEQ ID NO: 1588869 - RNA, 15 nt, Homo sapiens
ggaaaaugccaugaa

SEQ ID NO: 1588870 - RNA, 22 nt, Homo sapiens
ggaaacuugaaaggucugagga

SEQ ID NO: 1588871 - RNA, 16 nt, Homo sapiens
ggaaagucaugcaauc

SEQ ID NO: 1588872 - RNA, 20 nt, Homo sapiens
ggaaaguuuucuccacugga

SEQ ID NO: 1588873 - RNA, 13 nt, Homo sapiens
ggaaauaauauca

SEQ ID NO: 1588874 - RNA, 23 nt, Homo sapiens
ggaaauaguaccuucaauacuua

SEQ ID NO: 1588875 - RNA, 22 nt, Homo sapiens
ggaaauauuugucuucucaggc

SEQ ID NO: 1588876 - RNA, 19 nt, Homo sapiens
ggaaaucaaggaugcucag

SEQ ID NO: 1588877 - RNA, 22 nt, Homo sapiens
ggaacaaagacaaccacuggga

SEQ ID NO: 1588878 - RNA, 21 nt, Homo sapiens
ggaacauuggagcugacuguu

SEQ ID NO: 1588879 - RNA, 20 nt, Homo sapiens
ggaacccccaucucuacuaa

SEQ ID NO: 1588880 - RNA, 17 nt, Homo sapiens
ggaaccucgaguacugu

SEQ ID NO: 1588881 - RNA, 17 nt, Homo sapiens
ggaaccuguccuaagga

SEQ ID NO: 1588882 - RNA, 14 nt, Homo sapiens
ggaacucacuuucc

SEQ ID NO: 1588883 - RNA, 23 nt, Homo sapiens
ggaacucugcuugauuuuugccu

SEQ ID NO: 1588884 - RNA, 23 nt, Homo sapiens
ggaacuguguuucaaauggacug

SEQ ID NO: 1588885 - RNA, 18 nt, Homo sapiens
ggaagacuugaagcacag

SEQ ID NO: 1588886 - RNA, 14 nt, Homo sapiens
ggaagagcaaggga

SEQ ID NO: 1588887 - RNA, 12 nt, Homo sapiens
ggaagagcuaau

SEQ ID NO: 1588888 - RNA, 21 nt, Homo sapiens
ggaagaggaacagcacugggg

SEQ ID NO: 1588889 - RNA, 16 nt, Homo sapiens
ggaagcaaauggcaaa

SEQ ID NO: 1588890 - RNA, 12 nt, Homo sapiens
ggaagcacauaa

SEQ ID NO: 1588891 - RNA, 15 nt, Homo sapiens
ggaagcagaggcccu

SEQ ID NO: 1588892 - RNA, 19 nt, Homo sapiens
ggaagcagcaaaaccuuca

SEQ ID NO: 1588893 - RNA, 19 nt, Homo sapiens
ggaagcccaggagccucac

SEQ ID NO: 1588894 - RNA, 21 nt, Homo sapiens
ggaagcccauccugaccagcu

SEQ ID NO: 1588895 - RNA, 15 nt, Homo sapiens
ggaagcuaauuugca

SEQ ID NO: 1588896 - RNA, 15 nt, Homo sapiens
ggaagcuacccaagg

SEQ ID NO: 1588897 - RNA, 16 nt, Homo sapiens
ggaaggcagcaggcau

SEQ ID NO: 1588898 - RNA, 16 nt, Homo sapiens
ggaagggcugggccac

SEQ ID NO: 1588899 - RNA, 17 nt, Homo sapiens
ggaagguaagauguuuc

SEQ ID NO: 1588900 - RNA, 15 nt, Homo sapiens
ggaaguagcugucag

SEQ ID NO: 1588901 - RNA, 14 nt, Homo sapiens
ggaaguugacuuau

SEQ ID NO: 1588902 - RNA, 18 nt, Homo sapiens
ggaaguuucuggugccau

SEQ ID NO: 1588903 - RNA, 21 nt, Homo sapiens
ggaauauaaggaaagcaauaa

SEQ ID NO: 1588904 - RNA, 14 nt, Homo sapiens
ggaaucgacuguau

SEQ ID NO: 1588905 - RNA, 14 nt, Homo sapiens
ggaaugaacugucc

SEQ ID NO: 1588906 - RNA, 14 nt, Homo sapiens
ggaaugacaacacc

SEQ ID NO: 1588907 - RNA, 20 nt, Homo sapiens
ggaaugcaccuccccaaagc

SEQ ID NO: 1588908 - RNA, 18 nt, Homo sapiens
ggaauuauucuaugucaa

SEQ ID NO: 1588909 - RNA, 14 nt, Homo sapiens
ggacaaaagggagc

SEQ ID NO: 1588910 - RNA, 21 nt, Homo sapiens
ggacaaaucuaaaaugcaaag

SEQ ID NO: 1588911 - RNA, 16 nt, Homo sapiens
ggacaaccaccaggug

SEQ ID NO: 1588912 - RNA, 23 nt, Homo sapiens
ggacaagaguugagcagccuuuc

SEQ ID NO: 1588913 - RNA, 22 nt, Homo sapiens
ggacaauaugugccaaucaaua

SEQ ID NO: 1588914 - RNA, 14 nt, Homo sapiens
ggacacagugauga

SEQ ID NO: 1588915 - RNA, 17 nt, Homo sapiens
ggacaccauuaccaaaa

SEQ ID NO: 1588916 - RNA, 23 nt, Homo sapiens
ggacacuacacuggggcccuuca

SEQ ID NO: 1588917 - RNA, 22 nt, Homo sapiens
ggacacuguccaugaagcacug

SEQ ID NO: 1588918 - RNA, 15 nt, Homo sapiens
ggacagaaccacuga

SEQ ID NO: 1588919 - RNA, 20 nt, Homo sapiens
ggacagacggaaaugaaauu

SEQ ID NO: 1588920 - RNA, 22 nt, Homo sapiens
ggacagcaaagcagcagugucc

SEQ ID NO: 1588921 - RNA, 17 nt, Homo sapiens
ggacagcagaagccucc

SEQ ID NO: 1588922 - RNA, 13 nt, Homo sapiens
ggacagguggugc

SEQ ID NO: 1588923 - RNA, 19 nt, Homo sapiens
ggacaguuuaucaugaagc

SEQ ID NO: 1588924 - RNA, 23 nt, Homo sapiens
ggacaucaaagugguaaauacug

SEQ ID NO: 1588925 - RNA, 15 nt, Homo sapiens
ggacaugcaugacac

SEQ ID NO: 1588926 - RNA, 23 nt, Homo sapiens
ggaccaccccugguguguagcua

SEQ ID NO: 1588927 - RNA, 17 nt, Homo sapiens
ggaccagaaguguuuca

SEQ ID NO: 1588928 - RNA, 17 nt, Homo sapiens
ggaccagacacaggucc

SEQ ID NO: 1588929 - RNA, 17 nt, Homo sapiens
ggaccagcccauuggcc

SEQ ID NO: 1588930 - RNA, 15 nt, Homo sapiens
ggaccaggucucaua

SEQ ID NO: 1588931 - RNA, 15 nt, Homo sapiens
ggacccagggccuga

SEQ ID NO: 1588932 - RNA, 19 nt, Homo sapiens
ggaccccuuguuacucagg

SEQ ID NO: 1588933 - RNA, 17 nt, Homo sapiens
ggacccuggaaauggac

SEQ ID NO: 1588934 - RNA, 14 nt, Homo sapiens
ggacccuguccaau

SEQ ID NO: 1588935 - RNA, 22 nt, Homo sapiens
ggaccucggaugaccauacuca

SEQ ID NO: 1588936 - RNA, 20 nt, Homo sapiens
ggaccugagccugguccugg

SEQ ID NO: 1588937 - RNA, 19 nt, Homo sapiens
ggaccuguauuuaagcaaa

SEQ ID NO: 1588938 - RNA, 22 nt, Homo sapiens
ggacgauagcuuggagggaugg

SEQ ID NO: 1588939 - RNA, 23 nt, Homo sapiens
ggacucaggcgggacagugcugc

SEQ ID NO: 1588940 - RNA, 21 nt, Homo sapiens
ggacuccaccuuggaccucag

SEQ ID NO: 1588941 - RNA, 15 nt, Homo sapiens
ggacuccaugcuccu

SEQ ID NO: 1588942 - RNA, 20 nt, Homo sapiens
ggacucucuguggucccuuc

SEQ ID NO: 1588943 - RNA, 19 nt, Homo sapiens
ggacucuuacugcuaacuu

SEQ ID NO: 1588944 - RNA, 15 nt, Homo sapiens
ggagaaaaagcuuaa

SEQ ID NO: 1588945 - RNA, 21 nt, Homo sapiens
ggagaaacaaaauccucagga

SEQ ID NO: 1588946 - RNA, 13 nt, Homo sapiens
ggagaauggugcu

SEQ ID NO: 1588947 - RNA, 20 nt, Homo sapiens
ggagacagccagguggcacc

SEQ ID NO: 1588948 - RNA, 14 nt, Homo sapiens
ggagacaggugagg

SEQ ID NO: 1588949 - RNA, 14 nt, Homo sapiens
ggagacgggacccu

SEQ ID NO: 1588950 - RNA, 20 nt, Homo sapiens
ggagacuuucaugcagccua

SEQ ID NO: 1588951 - RNA, 11 nt, Homo sapiens
ggagaggaccc

SEQ ID NO: 1588952 - RNA, 14 nt, Homo sapiens
ggagaggggggcca

SEQ ID NO: 1588953 - RNA, 15 nt, Homo sapiens
ggagagucacuugaa

SEQ ID NO: 1588954 - RNA, 20 nt, Homo sapiens
ggagauauaccuaauguuaa

SEQ ID NO: 1588955 - RNA, 18 nt, Homo sapiens
ggagauccuuucucucaa

SEQ ID NO: 1588956 - RNA, 13 nt, Homo sapiens
ggagcaggaccua

SEQ ID NO: 1588957 - RNA, 21 nt, Homo sapiens
ggagcaguugcccucaggccu

SEQ ID NO: 1588958 - RNA, 18 nt, Homo sapiens
ggagccucccccucagau

SEQ ID NO: 1588959 - RNA, 18 nt, Homo sapiens
ggagcucaucugcaaaag

SEQ ID NO: 1588960 - RNA, 14 nt, Homo sapiens
ggagcuggugagau

SEQ ID NO: 1588961 - RNA, 21 nt, Homo sapiens
ggagcugucaccucucagcug

SEQ ID NO: 1588962 - RNA, 17 nt, Homo sapiens
ggagcuugggucucucu

SEQ ID NO: 1588963 - RNA, 15 nt, Homo sapiens
ggaggaauacauuuu

SEQ ID NO: 1588964 - RNA, 13 nt, Homo sapiens
ggaggacaugggg

SEQ ID NO: 1588965 - RNA, 20 nt, Homo sapiens
ggaggaguuccaccaugagc

SEQ ID NO: 1588966 - RNA, 14 nt, Homo sapiens
ggaggaucaaagaa

SEQ ID NO: 1588967 - RNA, 23 nt, Homo sapiens
ggaggauugcagguggaacucag

SEQ ID NO: 1588968 - RNA, 19 nt, Homo sapiens
ggaggcaagcguguucuca

SEQ ID NO: 1588969 - RNA, 13 nt, Homo sapiens
ggaggcacuggga

SEQ ID NO: 1588970 - RNA, 14 nt, Homo sapiens
ggaggccauugugu

SEQ ID NO: 1588971 - RNA, 21 nt, Homo sapiens
ggaggcccaaaugauggauca

SEQ ID NO: 1588972 - RNA, 17 nt, Homo sapiens
gggcguugggagccuag

SEQ ID NO: 1588973 - RNA, 18 nt, Homo sapiens
gggcucuagggacugcca

SEQ ID NO: 1588974 - RNA, 19 nt, Homo sapiens
gggcucucucaugauagaa

SEQ ID NO: 1588975 - RNA, 17 nt, Homo sapiens
gggcugaggccucucau

SEQ ID NO: 1588976 - RNA, 15 nt, Homo sapiens
gggcugccaccagcc

SEQ ID NO: 1588977 - RNA, 17 nt, Homo sapiens
gggcugggcaaggaaaa

SEQ ID NO: 1588978 - RNA, 17 nt, Homo sapiens
gggcugguuuugcuucc

SEQ ID NO: 1588979 - RNA, 11 nt, Homo sapiens
gggcuguguuu

SEQ ID NO: 1588980 - RNA, 11 nt, Homo sapiens
gggcuuucaua

SEQ ID NO: 1588981 - RNA, 20 nt, Homo sapiens
ggggaagcggcccuaaggga

SEQ ID NO: 1588982 - RNA, 15 nt, Homo sapiens
ggggcagacaauaaa

SEQ ID NO: 1588983 - RNA, 18 nt, Homo sapiens
ggggcaggcugggccaug

SEQ ID NO: 1588984 - RNA, 16 nt, Homo sapiens
ggggcaggggugcuuc

SEQ ID NO: 1588985 - RNA, 11 nt, Homo sapiens
ggggccuguuu

SEQ ID NO: 1588986 - RNA, 15 nt, Homo sapiens
ggggcguucgcugcg

SEQ ID NO: 1588987 - RNA, 13 nt, Homo sapiens
ggggcucuucuca

SEQ ID NO: 1588988 - RNA, 12 nt, Homo sapiens
ggggcugugagc

SEQ ID NO: 1588989 - RNA, 15 nt, Homo sapiens
gggggcuccacccca

SEQ ID NO: 1588990 - RNA, 12 nt, Homo sapiens
gggguuccucaa

SEQ ID NO: 1588991 - RNA, 19 nt, Homo sapiens
ggguacagcccuugcacuc

SEQ ID NO: 1588992 - RNA, 15 nt, Homo sapiens
ggguaccuggcuaug

SEQ ID NO: 1588993 - RNA, 18 nt, Homo sapiens
ggguagcccgccugccag

SEQ ID NO: 1588994 - RNA, 16 nt, Homo sapiens
ggguaugucaguguca

SEQ ID NO: 1588995 - RNA, 21 nt, Homo sapiens
ggguauuuugguacugugaug

SEQ ID NO: 1588996 - RNA, 17 nt, Homo sapiens
gggucaacauuuccaaa

SEQ ID NO: 1588997 - RNA, 23 nt, Homo sapiens
gggucccugauaacaaccuggag

SEQ ID NO: 1588998 - RNA, 20 nt, Homo sapiens
ggguccuagaugccaaaggg

SEQ ID NO: 1588999 - RNA, 17 nt, Homo sapiens
gggugaccucuugccuc

SEQ ID NO: 1589000 - RNA, 17 nt, Homo sapiens
gggugcuuccuccucag

SEQ ID NO: 1589001 - RNA, 18 nt, Homo sapiens
ggguggcacucagucucu

SEQ ID NO: 1589002 - RNA, 21 nt, Homo sapiens
ggguggggaagaagacacaga

SEQ ID NO: 1589003 - RNA, 18 nt, Homo sapiens
ggguggggggugacagug

SEQ ID NO: 1589004 - RNA, 23 nt, Homo sapiens
gggugucacgagcccauucucau

SEQ ID NO: 1589005 - RNA, 15 nt, Homo sapiens
gggugugugugggca

SEQ ID NO: 1589006 - RNA, 16 nt, Homo sapiens
ggguucacaccauucu

SEQ ID NO: 1589007 - RNA, 13 nt, Homo sapiens
ggguucaccagcc

SEQ ID NO: 1589008 - RNA, 13 nt, Homo sapiens
ggguugcgucuca

SEQ ID NO: 1589009 - RNA, 22 nt, Homo sapiens
ggguuuauuuucauucugccaa

SEQ ID NO: 1589010 - RNA, 20 nt, Homo sapiens
gguaaaaaucuguaaauauc

SEQ ID NO: 1589011 - RNA, 13 nt, Homo sapiens
gguaaaauguauu

SEQ ID NO: 1589012 - RNA, 19 nt, Homo sapiens
gguaaagaccagggaugcu

SEQ ID NO: 1589013 - RNA, 20 nt, Homo sapiens
gguaaaggguggggcauuga

SEQ ID NO: 1589014 - RNA, 18 nt, Homo sapiens
gguaaauuuuuaggcaaa

SEQ ID NO: 1589015 - RNA, 18 nt, Homo sapiens
gguaagaagaaagcaaaa

SEQ ID NO: 1589016 - RNA, 22 nt, Homo sapiens
gguaagguuuucaagguggcaa

SEQ ID NO: 1589017 - RNA, 18 nt, Homo sapiens
gguaauuaguaacaugug

SEQ ID NO: 1589018 - RNA, 18 nt, Homo sapiens
gguacauuuaucacugaa

SEQ ID NO: 1589019 - RNA, 16 nt, Homo sapiens
gguacgaugacagugu

SEQ ID NO: 1589020 - RNA, 23 nt, Homo sapiens
gguacuauaaaagcuuucugcca

SEQ ID NO: 1589021 - RNA, 19 nt, Homo sapiens
gguagccaucaagcacuuc

SEQ ID NO: 1589022 - RNA, 14 nt, Homo sapiens
gguaggucauucuu

SEQ ID NO: 1589023 - RNA, 14 nt, Homo sapiens
gguagguugggaga

SEQ ID NO: 1589024 - RNA, 21 nt, Homo sapiens
gguaucaaaauuacauauacu

SEQ ID NO: 1589025 - RNA, 18 nt, Homo sapiens
gguauuuuaagugauguc

SEQ ID NO: 1589026 - RNA, 15 nt, Homo sapiens
ggucaaaaaggccaa

SEQ ID NO: 1589027 - RNA, 12 nt, Homo sapiens
ggucaaacuccc

SEQ ID NO: 1589028 - RNA, 15 nt, Homo sapiens
ggucaaaggcucaaa

SEQ ID NO: 1589029 - RNA, 16 nt, Homo sapiens
ggucaaaguucauaga

SEQ ID NO: 1589030 - RNA, 15 nt, Homo sapiens
ggucaagaguuaaac

SEQ ID NO: 1589031 - RNA, 18 nt, Homo sapiens
ggucacuacugcauuuau

SEQ ID NO: 1589032 - RNA, 18 nt, Homo sapiens
ggucagagaaaaugagaa

SEQ ID NO: 1589033 - RNA, 13 nt, Homo sapiens
ggucagagccacu

SEQ ID NO: 1589034 - RNA, 15 nt, Homo sapiens
ggucagagugccacu

SEQ ID NO: 1589035 - RNA, 15 nt, Homo sapiens
ggucaggcgcagugg

SEQ ID NO: 1589036 - RNA, 12 nt, Homo sapiens
ggucaucaaauu

SEQ ID NO: 1589037 - RNA, 16 nt, Homo sapiens
gguccagacccacucc

SEQ ID NO: 1589038 - RNA, 18 nt, Homo sapiens
gguccaggaauggugcuu

SEQ ID NO: 1589039 - RNA, 19 nt, Homo sapiens
gguccaggguugcuaggaa

SEQ ID NO: 1589040 - RNA, 15 nt, Homo sapiens
gguccucuggggccu

SEQ ID NO: 1589041 - RNA, 19 nt, Homo sapiens
gguccuggccgucccuaag

SEQ ID NO: 1589042 - RNA, 15 nt, Homo sapiens
gguccuggcuccuga

SEQ ID NO: 1589043 - RNA, 21 nt, Homo sapiens
gguccuuccacugugcaccug

SEQ ID NO: 1589044 - RNA, 22 nt, Homo sapiens
ggucuaagcaccuuggugcuua

SEQ ID NO: 1589045 - RNA, 14 nt, Homo sapiens
ggucuacagugaua

SEQ ID NO: 1589046 - RNA, 15 nt, Homo sapiens
ggucuaggacacagu

SEQ ID NO: 1589047 - RNA, 16 nt, Homo sapiens
ggucucaaacuccuga

SEQ ID NO: 1589048 - RNA, 18 nt, Homo sapiens
ggucuccaccccaggguc

SEQ ID NO: 1589049 - RNA, 17 nt, Homo sapiens
ggucugggcagcaccuc

SEQ ID NO: 1589050 - RNA, 23 nt, Homo sapiens
ggugaaggaugcggcaggugcuc

SEQ ID NO: 1589051 - RNA, 12 nt, Homo sapiens
ggugacacucua

SEQ ID NO: 1589052 - RNA, 20 nt, Homo sapiens
ggugacaguccaaaccacuc

SEQ ID NO: 1589053 - RNA, 21 nt, Homo sapiens
ggugacagugccuucucuauu

SEQ ID NO: 1589054 - RNA, 19 nt, Homo sapiens
ggugacuguguaacuuucu

SEQ ID NO: 1589055 - RNA, 17 nt, Homo sapiens
ggugauccgccuaccuc

SEQ ID NO: 1589056 - RNA, 20 nt, Homo sapiens
ggugauuggccacacacuga

SEQ ID NO: 1589057 - RNA, 17 nt, Homo sapiens
ggugcacucacuccuga

SEQ ID NO: 1589058 - RNA, 22 nt, Homo sapiens
ggugcagaguguuuaccuggug

SEQ ID NO: 1589059 - RNA, 19 nt, Homo sapiens
ggugcaugggcucgccgug

SEQ ID NO: 1589060 - RNA, 22 nt, Homo sapiens
gguggcccuaaaggacucucca

SEQ ID NO: 1589061 - RNA, 17 nt, Homo sapiens
gguggcccuugcaguuc

SEQ ID NO: 1589062 - RNA, 20 nt, Homo sapiens
gguggcgggaauccuauuua

SEQ ID NO: 1589063 - RNA, 14 nt, Homo sapiens
gguggcucaugccu

SEQ ID NO: 1589064 - RNA, 15 nt, Homo sapiens
ggugggauuccacuc

SEQ ID NO: 1589065 - RNA, 20 nt, Homo sapiens
ggugggauuccacucgugug

SEQ ID NO: 1589066 - RNA, 16 nt, Homo sapiens
ggugggcccccaauga

SEQ ID NO: 1589067 - RNA, 24 nt, Homo sapiens
gguguagaugggggaacugugaau

SEQ ID NO: 1589068 - RNA, 15 nt, Homo sapiens
gguguauugaagucc

SEQ ID NO: 1589069 - RNA, 11 nt, Homo sapiens
ggugucauauu

SEQ ID NO: 1589070 - RNA, 12 nt, Homo sapiens
ggugugcuguau

SEQ ID NO: 1589071 - RNA, 17 nt, Homo sapiens
gguguuguaugccuuua

SEQ ID NO: 1589072 - RNA, 13 nt, Homo sapiens
gguguuuugccau

SEQ ID NO: 1589073 - RNA, 22 nt, Homo sapiens
gguguuuuguaaaggauaucaa

SEQ ID NO: 1589074 - RNA, 17 nt, Homo sapiens
gguuaagaaagcacuua

SEQ ID NO: 1589075 - RNA, 17 nt, Homo sapiens
gguuaccuuuguuccca

SEQ ID NO: 1589076 - RNA, 17 nt, Homo sapiens
gguuauagcuucaggag

SEQ ID NO: 1589077 - RNA, 13 nt, Homo sapiens
gguuauauguaua

SEQ ID NO: 1589078 - RNA, 13 nt, Homo sapiens
gguucaugaauau

SEQ ID NO: 1589079 - RNA, 22 nt, Homo sapiens
gguucccguguuguaccugacu

SEQ ID NO: 1589080 - RNA, 11 nt, Homo sapiens
gguucucaggc

SEQ ID NO: 1589081 - RNA, 15 nt, Homo sapiens
gguucucuacaggcc

SEQ ID NO: 1589082 - RNA, 15 nt, Homo sapiens
gguucugagcaaaua

SEQ ID NO: 1589083 - RNA, 20 nt, Homo sapiens
gguugaacucugguggcaca

SEQ ID NO: 1589084 - RNA, 14 nt, Homo sapiens
gguugacugauguu

SEQ ID NO: 1589085 - RNA, 17 nt, Homo sapiens
gguugagcucuucuuaa

SEQ ID NO: 1589086 - RNA, 15 nt, Homo sapiens
gguugggcuggugcu

SEQ ID NO: 1589087 - RNA, 22 nt, Homo sapiens
gguugggcuggugcucacagcu

SEQ ID NO: 1589088 - RNA, 16 nt, Homo sapiens
gguugucaccaagcua

SEQ ID NO: 1589089 - RNA, 18 nt, Homo sapiens
gguuuauugaaugugauu

SEQ ID NO: 1589090 - RNA, 14 nt, Homo sapiens
gguuucaccauauu

SEQ ID NO: 1589091 - RNA, 21 nt, Homo sapiens
gguuugacacgcaguugcucg

SEQ ID NO: 1589092 - RNA, 15 nt, Homo sapiens
ggccucaucucagac

SEQ ID NO: 1589093 - RNA, 22 nt, Homo sapiens
ggccucccaaagugcugggauu

SEQ ID NO: 1589094 - RNA, 17 nt, Homo sapiens
ggccuccugucccucau

SEQ ID NO: 1589095 - RNA, 16 nt, Homo sapiens
ggccucucucaaaaga

SEQ ID NO: 1589096 - RNA, 20 nt, Homo sapiens
ggccugaaaugacauuucac

SEQ ID NO: 1589097 - RNA, 19 nt, Homo sapiens
ggccugcugccagugcagc

SEQ ID NO: 1589098 - RNA, 17 nt, Homo sapiens
ggccugggauggggcuu

SEQ ID NO: 1589099 - RNA, 21 nt, Homo sapiens
ggccuggggagcccacugagg

SEQ ID NO: 1589100 - RNA, 24 nt, Homo sapiens
ggccuguccacccugccaagacuc

SEQ ID NO: 1589101 - RNA, 13 nt, Homo sapiens
ggccuuagcagua

SEQ ID NO: 1589102 - RNA, 13 nt, Homo sapiens
ggccuuguaagac

SEQ ID NO: 1589103 - RNA, 16 nt, Homo sapiens
ggccuuuaagaaccuu

SEQ ID NO: 1589104 - RNA, 15 nt, Homo sapiens
ggcgaagugcuaaaa

SEQ ID NO: 1589105 - RNA, 21 nt, Homo sapiens
ggcgaccuccuuucaucacac

SEQ ID NO: 1589106 - RNA, 17 nt, Homo sapiens
ggcgaggagagggcgcu

SEQ ID NO: 1589107 - RNA, 19 nt, Homo sapiens
ggcgcaccccacagcuggg

SEQ ID NO: 1589108 - RNA, 17 nt, Homo sapiens
ggcgcucagcagcccua

SEQ ID NO: 1589109 - RNA, 22 nt, Homo sapiens
ggcgcuugcaccacuuccgucc

SEQ ID NO: 1589110 - RNA, 15 nt, Homo sapiens
ggcguccauguuuau

SEQ ID NO: 1589111 - RNA, 22 nt, Homo sapiens
ggcguuacugcuugaccaaaga

SEQ ID NO: 1589112 - RNA, 15 nt, Homo sapiens
ggcuaaaaagcaaca

SEQ ID NO: 1589113 - RNA, 16 nt, Homo sapiens
ggcuaauucaguguca

SEQ ID NO: 1589114 - RNA, 23 nt, Homo sapiens
ggcuaauuuaacaagaacuuuaa

SEQ ID NO: 1589115 - RNA, 18 nt, Homo sapiens
ggcuacuauagguccaga

SEQ ID NO: 1589116 - RNA, 14 nt, Homo sapiens
ggcuacugcacucu

SEQ ID NO: 1589117 - RNA, 17 nt, Homo sapiens
ggcuagaaccuggagaa

SEQ ID NO: 1589118 - RNA, 19 nt, Homo sapiens
ggcuagagugcaauggcgc

SEQ ID NO: 1589119 - RNA, 16 nt, Homo sapiens
ggcuagguaucauuca

SEQ ID NO: 1589120 - RNA, 16 nt, Homo sapiens
ggcuauaagugcucaa

SEQ ID NO: 1589121 - RNA, 23 nt, Homo sapiens
ggcuaucuaauuuuacacucugu

SEQ ID NO: 1589122 - RNA, 20 nt, Homo sapiens
ggcucaaaugauccucccac

SEQ ID NO: 1589123 - RNA, 15 nt, Homo sapiens
ggcucaacauugugu

SEQ ID NO: 1589124 - RNA, 14 nt, Homo sapiens
ggcucacacugaga

SEQ ID NO: 1589125 - RNA, 11 nt, Homo sapiens
ggcucagagau

SEQ ID NO: 1589126 - RNA, 19 nt, Homo sapiens
ggcuccacucuugaucucu

SEQ ID NO: 1589127 - RNA, 20 nt, Homo sapiens
ggcuccaggagccucaucca

SEQ ID NO: 1589128 - RNA, 14 nt, Homo sapiens
ggcuccucagagcg

SEQ ID NO: 1589129 - RNA, 21 nt, Homo sapiens
ggcuccucgagaucccaacac

SEQ ID NO: 1589130 - RNA, 18 nt, Homo sapiens
ggcuccucugcuucucac

SEQ ID NO: 1589131 - RNA, 19 nt, Homo sapiens
ggcuccucugcuucucacg

SEQ ID NO: 1589132 - RNA, 21 nt, Homo sapiens
ggcucgagagggcugguccuu

SEQ ID NO: 1589133 - RNA, 17 nt, Homo sapiens
ggcucuguuugugggac

SEQ ID NO: 1589134 - RNA, 20 nt, Homo sapiens
ggcugaauaaagccuuugau

SEQ ID NO: 1589135 - RNA, 13 nt, Homo sapiens
ggcugcaugaccu

SEQ ID NO: 1589136 - RNA, 18 nt, Homo sapiens
ggcugccccucucaccaa

SEQ ID NO: 1589137 - RNA, 20 nt, Homo sapiens
ggcugccgcagggcacugaa

SEQ ID NO: 1589138 - RNA, 18 nt, Homo sapiens
ggcugcuccccaacaccu

SEQ ID NO: 1589139 - RNA, 17 nt, Homo sapiens
ggcuggaaucuggagag

SEQ ID NO: 1589140 - RNA, 19 nt, Homo sapiens
ggcuggacugcaguggccu

SEQ ID NO: 1589141 - RNA, 14 nt, Homo sapiens
ggcuggagugcagu

SEQ ID NO: 1589142 - RNA, 19 nt, Homo sapiens
ggcuggagugcaguggcgu

SEQ ID NO: 1589143 - RNA, 17 nt, Homo sapiens
ggcuggauagguaugca

SEQ ID NO: 1589144 - RNA, 17 nt, Homo sapiens
ggcuggcgggccuuuuu

SEQ ID NO: 1589145 - RNA, 15 nt, Homo sapiens
ggcugggauggugac

SEQ ID NO: 1589146 - RNA, 18 nt, Homo sapiens
ggcugggccccuccagga

SEQ ID NO: 1589147 - RNA, 21 nt, Homo sapiens
ggcuggugcucacagcuguaa

SEQ ID NO: 1589148 - RNA, 17 nt, Homo sapiens
ggcugugccaucagcuc

SEQ ID NO: 1589149 - RNA, 19 nt, Homo sapiens
ggcuguguuuccaucucaa

SEQ ID NO: 1589150 - RNA, 20 nt, Homo sapiens
ggcuguuaggacagcaaagc

SEQ ID NO: 1589151 - RNA, 13 nt, Homo sapiens
ggcuuagugccac

SEQ ID NO: 1589152 - RNA, 21 nt, Homo sapiens
ggcuucauugagaaacuggga

SEQ ID NO: 1589153 - RNA, 14 nt, Homo sapiens
ggcuuccaugccug

SEQ ID NO: 1589154 - RNA, 19 nt, Homo sapiens
ggcuuccucuagaagccaa

SEQ ID NO: 1589155 - RNA, 15 nt, Homo sapiens
ggcuucuccagggaa

SEQ ID NO: 1589156 - RNA, 19 nt, Homo sapiens
ggcuuggccugcugugauu

SEQ ID NO: 1589157 - RNA, 15 nt, Homo sapiens
ggcuuuaaaagucau

SEQ ID NO: 1589158 - RNA, 19 nt, Homo sapiens
ggcuuugccucuucuuugu

SEQ ID NO: 1589159 - RNA, 21 nt, Homo sapiens
ggcuuugcuguuguugggaca

SEQ ID NO: 1589160 - RNA, 12 nt, Homo sapiens
ggcuuuggcacu

SEQ ID NO: 1589161 - RNA, 21 nt, Homo sapiens
gggaaaccccccagagcucuu

SEQ ID NO: 1589162 - RNA, 12 nt, Homo sapiens
gggaaacuggcu

SEQ ID NO: 1589163 - RNA, 18 nt, Homo sapiens
gggaaaggaaucagagag

SEQ ID NO: 1589164 - RNA, 21 nt, Homo sapiens
gggaacaacugggccugggau

SEQ ID NO: 1589165 - RNA, 19 nt, Homo sapiens
gggaacacaggcccagaug

SEQ ID NO: 1589166 - RNA, 16 nt, Homo sapiens
gggaacuggagucugu

SEQ ID NO: 1589167 - RNA, 23 nt, Homo sapiens
gggaacuuuuuuagaaaugcaaa

SEQ ID NO: 1589168 - RNA, 12 nt, Homo sapiens
gggaagccaguc

SEQ ID NO: 1589169 - RNA, 14 nt, Homo sapiens
gggaagccuagaga

SEQ ID NO: 1589170 - RNA, 16 nt, Homo sapiens
gggaaggucaccagca

SEQ ID NO: 1589171 - RNA, 17 nt, Homo sapiens
gggaaguggaaggaaga

SEQ ID NO: 1589172 - RNA, 15 nt, Homo sapiens
gggaauacuggccau

SEQ ID NO: 1589173 - RNA, 13 nt, Homo sapiens
gggaauucuuaca

SEQ ID NO: 1589174 - RNA, 14 nt, Homo sapiens
gggaccagggaugg

SEQ ID NO: 1589175 - RNA, 22 nt, Homo sapiens
gggaccugacugugggguccua

SEQ ID NO: 1589176 - RNA, 13 nt, Homo sapiens
gggacucugagaa

SEQ ID NO: 1589177 - RNA, 20 nt, Homo sapiens
gggacugcuaccucugagaa

SEQ ID NO: 1589178 - RNA, 18 nt, Homo sapiens
gggacuucugucuucaca

SEQ ID NO: 1589179 - RNA, 14 nt, Homo sapiens
gggagaaaugccag

SEQ ID NO: 1589180 - RNA, 19 nt, Homo sapiens
gggagagcgaaggggguca

SEQ ID NO: 1589181 - RNA, 11 nt, Homo sapiens
gggagcacugc

SEQ ID NO: 1589182 - RNA, 23 nt, Homo sapiens
gggagcagagcuuccacaagaca

SEQ ID NO: 1589183 - RNA, 20 nt, Homo sapiens
gggagccuaaggaagcgugg

SEQ ID NO: 1589184 - RNA, 14 nt, Homo sapiens
gggagcugggcccu

SEQ ID NO: 1589185 - RNA, 20 nt, Homo sapiens
gggaggaacuccuugcacac

SEQ ID NO: 1589186 - RNA, 14 nt, Homo sapiens
gggaggacaggcag

SEQ ID NO: 1589187 - RNA, 12 nt, Homo sapiens
gggaggcccaaa

SEQ ID NO: 1589188 - RNA, 15 nt, Homo sapiens
gggaggugggguaca

SEQ ID NO: 1589189 - RNA, 18 nt, Homo sapiens
gggauauggcugcccagg

SEQ ID NO: 1589190 - RNA, 23 nt, Homo sapiens
gggaucagaguucccaagaaagg

SEQ ID NO: 1589191 - RNA, 21 nt, Homo sapiens
gggaucuggugggcagucgaa

SEQ ID NO: 1589192 - RNA, 13 nt, Homo sapiens
gggaucuucccac

SEQ ID NO: 1589193 - RNA, 17 nt, Homo sapiens
gggaugagcaugcuguu

SEQ ID NO: 1589194 - RNA, 19 nt, Homo sapiens
gggauggagaaacaagaca

SEQ ID NO: 1589195 - RNA, 13 nt, Homo sapiens
gggauuacaggcg

SEQ ID NO: 1589196 - RNA, 17 nt, Homo sapiens
gggauugucuuacuguu

SEQ ID NO: 1589197 - RNA, 14 nt, Homo sapiens
gggcaagccaagug

SEQ ID NO: 1589198 - RNA, 21 nt, Homo sapiens
gggcaccuuccgacaucccag

SEQ ID NO: 1589199 - RNA, 12 nt, Homo sapiens
gggcacugugcc

SEQ ID NO: 1589200 - RNA, 21 nt, Homo sapiens
gggcagaauaaauaagcaaaa

SEQ ID NO: 1589201 - RNA, 18 nt, Homo sapiens
gggcaucugccccucccc

SEQ ID NO: 1589202 - RNA, 19 nt, Homo sapiens
gggccaccgccuugcccag

SEQ ID NO: 1589203 - RNA, 21 nt, Homo sapiens
gggccagcacuuccaugggaa

SEQ ID NO: 1589204 - RNA, 14 nt, Homo sapiens
gggccauguccaaa

SEQ ID NO: 1589205 - RNA, 21 nt, Homo sapiens
gggccgguuuuccucagcucu

SEQ ID NO: 1589206 - RNA, 17 nt, Homo sapiens
gggccgugagggguccc

SEQ ID NO: 1589207 - RNA, 15 nt, Homo sapiens
gggccucacauucca

SEQ ID NO: 1589208 - RNA, 16 nt, Homo sapiens
gggccugaccaaacag

SEQ ID NO: 1589209 - RNA, 22 nt, Homo sapiens
gggccuuugccagcagagccag

SEQ ID NO: 1589210 - RNA, 17 nt, Homo sapiens
gggcgugggcgcuugca

SEQ ID NO: 1589211 - RNA, 15 nt, Homo sapiens
aaaaucaucuuauaa

SEQ ID NO: 1589212 - RNA, 15 nt, Homo sapiens
aaaaucauuucugca

SEQ ID NO: 1589213 - RNA, 13 nt, Homo sapiens
aaaauccaaggca

SEQ ID NO: 1589214 - RNA, 24 nt, Homo sapiens
aaaauccuauucugaugaaucuca

SEQ ID NO: 1589215 - RNA, 18 nt, Homo sapiens
aaaauccugaacuuucuc

SEQ ID NO: 1589216 - RNA, 12 nt, Homo sapiens
aaaaucuagagg

SEQ ID NO: 1589217 - RNA, 18 nt, Homo sapiens
aaaaucuccaauccacac

SEQ ID NO: 1589218 - RNA, 16 nt, Homo sapiens
aaaaucuccaucucaa

SEQ ID NO: 1589219 - RNA, 20 nt, Homo sapiens
aaaaugaaccugcaagccuu

SEQ ID NO: 1589220 - RNA, 20 nt, Homo sapiens
aaaaugaaguuuugauuuau

SEQ ID NO: 1589221 - RNA, 14 nt, Homo sapiens
aaaaugacccaaga

SEQ ID NO: 1589222 - RNA, 22 nt, Homo sapiens
aaaaugaugguaccauguaaca

SEQ ID NO: 1589223 - RNA, 12 nt, Homo sapiens
aaaaugcaauau

SEQ ID NO: 1589224 - RNA, 15 nt, Homo sapiens
aaaaugcaccaauca

SEQ ID NO: 1589225 - RNA, 17 nt, Homo sapiens
aaaaugcaccaaucagc

SEQ ID NO: 1589226 - RNA, 17 nt, Homo sapiens
aaaaugcagaacuuaau

SEQ ID NO: 1589227 - RNA, 11 nt, Homo sapiens
aaaaugcugcu

SEQ ID NO: 1589228 - RNA, 15 nt, Homo sapiens
aaaaugcuucacugu

SEQ ID NO: 1589229 - RNA, 13 nt, Homo sapiens
aaaaugcuuuguu

SEQ ID NO: 1589230 - RNA, 16 nt, Homo sapiens
aaaauggaaaagagag

SEQ ID NO: 1589231 - RNA, 19 nt, Homo sapiens
aaaauggaggccauugugu

SEQ ID NO: 1589232 - RNA, 16 nt, Homo sapiens
aaaauguaucauucag

SEQ ID NO: 1589233 - RNA, 14 nt, Homo sapiens
aaaaugucaucuca

SEQ ID NO: 1589234 - RNA, 22 nt, Homo sapiens
aaaauguucuguuugcugugga

SEQ ID NO: 1589235 - RNA, 15 nt, Homo sapiens
aaaauguucuuacac

SEQ ID NO: 1589236 - RNA, 22 nt, Homo sapiens
aaaauguuuuccccaaaccaua

SEQ ID NO: 1589237 - RNA, 16 nt, Homo sapiens
aaaauuaaacuacaga

SEQ ID NO: 1589238 - RNA, 13 nt, Homo sapiens
aaaauuacauguu

SEQ ID NO: 1589239 - RNA, 15 nt, Homo sapiens
aaaauuagacuguga

SEQ ID NO: 1589240 - RNA, 14 nt, Homo sapiens
aaaauucagaugcu

SEQ ID NO: 1589241 - RNA, 23 nt, Homo sapiens
aaaauucccuaaagacuaacuug

SEQ ID NO: 1589242 - RNA, 18 nt, Homo sapiens
aaaauuccucuuacugua

SEQ ID NO: 1589243 - RNA, 20 nt, Homo sapiens
aaaauucuauguuaauuaca

SEQ ID NO: 1589244 - RNA, 16 nt, Homo sapiens
aaaauugaacuacagc

SEQ ID NO: 1589245 - RNA, 20 nt, Homo sapiens
aaaauugaauaguuuauuuc

SEQ ID NO: 1589246 - RNA, 22 nt, Homo sapiens
aaaauugagaccugagugaaga

SEQ ID NO: 1589247 - RNA, 17 nt, Homo sapiens
aaaauugccaacauaag

SEQ ID NO: 1589248 - RNA, 16 nt, Homo sapiens
aaaauugccucucucu

SEQ ID NO: 1589249 - RNA, 18 nt, Homo sapiens
aaaauuguuuaccauaga

SEQ ID NO: 1589250 - RNA, 15 nt, Homo sapiens
aaaauuugcugccaa

SEQ ID NO: 1589251 - RNA, 22 nt, Homo sapiens
aaaauuuuaacacuaaccaaac

SEQ ID NO: 1589252 - RNA, 10 nt, Homo sapiens
aaacaaaaga

SEQ ID NO: 1589253 - RNA, 21 nt, Homo sapiens
aaacaaaaggguguauagugu

SEQ ID NO: 1589254 - RNA, 13 nt, Homo sapiens
aaacaaacaugac

SEQ ID NO: 1589255 - RNA, 17 nt, Homo sapiens
aaacaaauauuucacuu

SEQ ID NO: 1589256 - RNA, 18 nt, Homo sapiens
aaacaaauauuucacuua

SEQ ID NO: 1589257 - RNA, 16 nt, Homo sapiens
aaacaaaucaguuggc

SEQ ID NO: 1589258 - RNA, 20 nt, Homo sapiens
aaacaacagcucgauccaaa

SEQ ID NO: 1589259 - RNA, 15 nt, Homo sapiens
aaacaauucugugac

SEQ ID NO: 1589260 - RNA, 14 nt, Homo sapiens
aaacacacauacac

SEQ ID NO: 1589261 - RNA, 19 nt, Homo sapiens
aaacacacauugcagcuuc

SEQ ID NO: 1589262 - RNA, 19 nt, Homo sapiens
aaacacacuguauuuuaca

SEQ ID NO: 1589263 - RNA, 21 nt, Homo sapiens
aaacacagcaacaaugacuua

SEQ ID NO: 1589264 - RNA, 23 nt, Homo sapiens
aaacaccagccgaggccacagaa

SEQ ID NO: 1589265 - RNA, 22 nt, Homo sapiens
aaacacuauuuccaaaagcaca

SEQ ID NO: 1589266 - RNA, 12 nt, Homo sapiens
aaacacuccaca

SEQ ID NO: 1589267 - RNA, 19 nt, Homo sapiens
aaacagauguuuguuuuca

SEQ ID NO: 1589268 - RNA, 16 nt, Homo sapiens
aaacagauuacuagaa

SEQ ID NO: 1589269 - RNA, 20 nt, Homo sapiens
aaacagccaagauuuuccuc

SEQ ID NO: 1589270 - RNA, 15 nt, Homo sapiens
aaacagcuguauuua

SEQ ID NO: 1589271 - RNA, 14 nt, Homo sapiens
aaacagugugcaug

SEQ ID NO: 1589272 - RNA, 10 nt, Homo sapiens
aaacauacag

SEQ ID NO: 1589273 - RNA, 18 nt, Homo sapiens
aaacauagcuuucuuccc

SEQ ID NO: 1589274 - RNA, 19 nt, Homo sapiens
aaacaucacaccugcccua

SEQ ID NO: 1589275 - RNA, 14 nt, Homo sapiens
aaacaucauuucaa

SEQ ID NO: 1589276 - RNA, 22 nt, Homo sapiens
aaacaugcagaagauguuuaaa

SEQ ID NO: 1589277 - RNA, 14 nt, Homo sapiens
aaacaugucacaau

SEQ ID NO: 1589278 - RNA, 23 nt, Homo sapiens
aaacauugccuuugaauguuaau

SEQ ID NO: 1589279 - RNA, 23 nt, Homo sapiens
aaacauuguuuuuguugucuuua

SEQ ID NO: 1589280 - RNA, 22 nt, Homo sapiens
aaacauuuguuuguggucuaua

SEQ ID NO: 1589281 - RNA, 17 nt, Homo sapiens
aaaccaccgugaaccag

SEQ ID NO: 1589282 - RNA, 12 nt, Homo sapiens
aaaccacuguac

SEQ ID NO: 1589283 - RNA, 20 nt, Homo sapiens
aaaccaucuaugugaauauu

SEQ ID NO: 1589284 - RNA, 12 nt, Homo sapiens
aaaccauucuag

SEQ ID NO: 1589285 - RNA, 16 nt, Homo sapiens
aaacccaagugcugca

SEQ ID NO: 1589286 - RNA, 13 nt, Homo sapiens
aaacccaauccaa

SEQ ID NO: 1589287 - RNA, 21 nt, Homo sapiens
aaacccauaaguuuaacugua

SEQ ID NO: 1589288 - RNA, 22 nt, Homo sapiens
aaacccauguugaucuuucuca

SEQ ID NO: 1589289 - RNA, 15 nt, Homo sapiens
aaaccccaaacuguu

SEQ ID NO: 1589290 - RNA, 22 nt, Homo sapiens
aaacccuauacaaguuguucua

SEQ ID NO: 1589291 - RNA, 16 nt, Homo sapiens
aaacccucagcacugu

SEQ ID NO: 1589292 - RNA, 15 nt, Homo sapiens
aaaccuaguacugcc

SEQ ID NO: 1589293 - RNA, 23 nt, Homo sapiens
aaaccuccaaggaccucucucaa

SEQ ID NO: 1589294 - RNA, 16 nt, Homo sapiens
aaaccugccuugcaca

SEQ ID NO: 1589295 - RNA, 17 nt, Homo sapiens
aaaccuuaagugcugca

SEQ ID NO: 1589296 - RNA, 18 nt, Homo sapiens
aaaccuugcucuccucau

SEQ ID NO: 1589297 - RNA, 15 nt, Homo sapiens
aaacgcaccaaucag

SEQ ID NO: 1589298 - RNA, 13 nt, Homo sapiens
aaacgcuacugag

SEQ ID NO: 1589299 - RNA, 17 nt, Homo sapiens
aaacguuucuugaacaa

SEQ ID NO: 1589300 - RNA, 15 nt, Homo sapiens
aaacguuugacaaac

SEQ ID NO: 1589301 - RNA, 12 nt, Homo sapiens
aaacuaagccag

SEQ ID NO: 1589302 - RNA, 13 nt, Homo sapiens
aaacuaagccagg

SEQ ID NO: 1589303 - RNA, 12 nt, Homo sapiens
aaacuaaggauu

SEQ ID NO: 1589304 - RNA, 23 nt, Homo sapiens
aaacuaagguuagaaacauuuug

SEQ ID NO: 1589305 - RNA, 18 nt, Homo sapiens
aaacuaccaaauuaguga

SEQ ID NO: 1589306 - RNA, 22 nt, Homo sapiens
aaacuacuauuuuucuuuccaa

SEQ ID NO: 1589307 - RNA, 16 nt, Homo sapiens
aaacuauuuauaucac

SEQ ID NO: 1589308 - RNA, 16 nt, Homo sapiens
aaacuauuucagugau

SEQ ID NO: 1589309 - RNA, 16 nt, Homo sapiens
aaacucacucacuguu

SEQ ID NO: 1589310 - RNA, 15 nt, Homo sapiens
aaacucaucacauaa

SEQ ID NO: 1589311 - RNA, 18 nt, Homo sapiens
aaacucauccuucuucca

SEQ ID NO: 1589312 - RNA, 15 nt, Homo sapiens
aaacuccgagugaac

SEQ ID NO: 1589313 - RNA, 22 nt, Homo sapiens
aaacucugcauccagagauuca

SEQ ID NO: 1589314 - RNA, 15 nt, Homo sapiens
aaacugaauuuguac

SEQ ID NO: 1589315 - RNA, 22 nt, Homo sapiens
aaacugacuuaaugcucuucaa

SEQ ID NO: 1589316 - RNA, 12 nt, Homo sapiens
aaacugagucac

SEQ ID NO: 1589317 - RNA, 11 nt, Homo sapiens
aaacugcauuu

SEQ ID NO: 1589318 - RNA, 20 nt, Homo sapiens
aaacugcgaggacaucaaag

SEQ ID NO: 1589319 - RNA, 23 nt, Homo sapiens
aaacugggauuaagaaaccuugc

SEQ ID NO: 1589320 - RNA, 17 nt, Homo sapiens
aaacuguaugugcaguu

SEQ ID NO: 1589321 - RNA, 14 nt, Homo sapiens
aaacuguguugcca

SEQ ID NO: 1589322 - RNA, 19 nt, Homo sapiens
aaacuguuugacuucucaa

SEQ ID NO: 1589323 - RNA, 22 nt, Homo sapiens
aaacuuaacaaaagugauguaa

SEQ ID NO: 1589324 - RNA, 17 nt, Homo sapiens
aaacuuauuuacaaaua

SEQ ID NO: 1589325 - RNA, 20 nt, Homo sapiens
aaacuugugaaugcuucuca

SEQ ID NO: 1589326 - RNA, 22 nt, Homo sapiens
aaacuuguuagaucaaccucca

SEQ ID NO: 1589327 - RNA, 23 nt, Homo sapiens
aaacuuuuguucuuuaauaugcu

SEQ ID NO: 1589328 - RNA, 18 nt, Homo sapiens
aaagaaaaagaccuauga

SEQ ID NO: 1589329 - RNA, 18 nt, Homo sapiens
aaccauagaggauggucu

SEQ ID NO: 1589330 - RNA, 19 nt, Homo sapiens
aaccaucugaagaaacuuc

SEQ ID NO: 1589331 - RNA, 21 nt, Homo sapiens
aaccauggccaauucaguuuc

SEQ ID NO: 1589332 - RNA, 15 nt, Homo sapiens
aaccauuccaacuuc

SEQ ID NO: 1589333 - RNA, 12 nt, Homo sapiens
aacccaccugcu

SEQ ID NO: 1589334 - RNA, 13 nt, Homo sapiens
aacccaguggcug

SEQ ID NO: 1589335 - RNA, 20 nt, Homo sapiens
aacccaguguuuccacacuu

SEQ ID NO: 1589336 - RNA, 22 nt, Homo sapiens
aacccauaggcacuugggaugu

SEQ ID NO: 1589337 - RNA, 15 nt, Homo sapiens
aacccaucucugaac

SEQ ID NO: 1589338 - RNA, 17 nt, Homo sapiens
aaccccacaaucuagga

SEQ ID NO: 1589339 - RNA, 18 nt, Homo sapiens
aaccccagggcacugcca

SEQ ID NO: 1589340 - RNA, 17 nt, Homo sapiens
aacccccaucucuacua

SEQ ID NO: 1589341 - RNA, 20 nt, Homo sapiens
aaccccuccucccucagacu

SEQ ID NO: 1589342 - RNA, 15 nt, Homo sapiens
aacccucagcacugu

SEQ ID NO: 1589343 - RNA, 17 nt, Homo sapiens
aacccucagcacuguua

SEQ ID NO: 1589344 - RNA, 19 nt, Homo sapiens
aacccugccaguuucucca

SEQ ID NO: 1589345 - RNA, 13 nt, Homo sapiens
aacccugccaugg

SEQ ID NO: 1589346 - RNA, 20 nt, Homo sapiens
aacccugggcuauugcugcu

SEQ ID NO: 1589347 - RNA, 17 nt, Homo sapiens
aacccuuaaaaaugcac

SEQ ID NO: 1589348 - RNA, 16 nt, Homo sapiens
aaccgcacaugugcca

SEQ ID NO: 1589349 - RNA, 16 nt, Homo sapiens
aaccguccucuuuuuc

SEQ ID NO: 1589350 - RNA, 14 nt, Homo sapiens
aaccuagcuagcaa

SEQ ID NO: 1589351 - RNA, 11 nt, Homo sapiens
aaccucaggga

SEQ ID NO: 1589352 - RNA, 21 nt, Homo sapiens
aaccucaguuauuacauguaa

SEQ ID NO: 1589353 - RNA, 22 nt, Homo sapiens
aaccuccaaggaccucucucaa

SEQ ID NO: 1589354 - RNA, 14 nt, Homo sapiens
aaccuccuuuacca

SEQ ID NO: 1589355 - RNA, 20 nt, Homo sapiens
aaccucucgaacaguauuca

SEQ ID NO: 1589356 - RNA, 15 nt, Homo sapiens
aaccugaauggucug

SEQ ID NO: 1589357 - RNA, 21 nt, Homo sapiens
aaccugaauuaucuauuucau

SEQ ID NO: 1589358 - RNA, 19 nt, Homo sapiens
aaccugcacguugugcaca

SEQ ID NO: 1589359 - RNA, 13 nt, Homo sapiens
aaccugcaguuuu

SEQ ID NO: 1589360 - RNA, 18 nt, Homo sapiens
aaccugccaugccaggaa

SEQ ID NO: 1589361 - RNA, 21 nt, Homo sapiens
aaccuggaaucuacaagccaa

SEQ ID NO: 1589362 - RNA, 21 nt, Homo sapiens
aaccuggagagcuagaaccua

SEQ ID NO: 1589363 - RNA, 22 nt, Homo sapiens
aaccuggaggggcuagaaccua

SEQ ID NO: 1589364 - RNA, 22 nt, Homo sapiens
aaccuuacuaauuauacuacuu

SEQ ID NO: 1589365 - RNA, 23 nt, Homo sapiens
aaccuuagaaagacuacauguua

SEQ ID NO: 1589366 - RNA, 15 nt, Homo sapiens
aaccuucaacccagu

SEQ ID NO: 1589367 - RNA, 15 nt, Homo sapiens
aaccuugaaauggaa

SEQ ID NO: 1589368 - RNA, 22 nt, Homo sapiens
aaccuugaaauggaaagucaug

SEQ ID NO: 1589369 - RNA, 19 nt, Homo sapiens
aacgacuacccagaagugu

SEQ ID NO: 1589370 - RNA, 17 nt, Homo sapiens
aacgggcagucugcucu

SEQ ID NO: 1589371 - RNA, 20 nt, Homo sapiens
aacgguuaagaaagcacuua

SEQ ID NO: 1589372 - RNA, 19 nt, Homo sapiens
aacgucuaggaaaucuaga

SEQ ID NO: 1589373 - RNA, 15 nt, Homo sapiens
aacgugcucacugug

SEQ ID NO: 1589374 - RNA, 22 nt, Homo sapiens
aacguuuacuuaucuuaugcca

SEQ ID NO: 1589375 - RNA, 20 nt, Homo sapiens
aacuaaaaggaagucaucca

SEQ ID NO: 1589376 - RNA, 13 nt, Homo sapiens
aacuaaaauguuc

SEQ ID NO: 1589377 - RNA, 21 nt, Homo sapiens
aacuaaagcuggagagaccug

SEQ ID NO: 1589378 - RNA, 14 nt, Homo sapiens
aacuaacaaugccu

SEQ ID NO: 1589379 - RNA, 22 nt, Homo sapiens
aacuaacccuuaaaaaugcaca

SEQ ID NO: 1589380 - RNA, 19 nt, Homo sapiens
aacuaacugcauacacuuu

SEQ ID NO: 1589381 - RNA, 19 nt, Homo sapiens
aacuaagaaaaaaagcaca

SEQ ID NO: 1589382 - RNA, 21 nt, Homo sapiens
aacuaagaaaauucuauguua

SEQ ID NO: 1589383 - RNA, 23 nt, Homo sapiens
aacuaagguuagaaacauuuuga

SEQ ID NO: 1589384 - RNA, 22 nt, Homo sapiens
aacuaaucaagaaaaacaucuu

SEQ ID NO: 1589385 - RNA, 16 nt, Homo sapiens
aacuaauuucauuuca

SEQ ID NO: 1589386 - RNA, 20 nt, Homo sapiens
aacuaguaaagcaaagugag

SEQ ID NO: 1589387 - RNA, 13 nt, Homo sapiens
aacuauaaauccu

SEQ ID NO: 1589388 - RNA, 17 nt, Homo sapiens
aacuauaagauacaaua

SEQ ID NO: 1589389 - RNA, 13 nt, Homo sapiens
aacuauaagcaag

SEQ ID NO: 1589390 - RNA, 15 nt, Homo sapiens
aacuauuuaaaggaa

SEQ ID NO: 1589391 - RNA, 16 nt, Homo sapiens
aacuauuuaaaggaaa

SEQ ID NO: 1589392 - RNA, 19 nt, Homo sapiens
aacuauuuuaaauauccau

SEQ ID NO: 1589393 - RNA, 20 nt, Homo sapiens
aacucaacugggcucugucc

SEQ ID NO: 1589394 - RNA, 23 nt, Homo sapiens
aacucaaggacagccaccaagaa

SEQ ID NO: 1589395 - RNA, 18 nt, Homo sapiens
aacucacccccaccacca

SEQ ID NO: 1589396 - RNA, 17 nt, Homo sapiens
aacucacuaacagggag

SEQ ID NO: 1589397 - RNA, 12 nt, Homo sapiens
aacucacuguga

SEQ ID NO: 1589398 - RNA, 18 nt, Homo sapiens
aacucagaucugucugau

SEQ ID NO: 1589399 - RNA, 22 nt, Homo sapiens
aacucagcccccaccacaaaca

SEQ ID NO: 1589400 - RNA, 22 nt, Homo sapiens
aacucaguccucucccuuguga

SEQ ID NO: 1589401 - RNA, 23 nt, Homo sapiens
aacuccacugcuuaccuacuuuc

SEQ ID NO: 1589402 - RNA, 22 nt, Homo sapiens
aacuccccucagggauacgaca

SEQ ID NO: 1589403 - RNA, 23 nt, Homo sapiens
aacuccuaaaaaguuacagccau

SEQ ID NO: 1589404 - RNA, 19 nt, Homo sapiens
aacuccugaccuugugauc

SEQ ID NO: 1589405 - RNA, 24 nt, Homo sapiens
aacucgcgaguguaacuuucauac

SEQ ID NO: 1589406 - RNA, 23 nt, Homo sapiens
aacucuaaaucuuguauaugcau

SEQ ID NO: 1589407 - RNA, 16 nt, Homo sapiens
aacucuaccugcacac

SEQ ID NO: 1589408 - RNA, 22 nt, Homo sapiens
aacucuagcauucuaguuucau

SEQ ID NO: 1589409 - RNA, 22 nt, Homo sapiens
aacucucaccaugaugugaaga

SEQ ID NO: 1589410 - RNA, 21 nt, Homo sapiens
aacucuccaauguucuauuaa

SEQ ID NO: 1589411 - RNA, 13 nt, Homo sapiens
aacucuccccagu

SEQ ID NO: 1589412 - RNA, 15 nt, Homo sapiens
aacucugcacuacuc

SEQ ID NO: 1589413 - RNA, 23 nt, Homo sapiens
aacucuggugcuccugcaucuca

SEQ ID NO: 1589414 - RNA, 18 nt, Homo sapiens
aacucuguaaucaagaau

SEQ ID NO: 1589415 - RNA, 17 nt, Homo sapiens
aacugaaaaauuacuua

SEQ ID NO: 1589416 - RNA, 14 nt, Homo sapiens
aacugaaagcacua

SEQ ID NO: 1589417 - RNA, 13 nt, Homo sapiens
aacugaaggcaua

SEQ ID NO: 1589418 - RNA, 17 nt, Homo sapiens
aacugaaggcuaaaaag

SEQ ID NO: 1589419 - RNA, 19 nt, Homo sapiens
aacugaaggcuaaaaagca

SEQ ID NO: 1589420 - RNA, 13 nt, Homo sapiens
aacugaaugacuu

SEQ ID NO: 1589421 - RNA, 16 nt, Homo sapiens
aacugaaugacuugac

SEQ ID NO: 1589422 - RNA, 16 nt, Homo sapiens
aacugacaaugaaggg

SEQ ID NO: 1589423 - RNA, 16 nt, Homo sapiens
aacugacucuguuauu

SEQ ID NO: 1589424 - RNA, 22 nt, Homo sapiens
aacugcauugguuuuccaugac

SEQ ID NO: 1589425 - RNA, 21 nt, Homo sapiens
aacuguaaaugugacauugau

SEQ ID NO: 1589426 - RNA, 17 nt, Homo sapiens
aacuguagguaugaucu

SEQ ID NO: 1589427 - RNA, 18 nt, Homo sapiens
aacugucuugugagcuga

SEQ ID NO: 1589428 - RNA, 18 nt, Homo sapiens
aacugugaaauaccacaa

SEQ ID NO: 1589429 - RNA, 22 nt, Homo sapiens
aacugugaaauaccacaagccu

SEQ ID NO: 1589430 - RNA, 20 nt, Homo sapiens
aacugugaauacuugaacuc

SEQ ID NO: 1589431 - RNA, 14 nt, Homo sapiens
aacuguguauuuau

SEQ ID NO: 1589432 - RNA, 13 nt, Homo sapiens
aacuguguugcca

SEQ ID NO: 1589433 - RNA, 18 nt, Homo sapiens
aacuguuccugacuuuau

SEQ ID NO: 1589434 - RNA, 21 nt, Homo sapiens
aacuguuggcaaggugacauu

SEQ ID NO: 1589435 - RNA, 22 nt, Homo sapiens
aacuguuuuagaaauugguaca

SEQ ID NO: 1589436 - RNA, 18 nt, Homo sapiens
aacuguuuuagaccuaua

SEQ ID NO: 1589437 - RNA, 14 nt, Homo sapiens
aacuuaaaguauaa

SEQ ID NO: 1589438 - RNA, 16 nt, Homo sapiens
aacuuaaauuccaaac

SEQ ID NO: 1589439 - RNA, 13 nt, Homo sapiens
aacuuaacauuca

SEQ ID NO: 1589440 - RNA, 21 nt, Homo sapiens
aacuuagccauuuuucaaagc

SEQ ID NO: 1589441 - RNA, 15 nt, Homo sapiens
aacuucaauuuacuu

SEQ ID NO: 1589442 - RNA, 21 nt, Homo sapiens
aacuucaccuacauuaucuca

SEQ ID NO: 1589443 - RNA, 13 nt, Homo sapiens
aacuucauauuaa

SEQ ID NO: 1589444 - RNA, 23 nt, Homo sapiens
aacuucauuguuuggaccugcau

SEQ ID NO: 1589445 - RNA, 12 nt, Homo sapiens
aacuuccaguca

SEQ ID NO: 1589446 - RNA, 19 nt, Homo sapiens
acccuccccuagucacuca

SEQ ID NO: 1589447 - RNA, 16 nt, Homo sapiens
acccucccuccagggu

SEQ ID NO: 1589448 - RNA, 13 nt, Homo sapiens
acccuccucuugg

SEQ ID NO: 1589449 - RNA, 14 nt, Homo sapiens
acccucuugaauau

SEQ ID NO: 1589450 - RNA, 21 nt, Homo sapiens
acccugacacggacugugcau

SEQ ID NO: 1589451 - RNA, 16 nt, Homo sapiens
acccugcccaccaaga

SEQ ID NO: 1589452 - RNA, 22 nt, Homo sapiens
acccugcccaggguuggcauga

SEQ ID NO: 1589453 - RNA, 18 nt, Homo sapiens
acccuggagagugcacau

SEQ ID NO: 1589454 - RNA, 22 nt, Homo sapiens
acccuguccggcccagugccac

SEQ ID NO: 1589455 - RNA, 12 nt, Homo sapiens
acccugucugua

SEQ ID NO: 1589456 - RNA, 22 nt, Homo sapiens
acccuuaggccagcaccaucuc

SEQ ID NO: 1589457 - RNA, 20 nt, Homo sapiens
acccuucccgccucccucuc

SEQ ID NO: 1589458 - RNA, 18 nt, Homo sapiens
acccuugagaagcugcca

SEQ ID NO: 1589459 - RNA, 15 nt, Homo sapiens
acccuuuagugcuuu

SEQ ID NO: 1589460 - RNA, 19 nt, Homo sapiens
acccuuugucucugagaag

SEQ ID NO: 1589461 - RNA, 22 nt, Homo sapiens
acccuuuucccccuucccauuu

SEQ ID NO: 1589462 - RNA, 15 nt, Homo sapiens
accgaaaucccucag

SEQ ID NO: 1589463 - RNA, 12 nt, Homo sapiens
accgaacacuac

SEQ ID NO: 1589464 - RNA, 22 nt, Homo sapiens
accgagcgugugccacuggacc

SEQ ID NO: 1589465 - RNA, 14 nt, Homo sapiens
accgauaugcacuu

SEQ ID NO: 1589466 - RNA, 16 nt, Homo sapiens
accgcaauaugggagg

SEQ ID NO: 1589467 - RNA, 22 nt, Homo sapiens
accgcccaucaggguucucuua

SEQ ID NO: 1589468 - RNA, 16 nt, Homo sapiens
accgccccucccugaa

SEQ ID NO: 1589469 - RNA, 14 nt, Homo sapiens
accgccuugcccag

SEQ ID NO: 1589470 - RNA, 15 nt, Homo sapiens
accggaacugggcug

SEQ ID NO: 1589471 - RNA, 19 nt, Homo sapiens
accgugaccguuugcuaua

SEQ ID NO: 1589472 - RNA, 14 nt, Homo sapiens
accuaaaaacaaaa

SEQ ID NO: 1589473 - RNA, 17 nt, Homo sapiens
accuaaauaugagccca

SEQ ID NO: 1589474 - RNA, 20 nt, Homo sapiens
accuaauggucucuaccuaa

SEQ ID NO: 1589475 - RNA, 13 nt, Homo sapiens
accuacaguguac

SEQ ID NO: 1589476 - RNA, 23 nt, Homo sapiens
accuagaagggcuagaaccugga

SEQ ID NO: 1589477 - RNA, 15 nt, Homo sapiens
accuagacaaccaga

SEQ ID NO: 1589478 - RNA, 16 nt, Homo sapiens
accuagaguuuuauca

SEQ ID NO: 1589479 - RNA, 17 nt, Homo sapiens
accuagcaggcuguucc

SEQ ID NO: 1589480 - RNA, 21 nt, Homo sapiens
accuagugcaaaaacuguaaa

SEQ ID NO: 1589481 - RNA, 21 nt, Homo sapiens
accuaugagauggccaugcuc

SEQ ID NO: 1589482 - RNA, 11 nt, Homo sapiens
accuaugccug

SEQ ID NO: 1589483 - RNA, 13 nt, Homo sapiens
accuaugugccaa

SEQ ID NO: 1589484 - RNA, 22 nt, Homo sapiens
accucaacauugcauggugcua

SEQ ID NO: 1589485 - RNA, 12 nt, Homo sapiens
accucaagccau

SEQ ID NO: 1589486 - RNA, 16 nt, Homo sapiens
accucacacccaaagc

SEQ ID NO: 1589487 - RNA, 12 nt, Homo sapiens
accucacuuuag

SEQ ID NO: 1589488 - RNA, 18 nt, Homo sapiens
accucaguuauuacaugu

SEQ ID NO: 1589489 - RNA, 20 nt, Homo sapiens
accucauaaaaaucuagcac

SEQ ID NO: 1589490 - RNA, 15 nt, Homo sapiens
accucaucucuacua

SEQ ID NO: 1589491 - RNA, 14 nt, Homo sapiens
accuccaacacagu

SEQ ID NO: 1589492 - RNA, 16 nt, Homo sapiens
accuccacucugccau

SEQ ID NO: 1589493 - RNA, 20 nt, Homo sapiens
accucccugcucagugcuug

SEQ ID NO: 1589494 - RNA, 17 nt, Homo sapiens
accuccgccccugcccc

SEQ ID NO: 1589495 - RNA, 19 nt, Homo sapiens
accuccuuguguugcacug

SEQ ID NO: 1589496 - RNA, 22 nt, Homo sapiens
accuccuuucaucacacugggu

SEQ ID NO: 1589497 - RNA, 17 nt, Homo sapiens
accucgcuggacucuca

SEQ ID NO: 1589498 - RNA, 13 nt, Homo sapiens
accucuaccaaaa

SEQ ID NO: 1589499 - RNA, 20 nt, Homo sapiens
accucuccacacagguguuc

SEQ ID NO: 1589500 - RNA, 17 nt, Homo sapiens
accucuggacuggcuag

SEQ ID NO: 1589501 - RNA, 17 nt, Homo sapiens
accucuuggcugccuug

SEQ ID NO: 1589502 - RNA, 22 nt, Homo sapiens
accugaaauaaaauucauuagu

SEQ ID NO: 1589503 - RNA, 18 nt, Homo sapiens
accugagaaauggccaaa

SEQ ID NO: 1589504 - RNA, 17 nt, Homo sapiens
accugauugaucacaca

SEQ ID NO: 1589505 - RNA, 21 nt, Homo sapiens
accugauugaucacacagugu

SEQ ID NO: 1589506 - RNA, 12 nt, Homo sapiens
accugcaaaaaa

SEQ ID NO: 1589507 - RNA, 17 nt, Homo sapiens
accugcaagccuucuaa

SEQ ID NO: 1589508 - RNA, 12 nt, Homo sapiens
accugcaaguug

SEQ ID NO: 1589509 - RNA, 23 nt, Homo sapiens
accugcaccuccccccacugcag

SEQ ID NO: 1589510 - RNA, 23 nt, Homo sapiens
accugcacguugugcacauguac

SEQ ID NO: 1589511 - RNA, 15 nt, Homo sapiens
accugccucugaccc

SEQ ID NO: 1589512 - RNA, 19 nt, Homo sapiens
accugcucccaguccugcc

SEQ ID NO: 1589513 - RNA, 14 nt, Homo sapiens
accuggaacaucuc

SEQ ID NO: 1589514 - RNA, 21 nt, Homo sapiens
accuggagagcuagaaccuag

SEQ ID NO: 1589515 - RNA, 21 nt, Homo sapiens
accuggaggggcuagaaccua

SEQ ID NO: 1589516 - RNA, 22 nt, Homo sapiens
accuggaggggcuagaaccuag

SEQ ID NO: 1589517 - RNA, 20 nt, Homo sapiens
accuggaguggaucuauuua

SEQ ID NO: 1589518 - RNA, 22 nt, Homo sapiens
accuggauuuuuuauguacaac

SEQ ID NO: 1589519 - RNA, 21 nt, Homo sapiens
accuggcagguuagaaccuag

SEQ ID NO: 1589520 - RNA, 19 nt, Homo sapiens
accuggcccuugcaaucuu

SEQ ID NO: 1589521 - RNA, 15 nt, Homo sapiens
accugggcaaagccu

SEQ ID NO: 1589522 - RNA, 22 nt, Homo sapiens
accuggggagugguuaggcagc

SEQ ID NO: 1589523 - RNA, 15 nt, Homo sapiens
accuggugcucucaa

SEQ ID NO: 1589524 - RNA, 14 nt, Homo sapiens
accuguacauucuu

SEQ ID NO: 1589525 - RNA, 21 nt, Homo sapiens
accuguagauucagguaauac

SEQ ID NO: 1589526 - RNA, 16 nt, Homo sapiens
accugucaacauuugg

SEQ ID NO: 1589527 - RNA, 14 nt, Homo sapiens
accuguccaguuug

SEQ ID NO: 1589528 - RNA, 21 nt, Homo sapiens
accuguuccuuuuucuggguu

SEQ ID NO: 1589529 - RNA, 13 nt, Homo sapiens
accuuagugcaac

SEQ ID NO: 1589530 - RNA, 18 nt, Homo sapiens
accuuauaguuacugugu

SEQ ID NO: 1589531 - RNA, 12 nt, Homo sapiens
accuuauccugc

SEQ ID NO: 1589532 - RNA, 19 nt, Homo sapiens
accuucaaguauccaauuc

SEQ ID NO: 1589533 - RNA, 15 nt, Homo sapiens
accuucaauacuuaa

SEQ ID NO: 1589534 - RNA, 15 nt, Homo sapiens
accuuccccugagga

SEQ ID NO: 1589535 - RNA, 21 nt, Homo sapiens
accuuccuccugcagacaccu

SEQ ID NO: 1589536 - RNA, 14 nt, Homo sapiens
accuuccucuucca

SEQ ID NO: 1589537 - RNA, 16 nt, Homo sapiens
accuugaaagacauuu

SEQ ID NO: 1589538 - RNA, 22 nt, Homo sapiens
accuugaugcuuggccucccaa

SEQ ID NO: 1589539 - RNA, 17 nt, Homo sapiens
accuuggaaaugaccag

SEQ ID NO: 1589540 - RNA, 21 nt, Homo sapiens
accuuggaaaugaccaggcca

SEQ ID NO: 1589541 - RNA, 15 nt, Homo sapiens
accuuggaccucagu

SEQ ID NO: 1589542 - RNA, 16 nt, Homo sapiens
accuuggggucccucc

SEQ ID NO: 1589543 - RNA, 13 nt, Homo sapiens
accuuggugcuua

SEQ ID NO: 1589544 - RNA, 18 nt, Homo sapiens
accuugugauucugcuua

SEQ ID NO: 1589545 - RNA, 22 nt, Homo sapiens
accuuguuccuguaaaauccau

SEQ ID NO: 1589546 - RNA, 20 nt, Homo sapiens
accuuuccauuuauucuuug

SEQ ID NO: 1589547 - RNA, 10 nt, Homo sapiens
accuuuucau

SEQ ID NO: 1589548 - RNA, 14 nt, Homo sapiens
accuuuucaugguc

SEQ ID NO: 1589549 - RNA, 18 nt, Homo sapiens
acgacuguuguacaagcu

SEQ ID NO: 1589550 - RNA, 22 nt, Homo sapiens
acgagcaggcuacugucagcuc

SEQ ID NO: 1589551 - RNA, 20 nt, Homo sapiens
acgagugaaacuccgucuca

SEQ ID NO: 1589552 - RNA, 23 nt, Homo sapiens
acgaucaaguuguugacugugau

SEQ ID NO: 1589553 - RNA, 14 nt, Homo sapiens
acgaugacaguguu

SEQ ID NO: 1589554 - RNA, 16 nt, Homo sapiens
acgaugugacugccau

SEQ ID NO: 1589555 - RNA, 13 nt, Homo sapiens
acgauuauaguaa

SEQ ID NO: 1589556 - RNA, 22 nt, Homo sapiens
acgauuuugcacaaauauccac

SEQ ID NO: 1589557 - RNA, 13 nt, Homo sapiens
acgcaccagacac

SEQ ID NO: 1589558 - RNA, 21 nt, Homo sapiens
acgcaccgccugaaggcacag

SEQ ID NO: 1589559 - RNA, 21 nt, Homo sapiens
acgcaggccagcaacucccag

SEQ ID NO: 1589560 - RNA, 19 nt, Homo sapiens
acgccaacauggcacaugu

SEQ ID NO: 1589561 - RNA, 18 nt, Homo sapiens
acgccaauguuaugccag

SEQ ID NO: 1589562 - RNA, 21 nt, Homo sapiens
acgccacucauuucaucucau

SEQ ID NO: 1589563 - RNA, 17 nt, Homo sapiens
acgccacucccugggac

SEQ ID NO: 1589564 - RNA, 11 nt, Homo sapiens
agacagaggaa

SEQ ID NO: 1589565 - RNA, 13 nt, Homo sapiens
agacagagucuca

SEQ ID NO: 1589566 - RNA, 20 nt, Homo sapiens
agacagaguuucaccauguu

SEQ ID NO: 1589567 - RNA, 22 nt, Homo sapiens
agacaggcaaauguacuucuca

SEQ ID NO: 1589568 - RNA, 15 nt, Homo sapiens
agacaggcagagauc

SEQ ID NO: 1589569 - RNA, 20 nt, Homo sapiens
agacagugcccuuggugcga

SEQ ID NO: 1589570 - RNA, 22 nt, Homo sapiens
agacauaaagccuuuugcuuua

SEQ ID NO: 1589571 - RNA, 17 nt, Homo sapiens
agacauacuccuuccau

SEQ ID NO: 1589572 - RNA, 15 nt, Homo sapiens
agacauauaccaaaa

SEQ ID NO: 1589573 - RNA, 21 nt, Homo sapiens
agacaugauuuccuugaaugu

SEQ ID NO: 1589574 - RNA, 12 nt, Homo sapiens
agacauggaaag

SEQ ID NO: 1589575 - RNA, 14 nt, Homo sapiens
agacauguaugugu

SEQ ID NO: 1589576 - RNA, 23 nt, Homo sapiens
agacauuacaauguguaauggaa

SEQ ID NO: 1589577 - RNA, 22 nt, Homo sapiens
agacauucauuuaguugauaua

SEQ ID NO: 1589578 - RNA, 19 nt, Homo sapiens
agacauuucgaagucauca

SEQ ID NO: 1589579 - RNA, 17 nt, Homo sapiens
agacauuucucuaacuc

SEQ ID NO: 1589580 - RNA, 22 nt, Homo sapiens
agacauuuuaaaaaauggucac

SEQ ID NO: 1589581 - RNA, 21 nt, Homo sapiens
agacauuuuguuuuuacugua

SEQ ID NO: 1589582 - RNA, 22 nt, Homo sapiens
agaccaacuuuucaaugugauu

SEQ ID NO: 1589583 - RNA, 14 nt, Homo sapiens
agaccacugauaaa

SEQ ID NO: 1589584 - RNA, 19 nt, Homo sapiens
agaccaggucuacagugau

SEQ ID NO: 1589585 - RNA, 21 nt, Homo sapiens
agaccaugugguuugcuguua

SEQ ID NO: 1589586 - RNA, 17 nt, Homo sapiens
agacccagggguccagg

SEQ ID NO: 1589587 - RNA, 14 nt, Homo sapiens
agacccaguggacu

SEQ ID NO: 1589588 - RNA, 17 nt, Homo sapiens
agacccgauuccaccaa

SEQ ID NO: 1589589 - RNA, 14 nt, Homo sapiens
agacccugucucaa

SEQ ID NO: 1589590 - RNA, 21 nt, Homo sapiens
agacccuuuuaucugcuguug

SEQ ID NO: 1589591 - RNA, 17 nt, Homo sapiens
agaccucagcagggcau

SEQ ID NO: 1589592 - RNA, 21 nt, Homo sapiens
agaccugaccagucagauggu

SEQ ID NO: 1589593 - RNA, 21 nt, Homo sapiens
agaccuggcuccacucuugau

SEQ ID NO: 1589594 - RNA, 20 nt, Homo sapiens
agaccugguucccgccuccc

SEQ ID NO: 1589595 - RNA, 21 nt, Homo sapiens
agacgcccuauuucuauguca

SEQ ID NO: 1589596 - RNA, 12 nt, Homo sapiens
agacgccuguua

SEQ ID NO: 1589597 - RNA, 23 nt, Homo sapiens
agacgccuuugugagcugugagu

SEQ ID NO: 1589598 - RNA, 14 nt, Homo sapiens
agacggaugcccau

SEQ ID NO: 1589599 - RNA, 20 nt, Homo sapiens
agacgguaccaauucagugu

SEQ ID NO: 1589600 - RNA, 21 nt, Homo sapiens
agacgugauuuugcuguagaa

SEQ ID NO: 1589601 - RNA, 20 nt, Homo sapiens
agacuaccggacacucguca

SEQ ID NO: 1589602 - RNA, 22 nt, Homo sapiens
agacuaccggacacucgucacc

SEQ ID NO: 1589603 - RNA, 21 nt, Homo sapiens
agacuaucuuacuauuucaca

SEQ ID NO: 1589604 - RNA, 21 nt, Homo sapiens
agacuauggauguguucucua

SEQ ID NO: 1589605 - RNA, 13 nt, Homo sapiens
agacucaaaggga

SEQ ID NO: 1589606 - RNA, 22 nt, Homo sapiens
agacucaaagggagaggucuca

SEQ ID NO: 1589607 - RNA, 18 nt, Homo sapiens
agacucaagagaauuuau

SEQ ID NO: 1589608 - RNA, 19 nt, Homo sapiens
agacucagguuccagaaca

SEQ ID NO: 1589609 - RNA, 13 nt, Homo sapiens
agacuccaaagaa

SEQ ID NO: 1589610 - RNA, 18 nt, Homo sapiens
agacuccaccucuaccaa

SEQ ID NO: 1589611 - RNA, 20 nt, Homo sapiens
agacuccaccucuaccaaaa

SEQ ID NO: 1589612 - RNA, 21 nt, Homo sapiens
agacuccaccucuaccaaaaa

SEQ ID NO: 1589613 - RNA, 12 nt, Homo sapiens
agacuccaucuc

SEQ ID NO: 1589614 - RNA, 23 nt, Homo sapiens
agacuccugcucucuauccaaaa

SEQ ID NO: 1589615 - RNA, 15 nt, Homo sapiens
agacucuaguauuua

SEQ ID NO: 1589616 - RNA, 21 nt, Homo sapiens
agacucugauucuacagugau

SEQ ID NO: 1589617 - RNA, 17 nt, Homo sapiens
agacucuguaauugaau

SEQ ID NO: 1589618 - RNA, 17 nt, Homo sapiens
agacucugucuaccugg

SEQ ID NO: 1589619 - RNA, 18 nt, Homo sapiens
agacucugucuaccuggu

SEQ ID NO: 1589620 - RNA, 19 nt, Homo sapiens
agacugaaaggugugaaca

SEQ ID NO: 1589621 - RNA, 14 nt, Homo sapiens
agacugaagaaagu

SEQ ID NO: 1589622 - RNA, 19 nt, Homo sapiens
agacugacacuacuaaagc

SEQ ID NO: 1589623 - RNA, 16 nt, Homo sapiens
agacugaugagcacau

SEQ ID NO: 1589624 - RNA, 21 nt, Homo sapiens
agacugcccagcuaaagcaau

SEQ ID NO: 1589625 - RNA, 13 nt, Homo sapiens
agacugcuacagg

SEQ ID NO: 1589626 - RNA, 14 nt, Homo sapiens
agacugcuacaggu

SEQ ID NO: 1589627 - RNA, 23 nt, Homo sapiens
agacugcuagcuuucuccuuacc

SEQ ID NO: 1589628 - RNA, 16 nt, Homo sapiens
agacuggaaaagugau

SEQ ID NO: 1589629 - RNA, 19 nt, Homo sapiens
agacuggaauaguggcaua

SEQ ID NO: 1589630 - RNA, 14 nt, Homo sapiens
agacuggcuuuuau

SEQ ID NO: 1589631 - RNA, 17 nt, Homo sapiens
agacugggaugccuguc

SEQ ID NO: 1589632 - RNA, 17 nt, Homo sapiens
agacugguuuucugcca

SEQ ID NO: 1589633 - RNA, 19 nt, Homo sapiens
agacugucccugaaaccua

SEQ ID NO: 1589634 - RNA, 19 nt, Homo sapiens
agacuguuucacauugcac

SEQ ID NO: 1589635 - RNA, 18 nt, Homo sapiens
agacuuaggaaccuacca

SEQ ID NO: 1589636 - RNA, 21 nt, Homo sapiens
agacuuccaucuagucacaaa

SEQ ID NO: 1589637 - RNA, 11 nt, Homo sapiens
agacuucccag

SEQ ID NO: 1589638 - RNA, 17 nt, Homo sapiens
agacuuugcuaaagaca

SEQ ID NO: 1589639 - RNA, 14 nt, Homo sapiens
agacuuugcuguua

SEQ ID NO: 1589640 - RNA, 15 nt, Homo sapiens
agagaaaaacuaacu

SEQ ID NO: 1589641 - RNA, 20 nt, Homo sapiens
agagaacagaaaucggggaa

SEQ ID NO: 1589642 - RNA, 9 nt, Homo sapiens
agagaagau

SEQ ID NO: 1589643 - RNA, 21 nt, Homo sapiens
agagaaggaccagaaaaugua

SEQ ID NO: 1589644 - RNA, 13 nt, Homo sapiens
agagaaguuugaa

SEQ ID NO: 1589645 - RNA, 21 nt, Homo sapiens
agagaaugagcagagagcaaa

SEQ ID NO: 1589646 - RNA, 19 nt, Homo sapiens
agagaaugcacagauauac

SEQ ID NO: 1589647 - RNA, 14 nt, Homo sapiens
agagaaugcuuuga

SEQ ID NO: 1589648 - RNA, 19 nt, Homo sapiens
agagaauguuccagacauu

SEQ ID NO: 1589649 - RNA, 20 nt, Homo sapiens
agagacacugagccagucuu

SEQ ID NO: 1589650 - RNA, 23 nt, Homo sapiens
agagacagaaagcagaacaguga

SEQ ID NO: 1589651 - RNA, 16 nt, Homo sapiens
agagacaggguuucac

SEQ ID NO: 1589652 - RNA, 23 nt, Homo sapiens
agagacccuuugucucugagaag

SEQ ID NO: 1589653 - RNA, 11 nt, Homo sapiens
agagaccucca

SEQ ID NO: 1589654 - RNA, 12 nt, Homo sapiens
agagaccugcuc

SEQ ID NO: 1589655 - RNA, 13 nt, Homo sapiens
agagaccugcuca

SEQ ID NO: 1589656 - RNA, 18 nt, Homo sapiens
agagacgguguuuugcca

SEQ ID NO: 1589657 - RNA, 16 nt, Homo sapiens
agagacugucccugaa

SEQ ID NO: 1589658 - RNA, 13 nt, Homo sapiens
agagagcaaagau

SEQ ID NO: 1589659 - RNA, 15 nt, Homo sapiens
agagagcaucuuucc

SEQ ID NO: 1589660 - RNA, 17 nt, Homo sapiens
agagaggaggggaccaa

SEQ ID NO: 1589661 - RNA, 14 nt, Homo sapiens
agagagugcuauug

SEQ ID NO: 1589662 - RNA, 20 nt, Homo sapiens
agagauauuuauguacucuc

SEQ ID NO: 1589663 - RNA, 19 nt, Homo sapiens
agagaucuuucuuuccaaa

SEQ ID NO: 1589664 - RNA, 21 nt, Homo sapiens
agagaucuuucuuuccaaaac

SEQ ID NO: 1589665 - RNA, 17 nt, Homo sapiens
agagaugggacuaggac

SEQ ID NO: 1589666 - RNA, 21 nt, Homo sapiens
agagaugggguuucaccauau

SEQ ID NO: 1589667 - RNA, 17 nt, Homo sapiens
agagauuagaauaucug

SEQ ID NO: 1589668 - RNA, 18 nt, Homo sapiens
agagcaaaccuaacagga

SEQ ID NO: 1589669 - RNA, 21 nt, Homo sapiens
agagcaaaccuaacaggagaa

SEQ ID NO: 1589670 - RNA, 23 nt, Homo sapiens
agagcacuugagaaccagucucc

SEQ ID NO: 1589671 - RNA, 14 nt, Homo sapiens
agagcagcauuccc

SEQ ID NO: 1589672 - RNA, 14 nt, Homo sapiens
agagcaggacucca

SEQ ID NO: 1589673 - RNA, 16 nt, Homo sapiens
agagcaggacugcaca

SEQ ID NO: 1589674 - RNA, 16 nt, Homo sapiens
agagcaggggcuccag

SEQ ID NO: 1589675 - RNA, 17 nt, Homo sapiens
agagcaggggcuccagc

SEQ ID NO: 1589676 - RNA, 15 nt, Homo sapiens
agagccagcagguca

SEQ ID NO: 1589677 - RNA, 22 nt, Homo sapiens
agagccagugugccaccaggcu

SEQ ID NO: 1589678 - RNA, 22 nt, Homo sapiens
agagcccuucccagggcaccca

SEQ ID NO: 1589679 - RNA, 13 nt, Homo sapiens
agagcccuugccu

SEQ ID NO: 1589680 - RNA, 14 nt, Homo sapiens
agagcccuugccuc

SEQ ID NO: 1589681 - RNA, 15 nt, Homo sapiens
agagccugacgcuca

SEQ ID NO: 1589682 - RNA, 14 nt, Homo sapiens
agcugaaccacaga

SEQ ID NO: 1589683 - RNA, 22 nt, Homo sapiens
agcugagacuacaagugugugc

SEQ ID NO: 1589684 - RNA, 16 nt, Homo sapiens
agcugagaucgugcua

SEQ ID NO: 1589685 - RNA, 21 nt, Homo sapiens
agcugauuccagaacaaauca

SEQ ID NO: 1589686 - RNA, 22 nt, Homo sapiens
agcugccaccucuccauccugc

SEQ ID NO: 1589687 - RNA, 19 nt, Homo sapiens
agcugcccuccuuguccac

SEQ ID NO: 1589688 - RNA, 20 nt, Homo sapiens
agcugcccuuccugccugau

SEQ ID NO: 1589689 - RNA, 14 nt, Homo sapiens
agcugccucacuuc

SEQ ID NO: 1589690 - RNA, 16 nt, Homo sapiens
agcugccucacuuccu

SEQ ID NO: 1589691 - RNA, 13 nt, Homo sapiens
agcugccucugcu

SEQ ID NO: 1589692 - RNA, 14 nt, Homo sapiens
agcugccucugcuc

SEQ ID NO: 1589693 - RNA, 16 nt, Homo sapiens
agcugccuuagcuuca

SEQ ID NO: 1589694 - RNA, 15 nt, Homo sapiens
agcugcucuccuuca

SEQ ID NO: 1589695 - RNA, 20 nt, Homo sapiens
agcugcuggaugacuugaga

SEQ ID NO: 1589696 - RNA, 16 nt, Homo sapiens
agcugcuggcuugcag

SEQ ID NO: 1589697 - RNA, 16 nt, Homo sapiens
agcugcugugccugau

SEQ ID NO: 1589698 - RNA, 14 nt, Homo sapiens
agcuggaaaaccuc

SEQ ID NO: 1589699 - RNA, 14 nt, Homo sapiens
agcuggaggcacaa

SEQ ID NO: 1589700 - RNA, 18 nt, Homo sapiens
agcuggaucgcugcacau

SEQ ID NO: 1589701 - RNA, 20 nt, Homo sapiens
agcuggaucgcugcacaugg

SEQ ID NO: 1589702 - RNA, 22 nt, Homo sapiens
agcuggccaaccccgagaacca

SEQ ID NO: 1589703 - RNA, 16 nt, Homo sapiens
agcuggcucugugagg

SEQ ID NO: 1589704 - RNA, 18 nt, Homo sapiens
agcugggacuacaggcuc

SEQ ID NO: 1589705 - RNA, 14 nt, Homo sapiens
agcugggauuacag

SEQ ID NO: 1589706 - RNA, 17 nt, Homo sapiens
agcugggauuacaggcg

SEQ ID NO: 1589707 - RNA, 16 nt, Homo sapiens
agcugggcagaccccu

SEQ ID NO: 1589708 - RNA, 14 nt, Homo sapiens
agcuggugagauca

SEQ ID NO: 1589709 - RNA, 20 nt, Homo sapiens
agcuguaacuuaacuauuaa

SEQ ID NO: 1589710 - RNA, 22 nt, Homo sapiens
agcuguaaucccagcacuuuga

SEQ ID NO: 1589711 - RNA, 20 nt, Homo sapiens
agcuguaauuucgccuuaaa

SEQ ID NO: 1589712 - RNA, 23 nt, Homo sapiens
agcuguacucuucugacugcccc

SEQ ID NO: 1589713 - RNA, 14 nt, Homo sapiens
agcuguagaguccu

SEQ ID NO: 1589714 - RNA, 18 nt, Homo sapiens
agcugucacauacaacuu

SEQ ID NO: 1589715 - RNA, 15 nt, Homo sapiens
agcugugacuucuau

SEQ ID NO: 1589716 - RNA, 17 nt, Homo sapiens
agcuguuccuguucagu

SEQ ID NO: 1589717 - RNA, 17 nt, Homo sapiens
agcuguugaucuuucac

SEQ ID NO: 1589718 - RNA, 17 nt, Homo sapiens
agcuguuuauggccuca

SEQ ID NO: 1589719 - RNA, 18 nt, Homo sapiens
agcuguuuauggccucag

SEQ ID NO: 1589720 - RNA, 16 nt, Homo sapiens
agcuuaaaacacuucu

SEQ ID NO: 1589721 - RNA, 16 nt, Homo sapiens
agcuuaaaaucuguga

SEQ ID NO: 1589722 - RNA, 17 nt, Homo sapiens
agcuuaaaaucugugaa

SEQ ID NO: 1589723 - RNA, 18 nt, Homo sapiens
agcuuaagaaccauugau

SEQ ID NO: 1589724 - RNA, 21 nt, Homo sapiens
agcuuaaggcggccuacagaa

SEQ ID NO: 1589725 - RNA, 16 nt, Homo sapiens
agcuuagcauaucuga

SEQ ID NO: 1589726 - RNA, 13 nt, Homo sapiens
agcuucaacuuuu

SEQ ID NO: 1589727 - RNA, 15 nt, Homo sapiens
agcuuccacaagaca

SEQ ID NO: 1589728 - RNA, 14 nt, Homo sapiens
agcuugaagcccaa

SEQ ID NO: 1589729 - RNA, 18 nt, Homo sapiens
agcuugacaccuggugcu

SEQ ID NO: 1589730 - RNA, 23 nt, Homo sapiens
agcuugagaaggucacuacugca

SEQ ID NO: 1589731 - RNA, 23 nt, Homo sapiens
agcuugauuaaaucaaccaccua

SEQ ID NO: 1589732 - RNA, 14 nt, Homo sapiens
agcuuggacagucu

SEQ ID NO: 1589733 - RNA, 14 nt, Homo sapiens
agcuuggagggaug

SEQ ID NO: 1589734 - RNA, 22 nt, Homo sapiens
agcuuguugucuccacuuguau

SEQ ID NO: 1589735 - RNA, 20 nt, Homo sapiens
agcuuuauuaccaguggcgu

SEQ ID NO: 1589736 - RNA, 23 nt, Homo sapiens
agcuuucaauaguggcauaccaa

SEQ ID NO: 1589737 - RNA, 21 nt, Homo sapiens
agcuuucccugccucucauca

SEQ ID NO: 1589738 - RNA, 19 nt, Homo sapiens
agcuuuccucaucaggcca

SEQ ID NO: 1589739 - RNA, 23 nt, Homo sapiens
agcuuuuuaauuaaaugaagcca

SEQ ID NO: 1589740 - RNA, 18 nt, Homo sapiens
aggaaaaaaggccacaaa

SEQ ID NO: 1589741 - RNA, 20 nt, Homo sapiens
aggaaaaacaugagcauccc

SEQ ID NO: 1589742 - RNA, 22 nt, Homo sapiens
aggaaaacacuauuuccaaaag

SEQ ID NO: 1589743 - RNA, 16 nt, Homo sapiens
aggaaaacuacugaua

SEQ ID NO: 1589744 - RNA, 19 nt, Homo sapiens
aggaaaaguuauugugaua

SEQ ID NO: 1589745 - RNA, 16 nt, Homo sapiens
aggaaaauauugauca

SEQ ID NO: 1589746 - RNA, 20 nt, Homo sapiens
aggaaaaugccaugaaaauu

SEQ ID NO: 1589747 - RNA, 19 nt, Homo sapiens
aggaaaaugcuuauugaug

SEQ ID NO: 1589748 - RNA, 15 nt, Homo sapiens
aggaaaaugugaaca

SEQ ID NO: 1589749 - RNA, 19 nt, Homo sapiens
aggaaacugagucacucac

SEQ ID NO: 1589750 - RNA, 23 nt, Homo sapiens
aggaaacuugaaaggucugagga

SEQ ID NO: 1589751 - RNA, 13 nt, Homo sapiens
aggaaagcaauaa

SEQ ID NO: 1589752 - RNA, 17 nt, Homo sapiens
aggaaauaucaaagugu

SEQ ID NO: 1589753 - RNA, 13 nt, Homo sapiens
aggaaaugugcuc

SEQ ID NO: 1589754 - RNA, 13 nt, Homo sapiens
aggaacaaagaca

SEQ ID NO: 1589755 - RNA, 18 nt, Homo sapiens
aggaacaaauaaacucau

SEQ ID NO: 1589756 - RNA, 16 nt, Homo sapiens
aggaacagcaauggug

SEQ ID NO: 1589757 - RNA, 17 nt, Homo sapiens
aggaaccaggaggacaa

SEQ ID NO: 1589758 - RNA, 15 nt, Homo sapiens
aggaacuagaaagaa

SEQ ID NO: 1589759 - RNA, 16 nt, Homo sapiens
aggaagaaaugucaga

SEQ ID NO: 1589760 - RNA, 14 nt, Homo sapiens
aggaagccagguga

SEQ ID NO: 1589761 - RNA, 15 nt, Homo sapiens
aggaaggaacagcaa

SEQ ID NO: 1589762 - RNA, 21 nt, Homo sapiens
aggaaggaacagcaauggugu

SEQ ID NO: 1589763 - RNA, 18 nt, Homo sapiens
aggaagggacacauauca

SEQ ID NO: 1589764 - RNA, 21 nt, Homo sapiens
aggaauagucgcgcaagcauc

SEQ ID NO: 1589765 - RNA, 19 nt, Homo sapiens
aggaaucaccccucugccc

SEQ ID NO: 1589766 - RNA, 18 nt, Homo sapiens
aggaaucaugucaggcca

SEQ ID NO: 1589767 - RNA, 13 nt, Homo sapiens
aggaaugacaaua

SEQ ID NO: 1589768 - RNA, 17 nt, Homo sapiens
aggaaugacuuacuuuc

SEQ ID NO: 1589769 - RNA, 17 nt, Homo sapiens
aggaaugugaaagcacg

SEQ ID NO: 1589770 - RNA, 20 nt, Homo sapiens
aggaauuggccgcugucacu

SEQ ID NO: 1589771 - RNA, 14 nt, Homo sapiens
aggaauugguuuca

SEQ ID NO: 1589772 - RNA, 19 nt, Homo sapiens
aggaauuucuuaacuucuu

SEQ ID NO: 1589773 - RNA, 17 nt, Homo sapiens
aggacaaaagggagcau

SEQ ID NO: 1589774 - RNA, 12 nt, Homo sapiens
aggacaaccaug

SEQ ID NO: 1589775 - RNA, 23 nt, Homo sapiens
aggacacagugaugaauguacua

SEQ ID NO: 1589776 - RNA, 23 nt, Homo sapiens
aggacacuacccugagaucugca

SEQ ID NO: 1589777 - RNA, 17 nt, Homo sapiens
aggacagccaccaagaa

SEQ ID NO: 1589778 - RNA, 15 nt, Homo sapiens
aggacaucaaaaaca

SEQ ID NO: 1589779 - RNA, 14 nt, Homo sapiens
aggacaucagcaaa

SEQ ID NO: 1589780 - RNA, 20 nt, Homo sapiens
aggacaugcaugacacuucc

SEQ ID NO: 1589781 - RNA, 13 nt, Homo sapiens
aggaccaccaaug

SEQ ID NO: 1589782 - RNA, 21 nt, Homo sapiens
aggaccccaucgccaucccug

SEQ ID NO: 1589783 - RNA, 19 nt, Homo sapiens
aggaccucucucaaugcca

SEQ ID NO: 1589784 - RNA, 18 nt, Homo sapiens
aggaccuuggaagagcaa

SEQ ID NO: 1589785 - RNA, 23 nt, Homo sapiens
aggacggaguggggggacagaga

SEQ ID NO: 1589786 - RNA, 23 nt, Homo sapiens
aggacggugcaacccaaggacug

SEQ ID NO: 1589787 - RNA, 14 nt, Homo sapiens
aggacuacuuucca

SEQ ID NO: 1589788 - RNA, 17 nt, Homo sapiens
aggacuagaaccuggag

SEQ ID NO: 1589789 - RNA, 19 nt, Homo sapiens
aggacucccuccucaccuc

SEQ ID NO: 1589790 - RNA, 12 nt, Homo sapiens
aggacuguagaa

SEQ ID NO: 1589791 - RNA, 19 nt, Homo sapiens
aggagaaaagaaaugcacu

SEQ ID NO: 1589792 - RNA, 19 nt, Homo sapiens
aggagaaacuggaacucuc

SEQ ID NO: 1589793 - RNA, 17 nt, Homo sapiens
aggagaaaggggcccca

SEQ ID NO: 1589794 - RNA, 21 nt, Homo sapiens
aggagaacugcuguguucuca

SEQ ID NO: 1589795 - RNA, 20 nt, Homo sapiens
aggagaagaggggucaagag

SEQ ID NO: 1589796 - RNA, 15 nt, Homo sapiens
aggagaauaugauaa

SEQ ID NO: 1589797 - RNA, 13 nt, Homo sapiens
aggagaaucacuu

SEQ ID NO: 1589798 - RNA, 16 nt, Homo sapiens
aggagacagaccacuu

SEQ ID NO: 1589799 - RNA, 15 nt, Homo sapiens
aggagacuagauugc

SEQ ID NO: 1589800 - RNA, 18 nt, Homo sapiens
auugucuuacuguugcau

SEQ ID NO: 1589801 - RNA, 21 nt, Homo sapiens
auugugaauaaaaauugauga

SEQ ID NO: 1589802 - RNA, 10 nt, Homo sapiens
auugugaugu

SEQ ID NO: 1589803 - RNA, 14 nt, Homo sapiens
auugugcacuguau

SEQ ID NO: 1589804 - RNA, 14 nt, Homo sapiens
auuguggucauuuc

SEQ ID NO: 1589805 - RNA, 17 nt, Homo sapiens
auugugugacuauucau

SEQ ID NO: 1589806 - RNA, 18 nt, Homo sapiens
auuguuaggaaaugucau

SEQ ID NO: 1589807 - RNA, 19 nt, Homo sapiens
auuguuaggagaugucauc

SEQ ID NO: 1589808 - RNA, 17 nt, Homo sapiens
auuguuaucuuuaccuc

SEQ ID NO: 1589809 - RNA, 14 nt, Homo sapiens
auuguucacuucua

SEQ ID NO: 1589810 - RNA, 16 nt, Homo sapiens
auuguugucaggccau

SEQ ID NO: 1589811 - RNA, 14 nt, Homo sapiens
auuguuuaccauag

SEQ ID NO: 1589812 - RNA, 14 nt, Homo sapiens
auuuaaaaacauuu

SEQ ID NO: 1589813 - RNA, 14 nt, Homo sapiens
auuuaaaaauaagu

SEQ ID NO: 1589814 - RNA, 18 nt, Homo sapiens
auuuaaaacaucauuacu

SEQ ID NO: 1589815 - RNA, 14 nt, Homo sapiens
auuuaaaacuugcc

SEQ ID NO: 1589816 - RNA, 21 nt, Homo sapiens
auuuaaaaugcucaauuucag

SEQ ID NO: 1589817 - RNA, 17 nt, Homo sapiens
auuuaaagaaagaaugc

SEQ ID NO: 1589818 - RNA, 20 nt, Homo sapiens
auuuaacauuaucuaguuca

SEQ ID NO: 1589819 - RNA, 16 nt, Homo sapiens
auuuaacuaaaguuaa

SEQ ID NO: 1589820 - RNA, 15 nt, Homo sapiens
auuuaacucuuugaa

SEQ ID NO: 1589821 - RNA, 17 nt, Homo sapiens
auuuaagaacugaggaa

SEQ ID NO: 1589822 - RNA, 20 nt, Homo sapiens
auuuaagaaugaaacuauaa

SEQ ID NO: 1589823 - RNA, 13 nt, Homo sapiens
auuuaagauauau

SEQ ID NO: 1589824 - RNA, 21 nt, Homo sapiens
auuuaaggccaggcauggugg

SEQ ID NO: 1589825 - RNA, 15 nt, Homo sapiens
auuuaaguccaccuc

SEQ ID NO: 1589826 - RNA, 18 nt, Homo sapiens
auuuaauuaaagccuuaa

SEQ ID NO: 1589827 - RNA, 17 nt, Homo sapiens
auuuacaacucauucca

SEQ ID NO: 1589828 - RNA, 14 nt, Homo sapiens
auuuacacagugag

SEQ ID NO: 1589829 - RNA, 14 nt, Homo sapiens
auuuacaugugauu

SEQ ID NO: 1589830 - RNA, 17 nt, Homo sapiens
auuuaccuucuaccucu

SEQ ID NO: 1589831 - RNA, 18 nt, Homo sapiens
auuuaccuucuaccucuu

SEQ ID NO: 1589832 - RNA, 14 nt, Homo sapiens
auuuacgcuuugau

SEQ ID NO: 1589833 - RNA, 12 nt, Homo sapiens
auuuacuacuua

SEQ ID NO: 1589834 - RNA, 19 nt, Homo sapiens
auuuacugacauauaucua

SEQ ID NO: 1589835 - RNA, 23 nt, Homo sapiens
auuuacuggacaaagaauuccaa

SEQ ID NO: 1589836 - RNA, 16 nt, Homo sapiens
auuuagaaaaagucaa

SEQ ID NO: 1589837 - RNA, 21 nt, Homo sapiens
auuuagcuaaacggauuccaa

SEQ ID NO: 1589838 - RNA, 15 nt, Homo sapiens
auuuaggaguauuau

SEQ ID NO: 1589839 - RNA, 22 nt, Homo sapiens
auuuaguaaauaaacaagucaa

SEQ ID NO: 1589840 - RNA, 12 nt, Homo sapiens
auuuaguaauag

SEQ ID NO: 1589841 - RNA, 22 nt, Homo sapiens
auuuagugaucaaauugugcag

SEQ ID NO: 1589842 - RNA, 14 nt, Homo sapiens
auuuaguugauaua

SEQ ID NO: 1589843 - RNA, 14 nt, Homo sapiens
auuuauacagcaga

SEQ ID NO: 1589844 - RNA, 15 nt, Homo sapiens
auuuauagcuaugaa

SEQ ID NO: 1589845 - RNA, 23 nt, Homo sapiens
auuuauaucgcuggccagcauua

SEQ ID NO: 1589846 - RNA, 13 nt, Homo sapiens
auuuaucacugaa

SEQ ID NO: 1589847 - RNA, 22 nt, Homo sapiens
auuuaugaugcacuuauucaau

SEQ ID NO: 1589848 - RNA, 21 nt, Homo sapiens
auuuaugguucucaggccuga

SEQ ID NO: 1589849 - RNA, 16 nt, Homo sapiens
auuuauuaacuaauca

SEQ ID NO: 1589850 - RNA, 16 nt, Homo sapiens
auuuauuuacauguga

SEQ ID NO: 1589851 - RNA, 15 nt, Homo sapiens
auuuauuucuagcaa

SEQ ID NO: 1589852 - RNA, 23 nt, Homo sapiens
auuuauuugcaaauauacuuuac

SEQ ID NO: 1589853 - RNA, 14 nt, Homo sapiens
auuuauuugguucc

SEQ ID NO: 1589854 - RNA, 12 nt, Homo sapiens
auuucaagacua

SEQ ID NO: 1589855 - RNA, 14 nt, Homo sapiens
auuucaagugccua

SEQ ID NO: 1589856 - RNA, 17 nt, Homo sapiens
auuucaaugaguuauug

SEQ ID NO: 1589857 - RNA, 17 nt, Homo sapiens
auuucacaucagcuuua

SEQ ID NO: 1589858 - RNA, 22 nt, Homo sapiens
auuucacuuaaacuuugucacu

SEQ ID NO: 1589859 - RNA, 15 nt, Homo sapiens
auuucagcuaguuaa

SEQ ID NO: 1589860 - RNA, 15 nt, Homo sapiens
auuucagcugaucag

SEQ ID NO: 1589861 - RNA, 17 nt, Homo sapiens
auuucaguaagcugugu

SEQ ID NO: 1589862 - RNA, 23 nt, Homo sapiens
auuucauacaacagaaaccagaa

SEQ ID NO: 1589863 - RNA, 15 nt, Homo sapiens
auuucauacuguaac

SEQ ID NO: 1589864 - RNA, 15 nt, Homo sapiens
auuucauccuugaau

SEQ ID NO: 1589865 - RNA, 14 nt, Homo sapiens
auuuccacaccaag

SEQ ID NO: 1589866 - RNA, 23 nt, Homo sapiens
auuuccaccaggccgugccuugu

SEQ ID NO: 1589867 - RNA, 23 nt, Homo sapiens
auuucccauuaaagagccaguuu

SEQ ID NO: 1589868 - RNA, 23 nt, Homo sapiens
auuuccccaccccagcucaugcc

SEQ ID NO: 1589869 - RNA, 18 nt, Homo sapiens
auuuccugauaacauuau

SEQ ID NO: 1589870 - RNA, 17 nt, Homo sapiens
auuuccuguuugaaaua

SEQ ID NO: 1589871 - RNA, 21 nt, Homo sapiens
auuuccuuuuguccacuugua

SEQ ID NO: 1589872 - RNA, 17 nt, Homo sapiens
auuucuaaaguaaaauu

SEQ ID NO: 1589873 - RNA, 14 nt, Homo sapiens
auuucuacacugag

SEQ ID NO: 1589874 - RNA, 23 nt, Homo sapiens
auuucuacuucuggaagucaucu

SEQ ID NO: 1589875 - RNA, 20 nt, Homo sapiens
auuucuagccugcacuuuga

SEQ ID NO: 1589876 - RNA, 20 nt, Homo sapiens
auuucuaguaggcagcaaaa

SEQ ID NO: 1589877 - RNA, 20 nt, Homo sapiens
auuucuaucuugaauuucau

SEQ ID NO: 1589878 - RNA, 19 nt, Homo sapiens
auuucuccuccaugggaga

SEQ ID NO: 1589879 - RNA, 19 nt, Homo sapiens
auuucuuaaaacacaugau

SEQ ID NO: 1589880 - RNA, 15 nt, Homo sapiens
auuucuuaaguauaa

SEQ ID NO: 1589881 - RNA, 11 nt, Homo sapiens
auuucuuccca

SEQ ID NO: 1589882 - RNA, 23 nt, Homo sapiens
auuucuuucuuugcaccaaagac

SEQ ID NO: 1589883 - RNA, 20 nt, Homo sapiens
auuucuuuguauguauuucu

SEQ ID NO: 1589884 - RNA, 19 nt, Homo sapiens
auuugaaugcuuaauucaa

SEQ ID NO: 1589885 - RNA, 15 nt, Homo sapiens
auuugacuccacuuu

SEQ ID NO: 1589886 - RNA, 21 nt, Homo sapiens
auuugagagaaucuacuaagu

SEQ ID NO: 1589887 - RNA, 15 nt, Homo sapiens
auuugaucacuacaa

SEQ ID NO: 1589888 - RNA, 20 nt, Homo sapiens
auuugaugggccacaacugu

SEQ ID NO: 1589889 - RNA, 21 nt, Homo sapiens
auuugcaaauauacuuuacuu

SEQ ID NO: 1589890 - RNA, 15 nt, Homo sapiens
auuugcauccagcag

SEQ ID NO: 1589891 - RNA, 17 nt, Homo sapiens
auuugcuugcaaucuaa

SEQ ID NO: 1589892 - RNA, 19 nt, Homo sapiens
auuuggagauauaccuaau

SEQ ID NO: 1589893 - RNA, 22 nt, Homo sapiens
auuugggauggaagcaggacag

SEQ ID NO: 1589894 - RNA, 14 nt, Homo sapiens
auuugggcacugua

SEQ ID NO: 1589895 - RNA, 22 nt, Homo sapiens
auuugggcuagacuaccggaca

SEQ ID NO: 1589896 - RNA, 21 nt, Homo sapiens
auuugggggaacuggacacaa

SEQ ID NO: 1589897 - RNA, 22 nt, Homo sapiens
auuugguucccuuccuauucca

SEQ ID NO: 1589898 - RNA, 16 nt, Homo sapiens
auuuguaaacauacau

SEQ ID NO: 1589899 - RNA, 22 nt, Homo sapiens
auuuguagguaauguuccugaa

SEQ ID NO: 1589900 - RNA, 21 nt, Homo sapiens
auuuguaugguuccaaagaca

SEQ ID NO: 1589901 - RNA, 15 nt, Homo sapiens
auuuguauuaugcug

SEQ ID NO: 1589902 - RNA, 18 nt, Homo sapiens
auuugucccaagugccaa

SEQ ID NO: 1589903 - RNA, 20 nt, Homo sapiens
auuugugcuagaaauuuuca

SEQ ID NO: 1589904 - RNA, 21 nt, Homo sapiens
auuuguggucacagccaugaa

SEQ ID NO: 1589905 - RNA, 20 nt, Homo sapiens
auuuguguagaaguccacag

SEQ ID NO: 1589906 - RNA, 19 nt, Homo sapiens
auuugugugaaaaugugac

SEQ ID NO: 1589907 - RNA, 23 nt, Homo sapiens
auuuguguugaaggaacuugucu

SEQ ID NO: 1589908 - RNA, 19 nt, Homo sapiens
auuuuaaaaucagcuauuu

SEQ ID NO: 1589909 - RNA, 15 nt, Homo sapiens
auuuuaaacuacuga

SEQ ID NO: 1589910 - RNA, 17 nt, Homo sapiens
auuuuaacugauuuaac

SEQ ID NO: 1589911 - RNA, 21 nt, Homo sapiens
auuuuaagauccagaaauacu

SEQ ID NO: 1589912 - RNA, 19 nt, Homo sapiens
auuuuaaggaaaguagcaa

SEQ ID NO: 1589913 - RNA, 16 nt, Homo sapiens
auuuuaaggauaugau

SEQ ID NO: 1589914 - RNA, 20 nt, Homo sapiens
auuuuaaguaucccaucuaa

SEQ ID NO: 1589915 - RNA, 23 nt, Homo sapiens
auuuuaauagggaauauaucucu

SEQ ID NO: 1589916 - RNA, 18 nt, Homo sapiens
auuuuaaugaagugcaau

SEQ ID NO: 1589917 - RNA, 13 nt, Homo sapiens
auuuuacauacac

SEQ ID NO: 1589918 - RNA, 23 nt, Homo sapiens
caccaccuggggagagccugcuu

SEQ ID NO: 1589919 - RNA, 15 nt, Homo sapiens
caccacugauaucau

SEQ ID NO: 1589920 - RNA, 21 nt, Homo sapiens
caccacuuuacuuguguuaua

SEQ ID NO: 1589921 - RNA, 22 nt, Homo sapiens
caccagagggauaaaaacaaua

SEQ ID NO: 1589922 - RNA, 22 nt, Homo sapiens
caccagauguccacaacaauau

SEQ ID NO: 1589923 - RNA, 22 nt, Homo sapiens
caccagccaggcucugugcuga

SEQ ID NO: 1589924 - RNA, 13 nt, Homo sapiens
caccagcccugaa

SEQ ID NO: 1589925 - RNA, 18 nt, Homo sapiens
caccagcccugaccccag

SEQ ID NO: 1589926 - RNA, 23 nt, Homo sapiens
caccaggaauccccaacaugcac

SEQ ID NO: 1589927 - RNA, 19 nt, Homo sapiens
caccaggcuggagugcagu

SEQ ID NO: 1589928 - RNA, 18 nt, Homo sapiens
caccagggcaacucuugg

SEQ ID NO: 1589929 - RNA, 16 nt, Homo sapiens
caccagggcaccgcag

SEQ ID NO: 1589930 - RNA, 13 nt, Homo sapiens
caccaggugucaa

SEQ ID NO: 1589931 - RNA, 15 nt, Homo sapiens
caccaguuauuccuu

SEQ ID NO: 1589932 - RNA, 16 nt, Homo sapiens
caccaucucugugauc

SEQ ID NO: 1589933 - RNA, 19 nt, Homo sapiens
caccaucucuuuaccuccu

SEQ ID NO: 1589934 - RNA, 13 nt, Homo sapiens
caccaugaucacu

SEQ ID NO: 1589935 - RNA, 20 nt, Homo sapiens
caccaugaugugaagaguuu

SEQ ID NO: 1589936 - RNA, 14 nt, Homo sapiens
caccaugcacugua

SEQ ID NO: 1589937 - RNA, 23 nt, Homo sapiens
caccaugcacuguaaauaucccu

SEQ ID NO: 1589938 - RNA, 16 nt, Homo sapiens
caccaugcuugccuga

SEQ ID NO: 1589939 - RNA, 22 nt, Homo sapiens
cacccaacugucucgaugcaau

SEQ ID NO: 1589940 - RNA, 17 nt, Homo sapiens
cacccaccuaugugcca

SEQ ID NO: 1589941 - RNA, 21 nt, Homo sapiens
cacccaccuggcuucauacag

SEQ ID NO: 1589942 - RNA, 15 nt, Homo sapiens
cacccagagcuuucc

SEQ ID NO: 1589943 - RNA, 16 nt, Homo sapiens
cacccagagcuuuccu

SEQ ID NO: 1589944 - RNA, 23 nt, Homo sapiens
cacccagcucagcauuuccacac

SEQ ID NO: 1589945 - RNA, 15 nt, Homo sapiens
cacccagugcugaau

SEQ ID NO: 1589946 - RNA, 13 nt, Homo sapiens
cacccauaucaug

SEQ ID NO: 1589947 - RNA, 16 nt, Homo sapiens
cacccaugccagagag

SEQ ID NO: 1589948 - RNA, 15 nt, Homo sapiens
caccccaacucuccc

SEQ ID NO: 1589949 - RNA, 18 nt, Homo sapiens
caccccuaccucuaguaa

SEQ ID NO: 1589950 - RNA, 18 nt, Homo sapiens
cacccgccgccucccacg

SEQ ID NO: 1589951 - RNA, 15 nt, Homo sapiens
cacccgggaacuuuu

SEQ ID NO: 1589952 - RNA, 16 nt, Homo sapiens
cacccuccauucugca

SEQ ID NO: 1589953 - RNA, 20 nt, Homo sapiens
cacccuccuggccucauaca

SEQ ID NO: 1589954 - RNA, 21 nt, Homo sapiens
cacccuccuggccucauacag

SEQ ID NO: 1589955 - RNA, 21 nt, Homo sapiens
cacccugccaagacuccucag

SEQ ID NO: 1589956 - RNA, 22 nt, Homo sapiens
cacccugcuacacauacaggau

SEQ ID NO: 1589957 - RNA, 23 nt, Homo sapiens
caccgcggaggaggcuggugaca

SEQ ID NO: 1589958 - RNA, 18 nt, Homo sapiens
caccguacaucugcaaua

SEQ ID NO: 1589959 - RNA, 22 nt, Homo sapiens
caccguacaucugcaauaugaa

SEQ ID NO: 1589960 - RNA, 17 nt, Homo sapiens
caccuacauuaucucac

SEQ ID NO: 1589961 - RNA, 23 nt, Homo sapiens
caccuaccuuagaaaacaaguau

SEQ ID NO: 1589962 - RNA, 19 nt, Homo sapiens
caccucaacuccgugcuua

SEQ ID NO: 1589963 - RNA, 18 nt, Homo sapiens
caccucaagacccccauu

SEQ ID NO: 1589964 - RNA, 20 nt, Homo sapiens
caccucccugcucagugcuu

SEQ ID NO: 1589965 - RNA, 22 nt, Homo sapiens
caccucucugagcucugcauuu

SEQ ID NO: 1589966 - RNA, 14 nt, Homo sapiens
caccucugugccca

SEQ ID NO: 1589967 - RNA, 12 nt, Homo sapiens
caccugaagggu

SEQ ID NO: 1589968 - RNA, 16 nt, Homo sapiens
caccugccacaguuca

SEQ ID NO: 1589969 - RNA, 19 nt, Homo sapiens
caccugcuccaauuucccc

SEQ ID NO: 1589970 - RNA, 14 nt, Homo sapiens
caccuggaaacugc

SEQ ID NO: 1589971 - RNA, 17 nt, Homo sapiens
caccuggcuucauacag

SEQ ID NO: 1589972 - RNA, 18 nt, Homo sapiens
caccuguaaaacuuuauu

SEQ ID NO: 1589973 - RNA, 22 nt, Homo sapiens
caccugucaacuggagugcucu

SEQ ID NO: 1589974 - RNA, 14 nt, Homo sapiens
caccuuaauaugcu

SEQ ID NO: 1589975 - RNA, 18 nt, Homo sapiens
caccuuaauaugcugcaa

SEQ ID NO: 1589976 - RNA, 13 nt, Homo sapiens
caccuuugugcag

SEQ ID NO: 1589977 - RNA, 20 nt, Homo sapiens
caccuuuuuaaauccuaaaa

SEQ ID NO: 1589978 - RNA, 13 nt, Homo sapiens
cacgaacuggccu

SEQ ID NO: 1589979 - RNA, 13 nt, Homo sapiens
cacgaacuugaaa

SEQ ID NO: 1589980 - RNA, 15 nt, Homo sapiens
cacgcagauuagcag

SEQ ID NO: 1589981 - RNA, 15 nt, Homo sapiens
cacgcauguaugcau

SEQ ID NO: 1589982 - RNA, 17 nt, Homo sapiens
cacgcccaccagccuug

SEQ ID NO: 1589983 - RNA, 13 nt, Homo sapiens
cacgcccgucucu

SEQ ID NO: 1589984 - RNA, 18 nt, Homo sapiens
cacgcuuguuugccugaa

SEQ ID NO: 1589985 - RNA, 18 nt, Homo sapiens
cacgcuuuuugaaaaagc

SEQ ID NO: 1589986 - RNA, 16 nt, Homo sapiens
cacggaagcaagcaga

SEQ ID NO: 1589987 - RNA, 16 nt, Homo sapiens
cacgguagugccugaa

SEQ ID NO: 1589988 - RNA, 16 nt, Homo sapiens
cacggucccccaggag

SEQ ID NO: 1589989 - RNA, 16 nt, Homo sapiens
cacguauguuauacaa

SEQ ID NO: 1589990 - RNA, 12 nt, Homo sapiens
cacgugaaggca

SEQ ID NO: 1589991 - RNA, 19 nt, Homo sapiens
cacgugggccucacauucc

SEQ ID NO: 1589992 - RNA, 14 nt, Homo sapiens
cacguuaccauuua

SEQ ID NO: 1589993 - RNA, 22 nt, Homo sapiens
cacguucugauuucugcccuug

SEQ ID NO: 1589994 - RNA, 21 nt, Homo sapiens
cacguugcccaagguugcaca

SEQ ID NO: 1589995 - RNA, 18 nt, Homo sapiens
cacguugugcacauguac

SEQ ID NO: 1589996 - RNA, 22 nt, Homo sapiens
cacuaacauuauauugcaauga

SEQ ID NO: 1589997 - RNA, 23 nt, Homo sapiens
cacuaacugggaggacauucugc

SEQ ID NO: 1589998 - RNA, 18 nt, Homo sapiens
cacuaaggccgugucucu

SEQ ID NO: 1589999 - RNA, 19 nt, Homo sapiens
cacuaagguggacagcaga

SEQ ID NO: 1590000 - RNA, 19 nt, Homo sapiens
cacuacugggugucauuuc

SEQ ID NO: 1590001 - RNA, 22 nt, Homo sapiens
cacuagaauauuuaaaacauca

SEQ ID NO: 1590002 - RNA, 21 nt, Homo sapiens
cacuagcaauaaaaugcuaau

SEQ ID NO: 1590003 - RNA, 15 nt, Homo sapiens
cacuagcauccacug

SEQ ID NO: 1590004 - RNA, 17 nt, Homo sapiens
cacuagucucaccagcc

SEQ ID NO: 1590005 - RNA, 15 nt, Homo sapiens
cacuauuuccaaaag

SEQ ID NO: 1590006 - RNA, 20 nt, Homo sapiens
cacuauuucccucuacugag

SEQ ID NO: 1590007 - RNA, 12 nt, Homo sapiens
cacucaagaaga

SEQ ID NO: 1590008 - RNA, 15 nt, Homo sapiens
cacucaauuucucug

SEQ ID NO: 1590009 - RNA, 23 nt, Homo sapiens
cacucacacagccaggugccuug

SEQ ID NO: 1590010 - RNA, 18 nt, Homo sapiens
cacucacuguuuauaaau

SEQ ID NO: 1590011 - RNA, 17 nt, Homo sapiens
cacucagggagcauuua

SEQ ID NO: 1590012 - RNA, 12 nt, Homo sapiens
cacucagucucu

SEQ ID NO: 1590013 - RNA, 17 nt, Homo sapiens
cacucauuccuucacuc

SEQ ID NO: 1590014 - RNA, 18 nt, Homo sapiens
cacucauuccuucacuca

SEQ ID NO: 1590015 - RNA, 14 nt, Homo sapiens
cacuccacuggccu

SEQ ID NO: 1590016 - RNA, 20 nt, Homo sapiens
cacuccgcgccgaugccacc

SEQ ID NO: 1590017 - RNA, 16 nt, Homo sapiens
cacuccgucugcucca

SEQ ID NO: 1590018 - RNA, 15 nt, Homo sapiens
cacuccuacugaguu

SEQ ID NO: 1590019 - RNA, 16 nt, Homo sapiens
cacuccuauggucaca

SEQ ID NO: 1590020 - RNA, 16 nt, Homo sapiens
cacuccuccuacugua

SEQ ID NO: 1590021 - RNA, 22 nt, Homo sapiens
cacuccuggugcaggucuccac

SEQ ID NO: 1590022 - RNA, 14 nt, Homo sapiens
cacucgacucugcu

SEQ ID NO: 1590023 - RNA, 15 nt, Homo sapiens
cacucugacaguauu

SEQ ID NO: 1590024 - RNA, 18 nt, Homo sapiens
cacucuguauugaaaaug

SEQ ID NO: 1590025 - RNA, 13 nt, Homo sapiens
cacucuguuaaua

SEQ ID NO: 1590026 - RNA, 22 nt, Homo sapiens
cacucuuuauagugcacaaaau

SEQ ID NO: 1590027 - RNA, 16 nt, Homo sapiens
cacucuuuugcuuuau

SEQ ID NO: 1590028 - RNA, 13 nt, Homo sapiens
cacugaagcacca

SEQ ID NO: 1590029 - RNA, 15 nt, Homo sapiens
cacugacaguuaaua

SEQ ID NO: 1590030 - RNA, 23 nt, Homo sapiens
cacugacuucuaaguaaaaccac

SEQ ID NO: 1590031 - RNA, 15 nt, Homo sapiens
cacugauaaucacac

SEQ ID NO: 1590032 - RNA, 18 nt, Homo sapiens
cacugcaugucagagcac

SEQ ID NO: 1590033 - RNA, 19 nt, Homo sapiens
cacugccaggccagccucc

SEQ ID NO: 1590034 - RNA, 17 nt, Homo sapiens
cacugccccacaugcau

SEQ ID NO: 1590035 - RNA, 22 nt, Homo sapiens
cacugccccacguugucccuga

SEQ ID NO: 1590036 - RNA, 14 nt, Homo sapiens
caggugauucuguu

SEQ ID NO: 1590037 - RNA, 23 nt, Homo sapiens
caggugauuuguaugcucauuga

SEQ ID NO: 1590038 - RNA, 18 nt, Homo sapiens
caggugcaaucuacugga

SEQ ID NO: 1590039 - RNA, 13 nt, Homo sapiens
caggugcaguuuc

SEQ ID NO: 1590040 - RNA, 19 nt, Homo sapiens
caggugccaguuauggcua

SEQ ID NO: 1590041 - RNA, 17 nt, Homo sapiens
caggugccuucccagac

SEQ ID NO: 1590042 - RNA, 20 nt, Homo sapiens
caggugcgcgccaccgugcc

SEQ ID NO: 1590043 - RNA, 14 nt, Homo sapiens
caggugcugacaau

SEQ ID NO: 1590044 - RNA, 15 nt, Homo sapiens
caggugcugacaaua

SEQ ID NO: 1590045 - RNA, 19 nt, Homo sapiens
cagguguaagccaccgugc

SEQ ID NO: 1590046 - RNA, 18 nt, Homo sapiens
caggugugacucuagcaa

SEQ ID NO: 1590047 - RNA, 19 nt, Homo sapiens
caggugugagccaccgugc

SEQ ID NO: 1590048 - RNA, 15 nt, Homo sapiens
cagguucccccagca

SEQ ID NO: 1590049 - RNA, 15 nt, Homo sapiens
caguaaacacuccac

SEQ ID NO: 1590050 - RNA, 16 nt, Homo sapiens
caguaaacacuccaca

SEQ ID NO: 1590051 - RNA, 19 nt, Homo sapiens
caguaaacuuucucugcaa

SEQ ID NO: 1590052 - RNA, 22 nt, Homo sapiens
caguaaagaguacacucagcca

SEQ ID NO: 1590053 - RNA, 21 nt, Homo sapiens
caguaacauuuuucucagugc

SEQ ID NO: 1590054 - RNA, 14 nt, Homo sapiens
caguacagaaggca

SEQ ID NO: 1590055 - RNA, 21 nt, Homo sapiens
caguacuguugcgccgcaguu

SEQ ID NO: 1590056 - RNA, 12 nt, Homo sapiens
caguacuuguca

SEQ ID NO: 1590057 - RNA, 16 nt, Homo sapiens
caguagagcucuacug

SEQ ID NO: 1590058 - RNA, 23 nt, Homo sapiens
caguagauugcagaaaauucugu

SEQ ID NO: 1590059 - RNA, 19 nt, Homo sapiens
caguagcaaacuuuucaca

SEQ ID NO: 1590060 - RNA, 14 nt, Homo sapiens
caguagcccagagu

SEQ ID NO: 1590061 - RNA, 16 nt, Homo sapiens
caguagcuguggugag

SEQ ID NO: 1590062 - RNA, 13 nt, Homo sapiens
caguaguugcaau

SEQ ID NO: 1590063 - RNA, 14 nt, Homo sapiens
caguaguugcaaug

SEQ ID NO: 1590064 - RNA, 22 nt, Homo sapiens
caguauaccuggcaauucacaa

SEQ ID NO: 1590065 - RNA, 14 nt, Homo sapiens
caguaugacauuuc

SEQ ID NO: 1590066 - RNA, 16 nt, Homo sapiens
caguaugcaaagcaau

SEQ ID NO: 1590067 - RNA, 16 nt, Homo sapiens
caguaugucacucugg

SEQ ID NO: 1590068 - RNA, 18 nt, Homo sapiens
caguauucugacauguaa

SEQ ID NO: 1590069 - RNA, 23 nt, Homo sapiens
caguauuuagaagccaacuauga

SEQ ID NO: 1590070 - RNA, 20 nt, Homo sapiens
caguauuuucagauuacaug

SEQ ID NO: 1590071 - RNA, 23 nt, Homo sapiens
cagucaaagauacacaaucugaa

SEQ ID NO: 1590072 - RNA, 17 nt, Homo sapiens
cagucacauuccaagcc

SEQ ID NO: 1590073 - RNA, 19 nt, Homo sapiens
cagucacugacaguuaaua

SEQ ID NO: 1590074 - RNA, 20 nt, Homo sapiens
cagucacuggcccaaccaga

SEQ ID NO: 1590075 - RNA, 23 nt, Homo sapiens
cagucacuggcccaaccagaacu

SEQ ID NO: 1590076 - RNA, 22 nt, Homo sapiens
cagucagauccuguuacuugcu

SEQ ID NO: 1590077 - RNA, 22 nt, Homo sapiens
cagucaguuugcacaacaagau

SEQ ID NO: 1590078 - RNA, 15 nt, Homo sapiens
cagucaguuuugcuc

SEQ ID NO: 1590079 - RNA, 15 nt, Homo sapiens
cagucaucaggugug

SEQ ID NO: 1590080 - RNA, 22 nt, Homo sapiens
cagucaucuagaauucacugag

SEQ ID NO: 1590081 - RNA, 19 nt, Homo sapiens
cagucauggccugagaugc

SEQ ID NO: 1590082 - RNA, 16 nt, Homo sapiens
caguccaagaccccaa

SEQ ID NO: 1590083 - RNA, 15 nt, Homo sapiens
caguccaggccucuc

SEQ ID NO: 1590084 - RNA, 13 nt, Homo sapiens
caguccauuuccu

SEQ ID NO: 1590085 - RNA, 21 nt, Homo sapiens
caguccauuuccuaauguaua

SEQ ID NO: 1590086 - RNA, 13 nt, Homo sapiens
cagucuacccaga

SEQ ID NO: 1590087 - RNA, 18 nt, Homo sapiens
cagucuaguguaauggau

SEQ ID NO: 1590088 - RNA, 15 nt, Homo sapiens
cagucucuacuguua

SEQ ID NO: 1590089 - RNA, 18 nt, Homo sapiens
cagucucugaauacacag

SEQ ID NO: 1590090 - RNA, 14 nt, Homo sapiens
cagucucuuagaau

SEQ ID NO: 1590091 - RNA, 23 nt, Homo sapiens
cagucugcucugcugcucugacc

SEQ ID NO: 1590092 - RNA, 16 nt, Homo sapiens
cagucuuccacaaaga

SEQ ID NO: 1590093 - RNA, 17 nt, Homo sapiens
cagucuuuuguccugca

SEQ ID NO: 1590094 - RNA, 19 nt, Homo sapiens
cagucuuuuuaaacuugua

SEQ ID NO: 1590095 - RNA, 11 nt, Homo sapiens
cagugaaggcu

SEQ ID NO: 1590096 - RNA, 15 nt, Homo sapiens
cagugacauaaaaag

SEQ ID NO: 1590097 - RNA, 18 nt, Homo sapiens
cagugagacacaguaauu

SEQ ID NO: 1590098 - RNA, 13 nt, Homo sapiens
cagugagcacuag

SEQ ID NO: 1590099 - RNA, 15 nt, Homo sapiens
cagugagcccugcuc

SEQ ID NO: 1590100 - RNA, 19 nt, Homo sapiens
cagugagccgagauugugc

SEQ ID NO: 1590101 - RNA, 22 nt, Homo sapiens
cagugagccgcaucuucuccau

SEQ ID NO: 1590102 - RNA, 22 nt, Homo sapiens
cagugagucgagauugcacugc

SEQ ID NO: 1590103 - RNA, 23 nt, Homo sapiens
cagugaugcugugcuaugaauuu

SEQ ID NO: 1590104 - RNA, 10 nt, Homo sapiens
cagugcaguu

SEQ ID NO: 1590105 - RNA, 11 nt, Homo sapiens
cagugcaguuu

SEQ ID NO: 1590106 - RNA, 13 nt, Homo sapiens
cagugcaguuucu

SEQ ID NO: 1590107 - RNA, 18 nt, Homo sapiens
cagugccauggauuucca

SEQ ID NO: 1590108 - RNA, 16 nt, Homo sapiens
cagugccauugucuuu

SEQ ID NO: 1590109 - RNA, 23 nt, Homo sapiens
cagugccccagggaguccagggu

SEQ ID NO: 1590110 - RNA, 15 nt, Homo sapiens
cagugccugugagca

SEQ ID NO: 1590111 - RNA, 15 nt, Homo sapiens
cagugcuaaagccug

SEQ ID NO: 1590112 - RNA, 16 nt, Homo sapiens
cagugcugaauuuccc

SEQ ID NO: 1590113 - RNA, 17 nt, Homo sapiens
cagugcugaauuucccu

SEQ ID NO: 1590114 - RNA, 14 nt, Homo sapiens
cagugcuugauaca

SEQ ID NO: 1590115 - RNA, 14 nt, Homo sapiens
caguggagacaucu

SEQ ID NO: 1590116 - RNA, 13 nt, Homo sapiens
caguggauucuca

SEQ ID NO: 1590117 - RNA, 16 nt, Homo sapiens
caguggccaggugccg

SEQ ID NO: 1590118 - RNA, 17 nt, Homo sapiens
caguggccugaucucug

SEQ ID NO: 1590119 - RNA, 16 nt, Homo sapiens
caguggcgcaugccug

SEQ ID NO: 1590120 - RNA, 23 nt, Homo sapiens
caguggcggggggguuuugccua

SEQ ID NO: 1590121 - RNA, 18 nt, Homo sapiens
caguggcgugaucucggc

SEQ ID NO: 1590122 - RNA, 15 nt, Homo sapiens
caguggcucaugccu

SEQ ID NO: 1590123 - RNA, 19 nt, Homo sapiens
caguggcuggaucugugag

SEQ ID NO: 1590124 - RNA, 14 nt, Homo sapiens
caguggugccauca

SEQ ID NO: 1590125 - RNA, 19 nt, Homo sapiens
cagugguuuagaaauuacu

SEQ ID NO: 1590126 - RNA, 19 nt, Homo sapiens
cagugguuuuauacugaag

SEQ ID NO: 1590127 - RNA, 20 nt, Homo sapiens
caguguuaaaugugaugaau

SEQ ID NO: 1590128 - RNA, 19 nt, Homo sapiens
caguguuucugugaauaga

SEQ ID NO: 1590129 - RNA, 16 nt, Homo sapiens
caguuaacuauugcau

SEQ ID NO: 1590130 - RNA, 20 nt, Homo sapiens
caguuaauaaaccuuugcaa

SEQ ID NO: 1590131 - RNA, 14 nt, Homo sapiens
caguuacuuaauga

SEQ ID NO: 1590132 - RNA, 16 nt, Homo sapiens
caguucacaugccaca

SEQ ID NO: 1590133 - RNA, 21 nt, Homo sapiens
caguucuaaaaagauguaaua

SEQ ID NO: 1590134 - RNA, 16 nt, Homo sapiens
caguucucucccuucc

SEQ ID NO: 1590135 - RNA, 17 nt, Homo sapiens
caguugaaaacuuguaa

SEQ ID NO: 1590136 - RNA, 19 nt, Homo sapiens
caguugccgucuaggauug

SEQ ID NO: 1590137 - RNA, 23 nt, Homo sapiens
caguuggcuaagaagugacucuu

SEQ ID NO: 1590138 - RNA, 17 nt, Homo sapiens
caguuguguuccugaca

SEQ ID NO: 1590139 - RNA, 22 nt, Homo sapiens
caguuguguuccugacacucaa

SEQ ID NO: 1590140 - RNA, 18 nt, Homo sapiens
caguuuaagguacacugu

SEQ ID NO: 1590141 - RNA, 16 nt, Homo sapiens
caguuuagaacagagg

SEQ ID NO: 1590142 - RNA, 16 nt, Homo sapiens
caguuuaggaguacug

SEQ ID NO: 1590143 - RNA, 24 nt, Homo sapiens
caguuugaagcccaaucugcaagg

SEQ ID NO: 1590144 - RNA, 23 nt, Homo sapiens
caguuuuauauuuauaagccuua

SEQ ID NO: 1590145 - RNA, 20 nt, Homo sapiens
caguuuuccagaacacucuu

SEQ ID NO: 1590146 - RNA, 20 nt, Homo sapiens
caguuuuguacauagcaaau

SEQ ID NO: 1590147 - RNA, 20 nt, Homo sapiens
cauaaaaauaaaucaguuca

SEQ ID NO: 1590148 - RNA, 14 nt, Homo sapiens
cauaaacaaugaug

SEQ ID NO: 1590149 - RNA, 12 nt, Homo sapiens
cauaaagugaau

SEQ ID NO: 1590150 - RNA, 14 nt, Homo sapiens
cauaaccugucuca

SEQ ID NO: 1590151 - RNA, 22 nt, Homo sapiens
cauaacggaaaaauaauugcca

SEQ ID NO: 1590152 - RNA, 20 nt, Homo sapiens
cauaacugaaaaugugcuau

SEQ ID NO: 1590153 - RNA, 16 nt, Homo sapiens
cauaagaaagcacuau

SEQ ID NO: 1590154 - RNA, 19 nt, Homo sapiens
ccaacauggcacauguaua

SEQ ID NO: 1590155 - RNA, 14 nt, Homo sapiens
ccaacccaucagaa

SEQ ID NO: 1590156 - RNA, 13 nt, Homo sapiens
ccaaccccguguc

SEQ ID NO: 1590157 - RNA, 22 nt, Homo sapiens
ccaacccgucuggcccaccagg

SEQ ID NO: 1590158 - RNA, 14 nt, Homo sapiens
ccaacccuauccca

SEQ ID NO: 1590159 - RNA, 10 nt, Homo sapiens
ccaaccucag

SEQ ID NO: 1590160 - RNA, 13 nt, Homo sapiens
ccaaccucaggcu

SEQ ID NO: 1590161 - RNA, 23 nt, Homo sapiens
ccaacgcgccucgccggaucuga

SEQ ID NO: 1590162 - RNA, 15 nt, Homo sapiens
ccaacggcaacagca

SEQ ID NO: 1590163 - RNA, 18 nt, Homo sapiens
ccaacugaaggcuaaaaa

SEQ ID NO: 1590164 - RNA, 20 nt, Homo sapiens
ccaacugcauugguuuucca

SEQ ID NO: 1590165 - RNA, 16 nt, Homo sapiens
ccaacuugauguucca

SEQ ID NO: 1590166 - RNA, 18 nt, Homo sapiens
ccaagacaugacauucuu

SEQ ID NO: 1590167 - RNA, 14 nt, Homo sapiens
ccaagcacccagag

SEQ ID NO: 1590168 - RNA, 22 nt, Homo sapiens
ccaagcaggaaaugaaaauguc

SEQ ID NO: 1590169 - RNA, 22 nt, Homo sapiens
ccaagccauguuccccaguuca

SEQ ID NO: 1590170 - RNA, 17 nt, Homo sapiens
ccaagccugauacuuua

SEQ ID NO: 1590171 - RNA, 22 nt, Homo sapiens
ccaagcuaggcuuaaaccugga

SEQ ID NO: 1590172 - RNA, 16 nt, Homo sapiens
ccaagcuccaaaucca

SEQ ID NO: 1590173 - RNA, 16 nt, Homo sapiens
ccaaggacucuuccac

SEQ ID NO: 1590174 - RNA, 19 nt, Homo sapiens
ccaaggaggaaaaacagac

SEQ ID NO: 1590175 - RNA, 21 nt, Homo sapiens
ccaaggaguuggaagugaagu

SEQ ID NO: 1590176 - RNA, 15 nt, Homo sapiens
ccaaggaugaaauca

SEQ ID NO: 1590177 - RNA, 15 nt, Homo sapiens
ccaagggaaaggggu

SEQ ID NO: 1590178 - RNA, 17 nt, Homo sapiens
ccaagggaaaggggugc

SEQ ID NO: 1590179 - RNA, 12 nt, Homo sapiens
ccaaguaaaggu

SEQ ID NO: 1590180 - RNA, 15 nt, Homo sapiens
ccaaguagcugggau

SEQ ID NO: 1590181 - RNA, 19 nt, Homo sapiens
ccaaguaguccaccuucau

SEQ ID NO: 1590182 - RNA, 14 nt, Homo sapiens
ccaauaaaacuuua

SEQ ID NO: 1590183 - RNA, 19 nt, Homo sapiens
ccaauacaaagaugacugg

SEQ ID NO: 1590184 - RNA, 18 nt, Homo sapiens
ccaauagggcugagcucu

SEQ ID NO: 1590185 - RNA, 16 nt, Homo sapiens
ccaauauaacuaucuc

SEQ ID NO: 1590186 - RNA, 16 nt, Homo sapiens
ccaauaugaaaaccgu

SEQ ID NO: 1590187 - RNA, 15 nt, Homo sapiens
ccaaucagcacucug

SEQ ID NO: 1590188 - RNA, 18 nt, Homo sapiens
ccaaucagcacucuguaa

SEQ ID NO: 1590189 - RNA, 18 nt, Homo sapiens
ccaaucagcgcucuguag

SEQ ID NO: 1590190 - RNA, 20 nt, Homo sapiens
ccaaucagcuuuuguucuag

SEQ ID NO: 1590191 - RNA, 22 nt, Homo sapiens
ccaaucuaauuaugagcuaaaa

SEQ ID NO: 1590192 - RNA, 18 nt, Homo sapiens
ccaaucucuuggugggga

SEQ ID NO: 1590193 - RNA, 12 nt, Homo sapiens
ccaaucuugccc

SEQ ID NO: 1590194 - RNA, 15 nt, Homo sapiens
ccaaugaacaucuca

SEQ ID NO: 1590195 - RNA, 15 nt, Homo sapiens
ccaaugguccugacu

SEQ ID NO: 1590196 - RNA, 15 nt, Homo sapiens
ccaaugugugaagua

SEQ ID NO: 1590197 - RNA, 22 nt, Homo sapiens
ccaauguucuaaaguuuugcaa

SEQ ID NO: 1590198 - RNA, 11 nt, Homo sapiens
ccaauguuuca

SEQ ID NO: 1590199 - RNA, 24 nt, Homo sapiens
ccaauuaauuccuguuugucuaca

SEQ ID NO: 1590200 - RNA, 20 nt, Homo sapiens
ccaauuacagggugacucac

SEQ ID NO: 1590201 - RNA, 16 nt, Homo sapiens
ccaauuacuugaagua

SEQ ID NO: 1590202 - RNA, 19 nt, Homo sapiens
ccaauucaauuacuauuga

SEQ ID NO: 1590203 - RNA, 16 nt, Homo sapiens
ccaauugcucuuucac

SEQ ID NO: 1590204 - RNA, 21 nt, Homo sapiens
ccacaaacccccaccagcaag

SEQ ID NO: 1590205 - RNA, 12 nt, Homo sapiens
ccacaaacugau

SEQ ID NO: 1590206 - RNA, 17 nt, Homo sapiens
ccacaaauaacaucuca

SEQ ID NO: 1590207 - RNA, 16 nt, Homo sapiens
ccacaagaacaauuca

SEQ ID NO: 1590208 - RNA, 22 nt, Homo sapiens
ccacaaggggauuuugcugaug

SEQ ID NO: 1590209 - RNA, 24 nt, Homo sapiens
ccacaauuauauaaaucauuucaa

SEQ ID NO: 1590210 - RNA, 19 nt, Homo sapiens
ccacaauuauuggcaaagu

SEQ ID NO: 1590211 - RNA, 14 nt, Homo sapiens
ccacacacugaguu

SEQ ID NO: 1590212 - RNA, 18 nt, Homo sapiens
ccacacccacuuugucca

SEQ ID NO: 1590213 - RNA, 13 nt, Homo sapiens
ccacacccaggaa

SEQ ID NO: 1590214 - RNA, 16 nt, Homo sapiens
ccacacccucacugcu

SEQ ID NO: 1590215 - RNA, 16 nt, Homo sapiens
ccacaccugggcauuu

SEQ ID NO: 1590216 - RNA, 19 nt, Homo sapiens
ccacacuccuauggucaca

SEQ ID NO: 1590217 - RNA, 19 nt, Homo sapiens
ccacagaaagcuccuucca

SEQ ID NO: 1590218 - RNA, 10 nt, Homo sapiens
ccacagauua

SEQ ID NO: 1590219 - RNA, 14 nt, Homo sapiens
ccacagauuaucaa

SEQ ID NO: 1590220 - RNA, 22 nt, Homo sapiens
ccacagcaucgggagcacccag

SEQ ID NO: 1590221 - RNA, 23 nt, Homo sapiens
ccacagccuucggacagacauau

SEQ ID NO: 1590222 - RNA, 14 nt, Homo sapiens
ccacaggcagucca

SEQ ID NO: 1590223 - RNA, 15 nt, Homo sapiens
ccacauauugagaug

SEQ ID NO: 1590224 - RNA, 11 nt, Homo sapiens
ccacaucccag

SEQ ID NO: 1590225 - RNA, 16 nt, Homo sapiens
ccacaucgcucuagga

SEQ ID NO: 1590226 - RNA, 23 nt, Homo sapiens
ccacaucugccuuaaaaccaaag

SEQ ID NO: 1590227 - RNA, 12 nt, Homo sapiens
ccacaugguguc

SEQ ID NO: 1590228 - RNA, 16 nt, Homo sapiens
ccacauugagacuuuc

SEQ ID NO: 1590229 - RNA, 23 nt, Homo sapiens
ccaccaagaagcacugggugacc

SEQ ID NO: 1590230 - RNA, 18 nt, Homo sapiens
ccaccaagggaucugcca

SEQ ID NO: 1590231 - RNA, 12 nt, Homo sapiens
ccaccagaugag

SEQ ID NO: 1590232 - RNA, 13 nt, Homo sapiens
ccaccagcucaaa

SEQ ID NO: 1590233 - RNA, 18 nt, Homo sapiens
ccaccaguaugacaguau

SEQ ID NO: 1590234 - RNA, 12 nt, Homo sapiens
ccaccaugacug

SEQ ID NO: 1590235 - RNA, 14 nt, Homo sapiens
ccaccaugcacugu

SEQ ID NO: 1590236 - RNA, 17 nt, Homo sapiens
ccaccaugcucucucac

SEQ ID NO: 1590237 - RNA, 19 nt, Homo sapiens
ccaccauuguucauuugug

SEQ ID NO: 1590238 - RNA, 16 nt, Homo sapiens
ccaccauuuaauuuca

SEQ ID NO: 1590239 - RNA, 14 nt, Homo sapiens
ccacccaccacagc

SEQ ID NO: 1590240 - RNA, 18 nt, Homo sapiens
ccacccaccuaugugcca

SEQ ID NO: 1590241 - RNA, 15 nt, Homo sapiens
ccacccaccuuugcc

SEQ ID NO: 1590242 - RNA, 17 nt, Homo sapiens
ccacccccgccaugcaa

SEQ ID NO: 1590243 - RNA, 17 nt, Homo sapiens
ccacccccuucagugcc

SEQ ID NO: 1590244 - RNA, 21 nt, Homo sapiens
ccaccccugaggacacccagg

SEQ ID NO: 1590245 - RNA, 17 nt, Homo sapiens
ccacccuccaugcuccu

SEQ ID NO: 1590246 - RNA, 14 nt, Homo sapiens
ccacccucuuccca

SEQ ID NO: 1590247 - RNA, 22 nt, Homo sapiens
ccaccgaaguggacuggccccu

SEQ ID NO: 1590248 - RNA, 15 nt, Homo sapiens
ccaccggaacugggc

SEQ ID NO: 1590249 - RNA, 16 nt, Homo sapiens
ccaccgugccuggcca

SEQ ID NO: 1590250 - RNA, 20 nt, Homo sapiens
ccaccuaauccuucuggcaa

SEQ ID NO: 1590251 - RNA, 19 nt, Homo sapiens
ccaccuagagcuagaugug

SEQ ID NO: 1590252 - RNA, 16 nt, Homo sapiens
ccaccuggcuucauac

SEQ ID NO: 1590253 - RNA, 16 nt, Homo sapiens
ccaccuuggaccucag

SEQ ID NO: 1590254 - RNA, 17 nt, Homo sapiens
ccacuaaaaauauuguu

SEQ ID NO: 1590255 - RNA, 21 nt, Homo sapiens
ccacucaggcauuugacugaa

SEQ ID NO: 1590256 - RNA, 18 nt, Homo sapiens
ccacucaugugacucuuu

SEQ ID NO: 1590257 - RNA, 16 nt, Homo sapiens
ccacucauugucuuug

SEQ ID NO: 1590258 - RNA, 18 nt, Homo sapiens
ccacucucugggacucuc

SEQ ID NO: 1590259 - RNA, 21 nt, Homo sapiens
ccacugagaagugcacuuuaa

SEQ ID NO: 1590260 - RNA, 16 nt, Homo sapiens
ccacugagcaagcaag

SEQ ID NO: 1590261 - RNA, 18 nt, Homo sapiens
ccacugcagaagacagua

SEQ ID NO: 1590262 - RNA, 18 nt, Homo sapiens
ccacuggggaaugcuccc

SEQ ID NO: 1590263 - RNA, 17 nt, Homo sapiens
ccacuggguuuggcaaa

SEQ ID NO: 1590264 - RNA, 14 nt, Homo sapiens
ccacuguaugagug

SEQ ID NO: 1590265 - RNA, 14 nt, Homo sapiens
ccacuguaugauuc

SEQ ID NO: 1590266 - RNA, 20 nt, Homo sapiens
ccacuguaugauucucuuaa

SEQ ID NO: 1590267 - RNA, 17 nt, Homo sapiens
ccacugucacaggcaua

SEQ ID NO: 1590268 - RNA, 16 nt, Homo sapiens
ccacugucuagagcaa

SEQ ID NO: 1590269 - RNA, 19 nt, Homo sapiens
ccacugucuagagcaacuu

SEQ ID NO: 1590270 - RNA, 14 nt, Homo sapiens
ccacugucuuucaa

SEQ ID NO: 1590271 - RNA, 18 nt, Homo sapiens
ccacugugacuuugccca

SEQ ID NO: 1590272 - RNA, 15 nt, Homo sapiens
ccacuucgcacacac

SEQ ID NO: 1590273 - RNA, 13 nt, Homo sapiens
cucuugagcauca

SEQ ID NO: 1590274 - RNA, 22 nt, Homo sapiens
cucuugagcaucaaucuuguua

SEQ ID NO: 1590275 - RNA, 17 nt, Homo sapiens
cucuugcccauccugac

SEQ ID NO: 1590276 - RNA, 21 nt, Homo sapiens
cucuuggaauuacaagcccug

SEQ ID NO: 1590277 - RNA, 12 nt, Homo sapiens
cucuuggcaguc

SEQ ID NO: 1590278 - RNA, 13 nt, Homo sapiens
cucuuuaccuccu

SEQ ID NO: 1590279 - RNA, 12 nt, Homo sapiens
cucuuucacuuc

SEQ ID NO: 1590280 - RNA, 15 nt, Homo sapiens
cucuuucuucauuca

SEQ ID NO: 1590281 - RNA, 13 nt, Homo sapiens
cucuuugacaaaa

SEQ ID NO: 1590282 - RNA, 15 nt, Homo sapiens
cucuuuguacugcuu

SEQ ID NO: 1590283 - RNA, 13 nt, Homo sapiens
cucuuuuccuggc

SEQ ID NO: 1590284 - RNA, 21 nt, Homo sapiens
cucuuuuuccaucauaauucu

SEQ ID NO: 1590285 - RNA, 22 nt, Homo sapiens
cugaaaaaaacauauccaaaau

SEQ ID NO: 1590286 - RNA, 18 nt, Homo sapiens
cugaaaauaaagugucau

SEQ ID NO: 1590287 - RNA, 13 nt, Homo sapiens
cugaaaauugcaa

SEQ ID NO: 1590288 - RNA, 21 nt, Homo sapiens
cugaaacccgcccucaggggc

SEQ ID NO: 1590289 - RNA, 18 nt, Homo sapiens
cugaaagaggaaugaagu

SEQ ID NO: 1590290 - RNA, 17 nt, Homo sapiens
cugaaagccuuagggaa

SEQ ID NO: 1590291 - RNA, 17 nt, Homo sapiens
cugaaagugguacuuga

SEQ ID NO: 1590292 - RNA, 16 nt, Homo sapiens
cugaaaucagugccua

SEQ ID NO: 1590293 - RNA, 18 nt, Homo sapiens
cugaaaugacauuucacu

SEQ ID NO: 1590294 - RNA, 22 nt, Homo sapiens
cugaaaugacauuucacuaaaa

SEQ ID NO: 1590295 - RNA, 17 nt, Homo sapiens
cugaaauguuagauuaa

SEQ ID NO: 1590296 - RNA, 23 nt, Homo sapiens
cugaaauuuaucuuuucuucuau

SEQ ID NO: 1590297 - RNA, 17 nt, Homo sapiens
cugaacccugccucuug

SEQ ID NO: 1590298 - RNA, 22 nt, Homo sapiens
cugaacuguaacuuaaauucca

SEQ ID NO: 1590299 - RNA, 21 nt, Homo sapiens
cugaagaaacuucccaagugu

SEQ ID NO: 1590300 - RNA, 22 nt, Homo sapiens
cugaagcugacagcacuacaaa

SEQ ID NO: 1590301 - RNA, 19 nt, Homo sapiens
cugaagcuucaaaaagcca

SEQ ID NO: 1590302 - RNA, 22 nt, Homo sapiens
cugaaggaaaaacacaagcaaa

SEQ ID NO: 1590303 - RNA, 21 nt, Homo sapiens
cugaaggcacagcuaaccacu

SEQ ID NO: 1590304 - RNA, 21 nt, Homo sapiens
cugaaggcauaugcacaguca

SEQ ID NO: 1590305 - RNA, 17 nt, Homo sapiens
cugaauaaaugauuaaa

SEQ ID NO: 1590306 - RNA, 13 nt, Homo sapiens
cugaaugaucuau

SEQ ID NO: 1590307 - RNA, 18 nt, Homo sapiens
cugaaugugccuaaugga

SEQ ID NO: 1590308 - RNA, 13 nt, Homo sapiens
cugaauguugcau

SEQ ID NO: 1590309 - RNA, 18 nt, Homo sapiens
cugaauuucccucucuca

SEQ ID NO: 1590310 - RNA, 20 nt, Homo sapiens
cugaauuugcaaaguacugu

SEQ ID NO: 1590311 - RNA, 22 nt, Homo sapiens
cugaauuuguaagcaacuugcu

SEQ ID NO: 1590312 - RNA, 20 nt, Homo sapiens
cugaauuuuggggauuuuca

SEQ ID NO: 1590313 - RNA, 21 nt, Homo sapiens
cugaauuuuggggauuuucaa

SEQ ID NO: 1590314 - RNA, 15 nt, Homo sapiens
cugacaaagacaucg

SEQ ID NO: 1590315 - RNA, 17 nt, Homo sapiens
cugacaaauuuuaauua

SEQ ID NO: 1590316 - RNA, 21 nt, Homo sapiens
cugacacauagaaaacaauca

SEQ ID NO: 1590317 - RNA, 17 nt, Homo sapiens
cugacauauaucuauua

SEQ ID NO: 1590318 - RNA, 16 nt, Homo sapiens
cugacauugccaaaaa

SEQ ID NO: 1590319 - RNA, 23 nt, Homo sapiens
cugaccaaacagccaacuagccc

SEQ ID NO: 1590320 - RNA, 15 nt, Homo sapiens
cugaccaauauugua

SEQ ID NO: 1590321 - RNA, 19 nt, Homo sapiens
cugaccaaugugugaagua

SEQ ID NO: 1590322 - RNA, 22 nt, Homo sapiens
cugaccccagcauuuccagagc

SEQ ID NO: 1590323 - RNA, 13 nt, Homo sapiens
cugaccccagugu

SEQ ID NO: 1590324 - RNA, 15 nt, Homo sapiens
cugacccugcuccua

SEQ ID NO: 1590325 - RNA, 15 nt, Homo sapiens
cugaccuuccagagc

SEQ ID NO: 1590326 - RNA, 15 nt, Homo sapiens
cugacuugagccacu

SEQ ID NO: 1590327 - RNA, 21 nt, Homo sapiens
cugacuuuucccauucagcug

SEQ ID NO: 1590328 - RNA, 16 nt, Homo sapiens
cugagaaauggccaaa

SEQ ID NO: 1590329 - RNA, 18 nt, Homo sapiens
cugagacccacaggucua

SEQ ID NO: 1590330 - RNA, 24 nt, Homo sapiens
cugagacccacaggucuaagagga

SEQ ID NO: 1590331 - RNA, 16 nt, Homo sapiens
cugagagacccaagga

SEQ ID NO: 1590332 - RNA, 22 nt, Homo sapiens
cugagagacccaaggaggaaaa

SEQ ID NO: 1590333 - RNA, 16 nt, Homo sapiens
cugagagcaguuacug

SEQ ID NO: 1590334 - RNA, 16 nt, Homo sapiens
cugagaucagugccua

SEQ ID NO: 1590335 - RNA, 22 nt, Homo sapiens
cugagaugaaaacuagggcuca

SEQ ID NO: 1590336 - RNA, 17 nt, Homo sapiens
cugagaugcaggugaug

SEQ ID NO: 1590337 - RNA, 18 nt, Homo sapiens
cugagaugugaacacauc

SEQ ID NO: 1590338 - RNA, 14 nt, Homo sapiens
cugagcaaggaguu

SEQ ID NO: 1590339 - RNA, 22 nt, Homo sapiens
cugagcaccagggagcaguugc

SEQ ID NO: 1590340 - RNA, 17 nt, Homo sapiens
cugagcacggacucucc

SEQ ID NO: 1590341 - RNA, 18 nt, Homo sapiens
cugagcacuccuggugca

SEQ ID NO: 1590342 - RNA, 13 nt, Homo sapiens
cugagcagcaucc

SEQ ID NO: 1590343 - RNA, 13 nt, Homo sapiens
cugagcaggauuu

SEQ ID NO: 1590344 - RNA, 23 nt, Homo sapiens
cugagcagguguucuucauuacc

SEQ ID NO: 1590345 - RNA, 13 nt, Homo sapiens
cugagcaucacua

SEQ ID NO: 1590346 - RNA, 19 nt, Homo sapiens
cugagcauccagaccugag

SEQ ID NO: 1590347 - RNA, 14 nt, Homo sapiens
cugagccacagaaa

SEQ ID NO: 1590348 - RNA, 16 nt, Homo sapiens
cugagccacagcagca

SEQ ID NO: 1590349 - RNA, 19 nt, Homo sapiens
cugagccauuugcugcauu

SEQ ID NO: 1590350 - RNA, 22 nt, Homo sapiens
cugagccuuggggaguccacag

SEQ ID NO: 1590351 - RNA, 15 nt, Homo sapiens
cugagcgacagugag

SEQ ID NO: 1590352 - RNA, 16 nt, Homo sapiens
cugagcuguccagugg

SEQ ID NO: 1590353 - RNA, 22 nt, Homo sapiens
cugaggaauuucaccuguaaac

SEQ ID NO: 1590354 - RNA, 22 nt, Homo sapiens
cugaggagccugcaacaugcca

SEQ ID NO: 1590355 - RNA, 14 nt, Homo sapiens
cugaggaugcuuuu

SEQ ID NO: 1590356 - RNA, 18 nt, Homo sapiens
cugaggcagaaggauuac

SEQ ID NO: 1590357 - RNA, 16 nt, Homo sapiens
cugaggugaaagggag

SEQ ID NO: 1590358 - RNA, 23 nt, Homo sapiens
cugaguccagcuccccccaagau

SEQ ID NO: 1590359 - RNA, 23 nt, Homo sapiens
cugaguccuuuccaggggccaau

SEQ ID NO: 1590360 - RNA, 15 nt, Homo sapiens
cugagugacggcaac

SEQ ID NO: 1590361 - RNA, 22 nt, Homo sapiens
cugagugccuacucuuugccaa

SEQ ID NO: 1590362 - RNA, 13 nt, Homo sapiens
cugaguugcacau

SEQ ID NO: 1590363 - RNA, 13 nt, Homo sapiens
cugauaaacacaa

SEQ ID NO: 1590364 - RNA, 19 nt, Homo sapiens
cugauacuuugacaguguu

SEQ ID NO: 1590365 - RNA, 18 nt, Homo sapiens
cugauagaagugcauucu

SEQ ID NO: 1590366 - RNA, 20 nt, Homo sapiens
cugauaugcaaguaagaaau

SEQ ID NO: 1590367 - RNA, 23 nt, Homo sapiens
cugauaugugaauuuguuuguga

SEQ ID NO: 1590368 - RNA, 15 nt, Homo sapiens
cugauccaggcaauc

SEQ ID NO: 1590369 - RNA, 13 nt, Homo sapiens
cugaucuauacaa

SEQ ID NO: 1590370 - RNA, 21 nt, Homo sapiens
cugaugcuggggacacagcau

SEQ ID NO: 1590371 - RNA, 17 nt, Homo sapiens
cugauggaaaaugcaaa

SEQ ID NO: 1590372 - RNA, 14 nt, Homo sapiens
cugauggauuccaa

SEQ ID NO: 1590373 - RNA, 19 nt, Homo sapiens
cugaugucuccacuuucac

SEQ ID NO: 1590374 - RNA, 13 nt, Homo sapiens
cugauuaaaccaa

SEQ ID NO: 1590375 - RNA, 22 nt, Homo sapiens
cugauuaccuccuguguggaag

SEQ ID NO: 1590376 - RNA, 14 nt, Homo sapiens
cugauuaguauuca

SEQ ID NO: 1590377 - RNA, 20 nt, Homo sapiens
cugauuccccuccaccaaac

SEQ ID NO: 1590378 - RNA, 19 nt, Homo sapiens
cugauugaucacacagugu

SEQ ID NO: 1590379 - RNA, 16 nt, Homo sapiens
cugauuggccacugga

SEQ ID NO: 1590380 - RNA, 16 nt, Homo sapiens
cugauuuaacuuguau

SEQ ID NO: 1590381 - RNA, 14 nt, Homo sapiens
cugcaaaaggaggu

SEQ ID NO: 1590382 - RNA, 12 nt, Homo sapiens
cugcaaaccuuc

SEQ ID NO: 1590383 - RNA, 17 nt, Homo sapiens
cugcaaauugccugcaa

SEQ ID NO: 1590384 - RNA, 23 nt, Homo sapiens
cugcaacaugccagccacuguga

SEQ ID NO: 1590385 - RNA, 16 nt, Homo sapiens
cugcaagcacagcaua

SEQ ID NO: 1590386 - RNA, 19 nt, Homo sapiens
cugcaauauagagacugug

SEQ ID NO: 1590387 - RNA, 18 nt, Homo sapiens
cugcaaucccagcuacuu

SEQ ID NO: 1590388 - RNA, 13 nt, Homo sapiens
cugcacacacaug

SEQ ID NO: 1590389 - RNA, 15 nt, Homo sapiens
cugcacacacaugca

SEQ ID NO: 1590390 - RNA, 21 nt, Homo sapiens
cugcacacuguccuauuauau

SEQ ID NO: 1590391 - RNA, 19 nt, Homo sapiens
cuucuuuccagaaaccaaa

SEQ ID NO: 1590392 - RNA, 15 nt, Homo sapiens
cuucuuugugccuuu

SEQ ID NO: 1590393 - RNA, 16 nt, Homo sapiens
cuugaaaagaaaacca

SEQ ID NO: 1590394 - RNA, 21 nt, Homo sapiens
cuugaaacagauucaggccag

SEQ ID NO: 1590395 - RNA, 21 nt, Homo sapiens
cuugaaaguuuucuaaacuca

SEQ ID NO: 1590396 - RNA, 17 nt, Homo sapiens
cuugaaaugaaagggaa

SEQ ID NO: 1590397 - RNA, 20 nt, Homo sapiens
cuugaaauuaagaaggcaaa

SEQ ID NO: 1590398 - RNA, 20 nt, Homo sapiens
cuugaagacaucgauauaca

SEQ ID NO: 1590399 - RNA, 12 nt, Homo sapiens
cuugaagccaaa

SEQ ID NO: 1590400 - RNA, 18 nt, Homo sapiens
cuugaauggagcugguga

SEQ ID NO: 1590401 - RNA, 18 nt, Homo sapiens
cuugaggaaaacaagcau

SEQ ID NO: 1590402 - RNA, 20 nt, Homo sapiens
cuugagucucuuuaccuaau

SEQ ID NO: 1590403 - RNA, 17 nt, Homo sapiens
cuugcaaaacagggauu

SEQ ID NO: 1590404 - RNA, 20 nt, Homo sapiens
cuugcaagggaagagccuuu

SEQ ID NO: 1590405 - RNA, 21 nt, Homo sapiens
cuugcaauaccaauguucuaa

SEQ ID NO: 1590406 - RNA, 22 nt, Homo sapiens
cuugcaauccaggcuguucuca

SEQ ID NO: 1590407 - RNA, 14 nt, Homo sapiens
cuugcacugauaaa

SEQ ID NO: 1590408 - RNA, 22 nt, Homo sapiens
cuugcagcggcuccugcaaaag

SEQ ID NO: 1590409 - RNA, 17 nt, Homo sapiens
cuugcagcuaguuuucu

SEQ ID NO: 1590410 - RNA, 14 nt, Homo sapiens
cuugcagcuguaaa

SEQ ID NO: 1590411 - RNA, 15 nt, Homo sapiens
cuugccaacuccauc

SEQ ID NO: 1590412 - RNA, 13 nt, Homo sapiens
cuugccaggcucc

SEQ ID NO: 1590413 - RNA, 17 nt, Homo sapiens
cuugcccagacuacagg

SEQ ID NO: 1590414 - RNA, 18 nt, Homo sapiens
cuugcccaguacauuuaa

SEQ ID NO: 1590415 - RNA, 16 nt, Homo sapiens
cuugcucccucuccaa

SEQ ID NO: 1590416 - RNA, 19 nt, Homo sapiens
cuugcucccucuccaagac

SEQ ID NO: 1590417 - RNA, 22 nt, Homo sapiens
cuugcucucuucaauaaaccac

SEQ ID NO: 1590418 - RNA, 18 nt, Homo sapiens
cuugcugcgagacuucag

SEQ ID NO: 1590419 - RNA, 18 nt, Homo sapiens
cuugcuuuaauaaaucac

SEQ ID NO: 1590420 - RNA, 23 nt, Homo sapiens
cuugcuuuuaucacuuaauuuga

SEQ ID NO: 1590421 - RNA, 23 nt, Homo sapiens
cuuggaauuggaauuacuguaaa

SEQ ID NO: 1590422 - RNA, 16 nt, Homo sapiens
cuuggacccaccugug

SEQ ID NO: 1590423 - RNA, 19 nt, Homo sapiens
cuuggaccucagugacuca

SEQ ID NO: 1590424 - RNA, 18 nt, Homo sapiens
cuuggaguaaaacuguau

SEQ ID NO: 1590425 - RNA, 15 nt, Homo sapiens
cuuggggaccugaac

SEQ ID NO: 1590426 - RNA, 22 nt, Homo sapiens
cuuggguauuuuaaccuguaua

SEQ ID NO: 1590427 - RNA, 14 nt, Homo sapiens
cuuggucucagugu

SEQ ID NO: 1590428 - RNA, 18 nt, Homo sapiens
cuugguguuugacuguaa

SEQ ID NO: 1590429 - RNA, 19 nt, Homo sapiens
cuugguguuugacuguaau

SEQ ID NO: 1590430 - RNA, 16 nt, Homo sapiens
cuuguaaagacugguu

SEQ ID NO: 1590431 - RNA, 19 nt, Homo sapiens
cuuguaaggcauacugccu

SEQ ID NO: 1590432 - RNA, 20 nt, Homo sapiens
cuuguaauaccugauugauc

SEQ ID NO: 1590433 - RNA, 21 nt, Homo sapiens
cuuguaguuccauguacugua

SEQ ID NO: 1590434 - RNA, 21 nt, Homo sapiens
cuugucacgccagacuuccca

SEQ ID NO: 1590435 - RNA, 15 nt, Homo sapiens
cuugugagucuucac

SEQ ID NO: 1590436 - RNA, 17 nt, Homo sapiens
cuugugagucuucacua

SEQ ID NO: 1590437 - RNA, 14 nt, Homo sapiens
cuugugcucaagga

SEQ ID NO: 1590438 - RNA, 15 nt, Homo sapiens
cuuguuacucaggaa

SEQ ID NO: 1590439 - RNA, 16 nt, Homo sapiens
cuuguuccaaugccac

SEQ ID NO: 1590440 - RNA, 15 nt, Homo sapiens
cuuguucuacugaga

SEQ ID NO: 1590441 - RNA, 14 nt, Homo sapiens
cuuguugcugcauc

SEQ ID NO: 1590442 - RNA, 16 nt, Homo sapiens
cuuguugcugcaucuc

SEQ ID NO: 1590443 - RNA, 20 nt, Homo sapiens
cuuguuugguaguuagccau

SEQ ID NO: 1590444 - RNA, 15 nt, Homo sapiens
cuuuaaaaaagcaaa

SEQ ID NO: 1590445 - RNA, 15 nt, Homo sapiens
cuuuaaaaagauauu

SEQ ID NO: 1590446 - RNA, 16 nt, Homo sapiens
cuuuaaaggcaucuac

SEQ ID NO: 1590447 - RNA, 20 nt, Homo sapiens
cuuuaaagggauggcaagau

SEQ ID NO: 1590448 - RNA, 16 nt, Homo sapiens
cuuuaaucacuuaaca

SEQ ID NO: 1590449 - RNA, 19 nt, Homo sapiens
cuuuaauuaccaguuuucc

SEQ ID NO: 1590450 - RNA, 19 nt, Homo sapiens
cuuuaccagaacgguucuu

SEQ ID NO: 1590451 - RNA, 16 nt, Homo sapiens
cuuuaccaugcucaau

SEQ ID NO: 1590452 - RNA, 15 nt, Homo sapiens
cuuuacuccguaaca

SEQ ID NO: 1590453 - RNA, 21 nt, Homo sapiens
cuuuagaaagcugacauugcc

SEQ ID NO: 1590454 - RNA, 17 nt, Homo sapiens
cuuuaguagacauuuau

SEQ ID NO: 1590455 - RNA, 21 nt, Homo sapiens
cuuuauaaauguaccagagag

SEQ ID NO: 1590456 - RNA, 15 nt, Homo sapiens
cuuuauagugcacaa

SEQ ID NO: 1590457 - RNA, 14 nt, Homo sapiens
cuuuauaucugucu

SEQ ID NO: 1590458 - RNA, 12 nt, Homo sapiens
cuuuaugagcag

SEQ ID NO: 1590459 - RNA, 22 nt, Homo sapiens
cuuuaugguccuaaaagcaaaa

SEQ ID NO: 1590460 - RNA, 21 nt, Homo sapiens
cuuuauguacaaacauguugu

SEQ ID NO: 1590461 - RNA, 14 nt, Homo sapiens
cuuucaaaagccuu

SEQ ID NO: 1590462 - RNA, 14 nt, Homo sapiens
cuuucaaccuauac

SEQ ID NO: 1590463 - RNA, 22 nt, Homo sapiens
cuuucaagugagacccaaagga

SEQ ID NO: 1590464 - RNA, 15 nt, Homo sapiens
cuuucacaagcaaca

SEQ ID NO: 1590465 - RNA, 17 nt, Homo sapiens
cuuucacccucaugaaa

SEQ ID NO: 1590466 - RNA, 14 nt, Homo sapiens
cuuucaccuuucua

SEQ ID NO: 1590467 - RNA, 14 nt, Homo sapiens
cuuucagauuaugg

SEQ ID NO: 1590468 - RNA, 19 nt, Homo sapiens
cuuucaggguuuucuaacc

SEQ ID NO: 1590469 - RNA, 14 nt, Homo sapiens
cuuuccaaaaccuu

SEQ ID NO: 1590470 - RNA, 16 nt, Homo sapiens
cuuuccaaaaccuucc

SEQ ID NO: 1590471 - RNA, 16 nt, Homo sapiens
cuuuccaagucauuuu

SEQ ID NO: 1590472 - RNA, 19 nt, Homo sapiens
cuuuccaaugccacagaca

SEQ ID NO: 1590473 - RNA, 16 nt, Homo sapiens
cuuuccagaaaccaaa

SEQ ID NO: 1590474 - RNA, 21 nt, Homo sapiens
cuuucccagucccauuccuca

SEQ ID NO: 1590475 - RNA, 14 nt, Homo sapiens
cuuuccguuucucu

SEQ ID NO: 1590476 - RNA, 13 nt, Homo sapiens
cuuuccucaaaaa

SEQ ID NO: 1590477 - RNA, 15 nt, Homo sapiens
cuuuccugaaccaug

SEQ ID NO: 1590478 - RNA, 16 nt, Homo sapiens
cuuuccugaauccaaa

SEQ ID NO: 1590479 - RNA, 17 nt, Homo sapiens
cuuuccugaauccaaac

SEQ ID NO: 1590480 - RNA, 22 nt, Homo sapiens
cuuuccugagucauggccucaa

SEQ ID NO: 1590481 - RNA, 20 nt, Homo sapiens
cuuucuaaguaggaugaauc

SEQ ID NO: 1590482 - RNA, 21 nt, Homo sapiens
cuuucucuccccuccucugaa

SEQ ID NO: 1590483 - RNA, 12 nt, Homo sapiens
cuuucucuguga

SEQ ID NO: 1590484 - RNA, 17 nt, Homo sapiens
cuuucugcacacaaaua

SEQ ID NO: 1590485 - RNA, 23 nt, Homo sapiens
cuuucuggaaguuucuggugcca

SEQ ID NO: 1590486 - RNA, 13 nt, Homo sapiens
cuuucuguugaaa

SEQ ID NO: 1590487 - RNA, 21 nt, Homo sapiens
cuuucuguuggauuccaugcu

SEQ ID NO: 1590488 - RNA, 18 nt, Homo sapiens
cuuucuuaucccagugau

SEQ ID NO: 1590489 - RNA, 13 nt, Homo sapiens
cuuucuucauuca

SEQ ID NO: 1590490 - RNA, 16 nt, Homo sapiens
cuuucuuccaaacagg

SEQ ID NO: 1590491 - RNA, 14 nt, Homo sapiens
cuuucuucccauga

SEQ ID NO: 1590492 - RNA, 19 nt, Homo sapiens
cuuucuucccguaaaaacu

SEQ ID NO: 1590493 - RNA, 18 nt, Homo sapiens
cuuucuuuagcaugcuac

SEQ ID NO: 1590494 - RNA, 18 nt, Homo sapiens
cuuucuuugcaccaaaga

SEQ ID NO: 1590495 - RNA, 16 nt, Homo sapiens
cuuugaaacuaucuca

SEQ ID NO: 1590496 - RNA, 15 nt, Homo sapiens
cuuugacacuuuuca

SEQ ID NO: 1590497 - RNA, 15 nt, Homo sapiens
cuuugacaguguuuu

SEQ ID NO: 1590498 - RNA, 19 nt, Homo sapiens
cuuugagaccauccauucu

SEQ ID NO: 1590499 - RNA, 22 nt, Homo sapiens
cuuugagaggaagggugaagcc

SEQ ID NO: 1590500 - RNA, 22 nt, Homo sapiens
cuuugagcccauucuucugggu

SEQ ID NO: 1590501 - RNA, 18 nt, Homo sapiens
cuuugaucuacuugccuc

SEQ ID NO: 1590502 - RNA, 17 nt, Homo sapiens
cuuugaucuucagggaa

SEQ ID NO: 1590503 - RNA, 20 nt, Homo sapiens
cuuugcaaaggagacuuaau

SEQ ID NO: 1590504 - RNA, 14 nt, Homo sapiens
cuuugcaauccaaa

SEQ ID NO: 1590505 - RNA, 14 nt, Homo sapiens
cuuugcaccaaaga

SEQ ID NO: 1590506 - RNA, 15 nt, Homo sapiens
cuuugcaccaaagac

SEQ ID NO: 1590507 - RNA, 20 nt, Homo sapiens
cuuugcagaccgcauaguca

SEQ ID NO: 1590508 - RNA, 17 nt, Homo sapiens
cuuugccagcagagcca

SEQ ID NO: 1590509 - RNA, 14 nt, Homo sapiens
gaauuggugauucu

SEQ ID NO: 1590510 - RNA, 11 nt, Homo sapiens
gaauuuccucu

SEQ ID NO: 1590511 - RNA, 17 nt, Homo sapiens
gaauuuccuguaauaua

SEQ ID NO: 1590512 - RNA, 16 nt, Homo sapiens
gaauuugaauacugca

SEQ ID NO: 1590513 - RNA, 13 nt, Homo sapiens
gaauuugcaaagu

SEQ ID NO: 1590514 - RNA, 15 nt, Homo sapiens
gaauuuguaagcaac

SEQ ID NO: 1590515 - RNA, 16 nt, Homo sapiens
gaauuugugugguaug

SEQ ID NO: 1590516 - RNA, 19 nt, Homo sapiens
gaauuuucuggccuuucau

SEQ ID NO: 1590517 - RNA, 16 nt, Homo sapiens
gaauuuuuaagcaaau

SEQ ID NO: 1590518 - RNA, 13 nt, Homo sapiens
gacaaaacacagc

SEQ ID NO: 1590519 - RNA, 19 nt, Homo sapiens
gacaaaauggauacauaaa

SEQ ID NO: 1590520 - RNA, 21 nt, Homo sapiens
gacaaacaauaugauuugcug

SEQ ID NO: 1590521 - RNA, 16 nt, Homo sapiens
gacaaagacauuauuu

SEQ ID NO: 1590522 - RNA, 21 nt, Homo sapiens
gacaaagacauuauuucucau

SEQ ID NO: 1590523 - RNA, 19 nt, Homo sapiens
gacaaaggccacaggcagu

SEQ ID NO: 1590524 - RNA, 20 nt, Homo sapiens
gacaaauaaauaguugcucu

SEQ ID NO: 1590525 - RNA, 13 nt, Homo sapiens
gacaacaucgcaa

SEQ ID NO: 1590526 - RNA, 17 nt, Homo sapiens
gacaaccaccagguguc

SEQ ID NO: 1590527 - RNA, 20 nt, Homo sapiens
gacaaccaccaggugucaaa

SEQ ID NO: 1590528 - RNA, 11 nt, Homo sapiens
gacaaccagac

SEQ ID NO: 1590529 - RNA, 16 nt, Homo sapiens
gacaaccucauuuuaa

SEQ ID NO: 1590530 - RNA, 16 nt, Homo sapiens
gacaaccuccauucua

SEQ ID NO: 1590531 - RNA, 19 nt, Homo sapiens
gacaagacccccagcacuu

SEQ ID NO: 1590532 - RNA, 21 nt, Homo sapiens
gacaaggagugugaccacuga

SEQ ID NO: 1590533 - RNA, 14 nt, Homo sapiens
gacaaggugcuaac

SEQ ID NO: 1590534 - RNA, 21 nt, Homo sapiens
gacaauaaacccucagagccu

SEQ ID NO: 1590535 - RNA, 21 nt, Homo sapiens
gacaauaugugccaaucaaua

SEQ ID NO: 1590536 - RNA, 13 nt, Homo sapiens
gacaaugccaaua

SEQ ID NO: 1590537 - RNA, 24 nt, Homo sapiens
gacacacuguuacacgugccugua

SEQ ID NO: 1590538 - RNA, 13 nt, Homo sapiens
gacacagaaaaug

SEQ ID NO: 1590539 - RNA, 12 nt, Homo sapiens
gacacaguauug

SEQ ID NO: 1590540 - RNA, 16 nt, Homo sapiens
gacacaguauugacuu

SEQ ID NO: 1590541 - RNA, 13 nt, Homo sapiens
gacaccaccaagg

SEQ ID NO: 1590542 - RNA, 15 nt, Homo sapiens
gacaccagccuagcc

SEQ ID NO: 1590543 - RNA, 16 nt, Homo sapiens
gacaccauuaccaaaa

SEQ ID NO: 1590544 - RNA, 17 nt, Homo sapiens
gacaccauucauuccau

SEQ ID NO: 1590545 - RNA, 16 nt, Homo sapiens
gacaccuaggcuaggg

SEQ ID NO: 1590546 - RNA, 18 nt, Homo sapiens
gacaccuggacugagcca

SEQ ID NO: 1590547 - RNA, 17 nt, Homo sapiens
gacaccuggugcuuuua

SEQ ID NO: 1590548 - RNA, 20 nt, Homo sapiens
gacaccuguacauucuucca

SEQ ID NO: 1590549 - RNA, 15 nt, Homo sapiens
gacacuaucacucau

SEQ ID NO: 1590550 - RNA, 21 nt, Homo sapiens
gacacucaaaacgcuacugag

SEQ ID NO: 1590551 - RNA, 19 nt, Homo sapiens
gacacucacagcaaggaug

SEQ ID NO: 1590552 - RNA, 14 nt, Homo sapiens
gacacuuaauacua

SEQ ID NO: 1590553 - RNA, 21 nt, Homo sapiens
gacagaaagcagaacagugau

SEQ ID NO: 1590554 - RNA, 22 nt, Homo sapiens
gacagaaccacugagucuuuug

SEQ ID NO: 1590555 - RNA, 21 nt, Homo sapiens
gacagcacagccaaccuagcu

SEQ ID NO: 1590556 - RNA, 17 nt, Homo sapiens
gacagcagaagccucca

SEQ ID NO: 1590557 - RNA, 19 nt, Homo sapiens
gacagcauauaaauguaau

SEQ ID NO: 1590558 - RNA, 14 nt, Homo sapiens
gacagccaccaaga

SEQ ID NO: 1590559 - RNA, 22 nt, Homo sapiens
gacagcccuggcaaaugccuga

SEQ ID NO: 1590560 - RNA, 18 nt, Homo sapiens
gacagcgauaagcuuuca

SEQ ID NO: 1590561 - RNA, 16 nt, Homo sapiens
gacagcugugcucuca

SEQ ID NO: 1590562 - RNA, 20 nt, Homo sapiens
gacaggaacccuugcaucca

SEQ ID NO: 1590563 - RNA, 15 nt, Homo sapiens
gacaggaauuuagaa

SEQ ID NO: 1590564 - RNA, 18 nt, Homo sapiens
gacaggagaaucaccuga

SEQ ID NO: 1590565 - RNA, 12 nt, Homo sapiens
gacaggagcacu

SEQ ID NO: 1590566 - RNA, 20 nt, Homo sapiens
gacaggagccugguccuucc

SEQ ID NO: 1590567 - RNA, 15 nt, Homo sapiens
gacaggcaaauuuca

SEQ ID NO: 1590568 - RNA, 15 nt, Homo sapiens
gacagggacaugccc

SEQ ID NO: 1590569 - RNA, 22 nt, Homo sapiens
gacaggguuucuccauguuggu

SEQ ID NO: 1590570 - RNA, 13 nt, Homo sapiens
gacaggucaguag

SEQ ID NO: 1590571 - RNA, 18 nt, Homo sapiens
gacaguccacaggggcca

SEQ ID NO: 1590572 - RNA, 12 nt, Homo sapiens
gacagucucacu

SEQ ID NO: 1590573 - RNA, 21 nt, Homo sapiens
gacauaacagugcagggcaaa

SEQ ID NO: 1590574 - RNA, 18 nt, Homo sapiens
gacauacauauuaucuca

SEQ ID NO: 1590575 - RNA, 15 nt, Homo sapiens
gacauacuuaaugca

SEQ ID NO: 1590576 - RNA, 17 nt, Homo sapiens
gacauauaucuauuaca

SEQ ID NO: 1590577 - RNA, 23 nt, Homo sapiens
gacaucaaagugguaaauacugu

SEQ ID NO: 1590578 - RNA, 15 nt, Homo sapiens
gacaucaacagauaa

SEQ ID NO: 1590579 - RNA, 13 nt, Homo sapiens
gacaucaggaaac

SEQ ID NO: 1590580 - RNA, 22 nt, Homo sapiens
gacauccgucccacaucagggc

SEQ ID NO: 1590581 - RNA, 22 nt, Homo sapiens
gacaucugcuaauauaaauggg

SEQ ID NO: 1590582 - RNA, 22 nt, Homo sapiens
gacaugacgugguaaaauguga

SEQ ID NO: 1590583 - RNA, 13 nt, Homo sapiens
gacaugcccugug

SEQ ID NO: 1590584 - RNA, 15 nt, Homo sapiens
gacaugcccugugug

SEQ ID NO: 1590585 - RNA, 21 nt, Homo sapiens
gacauuacaauguguaaugga

SEQ ID NO: 1590586 - RNA, 14 nt, Homo sapiens
gacauucacugagu

SEQ ID NO: 1590587 - RNA, 16 nt, Homo sapiens
gacauuccuucuccca

SEQ ID NO: 1590588 - RNA, 20 nt, Homo sapiens
gacauuucucaagggccaug

SEQ ID NO: 1590589 - RNA, 16 nt, Homo sapiens
gacauuuguauucuca

SEQ ID NO: 1590590 - RNA, 20 nt, Homo sapiens
gacauuuuacuauuugccaa

SEQ ID NO: 1590591 - RNA, 18 nt, Homo sapiens
gacauuuuaugucuuucu

SEQ ID NO: 1590592 - RNA, 17 nt, Homo sapiens
gaccaaccgccugcagg

SEQ ID NO: 1590593 - RNA, 15 nt, Homo sapiens
gaccaacugggccca

SEQ ID NO: 1590594 - RNA, 12 nt, Homo sapiens
gaccaagguaua

SEQ ID NO: 1590595 - RNA, 13 nt, Homo sapiens
gaccaauacuacu

SEQ ID NO: 1590596 - RNA, 19 nt, Homo sapiens
gaccaaugucuugaugcau

SEQ ID NO: 1590597 - RNA, 21 nt, Homo sapiens
gaccaauuacugcacucuuaa

SEQ ID NO: 1590598 - RNA, 12 nt, Homo sapiens
gaccacaccacu

SEQ ID NO: 1590599 - RNA, 15 nt, Homo sapiens
gaccaccuaauauca

SEQ ID NO: 1590600 - RNA, 16 nt, Homo sapiens
gaccagaaauucccuu

SEQ ID NO: 1590601 - RNA, 19 nt, Homo sapiens
gacccaaaaaaucaucuca

SEQ ID NO: 1590602 - RNA, 11 nt, Homo sapiens
gacccaauccc

SEQ ID NO: 1590603 - RNA, 20 nt, Homo sapiens
gacccaggccuggccaguca

SEQ ID NO: 1590604 - RNA, 22 nt, Homo sapiens
gaccccaaaucaccacaaagga

SEQ ID NO: 1590605 - RNA, 23 nt, Homo sapiens
gaccccagguucagugcggcccc

SEQ ID NO: 1590606 - RNA, 12 nt, Homo sapiens
gaccccauacau

SEQ ID NO: 1590607 - RNA, 14 nt, Homo sapiens
gacccccagcacuu

SEQ ID NO: 1590608 - RNA, 16 nt, Homo sapiens
gacccugaacucagaa

SEQ ID NO: 1590609 - RNA, 17 nt, Homo sapiens
gacccugagaaggcaaa

SEQ ID NO: 1590610 - RNA, 15 nt, Homo sapiens
gacccugaggcccug

SEQ ID NO: 1590611 - RNA, 16 nt, Homo sapiens
gacccugcaagaccac

SEQ ID NO: 1590612 - RNA, 24 nt, Homo sapiens
gacccuuguggguccaugcuaaca

SEQ ID NO: 1590613 - RNA, 20 nt, Homo sapiens
gaccgcaggagggcagauuc

SEQ ID NO: 1590614 - RNA, 22 nt, Homo sapiens
gaccuaaauuauuuacugcaaa

SEQ ID NO: 1590615 - RNA, 13 nt, Homo sapiens
gaccucuugccuc

SEQ ID NO: 1590616 - RNA, 15 nt, Homo sapiens
gaccugccagccggu

SEQ ID NO: 1590617 - RNA, 16 nt, Homo sapiens
gaccuguguuucacuu

SEQ ID NO: 1590618 - RNA, 17 nt, Homo sapiens
gaccuuagcguucugga

SEQ ID NO: 1590619 - RNA, 23 nt, Homo sapiens
gaccuuaucaggauaccagagga

SEQ ID NO: 1590620 - RNA, 22 nt, Homo sapiens
gaccuuggaaacaguuggcacu

SEQ ID NO: 1590621 - RNA, 22 nt, Homo sapiens
gaccuuucuagacaucauuguc

SEQ ID NO: 1590622 - RNA, 21 nt, Homo sapiens
gaccuuuuuuaggaagcaagc

SEQ ID NO: 1590623 - RNA, 22 nt, Homo sapiens
gaccuuuuuuaggaagcaagcu

SEQ ID NO: 1590624 - RNA, 15 nt, Homo sapiens
gacgaggcucaaaaa

SEQ ID NO: 1590625 - RNA, 16 nt, Homo sapiens
gacgaguaacuccccu

SEQ ID NO: 1590626 - RNA, 15 nt, Homo sapiens
gacggauacugggga

SEQ ID NO: 1590627 - RNA, 20 nt, Homo sapiens
gcaaugcauuugauggccac

SEQ ID NO: 1590628 - RNA, 17 nt, Homo sapiens
gcaauggacaaggaagg

SEQ ID NO: 1590629 - RNA, 23 nt, Homo sapiens
gcaauggugucaguauccaggcu

SEQ ID NO: 1590630 - RNA, 15 nt, Homo sapiens
gcaaugugacuuaau

SEQ ID NO: 1590631 - RNA, 17 nt, Homo sapiens
gcaauuuuacugugaaa

SEQ ID NO: 1590632 - RNA, 16 nt, Homo sapiens
gcaauuuugcacugaa

SEQ ID NO: 1590633 - RNA, 21 nt, Homo sapiens
gcacaaaagcagauacuugag

SEQ ID NO: 1590634 - RNA, 14 nt, Homo sapiens
gcacaaacaauaug

SEQ ID NO: 1590635 - RNA, 17 nt, Homo sapiens
gcacaaccuuuuccuca

SEQ ID NO: 1590636 - RNA, 18 nt, Homo sapiens
gcacaacgcaccagacac

SEQ ID NO: 1590637 - RNA, 13 nt, Homo sapiens
gcacaacucccuu

SEQ ID NO: 1590638 - RNA, 14 nt, Homo sapiens
gcacacacaugcau

SEQ ID NO: 1590639 - RNA, 14 nt, Homo sapiens
gcacacacugugcu

SEQ ID NO: 1590640 - RNA, 13 nt, Homo sapiens
gcacaccagagac

SEQ ID NO: 1590641 - RNA, 16 nt, Homo sapiens
gcacaccagagacaag

SEQ ID NO: 1590642 - RNA, 17 nt, Homo sapiens
gcacacccuccagagac

SEQ ID NO: 1590643 - RNA, 17 nt, Homo sapiens
gcacacgaguuccagac

SEQ ID NO: 1590644 - RNA, 22 nt, Homo sapiens
gcacacgucuggccuacagaau

SEQ ID NO: 1590645 - RNA, 12 nt, Homo sapiens
gcacacuggaau

SEQ ID NO: 1590646 - RNA, 11 nt, Homo sapiens
gcacagccacc

SEQ ID NO: 1590647 - RNA, 21 nt, Homo sapiens
gcacaggaguguccucuuccc

SEQ ID NO: 1590648 - RNA, 21 nt, Homo sapiens
gcacauauccaggcaccagga

SEQ ID NO: 1590649 - RNA, 22 nt, Homo sapiens
gcacauauccaggcaccaggac

SEQ ID NO: 1590650 - RNA, 15 nt, Homo sapiens
gcacaucaauuacaa

SEQ ID NO: 1590651 - RNA, 14 nt, Homo sapiens
gcacaucaguacuu

SEQ ID NO: 1590652 - RNA, 19 nt, Homo sapiens
gcacaucuacaugccaugc

SEQ ID NO: 1590653 - RNA, 17 nt, Homo sapiens
gcacaugugauguggug

SEQ ID NO: 1590654 - RNA, 19 nt, Homo sapiens
gcacauucgggccauuucc

SEQ ID NO: 1590655 - RNA, 20 nt, Homo sapiens
gcacauucgggccauuuccg

SEQ ID NO: 1590656 - RNA, 10 nt, Homo sapiens
gcaccaaaga

SEQ ID NO: 1590657 - RNA, 21 nt, Homo sapiens
gcaccacacuagggacuauca

SEQ ID NO: 1590658 - RNA, 13 nt, Homo sapiens
gcaccagccaccc

SEQ ID NO: 1590659 - RNA, 21 nt, Homo sapiens
gcaccaggcacgaacccaccu

SEQ ID NO: 1590660 - RNA, 22 nt, Homo sapiens
gcaccaucauuuaaugugacag

SEQ ID NO: 1590661 - RNA, 12 nt, Homo sapiens
gcacccauucca

SEQ ID NO: 1590662 - RNA, 18 nt, Homo sapiens
gcacccauuucaaugugu

SEQ ID NO: 1590663 - RNA, 18 nt, Homo sapiens
gcaccccacacuggagcc

SEQ ID NO: 1590664 - RNA, 20 nt, Homo sapiens
gcaccucggggacaccagag

SEQ ID NO: 1590665 - RNA, 18 nt, Homo sapiens
gcaccugucaacuggagu

SEQ ID NO: 1590666 - RNA, 22 nt, Homo sapiens
gcacguguggccuguucuucua

SEQ ID NO: 1590667 - RNA, 20 nt, Homo sapiens
gcacuaugguuuguugccua

SEQ ID NO: 1590668 - RNA, 20 nt, Homo sapiens
gcacuauuauaagugcuuca

SEQ ID NO: 1590669 - RNA, 20 nt, Homo sapiens
gcacucagaaaauggcacuu

SEQ ID NO: 1590670 - RNA, 19 nt, Homo sapiens
gcacucagaaguugugcua

SEQ ID NO: 1590671 - RNA, 18 nt, Homo sapiens
gcacuccccguguucaua

SEQ ID NO: 1590672 - RNA, 18 nt, Homo sapiens
gcacucuguaaaaugcac

SEQ ID NO: 1590673 - RNA, 16 nt, Homo sapiens
gcacugcacccuguuu

SEQ ID NO: 1590674 - RNA, 21 nt, Homo sapiens
gcacuuuccaaugccacagac

SEQ ID NO: 1590675 - RNA, 16 nt, Homo sapiens
gcagaaaaucuaccaa

SEQ ID NO: 1590676 - RNA, 19 nt, Homo sapiens
gcagaacauacuguucuca

SEQ ID NO: 1590677 - RNA, 19 nt, Homo sapiens
gcagaacugaaaaauuacu

SEQ ID NO: 1590678 - RNA, 14 nt, Homo sapiens
gcagaagacaguau

SEQ ID NO: 1590679 - RNA, 21 nt, Homo sapiens
gcagaauucaaaagugauuau

SEQ ID NO: 1590680 - RNA, 17 nt, Homo sapiens
gcagacaauaaacccuc

SEQ ID NO: 1590681 - RNA, 16 nt, Homo sapiens
gcagacacagguguag

SEQ ID NO: 1590682 - RNA, 18 nt, Homo sapiens
gcagacaccauucauucc

SEQ ID NO: 1590683 - RNA, 15 nt, Homo sapiens
gcagaccagcacuuc

SEQ ID NO: 1590684 - RNA, 16 nt, Homo sapiens
gcagaccagcacuuca

SEQ ID NO: 1590685 - RNA, 21 nt, Homo sapiens
gcagaccagcacuucaaccua

SEQ ID NO: 1590686 - RNA, 13 nt, Homo sapiens
gcagaccccaggu

SEQ ID NO: 1590687 - RNA, 20 nt, Homo sapiens
gcagagaaccaaaggggcca

SEQ ID NO: 1590688 - RNA, 15 nt, Homo sapiens
gcagagacugaaaau

SEQ ID NO: 1590689 - RNA, 20 nt, Homo sapiens
gcagagccagggcagggcga

SEQ ID NO: 1590690 - RNA, 22 nt, Homo sapiens
gcagagccuacagaagggcagu

SEQ ID NO: 1590691 - RNA, 23 nt, Homo sapiens
gcagagcggguaaagugcaaugg

SEQ ID NO: 1590692 - RNA, 20 nt, Homo sapiens
gcagaggcuaauucaguguc

SEQ ID NO: 1590693 - RNA, 16 nt, Homo sapiens
gcagaguaacaggauc

SEQ ID NO: 1590694 - RNA, 21 nt, Homo sapiens
gcagaucuacaugucuagaga

SEQ ID NO: 1590695 - RNA, 18 nt, Homo sapiens
gcagaugaacuaauuuca

SEQ ID NO: 1590696 - RNA, 22 nt, Homo sapiens
gcagauucugagcaaaggcccu

SEQ ID NO: 1590697 - RNA, 15 nt, Homo sapiens
gcagcaaauuuucag

SEQ ID NO: 1590698 - RNA, 14 nt, Homo sapiens
gcagcaacucccac

SEQ ID NO: 1590699 - RNA, 21 nt, Homo sapiens
gcagcacagucacccauggaa

SEQ ID NO: 1590700 - RNA, 18 nt, Homo sapiens
gcagcaccaaccacagca

SEQ ID NO: 1590701 - RNA, 22 nt, Homo sapiens
gcagcacuccgcaucaccucac

SEQ ID NO: 1590702 - RNA, 13 nt, Homo sapiens
gcagcauggagcu

SEQ ID NO: 1590703 - RNA, 17 nt, Homo sapiens
gcagccacgucucaaca

SEQ ID NO: 1590704 - RNA, 14 nt, Homo sapiens
gcagccagacccac

SEQ ID NO: 1590705 - RNA, 14 nt, Homo sapiens
gcagccuccagggc

SEQ ID NO: 1590706 - RNA, 18 nt, Homo sapiens
gcagcuacaagugcagcu

SEQ ID NO: 1590707 - RNA, 13 nt, Homo sapiens
gcagcuacuggaa

SEQ ID NO: 1590708 - RNA, 15 nt, Homo sapiens
gcagcuagugccuuu

SEQ ID NO: 1590709 - RNA, 20 nt, Homo sapiens
gcagcucccuuucucaggag

SEQ ID NO: 1590710 - RNA, 20 nt, Homo sapiens
gcagcugagccugagccaau

SEQ ID NO: 1590711 - RNA, 13 nt, Homo sapiens
gcagcugauucca

SEQ ID NO: 1590712 - RNA, 20 nt, Homo sapiens
gcagcugauuccagaacaaa

SEQ ID NO: 1590713 - RNA, 17 nt, Homo sapiens
gcagcugcugugccuga

SEQ ID NO: 1590714 - RNA, 17 nt, Homo sapiens
gcagcugugaccccggg

SEQ ID NO: 1590715 - RNA, 20 nt, Homo sapiens
gcagcuuagacuaaggccau

SEQ ID NO: 1590716 - RNA, 22 nt, Homo sapiens
gcagcuucacccaccaggccag

SEQ ID NO: 1590717 - RNA, 16 nt, Homo sapiens
gcaggaagugguggca

SEQ ID NO: 1590718 - RNA, 15 nt, Homo sapiens
gcaggacagcuccug

SEQ ID NO: 1590719 - RNA, 16 nt, Homo sapiens
gcaggaggaucacuuu

SEQ ID NO: 1590720 - RNA, 22 nt, Homo sapiens
gcaggaucugucugugcacaug

SEQ ID NO: 1590721 - RNA, 18 nt, Homo sapiens
gcaggcccccaggugcca

SEQ ID NO: 1590722 - RNA, 14 nt, Homo sapiens
gcaggcugggccau

SEQ ID NO: 1590723 - RNA, 15 nt, Homo sapiens
gcaggcugguuugca

SEQ ID NO: 1590724 - RNA, 14 nt, Homo sapiens
gcagggacuugaac

SEQ ID NO: 1590725 - RNA, 15 nt, Homo sapiens
gcagggcgagcugca

SEQ ID NO: 1590726 - RNA, 21 nt, Homo sapiens
gcagggcgugaggaacucucc

SEQ ID NO: 1590727 - RNA, 20 nt, Homo sapiens
gcaggggaauucccuccccc

SEQ ID NO: 1590728 - RNA, 18 nt, Homo sapiens
gcaggucaaaaaggccaa

SEQ ID NO: 1590729 - RNA, 19 nt, Homo sapiens
gcagguguucuucauuacc

SEQ ID NO: 1590730 - RNA, 14 nt, Homo sapiens
gcaguauagacaau

SEQ ID NO: 1590731 - RNA, 13 nt, Homo sapiens
gcagucacuggag

SEQ ID NO: 1590732 - RNA, 22 nt, Homo sapiens
gcagucagggugggaagaaaga

SEQ ID NO: 1590733 - RNA, 23 nt, Homo sapiens
gcaguccaggccucucucugcuc

SEQ ID NO: 1590734 - RNA, 15 nt, Homo sapiens
gcaguccauuuccua

SEQ ID NO: 1590735 - RNA, 17 nt, Homo sapiens
gcagugcuaaagccugu

SEQ ID NO: 1590736 - RNA, 17 nt, Homo sapiens
gcaguggugccaucacc

SEQ ID NO: 1590737 - RNA, 22 nt, Homo sapiens
gcaguguguacuucuucaucca

SEQ ID NO: 1590738 - RNA, 21 nt, Homo sapiens
gcaguguuacaaaauguucag

SEQ ID NO: 1590739 - RNA, 23 nt, Homo sapiens
gcaguucugaguguuuaauuuca

SEQ ID NO: 1590740 - RNA, 19 nt, Homo sapiens
gcaguugaaaagacuccaa

SEQ ID NO: 1590741 - RNA, 18 nt, Homo sapiens
gcaguuucaaguaccaaa

SEQ ID NO: 1590742 - RNA, 19 nt, Homo sapiens
gcaguuucaaguaccaaaa

SEQ ID NO: 1590743 - RNA, 23 nt, Homo sapiens
gcauaaaauggaauaacauauca

SEQ ID NO: 1590744 - RNA, 22 nt, Homo sapiens
gcauaaauccauccauccaaag

SEQ ID NO: 1590745 - RNA, 21 nt, Homo sapiens
guggcagguggaggugucagg

SEQ ID NO: 1590746 - RNA, 22 nt, Homo sapiens
guggccaccaguaugacaguau

SEQ ID NO: 1590747 - RNA, 22 nt, Homo sapiens
guggcucaugccuguaauccca

SEQ ID NO: 1590748 - RNA, 17 nt, Homo sapiens
gugggcacugugccaag

SEQ ID NO: 1590749 - RNA, 21 nt, Homo sapiens
gugggcccccaaugacaccca

SEQ ID NO: 1590750 - RNA, 21 nt, Homo sapiens
gugggcucugugcagucacug

SEQ ID NO: 1590751 - RNA, 15 nt, Homo sapiens
gugggcugugccaag

SEQ ID NO: 1590752 - RNA, 17 nt, Homo sapiens
guggggcucaaaaccuc

SEQ ID NO: 1590753 - RNA, 20 nt, Homo sapiens
guggggggugacagugccuu

SEQ ID NO: 1590754 - RNA, 22 nt, Homo sapiens
gugggugccuuccauacuguuu

SEQ ID NO: 1590755 - RNA, 19 nt, Homo sapiens
gugggugcugccaugacag

SEQ ID NO: 1590756 - RNA, 17 nt, Homo sapiens
gugggugugugugggca

SEQ ID NO: 1590757 - RNA, 16 nt, Homo sapiens
gugguaaauacuguga

SEQ ID NO: 1590758 - RNA, 17 nt, Homo sapiens
gugguaagguguguacu

SEQ ID NO: 1590759 - RNA, 14 nt, Homo sapiens
guggugacaccucc

SEQ ID NO: 1590760 - RNA, 17 nt, Homo sapiens
guggugacaccuccccc

SEQ ID NO: 1590761 - RNA, 11 nt, Homo sapiens
guggugccugc

SEQ ID NO: 1590762 - RNA, 15 nt, Homo sapiens
guggugcgugugaau

SEQ ID NO: 1590763 - RNA, 19 nt, Homo sapiens
gugguuuaucagcaaaaaa

SEQ ID NO: 1590764 - RNA, 18 nt, Homo sapiens
guguaaaauuaauguaau

SEQ ID NO: 1590765 - RNA, 14 nt, Homo sapiens
guguagccaugccu

SEQ ID NO: 1590766 - RNA, 13 nt, Homo sapiens
guguauccaugca

SEQ ID NO: 1590767 - RNA, 22 nt, Homo sapiens
guguauccaugcaccuaccuua

SEQ ID NO: 1590768 - RNA, 17 nt, Homo sapiens
guguaucucagcauuuu

SEQ ID NO: 1590769 - RNA, 18 nt, Homo sapiens
gugucaaauaaacacugu

SEQ ID NO: 1590770 - RNA, 15 nt, Homo sapiens
gugucacagcuuugu

SEQ ID NO: 1590771 - RNA, 13 nt, Homo sapiens
gugucacccuuag

SEQ ID NO: 1590772 - RNA, 14 nt, Homo sapiens
gugucauacugugc

SEQ ID NO: 1590773 - RNA, 18 nt, Homo sapiens
gugucauuggaagccauc

SEQ ID NO: 1590774 - RNA, 16 nt, Homo sapiens
gugucuucccugccug

SEQ ID NO: 1590775 - RNA, 13 nt, Homo sapiens
gugucuucugccc

SEQ ID NO: 1590776 - RNA, 21 nt, Homo sapiens
gugugaacucaccaaacacaa

SEQ ID NO: 1590777 - RNA, 21 nt, Homo sapiens
gugugacuuugggcaagccaa

SEQ ID NO: 1590778 - RNA, 23 nt, Homo sapiens
gugugauguuuggauugauaucg

SEQ ID NO: 1590779 - RNA, 19 nt, Homo sapiens
gugugcgugugcgugcgug

SEQ ID NO: 1590780 - RNA, 14 nt, Homo sapiens
guguggagcacgug

SEQ ID NO: 1590781 - RNA, 15 nt, Homo sapiens
guguggagcacgugg

SEQ ID NO: 1590782 - RNA, 19 nt, Homo sapiens
guguguaaaauuaauguaa

SEQ ID NO: 1590783 - RNA, 21 nt, Homo sapiens
gugugugcacaucuacaugcc

SEQ ID NO: 1590784 - RNA, 19 nt, Homo sapiens
gugugugggaguguguaau

SEQ ID NO: 1590785 - RNA, 15 nt, Homo sapiens
gugugugugugugca

SEQ ID NO: 1590786 - RNA, 17 nt, Homo sapiens
guguguucuauccaaac

SEQ ID NO: 1590787 - RNA, 19 nt, Homo sapiens
guguuaggacagcauauaa

SEQ ID NO: 1590788 - RNA, 18 nt, Homo sapiens
guguucacaacagugaaa

SEQ ID NO: 1590789 - RNA, 14 nt, Homo sapiens
guguucacccgugg

SEQ ID NO: 1590790 - RNA, 15 nt, Homo sapiens
guguucaugaucucc

SEQ ID NO: 1590791 - RNA, 16 nt, Homo sapiens
guguugaagcacuguu

SEQ ID NO: 1590792 - RNA, 21 nt, Homo sapiens
guguugaugacucacucauaa

SEQ ID NO: 1590793 - RNA, 15 nt, Homo sapiens
guguugauuguauaa

SEQ ID NO: 1590794 - RNA, 18 nt, Homo sapiens
guguugccaaaaccaaac

SEQ ID NO: 1590795 - RNA, 21 nt, Homo sapiens
guguuuaccuggugcucucaa

SEQ ID NO: 1590796 - RNA, 12 nt, Homo sapiens
guguuuugccau

SEQ ID NO: 1590797 - RNA, 24 nt, Homo sapiens
guuaaagggcauuuuacuaaggca

SEQ ID NO: 1590798 - RNA, 15 nt, Homo sapiens
guuaagaaagcacuu

SEQ ID NO: 1590799 - RNA, 13 nt, Homo sapiens
guuaagcauggau

SEQ ID NO: 1590800 - RNA, 17 nt, Homo sapiens
guuaauaaaccuuugca

SEQ ID NO: 1590801 - RNA, 14 nt, Homo sapiens
guuaauauacccca

SEQ ID NO: 1590802 - RNA, 15 nt, Homo sapiens
guuaauggucaaugc

SEQ ID NO: 1590803 - RNA, 18 nt, Homo sapiens
guuaauuacaacugcuau

SEQ ID NO: 1590804 - RNA, 18 nt, Homo sapiens
guuacaaaauacaaaagu

SEQ ID NO: 1590805 - RNA, 21 nt, Homo sapiens
guuaccugaaaacacugugca

SEQ ID NO: 1590806 - RNA, 13 nt, Homo sapiens
guuaccuuuucau

SEQ ID NO: 1590807 - RNA, 19 nt, Homo sapiens
guuacugcuugaccaaaga

SEQ ID NO: 1590808 - RNA, 16 nt, Homo sapiens
guuacuggaugcagca

SEQ ID NO: 1590809 - RNA, 18 nt, Homo sapiens
guuacuggggucacccaa

SEQ ID NO: 1590810 - RNA, 16 nt, Homo sapiens
guuagaacuagccaaa

SEQ ID NO: 1590811 - RNA, 16 nt, Homo sapiens
guuagacuugcucccu

SEQ ID NO: 1590812 - RNA, 20 nt, Homo sapiens
guuagcacuaggcacccagc

SEQ ID NO: 1590813 - RNA, 13 nt, Homo sapiens
guuagcugucaca

SEQ ID NO: 1590814 - RNA, 19 nt, Homo sapiens
guuauaacucugcacuacu

SEQ ID NO: 1590815 - RNA, 23 nt, Homo sapiens
guuauccaacuauuaagauaucu

SEQ ID NO: 1590816 - RNA, 14 nt, Homo sapiens
guucaaagagguga

SEQ ID NO: 1590817 - RNA, 20 nt, Homo sapiens
guucaacuuggugacacucu

SEQ ID NO: 1590818 - RNA, 22 nt, Homo sapiens
guucaagaaguaaucaguaugc

SEQ ID NO: 1590819 - RNA, 22 nt, Homo sapiens
guucaagcgauucuccugccuc

SEQ ID NO: 1590820 - RNA, 19 nt, Homo sapiens
guucaaguccgacaacacc

SEQ ID NO: 1590821 - RNA, 21 nt, Homo sapiens
guucaccuccaagcauuucau

SEQ ID NO: 1590822 - RNA, 14 nt, Homo sapiens
guucaccugaauca

SEQ ID NO: 1590823 - RNA, 18 nt, Homo sapiens
guucagaaaagaagugaa

SEQ ID NO: 1590824 - RNA, 20 nt, Homo sapiens
guucagaaaagaagugaagu

SEQ ID NO: 1590825 - RNA, 20 nt, Homo sapiens
guucagauguuucaucaaug

SEQ ID NO: 1590826 - RNA, 17 nt, Homo sapiens
guucagcauucuuagcc

SEQ ID NO: 1590827 - RNA, 18 nt, Homo sapiens
guucaggaaaacuacuga

SEQ ID NO: 1590828 - RNA, 18 nt, Homo sapiens
guucaguuccacuaucua

SEQ ID NO: 1590829 - RNA, 20 nt, Homo sapiens
guucauauuuauacuuugca

SEQ ID NO: 1590830 - RNA, 23 nt, Homo sapiens
guucauggauauguuauacugaa

SEQ ID NO: 1590831 - RNA, 21 nt, Homo sapiens
guucauggauuacuucucuau

SEQ ID NO: 1590832 - RNA, 15 nt, Homo sapiens
guuccagaccagccu

SEQ ID NO: 1590833 - RNA, 15 nt, Homo sapiens
guuccaggcccucca

SEQ ID NO: 1590834 - RNA, 20 nt, Homo sapiens
guucccaagcgucaucugug

SEQ ID NO: 1590835 - RNA, 14 nt, Homo sapiens
guucccaggugaua

SEQ ID NO: 1590836 - RNA, 20 nt, Homo sapiens
guucccauuuuugcuuagcu

SEQ ID NO: 1590837 - RNA, 21 nt, Homo sapiens
guuccccaguagagcucuacu

SEQ ID NO: 1590838 - RNA, 15 nt, Homo sapiens
guucccccagcaagc

SEQ ID NO: 1590839 - RNA, 13 nt, Homo sapiens
guuccccucugcu

SEQ ID NO: 1590840 - RNA, 19 nt, Homo sapiens
guucccuuccuauuccaag

SEQ ID NO: 1590841 - RNA, 16 nt, Homo sapiens
guucccuuggccucag

SEQ ID NO: 1590842 - RNA, 13 nt, Homo sapiens
guuccuccacugg

SEQ ID NO: 1590843 - RNA, 18 nt, Homo sapiens
guuccucuuggugucaua

SEQ ID NO: 1590844 - RNA, 16 nt, Homo sapiens
guuccuuacugcagaa

SEQ ID NO: 1590845 - RNA, 15 nt, Homo sapiens
guuccuuucuuuucc

SEQ ID NO: 1590846 - RNA, 21 nt, Homo sapiens
guucgauugaaauuuugcacc

SEQ ID NO: 1590847 - RNA, 13 nt, Homo sapiens
guucgcuuaucaa

SEQ ID NO: 1590848 - RNA, 22 nt, Homo sapiens
guucuaggagaacugucaugag

SEQ ID NO: 1590849 - RNA, 15 nt, Homo sapiens
guucuauccaaacau

SEQ ID NO: 1590850 - RNA, 20 nt, Homo sapiens
guucucauggguggcacuca

SEQ ID NO: 1590851 - RNA, 21 nt, Homo sapiens
guucuccagucauuauguuaa

SEQ ID NO: 1590852 - RNA, 23 nt, Homo sapiens
guucucugauuuguaaugagcac

SEQ ID NO: 1590853 - RNA, 20 nt, Homo sapiens
guucucuucuuuaaagggau

SEQ ID NO: 1590854 - RNA, 19 nt, Homo sapiens
guucuggguguugaccacu

SEQ ID NO: 1590855 - RNA, 14 nt, Homo sapiens
guucuuagcccuug

SEQ ID NO: 1590856 - RNA, 18 nt, Homo sapiens
guucuuuucuccuuuacc

SEQ ID NO: 1590857 - RNA, 20 nt, Homo sapiens
guucuuuucuccuuuaccag

SEQ ID NO: 1590858 - RNA, 14 nt, Homo sapiens
guucuuuuugccag

SEQ ID NO: 1590859 - RNA, 19 nt, Homo sapiens
guugaaaaaguucugcaga

SEQ ID NO: 1590860 - RNA, 13 nt, Homo sapiens
guugaagcacugu

SEQ ID NO: 1590861 - RNA, 21 nt, Homo sapiens
guugacugugauuagaucaca

SEQ ID NO: 1590862 - RNA, 14 nt, Homo sapiens
guugagaauguuca

SEQ ID NO: 1590863 - RNA, 13 nt, Homo sapiens
uaagugccuucca

SEQ ID NO: 1590864 - RNA, 20 nt, Homo sapiens
uaaguucagcaacuguuuaa

SEQ ID NO: 1590865 - RNA, 13 nt, Homo sapiens
uaaguucagucca

SEQ ID NO: 1590866 - RNA, 13 nt, Homo sapiens
uaaguugucaaag

SEQ ID NO: 1590867 - RNA, 18 nt, Homo sapiens
uaaguugucgaacaguag

SEQ ID NO: 1590868 - RNA, 20 nt, Homo sapiens
uaauaaaaagcuucagggaa

SEQ ID NO: 1590869 - RNA, 19 nt, Homo sapiens
uaauaaaccacgccaugag

SEQ ID NO: 1590870 - RNA, 13 nt, Homo sapiens
uaauaaagugaac

SEQ ID NO: 1590871 - RNA, 14 nt, Homo sapiens
uaauaaauauucau

SEQ ID NO: 1590872 - RNA, 16 nt, Homo sapiens
uaauaaaugugacuca

SEQ ID NO: 1590873 - RNA, 12 nt, Homo sapiens
uaauaacuuauc

SEQ ID NO: 1590874 - RNA, 20 nt, Homo sapiens
uaauaagauauuuaguaaua

SEQ ID NO: 1590875 - RNA, 16 nt, Homo sapiens
uaauaaucauuuuaga

SEQ ID NO: 1590876 - RNA, 15 nt, Homo sapiens
uaauaauguuuaaua

SEQ ID NO: 1590877 - RNA, 21 nt, Homo sapiens
uaauaauucuuuguguucagu

SEQ ID NO: 1590878 - RNA, 17 nt, Homo sapiens
uaauaccuaaacuguau

SEQ ID NO: 1590879 - RNA, 17 nt, Homo sapiens
uaauacucugcagugau

SEQ ID NO: 1590880 - RNA, 17 nt, Homo sapiens
uaauacuguauugcugu

SEQ ID NO: 1590881 - RNA, 19 nt, Homo sapiens
uaauagacuuaauacaugc

SEQ ID NO: 1590882 - RNA, 16 nt, Homo sapiens
uaauagcuauacauua

SEQ ID NO: 1590883 - RNA, 16 nt, Homo sapiens
uaauaggcaucuccag

SEQ ID NO: 1590884 - RNA, 14 nt, Homo sapiens
uaauaguguuuaca

SEQ ID NO: 1590885 - RNA, 15 nt, Homo sapiens
uaauauaaauucacu

SEQ ID NO: 1590886 - RNA, 19 nt, Homo sapiens
uaauauacaaaacaauuaa

SEQ ID NO: 1590887 - RNA, 19 nt, Homo sapiens
uaauaucaaaugcaguaua

SEQ ID NO: 1590888 - RNA, 22 nt, Homo sapiens
uaauauuucugaaaaccuacca

SEQ ID NO: 1590889 - RNA, 17 nt, Homo sapiens
uaauauuuuacauacac

SEQ ID NO: 1590890 - RNA, 16 nt, Homo sapiens
uaauauuuuagauuac

SEQ ID NO: 1590891 - RNA, 15 nt, Homo sapiens
uaauauuuuguaaua

SEQ ID NO: 1590892 - RNA, 20 nt, Homo sapiens
uaaucaagagaaacuucaaa

SEQ ID NO: 1590893 - RNA, 18 nt, Homo sapiens
uaaucaagggcacuguga

SEQ ID NO: 1590894 - RNA, 23 nt, Homo sapiens
uaaucaucaaguaauacaaacua

SEQ ID NO: 1590895 - RNA, 18 nt, Homo sapiens
uaauccaauauuuugccu

SEQ ID NO: 1590896 - RNA, 19 nt, Homo sapiens
uaauccaaugaguguuaca

SEQ ID NO: 1590897 - RNA, 14 nt, Homo sapiens
uaaucuccuauucc

SEQ ID NO: 1590898 - RNA, 20 nt, Homo sapiens
uaaucugaccguucuauugu

SEQ ID NO: 1590899 - RNA, 21 nt, Homo sapiens
uaaucugagaggccacagugc

SEQ ID NO: 1590900 - RNA, 21 nt, Homo sapiens
uaaucuuaaauuuauuagaua

SEQ ID NO: 1590901 - RNA, 18 nt, Homo sapiens
uaaugaauuuuuaugaua

SEQ ID NO: 1590902 - RNA, 14 nt, Homo sapiens
uaaugacaacacuu

SEQ ID NO: 1590903 - RNA, 17 nt, Homo sapiens
uaaugagagugcacugc

SEQ ID NO: 1590904 - RNA, 18 nt, Homo sapiens
uaaugagagugcacugcu

SEQ ID NO: 1590905 - RNA, 15 nt, Homo sapiens
uaaugagcagaugag

SEQ ID NO: 1590906 - RNA, 18 nt, Homo sapiens
uaaugaggaaauguguug

SEQ ID NO: 1590907 - RNA, 17 nt, Homo sapiens
uaaugaguauguaaaac

SEQ ID NO: 1590908 - RNA, 16 nt, Homo sapiens
uaaugagugaauugaa

SEQ ID NO: 1590909 - RNA, 18 nt, Homo sapiens
uaaugcauguggcacuua

SEQ ID NO: 1590910 - RNA, 20 nt, Homo sapiens
uaaugccaaugaacaucuca

SEQ ID NO: 1590911 - RNA, 15 nt, Homo sapiens
uaaugccaccaaagg

SEQ ID NO: 1590912 - RNA, 17 nt, Homo sapiens
uaaugcuguugccucau

SEQ ID NO: 1590913 - RNA, 14 nt, Homo sapiens
uaauggaaaccaag

SEQ ID NO: 1590914 - RNA, 14 nt, Homo sapiens
uaauggaaugaagg

SEQ ID NO: 1590915 - RNA, 17 nt, Homo sapiens
uaauggcaauaggacau

SEQ ID NO: 1590916 - RNA, 21 nt, Homo sapiens
uaaugguaguuuuacaguguu

SEQ ID NO: 1590917 - RNA, 20 nt, Homo sapiens
uaaugugcuucuaguaggca

SEQ ID NO: 1590918 - RNA, 19 nt, Homo sapiens
uaauguuguaucauacucu

SEQ ID NO: 1590919 - RNA, 15 nt, Homo sapiens
uaauguuuacuauau

SEQ ID NO: 1590920 - RNA, 19 nt, Homo sapiens
uaauguuuuauacuguuua

SEQ ID NO: 1590921 - RNA, 20 nt, Homo sapiens
uaauguuuuguaauuuugca

SEQ ID NO: 1590922 - RNA, 12 nt, Homo sapiens
uaauuaccaugc

SEQ ID NO: 1590923 - RNA, 21 nt, Homo sapiens
uaauuauaaaaaauuaacuua

SEQ ID NO: 1590924 - RNA, 12 nt, Homo sapiens
uaauuauugcuu

SEQ ID NO: 1590925 - RNA, 13 nt, Homo sapiens
uaauucagcacuu

SEQ ID NO: 1590926 - RNA, 19 nt, Homo sapiens
uaauucauuugguucaaau

SEQ ID NO: 1590927 - RNA, 17 nt, Homo sapiens
uaauuccuacagcacua

SEQ ID NO: 1590928 - RNA, 17 nt, Homo sapiens
uaauucuaaucuaacaa

SEQ ID NO: 1590929 - RNA, 13 nt, Homo sapiens
uaauugaucagau

SEQ ID NO: 1590930 - RNA, 23 nt, Homo sapiens
uaauugggcaggugaaaagggua

SEQ ID NO: 1590931 - RNA, 15 nt, Homo sapiens
uaauuggucauguga

SEQ ID NO: 1590932 - RNA, 15 nt, Homo sapiens
uaauuguguggauuc

SEQ ID NO: 1590933 - RNA, 16 nt, Homo sapiens
uaauuuauguaugcau

SEQ ID NO: 1590934 - RNA, 17 nt, Homo sapiens
uaauuuauuauacaccu

SEQ ID NO: 1590935 - RNA, 16 nt, Homo sapiens
uaauuuauuucaucca

SEQ ID NO: 1590936 - RNA, 15 nt, Homo sapiens
uaauuucauguauau

SEQ ID NO: 1590937 - RNA, 21 nt, Homo sapiens
uaauuuccuuuuugacacuga

SEQ ID NO: 1590938 - RNA, 22 nt, Homo sapiens
uaauuucgccuuaaacucugga

SEQ ID NO: 1590939 - RNA, 19 nt, Homo sapiens
uaauuuucccaaugaucuu

SEQ ID NO: 1590940 - RNA, 13 nt, Homo sapiens
uaauuuucgcuua

SEQ ID NO: 1590941 - RNA, 16 nt, Homo sapiens
uacaaaaacacagcaa

SEQ ID NO: 1590942 - RNA, 15 nt, Homo sapiens
uacaaaaagauugua

SEQ ID NO: 1590943 - RNA, 16 nt, Homo sapiens
uacaaacuucaaagag

SEQ ID NO: 1590944 - RNA, 16 nt, Homo sapiens
uacaaagaacaugaac

SEQ ID NO: 1590945 - RNA, 13 nt, Homo sapiens
uacaaaguuucaa

SEQ ID NO: 1590946 - RNA, 20 nt, Homo sapiens
uacaaauuuggccuuaagaa

SEQ ID NO: 1590947 - RNA, 15 nt, Homo sapiens
uacaaauuuugcacu

SEQ ID NO: 1590948 - RNA, 17 nt, Homo sapiens
uacaaauuuugcacuuu

SEQ ID NO: 1590949 - RNA, 11 nt, Homo sapiens
uacaacacuga

SEQ ID NO: 1590950 - RNA, 16 nt, Homo sapiens
uacaacacugagccau

SEQ ID NO: 1590951 - RNA, 14 nt, Homo sapiens
uacaaccagcccaa

SEQ ID NO: 1590952 - RNA, 21 nt, Homo sapiens
uacaacgccgagugcacugca

SEQ ID NO: 1590953 - RNA, 15 nt, Homo sapiens
uacaagaaccaagga

SEQ ID NO: 1590954 - RNA, 14 nt, Homo sapiens
uacaagcuuguaaa

SEQ ID NO: 1590955 - RNA, 22 nt, Homo sapiens
uacaaggcccagaagccugauc

SEQ ID NO: 1590956 - RNA, 21 nt, Homo sapiens
uacaagugguuaaaacauagc

SEQ ID NO: 1590957 - RNA, 18 nt, Homo sapiens
uacaauaaaaacauugcc

SEQ ID NO: 1590958 - RNA, 14 nt, Homo sapiens
uacaauacaaugua

SEQ ID NO: 1590959 - RNA, 15 nt, Homo sapiens
uacaauacaauguac

SEQ ID NO: 1590960 - RNA, 17 nt, Homo sapiens
uacaauagacauugcaa

SEQ ID NO: 1590961 - RNA, 18 nt, Homo sapiens
uacaaucgagacugcaau

SEQ ID NO: 1590962 - RNA, 21 nt, Homo sapiens
uacaauuaugucucuugagca

SEQ ID NO: 1590963 - RNA, 13 nt, Homo sapiens
uacaauucauugu

SEQ ID NO: 1590964 - RNA, 18 nt, Homo sapiens
uacaauuuuuuaucaugc

SEQ ID NO: 1590965 - RNA, 22 nt, Homo sapiens
uacaauuuuuuaucaugcaugu

SEQ ID NO: 1590966 - RNA, 18 nt, Homo sapiens
uacacaaggggcaaauga

SEQ ID NO: 1590967 - RNA, 17 nt, Homo sapiens
uacacaauacaguauua

SEQ ID NO: 1590968 - RNA, 21 nt, Homo sapiens
uacacacacacaaaaacagaa

SEQ ID NO: 1590969 - RNA, 14 nt, Homo sapiens
uacacacaguggau

SEQ ID NO: 1590970 - RNA, 22 nt, Homo sapiens
uacacacccgccugacaccgug

SEQ ID NO: 1590971 - RNA, 20 nt, Homo sapiens
uacacaucacacccauuuaa

SEQ ID NO: 1590972 - RNA, 20 nt, Homo sapiens
uacacauuuuucagauauaa

SEQ ID NO: 1590973 - RNA, 13 nt, Homo sapiens
uacacgacucagu

SEQ ID NO: 1590974 - RNA, 21 nt, Homo sapiens
uacacgugccuguagucccag

SEQ ID NO: 1590975 - RNA, 20 nt, Homo sapiens
uacacuccucuaucaugcaa

SEQ ID NO: 1590976 - RNA, 20 nt, Homo sapiens
uacacugcacuuuguuuaga

SEQ ID NO: 1590977 - RNA, 14 nt, Homo sapiens
uacacuguuuccau

SEQ ID NO: 1590978 - RNA, 20 nt, Homo sapiens
uacacuuauuuuacuaguuu

SEQ ID NO: 1590979 - RNA, 17 nt, Homo sapiens
uacagaaauauccauga

SEQ ID NO: 1590980 - RNA, 14 nt, Homo sapiens
uacagaacucuuuc

SEQ ID NO: 1590981 - RNA, 20 nt, Homo sapiens
uacagacucaguagccauau

SEQ ID NO: 1590982 - RNA, 21 nt, Homo sapiens
uauacucuugaauuccucuca

SEQ ID NO: 1590983 - RNA, 15 nt, Homo sapiens
uauacuugacucuaa

SEQ ID NO: 1590984 - RNA, 21 nt, Homo sapiens
uauacuugggaauauaaagga

SEQ ID NO: 1590985 - RNA, 16 nt, Homo sapiens
uauagaaaugcugguu

SEQ ID NO: 1590986 - RNA, 18 nt, Homo sapiens
uauagaagaaaauuuugg

SEQ ID NO: 1590987 - RNA, 17 nt, Homo sapiens
uauagcuuccagauuac

SEQ ID NO: 1590988 - RNA, 17 nt, Homo sapiens
uauaggaaaaaaacugg

SEQ ID NO: 1590989 - RNA, 15 nt, Homo sapiens
uauaggaacaauucu

SEQ ID NO: 1590990 - RNA, 21 nt, Homo sapiens
uauaggugcuacaaaaacaca

SEQ ID NO: 1590991 - RNA, 20 nt, Homo sapiens
uauaguagacacacuaucau

SEQ ID NO: 1590992 - RNA, 22 nt, Homo sapiens
uauagucgaacaauucauauau

SEQ ID NO: 1590993 - RNA, 15 nt, Homo sapiens
uauauaaacauauca

SEQ ID NO: 1590994 - RNA, 21 nt, Homo sapiens
uauauaauaaauacucaguga

SEQ ID NO: 1590995 - RNA, 17 nt, Homo sapiens
uauauaauuuacuuugu

SEQ ID NO: 1590996 - RNA, 12 nt, Homo sapiens
uauauagccaau

SEQ ID NO: 1590997 - RNA, 18 nt, Homo sapiens
uauauauuuuugugcaca

SEQ ID NO: 1590998 - RNA, 21 nt, Homo sapiens
uauaucauagcaaauaaguca

SEQ ID NO: 1590999 - RNA, 15 nt, Homo sapiens
uauaucuaccccaga

SEQ ID NO: 1591000 - RNA, 13 nt, Homo sapiens
uauauguaccgua

SEQ ID NO: 1591001 - RNA, 16 nt, Homo sapiens
uauauuccagguuuaa

SEQ ID NO: 1591002 - RNA, 21 nt, Homo sapiens
uauauugcuuaccugaucuca

SEQ ID NO: 1591003 - RNA, 19 nt, Homo sapiens
uauauuguauuaagggcau

SEQ ID NO: 1591004 - RNA, 12 nt, Homo sapiens
uauauugucauu

SEQ ID NO: 1591005 - RNA, 22 nt, Homo sapiens
uauauuugaaaaaaacuucauu

SEQ ID NO: 1591006 - RNA, 21 nt, Homo sapiens
uaucaaaaagcuaaugugcag

SEQ ID NO: 1591007 - RNA, 14 nt, Homo sapiens
uaucaagccaaaga

SEQ ID NO: 1591008 - RNA, 14 nt, Homo sapiens
uaucaauggugcug

SEQ ID NO: 1591009 - RNA, 13 nt, Homo sapiens
uaucacacuguau

SEQ ID NO: 1591010 - RNA, 17 nt, Homo sapiens
uaucaccgugggcuccc

SEQ ID NO: 1591011 - RNA, 18 nt, Homo sapiens
uaucagagucaugaugaa

SEQ ID NO: 1591012 - RNA, 22 nt, Homo sapiens
uaucagcagacacuccaguuug

SEQ ID NO: 1591013 - RNA, 23 nt, Homo sapiens
uaucagcauagugacuaaacuac

SEQ ID NO: 1591014 - RNA, 10 nt, Homo sapiens
uaucagggca

SEQ ID NO: 1591015 - RNA, 15 nt, Homo sapiens
uaucaguacaugccu

SEQ ID NO: 1591016 - RNA, 19 nt, Homo sapiens
uaucauaauucagcacuua

SEQ ID NO: 1591017 - RNA, 23 nt, Homo sapiens
uaucaugaagcacaucaauuaca

SEQ ID NO: 1591018 - RNA, 11 nt, Homo sapiens
uaucaugcaaa

SEQ ID NO: 1591019 - RNA, 19 nt, Homo sapiens
uauccaaaauaaugaggaa

SEQ ID NO: 1591020 - RNA, 15 nt, Homo sapiens
uauccaauugcucuu

SEQ ID NO: 1591021 - RNA, 19 nt, Homo sapiens
uauccacagaaccuuuguc

SEQ ID NO: 1591022 - RNA, 22 nt, Homo sapiens
uauccacccagcccauucucuc

SEQ ID NO: 1591023 - RNA, 13 nt, Homo sapiens
uauccaugcaccu

SEQ ID NO: 1591024 - RNA, 21 nt, Homo sapiens
uauccccauucucugccugua

SEQ ID NO: 1591025 - RNA, 13 nt, Homo sapiens
uaucccucucuuc

SEQ ID NO: 1591026 - RNA, 14 nt, Homo sapiens
uauccugaaaggca

SEQ ID NO: 1591027 - RNA, 21 nt, Homo sapiens
uauccugggagcacugcguuu

SEQ ID NO: 1591028 - RNA, 19 nt, Homo sapiens
uaucgagaguuucuaugga

SEQ ID NO: 1591029 - RNA, 15 nt, Homo sapiens
uaucuacagaacugg

SEQ ID NO: 1591030 - RNA, 20 nt, Homo sapiens
uaucuauagcuaaguacaca

SEQ ID NO: 1591031 - RNA, 20 nt, Homo sapiens
uaucuauuuguacaauuuua

SEQ ID NO: 1591032 - RNA, 12 nt, Homo sapiens
uaucucaaugug

SEQ ID NO: 1591033 - RNA, 13 nt, Homo sapiens
uaucucagccaua

SEQ ID NO: 1591034 - RNA, 14 nt, Homo sapiens
uaucucagccauag

SEQ ID NO: 1591035 - RNA, 16 nt, Homo sapiens
uaucucaguaccccau

SEQ ID NO: 1591036 - RNA, 21 nt, Homo sapiens
uaucucaugccagugccuuau

SEQ ID NO: 1591037 - RNA, 17 nt, Homo sapiens
uaucugauuguugucag

SEQ ID NO: 1591038 - RNA, 16 nt, Homo sapiens
uaucugcuuccauuaa

SEQ ID NO: 1591039 - RNA, 16 nt, Homo sapiens
uaucuggccugagaca

SEQ ID NO: 1591040 - RNA, 14 nt, Homo sapiens
uaucuguugccuua

SEQ ID NO: 1591041 - RNA, 18 nt, Homo sapiens
uaucuuaccuaguguuua

SEQ ID NO: 1591042 - RNA, 22 nt, Homo sapiens
uaucuuagugguuccccaccga

SEQ ID NO: 1591043 - RNA, 14 nt, Homo sapiens
uaucuucaggccau

SEQ ID NO: 1591044 - RNA, 24 nt, Homo sapiens
uaucuuuaccaaaaaccauguugc

SEQ ID NO: 1591045 - RNA, 18 nt, Homo sapiens
uaucuuucgauaaacaac

SEQ ID NO: 1591046 - RNA, 19 nt, Homo sapiens
uaugaaaauacaacuuaaa

SEQ ID NO: 1591047 - RNA, 15 nt, Homo sapiens
uaugaaaaucuccau

SEQ ID NO: 1591048 - RNA, 21 nt, Homo sapiens
uaugaaaaucuccaucucaaa

SEQ ID NO: 1591049 - RNA, 12 nt, Homo sapiens
uaugaacaucca

SEQ ID NO: 1591050 - RNA, 15 nt, Homo sapiens
uaugaauaugauccc

SEQ ID NO: 1591051 - RNA, 22 nt, Homo sapiens
uaugacagugaagcagcacugu

SEQ ID NO: 1591052 - RNA, 14 nt, Homo sapiens
uaugacuacuacau

SEQ ID NO: 1591053 - RNA, 21 nt, Homo sapiens
uaugagaguuuggaauuauug

SEQ ID NO: 1591054 - RNA, 14 nt, Homo sapiens
uaugagcaugccaa

SEQ ID NO: 1591055 - RNA, 17 nt, Homo sapiens
uaugaggaaacugaguc

SEQ ID NO: 1591056 - RNA, 17 nt, Homo sapiens
uaugauaaaacacugcc

SEQ ID NO: 1591057 - RNA, 19 nt, Homo sapiens
uaugauaaaacacugcccu

SEQ ID NO: 1591058 - RNA, 13 nt, Homo sapiens
uaugaucagaaga

SEQ ID NO: 1591059 - RNA, 13 nt, Homo sapiens
uaugaugcacuua

SEQ ID NO: 1591060 - RNA, 15 nt, Homo sapiens
uaugaugcaguuuca

SEQ ID NO: 1591061 - RNA, 22 nt, Homo sapiens
uaugauuagagggaugagacag

SEQ ID NO: 1591062 - RNA, 13 nt, Homo sapiens
uaugcaaaccuca

SEQ ID NO: 1591063 - RNA, 12 nt, Homo sapiens
uaugcauaucag

SEQ ID NO: 1591064 - RNA, 18 nt, Homo sapiens
uaugcauguagcauauaa

SEQ ID NO: 1591065 - RNA, 18 nt, Homo sapiens
uaugcauuaccugggaau

SEQ ID NO: 1591066 - RNA, 17 nt, Homo sapiens
uaugcauucacauuuag

SEQ ID NO: 1591067 - RNA, 20 nt, Homo sapiens
uaugccucuguguaucucag

SEQ ID NO: 1591068 - RNA, 22 nt, Homo sapiens
uaugcuggacucuggaccauau

SEQ ID NO: 1591069 - RNA, 16 nt, Homo sapiens
uaugcuguaucugugc

SEQ ID NO: 1591070 - RNA, 22 nt, Homo sapiens
uauggaagcaaccagcaaauua

SEQ ID NO: 1591071 - RNA, 14 nt, Homo sapiens
uauggaauuuugca

SEQ ID NO: 1591072 - RNA, 15 nt, Homo sapiens
uauggauguguucuc

SEQ ID NO: 1591073 - RNA, 15 nt, Homo sapiens
uauggcaaauagcca

SEQ ID NO: 1591074 - RNA, 23 nt, Homo sapiens
uauggccgacagacauggacaag

SEQ ID NO: 1591075 - RNA, 17 nt, Homo sapiens
uaugggaggaacaaaga

SEQ ID NO: 1591076 - RNA, 18 nt, Homo sapiens
uauggguuggacaaccuc

SEQ ID NO: 1591077 - RNA, 14 nt, Homo sapiens
uaugguucucaggc

SEQ ID NO: 1591078 - RNA, 10 nt, Homo sapiens
uauguaaaaa

SEQ ID NO: 1591079 - RNA, 17 nt, Homo sapiens
uauguaauggaacuuag

SEQ ID NO: 1591080 - RNA, 22 nt, Homo sapiens
uauguagcaaaauacaugacau

SEQ ID NO: 1591081 - RNA, 16 nt, Homo sapiens
uaugucaaagcuuuga

SEQ ID NO: 1591082 - RNA, 14 nt, Homo sapiens
uauguccacuguuc

SEQ ID NO: 1591083 - RNA, 15 nt, Homo sapiens
uaugugcacaucugu

SEQ ID NO: 1591084 - RNA, 22 nt, Homo sapiens
uaugugcuauauaaauauguca

SEQ ID NO: 1591085 - RNA, 17 nt, Homo sapiens
uaugugggggucugugu

SEQ ID NO: 1591086 - RNA, 19 nt, Homo sapiens
uaugugucagccaugacca

SEQ ID NO: 1591087 - RNA, 13 nt, Homo sapiens
uaugugugccuuu

SEQ ID NO: 1591088 - RNA, 20 nt, Homo sapiens
uauguguggaugaugcugcc

SEQ ID NO: 1591089 - RNA, 18 nt, Homo sapiens
uaugugugugugugaacc

SEQ ID NO: 1591090 - RNA, 15 nt, Homo sapiens
uauguguuacauuau

SEQ ID NO: 1591091 - RNA, 16 nt, Homo sapiens
uauguuaccuuuucau

SEQ ID NO: 1591092 - RNA, 21 nt, Homo sapiens
uauguuauagaacuucaugga

SEQ ID NO: 1591093 - RNA, 15 nt, Homo sapiens
uauguucuaagaagu

SEQ ID NO: 1591094 - RNA, 18 nt, Homo sapiens
uauguuuccuaacuguga

SEQ ID NO: 1591095 - RNA, 18 nt, Homo sapiens
uauuaaagguaugcauuu

SEQ ID NO: 1591096 - RNA, 18 nt, Homo sapiens
uauuaagauucuugacuu

SEQ ID NO: 1591097 - RNA, 15 nt, Homo sapiens
uauuaagccacuuaa

SEQ ID NO: 1591098 - RNA, 23 nt, Homo sapiens
uauuaaucaagagaaacuucaaa

SEQ ID NO: 1591099 - RNA, 14 nt, Homo sapiens
uauuaaucucugug

SEQ ID NO: 1591100 - RNA, 19 nt, Homo sapiens
ucagugaagucuagaauca

SEQ ID NO: 1591101 - RNA, 13 nt, Homo sapiens
ucagugcaguuuc

SEQ ID NO: 1591102 - RNA, 14 nt, Homo sapiens
ucagugcaguuucu

SEQ ID NO: 1591103 - RNA, 14 nt, Homo sapiens
ucagugcucuguaa

SEQ ID NO: 1591104 - RNA, 15 nt, Homo sapiens
ucaguggaucuucag

SEQ ID NO: 1591105 - RNA, 22 nt, Homo sapiens
ucagugucaaauaaacacugug

SEQ ID NO: 1591106 - RNA, 16 nt, Homo sapiens
ucagugugagucagaa

SEQ ID NO: 1591107 - RNA, 12 nt, Homo sapiens
ucaguguugcau

SEQ ID NO: 1591108 - RNA, 22 nt, Homo sapiens
ucaguucccuccuucuuacaga

SEQ ID NO: 1591109 - RNA, 23 nt, Homo sapiens
ucaguugauuuuucuuauuuaca

SEQ ID NO: 1591110 - RNA, 19 nt, Homo sapiens
ucaguuuuuuuuuuuccag

SEQ ID NO: 1591111 - RNA, 14 nt, Homo sapiens
ucauaaaaaucuag

SEQ ID NO: 1591112 - RNA, 16 nt, Homo sapiens
ucauaacuauacuuga

SEQ ID NO: 1591113 - RNA, 21 nt, Homo sapiens
ucauaaguagcauucauguaa

SEQ ID NO: 1591114 - RNA, 16 nt, Homo sapiens
ucauaauucagcacuu

SEQ ID NO: 1591115 - RNA, 17 nt, Homo sapiens
ucauaauucagcacuua

SEQ ID NO: 1591116 - RNA, 14 nt, Homo sapiens
ucauaauucugaaa

SEQ ID NO: 1591117 - RNA, 13 nt, Homo sapiens
ucauacaaugaua

SEQ ID NO: 1591118 - RNA, 15 nt, Homo sapiens
ucauacagaaggcaa

SEQ ID NO: 1591119 - RNA, 15 nt, Homo sapiens
ucauaccacuugaau

SEQ ID NO: 1591120 - RNA, 16 nt, Homo sapiens
ucauaccuaucaucuu

SEQ ID NO: 1591121 - RNA, 12 nt, Homo sapiens
ucauacuguaac

SEQ ID NO: 1591122 - RNA, 17 nt, Homo sapiens
ucauagaaauauugacu

SEQ ID NO: 1591123 - RNA, 17 nt, Homo sapiens
ucauagcccucagacau

SEQ ID NO: 1591124 - RNA, 18 nt, Homo sapiens
ucauaguucccaggugau

SEQ ID NO: 1591125 - RNA, 14 nt, Homo sapiens
ucauauaccagcaa

SEQ ID NO: 1591126 - RNA, 15 nt, Homo sapiens
ucauauauacuguau

SEQ ID NO: 1591127 - RNA, 20 nt, Homo sapiens
ucauaucauccacacaugaa

SEQ ID NO: 1591128 - RNA, 18 nt, Homo sapiens
ucauauuauuuuagugug

SEQ ID NO: 1591129 - RNA, 21 nt, Homo sapiens
ucauauuauuuuaguguguaa

SEQ ID NO: 1591130 - RNA, 20 nt, Homo sapiens
ucauauugaugugugucuag

SEQ ID NO: 1591131 - RNA, 22 nt, Homo sapiens
ucaucaaaaccugcgcagucau

SEQ ID NO: 1591132 - RNA, 20 nt, Homo sapiens
ucaucacgacacauuugccu

SEQ ID NO: 1591133 - RNA, 13 nt, Homo sapiens
ucaucacuguaaa

SEQ ID NO: 1591134 - RNA, 12 nt, Homo sapiens
ucaucaggccau

SEQ ID NO: 1591135 - RNA, 15 nt, Homo sapiens
ucaucaggugcauag

SEQ ID NO: 1591136 - RNA, 18 nt, Homo sapiens
ucaucaggugcauagcaa

SEQ ID NO: 1591137 - RNA, 16 nt, Homo sapiens
ucaucagucaucaggu

SEQ ID NO: 1591138 - RNA, 19 nt, Homo sapiens
ucauccacauaagcacucc

SEQ ID NO: 1591139 - RNA, 19 nt, Homo sapiens
ucauccacucugccugcuu

SEQ ID NO: 1591140 - RNA, 21 nt, Homo sapiens
ucauccauagacacaguauug

SEQ ID NO: 1591141 - RNA, 18 nt, Homo sapiens
ucauccauccuugccaau

SEQ ID NO: 1591142 - RNA, 19 nt, Homo sapiens
ucauccccaggggucccag

SEQ ID NO: 1591143 - RNA, 18 nt, Homo sapiens
ucaucccuuuuucugcua

SEQ ID NO: 1591144 - RNA, 15 nt, Homo sapiens
ucauccugacucugc

SEQ ID NO: 1591145 - RNA, 17 nt, Homo sapiens
ucaucuauaacaugcau

SEQ ID NO: 1591146 - RNA, 18 nt, Homo sapiens
ucaucuucacugcaauuu

SEQ ID NO: 1591147 - RNA, 15 nt, Homo sapiens
ucaucuuucuuccaa

SEQ ID NO: 1591148 - RNA, 23 nt, Homo sapiens
ucaucuuuugaagagcaaaggga

SEQ ID NO: 1591149 - RNA, 16 nt, Homo sapiens
ucaugaaaacacacau

SEQ ID NO: 1591150 - RNA, 16 nt, Homo sapiens
ucaugaaagcaucuga

SEQ ID NO: 1591151 - RNA, 13 nt, Homo sapiens
ucaugaagcacau

SEQ ID NO: 1591152 - RNA, 21 nt, Homo sapiens
ucaugaguagugggcuaugca

SEQ ID NO: 1591153 - RNA, 16 nt, Homo sapiens
ucaugaucaagauaua

SEQ ID NO: 1591154 - RNA, 12 nt, Homo sapiens
ucaugaugcuag

SEQ ID NO: 1591155 - RNA, 13 nt, Homo sapiens
ucaugauuucccu

SEQ ID NO: 1591156 - RNA, 16 nt, Homo sapiens
ucaugauuuggcaugg

SEQ ID NO: 1591157 - RNA, 18 nt, Homo sapiens
ucaugcaaacugcuuuau

SEQ ID NO: 1591158 - RNA, 19 nt, Homo sapiens
ucaugccauugcauuccag

SEQ ID NO: 1591159 - RNA, 18 nt, Homo sapiens
ucaugccuguaaucccag

SEQ ID NO: 1591160 - RNA, 15 nt, Homo sapiens
ucauggauauguuau

SEQ ID NO: 1591161 - RNA, 21 nt, Homo sapiens
ucauggauauguuauacugaa

SEQ ID NO: 1591162 - RNA, 14 nt, Homo sapiens
ucauggauuacuuc

SEQ ID NO: 1591163 - RNA, 11 nt, Homo sapiens
ucauggcauau

SEQ ID NO: 1591164 - RNA, 17 nt, Homo sapiens
ucauggcuaauuuaaca

SEQ ID NO: 1591165 - RNA, 19 nt, Homo sapiens
ucaugggagggggcuugaa

SEQ ID NO: 1591166 - RNA, 15 nt, Homo sapiens
ucaugggccuguggg

SEQ ID NO: 1591167 - RNA, 20 nt, Homo sapiens
ucauggguggugacguggua

SEQ ID NO: 1591168 - RNA, 17 nt, Homo sapiens
ucauguaaacugugcac

SEQ ID NO: 1591169 - RNA, 19 nt, Homo sapiens
ucauguaaggcuuaacaca

SEQ ID NO: 1591170 - RNA, 12 nt, Homo sapiens
ucauguaugcau

SEQ ID NO: 1591171 - RNA, 17 nt, Homo sapiens
ucaugucccagaacuua

SEQ ID NO: 1591172 - RNA, 16 nt, Homo sapiens
ucaugugacucuuucc

SEQ ID NO: 1591173 - RNA, 22 nt, Homo sapiens
ucauuacaaucgagacugcaau

SEQ ID NO: 1591174 - RNA, 12 nt, Homo sapiens
ucauuaccaaua

SEQ ID NO: 1591175 - RNA, 16 nt, Homo sapiens
ucauuaugcuuugaac

SEQ ID NO: 1591176 - RNA, 14 nt, Homo sapiens
ucauuauguuaaua

SEQ ID NO: 1591177 - RNA, 22 nt, Homo sapiens
ucauuauuuuuguuagcaaaga

SEQ ID NO: 1591178 - RNA, 16 nt, Homo sapiens
ucauucacaacuauga

SEQ ID NO: 1591179 - RNA, 20 nt, Homo sapiens
ucauuccauguccauaugca

SEQ ID NO: 1591180 - RNA, 18 nt, Homo sapiens
ucauuccucacaaugagg

SEQ ID NO: 1591181 - RNA, 20 nt, Homo sapiens
ucauucuacugaacagucca

SEQ ID NO: 1591182 - RNA, 21 nt, Homo sapiens
ucauucuacugaacaguccau

SEQ ID NO: 1591183 - RNA, 15 nt, Homo sapiens
ucauucucauucuca

SEQ ID NO: 1591184 - RNA, 21 nt, Homo sapiens
ucauucucugucucauccauc

SEQ ID NO: 1591185 - RNA, 14 nt, Homo sapiens
ucauugacuucauu

SEQ ID NO: 1591186 - RNA, 18 nt, Homo sapiens
ucauuggugaaguaaauu

SEQ ID NO: 1591187 - RNA, 17 nt, Homo sapiens
ucauuguacaaguauua

SEQ ID NO: 1591188 - RNA, 18 nt, Homo sapiens
ucauuuaacucuuugaaa

SEQ ID NO: 1591189 - RNA, 16 nt, Homo sapiens
ucauuuaggaguauua

SEQ ID NO: 1591190 - RNA, 15 nt, Homo sapiens
ucauuuaguaaggau

SEQ ID NO: 1591191 - RNA, 20 nt, Homo sapiens
ucauuuauuuacaugugauu

SEQ ID NO: 1591192 - RNA, 14 nt, Homo sapiens
ucauuucauuucag

SEQ ID NO: 1591193 - RNA, 14 nt, Homo sapiens
ucauuugaaugcuu

SEQ ID NO: 1591194 - RNA, 14 nt, Homo sapiens
ucauuugcacacaa

SEQ ID NO: 1591195 - RNA, 20 nt, Homo sapiens
ucauuuuaaaaaauggaaca

SEQ ID NO: 1591196 - RNA, 19 nt, Homo sapiens
uccaaaaagcacauauuag

SEQ ID NO: 1591197 - RNA, 17 nt, Homo sapiens
uccaaaaagcucugaaa

SEQ ID NO: 1591198 - RNA, 14 nt, Homo sapiens
uccaaaaccuuccu

SEQ ID NO: 1591199 - RNA, 13 nt, Homo sapiens
uccaaaagcacau

SEQ ID NO: 1591200 - RNA, 16 nt, Homo sapiens
uccaaagagccuucag

SEQ ID NO: 1591201 - RNA, 12 nt, Homo sapiens
uccaaagaggcu

SEQ ID NO: 1591202 - RNA, 22 nt, Homo sapiens
uccaaagaggcugccccucuca

SEQ ID NO: 1591203 - RNA, 20 nt, Homo sapiens
uccaaagcauuuuugaucaa

SEQ ID NO: 1591204 - RNA, 18 nt, Homo sapiens
uccaaagccggcuugauu

SEQ ID NO: 1591205 - RNA, 16 nt, Homo sapiens
uccaaauaugcaaaaa

SEQ ID NO: 1591206 - RNA, 18 nt, Homo sapiens
uccaaauguccuuucuca

SEQ ID NO: 1591207 - RNA, 20 nt, Homo sapiens
uccaaauguccuuucucaga

SEQ ID NO: 1591208 - RNA, 17 nt, Homo sapiens
uccaacauuaaaagcca

SEQ ID NO: 1591209 - RNA, 20 nt, Homo sapiens
uccaacauuucucacugaaa

SEQ ID NO: 1591210 - RNA, 14 nt, Homo sapiens
uccaaccacuguac

SEQ ID NO: 1591211 - RNA, 23 nt, Homo sapiens
uccaaccccccagcacugaggaa

SEQ ID NO: 1591212 - RNA, 18 nt, Homo sapiens
uccaacccgccggucuca

SEQ ID NO: 1591213 - RNA, 16 nt, Homo sapiens
uccaaccuaaccccuu

SEQ ID NO: 1591214 - RNA, 17 nt, Homo sapiens
uccaagacucagaugau

SEQ ID NO: 1591215 - RNA, 14 nt, Homo sapiens
uccaagcauuucau

SEQ ID NO: 1591216 - RNA, 19 nt, Homo sapiens
uccaagccaaguuuucuca

SEQ ID NO: 1591217 - RNA, 15 nt, Homo sapiens
uccaagccucaaagu

SEQ ID NO: 1591218 - RNA, 18 nt, Homo sapiens
uccaagccucauguccac

SEQ ID NO: 1591219 - RNA, 21 nt, Homo sapiens
ugggcuggauugugcuuuggu

SEQ ID NO: 1591220 - RNA, 19 nt, Homo sapiens
ugggcugugggcaagccua

SEQ ID NO: 1591221 - RNA, 16 nt, Homo sapiens
uggggaaaaaaaucau

SEQ ID NO: 1591222 - RNA, 21 nt, Homo sapiens
uggggaagagugacucuccag

SEQ ID NO: 1591223 - RNA, 16 nt, Homo sapiens
uggggaaugcucccag

SEQ ID NO: 1591224 - RNA, 23 nt, Homo sapiens
uggggaaugcucccagcugugcu

SEQ ID NO: 1591225 - RNA, 21 nt, Homo sapiens
uggggacacagcaucagcuca

SEQ ID NO: 1591226 - RNA, 22 nt, Homo sapiens
uggggacacagcaucagcucaa

SEQ ID NO: 1591227 - RNA, 19 nt, Homo sapiens
uggggacguugcugagcca

SEQ ID NO: 1591228 - RNA, 14 nt, Homo sapiens
uggggaggcccaaa

SEQ ID NO: 1591229 - RNA, 22 nt, Homo sapiens
uggggcaggaaagcaugcauug

SEQ ID NO: 1591230 - RNA, 19 nt, Homo sapiens
uggggcaggcugggccaug

SEQ ID NO: 1591231 - RNA, 16 nt, Homo sapiens
uggggccaauuacuug

SEQ ID NO: 1591232 - RNA, 19 nt, Homo sapiens
uggggccaauuacuugaag

SEQ ID NO: 1591233 - RNA, 17 nt, Homo sapiens
uggggcccagacaccag

SEQ ID NO: 1591234 - RNA, 12 nt, Homo sapiens
uggggcucucuc

SEQ ID NO: 1591235 - RNA, 15 nt, Homo sapiens
ugggggaacugugaa

SEQ ID NO: 1591236 - RNA, 22 nt, Homo sapiens
ugggggaaugcaccuccccaaa

SEQ ID NO: 1591237 - RNA, 20 nt, Homo sapiens
uggggggaagcacauaaucc

SEQ ID NO: 1591238 - RNA, 17 nt, Homo sapiens
ugggguuucaccauauu

SEQ ID NO: 1591239 - RNA, 18 nt, Homo sapiens
ugggguuugaagcugacu

SEQ ID NO: 1591240 - RNA, 19 nt, Homo sapiens
uggguacugaaagccuuag

SEQ ID NO: 1591241 - RNA, 23 nt, Homo sapiens
uggguauuguuaggaaaugucau

SEQ ID NO: 1591242 - RNA, 21 nt, Homo sapiens
ugggucccagauuggcucaca

SEQ ID NO: 1591243 - RNA, 17 nt, Homo sapiens
ugggucccggcucugug

SEQ ID NO: 1591244 - RNA, 16 nt, Homo sapiens
uggguggaaaggugug

SEQ ID NO: 1591245 - RNA, 20 nt, Homo sapiens
uggguggggcugcuccucca

SEQ ID NO: 1591246 - RNA, 14 nt, Homo sapiens
uggguguugaccac

SEQ ID NO: 1591247 - RNA, 15 nt, Homo sapiens
uggguuaaguauuau

SEQ ID NO: 1591248 - RNA, 13 nt, Homo sapiens
uggguuaauuucu

SEQ ID NO: 1591249 - RNA, 10 nt, Homo sapiens
uggguucucu

SEQ ID NO: 1591250 - RNA, 14 nt, Homo sapiens
uggguugucaccaa

SEQ ID NO: 1591251 - RNA, 14 nt, Homo sapiens
uggguuuggcaaaa

SEQ ID NO: 1591252 - RNA, 15 nt, Homo sapiens
uggguuuggcuuguu

SEQ ID NO: 1591253 - RNA, 14 nt, Homo sapiens
ugguaauagcugua

SEQ ID NO: 1591254 - RNA, 12 nt, Homo sapiens
ugguacaaggaa

SEQ ID NO: 1591255 - RNA, 20 nt, Homo sapiens
ugguaccuguguauuuggaa

SEQ ID NO: 1591256 - RNA, 17 nt, Homo sapiens
ugguacugaaaaugaga

SEQ ID NO: 1591257 - RNA, 21 nt, Homo sapiens
ugguauaaacguccuacugua

SEQ ID NO: 1591258 - RNA, 15 nt, Homo sapiens
ugguauacuuuugcu

SEQ ID NO: 1591259 - RNA, 22 nt, Homo sapiens
ugguaucauuuucuagcaauaa

SEQ ID NO: 1591260 - RNA, 17 nt, Homo sapiens
ugguaucuacuucuaca

SEQ ID NO: 1591261 - RNA, 23 nt, Homo sapiens
ugguauucaacuaauacaugguu

SEQ ID NO: 1591262 - RNA, 15 nt, Homo sapiens
uggucauccaaacuc

SEQ ID NO: 1591263 - RNA, 22 nt, Homo sapiens
ugguccccucccccauccccac

SEQ ID NO: 1591264 - RNA, 20 nt, Homo sapiens
uggucgucaacuuuccucaa

SEQ ID NO: 1591265 - RNA, 22 nt, Homo sapiens
uggucuaagguucagccugaaa

SEQ ID NO: 1591266 - RNA, 20 nt, Homo sapiens
uggucucaaacuuguggccu

SEQ ID NO: 1591267 - RNA, 21 nt, Homo sapiens
uggucucuuuccaaagcauuu

SEQ ID NO: 1591268 - RNA, 23 nt, Homo sapiens
uggucugaagaaggaaggccuga

SEQ ID NO: 1591269 - RNA, 20 nt, Homo sapiens
uggucugcugaguaacaggu

SEQ ID NO: 1591270 - RNA, 20 nt, Homo sapiens
uggugaaaccccgucucuac

SEQ ID NO: 1591271 - RNA, 20 nt, Homo sapiens
uggugaacugagcugggcag

SEQ ID NO: 1591272 - RNA, 12 nt, Homo sapiens
uggugacugucc

SEQ ID NO: 1591273 - RNA, 14 nt, Homo sapiens
uggugagacugucc

SEQ ID NO: 1591274 - RNA, 13 nt, Homo sapiens
uggugaugucacu

SEQ ID NO: 1591275 - RNA, 18 nt, Homo sapiens
uggugcagccuacacuau

SEQ ID NO: 1591276 - RNA, 17 nt, Homo sapiens
uggugcugagguugaga

SEQ ID NO: 1591277 - RNA, 14 nt, Homo sapiens
ugguggcaccagau

SEQ ID NO: 1591278 - RNA, 21 nt, Homo sapiens
ugguggcaucacagaccccag

SEQ ID NO: 1591279 - RNA, 19 nt, Homo sapiens
uggugggcccccaaugaca

SEQ ID NO: 1591280 - RNA, 16 nt, Homo sapiens
ugguggguucagggga

SEQ ID NO: 1591281 - RNA, 18 nt, Homo sapiens
ugguguaauuuuguccuc

SEQ ID NO: 1591282 - RNA, 14 nt, Homo sapiens
ugguguccagucuu

SEQ ID NO: 1591283 - RNA, 19 nt, Homo sapiens
uggugucuugcgccuguac

SEQ ID NO: 1591284 - RNA, 13 nt, Homo sapiens
uggugugcuguau

SEQ ID NO: 1591285 - RNA, 14 nt, Homo sapiens
ugguguguuacaca

SEQ ID NO: 1591286 - RNA, 16 nt, Homo sapiens
ugguguugacauacau

SEQ ID NO: 1591287 - RNA, 23 nt, Homo sapiens
ugguuaaaaguagucauggauaa

SEQ ID NO: 1591288 - RNA, 12 nt, Homo sapiens
ugguuaaaguau

SEQ ID NO: 1591289 - RNA, 12 nt, Homo sapiens
ugguuaaaucau

SEQ ID NO: 1591290 - RNA, 17 nt, Homo sapiens
ugguuacucacaccugu

SEQ ID NO: 1591291 - RNA, 20 nt, Homo sapiens
ugguuaggcagcaagcuuug

SEQ ID NO: 1591292 - RNA, 14 nt, Homo sapiens
ugguuaucuuugag

SEQ ID NO: 1591293 - RNA, 13 nt, Homo sapiens
ugguuaugugcau

SEQ ID NO: 1591294 - RNA, 22 nt, Homo sapiens
ugguucaauuucagaaguaaug

SEQ ID NO: 1591295 - RNA, 17 nt, Homo sapiens
ugguucauuaauucuau

SEQ ID NO: 1591296 - RNA, 13 nt, Homo sapiens
ugguuccaaagac

SEQ ID NO: 1591297 - RNA, 16 nt, Homo sapiens
ugguuccuccacugga

SEQ ID NO: 1591298 - RNA, 20 nt, Homo sapiens
ugguugguuuugacuucaga

SEQ ID NO: 1591299 - RNA, 20 nt, Homo sapiens
ugguuguccccguaccacca

SEQ ID NO: 1591300 - RNA, 20 nt, Homo sapiens
ugguuuauugaaugugauuu

SEQ ID NO: 1591301 - RNA, 22 nt, Homo sapiens
ugguuugggcuccacauugcaa

SEQ ID NO: 1591302 - RNA, 20 nt, Homo sapiens
ugguuuguuauaucagggaa

SEQ ID NO: 1591303 - RNA, 20 nt, Homo sapiens
ugguuuuaaaaaagcauuau

SEQ ID NO: 1591304 - RNA, 14 nt, Homo sapiens
uguaaaaaauggag

SEQ ID NO: 1591305 - RNA, 20 nt, Homo sapiens
uguaaaaugcacccaucagc

SEQ ID NO: 1591306 - RNA, 22 nt, Homo sapiens
uguaaaaugcuuuucacuuucu

SEQ ID NO: 1591307 - RNA, 21 nt, Homo sapiens
uguaaaccuagaguuuuauca

SEQ ID NO: 1591308 - RNA, 14 nt, Homo sapiens
uguaaacuaguacu

SEQ ID NO: 1591309 - RNA, 18 nt, Homo sapiens
uguaaacuaguacuauua

SEQ ID NO: 1591310 - RNA, 11 nt, Homo sapiens
uguaaacugga

SEQ ID NO: 1591311 - RNA, 13 nt, Homo sapiens
uguaaacugugua

SEQ ID NO: 1591312 - RNA, 14 nt, Homo sapiens
uguaaagacugagc

SEQ ID NO: 1591313 - RNA, 18 nt, Homo sapiens
uguaaaggaaacauauuu

SEQ ID NO: 1591314 - RNA, 17 nt, Homo sapiens
uguaaauacacauagca

SEQ ID NO: 1591315 - RNA, 15 nt, Homo sapiens
uguaaaugaaguaca

SEQ ID NO: 1591316 - RNA, 15 nt, Homo sapiens
uguaaaugugacauu

SEQ ID NO: 1591317 - RNA, 12 nt, Homo sapiens
uguaaauguguu

SEQ ID NO: 1591318 - RNA, 11 nt, Homo sapiens
uguaaauugca

SEQ ID NO: 1591319 - RNA, 17 nt, Homo sapiens
uguaaauugcaaauaaa

SEQ ID NO: 1591320 - RNA, 11 nt, Homo sapiens
uguaaccacug

SEQ ID NO: 1591321 - RNA, 12 nt, Homo sapiens
uguaaccacugc

SEQ ID NO: 1591322 - RNA, 13 nt, Homo sapiens
uguaacugucagu

SEQ ID NO: 1591323 - RNA, 19 nt, Homo sapiens
uguaacuuaaauuccaaac

SEQ ID NO: 1591324 - RNA, 14 nt, Homo sapiens
uguaacuuucauac

SEQ ID NO: 1591325 - RNA, 20 nt, Homo sapiens
uguaacuuucauaccacuug

SEQ ID NO: 1591326 - RNA, 15 nt, Homo sapiens
uguaagaacuguaca

SEQ ID NO: 1591327 - RNA, 15 nt, Homo sapiens
uguaaggagccuuuc

SEQ ID NO: 1591328 - RNA, 22 nt, Homo sapiens
uguaaggggaagagggaaaugu

SEQ ID NO: 1591329 - RNA, 20 nt, Homo sapiens
uguaaggugcuugcucccca

SEQ ID NO: 1591330 - RNA, 20 nt, Homo sapiens
uguaauaaagugaacuuugu

SEQ ID NO: 1591331 - RNA, 21 nt, Homo sapiens
uguaauaaagugaacuuuguu

SEQ ID NO: 1591332 - RNA, 15 nt, Homo sapiens
uguaauaagcaauca

SEQ ID NO: 1591333 - RNA, 16 nt, Homo sapiens
uguaauacuucaccuc

SEQ ID NO: 1591334 - RNA, 19 nt, Homo sapiens
uguaaucccagcacuuugg

SEQ ID NO: 1591335 - RNA, 14 nt, Homo sapiens
uguaauccuguaca

SEQ ID NO: 1591336 - RNA, 22 nt, Homo sapiens
uguaauccuguacaauugcauc

SEQ ID NO: 1591337 - RNA, 23 nt, Homo sapiens
uuacaaucgagacugcaauguga

SEQ ID NO: 1591338 - RNA, 17 nt, Homo sapiens
uuacacacaugagggcu

SEQ ID NO: 1591339 - RNA, 19 nt, Homo sapiens
uuacacuauugugaauauu

SEQ ID NO: 1591340 - RNA, 21 nt, Homo sapiens
uuacacuccucguccauuuua

SEQ ID NO: 1591341 - RNA, 17 nt, Homo sapiens
uuacacucuugauucua

SEQ ID NO: 1591342 - RNA, 19 nt, Homo sapiens
uuacacugugucauucugu

SEQ ID NO: 1591343 - RNA, 14 nt, Homo sapiens
uuacagacucugau

SEQ ID NO: 1591344 - RNA, 22 nt, Homo sapiens
uuacagacugaaaggugugaac

SEQ ID NO: 1591345 - RNA, 21 nt, Homo sapiens
uuacagcuacuuuaaccuaug

SEQ ID NO: 1591346 - RNA, 20 nt, Homo sapiens
uuacaggauaucacauugga

SEQ ID NO: 1591347 - RNA, 17 nt, Homo sapiens
uuacaggauuaauauau

SEQ ID NO: 1591348 - RNA, 22 nt, Homo sapiens
uuacaggcacgugccaccacgc

SEQ ID NO: 1591349 - RNA, 14 nt, Homo sapiens
uuacaggggagaaa

SEQ ID NO: 1591350 - RNA, 23 nt, Homo sapiens
uuacaguaggagcccagcucuga

SEQ ID NO: 1591351 - RNA, 20 nt, Homo sapiens
uuacaucuccuugaucaugu

SEQ ID NO: 1591352 - RNA, 20 nt, Homo sapiens
uuacaugaguucaaauacuu

SEQ ID NO: 1591353 - RNA, 21 nt, Homo sapiens
uuacauuuuuugggcagcaau

SEQ ID NO: 1591354 - RNA, 10 nt, Homo sapiens
uuaccaaagc

SEQ ID NO: 1591355 - RNA, 22 nt, Homo sapiens
uuaccaaaugaaaugccaaagg

SEQ ID NO: 1591356 - RNA, 22 nt, Homo sapiens
uuaccagaugcugacuggcacu

SEQ ID NO: 1591357 - RNA, 22 nt, Homo sapiens
uuaccauagaaagaugacaaaa

SEQ ID NO: 1591358 - RNA, 12 nt, Homo sapiens
uuaccaucugaa

SEQ ID NO: 1591359 - RNA, 17 nt, Homo sapiens
uuaccaugcucaaugaa

SEQ ID NO: 1591360 - RNA, 21 nt, Homo sapiens
uuacccaaauauaaccauuua

SEQ ID NO: 1591361 - RNA, 14 nt, Homo sapiens
uuaccccugcacag

SEQ ID NO: 1591362 - RNA, 16 nt, Homo sapiens
uuaccuggugcucuca

SEQ ID NO: 1591363 - RNA, 20 nt, Homo sapiens
uuaccuucuaccucuuggcu

SEQ ID NO: 1591364 - RNA, 16 nt, Homo sapiens
uuaccuuuguucccaa

SEQ ID NO: 1591365 - RNA, 19 nt, Homo sapiens
uuacgaccugucuguucuu

SEQ ID NO: 1591366 - RNA, 20 nt, Homo sapiens
uuacguauguuuguacuugg

SEQ ID NO: 1591367 - RNA, 19 nt, Homo sapiens
uuacuacagcuucagugau

SEQ ID NO: 1591368 - RNA, 19 nt, Homo sapiens
uuacuauacagcauaccac

SEQ ID NO: 1591369 - RNA, 23 nt, Homo sapiens
uuacuauagcaaaguaguacuuc

SEQ ID NO: 1591370 - RNA, 16 nt, Homo sapiens
uuacuaucacacauga

SEQ ID NO: 1591371 - RNA, 17 nt, Homo sapiens
uuacuaucacacaugaa

SEQ ID NO: 1591372 - RNA, 16 nt, Homo sapiens
uuacuaucauggcaua

SEQ ID NO: 1591373 - RNA, 12 nt, Homo sapiens
uuacugcuugac

SEQ ID NO: 1591374 - RNA, 16 nt, Homo sapiens
uuacugcuugaccaaa

SEQ ID NO: 1591375 - RNA, 22 nt, Homo sapiens
uuacuggacaaagaauuccaaa

SEQ ID NO: 1591376 - RNA, 15 nt, Homo sapiens
uuacuguacauacaa

SEQ ID NO: 1591377 - RNA, 23 nt, Homo sapiens
uuacuguacauacaaauucuacu

SEQ ID NO: 1591378 - RNA, 23 nt, Homo sapiens
uuacuguucuaaggcugugccau

SEQ ID NO: 1591379 - RNA, 22 nt, Homo sapiens
uuacuuuagauggcaagcaugu

SEQ ID NO: 1591380 - RNA, 15 nt, Homo sapiens
uuacuuuucugccaa

SEQ ID NO: 1591381 - RNA, 17 nt, Homo sapiens
uuacuuuucugccaaaa

SEQ ID NO: 1591382 - RNA, 23 nt, Homo sapiens
uuacuuuucuguuuaguuuuaca

SEQ ID NO: 1591383 - RNA, 13 nt, Homo sapiens
uuagaaaauauuc

SEQ ID NO: 1591384 - RNA, 17 nt, Homo sapiens
uuagaaacaccauucau

SEQ ID NO: 1591385 - RNA, 17 nt, Homo sapiens
uuagaaacacugcaaau

SEQ ID NO: 1591386 - RNA, 13 nt, Homo sapiens
uuagaaagcuuaa

SEQ ID NO: 1591387 - RNA, 23 nt, Homo sapiens
uuagaaauaaaccuuaauauuuc

SEQ ID NO: 1591388 - RNA, 14 nt, Homo sapiens
uuagaaaugcaaaa

SEQ ID NO: 1591389 - RNA, 12 nt, Homo sapiens
uuagaaauucag

SEQ ID NO: 1591390 - RNA, 16 nt, Homo sapiens
uuagaacugauuacau

SEQ ID NO: 1591391 - RNA, 20 nt, Homo sapiens
uuagaaggacucaguauuau

SEQ ID NO: 1591392 - RNA, 18 nt, Homo sapiens
uuagaauauccaugaccu

SEQ ID NO: 1591393 - RNA, 23 nt, Homo sapiens
uuagaauauccaugaccuaguuu

SEQ ID NO: 1591394 - RNA, 12 nt, Homo sapiens
uuagaauaucug

SEQ ID NO: 1591395 - RNA, 23 nt, Homo sapiens
uuagaaugccgguuaaauuccau

SEQ ID NO: 1591396 - RNA, 15 nt, Homo sapiens
uuagaccgcucucuu

SEQ ID NO: 1591397 - RNA, 17 nt, Homo sapiens
uuagaccuguguuacua

SEQ ID NO: 1591398 - RNA, 16 nt, Homo sapiens
uuagagcuuuaccuaa

SEQ ID NO: 1591399 - RNA, 19 nt, Homo sapiens
uuagaggaggcaacacuga

SEQ ID NO: 1591400 - RNA, 12 nt, Homo sapiens
uuagauauugcu

SEQ ID NO: 1591401 - RNA, 19 nt, Homo sapiens
uuagaucaaauaguugcau

SEQ ID NO: 1591402 - RNA, 24 nt, Homo sapiens
uuagaucaaccuccaacaacgaca

SEQ ID NO: 1591403 - RNA, 23 nt, Homo sapiens
uuagauguucuaagucuuuccau

SEQ ID NO: 1591404 - RNA, 20 nt, Homo sapiens
uuagauugaguaagauuuac

SEQ ID NO: 1591405 - RNA, 16 nt, Homo sapiens
uuagcaaaucaguaua

SEQ ID NO: 1591406 - RNA, 22 nt, Homo sapiens
uuagcaguaacggguagcagca

SEQ ID NO: 1591407 - RNA, 18 nt, Homo sapiens
uuagcauccugccuuaga

SEQ ID NO: 1591408 - RNA, 17 nt, Homo sapiens
uuagcaugcuacaguua

SEQ ID NO: 1591409 - RNA, 15 nt, Homo sapiens
uuagcaugugugacu

SEQ ID NO: 1591410 - RNA, 20 nt, Homo sapiens
uuagccuugcucaggugcaa

SEQ ID NO: 1591411 - RNA, 16 nt, Homo sapiens
uuagcgucaagacauu

SEQ ID NO: 1591412 - RNA, 23 nt, Homo sapiens
uuagcgucaagacauuugcugaa

SEQ ID NO: 1591413 - RNA, 16 nt, Homo sapiens
uuagcuauguugacau

SEQ ID NO: 1591414 - RNA, 20 nt, Homo sapiens
uuagcuuuagaaacagugca

SEQ ID NO: 1591415 - RNA, 17 nt, Homo sapiens
uuaggaauuacuuuauu

SEQ ID NO: 1591416 - RNA, 14 nt, Homo sapiens
uuaggagaugucau

SEQ ID NO: 1591417 - RNA, 15 nt, Homo sapiens
uuaggauccaugcag

SEQ ID NO: 1591418 - RNA, 22 nt, Homo sapiens
uuagggacagucaaaaccaagu

SEQ ID NO: 1591419 - RNA, 16 nt, Homo sapiens
uuagggugaagcauua

SEQ ID NO: 1591420 - RNA, 20 nt, Homo sapiens
uuaggguucugccucuccag

SEQ ID NO: 1591421 - RNA, 18 nt, Homo sapiens
uuaggugagacaguugcc

SEQ ID NO: 1591422 - RNA, 16 nt, Homo sapiens
uuaggugugaggucca

SEQ ID NO: 1591423 - RNA, 22 nt, Homo sapiens
uuaguagagaugggguuucacc

SEQ ID NO: 1591424 - RNA, 20 nt, Homo sapiens
uuaguagucaaaaacaaagc

SEQ ID NO: 1591425 - RNA, 17 nt, Homo sapiens
uuaguccaauuccuugc

SEQ ID NO: 1591426 - RNA, 16 nt, Homo sapiens
uuagucuucaguaugc

SEQ ID NO: 1591427 - RNA, 19 nt, Homo sapiens
uuagucuuuuguaauauca

SEQ ID NO: 1591428 - RNA, 20 nt, Homo sapiens
uuaguggcucaacauugugu

SEQ ID NO: 1591429 - RNA, 23 nt, Homo sapiens
uuaguggguaaagaccagggaug

SEQ ID NO: 1591430 - RNA, 21 nt, Homo sapiens
uuagugucaacuuuuaacuuu

SEQ ID NO: 1591431 - RNA, 14 nt, Homo sapiens
uuaguucucaggca

SEQ ID NO: 1591432 - RNA, 14 nt, Homo sapiens
uuauaaaaguuuau

SEQ ID NO: 1591433 - RNA, 18 nt, Homo sapiens
uuauaaaauaauguacug

SEQ ID NO: 1591434 - RNA, 19 nt, Homo sapiens
uuauaaaucuuucucucac

SEQ ID NO: 1591435 - RNA, 21 nt, Homo sapiens
uuauaaauuucgcuucuuaga

SEQ ID NO: 1591436 - RNA, 19 nt, Homo sapiens
uuauaacguguucaauauu

SEQ ID NO: 1591437 - RNA, 13 nt, Homo sapiens
uuauaacucugua

SEQ ID NO: 1591438 - RNA, 17 nt, Homo sapiens
uuauaagucuuacauaa

SEQ ID NO: 1591439 - RNA, 20 nt, Homo sapiens
uuauaauuguucucagaauc

SEQ ID NO: 1591440 - RNA, 14 nt, Homo sapiens
uuauacagcagaga

SEQ ID NO: 1591441 - RNA, 16 nt, Homo sapiens
uuauaccaguuuucuu

SEQ ID NO: 1591442 - RNA, 16 nt, Homo sapiens
uuauacgcuggcaaca

SEQ ID NO: 1591443 - RNA, 14 nt, Homo sapiens
uuauacuacuuugu

SEQ ID NO: 1591444 - RNA, 13 nt, Homo sapiens
uuauacuguacaa

SEQ ID NO: 1591445 - RNA, 21 nt, Homo sapiens
uuauacuucucuauuaucuca

SEQ ID NO: 1591446 - RNA, 23 nt, Homo sapiens
uuauaggccugucccuugccucu

SEQ ID NO: 1591447 - RNA, 13 nt, Homo sapiens
uuauaguacauga

SEQ ID NO: 1591448 - RNA, 23 nt, Homo sapiens
uuauauaaagguggugggcaaaa

SEQ ID NO: 1591449 - RNA, 17 nt, Homo sapiens
uuauauaaaucauuuca

SEQ ID NO: 1591450 - RNA, 13 nt, Homo sapiens
uuauauaaucaau

SEQ ID NO: 1591451 - RNA, 17 nt, Homo sapiens
uuauauauuaugugaag

SEQ ID NO: 1591452 - RNA, 19 nt, Homo sapiens
uuauaucuguaaugauacu

SEQ ID NO: 1591453 - RNA, 14 nt, Homo sapiens
uuauauuaaucucu

SEQ ID NO: 1591454 - RNA, 19 nt, Homo sapiens
uugcaauuugcaaggauua

SEQ ID NO: 1591455 - RNA, 22 nt, Homo sapiens
uugcacaaguucccuggagaaa

SEQ ID NO: 1591456 - RNA, 22 nt, Homo sapiens
uugcacacaaaaauaaagacua

SEQ ID NO: 1591457 - RNA, 15 nt, Homo sapiens
uugcacagggauucu

SEQ ID NO: 1591458 - RNA, 20 nt, Homo sapiens
uugcacauuaaucagauuag

SEQ ID NO: 1591459 - RNA, 21 nt, Homo sapiens
uugcaccacugcacuccaguc

SEQ ID NO: 1591460 - RNA, 17 nt, Homo sapiens
uugcaccuaucucagcc

SEQ ID NO: 1591461 - RNA, 19 nt, Homo sapiens
uugcaccuaucucagccau

SEQ ID NO: 1591462 - RNA, 13 nt, Homo sapiens
uugcauugccaag

SEQ ID NO: 1591463 - RNA, 18 nt, Homo sapiens
uugccaagaaaaugaagg

SEQ ID NO: 1591464 - RNA, 23 nt, Homo sapiens
uugcccaccacaacuaacaaugc

SEQ ID NO: 1591465 - RNA, 14 nt, Homo sapiens
uugcccacuggccg

SEQ ID NO: 1591466 - RNA, 18 nt, Homo sapiens
uugcccagacuacagggc

SEQ ID NO: 1591467 - RNA, 17 nt, Homo sapiens
uugcccagagaugccuc

SEQ ID NO: 1591468 - RNA, 17 nt, Homo sapiens
uugcccccagacuuccu

SEQ ID NO: 1591469 - RNA, 19 nt, Homo sapiens
uugccccuggcuuugccuc

SEQ ID NO: 1591470 - RNA, 20 nt, Homo sapiens
uugcccgaaacuaagccagg

SEQ ID NO: 1591471 - RNA, 15 nt, Homo sapiens
uugccuccauucucc

SEQ ID NO: 1591472 - RNA, 18 nt, Homo sapiens
uugccucuuuuaccugcu

SEQ ID NO: 1591473 - RNA, 14 nt, Homo sapiens
uugccugcaaaaau

SEQ ID NO: 1591474 - RNA, 20 nt, Homo sapiens
uugccugucaaguuguacau

SEQ ID NO: 1591475 - RNA, 20 nt, Homo sapiens
uugccuuauuggcagcucua

SEQ ID NO: 1591476 - RNA, 15 nt, Homo sapiens
uugccuugggcugcu

SEQ ID NO: 1591477 - RNA, 16 nt, Homo sapiens
uugccuuugaauguua

SEQ ID NO: 1591478 - RNA, 18 nt, Homo sapiens
uugcgcucaggggcucca

SEQ ID NO: 1591479 - RNA, 20 nt, Homo sapiens
uugcgcuggaccugguucuu

SEQ ID NO: 1591480 - RNA, 15 nt, Homo sapiens
uugcggaaugcauug

SEQ ID NO: 1591481 - RNA, 20 nt, Homo sapiens
uugcgucaagucuaaaccaa

SEQ ID NO: 1591482 - RNA, 22 nt, Homo sapiens
uugcgucaagucuaaaccaaga

SEQ ID NO: 1591483 - RNA, 22 nt, Homo sapiens
uugcuaaagacaugaagccacg

SEQ ID NO: 1591484 - RNA, 12 nt, Homo sapiens
uugcuacauucu

SEQ ID NO: 1591485 - RNA, 19 nt, Homo sapiens
uugcuccuggguucaagua

SEQ ID NO: 1591486 - RNA, 15 nt, Homo sapiens
uugcucuaugucugc

SEQ ID NO: 1591487 - RNA, 16 nt, Homo sapiens
uugcucugaccuccuc

SEQ ID NO: 1591488 - RNA, 19 nt, Homo sapiens
uugcucugagaaaguacaa

SEQ ID NO: 1591489 - RNA, 17 nt, Homo sapiens
uugcucuuuucaaugug

SEQ ID NO: 1591490 - RNA, 14 nt, Homo sapiens
uugcugccaaaugc

SEQ ID NO: 1591491 - RNA, 14 nt, Homo sapiens
uugcugcuugugau

SEQ ID NO: 1591492 - RNA, 15 nt, Homo sapiens
uugcuguaugguaua

SEQ ID NO: 1591493 - RNA, 14 nt, Homo sapiens
uugcuguuuacucc

SEQ ID NO: 1591494 - RNA, 15 nt, Homo sapiens
uugcuguuuacuuga

SEQ ID NO: 1591495 - RNA, 22 nt, Homo sapiens
uugcuuaaacccuuuagugcuu

SEQ ID NO: 1591496 - RNA, 15 nt, Homo sapiens
uugcuuauuacauau

SEQ ID NO: 1591497 - RNA, 13 nt, Homo sapiens
uugcuucagugga

SEQ ID NO: 1591498 - RNA, 22 nt, Homo sapiens
uugcuuccuguguaacaucugc

SEQ ID NO: 1591499 - RNA, 10 nt, Homo sapiens
uugcuucuag

SEQ ID NO: 1591500 - RNA, 16 nt, Homo sapiens
uugcuugagcaggauu

SEQ ID NO: 1591501 - RNA, 15 nt, Homo sapiens
uugcuuuauuccaga

SEQ ID NO: 1591502 - RNA, 11 nt, Homo sapiens
uugcuuucuau

SEQ ID NO: 1591503 - RNA, 13 nt, Homo sapiens
uugcuuugccaaa

SEQ ID NO: 1591504 - RNA, 17 nt, Homo sapiens
uugcuuuugacuccagg

SEQ ID NO: 1591505 - RNA, 16 nt, Homo sapiens
uugcuuuuuuuccaau

SEQ ID NO: 1591506 - RNA, 21 nt, Homo sapiens
uuggaaauagaaagaagccau

SEQ ID NO: 1591507 - RNA, 12 nt, Homo sapiens
uuggaaauggau

SEQ ID NO: 1591508 - RNA, 17 nt, Homo sapiens
uuggaacuuacauacau

SEQ ID NO: 1591509 - RNA, 21 nt, Homo sapiens
uuggaacuuuuauuacugggg

SEQ ID NO: 1591510 - RNA, 21 nt, Homo sapiens
uuggaagaggaacagcacugg

SEQ ID NO: 1591511 - RNA, 17 nt, Homo sapiens
uuggaaggcugaggcag

SEQ ID NO: 1591512 - RNA, 13 nt, Homo sapiens
uuggaagucuaag

SEQ ID NO: 1591513 - RNA, 12 nt, Homo sapiens
uuggaauaucuc

SEQ ID NO: 1591514 - RNA, 14 nt, Homo sapiens
uuggacaaccucau

SEQ ID NO: 1591515 - RNA, 17 nt, Homo sapiens
uuggacagcugauaaau

SEQ ID NO: 1591516 - RNA, 17 nt, Homo sapiens
uuggacccaaaaaauca

SEQ ID NO: 1591517 - RNA, 18 nt, Homo sapiens
uuggacccaaaaaaucau

SEQ ID NO: 1591518 - RNA, 16 nt, Homo sapiens
uuggaccguaucacug

SEQ ID NO: 1591519 - RNA, 14 nt, Homo sapiens
uuggacugucuaua

SEQ ID NO: 1591520 - RNA, 12 nt, Homo sapiens
uuggaggcaauc

SEQ ID NO: 1591521 - RNA, 14 nt, Homo sapiens
uuggagggucccaa

SEQ ID NO: 1591522 - RNA, 13 nt, Homo sapiens
uuggcacuguaag

SEQ ID NO: 1591523 - RNA, 23 nt, Homo sapiens
uuggcagcucuacucuggagguu

SEQ ID NO: 1591524 - RNA, 17 nt, Homo sapiens
uuggcauaauagucaau

SEQ ID NO: 1591525 - RNA, 12 nt, Homo sapiens
uuggcauacaaa

SEQ ID NO: 1591526 - RNA, 16 nt, Homo sapiens
uuggccacacacugag

SEQ ID NO: 1591527 - RNA, 14 nt, Homo sapiens
uuggccgagcuccu

SEQ ID NO: 1591528 - RNA, 13 nt, Homo sapiens
uuggccucuccuu

SEQ ID NO: 1591529 - RNA, 17 nt, Homo sapiens
uuggcuugauaaacaua

SEQ ID NO: 1591530 - RNA, 12 nt, Homo sapiens
uuggcuuucaua

SEQ ID NO: 1591531 - RNA, 16 nt, Homo sapiens
uugggacccccuucaa

SEQ ID NO: 1591532 - RNA, 14 nt, Homo sapiens
uugggagcugccaa

SEQ ID NO: 1591533 - RNA, 20 nt, Homo sapiens
uugggauauccuuucacucu

SEQ ID NO: 1591534 - RNA, 23 nt, Homo sapiens
uugggauauccuuucacucugca

SEQ ID NO: 1591535 - RNA, 20 nt, Homo sapiens
uugggauugagucugugcca

SEQ ID NO: 1591536 - RNA, 13 nt, Homo sapiens
uugggcaagccaa

SEQ ID NO: 1591537 - RNA, 20 nt, Homo sapiens
uugggccucccuggcacuga

SEQ ID NO: 1591538 - RNA, 17 nt, Homo sapiens
uugggcgggacauccuc

SEQ ID NO: 1591539 - RNA, 17 nt, Homo sapiens
uugggcucucuucuguc

SEQ ID NO: 1591540 - RNA, 16 nt, Homo sapiens
uuggggcuuuacauac

SEQ ID NO: 1591541 - RNA, 18 nt, Homo sapiens
uugggggggccaaaagga

SEQ ID NO: 1591542 - RNA, 11 nt, Homo sapiens
uuggguucucu

SEQ ID NO: 1591543 - RNA, 16 nt, Homo sapiens
uugguacacauguguu

SEQ ID NO: 1591544 - RNA, 13 nt, Homo sapiens
uugguacugugau

SEQ ID NO: 1591545 - RNA, 15 nt, Homo sapiens
uugguagaugacaaa

SEQ ID NO: 1591546 - RNA, 23 nt, Homo sapiens
uugguaucuacuucuacauccaa

SEQ ID NO: 1591547 - RNA, 11 nt, Homo sapiens
uuggucuguag

SEQ ID NO: 1591548 - RNA, 16 nt, Homo sapiens
uuggugcugcuuucuu

SEQ ID NO: 1591549 - RNA, 19 nt, Homo sapiens
uuggugugugugacaauuc

SEQ ID NO: 1591550 - RNA, 17 nt, Homo sapiens
uugguuagugacugaug

SEQ ID NO: 1591551 - RNA, 15 nt, Homo sapiens
uugguugcauccagg

SEQ ID NO: 1591552 - RNA, 15 nt, Homo sapiens
uugguuguacuuugg

SEQ ID NO: 1591553 - RNA, 20 nt, Homo sapiens
uuguaaaacaaaauuugacu

SEQ ID NO: 1591554 - RNA, 14 nt, Homo sapiens
uuguaaacauacau

SEQ ID NO: 1591555 - RNA, 22 nt, Homo sapiens
uuguaaaggauaucaaugccuu

SEQ ID NO: 1591556 - RNA, 15 nt, Homo sapiens
uuguaaauaggauuu

SEQ ID NO: 1591557 - RNA, 22 nt, Homo sapiens
uuguaacgacuucuccaucucc

SEQ ID NO: 1591558 - RNA, 13 nt, Homo sapiens
uuguaacuccacc

SEQ ID NO: 1591559 - RNA, 16 nt, Homo sapiens
uuguaauaaaccacgc

SEQ ID NO: 1591560 - RNA, 14 nt, Homo sapiens
uuguaauaagcaau

SEQ ID NO: 1591561 - RNA, 19 nt, Homo sapiens
uuguaauuuugcaaaacau

SEQ ID NO: 1591562 - RNA, 11 nt, Homo sapiens
uuguacaguuc

SEQ ID NO: 1591563 - RNA, 16 nt, Homo sapiens
uuguaccugacuucca

SEQ ID NO: 1591564 - RNA, 11 nt, Homo sapiens
uuguacugcuu

SEQ ID NO: 1591565 - RNA, 16 nt, Homo sapiens
uuguacuguaucuauu

SEQ ID NO: 1591566 - RNA, 17 nt, Homo sapiens
uuguagacaaaguacau

SEQ ID NO: 1591567 - RNA, 22 nt, Homo sapiens
uuguauaaacauaaacuguaug

SEQ ID NO: 1591568 - RNA, 21 nt, Homo sapiens
uuguauaaaugcaauaagaaa

SEQ ID NO: 1591569 - RNA, 19 nt, Homo sapiens
uuguaugcauggaaacaug

SEQ ID NO: 1591570 - RNA, 12 nt, Homo sapiens
uuguaugccaau

SEQ ID NO: 1591571 - RNA, 15 nt, Homo sapiens
uuguauuaccauuac

SEQ ID NO: 1591572 - RNA, 15 nt, Homo sapiens
uuguauuaugcugga

SEQ ID NO: 1591573 - RNA, 15 nt, Homo sapiens
uuguauuuaaggauu

SEQ ID NO: 1591574 - RNA, 12 nt, Homo sapiens
aaaaaacagugg

SEQ ID NO: 1591575 - RNA, 19 nt, Homo sapiens
aaguuucuggugccauuuc

SEQ ID NO: 1591576 - RNA, 15 nt, Homo sapiens
aaguuugaagcacaa

SEQ ID NO: 1591577 - RNA, 17 nt, Homo sapiens
aaguuuuaauaccuaag

SEQ ID NO: 1591578 - RNA, 14 nt, Homo sapiens
aaguuuuacauugu

SEQ ID NO: 1591579 - RNA, 16 nt, Homo sapiens
aaguuuucuaaacuca

SEQ ID NO: 1591580 - RNA, 17 nt, Homo sapiens
aaguuuugcaacaauaa

SEQ ID NO: 1591581 - RNA, 20 nt, Homo sapiens
aaguuuuucauacuguacac

SEQ ID NO: 1591582 - RNA, 14 nt, Homo sapiens
aauaaaaacaucag

SEQ ID NO: 1591583 - RNA, 12 nt, Homo sapiens
aauaaaacauca

SEQ ID NO: 1591584 - RNA, 13 nt, Homo sapiens
aauaaaagcacaa

SEQ ID NO: 1591585 - RNA, 20 nt, Homo sapiens
aauaaaauaugagagcaaua

SEQ ID NO: 1591586 - RNA, 16 nt, Homo sapiens
aauaaaauguuucucu

SEQ ID NO: 1591587 - RNA, 18 nt, Homo sapiens
aauaaacaagucaaagac

SEQ ID NO: 1591588 - RNA, 12 nt, Homo sapiens
aauaaaccacaa

SEQ ID NO: 1591589 - RNA, 13 nt, Homo sapiens
aauaaacccucag

SEQ ID NO: 1591590 - RNA, 14 nt, Homo sapiens
aauaaacugugcaa

SEQ ID NO: 1591591 - RNA, 20 nt, Homo sapiens
aauaaacuguguuuacucag

SEQ ID NO: 1591592 - RNA, 21 nt, Homo sapiens
aauaaagaaugccauuucuca

SEQ ID NO: 1591593 - RNA, 18 nt, Homo sapiens
aauaaagaucacagagca

SEQ ID NO: 1591594 - RNA, 15 nt, Homo sapiens
aauaaagccuuugau

SEQ ID NO: 1591595 - RNA, 20 nt, Homo sapiens
aauaaaggaugugauugugg

SEQ ID NO: 1591596 - RNA, 11 nt, Homo sapiens
aauaaagggac

SEQ ID NO: 1591597 - RNA, 15 nt, Homo sapiens
aauaaaguauuccac

SEQ ID NO: 1591598 - RNA, 16 nt, Homo sapiens
aauaaagugaacuuug

SEQ ID NO: 1591599 - RNA, 18 nt, Homo sapiens
aauaaaguucuguacuca

SEQ ID NO: 1591600 - RNA, 17 nt, Homo sapiens
aauaaaguuuccauuag

SEQ ID NO: 1591601 - RNA, 16 nt, Homo sapiens
aauaaaucaaauauuc

SEQ ID NO: 1591602 - RNA, 16 nt, Homo sapiens
aauaaaugacaaugua

SEQ ID NO: 1591603 - RNA, 20 nt, Homo sapiens
aauaaauuuucaaauccuua

SEQ ID NO: 1591604 - RNA, 23 nt, Homo sapiens
aauaacauuuaaauuccacagau

SEQ ID NO: 1591605 - RNA, 13 nt, Homo sapiens
aauaaccaauccu

SEQ ID NO: 1591606 - RNA, 22 nt, Homo sapiens
aauaacuaagcaaguauauuua

SEQ ID NO: 1591607 - RNA, 21 nt, Homo sapiens
aauaagaauucagacaucuga

SEQ ID NO: 1591608 - RNA, 21 nt, Homo sapiens
aauaagauauuuaguaauauu

SEQ ID NO: 1591609 - RNA, 21 nt, Homo sapiens
aauaagauuuaguugaguuau

SEQ ID NO: 1591610 - RNA, 14 nt, Homo sapiens
aauaagcaggaugu

SEQ ID NO: 1591611 - RNA, 21 nt, Homo sapiens
aauaagcuaaacgcaauguca

SEQ ID NO: 1591612 - RNA, 20 nt, Homo sapiens
aauaagucaucugaugagaa

SEQ ID NO: 1591613 - RNA, 23 nt, Homo sapiens
aauaaguuaaucaggaacuguac

SEQ ID NO: 1591614 - RNA, 15 nt, Homo sapiens
aauaaucaaccuggg

SEQ ID NO: 1591615 - RNA, 16 nt, Homo sapiens
aauaaugaacacuaca

SEQ ID NO: 1591616 - RNA, 12 nt, Homo sapiens
aauaaugcagua

SEQ ID NO: 1591617 - RNA, 16 nt, Homo sapiens
aauaaugccaaugaac

SEQ ID NO: 1591618 - RNA, 22 nt, Homo sapiens
aauaaugcuggauggccugagg

SEQ ID NO: 1591619 - RNA, 14 nt, Homo sapiens
aauaaugugaauga

SEQ ID NO: 1591620 - RNA, 15 nt, Homo sapiens
aauaauuuccuccac

SEQ ID NO: 1591621 - RNA, 13 nt, Homo sapiens
aauacaaccagcc

SEQ ID NO: 1591622 - RNA, 14 nt, Homo sapiens
aauacaagaaccaa

SEQ ID NO: 1591623 - RNA, 16 nt, Homo sapiens
aauacaagaaccaagg

SEQ ID NO: 1591624 - RNA, 16 nt, Homo sapiens
aauacacuuauuucag

SEQ ID NO: 1591625 - RNA, 22 nt, Homo sapiens
aauacacuuauuucagccaaaa

SEQ ID NO: 1591626 - RNA, 18 nt, Homo sapiens
aauacagacaaagcauaa

SEQ ID NO: 1591627 - RNA, 16 nt, Homo sapiens
aauacagcagaacucc

SEQ ID NO: 1591628 - RNA, 18 nt, Homo sapiens
aauacaguauuauagaca

SEQ ID NO: 1591629 - RNA, 13 nt, Homo sapiens
aauacagucuucc

SEQ ID NO: 1591630 - RNA, 21 nt, Homo sapiens
aauacagucuuccauuugcaa

SEQ ID NO: 1591631 - RNA, 23 nt, Homo sapiens
aauacauuaaaauaacuaagcaa

SEQ ID NO: 1591632 - RNA, 13 nt, Homo sapiens
aauaccaauguuc

SEQ ID NO: 1591633 - RNA, 15 nt, Homo sapiens
aauaccauguacaua

SEQ ID NO: 1591634 - RNA, 15 nt, Homo sapiens
aauaccuuggucuca

SEQ ID NO: 1591635 - RNA, 21 nt, Homo sapiens
aauacguacuuuagcuggaau

SEQ ID NO: 1591636 - RNA, 21 nt, Homo sapiens
aauacuaaggaaccaacaauc

SEQ ID NO: 1591637 - RNA, 13 nt, Homo sapiens
aauacuacaauag

SEQ ID NO: 1591638 - RNA, 15 nt, Homo sapiens
aauacuacaauaguu

SEQ ID NO: 1591639 - RNA, 18 nt, Homo sapiens
aauacuaugcaguaucuc

SEQ ID NO: 1591640 - RNA, 13 nt, Homo sapiens
aauacuggccaug

SEQ ID NO: 1591641 - RNA, 15 nt, Homo sapiens
aauacuguacagggg

SEQ ID NO: 1591642 - RNA, 18 nt, Homo sapiens
aauacuuuacaaaccauu

SEQ ID NO: 1591643 - RNA, 16 nt, Homo sapiens
aauacuuuucuucccc

SEQ ID NO: 1591644 - RNA, 18 nt, Homo sapiens
aauacuuuuuacaauuaa

SEQ ID NO: 1591645 - RNA, 15 nt, Homo sapiens
aauagaacaaccugc

SEQ ID NO: 1591646 - RNA, 14 nt, Homo sapiens
aauagacaaaaagu

SEQ ID NO: 1591647 - RNA, 20 nt, Homo sapiens
aauagauauuuuaaggguaa

SEQ ID NO: 1591648 - RNA, 14 nt, Homo sapiens
aauagcaugcaaaa

SEQ ID NO: 1591649 - RNA, 15 nt, Homo sapiens
aauagccacauuugg

SEQ ID NO: 1591650 - RNA, 17 nt, Homo sapiens
aauagccacauuuggaa

SEQ ID NO: 1591651 - RNA, 18 nt, Homo sapiens
aauagcugccuucaagga

SEQ ID NO: 1591652 - RNA, 19 nt, Homo sapiens
aauagcugccuucaaggac

SEQ ID NO: 1591653 - RNA, 22 nt, Homo sapiens
aauagcugccuucaaggacugu

SEQ ID NO: 1591654 - RNA, 17 nt, Homo sapiens
aauagcuguaaacuucc

SEQ ID NO: 1591655 - RNA, 18 nt, Homo sapiens
aauagcuguaaacuucca

SEQ ID NO: 1591656 - RNA, 18 nt, Homo sapiens
aauagcuguaguuuuccc

SEQ ID NO: 1591657 - RNA, 14 nt, Homo sapiens
aauaggcaucucca

SEQ ID NO: 1591658 - RNA, 20 nt, Homo sapiens
aauagggcuaaauguuuaaa

SEQ ID NO: 1591659 - RNA, 16 nt, Homo sapiens
aauaguaaacuaaagu

SEQ ID NO: 1591660 - RNA, 15 nt, Homo sapiens
aauaguauacauugu

SEQ ID NO: 1591661 - RNA, 19 nt, Homo sapiens
aauagugaauaaagucauu

SEQ ID NO: 1591662 - RNA, 15 nt, Homo sapiens
aauagugucauccuc

SEQ ID NO: 1591663 - RNA, 20 nt, Homo sapiens
aauaguguccuaugcaauaa

SEQ ID NO: 1591664 - RNA, 14 nt, Homo sapiens
aauauaaacuauaa

SEQ ID NO: 1591665 - RNA, 14 nt, Homo sapiens
aauauacauucaaa

SEQ ID NO: 1591666 - RNA, 20 nt, Homo sapiens
aauauacuuuuuuuguuaua

SEQ ID NO: 1591667 - RNA, 12 nt, Homo sapiens
aaugcuccccac

SEQ ID NO: 1591668 - RNA, 22 nt, Homo sapiens
aaugcucuucaaaauaaaacau

SEQ ID NO: 1591669 - RNA, 17 nt, Homo sapiens
aaugcuuuccaucucca

SEQ ID NO: 1591670 - RNA, 14 nt, Homo sapiens
aauggacuguuaca

SEQ ID NO: 1591671 - RNA, 22 nt, Homo sapiens
aauggaggaacuuuccaaacac

SEQ ID NO: 1591672 - RNA, 16 nt, Homo sapiens
aauggcgcgaucucag

SEQ ID NO: 1591673 - RNA, 21 nt, Homo sapiens
aauggcuaagcaaaaugugau

SEQ ID NO: 1591674 - RNA, 16 nt, Homo sapiens
aaugggcacaaaaugg

SEQ ID NO: 1591675 - RNA, 17 nt, Homo sapiens
aaugguacacaauguga

SEQ ID NO: 1591676 - RNA, 17 nt, Homo sapiens
aauggucucuaccuaau

SEQ ID NO: 1591677 - RNA, 18 nt, Homo sapiens
aaugguguaauuuugucc

SEQ ID NO: 1591678 - RNA, 23 nt, Homo sapiens
aaugguuggguugauuguauguu

SEQ ID NO: 1591679 - RNA, 23 nt, Homo sapiens
aaugguuucacuugcucuuugac

SEQ ID NO: 1591680 - RNA, 20 nt, Homo sapiens
aauguaaggagccuuuccag

SEQ ID NO: 1591681 - RNA, 22 nt, Homo sapiens
aauguaagggaaacugccagca

SEQ ID NO: 1591682 - RNA, 20 nt, Homo sapiens
aauguaauaaagugaacuuu

SEQ ID NO: 1591683 - RNA, 20 nt, Homo sapiens
aauguacaaaaagaacaaua

SEQ ID NO: 1591684 - RNA, 17 nt, Homo sapiens
aauguacagacauauuu

SEQ ID NO: 1591685 - RNA, 21 nt, Homo sapiens
aauguacugaauucuuuaucc

SEQ ID NO: 1591686 - RNA, 22 nt, Homo sapiens
aauguauaaaaauuaucaaaaa

SEQ ID NO: 1591687 - RNA, 15 nt, Homo sapiens
aauguauacaaugca

SEQ ID NO: 1591688 - RNA, 15 nt, Homo sapiens
aauguauguacaaua

SEQ ID NO: 1591689 - RNA, 14 nt, Homo sapiens
aauguaugugcaca

SEQ ID NO: 1591690 - RNA, 15 nt, Homo sapiens
aauguaugugcacau

SEQ ID NO: 1591691 - RNA, 19 nt, Homo sapiens
aaugucaauacuuacuucu

SEQ ID NO: 1591692 - RNA, 14 nt, Homo sapiens
aaugucaccaccuu

SEQ ID NO: 1591693 - RNA, 17 nt, Homo sapiens
aaugucaguauguggaa

SEQ ID NO: 1591694 - RNA, 18 nt, Homo sapiens
aaugucuauuuccaagaa

SEQ ID NO: 1591695 - RNA, 20 nt, Homo sapiens
aaugucuguauuucauucuu

SEQ ID NO: 1591696 - RNA, 19 nt, Homo sapiens
aaugucuugaugcaugcac

SEQ ID NO: 1591697 - RNA, 19 nt, Homo sapiens
aaugucuugcuguugacau

SEQ ID NO: 1591698 - RNA, 16 nt, Homo sapiens
aaugugaaauguaacu

SEQ ID NO: 1591699 - RNA, 20 nt, Homo sapiens
aaugugacauuauaugcacu

SEQ ID NO: 1591700 - RNA, 14 nt, Homo sapiens
aaugugacauugau

SEQ ID NO: 1591701 - RNA, 13 nt, Homo sapiens
aaugugacucagc

SEQ ID NO: 1591702 - RNA, 16 nt, Homo sapiens
aaugugaggcaauaag

SEQ ID NO: 1591703 - RNA, 15 nt, Homo sapiens
aaugugcccaaagcu

SEQ ID NO: 1591704 - RNA, 17 nt, Homo sapiens
aauguggccaagccuau

SEQ ID NO: 1591705 - RNA, 18 nt, Homo sapiens
aaugugugaaguaugcac

SEQ ID NO: 1591706 - RNA, 16 nt, Homo sapiens
aauguguucuuuucuc

SEQ ID NO: 1591707 - RNA, 14 nt, Homo sapiens
aauguguuggcuca

SEQ ID NO: 1591708 - RNA, 18 nt, Homo sapiens
aauguuaauggucaaugc

SEQ ID NO: 1591709 - RNA, 13 nt, Homo sapiens
aauguuccugaaa

SEQ ID NO: 1591710 - RNA, 14 nt, Homo sapiens
aauguuccugaaaa

SEQ ID NO: 1591711 - RNA, 17 nt, Homo sapiens
aauguucuccagucauu

SEQ ID NO: 1591712 - RNA, 21 nt, Homo sapiens
aauguucuccagucauuaugu

SEQ ID NO: 1591713 - RNA, 15 nt, Homo sapiens
aauguugcaauguga

SEQ ID NO: 1591714 - RNA, 21 nt, Homo sapiens
aauguugcauuuaugaugcag

SEQ ID NO: 1591715 - RNA, 17 nt, Homo sapiens
aauguuggauaaggaau

SEQ ID NO: 1591716 - RNA, 21 nt, Homo sapiens
aauguuuaaauucucuuucac

SEQ ID NO: 1591717 - RNA, 14 nt, Homo sapiens
aauguuuaccauga

SEQ ID NO: 1591718 - RNA, 21 nt, Homo sapiens
aauguuuauuaaaugcuucau

SEQ ID NO: 1591719 - RNA, 15 nt, Homo sapiens
aauguuucuacagau

SEQ ID NO: 1591720 - RNA, 22 nt, Homo sapiens
aauguuuguuuauaucacuguc

SEQ ID NO: 1591721 - RNA, 19 nt, Homo sapiens
aauguuuuccccaaaccau

SEQ ID NO: 1591722 - RNA, 17 nt, Homo sapiens
aauguuuucuuugcaaa

SEQ ID NO: 1591723 - RNA, 21 nt, Homo sapiens
aauguuuuucccuccccagaa

SEQ ID NO: 1591724 - RNA, 23 nt, Homo sapiens
aauuaaaaguuugaaaagcaaua

SEQ ID NO: 1591725 - RNA, 19 nt, Homo sapiens
aauuaaaauccucaaucca

SEQ ID NO: 1591726 - RNA, 18 nt, Homo sapiens
aauuaaaauggaugccuu

SEQ ID NO: 1591727 - RNA, 16 nt, Homo sapiens
aauuaaacuaguuuaa

SEQ ID NO: 1591728 - RNA, 14 nt, Homo sapiens
aauuaaauacauaa

SEQ ID NO: 1591729 - RNA, 19 nt, Homo sapiens
aauuaacaaagaauuucag

SEQ ID NO: 1591730 - RNA, 14 nt, Homo sapiens
aauuaacacaugau

SEQ ID NO: 1591731 - RNA, 16 nt, Homo sapiens
aauuaagauuauguga

SEQ ID NO: 1591732 - RNA, 17 nt, Homo sapiens
aauuacaauacaucuaa

SEQ ID NO: 1591733 - RNA, 22 nt, Homo sapiens
aauuacaauacaucuaagcuau

SEQ ID NO: 1591734 - RNA, 20 nt, Homo sapiens
aauuacaauugaucugucau

SEQ ID NO: 1591735 - RNA, 19 nt, Homo sapiens
aauuacagggugacucaca

SEQ ID NO: 1591736 - RNA, 13 nt, Homo sapiens
aauuacauacuau

SEQ ID NO: 1591737 - RNA, 14 nt, Homo sapiens
aauuaccaguuuuc

SEQ ID NO: 1591738 - RNA, 14 nt, Homo sapiens
aauuacugccuuac

SEQ ID NO: 1591739 - RNA, 19 nt, Homo sapiens
aauuacuuugauuccauuu

SEQ ID NO: 1591740 - RNA, 16 nt, Homo sapiens
aauuagauccauuaau

SEQ ID NO: 1591741 - RNA, 22 nt, Homo sapiens
aauuagccauuucacucucaaa

SEQ ID NO: 1591742 - RNA, 10 nt, Homo sapiens
aauuaggcag

SEQ ID NO: 1591743 - RNA, 12 nt, Homo sapiens
aauuaguuucaa

SEQ ID NO: 1591744 - RNA, 14 nt, Homo sapiens
aauuauaaucucuu

SEQ ID NO: 1591745 - RNA, 20 nt, Homo sapiens
aauuauauaaaucauuucaa

SEQ ID NO: 1591746 - RNA, 22 nt, Homo sapiens
aauuaugaaaacucaugaucaa

SEQ ID NO: 1591747 - RNA, 16 nt, Homo sapiens
aauuauguguugccaa

SEQ ID NO: 1591748 - RNA, 21 nt, Homo sapiens
aauuauguguugccaaaacca

SEQ ID NO: 1591749 - RNA, 22 nt, Homo sapiens
aauuauuauauacauacugcau

SEQ ID NO: 1591750 - RNA, 16 nt, Homo sapiens
aauuauugauguuuuc

SEQ ID NO: 1591751 - RNA, 13 nt, Homo sapiens
aauucaaaaguga

SEQ ID NO: 1591752 - RNA, 15 nt, Homo sapiens
aauucagaugcuguu

SEQ ID NO: 1591753 - RNA, 14 nt, Homo sapiens
aauucagcacuuaa

SEQ ID NO: 1591754 - RNA, 13 nt, Homo sapiens
aauucagcauuug

SEQ ID NO: 1591755 - RNA, 23 nt, Homo sapiens
aauucagggucccuggagaucau

SEQ ID NO: 1591756 - RNA, 21 nt, Homo sapiens
aauucauuucuagacucaaaa

SEQ ID NO: 1591757 - RNA, 21 nt, Homo sapiens
aauucauuuuuuaaagccagu

SEQ ID NO: 1591758 - RNA, 19 nt, Homo sapiens
aauucauuuuuuaaauucc

SEQ ID NO: 1591759 - RNA, 11 nt, Homo sapiens
aauuccaaagc

SEQ ID NO: 1591760 - RNA, 20 nt, Homo sapiens
aauauuuuacauacacugua

SEQ ID NO: 1591761 - RNA, 22 nt, Homo sapiens
aauauuuuagauuacaggauua

SEQ ID NO: 1591762 - RNA, 12 nt, Homo sapiens
aauauuuuccau

SEQ ID NO: 1591763 - RNA, 18 nt, Homo sapiens
aauauuuucucuguacuu

SEQ ID NO: 1591764 - RNA, 19 nt, Homo sapiens
aauauuuucugcaauccaa

SEQ ID NO: 1591765 - RNA, 21 nt, Homo sapiens
aauauuuuguaaugcugcaca

SEQ ID NO: 1591766 - RNA, 20 nt, Homo sapiens
aaucaaauaugcaaagcacu

SEQ ID NO: 1591767 - RNA, 14 nt, Homo sapiens
aaucaacaccuuaa

SEQ ID NO: 1591768 - RNA, 19 nt, Homo sapiens
aaucaaucauuucuauuaa

SEQ ID NO: 1591769 - RNA, 22 nt, Homo sapiens
aaucacaaaggcugacauucac

SEQ ID NO: 1591770 - RNA, 12 nt, Homo sapiens
aaucacaucucc

SEQ ID NO: 1591771 - RNA, 17 nt, Homo sapiens
aaucagaacuguuggca

SEQ ID NO: 1591772 - RNA, 12 nt, Homo sapiens
aaucagcacucu

SEQ ID NO: 1591773 - RNA, 14 nt, Homo sapiens
aaucagcacucugu

SEQ ID NO: 1591774 - RNA, 18 nt, Homo sapiens
aaucagcucaaucuucaa

SEQ ID NO: 1591775 - RNA, 18 nt, Homo sapiens
aaucagucggcagucaug

SEQ ID NO: 1591776 - RNA, 12 nt, Homo sapiens
aaucaguuuaaa

SEQ ID NO: 1591777 - RNA, 19 nt, Homo sapiens
aaucauacaaacucucacc

SEQ ID NO: 1591778 - RNA, 16 nt, Homo sapiens
aaucaucaaguaauac

SEQ ID NO: 1591779 - RNA, 22 nt, Homo sapiens
aaucauccauccuugccaauag

SEQ ID NO: 1591780 - RNA, 17 nt, Homo sapiens
aaucaugagcaagugaa

SEQ ID NO: 1591781 - RNA, 22 nt, Homo sapiens
aaucaugcucauguauauuuag

SEQ ID NO: 1591782 - RNA, 21 nt, Homo sapiens
aaucauguugaucauguacuu

SEQ ID NO: 1591783 - RNA, 20 nt, Homo sapiens
aaucauuguauguggucaug

SEQ ID NO: 1591784 - RNA, 22 nt, Homo sapiens
aaucauuuauuuacaugugauu

SEQ ID NO: 1591785 - RNA, 16 nt, Homo sapiens
aaucauuucugcauca

SEQ ID NO: 1591786 - RNA, 21 nt, Homo sapiens
aaucauuuguuuacauuugau

SEQ ID NO: 1591787 - RNA, 20 nt, Homo sapiens
aaucauuuucauuccuaaag

SEQ ID NO: 1591788 - RNA, 23 nt, Homo sapiens
aauccaggaauuaaaucaucccu

SEQ ID NO: 1591789 - RNA, 21 nt, Homo sapiens
aauccaggcuuuauguacaaa

SEQ ID NO: 1591790 - RNA, 20 nt, Homo sapiens
aauccaguaggauccaguga

SEQ ID NO: 1591791 - RNA, 17 nt, Homo sapiens
aauccagugagcacuag

SEQ ID NO: 1591792 - RNA, 15 nt, Homo sapiens
aaucccagcuacuug

SEQ ID NO: 1591793 - RNA, 16 nt, Homo sapiens
aaucccaucucuacaa

SEQ ID NO: 1591794 - RNA, 11 nt, Homo sapiens
aauccccagac

SEQ ID NO: 1591795 - RNA, 21 nt, Homo sapiens
aauccggucagccaagugcag

SEQ ID NO: 1591796 - RNA, 12 nt, Homo sapiens
aauccucaggaa

SEQ ID NO: 1591797 - RNA, 18 nt, Homo sapiens
aauccugaacuuucuccc

SEQ ID NO: 1591798 - RNA, 22 nt, Homo sapiens
aauccuggaaggacacagugau

SEQ ID NO: 1591799 - RNA, 13 nt, Homo sapiens
aauccuggaccaa

SEQ ID NO: 1591800 - RNA, 21 nt, Homo sapiens
aauccuguuuuuagugcugac

SEQ ID NO: 1591801 - RNA, 24 nt, Homo sapiens
aauccuuauuuccucauagacuua

SEQ ID NO: 1591802 - RNA, 19 nt, Homo sapiens
aauccuucuauucuagccu

SEQ ID NO: 1591803 - RNA, 19 nt, Homo sapiens
aaucggcuggggacugcua

SEQ ID NO: 1591804 - RNA, 13 nt, Homo sapiens
aaucuaaccacuu

SEQ ID NO: 1591805 - RNA, 14 nt, Homo sapiens
aaucuaaccacuua

SEQ ID NO: 1591806 - RNA, 13 nt, Homo sapiens
aaucuaccaagaa

SEQ ID NO: 1591807 - RNA, 16 nt, Homo sapiens
aaucuacuaauuccac

SEQ ID NO: 1591808 - RNA, 22 nt, Homo sapiens
aaucuacugaauuggcuuccag

SEQ ID NO: 1591809 - RNA, 14 nt, Homo sapiens
aaucuacuguauca

SEQ ID NO: 1591810 - RNA, 21 nt, Homo sapiens
aaucuagaauuuagugauacu

SEQ ID NO: 1591811 - RNA, 14 nt, Homo sapiens
aaucucacuacaca

SEQ ID NO: 1591812 - RNA, 13 nt, Homo sapiens
aaucucagcacuu

SEQ ID NO: 1591813 - RNA, 14 nt, Homo sapiens
aaucucagcacuuu

SEQ ID NO: 1591814 - RNA, 22 nt, Homo sapiens
aaucucaguagcugauucugaa

SEQ ID NO: 1591815 - RNA, 15 nt, Homo sapiens
aaucuccaguacuug

SEQ ID NO: 1591816 - RNA, 16 nt, Homo sapiens
aaucucuccauucccg

SEQ ID NO: 1591817 - RNA, 22 nt, Homo sapiens
aaucucuucuuugcugcaguca

SEQ ID NO: 1591818 - RNA, 19 nt, Homo sapiens
aaucugaccguucuauugu

SEQ ID NO: 1591819 - RNA, 23 nt, Homo sapiens
aaucugagaggccacagugcaau

SEQ ID NO: 1591820 - RNA, 18 nt, Homo sapiens
aaucugagagucauucag

SEQ ID NO: 1591821 - RNA, 19 nt, Homo sapiens
aaucugagagucauucagg

SEQ ID NO: 1591822 - RNA, 13 nt, Homo sapiens
aaucugcaaggac

SEQ ID NO: 1591823 - RNA, 16 nt, Homo sapiens
aaucuggacacacugu

SEQ ID NO: 1591824 - RNA, 23 nt, Homo sapiens
aaucuggagagcuagaaccugga

SEQ ID NO: 1591825 - RNA, 14 nt, Homo sapiens
aaucugggacugug

SEQ ID NO: 1591826 - RNA, 13 nt, Homo sapiens
aaucugugugcau

SEQ ID NO: 1591827 - RNA, 18 nt, Homo sapiens
aaucuguuucucugcugu

SEQ ID NO: 1591828 - RNA, 14 nt, Homo sapiens
aaucuuaguguuca

SEQ ID NO: 1591829 - RNA, 22 nt, Homo sapiens
aaucuuaucuuugcucccugca

SEQ ID NO: 1591830 - RNA, 14 nt, Homo sapiens
aaucuuaugcucuc

SEQ ID NO: 1591831 - RNA, 19 nt, Homo sapiens
aaucuuauuccucagugag

SEQ ID NO: 1591832 - RNA, 21 nt, Homo sapiens
aaucuucugccuucucaugau

SEQ ID NO: 1591833 - RNA, 19 nt, Homo sapiens
aaucuuggagcugcuugga

SEQ ID NO: 1591834 - RNA, 21 nt, Homo sapiens
aaucuuuuauacaauaauuga

SEQ ID NO: 1591835 - RNA, 19 nt, Homo sapiens
aaucuuuuugcuucuacuu

SEQ ID NO: 1591836 - RNA, 14 nt, Homo sapiens
aaugaaaauuguau

SEQ ID NO: 1591837 - RNA, 13 nt, Homo sapiens
aaugaaacuuuaa

SEQ ID NO: 1591838 - RNA, 15 nt, Homo sapiens
aaugaaaugccaaag

SEQ ID NO: 1591839 - RNA, 16 nt, Homo sapiens
aaugaaccuucugcaa

SEQ ID NO: 1591840 - RNA, 12 nt, Homo sapiens
aaugaagcuuug

SEQ ID NO: 1591841 - RNA, 22 nt, Homo sapiens
aaugaauauagaugcuggccag

SEQ ID NO: 1591842 - RNA, 17 nt, Homo sapiens
aaugaaugaauggcuaa

SEQ ID NO: 1591843 - RNA, 13 nt, Homo sapiens
aaugaauggcuaa

SEQ ID NO: 1591844 - RNA, 14 nt, Homo sapiens
aaugaauuuaucuu

SEQ ID NO: 1591845 - RNA, 23 nt, Homo sapiens
aaugacaaaugacgucuucacca

SEQ ID NO: 1591846 - RNA, 20 nt, Homo sapiens
aaugacacccugaucuucac

SEQ ID NO: 1591847 - RNA, 13 nt, Homo sapiens
aaugacagccuuu

SEQ ID NO: 1591848 - RNA, 20 nt, Homo sapiens
aaugaccaggccaagacuca

SEQ ID NO: 1591849 - RNA, 15 nt, Homo sapiens
aaugacgucuucacc

SEQ ID NO: 1591850 - RNA, 18 nt, Homo sapiens
aaugacuauauaauuuau

SEQ ID NO: 1591851 - RNA, 17 nt, Homo sapiens
aaugacugugucugccu

SEQ ID NO: 1591852 - RNA, 13 nt, Homo sapiens
agaagcuauuuca

SEQ ID NO: 1591853 - RNA, 15 nt, Homo sapiens
agaagcugaagaucc

SEQ ID NO: 1591854 - RNA, 12 nt, Homo sapiens
agaagcugccau

SEQ ID NO: 1591855 - RNA, 20 nt, Homo sapiens
agaagcuuaaaaucugugaa

SEQ ID NO: 1591856 - RNA, 13 nt, Homo sapiens
agaaggauuaccu

SEQ ID NO: 1591857 - RNA, 20 nt, Homo sapiens
agaaggcaaccaaagugcag

SEQ ID NO: 1591858 - RNA, 14 nt, Homo sapiens
agaaggcauugcuu

SEQ ID NO: 1591859 - RNA, 20 nt, Homo sapiens
agaaggcugugagccaagga

SEQ ID NO: 1591860 - RNA, 20 nt, Homo sapiens
agaaggggcuuugugaccag

SEQ ID NO: 1591861 - RNA, 12 nt, Homo sapiens
agaaggugcuga

SEQ ID NO: 1591862 - RNA, 21 nt, Homo sapiens
agaaguaagccucaucaucag

SEQ ID NO: 1591863 - RNA, 19 nt, Homo sapiens
agaaguacuuuauugcaac

SEQ ID NO: 1591864 - RNA, 17 nt, Homo sapiens
agaaguauuuuaauuca

SEQ ID NO: 1591865 - RNA, 21 nt, Homo sapiens
agaaguauuuuuuuaauuucu

SEQ ID NO: 1591866 - RNA, 15 nt, Homo sapiens
agaaguccacagaca

SEQ ID NO: 1591867 - RNA, 22 nt, Homo sapiens
agaagugaaaaucuacacucca

SEQ ID NO: 1591868 - RNA, 22 nt, Homo sapiens
agaaguucuuguucuucaggag

SEQ ID NO: 1591869 - RNA, 22 nt, Homo sapiens
agaauaaauucccaacuucucu

SEQ ID NO: 1591870 - RNA, 21 nt, Homo sapiens
agaauacacauuuuuugccac

SEQ ID NO: 1591871 - RNA, 20 nt, Homo sapiens
agaauagugguuaacagagc

SEQ ID NO: 1591872 - RNA, 19 nt, Homo sapiens
agaauauagacagugcccu

SEQ ID NO: 1591873 - RNA, 13 nt, Homo sapiens
agaauaugacuuu

SEQ ID NO: 1591874 - RNA, 13 nt, Homo sapiens
agaaucacuuaag

SEQ ID NO: 1591875 - RNA, 19 nt, Homo sapiens
agaaucacuuaagccugga

SEQ ID NO: 1591876 - RNA, 23 nt, Homo sapiens
agagcugccugugccuuuugcca

SEQ ID NO: 1591877 - RNA, 17 nt, Homo sapiens
agagcuguuauacugug

SEQ ID NO: 1591878 - RNA, 14 nt, Homo sapiens
agagcuuccacaag

SEQ ID NO: 1591879 - RNA, 13 nt, Homo sapiens
agagcuuuaccua

SEQ ID NO: 1591880 - RNA, 20 nt, Homo sapiens
agagcuuuuuaauagcacua

SEQ ID NO: 1591881 - RNA, 13 nt, Homo sapiens
agaggaaauucuu

SEQ ID NO: 1591882 - RNA, 16 nt, Homo sapiens
agaggaacagcacugg

SEQ ID NO: 1591883 - RNA, 13 nt, Homo sapiens
agaggaauccaug

SEQ ID NO: 1591884 - RNA, 15 nt, Homo sapiens
agaggaauccaugua

SEQ ID NO: 1591885 - RNA, 21 nt, Homo sapiens
agaggaaugaaguacucauac

SEQ ID NO: 1591886 - RNA, 21 nt, Homo sapiens
agaggagaagagacauguacc

SEQ ID NO: 1591887 - RNA, 19 nt, Homo sapiens
agaggagccaccaguucuc

SEQ ID NO: 1591888 - RNA, 14 nt, Homo sapiens
agaggaggggacca

SEQ ID NO: 1591889 - RNA, 19 nt, Homo sapiens
agaggcggcagauccugcc

SEQ ID NO: 1591890 - RNA, 18 nt, Homo sapiens
agaggcuacaaggacuua

SEQ ID NO: 1591891 - RNA, 14 nt, Homo sapiens
agaggcuacagggc

SEQ ID NO: 1591892 - RNA, 21 nt, Homo sapiens
agaggcugccccucucaccaa

SEQ ID NO: 1591893 - RNA, 22 nt, Homo sapiens
agagggaccaaauugcuucuag

SEQ ID NO: 1591894 - RNA, 16 nt, Homo sapiens
agagggaggucacugg

SEQ ID NO: 1591895 - RNA, 18 nt, Homo sapiens
agagggaggucacuggaa

SEQ ID NO: 1591896 - RNA, 15 nt, Homo sapiens
agagggcccagccca

SEQ ID NO: 1591897 - RNA, 17 nt, Homo sapiens
agagggcccagcccaga

SEQ ID NO: 1591898 - RNA, 21 nt, Homo sapiens
agagggcgugggcgcuugcac

SEQ ID NO: 1591899 - RNA, 17 nt, Homo sapiens
agagggcugccuuugga

SEQ ID NO: 1591900 - RNA, 15 nt, Homo sapiens
agagggcugguccuu

SEQ ID NO: 1591901 - RNA, 13 nt, Homo sapiens
agagggcuuccuc

SEQ ID NO: 1591902 - RNA, 15 nt, Homo sapiens
agaggggcaaauaga

SEQ ID NO: 1591903 - RNA, 20 nt, Homo sapiens
agagggggggccgggccagg

SEQ ID NO: 1591904 - RNA, 22 nt, Homo sapiens
agaggggugggauccacacuga

SEQ ID NO: 1591905 - RNA, 17 nt, Homo sapiens
agaggguguccugcacc

SEQ ID NO: 1591906 - RNA, 12 nt, Homo sapiens
agagguccaggu

SEQ ID NO: 1591907 - RNA, 16 nt, Homo sapiens
agagguggaguucuua

SEQ ID NO: 1591908 - RNA, 14 nt, Homo sapiens
agagguugauuaua

SEQ ID NO: 1591909 - RNA, 21 nt, Homo sapiens
agagguuugguuuccuguguc

SEQ ID NO: 1591910 - RNA, 20 nt, Homo sapiens
agaguaaaccuugaagggcu

SEQ ID NO: 1591911 - RNA, 18 nt, Homo sapiens
agaguagaauugcauuga

SEQ ID NO: 1591912 - RNA, 22 nt, Homo sapiens
agagucuaauagucuuugccag

SEQ ID NO: 1591913 - RNA, 18 nt, Homo sapiens
agagucucugauacacag

SEQ ID NO: 1591914 - RNA, 19 nt, Homo sapiens
agagugagacccugucuca

SEQ ID NO: 1591915 - RNA, 12 nt, Homo sapiens
agagugcacaug

SEQ ID NO: 1591916 - RNA, 17 nt, Homo sapiens
agaguggagagugacau

SEQ ID NO: 1591917 - RNA, 19 nt, Homo sapiens
agaguguuuaccuggugcu

SEQ ID NO: 1591918 - RNA, 15 nt, Homo sapiens
agaguuaaaucucaa

SEQ ID NO: 1591919 - RNA, 15 nt, Homo sapiens
agaguuacaguucug

SEQ ID NO: 1591920 - RNA, 13 nt, Homo sapiens
agauaaacacaaa

SEQ ID NO: 1591921 - RNA, 20 nt, Homo sapiens
agauaaaccaauaaauccac

SEQ ID NO: 1591922 - RNA, 22 nt, Homo sapiens
agauaaagauuucuaguaggca

SEQ ID NO: 1591923 - RNA, 18 nt, Homo sapiens
agauaagaaaugaucuuu

SEQ ID NO: 1591924 - RNA, 17 nt, Homo sapiens
agauaaucgaagcaaaa

SEQ ID NO: 1591925 - RNA, 18 nt, Homo sapiens
agauaaucgaagcaaaag

SEQ ID NO: 1591926 - RNA, 16 nt, Homo sapiens
agauaaucuugugcaa

SEQ ID NO: 1591927 - RNA, 19 nt, Homo sapiens
agauacacagauauauaca

SEQ ID NO: 1591928 - RNA, 11 nt, Homo sapiens
agauacaugau

SEQ ID NO: 1591929 - RNA, 22 nt, Homo sapiens
agauacaugauugaaaccaagu

SEQ ID NO: 1591930 - RNA, 22 nt, Homo sapiens
agauacugaugcauugaccuca

SEQ ID NO: 1591931 - RNA, 23 nt, Homo sapiens
agauagcaucagaccugcauuga

SEQ ID NO: 1591932 - RNA, 15 nt, Homo sapiens
agauagcuacagugu

SEQ ID NO: 1591933 - RNA, 13 nt, Homo sapiens
agauagcugugac

SEQ ID NO: 1591934 - RNA, 20 nt, Homo sapiens
agauagugccagguggcuca

SEQ ID NO: 1591935 - RNA, 15 nt, Homo sapiens
agauauaaggggaaa

SEQ ID NO: 1591936 - RNA, 20 nt, Homo sapiens
agauauggacucucuaagga

SEQ ID NO: 1591937 - RNA, 13 nt, Homo sapiens
agauauuaauaga

SEQ ID NO: 1591938 - RNA, 22 nt, Homo sapiens
agauauuaauagauaauaugaa

SEQ ID NO: 1591939 - RNA, 17 nt, Homo sapiens
agauauuaauguuaaca

SEQ ID NO: 1591940 - RNA, 17 nt, Homo sapiens
agauauucagaaguaua

SEQ ID NO: 1591941 - RNA, 17 nt, Homo sapiens
agauauugcuacuauaa

SEQ ID NO: 1591942 - RNA, 15 nt, Homo sapiens
agauauuuuugcaac

SEQ ID NO: 1591943 - RNA, 13 nt, Homo sapiens
agaucaaugguuu

SEQ ID NO: 1591944 - RNA, 20 nt, Homo sapiens
agaucgauccuggauucacu

SEQ ID NO: 1591945 - RNA, 19 nt, Homo sapiens
agaucgccccacugcacuc

SEQ ID NO: 1591946 - RNA, 19 nt, Homo sapiens
agaucgcgccaaugcacuc

SEQ ID NO: 1591947 - RNA, 14 nt, Homo sapiens
agaucuaugggaag

SEQ ID NO: 1591948 - RNA, 16 nt, Homo sapiens
agaucucccuucucau

SEQ ID NO: 1591949 - RNA, 14 nt, Homo sapiens
agaucucuguagaa

SEQ ID NO: 1591950 - RNA, 22 nt, Homo sapiens
agaucuggucccuugcagcuag

SEQ ID NO: 1591951 - RNA, 14 nt, Homo sapiens
agaugaagacauca

SEQ ID NO: 1591952 - RNA, 20 nt, Homo sapiens
agaugaaggagaggcaacau

SEQ ID NO: 1591953 - RNA, 20 nt, Homo sapiens
agaugacaaccuccauucua

SEQ ID NO: 1591954 - RNA, 14 nt, Homo sapiens
agaugaugaugauc

SEQ ID NO: 1591955 - RNA, 19 nt, Homo sapiens
agaugauggaugccaauau

SEQ ID NO: 1591956 - RNA, 19 nt, Homo sapiens
agaugcaaggaccaggacu

SEQ ID NO: 1591957 - RNA, 15 nt, Homo sapiens
agaugccacuucuca

SEQ ID NO: 1591958 - RNA, 20 nt, Homo sapiens
agaugccucgcucuuuucaa

SEQ ID NO: 1591959 - RNA, 20 nt, Homo sapiens
agaugcuacgcuccagcuga

SEQ ID NO: 1591960 - RNA, 17 nt, Homo sapiens
agaugcuuagugugaag

SEQ ID NO: 1591961 - RNA, 16 nt, Homo sapiens
agaugcuucucuugcu

SEQ ID NO: 1591962 - RNA, 15 nt, Homo sapiens
agaugcuuggagcaa

SEQ ID NO: 1591963 - RNA, 15 nt, Homo sapiens
agaugcuugguugug

SEQ ID NO: 1591964 - RNA, 14 nt, Homo sapiens
agauggagcuuugu

SEQ ID NO: 1591965 - RNA, 14 nt, Homo sapiens
agauggagucuugc

SEQ ID NO: 1591966 - RNA, 22 nt, Homo sapiens
agauggcuuccgugagacacaa

SEQ ID NO: 1591967 - RNA, 23 nt, Homo sapiens
agaugggcgucacuacugcuacc

SEQ ID NO: 1591968 - RNA, 22 nt, Homo sapiens
agauguaauguuuucuuugcaa

SEQ ID NO: 1591969 - RNA, 13 nt, Homo sapiens
agauguagaggag

SEQ ID NO: 1591970 - RNA, 22 nt, Homo sapiens
agauguauuuuugauguauaua

SEQ ID NO: 1591971 - RNA, 19 nt, Homo sapiens
acucccugcugugugacuu

SEQ ID NO: 1591972 - RNA, 23 nt, Homo sapiens
acucccuucucggggugggacag

SEQ ID NO: 1591973 - RNA, 23 nt, Homo sapiens
acucccuucucguguuugcuuaa

SEQ ID NO: 1591974 - RNA, 22 nt, Homo sapiens
acuccggccugggugacagagu

SEQ ID NO: 1591975 - RNA, 15 nt, Homo sapiens
acuccgucucaaaaa

SEQ ID NO: 1591976 - RNA, 19 nt, Homo sapiens
acuccuccaaggaaaggga

SEQ ID NO: 1591977 - RNA, 18 nt, Homo sapiens
acuccucuaucaugcaaa

SEQ ID NO: 1591978 - RNA, 14 nt, Homo sapiens
acuccucugucaua

SEQ ID NO: 1591979 - RNA, 19 nt, Homo sapiens
acuccucuuuccuuccuuc

SEQ ID NO: 1591980 - RNA, 16 nt, Homo sapiens
acuccugaaaccucuu

SEQ ID NO: 1591981 - RNA, 13 nt, Homo sapiens
acuccugccauuc

SEQ ID NO: 1591982 - RNA, 16 nt, Homo sapiens
acucgcccuaggcccu

SEQ ID NO: 1591983 - RNA, 21 nt, Homo sapiens
acucgggaccaauacuacuga

SEQ ID NO: 1591984 - RNA, 15 nt, Homo sapiens
acucgugucuggcac

SEQ ID NO: 1591985 - RNA, 20 nt, Homo sapiens
acucuaacaguaguugcaau

SEQ ID NO: 1591986 - RNA, 21 nt, Homo sapiens
acucuaccaugguucugccuc

SEQ ID NO: 1591987 - RNA, 23 nt, Homo sapiens
acucuacuucagucaauagccau

SEQ ID NO: 1591988 - RNA, 18 nt, Homo sapiens
acucuaggguccagugga

SEQ ID NO: 1591989 - RNA, 22 nt, Homo sapiens
acucuauaagauuccaaaaagc

SEQ ID NO: 1591990 - RNA, 20 nt, Homo sapiens
acucucagcagcuaugguag

SEQ ID NO: 1591991 - RNA, 19 nt, Homo sapiens
acucucauccaaauggcau

SEQ ID NO: 1591992 - RNA, 18 nt, Homo sapiens
acucugagaacuccucau

SEQ ID NO: 1591993 - RNA, 21 nt, Homo sapiens
acucugagcaugccccaaaaa

SEQ ID NO: 1591994 - RNA, 16 nt, Homo sapiens
acucugcacuacuccu

SEQ ID NO: 1591995 - RNA, 20 nt, Homo sapiens
acucugcauccagagauuca

SEQ ID NO: 1591996 - RNA, 18 nt, Homo sapiens
acucuggaccauauacca

SEQ ID NO: 1591997 - RNA, 16 nt, Homo sapiens
acucuggagcauuucu

SEQ ID NO: 1591998 - RNA, 14 nt, Homo sapiens
acucugguggcaca

SEQ ID NO: 1591999 - RNA, 22 nt, Homo sapiens
acucuguaaaaugcaccaauca

SEQ ID NO: 1592000 - RNA, 13 nt, Homo sapiens
acucuguccugga

SEQ ID NO: 1592001 - RNA, 15 nt, Homo sapiens
acucugucuaccugg

SEQ ID NO: 1592002 - RNA, 14 nt, Homo sapiens
acucuucacagauu

SEQ ID NO: 1592003 - RNA, 13 nt, Homo sapiens
acucuucauucag

SEQ ID NO: 1592004 - RNA, 14 nt, Homo sapiens
acucuucauucagu

SEQ ID NO: 1592005 - RNA, 21 nt, Homo sapiens
acucuuccuuccuaauaggca

SEQ ID NO: 1592006 - RNA, 18 nt, Homo sapiens
acucuucuuuaagccaua

SEQ ID NO: 1592007 - RNA, 14 nt, Homo sapiens
acucuugaucucuc

SEQ ID NO: 1592008 - RNA, 16 nt, Homo sapiens
acucuugaucucucuu

SEQ ID NO: 1592009 - RNA, 19 nt, Homo sapiens
acugaaaaaaacauaucca

SEQ ID NO: 1592010 - RNA, 21 nt, Homo sapiens
acugaaaaaaacauauccaaa

SEQ ID NO: 1592011 - RNA, 22 nt, Homo sapiens
acugaaaaugauuccuggacau

SEQ ID NO: 1592012 - RNA, 13 nt, Homo sapiens
acugaaaaugcau

SEQ ID NO: 1592013 - RNA, 16 nt, Homo sapiens
acugaaccaggccaga

SEQ ID NO: 1592014 - RNA, 15 nt, Homo sapiens
acugaaccauuccaa

SEQ ID NO: 1592015 - RNA, 19 nt, Homo sapiens
acugaagccugcuccuucu

SEQ ID NO: 1592016 - RNA, 15 nt, Homo sapiens
acugaagcugcacag

SEQ ID NO: 1592017 - RNA, 16 nt, Homo sapiens
acugaagcugcacagu

SEQ ID NO: 1592018 - RNA, 18 nt, Homo sapiens
acugaagcugcacagugu

SEQ ID NO: 1592019 - RNA, 18 nt, Homo sapiens
acugaaggcauaugcaca

SEQ ID NO: 1592020 - RNA, 21 nt, Homo sapiens
acugaaggcuaaaaagcaaca

SEQ ID NO: 1592021 - RNA, 22 nt, Homo sapiens
acugaauagauaugaaagcuga

SEQ ID NO: 1592022 - RNA, 19 nt, Homo sapiens
acugaaucugcuaccaaaa

SEQ ID NO: 1592023 - RNA, 23 nt, Homo sapiens
acugaaugagaaccaacaaguaa

SEQ ID NO: 1592024 - RNA, 12 nt, Homo sapiens
acugaaugucau

SEQ ID NO: 1592025 - RNA, 22 nt, Homo sapiens
acugaauuaaacuuaaguccag

SEQ ID NO: 1592026 - RNA, 16 nt, Homo sapiens
acugaauuuugggacu

SEQ ID NO: 1592027 - RNA, 14 nt, Homo sapiens
acugacaaagacau

SEQ ID NO: 1592028 - RNA, 15 nt, Homo sapiens
acugacagggagcag

SEQ ID NO: 1592029 - RNA, 20 nt, Homo sapiens
acugacauauaucuauuaca

SEQ ID NO: 1592030 - RNA, 12 nt, Homo sapiens
acugacauuucu

SEQ ID NO: 1592031 - RNA, 17 nt, Homo sapiens
acugaccguaugaugag

SEQ ID NO: 1592032 - RNA, 21 nt, Homo sapiens
acugacuggauucauucucau

SEQ ID NO: 1592033 - RNA, 18 nt, Homo sapiens
acugagcugggcaggaag

SEQ ID NO: 1592034 - RNA, 15 nt, Homo sapiens
acugaggaauuucac

SEQ ID NO: 1592035 - RNA, 16 nt, Homo sapiens
acugagggguggcacg

SEQ ID NO: 1592036 - RNA, 14 nt, Homo sapiens
acugagucacucac

SEQ ID NO: 1592037 - RNA, 16 nt, Homo sapiens
acugagucacucacau

SEQ ID NO: 1592038 - RNA, 23 nt, Homo sapiens
acugagucuuuuggaggcuccaa

SEQ ID NO: 1592039 - RNA, 23 nt, Homo sapiens
acugagugugggagugcagagaa

SEQ ID NO: 1592040 - RNA, 13 nt, Homo sapiens
acugauacuuuca

SEQ ID NO: 1592041 - RNA, 19 nt, Homo sapiens
acugauagggguucaugcu

SEQ ID NO: 1592042 - RNA, 17 nt, Homo sapiens
acugauuaccugccaau

SEQ ID NO: 1592043 - RNA, 15 nt, Homo sapiens
acugcaaccucugcc

SEQ ID NO: 1592044 - RNA, 14 nt, Homo sapiens
acugcaagcauuuu

SEQ ID NO: 1592045 - RNA, 19 nt, Homo sapiens
acugcacccuguuuaacau

SEQ ID NO: 1592046 - RNA, 19 nt, Homo sapiens
acugcacuccagccuggca

SEQ ID NO: 1592047 - RNA, 20 nt, Homo sapiens
acugcacuccagucugggug

SEQ ID NO: 1592048 - RNA, 13 nt, Homo sapiens
acugcagcugucu

SEQ ID NO: 1592049 - RNA, 15 nt, Homo sapiens
acugcaggaccucca

SEQ ID NO: 1592050 - RNA, 17 nt, Homo sapiens
acugcaggaccuccagc

SEQ ID NO: 1592051 - RNA, 12 nt, Homo sapiens
acugcagucacc

SEQ ID NO: 1592052 - RNA, 19 nt, Homo sapiens
acugcaucccagcccacau

SEQ ID NO: 1592053 - RNA, 21 nt, Homo sapiens
acugcauugguuuuccaugac

SEQ ID NO: 1592054 - RNA, 17 nt, Homo sapiens
acugccagcucucugau

SEQ ID NO: 1592055 - RNA, 17 nt, Homo sapiens
acugccaggcuguuuca

SEQ ID NO: 1592056 - RNA, 21 nt, Homo sapiens
acugccaucuuuaucaugaag

SEQ ID NO: 1592057 - RNA, 18 nt, Homo sapiens
acugccccacaugcaugu

SEQ ID NO: 1592058 - RNA, 21 nt, Homo sapiens
acugccccccgaggcugcuag

SEQ ID NO: 1592059 - RNA, 21 nt, Homo sapiens
acugccccugcugugcugcuc

SEQ ID NO: 1592060 - RNA, 23 nt, Homo sapiens
acugccuuuuuguaauccuguac

SEQ ID NO: 1592061 - RNA, 24 nt, Homo sapiens
acugcuagcuuucuccuuaccguc

SEQ ID NO: 1592062 - RNA, 20 nt, Homo sapiens
acugcuaggaugaagcccua

SEQ ID NO: 1592063 - RNA, 19 nt, Homo sapiens
acaauuaaaccgcauguga

SEQ ID NO: 1592064 - RNA, 13 nt, Homo sapiens
acaauuaauuaaa

SEQ ID NO: 1592065 - RNA, 14 nt, Homo sapiens
acaauucauugugu

SEQ ID NO: 1592066 - RNA, 23 nt, Homo sapiens
acaauucugugacauacauauua

SEQ ID NO: 1592067 - RNA, 23 nt, Homo sapiens
acaauugguaaaacucacuguga

SEQ ID NO: 1592068 - RNA, 21 nt, Homo sapiens
acaauugucgaaaagagucuu

SEQ ID NO: 1592069 - RNA, 19 nt, Homo sapiens
acaauuucaacuacaguga

SEQ ID NO: 1592070 - RNA, 20 nt, Homo sapiens
acaauuuccaaaacugucca

SEQ ID NO: 1592071 - RNA, 18 nt, Homo sapiens
acacaaaauccauuccag

SEQ ID NO: 1592072 - RNA, 12 nt, Homo sapiens
acacaaagggaa

SEQ ID NO: 1592073 - RNA, 21 nt, Homo sapiens
acacaaauucagucucugaau

SEQ ID NO: 1592074 - RNA, 16 nt, Homo sapiens
acacaaugcccaacuu

SEQ ID NO: 1592075 - RNA, 22 nt, Homo sapiens
acacaauucuaggaugaacaau

SEQ ID NO: 1592076 - RNA, 16 nt, Homo sapiens
acacacauugcagcuu

SEQ ID NO: 1592077 - RNA, 15 nt, Homo sapiens
acacaccaaucagcg

SEQ ID NO: 1592078 - RNA, 17 nt, Homo sapiens
acacagaagccuuugau

SEQ ID NO: 1592079 - RNA, 20 nt, Homo sapiens
acacagacccaagauucaua

SEQ ID NO: 1592080 - RNA, 18 nt, Homo sapiens
acacagagaaauacaaaa

SEQ ID NO: 1592081 - RNA, 22 nt, Homo sapiens
acacagagcaggacugcacagc

SEQ ID NO: 1592082 - RNA, 16 nt, Homo sapiens
acacagauagaccuuu

SEQ ID NO: 1592083 - RNA, 17 nt, Homo sapiens
acacagcaacaaugacu

SEQ ID NO: 1592084 - RNA, 16 nt, Homo sapiens
acacagcaucagcuca

SEQ ID NO: 1592085 - RNA, 16 nt, Homo sapiens
acacaggcuguccuua

SEQ ID NO: 1592086 - RNA, 18 nt, Homo sapiens
acacaguaauugugacaa

SEQ ID NO: 1592087 - RNA, 16 nt, Homo sapiens
acacagugagacugua

SEQ ID NO: 1592088 - RNA, 17 nt, Homo sapiens
acacagugcaucucaga

SEQ ID NO: 1592089 - RNA, 18 nt, Homo sapiens
acacaguuuugucuucgu

SEQ ID NO: 1592090 - RNA, 20 nt, Homo sapiens
acacaugagacuuacugcuc

SEQ ID NO: 1592091 - RNA, 22 nt, Homo sapiens
acacauucaggaguuaaauauu

SEQ ID NO: 1592092 - RNA, 14 nt, Homo sapiens
acacauucugccuu

SEQ ID NO: 1592093 - RNA, 19 nt, Homo sapiens
acaccaaguaccaguauaa

SEQ ID NO: 1592094 - RNA, 20 nt, Homo sapiens
acaccauaagcuacugccau

SEQ ID NO: 1592095 - RNA, 22 nt, Homo sapiens
acaccauaagcuacugccaucc

SEQ ID NO: 1592096 - RNA, 12 nt, Homo sapiens
acaccauucauu

SEQ ID NO: 1592097 - RNA, 14 nt, Homo sapiens
acaccauucauucc

SEQ ID NO: 1592098 - RNA, 19 nt, Homo sapiens
acaccauucuccugccuca

SEQ ID NO: 1592099 - RNA, 20 nt, Homo sapiens
acacccagcucagcauuucc

SEQ ID NO: 1592100 - RNA, 17 nt, Homo sapiens
acacccaugccagagag

SEQ ID NO: 1592101 - RNA, 18 nt, Homo sapiens
acacccucccuccagggu

SEQ ID NO: 1592102 - RNA, 18 nt, Homo sapiens
acacccuuucaucucaga

SEQ ID NO: 1592103 - RNA, 19 nt, Homo sapiens
acaccguacaucugcaaua

SEQ ID NO: 1592104 - RNA, 20 nt, Homo sapiens
acaccguacaucugcaauau

SEQ ID NO: 1592105 - RNA, 17 nt, Homo sapiens
acaccguggacagcgcu

SEQ ID NO: 1592106 - RNA, 20 nt, Homo sapiens
acaccgugggucauuacaaa

SEQ ID NO: 1592107 - RNA, 16 nt, Homo sapiens
acaccucccugugaag

SEQ ID NO: 1592108 - RNA, 18 nt, Homo sapiens
acaccugccuucuacccu

SEQ ID NO: 1592109 - RNA, 18 nt, Homo sapiens
acaccuuaauaugcugca

SEQ ID NO: 1592110 - RNA, 18 nt, Homo sapiens
acaccuuuuauugacaca

SEQ ID NO: 1592111 - RNA, 20 nt, Homo sapiens
acacgagcaggcuacuguca

SEQ ID NO: 1592112 - RNA, 16 nt, Homo sapiens
acacgaguuccagacc

SEQ ID NO: 1592113 - RNA, 16 nt, Homo sapiens
acacgcauguaugcau

SEQ ID NO: 1592114 - RNA, 23 nt, Homo sapiens
acacguucugauuucugcccuug

SEQ ID NO: 1592115 - RNA, 20 nt, Homo sapiens
acacuaguccauaagcuuua

SEQ ID NO: 1592116 - RNA, 15 nt, Homo sapiens
acacuauuuccaaaa

SEQ ID NO: 1592117 - RNA, 23 nt, Homo sapiens
acacucaaaacgcuacugaguca

SEQ ID NO: 1592118 - RNA, 17 nt, Homo sapiens
acacucaaaucaagaaa

SEQ ID NO: 1592119 - RNA, 12 nt, Homo sapiens
acacuccucuau

SEQ ID NO: 1592120 - RNA, 20 nt, Homo sapiens
acacuccuugucaacaaagu

SEQ ID NO: 1592121 - RNA, 16 nt, Homo sapiens
acacucuauaagauuc

SEQ ID NO: 1592122 - RNA, 15 nt, Homo sapiens
acacugagagagugg

SEQ ID NO: 1592123 - RNA, 16 nt, Homo sapiens
acacugaguugcacau

SEQ ID NO: 1592124 - RNA, 21 nt, Homo sapiens
acacugaucuuauguguuaca

SEQ ID NO: 1592125 - RNA, 21 nt, Homo sapiens
acacugcacagggaaaauugc

SEQ ID NO: 1592126 - RNA, 16 nt, Homo sapiens
acacugcagcugucug

SEQ ID NO: 1592127 - RNA, 16 nt, Homo sapiens
acacuggagccaucuc

SEQ ID NO: 1592128 - RNA, 18 nt, Homo sapiens
acacuggcguuacugcuu

SEQ ID NO: 1592129 - RNA, 22 nt, Homo sapiens
acacuguauauaaacauaucaa

SEQ ID NO: 1592130 - RNA, 13 nt, Homo sapiens
acacuguuuccau

SEQ ID NO: 1592131 - RNA, 24 nt, Homo sapiens
acacuugcucccaacccauucacu

SEQ ID NO: 1592132 - RNA, 20 nt, Homo sapiens
acagaaaccagaaaagcaau

SEQ ID NO: 1592133 - RNA, 19 nt, Homo sapiens
acagaaagcagauaccuca

SEQ ID NO: 1592134 - RNA, 21 nt, Homo sapiens
acagaaagcuccuuccagacc

SEQ ID NO: 1592135 - RNA, 21 nt, Homo sapiens
acagaaauaaagagcuguuau

SEQ ID NO: 1592136 - RNA, 15 nt, Homo sapiens
acagaaauuguauau

SEQ ID NO: 1592137 - RNA, 23 nt, Homo sapiens
acagaacuaaaaauuaaaaccuc

SEQ ID NO: 1592138 - RNA, 16 nt, Homo sapiens
acagaacuccacugca

SEQ ID NO: 1592139 - RNA, 20 nt, Homo sapiens
acagaaguauuuuaauucac

SEQ ID NO: 1592140 - RNA, 15 nt, Homo sapiens
acagacacucccacu

SEQ ID NO: 1592141 - RNA, 18 nt, Homo sapiens
acagacauucaccuguau

SEQ ID NO: 1592142 - RNA, 16 nt, Homo sapiens
acagaccacuugccac

SEQ ID NO: 1592143 - RNA, 20 nt, Homo sapiens
acagacgagacaacagcaca

SEQ ID NO: 1592144 - RNA, 16 nt, Homo sapiens
acagacgugaaagcca

SEQ ID NO: 1592145 - RNA, 13 nt, Homo sapiens
acagacuacauuu

SEQ ID NO: 1592146 - RNA, 12 nt, Homo sapiens
acagacucucac

SEQ ID NO: 1592147 - RNA, 16 nt, Homo sapiens
acagacugauguguau

SEQ ID NO: 1592148 - RNA, 12 nt, Homo sapiens
acagagaaagca

SEQ ID NO: 1592149 - RNA, 15 nt, Homo sapiens
acagagaaagcagaa

SEQ ID NO: 1592150 - RNA, 13 nt, Homo sapiens
acagagacucaga

SEQ ID NO: 1592151 - RNA, 15 nt, Homo sapiens
acagagauacacaga

SEQ ID NO: 1592152 - RNA, 15 nt, Homo sapiens
acagagaugaaagag

SEQ ID NO: 1592153 - RNA, 21 nt, Homo sapiens
acagagcaagacccugucuca

SEQ ID NO: 1592154 - RNA, 16 nt, Homo sapiens
acagagcaaguccuca

SEQ ID NO: 1592155 - RNA, 15 nt, Homo sapiens
auaacugucuuguuu

SEQ ID NO: 1592156 - RNA, 12 nt, Homo sapiens
auaacuguuuau

SEQ ID NO: 1592157 - RNA, 19 nt, Homo sapiens
auaacuuggggaggcaaga

SEQ ID NO: 1592158 - RNA, 17 nt, Homo sapiens
auaacuuucucugugaa

SEQ ID NO: 1592159 - RNA, 23 nt, Homo sapiens
auaacuuuuuugagucauugacu

SEQ ID NO: 1592160 - RNA, 14 nt, Homo sapiens
auaagaaagcacua

SEQ ID NO: 1592161 - RNA, 18 nt, Homo sapiens
auaagaaagcacuauuaa

SEQ ID NO: 1592162 - RNA, 22 nt, Homo sapiens
auaagauuccaaaaagcacaua

SEQ ID NO: 1592163 - RNA, 14 nt, Homo sapiens
auaagcagccagac

SEQ ID NO: 1592164 - RNA, 23 nt, Homo sapiens
auaagcagucauccucagaucau

SEQ ID NO: 1592165 - RNA, 11 nt, Homo sapiens
auaagcauuua

SEQ ID NO: 1592166 - RNA, 14 nt, Homo sapiens
auaagcccaguuca

SEQ ID NO: 1592167 - RNA, 18 nt, Homo sapiens
auaagcccaguucaucac

SEQ ID NO: 1592168 - RNA, 21 nt, Homo sapiens
auaagcuuucaauaguggcau

SEQ ID NO: 1592169 - RNA, 18 nt, Homo sapiens
auaaggaguuagaaccac

SEQ ID NO: 1592170 - RNA, 14 nt, Homo sapiens
auaaggauucugaa

SEQ ID NO: 1592171 - RNA, 20 nt, Homo sapiens
auaaggggaagagucauuuu

SEQ ID NO: 1592172 - RNA, 17 nt, Homo sapiens
auaaggggucaaaauuu

SEQ ID NO: 1592173 - RNA, 23 nt, Homo sapiens
auaaggggucaaaauuugcugcc

SEQ ID NO: 1592174 - RNA, 19 nt, Homo sapiens
auaaguagcauucauguaa

SEQ ID NO: 1592175 - RNA, 13 nt, Homo sapiens
auaaguaggccau

SEQ ID NO: 1592176 - RNA, 19 nt, Homo sapiens
auaaguaucacacuguaua

SEQ ID NO: 1592177 - RNA, 20 nt, Homo sapiens
auaaguaucacacuguauau

SEQ ID NO: 1592178 - RNA, 20 nt, Homo sapiens
auaagugcucaauagcuuga

SEQ ID NO: 1592179 - RNA, 21 nt, Homo sapiens
auaaguggggagagagcccuu

SEQ ID NO: 1592180 - RNA, 18 nt, Homo sapiens
auaauaaaaggaguucag

SEQ ID NO: 1592181 - RNA, 17 nt, Homo sapiens
auaauaaaggcauuuca

SEQ ID NO: 1592182 - RNA, 16 nt, Homo sapiens
auaauaaauacucagu

SEQ ID NO: 1592183 - RNA, 17 nt, Homo sapiens
auaauaaugaugaugau

SEQ ID NO: 1592184 - RNA, 14 nt, Homo sapiens
auaauaguacuauu

SEQ ID NO: 1592185 - RNA, 13 nt, Homo sapiens
auaauauagcuua

SEQ ID NO: 1592186 - RNA, 18 nt, Homo sapiens
auaaucacaacccuucag

SEQ ID NO: 1592187 - RNA, 15 nt, Homo sapiens
auaaucaucaaguaa

SEQ ID NO: 1592188 - RNA, 19 nt, Homo sapiens
auaaucaugcucauguaua

SEQ ID NO: 1592189 - RNA, 16 nt, Homo sapiens
auaaugccaaugaaca

SEQ ID NO: 1592190 - RNA, 18 nt, Homo sapiens
auaaugcuguugccucau

SEQ ID NO: 1592191 - RNA, 19 nt, Homo sapiens
auaaugguguccagucuuu

SEQ ID NO: 1592192 - RNA, 17 nt, Homo sapiens
auaauguauacauuaca

SEQ ID NO: 1592193 - RNA, 20 nt, Homo sapiens
auaauuagcuuguuacaauu

SEQ ID NO: 1592194 - RNA, 14 nt, Homo sapiens
auaauucagcacuu

SEQ ID NO: 1592195 - RNA, 22 nt, Homo sapiens
auaauucagcacuuaacuauga

SEQ ID NO: 1592196 - RNA, 23 nt, Homo sapiens
auaauugcuuuuucacagucacu

SEQ ID NO: 1592197 - RNA, 15 nt, Homo sapiens
auaauuggaguagau

SEQ ID NO: 1592198 - RNA, 17 nt, Homo sapiens
auaauuuacuuuguaga

SEQ ID NO: 1592199 - RNA, 16 nt, Homo sapiens
auaauuucaaaccaca

SEQ ID NO: 1592200 - RNA, 17 nt, Homo sapiens
auaauuucaaaccacac

SEQ ID NO: 1592201 - RNA, 19 nt, Homo sapiens
auaauuucaaaccacacau

SEQ ID NO: 1592202 - RNA, 19 nt, Homo sapiens
auaauuuuacucacucacu

SEQ ID NO: 1592203 - RNA, 16 nt, Homo sapiens
auaauuuucacaugaa

SEQ ID NO: 1592204 - RNA, 20 nt, Homo sapiens
auaauuuugaauugauaccu

SEQ ID NO: 1592205 - RNA, 14 nt, Homo sapiens
auaauuuuguaaga

SEQ ID NO: 1592206 - RNA, 11 nt, Homo sapiens
auacaaaaaga

SEQ ID NO: 1592207 - RNA, 12 nt, Homo sapiens
auacaaacaauc

SEQ ID NO: 1592208 - RNA, 14 nt, Homo sapiens
auacaaaucaucca

SEQ ID NO: 1592209 - RNA, 20 nt, Homo sapiens
auacaaauugauagucaaua

SEQ ID NO: 1592210 - RNA, 18 nt, Homo sapiens
auacaaauuuggccuuaa

SEQ ID NO: 1592211 - RNA, 22 nt, Homo sapiens
auacaauguauguacaauacaa

SEQ ID NO: 1592212 - RNA, 13 nt, Homo sapiens
auacacagaggag

SEQ ID NO: 1592213 - RNA, 19 nt, Homo sapiens
auacacagauauauacaca

SEQ ID NO: 1592214 - RNA, 19 nt, Homo sapiens
auacacauuuuuugccacu

SEQ ID NO: 1592215 - RNA, 16 nt, Homo sapiens
auacacuuuguugcaa

SEQ ID NO: 1592216 - RNA, 14 nt, Homo sapiens
auacagcauaccac

SEQ ID NO: 1592217 - RNA, 14 nt, Homo sapiens
auacagucuuccac

SEQ ID NO: 1592218 - RNA, 20 nt, Homo sapiens
auacagucuuccacaaagaa

SEQ ID NO: 1592219 - RNA, 21 nt, Homo sapiens
auacagucuuccacaaagaaa

SEQ ID NO: 1592220 - RNA, 22 nt, Homo sapiens
auacauccacaggguuuugaca

SEQ ID NO: 1592221 - RNA, 19 nt, Homo sapiens
auacauuacaucugaguau

SEQ ID NO: 1592222 - RNA, 12 nt, Homo sapiens
auacauugcaau

SEQ ID NO: 1592223 - RNA, 13 nt, Homo sapiens
auacauugcaauc

SEQ ID NO: 1592224 - RNA, 16 nt, Homo sapiens
auacauuuauaaucua

SEQ ID NO: 1592225 - RNA, 23 nt, Homo sapiens
auaccagagccuucaagugccaa

SEQ ID NO: 1592226 - RNA, 15 nt, Homo sapiens
auaccaucugguacu

SEQ ID NO: 1592227 - RNA, 14 nt, Homo sapiens
auaccuaaacugua

SEQ ID NO: 1592228 - RNA, 19 nt, Homo sapiens
auaccuaauguuaaaugac

SEQ ID NO: 1592229 - RNA, 16 nt, Homo sapiens
auaccuagcacuuuau

SEQ ID NO: 1592230 - RNA, 14 nt, Homo sapiens
auaccugcucuugu

SEQ ID NO: 1592231 - RNA, 22 nt, Homo sapiens
auaccugcucuuguucuacuga

SEQ ID NO: 1592232 - RNA, 15 nt, Homo sapiens
auacguagcucucuu

SEQ ID NO: 1592233 - RNA, 11 nt, Homo sapiens
auacuaaaaag

SEQ ID NO: 1592234 - RNA, 15 nt, Homo sapiens
auacuaaauauguga

SEQ ID NO: 1592235 - RNA, 19 nt, Homo sapiens
auacuaacauuuucauuga

SEQ ID NO: 1592236 - RNA, 21 nt, Homo sapiens
auacuacauugaguagacaca

SEQ ID NO: 1592237 - RNA, 15 nt, Homo sapiens
auacuagaguucaug

SEQ ID NO: 1592238 - RNA, 20 nt, Homo sapiens
auacuagaguucauggauau

SEQ ID NO: 1592239 - RNA, 20 nt, Homo sapiens
auacuagaguugauuauaga

SEQ ID NO: 1592240 - RNA, 14 nt, Homo sapiens
auacuccugucacc

SEQ ID NO: 1592241 - RNA, 23 nt, Homo sapiens
auacucuagaugaaguuuuacau

SEQ ID NO: 1592242 - RNA, 22 nt, Homo sapiens
auacucugcccucuagagccuu

SEQ ID NO: 1592243 - RNA, 18 nt, Homo sapiens
auacugaaggaaaaacac

SEQ ID NO: 1592244 - RNA, 21 nt, Homo sapiens
auacugacuccaaccauucaa

SEQ ID NO: 1592245 - RNA, 18 nt, Homo sapiens
auacugagaauauacaau

SEQ ID NO: 1592246 - RNA, 14 nt, Homo sapiens
auacugaugcauug

SEQ ID NO: 1592247 - RNA, 17 nt, Homo sapiens
auacugcauuuacagug

SEQ ID NO: 1592248 - RNA, 18 nt, Homo sapiens
auacugcauuuacagugu

SEQ ID NO: 1592249 - RNA, 21 nt, Homo sapiens
auacuguagaagaagcccaua

SEQ ID NO: 1592250 - RNA, 18 nt, Homo sapiens
auacuguauauucaggac

SEQ ID NO: 1592251 - RNA, 12 nt, Homo sapiens
auacuguucuca

SEQ ID NO: 1592252 - RNA, 21 nt, Homo sapiens
auacuugauaguuuggcuaua

SEQ ID NO: 1592253 - RNA, 14 nt, Homo sapiens
auacuuggaccuca

SEQ ID NO: 1592254 - RNA, 15 nt, Homo sapiens
auacuuggaccucag

SEQ ID NO: 1592255 - RNA, 15 nt, Homo sapiens
auacuuuacaaacca

SEQ ID NO: 1592256 - RNA, 17 nt, Homo sapiens
auacuuuguauacaagu

SEQ ID NO: 1592257 - RNA, 14 nt, Homo sapiens
auagaaaaauguau

SEQ ID NO: 1592258 - RNA, 17 nt, Homo sapiens
auagaaauauugacuca

SEQ ID NO: 1592259 - RNA, 14 nt, Homo sapiens
auagaaauuuugua

SEQ ID NO: 1592260 - RNA, 17 nt, Homo sapiens
auagaacugaaugagaa

SEQ ID NO: 1592261 - RNA, 18 nt, Homo sapiens
auagaauaaaggcaguuu

SEQ ID NO: 1592262 - RNA, 12 nt, Homo sapiens
auagaauuaaca

SEQ ID NO: 1592263 - RNA, 17 nt, Homo sapiens
auagaauuaacacauga

SEQ ID NO: 1592264 - RNA, 15 nt, Homo sapiens
auagacacaguauug

SEQ ID NO: 1592265 - RNA, 15 nt, Homo sapiens
auagaccacuggguu

SEQ ID NO: 1592266 - RNA, 15 nt, Homo sapiens
auagacuuaauacau

SEQ ID NO: 1592267 - RNA, 14 nt, Homo sapiens
auagacuuacugca

SEQ ID NO: 1592268 - RNA, 13 nt, Homo sapiens
auagagccugagg

SEQ ID NO: 1592269 - RNA, 23 nt, Homo sapiens
auagauauuccuauugugcaaug

SEQ ID NO: 1592270 - RNA, 19 nt, Homo sapiens
auagauuucuacacugagg

SEQ ID NO: 1592271 - RNA, 19 nt, Homo sapiens
auagcaacagagcacuuga

SEQ ID NO: 1592272 - RNA, 20 nt, Homo sapiens
auagcaacagagcacuugag

SEQ ID NO: 1592273 - RNA, 14 nt, Homo sapiens
auagcaagugaaag

SEQ ID NO: 1592274 - RNA, 17 nt, Homo sapiens
agcuuuaucugucuuga

SEQ ID NO: 1592275 - RNA, 22 nt, Homo sapiens
agcuuucauguaaacugugcac

SEQ ID NO: 1592276 - RNA, 20 nt, Homo sapiens
agcuuuggaauauuuuaucc

SEQ ID NO: 1592277 - RNA, 22 nt, Homo sapiens
agcuuuuauuccuuugaauauu

SEQ ID NO: 1592278 - RNA, 19 nt, Homo sapiens
aggaaaaaaacugggauaa

SEQ ID NO: 1592279 - RNA, 19 nt, Homo sapiens
aggaaaaacacaagcaaaa

SEQ ID NO: 1592280 - RNA, 16 nt, Homo sapiens
aggaaaaauagcaaca

SEQ ID NO: 1592281 - RNA, 13 nt, Homo sapiens
aggaaaaccauuc

SEQ ID NO: 1592282 - RNA, 22 nt, Homo sapiens
aggaaaacuacugauacuuuca

SEQ ID NO: 1592283 - RNA, 21 nt, Homo sapiens
aggaaaaggccccugcaaugu

SEQ ID NO: 1592284 - RNA, 20 nt, Homo sapiens
aggaaaaguuauugugauaa

SEQ ID NO: 1592285 - RNA, 17 nt, Homo sapiens
aggaaaauaaacugaca

SEQ ID NO: 1592286 - RNA, 17 nt, Homo sapiens
aggaaaaucacaucucc

SEQ ID NO: 1592287 - RNA, 18 nt, Homo sapiens
aggaaaaucacaucucca

SEQ ID NO: 1592288 - RNA, 13 nt, Homo sapiens
aggaaacaaccau

SEQ ID NO: 1592289 - RNA, 13 nt, Homo sapiens
aggaaacaugcag

SEQ ID NO: 1592290 - RNA, 21 nt, Homo sapiens
aggaaacuccacaucugccuu

SEQ ID NO: 1592291 - RNA, 16 nt, Homo sapiens
aggaaacuccugugac

SEQ ID NO: 1592292 - RNA, 13 nt, Homo sapiens
aggaaacugaguc

SEQ ID NO: 1592293 - RNA, 16 nt, Homo sapiens
aggaaagaaacuugca

SEQ ID NO: 1592294 - RNA, 18 nt, Homo sapiens
aggaaagaccaugugguu

SEQ ID NO: 1592295 - RNA, 23 nt, Homo sapiens
aguuacaguucugugguuucaug

SEQ ID NO: 1592296 - RNA, 12 nt, Homo sapiens
aguuacugugua

SEQ ID NO: 1592297 - RNA, 12 nt, Homo sapiens
aguuacuuuaga

SEQ ID NO: 1592298 - RNA, 19 nt, Homo sapiens
aguuacuuuagauggcaag

SEQ ID NO: 1592299 - RNA, 17 nt, Homo sapiens
aguuaguuuguauauau

SEQ ID NO: 1592300 - RNA, 14 nt, Homo sapiens
aguuaucaguauuu

SEQ ID NO: 1592301 - RNA, 12 nt, Homo sapiens
aguucaaauacu

SEQ ID NO: 1592302 - RNA, 22 nt, Homo sapiens
aguucaaauucuucugaacuca

SEQ ID NO: 1592303 - RNA, 15 nt, Homo sapiens
aguucacauacaaau

SEQ ID NO: 1592304 - RNA, 17 nt, Homo sapiens
aguucacauacaaauca

SEQ ID NO: 1592305 - RNA, 18 nt, Homo sapiens
aguucacuaaaacccugg

SEQ ID NO: 1592306 - RNA, 19 nt, Homo sapiens
aguucagcuccuuccacca

SEQ ID NO: 1592307 - RNA, 17 nt, Homo sapiens
aguucccuuggccucag

SEQ ID NO: 1592308 - RNA, 14 nt, Homo sapiens
aguuccuagcacug

SEQ ID NO: 1592309 - RNA, 14 nt, Homo sapiens
aguuccucccagga

SEQ ID NO: 1592310 - RNA, 22 nt, Homo sapiens
aguuccuuggagggacaugacu

SEQ ID NO: 1592311 - RNA, 14 nt, Homo sapiens
aguucuacugaccu

SEQ ID NO: 1592312 - RNA, 18 nt, Homo sapiens
aguucuuugaaccacagc

SEQ ID NO: 1592313 - RNA, 18 nt, Homo sapiens
aguugaagggaggggcug

SEQ ID NO: 1592314 - RNA, 11 nt, Homo sapiens
aguugagauuc

SEQ ID NO: 1592315 - RNA, 15 nt, Homo sapiens
aguugagcucagguu

SEQ ID NO: 1592316 - RNA, 17 nt, Homo sapiens
aguugcaauugaauuaa

SEQ ID NO: 1592317 - RNA, 16 nt, Homo sapiens
aguugccaggcacuuu

SEQ ID NO: 1592318 - RNA, 18 nt, Homo sapiens
aguugcugaauguugcau

SEQ ID NO: 1592319 - RNA, 20 nt, Homo sapiens
aguugcugcuugugaucuca

SEQ ID NO: 1592320 - RNA, 20 nt, Homo sapiens
aguuggacuucagucuugcc

SEQ ID NO: 1592321 - RNA, 18 nt, Homo sapiens
aguuggggguguggcucu

SEQ ID NO: 1592322 - RNA, 20 nt, Homo sapiens
aguugugacagucacugcau

SEQ ID NO: 1592323 - RNA, 17 nt, Homo sapiens
aguugugcuaaaccaag

SEQ ID NO: 1592324 - RNA, 23 nt, Homo sapiens
aguuguggggagauccacuggga

SEQ ID NO: 1592325 - RNA, 19 nt, Homo sapiens
aguuguucgccgcguggaa

SEQ ID NO: 1592326 - RNA, 15 nt, Homo sapiens
aguuguucuguuaac

SEQ ID NO: 1592327 - RNA, 16 nt, Homo sapiens
aguuguugacugugau

SEQ ID NO: 1592328 - RNA, 17 nt, Homo sapiens
aguuguugacugugauu

SEQ ID NO: 1592329 - RNA, 19 nt, Homo sapiens
aguuuaacuuccacuguua

SEQ ID NO: 1592330 - RNA, 18 nt, Homo sapiens
aguuuaagguacacuguu

SEQ ID NO: 1592331 - RNA, 19 nt, Homo sapiens
aguuuauacuucucuauua

SEQ ID NO: 1592332 - RNA, 17 nt, Homo sapiens
aguuucaaguaccaaaa

SEQ ID NO: 1592333 - RNA, 15 nt, Homo sapiens
aguuucaaguuuuaa

SEQ ID NO: 1592334 - RNA, 15 nt, Homo sapiens
aguuucagacuugga

SEQ ID NO: 1592335 - RNA, 21 nt, Homo sapiens
aguuucccuucucccagucca

SEQ ID NO: 1592336 - RNA, 17 nt, Homo sapiens
aguuuccucaucugcaa

SEQ ID NO: 1592337 - RNA, 21 nt, Homo sapiens
aguuucuccauccagcucacg

SEQ ID NO: 1592338 - RNA, 16 nt, Homo sapiens
aguuucugacaauuaa

SEQ ID NO: 1592339 - RNA, 22 nt, Homo sapiens
aguuugaaaguuguacaugaua

SEQ ID NO: 1592340 - RNA, 15 nt, Homo sapiens
aguuugauaaaaaga

SEQ ID NO: 1592341 - RNA, 18 nt, Homo sapiens
aguuugauuauucagugu

SEQ ID NO: 1592342 - RNA, 13 nt, Homo sapiens
aguuugcaaaaaa

SEQ ID NO: 1592343 - RNA, 21 nt, Homo sapiens
aguuugcccaccacaacuaac

SEQ ID NO: 1592344 - RNA, 17 nt, Homo sapiens
aguuuggagucacugua

SEQ ID NO: 1592345 - RNA, 14 nt, Homo sapiens
aguuuuaacugugg

SEQ ID NO: 1592346 - RNA, 22 nt, Homo sapiens
aguuuuacaauagacauugcaa

SEQ ID NO: 1592347 - RNA, 11 nt, Homo sapiens
aguuuugcacu

SEQ ID NO: 1592348 - RNA, 20 nt, Homo sapiens
aguuuugguuccuccacugg

SEQ ID NO: 1592349 - RNA, 15 nt, Homo sapiens
aguuuuuguuucaca

SEQ ID NO: 1592350 - RNA, 18 nt, Homo sapiens
aguuuuuuauacugcacu

SEQ ID NO: 1592351 - RNA, 14 nt, Homo sapiens
auaaaaaacacuaa

SEQ ID NO: 1592352 - RNA, 15 nt, Homo sapiens
auaaaaaagaacuuu

SEQ ID NO: 1592353 - RNA, 15 nt, Homo sapiens
auaaaaauaaaucag

SEQ ID NO: 1592354 - RNA, 21 nt, Homo sapiens
auaaaaaugugguuuguacau

SEQ ID NO: 1592355 - RNA, 21 nt, Homo sapiens
auaaaaauguuucuacagaua

SEQ ID NO: 1592356 - RNA, 16 nt, Homo sapiens
auaaaacacugcccuc

SEQ ID NO: 1592357 - RNA, 16 nt, Homo sapiens
auaaaaccaaacaugc

SEQ ID NO: 1592358 - RNA, 15 nt, Homo sapiens
auaaaaccacuguac

SEQ ID NO: 1592359 - RNA, 16 nt, Homo sapiens
auaaaagagaagccaa

SEQ ID NO: 1592360 - RNA, 18 nt, Homo sapiens
auaaaagaucuugcagaa

SEQ ID NO: 1592361 - RNA, 17 nt, Homo sapiens
auaaacagacaggcucu

SEQ ID NO: 1592362 - RNA, 18 nt, Homo sapiens
auaaaccuguucuuccuu

SEQ ID NO: 1592363 - RNA, 18 nt, Homo sapiens
auaaagaucacacaucaa

SEQ ID NO: 1592364 - RNA, 20 nt, Homo sapiens
auaaagaucauuuauaauac

SEQ ID NO: 1592365 - RNA, 15 nt, Homo sapiens
auaaagauuucuagu

SEQ ID NO: 1592366 - RNA, 21 nt, Homo sapiens
auaaagcaguauuuuucuuga

SEQ ID NO: 1592367 - RNA, 13 nt, Homo sapiens
auaaagcagucau

SEQ ID NO: 1592368 - RNA, 22 nt, Homo sapiens
auaaagcagucaugauuuacuu

SEQ ID NO: 1592369 - RNA, 15 nt, Homo sapiens
auaaaggcauuucaa

SEQ ID NO: 1592370 - RNA, 23 nt, Homo sapiens
auaaaggcauuucaaagucucac

SEQ ID NO: 1592371 - RNA, 17 nt, Homo sapiens
auaaagggacacuuuua

SEQ ID NO: 1592372 - RNA, 19 nt, Homo sapiens
auaaaguauuccaccuuaa

SEQ ID NO: 1592373 - RNA, 22 nt, Homo sapiens
auaaagucauccucucacugca

SEQ ID NO: 1592374 - RNA, 23 nt, Homo sapiens
auaaagucauccucucacugcaa

SEQ ID NO: 1592375 - RNA, 14 nt, Homo sapiens
auaaagugaacuuu

SEQ ID NO: 1592376 - RNA, 16 nt, Homo sapiens
auaaaguuguauuuca

SEQ ID NO: 1592377 - RNA, 23 nt, Homo sapiens
auaaauaaaacagcagcagcaaa

SEQ ID NO: 1592378 - RNA, 16 nt, Homo sapiens
auaaauaaucaucccu

SEQ ID NO: 1592379 - RNA, 19 nt, Homo sapiens
auaaauacauuuuugucag

SEQ ID NO: 1592380 - RNA, 18 nt, Homo sapiens
auaaauacugcaaaucag

SEQ ID NO: 1592381 - RNA, 20 nt, Homo sapiens
auaaauacugucaaacaaua

SEQ ID NO: 1592382 - RNA, 19 nt, Homo sapiens
auaaauagaaagaguucua

SEQ ID NO: 1592383 - RNA, 15 nt, Homo sapiens
auaaauagcauuugg

SEQ ID NO: 1592384 - RNA, 15 nt, Homo sapiens
auaaaucaaauauuc

SEQ ID NO: 1592385 - RNA, 14 nt, Homo sapiens
auaaaucuuccuaa

SEQ ID NO: 1592386 - RNA, 18 nt, Homo sapiens
auaaaugaagaaagggag

SEQ ID NO: 1592387 - RNA, 14 nt, Homo sapiens
auaaaugugacuca

SEQ ID NO: 1592388 - RNA, 18 nt, Homo sapiens
auaaauucagaacaagca

SEQ ID NO: 1592389 - RNA, 18 nt, Homo sapiens
auaacauuuaaauuccac

SEQ ID NO: 1592390 - RNA, 22 nt, Homo sapiens
auaacauuuaaauuccacagau

SEQ ID NO: 1592391 - RNA, 22 nt, Homo sapiens
auaacgguuaagaaagcacuua

SEQ ID NO: 1592392 - RNA, 16 nt, Homo sapiens
auaacuaaacuaacga

SEQ ID NO: 1592393 - RNA, 22 nt, Homo sapiens
auaacuccuuguuucagaugau

SEQ ID NO: 1592394 - RNA, 22 nt, Homo sapiens
agccucagaaggccccagagag

SEQ ID NO: 1592395 - RNA, 18 nt, Homo sapiens
agccuccauccuaccccc

SEQ ID NO: 1592396 - RNA, 21 nt, Homo sapiens
agccucccccucagaugaucu

SEQ ID NO: 1592397 - RNA, 20 nt, Homo sapiens
agccucccugaagaccaaaa

SEQ ID NO: 1592398 - RNA, 17 nt, Homo sapiens
agccuccgccugcugug

SEQ ID NO: 1592399 - RNA, 13 nt, Homo sapiens
agccuccucugga

SEQ ID NO: 1592400 - RNA, 15 nt, Homo sapiens
agccucuauccuaca

SEQ ID NO: 1592401 - RNA, 17 nt, Homo sapiens
agccucucaaguaauau

SEQ ID NO: 1592402 - RNA, 19 nt, Homo sapiens
agccucuccccgcucugga

SEQ ID NO: 1592403 - RNA, 21 nt, Homo sapiens
agccucuggaugcauuuccau

SEQ ID NO: 1592404 - RNA, 15 nt, Homo sapiens
agccugaaguggaau

SEQ ID NO: 1592405 - RNA, 21 nt, Homo sapiens
agccugaauuggcuaugcagu

SEQ ID NO: 1592406 - RNA, 16 nt, Homo sapiens
agccugccucccaagg

SEQ ID NO: 1592407 - RNA, 21 nt, Homo sapiens
agccugcggggugcccucuca

SEQ ID NO: 1592408 - RNA, 20 nt, Homo sapiens
agccugcucauguaccucug

SEQ ID NO: 1592409 - RNA, 21 nt, Homo sapiens
agccugcucccccacccccuc

SEQ ID NO: 1592410 - RNA, 14 nt, Homo sapiens
agccugcugcaugg

SEQ ID NO: 1592411 - RNA, 21 nt, Homo sapiens
agccugcugguuuuaucugag

SEQ ID NO: 1592412 - RNA, 12 nt, Homo sapiens
agccuggaugcc

SEQ ID NO: 1592413 - RNA, 15 nt, Homo sapiens
agccuggaugccauc

SEQ ID NO: 1592414 - RNA, 19 nt, Homo sapiens
agccuggccaacaugguga

SEQ ID NO: 1592415 - RNA, 16 nt, Homo sapiens
agccugggagcccaga

SEQ ID NO: 1592416 - RNA, 15 nt, Homo sapiens
agccugggccugggu

SEQ ID NO: 1592417 - RNA, 19 nt, Homo sapiens
agccugggcucacugugcu

SEQ ID NO: 1592418 - RNA, 18 nt, Homo sapiens
agccugggucacagagug

SEQ ID NO: 1592419 - RNA, 13 nt, Homo sapiens
agccugugcaaaa

SEQ ID NO: 1592420 - RNA, 14 nt, Homo sapiens
agccugugcaaaaa

SEQ ID NO: 1592421 - RNA, 15 nt, Homo sapiens
agccugugcaaaaaa

SEQ ID NO: 1592422 - RNA, 16 nt, Homo sapiens
agccuguuugggaugu

SEQ ID NO: 1592423 - RNA, 22 nt, Homo sapiens
agccuuaccuugaaaugcuguu

SEQ ID NO: 1592424 - RNA, 18 nt, Homo sapiens
agccuucucauuugccau

SEQ ID NO: 1592425 - RNA, 18 nt, Homo sapiens
agccuugcucaggugcaa

SEQ ID NO: 1592426 - RNA, 21 nt, Homo sapiens
agccuuuuuuccugggccaga

SEQ ID NO: 1592427 - RNA, 16 nt, Homo sapiens
agcgauggcagugaga

SEQ ID NO: 1592428 - RNA, 21 nt, Homo sapiens
agcgccaaaacaagccaaaga

SEQ ID NO: 1592429 - RNA, 15 nt, Homo sapiens
agcgccgcugugagg

SEQ ID NO: 1592430 - RNA, 20 nt, Homo sapiens
agcgcuguauuuacagacac

SEQ ID NO: 1592431 - RNA, 23 nt, Homo sapiens
agcggcauagcacccguggugca

SEQ ID NO: 1592432 - RNA, 22 nt, Homo sapiens
agcggccccccgcacagccacc

SEQ ID NO: 1592433 - RNA, 19 nt, Homo sapiens
agcgggcuugacugcauug

SEQ ID NO: 1592434 - RNA, 20 nt, Homo sapiens
agcgggcuugacugcauugc

SEQ ID NO: 1592435 - RNA, 22 nt, Homo sapiens
agcgguaucucuggcaccacac

SEQ ID NO: 1592436 - RNA, 15 nt, Homo sapiens
agcgucaagacauuu

SEQ ID NO: 1592437 - RNA, 13 nt, Homo sapiens
agcgucugggaac

SEQ ID NO: 1592438 - RNA, 12 nt, Homo sapiens
agcgugcacucc

SEQ ID NO: 1592439 - RNA, 13 nt, Homo sapiens
agcguguucucag

SEQ ID NO: 1592440 - RNA, 18 nt, Homo sapiens
agcuaaccuuauccugca

SEQ ID NO: 1592441 - RNA, 20 nt, Homo sapiens
agcuaaguacacaauaagca

SEQ ID NO: 1592442 - RNA, 16 nt, Homo sapiens
agcuaauaaugagcua

SEQ ID NO: 1592443 - RNA, 13 nt, Homo sapiens
agcuaaugugcag

SEQ ID NO: 1592444 - RNA, 16 nt, Homo sapiens
agcuacaauauucucu

SEQ ID NO: 1592445 - RNA, 21 nt, Homo sapiens
agcuaccucaaacuuccaguc

SEQ ID NO: 1592446 - RNA, 19 nt, Homo sapiens
agcuacucacuuaucugau

SEQ ID NO: 1592447 - RNA, 19 nt, Homo sapiens
agcuacuguaguugucaca

SEQ ID NO: 1592448 - RNA, 15 nt, Homo sapiens
agcuagaaccuggag

SEQ ID NO: 1592449 - RNA, 14 nt, Homo sapiens
agcuagaauaccac

SEQ ID NO: 1592450 - RNA, 16 nt, Homo sapiens
agcuagaugugucuua

SEQ ID NO: 1592451 - RNA, 16 nt, Homo sapiens
agcuagcaacauuugu

SEQ ID NO: 1592452 - RNA, 15 nt, Homo sapiens
agcuauaacuaagca

SEQ ID NO: 1592453 - RNA, 21 nt, Homo sapiens
agcuaugaucagaagacuuua

SEQ ID NO: 1592454 - RNA, 16 nt, Homo sapiens
agcuauuuaaugacac

SEQ ID NO: 1592455 - RNA, 23 nt, Homo sapiens
agcucaaaguacuacagcaaagc

SEQ ID NO: 1592456 - RNA, 16 nt, Homo sapiens
agcucagacuugccag

SEQ ID NO: 1592457 - RNA, 19 nt, Homo sapiens
agcucagcauuuccacacc

SEQ ID NO: 1592458 - RNA, 20 nt, Homo sapiens
agcucaggucccaggccagc

SEQ ID NO: 1592459 - RNA, 17 nt, Homo sapiens
agcucaguaacugugca

SEQ ID NO: 1592460 - RNA, 23 nt, Homo sapiens
agcuccccccaagaugagcugca

SEQ ID NO: 1592461 - RNA, 17 nt, Homo sapiens
agcuccccucacucugu

SEQ ID NO: 1592462 - RNA, 18 nt, Homo sapiens
agcuccucaaagccucaa

SEQ ID NO: 1592463 - RNA, 15 nt, Homo sapiens
agcuccucuccugga

SEQ ID NO: 1592464 - RNA, 19 nt, Homo sapiens
agcuccuuucaugcuccau

SEQ ID NO: 1592465 - RNA, 18 nt, Homo sapiens
agcucuggggcagaggaa

SEQ ID NO: 1592466 - RNA, 20 nt, Homo sapiens
agcucuggggugggcaguuu

SEQ ID NO: 1592467 - RNA, 19 nt, Homo sapiens
agcucugguuauuuuucuc

SEQ ID NO: 1592468 - RNA, 17 nt, Homo sapiens
agcucuguugaaucaca

SEQ ID NO: 1592469 - RNA, 21 nt, Homo sapiens
agcucuuuuauaugcuaaagg

SEQ ID NO: 1592470 - RNA, 14 nt, Homo sapiens
agcugaaaacauaa

SEQ ID NO: 1592471 - RNA, 19 nt, Homo sapiens
agcugacaauuuccaaagc

SEQ ID NO: 1592472 - RNA, 18 nt, Homo sapiens
agcugacagcacuacaaa

SEQ ID NO: 1592473 - RNA, 17 nt, Homo sapiens
agcugacauugccaaaa

SEQ ID NO: 1592474 - RNA, 22 nt, Homo sapiens
agcugaccccuucgugguuaua

SEQ ID NO: 1592475 - RNA, 18 nt, Homo sapiens
agcugacuguucuuggua

SEQ ID NO: 1592476 - RNA, 20 nt, Homo sapiens
agcugagaucgugcuacugc

SEQ ID NO: 1592477 - RNA, 20 nt, Homo sapiens
agcugauguuuugguguauu

SEQ ID NO: 1592478 - RNA, 12 nt, Homo sapiens
agcugauucacu

SEQ ID NO: 1592479 - RNA, 13 nt, Homo sapiens
agcugcccuugca

SEQ ID NO: 1592480 - RNA, 20 nt, Homo sapiens
agcugccucuucucuugaca

SEQ ID NO: 1592481 - RNA, 13 nt, Homo sapiens
agcugccugguau

SEQ ID NO: 1592482 - RNA, 19 nt, Homo sapiens
agcugcucccuuuccugca

SEQ ID NO: 1592483 - RNA, 13 nt, Homo sapiens
agcugcugauaca

SEQ ID NO: 1592484 - RNA, 13 nt, Homo sapiens
agcugcugucacu

SEQ ID NO: 1592485 - RNA, 19 nt, Homo sapiens
agcugcugugccugaugug

SEQ ID NO: 1592486 - RNA, 13 nt, Homo sapiens
agcuggaaccaug

SEQ ID NO: 1592487 - RNA, 23 nt, Homo sapiens
agcuggaggacuagaaccuggag

SEQ ID NO: 1592488 - RNA, 14 nt, Homo sapiens
agcuggagucuguc

SEQ ID NO: 1592489 - RNA, 18 nt, Homo sapiens
agcuggagucugucaaug

SEQ ID NO: 1592490 - RNA, 14 nt, Homo sapiens
agcuggcucuguga

SEQ ID NO: 1592491 - RNA, 21 nt, Homo sapiens
agcugguaggauguaagccug

SEQ ID NO: 1592492 - RNA, 18 nt, Homo sapiens
agcugguuggagagcuag

SEQ ID NO: 1592493 - RNA, 21 nt, Homo sapiens
agcuguaaccgauaugcacuu

SEQ ID NO: 1592494 - RNA, 23 nt, Homo sapiens
agcuguauaauuaauugucauua

SEQ ID NO: 1592495 - RNA, 17 nt, Homo sapiens
agcugucagaacacucc

SEQ ID NO: 1592496 - RNA, 12 nt, Homo sapiens
agcugucaucac

SEQ ID NO: 1592497 - RNA, 18 nt, Homo sapiens
agcugugccgggaggcag

SEQ ID NO: 1592498 - RNA, 13 nt, Homo sapiens
agcuguguucaca

SEQ ID NO: 1592499 - RNA, 20 nt, Homo sapiens
agcuguuuaugcauagauaa

SEQ ID NO: 1592500 - RNA, 19 nt, Homo sapiens
agcuguuucaaaugugcau

SEQ ID NO: 1592501 - RNA, 14 nt, Homo sapiens
agcuuaaacacauu

SEQ ID NO: 1592502 - RNA, 22 nt, Homo sapiens
agcuuaaaguuauguuauuaua

SEQ ID NO: 1592503 - RNA, 15 nt, Homo sapiens
agcuuaaguguaaau

SEQ ID NO: 1592504 - RNA, 13 nt, Homo sapiens
agcuuaucugccc

SEQ ID NO: 1592505 - RNA, 14 nt, Homo sapiens
agcuucacaguacc

SEQ ID NO: 1592506 - RNA, 22 nt, Homo sapiens
agcuucucugcaguaaaacaca

SEQ ID NO: 1592507 - RNA, 16 nt, Homo sapiens
agcuucuucacaggca

SEQ ID NO: 1592508 - RNA, 17 nt, Homo sapiens
agcuugaaagcaguuaa

SEQ ID NO: 1592509 - RNA, 23 nt, Homo sapiens
agcuugcucuucagugggagaaa

SEQ ID NO: 1592510 - RNA, 22 nt, Homo sapiens
agcuuggaguucucuauacuca

SEQ ID NO: 1592511 - RNA, 20 nt, Homo sapiens
agcuugucugugaucucugc

SEQ ID NO: 1592512 - RNA, 13 nt, Homo sapiens
agaugucacagau

SEQ ID NO: 1592513 - RNA, 21 nt, Homo sapiens
agaugucuuaaccucagggag

SEQ ID NO: 1592514 - RNA, 22 nt, Homo sapiens
agaugugauuuggaccauggca

SEQ ID NO: 1592515 - RNA, 22 nt, Homo sapiens
agaugugggcagugaugucacu

SEQ ID NO: 1592516 - RNA, 13 nt, Homo sapiens
agauguguaaaca

SEQ ID NO: 1592517 - RNA, 14 nt, Homo sapiens
agaugugucuuacc

SEQ ID NO: 1592518 - RNA, 21 nt, Homo sapiens
agauguguuuuguuuuggacu

SEQ ID NO: 1592519 - RNA, 19 nt, Homo sapiens
agauguucuaagucuuucc

SEQ ID NO: 1592520 - RNA, 17 nt, Homo sapiens
agauguugacucuaaag

SEQ ID NO: 1592521 - RNA, 20 nt, Homo sapiens
agauguugagaauguucauc

SEQ ID NO: 1592522 - RNA, 12 nt, Homo sapiens
agauguuuauau

SEQ ID NO: 1592523 - RNA, 21 nt, Homo sapiens
agauguuuguuuucaaaauac

SEQ ID NO: 1592524 - RNA, 20 nt, Homo sapiens
agauuacugaaaaaugcaaa

SEQ ID NO: 1592525 - RNA, 23 nt, Homo sapiens
agauuagccuguauucucuucag

SEQ ID NO: 1592526 - RNA, 16 nt, Homo sapiens
agauuauaaacugacu

SEQ ID NO: 1592527 - RNA, 12 nt, Homo sapiens
agauuaucuggg

SEQ ID NO: 1592528 - RNA, 19 nt, Homo sapiens
agauuauggaugauuaaau

SEQ ID NO: 1592529 - RNA, 23 nt, Homo sapiens
agauuauuaucuauuaucucaau

SEQ ID NO: 1592530 - RNA, 21 nt, Homo sapiens
agauuauugugacuucacugu

SEQ ID NO: 1592531 - RNA, 22 nt, Homo sapiens
agauucagacuuggacuaugau

SEQ ID NO: 1592532 - RNA, 13 nt, Homo sapiens
agauuccaaaaag

SEQ ID NO: 1592533 - RNA, 19 nt, Homo sapiens
agauuccaaaaagcacaua

SEQ ID NO: 1592534 - RNA, 19 nt, Homo sapiens
agauuccaccuagagcuag

SEQ ID NO: 1592535 - RNA, 23 nt, Homo sapiens
gccuguuggcaggcccacucccc

SEQ ID NO: 1592536 - RNA, 19 nt, Homo sapiens
gccuuaaacacacauugca

SEQ ID NO: 1592537 - RNA, 15 nt, Homo sapiens
gccuuaaccaugagg

SEQ ID NO: 1592538 - RNA, 15 nt, Homo sapiens
gccuucaagugccaa

SEQ ID NO: 1592539 - RNA, 16 nt, Homo sapiens
gccuucaagugccaaa

SEQ ID NO: 1592540 - RNA, 17 nt, Homo sapiens
gccuucaagugccaaac

SEQ ID NO: 1592541 - RNA, 17 nt, Homo sapiens
gccuucagaaugcuccu

SEQ ID NO: 1592542 - RNA, 21 nt, Homo sapiens
gccuucaucuucacugcaauu

SEQ ID NO: 1592543 - RNA, 16 nt, Homo sapiens
gccuuccccagggugu

SEQ ID NO: 1592544 - RNA, 15 nt, Homo sapiens
gccuucucaccagcu

SEQ ID NO: 1592545 - RNA, 15 nt, Homo sapiens
gccuugcacaggaca

SEQ ID NO: 1592546 - RNA, 18 nt, Homo sapiens
gccuugggcuccugauga

SEQ ID NO: 1592547 - RNA, 14 nt, Homo sapiens
gccuugggcugcuc

SEQ ID NO: 1592548 - RNA, 20 nt, Homo sapiens
gccuugucacgccagacuuc

SEQ ID NO: 1592549 - RNA, 23 nt, Homo sapiens
gccuugucuucuuagcugucacc

SEQ ID NO: 1592550 - RNA, 16 nt, Homo sapiens
gccuuuaaaucuguga

SEQ ID NO: 1592551 - RNA, 12 nt, Homo sapiens
gccuuuaauauu

SEQ ID NO: 1592552 - RNA, 19 nt, Homo sapiens
gccuuuaguucuccacugg

SEQ ID NO: 1592553 - RNA, 15 nt, Homo sapiens
gccuuuccucaaaac

SEQ ID NO: 1592554 - RNA, 14 nt, Homo sapiens
gccuuucgugaucu

SEQ ID NO: 1592555 - RNA, 12 nt, Homo sapiens
gccuuuuguuaa

SEQ ID NO: 1592556 - RNA, 19 nt, Homo sapiens
gcgaacauaaaugucugua

SEQ ID NO: 1592557 - RNA, 19 nt, Homo sapiens
gcgaagcguuguccucagc

SEQ ID NO: 1592558 - RNA, 18 nt, Homo sapiens
gcgaagggugguuugcag

SEQ ID NO: 1592559 - RNA, 17 nt, Homo sapiens
gcgaccuccuuucauca

SEQ ID NO: 1592560 - RNA, 21 nt, Homo sapiens
gcgagacuccaccucuaccaa

SEQ ID NO: 1592561 - RNA, 15 nt, Homo sapiens
gcgagacuccaucuc

SEQ ID NO: 1592562 - RNA, 16 nt, Homo sapiens
gcgagacuccaucucu

SEQ ID NO: 1592563 - RNA, 22 nt, Homo sapiens
gcgcaagccuguaaucccagcu

SEQ ID NO: 1592564 - RNA, 23 nt, Homo sapiens
gcgccaaauaaugucucugugag

SEQ ID NO: 1592565 - RNA, 13 nt, Homo sapiens
gcgccgcugugag

SEQ ID NO: 1592566 - RNA, 19 nt, Homo sapiens
gcgcucaggggcuccaugc

SEQ ID NO: 1592567 - RNA, 17 nt, Homo sapiens
gcggauccaagcaaaug

SEQ ID NO: 1592568 - RNA, 23 nt, Homo sapiens
gcggcccugaccaaugugugaag

SEQ ID NO: 1592569 - RNA, 13 nt, Homo sapiens
gcgggaggcggug

SEQ ID NO: 1592570 - RNA, 12 nt, Homo sapiens
gcgggcugagga

SEQ ID NO: 1592571 - RNA, 23 nt, Homo sapiens
gcgguaggucauucuuuugccac

SEQ ID NO: 1592572 - RNA, 12 nt, Homo sapiens
gcgguggcucac

SEQ ID NO: 1592573 - RNA, 12 nt, Homo sapiens
gcguccugguca

SEQ ID NO: 1592574 - RNA, 22 nt, Homo sapiens
gcgugaucucggcucacugcaa

SEQ ID NO: 1592575 - RNA, 23 nt, Homo sapiens
gcguggaacucgugucuggcaca

SEQ ID NO: 1592576 - RNA, 16 nt, Homo sapiens
gcgugugagugaggga

SEQ ID NO: 1592577 - RNA, 12 nt, Homo sapiens
gcguucaaagag

SEQ ID NO: 1592578 - RNA, 19 nt, Homo sapiens
gcguuguugcauguuugaa

SEQ ID NO: 1592579 - RNA, 14 nt, Homo sapiens
gcuaaaaagcaaca

SEQ ID NO: 1592580 - RNA, 18 nt, Homo sapiens
gcuaaaggaagugaaucu

SEQ ID NO: 1592581 - RNA, 17 nt, Homo sapiens
gcuaacaguugccacau

SEQ ID NO: 1592582 - RNA, 16 nt, Homo sapiens
gcuaaccuccaacaca

SEQ ID NO: 1592583 - RNA, 21 nt, Homo sapiens
gcuaaccugcacguugugcac

SEQ ID NO: 1592584 - RNA, 19 nt, Homo sapiens
gcuaagcggaacaugugcu

SEQ ID NO: 1592585 - RNA, 13 nt, Homo sapiens
gcuaaggcucuau

SEQ ID NO: 1592586 - RNA, 18 nt, Homo sapiens
gcuaaguauugaauuuca

SEQ ID NO: 1592587 - RNA, 21 nt, Homo sapiens
gcuaauaaauaaucaucccuc

SEQ ID NO: 1592588 - RNA, 12 nt, Homo sapiens
gcuaauaccugu

SEQ ID NO: 1592589 - RNA, 21 nt, Homo sapiens
gcuaaucugccugguuuuauu

SEQ ID NO: 1592590 - RNA, 20 nt, Homo sapiens
gcuaauggaauuacugccuu

SEQ ID NO: 1592591 - RNA, 12 nt, Homo sapiens
gcuaauguugcu

SEQ ID NO: 1592592 - RNA, 23 nt, Homo sapiens
gcuacaucuuuuuuucuaugaaa

SEQ ID NO: 1592593 - RNA, 19 nt, Homo sapiens
gcuaccccauucucuagac

SEQ ID NO: 1592594 - RNA, 19 nt, Homo sapiens
gcuaccuacaugcugaaaa

SEQ ID NO: 1592595 - RNA, 13 nt, Homo sapiens
gcuacugcacucu

SEQ ID NO: 1592596 - RNA, 16 nt, Homo sapiens
gcuacuguucuugaca

SEQ ID NO: 1592597 - RNA, 13 nt, Homo sapiens
gcuacuugggagg

SEQ ID NO: 1592598 - RNA, 20 nt, Homo sapiens
gcuagaaaaaaaaaacacuu

SEQ ID NO: 1592599 - RNA, 11 nt, Homo sapiens
gcuagaaccug

SEQ ID NO: 1592600 - RNA, 14 nt, Homo sapiens
gcuagaugugucuu

SEQ ID NO: 1592601 - RNA, 17 nt, Homo sapiens
gcuaggaaaagaaauca

SEQ ID NO: 1592602 - RNA, 19 nt, Homo sapiens
gcuaggguggcccuugcag

SEQ ID NO: 1592603 - RNA, 16 nt, Homo sapiens
gcuagguaucauucaa

SEQ ID NO: 1592604 - RNA, 15 nt, Homo sapiens
gcuaggucuugccaa

SEQ ID NO: 1592605 - RNA, 17 nt, Homo sapiens
gcuaguccucacuucua

SEQ ID NO: 1592606 - RNA, 11 nt, Homo sapiens
gcuaguguuua

SEQ ID NO: 1592607 - RNA, 14 nt, Homo sapiens
gcuauaaagcagua

SEQ ID NO: 1592608 - RNA, 14 nt, Homo sapiens
gcuauagcuacagg

SEQ ID NO: 1592609 - RNA, 23 nt, Homo sapiens
gcuauauuccuuuuucuaugaaa

SEQ ID NO: 1592610 - RNA, 15 nt, Homo sapiens
gcuaucccacuguau

SEQ ID NO: 1592611 - RNA, 21 nt, Homo sapiens
gcuaucuggccugagacaaca

SEQ ID NO: 1592612 - RNA, 22 nt, Homo sapiens
gcuaugaaaaugagcccuggcu

SEQ ID NO: 1592613 - RNA, 18 nt, Homo sapiens
gcuaugcaguacauugua

SEQ ID NO: 1592614 - RNA, 13 nt, Homo sapiens
gcuauugcugcug

SEQ ID NO: 1592615 - RNA, 16 nt, Homo sapiens
gcuauugucuguaaua

SEQ ID NO: 1592616 - RNA, 22 nt, Homo sapiens
gcuauuuaacauuuuacaguaa

SEQ ID NO: 1592617 - RNA, 19 nt, Homo sapiens
gcuauuucuucuacugcua

SEQ ID NO: 1592618 - RNA, 14 nt, Homo sapiens
gcuauuugucaucu

SEQ ID NO: 1592619 - RNA, 19 nt, Homo sapiens
gcuauuuugugaagccaug

SEQ ID NO: 1592620 - RNA, 19 nt, Homo sapiens
gcucaaaguacuacagcaa

SEQ ID NO: 1592621 - RNA, 22 nt, Homo sapiens
gcucaaaguacuacagcaaagc

SEQ ID NO: 1592622 - RNA, 20 nt, Homo sapiens
gcucaaauuccgagugcaga

SEQ ID NO: 1592623 - RNA, 19 nt, Homo sapiens
gcucaacggcuccaucacc

SEQ ID NO: 1592624 - RNA, 20 nt, Homo sapiens
gcucaagcaauccuccugcc

SEQ ID NO: 1592625 - RNA, 16 nt, Homo sapiens
gcucaauagcuugaag

SEQ ID NO: 1592626 - RNA, 22 nt, Homo sapiens
gcucacacugagaauguaagaa

SEQ ID NO: 1592627 - RNA, 12 nt, Homo sapiens
gcucaccagccc

SEQ ID NO: 1592628 - RNA, 20 nt, Homo sapiens
gcucaccccccacacucacu

SEQ ID NO: 1592629 - RNA, 17 nt, Homo sapiens
gcucaccgcccaucagg

SEQ ID NO: 1592630 - RNA, 16 nt, Homo sapiens
gcuucaucugucaagu

SEQ ID NO: 1592631 - RNA, 16 nt, Homo sapiens
gcuucaugccagguua

SEQ ID NO: 1592632 - RNA, 22 nt, Homo sapiens
gcuucccgaguaccagugacac

SEQ ID NO: 1592633 - RNA, 18 nt, Homo sapiens
gcuucccugaaagacuga

SEQ ID NO: 1592634 - RNA, 15 nt, Homo sapiens
gcuuccuacaaagac

SEQ ID NO: 1592635 - RNA, 10 nt, Homo sapiens
gcuuccucua

SEQ ID NO: 1592636 - RNA, 21 nt, Homo sapiens
gcuucggagugaauguggcag

SEQ ID NO: 1592637 - RNA, 22 nt, Homo sapiens
gcuucuccuguuuuauauauua

SEQ ID NO: 1592638 - RNA, 18 nt, Homo sapiens
gcuucugggccacucagg

SEQ ID NO: 1592639 - RNA, 13 nt, Homo sapiens
gcuucuuuacuua

SEQ ID NO: 1592640 - RNA, 20 nt, Homo sapiens
gcuucuuuccagaaaccaaa

SEQ ID NO: 1592641 - RNA, 15 nt, Homo sapiens
gcuugccugaagcuu

SEQ ID NO: 1592642 - RNA, 19 nt, Homo sapiens
gcuugcgcuggaccugguu

SEQ ID NO: 1592643 - RNA, 20 nt, Homo sapiens
gcuuggagcaaucagaacuu

SEQ ID NO: 1592644 - RNA, 16 nt, Homo sapiens
gcuuguccaagacagg

SEQ ID NO: 1592645 - RNA, 16 nt, Homo sapiens
gcuuuaauaugagcuu

SEQ ID NO: 1592646 - RNA, 21 nt, Homo sapiens
gcuuuacccacuaacugggag

SEQ ID NO: 1592647 - RNA, 17 nt, Homo sapiens
gcuuuacucaagcagau

SEQ ID NO: 1592648 - RNA, 20 nt, Homo sapiens
gcuuuagaaacagugcaaca

SEQ ID NO: 1592649 - RNA, 22 nt, Homo sapiens
gcuuuaugauuuucauaacuua

SEQ ID NO: 1592650 - RNA, 14 nt, Homo sapiens
gcuuucagagccag

SEQ ID NO: 1592651 - RNA, 17 nt, Homo sapiens
gcuuuccagacuuugaa

SEQ ID NO: 1592652 - RNA, 16 nt, Homo sapiens
gcuuuccuucaucucc

SEQ ID NO: 1592653 - RNA, 12 nt, Homo sapiens
gcuuucugccac

SEQ ID NO: 1592654 - RNA, 18 nt, Homo sapiens
gcuuucuuaucccaguga

SEQ ID NO: 1592655 - RNA, 12 nt, Homo sapiens
gcuuugccaaaa

SEQ ID NO: 1592656 - RNA, 12 nt, Homo sapiens
gcuuugcccauu

SEQ ID NO: 1592657 - RNA, 20 nt, Homo sapiens
gauucagaaaauguucuguu

SEQ ID NO: 1592658 - RNA, 18 nt, Homo sapiens
gauucaggugcuggagaa

SEQ ID NO: 1592659 - RNA, 17 nt, Homo sapiens
gauucaguuuugcuuau

SEQ ID NO: 1592660 - RNA, 18 nt, Homo sapiens
gauucaucaucccuuaau

SEQ ID NO: 1592661 - RNA, 13 nt, Homo sapiens
gauucccagagac

SEQ ID NO: 1592662 - RNA, 18 nt, Homo sapiens
gauuccuggcagagccau

SEQ ID NO: 1592663 - RNA, 22 nt, Homo sapiens
gauucuuauuuuaccuucucau

SEQ ID NO: 1592664 - RNA, 22 nt, Homo sapiens
gauucuuuuuuucugucaguaa

SEQ ID NO: 1592665 - RNA, 20 nt, Homo sapiens
gauugaauuuuuaagcaaau

SEQ ID NO: 1592666 - RNA, 21 nt, Homo sapiens
gauugacugugcccaguacuu

SEQ ID NO: 1592667 - RNA, 16 nt, Homo sapiens
gauugauuaaugaacu

SEQ ID NO: 1592668 - RNA, 18 nt, Homo sapiens
gauuguauaaaugcaaua

SEQ ID NO: 1592669 - RNA, 19 nt, Homo sapiens
gauuuaaagcaucaucugu

SEQ ID NO: 1592670 - RNA, 16 nt, Homo sapiens
gauuuaaucugccaag

SEQ ID NO: 1592671 - RNA, 22 nt, Homo sapiens
gauuuaugaugcacuuauucaa

SEQ ID NO: 1592672 - RNA, 22 nt, Homo sapiens
gauuuauuuaagggggaaaaag

SEQ ID NO: 1592673 - RNA, 22 nt, Homo sapiens
gauuuauuuacucuugcuggau

SEQ ID NO: 1592674 - RNA, 21 nt, Homo sapiens
gauuucaucugcucuccuucc

SEQ ID NO: 1592675 - RNA, 12 nt, Homo sapiens
gauuucauucaa

SEQ ID NO: 1592676 - RNA, 16 nt, Homo sapiens
gauuuccaguuuuucu

SEQ ID NO: 1592677 - RNA, 23 nt, Homo sapiens
gauuuccuugaauguggcuugag

SEQ ID NO: 1592678 - RNA, 23 nt, Homo sapiens
gauuucucuacuugucauaucac

SEQ ID NO: 1592679 - RNA, 21 nt, Homo sapiens
gauuugaaaauuguauaccaa

SEQ ID NO: 1592680 - RNA, 18 nt, Homo sapiens
gauuuguaugcucauuga

SEQ ID NO: 1592681 - RNA, 19 nt, Homo sapiens
gauuuuaccaaagcaucaa

SEQ ID NO: 1592682 - RNA, 17 nt, Homo sapiens
gauuuuaugaguucuug

SEQ ID NO: 1592683 - RNA, 23 nt, Homo sapiens
gauuuucuuuuuaacuuuaccaa

SEQ ID NO: 1592684 - RNA, 13 nt, Homo sapiens
gauuuugaaccca

SEQ ID NO: 1592685 - RNA, 18 nt, Homo sapiens
gauuuugaagagauuuua

SEQ ID NO: 1592686 - RNA, 21 nt, Homo sapiens
gauuuuuagccccaaaucucu

SEQ ID NO: 1592687 - RNA, 20 nt, Homo sapiens
gauuuuuuucccaauugaga

SEQ ID NO: 1592688 - RNA, 19 nt, Homo sapiens
gauuuuuuuguaaauauga

SEQ ID NO: 1592689 - RNA, 22 nt, Homo sapiens
gauuuuuuuuaauuaccaugcu

SEQ ID NO: 1592690 - RNA, 22 nt, Homo sapiens
gauuuuuuuuucauacacuuau

SEQ ID NO: 1592691 - RNA, 20 nt, Homo sapiens
gcaaaaagucuacauacuuu

SEQ ID NO: 1592692 - RNA, 14 nt, Homo sapiens
gcaaaaaucuccca

SEQ ID NO: 1592693 - RNA, 15 nt, Homo sapiens
gcaaaacuccgucuc

SEQ ID NO: 1592694 - RNA, 18 nt, Homo sapiens
gcaaacagaaaaagaagg

SEQ ID NO: 1592695 - RNA, 14 nt, Homo sapiens
gcaaacugcuuuau

SEQ ID NO: 1592696 - RNA, 17 nt, Homo sapiens
gcaaagaacucauuuga

SEQ ID NO: 1592697 - RNA, 18 nt, Homo sapiens
gcaaagaacucauuugaa

SEQ ID NO: 1592698 - RNA, 20 nt, Homo sapiens
gcaaagaacucauuugaaug

SEQ ID NO: 1592699 - RNA, 22 nt, Homo sapiens
gcaaagccuagccugcauauca

SEQ ID NO: 1592700 - RNA, 14 nt, Homo sapiens
gcaaagggaaccau

SEQ ID NO: 1592701 - RNA, 12 nt, Homo sapiens
gcaaaguacugu

SEQ ID NO: 1592702 - RNA, 21 nt, Homo sapiens
gcaaaguacuguaagaauaau

SEQ ID NO: 1592703 - RNA, 14 nt, Homo sapiens
gcaaagugcccaug

SEQ ID NO: 1592704 - RNA, 17 nt, Homo sapiens
gcaaaguuuacagaugu

SEQ ID NO: 1592705 - RNA, 13 nt, Homo sapiens
gcaaauacuguau

SEQ ID NO: 1592706 - RNA, 18 nt, Homo sapiens
gcaaauauuuauaagcua

SEQ ID NO: 1592707 - RNA, 20 nt, Homo sapiens
gcaaauuucuauaaauuuaa

SEQ ID NO: 1592708 - RNA, 17 nt, Homo sapiens
gcaacaaaauguagaau

SEQ ID NO: 1592709 - RNA, 13 nt, Homo sapiens
gcaacaaugacuu

SEQ ID NO: 1592710 - RNA, 14 nt, Homo sapiens
gcaacagacuugaa

SEQ ID NO: 1592711 - RNA, 22 nt, Homo sapiens
gcaacagcaaaucacgaccacu

SEQ ID NO: 1592712 - RNA, 21 nt, Homo sapiens
gcaacagggccaugugcugcc

SEQ ID NO: 1592713 - RNA, 11 nt, Homo sapiens
gcaacccaaau

SEQ ID NO: 1592714 - RNA, 23 nt, Homo sapiens
gcaacugggucugacaugaacac

SEQ ID NO: 1592715 - RNA, 18 nt, Homo sapiens
gcaagaaaucagccauaa

SEQ ID NO: 1592716 - RNA, 16 nt, Homo sapiens
gcaagacauaaagccu

SEQ ID NO: 1592717 - RNA, 15 nt, Homo sapiens
gcaagaccucaucuc

SEQ ID NO: 1592718 - RNA, 20 nt, Homo sapiens
gcaagaucugcucgcugaga

SEQ ID NO: 1592719 - RNA, 22 nt, Homo sapiens
gcaagaugaaugcagauuacac

SEQ ID NO: 1592720 - RNA, 21 nt, Homo sapiens
gcaagauuucacaucagcuuu

SEQ ID NO: 1592721 - RNA, 16 nt, Homo sapiens
gcaaggaaacuaugua

SEQ ID NO: 1592722 - RNA, 23 nt, Homo sapiens
gcaagggaccuucaugcccuucu

SEQ ID NO: 1592723 - RNA, 18 nt, Homo sapiens
gcaagugaacucaucccu

SEQ ID NO: 1592724 - RNA, 20 nt, Homo sapiens
gcaaguuaacuuggaaauca

SEQ ID NO: 1592725 - RNA, 22 nt, Homo sapiens
gcaaguuaacuuggaaaucagu

SEQ ID NO: 1592726 - RNA, 14 nt, Homo sapiens
gcaaguugcucuga

SEQ ID NO: 1592727 - RNA, 13 nt, Homo sapiens
gcaauaccaaugu

SEQ ID NO: 1592728 - RNA, 15 nt, Homo sapiens
gcaauaccaauguuc

SEQ ID NO: 1592729 - RNA, 14 nt, Homo sapiens
gcaauacuguccag

SEQ ID NO: 1592730 - RNA, 19 nt, Homo sapiens
gcaauacuguccaguuuuc

SEQ ID NO: 1592731 - RNA, 18 nt, Homo sapiens
gcaauagauuacugaugu

SEQ ID NO: 1592732 - RNA, 16 nt, Homo sapiens
gcaauagcaguuauaa

SEQ ID NO: 1592733 - RNA, 21 nt, Homo sapiens
gcaauauccaaauaaugagua

SEQ ID NO: 1592734 - RNA, 15 nt, Homo sapiens
gcaaucuacuggaaa

SEQ ID NO: 1592735 - RNA, 16 nt, Homo sapiens
gcaaucuacuggaaau

SEQ ID NO: 1592736 - RNA, 15 nt, Homo sapiens
gcaaucugacccuau

SEQ ID NO: 1592737 - RNA, 22 nt, Homo sapiens
gcaaugugggaucucagaccca

SEQ ID NO: 1592738 - RNA, 17 nt, Homo sapiens
gcaauuacggggugacc

SEQ ID NO: 1592739 - RNA, 21 nt, Homo sapiens
gcaauugaaggaucaucugaa

SEQ ID NO: 1592740 - RNA, 17 nt, Homo sapiens
gcaauuuuguguaaauu

SEQ ID NO: 1592741 - RNA, 20 nt, Homo sapiens
gcacaaaagcagauacuuga

SEQ ID NO: 1592742 - RNA, 13 nt, Homo sapiens
gcacaagccagac

SEQ ID NO: 1592743 - RNA, 12 nt, Homo sapiens
gcacaaguacuu

SEQ ID NO: 1592744 - RNA, 20 nt, Homo sapiens
gcauagggucacuuugccau

SEQ ID NO: 1592745 - RNA, 15 nt, Homo sapiens
gcauaugcacaguca

SEQ ID NO: 1592746 - RNA, 20 nt, Homo sapiens
gcauaugggugggauuuugc

SEQ ID NO: 1592747 - RNA, 15 nt, Homo sapiens
gcauauguugaauac

SEQ ID NO: 1592748 - RNA, 14 nt, Homo sapiens
gcaucaaagaaucu

SEQ ID NO: 1592749 - RNA, 17 nt, Homo sapiens
gcaucaauacaaccagc

SEQ ID NO: 1592750 - RNA, 14 nt, Homo sapiens
gcaucaauuuucaa

SEQ ID NO: 1592751 - RNA, 23 nt, Homo sapiens
gcaucagauaaugccaccaaagg

SEQ ID NO: 1592752 - RNA, 22 nt, Homo sapiens
gcaucccaaaccacgccucuug

SEQ ID NO: 1592753 - RNA, 20 nt, Homo sapiens
gcauccccccugcucagcaa

SEQ ID NO: 1592754 - RNA, 22 nt, Homo sapiens
gcauccuuuucaaaaccuaaaa

SEQ ID NO: 1592755 - RNA, 15 nt, Homo sapiens
gcaucuacacaauuu

SEQ ID NO: 1592756 - RNA, 16 nt, Homo sapiens
gcaucuacacaauuua

SEQ ID NO: 1592757 - RNA, 20 nt, Homo sapiens
gcaucuaucuggugauuucu

SEQ ID NO: 1592758 - RNA, 17 nt, Homo sapiens
gcaucuccccucagauu

SEQ ID NO: 1592759 - RNA, 19 nt, Homo sapiens
gcaucuccccucagauucc

SEQ ID NO: 1592760 - RNA, 17 nt, Homo sapiens
gcaucugcacauaggca

SEQ ID NO: 1592761 - RNA, 16 nt, Homo sapiens
gcaucuggaacaacag

SEQ ID NO: 1592762 - RNA, 19 nt, Homo sapiens
gcaucuguaacagcauuaa

SEQ ID NO: 1592763 - RNA, 15 nt, Homo sapiens
gcaugcacacugaga

SEQ ID NO: 1592764 - RNA, 19 nt, Homo sapiens
gcaugcucaguuggugcug

SEQ ID NO: 1592765 - RNA, 17 nt, Homo sapiens
gcauggaacagcauuac

SEQ ID NO: 1592766 - RNA, 17 nt, Homo sapiens
gcauggcucucuauucc

SEQ ID NO: 1592767 - RNA, 17 nt, Homo sapiens
gcaugggugagaccuga

SEQ ID NO: 1592768 - RNA, 16 nt, Homo sapiens
gcauggucuuaugcac

SEQ ID NO: 1592769 - RNA, 15 nt, Homo sapiens
gcauggugcagggag

SEQ ID NO: 1592770 - RNA, 17 nt, Homo sapiens
gcaugucugccuaugca

SEQ ID NO: 1592771 - RNA, 16 nt, Homo sapiens
gcauguggagacacuc

SEQ ID NO: 1592772 - RNA, 20 nt, Homo sapiens
gaaacccccaucucuacuaa

SEQ ID NO: 1592773 - RNA, 14 nt, Homo sapiens
gaaaccccgucucu

SEQ ID NO: 1592774 - RNA, 19 nt, Homo sapiens
gaaacccuaagccaagacc

SEQ ID NO: 1592775 - RNA, 12 nt, Homo sapiens
gaaaccuuccac

SEQ ID NO: 1592776 - RNA, 20 nt, Homo sapiens
gaaacuacugccuuuagaaa

SEQ ID NO: 1592777 - RNA, 11 nt, Homo sapiens
gaaacuauuaa

SEQ ID NO: 1592778 - RNA, 18 nt, Homo sapiens
gaaacugagucacucaca

SEQ ID NO: 1592779 - RNA, 19 nt, Homo sapiens
gaaacuuuaaaagacugaa

SEQ ID NO: 1592780 - RNA, 22 nt, Homo sapiens
gaaagaaaaucaggcuggccaa

SEQ ID NO: 1592781 - RNA, 12 nt, Homo sapiens
gaaagaagaaua

SEQ ID NO: 1592782 - RNA, 19 nt, Homo sapiens
gaaagaaguuauuuuccag

SEQ ID NO: 1592783 - RNA, 14 nt, Homo sapiens
gaaagaaugcaaga

SEQ ID NO: 1592784 - RNA, 21 nt, Homo sapiens
gaaagaccaugugguuugcug

SEQ ID NO: 1592785 - RNA, 13 nt, Homo sapiens
gaaagacuugaaa

SEQ ID NO: 1592786 - RNA, 22 nt, Homo sapiens
gaaagagcagucagaguccagu

SEQ ID NO: 1592787 - RNA, 14 nt, Homo sapiens
gaaagaggaaugaa

SEQ ID NO: 1592788 - RNA, 14 nt, Homo sapiens
gaaagaugagaaau

SEQ ID NO: 1592789 - RNA, 19 nt, Homo sapiens
gaaagcagaaaaucuacca

SEQ ID NO: 1592790 - RNA, 18 nt, Homo sapiens
gaaagcauaaagcucaaa

SEQ ID NO: 1592791 - RNA, 18 nt, Homo sapiens
gaaagccaacauguggcu

SEQ ID NO: 1592792 - RNA, 18 nt, Homo sapiens
gaaagcucuaaagaccau

SEQ ID NO: 1592793 - RNA, 19 nt, Homo sapiens
gaaagcuuuuauuccuuug

SEQ ID NO: 1592794 - RNA, 13 nt, Homo sapiens
gaaaggaagcauu

SEQ ID NO: 1592795 - RNA, 17 nt, Homo sapiens
gaaaggauuuuaccaaa

SEQ ID NO: 1592796 - RNA, 23 nt, Homo sapiens
gaaaggcuguuaaauacaggaaa

SEQ ID NO: 1592797 - RNA, 18 nt, Homo sapiens
gaaagggaaacugggaaa

SEQ ID NO: 1592798 - RNA, 13 nt, Homo sapiens
gaaaggggcccca

SEQ ID NO: 1592799 - RNA, 15 nt, Homo sapiens
gaaagugaugacaua

SEQ ID NO: 1592800 - RNA, 15 nt, Homo sapiens
gaaaguguaaugugc

SEQ ID NO: 1592801 - RNA, 20 nt, Homo sapiens
gaaagugugagcucuucccu

SEQ ID NO: 1592802 - RNA, 19 nt, Homo sapiens
gaaaguuuucuccacugga

SEQ ID NO: 1592803 - RNA, 16 nt, Homo sapiens
gaaauaaacugugcaa

SEQ ID NO: 1592804 - RNA, 23 nt, Homo sapiens
gaaauaaagagcuguuauacugu

SEQ ID NO: 1592805 - RNA, 14 nt, Homo sapiens
gaaauaauagcaau

SEQ ID NO: 1592806 - RNA, 13 nt, Homo sapiens
gaaauaaugccuc

SEQ ID NO: 1592807 - RNA, 17 nt, Homo sapiens
gaaauaccacaagccug

SEQ ID NO: 1592808 - RNA, 18 nt, Homo sapiens
gaaauagaaagaagccau

SEQ ID NO: 1592809 - RNA, 19 nt, Homo sapiens
gaaauagucggugaagaaa

SEQ ID NO: 1592810 - RNA, 17 nt, Homo sapiens
gaaauauauaauauuca

SEQ ID NO: 1592811 - RNA, 14 nt, Homo sapiens
gaaaucaaacugcu

SEQ ID NO: 1592812 - RNA, 15 nt, Homo sapiens
gaaaucaaacugcuu

SEQ ID NO: 1592813 - RNA, 14 nt, Homo sapiens
gaaaucagcagaca

SEQ ID NO: 1592814 - RNA, 17 nt, Homo sapiens
gaaaucaguagaaagcu

SEQ ID NO: 1592815 - RNA, 15 nt, Homo sapiens
gaaaucaugauuucc

SEQ ID NO: 1592816 - RNA, 12 nt, Homo sapiens
gaaaucuacuga

SEQ ID NO: 1592817 - RNA, 24 nt, Homo sapiens
gaaaugaccaggccaagacucaag

SEQ ID NO: 1592818 - RNA, 11 nt, Homo sapiens
gaaaugcaaaa

SEQ ID NO: 1592819 - RNA, 12 nt, Homo sapiens
gaaaugcaaaac

SEQ ID NO: 1592820 - RNA, 12 nt, Homo sapiens
gaaaugcaaaau

SEQ ID NO: 1592821 - RNA, 12 nt, Homo sapiens
gaaaugccaaag

SEQ ID NO: 1592822 - RNA, 23 nt, Homo sapiens
gaaaugcugguuuuucaguuuuc

SEQ ID NO: 1592823 - RNA, 19 nt, Homo sapiens
gaaaugcuuuuauauucua

SEQ ID NO: 1592824 - RNA, 17 nt, Homo sapiens
gaaauggcuaugaacag

SEQ ID NO: 1592825 - RNA, 17 nt, Homo sapiens
gaaauguaccuucuuuc

SEQ ID NO: 1592826 - RNA, 16 nt, Homo sapiens
gaaauuuaaacucuga

SEQ ID NO: 1592827 - RNA, 16 nt, Homo sapiens
gaaauuuacacaguga

SEQ ID NO: 1592828 - RNA, 16 nt, Homo sapiens
gaaauuuacugugaga

SEQ ID NO: 1592829 - RNA, 21 nt, Homo sapiens
gaaauuuuaaugaagugcaau

SEQ ID NO: 1592830 - RNA, 16 nt, Homo sapiens
gaacaaaaauguuucc

SEQ ID NO: 1592831 - RNA, 20 nt, Homo sapiens
gaacaaaagaauaacauuuu

SEQ ID NO: 1592832 - RNA, 16 nt, Homo sapiens
gaacaaagacauuuau

SEQ ID NO: 1592833 - RNA, 19 nt, Homo sapiens
gaacaaauuauaaaaacca

SEQ ID NO: 1592834 - RNA, 20 nt, Homo sapiens
gaacaagaugcacucgcugu

SEQ ID NO: 1592835 - RNA, 23 nt, Homo sapiens
gaacaauguauacaaugcacuuu

SEQ ID NO: 1592836 - RNA, 22 nt, Homo sapiens
gaacaauuguggucucucuuaa

SEQ ID NO: 1592837 - RNA, 16 nt, Homo sapiens
gaacacaggcccagau

SEQ ID NO: 1592838 - RNA, 19 nt, Homo sapiens
gaacacaggcccagaugac

SEQ ID NO: 1592839 - RNA, 14 nt, Homo sapiens
gaacacaucagcuu

SEQ ID NO: 1592840 - RNA, 15 nt, Homo sapiens
gaacacuguucuacc

SEQ ID NO: 1592841 - RNA, 17 nt, Homo sapiens
gaacagagucucaggac

SEQ ID NO: 1592842 - RNA, 19 nt, Homo sapiens
gaacagcaauggugucagu

SEQ ID NO: 1592843 - RNA, 15 nt, Homo sapiens
gaacagcacugggga

SEQ ID NO: 1592844 - RNA, 21 nt, Homo sapiens
gaacagcauuacccuccucuc

SEQ ID NO: 1592845 - RNA, 18 nt, Homo sapiens
gaacagcccucucucuca

SEQ ID NO: 1592846 - RNA, 20 nt, Homo sapiens
gaacagguguuuuuccacaa

SEQ ID NO: 1592847 - RNA, 17 nt, Homo sapiens
gaacaguaugaauuuga

SEQ ID NO: 1592848 - RNA, 12 nt, Homo sapiens
gaacaguauuac

SEQ ID NO: 1592849 - RNA, 17 nt, Homo sapiens
gaacaguuuuggcauaa

SEQ ID NO: 1592850 - RNA, 20 nt, Homo sapiens
gaacauaaaaaggacaucag

SEQ ID NO: 1592851 - RNA, 16 nt, Homo sapiens
gaacauacuguucuca

SEQ ID NO: 1592852 - RNA, 21 nt, Homo sapiens
gaacaugauuuuacaaguaua

SEQ ID NO: 1592853 - RNA, 12 nt, Homo sapiens
gaacaugcaguu

SEQ ID NO: 1592854 - RNA, 22 nt, Homo sapiens
gaacauuaauccacauguuuca

SEQ ID NO: 1592855 - RNA, 16 nt, Homo sapiens
gaacauuauucaucuc

SEQ ID NO: 1592856 - RNA, 15 nt, Homo sapiens
gaacauuuacuacag

SEQ ID NO: 1592857 - RNA, 21 nt, Homo sapiens
uaaagccacuguaugauucuc

SEQ ID NO: 1592858 - RNA, 23 nt, Homo sapiens
uaaagccacuguaugauucucuu

SEQ ID NO: 1592859 - RNA, 14 nt, Homo sapiens
uaaagccuuugaug

SEQ ID NO: 1592860 - RNA, 16 nt, Homo sapiens
uaaagcugcugucacu

SEQ ID NO: 1592861 - RNA, 16 nt, Homo sapiens
uaaagcuugauuugau

SEQ ID NO: 1592862 - RNA, 13 nt, Homo sapiens
uaaaggauaucaa

SEQ ID NO: 1592863 - RNA, 13 nt, Homo sapiens
uaaaggcaucuac

SEQ ID NO: 1592864 - RNA, 23 nt, Homo sapiens
uaaagggaccagcccuucauggg

SEQ ID NO: 1592865 - RNA, 15 nt, Homo sapiens
uaaagguuaccuguu

SEQ ID NO: 1592866 - RNA, 18 nt, Homo sapiens
uaaaguauaauguuuauu

SEQ ID NO: 1592867 - RNA, 13 nt, Homo sapiens
uaaagucucugcu

SEQ ID NO: 1592868 - RNA, 14 nt, Homo sapiens
uaaagugaacuuug

SEQ ID NO: 1592869 - RNA, 20 nt, Homo sapiens
uaaagugagaaaacugugac

SEQ ID NO: 1592870 - RNA, 16 nt, Homo sapiens
uaaaguucaauuguga

SEQ ID NO: 1592871 - RNA, 15 nt, Homo sapiens
uaaaguugauaaaga

SEQ ID NO: 1592872 - RNA, 15 nt, Homo sapiens
uaaaguugguauuaa

SEQ ID NO: 1592873 - RNA, 16 nt, Homo sapiens
uaaaguugguauuaau

SEQ ID NO: 1592874 - RNA, 16 nt, Homo sapiens
uaaauaaaauuuguug

SEQ ID NO: 1592875 - RNA, 17 nt, Homo sapiens
uaaauaaacacauagau

SEQ ID NO: 1592876 - RNA, 13 nt, Homo sapiens
uaaauaaacagau

SEQ ID NO: 1592877 - RNA, 18 nt, Homo sapiens
uaaauaaaccacugugcg

SEQ ID NO: 1592878 - RNA, 12 nt, Homo sapiens
uaaauaagcaaa

SEQ ID NO: 1592879 - RNA, 15 nt, Homo sapiens
uaaauacagucuucc

SEQ ID NO: 1592880 - RNA, 13 nt, Homo sapiens
uaaauagaugaca

SEQ ID NO: 1592881 - RNA, 14 nt, Homo sapiens
uaaauagugugaug

SEQ ID NO: 1592882 - RNA, 16 nt, Homo sapiens
uaaauauuagugcagu

SEQ ID NO: 1592883 - RNA, 18 nt, Homo sapiens
uaaauauuuuucacauaa

SEQ ID NO: 1592884 - RNA, 14 nt, Homo sapiens
uaaaucaaauauuc

SEQ ID NO: 1592885 - RNA, 17 nt, Homo sapiens
uaaauccauccauccaa

SEQ ID NO: 1592886 - RNA, 18 nt, Homo sapiens
uaaaucccacaucccagu

SEQ ID NO: 1592887 - RNA, 16 nt, Homo sapiens
uaaaucuccaguacuu

SEQ ID NO: 1592888 - RNA, 20 nt, Homo sapiens
uaaaucugugaugauccuca

SEQ ID NO: 1592889 - RNA, 19 nt, Homo sapiens
uaaaucuucagcauagaag

SEQ ID NO: 1592890 - RNA, 16 nt, Homo sapiens
uaaaucuuucucucac

SEQ ID NO: 1592891 - RNA, 14 nt, Homo sapiens
uaaaugaagccaag

SEQ ID NO: 1592892 - RNA, 15 nt, Homo sapiens
uaaaugaagccaagu

SEQ ID NO: 1592893 - RNA, 13 nt, Homo sapiens
uaaaugacaauuu

SEQ ID NO: 1592894 - RNA, 16 nt, Homo sapiens
uaaaugacacuacuug

SEQ ID NO: 1592895 - RNA, 15 nt, Homo sapiens
uaaaugacaguaaua

SEQ ID NO: 1592896 - RNA, 19 nt, Homo sapiens
uaaaugacugaagugcuau

SEQ ID NO: 1592897 - RNA, 18 nt, Homo sapiens
uaaaugauagacaauuga

SEQ ID NO: 1592898 - RNA, 20 nt, Homo sapiens
uaaaugauagacaauugagg

SEQ ID NO: 1592899 - RNA, 20 nt, Homo sapiens
uaaaugcagacaacaccuuc

SEQ ID NO: 1592900 - RNA, 14 nt, Homo sapiens
uaaauguaauaagu

SEQ ID NO: 1592901 - RNA, 16 nt, Homo sapiens
uaaauguacagacaua

SEQ ID NO: 1592902 - RNA, 21 nt, Homo sapiens
uaaauguauacuauaguacca

SEQ ID NO: 1592903 - RNA, 16 nt, Homo sapiens
uaaauguuaugacuau

SEQ ID NO: 1592904 - RNA, 17 nt, Homo sapiens
uaaauuacaaaugcaau

SEQ ID NO: 1592905 - RNA, 16 nt, Homo sapiens
uaaauuauuuacugca

SEQ ID NO: 1592906 - RNA, 15 nt, Homo sapiens
uaaauuccacagauu

SEQ ID NO: 1592907 - RNA, 19 nt, Homo sapiens
uaaauuccacagauuauca

SEQ ID NO: 1592908 - RNA, 20 nt, Homo sapiens
uaaauucuauaggaacauau

SEQ ID NO: 1592909 - RNA, 15 nt, Homo sapiens
uaaauuuaauuuaca

SEQ ID NO: 1592910 - RNA, 15 nt, Homo sapiens
uaaauuucugccaag

SEQ ID NO: 1592911 - RNA, 18 nt, Homo sapiens
uaaauuucuuaugugaca

SEQ ID NO: 1592912 - RNA, 17 nt, Homo sapiens
uaaauuuggacugucua

SEQ ID NO: 1592913 - RNA, 15 nt, Homo sapiens
uaacaaaauccucag

SEQ ID NO: 1592914 - RNA, 14 nt, Homo sapiens
uaacaaacucugag

SEQ ID NO: 1592915 - RNA, 21 nt, Homo sapiens
uaacaagcugucuacuggaca

SEQ ID NO: 1592916 - RNA, 16 nt, Homo sapiens
uaacaauccauucaca

SEQ ID NO: 1592917 - RNA, 14 nt, Homo sapiens
uaacacuaauaaua

SEQ ID NO: 1592918 - RNA, 17 nt, Homo sapiens
uaacacuaauaauagua

SEQ ID NO: 1592919 - RNA, 21 nt, Homo sapiens
uaacacuaauaauaguacuau

SEQ ID NO: 1592920 - RNA, 21 nt, Homo sapiens
uaacagcggcaggguguccca

SEQ ID NO: 1592921 - RNA, 16 nt, Homo sapiens
uaacaggugccuuccc

SEQ ID NO: 1592922 - RNA, 21 nt, Homo sapiens
uaacauagauuuaagugaaua

SEQ ID NO: 1592923 - RNA, 15 nt, Homo sapiens
uaacaucaaagacuc

SEQ ID NO: 1592924 - RNA, 15 nt, Homo sapiens
uaacaucaacaggac

SEQ ID NO: 1592925 - RNA, 18 nt, Homo sapiens
uaacaucaacaggacuua

SEQ ID NO: 1592926 - RNA, 15 nt, Homo sapiens
uaacaugcaauaaca

SEQ ID NO: 1592927 - RNA, 18 nt, Homo sapiens
uaacauuaucuaguucau

SEQ ID NO: 1592928 - RNA, 20 nt, Homo sapiens
uaacauuccuaaaaugcuuc

SEQ ID NO: 1592929 - RNA, 21 nt, Homo sapiens
uaacauuccuaaaaugcuuca

SEQ ID NO: 1592930 - RNA, 22 nt, Homo sapiens
uaacauuuaaauuccacagauu

SEQ ID NO: 1592931 - RNA, 17 nt, Homo sapiens
uaaccaaacaaugcaga

SEQ ID NO: 1592932 - RNA, 23 nt, Homo sapiens
uaaccaaugccuuuuuagaugua

SEQ ID NO: 1592933 - RNA, 19 nt, Homo sapiens
uaaccacugcacuuuccaa

SEQ ID NO: 1592934 - RNA, 12 nt, Homo sapiens
uaaccaguauuu

SEQ ID NO: 1592935 - RNA, 19 nt, Homo sapiens
uaaccauccccaacuccau

SEQ ID NO: 1592936 - RNA, 19 nt, Homo sapiens
uaacccaagacaugacauu

SEQ ID NO: 1592937 - RNA, 23 nt, Homo sapiens
uaacccgugcagaaccagcacua

SEQ ID NO: 1592938 - RNA, 23 nt, Homo sapiens
uaaccuaugauaauuauuuacaa

SEQ ID NO: 1592939 - RNA, 20 nt, Homo sapiens
uaaccuccaacacagugcau

SEQ ID NO: 1592940 - RNA, 20 nt, Homo sapiens
uaaccugcacguugugcaca

SEQ ID NO: 1592941 - RNA, 13 nt, Homo sapiens
uaaccuguuuuca

SEQ ID NO: 1592942 - RNA, 22 nt, Homo sapiens
uaaccuugaaaaaaaacagugg

SEQ ID NO: 1592943 - RNA, 16 nt, Homo sapiens
uaaccuugaaauggaa

SEQ ID NO: 1592944 - RNA, 14 nt, Homo sapiens
uaaccuuucuaacc

SEQ ID NO: 1592945 - RNA, 16 nt, Homo sapiens
uaaccuuugcuaugua

SEQ ID NO: 1592946 - RNA, 19 nt, Homo sapiens
uaacgaaaauaguauuuca

SEQ ID NO: 1592947 - RNA, 13 nt, Homo sapiens
uaacgugugcgca

SEQ ID NO: 1592948 - RNA, 14 nt, Homo sapiens
uaacuaaacuaacg

SEQ ID NO: 1592949 - RNA, 15 nt, Homo sapiens
uaacuaacugcauac

SEQ ID NO: 1592950 - RNA, 15 nt, Homo sapiens
uaacuaaucaagaaa

SEQ ID NO: 1592951 - RNA, 15 nt, Homo sapiens
uaacuacaucugccu

SEQ ID NO: 1592952 - RNA, 22 nt, Homo sapiens
uaacucagucuuuaaucugaga

SEQ ID NO: 1592953 - RNA, 12 nt, Homo sapiens
uaacucuagaau

SEQ ID NO: 1592954 - RNA, 19 nt, Homo sapiens
uaacugaaaaugaaagugu

SEQ ID NO: 1592955 - RNA, 22 nt, Homo sapiens
uaacugaaccauuccaacuuca

SEQ ID NO: 1592956 - RNA, 21 nt, Homo sapiens
uaacugaaggagaaggugccc

SEQ ID NO: 1592957 - RNA, 19 nt, Homo sapiens
uaacugauuaccugccaau

SEQ ID NO: 1592958 - RNA, 14 nt, Homo sapiens
uaacugcacaaaca

SEQ ID NO: 1592959 - RNA, 22 nt, Homo sapiens
uaacuggguaaugaaacaaaga

SEQ ID NO: 1592960 - RNA, 23 nt, Homo sapiens
uaacuguauuucaguauuuucca

SEQ ID NO: 1592961 - RNA, 18 nt, Homo sapiens
uaacugugaaauaccaca

SEQ ID NO: 1592962 - RNA, 22 nt, Homo sapiens
uaacugugaaauaccacaagcc

SEQ ID NO: 1592963 - RNA, 13 nt, Homo sapiens
uaacuguuacagu

SEQ ID NO: 1592964 - RNA, 15 nt, Homo sapiens
uaacuuuaccaugcu

SEQ ID NO: 1592965 - RNA, 17 nt, Homo sapiens
uaagaaaaaugagcaua

SEQ ID NO: 1592966 - RNA, 13 nt, Homo sapiens
uaagaaacacuca

SEQ ID NO: 1592967 - RNA, 21 nt, Homo sapiens
uaagaaacuagcagauuugua

SEQ ID NO: 1592968 - RNA, 14 nt, Homo sapiens
uaagaaagcacuau

SEQ ID NO: 1592969 - RNA, 14 nt, Homo sapiens
uaagaaagcacuua

SEQ ID NO: 1592970 - RNA, 15 nt, Homo sapiens
uaagaaauucacuuc

SEQ ID NO: 1592971 - RNA, 19 nt, Homo sapiens
uaagaacuaaaauguucua

SEQ ID NO: 1592972 - RNA, 22 nt, Homo sapiens
uaagacaacaaagagaagcaga

SEQ ID NO: 1592973 - RNA, 17 nt, Homo sapiens
uaagacagagucucacu

SEQ ID NO: 1592974 - RNA, 21 nt, Homo sapiens
uaagacauacuccuuccauca

SEQ ID NO: 1592975 - RNA, 13 nt, Homo sapiens
uaagacucugcca

SEQ ID NO: 1592976 - RNA, 15 nt, Homo sapiens
guuuucucucuguua

SEQ ID NO: 1592977 - RNA, 20 nt, Homo sapiens
guuuucucuuuguacugcuu

SEQ ID NO: 1592978 - RNA, 14 nt, Homo sapiens
guuuucuucauuca

SEQ ID NO: 1592979 - RNA, 14 nt, Homo sapiens
guuuucuuucucac

SEQ ID NO: 1592980 - RNA, 15 nt, Homo sapiens
guuuucuuucucacc

SEQ ID NO: 1592981 - RNA, 20 nt, Homo sapiens
guuuugaaggcaaaauugca

SEQ ID NO: 1592982 - RNA, 23 nt, Homo sapiens
guuuugaaggcaaaauugcaaau

SEQ ID NO: 1592983 - RNA, 13 nt, Homo sapiens
guuuugauuuauu

SEQ ID NO: 1592984 - RNA, 22 nt, Homo sapiens
guuuuguuggugugaaaauaca

SEQ ID NO: 1592985 - RNA, 22 nt, Homo sapiens
guuuuuaaauuuuguaugccaa

SEQ ID NO: 1592986 - RNA, 14 nt, Homo sapiens
guuuuuauucugua

SEQ ID NO: 1592987 - RNA, 17 nt, Homo sapiens
guuuuuggaguguuaug

SEQ ID NO: 1592988 - RNA, 15 nt, Homo sapiens
guuuuuggauggcuu

SEQ ID NO: 1592989 - RNA, 22 nt, Homo sapiens
guuuuugggggguuuucuugcc

SEQ ID NO: 1592990 - RNA, 19 nt, Homo sapiens
guuuuuuauuaugcauuau

SEQ ID NO: 1592991 - RNA, 13 nt, Homo sapiens
guuuuuucuccag

SEQ ID NO: 1592992 - RNA, 18 nt, Homo sapiens
guuuuuuuacaacauuca

SEQ ID NO: 1592993 - RNA, 23 nt, Homo sapiens
uaaaaaaaaaaaaaacauugugu

SEQ ID NO: 1592994 - RNA, 12 nt, Homo sapiens
uaaaaaacaguc

SEQ ID NO: 1592995 - RNA, 15 nt, Homo sapiens
uaaaaaagcauauau

SEQ ID NO: 1592996 - RNA, 18 nt, Homo sapiens
uaaaaaagcauuauccuu

SEQ ID NO: 1592997 - RNA, 17 nt, Homo sapiens
uaaaaaauaaugguguc

SEQ ID NO: 1592998 - RNA, 13 nt, Homo sapiens
uaaaaaauacugu

SEQ ID NO: 1592999 - RNA, 13 nt, Homo sapiens
uaaaaaauggaac

SEQ ID NO: 1593000 - RNA, 13 nt, Homo sapiens
uaaaaaauuugua

SEQ ID NO: 1593001 - RNA, 19 nt, Homo sapiens
uaaaaaccccaaacuguug

SEQ ID NO: 1593002 - RNA, 18 nt, Homo sapiens
uaaaaagaauuugguuaa

SEQ ID NO: 1593003 - RNA, 16 nt, Homo sapiens
uaaaaaggaacaaaua

SEQ ID NO: 1593004 - RNA, 17 nt, Homo sapiens
uaaaaaggcaguuugca

SEQ ID NO: 1593005 - RNA, 14 nt, Homo sapiens
uaaaaauacacaaa

SEQ ID NO: 1593006 - RNA, 21 nt, Homo sapiens
uaaaaaucuagcacacucuuc

SEQ ID NO: 1593007 - RNA, 18 nt, Homo sapiens
uaaaaaugaaugucuugu

SEQ ID NO: 1593008 - RNA, 15 nt, Homo sapiens
uaaaaaugcugcucu

SEQ ID NO: 1593009 - RNA, 19 nt, Homo sapiens
uaaaaauuauauguuuaua

SEQ ID NO: 1593010 - RNA, 20 nt, Homo sapiens
uaaaaauuuauaagcauuug

SEQ ID NO: 1593011 - RNA, 12 nt, Homo sapiens
uaaaacaauccu

SEQ ID NO: 1593012 - RNA, 12 nt, Homo sapiens
uaaaacaauucu

SEQ ID NO: 1593013 - RNA, 18 nt, Homo sapiens
uaaaacacaccaaucagc

SEQ ID NO: 1593014 - RNA, 21 nt, Homo sapiens
uaaaacagguagaauuaucua

SEQ ID NO: 1593015 - RNA, 19 nt, Homo sapiens
uaaaacauugaaugaaacu

SEQ ID NO: 1593016 - RNA, 15 nt, Homo sapiens
uaaaacauuuugacu

SEQ ID NO: 1593017 - RNA, 12 nt, Homo sapiens
uaaaaccaaaga

SEQ ID NO: 1593018 - RNA, 13 nt, Homo sapiens
uaaaaccaaagag

SEQ ID NO: 1593019 - RNA, 15 nt, Homo sapiens
uaaaaccacagcagu

SEQ ID NO: 1593020 - RNA, 15 nt, Homo sapiens
uaaaaccacuguaca

SEQ ID NO: 1593021 - RNA, 18 nt, Homo sapiens
uaaaacccuggauugaaa

SEQ ID NO: 1593022 - RNA, 20 nt, Homo sapiens
uaaaacuaaauguaauuuau

SEQ ID NO: 1593023 - RNA, 16 nt, Homo sapiens
uaaaacucacugugau

SEQ ID NO: 1593024 - RNA, 18 nt, Homo sapiens
uaaaagaaaauccauuau

SEQ ID NO: 1593025 - RNA, 16 nt, Homo sapiens
uaaaagacaugcauuu

SEQ ID NO: 1593026 - RNA, 14 nt, Homo sapiens
uaaaagagaagcca

SEQ ID NO: 1593027 - RNA, 19 nt, Homo sapiens
uaaaagcaauucugacugu

SEQ ID NO: 1593028 - RNA, 17 nt, Homo sapiens
uaaaagcaccauuguga

SEQ ID NO: 1593029 - RNA, 22 nt, Homo sapiens
uaaaagcaccauugugaagcag

SEQ ID NO: 1593030 - RNA, 14 nt, Homo sapiens
uaaaaguaaauuca

SEQ ID NO: 1593031 - RNA, 22 nt, Homo sapiens
uaaaagucacgugaaacagagu

SEQ ID NO: 1593032 - RNA, 14 nt, Homo sapiens
uaaaagucuaccug

SEQ ID NO: 1593033 - RNA, 15 nt, Homo sapiens
uaaaaguucauaaca

SEQ ID NO: 1593034 - RNA, 16 nt, Homo sapiens
uaaaaguucauaacag

SEQ ID NO: 1593035 - RNA, 23 nt, Homo sapiens
uaaaaguucauaacagugccauu

SEQ ID NO: 1593036 - RNA, 23 nt, Homo sapiens
uaaaaguuggcucaggagucuua

SEQ ID NO: 1593037 - RNA, 19 nt, Homo sapiens
uaaaaguuuauuguuugau

SEQ ID NO: 1593038 - RNA, 15 nt, Homo sapiens
uaaaauaacuaagca

SEQ ID NO: 1593039 - RNA, 17 nt, Homo sapiens
uaaaauacaaacccaug

SEQ ID NO: 1593040 - RNA, 12 nt, Homo sapiens
gugcagcauuaa

SEQ ID NO: 1593041 - RNA, 21 nt, Homo sapiens
gugcagccaaguagccucucc

SEQ ID NO: 1593042 - RNA, 13 nt, Homo sapiens
gugcagcugugac

SEQ ID NO: 1593043 - RNA, 17 nt, Homo sapiens
gugcagcuucgaggaca

SEQ ID NO: 1593044 - RNA, 15 nt, Homo sapiens
gugcagucacuggag

SEQ ID NO: 1593045 - RNA, 19 nt, Homo sapiens
gugcaguggcgcauucuag

SEQ ID NO: 1593046 - RNA, 13 nt, Homo sapiens
gugcauugauaca

SEQ ID NO: 1593047 - RNA, 12 nt, Homo sapiens
gugccaaaaauc

SEQ ID NO: 1593048 - RNA, 20 nt, Homo sapiens
gugccaauacagacaaagca

SEQ ID NO: 1593049 - RNA, 22 nt, Homo sapiens
gugccagguggcucagugccac

SEQ ID NO: 1593050 - RNA, 15 nt, Homo sapiens
gugccauaaccauga

SEQ ID NO: 1593051 - RNA, 16 nt, Homo sapiens
gugccaucagcuccuu

SEQ ID NO: 1593052 - RNA, 15 nt, Homo sapiens
gugcccaccaacauc

SEQ ID NO: 1593053 - RNA, 23 nt, Homo sapiens
gugcccaguacuuccuggacaag

SEQ ID NO: 1593054 - RNA, 17 nt, Homo sapiens
gugccccccuccuccag

SEQ ID NO: 1593055 - RNA, 15 nt, Homo sapiens
gugcccuccaaagag

SEQ ID NO: 1593056 - RNA, 13 nt, Homo sapiens
gugcccugcaaau

SEQ ID NO: 1593057 - RNA, 23 nt, Homo sapiens
gugccgggaggcagccacaggga

SEQ ID NO: 1593058 - RNA, 19 nt, Homo sapiens
gugccuauggguugucaau

SEQ ID NO: 1593059 - RNA, 23 nt, Homo sapiens
gugccugacacauagaaaacaau

SEQ ID NO: 1593060 - RNA, 17 nt, Homo sapiens
gugccuuccauacuguu

SEQ ID NO: 1593061 - RNA, 17 nt, Homo sapiens
gugcgagggaagcaauu

SEQ ID NO: 1593062 - RNA, 19 nt, Homo sapiens
gugcgcgccaccgugccug

SEQ ID NO: 1593063 - RNA, 19 nt, Homo sapiens
gugcucaaauuacuaauga

SEQ ID NO: 1593064 - RNA, 17 nt, Homo sapiens
gugcucaauagcuugaa

SEQ ID NO: 1593065 - RNA, 15 nt, Homo sapiens
gugcuccggccaugg

SEQ ID NO: 1593066 - RNA, 15 nt, Homo sapiens
gugcugagguugaga

SEQ ID NO: 1593067 - RNA, 13 nt, Homo sapiens
gugcuuaaccaaa

SEQ ID NO: 1593068 - RNA, 14 nt, Homo sapiens
gugcuuguuuacag

SEQ ID NO: 1593069 - RNA, 19 nt, Homo sapiens
gugcuuuuugggaccauca

SEQ ID NO: 1593070 - RNA, 18 nt, Homo sapiens
guggaacucagucauuag

SEQ ID NO: 1593071 - RNA, 17 nt, Homo sapiens
guggaccugugcuguga

SEQ ID NO: 1593072 - RNA, 18 nt, Homo sapiens
guggaccugugcugugag

SEQ ID NO: 1593073 - RNA, 23 nt, Homo sapiens
guggacucuaacaguaguugcaa

SEQ ID NO: 1593074 - RNA, 17 nt, Homo sapiens
guggacuuauucauucc

SEQ ID NO: 1593075 - RNA, 20 nt, Homo sapiens
guggagacauauuucaguga

SEQ ID NO: 1593076 - RNA, 20 nt, Homo sapiens
guggagccccacacuggggu

SEQ ID NO: 1593077 - RNA, 12 nt, Homo sapiens
guggaugacccu

SEQ ID NO: 1593078 - RNA, 12 nt, Homo sapiens
guggauguauaa

SEQ ID NO: 1593079 - RNA, 15 nt, Homo sapiens
guggauucaugucca

SEQ ID NO: 1593080 - RNA, 13 nt, Homo sapiens
guggcacaggagu

SEQ ID NO: 1593081 - RNA, 13 nt, Homo sapiens
guggcauccagag

SEQ ID NO: 1593082 - RNA, 15 nt, Homo sapiens
guggccacacaggca

SEQ ID NO: 1593083 - RNA, 22 nt, Homo sapiens
guggcguuguugcauguuugaa

SEQ ID NO: 1593084 - RNA, 14 nt, Homo sapiens
guggcuccuaucug

SEQ ID NO: 1593085 - RNA, 17 nt, Homo sapiens
guggcucugcccuggaa

SEQ ID NO: 1593086 - RNA, 20 nt, Homo sapiens
guggcugccccggccuccuc

SEQ ID NO: 1593087 - RNA, 22 nt, Homo sapiens
guggcuggaucugugaggggcu

SEQ ID NO: 1593088 - RNA, 16 nt, Homo sapiens
guggcuuuuuguucag

SEQ ID NO: 1593089 - RNA, 15 nt, Homo sapiens
gugggagaaggacua

SEQ ID NO: 1593090 - RNA, 20 nt, Homo sapiens
gugggagauguuagacucau

SEQ ID NO: 1593091 - RNA, 17 nt, Homo sapiens
gugggauccucccucau

SEQ ID NO: 1593092 - RNA, 20 nt, Homo sapiens
gugggaucugucacaccagc

SEQ ID NO: 1593093 - RNA, 14 nt, Homo sapiens
gugggauuuugcaa

SEQ ID NO: 1593094 - RNA, 23 nt, Homo sapiens
gugggcucugugcagucacugga

SEQ ID NO: 1593095 - RNA, 20 nt, Homo sapiens
guggggaccgggcucugaca

SEQ ID NO: 1593096 - RNA, 22 nt, Homo sapiens
guggguauugagugugauuuga

SEQ ID NO: 1593097 - RNA, 19 nt, Homo sapiens
gugggucucugggcuguca

SEQ ID NO: 1593098 - RNA, 19 nt, Homo sapiens
gugggugugcuguugccuu

SEQ ID NO: 1593099 - RNA, 20 nt, Homo sapiens
gugguauggcuaauaccugu

SEQ ID NO: 1593100 - RNA, 16 nt, Homo sapiens
guggucagagugccac

SEQ ID NO: 1593101 - RNA, 20 nt, Homo sapiens
guggucauuuccuaugcaaa

SEQ ID NO: 1593102 - RNA, 22 nt, Homo sapiens
guggucuaagguucagccugaa

SEQ ID NO: 1593103 - RNA, 16 nt, Homo sapiens
gugguggccagcagca

SEQ ID NO: 1593104 - RNA, 20 nt, Homo sapiens
gugguuuauugaaugugauu

SEQ ID NO: 1593105 - RNA, 20 nt, Homo sapiens
guguaaauuaauuacauaca

SEQ ID NO: 1593106 - RNA, 19 nt, Homo sapiens
guguacagucuuguauuaa

SEQ ID NO: 1593107 - RNA, 14 nt, Homo sapiens
guguacaugugcuu

SEQ ID NO: 1593108 - RNA, 17 nt, Homo sapiens
guguaucuuuaagaaaa

SEQ ID NO: 1593109 - RNA, 17 nt, Homo sapiens
guguauugaaguccucc

SEQ ID NO: 1593110 - RNA, 18 nt, Homo sapiens
gugucaccuugguuugca

SEQ ID NO: 1593111 - RNA, 15 nt, Homo sapiens
gugucauuucauucc

SEQ ID NO: 1593112 - RNA, 19 nt, Homo sapiens
guguccccucacucuguca

SEQ ID NO: 1593113 - RNA, 15 nt, Homo sapiens
guguccuaugcaaua

SEQ ID NO: 1593114 - RNA, 21 nt, Homo sapiens
guguccugaggccuccaagga

SEQ ID NO: 1593115 - RNA, 22 nt, Homo sapiens
guguccuggggaauacuggcca

SEQ ID NO: 1593116 - RNA, 21 nt, Homo sapiens
gugucuacagacaagcauuuu

SEQ ID NO: 1593117 - RNA, 17 nt, Homo sapiens
gugucuggcaguuuaua

SEQ ID NO: 1593118 - RNA, 20 nt, Homo sapiens
gugucuuuuaaacauuauuu

SEQ ID NO: 1593119 - RNA, 19 nt, Homo sapiens
gugugaaccacuguguacu

SEQ ID NO: 1593120 - RNA, 22 nt, Homo sapiens
gugugaccacugcagaagacag

SEQ ID NO: 1593121 - RNA, 14 nt, Homo sapiens
guguggcuuuccag

SEQ ID NO: 1593122 - RNA, 16 nt, Homo sapiens
gugugggaguguguaa

SEQ ID NO: 1593123 - RNA, 11 nt, Homo sapiens
guguguguacc

SEQ ID NO: 1593124 - RNA, 14 nt, Homo sapiens
guguuaucuuuuga

SEQ ID NO: 1593125 - RNA, 16 nt, Homo sapiens
guguucccgugccugg

SEQ ID NO: 1593126 - RNA, 14 nt, Homo sapiens
guguucuucauuac

SEQ ID NO: 1593127 - RNA, 19 nt, Homo sapiens
guguucuucauuaccucag

SEQ ID NO: 1593128 - RNA, 17 nt, Homo sapiens
guguugccaaaaccaaa

SEQ ID NO: 1593129 - RNA, 15 nt, Homo sapiens
guguugggauuacag

SEQ ID NO: 1593130 - RNA, 17 nt, Homo sapiens
guguuuaccuggugcuc

SEQ ID NO: 1593131 - RNA, 17 nt, Homo sapiens
guguuucgugggaacaa

SEQ ID NO: 1593132 - RNA, 23 nt, Homo sapiens
guguuucuguccuguaacuguua

SEQ ID NO: 1593133 - RNA, 13 nt, Homo sapiens
guguuucuuuuga

SEQ ID NO: 1593134 - RNA, 20 nt, Homo sapiens
guguuuuacugucagauuaa

SEQ ID NO: 1593135 - RNA, 17 nt, Homo sapiens
guguuuuuaacauguca

SEQ ID NO: 1593136 - RNA, 18 nt, Homo sapiens
guguuuuuuaaauugauc

SEQ ID NO: 1593137 - RNA, 20 nt, Homo sapiens
guuaaacuuauaacccacuu

SEQ ID NO: 1593138 - RNA, 17 nt, Homo sapiens
guuaacagagcuaagaa

SEQ ID NO: 1593139 - RNA, 20 nt, Homo sapiens
guuaaccuuucuaaccuuca

SEQ ID NO: 1593140 - RNA, 15 nt, Homo sapiens
guuaagcacaagaca

SEQ ID NO: 1593141 - RNA, 16 nt, Homo sapiens
guuaauaguacuauua

SEQ ID NO: 1593142 - RNA, 17 nt, Homo sapiens
guuaaucacauuccuac

SEQ ID NO: 1593143 - RNA, 21 nt, Homo sapiens
guuaauugggcaggugaaaag

SEQ ID NO: 1593144 - RNA, 19 nt, Homo sapiens
guuaauuuugaagugcugu

SEQ ID NO: 1593145 - RNA, 20 nt, Homo sapiens
guuaauuuuuccaacuacua

SEQ ID NO: 1593146 - RNA, 21 nt, Homo sapiens
guuaauuuuuugguacaaaaa

SEQ ID NO: 1593147 - RNA, 13 nt, Homo sapiens
guuacagaccuca

SEQ ID NO: 1593148 - RNA, 14 nt, Homo sapiens
guuacagaccucag

SEQ ID NO: 1593149 - RNA, 21 nt, Homo sapiens
guuacagugaugcugugcuau

SEQ ID NO: 1593150 - RNA, 15 nt, Homo sapiens
guuaccaaguaugaa

SEQ ID NO: 1593151 - RNA, 17 nt, Homo sapiens
guuacuuagaaugccau

SEQ ID NO: 1593152 - RNA, 13 nt, Homo sapiens
guuacuuccuuau

SEQ ID NO: 1593153 - RNA, 16 nt, Homo sapiens
guuagaaacaccagcc

SEQ ID NO: 1593154 - RNA, 17 nt, Homo sapiens
guuagaaacaccagccg

SEQ ID NO: 1593155 - RNA, 17 nt, Homo sapiens
guuagauauugcuacua

SEQ ID NO: 1593156 - RNA, 15 nt, Homo sapiens
guuaggaaaugucau

SEQ ID NO: 1593157 - RNA, 18 nt, Homo sapiens
guuaguaaagaaaaguuu

SEQ ID NO: 1593158 - RNA, 15 nt, Homo sapiens
guuagugacugaugu

SEQ ID NO: 1593159 - RNA, 23 nt, Homo sapiens
cuagguacgaagagggguggugg

SEQ ID NO: 1593160 - RNA, 15 nt, Homo sapiens
cuagguagaaaaagg

SEQ ID NO: 1593161 - RNA, 22 nt, Homo sapiens
cuagguaucauucaacucucca

SEQ ID NO: 1593162 - RNA, 16 nt, Homo sapiens
cuaggucacuucucac

SEQ ID NO: 1593163 - RNA, 17 nt, Homo sapiens
cuaggucuccucagggu

SEQ ID NO: 1593164 - RNA, 12 nt, Homo sapiens
cuaguacuagua

SEQ ID NO: 1593165 - RNA, 13 nt, Homo sapiens
cuaguacuauuac

SEQ ID NO: 1593166 - RNA, 12 nt, Homo sapiens
cuaguacuauug

SEQ ID NO: 1593167 - RNA, 22 nt, Homo sapiens
cuaguacuauugcuauuacuag

SEQ ID NO: 1593168 - RNA, 22 nt, Homo sapiens
cuaguagcugggauuacaggcg

SEQ ID NO: 1593169 - RNA, 15 nt, Homo sapiens
cuagucaccagagac

SEQ ID NO: 1593170 - RNA, 22 nt, Homo sapiens
cuagucacucauccauccccug

SEQ ID NO: 1593171 - RNA, 15 nt, Homo sapiens
cuagucaguuggcua

SEQ ID NO: 1593172 - RNA, 15 nt, Homo sapiens
cuagucucaccagcc

SEQ ID NO: 1593173 - RNA, 20 nt, Homo sapiens
cuagucugugugggacugua

SEQ ID NO: 1593174 - RNA, 22 nt, Homo sapiens
cuagugaaagaggcagcuugaa

SEQ ID NO: 1593175 - RNA, 19 nt, Homo sapiens
cuagugcuuuucagugaua

SEQ ID NO: 1593176 - RNA, 15 nt, Homo sapiens
cuaguuacuguggua

SEQ ID NO: 1593177 - RNA, 18 nt, Homo sapiens
cuaguuaucagauccuuu

SEQ ID NO: 1593178 - RNA, 14 nt, Homo sapiens
cuaguuuucaauca

SEQ ID NO: 1593179 - RNA, 14 nt, Homo sapiens
cuaguuuucuuucc

SEQ ID NO: 1593180 - RNA, 20 nt, Homo sapiens
cuaguuuugucaaacuguag

SEQ ID NO: 1593181 - RNA, 19 nt, Homo sapiens
cuaguuuuuauacaugugu

SEQ ID NO: 1593182 - RNA, 16 nt, Homo sapiens
cuauaaaauauaguuu

SEQ ID NO: 1593183 - RNA, 18 nt, Homo sapiens
cuauaaaucaacaccuua

SEQ ID NO: 1593184 - RNA, 18 nt, Homo sapiens
cuauaagaugaaacauca

SEQ ID NO: 1593185 - RNA, 20 nt, Homo sapiens
cuauaagcaaauugcuuuuu

SEQ ID NO: 1593186 - RNA, 19 nt, Homo sapiens
cuauaaucaaaugauuuca

SEQ ID NO: 1593187 - RNA, 21 nt, Homo sapiens
cuauaauuuaccuaagauuac

SEQ ID NO: 1593188 - RNA, 14 nt, Homo sapiens
cuauacaaccuaac

SEQ ID NO: 1593189 - RNA, 22 nt, Homo sapiens
cuauacccacccagaaugagac

SEQ ID NO: 1593190 - RNA, 20 nt, Homo sapiens
cuauagcuaaguacacaaua

SEQ ID NO: 1593191 - RNA, 20 nt, Homo sapiens
cuauaggugacaaacaucuc

SEQ ID NO: 1593192 - RNA, 21 nt, Homo sapiens
cuauagucccacuacuugugg

SEQ ID NO: 1593193 - RNA, 22 nt, Homo sapiens
cuauauagaauuuccuguaaua

SEQ ID NO: 1593194 - RNA, 21 nt, Homo sapiens
cuaucaaaggaaaugagaaug

SEQ ID NO: 1593195 - RNA, 14 nt, Homo sapiens
cuaucacagucuac

SEQ ID NO: 1593196 - RNA, 16 nt, Homo sapiens
cuaucauggcauauaa

SEQ ID NO: 1593197 - RNA, 19 nt, Homo sapiens
cuaucauggugaaaagcuc

SEQ ID NO: 1593198 - RNA, 21 nt, Homo sapiens
cuauccacagaaccuuuguca

SEQ ID NO: 1593199 - RNA, 14 nt, Homo sapiens
cuauccuuuugccu

SEQ ID NO: 1593200 - RNA, 14 nt, Homo sapiens
cuaucguaucuuua

SEQ ID NO: 1593201 - RNA, 22 nt, Homo sapiens
cuaucuaauuuuacacucugua

SEQ ID NO: 1593202 - RNA, 12 nt, Homo sapiens
cuaucucuacug

SEQ ID NO: 1593203 - RNA, 15 nt, Homo sapiens
cuaucuggaagccac

SEQ ID NO: 1593204 - RNA, 19 nt, Homo sapiens
cuaugagauggccaugcuc

SEQ ID NO: 1593205 - RNA, 17 nt, Homo sapiens
cuaugagcacauaggac

SEQ ID NO: 1593206 - RNA, 23 nt, Homo sapiens
cuaugaggaaacugagucacuca

SEQ ID NO: 1593207 - RNA, 20 nt, Homo sapiens
cuaugaguuggacuucaguc

SEQ ID NO: 1593208 - RNA, 13 nt, Homo sapiens
cuaugauauaaca

SEQ ID NO: 1593209 - RNA, 18 nt, Homo sapiens
cuaugaucagaagacuuu

SEQ ID NO: 1593210 - RNA, 11 nt, Homo sapiens
cuaugcacuga

SEQ ID NO: 1593211 - RNA, 17 nt, Homo sapiens
cuaugcugcaauacauu

SEQ ID NO: 1593212 - RNA, 16 nt, Homo sapiens
cuauggccacauucaa

SEQ ID NO: 1593213 - RNA, 21 nt, Homo sapiens
cuaugggagauuaaaaccaga

SEQ ID NO: 1593214 - RNA, 11 nt, Homo sapiens
cuaugguucuc

SEQ ID NO: 1593215 - RNA, 15 nt, Homo sapiens
cuauguagcugaaaa

SEQ ID NO: 1593216 - RNA, 20 nt, Homo sapiens
cuauguuaaugaguauguaa

SEQ ID NO: 1593217 - RNA, 20 nt, Homo sapiens
cuauguuuauuuuuguacau

SEQ ID NO: 1593218 - RNA, 22 nt, Homo sapiens
cuauguuuuuguucaaagccag

SEQ ID NO: 1593219 - RNA, 16 nt, Homo sapiens
cuauuaaacuauuuua

SEQ ID NO: 1593220 - RNA, 18 nt, Homo sapiens
cuauuaacucugcauaga

SEQ ID NO: 1593221 - RNA, 17 nt, Homo sapiens
cuauuaauacucugcag

SEQ ID NO: 1593222 - RNA, 20 nt, Homo sapiens
cuauuaaucaccucucugua

SEQ ID NO: 1593223 - RNA, 14 nt, Homo sapiens
cuauuacuaguacu

SEQ ID NO: 1593224 - RNA, 12 nt, Homo sapiens
cuauuacuauuu

SEQ ID NO: 1593225 - RNA, 13 nt, Homo sapiens
cuauuacugaccg

SEQ ID NO: 1593226 - RNA, 23 nt, Homo sapiens
cuauuagagcugccugugccuuu

SEQ ID NO: 1593227 - RNA, 14 nt, Homo sapiens
cuauuauauucauu

SEQ ID NO: 1593228 - RNA, 15 nt, Homo sapiens
cuauuauauucauuc

SEQ ID NO: 1593229 - RNA, 17 nt, Homo sapiens
cuauucaaacagucuca

SEQ ID NO: 1593230 - RNA, 16 nt, Homo sapiens
cuauuccuucacacag

SEQ ID NO: 1593231 - RNA, 21 nt, Homo sapiens
cuauugauguacagucuguca

SEQ ID NO: 1593232 - RNA, 15 nt, Homo sapiens
cuauugcuaguacua

SEQ ID NO: 1593233 - RNA, 23 nt, Homo sapiens
cuauugggauauccuuucacucu

SEQ ID NO: 1593234 - RNA, 19 nt, Homo sapiens
cuauuguaguaaacuugga

SEQ ID NO: 1593235 - RNA, 14 nt, Homo sapiens
cuauugucuguaau

SEQ ID NO: 1593236 - RNA, 22 nt, Homo sapiens
cuauuucaauaacagauggugc

SEQ ID NO: 1593237 - RNA, 22 nt, Homo sapiens
cuauuucuguauauaaaggugc

SEQ ID NO: 1593238 - RNA, 16 nt, Homo sapiens
cuauuucuguuccagu

SEQ ID NO: 1593239 - RNA, 21 nt, Homo sapiens
cuauuugccuccagugcaguc

SEQ ID NO: 1593240 - RNA, 16 nt, Homo sapiens
cuauuugucucuuaca

SEQ ID NO: 1593241 - RNA, 13 nt, Homo sapiens
cuauuuugagcau

SEQ ID NO: 1593242 - RNA, 16 nt, Homo sapiens
cuauuuuucuuuccaa

SEQ ID NO: 1593243 - RNA, 20 nt, Homo sapiens
cuauuuuugacuguagccac

SEQ ID NO: 1593244 - RNA, 21 nt, Homo sapiens
cuauuuuuguuaagcgugucu

SEQ ID NO: 1593245 - RNA, 16 nt, Homo sapiens
cucaaaacacuuccag

SEQ ID NO: 1593246 - RNA, 14 nt, Homo sapiens
cucaaaaccuccaa

SEQ ID NO: 1593247 - RNA, 18 nt, Homo sapiens
cucaaaacugcacuguca

SEQ ID NO: 1593248 - RNA, 20 nt, Homo sapiens
cucaaaauagggacuaucua

SEQ ID NO: 1593249 - RNA, 13 nt, Homo sapiens
cucaaacagucuu

SEQ ID NO: 1593250 - RNA, 20 nt, Homo sapiens
cucaaacucccgaccucagg

SEQ ID NO: 1593251 - RNA, 22 nt, Homo sapiens
cucaaacucccgaccucaggug

SEQ ID NO: 1593252 - RNA, 17 nt, Homo sapiens
cucaaaugauccuccca

SEQ ID NO: 1593253 - RNA, 19 nt, Homo sapiens
cucaaauuccgagugcaga

SEQ ID NO: 1593254 - RNA, 11 nt, Homo sapiens
cucaacagaga

SEQ ID NO: 1593255 - RNA, 21 nt, Homo sapiens
cucaacagagaggaccaacau

SEQ ID NO: 1593256 - RNA, 20 nt, Homo sapiens
cucaacauugcauggugcua

SEQ ID NO: 1593257 - RNA, 15 nt, Homo sapiens
cucaaccugggacuu

SEQ ID NO: 1593258 - RNA, 22 nt, Homo sapiens
cucaagcaugaagauaaacaca

SEQ ID NO: 1593259 - RNA, 20 nt, Homo sapiens
cucaagccccauuuccucac

SEQ ID NO: 1593260 - RNA, 23 nt, Homo sapiens
cucaagggccaugugguuuugca

SEQ ID NO: 1593261 - RNA, 21 nt, Homo sapiens
cucaaguugaaggacauucua

SEQ ID NO: 1593262 - RNA, 13 nt, Homo sapiens
cucaauaauuucc

SEQ ID NO: 1593263 - RNA, 16 nt, Homo sapiens
cucaauccuaucacag

SEQ ID NO: 1593264 - RNA, 15 nt, Homo sapiens
cucaauucaaaucca

SEQ ID NO: 1593265 - RNA, 16 nt, Homo sapiens
cucacaaaaaggcaaa

SEQ ID NO: 1593266 - RNA, 18 nt, Homo sapiens
cucacaaggaaaaggcca

SEQ ID NO: 1593267 - RNA, 18 nt, Homo sapiens
cuguaaucccagcacuuu

SEQ ID NO: 1593268 - RNA, 16 nt, Homo sapiens
cuguaaucucacuaca

SEQ ID NO: 1593269 - RNA, 18 nt, Homo sapiens
cuguaaucucagcacuuu

SEQ ID NO: 1593270 - RNA, 19 nt, Homo sapiens
cuguaaugauacugauuau

SEQ ID NO: 1593271 - RNA, 18 nt, Homo sapiens
cuguacaaauaauagcaa

SEQ ID NO: 1593272 - RNA, 15 nt, Homo sapiens
cuguacacacuuuau

SEQ ID NO: 1593273 - RNA, 15 nt, Homo sapiens
cuguacauugugagc

SEQ ID NO: 1593274 - RNA, 16 nt, Homo sapiens
cuguaccugugcacgu

SEQ ID NO: 1593275 - RNA, 14 nt, Homo sapiens
cuguagaaaugaug

SEQ ID NO: 1593276 - RNA, 18 nt, Homo sapiens
cuguagcaauuggauaga

SEQ ID NO: 1593277 - RNA, 21 nt, Homo sapiens
cuguauaaacagaacuccacu

SEQ ID NO: 1593278 - RNA, 21 nt, Homo sapiens
cuguauaauacuuuguauaca

SEQ ID NO: 1593279 - RNA, 22 nt, Homo sapiens
cuguauaauacuuuguauacaa

SEQ ID NO: 1593280 - RNA, 12 nt, Homo sapiens
cuguauaugcau

SEQ ID NO: 1593281 - RNA, 17 nt, Homo sapiens
cuguaugguauaugcau

SEQ ID NO: 1593282 - RNA, 18 nt, Homo sapiens
cuguaugguauaugcaug

SEQ ID NO: 1593283 - RNA, 17 nt, Homo sapiens
cuguaugucucguggua

SEQ ID NO: 1593284 - RNA, 23 nt, Homo sapiens
cuguauucuguuugcguacuugu

SEQ ID NO: 1593285 - RNA, 20 nt, Homo sapiens
cuguauuuaacaaaaagugc

SEQ ID NO: 1593286 - RNA, 23 nt, Homo sapiens
cuguauuuuuacagcuacuuuaa

SEQ ID NO: 1593287 - RNA, 16 nt, Homo sapiens
cugucaaaacuacuga

SEQ ID NO: 1593288 - RNA, 22 nt, Homo sapiens
cuaaguaaaaccacagcaguug

SEQ ID NO: 1593289 - RNA, 15 nt, Homo sapiens
cuaaguacacaauaa

SEQ ID NO: 1593290 - RNA, 13 nt, Homo sapiens
cuaagucauucau

SEQ ID NO: 1593291 - RNA, 15 nt, Homo sapiens
cuaagucauuccucc

SEQ ID NO: 1593292 - RNA, 23 nt, Homo sapiens
cuaagugaaauaagccagacauc

SEQ ID NO: 1593293 - RNA, 18 nt, Homo sapiens
cuaaguuauuuuguacau

SEQ ID NO: 1593294 - RNA, 15 nt, Homo sapiens
cuaaguucacuaaaa

SEQ ID NO: 1593295 - RNA, 18 nt, Homo sapiens
cuaauaauaguacuauua

SEQ ID NO: 1593296 - RNA, 19 nt, Homo sapiens
cuaauacagcaacaauuua

SEQ ID NO: 1593297 - RNA, 16 nt, Homo sapiens
cuaauaguuuuucacu

SEQ ID NO: 1593298 - RNA, 13 nt, Homo sapiens
cuaauaugccuag

SEQ ID NO: 1593299 - RNA, 24 nt, Homo sapiens
cuaaucaagaaaaacaucuuuggc

SEQ ID NO: 1593300 - RNA, 23 nt, Homo sapiens
cuaaucaagaaaagaauuacaga

SEQ ID NO: 1593301 - RNA, 17 nt, Homo sapiens
cuaauccagcaaaguga

SEQ ID NO: 1593302 - RNA, 23 nt, Homo sapiens
cuaaugaagguuuucauuugcca

SEQ ID NO: 1593303 - RNA, 22 nt, Homo sapiens
cuaaugauuuagugaucaaauu

SEQ ID NO: 1593304 - RNA, 12 nt, Homo sapiens
cuaauggucucu

SEQ ID NO: 1593305 - RNA, 12 nt, Homo sapiens
cuaaugguguug

SEQ ID NO: 1593306 - RNA, 22 nt, Homo sapiens
cuaaugugcagggauauugccu

SEQ ID NO: 1593307 - RNA, 15 nt, Homo sapiens
cuaauuccacacccu

SEQ ID NO: 1593308 - RNA, 17 nt, Homo sapiens
cuaauucggauuugcca

SEQ ID NO: 1593309 - RNA, 22 nt, Homo sapiens
cuaauucuggcaggaccucacc

SEQ ID NO: 1593310 - RNA, 18 nt, Homo sapiens
cuaauucugggaagggag

SEQ ID NO: 1593311 - RNA, 17 nt, Homo sapiens
cuaauuuaaguacauuu

SEQ ID NO: 1593312 - RNA, 21 nt, Homo sapiens
cuaauuugcauuaaauucaca

SEQ ID NO: 1593313 - RNA, 12 nt, Homo sapiens
cuacaagcuugu

SEQ ID NO: 1593314 - RNA, 10 nt, Homo sapiens
cuacaaggac

SEQ ID NO: 1593315 - RNA, 19 nt, Homo sapiens
cuacaaguauuauuuuaca

SEQ ID NO: 1593316 - RNA, 13 nt, Homo sapiens
cuacaagugcagc

SEQ ID NO: 1593317 - RNA, 18 nt, Homo sapiens
cuacacacggugccuuua

SEQ ID NO: 1593318 - RNA, 22 nt, Homo sapiens
cuacaccaaugaaaacauguac

SEQ ID NO: 1593319 - RNA, 19 nt, Homo sapiens
cuacacucaccugcacuaa

SEQ ID NO: 1593320 - RNA, 16 nt, Homo sapiens
cuacagaagggcagug

SEQ ID NO: 1593321 - RNA, 22 nt, Homo sapiens
cuacagagcuucccugacucau

SEQ ID NO: 1593322 - RNA, 22 nt, Homo sapiens
cuacagagucuggugaagcuca

SEQ ID NO: 1593323 - RNA, 19 nt, Homo sapiens
cuacagauauuaauguuaa

SEQ ID NO: 1593324 - RNA, 20 nt, Homo sapiens
cuacaggaagcaccccaugc

SEQ ID NO: 1593325 - RNA, 18 nt, Homo sapiens
cuacaggcucaugccauc

SEQ ID NO: 1593326 - RNA, 17 nt, Homo sapiens
cuacauacguguuccua

SEQ ID NO: 1593327 - RNA, 14 nt, Homo sapiens
cuacauauaugcaa

SEQ ID NO: 1593328 - RNA, 15 nt, Homo sapiens
cuacauauaugcaau

SEQ ID NO: 1593329 - RNA, 21 nt, Homo sapiens
cuacaugacgacaaagcugcu

SEQ ID NO: 1593330 - RNA, 22 nt, Homo sapiens
cuacaugcugaaaaauauagcc

SEQ ID NO: 1593331 - RNA, 15 nt, Homo sapiens
cuacauuccaaagaa

SEQ ID NO: 1593332 - RNA, 15 nt, Homo sapiens
cuacauugugcugca

SEQ ID NO: 1593333 - RNA, 11 nt, Homo sapiens
cuaccaagaac

SEQ ID NO: 1593334 - RNA, 15 nt, Homo sapiens
cuaccacucuaauca

SEQ ID NO: 1593335 - RNA, 12 nt, Homo sapiens
cuaccacuguau

SEQ ID NO: 1593336 - RNA, 22 nt, Homo sapiens
cuaccccaguuccuagcacugc

SEQ ID NO: 1593337 - RNA, 18 nt, Homo sapiens
cuaccccauucucuagac

SEQ ID NO: 1593338 - RNA, 21 nt, Homo sapiens
cuacccccugugccuugucac

SEQ ID NO: 1593339 - RNA, 13 nt, Homo sapiens
cuacccuguguau

SEQ ID NO: 1593340 - RNA, 23 nt, Homo sapiens
cuacccuuaguauuuauuacuaa

SEQ ID NO: 1593341 - RNA, 17 nt, Homo sapiens
cuaccuauaacacucua

SEQ ID NO: 1593342 - RNA, 21 nt, Homo sapiens
cuaccucagaaagauuugaug

SEQ ID NO: 1593343 - RNA, 17 nt, Homo sapiens
cuaccucagugcuccug

SEQ ID NO: 1593344 - RNA, 12 nt, Homo sapiens
cuaccucuccac

SEQ ID NO: 1593345 - RNA, 23 nt, Homo sapiens
cuaccucugagaagacacaaggu

SEQ ID NO: 1593346 - RNA, 20 nt, Homo sapiens
cuaccugagcauucaggcag

SEQ ID NO: 1593347 - RNA, 16 nt, Homo sapiens
cuaccugagcuaaaua

SEQ ID NO: 1593348 - RNA, 19 nt, Homo sapiens
cuaccugcuuggucuuuca

SEQ ID NO: 1593349 - RNA, 22 nt, Homo sapiens
cuaccuguaggaucagggucua

SEQ ID NO: 1593350 - RNA, 20 nt, Homo sapiens
cuacuacaaacuucaaagag

SEQ ID NO: 1593351 - RNA, 13 nt, Homo sapiens
cuacuacauucca

SEQ ID NO: 1593352 - RNA, 13 nt, Homo sapiens
cuacucucagguu

SEQ ID NO: 1593353 - RNA, 16 nt, Homo sapiens
cuacucucaugcugca

SEQ ID NO: 1593354 - RNA, 23 nt, Homo sapiens
cuacucucuccuuuuugcuuccu

SEQ ID NO: 1593355 - RNA, 14 nt, Homo sapiens
cuacucugcucaca

SEQ ID NO: 1593356 - RNA, 12 nt, Homo sapiens
cuacucuggaau

SEQ ID NO: 1593357 - RNA, 18 nt, Homo sapiens
cuacucuuaaaugagaaa

SEQ ID NO: 1593358 - RNA, 15 nt, Homo sapiens
cuacugaaaaugcau

SEQ ID NO: 1593359 - RNA, 17 nt, Homo sapiens
cuacugacagggagcag

SEQ ID NO: 1593360 - RNA, 12 nt, Homo sapiens
cuacugacgucc

SEQ ID NO: 1593361 - RNA, 20 nt, Homo sapiens
cuacugcucuccuccaccuc

SEQ ID NO: 1593362 - RNA, 19 nt, Homo sapiens
cuacuucccaguaacccua

SEQ ID NO: 1593363 - RNA, 18 nt, Homo sapiens
cuacuuuaaccuaugaua

SEQ ID NO: 1593364 - RNA, 21 nt, Homo sapiens
cuacuuuaauauaaacccaua

SEQ ID NO: 1593365 - RNA, 13 nt, Homo sapiens
cuacuuuacuguu

SEQ ID NO: 1593366 - RNA, 21 nt, Homo sapiens
cuagaaaaauguucuuuaaag

SEQ ID NO: 1593367 - RNA, 22 nt, Homo sapiens
cuagaaagcugcacuggugcua

SEQ ID NO: 1593368 - RNA, 17 nt, Homo sapiens
cuagaaaugcagcaucu

SEQ ID NO: 1593369 - RNA, 21 nt, Homo sapiens
cuagaaccucucguaguccau

SEQ ID NO: 1593370 - RNA, 18 nt, Homo sapiens
cuagaaccuggagagcua

SEQ ID NO: 1593371 - RNA, 18 nt, Homo sapiens
cuagaaccuggagggcua

SEQ ID NO: 1593372 - RNA, 18 nt, Homo sapiens
cuagaaccuguagagcua

SEQ ID NO: 1593373 - RNA, 21 nt, Homo sapiens
cuagaagcuccagugauaaga

SEQ ID NO: 1593374 - RNA, 22 nt, Homo sapiens
cuagaaggcguccauguuuauu

SEQ ID NO: 1593375 - RNA, 21 nt, Homo sapiens
cuagaauuugggcuuggacca

SEQ ID NO: 1593376 - RNA, 19 nt, Homo sapiens
cuagacgucucacucaaag

SEQ ID NO: 1593377 - RNA, 17 nt, Homo sapiens
cuagacuguuacuuugg

SEQ ID NO: 1593378 - RNA, 16 nt, Homo sapiens
cuagagaaggcuguga

SEQ ID NO: 1593379 - RNA, 17 nt, Homo sapiens
cuagagcuagauguguc

SEQ ID NO: 1593380 - RNA, 19 nt, Homo sapiens
cuagagcuccauuucuacu

SEQ ID NO: 1593381 - RNA, 15 nt, Homo sapiens
cuagagggggucuca

SEQ ID NO: 1593382 - RNA, 17 nt, Homo sapiens
cuagaguccucacuccc

SEQ ID NO: 1593383 - RNA, 20 nt, Homo sapiens
cuagagugcaauggcgcgau

SEQ ID NO: 1593384 - RNA, 22 nt, Homo sapiens
cuagaguucauggauauguuau

SEQ ID NO: 1593385 - RNA, 12 nt, Homo sapiens
cuagaguuuuau

SEQ ID NO: 1593386 - RNA, 14 nt, Homo sapiens
cuagauacaauaaa

SEQ ID NO: 1593387 - RNA, 15 nt, Homo sapiens
cuagaugugucuuac

SEQ ID NO: 1593388 - RNA, 17 nt, Homo sapiens
cuagauuacaucugccu

SEQ ID NO: 1593389 - RNA, 15 nt, Homo sapiens
cuagcauccacugau

SEQ ID NO: 1593390 - RNA, 15 nt, Homo sapiens
cuagcauuacauuau

SEQ ID NO: 1593391 - RNA, 12 nt, Homo sapiens
cuagcauuguaa

SEQ ID NO: 1593392 - RNA, 16 nt, Homo sapiens
cuagccaugcuuuaug

SEQ ID NO: 1593393 - RNA, 23 nt, Homo sapiens
cuagccugcauaucauucaccca

SEQ ID NO: 1593394 - RNA, 13 nt, Homo sapiens
cuagcuguuucaa

SEQ ID NO: 1593395 - RNA, 21 nt, Homo sapiens
cuaggaaaaucacuugccaaa

SEQ ID NO: 1593396 - RNA, 20 nt, Homo sapiens
cuaggaaggugaaucugccc

SEQ ID NO: 1593397 - RNA, 22 nt, Homo sapiens
cuaggacuuaaccuugaaaugg

SEQ ID NO: 1593398 - RNA, 19 nt, Homo sapiens
cgcccuugucucagucauu

SEQ ID NO: 1593399 - RNA, 23 nt, Homo sapiens
cgccguguguucaacgacugccg

SEQ ID NO: 1593400 - RNA, 19 nt, Homo sapiens
cgccucuguucaguucauu

SEQ ID NO: 1593401 - RNA, 22 nt, Homo sapiens
ccucuuccccagaaaggagacu

SEQ ID NO: 1593402 - RNA, 22 nt, Homo sapiens
ccucuucucuugacagucugaa

SEQ ID NO: 1593403 - RNA, 17 nt, Homo sapiens
cccacuuucaagacaga

SEQ ID NO: 1593404 - RNA, 19 nt, Homo sapiens
cccagaaacagugugcaug

SEQ ID NO: 1593405 - RNA, 21 nt, Homo sapiens
cccagaaugagacauccagca

SEQ ID NO: 1593406 - RNA, 18 nt, Homo sapiens
cccagacaccaugugcaa

SEQ ID NO: 1593407 - RNA, 23 nt, Homo sapiens
cccagacacuggcguuacugcuu

SEQ ID NO: 1593408 - RNA, 13 nt, Homo sapiens
cccagacagccug

SEQ ID NO: 1593409 - RNA, 20 nt, Homo sapiens
cccagacugaugagcacauc

SEQ ID NO: 1593410 - RNA, 11 nt, Homo sapiens
cccagcacuug

SEQ ID NO: 1593411 - RNA, 17 nt, Homo sapiens
cccagccacaacugcca

SEQ ID NO: 1593412 - RNA, 19 nt, Homo sapiens
cccagccccuccucccuca

SEQ ID NO: 1593413 - RNA, 19 nt, Homo sapiens
cccagccuccccgugccaa

SEQ ID NO: 1593414 - RNA, 17 nt, Homo sapiens
cccagcucaaugcaaug

SEQ ID NO: 1593415 - RNA, 21 nt, Homo sapiens
cccagcuccuuucuccuguga

SEQ ID NO: 1593416 - RNA, 13 nt, Homo sapiens
cccaggacugggc

SEQ ID NO: 1593417 - RNA, 23 nt, Homo sapiens
cccaggagacagaccacuugcca

SEQ ID NO: 1593418 - RNA, 15 nt, Homo sapiens
cccaggauacuggca

SEQ ID NO: 1593419 - RNA, 17 nt, Homo sapiens
cccaggauacuggcaca

SEQ ID NO: 1593420 - RNA, 14 nt, Homo sapiens
cccaggcuggagug

SEQ ID NO: 1593421 - RNA, 15 nt, Homo sapiens
cccaggcugggaacu

SEQ ID NO: 1593422 - RNA, 17 nt, Homo sapiens
cccaggcugggaacuca

SEQ ID NO: 1593423 - RNA, 14 nt, Homo sapiens
cccagggaagccug

SEQ ID NO: 1593424 - RNA, 15 nt, Homo sapiens
cccagggcacugcca

SEQ ID NO: 1593425 - RNA, 23 nt, Homo sapiens
cccagggcccacuagcauccacu

SEQ ID NO: 1593426 - RNA, 18 nt, Homo sapiens
cccagggccugacuugag

SEQ ID NO: 1593427 - RNA, 17 nt, Homo sapiens
cccagggggcggggugc

SEQ ID NO: 1593428 - RNA, 14 nt, Homo sapiens
cccagguaccagcu

SEQ ID NO: 1593429 - RNA, 18 nt, Homo sapiens
cccagguggcugacccag

SEQ ID NO: 1593430 - RNA, 14 nt, Homo sapiens
cccaguccacugag

SEQ ID NO: 1593431 - RNA, 11 nt, Homo sapiens
cccagucccau

SEQ ID NO: 1593432 - RNA, 17 nt, Homo sapiens
cccagugacaacaucgc

SEQ ID NO: 1593433 - RNA, 22 nt, Homo sapiens
cccagugcagggcuggucuugg

SEQ ID NO: 1593434 - RNA, 19 nt, Homo sapiens
cccaguggccggucagcca

SEQ ID NO: 1593435 - RNA, 14 nt, Homo sapiens
cccaguucaucacc

SEQ ID NO: 1593436 - RNA, 18 nt, Homo sapiens
cccaguuccuagcacugc

SEQ ID NO: 1593437 - RNA, 13 nt, Homo sapiens
cccauaaucccag

SEQ ID NO: 1593438 - RNA, 18 nt, Homo sapiens
cccauaauugcuuugcca

SEQ ID NO: 1593439 - RNA, 16 nt, Homo sapiens
cccauacaauguaugu

SEQ ID NO: 1593440 - RNA, 21 nt, Homo sapiens
cccauacaauguauguacaau

SEQ ID NO: 1593441 - RNA, 22 nt, Homo sapiens
cccaucacccaagccacaagcu

SEQ ID NO: 1593442 - RNA, 20 nt, Homo sapiens
cccaucagcacucuguaaaa

SEQ ID NO: 1593443 - RNA, 21 nt, Homo sapiens
cccaucagugcucuguaaaac

SEQ ID NO: 1593444 - RNA, 16 nt, Homo sapiens
cccaucauguggccca

SEQ ID NO: 1593445 - RNA, 15 nt, Homo sapiens
cccauccagccagac

SEQ ID NO: 1593446 - RNA, 23 nt, Homo sapiens
cccaugaccccaaagccaagggc

SEQ ID NO: 1593447 - RNA, 20 nt, Homo sapiens
cccaugagggagaugccaug

SEQ ID NO: 1593448 - RNA, 18 nt, Homo sapiens
cccaugcuggcugaagag

SEQ ID NO: 1593449 - RNA, 21 nt, Homo sapiens
cccauggaaagagacugucau

SEQ ID NO: 1593450 - RNA, 22 nt, Homo sapiens
cccaugggcuaucaacuuaaua

SEQ ID NO: 1593451 - RNA, 15 nt, Homo sapiens
cccauguaaccacug

SEQ ID NO: 1593452 - RNA, 20 nt, Homo sapiens
cccauucuaugugucaucaa

SEQ ID NO: 1593453 - RNA, 16 nt, Homo sapiens
cccauuucccauuaaa

SEQ ID NO: 1593454 - RNA, 16 nt, Homo sapiens
cccauuugucccagac

SEQ ID NO: 1593455 - RNA, 22 nt, Homo sapiens
cccauuugugaagcuuacucaa

SEQ ID NO: 1593456 - RNA, 21 nt, Homo sapiens
ccccaaauuuaauuaaagccu

SEQ ID NO: 1593457 - RNA, 21 nt, Homo sapiens
ccccaagaggggcgggcucag

SEQ ID NO: 1593458 - RNA, 18 nt, Homo sapiens
ccccaauaaaccagugug

SEQ ID NO: 1593459 - RNA, 15 nt, Homo sapiens
ccccaauccaugcuu

SEQ ID NO: 1593460 - RNA, 22 nt, Homo sapiens
ccccaauggcuacucugcucac

SEQ ID NO: 1593461 - RNA, 16 nt, Homo sapiens
ccccaauuacagggug

SEQ ID NO: 1593462 - RNA, 18 nt, Homo sapiens
ccccaauuucggauuuuu

SEQ ID NO: 1593463 - RNA, 23 nt, Homo sapiens
ccccacagaaccuucaacccagu

SEQ ID NO: 1593464 - RNA, 13 nt, Homo sapiens
ccccacagcgcuc

SEQ ID NO: 1593465 - RNA, 17 nt, Homo sapiens
ccccacccccagugcag

SEQ ID NO: 1593466 - RNA, 14 nt, Homo sapiens
ccccacgcugacca

SEQ ID NO: 1593467 - RNA, 16 nt, Homo sapiens
ccccagaaacagugug

SEQ ID NO: 1593468 - RNA, 15 nt, Homo sapiens
ccccagacucaagau

SEQ ID NO: 1593469 - RNA, 14 nt, Homo sapiens
ccccagccauccag

SEQ ID NO: 1593470 - RNA, 17 nt, Homo sapiens
ccccaggggucccagcc

SEQ ID NO: 1593471 - RNA, 16 nt, Homo sapiens
ccccaguaggacaaac

SEQ ID NO: 1593472 - RNA, 12 nt, Homo sapiens
ccccagucccag

SEQ ID NO: 1593473 - RNA, 21 nt, Homo sapiens
ccccaguuccucccaggaagc

SEQ ID NO: 1593474 - RNA, 17 nt, Homo sapiens
ccccauccccaccacug

SEQ ID NO: 1593475 - RNA, 15 nt, Homo sapiens
ccccaucucccugcc

SEQ ID NO: 1593476 - RNA, 19 nt, Homo sapiens
ccccauuccaccaccccag

SEQ ID NO: 1593477 - RNA, 21 nt, Homo sapiens
ccccauugagaucuuccugcu

SEQ ID NO: 1593478 - RNA, 21 nt, Homo sapiens
cccccaaugacacccaugcca

SEQ ID NO: 1593479 - RNA, 19 nt, Homo sapiens
cccccaccuacucucaggu

SEQ ID NO: 1593480 - RNA, 20 nt, Homo sapiens
cccccaggaggcagcucagg

SEQ ID NO: 1593481 - RNA, 20 nt, Homo sapiens
cccccaggcuggagugcagu

SEQ ID NO: 1593482 - RNA, 14 nt, Homo sapiens
cccccaugcugccu

SEQ ID NO: 1593483 - RNA, 17 nt, Homo sapiens
ccccccaacuccaggaa

SEQ ID NO: 1593484 - RNA, 13 nt, Homo sapiens
ccccccaccucca

SEQ ID NO: 1593485 - RNA, 17 nt, Homo sapiens
cccccggagcagggguc

SEQ ID NO: 1593486 - RNA, 18 nt, Homo sapiens
cccccucccagacaggcc

SEQ ID NO: 1593487 - RNA, 14 nt, Homo sapiens
cccccugccagucu

SEQ ID NO: 1593488 - RNA, 21 nt, Homo sapiens
cccccugucccauucuagauc

SEQ ID NO: 1593489 - RNA, 12 nt, Homo sapiens
cccccugugcag

SEQ ID NO: 1593490 - RNA, 14 nt, Homo sapiens
cccccuucagugcc

SEQ ID NO: 1593491 - RNA, 17 nt, Homo sapiens
cccccuuucacacugga

SEQ ID NO: 1593492 - RNA, 19 nt, Homo sapiens
ccccgccuccacucuaguu

SEQ ID NO: 1593493 - RNA, 12 nt, Homo sapiens
ccccgggcgggu

SEQ ID NO: 1593494 - RNA, 22 nt, Homo sapiens
ccccguguccucucccugccaa

SEQ ID NO: 1593495 - RNA, 22 nt, Homo sapiens
ccccuaaugccuaucugaccaa

SEQ ID NO: 1593496 - RNA, 22 nt, Homo sapiens
ccccucaauccuaucacagucu

SEQ ID NO: 1593497 - RNA, 15 nt, Homo sapiens
ccccuccuccaggga

SEQ ID NO: 1593498 - RNA, 15 nt, Homo sapiens
ccccucggagaagag

SEQ ID NO: 1593499 - RNA, 23 nt, Homo sapiens
ccccucguuagccuuccucugau

SEQ ID NO: 1593500 - RNA, 14 nt, Homo sapiens
ccccucucaccuca

SEQ ID NO: 1593501 - RNA, 12 nt, Homo sapiens
ccccugcagauu

SEQ ID NO: 1593502 - RNA, 18 nt, Homo sapiens
ccccugcagcuggaaugu

SEQ ID NO: 1593503 - RNA, 14 nt, Homo sapiens
ccccugccagugaa

SEQ ID NO: 1593504 - RNA, 18 nt, Homo sapiens
ccccugcuccaccagcag

SEQ ID NO: 1593505 - RNA, 14 nt, Homo sapiens
ccccuggagccuca

SEQ ID NO: 1593506 - RNA, 19 nt, Homo sapiens
ccccuggaucuaccagcau

SEQ ID NO: 1593507 - RNA, 15 nt, Homo sapiens
ccccuggccacagua

SEQ ID NO: 1593508 - RNA, 16 nt, Homo sapiens
ccccuguagcagucac

SEQ ID NO: 1593509 - RNA, 17 nt, Homo sapiens
ccccugugccuugucac

SEQ ID NO: 1593510 - RNA, 18 nt, Homo sapiens
ccccuuauucccgcucac

SEQ ID NO: 1593511 - RNA, 16 nt, Homo sapiens
ccccuuccuucuuugu

SEQ ID NO: 1593512 - RNA, 16 nt, Homo sapiens
ccccuucucucaucuc

SEQ ID NO: 1593513 - RNA, 14 nt, Homo sapiens
ccccuucuguguca

SEQ ID NO: 1593514 - RNA, 17 nt, Homo sapiens
ccccuugucugcacugu

SEQ ID NO: 1593515 - RNA, 17 nt, Homo sapiens
cccgaaacuaagccagg

SEQ ID NO: 1593516 - RNA, 19 nt, Homo sapiens
cccgaauucuaugagcaug

SEQ ID NO: 1593517 - RNA, 14 nt, Homo sapiens
cccgaggucaucac

SEQ ID NO: 1593518 - RNA, 23 nt, Homo sapiens
cccgccccagggcccacuagcau

SEQ ID NO: 1593519 - RNA, 15 nt, Homo sapiens
cccgccugccagucc

SEQ ID NO: 1593520 - RNA, 14 nt, Homo sapiens
cccgcggguucuag

SEQ ID NO: 1593521 - RNA, 19 nt, Homo sapiens
cccgggagacucaaaggga

SEQ ID NO: 1593522 - RNA, 20 nt, Homo sapiens
cccgugacgaggcucaaaaa

SEQ ID NO: 1593523 - RNA, 20 nt, Homo sapiens
cccuaaagacuaacuugaaa

SEQ ID NO: 1593524 - RNA, 18 nt, Homo sapiens
cccuaagcagaccacuga

SEQ ID NO: 1593525 - RNA, 19 nt, Homo sapiens
cccuaauuuaugugcuaua

SEQ ID NO: 1593526 - RNA, 16 nt, Homo sapiens
cccuagaugcacgugg

SEQ ID NO: 1593527 - RNA, 16 nt, Homo sapiens
cccucagauuccaccu

SEQ ID NO: 1593528 - RNA, 22 nt, Homo sapiens
cccucagauuugaugauuuccu

SEQ ID NO: 1593529 - RNA, 12 nt, Homo sapiens
cccucagcacug

SEQ ID NO: 1593530 - RNA, 10 nt, Homo sapiens
cccucaggcc

SEQ ID NO: 1593531 - RNA, 16 nt, Homo sapiens
cccucaggcccaggag

SEQ ID NO: 1593532 - RNA, 18 nt, Homo sapiens
cccucauccuuuacauuu

SEQ ID NO: 1593533 - RNA, 10 nt, Homo sapiens
cccuccaaag

SEQ ID NO: 1593534 - RNA, 21 nt, Homo sapiens
cccuccaaaggucugaugucu

SEQ ID NO: 1593535 - RNA, 16 nt, Homo sapiens
cccuccagacaaugcc

SEQ ID NO: 1593536 - RNA, 15 nt, Homo sapiens
cccuccagccagaga

SEQ ID NO: 1593537 - RNA, 13 nt, Homo sapiens
cccucccaacaga

SEQ ID NO: 1593538 - RNA, 16 nt, Homo sapiens
cccuccugucuuccca

SEQ ID NO: 1593539 - RNA, 19 nt, Homo sapiens
cccucuaggaggugaugau

SEQ ID NO: 1593540 - RNA, 13 nt, Homo sapiens
cccucucaccuca

SEQ ID NO: 1593541 - RNA, 14 nt, Homo sapiens
cccucucugaaccu

SEQ ID NO: 1593542 - RNA, 13 nt, Homo sapiens
cccugaaauccag

SEQ ID NO: 1593543 - RNA, 14 nt, Homo sapiens
cccugaacucagaa

SEQ ID NO: 1593544 - RNA, 13 nt, Homo sapiens
cccugaacugcuu

SEQ ID NO: 1593545 - RNA, 16 nt, Homo sapiens
cccugacucuuagccc

SEQ ID NO: 1593546 - RNA, 20 nt, Homo sapiens
cccugagcacuccuggugca

SEQ ID NO: 1593547 - RNA, 20 nt, Homo sapiens
cccugagcucggggacaggu

SEQ ID NO: 1593548 - RNA, 20 nt, Homo sapiens
cccugaggaaaaguccacaa

SEQ ID NO: 1593549 - RNA, 16 nt, Homo sapiens
cccugagucaccagga

SEQ ID NO: 1593550 - RNA, 21 nt, Homo sapiens
cccugaguugggcagccagga

SEQ ID NO: 1593551 - RNA, 15 nt, Homo sapiens
cccugaucuucacug

SEQ ID NO: 1593552 - RNA, 12 nt, Homo sapiens
cccugcauuuau

SEQ ID NO: 1593553 - RNA, 13 nt, Homo sapiens
cccugcccacaga

SEQ ID NO: 1593554 - RNA, 16 nt, Homo sapiens
cccugccucagccagg

SEQ ID NO: 1593555 - RNA, 13 nt, Homo sapiens
cccugcucacugg

SEQ ID NO: 1593556 - RNA, 15 nt, Homo sapiens
cccugcucacugggc

SEQ ID NO: 1593557 - RNA, 16 nt, Homo sapiens
cccugcugagaucugc

SEQ ID NO: 1593558 - RNA, 22 nt, Homo sapiens
cccugcuggggaagaacagccc

SEQ ID NO: 1593559 - RNA, 15 nt, Homo sapiens
cccuggaaacauaca

SEQ ID NO: 1593560 - RNA, 20 nt, Homo sapiens
cccuggaaaccuuccaccca

SEQ ID NO: 1593561 - RNA, 13 nt, Homo sapiens
cccuggaaaugga

SEQ ID NO: 1593562 - RNA, 20 nt, Homo sapiens
cccuggaucuaccagcauaa

SEQ ID NO: 1593563 - RNA, 20 nt, Homo sapiens
cccugggcagugagugccau

SEQ ID NO: 1593564 - RNA, 19 nt, Homo sapiens
cccugggccccaccaccua

SEQ ID NO: 1593565 - RNA, 19 nt, Homo sapiens
cccuggguaagaagggugg

SEQ ID NO: 1593566 - RNA, 19 nt, Homo sapiens
cccugugcaggagcuaguu

SEQ ID NO: 1593567 - RNA, 17 nt, Homo sapiens
cccuguggaugcugcug

SEQ ID NO: 1593568 - RNA, 22 nt, Homo sapiens
cccuguuuaacauuucacccca

SEQ ID NO: 1593569 - RNA, 18 nt, Homo sapiens
cccuuaacugcauccagc

SEQ ID NO: 1593570 - RNA, 14 nt, Homo sapiens
cccuuauacagugg

SEQ ID NO: 1593571 - RNA, 16 nt, Homo sapiens
cccuuauccuucuccc

SEQ ID NO: 1593572 - RNA, 21 nt, Homo sapiens
cccuuccucccauuucccauu

SEQ ID NO: 1593573 - RNA, 17 nt, Homo sapiens
cccuucuuuacuuccca

SEQ ID NO: 1593574 - RNA, 21 nt, Homo sapiens
cccuugcaaucuucuacuuua

SEQ ID NO: 1593575 - RNA, 18 nt, Homo sapiens
cccuuggaaaacaaaagu

SEQ ID NO: 1593576 - RNA, 21 nt, Homo sapiens
cccuugugagagcccauuccc

SEQ ID NO: 1593577 - RNA, 17 nt, Homo sapiens
cccuuguuacucaggaa

SEQ ID NO: 1593578 - RNA, 16 nt, Homo sapiens
cccuuucacacuggau

SEQ ID NO: 1593579 - RNA, 22 nt, Homo sapiens
cccuuuuguauucucuuccuca

SEQ ID NO: 1593580 - RNA, 14 nt, Homo sapiens
cccuuuuucaauga

SEQ ID NO: 1593581 - RNA, 13 nt, Homo sapiens
ccgaaaucagaag

SEQ ID NO: 1593582 - RNA, 22 nt, Homo sapiens
ccgaauucuaugagcaugccaa

SEQ ID NO: 1593583 - RNA, 21 nt, Homo sapiens
ccgacagacauggacaaggag

SEQ ID NO: 1593584 - RNA, 23 nt, Homo sapiens
ccgacugccccugcugugcugcu

SEQ ID NO: 1593585 - RNA, 20 nt, Homo sapiens
ccgagcgggugcaagcacuc

SEQ ID NO: 1593586 - RNA, 23 nt, Homo sapiens
ccgagcugcucccuuuccugcac

SEQ ID NO: 1593587 - RNA, 13 nt, Homo sapiens
ccgaggcccucaa

SEQ ID NO: 1593588 - RNA, 15 nt, Homo sapiens
ccgauuccaccaaau

SEQ ID NO: 1593589 - RNA, 13 nt, Homo sapiens
ccgcaagggguga

SEQ ID NO: 1593590 - RNA, 22 nt, Homo sapiens
ccgcaaugugacuuaaugccac

SEQ ID NO: 1593591 - RNA, 21 nt, Homo sapiens
ccgcagacggucugugugcug

SEQ ID NO: 1593592 - RNA, 13 nt, Homo sapiens
ccgcagggcgggg

SEQ ID NO: 1593593 - RNA, 14 nt, Homo sapiens
ccgcaugugaucuc

SEQ ID NO: 1593594 - RNA, 15 nt, Homo sapiens
ccgcauuggugacuc

SEQ ID NO: 1593595 - RNA, 12 nt, Homo sapiens
ccgcguggaaug

SEQ ID NO: 1593596 - RNA, 13 nt, Homo sapiens
ccggacagagggg

SEQ ID NO: 1593597 - RNA, 15 nt, Homo sapiens
ccggcauaagccacu

SEQ ID NO: 1593598 - RNA, 19 nt, Homo sapiens
ccggccuccugucccucau

SEQ ID NO: 1593599 - RNA, 22 nt, Homo sapiens
ccggcugguugugggcacuggc

SEQ ID NO: 1593600 - RNA, 17 nt, Homo sapiens
ccggcuguuuccugaca

SEQ ID NO: 1593601 - RNA, 11 nt, Homo sapiens
ccgggacaccu

SEQ ID NO: 1593602 - RNA, 23 nt, Homo sapiens
ccgggcaccaacuccauguuugg

SEQ ID NO: 1593603 - RNA, 13 nt, Homo sapiens
ccggggguccagg

SEQ ID NO: 1593604 - RNA, 15 nt, Homo sapiens
ccguaucacaguguu

SEQ ID NO: 1593605 - RNA, 16 nt, Homo sapiens
ccguauugguauacuu

SEQ ID NO: 1593606 - RNA, 15 nt, Homo sapiens
ccguccucacccauc

SEQ ID NO: 1593607 - RNA, 14 nt, Homo sapiens
ccgugcccuacccc

SEQ ID NO: 1593608 - RNA, 11 nt, Homo sapiens
ccguguugcag

SEQ ID NO: 1593609 - RNA, 13 nt, Homo sapiens
ccuaaaagcaaaa

SEQ ID NO: 1593610 - RNA, 17 nt, Homo sapiens
ccuaaaaguucauaaca

SEQ ID NO: 1593611 - RNA, 16 nt, Homo sapiens
ccuaaaaugcuucacu

SEQ ID NO: 1593612 - RNA, 19 nt, Homo sapiens
ccuaaaauuuuagauguag

SEQ ID NO: 1593613 - RNA, 15 nt, Homo sapiens
ccuaaacuccagggg

SEQ ID NO: 1593614 - RNA, 16 nt, Homo sapiens
ccuaaacuguaucaua

SEQ ID NO: 1593615 - RNA, 13 nt, Homo sapiens
ccuaaacuuucca

SEQ ID NO: 1593616 - RNA, 19 nt, Homo sapiens
ccuaacagggcacauauuc

SEQ ID NO: 1593617 - RNA, 16 nt, Homo sapiens
ccuaagaaacacucau

SEQ ID NO: 1593618 - RNA, 11 nt, Homo sapiens
ccuaagacauu

SEQ ID NO: 1593619 - RNA, 18 nt, Homo sapiens
ccuaagagaugggacuag

SEQ ID NO: 1593620 - RNA, 21 nt, Homo sapiens
ccuaagagaugggacuaggac

SEQ ID NO: 1593621 - RNA, 18 nt, Homo sapiens
ccuaagcagaccacugau

SEQ ID NO: 1593622 - RNA, 15 nt, Homo sapiens
ccuaagggagugucu

SEQ ID NO: 1593623 - RNA, 13 nt, Homo sapiens
ccuaagugccucu

SEQ ID NO: 1593624 - RNA, 20 nt, Homo sapiens
ccuaauacugucauccucaa

SEQ ID NO: 1593625 - RNA, 15 nt, Homo sapiens
ccuaauaucaauuug

SEQ ID NO: 1593626 - RNA, 18 nt, Homo sapiens
ccuaaucauauaccagag

SEQ ID NO: 1593627 - RNA, 21 nt, Homo sapiens
ccuaaugaaagugaugacaua

SEQ ID NO: 1593628 - RNA, 21 nt, Homo sapiens
ccuacaccucuugcauuccau

SEQ ID NO: 1593629 - RNA, 16 nt, Homo sapiens
ccuacagaagggcagu

SEQ ID NO: 1593630 - RNA, 22 nt, Homo sapiens
ccuacaggugcuguucagugcc

SEQ ID NO: 1593631 - RNA, 14 nt, Homo sapiens
ccuacauuaucuca

SEQ ID NO: 1593632 - RNA, 19 nt, Homo sapiens
ccuacccccugugccuugu

SEQ ID NO: 1593633 - RNA, 13 nt, Homo sapiens
ccuaccucuagua

SEQ ID NO: 1593634 - RNA, 19 nt, Homo sapiens
ccuacuagucaccagagac

SEQ ID NO: 1593635 - RNA, 16 nt, Homo sapiens
ccuacuuugacuuuuu

SEQ ID NO: 1593636 - RNA, 19 nt, Homo sapiens
ccuacuuugacuuuuugca

SEQ ID NO: 1593637 - RNA, 18 nt, Homo sapiens
ccuagagaaggcugugag

SEQ ID NO: 1593638 - RNA, 18 nt, Homo sapiens
ccuagagcuagauguguc

SEQ ID NO: 1593639 - RNA, 20 nt, Homo sapiens
ccuagagucuuaaagcauuu

SEQ ID NO: 1593640 - RNA, 23 nt, Homo sapiens
ccuagagucuuaaagcauuucag

SEQ ID NO: 1593641 - RNA, 15 nt, Homo sapiens
cacccuccuacaggu

SEQ ID NO: 1593642 - RNA, 20 nt, Homo sapiens
cacccuggagagugcacaug

SEQ ID NO: 1593643 - RNA, 22 nt, Homo sapiens
cacccugggcagugagugccau

SEQ ID NO: 1593644 - RNA, 12 nt, Homo sapiens
cacccuuucauu

SEQ ID NO: 1593645 - RNA, 20 nt, Homo sapiens
caccgagaagaggcggcaga

SEQ ID NO: 1593646 - RNA, 16 nt, Homo sapiens
caccgagcgggugcaa

SEQ ID NO: 1593647 - RNA, 22 nt, Homo sapiens
caccgcgcccggccucagugcc

SEQ ID NO: 1593648 - RNA, 16 nt, Homo sapiens
caccuacauuaucuca

SEQ ID NO: 1593649 - RNA, 18 nt, Homo sapiens
caccuacgggggcaucug

SEQ ID NO: 1593650 - RNA, 18 nt, Homo sapiens
caccuauauauccaagaa

SEQ ID NO: 1593651 - RNA, 12 nt, Homo sapiens
caccuaugugcc

SEQ ID NO: 1593652 - RNA, 22 nt, Homo sapiens
caccucauuauuaucuagcuaa

SEQ ID NO: 1593653 - RNA, 23 nt, Homo sapiens
caccucccccuuucacacuggau

SEQ ID NO: 1593654 - RNA, 15 nt, Homo sapiens
caccucucagcugcu

SEQ ID NO: 1593655 - RNA, 19 nt, Homo sapiens
caccucucugagcucugca

SEQ ID NO: 1593656 - RNA, 18 nt, Homo sapiens
caccucucuguaguuuau

SEQ ID NO: 1593657 - RNA, 23 nt, Homo sapiens
caccucugauggcugaagaaugu

SEQ ID NO: 1593658 - RNA, 18 nt, Homo sapiens
caccugacacaccaggcg

SEQ ID NO: 1593659 - RNA, 19 nt, Homo sapiens
caccuuaauaugcugcaac

SEQ ID NO: 1593660 - RNA, 16 nt, Homo sapiens
caccuucagacuuugc

SEQ ID NO: 1593661 - RNA, 16 nt, Homo sapiens
caccuuggaauucgcu

SEQ ID NO: 1593662 - RNA, 20 nt, Homo sapiens
caccuuggaauucgcuuucu

SEQ ID NO: 1593663 - RNA, 14 nt, Homo sapiens
caccuuuuaugaau

SEQ ID NO: 1593664 - RNA, 16 nt, Homo sapiens
cacgagcccauucuca

SEQ ID NO: 1593665 - RNA, 17 nt, Homo sapiens
cacggauccauguagca

SEQ ID NO: 1593666 - RNA, 18 nt, Homo sapiens
cacggaugacuuaacugc

SEQ ID NO: 1593667 - RNA, 22 nt, Homo sapiens
cacgucgggcuucccuggccuc

SEQ ID NO: 1593668 - RNA, 15 nt, Homo sapiens
cacgucuaacuggaa

SEQ ID NO: 1593669 - RNA, 20 nt, Homo sapiens
cacguggagauagugccagg

SEQ ID NO: 1593670 - RNA, 22 nt, Homo sapiens
cacguuggucuugaacuccuga

SEQ ID NO: 1593671 - RNA, 18 nt, Homo sapiens
cacuaaaguuaguaaaga

SEQ ID NO: 1593672 - RNA, 19 nt, Homo sapiens
cacuaaauugacacuuaaa

SEQ ID NO: 1593673 - RNA, 19 nt, Homo sapiens
cacuaaccaaacaaugcag

SEQ ID NO: 1593674 - RNA, 11 nt, Homo sapiens
cacuacaggca

SEQ ID NO: 1593675 - RNA, 22 nt, Homo sapiens
cacuacuccugaggaugcuacu

SEQ ID NO: 1593676 - RNA, 21 nt, Homo sapiens
cacuacugggugucauuucau

SEQ ID NO: 1593677 - RNA, 15 nt, Homo sapiens
cacuagaaaugcagc

SEQ ID NO: 1593678 - RNA, 17 nt, Homo sapiens
cacuagaaaugcagcau

SEQ ID NO: 1593679 - RNA, 15 nt, Homo sapiens
cacuagaaugcaagu

SEQ ID NO: 1593680 - RNA, 16 nt, Homo sapiens
cacuagaaugcaagua

SEQ ID NO: 1593681 - RNA, 19 nt, Homo sapiens
cacuaguccauaagcuuua

SEQ ID NO: 1593682 - RNA, 12 nt, Homo sapiens
cacuagucucac

SEQ ID NO: 1593683 - RNA, 16 nt, Homo sapiens
cacuagugcaauucca

SEQ ID NO: 1593684 - RNA, 23 nt, Homo sapiens
cacuauccuggcaacucaaggcu

SEQ ID NO: 1593685 - RNA, 23 nt, Homo sapiens
cacucaauuucucugaggacaca

SEQ ID NO: 1593686 - RNA, 16 nt, Homo sapiens
cacucagggagcauuu

SEQ ID NO: 1593687 - RNA, 22 nt, Homo sapiens
cacucaguggcccauggcauuu

SEQ ID NO: 1593688 - RNA, 16 nt, Homo sapiens
cacucauuucaucuca

SEQ ID NO: 1593689 - RNA, 22 nt, Homo sapiens
cacuccaccacccaaaagucaa

SEQ ID NO: 1593690 - RNA, 13 nt, Homo sapiens
cacuccagccuga

SEQ ID NO: 1593691 - RNA, 16 nt, Homo sapiens
cacuccagguggaaca

SEQ ID NO: 1593692 - RNA, 23 nt, Homo sapiens
cacuccguccauccgacugcccc

SEQ ID NO: 1593693 - RNA, 15 nt, Homo sapiens
cacuccuccgugagc

SEQ ID NO: 1593694 - RNA, 14 nt, Homo sapiens
cacucuggagcauu

SEQ ID NO: 1593695 - RNA, 12 nt, Homo sapiens
cacucugucauc

SEQ ID NO: 1593696 - RNA, 14 nt, Homo sapiens
cacucuuagcuaug

SEQ ID NO: 1593697 - RNA, 14 nt, Homo sapiens
cacucuuguaauaa

SEQ ID NO: 1593698 - RNA, 20 nt, Homo sapiens
cacugaaaauuuaacaguau

SEQ ID NO: 1593699 - RNA, 21 nt, Homo sapiens
cacugaaacugguugaagggu

SEQ ID NO: 1593700 - RNA, 16 nt, Homo sapiens
cacugagccagucuuu

SEQ ID NO: 1593701 - RNA, 19 nt, Homo sapiens
cacugagugccuacucuuu

SEQ ID NO: 1593702 - RNA, 15 nt, Homo sapiens
cacugauaaaaccau

SEQ ID NO: 1593703 - RNA, 17 nt, Homo sapiens
cacugauaaucacacug

SEQ ID NO: 1593704 - RNA, 19 nt, Homo sapiens
cacugaucccccagaugca

SEQ ID NO: 1593705 - RNA, 22 nt, Homo sapiens
cacugauggaaaauaccagugu

SEQ ID NO: 1593706 - RNA, 16 nt, Homo sapiens
cacugauguacaauua

SEQ ID NO: 1593707 - RNA, 16 nt, Homo sapiens
cacugcagaagacagu

SEQ ID NO: 1593708 - RNA, 14 nt, Homo sapiens
cacugcagucagau

SEQ ID NO: 1593709 - RNA, 17 nt, Homo sapiens
cacugccccucucucag

SEQ ID NO: 1593710 - RNA, 18 nt, Homo sapiens
cacugcgggagcucugua

SEQ ID NO: 1593711 - RNA, 15 nt, Homo sapiens
cacugcuugaggaaa

SEQ ID NO: 1593712 - RNA, 21 nt, Homo sapiens
cacuggaauauaaaacaguca

SEQ ID NO: 1593713 - RNA, 23 nt, Homo sapiens
cacuggauccaucuugagccaca

SEQ ID NO: 1593714 - RNA, 22 nt, Homo sapiens
cacuggauugacuuugcuguca

SEQ ID NO: 1593715 - RNA, 19 nt, Homo sapiens
cacuggggcagacaauaaa

SEQ ID NO: 1593716 - RNA, 20 nt, Homo sapiens
cacuguacauuuuuauacag

SEQ ID NO: 1593717 - RNA, 13 nt, Homo sapiens
cacugucaucuuc

SEQ ID NO: 1593718 - RNA, 22 nt, Homo sapiens
cacuguccaugaagcacugagc

SEQ ID NO: 1593719 - RNA, 19 nt, Homo sapiens
cacugucuagagcaacuuu

SEQ ID NO: 1593720 - RNA, 22 nt, Homo sapiens
cacugucucauccacauaagca

SEQ ID NO: 1593721 - RNA, 15 nt, Homo sapiens
cacuguggucgucaa

SEQ ID NO: 1593722 - RNA, 16 nt, Homo sapiens
cacuguucuguucuca

SEQ ID NO: 1593723 - RNA, 15 nt, Homo sapiens
cacuuaaacucagcu

SEQ ID NO: 1593724 - RNA, 13 nt, Homo sapiens
cacuuaauagcaa

SEQ ID NO: 1593725 - RNA, 16 nt, Homo sapiens
cacuuagcccaagagg

SEQ ID NO: 1593726 - RNA, 17 nt, Homo sapiens
cacuuaguagagugauu

SEQ ID NO: 1593727 - RNA, 22 nt, Homo sapiens
cacuuauaagaaagaucaaaga

SEQ ID NO: 1593728 - RNA, 16 nt, Homo sapiens
cacuuauuucagccaa

SEQ ID NO: 1593729 - RNA, 14 nt, Homo sapiens
cacuuauuugucaa

SEQ ID NO: 1593730 - RNA, 13 nt, Homo sapiens
cacuucaaauuca

SEQ ID NO: 1593731 - RNA, 16 nt, Homo sapiens
cacuucuaaaccaaaa

SEQ ID NO: 1593732 - RNA, 17 nt, Homo sapiens
cacuucuaccuacauau

SEQ ID NO: 1593733 - RNA, 15 nt, Homo sapiens
cacuuggcauacaaa

SEQ ID NO: 1593734 - RNA, 17 nt, Homo sapiens
cacuugggauugucuua

SEQ ID NO: 1593735 - RNA, 16 nt, Homo sapiens
cacuugucaaagaagg

SEQ ID NO: 1593736 - RNA, 22 nt, Homo sapiens
cacuugucaaagaaggugcuga

SEQ ID NO: 1593737 - RNA, 18 nt, Homo sapiens
cacuuuaccucuguggac

SEQ ID NO: 1593738 - RNA, 20 nt, Homo sapiens
cacuuuaccucuguggaccu

SEQ ID NO: 1593739 - RNA, 20 nt, Homo sapiens
cacuuuaguuauauucacug

SEQ ID NO: 1593740 - RNA, 16 nt, Homo sapiens
cacuuugccuccugug

SEQ ID NO: 1593741 - RNA, 13 nt, Homo sapiens
cacuuuucaaugu

SEQ ID NO: 1593742 - RNA, 16 nt, Homo sapiens
cacuuuuugugaauua

SEQ ID NO: 1593743 - RNA, 17 nt, Homo sapiens
cacuuuuuuguuugaau

SEQ ID NO: 1593744 - RNA, 16 nt, Homo sapiens
cagaaaagcaccugcc

SEQ ID NO: 1593745 - RNA, 15 nt, Homo sapiens
cagaaaaucuaccaa

SEQ ID NO: 1593746 - RNA, 16 nt, Homo sapiens
cagaaaaucuaccaag

SEQ ID NO: 1593747 - RNA, 19 nt, Homo sapiens
cagaaaauuaaacuacaga

SEQ ID NO: 1593748 - RNA, 18 nt, Homo sapiens
cagaaagcagaacaguga

SEQ ID NO: 1593749 - RNA, 20 nt, Homo sapiens
cagaaagcuccuuccagacc

SEQ ID NO: 1593750 - RNA, 19 nt, Homo sapiens
cagaaagcuucauccacag

SEQ ID NO: 1593751 - RNA, 19 nt, Homo sapiens
cagaaauaaagagcuguua

SEQ ID NO: 1593752 - RNA, 21 nt, Homo sapiens
cagaaauggugcucaccaugc

SEQ ID NO: 1593753 - RNA, 18 nt, Homo sapiens
cagaacaaauuguuuaca

SEQ ID NO: 1593754 - RNA, 19 nt, Homo sapiens
cagaacacugcagucagau

SEQ ID NO: 1593755 - RNA, 13 nt, Homo sapiens
cagaacccagugu

SEQ ID NO: 1593756 - RNA, 14 nt, Homo sapiens
cagaacucuuucaa

SEQ ID NO: 1593757 - RNA, 15 nt, Homo sapiens
cagaacuuucugucc

SEQ ID NO: 1593758 - RNA, 23 nt, Homo sapiens
cagaagagguugggcuuccaugc

SEQ ID NO: 1593759 - RNA, 18 nt, Homo sapiens
auagcaccuccacauacc

SEQ ID NO: 1593760 - RNA, 17 nt, Homo sapiens
auagcagcuuauucaca

SEQ ID NO: 1593761 - RNA, 21 nt, Homo sapiens
auagccuagauaugaauauau

SEQ ID NO: 1593762 - RNA, 21 nt, Homo sapiens
auagcugccuucaaggacugu

SEQ ID NO: 1593763 - RNA, 18 nt, Homo sapiens
auagcuguaaacuuccaa

SEQ ID NO: 1593764 - RNA, 18 nt, Homo sapiens
auagcuuccagauuacaa

SEQ ID NO: 1593765 - RNA, 16 nt, Homo sapiens
auagcuugaagcccaa

SEQ ID NO: 1593766 - RNA, 22 nt, Homo sapiens
auaggaaaccacacagacuugg

SEQ ID NO: 1593767 - RNA, 21 nt, Homo sapiens
auaggaauuugcguaacuaac

SEQ ID NO: 1593768 - RNA, 20 nt, Homo sapiens
auaggacucuagacggcauc

SEQ ID NO: 1593769 - RNA, 15 nt, Homo sapiens
auaggagguggggga

SEQ ID NO: 1593770 - RNA, 21 nt, Homo sapiens
auaggauuuucacacauucac

SEQ ID NO: 1593771 - RNA, 21 nt, Homo sapiens
auaggcuucucacggcgacca

SEQ ID NO: 1593772 - RNA, 19 nt, Homo sapiens
auagggaaaauaaucucaa

SEQ ID NO: 1593773 - RNA, 14 nt, Homo sapiens
auagguaaaccaaa

SEQ ID NO: 1593774 - RNA, 19 nt, Homo sapiens
auaggugcuacaaaaacac

SEQ ID NO: 1593775 - RNA, 15 nt, Homo sapiens
auaguaaacuaaagu

SEQ ID NO: 1593776 - RNA, 17 nt, Homo sapiens
caaguauuacaaccaua

SEQ ID NO: 1593777 - RNA, 14 nt, Homo sapiens
caagucaugccuga

SEQ ID NO: 1593778 - RNA, 12 nt, Homo sapiens
caaguccaagca

SEQ ID NO: 1593779 - RNA, 13 nt, Homo sapiens
caagucccuguca

SEQ ID NO: 1593780 - RNA, 21 nt, Homo sapiens
caagucugcauuucauauuau

SEQ ID NO: 1593781 - RNA, 21 nt, Homo sapiens
caagugagagagaugggagcu

SEQ ID NO: 1593782 - RNA, 15 nt, Homo sapiens
caagugcagcuguga

SEQ ID NO: 1593783 - RNA, 19 nt, Homo sapiens
caagugcccagccugugga

SEQ ID NO: 1593784 - RNA, 22 nt, Homo sapiens
caagugcccucucugaaccuca

SEQ ID NO: 1593785 - RNA, 17 nt, Homo sapiens
caagugcgugacuguau

SEQ ID NO: 1593786 - RNA, 11 nt, Homo sapiens
caagugcugca

SEQ ID NO: 1593787 - RNA, 18 nt, Homo sapiens
caagugcugcacaaaagc

SEQ ID NO: 1593788 - RNA, 13 nt, Homo sapiens
caagugcuuccua

SEQ ID NO: 1593789 - RNA, 18 nt, Homo sapiens
caagugggaucugucaca

SEQ ID NO: 1593790 - RNA, 21 nt, Homo sapiens
caaguggugccuaaaguuuaa

SEQ ID NO: 1593791 - RNA, 16 nt, Homo sapiens
caagugucugugcaug

SEQ ID NO: 1593792 - RNA, 13 nt, Homo sapiens
caaguuacaguga

SEQ ID NO: 1593793 - RNA, 17 nt, Homo sapiens
caaguuacagugaugcu

SEQ ID NO: 1593794 - RNA, 15 nt, Homo sapiens
caaguuaguucaauc

SEQ ID NO: 1593795 - RNA, 18 nt, Homo sapiens
caaguucuggaucuuaua

SEQ ID NO: 1593796 - RNA, 20 nt, Homo sapiens
caaguucuuaguugcuguau

SEQ ID NO: 1593797 - RNA, 14 nt, Homo sapiens
caauaaaaccaaac

SEQ ID NO: 1593798 - RNA, 18 nt, Homo sapiens
caauaaaauuauuugcag

SEQ ID NO: 1593799 - RNA, 17 nt, Homo sapiens
caauaaacagucacugg

SEQ ID NO: 1593800 - RNA, 13 nt, Homo sapiens
caauaaaccacaa

SEQ ID NO: 1593801 - RNA, 14 nt, Homo sapiens
caauaaaccacaag

SEQ ID NO: 1593802 - RNA, 18 nt, Homo sapiens
caauaaaccagugugaac

SEQ ID NO: 1593803 - RNA, 15 nt, Homo sapiens
caauaaacccucaga

SEQ ID NO: 1593804 - RNA, 18 nt, Homo sapiens
caauaaagauacaugauu

SEQ ID NO: 1593805 - RNA, 19 nt, Homo sapiens
caauaaaggcagcugccuc

SEQ ID NO: 1593806 - RNA, 20 nt, Homo sapiens
caauaaagggagaauggugc

SEQ ID NO: 1593807 - RNA, 22 nt, Homo sapiens
caauaaagggagaauggugcug

SEQ ID NO: 1593808 - RNA, 13 nt, Homo sapiens
caauaaaguacuu

SEQ ID NO: 1593809 - RNA, 13 nt, Homo sapiens
caauaaugcagua

SEQ ID NO: 1593810 - RNA, 14 nt, Homo sapiens
caauacaaccagcc

SEQ ID NO: 1593811 - RNA, 19 nt, Homo sapiens
caauacaauguacaauuau

SEQ ID NO: 1593812 - RNA, 14 nt, Homo sapiens
caauagcaccccua

SEQ ID NO: 1593813 - RNA, 18 nt, Homo sapiens
caauagguuuguaaaaug

SEQ ID NO: 1593814 - RNA, 12 nt, Homo sapiens
caauaguauuaa

SEQ ID NO: 1593815 - RNA, 13 nt, Homo sapiens
caauaguauuucu

SEQ ID NO: 1593816 - RNA, 17 nt, Homo sapiens
caauagugucauccuca

SEQ ID NO: 1593817 - RNA, 19 nt, Homo sapiens
caauaguguccuaugcaau

SEQ ID NO: 1593818 - RNA, 17 nt, Homo sapiens
caauauuccuaugcugc

SEQ ID NO: 1593819 - RNA, 15 nt, Homo sapiens
caauauuuugccuuu

SEQ ID NO: 1593820 - RNA, 15 nt, Homo sapiens
caaucauuucuauua

SEQ ID NO: 1593821 - RNA, 18 nt, Homo sapiens
caauccagcuauguuaua

SEQ ID NO: 1593822 - RNA, 18 nt, Homo sapiens
caauccaggcuguucuca

SEQ ID NO: 1593823 - RNA, 13 nt, Homo sapiens
caauccccaaagg

SEQ ID NO: 1593824 - RNA, 15 nt, Homo sapiens
caauccccagacuca

SEQ ID NO: 1593825 - RNA, 22 nt, Homo sapiens
caaucccugaggacugauuuca

SEQ ID NO: 1593826 - RNA, 18 nt, Homo sapiens
caaucgagacugcaaugu

SEQ ID NO: 1593827 - RNA, 13 nt, Homo sapiens
caaucguaaaauu

SEQ ID NO: 1593828 - RNA, 21 nt, Homo sapiens
caaucugaaacagcuucaugg

SEQ ID NO: 1593829 - RNA, 18 nt, Homo sapiens
caaucugcaaggacauuu

SEQ ID NO: 1593830 - RNA, 19 nt, Homo sapiens
caaucuggcuuagugccac

SEQ ID NO: 1593831 - RNA, 18 nt, Homo sapiens
caaucugucacauaaaag

SEQ ID NO: 1593832 - RNA, 20 nt, Homo sapiens
caaucuguccguucacaugu

SEQ ID NO: 1593833 - RNA, 17 nt, Homo sapiens
caaucuuauguuuccaa

SEQ ID NO: 1593834 - RNA, 14 nt, Homo sapiens
caaucuucuacuuu

SEQ ID NO: 1593835 - RNA, 18 nt, Homo sapiens
caaucuuguuacugcuga

SEQ ID NO: 1593836 - RNA, 20 nt, Homo sapiens
caaucuuguuuauagcaaaa

SEQ ID NO: 1593837 - RNA, 23 nt, Homo sapiens
caaucuuucaugucuugucauac

SEQ ID NO: 1593838 - RNA, 13 nt, Homo sapiens
caaucuuuuauac

SEQ ID NO: 1593839 - RNA, 16 nt, Homo sapiens
caaugaacaucccuuu

SEQ ID NO: 1593840 - RNA, 17 nt, Homo sapiens
caaugacacccaugcca

SEQ ID NO: 1593841 - RNA, 13 nt, Homo sapiens
caaugacauuuau

SEQ ID NO: 1593842 - RNA, 15 nt, Homo sapiens
caaugaguuugggca

SEQ ID NO: 1593843 - RNA, 21 nt, Homo sapiens
caaugauaggaaaaauccauu

SEQ ID NO: 1593844 - RNA, 19 nt, Homo sapiens
caaugaucaccgacugaaa

SEQ ID NO: 1593845 - RNA, 12 nt, Homo sapiens
caaugaugcccu

SEQ ID NO: 1593846 - RNA, 19 nt, Homo sapiens
caaugaugugugcaaguac

SEQ ID NO: 1593847 - RNA, 16 nt, Homo sapiens
caaugcaaacaucuuc

SEQ ID NO: 1593848 - RNA, 20 nt, Homo sapiens
caaugcaccuaaagaaaaac

SEQ ID NO: 1593849 - RNA, 19 nt, Homo sapiens
caaugcccaacuuacuguc

SEQ ID NO: 1593850 - RNA, 19 nt, Homo sapiens
caaugcuguggguuuccaa

SEQ ID NO: 1593851 - RNA, 22 nt, Homo sapiens
caaugggacucugagaacuccu

SEQ ID NO: 1593852 - RNA, 17 nt, Homo sapiens
caaugguucucuucccu

SEQ ID NO: 1593853 - RNA, 14 nt, Homo sapiens
caauguaagcauac

SEQ ID NO: 1593854 - RNA, 15 nt, Homo sapiens
caauguauguacaau

SEQ ID NO: 1593855 - RNA, 21 nt, Homo sapiens
caauguugcauuuaugaugca

SEQ ID NO: 1593856 - RNA, 17 nt, Homo sapiens
caauuaacauacaucau

SEQ ID NO: 1593857 - RNA, 16 nt, Homo sapiens
caauuacucacuaaag

SEQ ID NO: 1593858 - RNA, 22 nt, Homo sapiens
caauuacuccaccaucaccucu

SEQ ID NO: 1593859 - RNA, 20 nt, Homo sapiens
caauuagacaaacagcauca

SEQ ID NO: 1593860 - RNA, 22 nt, Homo sapiens
caauuauacuaaaccucacaaa

SEQ ID NO: 1593861 - RNA, 13 nt, Homo sapiens
caauuaugucucu

SEQ ID NO: 1593862 - RNA, 22 nt, Homo sapiens
caauucguuggauuuuuguuua

SEQ ID NO: 1593863 - RNA, 13 nt, Homo sapiens
caauucuccugcc

SEQ ID NO: 1593864 - RNA, 14 nt, Homo sapiens
caauugaaaguggg

SEQ ID NO: 1593865 - RNA, 16 nt, Homo sapiens
caauugaaaugcauug

SEQ ID NO: 1593866 - RNA, 19 nt, Homo sapiens
caauugcuaccgagaaggu

SEQ ID NO: 1593867 - RNA, 16 nt, Homo sapiens
caauuuauuacugaaa

SEQ ID NO: 1593868 - RNA, 21 nt, Homo sapiens
caauuugguaaaaaugcugcu

SEQ ID NO: 1593869 - RNA, 22 nt, Homo sapiens
caauuugguaaaaaugcugcuc

SEQ ID NO: 1593870 - RNA, 13 nt, Homo sapiens
caauuuuccugug

SEQ ID NO: 1593871 - RNA, 14 nt, Homo sapiens
caauuuugcacuga

SEQ ID NO: 1593872 - RNA, 17 nt, Homo sapiens
caauuuuugacauuaau

SEQ ID NO: 1593873 - RNA, 13 nt, Homo sapiens
cacaaaaacagaa

SEQ ID NO: 1593874 - RNA, 19 nt, Homo sapiens
cacaaaagcagauacuuga

SEQ ID NO: 1593875 - RNA, 12 nt, Homo sapiens
cacaaacaauau

SEQ ID NO: 1593876 - RNA, 14 nt, Homo sapiens
cacaaacauucaaa

SEQ ID NO: 1593877 - RNA, 18 nt, Homo sapiens
cacaaaggcugacauuca

SEQ ID NO: 1593878 - RNA, 11 nt, Homo sapiens
cacaaagggaa

SEQ ID NO: 1593879 - RNA, 19 nt, Homo sapiens
cacaaaguagaggaaucca

SEQ ID NO: 1593880 - RNA, 18 nt, Homo sapiens
cacaaauauccaccacuu

SEQ ID NO: 1593881 - RNA, 18 nt, Homo sapiens
cacaaauuagcuaggcau

SEQ ID NO: 1593882 - RNA, 11 nt, Homo sapiens
cacaacaaucc

SEQ ID NO: 1593883 - RNA, 14 nt, Homo sapiens
cacaacagugaaaa

SEQ ID NO: 1593884 - RNA, 14 nt, Homo sapiens
cacaacccaaaagg

SEQ ID NO: 1593885 - RNA, 23 nt, Homo sapiens
cacaacccuucagauuugccuua

SEQ ID NO: 1593886 - RNA, 20 nt, Homo sapiens
cacaacgcaccagacacuca

SEQ ID NO: 1593887 - RNA, 14 nt, Homo sapiens
cacaacuaacaaug

SEQ ID NO: 1593888 - RNA, 12 nt, Homo sapiens
cacaacucccuu

SEQ ID NO: 1593889 - RNA, 18 nt, Homo sapiens
cauccuaagguucuugcu

SEQ ID NO: 1593890 - RNA, 16 nt, Homo sapiens
cauccuccauugcucc

SEQ ID NO: 1593891 - RNA, 17 nt, Homo sapiens
cauccucccauugccca

SEQ ID NO: 1593892 - RNA, 15 nt, Homo sapiens
cauccucucacugca

SEQ ID NO: 1593893 - RNA, 22 nt, Homo sapiens
cauccugaaaaggguguugcua

SEQ ID NO: 1593894 - RNA, 15 nt, Homo sapiens
cauccugguuuccac

SEQ ID NO: 1593895 - RNA, 20 nt, Homo sapiens
cauccugguuuccacugucu

SEQ ID NO: 1593896 - RNA, 18 nt, Homo sapiens
cauccuuuucaaaaccua

SEQ ID NO: 1593897 - RNA, 20 nt, Homo sapiens
cauccuuuucaaaaccuaaa

SEQ ID NO: 1593898 - RNA, 22 nt, Homo sapiens
caucgaaucuacuaauuccaca

SEQ ID NO: 1593899 - RNA, 22 nt, Homo sapiens
caucgcuuuauuggcugagaua

SEQ ID NO: 1593900 - RNA, 15 nt, Homo sapiens
caucguguauuccau

SEQ ID NO: 1593901 - RNA, 22 nt, Homo sapiens
caucuaaccucaucuucuucac

SEQ ID NO: 1593902 - RNA, 12 nt, Homo sapiens
caucuaauauga

SEQ ID NO: 1593903 - RNA, 22 nt, Homo sapiens
caucuacuuuuuuuuuaauuaa

SEQ ID NO: 1593904 - RNA, 22 nt, Homo sapiens
caucucagcccuuccccauggc

SEQ ID NO: 1593905 - RNA, 14 nt, Homo sapiens
caucucaguuaucu

SEQ ID NO: 1593906 - RNA, 17 nt, Homo sapiens
caucucaugugugcuca

SEQ ID NO: 1593907 - RNA, 21 nt, Homo sapiens
caucucccacgaacucaaggg

SEQ ID NO: 1593908 - RNA, 15 nt, Homo sapiens
caucucccugcaguu

SEQ ID NO: 1593909 - RNA, 14 nt, Homo sapiens
caucuccuccuugc

SEQ ID NO: 1593910 - RNA, 12 nt, Homo sapiens
caucucuacuaa

SEQ ID NO: 1593911 - RNA, 18 nt, Homo sapiens
caucucuccccauauaua

SEQ ID NO: 1593912 - RNA, 14 nt, Homo sapiens
caucucugucacac

SEQ ID NO: 1593913 - RNA, 17 nt, Homo sapiens
caucugaaagugguacu

SEQ ID NO: 1593914 - RNA, 15 nt, Homo sapiens
caucugcaaaauggg

SEQ ID NO: 1593915 - RNA, 19 nt, Homo sapiens
caucugccuuaaaaccaaa

SEQ ID NO: 1593916 - RNA, 22 nt, Homo sapiens
caucugcuuuucccauugccau

SEQ ID NO: 1593917 - RNA, 18 nt, Homo sapiens
caucuguaaaucuacaca

SEQ ID NO: 1593918 - RNA, 18 nt, Homo sapiens
caucuguaacagcauuaa

SEQ ID NO: 1593919 - RNA, 15 nt, Homo sapiens
caucuguguaaagug

SEQ ID NO: 1593920 - RNA, 18 nt, Homo sapiens
caucuguuaucaaacugc

SEQ ID NO: 1593921 - RNA, 12 nt, Homo sapiens
caucuuaaacua

SEQ ID NO: 1593922 - RNA, 23 nt, Homo sapiens
caucuucaauuuauuacugaaaa

SEQ ID NO: 1593923 - RNA, 17 nt, Homo sapiens
caucuucacugcaauuu

SEQ ID NO: 1593924 - RNA, 17 nt, Homo sapiens
caucuuguacaaacuuu

SEQ ID NO: 1593925 - RNA, 14 nt, Homo sapiens
caucuugugaaaug

SEQ ID NO: 1593926 - RNA, 21 nt, Homo sapiens
caucuuuaucaugaagcacau

SEQ ID NO: 1593927 - RNA, 14 nt, Homo sapiens
caucuuuggcugag

SEQ ID NO: 1593928 - RNA, 16 nt, Homo sapiens
caucuuuggcugagcu

SEQ ID NO: 1593929 - RNA, 16 nt, Homo sapiens
caucuuuucacaacuu

SEQ ID NO: 1593930 - RNA, 18 nt, Homo sapiens
caugaaaacacacauaca

SEQ ID NO: 1593931 - RNA, 19 nt, Homo sapiens
caugaaaaugaaccauuca

SEQ ID NO: 1593932 - RNA, 18 nt, Homo sapiens
caugaagauaaacuguuc

SEQ ID NO: 1593933 - RNA, 15 nt, Homo sapiens
caugaagcacugagc

SEQ ID NO: 1593934 - RNA, 21 nt, Homo sapiens
caugaagccuguggaugauca

SEQ ID NO: 1593935 - RNA, 21 nt, Homo sapiens
caugaauaacauuuaaauucc

SEQ ID NO: 1593936 - RNA, 16 nt, Homo sapiens
caugaauacacuuaca

SEQ ID NO: 1593937 - RNA, 14 nt, Homo sapiens
caugaaucucucaa

SEQ ID NO: 1593938 - RNA, 22 nt, Homo sapiens
caugaaucugcacaucuguaaa

SEQ ID NO: 1593939 - RNA, 22 nt, Homo sapiens
caugaauuucuccuuuccuaca

SEQ ID NO: 1593940 - RNA, 14 nt, Homo sapiens
caugacaagaacaa

SEQ ID NO: 1593941 - RNA, 12 nt, Homo sapiens
caugaccagaaa

SEQ ID NO: 1593942 - RNA, 15 nt, Homo sapiens
caugacguaguauua

SEQ ID NO: 1593943 - RNA, 16 nt, Homo sapiens
caugagaugagaugac

SEQ ID NO: 1593944 - RNA, 21 nt, Homo sapiens
caugagcuccuuaaggcucuu

SEQ ID NO: 1593945 - RNA, 15 nt, Homo sapiens
caugaggaccaggug

SEQ ID NO: 1593946 - RNA, 16 nt, Homo sapiens
caugaggccaucucag

SEQ ID NO: 1593947 - RNA, 18 nt, Homo sapiens
caugagggagaugccaug

SEQ ID NO: 1593948 - RNA, 23 nt, Homo sapiens
caugagggagaugccaugagccg

SEQ ID NO: 1593949 - RNA, 18 nt, Homo sapiens
caugaguuaucaugaauu

SEQ ID NO: 1593950 - RNA, 14 nt, Homo sapiens
caugaguucaaaua

SEQ ID NO: 1593951 - RNA, 20 nt, Homo sapiens
caugauauagcuuugccaug

SEQ ID NO: 1593952 - RNA, 16 nt, Homo sapiens
caugaucauagcucac

SEQ ID NO: 1593953 - RNA, 15 nt, Homo sapiens
caugaugcagucucc

SEQ ID NO: 1593954 - RNA, 20 nt, Homo sapiens
caugaugcuaaaggcugcga

SEQ ID NO: 1593955 - RNA, 17 nt, Homo sapiens
caugauguauuguugcu

SEQ ID NO: 1593956 - RNA, 15 nt, Homo sapiens
caugauuucuucuua

SEQ ID NO: 1593957 - RNA, 19 nt, Homo sapiens
caugcaaucccauuugcag

SEQ ID NO: 1593958 - RNA, 21 nt, Homo sapiens
caugcagcucuucaacaugac

SEQ ID NO: 1593959 - RNA, 15 nt, Homo sapiens
caugcauaaaucaau

SEQ ID NO: 1593960 - RNA, 14 nt, Homo sapiens
caugcauaccacaa

SEQ ID NO: 1593961 - RNA, 21 nt, Homo sapiens
caugcauuuuaccaucacaca

SEQ ID NO: 1593962 - RNA, 13 nt, Homo sapiens
caugccacaaaua

SEQ ID NO: 1593963 - RNA, 15 nt, Homo sapiens
caugcccauaauccc

SEQ ID NO: 1593964 - RNA, 14 nt, Homo sapiens
caugcccaugauga

SEQ ID NO: 1593965 - RNA, 18 nt, Homo sapiens
caugcucaguuggugcug

SEQ ID NO: 1593966 - RNA, 22 nt, Homo sapiens
caugcucugcaaaaggagagac

SEQ ID NO: 1593967 - RNA, 21 nt, Homo sapiens
caugcuuaauaaacaugucac

SEQ ID NO: 1593968 - RNA, 13 nt, Homo sapiens
cauggaaagggag

SEQ ID NO: 1593969 - RNA, 20 nt, Homo sapiens
cauggaaagggagacagcca

SEQ ID NO: 1593970 - RNA, 20 nt, Homo sapiens
cauggagaagccccgucucu

SEQ ID NO: 1593971 - RNA, 14 nt, Homo sapiens
cauggaggccaaga

SEQ ID NO: 1593972 - RNA, 15 nt, Homo sapiens
cauggaggccaagaa

SEQ ID NO: 1593973 - RNA, 16 nt, Homo sapiens
cauggaggccaagaac

SEQ ID NO: 1593974 - RNA, 23 nt, Homo sapiens
cauggaggccaagaacuugcaau

SEQ ID NO: 1593975 - RNA, 17 nt, Homo sapiens
cauggauaaauugcaca

SEQ ID NO: 1593976 - RNA, 18 nt, Homo sapiens
cauggaugauucuuuucc

SEQ ID NO: 1593977 - RNA, 16 nt, Homo sapiens
cauggcucucuauucc

SEQ ID NO: 1593978 - RNA, 16 nt, Homo sapiens
cauggggcugauugua

SEQ ID NO: 1593979 - RNA, 16 nt, Homo sapiens
cauggguucaccagcc

SEQ ID NO: 1593980 - RNA, 16 nt, Homo sapiens
cauggucuuaugcaca

SEQ ID NO: 1593981 - RNA, 18 nt, Homo sapiens
cauggugcagggagacau

SEQ ID NO: 1593982 - RNA, 14 nt, Homo sapiens
caugguggugugca

SEQ ID NO: 1593983 - RNA, 15 nt, Homo sapiens
caugguuccagugag

SEQ ID NO: 1593984 - RNA, 18 nt, Homo sapiens
caugguugaaaccccauc

SEQ ID NO: 1593985 - RNA, 17 nt, Homo sapiens
caugguuuaaagucaca

SEQ ID NO: 1593986 - RNA, 15 nt, Homo sapiens
cauguaacauucuuc

SEQ ID NO: 1593987 - RNA, 13 nt, Homo sapiens
cauguaagcucuu

SEQ ID NO: 1593988 - RNA, 17 nt, Homo sapiens
cauguaagcucuuugag

SEQ ID NO: 1593989 - RNA, 18 nt, Homo sapiens
cauguaugcaaaccucau

SEQ ID NO: 1593990 - RNA, 18 nt, Homo sapiens
cauguaugcaugcacaaa

SEQ ID NO: 1593991 - RNA, 20 nt, Homo sapiens
caugucccaaaccagacacc

SEQ ID NO: 1593992 - RNA, 19 nt, Homo sapiens
caugugaccgaacacugca

SEQ ID NO: 1593993 - RNA, 23 nt, Homo sapiens
caugugagauaguuuucauuuua

SEQ ID NO: 1593994 - RNA, 18 nt, Homo sapiens
caugugccuuaguguccu

SEQ ID NO: 1593995 - RNA, 18 nt, Homo sapiens
caugugccuuucuuugcc

SEQ ID NO: 1593996 - RNA, 15 nt, Homo sapiens
caugugcugccugca

SEQ ID NO: 1593997 - RNA, 18 nt, Homo sapiens
caugugcuggacacuguc

SEQ ID NO: 1593998 - RNA, 22 nt, Homo sapiens
cauguggcaucgcagucucuua

SEQ ID NO: 1593999 - RNA, 22 nt, Homo sapiens
cauguguaggagucugggcaca

SEQ ID NO: 1594000 - RNA, 12 nt, Homo sapiens
caugugugcuca

SEQ ID NO: 1594001 - RNA, 13 nt, Homo sapiens
cauguguguacau

SEQ ID NO: 1594002 - RNA, 14 nt, Homo sapiens
cauguuaguuaccu

SEQ ID NO: 1594003 - RNA, 22 nt, Homo sapiens
cauguuauguuucuacacauug

SEQ ID NO: 1594004 - RNA, 20 nt, Homo sapiens
caggcuggaagauagcugug

SEQ ID NO: 1594005 - RNA, 17 nt, Homo sapiens
caggcuggagugcagug

SEQ ID NO: 1594006 - RNA, 12 nt, Homo sapiens
caggcugggaac

SEQ ID NO: 1594007 - RNA, 17 nt, Homo sapiens
caggcugggccaugucc

SEQ ID NO: 1594008 - RNA, 18 nt, Homo sapiens
caggcugggccaugucca

SEQ ID NO: 1594009 - RNA, 18 nt, Homo sapiens
caggcuggucuugaacuc

SEQ ID NO: 1594010 - RNA, 14 nt, Homo sapiens
caggcuguucucag

SEQ ID NO: 1594011 - RNA, 15 nt, Homo sapiens
caggcuuacugagcu

SEQ ID NO: 1594012 - RNA, 23 nt, Homo sapiens
cagggaauggagcucagguccca

SEQ ID NO: 1594013 - RNA, 22 nt, Homo sapiens
cagggagaaguagcuaguagca

SEQ ID NO: 1594014 - RNA, 18 nt, Homo sapiens
cagggagcagagcuucca

SEQ ID NO: 1594015 - RNA, 12 nt, Homo sapiens
cagggagcauuu

SEQ ID NO: 1594016 - RNA, 21 nt, Homo sapiens
cagggaggggucccugcaaaa

SEQ ID NO: 1594017 - RNA, 12 nt, Homo sapiens
cagggaugagcc

SEQ ID NO: 1594018 - RNA, 20 nt, Homo sapiens
cagggauucuuccugcuuag

SEQ ID NO: 1594019 - RNA, 16 nt, Homo sapiens
cagggccaccauuguc

SEQ ID NO: 1594020 - RNA, 21 nt, Homo sapiens
cagggcugcuccccaacaccu

SEQ ID NO: 1594021 - RNA, 15 nt, Homo sapiens
caggggcagccacac

SEQ ID NO: 1594022 - RNA, 17 nt, Homo sapiens
caggggcuccagcaccu

SEQ ID NO: 1594023 - RNA, 20 nt, Homo sapiens
cagggggaggggaaccuguc

SEQ ID NO: 1594024 - RNA, 12 nt, Homo sapiens
cagggguugugg

SEQ ID NO: 1594025 - RNA, 15 nt, Homo sapiens
cagggucuugcucug

SEQ ID NO: 1594026 - RNA, 22 nt, Homo sapiens
caggguggggggugacagugcc

SEQ ID NO: 1594027 - RNA, 19 nt, Homo sapiens
cagggugggugagcucuca

SEQ ID NO: 1594028 - RNA, 15 nt, Homo sapiens
cagguaaaacagggc

SEQ ID NO: 1594029 - RNA, 19 nt, Homo sapiens
cagguauuuuuuuaaauca

SEQ ID NO: 1594030 - RNA, 16 nt, Homo sapiens
caggucaguuguaaua

SEQ ID NO: 1594031 - RNA, 17 nt, Homo sapiens
caggucaguuguaauaa

SEQ ID NO: 1594032 - RNA, 14 nt, Homo sapiens
cagguccuuccuuu

SEQ ID NO: 1594033 - RNA, 14 nt, Homo sapiens
caggucuacaguga

SEQ ID NO: 1594034 - RNA, 16 nt, Homo sapiens
caggucuacagugaua

SEQ ID NO: 1594035 - RNA, 20 nt, Homo sapiens
caggucuccaccugcacauu

SEQ ID NO: 1594036 - RNA, 20 nt, Homo sapiens
caggucuuuaaaucauuuua

SEQ ID NO: 1594037 - RNA, 16 nt, Homo sapiens
caggugauccacccac

SEQ ID NO: 1594038 - RNA, 22 nt, Homo sapiens
caggugcgcgccaccgugccug

SEQ ID NO: 1594039 - RNA, 15 nt, Homo sapiens
cagguggcaccugca

SEQ ID NO: 1594040 - RNA, 16 nt, Homo sapiens
cagguggcagagugaa

SEQ ID NO: 1594041 - RNA, 15 nt, Homo sapiens
cagguggcucagugc

SEQ ID NO: 1594042 - RNA, 22 nt, Homo sapiens
cagguguagcuaacaguugcca

SEQ ID NO: 1594043 - RNA, 20 nt, Homo sapiens
cagguguuacuguaauuccu

SEQ ID NO: 1594044 - RNA, 19 nt, Homo sapiens
cagguucucuuugagucaa

SEQ ID NO: 1594045 - RNA, 18 nt, Homo sapiens
caguaaaaauaaaauacu

SEQ ID NO: 1594046 - RNA, 16 nt, Homo sapiens
caguaaccucggagac

SEQ ID NO: 1594047 - RNA, 21 nt, Homo sapiens
caguaacggguagcagcagau

SEQ ID NO: 1594048 - RNA, 14 nt, Homo sapiens
caguaauggaauga

SEQ ID NO: 1594049 - RNA, 15 nt, Homo sapiens
caguaauggaaugaa

SEQ ID NO: 1594050 - RNA, 19 nt, Homo sapiens
caguacaggggugcugcag

SEQ ID NO: 1594051 - RNA, 15 nt, Homo sapiens
caguacuuccuccca

SEQ ID NO: 1594052 - RNA, 21 nt, Homo sapiens
caguacuugucauauguagcc

SEQ ID NO: 1594053 - RNA, 18 nt, Homo sapiens
caguagcaaacuuuucac

SEQ ID NO: 1594054 - RNA, 22 nt, Homo sapiens
caguauaagcaucugccaucug

SEQ ID NO: 1594055 - RNA, 20 nt, Homo sapiens
caguauccacaauagcugac

SEQ ID NO: 1594056 - RNA, 16 nt, Homo sapiens
caguauccacacauaa

SEQ ID NO: 1594057 - RNA, 21 nt, Homo sapiens
caguaucucuuacaucaguag

SEQ ID NO: 1594058 - RNA, 12 nt, Homo sapiens
caguaugucacu

SEQ ID NO: 1594059 - RNA, 13 nt, Homo sapiens
caguaugucacuc

SEQ ID NO: 1594060 - RNA, 18 nt, Homo sapiens
caguauuaacaucaaaga

SEQ ID NO: 1594061 - RNA, 14 nt, Homo sapiens
caguauuacagugu

SEQ ID NO: 1594062 - RNA, 18 nt, Homo sapiens
caguauuuuccagccuua

SEQ ID NO: 1594063 - RNA, 22 nt, Homo sapiens
caguauuuucccaauagcacuu

SEQ ID NO: 1594064 - RNA, 13 nt, Homo sapiens
cagucaaccuggg

SEQ ID NO: 1594065 - RNA, 18 nt, Homo sapiens
cagucaccucacaaaccu

SEQ ID NO: 1594066 - RNA, 16 nt, Homo sapiens
cagucacugacaguua

SEQ ID NO: 1594067 - RNA, 13 nt, Homo sapiens
cagucacuggaaa

SEQ ID NO: 1594068 - RNA, 15 nt, Homo sapiens
cagucauacaaguca

SEQ ID NO: 1594069 - RNA, 23 nt, Homo sapiens
cagucauagcaagcuuuugcuca

SEQ ID NO: 1594070 - RNA, 16 nt, Homo sapiens
caguccauuuccuaau

SEQ ID NO: 1594071 - RNA, 17 nt, Homo sapiens
cagucccagacaauucc

SEQ ID NO: 1594072 - RNA, 15 nt, Homo sapiens
cagucccaugaccuu

SEQ ID NO: 1594073 - RNA, 13 nt, Homo sapiens
cagucuagugcaa

SEQ ID NO: 1594074 - RNA, 16 nt, Homo sapiens
cagucuagugcaaaag

SEQ ID NO: 1594075 - RNA, 13 nt, Homo sapiens
cagucuauggguu

SEQ ID NO: 1594076 - RNA, 14 nt, Homo sapiens
cagucuauucacag

SEQ ID NO: 1594077 - RNA, 21 nt, Homo sapiens
cagucucugagcaccagggag

SEQ ID NO: 1594078 - RNA, 14 nt, Homo sapiens
cagucucuucugau

SEQ ID NO: 1594079 - RNA, 17 nt, Homo sapiens
cagucuuccauuugcaa

SEQ ID NO: 1594080 - RNA, 15 nt, Homo sapiens
cagugaaauaugaua

SEQ ID NO: 1594081 - RNA, 16 nt, Homo sapiens
cagugaagcagcacug

SEQ ID NO: 1594082 - RNA, 20 nt, Homo sapiens
cagugaagcagcacugugag

SEQ ID NO: 1594083 - RNA, 13 nt, Homo sapiens
cagugaaggcuaa

SEQ ID NO: 1594084 - RNA, 21 nt, Homo sapiens
cagugaaugauucaguguuaa

SEQ ID NO: 1594085 - RNA, 19 nt, Homo sapiens
cagugaauuuuugcaauaa

SEQ ID NO: 1594086 - RNA, 14 nt, Homo sapiens
cagugacaacaucg

SEQ ID NO: 1594087 - RNA, 19 nt, Homo sapiens
cagugacaacaucgcaaua

SEQ ID NO: 1594088 - RNA, 18 nt, Homo sapiens
cagugagacuguacauaa

SEQ ID NO: 1594089 - RNA, 17 nt, Homo sapiens
cagugagccgagaucau

SEQ ID NO: 1594090 - RNA, 21 nt, Homo sapiens
cagugagccgagaucaugcca

SEQ ID NO: 1594091 - RNA, 16 nt, Homo sapiens
cagugagcugagauca

SEQ ID NO: 1594092 - RNA, 13 nt, Homo sapiens
cagugauacucac

SEQ ID NO: 1594093 - RNA, 10 nt, Homo sapiens
cagugcaguc

SEQ ID NO: 1594094 - RNA, 19 nt, Homo sapiens
cagugcaguccauuuccua

SEQ ID NO: 1594095 - RNA, 22 nt, Homo sapiens
cagugcaguuucuuuucacauu

SEQ ID NO: 1594096 - RNA, 13 nt, Homo sapiens
cagugcccuaggc

SEQ ID NO: 1594097 - RNA, 18 nt, Homo sapiens
cagugcgugaagaccaac

SEQ ID NO: 1594098 - RNA, 23 nt, Homo sapiens
cagugcuaaaauucagaugcugu

SEQ ID NO: 1594099 - RNA, 12 nt, Homo sapiens
cagugcucccuc

SEQ ID NO: 1594100 - RNA, 14 nt, Homo sapiens
cagugcuggauuug

SEQ ID NO: 1594101 - RNA, 19 nt, Homo sapiens
cagugcuucaacgauguga

SEQ ID NO: 1594102 - RNA, 17 nt, Homo sapiens
caguggaauuggugauu

SEQ ID NO: 1594103 - RNA, 23 nt, Homo sapiens
caguggaucuucagaacugcccu

SEQ ID NO: 1594104 - RNA, 13 nt, Homo sapiens
caguggauguaua

SEQ ID NO: 1594105 - RNA, 20 nt, Homo sapiens
caguggcaugaucauagcuc

SEQ ID NO: 1594106 - RNA, 18 nt, Homo sapiens
caguggcccauggcauuu

SEQ ID NO: 1594107 - RNA, 23 nt, Homo sapiens
caguggccuacaaaucaguaauu

SEQ ID NO: 1594108 - RNA, 18 nt, Homo sapiens
caguggcuggaucuguga

SEQ ID NO: 1594109 - RNA, 21 nt, Homo sapiens
cagugggcguugggagccuag

SEQ ID NO: 1594110 - RNA, 18 nt, Homo sapiens
caguggucagcagguguc

SEQ ID NO: 1594111 - RNA, 16 nt, Homo sapiens
caguggugugaucucg

SEQ ID NO: 1594112 - RNA, 14 nt, Homo sapiens
caguguacccuccu

SEQ ID NO: 1594113 - RNA, 16 nt, Homo sapiens
caguguguacuucuuc

SEQ ID NO: 1594114 - RNA, 18 nt, Homo sapiens
caguguuuuuauugcucg

SEQ ID NO: 1594115 - RNA, 19 nt, Homo sapiens
caguuacuggggucaccca

SEQ ID NO: 1594116 - RNA, 16 nt, Homo sapiens
caguuauuaaucugga

SEQ ID NO: 1594117 - RNA, 14 nt, Homo sapiens
caguucagcuccuu

SEQ ID NO: 1594118 - RNA, 12 nt, Homo sapiens
caguucaucacc

SEQ ID NO: 1594119 - RNA, 16 nt, Homo sapiens
cagaauuauacaguaa

SEQ ID NO: 1594120 - RNA, 22 nt, Homo sapiens
cagaauucaaaagugauuaucu

SEQ ID NO: 1594121 - RNA, 18 nt, Homo sapiens
cagaauucggugugcugc

SEQ ID NO: 1594122 - RNA, 19 nt, Homo sapiens
cagacaaagcauaaucaau

SEQ ID NO: 1594123 - RNA, 21 nt, Homo sapiens
cagacaagcgccgcugugagg

SEQ ID NO: 1594124 - RNA, 22 nt, Homo sapiens
cagacaauaaacccucagagcc

SEQ ID NO: 1594125 - RNA, 13 nt, Homo sapiens
cagacaauuccau

SEQ ID NO: 1594126 - RNA, 16 nt, Homo sapiens
cagacacagguguaga

SEQ ID NO: 1594127 - RNA, 19 nt, Homo sapiens
cagacacuaaaugcagaca

SEQ ID NO: 1594128 - RNA, 13 nt, Homo sapiens
cagaccagcacuu

SEQ ID NO: 1594129 - RNA, 15 nt, Homo sapiens
cagaccagcacuuca

SEQ ID NO: 1594130 - RNA, 16 nt, Homo sapiens
cagaccccaugccuua

SEQ ID NO: 1594131 - RNA, 20 nt, Homo sapiens
cagacccccacucucauucc

SEQ ID NO: 1594132 - RNA, 20 nt, Homo sapiens
cagacgagacaacagcacac

SEQ ID NO: 1594133 - RNA, 16 nt, Homo sapiens
cagacgauuguucuua

SEQ ID NO: 1594134 - RNA, 19 nt, Homo sapiens
cagacucagacuccauuug

SEQ ID NO: 1594135 - RNA, 13 nt, Homo sapiens
cagacucucaggu

SEQ ID NO: 1594136 - RNA, 17 nt, Homo sapiens
cagacucugauucuaca

SEQ ID NO: 1594137 - RNA, 15 nt, Homo sapiens
cagacucuucauuca

SEQ ID NO: 1594138 - RNA, 20 nt, Homo sapiens
cagacugaacucgcagggaa

SEQ ID NO: 1594139 - RNA, 21 nt, Homo sapiens
cagacugccugucugcuugca

SEQ ID NO: 1594140 - RNA, 21 nt, Homo sapiens
cagacuugaaugcuaguuaua

SEQ ID NO: 1594141 - RNA, 13 nt, Homo sapiens
cagacuuggagua

SEQ ID NO: 1594142 - RNA, 19 nt, Homo sapiens
cagacuuuguguucauuuc

SEQ ID NO: 1594143 - RNA, 18 nt, Homo sapiens
cagagaaagaaagggaaa

SEQ ID NO: 1594144 - RNA, 18 nt, Homo sapiens
cagagaaaggacugugga

SEQ ID NO: 1594145 - RNA, 19 nt, Homo sapiens
cagagaacugccuuaaaaa

SEQ ID NO: 1594146 - RNA, 21 nt, Homo sapiens
cagagaaggaaaagacugaau

SEQ ID NO: 1594147 - RNA, 20 nt, Homo sapiens
cagagaagguaaggugugaa

SEQ ID NO: 1594148 - RNA, 23 nt, Homo sapiens
cagagaaguugcugcuugugauc

SEQ ID NO: 1594149 - RNA, 14 nt, Homo sapiens
cagagacacugagc

SEQ ID NO: 1594150 - RNA, 16 nt, Homo sapiens
cagagacaggaaaauc

SEQ ID NO: 1594151 - RNA, 14 nt, Homo sapiens
cagagacagugaaa

SEQ ID NO: 1594152 - RNA, 13 nt, Homo sapiens
cagagacugaaaa

SEQ ID NO: 1594153 - RNA, 16 nt, Homo sapiens
cagagacugucccuga

SEQ ID NO: 1594154 - RNA, 20 nt, Homo sapiens
cagagagagagaaggcagca

SEQ ID NO: 1594155 - RNA, 16 nt, Homo sapiens
cagagagagcucugca

SEQ ID NO: 1594156 - RNA, 21 nt, Homo sapiens
cagagagcugcccuucagcga

SEQ ID NO: 1594157 - RNA, 18 nt, Homo sapiens
cagagaggaggggaccaa

SEQ ID NO: 1594158 - RNA, 18 nt, Homo sapiens
cagagaucuauaaacaga

SEQ ID NO: 1594159 - RNA, 21 nt, Homo sapiens
cagagauggucacaugaccca

SEQ ID NO: 1594160 - RNA, 20 nt, Homo sapiens
cagagaugugcaugugggua

SEQ ID NO: 1594161 - RNA, 13 nt, Homo sapiens
cagagcaaacaga

SEQ ID NO: 1594162 - RNA, 20 nt, Homo sapiens
cagagcaagacccugucuca

SEQ ID NO: 1594163 - RNA, 16 nt, Homo sapiens
cagagcaaguccucac

SEQ ID NO: 1594164 - RNA, 18 nt, Homo sapiens
cagagcacuuuaaaaaca

SEQ ID NO: 1594165 - RNA, 15 nt, Homo sapiens
cagagcaggggcucc

SEQ ID NO: 1594166 - RNA, 22 nt, Homo sapiens
cagagcaggggcuccagcaccu

SEQ ID NO: 1594167 - RNA, 22 nt, Homo sapiens
cagagccagugugccaccaggc

SEQ ID NO: 1594168 - RNA, 15 nt, Homo sapiens
cagagcccaagggaa

SEQ ID NO: 1594169 - RNA, 19 nt, Homo sapiens
cagagcccaaggucaggga

SEQ ID NO: 1594170 - RNA, 20 nt, Homo sapiens
cagagccuucaagugccaaa

SEQ ID NO: 1594171 - RNA, 20 nt, Homo sapiens
cagagcgagacuccaucucu

SEQ ID NO: 1594172 - RNA, 20 nt, Homo sapiens
cagagcgccaggaagccaga

SEQ ID NO: 1594173 - RNA, 19 nt, Homo sapiens
cagagcucuuuaccaagga

SEQ ID NO: 1594174 - RNA, 13 nt, Homo sapiens
cagagcugggaaa

SEQ ID NO: 1594175 - RNA, 17 nt, Homo sapiens
cagagcugucugaacuc

SEQ ID NO: 1594176 - RNA, 14 nt, Homo sapiens
cagagcuuccacaa

SEQ ID NO: 1594177 - RNA, 13 nt, Homo sapiens
cagaggauguggc

SEQ ID NO: 1594178 - RNA, 14 nt, Homo sapiens
cagaggccaagagu

SEQ ID NO: 1594179 - RNA, 22 nt, Homo sapiens
cagaggccuauaacuuuuggua

SEQ ID NO: 1594180 - RNA, 23 nt, Homo sapiens
cagaggcuaauucagugucacau

SEQ ID NO: 1594181 - RNA, 15 nt, Homo sapiens
cagaggcuucuucag

SEQ ID NO: 1594182 - RNA, 20 nt, Homo sapiens
cagagggauaaaaacaauac

SEQ ID NO: 1594183 - RNA, 15 nt, Homo sapiens
cagagggcacucaga

SEQ ID NO: 1594184 - RNA, 13 nt, Homo sapiens
cagaggucacuuc

SEQ ID NO: 1594185 - RNA, 18 nt, Homo sapiens
cagagucucugauacaca

SEQ ID NO: 1594186 - RNA, 20 nt, Homo sapiens
cagagugagaccauguuuca

SEQ ID NO: 1594187 - RNA, 20 nt, Homo sapiens
cagagugagacuccaucuca

SEQ ID NO: 1594188 - RNA, 19 nt, Homo sapiens
cagagugauugguugcauc

SEQ ID NO: 1594189 - RNA, 16 nt, Homo sapiens
cagaguguucccugac

SEQ ID NO: 1594190 - RNA, 17 nt, Homo sapiens
cagauaacuucuuuagg

SEQ ID NO: 1594191 - RNA, 20 nt, Homo sapiens
cagauagcaucagaccugca

SEQ ID NO: 1594192 - RNA, 15 nt, Homo sapiens
cagauaggauggggu

SEQ ID NO: 1594193 - RNA, 22 nt, Homo sapiens
cagauauauacacacaguggau

SEQ ID NO: 1594194 - RNA, 14 nt, Homo sapiens
cagauaugcuuacu

SEQ ID NO: 1594195 - RNA, 17 nt, Homo sapiens
cagauccuuugucuaca

SEQ ID NO: 1594196 - RNA, 14 nt, Homo sapiens
cagaucgagucaca

SEQ ID NO: 1594197 - RNA, 19 nt, Homo sapiens
cagaucugucuccaagacc

SEQ ID NO: 1594198 - RNA, 16 nt, Homo sapiens
cagaucugugccccau

SEQ ID NO: 1594199 - RNA, 18 nt, Homo sapiens
cagaucuuccguggucag

SEQ ID NO: 1594200 - RNA, 12 nt, Homo sapiens
cagaugaucucu

SEQ ID NO: 1594201 - RNA, 23 nt, Homo sapiens
cagaugccaaccagacaccuccu

SEQ ID NO: 1594202 - RNA, 16 nt, Homo sapiens
cagauggccccuccac

SEQ ID NO: 1594203 - RNA, 15 nt, Homo sapiens
cagauggugcugcua

SEQ ID NO: 1594204 - RNA, 18 nt, Homo sapiens
cagauguaacagaacaaa

SEQ ID NO: 1594205 - RNA, 22 nt, Homo sapiens
cagaugucuucugccuguuaua

SEQ ID NO: 1594206 - RNA, 20 nt, Homo sapiens
cagaugugagccaccgugcc

SEQ ID NO: 1594207 - RNA, 22 nt, Homo sapiens
cagaugugagccaccgugccug

SEQ ID NO: 1594208 - RNA, 18 nt, Homo sapiens
cagauguuaugcuccugc

SEQ ID NO: 1594209 - RNA, 16 nt, Homo sapiens
cagauucaagagccag

SEQ ID NO: 1594210 - RNA, 19 nt, Homo sapiens
cagauuccuggcagagcca

SEQ ID NO: 1594211 - RNA, 18 nt, Homo sapiens
cagauuuaaagcaucauc

SEQ ID NO: 1594212 - RNA, 16 nt, Homo sapiens
cagauuuacuaaauca

SEQ ID NO: 1594213 - RNA, 23 nt, Homo sapiens
cagauuuguaugguuccaaagac

SEQ ID NO: 1594214 - RNA, 15 nt, Homo sapiens
cagauuuucagcaaa

SEQ ID NO: 1594215 - RNA, 19 nt, Homo sapiens
cagauuuuuuccucugcau

SEQ ID NO: 1594216 - RNA, 14 nt, Homo sapiens
cagcaaaagaccaa

SEQ ID NO: 1594217 - RNA, 13 nt, Homo sapiens
cagcaacaaugac

SEQ ID NO: 1594218 - RNA, 14 nt, Homo sapiens
cagcaacuguuuaa

SEQ ID NO: 1594219 - RNA, 19 nt, Homo sapiens
cagcacacgaguuccagac

SEQ ID NO: 1594220 - RNA, 21 nt, Homo sapiens
cagcaccaucucuuuaccucc

SEQ ID NO: 1594221 - RNA, 17 nt, Homo sapiens
cagcacccccaccaaac

SEQ ID NO: 1594222 - RNA, 21 nt, Homo sapiens
cagcaccgauggccauguaaa

SEQ ID NO: 1594223 - RNA, 20 nt, Homo sapiens
cagcaccuucuuucuggacu

SEQ ID NO: 1594224 - RNA, 13 nt, Homo sapiens
cagcacugacaau

SEQ ID NO: 1594225 - RNA, 22 nt, Homo sapiens
cagcacugggaaccuagcuaca

SEQ ID NO: 1594226 - RNA, 22 nt, Homo sapiens
cagcacuguuacaagaggccau

SEQ ID NO: 1594227 - RNA, 14 nt, Homo sapiens
cagcagaagcccca

SEQ ID NO: 1594228 - RNA, 18 nt, Homo sapiens
cagcagagaagcuguagg

SEQ ID NO: 1594229 - RNA, 14 nt, Homo sapiens
cagcagcagcacuu

SEQ ID NO: 1594230 - RNA, 17 nt, Homo sapiens
cagcagcugauuccaga

SEQ ID NO: 1594231 - RNA, 19 nt, Homo sapiens
cagcaggagagacugagca

SEQ ID NO: 1594232 - RNA, 15 nt, Homo sapiens
acuguaaaguucaau

SEQ ID NO: 1594233 - RNA, 18 nt, Homo sapiens
acuguaauuuucaugaua

SEQ ID NO: 1594234 - RNA, 17 nt, Homo sapiens
acuguacacacuuuauu

SEQ ID NO: 1594235 - RNA, 12 nt, Homo sapiens
acuguacagggg

SEQ ID NO: 1594236 - RNA, 17 nt, Homo sapiens
acuguaccgacuuugau

SEQ ID NO: 1594237 - RNA, 15 nt, Homo sapiens
acuguacuagucugu

SEQ ID NO: 1594238 - RNA, 19 nt, Homo sapiens
acuguagaaggccagcuga

SEQ ID NO: 1594239 - RNA, 23 nt, Homo sapiens
acuguaggaaaagaggccagcuc

SEQ ID NO: 1594240 - RNA, 18 nt, Homo sapiens
acuguauauaaacauauc

SEQ ID NO: 1594241 - RNA, 18 nt, Homo sapiens
acugucaagcugcugaaa

SEQ ID NO: 1594242 - RNA, 13 nt, Homo sapiens
acugucaguucuc

SEQ ID NO: 1594243 - RNA, 14 nt, Homo sapiens
acugucaguucucu

SEQ ID NO: 1594244 - RNA, 20 nt, Homo sapiens
acugucauuguguguggaau

SEQ ID NO: 1594245 - RNA, 20 nt, Homo sapiens
acuguccuauuauauucauu

SEQ ID NO: 1594246 - RNA, 21 nt, Homo sapiens
acugucuauuuaagugcaauu

SEQ ID NO: 1594247 - RNA, 16 nt, Homo sapiens
acugucucaacuacuc

SEQ ID NO: 1594248 - RNA, 16 nt, Homo sapiens
acugucuuccucaaaa

SEQ ID NO: 1594249 - RNA, 20 nt, Homo sapiens
acugucuucuucaugucauc

SEQ ID NO: 1594250 - RNA, 21 nt, Homo sapiens
acugugaaauaccacaagccu

SEQ ID NO: 1594251 - RNA, 22 nt, Homo sapiens
acugugaaccaacccccaucuc

SEQ ID NO: 1594252 - RNA, 21 nt, Homo sapiens
acugugauggggucaucaaau

SEQ ID NO: 1594253 - RNA, 12 nt, Homo sapiens
acugugauuaga

SEQ ID NO: 1594254 - RNA, 17 nt, Homo sapiens
acugugggaaggccagc

SEQ ID NO: 1594255 - RNA, 15 nt, Homo sapiens
acuguguaacuuucu

SEQ ID NO: 1594256 - RNA, 21 nt, Homo sapiens
acuguguaauuagugccacuu

SEQ ID NO: 1594257 - RNA, 18 nt, Homo sapiens
acuguguacauaacugaa

SEQ ID NO: 1594258 - RNA, 23 nt, Homo sapiens
acugugucauucuguuagauacu

SEQ ID NO: 1594259 - RNA, 16 nt, Homo sapiens
acuguuagcugggaag

SEQ ID NO: 1594260 - RNA, 14 nt, Homo sapiens
acuguucaaaccuc

SEQ ID NO: 1594261 - RNA, 22 nt, Homo sapiens
acuguucuugacaaucaucucc

SEQ ID NO: 1594262 - RNA, 19 nt, Homo sapiens
acuguuucaaagccaagac

SEQ ID NO: 1594263 - RNA, 21 nt, Homo sapiens
acuguuuuauaaacugcugua

SEQ ID NO: 1594264 - RNA, 18 nt, Homo sapiens
acuuaacuacuuaucucu

SEQ ID NO: 1594265 - RNA, 23 nt, Homo sapiens
acuuaagguuaccuuuguuccca

SEQ ID NO: 1594266 - RNA, 13 nt, Homo sapiens
acuuacauuccag

SEQ ID NO: 1594267 - RNA, 19 nt, Homo sapiens
acuuaccgagucagacuuu

SEQ ID NO: 1594268 - RNA, 19 nt, Homo sapiens
acuuacucuuuaaccagga

SEQ ID NO: 1594269 - RNA, 16 nt, Homo sapiens
acuuacuuaguguuau

SEQ ID NO: 1594270 - RNA, 14 nt, Homo sapiens
acuuagaaugccau

SEQ ID NO: 1594271 - RNA, 22 nt, Homo sapiens
acuuagcuuuugaugucuccaa

SEQ ID NO: 1594272 - RNA, 23 nt, Homo sapiens
acuuaggaaauggcuuugugauu

SEQ ID NO: 1594273 - RNA, 21 nt, Homo sapiens
acuuauaagaaagaucaaaga

SEQ ID NO: 1594274 - RNA, 21 nt, Homo sapiens
acuuauauuuaaaacuugccu

SEQ ID NO: 1594275 - RNA, 14 nt, Homo sapiens
acuuaucaacauuu

SEQ ID NO: 1594276 - RNA, 15 nt, Homo sapiens
acuuauuaacuaaga

SEQ ID NO: 1594277 - RNA, 18 nt, Homo sapiens
acuuauucauuccucaca

SEQ ID NO: 1594278 - RNA, 20 nt, Homo sapiens
acuuauuggauauucauucu

SEQ ID NO: 1594279 - RNA, 14 nt, Homo sapiens
acuuauuuauauaa

SEQ ID NO: 1594280 - RNA, 14 nt, Homo sapiens
acuucaaauucaaa

SEQ ID NO: 1594281 - RNA, 15 nt, Homo sapiens
acuucaaugugucau

SEQ ID NO: 1594282 - RNA, 23 nt, Homo sapiens
acuucagguggagagcacuagaa

SEQ ID NO: 1594283 - RNA, 15 nt, Homo sapiens
acuucagucuugccu

SEQ ID NO: 1594284 - RNA, 22 nt, Homo sapiens
acuucauggucccaaaauguca

SEQ ID NO: 1594285 - RNA, 12 nt, Homo sapiens
acuucauucucg

SEQ ID NO: 1594286 - RNA, 19 nt, Homo sapiens
acuuccaggggaaccugcc

SEQ ID NO: 1594287 - RNA, 21 nt, Homo sapiens
acuuccaucuagucacaaaga

SEQ ID NO: 1594288 - RNA, 22 nt, Homo sapiens
acuucccaaguguaagacucug

SEQ ID NO: 1594289 - RNA, 14 nt, Homo sapiens
acuucccacggcuc

SEQ ID NO: 1594290 - RNA, 23 nt, Homo sapiens
acuucgacagcaucaugcauuac

SEQ ID NO: 1594291 - RNA, 16 nt, Homo sapiens
acuucuaaaccaaaaa

SEQ ID NO: 1594292 - RNA, 17 nt, Homo sapiens
acuucuaagagcauaga

SEQ ID NO: 1594293 - RNA, 20 nt, Homo sapiens
acuucuaaguaaaaccacag

SEQ ID NO: 1594294 - RNA, 14 nt, Homo sapiens
acuucuacauccaa

SEQ ID NO: 1594295 - RNA, 18 nt, Homo sapiens
acuucuauuuuaaagaca

SEQ ID NO: 1594296 - RNA, 17 nt, Homo sapiens
acuucugcuuugcucuu

SEQ ID NO: 1594297 - RNA, 15 nt, Homo sapiens
acuucuggaagucau

SEQ ID NO: 1594298 - RNA, 22 nt, Homo sapiens
acuucugucuucacaacagauu

SEQ ID NO: 1594299 - RNA, 17 nt, Homo sapiens
acuucuuaaauauuuag

SEQ ID NO: 1594300 - RNA, 23 nt, Homo sapiens
acuucuuaaauauuuaguugaua

SEQ ID NO: 1594301 - RNA, 22 nt, Homo sapiens
acuucuuuaagcggacccgcua

SEQ ID NO: 1594302 - RNA, 19 nt, Homo sapiens
acuugaaaagaaaaccaca

SEQ ID NO: 1594303 - RNA, 13 nt, Homo sapiens
acuugaacaaaga

SEQ ID NO: 1594304 - RNA, 23 nt, Homo sapiens
acuugaacccgggggacagaggu

SEQ ID NO: 1594305 - RNA, 11 nt, Homo sapiens
acuugcaauac

SEQ ID NO: 1594306 - RNA, 12 nt, Homo sapiens
acuugcaauacc

SEQ ID NO: 1594307 - RNA, 15 nt, Homo sapiens
acuugcaauuugcaa

SEQ ID NO: 1594308 - RNA, 16 nt, Homo sapiens
acuugcaauuugcaag

SEQ ID NO: 1594309 - RNA, 21 nt, Homo sapiens
acuugccugugcuacaauuca

SEQ ID NO: 1594310 - RNA, 11 nt, Homo sapiens
acuugcuaaac

SEQ ID NO: 1594311 - RNA, 19 nt, Homo sapiens
acuugcucaaaaucuguga

SEQ ID NO: 1594312 - RNA, 19 nt, Homo sapiens
acuuggaguaaaacuguau

SEQ ID NO: 1594313 - RNA, 15 nt, Homo sapiens
acuuggcaucauuca

SEQ ID NO: 1594314 - RNA, 17 nt, Homo sapiens
acuugggcacaugcuca

SEQ ID NO: 1594315 - RNA, 17 nt, Homo sapiens
acuuggucagagccacu

SEQ ID NO: 1594316 - RNA, 21 nt, Homo sapiens
acuugugauagguaccugagu

SEQ ID NO: 1594317 - RNA, 18 nt, Homo sapiens
acuugugaugagagauaa

SEQ ID NO: 1594318 - RNA, 14 nt, Homo sapiens
acuuguggaaaaua

SEQ ID NO: 1594319 - RNA, 21 nt, Homo sapiens
acuuuaaaauaucuacauuaa

SEQ ID NO: 1594320 - RNA, 18 nt, Homo sapiens
acuuuacaggggagaaaa

SEQ ID NO: 1594321 - RNA, 15 nt, Homo sapiens
acuuuaccucucugu

SEQ ID NO: 1594322 - RNA, 17 nt, Homo sapiens
acuuuaccucuguggac

SEQ ID NO: 1594323 - RNA, 20 nt, Homo sapiens
acuuuagacuucccacuguu

SEQ ID NO: 1594324 - RNA, 14 nt, Homo sapiens
uuucaaagucucac

SEQ ID NO: 1594325 - RNA, 18 nt, Homo sapiens
uuucaaauuggagcuuca

SEQ ID NO: 1594326 - RNA, 19 nt, Homo sapiens
uuucaacugucuuccucaa

SEQ ID NO: 1594327 - RNA, 20 nt, Homo sapiens
uuucaagaaaauagcuauaa

SEQ ID NO: 1594328 - RNA, 15 nt, Homo sapiens
uuucaauagcacaua

SEQ ID NO: 1594329 - RNA, 19 nt, Homo sapiens
uuucaaucuucuacuuuua

SEQ ID NO: 1594330 - RNA, 21 nt, Homo sapiens
uuucacacguaagcacauucg

SEQ ID NO: 1594331 - RNA, 15 nt, Homo sapiens
uuucacagucacuga

SEQ ID NO: 1594332 - RNA, 16 nt, Homo sapiens
uuucacauucuuggcu

SEQ ID NO: 1594333 - RNA, 19 nt, Homo sapiens
uuucaccauguuggccagg

SEQ ID NO: 1594334 - RNA, 13 nt, Homo sapiens
uuucaccauuuga

SEQ ID NO: 1594335 - RNA, 12 nt, Homo sapiens
uuucacuacucu

SEQ ID NO: 1594336 - RNA, 13 nt, Homo sapiens
uuucacucugcau

SEQ ID NO: 1594337 - RNA, 17 nt, Homo sapiens
uuucagaagcaagccag

SEQ ID NO: 1594338 - RNA, 13 nt, Homo sapiens
uuucagacugcaa

SEQ ID NO: 1594339 - RNA, 20 nt, Homo sapiens
uuucagagaaaggacugugg

SEQ ID NO: 1594340 - RNA, 15 nt, Homo sapiens
uuucagagcauaaaa

SEQ ID NO: 1594341 - RNA, 21 nt, Homo sapiens
uuucagcauggaggguuuuaa

SEQ ID NO: 1594342 - RNA, 17 nt, Homo sapiens
uuucagucaaaacuuua

SEQ ID NO: 1594343 - RNA, 13 nt, Homo sapiens
uuucauagauuug

SEQ ID NO: 1594344 - RNA, 16 nt, Homo sapiens
uuucauagugaccugu

SEQ ID NO: 1594345 - RNA, 12 nt, Homo sapiens
uuucauauugau

SEQ ID NO: 1594346 - RNA, 21 nt, Homo sapiens
uuucaucacacuggguggugg

SEQ ID NO: 1594347 - RNA, 13 nt, Homo sapiens
uuucauccuccuu

SEQ ID NO: 1594348 - RNA, 19 nt, Homo sapiens
uuucauccugacucugccc

SEQ ID NO: 1594349 - RNA, 22 nt, Homo sapiens
uuucauccugguuuccacuguc

SEQ ID NO: 1594350 - RNA, 19 nt, Homo sapiens
uuucauggucugcugagua

SEQ ID NO: 1594351 - RNA, 18 nt, Homo sapiens
uuucauuaaagaauguuu

SEQ ID NO: 1594352 - RNA, 15 nt, Homo sapiens
uuucauucugccaaa

SEQ ID NO: 1594353 - RNA, 14 nt, Homo sapiens
uuucauucuuguug

SEQ ID NO: 1594354 - RNA, 17 nt, Homo sapiens
uuucauuguucacuucu

SEQ ID NO: 1594355 - RNA, 17 nt, Homo sapiens
uuucauuuuuuuccagg

SEQ ID NO: 1594356 - RNA, 21 nt, Homo sapiens
uuuccaaagcauuuuugauca

SEQ ID NO: 1594357 - RNA, 15 nt, Homo sapiens
uuuccaacuacuaau

SEQ ID NO: 1594358 - RNA, 17 nt, Homo sapiens
uuuccaauuuuguugca

SEQ ID NO: 1594359 - RNA, 16 nt, Homo sapiens
uuuccagaaaccaaac

SEQ ID NO: 1594360 - RNA, 20 nt, Homo sapiens
uuuccaguguucuauuugcu

SEQ ID NO: 1594361 - RNA, 23 nt, Homo sapiens
uuuccauuaaguacaugugccag

SEQ ID NO: 1594362 - RNA, 14 nt, Homo sapiens
uuucccauguauuu

SEQ ID NO: 1594363 - RNA, 19 nt, Homo sapiens
uuucccauuaaagagccag

SEQ ID NO: 1594364 - RNA, 12 nt, Homo sapiens
uuucccauuuca

SEQ ID NO: 1594365 - RNA, 18 nt, Homo sapiens
uuuccccaccccagcuca

SEQ ID NO: 1594366 - RNA, 21 nt, Homo sapiens
uuucccucucucauacccucc

SEQ ID NO: 1594367 - RNA, 16 nt, Homo sapiens
uuuccgagccuccagu

SEQ ID NO: 1594368 - RNA, 19 nt, Homo sapiens
uuuccgagccuccagucca

SEQ ID NO: 1594369 - RNA, 20 nt, Homo sapiens
uuuccgagccuccaguccaa

SEQ ID NO: 1594370 - RNA, 17 nt, Homo sapiens
uuuccucaaaacuggag

SEQ ID NO: 1594371 - RNA, 16 nt, Homo sapiens
uuuccucagugcauuu

SEQ ID NO: 1594372 - RNA, 16 nt, Homo sapiens
uuuccuuuaugugaau

SEQ ID NO: 1594373 - RNA, 19 nt, Homo sapiens
uuuccuuuuuccugugaca

SEQ ID NO: 1594374 - RNA, 14 nt, Homo sapiens
uuucuaaaccuugu

SEQ ID NO: 1594375 - RNA, 14 nt, Homo sapiens
uuucuaaaguaaaa

SEQ ID NO: 1594376 - RNA, 13 nt, Homo sapiens
uuucuaaccuuca

SEQ ID NO: 1594377 - RNA, 15 nt, Homo sapiens
uuucuaagcauaaaa

SEQ ID NO: 1594378 - RNA, 22 nt, Homo sapiens
uuucuacuuugaagucauacca

SEQ ID NO: 1594379 - RNA, 22 nt, Homo sapiens
uuucuagauacaauaaauugcu

SEQ ID NO: 1594380 - RNA, 18 nt, Homo sapiens
uuucucgggugcauuuga

SEQ ID NO: 1594381 - RNA, 18 nt, Homo sapiens
uuucucuaacuccugcca

SEQ ID NO: 1594382 - RNA, 20 nt, Homo sapiens
uuucucuaacuccugccauu

SEQ ID NO: 1594383 - RNA, 17 nt, Homo sapiens
uuucucuuuaaucuccu

SEQ ID NO: 1594384 - RNA, 17 nt, Homo sapiens
uuucugaagugcuugua

SEQ ID NO: 1594385 - RNA, 22 nt, Homo sapiens
uuucugcugauuaucacacauc

SEQ ID NO: 1594386 - RNA, 22 nt, Homo sapiens
uuucuggacuggcguucaccuc

SEQ ID NO: 1594387 - RNA, 19 nt, Homo sapiens
uuucuggccuuucauggca

SEQ ID NO: 1594388 - RNA, 20 nt, Homo sapiens
uuucuuagaauugaccaaau

SEQ ID NO: 1594389 - RNA, 22 nt, Homo sapiens
uuucuuagaauugaccaaauaa

SEQ ID NO: 1594390 - RNA, 19 nt, Homo sapiens
uuucuuaucccagugauca

SEQ ID NO: 1594391 - RNA, 16 nt, Homo sapiens
uuucuucaccaagugc

SEQ ID NO: 1594392 - RNA, 13 nt, Homo sapiens
uuucuuccuuuga

SEQ ID NO: 1594393 - RNA, 13 nt, Homo sapiens
uuucuucuugggc

SEQ ID NO: 1594394 - RNA, 20 nt, Homo sapiens
uuucuugaagaauaaauucu

SEQ ID NO: 1594395 - RNA, 16 nt, Homo sapiens
uuucuuguagcuaaaa

SEQ ID NO: 1594396 - RNA, 15 nt, Homo sapiens
uuucuuuagucuuua

SEQ ID NO: 1594397 - RNA, 12 nt, Homo sapiens
uuucuuugccuc

SEQ ID NO: 1594398 - RNA, 14 nt, Homo sapiens
uuugaaacuauuaa

SEQ ID NO: 1594399 - RNA, 15 nt, Homo sapiens
uuugaaagacugugc

SEQ ID NO: 1594400 - RNA, 13 nt, Homo sapiens
uuugaacugcagc

SEQ ID NO: 1594401 - RNA, 12 nt, Homo sapiens
uuugaacuucau

SEQ ID NO: 1594402 - RNA, 15 nt, Homo sapiens
uuugaauaaagaaua

SEQ ID NO: 1594403 - RNA, 20 nt, Homo sapiens
uuugggggaacuggacacaa

SEQ ID NO: 1594404 - RNA, 15 nt, Homo sapiens
uuugggguucaagaa

SEQ ID NO: 1594405 - RNA, 15 nt, Homo sapiens
uuugguacugugaug

SEQ ID NO: 1594406 - RNA, 16 nt, Homo sapiens
uuugguagaugacaaa

SEQ ID NO: 1594407 - RNA, 13 nt, Homo sapiens
uuugguccuugaa

SEQ ID NO: 1594408 - RNA, 18 nt, Homo sapiens
uuugguguuacacagccc

SEQ ID NO: 1594409 - RNA, 14 nt, Homo sapiens
uuuguaaugcugca

SEQ ID NO: 1594410 - RNA, 16 nt, Homo sapiens
uuuguaaugcugcaca

SEQ ID NO: 1594411 - RNA, 17 nt, Homo sapiens
uuuguacauagcaaaua

SEQ ID NO: 1594412 - RNA, 19 nt, Homo sapiens
uuuguaguguuauugccag

SEQ ID NO: 1594413 - RNA, 17 nt, Homo sapiens
uuuguauaaaaguguga

SEQ ID NO: 1594414 - RNA, 16 nt, Homo sapiens
uuuguauuauuacaaa

SEQ ID NO: 1594415 - RNA, 20 nt, Homo sapiens
uuuguauucucagacacuga

SEQ ID NO: 1594416 - RNA, 22 nt, Homo sapiens
uuuguauucucuuccucaucca

SEQ ID NO: 1594417 - RNA, 20 nt, Homo sapiens
uuuguauuugggccaguuga

SEQ ID NO: 1594418 - RNA, 14 nt, Homo sapiens
uuugucaacuucag

SEQ ID NO: 1594419 - RNA, 21 nt, Homo sapiens
uuuguccccagagacauucau

SEQ ID NO: 1594420 - RNA, 16 nt, Homo sapiens
uuugucuauucuccag

SEQ ID NO: 1594421 - RNA, 12 nt, Homo sapiens
uuugugaacugg

SEQ ID NO: 1594422 - RNA, 12 nt, Homo sapiens
uuugugcaagac

SEQ ID NO: 1594423 - RNA, 22 nt, Homo sapiens
uuuguggccuuggcugacauga

SEQ ID NO: 1594424 - RNA, 19 nt, Homo sapiens
uuuguguaucguaaccagc

SEQ ID NO: 1594425 - RNA, 21 nt, Homo sapiens
uuuguguaucguaaccagcca

SEQ ID NO: 1594426 - RNA, 16 nt, Homo sapiens
uuuguuacuuccuuau

SEQ ID NO: 1594427 - RNA, 15 nt, Homo sapiens
uuuguuagcaaagau

SEQ ID NO: 1594428 - RNA, 12 nt, Homo sapiens
uuuguuguaaaa

SEQ ID NO: 1594429 - RNA, 13 nt, Homo sapiens
uuuguuuguacug

SEQ ID NO: 1594430 - RNA, 18 nt, Homo sapiens
uuuguuuucagcacugau

SEQ ID NO: 1594431 - RNA, 17 nt, Homo sapiens
uuuuaaaacauucacac

SEQ ID NO: 1594432 - RNA, 18 nt, Homo sapiens
uuuuaaaauaagcauuua

SEQ ID NO: 1594433 - RNA, 19 nt, Homo sapiens
uuuuaaaguacugguguca

SEQ ID NO: 1594434 - RNA, 20 nt, Homo sapiens
uuuuaaauacaaaaggcauu

SEQ ID NO: 1594435 - RNA, 17 nt, Homo sapiens
uuuuaaauuuucuucag

SEQ ID NO: 1594436 - RNA, 20 nt, Homo sapiens
uuuuaaggcuaaaacuuaac

SEQ ID NO: 1594437 - RNA, 19 nt, Homo sapiens
uuuuaaguaucccaucuaa

SEQ ID NO: 1594438 - RNA, 15 nt, Homo sapiens
uuuuaagugauguca

SEQ ID NO: 1594439 - RNA, 22 nt, Homo sapiens
uuuuaaguuugaaacuaacuca

SEQ ID NO: 1594440 - RNA, 15 nt, Homo sapiens
uuuuaaugggcacaa

SEQ ID NO: 1594441 - RNA, 13 nt, Homo sapiens
uuuuaauguagaa

SEQ ID NO: 1594442 - RNA, 13 nt, Homo sapiens
uuuuaauuuucag

SEQ ID NO: 1594443 - RNA, 17 nt, Homo sapiens
uuuuacauuucauacaa

SEQ ID NO: 1594444 - RNA, 21 nt, Homo sapiens
uuuuaccaucacacauguuca

SEQ ID NO: 1594445 - RNA, 20 nt, Homo sapiens
uuuuacccuauacauccaca

SEQ ID NO: 1594446 - RNA, 18 nt, Homo sapiens
uuuuagcaguucugcaaa

SEQ ID NO: 1594447 - RNA, 12 nt, Homo sapiens
uuuuaggcaaag

SEQ ID NO: 1594448 - RNA, 19 nt, Homo sapiens
uuuuaguagagaugggguu

SEQ ID NO: 1594449 - RNA, 20 nt, Homo sapiens
uuuuaguguguaaaauuaau

SEQ ID NO: 1594450 - RNA, 21 nt, Homo sapiens
uuuuauaggccuguguguaua

SEQ ID NO: 1594451 - RNA, 22 nt, Homo sapiens
uuuuauauguuuauauucuuuc

SEQ ID NO: 1594452 - RNA, 19 nt, Homo sapiens
uuuuaucacuuaauuugaa

SEQ ID NO: 1594453 - RNA, 12 nt, Homo sapiens
uuuuaucucaca

SEQ ID NO: 1594454 - RNA, 11 nt, Homo sapiens
uuuuaugcugg

SEQ ID NO: 1594455 - RNA, 15 nt, Homo sapiens
uuuuauguucuuggc

SEQ ID NO: 1594456 - RNA, 18 nt, Homo sapiens
uuuucaagaugguguuau

SEQ ID NO: 1594457 - RNA, 21 nt, Homo sapiens
uuuucaauaaugugaaugcua

SEQ ID NO: 1594458 - RNA, 21 nt, Homo sapiens
uuuucaaucauaauaccugcu

SEQ ID NO: 1594459 - RNA, 22 nt, Homo sapiens
uuuucaaugugugugagguguu

SEQ ID NO: 1594460 - RNA, 16 nt, Homo sapiens
uuuucacauaugacaa

SEQ ID NO: 1594461 - RNA, 10 nt, Homo sapiens
uuuucacuga

SEQ ID NO: 1594462 - RNA, 13 nt, Homo sapiens
uuuucauacugua

SEQ ID NO: 1594463 - RNA, 21 nt, Homo sapiens
uuuucauccuauaagcuuaaa

SEQ ID NO: 1594464 - RNA, 15 nt, Homo sapiens
uuuucauuuguaaaa

SEQ ID NO: 1594465 - RNA, 22 nt, Homo sapiens
uuuuccacauaggaaaaugcca

SEQ ID NO: 1594466 - RNA, 15 nt, Homo sapiens
uuuuccagugacuug

SEQ ID NO: 1594467 - RNA, 22 nt, Homo sapiens
uuuuccuaugcuauugacaaua

SEQ ID NO: 1594468 - RNA, 23 nt, Homo sapiens
uuuucggccccauguaucucagu

SEQ ID NO: 1594469 - RNA, 15 nt, Homo sapiens
uuuucuauccaaaua

SEQ ID NO: 1594470 - RNA, 17 nt, Homo sapiens
uuuucucaaagucucau

SEQ ID NO: 1594471 - RNA, 21 nt, Homo sapiens
uuuucuccagaccccaugccu

SEQ ID NO: 1594472 - RNA, 16 nt, Homo sapiens
uuuucuggccuuucau

SEQ ID NO: 1594473 - RNA, 14 nt, Homo sapiens
uuuucugugccuga

SEQ ID NO: 1594474 - RNA, 16 nt, Homo sapiens
uuuucuucagcauuua

SEQ ID NO: 1594475 - RNA, 12 nt, Homo sapiens
uuuucuuuccaa

SEQ ID NO: 1594476 - RNA, 18 nt, Homo sapiens
uuuugaaaaagcgaaaaa

SEQ ID NO: 1594477 - RNA, 16 nt, Homo sapiens
uuuugaaaaugggcuc

SEQ ID NO: 1594478 - RNA, 14 nt, Homo sapiens
uuuugaaaugucaa

SEQ ID NO: 1594479 - RNA, 20 nt, Homo sapiens
uuuugaagauucuauguuaa

SEQ ID NO: 1594480 - RNA, 16 nt, Homo sapiens
uuuugacuucagauug

SEQ ID NO: 1594481 - RNA, 20 nt, Homo sapiens
uuuugagucauugacuucau

SEQ ID NO: 1594482 - RNA, 20 nt, Homo sapiens
uuuugauauaauuguacugu

SEQ ID NO: 1594483 - RNA, 18 nt, Homo sapiens
uuuugauggugucuguga

SEQ ID NO: 1594484 - RNA, 19 nt, Homo sapiens
uuaaaaauacauagcauua

SEQ ID NO: 1594485 - RNA, 14 nt, Homo sapiens
uuaaaaccaaagag

SEQ ID NO: 1594486 - RNA, 17 nt, Homo sapiens
uuaaaacucuggugaua

SEQ ID NO: 1594487 - RNA, 21 nt, Homo sapiens
uuaaaagaaaucuugcuucag

SEQ ID NO: 1594488 - RNA, 14 nt, Homo sapiens
uuaaaagagacaaa

SEQ ID NO: 1594489 - RNA, 14 nt, Homo sapiens
uuaaaagugcacau

SEQ ID NO: 1594490 - RNA, 22 nt, Homo sapiens
uuaaaauaacuaagcaaguaua

SEQ ID NO: 1594491 - RNA, 17 nt, Homo sapiens
uuaaaauaagcauuuag

SEQ ID NO: 1594492 - RNA, 14 nt, Homo sapiens
uuaaaauagcaaaa

SEQ ID NO: 1594493 - RNA, 14 nt, Homo sapiens
uuaaaauauauagu

SEQ ID NO: 1594494 - RNA, 17 nt, Homo sapiens
uuaaaauauaugaggcu

SEQ ID NO: 1594495 - RNA, 16 nt, Homo sapiens
uuaaaaucugugaaga

SEQ ID NO: 1594496 - RNA, 13 nt, Homo sapiens
uuaaaaugguuau

SEQ ID NO: 1594497 - RNA, 13 nt, Homo sapiens
uuaaaauucaauu

SEQ ID NO: 1594498 - RNA, 19 nt, Homo sapiens
uuaaacccauacaauguau

SEQ ID NO: 1594499 - RNA, 18 nt, Homo sapiens
uuaaaccuuaagauacua

SEQ ID NO: 1594500 - RNA, 15 nt, Homo sapiens
uuaaacuacugauug

SEQ ID NO: 1594501 - RNA, 19 nt, Homo sapiens
uuaaacucugcucaggaua

SEQ ID NO: 1594502 - RNA, 12 nt, Homo sapiens
uuaaacugauua

SEQ ID NO: 1594503 - RNA, 11 nt, Homo sapiens
uuaaacuguag

SEQ ID NO: 1594504 - RNA, 14 nt, Homo sapiens
uuaaacuuacuuag

SEQ ID NO: 1594505 - RNA, 22 nt, Homo sapiens
uuaaacuugaaauauauaauau

SEQ ID NO: 1594506 - RNA, 19 nt, Homo sapiens
uuaaacuugacccaggugg

SEQ ID NO: 1594507 - RNA, 12 nt, Homo sapiens
uuaaagaaagaa

SEQ ID NO: 1594508 - RNA, 16 nt, Homo sapiens
uugugguggugcuaaa

SEQ ID NO: 1594509 - RNA, 15 nt, Homo sapiens
uuguggugguugaga

SEQ ID NO: 1594510 - RNA, 20 nt, Homo sapiens
uugugguuuauugaauguga

SEQ ID NO: 1594511 - RNA, 18 nt, Homo sapiens
uuguguggaugaccacau

SEQ ID NO: 1594512 - RNA, 14 nt, Homo sapiens
uuguguuaccugua

SEQ ID NO: 1594513 - RNA, 15 nt, Homo sapiens
uuguguucaaucugu

SEQ ID NO: 1594514 - RNA, 18 nt, Homo sapiens
uuguguugugcagcauua

SEQ ID NO: 1594515 - RNA, 15 nt, Homo sapiens
uuguuaauucuuccu

SEQ ID NO: 1594516 - RNA, 20 nt, Homo sapiens
uuguuaggaaaugucaucaa

SEQ ID NO: 1594517 - RNA, 17 nt, Homo sapiens
uuguuaggagaugucau

SEQ ID NO: 1594518 - RNA, 20 nt, Homo sapiens
uuguuaggagaugucaucaa

SEQ ID NO: 1594519 - RNA, 15 nt, Homo sapiens
uuguuaucagucaau

SEQ ID NO: 1594520 - RNA, 16 nt, Homo sapiens
uuguuaucagucaaua

SEQ ID NO: 1594521 - RNA, 13 nt, Homo sapiens
uuguucagaauua

SEQ ID NO: 1594522 - RNA, 14 nt, Homo sapiens
uuguucuacugaga

SEQ ID NO: 1594523 - RNA, 20 nt, Homo sapiens
uuguugccuucaucuucacu

SEQ ID NO: 1594524 - RNA, 18 nt, Homo sapiens
uuguuuaacauugcugau

SEQ ID NO: 1594525 - RNA, 13 nt, Homo sapiens
uuguuuacauaag

SEQ ID NO: 1594526 - RNA, 14 nt, Homo sapiens
uuguuuaccagaga

SEQ ID NO: 1594527 - RNA, 16 nt, Homo sapiens
uuguuucugcauucau

SEQ ID NO: 1594528 - RNA, 18 nt, Homo sapiens
uuguuugaauuccuccuc

SEQ ID NO: 1594529 - RNA, 20 nt, Homo sapiens
uuguuugcaucugaaagaga

SEQ ID NO: 1594530 - RNA, 15 nt, Homo sapiens
uuguuugcuucuugc

SEQ ID NO: 1594531 - RNA, 16 nt, Homo sapiens
uuguuuguuacuguca

SEQ ID NO: 1594532 - RNA, 19 nt, Homo sapiens
uuguuuuacccuauacauc

SEQ ID NO: 1594533 - RNA, 18 nt, Homo sapiens
uuguuuucauuaucucaa

SEQ ID NO: 1594534 - RNA, 21 nt, Homo sapiens
uuuaaaaaaaaauacugaugu

SEQ ID NO: 1594535 - RNA, 23 nt, Homo sapiens
uuuaaaaaaaagaaucaccaaau

SEQ ID NO: 1594536 - RNA, 15 nt, Homo sapiens
uuuaaaaaacuaaaa

SEQ ID NO: 1594537 - RNA, 19 nt, Homo sapiens
uuuaaaaaagcauuauccu

SEQ ID NO: 1594538 - RNA, 13 nt, Homo sapiens
uuuaaaaaaugga

SEQ ID NO: 1594539 - RNA, 19 nt, Homo sapiens
uuuaaaaauacaacacuga

SEQ ID NO: 1594540 - RNA, 13 nt, Homo sapiens
uuuaaaacaucau

SEQ ID NO: 1594541 - RNA, 14 nt, Homo sapiens
uuuaaaacauucac

SEQ ID NO: 1594542 - RNA, 19 nt, Homo sapiens
uuuaaaagaaaaaugcugu

SEQ ID NO: 1594543 - RNA, 21 nt, Homo sapiens
uuuaaaagagacaaacuguaa

SEQ ID NO: 1594544 - RNA, 22 nt, Homo sapiens
uuuaaaagagacaaacuguaaa

SEQ ID NO: 1594545 - RNA, 20 nt, Homo sapiens
uuuaaaagcacgacagugga

SEQ ID NO: 1594546 - RNA, 18 nt, Homo sapiens
uuuaaaauacacacucaa

SEQ ID NO: 1594547 - RNA, 14 nt, Homo sapiens
uuuaaaauugugau

SEQ ID NO: 1594548 - RNA, 13 nt, Homo sapiens
uuuaaaauuucau

SEQ ID NO: 1594549 - RNA, 22 nt, Homo sapiens
uuuaaacacuuaucuucuggau

SEQ ID NO: 1594550 - RNA, 15 nt, Homo sapiens
uuuaaaccgcuaaaa

SEQ ID NO: 1594551 - RNA, 16 nt, Homo sapiens
uuuaaacuauaagcaa

SEQ ID NO: 1594552 - RNA, 17 nt, Homo sapiens
uuuaaauaaaagcacaa

SEQ ID NO: 1594553 - RNA, 17 nt, Homo sapiens
uuuaaauaaauccaaaa

SEQ ID NO: 1594554 - RNA, 22 nt, Homo sapiens
uuuaaaucaacgaguacuucaa

SEQ ID NO: 1594555 - RNA, 12 nt, Homo sapiens
uuuaaauggagg

SEQ ID NO: 1594556 - RNA, 15 nt, Homo sapiens
uuuaacaagcugucu

SEQ ID NO: 1594557 - RNA, 19 nt, Homo sapiens
uuuaaccccuugguacuga

SEQ ID NO: 1594558 - RNA, 22 nt, Homo sapiens
uuuaagaaaacaaguauauaau

SEQ ID NO: 1594559 - RNA, 15 nt, Homo sapiens
uuuaagaauugccag

SEQ ID NO: 1594560 - RNA, 12 nt, Homo sapiens
uuuaaggcuaaa

SEQ ID NO: 1594561 - RNA, 15 nt, Homo sapiens
uuuaagguacacugu

SEQ ID NO: 1594562 - RNA, 20 nt, Homo sapiens
uuuaaguaaaagucuaccug

SEQ ID NO: 1594563 - RNA, 14 nt, Homo sapiens
uuuaaguaguaaga

SEQ ID NO: 1594564 - RNA, 14 nt, Homo sapiens
uuuaaguccaccuc

SEQ ID NO: 1594565 - RNA, 21 nt, Homo sapiens
uuuaauaggugcagucuuuga

SEQ ID NO: 1594566 - RNA, 16 nt, Homo sapiens
uuuaaucaccaaggcu

SEQ ID NO: 1594567 - RNA, 13 nt, Homo sapiens
uuuaaucccagca

SEQ ID NO: 1594568 - RNA, 17 nt, Homo sapiens
uuuaaucccagcacuuu

SEQ ID NO: 1594569 - RNA, 15 nt, Homo sapiens
uuuaauccuaccuca

SEQ ID NO: 1594570 - RNA, 16 nt, Homo sapiens
uuuaauccuaccucaa

SEQ ID NO: 1594571 - RNA, 19 nt, Homo sapiens
uuuaaugccgauauacucu

SEQ ID NO: 1594572 - RNA, 22 nt, Homo sapiens
uuuaauuauaaucucuucuuau

SEQ ID NO: 1594573 - RNA, 23 nt, Homo sapiens
uuuaauuaugaaaacuagcauua

SEQ ID NO: 1594574 - RNA, 22 nt, Homo sapiens
uuuaauucaccccacacuagaa

SEQ ID NO: 1594575 - RNA, 18 nt, Homo sapiens
uuuaauuuugacacugaa

SEQ ID NO: 1594576 - RNA, 14 nt, Homo sapiens
uuuacaaaccauua

SEQ ID NO: 1594577 - RNA, 19 nt, Homo sapiens
uuuacagcacuacucugug

SEQ ID NO: 1594578 - RNA, 15 nt, Homo sapiens
uuuacauacacugua

SEQ ID NO: 1594579 - RNA, 14 nt, Homo sapiens
uuuacauacuuuau

SEQ ID NO: 1594580 - RNA, 18 nt, Homo sapiens
uuuacaugaguucaaaua

SEQ ID NO: 1594581 - RNA, 20 nt, Homo sapiens
uuuaccauagaaagaugaca

SEQ ID NO: 1594582 - RNA, 17 nt, Homo sapiens
uuuaccuucaaacuuua

SEQ ID NO: 1594583 - RNA, 18 nt, Homo sapiens
uuuaccuuugaacuuuca

SEQ ID NO: 1594584 - RNA, 21 nt, Homo sapiens
uuuacgcuuaguuaucagcuu

SEQ ID NO: 1594585 - RNA, 21 nt, Homo sapiens
uuuacguuuuaacacacagac

SEQ ID NO: 1594586 - RNA, 19 nt, Homo sapiens
uuuacuuaucuuaugccac

SEQ ID NO: 1594587 - RNA, 22 nt, Homo sapiens
uuuagaaaaagaacaugcaguu

SEQ ID NO: 1594588 - RNA, 18 nt, Homo sapiens
uuuagaaagaauauucau

SEQ ID NO: 1594589 - RNA, 13 nt, Homo sapiens
uuuagaaccagcc

SEQ ID NO: 1594590 - RNA, 13 nt, Homo sapiens
uguguucugucac

SEQ ID NO: 1594591 - RNA, 20 nt, Homo sapiens
uguguugaaggaacuugucu

SEQ ID NO: 1594592 - RNA, 22 nt, Homo sapiens
uguguuugauggaucaguguga

SEQ ID NO: 1594593 - RNA, 17 nt, Homo sapiens
uguguuuggaagacuau

SEQ ID NO: 1594594 - RNA, 18 nt, Homo sapiens
uguguuuuuaacauguca

SEQ ID NO: 1594595 - RNA, 20 nt, Homo sapiens
uguguuuuuaacaugucaau

SEQ ID NO: 1594596 - RNA, 13 nt, Homo sapiens
uguuaaaaaccuu

SEQ ID NO: 1594597 - RNA, 13 nt, Homo sapiens
uguuaaaucaaua

SEQ ID NO: 1594598 - RNA, 19 nt, Homo sapiens
uguuaacuguuaguauuaa

SEQ ID NO: 1594599 - RNA, 15 nt, Homo sapiens
uguuaauagacuuaa

SEQ ID NO: 1594600 - RNA, 14 nt, Homo sapiens
uguuaauauuugaa

SEQ ID NO: 1594601 - RNA, 23 nt, Homo sapiens
uguuaauggucaaugcuagcaca

SEQ ID NO: 1594602 - RNA, 15 nt, Homo sapiens
uguuaauguucauau

SEQ ID NO: 1594603 - RNA, 13 nt, Homo sapiens
uguuaauuuagag

SEQ ID NO: 1594604 - RNA, 13 nt, Homo sapiens
uguuaccuacuuu

SEQ ID NO: 1594605 - RNA, 13 nt, Homo sapiens
uguuaccuucaca

SEQ ID NO: 1594606 - RNA, 15 nt, Homo sapiens
uguuacugucauucc

SEQ ID NO: 1594607 - RNA, 19 nt, Homo sapiens
uguuacuuuggcaauuucc

SEQ ID NO: 1594608 - RNA, 21 nt, Homo sapiens
uguuauaacucugcacuacuc

SEQ ID NO: 1594609 - RNA, 20 nt, Homo sapiens
uguuaucaccuaagcacuuc

SEQ ID NO: 1594610 - RNA, 16 nt, Homo sapiens
uguuauccaacuauua

SEQ ID NO: 1594611 - RNA, 20 nt, Homo sapiens
uguuauuuccccagccacag

SEQ ID NO: 1594612 - RNA, 20 nt, Homo sapiens
uguucacagccagacuggca

SEQ ID NO: 1594613 - RNA, 17 nt, Homo sapiens
uguucaguucauuccca

SEQ ID NO: 1594614 - RNA, 15 nt, Homo sapiens
uguuccagacauucu

SEQ ID NO: 1594615 - RNA, 18 nt, Homo sapiens
uguuccauuggguccucu

SEQ ID NO: 1594616 - RNA, 23 nt, Homo sapiens
uguucccaaagugaacucucaaa

SEQ ID NO: 1594617 - RNA, 18 nt, Homo sapiens
uguuccccuuccacugag

SEQ ID NO: 1594618 - RNA, 21 nt, Homo sapiens
uguuccuggaggucagcauuu

SEQ ID NO: 1594619 - RNA, 19 nt, Homo sapiens
uguuccuucuccaauuuga

SEQ ID NO: 1594620 - RNA, 20 nt, Homo sapiens
uguuccuuuuugcagcaauu

SEQ ID NO: 1594621 - RNA, 22 nt, Homo sapiens
uguucuaaagguggugaggcaa

SEQ ID NO: 1594622 - RNA, 16 nt, Homo sapiens
uguucuauuugugcuu

SEQ ID NO: 1594623 - RNA, 16 nt, Homo sapiens
uguucucagcacauau

SEQ ID NO: 1594624 - RNA, 22 nt, Homo sapiens
uguucucauagaggaaauucaa

SEQ ID NO: 1594625 - RNA, 14 nt, Homo sapiens
uguucuuauggggu

SEQ ID NO: 1594626 - RNA, 23 nt, Homo sapiens
uguucuucauuaccucagugaga

SEQ ID NO: 1594627 - RNA, 12 nt, Homo sapiens
uguucuuuggaa

SEQ ID NO: 1594628 - RNA, 16 nt, Homo sapiens
uguugaagugagcuga

SEQ ID NO: 1594629 - RNA, 14 nt, Homo sapiens
uguugaauaaugcu

SEQ ID NO: 1594630 - RNA, 23 nt, Homo sapiens
uguugaccaucacugccaucaca

SEQ ID NO: 1594631 - RNA, 13 nt, Homo sapiens
uguugcaagcccc

SEQ ID NO: 1594632 - RNA, 13 nt, Homo sapiens
uguugcacccagc

SEQ ID NO: 1594633 - RNA, 20 nt, Homo sapiens
uguugcccaggcuggagugc

SEQ ID NO: 1594634 - RNA, 17 nt, Homo sapiens
uguugcgcucccaccuc

SEQ ID NO: 1594635 - RNA, 18 nt, Homo sapiens
uguugcuaagcuguaacc

SEQ ID NO: 1594636 - RNA, 13 nt, Homo sapiens
uguugcugcaucu

SEQ ID NO: 1594637 - RNA, 14 nt, Homo sapiens
uguugcugcaucuc

SEQ ID NO: 1594638 - RNA, 15 nt, Homo sapiens
uguugcugcuacugu

SEQ ID NO: 1594639 - RNA, 13 nt, Homo sapiens
uguugcuuugaaa

SEQ ID NO: 1594640 - RNA, 19 nt, Homo sapiens
uguuggaaauguaguauag

SEQ ID NO: 1594641 - RNA, 19 nt, Homo sapiens
uguuggagguuaaggcaua

SEQ ID NO: 1594642 - RNA, 17 nt, Homo sapiens
uguuggcuuuuugaaaa

SEQ ID NO: 1594643 - RNA, 20 nt, Homo sapiens
uguugggauuacagguguga

SEQ ID NO: 1594644 - RNA, 13 nt, Homo sapiens
uguuguacuuuau

SEQ ID NO: 1594645 - RNA, 13 nt, Homo sapiens
uguuguaugggga

SEQ ID NO: 1594646 - RNA, 15 nt, Homo sapiens
uguuguuauucagaa

SEQ ID NO: 1594647 - RNA, 21 nt, Homo sapiens
uguuguuccaggauguggaau

SEQ ID NO: 1594648 - RNA, 21 nt, Homo sapiens
uguuuaaaaucauuucugcau

SEQ ID NO: 1594649 - RNA, 18 nt, Homo sapiens
uguuuaaccuguuuucag

SEQ ID NO: 1594650 - RNA, 19 nt, Homo sapiens
uguuuaagcccagccaagu

SEQ ID NO: 1594651 - RNA, 15 nt, Homo sapiens
uguuuacagcacuac

SEQ ID NO: 1594652 - RNA, 17 nt, Homo sapiens
uguuuacagcacuacuc

SEQ ID NO: 1594653 - RNA, 15 nt, Homo sapiens
uguuuauagcaaaaa

SEQ ID NO: 1594654 - RNA, 17 nt, Homo sapiens
uguuuauaucacugucu

SEQ ID NO: 1594655 - RNA, 23 nt, Homo sapiens
uguuuauuccaaaugccauccag

SEQ ID NO: 1594656 - RNA, 16 nt, Homo sapiens
uguuucaaauggacug

SEQ ID NO: 1594657 - RNA, 23 nt, Homo sapiens
uguuucagaaaacauaauauagc

SEQ ID NO: 1594658 - RNA, 13 nt, Homo sapiens
uguuucaguguga

SEQ ID NO: 1594659 - RNA, 17 nt, Homo sapiens
uguuuccuaacugugau

SEQ ID NO: 1594660 - RNA, 23 nt, Homo sapiens
uguuucuacacauugcuaccuca

SEQ ID NO: 1594661 - RNA, 18 nt, Homo sapiens
uguuucugucaagcuggu

SEQ ID NO: 1594662 - RNA, 21 nt, Homo sapiens
uguuugaagaaaaaggacaaa

SEQ ID NO: 1594663 - RNA, 16 nt, Homo sapiens
uguuugcauguggcca

SEQ ID NO: 1594664 - RNA, 18 nt, Homo sapiens
uguuugcgcuugaccaug

SEQ ID NO: 1594665 - RNA, 22 nt, Homo sapiens
uguuugcugauuauuuaugacc

SEQ ID NO: 1594666 - RNA, 23 nt, Homo sapiens
uguuuggaaauaaacugugcaau

SEQ ID NO: 1594667 - RNA, 16 nt, Homo sapiens
uguuuggacagcugau

SEQ ID NO: 1594668 - RNA, 23 nt, Homo sapiens
uguuugugacaacuaaacaaggc

SEQ ID NO: 1594669 - RNA, 23 nt, Homo sapiens
uguuugugacccugagaaggcaa

SEQ ID NO: 1594670 - RNA, 17 nt, Homo sapiens
uguuuuaaauguacaga

SEQ ID NO: 1594671 - RNA, 12 nt, Homo sapiens
uguuuuagccau

SEQ ID NO: 1594672 - RNA, 14 nt, Homo sapiens
uguuuucauacaau

SEQ ID NO: 1594673 - RNA, 21 nt, Homo sapiens
uguuuuucucuauaaaggguc

SEQ ID NO: 1594674 - RNA, 20 nt, Homo sapiens
uguuuuucuuuuuccacaag

SEQ ID NO: 1594675 - RNA, 20 nt, Homo sapiens
uguuuuuguucaaagccagc

SEQ ID NO: 1594676 - RNA, 13 nt, Homo sapiens
uguuuuuuuucag

SEQ ID NO: 1594677 - RNA, 16 nt, Homo sapiens
uguuuuuuuucagcca

SEQ ID NO: 1594678 - RNA, 21 nt, Homo sapiens
uuaaaaaaaaaaaaaacauug

SEQ ID NO: 1594679 - RNA, 21 nt, Homo sapiens
uuaaaaaaaaaccugagcccc

SEQ ID NO: 1594680 - RNA, 20 nt, Homo sapiens
uuaaaaaaaaauacugaugu

SEQ ID NO: 1594681 - RNA, 13 nt, Homo sapiens
uuaaaaaacugca

SEQ ID NO: 1594682 - RNA, 14 nt, Homo sapiens
uuaaaaaauccugc

SEQ ID NO: 1594683 - RNA, 17 nt, Homo sapiens
uaauagucuuugccagu

SEQ ID NO: 1594684 - RNA, 16 nt, Homo sapiens
uaauauaaauguugcu

SEQ ID NO: 1594685 - RNA, 18 nt, Homo sapiens
uaauaucuaaaguuauau

SEQ ID NO: 1594686 - RNA, 16 nt, Homo sapiens
uaauaucuuucaguua

SEQ ID NO: 1594687 - RNA, 20 nt, Homo sapiens
uaauaugaguaauacaucaa

SEQ ID NO: 1594688 - RNA, 17 nt, Homo sapiens
uaauaugccuagcacaa

SEQ ID NO: 1594689 - RNA, 19 nt, Homo sapiens
uaauauuucaagugccuag

SEQ ID NO: 1594690 - RNA, 21 nt, Homo sapiens
uaauauuucuucaaauaucuc

SEQ ID NO: 1594691 - RNA, 17 nt, Homo sapiens
uaauauuuuccuaguag

SEQ ID NO: 1594692 - RNA, 19 nt, Homo sapiens
uaauauuuuccuaguagau

SEQ ID NO: 1594693 - RNA, 21 nt, Homo sapiens
uaaucaagaaaaacaucuuug

SEQ ID NO: 1594694 - RNA, 19 nt, Homo sapiens
uaaucaaggccagugcuaa

SEQ ID NO: 1594695 - RNA, 16 nt, Homo sapiens
uaaucaauauaaucug

SEQ ID NO: 1594696 - RNA, 14 nt, Homo sapiens
uaaucaguaugcaa

SEQ ID NO: 1594697 - RNA, 22 nt, Homo sapiens
uaaucaguaugcaaagcaaucu

SEQ ID NO: 1594698 - RNA, 15 nt, Homo sapiens
uaaucagucauuucu

SEQ ID NO: 1594699 - RNA, 17 nt, Homo sapiens
uaaucagucauuucuuc

SEQ ID NO: 1594700 - RNA, 18 nt, Homo sapiens
uaaucaucaaguaauaca

SEQ ID NO: 1594701 - RNA, 19 nt, Homo sapiens
uaaucaugaaagcaucuga

SEQ ID NO: 1594702 - RNA, 13 nt, Homo sapiens
uaaucaugcucau

SEQ ID NO: 1594703 - RNA, 13 nt, Homo sapiens
uaaucauuaucuc

SEQ ID NO: 1594704 - RNA, 23 nt, Homo sapiens
uaaucauuuguuuacauuugaug

SEQ ID NO: 1594705 - RNA, 18 nt, Homo sapiens
uaaucauuuuaaauucca

SEQ ID NO: 1594706 - RNA, 22 nt, Homo sapiens
uaauccacugugacuuugccca

SEQ ID NO: 1594707 - RNA, 14 nt, Homo sapiens
uaauccagcaaagu

SEQ ID NO: 1594708 - RNA, 19 nt, Homo sapiens
uaaucccaacacuuugaga

SEQ ID NO: 1594709 - RNA, 14 nt, Homo sapiens
uaaucccagcacuu

SEQ ID NO: 1594710 - RNA, 17 nt, Homo sapiens
uaaucccuggaugauau

SEQ ID NO: 1594711 - RNA, 14 nt, Homo sapiens
uaaucucagcacuu

SEQ ID NO: 1594712 - RNA, 18 nt, Homo sapiens
uaaucuucugccuucuca

SEQ ID NO: 1594713 - RNA, 18 nt, Homo sapiens
uaaucuuggauagcuaau

SEQ ID NO: 1594714 - RNA, 21 nt, Homo sapiens
uaaucuuucuaaaaauucaua

SEQ ID NO: 1594715 - RNA, 13 nt, Homo sapiens
uaaugaagaauca

SEQ ID NO: 1594716 - RNA, 13 nt, Homo sapiens
uaaugaaugacau

SEQ ID NO: 1594717 - RNA, 15 nt, Homo sapiens
uaaugagaauagaaa

SEQ ID NO: 1594718 - RNA, 15 nt, Homo sapiens
uaaugagacaugaau

SEQ ID NO: 1594719 - RNA, 15 nt, Homo sapiens
uaaugagagugcacu

SEQ ID NO: 1594720 - RNA, 12 nt, Homo sapiens
uaaugaugcugu

SEQ ID NO: 1594721 - RNA, 17 nt, Homo sapiens
uaaugaugcugucugaa

SEQ ID NO: 1594722 - RNA, 15 nt, Homo sapiens
uaaugcacucugggu

SEQ ID NO: 1594723 - RNA, 23 nt, Homo sapiens
uaaugcacucugggucuggccag

SEQ ID NO: 1594724 - RNA, 16 nt, Homo sapiens
uaaugccaccaaagga

SEQ ID NO: 1594725 - RNA, 19 nt, Homo sapiens
uaaugccauuaucccugaa

SEQ ID NO: 1594726 - RNA, 19 nt, Homo sapiens
uaaugcucaacaauuuauc

SEQ ID NO: 1594727 - RNA, 13 nt, Homo sapiens
uaauggaaaccaa

SEQ ID NO: 1594728 - RNA, 20 nt, Homo sapiens
uaauggcagcuagugccuuu

SEQ ID NO: 1594729 - RNA, 16 nt, Homo sapiens
uaauguaauuuagcua

SEQ ID NO: 1594730 - RNA, 22 nt, Homo sapiens
uaaugugcucuguaccugucaa

SEQ ID NO: 1594731 - RNA, 21 nt, Homo sapiens
uaauuaaagccuuaagcacaa

SEQ ID NO: 1594732 - RNA, 20 nt, Homo sapiens
uaauuaacuguaaacuugga

SEQ ID NO: 1594733 - RNA, 15 nt, Homo sapiens
uaauuaauugucauu

SEQ ID NO: 1594734 - RNA, 17 nt, Homo sapiens
uaauuauacuacuuugu

SEQ ID NO: 1594735 - RNA, 19 nt, Homo sapiens
uaauucugucauuccuaaa

SEQ ID NO: 1594736 - RNA, 12 nt, Homo sapiens
uaauucugugau

SEQ ID NO: 1594737 - RNA, 14 nt, Homo sapiens
uaauugcuuugcca

SEQ ID NO: 1594738 - RNA, 20 nt, Homo sapiens
uaauugcuuuuucacaguca

SEQ ID NO: 1594739 - RNA, 14 nt, Homo sapiens
uaauuguacugugu

SEQ ID NO: 1594740 - RNA, 23 nt, Homo sapiens
uaauugugaauaaaaauugauga

SEQ ID NO: 1594741 - RNA, 16 nt, Homo sapiens
uaauuuaaaagcacac

SEQ ID NO: 1594742 - RNA, 13 nt, Homo sapiens
uaauuuacauuaa

SEQ ID NO: 1594743 - RNA, 17 nt, Homo sapiens
uaauuucuuuaaaugug

SEQ ID NO: 1594744 - RNA, 13 nt, Homo sapiens
uuuugcaccagcg

SEQ ID NO: 1594745 - RNA, 18 nt, Homo sapiens
uuuugccuaccuggguca

SEQ ID NO: 1594746 - RNA, 15 nt, Homo sapiens
uuuuggaacuguccu

SEQ ID NO: 1594747 - RNA, 12 nt, Homo sapiens
uuuuggcuuuau

SEQ ID NO: 1594748 - RNA, 15 nt, Homo sapiens
uuuuggggggaacau

SEQ ID NO: 1594749 - RNA, 15 nt, Homo sapiens
uuuugguacugugau

SEQ ID NO: 1594750 - RNA, 22 nt, Homo sapiens
uuuuguaaauguucuugguguu

SEQ ID NO: 1594751 - RNA, 9 nt, Homo sapiens
uuuuguaca

SEQ ID NO: 1594752 - RNA, 15 nt, Homo sapiens
uuuuguaccaaauag

SEQ ID NO: 1594753 - RNA, 22 nt, Homo sapiens
uuuugugucaaaaggacauuua

SEQ ID NO: 1594754 - RNA, 14 nt, Homo sapiens
uuuuguugccuuca

SEQ ID NO: 1594755 - RNA, 16 nt, Homo sapiens
uuuuguuugcaucuga

SEQ ID NO: 1594756 - RNA, 15 nt, Homo sapiens
uuuuuaacugauucu

SEQ ID NO: 1594757 - RNA, 22 nt, Homo sapiens
uuuuuaagaaauuuugccuuua

SEQ ID NO: 1594758 - RNA, 18 nt, Homo sapiens
uuuuuacuauacagcaua

SEQ ID NO: 1594759 - RNA, 17 nt, Homo sapiens
uuuuuacuaucacacau

SEQ ID NO: 1594760 - RNA, 17 nt, Homo sapiens
uuuuuauacagugauaa

SEQ ID NO: 1594761 - RNA, 19 nt, Homo sapiens
uuuuuauaccagcuuaaua

SEQ ID NO: 1594762 - RNA, 20 nt, Homo sapiens
uuuuuauaucaugcaaaaua

SEQ ID NO: 1594763 - RNA, 17 nt, Homo sapiens
uuuuucacuucuaccua

SEQ ID NO: 1594764 - RNA, 18 nt, Homo sapiens
uuuuuccucccagugaga

SEQ ID NO: 1594765 - RNA, 21 nt, Homo sapiens
uuuuucuaaaacauuccccuc

SEQ ID NO: 1594766 - RNA, 17 nt, Homo sapiens
uuuuucuccagacccca

SEQ ID NO: 1594767 - RNA, 22 nt, Homo sapiens
uuuuucuggccucgcuguucuc

SEQ ID NO: 1594768 - RNA, 18 nt, Homo sapiens
uuuuucuucuuguuucuc

SEQ ID NO: 1594769 - RNA, 18 nt, Homo sapiens
uuuuugaaaaaagcucau

SEQ ID NO: 1594770 - RNA, 20 nt, Homo sapiens
uuuuugaguacuguacuauc

SEQ ID NO: 1594771 - RNA, 11 nt, Homo sapiens
uuuuugcugaa

SEQ ID NO: 1594772 - RNA, 13 nt, Homo sapiens
uuuuuguuauuaa

SEQ ID NO: 1594773 - RNA, 12 nt, Homo sapiens
uuuuuuacuuga

SEQ ID NO: 1594774 - RNA, 17 nt, Homo sapiens
uuuuuucugccuaauag

SEQ ID NO: 1594775 - RNA, 15 nt, Homo sapiens
aaagaaaaguuucac

SEQ ID NO: 1594776 - RNA, 18 nt, Homo sapiens
aaagaaauuguauuauca

SEQ ID NO: 1594777 - RNA, 19 nt, Homo sapiens
aaagaacaugcaguuugaa

SEQ ID NO: 1594778 - RNA, 18 nt, Homo sapiens
aaagaacguggucagagu

SEQ ID NO: 1594779 - RNA, 22 nt, Homo sapiens
aaagaacguggucagaguagaa

SEQ ID NO: 1594780 - RNA, 15 nt, Homo sapiens
aaagaacucauuuga

SEQ ID NO: 1594781 - RNA, 13 nt, Homo sapiens
aaagaagccacag

SEQ ID NO: 1594782 - RNA, 23 nt, Homo sapiens
aaagaaggcauuugcaggguccu

SEQ ID NO: 1594783 - RNA, 12 nt, Homo sapiens
aaagaaguacuu

SEQ ID NO: 1594784 - RNA, 21 nt, Homo sapiens
aaagaagucuuggaaacagac

SEQ ID NO: 1594785 - RNA, 21 nt, Homo sapiens
aaagaauauucauaguuuaau

SEQ ID NO: 1594786 - RNA, 17 nt, Homo sapiens
aaagaauguuacugccu

SEQ ID NO: 1594787 - RNA, 16 nt, Homo sapiens
aaagaauuccaaagca

SEQ ID NO: 1594788 - RNA, 18 nt, Homo sapiens
aaagaauuccaaagcaaa

SEQ ID NO: 1594789 - RNA, 12 nt, Homo sapiens
aaagacacaucu

SEQ ID NO: 1594790 - RNA, 13 nt, Homo sapiens
aaagacagucaaa

SEQ ID NO: 1594791 - RNA, 12 nt, Homo sapiens
aaagacaucaaa

SEQ ID NO: 1594792 - RNA, 13 nt, Homo sapiens
aaagacaucaaac

SEQ ID NO: 1594793 - RNA, 17 nt, Homo sapiens
aaagacaucagucucca

SEQ ID NO: 1594794 - RNA, 22 nt, Homo sapiens
aaagacauuuguucucccaaaa

SEQ ID NO: 1594795 - RNA, 14 nt, Homo sapiens
aaagaccaggccaa

SEQ ID NO: 1594796 - RNA, 14 nt, Homo sapiens
aaagacuaacuuga

SEQ ID NO: 1594797 - RNA, 14 nt, Homo sapiens
aaagagcuguuaua

SEQ ID NO: 1594798 - RNA, 18 nt, Homo sapiens
aaagagcuuugugauaua

SEQ ID NO: 1594799 - RNA, 22 nt, Homo sapiens
aaagaggaugcuuagucuuaaa

SEQ ID NO: 1594800 - RNA, 14 nt, Homo sapiens
aaagaguacacuca

SEQ ID NO: 1594801 - RNA, 12 nt, Homo sapiens
aaagaguugaag

SEQ ID NO: 1594802 - RNA, 18 nt, Homo sapiens
aaagauaauuuauuucaa

SEQ ID NO: 1594803 - RNA, 13 nt, Homo sapiens
aaagauacuagag

SEQ ID NO: 1594804 - RNA, 17 nt, Homo sapiens
aaagauauaaggggaaa

SEQ ID NO: 1594805 - RNA, 16 nt, Homo sapiens
aaagaucaccagccau

SEQ ID NO: 1594806 - RNA, 13 nt, Homo sapiens
aaagaugacaaaa

SEQ ID NO: 1594807 - RNA, 15 nt, Homo sapiens
aaagaugacaaaaga

SEQ ID NO: 1594808 - RNA, 18 nt, Homo sapiens
aaagauggcuuaugucau

SEQ ID NO: 1594809 - RNA, 18 nt, Homo sapiens
aaagauuugugaacugga

SEQ ID NO: 1594810 - RNA, 20 nt, Homo sapiens
aaagauuugugguaacugaa

SEQ ID NO: 1594811 - RNA, 18 nt, Homo sapiens
aaagcagaaaaucuacca

SEQ ID NO: 1594812 - RNA, 16 nt, Homo sapiens
aaagcagauaccucac

SEQ ID NO: 1594813 - RNA, 18 nt, Homo sapiens
aaagcaguguuugcucca

SEQ ID NO: 1594814 - RNA, 22 nt, Homo sapiens
aaagcaguuacuaauaugccua

SEQ ID NO: 1594815 - RNA, 20 nt, Homo sapiens
aaagcaucaauacaaccagc

SEQ ID NO: 1594816 - RNA, 12 nt, Homo sapiens
aaagcauuucag

SEQ ID NO: 1594817 - RNA, 17 nt, Homo sapiens
aaagccaccuuguuaca

SEQ ID NO: 1594818 - RNA, 14 nt, Homo sapiens
aaagccuguuccau

SEQ ID NO: 1594819 - RNA, 13 nt, Homo sapiens
aaagccuuaggga

SEQ ID NO: 1594820 - RNA, 16 nt, Homo sapiens
aaagcuaauuaaucau

SEQ ID NO: 1594821 - RNA, 18 nt, Homo sapiens
aaagcuaucuucauguaa

SEQ ID NO: 1594822 - RNA, 14 nt, Homo sapiens
aaagcuauuucaga

SEQ ID NO: 1594823 - RNA, 17 nt, Homo sapiens
aaagcuccaucaaugag

SEQ ID NO: 1594824 - RNA, 20 nt, Homo sapiens
aaagcugccccuugggagac

SEQ ID NO: 1594825 - RNA, 21 nt, Homo sapiens
aaagcuggugucugauuuugg

SEQ ID NO: 1594826 - RNA, 16 nt, Homo sapiens
aaagcuucacaguacc

SEQ ID NO: 1594827 - RNA, 14 nt, Homo sapiens
aaagcuucagggaa

SEQ ID NO: 1594828 - RNA, 22 nt, Homo sapiens
aaagcuuuauuaccaguggcgu

SEQ ID NO: 1594829 - RNA, 19 nt, Homo sapiens
aaagcuuuuauugucacag

SEQ ID NO: 1594830 - RNA, 16 nt, Homo sapiens
aaaggaaaaggucuga

SEQ ID NO: 1594831 - RNA, 21 nt, Homo sapiens
aaaggaacucuagaagaccaa

SEQ ID NO: 1594832 - RNA, 18 nt, Homo sapiens
aaaggaagaacuggauaa

SEQ ID NO: 1594833 - RNA, 20 nt, Homo sapiens
aaaggaauaaaaaauacugu

SEQ ID NO: 1594834 - RNA, 17 nt, Homo sapiens
aaaggaauacauugcaa

SEQ ID NO: 1594835 - RNA, 23 nt, Homo sapiens
aaaggaauuugcauccagcagca

SEQ ID NO: 1594836 - RNA, 22 nt, Homo sapiens
aaaggacaucagcaaacaggau

SEQ ID NO: 1594837 - RNA, 18 nt, Homo sapiens
aaaggauuuuaccaaagc

SEQ ID NO: 1594838 - RNA, 13 nt, Homo sapiens
aaaggcagcugcc

SEQ ID NO: 1594839 - RNA, 23 nt, Homo sapiens
aaaggcagcugccucugcucccu

SEQ ID NO: 1594840 - RNA, 15 nt, Homo sapiens
aaaggccucuuguaa

SEQ ID NO: 1594841 - RNA, 15 nt, Homo sapiens
aaagggaaacuggcu

SEQ ID NO: 1594842 - RNA, 13 nt, Homo sapiens
aaagggaaguagu

SEQ ID NO: 1594843 - RNA, 19 nt, Homo sapiens
aaagggaaguaguccuugg

SEQ ID NO: 1594844 - RNA, 10 nt, Homo sapiens
aaagggaugg

SEQ ID NO: 1594845 - RNA, 14 nt, Homo sapiens
aaagggcacucuga

SEQ ID NO: 1594846 - RNA, 13 nt, Homo sapiens
aaagguaugcauu

SEQ ID NO: 1594847 - RNA, 22 nt, Homo sapiens
aaaggugaauguugagggcccu

SEQ ID NO: 1594848 - RNA, 14 nt, Homo sapiens
aaagguugccugaa

SEQ ID NO: 1594849 - RNA, 18 nt, Homo sapiens
aaagguuuaugaaaaaga

SEQ ID NO: 1594850 - RNA, 17 nt, Homo sapiens
aaaguaaaaauuuugac

SEQ ID NO: 1594851 - RNA, 16 nt, Homo sapiens
aaaguaagcauuucca

SEQ ID NO: 1594852 - RNA, 14 nt, Homo sapiens
aaaguacaaccaua

SEQ ID NO: 1594853 - RNA, 17 nt, Homo sapiens
aaaguagaaaaagauuc

SEQ ID NO: 1594854 - RNA, 20 nt, Homo sapiens
aaaguagaggaauccaugua

SEQ ID NO: 1594855 - RNA, 16 nt, Homo sapiens
aaagucaaaaggugcc

SEQ ID NO: 1594856 - RNA, 12 nt, Homo sapiens
aaagucaugcaa

SEQ ID NO: 1594857 - RNA, 17 nt, Homo sapiens
aaagucccaacccaaug

SEQ ID NO: 1594858 - RNA, 19 nt, Homo sapiens
aaagucugucuuuccugaa

SEQ ID NO: 1594859 - RNA, 14 nt, Homo sapiens
aaagugaaaucaga

SEQ ID NO: 1594860 - RNA, 13 nt, Homo sapiens
aaagugaugacau

SEQ ID NO: 1594861 - RNA, 23 nt, Homo sapiens
aaagugcccgcagagcccaccuu

SEQ ID NO: 1594862 - RNA, 23 nt, Homo sapiens
aaagugcuucauucuuugcagga

SEQ ID NO: 1594863 - RNA, 15 nt, Homo sapiens
aaaguggcaaucuca

SEQ ID NO: 1594864 - RNA, 17 nt, Homo sapiens
aaaguggggguggagga

SEQ ID NO: 1594865 - RNA, 16 nt, Homo sapiens
aaagugguaauccucu

SEQ ID NO: 1594866 - RNA, 16 nt, Homo sapiens
aaaguguuuguuggca

SEQ ID NO: 1594867 - RNA, 21 nt, Homo sapiens
aaaguugcuuuuauugcacca

SEQ ID NO: 1594868 - RNA, 17 nt, Homo sapiens
aaaguuuuuaauuugau

SEQ ID NO: 1594869 - RNA, 23 nt, Homo sapiens
aaauaaaaaucauucuacugaac

SEQ ID NO: 1594870 - RNA, 14 nt, Homo sapiens
aaauaaaaauuaaa

SEQ ID NO: 1594871 - RNA, 21 nt, Homo sapiens
aaauaaaacagcagcagcaaa

SEQ ID NO: 1594872 - RNA, 17 nt, Homo sapiens
aaauaaaacaucaccua

SEQ ID NO: 1594873 - RNA, 14 nt, Homo sapiens
aaauaaaagaaaca

SEQ ID NO: 1594874 - RNA, 13 nt, Homo sapiens
aaauaaaauguuc

SEQ ID NO: 1594875 - RNA, 15 nt, Homo sapiens
aaauaaacacugugu

SEQ ID NO: 1594876 - RNA, 12 nt, Homo sapiens
aaauaaagacaa

SEQ ID NO: 1594877 - RNA, 17 nt, Homo sapiens
aaauaagggaauccuga

SEQ ID NO: 1594878 - RNA, 19 nt, Homo sapiens
aaauaauaaacaguggaau

SEQ ID NO: 1594879 - RNA, 17 nt, Homo sapiens
aaauacaagaaccaagg

SEQ ID NO: 1594880 - RNA, 19 nt, Homo sapiens
aaauacacacucaaaucaa

SEQ ID NO: 1594881 - RNA, 22 nt, Homo sapiens
aaauacagucuuccacaaagaa

SEQ ID NO: 1594882 - RNA, 13 nt, Homo sapiens
aaauacaugcaca

SEQ ID NO: 1594883 - RNA, 17 nt, Homo sapiens
aaauacaugcacaguca

SEQ ID NO: 1594884 - RNA, 15 nt, Homo sapiens
aaauaccuuuucuca

SEQ ID NO: 1594885 - RNA, 14 nt, Homo sapiens
aaauacuacaauag

SEQ ID NO: 1594886 - RNA, 12 nt, Homo sapiens
aaauacugucaa

SEQ ID NO: 1594887 - RNA, 20 nt, Homo sapiens
aaauacuuagagcagugaag

SEQ ID NO: 1594888 - RNA, 14 nt, Homo sapiens
aaauagaugacaaa

SEQ ID NO: 1594889 - RNA, 17 nt, Homo sapiens
aaauagcaaaagaagaa

SEQ ID NO: 1594890 - RNA, 12 nt, Homo sapiens
aaauagccacaa

SEQ ID NO: 1594891 - RNA, 16 nt, Homo sapiens
aaauagucuuccacaa

SEQ ID NO: 1594892 - RNA, 21 nt, Homo sapiens
aaauaguguaagaacuguaca

SEQ ID NO: 1594893 - RNA, 22 nt, Homo sapiens
aaauaguguaagaacuguacau

SEQ ID NO: 1594894 - RNA, 16 nt, Homo sapiens
aacuuuccaaacacca

SEQ ID NO: 1594895 - RNA, 13 nt, Homo sapiens
aacuuucuuucac

SEQ ID NO: 1594896 - RNA, 19 nt, Homo sapiens
aacuuuggugaacaguuuu

SEQ ID NO: 1594897 - RNA, 15 nt, Homo sapiens
aacuuugucacuucu

SEQ ID NO: 1594898 - RNA, 18 nt, Homo sapiens
aacuuuuagguuguuacc

SEQ ID NO: 1594899 - RNA, 14 nt, Homo sapiens
aagaaaaacaauaa

SEQ ID NO: 1594900 - RNA, 14 nt, Homo sapiens
aagaaaaacaucuu

SEQ ID NO: 1594901 - RNA, 22 nt, Homo sapiens
aagaaaaaugagcauacaucuu

SEQ ID NO: 1594902 - RNA, 21 nt, Homo sapiens
aagaaaacuuguguucaaucu

SEQ ID NO: 1594903 - RNA, 13 nt, Homo sapiens
aagaaaagcuggu

SEQ ID NO: 1594904 - RNA, 12 nt, Homo sapiens
aagaaaauccau

SEQ ID NO: 1594905 - RNA, 21 nt, Homo sapiens
aagaaacacagcaacaaugac

SEQ ID NO: 1594906 - RNA, 13 nt, Homo sapiens
aagaaacccaagu

SEQ ID NO: 1594907 - RNA, 15 nt, Homo sapiens
aagaaacuaguaaga

SEQ ID NO: 1594908 - RNA, 14 nt, Homo sapiens
aagaaagaaugcau

SEQ ID NO: 1594909 - RNA, 15 nt, Homo sapiens
aagaaagacuuauca

SEQ ID NO: 1594910 - RNA, 15 nt, Homo sapiens
aagaaagagccugaa

SEQ ID NO: 1594911 - RNA, 11 nt, Homo sapiens
aagaaagcaaa

SEQ ID NO: 1594912 - RNA, 17 nt, Homo sapiens
aagaaaucuugcuucag

SEQ ID NO: 1594913 - RNA, 12 nt, Homo sapiens
aagaaaugcaaa

SEQ ID NO: 1594914 - RNA, 16 nt, Homo sapiens
aagaaauggcuaugaa

SEQ ID NO: 1594915 - RNA, 17 nt, Homo sapiens
aagaacaugcaguuuga

SEQ ID NO: 1594916 - RNA, 12 nt, Homo sapiens
aagaacauguga

SEQ ID NO: 1594917 - RNA, 15 nt, Homo sapiens
aagaaccccucugcu

SEQ ID NO: 1594918 - RNA, 20 nt, Homo sapiens
aagaacugaaggcauaugca

SEQ ID NO: 1594919 - RNA, 23 nt, Homo sapiens
aagaacuggaaccccagcuuccc

SEQ ID NO: 1594920 - RNA, 17 nt, Homo sapiens
aagaacuguacauugug

SEQ ID NO: 1594921 - RNA, 16 nt, Homo sapiens
aagaagauaaacacaa

SEQ ID NO: 1594922 - RNA, 23 nt, Homo sapiens
aagaagcaaccucaguaauuuag

SEQ ID NO: 1594923 - RNA, 19 nt, Homo sapiens
aagaagcacugggugacca

SEQ ID NO: 1594924 - RNA, 21 nt, Homo sapiens
aagaagccauauaugaccaga

SEQ ID NO: 1594925 - RNA, 14 nt, Homo sapiens
aagaagcgagaugu

SEQ ID NO: 1594926 - RNA, 18 nt, Homo sapiens
aagaagcuuccacaaaau

SEQ ID NO: 1594927 - RNA, 14 nt, Homo sapiens
aagaaggauaccaa

SEQ ID NO: 1594928 - RNA, 24 nt, Homo sapiens
aagaaggcaauuuuaguguauuaa

SEQ ID NO: 1594929 - RNA, 13 nt, Homo sapiens
aagaaggcauuug

SEQ ID NO: 1594930 - RNA, 18 nt, Homo sapiens
aagaaggcucacagauuu

SEQ ID NO: 1594931 - RNA, 17 nt, Homo sapiens
aagaaggugucuccuag

SEQ ID NO: 1594932 - RNA, 18 nt, Homo sapiens
aagaagucggaaugucau

SEQ ID NO: 1594933 - RNA, 21 nt, Homo sapiens
aagaaguuaaaaaacagcugc

SEQ ID NO: 1594934 - RNA, 17 nt, Homo sapiens
aagaaguuauuuuccag

SEQ ID NO: 1594935 - RNA, 23 nt, Homo sapiens
aagaauuaaugacuuacuuuaau

SEQ ID NO: 1594936 - RNA, 12 nt, Homo sapiens
aagaauuccaaa

SEQ ID NO: 1594937 - RNA, 15 nt, Homo sapiens
aagacaagaacauuc

SEQ ID NO: 1594938 - RNA, 21 nt, Homo sapiens
aagacacuuuugaugacgauu

SEQ ID NO: 1594939 - RNA, 15 nt, Homo sapiens
aagacagcagacaaa

SEQ ID NO: 1594940 - RNA, 22 nt, Homo sapiens
aagacauuucucuaacuccugc

SEQ ID NO: 1594941 - RNA, 21 nt, Homo sapiens
aagacauuuuguuuuuacugu

SEQ ID NO: 1594942 - RNA, 17 nt, Homo sapiens
aagaccagccuggucaa

SEQ ID NO: 1594943 - RNA, 19 nt, Homo sapiens
aagaccaggucuacaguga

SEQ ID NO: 1594944 - RNA, 13 nt, Homo sapiens
aagacuacaauaa

SEQ ID NO: 1594945 - RNA, 13 nt, Homo sapiens
aagacuacugaau

SEQ ID NO: 1594946 - RNA, 14 nt, Homo sapiens
aagacuauucaaac

SEQ ID NO: 1594947 - RNA, 14 nt, Homo sapiens
aagacucagaugau

SEQ ID NO: 1594948 - RNA, 13 nt, Homo sapiens
aagacuccaaaga

SEQ ID NO: 1594949 - RNA, 22 nt, Homo sapiens
aagacugcugcagucacaucac

SEQ ID NO: 1594950 - RNA, 22 nt, Homo sapiens
aagacugcugguugacaucaga

SEQ ID NO: 1594951 - RNA, 20 nt, Homo sapiens
aagacuuccucaugaaucuc

SEQ ID NO: 1594952 - RNA, 16 nt, Homo sapiens
aagacuuuauguaguu

SEQ ID NO: 1594953 - RNA, 19 nt, Homo sapiens
aagagaaaauuccuagaaa

SEQ ID NO: 1594954 - RNA, 15 nt, Homo sapiens
aagagaacuaaagcu

SEQ ID NO: 1594955 - RNA, 16 nt, Homo sapiens
aagagaagagggccca

SEQ ID NO: 1594956 - RNA, 14 nt, Homo sapiens
aagagaauagggga

SEQ ID NO: 1594957 - RNA, 16 nt, Homo sapiens
aagagacuccgucuca

SEQ ID NO: 1594958 - RNA, 14 nt, Homo sapiens
aagagccaguuuau

SEQ ID NO: 1594959 - RNA, 13 nt, Homo sapiens
aagagcuaauaaa

SEQ ID NO: 1594960 - RNA, 14 nt, Homo sapiens
aagagcuacuccca

SEQ ID NO: 1594961 - RNA, 15 nt, Homo sapiens
aagagcucuuggccc

SEQ ID NO: 1594962 - RNA, 16 nt, Homo sapiens
aagagcuuaagaacca

SEQ ID NO: 1594963 - RNA, 14 nt, Homo sapiens
aagaggacugagac

SEQ ID NO: 1594964 - RNA, 12 nt, Homo sapiens
aagaggggaaaa

SEQ ID NO: 1594965 - RNA, 14 nt, Homo sapiens
aagaggucugagcc

SEQ ID NO: 1594966 - RNA, 20 nt, Homo sapiens
aagagucaacauugauccag

SEQ ID NO: 1594967 - RNA, 22 nt, Homo sapiens
aagagugccagucagcagucau

SEQ ID NO: 1594968 - RNA, 15 nt, Homo sapiens
aagaguggacugaau

SEQ ID NO: 1594969 - RNA, 14 nt, Homo sapiens
aagaguuaaacuua

SEQ ID NO: 1594970 - RNA, 24 nt, Homo sapiens
aagaguucuauggagacuuugcug

SEQ ID NO: 1594971 - RNA, 19 nt, Homo sapiens
aagaguuucacaaauccuu

SEQ ID NO: 1594972 - RNA, 14 nt, Homo sapiens
aagauaaacacaaa

SEQ ID NO: 1594973 - RNA, 16 nt, Homo sapiens
aagauaaacacaaaau

SEQ ID NO: 1594974 - RNA, 15 nt, Homo sapiens
aagauaauuuacuua

SEQ ID NO: 1594975 - RNA, 12 nt, Homo sapiens
aagauacaauaa

SEQ ID NO: 1594976 - RNA, 20 nt, Homo sapiens
aagauccccaacugcuccag

SEQ ID NO: 1594977 - RNA, 21 nt, Homo sapiens
aagaugacgaguaacuccccu

SEQ ID NO: 1594978 - RNA, 20 nt, Homo sapiens
aagaugcacucgcugugauu

SEQ ID NO: 1594979 - RNA, 22 nt, Homo sapiens
aagaugggacagcaacaaaauc

SEQ ID NO: 1594980 - RNA, 18 nt, Homo sapiens
aagaugggagguggaagc

SEQ ID NO: 1594981 - RNA, 22 nt, Homo sapiens
aagaugguauauuugguacugu

SEQ ID NO: 1594982 - RNA, 21 nt, Homo sapiens
aagaugucauuuccaccagca

SEQ ID NO: 1594983 - RNA, 19 nt, Homo sapiens
aagaugucuauguagcuga

SEQ ID NO: 1594984 - RNA, 17 nt, Homo sapiens
aagauguguaaacaggu

SEQ ID NO: 1594985 - RNA, 23 nt, Homo sapiens
aagauuauugugacuucacugua

SEQ ID NO: 1594986 - RNA, 20 nt, Homo sapiens
aagauuccaaaaagcacaua

SEQ ID NO: 1594987 - RNA, 17 nt, Homo sapiens
aagauugauuaaugaac

SEQ ID NO: 1594988 - RNA, 15 nt, Homo sapiens
aagauuuaaaauuaa

SEQ ID NO: 1594989 - RNA, 23 nt, Homo sapiens
aagauuugcccauuuacacuuuu

SEQ ID NO: 1594990 - RNA, 17 nt, Homo sapiens
aagauuuuccucuugug

SEQ ID NO: 1594991 - RNA, 17 nt, Homo sapiens
aagauuuuuggcacuuu

SEQ ID NO: 1594992 - RNA, 16 nt, Homo sapiens
aagauuuuuucauuuc

SEQ ID NO: 1594993 - RNA, 22 nt, Homo sapiens
aagauuuuuuuuguaacuucaa

SEQ ID NO: 1594994 - RNA, 18 nt, Homo sapiens
aagauuuuuuuugucaga

SEQ ID NO: 1594995 - RNA, 16 nt, Homo sapiens
aagcaaagugcccaug

SEQ ID NO: 1594996 - RNA, 12 nt, Homo sapiens
aagcaacauuca

SEQ ID NO: 1594997 - RNA, 16 nt, Homo sapiens
aagcaacuacaacuuc

SEQ ID NO: 1594998 - RNA, 17 nt, Homo sapiens
aagcaagaaaaccacaa

SEQ ID NO: 1594999 - RNA, 22 nt, Homo sapiens
aagcaagugaacucaucccuug

SEQ ID NO: 1595000 - RNA, 21 nt, Homo sapiens
aagcaaugggucacucauuaa

SEQ ID NO: 1595001 - RNA, 17 nt, Homo sapiens
aagcaauucuccugccu

SEQ ID NO: 1595002 - RNA, 16 nt, Homo sapiens
aagcaauucugacugu

SEQ ID NO: 1595003 - RNA, 19 nt, Homo sapiens
aagcaauugaaaugcauug

SEQ ID NO: 1595004 - RNA, 17 nt, Homo sapiens
aagcacaccuacagagc

SEQ ID NO: 1595005 - RNA, 14 nt, Homo sapiens
aagcacagcccuua

SEQ ID NO: 1595006 - RNA, 17 nt, Homo sapiens
aagcaccugccgaccuc

SEQ ID NO: 1595007 - RNA, 13 nt, Homo sapiens
aagcacuuuguua

SEQ ID NO: 1595008 - RNA, 16 nt, Homo sapiens
aagcagaaaaucuacc

SEQ ID NO: 1595009 - RNA, 20 nt, Homo sapiens
aagcagaacagugauuacca

SEQ ID NO: 1595010 - RNA, 15 nt, Homo sapiens
aagcagaccacugau

SEQ ID NO: 1595011 - RNA, 20 nt, Homo sapiens
aagcagacccaccucccagc

SEQ ID NO: 1595012 - RNA, 18 nt, Homo sapiens
aagcagaguaacaggauc

SEQ ID NO: 1595013 - RNA, 19 nt, Homo sapiens
aaucucagaugcaguuugg

SEQ ID NO: 1595014 - RNA, 15 nt, Homo sapiens
aaucuccaucucaaa

SEQ ID NO: 1595015 - RNA, 22 nt, Homo sapiens
aaucucccagugacaacaucgc

SEQ ID NO: 1595016 - RNA, 17 nt, Homo sapiens
aaucucuucaugcuuga

SEQ ID NO: 1595017 - RNA, 15 nt, Homo sapiens
aaucugcaaggacau

SEQ ID NO: 1595018 - RNA, 21 nt, Homo sapiens
aaucugcaaggacauuucuca

SEQ ID NO: 1595019 - RNA, 23 nt, Homo sapiens
aaucugcauccuuuucaaaaccu

SEQ ID NO: 1595020 - RNA, 19 nt, Homo sapiens
aaucuggguaucuuuccag

SEQ ID NO: 1595021 - RNA, 18 nt, Homo sapiens
aaucugguaaaagcacca

SEQ ID NO: 1595022 - RNA, 13 nt, Homo sapiens
aaucuuaucuuug

SEQ ID NO: 1595023 - RNA, 18 nt, Homo sapiens
aaucuuauguuuccaaga

SEQ ID NO: 1595024 - RNA, 12 nt, Homo sapiens
aaucuucuacuu

SEQ ID NO: 1595025 - RNA, 22 nt, Homo sapiens
aaucuucuacuuuuaacuaaua

SEQ ID NO: 1595026 - RNA, 16 nt, Homo sapiens
aaucuuuguaccaaaa

SEQ ID NO: 1595027 - RNA, 14 nt, Homo sapiens
aaucuuugugacag

SEQ ID NO: 1595028 - RNA, 15 nt, Homo sapiens
aaugaaaaaacugau

SEQ ID NO: 1595029 - RNA, 15 nt, Homo sapiens
aaugaaaagccaaau

SEQ ID NO: 1595030 - RNA, 21 nt, Homo sapiens
aaugaaacaagcuuacaaaga

SEQ ID NO: 1595031 - RNA, 17 nt, Homo sapiens
aaugaaagaaaaugaga

SEQ ID NO: 1595032 - RNA, 13 nt, Homo sapiens
aaugaaagggaaa

SEQ ID NO: 1595033 - RNA, 19 nt, Homo sapiens
aaugaaagggaaacuggga

SEQ ID NO: 1595034 - RNA, 21 nt, Homo sapiens
aaugaaagggaaacugggaaa

SEQ ID NO: 1595035 - RNA, 22 nt, Homo sapiens
aaugaaaguauuggcauucaaa

SEQ ID NO: 1595036 - RNA, 16 nt, Homo sapiens
aaugaaauccagugag

SEQ ID NO: 1595037 - RNA, 18 nt, Homo sapiens
aaugaaauccagugagca

SEQ ID NO: 1595038 - RNA, 22 nt, Homo sapiens
aaugaacacucuuuugcuuuau

SEQ ID NO: 1595039 - RNA, 14 nt, Homo sapiens
aaugaacauguuaa

SEQ ID NO: 1595040 - RNA, 22 nt, Homo sapiens
aaugaaccauucacagugcaag

SEQ ID NO: 1595041 - RNA, 22 nt, Homo sapiens
aaugaaccuucugcaacaucuu

SEQ ID NO: 1595042 - RNA, 14 nt, Homo sapiens
aaugaaguacucau

SEQ ID NO: 1595043 - RNA, 14 nt, Homo sapiens
aaugaagugcaaua

SEQ ID NO: 1595044 - RNA, 15 nt, Homo sapiens
aaugaagugcaauac

SEQ ID NO: 1595045 - RNA, 15 nt, Homo sapiens
aaugaaugacauuga

SEQ ID NO: 1595046 - RNA, 13 nt, Homo sapiens
aaugaauugcuaa

SEQ ID NO: 1595047 - RNA, 16 nt, Homo sapiens
aaugaauuucauguga

SEQ ID NO: 1595048 - RNA, 17 nt, Homo sapiens
aaugacgugccuaccuc

SEQ ID NO: 1595049 - RNA, 11 nt, Homo sapiens
aaugacuguau

SEQ ID NO: 1595050 - RNA, 23 nt, Homo sapiens
aaugacuuggguuuaacaagcug

SEQ ID NO: 1595051 - RNA, 16 nt, Homo sapiens
aaugauagacaauuga

SEQ ID NO: 1595052 - RNA, 22 nt, Homo sapiens
aaugaucacaucuaaagcuuua

SEQ ID NO: 1595053 - RNA, 14 nt, Homo sapiens
aaugaugugauaca

SEQ ID NO: 1595054 - RNA, 14 nt, Homo sapiens
aaugauuauauuca

SEQ ID NO: 1595055 - RNA, 16 nt, Homo sapiens
aaugauuguguagcca

SEQ ID NO: 1595056 - RNA, 20 nt, Homo sapiens
aaugauuucauauugaucuu

SEQ ID NO: 1595057 - RNA, 9 nt, Homo sapiens
aaugcaaaa

SEQ ID NO: 1595058 - RNA, 18 nt, Homo sapiens
aaugcaauaacucuggga

SEQ ID NO: 1595059 - RNA, 15 nt, Homo sapiens
aaugcacccaucagc

SEQ ID NO: 1595060 - RNA, 15 nt, Homo sapiens
aaugcagcaucuuug

SEQ ID NO: 1595061 - RNA, 12 nt, Homo sapiens
aaugccacagac

SEQ ID NO: 1595062 - RNA, 18 nt, Homo sapiens
aaugccacauacuugcag

SEQ ID NO: 1595063 - RNA, 14 nt, Homo sapiens
aaugccaugaauua

SEQ ID NO: 1595064 - RNA, 18 nt, Homo sapiens
aaugccuauaaaaugccc

SEQ ID NO: 1595065 - RNA, 22 nt, Homo sapiens
aaugccuuuuguuuccaggaaa

SEQ ID NO: 1595066 - RNA, 19 nt, Homo sapiens
aaugcugaugaaaacuguc

SEQ ID NO: 1595067 - RNA, 21 nt, Homo sapiens
aaugcugguuuuucaguuuuc

SEQ ID NO: 1595068 - RNA, 18 nt, Homo sapiens
aaugcuuuggaaaaaugg

SEQ ID NO: 1595069 - RNA, 17 nt, Homo sapiens
aauggaaaauacauuuu

SEQ ID NO: 1595070 - RNA, 14 nt, Homo sapiens
aauggaacuaucuc

SEQ ID NO: 1595071 - RNA, 21 nt, Homo sapiens
aauggaagaaauggcuaugaa

SEQ ID NO: 1595072 - RNA, 22 nt, Homo sapiens
aauggaccuccguggccaaaaa

SEQ ID NO: 1595073 - RNA, 16 nt, Homo sapiens
aauggacucaucuuag

SEQ ID NO: 1595074 - RNA, 19 nt, Homo sapiens
aauggcagcuagugccuuu

SEQ ID NO: 1595075 - RNA, 20 nt, Homo sapiens
aauggccuucauaucaucca

SEQ ID NO: 1595076 - RNA, 12 nt, Homo sapiens
aauggcuauuaa

SEQ ID NO: 1595077 - RNA, 15 nt, Homo sapiens
aaugggacucugaga

SEQ ID NO: 1595078 - RNA, 22 nt, Homo sapiens
aaugggccacugaaaucuguca

SEQ ID NO: 1595079 - RNA, 12 nt, Homo sapiens
aauggucaucca

SEQ ID NO: 1595080 - RNA, 14 nt, Homo sapiens
aauggucauccaaa

SEQ ID NO: 1595081 - RNA, 17 nt, Homo sapiens
aauggucauccaaacuc

SEQ ID NO: 1595082 - RNA, 12 nt, Homo sapiens
aauggugcuguu

SEQ ID NO: 1595083 - RNA, 12 nt, Homo sapiens
aaugguucucuu

SEQ ID NO: 1595084 - RNA, 14 nt, Homo sapiens
aaugguuucacuug

SEQ ID NO: 1595085 - RNA, 18 nt, Homo sapiens
aauguaaaaauccuuuug

SEQ ID NO: 1595086 - RNA, 16 nt, Homo sapiens
aauguaaacucucuuc

SEQ ID NO: 1595087 - RNA, 14 nt, Homo sapiens
aauguaacuaucuc

SEQ ID NO: 1595088 - RNA, 22 nt, Homo sapiens
aauguaagaugauaacguuaga

SEQ ID NO: 1595089 - RNA, 14 nt, Homo sapiens
aauguaagcauacu

SEQ ID NO: 1595090 - RNA, 20 nt, Homo sapiens
aauguaagggaaacugccag

SEQ ID NO: 1595091 - RNA, 16 nt, Homo sapiens
aauguaauaaagugaa

SEQ ID NO: 1595092 - RNA, 16 nt, Homo sapiens
aauguacaugucaaua

SEQ ID NO: 1595093 - RNA, 20 nt, Homo sapiens
aauguaccuucuuucacucu

SEQ ID NO: 1595094 - RNA, 13 nt, Homo sapiens
aauguagucaaua

SEQ ID NO: 1595095 - RNA, 19 nt, Homo sapiens
aauguauaaaaauuaucaa

SEQ ID NO: 1595096 - RNA, 21 nt, Homo sapiens
aauguaucuauuuguacaauu

SEQ ID NO: 1595097 - RNA, 20 nt, Homo sapiens
aauguaugccacaucucagu

SEQ ID NO: 1595098 - RNA, 15 nt, Homo sapiens
aauguauugauucaa

SEQ ID NO: 1595099 - RNA, 19 nt, Homo sapiens
aaugucacaacauggugcu

SEQ ID NO: 1595100 - RNA, 24 nt, Homo sapiens
aaugucagcaggaccccaucgcca

SEQ ID NO: 1595101 - RNA, 14 nt, Homo sapiens
aaugucauagguaa

SEQ ID NO: 1595102 - RNA, 12 nt, Homo sapiens
aaugucaucaaa

SEQ ID NO: 1595103 - RNA, 19 nt, Homo sapiens
aaugucauugccauacagc

SEQ ID NO: 1595104 - RNA, 19 nt, Homo sapiens
aaugucucacuuuacuuuc

SEQ ID NO: 1595105 - RNA, 15 nt, Homo sapiens
aaugucuuuuucaca

SEQ ID NO: 1595106 - RNA, 22 nt, Homo sapiens
aaugucuuuuucacaaucaugu

SEQ ID NO: 1595107 - RNA, 12 nt, Homo sapiens
aaugugacucag

SEQ ID NO: 1595108 - RNA, 22 nt, Homo sapiens
aaugugauuuuucuucagguaa

SEQ ID NO: 1595109 - RNA, 22 nt, Homo sapiens
aaugugcagggauauugccuua

SEQ ID NO: 1595110 - RNA, 22 nt, Homo sapiens
aaugugcugaagcaaagugccc

SEQ ID NO: 1595111 - RNA, 20 nt, Homo sapiens
aaugugcuucuaguaggcac

SEQ ID NO: 1595112 - RNA, 15 nt, Homo sapiens
aaugugggaucucag

SEQ ID NO: 1595113 - RNA, 22 nt, Homo sapiens
aauguguuuuucccccaugaaa

SEQ ID NO: 1595114 - RNA, 21 nt, Homo sapiens
aauguuaacuguucuuggaaa

SEQ ID NO: 1595115 - RNA, 19 nt, Homo sapiens
aauguuagauauugcuacu

SEQ ID NO: 1595116 - RNA, 23 nt, Homo sapiens
aauguuagauauugcuacuauaa

SEQ ID NO: 1595117 - RNA, 16 nt, Homo sapiens
aauguuauauaguuua

SEQ ID NO: 1595118 - RNA, 14 nt, Homo sapiens
aauguuaugacuau

SEQ ID NO: 1595119 - RNA, 21 nt, Homo sapiens
aauguuauuaagcaguuaaua

SEQ ID NO: 1595120 - RNA, 15 nt, Homo sapiens
aauguucacuuuuga

SEQ ID NO: 1595121 - RNA, 16 nt, Homo sapiens
aauguucaucaaugaa

SEQ ID NO: 1595122 - RNA, 21 nt, Homo sapiens
aauguuccugaaaauugcaau

SEQ ID NO: 1595123 - RNA, 19 nt, Homo sapiens
aauguugaaaaguaauuga

SEQ ID NO: 1595124 - RNA, 20 nt, Homo sapiens
aauguugcauuuaugaugca

SEQ ID NO: 1595125 - RNA, 16 nt, Homo sapiens
aauguugggacugcua

SEQ ID NO: 1595126 - RNA, 16 nt, Homo sapiens
aauguuuacuguauca

SEQ ID NO: 1595127 - RNA, 18 nt, Homo sapiens
aauguuuuaaaaauucau

SEQ ID NO: 1595128 - RNA, 21 nt, Homo sapiens
aauguuuuagaaugagacuua

SEQ ID NO: 1595129 - RNA, 15 nt, Homo sapiens
aauuaaaaaccugau

SEQ ID NO: 1595130 - RNA, 12 nt, Homo sapiens
aauuaaaaccuc

SEQ ID NO: 1595131 - RNA, 16 nt, Homo sapiens
accaaucagcacucug

SEQ ID NO: 1595132 - RNA, 16 nt, Homo sapiens
accaaucauuuccuug

SEQ ID NO: 1595133 - RNA, 13 nt, Homo sapiens
accaaugucuuga

SEQ ID NO: 1595134 - RNA, 21 nt, Homo sapiens
accaauguucuaaaguuuugc

SEQ ID NO: 1595135 - RNA, 22 nt, Homo sapiens
accacaccuggcauggugcagg

SEQ ID NO: 1595136 - RNA, 22 nt, Homo sapiens
accacagaaaucacagucaaug

SEQ ID NO: 1595137 - RNA, 19 nt, Homo sapiens
accacauguguuucugucu

SEQ ID NO: 1595138 - RNA, 23 nt, Homo sapiens
accaccauuuaauuucauguaua

SEQ ID NO: 1595139 - RNA, 22 nt, Homo sapiens
accacccuuucacaagcaacag

SEQ ID NO: 1595140 - RNA, 22 nt, Homo sapiens
accaccuggggagagccugcuu

SEQ ID NO: 1595141 - RNA, 20 nt, Homo sapiens
accaccuucccagcucuccc

SEQ ID NO: 1595142 - RNA, 18 nt, Homo sapiens
accacuacaugcagccca

SEQ ID NO: 1595143 - RNA, 23 nt, Homo sapiens
accacuacaugcagcccaugccc

SEQ ID NO: 1595144 - RNA, 20 nt, Homo sapiens
accacucuucuuuaagccau

SEQ ID NO: 1595145 - RNA, 17 nt, Homo sapiens
accacugaaaaaauaua

SEQ ID NO: 1595146 - RNA, 14 nt, Homo sapiens
accacugcacucca

SEQ ID NO: 1595147 - RNA, 16 nt, Homo sapiens
accagaaaagcaauac

SEQ ID NO: 1595148 - RNA, 15 nt, Homo sapiens
accagaacaguauga

SEQ ID NO: 1595149 - RNA, 13 nt, Homo sapiens
accagaacuuucu

SEQ ID NO: 1595150 - RNA, 21 nt, Homo sapiens
accagacacucacagcaagga

SEQ ID NO: 1595151 - RNA, 13 nt, Homo sapiens
accagagcugucu

SEQ ID NO: 1595152 - RNA, 21 nt, Homo sapiens
accagaggaaagaccaugugg

SEQ ID NO: 1595153 - RNA, 19 nt, Homo sapiens
accagaggagcagaccagc

SEQ ID NO: 1595154 - RNA, 14 nt, Homo sapiens
accagagucuuaag

SEQ ID NO: 1595155 - RNA, 13 nt, Homo sapiens
accagcaaauccu

SEQ ID NO: 1595156 - RNA, 14 nt, Homo sapiens
accagccauacuua

SEQ ID NO: 1595157 - RNA, 21 nt, Homo sapiens
accagcccgggcuggcccaag

SEQ ID NO: 1595158 - RNA, 20 nt, Homo sapiens
accagccguauuuuacauga

SEQ ID NO: 1595159 - RNA, 22 nt, Homo sapiens
accagccuguccaacaugguga

SEQ ID NO: 1595160 - RNA, 23 nt, Homo sapiens
accagcuucauguggcuucccuu

SEQ ID NO: 1595161 - RNA, 23 nt, Homo sapiens
accaggacacuacccugagaucu

SEQ ID NO: 1595162 - RNA, 13 nt, Homo sapiens
accaggccagcuc

SEQ ID NO: 1595163 - RNA, 15 nt, Homo sapiens
accaggccagcucag

SEQ ID NO: 1595164 - RNA, 18 nt, Homo sapiens
accaggcuggagugcagu

SEQ ID NO: 1595165 - RNA, 17 nt, Homo sapiens
accagggagcaguugcc

SEQ ID NO: 1595166 - RNA, 13 nt, Homo sapiens
accagggcuccag

SEQ ID NO: 1595167 - RNA, 11 nt, Homo sapiens
accaggggugc

SEQ ID NO: 1595168 - RNA, 16 nt, Homo sapiens
accaggggugcacaau

SEQ ID NO: 1595169 - RNA, 22 nt, Homo sapiens
accaggguccuuuugacacugc

SEQ ID NO: 1595170 - RNA, 18 nt, Homo sapiens
accaggucuacagugaua

SEQ ID NO: 1595171 - RNA, 17 nt, Homo sapiens
accaggugucaaaugag

SEQ ID NO: 1595172 - RNA, 16 nt, Homo sapiens
accagguuugcaggag

SEQ ID NO: 1595173 - RNA, 22 nt, Homo sapiens
accagugaauuuuugcaauaau

SEQ ID NO: 1595174 - RNA, 11 nt, Homo sapiens
accaguguucc

SEQ ID NO: 1595175 - RNA, 20 nt, Homo sapiens
accauacacacacacaaaaa

SEQ ID NO: 1595176 - RNA, 14 nt, Homo sapiens
accauacugaggga

SEQ ID NO: 1595177 - RNA, 16 nt, Homo sapiens
accauauaccaucucc

SEQ ID NO: 1595178 - RNA, 14 nt, Homo sapiens
accaucaccucucu

SEQ ID NO: 1595179 - RNA, 16 nt, Homo sapiens
accaucacugccauca

SEQ ID NO: 1595180 - RNA, 17 nt, Homo sapiens
accaucuccaugugacc

SEQ ID NO: 1595181 - RNA, 20 nt, Homo sapiens
accaucucuuuaccuccuaa

SEQ ID NO: 1595182 - RNA, 23 nt, Homo sapiens
accaucugaaagugguacuugau

SEQ ID NO: 1595183 - RNA, 21 nt, Homo sapiens
accaucugaagaaacuuccca

SEQ ID NO: 1595184 - RNA, 11 nt, Homo sapiens
accaugaaguc

SEQ ID NO: 1595185 - RNA, 14 nt, Homo sapiens
accaugccauuuaa

SEQ ID NO: 1595186 - RNA, 18 nt, Homo sapiens
accaugccuuccucagua

SEQ ID NO: 1595187 - RNA, 16 nt, Homo sapiens
accaugcucaaugaaa

SEQ ID NO: 1595188 - RNA, 21 nt, Homo sapiens
accaugcucucucaccugcuc

SEQ ID NO: 1595189 - RNA, 18 nt, Homo sapiens
accauggaccagcccauu

SEQ ID NO: 1595190 - RNA, 14 nt, Homo sapiens
accauggcacuuaa

SEQ ID NO: 1595191 - RNA, 13 nt, Homo sapiens
accauguacauaa

SEQ ID NO: 1595192 - RNA, 21 nt, Homo sapiens
accauguauaugagcuuauaa

SEQ ID NO: 1595193 - RNA, 20 nt, Homo sapiens
accauguggauaacuuuaca

SEQ ID NO: 1595194 - RNA, 21 nt, Homo sapiens
accauuaacuccuccugagcu

SEQ ID NO: 1595195 - RNA, 13 nt, Homo sapiens
accauuaccaaaa

SEQ ID NO: 1595196 - RNA, 16 nt, Homo sapiens
accauuauacuuuaua

SEQ ID NO: 1595197 - RNA, 14 nt, Homo sapiens
accauuugcuuaaa

SEQ ID NO: 1595198 - RNA, 21 nt, Homo sapiens
accauuuuguuauugacuaac

SEQ ID NO: 1595199 - RNA, 20 nt, Homo sapiens
accauuuuuacauccaugaa

SEQ ID NO: 1595200 - RNA, 17 nt, Homo sapiens
acccaacucaaggacag

SEQ ID NO: 1595201 - RNA, 12 nt, Homo sapiens
acccaacuccac

SEQ ID NO: 1595202 - RNA, 17 nt, Homo sapiens
acccaagggagugucag

SEQ ID NO: 1595203 - RNA, 14 nt, Homo sapiens
acccaccccaacuc

SEQ ID NO: 1595204 - RNA, 19 nt, Homo sapiens
acccaccuggcuucauaca

SEQ ID NO: 1595205 - RNA, 22 nt, Homo sapiens
acccaccuggcuucauacagaa

SEQ ID NO: 1595206 - RNA, 23 nt, Homo sapiens
acccacucggauggaccaaccug

SEQ ID NO: 1595207 - RNA, 14 nt, Homo sapiens
acccacugacccac

SEQ ID NO: 1595208 - RNA, 22 nt, Homo sapiens
acccacuuuaaaauaucuacau

SEQ ID NO: 1595209 - RNA, 14 nt, Homo sapiens
acccacuuugucca

SEQ ID NO: 1595210 - RNA, 14 nt, Homo sapiens
acccagagguccag

SEQ ID NO: 1595211 - RNA, 16 nt, Homo sapiens
acccagggcuaugagg

SEQ ID NO: 1595212 - RNA, 16 nt, Homo sapiens
acccagggguccaggc

SEQ ID NO: 1595213 - RNA, 20 nt, Homo sapiens
acccagugcgugaagaccaa

SEQ ID NO: 1595214 - RNA, 17 nt, Homo sapiens
acccaguggacucuucc

SEQ ID NO: 1595215 - RNA, 16 nt, Homo sapiens
acccaucagcacucug

SEQ ID NO: 1595216 - RNA, 14 nt, Homo sapiens
acccaucucugaac

SEQ ID NO: 1595217 - RNA, 23 nt, Homo sapiens
acccaugaaggcuggaaggcagc

SEQ ID NO: 1595218 - RNA, 17 nt, Homo sapiens
acccaugggcucugaca

SEQ ID NO: 1595219 - RNA, 16 nt, Homo sapiens
acccauucacuacagg

SEQ ID NO: 1595220 - RNA, 13 nt, Homo sapiens
acccauucuacac

SEQ ID NO: 1595221 - RNA, 18 nt, Homo sapiens
accccaaacuguugauua

SEQ ID NO: 1595222 - RNA, 15 nt, Homo sapiens
accccacgcugacca

SEQ ID NO: 1595223 - RNA, 17 nt, Homo sapiens
accccauuuguggucac

SEQ ID NO: 1595224 - RNA, 17 nt, Homo sapiens
acccccaccaccauaca

SEQ ID NO: 1595225 - RNA, 13 nt, Homo sapiens
acccccagcacuu

SEQ ID NO: 1595226 - RNA, 15 nt, Homo sapiens
acccccagcuuugag

SEQ ID NO: 1595227 - RNA, 16 nt, Homo sapiens
acccccaucucuacua

SEQ ID NO: 1595228 - RNA, 17 nt, Homo sapiens
acccccaucucuacuaa

SEQ ID NO: 1595229 - RNA, 21 nt, Homo sapiens
acccccugcuccaccagcagc

SEQ ID NO: 1595230 - RNA, 15 nt, Homo sapiens
acccccuuuucccuu

SEQ ID NO: 1595231 - RNA, 16 nt, Homo sapiens
accccuaccucuagua

SEQ ID NO: 1595232 - RNA, 19 nt, Homo sapiens
accccuccaccucucucuc

SEQ ID NO: 1595233 - RNA, 14 nt, Homo sapiens
accccugcacaguu

SEQ ID NO: 1595234 - RNA, 22 nt, Homo sapiens
accccugcucaguaaagcacuu

SEQ ID NO: 1595235 - RNA, 23 nt, Homo sapiens
accccugucccaaccccagugga

SEQ ID NO: 1595236 - RNA, 14 nt, Homo sapiens
accccuuagccucc

SEQ ID NO: 1595237 - RNA, 22 nt, Homo sapiens
accccuuucugucccacuacau

SEQ ID NO: 1595238 - RNA, 13 nt, Homo sapiens
accccuuugcacu

SEQ ID NO: 1595239 - RNA, 23 nt, Homo sapiens
acccggaagaucagaugcaauug

SEQ ID NO: 1595240 - RNA, 22 nt, Homo sapiens
acccggcaggcuagaaccuggc

SEQ ID NO: 1595241 - RNA, 20 nt, Homo sapiens
acccgggggagcccagugaa

SEQ ID NO: 1595242 - RNA, 14 nt, Homo sapiens
acccguaucugccc

SEQ ID NO: 1595243 - RNA, 20 nt, Homo sapiens
acccuccagaauccugaugg

SEQ ID NO: 1595244 - RNA, 20 nt, Homo sapiens
acccuccccuagucacucau

SEQ ID NO: 1595245 - RNA, 23 nt, Homo sapiens
acccuccuccccacacagacucc

SEQ ID NO: 1595246 - RNA, 19 nt, Homo sapiens
acccuccuggccucauaca

SEQ ID NO: 1595247 - RNA, 13 nt, Homo sapiens
acccugaguucau

SEQ ID NO: 1595248 - RNA, 20 nt, Homo sapiens
acccugcccaggguuggcau

SEQ ID NO: 1595249 - RNA, 17 nt, Homo sapiens
agggagaggucucagug

SEQ ID NO: 1595250 - RNA, 21 nt, Homo sapiens
agggagcuaucaggaacagcu

SEQ ID NO: 1595251 - RNA, 14 nt, Homo sapiens
agggaggucacugg

SEQ ID NO: 1595252 - RNA, 18 nt, Homo sapiens
agggagugcacauaucca

SEQ ID NO: 1595253 - RNA, 15 nt, Homo sapiens
agggcaagaucucag

SEQ ID NO: 1595254 - RNA, 18 nt, Homo sapiens
agggcaauggacaaggaa

SEQ ID NO: 1595255 - RNA, 14 nt, Homo sapiens
agggcacaagcuca

SEQ ID NO: 1595256 - RNA, 15 nt, Homo sapiens
agggcagaaagguuc

SEQ ID NO: 1595257 - RNA, 16 nt, Homo sapiens
agggcagauucaagag

SEQ ID NO: 1595258 - RNA, 23 nt, Homo sapiens
agggcagggcugaggccucucau

SEQ ID NO: 1595259 - RNA, 17 nt, Homo sapiens
agggcaguucugagugu

SEQ ID NO: 1595260 - RNA, 15 nt, Homo sapiens
agggccaauggccug

SEQ ID NO: 1595261 - RNA, 16 nt, Homo sapiens
agggccacaugggagg

SEQ ID NO: 1595262 - RNA, 17 nt, Homo sapiens
agggcccuccgaccacu

SEQ ID NO: 1595263 - RNA, 23 nt, Homo sapiens
agggcuagaaccuguagagcuag

SEQ ID NO: 1595264 - RNA, 15 nt, Homo sapiens
agggcuggggacaga

SEQ ID NO: 1595265 - RNA, 18 nt, Homo sapiens
aggggaaagacuuccauc

SEQ ID NO: 1595266 - RNA, 17 nt, Homo sapiens
aggggaagggucccuuu

SEQ ID NO: 1595267 - RNA, 20 nt, Homo sapiens
aggggcagccacaccacugc

SEQ ID NO: 1595268 - RNA, 13 nt, Homo sapiens
aggggcauugcug

SEQ ID NO: 1595269 - RNA, 17 nt, Homo sapiens
aggggccucccugugac

SEQ ID NO: 1595270 - RNA, 14 nt, Homo sapiens
aggggcucaguggc

SEQ ID NO: 1595271 - RNA, 13 nt, Homo sapiens
aggggcugcauga

SEQ ID NO: 1595272 - RNA, 21 nt, Homo sapiens
aggggcuggggccagggagca

SEQ ID NO: 1595273 - RNA, 13 nt, Homo sapiens
aggggcuguguuu

SEQ ID NO: 1595274 - RNA, 15 nt, Homo sapiens
agggggagaaugggu

SEQ ID NO: 1595275 - RNA, 16 nt, Homo sapiens
agggggccuggaugcc

SEQ ID NO: 1595276 - RNA, 21 nt, Homo sapiens
agggggcugucuuggucacug

SEQ ID NO: 1595277 - RNA, 18 nt, Homo sapiens
aggggggggugggugaga

SEQ ID NO: 1595278 - RNA, 22 nt, Homo sapiens
aggggguggggaagaagacaca

SEQ ID NO: 1595279 - RNA, 14 nt, Homo sapiens
agggggugucugca

SEQ ID NO: 1595280 - RNA, 18 nt, Homo sapiens
aggggucagagcacuccc

SEQ ID NO: 1595281 - RNA, 19 nt, Homo sapiens
aggggugagagaccugcuc

SEQ ID NO: 1595282 - RNA, 21 nt, Homo sapiens
aggggugagagaccugcucag

SEQ ID NO: 1595283 - RNA, 22 nt, Homo sapiens
agggguggggguggaggcuucc

SEQ ID NO: 1595284 - RNA, 15 nt, Homo sapiens
aggguagggcacaaa

SEQ ID NO: 1595285 - RNA, 16 nt, Homo sapiens
aggguagggcacaaag

SEQ ID NO: 1595286 - RNA, 21 nt, Homo sapiens
aggguaugucagugucacugg

SEQ ID NO: 1595287 - RNA, 22 nt, Homo sapiens
agggucaccuagggaagcacuu

SEQ ID NO: 1595288 - RNA, 19 nt, Homo sapiens
aggguccaggaauggugcu

SEQ ID NO: 1595289 - RNA, 20 nt, Homo sapiens
aggguccaggaauggugcuu

SEQ ID NO: 1595290 - RNA, 14 nt, Homo sapiens
agggugacuaugga

SEQ ID NO: 1595291 - RNA, 18 nt, Homo sapiens
agggugcccagcuuauaa

SEQ ID NO: 1595292 - RNA, 16 nt, Homo sapiens
aggguggcccuugcag

SEQ ID NO: 1595293 - RNA, 22 nt, Homo sapiens
agggugguggcgugcauaugua

SEQ ID NO: 1595294 - RNA, 14 nt, Homo sapiens
aggguugacaaaua

SEQ ID NO: 1595295 - RNA, 17 nt, Homo sapiens
aggguuuguaauacuuu

SEQ ID NO: 1595296 - RNA, 15 nt, Homo sapiens
aggguuuugacacuu

SEQ ID NO: 1595297 - RNA, 18 nt, Homo sapiens
agguaacuaacugcauac

SEQ ID NO: 1595298 - RNA, 17 nt, Homo sapiens
agguacgaugacagugu

SEQ ID NO: 1595299 - RNA, 23 nt, Homo sapiens
agguauccaaaaauguguaagaa

SEQ ID NO: 1595300 - RNA, 12 nt, Homo sapiens
agguaugcagag

SEQ ID NO: 1595301 - RNA, 21 nt, Homo sapiens
agguaugugucagccaugacc

SEQ ID NO: 1595302 - RNA, 18 nt, Homo sapiens
agguauuagcaaagcaaa

SEQ ID NO: 1595303 - RNA, 12 nt, Homo sapiens
aggucaccagca

SEQ ID NO: 1595304 - RNA, 21 nt, Homo sapiens
aggucagagcagagguggaaa

SEQ ID NO: 1595305 - RNA, 20 nt, Homo sapiens
aggucagcagccucccugaa

SEQ ID NO: 1595306 - RNA, 22 nt, Homo sapiens
aggucucauagguugagcaauu

SEQ ID NO: 1595307 - RNA, 17 nt, Homo sapiens
aggucuccuaaaacugg

SEQ ID NO: 1595308 - RNA, 16 nt, Homo sapiens
aggugaaagaaaccac

SEQ ID NO: 1595309 - RNA, 15 nt, Homo sapiens
aggugagaaaaccau

SEQ ID NO: 1595310 - RNA, 18 nt, Homo sapiens
aggugaggcucuucacau

SEQ ID NO: 1595311 - RNA, 19 nt, Homo sapiens
aggugauccacccaccucg

SEQ ID NO: 1595312 - RNA, 18 nt, Homo sapiens
aggugcauagcaagugaa

SEQ ID NO: 1595313 - RNA, 19 nt, Homo sapiens
aggugcauagcaagugaaa

SEQ ID NO: 1595314 - RNA, 18 nt, Homo sapiens
aggugcuacaaaaacaca

SEQ ID NO: 1595315 - RNA, 19 nt, Homo sapiens
aggugcuauuguuacucuu

SEQ ID NO: 1595316 - RNA, 18 nt, Homo sapiens
aggugcucuggucugugg

SEQ ID NO: 1595317 - RNA, 14 nt, Homo sapiens
aggugcugacaaua

SEQ ID NO: 1595318 - RNA, 14 nt, Homo sapiens
agguggaagcagag

SEQ ID NO: 1595319 - RNA, 13 nt, Homo sapiens
agguggcucagug

SEQ ID NO: 1595320 - RNA, 19 nt, Homo sapiens
agguggggauccugccuaa

SEQ ID NO: 1595321 - RNA, 13 nt, Homo sapiens
agguguagaccag

SEQ ID NO: 1595322 - RNA, 20 nt, Homo sapiens
agguguucuucauuaccuca

SEQ ID NO: 1595323 - RNA, 17 nt, Homo sapiens
agguuagcugcucccca

SEQ ID NO: 1595324 - RNA, 16 nt, Homo sapiens
agguucccacuuaaaa

SEQ ID NO: 1595325 - RNA, 12 nt, Homo sapiens
agguugcacagc

SEQ ID NO: 1595326 - RNA, 16 nt, Homo sapiens
agguugccugaaaaau

SEQ ID NO: 1595327 - RNA, 18 nt, Homo sapiens
agguuucuaagcauaaaa

SEQ ID NO: 1595328 - RNA, 21 nt, Homo sapiens
agguuuguuuagaagaagugu

SEQ ID NO: 1595329 - RNA, 23 nt, Homo sapiens
aguaaaaauaaauaaaacagcag

SEQ ID NO: 1595330 - RNA, 14 nt, Homo sapiens
aguaaaacagucau

SEQ ID NO: 1595331 - RNA, 13 nt, Homo sapiens
aguaaaacuguau

SEQ ID NO: 1595332 - RNA, 16 nt, Homo sapiens
aguaaaacuguauaaa

SEQ ID NO: 1595333 - RNA, 12 nt, Homo sapiens
aguaaacuuucu

SEQ ID NO: 1595334 - RNA, 17 nt, Homo sapiens
aguaaagaaaaguuuac

SEQ ID NO: 1595335 - RNA, 20 nt, Homo sapiens
aguaaaucuuuuacaacugc

SEQ ID NO: 1595336 - RNA, 19 nt, Homo sapiens
aguaacgggacaguaaaca

SEQ ID NO: 1595337 - RNA, 15 nt, Homo sapiens
aguaacugaaccauu

SEQ ID NO: 1595338 - RNA, 17 nt, Homo sapiens
aguaacugcacacuauu

SEQ ID NO: 1595339 - RNA, 16 nt, Homo sapiens
aguaagagugguggcc

SEQ ID NO: 1595340 - RNA, 15 nt, Homo sapiens
aguaaguaucuggag

SEQ ID NO: 1595341 - RNA, 15 nt, Homo sapiens
aguaagugccuucca

SEQ ID NO: 1595342 - RNA, 19 nt, Homo sapiens
aguaauagcgccucuuuua

SEQ ID NO: 1595343 - RNA, 15 nt, Homo sapiens
aguaauaucuuucag

SEQ ID NO: 1595344 - RNA, 14 nt, Homo sapiens
aguaaucacuuaaa

SEQ ID NO: 1595345 - RNA, 15 nt, Homo sapiens
aguaauuaugcacua

SEQ ID NO: 1595346 - RNA, 15 nt, Homo sapiens
aguaauucuucugcc

SEQ ID NO: 1595347 - RNA, 21 nt, Homo sapiens
aguaauuuuguuuaugcugcu

SEQ ID NO: 1595348 - RNA, 14 nt, Homo sapiens
aguacacucagcca

SEQ ID NO: 1595349 - RNA, 22 nt, Homo sapiens
aguaccaccaagggaucugcca

SEQ ID NO: 1595350 - RNA, 24 nt, Homo sapiens
aguaccaguauaagcaucugccau

SEQ ID NO: 1595351 - RNA, 10 nt, Homo sapiens
aguaccccau

SEQ ID NO: 1595352 - RNA, 16 nt, Homo sapiens
aguaccgccagcagcu

SEQ ID NO: 1595353 - RNA, 14 nt, Homo sapiens
aguaccuucaauac

SEQ ID NO: 1595354 - RNA, 22 nt, Homo sapiens
aguaccuuuccauuuauucuuu

SEQ ID NO: 1595355 - RNA, 17 nt, Homo sapiens
aguacgaaccuacaguu

SEQ ID NO: 1595356 - RNA, 22 nt, Homo sapiens
aguacuauugcuaguacuagua

SEQ ID NO: 1595357 - RNA, 14 nt, Homo sapiens
aguacuauugcuau

SEQ ID NO: 1595358 - RNA, 17 nt, Homo sapiens
aguacuuauagaccuua

SEQ ID NO: 1595359 - RNA, 16 nt, Homo sapiens
aguacuuauguugcac

SEQ ID NO: 1595360 - RNA, 18 nt, Homo sapiens
aguacuuauguugcacaa

SEQ ID NO: 1595361 - RNA, 14 nt, Homo sapiens
aguacuuuauugca

SEQ ID NO: 1595362 - RNA, 22 nt, Homo sapiens
aguacuuugguuucugagcacc

SEQ ID NO: 1595363 - RNA, 15 nt, Homo sapiens
aguacuuugugcauu

SEQ ID NO: 1595364 - RNA, 11 nt, Homo sapiens
aguagaacuca

SEQ ID NO: 1595365 - RNA, 17 nt, Homo sapiens
aguagacacacuaucau

SEQ ID NO: 1595366 - RNA, 13 nt, Homo sapiens
aguagacauuuau

SEQ ID NO: 1595367 - RNA, 16 nt, Homo sapiens
aguagacugauuacac

SEQ ID NO: 1595368 - RNA, 18 nt, Homo sapiens
auagaggugaugcugcua

SEQ ID NO: 1595369 - RNA, 12 nt, Homo sapiens
auagauuacuga

SEQ ID NO: 1595370 - RNA, 21 nt, Homo sapiens
auagcacugguuuguuucuca

SEQ ID NO: 1595371 - RNA, 20 nt, Homo sapiens
auagcagcucuugaaguaua

SEQ ID NO: 1595372 - RNA, 12 nt, Homo sapiens
auagcagggaua

SEQ ID NO: 1595373 - RNA, 15 nt, Homo sapiens
auagcauguaauggu

SEQ ID NO: 1595374 - RNA, 18 nt, Homo sapiens
auagcccucagacauuua

SEQ ID NO: 1595375 - RNA, 14 nt, Homo sapiens
auagccgauaucag

SEQ ID NO: 1595376 - RNA, 22 nt, Homo sapiens
auagccugaggugggagaauca

SEQ ID NO: 1595377 - RNA, 19 nt, Homo sapiens
auagcuccucaaagccuca

SEQ ID NO: 1595378 - RNA, 22 nt, Homo sapiens
auagcucuggggugggcaguuu

SEQ ID NO: 1595379 - RNA, 21 nt, Homo sapiens
auagcugcaaguguaucuccu

SEQ ID NO: 1595380 - RNA, 17 nt, Homo sapiens
auagcugcuuccagugu

SEQ ID NO: 1595381 - RNA, 13 nt, Homo sapiens
auagcuucaggag

SEQ ID NO: 1595382 - RNA, 15 nt, Homo sapiens
auagcuugaagccca

SEQ ID NO: 1595383 - RNA, 15 nt, Homo sapiens
auaggagugaauaca

SEQ ID NO: 1595384 - RNA, 14 nt, Homo sapiens
auaggcagcugucc

SEQ ID NO: 1595385 - RNA, 21 nt, Homo sapiens
auaggccugucccuugccucu

SEQ ID NO: 1595386 - RNA, 17 nt, Homo sapiens
auaggccuucauuaaca

SEQ ID NO: 1595387 - RNA, 17 nt, Homo sapiens
auagggaaaauaaucuc

SEQ ID NO: 1595388 - RNA, 20 nt, Homo sapiens
auagggagacccccaucuuu

SEQ ID NO: 1595389 - RNA, 19 nt, Homo sapiens
auagggguucaugcuuaau

SEQ ID NO: 1595390 - RNA, 12 nt, Homo sapiens
auaggugcaguu

SEQ ID NO: 1595391 - RNA, 15 nt, Homo sapiens
auaggugugugagac

SEQ ID NO: 1595392 - RNA, 15 nt, Homo sapiens
auagguugagcaauu

SEQ ID NO: 1595393 - RNA, 21 nt, Homo sapiens
auagguuuguaaaaugcaccc

SEQ ID NO: 1595394 - RNA, 15 nt, Homo sapiens
auaguaaguucagca

SEQ ID NO: 1595395 - RNA, 21 nt, Homo sapiens
auaguaccaguaggggcuuau

SEQ ID NO: 1595396 - RNA, 17 nt, Homo sapiens
auagucaaugaugguuu

SEQ ID NO: 1595397 - RNA, 18 nt, Homo sapiens
auagucaauuucuacuuc

SEQ ID NO: 1595398 - RNA, 18 nt, Homo sapiens
auagucuuugccagucau

SEQ ID NO: 1595399 - RNA, 17 nt, Homo sapiens
auagugaaacauguacu

SEQ ID NO: 1595400 - RNA, 18 nt, Homo sapiens
auagugaccuguguuuca

SEQ ID NO: 1595401 - RNA, 16 nt, Homo sapiens
auaguggauccacuuu

SEQ ID NO: 1595402 - RNA, 17 nt, Homo sapiens
auaguguaagaacugua

SEQ ID NO: 1595403 - RNA, 20 nt, Homo sapiens
auaguguucacaaacuguga

SEQ ID NO: 1595404 - RNA, 12 nt, Homo sapiens
auaguguugcuu

SEQ ID NO: 1595405 - RNA, 14 nt, Homo sapiens
auaguuaagacaug

SEQ ID NO: 1595406 - RNA, 21 nt, Homo sapiens
auaguuacaaaauacaaaagu

SEQ ID NO: 1595407 - RNA, 17 nt, Homo sapiens
auaguucccaggugaua

SEQ ID NO: 1595408 - RNA, 15 nt, Homo sapiens
auaguuguaccgcaa

SEQ ID NO: 1595409 - RNA, 22 nt, Homo sapiens
auaguuuggcuauaagugcuca

SEQ ID NO: 1595410 - RNA, 18 nt, Homo sapiens
auaguuuuguuuguuaga

SEQ ID NO: 1595411 - RNA, 19 nt, Homo sapiens
auauaaaaauaaagcacuu

SEQ ID NO: 1595412 - RNA, 20 nt, Homo sapiens
auauaaaaauaaugucauag

SEQ ID NO: 1595413 - RNA, 13 nt, Homo sapiens
auauaaacauauc

SEQ ID NO: 1595414 - RNA, 21 nt, Homo sapiens
auauaaagguggugggcaaaa

SEQ ID NO: 1595415 - RNA, 21 nt, Homo sapiens
auauaaaugugauugcagcuu

SEQ ID NO: 1595416 - RNA, 13 nt, Homo sapiens
auauaaucaauca

SEQ ID NO: 1595417 - RNA, 21 nt, Homo sapiens
auauaaugcuugcaccucagg

SEQ ID NO: 1595418 - RNA, 16 nt, Homo sapiens
auauaauuuauuucca

SEQ ID NO: 1595419 - RNA, 17 nt, Homo sapiens
auauacaaaacuuuauc

SEQ ID NO: 1595420 - RNA, 15 nt, Homo sapiens
auauacacacagugg

SEQ ID NO: 1595421 - RNA, 12 nt, Homo sapiens
auauaccaucuc

SEQ ID NO: 1595422 - RNA, 18 nt, Homo sapiens
auauaccucacuagccau

SEQ ID NO: 1595423 - RNA, 19 nt, Homo sapiens
auauaccuuuuugugucaa

SEQ ID NO: 1595424 - RNA, 22 nt, Homo sapiens
auauacuaaaccaacucuaaua

SEQ ID NO: 1595425 - RNA, 22 nt, Homo sapiens
auauacuugacucuaauaugau

SEQ ID NO: 1595426 - RNA, 18 nt, Homo sapiens
auauagacagugcccuug

SEQ ID NO: 1595427 - RNA, 19 nt, Homo sapiens
auauagcuuugccaugugg

SEQ ID NO: 1595428 - RNA, 15 nt, Homo sapiens
auauaggcuucucac

SEQ ID NO: 1595429 - RNA, 23 nt, Homo sapiens
auauaggcuucucacggcgacca

SEQ ID NO: 1595430 - RNA, 17 nt, Homo sapiens
auauaggugugugagac

SEQ ID NO: 1595431 - RNA, 15 nt, Homo sapiens
auauauacacacagu

SEQ ID NO: 1595432 - RNA, 15 nt, Homo sapiens
auauauacuaaacaa

SEQ ID NO: 1595433 - RNA, 17 nt, Homo sapiens
auauauggcauuugcag

SEQ ID NO: 1595434 - RNA, 23 nt, Homo sapiens
auauaugugugcccuggacuguu

SEQ ID NO: 1595435 - RNA, 16 nt, Homo sapiens
auauauuguaaagaag

SEQ ID NO: 1595436 - RNA, 17 nt, Homo sapiens
auauauuuacagaagaa

SEQ ID NO: 1595437 - RNA, 20 nt, Homo sapiens
auauauuuauauacuuuuuc

SEQ ID NO: 1595438 - RNA, 18 nt, Homo sapiens
auauauuugaaauaguau

SEQ ID NO: 1595439 - RNA, 20 nt, Homo sapiens
auauauuuuugugcacauuu

SEQ ID NO: 1595440 - RNA, 21 nt, Homo sapiens
auaucaacccucucuacaggu

SEQ ID NO: 1595441 - RNA, 14 nt, Homo sapiens
auaucacauuccca

SEQ ID NO: 1595442 - RNA, 19 nt, Homo sapiens
auaucacauuggagucacu

SEQ ID NO: 1595443 - RNA, 11 nt, Homo sapiens
auaucagggaa

SEQ ID NO: 1595444 - RNA, 20 nt, Homo sapiens
auaucagggguacauucuag

SEQ ID NO: 1595445 - RNA, 19 nt, Homo sapiens
auaucauaacuauacuuga

SEQ ID NO: 1595446 - RNA, 14 nt, Homo sapiens
auaucaugcaaaau

SEQ ID NO: 1595447 - RNA, 18 nt, Homo sapiens
auauccuguguaccucac

SEQ ID NO: 1595448 - RNA, 15 nt, Homo sapiens
auauccuuucacucu

SEQ ID NO: 1595449 - RNA, 17 nt, Homo sapiens
auauccuuucacucugc

SEQ ID NO: 1595450 - RNA, 19 nt, Homo sapiens
auaucgcuggccagcauua

SEQ ID NO: 1595451 - RNA, 17 nt, Homo sapiens
auaucuauaguagacac

SEQ ID NO: 1595452 - RNA, 20 nt, Homo sapiens
auaucugaagagcuauuaua

SEQ ID NO: 1595453 - RNA, 11 nt, Homo sapiens
auaucuuggcc

SEQ ID NO: 1595454 - RNA, 15 nt, Homo sapiens
auaugaaaaucucca

SEQ ID NO: 1595455 - RNA, 17 nt, Homo sapiens
auaugaaugucaguagu

SEQ ID NO: 1595456 - RNA, 13 nt, Homo sapiens
auaugcagccgcu

SEQ ID NO: 1595457 - RNA, 18 nt, Homo sapiens
auauggaagcaaccagca

SEQ ID NO: 1595458 - RNA, 22 nt, Homo sapiens
auauggcaaauagccacaauua

SEQ ID NO: 1595459 - RNA, 18 nt, Homo sapiens
auauguaaagcacaucag

SEQ ID NO: 1595460 - RNA, 16 nt, Homo sapiens
auaugucagggcacau

SEQ ID NO: 1595461 - RNA, 20 nt, Homo sapiens
auaugucagggcacauguga

SEQ ID NO: 1595462 - RNA, 15 nt, Homo sapiens
auauguccacuguuc

SEQ ID NO: 1595463 - RNA, 22 nt, Homo sapiens
auauguccacuguucuguucuc

SEQ ID NO: 1595464 - RNA, 22 nt, Homo sapiens
auaugugaaaggauaugaaucu

SEQ ID NO: 1595465 - RNA, 11 nt, Homo sapiens
auaugugccaa

SEQ ID NO: 1595466 - RNA, 21 nt, Homo sapiens
auauuacauuucaaaccaauu

SEQ ID NO: 1595467 - RNA, 15 nt, Homo sapiens
auauuaccuaaugaa

SEQ ID NO: 1595468 - RNA, 12 nt, Homo sapiens
auauuaucucau

SEQ ID NO: 1595469 - RNA, 19 nt, Homo sapiens
auauuauuuuaguguguaa

SEQ ID NO: 1595470 - RNA, 20 nt, Homo sapiens
auauucacugguuuuacaca

SEQ ID NO: 1595471 - RNA, 17 nt, Homo sapiens
auauucagccagcuuaa

SEQ ID NO: 1595472 - RNA, 16 nt, Homo sapiens
auauucaggacuugaa

SEQ ID NO: 1595473 - RNA, 15 nt, Homo sapiens
auauuccagguuuaa

SEQ ID NO: 1595474 - RNA, 23 nt, Homo sapiens
auauucccugcacacacaugcau

SEQ ID NO: 1595475 - RNA, 20 nt, Homo sapiens
auauuccuuuuucuaugaaa

SEQ ID NO: 1595476 - RNA, 23 nt, Homo sapiens
auauucuguugcuuuacaguuac

SEQ ID NO: 1595477 - RNA, 20 nt, Homo sapiens
auauugagcaauaugucagu

SEQ ID NO: 1595478 - RNA, 21 nt, Homo sapiens
auauugagcagaauucauuca

SEQ ID NO: 1595479 - RNA, 16 nt, Homo sapiens
auauugagggagacag

SEQ ID NO: 1595480 - RNA, 19 nt, Homo sapiens
auauugcagcuuauauuca

SEQ ID NO: 1595481 - RNA, 20 nt, Homo sapiens
auauugcagcuuauauucau

SEQ ID NO: 1595482 - RNA, 17 nt, Homo sapiens
auauuggaaaaaucaca

SEQ ID NO: 1595483 - RNA, 15 nt, Homo sapiens
auauugucauuguca

SEQ ID NO: 1595484 - RNA, 13 nt, Homo sapiens
auauugugcaaac

SEQ ID NO: 1595485 - RNA, 19 nt, Homo sapiens
auauuguguugacuuuaua

SEQ ID NO: 1595486 - RNA, 14 nt, Homo sapiens
aucuugugcuucuu

SEQ ID NO: 1595487 - RNA, 16 nt, Homo sapiens
aucuuguuuacaauaa

SEQ ID NO: 1595488 - RNA, 22 nt, Homo sapiens
aucuuguuuugaaaauaaccua

SEQ ID NO: 1595489 - RNA, 20 nt, Homo sapiens
aucuuuacaaaacuacauga

SEQ ID NO: 1595490 - RNA, 17 nt, Homo sapiens
aucuuucauccuugacu

SEQ ID NO: 1595491 - RNA, 13 nt, Homo sapiens
aucuuucuuccaa

SEQ ID NO: 1595492 - RNA, 17 nt, Homo sapiens
aucuuucuuuccaaaac

SEQ ID NO: 1595493 - RNA, 16 nt, Homo sapiens
aucuuugggccugucc

SEQ ID NO: 1595494 - RNA, 18 nt, Homo sapiens
aucuuuguauauaugugu

SEQ ID NO: 1595495 - RNA, 14 nt, Homo sapiens
aucuuugugacagg

SEQ ID NO: 1595496 - RNA, 23 nt, Homo sapiens
aucuuuguguaaucuaaguauau

SEQ ID NO: 1595497 - RNA, 11 nt, Homo sapiens
aucuuuuacau

SEQ ID NO: 1595498 - RNA, 19 nt, Homo sapiens
aucuuuucuagagacacau

SEQ ID NO: 1595499 - RNA, 14 nt, Homo sapiens
augaaaaaggagag

SEQ ID NO: 1595500 - RNA, 12 nt, Homo sapiens
augaaaaauugg

SEQ ID NO: 1595501 - RNA, 18 nt, Homo sapiens
augaaaacucaugaucaa

SEQ ID NO: 1595502 - RNA, 19 nt, Homo sapiens
augaaaaucuccaucucaa

SEQ ID NO: 1595503 - RNA, 17 nt, Homo sapiens
augaaaaugaaccauuc

SEQ ID NO: 1595504 - RNA, 15 nt, Homo sapiens
augaaaaugagcccu

SEQ ID NO: 1595505 - RNA, 17 nt, Homo sapiens
augaaaaugucaauacu

SEQ ID NO: 1595506 - RNA, 21 nt, Homo sapiens
augaaaauuuauuuuuaguga

SEQ ID NO: 1595507 - RNA, 13 nt, Homo sapiens
augaaacaucauu

SEQ ID NO: 1595508 - RNA, 19 nt, Homo sapiens
augaaacuauuuuaccuga

SEQ ID NO: 1595509 - RNA, 16 nt, Homo sapiens
augaaagggcaaagac

SEQ ID NO: 1595510 - RNA, 16 nt, Homo sapiens
augaaaguggacaagg

SEQ ID NO: 1595511 - RNA, 22 nt, Homo sapiens
augaaauaaaagcacacugcuu

SEQ ID NO: 1595512 - RNA, 13 nt, Homo sapiens
augaaauccagug

SEQ ID NO: 1595513 - RNA, 13 nt, Homo sapiens
augaacaauguau

SEQ ID NO: 1595514 - RNA, 22 nt, Homo sapiens
augaacccuuccugagcuuuau

SEQ ID NO: 1595515 - RNA, 14 nt, Homo sapiens
augaacuauugccu

SEQ ID NO: 1595516 - RNA, 16 nt, Homo sapiens
augaagacaucaggaa

SEQ ID NO: 1595517 - RNA, 17 nt, Homo sapiens
augaagaugggcuucau

SEQ ID NO: 1595518 - RNA, 14 nt, Homo sapiens
augaagcacugagc

SEQ ID NO: 1595519 - RNA, 15 nt, Homo sapiens
augaagcacugagca

SEQ ID NO: 1595520 - RNA, 20 nt, Homo sapiens
augaagccaagugggauuug

SEQ ID NO: 1595521 - RNA, 17 nt, Homo sapiens
augaagcuuugguucuc

SEQ ID NO: 1595522 - RNA, 20 nt, Homo sapiens
augaaggcaggggcucagug

SEQ ID NO: 1595523 - RNA, 22 nt, Homo sapiens
augaaguacagcagaagcccca

SEQ ID NO: 1595524 - RNA, 17 nt, Homo sapiens
augaaguacucauacau

SEQ ID NO: 1595525 - RNA, 17 nt, Homo sapiens
augaaguaucuuugaca

SEQ ID NO: 1595526 - RNA, 16 nt, Homo sapiens
augaaguauuacauga

SEQ ID NO: 1595527 - RNA, 21 nt, Homo sapiens
augaauaacauuuaaauucca

SEQ ID NO: 1595528 - RNA, 12 nt, Homo sapiens
augaaugaaacu

SEQ ID NO: 1595529 - RNA, 13 nt, Homo sapiens
augaaugcagauu

SEQ ID NO: 1595530 - RNA, 21 nt, Homo sapiens
augaaugcagauuacacugau

SEQ ID NO: 1595531 - RNA, 24 nt, Homo sapiens
augaaugcuuuuagugugugcaua

SEQ ID NO: 1595532 - RNA, 15 nt, Homo sapiens
augaaugugcugaag

SEQ ID NO: 1595533 - RNA, 13 nt, Homo sapiens
augaauuauuaua

SEQ ID NO: 1595534 - RNA, 21 nt, Homo sapiens
augaauuugagcaggucucau

SEQ ID NO: 1595535 - RNA, 20 nt, Homo sapiens
augacaaaugacgucuucac

SEQ ID NO: 1595536 - RNA, 12 nt, Homo sapiens
augacacuacuu

SEQ ID NO: 1595537 - RNA, 16 nt, Homo sapiens
augacacuacuugaua

SEQ ID NO: 1595538 - RNA, 17 nt, Homo sapiens
augacagagaugugcau

SEQ ID NO: 1595539 - RNA, 18 nt, Homo sapiens
augacagcugucccuguc

SEQ ID NO: 1595540 - RNA, 22 nt, Homo sapiens
augacagugaagcagcacugug

SEQ ID NO: 1595541 - RNA, 19 nt, Homo sapiens
augaccaggccaagacuca

SEQ ID NO: 1595542 - RNA, 19 nt, Homo sapiens
augacccaggccuggccag

SEQ ID NO: 1595543 - RNA, 20 nt, Homo sapiens
augaccuggcaacaaaaagu

SEQ ID NO: 1595544 - RNA, 23 nt, Homo sapiens
augacgguguccaugccuuccau

SEQ ID NO: 1595545 - RNA, 15 nt, Homo sapiens
augacuuaaccauau

SEQ ID NO: 1595546 - RNA, 13 nt, Homo sapiens
augacuuacuuuc

SEQ ID NO: 1595547 - RNA, 15 nt, Homo sapiens
augacuuacuuuccu

SEQ ID NO: 1595548 - RNA, 17 nt, Homo sapiens
augagaaaagaaauuag

SEQ ID NO: 1595549 - RNA, 14 nt, Homo sapiens
augagaacaagcua

SEQ ID NO: 1595550 - RNA, 16 nt, Homo sapiens
augagaacaagcuauu

SEQ ID NO: 1595551 - RNA, 13 nt, Homo sapiens
augagacagacau

SEQ ID NO: 1595552 - RNA, 18 nt, Homo sapiens
augagacauccagcagau

SEQ ID NO: 1595553 - RNA, 14 nt, Homo sapiens
augagagugcacug

SEQ ID NO: 1595554 - RNA, 21 nt, Homo sapiens
augagaguucuuuauauucaa

SEQ ID NO: 1595555 - RNA, 12 nt, Homo sapiens
augagaugacca

SEQ ID NO: 1595556 - RNA, 17 nt, Homo sapiens
augagaugagaugacca

SEQ ID NO: 1595557 - RNA, 17 nt, Homo sapiens
augagcaagacugggcc

SEQ ID NO: 1595558 - RNA, 16 nt, Homo sapiens
augagcacaucucucu

SEQ ID NO: 1595559 - RNA, 16 nt, Homo sapiens
augagccaaaccagca

SEQ ID NO: 1595560 - RNA, 17 nt, Homo sapiens
augagcuaaaacaucca

SEQ ID NO: 1595561 - RNA, 23 nt, Homo sapiens
augagcuggggaugucucucaug

SEQ ID NO: 1595562 - RNA, 22 nt, Homo sapiens
augagcuucaauauaagaagca

SEQ ID NO: 1595563 - RNA, 13 nt, Homo sapiens
augaggaaacuuu

SEQ ID NO: 1595564 - RNA, 22 nt, Homo sapiens
augaggaaggaacagcaauggu

SEQ ID NO: 1595565 - RNA, 13 nt, Homo sapiens
augaggacagagu

SEQ ID NO: 1595566 - RNA, 14 nt, Homo sapiens
augaggccaucuca

SEQ ID NO: 1595567 - RNA, 17 nt, Homo sapiens
augaggcuacagaacua

SEQ ID NO: 1595568 - RNA, 16 nt, Homo sapiens
augagggagaugccau

SEQ ID NO: 1595569 - RNA, 14 nt, Homo sapiens
augaguauggauug

SEQ ID NO: 1595570 - RNA, 16 nt, Homo sapiens
augaguuggacuucag

SEQ ID NO: 1595571 - RNA, 23 nt, Homo sapiens
augauaacguuagagaaacugaa

SEQ ID NO: 1595572 - RNA, 22 nt, Homo sapiens
augauagcagacauuguuacaa

SEQ ID NO: 1595573 - RNA, 21 nt, Homo sapiens
augaucaauccuuuauuauua

SEQ ID NO: 1595574 - RNA, 19 nt, Homo sapiens
augaucagaagaacaugau

SEQ ID NO: 1595575 - RNA, 18 nt, Homo sapiens
augaucagaagacuuuaa

SEQ ID NO: 1595576 - RNA, 20 nt, Homo sapiens
augauccucaugguucccaa

SEQ ID NO: 1595577 - RNA, 14 nt, Homo sapiens
augaucuuguguaa

SEQ ID NO: 1595578 - RNA, 21 nt, Homo sapiens
augaugaaaacuaaggauuuu

SEQ ID NO: 1595579 - RNA, 13 nt, Homo sapiens
augaugcaguuuu

SEQ ID NO: 1595580 - RNA, 15 nt, Homo sapiens
augaugcugucugaa

SEQ ID NO: 1595581 - RNA, 14 nt, Homo sapiens
augauggaugccaa

SEQ ID NO: 1595582 - RNA, 20 nt, Homo sapiens
augaugguuuuaaacuuuca

SEQ ID NO: 1595583 - RNA, 22 nt, Homo sapiens
augauguagauuacugaaaaau

SEQ ID NO: 1595584 - RNA, 15 nt, Homo sapiens
augaugugaaacacu

SEQ ID NO: 1595585 - RNA, 19 nt, Homo sapiens
augauucaaauugcugcuu

SEQ ID NO: 1595586 - RNA, 19 nt, Homo sapiens
augauucagaggucacuuc

SEQ ID NO: 1595587 - RNA, 21 nt, Homo sapiens
augauucagaggucacuucau

SEQ ID NO: 1595588 - RNA, 19 nt, Homo sapiens
augauuucauauugaucuu

SEQ ID NO: 1595589 - RNA, 17 nt, Homo sapiens
augauuuccuaguagaa

SEQ ID NO: 1595590 - RNA, 9 nt, Homo sapiens
augcaaaac

SEQ ID NO: 1595591 - RNA, 14 nt, Homo sapiens
augcaaccuaguca

SEQ ID NO: 1595592 - RNA, 13 nt, Homo sapiens
augcaagacccca

SEQ ID NO: 1595593 - RNA, 16 nt, Homo sapiens
augcaaguauccugcg

SEQ ID NO: 1595594 - RNA, 13 nt, Homo sapiens
augcaaugaacac

SEQ ID NO: 1595595 - RNA, 16 nt, Homo sapiens
augcaaugaacacuua

SEQ ID NO: 1595596 - RNA, 18 nt, Homo sapiens
augcaauggcucaucaga

SEQ ID NO: 1595597 - RNA, 17 nt, Homo sapiens
augcacaaaacuacuuu

SEQ ID NO: 1595598 - RNA, 13 nt, Homo sapiens
augcacacugaga

SEQ ID NO: 1595599 - RNA, 23 nt, Homo sapiens
augcaccaaucuuguuuauagca

SEQ ID NO: 1595600 - RNA, 16 nt, Homo sapiens
augcaccccugagcca

SEQ ID NO: 1595601 - RNA, 18 nt, Homo sapiens
augcaccccugagccagc

SEQ ID NO: 1595602 - RNA, 22 nt, Homo sapiens
augcacguggggcccacugcuc

SEQ ID NO: 1595603 - RNA, 15 nt, Homo sapiens
augcacugauguugu

SEQ ID NO: 1595604 - RNA, 19 nt, Homo sapiens
augcacuuggccugacuca

SEQ ID NO: 1595605 - RNA, 18 nt, Homo sapiens
auuucauuccauugccua

SEQ ID NO: 1595606 - RNA, 12 nt, Homo sapiens
auuuccaccucc

SEQ ID NO: 1595607 - RNA, 15 nt, Homo sapiens
auuuccacugugcag

SEQ ID NO: 1595608 - RNA, 15 nt, Homo sapiens
auuucccauuaaaga

SEQ ID NO: 1595609 - RNA, 21 nt, Homo sapiens
auuucccauuaaagagccagu

SEQ ID NO: 1595610 - RNA, 22 nt, Homo sapiens
auuucccauuaaagagccaguu

SEQ ID NO: 1595611 - RNA, 15 nt, Homo sapiens
auuuccccagccaca

SEQ ID NO: 1595612 - RNA, 15 nt, Homo sapiens
auuucccucuacuga

SEQ ID NO: 1595613 - RNA, 18 nt, Homo sapiens
auuuccuaguagaacuca

SEQ ID NO: 1595614 - RNA, 20 nt, Homo sapiens
auuuccuaguagaacucaca

SEQ ID NO: 1595615 - RNA, 13 nt, Homo sapiens
auuuccucugggc

SEQ ID NO: 1595616 - RNA, 13 nt, Homo sapiens
auuuccuuuaugu

SEQ ID NO: 1595617 - RNA, 20 nt, Homo sapiens
auuucgaagucaucauuccu

SEQ ID NO: 1595618 - RNA, 16 nt, Homo sapiens
auuucuaccugaguga

SEQ ID NO: 1595619 - RNA, 16 nt, Homo sapiens
auuucuauggcuuuca

SEQ ID NO: 1595620 - RNA, 12 nt, Homo sapiens
auuucucaaggg

SEQ ID NO: 1595621 - RNA, 15 nt, Homo sapiens
auuucucacacucua

SEQ ID NO: 1595622 - RNA, 22 nt, Homo sapiens
auuucucacacucuaacuguau

SEQ ID NO: 1595623 - RNA, 19 nt, Homo sapiens
auuucucaucaguaguuca

SEQ ID NO: 1595624 - RNA, 14 nt, Homo sapiens
auuucuccaaagcc

SEQ ID NO: 1595625 - RNA, 23 nt, Homo sapiens
auuucucccuguuauaagcagca

SEQ ID NO: 1595626 - RNA, 19 nt, Homo sapiens
auuucucuaacuccugcca

SEQ ID NO: 1595627 - RNA, 22 nt, Homo sapiens
auuucucuacuugucauaucac

SEQ ID NO: 1595628 - RNA, 21 nt, Homo sapiens
auuucucuuuuauucuguuau

SEQ ID NO: 1595629 - RNA, 18 nt, Homo sapiens
auuucugaaaaccuacca

SEQ ID NO: 1595630 - RNA, 16 nt, Homo sapiens
auuucugaacuguuac

SEQ ID NO: 1595631 - RNA, 17 nt, Homo sapiens
auuucugaacuguuaca

SEQ ID NO: 1595632 - RNA, 23 nt, Homo sapiens
auuucugaagaaguuaauucuua

SEQ ID NO: 1595633 - RNA, 17 nt, Homo sapiens
auuucugaagugcuugu

SEQ ID NO: 1595634 - RNA, 14 nt, Homo sapiens
auuucugacucuau

SEQ ID NO: 1595635 - RNA, 15 nt, Homo sapiens
auuucugcaucagcu

SEQ ID NO: 1595636 - RNA, 18 nt, Homo sapiens
auuucugcuaaauaucac

SEQ ID NO: 1595637 - RNA, 23 nt, Homo sapiens
auuucugcuaaauaucaccuagc

SEQ ID NO: 1595638 - RNA, 14 nt, Homo sapiens
auuucugcuuucuu

SEQ ID NO: 1595639 - RNA, 19 nt, Homo sapiens
auuucugucuuucugcuau

SEQ ID NO: 1595640 - RNA, 12 nt, Homo sapiens
auuucugugauu

SEQ ID NO: 1595641 - RNA, 17 nt, Homo sapiens
auuucuuaugugacauu

SEQ ID NO: 1595642 - RNA, 15 nt, Homo sapiens
auuucuucuacugcu

SEQ ID NO: 1595643 - RNA, 16 nt, Homo sapiens
auuucuucuacugcua

SEQ ID NO: 1595644 - RNA, 23 nt, Homo sapiens
auuucuucuucuaagaagacauu

SEQ ID NO: 1595645 - RNA, 21 nt, Homo sapiens
auuucuugaagaauaaauucu

SEQ ID NO: 1595646 - RNA, 16 nt, Homo sapiens
auuucuuggcauugga

SEQ ID NO: 1595647 - RNA, 19 nt, Homo sapiens
auuucuuuuguuguacuuu

SEQ ID NO: 1595648 - RNA, 17 nt, Homo sapiens
auuugaagaacauguga

SEQ ID NO: 1595649 - RNA, 16 nt, Homo sapiens
auuugaucacuacaag

SEQ ID NO: 1595650 - RNA, 16 nt, Homo sapiens
auuugcauaaagugaa

SEQ ID NO: 1595651 - RNA, 15 nt, Homo sapiens
auuugccauagccuu

SEQ ID NO: 1595652 - RNA, 19 nt, Homo sapiens
auuugccuccagugcaguc

SEQ ID NO: 1595653 - RNA, 13 nt, Homo sapiens
auuugcuaugagc

SEQ ID NO: 1595654 - RNA, 16 nt, Homo sapiens
auuugcuugcaaucua

SEQ ID NO: 1595655 - RNA, 20 nt, Homo sapiens
auuuggcagagucugaagaa

SEQ ID NO: 1595656 - RNA, 21 nt, Homo sapiens
auuugggauggaagcaggaca

SEQ ID NO: 1595657 - RNA, 15 nt, Homo sapiens
auuugggugaacaaa

SEQ ID NO: 1595658 - RNA, 17 nt, Homo sapiens
auuugguacacaugugu

SEQ ID NO: 1595659 - RNA, 18 nt, Homo sapiens
auuugguuaauaagaauu

SEQ ID NO: 1595660 - RNA, 23 nt, Homo sapiens
auuuguaugguuccaaagacacu

SEQ ID NO: 1595661 - RNA, 18 nt, Homo sapiens
auuuguauucucugcaau

SEQ ID NO: 1595662 - RNA, 21 nt, Homo sapiens
auuuguauucucugcaauuuu

SEQ ID NO: 1595663 - RNA, 23 nt, Homo sapiens
auuugucacaaauaaacauaaua

SEQ ID NO: 1595664 - RNA, 16 nt, Homo sapiens
auuuguuaauaucacu

SEQ ID NO: 1595665 - RNA, 23 nt, Homo sapiens
auuuguucucccaaaacagauua

SEQ ID NO: 1595666 - RNA, 22 nt, Homo sapiens
auuuguugggagucacauuugc

SEQ ID NO: 1595667 - RNA, 18 nt, Homo sapiens
auuuguuugugacaacua

SEQ ID NO: 1595668 - RNA, 16 nt, Homo sapiens
auuuguuuucaacaau

SEQ ID NO: 1595669 - RNA, 13 nt, Homo sapiens
auuuuaaagacaa

SEQ ID NO: 1595670 - RNA, 21 nt, Homo sapiens
auuuuaaugaagaaaguggaa

SEQ ID NO: 1595671 - RNA, 19 nt, Homo sapiens
auuuuaaugaagugcaaua

SEQ ID NO: 1595672 - RNA, 12 nt, Homo sapiens
auuuuacauuga

SEQ ID NO: 1595673 - RNA, 13 nt, Homo sapiens
auuuuaccaaagc

SEQ ID NO: 1595674 - RNA, 19 nt, Homo sapiens
auuuuaccaaagcaucaau

SEQ ID NO: 1595675 - RNA, 12 nt, Homo sapiens
auuuuacuguau

SEQ ID NO: 1595676 - RNA, 18 nt, Homo sapiens
auuuuacuuuucugccaa

SEQ ID NO: 1595677 - RNA, 20 nt, Homo sapiens
auuuuacuuuucugccaaaa

SEQ ID NO: 1595678 - RNA, 15 nt, Homo sapiens
auuuuagaaagcuaa

SEQ ID NO: 1595679 - RNA, 14 nt, Homo sapiens
auuuuagacacuuc

SEQ ID NO: 1595680 - RNA, 21 nt, Homo sapiens
auuuuaguguguaaaauuaau

SEQ ID NO: 1595681 - RNA, 20 nt, Homo sapiens
auuuuaguuaaacucugaca

SEQ ID NO: 1595682 - RNA, 23 nt, Homo sapiens
auuuuauaguguguugugcuuuc

SEQ ID NO: 1595683 - RNA, 19 nt, Homo sapiens
auuuuaucuaaauuacagu

SEQ ID NO: 1595684 - RNA, 13 nt, Homo sapiens
auuuuaugaacau

SEQ ID NO: 1595685 - RNA, 23 nt, Homo sapiens
auuuuauggugaugucacucacc

SEQ ID NO: 1595686 - RNA, 20 nt, Homo sapiens
auuuucacacguaagcacau

SEQ ID NO: 1595687 - RNA, 14 nt, Homo sapiens
auuuucagcauuaa

SEQ ID NO: 1595688 - RNA, 23 nt, Homo sapiens
auuuucaucccguaucacagugu

SEQ ID NO: 1595689 - RNA, 12 nt, Homo sapiens
auuuucauuccu

SEQ ID NO: 1595690 - RNA, 19 nt, Homo sapiens
auuuuccaaauuacagcau

SEQ ID NO: 1595691 - RNA, 12 nt, Homo sapiens
auuuuccaguga

SEQ ID NO: 1595692 - RNA, 22 nt, Homo sapiens
auuuucucccucuuucuuccca

SEQ ID NO: 1595693 - RNA, 22 nt, Homo sapiens
auuuucucuuuguaugucuguu

SEQ ID NO: 1595694 - RNA, 17 nt, Homo sapiens
auuuucuuccccaagcu

SEQ ID NO: 1595695 - RNA, 20 nt, Homo sapiens
auuuucuucucugcacuuau

SEQ ID NO: 1595696 - RNA, 19 nt, Homo sapiens
auuuugagcccccauucca

SEQ ID NO: 1595697 - RNA, 20 nt, Homo sapiens
auuuugagcccccauuccac

SEQ ID NO: 1595698 - RNA, 21 nt, Homo sapiens
auuuugauugcuuaccuacau

SEQ ID NO: 1595699 - RNA, 13 nt, Homo sapiens
auuuugcaaaaau

SEQ ID NO: 1595700 - RNA, 14 nt, Homo sapiens
auuuugcaccagcg

SEQ ID NO: 1595701 - RNA, 16 nt, Homo sapiens
auuuuggcgaaucuca

SEQ ID NO: 1595702 - RNA, 17 nt, Homo sapiens
auuuugguacugugaug

SEQ ID NO: 1595703 - RNA, 15 nt, Homo sapiens
auuuuguaugccaau

SEQ ID NO: 1595704 - RNA, 19 nt, Homo sapiens
auuuuguuauugacuaaca

SEQ ID NO: 1595705 - RNA, 12 nt, Homo sapiens
auuuuguugcau

SEQ ID NO: 1595706 - RNA, 18 nt, Homo sapiens
auuuuguuuucuguggag

SEQ ID NO: 1595707 - RNA, 15 nt, Homo sapiens
auuuuuaaauauuca

SEQ ID NO: 1595708 - RNA, 21 nt, Homo sapiens
auuuuuaauguuuguacacaa

SEQ ID NO: 1595709 - RNA, 15 nt, Homo sapiens
auuuuuagaauuaaa

SEQ ID NO: 1595710 - RNA, 18 nt, Homo sapiens
auuuuuauaaacuaccaa

SEQ ID NO: 1595711 - RNA, 18 nt, Homo sapiens
auuuuuauacagugauaa

SEQ ID NO: 1595712 - RNA, 14 nt, Homo sapiens
auuuuucaaagcaa

SEQ ID NO: 1595713 - RNA, 16 nt, Homo sapiens
auuuuucaucaaacau

SEQ ID NO: 1595714 - RNA, 17 nt, Homo sapiens
auuuuucuuuccaaguc

SEQ ID NO: 1595715 - RNA, 15 nt, Homo sapiens
auuuuugacauuaau

SEQ ID NO: 1595716 - RNA, 15 nt, Homo sapiens
auuuuugcaacuauu

SEQ ID NO: 1595717 - RNA, 12 nt, Homo sapiens
auuuuugcaaua

SEQ ID NO: 1595718 - RNA, 13 nt, Homo sapiens
auuuuugugcaca

SEQ ID NO: 1595719 - RNA, 13 nt, Homo sapiens
auuuuuuacuuga

SEQ ID NO: 1595720 - RNA, 16 nt, Homo sapiens
auuuuuugaaaguuaa

SEQ ID NO: 1595721 - RNA, 19 nt, Homo sapiens
auuuuuuuuguaacuucaa

SEQ ID NO: 1595722 - RNA, 16 nt, Homo sapiens
auuuuuuuuugaagca

SEQ ID NO: 1595723 - RNA, 13 nt, Homo sapiens
ccaagugggaaug

SEQ ID NO: 1595724 - RNA, 16 nt, Homo sapiens
ccaauaaaccagugug

SEQ ID NO: 1595725 - RNA, 13 nt, Homo sapiens
ccaauacuacuga

SEQ ID NO: 1595726 - RNA, 16 nt, Homo sapiens
ccaauagcacuuucau

SEQ ID NO: 1595727 - RNA, 20 nt, Homo sapiens
ccaauagcacuuucauugcc

SEQ ID NO: 1595728 - RNA, 19 nt, Homo sapiens
ccaauagggcugagcucuc

SEQ ID NO: 1595729 - RNA, 14 nt, Homo sapiens
ccaauauuuugccu

SEQ ID NO: 1595730 - RNA, 20 nt, Homo sapiens
ccaaucagcacucuguaaaa

SEQ ID NO: 1595731 - RNA, 21 nt, Homo sapiens
ccaaucagcaggauucuaaaa

SEQ ID NO: 1595732 - RNA, 19 nt, Homo sapiens
ccaaucagcuuuuguucua

SEQ ID NO: 1595733 - RNA, 17 nt, Homo sapiens
ccaauccccagacucaa

SEQ ID NO: 1595734 - RNA, 12 nt, Homo sapiens
ccaaucugcaag

SEQ ID NO: 1595735 - RNA, 23 nt, Homo sapiens
ccaaucugucacauaaaagucug

SEQ ID NO: 1595736 - RNA, 19 nt, Homo sapiens
ccaaugacacccaugccag

SEQ ID NO: 1595737 - RNA, 19 nt, Homo sapiens
ccaaugagaucauugugaa

SEQ ID NO: 1595738 - RNA, 23 nt, Homo sapiens
ccaauguucuaaaguuuugcaac

SEQ ID NO: 1595739 - RNA, 20 nt, Homo sapiens
ccaauuagacaaacagcauc

SEQ ID NO: 1595740 - RNA, 13 nt, Homo sapiens
ccaauucaauaca

SEQ ID NO: 1595741 - RNA, 14 nt, Homo sapiens
ccaauucugaaaua

SEQ ID NO: 1595742 - RNA, 21 nt, Homo sapiens
ccacaagaacaauucaagaaa

SEQ ID NO: 1595743 - RNA, 22 nt, Homo sapiens
ccacaaggccugaggagcagug

SEQ ID NO: 1595744 - RNA, 18 nt, Homo sapiens
ccacaaugcugaugaaaa

SEQ ID NO: 1595745 - RNA, 15 nt, Homo sapiens
ccacacagacuccac

SEQ ID NO: 1595746 - RNA, 13 nt, Homo sapiens
ccacacagguguu

SEQ ID NO: 1595747 - RNA, 19 nt, Homo sapiens
ccacacauuaguacuuaug

SEQ ID NO: 1595748 - RNA, 21 nt, Homo sapiens
ccacaccuggcauggugcagg

SEQ ID NO: 1595749 - RNA, 22 nt, Homo sapiens
ccacaccuggcccuugcaaucu

SEQ ID NO: 1595750 - RNA, 14 nt, Homo sapiens
ccacacuuccauga

SEQ ID NO: 1595751 - RNA, 20 nt, Homo sapiens
ccacagaggagggacucaga

SEQ ID NO: 1595752 - RNA, 15 nt, Homo sapiens
ccacagagugcugga

SEQ ID NO: 1595753 - RNA, 12 nt, Homo sapiens
ccacagcaguug

SEQ ID NO: 1595754 - RNA, 23 nt, Homo sapiens
ccacagcaguugaaaagacucca

SEQ ID NO: 1595755 - RNA, 21 nt, Homo sapiens
ccacaggccugagauuucauc

SEQ ID NO: 1595756 - RNA, 15 nt, Homo sapiens
ccacauaagaaggca

SEQ ID NO: 1595757 - RNA, 18 nt, Homo sapiens
ccacauauagagcuccag

SEQ ID NO: 1595758 - RNA, 22 nt, Homo sapiens
ccacauauagagcuccagggac

SEQ ID NO: 1595759 - RNA, 19 nt, Homo sapiens
ccacauauuuuagacacuu

SEQ ID NO: 1595760 - RNA, 16 nt, Homo sapiens
ccacaucccaguuucu

SEQ ID NO: 1595761 - RNA, 17 nt, Homo sapiens
ccacaucucaguuaucu

SEQ ID NO: 1595762 - RNA, 13 nt, Homo sapiens
ccacaugcauguc

SEQ ID NO: 1595763 - RNA, 23 nt, Homo sapiens
ccacaugcaugucugccuaugca

SEQ ID NO: 1595764 - RNA, 22 nt, Homo sapiens
ccacaugggagcaguccaugca

SEQ ID NO: 1595765 - RNA, 21 nt, Homo sapiens
ccaccaagaaguggcugccaa

SEQ ID NO: 1595766 - RNA, 21 nt, Homo sapiens
ccaccacuuuuggauuuuaug

SEQ ID NO: 1595767 - RNA, 18 nt, Homo sapiens
ccaccagggaucacagac

SEQ ID NO: 1595768 - RNA, 19 nt, Homo sapiens
ccaccaggugccuuucaaa

SEQ ID NO: 1595769 - RNA, 15 nt, Homo sapiens
ccaccaggugucaaa

SEQ ID NO: 1595770 - RNA, 18 nt, Homo sapiens
ccaccauuuaauuucaug

SEQ ID NO: 1595771 - RNA, 13 nt, Homo sapiens
ccacccagucuca

SEQ ID NO: 1595772 - RNA, 15 nt, Homo sapiens
ccacccagugcugaa

SEQ ID NO: 1595773 - RNA, 13 nt, Homo sapiens
ccaccccacacuu

SEQ ID NO: 1595774 - RNA, 15 nt, Homo sapiens
ccacccgggggagcc

SEQ ID NO: 1595775 - RNA, 13 nt, Homo sapiens
ccacccuaguccc

SEQ ID NO: 1595776 - RNA, 17 nt, Homo sapiens
ccacccuccugucuucc

SEQ ID NO: 1595777 - RNA, 17 nt, Homo sapiens
ccaccguucagucauuu

SEQ ID NO: 1595778 - RNA, 14 nt, Homo sapiens
ccaccuauccccau

SEQ ID NO: 1595779 - RNA, 20 nt, Homo sapiens
ccaccuaugccuguggugaa

SEQ ID NO: 1595780 - RNA, 15 nt, Homo sapiens
ccaccuaugugccaa

SEQ ID NO: 1595781 - RNA, 14 nt, Homo sapiens
ccaccucaccaaaa

SEQ ID NO: 1595782 - RNA, 17 nt, Homo sapiens
ccaccugccacaguuca

SEQ ID NO: 1595783 - RNA, 19 nt, Homo sapiens
ccaccuuugccacaaagcu

SEQ ID NO: 1595784 - RNA, 13 nt, Homo sapiens
ccacgaauauucu

SEQ ID NO: 1595785 - RNA, 22 nt, Homo sapiens
ccacgagcuguuuacuagggau

SEQ ID NO: 1595786 - RNA, 16 nt, Homo sapiens
ccacgugcugcugaca

SEQ ID NO: 1595787 - RNA, 23 nt, Homo sapiens
ccacuauccuggcaacucaaggc

SEQ ID NO: 1595788 - RNA, 17 nt, Homo sapiens
ccacucaagaagacacu

SEQ ID NO: 1595789 - RNA, 12 nt, Homo sapiens
ccacuccagaga

SEQ ID NO: 1595790 - RNA, 16 nt, Homo sapiens
ccacucggcggcagca

SEQ ID NO: 1595791 - RNA, 15 nt, Homo sapiens
ccacucuguccugga

SEQ ID NO: 1595792 - RNA, 18 nt, Homo sapiens
ccacugaagcaccacagg

SEQ ID NO: 1595793 - RNA, 22 nt, Homo sapiens
ccacugcugggggugagcugua

SEQ ID NO: 1595794 - RNA, 13 nt, Homo sapiens
ccacuggggacuu

SEQ ID NO: 1595795 - RNA, 20 nt, Homo sapiens
ccacuguacauuuuuauaca

SEQ ID NO: 1595796 - RNA, 18 nt, Homo sapiens
ccacuguggcacuggcca

SEQ ID NO: 1595797 - RNA, 17 nt, Homo sapiens
ccacuguucuguucuca

SEQ ID NO: 1595798 - RNA, 13 nt, Homo sapiens
ccacuuaugcaua

SEQ ID NO: 1595799 - RNA, 13 nt, Homo sapiens
ccacuucaccccc

SEQ ID NO: 1595800 - RNA, 18 nt, Homo sapiens
ccacuucacuuucuucaa

SEQ ID NO: 1595801 - RNA, 24 nt, Homo sapiens
ccacuugccugugcuacaauucau

SEQ ID NO: 1595802 - RNA, 17 nt, Homo sapiens
ccacuuucaagacagau

SEQ ID NO: 1595803 - RNA, 14 nt, Homo sapiens
ccagaaaggugauu

SEQ ID NO: 1595804 - RNA, 12 nt, Homo sapiens
ccagaacacucu

SEQ ID NO: 1595805 - RNA, 17 nt, Homo sapiens
ccagaauggagccugcu

SEQ ID NO: 1595806 - RNA, 23 nt, Homo sapiens
ccagaaugguacacaaugugauu

SEQ ID NO: 1595807 - RNA, 21 nt, Homo sapiens
ccagacaaaaauaucaauggu

SEQ ID NO: 1595808 - RNA, 19 nt, Homo sapiens
ccagacaccaugugcaaua

SEQ ID NO: 1595809 - RNA, 15 nt, Homo sapiens
ccagacccacaaggc

SEQ ID NO: 1595810 - RNA, 12 nt, Homo sapiens
ccagacccagug

SEQ ID NO: 1595811 - RNA, 22 nt, Homo sapiens
ccagaccuagcaggcuguucca

SEQ ID NO: 1595812 - RNA, 22 nt, Homo sapiens
ccagacuaaaggauccagagag

SEQ ID NO: 1595813 - RNA, 14 nt, Homo sapiens
ccagacucucaggu

SEQ ID NO: 1595814 - RNA, 15 nt, Homo sapiens
ccagacucucaggug

SEQ ID NO: 1595815 - RNA, 23 nt, Homo sapiens
ccagacuugggaggauguacagu

SEQ ID NO: 1595816 - RNA, 17 nt, Homo sapiens
ccagagaaaaagggagg

SEQ ID NO: 1595817 - RNA, 16 nt, Homo sapiens
ccagagacaagcagag

SEQ ID NO: 1595818 - RNA, 13 nt, Homo sapiens
ccagagagagcuc

SEQ ID NO: 1595819 - RNA, 14 nt, Homo sapiens
ccagagaugacuau

SEQ ID NO: 1595820 - RNA, 18 nt, Homo sapiens
ccagagauggucacauga

SEQ ID NO: 1595821 - RNA, 15 nt, Homo sapiens
ccagagcaaacagaa

SEQ ID NO: 1595822 - RNA, 15 nt, Homo sapiens
ccagagcaucugccc

SEQ ID NO: 1595823 - RNA, 23 nt, Homo sapiens
ccagaggaaagaccaugugguuu

SEQ ID NO: 1595824 - RNA, 11 nt, Homo sapiens
ccagagucaga

SEQ ID NO: 1595825 - RNA, 16 nt, Homo sapiens
ccagaguggagucuga

SEQ ID NO: 1595826 - RNA, 20 nt, Homo sapiens
ccagaguggccuggccagga

SEQ ID NO: 1595827 - RNA, 18 nt, Homo sapiens
ccagaucgauccuggauu

SEQ ID NO: 1595828 - RNA, 15 nt, Homo sapiens
ccagauggccccucc

SEQ ID NO: 1595829 - RNA, 20 nt, Homo sapiens
ccagauguuaugcuccugcu

SEQ ID NO: 1595830 - RNA, 20 nt, Homo sapiens
ccagauucugccucucugga

SEQ ID NO: 1595831 - RNA, 14 nt, Homo sapiens
ccagauuggcucac

SEQ ID NO: 1595832 - RNA, 16 nt, Homo sapiens
ccagcaagcucuucac

SEQ ID NO: 1595833 - RNA, 12 nt, Homo sapiens
ccagcacccucu

SEQ ID NO: 1595834 - RNA, 22 nt, Homo sapiens
ccagcaccuauugaauuaccau

SEQ ID NO: 1595835 - RNA, 15 nt, Homo sapiens
ccagcacuaugcuuu

SEQ ID NO: 1595836 - RNA, 14 nt, Homo sapiens
ccagcacugaggaa

SEQ ID NO: 1595837 - RNA, 12 nt, Homo sapiens
ccagcacuuugg

SEQ ID NO: 1595838 - RNA, 16 nt, Homo sapiens
ccagcagcagcacuua

SEQ ID NO: 1595839 - RNA, 17 nt, Homo sapiens
ccagcagcuuaagucca

SEQ ID NO: 1595840 - RNA, 16 nt, Homo sapiens
ccagcaggucaaaaag

SEQ ID NO: 1595841 - RNA, 19 nt, Homo sapiens
ccagcauccccaacugcga

SEQ ID NO: 1595842 - RNA, 21 nt, Homo sapiens
ccauuauuuugguuuaucuuc

SEQ ID NO: 1595843 - RNA, 15 nt, Homo sapiens
ccauucacuacaggu

SEQ ID NO: 1595844 - RNA, 12 nt, Homo sapiens
ccauucauucaa

SEQ ID NO: 1595845 - RNA, 21 nt, Homo sapiens
ccauucuacauacuauggaau

SEQ ID NO: 1595846 - RNA, 11 nt, Homo sapiens
ccauucucuga

SEQ ID NO: 1595847 - RNA, 20 nt, Homo sapiens
ccauucucugccuguacuga

SEQ ID NO: 1595848 - RNA, 20 nt, Homo sapiens
ccauugauuuaauguaauag

SEQ ID NO: 1595849 - RNA, 13 nt, Homo sapiens
ccauugucucaau

SEQ ID NO: 1595850 - RNA, 14 nt, Homo sapiens
ccauugucuuuaua

SEQ ID NO: 1595851 - RNA, 22 nt, Homo sapiens
ccauuguggccgccaugagcaa

SEQ ID NO: 1595852 - RNA, 13 nt, Homo sapiens
ccauuuacacuuu

SEQ ID NO: 1595853 - RNA, 21 nt, Homo sapiens
ccauuucccauuaaagagcca

SEQ ID NO: 1595854 - RNA, 15 nt, Homo sapiens
ccauuuuggugcuua

SEQ ID NO: 1595855 - RNA, 17 nt, Homo sapiens
ccauuuuuuucuuuacu

SEQ ID NO: 1595856 - RNA, 18 nt, Homo sapiens
cccaaaacucaagcaaga

SEQ ID NO: 1595857 - RNA, 13 nt, Homo sapiens
cccaaaaggcaga

SEQ ID NO: 1595858 - RNA, 13 nt, Homo sapiens
cccaaacccuuaa

SEQ ID NO: 1595859 - RNA, 10 nt, Homo sapiens
cccaaacuuu

SEQ ID NO: 1595860 - RNA, 16 nt, Homo sapiens
cccaaauagaacaaga

SEQ ID NO: 1595861 - RNA, 12 nt, Homo sapiens
cccaaaucugca

SEQ ID NO: 1595862 - RNA, 16 nt, Homo sapiens
cccaaauuucauaccu

SEQ ID NO: 1595863 - RNA, 20 nt, Homo sapiens
cccaaauuucauaccuauca

SEQ ID NO: 1595864 - RNA, 15 nt, Homo sapiens
cccaacacuuugaga

SEQ ID NO: 1595865 - RNA, 13 nt, Homo sapiens
cccaacccaugaa

SEQ ID NO: 1595866 - RNA, 16 nt, Homo sapiens
cccaaccccaguggau

SEQ ID NO: 1595867 - RNA, 16 nt, Homo sapiens
cccaaccuucuuguca

SEQ ID NO: 1595868 - RNA, 21 nt, Homo sapiens
cccaagacaugacauucuuag

SEQ ID NO: 1595869 - RNA, 14 nt, Homo sapiens
cccaagacucccau

SEQ ID NO: 1595870 - RNA, 21 nt, Homo sapiens
cccaagauuuuuucauuucaa

SEQ ID NO: 1595871 - RNA, 13 nt, Homo sapiens
cccaagcgucauc

SEQ ID NO: 1595872 - RNA, 22 nt, Homo sapiens
cccaagcugaauguucuugaau

SEQ ID NO: 1595873 - RNA, 12 nt, Homo sapiens
cccaagugccaa

SEQ ID NO: 1595874 - RNA, 15 nt, Homo sapiens
cccaauaaaggcagc

SEQ ID NO: 1595875 - RNA, 14 nt, Homo sapiens
cccaauagcacuuu

SEQ ID NO: 1595876 - RNA, 16 nt, Homo sapiens
cccaauccccagacuc

SEQ ID NO: 1595877 - RNA, 22 nt, Homo sapiens
cccacaccauaagcuacugcca

SEQ ID NO: 1595878 - RNA, 17 nt, Homo sapiens
cccacacuggagccauc

SEQ ID NO: 1595879 - RNA, 16 nt, Homo sapiens
cccaccauagggcaug

SEQ ID NO: 1595880 - RNA, 20 nt, Homo sapiens
cccacccaacuccacagggc

SEQ ID NO: 1595881 - RNA, 13 nt, Homo sapiens
cccacccagucuc

SEQ ID NO: 1595882 - RNA, 14 nt, Homo sapiens
cccacccagucuca

SEQ ID NO: 1595883 - RNA, 13 nt, Homo sapiens
cccaccccaucca

SEQ ID NO: 1595884 - RNA, 21 nt, Homo sapiens
cccacccccuucucugcucca

SEQ ID NO: 1595885 - RNA, 14 nt, Homo sapiens
cccacccgcuccca

SEQ ID NO: 1595886 - RNA, 20 nt, Homo sapiens
cccaccuccacucugccauu

SEQ ID NO: 1595887 - RNA, 19 nt, Homo sapiens
cccacuuggcaucauucac

SEQ ID NO: 1595888 - RNA, 17 nt, Homo sapiens
cccagaagccugaucuu

SEQ ID NO: 1595889 - RNA, 18 nt, Homo sapiens
cccagaaugccuccugca

SEQ ID NO: 1595890 - RNA, 18 nt, Homo sapiens
cccagacaauuccauuca

SEQ ID NO: 1595891 - RNA, 20 nt, Homo sapiens
cccagacaauuccauucaau

SEQ ID NO: 1595892 - RNA, 9 nt, Homo sapiens
cccagaccc

SEQ ID NO: 1595893 - RNA, 17 nt, Homo sapiens
cccagacuagauguagu

SEQ ID NO: 1595894 - RNA, 12 nt, Homo sapiens
cccagagcaucu

SEQ ID NO: 1595895 - RNA, 23 nt, Homo sapiens
cccagagcgaggaaaggauuuua

SEQ ID NO: 1595896 - RNA, 19 nt, Homo sapiens
cccagaggcucccaaucag

SEQ ID NO: 1595897 - RNA, 15 nt, Homo sapiens
cccagaucugguccc

SEQ ID NO: 1595898 - RNA, 23 nt, Homo sapiens
cccagcaaagucugcaucuggcg

SEQ ID NO: 1595899 - RNA, 19 nt, Homo sapiens
cccagcacacgaguuccag

SEQ ID NO: 1595900 - RNA, 13 nt, Homo sapiens
cccagcacugagg

SEQ ID NO: 1595901 - RNA, 11 nt, Homo sapiens
cccagcacuuu

SEQ ID NO: 1595902 - RNA, 14 nt, Homo sapiens
cccagcccaagcac

SEQ ID NO: 1595903 - RNA, 15 nt, Homo sapiens
cccagcccagagcca

SEQ ID NO: 1595904 - RNA, 16 nt, Homo sapiens
cccagccccaaagaca

SEQ ID NO: 1595905 - RNA, 14 nt, Homo sapiens
cccagccccuccaa

SEQ ID NO: 1595906 - RNA, 19 nt, Homo sapiens
cccagccccuccaaagguc

SEQ ID NO: 1595907 - RNA, 22 nt, Homo sapiens
cccagcccucggguccauagag

SEQ ID NO: 1595908 - RNA, 17 nt, Homo sapiens
cccagcuuucaaaggac

SEQ ID NO: 1595909 - RNA, 21 nt, Homo sapiens
cccaggaaagguuuuccuuau

SEQ ID NO: 1595910 - RNA, 16 nt, Homo sapiens
cccaggaaguggcuca

SEQ ID NO: 1595911 - RNA, 17 nt, Homo sapiens
cccaggaaguggcucag

SEQ ID NO: 1595912 - RNA, 22 nt, Homo sapiens
cccaggaccugcagggccaaug

SEQ ID NO: 1595913 - RNA, 20 nt, Homo sapiens
cccaggagccucacuggggc

SEQ ID NO: 1595914 - RNA, 12 nt, Homo sapiens
cccaggagucca

SEQ ID NO: 1595915 - RNA, 20 nt, Homo sapiens
cccaggcuagagugcaaugg

SEQ ID NO: 1595916 - RNA, 18 nt, Homo sapiens
cccaggcuggagugcagu

SEQ ID NO: 1595917 - RNA, 23 nt, Homo sapiens
cccagggaagccugggugucaag

SEQ ID NO: 1595918 - RNA, 21 nt, Homo sapiens
cccagggcugcgucugcaaag

SEQ ID NO: 1595919 - RNA, 17 nt, Homo sapiens
cccaggggcagccacac

SEQ ID NO: 1595920 - RNA, 18 nt, Homo sapiens
cccaggguagcccgccug

SEQ ID NO: 1595921 - RNA, 20 nt, Homo sapiens
cccaggucccauaaggguag

SEQ ID NO: 1595922 - RNA, 23 nt, Homo sapiens
cccagguggcccuaaaggacucu

SEQ ID NO: 1595923 - RNA, 17 nt, Homo sapiens
cccaguaccgcaucucc

SEQ ID NO: 1595924 - RNA, 19 nt, Homo sapiens
cccaguacuuccuggacaa

SEQ ID NO: 1595925 - RNA, 19 nt, Homo sapiens
cccagugcgugaagaccaa

SEQ ID NO: 1595926 - RNA, 14 nt, Homo sapiens
cccaguuagcacca

SEQ ID NO: 1595927 - RNA, 18 nt, Homo sapiens
cccaguucaguguugcau

SEQ ID NO: 1595928 - RNA, 23 nt, Homo sapiens
cccauacaauguauguacaauac

SEQ ID NO: 1595929 - RNA, 13 nt, Homo sapiens
cccaucaccagag

SEQ ID NO: 1595930 - RNA, 21 nt, Homo sapiens
cccaucagcacucuguaaaac

SEQ ID NO: 1595931 - RNA, 14 nt, Homo sapiens
cccaucagugcucu

SEQ ID NO: 1595932 - RNA, 15 nt, Homo sapiens
cccaucuccuuucau

SEQ ID NO: 1595933 - RNA, 22 nt, Homo sapiens
cccaucucuacaaaaauaaaga

SEQ ID NO: 1595934 - RNA, 20 nt, Homo sapiens
cccaucugaacacaaccaga

SEQ ID NO: 1595935 - RNA, 21 nt, Homo sapiens
cccaugagggagaugccauga

SEQ ID NO: 1595936 - RNA, 16 nt, Homo sapiens
cccauguaaccacugc

SEQ ID NO: 1595937 - RNA, 10 nt, Homo sapiens
cccauguauu

SEQ ID NO: 1595938 - RNA, 23 nt, Homo sapiens
cccaugucagauugaauguauuu

SEQ ID NO: 1595939 - RNA, 22 nt, Homo sapiens
cccaugugccucuccugggaca

SEQ ID NO: 1595940 - RNA, 18 nt, Homo sapiens
cccauuaaagagccaguu

SEQ ID NO: 1595941 - RNA, 21 nt, Homo sapiens
cccauuaaagagccaguuuau

SEQ ID NO: 1595942 - RNA, 18 nt, Homo sapiens
cccauuccaaagcuuuau

SEQ ID NO: 1595943 - RNA, 18 nt, Homo sapiens
cccauuccucccuccggc

SEQ ID NO: 1595944 - RNA, 23 nt, Homo sapiens
cccauuccugccugguccagugg

SEQ ID NO: 1595945 - RNA, 19 nt, Homo sapiens
cccauucuacacagagcag

SEQ ID NO: 1595946 - RNA, 14 nt, Homo sapiens
cccauuuacacuuu

SEQ ID NO: 1595947 - RNA, 18 nt, Homo sapiens
cccauuucccauuaaaga

SEQ ID NO: 1595948 - RNA, 17 nt, Homo sapiens
cccauuugugaagcuua

SEQ ID NO: 1595949 - RNA, 18 nt, Homo sapiens
ccccaauaaaggcagcug

SEQ ID NO: 1595950 - RNA, 14 nt, Homo sapiens
ccccaauccaugaa

SEQ ID NO: 1595951 - RNA, 21 nt, Homo sapiens
ccccaauuacagggugacuca

SEQ ID NO: 1595952 - RNA, 15 nt, Homo sapiens
ccccacaaugccaga

SEQ ID NO: 1595953 - RNA, 18 nt, Homo sapiens
ccccaccacaaacacagc

SEQ ID NO: 1595954 - RNA, 13 nt, Homo sapiens
ccccaccacugau

SEQ ID NO: 1595955 - RNA, 22 nt, Homo sapiens
ccccaccccaucuuugcugcca

SEQ ID NO: 1595956 - RNA, 21 nt, Homo sapiens
ccccagacucuucauucagug

SEQ ID NO: 1595957 - RNA, 14 nt, Homo sapiens
ccccagagcucuuu

SEQ ID NO: 1595958 - RNA, 14 nt, Homo sapiens
ccccagcauuucca

SEQ ID NO: 1595959 - RNA, 15 nt, Homo sapiens
ccccagccugggcca

SEQ ID NO: 1595960 - RNA, 22 nt, Homo sapiens
ccccaggcccagugggguggcc

SEQ ID NO: 1595961 - RNA, 19 nt, Homo sapiens
ccuguucagagcacucauu

SEQ ID NO: 1595962 - RNA, 22 nt, Homo sapiens
ccuguuccccaaggacucuucc

SEQ ID NO: 1595963 - RNA, 16 nt, Homo sapiens
ccuguuuuauauauua

SEQ ID NO: 1595964 - RNA, 15 nt, Homo sapiens
ccuuaaaacaauucu

SEQ ID NO: 1595965 - RNA, 16 nt, Homo sapiens
ccuuaaaaccaaagag

SEQ ID NO: 1595966 - RNA, 19 nt, Homo sapiens
ccuuaaauaucuuucacau

SEQ ID NO: 1595967 - RNA, 19 nt, Homo sapiens
ccuuaaccuuaaaauugau

SEQ ID NO: 1595968 - RNA, 23 nt, Homo sapiens
ccuuaacuuucauuaauaguguu

SEQ ID NO: 1595969 - RNA, 17 nt, Homo sapiens
ccuuaaggucuccaaac

SEQ ID NO: 1595970 - RNA, 13 nt, Homo sapiens
ccuuaaguauuau

SEQ ID NO: 1595971 - RNA, 12 nt, Homo sapiens
ccuuaauaugcu

SEQ ID NO: 1595972 - RNA, 19 nt, Homo sapiens
ccuuaaugacaacacuuaa

SEQ ID NO: 1595973 - RNA, 18 nt, Homo sapiens
ccuuaauuuccuuuuuga

SEQ ID NO: 1595974 - RNA, 14 nt, Homo sapiens
ccuuacaaaugaaa

SEQ ID NO: 1595975 - RNA, 16 nt, Homo sapiens
ccuuacaaguuagaaa

SEQ ID NO: 1595976 - RNA, 14 nt, Homo sapiens
ccuuacaguaggag

SEQ ID NO: 1595977 - RNA, 13 nt, Homo sapiens
ccuuaccuugaaa

SEQ ID NO: 1595978 - RNA, 11 nt, Homo sapiens
ccuuacugugc

SEQ ID NO: 1595979 - RNA, 23 nt, Homo sapiens
ccuuagagcuuggacagucugag

SEQ ID NO: 1595980 - RNA, 23 nt, Homo sapiens
ccuuagauguucuaagucuuucc

SEQ ID NO: 1595981 - RNA, 13 nt, Homo sapiens
ccuuagucuuucc

SEQ ID NO: 1595982 - RNA, 13 nt, Homo sapiens
ccuuaguugaaau

SEQ ID NO: 1595983 - RNA, 21 nt, Homo sapiens
ccuucaacuggcuacugaguc

SEQ ID NO: 1595984 - RNA, 17 nt, Homo sapiens
ccuucaaguauccaauu

SEQ ID NO: 1595985 - RNA, 13 nt, Homo sapiens
ccuucaagugcca

SEQ ID NO: 1595986 - RNA, 20 nt, Homo sapiens
ccuucagaacagaggcauuu

SEQ ID NO: 1595987 - RNA, 21 nt, Homo sapiens
ccuucagaacagaggcauuua

SEQ ID NO: 1595988 - RNA, 15 nt, Homo sapiens
ccuucagcaccugac

SEQ ID NO: 1595989 - RNA, 19 nt, Homo sapiens
ccuucaggagaaucuacac

SEQ ID NO: 1595990 - RNA, 15 nt, Homo sapiens
ccuucagucaagaaa

SEQ ID NO: 1595991 - RNA, 23 nt, Homo sapiens
ccuucauaucauccacacaugaa

SEQ ID NO: 1595992 - RNA, 19 nt, Homo sapiens
ccuucaucuucacugcaau

SEQ ID NO: 1595993 - RNA, 20 nt, Homo sapiens
ccuucaucuucacugcaauu

SEQ ID NO: 1595994 - RNA, 12 nt, Homo sapiens
ccuucaugcccu

SEQ ID NO: 1595995 - RNA, 17 nt, Homo sapiens
ccuucaugcuuacuauu

SEQ ID NO: 1595996 - RNA, 16 nt, Homo sapiens
ccuuccacagcuggcc

SEQ ID NO: 1595997 - RNA, 17 nt, Homo sapiens
ccuuccccgugcccuac

SEQ ID NO: 1595998 - RNA, 15 nt, Homo sapiens
ccuuccugcugcugc

SEQ ID NO: 1595999 - RNA, 12 nt, Homo sapiens
ccuucuaccucu

SEQ ID NO: 1596000 - RNA, 22 nt, Homo sapiens
ccuucuaggucacuucucacaa

SEQ ID NO: 1596001 - RNA, 13 nt, Homo sapiens
ccuucucaucucc

SEQ ID NO: 1596002 - RNA, 18 nt, Homo sapiens
ccuucucccucgacauuu

SEQ ID NO: 1596003 - RNA, 21 nt, Homo sapiens
ccuucucgcuuuugccauuag

SEQ ID NO: 1596004 - RNA, 18 nt, Homo sapiens
ccuucucugcagcucuga

SEQ ID NO: 1596005 - RNA, 13 nt, Homo sapiens
ccuucugugggga

SEQ ID NO: 1596006 - RNA, 16 nt, Homo sapiens
ccuucuucccaaucau

SEQ ID NO: 1596007 - RNA, 11 nt, Homo sapiens
ccuucuuucac

SEQ ID NO: 1596008 - RNA, 15 nt, Homo sapiens
ccuucuuugucuugc

SEQ ID NO: 1596009 - RNA, 13 nt, Homo sapiens
ccuugaaugccau

SEQ ID NO: 1596010 - RNA, 18 nt, Homo sapiens
ccuugagaagcugccaua

SEQ ID NO: 1596011 - RNA, 21 nt, Homo sapiens
ccuugcaaucuucuacuuuaa

SEQ ID NO: 1596012 - RNA, 22 nt, Homo sapiens
ccuugcagggugggugagcucu

SEQ ID NO: 1596013 - RNA, 14 nt, Homo sapiens
ccuugcccagagau

SEQ ID NO: 1596014 - RNA, 21 nt, Homo sapiens
ccuuggaaaugaccaggccaa

SEQ ID NO: 1596015 - RNA, 18 nt, Homo sapiens
ccuuggaccguaucacug

SEQ ID NO: 1596016 - RNA, 21 nt, Homo sapiens
ccuuggcaguggacucagaaa

SEQ ID NO: 1596017 - RNA, 16 nt, Homo sapiens
ccuuggcugacaugaa

SEQ ID NO: 1596018 - RNA, 17 nt, Homo sapiens
ccuuggguccauuuucu

SEQ ID NO: 1596019 - RNA, 17 nt, Homo sapiens
ccuuguccgcaaggggu

SEQ ID NO: 1596020 - RNA, 19 nt, Homo sapiens
ccuugugagagcccauucc

SEQ ID NO: 1596021 - RNA, 22 nt, Homo sapiens
ccuugugagaguggcuuucuac

SEQ ID NO: 1596022 - RNA, 16 nt, Homo sapiens
ccuugugcuuagcuuu

SEQ ID NO: 1596023 - RNA, 19 nt, Homo sapiens
ccuuuaacugacaagccau

SEQ ID NO: 1596024 - RNA, 16 nt, Homo sapiens
ccuuuacguucaucac

SEQ ID NO: 1596025 - RNA, 20 nt, Homo sapiens
ccuuuaggaagguauguguc

SEQ ID NO: 1596026 - RNA, 13 nt, Homo sapiens
ccuuuccaauaga

SEQ ID NO: 1596027 - RNA, 13 nt, Homo sapiens
ccuuuccucaaaa

SEQ ID NO: 1596028 - RNA, 14 nt, Homo sapiens
ccuuucuccuguga

SEQ ID NO: 1596029 - RNA, 23 nt, Homo sapiens
ccuuucugaggaguaaaaagacu

SEQ ID NO: 1596030 - RNA, 16 nt, Homo sapiens
ccuuucuucaccaaau

SEQ ID NO: 1596031 - RNA, 18 nt, Homo sapiens
ccuuugcaauagcaguua

SEQ ID NO: 1596032 - RNA, 16 nt, Homo sapiens
ccuuuggggacuuuuc

SEQ ID NO: 1596033 - RNA, 20 nt, Homo sapiens
ccuuugguuuuaaaagagaa

SEQ ID NO: 1596034 - RNA, 18 nt, Homo sapiens
ccuuugugagcugugagu

SEQ ID NO: 1596035 - RNA, 12 nt, Homo sapiens
ccuuuguuucaa

SEQ ID NO: 1596036 - RNA, 14 nt, Homo sapiens
ccuuuuauaccugc

SEQ ID NO: 1596037 - RNA, 22 nt, Homo sapiens
ccuuuuauguaauuucuuuaaa

SEQ ID NO: 1596038 - RNA, 11 nt, Homo sapiens
ccuuuugcaac

SEQ ID NO: 1596039 - RNA, 17 nt, Homo sapiens
ccuuuugcaaccaggaa

SEQ ID NO: 1596040 - RNA, 13 nt, Homo sapiens
ccuuuuucauaau

SEQ ID NO: 1596041 - RNA, 15 nt, Homo sapiens
ccuuuuugacacuga

SEQ ID NO: 1596042 - RNA, 16 nt, Homo sapiens
ccuuuuugguuuuuac

SEQ ID NO: 1596043 - RNA, 13 nt, Homo sapiens
ccuuuuuucccau

SEQ ID NO: 1596044 - RNA, 13 nt, Homo sapiens
ccuuuuuugagau

SEQ ID NO: 1596045 - RNA, 14 nt, Homo sapiens
cgaacaauucauau

SEQ ID NO: 1596046 - RNA, 21 nt, Homo sapiens
cgaacaauucauauauuugaa

SEQ ID NO: 1596047 - RNA, 19 nt, Homo sapiens
cgaaccaugccuuccucag

SEQ ID NO: 1596048 - RNA, 19 nt, Homo sapiens
cgaaccauggugaacucca

SEQ ID NO: 1596049 - RNA, 23 nt, Homo sapiens
cgaagccuuaacuuuaaaugaca

SEQ ID NO: 1596050 - RNA, 17 nt, Homo sapiens
cgaagucaucauuccuc

SEQ ID NO: 1596051 - RNA, 19 nt, Homo sapiens
cgaagucgccacguggccu

SEQ ID NO: 1596052 - RNA, 19 nt, Homo sapiens
cgaaguguuuauguaauag

SEQ ID NO: 1596053 - RNA, 20 nt, Homo sapiens
cgacaaaggccacaggcagu

SEQ ID NO: 1596054 - RNA, 16 nt, Homo sapiens
cgaccugcgccaaucc

SEQ ID NO: 1596055 - RNA, 15 nt, Homo sapiens
cgagacuccaucucu

SEQ ID NO: 1596056 - RNA, 15 nt, Homo sapiens
cgagaugaguuucug

SEQ ID NO: 1596057 - RNA, 22 nt, Homo sapiens
cgagauguucgcucgugcagua

SEQ ID NO: 1596058 - RNA, 14 nt, Homo sapiens
cgagcaggguguuu

SEQ ID NO: 1596059 - RNA, 14 nt, Homo sapiens
cgagccugcacugg

SEQ ID NO: 1596060 - RNA, 23 nt, Homo sapiens
cgaggcagacgucugucaggggc

SEQ ID NO: 1596061 - RNA, 14 nt, Homo sapiens
cgaggucaggagau

SEQ ID NO: 1596062 - RNA, 15 nt, Homo sapiens
cgauaccgggacaca

SEQ ID NO: 1596063 - RNA, 22 nt, Homo sapiens
cgauauacauuuauuuacacuc

SEQ ID NO: 1596064 - RNA, 13 nt, Homo sapiens
cgaucuccugacc

SEQ ID NO: 1596065 - RNA, 16 nt, Homo sapiens
cgaucuccugaccucg

SEQ ID NO: 1596066 - RNA, 13 nt, Homo sapiens
cgauucuuaacaa

SEQ ID NO: 1596067 - RNA, 23 nt, Homo sapiens
cgauuucucucucucccccucag

SEQ ID NO: 1596068 - RNA, 15 nt, Homo sapiens
cgcacaagccagacc

SEQ ID NO: 1596069 - RNA, 22 nt, Homo sapiens
cgcacacacccauguaaccacu

SEQ ID NO: 1596070 - RNA, 13 nt, Homo sapiens
cgcaccaaucagc

SEQ ID NO: 1596071 - RNA, 17 nt, Homo sapiens
cgcaccagacacucaca

SEQ ID NO: 1596072 - RNA, 15 nt, Homo sapiens
cgcagccuccagggc

SEQ ID NO: 1596073 - RNA, 12 nt, Homo sapiens
cgcaguggcuca

SEQ ID NO: 1596074 - RNA, 15 nt, Homo sapiens
cgcaguuuggaguca

SEQ ID NO: 1596075 - RNA, 20 nt, Homo sapiens
cgcaguuuggagucacugua

SEQ ID NO: 1596076 - RNA, 21 nt, Homo sapiens
cgcaguuuggagucacuguag

SEQ ID NO: 1596077 - RNA, 13 nt, Homo sapiens
cgcauucccugag

SEQ ID NO: 1596078 - RNA, 16 nt, Homo sapiens
cgccaaaacaagccaa

SEQ ID NO: 1596079 - RNA, 21 nt, Homo sapiens
cgcccaggcuggacugcagug

SEQ ID NO: 1596080 - RNA, 22 nt, Homo sapiens
cucaggacagaacaguguuuaa

SEQ ID NO: 1596081 - RNA, 19 nt, Homo sapiens
cucaggacagaaccacuga

SEQ ID NO: 1596082 - RNA, 20 nt, Homo sapiens
cucaggacagaaccacugag

SEQ ID NO: 1596083 - RNA, 21 nt, Homo sapiens
cucaggaggcugagacaggag

SEQ ID NO: 1596084 - RNA, 16 nt, Homo sapiens
cucagggagcagggaa

SEQ ID NO: 1596085 - RNA, 18 nt, Homo sapiens
cucaggggcuccaugcug

SEQ ID NO: 1596086 - RNA, 21 nt, Homo sapiens
cucagggucugcuucccccac

SEQ ID NO: 1596087 - RNA, 21 nt, Homo sapiens
cucaguagccauaucuuccaa

SEQ ID NO: 1596088 - RNA, 19 nt, Homo sapiens
cucaguagcugauucugaa

SEQ ID NO: 1596089 - RNA, 18 nt, Homo sapiens
cucaguauccaugcucuu

SEQ ID NO: 1596090 - RNA, 18 nt, Homo sapiens
cucagucucugagcagug

SEQ ID NO: 1596091 - RNA, 23 nt, Homo sapiens
cucagucuuaaaaaaauaugccu

SEQ ID NO: 1596092 - RNA, 16 nt, Homo sapiens
cucaguuggugcugcu

SEQ ID NO: 1596093 - RNA, 20 nt, Homo sapiens
cucauaaaaaucuagcacac

SEQ ID NO: 1596094 - RNA, 14 nt, Homo sapiens
cucauaauuuugca

SEQ ID NO: 1596095 - RNA, 16 nt, Homo sapiens
cucauaauuuugcaaa

SEQ ID NO: 1596096 - RNA, 14 nt, Homo sapiens
cucauacaaugaua

SEQ ID NO: 1596097 - RNA, 19 nt, Homo sapiens
cucauagaacauugaucug

SEQ ID NO: 1596098 - RNA, 12 nt, Homo sapiens
cucauagcuuug

SEQ ID NO: 1596099 - RNA, 22 nt, Homo sapiens
cucauagguugagcaauuuccc

SEQ ID NO: 1596100 - RNA, 23 nt, Homo sapiens
cucaucacauaaagaaauucaag

SEQ ID NO: 1596101 - RNA, 14 nt, Homo sapiens
cucaucaggccauu

SEQ ID NO: 1596102 - RNA, 18 nt, Homo sapiens
cucaucaguaguucacau

SEQ ID NO: 1596103 - RNA, 16 nt, Homo sapiens
cucauccccacaaucu

SEQ ID NO: 1596104 - RNA, 12 nt, Homo sapiens
cucaucugcaaa

SEQ ID NO: 1596105 - RNA, 20 nt, Homo sapiens
cucaugauguauuguugcuu

SEQ ID NO: 1596106 - RNA, 12 nt, Homo sapiens
cucaugccugua

SEQ ID NO: 1596107 - RNA, 20 nt, Homo sapiens
cucaugccuguaaucccaac

SEQ ID NO: 1596108 - RNA, 17 nt, Homo sapiens
cucauuaauagcugccu

SEQ ID NO: 1596109 - RNA, 18 nt, Homo sapiens
cucauuuaaaacaggcaa

SEQ ID NO: 1596110 - RNA, 14 nt, Homo sapiens
cucauuucaucuca

SEQ ID NO: 1596111 - RNA, 17 nt, Homo sapiens
cucauuugaaugcuuaa

SEQ ID NO: 1596112 - RNA, 14 nt, Homo sapiens
cucauuuuaaugua

SEQ ID NO: 1596113 - RNA, 23 nt, Homo sapiens
cucauuuuuguuuucauuaucuc

SEQ ID NO: 1596114 - RNA, 13 nt, Homo sapiens
cuccaaaauauua

SEQ ID NO: 1596115 - RNA, 19 nt, Homo sapiens
cuccaaaauauuaacauuc

SEQ ID NO: 1596116 - RNA, 21 nt, Homo sapiens
cuccaaaccagacggugacgc

SEQ ID NO: 1596117 - RNA, 15 nt, Homo sapiens
cuccaaauccaagga

SEQ ID NO: 1596118 - RNA, 14 nt, Homo sapiens
cuccaagcauuuca

SEQ ID NO: 1596119 - RNA, 18 nt, Homo sapiens
cuccaaggaccucucuca

SEQ ID NO: 1596120 - RNA, 21 nt, Homo sapiens
cuccacaccucuaaacaucuc

SEQ ID NO: 1596121 - RNA, 18 nt, Homo sapiens
cuccaccaacccaucaga

SEQ ID NO: 1596122 - RNA, 18 nt, Homo sapiens
cuccaccaucaccucucu

SEQ ID NO: 1596123 - RNA, 20 nt, Homo sapiens
cuccaccccacaacccaaaa

SEQ ID NO: 1596124 - RNA, 16 nt, Homo sapiens
cuccaccccaggguca

SEQ ID NO: 1596125 - RNA, 18 nt, Homo sapiens
cuccacuacuuuacuguu

SEQ ID NO: 1596126 - RNA, 19 nt, Homo sapiens
cuccacuggccuccuggca

SEQ ID NO: 1596127 - RNA, 12 nt, Homo sapiens
cuccacuuguau

SEQ ID NO: 1596128 - RNA, 14 nt, Homo sapiens
cuccagagauuugc

SEQ ID NO: 1596129 - RNA, 15 nt, Homo sapiens
cuccagcagcuuucc

SEQ ID NO: 1596130 - RNA, 19 nt, Homo sapiens
cuccagcccagacccagug

SEQ ID NO: 1596131 - RNA, 17 nt, Homo sapiens
cuccagccccugacccc

SEQ ID NO: 1596132 - RNA, 15 nt, Homo sapiens
cuccagccugaguga

SEQ ID NO: 1596133 - RNA, 17 nt, Homo sapiens
cuccaggaaagagcagu

SEQ ID NO: 1596134 - RNA, 17 nt, Homo sapiens
cuccagggagaaggcau

SEQ ID NO: 1596135 - RNA, 18 nt, Homo sapiens
cuccagugcauacuguag

SEQ ID NO: 1596136 - RNA, 19 nt, Homo sapiens
cuccagugggcugaugcug

SEQ ID NO: 1596137 - RNA, 20 nt, Homo sapiens
cuccauacugggcuaaggaa

SEQ ID NO: 1596138 - RNA, 15 nt, Homo sapiens
cuccaucagcuccug

SEQ ID NO: 1596139 - RNA, 16 nt, Homo sapiens
cuccauccuccugugu

SEQ ID NO: 1596140 - RNA, 17 nt, Homo sapiens
cuccaucucauguauca

SEQ ID NO: 1596141 - RNA, 21 nt, Homo sapiens
cuccaugcuccucaccugucu

SEQ ID NO: 1596142 - RNA, 21 nt, Homo sapiens
cuccauguagaagccacuauu

SEQ ID NO: 1596143 - RNA, 12 nt, Homo sapiens
cuccauguguuu

SEQ ID NO: 1596144 - RNA, 18 nt, Homo sapiens
cuccauugguguugacau

SEQ ID NO: 1596145 - RNA, 15 nt, Homo sapiens
cucccaaagcucaga

SEQ ID NO: 1596146 - RNA, 19 nt, Homo sapiens
cucccaaagugcugggauu

SEQ ID NO: 1596147 - RNA, 16 nt, Homo sapiens
cucccaacacugucac

SEQ ID NO: 1596148 - RNA, 14 nt, Homo sapiens
cucccaagguccuc

SEQ ID NO: 1596149 - RNA, 22 nt, Homo sapiens
cucccacaaugcugaugaaaac

SEQ ID NO: 1596150 - RNA, 22 nt, Homo sapiens
cucccagaggagccaccaguuc

SEQ ID NO: 1596151 - RNA, 13 nt, Homo sapiens
cucccagcuccuu

SEQ ID NO: 1596152 - RNA, 23 nt, Homo sapiens
cucccagcuccuuucuccuguga

SEQ ID NO: 1596153 - RNA, 15 nt, Homo sapiens
cucccagcugugcug

SEQ ID NO: 1596154 - RNA, 16 nt, Homo sapiens
cucccaggaagcccag

SEQ ID NO: 1596155 - RNA, 15 nt, Homo sapiens
cucccaguccaagac

SEQ ID NO: 1596156 - RNA, 19 nt, Homo sapiens
cucccagugaacuccugcc

SEQ ID NO: 1596157 - RNA, 23 nt, Homo sapiens
cucccauaauugcuuugccaaaa

SEQ ID NO: 1596158 - RNA, 14 nt, Homo sapiens
cuccccaaggccac

SEQ ID NO: 1596159 - RNA, 20 nt, Homo sapiens
cuccccaaggccacagggag

SEQ ID NO: 1596160 - RNA, 18 nt, Homo sapiens
cuccccagacucucaggu

SEQ ID NO: 1596161 - RNA, 22 nt, Homo sapiens
cuccccagacucucagguggag

SEQ ID NO: 1596162 - RNA, 18 nt, Homo sapiens
cuccccaucuguccagcu

SEQ ID NO: 1596163 - RNA, 23 nt, Homo sapiens
cucccccaaaaacccaccaaaau

SEQ ID NO: 1596164 - RNA, 20 nt, Homo sapiens
cucccccuccagccagagac

SEQ ID NO: 1596165 - RNA, 19 nt, Homo sapiens
cucccccuccuccagggaa

SEQ ID NO: 1596166 - RNA, 16 nt, Homo sapiens
cuccccucagauucca

SEQ ID NO: 1596167 - RNA, 16 nt, Homo sapiens
cuccccuccucugaau

SEQ ID NO: 1596168 - RNA, 18 nt, Homo sapiens
cuccccugcccuggucca

SEQ ID NO: 1596169 - RNA, 17 nt, Homo sapiens
cuccccuugucugcacu

SEQ ID NO: 1596170 - RNA, 16 nt, Homo sapiens
cuccccuuucacaggu

SEQ ID NO: 1596171 - RNA, 17 nt, Homo sapiens
cucccuacaggcccacc

SEQ ID NO: 1596172 - RNA, 21 nt, Homo sapiens
cucccuaggcugcccacucuc

SEQ ID NO: 1596173 - RNA, 22 nt, Homo sapiens
cucccucagacccaggagucca

SEQ ID NO: 1596174 - RNA, 22 nt, Homo sapiens
cucccucagacucagaggucca

SEQ ID NO: 1596175 - RNA, 15 nt, Homo sapiens
cucccucagcucucu

SEQ ID NO: 1596176 - RNA, 23 nt, Homo sapiens
cucccuccccagaaacagugugc

SEQ ID NO: 1596177 - RNA, 23 nt, Homo sapiens
cucccugaccuuagcguucugga

SEQ ID NO: 1596178 - RNA, 19 nt, Homo sapiens
cucccugcugugugacuuu

SEQ ID NO: 1596179 - RNA, 14 nt, Homo sapiens
cucccuguccuccu

SEQ ID NO: 1596180 - RNA, 15 nt, Homo sapiens
cucccuucucggggu

SEQ ID NO: 1596181 - RNA, 14 nt, Homo sapiens
cuccgucucaaaaa

SEQ ID NO: 1596182 - RNA, 22 nt, Homo sapiens
cuccguggccaaaaaguaccau

SEQ ID NO: 1596183 - RNA, 20 nt, Homo sapiens
cuccuacaggugcuguucag

SEQ ID NO: 1596184 - RNA, 21 nt, Homo sapiens
cuccuacccuuccagugcccu

SEQ ID NO: 1596185 - RNA, 18 nt, Homo sapiens
cuccuagaagaaccaaau

SEQ ID NO: 1596186 - RNA, 14 nt, Homo sapiens
cuccuaucuguguu

SEQ ID NO: 1596187 - RNA, 18 nt, Homo sapiens
cuccuauuccuucacaca

SEQ ID NO: 1596188 - RNA, 16 nt, Homo sapiens
cuccucaggcacacag

SEQ ID NO: 1596189 - RNA, 11 nt, Homo sapiens
cuccucaggcu

SEQ ID NO: 1596190 - RNA, 18 nt, Homo sapiens
cuccuccaaaggcccccu

SEQ ID NO: 1596191 - RNA, 20 nt, Homo sapiens
cuccucccucagacccagcg

SEQ ID NO: 1596192 - RNA, 14 nt, Homo sapiens
cuccucggagagca

SEQ ID NO: 1596193 - RNA, 16 nt, Homo sapiens
cuccucguccauuuua

SEQ ID NO: 1596194 - RNA, 14 nt, Homo sapiens
cuccucucaucccc

SEQ ID NO: 1596195 - RNA, 11 nt, Homo sapiens
cuccucugaau

SEQ ID NO: 1596196 - RNA, 18 nt, Homo sapiens
cuccucugcagugccuug

SEQ ID NO: 1596197 - RNA, 22 nt, Homo sapiens
cuccucuggacggcaggcucac

SEQ ID NO: 1596198 - RNA, 18 nt, Homo sapiens
gaccuaaagcaagccuga

SEQ ID NO: 1596199 - RNA, 15 nt, Homo sapiens
gaccuagagacuuca

SEQ ID NO: 1596200 - RNA, 17 nt, Homo sapiens
gaccucagcaagcugcc

SEQ ID NO: 1596201 - RNA, 19 nt, Homo sapiens
gaccucagcaagcugccca

SEQ ID NO: 1596202 - RNA, 15 nt, Homo sapiens
gaccucagugacuca

SEQ ID NO: 1596203 - RNA, 15 nt, Homo sapiens
gaccucuacuugcug

SEQ ID NO: 1596204 - RNA, 17 nt, Homo sapiens
gaccuggugcugccucu

SEQ ID NO: 1596205 - RNA, 13 nt, Homo sapiens
gaccuucaugccc

SEQ ID NO: 1596206 - RNA, 19 nt, Homo sapiens
gaccuuggaggaaugacaa

SEQ ID NO: 1596207 - RNA, 22 nt, Homo sapiens
gaccuuuauaucugucuuuuau

SEQ ID NO: 1596208 - RNA, 13 nt, Homo sapiens
gaccuuuauuuau

SEQ ID NO: 1596209 - RNA, 23 nt, Homo sapiens
gaccuuuuuuuuuuuaauggcaa

SEQ ID NO: 1596210 - RNA, 14 nt, Homo sapiens
gacgauucuuaaca

SEQ ID NO: 1596211 - RNA, 22 nt, Homo sapiens
gacgccacucauuucaucucau

SEQ ID NO: 1596212 - RNA, 15 nt, Homo sapiens
gacggaauuggguuu

SEQ ID NO: 1596213 - RNA, 14 nt, Homo sapiens
gacggauuccuugg

SEQ ID NO: 1596214 - RNA, 12 nt, Homo sapiens
gacgucuucacc

SEQ ID NO: 1596215 - RNA, 19 nt, Homo sapiens
gacgugauuuugcuguaga

SEQ ID NO: 1596216 - RNA, 15 nt, Homo sapiens
gacuaagcauugagc

SEQ ID NO: 1596217 - RNA, 22 nt, Homo sapiens
gacuaauuucaaaaugcuuuuu

SEQ ID NO: 1596218 - RNA, 20 nt, Homo sapiens
gacuacauccugagugugau

SEQ ID NO: 1596219 - RNA, 17 nt, Homo sapiens
gacuacuaaggccuuuu

SEQ ID NO: 1596220 - RNA, 20 nt, Homo sapiens
gacuaucuuacuauuucaca

SEQ ID NO: 1596221 - RNA, 12 nt, Homo sapiens
gacuauggagcu

SEQ ID NO: 1596222 - RNA, 20 nt, Homo sapiens
gacuauggauguguucucua

SEQ ID NO: 1596223 - RNA, 15 nt, Homo sapiens
gacuauguaaacuac

SEQ ID NO: 1596224 - RNA, 12 nt, Homo sapiens
gacucaaaggga

SEQ ID NO: 1596225 - RNA, 23 nt, Homo sapiens
gacucaguagccauaucuuccaa

SEQ ID NO: 1596226 - RNA, 20 nt, Homo sapiens
gacuccaccuuggaccucag

SEQ ID NO: 1596227 - RNA, 16 nt, Homo sapiens
gacuccaucucaaaaa

SEQ ID NO: 1596228 - RNA, 19 nt, Homo sapiens
gacuccugcucucuaucca

SEQ ID NO: 1596229 - RNA, 22 nt, Homo sapiens
gacuccugcucucuauccaaaa

SEQ ID NO: 1596230 - RNA, 18 nt, Homo sapiens
gacuccuuuccaauagaa

SEQ ID NO: 1596231 - RNA, 15 nt, Homo sapiens
gacucuguaacucac

SEQ ID NO: 1596232 - RNA, 20 nt, Homo sapiens
gacucuguguggcugugcaa

SEQ ID NO: 1596233 - RNA, 20 nt, Homo sapiens
gacucuuucugagugccuuc

SEQ ID NO: 1596234 - RNA, 14 nt, Homo sapiens
gacugaaacuggaa

SEQ ID NO: 1596235 - RNA, 22 nt, Homo sapiens
gacugaaugugccuaauggaga

SEQ ID NO: 1596236 - RNA, 14 nt, Homo sapiens
gacugacacuacua

SEQ ID NO: 1596237 - RNA, 14 nt, Homo sapiens
gacugcaacaggcu

SEQ ID NO: 1596238 - RNA, 19 nt, Homo sapiens
gacugcauugccgcuguau

SEQ ID NO: 1596239 - RNA, 20 nt, Homo sapiens
gacugcugguugacaucaga

SEQ ID NO: 1596240 - RNA, 19 nt, Homo sapiens
gacuggacuauacaacuuu

SEQ ID NO: 1596241 - RNA, 15 nt, Homo sapiens
gacugggcacugggg

SEQ ID NO: 1596242 - RNA, 20 nt, Homo sapiens
gacuggguuuugugauugcc

SEQ ID NO: 1596243 - RNA, 17 nt, Homo sapiens
gacuguacacacuuuau

SEQ ID NO: 1596244 - RNA, 21 nt, Homo sapiens
gacugucaguucucugggaag

SEQ ID NO: 1596245 - RNA, 19 nt, Homo sapiens
gacuuaaggggcugggaug

SEQ ID NO: 1596246 - RNA, 22 nt, Homo sapiens
gacuuauaugagggcagauuca

SEQ ID NO: 1596247 - RNA, 21 nt, Homo sapiens
gacuuauucauuccucacaau

SEQ ID NO: 1596248 - RNA, 16 nt, Homo sapiens
gacuucagucuugccu

SEQ ID NO: 1596249 - RNA, 20 nt, Homo sapiens
gacuuccaucuagucacaaa

SEQ ID NO: 1596250 - RNA, 15 nt, Homo sapiens
gacuucccacuguuc

SEQ ID NO: 1596251 - RNA, 17 nt, Homo sapiens
gacuucucggaauucau

SEQ ID NO: 1596252 - RNA, 20 nt, Homo sapiens
gacuucuggagaaagcucau

SEQ ID NO: 1596253 - RNA, 17 nt, Homo sapiens
gacuucugucuucacaa

SEQ ID NO: 1596254 - RNA, 17 nt, Homo sapiens
gacuucuuuuuggcauu

SEQ ID NO: 1596255 - RNA, 12 nt, Homo sapiens
gacuugaaccca

SEQ ID NO: 1596256 - RNA, 13 nt, Homo sapiens
gacuugcuuuaaa

SEQ ID NO: 1596257 - RNA, 16 nt, Homo sapiens
gacuugucaagccugu

SEQ ID NO: 1596258 - RNA, 23 nt, Homo sapiens
gacuuugaaacuaucucaugcca

SEQ ID NO: 1596259 - RNA, 19 nt, Homo sapiens
gacuuuguguucauuucau

SEQ ID NO: 1596260 - RNA, 16 nt, Homo sapiens
gagaaaaaaauugcuc

SEQ ID NO: 1596261 - RNA, 17 nt, Homo sapiens
gagaaaagccucuccag

SEQ ID NO: 1596262 - RNA, 15 nt, Homo sapiens
gagaaagacuauuca

SEQ ID NO: 1596263 - RNA, 14 nt, Homo sapiens
gagaaauggccaaa

SEQ ID NO: 1596264 - RNA, 16 nt, Homo sapiens
gagaacaaugugcuau

SEQ ID NO: 1596265 - RNA, 16 nt, Homo sapiens
gagaaccaacaaguaa

SEQ ID NO: 1596266 - RNA, 15 nt, Homo sapiens
gagaacuccucauuc

SEQ ID NO: 1596267 - RNA, 22 nt, Homo sapiens
gagaagagcuguucacagccag

SEQ ID NO: 1596268 - RNA, 14 nt, Homo sapiens
gagaagcagugagc

SEQ ID NO: 1596269 - RNA, 21 nt, Homo sapiens
gagaagccagcuuuccucauc

SEQ ID NO: 1596270 - RNA, 13 nt, Homo sapiens
gagaagcugccau

SEQ ID NO: 1596271 - RNA, 18 nt, Homo sapiens
gagaagcuguaggacugu

SEQ ID NO: 1596272 - RNA, 21 nt, Homo sapiens
gagaaggggugcagaguguuu

SEQ ID NO: 1596273 - RNA, 21 nt, Homo sapiens
gagaaguuucgagggguccuc

SEQ ID NO: 1596274 - RNA, 18 nt, Homo sapiens
gagaauaggggagccaag

SEQ ID NO: 1596275 - RNA, 16 nt, Homo sapiens
gagaauguuccagaca

SEQ ID NO: 1596276 - RNA, 23 nt, Homo sapiens
gagaauugaaaugaggugccacc

SEQ ID NO: 1596277 - RNA, 14 nt, Homo sapiens
gagacagccaggug

SEQ ID NO: 1596278 - RNA, 18 nt, Homo sapiens
gagacagcgcuaaggaug

SEQ ID NO: 1596279 - RNA, 18 nt, Homo sapiens
gagacagggcugcucccc

SEQ ID NO: 1596280 - RNA, 19 nt, Homo sapiens
gagacagucucacucuguu

SEQ ID NO: 1596281 - RNA, 16 nt, Homo sapiens
gagacauaucacucaa

SEQ ID NO: 1596282 - RNA, 13 nt, Homo sapiens
gagacccugccac

SEQ ID NO: 1596283 - RNA, 19 nt, Homo sapiens
gagacccugucucaaaaaa

SEQ ID NO: 1596284 - RNA, 13 nt, Homo sapiens
gagaccuccaaua

SEQ ID NO: 1596285 - RNA, 21 nt, Homo sapiens
gagacuccagggagaaggcau

SEQ ID NO: 1596286 - RNA, 14 nt, Homo sapiens
gagacuccaucucu

SEQ ID NO: 1596287 - RNA, 19 nt, Homo sapiens
gagacucgagaacuuucau

SEQ ID NO: 1596288 - RNA, 16 nt, Homo sapiens
gagacugaaaauugca

SEQ ID NO: 1596289 - RNA, 21 nt, Homo sapiens
gagacugggcgcaguggcuca

SEQ ID NO: 1596290 - RNA, 12 nt, Homo sapiens
gagacuguccau

SEQ ID NO: 1596291 - RNA, 19 nt, Homo sapiens
gagacuucacgggcaauca

SEQ ID NO: 1596292 - RNA, 20 nt, Homo sapiens
gagacuucacgggcaaucau

SEQ ID NO: 1596293 - RNA, 20 nt, Homo sapiens
gagacuuucuucuagugcuu

SEQ ID NO: 1596294 - RNA, 14 nt, Homo sapiens
gagagagaaggcag

SEQ ID NO: 1596295 - RNA, 14 nt, Homo sapiens
gagagagcucugca

SEQ ID NO: 1596296 - RNA, 14 nt, Homo sapiens
gagagagugcuauu

SEQ ID NO: 1596297 - RNA, 20 nt, Homo sapiens
gagagcacuagaagugguuu

SEQ ID NO: 1596298 - RNA, 16 nt, Homo sapiens
gagagccaccaagagg

SEQ ID NO: 1596299 - RNA, 14 nt, Homo sapiens
gagagcccuuccca

SEQ ID NO: 1596300 - RNA, 22 nt, Homo sapiens
gagagcucgcuuugagugacug

SEQ ID NO: 1596301 - RNA, 15 nt, Homo sapiens
gagaggaggggacca

SEQ ID NO: 1596302 - RNA, 17 nt, Homo sapiens
gagagguggauccugua

SEQ ID NO: 1596303 - RNA, 16 nt, Homo sapiens
gagaguaaaccuugaa

SEQ ID NO: 1596304 - RNA, 13 nt, Homo sapiens
gagaguccaucag

SEQ ID NO: 1596305 - RNA, 20 nt, Homo sapiens
gagaguccaucagccuccau

SEQ ID NO: 1596306 - RNA, 15 nt, Homo sapiens
gagagugagacucag

SEQ ID NO: 1596307 - RNA, 22 nt, Homo sapiens
gagaguuucuauggauucacuu

SEQ ID NO: 1596308 - RNA, 14 nt, Homo sapiens
gagaguuucuggau

SEQ ID NO: 1596309 - RNA, 16 nt, Homo sapiens
gagauaaaccaauaaa

SEQ ID NO: 1596310 - RNA, 13 nt, Homo sapiens
gagauacuuugca

SEQ ID NO: 1596311 - RNA, 12 nt, Homo sapiens
gagaugauuucc

SEQ ID NO: 1596312 - RNA, 11 nt, Homo sapiens
gagaugccaug

SEQ ID NO: 1596313 - RNA, 16 nt, Homo sapiens
gagaugccaugagccg

SEQ ID NO: 1596314 - RNA, 16 nt, Homo sapiens
gagauggguccagggg

SEQ ID NO: 1596315 - RNA, 12 nt, Homo sapiens
gagaugucauca

SEQ ID NO: 1596316 - RNA, 20 nt, Homo sapiens
gagauugaauuucacugucu

SEQ ID NO: 1596317 - RNA, 16 nt, Homo sapiens
gcacacuuuggcccag

SEQ ID NO: 1596318 - RNA, 20 nt, Homo sapiens
gcacagcaggcugccagugc

SEQ ID NO: 1596319 - RNA, 22 nt, Homo sapiens
gcacagcaggcugccagugccu

SEQ ID NO: 1596320 - RNA, 12 nt, Homo sapiens
gcacagccaccc

SEQ ID NO: 1596321 - RNA, 21 nt, Homo sapiens
gcacagccccuggagccucag

SEQ ID NO: 1596322 - RNA, 13 nt, Homo sapiens
gcacagccuggcu

SEQ ID NO: 1596323 - RNA, 20 nt, Homo sapiens
gcacagcguccuguccacac

SEQ ID NO: 1596324 - RNA, 22 nt, Homo sapiens
gcacaggaguguccucuucccu

SEQ ID NO: 1596325 - RNA, 21 nt, Homo sapiens
gcacagggagugcacauaucc

SEQ ID NO: 1596326 - RNA, 19 nt, Homo sapiens
gcacaguguaauccagggg

SEQ ID NO: 1596327 - RNA, 23 nt, Homo sapiens
gcacauauccaggcaccaggacu

SEQ ID NO: 1596328 - RNA, 22 nt, Homo sapiens
gcacauauggaauuuugcaaag

SEQ ID NO: 1596329 - RNA, 15 nt, Homo sapiens
gcacauguacccuaa

SEQ ID NO: 1596330 - RNA, 16 nt, Homo sapiens
gcacauguauacauau

SEQ ID NO: 1596331 - RNA, 15 nt, Homo sapiens
gcacauuugacucca

SEQ ID NO: 1596332 - RNA, 11 nt, Homo sapiens
gcaccaaagac

SEQ ID NO: 1596333 - RNA, 23 nt, Homo sapiens
gcaccaaagacaucagucuccaa

SEQ ID NO: 1596334 - RNA, 14 nt, Homo sapiens
gcaccaacuaagaa

SEQ ID NO: 1596335 - RNA, 17 nt, Homo sapiens
gcaccaaucagcacucu

SEQ ID NO: 1596336 - RNA, 14 nt, Homo sapiens
gcaccaggggccaa

SEQ ID NO: 1596337 - RNA, 18 nt, Homo sapiens
gcaccaggggugcacaau

SEQ ID NO: 1596338 - RNA, 17 nt, Homo sapiens
gcacccgccaccaugcc

SEQ ID NO: 1596339 - RNA, 13 nt, Homo sapiens
gcacccuacaggg

SEQ ID NO: 1596340 - RNA, 13 nt, Homo sapiens
gcacccucaggga

SEQ ID NO: 1596341 - RNA, 17 nt, Homo sapiens
gcacccugcccaccaag

SEQ ID NO: 1596342 - RNA, 16 nt, Homo sapiens
gcacccuggacaaaga

SEQ ID NO: 1596343 - RNA, 20 nt, Homo sapiens
gcacccuggagagugcacau

SEQ ID NO: 1596344 - RNA, 15 nt, Homo sapiens
gcaccuacaguguac

SEQ ID NO: 1596345 - RNA, 21 nt, Homo sapiens
gcaccuguaaucccagcuacu

SEQ ID NO: 1596346 - RNA, 14 nt, Homo sapiens
gcaccuucagacuu

SEQ ID NO: 1596347 - RNA, 17 nt, Homo sapiens
gcaccuucuuucuggac

SEQ ID NO: 1596348 - RNA, 19 nt, Homo sapiens
gcacgccaacauggcacau

SEQ ID NO: 1596349 - RNA, 23 nt, Homo sapiens
gcacguugcccaagguugcacag

SEQ ID NO: 1596350 - RNA, 18 nt, Homo sapiens
gcacuacaggcacccgcc

SEQ ID NO: 1596351 - RNA, 22 nt, Homo sapiens
gcacuacaggcacccgccacca

SEQ ID NO: 1596352 - RNA, 18 nt, Homo sapiens
gcacuacugggugucauu

SEQ ID NO: 1596353 - RNA, 22 nt, Homo sapiens
gcacuacugggugucauuucau

SEQ ID NO: 1596354 - RNA, 15 nt, Homo sapiens
gcacuagaauauuua

SEQ ID NO: 1596355 - RNA, 22 nt, Homo sapiens
gcacucccuaauuuaugugcua

SEQ ID NO: 1596356 - RNA, 19 nt, Homo sapiens
gcacuggggccacccagcc

SEQ ID NO: 1596357 - RNA, 21 nt, Homo sapiens
gcacuggugguuuuugcucuc

SEQ ID NO: 1596358 - RNA, 15 nt, Homo sapiens
gcacuuagcccaaga

SEQ ID NO: 1596359 - RNA, 15 nt, Homo sapiens
gcacuucaaauucaa

SEQ ID NO: 1596360 - RNA, 20 nt, Homo sapiens
gcacuuuaaaaacaggccag

SEQ ID NO: 1596361 - RNA, 14 nt, Homo sapiens
gcacuuuguaugau

SEQ ID NO: 1596362 - RNA, 17 nt, Homo sapiens
gcacuuuuuuguuugaa

SEQ ID NO: 1596363 - RNA, 18 nt, Homo sapiens
gcagaaaaucuaccaaga

SEQ ID NO: 1596364 - RNA, 15 nt, Homo sapiens
gcagaaacagcauau

SEQ ID NO: 1596365 - RNA, 19 nt, Homo sapiens
gcagaaauacagucuucca

SEQ ID NO: 1596366 - RNA, 19 nt, Homo sapiens
gcagaaauuuaaacucuga

SEQ ID NO: 1596367 - RNA, 12 nt, Homo sapiens
gcagaacaguga

SEQ ID NO: 1596368 - RNA, 15 nt, Homo sapiens
gcagaacuuaaucug

SEQ ID NO: 1596369 - RNA, 14 nt, Homo sapiens
gcagaagaaggcau

SEQ ID NO: 1596370 - RNA, 17 nt, Homo sapiens
gcagaagcaacccaaau

SEQ ID NO: 1596371 - RNA, 13 nt, Homo sapiens
gcagaaugaaucu

SEQ ID NO: 1596372 - RNA, 15 nt, Homo sapiens
gcagacaccuggacu

SEQ ID NO: 1596373 - RNA, 14 nt, Homo sapiens
gcagaccacugaua

SEQ ID NO: 1596374 - RNA, 14 nt, Homo sapiens
gcagaccauugggg

SEQ ID NO: 1596375 - RNA, 16 nt, Homo sapiens
gcagaccucaagccau

SEQ ID NO: 1596376 - RNA, 15 nt, Homo sapiens
gcagacucgggacca

SEQ ID NO: 1596377 - RNA, 21 nt, Homo sapiens
gcagagccucccaaggagaac

SEQ ID NO: 1596378 - RNA, 17 nt, Homo sapiens
gcagagccugacgcuca

SEQ ID NO: 1596379 - RNA, 19 nt, Homo sapiens
gcagagcggguaaagugca

SEQ ID NO: 1596380 - RNA, 21 nt, Homo sapiens
gcagagcggguaaagugcaau

SEQ ID NO: 1596381 - RNA, 21 nt, Homo sapiens
gcagagcucccacaaugcuga

SEQ ID NO: 1596382 - RNA, 13 nt, Homo sapiens
gcagaggcaccuc

SEQ ID NO: 1596383 - RNA, 14 nt, Homo sapiens
gcagaggucuccca

SEQ ID NO: 1596384 - RNA, 17 nt, Homo sapiens
gcagagguguaggggug

SEQ ID NO: 1596385 - RNA, 17 nt, Homo sapiens
gcagaguuacaguucug

SEQ ID NO: 1596386 - RNA, 20 nt, Homo sapiens
gcagaguucagacuucgcua

SEQ ID NO: 1596387 - RNA, 15 nt, Homo sapiens
gcagauaaacaguag

SEQ ID NO: 1596388 - RNA, 12 nt, Homo sapiens
gcagaucacuug

SEQ ID NO: 1596389 - RNA, 14 nt, Homo sapiens
gcagaucuacaugu

SEQ ID NO: 1596390 - RNA, 17 nt, Homo sapiens
gcagaucugugccccau

SEQ ID NO: 1596391 - RNA, 13 nt, Homo sapiens
gcagaugaugcuu

SEQ ID NO: 1596392 - RNA, 20 nt, Homo sapiens
gcagcacagcagacuaguua

SEQ ID NO: 1596393 - RNA, 20 nt, Homo sapiens
gcagcauuaaaaaaaaucaa

SEQ ID NO: 1596394 - RNA, 17 nt, Homo sapiens
gcagcauuuuauuuacc

SEQ ID NO: 1596395 - RNA, 18 nt, Homo sapiens
gcagccaaguagccucuc

SEQ ID NO: 1596396 - RNA, 12 nt, Homo sapiens
gcagccacaggg

SEQ ID NO: 1596397 - RNA, 23 nt, Homo sapiens
gcagccacagggaagcucacaca

SEQ ID NO: 1596398 - RNA, 22 nt, Homo sapiens
gcagccagacccacaaggccag

SEQ ID NO: 1596399 - RNA, 14 nt, Homo sapiens
gcagcccaugccca

SEQ ID NO: 1596400 - RNA, 13 nt, Homo sapiens
gcagccuccaggg

SEQ ID NO: 1596401 - RNA, 19 nt, Homo sapiens
gcagcggcuccugcaaaag

SEQ ID NO: 1596402 - RNA, 19 nt, Homo sapiens
gcagcuaaaggaagugaau

SEQ ID NO: 1596403 - RNA, 13 nt, Homo sapiens
gcagcucuacucu

SEQ ID NO: 1596404 - RNA, 13 nt, Homo sapiens
gcagcucugugac

SEQ ID NO: 1596405 - RNA, 14 nt, Homo sapiens
gcaggaaggaacaa

SEQ ID NO: 1596406 - RNA, 17 nt, Homo sapiens
gcaggacuggauuuuaa

SEQ ID NO: 1596407 - RNA, 17 nt, Homo sapiens
gcaggagaauagccuga

SEQ ID NO: 1596408 - RNA, 18 nt, Homo sapiens
gcaggagaaucacuugaa

SEQ ID NO: 1596409 - RNA, 18 nt, Homo sapiens
gcaggagaauggugugaa

SEQ ID NO: 1596410 - RNA, 23 nt, Homo sapiens
gcaggaggagaaaagaaaugcac

SEQ ID NO: 1596411 - RNA, 16 nt, Homo sapiens
gcaggaggaucacuug

SEQ ID NO: 1596412 - RNA, 13 nt, Homo sapiens
gcaggaugcuaau

SEQ ID NO: 1596413 - RNA, 13 nt, Homo sapiens
gcaggccaaugua

SEQ ID NO: 1596414 - RNA, 15 nt, Homo sapiens
gcaggcugggccaug

SEQ ID NO: 1596415 - RNA, 18 nt, Homo sapiens
gcaggcugggccaugucc

SEQ ID NO: 1596416 - RNA, 19 nt, Homo sapiens
gcaggcugggccaugucca

SEQ ID NO: 1596417 - RNA, 17 nt, Homo sapiens
gcaggcugguuugcaag

SEQ ID NO: 1596418 - RNA, 23 nt, Homo sapiens
gcagggauguuccuuaccaagga

SEQ ID NO: 1596419 - RNA, 14 nt, Homo sapiens
gcagggauucuucc

SEQ ID NO: 1596420 - RNA, 21 nt, Homo sapiens
gcaggggagacaggagccuag

SEQ ID NO: 1596421 - RNA, 22 nt, Homo sapiens
gcaggucuccaccugcacauug

SEQ ID NO: 1596422 - RNA, 20 nt, Homo sapiens
gcagguggggagacugggcu

SEQ ID NO: 1596423 - RNA, 23 nt, Homo sapiens
gcaguauauaggugcuggaugua

SEQ ID NO: 1596424 - RNA, 14 nt, Homo sapiens
gcagucaagcccug

SEQ ID NO: 1596425 - RNA, 15 nt, Homo sapiens
gcagucaagcccugu

SEQ ID NO: 1596426 - RNA, 21 nt, Homo sapiens
gcagucaucagucaucaggug

SEQ ID NO: 1596427 - RNA, 22 nt, Homo sapiens
gcagucauggaggccaagaacu

SEQ ID NO: 1596428 - RNA, 22 nt, Homo sapiens
gcagucauuaugagaggcaaug

SEQ ID NO: 1596429 - RNA, 15 nt, Homo sapiens
gcaguccaggccucu

SEQ ID NO: 1596430 - RNA, 23 nt, Homo sapiens
gcagucuccccuuccuggcacau

SEQ ID NO: 1596431 - RNA, 19 nt, Homo sapiens
gcagucucuuagaauuugu

SEQ ID NO: 1596432 - RNA, 13 nt, Homo sapiens
gcagugaaguaua

SEQ ID NO: 1596433 - RNA, 21 nt, Homo sapiens
gcagugagccgagaucaugcc

SEQ ID NO: 1596434 - RNA, 16 nt, Homo sapiens
gcagugagcugagauc

SEQ ID NO: 1596435 - RNA, 12 nt, Homo sapiens
gcucccauuccu

SEQ ID NO: 1596436 - RNA, 16 nt, Homo sapiens
gcuccccucacucugu

SEQ ID NO: 1596437 - RNA, 14 nt, Homo sapiens
gcucccuccuccag

SEQ ID NO: 1596438 - RNA, 16 nt, Homo sapiens
gcucccuuucucagga

SEQ ID NO: 1596439 - RNA, 20 nt, Homo sapiens
gcuccucagagcgccaggaa

SEQ ID NO: 1596440 - RNA, 17 nt, Homo sapiens
gcuccuccuuaugacuc

SEQ ID NO: 1596441 - RNA, 14 nt, Homo sapiens
gcuccugcaucuca

SEQ ID NO: 1596442 - RNA, 20 nt, Homo sapiens
gcuccugugcucacccucuc

SEQ ID NO: 1596443 - RNA, 14 nt, Homo sapiens
gcuccuguucacac

SEQ ID NO: 1596444 - RNA, 19 nt, Homo sapiens
gcuccuuucuccugugaau

SEQ ID NO: 1596445 - RNA, 16 nt, Homo sapiens
gcucgcuuugagugac

SEQ ID NO: 1596446 - RNA, 20 nt, Homo sapiens
gcucuaacaaugacauuuau

SEQ ID NO: 1596447 - RNA, 20 nt, Homo sapiens
gcucucauuuuccugggugc

SEQ ID NO: 1596448 - RNA, 15 nt, Homo sapiens
gcucuccuucacucu

SEQ ID NO: 1596449 - RNA, 13 nt, Homo sapiens
gcucucgacagua

SEQ ID NO: 1596450 - RNA, 15 nt, Homo sapiens
gcucucucaccugcu

SEQ ID NO: 1596451 - RNA, 17 nt, Homo sapiens
gcucuguauggucagga

SEQ ID NO: 1596452 - RNA, 20 nt, Homo sapiens
gcucuuaugugugccuuugu

SEQ ID NO: 1596453 - RNA, 16 nt, Homo sapiens
gcucuuuugugaugaa

SEQ ID NO: 1596454 - RNA, 24 nt, Homo sapiens
gcugaaaugcaggaagugguggca

SEQ ID NO: 1596455 - RNA, 14 nt, Homo sapiens
gcugacacuggcag

SEQ ID NO: 1596456 - RNA, 12 nt, Homo sapiens
gcugacauucac

SEQ ID NO: 1596457 - RNA, 14 nt, Homo sapiens
gcugagagacccaa

SEQ ID NO: 1596458 - RNA, 20 nt, Homo sapiens
gcugagauugcaccacugca

SEQ ID NO: 1596459 - RNA, 23 nt, Homo sapiens
gcugagcagguguucuucauuac

SEQ ID NO: 1596460 - RNA, 18 nt, Homo sapiens
gcugaggccucucauucc

SEQ ID NO: 1596461 - RNA, 22 nt, Homo sapiens
gcugagucccuccaugcaaaag

SEQ ID NO: 1596462 - RNA, 23 nt, Homo sapiens
gcugaguuuauuaguacaugggc

SEQ ID NO: 1596463 - RNA, 17 nt, Homo sapiens
gcugaugagaaucaugc

SEQ ID NO: 1596464 - RNA, 15 nt, Homo sapiens
gcugauuccagaaca

SEQ ID NO: 1596465 - RNA, 16 nt, Homo sapiens
gcugcaagguacucug

SEQ ID NO: 1596466 - RNA, 15 nt, Homo sapiens
gcugcaauacauuaa

SEQ ID NO: 1596467 - RNA, 15 nt, Homo sapiens
gcugcagucaucuac

SEQ ID NO: 1596468 - RNA, 11 nt, Homo sapiens
gcugcaucucc

SEQ ID NO: 1596469 - RNA, 18 nt, Homo sapiens
gcugcaucuccccucaga

SEQ ID NO: 1596470 - RNA, 19 nt, Homo sapiens
gcugcaucuccccucagau

SEQ ID NO: 1596471 - RNA, 20 nt, Homo sapiens
gcugccaugucucagaugag

SEQ ID NO: 1596472 - RNA, 22 nt, Homo sapiens
gcugcccuccuuguccacccac

SEQ ID NO: 1596473 - RNA, 14 nt, Homo sapiens
gcugccucccuuuc

SEQ ID NO: 1596474 - RNA, 21 nt, Homo sapiens
gcugccucguagagugaccuc

SEQ ID NO: 1596475 - RNA, 19 nt, Homo sapiens
gcugccucuaccugacacu

SEQ ID NO: 1596476 - RNA, 23 nt, Homo sapiens
gcugcuaaagggagaaaugccag

SEQ ID NO: 1596477 - RNA, 12 nt, Homo sapiens
gcugcucauggg

SEQ ID NO: 1596478 - RNA, 21 nt, Homo sapiens
gcugcuccccuggaggacaga

SEQ ID NO: 1596479 - RNA, 17 nt, Homo sapiens
gcugcucccuuuccugc

SEQ ID NO: 1596480 - RNA, 12 nt, Homo sapiens
gcugcuccuagg

SEQ ID NO: 1596481 - RNA, 16 nt, Homo sapiens
gcugcugagugacagc

SEQ ID NO: 1596482 - RNA, 20 nt, Homo sapiens
gcugcuggaugacuugagau

SEQ ID NO: 1596483 - RNA, 22 nt, Homo sapiens
gcugcugggacuugaacaaaga

SEQ ID NO: 1596484 - RNA, 12 nt, Homo sapiens
gcuggaaccugc

SEQ ID NO: 1596485 - RNA, 18 nt, Homo sapiens
gcuggaaccugcaaaaaa

SEQ ID NO: 1596486 - RNA, 22 nt, Homo sapiens
gcuggaauuauucuaugucaau

SEQ ID NO: 1596487 - RNA, 20 nt, Homo sapiens
gcuggacuguuccaggcccu

SEQ ID NO: 1596488 - RNA, 17 nt, Homo sapiens
gcuggacuucuaccugc

SEQ ID NO: 1596489 - RNA, 18 nt, Homo sapiens
gcuggacuucuaccugcc

SEQ ID NO: 1596490 - RNA, 21 nt, Homo sapiens
gcuggaguuuuguugguguga

SEQ ID NO: 1596491 - RNA, 16 nt, Homo sapiens
gcuggccagugcugcc

SEQ ID NO: 1596492 - RNA, 22 nt, Homo sapiens
gcuggcuggaaaaaggugaaug

SEQ ID NO: 1596493 - RNA, 13 nt, Homo sapiens
gcuggcuugcagu

SEQ ID NO: 1596494 - RNA, 19 nt, Homo sapiens
gcugggaaauucaugugga

SEQ ID NO: 1596495 - RNA, 19 nt, Homo sapiens
gcugggaauaagugccagg

SEQ ID NO: 1596496 - RNA, 16 nt, Homo sapiens
gcugggcagaccccuc

SEQ ID NO: 1596497 - RNA, 17 nt, Homo sapiens
gcugggccauguccaaa

SEQ ID NO: 1596498 - RNA, 17 nt, Homo sapiens
gcugggcugggcaguau

SEQ ID NO: 1596499 - RNA, 15 nt, Homo sapiens
gcugggguugccaga

SEQ ID NO: 1596500 - RNA, 20 nt, Homo sapiens
gcuggucuggaguugcugaa

SEQ ID NO: 1596501 - RNA, 20 nt, Homo sapiens
gcuguaaccgauaugcacuu

SEQ ID NO: 1596502 - RNA, 15 nt, Homo sapiens
gcuguagacaucugu

SEQ ID NO: 1596503 - RNA, 13 nt, Homo sapiens
gcuguagaugaca

SEQ ID NO: 1596504 - RNA, 23 nt, Homo sapiens
gcuguauagcugcuuccagugua

SEQ ID NO: 1596505 - RNA, 16 nt, Homo sapiens
gcuguauuguguauca

SEQ ID NO: 1596506 - RNA, 16 nt, Homo sapiens
gcugucacauacaacu

SEQ ID NO: 1596507 - RNA, 19 nt, Homo sapiens
gcugucguuguuguggaag

SEQ ID NO: 1596508 - RNA, 18 nt, Homo sapiens
gcuguggcagaguuacag

SEQ ID NO: 1596509 - RNA, 16 nt, Homo sapiens
gcuguggcauccagag

SEQ ID NO: 1596510 - RNA, 23 nt, Homo sapiens
gcuguggccgucuccucccucag

SEQ ID NO: 1596511 - RNA, 20 nt, Homo sapiens
gcuguguggacuucaucuca

SEQ ID NO: 1596512 - RNA, 16 nt, Homo sapiens
gcuguguuuccaucuc

SEQ ID NO: 1596513 - RNA, 17 nt, Homo sapiens
gcuguuauuucuucccu

SEQ ID NO: 1596514 - RNA, 15 nt, Homo sapiens
gcuguugacauauuu

SEQ ID NO: 1596515 - RNA, 13 nt, Homo sapiens
gcuguugccucau

SEQ ID NO: 1596516 - RNA, 21 nt, Homo sapiens
gcuguuuaugaacggaaauca

SEQ ID NO: 1596517 - RNA, 11 nt, Homo sapiens
gcuguuucauc

SEQ ID NO: 1596518 - RNA, 21 nt, Homo sapiens
gcuguuuucaauaaugugaau

SEQ ID NO: 1596519 - RNA, 20 nt, Homo sapiens
gcuuaaacccauacaaugua

SEQ ID NO: 1596520 - RNA, 20 nt, Homo sapiens
gcuuaaacccuuuagugcuu

SEQ ID NO: 1596521 - RNA, 18 nt, Homo sapiens
gcuuaaaguuauguuauu

SEQ ID NO: 1596522 - RNA, 20 nt, Homo sapiens
gcuuaaccuuuccaguuuau

SEQ ID NO: 1596523 - RNA, 23 nt, Homo sapiens
gcuuaaggagaggagaaacugag

SEQ ID NO: 1596524 - RNA, 18 nt, Homo sapiens
gcuuacaaauacuaaaaa

SEQ ID NO: 1596525 - RNA, 18 nt, Homo sapiens
gcuuacuagcacuuugag

SEQ ID NO: 1596526 - RNA, 21 nt, Homo sapiens
gcuuagacuaaggccauuauu

SEQ ID NO: 1596527 - RNA, 23 nt, Homo sapiens
gcuuaguccaauuccuugcacau

SEQ ID NO: 1596528 - RNA, 19 nt, Homo sapiens
gcuuauccccucagaaucc

SEQ ID NO: 1596529 - RNA, 19 nt, Homo sapiens
gcuucaguugcauaucuua

SEQ ID NO: 1596530 - RNA, 21 nt, Homo sapiens
gcuucaugaauuucuccuuuc

SEQ ID NO: 1596531 - RNA, 24 nt, Homo sapiens
gcuucaugugcugccugcaagcuu

SEQ ID NO: 1596532 - RNA, 22 nt, Homo sapiens
gcuuccaggcugagagccggcc

SEQ ID NO: 1596533 - RNA, 17 nt, Homo sapiens
gcuucccccacauuggg

SEQ ID NO: 1596534 - RNA, 19 nt, Homo sapiens
gcuuccccgugcaugauuu

SEQ ID NO: 1596535 - RNA, 15 nt, Homo sapiens
gcuucccugacucau

SEQ ID NO: 1596536 - RNA, 20 nt, Homo sapiens
gcuuccuacccacaccucug

SEQ ID NO: 1596537 - RNA, 19 nt, Homo sapiens
gcuuccuggaacuugcucu

SEQ ID NO: 1596538 - RNA, 19 nt, Homo sapiens
gcuuccuuuuauuuuuaua

SEQ ID NO: 1596539 - RNA, 21 nt, Homo sapiens
gcuucuagcugacuugcacag

SEQ ID NO: 1596540 - RNA, 17 nt, Homo sapiens
gcuucugggccacucag

SEQ ID NO: 1596541 - RNA, 17 nt, Homo sapiens
gcuucuucacaggcacu

SEQ ID NO: 1596542 - RNA, 13 nt, Homo sapiens
gcuucuuggagcu

SEQ ID NO: 1596543 - RNA, 21 nt, Homo sapiens
gcuucuuuccagaaaccaaac

SEQ ID NO: 1596544 - RNA, 13 nt, Homo sapiens
gcuugaagccaaa

SEQ ID NO: 1596545 - RNA, 15 nt, Homo sapiens
gcuugaagccaaaga

SEQ ID NO: 1596546 - RNA, 16 nt, Homo sapiens
gcuugaagccaaagaa

SEQ ID NO: 1596547 - RNA, 20 nt, Homo sapiens
gcuugaccauguugcacugu

SEQ ID NO: 1596548 - RNA, 15 nt, Homo sapiens
gcuugauaaacauaa

SEQ ID NO: 1596549 - RNA, 21 nt, Homo sapiens
gcuugcccuguuaaaagauga

SEQ ID NO: 1596550 - RNA, 22 nt, Homo sapiens
gcuuguaacuccaccaacccau

SEQ ID NO: 1596551 - RNA, 22 nt, Homo sapiens
gcuugucacagucucuacuguu

SEQ ID NO: 1596552 - RNA, 22 nt, Homo sapiens
gggcaaaugaauuucaugugaa

SEQ ID NO: 1596553 - RNA, 19 nt, Homo sapiens
gggcaaugaugugugcaag

SEQ ID NO: 1596554 - RNA, 23 nt, Homo sapiens
gggcacccaaaacucaagcaaga

SEQ ID NO: 1596555 - RNA, 17 nt, Homo sapiens
gggcacugccagcccac

SEQ ID NO: 1596556 - RNA, 13 nt, Homo sapiens
gggcagacaauaa

SEQ ID NO: 1596557 - RNA, 13 nt, Homo sapiens
gggcagauucuga

SEQ ID NO: 1596558 - RNA, 21 nt, Homo sapiens
gggcaggcugggccaugucca

SEQ ID NO: 1596559 - RNA, 17 nt, Homo sapiens
gggcaguuccuuaccuc

SEQ ID NO: 1596560 - RNA, 15 nt, Homo sapiens
gggccaaccucaggc

SEQ ID NO: 1596561 - RNA, 16 nt, Homo sapiens
gggccauguccaaaga

SEQ ID NO: 1596562 - RNA, 16 nt, Homo sapiens
gggcccacccauguca

SEQ ID NO: 1596563 - RNA, 22 nt, Homo sapiens
gggcccugccccaccccaucca

SEQ ID NO: 1596564 - RNA, 12 nt, Homo sapiens
gggcgccaaguc

SEQ ID NO: 1596565 - RNA, 23 nt, Homo sapiens
gggcuagagaaaucagcugcuau

SEQ ID NO: 1596566 - RNA, 21 nt, Homo sapiens
gggcucaaacuucuaaggggu

SEQ ID NO: 1596567 - RNA, 15 nt, Homo sapiens
gggcuccacgggcag

SEQ ID NO: 1596568 - RNA, 14 nt, Homo sapiens
gggcucgugcccug

SEQ ID NO: 1596569 - RNA, 14 nt, Homo sapiens
gggcucucucauga

SEQ ID NO: 1596570 - RNA, 17 nt, Homo sapiens
gggcugaccgugucucu

SEQ ID NO: 1596571 - RNA, 23 nt, Homo sapiens
gggcugcaugaccuaccaggaca

SEQ ID NO: 1596572 - RNA, 14 nt, Homo sapiens
gggcugcuccccaa

SEQ ID NO: 1596573 - RNA, 22 nt, Homo sapiens
gggcuuguuuuucuucagcauu

SEQ ID NO: 1596574 - RNA, 15 nt, Homo sapiens
ggggaaaacgggcag

SEQ ID NO: 1596575 - RNA, 19 nt, Homo sapiens
ggggaaguaaaacagucau

SEQ ID NO: 1596576 - RNA, 18 nt, Homo sapiens
ggggaauaaaagagaucu

SEQ ID NO: 1596577 - RNA, 21 nt, Homo sapiens
ggggacacagcaucagcucaa

SEQ ID NO: 1596578 - RNA, 19 nt, Homo sapiens
ggggacgcccccaccagcu

SEQ ID NO: 1596579 - RNA, 22 nt, Homo sapiens
ggggacugcuaccucugagaag

SEQ ID NO: 1596580 - RNA, 19 nt, Homo sapiens
ggggagcaguaaacuuucu

SEQ ID NO: 1596581 - RNA, 20 nt, Homo sapiens
ggggcacaagugucugugca

SEQ ID NO: 1596582 - RNA, 21 nt, Homo sapiens
ggggcagccacaccacugcca

SEQ ID NO: 1596583 - RNA, 16 nt, Homo sapiens
ggggcagggccacuca

SEQ ID NO: 1596584 - RNA, 18 nt, Homo sapiens
ggggccgggcgcgguggc

SEQ ID NO: 1596585 - RNA, 18 nt, Homo sapiens
ggggccuugggugagugg

SEQ ID NO: 1596586 - RNA, 18 nt, Homo sapiens
ggggcuccagcaccuucu

SEQ ID NO: 1596587 - RNA, 15 nt, Homo sapiens
ggggguucuguuuca

SEQ ID NO: 1596588 - RNA, 18 nt, Homo sapiens
ggggucucgcucugucac

SEQ ID NO: 1596589 - RNA, 19 nt, Homo sapiens
ggguaauagaaaugcauac

SEQ ID NO: 1596590 - RNA, 18 nt, Homo sapiens
ggguacagcccuugcacu

SEQ ID NO: 1596591 - RNA, 20 nt, Homo sapiens
ggguacagcccuugcacucc

SEQ ID NO: 1596592 - RNA, 23 nt, Homo sapiens
ggguauuguuaggaaaugucauc

SEQ ID NO: 1596593 - RNA, 23 nt, Homo sapiens
gggucccccugcuugucuucacc

SEQ ID NO: 1596594 - RNA, 22 nt, Homo sapiens
gggucccugcaaaacuccaggc

SEQ ID NO: 1596595 - RNA, 14 nt, Homo sapiens
gggucuucagcuuu

SEQ ID NO: 1596596 - RNA, 14 nt, Homo sapiens
gggugcaagcacuc

SEQ ID NO: 1596597 - RNA, 21 nt, Homo sapiens
ggguggcccuugcaguucagc

SEQ ID NO: 1596598 - RNA, 13 nt, Homo sapiens
gggugggggugga

SEQ ID NO: 1596599 - RNA, 14 nt, Homo sapiens
ggguuuugcuacau

SEQ ID NO: 1596600 - RNA, 23 nt, Homo sapiens
ggguuuuuguucuggaagccaua

SEQ ID NO: 1596601 - RNA, 19 nt, Homo sapiens
gguaaaacucacugugauc

SEQ ID NO: 1596602 - RNA, 17 nt, Homo sapiens
gguaaauacugugaaau

SEQ ID NO: 1596603 - RNA, 19 nt, Homo sapiens
gguaacugcuuucuguucc

SEQ ID NO: 1596604 - RNA, 20 nt, Homo sapiens
gguaauaaaugugacucagc

SEQ ID NO: 1596605 - RNA, 16 nt, Homo sapiens
gguaauacaaacuaua

SEQ ID NO: 1596606 - RNA, 17 nt, Homo sapiens
gguaauucuagccuuuu

SEQ ID NO: 1596607 - RNA, 18 nt, Homo sapiens
gguaauucuauugggaua

SEQ ID NO: 1596608 - RNA, 14 nt, Homo sapiens
gguacaauuguaaa

SEQ ID NO: 1596609 - RNA, 20 nt, Homo sapiens
gguacacuguuuccauguua

SEQ ID NO: 1596610 - RNA, 22 nt, Homo sapiens
gguacauaggcuucuauuaccu

SEQ ID NO: 1596611 - RNA, 23 nt, Homo sapiens
gguacauucuagcugagaagcaa

SEQ ID NO: 1596612 - RNA, 23 nt, Homo sapiens
gguaccucucaacauuaccaaaa

SEQ ID NO: 1596613 - RNA, 22 nt, Homo sapiens
gguacuauaaaagcuuucugcc

SEQ ID NO: 1596614 - RNA, 20 nt, Homo sapiens
gguagaggcugggggcucca

SEQ ID NO: 1596615 - RNA, 18 nt, Homo sapiens
gguaguuagccaucuaau

SEQ ID NO: 1596616 - RNA, 15 nt, Homo sapiens
gguaguuauucugcc

SEQ ID NO: 1596617 - RNA, 14 nt, Homo sapiens
gguaucuucuuuag

SEQ ID NO: 1596618 - RNA, 11 nt, Homo sapiens
gguaugcauuu

SEQ ID NO: 1596619 - RNA, 15 nt, Homo sapiens
gguauguaauggaac

SEQ ID NO: 1596620 - RNA, 17 nt, Homo sapiens
gguauuagcaaagcaaa

SEQ ID NO: 1596621 - RNA, 18 nt, Homo sapiens
ggucacccaacucaagga

SEQ ID NO: 1596622 - RNA, 23 nt, Homo sapiens
ggucagagagaccucauccugcu

SEQ ID NO: 1596623 - RNA, 20 nt, Homo sapiens
ggucauuacaaaaaaacacg

SEQ ID NO: 1596624 - RNA, 22 nt, Homo sapiens
ggucccugcaaaacuccaggca

SEQ ID NO: 1596625 - RNA, 16 nt, Homo sapiens
gguccuaaaagcaaaa

SEQ ID NO: 1596626 - RNA, 19 nt, Homo sapiens
gguccuagaugccaaaggg

SEQ ID NO: 1596627 - RNA, 17 nt, Homo sapiens
gguccuguucccuaccc

SEQ ID NO: 1596628 - RNA, 20 nt, Homo sapiens
gguccuucccucucaugacu

SEQ ID NO: 1596629 - RNA, 15 nt, Homo sapiens
ggucgggacagcugu

SEQ ID NO: 1596630 - RNA, 16 nt, Homo sapiens
ggucuaagguucagcc

SEQ ID NO: 1596631 - RNA, 20 nt, Homo sapiens
ggucucaaacuccugaccuc

SEQ ID NO: 1596632 - RNA, 22 nt, Homo sapiens
ggucucauagguugagcaauuu

SEQ ID NO: 1596633 - RNA, 17 nt, Homo sapiens
ggucucaucucccaggc

SEQ ID NO: 1596634 - RNA, 21 nt, Homo sapiens
ggucucuuuccaaagcauuuu

SEQ ID NO: 1596635 - RNA, 21 nt, Homo sapiens
ggucugacaugaacacuuuuu

SEQ ID NO: 1596636 - RNA, 16 nt, Homo sapiens
ggucugggcagcaccu

SEQ ID NO: 1596637 - RNA, 18 nt, Homo sapiens
ggucugguuguugcacca

SEQ ID NO: 1596638 - RNA, 20 nt, Homo sapiens
ggucugugggucaguccucu

SEQ ID NO: 1596639 - RNA, 12 nt, Homo sapiens
ggucugugucac

SEQ ID NO: 1596640 - RNA, 22 nt, Homo sapiens
ggucuuccuuuggcaugggaug

SEQ ID NO: 1596641 - RNA, 18 nt, Homo sapiens
ggugaaacccccaucucu

SEQ ID NO: 1596642 - RNA, 14 nt, Homo sapiens
ggugaaaucccugc

SEQ ID NO: 1596643 - RNA, 14 nt, Homo sapiens
ggugacaaccauua

SEQ ID NO: 1596644 - RNA, 16 nt, Homo sapiens
ggugacagcuccggga

SEQ ID NO: 1596645 - RNA, 16 nt, Homo sapiens
ggugaccucacuuuag

SEQ ID NO: 1596646 - RNA, 23 nt, Homo sapiens
ggugauugucauguaaggcuuaa

SEQ ID NO: 1596647 - RNA, 21 nt, Homo sapiens
ggugcaagcacucgggguccc

SEQ ID NO: 1596648 - RNA, 21 nt, Homo sapiens
ggugcagggagacaucugcac

SEQ ID NO: 1596649 - RNA, 19 nt, Homo sapiens
ggugcauagcaagugaaag

SEQ ID NO: 1596650 - RNA, 14 nt, Homo sapiens
ggugcccagcuuau

SEQ ID NO: 1596651 - RNA, 18 nt, Homo sapiens
ggugcccuuugggguccc

SEQ ID NO: 1596652 - RNA, 17 nt, Homo sapiens
ggugcugcuuucuuguu

SEQ ID NO: 1596653 - RNA, 20 nt, Homo sapiens
ggugcugcuuucuuguugcu

SEQ ID NO: 1596654 - RNA, 17 nt, Homo sapiens
ggugcuucucagauuuc

SEQ ID NO: 1596655 - RNA, 13 nt, Homo sapiens
gguggagggccac

SEQ ID NO: 1596656 - RNA, 22 nt, Homo sapiens
ggugggcccccaaugacaccca

SEQ ID NO: 1596657 - RNA, 13 nt, Homo sapiens
gguggugcuaaag

SEQ ID NO: 1596658 - RNA, 21 nt, Homo sapiens
ggugguggcgugcauauguaa

SEQ ID NO: 1596659 - RNA, 18 nt, Homo sapiens
gguguacacggaggucuc

SEQ ID NO: 1596660 - RNA, 18 nt, Homo sapiens
gguguauugaaguccucc

SEQ ID NO: 1596661 - RNA, 21 nt, Homo sapiens
ggugucaguauccaggcuuug

SEQ ID NO: 1596662 - RNA, 19 nt, Homo sapiens
ggugucuuuaacugucauu

SEQ ID NO: 1596663 - RNA, 14 nt, Homo sapiens
ggugugaccacugc

SEQ ID NO: 1596664 - RNA, 19 nt, Homo sapiens
gguuaaaaaaaaaagucac

SEQ ID NO: 1596665 - RNA, 23 nt, Homo sapiens
gguuacacuguuagaacacuauu

SEQ ID NO: 1596666 - RNA, 17 nt, Homo sapiens
gguuauaacaguguuua

SEQ ID NO: 1596667 - RNA, 14 nt, Homo sapiens
gguuauuucaauuc

SEQ ID NO: 1596668 - RNA, 22 nt, Homo sapiens
gguuauuucagcccccaucacc

SEQ ID NO: 1596669 - RNA, 20 nt, Homo sapiens
uagccuauuaaacuauuuua

SEQ ID NO: 1596670 - RNA, 22 nt, Homo sapiens
uagccugcagaaguaagccuca

SEQ ID NO: 1596671 - RNA, 18 nt, Homo sapiens
uagccugcauaucauuca

SEQ ID NO: 1596672 - RNA, 16 nt, Homo sapiens
uagccuuccucugauu

SEQ ID NO: 1596673 - RNA, 14 nt, Homo sapiens
uagcggagcccagc

SEQ ID NO: 1596674 - RNA, 22 nt, Homo sapiens
uagcuauuuuuuuccuaagaca

SEQ ID NO: 1596675 - RNA, 19 nt, Homo sapiens
uagcucaauuaguguggcu

SEQ ID NO: 1596676 - RNA, 22 nt, Homo sapiens
uagcucucucuagaaugagcaa

SEQ ID NO: 1596677 - RNA, 23 nt, Homo sapiens
uagcugagaagcaaugggucacu

SEQ ID NO: 1596678 - RNA, 19 nt, Homo sapiens
uagcugauuuaacuuguau

SEQ ID NO: 1596679 - RNA, 11 nt, Homo sapiens
uagcugucacc

SEQ ID NO: 1596680 - RNA, 23 nt, Homo sapiens
uagcugugucauguauauaccuu

SEQ ID NO: 1596681 - RNA, 14 nt, Homo sapiens
uagcuuaucugccc

SEQ ID NO: 1596682 - RNA, 18 nt, Homo sapiens
uagcuuuugaugucucca

SEQ ID NO: 1596683 - RNA, 22 nt, Homo sapiens
uagcuuuugaugucuccaagua

SEQ ID NO: 1596684 - RNA, 14 nt, Homo sapiens
uaggaaaaaaacug

SEQ ID NO: 1596685 - RNA, 18 nt, Homo sapiens
uaggaaaaaaauaguaaa

SEQ ID NO: 1596686 - RNA, 13 nt, Homo sapiens
uaggaaacuugaa

SEQ ID NO: 1596687 - RNA, 17 nt, Homo sapiens
uaggaaaguuucuucaa

SEQ ID NO: 1596688 - RNA, 19 nt, Homo sapiens
uaggaaaucuagaaguagu

SEQ ID NO: 1596689 - RNA, 15 nt, Homo sapiens
uaggaaaugucauca

SEQ ID NO: 1596690 - RNA, 13 nt, Homo sapiens
uaggaaccuugca

SEQ ID NO: 1596691 - RNA, 16 nt, Homo sapiens
uaggagguuauuucaa

SEQ ID NO: 1596692 - RNA, 15 nt, Homo sapiens
uaggauauaagaggg

SEQ ID NO: 1596693 - RNA, 12 nt, Homo sapiens
uaggaugugaug

SEQ ID NO: 1596694 - RNA, 17 nt, Homo sapiens
uaggauguguauuucau

SEQ ID NO: 1596695 - RNA, 15 nt, Homo sapiens
uaggcagugcuaaag

SEQ ID NO: 1596696 - RNA, 15 nt, Homo sapiens
uaggcauauaucacu

SEQ ID NO: 1596697 - RNA, 16 nt, Homo sapiens
uaggcaugguggacuc

SEQ ID NO: 1596698 - RNA, 23 nt, Homo sapiens
uaggcauuucauuaugcuuugaa

SEQ ID NO: 1596699 - RNA, 17 nt, Homo sapiens
uaggcauuuuaaguaaa

SEQ ID NO: 1596700 - RNA, 17 nt, Homo sapiens
uaggccagcaccaucuc

SEQ ID NO: 1596701 - RNA, 23 nt, Homo sapiens
uaggccucaacuccucccauaga

SEQ ID NO: 1596702 - RNA, 20 nt, Homo sapiens
uaggccugguguguucaaga

SEQ ID NO: 1596703 - RNA, 15 nt, Homo sapiens
uaggccuguguguau

SEQ ID NO: 1596704 - RNA, 22 nt, Homo sapiens
uaggccuguguguauagcugug

SEQ ID NO: 1596705 - RNA, 23 nt, Homo sapiens
uaggcuggaaaugguuucacuug

SEQ ID NO: 1596706 - RNA, 14 nt, Homo sapiens
uagggaucccucau

SEQ ID NO: 1596707 - RNA, 11 nt, Homo sapiens
uaggggaugag

SEQ ID NO: 1596708 - RNA, 20 nt, Homo sapiens
uagguaaaauaaaagacuau

SEQ ID NO: 1596709 - RNA, 14 nt, Homo sapiens
uagguaucauucaa

SEQ ID NO: 1596710 - RNA, 21 nt, Homo sapiens
uaggucauucuuuugccacau

SEQ ID NO: 1596711 - RNA, 15 nt, Homo sapiens
uaggugaaaguuaau

SEQ ID NO: 1596712 - RNA, 22 nt, Homo sapiens
uaggugaaaguuaauccacugu

SEQ ID NO: 1596713 - RNA, 16 nt, Homo sapiens
uaggugcuauuuguca

SEQ ID NO: 1596714 - RNA, 15 nt, Homo sapiens
uagguugagcaauuu

SEQ ID NO: 1596715 - RNA, 14 nt, Homo sapiens
uaguaaauagggaa

SEQ ID NO: 1596716 - RNA, 21 nt, Homo sapiens
uaguaaauuuaaguccaccuc

SEQ ID NO: 1596717 - RNA, 18 nt, Homo sapiens
uaguaagaaacaaugggc

SEQ ID NO: 1596718 - RNA, 16 nt, Homo sapiens
uaguaaguauuuccau

SEQ ID NO: 1596719 - RNA, 16 nt, Homo sapiens
uaguacuaagcuuaau

SEQ ID NO: 1596720 - RNA, 22 nt, Homo sapiens
uaguacuauuauggaauuacuc

SEQ ID NO: 1596721 - RNA, 15 nt, Homo sapiens
uaguagaacucacag

SEQ ID NO: 1596722 - RNA, 20 nt, Homo sapiens
uaguagcugggauuacaggc

SEQ ID NO: 1596723 - RNA, 13 nt, Homo sapiens
uaguauacuuugu

SEQ ID NO: 1596724 - RNA, 16 nt, Homo sapiens
uaguauuggaucugaa

SEQ ID NO: 1596725 - RNA, 22 nt, Homo sapiens
uaguauuuaacuacaucugccu

SEQ ID NO: 1596726 - RNA, 19 nt, Homo sapiens
uaguauuuuuauccaugac

SEQ ID NO: 1596727 - RNA, 13 nt, Homo sapiens
uagucaauaucaa

SEQ ID NO: 1596728 - RNA, 13 nt, Homo sapiens
uagucacaaagac

SEQ ID NO: 1596729 - RNA, 21 nt, Homo sapiens
uagucacugucucaacuacuc

SEQ ID NO: 1596730 - RNA, 16 nt, Homo sapiens
uagucaucaaugcaau

SEQ ID NO: 1596731 - RNA, 17 nt, Homo sapiens
uagucaucaaugcaaua

SEQ ID NO: 1596732 - RNA, 21 nt, Homo sapiens
uagucaucagauaugcuuacu

SEQ ID NO: 1596733 - RNA, 16 nt, Homo sapiens
uagucauggauaacua

SEQ ID NO: 1596734 - RNA, 23 nt, Homo sapiens
uagucauuaacccaucucugaac

SEQ ID NO: 1596735 - RNA, 14 nt, Homo sapiens
uaguccaauuccuu

SEQ ID NO: 1596736 - RNA, 14 nt, Homo sapiens
uaguccaccuucau

SEQ ID NO: 1596737 - RNA, 12 nt, Homo sapiens
uaguccagauuu

SEQ ID NO: 1596738 - RNA, 16 nt, Homo sapiens
uaguccauaagcuuua

SEQ ID NO: 1596739 - RNA, 17 nt, Homo sapiens
uagucgaacaauucaua

SEQ ID NO: 1596740 - RNA, 20 nt, Homo sapiens
uagucgagcuugggcaauuu

SEQ ID NO: 1596741 - RNA, 15 nt, Homo sapiens
uagucucuccccugg

SEQ ID NO: 1596742 - RNA, 15 nt, Homo sapiens
uagucuguuugcaaa

SEQ ID NO: 1596743 - RNA, 15 nt, Homo sapiens
uagugaaacauguac

SEQ ID NO: 1596744 - RNA, 14 nt, Homo sapiens
uagugauggagcuu

SEQ ID NO: 1596745 - RNA, 20 nt, Homo sapiens
uagugcaaaaacuguaaaag

SEQ ID NO: 1596746 - RNA, 13 nt, Homo sapiens
uagugcacaaaau

SEQ ID NO: 1596747 - RNA, 12 nt, Homo sapiens
uagugcagccaa

SEQ ID NO: 1596748 - RNA, 18 nt, Homo sapiens
uagugccugaaauuucac

SEQ ID NO: 1596749 - RNA, 22 nt, Homo sapiens
uagugcuuugugauaguucagu

SEQ ID NO: 1596750 - RNA, 20 nt, Homo sapiens
uaguggccugugcuuuucag

SEQ ID NO: 1596751 - RNA, 18 nt, Homo sapiens
uaguguauuuugcacaaa

SEQ ID NO: 1596752 - RNA, 20 nt, Homo sapiens
uaguguucauugaugcugcu

SEQ ID NO: 1596753 - RNA, 19 nt, Homo sapiens
uaguuaaaaaaaaauuccc

SEQ ID NO: 1596754 - RNA, 23 nt, Homo sapiens
uaguuaacauaguaaguucagca

SEQ ID NO: 1596755 - RNA, 14 nt, Homo sapiens
uaguuaagugugga

SEQ ID NO: 1596756 - RNA, 18 nt, Homo sapiens
uaguuauaaaacuaugug

SEQ ID NO: 1596757 - RNA, 15 nt, Homo sapiens
uaguuaucaguauuu

SEQ ID NO: 1596758 - RNA, 15 nt, Homo sapiens
uaguuccuuacuguu

SEQ ID NO: 1596759 - RNA, 16 nt, Homo sapiens
uaguucugccaggaga

SEQ ID NO: 1596760 - RNA, 16 nt, Homo sapiens
uaguucuguguugacc

SEQ ID NO: 1596761 - RNA, 21 nt, Homo sapiens
uaguugaauguugcaauguga

SEQ ID NO: 1596762 - RNA, 14 nt, Homo sapiens
uaguugcaguauug

SEQ ID NO: 1596763 - RNA, 16 nt, Homo sapiens
uaguuguuggucugua

SEQ ID NO: 1596764 - RNA, 19 nt, Homo sapiens
uaguuguuggucuguagca

SEQ ID NO: 1596765 - RNA, 15 nt, Homo sapiens
uaguuuaggcuggaa

SEQ ID NO: 1596766 - RNA, 17 nt, Homo sapiens
uaguuuaugauuccacc

SEQ ID NO: 1596767 - RNA, 17 nt, Homo sapiens
uaguuuuagcuguagau

SEQ ID NO: 1596768 - RNA, 23 nt, Homo sapiens
uaguuuuagcuguagaucaagcu

SEQ ID NO: 1596769 - RNA, 20 nt, Homo sapiens
uaguuuugucaaacuguaga

SEQ ID NO: 1596770 - RNA, 19 nt, Homo sapiens
uaguuuugugaaggugauu

SEQ ID NO: 1596771 - RNA, 19 nt, Homo sapiens
uaguuuuucagucuauggg

SEQ ID NO: 1596772 - RNA, 23 nt, Homo sapiens
uaguuuuuucuuucccauguauu

SEQ ID NO: 1596773 - RNA, 23 nt, Homo sapiens
uauaaaacuauguguucaaugaa

SEQ ID NO: 1596774 - RNA, 17 nt, Homo sapiens
uauaaacaaaagaaucu

SEQ ID NO: 1596775 - RNA, 12 nt, Homo sapiens
uauaaacauauc

SEQ ID NO: 1596776 - RNA, 15 nt, Homo sapiens
uauaaacuaccaaau

SEQ ID NO: 1596777 - RNA, 23 nt, Homo sapiens
uauaaagcaguauuuuucuugac

SEQ ID NO: 1596778 - RNA, 20 nt, Homo sapiens
uauaaagguggugggcaaaa

SEQ ID NO: 1596779 - RNA, 18 nt, Homo sapiens
uauaaauacacuuccugc

SEQ ID NO: 1596780 - RNA, 21 nt, Homo sapiens
uauaaauacacuuccugcuua

SEQ ID NO: 1596781 - RNA, 15 nt, Homo sapiens
uauaaaugaaugugc

SEQ ID NO: 1596782 - RNA, 23 nt, Homo sapiens
uauaaauuucugucuuucugcua

SEQ ID NO: 1596783 - RNA, 16 nt, Homo sapiens
uauaacaaaugcuuua

SEQ ID NO: 1596784 - RNA, 19 nt, Homo sapiens
uauaacuccuuguuucaga

SEQ ID NO: 1596785 - RNA, 16 nt, Homo sapiens
uauaacuguauuugaa

SEQ ID NO: 1596786 - RNA, 21 nt, Homo sapiens
uauaacuuaggccuagccucu

SEQ ID NO: 1596787 - RNA, 13 nt, Homo sapiens
uauggcuagacag

SEQ ID NO: 1596788 - RNA, 14 nt, Homo sapiens
uaugggagaauugc

SEQ ID NO: 1596789 - RNA, 23 nt, Homo sapiens
uaugggcagcccagugcugccac

SEQ ID NO: 1596790 - RNA, 18 nt, Homo sapiens
uauggguugucaauagua

SEQ ID NO: 1596791 - RNA, 22 nt, Homo sapiens
uaugguaggaacugcugggcuu

SEQ ID NO: 1596792 - RNA, 10 nt, Homo sapiens
uauggucaca

SEQ ID NO: 1596793 - RNA, 15 nt, Homo sapiens
uaugguugacacuag

SEQ ID NO: 1596794 - RNA, 22 nt, Homo sapiens
uauguaaauguguuagcacuga

SEQ ID NO: 1596795 - RNA, 13 nt, Homo sapiens
uauguaacaugua

SEQ ID NO: 1596796 - RNA, 23 nt, Homo sapiens
uauguaguaauugacaugugcca

SEQ ID NO: 1596797 - RNA, 19 nt, Homo sapiens
uaugucauuuuuaauguau

SEQ ID NO: 1596798 - RNA, 17 nt, Homo sapiens
uauguccgaugguaucu

SEQ ID NO: 1596799 - RNA, 13 nt, Homo sapiens
uaugucugccuuc

SEQ ID NO: 1596800 - RNA, 21 nt, Homo sapiens
uaugucugccuucgaccacag

SEQ ID NO: 1596801 - RNA, 18 nt, Homo sapiens
uaugugacuugcaauaaa

SEQ ID NO: 1596802 - RNA, 21 nt, Homo sapiens
uaugugagauuuccuuaucac

SEQ ID NO: 1596803 - RNA, 11 nt, Homo sapiens
uaugugcaaaa

SEQ ID NO: 1596804 - RNA, 22 nt, Homo sapiens
uauguggaagugugggucugug

SEQ ID NO: 1596805 - RNA, 18 nt, Homo sapiens
uaugugugaggagcugcu

SEQ ID NO: 1596806 - RNA, 17 nt, Homo sapiens
uauguguugccaaaacc

SEQ ID NO: 1596807 - RNA, 20 nt, Homo sapiens
uauguuacuguauuuuucag

SEQ ID NO: 1596808 - RNA, 23 nt, Homo sapiens
uauuaacacuaauaauaguacua

SEQ ID NO: 1596809 - RNA, 12 nt, Homo sapiens
uauuaagauauc

SEQ ID NO: 1596810 - RNA, 13 nt, Homo sapiens
uauuaaucaccuc

SEQ ID NO: 1596811 - RNA, 21 nt, Homo sapiens
uauuaaucauacaaacucuca

SEQ ID NO: 1596812 - RNA, 19 nt, Homo sapiens
uauuaaucuggacauucga

SEQ ID NO: 1596813 - RNA, 12 nt, Homo sapiens
uauuacaguguc

SEQ ID NO: 1596814 - RNA, 14 nt, Homo sapiens
uauuacauaugauu

SEQ ID NO: 1596815 - RNA, 18 nt, Homo sapiens
uauuacuaguacuauuac

SEQ ID NO: 1596816 - RNA, 15 nt, Homo sapiens
uauuacuaguguuua

SEQ ID NO: 1596817 - RNA, 12 nt, Homo sapiens
uauuacugaugu

SEQ ID NO: 1596818 - RNA, 19 nt, Homo sapiens
uauuacuuugucuuuucaa

SEQ ID NO: 1596819 - RNA, 18 nt, Homo sapiens
uauuagagcugccugugc

SEQ ID NO: 1596820 - RNA, 21 nt, Homo sapiens
uauuagaucaaauaguugcau

SEQ ID NO: 1596821 - RNA, 15 nt, Homo sapiens
uauuauagugaaaca

SEQ ID NO: 1596822 - RNA, 22 nt, Homo sapiens
uauuauaucagcuuuucugaug

SEQ ID NO: 1596823 - RNA, 17 nt, Homo sapiens
uauuauauuuauguugu

SEQ ID NO: 1596824 - RNA, 14 nt, Homo sapiens
uauuauguccugug

SEQ ID NO: 1596825 - RNA, 12 nt, Homo sapiens
uauuauugaacu

SEQ ID NO: 1596826 - RNA, 17 nt, Homo sapiens
uauuauuuuagugugua

SEQ ID NO: 1596827 - RNA, 15 nt, Homo sapiens
uauucaaaauuuugu

SEQ ID NO: 1596828 - RNA, 20 nt, Homo sapiens
uauucaaacauuauucucaa

SEQ ID NO: 1596829 - RNA, 23 nt, Homo sapiens
uauucaaagagaaaacaucucau

SEQ ID NO: 1596830 - RNA, 14 nt, Homo sapiens
uauucaaaugaagg

SEQ ID NO: 1596831 - RNA, 16 nt, Homo sapiens
uauuccaaaccaaauu

SEQ ID NO: 1596832 - RNA, 14 nt, Homo sapiens
uauuccaaaugcca

SEQ ID NO: 1596833 - RNA, 20 nt, Homo sapiens
uauuccaaaugccauccaga

SEQ ID NO: 1596834 - RNA, 15 nt, Homo sapiens
uauuccauaugucua

SEQ ID NO: 1596835 - RNA, 12 nt, Homo sapiens
uauucccaugag

SEQ ID NO: 1596836 - RNA, 17 nt, Homo sapiens
uauucccugcacacaca

SEQ ID NO: 1596837 - RNA, 21 nt, Homo sapiens
uauucgugcauuuuuggauca

SEQ ID NO: 1596838 - RNA, 15 nt, Homo sapiens
uauucuagccugcau

SEQ ID NO: 1596839 - RNA, 16 nt, Homo sapiens
uauucucaaccagaga

SEQ ID NO: 1596840 - RNA, 22 nt, Homo sapiens
uauucuccucggacugugugca

SEQ ID NO: 1596841 - RNA, 21 nt, Homo sapiens
uauucugggcaccacaaaaua

SEQ ID NO: 1596842 - RNA, 17 nt, Homo sapiens
uauucuuaaaaugcaau

SEQ ID NO: 1596843 - RNA, 15 nt, Homo sapiens
uauucuuacuaaucu

SEQ ID NO: 1596844 - RNA, 21 nt, Homo sapiens
uauucuugagggacaaugcca

SEQ ID NO: 1596845 - RNA, 17 nt, Homo sapiens
uauucuuggcuaaagga

SEQ ID NO: 1596846 - RNA, 20 nt, Homo sapiens
uauugaaaggggacaccugu

SEQ ID NO: 1596847 - RNA, 19 nt, Homo sapiens
uauugaaaguugcuuuuau

SEQ ID NO: 1596848 - RNA, 21 nt, Homo sapiens
uauugaacuuuuguacugaau

SEQ ID NO: 1596849 - RNA, 16 nt, Homo sapiens
uauugaaugugaaaca

SEQ ID NO: 1596850 - RNA, 13 nt, Homo sapiens
uauugacacugaa

SEQ ID NO: 1596851 - RNA, 18 nt, Homo sapiens
uauugacccucuaugaua

SEQ ID NO: 1596852 - RNA, 12 nt, Homo sapiens
uauugacugccu

SEQ ID NO: 1596853 - RNA, 20 nt, Homo sapiens
uauugagaaccuaaugcacu

SEQ ID NO: 1596854 - RNA, 16 nt, Homo sapiens
uauugaucaccaugaa

SEQ ID NO: 1596855 - RNA, 19 nt, Homo sapiens
uauugcagcuuauauucau

SEQ ID NO: 1596856 - RNA, 21 nt, Homo sapiens
uauugcuaaaagcauguauag

SEQ ID NO: 1596857 - RNA, 14 nt, Homo sapiens
uauugcuaguacua

SEQ ID NO: 1596858 - RNA, 16 nt, Homo sapiens
uauuggaaaaaucaca

SEQ ID NO: 1596859 - RNA, 13 nt, Homo sapiens
uauuggugcuaga

SEQ ID NO: 1596860 - RNA, 23 nt, Homo sapiens
uauuguaguaaacuauucuuaau

SEQ ID NO: 1596861 - RNA, 20 nt, Homo sapiens
uauuguauuccucaugucau

SEQ ID NO: 1596862 - RNA, 23 nt, Homo sapiens
uauuguuaggaaaugucaucaaa

SEQ ID NO: 1596863 - RNA, 22 nt, Homo sapiens
uauuguuaggagaugucaucaa

SEQ ID NO: 1596864 - RNA, 19 nt, Homo sapiens
uauuguuaucuuuaccucc

SEQ ID NO: 1596865 - RNA, 14 nt, Homo sapiens
uauuguuucugcau

SEQ ID NO: 1596866 - RNA, 16 nt, Homo sapiens
uauuuaagcaaauacu

SEQ ID NO: 1596867 - RNA, 14 nt, Homo sapiens
uauuuaagugcaau

SEQ ID NO: 1596868 - RNA, 14 nt, Homo sapiens
uauuuaguugauag

SEQ ID NO: 1596869 - RNA, 15 nt, Homo sapiens
uauuuauacuuugca

SEQ ID NO: 1596870 - RNA, 14 nt, Homo sapiens
uauuuaugugaaca

SEQ ID NO: 1596871 - RNA, 20 nt, Homo sapiens
uauuucaaaauauacauuca

SEQ ID NO: 1596872 - RNA, 20 nt, Homo sapiens
uauuucagacauagauuuca

SEQ ID NO: 1596873 - RNA, 20 nt, Homo sapiens
uauuucagcccccaucaccc

SEQ ID NO: 1596874 - RNA, 15 nt, Homo sapiens
uauuucagcugcuuu

SEQ ID NO: 1596875 - RNA, 14 nt, Homo sapiens
uauuuccaaaagca

SEQ ID NO: 1596876 - RNA, 19 nt, Homo sapiens
uauuuccauucaacaagag

SEQ ID NO: 1596877 - RNA, 19 nt, Homo sapiens
uauuucccucuacugagua

SEQ ID NO: 1596878 - RNA, 21 nt, Homo sapiens
uauuuccucugugcaaaggga

SEQ ID NO: 1596879 - RNA, 18 nt, Homo sapiens
uauuucugauguguucuc

SEQ ID NO: 1596880 - RNA, 16 nt, Homo sapiens
uauuucuguaccaaag

SEQ ID NO: 1596881 - RNA, 18 nt, Homo sapiens
uauuucuuaagaauucaa

SEQ ID NO: 1596882 - RNA, 15 nt, Homo sapiens
uauuucuugcuuuca

SEQ ID NO: 1596883 - RNA, 18 nt, Homo sapiens
uauuugcagaagcuguga

SEQ ID NO: 1596884 - RNA, 14 nt, Homo sapiens
uauuuguaucacaa

SEQ ID NO: 1596885 - RNA, 12 nt, Homo sapiens
uauuugucacaa

SEQ ID NO: 1596886 - RNA, 17 nt, Homo sapiens
uauuugugcuauaguau

SEQ ID NO: 1596887 - RNA, 14 nt, Homo sapiens
uauuugugggguac

SEQ ID NO: 1596888 - RNA, 16 nt, Homo sapiens
uauuuuaaaggcaaaa

SEQ ID NO: 1596889 - RNA, 14 nt, Homo sapiens
uauuuuagugugua

SEQ ID NO: 1596890 - RNA, 17 nt, Homo sapiens
uauuuucuacagugguu

SEQ ID NO: 1596891 - RNA, 16 nt, Homo sapiens
uauuuucuauuuuccc

SEQ ID NO: 1596892 - RNA, 13 nt, Homo sapiens
uauuuugaauuca

SEQ ID NO: 1596893 - RNA, 11 nt, Homo sapiens
uauuuugauca

SEQ ID NO: 1596894 - RNA, 18 nt, Homo sapiens
uauuuuggaggugcuuga

SEQ ID NO: 1596895 - RNA, 18 nt, Homo sapiens
uauuuugguacugugaug

SEQ ID NO: 1596896 - RNA, 21 nt, Homo sapiens
uauuuuguaaugcugcacaga

SEQ ID NO: 1596897 - RNA, 16 nt, Homo sapiens
uauuuuguugccuuca

SEQ ID NO: 1596898 - RNA, 15 nt, Homo sapiens
uauuuuuauguucuu

SEQ ID NO: 1596899 - RNA, 14 nt, Homo sapiens
uauuuuucucauga

SEQ ID NO: 1596900 - RNA, 14 nt, Homo sapiens
uauuuuugugcaca

SEQ ID NO: 1596901 - RNA, 16 nt, Homo sapiens
uauuuuuuuccuaaga

SEQ ID NO: 1596902 - RNA, 16 nt, Homo sapiens
ucaaaaaaccuuuaca

SEQ ID NO: 1596903 - RNA, 13 nt, Homo sapiens
ucaaaaagccacu

SEQ ID NO: 1596904 - RNA, 13 nt, Homo sapiens
ucaaaaaugccac

SEQ ID NO: 1596905 - RNA, 12 nt, Homo sapiens
ucaaaaccaagu

SEQ ID NO: 1596906 - RNA, 19 nt, Homo sapiens
ucauucauuggugaaguaa

SEQ ID NO: 1596907 - RNA, 16 nt, Homo sapiens
ucauuccauguccaua

SEQ ID NO: 1596908 - RNA, 18 nt, Homo sapiens
ucauucccccaccuaucc

SEQ ID NO: 1596909 - RNA, 16 nt, Homo sapiens
ucauuccucacaauga

SEQ ID NO: 1596910 - RNA, 22 nt, Homo sapiens
ucauucugcauucucuagucag

SEQ ID NO: 1596911 - RNA, 16 nt, Homo sapiens
ucauucugcuacuuca

SEQ ID NO: 1596912 - RNA, 17 nt, Homo sapiens
ucauucuuuugccacau

SEQ ID NO: 1596913 - RNA, 21 nt, Homo sapiens
ucauucuuuuugaaaugucaa

SEQ ID NO: 1596914 - RNA, 14 nt, Homo sapiens
ucauugaagcuuug

SEQ ID NO: 1596915 - RNA, 21 nt, Homo sapiens
ucauugcuaaacugaugacuu

SEQ ID NO: 1596916 - RNA, 18 nt, Homo sapiens
ucauugggaagauucucu

SEQ ID NO: 1596917 - RNA, 14 nt, Homo sapiens
ucauuguaaucacu

SEQ ID NO: 1596918 - RNA, 14 nt, Homo sapiens
ucauuuaaaacagg

SEQ ID NO: 1596919 - RNA, 14 nt, Homo sapiens
ucauuuaagggaaa

SEQ ID NO: 1596920 - RNA, 15 nt, Homo sapiens
ucauuucauuaguau

SEQ ID NO: 1596921 - RNA, 14 nt, Homo sapiens
ucauuucauuccau

SEQ ID NO: 1596922 - RNA, 22 nt, Homo sapiens
ucauuugaaugcuuaauucaau

SEQ ID NO: 1596923 - RNA, 19 nt, Homo sapiens
ucauuuguuuacauuugau

SEQ ID NO: 1596924 - RNA, 16 nt, Homo sapiens
ucauuuucacuuuuaa

SEQ ID NO: 1596925 - RNA, 20 nt, Homo sapiens
ucauuuuuacacuauuguga

SEQ ID NO: 1596926 - RNA, 14 nt, Homo sapiens
ucauuuuuuacuug

SEQ ID NO: 1596927 - RNA, 14 nt, Homo sapiens
uccaaaaagcacau

SEQ ID NO: 1596928 - RNA, 18 nt, Homo sapiens
uccaaaaauguguaagaa

SEQ ID NO: 1596929 - RNA, 15 nt, Homo sapiens
uccaaaacaaaaaga

SEQ ID NO: 1596930 - RNA, 13 nt, Homo sapiens
uccaaaacauuuc

SEQ ID NO: 1596931 - RNA, 19 nt, Homo sapiens
uccaaaaccuaaagaggaa

SEQ ID NO: 1596932 - RNA, 21 nt, Homo sapiens
uccaaagaaauguaagggaaa

SEQ ID NO: 1596933 - RNA, 23 nt, Homo sapiens
uccaaagaguagaauugcauuga

SEQ ID NO: 1596934 - RNA, 17 nt, Homo sapiens
uccaaagccggcuugau

SEQ ID NO: 1596935 - RNA, 22 nt, Homo sapiens
uccaaaugccauccagaugugu

SEQ ID NO: 1596936 - RNA, 19 nt, Homo sapiens
uccaaauggcuuugcagaa

SEQ ID NO: 1596937 - RNA, 15 nt, Homo sapiens
uccaaauguccucca

SEQ ID NO: 1596938 - RNA, 20 nt, Homo sapiens
uccaaauuacagcauauaua

SEQ ID NO: 1596939 - RNA, 17 nt, Homo sapiens
uccaaauucaguuucau

SEQ ID NO: 1596940 - RNA, 17 nt, Homo sapiens
uccaacacagugcaucu

SEQ ID NO: 1596941 - RNA, 21 nt, Homo sapiens
uccaacauuucucacugaaag

SEQ ID NO: 1596942 - RNA, 19 nt, Homo sapiens
uccaaccccccagcacuga

SEQ ID NO: 1596943 - RNA, 19 nt, Homo sapiens
uccaaccccccaguauaaa

SEQ ID NO: 1596944 - RNA, 22 nt, Homo sapiens
uccaaccuuuggaagucaugag

SEQ ID NO: 1596945 - RNA, 20 nt, Homo sapiens
uccaacuccuuucagccaca

SEQ ID NO: 1596946 - RNA, 15 nt, Homo sapiens
uccaagaccccaaau

SEQ ID NO: 1596947 - RNA, 11 nt, Homo sapiens
uccaaguacau

SEQ ID NO: 1596948 - RNA, 15 nt, Homo sapiens
uccaagucucagugg

SEQ ID NO: 1596949 - RNA, 22 nt, Homo sapiens
uccaauagaaagaaacuaaaca

SEQ ID NO: 1596950 - RNA, 15 nt, Homo sapiens
uccaaugccacagac

SEQ ID NO: 1596951 - RNA, 21 nt, Homo sapiens
uccaaugccacauacuugcag

SEQ ID NO: 1596952 - RNA, 18 nt, Homo sapiens
uccaauuccuugcacaua

SEQ ID NO: 1596953 - RNA, 21 nt, Homo sapiens
uccacaaaauuagaaaggaca

SEQ ID NO: 1596954 - RNA, 19 nt, Homo sapiens
uccacaaauuauuaaugaa

SEQ ID NO: 1596955 - RNA, 22 nt, Homo sapiens
uccacaagaacaauucaagaaa

SEQ ID NO: 1596956 - RNA, 11 nt, Homo sapiens
uccacaaggaa

SEQ ID NO: 1596957 - RNA, 15 nt, Homo sapiens
uccacaccugggcau

SEQ ID NO: 1596958 - RNA, 17 nt, Homo sapiens
uccacaccuuuuauuga

SEQ ID NO: 1596959 - RNA, 14 nt, Homo sapiens
uccacacgccaagc

SEQ ID NO: 1596960 - RNA, 13 nt, Homo sapiens
uccacacugagag

SEQ ID NO: 1596961 - RNA, 16 nt, Homo sapiens
uccacaggcuccccau

SEQ ID NO: 1596962 - RNA, 16 nt, Homo sapiens
uccacauaagcacucc

SEQ ID NO: 1596963 - RNA, 16 nt, Homo sapiens
uccacauauagagcuc

SEQ ID NO: 1596964 - RNA, 12 nt, Homo sapiens
uccacauguuac

SEQ ID NO: 1596965 - RNA, 14 nt, Homo sapiens
uccaccaugagcuc

SEQ ID NO: 1596966 - RNA, 15 nt, Homo sapiens
uccaccccaggguca

SEQ ID NO: 1596967 - RNA, 15 nt, Homo sapiens
uccacccgucucucu

SEQ ID NO: 1596968 - RNA, 13 nt, Homo sapiens
uccacccuuggcc

SEQ ID NO: 1596969 - RNA, 16 nt, Homo sapiens
uccaccgccacugggc

SEQ ID NO: 1596970 - RNA, 20 nt, Homo sapiens
uccaccucccaacacuguca

SEQ ID NO: 1596971 - RNA, 16 nt, Homo sapiens
uccaccucuaccaaaa

SEQ ID NO: 1596972 - RNA, 21 nt, Homo sapiens
uccaccuggaaacugcucaga

SEQ ID NO: 1596973 - RNA, 24 nt, Homo sapiens
uccaccuuaaauuaaacaauuuau

SEQ ID NO: 1596974 - RNA, 23 nt, Homo sapiens
uccaccuucauuuaacucuuuga

SEQ ID NO: 1596975 - RNA, 19 nt, Homo sapiens
uccaccuucuacgcaauug

SEQ ID NO: 1596976 - RNA, 21 nt, Homo sapiens
uccacguacuuaauuuacuua

SEQ ID NO: 1596977 - RNA, 21 nt, Homo sapiens
uccacgugggccucacauucc

SEQ ID NO: 1596978 - RNA, 17 nt, Homo sapiens
uccacuaacacuuuagu

SEQ ID NO: 1596979 - RNA, 16 nt, Homo sapiens
uccacuacuuuacugu

SEQ ID NO: 1596980 - RNA, 20 nt, Homo sapiens
uccacuccuccuacuguauu

SEQ ID NO: 1596981 - RNA, 13 nt, Homo sapiens
uccacucugccau

SEQ ID NO: 1596982 - RNA, 20 nt, Homo sapiens
uccacucuugaucucucuug

SEQ ID NO: 1596983 - RNA, 16 nt, Homo sapiens
uccacuggaaaacugc

SEQ ID NO: 1596984 - RNA, 20 nt, Homo sapiens
uccacugggacccccaacau

SEQ ID NO: 1596985 - RNA, 18 nt, Homo sapiens
uccacuguucuguucuca

SEQ ID NO: 1596986 - RNA, 13 nt, Homo sapiens
uccagaaaccaaa

SEQ ID NO: 1596987 - RNA, 18 nt, Homo sapiens
uccagaaaguaaagguga

SEQ ID NO: 1596988 - RNA, 14 nt, Homo sapiens
uccagaacacucuu

SEQ ID NO: 1596989 - RNA, 17 nt, Homo sapiens
uccagaauccugauggu

SEQ ID NO: 1596990 - RNA, 14 nt, Homo sapiens
uccagagaugguca

SEQ ID NO: 1596991 - RNA, 23 nt, Homo sapiens
uccagagauguaugagagcauuu

SEQ ID NO: 1596992 - RNA, 12 nt, Homo sapiens
uccagagauuug

SEQ ID NO: 1596993 - RNA, 13 nt, Homo sapiens
uccagagggcacu

SEQ ID NO: 1596994 - RNA, 18 nt, Homo sapiens
uccagagucccugccugg

SEQ ID NO: 1596995 - RNA, 16 nt, Homo sapiens
uccagaugugugcaau

SEQ ID NO: 1596996 - RNA, 14 nt, Homo sapiens
uccagcaacugaac

SEQ ID NO: 1596997 - RNA, 13 nt, Homo sapiens
uccagcacaaccu

SEQ ID NO: 1596998 - RNA, 11 nt, Homo sapiens
uccagcaccuu

SEQ ID NO: 1596999 - RNA, 16 nt, Homo sapiens
uccagcacgucugugu

SEQ ID NO: 1597000 - RNA, 20 nt, Homo sapiens
uccagcccagacccagugga

SEQ ID NO: 1597001 - RNA, 20 nt, Homo sapiens
uccagccccuccucccucag

SEQ ID NO: 1597002 - RNA, 17 nt, Homo sapiens
uccagccgccauugcca

SEQ ID NO: 1597003 - RNA, 17 nt, Homo sapiens
uccagccucuccuccau

SEQ ID NO: 1597004 - RNA, 23 nt, Homo sapiens
uccagccuucuacugcucuccuc

SEQ ID NO: 1597005 - RNA, 20 nt, Homo sapiens
uccagcgugacggagcccac

SEQ ID NO: 1597006 - RNA, 17 nt, Homo sapiens
uccaggagccucaucca

SEQ ID NO: 1597007 - RNA, 13 nt, Homo sapiens
uccaggaguuuga

SEQ ID NO: 1597008 - RNA, 14 nt, Homo sapiens
uccaggaguuugag

SEQ ID NO: 1597009 - RNA, 20 nt, Homo sapiens
uccaggauggaugcaucaca

SEQ ID NO: 1597010 - RNA, 21 nt, Homo sapiens
uccaggcauuuagcccucaca

SEQ ID NO: 1597011 - RNA, 16 nt, Homo sapiens
uccagggaaacagccu

SEQ ID NO: 1597012 - RNA, 21 nt, Homo sapiens
uccaggguauggccauggagu

SEQ ID NO: 1597013 - RNA, 15 nt, Homo sapiens
uccagugagcacuag

SEQ ID NO: 1597014 - RNA, 19 nt, Homo sapiens
uccaguuccucuuuugugc

SEQ ID NO: 1597015 - RNA, 14 nt, Homo sapiens
uccaguuugcccac

SEQ ID NO: 1597016 - RNA, 23 nt, Homo sapiens
uccauaaaugacacuacuugaua

SEQ ID NO: 1597017 - RNA, 15 nt, Homo sapiens
uccauaccaucuggu

SEQ ID NO: 1597018 - RNA, 23 nt, Homo sapiens
uccauauauuuagccccauuaca

SEQ ID NO: 1597019 - RNA, 14 nt, Homo sapiens
uccaucaguauuaa

SEQ ID NO: 1597020 - RNA, 20 nt, Homo sapiens
uccauccauggggcugauug

SEQ ID NO: 1597021 - RNA, 15 nt, Homo sapiens
uccauccuccugugu

SEQ ID NO: 1597022 - RNA, 15 nt, Homo sapiens
uccaucguccauccu

SEQ ID NO: 1597023 - RNA, 16 nt, Homo sapiens
uccaucucuucugcaa

SEQ ID NO: 1597024 - RNA, 17 nt, Homo sapiens
ucucaacauuaccaaaa

SEQ ID NO: 1597025 - RNA, 15 nt, Homo sapiens
ucucaacuacucagc

SEQ ID NO: 1597026 - RNA, 23 nt, Homo sapiens
ucucaaggagaggcaaagaaagg

SEQ ID NO: 1597027 - RNA, 19 nt, Homo sapiens
ucucaauaauuuccuccac

SEQ ID NO: 1597028 - RNA, 16 nt, Homo sapiens
ucucaaucuugaacuc

SEQ ID NO: 1597029 - RNA, 17 nt, Homo sapiens
ucucacaaauaaguaau

SEQ ID NO: 1597030 - RNA, 19 nt, Homo sapiens
ucucacaaauaaguaauau

SEQ ID NO: 1597031 - RNA, 20 nt, Homo sapiens
ucucacauaagcccaguuca

SEQ ID NO: 1597032 - RNA, 17 nt, Homo sapiens
ucucaccagcugcaaag

SEQ ID NO: 1597033 - RNA, 20 nt, Homo sapiens
ucucacccucaucacuagga

SEQ ID NO: 1597034 - RNA, 21 nt, Homo sapiens
ucucaccugccgugcguacug

SEQ ID NO: 1597035 - RNA, 15 nt, Homo sapiens
ucucacuauaccagu

SEQ ID NO: 1597036 - RNA, 19 nt, Homo sapiens
ucucacucuguugcccagg

SEQ ID NO: 1597037 - RNA, 16 nt, Homo sapiens
ucucacugcaagcaca

SEQ ID NO: 1597038 - RNA, 15 nt, Homo sapiens
ucucagaagcacaga

SEQ ID NO: 1597039 - RNA, 23 nt, Homo sapiens
ucucagaauucggugugcugcca

SEQ ID NO: 1597040 - RNA, 12 nt, Homo sapiens
ucucagcacuuu

SEQ ID NO: 1597041 - RNA, 23 nt, Homo sapiens
ucucaggaaaucaaauaugcaaa

SEQ ID NO: 1597042 - RNA, 22 nt, Homo sapiens
ucucaggaccgugcccucguca

SEQ ID NO: 1597043 - RNA, 19 nt, Homo sapiens
ucucaguggcuucaucugu

SEQ ID NO: 1597044 - RNA, 19 nt, Homo sapiens
ucucauaaguagcauucau

SEQ ID NO: 1597045 - RNA, 14 nt, Homo sapiens
ucucauaauuccua

SEQ ID NO: 1597046 - RNA, 21 nt, Homo sapiens
ucucauagguugagcaauuuc

SEQ ID NO: 1597047 - RNA, 19 nt, Homo sapiens
ucucaucaauccuuugaau

SEQ ID NO: 1597048 - RNA, 16 nt, Homo sapiens
ucucaucaguaguuca

SEQ ID NO: 1597049 - RNA, 17 nt, Homo sapiens
ucucauguaucaucugg

SEQ ID NO: 1597050 - RNA, 16 nt, Homo sapiens
ucucaugugugcucac

SEQ ID NO: 1597051 - RNA, 10 nt, Homo sapiens
ucucauuccc

SEQ ID NO: 1597052 - RNA, 19 nt, Homo sapiens
ucucauuugggcaccuuaa

SEQ ID NO: 1597053 - RNA, 18 nt, Homo sapiens
ucuccacacccacuuugu

SEQ ID NO: 1597054 - RNA, 22 nt, Homo sapiens
ucuccagcuucccgaguaccag

SEQ ID NO: 1597055 - RNA, 23 nt, Homo sapiens
ucuccauaaaugacacuacuuga

SEQ ID NO: 1597056 - RNA, 13 nt, Homo sapiens
ucucccaaggcca

SEQ ID NO: 1597057 - RNA, 14 nt, Homo sapiens
ucucccaguccaag

SEQ ID NO: 1597058 - RNA, 21 nt, Homo sapiens
ucucccagugacaacaucgca

SEQ ID NO: 1597059 - RNA, 19 nt, Homo sapiens
ucuccccagugccugccac

SEQ ID NO: 1597060 - RNA, 13 nt, Homo sapiens
ucucccugccaag

SEQ ID NO: 1597061 - RNA, 16 nt, Homo sapiens
ucucccugccuguggc

SEQ ID NO: 1597062 - RNA, 17 nt, Homo sapiens
ucucccugggucugcgu

SEQ ID NO: 1597063 - RNA, 23 nt, Homo sapiens
ucuccuccagcccagacccagug

SEQ ID NO: 1597064 - RNA, 13 nt, Homo sapiens
ucuccugcaaaag

SEQ ID NO: 1597065 - RNA, 14 nt, Homo sapiens
ucuccugggacaac

SEQ ID NO: 1597066 - RNA, 15 nt, Homo sapiens
ucuccuggucccugg

SEQ ID NO: 1597067 - RNA, 22 nt, Homo sapiens
ucuccuguauuuaacaaaaagu

SEQ ID NO: 1597068 - RNA, 16 nt, Homo sapiens
ucuccuguccaaccua

SEQ ID NO: 1597069 - RNA, 12 nt, Homo sapiens
ucuccugugaau

SEQ ID NO: 1597070 - RNA, 16 nt, Homo sapiens
ucucgaucuccugacc

SEQ ID NO: 1597071 - RNA, 16 nt, Homo sapiens
ucucggcucacugcaa

SEQ ID NO: 1597072 - RNA, 23 nt, Homo sapiens
ucucuaaccgaauauucauggau

SEQ ID NO: 1597073 - RNA, 21 nt, Homo sapiens
ucucuaacguccacuagcuua

SEQ ID NO: 1597074 - RNA, 16 nt, Homo sapiens
ucucuaacuccugcca

SEQ ID NO: 1597075 - RNA, 19 nt, Homo sapiens
ucucuaacuccugccauuc

SEQ ID NO: 1597076 - RNA, 20 nt, Homo sapiens
ucucuacuaaaaauacaaaa

SEQ ID NO: 1597077 - RNA, 12 nt, Homo sapiens
ucucuacugcuu

SEQ ID NO: 1597078 - RNA, 14 nt, Homo sapiens
ucucuauaaagggu

SEQ ID NO: 1597079 - RNA, 14 nt, Homo sapiens
ucucucaccugcuc

SEQ ID NO: 1597080 - RNA, 13 nt, Homo sapiens
ucucucaucucuu

SEQ ID NO: 1597081 - RNA, 12 nt, Homo sapiens
ucucucauuccc

SEQ ID NO: 1597082 - RNA, 23 nt, Homo sapiens
ucucuccccauccccacccaguc

SEQ ID NO: 1597083 - RNA, 19 nt, Homo sapiens
ucucuccuuauagacacuu

SEQ ID NO: 1597084 - RNA, 16 nt, Homo sapiens
ucucucuacugaucaa

SEQ ID NO: 1597085 - RNA, 10 nt, Homo sapiens
ucucucucau

SEQ ID NO: 1597086 - RNA, 12 nt, Homo sapiens
ucucucugcucc

SEQ ID NO: 1597087 - RNA, 15 nt, Homo sapiens
ucucugaauacacag

SEQ ID NO: 1597088 - RNA, 13 nt, Homo sapiens
ucucugcagucaa

SEQ ID NO: 1597089 - RNA, 22 nt, Homo sapiens
ucucugggggacagcagucucu

SEQ ID NO: 1597090 - RNA, 17 nt, Homo sapiens
ucucuuagggacaguca

SEQ ID NO: 1597091 - RNA, 13 nt, Homo sapiens
ucucuuccccaga

SEQ ID NO: 1597092 - RNA, 14 nt, Homo sapiens
ucucuucugagcua

SEQ ID NO: 1597093 - RNA, 13 nt, Homo sapiens
ucucuugccauuu

SEQ ID NO: 1597094 - RNA, 19 nt, Homo sapiens
ucucuugccauuuguagcu

SEQ ID NO: 1597095 - RNA, 12 nt, Homo sapiens
ucucuuuccaaa

SEQ ID NO: 1597096 - RNA, 14 nt, Homo sapiens
ucucuuucucaccu

SEQ ID NO: 1597097 - RNA, 19 nt, Homo sapiens
ucugaaagugguacuugau

SEQ ID NO: 1597098 - RNA, 20 nt, Homo sapiens
ucugaacauacagagcccac

SEQ ID NO: 1597099 - RNA, 15 nt, Homo sapiens
ucugaacauucuccu

SEQ ID NO: 1597100 - RNA, 15 nt, Homo sapiens
ucugaacugguagaa

SEQ ID NO: 1597101 - RNA, 14 nt, Homo sapiens
ucugaacuguuaca

SEQ ID NO: 1597102 - RNA, 12 nt, Homo sapiens
ucugaagccaca

SEQ ID NO: 1597103 - RNA, 20 nt, Homo sapiens
ucugaaggaagagaagacau

SEQ ID NO: 1597104 - RNA, 18 nt, Homo sapiens
ucugaauacacaguauuc

SEQ ID NO: 1597105 - RNA, 15 nt, Homo sapiens
ucugaauuugcaaag

SEQ ID NO: 1597106 - RNA, 22 nt, Homo sapiens
ucugacagaaagcagauaccuc

SEQ ID NO: 1597107 - RNA, 17 nt, Homo sapiens
ucugacucagggcuccu

SEQ ID NO: 1597108 - RNA, 20 nt, Homo sapiens
ucugagaagacacaagguga

SEQ ID NO: 1597109 - RNA, 23 nt, Homo sapiens
ucugagaagacacaaggugauuu

SEQ ID NO: 1597110 - RNA, 21 nt, Homo sapiens
ucugagauuuugcuugagcag

SEQ ID NO: 1597111 - RNA, 19 nt, Homo sapiens
ucugagcacauuugacucc

SEQ ID NO: 1597112 - RNA, 16 nt, Homo sapiens
ucugagcuaacuuaua

SEQ ID NO: 1597113 - RNA, 21 nt, Homo sapiens
ucugauaaaagauggccauau

SEQ ID NO: 1597114 - RNA, 22 nt, Homo sapiens
ucugauaaacacaaucugcuag

SEQ ID NO: 1597115 - RNA, 15 nt, Homo sapiens
ucugaucaaguauuu

SEQ ID NO: 1597116 - RNA, 19 nt, Homo sapiens
ucugaucauguaugcaucc

SEQ ID NO: 1597117 - RNA, 19 nt, Homo sapiens
ucugaugucccagugcuca

SEQ ID NO: 1597118 - RNA, 23 nt, Homo sapiens
ucugauguucuuuccaugaauca

SEQ ID NO: 1597119 - RNA, 22 nt, Homo sapiens
ucugauuccccuccaccaaacc

SEQ ID NO: 1597120 - RNA, 21 nt, Homo sapiens
ucugauuguugucaggccaua

SEQ ID NO: 1597121 - RNA, 15 nt, Homo sapiens
ucugauuuacauuca

SEQ ID NO: 1597122 - RNA, 19 nt, Homo sapiens
ucugcaauuuuacugugaa

SEQ ID NO: 1597123 - RNA, 16 nt, Homo sapiens
ucugcacauaggcagu

SEQ ID NO: 1597124 - RNA, 18 nt, Homo sapiens
ucugcaccacaccuggca

SEQ ID NO: 1597125 - RNA, 20 nt, Homo sapiens
ucugcacccagaacaguggu

SEQ ID NO: 1597126 - RNA, 13 nt, Homo sapiens
ucugcacuacucc

SEQ ID NO: 1597127 - RNA, 20 nt, Homo sapiens
ucugcagcucugacccaaau

SEQ ID NO: 1597128 - RNA, 17 nt, Homo sapiens
ucugcauaaauuuuaca

SEQ ID NO: 1597129 - RNA, 21 nt, Homo sapiens
ucugcauccuuuucaaaaccu

SEQ ID NO: 1597130 - RNA, 19 nt, Homo sapiens
ucugcauggaacagcauua

SEQ ID NO: 1597131 - RNA, 18 nt, Homo sapiens
ucugcauucucuagucag

SEQ ID NO: 1597132 - RNA, 21 nt, Homo sapiens
ucugccacuugucaaagaagg

SEQ ID NO: 1597133 - RNA, 23 nt, Homo sapiens
ucugccagcgccaaaacaagcca

SEQ ID NO: 1597134 - RNA, 18 nt, Homo sapiens
ucugccauuaaaacauua

SEQ ID NO: 1597135 - RNA, 17 nt, Homo sapiens
ucugcccgggagcucag

SEQ ID NO: 1597136 - RNA, 22 nt, Homo sapiens
ucugcccucaccucugugccca

SEQ ID NO: 1597137 - RNA, 14 nt, Homo sapiens
ucugccgcugccau

SEQ ID NO: 1597138 - RNA, 23 nt, Homo sapiens
ucugccuuaaacacacauugcag

SEQ ID NO: 1597139 - RNA, 21 nt, Homo sapiens
ucugccuuuggggacuuuucu

SEQ ID NO: 1597140 - RNA, 14 nt, Homo sapiens
ucugcggguccaaa

SEQ ID NO: 1597141 - RNA, 20 nt, Homo sapiens
ucugcgugucaccugugcuu

SEQ ID NO: 1597142 - RNA, 14 nt, Homo sapiens
ugagaaaacuguga

SEQ ID NO: 1597143 - RNA, 22 nt, Homo sapiens
ugagaaaauaucuugcuuucaa

SEQ ID NO: 1597144 - RNA, 18 nt, Homo sapiens
ugagaaagacuauucaaa

SEQ ID NO: 1597145 - RNA, 18 nt, Homo sapiens
ugagaaauuuaaacuaua

SEQ ID NO: 1597146 - RNA, 14 nt, Homo sapiens
ugagaacaccagag

SEQ ID NO: 1597147 - RNA, 20 nt, Homo sapiens
ugagaacaccagagaccuca

SEQ ID NO: 1597148 - RNA, 21 nt, Homo sapiens
ugagaacucguucaccuccaa

SEQ ID NO: 1597149 - RNA, 20 nt, Homo sapiens
ugagaagcccgaggucauca

SEQ ID NO: 1597150 - RNA, 22 nt, Homo sapiens
ugagaagcugccauaucuucag

SEQ ID NO: 1597151 - RNA, 16 nt, Homo sapiens
ugagaaggaacuucca

SEQ ID NO: 1597152 - RNA, 14 nt, Homo sapiens
ugagaaggcaaaag

SEQ ID NO: 1597153 - RNA, 22 nt, Homo sapiens
ugagaaggcaaaagaaagaacc

SEQ ID NO: 1597154 - RNA, 23 nt, Homo sapiens
ugagaaggcaaccaaagugcagg

SEQ ID NO: 1597155 - RNA, 19 nt, Homo sapiens
ugagaaggcagccaccagc

SEQ ID NO: 1597156 - RNA, 16 nt, Homo sapiens
ugagaagugcacuuua

SEQ ID NO: 1597157 - RNA, 14 nt, Homo sapiens
ugagacaacaguac

SEQ ID NO: 1597158 - RNA, 15 nt, Homo sapiens
ugagacagacauuca

SEQ ID NO: 1597159 - RNA, 16 nt, Homo sapiens
ugagacagacauucac

SEQ ID NO: 1597160 - RNA, 19 nt, Homo sapiens
ugagacagacauucaccug

SEQ ID NO: 1597161 - RNA, 15 nt, Homo sapiens
ugagacuccaucuca

SEQ ID NO: 1597162 - RNA, 21 nt, Homo sapiens
ugagacuuucuucuagugcuu

SEQ ID NO: 1597163 - RNA, 19 nt, Homo sapiens
ugagagaaaugaaguuuau

SEQ ID NO: 1597164 - RNA, 14 nt, Homo sapiens
ugagagaccugcuc

SEQ ID NO: 1597165 - RNA, 12 nt, Homo sapiens
ugagagcaauau

SEQ ID NO: 1597166 - RNA, 22 nt, Homo sapiens
ugagagcauugggauaucuccu

SEQ ID NO: 1597167 - RNA, 13 nt, Homo sapiens
ugagagucauuca

SEQ ID NO: 1597168 - RNA, 22 nt, Homo sapiens
ugagagucauucaggugaccuc

SEQ ID NO: 1597169 - RNA, 15 nt, Homo sapiens
ugagagugagacuca

SEQ ID NO: 1597170 - RNA, 14 nt, Homo sapiens
ugagagugcacugc

SEQ ID NO: 1597171 - RNA, 13 nt, Homo sapiens
ugagaguggcuuu

SEQ ID NO: 1597172 - RNA, 22 nt, Homo sapiens
ugagaguuucuggauuagcuuu

SEQ ID NO: 1597173 - RNA, 23 nt, Homo sapiens
ugagaucgugccguuacucucca

SEQ ID NO: 1597174 - RNA, 17 nt, Homo sapiens
ugagauggagugagcug

SEQ ID NO: 1597175 - RNA, 18 nt, Homo sapiens
ugagauuaagaaugccag

SEQ ID NO: 1597176 - RNA, 19 nt, Homo sapiens
ugagauugaauuucacugu

SEQ ID NO: 1597177 - RNA, 21 nt, Homo sapiens
ugagcaacucccucucagcua

SEQ ID NO: 1597178 - RNA, 16 nt, Homo sapiens
ugagcaacucuugauu

SEQ ID NO: 1597179 - RNA, 21 nt, Homo sapiens
ugagcaagcaagggacugagu

SEQ ID NO: 1597180 - RNA, 19 nt, Homo sapiens
ugagcacaucucucugccc

SEQ ID NO: 1597181 - RNA, 20 nt, Homo sapiens
ugagcaccaccagggcucca

SEQ ID NO: 1597182 - RNA, 19 nt, Homo sapiens
ugagcaccuggacauguca

SEQ ID NO: 1597183 - RNA, 16 nt, Homo sapiens
ugagcagaagcuggag

SEQ ID NO: 1597184 - RNA, 19 nt, Homo sapiens
ugagcagcauccaccccac

SEQ ID NO: 1597185 - RNA, 20 nt, Homo sapiens
ugagcagggagaccaugccu

SEQ ID NO: 1597186 - RNA, 18 nt, Homo sapiens
ugagcaguggacacguga

SEQ ID NO: 1597187 - RNA, 14 nt, Homo sapiens
ugagcauaaaucaa

SEQ ID NO: 1597188 - RNA, 17 nt, Homo sapiens
ugagcaugccccaaaaa

SEQ ID NO: 1597189 - RNA, 18 nt, Homo sapiens
ugagcauuguaauuaaua

SEQ ID NO: 1597190 - RNA, 15 nt, Homo sapiens
ugagccaagaucgca

SEQ ID NO: 1597191 - RNA, 20 nt, Homo sapiens
ugagccaagaucgcaccacu

SEQ ID NO: 1597192 - RNA, 20 nt, Homo sapiens
ugagccaccgugcccggcca

SEQ ID NO: 1597193 - RNA, 15 nt, Homo sapiens
ugagccacuccuucc

SEQ ID NO: 1597194 - RNA, 15 nt, Homo sapiens
ugagcccugccccac

SEQ ID NO: 1597195 - RNA, 18 nt, Homo sapiens
ugagccgagaucaugcca

SEQ ID NO: 1597196 - RNA, 15 nt, Homo sapiens
ugagccggguggauc

SEQ ID NO: 1597197 - RNA, 13 nt, Homo sapiens
ugagcgacaguga

SEQ ID NO: 1597198 - RNA, 14 nt, Homo sapiens
ugagcgacagugag

SEQ ID NO: 1597199 - RNA, 18 nt, Homo sapiens
ugagcuauugcuguucuc

SEQ ID NO: 1597200 - RNA, 21 nt, Homo sapiens
ugagcuauugcuguucucuug

SEQ ID NO: 1597201 - RNA, 20 nt, Homo sapiens
ugagcucaggaguuugagac

SEQ ID NO: 1597202 - RNA, 17 nt, Homo sapiens
ugagcugugagugccuc

SEQ ID NO: 1597203 - RNA, 23 nt, Homo sapiens
ugagcuucaauauaagaagcaau

SEQ ID NO: 1597204 - RNA, 15 nt, Homo sapiens
ugagcuugacaccug

SEQ ID NO: 1597205 - RNA, 18 nt, Homo sapiens
ugaggaaaugccacaaau

SEQ ID NO: 1597206 - RNA, 15 nt, Homo sapiens
ugaggaacccuuaca

SEQ ID NO: 1597207 - RNA, 17 nt, Homo sapiens
ugaggaaucacuuuuaa

SEQ ID NO: 1597208 - RNA, 15 nt, Homo sapiens
ugaggauaaugggaa

SEQ ID NO: 1597209 - RNA, 18 nt, Homo sapiens
ugaggcaauuagacacuu

SEQ ID NO: 1597210 - RNA, 16 nt, Homo sapiens
ugaggccaucucagga

SEQ ID NO: 1597211 - RNA, 17 nt, Homo sapiens
ugaggccaucucaggag

SEQ ID NO: 1597212 - RNA, 20 nt, Homo sapiens
ugaggcccugcccaaugaga

SEQ ID NO: 1597213 - RNA, 18 nt, Homo sapiens
ugaggccuagacucuguc

SEQ ID NO: 1597214 - RNA, 14 nt, Homo sapiens
ugaggccucucauu

SEQ ID NO: 1597215 - RNA, 16 nt, Homo sapiens
ugaggcucagauuaaa

SEQ ID NO: 1597216 - RNA, 13 nt, Homo sapiens
ugagggacaaugc

SEQ ID NO: 1597217 - RNA, 13 nt, Homo sapiens
ugagggacucuga

SEQ ID NO: 1597218 - RNA, 20 nt, Homo sapiens
ugagggaggagggcuuugaa

SEQ ID NO: 1597219 - RNA, 15 nt, Homo sapiens
ugagggcaguucuga

SEQ ID NO: 1597220 - RNA, 16 nt, Homo sapiens
ugaggggaagccauuu

SEQ ID NO: 1597221 - RNA, 20 nt, Homo sapiens
ugagggugacuauggagcug

SEQ ID NO: 1597222 - RNA, 17 nt, Homo sapiens
ugaggugccacccagua

SEQ ID NO: 1597223 - RNA, 23 nt, Homo sapiens
ugaguaaacugaggcccaaagca

SEQ ID NO: 1597224 - RNA, 19 nt, Homo sapiens
ugaguauggcuaucuauac

SEQ ID NO: 1597225 - RNA, 13 nt, Homo sapiens
ugaguauuuagga

SEQ ID NO: 1597226 - RNA, 23 nt, Homo sapiens
ugagucauuuaaauguguacaau

SEQ ID NO: 1597227 - RNA, 18 nt, Homo sapiens
ugaguccgacccagacau

SEQ ID NO: 1597228 - RNA, 17 nt, Homo sapiens
ugaguccuaggacuuaa

SEQ ID NO: 1597229 - RNA, 14 nt, Homo sapiens
ugagucugugccac

SEQ ID NO: 1597230 - RNA, 13 nt, Homo sapiens
ugagugacggcaa

SEQ ID NO: 1597231 - RNA, 22 nt, Homo sapiens
ugagugguucaagcacacugga

SEQ ID NO: 1597232 - RNA, 20 nt, Homo sapiens
ugaguuacuuagaaugccau

SEQ ID NO: 1597233 - RNA, 17 nt, Homo sapiens
ugaguuagaggagaaaa

SEQ ID NO: 1597234 - RNA, 14 nt, Homo sapiens
ugaguucaaauacu

SEQ ID NO: 1597235 - RNA, 23 nt, Homo sapiens
ugaguuucugaggaucagcacug

SEQ ID NO: 1597236 - RNA, 20 nt, Homo sapiens
ugaguuuggaugucuguagc

SEQ ID NO: 1597237 - RNA, 14 nt, Homo sapiens
ugaguuuucagugg

SEQ ID NO: 1597238 - RNA, 16 nt, Homo sapiens
ugaguuuuguucacaa

SEQ ID NO: 1597239 - RNA, 22 nt, Homo sapiens
ugaguuuuguuucacuuugaca

SEQ ID NO: 1597240 - RNA, 18 nt, Homo sapiens
ugauaaaagagaagccaa

SEQ ID NO: 1597241 - RNA, 22 nt, Homo sapiens
ugauaagcuauugucuguaaua

SEQ ID NO: 1597242 - RNA, 20 nt, Homo sapiens
ugauaauagagggcuggaau

SEQ ID NO: 1597243 - RNA, 21 nt, Homo sapiens
ugauaaugauaaaacaccuca

SEQ ID NO: 1597244 - RNA, 19 nt, Homo sapiens
ugauacccaacaguuuauu

SEQ ID NO: 1597245 - RNA, 20 nt, Homo sapiens
ugauacuggaggaacacuug

SEQ ID NO: 1597246 - RNA, 20 nt, Homo sapiens
ugauagaaccauugcaauau

SEQ ID NO: 1597247 - RNA, 17 nt, Homo sapiens
ugauagcagaaugugcu

SEQ ID NO: 1597248 - RNA, 16 nt, Homo sapiens
ugauaggaaaaaucca

SEQ ID NO: 1597249 - RNA, 13 nt, Homo sapiens
ugauagucaauau

SEQ ID NO: 1597250 - RNA, 12 nt, Homo sapiens
ugauaguccuuu

SEQ ID NO: 1597251 - RNA, 13 nt, Homo sapiens
ugauauaccaaau

SEQ ID NO: 1597252 - RNA, 17 nt, Homo sapiens
ugauauauaaaugugau

SEQ ID NO: 1597253 - RNA, 21 nt, Homo sapiens
ugauauauaaaugugauugca

SEQ ID NO: 1597254 - RNA, 20 nt, Homo sapiens
ugauaucuauaguagacaca

SEQ ID NO: 1597255 - RNA, 12 nt, Homo sapiens
ugauaugcauau

SEQ ID NO: 1597256 - RNA, 11 nt, Homo sapiens
ugauaugcuuc

SEQ ID NO: 1597257 - RNA, 12 nt, Homo sapiens
ugauauugcagc

SEQ ID NO: 1597258 - RNA, 22 nt, Homo sapiens
ugaucacacaguguuagugcug

SEQ ID NO: 1597259 - RNA, 17 nt, Homo sapiens
ugaucacauucuuucca

SEQ ID NO: 1597260 - RNA, 18 nt, Homo sapiens
uucucgugacaccaccaa

SEQ ID NO: 1597261 - RNA, 24 nt, Homo sapiens
uucucuauuguauccaaaggagaa

SEQ ID NO: 1597262 - RNA, 14 nt, Homo sapiens
uucucuauuuuacu

SEQ ID NO: 1597263 - RNA, 20 nt, Homo sapiens
uucucuccccuccucugaau

SEQ ID NO: 1597264 - RNA, 21 nt, Homo sapiens
uucucugcaauuuuacuguga

SEQ ID NO: 1597265 - RNA, 16 nt, Homo sapiens
uucucuggcuggaaua

SEQ ID NO: 1597266 - RNA, 20 nt, Homo sapiens
uucucuugccauuuguagcu

SEQ ID NO: 1597267 - RNA, 14 nt, Homo sapiens
uucucuuugacaaa

SEQ ID NO: 1597268 - RNA, 18 nt, Homo sapiens
uucugaaguuuccuauga

SEQ ID NO: 1597269 - RNA, 15 nt, Homo sapiens
uucugaauuugcaaa

SEQ ID NO: 1597270 - RNA, 15 nt, Homo sapiens
uucugacuuuuacag

SEQ ID NO: 1597271 - RNA, 19 nt, Homo sapiens
uucugagguccuuaugucc

SEQ ID NO: 1597272 - RNA, 16 nt, Homo sapiens
uucugauaaacacaau

SEQ ID NO: 1597273 - RNA, 20 nt, Homo sapiens
uucugauacuuuaguacaau

SEQ ID NO: 1597274 - RNA, 23 nt, Homo sapiens
uucugauguguucucugaucugc

SEQ ID NO: 1597275 - RNA, 18 nt, Homo sapiens
uucugcauucucuaguca

SEQ ID NO: 1597276 - RNA, 19 nt, Homo sapiens
uucugccaaugaccaaaca

SEQ ID NO: 1597277 - RNA, 22 nt, Homo sapiens
uucugccaccccuaaacuccag

SEQ ID NO: 1597278 - RNA, 15 nt, Homo sapiens
uucugcccuccagag

SEQ ID NO: 1597279 - RNA, 17 nt, Homo sapiens
uucugccucuccaggca

SEQ ID NO: 1597280 - RNA, 16 nt, Homo sapiens
uucugcuagagcagac

SEQ ID NO: 1597281 - RNA, 19 nt, Homo sapiens
uucugcuuuuuuucaggga

SEQ ID NO: 1597282 - RNA, 15 nt, Homo sapiens
uucugguaagacugc

SEQ ID NO: 1597283 - RNA, 23 nt, Homo sapiens
uucuguaucuuucauccuugacu

SEQ ID NO: 1597284 - RNA, 18 nt, Homo sapiens
uucuguccuaaucauaca

SEQ ID NO: 1597285 - RNA, 18 nt, Homo sapiens
uucugucuuucugcuaug

SEQ ID NO: 1597286 - RNA, 14 nt, Homo sapiens
uucuguguauuuaa

SEQ ID NO: 1597287 - RNA, 20 nt, Homo sapiens
uucuguucugcaacuccauc

SEQ ID NO: 1597288 - RNA, 16 nt, Homo sapiens
uucuguuuuguuaaua

SEQ ID NO: 1597289 - RNA, 22 nt, Homo sapiens
uucuguuuuguuguuugauuca

SEQ ID NO: 1597290 - RNA, 12 nt, Homo sapiens
uucuuacacugu

SEQ ID NO: 1597291 - RNA, 15 nt, Homo sapiens
uucuuacuaaucuga

SEQ ID NO: 1597292 - RNA, 22 nt, Homo sapiens
uucuuagcccuugggcacugca

SEQ ID NO: 1597293 - RNA, 23 nt, Homo sapiens
uucuuagcccuugggcacugcac

SEQ ID NO: 1597294 - RNA, 19 nt, Homo sapiens
uucuucacauguuuaacuu

SEQ ID NO: 1597295 - RNA, 11 nt, Homo sapiens
uucuucacuua

SEQ ID NO: 1597296 - RNA, 19 nt, Homo sapiens
uucuucacuuaaacucagc

SEQ ID NO: 1597297 - RNA, 15 nt, Homo sapiens
uucuucacuuaccca

SEQ ID NO: 1597298 - RNA, 20 nt, Homo sapiens
uucuuccaucaucacuguaa

SEQ ID NO: 1597299 - RNA, 21 nt, Homo sapiens
uucuuccaucaucacuguaaa

SEQ ID NO: 1597300 - RNA, 15 nt, Homo sapiens
uucuuccccauggaa

SEQ ID NO: 1597301 - RNA, 17 nt, Homo sapiens
uucuuccccauggaaca

SEQ ID NO: 1597302 - RNA, 14 nt, Homo sapiens
uucuucuacugcua

SEQ ID NO: 1597303 - RNA, 12 nt, Homo sapiens
uucuucugcaac

SEQ ID NO: 1597304 - RNA, 21 nt, Homo sapiens
uucuucuuggucucaguguca

SEQ ID NO: 1597305 - RNA, 17 nt, Homo sapiens
uucuugguaacugauua

SEQ ID NO: 1597306 - RNA, 22 nt, Homo sapiens
uucuuguaucaaauucaauaau

SEQ ID NO: 1597307 - RNA, 14 nt, Homo sapiens
uucuuguaucugga

SEQ ID NO: 1597308 - RNA, 15 nt, Homo sapiens
uucuuguugcugcau

SEQ ID NO: 1597309 - RNA, 22 nt, Homo sapiens
uucuuuaaaaaacaacuaugga

SEQ ID NO: 1597310 - RNA, 20 nt, Homo sapiens
uucuuuagagggaaggaaua

SEQ ID NO: 1597311 - RNA, 19 nt, Homo sapiens
uucuuuaggggaaguaaaa

SEQ ID NO: 1597312 - RNA, 14 nt, Homo sapiens
uucuuuauauucaa

SEQ ID NO: 1597313 - RNA, 21 nt, Homo sapiens
uucuuuaucccauuuuaucau

SEQ ID NO: 1597314 - RNA, 12 nt, Homo sapiens
uucuuucaggaa

SEQ ID NO: 1597315 - RNA, 17 nt, Homo sapiens
uucuuucccaacaccuc

SEQ ID NO: 1597316 - RNA, 13 nt, Homo sapiens
uucuuuccucaca

SEQ ID NO: 1597317 - RNA, 12 nt, Homo sapiens
uucuuucugucc

SEQ ID NO: 1597318 - RNA, 22 nt, Homo sapiens
uucuuugcaccaaagacaucag

SEQ ID NO: 1597319 - RNA, 20 nt, Homo sapiens
uucuuugguauuccauccac

SEQ ID NO: 1597320 - RNA, 22 nt, Homo sapiens
uucuuugucuugccccuaggaa

SEQ ID NO: 1597321 - RNA, 14 nt, Homo sapiens
uucuuugugccuuu

SEQ ID NO: 1597322 - RNA, 13 nt, Homo sapiens
uucuuuuauguga

SEQ ID NO: 1597323 - RNA, 19 nt, Homo sapiens
uucuuuucccaucaccaga

SEQ ID NO: 1597324 - RNA, 23 nt, Homo sapiens
uugaaaaaaagggcacucugaua

SEQ ID NO: 1597325 - RNA, 21 nt, Homo sapiens
uugaaaaacuuuuagguuguu

SEQ ID NO: 1597326 - RNA, 19 nt, Homo sapiens
uugaaaaaugagagcugua

SEQ ID NO: 1597327 - RNA, 18 nt, Homo sapiens
uugaaaagaaaaccacag

SEQ ID NO: 1597328 - RNA, 17 nt, Homo sapiens
uugaaaagacuccaaag

SEQ ID NO: 1597329 - RNA, 16 nt, Homo sapiens
uugaaaauaaccuaau

SEQ ID NO: 1597330 - RNA, 19 nt, Homo sapiens
uugaaaauauuuuguugcc

SEQ ID NO: 1597331 - RNA, 17 nt, Homo sapiens
uugaaaccugcucugua

SEQ ID NO: 1597332 - RNA, 17 nt, Homo sapiens
uugaaacguuaugauga

SEQ ID NO: 1597333 - RNA, 19 nt, Homo sapiens
uugaaacuaucucaugcca

SEQ ID NO: 1597334 - RNA, 15 nt, Homo sapiens
uugaaacugagaugu

SEQ ID NO: 1597335 - RNA, 13 nt, Homo sapiens
uugaaacuuugaa

SEQ ID NO: 1597336 - RNA, 11 nt, Homo sapiens
uugaaagaaga

SEQ ID NO: 1597337 - RNA, 19 nt, Homo sapiens
uugaaaguuguacaugaua

SEQ ID NO: 1597338 - RNA, 17 nt, Homo sapiens
uugaaauaaaugacaau

SEQ ID NO: 1597339 - RNA, 23 nt, Homo sapiens
uugaaauaaaugacaauguaauu

SEQ ID NO: 1597340 - RNA, 16 nt, Homo sapiens
uugaaauagucugugu

SEQ ID NO: 1597341 - RNA, 13 nt, Homo sapiens
uugaaauauucag

SEQ ID NO: 1597342 - RNA, 21 nt, Homo sapiens
uugaacaaaaauguuuccacu

SEQ ID NO: 1597343 - RNA, 21 nt, Homo sapiens
uugaacaagaugugggccuug

SEQ ID NO: 1597344 - RNA, 16 nt, Homo sapiens
uugaaccuccaaaugg

SEQ ID NO: 1597345 - RNA, 23 nt, Homo sapiens
uugaacuccugaccuugugaucc

SEQ ID NO: 1597346 - RNA, 13 nt, Homo sapiens
uugaacuuucaua

SEQ ID NO: 1597347 - RNA, 13 nt, Homo sapiens
uugaagauucuau

SEQ ID NO: 1597348 - RNA, 14 nt, Homo sapiens
uugaagcagauuuc

SEQ ID NO: 1597349 - RNA, 11 nt, Homo sapiens
uugaagccaaa

SEQ ID NO: 1597350 - RNA, 20 nt, Homo sapiens
uugaaggaguccuugcauca

SEQ ID NO: 1597351 - RNA, 13 nt, Homo sapiens
uugaaguguuccc

SEQ ID NO: 1597352 - RNA, 24 nt, Homo sapiens
uugaauacgcuaauaagugacaaa

SEQ ID NO: 1597353 - RNA, 19 nt, Homo sapiens
uugaaucagaaugccuuca

SEQ ID NO: 1597354 - RNA, 18 nt, Homo sapiens
uugaaugccauagucaaa

SEQ ID NO: 1597355 - RNA, 21 nt, Homo sapiens
uugaauggagauucugauuca

SEQ ID NO: 1597356 - RNA, 22 nt, Homo sapiens
uugaauggagcuggugagauca

SEQ ID NO: 1597357 - RNA, 14 nt, Homo sapiens
uugaauuucacugu

SEQ ID NO: 1597358 - RNA, 19 nt, Homo sapiens
uugacaaagaaacccaagu

SEQ ID NO: 1597359 - RNA, 18 nt, Homo sapiens
uugacaaaugacagaucu

SEQ ID NO: 1597360 - RNA, 13 nt, Homo sapiens
uugacaacauguu

SEQ ID NO: 1597361 - RNA, 11 nt, Homo sapiens
uugacacugaa

SEQ ID NO: 1597362 - RNA, 12 nt, Homo sapiens
uugacacugaac

SEQ ID NO: 1597363 - RNA, 22 nt, Homo sapiens
uugaccacguuuauguuuaaau

SEQ ID NO: 1597364 - RNA, 19 nt, Homo sapiens
uugacccuugcugugaauu

SEQ ID NO: 1597365 - RNA, 16 nt, Homo sapiens
uugacucaaaccauau

SEQ ID NO: 1597366 - RNA, 21 nt, Homo sapiens
uugacucgauuuaaacuccag

SEQ ID NO: 1597367 - RNA, 14 nt, Homo sapiens
uugagaaucccaaa

SEQ ID NO: 1597368 - RNA, 22 nt, Homo sapiens
uugagacuuucuucuagugcuu

SEQ ID NO: 1597369 - RNA, 16 nt, Homo sapiens
uugagagccaguggcg

SEQ ID NO: 1597370 - RNA, 16 nt, Homo sapiens
uugagaggcugaggug

SEQ ID NO: 1597371 - RNA, 13 nt, Homo sapiens
uugagcccaggag

SEQ ID NO: 1597372 - RNA, 21 nt, Homo sapiens
uugaguuauuccacaaacaca

SEQ ID NO: 1597373 - RNA, 22 nt, Homo sapiens
uugauaaaauaaaaaucauucu

SEQ ID NO: 1597374 - RNA, 16 nt, Homo sapiens
uugauagcagauauca

SEQ ID NO: 1597375 - RNA, 13 nt, Homo sapiens
uugauagcugucc

SEQ ID NO: 1597376 - RNA, 15 nt, Homo sapiens
uugauauaaucuuuc

SEQ ID NO: 1597377 - RNA, 15 nt, Homo sapiens
uugaucuuuuaguuu

SEQ ID NO: 1597378 - RNA, 15 nt, Homo sapiens
aaaaguagacaauca

SEQ ID NO: 1597379 - RNA, 21 nt, Homo sapiens
aaaaguagcaaauguuuacug

SEQ ID NO: 1597380 - RNA, 18 nt, Homo sapiens
aaaagucguuuuccaaac

SEQ ID NO: 1597381 - RNA, 11 nt, Homo sapiens
aaaagugcaca

SEQ ID NO: 1597382 - RNA, 22 nt, Homo sapiens
aaaagugcuucauucuuugcag

SEQ ID NO: 1597383 - RNA, 22 nt, Homo sapiens
aaaaguuggucaggcgcagugg

SEQ ID NO: 1597384 - RNA, 14 nt, Homo sapiens
aaaauaaaaauuaa

SEQ ID NO: 1597385 - RNA, 12 nt, Homo sapiens
aaaauaaagcug

SEQ ID NO: 1597386 - RNA, 13 nt, Homo sapiens
aaaauacaacucu

SEQ ID NO: 1597387 - RNA, 13 nt, Homo sapiens
aaaauagcaaaag

SEQ ID NO: 1597388 - RNA, 14 nt, Homo sapiens
aaaauagucuucca

SEQ ID NO: 1597389 - RNA, 12 nt, Homo sapiens
aaaauauauaca

SEQ ID NO: 1597390 - RNA, 15 nt, Homo sapiens
aaaauauauacuaaa

SEQ ID NO: 1597391 - RNA, 19 nt, Homo sapiens
aaaauauugaaaugcugua

SEQ ID NO: 1597392 - RNA, 15 nt, Homo sapiens
aaaauauuguuucug

SEQ ID NO: 1597393 - RNA, 13 nt, Homo sapiens
aaaaucaauacaa

SEQ ID NO: 1597394 - RNA, 14 nt, Homo sapiens
aaaaucagggccac

SEQ ID NO: 1597395 - RNA, 17 nt, Homo sapiens
aaaaucccaccuuccca

SEQ ID NO: 1597396 - RNA, 20 nt, Homo sapiens
aaaauccugaacuuucuccc

SEQ ID NO: 1597397 - RNA, 23 nt, Homo sapiens
aaaauccuuuuggcauguuccca

SEQ ID NO: 1597398 - RNA, 14 nt, Homo sapiens
aaaaucguuuugcc

SEQ ID NO: 1597399 - RNA, 14 nt, Homo sapiens
aaaaucuagcacac

SEQ ID NO: 1597400 - RNA, 20 nt, Homo sapiens
aaaaucuagcacacucuucu

SEQ ID NO: 1597401 - RNA, 16 nt, Homo sapiens
aaaaucucauuauuuc

SEQ ID NO: 1597402 - RNA, 12 nt, Homo sapiens
aaaaucugucca

SEQ ID NO: 1597403 - RNA, 22 nt, Homo sapiens
aaaaucugugaccugucagaau

SEQ ID NO: 1597404 - RNA, 15 nt, Homo sapiens
aaaaugaaaauucua

SEQ ID NO: 1597405 - RNA, 23 nt, Homo sapiens
aaaaugaaaauucuaacccaaga

SEQ ID NO: 1597406 - RNA, 18 nt, Homo sapiens
aaaaugagagcuguaacu

SEQ ID NO: 1597407 - RNA, 14 nt, Homo sapiens
aaaaugcaaaagca

SEQ ID NO: 1597408 - RNA, 17 nt, Homo sapiens
aaaaugcaaaagcacau

SEQ ID NO: 1597409 - RNA, 22 nt, Homo sapiens
aaaaugcaucauuaauaccuaa

SEQ ID NO: 1597410 - RNA, 14 nt, Homo sapiens
aaaaugccaugaaa

SEQ ID NO: 1597411 - RNA, 15 nt, Homo sapiens
aaaaugcugcucuca

SEQ ID NO: 1597412 - RNA, 14 nt, Homo sapiens
aaaauggagccaug

SEQ ID NO: 1597413 - RNA, 17 nt, Homo sapiens
aaaauggcgaacaugug

SEQ ID NO: 1597414 - RNA, 21 nt, Homo sapiens
aaaauggucacguuuggugcu

SEQ ID NO: 1597415 - RNA, 21 nt, Homo sapiens
aaaauguacaaaaagaacaau

SEQ ID NO: 1597416 - RNA, 20 nt, Homo sapiens
aaaauguaugccacaucuca

SEQ ID NO: 1597417 - RNA, 23 nt, Homo sapiens
aaaauguucuguuugcuguggaa

SEQ ID NO: 1597418 - RNA, 21 nt, Homo sapiens
aaaauuaagaaauucacuucc

SEQ ID NO: 1597419 - RNA, 13 nt, Homo sapiens
aaaauuacauaua

SEQ ID NO: 1597420 - RNA, 21 nt, Homo sapiens
aaaauuaguugggcauggugg

SEQ ID NO: 1597421 - RNA, 17 nt, Homo sapiens
aaaauuauacugagaac

SEQ ID NO: 1597422 - RNA, 19 nt, Homo sapiens
aaaauuaucaaaaagcuaa

SEQ ID NO: 1597423 - RNA, 18 nt, Homo sapiens
aaaauuauuagaacauuc

SEQ ID NO: 1597424 - RNA, 13 nt, Homo sapiens
aaaauucacauga

SEQ ID NO: 1597425 - RNA, 14 nt, Homo sapiens
aaaauucacaugau

SEQ ID NO: 1597426 - RNA, 18 nt, Homo sapiens
aaaauucauuucuaauua

SEQ ID NO: 1597427 - RNA, 17 nt, Homo sapiens
aaaauuccaaauucaug

SEQ ID NO: 1597428 - RNA, 14 nt, Homo sapiens
aaaauuccacucaa

SEQ ID NO: 1597429 - RNA, 15 nt, Homo sapiens
aaaauuccacucaaa

SEQ ID NO: 1597430 - RNA, 14 nt, Homo sapiens
aaaauugacaauga

SEQ ID NO: 1597431 - RNA, 16 nt, Homo sapiens
aaaauuuauuuuccag

SEQ ID NO: 1597432 - RNA, 22 nt, Homo sapiens
aaaauuuugggguaaaaaggag

SEQ ID NO: 1597433 - RNA, 20 nt, Homo sapiens
aaaauuuuuguuugguuaua

SEQ ID NO: 1597434 - RNA, 11 nt, Homo sapiens
aaacaaaauac

SEQ ID NO: 1597435 - RNA, 17 nt, Homo sapiens
aaacaaaauuugacuaa

SEQ ID NO: 1597436 - RNA, 16 nt, Homo sapiens
aaacaaaguugauuaa

SEQ ID NO: 1597437 - RNA, 19 nt, Homo sapiens
aaacaaauaaaaugaaaua

SEQ ID NO: 1597438 - RNA, 17 nt, Homo sapiens
aaacaaauguauuucaa

SEQ ID NO: 1597439 - RNA, 13 nt, Homo sapiens
aaacaacauuuau

SEQ ID NO: 1597440 - RNA, 15 nt, Homo sapiens
aaacaaccaugucau

SEQ ID NO: 1597441 - RNA, 14 nt, Homo sapiens
aaacaagccaaaga

SEQ ID NO: 1597442 - RNA, 17 nt, Homo sapiens
aaacaauauguuugcaa

SEQ ID NO: 1597443 - RNA, 19 nt, Homo sapiens
aaacaauccugacuuuuau

SEQ ID NO: 1597444 - RNA, 17 nt, Homo sapiens
aaacacuuggcauacaa

SEQ ID NO: 1597445 - RNA, 16 nt, Homo sapiens
aaacagaaaaccugau

SEQ ID NO: 1597446 - RNA, 22 nt, Homo sapiens
aaacagccucuuuuugauacug

SEQ ID NO: 1597447 - RNA, 13 nt, Homo sapiens
aaacagcugccuu

SEQ ID NO: 1597448 - RNA, 17 nt, Homo sapiens
aaacagggaaaaugaag

SEQ ID NO: 1597449 - RNA, 20 nt, Homo sapiens
aaacagggaauacauuguau

SEQ ID NO: 1597450 - RNA, 16 nt, Homo sapiens
aaacaggguaccucaa

SEQ ID NO: 1597451 - RNA, 21 nt, Homo sapiens
aaacagguuauaacaguguuu

SEQ ID NO: 1597452 - RNA, 19 nt, Homo sapiens
aaacagguuuuuaguuugu

SEQ ID NO: 1597453 - RNA, 17 nt, Homo sapiens
aaacauaauaaaaggag

SEQ ID NO: 1597454 - RNA, 19 nt, Homo sapiens
aaacauaauauagcuuaaa

SEQ ID NO: 1597455 - RNA, 13 nt, Homo sapiens
aaacauacguucu

SEQ ID NO: 1597456 - RNA, 14 nt, Homo sapiens
aaacauauuggaau

SEQ ID NO: 1597457 - RNA, 18 nt, Homo sapiens
aaacauauuggaauguac

SEQ ID NO: 1597458 - RNA, 20 nt, Homo sapiens
aaacaucuccccucucaccu

SEQ ID NO: 1597459 - RNA, 20 nt, Homo sapiens
aaacaucuuuucacaacuua

SEQ ID NO: 1597460 - RNA, 20 nt, Homo sapiens
aaacaugguggguccauggg

SEQ ID NO: 1597461 - RNA, 20 nt, Homo sapiens
aaacauuauaaaaauugaca

SEQ ID NO: 1597462 - RNA, 20 nt, Homo sapiens
aaacauuauucucaaccaga

SEQ ID NO: 1597463 - RNA, 18 nt, Homo sapiens
aaacauuccccuccccac

SEQ ID NO: 1597464 - RNA, 20 nt, Homo sapiens
aaacauuccccuccccacuc

SEQ ID NO: 1597465 - RNA, 20 nt, Homo sapiens
aaacauuggauuuuuccuua

SEQ ID NO: 1597466 - RNA, 21 nt, Homo sapiens
aaacauuggauuuuuccuuaa

SEQ ID NO: 1597467 - RNA, 13 nt, Homo sapiens
aaacauuuugaca

SEQ ID NO: 1597468 - RNA, 12 nt, Homo sapiens
aaaccaaaaaua

SEQ ID NO: 1597469 - RNA, 17 nt, Homo sapiens
aaaccagaaaagcaaua

SEQ ID NO: 1597470 - RNA, 17 nt, Homo sapiens
aaaccagaacccagugu

SEQ ID NO: 1597471 - RNA, 12 nt, Homo sapiens
aaaccaguguga

SEQ ID NO: 1597472 - RNA, 15 nt, Homo sapiens
aaaccauuaccugua

SEQ ID NO: 1597473 - RNA, 12 nt, Homo sapiens
aaaccauugugg

SEQ ID NO: 1597474 - RNA, 20 nt, Homo sapiens
aaacccagguucaugaauau

SEQ ID NO: 1597475 - RNA, 20 nt, Homo sapiens
aaacccucagcacuguuaca

SEQ ID NO: 1597476 - RNA, 14 nt, Homo sapiens
aaaccucuccugac

SEQ ID NO: 1597477 - RNA, 22 nt, Homo sapiens
aaaccucugccgcccuccacac

SEQ ID NO: 1597478 - RNA, 13 nt, Homo sapiens
aaaccugacuuaa

SEQ ID NO: 1597479 - RNA, 22 nt, Homo sapiens
aaaccuggaaucuacaagccaa

SEQ ID NO: 1597480 - RNA, 18 nt, Homo sapiens
aaaccuuaagugcugcag

SEQ ID NO: 1597481 - RNA, 18 nt, Homo sapiens
aaaccuuggccucugcua

SEQ ID NO: 1597482 - RNA, 13 nt, Homo sapiens
aaaccuuugcaaa

SEQ ID NO: 1597483 - RNA, 22 nt, Homo sapiens
aaacgggcucgggucugggcag

SEQ ID NO: 1597484 - RNA, 16 nt, Homo sapiens
aaacguuugacaaaca

SEQ ID NO: 1597485 - RNA, 16 nt, Homo sapiens
aaacuaaccaucugaa

SEQ ID NO: 1597486 - RNA, 23 nt, Homo sapiens
aaacuaagagcucucaagucaag

SEQ ID NO: 1597487 - RNA, 22 nt, Homo sapiens
aaacuaauuuaguaauagccug

SEQ ID NO: 1597488 - RNA, 19 nt, Homo sapiens
aaacuauguguucaaugaa

SEQ ID NO: 1597489 - RNA, 15 nt, Homo sapiens
aaacuauuucaguga

SEQ ID NO: 1597490 - RNA, 16 nt, Homo sapiens
aaacucaucacauaaa

SEQ ID NO: 1597491 - RNA, 19 nt, Homo sapiens
aaacuccacaucugccuua

SEQ ID NO: 1597492 - RNA, 16 nt, Homo sapiens
aaacucccgaccucag

SEQ ID NO: 1597493 - RNA, 22 nt, Homo sapiens
aaacucuguccacgauucacuc

SEQ ID NO: 1597494 - RNA, 20 nt, Homo sapiens
aaacugaagcugcacagugu

SEQ ID NO: 1597495 - RNA, 21 nt, Homo sapiens
aaacugagaugugaacacauc

SEQ ID NO: 1597496 - RNA, 22 nt, Homo sapiens
aaacugagaugugaacacauca

SEQ ID NO: 1597497 - RNA, 21 nt, Homo sapiens
aaacugaggaauuucaccugu

SEQ ID NO: 1597498 - RNA, 14 nt, Homo sapiens
aaacugaugacuua

SEQ ID NO: 1597499 - RNA, 12 nt, Homo sapiens
aaacugauuaaa

SEQ ID NO: 1597500 - RNA, 19 nt, Homo sapiens
aaacugcacugucaagaug

SEQ ID NO: 1597501 - RNA, 23 nt, Homo sapiens
aaacuguaucaucuuugccaagu

SEQ ID NO: 1597502 - RNA, 21 nt, Homo sapiens
aaacuguaugugcaguuauuu

SEQ ID NO: 1597503 - RNA, 23 nt, Homo sapiens
aaacuuaaggaagcaaaugcuac

SEQ ID NO: 1597504 - RNA, 16 nt, Homo sapiens
aaacuuagcuuuugau

SEQ ID NO: 1597505 - RNA, 13 nt, Homo sapiens
aaacuucaaagag

SEQ ID NO: 1597506 - RNA, 21 nt, Homo sapiens
aaacuucaccuacauuaucuc

SEQ ID NO: 1597507 - RNA, 17 nt, Homo sapiens
aaacuucacuaaugauc

SEQ ID NO: 1597508 - RNA, 13 nt, Homo sapiens
aaacuuccaguca

SEQ ID NO: 1597509 - RNA, 11 nt, Homo sapiens
aaacuugccug

SEQ ID NO: 1597510 - RNA, 19 nt, Homo sapiens
aaacuuggaaccuuggaaa

SEQ ID NO: 1597511 - RNA, 15 nt, Homo sapiens
aaacuuuagcaacag

SEQ ID NO: 1597512 - RNA, 23 nt, Homo sapiens
aaacuuucuccauuuaagacaca

SEQ ID NO: 1597513 - RNA, 15 nt, Homo sapiens
aaacuuuuuguucau

SEQ ID NO: 1597514 - RNA, 19 nt, Homo sapiens
aaacuuuuuuucuguacca

SEQ ID NO: 1597515 - RNA, 19 nt, Homo sapiens
aaagaaaaauaucuuggcc

SEQ ID NO: 1597516 - RNA, 20 nt, Homo sapiens
aaagaaaacuuguguucaau

SEQ ID NO: 1597517 - RNA, 21 nt, Homo sapiens
aaagaaaaucaggcuggccaa

SEQ ID NO: 1597518 - RNA, 21 nt, Homo sapiens
aaagaaaauuccuauaaggaa

SEQ ID NO: 1597519 - RNA, 16 nt, Homo sapiens
aaagaaaucagccaug

SEQ ID NO: 1597520 - RNA, 13 nt, Homo sapiens
aaagaaccacuug

SEQ ID NO: 1597521 - RNA, 17 nt, Homo sapiens
aaagaacguggucagag

SEQ ID NO: 1597522 - RNA, 18 nt, Homo sapiens
aaagaagaaaacaguaca

SEQ ID NO: 1597523 - RNA, 20 nt, Homo sapiens
aaagaagauaaacacaaaau

SEQ ID NO: 1597524 - RNA, 16 nt, Homo sapiens
aaagaagcagaccauu

SEQ ID NO: 1597525 - RNA, 22 nt, Homo sapiens
aaagaagcuucaugccagguua

SEQ ID NO: 1597526 - RNA, 15 nt, Homo sapiens
aaagaaguacuuuau

SEQ ID NO: 1597527 - RNA, 22 nt, Homo sapiens
aaagaaguaugguaaucuuuac

SEQ ID NO: 1597528 - RNA, 15 nt, Homo sapiens
aaagacaugcauuuu

SEQ ID NO: 1597529 - RNA, 20 nt, Homo sapiens
aaagaccaggucuacaguga

SEQ ID NO: 1597530 - RNA, 22 nt, Homo sapiens
aaagaccaggucuacagugaua

SEQ ID NO: 1597531 - RNA, 21 nt, Homo sapiens
aaagacuacaauaaaaccaaa

SEQ ID NO: 1597532 - RNA, 13 nt, Homo sapiens
aaagacugagcag

SEQ ID NO: 1597533 - RNA, 17 nt, Homo sapiens
aaagacugauuaccucc

SEQ ID NO: 1597534 - RNA, 14 nt, Homo sapiens
aaagagaaacuuug

SEQ ID NO: 1597535 - RNA, 13 nt, Homo sapiens
aaagagaagccaa

SEQ ID NO: 1597536 - RNA, 18 nt, Homo sapiens
aaagagacaaacuguaaa

SEQ ID NO: 1597537 - RNA, 14 nt, Homo sapiens
aaagagacagugau

SEQ ID NO: 1597538 - RNA, 10 nt, Homo sapiens
aaagagcaau

SEQ ID NO: 1597539 - RNA, 22 nt, Homo sapiens
aaagagccuucagaaugcuccu

SEQ ID NO: 1597540 - RNA, 19 nt, Homo sapiens
aaagaggaaaagugcaaug

SEQ ID NO: 1597541 - RNA, 22 nt, Homo sapiens
aaagaggcugccccucucacca

SEQ ID NO: 1597542 - RNA, 15 nt, Homo sapiens
aaagagggacaagag

SEQ ID NO: 1597543 - RNA, 17 nt, Homo sapiens
aaagagggcuuccucua

SEQ ID NO: 1597544 - RNA, 16 nt, Homo sapiens
aaagauccagccucau

SEQ ID NO: 1597545 - RNA, 16 nt, Homo sapiens
aaagaugaaaaguaua

SEQ ID NO: 1597546 - RNA, 22 nt, Homo sapiens
aaagaugcaaggaccaggacuc

SEQ ID NO: 1597547 - RNA, 14 nt, Homo sapiens
aaagaugucuuaac

SEQ ID NO: 1597548 - RNA, 19 nt, Homo sapiens
aaagauguuuacaucaaag

SEQ ID NO: 1597549 - RNA, 19 nt, Homo sapiens
aaagauuaaaugugucauu

SEQ ID NO: 1597550 - RNA, 20 nt, Homo sapiens
aaagauuauugugacuucac

SEQ ID NO: 1597551 - RNA, 19 nt, Homo sapiens
aaagauucucaucacucaa

SEQ ID NO: 1597552 - RNA, 13 nt, Homo sapiens
aaagauugagaag

SEQ ID NO: 1597553 - RNA, 20 nt, Homo sapiens
aaagcaagcauucagaagaa

SEQ ID NO: 1597554 - RNA, 22 nt, Homo sapiens
aaagcaauuauauuguccuccc

SEQ ID NO: 1597555 - RNA, 21 nt, Homo sapiens
aaagcaccagcaggcacguua

SEQ ID NO: 1597556 - RNA, 15 nt, Homo sapiens
aaagcaccauuguga

SEQ ID NO: 1597557 - RNA, 16 nt, Homo sapiens
aaagcagaacagugau

SEQ ID NO: 1597558 - RNA, 14 nt, Homo sapiens
aaagcagauacuug

SEQ ID NO: 1597559 - RNA, 19 nt, Homo sapiens
aaagcaguuacuaauaugc

SEQ ID NO: 1597560 - RNA, 13 nt, Homo sapiens
aaagcauaaagcu

SEQ ID NO: 1597561 - RNA, 13 nt, Homo sapiens
aaagcaucaaaga

SEQ ID NO: 1597562 - RNA, 19 nt, Homo sapiens
aaagcaucaucuguucgau

SEQ ID NO: 1597563 - RNA, 17 nt, Homo sapiens
aaagcaucuaucucauc

SEQ ID NO: 1597564 - RNA, 14 nt, Homo sapiens
aaagcaugcauauc

SEQ ID NO: 1597565 - RNA, 11 nt, Homo sapiens
aaagcauuauc

SEQ ID NO: 1597566 - RNA, 22 nt, Homo sapiens
aaagccaacauguggcuccucc

SEQ ID NO: 1597567 - RNA, 21 nt, Homo sapiens
aaagccaagggcaacagauca

SEQ ID NO: 1597568 - RNA, 19 nt, Homo sapiens
aaagccccccagcucccac

SEQ ID NO: 1597569 - RNA, 19 nt, Homo sapiens
aaagcccuuuuauaccucc

SEQ ID NO: 1597570 - RNA, 17 nt, Homo sapiens
aaagccugaaguggaau

SEQ ID NO: 1597571 - RNA, 20 nt, Homo sapiens
aaagccugaaguggaaugac

SEQ ID NO: 1597572 - RNA, 22 nt, Homo sapiens
aaagccuugugugaacucacca

SEQ ID NO: 1597573 - RNA, 23 nt, Homo sapiens
aaagcuaggaugguucugugacc

SEQ ID NO: 1597574 - RNA, 12 nt, Homo sapiens
aaagcugccccu

SEQ ID NO: 1597575 - RNA, 16 nt, Homo sapiens
aaagcugcuaaaucuc

SEQ ID NO: 1597576 - RNA, 15 nt, Homo sapiens
aaagcugcugucacu

SEQ ID NO: 1597577 - RNA, 11 nt, Homo sapiens
aaagcuuaaug

SEQ ID NO: 1597578 - RNA, 20 nt, Homo sapiens
aaagcuuaaugauucugaua

SEQ ID NO: 1597579 - RNA, 12 nt, Homo sapiens
aaagcuuuauga

SEQ ID NO: 1597580 - RNA, 19 nt, Homo sapiens
aaaggaaaauaguaauguu

SEQ ID NO: 1597581 - RNA, 17 nt, Homo sapiens
aaaggaaucacguuaga

SEQ ID NO: 1597582 - RNA, 16 nt, Homo sapiens
aaaggacaucagcaaa

SEQ ID NO: 1597583 - RNA, 12 nt, Homo sapiens
aaaggacuguaa

SEQ ID NO: 1597584 - RNA, 17 nt, Homo sapiens
aaaggagacauugcucu

SEQ ID NO: 1597585 - RNA, 15 nt, Homo sapiens
aaaggauuuuaccaa

SEQ ID NO: 1597586 - RNA, 22 nt, Homo sapiens
aaagugggcaaaagcuuacaaa

SEQ ID NO: 1597587 - RNA, 14 nt, Homo sapiens
aaagugggcuugau

SEQ ID NO: 1597588 - RNA, 19 nt, Homo sapiens
aaagugguaaauacuguga

SEQ ID NO: 1597589 - RNA, 19 nt, Homo sapiens
aaagugugagcucuucccu

SEQ ID NO: 1597590 - RNA, 19 nt, Homo sapiens
aaaguguguuucuauguga

SEQ ID NO: 1597591 - RNA, 15 nt, Homo sapiens
aaaguuaaacauuga

SEQ ID NO: 1597592 - RNA, 21 nt, Homo sapiens
aaaguuauauuucagauguaa

SEQ ID NO: 1597593 - RNA, 21 nt, Homo sapiens
aaaguuguccucagccaagga

SEQ ID NO: 1597594 - RNA, 16 nt, Homo sapiens
aaaguuuaaagacacu

SEQ ID NO: 1597595 - RNA, 21 nt, Homo sapiens
aaaguuuuaggguacaguuug

SEQ ID NO: 1597596 - RNA, 19 nt, Homo sapiens
aaaguuuugcaacaauaaa

SEQ ID NO: 1597597 - RNA, 20 nt, Homo sapiens
aaauaaaaaucucuuuucca

SEQ ID NO: 1597598 - RNA, 15 nt, Homo sapiens
aaauaaaaugacguc

SEQ ID NO: 1597599 - RNA, 14 nt, Homo sapiens
aaauaaacaaguca

SEQ ID NO: 1597600 - RNA, 19 nt, Homo sapiens
aaauaaacacauagauuca

SEQ ID NO: 1597601 - RNA, 14 nt, Homo sapiens
aaauaaaugacaau

SEQ ID NO: 1597602 - RNA, 17 nt, Homo sapiens
aaauaagccagacauca

SEQ ID NO: 1597603 - RNA, 23 nt, Homo sapiens
aaauaaguaauaucuuucaguua

SEQ ID NO: 1597604 - RNA, 14 nt, Homo sapiens
aaauaauaucauuu

SEQ ID NO: 1597605 - RNA, 16 nt, Homo sapiens
aaauaaucucaaagga

SEQ ID NO: 1597606 - RNA, 12 nt, Homo sapiens
aaauaaugagga

SEQ ID NO: 1597607 - RNA, 21 nt, Homo sapiens
aaauaaugguguccagucuuu

SEQ ID NO: 1597608 - RNA, 13 nt, Homo sapiens
aaauaauugccac

SEQ ID NO: 1597609 - RNA, 14 nt, Homo sapiens
aaauacaacacuga

SEQ ID NO: 1597610 - RNA, 14 nt, Homo sapiens
aaauacacauagca

SEQ ID NO: 1597611 - RNA, 15 nt, Homo sapiens
aaauacaugcacagu

SEQ ID NO: 1597612 - RNA, 17 nt, Homo sapiens
aaauaccacaagccuga

SEQ ID NO: 1597613 - RNA, 14 nt, Homo sapiens
aaauaccauguaca

SEQ ID NO: 1597614 - RNA, 21 nt, Homo sapiens
aaauaccuuuucucacaaaaa

SEQ ID NO: 1597615 - RNA, 18 nt, Homo sapiens
aaauagaaagaagccaua

SEQ ID NO: 1597616 - RNA, 15 nt, Homo sapiens
aaauagacaaaaagu

SEQ ID NO: 1597617 - RNA, 17 nt, Homo sapiens
aaauagagccugaggga

SEQ ID NO: 1597618 - RNA, 14 nt, Homo sapiens
aaauagcaaaagaa

SEQ ID NO: 1597619 - RNA, 13 nt, Homo sapiens
aaauagucuucca

SEQ ID NO: 1597620 - RNA, 20 nt, Homo sapiens
aaauaguguaagaacuguac

SEQ ID NO: 1597621 - RNA, 14 nt, Homo sapiens
aaauauacauucaa

SEQ ID NO: 1597622 - RNA, 22 nt, Homo sapiens
aaauauauauuauauauuuaca

SEQ ID NO: 1597623 - RNA, 21 nt, Homo sapiens
aaauauaucuagaacuaucau

SEQ ID NO: 1597624 - RNA, 17 nt, Homo sapiens
aaauaucaauggugcug

SEQ ID NO: 1597625 - RNA, 15 nt, Homo sapiens
aaauaucuacauuaa

SEQ ID NO: 1597626 - RNA, 18 nt, Homo sapiens
aaauaucuuggccuaaac

SEQ ID NO: 1597627 - RNA, 17 nt, Homo sapiens
aaauauuuuaaaaucag

SEQ ID NO: 1597628 - RNA, 20 nt, Homo sapiens
aaauauuuuguaaugcugca

SEQ ID NO: 1597629 - RNA, 15 nt, Homo sapiens
aaaucaaaacagaga

SEQ ID NO: 1597630 - RNA, 12 nt, Homo sapiens
aaaucaauacaa

SEQ ID NO: 1597631 - RNA, 18 nt, Homo sapiens
aaaucaauacacuaguug

SEQ ID NO: 1597632 - RNA, 22 nt, Homo sapiens
aaaucagaagucaucuugcuac

SEQ ID NO: 1597633 - RNA, 23 nt, Homo sapiens
aaaucaggacagguggugcaaau

SEQ ID NO: 1597634 - RNA, 23 nt, Homo sapiens
aaaucagggccaccauugucuca

SEQ ID NO: 1597635 - RNA, 18 nt, Homo sapiens
aaauccagugagcacuag

SEQ ID NO: 1597636 - RNA, 13 nt, Homo sapiens
aaauccucaggug

SEQ ID NO: 1597637 - RNA, 14 nt, Homo sapiens
aaauccucuucccu

SEQ ID NO: 1597638 - RNA, 13 nt, Homo sapiens
aaaucuaccaaga

SEQ ID NO: 1597639 - RNA, 15 nt, Homo sapiens
aaaucuaccacugua

SEQ ID NO: 1597640 - RNA, 14 nt, Homo sapiens
aaaucuccaucuca

SEQ ID NO: 1597641 - RNA, 17 nt, Homo sapiens
aaaucugugaccuguca

SEQ ID NO: 1597642 - RNA, 17 nt, Homo sapiens
aaaucugugccugagaa

SEQ ID NO: 1597643 - RNA, 15 nt, Homo sapiens
aaaucuuaacuugaa

SEQ ID NO: 1597644 - RNA, 21 nt, Homo sapiens
aaaucuugcuucagaccauca

SEQ ID NO: 1597645 - RNA, 23 nt, Homo sapiens
aaaucuuuuugcuucuacuuuca

SEQ ID NO: 1597646 - RNA, 19 nt, Homo sapiens
aaaugaaagggaaacuggg

SEQ ID NO: 1597647 - RNA, 15 nt, Homo sapiens
aaaugaaaugccaaa

SEQ ID NO: 1597648 - RNA, 14 nt, Homo sapiens
aaaugaacauuuca

SEQ ID NO: 1597649 - RNA, 16 nt, Homo sapiens
aaaugaaccauucaca

SEQ ID NO: 1597650 - RNA, 17 nt, Homo sapiens
aaaugaauaucaugcaa

SEQ ID NO: 1597651 - RNA, 22 nt, Homo sapiens
aaaugaauggaggaacuuucca

SEQ ID NO: 1597652 - RNA, 14 nt, Homo sapiens
aaaugacacuacuu

SEQ ID NO: 1597653 - RNA, 14 nt, Homo sapiens
aaaugacauuucac

SEQ ID NO: 1597654 - RNA, 15 nt, Homo sapiens
aaaugacauuucacu

SEQ ID NO: 1597655 - RNA, 22 nt, Homo sapiens
aaaugacgucuucaccaaguga

SEQ ID NO: 1597656 - RNA, 17 nt, Homo sapiens
aaaugagggaagaacau

SEQ ID NO: 1597657 - RNA, 20 nt, Homo sapiens
aaaugaggugccacccagua

SEQ ID NO: 1597658 - RNA, 19 nt, Homo sapiens
aaaugauaaggcucugaaa

SEQ ID NO: 1597659 - RNA, 13 nt, Homo sapiens
aaaugaucuuuac

SEQ ID NO: 1597660 - RNA, 18 nt, Homo sapiens
aaaugauuauauucacag

SEQ ID NO: 1597661 - RNA, 22 nt, Homo sapiens
aaaugauuccuggacaucacca

SEQ ID NO: 1597662 - RNA, 18 nt, Homo sapiens
aaaugauuucacagugug

SEQ ID NO: 1597663 - RNA, 14 nt, Homo sapiens
aaaugcacaaacaa

SEQ ID NO: 1597664 - RNA, 22 nt, Homo sapiens
aaaugcacuaagacaagaacau

SEQ ID NO: 1597665 - RNA, 21 nt, Homo sapiens
aaaugcagacaacaccuuccu

SEQ ID NO: 1597666 - RNA, 11 nt, Homo sapiens
aaaugcauucg

SEQ ID NO: 1597667 - RNA, 21 nt, Homo sapiens
aaaugcgcgugugcacgugug

SEQ ID NO: 1597668 - RNA, 14 nt, Homo sapiens
aaauggcuaugaac

SEQ ID NO: 1597669 - RNA, 19 nt, Homo sapiens
aaaugggagacagccucuu

SEQ ID NO: 1597670 - RNA, 15 nt, Homo sapiens
aaauguacacuuuuu

SEQ ID NO: 1597671 - RNA, 17 nt, Homo sapiens
aaauguauacuauagua

SEQ ID NO: 1597672 - RNA, 22 nt, Homo sapiens
aaauguaugucugguuccccag

SEQ ID NO: 1597673 - RNA, 22 nt, Homo sapiens
aaauguauugauucaacaggga

SEQ ID NO: 1597674 - RNA, 14 nt, Homo sapiens
aaauguauuuuaca

SEQ ID NO: 1597675 - RNA, 13 nt, Homo sapiens
aaaugucaucuca

SEQ ID NO: 1597676 - RNA, 13 nt, Homo sapiens
aauaaaugauuau

SEQ ID NO: 1597677 - RNA, 16 nt, Homo sapiens
aauaaaugugccuuca

SEQ ID NO: 1597678 - RNA, 16 nt, Homo sapiens
aauaaauuacaauuga

SEQ ID NO: 1597679 - RNA, 22 nt, Homo sapiens
aauaacacuguauuuuaaugua

SEQ ID NO: 1597680 - RNA, 22 nt, Homo sapiens
aauaacaucucaccuucaguca

SEQ ID NO: 1597681 - RNA, 19 nt, Homo sapiens
aauaacauuuaaauuccac

SEQ ID NO: 1597682 - RNA, 19 nt, Homo sapiens
aauaaccguaaagguuuau

SEQ ID NO: 1597683 - RNA, 14 nt, Homo sapiens
aauaagacaagaga

SEQ ID NO: 1597684 - RNA, 15 nt, Homo sapiens
aauaagauauuuagu

SEQ ID NO: 1597685 - RNA, 24 nt, Homo sapiens
aauaagcuaaacgcaaugucauuu

SEQ ID NO: 1597686 - RNA, 13 nt, Homo sapiens
aauaaguaauauc

SEQ ID NO: 1597687 - RNA, 15 nt, Homo sapiens
aauaauaagugaugu

SEQ ID NO: 1597688 - RNA, 18 nt, Homo sapiens
aauaauacauacuaauga

SEQ ID NO: 1597689 - RNA, 12 nt, Homo sapiens
aauaauagcaau

SEQ ID NO: 1597690 - RNA, 15 nt, Homo sapiens
aauaauagcaauuca

SEQ ID NO: 1597691 - RNA, 14 nt, Homo sapiens
aauaaucaaccugg

SEQ ID NO: 1597692 - RNA, 21 nt, Homo sapiens
aauaaugaauggacucaucuu

SEQ ID NO: 1597693 - RNA, 15 nt, Homo sapiens
aauaaugagcuauua

SEQ ID NO: 1597694 - RNA, 16 nt, Homo sapiens
aauacaaaaggcauuu

SEQ ID NO: 1597695 - RNA, 17 nt, Homo sapiens
aauacaaacaaucucuu

SEQ ID NO: 1597696 - RNA, 15 nt, Homo sapiens
aauacaauguacaau

SEQ ID NO: 1597697 - RNA, 11 nt, Homo sapiens
aauacacaauu

SEQ ID NO: 1597698 - RNA, 17 nt, Homo sapiens
aauacacacucaaauca

SEQ ID NO: 1597699 - RNA, 22 nt, Homo sapiens
aauacaggaggcagacaaugac

SEQ ID NO: 1597700 - RNA, 13 nt, Homo sapiens
aauacaguauuau

SEQ ID NO: 1597701 - RNA, 23 nt, Homo sapiens
aauacaguuacuuaaugaccaug

SEQ ID NO: 1597702 - RNA, 17 nt, Homo sapiens
aauacauacuaaugaag

SEQ ID NO: 1597703 - RNA, 14 nt, Homo sapiens
aauacaucaaagag

SEQ ID NO: 1597704 - RNA, 11 nt, Homo sapiens
aauacaugcac

SEQ ID NO: 1597705 - RNA, 13 nt, Homo sapiens
aauacaugcacag

SEQ ID NO: 1597706 - RNA, 14 nt, Homo sapiens
aauacaugguuuaa

SEQ ID NO: 1597707 - RNA, 15 nt, Homo sapiens
aauaccaauguucua

SEQ ID NO: 1597708 - RNA, 12 nt, Homo sapiens
aauaccauguac

SEQ ID NO: 1597709 - RNA, 20 nt, Homo sapiens
aauaccuaagucauuccucc

SEQ ID NO: 1597710 - RNA, 16 nt, Homo sapiens
aauacucugcagugau

SEQ ID NO: 1597711 - RNA, 20 nt, Homo sapiens
aauacucugcccucuagagc

SEQ ID NO: 1597712 - RNA, 13 nt, Homo sapiens
aauacuuacuucu

SEQ ID NO: 1597713 - RNA, 21 nt, Homo sapiens
aauacuugaacucuguucccc

SEQ ID NO: 1597714 - RNA, 20 nt, Homo sapiens
aauagaaccacuaugaagcu

SEQ ID NO: 1597715 - RNA, 20 nt, Homo sapiens
aauagaggugaugcugcuaa

SEQ ID NO: 1597716 - RNA, 17 nt, Homo sapiens
aauagcaccccuacuca

SEQ ID NO: 1597717 - RNA, 16 nt, Homo sapiens
aauagccacauuugga

SEQ ID NO: 1597718 - RNA, 21 nt, Homo sapiens
aauagguuuguaaaaugcacc

SEQ ID NO: 1597719 - RNA, 17 nt, Homo sapiens
aauaguaaugugaugcu

SEQ ID NO: 1597720 - RNA, 15 nt, Homo sapiens
aauaguacuauuacu

SEQ ID NO: 1597721 - RNA, 17 nt, Homo sapiens
aauaguacuauugcuag

SEQ ID NO: 1597722 - RNA, 20 nt, Homo sapiens
aauaguauuucagcugcaau

SEQ ID NO: 1597723 - RNA, 16 nt, Homo sapiens
aauagucuuccacaaa

SEQ ID NO: 1597724 - RNA, 18 nt, Homo sapiens
aauagugaauaaagucau

SEQ ID NO: 1597725 - RNA, 15 nt, Homo sapiens
aauaguggcauacca

SEQ ID NO: 1597726 - RNA, 17 nt, Homo sapiens
aauaguggcauaccaaa

SEQ ID NO: 1597727 - RNA, 14 nt, Homo sapiens
aauagugucauccu

SEQ ID NO: 1597728 - RNA, 18 nt, Homo sapiens
aauaguguccuaugcaau

SEQ ID NO: 1597729 - RNA, 15 nt, Homo sapiens
aauaguguucucugu

SEQ ID NO: 1597730 - RNA, 21 nt, Homo sapiens
aauaguucuauccuuuugccu

SEQ ID NO: 1597731 - RNA, 17 nt, Homo sapiens
aauauaaaacagucaug

SEQ ID NO: 1597732 - RNA, 14 nt, Homo sapiens
aauauaaugaugcu

SEQ ID NO: 1597733 - RNA, 12 nt, Homo sapiens
aauauacauuca

SEQ ID NO: 1597734 - RNA, 18 nt, Homo sapiens
aauauacauucaaacuua

SEQ ID NO: 1597735 - RNA, 17 nt, Homo sapiens
aauauagacagugcccu

SEQ ID NO: 1597736 - RNA, 19 nt, Homo sapiens
aauauagccuuuaaaucau

SEQ ID NO: 1597737 - RNA, 18 nt, Homo sapiens
aauauauccugaaagcau

SEQ ID NO: 1597738 - RNA, 13 nt, Homo sapiens
aauauaucuggaa

SEQ ID NO: 1597739 - RNA, 14 nt, Homo sapiens
aauauaugaggcua

SEQ ID NO: 1597740 - RNA, 16 nt, Homo sapiens
aauaucaacucugaaa

SEQ ID NO: 1597741 - RNA, 12 nt, Homo sapiens
aauaucaccuag

SEQ ID NO: 1597742 - RNA, 15 nt, Homo sapiens
aauaucacucauuaa

SEQ ID NO: 1597743 - RNA, 18 nt, Homo sapiens
aauaucacuguaaugagu

SEQ ID NO: 1597744 - RNA, 15 nt, Homo sapiens
aauaucagauuucau

SEQ ID NO: 1597745 - RNA, 20 nt, Homo sapiens
aauaucaucugucauuauau

SEQ ID NO: 1597746 - RNA, 23 nt, Homo sapiens
aauaucccuuggacauuuuaugu

SEQ ID NO: 1597747 - RNA, 17 nt, Homo sapiens
aauauccuaaacaucau

SEQ ID NO: 1597748 - RNA, 15 nt, Homo sapiens
aauaucuugcuuuca

SEQ ID NO: 1597749 - RNA, 17 nt, Homo sapiens
aauaucuugcuuucaaa

SEQ ID NO: 1597750 - RNA, 22 nt, Homo sapiens
aauaugccuagcacaaguacca

SEQ ID NO: 1597751 - RNA, 17 nt, Homo sapiens
aauaugcuuauaaccua

SEQ ID NO: 1597752 - RNA, 15 nt, Homo sapiens
aauaugggggccuuu

SEQ ID NO: 1597753 - RNA, 18 nt, Homo sapiens
aauauuaaaaaacuucau

SEQ ID NO: 1597754 - RNA, 19 nt, Homo sapiens
aauauuacuuugucuuuuc

SEQ ID NO: 1597755 - RNA, 21 nt, Homo sapiens
aauauuagcaaagaagcuuca

SEQ ID NO: 1597756 - RNA, 22 nt, Homo sapiens
aauauuauuagucugcaugguu

SEQ ID NO: 1597757 - RNA, 19 nt, Homo sapiens
aauauucagccagcuuaaa

SEQ ID NO: 1597758 - RNA, 16 nt, Homo sapiens
aauauucauugaauaa

SEQ ID NO: 1597759 - RNA, 21 nt, Homo sapiens
aauauuccuaugcugcaauac

SEQ ID NO: 1597760 - RNA, 18 nt, Homo sapiens
aauauugacucaaaccau

SEQ ID NO: 1597761 - RNA, 13 nt, Homo sapiens
aauauuuauucau

SEQ ID NO: 1597762 - RNA, 12 nt, Homo sapiens
aauauuucacuu

SEQ ID NO: 1597763 - RNA, 13 nt, Homo sapiens
aauauuucacuua

SEQ ID NO: 1597764 - RNA, 19 nt, Homo sapiens
aauauuuuaaacuacugau

SEQ ID NO: 1597765 - RNA, 23 nt, Homo sapiens
aauauuuugcuaaaaaagcauau

SEQ ID NO: 1597766 - RNA, 17 nt, Homo sapiens
aauauuuuuauauuucc

SEQ ID NO: 1597767 - RNA, 22 nt, Homo sapiens
aauauuuuuauauuuccuuuau

SEQ ID NO: 1597768 - RNA, 22 nt, Homo sapiens
aaucaaaggaaaauaguaaugu

SEQ ID NO: 1597769 - RNA, 12 nt, Homo sapiens
aaucaacauuuc

SEQ ID NO: 1597770 - RNA, 18 nt, Homo sapiens
aaucaagcuuuugcuuga

SEQ ID NO: 1597771 - RNA, 22 nt, Homo sapiens
aaucaaggaaaggcucauuuaa

SEQ ID NO: 1597772 - RNA, 18 nt, Homo sapiens
aaucaaggccagugcuaa

SEQ ID NO: 1597773 - RNA, 21 nt, Homo sapiens
aaggaugguuuuaucuucccu

SEQ ID NO: 1597774 - RNA, 21 nt, Homo sapiens
aaggauuguacacgcugauga

SEQ ID NO: 1597775 - RNA, 18 nt, Homo sapiens
aaggauuuuaccaaagca

SEQ ID NO: 1597776 - RNA, 17 nt, Homo sapiens
aaggcaaaguuuacaga

SEQ ID NO: 1597777 - RNA, 19 nt, Homo sapiens
aaggcacccaucugucugc

SEQ ID NO: 1597778 - RNA, 18 nt, Homo sapiens
aaggcaggagaugcagca

SEQ ID NO: 1597779 - RNA, 22 nt, Homo sapiens
aaggcaggaggaucacuugagc

SEQ ID NO: 1597780 - RNA, 15 nt, Homo sapiens
aaggcaucgucaugc

SEQ ID NO: 1597781 - RNA, 14 nt, Homo sapiens
aaggccaacacaac

SEQ ID NO: 1597782 - RNA, 13 nt, Homo sapiens
aaggccuacccca

SEQ ID NO: 1597783 - RNA, 23 nt, Homo sapiens
aaggcucagacugggcacugggg

SEQ ID NO: 1597784 - RNA, 20 nt, Homo sapiens
aaggcuuuguauaaucccac

SEQ ID NO: 1597785 - RNA, 23 nt, Homo sapiens
aagggaaaacaaauauuucacuu

SEQ ID NO: 1597786 - RNA, 16 nt, Homo sapiens
aagggaaacugggaaa

SEQ ID NO: 1597787 - RNA, 16 nt, Homo sapiens
aagggaaagauaauaa

SEQ ID NO: 1597788 - RNA, 16 nt, Homo sapiens
aagggaaauuguuuau

SEQ ID NO: 1597789 - RNA, 17 nt, Homo sapiens
aagggaagagccuuuau

SEQ ID NO: 1597790 - RNA, 17 nt, Homo sapiens
aagggaauccugagaaa

SEQ ID NO: 1597791 - RNA, 19 nt, Homo sapiens
aagggacaccaagccuugg

SEQ ID NO: 1597792 - RNA, 12 nt, Homo sapiens
aagggacugagu

SEQ ID NO: 1597793 - RNA, 15 nt, Homo sapiens
aagggagaaaugcca

SEQ ID NO: 1597794 - RNA, 20 nt, Homo sapiens
aagggagaaguugagauuca

SEQ ID NO: 1597795 - RNA, 21 nt, Homo sapiens
aagggaggggcuguguuucca

SEQ ID NO: 1597796 - RNA, 16 nt, Homo sapiens
aagggagugucagccu

SEQ ID NO: 1597797 - RNA, 19 nt, Homo sapiens
aagggcaaggaguuuauua

SEQ ID NO: 1597798 - RNA, 21 nt, Homo sapiens
aagggccaggcuuacugagcu

SEQ ID NO: 1597799 - RNA, 13 nt, Homo sapiens
aagggccaugugg

SEQ ID NO: 1597800 - RNA, 13 nt, Homo sapiens
aaggggcuggggc

SEQ ID NO: 1597801 - RNA, 14 nt, Homo sapiens
aagggggaaaaagu

SEQ ID NO: 1597802 - RNA, 22 nt, Homo sapiens
aagggucacuggccucucccca

SEQ ID NO: 1597803 - RNA, 18 nt, Homo sapiens
aaggguggaaaaaugccc

SEQ ID NO: 1597804 - RNA, 17 nt, Homo sapiens
aaggucugcacuccuuu

SEQ ID NO: 1597805 - RNA, 16 nt, Homo sapiens
aaggugaaagugcagu

SEQ ID NO: 1597806 - RNA, 19 nt, Homo sapiens
aaggugugagacugggaag

SEQ ID NO: 1597807 - RNA, 14 nt, Homo sapiens
aagguucucugugc

SEQ ID NO: 1597808 - RNA, 23 nt, Homo sapiens
aagguucuugcuuucucucucau

SEQ ID NO: 1597809 - RNA, 21 nt, Homo sapiens
aagguuuuugucuaugaauau

SEQ ID NO: 1597810 - RNA, 16 nt, Homo sapiens
aaguaaauuaggcagu

SEQ ID NO: 1597811 - RNA, 15 nt, Homo sapiens
aaguaagcauuucca

SEQ ID NO: 1597812 - RNA, 16 nt, Homo sapiens
aaguaauucuucugcc

SEQ ID NO: 1597813 - RNA, 19 nt, Homo sapiens
aaguacaaacuucuccuau

SEQ ID NO: 1597814 - RNA, 19 nt, Homo sapiens
aaguacagaauuugaauua

SEQ ID NO: 1597815 - RNA, 17 nt, Homo sapiens
aaguacauuaaaacacu

SEQ ID NO: 1597816 - RNA, 15 nt, Homo sapiens
aaguacuacagcaaa

SEQ ID NO: 1597817 - RNA, 12 nt, Homo sapiens
aaguacucauac

SEQ ID NO: 1597818 - RNA, 18 nt, Homo sapiens
aaguagggacuucugucu

SEQ ID NO: 1597819 - RNA, 14 nt, Homo sapiens
aaguagucauggau

SEQ ID NO: 1597820 - RNA, 17 nt, Homo sapiens
aaguaugcacuuggccu

SEQ ID NO: 1597821 - RNA, 14 nt, Homo sapiens
aaguauuacaugau

SEQ ID NO: 1597822 - RNA, 22 nt, Homo sapiens
aaguauuuuuuaauccuaccuc

SEQ ID NO: 1597823 - RNA, 23 nt, Homo sapiens
aaguauuuuuuaauccuaccuca

SEQ ID NO: 1597824 - RNA, 22 nt, Homo sapiens
aagucaucucauuccacuguug

SEQ ID NO: 1597825 - RNA, 13 nt, Homo sapiens
aagucaugcaauc

SEQ ID NO: 1597826 - RNA, 19 nt, Homo sapiens
aagucuaacgcugaacuga

SEQ ID NO: 1597827 - RNA, 13 nt, Homo sapiens
aagucuaacuuug

SEQ ID NO: 1597828 - RNA, 18 nt, Homo sapiens
aagucucuauuuaaauuc

SEQ ID NO: 1597829 - RNA, 22 nt, Homo sapiens
aagucugguaauaaaugugacu

SEQ ID NO: 1597830 - RNA, 13 nt, Homo sapiens
aagugaaagcaag

SEQ ID NO: 1597831 - RNA, 23 nt, Homo sapiens
aagugaaggacauagagguauau

SEQ ID NO: 1597832 - RNA, 13 nt, Homo sapiens
aagugaaggagaa

SEQ ID NO: 1597833 - RNA, 21 nt, Homo sapiens
aagugagcugagauugcacca

SEQ ID NO: 1597834 - RNA, 18 nt, Homo sapiens
aagugaggaagaguuuau

SEQ ID NO: 1597835 - RNA, 15 nt, Homo sapiens
aagugaugacauauu

SEQ ID NO: 1597836 - RNA, 13 nt, Homo sapiens
aagugauuaucuc

SEQ ID NO: 1597837 - RNA, 16 nt, Homo sapiens
aagugccagcauucca

SEQ ID NO: 1597838 - RNA, 21 nt, Homo sapiens
aagugcccucucugaaccuca

SEQ ID NO: 1597839 - RNA, 21 nt, Homo sapiens
aagugcugggauuacaggugu

SEQ ID NO: 1597840 - RNA, 15 nt, Homo sapiens
aagugggacauucaa

SEQ ID NO: 1597841 - RNA, 20 nt, Homo sapiens
aagugggacauucaaaaaac

SEQ ID NO: 1597842 - RNA, 23 nt, Homo sapiens
aagugggauuugcauaaagugaa

SEQ ID NO: 1597843 - RNA, 17 nt, Homo sapiens
aagugggcgugagugga

SEQ ID NO: 1597844 - RNA, 18 nt, Homo sapiens
aagugguaaauacuguga

SEQ ID NO: 1597845 - RNA, 23 nt, Homo sapiens
aaguguguugaugaccacugagc

SEQ ID NO: 1597846 - RNA, 20 nt, Homo sapiens
aaguguucacaacagugaaa

SEQ ID NO: 1597847 - RNA, 14 nt, Homo sapiens
aaguguucauuuua

SEQ ID NO: 1597848 - RNA, 19 nt, Homo sapiens
aaguguucauuuuaaguaa

SEQ ID NO: 1597849 - RNA, 16 nt, Homo sapiens
aaguuaagauagcuuu

SEQ ID NO: 1597850 - RNA, 21 nt, Homo sapiens
aaguucaaccucuuacaauaa

SEQ ID NO: 1597851 - RNA, 21 nt, Homo sapiens
aaguucaaggccagccuggac

SEQ ID NO: 1597852 - RNA, 20 nt, Homo sapiens
aaguucagcaacuguuuaac

SEQ ID NO: 1597853 - RNA, 13 nt, Homo sapiens
aaguucagcacuu

SEQ ID NO: 1597854 - RNA, 17 nt, Homo sapiens
aaguuccuauaccuuac

SEQ ID NO: 1597855 - RNA, 14 nt, Homo sapiens
aaguugcuaauaca

SEQ ID NO: 1597856 - RNA, 20 nt, Homo sapiens
aaguugcugcugugaaucug

SEQ ID NO: 1597857 - RNA, 17 nt, Homo sapiens
aaguugugacagucacu

SEQ ID NO: 1597858 - RNA, 17 nt, Homo sapiens
aaguuucuggugccauu

SEQ ID NO: 1597859 - RNA, 13 nt, Homo sapiens
aaguuuguuauag

SEQ ID NO: 1597860 - RNA, 23 nt, Homo sapiens
aaguuuucagaaccucuucccca

SEQ ID NO: 1597861 - RNA, 21 nt, Homo sapiens
aaguuuuguaaaagaaaucau

SEQ ID NO: 1597862 - RNA, 20 nt, Homo sapiens
aaguuuuuuauuaugcauua

SEQ ID NO: 1597863 - RNA, 18 nt, Homo sapiens
aauaaaaaagcucuuuua

SEQ ID NO: 1597864 - RNA, 16 nt, Homo sapiens
aauaaaaacauugccu

SEQ ID NO: 1597865 - RNA, 16 nt, Homo sapiens
aauaaaaagaucacuu

SEQ ID NO: 1597866 - RNA, 20 nt, Homo sapiens
aauaaaaagucacaaugagu

SEQ ID NO: 1597867 - RNA, 18 nt, Homo sapiens
agacucuguaauugaaua

SEQ ID NO: 1597868 - RNA, 10 nt, Homo sapiens
agacugauga

SEQ ID NO: 1597869 - RNA, 16 nt, Homo sapiens
agacugggcugaggga

SEQ ID NO: 1597870 - RNA, 17 nt, Homo sapiens
agacuguugccacuuaa

SEQ ID NO: 1597871 - RNA, 12 nt, Homo sapiens
agacuuacugca

SEQ ID NO: 1597872 - RNA, 14 nt, Homo sapiens
agacuuacugcuca

SEQ ID NO: 1597873 - RNA, 21 nt, Homo sapiens
agacuucuuccucuagacuug

SEQ ID NO: 1597874 - RNA, 16 nt, Homo sapiens
agacuuggacuaugau

SEQ ID NO: 1597875 - RNA, 19 nt, Homo sapiens
agacuuucuucuagugcuu

SEQ ID NO: 1597876 - RNA, 20 nt, Homo sapiens
agacuuuguguucauuucau

SEQ ID NO: 1597877 - RNA, 17 nt, Homo sapiens
agagaaagagaacuacu

SEQ ID NO: 1597878 - RNA, 23 nt, Homo sapiens
agagaaagaggccagacauggug

SEQ ID NO: 1597879 - RNA, 13 nt, Homo sapiens
agagaaaguguga

SEQ ID NO: 1597880 - RNA, 14 nt, Homo sapiens
agagaaccaaaggg

SEQ ID NO: 1597881 - RNA, 20 nt, Homo sapiens
agagaagauagcagggcaug

SEQ ID NO: 1597882 - RNA, 21 nt, Homo sapiens
agagaagcaucauuuccccaa

SEQ ID NO: 1597883 - RNA, 22 nt, Homo sapiens
agagaagccaaacagcaagaag

SEQ ID NO: 1597884 - RNA, 16 nt, Homo sapiens
agagaaggcugugagc

SEQ ID NO: 1597885 - RNA, 17 nt, Homo sapiens
agagaaggggugcagag

SEQ ID NO: 1597886 - RNA, 17 nt, Homo sapiens
agagaaucaacauuucu

SEQ ID NO: 1597887 - RNA, 14 nt, Homo sapiens
agagaauguauuug

SEQ ID NO: 1597888 - RNA, 21 nt, Homo sapiens
agagaccugacccuucucuca

SEQ ID NO: 1597889 - RNA, 14 nt, Homo sapiens
agagaccugcucag

SEQ ID NO: 1597890 - RNA, 16 nt, Homo sapiens
agagagcaccacguga

SEQ ID NO: 1597891 - RNA, 15 nt, Homo sapiens
agagaggaguccuuu

SEQ ID NO: 1597892 - RNA, 18 nt, Homo sapiens
agagaggcucauccugua

SEQ ID NO: 1597893 - RNA, 19 nt, Homo sapiens
agagauagggaugucauag

SEQ ID NO: 1597894 - RNA, 15 nt, Homo sapiens
agagaugaaagaggg

SEQ ID NO: 1597895 - RNA, 20 nt, Homo sapiens
agagaugacuauuacuuuuc

SEQ ID NO: 1597896 - RNA, 18 nt, Homo sapiens
agagauugugguggugcu

SEQ ID NO: 1597897 - RNA, 19 nt, Homo sapiens
agagcaaaacuccgucuca

SEQ ID NO: 1597898 - RNA, 23 nt, Homo sapiens
agagcaaguccucacucuucaag

SEQ ID NO: 1597899 - RNA, 22 nt, Homo sapiens
agagcaggggcuccagcaccuu

SEQ ID NO: 1597900 - RNA, 19 nt, Homo sapiens
agagcuagaaccuagaagg

SEQ ID NO: 1597901 - RNA, 21 nt, Homo sapiens
agagcuagaugugucuuacca

SEQ ID NO: 1597902 - RNA, 14 nt, Homo sapiens
agagcuccauuucc

SEQ ID NO: 1597903 - RNA, 22 nt, Homo sapiens
agagcuggcgcucagcagcccu

SEQ ID NO: 1597904 - RNA, 13 nt, Homo sapiens
agaggaacagcac

SEQ ID NO: 1597905 - RNA, 16 nt, Homo sapiens
agaggaaguucagauc

SEQ ID NO: 1597906 - RNA, 13 nt, Homo sapiens
agaggacugagac

SEQ ID NO: 1597907 - RNA, 20 nt, Homo sapiens
agaggagccaccaguucuca

SEQ ID NO: 1597908 - RNA, 14 nt, Homo sapiens
agaggaguagcaug

SEQ ID NO: 1597909 - RNA, 15 nt, Homo sapiens
agaggaguagcauga

SEQ ID NO: 1597910 - RNA, 13 nt, Homo sapiens
agaggagugcagc

SEQ ID NO: 1597911 - RNA, 15 nt, Homo sapiens
agaggauacauuuaa

SEQ ID NO: 1597912 - RNA, 22 nt, Homo sapiens
agaggcaaugauuguuaauuua

SEQ ID NO: 1597913 - RNA, 20 nt, Homo sapiens
agaggcagcuucuagacaga

SEQ ID NO: 1597914 - RNA, 21 nt, Homo sapiens
agaggcauagaauacacauuu

SEQ ID NO: 1597915 - RNA, 16 nt, Homo sapiens
agaggcucuggacagc

SEQ ID NO: 1597916 - RNA, 17 nt, Homo sapiens
agaggcugccccucuca

SEQ ID NO: 1597917 - RNA, 15 nt, Homo sapiens
agagggaaaacagaa

SEQ ID NO: 1597918 - RNA, 18 nt, Homo sapiens
agaggggauucacaaggu

SEQ ID NO: 1597919 - RNA, 17 nt, Homo sapiens
agagggggucucagaaa

SEQ ID NO: 1597920 - RNA, 23 nt, Homo sapiens
agagggguggaguuuuaacugua

SEQ ID NO: 1597921 - RNA, 13 nt, Homo sapiens
agaggguacuuua

SEQ ID NO: 1597922 - RNA, 13 nt, Homo sapiens
agagguccaggcc

SEQ ID NO: 1597923 - RNA, 15 nt, Homo sapiens
agaggucucaucucc

SEQ ID NO: 1597924 - RNA, 13 nt, Homo sapiens
agaggucugagcc

SEQ ID NO: 1597925 - RNA, 16 nt, Homo sapiens
agagguggauccugua

SEQ ID NO: 1597926 - RNA, 20 nt, Homo sapiens
agaguaacacauaacauugu

SEQ ID NO: 1597927 - RNA, 16 nt, Homo sapiens
agagucccugccugga

SEQ ID NO: 1597928 - RNA, 15 nt, Homo sapiens
agagucuccaguuua

SEQ ID NO: 1597929 - RNA, 17 nt, Homo sapiens
agagucuuaaagcauuu

SEQ ID NO: 1597930 - RNA, 20 nt, Homo sapiens
agagugaccucggacagagc

SEQ ID NO: 1597931 - RNA, 19 nt, Homo sapiens
agagugagaccauguuuca

SEQ ID NO: 1597932 - RNA, 21 nt, Homo sapiens
agaguggccuggccaggagcu

SEQ ID NO: 1597933 - RNA, 21 nt, Homo sapiens
agagugggguagguugggaga

SEQ ID NO: 1597934 - RNA, 13 nt, Homo sapiens
agagugucuuucc

SEQ ID NO: 1597935 - RNA, 22 nt, Homo sapiens
agaguguuuggggguuccguga

SEQ ID NO: 1597936 - RNA, 20 nt, Homo sapiens
agaguuauucaaaugaaggu

SEQ ID NO: 1597937 - RNA, 16 nt, Homo sapiens
agaguugcuuaaugaa

SEQ ID NO: 1597938 - RNA, 23 nt, Homo sapiens
agauaaaaaaauuuuaauuccuu

SEQ ID NO: 1597939 - RNA, 17 nt, Homo sapiens
agauaagaaaugaucuu

SEQ ID NO: 1597940 - RNA, 13 nt, Homo sapiens
agauaauguugcu

SEQ ID NO: 1597941 - RNA, 14 nt, Homo sapiens
agauaauguugcuu

SEQ ID NO: 1597942 - RNA, 20 nt, Homo sapiens
agauaauugaauaaguaccu

SEQ ID NO: 1597943 - RNA, 16 nt, Homo sapiens
agauacauucacauuc

SEQ ID NO: 1597944 - RNA, 21 nt, Homo sapiens
agauacccuacgcuguccaga

SEQ ID NO: 1597945 - RNA, 23 nt, Homo sapiens
agauaggaaacugaagcauaaag

SEQ ID NO: 1597946 - RNA, 22 nt, Homo sapiens
agauagugccagguggcucagu

SEQ ID NO: 1597947 - RNA, 17 nt, Homo sapiens
agauaguuuucauuuua

SEQ ID NO: 1597948 - RNA, 19 nt, Homo sapiens
agauauaccuaauguuaaa

SEQ ID NO: 1597949 - RNA, 20 nt, Homo sapiens
agauauauguguauacauac

SEQ ID NO: 1597950 - RNA, 18 nt, Homo sapiens
agauauucagaaguauau

SEQ ID NO: 1597951 - RNA, 14 nt, Homo sapiens
agauauugauuacu

SEQ ID NO: 1597952 - RNA, 18 nt, Homo sapiens
agauauuuuaaacuuuug

SEQ ID NO: 1597953 - RNA, 13 nt, Homo sapiens
agaucacacauca

SEQ ID NO: 1597954 - RNA, 13 nt, Homo sapiens
agaucagugccua

SEQ ID NO: 1597955 - RNA, 19 nt, Homo sapiens
agauccccaacugcuccag

SEQ ID NO: 1597956 - RNA, 22 nt, Homo sapiens
agauccccuguguggucuccau

SEQ ID NO: 1597957 - RNA, 15 nt, Homo sapiens
agauccuuucucuca

SEQ ID NO: 1597958 - RNA, 16 nt, Homo sapiens
agauccuuucucucaa

SEQ ID NO: 1597959 - RNA, 20 nt, Homo sapiens
agaucgagaccauccuggcu

SEQ ID NO: 1597960 - RNA, 15 nt, Homo sapiens
agaucgcaccacugc

SEQ ID NO: 1597961 - RNA, 15 nt, Homo sapiens
agaucuacacauguu

SEQ ID NO: 1597962 - RNA, 18 nt, Homo sapiens
agaucucaucucaugaca

SEQ ID NO: 1597963 - RNA, 23 nt, Homo sapiens
agaucucccuucucaucucccca

SEQ ID NO: 1597964 - RNA, 18 nt, Homo sapiens
agaucuggucccuugcag

SEQ ID NO: 1597965 - RNA, 19 nt, Homo sapiens
agaugaaacaucauuucaa

SEQ ID NO: 1597966 - RNA, 13 nt, Homo sapiens
agaugaaugucag

SEQ ID NO: 1597967 - RNA, 14 nt, Homo sapiens
agaugacaaccucc

SEQ ID NO: 1597968 - RNA, 14 nt, Homo sapiens
agaugacaguauuu

SEQ ID NO: 1597969 - RNA, 23 nt, Homo sapiens
agaugacaucccuuugaccacau

SEQ ID NO: 1597970 - RNA, 14 nt, Homo sapiens
agaugccaaagggg

SEQ ID NO: 1597971 - RNA, 17 nt, Homo sapiens
agaugccucuuaggacu

SEQ ID NO: 1597972 - RNA, 22 nt, Homo sapiens
agaugcgugcccagcucuucac

SEQ ID NO: 1597973 - RNA, 21 nt, Homo sapiens
agaugcuagaaaaauguucuu

SEQ ID NO: 1597974 - RNA, 16 nt, Homo sapiens
agauggacuccagccu

SEQ ID NO: 1597975 - RNA, 12 nt, Homo sapiens
agauggccauau

SEQ ID NO: 1597976 - RNA, 18 nt, Homo sapiens
agauggcuuuuccuggac

SEQ ID NO: 1597977 - RNA, 17 nt, Homo sapiens
agaugggggaacuguga

SEQ ID NO: 1597978 - RNA, 15 nt, Homo sapiens
agaugguuucuagag

SEQ ID NO: 1597979 - RNA, 17 nt, Homo sapiens
agauguaaauagaugac

SEQ ID NO: 1597980 - RNA, 22 nt, Homo sapiens
agaugucauuuaguucagcauc

SEQ ID NO: 1597981 - RNA, 19 nt, Homo sapiens
agaugucuucugccuguua

SEQ ID NO: 1597982 - RNA, 21 nt, Homo sapiens
agaugucuucugccuguuaua

SEQ ID NO: 1597983 - RNA, 18 nt, Homo sapiens
agaugucuuuuauagugg

SEQ ID NO: 1597984 - RNA, 22 nt, Homo sapiens
agaugugaauuauugacacuga

SEQ ID NO: 1597985 - RNA, 20 nt, Homo sapiens
accauuuuaagucccuguca

SEQ ID NO: 1597986 - RNA, 16 nt, Homo sapiens
acccaaaacucaagca

SEQ ID NO: 1597987 - RNA, 14 nt, Homo sapiens
acccaaaaggcaga

SEQ ID NO: 1597988 - RNA, 17 nt, Homo sapiens
acccaaauguucaucaa

SEQ ID NO: 1597989 - RNA, 22 nt, Homo sapiens
acccaaccugacuuccucugcc

SEQ ID NO: 1597990 - RNA, 16 nt, Homo sapiens
acccaacuccacaggg

SEQ ID NO: 1597991 - RNA, 13 nt, Homo sapiens
acccaagccacaa

SEQ ID NO: 1597992 - RNA, 23 nt, Homo sapiens
acccaaggauucuguucugcaac

SEQ ID NO: 1597993 - RNA, 19 nt, Homo sapiens
acccaccuuugccacaaag

SEQ ID NO: 1597994 - RNA, 21 nt, Homo sapiens
acccagaaugagacauccagc

SEQ ID NO: 1597995 - RNA, 21 nt, Homo sapiens
acccagagaaaaggacuccuc

SEQ ID NO: 1597996 - RNA, 16 nt, Homo sapiens
acccagcuaugguucu

SEQ ID NO: 1597997 - RNA, 14 nt, Homo sapiens
acccaggaguccag

SEQ ID NO: 1597998 - RNA, 15 nt, Homo sapiens
acccaggcaggugca

SEQ ID NO: 1597999 - RNA, 20 nt, Homo sapiens
acccaggcuggagugcagug

SEQ ID NO: 1598000 - RNA, 14 nt, Homo sapiens
acccagggguccag

SEQ ID NO: 1598001 - RNA, 23 nt, Homo sapiens
agaagcaauaacuauuuuuccuc

SEQ ID NO: 1598002 - RNA, 15 nt, Homo sapiens
agaagcacauuuuca

SEQ ID NO: 1598003 - RNA, 18 nt, Homo sapiens
agaagcacuucugcugca

SEQ ID NO: 1598004 - RNA, 14 nt, Homo sapiens
agaagcagaccauu

SEQ ID NO: 1598005 - RNA, 16 nt, Homo sapiens
agaagccaacuaugau

SEQ ID NO: 1598006 - RNA, 21 nt, Homo sapiens
agaagccuccaagccugccuc

SEQ ID NO: 1598007 - RNA, 14 nt, Homo sapiens
agaaggaacaauaa

SEQ ID NO: 1598008 - RNA, 17 nt, Homo sapiens
agaaggcucacagauuu

SEQ ID NO: 1598009 - RNA, 19 nt, Homo sapiens
agaaggcucacagauuuaa

SEQ ID NO: 1598010 - RNA, 20 nt, Homo sapiens
agaagggaacccccaaauuu

SEQ ID NO: 1598011 - RNA, 22 nt, Homo sapiens
agaaggguuacaugguguaaau

SEQ ID NO: 1598012 - RNA, 14 nt, Homo sapiens
agaagguaacucuu

SEQ ID NO: 1598013 - RNA, 22 nt, Homo sapiens
agaaggucacuacugcauuuau

SEQ ID NO: 1598014 - RNA, 20 nt, Homo sapiens
agaagguuucuggagcagug

SEQ ID NO: 1598015 - RNA, 18 nt, Homo sapiens
agaaguagcuaguagcaa

SEQ ID NO: 1598016 - RNA, 18 nt, Homo sapiens
agaaguccuuauguuaag

SEQ ID NO: 1598017 - RNA, 15 nt, Homo sapiens
agaagugaguggugu

SEQ ID NO: 1598018 - RNA, 14 nt, Homo sapiens
agaaguuauuuucc

SEQ ID NO: 1598019 - RNA, 23 nt, Homo sapiens
agaaguugugcuaaaccaaguua

SEQ ID NO: 1598020 - RNA, 18 nt, Homo sapiens
agaaguuuuuuacuuugg

SEQ ID NO: 1598021 - RNA, 17 nt, Homo sapiens
agaauaaaggcaguuuu

SEQ ID NO: 1598022 - RNA, 14 nt, Homo sapiens
agaauaaauuccca

SEQ ID NO: 1598023 - RNA, 17 nt, Homo sapiens
agaauaaauucuaccuc

SEQ ID NO: 1598024 - RNA, 13 nt, Homo sapiens
agaauaccaauau

SEQ ID NO: 1598025 - RNA, 19 nt, Homo sapiens
agaauaccaccuaauccuu

SEQ ID NO: 1598026 - RNA, 18 nt, Homo sapiens
agaauauaaaaauaaagc

SEQ ID NO: 1598027 - RNA, 15 nt, Homo sapiens
agaauauacuagaau

SEQ ID NO: 1598028 - RNA, 13 nt, Homo sapiens
agaaucaaaugca

SEQ ID NO: 1598029 - RNA, 16 nt, Homo sapiens
agaaucacgauuucau

SEQ ID NO: 1598030 - RNA, 18 nt, Homo sapiens
agaaucguaauggguaua

SEQ ID NO: 1598031 - RNA, 15 nt, Homo sapiens
agaaugaauuuaucu

SEQ ID NO: 1598032 - RNA, 20 nt, Homo sapiens
agaaugcaagaguggacuga

SEQ ID NO: 1598033 - RNA, 19 nt, Homo sapiens
agaauguuacugccuuaau

SEQ ID NO: 1598034 - RNA, 21 nt, Homo sapiens
agaauguuauccaacuauuaa

SEQ ID NO: 1598035 - RNA, 19 nt, Homo sapiens
agaauguuccagacauucu

SEQ ID NO: 1598036 - RNA, 21 nt, Homo sapiens
agaauguuccagacauucucg

SEQ ID NO: 1598037 - RNA, 21 nt, Homo sapiens
agaauguuuucaaauguucuc

SEQ ID NO: 1598038 - RNA, 23 nt, Homo sapiens
agaauuaccauuuguuaauauca

SEQ ID NO: 1598039 - RNA, 14 nt, Homo sapiens
agaauuauacagua

SEQ ID NO: 1598040 - RNA, 14 nt, Homo sapiens
agaauucacugagu

SEQ ID NO: 1598041 - RNA, 15 nt, Homo sapiens
agaauuccaaagcaa

SEQ ID NO: 1598042 - RNA, 23 nt, Homo sapiens
agaauugcuccugcaugcaacua

SEQ ID NO: 1598043 - RNA, 14 nt, Homo sapiens
agaauuguauguca

SEQ ID NO: 1598044 - RNA, 13 nt, Homo sapiens
agaauuuccugua

SEQ ID NO: 1598045 - RNA, 16 nt, Homo sapiens
agaauuuccuguaaua

SEQ ID NO: 1598046 - RNA, 16 nt, Homo sapiens
agaauuuguguugaag

SEQ ID NO: 1598047 - RNA, 22 nt, Homo sapiens
agacaaagaugucuuaaccuca

SEQ ID NO: 1598048 - RNA, 13 nt, Homo sapiens
agacaagaacuau

SEQ ID NO: 1598049 - RNA, 19 nt, Homo sapiens
agacaaggaggaguuccac

SEQ ID NO: 1598050 - RNA, 13 nt, Homo sapiens
agacacaagguga

SEQ ID NO: 1598051 - RNA, 15 nt, Homo sapiens
agacacaaggugauu

SEQ ID NO: 1598052 - RNA, 20 nt, Homo sapiens
agacacaauuucauuuccag

SEQ ID NO: 1598053 - RNA, 14 nt, Homo sapiens
agacaccauucauu

SEQ ID NO: 1598054 - RNA, 17 nt, Homo sapiens
agacacuaaaugcagac

SEQ ID NO: 1598055 - RNA, 23 nt, Homo sapiens
agacacucccacuuggcaucauu

SEQ ID NO: 1598056 - RNA, 11 nt, Homo sapiens
agacacugagu

SEQ ID NO: 1598057 - RNA, 18 nt, Homo sapiens
agacacuucccugcauua

SEQ ID NO: 1598058 - RNA, 14 nt, Homo sapiens
agacagaaagcaga

SEQ ID NO: 1598059 - RNA, 22 nt, Homo sapiens
agacagaaagcagaacagugau

SEQ ID NO: 1598060 - RNA, 19 nt, Homo sapiens
agacagagaugaaaagaca

SEQ ID NO: 1598061 - RNA, 17 nt, Homo sapiens
agacagagggcaaugau

SEQ ID NO: 1598062 - RNA, 17 nt, Homo sapiens
agacagagucucacuuu

SEQ ID NO: 1598063 - RNA, 22 nt, Homo sapiens
agacagcacagccaaccuagcu

SEQ ID NO: 1598064 - RNA, 18 nt, Homo sapiens
agacaggaacccuugcau

SEQ ID NO: 1598065 - RNA, 20 nt, Homo sapiens
agacaggaacggcucugggg

SEQ ID NO: 1598066 - RNA, 21 nt, Homo sapiens
agacagucucacucuguugcc

SEQ ID NO: 1598067 - RNA, 15 nt, Homo sapiens
agacauaucacucaa

SEQ ID NO: 1598068 - RNA, 12 nt, Homo sapiens
agacaucugccu

SEQ ID NO: 1598069 - RNA, 16 nt, Homo sapiens
agacauuacaaugugu

SEQ ID NO: 1598070 - RNA, 13 nt, Homo sapiens
agacauuccacca

SEQ ID NO: 1598071 - RNA, 13 nt, Homo sapiens
agacauucucaca

SEQ ID NO: 1598072 - RNA, 18 nt, Homo sapiens
agacauuugcuaugagcu

SEQ ID NO: 1598073 - RNA, 14 nt, Homo sapiens
agaccaaaucucag

SEQ ID NO: 1598074 - RNA, 14 nt, Homo sapiens
agaccaaggcacug

SEQ ID NO: 1598075 - RNA, 22 nt, Homo sapiens
agaccagccaaggguccucacc

SEQ ID NO: 1598076 - RNA, 23 nt, Homo sapiens
agaccagccuggccaacauguca

SEQ ID NO: 1598077 - RNA, 20 nt, Homo sapiens
agaccauuggggcucccagc

SEQ ID NO: 1598078 - RNA, 15 nt, Homo sapiens
agaccauuuguauua

SEQ ID NO: 1598079 - RNA, 19 nt, Homo sapiens
agaccauuuguauuaccau

SEQ ID NO: 1598080 - RNA, 15 nt, Homo sapiens
agacccacaggucua

SEQ ID NO: 1598081 - RNA, 19 nt, Homo sapiens
agacccaguggacucuucc

SEQ ID NO: 1598082 - RNA, 15 nt, Homo sapiens
agaccccagucguga

SEQ ID NO: 1598083 - RNA, 15 nt, Homo sapiens
agacccccagcacuu

SEQ ID NO: 1598084 - RNA, 18 nt, Homo sapiens
agacccccugagccacag

SEQ ID NO: 1598085 - RNA, 14 nt, Homo sapiens
agacccgcccuccc

SEQ ID NO: 1598086 - RNA, 20 nt, Homo sapiens
agacccucauuccuucccag

SEQ ID NO: 1598087 - RNA, 16 nt, Homo sapiens
agacccugucucaaaa

SEQ ID NO: 1598088 - RNA, 14 nt, Homo sapiens
agaccucaagccau

SEQ ID NO: 1598089 - RNA, 16 nt, Homo sapiens
agaccugccagccacu

SEQ ID NO: 1598090 - RNA, 12 nt, Homo sapiens
agaccugcucag

SEQ ID NO: 1598091 - RNA, 20 nt, Homo sapiens
agaccuguguuacuaaaaaa

SEQ ID NO: 1598092 - RNA, 22 nt, Homo sapiens
agacggagcccuggcaugucaa

SEQ ID NO: 1598093 - RNA, 21 nt, Homo sapiens
agacgggcccuggugguggcu

SEQ ID NO: 1598094 - RNA, 21 nt, Homo sapiens
agacggggccucacuauguug

SEQ ID NO: 1598095 - RNA, 17 nt, Homo sapiens
agacgguguuuugccau

SEQ ID NO: 1598096 - RNA, 20 nt, Homo sapiens
agacgucuagauggguucuu

SEQ ID NO: 1598097 - RNA, 19 nt, Homo sapiens
agacgucucacucaaagac

SEQ ID NO: 1598098 - RNA, 13 nt, Homo sapiens
agacgucugccuu

SEQ ID NO: 1598099 - RNA, 20 nt, Homo sapiens
agacguggugggacuccagc

SEQ ID NO: 1598100 - RNA, 19 nt, Homo sapiens
agacuagauguaguauuuu

SEQ ID NO: 1598101 - RNA, 15 nt, Homo sapiens
agacuagauugccuu

SEQ ID NO: 1598102 - RNA, 20 nt, Homo sapiens
agacuauggccucgccuccc

SEQ ID NO: 1598103 - RNA, 19 nt, Homo sapiens
agacuauuuucuauuuucc

SEQ ID NO: 1598104 - RNA, 17 nt, Homo sapiens
agacuccaccucuacca

SEQ ID NO: 1598105 - RNA, 18 nt, Homo sapiens
agacucccuccauagcga

SEQ ID NO: 1598106 - RNA, 16 nt, Homo sapiens
agacucugccauuaaa

SEQ ID NO: 1598107 - RNA, 20 nt, Homo sapiens
agacucugccauuaaaacau

SEQ ID NO: 1598108 - RNA, 21 nt, Homo sapiens
acauuggagaugccauccucu

SEQ ID NO: 1598109 - RNA, 17 nt, Homo sapiens
acauuggagcugacugu

SEQ ID NO: 1598110 - RNA, 21 nt, Homo sapiens
acauugggcugaccgugucuc

SEQ ID NO: 1598111 - RNA, 22 nt, Homo sapiens
acauuggguggggcuccuggga

SEQ ID NO: 1598112 - RNA, 21 nt, Homo sapiens
acauuguauuaauaccaaagu

SEQ ID NO: 1598113 - RNA, 17 nt, Homo sapiens
acauugugagcucuggu

SEQ ID NO: 1598114 - RNA, 13 nt, Homo sapiens
acauugugcuugg

SEQ ID NO: 1598115 - RNA, 15 nt, Homo sapiens
acauuuaaauuccac

SEQ ID NO: 1598116 - RNA, 16 nt, Homo sapiens
acauuuaaauuccaca

SEQ ID NO: 1598117 - RNA, 17 nt, Homo sapiens
acauuuaaauuccacag

SEQ ID NO: 1598118 - RNA, 20 nt, Homo sapiens
acauuuacugaccauguacu

SEQ ID NO: 1598119 - RNA, 14 nt, Homo sapiens
acauuuacugugga

SEQ ID NO: 1598120 - RNA, 19 nt, Homo sapiens
acauuuagccaaucuuucu

SEQ ID NO: 1598121 - RNA, 21 nt, Homo sapiens
acauuucucuaacuccugcca

SEQ ID NO: 1598122 - RNA, 14 nt, Homo sapiens
acauuucucugagc

SEQ ID NO: 1598123 - RNA, 22 nt, Homo sapiens
acauuucuggacaguaccugau

SEQ ID NO: 1598124 - RNA, 13 nt, Homo sapiens
acauuugcaauua

SEQ ID NO: 1598125 - RNA, 21 nt, Homo sapiens
acauuuguuucccccacaguu

SEQ ID NO: 1598126 - RNA, 18 nt, Homo sapiens
acauuuuauuaagcuuuu

SEQ ID NO: 1598127 - RNA, 16 nt, Homo sapiens
acauuuucauugauga

SEQ ID NO: 1598128 - RNA, 18 nt, Homo sapiens
acauuuuuguagaccacu

SEQ ID NO: 1598129 - RNA, 23 nt, Homo sapiens
acauuuuuugggcagcaauuuaa

SEQ ID NO: 1598130 - RNA, 16 nt, Homo sapiens
accaaaaugacaucuu

SEQ ID NO: 1598131 - RNA, 19 nt, Homo sapiens
accaaacccagguucauga

SEQ ID NO: 1598132 - RNA, 15 nt, Homo sapiens
accaaagcaucaaua

SEQ ID NO: 1598133 - RNA, 19 nt, Homo sapiens
accaaauagcaauacaaac

SEQ ID NO: 1598134 - RNA, 14 nt, Homo sapiens
accaaaucucagua

SEQ ID NO: 1598135 - RNA, 12 nt, Homo sapiens
accaaauugcuu

SEQ ID NO: 1598136 - RNA, 12 nt, Homo sapiens
accaaccacagc

SEQ ID NO: 1598137 - RNA, 14 nt, Homo sapiens
accaagaacugaag

SEQ ID NO: 1598138 - RNA, 17 nt, Homo sapiens
accaagggaucugccau

SEQ ID NO: 1598139 - RNA, 13 nt, Homo sapiens
accaagguauaca

SEQ ID NO: 1598140 - RNA, 16 nt, Homo sapiens
accaagguauacaucu

SEQ ID NO: 1598141 - RNA, 13 nt, Homo sapiens
accaagugcaaua

SEQ ID NO: 1598142 - RNA, 14 nt, Homo sapiens
accaauacuacuga

SEQ ID NO: 1598143 - RNA, 18 nt, Homo sapiens
accaaucagcacucugua

SEQ ID NO: 1598144 - RNA, 18 nt, Homo sapiens
accaaugaaaacauguac

SEQ ID NO: 1598145 - RNA, 20 nt, Homo sapiens
accaaugugugaaguaugca

SEQ ID NO: 1598146 - RNA, 21 nt, Homo sapiens
accaaugugugaaguaugcac

SEQ ID NO: 1598147 - RNA, 22 nt, Homo sapiens
accaaugugugaaguaugcacu

SEQ ID NO: 1598148 - RNA, 12 nt, Homo sapiens
accaauguucua

SEQ ID NO: 1598149 - RNA, 23 nt, Homo sapiens
accaauuugguaaaaaugcugcu

SEQ ID NO: 1598150 - RNA, 22 nt, Homo sapiens
accacaaaggacccaaucccca

SEQ ID NO: 1598151 - RNA, 17 nt, Homo sapiens
accacacccagugggaa

SEQ ID NO: 1598152 - RNA, 17 nt, Homo sapiens
accacauccuccgucca

SEQ ID NO: 1598153 - RNA, 16 nt, Homo sapiens
accacauccugaaaag

SEQ ID NO: 1598154 - RNA, 16 nt, Homo sapiens
accacccuagucccuu

SEQ ID NO: 1598155 - RNA, 14 nt, Homo sapiens
accacgcccagcua

SEQ ID NO: 1598156 - RNA, 22 nt, Homo sapiens
accacgccucuugaccaggcug

SEQ ID NO: 1598157 - RNA, 15 nt, Homo sapiens
accacgguagugccu

SEQ ID NO: 1598158 - RNA, 21 nt, Homo sapiens
accacuacaugcagcccaugc

SEQ ID NO: 1598159 - RNA, 16 nt, Homo sapiens
accacuaccagccagc

SEQ ID NO: 1598160 - RNA, 20 nt, Homo sapiens
accacucgaggccugcaaac

SEQ ID NO: 1598161 - RNA, 14 nt, Homo sapiens
accacugggugaga

SEQ ID NO: 1598162 - RNA, 21 nt, Homo sapiens
accacuuaugcauagauauau

SEQ ID NO: 1598163 - RNA, 15 nt, Homo sapiens
accagaaaggugauu

SEQ ID NO: 1598164 - RNA, 16 nt, Homo sapiens
accagaacaguaugaa

SEQ ID NO: 1598165 - RNA, 21 nt, Homo sapiens
accagaacaguaugaauuuga

SEQ ID NO: 1598166 - RNA, 21 nt, Homo sapiens
accagagccuucaagugccaa

SEQ ID NO: 1598167 - RNA, 16 nt, Homo sapiens
accagagcgguaucuc

SEQ ID NO: 1598168 - RNA, 13 nt, Homo sapiens
accagagcugccg

SEQ ID NO: 1598169 - RNA, 18 nt, Homo sapiens
accagccaccccaaagcc

SEQ ID NO: 1598170 - RNA, 21 nt, Homo sapiens
accagccaccccaaagcccuc

SEQ ID NO: 1598171 - RNA, 18 nt, Homo sapiens
accagcccugaccccagu

SEQ ID NO: 1598172 - RNA, 17 nt, Homo sapiens
accagccuugcucucuu

SEQ ID NO: 1598173 - RNA, 9 nt, Homo sapiens
accagcuca

SEQ ID NO: 1598174 - RNA, 11 nt, Homo sapiens
accagcucaaa

SEQ ID NO: 1598175 - RNA, 18 nt, Homo sapiens
accagcucugaacuucca

SEQ ID NO: 1598176 - RNA, 22 nt, Homo sapiens
accaggaaggaaaaugugaaca

SEQ ID NO: 1598177 - RNA, 20 nt, Homo sapiens
accaggacucccuccucacc

SEQ ID NO: 1598178 - RNA, 16 nt, Homo sapiens
accaggccaaugucag

SEQ ID NO: 1598179 - RNA, 14 nt, Homo sapiens
accaggccgugccu

SEQ ID NO: 1598180 - RNA, 13 nt, Homo sapiens
accaggcuacaag

SEQ ID NO: 1598181 - RNA, 16 nt, Homo sapiens
accagggcaacucuug

SEQ ID NO: 1598182 - RNA, 19 nt, Homo sapiens
accagggcaccgcagccaa

SEQ ID NO: 1598183 - RNA, 16 nt, Homo sapiens
accagggcucuucuca

SEQ ID NO: 1598184 - RNA, 18 nt, Homo sapiens
accaggggccaaccucag

SEQ ID NO: 1598185 - RNA, 19 nt, Homo sapiens
accaggucucauaaugcau

SEQ ID NO: 1598186 - RNA, 22 nt, Homo sapiens
accagguugcuugugagggaug

SEQ ID NO: 1598187 - RNA, 12 nt, Homo sapiens
accagucccaug

SEQ ID NO: 1598188 - RNA, 18 nt, Homo sapiens
accaguuaauuuuuccaa

SEQ ID NO: 1598189 - RNA, 22 nt, Homo sapiens
accauaagcagccagacccaca

SEQ ID NO: 1598190 - RNA, 15 nt, Homo sapiens
accauacaauuucau

SEQ ID NO: 1598191 - RNA, 15 nt, Homo sapiens
accauagagacccau

SEQ ID NO: 1598192 - RNA, 19 nt, Homo sapiens
accauagggcaugauuaac

SEQ ID NO: 1598193 - RNA, 17 nt, Homo sapiens
accauauguccacuguu

SEQ ID NO: 1598194 - RNA, 14 nt, Homo sapiens
accaucguccuucc

SEQ ID NO: 1598195 - RNA, 17 nt, Homo sapiens
accaucuaugugaauau

SEQ ID NO: 1598196 - RNA, 21 nt, Homo sapiens
accaucuccagcuauuuacac

SEQ ID NO: 1598197 - RNA, 17 nt, Homo sapiens
accaucucuuuaccucc

SEQ ID NO: 1598198 - RNA, 13 nt, Homo sapiens
accaugagcucac

SEQ ID NO: 1598199 - RNA, 11 nt, Homo sapiens
accaugaucac

SEQ ID NO: 1598200 - RNA, 20 nt, Homo sapiens
accaugcaaauugugaaaua

SEQ ID NO: 1598201 - RNA, 15 nt, Homo sapiens
accaugcucucucac

SEQ ID NO: 1598202 - RNA, 14 nt, Homo sapiens
accaugcuucacaa

SEQ ID NO: 1598203 - RNA, 13 nt, Homo sapiens
accaugugcaaua

SEQ ID NO: 1598204 - RNA, 19 nt, Homo sapiens
accauguggcagaagggau

SEQ ID NO: 1598205 - RNA, 21 nt, Homo sapiens
accauguggcagaagggauaa

SEQ ID NO: 1598206 - RNA, 17 nt, Homo sapiens
accauucacagugcaag

SEQ ID NO: 1598207 - RNA, 21 nt, Homo sapiens
accauucuaccugaggccagg

SEQ ID NO: 1598208 - RNA, 15 nt, Homo sapiens
accauuguccccaag

SEQ ID NO: 1598209 - RNA, 18 nt, Homo sapiens
accauuucacccagacag

SEQ ID NO: 1598210 - RNA, 20 nt, Homo sapiens
accauuugcuuaaaccugga

SEQ ID NO: 1598211 - RNA, 15 nt, Homo sapiens
acaguaguugcaaug

SEQ ID NO: 1598212 - RNA, 22 nt, Homo sapiens
acaguauggcagcuuuccucaa

SEQ ID NO: 1598213 - RNA, 16 nt, Homo sapiens
acaguauuacaguguc

SEQ ID NO: 1598214 - RNA, 14 nt, Homo sapiens
acaguauuuuccca

SEQ ID NO: 1598215 - RNA, 19 nt, Homo sapiens
acagucaauggauccacaa

SEQ ID NO: 1598216 - RNA, 14 nt, Homo sapiens
acagucaccucaca

SEQ ID NO: 1598217 - RNA, 16 nt, Homo sapiens
acagucaccucacaaa

SEQ ID NO: 1598218 - RNA, 22 nt, Homo sapiens
acagucacugauguacaauuaa

SEQ ID NO: 1598219 - RNA, 13 nt, Homo sapiens
acagucacuggaa

SEQ ID NO: 1598220 - RNA, 16 nt, Homo sapiens
acaguccaagcccugg

SEQ ID NO: 1598221 - RNA, 18 nt, Homo sapiens
acaguccacaggggccac

SEQ ID NO: 1598222 - RNA, 18 nt, Homo sapiens
acagucuuccauuugcaa

SEQ ID NO: 1598223 - RNA, 17 nt, Homo sapiens
acagugaugaauguacu

SEQ ID NO: 1598224 - RNA, 12 nt, Homo sapiens
acagugaugauu

SEQ ID NO: 1598225 - RNA, 21 nt, Homo sapiens
acagugaugcugugcuaugaa

SEQ ID NO: 1598226 - RNA, 14 nt, Homo sapiens
acagugcaacacug

SEQ ID NO: 1598227 - RNA, 13 nt, Homo sapiens
acagugcaguuua

SEQ ID NO: 1598228 - RNA, 21 nt, Homo sapiens
acagugcucuuuucuccucac

SEQ ID NO: 1598229 - RNA, 22 nt, Homo sapiens
acaguggggaagagugacucuc

SEQ ID NO: 1598230 - RNA, 23 nt, Homo sapiens
acaguggggaagagugacucucc

SEQ ID NO: 1598231 - RNA, 20 nt, Homo sapiens
acaguguccuaccacucuaa

SEQ ID NO: 1598232 - RNA, 19 nt, Homo sapiens
acaguguuuuuauugcucg

SEQ ID NO: 1598233 - RNA, 22 nt, Homo sapiens
acaguuacacuugacagacaaa

SEQ ID NO: 1598234 - RNA, 19 nt, Homo sapiens
acaguuagaaacaccagcc

SEQ ID NO: 1598235 - RNA, 16 nt, Homo sapiens
acaguuaucacacuuu

SEQ ID NO: 1598236 - RNA, 16 nt, Homo sapiens
acaguucuacagaaaa

SEQ ID NO: 1598237 - RNA, 17 nt, Homo sapiens
acaguucuuggugacug

SEQ ID NO: 1598238 - RNA, 17 nt, Homo sapiens
acaguuggaacuuacau

SEQ ID NO: 1598239 - RNA, 16 nt, Homo sapiens
acaguuggcacuguaa

SEQ ID NO: 1598240 - RNA, 14 nt, Homo sapiens
acaguuuuaacugu

SEQ ID NO: 1598241 - RNA, 18 nt, Homo sapiens
acaguuuuaacuguggau

SEQ ID NO: 1598242 - RNA, 23 nt, Homo sapiens
acaguuuugcuuuaguacaauag

SEQ ID NO: 1598243 - RNA, 16 nt, Homo sapiens
acauaacggaaaguuu

SEQ ID NO: 1598244 - RNA, 12 nt, Homo sapiens
acauacaaauca

SEQ ID NO: 1598245 - RNA, 16 nt, Homo sapiens
acauaccuaccaguau

SEQ ID NO: 1598246 - RNA, 21 nt, Homo sapiens
acauacuaaugaaguauuaca

SEQ ID NO: 1598247 - RNA, 23 nt, Homo sapiens
acauagaaauggaaauuuugcua

SEQ ID NO: 1598248 - RNA, 20 nt, Homo sapiens
acauagaauuaacacaugau

SEQ ID NO: 1598249 - RNA, 15 nt, Homo sapiens
acauagacagaagaa

SEQ ID NO: 1598250 - RNA, 22 nt, Homo sapiens
acauagagcuuuuuaauagcac

SEQ ID NO: 1598251 - RNA, 12 nt, Homo sapiens
acauagcgagac

SEQ ID NO: 1598252 - RNA, 17 nt, Homo sapiens
acauaggaaaaugccau

SEQ ID NO: 1598253 - RNA, 21 nt, Homo sapiens
acauaggaaaaugccaugaaa

SEQ ID NO: 1598254 - RNA, 21 nt, Homo sapiens
acauagucuuuguuuacauga

SEQ ID NO: 1598255 - RNA, 17 nt, Homo sapiens
acauaguguauuuugca

SEQ ID NO: 1598256 - RNA, 21 nt, Homo sapiens
acauaguuuucuuccuuugaa

SEQ ID NO: 1598257 - RNA, 17 nt, Homo sapiens
acauaugaucugucugu

SEQ ID NO: 1598258 - RNA, 13 nt, Homo sapiens
acauauuaucuca

SEQ ID NO: 1598259 - RNA, 14 nt, Homo sapiens
acauauuaucucau

SEQ ID NO: 1598260 - RNA, 23 nt, Homo sapiens
acauauuggaauguacaugucaa

SEQ ID NO: 1598261 - RNA, 20 nt, Homo sapiens
acaucaaaacuaaccaucug

SEQ ID NO: 1598262 - RNA, 15 nt, Homo sapiens
acaucaacagauaaa

SEQ ID NO: 1598263 - RNA, 15 nt, Homo sapiens
acaucaacaggacuu

SEQ ID NO: 1598264 - RNA, 16 nt, Homo sapiens
acaucaacaggacuua

SEQ ID NO: 1598265 - RNA, 18 nt, Homo sapiens
acaucaacauuccaggga

SEQ ID NO: 1598266 - RNA, 19 nt, Homo sapiens
acaucagcaaacaggauca

SEQ ID NO: 1598267 - RNA, 18 nt, Homo sapiens
acaucagcuugcccuguu

SEQ ID NO: 1598268 - RNA, 17 nt, Homo sapiens
acauccaaaauaguuaa

SEQ ID NO: 1598269 - RNA, 20 nt, Homo sapiens
acauccguuuucauuguuca

SEQ ID NO: 1598270 - RNA, 19 nt, Homo sapiens
acauccucugcuaccaucu

SEQ ID NO: 1598271 - RNA, 22 nt, Homo sapiens
acauccucugcuaccaucucau

SEQ ID NO: 1598272 - RNA, 17 nt, Homo sapiens
acauccugagugugaug

SEQ ID NO: 1598273 - RNA, 14 nt, Homo sapiens
acauccugucagug

SEQ ID NO: 1598274 - RNA, 19 nt, Homo sapiens
acaucuaagccucuaacag

SEQ ID NO: 1598275 - RNA, 22 nt, Homo sapiens
acaucuauuuuggauuguauau

SEQ ID NO: 1598276 - RNA, 17 nt, Homo sapiens
acaucucaucaugucua

SEQ ID NO: 1598277 - RNA, 21 nt, Homo sapiens
acaucuccuugaucaugucuu

SEQ ID NO: 1598278 - RNA, 12 nt, Homo sapiens
acaucugcaaua

SEQ ID NO: 1598279 - RNA, 20 nt, Homo sapiens
acaucugcaauaugaauuca

SEQ ID NO: 1598280 - RNA, 10 nt, Homo sapiens
acaucugccu

SEQ ID NO: 1598281 - RNA, 13 nt, Homo sapiens
acaucugcuaaua

SEQ ID NO: 1598282 - RNA, 16 nt, Homo sapiens
acaucuuuauugaaau

SEQ ID NO: 1598283 - RNA, 18 nt, Homo sapiens
acaucuuucccuaaagaa

SEQ ID NO: 1598284 - RNA, 18 nt, Homo sapiens
acaugaagacaccaucuc

SEQ ID NO: 1598285 - RNA, 15 nt, Homo sapiens
acaugaauaaagccu

SEQ ID NO: 1598286 - RNA, 20 nt, Homo sapiens
acaugacauucuuagcugua

SEQ ID NO: 1598287 - RNA, 19 nt, Homo sapiens
acaugagaacaaacagauc

SEQ ID NO: 1598288 - RNA, 23 nt, Homo sapiens
acaugagggcugguguucauuaa

SEQ ID NO: 1598289 - RNA, 16 nt, Homo sapiens
acaugcacagucauac

SEQ ID NO: 1598290 - RNA, 17 nt, Homo sapiens
acaugcagcccaugccc

SEQ ID NO: 1598291 - RNA, 13 nt, Homo sapiens
acaugcauaacaa

SEQ ID NO: 1598292 - RNA, 16 nt, Homo sapiens
acaugcauugagcucu

SEQ ID NO: 1598293 - RNA, 18 nt, Homo sapiens
acaugccagccacuguga

SEQ ID NO: 1598294 - RNA, 17 nt, Homo sapiens
acaugcccuguguggcu

SEQ ID NO: 1598295 - RNA, 18 nt, Homo sapiens
acaugcccuguguggcug

SEQ ID NO: 1598296 - RNA, 21 nt, Homo sapiens
acaugcugaaaaauauagccu

SEQ ID NO: 1598297 - RNA, 19 nt, Homo sapiens
acaugcuuuagccauacac

SEQ ID NO: 1598298 - RNA, 14 nt, Homo sapiens
acauggaaagggag

SEQ ID NO: 1598299 - RNA, 14 nt, Homo sapiens
acauggaacuuuag

SEQ ID NO: 1598300 - RNA, 21 nt, Homo sapiens
acauggaaucgaaguguuuau

SEQ ID NO: 1598301 - RNA, 14 nt, Homo sapiens
acauggagcuguca

SEQ ID NO: 1598302 - RNA, 20 nt, Homo sapiens
acaugggagcaguccaugca

SEQ ID NO: 1598303 - RNA, 20 nt, Homo sapiens
acauggugaaaccccgucuc

SEQ ID NO: 1598304 - RNA, 14 nt, Homo sapiens
acauguaguugaau

SEQ ID NO: 1598305 - RNA, 12 nt, Homo sapiens
acauguaugugu

SEQ ID NO: 1598306 - RNA, 15 nt, Homo sapiens
acauguccuauuacu

SEQ ID NO: 1598307 - RNA, 11 nt, Homo sapiens
acaugugauug

SEQ ID NO: 1598308 - RNA, 15 nt, Homo sapiens
acaugugauugugau

SEQ ID NO: 1598309 - RNA, 13 nt, Homo sapiens
acaugugcuucau

SEQ ID NO: 1598310 - RNA, 21 nt, Homo sapiens
acauguuaacaccuaccucac

SEQ ID NO: 1598311 - RNA, 16 nt, Homo sapiens
acauuaacggugcuaa

SEQ ID NO: 1598312 - RNA, 18 nt, Homo sapiens
acauuaagaaaaacaaua

SEQ ID NO: 1598313 - RNA, 16 nt, Homo sapiens
aauccaaacuaaucca

SEQ ID NO: 1598314 - RNA, 16 nt, Homo sapiens
aauccaaugcacugau

SEQ ID NO: 1598315 - RNA, 12 nt, Homo sapiens
aauccacucugc

SEQ ID NO: 1598316 - RNA, 23 nt, Homo sapiens
aauccagucccaaugguccugac

SEQ ID NO: 1598317 - RNA, 19 nt, Homo sapiens
aauccaugcuucucaucug

SEQ ID NO: 1598318 - RNA, 21 nt, Homo sapiens
aauccauggccuuauuuggaa

SEQ ID NO: 1598319 - RNA, 20 nt, Homo sapiens
aauccauguaaauugcaaau

SEQ ID NO: 1598320 - RNA, 22 nt, Homo sapiens
aauccauuaucgagcagcauuu

SEQ ID NO: 1598321 - RNA, 14 nt, Homo sapiens
aauccauucauuca

SEQ ID NO: 1598322 - RNA, 21 nt, Homo sapiens
aauccauuuaaucaauauuua

SEQ ID NO: 1598323 - RNA, 21 nt, Homo sapiens
aauccgaaaacuuccauugua

SEQ ID NO: 1598324 - RNA, 20 nt, Homo sapiens
aauccuauuuaucagacucu

SEQ ID NO: 1598325 - RNA, 21 nt, Homo sapiens
aauccuggaaggacacaguga

SEQ ID NO: 1598326 - RNA, 20 nt, Homo sapiens
aauccuggaccaagcacaaa

SEQ ID NO: 1598327 - RNA, 12 nt, Homo sapiens
aauccuguacaa

SEQ ID NO: 1598328 - RNA, 12 nt, Homo sapiens
aauccuugagaa

SEQ ID NO: 1598329 - RNA, 16 nt, Homo sapiens
aauccuugagaaucuu

SEQ ID NO: 1598330 - RNA, 21 nt, Homo sapiens
aauccuugcuauuaagaauuu

SEQ ID NO: 1598331 - RNA, 23 nt, Homo sapiens
aauccuuuaaggucaacauuguu

SEQ ID NO: 1598332 - RNA, 22 nt, Homo sapiens
aaucgacuguauucgugcauuu

SEQ ID NO: 1598333 - RNA, 22 nt, Homo sapiens
aaucggcuggggacugcuaccu

SEQ ID NO: 1598334 - RNA, 14 nt, Homo sapiens
aaucuaaaaauccu

SEQ ID NO: 1598335 - RNA, 16 nt, Homo sapiens
aaucuacaccaaugaa

SEQ ID NO: 1598336 - RNA, 20 nt, Homo sapiens
aaucuacacgcauguaugca

SEQ ID NO: 1598337 - RNA, 14 nt, Homo sapiens
aaucuaccaagaac

SEQ ID NO: 1598338 - RNA, 20 nt, Homo sapiens
aaucuaccugcccuaaggga

SEQ ID NO: 1598339 - RNA, 14 nt, Homo sapiens
aaucuacuaauucc

SEQ ID NO: 1598340 - RNA, 16 nt, Homo sapiens
aaucucaucucaguga

SEQ ID NO: 1598341 - RNA, 20 nt, Homo sapiens
aaucuccuauuccuucacac

SEQ ID NO: 1598342 - RNA, 19 nt, Homo sapiens
aaucucuacugcuuuggau

SEQ ID NO: 1598343 - RNA, 23 nt, Homo sapiens
aaucucuuaugggauuacauguu

SEQ ID NO: 1598344 - RNA, 20 nt, Homo sapiens
aaucugaacugaccuugaau

SEQ ID NO: 1598345 - RNA, 18 nt, Homo sapiens
aaucuggcuuagugccac

SEQ ID NO: 1598346 - RNA, 20 nt, Homo sapiens
aaucuguccguucacaugug

SEQ ID NO: 1598347 - RNA, 17 nt, Homo sapiens
aaucuguguaacuguaa

SEQ ID NO: 1598348 - RNA, 15 nt, Homo sapiens
aaucuucuacuuuaa

SEQ ID NO: 1598349 - RNA, 20 nt, Homo sapiens
aaucuucugccuucucauga

SEQ ID NO: 1598350 - RNA, 15 nt, Homo sapiens
aaucuuuaccuguau

SEQ ID NO: 1598351 - RNA, 16 nt, Homo sapiens
aaucuuucaaaccagc

SEQ ID NO: 1598352 - RNA, 17 nt, Homo sapiens
aaucuuuuaaaucuuug

SEQ ID NO: 1598353 - RNA, 16 nt, Homo sapiens
aaugaaaauucuaacc

SEQ ID NO: 1598354 - RNA, 12 nt, Homo sapiens
aaugaaauccag

SEQ ID NO: 1598355 - RNA, 16 nt, Homo sapiens
aaugaaauugucaaaa

SEQ ID NO: 1598356 - RNA, 13 nt, Homo sapiens
aaugaacacuuaa

SEQ ID NO: 1598357 - RNA, 23 nt, Homo sapiens
aaugaaccaucuucguacaugaa

SEQ ID NO: 1598358 - RNA, 23 nt, Homo sapiens
aaugaagccaagugggauuugca

SEQ ID NO: 1598359 - RNA, 18 nt, Homo sapiens
aaugaaguauuacaugau

SEQ ID NO: 1598360 - RNA, 13 nt, Homo sapiens
aaugaagugcaau

SEQ ID NO: 1598361 - RNA, 20 nt, Homo sapiens
aaugaauuuuauaaucugca

SEQ ID NO: 1598362 - RNA, 18 nt, Homo sapiens
aaugacauugaacugaau

SEQ ID NO: 1598363 - RNA, 16 nt, Homo sapiens
aaugacgucacaagac

SEQ ID NO: 1598364 - RNA, 18 nt, Homo sapiens
aaugagcacccauuccaa

SEQ ID NO: 1598365 - RNA, 13 nt, Homo sapiens
aaugagcaccugg

SEQ ID NO: 1598366 - RNA, 22 nt, Homo sapiens
aaugaggggaagccauuuucca

SEQ ID NO: 1598367 - RNA, 15 nt, Homo sapiens
aaugagugugacuau

SEQ ID NO: 1598368 - RNA, 23 nt, Homo sapiens
aaugauacugcuuuucaccaaaa

SEQ ID NO: 1598369 - RNA, 13 nt, Homo sapiens
aaugaugaucuuc

SEQ ID NO: 1598370 - RNA, 15 nt, Homo sapiens
aaugaugaucuucag

SEQ ID NO: 1598371 - RNA, 15 nt, Homo sapiens
aaugaugcugucuga

SEQ ID NO: 1598372 - RNA, 16 nt, Homo sapiens
aaugaugcugucugaa

SEQ ID NO: 1598373 - RNA, 14 nt, Homo sapiens
aaugaugggucagu

SEQ ID NO: 1598374 - RNA, 23 nt, Homo sapiens
aaugauuucacagugugugguca

SEQ ID NO: 1598375 - RNA, 16 nt, Homo sapiens
aaugcaccaaucagca

SEQ ID NO: 1598376 - RNA, 20 nt, Homo sapiens
aaugcacccaucagcacucu

SEQ ID NO: 1598377 - RNA, 13 nt, Homo sapiens
aaugcacuuucua

SEQ ID NO: 1598378 - RNA, 23 nt, Homo sapiens
aaugcacuuuuaugaaguuuuua

SEQ ID NO: 1598379 - RNA, 18 nt, Homo sapiens
aaugcagcucaucacuug

SEQ ID NO: 1598380 - RNA, 21 nt, Homo sapiens
aaugcauccagcaguacaaua

SEQ ID NO: 1598381 - RNA, 14 nt, Homo sapiens
aaugcauuccagaa

SEQ ID NO: 1598382 - RNA, 15 nt, Homo sapiens
aaugcauugucaaua

SEQ ID NO: 1598383 - RNA, 10 nt, Homo sapiens
aaugccacag

SEQ ID NO: 1598384 - RNA, 17 nt, Homo sapiens
aaugccacauacuugca

SEQ ID NO: 1598385 - RNA, 12 nt, Homo sapiens
aaugccaugaaa

SEQ ID NO: 1598386 - RNA, 17 nt, Homo sapiens
aaugcuagcacaauauu

SEQ ID NO: 1598387 - RNA, 21 nt, Homo sapiens
aaugcuagcacaauauuccua

SEQ ID NO: 1598388 - RNA, 14 nt, Homo sapiens
aaugcuauguucug

SEQ ID NO: 1598389 - RNA, 13 nt, Homo sapiens
aaugcuuaauuca

SEQ ID NO: 1598390 - RNA, 14 nt, Homo sapiens
aaugcuuaauucaa

SEQ ID NO: 1598391 - RNA, 16 nt, Homo sapiens
aaugcuuagaaauuca

SEQ ID NO: 1598392 - RNA, 12 nt, Homo sapiens
aauggaaaccaa

SEQ ID NO: 1598393 - RNA, 20 nt, Homo sapiens
aauggaggcagagaccucca

SEQ ID NO: 1598394 - RNA, 17 nt, Homo sapiens
aauggaggccauugugu

SEQ ID NO: 1598395 - RNA, 20 nt, Homo sapiens
aauggcauaugguccuagac

SEQ ID NO: 1598396 - RNA, 21 nt, Homo sapiens
aauggcuugucuuugcuacuu

SEQ ID NO: 1598397 - RNA, 11 nt, Homo sapiens
aaugggagaaa

SEQ ID NO: 1598398 - RNA, 16 nt, Homo sapiens
aaugggcucaaacuuc

SEQ ID NO: 1598399 - RNA, 14 nt, Homo sapiens
aaugguagcauuua

SEQ ID NO: 1598400 - RNA, 20 nt, Homo sapiens
aaugguaggucaaguaauaa

SEQ ID NO: 1598401 - RNA, 20 nt, Homo sapiens
aaugguaguuuuacaguguu

SEQ ID NO: 1598402 - RNA, 15 nt, Homo sapiens
aauggucauccaaac

SEQ ID NO: 1598403 - RNA, 21 nt, Homo sapiens
aauggugcuuuaugugagaua

SEQ ID NO: 1598404 - RNA, 22 nt, Homo sapiens
aauggugcuuuaugugagauac

SEQ ID NO: 1598405 - RNA, 17 nt, Homo sapiens
aaugguguuguaugccu

SEQ ID NO: 1598406 - RNA, 20 nt, Homo sapiens
aaugguuaucuuugagacca

SEQ ID NO: 1598407 - RNA, 13 nt, Homo sapiens
aauguacaauuau

SEQ ID NO: 1598408 - RNA, 21 nt, Homo sapiens
aauguacaauuaugucucuug

SEQ ID NO: 1598409 - RNA, 16 nt, Homo sapiens
aauguacagacauauu

SEQ ID NO: 1598410 - RNA, 17 nt, Homo sapiens
aauguacaugucaauaa

SEQ ID NO: 1598411 - RNA, 13 nt, Homo sapiens
aauguagcacuua

SEQ ID NO: 1598412 - RNA, 20 nt, Homo sapiens
aauguagcuucagucauuaa

SEQ ID NO: 1598413 - RNA, 14 nt, Homo sapiens
aauguaggcuccuc

SEQ ID NO: 1598414 - RNA, 12 nt, Homo sapiens
aauguauaccag

SEQ ID NO: 1598415 - RNA, 15 nt, Homo sapiens
aauguaucauucagu

SEQ ID NO: 1598416 - RNA, 14 nt, Homo sapiens
aauguauguacaau

SEQ ID NO: 1598417 - RNA, 21 nt, Homo sapiens
aauguauucuuggcuaaagga

SEQ ID NO: 1598418 - RNA, 11 nt, Homo sapiens
aauguauuuaa

SEQ ID NO: 1598419 - RNA, 16 nt, Homo sapiens
aauguauuuuucuaca

SEQ ID NO: 1598420 - RNA, 19 nt, Homo sapiens
aaugucaguguuugggaaa

SEQ ID NO: 1598421 - RNA, 14 nt, Homo sapiens
aaugucgaugcuac

SEQ ID NO: 1598422 - RNA, 15 nt, Homo sapiens
aaugucugaaaugga

SEQ ID NO: 1598423 - RNA, 23 nt, Homo sapiens
aaugucuugcuguugacauauuu

SEQ ID NO: 1598424 - RNA, 12 nt, Homo sapiens
aaugugauugca

SEQ ID NO: 1598425 - RNA, 21 nt, Homo sapiens
aaugugcccaaagcucugaau

SEQ ID NO: 1598426 - RNA, 15 nt, Homo sapiens
aaugugcugaagcaa

SEQ ID NO: 1598427 - RNA, 17 nt, Homo sapiens
aauguggaagucaguac

SEQ ID NO: 1598428 - RNA, 20 nt, Homo sapiens
aauguggguauugaguguga

SEQ ID NO: 1598429 - RNA, 18 nt, Homo sapiens
aaugugguuuguacauau

SEQ ID NO: 1598430 - RNA, 19 nt, Homo sapiens
aaugugugaaguaugcacu

SEQ ID NO: 1598431 - RNA, 18 nt, Homo sapiens
acacauuucacugugaug

SEQ ID NO: 1598432 - RNA, 14 nt, Homo sapiens
acaccaaagcuauu

SEQ ID NO: 1598433 - RNA, 19 nt, Homo sapiens
acaccaaugaaaacaugua

SEQ ID NO: 1598434 - RNA, 22 nt, Homo sapiens
acaccaaugaaaacauguacua

SEQ ID NO: 1598435 - RNA, 13 nt, Homo sapiens
acaccaccaacau

SEQ ID NO: 1598436 - RNA, 20 nt, Homo sapiens
acaccacuaaccauccccaa

SEQ ID NO: 1598437 - RNA, 23 nt, Homo sapiens
acaccagccauacuuaucucucu

SEQ ID NO: 1598438 - RNA, 13 nt, Homo sapiens
acaccaugugcaa

SEQ ID NO: 1598439 - RNA, 16 nt, Homo sapiens
acaccauucauuccau

SEQ ID NO: 1598440 - RNA, 22 nt, Homo sapiens
acacccagugcgugaagaccaa

SEQ ID NO: 1598441 - RNA, 18 nt, Homo sapiens
acaccuagccagcuguca

SEQ ID NO: 1598442 - RNA, 16 nt, Homo sapiens
acaccucaguucccuu

SEQ ID NO: 1598443 - RNA, 16 nt, Homo sapiens
acaccuccuucuuccu

SEQ ID NO: 1598444 - RNA, 16 nt, Homo sapiens
acaccugccucugacc

SEQ ID NO: 1598445 - RNA, 17 nt, Homo sapiens
acaccuggaugucuggg

SEQ ID NO: 1598446 - RNA, 20 nt, Homo sapiens
acaccuggcccuugcaaucu

SEQ ID NO: 1598447 - RNA, 15 nt, Homo sapiens
acaccuguacauucu

SEQ ID NO: 1598448 - RNA, 15 nt, Homo sapiens
acacggacugugcau

SEQ ID NO: 1598449 - RNA, 20 nt, Homo sapiens
acacuaaccuggguucccuu

SEQ ID NO: 1598450 - RNA, 13 nt, Homo sapiens
acacuaaucacaa

SEQ ID NO: 1598451 - RNA, 17 nt, Homo sapiens
acacuacuccugaggau

SEQ ID NO: 1598452 - RNA, 20 nt, Homo sapiens
acacucccacuuggcaucau

SEQ ID NO: 1598453 - RNA, 16 nt, Homo sapiens
acacugaugcuuagau

SEQ ID NO: 1598454 - RNA, 23 nt, Homo sapiens
acacuggaauauaaaacagucau

SEQ ID NO: 1598455 - RNA, 13 nt, Homo sapiens
acacuggauccau

SEQ ID NO: 1598456 - RNA, 21 nt, Homo sapiens
acacuggcguuacugcuugac

SEQ ID NO: 1598457 - RNA, 23 nt, Homo sapiens
acacuggucugcuguuccagugg

SEQ ID NO: 1598458 - RNA, 19 nt, Homo sapiens
acacugucacuagucucac

SEQ ID NO: 1598459 - RNA, 21 nt, Homo sapiens
acacugugauuuaucuuucaa

SEQ ID NO: 1598460 - RNA, 13 nt, Homo sapiens
acacugugucauu

SEQ ID NO: 1598461 - RNA, 15 nt, Homo sapiens
acacuuaauagcaac

SEQ ID NO: 1598462 - RNA, 21 nt, Homo sapiens
acacuucguucgcagagcuuu

SEQ ID NO: 1598463 - RNA, 18 nt, Homo sapiens
acacuuguuguccaguug

SEQ ID NO: 1598464 - RNA, 20 nt, Homo sapiens
acacuuuuggaaccaugccu

SEQ ID NO: 1598465 - RNA, 14 nt, Homo sapiens
acagaaaaauugaa

SEQ ID NO: 1598466 - RNA, 15 nt, Homo sapiens
acagaaaacucccaa

SEQ ID NO: 1598467 - RNA, 14 nt, Homo sapiens
acagaaauaaagag

SEQ ID NO: 1598468 - RNA, 15 nt, Homo sapiens
acagaaauauccaug

SEQ ID NO: 1598469 - RNA, 13 nt, Homo sapiens
acagaaauuguau

SEQ ID NO: 1598470 - RNA, 12 nt, Homo sapiens
acagaacaaagu

SEQ ID NO: 1598471 - RNA, 19 nt, Homo sapiens
acagaaccaaaucguggca

SEQ ID NO: 1598472 - RNA, 14 nt, Homo sapiens
acagaaccacugag

SEQ ID NO: 1598473 - RNA, 23 nt, Homo sapiens
acagaaccuucaacccagugggu

SEQ ID NO: 1598474 - RNA, 12 nt, Homo sapiens
acagaacuccac

SEQ ID NO: 1598475 - RNA, 22 nt, Homo sapiens
acagaagcuuuagcaagugugc

SEQ ID NO: 1598476 - RNA, 18 nt, Homo sapiens
acagaaggcaaaguuuac

SEQ ID NO: 1598477 - RNA, 15 nt, Homo sapiens
acagaagggcaguga

SEQ ID NO: 1598478 - RNA, 13 nt, Homo sapiens
acagaagugacuu

SEQ ID NO: 1598479 - RNA, 20 nt, Homo sapiens
acagaaugcggccucugaga

SEQ ID NO: 1598480 - RNA, 14 nt, Homo sapiens
acagaauugcuccu

SEQ ID NO: 1598481 - RNA, 16 nt, Homo sapiens
acagacacacccagug

SEQ ID NO: 1598482 - RNA, 20 nt, Homo sapiens
acagacacucccacuuggca

SEQ ID NO: 1598483 - RNA, 20 nt, Homo sapiens
acagacacuggcauggauau

SEQ ID NO: 1598484 - RNA, 17 nt, Homo sapiens
acagacuccacccuccu

SEQ ID NO: 1598485 - RNA, 24 nt, Homo sapiens
acagacucugauucuacagugaug

SEQ ID NO: 1598486 - RNA, 12 nt, Homo sapiens
acagacuguggu

SEQ ID NO: 1598487 - RNA, 16 nt, Homo sapiens
acagacuugaaugcua

SEQ ID NO: 1598488 - RNA, 18 nt, Homo sapiens
acagagaggaggggacca

SEQ ID NO: 1598489 - RNA, 18 nt, Homo sapiens
acagagaugugcaugugg

SEQ ID NO: 1598490 - RNA, 18 nt, Homo sapiens
acagagcaggacugcaca

SEQ ID NO: 1598491 - RNA, 18 nt, Homo sapiens
acagagcuucccugacuc

SEQ ID NO: 1598492 - RNA, 16 nt, Homo sapiens
acagaggagaugccac

SEQ ID NO: 1598493 - RNA, 18 nt, Homo sapiens
acagaggagggacucaga

SEQ ID NO: 1598494 - RNA, 15 nt, Homo sapiens
acagaggagugcagc

SEQ ID NO: 1598495 - RNA, 14 nt, Homo sapiens
acagaggcauuuaa

SEQ ID NO: 1598496 - RNA, 13 nt, Homo sapiens
acagaggccuugg

SEQ ID NO: 1598497 - RNA, 18 nt, Homo sapiens
acagaggcuagaaagcau

SEQ ID NO: 1598498 - RNA, 18 nt, Homo sapiens
acagaggcugacuucaga

SEQ ID NO: 1598499 - RNA, 13 nt, Homo sapiens
acagagucuugcu

SEQ ID NO: 1598500 - RNA, 20 nt, Homo sapiens
acagagugagacuccaucuc

SEQ ID NO: 1598501 - RNA, 23 nt, Homo sapiens
acagagugagacuccaucucaaa

SEQ ID NO: 1598502 - RNA, 22 nt, Homo sapiens
acagaguugccaggcacuuuga

SEQ ID NO: 1598503 - RNA, 18 nt, Homo sapiens
acagauaucagugucucc

SEQ ID NO: 1598504 - RNA, 18 nt, Homo sapiens
acagaugaagacaucagg

SEQ ID NO: 1598505 - RNA, 23 nt, Homo sapiens
acagaugggcaaacccuggugcu

SEQ ID NO: 1598506 - RNA, 17 nt, Homo sapiens
acagcaaggauggagcu

SEQ ID NO: 1598507 - RNA, 20 nt, Homo sapiens
acagcaagggugaugggaaa

SEQ ID NO: 1598508 - RNA, 20 nt, Homo sapiens
acagcaaguacgcaagaaau

SEQ ID NO: 1598509 - RNA, 15 nt, Homo sapiens
acagcagacuaguua

SEQ ID NO: 1598510 - RNA, 21 nt, Homo sapiens
acagcagcagcaaacaaauaa

SEQ ID NO: 1598511 - RNA, 14 nt, Homo sapiens
acagcaucagcuca

SEQ ID NO: 1598512 - RNA, 19 nt, Homo sapiens
acagcaucccuucccacau

SEQ ID NO: 1598513 - RNA, 22 nt, Homo sapiens
acagcaugggccucaccuccuc

SEQ ID NO: 1598514 - RNA, 15 nt, Homo sapiens
acagcauuaacuguc

SEQ ID NO: 1598515 - RNA, 12 nt, Homo sapiens
acagccaagggg

SEQ ID NO: 1598516 - RNA, 20 nt, Homo sapiens
acagccagacuggcacaguu

SEQ ID NO: 1598517 - RNA, 12 nt, Homo sapiens
acagccagugac

SEQ ID NO: 1598518 - RNA, 21 nt, Homo sapiens
acagccuauaaccagacacau

SEQ ID NO: 1598519 - RNA, 17 nt, Homo sapiens
acagcgcuaaggauggu

SEQ ID NO: 1598520 - RNA, 22 nt, Homo sapiens
acagcuacuuuaaccuaugaua

SEQ ID NO: 1598521 - RNA, 22 nt, Homo sapiens
acagcuagaaagcugcacuggu

SEQ ID NO: 1598522 - RNA, 11 nt, Homo sapiens
acagcucugca

SEQ ID NO: 1598523 - RNA, 17 nt, Homo sapiens
acagcugaaagauugau

SEQ ID NO: 1598524 - RNA, 14 nt, Homo sapiens
acagcugcucuuac

SEQ ID NO: 1598525 - RNA, 18 nt, Homo sapiens
acaggaaaaaaacuuuua

SEQ ID NO: 1598526 - RNA, 16 nt, Homo sapiens
acaggaaauugacuua

SEQ ID NO: 1598527 - RNA, 12 nt, Homo sapiens
acaggagccuag

SEQ ID NO: 1598528 - RNA, 21 nt, Homo sapiens
acaggaggaagacaggcaaau

SEQ ID NO: 1598529 - RNA, 20 nt, Homo sapiens
acaggaggcagacaaugacc

SEQ ID NO: 1598530 - RNA, 23 nt, Homo sapiens
acaggaguguccucuucccucuc

SEQ ID NO: 1598531 - RNA, 18 nt, Homo sapiens
cugaaggcagucauauca

SEQ ID NO: 1598532 - RNA, 15 nt, Homo sapiens
cugaaggcauaugca

SEQ ID NO: 1598533 - RNA, 12 nt, Homo sapiens
cugaaggcuaaa

SEQ ID NO: 1598534 - RNA, 18 nt, Homo sapiens
cugaaguggaaugacuga

SEQ ID NO: 1598535 - RNA, 18 nt, Homo sapiens
cugaauacacaguauuca

SEQ ID NO: 1598536 - RNA, 23 nt, Homo sapiens
cugaauagcagaagguugcaccu

SEQ ID NO: 1598537 - RNA, 14 nt, Homo sapiens
cugaaugaucuauu

SEQ ID NO: 1598538 - RNA, 14 nt, Homo sapiens
cugaauuuaauucu

SEQ ID NO: 1598539 - RNA, 12 nt, Homo sapiens
cugacaaagaca

SEQ ID NO: 1598540 - RNA, 19 nt, Homo sapiens
cugacacaccaggcgcuaa

SEQ ID NO: 1598541 - RNA, 22 nt, Homo sapiens
cugacagggacaugcccugugu

SEQ ID NO: 1598542 - RNA, 17 nt, Homo sapiens
cugacauucacugagug

SEQ ID NO: 1598543 - RNA, 14 nt, Homo sapiens
cugaccaacaugga

SEQ ID NO: 1598544 - RNA, 17 nt, Homo sapiens
cugaccaagauacuuaa

SEQ ID NO: 1598545 - RNA, 18 nt, Homo sapiens
cugacccugcuccuagca

SEQ ID NO: 1598546 - RNA, 14 nt, Homo sapiens
cucauuuguuguuu

SEQ ID NO: 1598547 - RNA, 14 nt, Homo sapiens
cucauuuuaacuca

SEQ ID NO: 1598548 - RNA, 17 nt, Homo sapiens
cucauuuuaguugccua

SEQ ID NO: 1598549 - RNA, 17 nt, Homo sapiens
cucauuuuuguuuucau

SEQ ID NO: 1598550 - RNA, 12 nt, Homo sapiens
cuccaaauggaa

SEQ ID NO: 1598551 - RNA, 18 nt, Homo sapiens
cuccaaguaguccaccuu

SEQ ID NO: 1598552 - RNA, 20 nt, Homo sapiens
cuccaaugacugagcagcau

SEQ ID NO: 1598553 - RNA, 12 nt, Homo sapiens
cuccacaccucu

SEQ ID NO: 1598554 - RNA, 20 nt, Homo sapiens
cuccacaccucuaaacaucu

SEQ ID NO: 1598555 - RNA, 12 nt, Homo sapiens
cuccacaucaac

SEQ ID NO: 1598556 - RNA, 13 nt, Homo sapiens
cuccacaucugcc

SEQ ID NO: 1598557 - RNA, 14 nt, Homo sapiens
cuccaccacauccu

SEQ ID NO: 1598558 - RNA, 14 nt, Homo sapiens
cuccaccccacaga

SEQ ID NO: 1598559 - RNA, 17 nt, Homo sapiens
cuccaccucuaccaaaa

SEQ ID NO: 1598560 - RNA, 23 nt, Homo sapiens
cuacccuuccagugcccuaggcc

SEQ ID NO: 1598561 - RNA, 16 nt, Homo sapiens
cuaccucaaacuucca

SEQ ID NO: 1598562 - RNA, 10 nt, Homo sapiens
cuaccucagc

SEQ ID NO: 1598563 - RNA, 12 nt, Homo sapiens
cuaccucuagua

SEQ ID NO: 1598564 - RNA, 13 nt, Homo sapiens
cuaccucuaguaa

SEQ ID NO: 1598565 - RNA, 16 nt, Homo sapiens
cuaccucuaguaaauu

SEQ ID NO: 1598566 - RNA, 14 nt, Homo sapiens
cuacgcacuggaca

SEQ ID NO: 1598567 - RNA, 16 nt, Homo sapiens
cuacgguuaugaaggc

SEQ ID NO: 1598568 - RNA, 20 nt, Homo sapiens
cuacucaggaggcugagaca

SEQ ID NO: 1598569 - RNA, 18 nt, Homo sapiens
cuacucucagguuuuuga

SEQ ID NO: 1598570 - RNA, 12 nt, Homo sapiens
cuacucuuugau

SEQ ID NO: 1598571 - RNA, 18 nt, Homo sapiens
cuacucuuugccaauccc

SEQ ID NO: 1598572 - RNA, 15 nt, Homo sapiens
cgugcagaaccagca

SEQ ID NO: 1598573 - RNA, 15 nt, Homo sapiens
cgugccaccaugacu

SEQ ID NO: 1598574 - RNA, 13 nt, Homo sapiens
cgugccugcuacg

SEQ ID NO: 1598575 - RNA, 13 nt, Homo sapiens
cgugcuaccugca

SEQ ID NO: 1598576 - RNA, 22 nt, Homo sapiens
cgugcucugugggucuccccca

SEQ ID NO: 1598577 - RNA, 19 nt, Homo sapiens
cgugguaggacuguagaaa

SEQ ID NO: 1598578 - RNA, 16 nt, Homo sapiens
cgugguagucacuugu

SEQ ID NO: 1598579 - RNA, 20 nt, Homo sapiens
cgugugagugagggagacag

SEQ ID NO: 1598580 - RNA, 18 nt, Homo sapiens
cguguuucugacucugag

SEQ ID NO: 1598581 - RNA, 18 nt, Homo sapiens
cguuagggugaagcauua

SEQ ID NO: 1598582 - RNA, 18 nt, Homo sapiens
cguugaauugaugaugca

SEQ ID NO: 1598583 - RNA, 16 nt, Homo sapiens
ccacuacaucugggac

SEQ ID NO: 1598584 - RNA, 21 nt, Homo sapiens
ccacuaccagccagccucaga

SEQ ID NO: 1598585 - RNA, 20 nt, Homo sapiens
ccacuagaagcaacuaggaa

SEQ ID NO: 1598586 - RNA, 16 nt, Homo sapiens
ccacucacuuugcaau

SEQ ID NO: 1598587 - RNA, 18 nt, Homo sapiens
ccacucaggggucauuca

SEQ ID NO: 1598588 - RNA, 19 nt, Homo sapiens
ccacucaggggucauucau

SEQ ID NO: 1598589 - RNA, 19 nt, Homo sapiens
ccaaagcccaaagugguau

SEQ ID NO: 1598590 - RNA, 16 nt, Homo sapiens
ccaaagcucagacuug

SEQ ID NO: 1598591 - RNA, 17 nt, Homo sapiens
ccaaagcuuucauguaa

SEQ ID NO: 1598592 - RNA, 21 nt, Homo sapiens
ccaaaggaagaacuggauaaa

SEQ ID NO: 1598593 - RNA, 22 nt, Homo sapiens
ccaaaggaauuugcauccagca

SEQ ID NO: 1598594 - RNA, 14 nt, Homo sapiens
ccaaaggagaagag

SEQ ID NO: 1598595 - RNA, 14 nt, Homo sapiens
caggcaaucuugcc

SEQ ID NO: 1598596 - RNA, 15 nt, Homo sapiens
caggcacacacugug

SEQ ID NO: 1598597 - RNA, 23 nt, Homo sapiens
caggcacgaacccaccugcugag

SEQ ID NO: 1598598 - RNA, 17 nt, Homo sapiens
caggcagccacgucuca

SEQ ID NO: 1598599 - RNA, 14 nt, Homo sapiens
caggccaaugucag

SEQ ID NO: 1598600 - RNA, 18 nt, Homo sapiens
caggccuuaccgcucugu

SEQ ID NO: 1598601 - RNA, 17 nt, Homo sapiens
caggcgcaguggcucau

SEQ ID NO: 1598602 - RNA, 17 nt, Homo sapiens
caggcuacuguucuuga

SEQ ID NO: 1598603 - RNA, 19 nt, Homo sapiens
caggcuagagugcaauggc

SEQ ID NO: 1598604 - RNA, 15 nt, Homo sapiens
caggcucaugccauc

SEQ ID NO: 1598605 - RNA, 16 nt, Homo sapiens
caggcuccaggccuca

SEQ ID NO: 1598606 - RNA, 20 nt, Homo sapiens
caggcuggagugcaguggca

SEQ ID NO: 1598607 - RNA, 18 nt, Homo sapiens
caggcugggcagggacaa

SEQ ID NO: 1598608 - RNA, 19 nt, Homo sapiens
caggcugggcaucauagca

SEQ ID NO: 1598609 - RNA, 14 nt, Homo sapiens
caggcugggccaug

SEQ ID NO: 1598610 - RNA, 14 nt, Homo sapiens
caggcuuucucugg

SEQ ID NO: 1598611 - RNA, 19 nt, Homo sapiens
cagggaacaagcccaaagc

SEQ ID NO: 1598612 - RNA, 13 nt, Homo sapiens
cagggacaccagc

SEQ ID NO: 1598613 - RNA, 19 nt, Homo sapiens
cagggacacuaucacucau

SEQ ID NO: 1598614 - RNA, 19 nt, Homo sapiens
cagggagaaggcauugcuu

SEQ ID NO: 1598615 - RNA, 24 nt, Homo sapiens
cagggagaaguagcuaguagcaau

SEQ ID NO: 1598616 - RNA, 23 nt, Homo sapiens
cagggagcaguugcccucaggcc

SEQ ID NO: 1598617 - RNA, 18 nt, Homo sapiens
cagggagugcagacaccu

SEQ ID NO: 1598618 - RNA, 18 nt, Homo sapiens
cagggauucuuccugcuu

SEQ ID NO: 1598619 - RNA, 16 nt, Homo sapiens
cagggcaacuguagaa

SEQ ID NO: 1598620 - RNA, 14 nt, Homo sapiens
cagggcacauguga

SEQ ID NO: 1598621 - RNA, 18 nt, Homo sapiens
cagggcauucuguuggcc

SEQ ID NO: 1598622 - RNA, 16 nt, Homo sapiens
cagggccccccaacug

SEQ ID NO: 1598623 - RNA, 20 nt, Homo sapiens
cagggcuccaggagccucau

SEQ ID NO: 1598624 - RNA, 17 nt, Homo sapiens
cagggcugcgucugcaa

SEQ ID NO: 1598625 - RNA, 13 nt, Homo sapiens
cagggcugcuccc

SEQ ID NO: 1598626 - RNA, 23 nt, Homo sapiens
caggggcaucuuccuggauacca

SEQ ID NO: 1598627 - RNA, 23 nt, Homo sapiens
caggggccaaccucaggcuccua

SEQ ID NO: 1598628 - RNA, 18 nt, Homo sapiens
caggggggagaaguucuu

SEQ ID NO: 1598629 - RNA, 16 nt, Homo sapiens
cagggguacauucuag

SEQ ID NO: 1598630 - RNA, 19 nt, Homo sapiens
caggggugcuccugugcuc

SEQ ID NO: 1598631 - RNA, 20 nt, Homo sapiens
caggggugcuccugugcuca

SEQ ID NO: 1598632 - RNA, 20 nt, Homo sapiens
caggguaccucaagccccau

SEQ ID NO: 1598633 - RNA, 15 nt, Homo sapiens
caggguucucuuagc

SEQ ID NO: 1598634 - RNA, 23 nt, Homo sapiens
caggguuuacccagugggacaga

SEQ ID NO: 1598635 - RNA, 16 nt, Homo sapiens
caggguuucuccaugu

SEQ ID NO: 1598636 - RNA, 19 nt, Homo sapiens
cagguaaagggcaaauaau

SEQ ID NO: 1598637 - RNA, 16 nt, Homo sapiens
cagguaauacaaacua

SEQ ID NO: 1598638 - RNA, 17 nt, Homo sapiens
cagguaccucuuucagg

SEQ ID NO: 1598639 - RNA, 17 nt, Homo sapiens
caggucaaaaaggccaa

SEQ ID NO: 1598640 - RNA, 20 nt, Homo sapiens
caggucagcgcgguccugac

SEQ ID NO: 1598641 - RNA, 17 nt, Homo sapiens
caggugaacugggagca

SEQ ID NO: 1598642 - RNA, 16 nt, Homo sapiens
caggugacaguggcug

SEQ ID NO: 1598643 - RNA, 17 nt, Homo sapiens
caggugauccaccugcc

SEQ ID NO: 1598644 - RNA, 16 nt, Homo sapiens
caggugccuucccaga

SEQ ID NO: 1598645 - RNA, 14 nt, Homo sapiens
caggugccuuucaa

SEQ ID NO: 1598646 - RNA, 16 nt, Homo sapiens
cagguggacaaaguca

SEQ ID NO: 1598647 - RNA, 14 nt, Homo sapiens
cagguggugcaaau

SEQ ID NO: 1598648 - RNA, 20 nt, Homo sapiens
cagguguaagccaccgugcc

SEQ ID NO: 1598649 - RNA, 11 nt, Homo sapiens
caggugucaaa

SEQ ID NO: 1598650 - RNA, 20 nt, Homo sapiens
caggugugagccaccgugcc

SEQ ID NO: 1598651 - RNA, 17 nt, Homo sapiens
cagguuauaacaguguu

SEQ ID NO: 1598652 - RNA, 22 nt, Homo sapiens
cagguucccacuuaaaaauuaa

SEQ ID NO: 1598653 - RNA, 19 nt, Homo sapiens
cagguuuguuuucagcacu

SEQ ID NO: 1598654 - RNA, 23 nt, Homo sapiens
caguaaacuuucucugcaaagac

SEQ ID NO: 1598655 - RNA, 18 nt, Homo sapiens
caguaaagaguacacuca

SEQ ID NO: 1598656 - RNA, 19 nt, Homo sapiens
caguacacaggggcuugac

SEQ ID NO: 1598657 - RNA, 19 nt, Homo sapiens
caguacauuguauucuguu

SEQ ID NO: 1598658 - RNA, 12 nt, Homo sapiens
caguacauuuaa

SEQ ID NO: 1598659 - RNA, 23 nt, Homo sapiens
caguacccacucuggagcauuuc

SEQ ID NO: 1598660 - RNA, 18 nt, Homo sapiens
caguaccgacuaagcaaa

SEQ ID NO: 1598661 - RNA, 23 nt, Homo sapiens
caguaccgcaucucccugcaguu

SEQ ID NO: 1598662 - RNA, 16 nt, Homo sapiens
caguaccuaaguaaga

SEQ ID NO: 1598663 - RNA, 16 nt, Homo sapiens
caguaccuagcuggcu

SEQ ID NO: 1598664 - RNA, 21 nt, Homo sapiens
caguacuguugguuaaaugac

SEQ ID NO: 1598665 - RNA, 18 nt, Homo sapiens
caguagaacugucuguga

SEQ ID NO: 1598666 - RNA, 15 nt, Homo sapiens
caguagagcucuacu

SEQ ID NO: 1598667 - RNA, 18 nt, Homo sapiens
caguagcugcccuuccug

SEQ ID NO: 1598668 - RNA, 13 nt, Homo sapiens
caguagcuuccca

SEQ ID NO: 1598669 - RNA, 20 nt, Homo sapiens
caguauccaggcuuuguaca

SEQ ID NO: 1598670 - RNA, 17 nt, Homo sapiens
caguaucucuuacauca

SEQ ID NO: 1598671 - RNA, 19 nt, Homo sapiens
cagucaaaauguuugauau

SEQ ID NO: 1598672 - RNA, 21 nt, Homo sapiens
cagucagaguccagugcucug

SEQ ID NO: 1598673 - RNA, 14 nt, Homo sapiens
caguccacugagca

SEQ ID NO: 1598674 - RNA, 22 nt, Homo sapiens
caguccacugagcaagcaaggg

SEQ ID NO: 1598675 - RNA, 15 nt, Homo sapiens
caguccaugcuccag

SEQ ID NO: 1598676 - RNA, 14 nt, Homo sapiens
caguccugcugacu

SEQ ID NO: 1598677 - RNA, 17 nt, Homo sapiens
cagucggccccaucucu

SEQ ID NO: 1598678 - RNA, 18 nt, Homo sapiens
cagucuaaggucucaugc

SEQ ID NO: 1598679 - RNA, 15 nt, Homo sapiens
cagucuacgaagcca

SEQ ID NO: 1598680 - RNA, 19 nt, Homo sapiens
cagucuacugacuuuuccc

SEQ ID NO: 1598681 - RNA, 15 nt, Homo sapiens
cagucuagugcaaaa

SEQ ID NO: 1598682 - RNA, 19 nt, Homo sapiens
cagucucacucuguugccc

SEQ ID NO: 1598683 - RNA, 13 nt, Homo sapiens
cagucucacuuug

SEQ ID NO: 1598684 - RNA, 17 nt, Homo sapiens
cagucuccucacucugu

SEQ ID NO: 1598685 - RNA, 22 nt, Homo sapiens
cagucucuucgaggcuuuacag

SEQ ID NO: 1598686 - RNA, 13 nt, Homo sapiens
cagucugagcugu

SEQ ID NO: 1598687 - RNA, 15 nt, Homo sapiens
cagucuggagaaggu

SEQ ID NO: 1598688 - RNA, 14 nt, Homo sapiens
cagucuuccauuug

SEQ ID NO: 1598689 - RNA, 14 nt, Homo sapiens
cagucuugccuagg

SEQ ID NO: 1598690 - RNA, 13 nt, Homo sapiens
cagugaacacuca

SEQ ID NO: 1598691 - RNA, 17 nt, Homo sapiens
cagugaagcagcacugu

SEQ ID NO: 1598692 - RNA, 19 nt, Homo sapiens
cagugaagucuagaaucau

SEQ ID NO: 1598693 - RNA, 17 nt, Homo sapiens
cagugagaagccagcuu

SEQ ID NO: 1598694 - RNA, 20 nt, Homo sapiens
cagugagccgagaucaugcc

SEQ ID NO: 1598695 - RNA, 12 nt, Homo sapiens
cagugagcucuu

SEQ ID NO: 1598696 - RNA, 14 nt, Homo sapiens
cagugagcucuuua

SEQ ID NO: 1598697 - RNA, 23 nt, Homo sapiens
cagugaggccugccaggccuccc

SEQ ID NO: 1598698 - RNA, 21 nt, Homo sapiens
cagugagucgagauugcacug

SEQ ID NO: 1598699 - RNA, 15 nt, Homo sapiens
cagugauagagcaaa

SEQ ID NO: 1598700 - RNA, 14 nt, Homo sapiens
cagugcaguuucuu

SEQ ID NO: 1598701 - RNA, 21 nt, Homo sapiens
cagugcccaccaacaucccau

SEQ ID NO: 1598702 - RNA, 16 nt, Homo sapiens
cagugcccaugggcua

SEQ ID NO: 1598703 - RNA, 17 nt, Homo sapiens
cagugcgugaagaccaa

SEQ ID NO: 1598704 - RNA, 22 nt, Homo sapiens
cagugcuaaagccuguggguuu

SEQ ID NO: 1598705 - RNA, 19 nt, Homo sapiens
cagugcugcccaugagcaa

SEQ ID NO: 1598706 - RNA, 14 nt, Homo sapiens
caguggacucuucc

SEQ ID NO: 1598707 - RNA, 15 nt, Homo sapiens
caguggcgugaucuc

SEQ ID NO: 1598708 - RNA, 16 nt, Homo sapiens
caguggcgugaucucg

SEQ ID NO: 1598709 - RNA, 20 nt, Homo sapiens
cauccuaccccuuugcacuu

SEQ ID NO: 1598710 - RNA, 16 nt, Homo sapiens
cauccuaguaauaaag

SEQ ID NO: 1598711 - RNA, 15 nt, Homo sapiens
cauccuccauugcuc

SEQ ID NO: 1598712 - RNA, 22 nt, Homo sapiens
cauccucugauagcuguuucaa

SEQ ID NO: 1598713 - RNA, 14 nt, Homo sapiens
cauccugacugaaa

SEQ ID NO: 1598714 - RNA, 15 nt, Homo sapiens
augucuauguagcug

SEQ ID NO: 1598715 - RNA, 22 nt, Homo sapiens
augucuccacuuucacccgcag

SEQ ID NO: 1598716 - RNA, 20 nt, Homo sapiens
augucuccccaguuccacag

SEQ ID NO: 1598717 - RNA, 20 nt, Homo sapiens
augucuccuggacucagggu

SEQ ID NO: 1598718 - RNA, 21 nt, Homo sapiens
augucucucagaauucuucag

SEQ ID NO: 1598719 - RNA, 17 nt, Homo sapiens
augucucuucugagcua

SEQ ID NO: 1598720 - RNA, 18 nt, Homo sapiens
augucugccuaugcacug

SEQ ID NO: 1598721 - RNA, 22 nt, Homo sapiens
augucuggggcagaaacacuca

SEQ ID NO: 1598722 - RNA, 18 nt, Homo sapiens
augucuuaaccucaggga

SEQ ID NO: 1598723 - RNA, 18 nt, Homo sapiens
augugaauuauugacacu

SEQ ID NO: 1598724 - RNA, 21 nt, Homo sapiens
augugaauuauugacacugaa

SEQ ID NO: 1598725 - RNA, 23 nt, Homo sapiens
augugaauuauuuuaaaggcaaa

SEQ ID NO: 1598726 - RNA, 12 nt, Homo sapiens
augugacucagc

SEQ ID NO: 1598727 - RNA, 11 nt, Homo sapiens
augugagauac

SEQ ID NO: 1598728 - RNA, 13 nt, Homo sapiens
augugauguggug

SEQ ID NO: 1598729 - RNA, 14 nt, Homo sapiens
augugauugcagcu

SEQ ID NO: 1598730 - RNA, 16 nt, Homo sapiens
augugauuuuucugca

SEQ ID NO: 1598731 - RNA, 15 nt, Homo sapiens
augugcaauaagauu

SEQ ID NO: 1598732 - RNA, 16 nt, Homo sapiens
augugcucagccaaau

SEQ ID NO: 1598733 - RNA, 23 nt, Homo sapiens
augugcuggacacuguccaugaa

SEQ ID NO: 1598734 - RNA, 17 nt, Homo sapiens
augugcuucaucugugg

SEQ ID NO: 1598735 - RNA, 23 nt, Homo sapiens
augugcuuuuaaaaaaaaauacu

SEQ ID NO: 1598736 - RNA, 22 nt, Homo sapiens
auguggcaaggaaaaacagguc

SEQ ID NO: 1598737 - RNA, 15 nt, Homo sapiens
auguggcccucugga

SEQ ID NO: 1598738 - RNA, 15 nt, Homo sapiens
augugggaacagcuc

SEQ ID NO: 1598739 - RNA, 21 nt, Homo sapiens
augugggggucuguguguuua

SEQ ID NO: 1598740 - RNA, 15 nt, Homo sapiens
augugguaggugaua

SEQ ID NO: 1598741 - RNA, 12 nt, Homo sapiens
augugucagcca

SEQ ID NO: 1598742 - RNA, 16 nt, Homo sapiens
augugugaaguaugca

SEQ ID NO: 1598743 - RNA, 16 nt, Homo sapiens
auguguguacaugugc

SEQ ID NO: 1598744 - RNA, 18 nt, Homo sapiens
augugugugccaagcccu

SEQ ID NO: 1598745 - RNA, 21 nt, Homo sapiens
auguguguuucuguccuguaa

SEQ ID NO: 1598746 - RNA, 11 nt, Homo sapiens
auguguucucu

SEQ ID NO: 1598747 - RNA, 21 nt, Homo sapiens
auguuaaagaugcacagaaua

SEQ ID NO: 1598748 - RNA, 23 nt, Homo sapiens
auguuaaaucaauaaagaccacu

SEQ ID NO: 1598749 - RNA, 20 nt, Homo sapiens
auguuaaucacauuccuacc

SEQ ID NO: 1598750 - RNA, 14 nt, Homo sapiens
auguuaccuucaca

SEQ ID NO: 1598751 - RNA, 17 nt, Homo sapiens
auguuaccuucacaugu

SEQ ID NO: 1598752 - RNA, 22 nt, Homo sapiens
auguuagaagaggccuuuggaa

SEQ ID NO: 1598753 - RNA, 16 nt, Homo sapiens
auguuaguuaccuuau

SEQ ID NO: 1598754 - RNA, 15 nt, Homo sapiens
auguuauagaacuuc

SEQ ID NO: 1598755 - RNA, 17 nt, Homo sapiens
auguuauagaacuucau

SEQ ID NO: 1598756 - RNA, 14 nt, Homo sapiens
auguuccacuaacc

SEQ ID NO: 1598757 - RNA, 12 nt, Homo sapiens
auguucugggug

SEQ ID NO: 1598758 - RNA, 15 nt, Homo sapiens
auguucuugguguuu

SEQ ID NO: 1598759 - RNA, 15 nt, Homo sapiens
auguucuuuccauga

SEQ ID NO: 1598760 - RNA, 22 nt, Homo sapiens
auguugaaaaaguucugcagau

SEQ ID NO: 1598761 - RNA, 21 nt, Homo sapiens
auguugaagugagcugagauu

SEQ ID NO: 1598762 - RNA, 17 nt, Homo sapiens
auguugaucuuucucaa

SEQ ID NO: 1598763 - RNA, 14 nt, Homo sapiens
auguugcacaauga

SEQ ID NO: 1598764 - RNA, 16 nt, Homo sapiens
auguuggccucuucag

SEQ ID NO: 1598765 - RNA, 20 nt, Homo sapiens
auguuuaaauucucuuucac

SEQ ID NO: 1598766 - RNA, 16 nt, Homo sapiens
auguuuauucuguucc

SEQ ID NO: 1598767 - RNA, 15 nt, Homo sapiens
auguuucagagcuca

SEQ ID NO: 1598768 - RNA, 15 nt, Homo sapiens
auguuucuacagaua

SEQ ID NO: 1598769 - RNA, 22 nt, Homo sapiens
auguuuggggaucgaugugcuc

SEQ ID NO: 1598770 - RNA, 16 nt, Homo sapiens
auguuuguccugaaca

SEQ ID NO: 1598771 - RNA, 14 nt, Homo sapiens
auguuuucuaguca

SEQ ID NO: 1598772 - RNA, 21 nt, Homo sapiens
auguuuucuagucacuuccuc

SEQ ID NO: 1598773 - RNA, 22 nt, Homo sapiens
auguuuucucuggaguauucua

SEQ ID NO: 1598774 - RNA, 18 nt, Homo sapiens
auguuuuuaauucuagua

SEQ ID NO: 1598775 - RNA, 23 nt, Homo sapiens
auguuuuuggaaacuaguggcaa

SEQ ID NO: 1598776 - RNA, 20 nt, Homo sapiens
auuaaaacaauaaugcaauu

SEQ ID NO: 1598777 - RNA, 19 nt, Homo sapiens
auuaaaagaauaucuggca

SEQ ID NO: 1598778 - RNA, 17 nt, Homo sapiens
auuaaaagcaaaucauu

SEQ ID NO: 1598779 - RNA, 18 nt, Homo sapiens
auuaaaauaacuaagcaa

SEQ ID NO: 1598780 - RNA, 15 nt, Homo sapiens
auuaaaauucaggaa

SEQ ID NO: 1598781 - RNA, 15 nt, Homo sapiens
auuaaagagccaguu

SEQ ID NO: 1598782 - RNA, 11 nt, Homo sapiens
auuaaagucag

SEQ ID NO: 1598783 - RNA, 13 nt, Homo sapiens
auuaaaguuauaa

SEQ ID NO: 1598784 - RNA, 14 nt, Homo sapiens
auuaaaugugagca

SEQ ID NO: 1598785 - RNA, 12 nt, Homo sapiens
auuaaauguuuc

SEQ ID NO: 1598786 - RNA, 16 nt, Homo sapiens
auuaaauuagauaucu

SEQ ID NO: 1598787 - RNA, 14 nt, Homo sapiens
auuaacaaaaugua

SEQ ID NO: 1598788 - RNA, 20 nt, Homo sapiens
auuaacauacaucauuccac

SEQ ID NO: 1598789 - RNA, 14 nt, Homo sapiens
auuaacaugcaaua

SEQ ID NO: 1598790 - RNA, 16 nt, Homo sapiens
auuaacaugcaauaac

SEQ ID NO: 1598791 - RNA, 13 nt, Homo sapiens
auuaaccugguca

SEQ ID NO: 1598792 - RNA, 11 nt, Homo sapiens
auuaacuaauc

SEQ ID NO: 1598793 - RNA, 13 nt, Homo sapiens
auuaacugugaaa

SEQ ID NO: 1598794 - RNA, 21 nt, Homo sapiens
auuaagaaaccuugcucuccu

SEQ ID NO: 1598795 - RNA, 18 nt, Homo sapiens
auuaagaaauucacuucc

SEQ ID NO: 1598796 - RNA, 20 nt, Homo sapiens
auuaagaauugguugccaua

SEQ ID NO: 1598797 - RNA, 19 nt, Homo sapiens
auuaagacuuuauguaguu

SEQ ID NO: 1598798 - RNA, 14 nt, Homo sapiens
auuaagauucuuga

SEQ ID NO: 1598799 - RNA, 24 nt, Homo sapiens
auuaaggccuuuuccacacgcauu

SEQ ID NO: 1598800 - RNA, 14 nt, Homo sapiens
auuaauagccaaag

SEQ ID NO: 1598801 - RNA, 12 nt, Homo sapiens
auuaaugaacua

SEQ ID NO: 1598802 - RNA, 18 nt, Homo sapiens
auuaaugccauuaucccu

SEQ ID NO: 1598803 - RNA, 19 nt, Homo sapiens
auuaauguuucuucuccaa

SEQ ID NO: 1598804 - RNA, 20 nt, Homo sapiens
auuaauuaagucaccuguau

SEQ ID NO: 1598805 - RNA, 13 nt, Homo sapiens
auuaauucacaug

SEQ ID NO: 1598806 - RNA, 13 nt, Homo sapiens
auuacacauuuca

SEQ ID NO: 1598807 - RNA, 22 nt, Homo sapiens
auuacagauuaaagaagaaaag

SEQ ID NO: 1598808 - RNA, 15 nt, Homo sapiens
auuacaggcaccugc

SEQ ID NO: 1598809 - RNA, 21 nt, Homo sapiens
auuacaguguccuaccacucu

SEQ ID NO: 1598810 - RNA, 14 nt, Homo sapiens
auuacaucugagua

SEQ ID NO: 1598811 - RNA, 21 nt, Homo sapiens
auuaccaaaauauauauuaau

SEQ ID NO: 1598812 - RNA, 12 nt, Homo sapiens
auuaccuucuau

SEQ ID NO: 1598813 - RNA, 16 nt, Homo sapiens
auuacggggugaccuu

SEQ ID NO: 1598814 - RNA, 14 nt, Homo sapiens
auuacuaaauugac

SEQ ID NO: 1598815 - RNA, 20 nt, Homo sapiens
auuacuagaaauauuuaacu

SEQ ID NO: 1598816 - RNA, 22 nt, Homo sapiens
auuacuaguacuaguacuauga

SEQ ID NO: 1598817 - RNA, 23 nt, Homo sapiens
auuacuaguguuuaagucauuuu

SEQ ID NO: 1598818 - RNA, 15 nt, Homo sapiens
auuacuauacauuga

SEQ ID NO: 1598819 - RNA, 15 nt, Homo sapiens
auuacucuacuguuc

SEQ ID NO: 1598820 - RNA, 15 nt, Homo sapiens
auuacugaugugaua

SEQ ID NO: 1598821 - RNA, 16 nt, Homo sapiens
auuagaauauccauga

SEQ ID NO: 1598822 - RNA, 14 nt, Homo sapiens
auuagcaaagcaaa

SEQ ID NO: 1598823 - RNA, 18 nt, Homo sapiens
auuagccgggcauggugg

SEQ ID NO: 1598824 - RNA, 19 nt, Homo sapiens
auuaguauucaggcacuga

SEQ ID NO: 1598825 - RNA, 23 nt, Homo sapiens
auuagugguuuaucagcaaaaaa

SEQ ID NO: 1598826 - RNA, 15 nt, Homo sapiens
auuaguugcuuuguu

SEQ ID NO: 1598827 - RNA, 17 nt, Homo sapiens
auuaguuggcuuucaua

SEQ ID NO: 1598828 - RNA, 24 nt, Homo sapiens
auuauacgcuggcaacacagaggc

SEQ ID NO: 1598829 - RNA, 24 nt, Homo sapiens
auuauaguaacuauaagauacaau

SEQ ID NO: 1598830 - RNA, 24 nt, Homo sapiens
auuauagugaaacauguacuuuga

SEQ ID NO: 1598831 - RNA, 15 nt, Homo sapiens
auuauauaacuguau

SEQ ID NO: 1598832 - RNA, 14 nt, Homo sapiens
auuauauucauucu

SEQ ID NO: 1598833 - RNA, 16 nt, Homo sapiens
augccaguuguggcag

SEQ ID NO: 1598834 - RNA, 20 nt, Homo sapiens
augccccauuggauuacuuu

SEQ ID NO: 1598835 - RNA, 22 nt, Homo sapiens
augccgauauacucuagaugaa

SEQ ID NO: 1598836 - RNA, 19 nt, Homo sapiens
augccgccguguuuccuca

SEQ ID NO: 1598837 - RNA, 18 nt, Homo sapiens
augccuauaaaaugccca

SEQ ID NO: 1598838 - RNA, 17 nt, Homo sapiens
augccuguaaucccaga

SEQ ID NO: 1598839 - RNA, 14 nt, Homo sapiens
augccuguaaucuc

SEQ ID NO: 1598840 - RNA, 23 nt, Homo sapiens
augccuguaaucucagcacuuug

SEQ ID NO: 1598841 - RNA, 19 nt, Homo sapiens
augcuaaaggagcaucuau

SEQ ID NO: 1598842 - RNA, 13 nt, Homo sapiens
augcucagaaagg

SEQ ID NO: 1598843 - RNA, 23 nt, Homo sapiens
augcucaguuggugcugcuuucu

SEQ ID NO: 1598844 - RNA, 14 nt, Homo sapiens
augcucucucaccu

SEQ ID NO: 1598845 - RNA, 21 nt, Homo sapiens
augcucucucaccugcuccca

SEQ ID NO: 1598846 - RNA, 18 nt, Homo sapiens
augcucuuguucuguucc

SEQ ID NO: 1598847 - RNA, 18 nt, Homo sapiens
augcucuuuucacagcua

SEQ ID NO: 1598848 - RNA, 14 nt, Homo sapiens
augcugcuugccuc

SEQ ID NO: 1598849 - RNA, 20 nt, Homo sapiens
augcuggaaccugcaaaaaa

SEQ ID NO: 1598850 - RNA, 20 nt, Homo sapiens
augcuggcugaagaggacca

SEQ ID NO: 1598851 - RNA, 15 nt, Homo sapiens
augcuguugccucau

SEQ ID NO: 1598852 - RNA, 19 nt, Homo sapiens
augcuguuuaugaacggaa

SEQ ID NO: 1598853 - RNA, 15 nt, Homo sapiens
auggaacagcauuac

SEQ ID NO: 1598854 - RNA, 20 nt, Homo sapiens
auggaacagcauuacccucc

SEQ ID NO: 1598855 - RNA, 13 nt, Homo sapiens
auggaacauaaaa

SEQ ID NO: 1598856 - RNA, 20 nt, Homo sapiens
auggaagcaaccagcaaauu

SEQ ID NO: 1598857 - RNA, 18 nt, Homo sapiens
auggaauuuugcaaagau

SEQ ID NO: 1598858 - RNA, 22 nt, Homo sapiens
auggacuggagcucaucugcaa

SEQ ID NO: 1598859 - RNA, 13 nt, Homo sapiens
auggagaacccag

SEQ ID NO: 1598860 - RNA, 13 nt, Homo sapiens
auggagaggacag

SEQ ID NO: 1598861 - RNA, 16 nt, Homo sapiens
auggagaggacagagc

SEQ ID NO: 1598862 - RNA, 19 nt, Homo sapiens
auggagaggcggccucgug

SEQ ID NO: 1598863 - RNA, 22 nt, Homo sapiens
auggaggaaauccggucagcca

SEQ ID NO: 1598864 - RNA, 17 nt, Homo sapiens
auggaggaacaguauua

SEQ ID NO: 1598865 - RNA, 15 nt, Homo sapiens
auggaggaacuuucc

SEQ ID NO: 1598866 - RNA, 17 nt, Homo sapiens
auggaggcgggaaaauc

SEQ ID NO: 1598867 - RNA, 18 nt, Homo sapiens
auggagggaaugcucaga

SEQ ID NO: 1598868 - RNA, 11 nt, Homo sapiens
auggagucuug

SEQ ID NO: 1598869 - RNA, 13 nt, Homo sapiens
auggaguuccuuc

SEQ ID NO: 1598870 - RNA, 21 nt, Homo sapiens
auggaguuucucuagaagcuc

SEQ ID NO: 1598871 - RNA, 14 nt, Homo sapiens
auggaugcauuuca

SEQ ID NO: 1598872 - RNA, 13 nt, Homo sapiens
auggauucacuuc

SEQ ID NO: 1598873 - RNA, 21 nt, Homo sapiens
auggcauaggccuuagcagua

SEQ ID NO: 1598874 - RNA, 18 nt, Homo sapiens
auggccaacucaacuuuc

SEQ ID NO: 1598875 - RNA, 13 nt, Homo sapiens
auggccacuacuu

SEQ ID NO: 1598876 - RNA, 19 nt, Homo sapiens
auggccagagccucuggcc

SEQ ID NO: 1598877 - RNA, 15 nt, Homo sapiens
auggcgcgaucucag

SEQ ID NO: 1598878 - RNA, 18 nt, Homo sapiens
auggcggucagccccuuc

SEQ ID NO: 1598879 - RNA, 18 nt, Homo sapiens
auggcuaguaucaaaaga

SEQ ID NO: 1598880 - RNA, 16 nt, Homo sapiens
auggcuauaggugcua

SEQ ID NO: 1598881 - RNA, 20 nt, Homo sapiens
auggcucaagucugcacaga

SEQ ID NO: 1598882 - RNA, 15 nt, Homo sapiens
auggcucucuauucc

SEQ ID NO: 1598883 - RNA, 19 nt, Homo sapiens
auggcuuaggaaugacuua

SEQ ID NO: 1598884 - RNA, 20 nt, Homo sapiens
augggaauugcgcucagggg

SEQ ID NO: 1598885 - RNA, 19 nt, Homo sapiens
augggagaaucacuugaac

SEQ ID NO: 1598886 - RNA, 19 nt, Homo sapiens
augggagaauugcacacag

SEQ ID NO: 1598887 - RNA, 20 nt, Homo sapiens
augggagauuaaaaccagag

SEQ ID NO: 1598888 - RNA, 14 nt, Homo sapiens
augggagcagucca

SEQ ID NO: 1598889 - RNA, 16 nt, Homo sapiens
augggcaaaaaaccaa

SEQ ID NO: 1598890 - RNA, 22 nt, Homo sapiens
augggcagcccaacagcacuuu

SEQ ID NO: 1598891 - RNA, 18 nt, Homo sapiens
auggggugggguagggcu

SEQ ID NO: 1598892 - RNA, 18 nt, Homo sapiens
auggggugucuguguuau

SEQ ID NO: 1598893 - RNA, 16 nt, Homo sapiens
augggucaugacaaga

SEQ ID NO: 1598894 - RNA, 17 nt, Homo sapiens
augggucuaggacacag

SEQ ID NO: 1598895 - RNA, 19 nt, Homo sapiens
augguaguuuuacaguguu

SEQ ID NO: 1598896 - RNA, 20 nt, Homo sapiens
augguauaaacaggagacag

SEQ ID NO: 1598897 - RNA, 17 nt, Homo sapiens
augguaugccucugugu

SEQ ID NO: 1598898 - RNA, 21 nt, Homo sapiens
augguaugcuggccagcaccc

SEQ ID NO: 1598899 - RNA, 16 nt, Homo sapiens
auggucaaugcuagca

SEQ ID NO: 1598900 - RNA, 13 nt, Homo sapiens
augguccaaaaau

SEQ ID NO: 1598901 - RNA, 17 nt, Homo sapiens
augguccaaaaauaguc

SEQ ID NO: 1598902 - RNA, 20 nt, Homo sapiens
auggucccaggcuucccaaa

SEQ ID NO: 1598903 - RNA, 20 nt, Homo sapiens
auggugaaacccccaucucu

SEQ ID NO: 1598904 - RNA, 15 nt, Homo sapiens
auggugaugucacuc

SEQ ID NO: 1598905 - RNA, 20 nt, Homo sapiens
auggugucugugacauuucc

SEQ ID NO: 1598906 - RNA, 14 nt, Homo sapiens
augguuaauacuau

SEQ ID NO: 1598907 - RNA, 20 nt, Homo sapiens
augguuacuucuucucuuag

SEQ ID NO: 1598908 - RNA, 20 nt, Homo sapiens
augguuaucuuugagaccau

SEQ ID NO: 1598909 - RNA, 17 nt, Homo sapiens
augguucccaagcguca

SEQ ID NO: 1598910 - RNA, 13 nt, Homo sapiens
augguucugccuc

SEQ ID NO: 1598911 - RNA, 17 nt, Homo sapiens
augguuuaaagucacag

SEQ ID NO: 1598912 - RNA, 21 nt, Homo sapiens
augguuuucuccaagagcuac

SEQ ID NO: 1598913 - RNA, 21 nt, Homo sapiens
auguaaaaaugaaaagccaaa

SEQ ID NO: 1598914 - RNA, 17 nt, Homo sapiens
auguaaacagugccugc

SEQ ID NO: 1598915 - RNA, 16 nt, Homo sapiens
auguaaacugugcacc

SEQ ID NO: 1598916 - RNA, 21 nt, Homo sapiens
auguaaagauauuuuuaucuu

SEQ ID NO: 1598917 - RNA, 15 nt, Homo sapiens
auguaaagcacauca

SEQ ID NO: 1598918 - RNA, 13 nt, Homo sapiens
auguaaccacugc

SEQ ID NO: 1598919 - RNA, 15 nt, Homo sapiens
auguaaccacugcac

SEQ ID NO: 1598920 - RNA, 17 nt, Homo sapiens
auguaagcauaacuuau

SEQ ID NO: 1598921 - RNA, 16 nt, Homo sapiens
auguaaggagccuuuc

SEQ ID NO: 1598922 - RNA, 21 nt, Homo sapiens
auguaauggaacuuagccauu

SEQ ID NO: 1598923 - RNA, 18 nt, Homo sapiens
auguaauuauguucuaag

SEQ ID NO: 1598924 - RNA, 15 nt, Homo sapiens
auguaccagcaucuc

SEQ ID NO: 1598925 - RNA, 17 nt, Homo sapiens
auguaccuccaugagcu

SEQ ID NO: 1598926 - RNA, 19 nt, Homo sapiens
auguacucaaguaccacca

SEQ ID NO: 1598927 - RNA, 19 nt, Homo sapiens
auguacugaauucuuuauc

SEQ ID NO: 1598928 - RNA, 14 nt, Homo sapiens
auguacuucucacc

SEQ ID NO: 1598929 - RNA, 23 nt, Homo sapiens
auguagaauaggcagggggcccu

SEQ ID NO: 1598930 - RNA, 22 nt, Homo sapiens
auguagccuuuacuguuugaua

SEQ ID NO: 1598931 - RNA, 19 nt, Homo sapiens
auguagcuucagucauuaa

SEQ ID NO: 1598932 - RNA, 16 nt, Homo sapiens
auguaguuugcacuua

SEQ ID NO: 1598933 - RNA, 19 nt, Homo sapiens
auguauacauauguagcua

SEQ ID NO: 1598934 - RNA, 13 nt, Homo sapiens
auguaugcugauu

SEQ ID NO: 1598935 - RNA, 17 nt, Homo sapiens
auguauguacaauacaa

SEQ ID NO: 1598936 - RNA, 14 nt, Homo sapiens
augucaaagcuuug

SEQ ID NO: 1598937 - RNA, 19 nt, Homo sapiens
augucacagauuccuggca

SEQ ID NO: 1598938 - RNA, 12 nt, Homo sapiens
augucacucugg

SEQ ID NO: 1598939 - RNA, 15 nt, Homo sapiens
augucagagcacuuu

SEQ ID NO: 1598940 - RNA, 14 nt, Homo sapiens
augucagucacuaa

SEQ ID NO: 1598941 - RNA, 20 nt, Homo sapiens
augucauagguaagaaacac

SEQ ID NO: 1598942 - RNA, 12 nt, Homo sapiens
augucauuuagu

SEQ ID NO: 1598943 - RNA, 15 nt, Homo sapiens
augucauuugcacac

SEQ ID NO: 1598944 - RNA, 13 nt, Homo sapiens
auguccaggaaag

SEQ ID NO: 1598945 - RNA, 17 nt, Homo sapiens
auguccauaugcaucua

SEQ ID NO: 1598946 - RNA, 17 nt, Homo sapiens
augucccaccucucuga

SEQ ID NO: 1598947 - RNA, 23 nt, Homo sapiens
augucccaggaaucaguuuaaaa

SEQ ID NO: 1598948 - RNA, 21 nt, Homo sapiens
auguccuacugagacagcaca

SEQ ID NO: 1598949 - RNA, 16 nt, Homo sapiens
augucgaugacuucau

SEQ ID NO: 1598950 - RNA, 13 nt, Homo sapiens
augucgcagacuc

SEQ ID NO: 1598951 - RNA, 13 nt, Homo sapiens
aucuucagauuaa

SEQ ID NO: 1598952 - RNA, 21 nt, Homo sapiens
aucuucagggaacugcauaga

SEQ ID NO: 1598953 - RNA, 15 nt, Homo sapiens
aucuuccaaauccaa

SEQ ID NO: 1598954 - RNA, 15 nt, Homo sapiens
aucuuccaccagcac

SEQ ID NO: 1598955 - RNA, 23 nt, Homo sapiens
aucuucccuuuauuacaagaagg

SEQ ID NO: 1598956 - RNA, 20 nt, Homo sapiens
aucuucuaaacccaauccaa

SEQ ID NO: 1598957 - RNA, 21 nt, Homo sapiens
aucuucugugcccagcacagu

SEQ ID NO: 1598958 - RNA, 22 nt, Homo sapiens
aucuugagccacagucacugga

SEQ ID NO: 1598959 - RNA, 14 nt, Homo sapiens
aucuugaguauuua

SEQ ID NO: 1598960 - RNA, 23 nt, Homo sapiens
aucuuucaaaagccuuaccuuga

SEQ ID NO: 1598961 - RNA, 16 nt, Homo sapiens
aucuuucacuauacag

SEQ ID NO: 1598962 - RNA, 20 nt, Homo sapiens
aucuuugcucccugcaagaa

SEQ ID NO: 1598963 - RNA, 20 nt, Homo sapiens
aucuuuguuuaaaugccaaa

SEQ ID NO: 1598964 - RNA, 13 nt, Homo sapiens
aucuuuucaaggc

SEQ ID NO: 1598965 - RNA, 13 nt, Homo sapiens
aucuuuucauuaa

SEQ ID NO: 1598966 - RNA, 17 nt, Homo sapiens
augaaaacuaaggauuu

SEQ ID NO: 1598967 - RNA, 13 nt, Homo sapiens
augaaaagcagaa

SEQ ID NO: 1598968 - RNA, 23 nt, Homo sapiens
augaaaagucguuuuccaaacug

SEQ ID NO: 1598969 - RNA, 20 nt, Homo sapiens
augaaaaugggaugaauucu

SEQ ID NO: 1598970 - RNA, 14 nt, Homo sapiens
augaaacaacaaaa

SEQ ID NO: 1598971 - RNA, 15 nt, Homo sapiens
augaaacaauuugag

SEQ ID NO: 1598972 - RNA, 12 nt, Homo sapiens
augaaacuaaga

SEQ ID NO: 1598973 - RNA, 19 nt, Homo sapiens
augaaagggaaacugggaa

SEQ ID NO: 1598974 - RNA, 16 nt, Homo sapiens
augaaagugaugacau

SEQ ID NO: 1598975 - RNA, 14 nt, Homo sapiens
augaaaguggacaa

SEQ ID NO: 1598976 - RNA, 17 nt, Homo sapiens
augaaauaaaauaucaa

SEQ ID NO: 1598977 - RNA, 20 nt, Homo sapiens
augaaauccagugagcacua

SEQ ID NO: 1598978 - RNA, 14 nt, Homo sapiens
augaaauuaacaca

SEQ ID NO: 1598979 - RNA, 15 nt, Homo sapiens
augaaauugucaaaa

SEQ ID NO: 1598980 - RNA, 13 nt, Homo sapiens
augaacacuuaau

SEQ ID NO: 1598981 - RNA, 21 nt, Homo sapiens
augaaccauucacagugcaag

SEQ ID NO: 1598982 - RNA, 20 nt, Homo sapiens
augaagcuaccucaaacuuc

SEQ ID NO: 1598983 - RNA, 20 nt, Homo sapiens
augaaggauuacucuccaua

SEQ ID NO: 1598984 - RNA, 16 nt, Homo sapiens
augaaggcagagccau

SEQ ID NO: 1598985 - RNA, 18 nt, Homo sapiens
augaaguaaggagaggga

SEQ ID NO: 1598986 - RNA, 23 nt, Homo sapiens
augaagugcuuuguaucaggaaa

SEQ ID NO: 1598987 - RNA, 18 nt, Homo sapiens
augaaguuuugauuuauu

SEQ ID NO: 1598988 - RNA, 14 nt, Homo sapiens
augaaugaauggcu

SEQ ID NO: 1598989 - RNA, 15 nt, Homo sapiens
augaaugcagauuac

SEQ ID NO: 1598990 - RNA, 23 nt, Homo sapiens
augaauucuuuguuuaugcacuu

SEQ ID NO: 1598991 - RNA, 23 nt, Homo sapiens
augaauuuuguaucugcuuccau

SEQ ID NO: 1598992 - RNA, 19 nt, Homo sapiens
augacaauguugcauuuau

SEQ ID NO: 1598993 - RNA, 11 nt, Homo sapiens
augacauauuu

SEQ ID NO: 1598994 - RNA, 16 nt, Homo sapiens
augaccacauccugaa

SEQ ID NO: 1598995 - RNA, 16 nt, Homo sapiens
augaccuugggguaca

SEQ ID NO: 1598996 - RNA, 13 nt, Homo sapiens
augacgucuucac

SEQ ID NO: 1598997 - RNA, 17 nt, Homo sapiens
augacgugccuaccucu

SEQ ID NO: 1598998 - RNA, 14 nt, Homo sapiens
augacuccauucaa

SEQ ID NO: 1598999 - RNA, 19 nt, Homo sapiens
augacuuagcgucaagaca

SEQ ID NO: 1599000 - RNA, 20 nt, Homo sapiens
augacuuauaugagggcaga

SEQ ID NO: 1599001 - RNA, 17 nt, Homo sapiens
augagaacaaacagauc

SEQ ID NO: 1599002 - RNA, 16 nt, Homo sapiens
augagacagacauuca

SEQ ID NO: 1599003 - RNA, 20 nt, Homo sapiens
augagaugguuucuagagau

SEQ ID NO: 1599004 - RNA, 19 nt, Homo sapiens
augagcacaucucucugcc

SEQ ID NO: 1599005 - RNA, 22 nt, Homo sapiens
augagcuggggaugucucucau

SEQ ID NO: 1599006 - RNA, 15 nt, Homo sapiens
augaggaaacugagu

SEQ ID NO: 1599007 - RNA, 15 nt, Homo sapiens
augaggccaucucag

SEQ ID NO: 1599008 - RNA, 23 nt, Homo sapiens
augaggucuguuuaaaguggcaa

SEQ ID NO: 1599009 - RNA, 16 nt, Homo sapiens
augagguuuuuccaaa

SEQ ID NO: 1599010 - RNA, 20 nt, Homo sapiens
augaguaauacaucaaagag

SEQ ID NO: 1599011 - RNA, 13 nt, Homo sapiens
augagucauuugu

SEQ ID NO: 1599012 - RNA, 16 nt, Homo sapiens
augaguuacuguuuaa

SEQ ID NO: 1599013 - RNA, 21 nt, Homo sapiens
augaguuacuuagaaugccau

SEQ ID NO: 1599014 - RNA, 16 nt, Homo sapiens
augaguuucugaggau

SEQ ID NO: 1599015 - RNA, 13 nt, Homo sapiens
augauaaagacuu

SEQ ID NO: 1599016 - RNA, 16 nt, Homo sapiens
augauacugaugccau

SEQ ID NO: 1599017 - RNA, 17 nt, Homo sapiens
augaucaaaaacugccu

SEQ ID NO: 1599018 - RNA, 17 nt, Homo sapiens
augaucaagauauaugu

SEQ ID NO: 1599019 - RNA, 22 nt, Homo sapiens
augaucaucacaaucaucauca

SEQ ID NO: 1599020 - RNA, 16 nt, Homo sapiens
augaucccuaaugugu

SEQ ID NO: 1599021 - RNA, 17 nt, Homo sapiens
augauccucccuaucaa

SEQ ID NO: 1599022 - RNA, 13 nt, Homo sapiens
augauccugcaau

SEQ ID NO: 1599023 - RNA, 17 nt, Homo sapiens
augauccuugcugauaa

SEQ ID NO: 1599024 - RNA, 13 nt, Homo sapiens
augaucucccugc

SEQ ID NO: 1599025 - RNA, 20 nt, Homo sapiens
augaugaaaacuaaggauuu

SEQ ID NO: 1599026 - RNA, 16 nt, Homo sapiens
augaugagaagcagaa

SEQ ID NO: 1599027 - RNA, 13 nt, Homo sapiens
augaugcacuuau

SEQ ID NO: 1599028 - RNA, 14 nt, Homo sapiens
augaugcagucucc

SEQ ID NO: 1599029 - RNA, 21 nt, Homo sapiens
augaugcuagccagcaaagau

SEQ ID NO: 1599030 - RNA, 17 nt, Homo sapiens
augauguauuguugcuu

SEQ ID NO: 1599031 - RNA, 15 nt, Homo sapiens
augauuaacaaagca

SEQ ID NO: 1599032 - RNA, 14 nt, Homo sapiens
augauuagagggau

SEQ ID NO: 1599033 - RNA, 14 nt, Homo sapiens
augauuauauucac

SEQ ID NO: 1599034 - RNA, 15 nt, Homo sapiens
augauucaagccauu

SEQ ID NO: 1599035 - RNA, 20 nt, Homo sapiens
augauucaagccauuccaaa

SEQ ID NO: 1599036 - RNA, 14 nt, Homo sapiens
augauucuaugucu

SEQ ID NO: 1599037 - RNA, 16 nt, Homo sapiens
augauugugugacuau

SEQ ID NO: 1599038 - RNA, 19 nt, Homo sapiens
augauuuagugaucaaauu

SEQ ID NO: 1599039 - RNA, 18 nt, Homo sapiens
augauuuuaagaggcuuu

SEQ ID NO: 1599040 - RNA, 16 nt, Homo sapiens
augcaaacugcuuuau

SEQ ID NO: 1599041 - RNA, 20 nt, Homo sapiens
augcaaauaaauuaugcaau

SEQ ID NO: 1599042 - RNA, 16 nt, Homo sapiens
augcaacagaagugac

SEQ ID NO: 1599043 - RNA, 19 nt, Homo sapiens
augcaauuuggguuuuaga

SEQ ID NO: 1599044 - RNA, 13 nt, Homo sapiens
augcaccaaucag

SEQ ID NO: 1599045 - RNA, 14 nt, Homo sapiens
augcacuaagacaa

SEQ ID NO: 1599046 - RNA, 15 nt, Homo sapiens
augcacuauauacau

SEQ ID NO: 1599047 - RNA, 18 nt, Homo sapiens
augcacugaagagcucuu

SEQ ID NO: 1599048 - RNA, 16 nt, Homo sapiens
augcacuuauucaaua

SEQ ID NO: 1599049 - RNA, 18 nt, Homo sapiens
augcagaaagcaucccuc

SEQ ID NO: 1599050 - RNA, 17 nt, Homo sapiens
augcagcaggaaggaac

SEQ ID NO: 1599051 - RNA, 22 nt, Homo sapiens
augcagcaggaaggaacaaaga

SEQ ID NO: 1599052 - RNA, 15 nt, Homo sapiens
augcagcccaugccc

SEQ ID NO: 1599053 - RNA, 15 nt, Homo sapiens
augcagcuacuggaa

SEQ ID NO: 1599054 - RNA, 13 nt, Homo sapiens
augcaguucucac

SEQ ID NO: 1599055 - RNA, 23 nt, Homo sapiens
augcaguucucacgaaaguauuu

SEQ ID NO: 1599056 - RNA, 20 nt, Homo sapiens
augcauauagugacaguaua

SEQ ID NO: 1599057 - RNA, 14 nt, Homo sapiens
augcaucacacuca

SEQ ID NO: 1599058 - RNA, 23 nt, Homo sapiens
augcauccagcaguacaauaaaa

SEQ ID NO: 1599059 - RNA, 20 nt, Homo sapiens
augcaucugggaaaugaggu

SEQ ID NO: 1599060 - RNA, 16 nt, Homo sapiens
augcaugucugccuau

SEQ ID NO: 1599061 - RNA, 23 nt, Homo sapiens
augcaugucugccuaugcacuga

SEQ ID NO: 1599062 - RNA, 12 nt, Homo sapiens
augccaaagggg

SEQ ID NO: 1599063 - RNA, 22 nt, Homo sapiens
augccaacuuaaguauuuacag

SEQ ID NO: 1599064 - RNA, 21 nt, Homo sapiens
augccaauaaaguuugcccau

SEQ ID NO: 1599065 - RNA, 13 nt, Homo sapiens
augccaccaaagg

SEQ ID NO: 1599066 - RNA, 19 nt, Homo sapiens
augccaccaacuuacaaaa

SEQ ID NO: 1599067 - RNA, 18 nt, Homo sapiens
augccaccuuccuugucc

SEQ ID NO: 1599068 - RNA, 14 nt, Homo sapiens
augccacuucucac

SEQ ID NO: 1599069 - RNA, 17 nt, Homo sapiens
aggccagccuggacgac

SEQ ID NO: 1599070 - RNA, 14 nt, Homo sapiens
aggccagggacuca

SEQ ID NO: 1599071 - RNA, 20 nt, Homo sapiens
aggccauggguucaccagcc

SEQ ID NO: 1599072 - RNA, 19 nt, Homo sapiens
aggccauucuuucccaaca

SEQ ID NO: 1599073 - RNA, 21 nt, Homo sapiens
aggccauugugaaccaaugca

SEQ ID NO: 1599074 - RNA, 10 nt, Homo sapiens
aggcccuccc

SEQ ID NO: 1599075 - RNA, 13 nt, Homo sapiens
agguggaagcaga

SEQ ID NO: 1599076 - RNA, 17 nt, Homo sapiens
agguggcucagugccac

SEQ ID NO: 1599077 - RNA, 20 nt, Homo sapiens
aggugggucccggcucugug

SEQ ID NO: 1599078 - RNA, 13 nt, Homo sapiens
agguggugcaaau

SEQ ID NO: 1599079 - RNA, 16 nt, Homo sapiens
aggugugaaccacugu

SEQ ID NO: 1599080 - RNA, 20 nt, Homo sapiens
aggugugaaccuaccugccu

SEQ ID NO: 1599081 - RNA, 15 nt, Homo sapiens
auccauaaugcauuc

SEQ ID NO: 1599082 - RNA, 14 nt, Homo sapiens
auccauccauccaa

SEQ ID NO: 1599083 - RNA, 18 nt, Homo sapiens
auccaugcaccuaccuua

SEQ ID NO: 1599084 - RNA, 20 nt, Homo sapiens
auccaugcaccuaccuuaga

SEQ ID NO: 1599085 - RNA, 23 nt, Homo sapiens
auccauuccucagggacagagac

SEQ ID NO: 1599086 - RNA, 18 nt, Homo sapiens
aucccaaagcaaggagau

SEQ ID NO: 1599087 - RNA, 16 nt, Homo sapiens
aucccagcccacaucu

SEQ ID NO: 1599088 - RNA, 18 nt, Homo sapiens
aucccagcuacuuggaag

SEQ ID NO: 1599089 - RNA, 14 nt, Homo sapiens
auccccaccacuga

SEQ ID NO: 1599090 - RNA, 18 nt, Homo sapiens
auccccaccacugauauc

SEQ ID NO: 1599091 - RNA, 19 nt, Homo sapiens
auccccaccacugauauca

SEQ ID NO: 1599092 - RNA, 18 nt, Homo sapiens
auccccacccagucucau

SEQ ID NO: 1599093 - RNA, 18 nt, Homo sapiens
auccccagccccaaagac

SEQ ID NO: 1599094 - RNA, 15 nt, Homo sapiens
auccccgcuccuggu

SEQ ID NO: 1599095 - RNA, 20 nt, Homo sapiens
auccccuguguggucuccau

SEQ ID NO: 1599096 - RNA, 15 nt, Homo sapiens
aucccuccuugccua

SEQ ID NO: 1599097 - RNA, 13 nt, Homo sapiens
aucccuuccccag

SEQ ID NO: 1599098 - RNA, 20 nt, Homo sapiens
aucccuuccucucaggcucu

SEQ ID NO: 1599099 - RNA, 15 nt, Homo sapiens
auccgccuaccucag

SEQ ID NO: 1599100 - RNA, 20 nt, Homo sapiens
auccguuuucauuguucacu

SEQ ID NO: 1599101 - RNA, 17 nt, Homo sapiens
auccuaaaaaacacugg

SEQ ID NO: 1599102 - RNA, 20 nt, Homo sapiens
auccuaccccuuugcacuug

SEQ ID NO: 1599103 - RNA, 15 nt, Homo sapiens
auccuauuuaucaga

SEQ ID NO: 1599104 - RNA, 17 nt, Homo sapiens
auccucaagcucagggc

SEQ ID NO: 1599105 - RNA, 14 nt, Homo sapiens
auccucacagugaa

SEQ ID NO: 1599106 - RNA, 17 nt, Homo sapiens
auccucaugguucccaa

SEQ ID NO: 1599107 - RNA, 13 nt, Homo sapiens
auccuccacagag

SEQ ID NO: 1599108 - RNA, 15 nt, Homo sapiens
auccuccauugcucc

SEQ ID NO: 1599109 - RNA, 20 nt, Homo sapiens
auccugaaaggcaacauaau

SEQ ID NO: 1599110 - RNA, 16 nt, Homo sapiens
auccugccauccucaa

SEQ ID NO: 1599111 - RNA, 15 nt, Homo sapiens
auccugcccaaaaug

SEQ ID NO: 1599112 - RNA, 22 nt, Homo sapiens
auccugcccucacaucuuccac

SEQ ID NO: 1599113 - RNA, 20 nt, Homo sapiens
auccuggaaggacacaguga

SEQ ID NO: 1599114 - RNA, 17 nt, Homo sapiens
auccuggaccaagcaca

SEQ ID NO: 1599115 - RNA, 16 nt, Homo sapiens
auccugucagugucac

SEQ ID NO: 1599116 - RNA, 22 nt, Homo sapiens
auccuguuacuugcuucagugg

SEQ ID NO: 1599117 - RNA, 13 nt, Homo sapiens
auccuuauuccuc

SEQ ID NO: 1599118 - RNA, 15 nt, Homo sapiens
auccuugcugauaaa

SEQ ID NO: 1599119 - RNA, 19 nt, Homo sapiens
aucgcaccacugcacucca

SEQ ID NO: 1599120 - RNA, 14 nt, Homo sapiens
aucgccaugcccau

SEQ ID NO: 1599121 - RNA, 23 nt, Homo sapiens
aucgccugaguugcuuuuacuuc

SEQ ID NO: 1599122 - RNA, 23 nt, Homo sapiens
aucgcucguguguucuauccaaa

SEQ ID NO: 1599123 - RNA, 15 nt, Homo sapiens
aucguccauccucuu

SEQ ID NO: 1599124 - RNA, 15 nt, Homo sapiens
aucuaaaaugcaaag

SEQ ID NO: 1599125 - RNA, 13 nt, Homo sapiens
aucuaaaucuuca

SEQ ID NO: 1599126 - RNA, 20 nt, Homo sapiens
aucuaaauuacagugcaguu

SEQ ID NO: 1599127 - RNA, 20 nt, Homo sapiens
aucuaauuuuacacucugua

SEQ ID NO: 1599128 - RNA, 21 nt, Homo sapiens
aucuacaacuguuugcacuua

SEQ ID NO: 1599129 - RNA, 16 nt, Homo sapiens
aucuacaccaaugaaa

SEQ ID NO: 1599130 - RNA, 14 nt, Homo sapiens
aucuacagaacugg

SEQ ID NO: 1599131 - RNA, 18 nt, Homo sapiens
aucuaccacuguaugagu

SEQ ID NO: 1599132 - RNA, 11 nt, Homo sapiens
aucuaccagca

SEQ ID NO: 1599133 - RNA, 12 nt, Homo sapiens
aucuaccugcuu

SEQ ID NO: 1599134 - RNA, 23 nt, Homo sapiens
aucuacugaauuggcuuccagau

SEQ ID NO: 1599135 - RNA, 16 nt, Homo sapiens
aucuagucacaaagac

SEQ ID NO: 1599136 - RNA, 19 nt, Homo sapiens
aucuauagcuaaguacaca

SEQ ID NO: 1599137 - RNA, 22 nt, Homo sapiens
aucuaucuuaauacuaaggaac

SEQ ID NO: 1599138 - RNA, 14 nt, Homo sapiens
aucuauuaucucaa

SEQ ID NO: 1599139 - RNA, 15 nt, Homo sapiens
aucucaaacuacugg

SEQ ID NO: 1599140 - RNA, 21 nt, Homo sapiens
aucucaaacuacuggcaauuu

SEQ ID NO: 1599141 - RNA, 15 nt, Homo sapiens
aucucaaagaaggca

SEQ ID NO: 1599142 - RNA, 17 nt, Homo sapiens
aucucaccuucagucaa

SEQ ID NO: 1599143 - RNA, 20 nt, Homo sapiens
aucucaccuucagucaagaa

SEQ ID NO: 1599144 - RNA, 19 nt, Homo sapiens
aucucacuuaguccuuuau

SEQ ID NO: 1599145 - RNA, 12 nt, Homo sapiens
aucucagcacuu

SEQ ID NO: 1599146 - RNA, 13 nt, Homo sapiens
aucucagcacuuu

SEQ ID NO: 1599147 - RNA, 14 nt, Homo sapiens
aucucagcacuuug

SEQ ID NO: 1599148 - RNA, 16 nt, Homo sapiens
aucucaugugugcuca

SEQ ID NO: 1599149 - RNA, 20 nt, Homo sapiens
aucucauuggacccuuccau

SEQ ID NO: 1599150 - RNA, 22 nt, Homo sapiens
aucucauuggacccuuccaugg

SEQ ID NO: 1599151 - RNA, 16 nt, Homo sapiens
aucuccaguacuugag

SEQ ID NO: 1599152 - RNA, 15 nt, Homo sapiens
aucuccaucucaaaa

SEQ ID NO: 1599153 - RNA, 18 nt, Homo sapiens
aucuccccucucaccuca

SEQ ID NO: 1599154 - RNA, 22 nt, Homo sapiens
aucucccugccgccucaaugug

SEQ ID NO: 1599155 - RNA, 20 nt, Homo sapiens
aucuccuauuccuucacaca

SEQ ID NO: 1599156 - RNA, 20 nt, Homo sapiens
aucuccuuuuaucuggugcc

SEQ ID NO: 1599157 - RNA, 24 nt, Homo sapiens
aucucuaacauaugauacugaugc

SEQ ID NO: 1599158 - RNA, 20 nt, Homo sapiens
aucucuacuaaaaacacaaa

SEQ ID NO: 1599159 - RNA, 17 nt, Homo sapiens
aucucucaaaacaauau

SEQ ID NO: 1599160 - RNA, 22 nt, Homo sapiens
aucucuuaaauuggguucauga

SEQ ID NO: 1599161 - RNA, 14 nt, Homo sapiens
aucucuucuggugu

SEQ ID NO: 1599162 - RNA, 22 nt, Homo sapiens
aucucuucuuugcugcagucau

SEQ ID NO: 1599163 - RNA, 17 nt, Homo sapiens
aucucuugaccucguga

SEQ ID NO: 1599164 - RNA, 17 nt, Homo sapiens
aucucuuugaucuacuu

SEQ ID NO: 1599165 - RNA, 13 nt, Homo sapiens
aucugaacauuua

SEQ ID NO: 1599166 - RNA, 16 nt, Homo sapiens
aucugagcuaacuuau

SEQ ID NO: 1599167 - RNA, 13 nt, Homo sapiens
aucugagugaaau

SEQ ID NO: 1599168 - RNA, 22 nt, Homo sapiens
aucugcacagucacuggcccaa

SEQ ID NO: 1599169 - RNA, 13 nt, Homo sapiens
aucugcaguuuaa

SEQ ID NO: 1599170 - RNA, 11 nt, Homo sapiens
aucugccauug

SEQ ID NO: 1599171 - RNA, 17 nt, Homo sapiens
aucugcccccacugucc

SEQ ID NO: 1599172 - RNA, 13 nt, Homo sapiens
aucugcccuagcc

SEQ ID NO: 1599173 - RNA, 22 nt, Homo sapiens
aucugccuuaaaaaaacacgga

SEQ ID NO: 1599174 - RNA, 21 nt, Homo sapiens
aucugccuuaaaaccaaagag

SEQ ID NO: 1599175 - RNA, 22 nt, Homo sapiens
aucugcuuccauuaaaagcaua

SEQ ID NO: 1599176 - RNA, 17 nt, Homo sapiens
aucuggacacacuguua

SEQ ID NO: 1599177 - RNA, 20 nt, Homo sapiens
aucuggacauucgaggaauu

SEQ ID NO: 1599178 - RNA, 18 nt, Homo sapiens
aucuggcuuagugccacc

SEQ ID NO: 1599179 - RNA, 18 nt, Homo sapiens
aucugggacugugccugg

SEQ ID NO: 1599180 - RNA, 17 nt, Homo sapiens
aucuggguaucuuucca

SEQ ID NO: 1599181 - RNA, 16 nt, Homo sapiens
aucuguaaaucuacac

SEQ ID NO: 1599182 - RNA, 15 nt, Homo sapiens
aucuguaguaauuua

SEQ ID NO: 1599183 - RNA, 16 nt, Homo sapiens
aucugucacaccagcc

SEQ ID NO: 1599184 - RNA, 22 nt, Homo sapiens
aucugucauuauauucuaauua

SEQ ID NO: 1599185 - RNA, 16 nt, Homo sapiens
aucugucugugcacau

SEQ ID NO: 1599186 - RNA, 14 nt, Homo sapiens
aucugugaagccuu

SEQ ID NO: 1599187 - RNA, 15 nt, Homo sapiens
aucugugaccuguca

SEQ ID NO: 1599188 - RNA, 15 nt, Homo sapiens
aucugugccugagaa

SEQ ID NO: 1599189 - RNA, 21 nt, Homo sapiens
aucugugcuuuccagcucacc

SEQ ID NO: 1599190 - RNA, 11 nt, Homo sapiens
aucuguuccuu

SEQ ID NO: 1599191 - RNA, 14 nt, Homo sapiens
aucuguucugggug

SEQ ID NO: 1599192 - RNA, 11 nt, Homo sapiens
aucuguugccu

SEQ ID NO: 1599193 - RNA, 20 nt, Homo sapiens
aucuguuuguuacugcauca

SEQ ID NO: 1599194 - RNA, 19 nt, Homo sapiens
aucuuaauauaaauucacu

SEQ ID NO: 1599195 - RNA, 12 nt, Homo sapiens
aucuuaauguau

SEQ ID NO: 1599196 - RNA, 13 nt, Homo sapiens
aucuuaguguuca

SEQ ID NO: 1599197 - RNA, 15 nt, Homo sapiens
aucuuauuuaggaag

SEQ ID NO: 1599198 - RNA, 14 nt, Homo sapiens
aggaaaagucccaa

SEQ ID NO: 1599199 - RNA, 20 nt, Homo sapiens
aggaaacuccacaucugccu

SEQ ID NO: 1599200 - RNA, 14 nt, Homo sapiens
aggaaacugaguca

SEQ ID NO: 1599201 - RNA, 23 nt, Homo sapiens
aggaaagagagcaccacgugaug

SEQ ID NO: 1599202 - RNA, 22 nt, Homo sapiens
aggaaagauuugugaacuggaa

SEQ ID NO: 1599203 - RNA, 16 nt, Homo sapiens
aggaaaggaugaucaa

SEQ ID NO: 1599204 - RNA, 16 nt, Homo sapiens
aggaaaggauuuuacc

SEQ ID NO: 1599205 - RNA, 17 nt, Homo sapiens
agauugauuaaugaacu

SEQ ID NO: 1599206 - RNA, 14 nt, Homo sapiens
agauugcacuauug

SEQ ID NO: 1599207 - RNA, 20 nt, Homo sapiens
agauugcgccauugcacucc

SEQ ID NO: 1599208 - RNA, 23 nt, Homo sapiens
agauugcgccauugcacuccagc

SEQ ID NO: 1599209 - RNA, 13 nt, Homo sapiens
agauuucaucugc

SEQ ID NO: 1599210 - RNA, 16 nt, Homo sapiens
agauuuucuuuugccu

SEQ ID NO: 1599211 - RNA, 21 nt, Homo sapiens
agauuuuuaucuuaauugcaa

SEQ ID NO: 1599212 - RNA, 21 nt, Homo sapiens
agauuuuugagcaaacacuug

SEQ ID NO: 1599213 - RNA, 22 nt, Homo sapiens
agauuuuuuccucugcauuuac

SEQ ID NO: 1599214 - RNA, 17 nt, Homo sapiens
agcaaaaaauaaugaca

SEQ ID NO: 1599215 - RNA, 14 nt, Homo sapiens
agcaaaaugugaua

SEQ ID NO: 1599216 - RNA, 23 nt, Homo sapiens
agcaaauaagucaucugaugaga

SEQ ID NO: 1599217 - RNA, 15 nt, Homo sapiens
agcaaauaggcaaaa

SEQ ID NO: 1599218 - RNA, 15 nt, Homo sapiens
agcaaauaucuuacc

SEQ ID NO: 1599219 - RNA, 23 nt, Homo sapiens
agcaaaugcuacauauaugcaau

SEQ ID NO: 1599220 - RNA, 17 nt, Homo sapiens
agcaaauguuuacugua

SEQ ID NO: 1599221 - RNA, 16 nt, Homo sapiens
agcaacagacucucac

SEQ ID NO: 1599222 - RNA, 20 nt, Homo sapiens
agcaacccuacaguauauaa

SEQ ID NO: 1599223 - RNA, 16 nt, Homo sapiens
agcaacuaggaaaauc

SEQ ID NO: 1599224 - RNA, 13 nt, Homo sapiens
agcaacucagaga

SEQ ID NO: 1599225 - RNA, 13 nt, Homo sapiens
agcaacucuggcc

SEQ ID NO: 1599226 - RNA, 16 nt, Homo sapiens
agcaacucuugauuau

SEQ ID NO: 1599227 - RNA, 23 nt, Homo sapiens
agcaagacaaauuagccauuuca

SEQ ID NO: 1599228 - RNA, 19 nt, Homo sapiens
agcaagcagaugaacuaau

SEQ ID NO: 1599229 - RNA, 17 nt, Homo sapiens
agcaagggacagugagg

SEQ ID NO: 1599230 - RNA, 16 nt, Homo sapiens
agcaagucacuggcca

SEQ ID NO: 1599231 - RNA, 19 nt, Homo sapiens
agcaagucacuggccagug

SEQ ID NO: 1599232 - RNA, 21 nt, Homo sapiens
agcaaguccucacucuucaag

SEQ ID NO: 1599233 - RNA, 16 nt, Homo sapiens
agcaagugugcacucc

SEQ ID NO: 1599234 - RNA, 14 nt, Homo sapiens
agcaaguuaagugu

SEQ ID NO: 1599235 - RNA, 16 nt, Homo sapiens
agcaauacuguuucca

SEQ ID NO: 1599236 - RNA, 22 nt, Homo sapiens
agcaauauaucugaagagcuau

SEQ ID NO: 1599237 - RNA, 16 nt, Homo sapiens
agcaauaugcauuuaa

SEQ ID NO: 1599238 - RNA, 12 nt, Homo sapiens
agcaauauguca

SEQ ID NO: 1599239 - RNA, 18 nt, Homo sapiens
agcaaucagaauugugcu

SEQ ID NO: 1599240 - RNA, 20 nt, Homo sapiens
agcaaugcaagcagccuagc

SEQ ID NO: 1599241 - RNA, 23 nt, Homo sapiens
agcaauggccagagccucuggcc

SEQ ID NO: 1599242 - RNA, 19 nt, Homo sapiens
agcaauguaaaaaugguuu

SEQ ID NO: 1599243 - RNA, 21 nt, Homo sapiens
agcaaugugccuugauugauu

SEQ ID NO: 1599244 - RNA, 18 nt, Homo sapiens
agcaauuaguaagccaug

SEQ ID NO: 1599245 - RNA, 16 nt, Homo sapiens
agcaauucuccugccu

SEQ ID NO: 1599246 - RNA, 21 nt, Homo sapiens
agcaauuucccccuaaaccaa

SEQ ID NO: 1599247 - RNA, 11 nt, Homo sapiens
agcacacucuu

SEQ ID NO: 1599248 - RNA, 12 nt, Homo sapiens
agcacacuggcu

SEQ ID NO: 1599249 - RNA, 21 nt, Homo sapiens
agcacagaggccugacugacu

SEQ ID NO: 1599250 - RNA, 22 nt, Homo sapiens
agcacauauggaauuuugcaaa

SEQ ID NO: 1599251 - RNA, 18 nt, Homo sapiens
agcacaucaauuacaagc

SEQ ID NO: 1599252 - RNA, 19 nt, Homo sapiens
agcacauucgggccauuuc

SEQ ID NO: 1599253 - RNA, 14 nt, Homo sapiens
agcaccauuaacuc

SEQ ID NO: 1599254 - RNA, 14 nt, Homo sapiens
agcacccauuccaa

SEQ ID NO: 1599255 - RNA, 19 nt, Homo sapiens
agcacccauuucaaugugu

SEQ ID NO: 1599256 - RNA, 14 nt, Homo sapiens
agcaccccaugcca

SEQ ID NO: 1599257 - RNA, 15 nt, Homo sapiens
agcacccuacaggga

SEQ ID NO: 1599258 - RNA, 19 nt, Homo sapiens
agcacccugcccaccaaga

SEQ ID NO: 1599259 - RNA, 20 nt, Homo sapiens
agcacccuggagagugcaca

SEQ ID NO: 1599260 - RNA, 18 nt, Homo sapiens
agcaccuucuuucuggac

SEQ ID NO: 1599261 - RNA, 15 nt, Homo sapiens
agcacggacucuuac

SEQ ID NO: 1599262 - RNA, 20 nt, Homo sapiens
agcacggacugucaguucuc

SEQ ID NO: 1599263 - RNA, 19 nt, Homo sapiens
agcacuaaccaaugccuuu

SEQ ID NO: 1599264 - RNA, 20 nt, Homo sapiens
agcacuagagaaugcacaga

SEQ ID NO: 1599265 - RNA, 17 nt, Homo sapiens
agcacucccuaauuuau

SEQ ID NO: 1599266 - RNA, 20 nt, Homo sapiens
agcacucuguaaaaugcacc

SEQ ID NO: 1599267 - RNA, 19 nt, Homo sapiens
agcacugccccacaugcau

SEQ ID NO: 1599268 - RNA, 17 nt, Homo sapiens
agcacugggugaccagc

SEQ ID NO: 1599269 - RNA, 21 nt, Homo sapiens
agcacugguuucaagaauaug

SEQ ID NO: 1599270 - RNA, 15 nt, Homo sapiens
agcacuugagaacca

SEQ ID NO: 1599271 - RNA, 19 nt, Homo sapiens
agcacuuucauugccagug

SEQ ID NO: 1599272 - RNA, 14 nt, Homo sapiens
agcacuuuguauga

SEQ ID NO: 1599273 - RNA, 17 nt, Homo sapiens
agcagaaaaucuaccaa

SEQ ID NO: 1599274 - RNA, 22 nt, Homo sapiens
agcagaaaguaagcauuuccag

SEQ ID NO: 1599275 - RNA, 20 nt, Homo sapiens
agcagaacacugcagucaga

SEQ ID NO: 1599276 - RNA, 15 nt, Homo sapiens
agcagaagcacauuu

SEQ ID NO: 1599277 - RNA, 14 nt, Homo sapiens
agcagaaggccauc

SEQ ID NO: 1599278 - RNA, 20 nt, Homo sapiens
agcagacacuccaguuugcc

SEQ ID NO: 1599279 - RNA, 16 nt, Homo sapiens
agcagacauuguuaca

SEQ ID NO: 1599280 - RNA, 22 nt, Homo sapiens
agcagagaagguaaggugugaa

SEQ ID NO: 1599281 - RNA, 23 nt, Homo sapiens
agcagagccuacagaagggcagu

SEQ ID NO: 1599282 - RNA, 13 nt, Homo sapiens
agcagcagcacca

SEQ ID NO: 1599283 - RNA, 23 nt, Homo sapiens
agcagccucuggacagccaguga

SEQ ID NO: 1599284 - RNA, 21 nt, Homo sapiens
agcagcgccccucccaagagg

SEQ ID NO: 1599285 - RNA, 21 nt, Homo sapiens
agcagcucuggcucugccuca

SEQ ID NO: 1599286 - RNA, 15 nt, Homo sapiens
agcagcucugugacu

SEQ ID NO: 1599287 - RNA, 18 nt, Homo sapiens
agcagcucuugaaguaua

SEQ ID NO: 1599288 - RNA, 20 nt, Homo sapiens
agcagcuuaaguccagcuca

SEQ ID NO: 1599289 - RNA, 13 nt, Homo sapiens
agcaggacuccag

SEQ ID NO: 1599290 - RNA, 18 nt, Homo sapiens
agcaggagagacugagca

SEQ ID NO: 1599291 - RNA, 16 nt, Homo sapiens
agcagguuaagaauuu

SEQ ID NO: 1599292 - RNA, 23 nt, Homo sapiens
agcagguuucaaggaaguagaaa

SEQ ID NO: 1599293 - RNA, 13 nt, Homo sapiens
agcaguaaacuuu

SEQ ID NO: 1599294 - RNA, 20 nt, Homo sapiens
agcaguaaacuuucucugca

SEQ ID NO: 1599295 - RNA, 16 nt, Homo sapiens
agcaguguuugcucca

SEQ ID NO: 1599296 - RNA, 13 nt, Homo sapiens
agcauaacuuauu

SEQ ID NO: 1599297 - RNA, 20 nt, Homo sapiens
agcauaggaaaccacacaga

SEQ ID NO: 1599298 - RNA, 19 nt, Homo sapiens
agcaucaauacaaccagcc

SEQ ID NO: 1599299 - RNA, 15 nt, Homo sapiens
agcaucaaucuuguu

SEQ ID NO: 1599300 - RNA, 12 nt, Homo sapiens
agcaucagcuca

SEQ ID NO: 1599301 - RNA, 15 nt, Homo sapiens
agcauccagaccuga

SEQ ID NO: 1599302 - RNA, 15 nt, Homo sapiens
agcauccccagccac

SEQ ID NO: 1599303 - RNA, 15 nt, Homo sapiens
agcaucccucaccca

SEQ ID NO: 1599304 - RNA, 16 nt, Homo sapiens
agcauccuucuaagac

SEQ ID NO: 1599305 - RNA, 14 nt, Homo sapiens
agcaucgggagcac

SEQ ID NO: 1599306 - RNA, 17 nt, Homo sapiens
agcaucucccaguucau

SEQ ID NO: 1599307 - RNA, 23 nt, Homo sapiens
agcaucucuucuucccugucagc

SEQ ID NO: 1599308 - RNA, 23 nt, Homo sapiens
agcaugaauaacauuuaaauucc

SEQ ID NO: 1599309 - RNA, 12 nt, Homo sapiens
agcaugcacaug

SEQ ID NO: 1599310 - RNA, 13 nt, Homo sapiens
agcaugcuacagu

SEQ ID NO: 1599311 - RNA, 22 nt, Homo sapiens
agcaugcucaguuggugcugcu

SEQ ID NO: 1599312 - RNA, 18 nt, Homo sapiens
agcauggcucucuauucc

SEQ ID NO: 1599313 - RNA, 22 nt, Homo sapiens
uugaggaaguggcugucccugu

SEQ ID NO: 1599314 - RNA, 18 nt, Homo sapiens
uugaggggcccuggccag

SEQ ID NO: 1599315 - RNA, 20 nt, Homo sapiens
uugagggucguuuugacuac

SEQ ID NO: 1599316 - RNA, 19 nt, Homo sapiens
uugagguucucuauauucg

SEQ ID NO: 1599317 - RNA, 20 nt, Homo sapiens
uugaguaucccuuauccaaa

SEQ ID NO: 1599318 - RNA, 21 nt, Homo sapiens
uugaguccacgcccaccagcc

SEQ ID NO: 1599319 - RNA, 20 nt, Homo sapiens
uugauaacuaugaaaguaac

SEQ ID NO: 1599320 - RNA, 12 nt, Homo sapiens
uugauacuugaa

SEQ ID NO: 1599321 - RNA, 12 nt, Homo sapiens
uugauagucaau

SEQ ID NO: 1599322 - RNA, 16 nt, Homo sapiens
uugaucaccaugaaag

SEQ ID NO: 1599323 - RNA, 13 nt, Homo sapiens
uugaucacuacaa

SEQ ID NO: 1599324 - RNA, 14 nt, Homo sapiens
uugaucacuacaag

SEQ ID NO: 1599325 - RNA, 18 nt, Homo sapiens
uugaugaguuaacuguga

SEQ ID NO: 1599326 - RNA, 23 nt, Homo sapiens
uugauguauauaucuauuauuca

SEQ ID NO: 1599327 - RNA, 18 nt, Homo sapiens
uugauuaaaauucaggaa

SEQ ID NO: 1599328 - RNA, 14 nt, Homo sapiens
uugauucuccuuca

SEQ ID NO: 1599329 - RNA, 20 nt, Homo sapiens
uugauuugcucuuacuacag

SEQ ID NO: 1599330 - RNA, 21 nt, Homo sapiens
uugauuuuauuuuuucucugu

SEQ ID NO: 1599331 - RNA, 15 nt, Homo sapiens
uugcaaaguacugua

SEQ ID NO: 1599332 - RNA, 16 nt, Homo sapiens
uugcaaaucuugaaau

SEQ ID NO: 1599333 - RNA, 14 nt, Homo sapiens
uugcaaccucgcug

SEQ ID NO: 1599334 - RNA, 23 nt, Homo sapiens
uugcaaggauuacacauuucacu

SEQ ID NO: 1599335 - RNA, 10 nt, Homo sapiens
uugcaauacc

SEQ ID NO: 1599336 - RNA, 21 nt, Homo sapiens
uugcaauaccaauguucuaaa

SEQ ID NO: 1599337 - RNA, 16 nt, Homo sapiens
uugcaaucuucuacuu

SEQ ID NO: 1599338 - RNA, 14 nt, Homo sapiens
uugcaauguaguca

SEQ ID NO: 1599339 - RNA, 14 nt, Homo sapiens
uugcacacacccug

SEQ ID NO: 1599340 - RNA, 14 nt, Homo sapiens
uugcacagccaaau

SEQ ID NO: 1599341 - RNA, 18 nt, Homo sapiens
uugcagaaaauucugugc

SEQ ID NO: 1599342 - RNA, 16 nt, Homo sapiens
uugcagaaaucacaau

SEQ ID NO: 1599343 - RNA, 20 nt, Homo sapiens
uugcagcggcuccugcaaaa

SEQ ID NO: 1599344 - RNA, 11 nt, Homo sapiens
uugcagcugcu

SEQ ID NO: 1599345 - RNA, 19 nt, Homo sapiens
uugcaggaggcccaaccuc

SEQ ID NO: 1599346 - RNA, 13 nt, Homo sapiens
uugcagggguccc

SEQ ID NO: 1599347 - RNA, 16 nt, Homo sapiens
uugcaggguccucuuc

SEQ ID NO: 1599348 - RNA, 14 nt, Homo sapiens
uugcagugagcuga

SEQ ID NO: 1599349 - RNA, 13 nt, Homo sapiens
uugcauccauugu

SEQ ID NO: 1599350 - RNA, 14 nt, Homo sapiens
uugcauccauuguu

SEQ ID NO: 1599351 - RNA, 14 nt, Homo sapiens
uugcaugcuugcau

SEQ ID NO: 1599352 - RNA, 17 nt, Homo sapiens
uugcauguggccauuac

SEQ ID NO: 1599353 - RNA, 22 nt, Homo sapiens
uugccaaaaucaauacaauccu

SEQ ID NO: 1599354 - RNA, 12 nt, Homo sapiens
uugccacuuaac

SEQ ID NO: 1599355 - RNA, 13 nt, Homo sapiens
uugccauguggac

SEQ ID NO: 1599356 - RNA, 22 nt, Homo sapiens
uugccauuuagcgaacaaccac

SEQ ID NO: 1599357 - RNA, 21 nt, Homo sapiens
uugcccagccuggaugccauc

SEQ ID NO: 1599358 - RNA, 15 nt, Homo sapiens
uugcccauuuacacu

SEQ ID NO: 1599359 - RNA, 19 nt, Homo sapiens
uugccccacucaucugccg

SEQ ID NO: 1599360 - RNA, 13 nt, Homo sapiens
uugccgagcccag

SEQ ID NO: 1599361 - RNA, 17 nt, Homo sapiens
uugccgugagcaugcac

SEQ ID NO: 1599362 - RNA, 18 nt, Homo sapiens
uuacauguuuuuucauuu

SEQ ID NO: 1599363 - RNA, 15 nt, Homo sapiens
uuaccaaagcaucaa

SEQ ID NO: 1599364 - RNA, 20 nt, Homo sapiens
uuaccaaagcaucaauacaa

SEQ ID NO: 1599365 - RNA, 20 nt, Homo sapiens
uuaccaggcaccaaaagaag

SEQ ID NO: 1599366 - RNA, 21 nt, Homo sapiens
uuaccaggcacugguuguuga

SEQ ID NO: 1599367 - RNA, 14 nt, Homo sapiens
uuaccaugcucaau

SEQ ID NO: 1599368 - RNA, 19 nt, Homo sapiens
uuacccaggcuggagugca

SEQ ID NO: 1599369 - RNA, 13 nt, Homo sapiens
uuacccagugccg

SEQ ID NO: 1599370 - RNA, 22 nt, Homo sapiens
uuaccccuuuucggccccaugu

SEQ ID NO: 1599371 - RNA, 22 nt, Homo sapiens
uuaccugaaauaaaauucauua

SEQ ID NO: 1599372 - RNA, 19 nt, Homo sapiens
uuaccuuguuaagacaaaa

SEQ ID NO: 1599373 - RNA, 15 nt, Homo sapiens
uuacuacuaagagaa

SEQ ID NO: 1599374 - RNA, 21 nt, Homo sapiens
uuacuagccucaaaauacauc

SEQ ID NO: 1599375 - RNA, 15 nt, Homo sapiens
uuacuaguacuauua

SEQ ID NO: 1599376 - RNA, 16 nt, Homo sapiens
uuacuaucauaauuca

SEQ ID NO: 1599377 - RNA, 20 nt, Homo sapiens
uuacucaauaaaacuuuaaa

SEQ ID NO: 1599378 - RNA, 23 nt, Homo sapiens
uuacucacaccuguaaucccagc

SEQ ID NO: 1599379 - RNA, 14 nt, Homo sapiens
uuacuccaccauca

SEQ ID NO: 1599380 - RNA, 19 nt, Homo sapiens
uuacuccaccaucaccucu

SEQ ID NO: 1599381 - RNA, 23 nt, Homo sapiens
uuacucuauacauucaacagaga

SEQ ID NO: 1599382 - RNA, 21 nt, Homo sapiens
uuacuggaauucuucugcaac

SEQ ID NO: 1599383 - RNA, 17 nt, Homo sapiens
uuacuggacaaagaauu

SEQ ID NO: 1599384 - RNA, 15 nt, Homo sapiens
uuacuguagccucag

SEQ ID NO: 1599385 - RNA, 14 nt, Homo sapiens
uuacuguggauaaa

SEQ ID NO: 1599386 - RNA, 19 nt, Homo sapiens
uuacuuuuuugguacuaua

SEQ ID NO: 1599387 - RNA, 16 nt, Homo sapiens
uuagaaacagugcaac

SEQ ID NO: 1599388 - RNA, 17 nt, Homo sapiens
uuagaaacagugcaaca

SEQ ID NO: 1599389 - RNA, 16 nt, Homo sapiens
uuagaaccacagcaga

SEQ ID NO: 1599390 - RNA, 14 nt, Homo sapiens
uuagaagacaauuu

SEQ ID NO: 1599391 - RNA, 18 nt, Homo sapiens
uuagaagccaacuaugau

SEQ ID NO: 1599392 - RNA, 20 nt, Homo sapiens
uuagaauaaaucaaauauuc

SEQ ID NO: 1599393 - RNA, 16 nt, Homo sapiens
uuagaauguugaaaag

SEQ ID NO: 1599394 - RNA, 17 nt, Homo sapiens
uuagaauuaccauuugu

SEQ ID NO: 1599395 - RNA, 13 nt, Homo sapiens
uuagacacuuugg

SEQ ID NO: 1599396 - RNA, 15 nt, Homo sapiens
uuagacccugcauuu

SEQ ID NO: 1599397 - RNA, 23 nt, Homo sapiens
uuagacucaugguguguuacaca

SEQ ID NO: 1599398 - RNA, 13 nt, Homo sapiens
uuagagaaacuga

SEQ ID NO: 1599399 - RNA, 22 nt, Homo sapiens
uuagagccaggcacacacugug

SEQ ID NO: 1599400 - RNA, 22 nt, Homo sapiens
uuagaggagaaaaagcuuaaug

SEQ ID NO: 1599401 - RNA, 23 nt, Homo sapiens
uuagaguauuccucaaaacugua

SEQ ID NO: 1599402 - RNA, 17 nt, Homo sapiens
uuagaucuuauauuggu

SEQ ID NO: 1599403 - RNA, 22 nt, Homo sapiens
uuagcaaacuguuuugacaaau

SEQ ID NO: 1599404 - RNA, 18 nt, Homo sapiens
uuagcaacaguuaucaca

SEQ ID NO: 1599405 - RNA, 16 nt, Homo sapiens
uuagcauguuguugaa

SEQ ID NO: 1599406 - RNA, 16 nt, Homo sapiens
uuagccagauuugucu

SEQ ID NO: 1599407 - RNA, 17 nt, Homo sapiens
uuagccagguaauguga

SEQ ID NO: 1599408 - RNA, 16 nt, Homo sapiens
uuagccauuucacucu

SEQ ID NO: 1599409 - RNA, 22 nt, Homo sapiens
uuagccauuuuucaaagcaauu

SEQ ID NO: 1599410 - RNA, 18 nt, Homo sapiens
uuaggaaaugucaucaaa

SEQ ID NO: 1599411 - RNA, 14 nt, Homo sapiens
uuaggaccaggaga

SEQ ID NO: 1599412 - RNA, 18 nt, Homo sapiens
uuaggauuuucacauucu

SEQ ID NO: 1599413 - RNA, 23 nt, Homo sapiens
uuaggauuuucacauucuuggcu

SEQ ID NO: 1599414 - RNA, 15 nt, Homo sapiens
uuaggcuggaaaugg

SEQ ID NO: 1599415 - RNA, 18 nt, Homo sapiens
uuaguauuuaacuacauc

SEQ ID NO: 1599416 - RNA, 15 nt, Homo sapiens
uuagugauggagcuu

SEQ ID NO: 1599417 - RNA, 14 nt, Homo sapiens
uuagugcagccaag

SEQ ID NO: 1599418 - RNA, 13 nt, Homo sapiens
uuaguguguaaaa

SEQ ID NO: 1599419 - RNA, 18 nt, Homo sapiens
uuaguguguaaaauuaau

SEQ ID NO: 1599420 - RNA, 19 nt, Homo sapiens
uuaguguuugaaauugaau

SEQ ID NO: 1599421 - RNA, 18 nt, Homo sapiens
uucagaaaucaaacugcu

SEQ ID NO: 1599422 - RNA, 19 nt, Homo sapiens
uucagaaaucaaacugcuu

SEQ ID NO: 1599423 - RNA, 19 nt, Homo sapiens
uucagaacagaggcauuua

SEQ ID NO: 1599424 - RNA, 21 nt, Homo sapiens
uucagaacuaaauuuuucaua

SEQ ID NO: 1599425 - RNA, 18 nt, Homo sapiens
uucagacuuggacuauga

SEQ ID NO: 1599426 - RNA, 17 nt, Homo sapiens
uucagaguccuugcaaa

SEQ ID NO: 1599427 - RNA, 17 nt, Homo sapiens
uucagagucucugauac

SEQ ID NO: 1599428 - RNA, 19 nt, Homo sapiens
uucagaugauucuaugucu

SEQ ID NO: 1599429 - RNA, 14 nt, Homo sapiens
uucagauuugccuu

SEQ ID NO: 1599430 - RNA, 22 nt, Homo sapiens
uucagcagagaagguaaggugu

SEQ ID NO: 1599431 - RNA, 17 nt, Homo sapiens
uucagcaguuucugaca

SEQ ID NO: 1599432 - RNA, 19 nt, Homo sapiens
uucagccaaaacauaccau

SEQ ID NO: 1599433 - RNA, 16 nt, Homo sapiens
uucagccugaaagagg

SEQ ID NO: 1599434 - RNA, 15 nt, Homo sapiens
uucagcugcaauaaa

SEQ ID NO: 1599435 - RNA, 19 nt, Homo sapiens
uucagcuucuaugcauuaa

SEQ ID NO: 1599436 - RNA, 17 nt, Homo sapiens
uucaggagaaucuacac

SEQ ID NO: 1599437 - RNA, 14 nt, Homo sapiens
uucaggccagugug

SEQ ID NO: 1599438 - RNA, 15 nt, Homo sapiens
uucagggaacugcau

SEQ ID NO: 1599439 - RNA, 20 nt, Homo sapiens
uucaggugcuggagaaucug

SEQ ID NO: 1599440 - RNA, 22 nt, Homo sapiens
uucaguauuaaauuagauaucu

SEQ ID NO: 1599441 - RNA, 17 nt, Homo sapiens
uucagucaaaacuuuaa

SEQ ID NO: 1599442 - RNA, 22 nt, Homo sapiens
uucagucaaagauacacaaucu

SEQ ID NO: 1599443 - RNA, 15 nt, Homo sapiens
uucagucuuauuuac

SEQ ID NO: 1599444 - RNA, 16 nt, Homo sapiens
uucaguuuuucacuuc

SEQ ID NO: 1599445 - RNA, 21 nt, Homo sapiens
uucauaaaaaauaaugguguc

SEQ ID NO: 1599446 - RNA, 22 nt, Homo sapiens
uucauaaucccaaucuaauuau

SEQ ID NO: 1599447 - RNA, 20 nt, Homo sapiens
uucauacuauuaagauucua

SEQ ID NO: 1599448 - RNA, 12 nt, Homo sapiens
uucauacuguac

SEQ ID NO: 1599449 - RNA, 18 nt, Homo sapiens
uucauauuuauugauuaa

SEQ ID NO: 1599450 - RNA, 19 nt, Homo sapiens
uucauauuuauugauuaaa

SEQ ID NO: 1599451 - RNA, 20 nt, Homo sapiens
uucaucccguaucacagugu

SEQ ID NO: 1599452 - RNA, 15 nt, Homo sapiens
uucauccuugacuaa

SEQ ID NO: 1599453 - RNA, 22 nt, Homo sapiens
uucaucgacuuagccugaguca

SEQ ID NO: 1599454 - RNA, 16 nt, Homo sapiens
uucaucugcucuccuu

SEQ ID NO: 1599455 - RNA, 18 nt, Homo sapiens
uucaucugcucuccuucc

SEQ ID NO: 1599456 - RNA, 20 nt, Homo sapiens
uucaucugugggaugcugaa

SEQ ID NO: 1599457 - RNA, 18 nt, Homo sapiens
uucaucuucacugcaauu

SEQ ID NO: 1599458 - RNA, 19 nt, Homo sapiens
uucaugauuagcaaguuac

SEQ ID NO: 1599459 - RNA, 21 nt, Homo sapiens
uucaugcagccuaaaguacag

SEQ ID NO: 1599460 - RNA, 22 nt, Homo sapiens
uucaugcagccuaaaguacagc

SEQ ID NO: 1599461 - RNA, 16 nt, Homo sapiens
uucaugcucugcaaaa

SEQ ID NO: 1599462 - RNA, 19 nt, Homo sapiens
uucaugcuugacauaccua

SEQ ID NO: 1599463 - RNA, 23 nt, Homo sapiens
uucauggauauguuauacugaac

SEQ ID NO: 1599464 - RNA, 20 nt, Homo sapiens
uucauggcuaccucagaaag

SEQ ID NO: 1599465 - RNA, 16 nt, Homo sapiens
uucauggucugcugag

SEQ ID NO: 1599466 - RNA, 13 nt, Homo sapiens
uucaugucaucaa

SEQ ID NO: 1599467 - RNA, 19 nt, Homo sapiens
uucauguuaguuaccuuau

SEQ ID NO: 1599468 - RNA, 22 nt, Homo sapiens
uucauuaacaaaauguaugucu

SEQ ID NO: 1599469 - RNA, 14 nt, Homo sapiens
uucauuaaugauga

SEQ ID NO: 1599470 - RNA, 15 nt, Homo sapiens
uucauuaguauuccu

SEQ ID NO: 1599471 - RNA, 16 nt, Homo sapiens
uucauuaugcuuugaa

SEQ ID NO: 1599472 - RNA, 19 nt, Homo sapiens
uucauuccuucagauuugg

SEQ ID NO: 1599473 - RNA, 14 nt, Homo sapiens
uucauucugccaaa

SEQ ID NO: 1599474 - RNA, 14 nt, Homo sapiens
uucauuuaucuaua

SEQ ID NO: 1599475 - RNA, 19 nt, Homo sapiens
uuccaaaccaggacacuac

SEQ ID NO: 1599476 - RNA, 20 nt, Homo sapiens
uuccaaagcagccugugaag

SEQ ID NO: 1599477 - RNA, 18 nt, Homo sapiens
uuccaaaugccauccaga

SEQ ID NO: 1599478 - RNA, 12 nt, Homo sapiens
uuccaaauucau

SEQ ID NO: 1599479 - RNA, 20 nt, Homo sapiens
uuccaacauuucucacugaa

SEQ ID NO: 1599480 - RNA, 15 nt, Homo sapiens
uuccaaccggcuuug

SEQ ID NO: 1599481 - RNA, 21 nt, Homo sapiens
uuccaacucgaaucuguguga

SEQ ID NO: 1599482 - RNA, 22 nt, Homo sapiens
uuccaaugcuguggguuuccaa

SEQ ID NO: 1599483 - RNA, 23 nt, Homo sapiens
uguuuuuuuuuuaaaaaagacau

SEQ ID NO: 1599484 - RNA, 13 nt, Homo sapiens
uuaaaaacuacca

SEQ ID NO: 1599485 - RNA, 18 nt, Homo sapiens
uuaaaaacuaccacaugu

SEQ ID NO: 1599486 - RNA, 20 nt, Homo sapiens
uuaaaaaugucuugcuguug

SEQ ID NO: 1599487 - RNA, 19 nt, Homo sapiens
uuaaaacaaaacaaaacaa

SEQ ID NO: 1599488 - RNA, 13 nt, Homo sapiens
uuaaaaccaaaga

SEQ ID NO: 1599489 - RNA, 15 nt, Homo sapiens
uuaaaacuauaacau

SEQ ID NO: 1599490 - RNA, 17 nt, Homo sapiens
uuaaaacuauaacauua

SEQ ID NO: 1599491 - RNA, 16 nt, Homo sapiens
uuaaaacucaucacau

SEQ ID NO: 1599492 - RNA, 16 nt, Homo sapiens
uuaaaacucuggugau

SEQ ID NO: 1599493 - RNA, 15 nt, Homo sapiens
uuaaaacuucaguuu

SEQ ID NO: 1599494 - RNA, 17 nt, Homo sapiens
uuaaaagagaagcauca

SEQ ID NO: 1599495 - RNA, 20 nt, Homo sapiens
uuaaaagagacaaacuguaa

SEQ ID NO: 1599496 - RNA, 20 nt, Homo sapiens
uuaaaaguuugaaaagcaau

SEQ ID NO: 1599497 - RNA, 15 nt, Homo sapiens
uuaaaauaagcauuu

SEQ ID NO: 1599498 - RNA, 14 nt, Homo sapiens
uuaaaauaggauua

SEQ ID NO: 1599499 - RNA, 12 nt, Homo sapiens
uuaaaaugguua

SEQ ID NO: 1599500 - RNA, 15 nt, Homo sapiens
uuaaaauucaauuag

SEQ ID NO: 1599501 - RNA, 21 nt, Homo sapiens
uuaaacaaaauuucacaguuc

SEQ ID NO: 1599502 - RNA, 19 nt, Homo sapiens
uuaaacacacauugcagcu

SEQ ID NO: 1599503 - RNA, 17 nt, Homo sapiens
uuaaacacuaaucacaa

SEQ ID NO: 1599504 - RNA, 18 nt, Homo sapiens
uuaaacauugaaguaaug

SEQ ID NO: 1599505 - RNA, 19 nt, Homo sapiens
uuaaacauuuucauaaaau

SEQ ID NO: 1599506 - RNA, 20 nt, Homo sapiens
uuaaaccagaacccaguguu

SEQ ID NO: 1599507 - RNA, 22 nt, Homo sapiens
uuaaacccaagugcugcacaaa

SEQ ID NO: 1599508 - RNA, 15 nt, Homo sapiens
uuaaacccuuaccaa

SEQ ID NO: 1599509 - RNA, 14 nt, Homo sapiens
uuaaaccuuuccau

SEQ ID NO: 1599510 - RNA, 18 nt, Homo sapiens
uuaaacuauaagcaagaa

SEQ ID NO: 1599511 - RNA, 10 nt, Homo sapiens
uuaaacuggu

SEQ ID NO: 1599512 - RNA, 12 nt, Homo sapiens
uuaaacuugaaa

SEQ ID NO: 1599513 - RNA, 20 nt, Homo sapiens
uuaaacuuucaauugucacu

SEQ ID NO: 1599514 - RNA, 23 nt, Homo sapiens
uuaaacuuucaauugucacuuuu

SEQ ID NO: 1599515 - RNA, 14 nt, Homo sapiens
uuaaacuuugucac

SEQ ID NO: 1599516 - RNA, 17 nt, Homo sapiens
uuaaacuuuuuuaacca

SEQ ID NO: 1599517 - RNA, 14 nt, Homo sapiens
uuaaagaaagaaug

SEQ ID NO: 1599518 - RNA, 15 nt, Homo sapiens
uuaaagaaccaucag

SEQ ID NO: 1599519 - RNA, 17 nt, Homo sapiens
uuaaagacaaauuuugc

SEQ ID NO: 1599520 - RNA, 11 nt, Homo sapiens
uuaaagaccaa

SEQ ID NO: 1599521 - RNA, 13 nt, Homo sapiens
uuaaagagccagu

SEQ ID NO: 1599522 - RNA, 16 nt, Homo sapiens
uuaaagagccaguuua

SEQ ID NO: 1599523 - RNA, 17 nt, Homo sapiens
uuaaagagccaguuuau

SEQ ID NO: 1599524 - RNA, 16 nt, Homo sapiens
uuaaagaugcacagaa

SEQ ID NO: 1599525 - RNA, 16 nt, Homo sapiens
uuaaaguauucuucuc

SEQ ID NO: 1599526 - RNA, 17 nt, Homo sapiens
uuaaaguggcaaucuca

SEQ ID NO: 1599527 - RNA, 15 nt, Homo sapiens
uuaaaguucauugca

SEQ ID NO: 1599528 - RNA, 17 nt, Homo sapiens
uuaaaguuuaaugccua

SEQ ID NO: 1599529 - RNA, 16 nt, Homo sapiens
uuaaauaaaagcacaa

SEQ ID NO: 1599530 - RNA, 19 nt, Homo sapiens
uuaaaucuuuggauuugau

SEQ ID NO: 1599531 - RNA, 15 nt, Homo sapiens
uuaaaugucugaaau

SEQ ID NO: 1599532 - RNA, 14 nt, Homo sapiens
uuaaauuccacaga

SEQ ID NO: 1599533 - RNA, 15 nt, Homo sapiens
uuaacaaaauccuca

SEQ ID NO: 1599534 - RNA, 14 nt, Homo sapiens
uuaacacaucucaa

SEQ ID NO: 1599535 - RNA, 14 nt, Homo sapiens
uuaacaccuaccuc

SEQ ID NO: 1599536 - RNA, 20 nt, Homo sapiens
uuaacacuaaccaaacaaug

SEQ ID NO: 1599537 - RNA, 21 nt, Homo sapiens
uuaacacuuccuauuagugac

SEQ ID NO: 1599538 - RNA, 12 nt, Homo sapiens
uuaacauauguc

SEQ ID NO: 1599539 - RNA, 13 nt, Homo sapiens
uuaacccaaagaa

SEQ ID NO: 1599540 - RNA, 14 nt, Homo sapiens
uuaaccuguuuuca

SEQ ID NO: 1599541 - RNA, 12 nt, Homo sapiens
uuaacucuagaa

SEQ ID NO: 1599542 - RNA, 20 nt, Homo sapiens
uuaacugauuaaaaauaccu

SEQ ID NO: 1599543 - RNA, 21 nt, Homo sapiens
uuaacugugaaauaccacaag

SEQ ID NO: 1599544 - RNA, 22 nt, Homo sapiens
uuaacugugaaauaccacaagc

SEQ ID NO: 1599545 - RNA, 21 nt, Homo sapiens
uuaacuugaggguguagaggu

SEQ ID NO: 1599546 - RNA, 22 nt, Homo sapiens
ugugcacaucuacaugccaugc

SEQ ID NO: 1599547 - RNA, 11 nt, Homo sapiens
ugugcacauuu

SEQ ID NO: 1599548 - RNA, 23 nt, Homo sapiens
ugugcacuuucuucucuuuccca

SEQ ID NO: 1599549 - RNA, 13 nt, Homo sapiens
ugugcagauauca

SEQ ID NO: 1599550 - RNA, 22 nt, Homo sapiens
ugugcaggcugcaguggcuccc

SEQ ID NO: 1599551 - RNA, 22 nt, Homo sapiens
ugugcaguguuuuuccugugua

SEQ ID NO: 1599552 - RNA, 21 nt, Homo sapiens
ugugcauccgccugaaagugu

SEQ ID NO: 1599553 - RNA, 23 nt, Homo sapiens
ugugcccuugggguaagccagag

SEQ ID NO: 1599554 - RNA, 15 nt, Homo sapiens
ugugcuaaaccaagu

SEQ ID NO: 1599555 - RNA, 22 nt, Homo sapiens
ugugcuccuccuacccuuccag

SEQ ID NO: 1599556 - RNA, 17 nt, Homo sapiens
ugugcucggacacaguu

SEQ ID NO: 1599557 - RNA, 20 nt, Homo sapiens
ugugcugcucaaggccacag

SEQ ID NO: 1599558 - RNA, 15 nt, Homo sapiens
ugugcuggacacugu

SEQ ID NO: 1599559 - RNA, 14 nt, Homo sapiens
ugugcuuguuuaca

SEQ ID NO: 1599560 - RNA, 13 nt, Homo sapiens
uguggaauguugg

SEQ ID NO: 1599561 - RNA, 19 nt, Homo sapiens
uguggacuuauucauuccu

SEQ ID NO: 1599562 - RNA, 23 nt, Homo sapiens
uguggaggagagggguggaggcu

SEQ ID NO: 1599563 - RNA, 20 nt, Homo sapiens
uguggaggcuaucaacaaag

SEQ ID NO: 1599564 - RNA, 16 nt, Homo sapiens
uguggaugcgugugaa

SEQ ID NO: 1599565 - RNA, 21 nt, Homo sapiens
uguggcacucagggagcauuu

SEQ ID NO: 1599566 - RNA, 15 nt, Homo sapiens
uguggcagugguuuu

SEQ ID NO: 1599567 - RNA, 15 nt, Homo sapiens
uguggccucaagcaa

SEQ ID NO: 1599568 - RNA, 17 nt, Homo sapiens
ugugggacgaaagcaca

SEQ ID NO: 1599569 - RNA, 15 nt, Homo sapiens
ugugggcuccaugua

SEQ ID NO: 1599570 - RNA, 19 nt, Homo sapiens
uguggucacagccaugaag

SEQ ID NO: 1599571 - RNA, 21 nt, Homo sapiens
ugugguuagcaagacugcaag

SEQ ID NO: 1599572 - RNA, 18 nt, Homo sapiens
ugugguuugguuggggcu

SEQ ID NO: 1599573 - RNA, 21 nt, Homo sapiens
uguguaauaaaguguuuucag

SEQ ID NO: 1599574 - RNA, 12 nt, Homo sapiens
uguguaaucuaa

SEQ ID NO: 1599575 - RNA, 17 nt, Homo sapiens
uguguaaucuaaguaua

SEQ ID NO: 1599576 - RNA, 22 nt, Homo sapiens
uguguaauuuuuuuuccuugcc

SEQ ID NO: 1599577 - RNA, 18 nt, Homo sapiens
uguguacauguaguugaa

SEQ ID NO: 1599578 - RNA, 20 nt, Homo sapiens
uguguacuucuucauccaua

SEQ ID NO: 1599579 - RNA, 23 nt, Homo sapiens
uguguaucaguguuuaugugcua

SEQ ID NO: 1599580 - RNA, 16 nt, Homo sapiens
ugugucagccaugacc

SEQ ID NO: 1599581 - RNA, 19 nt, Homo sapiens
ugugucccccucuguccag

SEQ ID NO: 1599582 - RNA, 18 nt, Homo sapiens
ugugucgcuuaugucuau

SEQ ID NO: 1599583 - RNA, 19 nt, Homo sapiens
ugugucgcuuaugucuaua

SEQ ID NO: 1599584 - RNA, 16 nt, Homo sapiens
ugugugccuauagucc

SEQ ID NO: 1599585 - RNA, 18 nt, Homo sapiens
ugugugggacuguacaca

SEQ ID NO: 1599586 - RNA, 12 nt, Homo sapiens
uguguguuucaa

SEQ ID NO: 1599587 - RNA, 19 nt, Homo sapiens
uguguguuuguguguuuca

SEQ ID NO: 1599588 - RNA, 21 nt, Homo sapiens
uguguuaggacagcauauaaa

SEQ ID NO: 1599589 - RNA, 22 nt, Homo sapiens
uguguuccuuuuugcagcaauu

SEQ ID NO: 1599590 - RNA, 18 nt, Homo sapiens
uguguucugucaccaacu

SEQ ID NO: 1599591 - RNA, 22 nt, Homo sapiens
uguguucugucaccaacugaag

SEQ ID NO: 1599592 - RNA, 19 nt, Homo sapiens
uguguugaagcacuguugg

SEQ ID NO: 1599593 - RNA, 13 nt, Homo sapiens
uguguugccacag

SEQ ID NO: 1599594 - RNA, 15 nt, Homo sapiens
uguuaaaaccaaacu

SEQ ID NO: 1599595 - RNA, 21 nt, Homo sapiens
uguuaacuuuuguaccaaaua

SEQ ID NO: 1599596 - RNA, 20 nt, Homo sapiens
uguuaauaaaaguacauguu

SEQ ID NO: 1599597 - RNA, 18 nt, Homo sapiens
uguuaauauaccccaaau

SEQ ID NO: 1599598 - RNA, 15 nt, Homo sapiens
uguuaccaaaucuca

SEQ ID NO: 1599599 - RNA, 23 nt, Homo sapiens
uguuaccugaaaacacugugcac

SEQ ID NO: 1599600 - RNA, 18 nt, Homo sapiens
uguuacuuuuaguucuau

SEQ ID NO: 1599601 - RNA, 20 nt, Homo sapiens
uguuaggaaaugucaucaaa

SEQ ID NO: 1599602 - RNA, 22 nt, Homo sapiens
uguuaggagaugucaucaagcu

SEQ ID NO: 1599603 - RNA, 18 nt, Homo sapiens
uguuaguauuaacuauua

SEQ ID NO: 1599604 - RNA, 19 nt, Homo sapiens
uguuauaacucugcacuac

SEQ ID NO: 1599605 - RNA, 19 nt, Homo sapiens
uguuauauagccaauauaa

SEQ ID NO: 1599606 - RNA, 15 nt, Homo sapiens
uguuaucagucaaua

SEQ ID NO: 1599607 - RNA, 14 nt, Homo sapiens
uguuauucauuugg

SEQ ID NO: 1599608 - RNA, 14 nt, Homo sapiens
uguucaaggcagug

SEQ ID NO: 1599609 - RNA, 21 nt, Homo sapiens
uguucacuucuaaaccaaaaa

SEQ ID NO: 1599610 - RNA, 17 nt, Homo sapiens
uguaggaaaagaggcca

SEQ ID NO: 1599611 - RNA, 14 nt, Homo sapiens
uguaggcauuuuaa

SEQ ID NO: 1599612 - RNA, 21 nt, Homo sapiens
uguaggcuaaaaggcuuccag

SEQ ID NO: 1599613 - RNA, 16 nt, Homo sapiens
uguaggguaaggugcc

SEQ ID NO: 1599614 - RNA, 22 nt, Homo sapiens
uguaggucauugcaccuaucuc

SEQ ID NO: 1599615 - RNA, 21 nt, Homo sapiens
uguagucccagcuacuuggga

SEQ ID NO: 1599616 - RNA, 15 nt, Homo sapiens
uguauaagcuacuca

SEQ ID NO: 1599617 - RNA, 18 nt, Homo sapiens
uguauacauuacaucuga

SEQ ID NO: 1599618 - RNA, 15 nt, Homo sapiens
uguauaccagccuac

SEQ ID NO: 1599619 - RNA, 17 nt, Homo sapiens
uguauacuccugucacc

SEQ ID NO: 1599620 - RNA, 18 nt, Homo sapiens
uguauauaaacauaucaa

SEQ ID NO: 1599621 - RNA, 14 nt, Homo sapiens
uguauauaugugua

SEQ ID NO: 1599622 - RNA, 15 nt, Homo sapiens
uguaucaaaugugac

SEQ ID NO: 1599623 - RNA, 19 nt, Homo sapiens
uguauccauccauggggcu

SEQ ID NO: 1599624 - RNA, 11 nt, Homo sapiens
uguaugccaau

SEQ ID NO: 1599625 - RNA, 21 nt, Homo sapiens
uguaugcugauuuacuacuua

SEQ ID NO: 1599626 - RNA, 20 nt, Homo sapiens
uguauggugauaaaagucac

SEQ ID NO: 1599627 - RNA, 20 nt, Homo sapiens
uguauguaauacauauagca

SEQ ID NO: 1599628 - RNA, 18 nt, Homo sapiens
uguauuccugccuuugau

SEQ ID NO: 1599629 - RNA, 14 nt, Homo sapiens
uguauucgugcauu

SEQ ID NO: 1599630 - RNA, 23 nt, Homo sapiens
uguauucuguuugcguacuugua

SEQ ID NO: 1599631 - RNA, 15 nt, Homo sapiens
uguauuuaagcaaau

SEQ ID NO: 1599632 - RNA, 17 nt, Homo sapiens
uguauuucaaauaucua

SEQ ID NO: 1599633 - RNA, 16 nt, Homo sapiens
uguauuuucauaguga

SEQ ID NO: 1599634 - RNA, 24 nt, Homo sapiens
ugucaaaauuguuuaccauagaaa

SEQ ID NO: 1599635 - RNA, 16 nt, Homo sapiens
ugucaaacaguaauaa

SEQ ID NO: 1599636 - RNA, 17 nt, Homo sapiens
ugucaaagaaggugcug

SEQ ID NO: 1599637 - RNA, 21 nt, Homo sapiens
ugucaacaaagugcuuuuuca

SEQ ID NO: 1599638 - RNA, 13 nt, Homo sapiens
ugucaacauuugg

SEQ ID NO: 1599639 - RNA, 21 nt, Homo sapiens
ugucaacuggagugcucucuc

SEQ ID NO: 1599640 - RNA, 20 nt, Homo sapiens
ugucaagccugugcaaaaaa

SEQ ID NO: 1599641 - RNA, 21 nt, Homo sapiens
ugucaauaaaaccacuguaca

SEQ ID NO: 1599642 - RNA, 19 nt, Homo sapiens
ugucaauugcaccaaaaga

SEQ ID NO: 1599643 - RNA, 20 nt, Homo sapiens
ugucacaauacaguaaguaa

SEQ ID NO: 1599644 - RNA, 20 nt, Homo sapiens
ugucacagaugaagacauca

SEQ ID NO: 1599645 - RNA, 23 nt, Homo sapiens
ugucaccaacugaaguggcuaaa

SEQ ID NO: 1599646 - RNA, 16 nt, Homo sapiens
ugucaccucagcacug

SEQ ID NO: 1599647 - RNA, 19 nt, Homo sapiens
ugucacgccagacuuccca

SEQ ID NO: 1599648 - RNA, 16 nt, Homo sapiens
ugucacuuaauaauca

SEQ ID NO: 1599649 - RNA, 19 nt, Homo sapiens
ugucacuugccacauggug

SEQ ID NO: 1599650 - RNA, 17 nt, Homo sapiens
ugucagauguacauaga

SEQ ID NO: 1599651 - RNA, 22 nt, Homo sapiens
ugucagcaaacggugaccagca

SEQ ID NO: 1599652 - RNA, 19 nt, Homo sapiens
ugucauagaaauauugacu

SEQ ID NO: 1599653 - RNA, 20 nt, Homo sapiens
ugucauagaagaaaauccau

SEQ ID NO: 1599654 - RNA, 14 nt, Homo sapiens
ugucauauguagcc

SEQ ID NO: 1599655 - RNA, 22 nt, Homo sapiens
ugucaucaaaaucugcacaguc

SEQ ID NO: 1599656 - RNA, 21 nt, Homo sapiens
ugucaucaucacccuuucauu

SEQ ID NO: 1599657 - RNA, 22 nt, Homo sapiens
ugucauguaaggcuuaacacag

SEQ ID NO: 1599658 - RNA, 21 nt, Homo sapiens
ugucauucuguuagauacuaa

SEQ ID NO: 1599659 - RNA, 18 nt, Homo sapiens
ugucauugucuacuccua

SEQ ID NO: 1599660 - RNA, 23 nt, Homo sapiens
ugucauuuuuauaaaacuuugaa

SEQ ID NO: 1599661 - RNA, 11 nt, Homo sapiens
uguccaaagag

SEQ ID NO: 1599662 - RNA, 21 nt, Homo sapiens
uguccacccaccuaugugcca

SEQ ID NO: 1599663 - RNA, 17 nt, Homo sapiens
uguccaggcacugagau

SEQ ID NO: 1599664 - RNA, 16 nt, Homo sapiens
uguccaugccuuccau

SEQ ID NO: 1599665 - RNA, 14 nt, Homo sapiens
uguccauuuacacg

SEQ ID NO: 1599666 - RNA, 14 nt, Homo sapiens
ugucccaagugcca

SEQ ID NO: 1599667 - RNA, 18 nt, Homo sapiens
ugucccaccccuaccucu

SEQ ID NO: 1599668 - RNA, 15 nt, Homo sapiens
ugucccagaaaagca

SEQ ID NO: 1599669 - RNA, 19 nt, Homo sapiens
uguccccagccuaccucuc

SEQ ID NO: 1599670 - RNA, 16 nt, Homo sapiens
ugucccgggacaccua

SEQ ID NO: 1599671 - RNA, 23 nt, Homo sapiens
ugucccugcccaggccucuggcu

SEQ ID NO: 1599672 - RNA, 19 nt, Homo sapiens
uguccuaaucauacaccag

SEQ ID NO: 1599673 - RNA, 20 nt, Homo sapiens
uguccuaaucauacaccaga

SEQ ID NO: 1599674 - RNA, 14 nt, Homo sapiens
uguccuaugcaaua

SEQ ID NO: 1599675 - RNA, 16 nt, Homo sapiens
uguccugcaucaucuu

SEQ ID NO: 1599676 - RNA, 14 nt, Homo sapiens
ugaauuucaguccu

SEQ ID NO: 1599677 - RNA, 19 nt, Homo sapiens
ugaauuugcaaaguacugu

SEQ ID NO: 1599678 - RNA, 23 nt, Homo sapiens
ugaauuugcaaaguacuguaaga

SEQ ID NO: 1599679 - RNA, 21 nt, Homo sapiens
ugaauuuucaaguaauuguga

SEQ ID NO: 1599680 - RNA, 17 nt, Homo sapiens
ugaauuuuuaagcaaau

SEQ ID NO: 1599681 - RNA, 15 nt, Homo sapiens
ugaauuuuugcaaua

SEQ ID NO: 1599682 - RNA, 14 nt, Homo sapiens
ugacaaaagaaaau

SEQ ID NO: 1599683 - RNA, 20 nt, Homo sapiens
ugacaaaagaaaauuuucca

SEQ ID NO: 1599684 - RNA, 18 nt, Homo sapiens
ugacaaaauucauuugcu

SEQ ID NO: 1599685 - RNA, 14 nt, Homo sapiens
ugacaacaguuuua

SEQ ID NO: 1599686 - RNA, 15 nt, Homo sapiens
ugacaacuguuuaau

SEQ ID NO: 1599687 - RNA, 13 nt, Homo sapiens
ugacaagaacaaa

SEQ ID NO: 1599688 - RNA, 19 nt, Homo sapiens
ugacaagggcacaagcuca

SEQ ID NO: 1599689 - RNA, 24 nt, Homo sapiens
ugacaauccuugagaaucuuugca

SEQ ID NO: 1599690 - RNA, 16 nt, Homo sapiens
ugacaauuuauggaag

SEQ ID NO: 1599691 - RNA, 19 nt, Homo sapiens
ugacaauuuauguggauuu

SEQ ID NO: 1599692 - RNA, 16 nt, Homo sapiens
ugacaccuggugcuuu

SEQ ID NO: 1599693 - RNA, 16 nt, Homo sapiens
ugacaccuuaguuccu

SEQ ID NO: 1599694 - RNA, 10 nt, Homo sapiens
ugacacugaa

SEQ ID NO: 1599695 - RNA, 18 nt, Homo sapiens
ugacacuuuaauuaccaa

SEQ ID NO: 1599696 - RNA, 22 nt, Homo sapiens
ugacagagugagacccugucuc

SEQ ID NO: 1599697 - RNA, 14 nt, Homo sapiens
ugacagcacuacaa

SEQ ID NO: 1599698 - RNA, 17 nt, Homo sapiens
ugacaguccacaggggc

SEQ ID NO: 1599699 - RNA, 20 nt, Homo sapiens
ugacagugaagcagcacugu

SEQ ID NO: 1599700 - RNA, 23 nt, Homo sapiens
ugacagugaagcagcacugugag

SEQ ID NO: 1599701 - RNA, 13 nt, Homo sapiens
ugacauacauauu

SEQ ID NO: 1599702 - RNA, 12 nt, Homo sapiens
ugacauaccuac

SEQ ID NO: 1599703 - RNA, 23 nt, Homo sapiens
ugacaugccuauaugagaagaau

SEQ ID NO: 1599704 - RNA, 16 nt, Homo sapiens
ugacauguaagaaaau

SEQ ID NO: 1599705 - RNA, 17 nt, Homo sapiens
ugacauuauaugcacua

SEQ ID NO: 1599706 - RNA, 15 nt, Homo sapiens
ugacauugccaaaaa

SEQ ID NO: 1599707 - RNA, 17 nt, Homo sapiens
ugacauugcguuugacc

SEQ ID NO: 1599708 - RNA, 23 nt, Homo sapiens
ugacauugcguuugaccuuuuau

SEQ ID NO: 1599709 - RNA, 18 nt, Homo sapiens
ugacauuuguauucucag

SEQ ID NO: 1599710 - RNA, 18 nt, Homo sapiens
uagauuugaaaauuguau

SEQ ID NO: 1599711 - RNA, 13 nt, Homo sapiens
uagcaaagcaaaa

SEQ ID NO: 1599712 - RNA, 23 nt, Homo sapiens
uagcaaagcaaaaggcugagaag

SEQ ID NO: 1599713 - RNA, 20 nt, Homo sapiens
uagcaaauguuuacuguauc

SEQ ID NO: 1599714 - RNA, 13 nt, Homo sapiens
uagcaacuacagu

SEQ ID NO: 1599715 - RNA, 20 nt, Homo sapiens
uagcaagacugcaagagaug

SEQ ID NO: 1599716 - RNA, 14 nt, Homo sapiens
uagcaauacaggga

SEQ ID NO: 1599717 - RNA, 14 nt, Homo sapiens
uagcaccccuacuc

SEQ ID NO: 1599718 - RNA, 23 nt, Homo sapiens
uagcacccuggagagugcacaug

SEQ ID NO: 1599719 - RNA, 14 nt, Homo sapiens
uagcacuaggcacc

SEQ ID NO: 1599720 - RNA, 19 nt, Homo sapiens
uagcagagaacugccuuaa

SEQ ID NO: 1599721 - RNA, 14 nt, Homo sapiens
uagcagauggagua

SEQ ID NO: 1599722 - RNA, 14 nt, Homo sapiens
uagcagcagaugua

SEQ ID NO: 1599723 - RNA, 15 nt, Homo sapiens
uagcagggauagauu

SEQ ID NO: 1599724 - RNA, 19 nt, Homo sapiens
uagcaguuuagaauggagg

SEQ ID NO: 1599725 - RNA, 19 nt, Homo sapiens
uagcauuuggaaaccacua

SEQ ID NO: 1599726 - RNA, 21 nt, Homo sapiens
uagccagauuugucuuuuugu

SEQ ID NO: 1599727 - RNA, 17 nt, Homo sapiens
uagccagcugugcacuu

SEQ ID NO: 1599728 - RNA, 17 nt, Homo sapiens
uagccaucaagcacuuc

SEQ ID NO: 1599729 - RNA, 16 nt, Homo sapiens
uagccaucauaacuca

SEQ ID NO: 1599730 - RNA, 21 nt, Homo sapiens
uagccauuuuucaaagcaauu

SEQ ID NO: 1599731 - RNA, 14 nt, Homo sapiens
uagcccagugcuuc

SEQ ID NO: 1599732 - RNA, 14 nt, Homo sapiens
uagccccauuacac

SEQ ID NO: 1599733 - RNA, 13 nt, Homo sapiens
uagcccugcauuu

SEQ ID NO: 1599734 - RNA, 18 nt, Homo sapiens
uagccugggcucacugug

SEQ ID NO: 1599735 - RNA, 17 nt, Homo sapiens
uagcgucaagacauuug

SEQ ID NO: 1599736 - RNA, 17 nt, Homo sapiens
uagcuagaagugggcca

SEQ ID NO: 1599737 - RNA, 11 nt, Homo sapiens
uagcuaggcau

SEQ ID NO: 1599738 - RNA, 11 nt, Homo sapiens
uagcuccacuc

SEQ ID NO: 1599739 - RNA, 21 nt, Homo sapiens
uagcuccccuggcuggcuccu

SEQ ID NO: 1599740 - RNA, 18 nt, Homo sapiens
uagcugaaccgacacuca

SEQ ID NO: 1599741 - RNA, 12 nt, Homo sapiens
ugauacacagua

SEQ ID NO: 1599742 - RNA, 11 nt, Homo sapiens
ugauacauuuu

SEQ ID NO: 1599743 - RNA, 18 nt, Homo sapiens
ugauacugauuaugaaau

SEQ ID NO: 1599744 - RNA, 19 nt, Homo sapiens
ugauacuggcucagaagaa

SEQ ID NO: 1599745 - RNA, 17 nt, Homo sapiens
ugauacuuugacagugu

SEQ ID NO: 1599746 - RNA, 18 nt, Homo sapiens
ugauacuuugacaguguu

SEQ ID NO: 1599747 - RNA, 21 nt, Homo sapiens
ugauagaagugcauucuccuc

SEQ ID NO: 1599748 - RNA, 20 nt, Homo sapiens
ugauagauuucuacacugag

SEQ ID NO: 1599749 - RNA, 18 nt, Homo sapiens
ugauaggaggacaaccau

SEQ ID NO: 1599750 - RNA, 16 nt, Homo sapiens
ugauaguucaguccca

SEQ ID NO: 1599751 - RNA, 19 nt, Homo sapiens
ugauauaacacuuuccagc

SEQ ID NO: 1599752 - RNA, 14 nt, Homo sapiens
ugauauacacagug

SEQ ID NO: 1599753 - RNA, 14 nt, Homo sapiens
ugauauauucuuga

SEQ ID NO: 1599754 - RNA, 21 nt, Homo sapiens
ugauauauucuugaagacauc

SEQ ID NO: 1599755 - RNA, 14 nt, Homo sapiens
ugauauauugcugu

SEQ ID NO: 1599756 - RNA, 19 nt, Homo sapiens
ugauauguauccaucagga

SEQ ID NO: 1599757 - RNA, 13 nt, Homo sapiens
ugauauugcagcu

SEQ ID NO: 1599758 - RNA, 16 nt, Homo sapiens
ugaucaaauuugaacu

SEQ ID NO: 1599759 - RNA, 21 nt, Homo sapiens
ugaucaauauuuuuauaucau

SEQ ID NO: 1599760 - RNA, 15 nt, Homo sapiens
ugaucacacaguguu

SEQ ID NO: 1599761 - RNA, 20 nt, Homo sapiens
ugaucacauucuuuccaaaa

SEQ ID NO: 1599762 - RNA, 14 nt, Homo sapiens
ugaucacugugaac

SEQ ID NO: 1599763 - RNA, 20 nt, Homo sapiens
ugaucagacagcuugaauca

SEQ ID NO: 1599764 - RNA, 20 nt, Homo sapiens
ugaucagcgccgcaccagcc

SEQ ID NO: 1599765 - RNA, 13 nt, Homo sapiens
ugauccgccuacc

SEQ ID NO: 1599766 - RNA, 18 nt, Homo sapiens
ugauccugcaauuccacu

SEQ ID NO: 1599767 - RNA, 14 nt, Homo sapiens
ugaucucacacaca

SEQ ID NO: 1599768 - RNA, 14 nt, Homo sapiens
ugaucuguacuuug

SEQ ID NO: 1599769 - RNA, 16 nt, Homo sapiens
ugaucuugcaaaacag

SEQ ID NO: 1599770 - RNA, 16 nt, Homo sapiens
ugaucuuugagcccau

SEQ ID NO: 1599771 - RNA, 14 nt, Homo sapiens
ugaucuuugcaaag

SEQ ID NO: 1599772 - RNA, 16 nt, Homo sapiens
ugaugaaaauuuacaa

SEQ ID NO: 1599773 - RNA, 23 nt, Homo sapiens
ugaugacuuagcgucaagacauu

SEQ ID NO: 1599774 - RNA, 13 nt, Homo sapiens
ugaugagcacauc

SEQ ID NO: 1599775 - RNA, 15 nt, Homo sapiens
ugaugauacaguguu

SEQ ID NO: 1599776 - RNA, 13 nt, Homo sapiens
ugaugaugaaggg

SEQ ID NO: 1599777 - RNA, 13 nt, Homo sapiens
ugaugcagcauuu

SEQ ID NO: 1599778 - RNA, 16 nt, Homo sapiens
ugaugcaggcacuuau

SEQ ID NO: 1599779 - RNA, 16 nt, Homo sapiens
ugaugccaggugcaau

SEQ ID NO: 1599780 - RNA, 14 nt, Homo sapiens
ugaugcugggaccc

SEQ ID NO: 1599781 - RNA, 15 nt, Homo sapiens
ugauggaacugugua

SEQ ID NO: 1599782 - RNA, 15 nt, Homo sapiens
ugauggagaggacag

SEQ ID NO: 1599783 - RNA, 16 nt, Homo sapiens
ugauggccaccagcuu

SEQ ID NO: 1599784 - RNA, 12 nt, Homo sapiens
ugauggcugaag

SEQ ID NO: 1599785 - RNA, 21 nt, Homo sapiens
ugaugggccacaacugucuua

SEQ ID NO: 1599786 - RNA, 16 nt, Homo sapiens
ugauggugcaugccug

SEQ ID NO: 1599787 - RNA, 21 nt, Homo sapiens
ugauguauuucaagucucuca

SEQ ID NO: 1599788 - RNA, 22 nt, Homo sapiens
ugaugucaagcaccacacccca

SEQ ID NO: 1599789 - RNA, 19 nt, Homo sapiens
ugaugucagcggugcagcg

SEQ ID NO: 1599790 - RNA, 20 nt, Homo sapiens
ugaugugauacaaauugaua

SEQ ID NO: 1599791 - RNA, 19 nt, Homo sapiens
ugauguuccaccugccaca

SEQ ID NO: 1599792 - RNA, 19 nt, Homo sapiens
ugauuacuaucauggcaua

SEQ ID NO: 1599793 - RNA, 23 nt, Homo sapiens
ugauuagaaagaccaggccaaug

SEQ ID NO: 1599794 - RNA, 15 nt, Homo sapiens
ugauuaggaagcauu

SEQ ID NO: 1599795 - RNA, 21 nt, Homo sapiens
ugauuaguauucaggcacuga

SEQ ID NO: 1599796 - RNA, 18 nt, Homo sapiens
ugauuauggagccuuaga

SEQ ID NO: 1599797 - RNA, 16 nt, Homo sapiens
ugauucaaauugcugc

SEQ ID NO: 1599798 - RNA, 18 nt, Homo sapiens
ugauucaaauugcugcuu

SEQ ID NO: 1599799 - RNA, 23 nt, Homo sapiens
ugauucaguucccuccuucuuac

SEQ ID NO: 1599800 - RNA, 11 nt, Homo sapiens
ugauucccaac

SEQ ID NO: 1599801 - RNA, 15 nt, Homo sapiens
ugauucccugcacac

SEQ ID NO: 1599802 - RNA, 19 nt, Homo sapiens
ugauuccuugaguuucaua

SEQ ID NO: 1599803 - RNA, 15 nt, Homo sapiens
ugauucuaugucuca

SEQ ID NO: 1599804 - RNA, 14 nt, Homo sapiens
ugauucuuguaaau

SEQ ID NO: 1599805 - RNA, 20 nt, Homo sapiens
ugauucuuuucccaucacca

SEQ ID NO: 1599806 - RNA, 14 nt, Homo sapiens
ugauugaaaccaag

SEQ ID NO: 1599807 - RNA, 22 nt, Homo sapiens
ugauugagaagaggacauugga

SEQ ID NO: 1599808 - RNA, 18 nt, Homo sapiens
ugauuggccacacacuga

SEQ ID NO: 1599809 - RNA, 16 nt, Homo sapiens
ugauugugccagugca

SEQ ID NO: 1599810 - RNA, 14 nt, Homo sapiens
ugauuuacauucaa

SEQ ID NO: 1599811 - RNA, 21 nt, Homo sapiens
ugauuuacuacuuaugcguaa

SEQ ID NO: 1599812 - RNA, 14 nt, Homo sapiens
ugauuuaguacuug

SEQ ID NO: 1599813 - RNA, 15 nt, Homo sapiens
ugauuuagugaucaa

SEQ ID NO: 1599814 - RNA, 17 nt, Homo sapiens
ugauuuauuugcuucuu

SEQ ID NO: 1599815 - RNA, 22 nt, Homo sapiens
ugauuucagcaccuacagugua

SEQ ID NO: 1599816 - RNA, 20 nt, Homo sapiens
ugauuucucuacuugucaua

SEQ ID NO: 1599817 - RNA, 17 nt, Homo sapiens
ugauuuguaaugagcac

SEQ ID NO: 1599818 - RNA, 18 nt, Homo sapiens
ugauuugucccuaugcau

SEQ ID NO: 1599819 - RNA, 14 nt, Homo sapiens
ugcaaaaguucuca

SEQ ID NO: 1599820 - RNA, 23 nt, Homo sapiens
ugcaaaauauuugacuauucugu

SEQ ID NO: 1599821 - RNA, 13 nt, Homo sapiens
ugcaaaccuuccu

SEQ ID NO: 1599822 - RNA, 13 nt, Homo sapiens
ugcaaaguacugu

SEQ ID NO: 1599823 - RNA, 14 nt, Homo sapiens
ugcaaaguacugua

SEQ ID NO: 1599824 - RNA, 19 nt, Homo sapiens
ugcaaauaaauuaugcaau

SEQ ID NO: 1599825 - RNA, 17 nt, Homo sapiens
ugcaaauugccugcaaa

SEQ ID NO: 1599826 - RNA, 15 nt, Homo sapiens
ugcaacagacuugaa

SEQ ID NO: 1599827 - RNA, 23 nt, Homo sapiens
ugcaacaugccagccacugugau

SEQ ID NO: 1599828 - RNA, 19 nt, Homo sapiens
ugcaacccugucauuacgu

SEQ ID NO: 1599829 - RNA, 16 nt, Homo sapiens
ugcaaccucacuaugg

SEQ ID NO: 1599830 - RNA, 17 nt, Homo sapiens
ugcaacuaauucaauaa

SEQ ID NO: 1599831 - RNA, 18 nt, Homo sapiens
ugcaacuauuuccaccuc

SEQ ID NO: 1599832 - RNA, 19 nt, Homo sapiens
ugcaagaaaucagccauaa

SEQ ID NO: 1599833 - RNA, 22 nt, Homo sapiens
ugcaagaaggauaccaaauacc

SEQ ID NO: 1599834 - RNA, 14 nt, Homo sapiens
ugcaagaaugaaau

SEQ ID NO: 1599835 - RNA, 19 nt, Homo sapiens
ugcaagauuucacaucagc

SEQ ID NO: 1599836 - RNA, 11 nt, Homo sapiens
ugcaagcacuc

SEQ ID NO: 1599837 - RNA, 22 nt, Homo sapiens
ugcaagccuucuaaaugaguca

SEQ ID NO: 1599838 - RNA, 17 nt, Homo sapiens
ugcaaggagcaacagcg

SEQ ID NO: 1599839 - RNA, 14 nt, Homo sapiens
ugcaaggggcugca

SEQ ID NO: 1599840 - RNA, 13 nt, Homo sapiens
ugcaauagauuac

SEQ ID NO: 1599841 - RNA, 16 nt, Homo sapiens
ugcaauccaaugcacu

SEQ ID NO: 1599842 - RNA, 12 nt, Homo sapiens
ugcaaugagcca

SEQ ID NO: 1599843 - RNA, 15 nt, Homo sapiens
ugcaauguaagcaua

SEQ ID NO: 1599844 - RNA, 12 nt, Homo sapiens
ugcaaugugauc

SEQ ID NO: 1599845 - RNA, 15 nt, Homo sapiens
ugcaauguggugaca

SEQ ID NO: 1599846 - RNA, 14 nt, Homo sapiens
ugcaauuuuacugu

SEQ ID NO: 1599847 - RNA, 17 nt, Homo sapiens
ugcaauuuuacugugaa

SEQ ID NO: 1599848 - RNA, 18 nt, Homo sapiens
ugcaauuuuacugugaaa

SEQ ID NO: 1599849 - RNA, 22 nt, Homo sapiens
ugcacaaaagcagauacuugag

SEQ ID NO: 1599850 - RNA, 22 nt, Homo sapiens
ugcacaaaaugggacugcugaa

SEQ ID NO: 1599851 - RNA, 15 nt, Homo sapiens
ugcacaaacaugugu

SEQ ID NO: 1599852 - RNA, 17 nt, Homo sapiens
ugcacaaacuugugagc

SEQ ID NO: 1599853 - RNA, 12 nt, Homo sapiens
ugcacaaccugg

SEQ ID NO: 1599854 - RNA, 20 nt, Homo sapiens
ugcacacaagcucugcgcca

SEQ ID NO: 1599855 - RNA, 17 nt, Homo sapiens
ugcacacacaugcauac

SEQ ID NO: 1599856 - RNA, 18 nt, Homo sapiens
ugcacacacccugagcuu

SEQ ID NO: 1599857 - RNA, 15 nt, Homo sapiens
ugcacaccucaugag

SEQ ID NO: 1599858 - RNA, 19 nt, Homo sapiens
ugcacagaauauguaugua

SEQ ID NO: 1599859 - RNA, 23 nt, Homo sapiens
ugcacagucacuggcccaaccag

SEQ ID NO: 1599860 - RNA, 14 nt, Homo sapiens
ugcacauaggcagu

SEQ ID NO: 1599861 - RNA, 14 nt, Homo sapiens
ucuucaccauuugg

SEQ ID NO: 1599862 - RNA, 24 nt, Homo sapiens
ucuucaccauuuggcaaugccauc

SEQ ID NO: 1599863 - RNA, 20 nt, Homo sapiens
ucuucacuaaaaucagugac

SEQ ID NO: 1599864 - RNA, 21 nt, Homo sapiens
ucuucaggccugcuagucacu

SEQ ID NO: 1599865 - RNA, 20 nt, Homo sapiens
ucuucaugcuuuugcuugca

SEQ ID NO: 1599866 - RNA, 16 nt, Homo sapiens
ucuucaugucaucaaa

SEQ ID NO: 1599867 - RNA, 20 nt, Homo sapiens
ucuucauuaccucagugaga

SEQ ID NO: 1599868 - RNA, 13 nt, Homo sapiens
ucuucauucagug

SEQ ID NO: 1599869 - RNA, 12 nt, Homo sapiens
ucuuccaaacag

SEQ ID NO: 1599870 - RNA, 16 nt, Homo sapiens
ucuuccaaauccaaaa

SEQ ID NO: 1599871 - RNA, 19 nt, Homo sapiens
ucuuccccuaaugccuauc

SEQ ID NO: 1599872 - RNA, 19 nt, Homo sapiens
ucuucccugggcugccacc

SEQ ID NO: 1599873 - RNA, 23 nt, Homo sapiens
ucuucccuuauucuaaagcugcc

SEQ ID NO: 1599874 - RNA, 13 nt, Homo sapiens
ucuucccuuugug

SEQ ID NO: 1599875 - RNA, 22 nt, Homo sapiens
ucuuccguggucagagugccac

SEQ ID NO: 1599876 - RNA, 19 nt, Homo sapiens
ucuuccuauuuuaaugaau

SEQ ID NO: 1599877 - RNA, 18 nt, Homo sapiens
ucuucguagguugugaug

SEQ ID NO: 1599878 - RNA, 21 nt, Homo sapiens
ucuucuacagaugagucacac

SEQ ID NO: 1599879 - RNA, 14 nt, Homo sapiens
ucuucuacugcuau

SEQ ID NO: 1599880 - RNA, 20 nt, Homo sapiens
ucuucuacuuuuaacuaaua

SEQ ID NO: 1599881 - RNA, 22 nt, Homo sapiens
ucuucuauggguuggacaaccu

SEQ ID NO: 1599882 - RNA, 13 nt, Homo sapiens
ucuucucauuuca

SEQ ID NO: 1599883 - RNA, 15 nt, Homo sapiens
ucuucucguuuucac

SEQ ID NO: 1599884 - RNA, 18 nt, Homo sapiens
ucuucuggugcuacucca

SEQ ID NO: 1599885 - RNA, 13 nt, Homo sapiens
ucuucuuacucca

SEQ ID NO: 1599886 - RNA, 18 nt, Homo sapiens
ucuucuuuaagccauaga

SEQ ID NO: 1599887 - RNA, 17 nt, Homo sapiens
ucuugaaagacagucca

SEQ ID NO: 1599888 - RNA, 21 nt, Homo sapiens
ucuugaaauuaagaaggcaaa

SEQ ID NO: 1599889 - RNA, 20 nt, Homo sapiens
ucuugaacucauagauuauu

SEQ ID NO: 1599890 - RNA, 14 nt, Homo sapiens
ucuugauaaaugac

SEQ ID NO: 1599891 - RNA, 20 nt, Homo sapiens
ucuugauuugaguugauuga

SEQ ID NO: 1599892 - RNA, 23 nt, Homo sapiens
ucuugcacuggccuucugaugaa

SEQ ID NO: 1599893 - RNA, 20 nt, Homo sapiens
ucuugcccuaggauacccag

SEQ ID NO: 1599894 - RNA, 14 nt, Homo sapiens
ucuugcuaccagua

SEQ ID NO: 1599895 - RNA, 19 nt, Homo sapiens
ucuugcuuucuaugcuguu

SEQ ID NO: 1599896 - RNA, 13 nt, Homo sapiens
ucuugggcacugg

SEQ ID NO: 1599897 - RNA, 18 nt, Homo sapiens
ucuuguaggucauugcac

SEQ ID NO: 1599898 - RNA, 19 nt, Homo sapiens
ucuugugccaaaccuacua

SEQ ID NO: 1599899 - RNA, 14 nt, Homo sapiens
ucuuguggugcauu

SEQ ID NO: 1599900 - RNA, 15 nt, Homo sapiens
ucuuguugcugcauc

SEQ ID NO: 1599901 - RNA, 16 nt, Homo sapiens
ucuuuaaaacaaaaca

SEQ ID NO: 1599902 - RNA, 18 nt, Homo sapiens
ucuuuaaaggcaucuaca

SEQ ID NO: 1599903 - RNA, 23 nt, Homo sapiens
ucuuuaagaguuuaaaaucauca

SEQ ID NO: 1599904 - RNA, 22 nt, Homo sapiens
ucuuuaaucuccuauuccuuca

SEQ ID NO: 1599905 - RNA, 18 nt, Homo sapiens
ucuuuaauuuuaacugau

SEQ ID NO: 1599906 - RNA, 21 nt, Homo sapiens
ucuuuacaaaacuacaugaga

SEQ ID NO: 1599907 - RNA, 17 nt, Homo sapiens
ucuuuacaaagaaaaaa

SEQ ID NO: 1599908 - RNA, 15 nt, Homo sapiens
ucuuuacuuaucucu

SEQ ID NO: 1599909 - RNA, 22 nt, Homo sapiens
ucuuuagaaggacucaguauua

SEQ ID NO: 1599910 - RNA, 17 nt, Homo sapiens
ucuuuagcaugcuacag

SEQ ID NO: 1599911 - RNA, 13 nt, Homo sapiens
ucuuuccaaaaca

SEQ ID NO: 1599912 - RNA, 23 nt, Homo sapiens
ucuuuccaaaaggaacucuagaa

SEQ ID NO: 1599913 - RNA, 12 nt, Homo sapiens
ucuuuccaugaa

SEQ ID NO: 1599914 - RNA, 14 nt, Homo sapiens
ucuuucccaauuca

SEQ ID NO: 1599915 - RNA, 16 nt, Homo sapiens
ucuuuccugaaccaug

SEQ ID NO: 1599916 - RNA, 12 nt, Homo sapiens
ucuuucuguccc

SEQ ID NO: 1599917 - RNA, 22 nt, Homo sapiens
ucuuucuuugcaccaaagacau

SEQ ID NO: 1599918 - RNA, 23 nt, Homo sapiens
ucuuugacugaaaaaaaaaaaga

SEQ ID NO: 1599919 - RNA, 19 nt, Homo sapiens
ucuuugagaccaaguucca

SEQ ID NO: 1599920 - RNA, 11 nt, Homo sapiens
ucuuugccucu

SEQ ID NO: 1599921 - RNA, 14 nt, Homo sapiens
ucuuuggauuugau

SEQ ID NO: 1599922 - RNA, 21 nt, Homo sapiens
ucuuuguaaugucaccaccuu

SEQ ID NO: 1599923 - RNA, 23 nt, Homo sapiens
ucuuugugcaguguuaguauuca

SEQ ID NO: 1599924 - RNA, 13 nt, Homo sapiens
ucuuugugccuuu

SEQ ID NO: 1599925 - RNA, 18 nt, Homo sapiens
ucuuuguuuacaugaguu

SEQ ID NO: 1599926 - RNA, 22 nt, Homo sapiens
ucuuuuauggcaaaaguaauca

SEQ ID NO: 1599927 - RNA, 19 nt, Homo sapiens
ucuuuuccugaccaaucuu

SEQ ID NO: 1599928 - RNA, 14 nt, Homo sapiens
ucuuuugucccaga

SEQ ID NO: 1599929 - RNA, 14 nt, Homo sapiens
ucuuuuuaucauga

SEQ ID NO: 1599930 - RNA, 22 nt, Homo sapiens
ucuuuuugggcuuucauagugu

SEQ ID NO: 1599931 - RNA, 18 nt, Homo sapiens
ucuuuuuuaaacuguaaa

SEQ ID NO: 1599932 - RNA, 21 nt, Homo sapiens
ucuuuuuuaaguugucaaaga

SEQ ID NO: 1599933 - RNA, 15 nt, Homo sapiens
ugaaaaaaacauauc

SEQ ID NO: 1599934 - RNA, 17 nt, Homo sapiens
ugaaaaaaacauaucca

SEQ ID NO: 1599935 - RNA, 19 nt, Homo sapiens
ugaaaaaaagggcacucug

SEQ ID NO: 1599936 - RNA, 21 nt, Homo sapiens
ugaaaaaaagggcacucugau

SEQ ID NO: 1599937 - RNA, 20 nt, Homo sapiens
ugaaaaacuaaugugucuca

SEQ ID NO: 1599938 - RNA, 19 nt, Homo sapiens
ugaaaaaggaaugauauau

SEQ ID NO: 1599939 - RNA, 14 nt, Homo sapiens
ugaaaaauuacuua

SEQ ID NO: 1599940 - RNA, 16 nt, Homo sapiens
ugaaaacacacauaca

SEQ ID NO: 1599941 - RNA, 17 nt, Homo sapiens
ugaaaacacugugcaca

SEQ ID NO: 1599942 - RNA, 22 nt, Homo sapiens
ugaaaacauaacccacucuguc

SEQ ID NO: 1599943 - RNA, 19 nt, Homo sapiens
ugaaaaccguaaagugccu

SEQ ID NO: 1599944 - RNA, 13 nt, Homo sapiens
ugaaaacugucaa

SEQ ID NO: 1599945 - RNA, 17 nt, Homo sapiens
ugaaaagaaaaagccac

SEQ ID NO: 1599946 - RNA, 21 nt, Homo sapiens
ugaaaagaaaaccacagcagg

SEQ ID NO: 1599947 - RNA, 21 nt, Homo sapiens
ugaaaagagaaugaugcucaa

SEQ ID NO: 1599948 - RNA, 20 nt, Homo sapiens
ugaaaagcacacacaauaaa

SEQ ID NO: 1599949 - RNA, 12 nt, Homo sapiens
ugaaaagccaaa

SEQ ID NO: 1599950 - RNA, 17 nt, Homo sapiens
ugaaaagcuacccugaa

SEQ ID NO: 1599951 - RNA, 21 nt, Homo sapiens
ugaaaagcuagaauugagugu

SEQ ID NO: 1599952 - RNA, 16 nt, Homo sapiens
ugaaaagcuccaucaa

SEQ ID NO: 1599953 - RNA, 12 nt, Homo sapiens
ugaaaaggugau

SEQ ID NO: 1599954 - RNA, 17 nt, Homo sapiens
ugaaaagguugccugaa

SEQ ID NO: 1599955 - RNA, 16 nt, Homo sapiens
ugaaaaguuugauuaa

SEQ ID NO: 1599956 - RNA, 22 nt, Homo sapiens
ugaaaauacaacuuaaauaaua

SEQ ID NO: 1599957 - RNA, 21 nt, Homo sapiens
ugaaaauaguguaagaacugu

SEQ ID NO: 1599958 - RNA, 19 nt, Homo sapiens
ugaaaauauagacauucuc

SEQ ID NO: 1599959 - RNA, 21 nt, Homo sapiens
ugaaaauauagacauucucac

SEQ ID NO: 1599960 - RNA, 17 nt, Homo sapiens
ugaaaaucuacacucca

SEQ ID NO: 1599961 - RNA, 21 nt, Homo sapiens
ugaaaaucuacacuccaguga

SEQ ID NO: 1599962 - RNA, 13 nt, Homo sapiens
ugaaaaucuccau

SEQ ID NO: 1599963 - RNA, 19 nt, Homo sapiens
ugaaaauguccauuuacac

SEQ ID NO: 1599964 - RNA, 11 nt, Homo sapiens
ugaaaauugca

SEQ ID NO: 1599965 - RNA, 23 nt, Homo sapiens
ugaaaauuuauuuuuagugauaa

SEQ ID NO: 1599966 - RNA, 22 nt, Homo sapiens
ugaaacagcugccuuagcuuca

SEQ ID NO: 1599967 - RNA, 12 nt, Homo sapiens
ugaaacaucauu

SEQ ID NO: 1599968 - RNA, 18 nt, Homo sapiens
ugaaacauguacuuugag

SEQ ID NO: 1599969 - RNA, 23 nt, Homo sapiens
ugaaacugagaugugaacacauc

SEQ ID NO: 1599970 - RNA, 17 nt, Homo sapiens
ugaaacuguaucaucuu

SEQ ID NO: 1599971 - RNA, 13 nt, Homo sapiens
ugaaagaagaaua

SEQ ID NO: 1599972 - RNA, 18 nt, Homo sapiens
ugaaagaggcagcuugaa

SEQ ID NO: 1599973 - RNA, 21 nt, Homo sapiens
ugaaagauguauggauuucca

SEQ ID NO: 1599974 - RNA, 16 nt, Homo sapiens
ugaaagcaaguguuca

SEQ ID NO: 1599975 - RNA, 17 nt, Homo sapiens
ugaaagcccaaggugcu

SEQ ID NO: 1599976 - RNA, 21 nt, Homo sapiens
ugaaagggaucaucaugcagc

SEQ ID NO: 1599977 - RNA, 18 nt, Homo sapiens
ugaaaggggacaccugua

SEQ ID NO: 1599978 - RNA, 15 nt, Homo sapiens
ugaaaggugccaugg

SEQ ID NO: 1599979 - RNA, 19 nt, Homo sapiens
uccugccuaagguugucua

SEQ ID NO: 1599980 - RNA, 13 nt, Homo sapiens
uccugcugccuaa

SEQ ID NO: 1599981 - RNA, 15 nt, Homo sapiens
uccuggacucagggu

SEQ ID NO: 1599982 - RNA, 15 nt, Homo sapiens
uccuggaggcacugg

SEQ ID NO: 1599983 - RNA, 20 nt, Homo sapiens
uccuggaggucagcauuuga

SEQ ID NO: 1599984 - RNA, 21 nt, Homo sapiens
uccuggcaucuauuuccucug

SEQ ID NO: 1599985 - RNA, 20 nt, Homo sapiens
uccuggccuucugaacucca

SEQ ID NO: 1599986 - RNA, 19 nt, Homo sapiens
uccuggggaauacuggcca

SEQ ID NO: 1599987 - RNA, 19 nt, Homo sapiens
uccuggggcacaagugucu

SEQ ID NO: 1599988 - RNA, 14 nt, Homo sapiens
uccuggucugugaa

SEQ ID NO: 1599989 - RNA, 15 nt, Homo sapiens
uccugguuuccacug

SEQ ID NO: 1599990 - RNA, 16 nt, Homo sapiens
uccugguuuccacugu

SEQ ID NO: 1599991 - RNA, 11 nt, Homo sapiens
uccuguaagaa

SEQ ID NO: 1599992 - RNA, 20 nt, Homo sapiens
uccuguccaaccuaaccccu

SEQ ID NO: 1599993 - RNA, 22 nt, Homo sapiens
uccugugugucgcuuaugucua

SEQ ID NO: 1599994 - RNA, 21 nt, Homo sapiens
uccuuaaaacaauucugugac

SEQ ID NO: 1599995 - RNA, 14 nt, Homo sapiens
uccuuaaccuuaac

SEQ ID NO: 1599996 - RNA, 22 nt, Homo sapiens
uccuuaauuuaauugcuuugaa

SEQ ID NO: 1599997 - RNA, 23 nt, Homo sapiens
uccuuaauuuaauugcuuugaag

SEQ ID NO: 1599998 - RNA, 15 nt, Homo sapiens
uccuuacuguuuaca

SEQ ID NO: 1599999 - RNA, 17 nt, Homo sapiens
uccuuaggccucugaga

SEQ ID NO: 1600000 - RNA, 15 nt, Homo sapiens
uccuuauuugccuuc

SEQ ID NO: 1600001 - RNA, 13 nt, Homo sapiens
uccuucagccuga

SEQ ID NO: 1600002 - RNA, 15 nt, Homo sapiens
uccuuccaggugauu

SEQ ID NO: 1600003 - RNA, 19 nt, Homo sapiens
uccuucccucucaugacuu

SEQ ID NO: 1600004 - RNA, 23 nt, Homo sapiens
uccuuccugcuugaguucccaga

SEQ ID NO: 1600005 - RNA, 20 nt, Homo sapiens
uccuucuuacagaaguauuu

SEQ ID NO: 1600006 - RNA, 13 nt, Homo sapiens
uccuucuuccuag

SEQ ID NO: 1600007 - RNA, 22 nt, Homo sapiens
uccuugagaaucuuugcaugca

SEQ ID NO: 1600008 - RNA, 15 nt, Homo sapiens
uccuugcacacaccc

SEQ ID NO: 1600009 - RNA, 16 nt, Homo sapiens
uccuugcacauaguag

SEQ ID NO: 1600010 - RNA, 20 nt, Homo sapiens
uccuugcccagacuacaggg

SEQ ID NO: 1600011 - RNA, 20 nt, Homo sapiens
uccuuggagggacaugacua

SEQ ID NO: 1600012 - RNA, 10 nt, Homo sapiens
uccuuggcau

SEQ ID NO: 1600013 - RNA, 22 nt, Homo sapiens
uccuuguaauaccugauugauc

SEQ ID NO: 1600014 - RNA, 21 nt, Homo sapiens
uccuugugccuucuuuguaua

SEQ ID NO: 1600015 - RNA, 13 nt, Homo sapiens
uccuugugguuuu

SEQ ID NO: 1600016 - RNA, 22 nt, Homo sapiens
uccuuuacuaaugguguugagu

SEQ ID NO: 1600017 - RNA, 23 nt, Homo sapiens
uccuuuaggucugguuguugcac

SEQ ID NO: 1600018 - RNA, 21 nt, Homo sapiens
uccuuuccuuuuuuugauaua

SEQ ID NO: 1600019 - RNA, 12 nt, Homo sapiens
uccuuucuuuuc

SEQ ID NO: 1600020 - RNA, 14 nt, Homo sapiens
uccuuuucuucacc

SEQ ID NO: 1600021 - RNA, 17 nt, Homo sapiens
uccuuuuucuucacuua

SEQ ID NO: 1600022 - RNA, 15 nt, Homo sapiens
uccuuuuugucaugc

SEQ ID NO: 1600023 - RNA, 22 nt, Homo sapiens
uccuuuuuucaauaugcaagca

SEQ ID NO: 1600024 - RNA, 16 nt, Homo sapiens
ucgagaccaaccugac

SEQ ID NO: 1600025 - RNA, 15 nt, Homo sapiens
ucgagauugcacugc

SEQ ID NO: 1600026 - RNA, 21 nt, Homo sapiens
ucgaguaaggcacacccaaau

SEQ ID NO: 1600027 - RNA, 18 nt, Homo sapiens
ucgagucacaaaaauuca

SEQ ID NO: 1600028 - RNA, 21 nt, Homo sapiens
ucgauccaaauugugcuucuc

SEQ ID NO: 1600029 - RNA, 11 nt, Homo sapiens
ucgaugugcuc

SEQ ID NO: 1600030 - RNA, 23 nt, Homo sapiens
ucgauugaaauuuugcaccagcg

SEQ ID NO: 1600031 - RNA, 17 nt, Homo sapiens
ucgcaccacugcacucc

SEQ ID NO: 1600032 - RNA, 19 nt, Homo sapiens
ucgcaccacugcacuccag

SEQ ID NO: 1600033 - RNA, 14 nt, Homo sapiens
ucgcauccagacag

SEQ ID NO: 1600034 - RNA, 15 nt, Homo sapiens
ucgcauccagacagu

SEQ ID NO: 1600035 - RNA, 16 nt, Homo sapiens
ucgcccacaaacugau

SEQ ID NO: 1600036 - RNA, 14 nt, Homo sapiens
ucgcggucuugggc

SEQ ID NO: 1600037 - RNA, 13 nt, Homo sapiens
ucgcucuuuucaa

SEQ ID NO: 1600038 - RNA, 18 nt, Homo sapiens
ucggcccuguuccccaag

SEQ ID NO: 1600039 - RNA, 13 nt, Homo sapiens
ucggcucacugca

SEQ ID NO: 1600040 - RNA, 22 nt, Homo sapiens
ucgggaggcagagacaggagaa

SEQ ID NO: 1600041 - RNA, 17 nt, Homo sapiens
ucgggccccauccucau

SEQ ID NO: 1600042 - RNA, 15 nt, Homo sapiens
ucgggcgcuacugug

SEQ ID NO: 1600043 - RNA, 15 nt, Homo sapiens
ucggggaacuccugg

SEQ ID NO: 1600044 - RNA, 15 nt, Homo sapiens
ucggugugcugccaa

SEQ ID NO: 1600045 - RNA, 21 nt, Homo sapiens
ucguagguugugaugauagca

SEQ ID NO: 1600046 - RNA, 16 nt, Homo sapiens
ucguaucucuagaaag

SEQ ID NO: 1600047 - RNA, 19 nt, Homo sapiens
ucgucaagagcaugcacau

SEQ ID NO: 1600048 - RNA, 20 nt, Homo sapiens
ucguuagccuuccucugauu

SEQ ID NO: 1600049 - RNA, 12 nt, Homo sapiens
ucguuuugacua

SEQ ID NO: 1600050 - RNA, 17 nt, Homo sapiens
ucuaaaauacaaaccca

SEQ ID NO: 1600051 - RNA, 21 nt, Homo sapiens
ucuaaacuuccccaucuucua

SEQ ID NO: 1600052 - RNA, 15 nt, Homo sapiens
ucuaaaggaaaucaa

SEQ ID NO: 1600053 - RNA, 16 nt, Homo sapiens
ucuaaauagcacuuuu

SEQ ID NO: 1600054 - RNA, 11 nt, Homo sapiens
ucuaaaugcaa

SEQ ID NO: 1600055 - RNA, 19 nt, Homo sapiens
ucuaacaagcuaugggaau

SEQ ID NO: 1600056 - RNA, 23 nt, Homo sapiens
ucuaacaauggaagauuugccca

SEQ ID NO: 1600057 - RNA, 16 nt, Homo sapiens
ucuaacauguuaucaa

SEQ ID NO: 1600058 - RNA, 20 nt, Homo sapiens
ucuaacucauauguucccaa

SEQ ID NO: 1600059 - RNA, 15 nt, Homo sapiens
ucuaacugcuguuaa

SEQ ID NO: 1600060 - RNA, 16 nt, Homo sapiens
ucuaacugcuguuaaa

SEQ ID NO: 1600061 - RNA, 15 nt, Homo sapiens
ucuaagaaagaaauu

SEQ ID NO: 1600062 - RNA, 21 nt, Homo sapiens
ucuaagacuacuaaggccuuu

SEQ ID NO: 1600063 - RNA, 17 nt, Homo sapiens
ucuaagaggagaggcag

SEQ ID NO: 1600064 - RNA, 19 nt, Homo sapiens
ucuaagcaguuauggugau

SEQ ID NO: 1600065 - RNA, 19 nt, Homo sapiens
ucuaagcugcucuaaaguc

SEQ ID NO: 1600066 - RNA, 18 nt, Homo sapiens
uauaggauuuucacacau

SEQ ID NO: 1600067 - RNA, 19 nt, Homo sapiens
uauaggccuguguguauag

SEQ ID NO: 1600068 - RNA, 17 nt, Homo sapiens
uauaguagacacacuau

SEQ ID NO: 1600069 - RNA, 17 nt, Homo sapiens
uauaguauaagcagugu

SEQ ID NO: 1600070 - RNA, 20 nt, Homo sapiens
uauagugaaaaaugucacua

SEQ ID NO: 1600071 - RNA, 21 nt, Homo sapiens
uauagugacccacccuagauc

SEQ ID NO: 1600072 - RNA, 22 nt, Homo sapiens
uauaguguucacaaacugugaa

SEQ ID NO: 1600073 - RNA, 18 nt, Homo sapiens
uauauaaaugugauugca

SEQ ID NO: 1600074 - RNA, 21 nt, Homo sapiens
uauauaaaugugauugcagcu

SEQ ID NO: 1600075 - RNA, 23 nt, Homo sapiens
uauauaguggguacaucaagucc

SEQ ID NO: 1600076 - RNA, 20 nt, Homo sapiens
uauauauuuuugugcacauu

SEQ ID NO: 1600077 - RNA, 18 nt, Homo sapiens
uauaucaagguuucaaua

SEQ ID NO: 1600078 - RNA, 19 nt, Homo sapiens
uauaucagcagacacucca

SEQ ID NO: 1600079 - RNA, 12 nt, Homo sapiens
uauaucagggaa

SEQ ID NO: 1600080 - RNA, 20 nt, Homo sapiens
uauaucauaacuauacuuga

SEQ ID NO: 1600081 - RNA, 20 nt, Homo sapiens
uauaucgcuggccagcauua

SEQ ID NO: 1600082 - RNA, 17 nt, Homo sapiens
uauaucgcuuaaucuua

SEQ ID NO: 1600083 - RNA, 22 nt, Homo sapiens
uauaugcaucuuuguugcuuau

SEQ ID NO: 1600084 - RNA, 19 nt, Homo sapiens
uauauggcauuugcagauu

SEQ ID NO: 1600085 - RNA, 18 nt, Homo sapiens
uauauguagaguguuuua

SEQ ID NO: 1600086 - RNA, 11 nt, Homo sapiens
uauauucacag

SEQ ID NO: 1600087 - RNA, 16 nt, Homo sapiens
uauauucauccaugcc

SEQ ID NO: 1600088 - RNA, 16 nt, Homo sapiens
uauauuggaagcugcu

SEQ ID NO: 1600089 - RNA, 20 nt, Homo sapiens
uauauuuaaaaaauuaugga

SEQ ID NO: 1600090 - RNA, 18 nt, Homo sapiens
uauauuuguugauauuaa

SEQ ID NO: 1600091 - RNA, 11 nt, Homo sapiens
uaucaaaaagc

SEQ ID NO: 1600092 - RNA, 15 nt, Homo sapiens
uaucaaaaagcuaau

SEQ ID NO: 1600093 - RNA, 12 nt, Homo sapiens
uaucaaacugaa

SEQ ID NO: 1600094 - RNA, 20 nt, Homo sapiens
uaucaacccucucuacaggu

SEQ ID NO: 1600095 - RNA, 22 nt, Homo sapiens
uaucacucaauuucucugagga

SEQ ID NO: 1600096 - RNA, 13 nt, Homo sapiens
uaucagcaaaaaa

SEQ ID NO: 1600097 - RNA, 19 nt, Homo sapiens
uaucagccugugccacgau

SEQ ID NO: 1600098 - RNA, 19 nt, Homo sapiens
uaucagggcacagucucca

SEQ ID NO: 1600099 - RNA, 20 nt, Homo sapiens
uaucaguauucugacaugua

SEQ ID NO: 1600100 - RNA, 19 nt, Homo sapiens
uaucauaacuauacuugau

SEQ ID NO: 1600101 - RNA, 20 nt, Homo sapiens
uaucauaauucagcacuuaa

SEQ ID NO: 1600102 - RNA, 15 nt, Homo sapiens
uaucaucuuugccaa

SEQ ID NO: 1600103 - RNA, 18 nt, Homo sapiens
uaucaucuuuugaucuuu

SEQ ID NO: 1600104 - RNA, 16 nt, Homo sapiens
uaucauguuaaauuag

SEQ ID NO: 1600105 - RNA, 23 nt, Homo sapiens
uaucauugcuaaacugaugacuu

SEQ ID NO: 1600106 - RNA, 20 nt, Homo sapiens
uaucccuauuuugcugauga

SEQ ID NO: 1600107 - RNA, 19 nt, Homo sapiens
uauccuggcaacucaaggc

SEQ ID NO: 1600108 - RNA, 23 nt, Homo sapiens
uauccuguuugaggaaagcaaga

SEQ ID NO: 1600109 - RNA, 14 nt, Homo sapiens
uauccuuucacucu

SEQ ID NO: 1600110 - RNA, 22 nt, Homo sapiens
uauccuuuuaucucacaaauaa

SEQ ID NO: 1600111 - RNA, 14 nt, Homo sapiens
uaucuaagacucau

SEQ ID NO: 1600112 - RNA, 14 nt, Homo sapiens
uaucuagcauuuau

SEQ ID NO: 1600113 - RNA, 22 nt, Homo sapiens
uaucuauaguagacacacuauc

SEQ ID NO: 1600114 - RNA, 20 nt, Homo sapiens
uaucuaugcaguuccaauca

SEQ ID NO: 1600115 - RNA, 23 nt, Homo sapiens
uaucucaaacuacuggcaauuug

SEQ ID NO: 1600116 - RNA, 14 nt, Homo sapiens
uaucucauuacuua

SEQ ID NO: 1600117 - RNA, 23 nt, Homo sapiens
uaucucauuuuacacaaagggaa

SEQ ID NO: 1600118 - RNA, 18 nt, Homo sapiens
uaucucucaaaacaauau

SEQ ID NO: 1600119 - RNA, 11 nt, Homo sapiens
uaucucuggca

SEQ ID NO: 1600120 - RNA, 22 nt, Homo sapiens
uaucugcauauguuuuccacau

SEQ ID NO: 1600121 - RNA, 13 nt, Homo sapiens
uaucuguucuguu

SEQ ID NO: 1600122 - RNA, 13 nt, Homo sapiens
uaucuguugccuu

SEQ ID NO: 1600123 - RNA, 13 nt, Homo sapiens
uaucuuaugccac

SEQ ID NO: 1600124 - RNA, 21 nt, Homo sapiens
uaucuucguuaguaaucugua

SEQ ID NO: 1600125 - RNA, 20 nt, Homo sapiens
uaucuucuuuugaacaaaug

SEQ ID NO: 1600126 - RNA, 17 nt, Homo sapiens
uaucuuguuggacaucu

SEQ ID NO: 1600127 - RNA, 16 nt, Homo sapiens
uaucuuuguauucuuc

SEQ ID NO: 1600128 - RNA, 21 nt, Homo sapiens
uaugaaaaagaagaaucucau

SEQ ID NO: 1600129 - RNA, 22 nt, Homo sapiens
uaugaaaaccguaaagugccuu

SEQ ID NO: 1600130 - RNA, 13 nt, Homo sapiens
uaugaaaacucau

SEQ ID NO: 1600131 - RNA, 20 nt, Homo sapiens
uaugaaaaucuccaucucaa

SEQ ID NO: 1600132 - RNA, 14 nt, Homo sapiens
uaugaaaugacuuc

SEQ ID NO: 1600133 - RNA, 19 nt, Homo sapiens
uaugaaccgcaauauggga

SEQ ID NO: 1600134 - RNA, 21 nt, Homo sapiens
uaugaaggauuacucuccaua

SEQ ID NO: 1600135 - RNA, 20 nt, Homo sapiens
uaugaauaaagaaugccauu

SEQ ID NO: 1600136 - RNA, 20 nt, Homo sapiens
uaugacaauguugcauuuau

SEQ ID NO: 1600137 - RNA, 22 nt, Homo sapiens
uaugacacuguuaauaguacua

SEQ ID NO: 1600138 - RNA, 16 nt, Homo sapiens
uaugacgcaaagauca

SEQ ID NO: 1600139 - RNA, 19 nt, Homo sapiens
uaugacuacuacauuccaa

SEQ ID NO: 1600140 - RNA, 18 nt, Homo sapiens
uaugagaauauaccuuau

SEQ ID NO: 1600141 - RNA, 15 nt, Homo sapiens
uaugagauacuuugc

SEQ ID NO: 1600142 - RNA, 20 nt, Homo sapiens
uaugaguaauacaucaaaga

SEQ ID NO: 1600143 - RNA, 21 nt, Homo sapiens
uaugauaauuauuuacaaaau

SEQ ID NO: 1600144 - RNA, 22 nt, Homo sapiens
uaugauaugcauguagcauaua

SEQ ID NO: 1600145 - RNA, 18 nt, Homo sapiens
uaugaucaaaaacugccu

SEQ ID NO: 1600146 - RNA, 21 nt, Homo sapiens
uaugaucagguaacuuucgac

SEQ ID NO: 1600147 - RNA, 12 nt, Homo sapiens
uaugaugcacuu

SEQ ID NO: 1600148 - RNA, 21 nt, Homo sapiens
uaugauuauuaacgaugucca

SEQ ID NO: 1600149 - RNA, 22 nt, Homo sapiens
uaugauuguccguaggcccaua

SEQ ID NO: 1600150 - RNA, 12 nt, Homo sapiens
uaugcaaaucag

SEQ ID NO: 1600151 - RNA, 23 nt, Homo sapiens
uaugcauuaagaguaaaauuccu

SEQ ID NO: 1600152 - RNA, 18 nt, Homo sapiens
ucaaaagccuuaccuuga

SEQ ID NO: 1600153 - RNA, 17 nt, Homo sapiens
ucaaaauaaaaaguaau

SEQ ID NO: 1600154 - RNA, 22 nt, Homo sapiens
ucaaaauaaaaauuaaauguga

SEQ ID NO: 1600155 - RNA, 13 nt, Homo sapiens
ucaaaaucugcac

SEQ ID NO: 1600156 - RNA, 14 nt, Homo sapiens
ucaaaaucuuucca

SEQ ID NO: 1600157 - RNA, 19 nt, Homo sapiens
ucaaacaaccgguaaccaa

SEQ ID NO: 1600158 - RNA, 19 nt, Homo sapiens
ucaaacucccuagucucca

SEQ ID NO: 1600159 - RNA, 10 nt, Homo sapiens
ucaaacugcu

SEQ ID NO: 1600160 - RNA, 22 nt, Homo sapiens
ucaaacuugugagguguuugca

SEQ ID NO: 1600161 - RNA, 14 nt, Homo sapiens
ucaaagaaagugua

SEQ ID NO: 1600162 - RNA, 14 nt, Homo sapiens
ucaaagaggccuua

SEQ ID NO: 1600163 - RNA, 22 nt, Homo sapiens
ucaaagcaauugaaaugcauug

SEQ ID NO: 1600164 - RNA, 12 nt, Homo sapiens
ucaaagccucaa

SEQ ID NO: 1600165 - RNA, 20 nt, Homo sapiens
ucaaagccucaaaaccugau

SEQ ID NO: 1600166 - RNA, 23 nt, Homo sapiens
ucaaagcuaaaauauauaauaua

SEQ ID NO: 1600167 - RNA, 20 nt, Homo sapiens
ucaaagggagagagugcuau

SEQ ID NO: 1600168 - RNA, 20 nt, Homo sapiens
ucaaaguguaaacaccauag

SEQ ID NO: 1600169 - RNA, 22 nt, Homo sapiens
ucaaaguguuuuucaagccugu

SEQ ID NO: 1600170 - RNA, 15 nt, Homo sapiens
ucaaauaaacacugu

SEQ ID NO: 1600171 - RNA, 16 nt, Homo sapiens
ucaaauaaacacugug

SEQ ID NO: 1600172 - RNA, 21 nt, Homo sapiens
ucaaauaaaucuaaaucuuca

SEQ ID NO: 1600173 - RNA, 14 nt, Homo sapiens
ucaaauacaugcac

SEQ ID NO: 1600174 - RNA, 21 nt, Homo sapiens
ucaaauaugcaaagcacugac

SEQ ID NO: 1600175 - RNA, 20 nt, Homo sapiens
ucaaaugaucaauaagcuuu

SEQ ID NO: 1600176 - RNA, 15 nt, Homo sapiens
ucaaauggacuguua

SEQ ID NO: 1600177 - RNA, 13 nt, Homo sapiens
ucaaaugugcauu

SEQ ID NO: 1600178 - RNA, 17 nt, Homo sapiens
ucaaaugugcauuuugu

SEQ ID NO: 1600179 - RNA, 23 nt, Homo sapiens
ucaaauguuagauauugcuacua

SEQ ID NO: 1600180 - RNA, 19 nt, Homo sapiens
ucaaauuacuuugugaaua

SEQ ID NO: 1600181 - RNA, 16 nt, Homo sapiens
ucaaauuggagcuuca

SEQ ID NO: 1600182 - RNA, 19 nt, Homo sapiens
ucaacaaaauggucaucca

SEQ ID NO: 1600183 - RNA, 22 nt, Homo sapiens
ucaacacauuuuuaagaugcau

SEQ ID NO: 1600184 - RNA, 16 nt, Homo sapiens
uacuauagguccagaa

SEQ ID NO: 1600185 - RNA, 16 nt, Homo sapiens
uacuaucacacaugaa

SEQ ID NO: 1600186 - RNA, 15 nt, Homo sapiens
uacuaucauaauuca

SEQ ID NO: 1600187 - RNA, 22 nt, Homo sapiens
uacuauuaagcaagaaugcagu

SEQ ID NO: 1600188 - RNA, 15 nt, Homo sapiens
uacuauuauggaauu

SEQ ID NO: 1600189 - RNA, 20 nt, Homo sapiens
uacuauuauggaauuacucu

SEQ ID NO: 1600190 - RNA, 19 nt, Homo sapiens
uacuauucuuacuaaucug

SEQ ID NO: 1600191 - RNA, 17 nt, Homo sapiens
uacuauugcuauuacua

SEQ ID NO: 1600192 - RNA, 19 nt, Homo sapiens
uacucaaguaccaccaagg

SEQ ID NO: 1600193 - RNA, 16 nt, Homo sapiens
uacucacuaaagggcu

SEQ ID NO: 1600194 - RNA, 15 nt, Homo sapiens
uacucccagcacuuu

SEQ ID NO: 1600195 - RNA, 13 nt, Homo sapiens
uacuccucugcag

SEQ ID NO: 1600196 - RNA, 16 nt, Homo sapiens
uacuccuuccaucaaa

SEQ ID NO: 1600197 - RNA, 15 nt, Homo sapiens
uacucucaugcugca

SEQ ID NO: 1600198 - RNA, 18 nt, Homo sapiens
uacugaaggaaaaacaca

SEQ ID NO: 1600199 - RNA, 20 nt, Homo sapiens
uacugaauuggcuuccagau

SEQ ID NO: 1600200 - RNA, 15 nt, Homo sapiens
uacugcaaauuuugu

SEQ ID NO: 1600201 - RNA, 12 nt, Homo sapiens
uacugcacuuau

SEQ ID NO: 1600202 - RNA, 16 nt, Homo sapiens
uacugcccaggccuau

SEQ ID NO: 1600203 - RNA, 19 nt, Homo sapiens
uacugcuaucuacuacaaa

SEQ ID NO: 1600204 - RNA, 14 nt, Homo sapiens
uacugcuguaaaua

SEQ ID NO: 1600205 - RNA, 20 nt, Homo sapiens
uacuggcaaggagaagagca

SEQ ID NO: 1600206 - RNA, 14 nt, Homo sapiens
uacuggcaauuugu

SEQ ID NO: 1600207 - RNA, 16 nt, Homo sapiens
uacuggggaucagagu

SEQ ID NO: 1600208 - RNA, 21 nt, Homo sapiens
uacugggguuuuucuaagaaa

SEQ ID NO: 1600209 - RNA, 23 nt, Homo sapiens
uacugggugucauuucauuccau

SEQ ID NO: 1600210 - RNA, 14 nt, Homo sapiens
uacuggugcaguca

SEQ ID NO: 1600211 - RNA, 15 nt, Homo sapiens
uacuguacauacaaa

SEQ ID NO: 1600212 - RNA, 21 nt, Homo sapiens
uacuguauguuuuuacugaau

SEQ ID NO: 1600213 - RNA, 14 nt, Homo sapiens
uacuguauugcugu

SEQ ID NO: 1600214 - RNA, 19 nt, Homo sapiens
uacugucaaacaauaaagg

SEQ ID NO: 1600215 - RNA, 12 nt, Homo sapiens
uacuguccuguu

SEQ ID NO: 1600216 - RNA, 14 nt, Homo sapiens
uaaguaaaaccaca

SEQ ID NO: 1600217 - RNA, 20 nt, Homo sapiens
uaaguaaucacuaaugcuca

SEQ ID NO: 1600218 - RNA, 15 nt, Homo sapiens
uaaguacaugugcca

SEQ ID NO: 1600219 - RNA, 22 nt, Homo sapiens
uaaguaggaugaaucauauuca

SEQ ID NO: 1600220 - RNA, 22 nt, Homo sapiens
uaaguagggacuucugucuuca

SEQ ID NO: 1600221 - RNA, 17 nt, Homo sapiens
uaaguaucacacuguau

SEQ ID NO: 1600222 - RNA, 17 nt, Homo sapiens
uaaguaucuugugcuuc

SEQ ID NO: 1600223 - RNA, 19 nt, Homo sapiens
uaaguaucuugugcuucuu

SEQ ID NO: 1600224 - RNA, 19 nt, Homo sapiens
uaaguccagcuuggccaag

SEQ ID NO: 1600225 - RNA, 22 nt, Homo sapiens
uaagucccuuuuaguuugauca

SEQ ID NO: 1600226 - RNA, 13 nt, Homo sapiens
uaagucuguuauu

SEQ ID NO: 1600227 - RNA, 15 nt, Homo sapiens
uaagucuuacauaaa

SEQ ID NO: 1600228 - RNA, 19 nt, Homo sapiens
uaagugaaauaagccagac

SEQ ID NO: 1600229 - RNA, 22 nt, Homo sapiens
uaagugaugagggccucugcau

SEQ ID NO: 1600230 - RNA, 19 nt, Homo sapiens
uaagugcaauuaacauaug

SEQ ID NO: 1600231 - RNA, 15 nt, Homo sapiens
uaaguggacuggugu

SEQ ID NO: 1600232 - RNA, 20 nt, Homo sapiens
uaaguggacuggugucauaa

SEQ ID NO: 1600233 - RNA, 20 nt, Homo sapiens
uaaguggggagagagcccuu

SEQ ID NO: 1600234 - RNA, 21 nt, Homo sapiens
uaaguucagcacuugucucau

SEQ ID NO: 1600235 - RNA, 20 nt, Homo sapiens
uaaguuugaaacuaacucau

SEQ ID NO: 1600236 - RNA, 22 nt, Homo sapiens
uaaguuuuauguuaaaucaaua

SEQ ID NO: 1600237 - RNA, 16 nt, Homo sapiens
uaauaaaaguacaugu

SEQ ID NO: 1600238 - RNA, 13 nt, Homo sapiens
uaauaaacauguc

SEQ ID NO: 1600239 - RNA, 20 nt, Homo sapiens
uaauaaagaagcuacuauuu

SEQ ID NO: 1600240 - RNA, 17 nt, Homo sapiens
uaauaaauuuucuaaaa

SEQ ID NO: 1600241 - RNA, 14 nt, Homo sapiens
uaauaacuuaucua

SEQ ID NO: 1600242 - RNA, 19 nt, Homo sapiens
uaauaacuuucucugugaa

SEQ ID NO: 1600243 - RNA, 21 nt, Homo sapiens
uaauaacuuucucugugaaag

SEQ ID NO: 1600244 - RNA, 11 nt, Homo sapiens
uaauaagcaau

SEQ ID NO: 1600245 - RNA, 19 nt, Homo sapiens
uaauaagcaaucaagguua

SEQ ID NO: 1600246 - RNA, 19 nt, Homo sapiens
uaauaauuuauauguaugg

SEQ ID NO: 1600247 - RNA, 13 nt, Homo sapiens
uaauaauuugcuc

SEQ ID NO: 1600248 - RNA, 15 nt, Homo sapiens
ggguggcccacugag

SEQ ID NO: 1600249 - RNA, 18 nt, Homo sapiens
gggugugcuguugccuuc

SEQ ID NO: 1600250 - RNA, 20 nt, Homo sapiens
ggguugcuaggaaaagaaau

SEQ ID NO: 1600251 - RNA, 21 nt, Homo sapiens
ggguuggcuguuccagacuca

SEQ ID NO: 1600252 - RNA, 21 nt, Homo sapiens
ggguuuggcaaaacucaggca

SEQ ID NO: 1600253 - RNA, 13 nt, Homo sapiens
gguaaaacagggc

SEQ ID NO: 1600254 - RNA, 16 nt, Homo sapiens
gguaaaacauuacuua

SEQ ID NO: 1600255 - RNA, 17 nt, Homo sapiens
gguaaaacucacuguga

SEQ ID NO: 1600256 - RNA, 19 nt, Homo sapiens
gguaaaagcaccauuguga

SEQ ID NO: 1600257 - RNA, 12 nt, Homo sapiens
gguaaagugcaa

SEQ ID NO: 1600258 - RNA, 14 nt, Homo sapiens
gguaaagugcaaug

SEQ ID NO: 1600259 - RNA, 21 nt, Homo sapiens
gguaauaauuuuuuugucagu

SEQ ID NO: 1600260 - RNA, 23 nt, Homo sapiens
gguaauauuuucuuuuauggcaa

SEQ ID NO: 1600261 - RNA, 16 nt, Homo sapiens
gguacacuguuuccau

SEQ ID NO: 1600262 - RNA, 12 nt, Homo sapiens
gguacugugaug

SEQ ID NO: 1600263 - RNA, 13 nt, Homo sapiens
gguacuuauacua

SEQ ID NO: 1600264 - RNA, 21 nt, Homo sapiens
gguacuugaucauuuuuacca

SEQ ID NO: 1600265 - RNA, 23 nt, Homo sapiens
gguaggucauucuuuugccacau

SEQ ID NO: 1600266 - RNA, 23 nt, Homo sapiens
gguaguuuguuuuagaaccagcc

SEQ ID NO: 1600267 - RNA, 13 nt, Homo sapiens
gguauaaugauac

SEQ ID NO: 1600268 - RNA, 21 nt, Homo sapiens
gguaucucuggcaccacacua

SEQ ID NO: 1600269 - RNA, 12 nt, Homo sapiens
gguaugauuaac

SEQ ID NO: 1600270 - RNA, 22 nt, Homo sapiens
ggucaacauagugagacacugu

SEQ ID NO: 1600271 - RNA, 21 nt, Homo sapiens
ggucaagagaguucugaccug

SEQ ID NO: 1600272 - RNA, 20 nt, Homo sapiens
ggucaauuuuguuauguaua

SEQ ID NO: 1600273 - RNA, 20 nt, Homo sapiens
ggucacccaacucaaggaca

SEQ ID NO: 1600274 - RNA, 21 nt, Homo sapiens
ggucacccaacucaaggacag

SEQ ID NO: 1600275 - RNA, 21 nt, Homo sapiens
ggucagaacccugccauggaa

SEQ ID NO: 1600276 - RNA, 14 nt, Homo sapiens
ggucagagugccac

SEQ ID NO: 1600277 - RNA, 12 nt, Homo sapiens
ggucagcauuug

SEQ ID NO: 1600278 - RNA, 21 nt, Homo sapiens
ggucaggagaaugaaacagcu

SEQ ID NO: 1600279 - RNA, 16 nt, Homo sapiens
ggucaucaccucccag

SEQ ID NO: 1600280 - RNA, 15 nt, Homo sapiens
ggucauccaaacuca

SEQ ID NO: 1600281 - RNA, 17 nt, Homo sapiens
ggucauccaaacucaaa

SEQ ID NO: 1600282 - RNA, 19 nt, Homo sapiens
gguccacagguccaaggac

SEQ ID NO: 1600283 - RNA, 22 nt, Homo sapiens
gguccagcuugcucuucagugg

SEQ ID NO: 1600284 - RNA, 23 nt, Homo sapiens
ggucccagccccuccucccucag

SEQ ID NO: 1600285 - RNA, 13 nt, Homo sapiens
ggucccggggcca

SEQ ID NO: 1600286 - RNA, 20 nt, Homo sapiens
ggucccggggccagcacuuc

SEQ ID NO: 1600287 - RNA, 16 nt, Homo sapiens
ggucccuggagggcaa

SEQ ID NO: 1600288 - RNA, 17 nt, Homo sapiens
ggucccuuggucaggag

SEQ ID NO: 1600289 - RNA, 16 nt, Homo sapiens
gguccuggcagggcgc

SEQ ID NO: 1600290 - RNA, 15 nt, Homo sapiens
ggucuucccuaccuc

SEQ ID NO: 1600291 - RNA, 18 nt, Homo sapiens
ggugaaaccccgucucua

SEQ ID NO: 1600292 - RNA, 14 nt, Homo sapiens
ggugaaagugcagu

SEQ ID NO: 1600293 - RNA, 13 nt, Homo sapiens
ggugaaguaaauu

SEQ ID NO: 1600294 - RNA, 14 nt, Homo sapiens
ggugacaccucccc

SEQ ID NO: 1600295 - RNA, 13 nt, Homo sapiens
ggugacacucuau

SEQ ID NO: 1600296 - RNA, 16 nt, Homo sapiens
ggugacuucaggugga

SEQ ID NO: 1600297 - RNA, 14 nt, Homo sapiens
ggugaggcaauaaa

SEQ ID NO: 1600298 - RNA, 15 nt, Homo sapiens
ggugaggucuguucc

SEQ ID NO: 1600299 - RNA, 15 nt, Homo sapiens
ggugauagguaaauu

SEQ ID NO: 1600300 - RNA, 15 nt, Homo sapiens
ggugaugucacucac

SEQ ID NO: 1600301 - RNA, 14 nt, Homo sapiens
ggugccagcugccc

SEQ ID NO: 1600302 - RNA, 17 nt, Homo sapiens
ggugcccucucacuuga

SEQ ID NO: 1600303 - RNA, 15 nt, Homo sapiens
ggugccuucacuggg

SEQ ID NO: 1600304 - RNA, 23 nt, Homo sapiens
ggugcuacacccuuuuccagcug

SEQ ID NO: 1600305 - RNA, 21 nt, Homo sapiens
ggugcugcuuucuuguugcug

SEQ ID NO: 1600306 - RNA, 21 nt, Homo sapiens
gguggcaccugccacucugcc

SEQ ID NO: 1600307 - RNA, 20 nt, Homo sapiens
gguggccagaaauaaaggga

SEQ ID NO: 1600308 - RNA, 19 nt, Homo sapiens
ggugggauccacacugaga

SEQ ID NO: 1600309 - RNA, 18 nt, Homo sapiens
gguggugaguucugacua

SEQ ID NO: 1600310 - RNA, 14 nt, Homo sapiens
gguggugucuccaa

SEQ ID NO: 1600311 - RNA, 16 nt, Homo sapiens
ggugguuuuugcucuc

SEQ ID NO: 1600312 - RNA, 18 nt, Homo sapiens
gguguaauuuuguccucu

SEQ ID NO: 1600313 - RNA, 18 nt, Homo sapiens
ggugucaagugccugcac

SEQ ID NO: 1600314 - RNA, 18 nt, Homo sapiens
gguguccagcauugcugg

SEQ ID NO: 1600315 - RNA, 12 nt, Homo sapiens
ggugucugugac

SEQ ID NO: 1600316 - RNA, 13 nt, Homo sapiens
ggugugaggucca

SEQ ID NO: 1600317 - RNA, 16 nt, Homo sapiens
ggugugcacaccaaag

SEQ ID NO: 1600318 - RNA, 15 nt, Homo sapiens
ggugugcucagggga

SEQ ID NO: 1600319 - RNA, 12 nt, Homo sapiens
gguguguuacac

SEQ ID NO: 1600320 - RNA, 15 nt, Homo sapiens
gguguuugucugugu

SEQ ID NO: 1600321 - RNA, 14 nt, Homo sapiens
gguuaacaccagag

SEQ ID NO: 1600322 - RNA, 15 nt, Homo sapiens
gguuaauucauuugg

SEQ ID NO: 1600323 - RNA, 19 nt, Homo sapiens
gguuaccuuuguucccaaa

SEQ ID NO: 1600324 - RNA, 21 nt, Homo sapiens
gguuauguugauaaaccaaaa

SEQ ID NO: 1600325 - RNA, 18 nt, Homo sapiens
gguucuaacugcuguuaa

SEQ ID NO: 1600326 - RNA, 18 nt, Homo sapiens
gguucucagaaccauuuc

SEQ ID NO: 1600327 - RNA, 12 nt, Homo sapiens
gguucucuacag

SEQ ID NO: 1600328 - RNA, 23 nt, Homo sapiens
gguucucuuagcaacucagagaa

SEQ ID NO: 1600329 - RNA, 14 nt, Homo sapiens
gguucugagcaaau

SEQ ID NO: 1600330 - RNA, 20 nt, Homo sapiens
gguucuuaaaaaggaacaaa

SEQ ID NO: 1600331 - RNA, 13 nt, Homo sapiens
gguugcagugagc

SEQ ID NO: 1600332 - RNA, 19 nt, Homo sapiens
gguugggcuggugcucaca

SEQ ID NO: 1600333 - RNA, 22 nt, Homo sapiens
gguugggugugggcagucauca

SEQ ID NO: 1600334 - RNA, 19 nt, Homo sapiens
gguuucauguuaguuaccu

SEQ ID NO: 1600335 - RNA, 15 nt, Homo sapiens
gguuucuggggucca

SEQ ID NO: 1600336 - RNA, 16 nt, Homo sapiens
gguuucuuauucaaag

SEQ ID NO: 1600337 - RNA, 18 nt, Homo sapiens
gguuugcaagaaugaaau

SEQ ID NO: 1600338 - RNA, 16 nt, Homo sapiens
gguuugguccuugaac

SEQ ID NO: 1600339 - RNA, 19 nt, Homo sapiens
gguuuguuauaucagggaa

SEQ ID NO: 1600340 - RNA, 15 nt, Homo sapiens
guaaaaaugcugcuc

SEQ ID NO: 1600341 - RNA, 14 nt, Homo sapiens
guaaaacauuacuu

SEQ ID NO: 1600342 - RNA, 19 nt, Homo sapiens
guaaaagcaccauugugaa

SEQ ID NO: 1600343 - RNA, 15 nt, Homo sapiens
guaaaagucuaccug

SEQ ID NO: 1600344 - RNA, 22 nt, Homo sapiens
guaaaaugaguuuguauuauua

SEQ ID NO: 1600345 - RNA, 23 nt, Homo sapiens
guaaaaugcaccaaucagcagga

SEQ ID NO: 1600346 - RNA, 19 nt, Homo sapiens
guaaaauuaauguaauaaa

SEQ ID NO: 1600347 - RNA, 15 nt, Homo sapiens
guaaaauuuguguaa

SEQ ID NO: 1600348 - RNA, 22 nt, Homo sapiens
guaaaauuuguguaaauuugua

SEQ ID NO: 1600349 - RNA, 13 nt, Homo sapiens
guaaaccuugaag

SEQ ID NO: 1600350 - RNA, 18 nt, Homo sapiens
guaaacuaguacuauuau

SEQ ID NO: 1600351 - RNA, 15 nt, Homo sapiens
guaaacuaugaccua

SEQ ID NO: 1600352 - RNA, 20 nt, Homo sapiens
guaaacuguacuagucugug

SEQ ID NO: 1600353 - RNA, 14 nt, Homo sapiens
guaaacugugcacc

SEQ ID NO: 1600354 - RNA, 15 nt, Homo sapiens
guaaaguauuugaug

SEQ ID NO: 1600355 - RNA, 14 nt, Homo sapiens
guaaagugauuaaa

SEQ ID NO: 1600356 - RNA, 16 nt, Homo sapiens
guaaauaaacaaguca

SEQ ID NO: 1600357 - RNA, 21 nt, Homo sapiens
guaaauaaccccauucuuugc

SEQ ID NO: 1600358 - RNA, 15 nt, Homo sapiens
guaaauagaugacaa

SEQ ID NO: 1600359 - RNA, 21 nt, Homo sapiens
guaaauauuuguuacuuuuag

SEQ ID NO: 1600360 - RNA, 20 nt, Homo sapiens
guaaauguguuagcacugau

SEQ ID NO: 1600361 - RNA, 22 nt, Homo sapiens
guaaauuaguguaccuauuaaa

SEQ ID NO: 1600362 - RNA, 13 nt, Homo sapiens
guaaauugcaaau

SEQ ID NO: 1600363 - RNA, 14 nt, Homo sapiens
guaaauugcaaaua

SEQ ID NO: 1600364 - RNA, 15 nt, Homo sapiens
guaaauuuaagucca

SEQ ID NO: 1600365 - RNA, 23 nt, Homo sapiens
guaacagcauuaacugucuuaaa

SEQ ID NO: 1600366 - RNA, 14 nt, Homo sapiens
guaacaucugccau

SEQ ID NO: 1600367 - RNA, 14 nt, Homo sapiens
ggcgggaaugagcu

SEQ ID NO: 1600368 - RNA, 13 nt, Homo sapiens
ggcguuacugcuu

SEQ ID NO: 1600369 - RNA, 19 nt, Homo sapiens
ggcuaaaugaaguguguua

SEQ ID NO: 1600370 - RNA, 22 nt, Homo sapiens
ggcuaagaagugacucuugcaa

SEQ ID NO: 1600371 - RNA, 21 nt, Homo sapiens
ggcuaccucagaaagauuuga

SEQ ID NO: 1600372 - RNA, 12 nt, Homo sapiens
ggcuacucugcu

SEQ ID NO: 1600373 - RNA, 16 nt, Homo sapiens
ggcuagaacuggagag

SEQ ID NO: 1600374 - RNA, 20 nt, Homo sapiens
ggcuagagugcaauggcgcg

SEQ ID NO: 1600375 - RNA, 14 nt, Homo sapiens
ggcuagcuucugcu

SEQ ID NO: 1600376 - RNA, 16 nt, Homo sapiens
ggcuaucaacuuaaua

SEQ ID NO: 1600377 - RNA, 19 nt, Homo sapiens
ggcuaugaggauaauggga

SEQ ID NO: 1600378 - RNA, 22 nt, Homo sapiens
ggcucaugggugggacauggaa

SEQ ID NO: 1600379 - RNA, 16 nt, Homo sapiens
ggcuccaucaccagcc

SEQ ID NO: 1600380 - RNA, 14 nt, Homo sapiens
ggcuccuccuuaug

SEQ ID NO: 1600381 - RNA, 22 nt, Homo sapiens
ggcuccugggagggagacucag

SEQ ID NO: 1600382 - RNA, 16 nt, Homo sapiens
ggcuccuggugcuaac

SEQ ID NO: 1600383 - RNA, 21 nt, Homo sapiens
ggcucuaacaaugacauuuau

SEQ ID NO: 1600384 - RNA, 19 nt, Homo sapiens
ggcucugacagaaagcaga

SEQ ID NO: 1600385 - RNA, 21 nt, Homo sapiens
ggcucugugcagucacuggag

SEQ ID NO: 1600386 - RNA, 12 nt, Homo sapiens
ggcucuucucau

SEQ ID NO: 1600387 - RNA, 15 nt, Homo sapiens
ggcucuucucauuuc

SEQ ID NO: 1600388 - RNA, 16 nt, Homo sapiens
ggcucuucucauuuca

SEQ ID NO: 1600389 - RNA, 18 nt, Homo sapiens
ggcugacaugaagcuguu

SEQ ID NO: 1600390 - RNA, 18 nt, Homo sapiens
ggcugaugcugggacccu

SEQ ID NO: 1600391 - RNA, 17 nt, Homo sapiens
ggcugcaaggagcaaca

SEQ ID NO: 1600392 - RNA, 19 nt, Homo sapiens
ggcuggaagauagcuguga

SEQ ID NO: 1600393 - RNA, 20 nt, Homo sapiens
ggcuggagugcaguggcgcg

SEQ ID NO: 1600394 - RNA, 20 nt, Homo sapiens
ggcuggagugcgguggcgca

SEQ ID NO: 1600395 - RNA, 16 nt, Homo sapiens
ggcuggucugauggaa

SEQ ID NO: 1600396 - RNA, 21 nt, Homo sapiens
ggcugucugucaccagcuauc

SEQ ID NO: 1600397 - RNA, 11 nt, Homo sapiens
ggcugugccaa

SEQ ID NO: 1600398 - RNA, 17 nt, Homo sapiens
ggcuuaaaccuggaauc

SEQ ID NO: 1600399 - RNA, 22 nt, Homo sapiens
ggcuuaacacagugggugguga

SEQ ID NO: 1600400 - RNA, 23 nt, Homo sapiens
ggcuuaaggagaggagaaacuga

SEQ ID NO: 1600401 - RNA, 11 nt, Homo sapiens
ggcuucacagc

SEQ ID NO: 1600402 - RNA, 19 nt, Homo sapiens
ggcuuccccagguggccug

SEQ ID NO: 1600403 - RNA, 23 nt, Homo sapiens
ggcuuccucaaauacaugcacag

SEQ ID NO: 1600404 - RNA, 14 nt, Homo sapiens
ggcuucuccaggga

SEQ ID NO: 1600405 - RNA, 21 nt, Homo sapiens
ggcuucucucaggcccagugg

SEQ ID NO: 1600406 - RNA, 13 nt, Homo sapiens
ggcuugaagccaa

SEQ ID NO: 1600407 - RNA, 12 nt, Homo sapiens
ggcuugaugucc

SEQ ID NO: 1600408 - RNA, 20 nt, Homo sapiens
ggcuuuacaguguaaacugu

SEQ ID NO: 1600409 - RNA, 14 nt, Homo sapiens
ggcuuugggguccu

SEQ ID NO: 1600410 - RNA, 14 nt, Homo sapiens
ggcuuuguggcacu

SEQ ID NO: 1600411 - RNA, 14 nt, Homo sapiens
gggaaacugggaaa

SEQ ID NO: 1600412 - RNA, 23 nt, Homo sapiens
gggaagcaguguguacuucuuca

SEQ ID NO: 1600413 - RNA, 22 nt, Homo sapiens
gggaagcucacacauccuguca

SEQ ID NO: 1600414 - RNA, 15 nt, Homo sapiens
gggaaggucaccagc

SEQ ID NO: 1600415 - RNA, 17 nt, Homo sapiens
gggaauguuguuccagg

SEQ ID NO: 1600416 - RNA, 22 nt, Homo sapiens
gggaccaacugggcccaagaca

SEQ ID NO: 1600417 - RNA, 20 nt, Homo sapiens
gggacccugcccagagcuga

SEQ ID NO: 1600418 - RNA, 15 nt, Homo sapiens
gggaccgacuuucca

SEQ ID NO: 1600419 - RNA, 12 nt, Homo sapiens
gggacuaggacc

SEQ ID NO: 1600420 - RNA, 19 nt, Homo sapiens
gggacuaucuuugcugcag

SEQ ID NO: 1600421 - RNA, 18 nt, Homo sapiens
gggacuaugguggccaag

SEQ ID NO: 1600422 - RNA, 13 nt, Homo sapiens
gggagaacucauu

SEQ ID NO: 1600423 - RNA, 22 nt, Homo sapiens
gggagacagggcugcuccccaa

SEQ ID NO: 1600424 - RNA, 16 nt, Homo sapiens
gggagagagugcuauu

SEQ ID NO: 1600425 - RNA, 18 nt, Homo sapiens
gggagauuaaaaccagag

SEQ ID NO: 1600426 - RNA, 12 nt, Homo sapiens
gggagcccagug

SEQ ID NO: 1600427 - RNA, 16 nt, Homo sapiens
gggagcccagugaagc

SEQ ID NO: 1600428 - RNA, 20 nt, Homo sapiens
gggagccgcuucuccaaguc

SEQ ID NO: 1600429 - RNA, 13 nt, Homo sapiens
gggaggaacaaag

SEQ ID NO: 1600430 - RNA, 18 nt, Homo sapiens
gggaggaagcuacccaag

SEQ ID NO: 1600431 - RNA, 20 nt, Homo sapiens
gggaggcagagguugcagug

SEQ ID NO: 1600432 - RNA, 12 nt, Homo sapiens
gggagugucuaa

SEQ ID NO: 1600433 - RNA, 15 nt, Homo sapiens
gggaguuuagggugg

SEQ ID NO: 1600434 - RNA, 22 nt, Homo sapiens
gggauggaagcaggacagacac

SEQ ID NO: 1600435 - RNA, 19 nt, Homo sapiens
gggaugucugaaaucagug

SEQ ID NO: 1600436 - RNA, 19 nt, Homo sapiens
gggaugucugagaucagug

SEQ ID NO: 1600437 - RNA, 23 nt, Homo sapiens
gggauuaaggcgugagccacugc

SEQ ID NO: 1600438 - RNA, 20 nt, Homo sapiens
gggauucuguacaugcauug

SEQ ID NO: 1600439 - RNA, 19 nt, Homo sapiens
gggcaacgagugaaacucc

SEQ ID NO: 1600440 - RNA, 14 nt, Homo sapiens
gggcaacuguagaa

SEQ ID NO: 1600441 - RNA, 20 nt, Homo sapiens
gggcaccaggggccaaccuc

SEQ ID NO: 1600442 - RNA, 15 nt, Homo sapiens
gggcacugcacccug

SEQ ID NO: 1600443 - RNA, 19 nt, Homo sapiens
gggcacuggcggucaagug

SEQ ID NO: 1600444 - RNA, 23 nt, Homo sapiens
gggcagaguuucugcaguuccau

SEQ ID NO: 1600445 - RNA, 20 nt, Homo sapiens
gggcaggagggcccuaccug

SEQ ID NO: 1600446 - RNA, 15 nt, Homo sapiens
gggcagggccacuca

SEQ ID NO: 1600447 - RNA, 14 nt, Homo sapiens
gggcagucauuauc

SEQ ID NO: 1600448 - RNA, 15 nt, Homo sapiens
gggcccagcccagag

SEQ ID NO: 1600449 - RNA, 14 nt, Homo sapiens
gggccccauccuca

SEQ ID NO: 1600450 - RNA, 19 nt, Homo sapiens
gggcccccaauaaaccagu

SEQ ID NO: 1600451 - RNA, 22 nt, Homo sapiens
gggcccggcgaggguaugucag

SEQ ID NO: 1600452 - RNA, 14 nt, Homo sapiens
gggccucugcauuu

SEQ ID NO: 1600453 - RNA, 19 nt, Homo sapiens
gggccucugcucccaugcu

SEQ ID NO: 1600454 - RNA, 17 nt, Homo sapiens
gggccuguggggacuga

SEQ ID NO: 1600455 - RNA, 12 nt, Homo sapiens
gggcgcgguggc

SEQ ID NO: 1600456 - RNA, 21 nt, Homo sapiens
gggcuaaaaagguccuguaag

SEQ ID NO: 1600457 - RNA, 19 nt, Homo sapiens
gggcugauuguauuuaccu

SEQ ID NO: 1600458 - RNA, 12 nt, Homo sapiens
gggcuggcacag

SEQ ID NO: 1600459 - RNA, 18 nt, Homo sapiens
gggcuucacugcugugac

SEQ ID NO: 1600460 - RNA, 16 nt, Homo sapiens
gggcuuucuggggccu

SEQ ID NO: 1600461 - RNA, 14 nt, Homo sapiens
ggggaagagugacu

SEQ ID NO: 1600462 - RNA, 18 nt, Homo sapiens
ggggacaauaugugccaa

SEQ ID NO: 1600463 - RNA, 16 nt, Homo sapiens
ggggacacagcaucag

SEQ ID NO: 1600464 - RNA, 13 nt, Homo sapiens
ggggacaggugac

SEQ ID NO: 1600465 - RNA, 19 nt, Homo sapiens
ggggagcaugcuauggcau

SEQ ID NO: 1600466 - RNA, 15 nt, Homo sapiens
ggggaucgaugugcu

SEQ ID NO: 1600467 - RNA, 15 nt, Homo sapiens
ggggaugucucucau

SEQ ID NO: 1600468 - RNA, 12 nt, Homo sapiens
ggggauuuugcu

SEQ ID NO: 1600469 - RNA, 16 nt, Homo sapiens
ggggauuuuuaugucu

SEQ ID NO: 1600470 - RNA, 23 nt, Homo sapiens
ggggcaaauagagagucuccaag

SEQ ID NO: 1600471 - RNA, 22 nt, Homo sapiens
ggggcacaagugucugugcaug

SEQ ID NO: 1600472 - RNA, 20 nt, Homo sapiens
ggggcagacaauaaacccuc

SEQ ID NO: 1600473 - RNA, 18 nt, Homo sapiens
ggggccuggggagcccac

SEQ ID NO: 1600474 - RNA, 13 nt, Homo sapiens
ggggguuccguga

SEQ ID NO: 1600475 - RNA, 17 nt, Homo sapiens
ggggguuuuuaaucuuu

SEQ ID NO: 1600476 - RNA, 13 nt, Homo sapiens
gggguccaucccc

SEQ ID NO: 1600477 - RNA, 17 nt, Homo sapiens
gggguuucuggggucca

SEQ ID NO: 1600478 - RNA, 19 nt, Homo sapiens
ggguaagaagaaagcaaaa

SEQ ID NO: 1600479 - RNA, 12 nt, Homo sapiens
ggguacuauuca

SEQ ID NO: 1600480 - RNA, 23 nt, Homo sapiens
ggguauuguuaggagaugucauc

SEQ ID NO: 1600481 - RNA, 18 nt, Homo sapiens
gggucaguggccaggugc

SEQ ID NO: 1600482 - RNA, 22 nt, Homo sapiens
ggguccuagaugccaaaggggu

SEQ ID NO: 1600483 - RNA, 18 nt, Homo sapiens
ggguccucuggggccuuc

SEQ ID NO: 1600484 - RNA, 19 nt, Homo sapiens
gggucucguuuuguugcca

SEQ ID NO: 1600485 - RNA, 20 nt, Homo sapiens
gggugccuucacugggccag

SEQ ID NO: 1600486 - RNA, 11 nt, Homo sapiens
aaaaaaaagcu

SEQ ID NO: 1600487 - RNA, 15 nt, Homo sapiens
aaaaaaacauaucca

SEQ ID NO: 1600488 - RNA, 21 nt, Homo sapiens
aaaaaacaggcccccaugugc

SEQ ID NO: 1600489 - RNA, 12 nt, Homo sapiens
aaaaaaccacau

SEQ ID NO: 1600490 - RNA, 12 nt, Homo sapiens
aaaaaacugcau

SEQ ID NO: 1600491 - RNA, 18 nt, Homo sapiens
aaaaaagagaacaccucc

SEQ ID NO: 1600492 - RNA, 13 nt, Homo sapiens
aaaaaagcuuuau

SEQ ID NO: 1600493 - RNA, 12 nt, Homo sapiens
aaaaaaguucau

SEQ ID NO: 1600494 - RNA, 21 nt, Homo sapiens
aaaaaaugauaaggcucugaa

SEQ ID NO: 1600495 - RNA, 12 nt, Homo sapiens
aaaaacaauaaa

SEQ ID NO: 1600496 - RNA, 13 nt, Homo sapiens
aaaaacaauaaag

SEQ ID NO: 1600497 - RNA, 19 nt, Homo sapiens
agaaaaagucaauguacuu

SEQ ID NO: 1600498 - RNA, 21 nt, Homo sapiens
agaaaacacuacagugguuua

SEQ ID NO: 1600499 - RNA, 15 nt, Homo sapiens
agaaaaccaaagggu

SEQ ID NO: 1600500 - RNA, 20 nt, Homo sapiens
agaaaaccuaagcaaacuua

SEQ ID NO: 1600501 - RNA, 22 nt, Homo sapiens
agaaaagaauuuuaguguuaau

SEQ ID NO: 1600502 - RNA, 19 nt, Homo sapiens
agaaaagcaguggcuccau

SEQ ID NO: 1600503 - RNA, 20 nt, Homo sapiens
agaaaaggcagcuaaaggaa

SEQ ID NO: 1600504 - RNA, 20 nt, Homo sapiens
agaaaaggccaauauaccua

SEQ ID NO: 1600505 - RNA, 12 nt, Homo sapiens
agaaaauaucuu

SEQ ID NO: 1600506 - RNA, 22 nt, Homo sapiens
agaaaaucuaccaagaacagag

SEQ ID NO: 1600507 - RNA, 23 nt, Homo sapiens
agaaaaugacuuauuucugcucu

SEQ ID NO: 1600508 - RNA, 22 nt, Homo sapiens
agaaaauguugagaaucccaaa

SEQ ID NO: 1600509 - RNA, 18 nt, Homo sapiens
agaaacuugugaagugga

SEQ ID NO: 1600510 - RNA, 21 nt, Homo sapiens
agaaacuuucuggugcugucu

SEQ ID NO: 1600511 - RNA, 14 nt, Homo sapiens
agaaagaaugcauu

SEQ ID NO: 1600512 - RNA, 19 nt, Homo sapiens
agaaagaccaggccaaugu

SEQ ID NO: 1600513 - RNA, 22 nt, Homo sapiens
agaaagacuuaucaacauuugu

SEQ ID NO: 1600514 - RNA, 14 nt, Homo sapiens
agaaagagccugaa

SEQ ID NO: 1600515 - RNA, 19 nt, Homo sapiens
agaaagaggaguagcauga

SEQ ID NO: 1600516 - RNA, 22 nt, Homo sapiens
agaaagaugacaaaagaaaauu

SEQ ID NO: 1600517 - RNA, 13 nt, Homo sapiens
agaaagcauuucu

SEQ ID NO: 1600518 - RNA, 18 nt, Homo sapiens
agaaaggauuuccuuucu

SEQ ID NO: 1600519 - RNA, 17 nt, Homo sapiens
agaaagggaaacuggcu

SEQ ID NO: 1600520 - RNA, 15 nt, Homo sapiens
agaaaguacaaacuu

SEQ ID NO: 1600521 - RNA, 18 nt, Homo sapiens
agaaagugaagcaaauca

SEQ ID NO: 1600522 - RNA, 22 nt, Homo sapiens
agaaagugaggcucagauuaaa

SEQ ID NO: 1600523 - RNA, 21 nt, Homo sapiens
agaaauagaggugaugcugcu

SEQ ID NO: 1600524 - RNA, 22 nt, Homo sapiens
agaaaucaaugguagcauuuag

SEQ ID NO: 1600525 - RNA, 14 nt, Homo sapiens
agaaaugaacauuc

SEQ ID NO: 1600526 - RNA, 15 nt, Homo sapiens
agaaaugaucuuuac

SEQ ID NO: 1600527 - RNA, 18 nt, Homo sapiens
agaaaugaugauguggaa

SEQ ID NO: 1600528 - RNA, 12 nt, Homo sapiens
agaaaugauuca

SEQ ID NO: 1600529 - RNA, 13 nt, Homo sapiens
agaaaugcaaaac

SEQ ID NO: 1600530 - RNA, 19 nt, Homo sapiens
agaaauggauguaagccug

SEQ ID NO: 1600531 - RNA, 20 nt, Homo sapiens
agaaauggauguaagccugg

SEQ ID NO: 1600532 - RNA, 22 nt, Homo sapiens
agaaauggccaaauauauuucc

SEQ ID NO: 1600533 - RNA, 11 nt, Homo sapiens
agaaauuacua

SEQ ID NO: 1600534 - RNA, 20 nt, Homo sapiens
agaaauuaggagugcugaua

SEQ ID NO: 1600535 - RNA, 22 nt, Homo sapiens
agaaauuaggagugcugauaag

SEQ ID NO: 1600536 - RNA, 13 nt, Homo sapiens
agaaauuccccaa

SEQ ID NO: 1600537 - RNA, 21 nt, Homo sapiens
agaaauuggaagaagcacuga

SEQ ID NO: 1600538 - RNA, 20 nt, Homo sapiens
agaaauuuggcuauaaucuu

SEQ ID NO: 1600539 - RNA, 21 nt, Homo sapiens
agaacaaaagaauaacauuuu

SEQ ID NO: 1600540 - RNA, 17 nt, Homo sapiens
agaacaaauuguuuaca

SEQ ID NO: 1600541 - RNA, 13 nt, Homo sapiens
agaacacuaaccu

SEQ ID NO: 1600542 - RNA, 22 nt, Homo sapiens
agaacaguuuuacaauagacau

SEQ ID NO: 1600543 - RNA, 21 nt, Homo sapiens
agaacauuuuauaaaacauac

SEQ ID NO: 1600544 - RNA, 20 nt, Homo sapiens
agaaccaaggaaucauguca

SEQ ID NO: 1600545 - RNA, 19 nt, Homo sapiens
agaaccagggcucuucuca

SEQ ID NO: 1600546 - RNA, 13 nt, Homo sapiens
agaaccauuacaa

SEQ ID NO: 1600547 - RNA, 13 nt, Homo sapiens
agaaccauuucac

SEQ ID NO: 1600548 - RNA, 15 nt, Homo sapiens
agaacccugcuguuu

SEQ ID NO: 1600549 - RNA, 13 nt, Homo sapiens
agaaccucuuccc

SEQ ID NO: 1600550 - RNA, 17 nt, Homo sapiens
agaaccuucaacccagu

SEQ ID NO: 1600551 - RNA, 18 nt, Homo sapiens
agaacggggcucuucuca

SEQ ID NO: 1600552 - RNA, 23 nt, Homo sapiens
agaacggggcucuucucauuuca

SEQ ID NO: 1600553 - RNA, 23 nt, Homo sapiens
agaacguggugaccuuucacgaa

SEQ ID NO: 1600554 - RNA, 16 nt, Homo sapiens
agaacucacagaaaua

SEQ ID NO: 1600555 - RNA, 17 nt, Homo sapiens
agaacuggugcucucuu

SEQ ID NO: 1600556 - RNA, 14 nt, Homo sapiens
agaagaagaaggag

SEQ ID NO: 1600557 - RNA, 18 nt, Homo sapiens
agaagaagcccauaucac

SEQ ID NO: 1600558 - RNA, 14 nt, Homo sapiens
agaagagauuucuc

SEQ ID NO: 1600559 - RNA, 13 nt, Homo sapiens
agaagcaagccag

SEQ ID NO: 1600560 - RNA, 14 nt, Homo sapiens
agaagcaagccaga

SEQ ID NO: 1600561 - RNA, 16 nt, Homo sapiens
agaagcaaucuuugaa

SEQ ID NO: 1600562 - RNA, 21 nt, Homo sapiens
agaagcagaagggcagaagau

SEQ ID NO: 1600563 - RNA, 19 nt, Homo sapiens
agaagccaaacagcaagaa

SEQ ID NO: 1600564 - RNA, 13 nt, Homo sapiens
agaagccagcuuu

SEQ ID NO: 1600565 - RNA, 15 nt, Homo sapiens
agaagcccauaucac

SEQ ID NO: 1600566 - RNA, 23 nt, Homo sapiens
agaagccccaagcaacuuuccuu

SEQ ID NO: 1600567 - RNA, 12 nt, Homo sapiens
agaagcccugau

SEQ ID NO: 1600568 - RNA, 11 nt, Homo sapiens
agaagcucucg

SEQ ID NO: 1600569 - RNA, 20 nt, Homo sapiens
agaagcugaggcuaguucca

SEQ ID NO: 1600570 - RNA, 17 nt, Homo sapiens
agaagcuguaggacugu

SEQ ID NO: 1600571 - RNA, 14 nt, Homo sapiens
agaaggcaaaaaug

SEQ ID NO: 1600572 - RNA, 15 nt, Homo sapiens
agaaggcuaugggga

SEQ ID NO: 1600573 - RNA, 22 nt, Homo sapiens
agaaggggugcagaguguuuac

SEQ ID NO: 1600574 - RNA, 23 nt, Homo sapiens
agaaggguggggauaucagggca

SEQ ID NO: 1600575 - RNA, 18 nt, Homo sapiens
agaagguugagggcaaug

SEQ ID NO: 1600576 - RNA, 15 nt, Homo sapiens
agaaguaaucaguau

SEQ ID NO: 1600577 - RNA, 16 nt, Homo sapiens
agaaguccacagacau

SEQ ID NO: 1600578 - RNA, 22 nt, Homo sapiens
agaaguccacagacaucuuuca

SEQ ID NO: 1600579 - RNA, 16 nt, Homo sapiens
agaagugcaucuggag

SEQ ID NO: 1600580 - RNA, 12 nt, Homo sapiens
agaagugcuuua

SEQ ID NO: 1600581 - RNA, 23 nt, Homo sapiens
agaaguguggggauuuucacuga

SEQ ID NO: 1600582 - RNA, 16 nt, Homo sapiens
agaaguugagauucaa

SEQ ID NO: 1600583 - RNA, 23 nt, Homo sapiens
agaaguugcugcuugugaucuca

SEQ ID NO: 1600584 - RNA, 23 nt, Homo sapiens
agaauaagacaagagaucuacac

SEQ ID NO: 1600585 - RNA, 14 nt, Homo sapiens
agaaucaacauuuc

SEQ ID NO: 1600586 - RNA, 14 nt, Homo sapiens
agaaucacuugaac

SEQ ID NO: 1600587 - RNA, 16 nt, Homo sapiens
agaaucacuugaaccc

SEQ ID NO: 1600588 - RNA, 17 nt, Homo sapiens
agaauccguauugaauu

SEQ ID NO: 1600589 - RNA, 21 nt, Homo sapiens
agaaucuagagcaaagccauc

SEQ ID NO: 1600590 - RNA, 21 nt, Homo sapiens
agaaucucuucaugcuugaca

SEQ ID NO: 1600591 - RNA, 19 nt, Homo sapiens
agaaucuuguuuugaaaau

SEQ ID NO: 1600592 - RNA, 16 nt, Homo sapiens
agaaugaagggccagg

SEQ ID NO: 1600593 - RNA, 18 nt, Homo sapiens
agaaugcauuccagaaca

SEQ ID NO: 1600594 - RNA, 20 nt, Homo sapiens
agaaugccgguuaaauucca

SEQ ID NO: 1600595 - RNA, 20 nt, Homo sapiens
agaaugguacacaaugugau

SEQ ID NO: 1600596 - RNA, 20 nt, Homo sapiens
agaauguagucagacugaca

SEQ ID NO: 1600597 - RNA, 17 nt, Homo sapiens
agaaugucuauuuccaa

SEQ ID NO: 1600598 - RNA, 19 nt, Homo sapiens
agaaugugaaaaaggaaua

SEQ ID NO: 1600599 - RNA, 18 nt, Homo sapiens
agaaugugggauauuucc

SEQ ID NO: 1600600 - RNA, 21 nt, Homo sapiens
agaauucaaaagugauuaucu

SEQ ID NO: 1600601 - RNA, 16 nt, Homo sapiens
agaauucaaauccucu

SEQ ID NO: 1600602 - RNA, 16 nt, Homo sapiens
agaauuguaugucaug

SEQ ID NO: 1600603 - RNA, 15 nt, Homo sapiens
agaauuuaagacuug

SEQ ID NO: 1600604 - RNA, 23 nt, Homo sapiens
agaauuuuaguguuaaugacucu

SEQ ID NO: 1600605 - RNA, 20 nt, Homo sapiens
agacaaauuagccauuucac

SEQ ID NO: 1600606 - RNA, 12 nt, Homo sapiens
agacaacaaaug

SEQ ID NO: 1600607 - RNA, 15 nt, Homo sapiens
agacaacaccuuccu

SEQ ID NO: 1600608 - RNA, 15 nt, Homo sapiens
agacaaccacuggga

SEQ ID NO: 1600609 - RNA, 20 nt, Homo sapiens
agacaagagggcaagccucu

SEQ ID NO: 1600610 - RNA, 20 nt, Homo sapiens
agacaagcgccgcugugagg

SEQ ID NO: 1600611 - RNA, 13 nt, Homo sapiens
agacaauaaaccc

SEQ ID NO: 1600612 - RNA, 17 nt, Homo sapiens
agacaauaaacccucag

SEQ ID NO: 1600613 - RNA, 17 nt, Homo sapiens
agacacagaagccuuug

SEQ ID NO: 1600614 - RNA, 12 nt, Homo sapiens
agcacauaaucc

SEQ ID NO: 1600615 - RNA, 13 nt, Homo sapiens
agcacauaauccc

SEQ ID NO: 1600616 - RNA, 18 nt, Homo sapiens
agcacauguauugacaac

SEQ ID NO: 1600617 - RNA, 14 nt, Homo sapiens
agcacauucgggac

SEQ ID NO: 1600618 - RNA, 16 nt, Homo sapiens
agcacauucgggccau

SEQ ID NO: 1600619 - RNA, 13 nt, Homo sapiens
agcacccauucca

SEQ ID NO: 1600620 - RNA, 21 nt, Homo sapiens
agcacccuggagagugcacau

SEQ ID NO: 1600621 - RNA, 20 nt, Homo sapiens
agcaccuccccgcugggaag

SEQ ID NO: 1600622 - RNA, 14 nt, Homo sapiens
agcacgacagugga

SEQ ID NO: 1600623 - RNA, 14 nt, Homo sapiens
agcacggacucucc

SEQ ID NO: 1600624 - RNA, 14 nt, Homo sapiens
agcacggacuguca

SEQ ID NO: 1600625 - RNA, 20 nt, Homo sapiens
agcacggucccccaggaggc

SEQ ID NO: 1600626 - RNA, 13 nt, Homo sapiens
agcacuagaauau

SEQ ID NO: 1600627 - RNA, 14 nt, Homo sapiens
agcacucauuccuu

SEQ ID NO: 1600628 - RNA, 14 nt, Homo sapiens
agcacugagcagaa

SEQ ID NO: 1600629 - RNA, 15 nt, Homo sapiens
agcacugaggaagaa

SEQ ID NO: 1600630 - RNA, 11 nt, Homo sapiens
agcacugugag

SEQ ID NO: 1600631 - RNA, 22 nt, Homo sapiens
agcacuugcaaccgucuguuau

SEQ ID NO: 1600632 - RNA, 15 nt, Homo sapiens
agcacuuugccaugc

SEQ ID NO: 1600633 - RNA, 21 nt, Homo sapiens
agcacuuuuugggguucaaga

SEQ ID NO: 1600634 - RNA, 17 nt, Homo sapiens
agcagaaacagcauauu

SEQ ID NO: 1600635 - RNA, 14 nt, Homo sapiens
agcagaacacugca

SEQ ID NO: 1600636 - RNA, 21 nt, Homo sapiens
agcagaacugaaaaauuacuu

SEQ ID NO: 1600637 - RNA, 22 nt, Homo sapiens
agcagacacagguguagaccag

SEQ ID NO: 1600638 - RNA, 12 nt, Homo sapiens
agcagaccuccu

SEQ ID NO: 1600639 - RNA, 17 nt, Homo sapiens
agcagagacaugacuca

SEQ ID NO: 1600640 - RNA, 20 nt, Homo sapiens
agcagagacgggguuucacc

SEQ ID NO: 1600641 - RNA, 22 nt, Homo sapiens
agcagaggaggggaaaguccag

SEQ ID NO: 1600642 - RNA, 21 nt, Homo sapiens
agcagaguguucccugacucc

SEQ ID NO: 1600643 - RNA, 13 nt, Homo sapiens
agcagauggagua

SEQ ID NO: 1600644 - RNA, 16 nt, Homo sapiens
agcagcaaaaccaaac

SEQ ID NO: 1600645 - RNA, 23 nt, Homo sapiens
agcagcacagucacccauggaac

SEQ ID NO: 1600646 - RNA, 20 nt, Homo sapiens
agcagcaccaaccacagcau

SEQ ID NO: 1600647 - RNA, 18 nt, Homo sapiens
agcagcagaccuccuagc

SEQ ID NO: 1600648 - RNA, 16 nt, Homo sapiens
agcagcauccacccca

SEQ ID NO: 1600649 - RNA, 13 nt, Homo sapiens
agcagcucuguga

SEQ ID NO: 1600650 - RNA, 20 nt, Homo sapiens
agcagcugucagaacacucc

SEQ ID NO: 1600651 - RNA, 15 nt, Homo sapiens
agcaggacugcacag

SEQ ID NO: 1600652 - RNA, 13 nt, Homo sapiens
agcaggccaggga

SEQ ID NO: 1600653 - RNA, 16 nt, Homo sapiens
agcaggcuacugucag

SEQ ID NO: 1600654 - RNA, 15 nt, Homo sapiens
agcagggacuugaac

SEQ ID NO: 1600655 - RNA, 17 nt, Homo sapiens
agcagguuucaaggaag

SEQ ID NO: 1600656 - RNA, 16 nt, Homo sapiens
agcaguaaacuuucuc

SEQ ID NO: 1600657 - RNA, 14 nt, Homo sapiens
agcaguacacaacu

SEQ ID NO: 1600658 - RNA, 16 nt, Homo sapiens
agcaguagcaaacuuu

SEQ ID NO: 1600659 - RNA, 11 nt, Homo sapiens
agcaguauucu

SEQ ID NO: 1600660 - RNA, 22 nt, Homo sapiens
agcagucacugacaguuaauaa

SEQ ID NO: 1600661 - RNA, 20 nt, Homo sapiens
agcagugaaugauucagugu

SEQ ID NO: 1600662 - RNA, 16 nt, Homo sapiens
agcaguggcuccauug

SEQ ID NO: 1600663 - RNA, 18 nt, Homo sapiens
agcaguuauggugaugac

SEQ ID NO: 1600664 - RNA, 14 nt, Homo sapiens
agcaguucagcucc

SEQ ID NO: 1600665 - RNA, 13 nt, Homo sapiens
agcauaacagcca

SEQ ID NO: 1600666 - RNA, 18 nt, Homo sapiens
agcauacgguaugauauu

SEQ ID NO: 1600667 - RNA, 21 nt, Homo sapiens
agcauacgguaugauauugca

SEQ ID NO: 1600668 - RNA, 12 nt, Homo sapiens
agcauacuuugu

SEQ ID NO: 1600669 - RNA, 18 nt, Homo sapiens
agcauagggucacuuugc

SEQ ID NO: 1600670 - RNA, 22 nt, Homo sapiens
agcauaugggugggauuuugca

SEQ ID NO: 1600671 - RNA, 24 nt, Homo sapiens
agcaucaaucuuguuacugcugau

SEQ ID NO: 1600672 - RNA, 11 nt, Homo sapiens
agcaucaucug

SEQ ID NO: 1600673 - RNA, 19 nt, Homo sapiens
agcaucgggagcacccaga

SEQ ID NO: 1600674 - RNA, 22 nt, Homo sapiens
agcaucgggagcacccagagca

SEQ ID NO: 1600675 - RNA, 23 nt, Homo sapiens
agcaucuaucucaucuaucucaa

SEQ ID NO: 1600676 - RNA, 17 nt, Homo sapiens
agcaucucuucuucccu

SEQ ID NO: 1600677 - RNA, 22 nt, Homo sapiens
agcaucugagcuaacuuauauu

SEQ ID NO: 1600678 - RNA, 16 nt, Homo sapiens
agcaucuguaacagca

SEQ ID NO: 1600679 - RNA, 20 nt, Homo sapiens
agcaugaaaguggacaagga

SEQ ID NO: 1600680 - RNA, 18 nt, Homo sapiens
agcaugcaauacauacca

SEQ ID NO: 1600681 - RNA, 18 nt, Homo sapiens
agcaugcacacugagaau

SEQ ID NO: 1600682 - RNA, 23 nt, Homo sapiens
agcaugcucaguuggugcugcuu

SEQ ID NO: 1600683 - RNA, 15 nt, Homo sapiens
agcaugggaagugac

SEQ ID NO: 1600684 - RNA, 15 nt, Homo sapiens
agcauguacuccccu

SEQ ID NO: 1600685 - RNA, 19 nt, Homo sapiens
agcauguggugauuggcca

SEQ ID NO: 1600686 - RNA, 17 nt, Homo sapiens
agcaugugugacuuuca

SEQ ID NO: 1600687 - RNA, 22 nt, Homo sapiens
agcauguguuaaucuuaaugua

SEQ ID NO: 1600688 - RNA, 17 nt, Homo sapiens
agcauguuucacagugg

SEQ ID NO: 1600689 - RNA, 15 nt, Homo sapiens
agcauuacccuccuc

SEQ ID NO: 1600690 - RNA, 17 nt, Homo sapiens
agcauuagaauggagga

SEQ ID NO: 1600691 - RNA, 17 nt, Homo sapiens
agcauuccagacuucaa

SEQ ID NO: 1600692 - RNA, 18 nt, Homo sapiens
agcauugcuggacucuga

SEQ ID NO: 1600693 - RNA, 21 nt, Homo sapiens
agcauuguaaaauuauuucau

SEQ ID NO: 1600694 - RNA, 17 nt, Homo sapiens
agcauuguaaaugugcu

SEQ ID NO: 1600695 - RNA, 17 nt, Homo sapiens
agcauuuccacaccaag

SEQ ID NO: 1600696 - RNA, 24 nt, Homo sapiens
agcauuuccagagcagagccuaca

SEQ ID NO: 1600697 - RNA, 21 nt, Homo sapiens
agcauuuccagccuaucuaau

SEQ ID NO: 1600698 - RNA, 14 nt, Homo sapiens
agcauuuucauuca

SEQ ID NO: 1600699 - RNA, 20 nt, Homo sapiens
agccaaauuuaaaacuguug

SEQ ID NO: 1600700 - RNA, 15 nt, Homo sapiens
agccaagagugcacu

SEQ ID NO: 1600701 - RNA, 18 nt, Homo sapiens
agccaagugcccucucug

SEQ ID NO: 1600702 - RNA, 20 nt, Homo sapiens
agccaagugcccucucugaa

SEQ ID NO: 1600703 - RNA, 20 nt, Homo sapiens
agccacaggccugagauuuc

SEQ ID NO: 1600704 - RNA, 19 nt, Homo sapiens
agccacccguggggugcug

SEQ ID NO: 1600705 - RNA, 18 nt, Homo sapiens
agccaccgugcccggcca

SEQ ID NO: 1600706 - RNA, 23 nt, Homo sapiens
agccaccuagcccuaucaagcca

SEQ ID NO: 1600707 - RNA, 16 nt, Homo sapiens
agccacuguaugauuc

SEQ ID NO: 1600708 - RNA, 13 nt, Homo sapiens
agccacugucaca

SEQ ID NO: 1600709 - RNA, 21 nt, Homo sapiens
agccacuguuuguuuacaaaa

SEQ ID NO: 1600710 - RNA, 22 nt, Homo sapiens
agccacuugccugugcuacaau

SEQ ID NO: 1600711 - RNA, 18 nt, Homo sapiens
agccagagagcaucuuuc

SEQ ID NO: 1600712 - RNA, 22 nt, Homo sapiens
agccagcaggucaaaaaggcca

SEQ ID NO: 1600713 - RNA, 22 nt, Homo sapiens
agccagcauccccaacugcgac

SEQ ID NO: 1600714 - RNA, 18 nt, Homo sapiens
agccagcuuaaacccaua

SEQ ID NO: 1600715 - RNA, 16 nt, Homo sapiens
agccaggcacacacug

SEQ ID NO: 1600716 - RNA, 17 nt, Homo sapiens
agccaggcacacacugu

SEQ ID NO: 1600717 - RNA, 18 nt, Homo sapiens
agccaggccaacagcacc

SEQ ID NO: 1600718 - RNA, 16 nt, Homo sapiens
agccaggcuuuucuca

SEQ ID NO: 1600719 - RNA, 17 nt, Homo sapiens
agccaguggugauguaa

SEQ ID NO: 1600720 - RNA, 21 nt, Homo sapiens
agccauaagaaagcacuauua

SEQ ID NO: 1600721 - RNA, 23 nt, Homo sapiens
agccauaggugcaguuugcuucu

SEQ ID NO: 1600722 - RNA, 13 nt, Homo sapiens
agccauaugaaug

SEQ ID NO: 1600723 - RNA, 16 nt, Homo sapiens
agccaucauaacucac

SEQ ID NO: 1600724 - RNA, 11 nt, Homo sapiens
agccauccagg

SEQ ID NO: 1600725 - RNA, 20 nt, Homo sapiens
agccaucccuuuuuuuacau

SEQ ID NO: 1600726 - RNA, 17 nt, Homo sapiens
agccaucguccugggac

SEQ ID NO: 1600727 - RNA, 21 nt, Homo sapiens
agccaucuaaugcuuguuuau

SEQ ID NO: 1600728 - RNA, 23 nt, Homo sapiens
agccaugacaagaacaaagccac

SEQ ID NO: 1600729 - RNA, 11 nt, Homo sapiens
agccaugccug

SEQ ID NO: 1600730 - RNA, 17 nt, Homo sapiens
agccauuucacucucaa

SEQ ID NO: 1600731 - RNA, 19 nt, Homo sapiens
agccauuugcugcauuucu

SEQ ID NO: 1600732 - RNA, 14 nt, Homo sapiens
caauuucaaacuuu

SEQ ID NO: 1600733 - RNA, 13 nt, Homo sapiens
caauuucauuuaa

SEQ ID NO: 1600734 - RNA, 23 nt, Homo sapiens
caauuucccccuaaaccaacuga

SEQ ID NO: 1600735 - RNA, 18 nt, Homo sapiens
caauuucucugaggacac

SEQ ID NO: 1600736 - RNA, 17 nt, Homo sapiens
caauuuuaaaucugaga

SEQ ID NO: 1600737 - RNA, 13 nt, Homo sapiens
caauuuugcacug

SEQ ID NO: 1600738 - RNA, 14 nt, Homo sapiens
caauuuuggaugag

SEQ ID NO: 1600739 - RNA, 15 nt, Homo sapiens
caauuuuguugcauc

SEQ ID NO: 1600740 - RNA, 17 nt, Homo sapiens
cacaaaaacagaaacaa

SEQ ID NO: 1600741 - RNA, 20 nt, Homo sapiens
cacaaaagcagauacuugag

SEQ ID NO: 1600742 - RNA, 19 nt, Homo sapiens
cacaaacaauauguuugca

SEQ ID NO: 1600743 - RNA, 20 nt, Homo sapiens
cacaaacauguguguacaug

SEQ ID NO: 1600744 - RNA, 22 nt, Homo sapiens
cacaaaggaaguccaaccugag

SEQ ID NO: 1600745 - RNA, 22 nt, Homo sapiens
cacaaauaacaucucaccuuca

SEQ ID NO: 1600746 - RNA, 19 nt, Homo sapiens
cacaaaugaagggauauaa

SEQ ID NO: 1600747 - RNA, 13 nt, Homo sapiens
cacaacauucugg

SEQ ID NO: 1600748 - RNA, 14 nt, Homo sapiens
cacaaccuggauuu

SEQ ID NO: 1600749 - RNA, 16 nt, Homo sapiens
cacaacuaaaacugga

SEQ ID NO: 1600750 - RNA, 21 nt, Homo sapiens
cacaacuauggaauagauuau

SEQ ID NO: 1600751 - RNA, 20 nt, Homo sapiens
cacaacugucuuagacugcu

SEQ ID NO: 1600752 - RNA, 20 nt, Homo sapiens
cacaagaacaauucaagaaa

SEQ ID NO: 1600753 - RNA, 20 nt, Homo sapiens
cacaagcaacagacucucac

SEQ ID NO: 1600754 - RNA, 13 nt, Homo sapiens
cacaaggacccuu

SEQ ID NO: 1600755 - RNA, 21 nt, Homo sapiens
cacaauagccgauaucagaau

SEQ ID NO: 1600756 - RNA, 13 nt, Homo sapiens
cacaauauuccua

SEQ ID NO: 1600757 - RNA, 21 nt, Homo sapiens
cacaaucugaaacagcuucau

SEQ ID NO: 1600758 - RNA, 16 nt, Homo sapiens
cacaauugaguugaag

SEQ ID NO: 1600759 - RNA, 18 nt, Homo sapiens
cacacaaaaaaugcacaa

SEQ ID NO: 1600760 - RNA, 20 nt, Homo sapiens
cacacaccaaguaccaguau

SEQ ID NO: 1600761 - RNA, 22 nt, Homo sapiens
cacacagcuacucuccccacga

SEQ ID NO: 1600762 - RNA, 12 nt, Homo sapiens
cacacagguguu

SEQ ID NO: 1600763 - RNA, 11 nt, Homo sapiens
cacacaguguu

SEQ ID NO: 1600764 - RNA, 18 nt, Homo sapiens
cacacaugaauaaagccu

SEQ ID NO: 1600765 - RNA, 12 nt, Homo sapiens
cacacaugcaua

SEQ ID NO: 1600766 - RNA, 17 nt, Homo sapiens
cacaccauucgucauca

SEQ ID NO: 1600767 - RNA, 15 nt, Homo sapiens
cacacccaggaaggg

SEQ ID NO: 1600768 - RNA, 12 nt, Homo sapiens
cacacccauggc

SEQ ID NO: 1600769 - RNA, 21 nt, Homo sapiens
cacacccauguaaccacugca

SEQ ID NO: 1600770 - RNA, 17 nt, Homo sapiens
cacaccugaacuugccu

SEQ ID NO: 1600771 - RNA, 21 nt, Homo sapiens
cacaccuggcccuugcaaucu

SEQ ID NO: 1600772 - RNA, 17 nt, Homo sapiens
cacacguaagcacauuc

SEQ ID NO: 1600773 - RNA, 23 nt, Homo sapiens
cacacguuuaaucccagcacuuu

SEQ ID NO: 1600774 - RNA, 18 nt, Homo sapiens
cacacuagaaaugcagca

SEQ ID NO: 1600775 - RNA, 18 nt, Homo sapiens
cacacucaaggacaggag

SEQ ID NO: 1600776 - RNA, 23 nt, Homo sapiens
cacacuguauauaaacauaucaa

SEQ ID NO: 1600777 - RNA, 16 nt, Homo sapiens
cacacuguccuauuau

SEQ ID NO: 1600778 - RNA, 22 nt, Homo sapiens
cacacuuuuggaaccaugccuu

SEQ ID NO: 1600779 - RNA, 19 nt, Homo sapiens
cacagaaaucacagucaau

SEQ ID NO: 1600780 - RNA, 16 nt, Homo sapiens
cacagaaauuuucaau

SEQ ID NO: 1600781 - RNA, 22 nt, Homo sapiens
cacagaauauuuuuauauuucc

SEQ ID NO: 1600782 - RNA, 16 nt, Homo sapiens
cacagaauuuaagcaa

SEQ ID NO: 1600783 - RNA, 16 nt, Homo sapiens
cacagacaucuuucaa

SEQ ID NO: 1600784 - RNA, 12 nt, Homo sapiens
cacagaccccag

SEQ ID NO: 1600785 - RNA, 20 nt, Homo sapiens
cacagacuauuuuuagauuu

SEQ ID NO: 1600786 - RNA, 15 nt, Homo sapiens
cacagaggagugcag

SEQ ID NO: 1600787 - RNA, 23 nt, Homo sapiens
cacagaggccccaccugaagggu

SEQ ID NO: 1600788 - RNA, 17 nt, Homo sapiens
cacagauauuguuauaa

SEQ ID NO: 1600789 - RNA, 13 nt, Homo sapiens
cacagaugcucca

SEQ ID NO: 1600790 - RNA, 15 nt, Homo sapiens
cacagcaacaaugac

SEQ ID NO: 1600791 - RNA, 17 nt, Homo sapiens
cacagcaacaaugacuu

SEQ ID NO: 1600792 - RNA, 15 nt, Homo sapiens
cacagcagacaccau

SEQ ID NO: 1600793 - RNA, 23 nt, Homo sapiens
cacagcaucgggagcacccagag

SEQ ID NO: 1600794 - RNA, 16 nt, Homo sapiens
cacagccaaccuagcu

SEQ ID NO: 1600795 - RNA, 23 nt, Homo sapiens
cacagccaacgagacacauugcc

SEQ ID NO: 1600796 - RNA, 15 nt, Homo sapiens
cacagcgugggaacu

SEQ ID NO: 1600797 - RNA, 16 nt, Homo sapiens
cacagcugcuggagaa

SEQ ID NO: 1600798 - RNA, 22 nt, Homo sapiens
cacagcuguaaucccagcacuu

SEQ ID NO: 1600799 - RNA, 22 nt, Homo sapiens
cacagcuguauagcugcuucca

SEQ ID NO: 1600800 - RNA, 14 nt, Homo sapiens
cacaggccugagau

SEQ ID NO: 1600801 - RNA, 13 nt, Homo sapiens
cacagggagcucc

SEQ ID NO: 1600802 - RNA, 20 nt, Homo sapiens
cacaguaaagaguacacuca

SEQ ID NO: 1600803 - RNA, 21 nt, Homo sapiens
cacaguaucaguauuuucaca

SEQ ID NO: 1600804 - RNA, 14 nt, Homo sapiens
cacagucacuggau

SEQ ID NO: 1600805 - RNA, 20 nt, Homo sapiens
cacaguggcaaaacaaaagu

SEQ ID NO: 1600806 - RNA, 19 nt, Homo sapiens
cacauaagcccaguucauc

SEQ ID NO: 1600807 - RNA, 20 nt, Homo sapiens
cacauagcaggggcaccuuc

SEQ ID NO: 1600808 - RNA, 20 nt, Homo sapiens
cacauaggaaaaugccauga

SEQ ID NO: 1600809 - RNA, 23 nt, Homo sapiens
cacauaguagguacccaauucaa

SEQ ID NO: 1600810 - RNA, 13 nt, Homo sapiens
cacauaguuugau

SEQ ID NO: 1600811 - RNA, 17 nt, Homo sapiens
cacauauugagaaccua

SEQ ID NO: 1600812 - RNA, 15 nt, Homo sapiens
cacaucacaauauuc

SEQ ID NO: 1600813 - RNA, 13 nt, Homo sapiens
cacaucagcuuua

SEQ ID NO: 1600814 - RNA, 23 nt, Homo sapiens
cacaucaugagcugagugacugc

SEQ ID NO: 1600815 - RNA, 20 nt, Homo sapiens
cacauccauuacuauacauu

SEQ ID NO: 1600816 - RNA, 20 nt, Homo sapiens
cacauccugaaaaggguguu

SEQ ID NO: 1600817 - RNA, 18 nt, Homo sapiens
cacaucuaaagcuuuauc

SEQ ID NO: 1600818 - RNA, 11 nt, Homo sapiens
cacaucuccag

SEQ ID NO: 1600819 - RNA, 17 nt, Homo sapiens
cacauguacccuaaaac

SEQ ID NO: 1600820 - RNA, 22 nt, Homo sapiens
cacauguugccuugcauuugug

SEQ ID NO: 1600821 - RNA, 16 nt, Homo sapiens
cacauguuuaacuuua

SEQ ID NO: 1600822 - RNA, 13 nt, Homo sapiens
cacauucugccuu

SEQ ID NO: 1600823 - RNA, 18 nt, Homo sapiens
cacauuggaaugccuugg

SEQ ID NO: 1600824 - RNA, 18 nt, Homo sapiens
cacauuggagacaucugc

SEQ ID NO: 1600825 - RNA, 13 nt, Homo sapiens
cacauuucacugu

SEQ ID NO: 1600826 - RNA, 17 nt, Homo sapiens
cacauuuuucagauaua

SEQ ID NO: 1600827 - RNA, 14 nt, Homo sapiens
cacauuuuuugcca

SEQ ID NO: 1600828 - RNA, 16 nt, Homo sapiens
cacauuuuuugccacu

SEQ ID NO: 1600829 - RNA, 15 nt, Homo sapiens
caccaaaacgaugaa

SEQ ID NO: 1600830 - RNA, 14 nt, Homo sapiens
caccaaaugugcuu

SEQ ID NO: 1600831 - RNA, 20 nt, Homo sapiens
caccaagcagcaacagcaaa

SEQ ID NO: 1600832 - RNA, 20 nt, Homo sapiens
caccaauggauuguggaaaa

SEQ ID NO: 1600833 - RNA, 16 nt, Homo sapiens
caccaccuucccagcu

SEQ ID NO: 1600834 - RNA, 18 nt, Homo sapiens
caccacgguagugccuga

SEQ ID NO: 1600835 - RNA, 23 nt, Homo sapiens
caccacuuccgucccauccuugc

SEQ ID NO: 1600836 - RNA, 20 nt, Homo sapiens
caccagaagacaaacaauau

SEQ ID NO: 1600837 - RNA, 22 nt, Homo sapiens
caccagccaccccaaagcccuc

SEQ ID NO: 1600838 - RNA, 14 nt, Homo sapiens
caccagccauccuc

SEQ ID NO: 1600839 - RNA, 18 nt, Homo sapiens
caccaggccgugccuugu

SEQ ID NO: 1600840 - RNA, 19 nt, Homo sapiens
caccauaagcuacugccau

SEQ ID NO: 1600841 - RNA, 20 nt, Homo sapiens
caccauagagacccauguca

SEQ ID NO: 1600842 - RNA, 14 nt, Homo sapiens
caccaucaccucuc

SEQ ID NO: 1600843 - RNA, 13 nt, Homo sapiens
caccaugagcuca

SEQ ID NO: 1600844 - RNA, 15 nt, Homo sapiens
caccauguuggccag

SEQ ID NO: 1600845 - RNA, 17 nt, Homo sapiens
caccauucgucaucacu

SEQ ID NO: 1600846 - RNA, 13 nt, Homo sapiens
caccauugucuca

SEQ ID NO: 1600847 - RNA, 14 nt, Homo sapiens
cacccaaaagucaa

SEQ ID NO: 1600848 - RNA, 18 nt, Homo sapiens
cacccaaccugacuuccu

SEQ ID NO: 1600849 - RNA, 23 nt, Homo sapiens
cacccaccaggccagcucaggaa

SEQ ID NO: 1600850 - RNA, 13 nt, Homo sapiens
cagagucucagga

SEQ ID NO: 1600851 - RNA, 14 nt, Homo sapiens
cagagugacaguca

SEQ ID NO: 1600852 - RNA, 23 nt, Homo sapiens
cagagugagacccagcccucauc

SEQ ID NO: 1600853 - RNA, 13 nt, Homo sapiens
cagagugccacug

SEQ ID NO: 1600854 - RNA, 18 nt, Homo sapiens
cagaguggacuuguguuu

SEQ ID NO: 1600855 - RNA, 20 nt, Homo sapiens
cagagugguuuccaaugugu

SEQ ID NO: 1600856 - RNA, 13 nt, Homo sapiens
cagaguguuuacc

SEQ ID NO: 1600857 - RNA, 18 nt, Homo sapiens
cagaguguuuaccuggug

SEQ ID NO: 1600858 - RNA, 14 nt, Homo sapiens
cagaucacuugagc

SEQ ID NO: 1600859 - RNA, 21 nt, Homo sapiens
cagaucuuagggaugauuaaa

SEQ ID NO: 1600860 - RNA, 22 nt, Homo sapiens
cagaugauucuaugucucauga

SEQ ID NO: 1600861 - RNA, 21 nt, Homo sapiens
cagaugcuguuaguaccuaca

SEQ ID NO: 1600862 - RNA, 22 nt, Homo sapiens
cagaugcuuuccugcacauuaa

SEQ ID NO: 1600863 - RNA, 21 nt, Homo sapiens
cagauguaaauagaacaaccu

SEQ ID NO: 1600864 - RNA, 20 nt, Homo sapiens
cagaugugaaaauauacuug

SEQ ID NO: 1600865 - RNA, 11 nt, Homo sapiens
cagauguuaaa

SEQ ID NO: 1600866 - RNA, 14 nt, Homo sapiens
cagauuacuagaaa

SEQ ID NO: 1600867 - RNA, 20 nt, Homo sapiens
cagauuaguucuuuuugcca

SEQ ID NO: 1600868 - RNA, 18 nt, Homo sapiens
cagauuaucuacuuagau

SEQ ID NO: 1600869 - RNA, 20 nt, Homo sapiens
cagauucugccucucuggaa

SEQ ID NO: 1600870 - RNA, 18 nt, Homo sapiens
cagauuggcucacacuga

SEQ ID NO: 1600871 - RNA, 20 nt, Homo sapiens
cagauuggcucacacugaga

SEQ ID NO: 1600872 - RNA, 17 nt, Homo sapiens
cagauuuaaagcaucau

SEQ ID NO: 1600873 - RNA, 17 nt, Homo sapiens
cagauuuguucuagaua

SEQ ID NO: 1600874 - RNA, 18 nt, Homo sapiens
cagauuuuuuccucugca

SEQ ID NO: 1600875 - RNA, 22 nt, Homo sapiens
cagcaaacaggugcuaauuugu

SEQ ID NO: 1600876 - RNA, 18 nt, Homo sapiens
cagcaaacucaaguugaa

SEQ ID NO: 1600877 - RNA, 18 nt, Homo sapiens
cagcaaagcagcaguguc

SEQ ID NO: 1600878 - RNA, 19 nt, Homo sapiens
cagcaaauaaagcagucau

SEQ ID NO: 1600879 - RNA, 17 nt, Homo sapiens
cagcaacagcaaaucac

SEQ ID NO: 1600880 - RNA, 14 nt, Homo sapiens
cagcaacauccaga

SEQ ID NO: 1600881 - RNA, 19 nt, Homo sapiens
cagcaagauugcuuuaacu

SEQ ID NO: 1600882 - RNA, 19 nt, Homo sapiens
cagcaaggauggagcugaa

SEQ ID NO: 1600883 - RNA, 20 nt, Homo sapiens
cagcacacgaguuccagacc

SEQ ID NO: 1600884 - RNA, 16 nt, Homo sapiens
cagcacagugccugac

SEQ ID NO: 1600885 - RNA, 19 nt, Homo sapiens
cagcacauauuugcauggg

SEQ ID NO: 1600886 - RNA, 18 nt, Homo sapiens
cagcacgccaacauggca

SEQ ID NO: 1600887 - RNA, 22 nt, Homo sapiens
cagcacuaaacuuggugcuuau

SEQ ID NO: 1600888 - RNA, 15 nt, Homo sapiens
cagcacuacucugug

SEQ ID NO: 1600889 - RNA, 15 nt, Homo sapiens
cagcacucuguaaaa

SEQ ID NO: 1600890 - RNA, 14 nt, Homo sapiens
cagcacugccagug

SEQ ID NO: 1600891 - RNA, 12 nt, Homo sapiens
cagcacuuccau

SEQ ID NO: 1600892 - RNA, 12 nt, Homo sapiens
cagcagacacag

SEQ ID NO: 1600893 - RNA, 23 nt, Homo sapiens
cagcagagaagcuguaggacugu

SEQ ID NO: 1600894 - RNA, 17 nt, Homo sapiens
cagcagcaaauuuucag

SEQ ID NO: 1600895 - RNA, 16 nt, Homo sapiens
cagcagccccaggaga

SEQ ID NO: 1600896 - RNA, 23 nt, Homo sapiens
cagcagccccaggagaaggggcu

SEQ ID NO: 1600897 - RNA, 16 nt, Homo sapiens
cagcagccucccugaa

SEQ ID NO: 1600898 - RNA, 15 nt, Homo sapiens
cagcagcugauucca

SEQ ID NO: 1600899 - RNA, 24 nt, Homo sapiens
cagcaggaggcaagcguguucuca

SEQ ID NO: 1600900 - RNA, 16 nt, Homo sapiens
cagcaggcauuugcua

SEQ ID NO: 1600901 - RNA, 22 nt, Homo sapiens
cagcaggugucuuuaacuguca

SEQ ID NO: 1600902 - RNA, 21 nt, Homo sapiens
cagcaguagcaaacuuuucac

SEQ ID NO: 1600903 - RNA, 13 nt, Homo sapiens
cagcagucaugca

SEQ ID NO: 1600904 - RNA, 22 nt, Homo sapiens
cagcaguuucugacaauuaaca

SEQ ID NO: 1600905 - RNA, 21 nt, Homo sapiens
cagcauagggucacuuugcca

SEQ ID NO: 1600906 - RNA, 18 nt, Homo sapiens
cagcauucuuagccugug

SEQ ID NO: 1600907 - RNA, 13 nt, Homo sapiens
cagcauugcugga

SEQ ID NO: 1600908 - RNA, 21 nt, Homo sapiens
cagcauuuagacccugcauuu

SEQ ID NO: 1600909 - RNA, 14 nt, Homo sapiens
cagcauuuccacac

SEQ ID NO: 1600910 - RNA, 15 nt, Homo sapiens
cagcauuugaugaua

SEQ ID NO: 1600911 - RNA, 17 nt, Homo sapiens
cagccaaaugcagggag

SEQ ID NO: 1600912 - RNA, 16 nt, Homo sapiens
cagccaacgagacaca

SEQ ID NO: 1600913 - RNA, 15 nt, Homo sapiens
cagccacauugagac

SEQ ID NO: 1600914 - RNA, 16 nt, Homo sapiens
cagccaccacaucccu

SEQ ID NO: 1600915 - RNA, 22 nt, Homo sapiens
cagccacccguggggugcugcc

SEQ ID NO: 1600916 - RNA, 14 nt, Homo sapiens
cagccagacuggca

SEQ ID NO: 1600917 - RNA, 20 nt, Homo sapiens
cagccagaggguagggcaca

SEQ ID NO: 1600918 - RNA, 15 nt, Homo sapiens
cagccagguggcacc

SEQ ID NO: 1600919 - RNA, 21 nt, Homo sapiens
cagcccaagaggacugagacu

SEQ ID NO: 1600920 - RNA, 17 nt, Homo sapiens
cagcccaagcacggggc

SEQ ID NO: 1600921 - RNA, 19 nt, Homo sapiens
cagcccagacccaguggac

SEQ ID NO: 1600922 - RNA, 18 nt, Homo sapiens
cagcccaggccacagcca

SEQ ID NO: 1600923 - RNA, 17 nt, Homo sapiens
cagcccccaucacccaa

SEQ ID NO: 1600924 - RNA, 17 nt, Homo sapiens
cagccccggcaagccac

SEQ ID NO: 1600925 - RNA, 22 nt, Homo sapiens
cagccccuccccagacucucag

SEQ ID NO: 1600926 - RNA, 12 nt, Homo sapiens
cagccccugacc

SEQ ID NO: 1600927 - RNA, 18 nt, Homo sapiens
cagcccgggucaucugua

SEQ ID NO: 1600928 - RNA, 21 nt, Homo sapiens
cagcccuagagccugccugga

SEQ ID NO: 1600929 - RNA, 15 nt, Homo sapiens
cagcccucucucuca

SEQ ID NO: 1600930 - RNA, 21 nt, Homo sapiens
cagcccugaaggcaccuguca

SEQ ID NO: 1600931 - RNA, 15 nt, Homo sapiens
cagcccugcucccug

SEQ ID NO: 1600932 - RNA, 18 nt, Homo sapiens
cagcccuggcccaggugc

SEQ ID NO: 1600933 - RNA, 14 nt, Homo sapiens
cagcccuuccccau

SEQ ID NO: 1600934 - RNA, 19 nt, Homo sapiens
cagcccuuccucccauuuc

SEQ ID NO: 1600935 - RNA, 22 nt, Homo sapiens
cagcccuuccucccauuuccca

SEQ ID NO: 1600936 - RNA, 11 nt, Homo sapiens
cagccggagau

SEQ ID NO: 1600937 - RNA, 15 nt, Homo sapiens
cagccguauuuuaca

SEQ ID NO: 1600938 - RNA, 21 nt, Homo sapiens
cagccgucccgcguucaagac

SEQ ID NO: 1600939 - RNA, 16 nt, Homo sapiens
cagccuaagaaacacu

SEQ ID NO: 1600940 - RNA, 16 nt, Homo sapiens
cagccuccccgugcca

SEQ ID NO: 1600941 - RNA, 18 nt, Homo sapiens
cagccuccccgugccaaa

SEQ ID NO: 1600942 - RNA, 16 nt, Homo sapiens
cagccucuccacucau

SEQ ID NO: 1600943 - RNA, 18 nt, Homo sapiens
cagccucugccgcugcca

SEQ ID NO: 1600944 - RNA, 22 nt, Homo sapiens
cagccuggacaccucucaugca

SEQ ID NO: 1600945 - RNA, 21 nt, Homo sapiens
cagccuggccaacauggugaa

SEQ ID NO: 1600946 - RNA, 22 nt, Homo sapiens
cagccuguggagagacccugca

SEQ ID NO: 1600947 - RNA, 17 nt, Homo sapiens
cagccuugcucucuuca

SEQ ID NO: 1600948 - RNA, 17 nt, Homo sapiens
cagcgaaaggauguaaa

SEQ ID NO: 1600949 - RNA, 20 nt, Homo sapiens
cagcguggguguugaaucca

SEQ ID NO: 1600950 - RNA, 13 nt, Homo sapiens
cagcuaaagcaau

SEQ ID NO: 1600951 - RNA, 13 nt, Homo sapiens
cagcuaaccacuu

SEQ ID NO: 1600952 - RNA, 13 nt, Homo sapiens
cagcuacuggaau

SEQ ID NO: 1600953 - RNA, 14 nt, Homo sapiens
cagcuagugccuuu

SEQ ID NO: 1600954 - RNA, 18 nt, Homo sapiens
cagcuaucugucaucucu

SEQ ID NO: 1600955 - RNA, 20 nt, Homo sapiens
cagcuauuuugugaagccau

SEQ ID NO: 1600956 - RNA, 23 nt, Homo sapiens
cagcucauuucaguuucuaucaa

SEQ ID NO: 1600957 - RNA, 17 nt, Homo sapiens
cagcuccuuccaccaca

SEQ ID NO: 1600958 - RNA, 19 nt, Homo sapiens
cagcuccuuucaugcucca

SEQ ID NO: 1600959 - RNA, 16 nt, Homo sapiens
cagcucuccugcugca

SEQ ID NO: 1600960 - RNA, 19 nt, Homo sapiens
cagcucugccuugcacugu

SEQ ID NO: 1600961 - RNA, 19 nt, Homo sapiens
cagcucuguaguuucuuga

SEQ ID NO: 1600962 - RNA, 14 nt, Homo sapiens
cagcugagguucau

SEQ ID NO: 1600963 - RNA, 16 nt, Homo sapiens
cagcugccucugcucc

SEQ ID NO: 1600964 - RNA, 17 nt, Homo sapiens
cagcugcuggaugacuu

SEQ ID NO: 1600965 - RNA, 15 nt, Homo sapiens
cagcugcuuugacaa

SEQ ID NO: 1600966 - RNA, 12 nt, Homo sapiens
cagcugggacac

SEQ ID NO: 1600967 - RNA, 13 nt, Homo sapiens
cagcugggagcac

SEQ ID NO: 1600968 - RNA, 20 nt, Homo sapiens
cagguucucuuugagucaau

SEQ ID NO: 1600969 - RNA, 15 nt, Homo sapiens
caguaaaaauaaaua

SEQ ID NO: 1600970 - RNA, 15 nt, Homo sapiens
caguaaaacucucaa

SEQ ID NO: 1600971 - RNA, 14 nt, Homo sapiens
caguaaacacucca

SEQ ID NO: 1600972 - RNA, 17 nt, Homo sapiens
caguaaacuuucucugc

SEQ ID NO: 1600973 - RNA, 22 nt, Homo sapiens
caguaaagcacuugcaaccguc

SEQ ID NO: 1600974 - RNA, 17 nt, Homo sapiens
caguaaagugguucucu

SEQ ID NO: 1600975 - RNA, 20 nt, Homo sapiens
caguaagguagaaauagaga

SEQ ID NO: 1600976 - RNA, 20 nt, Homo sapiens
caguacacaggggcuugacu

SEQ ID NO: 1600977 - RNA, 22 nt, Homo sapiens
caguacccacucuggagcauuu

SEQ ID NO: 1600978 - RNA, 14 nt, Homo sapiens
caguagaaagcuaa

SEQ ID NO: 1600979 - RNA, 22 nt, Homo sapiens
caguagagcucuacugccucaa

SEQ ID NO: 1600980 - RNA, 22 nt, Homo sapiens
caguagcaucuguaacagcauu

SEQ ID NO: 1600981 - RNA, 21 nt, Homo sapiens
caguaguucacauacaaauca

SEQ ID NO: 1600982 - RNA, 21 nt, Homo sapiens
caguaguuuugacacuuccca

SEQ ID NO: 1600983 - RNA, 17 nt, Homo sapiens
caguauaaucuuuucau

SEQ ID NO: 1600984 - RNA, 22 nt, Homo sapiens
caguauauuuguccagauaauu

SEQ ID NO: 1600985 - RNA, 14 nt, Homo sapiens
caguaugacaguau

SEQ ID NO: 1600986 - RNA, 15 nt, Homo sapiens
caguauuacaguguc

SEQ ID NO: 1600987 - RNA, 16 nt, Homo sapiens
caguauucugacaugu

SEQ ID NO: 1600988 - RNA, 16 nt, Homo sapiens
caguauugacuucuuu

SEQ ID NO: 1600989 - RNA, 16 nt, Homo sapiens
caguauuuaagcuuua

SEQ ID NO: 1600990 - RNA, 14 nt, Homo sapiens
cagucacauuccaa

SEQ ID NO: 1600991 - RNA, 15 nt, Homo sapiens
cagucagcagucaug

SEQ ID NO: 1600992 - RNA, 14 nt, Homo sapiens
cagucaucuacuuu

SEQ ID NO: 1600993 - RNA, 12 nt, Homo sapiens
cagucauugcug

SEQ ID NO: 1600994 - RNA, 23 nt, Homo sapiens
caguccccguggccaucccugug

SEQ ID NO: 1600995 - RNA, 22 nt, Homo sapiens
caguccuagcucuuacacauag

SEQ ID NO: 1600996 - RNA, 19 nt, Homo sapiens
caguccuauuuuucaaugg

SEQ ID NO: 1600997 - RNA, 16 nt, Homo sapiens
cagucggcugaacucu

SEQ ID NO: 1600998 - RNA, 23 nt, Homo sapiens
cagucuccucacucugucccugu

SEQ ID NO: 1600999 - RNA, 22 nt, Homo sapiens
cagucucggguggcuagucaga

SEQ ID NO: 1601000 - RNA, 17 nt, Homo sapiens
cagucucugaauacaca

SEQ ID NO: 1601001 - RNA, 22 nt, Homo sapiens
cagucucuucugauuaaagaga

SEQ ID NO: 1601002 - RNA, 22 nt, Homo sapiens
cagucuuccauuugcaagggaa

SEQ ID NO: 1601003 - RNA, 18 nt, Homo sapiens
cagugaaggcuaaaugag

SEQ ID NO: 1601004 - RNA, 23 nt, Homo sapiens
cagugaaggcuaagaaccuggug

SEQ ID NO: 1601005 - RNA, 23 nt, Homo sapiens
cagugaauuuuugcaauaaugca

SEQ ID NO: 1601006 - RNA, 19 nt, Homo sapiens
cagugaccagugccuguga

SEQ ID NO: 1601007 - RNA, 13 nt, Homo sapiens
cagugacuugcaa

SEQ ID NO: 1601008 - RNA, 17 nt, Homo sapiens
cagugagacugccccac

SEQ ID NO: 1601009 - RNA, 20 nt, Homo sapiens
cagugagccuccugugccug

SEQ ID NO: 1601010 - RNA, 17 nt, Homo sapiens
cagugaugcugugcuau

SEQ ID NO: 1601011 - RNA, 14 nt, Homo sapiens
cagugcauacugua

SEQ ID NO: 1601012 - RNA, 13 nt, Homo sapiens
cagugccaccuau

SEQ ID NO: 1601013 - RNA, 23 nt, Homo sapiens
cagugccaccuaugccuguggug

SEQ ID NO: 1601014 - RNA, 21 nt, Homo sapiens
cagugccucucccugcugcuc

SEQ ID NO: 1601015 - RNA, 15 nt, Homo sapiens
cagugcucaccagcc

SEQ ID NO: 1601016 - RNA, 18 nt, Homo sapiens
cagugcugccaccugcug

SEQ ID NO: 1601017 - RNA, 15 nt, Homo sapiens
caguggacucuucca

SEQ ID NO: 1601018 - RNA, 16 nt, Homo sapiens
caguggacucuuccac

SEQ ID NO: 1601019 - RNA, 14 nt, Homo sapiens
caguggaucuucag

SEQ ID NO: 1601020 - RNA, 22 nt, Homo sapiens
caguggaugccacagcccagcu

SEQ ID NO: 1601021 - RNA, 14 nt, Homo sapiens
caguggauucucau

SEQ ID NO: 1601022 - RNA, 21 nt, Homo sapiens
cagugguagagucauguuugc

SEQ ID NO: 1601023 - RNA, 18 nt, Homo sapiens
caguggugauguaaaaau

SEQ ID NO: 1601024 - RNA, 22 nt, Homo sapiens
caguguaaauuaauuacauaca

SEQ ID NO: 1601025 - RNA, 20 nt, Homo sapiens
cagugugugccacaggauug

SEQ ID NO: 1601026 - RNA, 14 nt, Homo sapiens
caguguucaguaaa

SEQ ID NO: 1601027 - RNA, 16 nt, Homo sapiens
caguguuuccacacuu

SEQ ID NO: 1601028 - RNA, 18 nt, Homo sapiens
caguguuuccacacuuaa

SEQ ID NO: 1601029 - RNA, 21 nt, Homo sapiens
caguguuugcuccaccuucau

SEQ ID NO: 1601030 - RNA, 19 nt, Homo sapiens
caguuaaagauuauuguga

SEQ ID NO: 1601031 - RNA, 19 nt, Homo sapiens
caguuaacuauugcauuua

SEQ ID NO: 1601032 - RNA, 20 nt, Homo sapiens
caguuacagagaauuucuaa

SEQ ID NO: 1601033 - RNA, 18 nt, Homo sapiens
caguuagaaacaccagcc

SEQ ID NO: 1601034 - RNA, 23 nt, Homo sapiens
caguucacuucuuugcagagccu

SEQ ID NO: 1601035 - RNA, 17 nt, Homo sapiens
caguucaguguugcaug

SEQ ID NO: 1601036 - RNA, 15 nt, Homo sapiens
caguugcauaucuua

SEQ ID NO: 1601037 - RNA, 16 nt, Homo sapiens
caguugccuccagggc

SEQ ID NO: 1601038 - RNA, 13 nt, Homo sapiens
caguuggugcugc

SEQ ID NO: 1601039 - RNA, 14 nt, Homo sapiens
caguuggugcugcu

SEQ ID NO: 1601040 - RNA, 21 nt, Homo sapiens
caguuguuugcuucuugccau

SEQ ID NO: 1601041 - RNA, 23 nt, Homo sapiens
caguuuaaaagcacgacagugga

SEQ ID NO: 1601042 - RNA, 14 nt, Homo sapiens
caguuuagaaugga

SEQ ID NO: 1601043 - RNA, 18 nt, Homo sapiens
caguuucuaggcaccuca

SEQ ID NO: 1601044 - RNA, 19 nt, Homo sapiens
caguuuuauaaaaagugga

SEQ ID NO: 1601045 - RNA, 22 nt, Homo sapiens
caguuuuccagaacacucuuag

SEQ ID NO: 1601046 - RNA, 18 nt, Homo sapiens
caguuuugcuuauugugu

SEQ ID NO: 1601047 - RNA, 23 nt, Homo sapiens
caguuuuguacauagcaaauaaa

SEQ ID NO: 1601048 - RNA, 18 nt, Homo sapiens
caguuuuuuuuuuuccag

SEQ ID NO: 1601049 - RNA, 17 nt, Homo sapiens
cauaaaacccuauacaa

SEQ ID NO: 1601050 - RNA, 15 nt, Homo sapiens
cauaaaagucuguga

SEQ ID NO: 1601051 - RNA, 16 nt, Homo sapiens
cauaaaaguuggcuca

SEQ ID NO: 1601052 - RNA, 19 nt, Homo sapiens
cauaaaauugcaguuucau

SEQ ID NO: 1601053 - RNA, 15 nt, Homo sapiens
cauaaauacugucaa

SEQ ID NO: 1601054 - RNA, 17 nt, Homo sapiens
cauaaaugacacuacuu

SEQ ID NO: 1601055 - RNA, 23 nt, Homo sapiens
cauaaauuuaugguucucaggcc

SEQ ID NO: 1601056 - RNA, 13 nt, Homo sapiens
cauaacaauuccu

SEQ ID NO: 1601057 - RNA, 23 nt, Homo sapiens
cauaacgguuaagaaagcacuua

SEQ ID NO: 1601058 - RNA, 15 nt, Homo sapiens
cauaacuauacuuga

SEQ ID NO: 1601059 - RNA, 21 nt, Homo sapiens
cauaacugcuucuuggagcuu

SEQ ID NO: 1601060 - RNA, 19 nt, Homo sapiens
cauaaggaguuagaaccac

SEQ ID NO: 1601061 - RNA, 16 nt, Homo sapiens
cauaaguuuaacugua

SEQ ID NO: 1601062 - RNA, 22 nt, Homo sapiens
cauaauagucaauuucuacuuc

SEQ ID NO: 1601063 - RNA, 18 nt, Homo sapiens
cauaaucaauauaaucug

SEQ ID NO: 1601064 - RNA, 19 nt, Homo sapiens
cauaaugcauguggcacuu

SEQ ID NO: 1601065 - RNA, 20 nt, Homo sapiens
cauaauucagcacuuaacua

SEQ ID NO: 1601066 - RNA, 22 nt, Homo sapiens
cauaauucugaaacaacuugcc

SEQ ID NO: 1601067 - RNA, 13 nt, Homo sapiens
cauacaacagaaa

SEQ ID NO: 1601068 - RNA, 16 nt, Homo sapiens
cauacacuuauuggaa

SEQ ID NO: 1601069 - RNA, 13 nt, Homo sapiens
cauacacuuuguu

SEQ ID NO: 1601070 - RNA, 21 nt, Homo sapiens
cauacagagguaacuaucaau

SEQ ID NO: 1601071 - RNA, 16 nt, Homo sapiens
cauacauauuaucuca

SEQ ID NO: 1601072 - RNA, 23 nt, Homo sapiens
cauaccauuucuacaccucaauc

SEQ ID NO: 1601073 - RNA, 16 nt, Homo sapiens
cauacguucuuuucaa

SEQ ID NO: 1601074 - RNA, 16 nt, Homo sapiens
cauacuccuuccauca

SEQ ID NO: 1601075 - RNA, 23 nt, Homo sapiens
cauacugcguccacccugagcuc

SEQ ID NO: 1601076 - RNA, 19 nt, Homo sapiens
cauacuuaaaaauuuauua

SEQ ID NO: 1601077 - RNA, 16 nt, Homo sapiens
cauacuuaaugcauau

SEQ ID NO: 1601078 - RNA, 13 nt, Homo sapiens
cauacuuaucucu

SEQ ID NO: 1601079 - RNA, 16 nt, Homo sapiens
cauagaaagaugacaa

SEQ ID NO: 1601080 - RNA, 18 nt, Homo sapiens
cauagaaauauugacuca

SEQ ID NO: 1601081 - RNA, 20 nt, Homo sapiens
cauagaaguguugagccaug

SEQ ID NO: 1601082 - RNA, 22 nt, Homo sapiens
cauagagaauauaaaaauaaag

SEQ ID NO: 1601083 - RNA, 17 nt, Homo sapiens
cauagagacccauguca

SEQ ID NO: 1601084 - RNA, 20 nt, Homo sapiens
cauagagauagcuacagugu

SEQ ID NO: 1601085 - RNA, 13 nt, Homo sapiens
cuguguauuccaa

SEQ ID NO: 1601086 - RNA, 22 nt, Homo sapiens
cugugucauucuguuagauacu

SEQ ID NO: 1601087 - RNA, 19 nt, Homo sapiens
cugugucuaggcaggcaag

SEQ ID NO: 1601088 - RNA, 19 nt, Homo sapiens
cugugugggacuguacaca

SEQ ID NO: 1601089 - RNA, 21 nt, Homo sapiens
cuguguggucuccaugcucac

SEQ ID NO: 1601090 - RNA, 20 nt, Homo sapiens
cuguguguguguguguaugu

SEQ ID NO: 1601091 - RNA, 14 nt, Homo sapiens
cuguguugccacag

SEQ ID NO: 1601092 - RNA, 18 nt, Homo sapiens
cuguguuuuuuucuaaaa

SEQ ID NO: 1601093 - RNA, 16 nt, Homo sapiens
cuguuaaaaauaauua

SEQ ID NO: 1601094 - RNA, 13 nt, Homo sapiens
cuguuaacugaag

SEQ ID NO: 1601095 - RNA, 15 nt, Homo sapiens
cuguuaauaguacua

SEQ ID NO: 1601096 - RNA, 16 nt, Homo sapiens
cuguuacuugcuucag

SEQ ID NO: 1601097 - RNA, 16 nt, Homo sapiens
cuguuacuuuggcaau

SEQ ID NO: 1601098 - RNA, 19 nt, Homo sapiens
cuguuaguauuaacuauua

SEQ ID NO: 1601099 - RNA, 21 nt, Homo sapiens
cuguuccaggcccuccagugg

SEQ ID NO: 1601100 - RNA, 21 nt, Homo sapiens
cuguuccagucacauugccau

SEQ ID NO: 1601101 - RNA, 22 nt, Homo sapiens
cuguuccccaaggacucuucca

SEQ ID NO: 1601102 - RNA, 21 nt, Homo sapiens
cuguucccccacccuccaugc

SEQ ID NO: 1601103 - RNA, 15 nt, Homo sapiens
cuguucccuugcagg

SEQ ID NO: 1601104 - RNA, 18 nt, Homo sapiens
cuguucccuugcaggggu

SEQ ID NO: 1601105 - RNA, 22 nt, Homo sapiens
cuguuccuccuaaaacaauccu

SEQ ID NO: 1601106 - RNA, 22 nt, Homo sapiens
cuguuccuggaggucagcauuu

SEQ ID NO: 1601107 - RNA, 22 nt, Homo sapiens
cuguucggaagggguuccucaa

SEQ ID NO: 1601108 - RNA, 16 nt, Homo sapiens
cuguucucagcguuuu

SEQ ID NO: 1601109 - RNA, 23 nt, Homo sapiens
cuguucuugacaaucaucuccaa

SEQ ID NO: 1601110 - RNA, 13 nt, Homo sapiens
cuguugacauauu

SEQ ID NO: 1601111 - RNA, 14 nt, Homo sapiens
cuguugacauauuu

SEQ ID NO: 1601112 - RNA, 17 nt, Homo sapiens
cuguuggauuccaugcu

SEQ ID NO: 1601113 - RNA, 22 nt, Homo sapiens
cuguugguggcaaaauugccaa

SEQ ID NO: 1601114 - RNA, 18 nt, Homo sapiens
cuguugguuaaaugacaa

SEQ ID NO: 1601115 - RNA, 22 nt, Homo sapiens
cuguuguaacuaggcucagaga

SEQ ID NO: 1601116 - RNA, 17 nt, Homo sapiens
cuguuuaugaacggaaa

SEQ ID NO: 1601117 - RNA, 19 nt, Homo sapiens
cuguuuauuaaaguacaac

SEQ ID NO: 1601118 - RNA, 21 nt, Homo sapiens
cuguuuauuaaaguacaacca

SEQ ID NO: 1601119 - RNA, 16 nt, Homo sapiens
cuguuuauuggaucua

SEQ ID NO: 1601120 - RNA, 22 nt, Homo sapiens
cuguuucuucaaugguucucuu

SEQ ID NO: 1601121 - RNA, 17 nt, Homo sapiens
cuguuugacaacauguu

SEQ ID NO: 1601122 - RNA, 20 nt, Homo sapiens
cuguuugcccccauucacuu

SEQ ID NO: 1601123 - RNA, 14 nt, Homo sapiens
cuguuugcugugga

SEQ ID NO: 1601124 - RNA, 17 nt, Homo sapiens
cuguuuggcuuaacaca

SEQ ID NO: 1601125 - RNA, 19 nt, Homo sapiens
cuguuuucuuuugguaaag

SEQ ID NO: 1601126 - RNA, 18 nt, Homo sapiens
cuuaaaaaauacuuuaug

SEQ ID NO: 1601127 - RNA, 15 nt, Homo sapiens
cuuaaaaaugcacac

SEQ ID NO: 1601128 - RNA, 22 nt, Homo sapiens
cuuaaaacuaaauguaauuuau

SEQ ID NO: 1601129 - RNA, 20 nt, Homo sapiens
cuuaaaacuauaacauuaua

SEQ ID NO: 1601130 - RNA, 17 nt, Homo sapiens
cuuaaaagaugccuuaa

SEQ ID NO: 1601131 - RNA, 24 nt, Homo sapiens
cuuaaaccagaacccaguguuucc

SEQ ID NO: 1601132 - RNA, 19 nt, Homo sapiens
cuuaaacccuuuagugcuu

SEQ ID NO: 1601133 - RNA, 21 nt, Homo sapiens
cuuaaacccuuuagugcuuug

SEQ ID NO: 1601134 - RNA, 21 nt, Homo sapiens
cuuaaacucuggacacucuau

SEQ ID NO: 1601135 - RNA, 17 nt, Homo sapiens
cuuaaagcugcugucac

SEQ ID NO: 1601136 - RNA, 13 nt, Homo sapiens
cuuaaagcuugau

SEQ ID NO: 1601137 - RNA, 21 nt, Homo sapiens
cuuaaauuaagauuaugugag

SEQ ID NO: 1601138 - RNA, 13 nt, Homo sapiens
cuuaacacaggcc

SEQ ID NO: 1601139 - RNA, 14 nt, Homo sapiens
cuuaacagacucaa

SEQ ID NO: 1601140 - RNA, 15 nt, Homo sapiens
cuuaacauucauaga

SEQ ID NO: 1601141 - RNA, 14 nt, Homo sapiens
cuuaaccucaggga

SEQ ID NO: 1601142 - RNA, 19 nt, Homo sapiens
cuuaaccuuugcuauguaa

SEQ ID NO: 1601143 - RNA, 18 nt, Homo sapiens
cuuaacugcauuuuuaga

SEQ ID NO: 1601144 - RNA, 20 nt, Homo sapiens
cuuaacuguuucaaagccaa

SEQ ID NO: 1601145 - RNA, 13 nt, Homo sapiens
cuuaagaauucaa

SEQ ID NO: 1601146 - RNA, 22 nt, Homo sapiens
cuuaagacgugauuuugcugua

SEQ ID NO: 1601147 - RNA, 13 nt, Homo sapiens
cuuaagcaguaau

SEQ ID NO: 1601148 - RNA, 16 nt, Homo sapiens
cuuaagccauaaaaua

SEQ ID NO: 1601149 - RNA, 16 nt, Homo sapiens
cuuaaguccagcucau

SEQ ID NO: 1601150 - RNA, 13 nt, Homo sapiens
cuuaaguucagca

SEQ ID NO: 1601151 - RNA, 19 nt, Homo sapiens
cuuaauagcuguaguuuuc

SEQ ID NO: 1601152 - RNA, 21 nt, Homo sapiens
cuuaauagcuguaguuuuccc

SEQ ID NO: 1601153 - RNA, 14 nt, Homo sapiens
cuuaaugacaacac

SEQ ID NO: 1601154 - RNA, 21 nt, Homo sapiens
cuuaauuauugauguuuucau

SEQ ID NO: 1601155 - RNA, 18 nt, Homo sapiens
cuuaauucuuuucacuca

SEQ ID NO: 1601156 - RNA, 19 nt, Homo sapiens
cuuaauuuacuuaaguguu

SEQ ID NO: 1601157 - RNA, 16 nt, Homo sapiens
cuuacaaauacuaaaa

SEQ ID NO: 1601158 - RNA, 19 nt, Homo sapiens
cuuacaagaggauuguaaa

SEQ ID NO: 1601159 - RNA, 20 nt, Homo sapiens
cuuacaagaggauuguaaaa

SEQ ID NO: 1601160 - RNA, 15 nt, Homo sapiens
cuuacaucaguagca

SEQ ID NO: 1601161 - RNA, 22 nt, Homo sapiens
cuuacccauuuuuuuuaccuca

SEQ ID NO: 1601162 - RNA, 16 nt, Homo sapiens
cuuacuagaccuguaa

SEQ ID NO: 1601163 - RNA, 19 nt, Homo sapiens
cuuacuccucuuuccuucc

SEQ ID NO: 1601164 - RNA, 15 nt, Homo sapiens
cuuacuuaguguuau

SEQ ID NO: 1601165 - RNA, 15 nt, Homo sapiens
cuuacuucuuagcac

SEQ ID NO: 1601166 - RNA, 18 nt, Homo sapiens
cuuagaccugccagccac

SEQ ID NO: 1601167 - RNA, 11 nt, Homo sapiens
cuuagccauuu

SEQ ID NO: 1601168 - RNA, 14 nt, Homo sapiens
cuuagcucccccac

SEQ ID NO: 1601169 - RNA, 12 nt, Homo sapiens
cuuagcugucac

SEQ ID NO: 1601170 - RNA, 23 nt, Homo sapiens
cuuaggacuaccagccauacaaa

SEQ ID NO: 1601171 - RNA, 15 nt, Homo sapiens
cuuaggccagcacca

SEQ ID NO: 1601172 - RNA, 18 nt, Homo sapiens
cuuagguccaaggucucc

SEQ ID NO: 1601173 - RNA, 17 nt, Homo sapiens
cuuaggugugaggucca

SEQ ID NO: 1601174 - RNA, 23 nt, Homo sapiens
cuuaggugugagguccaggguug

SEQ ID NO: 1601175 - RNA, 17 nt, Homo sapiens
cuuagucccucaugcaa

SEQ ID NO: 1601176 - RNA, 21 nt, Homo sapiens
cuuagugccacccaccuuugc

SEQ ID NO: 1601177 - RNA, 15 nt, Homo sapiens
cuuagugugaaguug

SEQ ID NO: 1601178 - RNA, 11 nt, Homo sapiens
cuuaguugaaa

SEQ ID NO: 1601179 - RNA, 17 nt, Homo sapiens
cuuauaacuguuuuaga

SEQ ID NO: 1601180 - RNA, 14 nt, Homo sapiens
cuuauaacuuguaa

SEQ ID NO: 1601181 - RNA, 20 nt, Homo sapiens
cuuauacucuugagaaugaa

SEQ ID NO: 1601182 - RNA, 16 nt, Homo sapiens
cuuauaggaauugacc

SEQ ID NO: 1601183 - RNA, 23 nt, Homo sapiens
cuuauaguguuuggacagcugau

SEQ ID NO: 1601184 - RNA, 23 nt, Homo sapiens
cuuaucaacauuuguuccaugag

SEQ ID NO: 1601185 - RNA, 15 nt, Homo sapiens
cuuaucaacuaauga

SEQ ID NO: 1601186 - RNA, 18 nt, Homo sapiens
cuuaucaacuaaugauuu

SEQ ID NO: 1601187 - RNA, 18 nt, Homo sapiens
cuuaucccucucuucccc

SEQ ID NO: 1601188 - RNA, 17 nt, Homo sapiens
cuuaugagauacuuugc

SEQ ID NO: 1601189 - RNA, 16 nt, Homo sapiens
cuuaugccagcgugac

SEQ ID NO: 1601190 - RNA, 23 nt, Homo sapiens
cuuaugccucgcuuauuuagccc

SEQ ID NO: 1601191 - RNA, 14 nt, Homo sapiens
cuuauguguuuuaa

SEQ ID NO: 1601192 - RNA, 17 nt, Homo sapiens
cuuauuaaucauacaaa

SEQ ID NO: 1601193 - RNA, 14 nt, Homo sapiens
cuuauuccucagug

SEQ ID NO: 1601194 - RNA, 21 nt, Homo sapiens
cuuauuguauuccucauguca

SEQ ID NO: 1601195 - RNA, 15 nt, Homo sapiens
cuuauuuaugugaac

SEQ ID NO: 1601196 - RNA, 23 nt, Homo sapiens
cuuauuucagccaaaacauacca

SEQ ID NO: 1601197 - RNA, 15 nt, Homo sapiens
cuucaaaagcaacaa

SEQ ID NO: 1601198 - RNA, 18 nt, Homo sapiens
cuucaaauuggucugaaa

SEQ ID NO: 1601199 - RNA, 13 nt, Homo sapiens
cuucaaccuaguc

SEQ ID NO: 1601200 - RNA, 14 nt, Homo sapiens
cuucaauacuuaaa

SEQ ID NO: 1601201 - RNA, 17 nt, Homo sapiens
cuucaauuuauuacuga

SEQ ID NO: 1601202 - RNA, 14 nt, Homo sapiens
cuucacaacagauu

SEQ ID NO: 1601203 - RNA, 19 nt, Homo sapiens
gaaacuugugaaguggaaa

SEQ ID NO: 1601204 - RNA, 20 nt, Homo sapiens
gaaagaauagaacacaguuu

SEQ ID NO: 1601205 - RNA, 19 nt, Homo sapiens
gaaagaaugcauuccagaa

SEQ ID NO: 1601206 - RNA, 13 nt, Homo sapiens
gaaagaccaggcc

SEQ ID NO: 1601207 - RNA, 17 nt, Homo sapiens
gaaagagaacuacuaag

SEQ ID NO: 1601208 - RNA, 22 nt, Homo sapiens
gaaagaggccagacaugguguc

SEQ ID NO: 1601209 - RNA, 14 nt, Homo sapiens
gaaagaucaaagac

SEQ ID NO: 1601210 - RNA, 20 nt, Homo sapiens
gaaagaugacaaaagaaaau

SEQ ID NO: 1601211 - RNA, 16 nt, Homo sapiens
gaaagaugucuaugua

SEQ ID NO: 1601212 - RNA, 21 nt, Homo sapiens
gaaagauugauuaaugaacua

SEQ ID NO: 1601213 - RNA, 20 nt, Homo sapiens
gaaagauuugaugggccaca

SEQ ID NO: 1601214 - RNA, 20 nt, Homo sapiens
gaaagauuugugaacuggaa

SEQ ID NO: 1601215 - RNA, 18 nt, Homo sapiens
gaaagcaaguguucacaa

SEQ ID NO: 1601216 - RNA, 21 nt, Homo sapiens
gaaagcaaguguucacaacag

SEQ ID NO: 1601217 - RNA, 17 nt, Homo sapiens
gaaagcagggacuugaa

SEQ ID NO: 1601218 - RNA, 15 nt, Homo sapiens
gaaagcucuaaagac

SEQ ID NO: 1601219 - RNA, 22 nt, Homo sapiens
gaaagcuuuuauuccuuugaau

SEQ ID NO: 1601220 - RNA, 14 nt, Homo sapiens
gaaaggagacuaga

SEQ ID NO: 1601221 - RNA, 20 nt, Homo sapiens
gaaaggauuuuaccaaagca

SEQ ID NO: 1601222 - RNA, 16 nt, Homo sapiens
gaaaggcucauuuaaa

SEQ ID NO: 1601223 - RNA, 20 nt, Homo sapiens
gaaaggcucauuuaaaacag

SEQ ID NO: 1601224 - RNA, 13 nt, Homo sapiens
gaaagggagcuau

SEQ ID NO: 1601225 - RNA, 13 nt, Homo sapiens
gaaaggugccaug

SEQ ID NO: 1601226 - RNA, 24 nt, Homo sapiens
gaaaguaauauaaugaugcugucu

SEQ ID NO: 1601227 - RNA, 15 nt, Homo sapiens
gaaagucaugcaauc

SEQ ID NO: 1601228 - RNA, 18 nt, Homo sapiens
gaaaguuaauccacugug

SEQ ID NO: 1601229 - RNA, 16 nt, Homo sapiens
gaaaguugcuuuuauu

SEQ ID NO: 1601230 - RNA, 20 nt, Homo sapiens
gaaaguuuuaauaccuaagu

SEQ ID NO: 1601231 - RNA, 19 nt, Homo sapiens
gaaauaaagagcuguuaua

SEQ ID NO: 1601232 - RNA, 15 nt, Homo sapiens
gaaauaaagaucuca

SEQ ID NO: 1601233 - RNA, 13 nt, Homo sapiens
gaaauaaagggac

SEQ ID NO: 1601234 - RNA, 23 nt, Homo sapiens
gaaauaagaauucagacaucuga

SEQ ID NO: 1601235 - RNA, 15 nt, Homo sapiens
gaaauaagcugugau

SEQ ID NO: 1601236 - RNA, 19 nt, Homo sapiens
gaaauaaguuuuuguuuca

SEQ ID NO: 1601237 - RNA, 12 nt, Homo sapiens
gaaauaauguga

SEQ ID NO: 1601238 - RNA, 19 nt, Homo sapiens
gaaauaccacaagccugag

SEQ ID NO: 1601239 - RNA, 23 nt, Homo sapiens
gaaauacguuaggaggacaaaag

SEQ ID NO: 1601240 - RNA, 19 nt, Homo sapiens
gaaauacuugaacuugccu

SEQ ID NO: 1601241 - RNA, 12 nt, Homo sapiens
gaaauacuuuug

SEQ ID NO: 1601242 - RNA, 20 nt, Homo sapiens
gaaauaggauuuugaaccca

SEQ ID NO: 1601243 - RNA, 16 nt, Homo sapiens
gaaauaguaccuucaa

SEQ ID NO: 1601244 - RNA, 22 nt, Homo sapiens
gaaauaguaccuucaauacuua

SEQ ID NO: 1601245 - RNA, 23 nt, Homo sapiens
gaaauauaguaaacacuuggaaa

SEQ ID NO: 1601246 - RNA, 17 nt, Homo sapiens
gaaauaugaagagcaaa

SEQ ID NO: 1601247 - RNA, 14 nt, Homo sapiens
gaaauauugacuca

SEQ ID NO: 1601248 - RNA, 12 nt, Homo sapiens
gaaaucuugcuu

SEQ ID NO: 1601249 - RNA, 21 nt, Homo sapiens
gaaaucuugcuucagaccauc

SEQ ID NO: 1601250 - RNA, 22 nt, Homo sapiens
gaaaugaaagggaaacugggaa

SEQ ID NO: 1601251 - RNA, 15 nt, Homo sapiens
gaaaugaacauucca

SEQ ID NO: 1601252 - RNA, 16 nt, Homo sapiens
gaaaugaccaggccaa

SEQ ID NO: 1601253 - RNA, 20 nt, Homo sapiens
gaaaugaccaggccaagacu

SEQ ID NO: 1601254 - RNA, 20 nt, Homo sapiens
gaaaugauaaagacuuuuau

SEQ ID NO: 1601255 - RNA, 17 nt, Homo sapiens
gaaaugcuguuaguaaa

SEQ ID NO: 1601256 - RNA, 21 nt, Homo sapiens
gaaauggugcucaccaugcuu

SEQ ID NO: 1601257 - RNA, 18 nt, Homo sapiens
gaaaugguggugcuuuaa

SEQ ID NO: 1601258 - RNA, 17 nt, Homo sapiens
gaaauuaaauguugauu

SEQ ID NO: 1601259 - RNA, 16 nt, Homo sapiens
gaaauuaagaaggcaa

SEQ ID NO: 1601260 - RNA, 15 nt, Homo sapiens
gaaauuguaucucag

SEQ ID NO: 1601261 - RNA, 17 nt, Homo sapiens
gaaauuuggcuauaauc

SEQ ID NO: 1601262 - RNA, 23 nt, Homo sapiens
gaaauuuucaauuugagauucua

SEQ ID NO: 1601263 - RNA, 11 nt, Homo sapiens
gaaauuuugca

SEQ ID NO: 1601264 - RNA, 13 nt, Homo sapiens
gaaauuuugcacc

SEQ ID NO: 1601265 - RNA, 13 nt, Homo sapiens
gaaauuuugccuu

SEQ ID NO: 1601266 - RNA, 14 nt, Homo sapiens
gaacaaacaaugaa

SEQ ID NO: 1601267 - RNA, 18 nt, Homo sapiens
gaacaaagccacugacug

SEQ ID NO: 1601268 - RNA, 13 nt, Homo sapiens
gaacaaauauuca

SEQ ID NO: 1601269 - RNA, 20 nt, Homo sapiens
gaacaaaucauuauguuucc

SEQ ID NO: 1601270 - RNA, 23 nt, Homo sapiens
gaacaaauuauaaaaaccaugga

SEQ ID NO: 1601271 - RNA, 20 nt, Homo sapiens
gaacaaccugcacaaccugg

SEQ ID NO: 1601272 - RNA, 21 nt, Homo sapiens
gaacaagguaaaacaacuaca

SEQ ID NO: 1601273 - RNA, 20 nt, Homo sapiens
gaacacucuuuugcuuuauu

SEQ ID NO: 1601274 - RNA, 17 nt, Homo sapiens
gaacagaggcauuuaaa

SEQ ID NO: 1601275 - RNA, 19 nt, Homo sapiens
gaacagaucaggaauucua

SEQ ID NO: 1601276 - RNA, 17 nt, Homo sapiens
gaacagcucuucuccca

SEQ ID NO: 1601277 - RNA, 13 nt, Homo sapiens
gaacagguucuua

SEQ ID NO: 1601278 - RNA, 16 nt, Homo sapiens
gaacaguauuacagug

SEQ ID NO: 1601279 - RNA, 17 nt, Homo sapiens
gaacaguauuacagugu

SEQ ID NO: 1601280 - RNA, 19 nt, Homo sapiens
gaacauaaguaaucacuaa

SEQ ID NO: 1601281 - RNA, 15 nt, Homo sapiens
gaacauacuguucuc

SEQ ID NO: 1601282 - RNA, 17 nt, Homo sapiens
gaacauagacuagagaa

SEQ ID NO: 1601283 - RNA, 16 nt, Homo sapiens
gaacaugcaguuugaa

SEQ ID NO: 1601284 - RNA, 14 nt, Homo sapiens
gaaccaaugcaaga

SEQ ID NO: 1601285 - RNA, 15 nt, Homo sapiens
gaaccacuguguacu

SEQ ID NO: 1601286 - RNA, 21 nt, Homo sapiens
gaaccagcuucugauaaacac

SEQ ID NO: 1601287 - RNA, 15 nt, Homo sapiens
gaaccaggaggacaa

SEQ ID NO: 1601288 - RNA, 18 nt, Homo sapiens
gaaccaggccagagcaaa

SEQ ID NO: 1601289 - RNA, 22 nt, Homo sapiens
gaaccauguggcagaagggaua

SEQ ID NO: 1601290 - RNA, 12 nt, Homo sapiens
gaaccauuucac

SEQ ID NO: 1601291 - RNA, 13 nt, Homo sapiens
gaaccauuucacc

SEQ ID NO: 1601292 - RNA, 16 nt, Homo sapiens
gaacccaguguuucca

SEQ ID NO: 1601293 - RNA, 21 nt, Homo sapiens
gaacccugggaacaauuucca

SEQ ID NO: 1601294 - RNA, 15 nt, Homo sapiens
gaacccuuguccucc

SEQ ID NO: 1601295 - RNA, 17 nt, Homo sapiens
gaaccuagaagggcuag

SEQ ID NO: 1601296 - RNA, 16 nt, Homo sapiens
gaaccugagacucaga

SEQ ID NO: 1601297 - RNA, 20 nt, Homo sapiens
gaaccuggaagaucauggac

SEQ ID NO: 1601298 - RNA, 16 nt, Homo sapiens
gaaccuggagggcuag

SEQ ID NO: 1601299 - RNA, 22 nt, Homo sapiens
gaaccuggauccagcacuggug

SEQ ID NO: 1601300 - RNA, 16 nt, Homo sapiens
gaaccuguccuaagga

SEQ ID NO: 1601301 - RNA, 22 nt, Homo sapiens
gaaccuguccuaaggaaccuuc

SEQ ID NO: 1601302 - RNA, 18 nt, Homo sapiens
gaaccuuugucaacuuca

SEQ ID NO: 1601303 - RNA, 15 nt, Homo sapiens
gaacgcgacuuccac

SEQ ID NO: 1601304 - RNA, 19 nt, Homo sapiens
gaacuaaauuuaagcuuaa

SEQ ID NO: 1601305 - RNA, 13 nt, Homo sapiens
gaacuagaaccug

SEQ ID NO: 1601306 - RNA, 17 nt, Homo sapiens
gaacuaggacugaacua

SEQ ID NO: 1601307 - RNA, 17 nt, Homo sapiens
gaacuccuuggcuucuu

SEQ ID NO: 1601308 - RNA, 19 nt, Homo sapiens
gaacugaaaaauuacuuau

SEQ ID NO: 1601309 - RNA, 18 nt, Homo sapiens
gaacugaaagcacuagag

SEQ ID NO: 1601310 - RNA, 15 nt, Homo sapiens
gaacugaacauucca

SEQ ID NO: 1601311 - RNA, 16 nt, Homo sapiens
gaacugaacauuccag

SEQ ID NO: 1601312 - RNA, 24 nt, Homo sapiens
gaacugcguuaugaagagcuaauu

SEQ ID NO: 1601313 - RNA, 20 nt, Homo sapiens
gaacuggauaaaaucuucca

SEQ ID NO: 1601314 - RNA, 21 nt, Homo sapiens
gaacuuaauaacuguguacug

SEQ ID NO: 1601315 - RNA, 19 nt, Homo sapiens
gaacuuaguaaguaauauc

SEQ ID NO: 1601316 - RNA, 14 nt, Homo sapiens
gaacuugaagcuaa

SEQ ID NO: 1601317 - RNA, 22 nt, Homo sapiens
gaacuugcgaguccaaggccag

SEQ ID NO: 1601318 - RNA, 22 nt, Homo sapiens
gaacuuuccccaauuacagggu

SEQ ID NO: 1601319 - RNA, 12 nt, Homo sapiens
gaacuuucuccc

SEQ ID NO: 1601320 - RNA, 22 nt, Homo sapiens
gaacuuuuuuagaaaugcaaaa

SEQ ID NO: 1601321 - RNA, 14 nt, Homo sapiens
guuaauauuugaau

SEQ ID NO: 1601322 - RNA, 23 nt, Homo sapiens
guuaauggucaaugcuagcacaa

SEQ ID NO: 1601323 - RNA, 23 nt, Homo sapiens
guuacaaauuuuuuaauuuccaa

SEQ ID NO: 1601324 - RNA, 12 nt, Homo sapiens
guuaccauucac

SEQ ID NO: 1601325 - RNA, 16 nt, Homo sapiens
guuaccauucacaaua

SEQ ID NO: 1601326 - RNA, 14 nt, Homo sapiens
guuaccucugcaug

SEQ ID NO: 1601327 - RNA, 22 nt, Homo sapiens
guuaccugaaaacacugugcac

SEQ ID NO: 1601328 - RNA, 22 nt, Homo sapiens
guuacuaaaauuuacacaucuu

SEQ ID NO: 1601329 - RNA, 11 nt, Homo sapiens
guuacugcuga

SEQ ID NO: 1601330 - RNA, 21 nt, Homo sapiens
guuacugcuugaccaaagagc

SEQ ID NO: 1601331 - RNA, 16 nt, Homo sapiens
guuacugucauuccca

SEQ ID NO: 1601332 - RNA, 11 nt, Homo sapiens
guuagaaccac

SEQ ID NO: 1601333 - RNA, 20 nt, Homo sapiens
guuagauauugcuacuauaa

SEQ ID NO: 1601334 - RNA, 19 nt, Homo sapiens
guuagaugcuuagugugaa

SEQ ID NO: 1601335 - RNA, 22 nt, Homo sapiens
guuagcaccauuaacuccuccu

SEQ ID NO: 1601336 - RNA, 23 nt, Homo sapiens
guuagcugaaccgacacucaaaa

SEQ ID NO: 1601337 - RNA, 20 nt, Homo sapiens
guuaggggaauggagggaau

SEQ ID NO: 1601338 - RNA, 19 nt, Homo sapiens
guuaguggauuacugccau

SEQ ID NO: 1601339 - RNA, 14 nt, Homo sapiens
guuaguuccuucau

SEQ ID NO: 1601340 - RNA, 16 nt, Homo sapiens
guuauaaaauaaugua

SEQ ID NO: 1601341 - RNA, 15 nt, Homo sapiens
guuauagaacuucau

SEQ ID NO: 1601342 - RNA, 21 nt, Homo sapiens
guuauagcccugcccucccaa

SEQ ID NO: 1601343 - RNA, 14 nt, Homo sapiens
guuauagcuucagg

SEQ ID NO: 1601344 - RNA, 15 nt, Homo sapiens
guuauauucagugug

SEQ ID NO: 1601345 - RNA, 15 nt, Homo sapiens
guuauccaacuauua

SEQ ID NO: 1601346 - RNA, 22 nt, Homo sapiens
guuaugaacccuuccugagcuu

SEQ ID NO: 1601347 - RNA, 14 nt, Homo sapiens
guuaugacuaugua

SEQ ID NO: 1601348 - RNA, 15 nt, Homo sapiens
guuaugacuauguaa

SEQ ID NO: 1601349 - RNA, 22 nt, Homo sapiens
guuaugcuccugcugauccaga

SEQ ID NO: 1601350 - RNA, 15 nt, Homo sapiens
guuauugacagcgau

SEQ ID NO: 1601351 - RNA, 23 nt, Homo sapiens
guuauuugaaaauuugauuuuga

SEQ ID NO: 1601352 - RNA, 14 nt, Homo sapiens
guuauuuuccauuu

SEQ ID NO: 1601353 - RNA, 15 nt, Homo sapiens
guucaagaccagccu

SEQ ID NO: 1601354 - RNA, 16 nt, Homo sapiens
guucaagcacacugga

SEQ ID NO: 1601355 - RNA, 21 nt, Homo sapiens
guucaaucuggauucauauuu

SEQ ID NO: 1601356 - RNA, 18 nt, Homo sapiens
guucacaccauucuccug

SEQ ID NO: 1601357 - RNA, 22 nt, Homo sapiens
guucagaaaauuaaacuacaga

SEQ ID NO: 1601358 - RNA, 20 nt, Homo sapiens
guucagcuccuuccaccaca

SEQ ID NO: 1601359 - RNA, 21 nt, Homo sapiens
guucagcuccuuccaccacaa

SEQ ID NO: 1601360 - RNA, 17 nt, Homo sapiens
guucagucccagggaaa

SEQ ID NO: 1601361 - RNA, 19 nt, Homo sapiens
guucauauuuauacuuugc

SEQ ID NO: 1601362 - RNA, 18 nt, Homo sapiens
guucaugaugcagucucc

SEQ ID NO: 1601363 - RNA, 19 nt, Homo sapiens
guucauuacuuuuucauau

SEQ ID NO: 1601364 - RNA, 20 nt, Homo sapiens
guuccaaauucaguuucaua

SEQ ID NO: 1601365 - RNA, 12 nt, Homo sapiens
guuccagacuca

SEQ ID NO: 1601366 - RNA, 16 nt, Homo sapiens
guuccagguggacaaa

SEQ ID NO: 1601367 - RNA, 15 nt, Homo sapiens
guucccacuuaaaaa

SEQ ID NO: 1601368 - RNA, 20 nt, Homo sapiens
guucccagccccuccucccu

SEQ ID NO: 1601369 - RNA, 23 nt, Homo sapiens
guucccagccccuccucccucag

SEQ ID NO: 1601370 - RNA, 17 nt, Homo sapiens
guucccauuucagcuga

SEQ ID NO: 1601371 - RNA, 14 nt, Homo sapiens
guucccccacugau

SEQ ID NO: 1601372 - RNA, 14 nt, Homo sapiens
guucccccugugca

SEQ ID NO: 1601373 - RNA, 23 nt, Homo sapiens
guucccucuguugggaugccagu

SEQ ID NO: 1601374 - RNA, 22 nt, Homo sapiens
guucccugacuccuccaaggaa

SEQ ID NO: 1601375 - RNA, 18 nt, Homo sapiens
guuccucccccaguuccu

SEQ ID NO: 1601376 - RNA, 20 nt, Homo sapiens
guuccucccccaguuccucc

SEQ ID NO: 1601377 - RNA, 14 nt, Homo sapiens
guuccugacacuca

SEQ ID NO: 1601378 - RNA, 20 nt, Homo sapiens
guuccuuaccucccuggucc

SEQ ID NO: 1601379 - RNA, 22 nt, Homo sapiens
guuccuuccaggugauucuguu

SEQ ID NO: 1601380 - RNA, 16 nt, Homo sapiens
guucgagaccaaccug

SEQ ID NO: 1601381 - RNA, 14 nt, Homo sapiens
guucuaaaugcaau

SEQ ID NO: 1601382 - RNA, 22 nt, Homo sapiens
guucuacugagaaaagccucuc

SEQ ID NO: 1601383 - RNA, 17 nt, Homo sapiens
guucuagacuuccccau

SEQ ID NO: 1601384 - RNA, 13 nt, Homo sapiens
guucuauccaaac

SEQ ID NO: 1601385 - RNA, 19 nt, Homo sapiens
guucucaggaccuguucaa

SEQ ID NO: 1601386 - RNA, 18 nt, Homo sapiens
guucucaucuuucuugau

SEQ ID NO: 1601387 - RNA, 13 nt, Homo sapiens
guucucuauacuc

SEQ ID NO: 1601388 - RNA, 22 nt, Homo sapiens
guucugagaagcccgaggucau

SEQ ID NO: 1601389 - RNA, 17 nt, Homo sapiens
guucugagauucaauau

SEQ ID NO: 1601390 - RNA, 22 nt, Homo sapiens
guucugcaagcaucaguucuac

SEQ ID NO: 1601391 - RNA, 14 nt, Homo sapiens
guucugugaccacu

SEQ ID NO: 1601392 - RNA, 18 nt, Homo sapiens
guucuucuuggucucagu

SEQ ID NO: 1601393 - RNA, 14 nt, Homo sapiens
guugaauaaaugaa

SEQ ID NO: 1601394 - RNA, 16 nt, Homo sapiens
guugaauaaugcuguu

SEQ ID NO: 1601395 - RNA, 22 nt, Homo sapiens
guugaauccacccaaaucuauu

SEQ ID NO: 1601396 - RNA, 16 nt, Homo sapiens
guugaccacuccagag

SEQ ID NO: 1601397 - RNA, 9 nt, Homo sapiens
guugagauu

SEQ ID NO: 1601398 - RNA, 16 nt, Homo sapiens
guugagcuauugcugu

SEQ ID NO: 1601399 - RNA, 16 nt, Homo sapiens
guugcaucauguugaa

SEQ ID NO: 1601400 - RNA, 20 nt, Homo sapiens
guugccuccagggccucucc

SEQ ID NO: 1601401 - RNA, 16 nt, Homo sapiens
guugcugcuacugucu

SEQ ID NO: 1601402 - RNA, 18 nt, Homo sapiens
guugcuggcaguacuguu

SEQ ID NO: 1601403 - RNA, 22 nt, Homo sapiens
guuggaacuuacauacaugggg

SEQ ID NO: 1601404 - RNA, 21 nt, Homo sapiens
guuggagagcuagaaccugga

SEQ ID NO: 1601405 - RNA, 16 nt, Homo sapiens
guuggccaauuucacc

SEQ ID NO: 1601406 - RNA, 23 nt, Homo sapiens
guuggccuuggaauauggccaag

SEQ ID NO: 1601407 - RNA, 13 nt, Homo sapiens
guuggcucaggag

SEQ ID NO: 1601408 - RNA, 13 nt, Homo sapiens
guugggaugccag

SEQ ID NO: 1601409 - RNA, 23 nt, Homo sapiens
guuggugcugcuuucuuguugcu

SEQ ID NO: 1601410 - RNA, 14 nt, Homo sapiens
guuguccugcccug

SEQ ID NO: 1601411 - RNA, 20 nt, Homo sapiens
guugugacagucacugcauu

SEQ ID NO: 1601412 - RNA, 13 nt, Homo sapiens
guugugacugcca

SEQ ID NO: 1601413 - RNA, 18 nt, Homo sapiens
guugugggcaacacaugc

SEQ ID NO: 1601414 - RNA, 11 nt, Homo sapiens
guuguguuccu

SEQ ID NO: 1601415 - RNA, 19 nt, Homo sapiens
guuguucgccgcguggaau

SEQ ID NO: 1601416 - RNA, 15 nt, Homo sapiens
guuguuggucuguag

SEQ ID NO: 1601417 - RNA, 21 nt, Homo sapiens
guuguuuauauacaguacaca

SEQ ID NO: 1601418 - RNA, 14 nt, Homo sapiens
guuguuuguuuaaa

SEQ ID NO: 1601419 - RNA, 18 nt, Homo sapiens
guuuaaacccaagugcug

SEQ ID NO: 1601420 - RNA, 14 nt, Homo sapiens
guuuaaagucacau

SEQ ID NO: 1601421 - RNA, 13 nt, Homo sapiens
guuuaacauuuca

SEQ ID NO: 1601422 - RNA, 19 nt, Homo sapiens
guuuaagcuuaacauuuca

SEQ ID NO: 1601423 - RNA, 23 nt, Homo sapiens
guuuaccaugaagauaaacuguu

SEQ ID NO: 1601424 - RNA, 18 nt, Homo sapiens
guuuaccuggugcucuca

SEQ ID NO: 1601425 - RNA, 12 nt, Homo sapiens
guuuacuuauaa

SEQ ID NO: 1601426 - RNA, 19 nt, Homo sapiens
guuuacuuaucuuaugcca

SEQ ID NO: 1601427 - RNA, 17 nt, Homo sapiens
guuuagaugaaugucag

SEQ ID NO: 1601428 - RNA, 23 nt, Homo sapiens
guuuauaucacugucuagcuguu

SEQ ID NO: 1601429 - RNA, 20 nt, Homo sapiens
guuuaugcauagauaaucuc

SEQ ID NO: 1601430 - RNA, 22 nt, Homo sapiens
guuuaugcauagauaaucucuc

SEQ ID NO: 1601431 - RNA, 22 nt, Homo sapiens
guuuauguguuaugaacaucca

SEQ ID NO: 1601432 - RNA, 20 nt, Homo sapiens
guuuauuccagagaagccag

SEQ ID NO: 1601433 - RNA, 17 nt, Homo sapiens
guuuauugaaugugauu

SEQ ID NO: 1601434 - RNA, 22 nt, Homo sapiens
guuuauuguaguaaacuauucu

SEQ ID NO: 1601435 - RNA, 22 nt, Homo sapiens
guuuauuucaggcauuggauau

SEQ ID NO: 1601436 - RNA, 19 nt, Homo sapiens
guuucaaaaauaaauuugc

SEQ ID NO: 1601437 - RNA, 23 nt, Homo sapiens
guuucagaugauucuaugucuca

SEQ ID NO: 1601438 - RNA, 15 nt, Homo sapiens
uaauauugugcaaac

SEQ ID NO: 1601439 - RNA, 17 nt, Homo sapiens
uaauauuucaagugccu

SEQ ID NO: 1601440 - RNA, 18 nt, Homo sapiens
uaauauuucaagugccua

SEQ ID NO: 1601441 - RNA, 17 nt, Homo sapiens
uaauauuugaauugccu

SEQ ID NO: 1601442 - RNA, 17 nt, Homo sapiens
uaauauuuuagauuaca

SEQ ID NO: 1601443 - RNA, 14 nt, Homo sapiens
uaauauuuuccaua

SEQ ID NO: 1601444 - RNA, 19 nt, Homo sapiens
uaaucaagaaaagaauuac

SEQ ID NO: 1601445 - RNA, 15 nt, Homo sapiens
uaaucaccucucugu

SEQ ID NO: 1601446 - RNA, 12 nt, Homo sapiens
uaaucacuuaaa

SEQ ID NO: 1601447 - RNA, 14 nt, Homo sapiens
uaaucaucaaguaa

SEQ ID NO: 1601448 - RNA, 20 nt, Homo sapiens
uaaucaucaaguaauacaaa

SEQ ID NO: 1601449 - RNA, 20 nt, Homo sapiens
uaauccaauauuuugccuuu

SEQ ID NO: 1601450 - RNA, 18 nt, Homo sapiens
uaauccaauccacuaaca

SEQ ID NO: 1601451 - RNA, 19 nt, Homo sapiens
uaaucccacccaccucacc

SEQ ID NO: 1601452 - RNA, 17 nt, Homo sapiens
uaaucccagcacuuuga

SEQ ID NO: 1601453 - RNA, 14 nt, Homo sapiens
uaauccuaccucaa

SEQ ID NO: 1601454 - RNA, 14 nt, Homo sapiens
uaaucgcuaaucag

SEQ ID NO: 1601455 - RNA, 11 nt, Homo sapiens
uaaucuacugu

SEQ ID NO: 1601456 - RNA, 15 nt, Homo sapiens
uaaucucacuacaca

SEQ ID NO: 1601457 - RNA, 15 nt, Homo sapiens
uaaucucagcacuuu

SEQ ID NO: 1601458 - RNA, 18 nt, Homo sapiens
uaaucuccucugcucauu

SEQ ID NO: 1601459 - RNA, 16 nt, Homo sapiens
uaaucugagaggccac

SEQ ID NO: 1601460 - RNA, 13 nt, Homo sapiens
uaaucuuccauuc

SEQ ID NO: 1601461 - RNA, 21 nt, Homo sapiens
uaaucuucugccuucucauga

SEQ ID NO: 1601462 - RNA, 18 nt, Homo sapiens
uaaugaacagaacauaga

SEQ ID NO: 1601463 - RNA, 22 nt, Homo sapiens
uaaugaagaaucacgauuucau

SEQ ID NO: 1601464 - RNA, 14 nt, Homo sapiens
uaaugacaugccua

SEQ ID NO: 1601465 - RNA, 17 nt, Homo sapiens
uaaugaccaguuguuau

SEQ ID NO: 1601466 - RNA, 21 nt, Homo sapiens
uaaugacucuuucugaaggaa

SEQ ID NO: 1601467 - RNA, 19 nt, Homo sapiens
uaaugagaauuccuuagca

SEQ ID NO: 1601468 - RNA, 16 nt, Homo sapiens
uaaugaugaacuuaua

SEQ ID NO: 1601469 - RNA, 20 nt, Homo sapiens
uaaugaugcugucugaacag

SEQ ID NO: 1601470 - RNA, 22 nt, Homo sapiens
uaaugcaccaaucuuguuuaua

SEQ ID NO: 1601471 - RNA, 18 nt, Homo sapiens
uaaugcucaacaauuuau

SEQ ID NO: 1601472 - RNA, 19 nt, Homo sapiens
uaauggagcaucaagccac

SEQ ID NO: 1601473 - RNA, 18 nt, Homo sapiens
uaauggucaaugcuagca

SEQ ID NO: 1601474 - RNA, 16 nt, Homo sapiens
uaaugguuauauguau

SEQ ID NO: 1601475 - RNA, 16 nt, Homo sapiens
uaauguaaauaaacua

SEQ ID NO: 1601476 - RNA, 19 nt, Homo sapiens
uaauguaggaugacaggcu

SEQ ID NO: 1601477 - RNA, 19 nt, Homo sapiens
uaauguauacauuacaucu

SEQ ID NO: 1601478 - RNA, 16 nt, Homo sapiens
uaaugucacaacaugg

SEQ ID NO: 1601479 - RNA, 14 nt, Homo sapiens
uaaugucaccaccu

SEQ ID NO: 1601480 - RNA, 15 nt, Homo sapiens
uaaugucaccaccuu

SEQ ID NO: 1601481 - RNA, 13 nt, Homo sapiens
uaaugucagcuua

SEQ ID NO: 1601482 - RNA, 22 nt, Homo sapiens
uaaugucauagguaagaaacac

SEQ ID NO: 1601483 - RNA, 12 nt, Homo sapiens
uaauguguuucu

SEQ ID NO: 1601484 - RNA, 22 nt, Homo sapiens
uaauguuccugaaaauugcaau

SEQ ID NO: 1601485 - RNA, 16 nt, Homo sapiens
uaauguugcuggauca

SEQ ID NO: 1601486 - RNA, 22 nt, Homo sapiens
uaauguugcuuucuuaucccag

SEQ ID NO: 1601487 - RNA, 18 nt, Homo sapiens
uaauguuuaauauugaga

SEQ ID NO: 1601488 - RNA, 18 nt, Homo sapiens
uaauuaaaagcaaaucau

SEQ ID NO: 1601489 - RNA, 15 nt, Homo sapiens
uaauuaaagccuuaa

SEQ ID NO: 1601490 - RNA, 18 nt, Homo sapiens
uaauuaagaaaacuauua

SEQ ID NO: 1601491 - RNA, 16 nt, Homo sapiens
uaauuaccaaccuguu

SEQ ID NO: 1601492 - RNA, 15 nt, Homo sapiens
uaauuaccaguuuuc

SEQ ID NO: 1601493 - RNA, 19 nt, Homo sapiens
uaauuaccaguuuuccaga

SEQ ID NO: 1601494 - RNA, 14 nt, Homo sapiens
uaauuacuauguca

SEQ ID NO: 1601495 - RNA, 19 nt, Homo sapiens
uaauuacucuacuucccag

SEQ ID NO: 1601496 - RNA, 14 nt, Homo sapiens
uaauuagggugaaa

SEQ ID NO: 1601497 - RNA, 23 nt, Homo sapiens
uaauucaagccucuaaacagaca

SEQ ID NO: 1601498 - RNA, 13 nt, Homo sapiens
uaauucaguguca

SEQ ID NO: 1601499 - RNA, 23 nt, Homo sapiens
uaauuccacacccucacugcugu

SEQ ID NO: 1601500 - RNA, 16 nt, Homo sapiens
uaauucggauuugcca

SEQ ID NO: 1601501 - RNA, 15 nt, Homo sapiens
uaauucuacccugaa

SEQ ID NO: 1601502 - RNA, 18 nt, Homo sapiens
uaauucuuaaaacuauaa

SEQ ID NO: 1601503 - RNA, 19 nt, Homo sapiens
uaauuguaaacuaguacua

SEQ ID NO: 1601504 - RNA, 19 nt, Homo sapiens
uaauuguuuaaaaugccuc

SEQ ID NO: 1601505 - RNA, 16 nt, Homo sapiens
uaauuuaacacccuuu

SEQ ID NO: 1601506 - RNA, 16 nt, Homo sapiens
uaauuuacagaaauca

SEQ ID NO: 1601507 - RNA, 15 nt, Homo sapiens
uaauuuaguuucaua

SEQ ID NO: 1601508 - RNA, 20 nt, Homo sapiens
uaauuuauuauacaccuuag

SEQ ID NO: 1601509 - RNA, 21 nt, Homo sapiens
uaauuugugcuacaguuuuuc

SEQ ID NO: 1601510 - RNA, 19 nt, Homo sapiens
uaauuuuuuuuccuugccu

SEQ ID NO: 1601511 - RNA, 22 nt, Homo sapiens
uacaaaaacuuagaugggcaug

SEQ ID NO: 1601512 - RNA, 18 nt, Homo sapiens
uacaaaacuacaugagaa

SEQ ID NO: 1601513 - RNA, 16 nt, Homo sapiens
uacaaagcgugcacaa

SEQ ID NO: 1601514 - RNA, 14 nt, Homo sapiens
uacaaaguuucaaa

SEQ ID NO: 1601515 - RNA, 23 nt, Homo sapiens
uacaaaucauccauccuugccaa

SEQ ID NO: 1601516 - RNA, 20 nt, Homo sapiens
uacaagcuuaaagcuugauu

SEQ ID NO: 1601517 - RNA, 18 nt, Homo sapiens
uacaaggacuuagugcau

SEQ ID NO: 1601518 - RNA, 21 nt, Homo sapiens
uacaaggcccagaagccugau

SEQ ID NO: 1601519 - RNA, 18 nt, Homo sapiens
uacaagugcagcugugac

SEQ ID NO: 1601520 - RNA, 15 nt, Homo sapiens
uacaauaaaaccaaa

SEQ ID NO: 1601521 - RNA, 20 nt, Homo sapiens
uacaaucgagacugcaaugu

SEQ ID NO: 1601522 - RNA, 17 nt, Homo sapiens
uacaaugaucaccgacu

SEQ ID NO: 1601523 - RNA, 14 nt, Homo sapiens
uacaauguacaauu

SEQ ID NO: 1601524 - RNA, 20 nt, Homo sapiens
uacaauguagaaaaugagga

SEQ ID NO: 1601525 - RNA, 20 nt, Homo sapiens
uacaauuuuuuaucaugcau

SEQ ID NO: 1601526 - RNA, 20 nt, Homo sapiens
uacacaaucugaaacagcuu

SEQ ID NO: 1601527 - RNA, 14 nt, Homo sapiens
uacacacacacaaa

SEQ ID NO: 1601528 - RNA, 12 nt, Homo sapiens
uacacacuuuau

SEQ ID NO: 1601529 - RNA, 16 nt, Homo sapiens
uacacauagcauguaa

SEQ ID NO: 1601530 - RNA, 20 nt, Homo sapiens
uacacaugccaacacuuaau

SEQ ID NO: 1601531 - RNA, 23 nt, Homo sapiens
uacaccucaauccuccauuugcu

SEQ ID NO: 1601532 - RNA, 17 nt, Homo sapiens
uacaccuuagucuuucc

SEQ ID NO: 1601533 - RNA, 21 nt, Homo sapiens
uacacggaggucucuguaaaa

SEQ ID NO: 1601534 - RNA, 13 nt, Homo sapiens
uacacuacuccug

SEQ ID NO: 1601535 - RNA, 13 nt, Homo sapiens
uacacuaguccau

SEQ ID NO: 1601536 - RNA, 15 nt, Homo sapiens
uacacuaguccauaa

SEQ ID NO: 1601537 - RNA, 16 nt, Homo sapiens
uacacuaguccauaag

SEQ ID NO: 1601538 - RNA, 18 nt, Homo sapiens
uacacucaagcaugaaga

SEQ ID NO: 1601539 - RNA, 19 nt, Homo sapiens
uacacuccagccugggcaa

SEQ ID NO: 1601540 - RNA, 20 nt, Homo sapiens
uacacuccagccugggcaac

SEQ ID NO: 1601541 - RNA, 15 nt, Homo sapiens
uacacuccucuauca

SEQ ID NO: 1601542 - RNA, 17 nt, Homo sapiens
uacacucuugauucuac

SEQ ID NO: 1601543 - RNA, 22 nt, Homo sapiens
uacacuguauguuauagaacuu

SEQ ID NO: 1601544 - RNA, 12 nt, Homo sapiens
uacagaaauauc

SEQ ID NO: 1601545 - RNA, 20 nt, Homo sapiens
uacagaaucaaaugcaauuu

SEQ ID NO: 1601546 - RNA, 21 nt, Homo sapiens
uacagacacucccacuuggca

SEQ ID NO: 1601547 - RNA, 16 nt, Homo sapiens
uacagagcaccuguag

SEQ ID NO: 1601548 - RNA, 17 nt, Homo sapiens
uacagaggucagcacac

SEQ ID NO: 1601549 - RNA, 22 nt, Homo sapiens
uacagcaaaauuaaauacauaa

SEQ ID NO: 1601550 - RNA, 21 nt, Homo sapiens
uacaggaagcaccccaugcca

SEQ ID NO: 1601551 - RNA, 20 nt, Homo sapiens
uacaggcgugauccaccaca

SEQ ID NO: 1601552 - RNA, 15 nt, Homo sapiens
uacaggggugcugca

SEQ ID NO: 1601553 - RNA, 19 nt, Homo sapiens
uacaggugaaggcucucac

SEQ ID NO: 1601554 - RNA, 22 nt, Homo sapiens
uacaggugugagccaccgugcc

SEQ ID NO: 1601555 - RNA, 20 nt, Homo sapiens
uacaguagaauaugaucaaa

SEQ ID NO: 1601556 - RNA, 15 nt, Homo sapiens
aaauguccuuucuca

SEQ ID NO: 1601557 - RNA, 16 nt, Homo sapiens
aaaugucuguauuuca

SEQ ID NO: 1601558 - RNA, 23 nt, Homo sapiens
aaaugucuugcuguugacauauu

SEQ ID NO: 1601559 - RNA, 13 nt, Homo sapiens
aaaugugacucag

SEQ ID NO: 1601560 - RNA, 13 nt, Homo sapiens
aaaugugaugaau

SEQ ID NO: 1601561 - RNA, 16 nt, Homo sapiens
aaauguuagauauugc

SEQ ID NO: 1601562 - RNA, 18 nt, Homo sapiens
aaauguuaugacuaugua

SEQ ID NO: 1601563 - RNA, 20 nt, Homo sapiens
aaauguucugguaugcauuc

SEQ ID NO: 1601564 - RNA, 13 nt, Homo sapiens
aaauguugacagg

SEQ ID NO: 1601565 - RNA, 12 nt, Homo sapiens
aaauguuugaua

SEQ ID NO: 1601566 - RNA, 23 nt, Homo sapiens
aaauguuuguuuauaucacuguc

SEQ ID NO: 1601567 - RNA, 17 nt, Homo sapiens
aaauuaaaccaacaaca

SEQ ID NO: 1601568 - RNA, 16 nt, Homo sapiens
aaauuaaauacauaaa

SEQ ID NO: 1601569 - RNA, 17 nt, Homo sapiens
aaauuaaccuggucaau

SEQ ID NO: 1601570 - RNA, 21 nt, Homo sapiens
aaauuaagaaauucacuuccc

SEQ ID NO: 1601571 - RNA, 21 nt, Homo sapiens
aaauuaauaucuuucugcaca

SEQ ID NO: 1601572 - RNA, 22 nt, Homo sapiens
aaauuacguucuuacaagcuua

SEQ ID NO: 1601573 - RNA, 16 nt, Homo sapiens
aaauuagccauuucac

SEQ ID NO: 1601574 - RNA, 14 nt, Homo sapiens
aaauuaugaauauu

SEQ ID NO: 1601575 - RNA, 13 nt, Homo sapiens
aaauuaugugaca

SEQ ID NO: 1601576 - RNA, 14 nt, Homo sapiens
aaauuaugugacau

SEQ ID NO: 1601577 - RNA, 19 nt, Homo sapiens
aaauuauugcuguauguaa

SEQ ID NO: 1601578 - RNA, 22 nt, Homo sapiens
aaauuauuguuaaagaauacac

SEQ ID NO: 1601579 - RNA, 13 nt, Homo sapiens
aaauuauuugcag

SEQ ID NO: 1601580 - RNA, 19 nt, Homo sapiens
aaauucaaagaaguacuuu

SEQ ID NO: 1601581 - RNA, 15 nt, Homo sapiens
aaauucagaugcugu

SEQ ID NO: 1601582 - RNA, 17 nt, Homo sapiens
aaauucauuugcuugca

SEQ ID NO: 1601583 - RNA, 15 nt, Homo sapiens
aaauuccacagauua

SEQ ID NO: 1601584 - RNA, 12 nt, Homo sapiens
aaauucuaccuc

SEQ ID NO: 1601585 - RNA, 18 nt, Homo sapiens
aaauucuguaauuugaau

SEQ ID NO: 1601586 - RNA, 13 nt, Homo sapiens
aaauugcugcuug

SEQ ID NO: 1601587 - RNA, 21 nt, Homo sapiens
aaauugggcuggauugugcuu

SEQ ID NO: 1601588 - RNA, 14 nt, Homo sapiens
aaauugguacauag

SEQ ID NO: 1601589 - RNA, 22 nt, Homo sapiens
aaauuguaucaaaugugacauu

SEQ ID NO: 1601590 - RNA, 18 nt, Homo sapiens
aaauuguuuaccauagaa

SEQ ID NO: 1601591 - RNA, 18 nt, Homo sapiens
aaauuuaaaacuguugga

SEQ ID NO: 1601592 - RNA, 14 nt, Homo sapiens
aaauuuaagcuuaa

SEQ ID NO: 1601593 - RNA, 20 nt, Homo sapiens
aaauuuaauuaaagccuuaa

SEQ ID NO: 1601594 - RNA, 19 nt, Homo sapiens
aaauuuauaagccaaaggu

SEQ ID NO: 1601595 - RNA, 18 nt, Homo sapiens
aaauuugauugauuugaa

SEQ ID NO: 1601596 - RNA, 17 nt, Homo sapiens
aaauuuuaaacuuauga

SEQ ID NO: 1601597 - RNA, 14 nt, Homo sapiens
aaauuuuaaccuau

SEQ ID NO: 1601598 - RNA, 21 nt, Homo sapiens
aaauuuugcaccagcgaagaa

SEQ ID NO: 1601599 - RNA, 18 nt, Homo sapiens
aaauuuugugacauuccu

SEQ ID NO: 1601600 - RNA, 21 nt, Homo sapiens
aaauuuuuuaaaagagacaaa

SEQ ID NO: 1601601 - RNA, 13 nt, Homo sapiens
aacaaaaccaacu

SEQ ID NO: 1601602 - RNA, 15 nt, Homo sapiens
aacaaaaccaacuca

SEQ ID NO: 1601603 - RNA, 21 nt, Homo sapiens
aacaaaacccucagcacuguu

SEQ ID NO: 1601604 - RNA, 13 nt, Homo sapiens
aacaaacaaaagc

SEQ ID NO: 1601605 - RNA, 12 nt, Homo sapiens
aacaaacagggc

SEQ ID NO: 1601606 - RNA, 13 nt, Homo sapiens
aacaaacagggcu

SEQ ID NO: 1601607 - RNA, 14 nt, Homo sapiens
aacaaagaaugggc

SEQ ID NO: 1601608 - RNA, 14 nt, Homo sapiens
aacaaagacauuua

SEQ ID NO: 1601609 - RNA, 15 nt, Homo sapiens
aacaacaacuuugga

SEQ ID NO: 1601610 - RNA, 16 nt, Homo sapiens
aacaacaacuuuggau

SEQ ID NO: 1601611 - RNA, 18 nt, Homo sapiens
aacaacagagacagugaa

SEQ ID NO: 1601612 - RNA, 21 nt, Homo sapiens
aacaacugcauaaccuuuaca

SEQ ID NO: 1601613 - RNA, 15 nt, Homo sapiens
aacaacuuacacuua

SEQ ID NO: 1601614 - RNA, 15 nt, Homo sapiens
aacaacuuguagcag

SEQ ID NO: 1601615 - RNA, 14 nt, Homo sapiens
aacaagaacuuuaa

SEQ ID NO: 1601616 - RNA, 21 nt, Homo sapiens
aacaaguauuuguuaauuuag

SEQ ID NO: 1601617 - RNA, 20 nt, Homo sapiens
aacaauaaagauacaugauu

SEQ ID NO: 1601618 - RNA, 21 nt, Homo sapiens
aacaauauguuugcaaacuug

SEQ ID NO: 1601619 - RNA, 13 nt, Homo sapiens
aacaauauuacuu

SEQ ID NO: 1601620 - RNA, 15 nt, Homo sapiens
aacaaugacauuuau

SEQ ID NO: 1601621 - RNA, 21 nt, Homo sapiens
aacaaugccuuguuguauucc

SEQ ID NO: 1601622 - RNA, 14 nt, Homo sapiens
aacaauucugugac

SEQ ID NO: 1601623 - RNA, 21 nt, Homo sapiens
aacacacaggugcaacagacu

SEQ ID NO: 1601624 - RNA, 17 nt, Homo sapiens
aacacacgauaccuguu

SEQ ID NO: 1601625 - RNA, 19 nt, Homo sapiens
aacacagcaacaaugacuu

SEQ ID NO: 1601626 - RNA, 13 nt, Homo sapiens
aacacaguauuuu

SEQ ID NO: 1601627 - RNA, 15 nt, Homo sapiens
aacacauaacauugu

SEQ ID NO: 1601628 - RNA, 21 nt, Homo sapiens
aacaccacgguagugccugaa

SEQ ID NO: 1601629 - RNA, 16 nt, Homo sapiens
aacacccuucagcaau

SEQ ID NO: 1601630 - RNA, 22 nt, Homo sapiens
aacacccuuucaucucagaguc

SEQ ID NO: 1601631 - RNA, 16 nt, Homo sapiens
aacaccuucaugcuua

SEQ ID NO: 1601632 - RNA, 12 nt, Homo sapiens
aacacgugugug

SEQ ID NO: 1601633 - RNA, 13 nt, Homo sapiens
aacacuacagugg

SEQ ID NO: 1601634 - RNA, 22 nt, Homo sapiens
aacacuauuuccaaaagcacau

SEQ ID NO: 1601635 - RNA, 21 nt, Homo sapiens
aacacugaucccccagaugca

SEQ ID NO: 1601636 - RNA, 16 nt, Homo sapiens
aacacuuggcauacaa

SEQ ID NO: 1601637 - RNA, 14 nt, Homo sapiens
aacagaaauuguau

SEQ ID NO: 1601638 - RNA, 18 nt, Homo sapiens
aacagaaauuguauauug

SEQ ID NO: 1601639 - RNA, 21 nt, Homo sapiens
aacagaaauuguauauuguaa

SEQ ID NO: 1601640 - RNA, 12 nt, Homo sapiens
aacagacucuca

SEQ ID NO: 1601641 - RNA, 14 nt, Homo sapiens
aacagagacugaau

SEQ ID NO: 1601642 - RNA, 14 nt, Homo sapiens
aacagauacauuca

SEQ ID NO: 1601643 - RNA, 18 nt, Homo sapiens
aacagauaucagugucuc

SEQ ID NO: 1601644 - RNA, 17 nt, Homo sapiens
aacagaucgagucacaa

SEQ ID NO: 1601645 - RNA, 17 nt, Homo sapiens
aacagcaauggugucag

SEQ ID NO: 1601646 - RNA, 19 nt, Homo sapiens
aacagcaccaccauuuaau

SEQ ID NO: 1601647 - RNA, 21 nt, Homo sapiens
aacagcaugggccucaccucc

SEQ ID NO: 1601648 - RNA, 18 nt, Homo sapiens
aacagcguggaugucgau

SEQ ID NO: 1601649 - RNA, 17 nt, Homo sapiens
aacagcucgauccaaau

SEQ ID NO: 1601650 - RNA, 21 nt, Homo sapiens
aacagcucuucucccagaugu

SEQ ID NO: 1601651 - RNA, 21 nt, Homo sapiens
aacaggauuacaguguagcua

SEQ ID NO: 1601652 - RNA, 15 nt, Homo sapiens
aacaggccauuguga

SEQ ID NO: 1601653 - RNA, 21 nt, Homo sapiens
aacagggcugccuucuggccu

SEQ ID NO: 1601654 - RNA, 17 nt, Homo sapiens
aacagguaaaacagggc

SEQ ID NO: 1601655 - RNA, 18 nt, Homo sapiens
aacagguuauaacagugu

SEQ ID NO: 1601656 - RNA, 17 nt, Homo sapiens
aacagguugggauggga

SEQ ID NO: 1601657 - RNA, 18 nt, Homo sapiens
aacagguuucuaagcaua

SEQ ID NO: 1601658 - RNA, 22 nt, Homo sapiens
aacagucuaguguaauggauca

SEQ ID NO: 1601659 - RNA, 19 nt, Homo sapiens
aacagugcaacacuggucu

SEQ ID NO: 1601660 - RNA, 13 nt, Homo sapiens
aacagugccauug

SEQ ID NO: 1601661 - RNA, 19 nt, Homo sapiens
aacaguggaaacuaugugu

SEQ ID NO: 1601662 - RNA, 17 nt, Homo sapiens
aacaguuaccugagaga

SEQ ID NO: 1601663 - RNA, 18 nt, Homo sapiens
aacaguuguauguuugcu

SEQ ID NO: 1601664 - RNA, 21 nt, Homo sapiens
aacaguuguauguuugcugau

SEQ ID NO: 1601665 - RNA, 15 nt, Homo sapiens
aacaguuuuacaaua

SEQ ID NO: 1601666 - RNA, 12 nt, Homo sapiens
aacauagacaga

SEQ ID NO: 1601667 - RNA, 13 nt, Homo sapiens
aacauauccaaaa

SEQ ID NO: 1601668 - RNA, 14 nt, Homo sapiens
aacauauggcuuua

SEQ ID NO: 1601669 - RNA, 15 nt, Homo sapiens
aacaucacaccugcc

SEQ ID NO: 1601670 - RNA, 14 nt, Homo sapiens
aacaucauuucaau

SEQ ID NO: 1601671 - RNA, 17 nt, Homo sapiens
aacauccaagucuuucu

SEQ ID NO: 1601672 - RNA, 21 nt, Homo sapiens
aacauccguuuucauuguuca

SEQ ID NO: 1601673 - RNA, 19 nt, Homo sapiens
aacaucucaugugugcuca

SEQ ID NO: 1601674 - RNA, 23 nt, Homo sapiens
aacaugaacucuugaagucacac

SEQ ID NO: 1601675 - RNA, 14 nt, Homo sapiens
aacugcacugucaa

SEQ ID NO: 1601676 - RNA, 16 nt, Homo sapiens
aacugcguuaugaaga

SEQ ID NO: 1601677 - RNA, 16 nt, Homo sapiens
aacuggaagaaagcaa

SEQ ID NO: 1601678 - RNA, 15 nt, Homo sapiens
aacuggagugcucuc

SEQ ID NO: 1601679 - RNA, 23 nt, Homo sapiens
aacuggauaaaaucuuccaaauc

SEQ ID NO: 1601680 - RNA, 22 nt, Homo sapiens
aacugguagaaaaacaucugaa

SEQ ID NO: 1601681 - RNA, 20 nt, Homo sapiens
aacugguauuuuaucuuuga

SEQ ID NO: 1601682 - RNA, 18 nt, Homo sapiens
aacuguaucaucuuugcc

SEQ ID NO: 1601683 - RNA, 23 nt, Homo sapiens
aacuguauuucaguauuuuccag

SEQ ID NO: 1601684 - RNA, 15 nt, Homo sapiens
aacugucuuguuuca

SEQ ID NO: 1601685 - RNA, 19 nt, Homo sapiens
aacugucuuguuucaguga

SEQ ID NO: 1601686 - RNA, 21 nt, Homo sapiens
aacugugucuggcguucucaa

SEQ ID NO: 1601687 - RNA, 16 nt, Homo sapiens
aacuguuucaaagcca

SEQ ID NO: 1601688 - RNA, 20 nt, Homo sapiens
aacuuacagguccugcugaa

SEQ ID NO: 1601689 - RNA, 17 nt, Homo sapiens
aacuuaccuuguuaaga

SEQ ID NO: 1601690 - RNA, 23 nt, Homo sapiens
aacuuacugucuucuucauguca

SEQ ID NO: 1601691 - RNA, 21 nt, Homo sapiens
aacuuagaugggcaugguggu

SEQ ID NO: 1601692 - RNA, 16 nt, Homo sapiens
aacuucaauuuacuua

SEQ ID NO: 1601693 - RNA, 12 nt, Homo sapiens
aacuucauucuc

SEQ ID NO: 1601694 - RNA, 19 nt, Homo sapiens
aacuuccuuaaaaaagaau

SEQ ID NO: 1601695 - RNA, 22 nt, Homo sapiens
aacuuccuuggacucauuuuaa

SEQ ID NO: 1601696 - RNA, 19 nt, Homo sapiens
aacuucucuugcuuucuau

SEQ ID NO: 1601697 - RNA, 17 nt, Homo sapiens
aacuucuuccugugaag

SEQ ID NO: 1601698 - RNA, 13 nt, Homo sapiens
aacuugaguauaa

SEQ ID NO: 1601699 - RNA, 15 nt, Homo sapiens
aacuugcaauaccaa

SEQ ID NO: 1601700 - RNA, 12 nt, Homo sapiens
aacuugcaauuu

SEQ ID NO: 1601701 - RNA, 13 nt, Homo sapiens
aacuugcucucau

SEQ ID NO: 1601702 - RNA, 19 nt, Homo sapiens
aacuuggauguaccugccc

SEQ ID NO: 1601703 - RNA, 22 nt, Homo sapiens
aacuuggucugcagaccaucca

SEQ ID NO: 1601704 - RNA, 19 nt, Homo sapiens
aacuugucucuucaucuaa

SEQ ID NO: 1601705 - RNA, 22 nt, Homo sapiens
aacuuguuugguaguuagccau

SEQ ID NO: 1601706 - RNA, 18 nt, Homo sapiens
aacuuuagcaacaguuau

SEQ ID NO: 1601707 - RNA, 20 nt, Homo sapiens
aacuuuagcaacaguuauca

SEQ ID NO: 1601708 - RNA, 23 nt, Homo sapiens
aacuuucuguuggauuccaugcu

SEQ ID NO: 1601709 - RNA, 19 nt, Homo sapiens
aacuuugauaggaugugga

SEQ ID NO: 1601710 - RNA, 23 nt, Homo sapiens
aacuuuguaaccagaauuauaca

SEQ ID NO: 1601711 - RNA, 13 nt, Homo sapiens
aacuuugucacuu

SEQ ID NO: 1601712 - RNA, 18 nt, Homo sapiens
aacuuuugguaucuacuu

SEQ ID NO: 1601713 - RNA, 19 nt, Homo sapiens
aacuuuuugcaaggcauuu

SEQ ID NO: 1601714 - RNA, 19 nt, Homo sapiens
aacuuuuuguuuuuauuuc

SEQ ID NO: 1601715 - RNA, 18 nt, Homo sapiens
aacuuuuuuuucucucuu

SEQ ID NO: 1601716 - RNA, 19 nt, Homo sapiens
aacuuuuuuuucucucuuu

SEQ ID NO: 1601717 - RNA, 16 nt, Homo sapiens
aagaaaacaguacaga

SEQ ID NO: 1601718 - RNA, 17 nt, Homo sapiens
aagaaacagaguggccu

SEQ ID NO: 1601719 - RNA, 22 nt, Homo sapiens
aagaaaccaccgaaaucccuca

SEQ ID NO: 1601720 - RNA, 17 nt, Homo sapiens
aagaaacuaaacagaaa

SEQ ID NO: 1601721 - RNA, 23 nt, Homo sapiens
aagaaacuaaacagaaaacuccc

SEQ ID NO: 1601722 - RNA, 14 nt, Homo sapiens
aagaaagaucaaag

SEQ ID NO: 1601723 - RNA, 15 nt, Homo sapiens
aagaaagaucaaaga

SEQ ID NO: 1601724 - RNA, 12 nt, Homo sapiens
aagaaaguguau

SEQ ID NO: 1601725 - RNA, 15 nt, Homo sapiens
aagaaauaaugccuc

SEQ ID NO: 1601726 - RNA, 19 nt, Homo sapiens
aagaaaucaaaagaaucua

SEQ ID NO: 1601727 - RNA, 11 nt, Homo sapiens
aagaaaugcaa

SEQ ID NO: 1601728 - RNA, 19 nt, Homo sapiens
aagaacagagucucaggac

SEQ ID NO: 1601729 - RNA, 17 nt, Homo sapiens
aagaaccaaauaccuca

SEQ ID NO: 1601730 - RNA, 23 nt, Homo sapiens
aagaaccacucauugucuuugag

SEQ ID NO: 1601731 - RNA, 11 nt, Homo sapiens
aagaaccacuu

SEQ ID NO: 1601732 - RNA, 15 nt, Homo sapiens
aagaaccauugauuu

SEQ ID NO: 1601733 - RNA, 16 nt, Homo sapiens
aagaacucauuugaau

SEQ ID NO: 1601734 - RNA, 21 nt, Homo sapiens
aagaacucauuugaaugcuua

SEQ ID NO: 1601735 - RNA, 14 nt, Homo sapiens
aagaacucucugga

SEQ ID NO: 1601736 - RNA, 16 nt, Homo sapiens
aagaacugaagcucuu

SEQ ID NO: 1601737 - RNA, 14 nt, Homo sapiens
aagaacugcaucug

SEQ ID NO: 1601738 - RNA, 22 nt, Homo sapiens
aagaacuguugccuaauuggaa

SEQ ID NO: 1601739 - RNA, 15 nt, Homo sapiens
aagaacuugcaauac

SEQ ID NO: 1601740 - RNA, 14 nt, Homo sapiens
aagaagaaucucau

SEQ ID NO: 1601741 - RNA, 15 nt, Homo sapiens
aagaagacacagaag

SEQ ID NO: 1601742 - RNA, 12 nt, Homo sapiens
aagaagacauuu

SEQ ID NO: 1601743 - RNA, 17 nt, Homo sapiens
aagaagauguccgugag

SEQ ID NO: 1601744 - RNA, 16 nt, Homo sapiens
aagaagcuucaugcca

SEQ ID NO: 1601745 - RNA, 13 nt, Homo sapiens
aagaagguuucug

SEQ ID NO: 1601746 - RNA, 19 nt, Homo sapiens
aagaaguggcugccaaaga

SEQ ID NO: 1601747 - RNA, 20 nt, Homo sapiens
aagaaguggcugccaaagag

SEQ ID NO: 1601748 - RNA, 15 nt, Homo sapiens
aagaaguuugaccau

SEQ ID NO: 1601749 - RNA, 21 nt, Homo sapiens
aagaauaaggcuuuuucuucc

SEQ ID NO: 1601750 - RNA, 13 nt, Homo sapiens
aagaauacacaau

SEQ ID NO: 1601751 - RNA, 12 nt, Homo sapiens
aagaauaccaau

SEQ ID NO: 1601752 - RNA, 12 nt, Homo sapiens
aagaauacuuga

SEQ ID NO: 1601753 - RNA, 18 nt, Homo sapiens
aagaaugcaaccuaguca

SEQ ID NO: 1601754 - RNA, 15 nt, Homo sapiens
aagaauguagucaga

SEQ ID NO: 1601755 - RNA, 21 nt, Homo sapiens
aagaauguuauccaacuauua

SEQ ID NO: 1601756 - RNA, 15 nt, Homo sapiens
aagaauuacuuugug

SEQ ID NO: 1601757 - RNA, 15 nt, Homo sapiens
aagacaagcuguaua

SEQ ID NO: 1601758 - RNA, 22 nt, Homo sapiens
aagacacagaauaguuuacaca

SEQ ID NO: 1601759 - RNA, 13 nt, Homo sapiens
aagacacauugac

SEQ ID NO: 1601760 - RNA, 16 nt, Homo sapiens
aagacagaugccccag

SEQ ID NO: 1601761 - RNA, 14 nt, Homo sapiens
aagacagcuuccca

SEQ ID NO: 1601762 - RNA, 15 nt, Homo sapiens
aagacauguuggaaa

SEQ ID NO: 1601763 - RNA, 24 nt, Homo sapiens
aagacauuucgaagucaucauucc

SEQ ID NO: 1601764 - RNA, 18 nt, Homo sapiens
aagaccagggaugcugcc

SEQ ID NO: 1601765 - RNA, 16 nt, Homo sapiens
aagacccccagcacuu

SEQ ID NO: 1601766 - RNA, 13 nt, Homo sapiens
aagaccucaucuc

SEQ ID NO: 1601767 - RNA, 20 nt, Homo sapiens
aagaccugacagcuugagaa

SEQ ID NO: 1601768 - RNA, 16 nt, Homo sapiens
aagacgccuucaucug

SEQ ID NO: 1601769 - RNA, 16 nt, Homo sapiens
aaccagaaaggugauu

SEQ ID NO: 1601770 - RNA, 23 nt, Homo sapiens
aaccagaccaaccgccugcagga

SEQ ID NO: 1601771 - RNA, 15 nt, Homo sapiens
aaccagacucuguaa

SEQ ID NO: 1601772 - RNA, 15 nt, Homo sapiens
aaccagcccaaccau

SEQ ID NO: 1601773 - RNA, 14 nt, Homo sapiens
aaccagcucugaac

SEQ ID NO: 1601774 - RNA, 16 nt, Homo sapiens
aaccagcuucaugugg

SEQ ID NO: 1601775 - RNA, 17 nt, Homo sapiens
aaccagggcucuucuca

SEQ ID NO: 1601776 - RNA, 23 nt, Homo sapiens
aaccaugccuuccucaguaucca

SEQ ID NO: 1601777 - RNA, 19 nt, Homo sapiens
aaccauguugguugcacuu

SEQ ID NO: 1601778 - RNA, 20 nt, Homo sapiens
aaccauuccaacuucaauuu

SEQ ID NO: 1601779 - RNA, 19 nt, Homo sapiens
aaccauuuuuguuacucuc

SEQ ID NO: 1601780 - RNA, 15 nt, Homo sapiens
aacccaaauguucau

SEQ ID NO: 1601781 - RNA, 22 nt, Homo sapiens
aacccaaauguucaucaaugaa

SEQ ID NO: 1601782 - RNA, 11 nt, Homo sapiens
aaccccagugg

SEQ ID NO: 1601783 - RNA, 13 nt, Homo sapiens
aaccccaguggau

SEQ ID NO: 1601784 - RNA, 18 nt, Homo sapiens
aaccccaguggauucuca

SEQ ID NO: 1601785 - RNA, 15 nt, Homo sapiens
aaccccauuccugug

SEQ ID NO: 1601786 - RNA, 22 nt, Homo sapiens
aacccccagcccacagagccug

SEQ ID NO: 1601787 - RNA, 13 nt, Homo sapiens
aacccccaucucc

SEQ ID NO: 1601788 - RNA, 16 nt, Homo sapiens
aacccccaucucccua

SEQ ID NO: 1601789 - RNA, 15 nt, Homo sapiens
aaccccuccacugcu

SEQ ID NO: 1601790 - RNA, 14 nt, Homo sapiens
aaccccuucuuuac

SEQ ID NO: 1601791 - RNA, 22 nt, Homo sapiens
aacccuagaaauauauccugug

SEQ ID NO: 1601792 - RNA, 21 nt, Homo sapiens
aacccugggaacaauuuccaa

SEQ ID NO: 1601793 - RNA, 15 nt, Homo sapiens
aacccuuaacugaca

SEQ ID NO: 1601794 - RNA, 16 nt, Homo sapiens
aaccguaaagugccuu

SEQ ID NO: 1601795 - RNA, 14 nt, Homo sapiens
aaccuaaugcacuc

SEQ ID NO: 1601796 - RNA, 14 nt, Homo sapiens
aaccuaguacugcc

SEQ ID NO: 1601797 - RNA, 18 nt, Homo sapiens
aaccuaguccgcugaaga

SEQ ID NO: 1601798 - RNA, 15 nt, Homo sapiens
aaccuauccuuccag

SEQ ID NO: 1601799 - RNA, 20 nt, Homo sapiens
aaccuauggaaguuguugcu

SEQ ID NO: 1601800 - RNA, 14 nt, Homo sapiens
aaccucacaaagua

SEQ ID NO: 1601801 - RNA, 11 nt, Homo sapiens
aaccucagggc

SEQ ID NO: 1601802 - RNA, 23 nt, Homo sapiens
aaccucaguaauuuagaaaucau

SEQ ID NO: 1601803 - RNA, 23 nt, Homo sapiens
aaccucagugauuggcucugugg

SEQ ID NO: 1601804 - RNA, 22 nt, Homo sapiens
aaccucaguuuccucaucugca

SEQ ID NO: 1601805 - RNA, 20 nt, Homo sapiens
aaccucauaaaaaucuagca

SEQ ID NO: 1601806 - RNA, 14 nt, Homo sapiens
aaccucaucuuucu

SEQ ID NO: 1601807 - RNA, 18 nt, Homo sapiens
aaccuccaacacagugca

SEQ ID NO: 1601808 - RNA, 20 nt, Homo sapiens
aaccugacuuccucugccac

SEQ ID NO: 1601809 - RNA, 13 nt, Homo sapiens
aaccugaguauca

SEQ ID NO: 1601810 - RNA, 20 nt, Homo sapiens
aaccugcacguugugcacau

SEQ ID NO: 1601811 - RNA, 17 nt, Homo sapiens
aaccugguggcaccaga

SEQ ID NO: 1601812 - RNA, 21 nt, Homo sapiens
aaccuuaaagaaccaucagca

SEQ ID NO: 1601813 - RNA, 23 nt, Homo sapiens
aaccuuaaaggccgucauuucau

SEQ ID NO: 1601814 - RNA, 15 nt, Homo sapiens
aaccuuccacccagu

SEQ ID NO: 1601815 - RNA, 16 nt, Homo sapiens
aaccuuccucuuccag

SEQ ID NO: 1601816 - RNA, 19 nt, Homo sapiens
aaccuuccuuccugcuuga

SEQ ID NO: 1601817 - RNA, 12 nt, Homo sapiens
aaccuuuacacu

SEQ ID NO: 1601818 - RNA, 20 nt, Homo sapiens
aacgacugccgugacaucau

SEQ ID NO: 1601819 - RNA, 23 nt, Homo sapiens
aacgauacaaauuuggccuuaag

SEQ ID NO: 1601820 - RNA, 21 nt, Homo sapiens
aacgauccuucaaagucucaa

SEQ ID NO: 1601821 - RNA, 14 nt, Homo sapiens
aacgcaccaaucag

SEQ ID NO: 1601822 - RNA, 17 nt, Homo sapiens
aacgcaccagacacuca

SEQ ID NO: 1601823 - RNA, 19 nt, Homo sapiens
aacgcaccagacacucaca

SEQ ID NO: 1601824 - RNA, 13 nt, Homo sapiens
aacgccgagugca

SEQ ID NO: 1601825 - RNA, 17 nt, Homo sapiens
aacgccgagugcacugc

SEQ ID NO: 1601826 - RNA, 13 nt, Homo sapiens
aacgcgacuucca

SEQ ID NO: 1601827 - RNA, 14 nt, Homo sapiens
aacgcgacuuccac

SEQ ID NO: 1601828 - RNA, 23 nt, Homo sapiens
aacgcgacuuccacaaaccugga

SEQ ID NO: 1601829 - RNA, 20 nt, Homo sapiens
aacggugaccagcaaauccu

SEQ ID NO: 1601830 - RNA, 23 nt, Homo sapiens
aacguaauuguacaagcaguuaa

SEQ ID NO: 1601831 - RNA, 20 nt, Homo sapiens
aacguucuauaaaugaaugu

SEQ ID NO: 1601832 - RNA, 23 nt, Homo sapiens
aacguugaauugaugaugcaguu

SEQ ID NO: 1601833 - RNA, 19 nt, Homo sapiens
aacguuugacaaacacaau

SEQ ID NO: 1601834 - RNA, 19 nt, Homo sapiens
aacuaaaaauuaaaaccuc

SEQ ID NO: 1601835 - RNA, 15 nt, Homo sapiens
aacuaaaauguucua

SEQ ID NO: 1601836 - RNA, 23 nt, Homo sapiens
aacuaagcaaguauauuuauuuc

SEQ ID NO: 1601837 - RNA, 17 nt, Homo sapiens
aacuaauuucauuucaa

SEQ ID NO: 1601838 - RNA, 22 nt, Homo sapiens
aacuacauuaccuguucuugcc

SEQ ID NO: 1601839 - RNA, 21 nt, Homo sapiens
aacuaccaaauuagugaacca

SEQ ID NO: 1601840 - RNA, 21 nt, Homo sapiens
aacuacuauuuuucuuuccaa

SEQ ID NO: 1601841 - RNA, 14 nt, Homo sapiens
aacuacugccuuua

SEQ ID NO: 1601842 - RNA, 21 nt, Homo sapiens
aacuagacuaagaagauuuag

SEQ ID NO: 1601843 - RNA, 17 nt, Homo sapiens
aacuagcauuacauuau

SEQ ID NO: 1601844 - RNA, 12 nt, Homo sapiens
aacuagccaaac

SEQ ID NO: 1601845 - RNA, 18 nt, Homo sapiens
aacuagccaaaccaggac

SEQ ID NO: 1601846 - RNA, 15 nt, Homo sapiens
aacuaggaaaaucac

SEQ ID NO: 1601847 - RNA, 21 nt, Homo sapiens
aacuaggaaaaucacuugcca

SEQ ID NO: 1601848 - RNA, 21 nt, Homo sapiens
aacuaggcucagagaugugca

SEQ ID NO: 1601849 - RNA, 20 nt, Homo sapiens
aacuaucauuuuuacacuau

SEQ ID NO: 1601850 - RNA, 17 nt, Homo sapiens
aacuaucucuacugaau

SEQ ID NO: 1601851 - RNA, 23 nt, Homo sapiens
aacuaugaggagccucugaucaa

SEQ ID NO: 1601852 - RNA, 12 nt, Homo sapiens
aacuauguguuc

SEQ ID NO: 1601853 - RNA, 18 nt, Homo sapiens
aacuauguguucaaugaa

SEQ ID NO: 1601854 - RNA, 15 nt, Homo sapiens
aacuauuaaggccuu

SEQ ID NO: 1601855 - RNA, 21 nt, Homo sapiens
aacucaaggaaaaguucuuuc

SEQ ID NO: 1601856 - RNA, 12 nt, Homo sapiens
aacucaaggguu

SEQ ID NO: 1601857 - RNA, 12 nt, Homo sapiens
aacucaccaggg

SEQ ID NO: 1601858 - RNA, 14 nt, Homo sapiens
aacucaccauagag

SEQ ID NO: 1601859 - RNA, 16 nt, Homo sapiens
aacucaccauagagac

SEQ ID NO: 1601860 - RNA, 18 nt, Homo sapiens
aacucacggaccacucga

SEQ ID NO: 1601861 - RNA, 16 nt, Homo sapiens
uaaauagugugauguu

SEQ ID NO: 1601862 - RNA, 12 nt, Homo sapiens
uaaauaucucaa

SEQ ID NO: 1601863 - RNA, 13 nt, Homo sapiens
uaaaucauaaagu

SEQ ID NO: 1601864 - RNA, 15 nt, Homo sapiens
uaaaucaucccuuaa

SEQ ID NO: 1601865 - RNA, 14 nt, Homo sapiens
uaaaucaugaugcu

SEQ ID NO: 1601866 - RNA, 21 nt, Homo sapiens
uaaauccuuguuaccuaucuc

SEQ ID NO: 1601867 - RNA, 17 nt, Homo sapiens
uaaaucuccaguacuug

SEQ ID NO: 1601868 - RNA, 14 nt, Homo sapiens
uaaaucugugauga

SEQ ID NO: 1601869 - RNA, 16 nt, Homo sapiens
uaaaucuuuucaauua

SEQ ID NO: 1601870 - RNA, 21 nt, Homo sapiens
uaaaucuuuuugcuucuacuu

SEQ ID NO: 1601871 - RNA, 14 nt, Homo sapiens
uaaaugacaaugua

SEQ ID NO: 1601872 - RNA, 14 nt, Homo sapiens
uaaaugcaauaaga

SEQ ID NO: 1601873 - RNA, 14 nt, Homo sapiens
uaaaugcaauauuc

SEQ ID NO: 1601874 - RNA, 22 nt, Homo sapiens
uaaaugcagacaacaccuuccu

SEQ ID NO: 1601875 - RNA, 13 nt, Homo sapiens
uaaaugcccaguu

SEQ ID NO: 1601876 - RNA, 20 nt, Homo sapiens
uaaaugggucaugacaagau

SEQ ID NO: 1601877 - RNA, 11 nt, Homo sapiens
uaaauguaaua

SEQ ID NO: 1601878 - RNA, 18 nt, Homo sapiens
uaaauguauacuauagua

SEQ ID NO: 1601879 - RNA, 19 nt, Homo sapiens
uaaaugugaaacaucuucu

SEQ ID NO: 1601880 - RNA, 14 nt, Homo sapiens
uaaaugugagcaaa

SEQ ID NO: 1601881 - RNA, 17 nt, Homo sapiens
uaaauguguuagcacug

SEQ ID NO: 1601882 - RNA, 21 nt, Homo sapiens
uaaauguuuguuuauaucacu

SEQ ID NO: 1601883 - RNA, 17 nt, Homo sapiens
uaaauguuuuacucaga

SEQ ID NO: 1601884 - RNA, 17 nt, Homo sapiens
uaaauuaagauccuaaa

SEQ ID NO: 1601885 - RNA, 18 nt, Homo sapiens
uaaauucccaacuucucu

SEQ ID NO: 1601886 - RNA, 19 nt, Homo sapiens
uaaauugucugccauuaca

SEQ ID NO: 1601887 - RNA, 17 nt, Homo sapiens
uaaauuuaaguccaccu

SEQ ID NO: 1601888 - RNA, 21 nt, Homo sapiens
uaaauuuaugguucucaggcc

SEQ ID NO: 1601889 - RNA, 20 nt, Homo sapiens
uaaauuuuuuauaaaagugu

SEQ ID NO: 1601890 - RNA, 18 nt, Homo sapiens
uaacaaacaagaaagcua

SEQ ID NO: 1601891 - RNA, 20 nt, Homo sapiens
uaacaaugacauuuauauca

SEQ ID NO: 1601892 - RNA, 16 nt, Homo sapiens
uaacaaugccuauugu

SEQ ID NO: 1601893 - RNA, 18 nt, Homo sapiens
guggacaggaugaggaca

SEQ ID NO: 1601894 - RNA, 14 nt, Homo sapiens
guggacugugcugg

SEQ ID NO: 1601895 - RNA, 19 nt, Homo sapiens
guggacugugcuggugcau

SEQ ID NO: 1601896 - RNA, 16 nt, Homo sapiens
guggagauagugccag

SEQ ID NO: 1601897 - RNA, 15 nt, Homo sapiens
guggaugaugcugcc

SEQ ID NO: 1601898 - RNA, 23 nt, Homo sapiens
guggcaaagguuuauuccagaga

SEQ ID NO: 1601899 - RNA, 19 nt, Homo sapiens
guggcaagagggaauguca

SEQ ID NO: 1601900 - RNA, 16 nt, Homo sapiens
guggcacucagucucu

SEQ ID NO: 1601901 - RNA, 12 nt, Homo sapiens
guggccucagaa

SEQ ID NO: 1601902 - RNA, 16 nt, Homo sapiens
guggcucaacauugug

SEQ ID NO: 1601903 - RNA, 17 nt, Homo sapiens
guggcuccuaucugugu

SEQ ID NO: 1601904 - RNA, 21 nt, Homo sapiens
guggcuggcucuaccuuccug

SEQ ID NO: 1601905 - RNA, 14 nt, Homo sapiens
guggcuguuucauc

SEQ ID NO: 1601906 - RNA, 19 nt, Homo sapiens
gugggaacucacuuucccu

SEQ ID NO: 1601907 - RNA, 17 nt, Homo sapiens
gugggaagaauuggaag

SEQ ID NO: 1601908 - RNA, 19 nt, Homo sapiens
gugggaggcggugcacuca

SEQ ID NO: 1601909 - RNA, 16 nt, Homo sapiens
gugggcaacacaugca

SEQ ID NO: 1601910 - RNA, 16 nt, Homo sapiens
gugggcacugugccaa

SEQ ID NO: 1601911 - RNA, 21 nt, Homo sapiens
guggggaggcggacguuccag

SEQ ID NO: 1601912 - RNA, 23 nt, Homo sapiens
guggggcccuucucugcagucaa

SEQ ID NO: 1601913 - RNA, 23 nt, Homo sapiens
gugggguacagagaugaaagagg

SEQ ID NO: 1601914 - RNA, 14 nt, Homo sapiens
gugggguacauuuc

SEQ ID NO: 1601915 - RNA, 21 nt, Homo sapiens
gugggucaguccucuuuccuu

SEQ ID NO: 1601916 - RNA, 22 nt, Homo sapiens
guggguccaggggccccuccag

SEQ ID NO: 1601917 - RNA, 20 nt, Homo sapiens
gugggucucugggcugucag

SEQ ID NO: 1601918 - RNA, 21 nt, Homo sapiens
guggguggccagcgcgaugaa

SEQ ID NO: 1601919 - RNA, 12 nt, Homo sapiens
gugguaaucuac

SEQ ID NO: 1601920 - RNA, 12 nt, Homo sapiens
gugguacuugau

SEQ ID NO: 1601921 - RNA, 22 nt, Homo sapiens
gccugguucaaaguaaagcaga

SEQ ID NO: 1601922 - RNA, 22 nt, Homo sapiens
gccugguucccuccccaaggcc

SEQ ID NO: 1601923 - RNA, 19 nt, Homo sapiens
gccuguaaucucagcacuu

SEQ ID NO: 1601924 - RNA, 21 nt, Homo sapiens
gccuguaaucucagcacuuug

SEQ ID NO: 1601925 - RNA, 11 nt, Homo sapiens
gccuguggcau

SEQ ID NO: 1601926 - RNA, 18 nt, Homo sapiens
gccuguggcuggcuggaa

SEQ ID NO: 1601927 - RNA, 13 nt, Homo sapiens
gccuguggugaag

SEQ ID NO: 1601928 - RNA, 20 nt, Homo sapiens
gccuuaaacacacauugcag

SEQ ID NO: 1601929 - RNA, 12 nt, Homo sapiens
gccuuaacaaac

SEQ ID NO: 1601930 - RNA, 21 nt, Homo sapiens
gccuucccaaguugugcuuga

SEQ ID NO: 1601931 - RNA, 13 nt, Homo sapiens
gccuuccuccuca

SEQ ID NO: 1601932 - RNA, 18 nt, Homo sapiens
gccuucuacugcucuccu

SEQ ID NO: 1601933 - RNA, 13 nt, Homo sapiens
gccuucuggagcu

SEQ ID NO: 1601934 - RNA, 20 nt, Homo sapiens
gccuugcccagccuggaugc

SEQ ID NO: 1601935 - RNA, 16 nt, Homo sapiens
gccuuggaaccagccc

SEQ ID NO: 1601936 - RNA, 21 nt, Homo sapiens
gccuugucuucuuagcuguca

SEQ ID NO: 1601937 - RNA, 18 nt, Homo sapiens
gccuuuauuuccacugug

SEQ ID NO: 1601938 - RNA, 16 nt, Homo sapiens
gccuuugauguggaug

SEQ ID NO: 1601939 - RNA, 20 nt, Homo sapiens
gccuuuuuuccugggccaga

SEQ ID NO: 1601940 - RNA, 17 nt, Homo sapiens
gcgacccauucagagac

SEQ ID NO: 1601941 - RNA, 17 nt, Homo sapiens
gcgagccauuuguccca

SEQ ID NO: 1601942 - RNA, 18 nt, Homo sapiens
gcgagggaagcaauugaa

SEQ ID NO: 1601943 - RNA, 13 nt, Homo sapiens
gcgagguguaaag

SEQ ID NO: 1601944 - RNA, 14 nt, Homo sapiens
gcgcucgcccagca

SEQ ID NO: 1601945 - RNA, 17 nt, Homo sapiens
gccauguuauuuauagu

SEQ ID NO: 1601946 - RNA, 20 nt, Homo sapiens
gccauuaugcaaauggagau

SEQ ID NO: 1601947 - RNA, 14 nt, Homo sapiens
gccauucuuuccca

SEQ ID NO: 1601948 - RNA, 18 nt, Homo sapiens
gccauugcauuccagccu

SEQ ID NO: 1601949 - RNA, 19 nt, Homo sapiens
gcccaaacuggagugcagu

SEQ ID NO: 1601950 - RNA, 16 nt, Homo sapiens
gcccaaccagaacuuu

SEQ ID NO: 1601951 - RNA, 17 nt, Homo sapiens
gcccaacccuaucccag

SEQ ID NO: 1601952 - RNA, 15 nt, Homo sapiens
gcccaagaggacuga

SEQ ID NO: 1601953 - RNA, 16 nt, Homo sapiens
gcccaagaggacugag

SEQ ID NO: 1601954 - RNA, 16 nt, Homo sapiens
gcccaaggugcugaug

SEQ ID NO: 1601955 - RNA, 20 nt, Homo sapiens
gcccaaguaccacgcagugc

SEQ ID NO: 1601956 - RNA, 19 nt, Homo sapiens
gcccacccuccugucuucc

SEQ ID NO: 1601957 - RNA, 22 nt, Homo sapiens
gcccacgucaggccuggccuca

SEQ ID NO: 1601958 - RNA, 16 nt, Homo sapiens
gcccacugaggggcca

SEQ ID NO: 1601959 - RNA, 20 nt, Homo sapiens
gcccagacaccaugugcaau

SEQ ID NO: 1601960 - RNA, 15 nt, Homo sapiens
gcccagacccagugg

SEQ ID NO: 1601961 - RNA, 12 nt, Homo sapiens
gcccagacuaca

SEQ ID NO: 1601962 - RNA, 16 nt, Homo sapiens
gcccagaggguggcaa

SEQ ID NO: 1601963 - RNA, 13 nt, Homo sapiens
gcccagccuggga

SEQ ID NO: 1601964 - RNA, 20 nt, Homo sapiens
gcccaggagccucacugggg

SEQ ID NO: 1601965 - RNA, 15 nt, Homo sapiens
gcccaggccaggugc

SEQ ID NO: 1601966 - RNA, 16 nt, Homo sapiens
gcccagggacaccagc

SEQ ID NO: 1601967 - RNA, 18 nt, Homo sapiens
gcccauaaccaguauuuu

SEQ ID NO: 1601968 - RNA, 22 nt, Homo sapiens
cugcccgggaaggucaccagca

SEQ ID NO: 1601969 - RNA, 22 nt, Homo sapiens
cugcccgucucucucccaugga

SEQ ID NO: 1601970 - RNA, 15 nt, Homo sapiens
cugccgaauauagaa

SEQ ID NO: 1601971 - RNA, 21 nt, Homo sapiens
cugccgcccuccacaccucua

SEQ ID NO: 1601972 - RNA, 22 nt, Homo sapiens
cugccuaagugcagccccgugg

SEQ ID NO: 1601973 - RNA, 18 nt, Homo sapiens
cugccuaaguggcugcug

SEQ ID NO: 1601974 - RNA, 17 nt, Homo sapiens
cugccuacuccaaaaug

SEQ ID NO: 1601975 - RNA, 14 nt, Homo sapiens
cugccucacuccuc

SEQ ID NO: 1601976 - RNA, 20 nt, Homo sapiens
cugccugcgccagaagagcu

SEQ ID NO: 1601977 - RNA, 14 nt, Homo sapiens
cugccugguggcaa

SEQ ID NO: 1601978 - RNA, 19 nt, Homo sapiens
cugccuguuauaacucugc

SEQ ID NO: 1601979 - RNA, 21 nt, Homo sapiens
cugccuguuggcaggcccacu

SEQ ID NO: 1601980 - RNA, 14 nt, Homo sapiens
cugccuuaaacaca

SEQ ID NO: 1601981 - RNA, 12 nt, Homo sapiens
cugccuucacaa

SEQ ID NO: 1601982 - RNA, 14 nt, Homo sapiens
cugccuucucagga

SEQ ID NO: 1601983 - RNA, 18 nt, Homo sapiens
cugccuucucaugaucca

SEQ ID NO: 1601984 - RNA, 15 nt, Homo sapiens
cugcgaggacaucaa

SEQ ID NO: 1601985 - RNA, 22 nt, Homo sapiens
cugcuaagauuccuuuugucaa

SEQ ID NO: 1601986 - RNA, 14 nt, Homo sapiens
cugcuaccaaaaca

SEQ ID NO: 1601987 - RNA, 13 nt, Homo sapiens
cugcuagcacaga

SEQ ID NO: 1601988 - RNA, 22 nt, Homo sapiens
cugcuccaaucugucacauaaa

SEQ ID NO: 1601989 - RNA, 14 nt, Homo sapiens
cugcuccagccucu

SEQ ID NO: 1601990 - RNA, 20 nt, Homo sapiens
cugcucccaguccugccuga

SEQ ID NO: 1601991 - RNA, 19 nt, Homo sapiens
cugcuccccaacaccugcc

SEQ ID NO: 1601992 - RNA, 14 nt, Homo sapiens
cugcucucuaucca

SEQ ID NO: 1601993 - RNA, 17 nt, Homo sapiens
cugcucuuguucuacug

SEQ ID NO: 1601994 - RNA, 19 nt, Homo sapiens
cugcugcagcaugaaggca

SEQ ID NO: 1601995 - RNA, 21 nt, Homo sapiens
cugcugcagggacagcccuga

SEQ ID NO: 1601996 - RNA, 19 nt, Homo sapiens
cugcugccacagacugugg

SEQ ID NO: 1601997 - RNA, 17 nt, Homo sapiens
cugcugcugcuacugcu

SEQ ID NO: 1601998 - RNA, 17 nt, Homo sapiens
cugcuggcuaagcauuu

SEQ ID NO: 1601999 - RNA, 16 nt, Homo sapiens
cugcuggcugcucccc

SEQ ID NO: 1602000 - RNA, 13 nt, Homo sapiens
cugcugugccuga

SEQ ID NO: 1602001 - RNA, 13 nt, Homo sapiens
cugcuucauugac

SEQ ID NO: 1602002 - RNA, 10 nt, Homo sapiens
cugcuuccag

SEQ ID NO: 1602003 - RNA, 11 nt, Homo sapiens
cugcuucucac

SEQ ID NO: 1602004 - RNA, 12 nt, Homo sapiens
cugcuucuguua

SEQ ID NO: 1602005 - RNA, 16 nt, Homo sapiens
cugcuucuuggagcuu

SEQ ID NO: 1602006 - RNA, 15 nt, Homo sapiens
cugcuuggucuuuca

SEQ ID NO: 1602007 - RNA, 16 nt, Homo sapiens
cugcuugugaucucac

SEQ ID NO: 1602008 - RNA, 17 nt, Homo sapiens
cugcuugugaucucaca

SEQ ID NO: 1602009 - RNA, 23 nt, Homo sapiens
cugcuugugaucucacacacaga

SEQ ID NO: 1602010 - RNA, 23 nt, Homo sapiens
cugcuuguggcggauuccucacc

SEQ ID NO: 1602011 - RNA, 21 nt, Homo sapiens
cugcuuucuuguugcugcauc

SEQ ID NO: 1602012 - RNA, 18 nt, Homo sapiens
cugcuuuuaacucuagaa

SEQ ID NO: 1602013 - RNA, 22 nt, Homo sapiens
cuggaaaacagaaaccauucua

SEQ ID NO: 1602014 - RNA, 13 nt, Homo sapiens
cuggaaacauaca

SEQ ID NO: 1602015 - RNA, 17 nt, Homo sapiens
cuggaaagcuauuucag

SEQ ID NO: 1602016 - RNA, 16 nt, Homo sapiens
cuggaaaucauaauaa

SEQ ID NO: 1602017 - RNA, 22 nt, Homo sapiens
cuggaagaucagcacccuaaga

SEQ ID NO: 1602018 - RNA, 12 nt, Homo sapiens
cuggaagaugua

SEQ ID NO: 1602019 - RNA, 22 nt, Homo sapiens
cuggaagccaccucaccaagga

SEQ ID NO: 1602020 - RNA, 17 nt, Homo sapiens
cuggaaggacacaguga

SEQ ID NO: 1602021 - RNA, 22 nt, Homo sapiens
cuggaaggcagcaggcauuugc

SEQ ID NO: 1602022 - RNA, 20 nt, Homo sapiens
cuggaaguuucuggugccau

SEQ ID NO: 1602023 - RNA, 20 nt, Homo sapiens
cuggaauauaaaacagucau

SEQ ID NO: 1602024 - RNA, 15 nt, Homo sapiens
cuggaaugugccaca

SEQ ID NO: 1602025 - RNA, 20 nt, Homo sapiens
cuggaauuauucuaugucaa

SEQ ID NO: 1602026 - RNA, 21 nt, Homo sapiens
cuggaauuauucuaugucaau

SEQ ID NO: 1602027 - RNA, 22 nt, Homo sapiens
cuggaauuauucuaugucaaug

SEQ ID NO: 1602028 - RNA, 13 nt, Homo sapiens
cuggaauugauau

SEQ ID NO: 1602029 - RNA, 17 nt, Homo sapiens
cuggaauugauauugaa

SEQ ID NO: 1602030 - RNA, 17 nt, Homo sapiens
cuggacaaagaauucca

SEQ ID NO: 1602031 - RNA, 23 nt, Homo sapiens
cuggacacacuguuacacgugcc

SEQ ID NO: 1602032 - RNA, 12 nt, Homo sapiens
cuggacaccucu

SEQ ID NO: 1602033 - RNA, 13 nt, Homo sapiens
cuggacaugucaa

SEQ ID NO: 1602034 - RNA, 13 nt, Homo sapiens
cuggacucagggu

SEQ ID NO: 1602035 - RNA, 13 nt, Homo sapiens
cuggacucucagu

SEQ ID NO: 1602036 - RNA, 14 nt, Homo sapiens
cuggagagugcaca

SEQ ID NO: 1602037 - RNA, 12 nt, Homo sapiens
cuggagccucag

SEQ ID NO: 1602038 - RNA, 18 nt, Homo sapiens
cuggagcucaucugcaaa

SEQ ID NO: 1602039 - RNA, 20 nt, Homo sapiens
cuggagggcuggaaucugga

SEQ ID NO: 1602040 - RNA, 22 nt, Homo sapiens
cuggagggguggcccagagcca

SEQ ID NO: 1602041 - RNA, 23 nt, Homo sapiens
cuggagucugucucuuucagugc

SEQ ID NO: 1602042 - RNA, 20 nt, Homo sapiens
cuggagugcaguggugugau

SEQ ID NO: 1602043 - RNA, 16 nt, Homo sapiens
cuggaguguggcugag

SEQ ID NO: 1602044 - RNA, 13 nt, Homo sapiens
cuggaguugcuga

SEQ ID NO: 1602045 - RNA, 19 nt, Homo sapiens
cuggauagaaccaccauag

SEQ ID NO: 1602046 - RNA, 20 nt, Homo sapiens
cuggaucugugaggggcucu

SEQ ID NO: 1602047 - RNA, 13 nt, Homo sapiens
cuggauucauucu

SEQ ID NO: 1602048 - RNA, 18 nt, Homo sapiens
cuggauuucauacuguaa

SEQ ID NO: 1602049 - RNA, 21 nt, Homo sapiens
cuggcaaagaacucauuugaa

SEQ ID NO: 1602050 - RNA, 14 nt, Homo sapiens
cuggcaacacagag

SEQ ID NO: 1602051 - RNA, 13 nt, Homo sapiens
cuggcacuggcaa

SEQ ID NO: 1602052 - RNA, 20 nt, Homo sapiens
cuggcacuuagcccaagagg

SEQ ID NO: 1602053 - RNA, 19 nt, Homo sapiens
cuggcagacucgggaccaa

SEQ ID NO: 1602054 - RNA, 22 nt, Homo sapiens
cuggccaugccuggagacauau

SEQ ID NO: 1602055 - RNA, 18 nt, Homo sapiens
cuggcccaagauuauuca

SEQ ID NO: 1602056 - RNA, 18 nt, Homo sapiens
cuggcccagggccugaaa

SEQ ID NO: 1602057 - RNA, 15 nt, Homo sapiens
cuggccccagacaag

SEQ ID NO: 1602058 - RNA, 22 nt, Homo sapiens
cuggcccccaucagcccugcua

SEQ ID NO: 1602059 - RNA, 19 nt, Homo sapiens
cuggccuccuaugccucau

SEQ ID NO: 1602060 - RNA, 22 nt, Homo sapiens
cuggccuuuauaauuuuacuca

SEQ ID NO: 1602061 - RNA, 15 nt, Homo sapiens
cuggcuggccagucu

SEQ ID NO: 1602062 - RNA, 20 nt, Homo sapiens
cuggcugucaguaugacauu

SEQ ID NO: 1602063 - RNA, 14 nt, Homo sapiens
cuggcuguggacca

SEQ ID NO: 1602064 - RNA, 16 nt, Homo sapiens
cuggcuucugcauuac

SEQ ID NO: 1602065 - RNA, 13 nt, Homo sapiens
cuggcuuugcaag

SEQ ID NO: 1602066 - RNA, 18 nt, Homo sapiens
cugggaagaauguauucg

SEQ ID NO: 1602067 - RNA, 22 nt, Homo sapiens
cugggacacuccgucugcucca

SEQ ID NO: 1602068 - RNA, 14 nt, Homo sapiens
cugggacugugccu

SEQ ID NO: 1602069 - RNA, 19 nt, Homo sapiens
cugggacugugcucagaga

SEQ ID NO: 1602070 - RNA, 16 nt, Homo sapiens
cugggagcagcucugu

SEQ ID NO: 1602071 - RNA, 22 nt, Homo sapiens
cuguguauuuucagucaaaacu

SEQ ID NO: 1602072 - RNA, 22 nt, Homo sapiens
cugugucaccguaucucaggaa

SEQ ID NO: 1602073 - RNA, 19 nt, Homo sapiens
cugugucuccucucagagu

SEQ ID NO: 1602074 - RNA, 15 nt, Homo sapiens
cugugugaaggugaa

SEQ ID NO: 1602075 - RNA, 13 nt, Homo sapiens
cuguguucacaga

SEQ ID NO: 1602076 - RNA, 17 nt, Homo sapiens
cuguguugaagcacugu

SEQ ID NO: 1602077 - RNA, 22 nt, Homo sapiens
cuguuaacuuuuguaccaaaua

SEQ ID NO: 1602078 - RNA, 18 nt, Homo sapiens
cuguuaauaguacuauua

SEQ ID NO: 1602079 - RNA, 20 nt, Homo sapiens
cuguuacacacuaacaucaa

SEQ ID NO: 1602080 - RNA, 12 nt, Homo sapiens
cuguuaccaaau

SEQ ID NO: 1602081 - RNA, 14 nt, Homo sapiens
cuguuaccaaaucu

SEQ ID NO: 1602082 - RNA, 21 nt, Homo sapiens
cuguuaguaaauuucugugau

SEQ ID NO: 1602083 - RNA, 18 nt, Homo sapiens
cuguuaucaaacugcugu

SEQ ID NO: 1602084 - RNA, 14 nt, Homo sapiens
cuguuauugacagc

SEQ ID NO: 1602085 - RNA, 13 nt, Homo sapiens
cuguucacagcca

SEQ ID NO: 1602086 - RNA, 23 nt, Homo sapiens
cuguuccccaaggacucuuccac

SEQ ID NO: 1602087 - RNA, 20 nt, Homo sapiens
cuguucuaaggcugugccau

SEQ ID NO: 1602088 - RNA, 20 nt, Homo sapiens
cuguucuaauggauuauaau

SEQ ID NO: 1602089 - RNA, 23 nt, Homo sapiens
cuguucugaaaggagacauugcu

SEQ ID NO: 1602090 - RNA, 16 nt, Homo sapiens
cuguucuguagcuuau

SEQ ID NO: 1602091 - RNA, 14 nt, Homo sapiens
cuguugaagucuca

SEQ ID NO: 1602092 - RNA, 21 nt, Homo sapiens
cuguugacaaaugacagaucu

SEQ ID NO: 1602093 - RNA, 21 nt, Homo sapiens
cuguugccagugcuuugcaca

SEQ ID NO: 1602094 - RNA, 18 nt, Homo sapiens
cuguugcuuuacaguuac

SEQ ID NO: 1602095 - RNA, 14 nt, Homo sapiens
cuguuggauaauua

SEQ ID NO: 1602096 - RNA, 11 nt, Homo sapiens
cuguugguguu

SEQ ID NO: 1602097 - RNA, 16 nt, Homo sapiens
cuguugguuagauuca

SEQ ID NO: 1602098 - RNA, 17 nt, Homo sapiens
cuguuuaaaguggcaau

SEQ ID NO: 1602099 - RNA, 17 nt, Homo sapiens
cuguuugcguacuugua

SEQ ID NO: 1602100 - RNA, 20 nt, Homo sapiens
cuguuugcguacuuguaaua

SEQ ID NO: 1602101 - RNA, 19 nt, Homo sapiens
cuguuuucucucuguuaca

SEQ ID NO: 1602102 - RNA, 14 nt, Homo sapiens
cuguuuugauagau

SEQ ID NO: 1602103 - RNA, 22 nt, Homo sapiens
cuguuuuguuaauauaccccaa

SEQ ID NO: 1602104 - RNA, 14 nt, Homo sapiens
cuguuuuuucucca

SEQ ID NO: 1602105 - RNA, 14 nt, Homo sapiens
cuuaaaacuaaaug

SEQ ID NO: 1602106 - RNA, 15 nt, Homo sapiens
cuuaaaacuauaaca

SEQ ID NO: 1602107 - RNA, 15 nt, Homo sapiens
cuuaaaaucugugaa

SEQ ID NO: 1602108 - RNA, 16 nt, Homo sapiens
cuuaaacccauacaau

SEQ ID NO: 1602109 - RNA, 20 nt, Homo sapiens
cuuaaacccauacaauguau

SEQ ID NO: 1602110 - RNA, 20 nt, Homo sapiens
cuuaaaccuuaagauacuaa

SEQ ID NO: 1602111 - RNA, 19 nt, Homo sapiens
cuuaaacuaauacgugcca

SEQ ID NO: 1602112 - RNA, 19 nt, Homo sapiens
cuuaaacucuggacacucu

SEQ ID NO: 1602113 - RNA, 14 nt, Homo sapiens
cuuaaacuuuguca

SEQ ID NO: 1602114 - RNA, 20 nt, Homo sapiens
cuuaaacuuugucacuucug

SEQ ID NO: 1602115 - RNA, 12 nt, Homo sapiens
cuuaaagcugcu

SEQ ID NO: 1602116 - RNA, 20 nt, Homo sapiens
cuuaaagggcccaaugaauu

SEQ ID NO: 1602117 - RNA, 22 nt, Homo sapiens
cuuaaagggucuuaugaaacaa

SEQ ID NO: 1602118 - RNA, 23 nt, Homo sapiens
cuuaaauaauaaacaguggaaua

SEQ ID NO: 1602119 - RNA, 19 nt, Homo sapiens
cuuaaaugagaaagcauuu

SEQ ID NO: 1602120 - RNA, 14 nt, Homo sapiens
cuuaacaguuguau

SEQ ID NO: 1602121 - RNA, 23 nt, Homo sapiens
cuuaacauuccuaaaaugcuuca

SEQ ID NO: 1602122 - RNA, 15 nt, Homo sapiens
cuuaaccucagggag

SEQ ID NO: 1602123 - RNA, 20 nt, Homo sapiens
cuuaacuauccuuccagggc

SEQ ID NO: 1602124 - RNA, 20 nt, Homo sapiens
cuuaacuuguuugguaguua

SEQ ID NO: 1602125 - RNA, 22 nt, Homo sapiens
cuuaagcaguaaucugucagug

SEQ ID NO: 1602126 - RNA, 16 nt, Homo sapiens
cuuaauaaacauguca

SEQ ID NO: 1602127 - RNA, 18 nt, Homo sapiens
cuuaauacuaccuugaaa

SEQ ID NO: 1602128 - RNA, 20 nt, Homo sapiens
cuuaauccaauauuuugccu

SEQ ID NO: 1602129 - RNA, 21 nt, Homo sapiens
cuuaauggaagguuggaucca

SEQ ID NO: 1602130 - RNA, 16 nt, Homo sapiens
cuuaauguuucuuaga

SEQ ID NO: 1602131 - RNA, 16 nt, Homo sapiens
cuuaauuaaauaucaa

SEQ ID NO: 1602132 - RNA, 15 nt, Homo sapiens
cuuaauuauuauaaa

SEQ ID NO: 1602133 - RNA, 23 nt, Homo sapiens
cuuaauugaaaugaaaauuuaau

SEQ ID NO: 1602134 - RNA, 20 nt, Homo sapiens
cuuaauuuaauugcuuugaa

SEQ ID NO: 1602135 - RNA, 23 nt, Homo sapiens
cuuaauuuccuuuuugacacuga

SEQ ID NO: 1602136 - RNA, 22 nt, Homo sapiens
cuuacaagaaaggccugaaugg

SEQ ID NO: 1602137 - RNA, 12 nt, Homo sapiens
cuuacacauaau

SEQ ID NO: 1602138 - RNA, 20 nt, Homo sapiens
cuuacguuuuucuggugcuu

SEQ ID NO: 1602139 - RNA, 20 nt, Homo sapiens
cuuacuuuaccucucuguca

SEQ ID NO: 1602140 - RNA, 18 nt, Homo sapiens
cuuagaaaacaaguauug

SEQ ID NO: 1602141 - RNA, 12 nt, Homo sapiens
cuuagaacaaag

SEQ ID NO: 1602142 - RNA, 13 nt, Homo sapiens
cuuagaaugccau

SEQ ID NO: 1602143 - RNA, 22 nt, Homo sapiens
cuuagagccaggcacacacugu

SEQ ID NO: 1602144 - RNA, 23 nt, Homo sapiens
cuuagagcuuuaccuaaauauga

SEQ ID NO: 1602145 - RNA, 22 nt, Homo sapiens
cuuagccauuuuucaaagcaau

SEQ ID NO: 1602146 - RNA, 23 nt, Homo sapiens
cuuagccauuuuucaaagcaauu

SEQ ID NO: 1602147 - RNA, 18 nt, Homo sapiens
cuuagcccaagaggucug

SEQ ID NO: 1602148 - RNA, 16 nt, Homo sapiens
cuuagccccagacucu

SEQ ID NO: 1602149 - RNA, 15 nt, Homo sapiens
cuuagcgucaagaca

SEQ ID NO: 1602150 - RNA, 22 nt, Homo sapiens
cuuagcuauugcucugagaaag

SEQ ID NO: 1602151 - RNA, 13 nt, Homo sapiens
cuuagcugucacc

SEQ ID NO: 1602152 - RNA, 14 nt, Homo sapiens
cuuagcuucaggaa

SEQ ID NO: 1602153 - RNA, 16 nt, Homo sapiens
cuuagcuuuagaaaca

SEQ ID NO: 1602154 - RNA, 16 nt, Homo sapiens
cuuaggaaccuaccag

SEQ ID NO: 1602155 - RNA, 23 nt, Homo sapiens
cuuaggcuuuguaugacagugaa

SEQ ID NO: 1602156 - RNA, 17 nt, Homo sapiens
cuuagggacagucaaaa

SEQ ID NO: 1602157 - RNA, 15 nt, Homo sapiens
cuuagggaugauuaa

SEQ ID NO: 1602158 - RNA, 18 nt, Homo sapiens
cuuaguaaguaauaucaa

SEQ ID NO: 1602159 - RNA, 16 nt, Homo sapiens
cuuaguaaguauuucc

SEQ ID NO: 1602160 - RNA, 14 nt, Homo sapiens
cuuaguagucaaaa

SEQ ID NO: 1602161 - RNA, 17 nt, Homo sapiens
cuuaguuaucaguauuu

SEQ ID NO: 1602162 - RNA, 13 nt, Homo sapiens
cuuaguugcugua

SEQ ID NO: 1602163 - RNA, 18 nt, Homo sapiens
cuuauaauuguucucaga

SEQ ID NO: 1602164 - RNA, 16 nt, Homo sapiens
cuuauacuguacaaua

SEQ ID NO: 1602165 - RNA, 20 nt, Homo sapiens
cuuauagacacuugcuccca

SEQ ID NO: 1602166 - RNA, 19 nt, Homo sapiens
cuuauagaggaacuugaaa

SEQ ID NO: 1602167 - RNA, 14 nt, Homo sapiens
cuuauauucaucca

SEQ ID NO: 1602168 - RNA, 20 nt, Homo sapiens
cuuauauuuaaaacuugccu

SEQ ID NO: 1602169 - RNA, 19 nt, Homo sapiens
cuuaucaacauuuguucca

SEQ ID NO: 1602170 - RNA, 18 nt, Homo sapiens
cuuaucccagugaucacc

SEQ ID NO: 1602171 - RNA, 18 nt, Homo sapiens
cuuauccccucagaaucc

SEQ ID NO: 1602172 - RNA, 20 nt, Homo sapiens
cuuaugaugaaaauuuacaa

SEQ ID NO: 1602173 - RNA, 18 nt, Homo sapiens
gcaaggggcuggggccag

SEQ ID NO: 1602174 - RNA, 19 nt, Homo sapiens
gcaaggucauagacaauuc

SEQ ID NO: 1602175 - RNA, 16 nt, Homo sapiens
gcaagguuuggugcaa

SEQ ID NO: 1602176 - RNA, 14 nt, Homo sapiens
gcaagucacuggcc

SEQ ID NO: 1602177 - RNA, 16 nt, Homo sapiens
gcaauaaaguuauuca

SEQ ID NO: 1602178 - RNA, 18 nt, Homo sapiens
gcaauaucuacguguuuu

SEQ ID NO: 1602179 - RNA, 20 nt, Homo sapiens
gcaauaugggaggaacaaag

SEQ ID NO: 1602180 - RNA, 18 nt, Homo sapiens
gcaauccaccugccuugg

SEQ ID NO: 1602181 - RNA, 20 nt, Homo sapiens
gcaauggaagcccucaaaga

SEQ ID NO: 1602182 - RNA, 16 nt, Homo sapiens
gcaauuaggcagauca

SEQ ID NO: 1602183 - RNA, 14 nt, Homo sapiens
gcaauuugcaagga

SEQ ID NO: 1602184 - RNA, 14 nt, Homo sapiens
gcacaaaacuacuu

SEQ ID NO: 1602185 - RNA, 20 nt, Homo sapiens
gcacaaacauguguguacau

SEQ ID NO: 1602186 - RNA, 20 nt, Homo sapiens
gcacaaagauggauguaaug

SEQ ID NO: 1602187 - RNA, 15 nt, Homo sapiens
gcacaagccagaccc

SEQ ID NO: 1602188 - RNA, 13 nt, Homo sapiens
gcacaagugucug

SEQ ID NO: 1602189 - RNA, 22 nt, Homo sapiens
gcacaauauuccuaugcugcaa

SEQ ID NO: 1602190 - RNA, 12 nt, Homo sapiens
gcacacacugug

SEQ ID NO: 1602191 - RNA, 19 nt, Homo sapiens
gcacacagcugagcacuua

SEQ ID NO: 1602192 - RNA, 23 nt, Homo sapiens
gcacaccccuggggcugagucuc

SEQ ID NO: 1602193 - RNA, 17 nt, Homo sapiens
gcacacucuucucuuga

SEQ ID NO: 1602194 - RNA, 14 nt, Homo sapiens
cccuuggugcgagg

SEQ ID NO: 1602195 - RNA, 13 nt, Homo sapiens
cccuuucauacaa

SEQ ID NO: 1602196 - RNA, 22 nt, Homo sapiens
cccuuugggcccagggacacca

SEQ ID NO: 1602197 - RNA, 18 nt, Homo sapiens
ccgaaggguuuugcuaca

SEQ ID NO: 1602198 - RNA, 20 nt, Homo sapiens
ccgaagucuuuuguucgcau

SEQ ID NO: 1602199 - RNA, 16 nt, Homo sapiens
ccgacccacugaccca

SEQ ID NO: 1602200 - RNA, 18 nt, Homo sapiens
ccgaccucaggugaucca

SEQ ID NO: 1602201 - RNA, 22 nt, Homo sapiens
ccgacuuuuguuuaccagagaa

SEQ ID NO: 1602202 - RNA, 20 nt, Homo sapiens
ccgagagccuuauuuaccua

SEQ ID NO: 1602203 - RNA, 21 nt, Homo sapiens
ccgagcgggugcaagcacucg

SEQ ID NO: 1602204 - RNA, 15 nt, Homo sapiens
ccgaggggagggcag

SEQ ID NO: 1602205 - RNA, 15 nt, Homo sapiens
ccgagguaggggugg

SEQ ID NO: 1602206 - RNA, 21 nt, Homo sapiens
ccgaggugggcagaucacuug

SEQ ID NO: 1602207 - RNA, 21 nt, Homo sapiens
ccgagucagacuuuguguuca

SEQ ID NO: 1602208 - RNA, 13 nt, Homo sapiens
ccgagugcacugc

SEQ ID NO: 1602209 - RNA, 12 nt, Homo sapiens
ccgauaccaugc

SEQ ID NO: 1602210 - RNA, 14 nt, Homo sapiens
ccgcaaagacauca

SEQ ID NO: 1602211 - RNA, 17 nt, Homo sapiens
ccgcaggugcugguccc

SEQ ID NO: 1602212 - RNA, 13 nt, Homo sapiens
ccgcaucaccuca

SEQ ID NO: 1602213 - RNA, 17 nt, Homo sapiens
ccgcauuggugacucac

SEQ ID NO: 1602214 - RNA, 20 nt, Homo sapiens
ccgccaacacgccuggcuaa

SEQ ID NO: 1602215 - RNA, 21 nt, Homo sapiens
ccgccauugccaccaggagaa

SEQ ID NO: 1602216 - RNA, 17 nt, Homo sapiens
ccgcccuccacaccucu

SEQ ID NO: 1602217 - RNA, 20 nt, Homo sapiens
ccgccugcccagacugauga

SEQ ID NO: 1602218 - RNA, 14 nt, Homo sapiens
ccgccuuugcuuuu

SEQ ID NO: 1602219 - RNA, 21 nt, Homo sapiens
ccggcgaggguaugucagugu

SEQ ID NO: 1602220 - RNA, 16 nt, Homo sapiens
ccggcucuguggguga

SEQ ID NO: 1602221 - RNA, 16 nt, Homo sapiens
ccgggagacucaaagg

SEQ ID NO: 1602222 - RNA, 21 nt, Homo sapiens
ccgggcgugguggcacaugcc

SEQ ID NO: 1602223 - RNA, 22 nt, Homo sapiens
ccggggcauuugggcacuguag

SEQ ID NO: 1602224 - RNA, 13 nt, Homo sapiens
ccggggugggugu

SEQ ID NO: 1602225 - RNA, 17 nt, Homo sapiens
ccgggucccugagcucc

SEQ ID NO: 1602226 - RNA, 15 nt, Homo sapiens
ccguaaagugccuua

SEQ ID NO: 1602227 - RNA, 16 nt, Homo sapiens
ccguaucacaguguuu

SEQ ID NO: 1602228 - RNA, 12 nt, Homo sapiens
ccgucucaaaaa

SEQ ID NO: 1602229 - RNA, 22 nt, Homo sapiens
ccgucucuacuaaaaauacaaa

SEQ ID NO: 1602230 - RNA, 14 nt, Homo sapiens
ccgucucuuuaaaa

SEQ ID NO: 1602231 - RNA, 21 nt, Homo sapiens
ccgucuucucccuauucccuc

SEQ ID NO: 1602232 - RNA, 14 nt, Homo sapiens
ccgugccugggaga

SEQ ID NO: 1602233 - RNA, 16 nt, Homo sapiens
ccgugcuuaaccaaag

SEQ ID NO: 1602234 - RNA, 18 nt, Homo sapiens
ccguggggggaagcacau

SEQ ID NO: 1602235 - RNA, 23 nt, Homo sapiens
ccguuuucauuguucacuucuaa

SEQ ID NO: 1602236 - RNA, 14 nt, Homo sapiens
ccuaaaaaacacug

SEQ ID NO: 1602237 - RNA, 16 nt, Homo sapiens
ccuaaaaaacacuggc

SEQ ID NO: 1602238 - RNA, 14 nt, Homo sapiens
ccuaaaacacuugc

SEQ ID NO: 1602239 - RNA, 17 nt, Homo sapiens
ccuaaacaucauucauu

SEQ ID NO: 1602240 - RNA, 22 nt, Homo sapiens
ccuaaagaaugcaaccuaguca

SEQ ID NO: 1602241 - RNA, 19 nt, Homo sapiens
ccuaaagacuaacuugaaa

SEQ ID NO: 1602242 - RNA, 15 nt, Homo sapiens
ccuaaagacuguaua

SEQ ID NO: 1602243 - RNA, 20 nt, Homo sapiens
ccuaaagaggaaaagugcaa

SEQ ID NO: 1602244 - RNA, 16 nt, Homo sapiens
ccuaaaggacuauuau

SEQ ID NO: 1602245 - RNA, 13 nt, Homo sapiens
ccuaaaggacucu

SEQ ID NO: 1602246 - RNA, 14 nt, Homo sapiens
ccuaaagucucugc

SEQ ID NO: 1602247 - RNA, 16 nt, Homo sapiens
ccuaaauuucugccaa

SEQ ID NO: 1602248 - RNA, 16 nt, Homo sapiens
ccuaaggaaccuuccu

SEQ ID NO: 1602249 - RNA, 13 nt, Homo sapiens
ccuaaucauacac

SEQ ID NO: 1602250 - RNA, 18 nt, Homo sapiens
ccuaaugugaucauauga

SEQ ID NO: 1602251 - RNA, 16 nt, Homo sapiens
ccuaauguguuuagau

SEQ ID NO: 1602252 - RNA, 18 nt, Homo sapiens
ccuacagcacuacugggu

SEQ ID NO: 1602253 - RNA, 19 nt, Homo sapiens
ccuacagcacuacugggug

SEQ ID NO: 1602254 - RNA, 16 nt, Homo sapiens
ccuacaggcagucucu

SEQ ID NO: 1602255 - RNA, 21 nt, Homo sapiens
ccuacagggacacuaucacuc

SEQ ID NO: 1602256 - RNA, 13 nt, Homo sapiens
ccuacauuaucuc

SEQ ID NO: 1602257 - RNA, 15 nt, Homo sapiens
ccuacauuaucucac

SEQ ID NO: 1602258 - RNA, 20 nt, Homo sapiens
ccuacauuaucucacuuagu

SEQ ID NO: 1602259 - RNA, 23 nt, Homo sapiens
ccuacauugugcugcaccugguc

SEQ ID NO: 1602260 - RNA, 15 nt, Homo sapiens
ccuaccaacuuuacu

SEQ ID NO: 1602261 - RNA, 15 nt, Homo sapiens
ccuaccaggacagaa

SEQ ID NO: 1602262 - RNA, 23 nt, Homo sapiens
ccuaccaguuggccaugaugucu

SEQ ID NO: 1602263 - RNA, 15 nt, Homo sapiens
ccuacccuaaccaag

SEQ ID NO: 1602264 - RNA, 16 nt, Homo sapiens
ccuacgacuaucugga

SEQ ID NO: 1602265 - RNA, 13 nt, Homo sapiens
ccuacugagacag

SEQ ID NO: 1602266 - RNA, 23 nt, Homo sapiens
ccuagaagggcuagaaccuggag

SEQ ID NO: 1602267 - RNA, 17 nt, Homo sapiens
ccuagaaguucuuugau

SEQ ID NO: 1602268 - RNA, 14 nt, Homo sapiens
ccuagaauguuuca

SEQ ID NO: 1602269 - RNA, 12 nt, Homo sapiens
ccuagacuguua

SEQ ID NO: 1602270 - RNA, 22 nt, Homo sapiens
ccuagagaaggcugugagccaa

SEQ ID NO: 1602271 - RNA, 15 nt, Homo sapiens
ccuagagcuagaugu

SEQ ID NO: 1602272 - RNA, 17 nt, Homo sapiens
ccuagagcuagaugugu

SEQ ID NO: 1602273 - RNA, 22 nt, Homo sapiens
ccuagagucggccaccacagau

SEQ ID NO: 1602274 - RNA, 17 nt, Homo sapiens
ccuagcaauacagggag

SEQ ID NO: 1602275 - RNA, 14 nt, Homo sapiens
ccuagcacuuuaua

SEQ ID NO: 1602276 - RNA, 17 nt, Homo sapiens
ccuagcaggcuguucca

SEQ ID NO: 1602277 - RNA, 17 nt, Homo sapiens
ccuagcucuuacacaua

SEQ ID NO: 1602278 - RNA, 17 nt, Homo sapiens
ccuagcugcacagggca

SEQ ID NO: 1602279 - RNA, 21 nt, Homo sapiens
ccuaggacuuaaaauuagucu

SEQ ID NO: 1602280 - RNA, 17 nt, Homo sapiens
ccuaggggaagagcaga

SEQ ID NO: 1602281 - RNA, 19 nt, Homo sapiens
ccuagugcaaaaacuguaa

SEQ ID NO: 1602282 - RNA, 18 nt, Homo sapiens
ccuauagcacugagcuca

SEQ ID NO: 1602283 - RNA, 15 nt, Homo sapiens
ccuauaguaucuuuu

SEQ ID NO: 1602284 - RNA, 20 nt, Homo sapiens
ccuaucagaguugcugcaaa

SEQ ID NO: 1602285 - RNA, 14 nt, Homo sapiens
ccuaucauguuaac

SEQ ID NO: 1602286 - RNA, 19 nt, Homo sapiens
ccuaucccagagaccuuga

SEQ ID NO: 1602287 - RNA, 20 nt, Homo sapiens
ccuaucugaccaaacuggau

SEQ ID NO: 1602288 - RNA, 16 nt, Homo sapiens
ccuaucuuccuuccuc

SEQ ID NO: 1602289 - RNA, 12 nt, Homo sapiens
ccuaugcacuga

SEQ ID NO: 1602290 - RNA, 13 nt, Homo sapiens
ccuaugcacugaa

SEQ ID NO: 1602291 - RNA, 17 nt, Homo sapiens
ccuaugcuauugacaau

SEQ ID NO: 1602292 - RNA, 14 nt, Homo sapiens
ccuauguaugccau

SEQ ID NO: 1602293 - RNA, 16 nt, Homo sapiens
ccuauuuaaagaccug

SEQ ID NO: 1602294 - RNA, 15 nt, Homo sapiens
ccuauuuucauuccu

SEQ ID NO: 1602295 - RNA, 19 nt, Homo sapiens
ccuauuuuuguaaacugga

SEQ ID NO: 1602296 - RNA, 15 nt, Homo sapiens
ccucaaacaggaugg

SEQ ID NO: 1602297 - RNA, 22 nt, Homo sapiens
ccucaaagaagucggaauguca

SEQ ID NO: 1602298 - RNA, 16 nt, Homo sapiens
ccucaaagaggccuua

SEQ ID NO: 1602299 - RNA, 16 nt, Homo sapiens
ccucaaauacaugcac

SEQ ID NO: 1602300 - RNA, 22 nt, Homo sapiens
ccucaacauugcauggugcuag

SEQ ID NO: 1602301 - RNA, 18 nt, Homo sapiens
ccucaccugguugaccca

SEQ ID NO: 1602302 - RNA, 13 nt, Homo sapiens
ccucacuggggca

SEQ ID NO: 1602303 - RNA, 18 nt, Homo sapiens
ccaguggaucauaagaca

SEQ ID NO: 1602304 - RNA, 18 nt, Homo sapiens
ccagugggcugaugcugg

SEQ ID NO: 1602305 - RNA, 18 nt, Homo sapiens
ccagugguacuaagcaca

SEQ ID NO: 1602306 - RNA, 22 nt, Homo sapiens
ccaguuccucuuuugugcugcu

SEQ ID NO: 1602307 - RNA, 14 nt, Homo sapiens
ccaguucuacugac

SEQ ID NO: 1602308 - RNA, 13 nt, Homo sapiens
ccaguugccucca

SEQ ID NO: 1602309 - RNA, 16 nt, Homo sapiens
ccauaagcuacacaga

SEQ ID NO: 1602310 - RNA, 22 nt, Homo sapiens
cacccugagcucggggacaggu

SEQ ID NO: 1602311 - RNA, 14 nt, Homo sapiens
cacccugaucuuca

SEQ ID NO: 1602312 - RNA, 18 nt, Homo sapiens
cacccuggagagugcaca

SEQ ID NO: 1602313 - RNA, 18 nt, Homo sapiens
agucuuugaacugcagca

SEQ ID NO: 1602314 - RNA, 13 nt, Homo sapiens
agugaaacaugua

SEQ ID NO: 1602315 - RNA, 17 nt, Homo sapiens
agugaaacuccgucuca

SEQ ID NO: 1602316 - RNA, 16 nt, Homo sapiens
agugaaauacuguaca

SEQ ID NO: 1602317 - RNA, 19 nt, Homo sapiens
agugaacaaauuuacagag

SEQ ID NO: 1602318 - RNA, 14 nt, Homo sapiens
auaaaacagucaug

SEQ ID NO: 1602319 - RNA, 17 nt, Homo sapiens
auaaaacaucacuauca

SEQ ID NO: 1602320 - RNA, 13 nt, Homo sapiens
auaaaacauuaau

SEQ ID NO: 1602321 - RNA, 13 nt, Homo sapiens
auaaaacggugcu

SEQ ID NO: 1602322 - RNA, 13 nt, Homo sapiens
auaaaacuaugug

SEQ ID NO: 1602323 - RNA, 18 nt, Homo sapiens
auaaaaguguucauuguu

SEQ ID NO: 1602324 - RNA, 16 nt, Homo sapiens
auaaaaguuggcucag

SEQ ID NO: 1602325 - RNA, 20 nt, Homo sapiens
auaaaauaaguggauuuugu

SEQ ID NO: 1602326 - RNA, 17 nt, Homo sapiens
auaaaauagaaacauuu

SEQ ID NO: 1602327 - RNA, 18 nt, Homo sapiens
auaaaauauuauugaacu

SEQ ID NO: 1602328 - RNA, 14 nt, Homo sapiens
auaaaaucuggcca

SEQ ID NO: 1602329 - RNA, 22 nt, Homo sapiens
auaaaauggaauaacauaucaa

SEQ ID NO: 1602330 - RNA, 16 nt, Homo sapiens
auaaaauucauuaguu

SEQ ID NO: 1602331 - RNA, 14 nt, Homo sapiens
auaaaauucuguaa

SEQ ID NO: 1602332 - RNA, 23 nt, Homo sapiens
auaaaauugcaguuucauguaug

SEQ ID NO: 1602333 - RNA, 14 nt, Homo sapiens
auaaacacugugua

SEQ ID NO: 1602334 - RNA, 16 nt, Homo sapiens
auaaacauaucaaugu

SEQ ID NO: 1602335 - RNA, 12 nt, Homo sapiens
auaaacauugag

SEQ ID NO: 1602336 - RNA, 17 nt, Homo sapiens
auaaaccaaaaacauuu

SEQ ID NO: 1602337 - RNA, 15 nt, Homo sapiens
auaaaccugaccucc

SEQ ID NO: 1602338 - RNA, 19 nt, Homo sapiens
auaaacuauuuauaucaca

SEQ ID NO: 1602339 - RNA, 17 nt, Homo sapiens
auaaacugaagagcuua

SEQ ID NO: 1602340 - RNA, 18 nt, Homo sapiens
auaaacugaauuuguacu

SEQ ID NO: 1602341 - RNA, 18 nt, Homo sapiens
auaaacugacuaaacuua

SEQ ID NO: 1602342 - RNA, 20 nt, Homo sapiens
auaaacugugccaauacaga

SEQ ID NO: 1602343 - RNA, 17 nt, Homo sapiens
auaaagagacagugaua

SEQ ID NO: 1602344 - RNA, 14 nt, Homo sapiens
auaaagauacauga

SEQ ID NO: 1602345 - RNA, 16 nt, Homo sapiens
auaaagauacaugauu

SEQ ID NO: 1602346 - RNA, 12 nt, Homo sapiens
auaaagcugucu

SEQ ID NO: 1602347 - RNA, 22 nt, Homo sapiens
auaaaggcagcugccucugcuc

SEQ ID NO: 1602348 - RNA, 20 nt, Homo sapiens
auaaaggcauuucaaagucu

SEQ ID NO: 1602349 - RNA, 13 nt, Homo sapiens
auaaagugaaugu

SEQ ID NO: 1602350 - RNA, 13 nt, Homo sapiens
auaaauaagcaaa

SEQ ID NO: 1602351 - RNA, 14 nt, Homo sapiens
auaaauaugucaga

SEQ ID NO: 1602352 - RNA, 22 nt, Homo sapiens
auaaauccauccauccaaaggc

SEQ ID NO: 1602353 - RNA, 22 nt, Homo sapiens
auaaaucucuucuuugcugcag

SEQ ID NO: 1602354 - RNA, 13 nt, Homo sapiens
auaaaugacuguu

SEQ ID NO: 1602355 - RNA, 20 nt, Homo sapiens
auaaaugauuaaaaaaucag

SEQ ID NO: 1602356 - RNA, 19 nt, Homo sapiens
auaaauuaugaauauuaaa

SEQ ID NO: 1602357 - RNA, 22 nt, Homo sapiens
auaaauuuaaaaaucaucuuau

SEQ ID NO: 1602358 - RNA, 16 nt, Homo sapiens
auaaauuugcacuguu

SEQ ID NO: 1602359 - RNA, 20 nt, Homo sapiens
auaaauuuggacugucuaua

SEQ ID NO: 1602360 - RNA, 18 nt, Homo sapiens
auaaauuuuacaguagaa

SEQ ID NO: 1602361 - RNA, 15 nt, Homo sapiens
auaacaaaagcaaua

SEQ ID NO: 1602362 - RNA, 23 nt, Homo sapiens
auaacagaugugaaaauauacuu

SEQ ID NO: 1602363 - RNA, 11 nt, Homo sapiens
auaacagcuaa

SEQ ID NO: 1602364 - RNA, 17 nt, Homo sapiens
auaacauuuaaauucca

SEQ ID NO: 1602365 - RNA, 14 nt, Homo sapiens
auaacuauacuuga

SEQ ID NO: 1602366 - RNA, 17 nt, Homo sapiens
auaacucugcacuacuc

SEQ ID NO: 1602367 - RNA, 18 nt, Homo sapiens
auaacugaaaaugugcua

SEQ ID NO: 1602368 - RNA, 16 nt, Homo sapiens
auaacuuuacagaaau

SEQ ID NO: 1602369 - RNA, 21 nt, Homo sapiens
auaacuuuuuuuuaaguuaca

SEQ ID NO: 1602370 - RNA, 18 nt, Homo sapiens
auaagaaagaucaaagac

SEQ ID NO: 1602371 - RNA, 14 nt, Homo sapiens
auaagacuacugaa

SEQ ID NO: 1602372 - RNA, 21 nt, Homo sapiens
auaagacuacugaaucugcua

SEQ ID NO: 1602373 - RNA, 13 nt, Homo sapiens
auaagauuccaaa

SEQ ID NO: 1602374 - RNA, 14 nt, Homo sapiens
auaagauuccaaaa

SEQ ID NO: 1602375 - RNA, 11 nt, Homo sapiens
auaagcacucc

SEQ ID NO: 1602376 - RNA, 23 nt, Homo sapiens
auaagcagaacauacuguucuca

SEQ ID NO: 1602377 - RNA, 20 nt, Homo sapiens
auaagcagucauccucagau

SEQ ID NO: 1602378 - RNA, 14 nt, Homo sapiens
auaagcaugguguc

SEQ ID NO: 1602379 - RNA, 13 nt, Homo sapiens
auaagccacuucc

SEQ ID NO: 1602380 - RNA, 20 nt, Homo sapiens
auaagccacuuccccacaaa

SEQ ID NO: 1602381 - RNA, 13 nt, Homo sapiens
auaaggcccagag

SEQ ID NO: 1602382 - RNA, 18 nt, Homo sapiens
auaagggaauccugagaa

SEQ ID NO: 1602383 - RNA, 14 nt, Homo sapiens
auaaguaauaucuu

SEQ ID NO: 1602384 - RNA, 14 nt, Homo sapiens
auaaguagcauuca

SEQ ID NO: 1602385 - RNA, 17 nt, Homo sapiens
auaaguaucacacugua

SEQ ID NO: 1602386 - RNA, 22 nt, Homo sapiens
auaagucugggcacuggaugca

SEQ ID NO: 1602387 - RNA, 19 nt, Homo sapiens
auaaguuauugcaguuuau

SEQ ID NO: 1602388 - RNA, 17 nt, Homo sapiens
auaauaaaaagcuucag

SEQ ID NO: 1602389 - RNA, 21 nt, Homo sapiens
auaauaaaaagcuucagggaa

SEQ ID NO: 1602390 - RNA, 18 nt, Homo sapiens
auaauaaaggcauuucaa

SEQ ID NO: 1602391 - RNA, 15 nt, Homo sapiens
auaauaaauacucag

SEQ ID NO: 1602392 - RNA, 16 nt, Homo sapiens
auaauagagauaaguc

SEQ ID NO: 1602393 - RNA, 19 nt, Homo sapiens
auaauaguacuauuacuau

SEQ ID NO: 1602394 - RNA, 17 nt, Homo sapiens
auaauaugaaaaucucc

SEQ ID NO: 1602395 - RNA, 19 nt, Homo sapiens
auaauauuucaagugccua

SEQ ID NO: 1602396 - RNA, 19 nt, Homo sapiens
auaauauuuuacauacacu

SEQ ID NO: 1602397 - RNA, 17 nt, Homo sapiens
auaauauuuuucuuaga

SEQ ID NO: 1602398 - RNA, 17 nt, Homo sapiens
auaaucaagggcacugu

SEQ ID NO: 1602399 - RNA, 16 nt, Homo sapiens
auaaucuuaaacaauu

SEQ ID NO: 1602400 - RNA, 14 nt, Homo sapiens
auaaugcaguaugg

SEQ ID NO: 1602401 - RNA, 16 nt, Homo sapiens
auaaugccaccaaagg

SEQ ID NO: 1602402 - RNA, 17 nt, Homo sapiens
auaaugcuguugccuca

SEQ ID NO: 1602403 - RNA, 22 nt, Homo sapiens
auaaugugaaugcuauguucug

SEQ ID NO: 1602404 - RNA, 18 nt, Homo sapiens
auaauuccuacagcacua

SEQ ID NO: 1602405 - RNA, 19 nt, Homo sapiens
auaauugcuuugccaaaau

SEQ ID NO: 1602406 - RNA, 19 nt, Homo sapiens
auaauuggagaagauuuau

SEQ ID NO: 1602407 - RNA, 23 nt, Homo sapiens
auaauuuuacucacucacucuga

SEQ ID NO: 1602408 - RNA, 17 nt, Homo sapiens
auacaaaaaaaauuuag

SEQ ID NO: 1602409 - RNA, 21 nt, Homo sapiens
auacaaaauaaagaucacaca

SEQ ID NO: 1602410 - RNA, 14 nt, Homo sapiens
auacaaaauauuua

SEQ ID NO: 1602411 - RNA, 23 nt, Homo sapiens
auacaaaucauccauccuugcca

SEQ ID NO: 1602412 - RNA, 16 nt, Homo sapiens
auacaaauucuacuuu

SEQ ID NO: 1602413 - RNA, 18 nt, Homo sapiens
auacaacagaaaccagaa

SEQ ID NO: 1602414 - RNA, 12 nt, Homo sapiens
auacaaccagcc

SEQ ID NO: 1602415 - RNA, 22 nt, Homo sapiens
auacaaccuaacuuauggacug

SEQ ID NO: 1602416 - RNA, 14 nt, Homo sapiens
auacaauauaacac

SEQ ID NO: 1602417 - RNA, 13 nt, Homo sapiens
auacaaugauccu

SEQ ID NO: 1602418 - RNA, 22 nt, Homo sapiens
auacacaaggacccuucaggug

SEQ ID NO: 1602419 - RNA, 20 nt, Homo sapiens
auacacaugguaacauugac

SEQ ID NO: 1602420 - RNA, 19 nt, Homo sapiens
auacagagguaacuaucaa

SEQ ID NO: 1602421 - RNA, 22 nt, Homo sapiens
auacagcccugacgcaaugaaa

SEQ ID NO: 1602422 - RNA, 18 nt, Homo sapiens
auacaggaggcagacaau

SEQ ID NO: 1602423 - RNA, 23 nt, Homo sapiens
auacaguauaccuggcaauucac

SEQ ID NO: 1602424 - RNA, 23 nt, Homo sapiens
auacauauaugaguugccuauau

SEQ ID NO: 1602425 - RNA, 14 nt, Homo sapiens
auacauauguagcu

SEQ ID NO: 1602426 - RNA, 23 nt, Homo sapiens
auacaugcaacagaagugacuuc

SEQ ID NO: 1602427 - RNA, 23 nt, Homo sapiens
auacauggaaucgaaguguuuau

SEQ ID NO: 1602428 - RNA, 23 nt, Homo sapiens
auaccaaaguguuuggucauuuu

SEQ ID NO: 1602429 - RNA, 14 nt, Homo sapiens
auaccaaguugaua

SEQ ID NO: 1602430 - RNA, 22 nt, Homo sapiens
auaccauguacauaauucuugc

SEQ ID NO: 1602431 - RNA, 16 nt, Homo sapiens
auaccauuguccccaa

SEQ ID NO: 1602432 - RNA, 18 nt, Homo sapiens
auaccccaagacucccau

SEQ ID NO: 1602433 - RNA, 15 nt, Homo sapiens
aggugugcucugagc

SEQ ID NO: 1602434 - RNA, 23 nt, Homo sapiens
agguguucuucauuaccucagug

SEQ ID NO: 1602435 - RNA, 18 nt, Homo sapiens
agguuaaagcuaaacuga

SEQ ID NO: 1602436 - RNA, 14 nt, Homo sapiens
agguucagccugaa

SEQ ID NO: 1602437 - RNA, 14 nt, Homo sapiens
agguugaagccaag

SEQ ID NO: 1602438 - RNA, 17 nt, Homo sapiens
agguugagcaauuuccc

SEQ ID NO: 1602439 - RNA, 13 nt, Homo sapiens
agguugagggcaa

SEQ ID NO: 1602440 - RNA, 19 nt, Homo sapiens
agguugggcuggugcucac

SEQ ID NO: 1602441 - RNA, 19 nt, Homo sapiens
agguugggcuuccaugccu

SEQ ID NO: 1602442 - RNA, 22 nt, Homo sapiens
agguugugaugauagcacuggu

SEQ ID NO: 1602443 - RNA, 15 nt, Homo sapiens
aguaaaaagacauuu

SEQ ID NO: 1602444 - RNA, 18 nt, Homo sapiens
aguaaaaccacagcaguu

SEQ ID NO: 1602445 - RNA, 20 nt, Homo sapiens
aguaaaacuccgagugaacu

SEQ ID NO: 1602446 - RNA, 21 nt, Homo sapiens
aguaaagaguacacucagcca

SEQ ID NO: 1602447 - RNA, 19 nt, Homo sapiens
aguaaagguuaauuaugau

SEQ ID NO: 1602448 - RNA, 19 nt, Homo sapiens
aguaaauaaacaagucaaa

SEQ ID NO: 1602449 - RNA, 14 nt, Homo sapiens
aguaaauuaggcag

SEQ ID NO: 1602450 - RNA, 15 nt, Homo sapiens
aguaacauguguuaa

SEQ ID NO: 1602451 - RNA, 19 nt, Homo sapiens
aguaacgagaagugcuuua

SEQ ID NO: 1602452 - RNA, 14 nt, Homo sapiens
aguaaguaaagugg

SEQ ID NO: 1602453 - RNA, 14 nt, Homo sapiens
aguaaguaauauca

SEQ ID NO: 1602454 - RNA, 20 nt, Homo sapiens
aguaaguuaauguauauaaa

SEQ ID NO: 1602455 - RNA, 18 nt, Homo sapiens
aguaauaaauuaaaccaa

SEQ ID NO: 1602456 - RNA, 13 nt, Homo sapiens
aguaauaagcaug

SEQ ID NO: 1602457 - RNA, 17 nt, Homo sapiens
aguaauacaucaaagag

SEQ ID NO: 1602458 - RNA, 19 nt, Homo sapiens
aguaauauagcugagacua

SEQ ID NO: 1602459 - RNA, 16 nt, Homo sapiens
aguaaugccacacauu

SEQ ID NO: 1602460 - RNA, 21 nt, Homo sapiens
aguaaugccacacauugugcu

SEQ ID NO: 1602461 - RNA, 20 nt, Homo sapiens
aguaauucuucugccucagc

SEQ ID NO: 1602462 - RNA, 20 nt, Homo sapiens
aguaauuuauauagauguca

SEQ ID NO: 1602463 - RNA, 16 nt, Homo sapiens
aguaauuucaguguaa

SEQ ID NO: 1602464 - RNA, 15 nt, Homo sapiens
aguacacagauaccu

SEQ ID NO: 1602465 - RNA, 15 nt, Homo sapiens
aguaccaaugcucuu

SEQ ID NO: 1602466 - RNA, 17 nt, Homo sapiens
aguaccaccaagggauc

SEQ ID NO: 1602467 - RNA, 21 nt, Homo sapiens
aguacccacucuggagcauuu

SEQ ID NO: 1602468 - RNA, 17 nt, Homo sapiens
aguaccuucaauacuua

SEQ ID NO: 1602469 - RNA, 19 nt, Homo sapiens
aguacugucuaucaaaggu

SEQ ID NO: 1602470 - RNA, 22 nt, Homo sapiens
aguacuguugguuaaaugacaa

SEQ ID NO: 1602471 - RNA, 20 nt, Homo sapiens
aguacuuccucccagcauug

SEQ ID NO: 1602472 - RNA, 19 nt, Homo sapiens
aguacuuccuggacaagau

SEQ ID NO: 1602473 - RNA, 13 nt, Homo sapiens
aguagaaagcuaa

SEQ ID NO: 1602474 - RNA, 15 nt, Homo sapiens
aguagaaagcuaaag

SEQ ID NO: 1602475 - RNA, 17 nt, Homo sapiens
aguagcugcccuuccug

SEQ ID NO: 1602476 - RNA, 18 nt, Homo sapiens
aguaggacaaacgggcuc

SEQ ID NO: 1602477 - RNA, 22 nt, Homo sapiens
aguaggcaucaguaugucacuc

SEQ ID NO: 1602478 - RNA, 17 nt, Homo sapiens
aguaguacuucuucugu

SEQ ID NO: 1602479 - RNA, 16 nt, Homo sapiens
aguaguauuaccaccc

SEQ ID NO: 1602480 - RNA, 15 nt, Homo sapiens
aguagucaucaaugc

SEQ ID NO: 1602481 - RNA, 18 nt, Homo sapiens
aguauaagcaucugccau

SEQ ID NO: 1602482 - RNA, 14 nt, Homo sapiens
aguauaaucuuuuc

SEQ ID NO: 1602483 - RNA, 17 nt, Homo sapiens
aguauaauguuuauuaa

SEQ ID NO: 1602484 - RNA, 14 nt, Homo sapiens
aguauacaaaaaga

SEQ ID NO: 1602485 - RNA, 15 nt, Homo sapiens
aguauauaggugcug

SEQ ID NO: 1602486 - RNA, 18 nt, Homo sapiens
aguauauauaucauagca

SEQ ID NO: 1602487 - RNA, 16 nt, Homo sapiens
aguaucacacuguaua

SEQ ID NO: 1602488 - RNA, 12 nt, Homo sapiens
aguauccacaau

SEQ ID NO: 1602489 - RNA, 16 nt, Homo sapiens
aguauccaggcuuugu

SEQ ID NO: 1602490 - RNA, 15 nt, Homo sapiens
aguauccaugcucuu

SEQ ID NO: 1602491 - RNA, 15 nt, Homo sapiens
aguauguggaagugu

SEQ ID NO: 1602492 - RNA, 19 nt, Homo sapiens
aguauucaggcacugagaa

SEQ ID NO: 1602493 - RNA, 17 nt, Homo sapiens
aguauugucgguuaccu

SEQ ID NO: 1602494 - RNA, 21 nt, Homo sapiens
aguauuuaacuacaucugccu

SEQ ID NO: 1602495 - RNA, 16 nt, Homo sapiens
aguauuuagaagccaa

SEQ ID NO: 1602496 - RNA, 20 nt, Homo sapiens
aguauuuagaagccaacuau

SEQ ID NO: 1602497 - RNA, 18 nt, Homo sapiens
aguauuucagcugcaaua

SEQ ID NO: 1602498 - RNA, 15 nt, Homo sapiens
aguauuuuucuugac

SEQ ID NO: 1602499 - RNA, 15 nt, Homo sapiens
aguauuuuuucaagu

SEQ ID NO: 1602500 - RNA, 14 nt, Homo sapiens
agucaauguacuug

SEQ ID NO: 1602501 - RNA, 22 nt, Homo sapiens
agucacaaugaguuugggcaua

SEQ ID NO: 1602502 - RNA, 12 nt, Homo sapiens
agucaccaaaua

SEQ ID NO: 1602503 - RNA, 14 nt, Homo sapiens
agucaccgggauga

SEQ ID NO: 1602504 - RNA, 20 nt, Homo sapiens
agucacuaucauagggauaa

SEQ ID NO: 1602505 - RNA, 23 nt, Homo sapiens
agucacuggagguugaagccaag

SEQ ID NO: 1602506 - RNA, 20 nt, Homo sapiens
agucacuggcccaaccagaa

SEQ ID NO: 1602507 - RNA, 19 nt, Homo sapiens
agucagaguccagugcucu

SEQ ID NO: 1602508 - RNA, 19 nt, Homo sapiens
agucagauuaucuacuuag

SEQ ID NO: 1602509 - RNA, 14 nt, Homo sapiens
agucagcagucaug

SEQ ID NO: 1602510 - RNA, 14 nt, Homo sapiens
agucaucaggugug

SEQ ID NO: 1602511 - RNA, 20 nt, Homo sapiens
agucaucagucaucaggugu

SEQ ID NO: 1602512 - RNA, 14 nt, Homo sapiens
agucaucauuccuc

SEQ ID NO: 1602513 - RNA, 13 nt, Homo sapiens
agucauccucaga

SEQ ID NO: 1602514 - RNA, 15 nt, Homo sapiens
agucaucucauucca

SEQ ID NO: 1602515 - RNA, 23 nt, Homo sapiens
agucaucuugcuaccaguauuua

SEQ ID NO: 1602516 - RNA, 13 nt, Homo sapiens
agucauggucaca

SEQ ID NO: 1602517 - RNA, 21 nt, Homo sapiens
agucauugaaauuuacuguga

SEQ ID NO: 1602518 - RNA, 18 nt, Homo sapiens
aguccacaagaacaauuc

SEQ ID NO: 1602519 - RNA, 19 nt, Homo sapiens
aguccacaagaacaauuca

SEQ ID NO: 1602520 - RNA, 22 nt, Homo sapiens
aguccagccccuccucccucag

SEQ ID NO: 1602521 - RNA, 20 nt, Homo sapiens
aguccaggccucucucugcu

SEQ ID NO: 1602522 - RNA, 16 nt, Homo sapiens
aguccaucuucuuuau

SEQ ID NO: 1602523 - RNA, 15 nt, Homo sapiens
agucccagcuacuug

SEQ ID NO: 1602524 - RNA, 20 nt, Homo sapiens
agucccaggggcagccacac

SEQ ID NO: 1602525 - RNA, 21 nt, Homo sapiens
agucccucaugcaaaucaauu

SEQ ID NO: 1602526 - RNA, 17 nt, Homo sapiens
agucccugucaccucuu

SEQ ID NO: 1602527 - RNA, 19 nt, Homo sapiens
aguccgacccagacaucca

SEQ ID NO: 1602528 - RNA, 20 nt, Homo sapiens
aguccuggaagccagcuuuc

SEQ ID NO: 1602529 - RNA, 18 nt, Homo sapiens
agucgagauugcacugcu

SEQ ID NO: 1602530 - RNA, 12 nt, Homo sapiens
agucuaaaccaa

SEQ ID NO: 1602531 - RNA, 17 nt, Homo sapiens
agucuaggagcugggag

SEQ ID NO: 1602532 - RNA, 13 nt, Homo sapiens
agucucaccagcc

SEQ ID NO: 1602533 - RNA, 17 nt, Homo sapiens
agucucauagcuuugga

SEQ ID NO: 1602534 - RNA, 16 nt, Homo sapiens
agucucucacccucau

SEQ ID NO: 1602535 - RNA, 21 nt, Homo sapiens
agucucugguagccugcagaa

SEQ ID NO: 1602536 - RNA, 12 nt, Homo sapiens
agucucuugacu

SEQ ID NO: 1602537 - RNA, 17 nt, Homo sapiens
agucucuugacuccacu

SEQ ID NO: 1602538 - RNA, 15 nt, Homo sapiens
agucugaacaauaua

SEQ ID NO: 1602539 - RNA, 19 nt, Homo sapiens
agucugccacuugucaaag

SEQ ID NO: 1602540 - RNA, 17 nt, Homo sapiens
agucugucaauguccua

SEQ ID NO: 1602541 - RNA, 18 nt, Homo sapiens
agucuuaaagcauuucag

SEQ ID NO: 1602542 - RNA, 17 nt, Homo sapiens
agucuuaauuguguuua

SEQ ID NO: 1602543 - RNA, 14 nt, Homo sapiens
agucuucacuaaaa

SEQ ID NO: 1602544 - RNA, 16 nt, Homo sapiens
agucuucacuaaccuu

SEQ ID NO: 1602545 - RNA, 20 nt, Homo sapiens
agucuugaaaugaaagggaa

SEQ ID NO: 1602546 - RNA, 14 nt, Homo sapiens
caagugacuuucua

SEQ ID NO: 1602547 - RNA, 14 nt, Homo sapiens
caagugccaaacag

SEQ ID NO: 1602548 - RNA, 17 nt, Homo sapiens
caagugcugcacaaaag

SEQ ID NO: 1602549 - RNA, 19 nt, Homo sapiens
caagugcuuccuacaaaga

SEQ ID NO: 1602550 - RNA, 18 nt, Homo sapiens
caaguggugccuaaaguu

SEQ ID NO: 1602551 - RNA, 22 nt, Homo sapiens
caaguguaaaauauuuugaauc

SEQ ID NO: 1602552 - RNA, 21 nt, Homo sapiens
caaguuagaaaacauaaucuu

SEQ ID NO: 1602553 - RNA, 17 nt, Homo sapiens
caaguucuggaucuuau

SEQ ID NO: 1602554 - RNA, 14 nt, Homo sapiens
caaguucugugguu

SEQ ID NO: 1602555 - RNA, 21 nt, Homo sapiens
caaguucuuaguugcuguaug

SEQ ID NO: 1602556 - RNA, 18 nt, Homo sapiens
caaguuguugacugugau

SEQ ID NO: 1602557 - RNA, 21 nt, Homo sapiens
caaguuuuuuaauuaagcaga

SEQ ID NO: 1602558 - RNA, 20 nt, Homo sapiens
caaguuuuuuauacugcacu

SEQ ID NO: 1602559 - RNA, 23 nt, Homo sapiens
caaguuuuuuauacugcacuuau

SEQ ID NO: 1602560 - RNA, 14 nt, Homo sapiens
caauaaaaacaauu

SEQ ID NO: 1602561 - RNA, 16 nt, Homo sapiens
caauaaaaacauugcc

SEQ ID NO: 1602562 - RNA, 16 nt, Homo sapiens
caauaaaaccacugua

SEQ ID NO: 1602563 - RNA, 17 nt, Homo sapiens
caauaaaaccacuguac

SEQ ID NO: 1602564 - RNA, 15 nt, Homo sapiens
caauaaaauguaucu

SEQ ID NO: 1602565 - RNA, 17 nt, Homo sapiens
caauaaaccagugugaa

SEQ ID NO: 1602566 - RNA, 13 nt, Homo sapiens
caauaaacccuca

SEQ ID NO: 1602567 - RNA, 13 nt, Homo sapiens
caauaaagaccac

SEQ ID NO: 1602568 - RNA, 17 nt, Homo sapiens
caauaaagauacaugau

SEQ ID NO: 1602569 - RNA, 18 nt, Homo sapiens
caauaaaggcagcugccu

SEQ ID NO: 1602570 - RNA, 12 nt, Homo sapiens
caauaaaggggg

SEQ ID NO: 1602571 - RNA, 14 nt, Homo sapiens
caauaaaguacuuu

SEQ ID NO: 1602572 - RNA, 16 nt, Homo sapiens
caauaaaguuugccca

SEQ ID NO: 1602573 - RNA, 16 nt, Homo sapiens
caauaacuauuuuucc

SEQ ID NO: 1602574 - RNA, 16 nt, Homo sapiens
caauaagauuuaguug

SEQ ID NO: 1602575 - RNA, 13 nt, Homo sapiens
caauaauauuuca

SEQ ID NO: 1602576 - RNA, 16 nt, Homo sapiens
caauacaaagaugacu

SEQ ID NO: 1602577 - RNA, 14 nt, Homo sapiens
caauagcaugcaaa

SEQ ID NO: 1602578 - RNA, 21 nt, Homo sapiens
caauagcaugcaaaaaaugcu

SEQ ID NO: 1602579 - RNA, 17 nt, Homo sapiens
caauaguggcauaccaa

SEQ ID NO: 1602580 - RNA, 14 nt, Homo sapiens
caauauaaucugaa

SEQ ID NO: 1602581 - RNA, 13 nt, Homo sapiens
caauauaccuauc

SEQ ID NO: 1602582 - RNA, 19 nt, Homo sapiens
caauauauacuuauagaau

SEQ ID NO: 1602583 - RNA, 13 nt, Homo sapiens
caauaugauuugc

SEQ ID NO: 1602584 - RNA, 18 nt, Homo sapiens
caauaugcaagcagcuuu

SEQ ID NO: 1602585 - RNA, 19 nt, Homo sapiens
caauauucuuuuguucuaa

SEQ ID NO: 1602586 - RNA, 20 nt, Homo sapiens
caauauuuucugcaauccaa

SEQ ID NO: 1602587 - RNA, 18 nt, Homo sapiens
caauauuuuuauaucaug

SEQ ID NO: 1602588 - RNA, 22 nt, Homo sapiens
caauauuuuuauaucaugcaaa

SEQ ID NO: 1602589 - RNA, 15 nt, Homo sapiens
caaucaacagaaaag

SEQ ID NO: 1602590 - RNA, 22 nt, Homo sapiens
caaucaacagaaaagcuguaaa

SEQ ID NO: 1602591 - RNA, 23 nt, Homo sapiens
caaucacaaaggcugacauucac

SEQ ID NO: 1602592 - RNA, 19 nt, Homo sapiens
caaucaucaucauucucau

SEQ ID NO: 1602593 - RNA, 19 nt, Homo sapiens
caaucaucuccaauggaaa

SEQ ID NO: 1602594 - RNA, 13 nt, Homo sapiens
caaucauguacug

SEQ ID NO: 1602595 - RNA, 17 nt, Homo sapiens
caaucauuuauucauug

SEQ ID NO: 1602596 - RNA, 15 nt, Homo sapiens
caauccaaguacaug

SEQ ID NO: 1602597 - RNA, 19 nt, Homo sapiens
caaucccaacuacguaaua

SEQ ID NO: 1602598 - RNA, 15 nt, Homo sapiens
caauccccgugcuaa

SEQ ID NO: 1602599 - RNA, 13 nt, Homo sapiens
caaucguucugcu

SEQ ID NO: 1602600 - RNA, 19 nt, Homo sapiens
caaucucagcucacugcaa

SEQ ID NO: 1602601 - RNA, 22 nt, Homo sapiens
caaucucccuggggcacuuuca

SEQ ID NO: 1602602 - RNA, 18 nt, Homo sapiens
caaucugcaguuuaacaa

SEQ ID NO: 1602603 - RNA, 18 nt, Homo sapiens
caaucuggcuuagugcca

SEQ ID NO: 1602604 - RNA, 22 nt, Homo sapiens
caaucuuauguuuccaagagaa

SEQ ID NO: 1602605 - RNA, 14 nt, Homo sapiens
caaucuugaacuca

SEQ ID NO: 1602606 - RNA, 14 nt, Homo sapiens
caaugaacacuuaa

SEQ ID NO: 1602607 - RNA, 12 nt, Homo sapiens
caaugaagggaa

SEQ ID NO: 1602608 - RNA, 18 nt, Homo sapiens
caaugaccacauccugaa

SEQ ID NO: 1602609 - RNA, 21 nt, Homo sapiens
caaugauacccaacaguuuau

SEQ ID NO: 1602610 - RNA, 16 nt, Homo sapiens
caaugaugguuuaaua

SEQ ID NO: 1602611 - RNA, 22 nt, Homo sapiens
caaugccacauacuugcagcuc

SEQ ID NO: 1602612 - RNA, 23 nt, Homo sapiens
caaugccccuggaucuaccagca

SEQ ID NO: 1602613 - RNA, 15 nt, Homo sapiens
caaugccuauaaaau

SEQ ID NO: 1602614 - RNA, 16 nt, Homo sapiens
caaugccuuguuguau

SEQ ID NO: 1602615 - RNA, 23 nt, Homo sapiens
caauggccaacuuauuguauucc

SEQ ID NO: 1602616 - RNA, 22 nt, Homo sapiens
caaugggcagaaagcuguggga

SEQ ID NO: 1602617 - RNA, 19 nt, Homo sapiens
caaugggcucaaacuucua

SEQ ID NO: 1602618 - RNA, 15 nt, Homo sapiens
caauggggcugguuu

SEQ ID NO: 1602619 - RNA, 23 nt, Homo sapiens
caauggugucaguauccaggcuu

SEQ ID NO: 1602620 - RNA, 17 nt, Homo sapiens
caauguaaggagccuuu

SEQ ID NO: 1602621 - RNA, 13 nt, Homo sapiens
caauguacaauua

SEQ ID NO: 1602622 - RNA, 19 nt, Homo sapiens
caauguacaauuaugucuc

SEQ ID NO: 1602623 - RNA, 22 nt, Homo sapiens
caauguacaguugaaauaacug

SEQ ID NO: 1602624 - RNA, 16 nt, Homo sapiens
caauguauacaaugca

SEQ ID NO: 1602625 - RNA, 13 nt, Homo sapiens
caauguucuauua

SEQ ID NO: 1602626 - RNA, 14 nt, Homo sapiens
caauguuuuagaau

SEQ ID NO: 1602627 - RNA, 19 nt, Homo sapiens
caauuaaaccgcaugugau

SEQ ID NO: 1602628 - RNA, 17 nt, Homo sapiens
caauuaacauaugucac

SEQ ID NO: 1602629 - RNA, 18 nt, Homo sapiens
caauuacagggugacuca

SEQ ID NO: 1602630 - RNA, 18 nt, Homo sapiens
caauuauacuaaaccuca

SEQ ID NO: 1602631 - RNA, 17 nt, Homo sapiens
caauuaucaucuuuuga

SEQ ID NO: 1602632 - RNA, 16 nt, Homo sapiens
caauuauugauauaua

SEQ ID NO: 1602633 - RNA, 22 nt, Homo sapiens
caauucaaauccauagauuucg

SEQ ID NO: 1602634 - RNA, 21 nt, Homo sapiens
caauucaguuaggcuagagac

SEQ ID NO: 1602635 - RNA, 22 nt, Homo sapiens
caauucauauauuugaagugga

SEQ ID NO: 1602636 - RNA, 23 nt, Homo sapiens
caauucuaggaugaacaauguau

SEQ ID NO: 1602637 - RNA, 22 nt, Homo sapiens
caauucuaucuuuuguuuccuu

SEQ ID NO: 1602638 - RNA, 23 nt, Homo sapiens
caauucugugacauacauauuau

SEQ ID NO: 1602639 - RNA, 15 nt, Homo sapiens
caauuguaacgacuu

SEQ ID NO: 1602640 - RNA, 22 nt, Homo sapiens
caauuuagaaaaagaacaugca

SEQ ID NO: 1602641 - RNA, 23 nt, Homo sapiens
caauuucauacuaaacugauuaa

SEQ ID NO: 1602642 - RNA, 22 nt, Homo sapiens
caauuugagauucuacaguaag

SEQ ID NO: 1602643 - RNA, 22 nt, Homo sapiens
caauuugagccagagagcaucu

SEQ ID NO: 1602644 - RNA, 15 nt, Homo sapiens
caauuuugcacugaa

SEQ ID NO: 1602645 - RNA, 18 nt, Homo sapiens
caauuuuuuaucaugcau

SEQ ID NO: 1602646 - RNA, 16 nt, Homo sapiens
cacaaaaucuguccaa

SEQ ID NO: 1602647 - RNA, 15 nt, Homo sapiens
cacaaacacauuaua

SEQ ID NO: 1602648 - RNA, 13 nt, Homo sapiens
cacaaacaugugu

SEQ ID NO: 1602649 - RNA, 19 nt, Homo sapiens
cacaaacugaaugacuuga

SEQ ID NO: 1602650 - RNA, 21 nt, Homo sapiens
cacaaaguagaggaauccaug

SEQ ID NO: 1602651 - RNA, 16 nt, Homo sapiens
cacaaauaacaucuca

SEQ ID NO: 1602652 - RNA, 21 nt, Homo sapiens
cacaaaucauccuaguaauaa

SEQ ID NO: 1602653 - RNA, 14 nt, Homo sapiens
cacaaaucuuaacu

SEQ ID NO: 1602654 - RNA, 13 nt, Homo sapiens
cacaacagugaaa

SEQ ID NO: 1602655 - RNA, 15 nt, Homo sapiens
cacaagaacaauuca

SEQ ID NO: 1602656 - RNA, 20 nt, Homo sapiens
cacaagaagcugguggagca

SEQ ID NO: 1602657 - RNA, 14 nt, Homo sapiens
cacaagccugagaa

SEQ ID NO: 1602658 - RNA, 19 nt, Homo sapiens
cacaagcucagguccugcu

SEQ ID NO: 1602659 - RNA, 21 nt, Homo sapiens
cacaaggaaaaggccauuaaa

SEQ ID NO: 1602660 - RNA, 21 nt, Homo sapiens
cacaaggugauuucagacugc

SEQ ID NO: 1602661 - RNA, 13 nt, Homo sapiens
cacaauacaguau

SEQ ID NO: 1602662 - RNA, 14 nt, Homo sapiens
cacaauacaguauu

SEQ ID NO: 1602663 - RNA, 14 nt, Homo sapiens
cacaauaggucuuu

SEQ ID NO: 1602664 - RNA, 14 nt, Homo sapiens
auacgguaugauau

SEQ ID NO: 1602665 - RNA, 17 nt, Homo sapiens
auacguuaggaggacaa

SEQ ID NO: 1602666 - RNA, 18 nt, Homo sapiens
auacuaaacugauuaaau

SEQ ID NO: 1602667 - RNA, 15 nt, Homo sapiens
auacucuagaugaag

SEQ ID NO: 1602668 - RNA, 16 nt, Homo sapiens
auacucuuucuuugca

SEQ ID NO: 1602669 - RNA, 18 nt, Homo sapiens
auacugagugugccucau

SEQ ID NO: 1602670 - RNA, 14 nt, Homo sapiens
auacugucaaacaa

SEQ ID NO: 1602671 - RNA, 12 nt, Homo sapiens
auacugugaaau

SEQ ID NO: 1602672 - RNA, 13 nt, Homo sapiens
auacuguuuccau

SEQ ID NO: 1602673 - RNA, 20 nt, Homo sapiens
auacuuauagaauucaguca

SEQ ID NO: 1602674 - RNA, 19 nt, Homo sapiens
auacuucuuuuucauuauu

SEQ ID NO: 1602675 - RNA, 20 nt, Homo sapiens
auacuucuuuuucauuauug

SEQ ID NO: 1602676 - RNA, 22 nt, Homo sapiens
auacuugagcgcugcugaaaag

SEQ ID NO: 1602677 - RNA, 12 nt, Homo sapiens
auagaacaucca

SEQ ID NO: 1602678 - RNA, 14 nt, Homo sapiens
auagaacauccaga

SEQ ID NO: 1602679 - RNA, 15 nt, Homo sapiens
auagaaccacuauga

SEQ ID NO: 1602680 - RNA, 21 nt, Homo sapiens
auagaacugaaugagaaccaa

SEQ ID NO: 1602681 - RNA, 22 nt, Homo sapiens
auagaagaaaauccauucauuc

SEQ ID NO: 1602682 - RNA, 12 nt, Homo sapiens
auagacaauucc

SEQ ID NO: 1602683 - RNA, 19 nt, Homo sapiens
auagacacaguauugacuu

SEQ ID NO: 1602684 - RNA, 17 nt, Homo sapiens
auagacacuugcuccca

SEQ ID NO: 1602685 - RNA, 13 nt, Homo sapiens
auagacauucuca

SEQ ID NO: 1602686 - RNA, 16 nt, Homo sapiens
auagagacccauguca

SEQ ID NO: 1602687 - RNA, 17 nt, Homo sapiens
auagagcuccauuuccc

SEQ ID NO: 1602688 - RNA, 15 nt, Homo sapiens
auagaggaacuugaa

SEQ ID NO: 1602689 - RNA, 16 nt, Homo sapiens
auagaggaacuugaaa

SEQ ID NO: 1602690 - RNA, 14 nt, Homo sapiens
auagaggcuagcuu

SEQ ID NO: 1602691 - RNA, 12 nt, Homo sapiens
auagaugacaaa

SEQ ID NO: 1602692 - RNA, 21 nt, Homo sapiens
auagauuauuauaaacuauaa

SEQ ID NO: 1602693 - RNA, 21 nt, Homo sapiens
auagauuucgaagccacagag

SEQ ID NO: 1602694 - RNA, 17 nt, Homo sapiens
auagauuucuacacuga

SEQ ID NO: 1602695 - RNA, 15 nt, Homo sapiens
auagauuuuuucaga

SEQ ID NO: 1602696 - RNA, 20 nt, Homo sapiens
auagcaccuccacauaccug

SEQ ID NO: 1602697 - RNA, 22 nt, Homo sapiens
auagcacugcagaaaccuuuaa

SEQ ID NO: 1602698 - RNA, 21 nt, Homo sapiens
auagcagcuuauucacaagac

SEQ ID NO: 1602699 - RNA, 18 nt, Homo sapiens
auagccuggguuaaguau

SEQ ID NO: 1602700 - RNA, 19 nt, Homo sapiens
auagcuaaguacacaauaa

SEQ ID NO: 1602701 - RNA, 17 nt, Homo sapiens
auagcuacaguguaaua

SEQ ID NO: 1602702 - RNA, 23 nt, Homo sapiens
auagcucuggggugggcaguuuu

SEQ ID NO: 1602703 - RNA, 12 nt, Homo sapiens
auagcugugacu

SEQ ID NO: 1602704 - RNA, 17 nt, Homo sapiens
auaggacauugugucag

SEQ ID NO: 1602705 - RNA, 16 nt, Homo sapiens
auaggcaaaagacaug

SEQ ID NO: 1602706 - RNA, 13 nt, Homo sapiens
auaggcaauaaua

SEQ ID NO: 1602707 - RNA, 16 nt, Homo sapiens
auaggccugucccuug

SEQ ID NO: 1602708 - RNA, 16 nt, Homo sapiens
auagguugagcaauuu

SEQ ID NO: 1602709 - RNA, 20 nt, Homo sapiens
auaguacucuuuguagcaaa

SEQ ID NO: 1602710 - RNA, 20 nt, Homo sapiens
auaguauuucagcugcaaua

SEQ ID NO: 1602711 - RNA, 18 nt, Homo sapiens
auagugccagguggcuca

SEQ ID NO: 1602712 - RNA, 23 nt, Homo sapiens
auagugcugcaauaaacauaugu

SEQ ID NO: 1602713 - RNA, 16 nt, Homo sapiens
auaguggaaaaacaca

SEQ ID NO: 1602714 - RNA, 22 nt, Homo sapiens
auaguggguacaucaaguccau

SEQ ID NO: 1602715 - RNA, 17 nt, Homo sapiens
auaguuuuuuacuucuc

SEQ ID NO: 1602716 - RNA, 22 nt, Homo sapiens
auauaaaacuguuucaagcccu

SEQ ID NO: 1602717 - RNA, 14 nt, Homo sapiens
auauaaacauauca

SEQ ID NO: 1602718 - RNA, 13 nt, Homo sapiens
auauaaacauauu

SEQ ID NO: 1602719 - RNA, 13 nt, Homo sapiens
auauaacaaauaa

SEQ ID NO: 1602720 - RNA, 16 nt, Homo sapiens
auauaacauguguaug

SEQ ID NO: 1602721 - RNA, 13 nt, Homo sapiens
auauaacuaucuc

SEQ ID NO: 1602722 - RNA, 16 nt, Homo sapiens
auauaaguacugacca

SEQ ID NO: 1602723 - RNA, 20 nt, Homo sapiens
auauaauccuaccagaagga

SEQ ID NO: 1602724 - RNA, 18 nt, Homo sapiens
auauacaaaacaauuaau

SEQ ID NO: 1602725 - RNA, 16 nt, Homo sapiens
auauacaaaacuuuau

SEQ ID NO: 1602726 - RNA, 15 nt, Homo sapiens
auauacauauaugag

SEQ ID NO: 1602727 - RNA, 22 nt, Homo sapiens
auauaccacucuuuaccuuuau

SEQ ID NO: 1602728 - RNA, 21 nt, Homo sapiens
auauaccccaaauuguguaua

SEQ ID NO: 1602729 - RNA, 22 nt, Homo sapiens
auauacuuauagaauucaguca

SEQ ID NO: 1602730 - RNA, 16 nt, Homo sapiens
auauagacauucucac

SEQ ID NO: 1602731 - RNA, 15 nt, Homo sapiens
auauauaaacuuugu

SEQ ID NO: 1602732 - RNA, 20 nt, Homo sapiens
auauauagggguuccaggaa

SEQ ID NO: 1602733 - RNA, 20 nt, Homo sapiens
auauauauuuuugugcacau

SEQ ID NO: 1602734 - RNA, 17 nt, Homo sapiens
auauaugaaauaaguaa

SEQ ID NO: 1602735 - RNA, 12 nt, Homo sapiens
auauaugaccag

SEQ ID NO: 1602736 - RNA, 18 nt, Homo sapiens
auauauggcauuugcaga

SEQ ID NO: 1602737 - RNA, 20 nt, Homo sapiens
auauauggcauuugcagauu

SEQ ID NO: 1602738 - RNA, 20 nt, Homo sapiens
auauauguguauacauacau

SEQ ID NO: 1602739 - RNA, 14 nt, Homo sapiens
auauauuuaauuga

SEQ ID NO: 1602740 - RNA, 20 nt, Homo sapiens
auauauuuacaaggaguuau

SEQ ID NO: 1602741 - RNA, 22 nt, Homo sapiens
auaucaaaaaaccuuuacaguu

SEQ ID NO: 1602742 - RNA, 23 nt, Homo sapiens
auaucaaaagccugaaguggaau

SEQ ID NO: 1602743 - RNA, 16 nt, Homo sapiens
auaucaacucugaaag

SEQ ID NO: 1602744 - RNA, 19 nt, Homo sapiens
auaucaauggugcugaggu

SEQ ID NO: 1602745 - RNA, 20 nt, Homo sapiens
auaucagcuuuucuuauucc

SEQ ID NO: 1602746 - RNA, 11 nt, Homo sapiens
auaucagggca

SEQ ID NO: 1602747 - RNA, 13 nt, Homo sapiens
auaucauuaaaca

SEQ ID NO: 1602748 - RNA, 18 nt, Homo sapiens
auauccaggcaccaggac

SEQ ID NO: 1602749 - RNA, 17 nt, Homo sapiens
auaucuguaaugauacu

SEQ ID NO: 1602750 - RNA, 16 nt, Homo sapiens
auaucuugcuuucaaa

SEQ ID NO: 1602751 - RNA, 23 nt, Homo sapiens
auaucuugcuuucaaauuggcac

SEQ ID NO: 1602752 - RNA, 15 nt, Homo sapiens
auaugaauucaagaa

SEQ ID NO: 1602753 - RNA, 17 nt, Homo sapiens
auaugagaauauaccuu

SEQ ID NO: 1602754 - RNA, 15 nt, Homo sapiens
auaugaggcuacaga

SEQ ID NO: 1602755 - RNA, 20 nt, Homo sapiens
auaugauauauaaaugugau

SEQ ID NO: 1602756 - RNA, 14 nt, Homo sapiens
auaugaucccuaau

SEQ ID NO: 1602757 - RNA, 21 nt, Homo sapiens
auaugaucccuaauguguuuc

SEQ ID NO: 1602758 - RNA, 14 nt, Homo sapiens
auaugcaaagcacu

SEQ ID NO: 1602759 - RNA, 11 nt, Homo sapiens
auaugcaaauc

SEQ ID NO: 1602760 - RNA, 13 nt, Homo sapiens
auaugcacuugaa

SEQ ID NO: 1602761 - RNA, 18 nt, Homo sapiens
auaugccuuuuugaagca

SEQ ID NO: 1602762 - RNA, 16 nt, Homo sapiens
auaugggaggaacaaa

SEQ ID NO: 1602763 - RNA, 19 nt, Homo sapiens
auaugucacgaacuugaaa

SEQ ID NO: 1602764 - RNA, 23 nt, Homo sapiens
auauguccacuguucuguucuca

SEQ ID NO: 1602765 - RNA, 14 nt, Homo sapiens
auauuaacauucuu

SEQ ID NO: 1602766 - RNA, 16 nt, Homo sapiens
auauuaagaagcaaua

SEQ ID NO: 1602767 - RNA, 17 nt, Homo sapiens
auauuaagauucuugac

SEQ ID NO: 1602768 - RNA, 17 nt, Homo sapiens
auauuaauaaucuuggc

SEQ ID NO: 1602769 - RNA, 15 nt, Homo sapiens
auauuagaucaaaua

SEQ ID NO: 1602770 - RNA, 17 nt, Homo sapiens
auauuaguugcuuuguu

SEQ ID NO: 1602771 - RNA, 13 nt, Homo sapiens
auauuauaacucu

SEQ ID NO: 1602772 - RNA, 21 nt, Homo sapiens
auauuauuuuaguguguaaaa

SEQ ID NO: 1602773 - RNA, 18 nt, Homo sapiens
auauucaugaaaugugga

SEQ ID NO: 1602774 - RNA, 22 nt, Homo sapiens
auauucuaauuaaaauugugca

SEQ ID NO: 1602775 - RNA, 20 nt, Homo sapiens
auauucugaaucaccaauua

SEQ ID NO: 1602776 - RNA, 20 nt, Homo sapiens
auauugaaaguugcuuuuau

SEQ ID NO: 1602777 - RNA, 22 nt, Homo sapiens
auauugaaugaugugauacaaa

SEQ ID NO: 1602778 - RNA, 13 nt, Homo sapiens
auauugaauguga

SEQ ID NO: 1602779 - RNA, 11 nt, Homo sapiens
auauugccuua

SEQ ID NO: 1602780 - RNA, 22 nt, Homo sapiens
aagagcuagucuaucagcaucu

SEQ ID NO: 1602781 - RNA, 12 nt, Homo sapiens
aagagcuguuau

SEQ ID NO: 1602782 - RNA, 12 nt, Homo sapiens
aagaggaccaga

SEQ ID NO: 1602783 - RNA, 23 nt, Homo sapiens
aagaggcagcuugaaacugagau

SEQ ID NO: 1602784 - RNA, 15 nt, Homo sapiens
aagaggcuacagggc

SEQ ID NO: 1602785 - RNA, 18 nt, Homo sapiens
aagaggcugccccucuca

SEQ ID NO: 1602786 - RNA, 21 nt, Homo sapiens
aagaggcugccccucucacca

SEQ ID NO: 1602787 - RNA, 13 nt, Homo sapiens
aagagggcuuccu

SEQ ID NO: 1602788 - RNA, 15 nt, Homo sapiens
aagaguaguuauaua

SEQ ID NO: 1602789 - RNA, 13 nt, Homo sapiens
aagauaauguugc

SEQ ID NO: 1602790 - RNA, 22 nt, Homo sapiens
aagauauggagaauugcugaag

SEQ ID NO: 1602791 - RNA, 12 nt, Homo sapiens
aagaucaaagac

SEQ ID NO: 1602792 - RNA, 17 nt, Homo sapiens
aagaucaauuucuccca

SEQ ID NO: 1602793 - RNA, 13 nt, Homo sapiens
aagaucaggcaca

SEQ ID NO: 1602794 - RNA, 19 nt, Homo sapiens
aagauccagccucauaccu

SEQ ID NO: 1602795 - RNA, 20 nt, Homo sapiens
aagaucuguuuugaaggcaa

SEQ ID NO: 1602796 - RNA, 21 nt, Homo sapiens
aagaugaagcugagcuuuuga

SEQ ID NO: 1602797 - RNA, 22 nt, Homo sapiens
aagaugagaugguuucuagaga

SEQ ID NO: 1602798 - RNA, 16 nt, Homo sapiens
aagaugaugaugaucu

SEQ ID NO: 1602799 - RNA, 19 nt, Homo sapiens
aagaugauuuaaguauaca

SEQ ID NO: 1602800 - RNA, 14 nt, Homo sapiens
aagaugcucuguga

SEQ ID NO: 1602801 - RNA, 12 nt, Homo sapiens
aagauggcauaa

SEQ ID NO: 1602802 - RNA, 18 nt, Homo sapiens
aagaugguaaaccagauc

SEQ ID NO: 1602803 - RNA, 22 nt, Homo sapiens
aagauguagaggagaaacugga

SEQ ID NO: 1602804 - RNA, 16 nt, Homo sapiens
aagauuaacacauuug

SEQ ID NO: 1602805 - RNA, 11 nt, Homo sapiens
aagauuccaaa

SEQ ID NO: 1602806 - RNA, 16 nt, Homo sapiens
aagauuccaaaaagca

SEQ ID NO: 1602807 - RNA, 16 nt, Homo sapiens
aagauucucgccccuu

SEQ ID NO: 1602808 - RNA, 16 nt, Homo sapiens
aagauucucugcccag

SEQ ID NO: 1602809 - RNA, 20 nt, Homo sapiens
aagauucuggggcuguguua

SEQ ID NO: 1602810 - RNA, 12 nt, Homo sapiens
aagauucuugac

SEQ ID NO: 1602811 - RNA, 19 nt, Homo sapiens
aagauugauuaaugaacua

SEQ ID NO: 1602812 - RNA, 19 nt, Homo sapiens
aagauuuauacaguugaaa

SEQ ID NO: 1602813 - RNA, 19 nt, Homo sapiens
aagauuuggaagcucuucu

SEQ ID NO: 1602814 - RNA, 17 nt, Homo sapiens
aagauuugugaacugga

SEQ ID NO: 1602815 - RNA, 14 nt, Homo sapiens
aagcaaauggccaa

SEQ ID NO: 1602816 - RNA, 17 nt, Homo sapiens
aagcaacagacucucac

SEQ ID NO: 1602817 - RNA, 18 nt, Homo sapiens
aagcaacuugcuucuaaa

SEQ ID NO: 1602818 - RNA, 16 nt, Homo sapiens
aagcaagaaugcagua

SEQ ID NO: 1602819 - RNA, 16 nt, Homo sapiens
aagcaagggaccuuca

SEQ ID NO: 1602820 - RNA, 18 nt, Homo sapiens
aagcaagggacugaguga

SEQ ID NO: 1602821 - RNA, 16 nt, Homo sapiens
aagcaauacuguuucc

SEQ ID NO: 1602822 - RNA, 22 nt, Homo sapiens
aagcacaaaguucucagagcuc

SEQ ID NO: 1602823 - RNA, 14 nt, Homo sapiens
aagcacacuggaau

SEQ ID NO: 1602824 - RNA, 14 nt, Homo sapiens
aagcacaucaauua

SEQ ID NO: 1602825 - RNA, 12 nt, Homo sapiens
aagcacauucca

SEQ ID NO: 1602826 - RNA, 14 nt, Homo sapiens
aagcacauuccaaa

SEQ ID NO: 1602827 - RNA, 18 nt, Homo sapiens
aagcaccagugggacugu

SEQ ID NO: 1602828 - RNA, 20 nt, Homo sapiens
aagcaccuuccccuccauuc

SEQ ID NO: 1602829 - RNA, 23 nt, Homo sapiens
aagcacucuggaugauggauucc

SEQ ID NO: 1602830 - RNA, 15 nt, Homo sapiens
aagcagaacagugau

SEQ ID NO: 1602831 - RNA, 17 nt, Homo sapiens
aagcagaacagugauua

SEQ ID NO: 1602832 - RNA, 22 nt, Homo sapiens
aagcagcaucuucugguuuaaa

SEQ ID NO: 1602833 - RNA, 21 nt, Homo sapiens
aagcaggcuugcccaguacau

SEQ ID NO: 1602834 - RNA, 22 nt, Homo sapiens
aagcagggacuugaacccauau

SEQ ID NO: 1602835 - RNA, 17 nt, Homo sapiens
aagcaggugaacuggga

SEQ ID NO: 1602836 - RNA, 21 nt, Homo sapiens
aagcagguuuuuaaguugucu

SEQ ID NO: 1602837 - RNA, 19 nt, Homo sapiens
aagcaguguguacuucuuc

SEQ ID NO: 1602838 - RNA, 13 nt, Homo sapiens
aagcauacuucua

SEQ ID NO: 1602839 - RNA, 12 nt, Homo sapiens
aagcauacuuug

SEQ ID NO: 1602840 - RNA, 16 nt, Homo sapiens
aagcaucauuucccca

SEQ ID NO: 1602841 - RNA, 12 nt, Homo sapiens
aagcaucuucaa

SEQ ID NO: 1602842 - RNA, 11 nt, Homo sapiens
aagcauuguaa

SEQ ID NO: 1602843 - RNA, 11 nt, Homo sapiens
aagcauuucag

SEQ ID NO: 1602844 - RNA, 17 nt, Homo sapiens
aagcauuucaggccagu

SEQ ID NO: 1602845 - RNA, 21 nt, Homo sapiens
aagcauuuccagccuaucuaa

SEQ ID NO: 1602846 - RNA, 21 nt, Homo sapiens
aagcauuucuuuucucuuuaa

SEQ ID NO: 1602847 - RNA, 19 nt, Homo sapiens
aagcauuuugccuaccugg

SEQ ID NO: 1602848 - RNA, 20 nt, Homo sapiens
aagcauuuuuucauauucug

SEQ ID NO: 1602849 - RNA, 16 nt, Homo sapiens
aagccagcuuuccuca

SEQ ID NO: 1602850 - RNA, 18 nt, Homo sapiens
aagccauuuuccagugac

SEQ ID NO: 1602851 - RNA, 13 nt, Homo sapiens
aagcccaggagcc

SEQ ID NO: 1602852 - RNA, 16 nt, Homo sapiens
aagcccaggagccuca

SEQ ID NO: 1602853 - RNA, 20 nt, Homo sapiens
aagcccaggagccucacugg

SEQ ID NO: 1602854 - RNA, 22 nt, Homo sapiens
aagcccaggagccucacugggg

SEQ ID NO: 1602855 - RNA, 12 nt, Homo sapiens
aagcccaguuca

SEQ ID NO: 1602856 - RNA, 18 nt, Homo sapiens
aagccccauuuccucaca

SEQ ID NO: 1602857 - RNA, 20 nt, Homo sapiens
aagccucucuggcacuuuga

SEQ ID NO: 1602858 - RNA, 19 nt, Homo sapiens
aagccuuaagcacaauuaa

SEQ ID NO: 1602859 - RNA, 12 nt, Homo sapiens
aagccuuaggga

SEQ ID NO: 1602860 - RNA, 17 nt, Homo sapiens
aagcgauucuccugccu

SEQ ID NO: 1602861 - RNA, 16 nt, Homo sapiens
aagcgucaucugugua

SEQ ID NO: 1602862 - RNA, 21 nt, Homo sapiens
aagcuaaaauauauaauauac

SEQ ID NO: 1602863 - RNA, 22 nt, Homo sapiens
aagcucaguaacugugcaucug

SEQ ID NO: 1602864 - RNA, 21 nt, Homo sapiens
aagcucuucacugaaacuggu

SEQ ID NO: 1602865 - RNA, 12 nt, Homo sapiens
aagcugacagca

SEQ ID NO: 1602866 - RNA, 15 nt, Homo sapiens
aagcugacauugcca

SEQ ID NO: 1602867 - RNA, 17 nt, Homo sapiens
aagcugacauugccaaa

SEQ ID NO: 1602868 - RNA, 23 nt, Homo sapiens
aagcuggaggacuagaaccugga

SEQ ID NO: 1602869 - RNA, 17 nt, Homo sapiens
aagcuggagucugucaa

SEQ ID NO: 1602870 - RNA, 22 nt, Homo sapiens
aagcuguuccuccuaaaacaau

SEQ ID NO: 1602871 - RNA, 14 nt, Homo sapiens
aagcuguugaaguc

SEQ ID NO: 1602872 - RNA, 21 nt, Homo sapiens
aagcuguugguguucuaagac

SEQ ID NO: 1602873 - RNA, 23 nt, Homo sapiens
aagcuuacucaauaaaacuuuaa

SEQ ID NO: 1602874 - RNA, 16 nt, Homo sapiens
ccagugcaguccauuu

SEQ ID NO: 1602875 - RNA, 20 nt, Homo sapiens
cucacacuuuuggaaccaug

SEQ ID NO: 1602876 - RNA, 22 nt, Homo sapiens
cucacagauuuaaagcaucauc

SEQ ID NO: 1602877 - RNA, 21 nt, Homo sapiens
cucacagccgcauuggugacu

SEQ ID NO: 1602878 - RNA, 14 nt, Homo sapiens
cucacauaagccca

SEQ ID NO: 1602879 - RNA, 20 nt, Homo sapiens
cucacauaagcccaguucau

SEQ ID NO: 1602880 - RNA, 12 nt, Homo sapiens
cucacauaugcc

SEQ ID NO: 1602881 - RNA, 15 nt, Homo sapiens
cucacauuagaucua

SEQ ID NO: 1602882 - RNA, 21 nt, Homo sapiens
cucacauuagaucuaguuacu

SEQ ID NO: 1602883 - RNA, 13 nt, Homo sapiens
cucacauugagag

SEQ ID NO: 1602884 - RNA, 12 nt, Homo sapiens
cucaccaaaacg

SEQ ID NO: 1602885 - RNA, 19 nt, Homo sapiens
aagauuugugaacuggaag

SEQ ID NO: 1602886 - RNA, 16 nt, Homo sapiens
aagauuuuccucuugu

SEQ ID NO: 1602887 - RNA, 15 nt, Homo sapiens
aagcaaaaucuaaaa

SEQ ID NO: 1602888 - RNA, 22 nt, Homo sapiens
aagcaacuacaacuucuccuua

SEQ ID NO: 1602889 - RNA, 14 nt, Homo sapiens
aagcaacuuuccuu

SEQ ID NO: 1602890 - RNA, 12 nt, Homo sapiens
aagcaagcagau

SEQ ID NO: 1602891 - RNA, 17 nt, Homo sapiens
aagcaagcagaugaacu

SEQ ID NO: 1602892 - RNA, 18 nt, Homo sapiens
aagcaagcagaugaacua

SEQ ID NO: 1602893 - RNA, 17 nt, Homo sapiens
aagcaaguucgucuguu

SEQ ID NO: 1602894 - RNA, 20 nt, Homo sapiens
aagcaauccaccugccuugg

SEQ ID NO: 1602895 - RNA, 21 nt, Homo sapiens
aagcaauuacaauacaucuaa

SEQ ID NO: 1602896 - RNA, 15 nt, Homo sapiens
aagcacaaaguucuc

SEQ ID NO: 1602897 - RNA, 15 nt, Homo sapiens
aagcacaaguacuuu

SEQ ID NO: 1602898 - RNA, 22 nt, Homo sapiens
aagcacauucgggccauuuccg

SEQ ID NO: 1602899 - RNA, 22 nt, Homo sapiens
aagcacauuuucagacugcaau

SEQ ID NO: 1602900 - RNA, 15 nt, Homo sapiens
aagcaccccaugcca

SEQ ID NO: 1602901 - RNA, 22 nt, Homo sapiens
aagcacuauuaauacucugcag

SEQ ID NO: 1602902 - RNA, 19 nt, Homo sapiens
aagcacuugcuuacauccu

SEQ ID NO: 1602903 - RNA, 12 nt, Homo sapiens
aagcacuugugg

SEQ ID NO: 1602904 - RNA, 18 nt, Homo sapiens
aagcagaaaaucuaccaa

SEQ ID NO: 1602905 - RNA, 14 nt, Homo sapiens
aagcagauacuuga

SEQ ID NO: 1602906 - RNA, 21 nt, Homo sapiens
aagcagauuucugcuuccuuu

SEQ ID NO: 1602907 - RNA, 14 nt, Homo sapiens
aagcagcaagacaa

SEQ ID NO: 1602908 - RNA, 14 nt, Homo sapiens
aagcagcuuacuua

SEQ ID NO: 1602909 - RNA, 20 nt, Homo sapiens
aagcaggaaaugaaaauguc

SEQ ID NO: 1602910 - RNA, 16 nt, Homo sapiens
aagcagucuugcucug

SEQ ID NO: 1602911 - RNA, 20 nt, Homo sapiens
aagcaguggccuuauugcau

SEQ ID NO: 1602912 - RNA, 16 nt, Homo sapiens
aagcaguuacuaauau

SEQ ID NO: 1602913 - RNA, 15 nt, Homo sapiens
aagcaguuaguuccu

SEQ ID NO: 1602914 - RNA, 22 nt, Homo sapiens
aagcaucccgcuggugccuccc

SEQ ID NO: 1602915 - RNA, 19 nt, Homo sapiens
aagcaucugagcuaacuua

SEQ ID NO: 1602916 - RNA, 12 nt, Homo sapiens
aagcaucugcca

SEQ ID NO: 1602917 - RNA, 19 nt, Homo sapiens
aagcauuaccacucaggca

SEQ ID NO: 1602918 - RNA, 17 nt, Homo sapiens
aagcauuauccuuuuau

SEQ ID NO: 1602919 - RNA, 21 nt, Homo sapiens
aagcauuauccuuuuaucuca

SEQ ID NO: 1602920 - RNA, 19 nt, Homo sapiens
aagcauucacaacuuguuu

SEQ ID NO: 1602921 - RNA, 16 nt, Homo sapiens
aagcauuggacauuua

SEQ ID NO: 1602922 - RNA, 20 nt, Homo sapiens
aagcauuuccagccuaucua

SEQ ID NO: 1602923 - RNA, 17 nt, Homo sapiens
aagcauuuugccuaccu

SEQ ID NO: 1602924 - RNA, 17 nt, Homo sapiens
aagcauuuuugaucaaa

SEQ ID NO: 1602925 - RNA, 23 nt, Homo sapiens
aagccaaagaaaaauaacccuuu

SEQ ID NO: 1602926 - RNA, 14 nt, Homo sapiens
aagccacuguauga

SEQ ID NO: 1602927 - RNA, 14 nt, Homo sapiens
aagccagacaucaa

SEQ ID NO: 1602928 - RNA, 18 nt, Homo sapiens
aagccagucuuguucaca

SEQ ID NO: 1602929 - RNA, 16 nt, Homo sapiens
aagccauuauucacua

SEQ ID NO: 1602930 - RNA, 23 nt, Homo sapiens
aagccauuuuccagugacuugca

SEQ ID NO: 1602931 - RNA, 15 nt, Homo sapiens
aagcccaaucugcaa

SEQ ID NO: 1602932 - RNA, 17 nt, Homo sapiens
aagcccugcccacagaa

SEQ ID NO: 1602933 - RNA, 21 nt, Homo sapiens
aagccgaccuucccuccgccu

SEQ ID NO: 1602934 - RNA, 18 nt, Homo sapiens
aagccuauguaugccaug

SEQ ID NO: 1602935 - RNA, 12 nt, Homo sapiens
aagccuccgccu

SEQ ID NO: 1602936 - RNA, 24 nt, Homo sapiens
aagccuccugcccccugccaguga

SEQ ID NO: 1602937 - RNA, 21 nt, Homo sapiens
aagccuccuguaccucagugg

SEQ ID NO: 1602938 - RNA, 22 nt, Homo sapiens
aagccucuaguguaccaagugc

SEQ ID NO: 1602939 - RNA, 12 nt, Homo sapiens
aagccugagaac

SEQ ID NO: 1602940 - RNA, 16 nt, Homo sapiens
aagccugagaacugaa

SEQ ID NO: 1602941 - RNA, 16 nt, Homo sapiens
aagccuuaccuugaaa

SEQ ID NO: 1602942 - RNA, 20 nt, Homo sapiens
aagccuuugacuuaaggguu

SEQ ID NO: 1602943 - RNA, 16 nt, Homo sapiens
aagcgccgcugugagg

SEQ ID NO: 1602944 - RNA, 14 nt, Homo sapiens
aagcgugugaguga

SEQ ID NO: 1602945 - RNA, 13 nt, Homo sapiens
aagcguguucuca

SEQ ID NO: 1602946 - RNA, 23 nt, Homo sapiens
aagcuaaauauuuaacauuguug

SEQ ID NO: 1602947 - RNA, 15 nt, Homo sapiens
aagcuacugccaucc

SEQ ID NO: 1602948 - RNA, 20 nt, Homo sapiens
aagcucaggaggcgaauaaa

SEQ ID NO: 1602949 - RNA, 15 nt, Homo sapiens
aagcuccaucaauga

SEQ ID NO: 1602950 - RNA, 16 nt, Homo sapiens
aagcucuaaagaccau

SEQ ID NO: 1602951 - RNA, 22 nt, Homo sapiens
aagcugaaaugcaggaaguggu

SEQ ID NO: 1602952 - RNA, 14 nt, Homo sapiens
aagcugacauugcc

SEQ ID NO: 1602953 - RNA, 13 nt, Homo sapiens
aagcugacuuuau

SEQ ID NO: 1602954 - RNA, 15 nt, Homo sapiens
aagcugauagccaga

SEQ ID NO: 1602955 - RNA, 13 nt, Homo sapiens
aagcuggaggcac

SEQ ID NO: 1602956 - RNA, 16 nt, Homo sapiens
aagcuggcuuuuccca

SEQ ID NO: 1602957 - RNA, 14 nt, Homo sapiens
aagcuggugcuacu

SEQ ID NO: 1602958 - RNA, 21 nt, Homo sapiens
aagcuguaagauaauguugcu

SEQ ID NO: 1602959 - RNA, 22 nt, Homo sapiens
aagcuguguccuugcaccugca

SEQ ID NO: 1602960 - RNA, 19 nt, Homo sapiens
aagcuguuauuucuucccu

SEQ ID NO: 1602961 - RNA, 19 nt, Homo sapiens
aagcuguugaagucucagg

SEQ ID NO: 1602962 - RNA, 12 nt, Homo sapiens
aaggaaaucaaa

SEQ ID NO: 1602963 - RNA, 17 nt, Homo sapiens
aaggaaccuuccuuccu

SEQ ID NO: 1602964 - RNA, 12 nt, Homo sapiens
aaggaacuucca

SEQ ID NO: 1602965 - RNA, 13 nt, Homo sapiens
aaggacacaguga

SEQ ID NO: 1602966 - RNA, 14 nt, Homo sapiens
aaggacacagugau

SEQ ID NO: 1602967 - RNA, 22 nt, Homo sapiens
aaggacauuucucaagggccau

SEQ ID NO: 1602968 - RNA, 11 nt, Homo sapiens
aaggacucuca

SEQ ID NO: 1602969 - RNA, 14 nt, Homo sapiens
aaggagaaaucugg

SEQ ID NO: 1602970 - RNA, 14 nt, Homo sapiens
aaggagacauauca

SEQ ID NO: 1602971 - RNA, 12 nt, Homo sapiens
aaggagggaugc

SEQ ID NO: 1602972 - RNA, 20 nt, Homo sapiens
aaggaggggaaacaaugaaa

SEQ ID NO: 1602973 - RNA, 18 nt, Homo sapiens
aaggaggggaccucucca

SEQ ID NO: 1602974 - RNA, 17 nt, Homo sapiens
aaggaguccuugcauca

SEQ ID NO: 1602975 - RNA, 20 nt, Homo sapiens
aaggagugcgugccugcuac

SEQ ID NO: 1602976 - RNA, 23 nt, Homo sapiens
aaggaguuaaauguauucuuggc

SEQ ID NO: 1602977 - RNA, 15 nt, Homo sapiens
aaggauaugauuaau

SEQ ID NO: 1602978 - RNA, 12 nt, Homo sapiens
aaggaugugauu

SEQ ID NO: 1602979 - RNA, 18 nt, Homo sapiens
aaggauuugaaccaugaa

SEQ ID NO: 1602980 - RNA, 19 nt, Homo sapiens
aaggauuuuaccaaagcau

SEQ ID NO: 1602981 - RNA, 19 nt, Homo sapiens
aaggcaacauaauucuucc

SEQ ID NO: 1602982 - RNA, 19 nt, Homo sapiens
aaggcaaugcucaccucuu

SEQ ID NO: 1602983 - RNA, 20 nt, Homo sapiens
aaggcaauuuuaguguauua

SEQ ID NO: 1602984 - RNA, 14 nt, Homo sapiens
aaggcaccuucuua

SEQ ID NO: 1602985 - RNA, 14 nt, Homo sapiens
aaggcagcugccuc

SEQ ID NO: 1602986 - RNA, 20 nt, Homo sapiens
aaggcagcugccucugcucc

SEQ ID NO: 1602987 - RNA, 16 nt, Homo sapiens
aaggcaggaggaucac

SEQ ID NO: 1602988 - RNA, 19 nt, Homo sapiens
aaggcaggaggaucacuug

SEQ ID NO: 1602989 - RNA, 17 nt, Homo sapiens
aaggcauuuuauaugaa

SEQ ID NO: 1602990 - RNA, 17 nt, Homo sapiens
aaggccaccuagcuuuu

SEQ ID NO: 1602991 - RNA, 15 nt, Homo sapiens
aaggcccacuucuuc

SEQ ID NO: 1602992 - RNA, 18 nt, Homo sapiens
aaggcccacuucuucuca

SEQ ID NO: 1602993 - RNA, 17 nt, Homo sapiens
aaggccccaagguuuac

SEQ ID NO: 1602994 - RNA, 16 nt, Homo sapiens
aaggccccugcaaugu

SEQ ID NO: 1602995 - RNA, 12 nt, Homo sapiens
aaggccuacccc

SEQ ID NO: 1602996 - RNA, 20 nt, Homo sapiens
aaggcgggaggauugcuuga

SEQ ID NO: 1602997 - RNA, 23 nt, Homo sapiens
aaggcuaaaaagcaacaggccau

SEQ ID NO: 1602998 - RNA, 18 nt, Homo sapiens
aaggcuaagcaucuucaa

SEQ ID NO: 1602999 - RNA, 23 nt, Homo sapiens
aaggcucccggaauuccgucacc

SEQ ID NO: 1603000 - RNA, 21 nt, Homo sapiens
aaggcugacauucacugagug

SEQ ID NO: 1603001 - RNA, 21 nt, Homo sapiens
aaggcugugagccaaggaggg

SEQ ID NO: 1603002 - RNA, 20 nt, Homo sapiens
aaggcugugccaucagcucc

SEQ ID NO: 1603003 - RNA, 16 nt, Homo sapiens
aaucccgccccagggc

SEQ ID NO: 1603004 - RNA, 21 nt, Homo sapiens
aauccuaucacagucuacuga

SEQ ID NO: 1603005 - RNA, 14 nt, Homo sapiens
aauccuauuuauca

SEQ ID NO: 1603006 - RNA, 23 nt, Homo sapiens
aauccuauuuaucagacucugua

SEQ ID NO: 1603007 - RNA, 16 nt, Homo sapiens
aauccugagaaacaau

SEQ ID NO: 1603008 - RNA, 12 nt, Homo sapiens
aauccuggacca

SEQ ID NO: 1603009 - RNA, 15 nt, Homo sapiens
aauccuuuuccuuau

SEQ ID NO: 1603010 - RNA, 16 nt, Homo sapiens
aaucuaaccacuuaag

SEQ ID NO: 1603011 - RNA, 20 nt, Homo sapiens
aaucuaccaagaacagaguc

SEQ ID NO: 1603012 - RNA, 15 nt, Homo sapiens
aaucuacuaauucca

SEQ ID NO: 1603013 - RNA, 15 nt, Homo sapiens
aaucuauagaacuga

SEQ ID NO: 1603014 - RNA, 23 nt, Homo sapiens
aaucucagauucuucacugguga

SEQ ID NO: 1603015 - RNA, 21 nt, Homo sapiens
aaucucaguuguuugcuucuu

SEQ ID NO: 1603016 - RNA, 14 nt, Homo sapiens
aaucucauucccag

SEQ ID NO: 1603017 - RNA, 16 nt, Homo sapiens
aaucuccaucucaaaa

SEQ ID NO: 1603018 - RNA, 13 nt, Homo sapiens
aaucucccaguga

SEQ ID NO: 1603019 - RNA, 11 nt, Homo sapiens
aaucucuucau

SEQ ID NO: 1603020 - RNA, 22 nt, Homo sapiens
aaucugaaaauagcaacccaga

SEQ ID NO: 1603021 - RNA, 13 nt, Homo sapiens
aaucuggauucau

SEQ ID NO: 1603022 - RNA, 17 nt, Homo sapiens
aaucuggcuuagugcca

SEQ ID NO: 1603023 - RNA, 21 nt, Homo sapiens
aaucuguccguucacaugugu

SEQ ID NO: 1603024 - RNA, 13 nt, Homo sapiens
aaucuuaugcucu

SEQ ID NO: 1603025 - RNA, 18 nt, Homo sapiens
aaucuuuuacaacugccu

SEQ ID NO: 1603026 - RNA, 15 nt, Homo sapiens
aaucuuuuacauuuu

SEQ ID NO: 1603027 - RNA, 20 nt, Homo sapiens
aaugaaaaauuccacucaaa

SEQ ID NO: 1603028 - RNA, 15 nt, Homo sapiens
aaugaaauaaaagca

SEQ ID NO: 1603029 - RNA, 17 nt, Homo sapiens
aaugaaaugccaaagga

SEQ ID NO: 1603030 - RNA, 18 nt, Homo sapiens
aaugaacacaucuugagu

SEQ ID NO: 1603031 - RNA, 15 nt, Homo sapiens
aaugaagaaagggag

SEQ ID NO: 1603032 - RNA, 13 nt, Homo sapiens
aaugaaugauucu

SEQ ID NO: 1603033 - RNA, 19 nt, Homo sapiens
aaugaauguaaucuaauag

SEQ ID NO: 1603034 - RNA, 12 nt, Homo sapiens
aaugaaugugcu

SEQ ID NO: 1603035 - RNA, 15 nt, Homo sapiens
aaugaauucaguuuc

SEQ ID NO: 1603036 - RNA, 16 nt, Homo sapiens
aaugaauuuaucuuua

SEQ ID NO: 1603037 - RNA, 21 nt, Homo sapiens
aaugacacccaugccagagag

SEQ ID NO: 1603038 - RNA, 12 nt, Homo sapiens
aaugacagaucu

SEQ ID NO: 1603039 - RNA, 14 nt, Homo sapiens
aaugaccaggccaa

SEQ ID NO: 1603040 - RNA, 14 nt, Homo sapiens
aaugaccauguuau

SEQ ID NO: 1603041 - RNA, 19 nt, Homo sapiens
aaugacgugccuaccucuu

SEQ ID NO: 1603042 - RNA, 14 nt, Homo sapiens
aaugacuggcuccu

SEQ ID NO: 1603043 - RNA, 14 nt, Homo sapiens
aaugacuuacuuuc

SEQ ID NO: 1603044 - RNA, 19 nt, Homo sapiens
aaugacuuggguuuaacaa

SEQ ID NO: 1603045 - RNA, 20 nt, Homo sapiens
aaugagaaggcagccaccag

SEQ ID NO: 1603046 - RNA, 14 nt, Homo sapiens
aaugagacuuacuu

SEQ ID NO: 1603047 - RNA, 17 nt, Homo sapiens
aaugaggucuguuuaaa

SEQ ID NO: 1603048 - RNA, 14 nt, Homo sapiens
aaugauaaaacacc

SEQ ID NO: 1603049 - RNA, 22 nt, Homo sapiens
aaugauccucccaccucagccu

SEQ ID NO: 1603050 - RNA, 16 nt, Homo sapiens
aaugaugguaaguuaa

SEQ ID NO: 1603051 - RNA, 23 nt, Homo sapiens
aaugauuaacaguuaugugguca

SEQ ID NO: 1603052 - RNA, 20 nt, Homo sapiens
aaugauugguuaaaauguga

SEQ ID NO: 1603053 - RNA, 15 nt, Homo sapiens
aaugauuucacagug

SEQ ID NO: 1603054 - RNA, 15 nt, Homo sapiens
aaugauuucauucaa

SEQ ID NO: 1603055 - RNA, 15 nt, Homo sapiens
aaugcaaaacuuuag

SEQ ID NO: 1603056 - RNA, 17 nt, Homo sapiens
aaugcaaauuucuauaa

SEQ ID NO: 1603057 - RNA, 13 nt, Homo sapiens
aaugcacucuggg

SEQ ID NO: 1603058 - RNA, 23 nt, Homo sapiens
aaugcagcaggaaggaacaaaga

SEQ ID NO: 1603059 - RNA, 10 nt, Homo sapiens
aaugcauugu

SEQ ID NO: 1603060 - RNA, 14 nt, Homo sapiens
aaugcauugucaau

SEQ ID NO: 1603061 - RNA, 18 nt, Homo sapiens
aaugcauuugauggccac

SEQ ID NO: 1603062 - RNA, 11 nt, Homo sapiens
aaugccaaagg

SEQ ID NO: 1603063 - RNA, 23 nt, Homo sapiens
aaugccagcauaaauccauccau

SEQ ID NO: 1603064 - RNA, 12 nt, Homo sapiens
aaugccauccag

SEQ ID NO: 1603065 - RNA, 20 nt, Homo sapiens
aaugcccaguucacuucuuu

SEQ ID NO: 1603066 - RNA, 23 nt, Homo sapiens
aaugccuaucugaccaaacugga

SEQ ID NO: 1603067 - RNA, 14 nt, Homo sapiens
aaugccugacucag

SEQ ID NO: 1603068 - RNA, 21 nt, Homo sapiens
aaugccuuuuguuuccaggaa

SEQ ID NO: 1603069 - RNA, 13 nt, Homo sapiens
aaugcucaccucu

SEQ ID NO: 1603070 - RNA, 19 nt, Homo sapiens
aaugcucccagcugugcug

SEQ ID NO: 1603071 - RNA, 18 nt, Homo sapiens
aaugcugaugaaaacugu

SEQ ID NO: 1603072 - RNA, 18 nt, Homo sapiens
aaugcuguggguuuccaa

SEQ ID NO: 1603073 - RNA, 11 nt, Homo sapiens
aaugcuuuaaa

SEQ ID NO: 1603074 - RNA, 14 nt, Homo sapiens
aauggaaaccaagg

SEQ ID NO: 1603075 - RNA, 14 nt, Homo sapiens
aauggaaagcuuuu

SEQ ID NO: 1603076 - RNA, 19 nt, Homo sapiens
aauggaagauuugcccauu

SEQ ID NO: 1603077 - RNA, 17 nt, Homo sapiens
aauggacuaaaacauuu

SEQ ID NO: 1603078 - RNA, 13 nt, Homo sapiens
aauggacugcaua

SEQ ID NO: 1603079 - RNA, 12 nt, Homo sapiens
aauggacuggag

SEQ ID NO: 1603080 - RNA, 17 nt, Homo sapiens
aauggagcaucaagcca

SEQ ID NO: 1603081 - RNA, 18 nt, Homo sapiens
aauggagccaugacaaga

SEQ ID NO: 1603082 - RNA, 12 nt, Homo sapiens
aauggagcucag

SEQ ID NO: 1603083 - RNA, 17 nt, Homo sapiens
aauggagcucaguaaca

SEQ ID NO: 1603084 - RNA, 19 nt, Homo sapiens
aauggaggaagaacaacaa

SEQ ID NO: 1603085 - RNA, 21 nt, Homo sapiens
aauggauuguuaauuucaguc

SEQ ID NO: 1603086 - RNA, 23 nt, Homo sapiens
aauggccuggugagacuguccau

SEQ ID NO: 1603087 - RNA, 20 nt, Homo sapiens
aauggcgcgaucucagcuca

SEQ ID NO: 1603088 - RNA, 17 nt, Homo sapiens
aaugggaauugcgcuca

SEQ ID NO: 1603089 - RNA, 22 nt, Homo sapiens
aaugggauggucggaucucaca

SEQ ID NO: 1603090 - RNA, 18 nt, Homo sapiens
aauggguccccaaaaugg

SEQ ID NO: 1603091 - RNA, 13 nt, Homo sapiens
aauggucaaugcu

SEQ ID NO: 1603092 - RNA, 18 nt, Homo sapiens
aaugguguuguaugccuu

SEQ ID NO: 1603093 - RNA, 12 nt, Homo sapiens
aaugguuaucau

SEQ ID NO: 1603094 - RNA, 17 nt, Homo sapiens
aaugguuaugugcauua

SEQ ID NO: 1603095 - RNA, 18 nt, Homo sapiens
aauguacaguugagcuca

SEQ ID NO: 1603096 - RNA, 13 nt, Homo sapiens
aauguacaucagu

SEQ ID NO: 1603097 - RNA, 16 nt, Homo sapiens
aauguagaaccucaaa

SEQ ID NO: 1603098 - RNA, 15 nt, Homo sapiens
aauguaggaugacag

SEQ ID NO: 1603099 - RNA, 20 nt, Homo sapiens
aauguaucuauuuguacaau

SEQ ID NO: 1603100 - RNA, 21 nt, Homo sapiens
aauguaucugcauauguuuuc

SEQ ID NO: 1603101 - RNA, 21 nt, Homo sapiens
aauguaugcauucacauuuag

SEQ ID NO: 1603102 - RNA, 16 nt, Homo sapiens
aauguauguacaauac

SEQ ID NO: 1603103 - RNA, 17 nt, Homo sapiens
aaugucacuauaucuuc

SEQ ID NO: 1603104 - RNA, 14 nt, Homo sapiens
aaugucauagucuu

SEQ ID NO: 1603105 - RNA, 18 nt, Homo sapiens
aaugucauagucuugaaa

SEQ ID NO: 1603106 - RNA, 23 nt, Homo sapiens
aauguccauauuuauuuuuaugu

SEQ ID NO: 1603107 - RNA, 18 nt, Homo sapiens
aauguccuacugagacag

SEQ ID NO: 1603108 - RNA, 15 nt, Homo sapiens
aauguccuuuuauga

SEQ ID NO: 1603109 - RNA, 13 nt, Homo sapiens
aaugucucuguga

SEQ ID NO: 1603110 - RNA, 17 nt, Homo sapiens
aaugucugugaauuuca

SEQ ID NO: 1603111 - RNA, 22 nt, Homo sapiens
aaugugaaaaugguccaggaga

SEQ ID NO: 1603112 - RNA, 16 nt, Homo sapiens
aaugugaucauaugag

SEQ ID NO: 1603113 - RNA, 15 nt, Homo sapiens
aaugugaugcuuuca

SEQ ID NO: 1603114 - RNA, 15 nt, Homo sapiens
aaugugauugcagcu

SEQ ID NO: 1603115 - RNA, 23 nt, Homo sapiens
aauguggaagucaguacgaucaa

SEQ ID NO: 1603116 - RNA, 15 nt, Homo sapiens
aaugugguuuguaca

SEQ ID NO: 1603117 - RNA, 22 nt, Homo sapiens
aaugugguuuguacauaucaaa

SEQ ID NO: 1603118 - RNA, 23 nt, Homo sapiens
aauguguauuucuuaagaauuca

SEQ ID NO: 1603119 - RNA, 23 nt, Homo sapiens
aauguguuuucuguagacucuaa

SEQ ID NO: 1603120 - RNA, 16 nt, Homo sapiens
aauguuaaaugacgag

SEQ ID NO: 1603121 - RNA, 17 nt, Homo sapiens
aauguuaugacuaugua

SEQ ID NO: 1603122 - RNA, 16 nt, Homo sapiens
acacuacgcacuggac

SEQ ID NO: 1603123 - RNA, 14 nt, Homo sapiens
acacuaguccauaa

SEQ ID NO: 1603124 - RNA, 19 nt, Homo sapiens
acacucaauaaacagucac

SEQ ID NO: 1603125 - RNA, 23 nt, Homo sapiens
acacucacagcaaggauggagcu

SEQ ID NO: 1603126 - RNA, 17 nt, Homo sapiens
acacucccacuuggcau

SEQ ID NO: 1603127 - RNA, 15 nt, Homo sapiens
acacuccucuaucau

SEQ ID NO: 1603128 - RNA, 14 nt, Homo sapiens
acacucuuagcuau

SEQ ID NO: 1603129 - RNA, 23 nt, Homo sapiens
acacucuugagucucuuuaccua

SEQ ID NO: 1603130 - RNA, 14 nt, Homo sapiens
acacugaacuuaau

SEQ ID NO: 1603131 - RNA, 14 nt, Homo sapiens
acacugaucuggcu

SEQ ID NO: 1603132 - RNA, 16 nt, Homo sapiens
acacuggugugaccug

SEQ ID NO: 1603133 - RNA, 23 nt, Homo sapiens
acacuggugugaccugagggcag

SEQ ID NO: 1603134 - RNA, 22 nt, Homo sapiens
acacuguaccgacuuugauaga

SEQ ID NO: 1603135 - RNA, 18 nt, Homo sapiens
acacuguauauaaacaua

SEQ ID NO: 1603136 - RNA, 18 nt, Homo sapiens
acacugucacuagucuca

SEQ ID NO: 1603137 - RNA, 23 nt, Homo sapiens
acacuguccaugaagcacugagc

SEQ ID NO: 1603138 - RNA, 16 nt, Homo sapiens
acacugucucuaccaa

SEQ ID NO: 1603139 - RNA, 22 nt, Homo sapiens
acacuuaucugucucuucuaca

SEQ ID NO: 1603140 - RNA, 24 nt, Homo sapiens
acacuucguucgcagagcuuuuca

SEQ ID NO: 1603141 - RNA, 19 nt, Homo sapiens
acacuucugugagaccccc

SEQ ID NO: 1603142 - RNA, 16 nt, Homo sapiens
acacuuggcauacaaa

SEQ ID NO: 1603143 - RNA, 23 nt, Homo sapiens
acacuugggauugucuuacuguu

SEQ ID NO: 1603144 - RNA, 23 nt, Homo sapiens
acacuuuccagccuauagcagaa

SEQ ID NO: 1603145 - RNA, 17 nt, Homo sapiens
acacuuuugaugacgau

SEQ ID NO: 1603146 - RNA, 17 nt, Homo sapiens
acagaaacaaaaucaaa

SEQ ID NO: 1603147 - RNA, 21 nt, Homo sapiens
acagaaagagacuccgucuca

SEQ ID NO: 1603148 - RNA, 18 nt, Homo sapiens
acagaaagauuugaugua

SEQ ID NO: 1603149 - RNA, 15 nt, Homo sapiens
acagaacuggugcuc

SEQ ID NO: 1603150 - RNA, 12 nt, Homo sapiens
acagaagguccu

SEQ ID NO: 1603151 - RNA, 13 nt, Homo sapiens
acagaauaguuua

SEQ ID NO: 1603152 - RNA, 23 nt, Homo sapiens
acagacacucccacuuggcauca

SEQ ID NO: 1603153 - RNA, 11 nt, Homo sapiens
acagacauauu

SEQ ID NO: 1603154 - RNA, 13 nt, Homo sapiens
acagacggaaaug

SEQ ID NO: 1603155 - RNA, 22 nt, Homo sapiens
acagacucuucacagauuuuua

SEQ ID NO: 1603156 - RNA, 20 nt, Homo sapiens
acagagacagugaaaguuuu

SEQ ID NO: 1603157 - RNA, 19 nt, Homo sapiens
acagagagcuugcugugac

SEQ ID NO: 1603158 - RNA, 20 nt, Homo sapiens
acagagcgagacuccaucuc

SEQ ID NO: 1603159 - RNA, 14 nt, Homo sapiens
acagauuccuggca

SEQ ID NO: 1603160 - RNA, 23 nt, Homo sapiens
acagauuccuggcagagccaugg

SEQ ID NO: 1603161 - RNA, 23 nt, Homo sapiens
acagauuuugaaucugugugcau

SEQ ID NO: 1603162 - RNA, 21 nt, Homo sapiens
acagcaaagcagcagugucca

SEQ ID NO: 1603163 - RNA, 16 nt, Homo sapiens
acagcacuacugggug

SEQ ID NO: 1603164 - RNA, 21 nt, Homo sapiens
acagcacuuuuccucuucuag

SEQ ID NO: 1603165 - RNA, 17 nt, Homo sapiens
acagcagagaagcugua

SEQ ID NO: 1603166 - RNA, 20 nt, Homo sapiens
acagcaggcugccagugccu

SEQ ID NO: 1603167 - RNA, 17 nt, Homo sapiens
acagcauaccacgccac

SEQ ID NO: 1603168 - RNA, 23 nt, Homo sapiens
acagcauuaacugucuuaaagag

SEQ ID NO: 1603169 - RNA, 21 nt, Homo sapiens
acagccaccaagaaguggcug

SEQ ID NO: 1603170 - RNA, 23 nt, Homo sapiens
acagccagugggagauguuagac

SEQ ID NO: 1603171 - RNA, 19 nt, Homo sapiens
acagccccugcaacaaaga

SEQ ID NO: 1603172 - RNA, 18 nt, Homo sapiens
acagcccuuaugcgguua

SEQ ID NO: 1603173 - RNA, 22 nt, Homo sapiens
acagccguggggggaagcacau

SEQ ID NO: 1603174 - RNA, 23 nt, Homo sapiens
acagccguggggggaagcacaua

SEQ ID NO: 1603175 - RNA, 14 nt, Homo sapiens
acagccguuugaau

SEQ ID NO: 1603176 - RNA, 21 nt, Homo sapiens
acagccuccucugucugcccu

SEQ ID NO: 1603177 - RNA, 14 nt, Homo sapiens
acagccuggaccac

SEQ ID NO: 1603178 - RNA, 15 nt, Homo sapiens
acagccuggaccacc

SEQ ID NO: 1603179 - RNA, 18 nt, Homo sapiens
acagcgauaagcuuucaa

SEQ ID NO: 1603180 - RNA, 21 nt, Homo sapiens
acagcguggaugucgaugacu

SEQ ID NO: 1603181 - RNA, 14 nt, Homo sapiens
acagcuaaccacuu

SEQ ID NO: 1603182 - RNA, 22 nt, Homo sapiens
acagcuauuauaucagcuuuuc

SEQ ID NO: 1603183 - RNA, 23 nt, Homo sapiens
acagcucgggcccucugugagau

SEQ ID NO: 1603184 - RNA, 21 nt, Homo sapiens
acagcucugcauacucauuag

SEQ ID NO: 1603185 - RNA, 22 nt, Homo sapiens
acagcugacuccaagcugcaug

SEQ ID NO: 1603186 - RNA, 15 nt, Homo sapiens
acagcugucccuguc

SEQ ID NO: 1603187 - RNA, 13 nt, Homo sapiens
acaggaaauugac

SEQ ID NO: 1603188 - RNA, 22 nt, Homo sapiens
acaggaagaugggagguggaag

SEQ ID NO: 1603189 - RNA, 20 nt, Homo sapiens
acaggaagcaccccaugcca

SEQ ID NO: 1603190 - RNA, 19 nt, Homo sapiens
acaggagaaucaccugaac

SEQ ID NO: 1603191 - RNA, 13 nt, Homo sapiens
acaggagcacugc

SEQ ID NO: 1603192 - RNA, 13 nt, Homo sapiens
acaggaguguccu

SEQ ID NO: 1603193 - RNA, 15 nt, Homo sapiens
acaggcaaauguacu

SEQ ID NO: 1603194 - RNA, 13 nt, Homo sapiens
acaggcaccugcc

SEQ ID NO: 1603195 - RNA, 22 nt, Homo sapiens
acaggcagccagccguggccag

SEQ ID NO: 1603196 - RNA, 18 nt, Homo sapiens
acaggcagucucucucuu

SEQ ID NO: 1603197 - RNA, 20 nt, Homo sapiens
acaggcauauucccugcaca

SEQ ID NO: 1603198 - RNA, 14 nt, Homo sapiens
acaggccugagauu

SEQ ID NO: 1603199 - RNA, 17 nt, Homo sapiens
acaggccugagauuuca

SEQ ID NO: 1603200 - RNA, 20 nt, Homo sapiens
acaggcugagaacucguuca

SEQ ID NO: 1603201 - RNA, 18 nt, Homo sapiens
acagggaagaaacuuucu

SEQ ID NO: 1603202 - RNA, 20 nt, Homo sapiens
acagggacaugcccugugug

SEQ ID NO: 1603203 - RNA, 15 nt, Homo sapiens
acagggagugcacau

SEQ ID NO: 1603204 - RNA, 21 nt, Homo sapiens
acagggcuucucucaggccca

SEQ ID NO: 1603205 - RNA, 17 nt, Homo sapiens
acagggucuugcucugu

SEQ ID NO: 1603206 - RNA, 19 nt, Homo sapiens
acaggguggcccaaauaga

SEQ ID NO: 1603207 - RNA, 19 nt, Homo sapiens
acaggguuucaccauguua

SEQ ID NO: 1603208 - RNA, 20 nt, Homo sapiens
acaggucuagaaaaccagcu

SEQ ID NO: 1603209 - RNA, 18 nt, Homo sapiens
acagguuauaacaguguu

SEQ ID NO: 1603210 - RNA, 17 nt, Homo sapiens
acagguucuuaaaaagg

SEQ ID NO: 1603211 - RNA, 15 nt, Homo sapiens
acaguaaacacucca

SEQ ID NO: 1603212 - RNA, 16 nt, Homo sapiens
acaguaaacacuccac

SEQ ID NO: 1603213 - RNA, 15 nt, Homo sapiens
acaguacagaaggca

SEQ ID NO: 1603214 - RNA, 18 nt, Homo sapiens
acaguaccggauucucuc

SEQ ID NO: 1603215 - RNA, 21 nt, Homo sapiens
acaguaucaguauuuucacac

SEQ ID NO: 1603216 - RNA, 15 nt, Homo sapiens
acaguauuacagugu

SEQ ID NO: 1603217 - RNA, 22 nt, Homo sapiens
acagucaaaaccaagucacuua

SEQ ID NO: 1603218 - RNA, 18 nt, Homo sapiens
acagucaaaauguuugau

SEQ ID NO: 1603219 - RNA, 15 nt, Homo sapiens
acagucacauuccaa

SEQ ID NO: 1603220 - RNA, 16 nt, Homo sapiens
acagucacugauguac

SEQ ID NO: 1603221 - RNA, 12 nt, Homo sapiens
acagucacugga

SEQ ID NO: 1603222 - RNA, 16 nt, Homo sapiens
acagucacuggaaaga

SEQ ID NO: 1603223 - RNA, 14 nt, Homo sapiens
acagucccacugug

SEQ ID NO: 1603224 - RNA, 15 nt, Homo sapiens
acagucccuauggaa

SEQ ID NO: 1603225 - RNA, 14 nt, Homo sapiens
acagucuagugcaa

SEQ ID NO: 1603226 - RNA, 14 nt, Homo sapiens
acagugaacacuca

SEQ ID NO: 1603227 - RNA, 18 nt, Homo sapiens
acagugaagcagcacugu

SEQ ID NO: 1603228 - RNA, 19 nt, Homo sapiens
acagugaagcagcacugug

SEQ ID NO: 1603229 - RNA, 20 nt, Homo sapiens
acagugaagcagcacuguga

SEQ ID NO: 1603230 - RNA, 22 nt, Homo sapiens
acagugaagcagcacugugagu

SEQ ID NO: 1603231 - RNA, 19 nt, Homo sapiens
acagugagacucugucuca

SEQ ID NO: 1603232 - RNA, 14 nt, Homo sapiens
acagugcaucucag

SEQ ID NO: 1603233 - RNA, 13 nt, Homo sapiens
acaguuacaguug

SEQ ID NO: 1603234 - RNA, 18 nt, Homo sapiens
acaguugguucaucccuu

SEQ ID NO: 1603235 - RNA, 22 nt, Homo sapiens
acaguuguguuccugacacuca

SEQ ID NO: 1603236 - RNA, 18 nt, Homo sapiens
acaguuuaucaugaagcc

SEQ ID NO: 1603237 - RNA, 17 nt, Homo sapiens
acaguuuuaacugugga

SEQ ID NO: 1603238 - RNA, 21 nt, Homo sapiens
acauaacagugcagggcaaaa

SEQ ID NO: 1603239 - RNA, 12 nt, Homo sapiens
auaccagcaaua

SEQ ID NO: 1603240 - RNA, 14 nt, Homo sapiens
auaccuaucaucuu

SEQ ID NO: 1603241 - RNA, 20 nt, Homo sapiens
auaccuggcccugugccuug

SEQ ID NO: 1603242 - RNA, 19 nt, Homo sapiens
auacugcacuuauuuguca

SEQ ID NO: 1603243 - RNA, 20 nt, Homo sapiens
auacugguuuauggaacuuu

SEQ ID NO: 1603244 - RNA, 19 nt, Homo sapiens
auacuucucuauuaucuca

SEQ ID NO: 1603245 - RNA, 18 nt, Homo sapiens
auacuuggaccucagcca

SEQ ID NO: 1603246 - RNA, 12 nt, Homo sapiens
auacuuuacuuu

SEQ ID NO: 1603247 - RNA, 23 nt, Homo sapiens
auacuuuauaucuguaaugauac

SEQ ID NO: 1603248 - RNA, 15 nt, Homo sapiens
auacuuuugcuuuca

SEQ ID NO: 1603249 - RNA, 21 nt, Homo sapiens
auacuuuugcuuucagggaaa

SEQ ID NO: 1603250 - RNA, 15 nt, Homo sapiens
auagaacacaguuug

SEQ ID NO: 1603251 - RNA, 15 nt, Homo sapiens
auagaagaaaaucca

SEQ ID NO: 1603252 - RNA, 18 nt, Homo sapiens
auagaagagaagagccau

SEQ ID NO: 1603253 - RNA, 17 nt, Homo sapiens
auagaagugcauucucc

SEQ ID NO: 1603254 - RNA, 21 nt, Homo sapiens
auagaaugagcacccauucca

SEQ ID NO: 1603255 - RNA, 15 nt, Homo sapiens
auagaauucagucaa

SEQ ID NO: 1603256 - RNA, 18 nt, Homo sapiens
auagacacugaucuggcu

SEQ ID NO: 1603257 - RNA, 14 nt, Homo sapiens
auagacauugcaaa

SEQ ID NO: 1603258 - RNA, 12 nt, Homo sapiens
auagaccacugg

SEQ ID NO: 1603259 - RNA, 20 nt, Homo sapiens
auagacugcuacagguaaua

SEQ ID NO: 1603260 - RNA, 21 nt, Homo sapiens
auagagauagcuacaguguaa

SEQ ID NO: 1603261 - RNA, 12 nt, Homo sapiens
auagaggcuagc

SEQ ID NO: 1603262 - RNA, 15 nt, Homo sapiens
auagaugucagcaau

SEQ ID NO: 1603263 - RNA, 15 nt, Homo sapiens
auagaugucuuuuau

SEQ ID NO: 1603264 - RNA, 19 nt, Homo sapiens
auagauuacugaugugaua

SEQ ID NO: 1603265 - RNA, 20 nt, Homo sapiens
auagauuucuacacugaggu

SEQ ID NO: 1603266 - RNA, 21 nt, Homo sapiens
auagauuuucugcuacuuugc

SEQ ID NO: 1603267 - RNA, 18 nt, Homo sapiens
auagcaagaccucaucuc

SEQ ID NO: 1603268 - RNA, 15 nt, Homo sapiens
auagcaagugaaagc

SEQ ID NO: 1603269 - RNA, 23 nt, Homo sapiens
auagcaccccuacucacauacac

SEQ ID NO: 1603270 - RNA, 15 nt, Homo sapiens
auagcaccuccacau

SEQ ID NO: 1603271 - RNA, 21 nt, Homo sapiens
auagcauuuggagauauaccu

SEQ ID NO: 1603272 - RNA, 22 nt, Homo sapiens
auagcgugcaguagagagcaaa

SEQ ID NO: 1603273 - RNA, 18 nt, Homo sapiens
auagcuaaguacacaaua

SEQ ID NO: 1603274 - RNA, 20 nt, Homo sapiens
auagcuccucaaagccucaa

SEQ ID NO: 1603275 - RNA, 15 nt, Homo sapiens
auagcuuaaaacacu

SEQ ID NO: 1603276 - RNA, 12 nt, Homo sapiens
auagcuucagga

SEQ ID NO: 1603277 - RNA, 22 nt, Homo sapiens
auagcuugucuucguccaucug

SEQ ID NO: 1603278 - RNA, 16 nt, Homo sapiens
auaggaaaaaaacugg

SEQ ID NO: 1603279 - RNA, 18 nt, Homo sapiens
auaggauuuucacacauu

SEQ ID NO: 1603280 - RNA, 16 nt, Homo sapiens
auaggccuuagcagua

SEQ ID NO: 1603281 - RNA, 22 nt, Homo sapiens
auagggagacccccaucuuuac

SEQ ID NO: 1603282 - RNA, 21 nt, Homo sapiens
auagggcaugauuaacaaagc

SEQ ID NO: 1603283 - RNA, 23 nt, Homo sapiens
auagggcaugauuaacaaagcaa

SEQ ID NO: 1603284 - RNA, 20 nt, Homo sapiens
auagggucggaggugcuguc

SEQ ID NO: 1603285 - RNA, 20 nt, Homo sapiens
auaggucuuucucucaguga

SEQ ID NO: 1603286 - RNA, 20 nt, Homo sapiens
auaggugcuacaaaaacaca

SEQ ID NO: 1603287 - RNA, 17 nt, Homo sapiens
auaggugguauggagcu

SEQ ID NO: 1603288 - RNA, 17 nt, Homo sapiens
auagguugagcaauuuc

SEQ ID NO: 1603289 - RNA, 13 nt, Homo sapiens
auaguacuauuac

SEQ ID NO: 1603290 - RNA, 15 nt, Homo sapiens
auagucccacuacuu

SEQ ID NO: 1603291 - RNA, 22 nt, Homo sapiens
auagugcuucacaaaaugcacu

SEQ ID NO: 1603292 - RNA, 23 nt, Homo sapiens
auagugcuucacaaaaugcacuu

SEQ ID NO: 1603293 - RNA, 21 nt, Homo sapiens
auagugggguuccaugaguua

SEQ ID NO: 1603294 - RNA, 17 nt, Homo sapiens
auaguguagcugaggag

SEQ ID NO: 1603295 - RNA, 15 nt, Homo sapiens
auaguguauuuugca

SEQ ID NO: 1603296 - RNA, 22 nt, Homo sapiens
auagugucauccucacagugaa

SEQ ID NO: 1603297 - RNA, 21 nt, Homo sapiens
auaguguucacaaacugugaa

SEQ ID NO: 1603298 - RNA, 16 nt, Homo sapiens
auaguuuacacacugu

SEQ ID NO: 1603299 - RNA, 15 nt, Homo sapiens
auauaaaaaaucaug

SEQ ID NO: 1603300 - RNA, 18 nt, Homo sapiens
auauaaacaugcuugcau

SEQ ID NO: 1603301 - RNA, 12 nt, Homo sapiens
auauaaaccugg

SEQ ID NO: 1603302 - RNA, 16 nt, Homo sapiens
auauaauuucaaacca

SEQ ID NO: 1603303 - RNA, 23 nt, Homo sapiens
auauaauuuugaaaaguaaaaau

SEQ ID NO: 1603304 - RNA, 11 nt, Homo sapiens
auauaccaaau

SEQ ID NO: 1603305 - RNA, 18 nt, Homo sapiens
auauacugguucacaucc

SEQ ID NO: 1603306 - RNA, 13 nt, Homo sapiens
auauagccaauau

SEQ ID NO: 1603307 - RNA, 19 nt, Homo sapiens
auauauauuuuugugcaca

SEQ ID NO: 1603308 - RNA, 15 nt, Homo sapiens
auauaucacuaagcu

SEQ ID NO: 1603309 - RNA, 13 nt, Homo sapiens
auauauccaagaa

SEQ ID NO: 1603310 - RNA, 15 nt, Homo sapiens
auauaucuaccccag

SEQ ID NO: 1603311 - RNA, 23 nt, Homo sapiens
auauaugauauauaaaugugauu

SEQ ID NO: 1603312 - RNA, 19 nt, Homo sapiens
auauauguguauacauaca

SEQ ID NO: 1603313 - RNA, 12 nt, Homo sapiens
auauauugaacu

SEQ ID NO: 1603314 - RNA, 20 nt, Homo sapiens
auauauuuaaaaauaaguca

SEQ ID NO: 1603315 - RNA, 17 nt, Homo sapiens
auauauuuuuaccaucu

SEQ ID NO: 1603316 - RNA, 20 nt, Homo sapiens
auaucaaaaaaccuuuacag

SEQ ID NO: 1603317 - RNA, 13 nt, Homo sapiens
auaucaacucuga

SEQ ID NO: 1603318 - RNA, 20 nt, Homo sapiens
auaucaauauuuucugcaau

SEQ ID NO: 1603319 - RNA, 15 nt, Homo sapiens
auaucacgacagauu

SEQ ID NO: 1603320 - RNA, 21 nt, Homo sapiens
auaucagcuuuucugauggua

SEQ ID NO: 1603321 - RNA, 18 nt, Homo sapiens
auaucauccacacaugaa

SEQ ID NO: 1603322 - RNA, 19 nt, Homo sapiens
auaucaugcacacaauuag

SEQ ID NO: 1603323 - RNA, 13 nt, Homo sapiens
auauccaagaagc

SEQ ID NO: 1603324 - RNA, 23 nt, Homo sapiens
auauccaagaagcaugcagagaa

SEQ ID NO: 1603325 - RNA, 18 nt, Homo sapiens
auaucccuuccucucagg

SEQ ID NO: 1603326 - RNA, 16 nt, Homo sapiens
auaucgaaauaguuac

SEQ ID NO: 1603327 - RNA, 18 nt, Homo sapiens
auaucuauaguagacaca

SEQ ID NO: 1603328 - RNA, 20 nt, Homo sapiens
auaucuauuauucaaaaaau

SEQ ID NO: 1603329 - RNA, 23 nt, Homo sapiens
auaucuccauggcccugucccag

SEQ ID NO: 1603330 - RNA, 15 nt, Homo sapiens
auaucugcuguccag

SEQ ID NO: 1603331 - RNA, 19 nt, Homo sapiens
auaucuuacaaaauacaca

SEQ ID NO: 1603332 - RNA, 16 nt, Homo sapiens
auaugaaaaucuccau

SEQ ID NO: 1603333 - RNA, 20 nt, Homo sapiens
auaugaaaaucuccaucuca

SEQ ID NO: 1603334 - RNA, 17 nt, Homo sapiens
auaugaagaacugagga

SEQ ID NO: 1603335 - RNA, 15 nt, Homo sapiens
auaugaaggauuacu

SEQ ID NO: 1603336 - RNA, 17 nt, Homo sapiens
auaugaaggauuacucu

SEQ ID NO: 1603337 - RNA, 14 nt, Homo sapiens
auaugacaauguug

SEQ ID NO: 1603338 - RNA, 19 nt, Homo sapiens
auaugacuaaguucacuaa

SEQ ID NO: 1603339 - RNA, 14 nt, Homo sapiens
auaugcaagcagcu

SEQ ID NO: 1603340 - RNA, 15 nt, Homo sapiens
auaugcaagcagcuu

SEQ ID NO: 1603341 - RNA, 14 nt, Homo sapiens
auaugcacuugaaa

SEQ ID NO: 1603342 - RNA, 20 nt, Homo sapiens
auaugcaucuacuuggcaag

SEQ ID NO: 1603343 - RNA, 13 nt, Homo sapiens
auaugcgcuuaaa

SEQ ID NO: 1603344 - RNA, 17 nt, Homo sapiens
auauggacacuacacug

SEQ ID NO: 1603345 - RNA, 14 nt, Homo sapiens
auaugggaggaaca

SEQ ID NO: 1603346 - RNA, 15 nt, Homo sapiens
auaugguagagcaau

SEQ ID NO: 1603347 - RNA, 15 nt, Homo sapiens
auauggucauauaca

SEQ ID NO: 1603348 - RNA, 15 nt, Homo sapiens
auauguaaagcacau

SEQ ID NO: 1603349 - RNA, 16 nt, Homo sapiens
auauguauuuaccaaa

SEQ ID NO: 1603350 - RNA, 19 nt, Homo sapiens
auauguugcuuugaaaaag

SEQ ID NO: 1603351 - RNA, 19 nt, Homo sapiens
auauuaagacaauagcacu

SEQ ID NO: 1603352 - RNA, 21 nt, Homo sapiens
auauucacugggccaauucaa

SEQ ID NO: 1603353 - RNA, 13 nt, Homo sapiens
auauucauauaca

SEQ ID NO: 1603354 - RNA, 13 nt, Homo sapiens
auauuccuaugcu

SEQ ID NO: 1603355 - RNA, 20 nt, Homo sapiens
auauugcuuccuguguaaca

SEQ ID NO: 1603356 - RNA, 17 nt, Homo sapiens
auauugucugucucuau

SEQ ID NO: 1603357 - RNA, 23 nt, Homo sapiens
auccucucccccuccuccaggga

SEQ ID NO: 1603358 - RNA, 19 nt, Homo sapiens
auccucuuccuccccaguc

SEQ ID NO: 1603359 - RNA, 18 nt, Homo sapiens
auccugagugugaugaac

SEQ ID NO: 1603360 - RNA, 17 nt, Homo sapiens
auccuggccuuguacuu

SEQ ID NO: 1603361 - RNA, 15 nt, Homo sapiens
auccuucuaagacau

SEQ ID NO: 1603362 - RNA, 21 nt, Homo sapiens
auccuugggagucauuaccac

SEQ ID NO: 1603363 - RNA, 13 nt, Homo sapiens
auccuuuuaucuc

SEQ ID NO: 1603364 - RNA, 16 nt, Homo sapiens
aucgaaucuacuaauu

SEQ ID NO: 1603365 - RNA, 11 nt, Homo sapiens
aucgacaagaa

SEQ ID NO: 1603366 - RNA, 20 nt, Homo sapiens
aucgacuuagccugagucau

SEQ ID NO: 1603367 - RNA, 19 nt, Homo sapiens
aucgagaccauccuggcua

SEQ ID NO: 1603368 - RNA, 14 nt, Homo sapiens
aucgagacugcaau

SEQ ID NO: 1603369 - RNA, 12 nt, Homo sapiens
aucgaugugcuc

SEQ ID NO: 1603370 - RNA, 12 nt, Homo sapiens
aucuaaacuaga

SEQ ID NO: 1603371 - RNA, 18 nt, Homo sapiens
aucuacaaaaauuuauua

SEQ ID NO: 1603372 - RNA, 13 nt, Homo sapiens
aucuacaagccaa

SEQ ID NO: 1603373 - RNA, 15 nt, Homo sapiens
aucuaccaagaacag

SEQ ID NO: 1603374 - RNA, 14 nt, Homo sapiens
aucuaccacuguau

SEQ ID NO: 1603375 - RNA, 14 nt, Homo sapiens
aucuaccagcauaa

SEQ ID NO: 1603376 - RNA, 16 nt, Homo sapiens
aucuacuaauuccaca

SEQ ID NO: 1603377 - RNA, 21 nt, Homo sapiens
aucuacuacaaacuucaaaga

SEQ ID NO: 1603378 - RNA, 15 nt, Homo sapiens
aucuacuucuacauc

SEQ ID NO: 1603379 - RNA, 22 nt, Homo sapiens
aucuacuuggcaaggucauaga

SEQ ID NO: 1603380 - RNA, 19 nt, Homo sapiens
aucuagaagagucuauugu

SEQ ID NO: 1603381 - RNA, 13 nt, Homo sapiens
aucuagcauuuau

SEQ ID NO: 1603382 - RNA, 15 nt, Homo sapiens
aucuaggaugugaug

SEQ ID NO: 1603383 - RNA, 14 nt, Homo sapiens
aucuaguucauuga

SEQ ID NO: 1603384 - RNA, 18 nt, Homo sapiens
aucuauaguagacacacu

SEQ ID NO: 1603385 - RNA, 15 nt, Homo sapiens
aucuauuuguacaau

SEQ ID NO: 1603386 - RNA, 18 nt, Homo sapiens
aucuauuuugaugcagca

SEQ ID NO: 1603387 - RNA, 21 nt, Homo sapiens
aucuauuuugaugcagcauuu

SEQ ID NO: 1603388 - RNA, 16 nt, Homo sapiens
aucucaaagaaggcau

SEQ ID NO: 1603389 - RNA, 13 nt, Homo sapiens
aucucacaaauaa

SEQ ID NO: 1603390 - RNA, 19 nt, Homo sapiens
aucucaccuuuuuaaaucc

SEQ ID NO: 1603391 - RNA, 15 nt, Homo sapiens
aucucagaguccacu

SEQ ID NO: 1603392 - RNA, 12 nt, Homo sapiens
aucucaggugag

SEQ ID NO: 1603393 - RNA, 20 nt, Homo sapiens
aucucaugccagugccuuau

SEQ ID NO: 1603394 - RNA, 15 nt, Homo sapiens
aucucauuccacugu

SEQ ID NO: 1603395 - RNA, 23 nt, Homo sapiens
aucucauucccagagucagagga

SEQ ID NO: 1603396 - RNA, 23 nt, Homo sapiens
aucucauuggacccuuccauggu

SEQ ID NO: 1603397 - RNA, 17 nt, Homo sapiens
aucucauuuaagggaaa

SEQ ID NO: 1603398 - RNA, 16 nt, Homo sapiens
aucuccccucagauuc

SEQ ID NO: 1603399 - RNA, 21 nt, Homo sapiens
aucuccccucagauuccaccu

SEQ ID NO: 1603400 - RNA, 23 nt, Homo sapiens
aucuccccucucaccucauuccc

SEQ ID NO: 1603401 - RNA, 18 nt, Homo sapiens
aucucccucuaagcacau

SEQ ID NO: 1603402 - RNA, 17 nt, Homo sapiens
aucucggcucacugcaa

SEQ ID NO: 1603403 - RNA, 22 nt, Homo sapiens
aucucggcucacugcaaccucu

SEQ ID NO: 1603404 - RNA, 19 nt, Homo sapiens
aucucggcucacugcaagu

SEQ ID NO: 1603405 - RNA, 18 nt, Homo sapiens
aucucuacuaaaaacaca

SEQ ID NO: 1603406 - RNA, 16 nt, Homo sapiens
aucucuagaaagcucu

SEQ ID NO: 1603407 - RNA, 20 nt, Homo sapiens
aucucucaaaacaauauuac

SEQ ID NO: 1603408 - RNA, 16 nt, Homo sapiens
aucucuguuucuucaa

SEQ ID NO: 1603409 - RNA, 14 nt, Homo sapiens
aucucuucuggccg

SEQ ID NO: 1603410 - RNA, 20 nt, Homo sapiens
aucugaaaauaaagugucau

SEQ ID NO: 1603411 - RNA, 21 nt, Homo sapiens
aucugaaagugguacuugauc

SEQ ID NO: 1603412 - RNA, 15 nt, Homo sapiens
aucugaacauuuacu

SEQ ID NO: 1603413 - RNA, 13 nt, Homo sapiens
aucugaacuccuu

SEQ ID NO: 1603414 - RNA, 13 nt, Homo sapiens
aucugacaaaaug

SEQ ID NO: 1603415 - RNA, 17 nt, Homo sapiens
aucugagaggccacagu

SEQ ID NO: 1603416 - RNA, 21 nt, Homo sapiens
aucugcacaacugacuuccaa

SEQ ID NO: 1603417 - RNA, 18 nt, Homo sapiens
aucugcacagucacuggc

SEQ ID NO: 1603418 - RNA, 22 nt, Homo sapiens
aucugccaagggccgacuaaga

SEQ ID NO: 1603419 - RNA, 23 nt, Homo sapiens
aucugcuuccauuaaaagcauaa

SEQ ID NO: 1603420 - RNA, 20 nt, Homo sapiens
aucugcuuuuuauuuuacaa

SEQ ID NO: 1603421 - RNA, 16 nt, Homo sapiens
aucuggcuuagugcca

SEQ ID NO: 1603422 - RNA, 17 nt, Homo sapiens
aucuggcuuagugccac

SEQ ID NO: 1603423 - RNA, 22 nt, Homo sapiens
aucuggcuuagugccacccacc

SEQ ID NO: 1603424 - RNA, 18 nt, Homo sapiens
aucugggcugugggcaag

SEQ ID NO: 1603425 - RNA, 20 nt, Homo sapiens
aucuggguuaauucauuugg

SEQ ID NO: 1603426 - RNA, 14 nt, Homo sapiens
aucuguaacagcau

SEQ ID NO: 1603427 - RNA, 15 nt, Homo sapiens
aucuguaaugauacu

SEQ ID NO: 1603428 - RNA, 15 nt, Homo sapiens
aucuguacuuugugu

SEQ ID NO: 1603429 - RNA, 18 nt, Homo sapiens
aucuguaggguugacaaa

SEQ ID NO: 1603430 - RNA, 15 nt, Homo sapiens
aucugucacauaaaa

SEQ ID NO: 1603431 - RNA, 23 nt, Homo sapiens
aucuguucgauugaaauuuugca

SEQ ID NO: 1603432 - RNA, 14 nt, Homo sapiens
aucuguuuguaauc

SEQ ID NO: 1603433 - RNA, 14 nt, Homo sapiens
aucuuaagauccac

SEQ ID NO: 1603434 - RNA, 16 nt, Homo sapiens
aucuuaguguucaaaa

SEQ ID NO: 1603435 - RNA, 17 nt, Homo sapiens
aucuuaguucuguauau

SEQ ID NO: 1603436 - RNA, 18 nt, Homo sapiens
aucuuauacuguacaaua

SEQ ID NO: 1603437 - RNA, 19 nt, Homo sapiens
aucuuauacuguacaauaa

SEQ ID NO: 1603438 - RNA, 13 nt, Homo sapiens
aucuucacugcaa

SEQ ID NO: 1603439 - RNA, 13 nt, Homo sapiens
aucuucaggccau

SEQ ID NO: 1603440 - RNA, 22 nt, Homo sapiens
aucuucagggaacugcauagau

SEQ ID NO: 1603441 - RNA, 17 nt, Homo sapiens
aucuuccaaauccaaaa

SEQ ID NO: 1603442 - RNA, 19 nt, Homo sapiens
aucuuccccaagagggacu

SEQ ID NO: 1603443 - RNA, 12 nt, Homo sapiens
aucuuccuuccu

SEQ ID NO: 1603444 - RNA, 13 nt, Homo sapiens
aucuuccuuccuc

SEQ ID NO: 1603445 - RNA, 16 nt, Homo sapiens
aucuucuucaccauuu

SEQ ID NO: 1603446 - RNA, 20 nt, Homo sapiens
aucuugcuucugcuucucau

SEQ ID NO: 1603447 - RNA, 23 nt, Homo sapiens
aucuuguguaagguuuugguuau

SEQ ID NO: 1603448 - RNA, 20 nt, Homo sapiens
aucuuguuuauagcaaaaau

SEQ ID NO: 1603449 - RNA, 19 nt, Homo sapiens
aucuuguuuguuacuguca

SEQ ID NO: 1603450 - RNA, 18 nt, Homo sapiens
aucuuuaaaauacacacu

SEQ ID NO: 1603451 - RNA, 22 nt, Homo sapiens
aucuuuaucaugaagcacauca

SEQ ID NO: 1603452 - RNA, 23 nt, Homo sapiens
aucuuuaucaugaagcacaucaa

SEQ ID NO: 1603453 - RNA, 14 nt, Homo sapiens
aucuuucauccuug

SEQ ID NO: 1603454 - RNA, 19 nt, Homo sapiens
aucuuucauccuugacuaa

SEQ ID NO: 1603455 - RNA, 16 nt, Homo sapiens
aucuuucuccuugaau

SEQ ID NO: 1603456 - RNA, 19 nt, Homo sapiens
aucuuucugcacacaaaua

SEQ ID NO: 1603457 - RNA, 15 nt, Homo sapiens
aucuuugacugaaaa

SEQ ID NO: 1603458 - RNA, 17 nt, Homo sapiens
aucuuugagaccaucca

SEQ ID NO: 1603459 - RNA, 15 nt, Homo sapiens
aucuuugagcccauu

SEQ ID NO: 1603460 - RNA, 18 nt, Homo sapiens
aucuuugauucuccuuca

SEQ ID NO: 1603461 - RNA, 13 nt, Homo sapiens
aucuuugcuguua

SEQ ID NO: 1603462 - RNA, 20 nt, Homo sapiens
aucuuuguauucuucaugaa

SEQ ID NO: 1603463 - RNA, 16 nt, Homo sapiens
aucuuuucauuaaaga

SEQ ID NO: 1603464 - RNA, 19 nt, Homo sapiens
aucuuuuuaccuuucauac

SEQ ID NO: 1603465 - RNA, 13 nt, Homo sapiens
augaaaacaaaua

SEQ ID NO: 1603466 - RNA, 20 nt, Homo sapiens
augaaaaccguaaagugccu

SEQ ID NO: 1603467 - RNA, 12 nt, Homo sapiens
augaaaagccaa

SEQ ID NO: 1603468 - RNA, 18 nt, Homo sapiens
augaaaaucuccaucuca

SEQ ID NO: 1603469 - RNA, 18 nt, Homo sapiens
augaaaguauuggcauuc

SEQ ID NO: 1603470 - RNA, 21 nt, Homo sapiens
augaaauaaaagaaacaaaug

SEQ ID NO: 1603471 - RNA, 21 nt, Homo sapiens
augaaauccagugagcacuag

SEQ ID NO: 1603472 - RNA, 12 nt, Homo sapiens
augaaaugccaa

SEQ ID NO: 1603473 - RNA, 13 nt, Homo sapiens
augaaaugccaaa

SEQ ID NO: 1603474 - RNA, 13 nt, Homo sapiens
augaacacuuuuu

SEQ ID NO: 1603475 - RNA, 16 nt, Homo sapiens
auggcaggacagcucc

SEQ ID NO: 1603476 - RNA, 14 nt, Homo sapiens
auggcauauggucc

SEQ ID NO: 1603477 - RNA, 15 nt, Homo sapiens
auggccagagccucu

SEQ ID NO: 1603478 - RNA, 17 nt, Homo sapiens
auggcccugcaaaagga

SEQ ID NO: 1603479 - RNA, 21 nt, Homo sapiens
auggccuggugagacugucca

SEQ ID NO: 1603480 - RNA, 16 nt, Homo sapiens
auggccuucauaucau

SEQ ID NO: 1603481 - RNA, 15 nt, Homo sapiens
auggcuaauaccugu

SEQ ID NO: 1603482 - RNA, 16 nt, Homo sapiens
auggcuaguaucaaaa

SEQ ID NO: 1603483 - RNA, 19 nt, Homo sapiens
auggcuuaagccuguguau

SEQ ID NO: 1603484 - RNA, 14 nt, Homo sapiens
augggaccagggau

SEQ ID NO: 1603485 - RNA, 16 nt, Homo sapiens
augggacucugagaac

SEQ ID NO: 1603486 - RNA, 22 nt, Homo sapiens
augggacucugagaacuccuca

SEQ ID NO: 1603487 - RNA, 17 nt, Homo sapiens
augggauuacauguuau

SEQ ID NO: 1603488 - RNA, 19 nt, Homo sapiens
augggcagagcccaaggga

SEQ ID NO: 1603489 - RNA, 21 nt, Homo sapiens
augggcagcccaacagcacuu

SEQ ID NO: 1603490 - RNA, 14 nt, Homo sapiens
augggccagaguug

SEQ ID NO: 1603491 - RNA, 19 nt, Homo sapiens
augggccuuuaagaaccuu

SEQ ID NO: 1603492 - RNA, 22 nt, Homo sapiens
augggggaaaauuauuuugaca

SEQ ID NO: 1603493 - RNA, 21 nt, Homo sapiens
augggggacaggauuuggcca

SEQ ID NO: 1603494 - RNA, 15 nt, Homo sapiens
augggggcaucucuu

SEQ ID NO: 1603495 - RNA, 14 nt, Homo sapiens
augggucuaggaca

SEQ ID NO: 1603496 - RNA, 20 nt, Homo sapiens
augggugaacuuacuugcau

SEQ ID NO: 1603497 - RNA, 23 nt, Homo sapiens
augguacuuccucugugaacugu

SEQ ID NO: 1603498 - RNA, 14 nt, Homo sapiens
augguagagcaaua

SEQ ID NO: 1603499 - RNA, 23 nt, Homo sapiens
augguaugccaacuuaaguauuu

SEQ ID NO: 1603500 - RNA, 18 nt, Homo sapiens
augguaugugggugaccc

SEQ ID NO: 1603501 - RNA, 14 nt, Homo sapiens
auggucacaguaaa

SEQ ID NO: 1603502 - RNA, 21 nt, Homo sapiens
auggucacccaacucaaggac

SEQ ID NO: 1603503 - RNA, 21 nt, Homo sapiens
auggucacgagguccagaccc

SEQ ID NO: 1603504 - RNA, 15 nt, Homo sapiens
augguccagugucau

SEQ ID NO: 1603505 - RNA, 17 nt, Homo sapiens
auggucucuaccuaaug

SEQ ID NO: 1603506 - RNA, 19 nt, Homo sapiens
auggugaaaccccgucucu

SEQ ID NO: 1603507 - RNA, 21 nt, Homo sapiens
auggugagagauaagaucuau

SEQ ID NO: 1603508 - RNA, 19 nt, Homo sapiens
augguggacucgccuguaa

SEQ ID NO: 1603509 - RNA, 23 nt, Homo sapiens
augguggagggccacaugggagg

SEQ ID NO: 1603510 - RNA, 13 nt, Homo sapiens
auggugucauuua

SEQ ID NO: 1603511 - RNA, 15 nt, Homo sapiens
auggugucugugaca

SEQ ID NO: 1603512 - RNA, 21 nt, Homo sapiens
auggugucugugacauuuccu

SEQ ID NO: 1603513 - RNA, 23 nt, Homo sapiens
augguucucagaaccauuucacc

SEQ ID NO: 1603514 - RNA, 13 nt, Homo sapiens
auguaaacuacuu

SEQ ID NO: 1603515 - RNA, 22 nt, Homo sapiens
auguaaagaacgcgacuuccac

SEQ ID NO: 1603516 - RNA, 16 nt, Homo sapiens
auguaaaggccuuuaa

SEQ ID NO: 1603517 - RNA, 17 nt, Homo sapiens
auguaaauagaugacaa

SEQ ID NO: 1603518 - RNA, 16 nt, Homo sapiens
auguaaauugcaaaua

SEQ ID NO: 1603519 - RNA, 23 nt, Homo sapiens
auguaacauguaggaaguaggaa

SEQ ID NO: 1603520 - RNA, 19 nt, Homo sapiens
auguaauaaagugaacuuu

SEQ ID NO: 1603521 - RNA, 23 nt, Homo sapiens
auguaauaaguaucacacuguau

SEQ ID NO: 1603522 - RNA, 19 nt, Homo sapiens
auguaauggaacuuagcca

SEQ ID NO: 1603523 - RNA, 17 nt, Homo sapiens
auguacaccacaugcua

SEQ ID NO: 1603524 - RNA, 16 nt, Homo sapiens
auguacagacauauuu

SEQ ID NO: 1603525 - RNA, 16 nt, Homo sapiens
auguacauuacagauu

SEQ ID NO: 1603526 - RNA, 14 nt, Homo sapiens
auguaccagcaucu

SEQ ID NO: 1603527 - RNA, 23 nt, Homo sapiens
auguaccuucuuucacucuguca

SEQ ID NO: 1603528 - RNA, 13 nt, Homo sapiens
auguagcacuuac

SEQ ID NO: 1603529 - RNA, 21 nt, Homo sapiens
auguagccagcugugcacuuu

SEQ ID NO: 1603530 - RNA, 22 nt, Homo sapiens
auguagggguuaacuuggucag

SEQ ID NO: 1603531 - RNA, 20 nt, Homo sapiens
auguaguuuuuauauguugu

SEQ ID NO: 1603532 - RNA, 21 nt, Homo sapiens
auguaguuuuuauauguugua

SEQ ID NO: 1603533 - RNA, 14 nt, Homo sapiens
auguauaccagccu

SEQ ID NO: 1603534 - RNA, 19 nt, Homo sapiens
auguaucuauuuguacaau

SEQ ID NO: 1603535 - RNA, 22 nt, Homo sapiens
auguaugcaaaccucaucuuuc

SEQ ID NO: 1603536 - RNA, 14 nt, Homo sapiens
auguaugcaugcac

SEQ ID NO: 1603537 - RNA, 21 nt, Homo sapiens
auguaugcugauuuacuacuu

SEQ ID NO: 1603538 - RNA, 16 nt, Homo sapiens
auguauguacaauaca

SEQ ID NO: 1603539 - RNA, 23 nt, Homo sapiens
auguauguguaaaacaaucuguu

SEQ ID NO: 1603540 - RNA, 15 nt, Homo sapiens
auguauucuuggcua

SEQ ID NO: 1603541 - RNA, 14 nt, Homo sapiens
auguauuuucauag

SEQ ID NO: 1603542 - RNA, 13 nt, Homo sapiens
augucaccaccuu

SEQ ID NO: 1603543 - RNA, 21 nt, Homo sapiens
augucacucuggucccuuuaa

SEQ ID NO: 1603544 - RNA, 16 nt, Homo sapiens
augucagggcacaugu

SEQ ID NO: 1603545 - RNA, 16 nt, Homo sapiens
augucagugucacugg

SEQ ID NO: 1603546 - RNA, 18 nt, Homo sapiens
augucagugucacuggau

SEQ ID NO: 1603547 - RNA, 15 nt, Homo sapiens
augucauaaagugag

SEQ ID NO: 1603548 - RNA, 16 nt, Homo sapiens
augucaucaagcucca

SEQ ID NO: 1603549 - RNA, 20 nt, Homo sapiens
augucauuuugguacuuugg

SEQ ID NO: 1603550 - RNA, 12 nt, Homo sapiens
auguccaaagag

SEQ ID NO: 1603551 - RNA, 16 nt, Homo sapiens
auguccauaugcaucu

SEQ ID NO: 1603552 - RNA, 22 nt, Homo sapiens
augucuaccuggcagauacuca

SEQ ID NO: 1603553 - RNA, 18 nt, Homo sapiens
augucucuugagcaucaa

SEQ ID NO: 1603554 - RNA, 16 nt, Homo sapiens
augucugccuaugcac

SEQ ID NO: 1603555 - RNA, 20 nt, Homo sapiens
augucugccuaugcacugaa

SEQ ID NO: 1603556 - RNA, 15 nt, Homo sapiens
augucuuaaccucag

SEQ ID NO: 1603557 - RNA, 15 nt, Homo sapiens
augugaaacaucuuc

SEQ ID NO: 1603558 - RNA, 17 nt, Homo sapiens
augugaacacaucagcu

SEQ ID NO: 1603559 - RNA, 20 nt, Homo sapiens
augugaagaguuucacaaau

SEQ ID NO: 1603560 - RNA, 18 nt, Homo sapiens
augugaagucucugggug

SEQ ID NO: 1603561 - RNA, 22 nt, Homo sapiens
augugaauaaauucuauaggaa

SEQ ID NO: 1603562 - RNA, 19 nt, Homo sapiens
augugacaguguucaguaa

SEQ ID NO: 1603563 - RNA, 19 nt, Homo sapiens
augugacauuauaugcacu

SEQ ID NO: 1603564 - RNA, 16 nt, Homo sapiens
augugacucuuuccaa

SEQ ID NO: 1603565 - RNA, 18 nt, Homo sapiens
augugacugccaucaucu

SEQ ID NO: 1603566 - RNA, 22 nt, Homo sapiens
augugacuugcgcuuaauccaa

SEQ ID NO: 1603567 - RNA, 16 nt, Homo sapiens
augugagcgagcaagc

SEQ ID NO: 1603568 - RNA, 17 nt, Homo sapiens
augugauauguaccuaa

SEQ ID NO: 1603569 - RNA, 16 nt, Homo sapiens
augugaugcaagccag

SEQ ID NO: 1603570 - RNA, 22 nt, Homo sapiens
augugauuuggaccauggcacu

SEQ ID NO: 1603571 - RNA, 13 nt, Homo sapiens
augugcagauauc

SEQ ID NO: 1603572 - RNA, 17 nt, Homo sapiens
augugcagauaucacag

SEQ ID NO: 1603573 - RNA, 18 nt, Homo sapiens
augugcaugcauaccaca

SEQ ID NO: 1603574 - RNA, 20 nt, Homo sapiens
augugccuugauugauuaga

SEQ ID NO: 1603575 - RNA, 10 nt, Homo sapiens
augugccuuu

SEQ ID NO: 1603576 - RNA, 17 nt, Homo sapiens
augugcuggacacuguc

SEQ ID NO: 1603577 - RNA, 17 nt, Homo sapiens
auguggaauaauacaua

SEQ ID NO: 1603578 - RNA, 15 nt, Homo sapiens
auguggaucugggga

SEQ ID NO: 1603579 - RNA, 20 nt, Homo sapiens
augugggagcugaaccacag

SEQ ID NO: 1603580 - RNA, 17 nt, Homo sapiens
auguggucacagcugua

SEQ ID NO: 1603581 - RNA, 22 nt, Homo sapiens
auguguaagaacaacuaccuga

SEQ ID NO: 1603582 - RNA, 18 nt, Homo sapiens
auguguauauaugugugc

SEQ ID NO: 1603583 - RNA, 14 nt, Homo sapiens
augugugaggagcu

SEQ ID NO: 1603584 - RNA, 15 nt, Homo sapiens
augugugaggagcug

SEQ ID NO: 1603585 - RNA, 18 nt, Homo sapiens
augugugcauauuuagca

SEQ ID NO: 1603586 - RNA, 19 nt, Homo sapiens
auguguuauuugucacaaa

SEQ ID NO: 1603587 - RNA, 15 nt, Homo sapiens
auguguucaaugaaa

SEQ ID NO: 1603588 - RNA, 15 nt, Homo sapiens
auguguucucuaggc

SEQ ID NO: 1603589 - RNA, 17 nt, Homo sapiens
auguuaaagaugcacag

SEQ ID NO: 1603590 - RNA, 23 nt, Homo sapiens
auguuaauugggcaggugaaaag

SEQ ID NO: 1603591 - RNA, 22 nt, Homo sapiens
auguuacaauucucucacuuaa

SEQ ID NO: 1603592 - RNA, 13 nt, Homo sapiens
cccaugugccucu

SEQ ID NO: 1603593 - RNA, 20 nt, Homo sapiens
cccauguugaucuuucucaa

SEQ ID NO: 1603594 - RNA, 20 nt, Homo sapiens
cccauuaaagagccaguuua

SEQ ID NO: 1603595 - RNA, 17 nt, Homo sapiens
cccauuucaauuccugu

SEQ ID NO: 1603596 - RNA, 21 nt, Homo sapiens
cccauuucaauuccugugauu

SEQ ID NO: 1603597 - RNA, 17 nt, Homo sapiens
ccccaacaugcacugau

SEQ ID NO: 1603598 - RNA, 15 nt, Homo sapiens
ccccaacuccaggaa

SEQ ID NO: 1603599 - RNA, 13 nt, Homo sapiens
ccccaacugcucc

SEQ ID NO: 1603600 - RNA, 15 nt, Homo sapiens
ccccaaucuugccca

SEQ ID NO: 1603601 - RNA, 22 nt, Homo sapiens
ccccaaugacacccaugccaga

SEQ ID NO: 1603602 - RNA, 22 nt, Homo sapiens
ccccaauuacagggugacucac

SEQ ID NO: 1603603 - RNA, 23 nt, Homo sapiens
ccccacacuggagccaucucuuc

SEQ ID NO: 1603604 - RNA, 14 nt, Homo sapiens
ccccaccagugccu

SEQ ID NO: 1603605 - RNA, 18 nt, Homo sapiens
ccccacccuccucuugga

SEQ ID NO: 1603606 - RNA, 21 nt, Homo sapiens
ccccaccugaaggguggaugu

SEQ ID NO: 1603607 - RNA, 14 nt, Homo sapiens
ccccacucuguaca

SEQ ID NO: 1603608 - RNA, 14 nt, Homo sapiens
ccccacuguccugu

SEQ ID NO: 1603609 - RNA, 16 nt, Homo sapiens
ccccacuguccuguga

SEQ ID NO: 1603610 - RNA, 18 nt, Homo sapiens
ccccacuguccugugagg

SEQ ID NO: 1603611 - RNA, 15 nt, Homo sapiens
ccccagaucugcucc

SEQ ID NO: 1603612 - RNA, 22 nt, Homo sapiens
ccccagcacacgaguuccagac

SEQ ID NO: 1603613 - RNA, 17 nt, Homo sapiens
ccccagcauuuccagag

SEQ ID NO: 1603614 - RNA, 16 nt, Homo sapiens
ccccagccuaccucuc

SEQ ID NO: 1603615 - RNA, 13 nt, Homo sapiens
ccccagcgcgggu

SEQ ID NO: 1603616 - RNA, 20 nt, Homo sapiens
ccccaggaggcagcucagga

SEQ ID NO: 1603617 - RNA, 19 nt, Homo sapiens
ccccaggcuggagugcagu

SEQ ID NO: 1603618 - RNA, 16 nt, Homo sapiens
ccccaguggauucuca

SEQ ID NO: 1603619 - RNA, 19 nt, Homo sapiens
ccccaguuccucccaggaa

SEQ ID NO: 1603620 - RNA, 20 nt, Homo sapiens
ccccaguuccucccccaguu

SEQ ID NO: 1603621 - RNA, 15 nt, Homo sapiens
ccccaguucuacuga

SEQ ID NO: 1603622 - RNA, 21 nt, Homo sapiens
ccccaguuuccuggggcacaa

SEQ ID NO: 1603623 - RNA, 18 nt, Homo sapiens
ccccaucauguggcccaa

SEQ ID NO: 1603624 - RNA, 19 nt, Homo sapiens
ccccaucuugaucuuugag

SEQ ID NO: 1603625 - RNA, 23 nt, Homo sapiens
ccccauguaucucaguaccccau

SEQ ID NO: 1603626 - RNA, 15 nt, Homo sapiens
ccccauuccugggaa

SEQ ID NO: 1603627 - RNA, 13 nt, Homo sapiens
ccccauugagauc

SEQ ID NO: 1603628 - RNA, 20 nt, Homo sapiens
ccccauuuccccgauguccc

SEQ ID NO: 1603629 - RNA, 16 nt, Homo sapiens
cccccaaaucaagcag

SEQ ID NO: 1603630 - RNA, 18 nt, Homo sapiens
cccccaauaaaccagugu

SEQ ID NO: 1603631 - RNA, 21 nt, Homo sapiens
cccccaccuccacucugccau

SEQ ID NO: 1603632 - RNA, 15 nt, Homo sapiens
cccccagcacugagg

SEQ ID NO: 1603633 - RNA, 12 nt, Homo sapiens
cccccagcacuu

SEQ ID NO: 1603634 - RNA, 22 nt, Homo sapiens
cccccauuguggucacaggaag

SEQ ID NO: 1603635 - RNA, 13 nt, Homo sapiens
cccccccaacaag

SEQ ID NO: 1603636 - RNA, 18 nt, Homo sapiens
cccccgcggguucuagac

SEQ ID NO: 1603637 - RNA, 13 nt, Homo sapiens
ccccgccuccagu

SEQ ID NO: 1603638 - RNA, 22 nt, Homo sapiens
ccccgcucccagauguaaagaa

SEQ ID NO: 1603639 - RNA, 16 nt, Homo sapiens
ccccuaaaccaacuga

SEQ ID NO: 1603640 - RNA, 14 nt, Homo sapiens
ccccuaagagccau

SEQ ID NO: 1603641 - RNA, 13 nt, Homo sapiens
ccccuaccucuag

SEQ ID NO: 1603642 - RNA, 16 nt, Homo sapiens
ccccuaccucuaguaa

SEQ ID NO: 1603643 - RNA, 15 nt, Homo sapiens
ccccucacucuguca

SEQ ID NO: 1603644 - RNA, 16 nt, Homo sapiens
ccccucagaugaucuc

SEQ ID NO: 1603645 - RNA, 23 nt, Homo sapiens
ccccucauccgauuccccuguag

SEQ ID NO: 1603646 - RNA, 16 nt, Homo sapiens
ccccuccuccacucuc

SEQ ID NO: 1603647 - RNA, 14 nt, Homo sapiens
ccccucucuuguca

SEQ ID NO: 1603648 - RNA, 14 nt, Homo sapiens
ccccucugcugcaa

SEQ ID NO: 1603649 - RNA, 15 nt, Homo sapiens
ccccuggcuuugccu

SEQ ID NO: 1603650 - RNA, 16 nt, Homo sapiens
ccccugguaagcagag

SEQ ID NO: 1603651 - RNA, 17 nt, Homo sapiens
ccccuggucucuggucc

SEQ ID NO: 1603652 - RNA, 17 nt, Homo sapiens
ccccugucccauucuag

SEQ ID NO: 1603653 - RNA, 17 nt, Homo sapiens
ccccuuauccuucuccc

SEQ ID NO: 1603654 - RNA, 11 nt, Homo sapiens
cccgagcugcu

SEQ ID NO: 1603655 - RNA, 20 nt, Homo sapiens
cccgcagagcccaccuugag

SEQ ID NO: 1603656 - RNA, 14 nt, Homo sapiens
cccgccuccaguca

SEQ ID NO: 1603657 - RNA, 23 nt, Homo sapiens
cccgccucggccucccaaagugc

SEQ ID NO: 1603658 - RNA, 18 nt, Homo sapiens
cccggcuacaucagccuu

SEQ ID NO: 1603659 - RNA, 16 nt, Homo sapiens
cccgggagacucaaag

SEQ ID NO: 1603660 - RNA, 16 nt, Homo sapiens
cccggggccagcacuu

SEQ ID NO: 1603661 - RNA, 22 nt, Homo sapiens
cccggggcuggcggcuacucag

SEQ ID NO: 1603662 - RNA, 16 nt, Homo sapiens
cccggggugaguccau

SEQ ID NO: 1603663 - RNA, 14 nt, Homo sapiens
cccgucagcaucac

SEQ ID NO: 1603664 - RNA, 15 nt, Homo sapiens
cccgucgugcuuccu

SEQ ID NO: 1603665 - RNA, 15 nt, Homo sapiens
cccgucucucuugga

SEQ ID NO: 1603666 - RNA, 13 nt, Homo sapiens
cccgugccaaaaa

SEQ ID NO: 1603667 - RNA, 17 nt, Homo sapiens
cccgugggugugugugg

SEQ ID NO: 1603668 - RNA, 15 nt, Homo sapiens
cccuaccucuaguaa

SEQ ID NO: 1603669 - RNA, 17 nt, Homo sapiens
cccuagcaauacaggga

SEQ ID NO: 1603670 - RNA, 16 nt, Homo sapiens
cccuauccacccagcc

SEQ ID NO: 1603671 - RNA, 19 nt, Homo sapiens
cccucaaagaagucggaau

SEQ ID NO: 1603672 - RNA, 13 nt, Homo sapiens
cccucagauucca

SEQ ID NO: 1603673 - RNA, 16 nt, Homo sapiens
cccucagauuugauga

SEQ ID NO: 1603674 - RNA, 11 nt, Homo sapiens
cccucagcacu

SEQ ID NO: 1603675 - RNA, 20 nt, Homo sapiens
cccucaggagccucugcucc

SEQ ID NO: 1603676 - RNA, 13 nt, Homo sapiens
cccucaugaaaac

SEQ ID NO: 1603677 - RNA, 18 nt, Homo sapiens
cccucaugaaaacacaca

SEQ ID NO: 1603678 - RNA, 14 nt, Homo sapiens
cccuccacuccuca

SEQ ID NO: 1603679 - RNA, 16 nt, Homo sapiens
cccuccauucugcacu

SEQ ID NO: 1603680 - RNA, 13 nt, Homo sapiens
cccucccauggca

SEQ ID NO: 1603681 - RNA, 16 nt, Homo sapiens
cccuccccagauauca

SEQ ID NO: 1603682 - RNA, 14 nt, Homo sapiens
cccucccuuucucc

SEQ ID NO: 1603683 - RNA, 16 nt, Homo sapiens
cccucgacauuuucuc

SEQ ID NO: 1603684 - RNA, 13 nt, Homo sapiens
cccucgccuucac

SEQ ID NO: 1603685 - RNA, 16 nt, Homo sapiens
cccucucuagggaccc

SEQ ID NO: 1603686 - RNA, 18 nt, Homo sapiens
cccucucucccugccuca

SEQ ID NO: 1603687 - RNA, 14 nt, Homo sapiens
cccucugcaaagcu

SEQ ID NO: 1603688 - RNA, 14 nt, Homo sapiens
cccugaaagacuga

SEQ ID NO: 1603689 - RNA, 21 nt, Homo sapiens
cccugacugggaguugaucgc

SEQ ID NO: 1603690 - RNA, 19 nt, Homo sapiens
cccugagauucagauguca

SEQ ID NO: 1603691 - RNA, 12 nt, Homo sapiens
cccugaucuuca

SEQ ID NO: 1603692 - RNA, 15 nt, Homo sapiens
cccugcacuccagcc

SEQ ID NO: 1603693 - RNA, 23 nt, Homo sapiens
cccugccaagacuccucaggcag

SEQ ID NO: 1603694 - RNA, 15 nt, Homo sapiens
cccugcccaccaaga

SEQ ID NO: 1603695 - RNA, 23 nt, Homo sapiens
cccugcccaccaagaagcacugg

SEQ ID NO: 1603696 - RNA, 16 nt, Homo sapiens
cccugcccagagcuga

SEQ ID NO: 1603697 - RNA, 19 nt, Homo sapiens
cccugcccccacuugccau

SEQ ID NO: 1603698 - RNA, 15 nt, Homo sapiens
cccugcuagcacaga

SEQ ID NO: 1603699 - RNA, 20 nt, Homo sapiens
cccugcucaguaaagcacuu

SEQ ID NO: 1603700 - RNA, 13 nt, Homo sapiens
cccuggaagcuga

SEQ ID NO: 1603701 - RNA, 19 nt, Homo sapiens
cccuggagaugucacagau

SEQ ID NO: 1603702 - RNA, 22 nt, Homo sapiens
cccuggcaaaugccugacucag

SEQ ID NO: 1603703 - RNA, 14 nt, Homo sapiens
cccugggguggcca

SEQ ID NO: 1603704 - RNA, 17 nt, Homo sapiens
cccuggguaagaagggu

SEQ ID NO: 1603705 - RNA, 23 nt, Homo sapiens
cccuggguuccgguuguugauau

SEQ ID NO: 1603706 - RNA, 19 nt, Homo sapiens
cccugguccccucccccau

SEQ ID NO: 1603707 - RNA, 14 nt, Homo sapiens
cccuggugguggau

SEQ ID NO: 1603708 - RNA, 16 nt, Homo sapiens
cccuggugugaacucu

SEQ ID NO: 1603709 - RNA, 15 nt, Homo sapiens
cccugguguguuucc

SEQ ID NO: 1603710 - RNA, 18 nt, Homo sapiens
cccuguccugcacacccu

SEQ ID NO: 1603711 - RNA, 15 nt, Homo sapiens
ccugcguucccagac

SEQ ID NO: 1603712 - RNA, 15 nt, Homo sapiens
ccugcuagucacugg

SEQ ID NO: 1603713 - RNA, 19 nt, Homo sapiens
ccugcuagucacuggaaau

SEQ ID NO: 1603714 - RNA, 9 nt, Homo sapiens
ccugcucag

SEQ ID NO: 1603715 - RNA, 14 nt, Homo sapiens
ccugcugagaucug

SEQ ID NO: 1603716 - RNA, 18 nt, Homo sapiens
ccugcuggcucuucugcc

SEQ ID NO: 1603717 - RNA, 23 nt, Homo sapiens
ccugcuguguggacuucaucuca

SEQ ID NO: 1603718 - RNA, 19 nt, Homo sapiens
ccugcuuggucuuucauug

SEQ ID NO: 1603719 - RNA, 20 nt, Homo sapiens
ccugcuuuccugcagcaguc

SEQ ID NO: 1603720 - RNA, 15 nt, Homo sapiens
ccugcuuugcaucuu

SEQ ID NO: 1603721 - RNA, 14 nt, Homo sapiens
ccuggaacaucuca

SEQ ID NO: 1603722 - RNA, 18 nt, Homo sapiens
ccuggaaggacacaguga

SEQ ID NO: 1603723 - RNA, 15 nt, Homo sapiens
ccuggacucaggguc

SEQ ID NO: 1603724 - RNA, 21 nt, Homo sapiens
ccuggagacauaucacucaau

SEQ ID NO: 1603725 - RNA, 16 nt, Homo sapiens
ccuggagggcaagccc

SEQ ID NO: 1603726 - RNA, 14 nt, Homo sapiens
ccuggauccagcac

SEQ ID NO: 1603727 - RNA, 19 nt, Homo sapiens
ccuggaugucugggugacc

SEQ ID NO: 1603728 - RNA, 16 nt, Homo sapiens
ccuggcagagccaugg

SEQ ID NO: 1603729 - RNA, 21 nt, Homo sapiens
ccuggccaccagccauccucc

SEQ ID NO: 1603730 - RNA, 16 nt, Homo sapiens
ccuggcccaggugccc

SEQ ID NO: 1603731 - RNA, 15 nt, Homo sapiens
ccuggccucauacag

SEQ ID NO: 1603732 - RNA, 16 nt, Homo sapiens
ccuggcuuugccucuu

SEQ ID NO: 1603733 - RNA, 13 nt, Homo sapiens
ccugggaacauca

SEQ ID NO: 1603734 - RNA, 18 nt, Homo sapiens
ccugggagucucuugacu

SEQ ID NO: 1603735 - RNA, 20 nt, Homo sapiens
ccuggggaaagacgccuuca

SEQ ID NO: 1603736 - RNA, 20 nt, Homo sapiens
ccuggggagcccacugaggg

SEQ ID NO: 1603737 - RNA, 19 nt, Homo sapiens
ccuggggagucugggcaca

SEQ ID NO: 1603738 - RNA, 21 nt, Homo sapiens
ccuggggagugguuaggcagc

SEQ ID NO: 1603739 - RNA, 16 nt, Homo sapiens
ccugggggaggucaga

SEQ ID NO: 1603740 - RNA, 14 nt, Homo sapiens
ccuggggugcaucu

SEQ ID NO: 1603741 - RNA, 22 nt, Homo sapiens
ccugggugcaucaaacaaaaca

SEQ ID NO: 1603742 - RNA, 17 nt, Homo sapiens
ccuggguggggcugcuc

SEQ ID NO: 1603743 - RNA, 16 nt, Homo sapiens
ccugguaauagcugua

SEQ ID NO: 1603744 - RNA, 16 nt, Homo sapiens
ccugguauauccaaaa

SEQ ID NO: 1603745 - RNA, 20 nt, Homo sapiens
ccugguccuuccacugugca

SEQ ID NO: 1603746 - RNA, 16 nt, Homo sapiens
ccugguccuucccuga

SEQ ID NO: 1603747 - RNA, 14 nt, Homo sapiens
ccuggugagacugu

SEQ ID NO: 1603748 - RNA, 12 nt, Homo sapiens
ccuggugcucca

SEQ ID NO: 1603749 - RNA, 12 nt, Homo sapiens
ccuggugcucuu

SEQ ID NO: 1603750 - RNA, 19 nt, Homo sapiens
ccugguggauacuguagaa

SEQ ID NO: 1603751 - RNA, 13 nt, Homo sapiens
ccuggugugaacu

SEQ ID NO: 1603752 - RNA, 23 nt, Homo sapiens
ccugguucccuccccaaggccac

SEQ ID NO: 1603753 - RNA, 21 nt, Homo sapiens
ccugguuuguucucuguugua

SEQ ID NO: 1603754 - RNA, 12 nt, Homo sapiens
ccuguaaauaua

SEQ ID NO: 1603755 - RNA, 13 nt, Homo sapiens
ccuguaaucacag

SEQ ID NO: 1603756 - RNA, 18 nt, Homo sapiens
ccuguaaucccagcacuu

SEQ ID NO: 1603757 - RNA, 17 nt, Homo sapiens
ccuguaaucucagcacu

SEQ ID NO: 1603758 - RNA, 20 nt, Homo sapiens
ccuguaauuaaacuaguuua

SEQ ID NO: 1603759 - RNA, 18 nt, Homo sapiens
ccuguacucccagcacuu

SEQ ID NO: 1603760 - RNA, 22 nt, Homo sapiens
ccuguaggguuuggacagaccc

SEQ ID NO: 1603761 - RNA, 19 nt, Homo sapiens
ccuguauuuaacaaaaagu

SEQ ID NO: 1603762 - RNA, 16 nt, Homo sapiens
ccuguccacacccagc

SEQ ID NO: 1603763 - RNA, 21 nt, Homo sapiens
ccugucccaccccuaccucua

SEQ ID NO: 1603764 - RNA, 15 nt, Homo sapiens
ccuguccuaucacuc

SEQ ID NO: 1603765 - RNA, 15 nt, Homo sapiens
ccugucuaggugccc

SEQ ID NO: 1603766 - RNA, 21 nt, Homo sapiens
ccugucugcuaggcgcugggg

SEQ ID NO: 1603767 - RNA, 16 nt, Homo sapiens
ccugugcccaccaguu

SEQ ID NO: 1603768 - RNA, 15 nt, Homo sapiens
ccugugccuuuugcc

SEQ ID NO: 1603769 - RNA, 12 nt, Homo sapiens
ccugugcucacc

SEQ ID NO: 1603770 - RNA, 16 nt, Homo sapiens
ccuguggaaaggccaa

SEQ ID NO: 1603771 - RNA, 19 nt, Homo sapiens
ccuguggaugcugcugccc

SEQ ID NO: 1603772 - RNA, 14 nt, Homo sapiens
ccuguggccugaag

SEQ ID NO: 1603773 - RNA, 18 nt, Homo sapiens
ccuguguguauagcugug

SEQ ID NO: 1603774 - RNA, 12 nt, Homo sapiens
ccuguuccccaa

SEQ ID NO: 1603775 - RNA, 20 nt, Homo sapiens
ccuguuccuggaggucagca

SEQ ID NO: 1603776 - RNA, 19 nt, Homo sapiens
ccuguuccuuuuucugggu

SEQ ID NO: 1603777 - RNA, 20 nt, Homo sapiens
ccuuaaauuaaacaauuuau

SEQ ID NO: 1603778 - RNA, 15 nt, Homo sapiens
ccuuaacgcuagaga

SEQ ID NO: 1603779 - RNA, 14 nt, Homo sapiens
ccuuaacugcaucc

SEQ ID NO: 1603780 - RNA, 21 nt, Homo sapiens
ccuuaaguucagcaacuguuu

SEQ ID NO: 1603781 - RNA, 14 nt, Homo sapiens
ccuuacuguuuaca

SEQ ID NO: 1603782 - RNA, 10 nt, Homo sapiens
ccuuacuuug

SEQ ID NO: 1603783 - RNA, 23 nt, Homo sapiens
ccuuagaugccucgcucuuuuca

SEQ ID NO: 1603784 - RNA, 14 nt, Homo sapiens
ccuuauccugcauu

SEQ ID NO: 1603785 - RNA, 21 nt, Homo sapiens
ccuuauuaaagguaugcauuu

SEQ ID NO: 1603786 - RNA, 15 nt, Homo sapiens
ccuuauuugucugua

SEQ ID NO: 1603787 - RNA, 15 nt, Homo sapiens
ccuucaagugccaaa

SEQ ID NO: 1603788 - RNA, 14 nt, Homo sapiens
ccuucagauuugcc

SEQ ID NO: 1603789 - RNA, 14 nt, Homo sapiens
ccuucagccuuaau

SEQ ID NO: 1603790 - RNA, 16 nt, Homo sapiens
ccuucagcgauuauuu

SEQ ID NO: 1603791 - RNA, 23 nt, Homo sapiens
ccuucauaaaacucuagcauucu

SEQ ID NO: 1603792 - RNA, 22 nt, Homo sapiens
ccuucaucaugaguucugcuga

SEQ ID NO: 1603793 - RNA, 16 nt, Homo sapiens
ccuuccaugugccuuu

SEQ ID NO: 1603794 - RNA, 14 nt, Homo sapiens
ccuuccccauggga

SEQ ID NO: 1603795 - RNA, 23 nt, Homo sapiens
ccuucccuagcuuuagacccugg

SEQ ID NO: 1603796 - RNA, 21 nt, Homo sapiens
ccuuccucucaagcuagccag

SEQ ID NO: 1603797 - RNA, 21 nt, Homo sapiens
ccuuccuuuaggucugguugu

SEQ ID NO: 1603798 - RNA, 22 nt, Homo sapiens
ccuucuagaacaccugccuucu

SEQ ID NO: 1603799 - RNA, 18 nt, Homo sapiens
ccuucuccacacccacuu

SEQ ID NO: 1603800 - RNA, 19 nt, Homo sapiens
ccuucucuacacucuugua

SEQ ID NO: 1603801 - RNA, 15 nt, Homo sapiens
ccuucucugcuccac

SEQ ID NO: 1603802 - RNA, 14 nt, Homo sapiens
ccuucuugacauuu

SEQ ID NO: 1603803 - RNA, 16 nt, Homo sapiens
ccuucuugucauugaa

SEQ ID NO: 1603804 - RNA, 14 nt, Homo sapiens
ccuugacuaaauuc

SEQ ID NO: 1603805 - RNA, 16 nt, Homo sapiens
ccuugagaagugggag

SEQ ID NO: 1603806 - RNA, 19 nt, Homo sapiens
ccuugauggaaauugacca

SEQ ID NO: 1603807 - RNA, 13 nt, Homo sapiens
ccuugcagggugg

SEQ ID NO: 1603808 - RNA, 18 nt, Homo sapiens
ccuugccaauagugucau

SEQ ID NO: 1603809 - RNA, 11 nt, Homo sapiens
ccuugcucccc

SEQ ID NO: 1603810 - RNA, 20 nt, Homo sapiens
ccuugcucuccucaucucca

SEQ ID NO: 1603811 - RNA, 15 nt, Homo sapiens
ccuugcucucuucaa

SEQ ID NO: 1603812 - RNA, 17 nt, Homo sapiens
ccuugcuuuugcuucua

SEQ ID NO: 1603813 - RNA, 19 nt, Homo sapiens
ccuuggcacccccaugcug

SEQ ID NO: 1603814 - RNA, 18 nt, Homo sapiens
ccuuggucccaagccuga

SEQ ID NO: 1603815 - RNA, 19 nt, Homo sapiens
ccuugguucccccacugau

SEQ ID NO: 1603816 - RNA, 21 nt, Homo sapiens
ccuuguaauaccugauugauc

SEQ ID NO: 1603817 - RNA, 22 nt, Homo sapiens
ccuugucccgucuggaccuggg

SEQ ID NO: 1603818 - RNA, 13 nt, Homo sapiens
ccuugucugcacu

SEQ ID NO: 1603819 - RNA, 14 nt, Homo sapiens
ccuuguuguauucc

SEQ ID NO: 1603820 - RNA, 16 nt, Homo sapiens
ccuuuaaagagcaauc

SEQ ID NO: 1603821 - RNA, 17 nt, Homo sapiens
ccuuuaggauguuuucc

SEQ ID NO: 1603822 - RNA, 12 nt, Homo sapiens
ccuuuauacaug

SEQ ID NO: 1603823 - RNA, 21 nt, Homo sapiens
ccuuuauugauaucuccauga

SEQ ID NO: 1603824 - RNA, 19 nt, Homo sapiens
ccuuucauggucugcugag

SEQ ID NO: 1603825 - RNA, 14 nt, Homo sapiens
ccuuuccucaaaac

SEQ ID NO: 1603826 - RNA, 24 nt, Homo sapiens
ccuuucucucuccucucugcuuca

SEQ ID NO: 1603827 - RNA, 24 nt, Homo sapiens
ccuuucugucccacuacaucuggg

SEQ ID NO: 1603828 - RNA, 17 nt, Homo sapiens
ccuuugaaagacugugc

SEQ ID NO: 1603829 - RNA, 21 nt, Homo sapiens
ccuuugcaguuggacucucag

SEQ ID NO: 1603830 - RNA, 18 nt, Homo sapiens
cucacaacagucaccuca

SEQ ID NO: 1603831 - RNA, 23 nt, Homo sapiens
cucacaaugucccuucagcaccu

SEQ ID NO: 1603832 - RNA, 15 nt, Homo sapiens
cucacacccaaagca

SEQ ID NO: 1603833 - RNA, 19 nt, Homo sapiens
cucacauaagcccaguuca

SEQ ID NO: 1603834 - RNA, 23 nt, Homo sapiens
cucaccagcccugaccccagugu

SEQ ID NO: 1603835 - RNA, 17 nt, Homo sapiens
cucacccagucuucuac

SEQ ID NO: 1603836 - RNA, 22 nt, Homo sapiens
cucaccucuucuuuaccagaac

SEQ ID NO: 1603837 - RNA, 20 nt, Homo sapiens
cucacgccuguaaucccagc

SEQ ID NO: 1603838 - RNA, 17 nt, Homo sapiens
cucacgggacuauuucc

SEQ ID NO: 1603839 - RNA, 12 nt, Homo sapiens
cucacucuguca

SEQ ID NO: 1603840 - RNA, 17 nt, Homo sapiens
cucacuggggcagacaa

SEQ ID NO: 1603841 - RNA, 21 nt, Homo sapiens
cucacugugggaaggccagcu

SEQ ID NO: 1603842 - RNA, 16 nt, Homo sapiens
cucacuuugacaccca

SEQ ID NO: 1603843 - RNA, 13 nt, Homo sapiens
cucagaaagccaa

SEQ ID NO: 1603844 - RNA, 14 nt, Homo sapiens
cucagacccaggag

SEQ ID NO: 1603845 - RNA, 14 nt, Homo sapiens
cucagagaugugca

SEQ ID NO: 1603846 - RNA, 18 nt, Homo sapiens
cucagaggguguccugca

SEQ ID NO: 1603847 - RNA, 21 nt, Homo sapiens
cucagaguccacuguggcacu

SEQ ID NO: 1603848 - RNA, 17 nt, Homo sapiens
cucagaugaggacagag

SEQ ID NO: 1603849 - RNA, 13 nt, Homo sapiens
cucagaugaucuc

SEQ ID NO: 1603850 - RNA, 23 nt, Homo sapiens
cucagauuccaccuagagcuaga

SEQ ID NO: 1603851 - RNA, 22 nt, Homo sapiens
cucagauucuucacuggugaga

SEQ ID NO: 1603852 - RNA, 12 nt, Homo sapiens
cucagcacuguu

SEQ ID NO: 1603853 - RNA, 20 nt, Homo sapiens
cucagcauagggucacuuug

SEQ ID NO: 1603854 - RNA, 14 nt, Homo sapiens
cucagccacuguca

SEQ ID NO: 1603855 - RNA, 19 nt, Homo sapiens
cucagccauaggugcaguu

SEQ ID NO: 1603856 - RNA, 16 nt, Homo sapiens
cucagcccugcucccu

SEQ ID NO: 1603857 - RNA, 23 nt, Homo sapiens
cucagcccugggccccaccaccu

SEQ ID NO: 1603858 - RNA, 14 nt, Homo sapiens
cucagccucugcca

SEQ ID NO: 1603859 - RNA, 14 nt, Homo sapiens
cucagcucaccuca

SEQ ID NO: 1603860 - RNA, 22 nt, Homo sapiens
cucagcucuaggcuguucugua

SEQ ID NO: 1603861 - RNA, 19 nt, Homo sapiens
cucagcuuuuuaauuaaau

SEQ ID NO: 1603862 - RNA, 19 nt, Homo sapiens
cucaggcacacagcuacuc

SEQ ID NO: 1603863 - RNA, 16 nt, Homo sapiens
cucaggccugaacuca

SEQ ID NO: 1603864 - RNA, 17 nt, Homo sapiens
cucagggagcagggaag

SEQ ID NO: 1603865 - RNA, 14 nt, Homo sapiens
cucaggggcuccau

SEQ ID NO: 1603866 - RNA, 14 nt, Homo sapiens
cucagggugggggg

SEQ ID NO: 1603867 - RNA, 22 nt, Homo sapiens
cucagguuuuugaggaaacaaa

SEQ ID NO: 1603868 - RNA, 13 nt, Homo sapiens
cucaguaccccau

SEQ ID NO: 1603869 - RNA, 16 nt, Homo sapiens
cucagucccuacugag

SEQ ID NO: 1603870 - RNA, 21 nt, Homo sapiens
cucagugccaccuaugccugu

SEQ ID NO: 1603871 - RNA, 19 nt, Homo sapiens
cucagugcuugggcuccac

SEQ ID NO: 1603872 - RNA, 19 nt, Homo sapiens
cucaguggcugauucugaa

SEQ ID NO: 1603873 - RNA, 14 nt, Homo sapiens
cucaguuggugcug

SEQ ID NO: 1603874 - RNA, 17 nt, Homo sapiens
cucaguuggugcugcuu

SEQ ID NO: 1603875 - RNA, 20 nt, Homo sapiens
cucaguuggugcugcuuucu

SEQ ID NO: 1603876 - RNA, 15 nt, Homo sapiens
cucaguuuccucauc

SEQ ID NO: 1603877 - RNA, 15 nt, Homo sapiens
cucaguuucuaggca

SEQ ID NO: 1603878 - RNA, 15 nt, Homo sapiens
cucauagauugcaaa

SEQ ID NO: 1603879 - RNA, 18 nt, Homo sapiens
cucauagguugagcaauu

SEQ ID NO: 1603880 - RNA, 18 nt, Homo sapiens
cucaucaucagagccuuu

SEQ ID NO: 1603881 - RNA, 22 nt, Homo sapiens
cucauccugauuuuuacuauca

SEQ ID NO: 1603882 - RNA, 16 nt, Homo sapiens
cucauccuuuacauuu

SEQ ID NO: 1603883 - RNA, 17 nt, Homo sapiens
cucaucucuacuaaaau

SEQ ID NO: 1603884 - RNA, 16 nt, Homo sapiens
cucaucuuucuuccaa

SEQ ID NO: 1603885 - RNA, 15 nt, Homo sapiens
cucaucuuucuugau

SEQ ID NO: 1603886 - RNA, 19 nt, Homo sapiens
cucaugagcuguguucaca

SEQ ID NO: 1603887 - RNA, 13 nt, Homo sapiens
cucaugauccaac

SEQ ID NO: 1603888 - RNA, 15 nt, Homo sapiens
cucaugccuguaauc

SEQ ID NO: 1603889 - RNA, 23 nt, Homo sapiens
cucauggguggcacucagucucu

SEQ ID NO: 1603890 - RNA, 18 nt, Homo sapiens
cucaugugacucuuucca

SEQ ID NO: 1603891 - RNA, 16 nt, Homo sapiens
cucaugugugcucaca

SEQ ID NO: 1603892 - RNA, 19 nt, Homo sapiens
cucauuccuucccagagau

SEQ ID NO: 1603893 - RNA, 21 nt, Homo sapiens
cucauuggugguagccaucaa

SEQ ID NO: 1603894 - RNA, 18 nt, Homo sapiens
cucauuuaagaauuugaa

SEQ ID NO: 1603895 - RNA, 15 nt, Homo sapiens
cucauuucaucucau

SEQ ID NO: 1603896 - RNA, 23 nt, Homo sapiens
cucauuugaaugcuuaauucaau

SEQ ID NO: 1603897 - RNA, 20 nt, Homo sapiens
cuccaaaggucugaugucuc

SEQ ID NO: 1603898 - RNA, 23 nt, Homo sapiens
cuccaaccuggggggcaguggug

SEQ ID NO: 1603899 - RNA, 22 nt, Homo sapiens
cuccaacuccuuucagccacau

SEQ ID NO: 1603900 - RNA, 23 nt, Homo sapiens
cuccaagauuuaaccugcaaguu

SEQ ID NO: 1603901 - RNA, 21 nt, Homo sapiens
cuccaagcugcauggcaaguu

SEQ ID NO: 1603902 - RNA, 15 nt, Homo sapiens
cuccacaccucuaaa

SEQ ID NO: 1603903 - RNA, 11 nt, Homo sapiens
cuccacagggc

SEQ ID NO: 1603904 - RNA, 12 nt, Homo sapiens
cuccacauaccu

SEQ ID NO: 1603905 - RNA, 22 nt, Homo sapiens
cuccacaucugccuuaaaacca

SEQ ID NO: 1603906 - RNA, 14 nt, Homo sapiens
cuccacauugcaau

SEQ ID NO: 1603907 - RNA, 17 nt, Homo sapiens
cuccacuggaaaacugc

SEQ ID NO: 1603908 - RNA, 15 nt, Homo sapiens
cuccagagaugguca

SEQ ID NO: 1603909 - RNA, 17 nt, Homo sapiens
cuccagagauuugcuca

SEQ ID NO: 1603910 - RNA, 20 nt, Homo sapiens
cuccagcccagacccagugg

SEQ ID NO: 1603911 - RNA, 15 nt, Homo sapiens
cuccagccuggguca

SEQ ID NO: 1603912 - RNA, 23 nt, Homo sapiens
cuccaggaagaaagaauguuacu

SEQ ID NO: 1603913 - RNA, 15 nt, Homo sapiens
cuccaggggcaucuu

SEQ ID NO: 1603914 - RNA, 18 nt, Homo sapiens
cuccaggggggacaauau

SEQ ID NO: 1603915 - RNA, 18 nt, Homo sapiens
cuccagugcuguccaugc

SEQ ID NO: 1603916 - RNA, 19 nt, Homo sapiens
cuccauaugucucaucugu

SEQ ID NO: 1603917 - RNA, 19 nt, Homo sapiens
cuccauguagaagccacua

SEQ ID NO: 1603918 - RNA, 22 nt, Homo sapiens
cuccauugguguugacauacau

SEQ ID NO: 1603919 - RNA, 20 nt, Homo sapiens
cucccaaagugcugggauua

SEQ ID NO: 1603920 - RNA, 15 nt, Homo sapiens
cucccaaaugaaaac

SEQ ID NO: 1603921 - RNA, 14 nt, Homo sapiens
cucccaagcguucc

SEQ ID NO: 1603922 - RNA, 14 nt, Homo sapiens
cucccaaucagcuu

SEQ ID NO: 1603923 - RNA, 21 nt, Homo sapiens
cucccacaugaggccaucuca

SEQ ID NO: 1603924 - RNA, 14 nt, Homo sapiens
cucccagcuccuuu

SEQ ID NO: 1603925 - RNA, 16 nt, Homo sapiens
cucccagguaccagcu

SEQ ID NO: 1603926 - RNA, 11 nt, Homo sapiens
cucccauuucc

SEQ ID NO: 1603927 - RNA, 12 nt, Homo sapiens
cucccauuuccc

SEQ ID NO: 1603928 - RNA, 16 nt, Homo sapiens
cuccccacacuaaccu

SEQ ID NO: 1603929 - RNA, 18 nt, Homo sapiens
cuccccagaaucaagcuu

SEQ ID NO: 1603930 - RNA, 21 nt, Homo sapiens
cuccccagaugugacuacuga

SEQ ID NO: 1603931 - RNA, 18 nt, Homo sapiens
cucccccacuccucccua

SEQ ID NO: 1603932 - RNA, 14 nt, Homo sapiens
cucccccaguuccu

SEQ ID NO: 1603933 - RNA, 14 nt, Homo sapiens
cuccccccacugca

SEQ ID NO: 1603934 - RNA, 18 nt, Homo sapiens
cucccccuuucacacugg

SEQ ID NO: 1603935 - RNA, 16 nt, Homo sapiens
cuccccucucaccuca

SEQ ID NO: 1603936 - RNA, 14 nt, Homo sapiens
cuccccugccccuc

SEQ ID NO: 1603937 - RNA, 19 nt, Homo sapiens
cuccccuugucugcacugu

SEQ ID NO: 1603938 - RNA, 17 nt, Homo sapiens
cucccuaggcugcccac

SEQ ID NO: 1603939 - RNA, 17 nt, Homo sapiens
cucccucuccauaucuc

SEQ ID NO: 1603940 - RNA, 24 nt, Homo sapiens
cucccucuuucuucccaugacccc

SEQ ID NO: 1603941 - RNA, 16 nt, Homo sapiens
cucccugcaagaaauc

SEQ ID NO: 1603942 - RNA, 22 nt, Homo sapiens
cucccugcaagaaaucagccau

SEQ ID NO: 1603943 - RNA, 17 nt, Homo sapiens
cucccugcugugccaug

SEQ ID NO: 1603944 - RNA, 20 nt, Homo sapiens
cucccuguagcucugccucc

SEQ ID NO: 1603945 - RNA, 14 nt, Homo sapiens
cuccgcaucaccuc

SEQ ID NO: 1603946 - RNA, 15 nt, Homo sapiens
cuccgcgccuacccu

SEQ ID NO: 1603947 - RNA, 17 nt, Homo sapiens
cuccgugcuuaaccaaa

SEQ ID NO: 1603948 - RNA, 14 nt, Homo sapiens
gccuuaccuugaaa

SEQ ID NO: 1603949 - RNA, 13 nt, Homo sapiens
gccuuagcaguaa

SEQ ID NO: 1603950 - RNA, 14 nt, Homo sapiens
gccuuagcaguaac

SEQ ID NO: 1603951 - RNA, 18 nt, Homo sapiens
gccuuaguugagauuuca

SEQ ID NO: 1603952 - RNA, 15 nt, Homo sapiens
gccuuauuggcagcu

SEQ ID NO: 1603953 - RNA, 14 nt, Homo sapiens
gccuucaucuucac

SEQ ID NO: 1603954 - RNA, 16 nt, Homo sapiens
gccuuccccuggcacu

SEQ ID NO: 1603955 - RNA, 18 nt, Homo sapiens
gccuuccccuggcacugg

SEQ ID NO: 1603956 - RNA, 23 nt, Homo sapiens
gccuuccuggaggugacacuuga

SEQ ID NO: 1603957 - RNA, 16 nt, Homo sapiens
gccuucucaccagcug

SEQ ID NO: 1603958 - RNA, 13 nt, Homo sapiens
gccuucucaggaa

SEQ ID NO: 1603959 - RNA, 16 nt, Homo sapiens
gccuugagcccuggcu

SEQ ID NO: 1603960 - RNA, 18 nt, Homo sapiens
gccuugcccagccuggau

SEQ ID NO: 1603961 - RNA, 20 nt, Homo sapiens
gccuugugugaacucaccaa

SEQ ID NO: 1603962 - RNA, 15 nt, Homo sapiens
gccuuuaagaaccuu

SEQ ID NO: 1603963 - RNA, 12 nt, Homo sapiens
gccuuucuuugc

SEQ ID NO: 1603964 - RNA, 19 nt, Homo sapiens
gccuuugucagaacuagaa

SEQ ID NO: 1603965 - RNA, 12 nt, Homo sapiens
gccuuugugagc

SEQ ID NO: 1603966 - RNA, 21 nt, Homo sapiens
gccuuuuuuccugggccagaa

SEQ ID NO: 1603967 - RNA, 14 nt, Homo sapiens
gcgaacaaccacag

SEQ ID NO: 1603968 - RNA, 20 nt, Homo sapiens
gcgaacauguguuuucauca

SEQ ID NO: 1603969 - RNA, 13 nt, Homo sapiens
gcgaagaggaccc

SEQ ID NO: 1603970 - RNA, 14 nt, Homo sapiens
gcgaagggugguuu

SEQ ID NO: 1603971 - RNA, 13 nt, Homo sapiens
gcgaauaacaguc

SEQ ID NO: 1603972 - RNA, 15 nt, Homo sapiens
gcgaauaacaguccc

SEQ ID NO: 1603973 - RNA, 14 nt, Homo sapiens
gcgaggacaucaaa

SEQ ID NO: 1603974 - RNA, 21 nt, Homo sapiens
gcgcaaucucggcucacugca

SEQ ID NO: 1603975 - RNA, 20 nt, Homo sapiens
gcgcaauugaaggaucaucu

SEQ ID NO: 1603976 - RNA, 23 nt, Homo sapiens
gcgcaucucugucacacccgggg

SEQ ID NO: 1603977 - RNA, 16 nt, Homo sapiens
gcgccaggaagccaga

SEQ ID NO: 1603978 - RNA, 20 nt, Homo sapiens
gcgccugcugccugcugaga

SEQ ID NO: 1603979 - RNA, 14 nt, Homo sapiens
gcgcgguggcucac

SEQ ID NO: 1603980 - RNA, 20 nt, Homo sapiens
gcgcucggucuccaccccag

SEQ ID NO: 1603981 - RNA, 14 nt, Homo sapiens
gcggaagagcaugu

SEQ ID NO: 1603982 - RNA, 13 nt, Homo sapiens
gcggaaugcauug

SEQ ID NO: 1603983 - RNA, 14 nt, Homo sapiens
gcggaccggggacc

SEQ ID NO: 1603984 - RNA, 23 nt, Homo sapiens
gcggauuccucaccaagcucaac

SEQ ID NO: 1603985 - RNA, 20 nt, Homo sapiens
gcggcaccuuuccucuaauc

SEQ ID NO: 1603986 - RNA, 18 nt, Homo sapiens
gcggcagguucucuuuga

SEQ ID NO: 1603987 - RNA, 20 nt, Homo sapiens
gcggccuacagaaaaaggaa

SEQ ID NO: 1603988 - RNA, 15 nt, Homo sapiens
gcggcgucccuucca

SEQ ID NO: 1603989 - RNA, 13 nt, Homo sapiens
gcgggcuugacug

SEQ ID NO: 1603990 - RNA, 17 nt, Homo sapiens
gcgggucaacauuucca

SEQ ID NO: 1603991 - RNA, 13 nt, Homo sapiens
gcggugcacucac

SEQ ID NO: 1603992 - RNA, 14 nt, Homo sapiens
gcggugcagcgugu

SEQ ID NO: 1603993 - RNA, 20 nt, Homo sapiens
gcgucaagucuaaaccaaga

SEQ ID NO: 1603994 - RNA, 15 nt, Homo sapiens
gcgucaccguccacu

SEQ ID NO: 1603995 - RNA, 12 nt, Homo sapiens
gcgucacuacug

SEQ ID NO: 1603996 - RNA, 15 nt, Homo sapiens
gcguccucugacccc

SEQ ID NO: 1603997 - RNA, 17 nt, Homo sapiens
gcgugacucacccaagc

SEQ ID NO: 1603998 - RNA, 22 nt, Homo sapiens
gcgugaguggacgugucaggug

SEQ ID NO: 1603999 - RNA, 17 nt, Homo sapiens
gcgugggcgcuugcacc

SEQ ID NO: 1604000 - RNA, 16 nt, Homo sapiens
gcguguuggugugcac

SEQ ID NO: 1604001 - RNA, 22 nt, Homo sapiens
gcguguuucugacucugagcua

SEQ ID NO: 1604002 - RNA, 14 nt, Homo sapiens
gcguucaccucccu

SEQ ID NO: 1604003 - RNA, 17 nt, Homo sapiens
gcuaaacugaugacuua

SEQ ID NO: 1604004 - RNA, 16 nt, Homo sapiens
gcuaaaggaagugaau

SEQ ID NO: 1604005 - RNA, 12 nt, Homo sapiens
gcuaaauaucac

SEQ ID NO: 1604006 - RNA, 13 nt, Homo sapiens
gcuaaguauugaa

SEQ ID NO: 1604007 - RNA, 12 nt, Homo sapiens
gcuaaucugccu

SEQ ID NO: 1604008 - RNA, 17 nt, Homo sapiens
gcuacaguuauuaaucu

SEQ ID NO: 1604009 - RNA, 15 nt, Homo sapiens
gcuacauauaugcaa

SEQ ID NO: 1604010 - RNA, 22 nt, Homo sapiens
gcuacgcuccagcugauccaga

SEQ ID NO: 1604011 - RNA, 15 nt, Homo sapiens
gcuacuauaaucaaa

SEQ ID NO: 1604012 - RNA, 22 nt, Homo sapiens
gcuagacuaccggacacucguc

SEQ ID NO: 1604013 - RNA, 14 nt, Homo sapiens
gcuagagugcaaug

SEQ ID NO: 1604014 - RNA, 18 nt, Homo sapiens
gcuagaugugucuuacca

SEQ ID NO: 1604015 - RNA, 16 nt, Homo sapiens
gcuagcuuucuccuua

SEQ ID NO: 1604016 - RNA, 15 nt, Homo sapiens
gcuaggaacuuggga

SEQ ID NO: 1604017 - RNA, 19 nt, Homo sapiens
gcuaggaugguucugugac

SEQ ID NO: 1604018 - RNA, 22 nt, Homo sapiens
gcuaggucuugccaacuccauc

SEQ ID NO: 1604019 - RNA, 15 nt, Homo sapiens
gcuagucacuggaaa

SEQ ID NO: 1604020 - RNA, 12 nt, Homo sapiens
gcuagugccuuu

SEQ ID NO: 1604021 - RNA, 13 nt, Homo sapiens
gcuauaagugcuc

SEQ ID NO: 1604022 - RNA, 14 nt, Homo sapiens
gcuauaagugcuca

SEQ ID NO: 1604023 - RNA, 22 nt, Homo sapiens
gcuauccguguugcagguucau

SEQ ID NO: 1604024 - RNA, 20 nt, Homo sapiens
gcuaucuaauuuuacacucu

SEQ ID NO: 1604025 - RNA, 23 nt, Homo sapiens
gcuaugguuuucuccaagagcua

SEQ ID NO: 1604026 - RNA, 22 nt, Homo sapiens
gcuaugugaagaguaagucaac

SEQ ID NO: 1604027 - RNA, 19 nt, Homo sapiens
gcuauuacuaguacuauua

SEQ ID NO: 1604028 - RNA, 15 nt, Homo sapiens
gcuauuuaacauuuu

SEQ ID NO: 1604029 - RNA, 18 nt, Homo sapiens
gcuauuuugugaagccau

SEQ ID NO: 1604030 - RNA, 21 nt, Homo sapiens
gcucaaaaccuccaaggaccu

SEQ ID NO: 1604031 - RNA, 15 nt, Homo sapiens
gcucaaaugaucaau

SEQ ID NO: 1604032 - RNA, 14 nt, Homo sapiens
gcucaacauugugu

SEQ ID NO: 1604033 - RNA, 21 nt, Homo sapiens
gcucaacggcuccaucaccag

SEQ ID NO: 1604034 - RNA, 20 nt, Homo sapiens
gcucacaugggacugggaua

SEQ ID NO: 1604035 - RNA, 21 nt, Homo sapiens
gcucacguuaccuugacacau

SEQ ID NO: 1604036 - RNA, 22 nt, Homo sapiens
gcucacugugcuggggcacggc

SEQ ID NO: 1604037 - RNA, 15 nt, Homo sapiens
gcucagaaaggaaau

SEQ ID NO: 1604038 - RNA, 16 nt, Homo sapiens
gcucagagcuuuguca

SEQ ID NO: 1604039 - RNA, 19 nt, Homo sapiens
gcucagcacauauuugcau

SEQ ID NO: 1604040 - RNA, 9 nt, Homo sapiens
gcucaggaa

SEQ ID NO: 1604041 - RNA, 15 nt, Homo sapiens
gcucaguaacugugc

SEQ ID NO: 1604042 - RNA, 17 nt, Homo sapiens
gcucagucccuacugag

SEQ ID NO: 1604043 - RNA, 19 nt, Homo sapiens
gcucagucccuacugagua

SEQ ID NO: 1604044 - RNA, 15 nt, Homo sapiens
gcucauugaacuuua

SEQ ID NO: 1604045 - RNA, 13 nt, Homo sapiens
gcuccaaauccaa

SEQ ID NO: 1604046 - RNA, 14 nt, Homo sapiens
gcuccaccuucaua

SEQ ID NO: 1604047 - RNA, 14 nt, Homo sapiens
gcuccagagggcac

SEQ ID NO: 1604048 - RNA, 22 nt, Homo sapiens
gcuccaggaucuuugacugaaa

SEQ ID NO: 1604049 - RNA, 17 nt, Homo sapiens
gcucccacauaagcacu

SEQ ID NO: 1604050 - RNA, 21 nt, Homo sapiens
gcucccagcugugcuguggag

SEQ ID NO: 1604051 - RNA, 20 nt, Homo sapiens
gcucccaugcucauaccucu

SEQ ID NO: 1604052 - RNA, 21 nt, Homo sapiens
gcuccccacgucagcugggac

SEQ ID NO: 1604053 - RNA, 15 nt, Homo sapiens
gcuccuagcacccug

SEQ ID NO: 1604054 - RNA, 22 nt, Homo sapiens
gcuccugcccaggccacagaga

SEQ ID NO: 1604055 - RNA, 18 nt, Homo sapiens
gcuccuguucacaccaga

SEQ ID NO: 1604056 - RNA, 13 nt, Homo sapiens
gcuccuuccagac

SEQ ID NO: 1604057 - RNA, 15 nt, Homo sapiens
gcuccuuccagaccu

SEQ ID NO: 1604058 - RNA, 19 nt, Homo sapiens
gcucgcauuugucaaugac

SEQ ID NO: 1604059 - RNA, 16 nt, Homo sapiens
gcucggggacagguga

SEQ ID NO: 1604060 - RNA, 16 nt, Homo sapiens
gcucguggacugugcu

SEQ ID NO: 1604061 - RNA, 19 nt, Homo sapiens
gcucuacccugaguucaua

SEQ ID NO: 1604062 - RNA, 13 nt, Homo sapiens
gcucuaguuuuca

SEQ ID NO: 1604063 - RNA, 17 nt, Homo sapiens
gcucuccuccaccucaa

SEQ ID NO: 1604064 - RNA, 14 nt, Homo sapiens
gcucucgacaguau

SEQ ID NO: 1604065 - RNA, 17 nt, Homo sapiens
gcucugagaaaguacaa

SEQ ID NO: 1604066 - RNA, 13 nt, Homo sapiens
gcucugccucaga

SEQ ID NO: 1604067 - RNA, 16 nt, Homo sapiens
ggagucagggaccugc

SEQ ID NO: 1604068 - RNA, 23 nt, Homo sapiens
ggagugaggaugucugggccacu

SEQ ID NO: 1604069 - RNA, 23 nt, Homo sapiens
ggauaauauccagccucccacaa

SEQ ID NO: 1604070 - RNA, 20 nt, Homo sapiens
ggauacaauguauaagcuac

SEQ ID NO: 1604071 - RNA, 15 nt, Homo sapiens
ggauacgacacaugc

SEQ ID NO: 1604072 - RNA, 17 nt, Homo sapiens
ggauacuggugcaguca

SEQ ID NO: 1604073 - RNA, 23 nt, Homo sapiens
ggauauucuccucggacugugug

SEQ ID NO: 1604074 - RNA, 23 nt, Homo sapiens
ggaucagcaacccuuccugcugc

SEQ ID NO: 1604075 - RNA, 22 nt, Homo sapiens
ggaucagcugguucaguacugu

SEQ ID NO: 1604076 - RNA, 22 nt, Homo sapiens
ggaucaguuaacuauugcauuu

SEQ ID NO: 1604077 - RNA, 15 nt, Homo sapiens
ggauccuccacagag

SEQ ID NO: 1604078 - RNA, 14 nt, Homo sapiens
ggauccugcacucu

SEQ ID NO: 1604079 - RNA, 13 nt, Homo sapiens
ggaucuaccagca

SEQ ID NO: 1604080 - RNA, 18 nt, Homo sapiens
ggaucugucugugcacau

SEQ ID NO: 1604081 - RNA, 17 nt, Homo sapiens
ggaugaagcccuaaaga

SEQ ID NO: 1604082 - RNA, 19 nt, Homo sapiens
ggaugauucaagccauucc

SEQ ID NO: 1604083 - RNA, 18 nt, Homo sapiens
ggaugcccauuccugccu

SEQ ID NO: 1604084 - RNA, 21 nt, Homo sapiens
ggauggagcugaaaacauaac

SEQ ID NO: 1604085 - RNA, 18 nt, Homo sapiens
ggauggcuuaagccugug

SEQ ID NO: 1604086 - RNA, 14 nt, Homo sapiens
ggauggggcuccca

SEQ ID NO: 1604087 - RNA, 21 nt, Homo sapiens
ggaugguucucagaaccauuu

SEQ ID NO: 1604088 - RNA, 15 nt, Homo sapiens
ggaugguucugugac

SEQ ID NO: 1604089 - RNA, 22 nt, Homo sapiens
ggaugguuuuaucuucccuuua

SEQ ID NO: 1604090 - RNA, 16 nt, Homo sapiens
ggauguaccagcaucu

SEQ ID NO: 1604091 - RNA, 12 nt, Homo sapiens
ggaugucucuca

SEQ ID NO: 1604092 - RNA, 14 nt, Homo sapiens
ggauuacacauuuc

SEQ ID NO: 1604093 - RNA, 16 nt, Homo sapiens
ggauuacaggcuugag

SEQ ID NO: 1604094 - RNA, 21 nt, Homo sapiens
ggauucauguccagagcucau

SEQ ID NO: 1604095 - RNA, 18 nt, Homo sapiens
ggauuccucaccaagcuc

SEQ ID NO: 1604096 - RNA, 22 nt, Homo sapiens
ggauugucuuacuguugcauaa

SEQ ID NO: 1604097 - RNA, 23 nt, Homo sapiens
ggauuuaucccccgcaaagacau

SEQ ID NO: 1604098 - RNA, 16 nt, Homo sapiens
ggauuucauacuguaa

SEQ ID NO: 1604099 - RNA, 14 nt, Homo sapiens
ggauuuuaccaaag

SEQ ID NO: 1604100 - RNA, 15 nt, Homo sapiens
ggauuuuaccaaagc

SEQ ID NO: 1604101 - RNA, 17 nt, Homo sapiens
ggauuuuaccaaagcau

SEQ ID NO: 1604102 - RNA, 17 nt, Homo sapiens
ggauuuucacagaggaa

SEQ ID NO: 1604103 - RNA, 15 nt, Homo sapiens
ggcaaagaaggauua

SEQ ID NO: 1604104 - RNA, 15 nt, Homo sapiens
ggcaaagccuaguga

SEQ ID NO: 1604105 - RNA, 12 nt, Homo sapiens
ggcaaaugaauu

SEQ ID NO: 1604106 - RNA, 13 nt, Homo sapiens
ggcaaaugccuga

SEQ ID NO: 1604107 - RNA, 17 nt, Homo sapiens
ggcaacauaccaagacc

SEQ ID NO: 1604108 - RNA, 22 nt, Homo sapiens
ggcaagagaauugaaaugaggu

SEQ ID NO: 1604109 - RNA, 23 nt, Homo sapiens
ggcaagaggaauuacgugcucug

SEQ ID NO: 1604110 - RNA, 16 nt, Homo sapiens
ggcaagcguguucuca

SEQ ID NO: 1604111 - RNA, 19 nt, Homo sapiens
ggcaaucaugagcaaguga

SEQ ID NO: 1604112 - RNA, 13 nt, Homo sapiens
ggcaauucacaaa

SEQ ID NO: 1604113 - RNA, 19 nt, Homo sapiens
ggcacaagugucugugcau

SEQ ID NO: 1604114 - RNA, 12 nt, Homo sapiens
ggcacacagcua

SEQ ID NO: 1604115 - RNA, 13 nt, Homo sapiens
ggcacagucucca

SEQ ID NO: 1604116 - RNA, 18 nt, Homo sapiens
ggcacagucuccaugugu

SEQ ID NO: 1604117 - RNA, 22 nt, Homo sapiens
ggcacccaaaacucaagcaaga

SEQ ID NO: 1604118 - RNA, 15 nt, Homo sapiens
ggcacccucagggag

SEQ ID NO: 1604119 - RNA, 17 nt, Homo sapiens
ggcaccguggugugagc

SEQ ID NO: 1604120 - RNA, 20 nt, Homo sapiens
ggcagaauaaauaagcaaaa

SEQ ID NO: 1604121 - RNA, 19 nt, Homo sapiens
ggcagacugugaacuugac

SEQ ID NO: 1604122 - RNA, 14 nt, Homo sapiens
ggcagaucacuuga

SEQ ID NO: 1604123 - RNA, 20 nt, Homo sapiens
ggcagauuuucaugcaaaag

SEQ ID NO: 1604124 - RNA, 14 nt, Homo sapiens
ggcagccaccagcg

SEQ ID NO: 1604125 - RNA, 19 nt, Homo sapiens
ggcagcccagugcugccac

SEQ ID NO: 1604126 - RNA, 22 nt, Homo sapiens
ggcagcugccucugcucccucu

SEQ ID NO: 1604127 - RNA, 21 nt, Homo sapiens
ggcagcuguccugugauguca

SEQ ID NO: 1604128 - RNA, 22 nt, Homo sapiens
ggcagcuguccugugaugucag

SEQ ID NO: 1604129 - RNA, 18 nt, Homo sapiens
ggcaggaacaaacagggc

SEQ ID NO: 1604130 - RNA, 16 nt, Homo sapiens
ggcaggagaauggugu

SEQ ID NO: 1604131 - RNA, 20 nt, Homo sapiens
ggcaggagagucacuugaac

SEQ ID NO: 1604132 - RNA, 20 nt, Homo sapiens
ggcaggcugggccaugucca

SEQ ID NO: 1604133 - RNA, 20 nt, Homo sapiens
ggcagggccaggccucugcu

SEQ ID NO: 1604134 - RNA, 16 nt, Homo sapiens
ggcagggggcaggccu

SEQ ID NO: 1604135 - RNA, 16 nt, Homo sapiens
ggcaggugaaaagggu

SEQ ID NO: 1604136 - RNA, 20 nt, Homo sapiens
ggcagucaugcugggucucc

SEQ ID NO: 1604137 - RNA, 21 nt, Homo sapiens
ggcagucaugcugggucucca

SEQ ID NO: 1604138 - RNA, 21 nt, Homo sapiens
ggcagugguguggagaagcca

SEQ ID NO: 1604139 - RNA, 19 nt, Homo sapiens
ggcauaguccccagagcuc

SEQ ID NO: 1604140 - RNA, 18 nt, Homo sapiens
ggcauaugguccuagaca

SEQ ID NO: 1604141 - RNA, 22 nt, Homo sapiens
ggcaucaaaaaagauagaucua

SEQ ID NO: 1604142 - RNA, 22 nt, Homo sapiens
ggcaucuauuuccucugugcaa

SEQ ID NO: 1604143 - RNA, 22 nt, Homo sapiens
ggcaucuuugccuugggcugcu

SEQ ID NO: 1604144 - RNA, 10 nt, Homo sapiens
ggcauuauua

SEQ ID NO: 1604145 - RNA, 14 nt, Homo sapiens
ggccaacagcaccu

SEQ ID NO: 1604146 - RNA, 14 nt, Homo sapiens
ggccaacaugucag

SEQ ID NO: 1604147 - RNA, 12 nt, Homo sapiens
ggccaaugucag

SEQ ID NO: 1604148 - RNA, 15 nt, Homo sapiens
ggccacacccaggaa

SEQ ID NO: 1604149 - RNA, 10 nt, Homo sapiens
ggccacagac

SEQ ID NO: 1604150 - RNA, 12 nt, Homo sapiens
ggccacauucaa

SEQ ID NO: 1604151 - RNA, 15 nt, Homo sapiens
ggccacccagccagg

SEQ ID NO: 1604152 - RNA, 19 nt, Homo sapiens
ggccagcaagcucuucacu

SEQ ID NO: 1604153 - RNA, 16 nt, Homo sapiens
ggccagcaccaucucu

SEQ ID NO: 1604154 - RNA, 20 nt, Homo sapiens
ggccaggcacccccaaauca

SEQ ID NO: 1604155 - RNA, 15 nt, Homo sapiens
ggccagguccugugc

SEQ ID NO: 1604156 - RNA, 13 nt, Homo sapiens
ggccauauuaccc

SEQ ID NO: 1604157 - RNA, 16 nt, Homo sapiens
ggccauguccaaagag

SEQ ID NO: 1604158 - RNA, 19 nt, Homo sapiens
ggcccagaagccugaucuu

SEQ ID NO: 1604159 - RNA, 17 nt, Homo sapiens
ggcccaggaguccaggc

SEQ ID NO: 1604160 - RNA, 18 nt, Homo sapiens
ggcccaucucuucuggcc

SEQ ID NO: 1604161 - RNA, 14 nt, Homo sapiens
ggccccauccucau

SEQ ID NO: 1604162 - RNA, 12 nt, Homo sapiens
ggccccaucucu

SEQ ID NO: 1604163 - RNA, 19 nt, Homo sapiens
ggccccucacccaccaugg

SEQ ID NO: 1604164 - RNA, 20 nt, Homo sapiens
ggcccuaaaggacucuccag

SEQ ID NO: 1604165 - RNA, 22 nt, Homo sapiens
ggcccugcagccggagaucuga

SEQ ID NO: 1604166 - RNA, 14 nt, Homo sapiens
ggcccuggcuuccc

SEQ ID NO: 1604167 - RNA, 20 nt, Homo sapiens
ggcccuggggaucuucccac

SEQ ID NO: 1604168 - RNA, 15 nt, Homo sapiens
ggcccuucacuucca

SEQ ID NO: 1604169 - RNA, 15 nt, Homo sapiens
ggccgccagacucga

SEQ ID NO: 1604170 - RNA, 20 nt, Homo sapiens
ggccgguucuaaggcucaga

SEQ ID NO: 1604171 - RNA, 17 nt, Homo sapiens
ggccuaccccaguuccu

SEQ ID NO: 1604172 - RNA, 21 nt, Homo sapiens
ggccuaccccaguuccuagca

SEQ ID NO: 1604173 - RNA, 22 nt, Homo sapiens
ggccucacccaccccugcacag

SEQ ID NO: 1604174 - RNA, 17 nt, Homo sapiens
ggccuccaaacacagau

SEQ ID NO: 1604175 - RNA, 20 nt, Homo sapiens
ggccucccaaagugcugaga

SEQ ID NO: 1604176 - RNA, 22 nt, Homo sapiens
ggccuccuuggcaaugcauuug

SEQ ID NO: 1604177 - RNA, 19 nt, Homo sapiens
ggccugaaaugacauuuca

SEQ ID NO: 1604178 - RNA, 17 nt, Homo sapiens
ggccugacugacuuuuu

SEQ ID NO: 1604179 - RNA, 21 nt, Homo sapiens
ggccugagaugcaggugaugc

SEQ ID NO: 1604180 - RNA, 20 nt, Homo sapiens
ggccugcuagucacuggaaa

SEQ ID NO: 1604181 - RNA, 14 nt, Homo sapiens
ggccuuaaccauga

SEQ ID NO: 1604182 - RNA, 14 nt, Homo sapiens
ggcgccuaagccuu

SEQ ID NO: 1604183 - RNA, 16 nt, Homo sapiens
ggcggcccugaccaau

SEQ ID NO: 1604184 - RNA, 16 nt, Homo sapiens
ggcgucccuuccaacc

SEQ ID NO: 1604185 - RNA, 22 nt, Homo sapiens
uccaagcgcgguuacuauggcc

SEQ ID NO: 1604186 - RNA, 16 nt, Homo sapiens
uccaauauuuugccuu

SEQ ID NO: 1604187 - RNA, 12 nt, Homo sapiens
uccaaucagaac

SEQ ID NO: 1604188 - RNA, 21 nt, Homo sapiens
uccaaugacugagcagcaucc

SEQ ID NO: 1604189 - RNA, 20 nt, Homo sapiens
uccaaugcuguggguuucca

SEQ ID NO: 1604190 - RNA, 14 nt, Homo sapiens
uccaauguguucaa

SEQ ID NO: 1604191 - RNA, 17 nt, Homo sapiens
uccaauuccuugcacau

SEQ ID NO: 1604192 - RNA, 19 nt, Homo sapiens
uccaauuccuugcacauag

SEQ ID NO: 1604193 - RNA, 17 nt, Homo sapiens
uccacaagaacaauuca

SEQ ID NO: 1604194 - RNA, 14 nt, Homo sapiens
uccacacccagcuc

SEQ ID NO: 1604195 - RNA, 16 nt, Homo sapiens
uccacaccuggucuga

SEQ ID NO: 1604196 - RNA, 16 nt, Homo sapiens
uccacagacaucuuuc

SEQ ID NO: 1604197 - RNA, 15 nt, Homo sapiens
uccacagauuaucaa

SEQ ID NO: 1604198 - RNA, 16 nt, Homo sapiens
uccacaggacgcacag

SEQ ID NO: 1604199 - RNA, 14 nt, Homo sapiens
uccacauaagcacu

SEQ ID NO: 1604200 - RNA, 13 nt, Homo sapiens
uccaccagcagca

SEQ ID NO: 1604201 - RNA, 19 nt, Homo sapiens
uccacccaccuggcuucau

SEQ ID NO: 1604202 - RNA, 13 nt, Homo sapiens
uccaccucuacca

SEQ ID NO: 1604203 - RNA, 15 nt, Homo sapiens
uccaccucuaccaaa

SEQ ID NO: 1604204 - RNA, 15 nt, Homo sapiens
uccaccugcacauug

SEQ ID NO: 1604205 - RNA, 17 nt, Homo sapiens
uccaccuuggaccucag

SEQ ID NO: 1604206 - RNA, 16 nt, Homo sapiens
uccacgcccaccagcc

SEQ ID NO: 1604207 - RNA, 15 nt, Homo sapiens
uccacuaaaccccau

SEQ ID NO: 1604208 - RNA, 18 nt, Homo sapiens
uccacuccacacucuuga

SEQ ID NO: 1604209 - RNA, 17 nt, Homo sapiens
uccacucguguguuucu

SEQ ID NO: 1604210 - RNA, 14 nt, Homo sapiens
uccacucugccauu

SEQ ID NO: 1604211 - RNA, 19 nt, Homo sapiens
uccacuggggaaugcuccc

SEQ ID NO: 1604212 - RNA, 23 nt, Homo sapiens
uccacuggggaggaauccuggac

SEQ ID NO: 1604213 - RNA, 15 nt, Homo sapiens
uccacugucaggguu

SEQ ID NO: 1604214 - RNA, 11 nt, Homo sapiens
uccacuuguau

SEQ ID NO: 1604215 - RNA, 23 nt, Homo sapiens
uccagaacaaauuguuuacauaa

SEQ ID NO: 1604216 - RNA, 13 nt, Homo sapiens
uccagaacacucu

SEQ ID NO: 1604217 - RNA, 12 nt, Homo sapiens
uccagacagucg

SEQ ID NO: 1604218 - RNA, 14 nt, Homo sapiens
uccagaccuuauca

SEQ ID NO: 1604219 - RNA, 15 nt, Homo sapiens
uccagagacacugag

SEQ ID NO: 1604220 - RNA, 15 nt, Homo sapiens
uccagagaugacuau

SEQ ID NO: 1604221 - RNA, 14 nt, Homo sapiens
uccagcagauuucc

SEQ ID NO: 1604222 - RNA, 13 nt, Homo sapiens
uccagcagcuuuc

SEQ ID NO: 1604223 - RNA, 21 nt, Homo sapiens
uccagcugacccugguucucu

SEQ ID NO: 1604224 - RNA, 17 nt, Homo sapiens
uccaggaaaguggccaa

SEQ ID NO: 1604225 - RNA, 14 nt, Homo sapiens
uccaggaucuuuga

SEQ ID NO: 1604226 - RNA, 19 nt, Homo sapiens
uccaggauuuuaauuucag

SEQ ID NO: 1604227 - RNA, 18 nt, Homo sapiens
uccaggcccacggcucaa

SEQ ID NO: 1604228 - RNA, 13 nt, Homo sapiens
uccaggcccucca

SEQ ID NO: 1604229 - RNA, 19 nt, Homo sapiens
uccagggaauggagcucag

SEQ ID NO: 1604230 - RNA, 20 nt, Homo sapiens
uccagggcuauaggguguga

SEQ ID NO: 1604231 - RNA, 23 nt, Homo sapiens
uccagggcuauagggugugauga

SEQ ID NO: 1604232 - RNA, 19 nt, Homo sapiens
uccagggcuggacugaggc

SEQ ID NO: 1604233 - RNA, 16 nt, Homo sapiens
uccaggugauucuguu

SEQ ID NO: 1604234 - RNA, 21 nt, Homo sapiens
uccagguuauugcaauaaagu

SEQ ID NO: 1604235 - RNA, 20 nt, Homo sapiens
uccaguagugggaucaucca

SEQ ID NO: 1604236 - RNA, 18 nt, Homo sapiens
uccagucaacaucgugga

SEQ ID NO: 1604237 - RNA, 16 nt, Homo sapiens
uccagucccaugaccu

SEQ ID NO: 1604238 - RNA, 13 nt, Homo sapiens
uccagugcuucaa

SEQ ID NO: 1604239 - RNA, 17 nt, Homo sapiens
uccauagacacaguauu

SEQ ID NO: 1604240 - RNA, 13 nt, Homo sapiens
uccauagauuucg

SEQ ID NO: 1604241 - RNA, 23 nt, Homo sapiens
uccauaucccuuccucucaggcu

SEQ ID NO: 1604242 - RNA, 15 nt, Homo sapiens
uccaucaacucccaa

SEQ ID NO: 1604243 - RNA, 18 nt, Homo sapiens
uccaucagaaaaccaaag

SEQ ID NO: 1604244 - RNA, 15 nt, Homo sapiens
uccaucaucacugua

SEQ ID NO: 1604245 - RNA, 20 nt, Homo sapiens
uccaucuuuacaaaacuaca

SEQ ID NO: 1604246 - RNA, 19 nt, Homo sapiens
uccaugaccuaguuuucca

SEQ ID NO: 1604247 - RNA, 17 nt, Homo sapiens
uccaugcucaccaagga

SEQ ID NO: 1604248 - RNA, 22 nt, Homo sapiens
uccaugcuccucaccugucuag

SEQ ID NO: 1604249 - RNA, 21 nt, Homo sapiens
uccauguagaauaaaugaaga

SEQ ID NO: 1604250 - RNA, 21 nt, Homo sapiens
uccaugugaccgaacacugca

SEQ ID NO: 1604251 - RNA, 22 nt, Homo sapiens
uccauguuugcaccugugcauu

SEQ ID NO: 1604252 - RNA, 13 nt, Homo sapiens
uccauuagucaau

SEQ ID NO: 1604253 - RNA, 15 nt, Homo sapiens
uccauucucugaguc

SEQ ID NO: 1604254 - RNA, 20 nt, Homo sapiens
uccauuuauucuuugaucuu

SEQ ID NO: 1604255 - RNA, 14 nt, Homo sapiens
ucccaaagcucaga

SEQ ID NO: 1604256 - RNA, 14 nt, Homo sapiens
ucccaaagugaacu

SEQ ID NO: 1604257 - RNA, 14 nt, Homo sapiens
ucccaacacuguca

SEQ ID NO: 1604258 - RNA, 13 nt, Homo sapiens
ucccaacccauuc

SEQ ID NO: 1604259 - RNA, 16 nt, Homo sapiens
ucccaaccccagugga

SEQ ID NO: 1604260 - RNA, 20 nt, Homo sapiens
ucccaagguccucucaguuc

SEQ ID NO: 1604261 - RNA, 13 nt, Homo sapiens
ucccaagugccaa

SEQ ID NO: 1604262 - RNA, 15 nt, Homo sapiens
ucccaaucggccuua

SEQ ID NO: 1604263 - RNA, 14 nt, Homo sapiens
ucccaaucuugccc

SEQ ID NO: 1604264 - RNA, 15 nt, Homo sapiens
ucccacaaugcugau

SEQ ID NO: 1604265 - RNA, 20 nt, Homo sapiens
ucccacaugaggccaucuca

SEQ ID NO: 1604266 - RNA, 16 nt, Homo sapiens
ucccaccccuaccucu

SEQ ID NO: 1604267 - RNA, 17 nt, Homo sapiens
ucccaccccuaccucua

SEQ ID NO: 1604268 - RNA, 20 nt, Homo sapiens
ucccaccccuaccucuagua

SEQ ID NO: 1604269 - RNA, 19 nt, Homo sapiens
ucccaccugccacaguuca

SEQ ID NO: 1604270 - RNA, 16 nt, Homo sapiens
ucccacguucuguuaa

SEQ ID NO: 1604271 - RNA, 18 nt, Homo sapiens
ucccacuguuuaaggagu

SEQ ID NO: 1604272 - RNA, 15 nt, Homo sapiens
ucccagaaguccaca

SEQ ID NO: 1604273 - RNA, 17 nt, Homo sapiens
ucccagauagcugcauu

SEQ ID NO: 1604274 - RNA, 22 nt, Homo sapiens
ucccagauguaaauagaacaac

SEQ ID NO: 1604275 - RNA, 21 nt, Homo sapiens
ucccagauuggcucacacuga

SEQ ID NO: 1604276 - RNA, 21 nt, Homo sapiens
ucccagcuccuuucaugcucc

SEQ ID NO: 1604277 - RNA, 14 nt, Homo sapiens
ucccaggaagccca

SEQ ID NO: 1604278 - RNA, 16 nt, Homo sapiens
ucccaggcuucccaaa

SEQ ID NO: 1604279 - RNA, 12 nt, Homo sapiens
ucccagucccau

SEQ ID NO: 1604280 - RNA, 20 nt, Homo sapiens
ucccauaauugcuuugccaa

SEQ ID NO: 1604281 - RNA, 14 nt, Homo sapiens
ucccaucucuacaa

SEQ ID NO: 1604282 - RNA, 16 nt, Homo sapiens
ucccaugaccccaaag

SEQ ID NO: 1604283 - RNA, 19 nt, Homo sapiens
ucccaugagggagaugcca

SEQ ID NO: 1604284 - RNA, 20 nt, Homo sapiens
ucccaugagggagaugccau

SEQ ID NO: 1604285 - RNA, 16 nt, Homo sapiens
ucccauucagcuguga

SEQ ID NO: 1604286 - RNA, 13 nt, Homo sapiens
ucccauugccaug

SEQ ID NO: 1604287 - RNA, 22 nt, Homo sapiens
ucccauuguggcuccuaucugu

SEQ ID NO: 1604288 - RNA, 22 nt, Homo sapiens
ucccauuucaauuccugugauu

SEQ ID NO: 1604289 - RNA, 21 nt, Homo sapiens
ucccauuuuucucuugccauu

SEQ ID NO: 1604290 - RNA, 20 nt, Homo sapiens
ucccauuuuugcuuagcuca

SEQ ID NO: 1604291 - RNA, 14 nt, Homo sapiens
uccccaacaccugc

SEQ ID NO: 1604292 - RNA, 16 nt, Homo sapiens
uccccaauuacagggu

SEQ ID NO: 1604293 - RNA, 23 nt, Homo sapiens
uccccacgagggcuggcuggccu

SEQ ID NO: 1604294 - RNA, 21 nt, Homo sapiens
uccccagccccuccucccuca

SEQ ID NO: 1604295 - RNA, 15 nt, Homo sapiens
uccccaguucagugu

SEQ ID NO: 1604296 - RNA, 19 nt, Homo sapiens
uccccaguucuacugaccu

SEQ ID NO: 1604297 - RNA, 20 nt, Homo sapiens
uccccaguugccgucuagga

SEQ ID NO: 1604298 - RNA, 17 nt, Homo sapiens
ucccccacuccucccua

SEQ ID NO: 1604299 - RNA, 13 nt, Homo sapiens
ucccccaguuccu

SEQ ID NO: 1604300 - RNA, 21 nt, Homo sapiens
ucccccaguuccucccaggaa

SEQ ID NO: 1604301 - RNA, 17 nt, Homo sapiens
ucccccguggugccugc

SEQ ID NO: 1604302 - RNA, 13 nt, Homo sapiens
ucccccugccucc

SEQ ID NO: 1604303 - RNA, 19 nt, Homo sapiens
ucccccuuugugcacauuu

SEQ ID NO: 1604304 - RNA, 19 nt, Homo sapiens
ucucagcucaccucaaccu

SEQ ID NO: 1604305 - RNA, 15 nt, Homo sapiens
ucucagcugcuggau

SEQ ID NO: 1604306 - RNA, 18 nt, Homo sapiens
ucucaggccugacucuca

SEQ ID NO: 1604307 - RNA, 21 nt, Homo sapiens
ucucaggcucuugacuacuug

SEQ ID NO: 1604308 - RNA, 20 nt, Homo sapiens
ucucaguaccccauggagcu

SEQ ID NO: 1604309 - RNA, 12 nt, Homo sapiens
ucucaucacuca

SEQ ID NO: 1604310 - RNA, 13 nt, Homo sapiens
ucucauccaucau

SEQ ID NO: 1604311 - RNA, 19 nt, Homo sapiens
ucucaucuuucuugaucaa

SEQ ID NO: 1604312 - RNA, 17 nt, Homo sapiens
ucucaugaccaaaugcu

SEQ ID NO: 1604313 - RNA, 17 nt, Homo sapiens
ucucaugauagaaggcu

SEQ ID NO: 1604314 - RNA, 17 nt, Homo sapiens
ucucaugccagugccuu

SEQ ID NO: 1604315 - RNA, 18 nt, Homo sapiens
ucucaugccagugccuua

SEQ ID NO: 1604316 - RNA, 15 nt, Homo sapiens
ucucauuuaagggaa

SEQ ID NO: 1604317 - RNA, 10 nt, Homo sapiens
ucucauuucu

SEQ ID NO: 1604318 - RNA, 21 nt, Homo sapiens
ucuccaaccccccagcacuga

SEQ ID NO: 1604319 - RNA, 18 nt, Homo sapiens
ucuccaaggcagggacca

SEQ ID NO: 1604320 - RNA, 14 nt, Homo sapiens
ucuccaauuugaag

SEQ ID NO: 1604321 - RNA, 20 nt, Homo sapiens
ucuccacgguagcacuugac

SEQ ID NO: 1604322 - RNA, 18 nt, Homo sapiens
ucuccacucaugugacuc

SEQ ID NO: 1604323 - RNA, 20 nt, Homo sapiens
ucuccacuggaaaacugcua

SEQ ID NO: 1604324 - RNA, 13 nt, Homo sapiens
ucuccaggcauuu

SEQ ID NO: 1604325 - RNA, 21 nt, Homo sapiens
ucuccagggguuuacagugaa

SEQ ID NO: 1604326 - RNA, 15 nt, Homo sapiens
ucuccaucucaaaaa

SEQ ID NO: 1604327 - RNA, 13 nt, Homo sapiens
ucuccaugcucac

SEQ ID NO: 1604328 - RNA, 20 nt, Homo sapiens
ucuccauggcccugucccag

SEQ ID NO: 1604329 - RNA, 23 nt, Homo sapiens
ucucccaacaugggagggaucag

SEQ ID NO: 1604330 - RNA, 18 nt, Homo sapiens
ucucccauacuuuugaag

SEQ ID NO: 1604331 - RNA, 13 nt, Homo sapiens
ucucccaucucuu

SEQ ID NO: 1604332 - RNA, 21 nt, Homo sapiens
ucucccauuucuugcuagcua

SEQ ID NO: 1604333 - RNA, 18 nt, Homo sapiens
ucucccauuuuggaauuu

SEQ ID NO: 1604334 - RNA, 21 nt, Homo sapiens
ucuccccaggaaguggcucag

SEQ ID NO: 1604335 - RNA, 21 nt, Homo sapiens
ucuccccuugucugcacuguu

SEQ ID NO: 1604336 - RNA, 16 nt, Homo sapiens
ucucccuccucugccc

SEQ ID NO: 1604337 - RNA, 14 nt, Homo sapiens
ucuccgacucugca

SEQ ID NO: 1604338 - RNA, 12 nt, Homo sapiens
ucuccucagggu

SEQ ID NO: 1604339 - RNA, 17 nt, Homo sapiens
ucuccuggacucagggu

SEQ ID NO: 1604340 - RNA, 18 nt, Homo sapiens
ucuccuuggccacagacu

SEQ ID NO: 1604341 - RNA, 23 nt, Homo sapiens
ucuccuuugaaaccugcucugua

SEQ ID NO: 1604342 - RNA, 13 nt, Homo sapiens
ucuccuuuuccua

SEQ ID NO: 1604343 - RNA, 15 nt, Homo sapiens
ucucgguuugccaaa

SEQ ID NO: 1604344 - RNA, 16 nt, Homo sapiens
ucucguaguccaucac

SEQ ID NO: 1604345 - RNA, 15 nt, Homo sapiens
ucucuaaaccaucua

SEQ ID NO: 1604346 - RNA, 18 nt, Homo sapiens
ucucuaacuccugccauu

SEQ ID NO: 1604347 - RNA, 15 nt, Homo sapiens
ucucucaaaacaaua

SEQ ID NO: 1604348 - RNA, 12 nt, Homo sapiens
ucucucaucucu

SEQ ID NO: 1604349 - RNA, 13 nt, Homo sapiens
ucucucccaugga

SEQ ID NO: 1604350 - RNA, 16 nt, Homo sapiens
ucucuccuuggccaca

SEQ ID NO: 1604351 - RNA, 16 nt, Homo sapiens
ucucucgcaagggaag

SEQ ID NO: 1604352 - RNA, 15 nt, Homo sapiens
ucucucucuuagcau

SEQ ID NO: 1604353 - RNA, 16 nt, Homo sapiens
ucucucugucccugua

SEQ ID NO: 1604354 - RNA, 13 nt, Homo sapiens
ucucugagcucug

SEQ ID NO: 1604355 - RNA, 17 nt, Homo sapiens
ucucugauuccccaaau

SEQ ID NO: 1604356 - RNA, 17 nt, Homo sapiens
ucucugcaaagacuaga

SEQ ID NO: 1604357 - RNA, 15 nt, Homo sapiens
ucucugcagcucuga

SEQ ID NO: 1604358 - RNA, 23 nt, Homo sapiens
ucucugccuguacugaagcugaa

SEQ ID NO: 1604359 - RNA, 14 nt, Homo sapiens
ucucugcuaucuag

SEQ ID NO: 1604360 - RNA, 18 nt, Homo sapiens
ucucugcuccaccacauc

SEQ ID NO: 1604361 - RNA, 12 nt, Homo sapiens
ucucugcugcua

SEQ ID NO: 1604362 - RNA, 13 nt, Homo sapiens
ucucuggaguauu

SEQ ID NO: 1604363 - RNA, 14 nt, Homo sapiens
ucucuggaguauuc

SEQ ID NO: 1604364 - RNA, 16 nt, Homo sapiens
ucucugggacucuccu

SEQ ID NO: 1604365 - RNA, 20 nt, Homo sapiens
ucucugggauuuaugcucau

SEQ ID NO: 1604366 - RNA, 21 nt, Homo sapiens
ucucuggggcaggcugcuuca

SEQ ID NO: 1604367 - RNA, 20 nt, Homo sapiens
ucucuggggcuguguuuuga

SEQ ID NO: 1604368 - RNA, 12 nt, Homo sapiens
ucucugugaaag

SEQ ID NO: 1604369 - RNA, 20 nt, Homo sapiens
ucucuguguaguuccagcaa

SEQ ID NO: 1604370 - RNA, 15 nt, Homo sapiens
ucucuuagcaacuca

SEQ ID NO: 1604371 - RNA, 22 nt, Homo sapiens
ucucuuccucauauuucagcag

SEQ ID NO: 1604372 - RNA, 19 nt, Homo sapiens
ucucuucuacaauuguggu

SEQ ID NO: 1604373 - RNA, 13 nt, Homo sapiens
ucucuucuguccc

SEQ ID NO: 1604374 - RNA, 14 nt, Homo sapiens
ucucuugacagucu

SEQ ID NO: 1604375 - RNA, 14 nt, Homo sapiens
ucucuugacuccac

SEQ ID NO: 1604376 - RNA, 14 nt, Homo sapiens
ucucuuugagucaa

SEQ ID NO: 1604377 - RNA, 16 nt, Homo sapiens
ucucuuugagucaaua

SEQ ID NO: 1604378 - RNA, 12 nt, Homo sapiens
ucucuuuggucu

SEQ ID NO: 1604379 - RNA, 13 nt, Homo sapiens
ucugaaacagcuu

SEQ ID NO: 1604380 - RNA, 17 nt, Homo sapiens
ucugaaaucagugccua

SEQ ID NO: 1604381 - RNA, 15 nt, Homo sapiens
ucugaaccucuucaa

SEQ ID NO: 1604382 - RNA, 23 nt, Homo sapiens
ucugaacugaccuugaaucuuuu

SEQ ID NO: 1604383 - RNA, 14 nt, Homo sapiens
ucugaagaguagaa

SEQ ID NO: 1604384 - RNA, 20 nt, Homo sapiens
ucugaauuugcaaaguacug

SEQ ID NO: 1604385 - RNA, 22 nt, Homo sapiens
ucugaauuugcaaaguacugua

SEQ ID NO: 1604386 - RNA, 19 nt, Homo sapiens
ucugacaauuaacauacau

SEQ ID NO: 1604387 - RNA, 13 nt, Homo sapiens
ucugacaggugaa

SEQ ID NO: 1604388 - RNA, 15 nt, Homo sapiens
ucugacucugagcua

SEQ ID NO: 1604389 - RNA, 14 nt, Homo sapiens
ucugagaccaaagu

SEQ ID NO: 1604390 - RNA, 13 nt, Homo sapiens
ucugagauacuaa

SEQ ID NO: 1604391 - RNA, 17 nt, Homo sapiens
ucugagaucagugccua

SEQ ID NO: 1604392 - RNA, 21 nt, Homo sapiens
ucugagcccccacugcuucua

SEQ ID NO: 1604393 - RNA, 13 nt, Homo sapiens
ucugagcugugca

SEQ ID NO: 1604394 - RNA, 14 nt, Homo sapiens
ucugaguaagcccu

SEQ ID NO: 1604395 - RNA, 13 nt, Homo sapiens
ucugagugccuuc

SEQ ID NO: 1604396 - RNA, 22 nt, Homo sapiens
ucugauaagagaaucaacauuu

SEQ ID NO: 1604397 - RNA, 20 nt, Homo sapiens
ucugauggcugaagaaugua

SEQ ID NO: 1604398 - RNA, 17 nt, Homo sapiens
ucugauucuacagugau

SEQ ID NO: 1604399 - RNA, 16 nt, Homo sapiens
ucugauuuacauucaa

SEQ ID NO: 1604400 - RNA, 23 nt, Homo sapiens
ucugauuuauguuuugaucaaau

SEQ ID NO: 1604401 - RNA, 16 nt, Homo sapiens
ucugauuucugaagug

SEQ ID NO: 1604402 - RNA, 20 nt, Homo sapiens
ucugcaaaaggccucuugua

SEQ ID NO: 1604403 - RNA, 17 nt, Homo sapiens
ucugcaaagacuagauc

SEQ ID NO: 1604404 - RNA, 16 nt, Homo sapiens
ucugcaacauuugaca

SEQ ID NO: 1604405 - RNA, 22 nt, Homo sapiens
ucugcaacauuugacaaaacua

SEQ ID NO: 1604406 - RNA, 23 nt, Homo sapiens
ucugcaagugaggugugucacaa

SEQ ID NO: 1604407 - RNA, 23 nt, Homo sapiens
ucugcaauaugaauucaagaaag

SEQ ID NO: 1604408 - RNA, 14 nt, Homo sapiens
ucugcacagauucu

SEQ ID NO: 1604409 - RNA, 17 nt, Homo sapiens
ucugcacauaggcagua

SEQ ID NO: 1604410 - RNA, 23 nt, Homo sapiens
ucugcacuuauaagaaagaucaa

SEQ ID NO: 1604411 - RNA, 23 nt, Homo sapiens
ucugcaggcuggggaggugcugg

SEQ ID NO: 1604412 - RNA, 14 nt, Homo sapiens
ucugcaguuuaaca

SEQ ID NO: 1604413 - RNA, 19 nt, Homo sapiens
ucugcauccagagauucau

SEQ ID NO: 1604414 - RNA, 20 nt, Homo sapiens
ucugcauccagagauucauu

SEQ ID NO: 1604415 - RNA, 18 nt, Homo sapiens
ucugcauccuggcuugaa

SEQ ID NO: 1604416 - RNA, 17 nt, Homo sapiens
ucugcauuucauauuau

SEQ ID NO: 1604417 - RNA, 20 nt, Homo sapiens
ucugccaaaguaaaacaaua

SEQ ID NO: 1604418 - RNA, 16 nt, Homo sapiens
ucugccagaagauccc

SEQ ID NO: 1604419 - RNA, 19 nt, Homo sapiens
ucugccccagguacaccuc

SEQ ID NO: 1604420 - RNA, 17 nt, Homo sapiens
ucugcccgcuccaugga

SEQ ID NO: 1604421 - RNA, 14 nt, Homo sapiens
ucugcccuuguucc

SEQ ID NO: 1604422 - RNA, 14 nt, Homo sapiens
ucugccugcuuaca

SEQ ID NO: 1604423 - RNA, 11 nt, Homo sapiens
ugaagugcaau

SEQ ID NO: 1604424 - RNA, 11 nt, Homo sapiens
ugaagugcuug

SEQ ID NO: 1604425 - RNA, 22 nt, Homo sapiens
ugaauaaacugaaaauggaccu

SEQ ID NO: 1604426 - RNA, 21 nt, Homo sapiens
ugaauaacauuuaaauuccac

SEQ ID NO: 1604427 - RNA, 23 nt, Homo sapiens
ugaauaagcagaacauacuguuc

SEQ ID NO: 1604428 - RNA, 18 nt, Homo sapiens
ugaauaaugcuguuuuau

SEQ ID NO: 1604429 - RNA, 23 nt, Homo sapiens
ugaauacaggagcccucuccuca

SEQ ID NO: 1604430 - RNA, 21 nt, Homo sapiens
ugaauacauuaacggugcuaa

SEQ ID NO: 1604431 - RNA, 21 nt, Homo sapiens
ugaauauagaugcuggccagc

SEQ ID NO: 1604432 - RNA, 19 nt, Homo sapiens
ugaauaugaugacaaucag

SEQ ID NO: 1604433 - RNA, 21 nt, Homo sapiens
ugaauauuuguuauguagaua

SEQ ID NO: 1604434 - RNA, 23 nt, Homo sapiens
ugaaucacauuuuuuuaugcucu

SEQ ID NO: 1604435 - RNA, 19 nt, Homo sapiens
ugaaucagaaugccuucaa

SEQ ID NO: 1604436 - RNA, 17 nt, Homo sapiens
ugaaucagacccuaccc

SEQ ID NO: 1604437 - RNA, 16 nt, Homo sapiens
ugaaucaugaaguaaa

SEQ ID NO: 1604438 - RNA, 21 nt, Homo sapiens
ugaaucauuguauguggucau

SEQ ID NO: 1604439 - RNA, 18 nt, Homo sapiens
ugaauccaaacuaaucca

SEQ ID NO: 1604440 - RNA, 13 nt, Homo sapiens
ugaaucccuuuag

SEQ ID NO: 1604441 - RNA, 19 nt, Homo sapiens
ugaaucugcuuuuccucug

SEQ ID NO: 1604442 - RNA, 20 nt, Homo sapiens
ugaaucuugcuguuuucaau

SEQ ID NO: 1604443 - RNA, 16 nt, Homo sapiens
ugaaugccgaauuugg

SEQ ID NO: 1604444 - RNA, 23 nt, Homo sapiens
ugaaugccucccucaaaggaccu

SEQ ID NO: 1604445 - RNA, 15 nt, Homo sapiens
ugaaugcuuaauuca

SEQ ID NO: 1604446 - RNA, 12 nt, Homo sapiens
ugaaugcuucuc

SEQ ID NO: 1604447 - RNA, 22 nt, Homo sapiens
ugaaugucauugaaaaacuaaa

SEQ ID NO: 1604448 - RNA, 12 nt, Homo sapiens
ugaauguugcau

SEQ ID NO: 1604449 - RNA, 14 nt, Homo sapiens
ugaauguugcauua

SEQ ID NO: 1604450 - RNA, 15 nt, Homo sapiens
ugaauuaaacuuaag

SEQ ID NO: 1604451 - RNA, 17 nt, Homo sapiens
ugaauuccucucaaauu

SEQ ID NO: 1604452 - RNA, 21 nt, Homo sapiens
ugaauuguccuuuucuaggaa

SEQ ID NO: 1604453 - RNA, 13 nt, Homo sapiens
ugaauuuuugcaa

SEQ ID NO: 1604454 - RNA, 14 nt, Homo sapiens
ugaauuuuugcaau

SEQ ID NO: 1604455 - RNA, 14 nt, Homo sapiens
ugacaaaacacagc

SEQ ID NO: 1604456 - RNA, 18 nt, Homo sapiens
ugacaaaacaucuuuuca

SEQ ID NO: 1604457 - RNA, 20 nt, Homo sapiens
ugacaaaacaucuuuucaca

SEQ ID NO: 1604458 - RNA, 20 nt, Homo sapiens
ugacaaaugacgucuucacc

SEQ ID NO: 1604459 - RNA, 12 nt, Homo sapiens
ugacaacauguu

SEQ ID NO: 1604460 - RNA, 14 nt, Homo sapiens
ugacaacuaaacaa

SEQ ID NO: 1604461 - RNA, 18 nt, Homo sapiens
ugacaauacugcugccuu

SEQ ID NO: 1604462 - RNA, 14 nt, Homo sapiens
ugacaaucaucucc

SEQ ID NO: 1604463 - RNA, 16 nt, Homo sapiens
ugacaauccuugagaa

SEQ ID NO: 1604464 - RNA, 19 nt, Homo sapiens
ugacaauugggagcugcca

SEQ ID NO: 1604465 - RNA, 21 nt, Homo sapiens
ugacacauagaaaacaaucaa

SEQ ID NO: 1604466 - RNA, 17 nt, Homo sapiens
ugacacauugcugauau

SEQ ID NO: 1604467 - RNA, 23 nt, Homo sapiens
ugacaccgugggucauuacaaaa

SEQ ID NO: 1604468 - RNA, 16 nt, Homo sapiens
ugacacgucucgccaa

SEQ ID NO: 1604469 - RNA, 23 nt, Homo sapiens
ugacacucuauaagauuccaaaa

SEQ ID NO: 1604470 - RNA, 20 nt, Homo sapiens
ugacagggacaugcccugug

SEQ ID NO: 1604471 - RNA, 19 nt, Homo sapiens
ugacaguccacaggggcca

SEQ ID NO: 1604472 - RNA, 22 nt, Homo sapiens
ugacauaacagugcagggcaaa

SEQ ID NO: 1604473 - RNA, 19 nt, Homo sapiens
ugacauacauauuaucuca

SEQ ID NO: 1604474 - RNA, 16 nt, Homo sapiens
ugacauacauccaaca

SEQ ID NO: 1604475 - RNA, 21 nt, Homo sapiens
ugacauaccuaccaguauuau

SEQ ID NO: 1604476 - RNA, 14 nt, Homo sapiens
ugacauuauaugca

SEQ ID NO: 1604477 - RNA, 16 nt, Homo sapiens
ugacauucacugagug

SEQ ID NO: 1604478 - RNA, 17 nt, Homo sapiens
ugacauuucacuaaaag

SEQ ID NO: 1604479 - RNA, 17 nt, Homo sapiens
ugaccaaacagccaaga

SEQ ID NO: 1604480 - RNA, 23 nt, Homo sapiens
ugaccacucuucuuuaagccaua

SEQ ID NO: 1604481 - RNA, 13 nt, Homo sapiens
ugaccagaagccu

SEQ ID NO: 1604482 - RNA, 19 nt, Homo sapiens
ugaccaguggggcccuucu

SEQ ID NO: 1604483 - RNA, 21 nt, Homo sapiens
ugacccaggccuggccaguca

SEQ ID NO: 1604484 - RNA, 14 nt, Homo sapiens
ugaccccaugucuc

SEQ ID NO: 1604485 - RNA, 15 nt, Homo sapiens
ugaccccaugucucc

SEQ ID NO: 1604486 - RNA, 14 nt, Homo sapiens
ugaccccugcucag

SEQ ID NO: 1604487 - RNA, 21 nt, Homo sapiens
ugacccuaugggucuaggaca

SEQ ID NO: 1604488 - RNA, 17 nt, Homo sapiens
ugacccuccccuaguca

SEQ ID NO: 1604489 - RNA, 12 nt, Homo sapiens
ugacccugagaa

SEQ ID NO: 1604490 - RNA, 19 nt, Homo sapiens
ugaccuugggguacaauug

SEQ ID NO: 1604491 - RNA, 12 nt, Homo sapiens
ugacgcuggaag

SEQ ID NO: 1604492 - RNA, 17 nt, Homo sapiens
ugacgguguccaugccu

SEQ ID NO: 1604493 - RNA, 16 nt, Homo sapiens
ugacuaauagagcucc

SEQ ID NO: 1604494 - RNA, 19 nt, Homo sapiens
ugacucaaaaaugagguac

SEQ ID NO: 1604495 - RNA, 19 nt, Homo sapiens
ugacucagcuaaugucaca

SEQ ID NO: 1604496 - RNA, 16 nt, Homo sapiens
ugacuccuccaaggaa

SEQ ID NO: 1604497 - RNA, 19 nt, Homo sapiens
ugacugcauugccgcugua

SEQ ID NO: 1604498 - RNA, 19 nt, Homo sapiens
ugacugggucagccuuccg

SEQ ID NO: 1604499 - RNA, 16 nt, Homo sapiens
ugacuguucuugguaa

SEQ ID NO: 1604500 - RNA, 19 nt, Homo sapiens
ugacuuaaggggcugggau

SEQ ID NO: 1604501 - RNA, 18 nt, Homo sapiens
ugacuuagcgucaagaca

SEQ ID NO: 1604502 - RNA, 16 nt, Homo sapiens
ugacuuccucugccac

SEQ ID NO: 1604503 - RNA, 19 nt, Homo sapiens
ugacuuccucugccacucc

SEQ ID NO: 1604504 - RNA, 13 nt, Homo sapiens
ugacuugagccac

SEQ ID NO: 1604505 - RNA, 14 nt, Homo sapiens
ugacuugcaaucca

SEQ ID NO: 1604506 - RNA, 20 nt, Homo sapiens
ugacuuugggcaagccaagu

SEQ ID NO: 1604507 - RNA, 15 nt, Homo sapiens
ugagaaaacagggaa

SEQ ID NO: 1604508 - RNA, 17 nt, Homo sapiens
ugagaaaauaucuugcu

SEQ ID NO: 1604509 - RNA, 20 nt, Homo sapiens
ugagaaagcuuuuauuccuu

SEQ ID NO: 1604510 - RNA, 20 nt, Homo sapiens
ugagaaauauggacacuuaa

SEQ ID NO: 1604511 - RNA, 17 nt, Homo sapiens
ugagaaccuaaugcacu

SEQ ID NO: 1604512 - RNA, 13 nt, Homo sapiens
ugagaagcugcca

SEQ ID NO: 1604513 - RNA, 16 nt, Homo sapiens
ugagaaucacugcucc

SEQ ID NO: 1604514 - RNA, 17 nt, Homo sapiens
ugagaaucaugcacuuu

SEQ ID NO: 1604515 - RNA, 16 nt, Homo sapiens
ugagaauuguauguca

SEQ ID NO: 1604516 - RNA, 17 nt, Homo sapiens
ugagaauuguaugucau

SEQ ID NO: 1604517 - RNA, 18 nt, Homo sapiens
ugagacaacaaauggguc

SEQ ID NO: 1604518 - RNA, 18 nt, Homo sapiens
ugagacagcucugcauac

SEQ ID NO: 1604519 - RNA, 15 nt, Homo sapiens
ugagacagucuugcu

SEQ ID NO: 1604520 - RNA, 22 nt, Homo sapiens
ugagaccauccauucuccucag

SEQ ID NO: 1604521 - RNA, 20 nt, Homo sapiens
ugagacccacaggucuaaga

SEQ ID NO: 1604522 - RNA, 15 nt, Homo sapiens
ugagacccugucuca

SEQ ID NO: 1604523 - RNA, 21 nt, Homo sapiens
ugagacuuacuucucugcuau

SEQ ID NO: 1604524 - RNA, 22 nt, Homo sapiens
ugagacuuucuucuagugcuuu

SEQ ID NO: 1604525 - RNA, 15 nt, Homo sapiens
ugagagagacaggca

SEQ ID NO: 1604526 - RNA, 15 nt, Homo sapiens
ugagagagagagugu

SEQ ID NO: 1604527 - RNA, 19 nt, Homo sapiens
ugagagggaaucgacugua

SEQ ID NO: 1604528 - RNA, 21 nt, Homo sapiens
ugagaguaagcacguugccca

SEQ ID NO: 1604529 - RNA, 22 nt, Homo sapiens
ugagaucugugguggucuucaa

SEQ ID NO: 1604530 - RNA, 15 nt, Homo sapiens
ugagaucuuccugcu

SEQ ID NO: 1604531 - RNA, 23 nt, Homo sapiens
ugagaugggagaaucacuugaac

SEQ ID NO: 1604532 - RNA, 17 nt, Homo sapiens
ugagauucaauauugaa

SEQ ID NO: 1604533 - RNA, 16 nt, Homo sapiens
ugagcaagacauacuu

SEQ ID NO: 1604534 - RNA, 16 nt, Homo sapiens
ugagcacccauuccaa

SEQ ID NO: 1604535 - RNA, 20 nt, Homo sapiens
ugagcaccuggacaugucaa

SEQ ID NO: 1604536 - RNA, 19 nt, Homo sapiens
ugagcacggacucucccag

SEQ ID NO: 1604537 - RNA, 15 nt, Homo sapiens
ugagcagagacauga

SEQ ID NO: 1604538 - RNA, 23 nt, Homo sapiens
ugagcaggggcggggacuggagc

SEQ ID NO: 1604539 - RNA, 17 nt, Homo sapiens
ugagcaugcacacugag

SEQ ID NO: 1604540 - RNA, 15 nt, Homo sapiens
ugagcauggggccag

SEQ ID NO: 1604541 - RNA, 15 nt, Homo sapiens
caacaccacuaggaa

SEQ ID NO: 1604542 - RNA, 18 nt, Homo sapiens
caacaccguguccaaaaa

SEQ ID NO: 1604543 - RNA, 17 nt, Homo sapiens
caacaccuuaauaugcu

SEQ ID NO: 1604544 - RNA, 22 nt, Homo sapiens
aacauuuguuuuagucugaaca

SEQ ID NO: 1604545 - RNA, 11 nt, Homo sapiens
aaccaaugcaa

SEQ ID NO: 1604546 - RNA, 23 nt, Homo sapiens
aaccacaaauuuuaaacuuauga

SEQ ID NO: 1604547 - RNA, 23 nt, Homo sapiens
aaccacauaguucguuuaccuuc

SEQ ID NO: 1604548 - RNA, 19 nt, Homo sapiens
aaccacuugccucuuucuc

SEQ ID NO: 1604549 - RNA, 23 nt, Homo sapiens
aaccagcuucugauaaacacaau

SEQ ID NO: 1604550 - RNA, 14 nt, Homo sapiens
aaccauagcacagg

SEQ ID NO: 1604551 - RNA, 14 nt, Homo sapiens
aaccaucagcauca

SEQ ID NO: 1604552 - RNA, 16 nt, Homo sapiens
aaccaucaucuugcca

SEQ ID NO: 1604553 - RNA, 19 nt, Homo sapiens
aaccaucuucguacaugaa

SEQ ID NO: 1604554 - RNA, 19 nt, Homo sapiens
aaccauggugaacuccacc

SEQ ID NO: 1604555 - RNA, 18 nt, Homo sapiens
aaccauguauaugagcuu

SEQ ID NO: 1604556 - RNA, 16 nt, Homo sapiens
aaccauguugguugca

SEQ ID NO: 1604557 - RNA, 18 nt, Homo sapiens
aaccauguugguugcacu

SEQ ID NO: 1604558 - RNA, 23 nt, Homo sapiens
aaccauguugguugcacuuugua

SEQ ID NO: 1604559 - RNA, 19 nt, Homo sapiens
aaccauucacagugcaaga

SEQ ID NO: 1604560 - RNA, 13 nt, Homo sapiens
aaccauuuacuua

SEQ ID NO: 1604561 - RNA, 18 nt, Homo sapiens
aacccaaggacugaggga

SEQ ID NO: 1604562 - RNA, 18 nt, Homo sapiens
aacccaagugcugcacaa

SEQ ID NO: 1604563 - RNA, 17 nt, Homo sapiens
aacccaggggacagcug

SEQ ID NO: 1604564 - RNA, 16 nt, Homo sapiens
aaccccaaacuguuga

SEQ ID NO: 1604565 - RNA, 12 nt, Homo sapiens
aaccccagugga

SEQ ID NO: 1604566 - RNA, 18 nt, Homo sapiens
aaccccccagcacugagg

SEQ ID NO: 1604567 - RNA, 17 nt, Homo sapiens
aaccccuccucccucag

SEQ ID NO: 1604568 - RNA, 19 nt, Homo sapiens
aaccccuccucccucagac

SEQ ID NO: 1604569 - RNA, 14 nt, Homo sapiens
aaccccugaaguau

SEQ ID NO: 1604570 - RNA, 16 nt, Homo sapiens
aacccuaagccaagac

SEQ ID NO: 1604571 - RNA, 12 nt, Homo sapiens
aacccugucucu

SEQ ID NO: 1604572 - RNA, 14 nt, Homo sapiens
aacccuuauuccau

SEQ ID NO: 1604573 - RNA, 19 nt, Homo sapiens
aaccgaggcccucaaucca

SEQ ID NO: 1604574 - RNA, 19 nt, Homo sapiens
aaccgcgggggcugugagc

SEQ ID NO: 1604575 - RNA, 21 nt, Homo sapiens
aaccggcuuuguggcacuggg

SEQ ID NO: 1604576 - RNA, 14 nt, Homo sapiens
aaccgugaagcucu

SEQ ID NO: 1604577 - RNA, 18 nt, Homo sapiens
aaccguguaacacgugaa

SEQ ID NO: 1604578 - RNA, 13 nt, Homo sapiens
aaccuaaugcacu

SEQ ID NO: 1604579 - RNA, 16 nt, Homo sapiens
aaccuaccagccagag

SEQ ID NO: 1604580 - RNA, 23 nt, Homo sapiens
aaccuaguacugccccccaugag

SEQ ID NO: 1604581 - RNA, 22 nt, Homo sapiens
aaccucacaaaguagaggaauc

SEQ ID NO: 1604582 - RNA, 16 nt, Homo sapiens
aaccuccaaauggaau

SEQ ID NO: 1604583 - RNA, 20 nt, Homo sapiens
aaccuccgccucccggguuc

SEQ ID NO: 1604584 - RNA, 15 nt, Homo sapiens
aaccucgaguacugu

SEQ ID NO: 1604585 - RNA, 23 nt, Homo sapiens
aaccugcacguugugcacaugua

SEQ ID NO: 1604586 - RNA, 20 nt, Homo sapiens
aaccuggaaucuacaagcca

SEQ ID NO: 1604587 - RNA, 21 nt, Homo sapiens
aaccuggagggcuagaaccua

SEQ ID NO: 1604588 - RNA, 23 nt, Homo sapiens
aaccuggagggcuagaaccugga

SEQ ID NO: 1604589 - RNA, 17 nt, Homo sapiens
aaccuggauccagcacu

SEQ ID NO: 1604590 - RNA, 23 nt, Homo sapiens
aaccuguccuaaggaaccuuccu

SEQ ID NO: 1604591 - RNA, 19 nt, Homo sapiens
aaccuguuauuucuaugaa

SEQ ID NO: 1604592 - RNA, 22 nt, Homo sapiens
aaccuugaaaaaaaacagugga

SEQ ID NO: 1604593 - RNA, 16 nt, Homo sapiens
aaccuuugcuauguaa

SEQ ID NO: 1604594 - RNA, 13 nt, Homo sapiens
aacgacacauuca

SEQ ID NO: 1604595 - RNA, 14 nt, Homo sapiens
aacgacacauucag

SEQ ID NO: 1604596 - RNA, 19 nt, Homo sapiens
aacgcccuuuccuccucag

SEQ ID NO: 1604597 - RNA, 19 nt, Homo sapiens
aacggcccaggccaggugc

SEQ ID NO: 1604598 - RNA, 23 nt, Homo sapiens
aacggcuccaucaccagcccggg

SEQ ID NO: 1604599 - RNA, 14 nt, Homo sapiens
aacggguaucuuuu

SEQ ID NO: 1604600 - RNA, 20 nt, Homo sapiens
aacguugaauugaugaugca

SEQ ID NO: 1604601 - RNA, 17 nt, Homo sapiens
aacuaaaaggaagucau

SEQ ID NO: 1604602 - RNA, 13 nt, Homo sapiens
aacuaaacaaggc

SEQ ID NO: 1604603 - RNA, 22 nt, Homo sapiens
aacuaagaaaaaaagcacaaag

SEQ ID NO: 1604604 - RNA, 13 nt, Homo sapiens
aacuaagagcucu

SEQ ID NO: 1604605 - RNA, 14 nt, Homo sapiens
aacuacaucugccu

SEQ ID NO: 1604606 - RNA, 21 nt, Homo sapiens
aacuacauuucuacuaugauc

SEQ ID NO: 1604607 - RNA, 20 nt, Homo sapiens
aacuacuauuuuucuuucca

SEQ ID NO: 1604608 - RNA, 16 nt, Homo sapiens
aacuacugccuuuaga

SEQ ID NO: 1604609 - RNA, 15 nt, Homo sapiens
aacuacuggcaauuu

SEQ ID NO: 1604610 - RNA, 21 nt, Homo sapiens
aacuacuuaucucuaaaccau

SEQ ID NO: 1604611 - RNA, 13 nt, Homo sapiens
aacuagcagauuu

SEQ ID NO: 1604612 - RNA, 16 nt, Homo sapiens
aacuagugaaauguuc

SEQ ID NO: 1604613 - RNA, 18 nt, Homo sapiens
aacuauaagauacaauaa

SEQ ID NO: 1604614 - RNA, 13 nt, Homo sapiens
aacuauacuugau

SEQ ID NO: 1604615 - RNA, 22 nt, Homo sapiens
aacuaucucuacugaaugucau

SEQ ID NO: 1604616 - RNA, 16 nt, Homo sapiens
aacuauguaacaugua

SEQ ID NO: 1604617 - RNA, 22 nt, Homo sapiens
aacuauucgaaugaaaagacaa

SEQ ID NO: 1604618 - RNA, 16 nt, Homo sapiens
aacuauuguuaauucu

SEQ ID NO: 1604619 - RNA, 13 nt, Homo sapiens
aacucaagcaaga

SEQ ID NO: 1604620 - RNA, 14 nt, Homo sapiens
aacucaaggacagc

SEQ ID NO: 1604621 - RNA, 19 nt, Homo sapiens
aacucaaggacagccacca

SEQ ID NO: 1604622 - RNA, 18 nt, Homo sapiens
aacucaaggauaccuucu

SEQ ID NO: 1604623 - RNA, 13 nt, Homo sapiens
aacucaccauaga

SEQ ID NO: 1604624 - RNA, 14 nt, Homo sapiens
aacucacugugauc

SEQ ID NO: 1604625 - RNA, 23 nt, Homo sapiens
aacucacuuucccuugugucaag

SEQ ID NO: 1604626 - RNA, 21 nt, Homo sapiens
aacucagguuuuggcauuaaa

SEQ ID NO: 1604627 - RNA, 24 nt, Homo sapiens
aacucaugaucaagauauaugugu

SEQ ID NO: 1604628 - RNA, 11 nt, Homo sapiens
aacucauuuga

SEQ ID NO: 1604629 - RNA, 12 nt, Homo sapiens
aacucauuugaa

SEQ ID NO: 1604630 - RNA, 15 nt, Homo sapiens
aacucccgaccucag

SEQ ID NO: 1604631 - RNA, 20 nt, Homo sapiens
accuucacgauuaacuguga

SEQ ID NO: 1604632 - RNA, 20 nt, Homo sapiens
accuucaugcccuucugauu

SEQ ID NO: 1604633 - RNA, 22 nt, Homo sapiens
accuucauuuaacucuuugaaa

SEQ ID NO: 1604634 - RNA, 18 nt, Homo sapiens
accuuccaacuuccugug

SEQ ID NO: 1604635 - RNA, 14 nt, Homo sapiens
accuuccacccagu

SEQ ID NO: 1604636 - RNA, 14 nt, Homo sapiens
accuucuaccucuu

SEQ ID NO: 1604637 - RNA, 16 nt, Homo sapiens
accuucuauguauuag

SEQ ID NO: 1604638 - RNA, 12 nt, Homo sapiens
accuucuuucac

SEQ ID NO: 1604639 - RNA, 17 nt, Homo sapiens
accuucuuucuggacug

SEQ ID NO: 1604640 - RNA, 17 nt, Homo sapiens
accuugcuuuugcuucu

SEQ ID NO: 1604641 - RNA, 22 nt, Homo sapiens
accuugcuuuugcuucuagagc

SEQ ID NO: 1604642 - RNA, 22 nt, Homo sapiens
accuuggaaaugaccaggccaa

SEQ ID NO: 1604643 - RNA, 19 nt, Homo sapiens
accuuggacggaaugggau

SEQ ID NO: 1604644 - RNA, 19 nt, Homo sapiens
accuuggaggaaugacaau

SEQ ID NO: 1604645 - RNA, 17 nt, Homo sapiens
accuuguuaagacaaaa

SEQ ID NO: 1604646 - RNA, 18 nt, Homo sapiens
accuuuaaaaauguauaa

SEQ ID NO: 1604647 - RNA, 17 nt, Homo sapiens
accuuucacccucauga

SEQ ID NO: 1604648 - RNA, 13 nt, Homo sapiens
accuuucccucac

SEQ ID NO: 1604649 - RNA, 15 nt, Homo sapiens
accuuuccugaggaa

SEQ ID NO: 1604650 - RNA, 21 nt, Homo sapiens
accuuugguuuuaaaagagaa

SEQ ID NO: 1604651 - RNA, 19 nt, Homo sapiens
accuuuuccucaccagucc

SEQ ID NO: 1604652 - RNA, 15 nt, Homo sapiens
accuuuuuauuugca

SEQ ID NO: 1604653 - RNA, 16 nt, Homo sapiens
accuuuuuauuugcau

SEQ ID NO: 1604654 - RNA, 15 nt, Homo sapiens
acgaacccaccugcu

SEQ ID NO: 1604655 - RNA, 18 nt, Homo sapiens
acgacuggccagggccac

SEQ ID NO: 1604656 - RNA, 17 nt, Homo sapiens
acgacugucuccauggc

SEQ ID NO: 1604657 - RNA, 15 nt, Homo sapiens
acgaggcucaaaaac

SEQ ID NO: 1604658 - RNA, 15 nt, Homo sapiens
acgagugaaacuccg

SEQ ID NO: 1604659 - RNA, 14 nt, Homo sapiens
acgaguuacuggau

SEQ ID NO: 1604660 - RNA, 17 nt, Homo sapiens
acgauucuuaacaauaa

SEQ ID NO: 1604661 - RNA, 15 nt, Homo sapiens
acgcaaggugugcuc

SEQ ID NO: 1604662 - RNA, 16 nt, Homo sapiens
acgcacugguaugugu

SEQ ID NO: 1604663 - RNA, 23 nt, Homo sapiens
acgcagucauggaggccaagaac

SEQ ID NO: 1604664 - RNA, 15 nt, Homo sapiens
acgccacucauuuca

SEQ ID NO: 1604665 - RNA, 19 nt, Homo sapiens
acgccacucauuucaucuc

SEQ ID NO: 1604666 - RNA, 15 nt, Homo sapiens
acgcccccaccagcu

SEQ ID NO: 1604667 - RNA, 20 nt, Homo sapiens
acgccguccagauucuccuu

SEQ ID NO: 1604668 - RNA, 16 nt, Homo sapiens
acgcgacuuccacaaa

SEQ ID NO: 1604669 - RNA, 15 nt, Homo sapiens
acggauggugcaugg

SEQ ID NO: 1604670 - RNA, 20 nt, Homo sapiens
acggcggcgaagugcuaaaa

SEQ ID NO: 1604671 - RNA, 21 nt, Homo sapiens
acggcgugccuggacacugua

SEQ ID NO: 1604672 - RNA, 23 nt, Homo sapiens
acggcuugugggcacugugccaa

SEQ ID NO: 1604673 - RNA, 20 nt, Homo sapiens
acggggcucuucucauuuca

SEQ ID NO: 1604674 - RNA, 20 nt, Homo sapiens
acggggggcuccugcccagg

SEQ ID NO: 1604675 - RNA, 20 nt, Homo sapiens
acggugcuaaaaaugaaaau

SEQ ID NO: 1604676 - RNA, 20 nt, Homo sapiens
acgguggcucacgccuguaa

SEQ ID NO: 1604677 - RNA, 14 nt, Homo sapiens
acgguuaugaaggc

SEQ ID NO: 1604678 - RNA, 14 nt, Homo sapiens
acgugccuaccucu

SEQ ID NO: 1604679 - RNA, 16 nt, Homo sapiens
acgugccuaccucuua

SEQ ID NO: 1604680 - RNA, 17 nt, Homo sapiens
acguggagauagugcca

SEQ ID NO: 1604681 - RNA, 19 nt, Homo sapiens
acgugggccucacauucca

SEQ ID NO: 1604682 - RNA, 18 nt, Homo sapiens
acguuaguucuacauuau

SEQ ID NO: 1604683 - RNA, 17 nt, Homo sapiens
acguugucccugagauu

SEQ ID NO: 1604684 - RNA, 16 nt, Homo sapiens
acguuugcucauuuaa

SEQ ID NO: 1604685 - RNA, 13 nt, Homo sapiens
acguuugcuuaaa

SEQ ID NO: 1604686 - RNA, 14 nt, Homo sapiens
acuaaaauguucua

SEQ ID NO: 1604687 - RNA, 14 nt, Homo sapiens
acuaaauaugugac

SEQ ID NO: 1604688 - RNA, 19 nt, Homo sapiens
acuaaauuacaaaugcaau

SEQ ID NO: 1604689 - RNA, 15 nt, Homo sapiens
acuaaauucaaagaa

SEQ ID NO: 1604690 - RNA, 14 nt, Homo sapiens
acuaaccaucugaa

SEQ ID NO: 1604691 - RNA, 22 nt, Homo sapiens
acuaacgcaaccaagugugcua

SEQ ID NO: 1604692 - RNA, 19 nt, Homo sapiens
acuaagagaaggggugcag

SEQ ID NO: 1604693 - RNA, 13 nt, Homo sapiens
acuaagccuuuga

SEQ ID NO: 1604694 - RNA, 18 nt, Homo sapiens
acuaagguggacagcaga

SEQ ID NO: 1604695 - RNA, 16 nt, Homo sapiens
acuaaguucacuaaaa

SEQ ID NO: 1604696 - RNA, 22 nt, Homo sapiens
acuaauagaauaaaggcaguuu

SEQ ID NO: 1604697 - RNA, 13 nt, Homo sapiens
acuaaucaagaaa

SEQ ID NO: 1604698 - RNA, 22 nt, Homo sapiens
acuaaugaucacauucuuucca

SEQ ID NO: 1604699 - RNA, 20 nt, Homo sapiens
acuaauuauacuacuuuguu

SEQ ID NO: 1604700 - RNA, 15 nt, Homo sapiens
acuaauuucauuuca

SEQ ID NO: 1604701 - RNA, 16 nt, Homo sapiens
acuaauuuuacuucua

SEQ ID NO: 1604702 - RNA, 23 nt, Homo sapiens
acuacacuggggcccuucauccu

SEQ ID NO: 1604703 - RNA, 17 nt, Homo sapiens
acuacagaguacgugaa

SEQ ID NO: 1604704 - RNA, 20 nt, Homo sapiens
acuacaggcucaugccauca

SEQ ID NO: 1604705 - RNA, 17 nt, Homo sapiens
acuacauuucuacuaug

SEQ ID NO: 1604706 - RNA, 16 nt, Homo sapiens
acuaccucaaaggcca

SEQ ID NO: 1604707 - RNA, 23 nt, Homo sapiens
acuaccuugguucccccacugau

SEQ ID NO: 1604708 - RNA, 15 nt, Homo sapiens
acuacuggcaauuug

SEQ ID NO: 1604709 - RNA, 13 nt, Homo sapiens
acuacuguacucc

SEQ ID NO: 1604710 - RNA, 16 nt, Homo sapiens
acuacuucucuuguua

SEQ ID NO: 1604711 - RNA, 13 nt, Homo sapiens
acuagaaccugga

SEQ ID NO: 1604712 - RNA, 17 nt, Homo sapiens
acuagaagcaacuagga

SEQ ID NO: 1604713 - RNA, 17 nt, Homo sapiens
acuagagcuccauuucu

SEQ ID NO: 1604714 - RNA, 15 nt, Homo sapiens
acuagcauccacuga

SEQ ID NO: 1604715 - RNA, 16 nt, Homo sapiens
acuagccacugagaag

SEQ ID NO: 1604716 - RNA, 17 nt, Homo sapiens
acuagccagcacaaaag

SEQ ID NO: 1604717 - RNA, 21 nt, Homo sapiens
acuagcccaaugaaaugaauu

SEQ ID NO: 1604718 - RNA, 14 nt, Homo sapiens
acuaggcucagaga

SEQ ID NO: 1604719 - RNA, 23 nt, Homo sapiens
acuaggcucuuaugugugccuuu

SEQ ID NO: 1604720 - RNA, 14 nt, Homo sapiens
acuaguaaagcaaa

SEQ ID NO: 1604721 - RNA, 16 nt, Homo sapiens
acuagucucaccagcc

SEQ ID NO: 1604722 - RNA, 20 nt, Homo sapiens
acuaguuagauucacuuuga

SEQ ID NO: 1604723 - RNA, 14 nt, Homo sapiens
acuauaacauuaua

SEQ ID NO: 1604724 - RNA, 20 nt, Homo sapiens
acuauaaucaaaugauuuca

SEQ ID NO: 1604725 - RNA, 18 nt, Homo sapiens
acuauaauuuauugucua

SEQ ID NO: 1604726 - RNA, 12 nt, Homo sapiens
acuauacuugau

SEQ ID NO: 1604727 - RNA, 14 nt, Homo sapiens
acuaucuagguauu

SEQ ID NO: 1604728 - RNA, 21 nt, Homo sapiens
acuaucucaugccagugccuu

SEQ ID NO: 1604729 - RNA, 23 nt, Homo sapiens
acuaugaaaucgcugcucaaaaa

SEQ ID NO: 1604730 - RNA, 20 nt, Homo sapiens
acuaugaacugaaggcagca

SEQ ID NO: 1604731 - RNA, 21 nt, Homo sapiens
acuauggagucuugugaaagu

SEQ ID NO: 1604732 - RNA, 21 nt, Homo sapiens
acuauggauguguucucuagg

SEQ ID NO: 1604733 - RNA, 20 nt, Homo sapiens
acuaugguggccaagggcag

SEQ ID NO: 1604734 - RNA, 21 nt, Homo sapiens
acuauguuaaugaguauguaa

SEQ ID NO: 1604735 - RNA, 20 nt, Homo sapiens
acuauuaagcaagaaugcag

SEQ ID NO: 1604736 - RNA, 20 nt, Homo sapiens
acuauuauaagugcuucaca

SEQ ID NO: 1604737 - RNA, 22 nt, Homo sapiens
acuauucauggcuaccucagaa

SEQ ID NO: 1604738 - RNA, 19 nt, Homo sapiens
acuauuccuuacaacugga

SEQ ID NO: 1604739 - RNA, 14 nt, Homo sapiens
acuauugcauuuau

SEQ ID NO: 1604740 - RNA, 21 nt, Homo sapiens
acuauuguuacauuaugugga

SEQ ID NO: 1604741 - RNA, 22 nt, Homo sapiens
acuauuguuacauuauguggaa

SEQ ID NO: 1604742 - RNA, 18 nt, Homo sapiens
acuauuuccaaaagcaca

SEQ ID NO: 1604743 - RNA, 17 nt, Homo sapiens
acucaaacagucuuucu

SEQ ID NO: 1604744 - RNA, 22 nt, Homo sapiens
acucaaagggagaggucucagu

SEQ ID NO: 1604745 - RNA, 21 nt, Homo sapiens
acucaagaagcacaccuacag

SEQ ID NO: 1604746 - RNA, 23 nt, Homo sapiens
acucaagguggacgugcguucug

SEQ ID NO: 1604747 - RNA, 15 nt, Homo sapiens
acucaccugcacuaa

SEQ ID NO: 1604748 - RNA, 16 nt, Homo sapiens
acucaccugcacuaac

SEQ ID NO: 1604749 - RNA, 16 nt, Homo sapiens
aacucccgaccucagg

SEQ ID NO: 1604750 - RNA, 13 nt, Homo sapiens
aacuccuauuuca

SEQ ID NO: 1604751 - RNA, 18 nt, Homo sapiens
aacuccuuucagccacau

SEQ ID NO: 1604752 - RNA, 15 nt, Homo sapiens
aacucuagaagacca

SEQ ID NO: 1604753 - RNA, 20 nt, Homo sapiens
aacucuauaaccucagcuuu

SEQ ID NO: 1604754 - RNA, 21 nt, Homo sapiens
aacucucaccaugaugugaag

SEQ ID NO: 1604755 - RNA, 22 nt, Homo sapiens
aacucuccuguggccugcucau

SEQ ID NO: 1604756 - RNA, 15 nt, Homo sapiens
aacucucuagcuuaa

SEQ ID NO: 1604757 - RNA, 23 nt, Homo sapiens
aacucugaaagagcaaaccuaac

SEQ ID NO: 1604758 - RNA, 23 nt, Homo sapiens
aacucugcauagacaaaggccuu

SEQ ID NO: 1604759 - RNA, 12 nt, Homo sapiens
aacucuggugcu

SEQ ID NO: 1604760 - RNA, 21 nt, Homo sapiens
aacucuuucuuugguauucca

SEQ ID NO: 1604761 - RNA, 17 nt, Homo sapiens
aacucuuuuaagugccu

SEQ ID NO: 1604762 - RNA, 16 nt, Homo sapiens
aacugaaaauggaccu

SEQ ID NO: 1604763 - RNA, 15 nt, Homo sapiens
aacugaaagcuuuaa

SEQ ID NO: 1604764 - RNA, 15 nt, Homo sapiens
aacugaacauuccag

SEQ ID NO: 1604765 - RNA, 14 nt, Homo sapiens
aacugaacucacuu

SEQ ID NO: 1604766 - RNA, 20 nt, Homo sapiens
aacugaaucuauggcuuuaa

SEQ ID NO: 1604767 - RNA, 20 nt, Homo sapiens
aacugaauuuugggacuucu

SEQ ID NO: 1604768 - RNA, 12 nt, Homo sapiens
aacugacuucca

SEQ ID NO: 1604769 - RNA, 17 nt, Homo sapiens
aacugagcgaaauccaa

SEQ ID NO: 1604770 - RNA, 23 nt, Homo sapiens
aacugaggacuguuugcaauuga

SEQ ID NO: 1604771 - RNA, 14 nt, Homo sapiens
aacugagucacuca

SEQ ID NO: 1604772 - RNA, 22 nt, Homo sapiens
aacugauuaaauaauacauuua

SEQ ID NO: 1604773 - RNA, 21 nt, Homo sapiens
aacugcauugguuuuccauga

SEQ ID NO: 1604774 - RNA, 19 nt, Homo sapiens
aacugccaggcugccuccu

SEQ ID NO: 1604775 - RNA, 19 nt, Homo sapiens
aacugccucgaaacacaga

SEQ ID NO: 1604776 - RNA, 17 nt, Homo sapiens
aacugcuuuauuuuccc

SEQ ID NO: 1604777 - RNA, 20 nt, Homo sapiens
aacugcuuuuaaaagugcac

SEQ ID NO: 1604778 - RNA, 22 nt, Homo sapiens
aacugcuuuuaaaagugcacau

SEQ ID NO: 1604779 - RNA, 23 nt, Homo sapiens
auugcuaaaagcauguauaguua

SEQ ID NO: 1604780 - RNA, 16 nt, Homo sapiens
auugcuaagaagggaa

SEQ ID NO: 1604781 - RNA, 16 nt, Homo sapiens
auugcuaauuuagaga

SEQ ID NO: 1604782 - RNA, 13 nt, Homo sapiens
auugcuacaaauc

SEQ ID NO: 1604783 - RNA, 16 nt, Homo sapiens
auugcucuaugucugc

SEQ ID NO: 1604784 - RNA, 20 nt, Homo sapiens
auugcugauuuuaauggauu

SEQ ID NO: 1604785 - RNA, 18 nt, Homo sapiens
auugcuuaccugaucuca

SEQ ID NO: 1604786 - RNA, 15 nt, Homo sapiens
auugcuuuaacuuuu

SEQ ID NO: 1604787 - RNA, 14 nt, Homo sapiens
auugcuuucugcuc

SEQ ID NO: 1604788 - RNA, 23 nt, Homo sapiens
auugcuuugccaaaauaccagag

SEQ ID NO: 1604789 - RNA, 16 nt, Homo sapiens
auuucuuguugcucaa

SEQ ID NO: 1604790 - RNA, 24 nt, Homo sapiens
auuucuuucuuugcaccaaagaca

SEQ ID NO: 1604791 - RNA, 22 nt, Homo sapiens
auuucuuuuaaaauaagcauuu

SEQ ID NO: 1604792 - RNA, 22 nt, Homo sapiens
auuucuuuuagaaaaggccaau

SEQ ID NO: 1604793 - RNA, 23 nt, Homo sapiens
auuucuuuucucuuuaaucuccu

SEQ ID NO: 1604794 - RNA, 22 nt, Homo sapiens
auuugaaaaaaacuucauucuc

SEQ ID NO: 1604795 - RNA, 23 nt, Homo sapiens
auuugaaaaaaacuucauucucg

SEQ ID NO: 1604796 - RNA, 13 nt, Homo sapiens
auuugaaugauuu

SEQ ID NO: 1604797 - RNA, 16 nt, Homo sapiens
auuugaaugcuuaauu

SEQ ID NO: 1604798 - RNA, 17 nt, Homo sapiens
auuugaaugcuuaauuc

SEQ ID NO: 1604799 - RNA, 20 nt, Homo sapiens
auuugagagaagccacgcug

SEQ ID NO: 1604800 - RNA, 19 nt, Homo sapiens
auuugagagaaucuacuaa

SEQ ID NO: 1604801 - RNA, 13 nt, Homo sapiens
auuugagugcucu

SEQ ID NO: 1604802 - RNA, 21 nt, Homo sapiens
auuugauacauuuuuguacua

SEQ ID NO: 1604803 - RNA, 19 nt, Homo sapiens
auuugauuuuuacugagga

SEQ ID NO: 1604804 - RNA, 19 nt, Homo sapiens
auuugcaaaggcgacaaua

SEQ ID NO: 1604805 - RNA, 16 nt, Homo sapiens
auuugcaaaguacugu

SEQ ID NO: 1604806 - RNA, 17 nt, Homo sapiens
auuugcaaaguacugua

SEQ ID NO: 1604807 - RNA, 21 nt, Homo sapiens
auuugcaagggaaaagucucu

SEQ ID NO: 1604808 - RNA, 24 nt, Homo sapiens
auuugcacaaacuugugagcauca

SEQ ID NO: 1604809 - RNA, 19 nt, Homo sapiens
auuugcauaacaauuccuc

SEQ ID NO: 1604810 - RNA, 15 nt, Homo sapiens
auuugcuaaggcagc

SEQ ID NO: 1604811 - RNA, 20 nt, Homo sapiens
auuugcuuagaaagucugau

SEQ ID NO: 1604812 - RNA, 14 nt, Homo sapiens
auuuggaggcaauc

SEQ ID NO: 1604813 - RNA, 21 nt, Homo sapiens
auuuggaggcaauccuaccuu

SEQ ID NO: 1604814 - RNA, 20 nt, Homo sapiens
auuuguaaauuuaugugaug

SEQ ID NO: 1604815 - RNA, 20 nt, Homo sapiens
auuuguaauuaaaagcaaau

SEQ ID NO: 1604816 - RNA, 15 nt, Homo sapiens
auuuguagauuuacu

SEQ ID NO: 1604817 - RNA, 20 nt, Homo sapiens
auuuguaugcucauugaacu

SEQ ID NO: 1604818 - RNA, 22 nt, Homo sapiens
auuugucacaaauaaacauaau

SEQ ID NO: 1604819 - RNA, 20 nt, Homo sapiens
auuuguccaaauaaauucaa

SEQ ID NO: 1604820 - RNA, 21 nt, Homo sapiens
auuugucuguaaaaaauggag

SEQ ID NO: 1604821 - RNA, 18 nt, Homo sapiens
auuugugaacuggaagaa

SEQ ID NO: 1604822 - RNA, 18 nt, Homo sapiens
auuuguuuaaacaaucuu

SEQ ID NO: 1604823 - RNA, 16 nt, Homo sapiens
auuuuaaauacaaaag

SEQ ID NO: 1604824 - RNA, 18 nt, Homo sapiens
auuuuaaauuccacugaa

SEQ ID NO: 1604825 - RNA, 18 nt, Homo sapiens
auuuuaaguaaaagucua

SEQ ID NO: 1604826 - RNA, 17 nt, Homo sapiens
auuuuaaugaagugcaa

SEQ ID NO: 1604827 - RNA, 14 nt, Homo sapiens
auuuuacaaguaua

SEQ ID NO: 1604828 - RNA, 17 nt, Homo sapiens
auuuuacacaaagggaa

SEQ ID NO: 1604829 - RNA, 12 nt, Homo sapiens
auuuuacuguga

SEQ ID NO: 1604830 - RNA, 20 nt, Homo sapiens
auuuuagcuaaauucaggga

SEQ ID NO: 1604831 - RNA, 23 nt, Homo sapiens
auuuuagcuaaauucagggagau

SEQ ID NO: 1604832 - RNA, 22 nt, Homo sapiens
auuuuauaaaugauaucaaaga

SEQ ID NO: 1604833 - RNA, 17 nt, Homo sapiens
auuuuaugagacagggu

SEQ ID NO: 1604834 - RNA, 21 nt, Homo sapiens
auuuuaugcuggacucuggac

SEQ ID NO: 1604835 - RNA, 20 nt, Homo sapiens
auuuuauggugaugucacuc

SEQ ID NO: 1604836 - RNA, 18 nt, Homo sapiens
auuuuauuuuucucauga

SEQ ID NO: 1604837 - RNA, 22 nt, Homo sapiens
auuuucaagagucuaauagucu

SEQ ID NO: 1604838 - RNA, 14 nt, Homo sapiens
auuuucaaguaauu

SEQ ID NO: 1604839 - RNA, 19 nt, Homo sapiens
auuuucacacguaagcaca

SEQ ID NO: 1604840 - RNA, 15 nt, Homo sapiens
auuuucacagaggaa

SEQ ID NO: 1604841 - RNA, 20 nt, Homo sapiens
auuuucagucaaaacuuuaa

SEQ ID NO: 1604842 - RNA, 23 nt, Homo sapiens
auuuucauccuauaagcuuaaau

SEQ ID NO: 1604843 - RNA, 11 nt, Homo sapiens
auuuucauucu

SEQ ID NO: 1604844 - RNA, 16 nt, Homo sapiens
auuuucauucugccaa

SEQ ID NO: 1604845 - RNA, 17 nt, Homo sapiens
auuuucauucugccaaa

SEQ ID NO: 1604846 - RNA, 20 nt, Homo sapiens
auuuuccagugacuugcaau

SEQ ID NO: 1604847 - RNA, 22 nt, Homo sapiens
auuuuccccccacucuccccac

SEQ ID NO: 1604848 - RNA, 20 nt, Homo sapiens
auuuuccuuaggaaaaacau

SEQ ID NO: 1604849 - RNA, 16 nt, Homo sapiens
auuuucugcaauccaa

SEQ ID NO: 1604850 - RNA, 16 nt, Homo sapiens
auuuucuucucugcac

SEQ ID NO: 1604851 - RNA, 19 nt, Homo sapiens
auuuugauauaaucuuuca

SEQ ID NO: 1604852 - RNA, 12 nt, Homo sapiens
auuuugauucag

SEQ ID NO: 1604853 - RNA, 16 nt, Homo sapiens
auuuuguaaauaugca

SEQ ID NO: 1604854 - RNA, 19 nt, Homo sapiens
auuuuguaaauaugcaaau

SEQ ID NO: 1604855 - RNA, 19 nt, Homo sapiens
auuuuguaauauugaggga

SEQ ID NO: 1604856 - RNA, 14 nt, Homo sapiens
auuuugucuaccau

SEQ ID NO: 1604857 - RNA, 16 nt, Homo sapiens
auuuuguuugcaucug

SEQ ID NO: 1604858 - RNA, 17 nt, Homo sapiens
auuuuguuugcaucuga

SEQ ID NO: 1604859 - RNA, 18 nt, Homo sapiens
auuuuguuuuuacuguau

SEQ ID NO: 1604860 - RNA, 13 nt, Homo sapiens
auuuuuaaacuug

SEQ ID NO: 1604861 - RNA, 17 nt, Homo sapiens
auuuuuaagcugcaaau

SEQ ID NO: 1604862 - RNA, 21 nt, Homo sapiens
auuuuuacuaucacacaugaa

SEQ ID NO: 1604863 - RNA, 15 nt, Homo sapiens
auuuuuaggcaaaga

SEQ ID NO: 1604864 - RNA, 15 nt, Homo sapiens
auuuuuagucuggcu

SEQ ID NO: 1604865 - RNA, 22 nt, Homo sapiens
auuuuuaugucuggggcagaaa

SEQ ID NO: 1604866 - RNA, 18 nt, Homo sapiens
auuuuucagauauaaaag

SEQ ID NO: 1604867 - RNA, 23 nt, Homo sapiens
auuuuucagcagcaaaaccaaac

SEQ ID NO: 1604868 - RNA, 15 nt, Homo sapiens
auuuuuccaacuacu

SEQ ID NO: 1604869 - RNA, 15 nt, Homo sapiens
auuuuuccacuuaaa

SEQ ID NO: 1604870 - RNA, 18 nt, Homo sapiens
auuuuugaagcaaagaag

SEQ ID NO: 1604871 - RNA, 15 nt, Homo sapiens
auuuuuguguaggug

SEQ ID NO: 1604872 - RNA, 21 nt, Homo sapiens
auuuuuguuagcaaagauuaa

SEQ ID NO: 1604873 - RNA, 22 nt, Homo sapiens
auuuuuguuuucauuaucucaa

SEQ ID NO: 1604874 - RNA, 18 nt, Homo sapiens
auuuuuuaauccuaccuc

SEQ ID NO: 1604875 - RNA, 17 nt, Homo sapiens
auuuuuuaaugugcucu

SEQ ID NO: 1604876 - RNA, 18 nt, Homo sapiens
auuuuuuuaaaucaagga

SEQ ID NO: 1604877 - RNA, 21 nt, Homo sapiens
auuuuuuuaauuucugaagaa

SEQ ID NO: 1604878 - RNA, 13 nt, Homo sapiens
auuuuuuuuacau

SEQ ID NO: 1604879 - RNA, 15 nt, Homo sapiens
caaaaaaaggaagga

SEQ ID NO: 1604880 - RNA, 14 nt, Homo sapiens
caaaaagaaccacu

SEQ ID NO: 1604881 - RNA, 15 nt, Homo sapiens
caaaaaugaaaucca

SEQ ID NO: 1604882 - RNA, 20 nt, Homo sapiens
caaaaauguguaagaacaac

SEQ ID NO: 1604883 - RNA, 14 nt, Homo sapiens
caaaaauucaggaa

SEQ ID NO: 1604884 - RNA, 13 nt, Homo sapiens
caaaacauaucuu

SEQ ID NO: 1604885 - RNA, 17 nt, Homo sapiens
caaaaccaagucacuua

SEQ ID NO: 1604886 - RNA, 18 nt, Homo sapiens
caaaacccucagcacugu

SEQ ID NO: 1604887 - RNA, 17 nt, Homo sapiens
caaaaccugacuugaaa

SEQ ID NO: 1604888 - RNA, 19 nt, Homo sapiens
caaaaccuuccucuuccag

SEQ ID NO: 1604889 - RNA, 22 nt, Homo sapiens
caaaacuauacuugaacaaaag

SEQ ID NO: 1604890 - RNA, 13 nt, Homo sapiens
caaaacucaggca

SEQ ID NO: 1604891 - RNA, 14 nt, Homo sapiens
caaaacucaggcag

SEQ ID NO: 1604892 - RNA, 17 nt, Homo sapiens
caaaacuggagucccaa

SEQ ID NO: 1604893 - RNA, 17 nt, Homo sapiens
caaaacuucagacauag

SEQ ID NO: 1604894 - RNA, 18 nt, Homo sapiens
caaaagcaagaaaaccac

SEQ ID NO: 1604895 - RNA, 22 nt, Homo sapiens
caaaagcaagggaccuucaugc

SEQ ID NO: 1604896 - RNA, 23 nt, Homo sapiens
caaaaggagagacucccaugaag

SEQ ID NO: 1604897 - RNA, 21 nt, Homo sapiens
caaaaggaggugaaaucccug

SEQ ID NO: 1604898 - RNA, 17 nt, Homo sapiens
cugcacaaacaauaugu

SEQ ID NO: 1604899 - RNA, 18 nt, Homo sapiens
cugcacacccuccagaga

SEQ ID NO: 1604900 - RNA, 12 nt, Homo sapiens
cugcacacuguc

SEQ ID NO: 1604901 - RNA, 17 nt, Homo sapiens
cugcacagcaggcugcc

SEQ ID NO: 1604902 - RNA, 15 nt, Homo sapiens
cugcacauggccuga

SEQ ID NO: 1604903 - RNA, 20 nt, Homo sapiens
cugcacguugugcacaugua

SEQ ID NO: 1604904 - RNA, 21 nt, Homo sapiens
cugcacguugugcacauguac

SEQ ID NO: 1604905 - RNA, 16 nt, Homo sapiens
cugcacuggggccacc

SEQ ID NO: 1604906 - RNA, 13 nt, Homo sapiens
cugcacugugaac

SEQ ID NO: 1604907 - RNA, 20 nt, Homo sapiens
cugcagaagacaguauggca

SEQ ID NO: 1604908 - RNA, 19 nt, Homo sapiens
cugcagaaguaagccucau

SEQ ID NO: 1604909 - RNA, 12 nt, Homo sapiens
cugcagacaccu

SEQ ID NO: 1604910 - RNA, 20 nt, Homo sapiens
cugcagcccaccagacguca

SEQ ID NO: 1604911 - RNA, 16 nt, Homo sapiens
cugcagucaagcccug

SEQ ID NO: 1604912 - RNA, 17 nt, Homo sapiens
cugcagucaucuacuuu

SEQ ID NO: 1604913 - RNA, 13 nt, Homo sapiens
cugcauacagggg

SEQ ID NO: 1604914 - RNA, 17 nt, Homo sapiens
cugcaucccagcccaca

SEQ ID NO: 1604915 - RNA, 15 nt, Homo sapiens
cugcaugaccuacca

SEQ ID NO: 1604916 - RNA, 14 nt, Homo sapiens
cugcauggcaucag

SEQ ID NO: 1604917 - RNA, 20 nt, Homo sapiens
cugcauuaacugcacaaaca

SEQ ID NO: 1604918 - RNA, 14 nt, Homo sapiens
cugcauuacuauua

SEQ ID NO: 1604919 - RNA, 19 nt, Homo sapiens
cugcauugguuuuccauga

SEQ ID NO: 1604920 - RNA, 15 nt, Homo sapiens
cugcauuuacagugu

SEQ ID NO: 1604921 - RNA, 15 nt, Homo sapiens
cugcauuucauauua

SEQ ID NO: 1604922 - RNA, 21 nt, Homo sapiens
cugcauuucauauuauuuuag

SEQ ID NO: 1604923 - RNA, 19 nt, Homo sapiens
cugcauuugccugcuucuu

SEQ ID NO: 1604924 - RNA, 23 nt, Homo sapiens
cugcauuugccugcuucuuucca

SEQ ID NO: 1604925 - RNA, 22 nt, Homo sapiens
cugcauuugucuauucuccagc

SEQ ID NO: 1604926 - RNA, 11 nt, Homo sapiens
cugccaccacc

SEQ ID NO: 1604927 - RNA, 16 nt, Homo sapiens
cugccagcucucugau

SEQ ID NO: 1604928 - RNA, 19 nt, Homo sapiens
cugcccaaggccuacccca

SEQ ID NO: 1604929 - RNA, 16 nt, Homo sapiens
cugcccagacugauga

SEQ ID NO: 1604930 - RNA, 17 nt, Homo sapiens
cugcccagacugaugag

SEQ ID NO: 1604931 - RNA, 12 nt, Homo sapiens
cugcccccggcc

SEQ ID NO: 1604932 - RNA, 15 nt, Homo sapiens
cugccccucucacca

SEQ ID NO: 1604933 - RNA, 15 nt, Homo sapiens
cugcccuaaacccug

SEQ ID NO: 1604934 - RNA, 18 nt, Homo sapiens
cugcccugguccagggaa

SEQ ID NO: 1604935 - RNA, 14 nt, Homo sapiens
cugcccugucuccc

SEQ ID NO: 1604936 - RNA, 18 nt, Homo sapiens
cugccgagaguccaucag

SEQ ID NO: 1604937 - RNA, 14 nt, Homo sapiens
cugccuaugcacug

SEQ ID NO: 1604938 - RNA, 17 nt, Homo sapiens
cugccuaugcacugaag

SEQ ID NO: 1604939 - RNA, 18 nt, Homo sapiens
cugccuaugcacugaaga

SEQ ID NO: 1604940 - RNA, 17 nt, Homo sapiens
cugccuauuaucuguca

SEQ ID NO: 1604941 - RNA, 17 nt, Homo sapiens
cugccucagacguugcc

SEQ ID NO: 1604942 - RNA, 14 nt, Homo sapiens
cugccucagccucc

SEQ ID NO: 1604943 - RNA, 20 nt, Homo sapiens
cugccucccaacagugggga

SEQ ID NO: 1604944 - RNA, 15 nt, Homo sapiens
cugccucccuuucau

SEQ ID NO: 1604945 - RNA, 16 nt, Homo sapiens
cugccuccuggccaag

SEQ ID NO: 1604946 - RNA, 23 nt, Homo sapiens
cugccucucuuucacacaaugcc

SEQ ID NO: 1604947 - RNA, 17 nt, Homo sapiens
cugccugcauggcauca

SEQ ID NO: 1604948 - RNA, 16 nt, Homo sapiens
cugccugcggcccaga

SEQ ID NO: 1604949 - RNA, 16 nt, Homo sapiens
cugccugguauaucca

SEQ ID NO: 1604950 - RNA, 12 nt, Homo sapiens
cugccuguaacu

SEQ ID NO: 1604951 - RNA, 19 nt, Homo sapiens
cugccuguagcaauggcca

SEQ ID NO: 1604952 - RNA, 20 nt, Homo sapiens
cugccugucugcuugcaucu

SEQ ID NO: 1604953 - RNA, 22 nt, Homo sapiens
cugccuguuauaacucugcacu

SEQ ID NO: 1604954 - RNA, 19 nt, Homo sapiens
cugccuuaaaaccaaagag

SEQ ID NO: 1604955 - RNA, 21 nt, Homo sapiens
cugccuucaccuccucuuuca

SEQ ID NO: 1604956 - RNA, 13 nt, Homo sapiens
cugcgcagucauu

SEQ ID NO: 1604957 - RNA, 21 nt, Homo sapiens
cugcguccuccucaccucaug

SEQ ID NO: 1604958 - RNA, 17 nt, Homo sapiens
cugcguuaugaagagcu

SEQ ID NO: 1604959 - RNA, 22 nt, Homo sapiens
cugcuaaauaucaccuagcaug

SEQ ID NO: 1604960 - RNA, 14 nt, Homo sapiens
cugcuaagauuccu

SEQ ID NO: 1604961 - RNA, 15 nt, Homo sapiens
cugcuagcacagagg

SEQ ID NO: 1604962 - RNA, 17 nt, Homo sapiens
cugcucaagauauggaa

SEQ ID NO: 1604963 - RNA, 18 nt, Homo sapiens
cugcucaagauauggaag

SEQ ID NO: 1604964 - RNA, 15 nt, Homo sapiens
cugcucauauuguga

SEQ ID NO: 1604965 - RNA, 21 nt, Homo sapiens
cugcucccaguccugccugaa

SEQ ID NO: 1604966 - RNA, 19 nt, Homo sapiens
cugcucccccugguggugg

SEQ ID NO: 1604967 - RNA, 17 nt, Homo sapiens
cugcucuuuugugauga

SEQ ID NO: 1604968 - RNA, 21 nt, Homo sapiens
cugcugaaggcagucauauca

SEQ ID NO: 1604969 - RNA, 12 nt, Homo sapiens
cugcugauccag

SEQ ID NO: 1604970 - RNA, 21 nt, Homo sapiens
cugcugcccccaccccgggga

SEQ ID NO: 1604971 - RNA, 17 nt, Homo sapiens
cugcugccucccuuuca

SEQ ID NO: 1604972 - RNA, 16 nt, Homo sapiens
cugcugccugcugaga

SEQ ID NO: 1604973 - RNA, 14 nt, Homo sapiens
cugcugcuaaggcu

SEQ ID NO: 1604974 - RNA, 20 nt, Homo sapiens
cugcugggcucugccuuaaa

SEQ ID NO: 1604975 - RNA, 19 nt, Homo sapiens
cugcugugauuccacuaca

SEQ ID NO: 1604976 - RNA, 22 nt, Homo sapiens
cugcuguguggacuucaucuca

SEQ ID NO: 1604977 - RNA, 13 nt, Homo sapiens
cugcuguguguga

SEQ ID NO: 1604978 - RNA, 13 nt, Homo sapiens
cugcuuccugucu

SEQ ID NO: 1604979 - RNA, 23 nt, Homo sapiens
cugcuucuuggagcuuuggaaua

SEQ ID NO: 1604980 - RNA, 16 nt, Homo sapiens
cugcuugaccaaagag

SEQ ID NO: 1604981 - RNA, 15 nt, Homo sapiens
cugcuugcaucugca

SEQ ID NO: 1604982 - RNA, 15 nt, Homo sapiens
cugcuugcuuggccc

SEQ ID NO: 1604983 - RNA, 15 nt, Homo sapiens
cugcuugugaucuca

SEQ ID NO: 1604984 - RNA, 11 nt, Homo sapiens
cugcuuucuac

SEQ ID NO: 1604985 - RNA, 14 nt, Homo sapiens
cugcuuucuuguug

SEQ ID NO: 1604986 - RNA, 20 nt, Homo sapiens
cugcuuucuuguugcugcau

SEQ ID NO: 1604987 - RNA, 17 nt, Homo sapiens
cugcuuuucccauugcc

SEQ ID NO: 1604988 - RNA, 18 nt, Homo sapiens
cugcuuuuuuucagggaa

SEQ ID NO: 1604989 - RNA, 23 nt, Homo sapiens
cuggaaaagugauguauuuucau

SEQ ID NO: 1604990 - RNA, 16 nt, Homo sapiens
cuggaaauaauaucau

SEQ ID NO: 1604991 - RNA, 13 nt, Homo sapiens
cuggaaauggacu

SEQ ID NO: 1604992 - RNA, 19 nt, Homo sapiens
cuggaaauugagguccaug

SEQ ID NO: 1604993 - RNA, 19 nt, Homo sapiens
cuggaaauugcaguaacaa

SEQ ID NO: 1604994 - RNA, 20 nt, Homo sapiens
cuggaagaaagcaacaaaga

SEQ ID NO: 1604995 - RNA, 22 nt, Homo sapiens
cuggaagaucauggaccuggug

SEQ ID NO: 1604996 - RNA, 23 nt, Homo sapiens
cuggaagcauguaggagaaucca

SEQ ID NO: 1604997 - RNA, 15 nt, Homo sapiens
cuggaagcugauuca

SEQ ID NO: 1604998 - RNA, 15 nt, Homo sapiens
cuggaagucaucuca

SEQ ID NO: 1604999 - RNA, 13 nt, Homo sapiens
gaccagacacagg

SEQ ID NO: 1605000 - RNA, 12 nt, Homo sapiens
gaccagcccauu

SEQ ID NO: 1605001 - RNA, 21 nt, Homo sapiens
gaccagccugggcaacauacc

SEQ ID NO: 1605002 - RNA, 19 nt, Homo sapiens
gacccaauccccagacuca

SEQ ID NO: 1605003 - RNA, 15 nt, Homo sapiens
gacccacaaggccag

SEQ ID NO: 1605004 - RNA, 17 nt, Homo sapiens
gacccagagguccaggu

SEQ ID NO: 1605005 - RNA, 12 nt, Homo sapiens
gacccaggaaag

SEQ ID NO: 1605006 - RNA, 16 nt, Homo sapiens
gacccagggccugacu

SEQ ID NO: 1605007 - RNA, 17 nt, Homo sapiens
gacccagggguccaggc

SEQ ID NO: 1605008 - RNA, 20 nt, Homo sapiens
gacccaguggacucuuccac

SEQ ID NO: 1605009 - RNA, 22 nt, Homo sapiens
gaccccgggagacucaaaggga

SEQ ID NO: 1605010 - RNA, 15 nt, Homo sapiens
gaccccuauccugau

SEQ ID NO: 1605011 - RNA, 19 nt, Homo sapiens
gacccugccacagccagag

SEQ ID NO: 1605012 - RNA, 16 nt, Homo sapiens
gacccuggaaauggac

SEQ ID NO: 1605013 - RNA, 22 nt, Homo sapiens
gacccuggacucgccacuggua

SEQ ID NO: 1605014 - RNA, 15 nt, Homo sapiens
gacccuugcugugaa

SEQ ID NO: 1605015 - RNA, 16 nt, Homo sapiens
gacccuuggcuaugaa

SEQ ID NO: 1605016 - RNA, 16 nt, Homo sapiens
gaccguuugcuauauu

SEQ ID NO: 1605017 - RNA, 15 nt, Homo sapiens
gaccucaagccauca

SEQ ID NO: 1605018 - RNA, 19 nt, Homo sapiens
gaccucacacacacaaaaa

SEQ ID NO: 1605019 - RNA, 14 nt, Homo sapiens
gaccucaggugauc

SEQ ID NO: 1605020 - RNA, 17 nt, Homo sapiens
gaccucaucucuacuaa

SEQ ID NO: 1605021 - RNA, 22 nt, Homo sapiens
gaccugcaggcagagacugaaa

SEQ ID NO: 1605022 - RNA, 13 nt, Homo sapiens
gaccuguguuuca

SEQ ID NO: 1605023 - RNA, 14 nt, Homo sapiens
gaccuguugggagu

SEQ ID NO: 1605024 - RNA, 12 nt, Homo sapiens
gaccuuacuuug

SEQ ID NO: 1605025 - RNA, 18 nt, Homo sapiens
gaccuuaugagaaacugc

SEQ ID NO: 1605026 - RNA, 17 nt, Homo sapiens
gaccuugggguacaauu

SEQ ID NO: 1605027 - RNA, 19 nt, Homo sapiens
gaccuuguagagaacacgc

SEQ ID NO: 1605028 - RNA, 22 nt, Homo sapiens
gaccuuuaggucaaacucccua

SEQ ID NO: 1605029 - RNA, 22 nt, Homo sapiens
gacgcggcgggaggcccacggu

SEQ ID NO: 1605030 - RNA, 21 nt, Homo sapiens
gacgcucagccccaggccagc

SEQ ID NO: 1605031 - RNA, 20 nt, Homo sapiens
gacgugauuuugcuguagaa

SEQ ID NO: 1605032 - RNA, 17 nt, Homo sapiens
gacuaaacuacauuaua

SEQ ID NO: 1605033 - RNA, 23 nt, Homo sapiens
gacuaagccuaccugcucuccaa

SEQ ID NO: 1605034 - RNA, 16 nt, Homo sapiens
gacuacacaauacagu

SEQ ID NO: 1605035 - RNA, 19 nt, Homo sapiens
gacuacacaauacaguauu

SEQ ID NO: 1605036 - RNA, 17 nt, Homo sapiens
gacuacauguuacuaag

SEQ ID NO: 1605037 - RNA, 21 nt, Homo sapiens
gacuacuuggaacuaggcucu

SEQ ID NO: 1605038 - RNA, 12 nt, Homo sapiens
cucuuccagcaa

SEQ ID NO: 1605039 - RNA, 19 nt, Homo sapiens
cucuucuacuuguaaaaug

SEQ ID NO: 1605040 - RNA, 15 nt, Homo sapiens
cucuucucauuucac

SEQ ID NO: 1605041 - RNA, 23 nt, Homo sapiens
cucuugagucucuuuaccuaaug

SEQ ID NO: 1605042 - RNA, 19 nt, Homo sapiens
cucuuguaauaaaaugucu

SEQ ID NO: 1605043 - RNA, 19 nt, Homo sapiens
cucuuguacugccugccac

SEQ ID NO: 1605044 - RNA, 18 nt, Homo sapiens
cucuuuccaugacaucaa

SEQ ID NO: 1605045 - RNA, 22 nt, Homo sapiens
cucuuucccuuccccugugguc

SEQ ID NO: 1605046 - RNA, 16 nt, Homo sapiens
cucuuucuucauucag

SEQ ID NO: 1605047 - RNA, 16 nt, Homo sapiens
cucuuugaaagcuuug

SEQ ID NO: 1605048 - RNA, 15 nt, Homo sapiens
cucuuugcuaguacc

SEQ ID NO: 1605049 - RNA, 15 nt, Homo sapiens
cucuuuuacaguuag

SEQ ID NO: 1605050 - RNA, 16 nt, Homo sapiens
cugaaaaaaacauauc

SEQ ID NO: 1605051 - RNA, 20 nt, Homo sapiens
cugaaaaaaacauauccaaa

SEQ ID NO: 1605052 - RNA, 14 nt, Homo sapiens
cugaaaaccuacca

SEQ ID NO: 1605053 - RNA, 22 nt, Homo sapiens
cugaaaagauacugaugcauug

SEQ ID NO: 1605054 - RNA, 16 nt, Homo sapiens
cugaaacccaguaauu

SEQ ID NO: 1605055 - RNA, 13 nt, Homo sapiens
cugaaagagcaaa

SEQ ID NO: 1605056 - RNA, 20 nt, Homo sapiens
cugaaagauugauuaaugaa

SEQ ID NO: 1605057 - RNA, 15 nt, Homo sapiens
cugaaaguaauauaa

SEQ ID NO: 1605058 - RNA, 19 nt, Homo sapiens
cugaaaguccugcuuuccu

SEQ ID NO: 1605059 - RNA, 17 nt, Homo sapiens
cugaaauaaaauucauu

SEQ ID NO: 1605060 - RNA, 24 nt, Homo sapiens
cugaaaucugucaagaguaguuau

SEQ ID NO: 1605061 - RNA, 16 nt, Homo sapiens
cugaaaugacauuuca

SEQ ID NO: 1605062 - RNA, 19 nt, Homo sapiens
cugaaccauuccaacuuca

SEQ ID NO: 1605063 - RNA, 20 nt, Homo sapiens
cugaaccucaguuuccucau

SEQ ID NO: 1605064 - RNA, 22 nt, Homo sapiens
cugaacuauuuuaaauaaaaua

SEQ ID NO: 1605065 - RNA, 12 nt, Homo sapiens
cugaacuugaag

SEQ ID NO: 1605066 - RNA, 20 nt, Homo sapiens
cugaagaaguuuuugguguc

SEQ ID NO: 1605067 - RNA, 21 nt, Homo sapiens
cugaagcuucaaaaagccacu

SEQ ID NO: 1605068 - RNA, 18 nt, Homo sapiens
cugaaggcuaaaaagcaa

SEQ ID NO: 1605069 - RNA, 20 nt, Homo sapiens
cugaaggggaggucacagcc

SEQ ID NO: 1605070 - RNA, 14 nt, Homo sapiens
cugaaguggcuaaa

SEQ ID NO: 1605071 - RNA, 14 nt, Homo sapiens
cugaauaguuaaaa

SEQ ID NO: 1605072 - RNA, 16 nt, Homo sapiens
cugaaucaccaauuaa

SEQ ID NO: 1605073 - RNA, 23 nt, Homo sapiens
cugaauccaaacuaauccaucac

SEQ ID NO: 1605074 - RNA, 18 nt, Homo sapiens
cugaaucuauggcuuuaa

SEQ ID NO: 1605075 - RNA, 18 nt, Homo sapiens
cugaaugauuuccaaaga

SEQ ID NO: 1605076 - RNA, 18 nt, Homo sapiens
cugaauuaucuauuucau

SEQ ID NO: 1605077 - RNA, 19 nt, Homo sapiens
cugaauuggcuaugcagua

SEQ ID NO: 1605078 - RNA, 15 nt, Homo sapiens
cugacaauaaaaaca

SEQ ID NO: 1605079 - RNA, 17 nt, Homo sapiens
cugacaaugaagggaaa

SEQ ID NO: 1605080 - RNA, 14 nt, Homo sapiens
cugacacauagaaa

SEQ ID NO: 1605081 - RNA, 18 nt, Homo sapiens
cugacacauagaaaacaa

SEQ ID NO: 1605082 - RNA, 16 nt, Homo sapiens
cugacacuacuaaagc

SEQ ID NO: 1605083 - RNA, 22 nt, Homo sapiens
cugacagaaagcagauaccuca

SEQ ID NO: 1605084 - RNA, 16 nt, Homo sapiens
cugacauucacugagu

SEQ ID NO: 1605085 - RNA, 11 nt, Homo sapiens
cugacauugcc

SEQ ID NO: 1605086 - RNA, 22 nt, Homo sapiens
cugacccuucucucacuucuaa

SEQ ID NO: 1605087 - RNA, 19 nt, Homo sapiens
cugaccucaggugauccac

SEQ ID NO: 1605088 - RNA, 19 nt, Homo sapiens
cugaccucaggugauccgc

SEQ ID NO: 1605089 - RNA, 15 nt, Homo sapiens
cugaccuuccaaaga

SEQ ID NO: 1605090 - RNA, 21 nt, Homo sapiens
cugaccuuccaaagacuaaga

SEQ ID NO: 1605091 - RNA, 15 nt, Homo sapiens
cugaccuugaaucuu

SEQ ID NO: 1605092 - RNA, 15 nt, Homo sapiens
cugaccuugugaucc

SEQ ID NO: 1605093 - RNA, 15 nt, Homo sapiens
cugacuaagccuuug

SEQ ID NO: 1605094 - RNA, 18 nt, Homo sapiens
cugacuaagccuuugacu

SEQ ID NO: 1605095 - RNA, 23 nt, Homo sapiens
cugacuaauuuuuguauuuuuag

SEQ ID NO: 1605096 - RNA, 20 nt, Homo sapiens
cugacuagaagggccagucc

SEQ ID NO: 1605097 - RNA, 18 nt, Homo sapiens
cugacugccaauaacauu

SEQ ID NO: 1605098 - RNA, 19 nt, Homo sapiens
cugacuucagaguggacuu

SEQ ID NO: 1605099 - RNA, 21 nt, Homo sapiens
cugagaagcccgaggucauca

SEQ ID NO: 1605100 - RNA, 20 nt, Homo sapiens
cugagaccaggguggccaca

SEQ ID NO: 1605101 - RNA, 19 nt, Homo sapiens
cugagaggcaccaguccag

SEQ ID NO: 1605102 - RNA, 22 nt, Homo sapiens
cugagaggcaggcauagaggcu

SEQ ID NO: 1605103 - RNA, 23 nt, Homo sapiens
cugagauauuauuuuaaauuucu

SEQ ID NO: 1605104 - RNA, 14 nt, Homo sapiens
cugagaucgugcua

SEQ ID NO: 1605105 - RNA, 17 nt, Homo sapiens
cugagauuacucugaaa

SEQ ID NO: 1605106 - RNA, 17 nt, Homo sapiens
cugagcaacucuugauu

SEQ ID NO: 1605107 - RNA, 23 nt, Homo sapiens
cugagcaccacacccagugggaa

SEQ ID NO: 1605108 - RNA, 16 nt, Homo sapiens
cugagcagccucugga

SEQ ID NO: 1605109 - RNA, 17 nt, Homo sapiens
cugagcaucacuaguga

SEQ ID NO: 1605110 - RNA, 22 nt, Homo sapiens
cugagcaucacuagugacaagu

SEQ ID NO: 1605111 - RNA, 19 nt, Homo sapiens
cugagccacagaugggcaa

SEQ ID NO: 1605112 - RNA, 23 nt, Homo sapiens
cugagccccucaauccuaucaca

SEQ ID NO: 1605113 - RNA, 17 nt, Homo sapiens
cugagccuccugaaguu

SEQ ID NO: 1605114 - RNA, 14 nt, Homo sapiens
cugagcgaaaucca

SEQ ID NO: 1605115 - RNA, 19 nt, Homo sapiens
cugagcgggagucagggac

SEQ ID NO: 1605116 - RNA, 19 nt, Homo sapiens
cugagcuggccuccuaugc

SEQ ID NO: 1605117 - RNA, 13 nt, Homo sapiens
cugagcugugcag

SEQ ID NO: 1605118 - RNA, 13 nt, Homo sapiens
cugagcuuugaaa

SEQ ID NO: 1605119 - RNA, 22 nt, Homo sapiens
cugaggaaagauucaacugccu

SEQ ID NO: 1605120 - RNA, 20 nt, Homo sapiens
cugaggaucagcacugccag

SEQ ID NO: 1605121 - RNA, 15 nt, Homo sapiens
cugaggccagaguca

SEQ ID NO: 1605122 - RNA, 22 nt, Homo sapiens
cugagggcagaaagguucugcc

SEQ ID NO: 1605123 - RNA, 16 nt, Homo sapiens
cugaggggcaucugcc

SEQ ID NO: 1605124 - RNA, 18 nt, Homo sapiens
cugaguaagcccucagga

SEQ ID NO: 1605125 - RNA, 17 nt, Homo sapiens
cugagucacaauaaaga

SEQ ID NO: 1605126 - RNA, 18 nt, Homo sapiens
cugagucccuccaugcaa

SEQ ID NO: 1605127 - RNA, 17 nt, Homo sapiens
cugagugacugcagcuu

SEQ ID NO: 1605128 - RNA, 22 nt, Homo sapiens
cugagugcgggcugaggccaga

SEQ ID NO: 1605129 - RNA, 19 nt, Homo sapiens
cugaguuuuguuucacuuu

SEQ ID NO: 1605130 - RNA, 18 nt, Homo sapiens
cugauaagagaaucaaca

SEQ ID NO: 1605131 - RNA, 16 nt, Homo sapiens
cugauaggaaugugaa

SEQ ID NO: 1605132 - RNA, 12 nt, Homo sapiens
cugauaugucag

SEQ ID NO: 1605133 - RNA, 20 nt, Homo sapiens
cugauaugucagucccuggc

SEQ ID NO: 1605134 - RNA, 15 nt, Homo sapiens
cugaucauguaugca

SEQ ID NO: 1605135 - RNA, 15 nt, Homo sapiens
cugaugauacaugca

SEQ ID NO: 1605136 - RNA, 11 nt, Homo sapiens
cugaugcauug

SEQ ID NO: 1605137 - RNA, 19 nt, Homo sapiens
cugaugccuugaggggugu

SEQ ID NO: 1605138 - RNA, 15 nt, Homo sapiens
cugaugcugggaccc

SEQ ID NO: 1605139 - RNA, 16 nt, Homo sapiens
cugauggaacugugua

SEQ ID NO: 1605140 - RNA, 19 nt, Homo sapiens
cucuguccuaaauaucuca

SEQ ID NO: 1605141 - RNA, 17 nt, Homo sapiens
cucugucgccaggcuag

SEQ ID NO: 1605142 - RNA, 19 nt, Homo sapiens
cucugugcagucacuggag

SEQ ID NO: 1605143 - RNA, 21 nt, Homo sapiens
cucuguguggcugugcaauuu

SEQ ID NO: 1605144 - RNA, 22 nt, Homo sapiens
cucuguuacacacuaacaucaa

SEQ ID NO: 1605145 - RNA, 16 nt, Homo sapiens
cucuguugaaucacag

SEQ ID NO: 1605146 - RNA, 17 nt, Homo sapiens
cucuuacaauaagcuaa

SEQ ID NO: 1605147 - RNA, 12 nt, Homo sapiens
cucuuacacaua

SEQ ID NO: 1605148 - RNA, 15 nt, Homo sapiens
cucuuacacauagca

SEQ ID NO: 1605149 - RNA, 22 nt, Homo sapiens
cucuuagaauuuguuucaucua

SEQ ID NO: 1605150 - RNA, 15 nt, Homo sapiens
cucuucaacaugaca

SEQ ID NO: 1605151 - RNA, 19 nt, Homo sapiens
cucuucaacaugacaucca

SEQ ID NO: 1605152 - RNA, 16 nt, Homo sapiens
cucuucaauaaaccac

SEQ ID NO: 1605153 - RNA, 10 nt, Homo sapiens
cucuucacau

SEQ ID NO: 1605154 - RNA, 13 nt, Homo sapiens
cucccccaguucc

SEQ ID NO: 1605155 - RNA, 22 nt, Homo sapiens
cucccccaguuccucccaggaa

SEQ ID NO: 1605156 - RNA, 17 nt, Homo sapiens
cucccccugccagugcc

SEQ ID NO: 1605157 - RNA, 17 nt, Homo sapiens
cuccccugcccuggucc

SEQ ID NO: 1605158 - RNA, 20 nt, Homo sapiens
cuccccuugucugcacuguu

SEQ ID NO: 1605159 - RNA, 22 nt, Homo sapiens
cuccccuuuuauaccugcucuu

SEQ ID NO: 1605160 - RNA, 20 nt, Homo sapiens
cucccuaguagcugggauua

SEQ ID NO: 1605161 - RNA, 18 nt, Homo sapiens
cucccuccagacaaugcc

SEQ ID NO: 1605162 - RNA, 18 nt, Homo sapiens
cucccugaagaccaaaau

SEQ ID NO: 1605163 - RNA, 19 nt, Homo sapiens
cucccugccuccugccuau

SEQ ID NO: 1605164 - RNA, 18 nt, Homo sapiens
cucccugcuagcacagag

SEQ ID NO: 1605165 - RNA, 14 nt, Homo sapiens
cucccuggcacuga

SEQ ID NO: 1605166 - RNA, 16 nt, Homo sapiens
ccaccaggccagcuca

SEQ ID NO: 1605167 - RNA, 13 nt, Homo sapiens
ccaccaguucuca

SEQ ID NO: 1605168 - RNA, 12 nt, Homo sapiens
ccaccaugagcu

SEQ ID NO: 1605169 - RNA, 14 nt, Homo sapiens
ccacccauaucaug

SEQ ID NO: 1605170 - RNA, 22 nt, Homo sapiens
ccaccccuaaguagucaucaau

SEQ ID NO: 1605171 - RNA, 15 nt, Homo sapiens
ccaccguggggagcc

SEQ ID NO: 1605172 - RNA, 13 nt, Homo sapiens
ccaccuaauauca

SEQ ID NO: 1605173 - RNA, 15 nt, Homo sapiens
ccaccuagagcuaga

SEQ ID NO: 1605174 - RNA, 22 nt, Homo sapiens
ccaccuagagcuagaugugucu

SEQ ID NO: 1605175 - RNA, 16 nt, Homo sapiens
ccaccucuaccaaaaa

SEQ ID NO: 1605176 - RNA, 17 nt, Homo sapiens
ccaccucuugugcaagg

SEQ ID NO: 1605177 - RNA, 15 nt, Homo sapiens
ccaccugcccaucac

SEQ ID NO: 1605178 - RNA, 23 nt, Homo sapiens
ccaccuucuacgcaauugacaaa

SEQ ID NO: 1605179 - RNA, 18 nt, Homo sapiens
ccacgccucuugaccagg

SEQ ID NO: 1605180 - RNA, 20 nt, Homo sapiens
ccacgugggccucacauucc

SEQ ID NO: 1605181 - RNA, 13 nt, Homo sapiens
ccacucaaaauag

SEQ ID NO: 1605182 - RNA, 11 nt, Homo sapiens
ccacucaggcc

SEQ ID NO: 1605183 - RNA, 14 nt, Homo sapiens
ccacucccaaagcu

SEQ ID NO: 1605184 - RNA, 15 nt, Homo sapiens
ccacucccugggaca

SEQ ID NO: 1605185 - RNA, 14 nt, Homo sapiens
ccacugcacuccag

SEQ ID NO: 1605186 - RNA, 21 nt, Homo sapiens
ccacuggauccugcugcuuug

SEQ ID NO: 1605187 - RNA, 23 nt, Homo sapiens
ccacuggggaggaauccuggacc

SEQ ID NO: 1605188 - RNA, 22 nt, Homo sapiens
ccacuguauaugcauauaguga

SEQ ID NO: 1605189 - RNA, 16 nt, Homo sapiens
ccacuguaugauucuc

SEQ ID NO: 1605190 - RNA, 19 nt, Homo sapiens
ccacuguggcacuggccac

SEQ ID NO: 1605191 - RNA, 20 nt, Homo sapiens
ccacuuaaggaccuuuuuaa

SEQ ID NO: 1605192 - RNA, 18 nt, Homo sapiens
ccacuucucacucaccac

SEQ ID NO: 1605193 - RNA, 20 nt, Homo sapiens
ccagaaaaccucuccugacc

SEQ ID NO: 1605194 - RNA, 21 nt, Homo sapiens
ccagaaaaccucuccugaccc

SEQ ID NO: 1605195 - RNA, 14 nt, Homo sapiens
ccagaaaagcaaua

SEQ ID NO: 1605196 - RNA, 17 nt, Homo sapiens
ccagaaaagcaguggcu

SEQ ID NO: 1605197 - RNA, 15 nt, Homo sapiens
ccagaaacagggaca

SEQ ID NO: 1605198 - RNA, 20 nt, Homo sapiens
ccagaacaguaugaauuuga

SEQ ID NO: 1605199 - RNA, 13 nt, Homo sapiens
ccagaaccuggag

SEQ ID NO: 1605200 - RNA, 17 nt, Homo sapiens
ccagaacuguuuucuca

SEQ ID NO: 1605201 - RNA, 20 nt, Homo sapiens
ccagaacuuucuguccuaau

SEQ ID NO: 1605202 - RNA, 15 nt, Homo sapiens
ccagacaauuccauu

SEQ ID NO: 1605203 - RNA, 22 nt, Homo sapiens
ccagacucagguuccagaacag

SEQ ID NO: 1605204 - RNA, 16 nt, Homo sapiens
ccagacuggcacaguu

SEQ ID NO: 1605205 - RNA, 20 nt, Homo sapiens
ccagacuuucuuuuucuaca

SEQ ID NO: 1605206 - RNA, 14 nt, Homo sapiens
ccagagacacugag

SEQ ID NO: 1605207 - RNA, 19 nt, Homo sapiens
ccagagacagaggaugugg

SEQ ID NO: 1605208 - RNA, 21 nt, Homo sapiens
ccagagaugacuauuacuuuu

SEQ ID NO: 1605209 - RNA, 17 nt, Homo sapiens
ccagagcgguaucucug

SEQ ID NO: 1605210 - RNA, 23 nt, Homo sapiens
ccagagcgguaucucuggcacca

SEQ ID NO: 1605211 - RNA, 18 nt, Homo sapiens
ccagagcguguagugaau

SEQ ID NO: 1605212 - RNA, 19 nt, Homo sapiens
ccagagcugagauggcaua

SEQ ID NO: 1605213 - RNA, 20 nt, Homo sapiens
ccagaggauugcugccccau

SEQ ID NO: 1605214 - RNA, 20 nt, Homo sapiens
ccagaggguagggcacaaag

SEQ ID NO: 1605215 - RNA, 13 nt, Homo sapiens
ccagagguccagg

SEQ ID NO: 1605216 - RNA, 18 nt, Homo sapiens
ccagauauaacugucuug

SEQ ID NO: 1605217 - RNA, 18 nt, Homo sapiens
ccagaucuaacaucuuga

SEQ ID NO: 1605218 - RNA, 17 nt, Homo sapiens
ccagaugccaaccagac

SEQ ID NO: 1605219 - RNA, 21 nt, Homo sapiens
ccagaugcccagaggcuccau

SEQ ID NO: 1605220 - RNA, 21 nt, Homo sapiens
ccagaugugugcaauguggca

SEQ ID NO: 1605221 - RNA, 14 nt, Homo sapiens
ccagauguuaugcu

SEQ ID NO: 1605222 - RNA, 21 nt, Homo sapiens
ccagauuggcucacacugaga

SEQ ID NO: 1605223 - RNA, 18 nt, Homo sapiens
ccagcaaagucugcaucu

SEQ ID NO: 1605224 - RNA, 14 nt, Homo sapiens
ccagcacuggugaa

SEQ ID NO: 1605225 - RNA, 12 nt, Homo sapiens
ccagcacuucca

SEQ ID NO: 1605226 - RNA, 16 nt, Homo sapiens
ccagcagcugauucca

SEQ ID NO: 1605227 - RNA, 17 nt, Homo sapiens
ccagcagcuggguuggg

SEQ ID NO: 1605228 - RNA, 14 nt, Homo sapiens
ccagcaucuggaag

SEQ ID NO: 1605229 - RNA, 16 nt, Homo sapiens
ccagcaugacgguguc

SEQ ID NO: 1605230 - RNA, 19 nt, Homo sapiens
ccagcauuuuuauaaacua

SEQ ID NO: 1605231 - RNA, 10 nt, Homo sapiens
ccagccacag

SEQ ID NO: 1605232 - RNA, 22 nt, Homo sapiens
ccagccaccccgggcucucugc

SEQ ID NO: 1605233 - RNA, 14 nt, Homo sapiens
ccagccacugugau

SEQ ID NO: 1605234 - RNA, 16 nt, Homo sapiens
ccagccaugugccuua

SEQ ID NO: 1605235 - RNA, 13 nt, Homo sapiens
ccagcccaagcac

SEQ ID NO: 1605236 - RNA, 23 nt, Homo sapiens
ccagcccgggcuggcccaaggag

SEQ ID NO: 1605237 - RNA, 19 nt, Homo sapiens
ccagcccuggcccaggugc

SEQ ID NO: 1605238 - RNA, 15 nt, Homo sapiens
ccagccgauguggua

SEQ ID NO: 1605239 - RNA, 24 nt, Homo sapiens
ccagccuauagcagaagcacauuu

SEQ ID NO: 1605240 - RNA, 19 nt, Homo sapiens
ccagccuccccgugccaaa

SEQ ID NO: 1605241 - RNA, 20 nt, Homo sapiens
ccagccugggcaacagagca

SEQ ID NO: 1605242 - RNA, 14 nt, Homo sapiens
ccagcgauggugcu

SEQ ID NO: 1605243 - RNA, 19 nt, Homo sapiens
ccagcuaacaggucuagaa

SEQ ID NO: 1605244 - RNA, 15 nt, Homo sapiens
ccagcuagugccaaa

SEQ ID NO: 1605245 - RNA, 19 nt, Homo sapiens
ccagcugcccuugcagggu

SEQ ID NO: 1605246 - RNA, 13 nt, Homo sapiens
ccagcuggcagac

SEQ ID NO: 1605247 - RNA, 20 nt, Homo sapiens
ccagcugucucccacgugug

SEQ ID NO: 1605248 - RNA, 19 nt, Homo sapiens
ccagcuuucccugccucuc

SEQ ID NO: 1605249 - RNA, 17 nt, Homo sapiens
ccaggacagcugugcuc

SEQ ID NO: 1605250 - RNA, 13 nt, Homo sapiens
ccaggacugggcc

SEQ ID NO: 1605251 - RNA, 12 nt, Homo sapiens
ccaggagccuca

SEQ ID NO: 1605252 - RNA, 13 nt, Homo sapiens
ccaggagccucac

SEQ ID NO: 1605253 - RNA, 14 nt, Homo sapiens
ccaggagccucacu

SEQ ID NO: 1605254 - RNA, 13 nt, Homo sapiens
ccaggagcucuuc

SEQ ID NO: 1605255 - RNA, 19 nt, Homo sapiens
ccaggcacacacugugcuu

SEQ ID NO: 1605256 - RNA, 13 nt, Homo sapiens
ccaggcacagugg

SEQ ID NO: 1605257 - RNA, 19 nt, Homo sapiens
ccaggccccaggggagaaa

SEQ ID NO: 1605258 - RNA, 21 nt, Homo sapiens
ccaggccugcauuacuccuuc

SEQ ID NO: 1605259 - RNA, 18 nt, Homo sapiens
ccaggcuagagugcaaug

SEQ ID NO: 1605260 - RNA, 19 nt, Homo sapiens
ccaggcuagagugcaaugg

SEQ ID NO: 1605261 - RNA, 20 nt, Homo sapiens
ccaggcuagagugcaauggc

SEQ ID NO: 1605262 - RNA, 22 nt, Homo sapiens
ccaggcugagagccggccgugg

SEQ ID NO: 1605263 - RNA, 22 nt, Homo sapiens
ccaggcugccuggucacugccc

SEQ ID NO: 1605264 - RNA, 20 nt, Homo sapiens
ccaggcuggagugcaguggu

SEQ ID NO: 1605265 - RNA, 23 nt, Homo sapiens
ccagggagcagagcuuccacaag

SEQ ID NO: 1605266 - RNA, 14 nt, Homo sapiens
ccagggaucacaga

SEQ ID NO: 1605267 - RNA, 13 nt, Homo sapiens
ccagggaugggca

SEQ ID NO: 1605268 - RNA, 23 nt, Homo sapiens
ccagggcagggcgagcugcagga

SEQ ID NO: 1605269 - RNA, 18 nt, Homo sapiens
ccagggcuggacugaggc

SEQ ID NO: 1605270 - RNA, 15 nt, Homo sapiens
ccagggcuuccucaa

SEQ ID NO: 1605271 - RNA, 18 nt, Homo sapiens
ccaggggaaccugccaug

SEQ ID NO: 1605272 - RNA, 18 nt, Homo sapiens
ccaggggggacaauaugu

SEQ ID NO: 1605273 - RNA, 15 nt, Homo sapiens
ccagggguguagaug

SEQ ID NO: 1605274 - RNA, 16 nt, Homo sapiens
ccaggugucaaaugag

SEQ ID NO: 1605275 - RNA, 19 nt, Homo sapiens
ccagguuuuaauaaccaca

SEQ ID NO: 1605276 - RNA, 20 nt, Homo sapiens
ccaguagcuucccaaaaaca

SEQ ID NO: 1605277 - RNA, 12 nt, Homo sapiens
ccaguaguggga

SEQ ID NO: 1605278 - RNA, 17 nt, Homo sapiens
ccagucauuauguuaau

SEQ ID NO: 1605279 - RNA, 15 nt, Homo sapiens
ccaguccacugagca

SEQ ID NO: 1605280 - RNA, 16 nt, Homo sapiens
ccaguccaugcuccag

SEQ ID NO: 1605281 - RNA, 16 nt, Homo sapiens
ccaguccuagcugcac

SEQ ID NO: 1605282 - RNA, 14 nt, Homo sapiens
ccaguccuguccua

SEQ ID NO: 1605283 - RNA, 14 nt, Homo sapiens
ccagugacuugcaa

SEQ ID NO: 1605284 - RNA, 13 nt, Homo sapiens
ccagugcagccac

SEQ ID NO: 1605285 - RNA, 19 nt, Homo sapiens
caacaacuuacacuuauuu

SEQ ID NO: 1605286 - RNA, 17 nt, Homo sapiens
caacaauaaaguacuuu

SEQ ID NO: 1605287 - RNA, 23 nt, Homo sapiens
caacaauccuucuauucuagccu

SEQ ID NO: 1605288 - RNA, 15 nt, Homo sapiens
caacacccaacuguc

SEQ ID NO: 1605289 - RNA, 22 nt, Homo sapiens
caacaccuauauauccaagaag

SEQ ID NO: 1605290 - RNA, 19 nt, Homo sapiens
caacacuggugugaccuga

SEQ ID NO: 1605291 - RNA, 22 nt, Homo sapiens
caacagagaggaccaacaucca

SEQ ID NO: 1605292 - RNA, 13 nt, Homo sapiens
caacagcacacag

SEQ ID NO: 1605293 - RNA, 17 nt, Homo sapiens
agugucacuggauguca

SEQ ID NO: 1605294 - RNA, 22 nt, Homo sapiens
aguguccuaccacucuaaucaa

SEQ ID NO: 1605295 - RNA, 22 nt, Homo sapiens
aguguccuggcugugaaugcca

SEQ ID NO: 1605296 - RNA, 22 nt, Homo sapiens
agugugaggcggcccugaccaa

SEQ ID NO: 1605297 - RNA, 23 nt, Homo sapiens
agugugggggaggcgcacagugu

SEQ ID NO: 1605298 - RNA, 22 nt, Homo sapiens
aguguguaaaauuaauguaaua

SEQ ID NO: 1605299 - RNA, 24 nt, Homo sapiens
agugugugccaagagcuacuccca

SEQ ID NO: 1605300 - RNA, 20 nt, Homo sapiens
aguguuaauuuuaccuuguu

SEQ ID NO: 1605301 - RNA, 19 nt, Homo sapiens
aguguucacaaacugugaa

SEQ ID NO: 1605302 - RNA, 17 nt, Homo sapiens
aguguucaguaaacaaa

SEQ ID NO: 1605303 - RNA, 20 nt, Homo sapiens
aguguuccccgauaccaugc

SEQ ID NO: 1605304 - RNA, 17 nt, Homo sapiens
aguguucccgugccugg

SEQ ID NO: 1605305 - RNA, 22 nt, Homo sapiens
aguguuugcuccaccuucauau

SEQ ID NO: 1605306 - RNA, 21 nt, Homo sapiens
aguuaaaacucaucacauaaa

SEQ ID NO: 1605307 - RNA, 15 nt, Homo sapiens
aguuaagaacaucaa

SEQ ID NO: 1605308 - RNA, 16 nt, Homo sapiens
aguuaauccacuguga

SEQ ID NO: 1605309 - RNA, 17 nt, Homo sapiens
aguuacaaaauacaaaa

SEQ ID NO: 1605310 - RNA, 18 nt, Homo sapiens
aguuacaaaauacaaaag

SEQ ID NO: 1605311 - RNA, 13 nt, Homo sapiens
aguuacacuugac

SEQ ID NO: 1605312 - RNA, 19 nt, Homo sapiens
aggccauugugaaccaaug

SEQ ID NO: 1605313 - RNA, 15 nt, Homo sapiens
aggcccaaagcacuu

SEQ ID NO: 1605314 - RNA, 17 nt, Homo sapiens
aggcccaaaugauggau

SEQ ID NO: 1605315 - RNA, 20 nt, Homo sapiens
aggcccaccccugaggacac

SEQ ID NO: 1605316 - RNA, 16 nt, Homo sapiens
aggcccaggaguccag

SEQ ID NO: 1605317 - RNA, 13 nt, Homo sapiens
aggcccauguaua

SEQ ID NO: 1605318 - RNA, 16 nt, Homo sapiens
aggccccaaucuugcc

SEQ ID NO: 1605319 - RNA, 20 nt, Homo sapiens
aggccccugcaaugugguga

SEQ ID NO: 1605320 - RNA, 17 nt, Homo sapiens
aggcccugcccaaugag

SEQ ID NO: 1605321 - RNA, 17 nt, Homo sapiens
aggccucucucugcucc

SEQ ID NO: 1605322 - RNA, 20 nt, Homo sapiens
aggccucugcuggcucagga

SEQ ID NO: 1605323 - RNA, 15 nt, Homo sapiens
aggccucuguggcac

SEQ ID NO: 1605324 - RNA, 13 nt, Homo sapiens
aggccugaacuca

SEQ ID NO: 1605325 - RNA, 17 nt, Homo sapiens
aggccugcugccagugc

SEQ ID NO: 1605326 - RNA, 15 nt, Homo sapiens
aggccuggauaauau

SEQ ID NO: 1605327 - RNA, 22 nt, Homo sapiens
aggccuuccccuggcacuggca

SEQ ID NO: 1605328 - RNA, 20 nt, Homo sapiens
aggcgcaguggcucaugccu

SEQ ID NO: 1605329 - RNA, 21 nt, Homo sapiens
aggcgcaguggcucaugccug

SEQ ID NO: 1605330 - RNA, 19 nt, Homo sapiens
aggcgcugcauacagggga

SEQ ID NO: 1605331 - RNA, 14 nt, Homo sapiens
aggcguucuucgag

SEQ ID NO: 1605332 - RNA, 18 nt, Homo sapiens
aggcuaaaaggcuuccag

SEQ ID NO: 1605333 - RNA, 13 nt, Homo sapiens
aaaaaaacuucau

SEQ ID NO: 1605334 - RNA, 13 nt, Homo sapiens
aaaaaaaucaucu

SEQ ID NO: 1605335 - RNA, 19 nt, Homo sapiens
aaaaaauucacaugaugca

SEQ ID NO: 1605336 - RNA, 15 nt, Homo sapiens
aaaaacaauuuugac

SEQ ID NO: 1605337 - RNA, 19 nt, Homo sapiens
aaaaagaccuaugagcaca

SEQ ID NO: 1605338 - RNA, 12 nt, Homo sapiens
aaaaagcacaaa

SEQ ID NO: 1605339 - RNA, 21 nt, Homo sapiens
aaaaagcaggaaaaaaggaau

SEQ ID NO: 1605340 - RNA, 17 nt, Homo sapiens
aaaaagcuaaugugcag

SEQ ID NO: 1605341 - RNA, 16 nt, Homo sapiens
aaaaagcucauuucau

SEQ ID NO: 1605342 - RNA, 13 nt, Homo sapiens
aaaaagcugcuuc

SEQ ID NO: 1605343 - RNA, 21 nt, Homo sapiens
aaaaagcuuuaugauuuucau

SEQ ID NO: 1605344 - RNA, 17 nt, Homo sapiens
aaaaauaaagcacuuau

SEQ ID NO: 1605345 - RNA, 23 nt, Homo sapiens
aaaaauaaugguguccagucuuu

SEQ ID NO: 1605346 - RNA, 23 nt, Homo sapiens
aaaaauauuguuucugcauucau

SEQ ID NO: 1605347 - RNA, 20 nt, Homo sapiens
aaaaaucuuuucauuaaaga

SEQ ID NO: 1605348 - RNA, 24 nt, Homo sapiens
aaaaaugaaaagagaaugaugcuc

SEQ ID NO: 1605349 - RNA, 15 nt, Homo sapiens
aaaaaugaaguuuau

SEQ ID NO: 1605350 - RNA, 16 nt, Homo sapiens
aaaaauggauagcuca

SEQ ID NO: 1605351 - RNA, 19 nt, Homo sapiens
aaaaauguauaaugacuuu

SEQ ID NO: 1605352 - RNA, 14 nt, Homo sapiens
aaaaauuaucuaua

SEQ ID NO: 1605353 - RNA, 15 nt, Homo sapiens
aaaaauuuauacuua

SEQ ID NO: 1605354 - RNA, 16 nt, Homo sapiens
aaaacaagcauucaca

SEQ ID NO: 1605355 - RNA, 16 nt, Homo sapiens
aaaacacaccaaucag

SEQ ID NO: 1605356 - RNA, 14 nt, Homo sapiens
aaaacaccaugaaa

SEQ ID NO: 1605357 - RNA, 15 nt, Homo sapiens
aaaacacugugcaca

SEQ ID NO: 1605358 - RNA, 14 nt, Homo sapiens
aaaacauagcuuuc

SEQ ID NO: 1605359 - RNA, 13 nt, Homo sapiens
aaaacauauccaa

SEQ ID NO: 1605360 - RNA, 19 nt, Homo sapiens
aaaacaucauuacugccau

SEQ ID NO: 1605361 - RNA, 13 nt, Homo sapiens
aaaacauccagca

SEQ ID NO: 1605362 - RNA, 18 nt, Homo sapiens
aaaaccacagcaguugaa

SEQ ID NO: 1605363 - RNA, 21 nt, Homo sapiens
aaaaccauucuaaaacacaac

SEQ ID NO: 1605364 - RNA, 21 nt, Homo sapiens
aaaaccgaggcccucaaucca

SEQ ID NO: 1605365 - RNA, 22 nt, Homo sapiens
aaaaccuuguggauaaguggcu

SEQ ID NO: 1605366 - RNA, 21 nt, Homo sapiens
aaaacgaugaaguuaugcugu

SEQ ID NO: 1605367 - RNA, 22 nt, Homo sapiens
aaaacguugaauugaugaugca

SEQ ID NO: 1605368 - RNA, 23 nt, Homo sapiens
aaaacguugaauugaugaugcag

SEQ ID NO: 1605369 - RNA, 17 nt, Homo sapiens
aaaacuaaccaucugaa

SEQ ID NO: 1605370 - RNA, 14 nt, Homo sapiens
aaaacuacaaauca

SEQ ID NO: 1605371 - RNA, 18 nt, Homo sapiens
aaaacuacugacagggag

SEQ ID NO: 1605372 - RNA, 16 nt, Homo sapiens
aaaacuacugauacuu

SEQ ID NO: 1605373 - RNA, 17 nt, Homo sapiens
aaaacugaacuugaagc

SEQ ID NO: 1605374 - RNA, 14 nt, Homo sapiens
aaaacugacagagg

SEQ ID NO: 1605375 - RNA, 14 nt, Homo sapiens
aaaacuuaacauuc

SEQ ID NO: 1605376 - RNA, 13 nt, Homo sapiens
aaaacuuccuuaa

SEQ ID NO: 1605377 - RNA, 23 nt, Homo sapiens
aaaacuuucauccugguuuccac

SEQ ID NO: 1605378 - RNA, 15 nt, Homo sapiens
aaaagaaaagaaaau

SEQ ID NO: 1605379 - RNA, 23 nt, Homo sapiens
aaaagaaauauacaguuugacuu

SEQ ID NO: 1605380 - RNA, 17 nt, Homo sapiens
aaaagacaagaaaauca

SEQ ID NO: 1605381 - RNA, 15 nt, Homo sapiens
aaaagacugaaucua

SEQ ID NO: 1605382 - RNA, 13 nt, Homo sapiens
aaaagagaucuua

SEQ ID NO: 1605383 - RNA, 22 nt, Homo sapiens
aaaagagcauggaugcauuuca

SEQ ID NO: 1605384 - RNA, 16 nt, Homo sapiens
aaaagcaacaggccau

SEQ ID NO: 1605385 - RNA, 13 nt, Homo sapiens
aaaagcaccugcc

SEQ ID NO: 1605386 - RNA, 17 nt, Homo sapiens
aaaagcacgacagugga

SEQ ID NO: 1605387 - RNA, 14 nt, Homo sapiens
aaaagcaugcauau

SEQ ID NO: 1605388 - RNA, 16 nt, Homo sapiens
aaaagcgacccauuca

SEQ ID NO: 1605389 - RNA, 20 nt, Homo sapiens
aaaaggaaagcuguguuuau

SEQ ID NO: 1605390 - RNA, 22 nt, Homo sapiens
aaaaggaacucuagaagaccaa

SEQ ID NO: 1605391 - RNA, 23 nt, Homo sapiens
aaaaggagguaucuagcaaugga

SEQ ID NO: 1605392 - RNA, 20 nt, Homo sapiens
aaaaggaguagggaguucau

SEQ ID NO: 1605393 - RNA, 19 nt, Homo sapiens
aaaaggcuaagaauagugg

SEQ ID NO: 1605394 - RNA, 16 nt, Homo sapiens
aaaaggugauugucac

SEQ ID NO: 1605395 - RNA, 18 nt, Homo sapiens
aaaaguaaauucauguaa

SEQ ID NO: 1605396 - RNA, 17 nt, Homo sapiens
aaaaguaaucacuuaaa

SEQ ID NO: 1605397 - RNA, 18 nt, Homo sapiens
aaaaguaaugaagaaaau

SEQ ID NO: 1605398 - RNA, 13 nt, Homo sapiens
aaaaguacauuaa

SEQ ID NO: 1605399 - RNA, 21 nt, Homo sapiens
aaaaguagacugauuacacug

SEQ ID NO: 1605400 - RNA, 23 nt, Homo sapiens
aaaagucccaacccaaugggcuc

SEQ ID NO: 1605401 - RNA, 16 nt, Homo sapiens
aaaagucccucccugc

SEQ ID NO: 1605402 - RNA, 20 nt, Homo sapiens
aaaagucccucccugccuga

SEQ ID NO: 1605403 - RNA, 13 nt, Homo sapiens
aaaagucuaccug

SEQ ID NO: 1605404 - RNA, 12 nt, Homo sapiens
aaaagugauuau

SEQ ID NO: 1605405 - RNA, 13 nt, Homo sapiens
aaaaguggggcag

SEQ ID NO: 1605406 - RNA, 14 nt, Homo sapiens
aaaagugucuugaa

SEQ ID NO: 1605407 - RNA, 17 nt, Homo sapiens
aaaaguuuaaagacacu

SEQ ID NO: 1605408 - RNA, 17 nt, Homo sapiens
aaaauaaaacugucacu

SEQ ID NO: 1605409 - RNA, 14 nt, Homo sapiens
aaaauaagcauuua

SEQ ID NO: 1605410 - RNA, 17 nt, Homo sapiens
aaaauacaaaaagcaaa

SEQ ID NO: 1605411 - RNA, 18 nt, Homo sapiens
aaaauacaacacugagcc

SEQ ID NO: 1605412 - RNA, 16 nt, Homo sapiens
aaaauacaagaaccaa

SEQ ID NO: 1605413 - RNA, 11 nt, Homo sapiens
aaaauacacuu

SEQ ID NO: 1605414 - RNA, 15 nt, Homo sapiens
aaaauagacuuaaau

SEQ ID NO: 1605415 - RNA, 18 nt, Homo sapiens
aaaauagagccugaggga

SEQ ID NO: 1605416 - RNA, 19 nt, Homo sapiens
aaaauauaauuuacauuaa

SEQ ID NO: 1605417 - RNA, 16 nt, Homo sapiens
aaaauauagacauucu

SEQ ID NO: 1605418 - RNA, 13 nt, Homo sapiens
aaaauaucaauau

SEQ ID NO: 1605419 - RNA, 12 nt, Homo sapiens
aaaauaugccuu

SEQ ID NO: 1605420 - RNA, 19 nt, Homo sapiens
aaaauauguauuuaccaaa

SEQ ID NO: 1605421 - RNA, 22 nt, Homo sapiens
aaaauauuuguaucacaaaucu

SEQ ID NO: 1605422 - RNA, 15 nt, Homo sapiens
aaaaucacaucucca

SEQ ID NO: 1605423 - RNA, 19 nt, Homo sapiens
aaaaucagagaacuuuccc

SEQ ID NO: 1605424 - RNA, 16 nt, Homo sapiens
aaaaucauaguacucu

SEQ ID NO: 1605425 - RNA, 19 nt, Homo sapiens
aaauugagaccugagugaa

SEQ ID NO: 1605426 - RNA, 20 nt, Homo sapiens
aaauugaguucuuccuguaa

SEQ ID NO: 1605427 - RNA, 16 nt, Homo sapiens
aaauugggcagucuua

SEQ ID NO: 1605428 - RNA, 16 nt, Homo sapiens
aaauugguaauauaca

SEQ ID NO: 1605429 - RNA, 19 nt, Homo sapiens
aaauuguaucucagucuaa

SEQ ID NO: 1605430 - RNA, 19 nt, Homo sapiens
aaauuuaacaguuaccuga

SEQ ID NO: 1605431 - RNA, 23 nt, Homo sapiens
aaauuuaagaaaacaaguauaua

SEQ ID NO: 1605432 - RNA, 13 nt, Homo sapiens
aaauuuaugugau

SEQ ID NO: 1605433 - RNA, 16 nt, Homo sapiens
aaauuucuacaccaag

SEQ ID NO: 1605434 - RNA, 21 nt, Homo sapiens
aaauuucuguaaaacagguua

SEQ ID NO: 1605435 - RNA, 15 nt, Homo sapiens
aaauuuggccuuaag

SEQ ID NO: 1605436 - RNA, 22 nt, Homo sapiens
aaauuuggccuuaagaacugug

SEQ ID NO: 1605437 - RNA, 15 nt, Homo sapiens
aaauuuucuggugcu

SEQ ID NO: 1605438 - RNA, 15 nt, Homo sapiens
aaauuuugagauuaa

SEQ ID NO: 1605439 - RNA, 16 nt, Homo sapiens
aaauuuuuaaauauuc

SEQ ID NO: 1605440 - RNA, 17 nt, Homo sapiens
aacaaaagaaucuucca

SEQ ID NO: 1605441 - RNA, 19 nt, Homo sapiens
aacaaaagcgacccauuca

SEQ ID NO: 1605442 - RNA, 12 nt, Homo sapiens
aacaaaauccuc

SEQ ID NO: 1605443 - RNA, 13 nt, Homo sapiens
aacaaaauuagaa

SEQ ID NO: 1605444 - RNA, 14 nt, Homo sapiens
aacaaagaacugaa

SEQ ID NO: 1605445 - RNA, 17 nt, Homo sapiens
aacaaagaacugaagcu

SEQ ID NO: 1605446 - RNA, 12 nt, Homo sapiens
aacaaagacagg

SEQ ID NO: 1605447 - RNA, 19 nt, Homo sapiens
aacaaagacuugcuuuaaa

SEQ ID NO: 1605448 - RNA, 18 nt, Homo sapiens
aacaaauaaaaugaaaua

SEQ ID NO: 1605449 - RNA, 16 nt, Homo sapiens
aacaaauauuucacuu

SEQ ID NO: 1605450 - RNA, 13 nt, Homo sapiens
aacaaaugaaaua

SEQ ID NO: 1605451 - RNA, 15 nt, Homo sapiens
aacaaauguauuuca

SEQ ID NO: 1605452 - RNA, 15 nt, Homo sapiens
aacaaauuguuuaca

SEQ ID NO: 1605453 - RNA, 23 nt, Homo sapiens
aacaacaaaacaauuacuaauga

SEQ ID NO: 1605454 - RNA, 22 nt, Homo sapiens
aacaacaaagacaugcuuucca

SEQ ID NO: 1605455 - RNA, 20 nt, Homo sapiens
aacaacacuggugugaccug

SEQ ID NO: 1605456 - RNA, 12 nt, Homo sapiens
aacaacauuuau

SEQ ID NO: 1605457 - RNA, 13 nt, Homo sapiens
aacaagucuauaa

SEQ ID NO: 1605458 - RNA, 23 nt, Homo sapiens
aacaauauuacuuugucuuuuca

SEQ ID NO: 1605459 - RNA, 13 nt, Homo sapiens
aacaauccauuca

SEQ ID NO: 1605460 - RNA, 13 nt, Homo sapiens
aacaaugacuuaa

SEQ ID NO: 1605461 - RNA, 16 nt, Homo sapiens
aacaauggaagauuug

SEQ ID NO: 1605462 - RNA, 13 nt, Homo sapiens
aacaauugguaaa

SEQ ID NO: 1605463 - RNA, 15 nt, Homo sapiens
aacacacagcaacau

SEQ ID NO: 1605464 - RNA, 19 nt, Homo sapiens
aacacacuuaucugucucu

SEQ ID NO: 1605465 - RNA, 11 nt, Homo sapiens
aacacaugaua

SEQ ID NO: 1605466 - RNA, 12 nt, Homo sapiens
aacaccugccuc

SEQ ID NO: 1605467 - RNA, 13 nt, Homo sapiens
aacaccugccucu

SEQ ID NO: 1605468 - RNA, 21 nt, Homo sapiens
aacaccuuccuccugcagaca

SEQ ID NO: 1605469 - RNA, 16 nt, Homo sapiens
aacacgcguauuuaca

SEQ ID NO: 1605470 - RNA, 22 nt, Homo sapiens
aacacuaauaauaguacuauua

SEQ ID NO: 1605471 - RNA, 14 nt, Homo sapiens
aacacugcccucuu

SEQ ID NO: 1605472 - RNA, 18 nt, Homo sapiens
aacacuggugugaccuga

SEQ ID NO: 1605473 - RNA, 22 nt, Homo sapiens
aacacugugauuuaucuuucaa

SEQ ID NO: 1605474 - RNA, 17 nt, Homo sapiens
aacacuuaaucauuuua

SEQ ID NO: 1605475 - RNA, 19 nt, Homo sapiens
aacacuuggcauacaaaau

SEQ ID NO: 1605476 - RNA, 12 nt, Homo sapiens
aacagaaaccau

SEQ ID NO: 1605477 - RNA, 22 nt, Homo sapiens
aacagaaauguuuuuuggcauu

SEQ ID NO: 1605478 - RNA, 14 nt, Homo sapiens
aacagaacuccacu

SEQ ID NO: 1605479 - RNA, 13 nt, Homo sapiens
aacagacaauauu

SEQ ID NO: 1605480 - RNA, 13 nt, Homo sapiens
aacagacuugaau

SEQ ID NO: 1605481 - RNA, 16 nt, Homo sapiens
aacagaggcauuuaaa

SEQ ID NO: 1605482 - RNA, 16 nt, Homo sapiens
aacagagggaguuuaa

SEQ ID NO: 1605483 - RNA, 15 nt, Homo sapiens
aacagauuacuagaa

SEQ ID NO: 1605484 - RNA, 20 nt, Homo sapiens
aacagauucaggccagccca

SEQ ID NO: 1605485 - RNA, 14 nt, Homo sapiens
aacagcaccucccc

SEQ ID NO: 1605486 - RNA, 21 nt, Homo sapiens
aacagcaccuccccgcuggga

SEQ ID NO: 1605487 - RNA, 18 nt, Homo sapiens
aacagcaguguucugggu

SEQ ID NO: 1605488 - RNA, 20 nt, Homo sapiens
aacagccacgucagcuuuuc

SEQ ID NO: 1605489 - RNA, 18 nt, Homo sapiens
aacagcccuccucugcac

SEQ ID NO: 1605490 - RNA, 13 nt, Homo sapiens
aacagcuacaaac

SEQ ID NO: 1605491 - RNA, 21 nt, Homo sapiens
aacagcuauuauaucagcuuu

SEQ ID NO: 1605492 - RNA, 20 nt, Homo sapiens
aacaggauuacaguguagcu

SEQ ID NO: 1605493 - RNA, 14 nt, Homo sapiens
aacaggccauugug

SEQ ID NO: 1605494 - RNA, 21 nt, Homo sapiens
aacaggcccccaugugccucu

SEQ ID NO: 1605495 - RNA, 14 nt, Homo sapiens
aacagggacaaaga

SEQ ID NO: 1605496 - RNA, 22 nt, Homo sapiens
aacagggagaaguagcuaguag

SEQ ID NO: 1605497 - RNA, 15 nt, Homo sapiens
aacagggcaacugua

SEQ ID NO: 1605498 - RNA, 16 nt, Homo sapiens
aacagggcacauauuc

SEQ ID NO: 1605499 - RNA, 16 nt, Homo sapiens
aacaguauuacagugu

SEQ ID NO: 1605500 - RNA, 17 nt, Homo sapiens
aacaguauuacaguguc

SEQ ID NO: 1605501 - RNA, 14 nt, Homo sapiens
aacagucucaggaa

SEQ ID NO: 1605502 - RNA, 23 nt, Homo sapiens
aacagugggcguugggagccuag

SEQ ID NO: 1605503 - RNA, 18 nt, Homo sapiens
aacaguuaccugagagau

SEQ ID NO: 1605504 - RNA, 15 nt, Homo sapiens
aacaguuggcacugu

SEQ ID NO: 1605505 - RNA, 17 nt, Homo sapiens
aacaguuggcacuguaa

SEQ ID NO: 1605506 - RNA, 19 nt, Homo sapiens
aacauaacugcuucuugga

SEQ ID NO: 1605507 - RNA, 17 nt, Homo sapiens
aacauacgggaaguuua

SEQ ID NO: 1605508 - RNA, 14 nt, Homo sapiens
aacauacuguucuc

SEQ ID NO: 1605509 - RNA, 20 nt, Homo sapiens
aacaucauuacugccaucuu

SEQ ID NO: 1605510 - RNA, 16 nt, Homo sapiens
aacaucauucuugaga

SEQ ID NO: 1605511 - RNA, 19 nt, Homo sapiens
aacaucuaagccucuaaca

SEQ ID NO: 1605512 - RNA, 20 nt, Homo sapiens
aacaucuugaauacucugcc

SEQ ID NO: 1605513 - RNA, 14 nt, Homo sapiens
aacaugaacucuug

SEQ ID NO: 1605514 - RNA, 20 nt, Homo sapiens
aacaugcgcguggaguucaa

SEQ ID NO: 1605515 - RNA, 23 nt, Homo sapiens
aacauggagcugucaucacucaa

SEQ ID NO: 1605516 - RNA, 16 nt, Homo sapiens
aacauggccagcaaau

SEQ ID NO: 1605517 - RNA, 19 nt, Homo sapiens
aacauguguguacaugugc

SEQ ID NO: 1605518 - RNA, 13 nt, Homo sapiens
aacauuaccaaaa

SEQ ID NO: 1605519 - RNA, 22 nt, Homo sapiens
aacauuauauugcaaugaagga

SEQ ID NO: 1605520 - RNA, 22 nt, Homo sapiens
aacauuauguggcccucuggau

SEQ ID NO: 1605521 - RNA, 14 nt, Homo sapiens
aacauuauucucaa

SEQ ID NO: 1605522 - RNA, 21 nt, Homo sapiens
aacauucugcccucaccucug

SEQ ID NO: 1605523 - RNA, 13 nt, Homo sapiens
aacauugcugauu

SEQ ID NO: 1605524 - RNA, 14 nt, Homo sapiens
aacauuuaaauucc

SEQ ID NO: 1605525 - RNA, 15 nt, Homo sapiens
aacauuuaaauucca

SEQ ID NO: 1605526 - RNA, 20 nt, Homo sapiens
aacauuuccaaaaguggcua

SEQ ID NO: 1605527 - RNA, 19 nt, Homo sapiens
aaccaaagagggcuuccuc

SEQ ID NO: 1605528 - RNA, 19 nt, Homo sapiens
aaccaaagucacaaaucau

SEQ ID NO: 1605529 - RNA, 13 nt, Homo sapiens
aaccaacugcccc

SEQ ID NO: 1605530 - RNA, 20 nt, Homo sapiens
aaccaagacaaaaagccaca

SEQ ID NO: 1605531 - RNA, 21 nt, Homo sapiens
aaccaagagauaacuguaaau

SEQ ID NO: 1605532 - RNA, 16 nt, Homo sapiens
aaccaaggaaagugaa

SEQ ID NO: 1605533 - RNA, 14 nt, Homo sapiens
aaccaccagguguc

SEQ ID NO: 1605534 - RNA, 15 nt, Homo sapiens
aaccaccagguguca

SEQ ID NO: 1605535 - RNA, 15 nt, Homo sapiens
aaccaccauagugaa

SEQ ID NO: 1605536 - RNA, 22 nt, Homo sapiens
aaccacuaugaagcuaccucaa

SEQ ID NO: 1605537 - RNA, 17 nt, Homo sapiens
aaccacuccacuggccu

SEQ ID NO: 1605538 - RNA, 21 nt, Homo sapiens
aaccagaacaguaugaauuug

SEQ ID NO: 1605539 - RNA, 21 nt, Homo sapiens
aaccagacuugaauacaacau

SEQ ID NO: 1605540 - RNA, 15 nt, Homo sapiens
aaccagaucaggaga

SEQ ID NO: 1605541 - RNA, 18 nt, Homo sapiens
aaccagaucugucuccaa

SEQ ID NO: 1605542 - RNA, 20 nt, Homo sapiens
aaccaggaaggaaaauguga

SEQ ID NO: 1605543 - RNA, 17 nt, Homo sapiens
aaccaggacccugucca

SEQ ID NO: 1605544 - RNA, 21 nt, Homo sapiens
acgcguauuuacagccagugg

SEQ ID NO: 1605545 - RNA, 14 nt, Homo sapiens
acgcuacugaguca

SEQ ID NO: 1605546 - RNA, 21 nt, Homo sapiens
acgcugcagaccccagguuca

SEQ ID NO: 1605547 - RNA, 23 nt, Homo sapiens
acgcuuguuugccugaaaguaau

SEQ ID NO: 1605548 - RNA, 16 nt, Homo sapiens
acggacugucaguucu

SEQ ID NO: 1605549 - RNA, 22 nt, Homo sapiens
acggagccacuccucugacuca

SEQ ID NO: 1605550 - RNA, 13 nt, Homo sapiens
acggcaccucggg

SEQ ID NO: 1605551 - RNA, 21 nt, Homo sapiens
acggcucaagugaauuugaau

SEQ ID NO: 1605552 - RNA, 19 nt, Homo sapiens
acggcucacugcagccuca

SEQ ID NO: 1605553 - RNA, 18 nt, Homo sapiens
acggcuccaucaccagcc

SEQ ID NO: 1605554 - RNA, 23 nt, Homo sapiens
acggcuggugugucauacugugc

SEQ ID NO: 1605555 - RNA, 17 nt, Homo sapiens
acggcuucucacgcuuu

SEQ ID NO: 1605556 - RNA, 15 nt, Homo sapiens
acggggcucuucuca

SEQ ID NO: 1605557 - RNA, 15 nt, Homo sapiens
acggggcuuacagga

SEQ ID NO: 1605558 - RNA, 19 nt, Homo sapiens
acgggguuggcuguuccag

SEQ ID NO: 1605559 - RNA, 17 nt, Homo sapiens
acggugcccauccugcc

SEQ ID NO: 1605560 - RNA, 15 nt, Homo sapiens
acgguguccaugccu

SEQ ID NO: 1605561 - RNA, 21 nt, Homo sapiens
acgguuaagaaagcacuuaaa

SEQ ID NO: 1605562 - RNA, 17 nt, Homo sapiens
acguacuuaauuuacuu

SEQ ID NO: 1605563 - RNA, 23 nt, Homo sapiens
acguauuugaauggccuucauau

SEQ ID NO: 1605564 - RNA, 16 nt, Homo sapiens
acgucauuugugcaag

SEQ ID NO: 1605565 - RNA, 15 nt, Homo sapiens
acgugaaacagagug

SEQ ID NO: 1605566 - RNA, 15 nt, Homo sapiens
acgugaaaugcucaa

SEQ ID NO: 1605567 - RNA, 20 nt, Homo sapiens
acgugauccucucaccucag

SEQ ID NO: 1605568 - RNA, 19 nt, Homo sapiens
acgugcauccuuguaauac

SEQ ID NO: 1605569 - RNA, 17 nt, Homo sapiens
acgugccaccaugacug

SEQ ID NO: 1605570 - RNA, 14 nt, Homo sapiens
acgugguagucacu

SEQ ID NO: 1605571 - RNA, 21 nt, Homo sapiens
acguguggaugagcgugcacu

SEQ ID NO: 1605572 - RNA, 17 nt, Homo sapiens
acguucauccacucugc

SEQ ID NO: 1605573 - RNA, 18 nt, Homo sapiens
acguuccugaacauauua

SEQ ID NO: 1605574 - RNA, 21 nt, Homo sapiens
acguugcccaagguugcacag

SEQ ID NO: 1605575 - RNA, 23 nt, Homo sapiens
acguuguuuugguuguacuuugg

SEQ ID NO: 1605576 - RNA, 15 nt, Homo sapiens
acuaaacaaggcauu

SEQ ID NO: 1605577 - RNA, 17 nt, Homo sapiens
acuaaacuucaccuaca

SEQ ID NO: 1605578 - RNA, 20 nt, Homo sapiens
acuaaaguaugguacaucua

SEQ ID NO: 1605579 - RNA, 12 nt, Homo sapiens
acuaaaguuaac

SEQ ID NO: 1605580 - RNA, 18 nt, Homo sapiens
acuaaauugacacuuaaa

SEQ ID NO: 1605581 - RNA, 18 nt, Homo sapiens
acuaaccaaacaaugcag

SEQ ID NO: 1605582 - RNA, 18 nt, Homo sapiens
acuaaccauccccaacuc

SEQ ID NO: 1605583 - RNA, 16 nt, Homo sapiens
acuaacuagacuaaga

SEQ ID NO: 1605584 - RNA, 21 nt, Homo sapiens
acuaagaaaaaaagcacaaag

SEQ ID NO: 1605585 - RNA, 23 nt, Homo sapiens
acuaaggaaccaacaaucuuccu

SEQ ID NO: 1605586 - RNA, 15 nt, Homo sapiens
acuaaggagcaugau

SEQ ID NO: 1605587 - RNA, 20 nt, Homo sapiens
acuacacuccagccugggca

SEQ ID NO: 1605588 - RNA, 22 nt, Homo sapiens
acuacagaauauuaaauauuau

SEQ ID NO: 1605589 - RNA, 22 nt, Homo sapiens
acuacagcaugacguaguauua

SEQ ID NO: 1605590 - RNA, 18 nt, Homo sapiens
acuacaggagaugcuguc

SEQ ID NO: 1605591 - RNA, 22 nt, Homo sapiens
acuacauuaccuguucuugccu

SEQ ID NO: 1605592 - RNA, 13 nt, Homo sapiens
acuacauuccaaa

SEQ ID NO: 1605593 - RNA, 15 nt, Homo sapiens
acuacauuccaaaga

SEQ ID NO: 1605594 - RNA, 18 nt, Homo sapiens
acuaccauucuauuccau

SEQ ID NO: 1605595 - RNA, 21 nt, Homo sapiens
acuacguagcuaguaagcauu

SEQ ID NO: 1605596 - RNA, 21 nt, Homo sapiens
acuacuccucugcagugccuu

SEQ ID NO: 1605597 - RNA, 15 nt, Homo sapiens
acuacuccugaggau

SEQ ID NO: 1605598 - RNA, 19 nt, Homo sapiens
acuacucucuacucuguua

SEQ ID NO: 1605599 - RNA, 16 nt, Homo sapiens
acuagaagggccaguc

SEQ ID NO: 1605600 - RNA, 13 nt, Homo sapiens
acuagcauccacu

SEQ ID NO: 1605601 - RNA, 10 nt, Homo sapiens
acuagcauua

SEQ ID NO: 1605602 - RNA, 14 nt, Homo sapiens
acuagcuuacugag

SEQ ID NO: 1605603 - RNA, 20 nt, Homo sapiens
acuaggccauuagcccuuca

SEQ ID NO: 1605604 - RNA, 11 nt, Homo sapiens
acuagggccaa

SEQ ID NO: 1605605 - RNA, 13 nt, Homo sapiens
acuaggguguaaa

SEQ ID NO: 1605606 - RNA, 13 nt, Homo sapiens
acuaguacuauua

SEQ ID NO: 1605607 - RNA, 16 nt, Homo sapiens
acuagugcaauuccaa

SEQ ID NO: 1605608 - RNA, 15 nt, Homo sapiens
acuauagguccagaa

SEQ ID NO: 1605609 - RNA, 15 nt, Homo sapiens
acuaucucaugccag

SEQ ID NO: 1605610 - RNA, 23 nt, Homo sapiens
acuaugagccaggcaucauacua

SEQ ID NO: 1605611 - RNA, 20 nt, Homo sapiens
acuauggagucuugugaaag

SEQ ID NO: 1605612 - RNA, 15 nt, Homo sapiens
acuauguaacaugua

SEQ ID NO: 1605613 - RNA, 17 nt, Homo sapiens
acuaugucugaacauag

SEQ ID NO: 1605614 - RNA, 17 nt, Homo sapiens
acuauguguucaaugaa

SEQ ID NO: 1605615 - RNA, 22 nt, Homo sapiens
acuauguuccaauaaaacuuua

SEQ ID NO: 1605616 - RNA, 16 nt, Homo sapiens
acuauuaacucugcau

SEQ ID NO: 1605617 - RNA, 16 nt, Homo sapiens
acuauuaauacucugc

SEQ ID NO: 1605618 - RNA, 12 nt, Homo sapiens
acuauuacuggg

SEQ ID NO: 1605619 - RNA, 18 nt, Homo sapiens
acuauucauggcuaccuc

SEQ ID NO: 1605620 - RNA, 20 nt, Homo sapiens
acuauuccuuacaacuggag

SEQ ID NO: 1605621 - RNA, 16 nt, Homo sapiens
acuauucuagcaggag

SEQ ID NO: 1605622 - RNA, 17 nt, Homo sapiens
acuauuuuaaauaucca

SEQ ID NO: 1605623 - RNA, 15 nt, Homo sapiens
acuauuuuaccugaa

SEQ ID NO: 1605624 - RNA, 15 nt, Homo sapiens
acuauuuugugcucc

SEQ ID NO: 1605625 - RNA, 13 nt, Homo sapiens
acucaaacuugag

SEQ ID NO: 1605626 - RNA, 13 nt, Homo sapiens
acucaaggacagc

SEQ ID NO: 1605627 - RNA, 13 nt, Homo sapiens
acucacaccugua

SEQ ID NO: 1605628 - RNA, 21 nt, Homo sapiens
acucacagccguccaacuuaa

SEQ ID NO: 1605629 - RNA, 20 nt, Homo sapiens
acucacauacacacacaccu

SEQ ID NO: 1605630 - RNA, 21 nt, Homo sapiens
acucaccacuaccagccagcc

SEQ ID NO: 1605631 - RNA, 12 nt, Homo sapiens
acucacccaagc

SEQ ID NO: 1605632 - RNA, 21 nt, Homo sapiens
acucagaaagccaacaugugg

SEQ ID NO: 1605633 - RNA, 23 nt, Homo sapiens
acucagcaacuguuagcugggaa

SEQ ID NO: 1605634 - RNA, 16 nt, Homo sapiens
acucagcagcagagag

SEQ ID NO: 1605635 - RNA, 12 nt, Homo sapiens
acucagcaucac

SEQ ID NO: 1605636 - RNA, 23 nt, Homo sapiens
acucagcauggucuuaugcacag

SEQ ID NO: 1605637 - RNA, 18 nt, Homo sapiens
acucagccacugucacag

SEQ ID NO: 1605638 - RNA, 17 nt, Homo sapiens
acucaggaggcugagac

SEQ ID NO: 1605639 - RNA, 13 nt, Homo sapiens
acucagggcuccu

SEQ ID NO: 1605640 - RNA, 16 nt, Homo sapiens
acucaggggucauuca

SEQ ID NO: 1605641 - RNA, 18 nt, Homo sapiens
acucagucucucuucucu

SEQ ID NO: 1605642 - RNA, 18 nt, Homo sapiens
acucagucuuuaaucuga

SEQ ID NO: 1605643 - RNA, 15 nt, Homo sapiens
acucaugaucaagau

SEQ ID NO: 1605644 - RNA, 18 nt, Homo sapiens
acucaugguguguuacac

SEQ ID NO: 1605645 - RNA, 16 nt, Homo sapiens
acucauuaaugaauca

SEQ ID NO: 1605646 - RNA, 19 nt, Homo sapiens
acucauuaaugaaucacau

SEQ ID NO: 1605647 - RNA, 16 nt, Homo sapiens
acucauuucaucucau

SEQ ID NO: 1605648 - RNA, 17 nt, Homo sapiens
acucauuuuuguuuuca

SEQ ID NO: 1605649 - RNA, 23 nt, Homo sapiens
acucauuuuuguuuucauuaucu

SEQ ID NO: 1605650 - RNA, 22 nt, Homo sapiens
acuccaaagaaauguaagggaa

SEQ ID NO: 1605651 - RNA, 13 nt, Homo sapiens
acuccaagcugca

SEQ ID NO: 1605652 - RNA, 21 nt, Homo sapiens
acuccaauuacuccaccauca

SEQ ID NO: 1605653 - RNA, 19 nt, Homo sapiens
acuccacccuccuacaggu

SEQ ID NO: 1605654 - RNA, 19 nt, Homo sapiens
acuccaccucuaccaaaaa

SEQ ID NO: 1605655 - RNA, 20 nt, Homo sapiens
acuccagccugagugacaga

SEQ ID NO: 1605656 - RNA, 21 nt, Homo sapiens
acuccaggaacaaaaagguaa

SEQ ID NO: 1605657 - RNA, 15 nt, Homo sapiens
acuccauccuccugu

SEQ ID NO: 1605658 - RNA, 14 nt, Homo sapiens
acucccaugaagcc

SEQ ID NO: 1605659 - RNA, 16 nt, Homo sapiens
acucccccucuuucac

SEQ ID NO: 1605660 - RNA, 14 nt, Homo sapiens
acucccgaccucag

SEQ ID NO: 1605661 - RNA, 21 nt, Homo sapiens
acucccuagucuccaccugag

SEQ ID NO: 1605662 - RNA, 14 nt, Homo sapiens
agaaagaagccaua

SEQ ID NO: 1605663 - RNA, 19 nt, Homo sapiens
agaaagaaguuauuuucca

SEQ ID NO: 1605664 - RNA, 15 nt, Homo sapiens
agaaagaccaggcca

SEQ ID NO: 1605665 - RNA, 19 nt, Homo sapiens
agaaagagacuccgucuca

SEQ ID NO: 1605666 - RNA, 11 nt, Homo sapiens
agaaagagccu

SEQ ID NO: 1605667 - RNA, 13 nt, Homo sapiens
agaaagagccuga

SEQ ID NO: 1605668 - RNA, 15 nt, Homo sapiens
agaaagaucaaagac

SEQ ID NO: 1605669 - RNA, 14 nt, Homo sapiens
agaaagaugacaaa

SEQ ID NO: 1605670 - RNA, 21 nt, Homo sapiens
agaaagcacuuaaacagaagc

SEQ ID NO: 1605671 - RNA, 21 nt, Homo sapiens
agaaaggccaaggugcuggac

SEQ ID NO: 1605672 - RNA, 20 nt, Homo sapiens
agaaagucuaucuaaugaca

SEQ ID NO: 1605673 - RNA, 21 nt, Homo sapiens
agaaagucuaucuaaugacau

SEQ ID NO: 1605674 - RNA, 17 nt, Homo sapiens
agaaauaaaauaucucc

SEQ ID NO: 1605675 - RNA, 15 nt, Homo sapiens
agaaauaaagaucuc

SEQ ID NO: 1605676 - RNA, 14 nt, Homo sapiens
agaaauaaagggac

SEQ ID NO: 1605677 - RNA, 13 nt, Homo sapiens
agaaauaaggcua

SEQ ID NO: 1605678 - RNA, 14 nt, Homo sapiens
agaaauauuuaacu

SEQ ID NO: 1605679 - RNA, 15 nt, Homo sapiens
agaaaucaaacugcu

SEQ ID NO: 1605680 - RNA, 21 nt, Homo sapiens
agaaaucacaauuuuccugug

SEQ ID NO: 1605681 - RNA, 14 nt, Homo sapiens
agaaaucagccaug

SEQ ID NO: 1605682 - RNA, 16 nt, Homo sapiens
agaaaucuaagcugug

SEQ ID NO: 1605683 - RNA, 20 nt, Homo sapiens
agaaauggacuggagcucau

SEQ ID NO: 1605684 - RNA, 16 nt, Homo sapiens
agaaauguaguuugca

SEQ ID NO: 1605685 - RNA, 23 nt, Homo sapiens
agaaauuaguuucaaauuuaccu

SEQ ID NO: 1605686 - RNA, 16 nt, Homo sapiens
agaaauucagcauuug

SEQ ID NO: 1605687 - RNA, 15 nt, Homo sapiens
agaaauuuggcuaua

SEQ ID NO: 1605688 - RNA, 18 nt, Homo sapiens
agaacaccuccagcuuuu

SEQ ID NO: 1605689 - RNA, 15 nt, Homo sapiens
agaacagaucaggaa

SEQ ID NO: 1605690 - RNA, 14 nt, Homo sapiens
agaacauugaucug

SEQ ID NO: 1605691 - RNA, 23 nt, Homo sapiens
agaaccacauauuuuagacacuu

SEQ ID NO: 1605692 - RNA, 14 nt, Homo sapiens
agaaccacugaguc

SEQ ID NO: 1605693 - RNA, 13 nt, Homo sapiens
agaaccacugucu

SEQ ID NO: 1605694 - RNA, 16 nt, Homo sapiens
agaaccagggcucuuc

SEQ ID NO: 1605695 - RNA, 14 nt, Homo sapiens
agaaccauuuacuu

SEQ ID NO: 1605696 - RNA, 15 nt, Homo sapiens
agaaccauuuacuua

SEQ ID NO: 1605697 - RNA, 18 nt, Homo sapiens
agaacccaccaaccagaa

SEQ ID NO: 1605698 - RNA, 16 nt, Homo sapiens
agaaccuaaugcacuc

SEQ ID NO: 1605699 - RNA, 22 nt, Homo sapiens
agaaccucagaggccacuugcu

SEQ ID NO: 1605700 - RNA, 19 nt, Homo sapiens
agaaccucagauucuucau

SEQ ID NO: 1605701 - RNA, 23 nt, Homo sapiens
agaaccuggagagcuagaaccua

SEQ ID NO: 1605702 - RNA, 23 nt, Homo sapiens
agaaccuggcagguuagaaccua

SEQ ID NO: 1605703 - RNA, 22 nt, Homo sapiens
agaaccuuaaugacaacacuua

SEQ ID NO: 1605704 - RNA, 14 nt, Homo sapiens
agaaccuucaaccc

SEQ ID NO: 1605705 - RNA, 19 nt, Homo sapiens
agaacguuuuuuccucagu

SEQ ID NO: 1605706 - RNA, 23 nt, Homo sapiens
agaacguuuuuuccucagugcau

SEQ ID NO: 1605707 - RNA, 22 nt, Homo sapiens
agaacuaaaaauuaaaaccucu

SEQ ID NO: 1605708 - RNA, 15 nt, Homo sapiens
agaacuaagcacuuu

SEQ ID NO: 1605709 - RNA, 15 nt, Homo sapiens
agaacucauucauag

SEQ ID NO: 1605710 - RNA, 15 nt, Homo sapiens
agaacugaaggcaua

SEQ ID NO: 1605711 - RNA, 19 nt, Homo sapiens
agaacugaaggcauaugca

SEQ ID NO: 1605712 - RNA, 20 nt, Homo sapiens
agaacuugcaauaccaaugu

SEQ ID NO: 1605713 - RNA, 18 nt, Homo sapiens
agaagaaaucaugauaua

SEQ ID NO: 1605714 - RNA, 21 nt, Homo sapiens
agaagaaguuugaccaucacc

SEQ ID NO: 1605715 - RNA, 14 nt, Homo sapiens
agaagagcuguuca

SEQ ID NO: 1605716 - RNA, 23 nt, Homo sapiens
agaagaggggucaagaguuaaac

SEQ ID NO: 1605717 - RNA, 22 nt, Homo sapiens
agaagauggcacuuauaaccaa

SEQ ID NO: 1605718 - RNA, 19 nt, Homo sapiens
agaagcaaugggucacuca

SEQ ID NO: 1605719 - RNA, 18 nt, Homo sapiens
agaagcacugggugacca

SEQ ID NO: 1605720 - RNA, 14 nt, Homo sapiens
agaagcccauauca

SEQ ID NO: 1605721 - RNA, 15 nt, Homo sapiens
agaagccccgucucu

SEQ ID NO: 1605722 - RNA, 22 nt, Homo sapiens
agaagcccugauguguccucag

SEQ ID NO: 1605723 - RNA, 21 nt, Homo sapiens
agaagcugcagugguauuaau

SEQ ID NO: 1605724 - RNA, 18 nt, Homo sapiens
agaaggcagccaccagcg

SEQ ID NO: 1605725 - RNA, 18 nt, Homo sapiens
agaagggcaaauauuuau

SEQ ID NO: 1605726 - RNA, 14 nt, Homo sapiens
agaagguaaggugu

SEQ ID NO: 1605727 - RNA, 19 nt, Homo sapiens
agaaggucauaagggagca

SEQ ID NO: 1605728 - RNA, 20 nt, Homo sapiens
agaaggucauaagggagcau

SEQ ID NO: 1605729 - RNA, 23 nt, Homo sapiens
agaagguugagggcaauggacaa

SEQ ID NO: 1605730 - RNA, 12 nt, Homo sapiens
agaaguacuuua

SEQ ID NO: 1605731 - RNA, 18 nt, Homo sapiens
agaaguacuuuauugcaa

SEQ ID NO: 1605732 - RNA, 16 nt, Homo sapiens
agaagucggaauguca

SEQ ID NO: 1605733 - RNA, 20 nt, Homo sapiens
agaagugcagcugcugugcc

SEQ ID NO: 1605734 - RNA, 21 nt, Homo sapiens
agaaguggcugccaaagagac

SEQ ID NO: 1605735 - RNA, 13 nt, Homo sapiens
agaaguuaauucu

SEQ ID NO: 1605736 - RNA, 21 nt, Homo sapiens
agaaguugcugcuugugaucu

SEQ ID NO: 1605737 - RNA, 21 nt, Homo sapiens
agaauaaagccacuguaugau

SEQ ID NO: 1605738 - RNA, 23 nt, Homo sapiens
agaauaaaugguuucucauuaaa

SEQ ID NO: 1605739 - RNA, 15 nt, Homo sapiens
agaauaaauucccaa

SEQ ID NO: 1605740 - RNA, 20 nt, Homo sapiens
agaauaaggcuuuuucuucc

SEQ ID NO: 1605741 - RNA, 23 nt, Homo sapiens
agaauaaggcuuuuucuucccuu

SEQ ID NO: 1605742 - RNA, 19 nt, Homo sapiens
agaauaauccuguuuuaca

SEQ ID NO: 1605743 - RNA, 22 nt, Homo sapiens
agaauagaaacguaaacuauga

SEQ ID NO: 1605744 - RNA, 13 nt, Homo sapiens
agaauauaccuua

SEQ ID NO: 1605745 - RNA, 17 nt, Homo sapiens
agaauauguugcuuuga

SEQ ID NO: 1605746 - RNA, 14 nt, Homo sapiens
agaauauuauuagu

SEQ ID NO: 1605747 - RNA, 20 nt, Homo sapiens
agaauauuauuagucugcau

SEQ ID NO: 1605748 - RNA, 13 nt, Homo sapiens
agaaucacuugaa

SEQ ID NO: 1605749 - RNA, 20 nt, Homo sapiens
agaaucauacuuaacauuuc

SEQ ID NO: 1605750 - RNA, 14 nt, Homo sapiens
agaaucuacuaagu

SEQ ID NO: 1605751 - RNA, 12 nt, Homo sapiens
agaaucuagagc

SEQ ID NO: 1605752 - RNA, 20 nt, Homo sapiens
agaaugagcacccauuccaa

SEQ ID NO: 1605753 - RNA, 15 nt, Homo sapiens
agaaugccaggaaua

SEQ ID NO: 1605754 - RNA, 11 nt, Homo sapiens
agaauggagcu

SEQ ID NO: 1605755 - RNA, 21 nt, Homo sapiens
agaauggugcucuuaucuuuc

SEQ ID NO: 1605756 - RNA, 13 nt, Homo sapiens
agaauggugcugu

SEQ ID NO: 1605757 - RNA, 13 nt, Homo sapiens
agaauguuuucaa

SEQ ID NO: 1605758 - RNA, 18 nt, Homo sapiens
agaauuaaaaaagcauac

SEQ ID NO: 1605759 - RNA, 13 nt, Homo sapiens
agaauuacagacu

SEQ ID NO: 1605760 - RNA, 23 nt, Homo sapiens
agaauuauauuagucuguuugca

SEQ ID NO: 1605761 - RNA, 17 nt, Homo sapiens
agaauucagacaucuga

SEQ ID NO: 1605762 - RNA, 16 nt, Homo sapiens
agaauugguugccaua

SEQ ID NO: 1605763 - RNA, 19 nt, Homo sapiens
agaauuuaagacuugugcu

SEQ ID NO: 1605764 - RNA, 20 nt, Homo sapiens
agacaaaacgagucuuucau

SEQ ID NO: 1605765 - RNA, 12 nt, Homo sapiens
agacaaaaugga

SEQ ID NO: 1605766 - RNA, 22 nt, Homo sapiens
agacaagagaucuacacauguu

SEQ ID NO: 1605767 - RNA, 22 nt, Homo sapiens
agacaaggaggaguuccaccau

SEQ ID NO: 1605768 - RNA, 14 nt, Homo sapiens
agacaauaaacccu

SEQ ID NO: 1605769 - RNA, 20 nt, Homo sapiens
agacaaugaaacaacagaga

SEQ ID NO: 1605770 - RNA, 13 nt, Homo sapiens
agacacaggugua

SEQ ID NO: 1605771 - RNA, 17 nt, Homo sapiens
agacaccaugugcaaua

SEQ ID NO: 1605772 - RNA, 17 nt, Homo sapiens
agacaccauucauucca

SEQ ID NO: 1605773 - RNA, 18 nt, Homo sapiens
agacaccuccuucuuccu

SEQ ID NO: 1605774 - RNA, 18 nt, Homo sapiens
agacacucacagcaagga

SEQ ID NO: 1605775 - RNA, 15 nt, Homo sapiens
agacacugaucuggc

SEQ ID NO: 1605776 - RNA, 19 nt, Homo sapiens
agacacuggcguuacugcu

SEQ ID NO: 1605777 - RNA, 19 nt, Homo sapiens
agacacuucccugcauuaa

SEQ ID NO: 1605778 - RNA, 14 nt, Homo sapiens
agacagaagcuuaa

SEQ ID NO: 1605779 - RNA, 18 nt, Homo sapiens
agacagagccuuguucua

SEQ ID NO: 1605780 - RNA, 19 nt, Homo sapiens
agccaggccaacagcaccu

SEQ ID NO: 1605781 - RNA, 23 nt, Homo sapiens
agccaggcuuuucucaggagcuu

SEQ ID NO: 1605782 - RNA, 16 nt, Homo sapiens
agccagguaaugugaa

SEQ ID NO: 1605783 - RNA, 14 nt, Homo sapiens
agccagguggcacc

SEQ ID NO: 1605784 - RNA, 21 nt, Homo sapiens
agccagucuuugaacugcagc

SEQ ID NO: 1605785 - RNA, 14 nt, Homo sapiens
agccagugggagau

SEQ ID NO: 1605786 - RNA, 23 nt, Homo sapiens
agccauaagaaagcacuauuaau

SEQ ID NO: 1605787 - RNA, 17 nt, Homo sapiens
agccauaugaaugucag

SEQ ID NO: 1605788 - RNA, 19 nt, Homo sapiens
agccauauuugauaguaua

SEQ ID NO: 1605789 - RNA, 13 nt, Homo sapiens
agccaugcuuuau

SEQ ID NO: 1605790 - RNA, 12 nt, Homo sapiens
agccauuccaaa

SEQ ID NO: 1605791 - RNA, 13 nt, Homo sapiens
agccauuucccau

SEQ ID NO: 1605792 - RNA, 15 nt, Homo sapiens
agcccaacagcacuu

SEQ ID NO: 1605793 - RNA, 16 nt, Homo sapiens
agcccaccagacguca

SEQ ID NO: 1605794 - RNA, 14 nt, Homo sapiens
agcccagagccacc

SEQ ID NO: 1605795 - RNA, 21 nt, Homo sapiens
agcccaggagccucacugggg

SEQ ID NO: 1605796 - RNA, 16 nt, Homo sapiens
agcccagugcugccac

SEQ ID NO: 1605797 - RNA, 19 nt, Homo sapiens
agcccauccugaccagcug

SEQ ID NO: 1605798 - RNA, 15 nt, Homo sapiens
agcccauggcacucu

SEQ ID NO: 1605799 - RNA, 24 nt, Homo sapiens
agcccauggcccccaauaaaggca

SEQ ID NO: 1605800 - RNA, 22 nt, Homo sapiens
agcccauuuguguacacaguca

SEQ ID NO: 1605801 - RNA, 17 nt, Homo sapiens
agccccagccuaggaaa

SEQ ID NO: 1605802 - RNA, 21 nt, Homo sapiens
agcccccauuguggucacagg

SEQ ID NO: 1605803 - RNA, 16 nt, Homo sapiens
agcccccgccccagag

SEQ ID NO: 1605804 - RNA, 13 nt, Homo sapiens
agccccgacucca

SEQ ID NO: 1605805 - RNA, 18 nt, Homo sapiens
agccccucaauccuauca

SEQ ID NO: 1605806 - RNA, 17 nt, Homo sapiens
agccccuccucccucag

SEQ ID NO: 1605807 - RNA, 19 nt, Homo sapiens
agcccgccugccgugcaug

SEQ ID NO: 1605808 - RNA, 16 nt, Homo sapiens
agcccggagaggaccc

SEQ ID NO: 1605809 - RNA, 23 nt, Homo sapiens
agcccgggucaucuguaccucug

SEQ ID NO: 1605810 - RNA, 18 nt, Homo sapiens
agcccuaaagaaugcaac

SEQ ID NO: 1605811 - RNA, 13 nt, Homo sapiens
agcccucacauua

SEQ ID NO: 1605812 - RNA, 14 nt, Homo sapiens
agcccuuccuccca

SEQ ID NO: 1605813 - RNA, 16 nt, Homo sapiens
agcccuucuauaccca

SEQ ID NO: 1605814 - RNA, 21 nt, Homo sapiens
agcccuucuauacccacccag

SEQ ID NO: 1605815 - RNA, 17 nt, Homo sapiens
agccgauggggagggga

SEQ ID NO: 1605816 - RNA, 23 nt, Homo sapiens
agccuaaaguacagccuggacca

SEQ ID NO: 1605817 - RNA, 16 nt, Homo sapiens
agccuaaauuucccaa

SEQ ID NO: 1605818 - RNA, 21 nt, Homo sapiens
agccuaagaaacacucauggg

SEQ ID NO: 1605819 - RNA, 19 nt, Homo sapiens
agccuacacuauucuagca

SEQ ID NO: 1605820 - RNA, 22 nt, Homo sapiens
agccuaggaaagccaguuacau

SEQ ID NO: 1605821 - RNA, 21 nt, Homo sapiens
agccuauguaugccauggagg

SEQ ID NO: 1605822 - RNA, 23 nt, Homo sapiens
agccuauguaugccauggaggca

SEQ ID NO: 1605823 - RNA, 13 nt, Homo sapiens
agccucacugggg

SEQ ID NO: 1605824 - RNA, 17 nt, Homo sapiens
agccucagaugauuucc

SEQ ID NO: 1605825 - RNA, 18 nt, Homo sapiens
agccuccccgugccaaaa

SEQ ID NO: 1605826 - RNA, 15 nt, Homo sapiens
agccuccgccugcug

SEQ ID NO: 1605827 - RNA, 20 nt, Homo sapiens
agccucugccgcugccaugc

SEQ ID NO: 1605828 - RNA, 22 nt, Homo sapiens
agccucugccgcugccaugcuu

SEQ ID NO: 1605829 - RNA, 18 nt, Homo sapiens
agccucuguccgccuuua

SEQ ID NO: 1605830 - RNA, 22 nt, Homo sapiens
agccucuugacgcuggaagugu

SEQ ID NO: 1605831 - RNA, 17 nt, Homo sapiens
agccugagcagagacau

SEQ ID NO: 1605832 - RNA, 13 nt, Homo sapiens
agccugcacuggg

SEQ ID NO: 1605833 - RNA, 22 nt, Homo sapiens
agccugcacuuugaugucaugu

SEQ ID NO: 1605834 - RNA, 14 nt, Homo sapiens
agccugcuggucac

SEQ ID NO: 1605835 - RNA, 16 nt, Homo sapiens
agccuggaugccaucc

SEQ ID NO: 1605836 - RNA, 18 nt, Homo sapiens
agccuggccaccagccau

SEQ ID NO: 1605837 - RNA, 20 nt, Homo sapiens
agccugggcaacaagagcaa

SEQ ID NO: 1605838 - RNA, 23 nt, Homo sapiens
agccugggcaacauaccaagacc

SEQ ID NO: 1605839 - RNA, 16 nt, Homo sapiens
agccugugaaguccua

SEQ ID NO: 1605840 - RNA, 23 nt, Homo sapiens
agccuguggcaucuuugccuugg

SEQ ID NO: 1605841 - RNA, 18 nt, Homo sapiens
agccuuaguugagauuuc

SEQ ID NO: 1605842 - RNA, 19 nt, Homo sapiens
agccuuauuuaugauguau

SEQ ID NO: 1605843 - RNA, 16 nt, Homo sapiens
agccuucaagugccaa

SEQ ID NO: 1605844 - RNA, 16 nt, Homo sapiens
agccuucacacagaua

SEQ ID NO: 1605845 - RNA, 23 nt, Homo sapiens
agccuucacacagauagaccuuu

SEQ ID NO: 1605846 - RNA, 22 nt, Homo sapiens
agccuuccugaguuucucucuc

SEQ ID NO: 1605847 - RNA, 16 nt, Homo sapiens
agccuucggacagaca

SEQ ID NO: 1605848 - RNA, 13 nt, Homo sapiens
agcgagacccugu

SEQ ID NO: 1605849 - RNA, 19 nt, Homo sapiens
agcgaggaggcuccagagg

SEQ ID NO: 1605850 - RNA, 18 nt, Homo sapiens
agcgcucgauggaccuca

SEQ ID NO: 1605851 - RNA, 16 nt, Homo sapiens
agcgucaagacauuug

SEQ ID NO: 1605852 - RNA, 18 nt, Homo sapiens
agcuaaacggauuccaaa

SEQ ID NO: 1605853 - RNA, 13 nt, Homo sapiens
agcuaaacugaau

SEQ ID NO: 1605854 - RNA, 22 nt, Homo sapiens
agcuaaagcaguguuugcucca

SEQ ID NO: 1605855 - RNA, 15 nt, Homo sapiens
agcuaaccacuucgc

SEQ ID NO: 1605856 - RNA, 23 nt, Homo sapiens
agcuaaccugcacguugugcaca

SEQ ID NO: 1605857 - RNA, 17 nt, Homo sapiens
agcuaaccuuauccugc

SEQ ID NO: 1605858 - RNA, 18 nt, Homo sapiens
agcuaagaaauaaggcua

SEQ ID NO: 1605859 - RNA, 16 nt, Homo sapiens
agcuaagacauauuca

SEQ ID NO: 1605860 - RNA, 13 nt, Homo sapiens
agcuaaguacaca

SEQ ID NO: 1605861 - RNA, 23 nt, Homo sapiens
agcuaaugucacaacauggugcu

SEQ ID NO: 1605862 - RNA, 21 nt, Homo sapiens
agcuacaauuuguuuuugcau

SEQ ID NO: 1605863 - RNA, 13 nt, Homo sapiens
agcuacccugaaa

SEQ ID NO: 1605864 - RNA, 23 nt, Homo sapiens
agcuacguauuuaauagcaaaga

SEQ ID NO: 1605865 - RNA, 23 nt, Homo sapiens
agcuacugugugugugaaugaac

SEQ ID NO: 1605866 - RNA, 14 nt, Homo sapiens
agcuagaaccugga

SEQ ID NO: 1605867 - RNA, 17 nt, Homo sapiens
agcuagaauaccaccua

SEQ ID NO: 1605868 - RNA, 15 nt, Homo sapiens
agcuaggugcuauuu

SEQ ID NO: 1605869 - RNA, 17 nt, Homo sapiens
agcuaggugcuauuugu

SEQ ID NO: 1605870 - RNA, 22 nt, Homo sapiens
agcuagucuaucagcaucugac

SEQ ID NO: 1605871 - RNA, 18 nt, Homo sapiens
agcuauacuuacacugua

SEQ ID NO: 1605872 - RNA, 22 nt, Homo sapiens
agcuauguugacaugaggcagu

SEQ ID NO: 1605873 - RNA, 17 nt, Homo sapiens
agcucacugcagccuca

SEQ ID NO: 1605874 - RNA, 18 nt, Homo sapiens
agcucagcauuuccacac

SEQ ID NO: 1605875 - RNA, 20 nt, Homo sapiens
agcucagcauuuccacacca

SEQ ID NO: 1605876 - RNA, 19 nt, Homo sapiens
agcucagggcccaucccuu

SEQ ID NO: 1605877 - RNA, 20 nt, Homo sapiens
agcucaggugacaaccauua

SEQ ID NO: 1605878 - RNA, 11 nt, Homo sapiens
agcucaugccc

SEQ ID NO: 1605879 - RNA, 20 nt, Homo sapiens
agcuccucaaagccucaaaa

SEQ ID NO: 1605880 - RNA, 15 nt, Homo sapiens
agcuccuguguuaca

SEQ ID NO: 1605881 - RNA, 12 nt, Homo sapiens
agcuccuuccac

SEQ ID NO: 1605882 - RNA, 20 nt, Homo sapiens
agcucgggcccucugugaga

SEQ ID NO: 1605883 - RNA, 15 nt, Homo sapiens
agcucuaaagaccau

SEQ ID NO: 1605884 - RNA, 13 nt, Homo sapiens
agcucuacucugg

SEQ ID NO: 1605885 - RNA, 18 nt, Homo sapiens
agcucucugauuccccaa

SEQ ID NO: 1605886 - RNA, 20 nt, Homo sapiens
agcucugaaaccaguguuag

SEQ ID NO: 1605887 - RNA, 23 nt, Homo sapiens
agcucugaaaccaguguuaggga

SEQ ID NO: 1605888 - RNA, 23 nt, Homo sapiens
agcucuggggcagaggaagccca

SEQ ID NO: 1605889 - RNA, 21 nt, Homo sapiens
agcucuguauggucaggaugu

SEQ ID NO: 1605890 - RNA, 17 nt, Homo sapiens
agcucuucaacaugaca

SEQ ID NO: 1605891 - RNA, 17 nt, Homo sapiens
agcucuucaggccuccc

SEQ ID NO: 1605892 - RNA, 21 nt, Homo sapiens
agcucuucaggccucccucuc

SEQ ID NO: 1605893 - RNA, 13 nt, Homo sapiens
agcucuucuuccc

SEQ ID NO: 1605894 - RNA, 18 nt, Homo sapiens
agcugaaaagagcuuugu

SEQ ID NO: 1605895 - RNA, 16 nt, Homo sapiens
agcugaaagauugauu

SEQ ID NO: 1605896 - RNA, 17 nt, Homo sapiens
agcugaaaugcaggaag

SEQ ID NO: 1605897 - RNA, 16 nt, Homo sapiens
aguaacaggaucagug

SEQ ID NO: 1605898 - RNA, 11 nt, Homo sapiens
aguaacaugug

SEQ ID NO: 1605899 - RNA, 15 nt, Homo sapiens
aguaacuccccucag

SEQ ID NO: 1605900 - RNA, 16 nt, Homo sapiens
aguaacugaaccauuc

SEQ ID NO: 1605901 - RNA, 23 nt, Homo sapiens
aguaacugguuaaaaaacaaaug

SEQ ID NO: 1605902 - RNA, 12 nt, Homo sapiens
aguaagccucau

SEQ ID NO: 1605903 - RNA, 15 nt, Homo sapiens
aguaagccucaucau

SEQ ID NO: 1605904 - RNA, 23 nt, Homo sapiens
aguaaggaaauauuaagagcuau

SEQ ID NO: 1605905 - RNA, 21 nt, Homo sapiens
aguaauaucaaagcauuuuau

SEQ ID NO: 1605906 - RNA, 19 nt, Homo sapiens
aguaaucuaauauggccac

SEQ ID NO: 1605907 - RNA, 19 nt, Homo sapiens
aguaaucuguauaauacuu

SEQ ID NO: 1605908 - RNA, 14 nt, Homo sapiens
aguaauucugucau

SEQ ID NO: 1605909 - RNA, 19 nt, Homo sapiens
aguaauugaaaaaggugau

SEQ ID NO: 1605910 - RNA, 13 nt, Homo sapiens
aguaccaaaauaa

SEQ ID NO: 1605911 - RNA, 22 nt, Homo sapiens
aguaccuuuuccuacacagcgg

SEQ ID NO: 1605912 - RNA, 15 nt, Homo sapiens
aguacuagagauauu

SEQ ID NO: 1605913 - RNA, 16 nt, Homo sapiens
aguacuauuacuagua

SEQ ID NO: 1605914 - RNA, 20 nt, Homo sapiens
aguacuauugcuaguacuag

SEQ ID NO: 1605915 - RNA, 15 nt, Homo sapiens
aguacugaccacugg

SEQ ID NO: 1605916 - RNA, 13 nt, Homo sapiens
aguagaacugucu

SEQ ID NO: 1605917 - RNA, 13 nt, Homo sapiens
aguagaagggaaa

SEQ ID NO: 1605918 - RNA, 22 nt, Homo sapiens
aguagaucuauauuagaucaaa

SEQ ID NO: 1605919 - RNA, 20 nt, Homo sapiens
aguagcccagagugagcuuu

SEQ ID NO: 1605920 - RNA, 23 nt, Homo sapiens
aguagcguuuuuuaaauguauac

SEQ ID NO: 1605921 - RNA, 19 nt, Homo sapiens
aguaggcauauaucacuaa

SEQ ID NO: 1605922 - RNA, 18 nt, Homo sapiens
aguagggauaaagucauc

SEQ ID NO: 1605923 - RNA, 21 nt, Homo sapiens
aguagucacaaacugaucuaa

SEQ ID NO: 1605924 - RNA, 9 nt, Homo sapiens
aguaguccu

SEQ ID NO: 1605925 - RNA, 16 nt, Homo sapiens
aguauaagucugggca

SEQ ID NO: 1605926 - RNA, 21 nt, Homo sapiens
aguauaggccaggcacagugg

SEQ ID NO: 1605927 - RNA, 17 nt, Homo sapiens
aguauauugauaaccuu

SEQ ID NO: 1605928 - RNA, 13 nt, Homo sapiens
aguauccacagaa

SEQ ID NO: 1605929 - RNA, 15 nt, Homo sapiens
aguauccaggcuuug

SEQ ID NO: 1605930 - RNA, 16 nt, Homo sapiens
aguaugcacuuggccu

SEQ ID NO: 1605931 - RNA, 22 nt, Homo sapiens
aguauguauuauuuacauuuaa

SEQ ID NO: 1605932 - RNA, 20 nt, Homo sapiens
aguauguccuucagcugacu

SEQ ID NO: 1605933 - RNA, 15 nt, Homo sapiens
aguauuaacuauuag

SEQ ID NO: 1605934 - RNA, 21 nt, Homo sapiens
aguauuaacuauuaguguuaa

SEQ ID NO: 1605935 - RNA, 20 nt, Homo sapiens
aguauuauauaaacugugcc

SEQ ID NO: 1605936 - RNA, 14 nt, Homo sapiens
aguauuaucagaug

SEQ ID NO: 1605937 - RNA, 19 nt, Homo sapiens
aguauuggaucugaaaaua

SEQ ID NO: 1605938 - RNA, 20 nt, Homo sapiens
aguauugucgguuaccucug

SEQ ID NO: 1605939 - RNA, 23 nt, Homo sapiens
aguauuugggaagugaagacugg

SEQ ID NO: 1605940 - RNA, 19 nt, Homo sapiens
aguauuuuuauccaugaca

SEQ ID NO: 1605941 - RNA, 19 nt, Homo sapiens
aguauuuuugcugcuucug

SEQ ID NO: 1605942 - RNA, 22 nt, Homo sapiens
aguauuuuuuaauccuaccuca

SEQ ID NO: 1605943 - RNA, 17 nt, Homo sapiens
agucaaaacuacaaauc

SEQ ID NO: 1605944 - RNA, 16 nt, Homo sapiens
agucaauagcuugucu

SEQ ID NO: 1605945 - RNA, 10 nt, Homo sapiens
agucaaucca

SEQ ID NO: 1605946 - RNA, 15 nt, Homo sapiens
agucaauuucuacuu

SEQ ID NO: 1605947 - RNA, 12 nt, Homo sapiens
agucacacagug

SEQ ID NO: 1605948 - RNA, 14 nt, Homo sapiens
agucacaucucuuc

SEQ ID NO: 1605949 - RNA, 14 nt, Homo sapiens
agucacauugccau

SEQ ID NO: 1605950 - RNA, 19 nt, Homo sapiens
agucaccaaauagugugaa

SEQ ID NO: 1605951 - RNA, 13 nt, Homo sapiens
agucaccaggaau

SEQ ID NO: 1605952 - RNA, 11 nt, Homo sapiens
agucaccucac

SEQ ID NO: 1605953 - RNA, 18 nt, Homo sapiens
agucacgugaaacagagu

SEQ ID NO: 1605954 - RNA, 15 nt, Homo sapiens
agucacugagcauca

SEQ ID NO: 1605955 - RNA, 20 nt, Homo sapiens
agucacuggucuguuugcau

SEQ ID NO: 1605956 - RNA, 21 nt, Homo sapiens
agucagacugacacuacuaaa

SEQ ID NO: 1605957 - RNA, 20 nt, Homo sapiens
agucagcacccccaccaaac

SEQ ID NO: 1605958 - RNA, 13 nt, Homo sapiens
agucagcagucau

SEQ ID NO: 1605959 - RNA, 21 nt, Homo sapiens
agucauacaagucauggucac

SEQ ID NO: 1605960 - RNA, 20 nt, Homo sapiens
agucaucugaugagaacaag

SEQ ID NO: 1605961 - RNA, 14 nt, Homo sapiens
agucaugauccuug

SEQ ID NO: 1605962 - RNA, 22 nt, Homo sapiens
agucauggaggccaagaacuug

SEQ ID NO: 1605963 - RNA, 17 nt, Homo sapiens
agucauggcuaauuuaa

SEQ ID NO: 1605964 - RNA, 15 nt, Homo sapiens
agucauuuaucuaau

SEQ ID NO: 1605965 - RNA, 17 nt, Homo sapiens
aguccaaaccacuccac

SEQ ID NO: 1605966 - RNA, 14 nt, Homo sapiens
aguccaauuccuug

SEQ ID NO: 1605967 - RNA, 13 nt, Homo sapiens
aguccacugagca

SEQ ID NO: 1605968 - RNA, 15 nt, Homo sapiens
aguccacuguggcac

SEQ ID NO: 1605969 - RNA, 20 nt, Homo sapiens
aguccagagggacagucagu

SEQ ID NO: 1605970 - RNA, 24 nt, Homo sapiens
aguccaggccucucucugcuccau

SEQ ID NO: 1605971 - RNA, 19 nt, Homo sapiens
agucccaaugguccugacu

SEQ ID NO: 1605972 - RNA, 20 nt, Homo sapiens
agucccaugcuggcugaaga

SEQ ID NO: 1605973 - RNA, 15 nt, Homo sapiens
aguccucacucuuca

SEQ ID NO: 1605974 - RNA, 12 nt, Homo sapiens
aguccucuuucc

SEQ ID NO: 1605975 - RNA, 14 nt, Homo sapiens
aguccucuuuccuu

SEQ ID NO: 1605976 - RNA, 12 nt, Homo sapiens
aguccuugcaaa

SEQ ID NO: 1605977 - RNA, 13 nt, Homo sapiens
aguccuuuaguca

SEQ ID NO: 1605978 - RNA, 17 nt, Homo sapiens
agucgagauugcacugc

SEQ ID NO: 1605979 - RNA, 19 nt, Homo sapiens
agucgagauugcacugcug

SEQ ID NO: 1605980 - RNA, 19 nt, Homo sapiens
agucuauguauguguaaaa

SEQ ID NO: 1605981 - RNA, 23 nt, Homo sapiens
agucuauugucuccuugguuaua

SEQ ID NO: 1605982 - RNA, 22 nt, Homo sapiens
agucucacuuuuauugauaaaa

SEQ ID NO: 1605983 - RNA, 16 nt, Homo sapiens
agucucaggaaaucaa

SEQ ID NO: 1605984 - RNA, 20 nt, Homo sapiens
agucucaggacagaaccacu

SEQ ID NO: 1605985 - RNA, 21 nt, Homo sapiens
agucucauccucccauugccc

SEQ ID NO: 1605986 - RNA, 22 nt, Homo sapiens
agucucucucuuccucacaguc

SEQ ID NO: 1605987 - RNA, 14 nt, Homo sapiens
agucucugcugcua

SEQ ID NO: 1605988 - RNA, 13 nt, Homo sapiens
agucugaaacugg

SEQ ID NO: 1605989 - RNA, 15 nt, Homo sapiens
agucugauaaacuga

SEQ ID NO: 1605990 - RNA, 18 nt, Homo sapiens
agucugcauuucauauua

SEQ ID NO: 1605991 - RNA, 21 nt, Homo sapiens
agucugccacuugucaaagaa

SEQ ID NO: 1605992 - RNA, 16 nt, Homo sapiens
agucugccgauuuugu

SEQ ID NO: 1605993 - RNA, 21 nt, Homo sapiens
agucuggaaaacagaaaccau

SEQ ID NO: 1605994 - RNA, 21 nt, Homo sapiens
agucugggcacaagugucccu

SEQ ID NO: 1605995 - RNA, 16 nt, Homo sapiens
agucugggcacuggau

SEQ ID NO: 1605996 - RNA, 23 nt, Homo sapiens
agucugguaauaaaugugacuca

SEQ ID NO: 1605997 - RNA, 20 nt, Homo sapiens
agucugucgauuuaugccuc

SEQ ID NO: 1605998 - RNA, 22 nt, Homo sapiens
agucuuaaaaaaauaugccuuu

SEQ ID NO: 1605999 - RNA, 15 nt, Homo sapiens
agucuuaaagcauuu

SEQ ID NO: 1606000 - RNA, 17 nt, Homo sapiens
agucuuagagcuuuacc

SEQ ID NO: 1606001 - RNA, 12 nt, Homo sapiens
agucuucacuaa

SEQ ID NO: 1606002 - RNA, 13 nt, Homo sapiens
agucuucuauuua

SEQ ID NO: 1606003 - RNA, 14 nt, Homo sapiens
agucuuguguucac

SEQ ID NO: 1606004 - RNA, 13 nt, Homo sapiens
agucuuuccuuag

SEQ ID NO: 1606005 - RNA, 17 nt, Homo sapiens
agucuuuguuuacauga

SEQ ID NO: 1606006 - RNA, 18 nt, Homo sapiens
agucuuuguuuacaugag

SEQ ID NO: 1606007 - RNA, 22 nt, Homo sapiens
agucuuuuguucgcauggucac

SEQ ID NO: 1606008 - RNA, 20 nt, Homo sapiens
agugaaaaucuacacuccag

SEQ ID NO: 1606009 - RNA, 22 nt, Homo sapiens
agugaaauaauagaaugagcac

SEQ ID NO: 1606010 - RNA, 20 nt, Homo sapiens
agugaacucucaaauccaaa

SEQ ID NO: 1606011 - RNA, 18 nt, Homo sapiens
agugaagcagcacuguga

SEQ ID NO: 1606012 - RNA, 15 nt, Homo sapiens
agugaagucuaugau

SEQ ID NO: 1606013 - RNA, 19 nt, Homo sapiens
agugaauaaaccaucaucu

SEQ ID NO: 1606014 - RNA, 22 nt, Homo sapiens
agugaauacauuaacggugcua

SEQ ID NO: 1606015 - RNA, 17 nt, Homo sapiens
caaagacccagagcaaa

SEQ ID NO: 1606016 - RNA, 14 nt, Homo sapiens
caaagaugacuggu

SEQ ID NO: 1606017 - RNA, 16 nt, Homo sapiens
caaagcaaggagauca

SEQ ID NO: 1606018 - RNA, 16 nt, Homo sapiens
caaagcagcagugucc

SEQ ID NO: 1606019 - RNA, 18 nt, Homo sapiens
caaagcauuuugccuacc

SEQ ID NO: 1606020 - RNA, 20 nt, Homo sapiens
caaagccaagggcaacagau

SEQ ID NO: 1606021 - RNA, 17 nt, Homo sapiens
caaagcuuucauguaaa

SEQ ID NO: 1606022 - RNA, 16 nt, Homo sapiens
caaaggaagacuugaa

SEQ ID NO: 1606023 - RNA, 18 nt, Homo sapiens
caaaggacccaaucccca

SEQ ID NO: 1606024 - RNA, 19 nt, Homo sapiens
caaaggagacuuaauuuca

SEQ ID NO: 1606025 - RNA, 22 nt, Homo sapiens
caaaggaggggaaacaaugaaa

SEQ ID NO: 1606026 - RNA, 17 nt, Homo sapiens
caaaggccacaggcagu

SEQ ID NO: 1606027 - RNA, 16 nt, Homo sapiens
caaaggcgacaauaaa

SEQ ID NO: 1606028 - RNA, 15 nt, Homo sapiens
caaaggcugacauuc

SEQ ID NO: 1606029 - RNA, 16 nt, Homo sapiens
caaaguaaagacugag

SEQ ID NO: 1606030 - RNA, 11 nt, Homo sapiens
caaaguaauag

SEQ ID NO: 1606031 - RNA, 22 nt, Homo sapiens
caaagugcugggauuacaggcg

SEQ ID NO: 1606032 - RNA, 21 nt, Homo sapiens
caaagugguaaauacugugaa

SEQ ID NO: 1606033 - RNA, 18 nt, Homo sapiens
caaauaaaauguucccua

SEQ ID NO: 1606034 - RNA, 14 nt, Homo sapiens
caaauaaacacugu

SEQ ID NO: 1606035 - RNA, 20 nt, Homo sapiens
caaauaaugaguaguguaaa

SEQ ID NO: 1606036 - RNA, 18 nt, Homo sapiens
caaauaaugucucuguga

SEQ ID NO: 1606037 - RNA, 17 nt, Homo sapiens
caaauauuuauaagcua

SEQ ID NO: 1606038 - RNA, 17 nt, Homo sapiens
caaaucauuuguuuaaa

SEQ ID NO: 1606039 - RNA, 12 nt, Homo sapiens
caaauccauaga

SEQ ID NO: 1606040 - RNA, 22 nt, Homo sapiens
caaauccuucaaaauaaaaagu

SEQ ID NO: 1606041 - RNA, 14 nt, Homo sapiens
caaaucgcccccuu

SEQ ID NO: 1606042 - RNA, 13 nt, Homo sapiens
caaaucucuucaa

SEQ ID NO: 1606043 - RNA, 17 nt, Homo sapiens
caaaucugauggccuua

SEQ ID NO: 1606044 - RNA, 18 nt, Homo sapiens
caaaucuuaacuugaagg

SEQ ID NO: 1606045 - RNA, 11 nt, Homo sapiens
caaaugaaaua

SEQ ID NO: 1606046 - RNA, 20 nt, Homo sapiens
caaaugcauacaaguuucau

SEQ ID NO: 1606047 - RNA, 16 nt, Homo sapiens
caaaugcuuuuccuca

SEQ ID NO: 1606048 - RNA, 13 nt, Homo sapiens
caaauggacuguu

SEQ ID NO: 1606049 - RNA, 16 nt, Homo sapiens
caaaugggaucaauuu

SEQ ID NO: 1606050 - RNA, 20 nt, Homo sapiens
caaauggggcaaacagucua

SEQ ID NO: 1606051 - RNA, 12 nt, Homo sapiens
caaaugucauca

SEQ ID NO: 1606052 - RNA, 11 nt, Homo sapiens
caaauguucuc

SEQ ID NO: 1606053 - RNA, 20 nt, Homo sapiens
caaauguuuuaaaguuuaau

SEQ ID NO: 1606054 - RNA, 16 nt, Homo sapiens
caaauuagccauuuca

SEQ ID NO: 1606055 - RNA, 19 nt, Homo sapiens
caaauuauuuuuaucuuuc

SEQ ID NO: 1606056 - RNA, 14 nt, Homo sapiens
caaauugcuucuag

SEQ ID NO: 1606057 - RNA, 16 nt, Homo sapiens
caaauugcuucuagga

SEQ ID NO: 1606058 - RNA, 20 nt, Homo sapiens
caaauuuaauuaaagccuua

SEQ ID NO: 1606059 - RNA, 20 nt, Homo sapiens
caacaaagaaugggcuugaa

SEQ ID NO: 1606060 - RNA, 22 nt, Homo sapiens
caacaaaugggucccucagucu

SEQ ID NO: 1606061 - RNA, 13 nt, Homo sapiens
caacaacgacaca

SEQ ID NO: 1606062 - RNA, 14 nt, Homo sapiens
caacaagaacugca

SEQ ID NO: 1606063 - RNA, 21 nt, Homo sapiens
caacaaggguccguggaccag

SEQ ID NO: 1606064 - RNA, 23 nt, Homo sapiens
caacaauaaaguacuuuaccuaa

SEQ ID NO: 1606065 - RNA, 14 nt, Homo sapiens
caacaaugacuuaa

SEQ ID NO: 1606066 - RNA, 18 nt, Homo sapiens
caacaauuuauccauuca

SEQ ID NO: 1606067 - RNA, 18 nt, Homo sapiens
caacaccuuccuccugca

SEQ ID NO: 1606068 - RNA, 16 nt, Homo sapiens
caacagauuauuaccu

SEQ ID NO: 1606069 - RNA, 11 nt, Homo sapiens
caacagcauuu

SEQ ID NO: 1606070 - RNA, 15 nt, Homo sapiens
caacagcauuuucaa

SEQ ID NO: 1606071 - RNA, 22 nt, Homo sapiens
caacaggauuacaguguagcua

SEQ ID NO: 1606072 - RNA, 20 nt, Homo sapiens
caacaguggggaagagugac

SEQ ID NO: 1606073 - RNA, 22 nt, Homo sapiens
caacaguggggaagagugacuc

SEQ ID NO: 1606074 - RNA, 15 nt, Homo sapiens
caacauaaagagcaa

SEQ ID NO: 1606075 - RNA, 14 nt, Homo sapiens
caacaucccauugc

SEQ ID NO: 1606076 - RNA, 18 nt, Homo sapiens
caacaugacauccagaga

SEQ ID NO: 1606077 - RNA, 15 nt, Homo sapiens
caacauggcacaugu

SEQ ID NO: 1606078 - RNA, 14 nt, Homo sapiens
caacauuaccaaaa

SEQ ID NO: 1606079 - RNA, 16 nt, Homo sapiens
caacauuuguuuuagu

SEQ ID NO: 1606080 - RNA, 16 nt, Homo sapiens
caaccagaacuuucug

SEQ ID NO: 1606081 - RNA, 18 nt, Homo sapiens
caaccagaccaaccgccu

SEQ ID NO: 1606082 - RNA, 21 nt, Homo sapiens
caaccaugcaaauugugaaau

SEQ ID NO: 1606083 - RNA, 14 nt, Homo sapiens
caacccccaucucc

SEQ ID NO: 1606084 - RNA, 17 nt, Homo sapiens
caaccccccagcacuga

SEQ ID NO: 1606085 - RNA, 19 nt, Homo sapiens
caaccccccagcacugagg

SEQ ID NO: 1606086 - RNA, 22 nt, Homo sapiens
caacccgucuggcccaccaggg

SEQ ID NO: 1606087 - RNA, 19 nt, Homo sapiens
caaccgcgggggcugugag

SEQ ID NO: 1606088 - RNA, 18 nt, Homo sapiens
caaccggcuuuguggcac

SEQ ID NO: 1606089 - RNA, 17 nt, Homo sapiens
caaccucagcccugaaa

SEQ ID NO: 1606090 - RNA, 16 nt, Homo sapiens
caaccucaggcuccua

SEQ ID NO: 1606091 - RNA, 14 nt, Homo sapiens
caaccucugccucc

SEQ ID NO: 1606092 - RNA, 19 nt, Homo sapiens
caaccugggacuuccuaaa

SEQ ID NO: 1606093 - RNA, 19 nt, Homo sapiens
caacgagacacauugccuu

SEQ ID NO: 1606094 - RNA, 14 nt, Homo sapiens
caacgaguacuuca

SEQ ID NO: 1606095 - RNA, 19 nt, Homo sapiens
caacgagugaaacuccguc

SEQ ID NO: 1606096 - RNA, 22 nt, Homo sapiens
caacgguauccagggacuauga

SEQ ID NO: 1606097 - RNA, 22 nt, Homo sapiens
caacuaaacaaggcauucagca

SEQ ID NO: 1606098 - RNA, 11 nt, Homo sapiens
caacuaccuga

SEQ ID NO: 1606099 - RNA, 15 nt, Homo sapiens
caacuagcugggacu

SEQ ID NO: 1606100 - RNA, 13 nt, Homo sapiens
caacuaugauuau

SEQ ID NO: 1606101 - RNA, 15 nt, Homo sapiens
caacucauuuuuaca

SEQ ID NO: 1606102 - RNA, 13 nt, Homo sapiens
caacuccacaggg

SEQ ID NO: 1606103 - RNA, 22 nt, Homo sapiens
caacugggccugggauggggcu

SEQ ID NO: 1606104 - RNA, 23 nt, Homo sapiens
caacugggccugggauggggcuu

SEQ ID NO: 1606105 - RNA, 19 nt, Homo sapiens
caacuguuugcacuuacag

SEQ ID NO: 1606106 - RNA, 17 nt, Homo sapiens
caacuuaaguauuuaca

SEQ ID NO: 1606107 - RNA, 23 nt, Homo sapiens
caacuuauuguauuccucauguc

SEQ ID NO: 1606108 - RNA, 12 nt, Homo sapiens
caacuuuccuca

SEQ ID NO: 1606109 - RNA, 14 nt, Homo sapiens
caacuuugaauaaa

SEQ ID NO: 1606110 - RNA, 17 nt, Homo sapiens
caacuuuucaaugugau

SEQ ID NO: 1606111 - RNA, 23 nt, Homo sapiens
caagaaaucugugccugagaaca

SEQ ID NO: 1606112 - RNA, 13 nt, Homo sapiens
caagaaauuggaa

SEQ ID NO: 1606113 - RNA, 13 nt, Homo sapiens
caagaacugcauc

SEQ ID NO: 1606114 - RNA, 13 nt, Homo sapiens
caagaacuugcaa

SEQ ID NO: 1606115 - RNA, 19 nt, Homo sapiens
caagaacuugcaauaccaa

SEQ ID NO: 1606116 - RNA, 17 nt, Homo sapiens
caagaaggaaagauuug

SEQ ID NO: 1606117 - RNA, 13 nt, Homo sapiens
caagaagggcuag

SEQ ID NO: 1606118 - RNA, 18 nt, Homo sapiens
caagaagguuucuguccu

SEQ ID NO: 1606119 - RNA, 17 nt, Homo sapiens
caagaaguggcugccaa

SEQ ID NO: 1606120 - RNA, 17 nt, Homo sapiens
caagacaagccuggccu

SEQ ID NO: 1606121 - RNA, 11 nt, Homo sapiens
caagacauuuc

SEQ ID NO: 1606122 - RNA, 17 nt, Homo sapiens
caagacauuugcugaac

SEQ ID NO: 1606123 - RNA, 20 nt, Homo sapiens
caagacauuugcugaacuca

SEQ ID NO: 1606124 - RNA, 14 nt, Homo sapiens
caagaccagccugg

SEQ ID NO: 1606125 - RNA, 20 nt, Homo sapiens
caagaccagccugggcaaca

SEQ ID NO: 1606126 - RNA, 16 nt, Homo sapiens
caagacucccaugagg

SEQ ID NO: 1606127 - RNA, 16 nt, Homo sapiens
caagagaucuacacau

SEQ ID NO: 1606128 - RNA, 16 nt, Homo sapiens
caagagcaugcacaug

SEQ ID NO: 1606129 - RNA, 18 nt, Homo sapiens
caagaggauuguaaaaug

SEQ ID NO: 1606130 - RNA, 21 nt, Homo sapiens
caagaggauuguaaaaugcac

SEQ ID NO: 1606131 - RNA, 16 nt, Homo sapiens
caagagggaaugucag

SEQ ID NO: 1606132 - RNA, 15 nt, Homo sapiens
caagaguggacugaa

SEQ ID NO: 1606133 - RNA, 22 nt, Homo sapiens
caagauacacucaagcaugaag

SEQ ID NO: 1606134 - RNA, 23 nt, Homo sapiens
cacugcuugaggaaaacaagcau

SEQ ID NO: 1606135 - RNA, 16 nt, Homo sapiens
cacuggaccucagucc

SEQ ID NO: 1606136 - RNA, 17 nt, Homo sapiens
cacugggccugucacug

SEQ ID NO: 1606137 - RNA, 23 nt, Homo sapiens
cacuggggaggaauccuggacca

SEQ ID NO: 1606138 - RNA, 19 nt, Homo sapiens
cacugguuuguuucucaag

SEQ ID NO: 1606139 - RNA, 14 nt, Homo sapiens
cacuguaaagacaa

SEQ ID NO: 1606140 - RNA, 18 nt, Homo sapiens
cacuguaccgacuuugau

SEQ ID NO: 1606141 - RNA, 19 nt, Homo sapiens
cacuguauauaaacauauc

SEQ ID NO: 1606142 - RNA, 15 nt, Homo sapiens
cacugucacaggcau

SEQ ID NO: 1606143 - RNA, 23 nt, Homo sapiens
cacuguccaugaagcacugagca

SEQ ID NO: 1606144 - RNA, 22 nt, Homo sapiens
cacuguccugugaggacagcug

SEQ ID NO: 1606145 - RNA, 18 nt, Homo sapiens
cacugucuuuaauucugu

SEQ ID NO: 1606146 - RNA, 12 nt, Homo sapiens
cacugucuuuca

SEQ ID NO: 1606147 - RNA, 13 nt, Homo sapiens
cacugucuuucaa

SEQ ID NO: 1606148 - RNA, 18 nt, Homo sapiens
cacugugggaaggccagc

SEQ ID NO: 1606149 - RNA, 20 nt, Homo sapiens
cacuguuaauaguacuauua

SEQ ID NO: 1606150 - RNA, 15 nt, Homo sapiens
cacuuaaccauucca

SEQ ID NO: 1606151 - RNA, 15 nt, Homo sapiens
cacuuaaggaccuuu

SEQ ID NO: 1606152 - RNA, 20 nt, Homo sapiens
cacuuaauaaucaaccuggg

SEQ ID NO: 1606153 - RNA, 15 nt, Homo sapiens
cacuuaauuuuccca

SEQ ID NO: 1606154 - RNA, 22 nt, Homo sapiens
cacuuagaccugccagccacug

SEQ ID NO: 1606155 - RNA, 19 nt, Homo sapiens
cacuuagguccaaggucuc

SEQ ID NO: 1606156 - RNA, 20 nt, Homo sapiens
cacuuauaggaauugaccca

SEQ ID NO: 1606157 - RNA, 19 nt, Homo sapiens
cacuuaucaguuugcuaau

SEQ ID NO: 1606158 - RNA, 16 nt, Homo sapiens
cacuucacuuucuuca

SEQ ID NO: 1606159 - RNA, 16 nt, Homo sapiens
cacuuccaucacaaga

SEQ ID NO: 1606160 - RNA, 23 nt, Homo sapiens
cacuuccaugagaagaagcagau

SEQ ID NO: 1606161 - RNA, 18 nt, Homo sapiens
cacuucccauacccaguc

SEQ ID NO: 1606162 - RNA, 22 nt, Homo sapiens
cacuugccugugcuacaauuca

SEQ ID NO: 1606163 - RNA, 20 nt, Homo sapiens
cacuugcucccaacccauuc

SEQ ID NO: 1606164 - RNA, 22 nt, Homo sapiens
cacuugggauugucuuacuguu

SEQ ID NO: 1606165 - RNA, 14 nt, Homo sapiens
cacuugugugugua

SEQ ID NO: 1606166 - RNA, 21 nt, Homo sapiens
cacuuuaauuaccaaccuguu

SEQ ID NO: 1606167 - RNA, 18 nt, Homo sapiens
cacuuuacaaaaguauua

SEQ ID NO: 1606168 - RNA, 19 nt, Homo sapiens
cacuuucuucaaagccaca

SEQ ID NO: 1606169 - RNA, 12 nt, Homo sapiens
cacuuugccucc

SEQ ID NO: 1606170 - RNA, 14 nt, Homo sapiens
cacuuuucauauca

SEQ ID NO: 1606171 - RNA, 20 nt, Homo sapiens
cagaaaaauugaacuacagc

SEQ ID NO: 1606172 - RNA, 13 nt, Homo sapiens
cagaaaaccaaag

SEQ ID NO: 1606173 - RNA, 17 nt, Homo sapiens
cagaaaaccucuccuga

SEQ ID NO: 1606174 - RNA, 18 nt, Homo sapiens
cagaaaagcccaaguuca

SEQ ID NO: 1606175 - RNA, 19 nt, Homo sapiens
cagaaaaucuaccaagaac

SEQ ID NO: 1606176 - RNA, 16 nt, Homo sapiens
cagaaaauguucuguu

SEQ ID NO: 1606177 - RNA, 18 nt, Homo sapiens
cagaaacacucaaguuga

SEQ ID NO: 1606178 - RNA, 15 nt, Homo sapiens
cagaaacagugugca

SEQ ID NO: 1606179 - RNA, 16 nt, Homo sapiens
cagaaagcaucccuca

SEQ ID NO: 1606180 - RNA, 21 nt, Homo sapiens
cagaaagcaucccucacccau

SEQ ID NO: 1606181 - RNA, 19 nt, Homo sapiens
cagaaagccaacauguggc

SEQ ID NO: 1606182 - RNA, 23 nt, Homo sapiens
cagaaauggugcucaccaugcuu

SEQ ID NO: 1606183 - RNA, 18 nt, Homo sapiens
cagaacaguaugaauuug

SEQ ID NO: 1606184 - RNA, 19 nt, Homo sapiens
cagaaccuucaacccagug

SEQ ID NO: 1606185 - RNA, 16 nt, Homo sapiens
cagaacuuaaucugga

SEQ ID NO: 1606186 - RNA, 18 nt, Homo sapiens
cagaacuucaggugugac

SEQ ID NO: 1606187 - RNA, 15 nt, Homo sapiens
cagaagccuccaagc

SEQ ID NO: 1606188 - RNA, 15 nt, Homo sapiens
cagaaggagagugag

SEQ ID NO: 1606189 - RNA, 20 nt, Homo sapiens
cagaaggagaugcugcugag

SEQ ID NO: 1606190 - RNA, 20 nt, Homo sapiens
cagaaggcaaaguuuacaga

SEQ ID NO: 1606191 - RNA, 17 nt, Homo sapiens
cagaaggccccagagag

SEQ ID NO: 1606192 - RNA, 20 nt, Homo sapiens
cagaaggguggggauaucag

SEQ ID NO: 1606193 - RNA, 16 nt, Homo sapiens
cagaauaaauaagcaa

SEQ ID NO: 1606194 - RNA, 17 nt, Homo sapiens
cagaaucaaaugcaauu

SEQ ID NO: 1606195 - RNA, 16 nt, Homo sapiens
cagaauccugauggua

SEQ ID NO: 1606196 - RNA, 21 nt, Homo sapiens
cagaauuuucuggccuuucau

SEQ ID NO: 1606197 - RNA, 19 nt, Homo sapiens
cagacacaggucccugagc

SEQ ID NO: 1606198 - RNA, 11 nt, Homo sapiens
cagacccagug

SEQ ID NO: 1606199 - RNA, 22 nt, Homo sapiens
cagacccaguggacucuuccac

SEQ ID NO: 1606200 - RNA, 18 nt, Homo sapiens
cagaccccacgcugacca

SEQ ID NO: 1606201 - RNA, 13 nt, Homo sapiens
cagaccuccuagc

SEQ ID NO: 1606202 - RNA, 17 nt, Homo sapiens
cagacggaaaugaaauu

SEQ ID NO: 1606203 - RNA, 20 nt, Homo sapiens
cagacuaaaggauccagaga

SEQ ID NO: 1606204 - RNA, 22 nt, Homo sapiens
cagacuauggauguguucucua

SEQ ID NO: 1606205 - RNA, 14 nt, Homo sapiens
cagacuccugcucu

SEQ ID NO: 1606206 - RNA, 18 nt, Homo sapiens
cagacucgggaccaauac

SEQ ID NO: 1606207 - RNA, 14 nt, Homo sapiens
cagacucucaggug

SEQ ID NO: 1606208 - RNA, 19 nt, Homo sapiens
cagacucuguaauugaaua

SEQ ID NO: 1606209 - RNA, 17 nt, Homo sapiens
cagacugccugucugcu

SEQ ID NO: 1606210 - RNA, 14 nt, Homo sapiens
cagacuugaauaca

SEQ ID NO: 1606211 - RNA, 22 nt, Homo sapiens
cagacuuggacuaugauuaucu

SEQ ID NO: 1606212 - RNA, 17 nt, Homo sapiens
cagagaaauacaaaaua

SEQ ID NO: 1606213 - RNA, 15 nt, Homo sapiens
cagagaaccaaaggg

SEQ ID NO: 1606214 - RNA, 13 nt, Homo sapiens
cagagaagccagg

SEQ ID NO: 1606215 - RNA, 13 nt, Homo sapiens
cagagaagcugua

SEQ ID NO: 1606216 - RNA, 18 nt, Homo sapiens
cagagaaggaacauaccc

SEQ ID NO: 1606217 - RNA, 13 nt, Homo sapiens
cagagaagguaag

SEQ ID NO: 1606218 - RNA, 20 nt, Homo sapiens
cagagagguggggauccugc

SEQ ID NO: 1606219 - RNA, 20 nt, Homo sapiens
cagagaucucuguagaagga

SEQ ID NO: 1606220 - RNA, 11 nt, Homo sapiens
cagagcacuug

SEQ ID NO: 1606221 - RNA, 13 nt, Homo sapiens
cagagcagagccu

SEQ ID NO: 1606222 - RNA, 20 nt, Homo sapiens
cagagcagagguggaaaaac

SEQ ID NO: 1606223 - RNA, 23 nt, Homo sapiens
cagagccauggucccaggcuucc

SEQ ID NO: 1606224 - RNA, 20 nt, Homo sapiens
cagagccccuuaaagcugcu

SEQ ID NO: 1606225 - RNA, 20 nt, Homo sapiens
cagagccucccaaggagaac

SEQ ID NO: 1606226 - RNA, 16 nt, Homo sapiens
cagagccuuuuacccc

SEQ ID NO: 1606227 - RNA, 16 nt, Homo sapiens
cagagcgcacagggag

SEQ ID NO: 1606228 - RNA, 21 nt, Homo sapiens
cagagcgccaggaagccagag

SEQ ID NO: 1606229 - RNA, 15 nt, Homo sapiens
cagagcucaccaggc

SEQ ID NO: 1606230 - RNA, 20 nt, Homo sapiens
cagaggagggcgugacucac

SEQ ID NO: 1606231 - RNA, 23 nt, Homo sapiens
cagaggagugcagccuucuccau

SEQ ID NO: 1606232 - RNA, 22 nt, Homo sapiens
cagaggaugcaacaaauguggc

SEQ ID NO: 1606233 - RNA, 22 nt, Homo sapiens
cagaggcagcccgcacaccugc

SEQ ID NO: 1606234 - RNA, 21 nt, Homo sapiens
cagaggcauuuaaaauggaaa

SEQ ID NO: 1606235 - RNA, 20 nt, Homo sapiens
cagaggccuuggguguucca

SEQ ID NO: 1606236 - RNA, 13 nt, Homo sapiens
cagagggagacag

SEQ ID NO: 1606237 - RNA, 14 nt, Homo sapiens
cagagggauaaaaa

SEQ ID NO: 1606238 - RNA, 15 nt, Homo sapiens
cagaggucacuucau

SEQ ID NO: 1606239 - RNA, 13 nt, Homo sapiens
cagaggucuccca

SEQ ID NO: 1606240 - RNA, 14 nt, Homo sapiens
cagaggugcuaaau

SEQ ID NO: 1606241 - RNA, 18 nt, Homo sapiens
cagagguuguagugagcc

SEQ ID NO: 1606242 - RNA, 14 nt, Homo sapiens
cagaguaacaggau

SEQ ID NO: 1606243 - RNA, 16 nt, Homo sapiens
cagagucccugccugg

SEQ ID NO: 1606244 - RNA, 17 nt, Homo sapiens
cagaguccuugcaaaau

SEQ ID NO: 1606245 - RNA, 16 nt, Homo sapiens
cagagugacagucaua

SEQ ID NO: 1606246 - RNA, 20 nt, Homo sapiens
cagagugagacccugucuca

SEQ ID NO: 1606247 - RNA, 11 nt, Homo sapiens
cagagugccac

SEQ ID NO: 1606248 - RNA, 19 nt, Homo sapiens
cagagugcuggacuguucc

SEQ ID NO: 1606249 - RNA, 13 nt, Homo sapiens
cagaguggagucu

SEQ ID NO: 1606250 - RNA, 17 nt, Homo sapiens
cagaguguuuaccuggu

SEQ ID NO: 1606251 - RNA, 20 nt, Homo sapiens
cagaguuucaccauguuggc

SEQ ID NO: 1606252 - RNA, 18 nt, Homo sapiens
cauaagaaagcacuauua

SEQ ID NO: 1606253 - RNA, 16 nt, Homo sapiens
cauaagcccaguucau

SEQ ID NO: 1606254 - RNA, 23 nt, Homo sapiens
cauaaguaaucacuaaugcucaa

SEQ ID NO: 1606255 - RNA, 20 nt, Homo sapiens
cauaaguuaugccucugaca

SEQ ID NO: 1606256 - RNA, 16 nt, Homo sapiens
cauaauaaaaggaguu

SEQ ID NO: 1606257 - RNA, 12 nt, Homo sapiens
cauaauggacua

SEQ ID NO: 1606258 - RNA, 21 nt, Homo sapiens
cauaauguuucuggauuucau

SEQ ID NO: 1606259 - RNA, 16 nt, Homo sapiens
cauaauucagcacuua

SEQ ID NO: 1606260 - RNA, 17 nt, Homo sapiens
cauaauucagcacuuaa

SEQ ID NO: 1606261 - RNA, 19 nt, Homo sapiens
cauaauuccuacagcacua

SEQ ID NO: 1606262 - RNA, 20 nt, Homo sapiens
cauaauugcuuugccaaaau

SEQ ID NO: 1606263 - RNA, 20 nt, Homo sapiens
cauacaaauucuacuuuaau

SEQ ID NO: 1606264 - RNA, 14 nt, Homo sapiens
cauacaauguaugu

SEQ ID NO: 1606265 - RNA, 14 nt, Homo sapiens
cauacaauuucagc

SEQ ID NO: 1606266 - RNA, 19 nt, Homo sapiens
cauacaggauuugaacuca

SEQ ID NO: 1606267 - RNA, 17 nt, Homo sapiens
cauacauauuaucucau

SEQ ID NO: 1606268 - RNA, 20 nt, Homo sapiens
cauaccaaguugauacuuga

SEQ ID NO: 1606269 - RNA, 21 nt, Homo sapiens
cauaccaaguugauacuugaa

SEQ ID NO: 1606270 - RNA, 22 nt, Homo sapiens
cauaccauuucuacaccucaau

SEQ ID NO: 1606271 - RNA, 15 nt, Homo sapiens
cauaccccuuacaaa

SEQ ID NO: 1606272 - RNA, 20 nt, Homo sapiens
cauaccucuucuuacuccaa

SEQ ID NO: 1606273 - RNA, 21 nt, Homo sapiens
cauaccuggcccugugccuug

SEQ ID NO: 1606274 - RNA, 22 nt, Homo sapiens
cauaccuggcccugugccuugg

SEQ ID NO: 1606275 - RNA, 22 nt, Homo sapiens
cauacgguaugauauugcagcu

SEQ ID NO: 1606276 - RNA, 17 nt, Homo sapiens
cauacucccuauuuuca

SEQ ID NO: 1606277 - RNA, 19 nt, Homo sapiens
cauagaaaaaaguagcaaa

SEQ ID NO: 1606278 - RNA, 23 nt, Homo sapiens
cauagagaugagcccacccugcu

SEQ ID NO: 1606279 - RNA, 13 nt, Homo sapiens
cauagagcuuuuu

SEQ ID NO: 1606280 - RNA, 20 nt, Homo sapiens
cauagaguucccaugaacua

SEQ ID NO: 1606281 - RNA, 22 nt, Homo sapiens
cauagauucaccuguaaaacuu

SEQ ID NO: 1606282 - RNA, 14 nt, Homo sapiens
cauagauuucauag

SEQ ID NO: 1606283 - RNA, 18 nt, Homo sapiens
cauagcagcuuauucaca

SEQ ID NO: 1606284 - RNA, 19 nt, Homo sapiens
cauagggucacuuugccau

SEQ ID NO: 1606285 - RNA, 21 nt, Homo sapiens
cauaggugcaguuugcuucua

SEQ ID NO: 1606286 - RNA, 19 nt, Homo sapiens
cauaguaaguucagcacuu

SEQ ID NO: 1606287 - RNA, 14 nt, Homo sapiens
cauagucaaugaug

SEQ ID NO: 1606288 - RNA, 21 nt, Homo sapiens
cauaguuugauaaaaagauca

SEQ ID NO: 1606289 - RNA, 13 nt, Homo sapiens
cauauaccagcaa

SEQ ID NO: 1606290 - RNA, 16 nt, Homo sapiens
cauauaccaucuccag

SEQ ID NO: 1606291 - RNA, 13 nt, Homo sapiens
cauauaugcaaua

SEQ ID NO: 1606292 - RNA, 20 nt, Homo sapiens
cauaucagggguacauucua

SEQ ID NO: 1606293 - RNA, 14 nt, Homo sapiens
cauaucauuaaaca

SEQ ID NO: 1606294 - RNA, 19 nt, Homo sapiens
cauaugacuaaguucacua

SEQ ID NO: 1606295 - RNA, 20 nt, Homo sapiens
cauaugaguaagggcacuga

SEQ ID NO: 1606296 - RNA, 16 nt, Homo sapiens
cauaugauacugaugc

SEQ ID NO: 1606297 - RNA, 18 nt, Homo sapiens
cauaugaucugucugugg

SEQ ID NO: 1606298 - RNA, 16 nt, Homo sapiens
cauauguaaagcacau

SEQ ID NO: 1606299 - RNA, 14 nt, Homo sapiens
cauauguagcuaac

SEQ ID NO: 1606300 - RNA, 19 nt, Homo sapiens
cauauguguaaagauuuau

SEQ ID NO: 1606301 - RNA, 12 nt, Homo sapiens
cauauuaucuca

SEQ ID NO: 1606302 - RNA, 19 nt, Homo sapiens
cauauuauuuuagugugua

SEQ ID NO: 1606303 - RNA, 20 nt, Homo sapiens
cauauuauuuuaguguguaa

SEQ ID NO: 1606304 - RNA, 18 nt, Homo sapiens
cauauugaugugugucua

SEQ ID NO: 1606305 - RNA, 20 nt, Homo sapiens
cauauuggaauguacauguc

SEQ ID NO: 1606306 - RNA, 22 nt, Homo sapiens
cauauuggaauguacaugucaa

SEQ ID NO: 1606307 - RNA, 16 nt, Homo sapiens
cauauuggucacguca

SEQ ID NO: 1606308 - RNA, 14 nt, Homo sapiens
cauauuuauucaug

SEQ ID NO: 1606309 - RNA, 21 nt, Homo sapiens
cauauuucuaccugagugaag

SEQ ID NO: 1606310 - RNA, 22 nt, Homo sapiens
cauauuuguuuaugguaaaaaa

SEQ ID NO: 1606311 - RNA, 20 nt, Homo sapiens
caucaaaaaagauagaucua

SEQ ID NO: 1606312 - RNA, 15 nt, Homo sapiens
caucaaaaacaaccu

SEQ ID NO: 1606313 - RNA, 20 nt, Homo sapiens
caucaaaaccugcgcaguca

SEQ ID NO: 1606314 - RNA, 13 nt, Homo sapiens
caucaaaccugag

SEQ ID NO: 1606315 - RNA, 22 nt, Homo sapiens
caucaaauuauuaaucugaaaa

SEQ ID NO: 1606316 - RNA, 23 nt, Homo sapiens
caucaauaguguccuaugcaaua

SEQ ID NO: 1606317 - RNA, 15 nt, Homo sapiens
caucacacauguuca

SEQ ID NO: 1606318 - RNA, 18 nt, Homo sapiens
caucacaucuuauuuauu

SEQ ID NO: 1606319 - RNA, 23 nt, Homo sapiens
caucacggauggugcaugggcuc

SEQ ID NO: 1606320 - RNA, 16 nt, Homo sapiens
caucacguauguuaua

SEQ ID NO: 1606321 - RNA, 16 nt, Homo sapiens
caucacguuagcuguc

SEQ ID NO: 1606322 - RNA, 12 nt, Homo sapiens
caucagcacucu

SEQ ID NO: 1606323 - RNA, 15 nt, Homo sapiens
caucaggacucugac

SEQ ID NO: 1606324 - RNA, 21 nt, Homo sapiens
caucaggugaggugugcucca

SEQ ID NO: 1606325 - RNA, 17 nt, Homo sapiens
caucaguagcaucugua

SEQ ID NO: 1606326 - RNA, 14 nt, Homo sapiens
caucaguaguucac

SEQ ID NO: 1606327 - RNA, 16 nt, Homo sapiens
caucaguaugucacuc

SEQ ID NO: 1606328 - RNA, 18 nt, Homo sapiens
caucagucuccaacaugu

SEQ ID NO: 1606329 - RNA, 16 nt, Homo sapiens
caucagugcucuguaa

SEQ ID NO: 1606330 - RNA, 21 nt, Homo sapiens
caucaucacgacacauuugcc

SEQ ID NO: 1606331 - RNA, 19 nt, Homo sapiens
caucauccuccauugcucc

SEQ ID NO: 1606332 - RNA, 15 nt, Homo sapiens
caucauguugaauaa

SEQ ID NO: 1606333 - RNA, 19 nt, Homo sapiens
caucauuacuuaugaugau

SEQ ID NO: 1606334 - RNA, 21 nt, Homo sapiens
caucauucauuuuuguuguug

SEQ ID NO: 1606335 - RNA, 16 nt, Homo sapiens
cauccaaggcuguuac

SEQ ID NO: 1606336 - RNA, 18 nt, Homo sapiens
cauccagaguaagugaug

SEQ ID NO: 1606337 - RNA, 21 nt, Homo sapiens
cauccagagucccugccugga

SEQ ID NO: 1606338 - RNA, 14 nt, Homo sapiens
cauccagaugugug

SEQ ID NO: 1606339 - RNA, 17 nt, Homo sapiens
cauccccaccacugaua

SEQ ID NO: 1606340 - RNA, 15 nt, Homo sapiens
cauccccacccaguc

SEQ ID NO: 1606341 - RNA, 18 nt, Homo sapiens
cauccccaccugcugcag

SEQ ID NO: 1606342 - RNA, 17 nt, Homo sapiens
caucccgaagccaucac

SEQ ID NO: 1606343 - RNA, 13 nt, Homo sapiens
caucccuaccacu

SEQ ID NO: 1606344 - RNA, 16 nt, Homo sapiens
caucccuuguuuauaa

SEQ ID NO: 1606345 - RNA, 17 nt, Homo sapiens
caucccuuuuucugcua

SEQ ID NO: 1606346 - RNA, 14 nt, Homo sapiens
cauccgacugcccc

SEQ ID NO: 1606347 - RNA, 19 nt, Homo sapiens
cauccgggaggacaaccag

SEQ ID NO: 1606348 - RNA, 21 nt, Homo sapiens
cauccuacccccugugccuug

SEQ ID NO: 1606349 - RNA, 18 nt, Homo sapiens
cauccuccagauagugua

SEQ ID NO: 1606350 - RNA, 17 nt, Homo sapiens
cauccugagugugauga

SEQ ID NO: 1606351 - RNA, 18 nt, Homo sapiens
cauccugagugugaugaa

SEQ ID NO: 1606352 - RNA, 24 nt, Homo sapiens
cauccuuaaaacaauucugugaca

SEQ ID NO: 1606353 - RNA, 16 nt, Homo sapiens
cauccuucuaagacau

SEQ ID NO: 1606354 - RNA, 23 nt, Homo sapiens
caucgauauacauuuauuuacac

SEQ ID NO: 1606355 - RNA, 21 nt, Homo sapiens
caucgauuuucuauuauggaa

SEQ ID NO: 1606356 - RNA, 20 nt, Homo sapiens
caucgcaauaguuuuuuacu

SEQ ID NO: 1606357 - RNA, 17 nt, Homo sapiens
caucuaaaacucauaca

SEQ ID NO: 1606358 - RNA, 13 nt, Homo sapiens
caucuaauaugau

SEQ ID NO: 1606359 - RNA, 20 nt, Homo sapiens
caucuaccuuuucuggcaaa

SEQ ID NO: 1606360 - RNA, 13 nt, Homo sapiens
caucuacuuagau

SEQ ID NO: 1606361 - RNA, 14 nt, Homo sapiens
caucuagaauucac

SEQ ID NO: 1606362 - RNA, 19 nt, Homo sapiens
caucuagcgcaauugaagg

SEQ ID NO: 1606363 - RNA, 20 nt, Homo sapiens
caucuagucacaaagacucc

SEQ ID NO: 1606364 - RNA, 22 nt, Homo sapiens
caucuaugaggguguuuccucu

SEQ ID NO: 1606365 - RNA, 21 nt, Homo sapiens
caucucaaaaauaaugcauaa

SEQ ID NO: 1606366 - RNA, 13 nt, Homo sapiens
caucuccagcuau

SEQ ID NO: 1606367 - RNA, 15 nt, Homo sapiens
caucuccagcuauuu

SEQ ID NO: 1606368 - RNA, 18 nt, Homo sapiens
caucuccccucagauucc

SEQ ID NO: 1606369 - RNA, 21 nt, Homo sapiens
ccacuucuggguggggcagug

SEQ ID NO: 1606370 - RNA, 20 nt, Homo sapiens
ccacuugccugugcuacaau

SEQ ID NO: 1606371 - RNA, 17 nt, Homo sapiens
ccacuuggcaucauuca

SEQ ID NO: 1606372 - RNA, 20 nt, Homo sapiens
ccacuuuucugcuguugccu

SEQ ID NO: 1606373 - RNA, 16 nt, Homo sapiens
ccagaaauaaagggac

SEQ ID NO: 1606374 - RNA, 17 nt, Homo sapiens
ccagaaccaacugcauu

SEQ ID NO: 1606375 - RNA, 17 nt, Homo sapiens
ccagaacuuucuuucac

SEQ ID NO: 1606376 - RNA, 19 nt, Homo sapiens
ccagaagauccccucagga

SEQ ID NO: 1606377 - RNA, 14 nt, Homo sapiens
ccagaaguguuuca

SEQ ID NO: 1606378 - RNA, 18 nt, Homo sapiens
ccagaaugccuccugcag

SEQ ID NO: 1606379 - RNA, 22 nt, Homo sapiens
ccagaaugguacacaaugugau

SEQ ID NO: 1606380 - RNA, 18 nt, Homo sapiens
ccagacaccaugugcaau

SEQ ID NO: 1606381 - RNA, 13 nt, Homo sapiens
ccagacauggugu

SEQ ID NO: 1606382 - RNA, 18 nt, Homo sapiens
ccagacccacaaggccag

SEQ ID NO: 1606383 - RNA, 14 nt, Homo sapiens
ccagacuggcacag

SEQ ID NO: 1606384 - RNA, 18 nt, Homo sapiens
ccagacuuccuccuuucc

SEQ ID NO: 1606385 - RNA, 12 nt, Homo sapiens
ccagacuugaau

SEQ ID NO: 1606386 - RNA, 17 nt, Homo sapiens
ccagagagagcucugca

SEQ ID NO: 1606387 - RNA, 13 nt, Homo sapiens
ccagagaugacua

SEQ ID NO: 1606388 - RNA, 20 nt, Homo sapiens
ccagaggaagggacaccaag

SEQ ID NO: 1606389 - RNA, 18 nt, Homo sapiens
ccagaggcuggcauugag

SEQ ID NO: 1606390 - RNA, 17 nt, Homo sapiens
ccagaggguagggcaca

SEQ ID NO: 1606391 - RNA, 18 nt, Homo sapiens
ccagaggucuggcccuau

SEQ ID NO: 1606392 - RNA, 22 nt, Homo sapiens
ccagaggugucgggacaugguu

SEQ ID NO: 1606393 - RNA, 17 nt, Homo sapiens
ccagaucugucuccaag

SEQ ID NO: 1606394 - RNA, 23 nt, Homo sapiens
ccagauuggcucacacugagaau

SEQ ID NO: 1606395 - RNA, 20 nt, Homo sapiens
ccagcaaauaaagcagucau

SEQ ID NO: 1606396 - RNA, 21 nt, Homo sapiens
ccagcacagcuuagauuucau

SEQ ID NO: 1606397 - RNA, 16 nt, Homo sapiens
ccagcaccaacaccac

SEQ ID NO: 1606398 - RNA, 20 nt, Homo sapiens
ccagcacuuugggaguccaa

SEQ ID NO: 1606399 - RNA, 22 nt, Homo sapiens
ccagcagagccagggcagggcg

SEQ ID NO: 1606400 - RNA, 21 nt, Homo sapiens
ccagcagagggggaguagcca

SEQ ID NO: 1606401 - RNA, 19 nt, Homo sapiens
ccagcaucucccaguucau

SEQ ID NO: 1606402 - RNA, 12 nt, Homo sapiens
ccagcaucugga

SEQ ID NO: 1606403 - RNA, 22 nt, Homo sapiens
ccagcauuuaagugaccuucug

SEQ ID NO: 1606404 - RNA, 14 nt, Homo sapiens
ccagccaagcuuua

SEQ ID NO: 1606405 - RNA, 17 nt, Homo sapiens
ccagcccagacccagug

SEQ ID NO: 1606406 - RNA, 14 nt, Homo sapiens
ccagcccaggaguu

SEQ ID NO: 1606407 - RNA, 20 nt, Homo sapiens
ccagccccuccccagacucu

SEQ ID NO: 1606408 - RNA, 18 nt, Homo sapiens
ccagccccuccucccuca

SEQ ID NO: 1606409 - RNA, 20 nt, Homo sapiens
ccagccccugcagauucuga

SEQ ID NO: 1606410 - RNA, 21 nt, Homo sapiens
ccagcccuucaugggugguga

SEQ ID NO: 1606411 - RNA, 17 nt, Homo sapiens
ccagccuggacaccucu

SEQ ID NO: 1606412 - RNA, 17 nt, Homo sapiens
ccagccuggaugccauc

SEQ ID NO: 1606413 - RNA, 20 nt, Homo sapiens
ccagccugggcaacauacca

SEQ ID NO: 1606414 - RNA, 19 nt, Homo sapiens
ccagccuuauguguuacau

SEQ ID NO: 1606415 - RNA, 16 nt, Homo sapiens
ccagcggcucacaaag

SEQ ID NO: 1606416 - RNA, 15 nt, Homo sapiens
ccagcuauuuacaca

SEQ ID NO: 1606417 - RNA, 18 nt, Homo sapiens
ccagcucaaugcaauggc

SEQ ID NO: 1606418 - RNA, 20 nt, Homo sapiens
ccagcuccuuucaugcucca

SEQ ID NO: 1606419 - RNA, 18 nt, Homo sapiens
ccagcugcagaagggugg

SEQ ID NO: 1606420 - RNA, 23 nt, Homo sapiens
ccagcuucccgaguaccagugac

SEQ ID NO: 1606421 - RNA, 19 nt, Homo sapiens
ccagcuuguggagccccac

SEQ ID NO: 1606422 - RNA, 15 nt, Homo sapiens
ccaggaaagagcagu

SEQ ID NO: 1606423 - RNA, 18 nt, Homo sapiens
ccaggaaagagcagucag

SEQ ID NO: 1606424 - RNA, 21 nt, Homo sapiens
ccaggaacagcaaaugcaaaa

SEQ ID NO: 1606425 - RNA, 21 nt, Homo sapiens
ccaggaccugcagggccaaug

SEQ ID NO: 1606426 - RNA, 22 nt, Homo sapiens
ccaggagacagaccacuugcca

SEQ ID NO: 1606427 - RNA, 17 nt, Homo sapiens
ccaggagccucacuggg

SEQ ID NO: 1606428 - RNA, 16 nt, Homo sapiens
ccaggaggaacaaaga

SEQ ID NO: 1606429 - RNA, 22 nt, Homo sapiens
ccaggaggauugccuuuaauau

SEQ ID NO: 1606430 - RNA, 20 nt, Homo sapiens
ccaggauggucucgaucucu

SEQ ID NO: 1606431 - RNA, 13 nt, Homo sapiens
ccaggcauggugg

SEQ ID NO: 1606432 - RNA, 17 nt, Homo sapiens
ccaggccaacagcaccu

SEQ ID NO: 1606433 - RNA, 15 nt, Homo sapiens
ccaggccaaugucag

SEQ ID NO: 1606434 - RNA, 15 nt, Homo sapiens
ccaggccgacccaag

SEQ ID NO: 1606435 - RNA, 16 nt, Homo sapiens
ccaggccucuuggcag

SEQ ID NO: 1606436 - RNA, 13 nt, Homo sapiens
ccaggccugcauu

SEQ ID NO: 1606437 - RNA, 15 nt, Homo sapiens
ccaggcugggaacuc

SEQ ID NO: 1606438 - RNA, 15 nt, Homo sapiens
ccagggaaacagccu

SEQ ID NO: 1606439 - RNA, 20 nt, Homo sapiens
ccagggagcacccugcccac

SEQ ID NO: 1606440 - RNA, 23 nt, Homo sapiens
ccagggaggggucccugcaaaac

SEQ ID NO: 1606441 - RNA, 16 nt, Homo sapiens
ccagggaguccagggu

SEQ ID NO: 1606442 - RNA, 23 nt, Homo sapiens
ccagggaugggggaugggccagg

SEQ ID NO: 1606443 - RNA, 14 nt, Homo sapiens
ccagggcuccagga

SEQ ID NO: 1606444 - RNA, 15 nt, Homo sapiens
ccaggggagcaguaa

SEQ ID NO: 1606445 - RNA, 13 nt, Homo sapiens
ccagggguccagg

SEQ ID NO: 1606446 - RNA, 13 nt, Homo sapiens
ccaggggugcaca

SEQ ID NO: 1606447 - RNA, 22 nt, Homo sapiens
ccagggugacagagugagacca

SEQ ID NO: 1606448 - RNA, 15 nt, Homo sapiens
ccagguaagcccuuu

SEQ ID NO: 1606449 - RNA, 15 nt, Homo sapiens
ccaggugauucuguu

SEQ ID NO: 1606450 - RNA, 12 nt, Homo sapiens
ccaggugccuug

SEQ ID NO: 1606451 - RNA, 12 nt, Homo sapiens
ccagguggcacc

SEQ ID NO: 1606452 - RNA, 18 nt, Homo sapiens
ccaguauaagacuacuga

SEQ ID NO: 1606453 - RNA, 13 nt, Homo sapiens
ccaguauaaucuc

SEQ ID NO: 1606454 - RNA, 15 nt, Homo sapiens
ccaguaugacaguau

SEQ ID NO: 1606455 - RNA, 17 nt, Homo sapiens
ccaguauuuaagcuuua

SEQ ID NO: 1606456 - RNA, 19 nt, Homo sapiens
ccagucuuccugacacuuu

SEQ ID NO: 1606457 - RNA, 21 nt, Homo sapiens
ccagucuuccugacacuuuaa

SEQ ID NO: 1606458 - RNA, 14 nt, Homo sapiens
ccagugacaacauc

SEQ ID NO: 1606459 - RNA, 19 nt, Homo sapiens
ccagugagacagcucugca

SEQ ID NO: 1606460 - RNA, 23 nt, Homo sapiens
ccagugccucucccugcugcucc

SEQ ID NO: 1606461 - RNA, 16 nt, Homo sapiens
ccagugccugugagca

SEQ ID NO: 1606462 - RNA, 12 nt, Homo sapiens
ccagugccuuau

SEQ ID NO: 1606463 - RNA, 19 nt, Homo sapiens
ccagugcuuuauguuguug

SEQ ID NO: 1606464 - RNA, 14 nt, Homo sapiens
ccaguggaugccac

SEQ ID NO: 1606465 - RNA, 19 nt, Homo sapiens
ccaguggucagcagguguc

SEQ ID NO: 1606466 - RNA, 14 nt, Homo sapiens
ccaguuuuucacau

SEQ ID NO: 1606467 - RNA, 22 nt, Homo sapiens
ccauaaaaauaaaucaguucau

SEQ ID NO: 1606468 - RNA, 16 nt, Homo sapiens
ccauaauguugcuucu

SEQ ID NO: 1606469 - RNA, 21 nt, Homo sapiens
ccauaauugcuuugccaaaau

SEQ ID NO: 1606470 - RNA, 23 nt, Homo sapiens
ccauacuguuugcccauuuucau

SEQ ID NO: 1606471 - RNA, 16 nt, Homo sapiens
ccauagacacaguauu

SEQ ID NO: 1606472 - RNA, 22 nt, Homo sapiens
ccauagggucggaggugcuguc

SEQ ID NO: 1606473 - RNA, 14 nt, Homo sapiens
ccauaguauaauca

SEQ ID NO: 1606474 - RNA, 23 nt, Homo sapiens
ccauauaccaucuccagcuauuu

SEQ ID NO: 1606475 - RNA, 17 nt, Homo sapiens
ccauauguccacuguuc

SEQ ID NO: 1606476 - RNA, 20 nt, Homo sapiens
ccauauuuucaccauuugau

SEQ ID NO: 1606477 - RNA, 16 nt, Homo sapiens
ccaucacacauguuca

SEQ ID NO: 1606478 - RNA, 18 nt, Homo sapiens
ccaucacccaagccacaa

SEQ ID NO: 1606479 - RNA, 17 nt, Homo sapiens
ccaucagaaaaccaaag

SEQ ID NO: 1606480 - RNA, 23 nt, Homo sapiens
ccaucagugcucuguaaaacaca

SEQ ID NO: 1606481 - RNA, 15 nt, Homo sapiens
ccaucaucacuguaa

SEQ ID NO: 1606482 - RNA, 21 nt, Homo sapiens
ccauccagaugugugcaaugu

SEQ ID NO: 1606483 - RNA, 18 nt, Homo sapiens
ccaucccuaccacugugg

SEQ ID NO: 1606484 - RNA, 16 nt, Homo sapiens
ccauccugaccagcug

SEQ ID NO: 1606485 - RNA, 21 nt, Homo sapiens
ccauccuggccaacaugguga

SEQ ID NO: 1606486 - RNA, 22 nt, Homo sapiens
ccauccuugccaauagugucau

SEQ ID NO: 1606487 - RNA, 20 nt, Homo sapiens
cugcacagaaauuuucaauu

SEQ ID NO: 1606488 - RNA, 14 nt, Homo sapiens
cugcacagagcaag

SEQ ID NO: 1606489 - RNA, 23 nt, Homo sapiens
cugcacaucuguaaaucuacaca

SEQ ID NO: 1606490 - RNA, 16 nt, Homo sapiens
cugcacauggccugag

SEQ ID NO: 1606491 - RNA, 19 nt, Homo sapiens
cugcaccggggccugggca

SEQ ID NO: 1606492 - RNA, 17 nt, Homo sapiens
cugcacguugugcacau

SEQ ID NO: 1606493 - RNA, 18 nt, Homo sapiens
cugcacucccaccugaca

SEQ ID NO: 1606494 - RNA, 19 nt, Homo sapiens
cugcacucuccacugggac

SEQ ID NO: 1606495 - RNA, 16 nt, Homo sapiens
cugcagaccauccaga

SEQ ID NO: 1606496 - RNA, 14 nt, Homo sapiens
cugcagaccugguu

SEQ ID NO: 1606497 - RNA, 15 nt, Homo sapiens
cugcagacgucugcc

SEQ ID NO: 1606498 - RNA, 15 nt, Homo sapiens
cugcagccccccaga

SEQ ID NO: 1606499 - RNA, 15 nt, Homo sapiens
cugcaguaaaacaca

SEQ ID NO: 1606500 - RNA, 18 nt, Homo sapiens
cugcauaaccuuuacacu

SEQ ID NO: 1606501 - RNA, 17 nt, Homo sapiens
cugcauccagagauuca

SEQ ID NO: 1606502 - RNA, 18 nt, Homo sapiens
cugcaucuccccucagau

SEQ ID NO: 1606503 - RNA, 23 nt, Homo sapiens
cugcaucuccccucagauuccac

SEQ ID NO: 1606504 - RNA, 14 nt, Homo sapiens
cugcauguacugua

SEQ ID NO: 1606505 - RNA, 16 nt, Homo sapiens
cugcauuuacacacac

SEQ ID NO: 1606506 - RNA, 12 nt, Homo sapiens
cugcauuuacag

SEQ ID NO: 1606507 - RNA, 22 nt, Homo sapiens
cugcauuuauagcauacgguau

SEQ ID NO: 1606508 - RNA, 22 nt, Homo sapiens
cugcauuugccugcuucuuucc

SEQ ID NO: 1606509 - RNA, 18 nt, Homo sapiens
cugccacagccagaggag

SEQ ID NO: 1606510 - RNA, 17 nt, Homo sapiens
cugccacucugccccuu

SEQ ID NO: 1606511 - RNA, 16 nt, Homo sapiens
cugccagcauuucccu

SEQ ID NO: 1606512 - RNA, 16 nt, Homo sapiens
cugccagcucucagga

SEQ ID NO: 1606513 - RNA, 15 nt, Homo sapiens
cugccagcucucuga

SEQ ID NO: 1606514 - RNA, 20 nt, Homo sapiens
cugccagugccuuaccuccu

SEQ ID NO: 1606515 - RNA, 17 nt, Homo sapiens
cugccaucaugccugac

SEQ ID NO: 1606516 - RNA, 15 nt, Homo sapiens
cugccaugcuuugag

SEQ ID NO: 1606517 - RNA, 17 nt, Homo sapiens
cugccauugggacccuc

SEQ ID NO: 1606518 - RNA, 20 nt, Homo sapiens
cugcccaaaaugugaagcuu

SEQ ID NO: 1606519 - RNA, 18 nt, Homo sapiens
cugccccacaugcauguc

SEQ ID NO: 1606520 - RNA, 16 nt, Homo sapiens
cugcccccaauccaug

SEQ ID NO: 1606521 - RNA, 21 nt, Homo sapiens
cugcccccacuguccugugag

SEQ ID NO: 1606522 - RNA, 16 nt, Homo sapiens
cugccccuacccugga

SEQ ID NO: 1606523 - RNA, 18 nt, Homo sapiens
cugcccuuccugccugau

SEQ ID NO: 1606524 - RNA, 15 nt, Homo sapiens
cugcccuugcagggu

SEQ ID NO: 1606525 - RNA, 14 nt, Homo sapiens
cugcccuuguucca

SEQ ID NO: 1606526 - RNA, 15 nt, Homo sapiens
cugccgagaguccau

SEQ ID NO: 1606527 - RNA, 16 nt, Homo sapiens
cugccgcugcaccacg

SEQ ID NO: 1606528 - RNA, 17 nt, Homo sapiens
cugccggcucuaguacc

SEQ ID NO: 1606529 - RNA, 23 nt, Homo sapiens
cugccggcucuaguaccuuuuca

SEQ ID NO: 1606530 - RNA, 21 nt, Homo sapiens
cugccggucgggcagccagca

SEQ ID NO: 1606531 - RNA, 19 nt, Homo sapiens
cugccuaaauccacucugc

SEQ ID NO: 1606532 - RNA, 21 nt, Homo sapiens
cugccuaugcacugaagagcu

SEQ ID NO: 1606533 - RNA, 16 nt, Homo sapiens
cugccuaugucuccuc

SEQ ID NO: 1606534 - RNA, 16 nt, Homo sapiens
cugccucccuuucaua

SEQ ID NO: 1606535 - RNA, 21 nt, Homo sapiens
cugccucggccucccaaagug

SEQ ID NO: 1606536 - RNA, 18 nt, Homo sapiens
cugccucucuuucacaca

SEQ ID NO: 1606537 - RNA, 23 nt, Homo sapiens
cugccuggagucuuguguucacc

SEQ ID NO: 1606538 - RNA, 20 nt, Homo sapiens
cugccuggcccccaaccuca

SEQ ID NO: 1606539 - RNA, 15 nt, Homo sapiens
cugccuuacuguaca

SEQ ID NO: 1606540 - RNA, 19 nt, Homo sapiens
cugccuucacaaaugucau

SEQ ID NO: 1606541 - RNA, 18 nt, Homo sapiens
cugccuuuuuacuauaca

SEQ ID NO: 1606542 - RNA, 19 nt, Homo sapiens
cugcgacgcuugcucuguu

SEQ ID NO: 1606543 - RNA, 13 nt, Homo sapiens
cugcgcaccaucu

SEQ ID NO: 1606544 - RNA, 15 nt, Homo sapiens
cugcguuuuccuagc

SEQ ID NO: 1606545 - RNA, 22 nt, Homo sapiens
cugcuaaagggagaaaugccag

SEQ ID NO: 1606546 - RNA, 17 nt, Homo sapiens
cugcuaggcgcugggga

SEQ ID NO: 1606547 - RNA, 21 nt, Homo sapiens
cugcuaggggcuguugcauuu

SEQ ID NO: 1606548 - RNA, 16 nt, Homo sapiens
cugcuagucacuggaa

SEQ ID NO: 1606549 - RNA, 14 nt, Homo sapiens
cugcuccaccagca

SEQ ID NO: 1606550 - RNA, 22 nt, Homo sapiens
cugcuccaccagcagcauggca

SEQ ID NO: 1606551 - RNA, 13 nt, Homo sapiens
cugcuccacccuu

SEQ ID NO: 1606552 - RNA, 13 nt, Homo sapiens
cugcucccauucc

SEQ ID NO: 1606553 - RNA, 22 nt, Homo sapiens
cugcuccuccccuuucacaggu

SEQ ID NO: 1606554 - RNA, 22 nt, Homo sapiens
cugcuccuguucacaccagaga

SEQ ID NO: 1606555 - RNA, 16 nt, Homo sapiens
cugcuccuucuuguuc

SEQ ID NO: 1606556 - RNA, 15 nt, Homo sapiens
cugcucugaccuucc
